United States Patent 7,374,927 (METHODS OF ANALYSIS OF DEGRADED NUCLEIC ACID SAMPLES) - sequence listing, part 5

SEQ ID NO: 160011 - DNA, 25 bp, Homo sapien
atttgttgtgatgtcttttcttggc

SEQ ID NO: 160012 - DNA, 25 bp, Homo sapien
aagattttcagtctagttgccaaat

SEQ ID NO: 160013 - DNA, 25 bp, Homo sapien
tttcagtctagttgccaaatctggc

SEQ ID NO: 160014 - DNA, 25 bp, Homo sapien
ccaaatctggctcctttacaaaaga

SEQ ID NO: 160015 - DNA, 25 bp, Homo sapien
aggtacccaaccctctgggatagat

SEQ ID NO: 160016 - DNA, 25 bp, Homo sapien
ggtacccaaccctctgggatagatg

SEQ ID NO: 160017 - DNA, 25 bp, Homo sapien
gtacccaaccctctgggatagatgc

SEQ ID NO: 160018 - DNA, 25 bp, Homo sapien
tacccaaccctctgggatagatgca

SEQ ID NO: 160019 - DNA, 25 bp, Homo sapien
ccaaccctctgggatagatgcagga

SEQ ID NO: 160020 - DNA, 25 bp, Homo sapien
caaccctctgggatagatgcaggaa

SEQ ID NO: 160021 - DNA, 25 bp, Homo sapien
ccctctgggatagatgcaggaagcg

SEQ ID NO: 160022 - DNA, 25 bp, Homo sapien
atagatgcaggaagcgatggttaag

SEQ ID NO: 160023 - DNA, 25 bp, Homo sapien
tgcaggaagcgatggttaagaccca

SEQ ID NO: 160024 - DNA, 25 bp, Homo sapien
aggaagcgatggttaagacccattt

SEQ ID NO: 160025 - DNA, 25 bp, Homo sapien
tttcacccaacttctcgccgcaggt

SEQ ID NO: 160026 - DNA, 25 bp, Homo sapien
tacatttgattaactgtgttgccta

SEQ ID NO: 160027 - DNA, 25 bp, Homo sapien
aactgtgttgcctatttatgcaggg

SEQ ID NO: 160028 - DNA, 25 bp, Homo sapien
ttatgcagggtaatccagctaaagg

SEQ ID NO: 160029 - DNA, 25 bp, Homo sapien
agagaatgctatcatcctgcttgcc

SEQ ID NO: 160030 - DNA, 25 bp, Homo sapien
tgcttgcctgtccatttgtggaaca

SEQ ID NO: 160031 - DNA, 25 bp, Homo sapien
gtccatttgtggaacagcatctggt

SEQ ID NO: 160032 - DNA, 25 bp, Homo sapien
ggtgatatgcaattccacactggta

SEQ ID NO: 160033 - DNA, 25 bp, Homo sapien
gcaattccacactggtaacctgcag

SEQ ID NO: 160034 - DNA, 25 bp, Homo sapien
taacctgcagcagttgggtcctaat

SEQ ID NO: 160035 - DNA, 25 bp, Homo sapien
cagttgggtcctaatgatggcatta

SEQ ID NO: 160036 - DNA, 25 bp, Homo sapien
attagactttcataatgtcctgtat

SEQ ID NO: 160037 - DNA, 25 bp, Homo sapien
cccaagtataggctctgcccagatg

SEQ ID NO: 160038 - DNA, 25 bp, Homo sapien
agatgccatcacatccctgatactg

SEQ ID NO: 160039 - DNA, 25 bp, Homo sapien
cacatccctgatactgtgtatgctt

SEQ ID NO: 160040 - DNA, 25 bp, Homo sapien
tgctttgaagcaccttccctgagaa

SEQ ID NO: 160041 - DNA, 25 bp, Homo sapien
gggatctttggactacgttcttggc

SEQ ID NO: 160042 - DNA, 25 bp, Homo sapien
ttggactacgttcttggctccagac

SEQ ID NO: 160043 - DNA, 25 bp, Homo sapien
gacctggaatccacaaaagccaaac

SEQ ID NO: 160044 - DNA, 25 bp, Homo sapien
gccaaaccagctcatttcaacaaag

SEQ ID NO: 160045 - DNA, 25 bp, Homo sapien
ttcaacaaaggagctccgatgtgag

SEQ ID NO: 160046 - DNA, 25 bp, Homo sapien
gaaagcatctgcatgtgaacaccat

SEQ ID NO: 160047 - DNA, 25 bp, Homo sapien
gtgaacaccatcatgcctttataaa

SEQ ID NO: 160048 - DNA, 25 bp, Homo sapien
gtgtccccagagacatgcaagtcat

SEQ ID NO: 160049 - DNA, 25 bp, Homo sapien
catgcaagtcatgggtcacacctga

SEQ ID NO: 160050 - DNA, 25 bp, Homo sapien
gcaagtcatgggtcacacctgacaa

SEQ ID NO: 160051 - DNA, 25 bp, Homo sapien
catgggtcacacctgacaaatggaa

SEQ ID NO: 160052 - DNA, 25 bp, Homo sapien
gacaaatggaaggagttcctctaac

SEQ ID NO: 160053 - DNA, 25 bp, Homo sapien
gaaggagttcctctaacatttgcaa

SEQ ID NO: 160054 - DNA, 25 bp, Homo sapien
gagttcctctaacatttgcaaaatg

SEQ ID NO: 160055 - DNA, 25 bp, Homo sapien
taatgaatgtcatgcaccgctgcag

SEQ ID NO: 160056 - DNA, 25 bp, Homo sapien
cgctgcagccagcagttgtaaaatt

SEQ ID NO: 160057 - DNA, 25 bp, Homo sapien
attcataactggtagctataacttg

SEQ ID NO: 160058 - DNA, 25 bp, Homo sapien
tagctataacttgagcttattcagg

SEQ ID NO: 160059 - DNA, 25 bp, Homo sapien
aacagaagagtactttccaactatg

SEQ ID NO: 160060 - DNA, 25 bp, Homo sapien
gtactttccaactatgaaaggccat

SEQ ID NO: 160061 - DNA, 25 bp, Homo sapien
tgaaaggccatagaaacgttttaat

SEQ ID NO: 160062 - DNA, 25 bp, Homo sapien
actgaaaatccaactccaggagcta

SEQ ID NO: 160063 - DNA, 25 bp, Homo sapien
ccaactccaggagctatggcagtgt

SEQ ID NO: 160064 - DNA, 25 bp, Homo sapien
actccaggagctatggcagtgttaa

SEQ ID NO: 160065 - DNA, 25 bp, Homo sapien
ggagctatggcagtgttaatgaaca

SEQ ID NO: 160066 - DNA, 25 bp, Homo sapien
gaacatatatcatcaggtcttaaaa

SEQ ID NO: 160067 - DNA, 25 bp, Homo sapien
actgaaaagacaactggctacaaag

SEQ ID NO: 160068 - DNA, 25 bp, Homo sapien
caactggctacaaagaaggatgtca

SEQ ID NO: 160069 - DNA, 25 bp, Homo sapien
ggatgtcagaatgtaaggaaactat

SEQ ID NO: 160070 - DNA, 25 bp, Homo sapien
tgcacgcctttgctggcagcgcagc

SEQ ID NO: 160071 - DNA, 25 bp, Homo sapien
agggcctccatgtcaccgcactgta

SEQ ID NO: 160072 - DNA, 25 bp, Homo sapien
atgtcaccgcactgtagaggccggt

SEQ ID NO: 160073 - DNA, 25 bp, Homo sapien
tgtagaggccggtcttggtgtccca

SEQ ID NO: 160074 - DNA, 25 bp, Homo sapien
cggtcttggtgtcccatccctgtca

SEQ ID NO: 160075 - DNA, 25 bp, Homo sapien
tctgcttcccaagatgccatggctg

SEQ ID NO: 160076 - DNA, 25 bp, Homo sapien
aagatgccatggctggactggaccc

SEQ ID NO: 160077 - DNA, 25 bp, Homo sapien
acatgaccatgcctcagactgtcac

SEQ ID NO: 160078 - DNA, 25 bp, Homo sapien
atgtgtaccccgctcaccacgggaa

SEQ ID NO: 160079 - DNA, 25 bp, Homo sapien
aaccacaggcatcaggcaaccattt

SEQ ID NO: 160080 - DNA, 25 bp, Homo sapien
acaggcatcaggcaaccatttgaaa

SEQ ID NO: 160081 - DNA, 25 bp, Homo sapien
tgaaaatgccttccgggccccgtga

SEQ ID NO: 160082 - DNA, 25 bp, Homo sapien
cgtgacccctgactgggatgccctg

SEQ ID NO: 160083 - DNA, 25 bp, Homo sapien
tggccctgctacttgagggagctga

SEQ ID NO: 160084 - DNA, 25 bp, Homo sapien
gagctgacttagctcccggccctaa

SEQ ID NO: 160085 - DNA, 25 bp, Homo sapien
gagacatcactaactgatggctcct

SEQ ID NO: 160086 - DNA, 25 bp, Homo sapien
taactgatggctcctccgtagtgct

SEQ ID NO: 160087 - DNA, 25 bp, Homo sapien
ctccgtagtgctcccaatcctatgg

SEQ ID NO: 160088 - DNA, 25 bp, Homo sapien
ctatggccatgactgctgaacctga

SEQ ID NO: 160089 - DNA, 25 bp, Homo sapien
atgactgctgaacctgacaggcgtg

SEQ ID NO: 160090 - DNA, 25 bp, Homo sapien
gggagttcactgtgacctagtcccc

SEQ ID NO: 160091 - DNA, 25 bp, Homo sapien
gccacggctgttgcttcggttattt

SEQ ID NO: 160092 - DNA, 25 bp, Homo sapien
gcattttccacccttaaccctgtgt

SEQ ID NO: 160093 - DNA, 25 bp, Homo sapien
cccttaaccctgtgttcaggcactt

SEQ ID NO: 160094 - DNA, 25 bp, Homo sapien
ctgcccaccccatttatgaattgag

SEQ ID NO: 160095 - DNA, 25 bp, Homo sapien
atgaattgagccaggtttggtccgt

SEQ ID NO: 160096 - DNA, 25 bp, Homo sapien
aattgagccaggtttggtccgtggt

SEQ ID NO: 160097 - DNA, 25 bp, Homo sapien
gacaggcaatcaggagggcccagta

SEQ ID NO: 160098 - DNA, 25 bp, Homo sapien
taaaggctgagatgaagtggactga

SEQ ID NO: 160099 - DNA, 25 bp, Homo sapien
atgaagtggactgagtagaactgga

SEQ ID NO: 160100 - DNA, 25 bp, Homo sapien
ggacaagagttgacgtgagttcctg

SEQ ID NO: 160101 - DNA, 25 bp, Homo sapien
acgtgagttcctgggagtttccaga

SEQ ID NO: 160102 - DNA, 25 bp, Homo sapien
gagttcctgggagtttccagagatg

SEQ ID NO: 160103 - DNA, 25 bp, Homo sapien
gaatgcaacatatatctgtcagagg

SEQ ID NO: 160104 - DNA, 25 bp, Homo sapien
gtgaaaagggtgtcccactcgcaca

SEQ ID NO: 160105 - DNA, 25 bp, Homo sapien
accttaaagcaaaagtgccttgaga

SEQ ID NO: 160106 - DNA, 25 bp, Homo sapien
gtgccttgagaatatctgcaagtct

SEQ ID NO: 160107 - DNA, 25 bp, Homo sapien
aatatctgcaagtctgtgtgaggcc

SEQ ID NO: 160108 - DNA, 25 bp, Homo sapien
ggccttgaaaataacactagggcat

SEQ ID NO: 160109 - DNA, 25 bp, Homo sapien
ctagggcataacaattacttcaggg

SEQ ID NO: 160110 - DNA, 25 bp, Homo sapien
tggctcttgtcccaagtgggctaca

SEQ ID NO: 160111 - DNA, 25 bp, Homo sapien
gaagaattcacccaggctccagcta

SEQ ID NO: 160112 - DNA, 25 bp, Homo sapien
caggctccagctagatcatcagtta

SEQ ID NO: 160113 - DNA, 25 bp, Homo sapien
cctctcctgtgaatctgtgcaaaac

SEQ ID NO: 160114 - DNA, 25 bp, Homo sapien
gagtaactgcagcttggtttgaaat

SEQ ID NO: 160115 - DNA, 25 bp, Homo sapien
agtaactgcagcttggtttgaaatt

SEQ ID NO: 160116 - DNA, 25 bp, Homo sapien
gtaactgcagcttggtttgaaattt

SEQ ID NO: 160117 - DNA, 25 bp, Homo sapien
taactgcagcttggtttgaaatttg

SEQ ID NO: 160118 - DNA, 25 bp, Homo sapien
actgcagcttggtttgaaatttgta

SEQ ID NO: 160119 - DNA, 25 bp, Homo sapien
ctgcagcttggtttgaaatttgtac

SEQ ID NO: 160120 - DNA, 25 bp, Homo sapien
tgcagcttggtttgaaatttgtact

SEQ ID NO: 160121 - DNA, 25 bp, Homo sapien
gcttggtttgaaatttgtactgttt

SEQ ID NO: 160122 - DNA, 25 bp, Homo sapien
gtttgaaatttgtactgtttctatc

SEQ ID NO: 160123 - DNA, 25 bp, Homo sapien
aaatttgtactgtttctatcataaa

SEQ ID NO: 160124 - DNA, 25 bp, Homo sapien
tgtactgtttctatcataaataaag

SEQ ID NO: 160125 - DNA, 25 bp, Homo sapien
gggtcatgaccttcctagtttcctg

SEQ ID NO: 160126 - DNA, 25 bp, Homo sapien
tcatgaccttcctagtttcctgacg

SEQ ID NO: 160127 - DNA, 25 bp, Homo sapien
tgaccttcctagtttcctgacgcag

SEQ ID NO: 160128 - DNA, 25 bp, Homo sapien
cttcctagtttcctgacgcagggaa

SEQ ID NO: 160129 - DNA, 25 bp, Homo sapien
cctagtttcctgacgcagggaatac

SEQ ID NO: 160130 - DNA, 25 bp, Homo sapien
gtttcctgacgcagggaatacaggg

SEQ ID NO: 160131 - DNA, 25 bp, Homo sapien
cttccccccagcaaatgcaataatg

SEQ ID NO: 160132 - DNA, 25 bp, Homo sapien
agcaaatgcaataatgccctcaccc

SEQ ID NO: 160133 - DNA, 25 bp, Homo sapien
tgtggagcctgttacctccgcattt

SEQ ID NO: 160134 - DNA, 25 bp, Homo sapien
tggagcctgttacctccgcatttga

SEQ ID NO: 160135 - DNA, 25 bp, Homo sapien
tgttacctccgcatttgacacgagt

SEQ ID NO: 160136 - DNA, 25 bp, Homo sapien
ggtttctcttaatatagttctccag

SEQ ID NO: 160137 - DNA, 25 bp, Homo sapien
cactgaccttgaattgacttacata

SEQ ID NO: 160138 - DNA, 25 bp, Homo sapien
tgacttacataaactactgccaatg

SEQ ID NO: 160139 - DNA, 25 bp, Homo sapien
gccaatgtttaaattgcccttatgt

SEQ ID NO: 160140 - DNA, 25 bp, Homo sapien
taaattgcccttatgtttatgttta

SEQ ID NO: 160141 - DNA, 25 bp, Homo sapien
gtttattatgtcaagccaattcgta

SEQ ID NO: 160142 - DNA, 25 bp, Homo sapien
gtcaagccaattcgtacatacaatt

SEQ ID NO: 160143 - DNA, 25 bp, Homo sapien
aaaatgcctctccagccttaagtat

SEQ ID NO: 160144 - DNA, 25 bp, Homo sapien
gcctctccagccttaagtatttaca

SEQ ID NO: 160145 - DNA, 25 bp, Homo sapien
tatttacatgctcccaggtcattgt

SEQ ID NO: 160146 - DNA, 25 bp, Homo sapien
tgctcccaggtcattgtcagtttat

SEQ ID NO: 160147 - DNA, 25 bp, Homo sapien
tatggatatatacccatgtctactg

SEQ ID NO: 160148 - DNA, 25 bp, Homo sapien
tacccatgtctactgttttgcttca

SEQ ID NO: 160149 - DNA, 25 bp, Homo sapien
gtgcttacaatttcattcaagtcct

SEQ ID NO: 160150 - DNA, 25 bp, Homo sapien
tcaagtcctgagtatgtgtcctgct

SEQ ID NO: 160151 - DNA, 25 bp, Homo sapien
gtatgtgtcctgctgttactccttc

SEQ ID NO: 160152 - DNA, 25 bp, Homo sapien
ttactccttctttggtagttgaaag

SEQ ID NO: 160153 - DNA, 25 bp, Homo sapien
gttgaattcaagtctttccttctgt

SEQ ID NO: 160154 - DNA, 25 bp, Homo sapien
gaatggcgcatgctagtgtttgaat

SEQ ID NO: 160155 - DNA, 25 bp, Homo sapien
gaatatgctctcttgttgctctaat

SEQ ID NO: 160156 - DNA, 25 bp, Homo sapien
tcttgttgctctaattctgtgcctc

SEQ ID NO: 160157 - DNA, 25 bp, Homo sapien
ttctgtgcctccgtgcattaatatt

SEQ ID NO: 160158 - DNA, 25 bp, Homo sapien
tgttaaaactctaatccatggatgt

SEQ ID NO: 160159 - DNA, 25 bp, Homo sapien
aataaaccaggcctctggctaccac

SEQ ID NO: 160160 - DNA, 25 bp, Homo sapien
tggctaccacttggacctttattgc

SEQ ID NO: 160161 - DNA, 25 bp, Homo sapien
tgttcctctttcatcacaagctcat

SEQ ID NO: 160162 - DNA, 25 bp, Homo sapien
agctcatctatattccaggacttca

SEQ ID NO: 160163 - DNA, 25 bp, Homo sapien
attccaggacttcacatttgttatt

SEQ ID NO: 160164 - DNA, 25 bp, Homo sapien
ttgttatttcttctgtctactctgt

SEQ ID NO: 160165 - DNA, 25 bp, Homo sapien
actctgtctctcaagacaatagagg

SEQ ID NO: 160166 - DNA, 25 bp, Homo sapien
aatagaggtcacagcaaatacaaac

SEQ ID NO: 160167 - DNA, 25 bp, Homo sapien
taagttttcttcttggaccctccat

SEQ ID NO: 160168 - DNA, 25 bp, Homo sapien
ggaccctccatagcaaccaagagat

SEQ ID NO: 160169 - DNA, 25 bp, Homo sapien
gtctggttgactcaaaccctgcccc

SEQ ID NO: 160170 - DNA, 25 bp, Homo sapien
gagaagaagccgctgaagccctgct

SEQ ID NO: 160171 - DNA, 25 bp, Homo sapien
aagaagccgctgaagccctgctgcg

SEQ ID NO: 160172 - DNA, 25 bp, Homo sapien
agaaggcgcgcgatgcgtgtatcat

SEQ ID NO: 160173 - DNA, 25 bp, Homo sapien
gcgcgcgatgcgtgtatcatcgaga

SEQ ID NO: 160174 - DNA, 25 bp, Homo sapien
tgcgtgtatcatcgagaaaggagaa

SEQ ID NO: 160175 - DNA, 25 bp, Homo sapien
cactgtggacatctaattgaggccc

SEQ ID NO: 160176 - DNA, 25 bp, Homo sapien
ggacatctaattgaggcccacaagg

SEQ ID NO: 160177 - DNA, 25 bp, Homo sapien
aggaatgcatgagagccctaggatt

SEQ ID NO: 160178 - DNA, 25 bp, Homo sapien
gcatgagagccctaggatttaaaat

SEQ ID NO: 160179 - DNA, 25 bp, Homo sapien
aatatgaaatggtggtctgctgtgt

SEQ ID NO: 160180 - DNA, 25 bp, Homo sapien
gatgacagaatttatttggttgcct

SEQ ID NO: 160181 - DNA, 25 bp, Homo sapien
tttggttgccttgtgtgttaattga

SEQ ID NO: 160182 - DNA, 25 bp, Homo sapien
gttgccttgtgtgttaattgaatgc

SEQ ID NO: 160183 - DNA, 25 bp, Homo sapien
aattgaatgcatacctaattgtaaa

SEQ ID NO: 160184 - DNA, 25 bp, Homo sapien
gaaatttatcctagcaagactttac

SEQ ID NO: 160185 - DNA, 25 bp, Homo sapien
atcctagcaagactttacaagatag

SEQ ID NO: 160186 - DNA, 25 bp, Homo sapien
attctaatggaattgagccggtttc

SEQ ID NO: 160187 - DNA, 25 bp, Homo sapien
gaattgagccggtttcttatcctaa

SEQ ID NO: 160188 - DNA, 25 bp, Homo sapien
gagccggtttcttatcctaaatgtt

SEQ ID NO: 160189 - DNA, 25 bp, Homo sapien
tccagcacctcttggttaaataatg

SEQ ID NO: 160190 - DNA, 25 bp, Homo sapien
aataatgtatgctgtgagacatgaa

SEQ ID NO: 160191 - DNA, 25 bp, Homo sapien
gatcttttgattcctcttgggctga

SEQ ID NO: 160192 - DNA, 25 bp, Homo sapien
cctcttgggctgaagcagaccaagt

SEQ ID NO: 160193 - DNA, 25 bp, Homo sapien
atgctgccaacttctaaccgcaata

SEQ ID NO: 160194 - DNA, 25 bp, Homo sapien
ctgccaacttctaaccgcaatagtg

SEQ ID NO: 160195 - DNA, 25 bp, Homo sapien
acttctaaccgcaatagtgactctg

SEQ ID NO: 160196 - DNA, 25 bp, Homo sapien
ttctaaccgcaatagtgactctgtg

SEQ ID NO: 160197 - DNA, 25 bp, Homo sapien
aaccgcaatagtgactctgtgcttg

SEQ ID NO: 160198 - DNA, 25 bp, Homo sapien
gcaatagtgactctgtgcttgtctg

SEQ ID NO: 160199 - DNA, 25 bp, Homo sapien
atagtgactctgtgcttgtctgttt

SEQ ID NO: 160200 - DNA, 25 bp, Homo sapien
gtgactctgtgcttgtctgtttagt

SEQ ID NO: 160201 - DNA, 25 bp, Homo sapien
tggaatgttgtggagatgacccctc

SEQ ID NO: 160202 - DNA, 25 bp, Homo sapien
ctgctattgttgctacatgtatcga

SEQ ID NO: 160203 - DNA, 25 bp, Homo sapien
atgtatcgagccttgattgctccta

SEQ ID NO: 160204 - DNA, 25 bp, Homo sapien
gccttgattgctcctagttatatac

SEQ ID NO: 160205 - DNA, 25 bp, Homo sapien
atacagggtctatcttgcttcctac

SEQ ID NO: 160206 - DNA, 25 bp, Homo sapien
ttcctacctacatctgcttgagcag

SEQ ID NO: 160207 - DNA, 25 bp, Homo sapien
tacatctgcttgagcagtgcctcaa

SEQ ID NO: 160208 - DNA, 25 bp, Homo sapien
agtgcctcaagtacatccttattag

SEQ ID NO: 160209 - DNA, 25 bp, Homo sapien
agtctttcactaaggttctcttgca

SEQ ID NO: 160210 - DNA, 25 bp, Homo sapien
gtgaatgttggatctcagactaacc

SEQ ID NO: 160211 - DNA, 25 bp, Homo sapien
cacatttctgtgagtgctgacttgt

SEQ ID NO: 160212 - DNA, 25 bp, Homo sapien
gagtgctgacttgtctttgcaatat

SEQ ID NO: 160213 - DNA, 25 bp, Homo sapien
gctcaggtggatctaaaactcaaga

SEQ ID NO: 160214 - DNA, 25 bp, Homo sapien
caggtggatctaaaactcaagaaca

SEQ ID NO: 160215 - DNA, 25 bp, Homo sapien
gtggatctaaaactcaagaacaaat

SEQ ID NO: 160216 - DNA, 25 bp, Homo sapien
gaaaagcaactcaaaacaacttcaa

SEQ ID NO: 160217 - DNA, 25 bp, Homo sapien
ataaaaagtgcatctgttttgtttt

SEQ ID NO: 160218 - DNA, 25 bp, Homo sapien
aatgaatctgattgttgtcaacaca

SEQ ID NO: 160219 - DNA, 25 bp, Homo sapien
gattgttgtcaacacatttgtgaag

SEQ ID NO: 160220 - DNA, 25 bp, Homo sapien
gttgtcaacacatttgtgaagtctt

SEQ ID NO: 160221 - DNA, 25 bp, Homo sapien
aacacatttgtgaagtcttgtgcta

SEQ ID NO: 160222 - DNA, 25 bp, Homo sapien
acatttgtgaagtcttgtgctataa

SEQ ID NO: 160223 - DNA, 25 bp, Homo sapien
ttgtgaagtcttgtgctataaaggg

SEQ ID NO: 160224 - DNA, 25 bp, Homo sapien
ccatcgtgctggtagaagagtcttt

SEQ ID NO: 160225 - DNA, 25 bp, Homo sapien
agaagagtctttgctgttgctcccg

SEQ ID NO: 160226 - DNA, 25 bp, Homo sapien
tttgctgttgctcccgaaagccgtg

SEQ ID NO: 160227 - DNA, 25 bp, Homo sapien
ctcttggttccaggctcttgaaata

SEQ ID NO: 160228 - DNA, 25 bp, Homo sapien
agccttttcttcctatctctgtggc

SEQ ID NO: 160229 - DNA, 25 bp, Homo sapien
atctctgtggctttcagctctgctt

SEQ ID NO: 160230 - DNA, 25 bp, Homo sapien
gagaatagatgggtgatgtctttcc

SEQ ID NO: 160231 - DNA, 25 bp, Homo sapien
gatgtctttccttatgttgcttttt

SEQ ID NO: 160232 - DNA, 25 bp, Homo sapien
aatccagtggtgtgtgtgaatgcag

SEQ ID NO: 160233 - DNA, 25 bp, Homo sapien
tgcagaagggaatgcaccccacatt

SEQ ID NO: 160234 - DNA, 25 bp, Homo sapien
accccacattcccatgatggaagtc

SEQ ID NO: 160235 - DNA, 25 bp, Homo sapien
acatctgtcccaacccagctggagg

SEQ ID NO: 160236 - DNA, 25 bp, Homo sapien
tggaggcctggtctctccttacaac

SEQ ID NO: 160237 - DNA, 25 bp, Homo sapien
cttggatcttgagggtctggcacat

SEQ ID NO: 160238 - DNA, 25 bp, Homo sapien
ttgagggtctggcacatccttaatc

SEQ ID NO: 160239 - DNA, 25 bp, Homo sapien
ggtctggcacatccttaatcctgtg

SEQ ID NO: 160240 - DNA, 25 bp, Homo sapien
tgtgcccctgcctgggacagaaatg

SEQ ID NO: 160241 - DNA, 25 bp, Homo sapien
agaaatgtggctccagttgctctgt

SEQ ID NO: 160242 - DNA, 25 bp, Homo sapien
cagttgctctgtctctcgtggtcac

SEQ ID NO: 160243 - DNA, 25 bp, Homo sapien
gtctctcgtggtcaccctgagggca

SEQ ID NO: 160244 - DNA, 25 bp, Homo sapien
actctgcatcctctgtcattttaac

SEQ ID NO: 160245 - DNA, 25 bp, Homo sapien
ggaggagaggccctttgccaggagc

SEQ ID NO: 160246 - DNA, 25 bp, Homo sapien
taaaggtagatttcttcctggtact

SEQ ID NO: 160247 - DNA, 25 bp, Homo sapien
gtagatttcttcctggtacttttat

SEQ ID NO: 160248 - DNA, 25 bp, Homo sapien
ttcttcctggtacttttatctgtct

SEQ ID NO: 160249 - DNA, 25 bp, Homo sapien
tcctggtacttttatctgtctttga

SEQ ID NO: 160250 - DNA, 25 bp, Homo sapien
tctgtctttgaaagtgtctgaactt

SEQ ID NO: 160251 - DNA, 25 bp, Homo sapien
ttgtttcaaatattgcttgttctat

SEQ ID NO: 160252 - DNA, 25 bp, Homo sapien
tgcttgttctatttctaacattcca

SEQ ID NO: 160253 - DNA, 25 bp, Homo sapien
tataataacgcttgaatatctgaat

SEQ ID NO: 160254 - DNA, 25 bp, Homo sapien
gaaaaatgcacttgaaatacactgg

SEQ ID NO: 160255 - DNA, 25 bp, Homo sapien
tgcacttgaaatacactggataatt

SEQ ID NO: 160256 - DNA, 25 bp, Homo sapien
ctggataattacttttgtgatttag

SEQ ID NO: 160257 - DNA, 25 bp, Homo sapien
acgcctggctggatcctatatctta

SEQ ID NO: 160258 - DNA, 25 bp, Homo sapien
gacatataacgcagtctaattacat

SEQ ID NO: 160259 - DNA, 25 bp, Homo sapien
taattacatttcacttcaaggctca

SEQ ID NO: 160260 - DNA, 25 bp, Homo sapien
caaggctcaatgctattctaactaa

SEQ ID NO: 160261 - DNA, 25 bp, Homo sapien
gacaagtattttctactaaaccaga

SEQ ID NO: 160262 - DNA, 25 bp, Homo sapien
gtaaaagctactatgtactgcctta

SEQ ID NO: 160263 - DNA, 25 bp, Homo sapien
ctatgtactgccttagtgctgatgc

SEQ ID NO: 160264 - DNA, 25 bp, Homo sapien
gatgcctgtgtactgccttaaatgt

SEQ ID NO: 160265 - DNA, 25 bp, Homo sapien
gccttaaatgtacctatggcaattt

SEQ ID NO: 160266 - DNA, 25 bp, Homo sapien
atggcaatttagctctcttgggttc

SEQ ID NO: 160267 - DNA, 25 bp, Homo sapien
cccaaatccctctcacaagaatgtg

SEQ ID NO: 160268 - DNA, 25 bp, Homo sapien
caccaaggcccagaggaagttaagg

SEQ ID NO: 160269 - DNA, 25 bp, Homo sapien
gtcctggttgggatcacacccacgg

SEQ ID NO: 160270 - DNA, 25 bp, Homo sapien
gttgggatcacacccacgggtgcta

SEQ ID NO: 160271 - DNA, 25 bp, Homo sapien
acgggtgctactgcacgtaacactc

SEQ ID NO: 160272 - DNA, 25 bp, Homo sapien
gtaacactcctccttaggcctggag

SEQ ID NO: 160273 - DNA, 25 bp, Homo sapien
caaggtgtgggtccccacgcctgat

SEQ ID NO: 160274 - DNA, 25 bp, Homo sapien
ggtccccacgcctgatctttgaaaa

SEQ ID NO: 160275 - DNA, 25 bp, Homo sapien
ttgaaaacactacacagggctgctg

SEQ ID NO: 160276 - DNA, 25 bp, Homo sapien
aaacactacacagggctgctgtcac

SEQ ID NO: 160277 - DNA, 25 bp, Homo sapien
ccaggcctcgggaccaactctttgt

SEQ ID NO: 160278 - DNA, 25 bp, Homo sapien
aactctttgtataacctacctgaat

SEQ ID NO: 160279 - DNA, 25 bp, Homo sapien
aaacgggctcgggtctgggcagcac

SEQ ID NO: 160280 - DNA, 25 bp, Homo sapien
gcagcacctctggtcaggagggtca

SEQ ID NO: 160281 - DNA, 25 bp, Homo sapien
agcacctctggtcaggagggtcacc

SEQ ID NO: 160282 - DNA, 25 bp, Homo sapien
acctctggtcaggagggtcaccctg

SEQ ID NO: 160283 - DNA, 25 bp, Homo sapien
ggcttcacagccacacctggactga

SEQ ID NO: 160284 - DNA, 25 bp, Homo sapien
ggactgaccctgcaggttgttcata

SEQ ID NO: 160285 - DNA, 25 bp, Homo sapien
cccgctccacagagatacacagata

SEQ ID NO: 160286 - DNA, 25 bp, Homo sapien
cgctccacagagatacacagatata

SEQ ID NO: 160287 - DNA, 25 bp, Homo sapien
atacacacagtggatggacggacaa

SEQ ID NO: 160288 - DNA, 25 bp, Homo sapien
cacacagtggatggacggacaagac

SEQ ID NO: 160289 - DNA, 25 bp, Homo sapien
cacagtggatggacggacaagacag

SEQ ID NO: 160290 - DNA, 25 bp, Homo sapien
gggagtagggttccagctctgggac

SEQ ID NO: 160291 - DNA, 25 bp, Homo sapien
cagctctgggacattgtgctcagga

SEQ ID NO: 160292 - DNA, 25 bp, Homo sapien
tgggacattgtgctcaggaatttga

SEQ ID NO: 160293 - DNA, 25 bp, Homo sapien
aggaatttgaaaacgctgctatact

SEQ ID NO: 160294 - DNA, 25 bp, Homo sapien
gaaaacgctgctatacttactctgg

SEQ ID NO: 160295 - DNA, 25 bp, Homo sapien
acgctgctatacttactctggttac

SEQ ID NO: 160296 - DNA, 25 bp, Homo sapien
actctggttactacatttcttccac

SEQ ID NO: 160297 - DNA, 25 bp, Homo sapien
ctacctgccttaaccaaggctcata

SEQ ID NO: 160298 - DNA, 25 bp, Homo sapien
ttaaccaaggctcatactgtcctgt

SEQ ID NO: 160299 - DNA, 25 bp, Homo sapien
aaggctcatactgtcctgtccttac

SEQ ID NO: 160300 - DNA, 25 bp, Homo sapien
aagctcagtgaaaggcttccctacc

SEQ ID NO: 160301 - DNA, 25 bp, Homo sapien
agatgatggcggctcagaccagcgc

SEQ ID NO: 160302 - DNA, 25 bp, Homo sapien
agaccagcgcagtggcctggttgaa

SEQ ID NO: 160303 - DNA, 25 bp, Homo sapien
cagtggcctggttgaacttgggata

SEQ ID NO: 160304 - DNA, 25 bp, Homo sapien
ggcctggttgaacttgggatatatt

SEQ ID NO: 160305 - DNA, 25 bp, Homo sapien
ttgggatatatttcgaaggtagagc

SEQ ID NO: 160306 - DNA, 25 bp, Homo sapien
gagccaacaggatttccggccggat

SEQ ID NO: 160307 - DNA, 25 bp, Homo sapien
ccaacaggatttccggccggattgg

SEQ ID NO: 160308 - DNA, 25 bp, Homo sapien
aggatgacgtcaagggttttggcct

SEQ ID NO: 160309 - DNA, 25 bp, Homo sapien
cgtcaagggttttggcctgagcagc

SEQ ID NO: 160310 - DNA, 25 bp, Homo sapien
ctgttgagtggttttaactgtctcc

SEQ ID NO: 160311 - DNA, 25 bp, Homo sapien
cctggctctgtggctcagggaatag

SEQ ID NO: 160312 - DNA, 25 bp, Homo sapien
gcagcttctggagccttgggacaga

SEQ ID NO: 160313 - DNA, 25 bp, Homo sapien
ttgggacagagcaggcccacaatgc

SEQ ID NO: 160314 - DNA, 25 bp, Homo sapien
ttcttccagccaagaagagctcaca

SEQ ID NO: 160315 - DNA, 25 bp, Homo sapien
gaagagctcacaggagtccagagta

SEQ ID NO: 160316 - DNA, 25 bp, Homo sapien
aggagtccagagtagccgaggctct

SEQ ID NO: 160317 - DNA, 25 bp, Homo sapien
tagccgaggctctggtattaacctg

SEQ ID NO: 160318 - DNA, 25 bp, Homo sapien
gctctggtattaacctggaagcccc

SEQ ID NO: 160319 - DNA, 25 bp, Homo sapien
acgtgaccttgacttacctctggaa

SEQ ID NO: 160320 - DNA, 25 bp, Homo sapien
tgacttacctctggaaagggtccca

SEQ ID NO: 160321 - DNA, 25 bp, Homo sapien
aagggtcccagcctagactgcttac

SEQ ID NO: 160322 - DNA, 25 bp, Homo sapien
gcttaccccatagccacatttgtgg

SEQ ID NO: 160323 - DNA, 25 bp, Homo sapien
ctgccaatgctgtacgtactgcatt

SEQ ID NO: 160324 - DNA, 25 bp, Homo sapien
gtacgtactgcatttgccccttgag

SEQ ID NO: 160325 - DNA, 25 bp, Homo sapien
cttgagccaggtggatgtttaccgt

SEQ ID NO: 160326 - DNA, 25 bp, Homo sapien
ggatgtttaccgtgtgttatataac

SEQ ID NO: 160327 - DNA, 25 bp, Homo sapien
gttatataacttcctggctccttca

SEQ ID NO: 160328 - DNA, 25 bp, Homo sapien
tggctccttcactgaacatgcctag

SEQ ID NO: 160329 - DNA, 25 bp, Homo sapien
cactgaacatgcctagtccaacatt

SEQ ID NO: 160330 - DNA, 25 bp, Homo sapien
acattttttcccagtgagtcacatc

SEQ ID NO: 160331 - DNA, 25 bp, Homo sapien
gagtcacatcctgggatccagtgta

SEQ ID NO: 160332 - DNA, 25 bp, Homo sapien
ataaatccaatatcatgtcttgtgc

SEQ ID NO: 160333 - DNA, 25 bp, Homo sapien
catgtcttgtgcataattcttccaa

SEQ ID NO: 160334 - DNA, 25 bp, Homo sapien
agtttgttcctctagtagtatattt

SEQ ID NO: 160335 - DNA, 25 bp, Homo sapien
ttatacaccagcaatttagacaaag

SEQ ID NO: 160336 - DNA, 25 bp, Homo sapien
ccagcaatttagacaaagccttaag

SEQ ID NO: 160337 - DNA, 25 bp, Homo sapien
gtagaagttacttaattgccagcaa

SEQ ID NO: 160338 - DNA, 25 bp, Homo sapien
aattgccagcaaataaatacgtgtc

SEQ ID NO: 160339 - DNA, 25 bp, Homo sapien
gccagcaaataaatacgtgtcaaaa

SEQ ID NO: 160340 - DNA, 25 bp, Homo sapien
aagaatctgtattcagacccctggg

SEQ ID NO: 160341 - DNA, 25 bp, Homo sapien
gtcaggaaattactgccccacttgt

SEQ ID NO: 160342 - DNA, 25 bp, Homo sapien
acttgtcaagttcagcccaccatct

SEQ ID NO: 160343 - DNA, 25 bp, Homo sapien
aagttcagcccaccatctgtttgaa

SEQ ID NO: 160344 - DNA, 25 bp, Homo sapien
gaagtttaaattctagtgtccataa

SEQ ID NO: 160345 - DNA, 25 bp, Homo sapien
gacttcagaaggtttgtccgaaaag

SEQ ID NO: 160346 - DNA, 25 bp, Homo sapien
cagaaggtttgtccgaaaagtgaga

SEQ ID NO: 160347 - DNA, 25 bp, Homo sapien
gcggaggagagagcctgcgaggtca

SEQ ID NO: 160348 - DNA, 25 bp, Homo sapien
aggtcaagctgcagagaacatgagc

SEQ ID NO: 160349 - DNA, 25 bp, Homo sapien
agagaacatgagcttctacctccag

SEQ ID NO: 160350 - DNA, 25 bp, Homo sapien
ttctacctccagatgtgccagggtg

SEQ ID NO: 160351 - DNA, 25 bp, Homo sapien
gatgtgccagggtgcatctcaataa

SEQ ID NO: 160352 - DNA, 25 bp, Homo sapien
tgccagggtgcatctcaataaactt

SEQ ID NO: 160353 - DNA, 25 bp, Homo sapien
gggtgcatctcaataaacttggatt

SEQ ID NO: 160354 - DNA, 25 bp, Homo sapien
ataaacttggattttggccaggcgc

SEQ ID NO: 160355 - DNA, 25 bp, Homo sapien
caagagatcttgtctcagaaataaa

SEQ ID NO: 160356 - DNA, 25 bp, Homo sapien
ttggattttaacttggcccgagtga

SEQ ID NO: 160357 - DNA, 25 bp, Homo sapien
acttggcccgagtgaaataatcaga

SEQ ID NO: 160358 - DNA, 25 bp, Homo sapien
tggaagtaaggttcattcccttaag

SEQ ID NO: 160359 - DNA, 25 bp, Homo sapien
ggttcattcccttaagacgatggat

SEQ ID NO: 160360 - DNA, 25 bp, Homo sapien
agacgatggattctgttgaactatg

SEQ ID NO: 160361 - DNA, 25 bp, Homo sapien
gggtcccacactgcactattaattc

SEQ ID NO: 160362 - DNA, 25 bp, Homo sapien
actattaattccacccactgtaagg

SEQ ID NO: 160363 - DNA, 25 bp, Homo sapien
cactgtaagggcaaggacaccattc

SEQ ID NO: 160364 - DNA, 25 bp, Homo sapien
ggacaccattccttctacatataag

SEQ ID NO: 160365 - DNA, 25 bp, Homo sapien
ctccccaagggcagcctttgttact

SEQ ID NO: 160366 - DNA, 25 bp, Homo sapien
tttctgttattacaagtgctctaat

SEQ ID NO: 160367 - DNA, 25 bp, Homo sapien
atcatgggatgtagagactgcaaca

SEQ ID NO: 160368 - DNA, 25 bp, Homo sapien
gactgcaacagaattgcttctgagt

SEQ ID NO: 160369 - DNA, 25 bp, Homo sapien
ctgaggcatagagagctgctgatat

SEQ ID NO: 160370 - DNA, 25 bp, Homo sapien
tgctgatatagtcaagcttgcctct

SEQ ID NO: 160371 - DNA, 25 bp, Homo sapien
aagcttgcctcttcttgaggagcac

SEQ ID NO: 160372 - DNA, 25 bp, Homo sapien
ttgaggagcaccaacatctgttatt

SEQ ID NO: 160373 - DNA, 25 bp, Homo sapien
tttcttttaatctggcattctcgcc

SEQ ID NO: 160374 - DNA, 25 bp, Homo sapien
ggcattctcgcctaatgatgttatc

SEQ ID NO: 160375 - DNA, 25 bp, Homo sapien
tgatgttatctaggcaccattggag

SEQ ID NO: 160376 - DNA, 25 bp, Homo sapien
aaatccctgctctgtaaataaagct

SEQ ID NO: 160377 - DNA, 25 bp, Homo sapien
agtgtaaaaattccctgagctaagc

SEQ ID NO: 160378 - DNA, 25 bp, Homo sapien
cctttccgcatgtggaagagtggga

SEQ ID NO: 160379 - DNA, 25 bp, Homo sapien
ggagtctcccacagggaggccattc

SEQ ID NO: 160380 - DNA, 25 bp, Homo sapien
tgaaaggagatcatcagcccccaca

SEQ ID NO: 160381 - DNA, 25 bp, Homo sapien
agcccccacaatttgtcagagctga

SEQ ID NO: 160382 - DNA, 25 bp, Homo sapien
ccccactacagcattgtgcttgggt

SEQ ID NO: 160383 - DNA, 25 bp, Homo sapien
acagcattgtgcttgggtctgggtt

SEQ ID NO: 160384 - DNA, 25 bp, Homo sapien
cattgtgcttgggtctgggttctca

SEQ ID NO: 160385 - DNA, 25 bp, Homo sapien
gcttgggtctgggttctcagtaaat

SEQ ID NO: 160386 - DNA, 25 bp, Homo sapien
gggttctcagtaaatgtagccattt

SEQ ID NO: 160387 - DNA, 25 bp, Homo sapien
tgtagccatttgagaaacttacttg

SEQ ID NO: 160388 - DNA, 25 bp, Homo sapien
acttggggacaaagtctcaatcctt

SEQ ID NO: 160389 - DNA, 25 bp, Homo sapien
gatttgaaacctggaaatacagtaa

SEQ ID NO: 160390 - DNA, 25 bp, Homo sapien
tgactgtttaaaatgttggccaaaa

SEQ ID NO: 160391 - DNA, 25 bp, Homo sapien
aactgttaattctcagccatctttg

SEQ ID NO: 160392 - DNA, 25 bp, Homo sapien
ttctcagccatctttgaagcttgaa

SEQ ID NO: 160393 - DNA, 25 bp, Homo sapien
ggtattttgtaaacgttagcagact

SEQ ID NO: 160394 - DNA, 25 bp, Homo sapien
aacgttagcagactttcctgccagt

SEQ ID NO: 160395 - DNA, 25 bp, Homo sapien
agactttcctgccagtgtcagaaaa

SEQ ID NO: 160396 - DNA, 25 bp, Homo sapien
cctgccagtgtcagaaaatcctatt

SEQ ID NO: 160397 - DNA, 25 bp, Homo sapien
cctatttatgaatcctgtcggtatt

SEQ ID NO: 160398 - DNA, 25 bp, Homo sapien
tatgaatcctgtcggtattccttgg

SEQ ID NO: 160399 - DNA, 25 bp, Homo sapien
gtaccatacatgagttatttctaag

SEQ ID NO: 160400 - DNA, 25 bp, Homo sapien
tttatgtatggtgcaatgtgtgtat

SEQ ID NO: 160401 - DNA, 25 bp, Homo sapien
gcaatgtgtgtatatggacaaaaca

SEQ ID NO: 160402 - DNA, 25 bp, Homo sapien
acaagaaagacgcactttggcttat

SEQ ID NO: 160403 - DNA, 25 bp, Homo sapien
aagacgcactttggcttataattct

SEQ ID NO: 160404 - DNA, 25 bp, Homo sapien
aatgatacagcagagctaggtggaa

SEQ ID NO: 160405 - DNA, 25 bp, Homo sapien
acagcagagctaggtggaaaagcct

SEQ ID NO: 160406 - DNA, 25 bp, Homo sapien
gaaaagcctgggtttggtgtatggt

SEQ ID NO: 160407 - DNA, 25 bp, Homo sapien
ggtttttgagatattaatgcccaga

SEQ ID NO: 160408 - DNA, 25 bp, Homo sapien
ttaatgcccagacaaaaagctaata

SEQ ID NO: 160409 - DNA, 25 bp, Homo sapien
gacaaaaagctaataccagtcactc

SEQ ID NO: 160410 - DNA, 25 bp, Homo sapien
atacttgtaattatggagtcatttt

SEQ ID NO: 160411 - DNA, 25 bp, Homo sapien
gggaatggatctttcaccaaagagc

SEQ ID NO: 160412 - DNA, 25 bp, Homo sapien
tttcaccaaagagctcaccagcatt

SEQ ID NO: 160413 - DNA, 25 bp, Homo sapien
gcccttggagttcccagtggattca

SEQ ID NO: 160414 - DNA, 25 bp, Homo sapien
ggatgcctacttatgagcttgacca

SEQ ID NO: 160415 - DNA, 25 bp, Homo sapien
gcttgaccatcacagctatcggtaa

SEQ ID NO: 160416 - DNA, 25 bp, Homo sapien
agctcttaagttcacagggtgcctg

SEQ ID NO: 160417 - DNA, 25 bp, Homo sapien
agttcacagggtgcctgggctgcat

SEQ ID NO: 160418 - DNA, 25 bp, Homo sapien
tgggctgcatttgaatatcacttcc

SEQ ID NO: 160419 - DNA, 25 bp, Homo sapien
ttttcccatcacatagaagactttg

SEQ ID NO: 160420 - DNA, 25 bp, Homo sapien
aagactttgacctgtgaagctgcca

SEQ ID NO: 160421 - DNA, 25 bp, Homo sapien
gtgaagctgccatctgttaatacta

SEQ ID NO: 160422 - DNA, 25 bp, Homo sapien
ccagggaagccagtacagacgggtt

SEQ ID NO: 160423 - DNA, 25 bp, Homo sapien
atcgggcctggctggctagtgcaat

SEQ ID NO: 160424 - DNA, 25 bp, Homo sapien
gcctggctggctagtgcaatttgga

SEQ ID NO: 160425 - DNA, 25 bp, Homo sapien
gctggctagtgcaatttggacgatg

SEQ ID NO: 160426 - DNA, 25 bp, Homo sapien
gtgcaatttggacgatgagtttaaa

SEQ ID NO: 160427 - DNA, 25 bp, Homo sapien
taaaactgcagaaccaaagtaacct

SEQ ID NO: 160428 - DNA, 25 bp, Homo sapien
acaggcttcaagcacagtagctgaa

SEQ ID NO: 160429 - DNA, 25 bp, Homo sapien
ttcaagcacagtagctgaagataat

SEQ ID NO: 160430 - DNA, 25 bp, Homo sapien
atccattataacaaaagagtagcca

SEQ ID NO: 160431 - DNA, 25 bp, Homo sapien
agagtagccaaaatgctgtggcatt

SEQ ID NO: 160432 - DNA, 25 bp, Homo sapien
aatgctgtggcattcttagaaatga

SEQ ID NO: 160433 - DNA, 25 bp, Homo sapien
gccttttcccggtgggtgtcaggat

SEQ ID NO: 160434 - DNA, 25 bp, Homo sapien
ttttcccggtgggtgtcaggatcac

SEQ ID NO: 160435 - DNA, 25 bp, Homo sapien
ctaattacctgagcgaccaggacta

SEQ ID NO: 160436 - DNA, 25 bp, Homo sapien
tgagcgaccaggactacatttccca

SEQ ID NO: 160437 - DNA, 25 bp, Homo sapien
cgaccaggactacatttcccaagag

SEQ ID NO: 160438 - DNA, 25 bp, Homo sapien
gagtccaggaaagacgaggcacctt

SEQ ID NO: 160439 - DNA, 25 bp, Homo sapien
caggaaagacgaggcaccttggccg

SEQ ID NO: 160440 - DNA, 25 bp, Homo sapien
cctgctgggacttgtagttgcctag

SEQ ID NO: 160441 - DNA, 25 bp, Homo sapien
gctgggacttgtagttgcctagaca

SEQ ID NO: 160442 - DNA, 25 bp, Homo sapien
gtagttgcctagacagggcaccacc

SEQ ID NO: 160443 - DNA, 25 bp, Homo sapien
cgtgaggcgttggtgtctcctggat

SEQ ID NO: 160444 - DNA, 25 bp, Homo sapien
atgcacaaatgagcagggccgcggt

SEQ ID NO: 160445 - DNA, 25 bp, Homo sapien
actgaggtgttgtgcatgatgtttg

SEQ ID NO: 160446 - DNA, 25 bp, Homo sapien
atgatgtttggatgctagactagtt

SEQ ID NO: 160447 - DNA, 25 bp, Homo sapien
agactagttgcatctgacgggagaa

SEQ ID NO: 160448 - DNA, 25 bp, Homo sapien
aagtttgtgttgtaccagcgcatgc

SEQ ID NO: 160449 - DNA, 25 bp, Homo sapien
accagcgcatgccttggaaagactt

SEQ ID NO: 160450 - DNA, 25 bp, Homo sapien
taatctactgacaagttgctctagt

SEQ ID NO: 160451 - DNA, 25 bp, Homo sapien
gttgctctagtaacccaaagaagtg

SEQ ID NO: 160452 - DNA, 25 bp, Homo sapien
aaggagaaagcagctgcctcaccgc

SEQ ID NO: 160453 - DNA, 25 bp, Homo sapien
accgcccagacattgatttgttcag

SEQ ID NO: 160454 - DNA, 25 bp, Homo sapien
tgttcagatgtttcaatgcctcatg

SEQ ID NO: 160455 - DNA, 25 bp, Homo sapien
ccaacatgaccacacgtgggtgctg

SEQ ID NO: 160456 - DNA, 25 bp, Homo sapien
caacatgaccacacgtgggtgctga

SEQ ID NO: 160457 - DNA, 25 bp, Homo sapien
accacacgtgggtgctgaactcggg

SEQ ID NO: 160458 - DNA, 25 bp, Homo sapien
gcgccgtgcccaccggcatggtcct

SEQ ID NO: 160459 - DNA, 25 bp, Homo sapien
gacagcattacctcacccggcccca

SEQ ID NO: 160460 - DNA, 25 bp, Homo sapien
tgttgccccggtccagccctgatgg

SEQ ID NO: 160461 - DNA, 25 bp, Homo sapien
ggtccagccctgatggcgcgcgcct

SEQ ID NO: 160462 - DNA, 25 bp, Homo sapien
atggcgcgcgcctggtctgtctgat

SEQ ID NO: 160463 - DNA, 25 bp, Homo sapien
tgtaccgggtttctgcagtgttaaa

SEQ ID NO: 160464 - DNA, 25 bp, Homo sapien
aaatgtaaagccatctgtccggcgt

SEQ ID NO: 160465 - DNA, 25 bp, Homo sapien
aaagccatctgtccggcgtaaggac

SEQ ID NO: 160466 - DNA, 25 bp, Homo sapien
attgctgaactgttcttcaggccca

SEQ ID NO: 160467 - DNA, 25 bp, Homo sapien
aactgttcttcaggcccatcatcgg

SEQ ID NO: 160468 - DNA, 25 bp, Homo sapien
catcatcggcacagtcagcatggat

SEQ ID NO: 160469 - DNA, 25 bp, Homo sapien
tcggcacagtcagcatggatgatat

SEQ ID NO: 160470 - DNA, 25 bp, Homo sapien
atgatgctggaaatgctctgtacaa

SEQ ID NO: 160471 - DNA, 25 bp, Homo sapien
gctggaaatgctctgtacaaagata

SEQ ID NO: 160472 - DNA, 25 bp, Homo sapien
aaagatataaagtcatgtgggccac

SEQ ID NO: 160473 - DNA, 25 bp, Homo sapien
tgtgggccacacaagtgcagtagtg

SEQ ID NO: 160474 - DNA, 25 bp, Homo sapien
gtgcagtagtgcagttcaccatgag

SEQ ID NO: 160475 - DNA, 25 bp, Homo sapien
gtgcagttcaccatgagggaagaat

SEQ ID NO: 160476 - DNA, 25 bp, Homo sapien
agagctgtgggcaaaagagtgtaaa

SEQ ID NO: 160477 - DNA, 25 bp, Homo sapien
atgaccgactgatgttcccacggat

SEQ ID NO: 160478 - DNA, 25 bp, Homo sapien
actgatgttcccacggatgctaatg

SEQ ID NO: 160479 - DNA, 25 bp, Homo sapien
aatgaaactggtgagcctccggacc

SEQ ID NO: 160480 - DNA, 25 bp, Homo sapien
agcagcgtccactcagagcaagtgt

SEQ ID NO: 160481 - DNA, 25 bp, Homo sapien
gcaagtgtttgcactgcgtctgcag

SEQ ID NO: 160482 - DNA, 25 bp, Homo sapien
gcgtctgcaggacaaaaagctccca

SEQ ID NO: 160483 - DNA, 25 bp, Homo sapien
gatgtgcacgaatgactgttctgtc

SEQ ID NO: 160484 - DNA, 25 bp, Homo sapien
attttctgttttcttggccggatgg

SEQ ID NO: 160485 - DNA, 25 bp, Homo sapien
ttttcttggccggatggctgaggcc

SEQ ID NO: 160486 - DNA, 25 bp, Homo sapien
gtggctgcctcctagaagtggaaca

SEQ ID NO: 160487 - DNA, 25 bp, Homo sapien
gaagggcaaacattcctgggagctg

SEQ ID NO: 160488 - DNA, 25 bp, Homo sapien
ggaagccaagcaaggatagtaaatt

SEQ ID NO: 160489 - DNA, 25 bp, Homo sapien
agtaaattgaccagaacacagttgt

SEQ ID NO: 160490 - DNA, 25 bp, Homo sapien
acacagttgtgggaatttggtctga

SEQ ID NO: 160491 - DNA, 25 bp, Homo sapien
tatatctgtgtggagtaggttttct

SEQ ID NO: 160492 - DNA, 25 bp, Homo sapien
ggagtaggttttctctggtctgatt

SEQ ID NO: 160493 - DNA, 25 bp, Homo sapien
tctgccctcctggatgctattaaag

SEQ ID NO: 160494 - DNA, 25 bp, Homo sapien
ttttgttgaacaatcagatgcccaa

SEQ ID NO: 160495 - DNA, 25 bp, Homo sapien
agatgcccaactctgttgccttgtg

SEQ ID NO: 160496 - DNA, 25 bp, Homo sapien
aactctgttgccttgtggaagatga

SEQ ID NO: 160497 - DNA, 25 bp, Homo sapien
gtgcttcttaaagtggtctcttctc

SEQ ID NO: 160498 - DNA, 25 bp, Homo sapien
ttcttaaagtggtctcttctcccta

SEQ ID NO: 160499 - DNA, 25 bp, Homo sapien
tttcttaatcttcagacactcacta

SEQ ID NO: 160500 - DNA, 25 bp, Homo sapien
tcttcagacactcactattttcatg

SEQ ID NO: 160501 - DNA, 25 bp, Homo sapien
tcctttggcccttgtgtaacattgc

SEQ ID NO: 160502 - DNA, 25 bp, Homo sapien
ggcccttgtgtaacattgcaaacct

SEQ ID NO: 160503 - DNA, 25 bp, Homo sapien
gtaacattgcaaacctgtggctttg

SEQ ID NO: 160504 - DNA, 25 bp, Homo sapien
ggctttgcaaaatgtacccaggtca

SEQ ID NO: 160505 - DNA, 25 bp, Homo sapien
gcaaaatgtacccaggtcacaaggg

SEQ ID NO: 160506 - DNA, 25 bp, Homo sapien
tttagcaatgatatccctgtctggg

SEQ ID NO: 160507 - DNA, 25 bp, Homo sapien
aatgatatccctgtctgggtcactt

SEQ ID NO: 160508 - DNA, 25 bp, Homo sapien
cctgtctgggtcactttttaagctt

SEQ ID NO: 160509 - DNA, 25 bp, Homo sapien
ccccagacttataatcttaaatgta

SEQ ID NO: 160510 - DNA, 25 bp, Homo sapien
aatcttcatggatcttcatgcagcc

SEQ ID NO: 160511 - DNA, 25 bp, Homo sapien
tcatgcagccatacaaaccctggtt

SEQ ID NO: 160512 - DNA, 25 bp, Homo sapien
aaccctggttccaacagaatggtga

SEQ ID NO: 160513 - DNA, 25 bp, Homo sapien
ggtgaattttcgacagcctttggta

SEQ ID NO: 160514 - DNA, 25 bp, Homo sapien
gacagcctttggtatcttggagtat

SEQ ID NO: 160515 - DNA, 25 bp, Homo sapien
gtatcttggagtatgaccccagtct

SEQ ID NO: 160516 - DNA, 25 bp, Homo sapien
ggagtatgaccccagtctgttataa

SEQ ID NO: 160517 - DNA, 25 bp, Homo sapien
atgaccccagtctgttataaactgc

SEQ ID NO: 160518 - DNA, 25 bp, Homo sapien
tgtgttaatggtgtgtgctccctct

SEQ ID NO: 160519 - DNA, 25 bp, Homo sapien
tgacctttagtctttcacttccaat

SEQ ID NO: 160520 - DNA, 25 bp, Homo sapien
tagtctttcacttccaattttgtgg

SEQ ID NO: 160521 - DNA, 25 bp, Homo sapien
tccgggacgcccctgggtggcctgg

SEQ ID NO: 160522 - DNA, 25 bp, Homo sapien
cgaggcgcagcggtttaccgacatc

SEQ ID NO: 160523 - DNA, 25 bp, Homo sapien
ggcgcagcggtttaccgacatcctg

SEQ ID NO: 160524 - DNA, 25 bp, Homo sapien
agcggtttaccgacatcctggcgca

SEQ ID NO: 160525 - DNA, 25 bp, Homo sapien
tgcactccatgtcggccgaggtctt

SEQ ID NO: 160526 - DNA, 25 bp, Homo sapien
atgtcggccgaggtcttcggaccca

SEQ ID NO: 160527 - DNA, 25 bp, Homo sapien
cttctcgtcgctgtcggtcaacggt

SEQ ID NO: 160528 - DNA, 25 bp, Homo sapien
gggcgagctacggaaaccacctgtc

SEQ ID NO: 160529 - DNA, 25 bp, Homo sapien
cccgaaatgaacgaggcggccgtgt

SEQ ID NO: 160530 - DNA, 25 bp, Homo sapien
tctcgcacggtctgcggagttcgtg

SEQ ID NO: 160531 - DNA, 25 bp, Homo sapien
acggtctgcggagttcgtggttgta

SEQ ID NO: 160532 - DNA, 25 bp, Homo sapien
ggaccttgcttaaatttgatactct

SEQ ID NO: 160533 - DNA, 25 bp, Homo sapien
cctggacgattggaccattccatgt

SEQ ID NO: 160534 - DNA, 25 bp, Homo sapien
atgtgtatcattccatggccagtga

SEQ ID NO: 160535 - DNA, 25 bp, Homo sapien
ggccagtgacgtgtgcttctgagaa

SEQ ID NO: 160536 - DNA, 25 bp, Homo sapien
aaagaagattccaactctctcactc

SEQ ID NO: 160537 - DNA, 25 bp, Homo sapien
tctctcactctgaaccatgaagctg

SEQ ID NO: 160538 - DNA, 25 bp, Homo sapien
gtaatgagccacagtggtgactcac

SEQ ID NO: 160539 - DNA, 25 bp, Homo sapien
aggaaagccagactgctacactgct

SEQ ID NO: 160540 - DNA, 25 bp, Homo sapien
tgctacactgctctgtttggtgttt

SEQ ID NO: 160541 - DNA, 25 bp, Homo sapien
atctatgacgattgtattgtgactg

SEQ ID NO: 160542 - DNA, 25 bp, Homo sapien
gagcagcattggaccttgcttaaat

SEQ ID NO: 160543 - DNA, 25 bp, Homo sapien
cacggaccaggtctctgtcattaag

SEQ ID NO: 160544 - DNA, 25 bp, Homo sapien
caggtctctgtcattaaggtgaaga

SEQ ID NO: 160545 - DNA, 25 bp, Homo sapien
tgaagattcatgaagccacaggcat

SEQ ID NO: 160546 - DNA, 25 bp, Homo sapien
aagccacaggcatgcctgcagggaa

SEQ ID NO: 160547 - DNA, 25 bp, Homo sapien
cagaagctacagtatgagggtatct

SEQ ID NO: 160548 - DNA, 25 bp, Homo sapien
gagggtatcttcatcaaagattcca

SEQ ID NO: 160549 - DNA, 25 bp, Homo sapien
aaagattccaactcactggcttact

SEQ ID NO: 160550 - DNA, 25 bp, Homo sapien
aactcactggcttactacaacatgg

SEQ ID NO: 160551 - DNA, 25 bp, Homo sapien
acaacatggccaatggcgcagtcat

SEQ ID NO: 160552 - DNA, 25 bp, Homo sapien
agaagtagacaagaggaacctgctg

SEQ ID NO: 160553 - DNA, 25 bp, Homo sapien
acaagaggaacctgctgtcaagtcc

SEQ ID NO: 160554 - DNA, 25 bp, Homo sapien
gaagtcttcacaggcactgcatcgg

SEQ ID NO: 160555 - DNA, 25 bp, Homo sapien
acaggcactgcatcgggttgtctgg

SEQ ID NO: 160556 - DNA, 25 bp, Homo sapien
gcatcgggttgtctggcgccctttt

SEQ ID NO: 160557 - DNA, 25 bp, Homo sapien
ttttcctccagcctaaactgacatc

SEQ ID NO: 160558 - DNA, 25 bp, Homo sapien
taaactgacatcatcctatggactg

SEQ ID NO: 160559 - DNA, 25 bp, Homo sapien
catcctatggactgagccggccact

SEQ ID NO: 160560 - DNA, 25 bp, Homo sapien
cacagggtccctcagattataggtg

SEQ ID NO: 160561 - DNA, 25 bp, Homo sapien
ggtccctcagattataggtgcccag

SEQ ID NO: 160562 - DNA, 25 bp, Homo sapien
ggcaaacctgtgacccttttctact

SEQ ID NO: 160563 - DNA, 25 bp, Homo sapien
acctgtgacccttttctactggaat

SEQ ID NO: 160564 - DNA, 25 bp, Homo sapien
gtgacccttttctactggaatagaa

SEQ ID NO: 160565 - DNA, 25 bp, Homo sapien
agtttcacagcgtgaggccacaggg

SEQ ID NO: 160566 - DNA, 25 bp, Homo sapien
tcctcctcatgctggcgggcatggg

SEQ ID NO: 160567 - DNA, 25 bp, Homo sapien
cgggcatgggcctgcactacattgc

SEQ ID NO: 160568 - DNA, 25 bp, Homo sapien
acattgccttcaggtgatgcctgtt

SEQ ID NO: 160569 - DNA, 25 bp, Homo sapien
agggtgggtgaattccagtgtggtc

SEQ ID NO: 160570 - DNA, 25 bp, Homo sapien
agtgtggtcagccagtcctccacag

SEQ ID NO: 160571 - DNA, 25 bp, Homo sapien
tcgtggcccgtactcttgtgtctct

SEQ ID NO: 160572 - DNA, 25 bp, Homo sapien
ttgtgtctctcaagctaaaactgct

SEQ ID NO: 160573 - DNA, 25 bp, Homo sapien
ctaaaactgcttgaagttggtctct

SEQ ID NO: 160574 - DNA, 25 bp, Homo sapien
ctgcttgaagttggtctctggacct

SEQ ID NO: 160575 - DNA, 25 bp, Homo sapien
tctggacctctccttacttattaaa

SEQ ID NO: 160576 - DNA, 25 bp, Homo sapien
ggctgcacacatcgtctgtgaattg

SEQ ID NO: 160577 - DNA, 25 bp, Homo sapien
tgaattgtggctgttcactcccgag

SEQ ID NO: 160578 - DNA, 25 bp, Homo sapien
gaggatgtgtcctagactccgggtc

SEQ ID NO: 160579 - DNA, 25 bp, Homo sapien
tcgcgtggatctaccctctagttta

SEQ ID NO: 160580 - DNA, 25 bp, Homo sapien
cctctagtttacttgctcgggagaa

SEQ ID NO: 160581 - DNA, 25 bp, Homo sapien
aactgactcgttttatttagtgcct

SEQ ID NO: 160582 - DNA, 25 bp, Homo sapien
tttagtgcctatttagcgagcccag

SEQ ID NO: 160583 - DNA, 25 bp, Homo sapien
gcgagcccagagtaacgtacatttg

SEQ ID NO: 160584 - DNA, 25 bp, Homo sapien
aattcacattcatcatcagcacgag

SEQ ID NO: 160585 - DNA, 25 bp, Homo sapien
atcagcacgagacccatttccttgt

SEQ ID NO: 160586 - DNA, 25 bp, Homo sapien
gccagctcaggatattatgtttctt

SEQ ID NO: 160587 - DNA, 25 bp, Homo sapien
ggaaagcaactaagacactggacta

SEQ ID NO: 160588 - DNA, 25 bp, Homo sapien
gacactggactatcctttaaaggta

SEQ ID NO: 160589 - DNA, 25 bp, Homo sapien
tatcctttaaaggtagcaggtgtaa

SEQ ID NO: 160590 - DNA, 25 bp, Homo sapien
atgatgtgttttgacctttgcaggc

SEQ ID NO: 160591 - DNA, 25 bp, Homo sapien
acctttgcaggcgagtaaccaggca

SEQ ID NO: 160592 - DNA, 25 bp, Homo sapien
accaggcaatggagtggagtgtctc

SEQ ID NO: 160593 - DNA, 25 bp, Homo sapien
gagacagagagatggcaagcactga

SEQ ID NO: 160594 - DNA, 25 bp, Homo sapien
aagcactgagataaatacctggcaa

SEQ ID NO: 160595 - DNA, 25 bp, Homo sapien
aaatccaccaaaccatgataaacac

SEQ ID NO: 160596 - DNA, 25 bp, Homo sapien
aaaatgcagcttcctgatgcttaga

SEQ ID NO: 160597 - DNA, 25 bp, Homo sapien
ttcctgatgcttagagttggcacat

SEQ ID NO: 160598 - DNA, 25 bp, Homo sapien
aaagctgggccaagaggatctgtcc

SEQ ID NO: 160599 - DNA, 25 bp, Homo sapien
ggatctgtccaatatcttcctgact

SEQ ID NO: 160600 - DNA, 25 bp, Homo sapien
aatatcttcctgacttggatgataa

SEQ ID NO: 160601 - DNA, 25 bp, Homo sapien
aggaggcctttcctgtgcatctgga

SEQ ID NO: 160602 - DNA, 25 bp, Homo sapien
tttcctgtgcatctggacctaacca

SEQ ID NO: 160603 - DNA, 25 bp, Homo sapien
gacctaaccacgaatccccagggag

SEQ ID NO: 160604 - DNA, 25 bp, Homo sapien
gaaaccctggatatttccttcctct

SEQ ID NO: 160605 - DNA, 25 bp, Homo sapien
aggagaagctggtggtcctgccttt

SEQ ID NO: 160606 - DNA, 25 bp, Homo sapien
aaaaagcacgcactgctgagtgccc

SEQ ID NO: 160607 - DNA, 25 bp, Homo sapien
ttgtccttccgccatgagaatcaca

SEQ ID NO: 160608 - DNA, 25 bp, Homo sapien
atgagaatcacacagagtcttctgt

SEQ ID NO: 160609 - DNA, 25 bp, Homo sapien
agtggctggtatggctctgaggctc

SEQ ID NO: 160610 - DNA, 25 bp, Homo sapien
ctcctgctccttgctgttttctgat

SEQ ID NO: 160611 - DNA, 25 bp, Homo sapien
gggcttgggagtccctttgtcctca

SEQ ID NO: 160612 - DNA, 25 bp, Homo sapien
ttgggagtccctttgtcctcatctg

SEQ ID NO: 160613 - DNA, 25 bp, Homo sapien
gtcctcatctgagactgaaatgtgg

SEQ ID NO: 160614 - DNA, 25 bp, Homo sapien
aacctctatcctggaacctgtcctc

SEQ ID NO: 160615 - DNA, 25 bp, Homo sapien
tttctccccaactatgcatctgttg

SEQ ID NO: 160616 - DNA, 25 bp, Homo sapien
aactatgcatctgttgtctgctcct

SEQ ID NO: 160617 - DNA, 25 bp, Homo sapien
tatgcatctgttgtctgctcctctg

SEQ ID NO: 160618 - DNA, 25 bp, Homo sapien
tgcatctgttgtctgctcctctgca

SEQ ID NO: 160619 - DNA, 25 bp, Homo sapien
tgctcctctgcaaaggccagccagc

SEQ ID NO: 160620 - DNA, 25 bp, Homo sapien
cggccaccagaatcctttggtatag

SEQ ID NO: 160621 - DNA, 25 bp, Homo sapien
tatagccaagccttttggttaccgc

SEQ ID NO: 160622 - DNA, 25 bp, Homo sapien
ttggttaccgcctcatgaagaatat

SEQ ID NO: 160623 - DNA, 25 bp, Homo sapien
tgaagaatatgcttcccgcattgtc

SEQ ID NO: 160624 - DNA, 25 bp, Homo sapien
gcattgtcctagtcccagttgtatt

SEQ ID NO: 160625 - DNA, 25 bp, Homo sapien
gtcccagttgtattctcacaggtgt

SEQ ID NO: 160626 - DNA, 25 bp, Homo sapien
aatcataaacctggctcatgcccaa

SEQ ID NO: 160627 - DNA, 25 bp, Homo sapien
tcatgcccaacacatttctgctaat

SEQ ID NO: 160628 - DNA, 25 bp, Homo sapien
atagggagagggacccaccacacac

SEQ ID NO: 160629 - DNA, 25 bp, Homo sapien
agggcctgtgtctgtagaaggttaa

SEQ ID NO: 160630 - DNA, 25 bp, Homo sapien
atcccagaattatgactcttcccaa

SEQ ID NO: 160631 - DNA, 25 bp, Homo sapien
cctccttctttgtgtggaatctgca

SEQ ID NO: 160632 - DNA, 25 bp, Homo sapien
gaatctgcaatagtgggctgactcc

SEQ ID NO: 160633 - DNA, 25 bp, Homo sapien
gcaatagtgggctgactccctccag

SEQ ID NO: 160634 - DNA, 25 bp, Homo sapien
tacccgcccttgaagtatagccagc

SEQ ID NO: 160635 - DNA, 25 bp, Homo sapien
gccaaggttggagctcagaccgtgt

SEQ ID NO: 160636 - DNA, 25 bp, Homo sapien
ttggagctcagaccgtgtctaggtt

SEQ ID NO: 160637 - DNA, 25 bp, Homo sapien
aagagccttctggagaggacagtca

SEQ ID NO: 160638 - DNA, 25 bp, Homo sapien
aggacagtcagctgagcacctccca

SEQ ID NO: 160639 - DNA, 25 bp, Homo sapien
cacgtccttccccataactatggaa

SEQ ID NO: 160640 - DNA, 25 bp, Homo sapien
cataactatggaaatggccctaatt

SEQ ID NO: 160641 - DNA, 25 bp, Homo sapien
aaatggccctaatttctgtgaaata

SEQ ID NO: 160642 - DNA, 25 bp, Homo sapien
tcccagtttcacagcgtgaggccac

SEQ ID NO: 160643 - DNA, 25 bp, Homo sapien
agtttcacagcgtgaggccacaggg

SEQ ID NO: 160644 - DNA, 25 bp, Homo sapien
caaacaagtgctggggtactgcctc

SEQ ID NO: 160645 - DNA, 25 bp, Homo sapien
acaagtgctggggtactgcctcctc

SEQ ID NO: 160646 - DNA, 25 bp, Homo sapien
ctcctcctcatgctggcgggcatgg

SEQ ID NO: 160647 - DNA, 25 bp, Homo sapien
tcctcctcatgctggcgggcatggg

SEQ ID NO: 160648 - DNA, 25 bp, Homo sapien
cgggcatgggcctgcactacattgc

SEQ ID NO: 160649 - DNA, 25 bp, Homo sapien
gggcatgggcctgcactacattgcc

SEQ ID NO: 160650 - DNA, 25 bp, Homo sapien
ggcatgggcctgcactacattgcct

SEQ ID NO: 160651 - DNA, 25 bp, Homo sapien
gcatgggcctgcactacattgcctt

SEQ ID NO: 160652 - DNA, 25 bp, Homo sapien
catgggcctgcactacattgccttc

SEQ ID NO: 160653 - DNA, 25 bp, Homo sapien
agattccctggagcttttataagtt

SEQ ID NO: 160654 - DNA, 25 bp, Homo sapien
tatttttgctaatccttctgcttgg

SEQ ID NO: 160655 - DNA, 25 bp, Homo sapien
ttctgcttggccttgtcattgtctt

SEQ ID NO: 160656 - DNA, 25 bp, Homo sapien
gtcattgtctttggtcctaccatgt

SEQ ID NO: 160657 - DNA, 25 bp, Homo sapien
ttggtcctaccatgttcctagaatg

SEQ ID NO: 160658 - DNA, 25 bp, Homo sapien
cattatttgatgacctggcaacttg

SEQ ID NO: 160659 - DNA, 25 bp, Homo sapien
ctggcaacttggaaaggctgtcttt

SEQ ID NO: 160660 - DNA, 25 bp, Homo sapien
ttcctatctgactaaaacagccgat

SEQ ID NO: 160661 - DNA, 25 bp, Homo sapien
aaaacagccgatttcatagaacaat

SEQ ID NO: 160662 - DNA, 25 bp, Homo sapien
aacaggtgacagatgggtttttcat

SEQ ID NO: 160663 - DNA, 25 bp, Homo sapien
tttactttggtggtactgaacaatg

SEQ ID NO: 160664 - DNA, 25 bp, Homo sapien
agcgtttctgacagctcccagctgg

SEQ ID NO: 160665 - DNA, 25 bp, Homo sapien
tcccagctgggagaaaccaacatgt

SEQ ID NO: 160666 - DNA, 25 bp, Homo sapien
agggtgggcagagcacaacctcatc

SEQ ID NO: 160667 - DNA, 25 bp, Homo sapien
atcctcccagtggttcctcttgagt

SEQ ID NO: 160668 - DNA, 25 bp, Homo sapien
ctcccagtggttcctcttgagtttg

SEQ ID NO: 160669 - DNA, 25 bp, Homo sapien
gtttgatttgacaagatgccttccc

SEQ ID NO: 160670 - DNA, 25 bp, Homo sapien
caggtaaccccgtggaacgtgccag

SEQ ID NO: 160671 - DNA, 25 bp, Homo sapien
gtggaacgtgccagtacctcaccgc

SEQ ID NO: 160672 - DNA, 25 bp, Homo sapien
aacaaatccaggctgcagatttttt

SEQ ID NO: 160673 - DNA, 25 bp, Homo sapien
ggttaaagagtttgcctgaggttgc

SEQ ID NO: 160674 - DNA, 25 bp, Homo sapien
gtttgcctgaggttgcttagataat

SEQ ID NO: 160675 - DNA, 25 bp, Homo sapien
caagaggatctgtccaatatcttcc

SEQ ID NO: 160676 - DNA, 25 bp, Homo sapien
agaggatctgtccaatatcttcctg

SEQ ID NO: 160677 - DNA, 25 bp, Homo sapien
gaggatctgtccaatatcttcctga

SEQ ID NO: 160678 - DNA, 25 bp, Homo sapien
ggatctgtccaatatcttcctgact

SEQ ID NO: 160679 - DNA, 25 bp, Homo sapien
gatctgtccaatatcttcctgactt

SEQ ID NO: 160680 - DNA, 25 bp, Homo sapien
atctgtccaatatcttcctgacttg

SEQ ID NO: 160681 - DNA, 25 bp, Homo sapien
tctgtccaatatcttcctgacttgg

SEQ ID NO: 160682 - DNA, 25 bp, Homo sapien
gaaaccctggatatttccttcctct

SEQ ID NO: 160683 - DNA, 25 bp, Homo sapien
gaatgccagccctcttgtccttccg

SEQ ID NO: 160684 - DNA, 25 bp, Homo sapien
atgagaatcacacagagtcttctgt

SEQ ID NO: 160685 - DNA, 25 bp, Homo sapien
tgagaatcacacagagtcttctgta

SEQ ID NO: 160686 - DNA, 25 bp, Homo sapien
atattgctcatcaaaatgtctctgg

SEQ ID NO: 160687 - DNA, 25 bp, Homo sapien
ttgctcatcaaaatgtctctggtgt

SEQ ID NO: 160688 - DNA, 25 bp, Homo sapien
gctcatcaaaatgtctctggtgttt

SEQ ID NO: 160689 - DNA, 25 bp, Homo sapien
tcatcaaaatgtctctggtgtttag

SEQ ID NO: 160690 - DNA, 25 bp, Homo sapien
aaatgtctctggtgtttagagcttt

SEQ ID NO: 160691 - DNA, 25 bp, Homo sapien
tgtctctggtgtttagagctttatt

SEQ ID NO: 160692 - DNA, 25 bp, Homo sapien
ttctctttaatcctttagttatatt

SEQ ID NO: 160693 - DNA, 25 bp, Homo sapien
ataatactgcctaatgtatatattt

SEQ ID NO: 160694 - DNA, 25 bp, Homo sapien
atattttgatcttttcttgtaagaa

SEQ ID NO: 160695 - DNA, 25 bp, Homo sapien
aatagtactttgtggatcatttcaa

SEQ ID NO: 160696 - DNA, 25 bp, Homo sapien
gtactttgtggatcatttcaagata

SEQ ID NO: 160697 - DNA, 25 bp, Homo sapien
tatgcagacctttagagttaagcct

SEQ ID NO: 160698 - DNA, 25 bp, Homo sapien
gagttaagcctttgtatttccatgt

SEQ ID NO: 160699 - DNA, 25 bp, Homo sapien
gtatttccatgttattccacaatat

SEQ ID NO: 160700 - DNA, 25 bp, Homo sapien
atttctctgagtagcttctgctatg

SEQ ID NO: 160701 - DNA, 25 bp, Homo sapien
agcttctgctatgatattcttatga

SEQ ID NO: 160702 - DNA, 25 bp, Homo sapien
gggcaactttctgtccactatagga

SEQ ID NO: 160703 - DNA, 25 bp, Homo sapien
cactataggagagaattcagccgaa

SEQ ID NO: 160704 - DNA, 25 bp, Homo sapien
ccagtcattggatcgtgttttcttt

SEQ ID NO: 160705 - DNA, 25 bp, Homo sapien
cattggatcgtgttttcttttgtcc

SEQ ID NO: 160706 - DNA, 25 bp, Homo sapien
tcttttgtccattattgtactgtgc

SEQ ID NO: 160707 - DNA, 25 bp, Homo sapien
gtgctgtaccacatttatttctata

SEQ ID NO: 160708 - DNA, 25 bp, Homo sapien
gggtgtcaggatcactcccactagg

SEQ ID NO: 160709 - DNA, 25 bp, Homo sapien
gtgtcaggatcactcccactaggga

SEQ ID NO: 160710 - DNA, 25 bp, Homo sapien
gtcaggatcactcccactagggact

SEQ ID NO: 160711 - DNA, 25 bp, Homo sapien
aggatcactcccactagggactctg

SEQ ID NO: 160712 - DNA, 25 bp, Homo sapien
gatcactcccactagggactctgcg

SEQ ID NO: 160713 - DNA, 25 bp, Homo sapien
tcccactagggactctgcgctaatt

SEQ ID NO: 160714 - DNA, 25 bp, Homo sapien
ccactagggactctgcgctaattac

SEQ ID NO: 160715 - DNA, 25 bp, Homo sapien
actagggactctgcgctaattacct

SEQ ID NO: 160716 - DNA, 25 bp, Homo sapien
agggactctgcgctaattacctgag

SEQ ID NO: 160717 - DNA, 25 bp, Homo sapien
gggactctgcgctaattacctgagc

SEQ ID NO: 160718 - DNA, 25 bp, Homo sapien
ggactctgcgctaattacctgagcg

SEQ ID NO: 160719 - DNA, 25 bp, Homo sapien
aatatattgaacttttgtactgaat

SEQ ID NO: 160720 - DNA, 25 bp, Homo sapien
gaaggcaatattaacctaatcacca

SEQ ID NO: 160721 - DNA, 25 bp, Homo sapien
atattaacctaatcaccatgtaagc

SEQ ID NO: 160722 - DNA, 25 bp, Homo sapien
atcaccatgtaagcactctggatga

SEQ ID NO: 160723 - DNA, 25 bp, Homo sapien
caccatgtaagcactctggatgatg

SEQ ID NO: 160724 - DNA, 25 bp, Homo sapien
atgtaagcactctggatgatggatt

SEQ ID NO: 160725 - DNA, 25 bp, Homo sapien
atgatggattccacaaaacttggtt

SEQ ID NO: 160726 - DNA, 25 bp, Homo sapien
ggattccacaaaacttggttttatg

SEQ ID NO: 160727 - DNA, 25 bp, Homo sapien
ggttacttcttctcttagattctta

SEQ ID NO: 160728 - DNA, 25 bp, Homo sapien
tagattcttaattcatgaggagggt

SEQ ID NO: 160729 - DNA, 25 bp, Homo sapien
ctattaaaatgcattcgttgtgttt

SEQ ID NO: 160730 - DNA, 25 bp, Homo sapien
ataatttcgctgtcatcggtcaaga

SEQ ID NO: 160731 - DNA, 25 bp, Homo sapien
gctgtcatcggtcaagactccagga

SEQ ID NO: 160732 - DNA, 25 bp, Homo sapien
gactccaggatgatattctgagcca

SEQ ID NO: 160733 - DNA, 25 bp, Homo sapien
gatgatattctgagccatatgttaa

SEQ ID NO: 160734 - DNA, 25 bp, Homo sapien
ttaattttgataaccacctagaaca

SEQ ID NO: 160735 - DNA, 25 bp, Homo sapien
aaacatgctaccatcttctattctc

SEQ ID NO: 160736 - DNA, 25 bp, Homo sapien
ttctattctcattgcaccactggat

SEQ ID NO: 160737 - DNA, 25 bp, Homo sapien
attctcattgcaccactggattctg

SEQ ID NO: 160738 - DNA, 25 bp, Homo sapien
gcaccactggattctggtacatcta

SEQ ID NO: 160739 - DNA, 25 bp, Homo sapien
ctggattctggtacatctaaaaatt

SEQ ID NO: 160740 - DNA, 25 bp, Homo sapien
aatgatatccaagaaatgctgtaaa

SEQ ID NO: 160741 - DNA, 25 bp, Homo sapien
gcctccctgactctgcttcttggga

SEQ ID NO: 160742 - DNA, 25 bp, Homo sapien
tcttgggagcatggtgagcagccct

SEQ ID NO: 160743 - DNA, 25 bp, Homo sapien
tggtgctcagcagccatacctatgg

SEQ ID NO: 160744 - DNA, 25 bp, Homo sapien
atacctatgggacacacactacgaa

SEQ ID NO: 160745 - DNA, 25 bp, Homo sapien
cacacactacgaaaaggatgccttt

SEQ ID NO: 160746 - DNA, 25 bp, Homo sapien
gattttactcctttcttcaacaact

SEQ ID NO: 160747 - DNA, 25 bp, Homo sapien
ttactcctttcttcaacaactattc

SEQ ID NO: 160748 - DNA, 25 bp, Homo sapien
tattcactggacaagttctctgctc

SEQ ID NO: 160749 - DNA, 25 bp, Homo sapien
ggacaagttctctgctcccatgacg

SEQ ID NO: 160750 - DNA, 25 bp, Homo sapien
ccatgacgcgccaggcacagttctg

SEQ ID NO: 160751 - DNA, 25 bp, Homo sapien
gtattgttctagtgggatacacaaa

SEQ ID NO: 160752 - DNA, 25 bp, Homo sapien
gcgttcccctttactcaaatctggg

SEQ ID NO: 160753 - DNA, 25 bp, Homo sapien
ttactcaaatctgggccttttggca

SEQ ID NO: 160754 - DNA, 25 bp, Homo sapien
agaagagcagtcatggccctgaggt

SEQ ID NO: 160755 - DNA, 25 bp, Homo sapien
tgaggtgggtcagctactctcctga

SEQ ID NO: 160756 - DNA, 25 bp, Homo sapien
actctcctgaagaaataggtctctt

SEQ ID NO: 160757 - DNA, 25 bp, Homo sapien
ggtctcttttatgctttaccatata

SEQ ID NO: 160758 - DNA, 25 bp, Homo sapien
ggatgcaatactcagacactagctt

SEQ ID NO: 160759 - DNA, 25 bp, Homo sapien
gacactagcttttttctcacttttg

SEQ ID NO: 160760 - DNA, 25 bp, Homo sapien
cacttttgtattataaccacctatg

SEQ ID NO: 160761 - DNA, 25 bp, Homo sapien
aaccacctatgtaatctcatgttgt

SEQ ID NO: 160762 - DNA, 25 bp, Homo sapien
acttatatgatttctatgcacacaa

SEQ ID NO: 160763 - DNA, 25 bp, Homo sapien
ttcttctgtgtctctatttctcttc

SEQ ID NO: 160764 - DNA, 25 bp, Homo sapien
tctatttctcttcctgtcacttaat

SEQ ID NO: 160765 - DNA, 25 bp, Homo sapien
cttcctgtcacttaatcttttcctt

SEQ ID NO: 160766 - DNA, 25 bp, Homo sapien
atctctcttatttagtcttccttcc

SEQ ID NO: 160767 - DNA, 25 bp, Homo sapien
accatcttttcccacaatcaaatat

SEQ ID NO: 160768 - DNA, 25 bp, Homo sapien
ccagcttccaactctagggattcat

SEQ ID NO: 160769 - DNA, 25 bp, Homo sapien
tgattctggtggagattccttcttc

SEQ ID NO: 160770 - DNA, 25 bp, Homo sapien
gatagggctaatcccaagggtgcct

SEQ ID NO: 160771 - DNA, 25 bp, Homo sapien
aagggtgcctgcttaggctatgtta

SEQ ID NO: 160772 - DNA, 25 bp, Homo sapien
tgttagctgtgacaggaacctgcca

SEQ ID NO: 160773 - DNA, 25 bp, Homo sapien
aggaacctgccatagatttgcactg

SEQ ID NO: 160774 - DNA, 25 bp, Homo sapien
ccagaaactctgtgtggtattagtt

SEQ ID NO: 160775 - DNA, 25 bp, Homo sapien
ggtattagtttgtatccagagggtg

SEQ ID NO: 160776 - DNA, 25 bp, Homo sapien
agagggtgaccctcttctcaaggaa

SEQ ID NO: 160777 - DNA, 25 bp, Homo sapien
gggactttctaccagactcacagag

SEQ ID NO: 160778 - DNA, 25 bp, Homo sapien
ttttgggaagggtgtgcgtgtcttt

SEQ ID NO: 160779 - DNA, 25 bp, Homo sapien
gttatagtggagacccagaggatga

SEQ ID NO: 160780 - DNA, 25 bp, Homo sapien
tgagaaaacttctctgcctcagcag

SEQ ID NO: 160781 - DNA, 25 bp, Homo sapien
tctctgcctcagcagaagagtggca

SEQ ID NO: 160782 - DNA, 25 bp, Homo sapien
gagaggcaagaaactcgcacccact

SEQ ID NO: 160783 - DNA, 25 bp, Homo sapien
aaactcgcacccactgtggactggg

SEQ ID NO: 160784 - DNA, 25 bp, Homo sapien
ggagaatgaaatccagaaactctgt

SEQ ID NO: 160785 - DNA, 25 bp, Homo sapien
gatccctgagccagtgtcaggagga

SEQ ID NO: 160786 - DNA, 25 bp, Homo sapien
ggaaggcttacacccacagtggaaa

SEQ ID NO: 160787 - DNA, 25 bp, Homo sapien
ggaaagacagcttctcatcctgcag

SEQ ID NO: 160788 - DNA, 25 bp, Homo sapien
cactagacaagtccagcctggcaag

SEQ ID NO: 160789 - DNA, 25 bp, Homo sapien
aagggttcacctgggctgaggcatc

SEQ ID NO: 160790 - DNA, 25 bp, Homo sapien
caggcttgcctgcaggcatgagtca

SEQ ID NO: 160791 - DNA, 25 bp, Homo sapien
gcatgagtcagtctgatgagaactc

SEQ ID NO: 160792 - DNA, 25 bp, Homo sapien
atgagaactctgagcagtgcttgaa

SEQ ID NO: 160793 - DNA, 25 bp, Homo sapien
ggcaaagactattcccttctaacct

SEQ ID NO: 160794 - DNA, 25 bp, Homo sapien
attcccttctaacctgaactgatgg

SEQ ID NO: 160795 - DNA, 25 bp, Homo sapien
agggaattgcagagtactggctgat

SEQ ID NO: 160796 - DNA, 25 bp, Homo sapien
gaccgcttcctgcagcgattccgaa

SEQ ID NO: 160797 - DNA, 25 bp, Homo sapien
tgcagcgattccgaagccagattga

SEQ ID NO: 160798 - DNA, 25 bp, Homo sapien
agcgattccgaagccagattgagac

SEQ ID NO: 160799 - DNA, 25 bp, Homo sapien
aagccagattgagacctgggagctg

SEQ ID NO: 160800 - DNA, 25 bp, Homo sapien
gtgatgggagcagtgacagcccttt

SEQ ID NO: 160801 - DNA, 25 bp, Homo sapien
gggagcagtgacagccctttctcag

SEQ ID NO: 160802 - DNA, 25 bp, Homo sapien
ctttctcaggccctgaatcgccatg

SEQ ID NO: 160803 - DNA, 25 bp, Homo sapien
tgaatcgccatgcagaggccctcaa

SEQ ID NO: 160804 - DNA, 25 bp, Homo sapien
agaggccctcaagtgaccctaggga

SEQ ID NO: 160805 - DNA, 25 bp, Homo sapien
gtgaccctagggaagaagcaagaaa

SEQ ID NO: 160806 - DNA, 25 bp, Homo sapien
gccaggtgctgctcagcagaggata

SEQ ID NO: 160807 - DNA, 25 bp, Homo sapien
tacagagtctgatgtgtgggcctat

SEQ ID NO: 160808 - DNA, 25 bp, Homo sapien
gggagatcttctcctatggcctgca

SEQ ID NO: 160809 - DNA, 25 bp, Homo sapien
gcagccctactatgggatggcccat

SEQ ID NO: 160810 - DNA, 25 bp, Homo sapien
gaggaggtcatttactacgtgcgag

SEQ ID NO: 160811 - DNA, 25 bp, Homo sapien
tacgtgcgagatggcaacatcctct

SEQ ID NO: 160812 - DNA, 25 bp, Homo sapien
tgccctgagaactgccccgtggagc

SEQ ID NO: 160813 - DNA, 25 bp, Homo sapien
ggagctgtacaatctcatgcgtcta

SEQ ID NO: 160814 - DNA, 25 bp, Homo sapien
atctcatgcgtctatgttggagcaa

SEQ ID NO: 160815 - DNA, 25 bp, Homo sapien
ccagtttcaccagtattcaccgaat

SEQ ID NO: 160816 - DNA, 25 bp, Homo sapien
gtattcaccgaattctggaacgcat

SEQ ID NO: 160817 - DNA, 25 bp, Homo sapien
cgaattctggaacgcatgtgtgaga

SEQ ID NO: 160818 - DNA, 25 bp, Homo sapien
gacaccctctctaagggtgagctga

SEQ ID NO: 160819 - DNA, 25 bp, Homo sapien
caaaggagcttgcaaacaccatcaa

SEQ ID NO: 160820 - DNA, 25 bp, Homo sapien
ccaaggcctggatgctaatcaagat

SEQ ID NO: 160821 - DNA, 25 bp, Homo sapien
gaacaggtcgactttcaagaattca

SEQ ID NO: 160822 - DNA, 25 bp, Homo sapien
gaattcatatccctggtagccattg

SEQ ID NO: 160823 - DNA, 25 bp, Homo sapien
atatccctggtagccattgcgctga

SEQ ID NO: 160824 - DNA, 25 bp, Homo sapien
ttgcgctgaaggctgcccattacca

SEQ ID NO: 160825 - DNA, 25 bp, Homo sapien
cattaccacacccacaaagagtagg

SEQ ID NO: 160826 - DNA, 25 bp, Homo sapien
gtagctctctgaaggctttttaccc

SEQ ID NO: 160827 - DNA, 25 bp, Homo sapien
gaaggctttttacccagcaatgtcc

SEQ ID NO: 160828 - DNA, 25 bp, Homo sapien
tcctcaatgagggtcttttctttcc

SEQ ID NO: 160829 - DNA, 25 bp, Homo sapien
agcgaagaacccagcaagtccctat

SEQ ID NO: 160830 - DNA, 25 bp, Homo sapien
aagtccctataaccttgcatataag

SEQ ID NO: 160831 - DNA, 25 bp, Homo sapien
gaatattccgtggttttcaacatgg

SEQ ID NO: 160832 - DNA, 25 bp, Homo sapien
ccgtggttttcaacatggtactttg

SEQ ID NO: 160833 - DNA, 25 bp, Homo sapien
tggtactttggataatgatcgcctt

SEQ ID NO: 160834 - DNA, 25 bp, Homo sapien
ataatgatcgccttggccttggctg

SEQ ID NO: 160835 - DNA, 25 bp, Homo sapien
ttggccttggctgtgattatcacct

SEQ ID NO: 160836 - DNA, 25 bp, Homo sapien
gattatcacctcttacaatatttgg

SEQ ID NO: 160837 - DNA, 25 bp, Homo sapien
tggatcctggatatgatagcatcat

SEQ ID NO: 160838 - DNA, 25 bp, Homo sapien
ggatgacaaaccagaagattcgaat

SEQ ID NO: 160839 - DNA, 25 bp, Homo sapien
gaatgttacctgtgccagaattaga

SEQ ID NO: 160840 - DNA, 25 bp, Homo sapien
agggtgggtgaattccagtgtggtc

SEQ ID NO: 160841 - DNA, 25 bp, Homo sapien
agtgtggtcagccagtcctccacag

SEQ ID NO: 160842 - DNA, 25 bp, Homo sapien
gtgtggtcagccagtcctccacagc

SEQ ID NO: 160843 - DNA, 25 bp, Homo sapien
tcgtggcccgtactcttgtgtctct

SEQ ID NO: 160844 - DNA, 25 bp, Homo sapien
ctcttgtgtctctcaagctaaaact

SEQ ID NO: 160845 - DNA, 25 bp, Homo sapien
ttgtgtctctcaagctaaaactgct

SEQ ID NO: 160846 - DNA, 25 bp, Homo sapien
gctaaaactgcttgaagttggtctc

SEQ ID NO: 160847 - DNA, 25 bp, Homo sapien
ctaaaactgcttgaagttggtctct

SEQ ID NO: 160848 - DNA, 25 bp, Homo sapien
ctgcttgaagttggtctctggacct

SEQ ID NO: 160849 - DNA, 25 bp, Homo sapien
tctctggacctctccttacttatta

SEQ ID NO: 160850 - DNA, 25 bp, Homo sapien
tctggacctctccttacttattaaa

SEQ ID NO: 160851 - DNA, 25 bp, Homo sapien
gcactcatcattagttaacaaagca

SEQ ID NO: 160852 - DNA, 25 bp, Homo sapien
aatatgttcatcactgtcaggctgc

SEQ ID NO: 160853 - DNA, 25 bp, Homo sapien
gcccacagcaacaccaagcatatta

SEQ ID NO: 160854 - DNA, 25 bp, Homo sapien
gaagaggaaccccaggaacgcaact

SEQ ID NO: 160855 - DNA, 25 bp, Homo sapien
ggaacgcaactcagaccttgggaaa

SEQ ID NO: 160856 - DNA, 25 bp, Homo sapien
taaaccatccttgtcagcagaagcc

SEQ ID NO: 160857 - DNA, 25 bp, Homo sapien
gcagtttgagcaatgaaatccgtaa

SEQ ID NO: 160858 - DNA, 25 bp, Homo sapien
gtaaatgcttcagtcaggactctga

SEQ ID NO: 160859 - DNA, 25 bp, Homo sapien
ggactctgagtctgatcatgaattt

SEQ ID NO: 160860 - DNA, 25 bp, Homo sapien
gtcttctggaatctcttttggtttg

SEQ ID NO: 160861 - DNA, 25 bp, Homo sapien
ttggtttggatattgggatgcttag

SEQ ID NO: 160862 - DNA, 25 bp, Homo sapien
caattacccctgacgtgactgaaaa

SEQ ID NO: 160863 - DNA, 25 bp, Homo sapien
ttacccctgacgtgactgaaaaatg

SEQ ID NO: 160864 - DNA, 25 bp, Homo sapien
atggagaaacaagacgggcctggat

SEQ ID NO: 160865 - DNA, 25 bp, Homo sapien
aagacgggcctggatatctacgaag

SEQ ID NO: 160866 - DNA, 25 bp, Homo sapien
cgggcctggatatctacgaaggata

SEQ ID NO: 160867 - DNA, 25 bp, Homo sapien
ctacgaaggatatggacagactgaa

SEQ ID NO: 160868 - DNA, 25 bp, Homo sapien
tggacagactgaaacggtgctaatc

SEQ ID NO: 160869 - DNA, 25 bp, Homo sapien
tgaaacggtgctaatctgtggaaat

SEQ ID NO: 160870 - DNA, 25 bp, Homo sapien
taaacctggctcaatgggaaaacct

SEQ ID NO: 160871 - DNA, 25 bp, Homo sapien
caatgggaaaaccttctcctgcttt

SEQ ID NO: 160872 - DNA, 25 bp, Homo sapien
accttctcctgctttcgatgttaag

SEQ ID NO: 160873 - DNA, 25 bp, Homo sapien
gaaacttaaatgattccagcctatt

SEQ ID NO: 160874 - DNA, 25 bp, Homo sapien
tgattccagcctatttgtatctgct

SEQ ID NO: 160875 - DNA, 25 bp, Homo sapien
tgtatctgctgaagagtttggccat

SEQ ID NO: 160876 - DNA, 25 bp, Homo sapien
gagtttggccatctattggatgaaa

SEQ ID NO: 160877 - DNA, 25 bp, Homo sapien
gggatccaagtttgataacattgca

SEQ ID NO: 160878 - DNA, 25 bp, Homo sapien
aacattgcatgaatgccatggctaa

SEQ ID NO: 160879 - DNA, 25 bp, Homo sapien
gaatgccatggctaacaaagataat

SEQ ID NO: 160880 - DNA, 25 bp, Homo sapien
agataatgcaagtctcaaacagctt

SEQ ID NO: 160881 - DNA, 25 bp, Homo sapien
tctcaaacagcttagatgggaggct

SEQ ID NO: 160882 - DNA, 25 bp, Homo sapien
aggctgaacgtgatgactggctaca

SEQ ID NO: 160883 - DNA, 25 bp, Homo sapien
gaacgtgatgactggctacacaaca

SEQ ID NO: 160884 - DNA, 25 bp, Homo sapien
ttaattttcagccatgtggaccata

SEQ ID NO: 160885 - DNA, 25 bp, Homo sapien
ttcagccatgtggaccatattttgt

SEQ ID NO: 160886 - DNA, 25 bp, Homo sapien
gaccatattttgtatccaaggatcc

SEQ ID NO: 160887 - DNA, 25 bp, Homo sapien
caaggatccttatttaaagctttca

SEQ ID NO: 160888 - DNA, 25 bp, Homo sapien
gagatagttctaaacacattcttga

SEQ ID NO: 160889 - DNA, 25 bp, Homo sapien
aacacattcttgatcaccaaacaac

SEQ ID NO: 160890 - DNA, 25 bp, Homo sapien
gacagtgactgtacagttatcatta

SEQ ID NO: 160891 - DNA, 25 bp, Homo sapien
catcatcataggtaacagttatatc

SEQ ID NO: 160892 - DNA, 25 bp, Homo sapien
atatcaagcttaatatgtgctgaac

SEQ ID NO: 160893 - DNA, 25 bp, Homo sapien
gtgctgaacattgttctgaacactt

SEQ ID NO: 160894 - DNA, 25 bp, Homo sapien
tctgaacactttaggtagatgaact

SEQ ID NO: 160895 - DNA, 25 bp, Homo sapien
catttgggctctggttttctggtgg

SEQ ID NO: 160896 - DNA, 25 bp, Homo sapien
agcctccttctgtttgtcgagcatt

SEQ ID NO: 160897 - DNA, 25 bp, Homo sapien
gtcgagcatttcttctactcttgag

SEQ ID NO: 160898 - DNA, 25 bp, Homo sapien
tactcttgagagctcaggcagcgtt

SEQ ID NO: 160899 - DNA, 25 bp, Homo sapien
agcgttagggctgcttaggtctcat

SEQ ID NO: 160900 - DNA, 25 bp, Homo sapien
taggtctcatggaccagtggctggt

SEQ ID NO: 160901 - DNA, 25 bp, Homo sapien
gtctcacccaactgcagtttactat

SEQ ID NO: 160902 - DNA, 25 bp, Homo sapien
agtttactattgctatcttttctgg

SEQ ID NO: 160903 - DNA, 25 bp, Homo sapien
ccataaatctattgtctacttgcga

SEQ ID NO: 160904 - DNA, 25 bp, Homo sapien
ctattgtctacttgcgattttttaa

SEQ ID NO: 160905 - DNA, 25 bp, Homo sapien
ttgttaaatcctttgcttcattcca

SEQ ID NO: 160906 - DNA, 25 bp, Homo sapien
tccaggcctccagagatccgtgagg

SEQ ID NO: 160907 - DNA, 25 bp, Homo sapien
gggtgtttgacatccacttgtaata

SEQ ID NO: 160908 - DNA, 25 bp, Homo sapien
tgacatccacttgtaatagatgctg

SEQ ID NO: 160909 - DNA, 25 bp, Homo sapien
atgctgtggttggatcaaggactca

SEQ ID NO: 160910 - DNA, 25 bp, Homo sapien
gtggttggatcaaggactcattcct

SEQ ID NO: 160911 - DNA, 25 bp, Homo sapien
actcattcctgccttggagaaaata

SEQ ID NO: 160912 - DNA, 25 bp, Homo sapien
tcctgccttggagaaaatacttcaa

SEQ ID NO: 160913 - DNA, 25 bp, Homo sapien
gtggcatgcagctgagggcagggcc

SEQ ID NO: 160914 - DNA, 25 bp, Homo sapien
ggctggtgtccctaaggttgtacag

SEQ ID NO: 160915 - DNA, 25 bp, Homo sapien
gtccctaaggttgtacagactcttg

SEQ ID NO: 160916 - DNA, 25 bp, Homo sapien
cagactcttgtgaatatttgtattt

SEQ ID NO: 160917 - DNA, 25 bp, Homo sapien
tatgtcgggacataccctatagaat

SEQ ID NO: 160918 - DNA, 25 bp, Homo sapien
tagaattactaaccttactgcccct

SEQ ID NO: 160919 - DNA, 25 bp, Homo sapien
ggttcttactggaatgtctaggcac

SEQ ID NO: 160920 - DNA, 25 bp, Homo sapien
gaatgtctaggcactgtacagttat

SEQ ID NO: 160921 - DNA, 25 bp, Homo sapien
atatatcttggttgttgtattgtac

SEQ ID NO: 160922 - DNA, 25 bp, Homo sapien
gttgtattgtaccagtgaaatgcca

SEQ ID NO: 160923 - DNA, 25 bp, Homo sapien
gaaatgccaaatttgaaaggcctgt

SEQ ID NO: 160924 - DNA, 25 bp, Homo sapien
gaaaggcctgtactgcaattttata

SEQ ID NO: 160925 - DNA, 25 bp, Homo sapien
atgtcagagattgcctgtggctcta

SEQ ID NO: 160926 - DNA, 25 bp, Homo sapien
gtggctctaatatgcacctcaagat

SEQ ID NO: 160927 - DNA, 25 bp, Homo sapien
ttagagagaatttctgcttccacta

SEQ ID NO: 160928 - DNA, 25 bp, Homo sapien
gaacatcctcaagagttgggatgga

SEQ ID NO: 160929 - DNA, 25 bp, Homo sapien
ggtgatttttacatgtgtcctggaa

SEQ ID NO: 160930 - DNA, 25 bp, Homo sapien
gagagtgatactgacctttttaagt

SEQ ID NO: 160931 - DNA, 25 bp, Homo sapien
agtcatagaccaaagtctgctgtag

SEQ ID NO: 160932 - DNA, 25 bp, Homo sapien
agtctgctgtagaacaaatatggga

SEQ ID NO: 160933 - DNA, 25 bp, Homo sapien
gaatcgcaaattcttcaaatgacta

SEQ ID NO: 160934 - DNA, 25 bp, Homo sapien
gtattattaacatgcgatgccacag

SEQ ID NO: 160935 - DNA, 25 bp, Homo sapien
gcgatgccacaggtatgaaagtctt

SEQ ID NO: 160936 - DNA, 25 bp, Homo sapien
gaaagtcttgccttatttcacaatt

SEQ ID NO: 160937 - DNA, 25 bp, Homo sapien
caattttaaaaggtagctgtgcaga

SEQ ID NO: 160938 - DNA, 25 bp, Homo sapien
gtagctgtgcagatgtggatcaaca

SEQ ID NO: 160939 - DNA, 25 bp, Homo sapien
tttacacttttactagctaaaacat

SEQ ID NO: 160940 - DNA, 25 bp, Homo sapien
aatcacaaagctttatcgtgttgta

SEQ ID NO: 160941 - DNA, 25 bp, Homo sapien
taatggcaataggtagagatacaac

SEQ ID NO: 160942 - DNA, 25 bp, Homo sapien
cactataacacttcatattttccaa

SEQ ID NO: 160943 - DNA, 25 bp, Homo sapien
atatctaaggtatacaaatctgtct

SEQ ID NO: 160944 - DNA, 25 bp, Homo sapien
ggtatacaaatctgtctacatgaag

SEQ ID NO: 160945 - DNA, 25 bp, Homo sapien
gtctacatgaagtttacagattggt

SEQ ID NO: 160946 - DNA, 25 bp, Homo sapien
gattggtaaatatcacctgctcaac

SEQ ID NO: 160947 - DNA, 25 bp, Homo sapien
gtaaatatcacctgctcaacatgta

SEQ ID NO: 160948 - DNA, 25 bp, Homo sapien
atatcacctgctcaacatgtaatta

SEQ ID NO: 160949 - DNA, 25 bp, Homo sapien
cacctgctcaacatgtaattattta

SEQ ID NO: 160950 - DNA, 25 bp, Homo sapien
cctggtgtccttgaccgcatgatga

SEQ ID NO: 160951 - DNA, 25 bp, Homo sapien
aactggacaccaacagtgatggtca

SEQ ID NO: 160952 - DNA, 25 bp, Homo sapien
ggacaccaacagtgatggtcagcta

SEQ ID NO: 160953 - DNA, 25 bp, Homo sapien
ggtcagctagatttctcagaatttc

SEQ ID NO: 160954 - DNA, 25 bp, Homo sapien
gtcagctagatttctcagaatttct

SEQ ID NO: 160955 - DNA, 25 bp, Homo sapien
agctagatttctcagaatttcttaa

SEQ ID NO: 160956 - DNA, 25 bp, Homo sapien
tcccttcccagaagcggacctgagg

SEQ ID NO: 160957 - DNA, 25 bp, Homo sapien
agaagcggacctgaggaccccttgg

SEQ ID NO: 160958 - DNA, 25 bp, Homo sapien
gaagcggacctgaggaccccttggc

SEQ ID NO: 160959 - DNA, 25 bp, Homo sapien
tgagcacactaaccacctcatgcag

SEQ ID NO: 160960 - DNA, 25 bp, Homo sapien
gagcacactaaccacctcatgcagg

SEQ ID NO: 160961 - DNA, 25 bp, Homo sapien
ttttcctgtaagacaataggccatg

SEQ ID NO: 160962 - DNA, 25 bp, Homo sapien
gacaataggccatgttaattaaact

SEQ ID NO: 160963 - DNA, 25 bp, Homo sapien
ggatatatttggctgggtgttttca

SEQ ID NO: 160964 - DNA, 25 bp, Homo sapien
gggtgttttcaaatgtcagcttaaa

SEQ ID NO: 160965 - DNA, 25 bp, Homo sapien
gaaattaaagtcttccattgcatgt

SEQ ID NO: 160966 - DNA, 25 bp, Homo sapien
aagtcttccattgcatgtattgtaa

SEQ ID NO: 160967 - DNA, 25 bp, Homo sapien
gagatgggtgattccttcaattcaa

SEQ ID NO: 160968 - DNA, 25 bp, Homo sapien
ccttcaattcaaaagctctctttgg

SEQ ID NO: 160969 - DNA, 25 bp, Homo sapien
aaagctctctttggaatgaacaatg

SEQ ID NO: 160970 - DNA, 25 bp, Homo sapien
caatgtgggcgtttgtaaattctgg

SEQ ID NO: 160971 - DNA, 25 bp, Homo sapien
gaaatgtctttctattcataataaa

SEQ ID NO: 160972 - DNA, 25 bp, Homo sapien
catcaccgtgccctacaaggtgtgg

SEQ ID NO: 160973 - DNA, 25 bp, Homo sapien
cctacaaggtgtgggccaagttcgg

SEQ ID NO: 160974 - DNA, 25 bp, Homo sapien
aaggtgtgggccaagttcggacaca

SEQ ID NO: 160975 - DNA, 25 bp, Homo sapien
tgtgggccaagttcggacacacctt

SEQ ID NO: 160976 - DNA, 25 bp, Homo sapien
aagttcggacacaccttctgcaagt

SEQ ID NO: 160977 - DNA, 25 bp, Homo sapien
ttcggacacaccttctgcaagtact

SEQ ID NO: 160978 - DNA, 25 bp, Homo sapien
gacacaccttctgcaagtactcgga

SEQ ID NO: 160979 - DNA, 25 bp, Homo sapien
acaccttctgcaagtactcggagga

SEQ ID NO: 160980 - DNA, 25 bp, Homo sapien
ccttctgcaagtactcggaggagat

SEQ ID NO: 160981 - DNA, 25 bp, Homo sapien
tctgcaagtactcggaggagatgaa

SEQ ID NO: 160982 - DNA, 25 bp, Homo sapien
gcagagggagaagcgggctgcctgt

SEQ ID NO: 160983 - DNA, 25 bp, Homo sapien
gggagtgctgccctcttaccatgca

SEQ ID NO: 160984 - DNA, 25 bp, Homo sapien
tgccctcttaccatgcacacgggtg

SEQ ID NO: 160985 - DNA, 25 bp, Homo sapien
acacgggtgctctccttttgggctg

SEQ ID NO: 160986 - DNA, 25 bp, Homo sapien
ttttgggctgcatgctattccattt

SEQ ID NO: 160987 - DNA, 25 bp, Homo sapien
tgggctgcatgctattccattttgc

SEQ ID NO: 160988 - DNA, 25 bp, Homo sapien
attttgcagccagaccgatgtgtat

SEQ ID NO: 160989 - DNA, 25 bp, Homo sapien
tgcagccagaccgatgtgtatttaa

SEQ ID NO: 160990 - DNA, 25 bp, Homo sapien
gccagaccgatgtgtatttaaccag

SEQ ID NO: 160991 - DNA, 25 bp, Homo sapien
gaccgatgtgtatttaaccagtcac

SEQ ID NO: 160992 - DNA, 25 bp, Homo sapien
gtatttaaccagtcactattgatgg

SEQ ID NO: 160993 - DNA, 25 bp, Homo sapien
tcccatctttttgttaccataaata

SEQ ID NO: 160994 - DNA, 25 bp, Homo sapien
gttctgcaccactggcatggatggc

SEQ ID NO: 160995 - DNA, 25 bp, Homo sapien
accactggcatggatggcggcatga

SEQ ID NO: 160996 - DNA, 25 bp, Homo sapien
gagcttggagtcagccttgaaggac

SEQ ID NO: 160997 - DNA, 25 bp, Homo sapien
gagtcagccttgaaggacctcaaga

SEQ ID NO: 160998 - DNA, 25 bp, Homo sapien
ggacctcaagatcaaatgacctgtg

SEQ ID NO: 160999 - DNA, 25 bp, Homo sapien
tgtgaggaatatgttgccttcatcc

SEQ ID NO: 161000 - DNA, 25 bp, Homo sapien
tcagggaggctaatggttgctttgc

SEQ ID NO: 161001 - DNA, 25 bp, Homo sapien
ggttgctttgctgaatgtttctggg

SEQ ID NO: 161002 - DNA, 25 bp, Homo sapien
ggtaccaatacgagttcccataggg

SEQ ID NO: 161003 - DNA, 25 bp, Homo sapien
agcttttcttacctattcaaggaat

SEQ ID NO: 161004 - DNA, 25 bp, Homo sapien
tcaaggaatacgtgcctttttctta

SEQ ID NO: 161005 - DNA, 25 bp, Homo sapien
tctttgggcagtatgtagttattta

SEQ ID NO: 161006 - DNA, 25 bp, Homo sapien
attcacgtaaatgccaaccatctac

SEQ ID NO: 161007 - DNA, 25 bp, Homo sapien
accctgttttggaattctgttctat

SEQ ID NO: 161008 - DNA, 25 bp, Homo sapien
ttctgttctattcctcagtatccag

SEQ ID NO: 161009 - DNA, 25 bp, Homo sapien
gtatccagaaagttactgacacagt

SEQ ID NO: 161010 - DNA, 25 bp, Homo sapien
gaaagttctaccctaagagccgcca

SEQ ID NO: 161011 - DNA, 25 bp, Homo sapien
taagagccgccatcacttcaggccg

SEQ ID NO: 161012 - DNA, 25 bp, Homo sapien
acttcaggccgctggtttgtcagcc

SEQ ID NO: 161013 - DNA, 25 bp, Homo sapien
gccatctgctgcttcttattgatag

SEQ ID NO: 161014 - DNA, 25 bp, Homo sapien
gctgcttcttattgatagatggcat

SEQ ID NO: 161015 - DNA, 25 bp, Homo sapien
gaatgtggtacaaagttagctctga

SEQ ID NO: 161016 - DNA, 25 bp, Homo sapien
aggtcatgcgccaacagctgacaga

SEQ ID NO: 161017 - DNA, 25 bp, Homo sapien
ctgacagagctgtaccgtgacattt

SEQ ID NO: 161018 - DNA, 25 bp, Homo sapien
agcaccttcgggatgaatcaggcaa

SEQ ID NO: 161019 - DNA, 25 bp, Homo sapien
tgaatcaggcaacagctactctcct

SEQ ID NO: 161020 - DNA, 25 bp, Homo sapien
tctcctgaagagtacgcgctgcaac

SEQ ID NO: 161021 - DNA, 25 bp, Homo sapien
aagagtacgcgctgcaacaggctgc

SEQ ID NO: 161022 - DNA, 25 bp, Homo sapien
aacaggctgccgatgggaccatctt

SEQ ID NO: 161023 - DNA, 25 bp, Homo sapien
gatgggaccatcttccttgtgcccc

SEQ ID NO: 161024 - DNA, 25 bp, Homo sapien
tggaggccacagactgagctggccc

SEQ ID NO: 161025 - DNA, 25 bp, Homo sapien
tccttcattcccttctgataaaggt

SEQ ID NO: 161026 - DNA, 25 bp, Homo sapien
tgataaaggtactccccaaccctga

SEQ ID NO: 161027 - DNA, 25 bp, Homo sapien
gagggtctgggaaatgagcagggat

SEQ ID NO: 161028 - DNA, 25 bp, Homo sapien
tttactagcacctgccagggaggcc

SEQ ID NO: 161029 - DNA, 25 bp, Homo sapien
ctgctgtgggttcccatcatttcct

SEQ ID NO: 161030 - DNA, 25 bp, Homo sapien
tgtgggttcccatcatttcctgtgt

SEQ ID NO: 161031 - DNA, 25 bp, Homo sapien
tgggttcccatcatttcctgtgtca

SEQ ID NO: 161032 - DNA, 25 bp, Homo sapien
gggttcccatcatttcctgtgtcag

SEQ ID NO: 161033 - DNA, 25 bp, Homo sapien
atttcctgtgtcagcgcctggccta

SEQ ID NO: 161034 - DNA, 25 bp, Homo sapien
ccagattgtatcatgtgctagattg

SEQ ID NO: 161035 - DNA, 25 bp, Homo sapien
gattgtatcatgtgctagattggag

SEQ ID NO: 161036 - DNA, 25 bp, Homo sapien
tgtatcatgtgctagattggagtgg

SEQ ID NO: 161037 - DNA, 25 bp, Homo sapien
aattcaataaatgcctataaccagc

SEQ ID NO: 161038 - DNA, 25 bp, Homo sapien
attgcgccagcattacagtaactaa

SEQ ID NO: 161039 - DNA, 25 bp, Homo sapien
taactctttctaaccaaccgtgatg

SEQ ID NO: 161040 - DNA, 25 bp, Homo sapien
gatgccacgtaacttaccctatgga

SEQ ID NO: 161041 - DNA, 25 bp, Homo sapien
gaatgactaacacatcctaggaggg

SEQ ID NO: 161042 - DNA, 25 bp, Homo sapien
gggaaagtccagtgtacctgtcatc

SEQ ID NO: 161043 - DNA, 25 bp, Homo sapien
agtgtacctgtcatcacggacgcac

SEQ ID NO: 161044 - DNA, 25 bp, Homo sapien
atcacggacgcactgtggtcacaga

SEQ ID NO: 161045 - DNA, 25 bp, Homo sapien
gtggtcacagactggaatacgaaat

SEQ ID NO: 161046 - DNA, 25 bp, Homo sapien
aatacgaaatactacagccctgctc

SEQ ID NO: 161047 - DNA, 25 bp, Homo sapien
ctcccaggtgtgcatcttactggat

SEQ ID NO: 161048 - DNA, 25 bp, Homo sapien
acatttgatttctaccaagagttga

SEQ ID NO: 161049 - DNA, 25 bp, Homo sapien
gccagggttcacattggccaagtta

SEQ ID NO: 161050 - DNA, 25 bp, Homo sapien
tggccaagttatcatgtccatccgc

SEQ ID NO: 161051 - DNA, 25 bp, Homo sapien
agttatcatgtccatccgcaccaag

SEQ ID NO: 161052 - DNA, 25 bp, Homo sapien
gagcatgtgattgaggccctgcgca

SEQ ID NO: 161053 - DNA, 25 bp, Homo sapien
agcatgtgattgaggccctgcgcag

SEQ ID NO: 161054 - DNA, 25 bp, Homo sapien
tgcgcagggccaagttcaagtttcc

SEQ ID NO: 161055 - DNA, 25 bp, Homo sapien
aagttcaagtttcctggccgccaga

SEQ ID NO: 161056 - DNA, 25 bp, Homo sapien
gggcttcaccaagttcaatgctgat

SEQ ID NO: 161057 - DNA, 25 bp, Homo sapien
gggtcaagtacatccccagtcgtgg

SEQ ID NO: 161058 - DNA, 25 bp, Homo sapien
gccctctggacaagtggcgggccct

SEQ ID NO: 161059 - DNA, 25 bp, Homo sapien
gccctgcactcatgagggcttccaa

SEQ ID NO: 161060 - DNA, 25 bp, Homo sapien
caagaagtttcccacttgtggatgt

SEQ ID NO: 161061 - DNA, 25 bp, Homo sapien
cacttgtggatgtttagtgcagcca

SEQ ID NO: 161062 - DNA, 25 bp, Homo sapien
agtgcagccacagacttgtattttg

SEQ ID NO: 161063 - DNA, 25 bp, Homo sapien
tttgaaagagttctcctcataggag

SEQ ID NO: 161064 - DNA, 25 bp, Homo sapien
ggaacccatagcttggtgtcattaa

SEQ ID NO: 161065 - DNA, 25 bp, Homo sapien
gcagccataatttgaataactctac

SEQ ID NO: 161066 - DNA, 25 bp, Homo sapien
taactctacgagaccagagagactg

SEQ ID NO: 161067 - DNA, 25 bp, Homo sapien
gagagactgtagttccctattttaa

SEQ ID NO: 161068 - DNA, 25 bp, Homo sapien
aaccccactgagaactaaatgctgt

SEQ ID NO: 161069 - DNA, 25 bp, Homo sapien
taaatgctgtaccacagagccgggt

SEQ ID NO: 161070 - DNA, 25 bp, Homo sapien
acagagccgggtgtgaactatggtt

SEQ ID NO: 161071 - DNA, 25 bp, Homo sapien
gctctgtgtcaatgttaacctgtct

SEQ ID NO: 161072 - DNA, 25 bp, Homo sapien
acctgtctcagatcaagtaattcct

SEQ ID NO: 161073 - DNA, 25 bp, Homo sapien
taattccttcactaggttgggtttg

SEQ ID NO: 161074 - DNA, 25 bp, Homo sapien
ggaaagactccttgaagtgttgcaa

SEQ ID NO: 161075 - DNA, 25 bp, Homo sapien
agtgttgcaagggaacctcctagca

SEQ ID NO: 161076 - DNA, 25 bp, Homo sapien
gaacctcctagcactgtgaaagtca

SEQ ID NO: 161077 - DNA, 25 bp, Homo sapien
gaaagtcagaatcgcctcagcattt

SEQ ID NO: 161078 - DNA, 25 bp, Homo sapien
ctcagcatttccatgacgcacatta

SEQ ID NO: 161079 - DNA, 25 bp, Homo sapien
acgcacattatgcaaatctctttag

SEQ ID NO: 161080 - DNA, 25 bp, Homo sapien
gggaagatttccaccaactgaatca

SEQ ID NO: 161081 - DNA, 25 bp, Homo sapien
tcatttgtgcacgtgtatagctcaa

SEQ ID NO: 161082 - DNA, 25 bp, Homo sapien
gtgggacagcatgggcactactctt

SEQ ID NO: 161083 - DNA, 25 bp, Homo sapien
tactcttcatgtgcggtgacaccag

SEQ ID NO: 161084 - DNA, 25 bp, Homo sapien
cagatgccttgaattaagtgtcctc

SEQ ID NO: 161085 - DNA, 25 bp, Homo sapien
aagtgtcctcacctttatgcatgac

SEQ ID NO: 161086 - DNA, 25 bp, Homo sapien
ttatgcatgactgcaaagccagctg

SEQ ID NO: 161087 - DNA, 25 bp, Homo sapien
aaagccagctggagcattttctatg

SEQ ID NO: 161088 - DNA, 25 bp, Homo sapien
gagcattttctatggagcctccgta

SEQ ID NO: 161089 - DNA, 25 bp, Homo sapien
gagcctccgtatgttttaggcccat

SEQ ID NO: 161090 - DNA, 25 bp, Homo sapien
taggcccatgaccttcgtgaggtga

SEQ ID NO: 161091 - DNA, 25 bp, Homo sapien
aggtgacgggcactcactcccatga

SEQ ID NO: 161092 - DNA, 25 bp, Homo sapien
tgttgtgtgcctatcggcagatcca

SEQ ID NO: 161093 - DNA, 25 bp, Homo sapien
atcagggagggctaaagttgtgtct

SEQ ID NO: 161094 - DNA, 25 bp, Homo sapien
gggctaaagttgtgtcttatgccaa

SEQ ID NO: 161095 - DNA, 25 bp, Homo sapien
gttgtgtcttatgccaagcggaagt

SEQ ID NO: 161096 - DNA, 25 bp, Homo sapien
atatcacttttcactttatcaactg

SEQ ID NO: 161097 - DNA, 25 bp, Homo sapien
ttcactttatcaactgagactttgg

SEQ ID NO: 161098 - DNA, 25 bp, Homo sapien
aattgacaactttagattctgaggc

SEQ ID NO: 161099 - DNA, 25 bp, Homo sapien
gattctgaggctaggctgagtactt

SEQ ID NO: 161100 - DNA, 25 bp, Homo sapien
gaggctaggctgagtacttattata

SEQ ID NO: 161101 - DNA, 25 bp, Homo sapien
gctgagtacttattatacggctaca

SEQ ID NO: 161102 - DNA, 25 bp, Homo sapien
attatacggctacatttacacattt

SEQ ID NO: 161103 - DNA, 25 bp, Homo sapien
acatttacacatttacacttatcta

SEQ ID NO: 161104 - DNA, 25 bp, Homo sapien
ggagatgatgtctgctttaagctgt

SEQ ID NO: 161105 - DNA, 25 bp, Homo sapien
gctttaagctgtaatgttttgccat

SEQ ID NO: 161106 - DNA, 25 bp, Homo sapien
ttgccatgttgcaaaaagccataat

SEQ ID NO: 161107 - DNA, 25 bp, Homo sapien
gttaatctggtttgtctgtccacca

SEQ ID NO: 161108 - DNA, 25 bp, Homo sapien
tgtccaccagagacagatcttctgt

SEQ ID NO: 161109 - DNA, 25 bp, Homo sapien
ttctgtgacagcctccttatgcagg

SEQ ID NO: 161110 - DNA, 25 bp, Homo sapien
gcctccttatgcaggtctatcatta

SEQ ID NO: 161111 - DNA, 25 bp, Homo sapien
ttctaaaatacttcactcacattgt

SEQ ID NO: 161112 - DNA, 25 bp, Homo sapien
tgtcatgttgacctcatttcatcgg

SEQ ID NO: 161113 - DNA, 25 bp, Homo sapien
gacctcatttcatcggaactgcagt

SEQ ID NO: 161114 - DNA, 25 bp, Homo sapien
actgcagtatatttttgttggttaa

SEQ ID NO: 161115 - DNA, 25 bp, Homo sapien
gagccaagctcatcttcattgaatg

SEQ ID NO: 161116 - DNA, 25 bp, Homo sapien
tcattgaatgtctcatttggccgag

SEQ ID NO: 161117 - DNA, 25 bp, Homo sapien
tttggccgaggaacaactgaacttt

SEQ ID NO: 161118 - DNA, 25 bp, Homo sapien
aactttgtggtttgctgtttagcct

SEQ ID NO: 161119 - DNA, 25 bp, Homo sapien
tgtttagccttcagtttgctccgct

SEQ ID NO: 161120 - DNA, 25 bp, Homo sapien
gcctcctacccagaggtttgtgcga

SEQ ID NO: 161121 - DNA, 25 bp, Homo sapien
ccagaggtttgtgcgagcctgtgtt

SEQ ID NO: 161122 - DNA, 25 bp, Homo sapien
tacttcgttagttttgcccattcag

SEQ ID NO: 161123 - DNA, 25 bp, Homo sapien
attcagccatggtcacgtgacatgc

SEQ ID NO: 161124 - DNA, 25 bp, Homo sapien
aagtaatcttgctcctaattataga

SEQ ID NO: 161125 - DNA, 25 bp, Homo sapien
accagactttactttgtactcagag

SEQ ID NO: 161126 - DNA, 25 bp, Homo sapien
caaaaactgcaagcttttcccaact

SEQ ID NO: 161127 - DNA, 25 bp, Homo sapien
ttcccaactttaaccttaccagcat

SEQ ID NO: 161128 - DNA, 25 bp, Homo sapien
ttaccagcatgttaatatccagttt

SEQ ID NO: 161129 - DNA, 25 bp, Homo sapien
aagttaaagtgcctcatattttgaa

SEQ ID NO: 161130 - DNA, 25 bp, Homo sapien
gaaaatatccattaaggacccagga

SEQ ID NO: 161131 - DNA, 25 bp, Homo sapien
gacccaggaattagcatttcacttg

SEQ ID NO: 161132 - DNA, 25 bp, Homo sapien
taacttgcaggaatggtatcgactc

SEQ ID NO: 161133 - DNA, 25 bp, Homo sapien
aatggtatcgactcgtgtttcctac

SEQ ID NO: 161134 - DNA, 25 bp, Homo sapien
tcgactcgtgtttcctactgcttta

SEQ ID NO: 161135 - DNA, 25 bp, Homo sapien
ttcctactgctttattctgtaaaca

SEQ ID NO: 161136 - DNA, 25 bp, Homo sapien
tgtagcaccatgaaacagacctctg

SEQ ID NO: 161137 - DNA, 25 bp, Homo sapien
ccctcagcaacaaagctcagctggg

SEQ ID NO: 161138 - DNA, 25 bp, Homo sapien
gaagaatgcttgaagtcagcgtctt

SEQ ID NO: 161139 - DNA, 25 bp, Homo sapien
atgcttgaagtcagcgtcttccatt

SEQ ID NO: 161140 - DNA, 25 bp, Homo sapien
tgaagtcagcgtcttccattccaga

SEQ ID NO: 161141 - DNA, 25 bp, Homo sapien
tatgatgtggaagctggtttcagcc

SEQ ID NO: 161142 - DNA, 25 bp, Homo sapien
tggaagctggtttcagcccaggacc

SEQ ID NO: 161143 - DNA, 25 bp, Homo sapien
accactgaggagaggatctagacag

SEQ ID NO: 161144 - DNA, 25 bp, Homo sapien
gaggatctagacaggtgggcctaat

SEQ ID NO: 161145 - DNA, 25 bp, Homo sapien
atctagacaggtgggcctaattcca

SEQ ID NO: 161146 - DNA, 25 bp, Homo sapien
ctggcctggagaaggccttttacac

SEQ ID NO: 161147 - DNA, 25 bp, Homo sapien
ggagaaggccttttacacacacaca

SEQ ID NO: 161148 - DNA, 25 bp, Homo sapien
ttatgggatctcaacgaaggcaaac

SEQ ID NO: 161149 - DNA, 25 bp, Homo sapien
gaaggcaaacacctttacacgctag

SEQ ID NO: 161150 - DNA, 25 bp, Homo sapien
gggacatcatcaacgccctgtgctt

SEQ ID NO: 161151 - DNA, 25 bp, Homo sapien
tgtgtgctgccacaggccccagcat

SEQ ID NO: 161152 - DNA, 25 bp, Homo sapien
acaggccccagcatcaagatctggg

SEQ ID NO: 161153 - DNA, 25 bp, Homo sapien
agcaagaagttatcagtaccagcag

SEQ ID NO: 161154 - DNA, 25 bp, Homo sapien
agaagttatcagtaccagcagcaag

SEQ ID NO: 161155 - DNA, 25 bp, Homo sapien
gttatcagtaccagcagcaaggcag

SEQ ID NO: 161156 - DNA, 25 bp, Homo sapien
gtaccagcagcaaggcagaaccacc

SEQ ID NO: 161157 - DNA, 25 bp, Homo sapien
acttccctggcctggtctgctgatg

SEQ ID NO: 161158 - DNA, 25 bp, Homo sapien
gatggccagactctgtttgctggct

SEQ ID NO: 161159 - DNA, 25 bp, Homo sapien
ttctcccttttttaggctgggcatg

SEQ ID NO: 161160 - DNA, 25 bp, Homo sapien
ggccgaggtgagacgggaagatggc

SEQ ID NO: 161161 - DNA, 25 bp, Homo sapien
gccgaggtgagacgggaagatggct

SEQ ID NO: 161162 - DNA, 25 bp, Homo sapien
ccgaggtgagacgggaagatggctt

SEQ ID NO: 161163 - DNA, 25 bp, Homo sapien
cgaggtgagacgggaagatggcttg

SEQ ID NO: 161164 - DNA, 25 bp, Homo sapien
gaagatggcttgaactcgggagttc

SEQ ID NO: 161165 - DNA, 25 bp, Homo sapien
gggcaacgtgatgagactccgtctc

SEQ ID NO: 161166 - DNA, 25 bp, Homo sapien
gccgggcgttgtggcttgtacctgt

SEQ ID NO: 161167 - DNA, 25 bp, Homo sapien
cgggcgttgtggcttgtacctgtgg

SEQ ID NO: 161168 - DNA, 25 bp, Homo sapien
gcgttgtggcttgtacctgtggtcc

SEQ ID NO: 161169 - DNA, 25 bp, Homo sapien
cggcctgggtgacagcatgagaacc

SEQ ID NO: 161170 - DNA, 25 bp, Homo sapien
agcctcggtgctgaagtgtgctgaa

SEQ ID NO: 161171 - DNA, 25 bp, Homo sapien
ctgaagcattgcagctgcctgtggt

SEQ ID NO: 161172 - DNA, 25 bp, Homo sapien
aagagtgggtgatccagtgcctcat

SEQ ID NO: 161173 - DNA, 25 bp, Homo sapien
gggtgatccagtgcctcattgttgg

SEQ ID NO: 161174 - DNA, 25 bp, Homo sapien
gattcaagcagcatccaaaatataa

SEQ ID NO: 161175 - DNA, 25 bp, Homo sapien
acacgattatgtttctcactaaaga

SEQ ID NO: 161176 - DNA, 25 bp, Homo sapien
agatacttggtcttactggttttat

SEQ ID NO: 161177 - DNA, 25 bp, Homo sapien
tttattccctgctatcgtggagatt

SEQ ID NO: 161178 - DNA, 25 bp, Homo sapien
gtgtcttgtgtgtaactggattcct

SEQ ID NO: 161179 - DNA, 25 bp, Homo sapien
gtaactggattccttgcatggatct

SEQ ID NO: 161180 - DNA, 25 bp, Homo sapien
tccttgcatggatcttgtatatagt

SEQ ID NO: 161181 - DNA, 25 bp, Homo sapien
ttaacttgtgttcagcctttttgta

SEQ ID NO: 161182 - DNA, 25 bp, Homo sapien
tgtgttcagcctttttgtaactttt

SEQ ID NO: 161183 - DNA, 25 bp, Homo sapien
tttgaaagtgcaaacaattctttgg

SEQ ID NO: 161184 - DNA, 25 bp, Homo sapien
aggtatacagtatgcatggtttctc

SEQ ID NO: 161185 - DNA, 25 bp, Homo sapien
cagtatgcatggtttctcaaattta

SEQ ID NO: 161186 - DNA, 25 bp, Homo sapien
gcatggtttctcaaatttagtttta

SEQ ID NO: 161187 - DNA, 25 bp, Homo sapien
aagtctataaagaatcagatgcata

SEQ ID NO: 161188 - DNA, 25 bp, Homo sapien
gatgcataggcaatatgttaagttc

SEQ ID NO: 161189 - DNA, 25 bp, Homo sapien
taagttcacttggaggctaaaaatc

SEQ ID NO: 161190 - DNA, 25 bp, Homo sapien
gtatgcattgaagatctgtttctac

SEQ ID NO: 161191 - DNA, 25 bp, Homo sapien
attgaagatctgtttctaccaataa

SEQ ID NO: 161192 - DNA, 25 bp, Homo sapien
cttctgttgctggtgtactctagga

SEQ ID NO: 161193 - DNA, 25 bp, Homo sapien
gctggtgtactctaggacttcaaag

SEQ ID NO: 161194 - DNA, 25 bp, Homo sapien
gacttcaaagtgtgtctgggatttt

SEQ ID NO: 161195 - DNA, 25 bp, Homo sapien
aaatgaactgatgcctaaatatgcc

SEQ ID NO: 161196 - DNA, 25 bp, Homo sapien
aaggcagccagtgcaccgaccgatt

SEQ ID NO: 161197 - DNA, 25 bp, Homo sapien
agtgcaccgaccgatttgtagtctg

SEQ ID NO: 161198 - DNA, 25 bp, Homo sapien
tttgtagtctgctcaatctctgttg

SEQ ID NO: 161199 - DNA, 25 bp, Homo sapien
gctcaatctctgttgcacctgaggg

SEQ ID NO: 161200 - DNA, 25 bp, Homo sapien
aaacagttcaactgcttactcccaa

SEQ ID NO: 161201 - DNA, 25 bp, Homo sapien
gtatcagatgtgaagcctggagctt

SEQ ID NO: 161202 - DNA, 25 bp, Homo sapien
tcctgatgatgctggccctacagta

SEQ ID NO: 161203 - DNA, 25 bp, Homo sapien
acttcagttgatcttttgaccaaga

SEQ ID NO: 161204 - DNA, 25 bp, Homo sapien
gatcttttgaccaagacctcaagag

SEQ ID NO: 161205 - DNA, 25 bp, Homo sapien
agacctcaagagagccagaactacc

SEQ ID NO: 161206 - DNA, 25 bp, Homo sapien
aagtgcttattgtttaacaccatta

SEQ ID NO: 161207 - DNA, 25 bp, Homo sapien
gcgacagataactatacagctcaac

SEQ ID NO: 161208 - DNA, 25 bp, Homo sapien
taaactgtttacctgccttaattat

SEQ ID NO: 161209 - DNA, 25 bp, Homo sapien
atctttagttccttattagttctca

SEQ ID NO: 161210 - DNA, 25 bp, Homo sapien
gttctcaagaaacaaatgctagctt

SEQ ID NO: 161211 - DNA, 25 bp, Homo sapien
caaatgctagcttcatatgtatggc

SEQ ID NO: 161212 - DNA, 25 bp, Homo sapien
atgtatggctgttgctttgcttcat

SEQ ID NO: 161213 - DNA, 25 bp, Homo sapien
gttgctttgcttcatgtgtatggct

SEQ ID NO: 161214 - DNA, 25 bp, Homo sapien
ggacagatgaatgccgtggattgca

SEQ ID NO: 161215 - DNA, 25 bp, Homo sapien
taaaacatcataaggccagggcccc

SEQ ID NO: 161216 - DNA, 25 bp, Homo sapien
ccaggcctgaaagaggctgaggcct

SEQ ID NO: 161217 - DNA, 25 bp, Homo sapien
tggactttcctgcaactcaaggact

SEQ ID NO: 161218 - DNA, 25 bp, Homo sapien
tgcaactcaaggactttgcagccgg

SEQ ID NO: 161219 - DNA, 25 bp, Homo sapien
tttgcagccggcacagggtctgctc

SEQ ID NO: 161220 - DNA, 25 bp, Homo sapien
ggcacagggtctgctctttctctgc

SEQ ID NO: 161221 - DNA, 25 bp, Homo sapien
gtgacagacaggctcttagcagctt

SEQ ID NO: 161222 - DNA, 25 bp, Homo sapien
aggctcttagcagcttccagattga

SEQ ID NO: 161223 - DNA, 25 bp, Homo sapien
agcagcttccagattgacgacaagt

SEQ ID NO: 161224 - DNA, 25 bp, Homo sapien
agattgacgacaagtgctgaacagt

SEQ ID NO: 161225 - DNA, 25 bp, Homo sapien
ttaatatcacagcataaccccaccc

SEQ ID NO: 161226 - DNA, 25 bp, Homo sapien
ctttcatgtaagtagcaaacagggc

SEQ ID NO: 161227 - DNA, 25 bp, Homo sapien
caaacagggctttactatcttttca

SEQ ID NO: 161228 - DNA, 25 bp, Homo sapien
ttatcgactgtgtcatgacaaggaa

SEQ ID NO: 161229 - DNA, 25 bp, Homo sapien
ggaaacttacaaactgcaacgcaga

SEQ ID NO: 161230 - DNA, 25 bp, Homo sapien
actgcaacgcagagaaactattaaa

SEQ ID NO: 161231 - DNA, 25 bp, Homo sapien
gtattcagaaacgtgaagccagcaa

SEQ ID NO: 161232 - DNA, 25 bp, Homo sapien
aagccagcaattgtttcgcaattcg

SEQ ID NO: 161233 - DNA, 25 bp, Homo sapien
attgtttcgcaattcggcattttga

SEQ ID NO: 161234 - DNA, 25 bp, Homo sapien
tcgcaattcggcattttgaaaacaa

SEQ ID NO: 161235 - DNA, 25 bp, Homo sapien
tgccgtggaaactttaatttgttct

SEQ ID NO: 161236 - DNA, 25 bp, Homo sapien
gagactcaaatggtactttcttcgt

SEQ ID NO: 161237 - DNA, 25 bp, Homo sapien
tactttcttcgtttaccatgctatc

SEQ ID NO: 161238 - DNA, 25 bp, Homo sapien
cttcgtttaccatgctatctatcta

SEQ ID NO: 161239 - DNA, 25 bp, Homo sapien
aaaattgctcagcttttcagcattt

SEQ ID NO: 161240 - DNA, 25 bp, Homo sapien
ttttcagcatttccccttgccagat

SEQ ID NO: 161241 - DNA, 25 bp, Homo sapien
ccttgccagatcagccagatttaca

SEQ ID NO: 161242 - DNA, 25 bp, Homo sapien
agatcagccagatttacaagcaggg

SEQ ID NO: 161243 - DNA, 25 bp, Homo sapien
gggccaacaggaattcatgtgctca

SEQ ID NO: 161244 - DNA, 25 bp, Homo sapien
ggaattcatgtgctcatcagtgatg

SEQ ID NO: 161245 - DNA, 25 bp, Homo sapien
gagatgatacagaactttcaggaag

SEQ ID NO: 161246 - DNA, 25 bp, Homo sapien
aagcatgttttattctggacacaat

SEQ ID NO: 161247 - DNA, 25 bp, Homo sapien
gggatgtggatcaggtttactagca

SEQ ID NO: 161248 - DNA, 25 bp, Homo sapien
tttactagcacctgccagggaggcc

SEQ ID NO: 161249 - DNA, 25 bp, Homo sapien
ctgctgtgggttcccatcatttcct

SEQ ID NO: 161250 - DNA, 25 bp, Homo sapien
tgtgggttcccatcatttcctgtgt

SEQ ID NO: 161251 - DNA, 25 bp, Homo sapien
tgggttcccatcatttcctgtgtca

SEQ ID NO: 161252 - DNA, 25 bp, Homo sapien
gggttcccatcatttcctgtgtcag

SEQ ID NO: 161253 - DNA, 25 bp, Homo sapien
atttcctgtgtcagcgcctggccta

SEQ ID NO: 161254 - DNA, 25 bp, Homo sapien
ctggcctacccagattgtatcatgt

SEQ ID NO: 161255 - DNA, 25 bp, Homo sapien
ccagattgtatcatgtgctagattg

SEQ ID NO: 161256 - DNA, 25 bp, Homo sapien
tgtatcatgtgctagattggagtgg

SEQ ID NO: 161257 - DNA, 25 bp, Homo sapien
aattcaataaatgcctataaccagc

SEQ ID NO: 161258 - DNA, 25 bp, Homo sapien
atgatgcatgtgatctgggccgcac

SEQ ID NO: 161259 - DNA, 25 bp, Homo sapien
gggccgcactggcatttgcagctat

SEQ ID NO: 161260 - DNA, 25 bp, Homo sapien
tttgcagctattcagctgctgggca

SEQ ID NO: 161261 - DNA, 25 bp, Homo sapien
tgtgtgcttgcatcgtgttgtgcag

SEQ ID NO: 161262 - DNA, 25 bp, Homo sapien
agtagagatcctgcttacgagctcc

SEQ ID NO: 161263 - DNA, 25 bp, Homo sapien
tacgagctcctcatcactggcggaa

SEQ ID NO: 161264 - DNA, 25 bp, Homo sapien
tcactggcggaacctatgcatagtt

SEQ ID NO: 161265 - DNA, 25 bp, Homo sapien
tttttggtcttgttctgatttggaa

SEQ ID NO: 161266 - DNA, 25 bp, Homo sapien
cctctggagttcatttagttaaagc

SEQ ID NO: 161267 - DNA, 25 bp, Homo sapien
taaagcacatgtacactggtgttgg

SEQ ID NO: 161268 - DNA, 25 bp, Homo sapien
acactggtgttggacagagcagctt

SEQ ID NO: 161269 - DNA, 25 bp, Homo sapien
gtatgtttttagattgtattttgcc

SEQ ID NO: 161270 - DNA, 25 bp, Homo sapien
gtattttgccttacagaaagccttt

SEQ ID NO: 161271 - DNA, 25 bp, Homo sapien
gaaagcctttattgtaagactctga

SEQ ID NO: 161272 - DNA, 25 bp, Homo sapien
gcctttattgtaagactctgatttc

SEQ ID NO: 161273 - DNA, 25 bp, Homo sapien
actctgatttccctttggacttcat

SEQ ID NO: 161274 - DNA, 25 bp, Homo sapien
gatttccctttggacttcatgtata

SEQ ID NO: 161275 - DNA, 25 bp, Homo sapien
ttccctttggacttcatgtatattg

SEQ ID NO: 161276 - DNA, 25 bp, Homo sapien
ggacttcatgtatattgtacagtta

SEQ ID NO: 161277 - DNA, 25 bp, Homo sapien
gtacagttacagtaaaattcaacct

SEQ ID NO: 161278 - DNA, 25 bp, Homo sapien
ggcatcttacaaattttgccccttt

SEQ ID NO: 161279 - DNA, 25 bp, Homo sapien
acagatgcatatgtccaatataaaa

SEQ ID NO: 161280 - DNA, 25 bp, Homo sapien
gaaaagagcttgtccatgaacccag

SEQ ID NO: 161281 - DNA, 25 bp, Homo sapien
agagcttgtccatgaacccaggttc

SEQ ID NO: 161282 - DNA, 25 bp, Homo sapien
tgtccatgaacccaggttctcactc

SEQ ID NO: 161283 - DNA, 25 bp, Homo sapien
ggttctcactctgtttacagaagtg

SEQ ID NO: 161284 - DNA, 25 bp, Homo sapien
tttacagaagtgtgttgagtacagt

SEQ ID NO: 161285 - DNA, 25 bp, Homo sapien
tccatgaaaatgacttccagaaaag

SEQ ID NO: 161286 - DNA, 25 bp, Homo sapien
aaggaagaatatgaaccccagaccg

SEQ ID NO: 161287 - DNA, 25 bp, Homo sapien
atagtattatctaacctggttggta

SEQ ID NO: 161288 - DNA, 25 bp, Homo sapien
ctaacctggttggtatttgtaatga

SEQ ID NO: 161289 - DNA, 25 bp, Homo sapien
ggtgattttaattagtcattagcca

SEQ ID NO: 161290 - DNA, 25 bp, Homo sapien
gtataactcctgaatgctacttaaa

SEQ ID NO: 161291 - DNA, 25 bp, Homo sapien
atctttgccgcctttgccgtgatga

SEQ ID NO: 161292 - DNA, 25 bp, Homo sapien
gcctttgccgtgatgaccgtggcta

SEQ ID NO: 161293 - DNA, 25 bp, Homo sapien
ttgccgtgatgaccgtggctatcct

SEQ ID NO: 161294 - DNA, 25 bp, Homo sapien
cgtgatgaccgtggctatcctgctg

SEQ ID NO: 161295 - DNA, 25 bp, Homo sapien
ggtgatggagggactctcagccttc

SEQ ID NO: 161296 - DNA, 25 bp, Homo sapien
tggagggactctcagccttcctgca

SEQ ID NO: 161297 - DNA, 25 bp, Homo sapien
tgcggctgcactgggtggaattcca

SEQ ID NO: 161298 - DNA, 25 bp, Homo sapien
acaagttctactcaggcacgggcta

SEQ ID NO: 161299 - DNA, 25 bp, Homo sapien
gttctactcaggcacgggctacaag

SEQ ID NO: 161300 - DNA, 25 bp, Homo sapien
tcaggcacgggctacaagctgagtc

SEQ ID NO: 161301 - DNA, 25 bp, Homo sapien
acgggctacaagctgagtcccttca

SEQ ID NO: 161302 - DNA, 25 bp, Homo sapien
ccctcagcaacaaagctcagctggg

SEQ ID NO: 161303 - DNA, 25 bp, Homo sapien
gaatgcttgaagtcagcgtcttcca

SEQ ID NO: 161304 - DNA, 25 bp, Homo sapien
tgaagtcagcgtcttccattccaga

SEQ ID NO: 161305 - DNA, 25 bp, Homo sapien
tatgatgtggaagctggtttcagcc

SEQ ID NO: 161306 - DNA, 25 bp, Homo sapien
tggaagctggtttcagcccaggacc

SEQ ID NO: 161307 - DNA, 25 bp, Homo sapien
ggacccaccactgaggagaggatct

SEQ ID NO: 161308 - DNA, 25 bp, Homo sapien
gaggatctagacaggtgggcctaat

SEQ ID NO: 161309 - DNA, 25 bp, Homo sapien
atctagacaggtgggcctaattcca

SEQ ID NO: 161310 - DNA, 25 bp, Homo sapien
ctggcctggagaaggccttttacac

SEQ ID NO: 161311 - DNA, 25 bp, Homo sapien
ggagaaggccttttacacacacaca

SEQ ID NO: 161312 - DNA, 25 bp, Homo sapien
cacatatcacagttttcacacagcc

SEQ ID NO: 161313 - DNA, 25 bp, Homo sapien
tctgataccttgatgtaatttcaca

SEQ ID NO: 161314 - DNA, 25 bp, Homo sapien
gtaatttcacaatacagttccaatt

SEQ ID NO: 161315 - DNA, 25 bp, Homo sapien
acaatacagttccaatttttatggc

SEQ ID NO: 161316 - DNA, 25 bp, Homo sapien
attacaatgatattttcttctataa

SEQ ID NO: 161317 - DNA, 25 bp, Homo sapien
gaagtataagcctctactgggtcta

SEQ ID NO: 161318 - DNA, 25 bp, Homo sapien
gtataagcctctactgggtctatat

SEQ ID NO: 161319 - DNA, 25 bp, Homo sapien
ataagcctctactgggtctatattg

SEQ ID NO: 161320 - DNA, 25 bp, Homo sapien
gcctctactgggtctatattgtgaa

SEQ ID NO: 161321 - DNA, 25 bp, Homo sapien
actgggtctatattgtgaatcatcc

SEQ ID NO: 161322 - DNA, 25 bp, Homo sapien
gtctatattgtgaatcatcctgcct

SEQ ID NO: 161323 - DNA, 25 bp, Homo sapien
ctatattgtgaatcatcctgccttt

SEQ ID NO: 161324 - DNA, 25 bp, Homo sapien
gtctttgtggaaaccactgttacag

SEQ ID NO: 161325 - DNA, 25 bp, Homo sapien
gcttatttccaaagccacctcattt

SEQ ID NO: 161326 - DNA, 25 bp, Homo sapien
ctcatttccaaacatctcactcagg

SEQ ID NO: 161327 - DNA, 25 bp, Homo sapien
gaagggaggctcaatgtaacctcag

SEQ ID NO: 161328 - DNA, 25 bp, Homo sapien
ggttctgcttggaaaatgatgccct

SEQ ID NO: 161329 - DNA, 25 bp, Homo sapien
aatgatgccctgcaactaaccctgg

SEQ ID NO: 161330 - DNA, 25 bp, Homo sapien
cctggtctttcccatggcaatttaa

SEQ ID NO: 161331 - DNA, 25 bp, Homo sapien
catggcaatttaaccacatttggaa

SEQ ID NO: 161332 - DNA, 25 bp, Homo sapien
gaatgccaaccttcaggttctagaa

SEQ ID NO: 161333 - DNA, 25 bp, Homo sapien
gttctagaagattggttgcactccc

SEQ ID NO: 161334 - DNA, 25 bp, Homo sapien
gcactcccaaacctttattctatta

SEQ ID NO: 161335 - DNA, 25 bp, Homo sapien
taacattcttatccctttcttgact

SEQ ID NO: 161336 - DNA, 25 bp, Homo sapien
cattcttatccctttcttgactaaa

SEQ ID NO: 161337 - DNA, 25 bp, Homo sapien
tcttatccctttcttgactaaattt

SEQ ID NO: 161338 - DNA, 25 bp, Homo sapien
ttgactaaatttaaatacttcttgg

SEQ ID NO: 161339 - DNA, 25 bp, Homo sapien
tacttcttggtatttgggagctgga

SEQ ID NO: 161340 - DNA, 25 bp, Homo sapien
tgggagctggattcttgtcaactgc

SEQ ID NO: 161341 - DNA, 25 bp, Homo sapien
gctggattcttgtcaactgctgtat

SEQ ID NO: 161342 - DNA, 25 bp, Homo sapien
gattcttgtcaactgctgtataaaa

SEQ ID NO: 161343 - DNA, 25 bp, Homo sapien
ataaaatatactcacccaaccattg

SEQ ID NO: 161344 - DNA, 25 bp, Homo sapien
taagataattgggagctgagcataa

SEQ ID NO: 161345 - DNA, 25 bp, Homo sapien
tgggagctgagcataaaacattatt

SEQ ID NO: 161346 - DNA, 25 bp, Homo sapien
ctataggcatgaggcgctgcacttg

SEQ ID NO: 161347 - DNA, 25 bp, Homo sapien
gctgcacttggcctgatactgattt

SEQ ID NO: 161348 - DNA, 25 bp, Homo sapien
acttggcctgatactgatttttatt

SEQ ID NO: 161349 - DNA, 25 bp, Homo sapien
gatttttattccttgcgttatcaca

SEQ ID NO: 161350 - DNA, 25 bp, Homo sapien
ttccttgcgttatcacatagtgttg

SEQ ID NO: 161351 - DNA, 25 bp, Homo sapien
aacatagttcatggttttatcaaag

SEQ ID NO: 161352 - DNA, 25 bp, Homo sapien
gaatactggtcatctaactttgtaa

SEQ ID NO: 161353 - DNA, 25 bp, Homo sapien
tgtaaagtttgacagtcccatttta

SEQ ID NO: 161354 - DNA, 25 bp, Homo sapien
gacagtcccattttaacctgcgttt

SEQ ID NO: 161355 - DNA, 25 bp, Homo sapien
aacctgcgtttgtatctattactaa

SEQ ID NO: 161356 - DNA, 25 bp, Homo sapien
actgattcatggttggtatgtacaa

SEQ ID NO: 161357 - DNA, 25 bp, Homo sapien
aaggttgtagatatttccggtatat

SEQ ID NO: 161358 - DNA, 25 bp, Homo sapien
gatatttccggtatattttaaagca

SEQ ID NO: 161359 - DNA, 25 bp, Homo sapien
aagcaagatcaccaaatcttaggga

SEQ ID NO: 161360 - DNA, 25 bp, Homo sapien
agatcaccaaatcttagggaagaaa

SEQ ID NO: 161361 - DNA, 25 bp, Homo sapien
gaaaattaagcggatgaagagatct

SEQ ID NO: 161362 - DNA, 25 bp, Homo sapien
acagtattgtaaatccaagactctg

SEQ ID NO: 161363 - DNA, 25 bp, Homo sapien
gtattgtaaatccaagactctgata

SEQ ID NO: 161364 - DNA, 25 bp, Homo sapien
gtaaatccaagactctgatactgaa

SEQ ID NO: 161365 - DNA, 25 bp, Homo sapien
actctgatactgaattttagttatt

SEQ ID NO: 161366 - DNA, 25 bp, Homo sapien
gaattttagttatttcacagttgta

SEQ ID NO: 161367 - DNA, 25 bp, Homo sapien
atttcacagttgtagctacacagta

SEQ ID NO: 161368 - DNA, 25 bp, Homo sapien
agaaggagctaccaggcttcctgca

SEQ ID NO: 161369 - DNA, 25 bp, Homo sapien
accaggcttcctgcagagtggaaaa

SEQ ID NO: 161370 - DNA, 25 bp, Homo sapien
gatgccgtggataaattgctcaagg

SEQ ID NO: 161371 - DNA, 25 bp, Homo sapien
tggacgccaatggagatgcccaggt

SEQ ID NO: 161372 - DNA, 25 bp, Homo sapien
ggacttcagtgagttcatcgtgttc

SEQ ID NO: 161373 - DNA, 25 bp, Homo sapien
gtgttcgtggctgcaatcacgtctg

SEQ ID NO: 161374 - DNA, 25 bp, Homo sapien
gtctgcctgtcacaagtactttgag

SEQ ID NO: 161375 - DNA, 25 bp, Homo sapien
aggactcaaatgatgccctggagat

SEQ ID NO: 161376 - DNA, 25 bp, Homo sapien
atggtcccaggcttcccaaaagtgt

SEQ ID NO: 161377 - DNA, 25 bp, Homo sapien
gtttgttggcaattattcccctagg

SEQ ID NO: 161378 - DNA, 25 bp, Homo sapien
caattattcccctaggctgagcctg

SEQ ID NO: 161379 - DNA, 25 bp, Homo sapien
gtgggaaataacttgcaacgtctgt

SEQ ID NO: 161380 - DNA, 25 bp, Homo sapien
aacgtctgttagagatggttgctac

SEQ ID NO: 161381 - DNA, 25 bp, Homo sapien
tggttgctacacatgttgggtctgt

SEQ ID NO: 161382 - DNA, 25 bp, Homo sapien
ttgggtctgtagagaaacatcttga

SEQ ID NO: 161383 - DNA, 25 bp, Homo sapien
aacatcttgaggagcagattgctaa

SEQ ID NO: 161384 - DNA, 25 bp, Homo sapien
aatgcatgtcagaagatctctcgga

SEQ ID NO: 161385 - DNA, 25 bp, Homo sapien
gaagatctctcggaaaatattaaag

SEQ ID NO: 161386 - DNA, 25 bp, Homo sapien
gtatgagaagaaagctactctaatt

SEQ ID NO: 161387 - DNA, 25 bp, Homo sapien
gctactctaattaagtcttctgaag

SEQ ID NO: 161388 - DNA, 25 bp, Homo sapien
aatgttgatcatgtatatatatcca

SEQ ID NO: 161389 - DNA, 25 bp, Homo sapien
tatccatagtgaataaaattgtctc

SEQ ID NO: 161390 - DNA, 25 bp, Homo sapien
tgggctgctaacctggcctgctcag

SEQ ID NO: 161391 - DNA, 25 bp, Homo sapien
ggctcccacgtccaggcttaaggtg

SEQ ID NO: 161392 - DNA, 25 bp, Homo sapien
gcttaaggtggatgcacttcccgca

SEQ ID NO: 161393 - DNA, 25 bp, Homo sapien
gcacctccagtcttctgtgtagcag

SEQ ID NO: 161394 - DNA, 25 bp, Homo sapien
tgtgtagcagctttaacccacgttt

SEQ ID NO: 161395 - DNA, 25 bp, Homo sapien
agctttaacccacgtttgtctgtca

SEQ ID NO: 161396 - DNA, 25 bp, Homo sapien
ttgtctgtcacgtccagtcccgaga

SEQ ID NO: 161397 - DNA, 25 bp, Homo sapien
gtccagtcccgagacggctgagtga

SEQ ID NO: 161398 - DNA, 25 bp, Homo sapien
gagacggctgagtgaccccaagaaa

SEQ ID NO: 161399 - DNA, 25 bp, Homo sapien
tgagtgaccccaagaaaggcttccc

SEQ ID NO: 161400 - DNA, 25 bp, Homo sapien
gcggggacattctactgtgctaaaa

SEQ ID NO: 161401 - DNA, 25 bp, Homo sapien
atgtgggagtatgtctgccggtttc

SEQ ID NO: 161402 - DNA, 25 bp, Homo sapien
gtatgtctgccggtttcaacacaca

SEQ ID NO: 161403 - DNA, 25 bp, Homo sapien
ctgccggtttcaacacacacagaca

SEQ ID NO: 161404 - DNA, 25 bp, Homo sapien
agccacacgcgcacacaagtataag

SEQ ID NO: 161405 - DNA, 25 bp, Homo sapien
tttgtattactgctccctacttaac

SEQ ID NO: 161406 - DNA, 25 bp, Homo sapien
ctgctccctacttaacatacttgaa

SEQ ID NO: 161407 - DNA, 25 bp, Homo sapien
ggatttgaaaccataaagtgttctg

SEQ ID NO: 161408 - DNA, 25 bp, Homo sapien
ttttttccctccacagacaatgtcc

SEQ ID NO: 161409 - DNA, 25 bp, Homo sapien
gacaatgtcctctgttcaattccta

SEQ ID NO: 161410 - DNA, 25 bp, Homo sapien
ttcctaacgcaaactacaataaatg

SEQ ID NO: 161411 - DNA, 25 bp, Homo sapien
aaatggtgacacacgttcagaagaa

SEQ ID NO: 161412 - DNA, 25 bp, Homo sapien
accgagggtgcctgtttgaagcaag

SEQ ID NO: 161413 - DNA, 25 bp, Homo sapien
gtgcctgtttgaagcaagcagcatt

SEQ ID NO: 161414 - DNA, 25 bp, Homo sapien
agcatttgggatatgtgcccttcct

SEQ ID NO: 161415 - DNA, 25 bp, Homo sapien
cttcctcagggtctgcttggagcag

SEQ ID NO: 161416 - DNA, 25 bp, Homo sapien
agggtctgcttggagcagctcctct

SEQ ID NO: 161417 - DNA, 25 bp, Homo sapien
agcctggactattcccaggcacagc

SEQ ID NO: 161418 - DNA, 25 bp, Homo sapien
tccaccatgggcaggctgtgcaaaa

SEQ ID NO: 161419 - DNA, 25 bp, Homo sapien
actggcttttctcagcatttgctgc

SEQ ID NO: 161420 - DNA, 25 bp, Homo sapien
ttttctcagcatttgctgctgggcc

SEQ ID NO: 161421 - DNA, 25 bp, Homo sapien
taccagtgtggctcttacgtgtttt

SEQ ID NO: 161422 - DNA, 25 bp, Homo sapien
tggctcttacgtgttttctttgcta

SEQ ID NO: 161423 - DNA, 25 bp, Homo sapien
tgtattttacctacttcagcaatgg

SEQ ID NO: 161424 - DNA, 25 bp, Homo sapien
ttcagcaatggaactgcaacttggg

SEQ ID NO: 161425 - DNA, 25 bp, Homo sapien
gtgaataaaatttagctgccttgta

SEQ ID NO: 161426 - DNA, 25 bp, Homo sapien
aatttagctgccttgtatagtcgtt

SEQ ID NO: 161427 - DNA, 25 bp, Homo sapien
agctgccttgtatagtcgtttgaaa

SEQ ID NO: 161428 - DNA, 25 bp, Homo sapien
aaatctgcaaaagatctttccaaag

SEQ ID NO: 161429 - DNA, 25 bp, Homo sapien
atctttccaaagacaatgtgccaca

SEQ ID NO: 161430 - DNA, 25 bp, Homo sapien
aatgtgccacagatcttttgttctc

SEQ ID NO: 161431 - DNA, 25 bp, Homo sapien
gccacagatcttttgttctctgtaa

SEQ ID NO: 161432 - DNA, 25 bp, Homo sapien
gttctctgtaatgaggattaattgc

SEQ ID NO: 161433 - DNA, 25 bp, Homo sapien
ttttcataagaggatcaagctgtaa

SEQ ID NO: 161434 - DNA, 25 bp, Homo sapien
cccttggtgcgagggaagcaattga

SEQ ID NO: 161435 - DNA, 25 bp, Homo sapien
gaaaaggaacttgccctgagcactc

SEQ ID NO: 161436 - DNA, 25 bp, Homo sapien
tgagcactcctggtgcaggtctcca

SEQ ID NO: 161437 - DNA, 25 bp, Homo sapien
ctgggagggagactcagccttcctc

SEQ ID NO: 161438 - DNA, 25 bp, Homo sapien
accctggagagtgaatgccccttgg

SEQ ID NO: 161439 - DNA, 25 bp, Homo sapien
tggcagggcgccaagtttggcacca

SEQ ID NO: 161440 - DNA, 25 bp, Homo sapien
aagtttggcaccatgtcggcctctt

SEQ ID NO: 161441 - DNA, 25 bp, Homo sapien
tcttcaggcctgatagtcattggaa

SEQ ID NO: 161442 - DNA, 25 bp, Homo sapien
atcaaggatgctcagtttaaggtac

SEQ ID NO: 161443 - DNA, 25 bp, Homo sapien
gtttaaggtacactgtttccatgtt

SEQ ID NO: 161444 - DNA, 25 bp, Homo sapien
ttccatgttatgtttctacacattg

SEQ ID NO: 161445 - DNA, 25 bp, Homo sapien
atcctccaaatcaaagctctttctg

SEQ ID NO: 161446 - DNA, 25 bp, Homo sapien
caggcaccgctgtgactgggctccg

SEQ ID NO: 161447 - DNA, 25 bp, Homo sapien
gcctgtgtggaaagctgaccgtttt

SEQ ID NO: 161448 - DNA, 25 bp, Homo sapien
ccgttttaagaagtggcatgtgcct

SEQ ID NO: 161449 - DNA, 25 bp, Homo sapien
gcagaatgttcagtcggtcgtgttt

SEQ ID NO: 161450 - DNA, 25 bp, Homo sapien
gtgtttttaacacagagtctctaga

SEQ ID NO: 161451 - DNA, 25 bp, Homo sapien
tagaagaggtgcagacatcccgtct

SEQ ID NO: 161452 - DNA, 25 bp, Homo sapien
catcccgtctgactgtccctgtgga

SEQ ID NO: 161453 - DNA, 25 bp, Homo sapien
ctgtggactctctcagttgtatgtt

SEQ ID NO: 161454 - DNA, 25 bp, Homo sapien
gactctctcagttgtatgttgctat

SEQ ID NO: 161455 - DNA, 25 bp, Homo sapien
gtatgttgctataatcctccaaatc

SEQ ID NO: 161456 - DNA, 25 bp, Homo sapien
gcagaggccctaggcagcttgttga

SEQ ID NO: 161457 - DNA, 25 bp, Homo sapien
aggcagcttgttgactgctgtctgt

SEQ ID NO: 161458 - DNA, 25 bp, Homo sapien
tgctgtctgttgatgacgtgtgtgc

SEQ ID NO: 161459 - DNA, 25 bp, Homo sapien
atgacgtgtgtgcaaagcaggctct

SEQ ID NO: 161460 - DNA, 25 bp, Homo sapien
gcaggctctagcaacatgatcactg

SEQ ID NO: 161461 - DNA, 25 bp, Homo sapien
ggttctttctctcggttggttgcca

SEQ ID NO: 161462 - DNA, 25 bp, Homo sapien
agggcttgcagatcgcagtgaattt

SEQ ID NO: 161463 - DNA, 25 bp, Homo sapien
gaacatcgctgttttgtcctagagt

SEQ ID NO: 161464 - DNA, 25 bp, Homo sapien
tagagtgaacttgtggcttatggcc

SEQ ID NO: 161465 - DNA, 25 bp, Homo sapien
cttatggccagtgctgtttggtggt

SEQ ID NO: 161466 - DNA, 25 bp, Homo sapien
cttcctcagagcagaagggctgcat

SEQ ID NO: 161467 - DNA, 25 bp, Homo sapien
tttaacaggaaatttttagcattca

SEQ ID NO: 161468 - DNA, 25 bp, Homo sapien
tagcattcagtcatataacatctgg

SEQ ID NO: 161469 - DNA, 25 bp, Homo sapien
taacatctggttatcaatgcacgtt

SEQ ID NO: 161470 - DNA, 25 bp, Homo sapien
atctggttatcaatgcacgtttaca

SEQ ID NO: 161471 - DNA, 25 bp, Homo sapien
ggttatcaatgcacgtttacacaat

SEQ ID NO: 161472 - DNA, 25 bp, Homo sapien
tatcaatgcacgtttacacaataaa

SEQ ID NO: 161473 - DNA, 25 bp, Homo sapien
gcacgtttacacaataaatacttga

SEQ ID NO: 161474 - DNA, 25 bp, Homo sapien
atatatcttaaactagttgacctag

SEQ ID NO: 161475 - DNA, 25 bp, Homo sapien
gttgacctagattgtattaatagct

SEQ ID NO: 161476 - DNA, 25 bp, Homo sapien
taatagctacttaagatgtttcaaa

SEQ ID NO: 161477 - DNA, 25 bp, Homo sapien
gatgtttcaaagataggaagctatt

SEQ ID NO: 161478 - DNA, 25 bp, Homo sapien
gcagctgcagcctcaaaatttttaa

SEQ ID NO: 161479 - DNA, 25 bp, Homo sapien
ttttaacaatcaggagtttgctcag

SEQ ID NO: 161480 - DNA, 25 bp, Homo sapien
agcttctggctcaatctgtcaacca

SEQ ID NO: 161481 - DNA, 25 bp, Homo sapien
ggctcaatctgtcaaccatgggttt

SEQ ID NO: 161482 - DNA, 25 bp, Homo sapien
caaccatgggtttgaggcagtatat

SEQ ID NO: 161483 - DNA, 25 bp, Homo sapien
gaggcagtatatgagctcaccaaaa

SEQ ID NO: 161484 - DNA, 25 bp, Homo sapien
gctcaccaaaatgtgtaccattcgg

SEQ ID NO: 161485 - DNA, 25 bp, Homo sapien
gtaccattcggatgagttttgtcaa

SEQ ID NO: 161486 - DNA, 25 bp, Homo sapien
tatcaccggcaggatgtaaccagca

SEQ ID NO: 161487 - DNA, 25 bp, Homo sapien
aaagtccttactcagatgggctccc

SEQ ID NO: 161488 - DNA, 25 bp, Homo sapien
gaaccccatatcttctgtttcataa

SEQ ID NO: 161489 - DNA, 25 bp, Homo sapien
cagattcaaaaccagactcccaaga

SEQ ID NO: 161490 - DNA, 25 bp, Homo sapien
gactcccaagaccttttggatttag

SEQ ID NO: 161491 - DNA, 25 bp, Homo sapien
ggatttagaagatatctgccaacag

SEQ ID NO: 161492 - DNA, 25 bp, Homo sapien
atctgccaacagatgggtccaatga

SEQ ID NO: 161493 - DNA, 25 bp, Homo sapien
ggtgagatttttcgtgcaaggaata

SEQ ID NO: 161494 - DNA, 25 bp, Homo sapien
gggttcacttgtgttttggcaaaca

SEQ ID NO: 161495 - DNA, 25 bp, Homo sapien
gaaagtttttgtggaactgtacaat

SEQ ID NO: 161496 - DNA, 25 bp, Homo sapien
gtggaactgtacaattcatggaaat

SEQ ID NO: 161497 - DNA, 25 bp, Homo sapien
tcccaggcttttaacaaatttatag

SEQ ID NO: 161498 - DNA, 25 bp, Homo sapien
ttaacaaatttatagcaaggtggtg

SEQ ID NO: 161499 - DNA, 25 bp, Homo sapien
caaggtggtgctttttatcttgttt

SEQ ID NO: 161500 - DNA, 25 bp, Homo sapien
tctattttccctcgctggggcagtg

SEQ ID NO: 161501 - DNA, 25 bp, Homo sapien
cagagcgtgggagacggtgggcctt

SEQ ID NO: 161502 - DNA, 25 bp, Homo sapien
gcgtgggagacggtgggccttgtcc

SEQ ID NO: 161503 - DNA, 25 bp, Homo sapien
cctgggagttttgtattcatctttt

SEQ ID NO: 161504 - DNA, 25 bp, Homo sapien
attcatcttttgtatagttgtggac

SEQ ID NO: 161505 - DNA, 25 bp, Homo sapien
catcttttgtatagttgtggacatt

SEQ ID NO: 161506 - DNA, 25 bp, Homo sapien
gacagtctttgggtacctattttca

SEQ ID NO: 161507 - DNA, 25 bp, Homo sapien
cagtctttgggtacctattttcatt

SEQ ID NO: 161508 - DNA, 25 bp, Homo sapien
tctttgggtacctattttcattgta

SEQ ID NO: 161509 - DNA, 25 bp, Homo sapien
gtacctattttcattgtaaaactat

SEQ ID NO: 161510 - DNA, 25 bp, Homo sapien
ttttcattgtaaaactatctgaacc

SEQ ID NO: 161511 - DNA, 25 bp, Homo sapien
attcaaaaccagactcccaagacct

SEQ ID NO: 161512 - DNA, 25 bp, Homo sapien
tcaaaaccagactcccaagaccttt

SEQ ID NO: 161513 - DNA, 25 bp, Homo sapien
accagactcccaagaccttttggat

SEQ ID NO: 161514 - DNA, 25 bp, Homo sapien
cagactcccaagaccttttggattt

SEQ ID NO: 161515 - DNA, 25 bp, Homo sapien
gactcccaagaccttttggatttag

SEQ ID NO: 161516 - DNA, 25 bp, Homo sapien
tcccaagaccttttggatttagaag

SEQ ID NO: 161517 - DNA, 25 bp, Homo sapien
ggatttagaagatatctgccaacag

SEQ ID NO: 161518 - DNA, 25 bp, Homo sapien
atctgccaacagatgggtccaatga

SEQ ID NO: 161519 - DNA, 25 bp, Homo sapien
ctgccaacagatgggtccaatgata

SEQ ID NO: 161520 - DNA, 25 bp, Homo sapien
cagatgggtccaatgatagatgaaa

SEQ ID NO: 161521 - DNA, 25 bp, Homo sapien
gggtccaatgatagatgaaaaactt

SEQ ID NO: 161522 - DNA, 25 bp, Homo sapien
cataggaagtttggtcagagtgaat

SEQ ID NO: 161523 - DNA, 25 bp, Homo sapien
gaatattgtaagtcagccactggga

SEQ ID NO: 161524 - DNA, 25 bp, Homo sapien
ccactgggacccgaggatttctggg

SEQ ID NO: 161525 - DNA, 25 bp, Homo sapien
aggatttctgggaccccgcagttgg

SEQ ID NO: 161526 - DNA, 25 bp, Homo sapien
gaggaagtagtccagccttccaggt

SEQ ID NO: 161527 - DNA, 25 bp, Homo sapien
tgagaggcaatgactcgttacctgc

SEQ ID NO: 161528 - DNA, 25 bp, Homo sapien
tccctggccttgagtagaaaagtcg

SEQ ID NO: 161529 - DNA, 25 bp, Homo sapien
ggctgagtacggatgggaaactatt

SEQ ID NO: 161530 - DNA, 25 bp, Homo sapien
gggaaactattgtgcacaagtcttt

SEQ ID NO: 161531 - DNA, 25 bp, Homo sapien
gtgcacaagtctttccagaggagtt

SEQ ID NO: 161532 - DNA, 25 bp, Homo sapien
agtctttccagaggagtttcttaat

SEQ ID NO: 161533 - DNA, 25 bp, Homo sapien
cagggagcccatgctcatggttgaa

SEQ ID NO: 161534 - DNA, 25 bp, Homo sapien
gagcccatgctcatggttgaaggta

SEQ ID NO: 161535 - DNA, 25 bp, Homo sapien
cccatgctcatggttgaaggtatgc

SEQ ID NO: 161536 - DNA, 25 bp, Homo sapien
tatgcttcagaagtgtccttctgtt

SEQ ID NO: 161537 - DNA, 25 bp, Homo sapien
gcttcagaagtgtccttctgttgat

SEQ ID NO: 161538 - DNA, 25 bp, Homo sapien
tttcattgttcgcttctgtaattct

SEQ ID NO: 161539 - DNA, 25 bp, Homo sapien
ttcattgttcgcttctgtaattctg

SEQ ID NO: 161540 - DNA, 25 bp, Homo sapien
tcattgttcgcttctgtaattctga

SEQ ID NO: 161541 - DNA, 25 bp, Homo sapien
cattgttcgcttctgtaattctgaa

SEQ ID NO: 161542 - DNA, 25 bp, Homo sapien
attgttcgcttctgtaattctgaaa

SEQ ID NO: 161543 - DNA, 25 bp, Homo sapien
gttcgcttctgtaattctgaaaaac

SEQ ID NO: 161544 - DNA, 25 bp, Homo sapien
ggctggccccggtaggagatcaccc

SEQ ID NO: 161545 - DNA, 25 bp, Homo sapien
tggccccggtaggagatcacccggt

SEQ ID NO: 161546 - DNA, 25 bp, Homo sapien
cggtaggagatcacccggtggcacc

SEQ ID NO: 161547 - DNA, 25 bp, Homo sapien
agcccagagcgctcgccaggtacgg

SEQ ID NO: 161548 - DNA, 25 bp, Homo sapien
tccaggcctcttcagagaagaccca

SEQ ID NO: 161549 - DNA, 25 bp, Homo sapien
aggcctcttcagagaagacccaaca

SEQ ID NO: 161550 - DNA, 25 bp, Homo sapien
agagaagacccaacagtgacgcccc

SEQ ID NO: 161551 - DNA, 25 bp, Homo sapien
aggtgggcggctggactcaatccac

SEQ ID NO: 161552 - DNA, 25 bp, Homo sapien
tggactcaatccaccctggggggct

SEQ ID NO: 161553 - DNA, 25 bp, Homo sapien
tcctttccttcttcctatttgtgtg

SEQ ID NO: 161554 - DNA, 25 bp, Homo sapien
cctttccttcttcctatttgtgtgt

SEQ ID NO: 161555 - DNA, 25 bp, Homo sapien
atgccccagttgtcagtcagagccg

SEQ ID NO: 161556 - DNA, 25 bp, Homo sapien
cagttgtcagtcagagccgttggtg

SEQ ID NO: 161557 - DNA, 25 bp, Homo sapien
cagtcagagccgttggtgtttttca

SEQ ID NO: 161558 - DNA, 25 bp, Homo sapien
gagccgttggtgtttttcattgttt

SEQ ID NO: 161559 - DNA, 25 bp, Homo sapien
ttttttgcattcctgataattgtat

SEQ ID NO: 161560 - DNA, 25 bp, Homo sapien
aagaacgtctgtacattgggttata

SEQ ID NO: 161561 - DNA, 25 bp, Homo sapien
gtacattgggttataacactagtat

SEQ ID NO: 161562 - DNA, 25 bp, Homo sapien
gcttatttgtaatgtaaaccaccat

SEQ ID NO: 161563 - DNA, 25 bp, Homo sapien
tgtaaaccaccattttaatgtactg

SEQ ID NO: 161564 - DNA, 25 bp, Homo sapien
ttataatacgtacaatccttccctc

SEQ ID NO: 161565 - DNA, 25 bp, Homo sapien
tcatcccatcacacaactttttttg

SEQ ID NO: 161566 - DNA, 25 bp, Homo sapien
acaggtgtgcccatacagacattcc

SEQ ID NO: 161567 - DNA, 25 bp, Homo sapien
ggagccggctgctgtgaactcgacc

SEQ ID NO: 161568 - DNA, 25 bp, Homo sapien
aactcgaccccgtgtggatagtcac

SEQ ID NO: 161569 - DNA, 25 bp, Homo sapien
tggatagtcacactccctgccgatt

SEQ ID NO: 161570 - DNA, 25 bp, Homo sapien
tgccgattctgtctgtggcttcttc

SEQ ID NO: 161571 - DNA, 25 bp, Homo sapien
aggactgagtgtgcgtacccagttc

SEQ ID NO: 161572 - DNA, 25 bp, Homo sapien
gtacccagttcacctggacatgagt

SEQ ID NO: 161573 - DNA, 25 bp, Homo sapien
tggacatgagtgcacactctcaccc

SEQ ID NO: 161574 - DNA, 25 bp, Homo sapien
tcacccctgcacatgcataaacggg

SEQ ID NO: 161575 - DNA, 25 bp, Homo sapien
gggcacaccccagtgtcaataacat

SEQ ID NO: 161576 - DNA, 25 bp, Homo sapien
aacatacacacgtgagggtgcatgt

SEQ ID NO: 161577 - DNA, 25 bp, Homo sapien
gaaacacatgaaagccacagaattt

SEQ ID NO: 161578 - DNA, 25 bp, Homo sapien
acagaatttatgttgcaatacgagc

SEQ ID NO: 161579 - DNA, 25 bp, Homo sapien
ataggaactccttacagtctgctgt

SEQ ID NO: 161580 - DNA, 25 bp, Homo sapien
cagtctgctgtatctaacattgccc

SEQ ID NO: 161581 - DNA, 25 bp, Homo sapien
taacattgcccaggcgcctctgttt

SEQ ID NO: 161582 - DNA, 25 bp, Homo sapien
aattctgatcctgtacctgccagag

SEQ ID NO: 161583 - DNA, 25 bp, Homo sapien
tgtacctgccagagattatcttata

SEQ ID NO: 161584 - DNA, 25 bp, Homo sapien
ggagttttaacagcaatgggtttga

SEQ ID NO: 161585 - DNA, 25 bp, Homo sapien
gataggaatcatttgccttattata

SEQ ID NO: 161586 - DNA, 25 bp, Homo sapien
gccttattatagttgtgacacatca

SEQ ID NO: 161587 - DNA, 25 bp, Homo sapien
gtgacacatcatactttaagcagga

SEQ ID NO: 161588 - DNA, 25 bp, Homo sapien
taaagacgttttataagcatcatta

SEQ ID NO: 161589 - DNA, 25 bp, Homo sapien
gacgttttataagcatcattattta

SEQ ID NO: 161590 - DNA, 25 bp, Homo sapien
gtattgtgcaatgtgtataaacaag

SEQ ID NO: 161591 - DNA, 25 bp, Homo sapien
aaagaaaagatgcactttgctttaa

SEQ ID NO: 161592 - DNA, 25 bp, Homo sapien
gattggtgttttttcctatgggtgt

SEQ ID NO: 161593 - DNA, 25 bp, Homo sapien
gtgttttttcctatgggtgttatca

SEQ ID NO: 161594 - DNA, 25 bp, Homo sapien
tttcctatgggtgttatcacctagc

SEQ ID NO: 161595 - DNA, 25 bp, Homo sapien
ctatgggtgttatcacctagctgaa

SEQ ID NO: 161596 - DNA, 25 bp, Homo sapien
tgggtgttatcacctagctgaatgt

SEQ ID NO: 161597 - DNA, 25 bp, Homo sapien
ttttctaaaggagtttatgttccat

SEQ ID NO: 161598 - DNA, 25 bp, Homo sapien
tctaaaggagtttatgttccattaa

SEQ ID NO: 161599 - DNA, 25 bp, Homo sapien
actgcttcatatctctgtccacttt

SEQ ID NO: 161600 - DNA, 25 bp, Homo sapien
atatctctgtccactttctgaatga

SEQ ID NO: 161601 - DNA, 25 bp, Homo sapien
gagaacttattttgtgcctagagct

SEQ ID NO: 161602 - DNA, 25 bp, Homo sapien
attttgtgcctagagctctcactca

SEQ ID NO: 161603 - DNA, 25 bp, Homo sapien
gagctctcactcactgataatgctt

SEQ ID NO: 161604 - DNA, 25 bp, Homo sapien
gataatgcttattaccttctgggca

SEQ ID NO: 161605 - DNA, 25 bp, Homo sapien
tgggcatttattccaaagtgggatc

SEQ ID NO: 161606 - DNA, 25 bp, Homo sapien
aagtgggatcaactgtacgcctttg

SEQ ID NO: 161607 - DNA, 25 bp, Homo sapien
gtacgcctttggtatctgaccataa

SEQ ID NO: 161608 - DNA, 25 bp, Homo sapien
gaccataaagtcttttgctccgctg

SEQ ID NO: 161609 - DNA, 25 bp, Homo sapien
ttttgctccgctgacatttgggtga

SEQ ID NO: 161610 - DNA, 25 bp, Homo sapien
gcacggagataccaagccatgatgt

SEQ ID NO: 161611 - DNA, 25 bp, Homo sapien
aagccatgatgtgccttccttagtg

SEQ ID NO: 161612 - DNA, 25 bp, Homo sapien
gccatgatgtgccttccttagtgaa

SEQ ID NO: 161613 - DNA, 25 bp, Homo sapien
catgatgtgccttccttagtgaact

SEQ ID NO: 161614 - DNA, 25 bp, Homo sapien
atgatgtgccttccttagtgaactg

SEQ ID NO: 161615 - DNA, 25 bp, Homo sapien
tgatgtgccttccttagtgaactgc

SEQ ID NO: 161616 - DNA, 25 bp, Homo sapien
gatgtgccttccttagtgaactgct

SEQ ID NO: 161617 - DNA, 25 bp, Homo sapien
tttggactaaagaaacagattctga

SEQ ID NO: 161618 - DNA, 25 bp, Homo sapien
aaagtttgccatgtgccttaaacat

SEQ ID NO: 161619 - DNA, 25 bp, Homo sapien
agtttgccatgtgccttaaacatat

SEQ ID NO: 161620 - DNA, 25 bp, Homo sapien
aaatattttaagcaattgtccaata

SEQ ID NO: 161621 - DNA, 25 bp, Homo sapien
caagcctgatttaggcactgcttta

SEQ ID NO: 161622 - DNA, 25 bp, Homo sapien
gatttaggcactgctttatccaggg

SEQ ID NO: 161623 - DNA, 25 bp, Homo sapien
gggcttcacccatgaaattaataaa

SEQ ID NO: 161624 - DNA, 25 bp, Homo sapien
ataaaacttatctgagtcacttgaa

SEQ ID NO: 161625 - DNA, 25 bp, Homo sapien
atctgagtcacttgaaacttggttc

SEQ ID NO: 161626 - DNA, 25 bp, Homo sapien
tgaaacttggttcccagaaaacaca

SEQ ID NO: 161627 - DNA, 25 bp, Homo sapien
aacacatttctggtttataatctcc

SEQ ID NO: 161628 - DNA, 25 bp, Homo sapien
ggtttataatctccttttatgctca

SEQ ID NO: 161629 - DNA, 25 bp, Homo sapien
ccttttatgctcacctgacattaat

SEQ ID NO: 161630 - DNA, 25 bp, Homo sapien
cctgacattaattatctatccttga

SEQ ID NO: 161631 - DNA, 25 bp, Homo sapien
gtagcagaaaacagaggccacactt

SEQ ID NO: 161632 - DNA, 25 bp, Homo sapien
ccagcagaggacgaaaatgattcga

SEQ ID NO: 161633 - DNA, 25 bp, Homo sapien
cagcagaggacgaaaatgattcgaa

SEQ ID NO: 161634 - DNA, 25 bp, Homo sapien
cgaaaatgattcgaagggagtgtca

SEQ ID NO: 161635 - DNA, 25 bp, Homo sapien
gaaaatgattcgaagggagtgtcag

SEQ ID NO: 161636 - DNA, 25 bp, Homo sapien
aaaatgattcgaagggagtgtcaga

SEQ ID NO: 161637 - DNA, 25 bp, Homo sapien
gatgggaaacaactgcaccccccag

SEQ ID NO: 161638 - DNA, 25 bp, Homo sapien
atgggaaacaactgcaccccccagg

SEQ ID NO: 161639 - DNA, 25 bp, Homo sapien
tgggaaacaactgcaccccccagga

SEQ ID NO: 161640 - DNA, 25 bp, Homo sapien
ggaaaagcaaatatttctgagaaga

SEQ ID NO: 161641 - DNA, 25 bp, Homo sapien
aaaagcaaatatttctgagaagatt

SEQ ID NO: 161642 - DNA, 25 bp, Homo sapien
aagcaaatatttctgagaagattaa

SEQ ID NO: 161643 - DNA, 25 bp, Homo sapien
caccgtggagacctcatcacggagc

SEQ ID NO: 161644 - DNA, 25 bp, Homo sapien
accgtggagacctcatcacggagcc

SEQ ID NO: 161645 - DNA, 25 bp, Homo sapien
cgtggagacctcatcacggagccct

SEQ ID NO: 161646 - DNA, 25 bp, Homo sapien
gtggagacctcatcacggagccctt

SEQ ID NO: 161647 - DNA, 25 bp, Homo sapien
tggagacctcatcacggagcccttt

SEQ ID NO: 161648 - DNA, 25 bp, Homo sapien
ggagacctcatcacggagccctttc

SEQ ID NO: 161649 - DNA, 25 bp, Homo sapien
gagacctcatcacggagccctttct

SEQ ID NO: 161650 - DNA, 25 bp, Homo sapien
agacctcatcacggagccctttctg

SEQ ID NO: 161651 - DNA, 25 bp, Homo sapien
gacctcatcacggagccctttctgc

SEQ ID NO: 161652 - DNA, 25 bp, Homo sapien
acctcatcacggagccctttctgcc

SEQ ID NO: 161653 - DNA, 25 bp, Homo sapien
tcatcacggagccctttctgccaaa

SEQ ID NO: 161654 - DNA, 25 bp, Homo sapien
ggaatctcaaactccctttggccct

SEQ ID NO: 161655 - DNA, 25 bp, Homo sapien
ctttggccctgaaccagggccagat

SEQ ID NO: 161656 - DNA, 25 bp, Homo sapien
cagggccagataaggaacagctcgg

SEQ ID NO: 161657 - DNA, 25 bp, Homo sapien
gatctcaaggatccagactctcatt

SEQ ID NO: 161658 - DNA, 25 bp, Homo sapien
tttcctctggcccagtgaatttggt

SEQ ID NO: 161659 - DNA, 25 bp, Homo sapien
ccagtgaatttggtctctcccagct

SEQ ID NO: 161660 - DNA, 25 bp, Homo sapien
ttgaaccctaataagaccccactgg

SEQ ID NO: 161661 - DNA, 25 bp, Homo sapien
aataagaccccactggagtctctct

SEQ ID NO: 161662 - DNA, 25 bp, Homo sapien
ctctgctctaattgctgccaggatt

SEQ ID NO: 161663 - DNA, 25 bp, Homo sapien
attgctgccaggattgtcactccaa

SEQ ID NO: 161664 - DNA, 25 bp, Homo sapien
caggattgtcactccaaaccttact

SEQ ID NO: 161665 - DNA, 25 bp, Homo sapien
aaaactacacgctgttaatgctgaa

SEQ ID NO: 161666 - DNA, 25 bp, Homo sapien
aagaatgcaatgtccttcagggaag

SEQ ID NO: 161667 - DNA, 25 bp, Homo sapien
gatggctatcagatgaatgcacaaa

SEQ ID NO: 161668 - DNA, 25 bp, Homo sapien
caaatgctgtggtgaacttcttatc

SEQ ID NO: 161669 - DNA, 25 bp, Homo sapien
gctgtggtgaacttcttatccagaa

SEQ ID NO: 161670 - DNA, 25 bp, Homo sapien
tgtgatgaccactacagcagagtaa

SEQ ID NO: 161671 - DNA, 25 bp, Homo sapien
agcagagtaaagcatgtccaaggaa

SEQ ID NO: 161672 - DNA, 25 bp, Homo sapien
ggaaggatgtgctgttacctctgat

SEQ ID NO: 161673 - DNA, 25 bp, Homo sapien
tgctgttacctctgatttccagtac

SEQ ID NO: 161674 - DNA, 25 bp, Homo sapien
gaactaaataagcttcattgtgcct

SEQ ID NO: 161675 - DNA, 25 bp, Homo sapien
cattgtgccttttgtagtgctagaa

SEQ ID NO: 161676 - DNA, 25 bp, Homo sapien
gatattttgggaataggacccgagc

SEQ ID NO: 161677 - DNA, 25 bp, Homo sapien
taggacccgagcctaaacacaaaat

SEQ ID NO: 161678 - DNA, 25 bp, Homo sapien
aaattcattgatgtgtcagttacac

SEQ ID NO: 161679 - DNA, 25 bp, Homo sapien
gtcagttacaccttatccacatagc

SEQ ID NO: 161680 - DNA, 25 bp, Homo sapien
agttacaccttatccacatagcctg

SEQ ID NO: 161681 - DNA, 25 bp, Homo sapien
aatagttgtgtacatgaagcatggt

SEQ ID NO: 161682 - DNA, 25 bp, Homo sapien
gaagcatggtttgtggtaacttatg

SEQ ID NO: 161683 - DNA, 25 bp, Homo sapien
ttggattagggttgctcaacccata

SEQ ID NO: 161684 - DNA, 25 bp, Homo sapien
tgctcaacccatattattggctgta

SEQ ID NO: 161685 - DNA, 25 bp, Homo sapien
attattggctgtacatcctggtcac

SEQ ID NO: 161686 - DNA, 25 bp, Homo sapien
tggctgtacatcctggtcacttctg

SEQ ID NO: 161687 - DNA, 25 bp, Homo sapien
gatgccgagctgtatgggcccttca

SEQ ID NO: 161688 - DNA, 25 bp, Homo sapien
cagcgcccagatgcagacctgggtg

SEQ ID NO: 161689 - DNA, 25 bp, Homo sapien
gtgagtgaaggctacttcccggacg

SEQ ID NO: 161690 - DNA, 25 bp, Homo sapien
gctacttcccggacggtgtttattg

SEQ ID NO: 161691 - DNA, 25 bp, Homo sapien
tgtttattgccggaagctggacccc

SEQ ID NO: 161692 - DNA, 25 bp, Homo sapien
ctggtggtcagttctacaactccaa

SEQ ID NO: 161693 - DNA, 25 bp, Homo sapien
cagttctacaactccaaacgcattg

SEQ ID NO: 161694 - DNA, 25 bp, Homo sapien
aaacgcattgactttgacctctaca

SEQ ID NO: 161695 - DNA, 25 bp, Homo sapien
attgactttgacctctacacctgag

SEQ ID NO: 161696 - DNA, 25 bp, Homo sapien
ggaggcaccaagtgtctcaggcagc

SEQ ID NO: 161697 - DNA, 25 bp, Homo sapien
gaggccatttttcagtcaatttccc

SEQ ID NO: 161698 - DNA, 25 bp, Homo sapien
gcttctcatttattcttaaagctac

SEQ ID NO: 161699 - DNA, 25 bp, Homo sapien
aaaggtacatatgggttcacattga

SEQ ID NO: 161700 - DNA, 25 bp, Homo sapien
gctgaatatagcaacatatgcatct

SEQ ID NO: 161701 - DNA, 25 bp, Homo sapien
aacatatgcatctaagatttgggca

SEQ ID NO: 161702 - DNA, 25 bp, Homo sapien
ttgggcatttggttattaatagcgt

SEQ ID NO: 161703 - DNA, 25 bp, Homo sapien
taatagcgtgctggactattcagga

SEQ ID NO: 161704 - DNA, 25 bp, Homo sapien
gaaaatgtggtttatcacttaagag

SEQ ID NO: 161705 - DNA, 25 bp, Homo sapien
agggctggtagctgtactattttca

SEQ ID NO: 161706 - DNA, 25 bp, Homo sapien
tgtactattttcactcagaagcatg

SEQ ID NO: 161707 - DNA, 25 bp, Homo sapien
cactcagaagcatgttcatttatgt

SEQ ID NO: 161708 - DNA, 25 bp, Homo sapien
ttatgtagatgccactttaagcttt

SEQ ID NO: 161709 - DNA, 25 bp, Homo sapien
agcgctcatactgtaaaaactgtta

SEQ ID NO: 161710 - DNA, 25 bp, Homo sapien
cactcttactttatattcctacaaa

SEQ ID NO: 161711 - DNA, 25 bp, Homo sapien
ggttatttagatatgttccctcact

SEQ ID NO: 161712 - DNA, 25 bp, Homo sapien
gttccctcactgaaaaatcactcat

SEQ ID NO: 161713 - DNA, 25 bp, Homo sapien
aagcactttgttatgctgtacaatg

SEQ ID NO: 161714 - DNA, 25 bp, Homo sapien
gaatggattgttcttgtttctcaga

SEQ ID NO: 161715 - DNA, 25 bp, Homo sapien
gtgtctgtactttacaattcaacta

SEQ ID NO: 161716 - DNA, 25 bp, Homo sapien
aattcaactacttgttctacccagc

SEQ ID NO: 161717 - DNA, 25 bp, Homo sapien
gttctacccagcatttaacggcaag

SEQ ID NO: 161718 - DNA, 25 bp, Homo sapien
atatttattctcaagcagggcatgt

SEQ ID NO: 161719 - DNA, 25 bp, Homo sapien
aagcagggcatgtttccctttgttc

SEQ ID NO: 161720 - DNA, 25 bp, Homo sapien
ttccattagcttccatgacactctc

SEQ ID NO: 161721 - DNA, 25 bp, Homo sapien
ttttttctacatctctagcctttgc

SEQ ID NO: 161722 - DNA, 25 bp, Homo sapien
acatctctagcctttgctgtttcct

SEQ ID NO: 161723 - DNA, 25 bp, Homo sapien
taccccacctttagattttactcag

SEQ ID NO: 161724 - DNA, 25 bp, Homo sapien
tttactcagagttcagtctccagcc

SEQ ID NO: 161725 - DNA, 25 bp, Homo sapien
gtctccagccctacaatctgaggga

SEQ ID NO: 161726 - DNA, 25 bp, Homo sapien
aatctgagggacacctttaccaggt

SEQ ID NO: 161727 - DNA, 25 bp, Homo sapien
gattctttaaccacactctaaaagt

SEQ ID NO: 161728 - DNA, 25 bp, Homo sapien
caggacttaaacatagccacgccac

SEQ ID NO: 161729 - DNA, 25 bp, Homo sapien
gggatctagcaatgctgcatcatca

SEQ ID NO: 161730 - DNA, 25 bp, Homo sapien
atcatcagccttccaataccaggtt

SEQ ID NO: 161731 - DNA, 25 bp, Homo sapien
aggctaccccagctatcagcagtac

SEQ ID NO: 161732 - DNA, 25 bp, Homo sapien
agtaccactgaggaagccactgcca

SEQ ID NO: 161733 - DNA, 25 bp, Homo sapien
accatgggagctacttcctcggttc

SEQ ID NO: 161734 - DNA, 25 bp, Homo sapien
tccccgatggtctacctcgaaggga

SEQ ID NO: 161735 - DNA, 25 bp, Homo sapien
acctcgaagggagggctggctccca

SEQ ID NO: 161736 - DNA, 25 bp, Homo sapien
agggtttctactctgctccctagtc

SEQ ID NO: 161737 - DNA, 25 bp, Homo sapien
tgacagatgggtcccctttttctct

SEQ ID NO: 161738 - DNA, 25 bp, Homo sapien
agccccacactcacatgtacgaagt

SEQ ID NO: 161739 - DNA, 25 bp, Homo sapien
acatgtacgaagttctcaccccagc

SEQ ID NO: 161740 - DNA, 25 bp, Homo sapien
agctcctttgtgtggcaccctgatg

SEQ ID NO: 161741 - DNA, 25 bp, Homo sapien
tgtgtggcaccctgatgagtattta

SEQ ID NO: 161742 - DNA, 25 bp, Homo sapien
tagcatagcacaaacgtttttccag

SEQ ID NO: 161743 - DNA, 25 bp, Homo sapien
atagcacaaacgtttttccagtctt

SEQ ID NO: 161744 - DNA, 25 bp, Homo sapien
gtcttctttatcaacactaatgcct

SEQ ID NO: 161745 - DNA, 25 bp, Homo sapien
acactaatgcctcttaattgcatca

SEQ ID NO: 161746 - DNA, 25 bp, Homo sapien
aattgcatcagtatttcctattgga

SEQ ID NO: 161747 - DNA, 25 bp, Homo sapien
aaaacatttggcattcctgaataat

SEQ ID NO: 161748 - DNA, 25 bp, Homo sapien
ttatttccctttcttatacacacct

SEQ ID NO: 161749 - DNA, 25 bp, Homo sapien
tgtgcatgttttagggatcaattac

SEQ ID NO: 161750 - DNA, 25 bp, Homo sapien
gatcaattacctaactgttccttgg

SEQ ID NO: 161751 - DNA, 25 bp, Homo sapien
ctgttccttggtctatttatgtata

SEQ ID NO: 161752 - DNA, 25 bp, Homo sapien
gctttttaaagcacatgtctcattt

SEQ ID NO: 161753 - DNA, 25 bp, Homo sapien
tccttctgttgatgacttcgtaagt

SEQ ID NO: 161754 - DNA, 25 bp, Homo sapien
cttctgttgatgacttcgtaagtgc

SEQ ID NO: 161755 - DNA, 25 bp, Homo sapien
gatgacttcgtaagtgccctcgttt

SEQ ID NO: 161756 - DNA, 25 bp, Homo sapien
tcgtttccgacttggatctggactt

SEQ ID NO: 161757 - DNA, 25 bp, Homo sapien
ctggacttcgaaactttcctcatgg

SEQ ID NO: 161758 - DNA, 25 bp, Homo sapien
gaaacactctacacctctaatcaag

SEQ ID NO: 161759 - DNA, 25 bp, Homo sapien
acactctacacctctaatcaaggtc

SEQ ID NO: 161760 - DNA, 25 bp, Homo sapien
tctacacctctaatcaaggtcatgt

SEQ ID NO: 161761 - DNA, 25 bp, Homo sapien
cctctaatcaaggtcatgtagtaat

SEQ ID NO: 161762 - DNA, 25 bp, Homo sapien
gtagtaatgactttgttataaatgc

SEQ ID NO: 161763 - DNA, 25 bp, Homo sapien
gattgtttcattgttcgcttctgta

SEQ ID NO: 161764 - DNA, 25 bp, Homo sapien
ttttggccctgcagcatgtcatgct

SEQ ID NO: 161765 - DNA, 25 bp, Homo sapien
tgtcatgctcccagaatttcagctt

SEQ ID NO: 161766 - DNA, 25 bp, Homo sapien
ttcagcttcagcttaactgacagat

SEQ ID NO: 161767 - DNA, 25 bp, Homo sapien
gcttcagcttaactgacagatgtta

SEQ ID NO: 161768 - DNA, 25 bp, Homo sapien
actgacagatgttaaagctttctgg

SEQ ID NO: 161769 - DNA, 25 bp, Homo sapien
gatgttaaagctttctggttagatt

SEQ ID NO: 161770 - DNA, 25 bp, Homo sapien
gatcatgtcttttccatgtgtacct

SEQ ID NO: 161771 - DNA, 25 bp, Homo sapien
atcatgtcttttccatgtgtacctg

SEQ ID NO: 161772 - DNA, 25 bp, Homo sapien
tcatgtcttttccatgtgtacctgt

SEQ ID NO: 161773 - DNA, 25 bp, Homo sapien
gtcttttccatgtgtacctgtaata

SEQ ID NO: 161774 - DNA, 25 bp, Homo sapien
catgtgtacctgtaatatttttcca

SEQ ID NO: 161775 - DNA, 25 bp, Homo sapien
ccttatacatctggtcttacaaaga

SEQ ID NO: 161776 - DNA, 25 bp, Homo sapien
gtcttacaaagaccaaagggatcct

SEQ ID NO: 161777 - DNA, 25 bp, Homo sapien
agaccaaagggatcctgcgcttgat

SEQ ID NO: 161778 - DNA, 25 bp, Homo sapien
caaagggatcctgcgcttgatcaac

SEQ ID NO: 161779 - DNA, 25 bp, Homo sapien
agggatcctgcgcttgatcaactga

SEQ ID NO: 161780 - DNA, 25 bp, Homo sapien
ggatcctgcgcttgatcaactgaac

SEQ ID NO: 161781 - DNA, 25 bp, Homo sapien
tgcgcttgatcaactgaaccagtat

SEQ ID NO: 161782 - DNA, 25 bp, Homo sapien
gatcaactgaaccagtatgccaaaa

SEQ ID NO: 161783 - DNA, 25 bp, Homo sapien
actgaaccagtatgccaaaaccagg

SEQ ID NO: 161784 - DNA, 25 bp, Homo sapien
actttatgaacttcaccaccactag

SEQ ID NO: 161785 - DNA, 25 bp, Homo sapien
tatgaacttcaccaccactagtgtc

SEQ ID NO: 161786 - DNA, 25 bp, Homo sapien
attgcgatgtatgatgtatggcttt

SEQ ID NO: 161787 - DNA, 25 bp, Homo sapien
gggatgaccagaatccttatactga

SEQ ID NO: 161788 - DNA, 25 bp, Homo sapien
cagaatccttatactgagtcagtgg

SEQ ID NO: 161789 - DNA, 25 bp, Homo sapien
gagtcagtggatattcttgaagatc

SEQ ID NO: 161790 - DNA, 25 bp, Homo sapien
gtttatcactgaaatgactcacaag

SEQ ID NO: 161791 - DNA, 25 bp, Homo sapien
gactcacaaggcaatgtcaattgga

SEQ ID NO: 161792 - DNA, 25 bp, Homo sapien
gaagacaaggtcgagtacaagttga

SEQ ID NO: 161793 - DNA, 25 bp, Homo sapien
aagatatcgtcttcttgattcgaaa

SEQ ID NO: 161794 - DNA, 25 bp, Homo sapien
gtcttcttgattcgaaaggacccaa

SEQ ID NO: 161795 - DNA, 25 bp, Homo sapien
gtttgccagggttaaagacttgctt

SEQ ID NO: 161796 - DNA, 25 bp, Homo sapien
aaagacttgcttactatgaatgaag

SEQ ID NO: 161797 - DNA, 25 bp, Homo sapien
agacctctctactgggagggacgct

SEQ ID NO: 161798 - DNA, 25 bp, Homo sapien
tctctactgggagggacgctcacaa

SEQ ID NO: 161799 - DNA, 25 bp, Homo sapien
tctactgggagggacgctcacaagc

SEQ ID NO: 161800 - DNA, 25 bp, Homo sapien
tactgggagggacgctcacaagcta

SEQ ID NO: 161801 - DNA, 25 bp, Homo sapien
tgggagggacgctcacaagctaata

SEQ ID NO: 161802 - DNA, 25 bp, Homo sapien
ggagggacgctcacaagctaataga

SEQ ID NO: 161803 - DNA, 25 bp, Homo sapien
agggacgctcacaagctaatagact

SEQ ID NO: 161804 - DNA, 25 bp, Homo sapien
ggacgctcacaagctaatagacttc

SEQ ID NO: 161805 - DNA, 25 bp, Homo sapien
gctcacaagctaatagacttcctta

SEQ ID NO: 161806 - DNA, 25 bp, Homo sapien
cacaagctaatagacttccttaagc

SEQ ID NO: 161807 - DNA, 25 bp, Homo sapien
agctaatagacttccttaagctgaa

SEQ ID NO: 161808 - DNA, 25 bp, Homo sapien
aacagacaaaacaatccccatcagg

SEQ ID NO: 161809 - DNA, 25 bp, Homo sapien
aaaacaatccccatcaggtagctgt

SEQ ID NO: 161810 - DNA, 25 bp, Homo sapien
acaatccccatcaggtagctgtcta

SEQ ID NO: 161811 - DNA, 25 bp, Homo sapien
aatccccatcaggtagctgtctaac

SEQ ID NO: 161812 - DNA, 25 bp, Homo sapien
gtagctgtctaacccccagctgggt

SEQ ID NO: 161813 - DNA, 25 bp, Homo sapien
cagctgggtctaatccttctcatta

SEQ ID NO: 161814 - DNA, 25 bp, Homo sapien
agctgggtctaatccttctcattac

SEQ ID NO: 161815 - DNA, 25 bp, Homo sapien
ctgggtctaatccttctcattaccc

SEQ ID NO: 161816 - DNA, 25 bp, Homo sapien
tctattttgtacagacaagttggaa

SEQ ID NO: 161817 - DNA, 25 bp, Homo sapien
aactttgtaaaatatcgtgtgtgtg

SEQ ID NO: 161818 - DNA, 25 bp, Homo sapien
aaatatcgtgtgtgtgattccttgt

SEQ ID NO: 161819 - DNA, 25 bp, Homo sapien
agcgcttcttcgagacgcgcatgaa

SEQ ID NO: 161820 - DNA, 25 bp, Homo sapien
gcttcttcgagacgcgcatgaacga

SEQ ID NO: 161821 - DNA, 25 bp, Homo sapien
ttcgagacgcgcatgaacgaggcct

SEQ ID NO: 161822 - DNA, 25 bp, Homo sapien
gaggccttcggtgacaccaagttct

SEQ ID NO: 161823 - DNA, 25 bp, Homo sapien
ttcggtgacaccaagttctctgctg

SEQ ID NO: 161824 - DNA, 25 bp, Homo sapien
tcggtgacaccaagttctctgctgt

SEQ ID NO: 161825 - DNA, 25 bp, Homo sapien
aagttctctgctgtgctggtggagc

SEQ ID NO: 161826 - DNA, 25 bp, Homo sapien
cagcctggctctgttctctgtcctg

SEQ ID NO: 161827 - DNA, 25 bp, Homo sapien
ttcctcacgatatggtttttacttc

SEQ ID NO: 161828 - DNA, 25 bp, Homo sapien
ctcacgatatggtttttacttctgt

SEQ ID NO: 161829 - DNA, 25 bp, Homo sapien
acgatatggtttttacttctgtgga

SEQ ID NO: 161830 - DNA, 25 bp, Homo sapien
gagagtgagagcgtgcagtcttaaa

SEQ ID NO: 161831 - DNA, 25 bp, Homo sapien
agtgagagcgtgcagtcttaaaaaa

SEQ ID NO: 161832 - DNA, 25 bp, Homo sapien
aaactattgcctttttggaggcacg

SEQ ID NO: 161833 - DNA, 25 bp, Homo sapien
tttggaggcacggtacattttgtaa

SEQ ID NO: 161834 - DNA, 25 bp, Homo sapien
gaggcacggtacattttgtaaacaa

SEQ ID NO: 161835 - DNA, 25 bp, Homo sapien
aacaaagcaaggctgaagtcgtgct

SEQ ID NO: 161836 - DNA, 25 bp, Homo sapien
gcaaggctgaagtcgtgcttgactt

SEQ ID NO: 161837 - DNA, 25 bp, Homo sapien
gtcgtgcttgacttatatctattag

SEQ ID NO: 161838 - DNA, 25 bp, Homo sapien
gcttgacttatatctattagttttg

SEQ ID NO: 161839 - DNA, 25 bp, Homo sapien
ttggttttctacagccccaattcct

SEQ ID NO: 161840 - DNA, 25 bp, Homo sapien
taacacccaactgtctcgatgcaat

SEQ ID NO: 161841 - DNA, 25 bp, Homo sapien
gtccaaaagtgttgactgtgtcatt

SEQ ID NO: 161842 - DNA, 25 bp, Homo sapien
gactgtgtcattagtcctttgtcta

SEQ ID NO: 161843 - DNA, 25 bp, Homo sapien
tagtcctttgtctaagtagggccag

SEQ ID NO: 161844 - DNA, 25 bp, Homo sapien
tttgtctaagtagggccagggcacc

SEQ ID NO: 161845 - DNA, 25 bp, Homo sapien
gggccatgtcctctcttaataggtg

SEQ ID NO: 161846 - DNA, 25 bp, Homo sapien
ctcttaataggtggcactaccccaa

SEQ ID NO: 161847 - DNA, 25 bp, Homo sapien
aaacccatcttttgttctcctatat

SEQ ID NO: 161848 - DNA, 25 bp, Homo sapien
ttttgttctcctatatcctccttct

SEQ ID NO: 161849 - DNA, 25 bp, Homo sapien
ttctcctgttccatttcagttcagt

SEQ ID NO: 161850 - DNA, 25 bp, Homo sapien
agttcagtttcagcggtgccaacct

SEQ ID NO: 161851 - DNA, 25 bp, Homo sapien
tgccaacctctttgcgtttcctttt

SEQ ID NO: 161852 - DNA, 25 bp, Homo sapien
gggactctaaagtgcaaggagattt

SEQ ID NO: 161853 - DNA, 25 bp, Homo sapien
agtgcaaggagatttacagttggga

SEQ ID NO: 161854 - DNA, 25 bp, Homo sapien
ggcccttaagtccagcgaggaaagc

SEQ ID NO: 161855 - DNA, 25 bp, Homo sapien
aagtccagcgaggaaagctcggtgt

SEQ ID NO: 161856 - DNA, 25 bp, Homo sapien
tctacgctccgtttggggtgacctg

SEQ ID NO: 161857 - DNA, 25 bp, Homo sapien
gggtgacctggaacgcctcttctcc

SEQ ID NO: 161858 - DNA, 25 bp, Homo sapien
atcagcagcctcttgtcaagcttct

SEQ ID NO: 161859 - DNA, 25 bp, Homo sapien
agcctcttgtcaagcttctgcctcg

SEQ ID NO: 161860 - DNA, 25 bp, Homo sapien
cacctttcttcaacggtcactattt

SEQ ID NO: 161861 - DNA, 25 bp, Homo sapien
ttcttcaacggtcactatttattct

SEQ ID NO: 161862 - DNA, 25 bp, Homo sapien
ttcttttgtgtaagaaacattcaca

SEQ ID NO: 161863 - DNA, 25 bp, Homo sapien
tccctacaccctgacgccagatgcc

SEQ ID NO: 161864 - DNA, 25 bp, Homo sapien
acaccctgacgccagatgccgcaca

SEQ ID NO: 161865 - DNA, 25 bp, Homo sapien
caccctgacgccagatgccgcacac

SEQ ID NO: 161866 - DNA, 25 bp, Homo sapien
ctgacgccagatgccgcacacccaa

SEQ ID NO: 161867 - DNA, 25 bp, Homo sapien
gccagatgccgcacacccaacgcca

SEQ ID NO: 161868 - DNA, 25 bp, Homo sapien
agatgccgcacacccaacgccacca

SEQ ID NO: 161869 - DNA, 25 bp, Homo sapien
cacacccaacgccaccagccatggg

SEQ ID NO: 161870 - DNA, 25 bp, Homo sapien
gagtcgcggggcagacgtgacatct

SEQ ID NO: 161871 - DNA, 25 bp, Homo sapien
agacgtgacatctgtccagaggggg

SEQ ID NO: 161872 - DNA, 25 bp, Homo sapien
gacgtgacatctgtccagagggggc

SEQ ID NO: 161873 - DNA, 25 bp, Homo sapien
gaggcaccaagggaaccgcattccg

SEQ ID NO: 161874 - DNA, 25 bp, Homo sapien
gggctgtctctttattcgctacacg

SEQ ID NO: 161875 - DNA, 25 bp, Homo sapien
tctttattcgctacacgcctcttct

SEQ ID NO: 161876 - DNA, 25 bp, Homo sapien
acgcctcttctctcctagaaggatg

SEQ ID NO: 161877 - DNA, 25 bp, Homo sapien
ttctctcctagaaggatgcgcccca

SEQ ID NO: 161878 - DNA, 25 bp, Homo sapien
tttatttattcgtgagcctctcggc

SEQ ID NO: 161879 - DNA, 25 bp, Homo sapien
gcccgcgcccttaatttaaatcgca

SEQ ID NO: 161880 - DNA, 25 bp, Homo sapien
gcgcccttaatttaaatcgcagtat

SEQ ID NO: 161881 - DNA, 25 bp, Homo sapien
gtatactgtatttatcggggccccg

SEQ ID NO: 161882 - DNA, 25 bp, Homo sapien
gcgagagccgcgtctgtgtataaaa

SEQ ID NO: 161883 - DNA, 25 bp, Homo sapien
agagccgcgtctgtgtataaaagca

SEQ ID NO: 161884 - DNA, 25 bp, Homo sapien
agccaaagctttaatctagcctaat

SEQ ID NO: 161885 - DNA, 25 bp, Homo sapien
acttccggaacaagagcagcagccc

SEQ ID NO: 161886 - DNA, 25 bp, Homo sapien
gcagccccgaggacccaggtgctga

SEQ ID NO: 161887 - DNA, 25 bp, Homo sapien
cccgaggacccaggtgctgaggtct

SEQ ID NO: 161888 - DNA, 25 bp, Homo sapien
acccaggtgctgaggtctgagaggg

SEQ ID NO: 161889 - DNA, 25 bp, Homo sapien
aggaagcctgcaggtggcaccggtg

SEQ ID NO: 161890 - DNA, 25 bp, Homo sapien
tgggcagcatcctcccaagcagaga

SEQ ID NO: 161891 - DNA, 25 bp, Homo sapien
agcatcctcccaagcagagaccttg

SEQ ID NO: 161892 - DNA, 25 bp, Homo sapien
cctcccaagcagagaccttgctgaa

SEQ ID NO: 161893 - DNA, 25 bp, Homo sapien
agcactggctccctggtagggacaa

SEQ ID NO: 161894 - DNA, 25 bp, Homo sapien
cactggctccctggtagggacaata

SEQ ID NO: 161895 - DNA, 25 bp, Homo sapien
ctggctccctggtagggacaataaa

SEQ ID NO: 161896 - DNA, 25 bp, Homo sapien
gactgttcaagtgggtctggccaaa

SEQ ID NO: 161897 - DNA, 25 bp, Homo sapien
ggccaaatgtgacagatgcagatct

SEQ ID NO: 161898 - DNA, 25 bp, Homo sapien
gatgcagatcttagaggacttacaa

SEQ ID NO: 161899 - DNA, 25 bp, Homo sapien
ggacttacaaagcactatattggta

SEQ ID NO: 161900 - DNA, 25 bp, Homo sapien
caatggcattagtagcttactctat

SEQ ID NO: 161901 - DNA, 25 bp, Homo sapien
atacagagatggttttcctatgcag

SEQ ID NO: 161902 - DNA, 25 bp, Homo sapien
ttcctatgcagtttagccaccttct

SEQ ID NO: 161903 - DNA, 25 bp, Homo sapien
tagccaccttctcattaattctttg

SEQ ID NO: 161904 - DNA, 25 bp, Homo sapien
cagcaaatcctaggctcagaggcac

SEQ ID NO: 161905 - DNA, 25 bp, Homo sapien
gaggcacagtgctttgtatttgata

SEQ ID NO: 161906 - DNA, 25 bp, Homo sapien
aagtctctagactttcccaacaagg

SEQ ID NO: 161907 - DNA, 25 bp, Homo sapien
aatactacctggagtcttgtcctct

SEQ ID NO: 161908 - DNA, 25 bp, Homo sapien
atcttttttggacttctgctggcct

SEQ ID NO: 161909 - DNA, 25 bp, Homo sapien
aaacactatcttatcttctcctgaa

SEQ ID NO: 161910 - DNA, 25 bp, Homo sapien
aacactatcttatcttctcctgaac

SEQ ID NO: 161911 - DNA, 25 bp, Homo sapien
acactatcttatcttctcctgaact

SEQ ID NO: 161912 - DNA, 25 bp, Homo sapien
actatcttatcttctcctgaactgt

SEQ ID NO: 161913 - DNA, 25 bp, Homo sapien
tatcttatcttctcctgaactgttg

SEQ ID NO: 161914 - DNA, 25 bp, Homo sapien
atcttatcttctcctgaactgttga

SEQ ID NO: 161915 - DNA, 25 bp, Homo sapien
cttatcttctcctgaactgttgatt

SEQ ID NO: 161916 - DNA, 25 bp, Homo sapien
tatcttctcctgaactgttgatttt

SEQ ID NO: 161917 - DNA, 25 bp, Homo sapien
tctcctgaactgttgattttaatta

SEQ ID NO: 161918 - DNA, 25 bp, Homo sapien
gaaccctgaaggaagtctggtcgca

SEQ ID NO: 161919 - DNA, 25 bp, Homo sapien
aagtctggtcgcagcttcaatctat

SEQ ID NO: 161920 - DNA, 25 bp, Homo sapien
ggtcgcagcttcaatctatcagcaa

SEQ ID NO: 161921 - DNA, 25 bp, Homo sapien
tatcagcaactacctccaaactcag

SEQ ID NO: 161922 - DNA, 25 bp, Homo sapien
tccaaactcaggaccagacagacca

SEQ ID NO: 161923 - DNA, 25 bp, Homo sapien
ggaccagacagaccaacaggaggca

SEQ ID NO: 161924 - DNA, 25 bp, Homo sapien
cagaccaacaggaggcagagtggct

SEQ ID NO: 161925 - DNA, 25 bp, Homo sapien
gctttgaccgactgctcttccaaag

SEQ ID NO: 161926 - DNA, 25 bp, Homo sapien
gctcttccaaagctaccttttcatg

SEQ ID NO: 161927 - DNA, 25 bp, Homo sapien
gggatctacaccatcactctgtgct

SEQ ID NO: 161928 - DNA, 25 bp, Homo sapien
gttcttcagtaattgtgctggcact

SEQ ID NO: 161929 - DNA, 25 bp, Homo sapien
tttacatgtatactcctttggctgc

SEQ ID NO: 161930 - DNA, 25 bp, Homo sapien
gtatactcctttggctgctagaact

SEQ ID NO: 161931 - DNA, 25 bp, Homo sapien
ctttggctgctagaactcatctgta

SEQ ID NO: 161932 - DNA, 25 bp, Homo sapien
gaactcatctgtagtcctttattat

SEQ ID NO: 161933 - DNA, 25 bp, Homo sapien
cttccgctaagtaagagcacctcat

SEQ ID NO: 161934 - DNA, 25 bp, Homo sapien
aagagcacctcattcctgtgttttc

SEQ ID NO: 161935 - DNA, 25 bp, Homo sapien
ttttctctactattgagctgtagac

SEQ ID NO: 161936 - DNA, 25 bp, Homo sapien
gagctgtagacgaactgtttctcta

SEQ ID NO: 161937 - DNA, 25 bp, Homo sapien
ggatattcagggaaactaccccaat

SEQ ID NO: 161938 - DNA, 25 bp, Homo sapien
tcagggaaactaccccaatgttatg

SEQ ID NO: 161939 - DNA, 25 bp, Homo sapien
catttaatgggaaaggctgggatca

SEQ ID NO: 161940 - DNA, 25 bp, Homo sapien
tattcactgagtttcttgcacggtt

SEQ ID NO: 161941 - DNA, 25 bp, Homo sapien
gtttcttgcacggtttctttattgc

SEQ ID NO: 161942 - DNA, 25 bp, Homo sapien
ggtatttactattttctgtggagga

SEQ ID NO: 161943 - DNA, 25 bp, Homo sapien
gaggatattgagatgtactacagga

SEQ ID NO: 161944 - DNA, 25 bp, Homo sapien
taactgtagtgaatgatgtgtcatc

SEQ ID NO: 161945 - DNA, 25 bp, Homo sapien
atgtgtcatcattttgagctttgga

SEQ ID NO: 161946 - DNA, 25 bp, Homo sapien
gagctttggactcaatatctttagt

SEQ ID NO: 161947 - DNA, 25 bp, Homo sapien
ggactcaatatctttagtgtttccc

SEQ ID NO: 161948 - DNA, 25 bp, Homo sapien
tagtgtttccctaaatcagatttgt

SEQ ID NO: 161949 - DNA, 25 bp, Homo sapien
gtaggtcatgttaagcttcttgcac

SEQ ID NO: 161950 - DNA, 25 bp, Homo sapien
gttaagcttcttgcacattaatatg

SEQ ID NO: 161951 - DNA, 25 bp, Homo sapien
gcttggcgccagggcccggctttgg

SEQ ID NO: 161952 - DNA, 25 bp, Homo sapien
cttggcgccagggcccggctttggg

SEQ ID NO: 161953 - DNA, 25 bp, Homo sapien
tggcgccagggcccggctttgggat

SEQ ID NO: 161954 - DNA, 25 bp, Homo sapien
gccagggcccggctttgggatgagc

SEQ ID NO: 161955 - DNA, 25 bp, Homo sapien
ccagggcccggctttgggatgagca

SEQ ID NO: 161956 - DNA, 25 bp, Homo sapien
cagggcccggctttgggatgagcag

SEQ ID NO: 161957 - DNA, 25 bp, Homo sapien
agggcccggctttgggatgagcagt

SEQ ID NO: 161958 - DNA, 25 bp, Homo sapien
gggcccggctttgggatgagcagtg

SEQ ID NO: 161959 - DNA, 25 bp, Homo sapien
gcccggctttgggatgagcagtgct

SEQ ID NO: 161960 - DNA, 25 bp, Homo sapien
cccggctttgggatgagcagtgctg

SEQ ID NO: 161961 - DNA, 25 bp, Homo sapien
ccggctttgggatgagcagtgctgg

SEQ ID NO: 161962 - DNA, 25 bp, Homo sapien
cccggattcccacacatgcagacat

SEQ ID NO: 161963 - DNA, 25 bp, Homo sapien
acacatgcatgctcgctaagcggaa

SEQ ID NO: 161964 - DNA, 25 bp, Homo sapien
atgcatgctcgctaagcggaaggaa

SEQ ID NO: 161965 - DNA, 25 bp, Homo sapien
gctcgctaagcggaaggaagttgta

SEQ ID NO: 161966 - DNA, 25 bp, Homo sapien
agttgtagattgcttccttcatgtc

SEQ ID NO: 161967 - DNA, 25 bp, Homo sapien
ttgtagattgcttccttcatgtcac

SEQ ID NO: 161968 - DNA, 25 bp, Homo sapien
tagattgcttccttcatgtcacttt

SEQ ID NO: 161969 - DNA, 25 bp, Homo sapien
attgcttccttcatgtcactttctt

SEQ ID NO: 161970 - DNA, 25 bp, Homo sapien
cttccttcatgtcactttcttttta

SEQ ID NO: 161971 - DNA, 25 bp, Homo sapien
ccttcatgtcactttctttttagat

SEQ ID NO: 161972 - DNA, 25 bp, Homo sapien
catgtcactttctttttagatattg

SEQ ID NO: 161973 - DNA, 25 bp, Homo sapien
accacaacacaatacagccactaat

SEQ ID NO: 161974 - DNA, 25 bp, Homo sapien
gccactaattgccttacaagcctta

SEQ ID NO: 161975 - DNA, 25 bp, Homo sapien
acaaatgagtgattccagtatttca

SEQ ID NO: 161976 - DNA, 25 bp, Homo sapien
cagtaatgtgtgtctttgtatctca

SEQ ID NO: 161977 - DNA, 25 bp, Homo sapien
atgtgtggtcatatctagtcactgt

SEQ ID NO: 161978 - DNA, 25 bp, Homo sapien
tagtcactgtctactcacaaatcag

SEQ ID NO: 161979 - DNA, 25 bp, Homo sapien
aatcagtaaatgcttgtgtcttttt

SEQ ID NO: 161980 - DNA, 25 bp, Homo sapien
gtgtctttttgtatctcattgtgtg

SEQ ID NO: 161981 - DNA, 25 bp, Homo sapien
cattgtgtgtggtcatatctagtca

SEQ ID NO: 161982 - DNA, 25 bp, Homo sapien
tatctagtcacttgctttctaccaa

SEQ ID NO: 161983 - DNA, 25 bp, Homo sapien
atagtcacaggaaactactcacgta

SEQ ID NO: 161984 - DNA, 25 bp, Homo sapien
tcctgggtcttggtcttgatgccaa

SEQ ID NO: 161985 - DNA, 25 bp, Homo sapien
ggagctaagaagacatcccactagg

SEQ ID NO: 161986 - DNA, 25 bp, Homo sapien
ggaagagagagactacctccacatc

SEQ ID NO: 161987 - DNA, 25 bp, Homo sapien
gagactacctccacatcaagaatat

SEQ ID NO: 161988 - DNA, 25 bp, Homo sapien
aaacagtgacatctcttgggaaaat

SEQ ID NO: 161989 - DNA, 25 bp, Homo sapien
tgacggttgtgtattttggtcccct

SEQ ID NO: 161990 - DNA, 25 bp, Homo sapien
tccatcatcactacaactcgaaagt

SEQ ID NO: 161991 - DNA, 25 bp, Homo sapien
agttcttcacaattttggcctctgt

SEQ ID NO: 161992 - DNA, 25 bp, Homo sapien
aattttggcctctgtgatcctcttc

SEQ ID NO: 161993 - DNA, 25 bp, Homo sapien
tcagccccatgcagtgggtgggcac

SEQ ID NO: 161994 - DNA, 25 bp, Homo sapien
ggcactgtgcttgtgttcctgggtc

SEQ ID NO: 161995 - DNA, 25 bp, Homo sapien
tgcccattggcagattacacatgta

SEQ ID NO: 161996 - DNA, 25 bp, Homo sapien
gaaccagaggcccaagggcaataat

SEQ ID NO: 161997 - DNA, 25 bp, Homo sapien
ggaatttgcaggtcagcccaggaat

SEQ ID NO: 161998 - DNA, 25 bp, Homo sapien
gcaggtcagcccaggaattggcaga

SEQ ID NO: 161999 - DNA, 25 bp, Homo sapien
ggaagtaggtgtctgataacccttt

SEQ ID NO: 162000 - DNA, 25 bp, Homo sapien
ggtgtctgataaccctttgtggaga

SEQ ID NO: 162001 - DNA, 25 bp, Homo sapien
taaccctttgtggagaatgagattc

SEQ ID NO: 162002 - DNA, 25 bp, Homo sapien
aaacagctctggagtcttgttcctg

SEQ ID NO: 162003 - DNA, 25 bp, Homo sapien
cttgttcctgactccagaggaacga

SEQ ID NO: 162004 - DNA, 25 bp, Homo sapien
ggaaagagagattccctggaaaatt

SEQ ID NO: 162005 - DNA, 25 bp, Homo sapien
ggattgtgtctttccctgttgaaaa

SEQ ID NO: 162006 - DNA, 25 bp, Homo sapien
tcgatgagcgccacctctttaaaaa

SEQ ID NO: 162007 - DNA, 25 bp, Homo sapien
tgctgaggcccagtgcatatgcaat

SEQ ID NO: 162008 - DNA, 25 bp, Homo sapien
gtgtctattatcacattaatctcaa

SEQ ID NO: 162009 - DNA, 25 bp, Homo sapien
gacggtaagtgttctcatgaagcag

SEQ ID NO: 162010 - DNA, 25 bp, Homo sapien
aggcccttgtcgtgggatggcattt

SEQ ID NO: 162011 - DNA, 25 bp, Homo sapien
gatggcatttggtctcaggcagcac

SEQ ID NO: 162012 - DNA, 25 bp, Homo sapien
gtctcaggcagcaccacactgggtg

SEQ ID NO: 162013 - DNA, 25 bp, Homo sapien
gtgcgtctccagtcatctgtaagag

SEQ ID NO: 162014 - DNA, 25 bp, Homo sapien
aagagcttgctccagattctgatgc

SEQ ID NO: 162015 - DNA, 25 bp, Homo sapien
gattctgatgcatacggctatattg

SEQ ID NO: 162016 - DNA, 25 bp, Homo sapien
gtttatgtagtcagttgcattcatt

SEQ ID NO: 162017 - DNA, 25 bp, Homo sapien
ggagtgcagctaacatgagtatcat

SEQ ID NO: 162018 - DNA, 25 bp, Homo sapien
gagaagatcctgtcacaattcttag

SEQ ID NO: 162019 - DNA, 25 bp, Homo sapien
acaattcttagatctggtgtccagc

SEQ ID NO: 162020 - DNA, 25 bp, Homo sapien
ggtgtccagcatggatgaaaccttt

SEQ ID NO: 162021 - DNA, 25 bp, Homo sapien
gatgaaacctttgagtttggtccct

SEQ ID NO: 162022 - DNA, 25 bp, Homo sapien
gagtttggtccctaaatttgcatga

SEQ ID NO: 162023 - DNA, 25 bp, Homo sapien
atattcatttgcttcaggagtttca

SEQ ID NO: 162024 - DNA, 25 bp, Homo sapien
gcttcaggagtttcatgttggatct

SEQ ID NO: 162025 - DNA, 25 bp, Homo sapien
agcaatgaagaactggtcggacaaa

SEQ ID NO: 162026 - DNA, 25 bp, Homo sapien
ggaattccagatgtaggcattcccc

SEQ ID NO: 162027 - DNA, 25 bp, Homo sapien
ccccaggtcttttcatgtgcagatt

SEQ ID NO: 162028 - DNA, 25 bp, Homo sapien
gaacacttaacagtttctttgagac

SEQ ID NO: 162029 - DNA, 25 bp, Homo sapien
ttggtactatctatcattccttatg

SEQ ID NO: 162030 - DNA, 25 bp, Homo sapien
tcattccttatgacatgtacattgt

SEQ ID NO: 162031 - DNA, 25 bp, Homo sapien
gtacattgtctgtcactaatccttg

SEQ ID NO: 162032 - DNA, 25 bp, Homo sapien
ttgtctgtcactaatccttggattt

SEQ ID NO: 162033 - DNA, 25 bp, Homo sapien
cactaatccttggattttgctgtat

SEQ ID NO: 162034 - DNA, 25 bp, Homo sapien
gtacaggtactgatgaaaatctcta

SEQ ID NO: 162035 - DNA, 25 bp, Homo sapien
ggataatcataacactctcggtcac

SEQ ID NO: 162036 - DNA, 25 bp, Homo sapien
acactctcggtcacatgtttttcct

SEQ ID NO: 162037 - DNA, 25 bp, Homo sapien
aaaagataccaaatgcctgctgcta

SEQ ID NO: 162038 - DNA, 25 bp, Homo sapien
ttgaaaggcaccagtatgtgtttta

SEQ ID NO: 162039 - DNA, 25 bp, Homo sapien
cttcacaattgatggtgcttctatt

SEQ ID NO: 162040 - DNA, 25 bp, Homo sapien
gttgttacgggtattcagccttcag

SEQ ID NO: 162041 - DNA, 25 bp, Homo sapien
tcagccttcagtcaccgtctgagtt

SEQ ID NO: 162042 - DNA, 25 bp, Homo sapien
gtctgagttctccagttgctgcctc

SEQ ID NO: 162043 - DNA, 25 bp, Homo sapien
tgcctccttgtcttgtcttgggtct

SEQ ID NO: 162044 - DNA, 25 bp, Homo sapien
tcctgcctgtgtacctcgtaggaac

SEQ ID NO: 162045 - DNA, 25 bp, Homo sapien
tcgtaggaacgctgagctgcctcaa

SEQ ID NO: 162046 - DNA, 25 bp, Homo sapien
tgagctgcctcaacagggctgtatt

SEQ ID NO: 162047 - DNA, 25 bp, Homo sapien
ttctgaagggcaggcctcatgcagc

SEQ ID NO: 162048 - DNA, 25 bp, Homo sapien
agcagcctccttgcagatgtggtgt

SEQ ID NO: 162049 - DNA, 25 bp, Homo sapien
cagatgtggtgtcccgtccaatgat

SEQ ID NO: 162050 - DNA, 25 bp, Homo sapien
tcaccacaacagaacatgcagtact

SEQ ID NO: 162051 - DNA, 25 bp, Homo sapien
gcaatatatttgtgattccccatgt

SEQ ID NO: 162052 - DNA, 25 bp, Homo sapien
gtgattccccatgtaattcttcaat

SEQ ID NO: 162053 - DNA, 25 bp, Homo sapien
gttaaacagtgcagtcctctttcga

SEQ ID NO: 162054 - DNA, 25 bp, Homo sapien
gtgcagtcctctttcgaaagctaag

SEQ ID NO: 162055 - DNA, 25 bp, Homo sapien
aaagctaagatgaccatgcgccctt

SEQ ID NO: 162056 - DNA, 25 bp, Homo sapien
tgcgccctttcctctgtacatatac

SEQ ID NO: 162057 - DNA, 25 bp, Homo sapien
gtatatgccgcattgtactgctgtg

SEQ ID NO: 162058 - DNA, 25 bp, Homo sapien
actgctgtgttatatgctatgtaca

SEQ ID NO: 162059 - DNA, 25 bp, Homo sapien
gaaaccattagcattgcatgcaggt

SEQ ID NO: 162060 - DNA, 25 bp, Homo sapien
gcatgcaggtttcatattctttcta

SEQ ID NO: 162061 - DNA, 25 bp, Homo sapien
ggaaggctgaccatgatgagcagta

SEQ ID NO: 162062 - DNA, 25 bp, Homo sapien
gtatgtctaaacaaggactgctctg

SEQ ID NO: 162063 - DNA, 25 bp, Homo sapien
tctgtgtcctcaccagatgaatgag

SEQ ID NO: 162064 - DNA, 25 bp, Homo sapien
aatgaggtcatgctgggaattccct

SEQ ID NO: 162065 - DNA, 25 bp, Homo sapien
atgctgggaattccctctgcaggga

SEQ ID NO: 162066 - DNA, 25 bp, Homo sapien
agggaactggcctgactgacatgca

SEQ ID NO: 162067 - DNA, 25 bp, Homo sapien
gactgacatgcagttccataaatgc

SEQ ID NO: 162068 - DNA, 25 bp, Homo sapien
atgcagatgtttgtctcattacctt

SEQ ID NO: 162069 - DNA, 25 bp, Homo sapien
gtttgtctcattacctttttgtata

SEQ ID NO: 162070 - DNA, 25 bp, Homo sapien
ttaggttgcagaatggactcctcat

SEQ ID NO: 162071 - DNA, 25 bp, Homo sapien
ggactcctcatctttatattcacga

SEQ ID NO: 162072 - DNA, 25 bp, Homo sapien
gagtttctggaaaggtactaggatt

SEQ ID NO: 162073 - DNA, 25 bp, Homo sapien
ggtactaggatttctcaaaaggatt

SEQ ID NO: 162074 - DNA, 25 bp, Homo sapien
tttctcaaaaggatttgtcttctcc

SEQ ID NO: 162075 - DNA, 25 bp, Homo sapien
ttctcccttgtgaaagacagatgtc

SEQ ID NO: 162076 - DNA, 25 bp, Homo sapien
atgtcagactaatcaggcttatccg

SEQ ID NO: 162077 - DNA, 25 bp, Homo sapien
aatcaggcttatccgatgtgctaca

SEQ ID NO: 162078 - DNA, 25 bp, Homo sapien
ggcttatccgatgtgctacatgaga

SEQ ID NO: 162079 - DNA, 25 bp, Homo sapien
tgtgctacatgagatggaaatgcgt

SEQ ID NO: 162080 - DNA, 25 bp, Homo sapien
gtaagtcacactaagtcttctggag

SEQ ID NO: 162081 - DNA, 25 bp, Homo sapien
agtcttctggaggttctatttacgg

SEQ ID NO: 162082 - DNA, 25 bp, Homo sapien
tctatttacgggtttggtttgatat

SEQ ID NO: 162083 - DNA, 25 bp, Homo sapien
ggagctgacatgaccagcccactga

SEQ ID NO: 162084 - DNA, 25 bp, Homo sapien
actgatcctgtcagcaggtcctgct

SEQ ID NO: 162085 - DNA, 25 bp, Homo sapien
ctgttgccaggctcttgtttatagc

SEQ ID NO: 162086 - DNA, 25 bp, Homo sapien
ccatgatcagatgtggtcagactct

SEQ ID NO: 162087 - DNA, 25 bp, Homo sapien
gtcagactctttctgggcctggaga

SEQ ID NO: 162088 - DNA, 25 bp, Homo sapien
tttctgggcctggagaccacggtca

SEQ ID NO: 162089 - DNA, 25 bp, Homo sapien
gagaccacggtcacttgttgactgt

SEQ ID NO: 162090 - DNA, 25 bp, Homo sapien
acttgttgactgtctctgtggacca

SEQ ID NO: 162091 - DNA, 25 bp, Homo sapien
ggaccagagtgcttgaggcatctca

SEQ ID NO: 162092 - DNA, 25 bp, Homo sapien
tacctgcctttgacttgcttctagc

SEQ ID NO: 162093 - DNA, 25 bp, Homo sapien
tgcttctagcatagcctgggccaag

SEQ ID NO: 162094 - DNA, 25 bp, Homo sapien
tagttacactagctcatcctattcc

SEQ ID NO: 162095 - DNA, 25 bp, Homo sapien
tctgctgtttcccaatgaagttttc

SEQ ID NO: 162096 - DNA, 25 bp, Homo sapien
agatcagtggcaatctcagttccct

SEQ ID NO: 162097 - DNA, 25 bp, Homo sapien
gcaatctcagttcccttgctatgac

SEQ ID NO: 162098 - DNA, 25 bp, Homo sapien
ttgctatgaccctgctttgttcttt

SEQ ID NO: 162099 - DNA, 25 bp, Homo sapien
ctgctttgttctttcccgagaaaca

SEQ ID NO: 162100 - DNA, 25 bp, Homo sapien
tttcccgagaaacagttcagcagtg

SEQ ID NO: 162101 - DNA, 25 bp, Homo sapien
atgacatttcaagcaccaccttaag

SEQ ID NO: 162102 - DNA, 25 bp, Homo sapien
taagccagccagagtaggaccagtt

SEQ ID NO: 162103 - DNA, 25 bp, Homo sapien
agacctagggtgtggacagctcctt

SEQ ID NO: 162104 - DNA, 25 bp, Homo sapien
agctccttgcatcttaacactgtgc

SEQ ID NO: 162105 - DNA, 25 bp, Homo sapien
cctacccctctgtgaggagctgtgg

SEQ ID NO: 162106 - DNA, 25 bp, Homo sapien
gtgtgggtttgtctccagaacagaa

SEQ ID NO: 162107 - DNA, 25 bp, Homo sapien
gaatgatggatattctggctctggg

SEQ ID NO: 162108 - DNA, 25 bp, Homo sapien
agtagccttgctgaagccatcacag

SEQ ID NO: 162109 - DNA, 25 bp, Homo sapien
agctgccaggccctgaggttcagac

SEQ ID NO: 162110 - DNA, 25 bp, Homo sapien
gaggttcagaccctggaccccatag

SEQ ID NO: 162111 - DNA, 25 bp, Homo sapien
ctggaccccatagctggaggcctgt

SEQ ID NO: 162112 - DNA, 25 bp, Homo sapien
aagcccagattagggtggctgtcca

SEQ ID NO: 162113 - DNA, 25 bp, Homo sapien
gtggctgtccatccctggatagcta

SEQ ID NO: 162114 - DNA, 25 bp, Homo sapien
atccctggatagctatttgcacgaa

SEQ ID NO: 162115 - DNA, 25 bp, Homo sapien
gctatttgcacgaatcatggacata

SEQ ID NO: 162116 - DNA, 25 bp, Homo sapien
cagtcagttcaccacggctttgaag

SEQ ID NO: 162117 - DNA, 25 bp, Homo sapien
gttcaccacggctttgaagtcgtgt

SEQ ID NO: 162118 - DNA, 25 bp, Homo sapien
gaagtcgtgtatgaactgaccaaga

SEQ ID NO: 162119 - DNA, 25 bp, Homo sapien
tgaccaagatgtgtactatccggat

SEQ ID NO: 162120 - DNA, 25 bp, Homo sapien
gtactatccggatgagttttgttaa

SEQ ID NO: 162121 - DNA, 25 bp, Homo sapien
gggtgctgagtatcatcgccaggat

SEQ ID NO: 162122 - DNA, 25 bp, Homo sapien
tatcatcgccaggatgtcaccagca

SEQ ID NO: 162123 - DNA, 25 bp, Homo sapien
tgcagtggctggacaaagttctgac

SEQ ID NO: 162124 - DNA, 25 bp, Homo sapien
aaagttctgactcagatgggctctc

SEQ ID NO: 162125 - DNA, 25 bp, Homo sapien
atgggctctccacataaccccattt

SEQ ID NO: 162126 - DNA, 25 bp, Homo sapien
taaccccatttcttcagtgtcttaa

SEQ ID NO: 162127 - DNA, 25 bp, Homo sapien
ctcagctgtgaagaggatgcggctt

SEQ ID NO: 162128 - DNA, 25 bp, Homo sapien
aggatgcggcttgatacctggacat

SEQ ID NO: 162129 - DNA, 25 bp, Homo sapien
gatgcggcttgatacctggacatta

SEQ ID NO: 162130 - DNA, 25 bp, Homo sapien
gcggcttgatacctggacattaaag

SEQ ID NO: 162131 - DNA, 25 bp, Homo sapien
gatacctggacattaaagtgacgat

SEQ ID NO: 162132 - DNA, 25 bp, Homo sapien
ttaaagtgacgattcccactcccct

SEQ ID NO: 162133 - DNA, 25 bp, Homo sapien
tctcagcctccctgatgaagagttg

SEQ ID NO: 162134 - DNA, 25 bp, Homo sapien
agcctccctgatgaagagttgacaa

SEQ ID NO: 162135 - DNA, 25 bp, Homo sapien
gaagagttgacaatctcaccgcccg

SEQ ID NO: 162136 - DNA, 25 bp, Homo sapien
acttcctttcttgtgcttcgtgtcc

SEQ ID NO: 162137 - DNA, 25 bp, Homo sapien
ttcttgtgcttcgtgtcctgttgac

SEQ ID NO: 162138 - DNA, 25 bp, Homo sapien
tctgccaaagttgctcaccaaggtg

SEQ ID NO: 162139 - DNA, 25 bp, Homo sapien
ccaaggtgaagggttcctagccgct

SEQ ID NO: 162140 - DNA, 25 bp, Homo sapien
tgaagggttcctagccgctgggatt

SEQ ID NO: 162141 - DNA, 25 bp, Homo sapien
ctagccgctgggattgaagacattg

SEQ ID NO: 162142 - DNA, 25 bp, Homo sapien
aagacattggcctggcctcgttctc

SEQ ID NO: 162143 - DNA, 25 bp, Homo sapien
tggcccagctgggaccaaactctga

SEQ ID NO: 162144 - DNA, 25 bp, Homo sapien
gggaccaaactctgatcagtattag

SEQ ID NO: 162145 - DNA, 25 bp, Homo sapien
gtgaggtagacactggactccctgt

SEQ ID NO: 162146 - DNA, 25 bp, Homo sapien
agggccaacatgactaagctctctc

SEQ ID NO: 162147 - DNA, 25 bp, Homo sapien
atgactaagctctctcatgacccac

SEQ ID NO: 162148 - DNA, 25 bp, Homo sapien
gctccacactatctcttagctgagt

SEQ ID NO: 162149 - DNA, 25 bp, Homo sapien
gcacggagataccaagccatgatgt

SEQ ID NO: 162150 - DNA, 25 bp, Homo sapien
aagccatgatgtgccttccttagtg

SEQ ID NO: 162151 - DNA, 25 bp, Homo sapien
catgatgtgccttccttagtgaact

SEQ ID NO: 162152 - DNA, 25 bp, Homo sapien
gatgtgccttccttagtgaactgct

SEQ ID NO: 162153 - DNA, 25 bp, Homo sapien
gctgctgctgttcagacttttttaa

SEQ ID NO: 162154 - DNA, 25 bp, Homo sapien
tttggactaaagaaacagattctga

SEQ ID NO: 162155 - DNA, 25 bp, Homo sapien
ttttcttgcaatttaatgccaaaag

SEQ ID NO: 162156 - DNA, 25 bp, Homo sapien
aaagtttgccatgtgccttaaacat

SEQ ID NO: 162157 - DNA, 25 bp, Homo sapien
agtttgccatgtgccttaaacatat

SEQ ID NO: 162158 - DNA, 25 bp, Homo sapien
catattactatatattttccccttt

SEQ ID NO: 162159 - DNA, 25 bp, Homo sapien
aaatattttaagcaattgtccaata

SEQ ID NO: 162160 - DNA, 25 bp, Homo sapien
gttaaatatcaggaatataggccgg

SEQ ID NO: 162161 - DNA, 25 bp, Homo sapien
ttaaatatcaggaatataggccggg

SEQ ID NO: 162162 - DNA, 25 bp, Homo sapien
taaatatcaggaatataggccgggt

SEQ ID NO: 162163 - DNA, 25 bp, Homo sapien
aaatatcaggaatataggccgggtg

SEQ ID NO: 162164 - DNA, 25 bp, Homo sapien
aatatcaggaatataggccgggtgc

SEQ ID NO: 162165 - DNA, 25 bp, Homo sapien
atatcaggaatataggccgggtgcg

SEQ ID NO: 162166 - DNA, 25 bp, Homo sapien
tatcaggaatataggccgggtgcgg

SEQ ID NO: 162167 - DNA, 25 bp, Homo sapien
atcaggaatataggccgggtgcggt

SEQ ID NO: 162168 - DNA, 25 bp, Homo sapien
gcatggtagcaggtgtctgttatcc

SEQ ID NO: 162169 - DNA, 25 bp, Homo sapien
atggtagcaggtgtctgttatccca

SEQ ID NO: 162170 - DNA, 25 bp, Homo sapien
tgtctgttatcccagttaggaggct

SEQ ID NO: 162171 - DNA, 25 bp, Homo sapien
gataagattagttccctgatcccct

SEQ ID NO: 162172 - DNA, 25 bp, Homo sapien
tcttttcccaattcccttccttatg

SEQ ID NO: 162173 - DNA, 25 bp, Homo sapien
tccttatgctggacttttaaagctt

SEQ ID NO: 162174 - DNA, 25 bp, Homo sapien
ttgtgaaatggttgcttcctcctga

SEQ ID NO: 162175 - DNA, 25 bp, Homo sapien
tcctgattccctaattgtgctgtgt

SEQ ID NO: 162176 - DNA, 25 bp, Homo sapien
aattgtgctgtgttcgtgtcttgca

SEQ ID NO: 162177 - DNA, 25 bp, Homo sapien
gtgtcttgcactggaattcaacatt

SEQ ID NO: 162178 - DNA, 25 bp, Homo sapien
tcaacattcccttctccttttgtac

SEQ ID NO: 162179 - DNA, 25 bp, Homo sapien
tctccttttgtactgtgttgtgctt

SEQ ID NO: 162180 - DNA, 25 bp, Homo sapien
tactgtgttgtgcttgctgtctctc

SEQ ID NO: 162181 - DNA, 25 bp, Homo sapien
tgtctctcccggacacccttaaaga

SEQ ID NO: 162182 - DNA, 25 bp, Homo sapien
attttatgttctatatacccagtca

SEQ ID NO: 162183 - DNA, 25 bp, Homo sapien
atgttctatatacccagtcataaag

SEQ ID NO: 162184 - DNA, 25 bp, Homo sapien
gtcataaagtataagcatcagttgt

SEQ ID NO: 162185 - DNA, 25 bp, Homo sapien
aagcatcagttgtcattaaaagttt

SEQ ID NO: 162186 - DNA, 25 bp, Homo sapien
tacaaggccctgataaaattgatat

SEQ ID NO: 162187 - DNA, 25 bp, Homo sapien
atttcccagttagtattatcatatg

SEQ ID NO: 162188 - DNA, 25 bp, Homo sapien
attatcatatgtttgtacccgtcac

SEQ ID NO: 162189 - DNA, 25 bp, Homo sapien
gtttgtacccgtcacagttttcata

SEQ ID NO: 162190 - DNA, 25 bp, Homo sapien
acccgtcacagttttcatagtgctt

SEQ ID NO: 162191 - DNA, 25 bp, Homo sapien
catagtgctttcaaatacacctttt

SEQ ID NO: 162192 - DNA, 25 bp, Homo sapien
caaatacacctttttgatcattaaa

SEQ ID NO: 162193 - DNA, 25 bp, Homo sapien
ttcctttcacgtatttcttttagca

SEQ ID NO: 162194 - DNA, 25 bp, Homo sapien
tatttcttttagcagcacttctgct

SEQ ID NO: 162195 - DNA, 25 bp, Homo sapien
gcagcacttctgctactaaagttaa

SEQ ID NO: 162196 - DNA, 25 bp, Homo sapien
actaaagttaatgtgtttactctct

SEQ ID NO: 162197 - DNA, 25 bp, Homo sapien
tgtttactctctttccttcccacat

SEQ ID NO: 162198 - DNA, 25 bp, Homo sapien
tttccttcccacattctcaattaaa

SEQ ID NO: 162199 - DNA, 25 bp, Homo sapien
aaaaggtgagctaagcctcctcggt

SEQ ID NO: 162200 - DNA, 25 bp, Homo sapien
aaggtgagctaagcctcctcggtgt

SEQ ID NO: 162201 - DNA, 25 bp, Homo sapien
agctaagcctcctcggtgtttctga

SEQ ID NO: 162202 - DNA, 25 bp, Homo sapien
aagcctcctcggtgtttctgattaa

SEQ ID NO: 162203 - DNA, 25 bp, Homo sapien
cctcctcggtgtttctgattaacag

SEQ ID NO: 162204 - DNA, 25 bp, Homo sapien
acaccctgacgccagatgccgcaca

SEQ ID NO: 162205 - DNA, 25 bp, Homo sapien
ggcagacgtgacatctgtccagagg

SEQ ID NO: 162206 - DNA, 25 bp, Homo sapien
gaggcaccaagggaaccgcattccg

SEQ ID NO: 162207 - DNA, 25 bp, Homo sapien
aggaagggaagcctctgtgtgcccc

SEQ ID NO: 162208 - DNA, 25 bp, Homo sapien
gaagaggccctgagtcctgggatca

SEQ ID NO: 162209 - DNA, 25 bp, Homo sapien
ggccctgagtcctgggatcagacac

SEQ ID NO: 162210 - DNA, 25 bp, Homo sapien
tgagtcctgggatcagacacccctt

SEQ ID NO: 162211 - DNA, 25 bp, Homo sapien
ctgggatcagacaccccttcacgtg

SEQ ID NO: 162212 - DNA, 25 bp, Homo sapien
ccttcacgtgtatcccacacaaatg

SEQ ID NO: 162213 - DNA, 25 bp, Homo sapien
gtatcccacacaaatgcaagctcac

SEQ ID NO: 162214 - DNA, 25 bp, Homo sapien
acaaatgcaagctcaccaaggtccc

SEQ ID NO: 162215 - DNA, 25 bp, Homo sapien
caaatacggctggagtgccgacgag

SEQ ID NO: 162216 - DNA, 25 bp, Homo sapien
aaatacggctggagtgccgacgagt

SEQ ID NO: 162217 - DNA, 25 bp, Homo sapien
aatacggctggagtgccgacgagtc

SEQ ID NO: 162218 - DNA, 25 bp, Homo sapien
atacggctggagtgccgacgagtcg

SEQ ID NO: 162219 - DNA, 25 bp, Homo sapien
tacggctggagtgccgacgagtcgg

SEQ ID NO: 162220 - DNA, 25 bp, Homo sapien
acggctggagtgccgacgagtcggg

SEQ ID NO: 162221 - DNA, 25 bp, Homo sapien
tgccgacgagtcggggcagatcttc

SEQ ID NO: 162222 - DNA, 25 bp, Homo sapien
gccgacgagtcggggcagatcttca

SEQ ID NO: 162223 - DNA, 25 bp, Homo sapien
ccgacgagtcggggcagatcttcat

SEQ ID NO: 162224 - DNA, 25 bp, Homo sapien
aactgtggcggcagacacagcttgt

SEQ ID NO: 162225 - DNA, 25 bp, Homo sapien
ggcggcagacacagcttgtccacag

SEQ ID NO: 162226 - DNA, 25 bp, Homo sapien
ttgtccacagcttgggccaggcttc

SEQ ID NO: 162227 - DNA, 25 bp, Homo sapien
acagcttgggccaggcttcccctgt

SEQ ID NO: 162228 - DNA, 25 bp, Homo sapien
caccggtcggctgcttggcaaggct

SEQ ID NO: 162229 - DNA, 25 bp, Homo sapien
gctgcttggcaaggctgttcaggac

SEQ ID NO: 162230 - DNA, 25 bp, Homo sapien
tgttcaggacgtgcacttccccaag

SEQ ID NO: 162231 - DNA, 25 bp, Homo sapien
acttccccaagtcggcactgagtgg

SEQ ID NO: 162232 - DNA, 25 bp, Homo sapien
gggccttctgctggatgggcacctg

SEQ ID NO: 162233 - DNA, 25 bp, Homo sapien
acatttttgaacaatttacctgtca

SEQ ID NO: 162234 - DNA, 25 bp, Homo sapien
tttacctgtcaataaagcagaagac

SEQ ID NO: 162235 - DNA, 25 bp, Homo sapien
taggattagaggcttcccacttaaa

SEQ ID NO: 162236 - DNA, 25 bp, Homo sapien
gagaaatcttaggttttatcactgc

SEQ ID NO: 162237 - DNA, 25 bp, Homo sapien
gttttatcactgctatggtttccca

SEQ ID NO: 162238 - DNA, 25 bp, Homo sapien
ctatggtttcccatatttacttggg

SEQ ID NO: 162239 - DNA, 25 bp, Homo sapien
tttacttgggactgttctgactttc

SEQ ID NO: 162240 - DNA, 25 bp, Homo sapien
tgggactgttctgactttctttttc

SEQ ID NO: 162241 - DNA, 25 bp, Homo sapien
tttccagcccttagcttgggttaga

SEQ ID NO: 162242 - DNA, 25 bp, Homo sapien
aacaatgcattacttctaccttagg

SEQ ID NO: 162243 - DNA, 25 bp, Homo sapien
tctaccttaggtttaggagtaatat

SEQ ID NO: 162244 - DNA, 25 bp, Homo sapien
atacccggaaatctaagctcatgga

SEQ ID NO: 162245 - DNA, 25 bp, Homo sapien
ggagtccgtttttctagttgtacat

SEQ ID NO: 162246 - DNA, 25 bp, Homo sapien
gagaaaaactgtgaacctgtggttc

SEQ ID NO: 162247 - DNA, 25 bp, Homo sapien
caatgctccacctgcttatgagaaa

SEQ ID NO: 162248 - DNA, 25 bp, Homo sapien
gaaactctctgcagaacagtcacca

SEQ ID NO: 162249 - DNA, 25 bp, Homo sapien
agaacagtcaccaccaccttattca

SEQ ID NO: 162250 - DNA, 25 bp, Homo sapien
ttattcaccttaagagccagcgaga

SEQ ID NO: 162251 - DNA, 25 bp, Homo sapien
tatttctctcacacttttgcttgaa

SEQ ID NO: 162252 - DNA, 25 bp, Homo sapien
aatacagacatctaatgttctcctt

SEQ ID NO: 162253 - DNA, 25 bp, Homo sapien
tgttctcctttggaatggtgtagga

SEQ ID NO: 162254 - DNA, 25 bp, Homo sapien
ggaaaaatgcaagccatctctaata

SEQ ID NO: 162255 - DNA, 25 bp, Homo sapien
aaattttagtaggtccgctagcagt

SEQ ID NO: 162256 - DNA, 25 bp, Homo sapien
ggtccgctagcagtactaatcatgt

SEQ ID NO: 162257 - DNA, 25 bp, Homo sapien
agctcagcttcccaacacgcaggag

SEQ ID NO: 162258 - DNA, 25 bp, Homo sapien
taaacaccacgtcacttcatgcagg

SEQ ID NO: 162259 - DNA, 25 bp, Homo sapien
gtcacttcatgcaggtgaaacccag

SEQ ID NO: 162260 - DNA, 25 bp, Homo sapien
tgaaacccagtcactgtgagctccc

SEQ ID NO: 162261 - DNA, 25 bp, Homo sapien
cctagaggccccacctttggtgctt

SEQ ID NO: 162262 - DNA, 25 bp, Homo sapien
tccagaatcccgtaacacctgatta

SEQ ID NO: 162263 - DNA, 25 bp, Homo sapien
acctgattaactgaggcatccactt

SEQ ID NO: 162264 - DNA, 25 bp, Homo sapien
gcatccacttctttcagcagactga

SEQ ID NO: 162265 - DNA, 25 bp, Homo sapien
tcagcagactgatcaggacctccaa

SEQ ID NO: 162266 - DNA, 25 bp, Homo sapien
tgatcaggacctccaagccactgag

SEQ ID NO: 162267 - DNA, 25 bp, Homo sapien
ccaagccactgagcaatgtataacc

SEQ ID NO: 162268 - DNA, 25 bp, Homo sapien
agggactgagctaaacagtgttatt

SEQ ID NO: 162269 - DNA, 25 bp, Homo sapien
tggcattgctgctttcaaccagcga

SEQ ID NO: 162270 - DNA, 25 bp, Homo sapien
tgctgctttcaaccagcgactaatg

SEQ ID NO: 162271 - DNA, 25 bp, Homo sapien
agcgactaatgcaatccattcctct

SEQ ID NO: 162272 - DNA, 25 bp, Homo sapien
aatccattcctctcttgtttatagt

SEQ ID NO: 162273 - DNA, 25 bp, Homo sapien
agtaatctaagggttgagcagttaa

SEQ ID NO: 162274 - DNA, 25 bp, Homo sapien
gagcagttaaaacggcttcaggata

SEQ ID NO: 162275 - DNA, 25 bp, Homo sapien
cattaaaagggaaacgtgcctctgc

SEQ ID NO: 162276 - DNA, 25 bp, Homo sapien
gggtgcacgttcctcctggttcctt

SEQ ID NO: 162277 - DNA, 25 bp, Homo sapien
tggttccttcgcttgtgtttctgta

SEQ ID NO: 162278 - DNA, 25 bp, Homo sapien
gcttgtgtttctgtacttaccaaaa

SEQ ID NO: 162279 - DNA, 25 bp, Homo sapien
aaatttgaataagcagaacatactg

SEQ ID NO: 162280 - DNA, 25 bp, Homo sapien
gaacatactgttctcaacatactgt

SEQ ID NO: 162281 - DNA, 25 bp, Homo sapien
catactgttctcaacatactgtaat

SEQ ID NO: 162282 - DNA, 25 bp, Homo sapien
actgttctcaacatactgtaatcaa

SEQ ID NO: 162283 - DNA, 25 bp, Homo sapien
tactgtaatcaaaaggaggaatttc

SEQ ID NO: 162284 - DNA, 25 bp, Homo sapien
gaatttcagtgggtctctgtgtgtg

SEQ ID NO: 162285 - DNA, 25 bp, Homo sapien
atttcagtgggtctctgtgtgtgta

SEQ ID NO: 162286 - DNA, 25 bp, Homo sapien
tgtgtttgtgtgtttcaaggtcaga

SEQ ID NO: 162287 - DNA, 25 bp, Homo sapien
tgtttgtgtgtttcaaggtcagaac

SEQ ID NO: 162288 - DNA, 25 bp, Homo sapien
gtgtgtttcaaggtcagaacaggtt

SEQ ID NO: 162289 - DNA, 25 bp, Homo sapien
tgtttcaaggtcagaacaggttttt

SEQ ID NO: 162290 - DNA, 25 bp, Homo sapien
cctcctcagaccttatcaattcatt

SEQ ID NO: 162291 - DNA, 25 bp, Homo sapien
agacagaccctttggtgatgaaata

SEQ ID NO: 162292 - DNA, 25 bp, Homo sapien
taaaccagtgacttcagagcctatg

SEQ ID NO: 162293 - DNA, 25 bp, Homo sapien
agagcctatggtctcaactgtgctt

SEQ ID NO: 162294 - DNA, 25 bp, Homo sapien
gtgcttgaaaaacactgtctctgaa

SEQ ID NO: 162295 - DNA, 25 bp, Homo sapien
aaacaactttgtgattctccctgct

SEQ ID NO: 162296 - DNA, 25 bp, Homo sapien
ctgctccctgtggacaaaagcacat

SEQ ID NO: 162297 - DNA, 25 bp, Homo sapien
gcacataattctgctgttacgggta

SEQ ID NO: 162298 - DNA, 25 bp, Homo sapien
gttacgggtactttgctcatacgag

SEQ ID NO: 162299 - DNA, 25 bp, Homo sapien
acgagctttcatgttcagcatgcaa

SEQ ID NO: 162300 - DNA, 25 bp, Homo sapien
ggaatcatgcttgtccatgtgaaat

SEQ ID NO: 162301 - DNA, 25 bp, Homo sapien
agcggcagcgcgtcatggccgccca

SEQ ID NO: 162302 - DNA, 25 bp, Homo sapien
aggcagcaggccaccgaggacaaga

SEQ ID NO: 162303 - DNA, 25 bp, Homo sapien
ttccgggaaacagaataatttcgag

SEQ ID NO: 162304 - DNA, 25 bp, Homo sapien
aacagaataatttcgagcgcaaagc

SEQ ID NO: 162305 - DNA, 25 bp, Homo sapien
aatttcgagcgcaaagctgtgtacc

SEQ ID NO: 162306 - DNA, 25 bp, Homo sapien
ttcgagcgcaaagctgtgtaccaga

SEQ ID NO: 162307 - DNA, 25 bp, Homo sapien
cgagcgcaaagctgtgtaccagagg

SEQ ID NO: 162308 - DNA, 25 bp, Homo sapien
ctgtgtaccagaggcaagtcagagc

SEQ ID NO: 162309 - DNA, 25 bp, Homo sapien
tgtaccagaggcaagtcagagcccc

SEQ ID NO: 162310 - DNA, 25 bp, Homo sapien
gaggcaagtcagagcccccagtttg

SEQ ID NO: 162311 - DNA, 25 bp, Homo sapien
agagcccccagtttgctggccaaaa

SEQ ID NO: 162312 - DNA, 25 bp, Homo sapien
cagtgattgtctttttgggcttccc

SEQ ID NO: 162313 - DNA, 25 bp, Homo sapien
ctccaaaggaccttctgcagtggaa

SEQ ID NO: 162314 - DNA, 25 bp, Homo sapien
tgcagtggaagtgccacatccagtt

SEQ ID NO: 162315 - DNA, 25 bp, Homo sapien
gtggaagtgccacatccagttcttt

SEQ ID NO: 162316 - DNA, 25 bp, Homo sapien
ttgttgctgctgtgtttagataatt

SEQ ID NO: 162317 - DNA, 25 bp, Homo sapien
tgaagagatctttgtgccacacagg

SEQ ID NO: 162318 - DNA, 25 bp, Homo sapien
tgtgtacgtgtctgtgcgtgcaaca

SEQ ID NO: 162319 - DNA, 25 bp, Homo sapien
acgtgtctgtgcgtgcaacataaaa

SEQ ID NO: 162320 - DNA, 25 bp, Homo sapien
tgtgcgtgcaacataaaaatacagt

SEQ ID NO: 162321 - DNA, 25 bp, Homo sapien
aaatacagtagcacctaaggagctt

SEQ ID NO: 162322 - DNA, 25 bp, Homo sapien
acctaaggagcttgaatcttggttc

SEQ ID NO: 162323 - DNA, 25 bp, Homo sapien
tgtgacccatccttactctacttgg

SEQ ID NO: 162324 - DNA, 25 bp, Homo sapien
atccttactctacttggccaggcca

SEQ ID NO: 162325 - DNA, 25 bp, Homo sapien
ttggccaggccacagtaaaacaagt

SEQ ID NO: 162326 - DNA, 25 bp, Homo sapien
agagcagctgccacaactggccatg

SEQ ID NO: 162327 - DNA, 25 bp, Homo sapien
gccatgccctgccattgaaacagtg

SEQ ID NO: 162328 - DNA, 25 bp, Homo sapien
taagtttgatcaagccatggtgaca

SEQ ID NO: 162329 - DNA, 25 bp, Homo sapien
tgcattgatcatgaataggagccca

SEQ ID NO: 162330 - DNA, 25 bp, Homo sapien
gaataggagcccatgctagaagtac

SEQ ID NO: 162331 - DNA, 25 bp, Homo sapien
gtacattctctcagatttgaaccag

SEQ ID NO: 162332 - DNA, 25 bp, Homo sapien
attcttgccaagtaaccaccacttc

SEQ ID NO: 162333 - DNA, 25 bp, Homo sapien
caagtaaccaccacttctgccttag

SEQ ID NO: 162334 - DNA, 25 bp, Homo sapien
agggcatcctctgtacccctttaat

SEQ ID NO: 162335 - DNA, 25 bp, Homo sapien
ttaatgacccgtactgagaccacag

SEQ ID NO: 162336 - DNA, 25 bp, Homo sapien
cagctctgcagctaatgaggtcctg

SEQ ID NO: 162337 - DNA, 25 bp, Homo sapien
atgaggtcctgccacaacggaaaga

SEQ ID NO: 162338 - DNA, 25 bp, Homo sapien
agcggaaagtgatctgcatccccaa

SEQ ID NO: 162339 - DNA, 25 bp, Homo sapien
atctgcatccccaaaagtatcactc

SEQ ID NO: 162340 - DNA, 25 bp, Homo sapien
aagtatcactccttctcgaatcctt

SEQ ID NO: 162341 - DNA, 25 bp, Homo sapien
gaatccttcagaacatcaaggtgtt

SEQ ID NO: 162342 - DNA, 25 bp, Homo sapien
ttgacttcacctttagcccagaaga

SEQ ID NO: 162343 - DNA, 25 bp, Homo sapien
gaagcagctaaatgccctgaacaaa

SEQ ID NO: 162344 - DNA, 25 bp, Homo sapien
atattgtgcctatgcttacggtgga

SEQ ID NO: 162345 - DNA, 25 bp, Homo sapien
ttaccattctttgtaaacagttgga

SEQ ID NO: 162346 - DNA, 25 bp, Homo sapien
ctgactatgtgccaacgcctcgttt

SEQ ID NO: 162347 - DNA, 25 bp, Homo sapien
actatgtgccaacgcctcgtttcag

SEQ ID NO: 162348 - DNA, 25 bp, Homo sapien
atgtgccaacgcctcgtttcaggct

SEQ ID NO: 162349 - DNA, 25 bp, Homo sapien
aacgcctcgtttcaggcttgtgact

SEQ ID NO: 162350 - DNA, 25 bp, Homo sapien
gtttgggatttgtagttgcgacttc

SEQ ID NO: 162351 - DNA, 25 bp, Homo sapien
ggatttgtagttgcgacttcttcga

SEQ ID NO: 162352 - DNA, 25 bp, Homo sapien
tttgtagttgcgacttcttcgatag

SEQ ID NO: 162353 - DNA, 25 bp, Homo sapien
tgtagttgcgacttcttcgatagtt

SEQ ID NO: 162354 - DNA, 25 bp, Homo sapien
acgtccattgctggcaactgacttg

SEQ ID NO: 162355 - DNA, 25 bp, Homo sapien
tccattgctggcaactgacttgtca

SEQ ID NO: 162356 - DNA, 25 bp, Homo sapien
agttacacacaatggccacagcagt

SEQ ID NO: 162357 - DNA, 25 bp, Homo sapien
gtttgtctttaatagtatagtgcct

SEQ ID NO: 162358 - DNA, 25 bp, Homo sapien
tagtgcctatactcatgtaatcggt

SEQ ID NO: 162359 - DNA, 25 bp, Homo sapien
tgtaatcggttactcactactgcct

SEQ ID NO: 162360 - DNA, 25 bp, Homo sapien
tcggttactcactactgcctttaaa

SEQ ID NO: 162361 - DNA, 25 bp, Homo sapien
acaggattatagtgccttaaccgat

SEQ ID NO: 162362 - DNA, 25 bp, Homo sapien
gccttaaccgatatattttgtgact

SEQ ID NO: 162363 - DNA, 25 bp, Homo sapien
ttaaaactgctcttctgctctagta

SEQ ID NO: 162364 - DNA, 25 bp, Homo sapien
tgctctagtaccatgcttagtgcaa

SEQ ID NO: 162365 - DNA, 25 bp, Homo sapien
gattatttctatgtacaactgatgc

SEQ ID NO: 162366 - DNA, 25 bp, Homo sapien
caactgatgcttgttcttattttaa

SEQ ID NO: 162367 - DNA, 25 bp, Homo sapien
gtcattgctgtttcatctactgttg

SEQ ID NO: 162368 - DNA, 25 bp, Homo sapien
gtttcatctactgttgctgtgtttg

SEQ ID NO: 162369 - DNA, 25 bp, Homo sapien
ctgtgtttgccttgatgctgatcat

SEQ ID NO: 162370 - DNA, 25 bp, Homo sapien
tcacccttgtcagtgtctattgcac

SEQ ID NO: 162371 - DNA, 25 bp, Homo sapien
tcagtgtctattgcaccaggaagaa

SEQ ID NO: 162372 - DNA, 25 bp, Homo sapien
gaaaggatgagctcaaatcgaccaa

SEQ ID NO: 162373 - DNA, 25 bp, Homo sapien
aaatcgaccaaatttgactctgcaa

SEQ ID NO: 162374 - DNA, 25 bp, Homo sapien
tttgactctgcaaaatcatgctttt

SEQ ID NO: 162375 - DNA, 25 bp, Homo sapien
gattaactcgacaatatggccagct

SEQ ID NO: 162376 - DNA, 25 bp, Homo sapien
catggatttcgcctaagtgatatta

SEQ ID NO: 162377 - DNA, 25 bp, Homo sapien
agtgatattacagccacctcattct

SEQ ID NO: 162378 - DNA, 25 bp, Homo sapien
gaagttctcatagaaagcgtataac

SEQ ID NO: 162379 - DNA, 25 bp, Homo sapien
agcgtataacataggtcttcagaaa

SEQ ID NO: 162380 - DNA, 25 bp, Homo sapien
gtataacataggtcttcagaaacta

SEQ ID NO: 162381 - DNA, 25 bp, Homo sapien
aaatccatagactaaaatctgagaa

SEQ ID NO: 162382 - DNA, 25 bp, Homo sapien
tttaacatatgcaagtcagccaaac

SEQ ID NO: 162383 - DNA, 25 bp, Homo sapien
gcaagtcagccaaacataagctacc

SEQ ID NO: 162384 - DNA, 25 bp, Homo sapien
tcagccaaacataagctaccaaaat

SEQ ID NO: 162385 - DNA, 25 bp, Homo sapien
taaagagcaatgtgttctggctgtt

SEQ ID NO: 162386 - DNA, 25 bp, Homo sapien
tttccctaagtggtaagcaattact

SEQ ID NO: 162387 - DNA, 25 bp, Homo sapien
gtggtaagcaattactttaaaacat

SEQ ID NO: 162388 - DNA, 25 bp, Homo sapien
catcggtatcgggagctgcggtggc

SEQ ID NO: 162389 - DNA, 25 bp, Homo sapien
agacctctctactgggagggacgct

SEQ ID NO: 162390 - DNA, 25 bp, Homo sapien
tctctactgggagggacgctcacaa

SEQ ID NO: 162391 - DNA, 25 bp, Homo sapien
tctactgggagggacgctcacaagc

SEQ ID NO: 162392 - DNA, 25 bp, Homo sapien
tactgggagggacgctcacaagcta

SEQ ID NO: 162393 - DNA, 25 bp, Homo sapien
tgggagggacgctcacaagctaata

SEQ ID NO: 162394 - DNA, 25 bp, Homo sapien
ggagggacgctcacaagctaataga

SEQ ID NO: 162395 - DNA, 25 bp, Homo sapien
gggacgctcacaagctaatagactt

SEQ ID NO: 162396 - DNA, 25 bp, Homo sapien
gctcacaagctaatagacttcctta

SEQ ID NO: 162397 - DNA, 25 bp, Homo sapien
agctaatagacttccttaagctgaa

SEQ ID NO: 162398 - DNA, 25 bp, Homo sapien
cgactgatgagcgtactgtaactgg

SEQ ID NO: 162399 - DNA, 25 bp, Homo sapien
ggacatcagccactttttatattca

SEQ ID NO: 162400 - DNA, 25 bp, Homo sapien
ggcttaaatgtagcaatctctgcgt

SEQ ID NO: 162401 - DNA, 25 bp, Homo sapien
atctctgcgttaattaaatgccttt

SEQ ID NO: 162402 - DNA, 25 bp, Homo sapien
tcatgatttgccacaatgtccttaa

SEQ ID NO: 162403 - DNA, 25 bp, Homo sapien
caatgtccttaactctaatgcctgg

SEQ ID NO: 162404 - DNA, 25 bp, Homo sapien
taatgcctggactggccatgttcta

SEQ ID NO: 162405 - DNA, 25 bp, Homo sapien
actggccatgttctagtctgttgcg

SEQ ID NO: 162406 - DNA, 25 bp, Homo sapien
gtctgttgcgctgttacaatctgta

SEQ ID NO: 162407 - DNA, 25 bp, Homo sapien
tacaatctgtattggtgctagtcag

SEQ ID NO: 162408 - DNA, 25 bp, Homo sapien
gaaaattcctagctcacatagccca

SEQ ID NO: 162409 - DNA, 25 bp, Homo sapien
aggtggattaccagtattgttcaat

SEQ ID NO: 162410 - DNA, 25 bp, Homo sapien
ataatccatggttcaaagactgtat

SEQ ID NO: 162411 - DNA, 25 bp, Homo sapien
attgttcagcaccacgatgctctga

SEQ ID NO: 162412 - DNA, 25 bp, Homo sapien
gcaccacgatgctctgatttaattc

SEQ ID NO: 162413 - DNA, 25 bp, Homo sapien
gatgctctgatttaattctagaaac

SEQ ID NO: 162414 - DNA, 25 bp, Homo sapien
atttgattacctcttgtttgtgaca

SEQ ID NO: 162415 - DNA, 25 bp, Homo sapien
aacattgtacatagggtgttttcct

SEQ ID NO: 162416 - DNA, 25 bp, Homo sapien
cagtttcccctgagacttaatgtaa

SEQ ID NO: 162417 - DNA, 25 bp, Homo sapien
ccctgagacttaatgtaaccactta

SEQ ID NO: 162418 - DNA, 25 bp, Homo sapien
aaccacttaatgtaatcactatctc

SEQ ID NO: 162419 - DNA, 25 bp, Homo sapien
gtaatcactatctcattgtttcatc

SEQ ID NO: 162420 - DNA, 25 bp, Homo sapien
ataaacttgtaaacttcatctattt

SEQ ID NO: 162421 - DNA, 25 bp, Homo sapien
cattatattattctgtacaaaggct

SEQ ID NO: 162422 - DNA, 25 bp, Homo sapien
cagatgcccagcctcatagctgaag

SEQ ID NO: 162423 - DNA, 25 bp, Homo sapien
agcctcatagctgaagttgcctgaa

SEQ ID NO: 162424 - DNA, 25 bp, Homo sapien
aagttgcctgaatgatcctcctgtt

SEQ ID NO: 162425 - DNA, 25 bp, Homo sapien
tggcctccctgagcatgtccattga

SEQ ID NO: 162426 - DNA, 25 bp, Homo sapien
tgtccattgacagtgaggtcccacc

SEQ ID NO: 162427 - DNA, 25 bp, Homo sapien
ttgccaacctcacactgctatgatt

SEQ ID NO: 162428 - DNA, 25 bp, Homo sapien
tgctatgattgccaactccagcggt

SEQ ID NO: 162429 - DNA, 25 bp, Homo sapien
attgccaactccagcggtcccatgt

SEQ ID NO: 162430 - DNA, 25 bp, Homo sapien
ggtcccatgtcagccttctgatgat

SEQ ID NO: 162431 - DNA, 25 bp, Homo sapien
atgtcagccttctgatgatcccact

SEQ ID NO: 162432 - DNA, 25 bp, Homo sapien
cttcctaattaaatcagactgtttg

SEQ ID NO: 162433 - DNA, 25 bp, Homo sapien
gttcagcacttgtctcattttaatg

SEQ ID NO: 162434 - DNA, 25 bp, Homo sapien
tgcttccattttcctacaggcagtc

SEQ ID NO: 162435 - DNA, 25 bp, Homo sapien
ttttcctacaggcagtctctctctt

SEQ ID NO: 162436 - DNA, 25 bp, Homo sapien
agtcccactgtgcaggtgctattgt

SEQ ID NO: 162437 - DNA, 25 bp, Homo sapien
gcaggtgctattgttactcttacga

SEQ ID NO: 162438 - DNA, 25 bp, Homo sapien
ttctaagtgaaatttctagcctgca

SEQ ID NO: 162439 - DNA, 25 bp, Homo sapien
ctagcctgcactttgatgtcatgtg

SEQ ID NO: 162440 - DNA, 25 bp, Homo sapien
tgatgtcatgtgttccctttgtctt

SEQ ID NO: 162441 - DNA, 25 bp, Homo sapien
tttcaaactccaaggttcccctgtg

SEQ ID NO: 162442 - DNA, 25 bp, Homo sapien
tgggaaggcctcttggagaccttac

SEQ ID NO: 162443 - DNA, 25 bp, Homo sapien
ttacccctggctgtttggactttgt

SEQ ID NO: 162444 - DNA, 25 bp, Homo sapien
ggacattatttcgtgttgtgttctt

SEQ ID NO: 162445 - DNA, 25 bp, Homo sapien
gttgtgttctttataaccaccgagt

SEQ ID NO: 162446 - DNA, 25 bp, Homo sapien
tataaccaccgagtattaaactgta

SEQ ID NO: 162447 - DNA, 25 bp, Homo sapien
tgaagcataaacatcacatggcatg

SEQ ID NO: 162448 - DNA, 25 bp, Homo sapien
tttgtcattgttttcaggtactgag

SEQ ID NO: 162449 - DNA, 25 bp, Homo sapien
aggtactgagttcttacttgagtat

SEQ ID NO: 162450 - DNA, 25 bp, Homo sapien
aacaccaacactgtaacatttacga

SEQ ID NO: 162451 - DNA, 25 bp, Homo sapien
ttcagttttactgcattttcacaac

SEQ ID NO: 162452 - DNA, 25 bp, Homo sapien
ttcacaacatatcagacttcaccaa

SEQ ID NO: 162453 - DNA, 25 bp, Homo sapien
ccaaatatatgccttactattgtat

SEQ ID NO: 162454 - DNA, 25 bp, Homo sapien
ttgtattatagtactgctttactgt

SEQ ID NO: 162455 - DNA, 25 bp, Homo sapien
atgtgcatgcatcttgaagcaacaa

SEQ ID NO: 162456 - DNA, 25 bp, Homo sapien
tgaagcaacaaagcagccacagttt

SEQ ID NO: 162457 - DNA, 25 bp, Homo sapien
acaaagcagccacagtttcagacaa

SEQ ID NO: 162458 - DNA, 25 bp, Homo sapien
gtttcagacaaatgttcagtgtgag

SEQ ID NO: 162459 - DNA, 25 bp, Homo sapien
gaggaaaacatgttcagtgaggaaa

SEQ ID NO: 162460 - DNA, 25 bp, Homo sapien
attcagacaaatgttcagtgaggaa

SEQ ID NO: 162461 - DNA, 25 bp, Homo sapien
taggcagatgttgacttgaggagtt

SEQ ID NO: 162462 - DNA, 25 bp, Homo sapien
gacttgaggagttaatgtgatcttt

SEQ ID NO: 162463 - DNA, 25 bp, Homo sapien
gggagatacatcttatagagttaga

SEQ ID NO: 162464 - DNA, 25 bp, Homo sapien
aatttctaaagggagattctggctt

SEQ ID NO: 162465 - DNA, 25 bp, Homo sapien
tctaaagggagattctggcttggga

SEQ ID NO: 162466 - DNA, 25 bp, Homo sapien
ctgggaagtcctgcgtttcagtgga

SEQ ID NO: 162467 - DNA, 25 bp, Homo sapien
gaagtcctgcgtttcagtggagcgt

SEQ ID NO: 162468 - DNA, 25 bp, Homo sapien
agtcctgcgtttcagtggagcgtat

SEQ ID NO: 162469 - DNA, 25 bp, Homo sapien
ctgcgtttcagtggagcgtatgagc

SEQ ID NO: 162470 - DNA, 25 bp, Homo sapien
tttcagtggagcgtatgagcgtcaa

SEQ ID NO: 162471 - DNA, 25 bp, Homo sapien
cagtggagcgtatgagcgtcaagtc

SEQ ID NO: 162472 - DNA, 25 bp, Homo sapien
gagcgtatgagcgtcaagtcctgct

SEQ ID NO: 162473 - DNA, 25 bp, Homo sapien
gcgtatgagcgtcaagtcctgcttt

SEQ ID NO: 162474 - DNA, 25 bp, Homo sapien
tatgagcgtcaagtcctgctttctc

SEQ ID NO: 162475 - DNA, 25 bp, Homo sapien
agtcctgctttctcagtagccccat

SEQ ID NO: 162476 - DNA, 25 bp, Homo sapien
tgctttctcagtagccccattgcgg

SEQ ID NO: 162477 - DNA, 25 bp, Homo sapien
gaaggacctgatgccatgtatgtca

SEQ ID NO: 162478 - DNA, 25 bp, Homo sapien
gacctgatgccatgtatgtcaaatt

SEQ ID NO: 162479 - DNA, 25 bp, Homo sapien
acatcaggcacgataaaagccatgt

SEQ ID NO: 162480 - DNA, 25 bp, Homo sapien
aaaagccatgttgagtggcccaggt

SEQ ID NO: 162481 - DNA, 25 bp, Homo sapien
ggtcagtttgctgagaacgaaacca

SEQ ID NO: 162482 - DNA, 25 bp, Homo sapien
ttgctgagaacgaaaccaatgaggt

SEQ ID NO: 162483 - DNA, 25 bp, Homo sapien
ttcacatgtgctatcgaaagtatgc

SEQ ID NO: 162484 - DNA, 25 bp, Homo sapien
gtatgcatgtattttacgtacaagg

SEQ ID NO: 162485 - DNA, 25 bp, Homo sapien
ttttacgtacaaggttcgctacact

SEQ ID NO: 162486 - DNA, 25 bp, Homo sapien
acgtacaaggttcgctacactaaca

SEQ ID NO: 162487 - DNA, 25 bp, Homo sapien
agattcctgaattcccaattgcacc

SEQ ID NO: 162488 - DNA, 25 bp, Homo sapien
gtctgtgccggagggttcttgttca

SEQ ID NO: 162489 - DNA, 25 bp, Homo sapien
ttcttgttcaggtctcttatgctat

SEQ ID NO: 162490 - DNA, 25 bp, Homo sapien
cttatgctattggagtttctcatcc

SEQ ID NO: 162491 - DNA, 25 bp, Homo sapien
tttctcatccattatctatctccat

SEQ ID NO: 162492 - DNA, 25 bp, Homo sapien
tttccattatggtacctctcagaag

SEQ ID NO: 162493 - DNA, 25 bp, Homo sapien
gaagaagaatttcgatctccgccct

SEQ ID NO: 162494 - DNA, 25 bp, Homo sapien
gggtcattgtcagggatctggatct

SEQ ID NO: 162495 - DNA, 25 bp, Homo sapien
gaagccaatttatcagaggactgca

SEQ ID NO: 162496 - DNA, 25 bp, Homo sapien
gaggactgcagcctatggccacttt

SEQ ID NO: 162497 - DNA, 25 bp, Homo sapien
tggccactttggtagggacagcttc

SEQ ID NO: 162498 - DNA, 25 bp, Homo sapien
tgctcgttgggtggcaaaatccctt

SEQ ID NO: 162499 - DNA, 25 bp, Homo sapien
agctgatcgccaagagcaacggcaa

SEQ ID NO: 162500 - DNA, 25 bp, Homo sapien
acggcaaaggcaaggactgcgtctt

SEQ ID NO: 162501 - DNA, 25 bp, Homo sapien
aggactgcgtcttcacggagattgt

SEQ ID NO: 162502 - DNA, 25 bp, Homo sapien
ggagaacaactacacagcgctgcag

SEQ ID NO: 162503 - DNA, 25 bp, Homo sapien
tacacagcgctgcagaatgccaagt

SEQ ID NO: 162504 - DNA, 25 bp, Homo sapien
atgccaagtacgagggctggtacat

SEQ ID NO: 162505 - DNA, 25 bp, Homo sapien
tggtacatggccttcacccgcaagg

SEQ ID NO: 162506 - DNA, 25 bp, Homo sapien
gcaagggctccaagacgcggcagca

SEQ ID NO: 162507 - DNA, 25 bp, Homo sapien
agcaccagcgtgaggtccacttcat

SEQ ID NO: 162508 - DNA, 25 bp, Homo sapien
gaggtccacttcatgaagcggctgc

SEQ ID NO: 162509 - DNA, 25 bp, Homo sapien
agagcctgcgcttcgagttcctcaa

SEQ ID NO: 162510 - DNA, 25 bp, Homo sapien
taaggccttagccatgatctgcagg

SEQ ID NO: 162511 - DNA, 25 bp, Homo sapien
ggcccggcctattgcttgggtctct

SEQ ID NO: 162512 - DNA, 25 bp, Homo sapien
cttgggtctctctctatttatatat

SEQ ID NO: 162513 - DNA, 25 bp, Homo sapien
atatatctaagttcacagtgtttct

SEQ ID NO: 162514 - DNA, 25 bp, Homo sapien
taagcttctagaggctcatggccct

SEQ ID NO: 162515 - DNA, 25 bp, Homo sapien
tcatggccctgtagttaggcctggc

SEQ ID NO: 162516 - DNA, 25 bp, Homo sapien
gtagttaggcctggctcattctgca

SEQ ID NO: 162517 - DNA, 25 bp, Homo sapien
ggctcattctgcacctttccaggga

SEQ ID NO: 162518 - DNA, 25 bp, Homo sapien
aatcttctttttcaggctcgccaag

SEQ ID NO: 162519 - DNA, 25 bp, Homo sapien
gctcgccaaggcctaggacctatgt

SEQ ID NO: 162520 - DNA, 25 bp, Homo sapien
ggcctaggacctatgttgtaatttt

SEQ ID NO: 162521 - DNA, 25 bp, Homo sapien
ttcacctctcagctttagcaggaca

SEQ ID NO: 162522 - DNA, 25 bp, Homo sapien
ttagcaggacatgaaccagttataa

SEQ ID NO: 162523 - DNA, 25 bp, Homo sapien
ccagttataacaagatggccctgca

SEQ ID NO: 162524 - DNA, 25 bp, Homo sapien
gcagctggttacaagaatgtgacat

SEQ ID NO: 162525 - DNA, 25 bp, Homo sapien
gtgacatggcaggatctatggaacc

SEQ ID NO: 162526 - DNA, 25 bp, Homo sapien
gatgtaggtctttcacagctagctt

SEQ ID NO: 162527 - DNA, 25 bp, Homo sapien
aagtgctttgttattatttcagagg

SEQ ID NO: 162528 - DNA, 25 bp, Homo sapien
gaatggcgattgaaatgttacaaca

SEQ ID NO: 162529 - DNA, 25 bp, Homo sapien
acagagatttcttggtggtagctat

SEQ ID NO: 162530 - DNA, 25 bp, Homo sapien
tcttggtggtagctatttgggtaaa

SEQ ID NO: 162531 - DNA, 25 bp, Homo sapien
ggtatatgggtatttttctgtacat

SEQ ID NO: 162532 - DNA, 25 bp, Homo sapien
gtgtttgtgcctgtcagacacttaa

SEQ ID NO: 162533 - DNA, 25 bp, Homo sapien
gacattgactttagccatttgtgaa

SEQ ID NO: 162534 - DNA, 25 bp, Homo sapien
tgtgaaatgggtttgctttttccct

SEQ ID NO: 162535 - DNA, 25 bp, Homo sapien
ttcccttttcctacagacgtatatg

SEQ ID NO: 162536 - DNA, 25 bp, Homo sapien
tttcctacagacgtatatgctagat

SEQ ID NO: 162537 - DNA, 25 bp, Homo sapien
gtatatgctagatgtcacgtgatca

SEQ ID NO: 162538 - DNA, 25 bp, Homo sapien
atgtcacgtgatcatcagaaacaga

SEQ ID NO: 162539 - DNA, 25 bp, Homo sapien
tcagaaacagatatccgagtgggtg

SEQ ID NO: 162540 - DNA, 25 bp, Homo sapien
aggtgtgctttagatttctcattag

SEQ ID NO: 162541 - DNA, 25 bp, Homo sapien
gaagaccaccaaactggtaatattt

SEQ ID NO: 162542 - DNA, 25 bp, Homo sapien
atagcattttaatagcttgatcaaa

SEQ ID NO: 162543 - DNA, 25 bp, Homo sapien
gaacattcacttttgttaacagtat

SEQ ID NO: 162544 - DNA, 25 bp, Homo sapien
tttgttaacagtatttctcttttat

SEQ ID NO: 162545 - DNA, 25 bp, Homo sapien
tctcttttattctgttatatagtgg

SEQ ID NO: 162546 - DNA, 25 bp, Homo sapien
tatagtggatgatatacacagtggc

SEQ ID NO: 162547 - DNA, 25 bp, Homo sapien
acacagtggcaaaacaaaagtacat

SEQ ID NO: 162548 - DNA, 25 bp, Homo sapien
gaaaaatgtcactatatcttcccat

SEQ ID NO: 162549 - DNA, 25 bp, Homo sapien
gtcactatatcttcccatttaacat

SEQ ID NO: 162550 - DNA, 25 bp, Homo sapien
atcttcccatttaacattgtttttg

SEQ ID NO: 162551 - DNA, 25 bp, Homo sapien
attgggtgtagatttctgacatcaa

SEQ ID NO: 162552 - DNA, 25 bp, Homo sapien
gacatcaaaacttggacccttggaa

SEQ ID NO: 162553 - DNA, 25 bp, Homo sapien
aatccttgtgacttacaatttgcac

SEQ ID NO: 162554 - DNA, 25 bp, Homo sapien
aacccacggcactgcattcaagatg

SEQ ID NO: 162555 - DNA, 25 bp, Homo sapien
ttcaagatgcttccaagggcagcca

SEQ ID NO: 162556 - DNA, 25 bp, Homo sapien
agctccacccatcattggtgtgcag

SEQ ID NO: 162557 - DNA, 25 bp, Homo sapien
atcattggtgtgcagcaccaggcag

SEQ ID NO: 162558 - DNA, 25 bp, Homo sapien
gcatcggcctcgctgtggccatcaa

SEQ ID NO: 162559 - DNA, 25 bp, Homo sapien
gggctatttgtcactagctacttac

SEQ ID NO: 162560 - DNA, 25 bp, Homo sapien
gtcactagctacttactggcttatt

SEQ ID NO: 162561 - DNA, 25 bp, Homo sapien
agctgcctgaatgccattgtctatg

SEQ ID NO: 162562 - DNA, 25 bp, Homo sapien
tgaatgccattgtctatgggctctt

SEQ ID NO: 162563 - DNA, 25 bp, Homo sapien
gggctcttgaaccaaaacttccgca

SEQ ID NO: 162564 - DNA, 25 bp, Homo sapien
aagaggatcctcttggccctttgga

SEQ ID NO: 162565 - DNA, 25 bp, Homo sapien
ttagcaatgtagtatcttgagccat

SEQ ID NO: 162566 - DNA, 25 bp, Homo sapien
gtagtatcttgagccattaattttt

SEQ ID NO: 162567 - DNA, 25 bp, Homo sapien
gaaggtatatagaaaccttttcaga

SEQ ID NO: 162568 - DNA, 25 bp, Homo sapien
atgttcttctatcaaataccttatt

SEQ ID NO: 162569 - DNA, 25 bp, Homo sapien
ttaccttacagatatttgttgcaca

SEQ ID NO: 162570 - DNA, 25 bp, Homo sapien
tacagatatttgttgcacaggcaga

SEQ ID NO: 162571 - DNA, 25 bp, Homo sapien
tatttgttgcacaggcagatactgc

SEQ ID NO: 162572 - DNA, 25 bp, Homo sapien
aactgcaaaaccaatctgtatcatg

SEQ ID NO: 162573 - DNA, 25 bp, Homo sapien
aaaccaatctgtatcatgtaccaaa

SEQ ID NO: 162574 - DNA, 25 bp, Homo sapien
atctgtatcatgtaccaaactgact

SEQ ID NO: 162575 - DNA, 25 bp, Homo sapien
gtatcatgtaccaaactgacttaaa

SEQ ID NO: 162576 - DNA, 25 bp, Homo sapien
tttattaccagaccctctgctgcgg

SEQ ID NO: 162577 - DNA, 25 bp, Homo sapien
tctgctgcgggattactgggtgtat

SEQ ID NO: 162578 - DNA, 25 bp, Homo sapien
tactgggtgtatgaaggctctctca

SEQ ID NO: 162579 - DNA, 25 bp, Homo sapien
tcaccatcccaccttgcagtgaagg

SEQ ID NO: 162580 - DNA, 25 bp, Homo sapien
aggtgtcacctggatattattccga

SEQ ID NO: 162581 - DNA, 25 bp, Homo sapien
gatattattccgataccctttaact

SEQ ID NO: 162582 - DNA, 25 bp, Homo sapien
ataccctttaactatatcccagcta

SEQ ID NO: 162583 - DNA, 25 bp, Homo sapien
tttgggagacaactttcggcccact

SEQ ID NO: 162584 - DNA, 25 bp, Homo sapien
ccactcagcctcttagtgacagagt

SEQ ID NO: 162585 - DNA, 25 bp, Homo sapien
tagagctgcatttcagtagccaaag

SEQ ID NO: 162586 - DNA, 25 bp, Homo sapien
ggaacaagtctgtcttcatgaggga

SEQ ID NO: 162587 - DNA, 25 bp, Homo sapien
gaatttccgtcatcaactttcttga

SEQ ID NO: 162588 - DNA, 25 bp, Homo sapien
tcatcaactttcttgaccagctttc

SEQ ID NO: 162589 - DNA, 25 bp, Homo sapien
aactttcttgaccagctttccctgg

SEQ ID NO: 162590 - DNA, 25 bp, Homo sapien
ggcaaatggagcgaggtcccacttt

SEQ ID NO: 162591 - DNA, 25 bp, Homo sapien
aatggagcgaggtcccactttgcgt

SEQ ID NO: 162592 - DNA, 25 bp, Homo sapien
cactttgcgtctccttgtaggcagt

SEQ ID NO: 162593 - DNA, 25 bp, Homo sapien
tctccttgtaggcagtgcgtccatc

SEQ ID NO: 162594 - DNA, 25 bp, Homo sapien
cttgtaggcagtgcgtccatccttc

SEQ ID NO: 162595 - DNA, 25 bp, Homo sapien
ccatccttccctagggcaggaattc

SEQ ID NO: 162596 - DNA, 25 bp, Homo sapien
actttcctgggagggcctcatgttt

SEQ ID NO: 162597 - DNA, 25 bp, Homo sapien
agggcctcatgttttatctggttct

SEQ ID NO: 162598 - DNA, 25 bp, Homo sapien
tgtcttgtaaaaccactggacagag

SEQ ID NO: 162599 - DNA, 25 bp, Homo sapien
aaaccactggacagagggccagagt

SEQ ID NO: 162600 - DNA, 25 bp, Homo sapien
tggtgggtggtcactgagaccactc

SEQ ID NO: 162601 - DNA, 25 bp, Homo sapien
cactatttctgcctgccccattgta

SEQ ID NO: 162602 - DNA, 25 bp, Homo sapien
cctagcactgagacttgtgcctgga

SEQ ID NO: 162603 - DNA, 25 bp, Homo sapien
actgagacttgtgcctggaaggaaa

SEQ ID NO: 162604 - DNA, 25 bp, Homo sapien
gggcacctgaggttcacgctgctag

SEQ ID NO: 162605 - DNA, 25 bp, Homo sapien
gaggttcacgctgctagcgtggaca

SEQ ID NO: 162606 - DNA, 25 bp, Homo sapien
ctagcgtggacatagccctgtgata

SEQ ID NO: 162607 - DNA, 25 bp, Homo sapien
gacatagccctgtgatactgcatct

SEQ ID NO: 162608 - DNA, 25 bp, Homo sapien
gccctgtgatactgcatctcactgg

SEQ ID NO: 162609 - DNA, 25 bp, Homo sapien
ggctggacgagcacacgctggtcac

SEQ ID NO: 162610 - DNA, 25 bp, Homo sapien
tggacgagcacacgctggtcacgac

SEQ ID NO: 162611 - DNA, 25 bp, Homo sapien
acgctggtcacgacctcccatgatg

SEQ ID NO: 162612 - DNA, 25 bp, Homo sapien
gcctctgtcaaggagtggacaatca

SEQ ID NO: 162613 - DNA, 25 bp, Homo sapien
ggagtggacaatcacctactgagga

SEQ ID NO: 162614 - DNA, 25 bp, Homo sapien
ccgcctctggatggaccgaatcagg

SEQ ID NO: 162615 - DNA, 25 bp, Homo sapien
ctagagtttaactgcagcggaacat

SEQ ID NO: 162616 - DNA, 25 bp, Homo sapien
aactgcagcggaacatgtcatttct

SEQ ID NO: 162617 - DNA, 25 bp, Homo sapien
ctcgtctctgcagggtgtctgtaca

SEQ ID NO: 162618 - DNA, 25 bp, Homo sapien
tctctgcagggtgtctgtacacgtt

SEQ ID NO: 162619 - DNA, 25 bp, Homo sapien
agctttagacagtaacagtttgcac

SEQ ID NO: 162620 - DNA, 25 bp, Homo sapien
ggcacaggtccagggagacagactc

SEQ ID NO: 162621 - DNA, 25 bp, Homo sapien
cagactctgaatgggactgagtccc

SEQ ID NO: 162622 - DNA, 25 bp, Homo sapien
tttccgatgagactcagcccaccat

SEQ ID NO: 162623 - DNA, 25 bp, Homo sapien
tggactctcctaagcacctctcagg

SEQ ID NO: 162624 - DNA, 25 bp, Homo sapien
agcacctctcaggagagccacaggt

SEQ ID NO: 162625 - DNA, 25 bp, Homo sapien
actgcctcctcaaatcacatttgtg

SEQ ID NO: 162626 - DNA, 25 bp, Homo sapien
aatcacatttgtgcctggtgacttc

SEQ ID NO: 162627 - DNA, 25 bp, Homo sapien
atttgtgcctggtgacttcctgtcc

SEQ ID NO: 162628 - DNA, 25 bp, Homo sapien
tgtccctgggacagttgagaagctg

SEQ ID NO: 162629 - DNA, 25 bp, Homo sapien
gacagttgagaagctgactgggcaa

SEQ ID NO: 162630 - DNA, 25 bp, Homo sapien
gtgtgaggctgttagactgttagat

SEQ ID NO: 162631 - DNA, 25 bp, Homo sapien
gtaaaggcaatgagctagtcccaga

SEQ ID NO: 162632 - DNA, 25 bp, Homo sapien
ggcaatgagctagtcccagaaagga

SEQ ID NO: 162633 - DNA, 25 bp, Homo sapien
gctagtcccagaaaggatccttcag

SEQ ID NO: 162634 - DNA, 25 bp, Homo sapien
aggatccttcagttacatacaattt

SEQ ID NO: 162635 - DNA, 25 bp, Homo sapien
atgtcatggctctgttcatattttt

SEQ ID NO: 162636 - DNA, 25 bp, Homo sapien
atggctctgttcatatttttgtctt

SEQ ID NO: 162637 - DNA, 25 bp, Homo sapien
ttgtcttgttcttccaattggtata

SEQ ID NO: 162638 - DNA, 25 bp, Homo sapien
actttcagagcctcttgtatttgga

SEQ ID NO: 162639 - DNA, 25 bp, Homo sapien
cctcttgtatttggaaggctggaag

SEQ ID NO: 162640 - DNA, 25 bp, Homo sapien
ggaagggcccagactttggaatagt

SEQ ID NO: 162641 - DNA, 25 bp, Homo sapien
ctttggaatagtgtcttggtttcac

SEQ ID NO: 162642 - DNA, 25 bp, Homo sapien
tttgatcttctcttccacctctctg

SEQ ID NO: 162643 - DNA, 25 bp, Homo sapien
acctctctggctctcatggaagaat

SEQ ID NO: 162644 - DNA, 25 bp, Homo sapien
ctctggctctcatggaagaatcctt

SEQ ID NO: 162645 - DNA, 25 bp, Homo sapien
gaagaatcctttacacatgaaaaca

SEQ ID NO: 162646 - DNA, 25 bp, Homo sapien
ttaatcacaactatctctcttgcct

SEQ ID NO: 162647 - DNA, 25 bp, Homo sapien
cacaactatctctcttgcctaaaag

SEQ ID NO: 162648 - DNA, 25 bp, Homo sapien
gggaatttagtttctctacatgtca

SEQ ID NO: 162649 - DNA, 25 bp, Homo sapien
tctacatgtcatttcggtctccaaa

SEQ ID NO: 162650 - DNA, 25 bp, Homo sapien
atttcggtctccaaactccctgttg

SEQ ID NO: 162651 - DNA, 25 bp, Homo sapien
actccctgttggctttttaatgcaa

SEQ ID NO: 162652 - DNA, 25 bp, Homo sapien
tgttactgttttctccatgaataaa

SEQ ID NO: 162653 - DNA, 25 bp, Homo sapien
tgtctaaagcatcaagtccctcttc

SEQ ID NO: 162654 - DNA, 25 bp, Homo sapien
ttctctagctgcagtggaagattct

SEQ ID NO: 162655 - DNA, 25 bp, Homo sapien
gaaaatgctcacttgagattttgca

SEQ ID NO: 162656 - DNA, 25 bp, Homo sapien
ttgagattttgcagggacccgggtc

SEQ ID NO: 162657 - DNA, 25 bp, Homo sapien
cccgggtctgtctggtttctgatga

SEQ ID NO: 162658 - DNA, 25 bp, Homo sapien
ctggtttctgatgacatagtaagag

SEQ ID NO: 162659 - DNA, 25 bp, Homo sapien
gtcttttttcaggttggctggtgaa

SEQ ID NO: 162660 - DNA, 25 bp, Homo sapien
aaaggaattgcatgtgactcacaca

SEQ ID NO: 162661 - DNA, 25 bp, Homo sapien
gtgactcacacaaacaggagctagc

SEQ ID NO: 162662 - DNA, 25 bp, Homo sapien
aggagctagcccaatcatacactga

SEQ ID NO: 162663 - DNA, 25 bp, Homo sapien
aatcatacactgactcgcgtgggtg

SEQ ID NO: 162664 - DNA, 25 bp, Homo sapien
agatcgactccctgtgggagatcag

SEQ ID NO: 162665 - DNA, 25 bp, Homo sapien
caagcagatagaaggccatacgatt

SEQ ID NO: 162666 - DNA, 25 bp, Homo sapien
agaaggccatacgatttgtgctctg

SEQ ID NO: 162667 - DNA, 25 bp, Homo sapien
aggccatacgatttgtgctctgggt

SEQ ID NO: 162668 - DNA, 25 bp, Homo sapien
ggcctgtgcagggtctgatccgcca

SEQ ID NO: 162669 - DNA, 25 bp, Homo sapien
tgtgcagggtctgatccgccacttt

SEQ ID NO: 162670 - DNA, 25 bp, Homo sapien
tgatccgccactttcggccggagct

SEQ ID NO: 162671 - DNA, 25 bp, Homo sapien
tgctgtcctgcgtctatccatgtgg

SEQ ID NO: 162672 - DNA, 25 bp, Homo sapien
cctgcgtctatccatgtggaatgct

SEQ ID NO: 162673 - DNA, 25 bp, Homo sapien
gtctatccatgtggaatgctggaca

SEQ ID NO: 162674 - DNA, 25 bp, Homo sapien
aatgctggacaataaagcgagtgct

SEQ ID NO: 162675 - DNA, 25 bp, Homo sapien
gggccgtggacaggctgaggctcaa

SEQ ID NO: 162676 - DNA, 25 bp, Homo sapien
ggctcaaggaaggtggtcctcagct

SEQ ID NO: 162677 - DNA, 25 bp, Homo sapien
caaggaaggtggtcctcagctcggc

SEQ ID NO: 162678 - DNA, 25 bp, Homo sapien
aaggtggtcctcagctcggctggcc

SEQ ID NO: 162679 - DNA, 25 bp, Homo sapien
ctgtggcccgcctcaaacgggctgg

SEQ ID NO: 162680 - DNA, 25 bp, Homo sapien
aaacgggctggtgcatcctcctctt

SEQ ID NO: 162681 - DNA, 25 bp, Homo sapien
aaatgctgcttgcagcacccaccct

SEQ ID NO: 162682 - DNA, 25 bp, Homo sapien
ctccaaatagccatacttagcctca

SEQ ID NO: 162683 - DNA, 25 bp, Homo sapien
tagccatacttagcctcagcaggag

SEQ ID NO: 162684 - DNA, 25 bp, Homo sapien
ggagcctggcctgtaacttataaag

SEQ ID NO: 162685 - DNA, 25 bp, Homo sapien
gaggaccgtccatggaccttatttt

SEQ ID NO: 162686 - DNA, 25 bp, Homo sapien
gggccgtggacaggctgaggctcaa

SEQ ID NO: 162687 - DNA, 25 bp, Homo sapien
aggctcaaggaaggtggtcctcagc

SEQ ID NO: 162688 - DNA, 25 bp, Homo sapien
gctcaaggaaggtggtcctcagctc

SEQ ID NO: 162689 - DNA, 25 bp, Homo sapien
caaggaaggtggtcctcagctcggc

SEQ ID NO: 162690 - DNA, 25 bp, Homo sapien
ctgtggcccgcctcaaacgggctgg

SEQ ID NO: 162691 - DNA, 25 bp, Homo sapien
aaacgggctggtgcatcctcctctt

SEQ ID NO: 162692 - DNA, 25 bp, Homo sapien
aacgggctggtgcatcctcctcttg

SEQ ID NO: 162693 - DNA, 25 bp, Homo sapien
aaatgctgcttgcagcacccaccct

SEQ ID NO: 162694 - DNA, 25 bp, Homo sapien
ctccaaatagccatacttagcctca

SEQ ID NO: 162695 - DNA, 25 bp, Homo sapien
ccgaggaccgtccatggaccttatt

SEQ ID NO: 162696 - DNA, 25 bp, Homo sapien
gaggaccgtccatggaccttatttt

SEQ ID NO: 162697 - DNA, 25 bp, Homo sapien
tctttgtggacagctctaacgacgt

SEQ ID NO: 162698 - DNA, 25 bp, Homo sapien
ctctaacgacgtggccgatagggtt

SEQ ID NO: 162699 - DNA, 25 bp, Homo sapien
aatggaaaccgtctccactgatgac

SEQ ID NO: 162700 - DNA, 25 bp, Homo sapien
agcatggtgcctaggatcccagagt

SEQ ID NO: 162701 - DNA, 25 bp, Homo sapien
atcccagagtggctgtttgtggcca

SEQ ID NO: 162702 - DNA, 25 bp, Homo sapien
gctgtttgtggccagttactacatg

SEQ ID NO: 162703 - DNA, 25 bp, Homo sapien
ctacatggcgtatttcaacagctgc

SEQ ID NO: 162704 - DNA, 25 bp, Homo sapien
aacagctgcctcaatgccattatat

SEQ ID NO: 162705 - DNA, 25 bp, Homo sapien
tatacgggctactgaaccaaaattt

SEQ ID NO: 162706 - DNA, 25 bp, Homo sapien
caggagaattatagtctcgctctgt

SEQ ID NO: 162707 - DNA, 25 bp, Homo sapien
tctgtacagccagggtgttctttgt

SEQ ID NO: 162708 - DNA, 25 bp, Homo sapien
tactatgccacctgcaagtgatgct

SEQ ID NO: 162709 - DNA, 25 bp, Homo sapien
aagtgatgctacacgttccagcccg

SEQ ID NO: 162710 - DNA, 25 bp, Homo sapien
atctgcgcgctttgcttttggttgg

SEQ ID NO: 162711 - DNA, 25 bp, Homo sapien
tggaatgctttccatctccaggaga

SEQ ID NO: 162712 - DNA, 25 bp, Homo sapien
ccaggagactttcatgtagcccaaa

SEQ ID NO: 162713 - DNA, 25 bp, Homo sapien
gtagcccaaagtacagcctggacca

SEQ ID NO: 162714 - DNA, 25 bp, Homo sapien
cacccctggtgtgtgtagctagtaa

SEQ ID NO: 162715 - DNA, 25 bp, Homo sapien
aagattaccctgagctgcagctgag

SEQ ID NO: 162716 - DNA, 25 bp, Homo sapien
agctgagcctgagccaatgggacag

SEQ ID NO: 162717 - DNA, 25 bp, Homo sapien
aatgggacagttacacttgacagac

SEQ ID NO: 162718 - DNA, 25 bp, Homo sapien
catgccattgaaactaagagctctc

SEQ ID NO: 162719 - DNA, 25 bp, Homo sapien
aaatggtttgaaggaagtgccagag

SEQ ID NO: 162720 - DNA, 25 bp, Homo sapien
aatggtttgaaggaagtgccagagg

SEQ ID NO: 162721 - DNA, 25 bp, Homo sapien
atggtttgaaggaagtgccagaggc

SEQ ID NO: 162722 - DNA, 25 bp, Homo sapien
tggtttgaaggaagtgccagaggca

SEQ ID NO: 162723 - DNA, 25 bp, Homo sapien
ggtttgaaggaagtgccagaggcat

SEQ ID NO: 162724 - DNA, 25 bp, Homo sapien
gtttgaaggaagtgccagaggcatc

SEQ ID NO: 162725 - DNA, 25 bp, Homo sapien
gggaaatccaagtaccttggagaag

SEQ ID NO: 162726 - DNA, 25 bp, Homo sapien
ggaaatccaagtaccttggagaaga

SEQ ID NO: 162727 - DNA, 25 bp, Homo sapien
gaaatccaagtaccttggagaagat

SEQ ID NO: 162728 - DNA, 25 bp, Homo sapien
gccggaaggatagcctcagcgtcaa

SEQ ID NO: 162729 - DNA, 25 bp, Homo sapien
atagcctcagcgtcaacgagttcaa

SEQ ID NO: 162730 - DNA, 25 bp, Homo sapien
acgagttcaaagagctggttaccca

SEQ ID NO: 162731 - DNA, 25 bp, Homo sapien
aagagctggttacccagcagttgcc

SEQ ID NO: 162732 - DNA, 25 bp, Homo sapien
ttgccccatctgctcaaggatgtgg

SEQ ID NO: 162733 - DNA, 25 bp, Homo sapien
atctgctcaaggatgtgggctctct

SEQ ID NO: 162734 - DNA, 25 bp, Homo sapien
aaggatgtgggctctcttgatgaga

SEQ ID NO: 162735 - DNA, 25 bp, Homo sapien
ggatgtgaatcaggactcggagctc

SEQ ID NO: 162736 - DNA, 25 bp, Homo sapien
aggactcggagctcaagttcaatga

SEQ ID NO: 162737 - DNA, 25 bp, Homo sapien
aggaagaagtaaagccgcctggctg

SEQ ID NO: 162738 - DNA, 25 bp, Homo sapien
gcagaaccgcactcttcccaaataa

SEQ ID NO: 162739 - DNA, 25 bp, Homo sapien
tccttctgttgatgacttcgtaagt

SEQ ID NO: 162740 - DNA, 25 bp, Homo sapien
cttctgttgatgacttcgtaagtgc

SEQ ID NO: 162741 - DNA, 25 bp, Homo sapien
agaaacactctacacctctaatcaa

SEQ ID NO: 162742 - DNA, 25 bp, Homo sapien
gaaacactctacacctctaatcaag

SEQ ID NO: 162743 - DNA, 25 bp, Homo sapien
aaacactctacacctctaatcaagg

SEQ ID NO: 162744 - DNA, 25 bp, Homo sapien
acactctacacctctaatcaaggtc

SEQ ID NO: 162745 - DNA, 25 bp, Homo sapien
actctacacctctaatcaaggtcat

SEQ ID NO: 162746 - DNA, 25 bp, Homo sapien
tctacacctctaatcaaggtcatgt

SEQ ID NO: 162747 - DNA, 25 bp, Homo sapien
acacctctaatcaaggtcatgtagt

SEQ ID NO: 162748 - DNA, 25 bp, Homo sapien
cctctaatcaaggtcatgtagtaat

SEQ ID NO: 162749 - DNA, 25 bp, Homo sapien
atcaaggtcatgtagtaatgacttt

SEQ ID NO: 162750 - DNA, 25 bp, Homo sapien
gatggatcttactgcaaaggaactg

SEQ ID NO: 162751 - DNA, 25 bp, Homo sapien
tttcctctgcctgactagacaatga

SEQ ID NO: 162752 - DNA, 25 bp, Homo sapien
ctgcctgactagacaatgatgttac

SEQ ID NO: 162753 - DNA, 25 bp, Homo sapien
gacaatgatgttactaaatgcttca

SEQ ID NO: 162754 - DNA, 25 bp, Homo sapien
gaatctaaatgtcgtctttgactca

SEQ ID NO: 162755 - DNA, 25 bp, Homo sapien
gtcgtctttgactcaagtaccaaat

SEQ ID NO: 162756 - DNA, 25 bp, Homo sapien
tgcttcttggtacaggtttgtgaat

SEQ ID NO: 162757 - DNA, 25 bp, Homo sapien
gacagtttatcgtcatgctgttagt

SEQ ID NO: 162758 - DNA, 25 bp, Homo sapien
ggaagtttgttgaaggtctccctat

SEQ ID NO: 162759 - DNA, 25 bp, Homo sapien
ggtctccctattaatgatttctcac

SEQ ID NO: 162760 - DNA, 25 bp, Homo sapien
cctattaatgatttctcacgtgaga

SEQ ID NO: 162761 - DNA, 25 bp, Homo sapien
agcgcttcttcgagacgcgcatgaa

SEQ ID NO: 162762 - DNA, 25 bp, Homo sapien
cgcttcttcgagacgcgcatgaacg

SEQ ID NO: 162763 - DNA, 25 bp, Homo sapien
gcttcttcgagacgcgcatgaacga

SEQ ID NO: 162764 - DNA, 25 bp, Homo sapien
ttcgagacgcgcatgaacgaggcct

SEQ ID NO: 162765 - DNA, 25 bp, Homo sapien
ttcggtgacaccaagttctctgctg

SEQ ID NO: 162766 - DNA, 25 bp, Homo sapien
tcggtgacaccaagttctctgctgt

SEQ ID NO: 162767 - DNA, 25 bp, Homo sapien
cagcctggctctgttctctgtcctg

SEQ ID NO: 162768 - DNA, 25 bp, Homo sapien
ttcctcacgatatggtttttacttc

SEQ ID NO: 162769 - DNA, 25 bp, Homo sapien
cctcacgatatggtttttacttctg

SEQ ID NO: 162770 - DNA, 25 bp, Homo sapien
ctcacgatatggtttttacttctgt

SEQ ID NO: 162771 - DNA, 25 bp, Homo sapien
acgatatggtttttacttctgtgga

SEQ ID NO: 162772 - DNA, 25 bp, Homo sapien
agcattgtgtatgtattcatgcaca

SEQ ID NO: 162773 - DNA, 25 bp, Homo sapien
tacctgtatatttgtggaatgctaa

SEQ ID NO: 162774 - DNA, 25 bp, Homo sapien
taaacttttacgcattacaatactg

SEQ ID NO: 162775 - DNA, 25 bp, Homo sapien
acaatactgctgaatgtgtagctcg

SEQ ID NO: 162776 - DNA, 25 bp, Homo sapien
aatgtgtagctcgaggtgtcctgca

SEQ ID NO: 162777 - DNA, 25 bp, Homo sapien
aggtgtcctgcacttttcttataag

SEQ ID NO: 162778 - DNA, 25 bp, Homo sapien
ttcttataaggctactgaagttaca

SEQ ID NO: 162779 - DNA, 25 bp, Homo sapien
actgaagttacatgttttgcctaat

SEQ ID NO: 162780 - DNA, 25 bp, Homo sapien
gttttgcctaatatattctactggt

SEQ ID NO: 162781 - DNA, 25 bp, Homo sapien
tattctactggtgatgaagacagat

SEQ ID NO: 162782 - DNA, 25 bp, Homo sapien
agataatatcacttgtagagaccta

SEQ ID NO: 162783 - DNA, 25 bp, Homo sapien
ttcctgtctcctttgaagtagactc

SEQ ID NO: 162784 - DNA, 25 bp, Homo sapien
agtagactcattcttcacacgattg

SEQ ID NO: 162785 - DNA, 25 bp, Homo sapien
attcttcacacgattgacctgtcct

SEQ ID NO: 162786 - DNA, 25 bp, Homo sapien
gacctgtcctctttgtgataattct

SEQ ID NO: 162787 - DNA, 25 bp, Homo sapien
attctcagtagttgtccgtgataat

SEQ ID NO: 162788 - DNA, 25 bp, Homo sapien
gttgtccgtgataatcgtgtcctga

SEQ ID NO: 162789 - DNA, 25 bp, Homo sapien
taatcgtgtcctgaaaatcctcgca

SEQ ID NO: 162790 - DNA, 25 bp, Homo sapien
ctcgcacacactggctggtggagaa

SEQ ID NO: 162791 - DNA, 25 bp, Homo sapien
ggtggagaactcaaggctaattttt

SEQ ID NO: 162792 - DNA, 25 bp, Homo sapien
cgccctctttcatctgtaagggact

SEQ ID NO: 162793 - DNA, 25 bp, Homo sapien
tcccaactctaaagccaagcacttt

SEQ ID NO: 162794 - DNA, 25 bp, Homo sapien
gagagtgagagcgtgcagtcttaaa

SEQ ID NO: 162795 - DNA, 25 bp, Homo sapien
agtgagagcgtgcagtcttaaaaaa

SEQ ID NO: 162796 - DNA, 25 bp, Homo sapien
aaactattgcctttttggaggcacg

SEQ ID NO: 162797 - DNA, 25 bp, Homo sapien
tttggaggcacggtacattttgtaa

SEQ ID NO: 162798 - DNA, 25 bp, Homo sapien
gaggcacggtacattttgtaaacaa

SEQ ID NO: 162799 - DNA, 25 bp, Homo sapien
gcacggtacattttgtaaacaaagc

SEQ ID NO: 162800 - DNA, 25 bp, Homo sapien
aacaaagcaaggctgaagtcgtgct

SEQ ID NO: 162801 - DNA, 25 bp, Homo sapien
agcaaggctgaagtcgtgcttgact

SEQ ID NO: 162802 - DNA, 25 bp, Homo sapien
aaggctgaagtcgtgcttgacttat

SEQ ID NO: 162803 - DNA, 25 bp, Homo sapien
gtcgtgcttgacttatatctattag

SEQ ID NO: 162804 - DNA, 25 bp, Homo sapien
gcttgacttatatctattagttttg

SEQ ID NO: 162805 - DNA, 25 bp, Homo sapien
gaagctcagaaacaactcttgcatg

SEQ ID NO: 162806 - DNA, 25 bp, Homo sapien
caactcttgcatgtaaaagtcttat

SEQ ID NO: 162807 - DNA, 25 bp, Homo sapien
atgcaagtggatgtaagcactctgg

SEQ ID NO: 162808 - DNA, 25 bp, Homo sapien
aatctggcaaagttcttcagacgac

SEQ ID NO: 162809 - DNA, 25 bp, Homo sapien
gttcttcagacgacttgggagcaaa

SEQ ID NO: 162810 - DNA, 25 bp, Homo sapien
gcaaaatggctgcttgagctactct

SEQ ID NO: 162811 - DNA, 25 bp, Homo sapien
gagctactctgtgtcgttaatttgt

SEQ ID NO: 162812 - DNA, 25 bp, Homo sapien
ctgtgtcgttaatttgttgtttgca

SEQ ID NO: 162813 - DNA, 25 bp, Homo sapien
gttgtttgcacataggttccacttt

SEQ ID NO: 162814 - DNA, 25 bp, Homo sapien
acataggttccactttgggcactgt

SEQ ID NO: 162815 - DNA, 25 bp, Homo sapien
tccactttgggcactgtctttttaa

SEQ ID NO: 162816 - DNA, 25 bp, Homo sapien
acaaccactacatgccggatttgca

SEQ ID NO: 162817 - DNA, 25 bp, Homo sapien
tgcaggccaccagatgaacgggaca

SEQ ID NO: 162818 - DNA, 25 bp, Homo sapien
aaaccagcacttccgagattgcaac

SEQ ID NO: 162819 - DNA, 25 bp, Homo sapien
tagacactgatttcatcgacgagga

SEQ ID NO: 162820 - DNA, 25 bp, Homo sapien
agttcttatgtccttggtgatagaa

SEQ ID NO: 162821 - DNA, 25 bp, Homo sapien
gaaatgggtttggaccgcatcaagg

SEQ ID NO: 162822 - DNA, 25 bp, Homo sapien
gtttgattttatgacggacttcgtg

SEQ ID NO: 162823 - DNA, 25 bp, Homo sapien
gacggacttcgtgtgcaaacagcag

SEQ ID NO: 162824 - DNA, 25 bp, Homo sapien
aaacagcagcccagcagagtgagct

SEQ ID NO: 162825 - DNA, 25 bp, Homo sapien
agtgagctgttgactcgatcgaaac

SEQ ID NO: 162826 - DNA, 25 bp, Homo sapien
gactcgatcgaaaccccggcgaaag

SEQ ID NO: 162827 - DNA, 25 bp, Homo sapien
gtcgtcatggttactggcccctagg

SEQ ID NO: 162828 - DNA, 25 bp, Homo sapien
gttactggcccctaggcgccgatgg

SEQ ID NO: 162829 - DNA, 25 bp, Homo sapien
ttgcctttgggtgcgcgacaaacaa

SEQ ID NO: 162830 - DNA, 25 bp, Homo sapien
tgggtgcgcgacaaacaatcgctcc

SEQ ID NO: 162831 - DNA, 25 bp, Homo sapien
acaaacaatcgctccgggctcaggg

SEQ ID NO: 162832 - DNA, 25 bp, Homo sapien
agggctgcgcggctcttcccttcat

SEQ ID NO: 162833 - DNA, 25 bp, Homo sapien
cttcccttcattccatgggcctttt

SEQ ID NO: 162834 - DNA, 25 bp, Homo sapien
cgatgtagcgtttttcgttgtttgc

SEQ ID NO: 162835 - DNA, 25 bp, Homo sapien
tagcgtttttcgttgtttgctttag

SEQ ID NO: 162836 - DNA, 25 bp, Homo sapien
ggcgacgcctctattggctctcggc

SEQ ID NO: 162837 - DNA, 25 bp, Homo sapien
ttggcaacggccgtcgtcatggtta

SEQ ID NO: 162838 - DNA, 25 bp, Homo sapien
gaaagtaacaggaaacgtgagcaag

SEQ ID NO: 162839 - DNA, 25 bp, Homo sapien
gaaaaccagctacctcgtcatgggc

SEQ ID NO: 162840 - DNA, 25 bp, Homo sapien
agctacctcgtcatgggccgggaca

SEQ ID NO: 162841 - DNA, 25 bp, Homo sapien
gacagcgggcagtccaagagtgaca

SEQ ID NO: 162842 - DNA, 25 bp, Homo sapien
aaatccttgatgaagacggcctgtt

SEQ ID NO: 162843 - DNA, 25 bp, Homo sapien
gacggcctgttggatctgattcgaa

SEQ ID NO: 162844 - DNA, 25 bp, Homo sapien
gatctgattcgaactatgccgggca

SEQ ID NO: 162845 - DNA, 25 bp, Homo sapien
tgattcgaactatgccgggcaaaaa

SEQ ID NO: 162846 - DNA, 25 bp, Homo sapien
aaaatccaagtcgaaatcgctgctg

SEQ ID NO: 162847 - DNA, 25 bp, Homo sapien
aagtcgaaatcgctgctgaggctga

SEQ ID NO: 162848 - DNA, 25 bp, Homo sapien
aatcgctgctgaggctgagatgaag

SEQ ID NO: 162849 - DNA, 25 bp, Homo sapien
ccttttactcatggcccacagtaga

SEQ ID NO: 162850 - DNA, 25 bp, Homo sapien
acagtagaatatccaaaacgccttg

SEQ ID NO: 162851 - DNA, 25 bp, Homo sapien
aaaacgccttggctttcaggcctgg

SEQ ID NO: 162852 - DNA, 25 bp, Homo sapien
gcctttcctacagggagctcagtaa

SEQ ID NO: 162853 - DNA, 25 bp, Homo sapien
agctcagtaacctggacggctctaa

SEQ ID NO: 162854 - DNA, 25 bp, Homo sapien
acggctctaaggctggaatgaccac

SEQ ID NO: 162855 - DNA, 25 bp, Homo sapien
ttgctcttgaattgatgcccttcga

SEQ ID NO: 162856 - DNA, 25 bp, Homo sapien
atgcccttcgatgtatgccatttag

SEQ ID NO: 162857 - DNA, 25 bp, Homo sapien
gaaagtgctaagtcttaagtttcct

SEQ ID NO: 162858 - DNA, 25 bp, Homo sapien
taccactttggtttcatatttttgg

SEQ ID NO: 162859 - DNA, 25 bp, Homo sapien
aattgatacctgcagtaacccatag

SEQ ID NO: 162860 - DNA, 25 bp, Homo sapien
aaataccttttaagctagttgatct

SEQ ID NO: 162861 - DNA, 25 bp, Homo sapien
cattccaaggttttagttactcagg

SEQ ID NO: 162862 - DNA, 25 bp, Homo sapien
tattattatgaaccttcagcctact

SEQ ID NO: 162863 - DNA, 25 bp, Homo sapien
ttcagcctactttcttgagtgccgt

SEQ ID NO: 162864 - DNA, 25 bp, Homo sapien
cagcctactttcttgagtgccgtaa

SEQ ID NO: 162865 - DNA, 25 bp, Homo sapien
gcctactttcttgagtgccgtaaaa

SEQ ID NO: 162866 - DNA, 25 bp, Homo sapien
tcttgagtgccgtaaaagtgcttgt

SEQ ID NO: 162867 - DNA, 25 bp, Homo sapien
gagtgccgtaaaagtgcttgtaaat

SEQ ID NO: 162868 - DNA, 25 bp, Homo sapien
tgccgtaaaagtgcttgtaaatctt

SEQ ID NO: 162869 - DNA, 25 bp, Homo sapien
aaaatggtgtttgacgttgatggaa

SEQ ID NO: 162870 - DNA, 25 bp, Homo sapien
tggtgtttgacgttgatggaaattc

SEQ ID NO: 162871 - DNA, 25 bp, Homo sapien
agaccccgcttgttcagcagcagaa

SEQ ID NO: 162872 - DNA, 25 bp, Homo sapien
accccgcttgttcagcagcagaatg

SEQ ID NO: 162873 - DNA, 25 bp, Homo sapien
gcttgttcagcagcagaatggctct

SEQ ID NO: 162874 - DNA, 25 bp, Homo sapien
ttgttcagcagcagaatggctcttc

SEQ ID NO: 162875 - DNA, 25 bp, Homo sapien
gcagcagaatggctcttccttcggg

SEQ ID NO: 162876 - DNA, 25 bp, Homo sapien
aatggctcttccttcggggacttag

SEQ ID NO: 162877 - DNA, 25 bp, Homo sapien
gggacttaggatcagccaagttggg

SEQ ID NO: 162878 - DNA, 25 bp, Homo sapien
agccagccagctgggatctccacca

SEQ ID NO: 162879 - DNA, 25 bp, Homo sapien
aaccccttcatgactggaccctcat

SEQ ID NO: 162880 - DNA, 25 bp, Homo sapien
aaccccttcttgtagcactgtgttt

SEQ ID NO: 162881 - DNA, 25 bp, Homo sapien
cccttcttgtagcactgtgtttttg

SEQ ID NO: 162882 - DNA, 25 bp, Homo sapien
attttattatattagccaccatgcc

SEQ ID NO: 162883 - DNA, 25 bp, Homo sapien
accatgcctgtcctattttcttatg

SEQ ID NO: 162884 - DNA, 25 bp, Homo sapien
atgcctgtcctattttcttatgttt

SEQ ID NO: 162885 - DNA, 25 bp, Homo sapien
attagattatcatgggtgaacttta

SEQ ID NO: 162886 - DNA, 25 bp, Homo sapien
ggtgaactttatgagtgagtatctt

SEQ ID NO: 162887 - DNA, 25 bp, Homo sapien
agtatcttggtgatgactcctcctg

SEQ ID NO: 162888 - DNA, 25 bp, Homo sapien
ttggtgatgactcctcctgaccagc

SEQ ID NO: 162889 - DNA, 25 bp, Homo sapien
accagcccaggaccagctttcttgt

SEQ ID NO: 162890 - DNA, 25 bp, Homo sapien
gtcacaccgttatgcattactctgt

SEQ ID NO: 162891 - DNA, 25 bp, Homo sapien
gttatgcattactctgtgtctacta

SEQ ID NO: 162892 - DNA, 25 bp, Homo sapien
ctctgtgtctactattatgtgtgca

SEQ ID NO: 162893 - DNA, 25 bp, Homo sapien
ataggcaaatcagttaccttgcaga

SEQ ID NO: 162894 - DNA, 25 bp, Homo sapien
aatcagttaccttgcagaaagagct

SEQ ID NO: 162895 - DNA, 25 bp, Homo sapien
gaaagagctttgtatgacagacatt

SEQ ID NO: 162896 - DNA, 25 bp, Homo sapien
gctttgtatgacagacattgtctta

SEQ ID NO: 162897 - DNA, 25 bp, Homo sapien
atttcttcctgattgacaacagtgt

SEQ ID NO: 162898 - DNA, 25 bp, Homo sapien
tcttcctgattgacaacagtgttag

SEQ ID NO: 162899 - DNA, 25 bp, Homo sapien
aggtgcaaagcgaaactggttgctc

SEQ ID NO: 162900 - DNA, 25 bp, Homo sapien
aaactggttgctcaagttgatagaa

SEQ ID NO: 162901 - DNA, 25 bp, Homo sapien
tttcatatgtgatgtattcatgcag

SEQ ID NO: 162902 - DNA, 25 bp, Homo sapien
tgtgatgtattcatgcagaacaact

SEQ ID NO: 162903 - DNA, 25 bp, Homo sapien
tgtattcatgcagaacaactatctt

SEQ ID NO: 162904 - DNA, 25 bp, Homo sapien
catcgtggacatgctgagcaaggag

SEQ ID NO: 162905 - DNA, 25 bp, Homo sapien
gacatgctgagcaaggagatccagg

SEQ ID NO: 162906 - DNA, 25 bp, Homo sapien
aggagctccagagcaaaccggaccg

SEQ ID NO: 162907 - DNA, 25 bp, Homo sapien
aaaccggaccgcagcgccgaggaga

SEQ ID NO: 162908 - DNA, 25 bp, Homo sapien
agagcgaccggctgcgcaagctcat

SEQ ID NO: 162909 - DNA, 25 bp, Homo sapien
tgcgcaagctcatgctggagtggca

SEQ ID NO: 162910 - DNA, 25 bp, Homo sapien
agctcatgctggagtggcagttcca

SEQ ID NO: 162911 - DNA, 25 bp, Homo sapien
agactccaggagtcgaagcagaagg

SEQ ID NO: 162912 - DNA, 25 bp, Homo sapien
gacgatgatgtggacaccatgctga

SEQ ID NO: 162913 - DNA, 25 bp, Homo sapien
tgtggacaccatgctgatcatgcag

SEQ ID NO: 162914 - DNA, 25 bp, Homo sapien
gctgatcatgcagcgcctggaggct

SEQ ID NO: 162915 - DNA, 25 bp, Homo sapien
ccagaaccaatttccattccagttt

SEQ ID NO: 162916 - DNA, 25 bp, Homo sapien
aatttccattccagtttggccgaga

SEQ ID NO: 162917 - DNA, 25 bp, Homo sapien
gtttggccgagaccgtgtctctgca

SEQ ID NO: 162918 - DNA, 25 bp, Homo sapien
atgggcggccccatacaggcatcag

SEQ ID NO: 162919 - DNA, 25 bp, Homo sapien
acaggcatcagctgaggttgctcag

SEQ ID NO: 162920 - DNA, 25 bp, Homo sapien
ggttgctcagcaaggcaccatgtgg

SEQ ID NO: 162921 - DNA, 25 bp, Homo sapien
gggcgtaatgacatgacctataatt

SEQ ID NO: 162922 - DNA, 25 bp, Homo sapien
gacctataattatgccaacaggcag

SEQ ID NO: 162923 - DNA, 25 bp, Homo sapien
gcctatcatggcgtgaaccgaacag

SEQ ID NO: 162924 - DNA, 25 bp, Homo sapien
tgctgcacacagatcagagggccaa

SEQ ID NO: 162925 - DNA, 25 bp, Homo sapien
agagggccaaccacgaaggctcgtg

SEQ ID NO: 162926 - DNA, 25 bp, Homo sapien
ttacagtacttgtcttcaccaacac

SEQ ID NO: 162927 - DNA, 25 bp, Homo sapien
actgtcccaaggtgaaatgaagcaa

SEQ ID NO: 162928 - DNA, 25 bp, Homo sapien
gggttcttagtctcagcactatgac

SEQ ID NO: 162929 - DNA, 25 bp, Homo sapien
gtctcagcactatgacattttgggc

SEQ ID NO: 162930 - DNA, 25 bp, Homo sapien
gacattttgggctgactacttattt

SEQ ID NO: 162931 - DNA, 25 bp, Homo sapien
tacttatttgttaggcgggagctct

SEQ ID NO: 162932 - DNA, 25 bp, Homo sapien
aggcgggagctctcctgtgcattgt

SEQ ID NO: 162933 - DNA, 25 bp, Homo sapien
tagcagtatccctggtggctaccca

SEQ ID NO: 162934 - DNA, 25 bp, Homo sapien
gtggctacccaatagacgccagtag

SEQ ID NO: 162935 - DNA, 25 bp, Homo sapien
gtagcaccccgaattgacaacccaa

SEQ ID NO: 162936 - DNA, 25 bp, Homo sapien
actgtcccctgcgaggagaaatcac

SEQ ID NO: 162937 - DNA, 25 bp, Homo sapien
gattgaaggatacccagaccccgag

SEQ ID NO: 162938 - DNA, 25 bp, Homo sapien
cagaccccgaggttgtctggttcaa

SEQ ID NO: 162939 - DNA, 25 bp, Homo sapien
gaggttgtctggttcaaagatgacc

SEQ ID NO: 162940 - DNA, 25 bp, Homo sapien
tgaccagtcaatcagggagtcccgc

SEQ ID NO: 162941 - DNA, 25 bp, Homo sapien
cgccacttccagatagactacgatg

SEQ ID NO: 162942 - DNA, 25 bp, Homo sapien
gactacgatgaggacgggaactgct

SEQ ID NO: 162943 - DNA, 25 bp, Homo sapien
ggacgggaactgctctttaattatt

SEQ ID NO: 162944 - DNA, 25 bp, Homo sapien
ggatgacgatgccaagtacacctgc

SEQ ID NO: 162945 - DNA, 25 bp, Homo sapien
gtacacctgcaaggctgtcaacagt

SEQ ID NO: 162946 - DNA, 25 bp, Homo sapien
gtcaacagtcttggagaagccacct

SEQ ID NO: 162947 - DNA, 25 bp, Homo sapien
cttggagaagccacctgcacagcag

SEQ ID NO: 162948 - DNA, 25 bp, Homo sapien
tgcaaaagatccacctgtattccct

SEQ ID NO: 162949 - DNA, 25 bp, Homo sapien
aaatgaccatttgccaacctggctg

SEQ ID NO: 162950 - DNA, 25 bp, Homo sapien
taaagcaccgagtcaggtgcctgat

SEQ ID NO: 162951 - DNA, 25 bp, Homo sapien
gtgcctgatacgcagtaggtgctta

SEQ ID NO: 162952 - DNA, 25 bp, Homo sapien
gtaggtgcttagcaaacggtagcta

SEQ ID NO: 162953 - DNA, 25 bp, Homo sapien
gtagctaatactatcatcattgtca

SEQ ID NO: 162954 - DNA, 25 bp, Homo sapien
ttgttattgtgacacccatgagccc

SEQ ID NO: 162955 - DNA, 25 bp, Homo sapien
agcccacagacagagctgtattaag

SEQ ID NO: 162956 - DNA, 25 bp, Homo sapien
gtaacctgttttgaatccagacatt

SEQ ID NO: 162957 - DNA, 25 bp, Homo sapien
ttttgaatccagacattcactcccc

SEQ ID NO: 162958 - DNA, 25 bp, Homo sapien
atgactaccctcctttgatctattt

SEQ ID NO: 162959 - DNA, 25 bp, Homo sapien
tggatggccggaatcccctcacaca

SEQ ID NO: 162960 - DNA, 25 bp, Homo sapien
agcagctcgccatcagaccagcaga

SEQ ID NO: 162961 - DNA, 25 bp, Homo sapien
gattaaccagctggctcagaagcta

SEQ ID NO: 162962 - DNA, 25 bp, Homo sapien
aaccagctggctcagaagctaggcc

SEQ ID NO: 162963 - DNA, 25 bp, Homo sapien
gctcagaagctaggcccggagtggg

SEQ ID NO: 162964 - DNA, 25 bp, Homo sapien
agaccgacatctaccgctgcaaggc

SEQ ID NO: 162965 - DNA, 25 bp, Homo sapien
tggaggcctttgtccgctggcgcca

SEQ ID NO: 162966 - DNA, 25 bp, Homo sapien
tccgctggcgccagcgttttgggaa

SEQ ID NO: 162967 - DNA, 25 bp, Homo sapien
agcaggccaccttcctaagcttaca

SEQ ID NO: 162968 - DNA, 25 bp, Homo sapien
ctaagcttacacaagggcctccagg

SEQ ID NO: 162969 - DNA, 25 bp, Homo sapien
aagcttacacaagggcctccaggca

SEQ ID NO: 162970 - DNA, 25 bp, Homo sapien
ccaggagtttggcatcttagacaag

SEQ ID NO: 162971 - DNA, 25 bp, Homo sapien
ttggcatcttagacaaggttctggt

SEQ ID NO: 162972 - DNA, 25 bp, Homo sapien
atcttagacaaggttctggtccacc

SEQ ID NO: 162973 - DNA, 25 bp, Homo sapien
ttagacaaggttctggtccaccctc

SEQ ID NO: 162974 - DNA, 25 bp, Homo sapien
ccccaggacggtgaggatgagccca

SEQ ID NO: 162975 - DNA, 25 bp, Homo sapien
atgagcccacgctggtgcagaagga

SEQ ID NO: 162976 - DNA, 25 bp, Homo sapien
cagaaggagcctgtagaagcagcgc

SEQ ID NO: 162977 - DNA, 25 bp, Homo sapien
cggcagcagaacctgtcccagctag

SEQ ID NO: 162978 - DNA, 25 bp, Homo sapien
gtcccagctagcacctgagagctgg

SEQ ID NO: 162979 - DNA, 25 bp, Homo sapien
ctcttgaggaacttttaatttgcag

SEQ ID NO: 162980 - DNA, 25 bp, Homo sapien
atttgcaggggtgcccgctatggac

SEQ ID NO: 162981 - DNA, 25 bp, Homo sapien
tctcaacgaaggcaaacacctttac

SEQ ID NO: 162982 - DNA, 25 bp, Homo sapien
gaaggcaaacacctttacacgctag

SEQ ID NO: 162983 - DNA, 25 bp, Homo sapien
aaggcaaacacctttacacgctaga

SEQ ID NO: 162984 - DNA, 25 bp, Homo sapien
tgtgtgctgccacaggccccagcat

SEQ ID NO: 162985 - DNA, 25 bp, Homo sapien
acaggccccagcatcaagatctggg

SEQ ID NO: 162986 - DNA, 25 bp, Homo sapien
agcaagaagttatcagtaccagcag

SEQ ID NO: 162987 - DNA, 25 bp, Homo sapien
agaagttatcagtaccagcagcaag

SEQ ID NO: 162988 - DNA, 25 bp, Homo sapien
agttatcagtaccagcagcaaggca

SEQ ID NO: 162989 - DNA, 25 bp, Homo sapien
ttatcagtaccagcagcaaggcaga

SEQ ID NO: 162990 - DNA, 25 bp, Homo sapien
atcagtaccagcagcaaggcagaac

SEQ ID NO: 162991 - DNA, 25 bp, Homo sapien
gtaccagcagcaaggcagaaccacc

SEQ ID NO: 162992 - DNA, 25 bp, Homo sapien
atgccctaaacttatctgggaaggc

SEQ ID NO: 162993 - DNA, 25 bp, Homo sapien
gaagtaggctctgggtccatgccta

SEQ ID NO: 162994 - DNA, 25 bp, Homo sapien
catgcctaactctgtaccgttttat

SEQ ID NO: 162995 - DNA, 25 bp, Homo sapien
actctgtaccgttttattcctcaag

SEQ ID NO: 162996 - DNA, 25 bp, Homo sapien
gttttattcctcaaggcctatagcc

SEQ ID NO: 162997 - DNA, 25 bp, Homo sapien
aaggcctatagcctgtcactccttg

SEQ ID NO: 162998 - DNA, 25 bp, Homo sapien
actccttgaagccttctctgcctgt

SEQ ID NO: 162999 - DNA, 25 bp, Homo sapien
gatccttgtccaccgtctatttatt

SEQ ID NO: 163000 - DNA, 25 bp, Homo sapien
tatacggatgactgggaggcactgc

SEQ ID NO: 163001 - DNA, 25 bp, Homo sapien
tttccttgggtccttgtgttccttg

SEQ ID NO: 163002 - DNA, 25 bp, Homo sapien
ttggctctacctcagtaacacttta

SEQ ID NO: 163003 - DNA, 25 bp, Homo sapien
atgcttctggccagggatcctgggt

SEQ ID NO: 163004 - DNA, 25 bp, Homo sapien
gatcctgggtctgcaactttggaaa

SEQ ID NO: 163005 - DNA, 25 bp, Homo sapien
gcaactttggaaaactcctcttcac

SEQ ID NO: 163006 - DNA, 25 bp, Homo sapien
ctcttcacataacaatttcatccaa

SEQ ID NO: 163007 - DNA, 25 bp, Homo sapien
atttcatccaattcatcttcaaagc

SEQ ID NO: 163008 - DNA, 25 bp, Homo sapien
aagcacaactctatttcatgctttc

SEQ ID NO: 163009 - DNA, 25 bp, Homo sapien
catgctttctgttattatctttctt

SEQ ID NO: 163010 - DNA, 25 bp, Homo sapien
attatctttcttgatactttccaaa

SEQ ID NO: 163011 - DNA, 25 bp, Homo sapien
ttgatactttccaaattctctgatt

SEQ ID NO: 163012 - DNA, 25 bp, Homo sapien
ctcccaccacatagaatcaacatat

SEQ ID NO: 163013 - DNA, 25 bp, Homo sapien
atcaacatatggtagggattacagt

SEQ ID NO: 163014 - DNA, 25 bp, Homo sapien
tttccagtacagtcatcccttgata

SEQ ID NO: 163015 - DNA, 25 bp, Homo sapien
atcccttgatacctgctgggtattg

SEQ ID NO: 163016 - DNA, 25 bp, Homo sapien
tgggtattggttccagcactccgtg

SEQ ID NO: 163017 - DNA, 25 bp, Homo sapien
cagcactccgtgagccatgtccagt

SEQ ID NO: 163018 - DNA, 25 bp, Homo sapien
gccatgtccagtcccttttataaaa

SEQ ID NO: 163019 - DNA, 25 bp, Homo sapien
ttgtatgtaacttacccacatcctc

SEQ ID NO: 163020 - DNA, 25 bp, Homo sapien
ccacatcctcttgtatagtctcaat

SEQ ID NO: 163021 - DNA, 25 bp, Homo sapien
gtctcaattatgtctagattactta

SEQ ID NO: 163022 - DNA, 25 bp, Homo sapien
aaagagtctatgtattttcagtata

SEQ ID NO: 163023 - DNA, 25 bp, Homo sapien
gatgcagtaattgtcagcctatcaa

SEQ ID NO: 163024 - DNA, 25 bp, Homo sapien
tatcaacatagtgtagtcagccaga

SEQ ID NO: 163025 - DNA, 25 bp, Homo sapien
tctgcgcggcagaggaccagcatgc

SEQ ID NO: 163026 - DNA, 25 bp, Homo sapien
ctgctgggcgtgtttaccgtgtgct

SEQ ID NO: 163027 - DNA, 25 bp, Homo sapien
tcttccttcatctcactttaatgct

SEQ ID NO: 163028 - DNA, 25 bp, Homo sapien
tttaatgctttcttgccctcagaac

SEQ ID NO: 163029 - DNA, 25 bp, Homo sapien
tcatgtctcacttcaatatgtacct

SEQ ID NO: 163030 - DNA, 25 bp, Homo sapien
tatgtacctcatactcatcatgtgt

SEQ ID NO: 163031 - DNA, 25 bp, Homo sapien
tgtgtaattccgtgatggaccctct

SEQ ID NO: 163032 - DNA, 25 bp, Homo sapien
tgatggaccctctcatatatgcctt

SEQ ID NO: 163033 - DNA, 25 bp, Homo sapien
atatgccttccgcagccaagagatg

SEQ ID NO: 163034 - DNA, 25 bp, Homo sapien
cagccaagagatgcggaagaccttt

SEQ ID NO: 163035 - DNA, 25 bp, Homo sapien
gagattatttgctgccgtggtttca

SEQ ID NO: 163036 - DNA, 25 bp, Homo sapien
tgctctatagcctcatgtccagccg

SEQ ID NO: 163037 - DNA, 25 bp, Homo sapien
atgtccagccgcttccgagagacct

SEQ ID NO: 163038 - DNA, 25 bp, Homo sapien
gcttccgagagaccttccaggaggc

SEQ ID NO: 163039 - DNA, 25 bp, Homo sapien
tcagcaggatgaccacaggcagcac

SEQ ID NO: 163040 - DNA, 25 bp, Homo sapien
agcaccctgtgtgatgtgggctccc

SEQ ID NO: 163041 - DNA, 25 bp, Homo sapien
ccctggctgggaacgatggcccaga

SEQ ID NO: 163042 - DNA, 25 bp, Homo sapien
gaacgatggcccagaggcgcagcaa

SEQ ID NO: 163043 - DNA, 25 bp, Homo sapien
gaggcgcagcaagagaccgatccat

SEQ ID NO: 163044 - DNA, 25 bp, Homo sapien
tggccttccagcacgtgcacgtcat

SEQ ID NO: 163045 - DNA, 25 bp, Homo sapien
tgcacgtcatctccggcatcttctt

SEQ ID NO: 163046 - DNA, 25 bp, Homo sapien
aaccccgtgctctatagcctcatgt

SEQ ID NO: 163047 - DNA, 25 bp, Homo sapien
aaacactatcttatcttctcctgaa

SEQ ID NO: 163048 - DNA, 25 bp, Homo sapien
aacactatcttatcttctcctgaac

SEQ ID NO: 163049 - DNA, 25 bp, Homo sapien
acactatcttatcttctcctgaact

SEQ ID NO: 163050 - DNA, 25 bp, Homo sapien
actatcttatcttctcctgaactgt

SEQ ID NO: 163051 - DNA, 25 bp, Homo sapien
ctatcttatcttctcctgaactgtt

SEQ ID NO: 163052 - DNA, 25 bp, Homo sapien
tatcttatcttctcctgaactgttg

SEQ ID NO: 163053 - DNA, 25 bp, Homo sapien
atcttatcttctcctgaactgttga

SEQ ID NO: 163054 - DNA, 25 bp, Homo sapien
tcttatcttctcctgaactgttgat

SEQ ID NO: 163055 - DNA, 25 bp, Homo sapien
cttatcttctcctgaactgttgatt

SEQ ID NO: 163056 - DNA, 25 bp, Homo sapien
ttatcttctcctgaactgttgattt

SEQ ID NO: 163057 - DNA, 25 bp, Homo sapien
tatcttctcctgaactgttgatttt

SEQ ID NO: 163058 - DNA, 25 bp, Homo sapien
agcggctctagctctgataacacag

SEQ ID NO: 163059 - DNA, 25 bp, Homo sapien
agaggaatgtccaggtcatcttcac

SEQ ID NO: 163060 - DNA, 25 bp, Homo sapien
tcttcacccagaggagaagcctcat

SEQ ID NO: 163061 - DNA, 25 bp, Homo sapien
tccaatttcttagtcacttctgtcc

SEQ ID NO: 163062 - DNA, 25 bp, Homo sapien
acttctgtcctaccatgcaaataca

SEQ ID NO: 163063 - DNA, 25 bp, Homo sapien
atgcaaatacacagattatgccaag

SEQ ID NO: 163064 - DNA, 25 bp, Homo sapien
ttatgccaagaggtaccacattttc

SEQ ID NO: 163065 - DNA, 25 bp, Homo sapien
gaggtaccacattttcatgacagat

SEQ ID NO: 163066 - DNA, 25 bp, Homo sapien
gacagatacattcatgcacaatcca

SEQ ID NO: 163067 - DNA, 25 bp, Homo sapien
ttgcaatgatgcctaccaaacattt

SEQ ID NO: 163068 - DNA, 25 bp, Homo sapien
tccagacttaacattttggtctctg

SEQ ID NO: 163069 - DNA, 25 bp, Homo sapien
gttatttcataaagccatacggtat

SEQ ID NO: 163070 - DNA, 25 bp, Homo sapien
tttcataaagccatacggtattgac

SEQ ID NO: 163071 - DNA, 25 bp, Homo sapien
agccatacggtattgacatattttt

SEQ ID NO: 163072 - DNA, 25 bp, Homo sapien
tacggtattgacatatttttaaggt

SEQ ID NO: 163073 - DNA, 25 bp, Homo sapien
gagagttattctggaaatgtgttat

SEQ ID NO: 163074 - DNA, 25 bp, Homo sapien
tgtgttataagctaggagaatccct

SEQ ID NO: 163075 - DNA, 25 bp, Homo sapien
gagaatccctttggacagtctttat

SEQ ID NO: 163076 - DNA, 25 bp, Homo sapien
gaatccctttggacagtctttattt

SEQ ID NO: 163077 - DNA, 25 bp, Homo sapien
tatgattcaaaaccatttcttcagg

SEQ ID NO: 163078 - DNA, 25 bp, Homo sapien
gattcaaaaccatttcttcaggtta

SEQ ID NO: 163079 - DNA, 25 bp, Homo sapien
aaccatttcttcaggttaaattgag

SEQ ID NO: 163080 - DNA, 25 bp, Homo sapien
ggtgttcatcctataagaagcagga

SEQ ID NO: 163081 - DNA, 25 bp, Homo sapien
agaagcaggatcgtataggcagaaa

SEQ ID NO: 163082 - DNA, 25 bp, Homo sapien
ggattagcggaatgtatggttcaac

SEQ ID NO: 163083 - DNA, 25 bp, Homo sapien
atggttcaaccttaattatagcttc

SEQ ID NO: 163084 - DNA, 25 bp, Homo sapien
tatagcttcattgcaggactttact

SEQ ID NO: 163085 - DNA, 25 bp, Homo sapien
cattgcaggactttactgtttctcc

SEQ ID NO: 163086 - DNA, 25 bp, Homo sapien
gtttctccattttctagaagctgct

SEQ ID NO: 163087 - DNA, 25 bp, Homo sapien
ttgctgctttgtgatgacgtgagat

SEQ ID NO: 163088 - DNA, 25 bp, Homo sapien
gagacaatgatgctagtttgcatat

SEQ ID NO: 163089 - DNA, 25 bp, Homo sapien
ttcctatgcaatagttgttttccca

SEQ ID NO: 163090 - DNA, 25 bp, Homo sapien
gttttcccagttattcaaagcagct

SEQ ID NO: 163091 - DNA, 25 bp, Homo sapien
ggaaacttgggaatcattctggctt

SEQ ID NO: 163092 - DNA, 25 bp, Homo sapien
gggaatcattctggcttaaacaaca

SEQ ID NO: 163093 - DNA, 25 bp, Homo sapien
attctggcttaaacaacacctcctc

SEQ ID NO: 163094 - DNA, 25 bp, Homo sapien
gggctcactgcaggcatgctgaaca

SEQ ID NO: 163095 - DNA, 25 bp, Homo sapien
gctcactgcaggcatgctgaacaag

SEQ ID NO: 163096 - DNA, 25 bp, Homo sapien
agagggtggcatcaggagctgctca

SEQ ID NO: 163097 - DNA, 25 bp, Homo sapien
caggagctgctcaggcttggcggag

SEQ ID NO: 163098 - DNA, 25 bp, Homo sapien
agcggcatgggcgatgtcactcatg

SEQ ID NO: 163099 - DNA, 25 bp, Homo sapien
atgggcgatgtcactcatgcccttc

SEQ ID NO: 163100 - DNA, 25 bp, Homo sapien
ttccctccttcatgatttccattaa

SEQ ID NO: 163101 - DNA, 25 bp, Homo sapien
ctccttcatgatttccattaaagtc

SEQ ID NO: 163102 - DNA, 25 bp, Homo sapien
ggcataaaactgagtgtcccaaagg

SEQ ID NO: 163103 - DNA, 25 bp, Homo sapien
ctgagtgtcccaaaggtttattaat

SEQ ID NO: 163104 - DNA, 25 bp, Homo sapien
gtacaggtaatgtatcatgatccag

SEQ ID NO: 163105 - DNA, 25 bp, Homo sapien
gtatcatgatccagtatcacagtat

SEQ ID NO: 163106 - DNA, 25 bp, Homo sapien
atccagtatcacagtattgtgctgt

SEQ ID NO: 163107 - DNA, 25 bp, Homo sapien
tgtgtgtgtgcgctgcttcttgatc

SEQ ID NO: 163108 - DNA, 25 bp, Homo sapien
gtgcgctgcttcttgatctaggcaa

SEQ ID NO: 163109 - DNA, 25 bp, Homo sapien
tgcttcttgatctaggcaaaccttt

SEQ ID NO: 163110 - DNA, 25 bp, Homo sapien
cctttataaagttgcagtacctaat

SEQ ID NO: 163111 - DNA, 25 bp, Homo sapien
gtacctaatctgttattcccacttc

SEQ ID NO: 163112 - DNA, 25 bp, Homo sapien
taatctgttattcccacttctctgt

SEQ ID NO: 163113 - DNA, 25 bp, Homo sapien
tctcctctggacctaaacctgaaat

SEQ ID NO: 163114 - DNA, 25 bp, Homo sapien
tcctctggacctaaacctgaaatcc

SEQ ID NO: 163115 - DNA, 25 bp, Homo sapien
cccagccctacagacttgctgtgtg

SEQ ID NO: 163116 - DNA, 25 bp, Homo sapien
ctgtgtgacctcaggccagtgtgcc

SEQ ID NO: 163117 - DNA, 25 bp, Homo sapien
tgacctcaggccagtgtgccgacct

SEQ ID NO: 163118 - DNA, 25 bp, Homo sapien
cctcagttttcccagctatgaaaac

SEQ ID NO: 163119 - DNA, 25 bp, Homo sapien
ttttcccagctatgaaaacagctat

SEQ ID NO: 163120 - DNA, 25 bp, Homo sapien
aaaacagctatctcacaaagttgtg

SEQ ID NO: 163121 - DNA, 25 bp, Homo sapien
caaagttgtgtgaagcagaagagaa

SEQ ID NO: 163122 - DNA, 25 bp, Homo sapien
attaatattgttgccgctgttgtgt

SEQ ID NO: 163123 - DNA, 25 bp, Homo sapien
atattgttgccgctgttgtgttgtt

SEQ ID NO: 163124 - DNA, 25 bp, Homo sapien
ccatccgccaaggtgccaatatgaa

SEQ ID NO: 163125 - DNA, 25 bp, Homo sapien
agggagcgattaccttgaccatcct

SEQ ID NO: 163126 - DNA, 25 bp, Homo sapien
ttgaccatcctgattggcgtctttg

SEQ ID NO: 163127 - DNA, 25 bp, Homo sapien
ttggcgtctttgttgtctgctgggc

SEQ ID NO: 163128 - DNA, 25 bp, Homo sapien
ttaatattctacatctcttgtcctc

SEQ ID NO: 163129 - DNA, 25 bp, Homo sapien
ttgtcctcagaatccatattgtgtg

SEQ ID NO: 163130 - DNA, 25 bp, Homo sapien
gtctcactttaacttgtatctcata

SEQ ID NO: 163131 - DNA, 25 bp, Homo sapien
tgtgtaattcaatcatcgatcctct

SEQ ID NO: 163132 - DNA, 25 bp, Homo sapien
gatcctctgatttatgcactccgga

SEQ ID NO: 163133 - DNA, 25 bp, Homo sapien
aagagatcatctgttgctatcccct

SEQ ID NO: 163134 - DNA, 25 bp, Homo sapien
gaggcctttgtgacttgtctagcag

SEQ ID NO: 163135 - DNA, 25 bp, Homo sapien
agtgacgctgtggtgtgaggtgttc

SEQ ID NO: 163136 - DNA, 25 bp, Homo sapien
tgaggtgttctgagctcactgaccg

SEQ ID NO: 163137 - DNA, 25 bp, Homo sapien
ggaaggtccaggtgaatctcgtcat

SEQ ID NO: 163138 - DNA, 25 bp, Homo sapien
ggtccaggtgaatctcgtcataagt

SEQ ID NO: 163139 - DNA, 25 bp, Homo sapien
cgtcataagtgatctcaggctctca

SEQ ID NO: 163140 - DNA, 25 bp, Homo sapien
aggctctcacaggatccggagggaa

SEQ ID NO: 163141 - DNA, 25 bp, Homo sapien
aattcagtgcttttgagttacttgt

SEQ ID NO: 163142 - DNA, 25 bp, Homo sapien
atttcctcacaaaagagagtcctca

SEQ ID NO: 163143 - DNA, 25 bp, Homo sapien
aagagagtcctcaagttgtggctgt

SEQ ID NO: 163144 - DNA, 25 bp, Homo sapien
caagttgtggctgttcttgggaaag

SEQ ID NO: 163145 - DNA, 25 bp, Homo sapien
aagtgtgcttgggaattccttaaat

SEQ ID NO: 163146 - DNA, 25 bp, Homo sapien
caggcgtgtaaatgccattgaacat

SEQ ID NO: 163147 - DNA, 25 bp, Homo sapien
tgccattgaacatgtcatcattccc

SEQ ID NO: 163148 - DNA, 25 bp, Homo sapien
atcattccccggattgaacgtactc

SEQ ID NO: 163149 - DNA, 25 bp, Homo sapien
attccccggattgaacgtactcttg

SEQ ID NO: 163150 - DNA, 25 bp, Homo sapien
cggattgaacgtactcttgcttata

SEQ ID NO: 163151 - DNA, 25 bp, Homo sapien
gaacgtactcttgcttatatcatca

SEQ ID NO: 163152 - DNA, 25 bp, Homo sapien
gtactcttgcttatatcatcacaga

SEQ ID NO: 163153 - DNA, 25 bp, Homo sapien
gcttatatcatcacagagctggatg

SEQ ID NO: 163154 - DNA, 25 bp, Homo sapien
aaggacgaggatcttctatttgaat

SEQ ID NO: 163155 - DNA, 25 bp, Homo sapien
gagaaaccctaacactggcttcatt

SEQ ID NO: 163156 - DNA, 25 bp, Homo sapien
gaaaccctaacactggcttcatttt

SEQ ID NO: 163157 - DNA, 25 bp, Homo sapien
gctacagtgtctggccttgggaaga

SEQ ID NO: 163158 - DNA, 25 bp, Homo sapien
ggaagaagtgattctgtccctccaa

SEQ ID NO: 163159 - DNA, 25 bp, Homo sapien
gattctgtccctccaaagaaatagg

SEQ ID NO: 163160 - DNA, 25 bp, Homo sapien
gaaatagggcatggcttgcccctgt

SEQ ID NO: 163161 - DNA, 25 bp, Homo sapien
tgtggccctggcatccaaatggctg

SEQ ID NO: 163162 - DNA, 25 bp, Homo sapien
caaatggctgcttttgtctccctta

SEQ ID NO: 163163 - DNA, 25 bp, Homo sapien
tgtctcccttacctcgtgaagaggg

SEQ ID NO: 163164 - DNA, 25 bp, Homo sapien
tgaagggtgactaaacgggcgccaa

SEQ ID NO: 163165 - DNA, 25 bp, Homo sapien
aactgggccagcagagcatgttgga

SEQ ID NO: 163166 - DNA, 25 bp, Homo sapien
gccagcagagcatgttggacacccc

SEQ ID NO: 163167 - DNA, 25 bp, Homo sapien
tactactagatcacttgtcctcttg

SEQ ID NO: 163168 - DNA, 25 bp, Homo sapien
ggaaccctaagatcgtcgtccccat

SEQ ID NO: 163169 - DNA, 25 bp, Homo sapien
ctgtccacgtcagcaggttcgctat

SEQ ID NO: 163170 - DNA, 25 bp, Homo sapien
acgtcagcaggttcgctatcagaag

SEQ ID NO: 163171 - DNA, 25 bp, Homo sapien
ggttcgctatcagaagtcagcatca

SEQ ID NO: 163172 - DNA, 25 bp, Homo sapien
atcagaagtcagcatcagcagctag

SEQ ID NO: 163173 - DNA, 25 bp, Homo sapien
atcagcagctagaacaggcccggcc

SEQ ID NO: 163174 - DNA, 25 bp, Homo sapien
tgagggtccagaagggccagggcct

SEQ ID NO: 163175 - DNA, 25 bp, Homo sapien
aaagtacctctccttgaccgagcgc

SEQ ID NO: 163176 - DNA, 25 bp, Homo sapien
tctccttgaccgagcgctcgcagat

SEQ ID NO: 163177 - DNA, 25 bp, Homo sapien
tcaaactcagcgaggtgcaggtgaa

SEQ ID NO: 163178 - DNA, 25 bp, Homo sapien
tgaaggcaggcaatgccaattccaa

SEQ ID NO: 163179 - DNA, 25 bp, Homo sapien
tgcagcacggcccacgctggtaatt

SEQ ID NO: 163180 - DNA, 25 bp, Homo sapien
cacggcccacgctggtaattttttg

SEQ ID NO: 163181 - DNA, 25 bp, Homo sapien
gatggtgagaagttttcaccgtgtt

SEQ ID NO: 163182 - DNA, 25 bp, Homo sapien
ccgtgttgccaggatggcttatcct

SEQ ID NO: 163183 - DNA, 25 bp, Homo sapien
ggatggcttatcctgacatcgtgat

SEQ ID NO: 163184 - DNA, 25 bp, Homo sapien
tcgtgatctgtatgcctcggatccc

SEQ ID NO: 163185 - DNA, 25 bp, Homo sapien
gatctgtatgcctcggatcccaaag

SEQ ID NO: 163186 - DNA, 25 bp, Homo sapien
ggatcccaaagtgcatgggatgaca

SEQ ID NO: 163187 - DNA, 25 bp, Homo sapien
tgcatgggatgacagctgtgagcca

SEQ ID NO: 163188 - DNA, 25 bp, Homo sapien
aatctcactctgtttttcacagtaa

SEQ ID NO: 163189 - DNA, 25 bp, Homo sapien
aacgttttatccaattagaatatat

SEQ ID NO: 163190 - DNA, 25 bp, Homo sapien
tggatgaaaacatggacctcttgga

SEQ ID NO: 163191 - DNA, 25 bp, Homo sapien
gaaaacatggacctcttggaaggta

SEQ ID NO: 163192 - DNA, 25 bp, Homo sapien
acatggacctcttggaaggtataac

SEQ ID NO: 163193 - DNA, 25 bp, Homo sapien
cctcttggaaggtataactggcttt

SEQ ID NO: 163194 - DNA, 25 bp, Homo sapien
ggctttgaagactctgtccgaaagt

SEQ ID NO: 163195 - DNA, 25 bp, Homo sapien
ttatctgccatgttgtgggtatcac

SEQ ID NO: 163196 - DNA, 25 bp, Homo sapien
tctgccatgttgtgggtatcactta

SEQ ID NO: 163197 - DNA, 25 bp, Homo sapien
gccatgttgtgggtatcacttacca

SEQ ID NO: 163198 - DNA, 25 bp, Homo sapien
tgttgtgggtatcacttaccagcac

SEQ ID NO: 163199 - DNA, 25 bp, Homo sapien
ttaccagcacattgaccgctggctg

SEQ ID NO: 163200 - DNA, 25 bp, Homo sapien
ttgaccgctggctgctggccgagat

SEQ ID NO: 163201 - DNA, 25 bp, Homo sapien
attgtcttttagtaacatccttgtt

SEQ ID NO: 163202 - DNA, 25 bp, Homo sapien
tccttgtttagtgtcttctcaagct

SEQ ID NO: 163203 - DNA, 25 bp, Homo sapien
caagctttctttactgaggaattca

SEQ ID NO: 163204 - DNA, 25 bp, Homo sapien
gaggaattcagcttgtgacacagat

SEQ ID NO: 163205 - DNA, 25 bp, Homo sapien
tgacacagatacatcccactagctt

SEQ ID NO: 163206 - DNA, 25 bp, Homo sapien
gatacatcccactagcttgtgaggt

SEQ ID NO: 163207 - DNA, 25 bp, Homo sapien
gattgaaaagtttcctatctttaca

SEQ ID NO: 163208 - DNA, 25 bp, Homo sapien
ctttacattgttgaggaagtccttt

SEQ ID NO: 163209 - DNA, 25 bp, Homo sapien
gaaatgattctctcacaggcttggg

SEQ ID NO: 163210 - DNA, 25 bp, Homo sapien
caggcttgggaaatcctgttagcat

SEQ ID NO: 163211 - DNA, 25 bp, Homo sapien
gtggtaactttgtcaatttcccatt

SEQ ID NO: 163212 - DNA, 25 bp, Homo sapien
tttttcatgttaaagagccgtgtct

SEQ ID NO: 163213 - DNA, 25 bp, Homo sapien
gttaaagagccgtgtctcccgccag

SEQ ID NO: 163214 - DNA, 25 bp, Homo sapien
tcctcaccccggtatgaatgtgttt

SEQ ID NO: 163215 - DNA, 25 bp, Homo sapien
cccggtatgaatgtgtttcctccac

SEQ ID NO: 163216 - DNA, 25 bp, Homo sapien
gtttcctccacattgtatatccttc

SEQ ID NO: 163217 - DNA, 25 bp, Homo sapien
cctctggctgcctagatcagtaaat

SEQ ID NO: 163218 - DNA, 25 bp, Homo sapien
gtaacactgttgaaaccctgatccc

SEQ ID NO: 163219 - DNA, 25 bp, Homo sapien
tgaaaccctgatcccagtggaggct

SEQ ID NO: 163220 - DNA, 25 bp, Homo sapien
cccagtggaggctgtaacccacctg

SEQ ID NO: 163221 - DNA, 25 bp, Homo sapien
tgacccctgttaccgcatttgtgtg

SEQ ID NO: 163222 - DNA, 25 bp, Homo sapien
aggcgtttgctatatacagttgtcc

SEQ ID NO: 163223 - DNA, 25 bp, Homo sapien
tgtactttagacatgaatgcaacta

SEQ ID NO: 163224 - DNA, 25 bp, Homo sapien
gacatgaatgcaactatttaaagaa

SEQ ID NO: 163225 - DNA, 25 bp, Homo sapien
atgttattccttacatgtcataaga

SEQ ID NO: 163226 - DNA, 25 bp, Homo sapien
ccttacatgtcataagattcttact

SEQ ID NO: 163227 - DNA, 25 bp, Homo sapien
gattcttacttaaacttggtcttct

SEQ ID NO: 163228 - DNA, 25 bp, Homo sapien
gtttgtatgaagatgctgtacccac

SEQ ID NO: 163229 - DNA, 25 bp, Homo sapien
gtatgaagatgctgtacccacttga

SEQ ID NO: 163230 - DNA, 25 bp, Homo sapien
tgaagatgctgtacccacttgaaca

SEQ ID NO: 163231 - DNA, 25 bp, Homo sapien
gatgctgtacccacttgaacagtcc

SEQ ID NO: 163232 - DNA, 25 bp, Homo sapien
tacccacttgaacagtcctcaggtg

SEQ ID NO: 163233 - DNA, 25 bp, Homo sapien
gtcctcaggtgtttacataaatact

SEQ ID NO: 163234 - DNA, 25 bp, Homo sapien
ttgacctgtgatcaaaattgaacca

SEQ ID NO: 163235 - DNA, 25 bp, Homo sapien
gacctgtgatcaaaattgaaccatt

SEQ ID NO: 163236 - DNA, 25 bp, Homo sapien
tgtagaattgtggttgatgattaat

SEQ ID NO: 163237 - DNA, 25 bp, Homo sapien
gggcttcacggaatgttacaatgtt

SEQ ID NO: 163238 - DNA, 25 bp, Homo sapien
ggcttcacggaatgttacaatgtta

SEQ ID NO: 163239 - DNA, 25 bp, Homo sapien
cttcacggaatgttacaatgttact

SEQ ID NO: 163240 - DNA, 25 bp, Homo sapien
cacggaatgttacaatgttactaat

SEQ ID NO: 163241 - DNA, 25 bp, Homo sapien
caatgttactaatataatttggctt

SEQ ID NO: 163242 - DNA, 25 bp, Homo sapien
ggcttttgttatgcaaattgttaac

SEQ ID NO: 163243 - DNA, 25 bp, Homo sapien
gttatgcaaattgttaacaccagct

SEQ ID NO: 163244 - DNA, 25 bp, Homo sapien
ttatgcaaattgttaacaccagcta

SEQ ID NO: 163245 - DNA, 25 bp, Homo sapien
gtcttacattgctgcatcaagaaac

SEQ ID NO: 163246 - DNA, 25 bp, Homo sapien
atcaagaaacccaagctgctgagat

SEQ ID NO: 163247 - DNA, 25 bp, Homo sapien
ctgctgagatctgggacatgagcga

SEQ ID NO: 163248 - DNA, 25 bp, Homo sapien
atgagaccatctgagatggccccgc

SEQ ID NO: 163249 - DNA, 25 bp, Homo sapien
gaggagctctccatcgccagagcag

SEQ ID NO: 163250 - DNA, 25 bp, Homo sapien
agagcaggactgctgaccccaggcc

SEQ ID NO: 163251 - DNA, 25 bp, Homo sapien
ctccataccccgaggtctgggattc

SEQ ID NO: 163252 - DNA, 25 bp, Homo sapien
gttcggcgttgctcgggattcaaga

SEQ ID NO: 163253 - DNA, 25 bp, Homo sapien
gggattcaagataccaccagttcag

SEQ ID NO: 163254 - DNA, 25 bp, Homo sapien
gataccaccagttcagagctaaata

SEQ ID NO: 163255 - DNA, 25 bp, Homo sapien
taaataataaccttggccttggcct

SEQ ID NO: 163256 - DNA, 25 bp, Homo sapien
tgagctgggaactcaggctcctgga

SEQ ID NO: 163257 - DNA, 25 bp, Homo sapien
ctcctggaaaaacctgggcagtggg

SEQ ID NO: 163258 - DNA, 25 bp, Homo sapien
tcagctgcgggccattgatttgagc

SEQ ID NO: 163259 - DNA, 25 bp, Homo sapien
ctgcgggccattgatttgagccttt

SEQ ID NO: 163260 - DNA, 25 bp, Homo sapien
gcgggccattgatttgagcctttga

SEQ ID NO: 163261 - DNA, 25 bp, Homo sapien
gccattgatttgagcctttgaggga

SEQ ID NO: 163262 - DNA, 25 bp, Homo sapien
tgatttgagcctttgagggaggata

SEQ ID NO: 163263 - DNA, 25 bp, Homo sapien
ggaggatagggctggcctttgtgaa

SEQ ID NO: 163264 - DNA, 25 bp, Homo sapien
tgtctccagctgattagcctcagac

SEQ ID NO: 163265 - DNA, 25 bp, Homo sapien
tccagctgattagcctcagactctt

SEQ ID NO: 163266 - DNA, 25 bp, Homo sapien
gcctcagactcttcttttattgttt

SEQ ID NO: 163267 - DNA, 25 bp, Homo sapien
acaagtttttggaatcgtgccagat

SEQ ID NO: 163268 - DNA, 25 bp, Homo sapien
agatggtacccttcaactgttaaag

SEQ ID NO: 163269 - DNA, 25 bp, Homo sapien
agcccttcctcatctacagattaat

SEQ ID NO: 163270 - DNA, 25 bp, Homo sapien
acagattaattgctcccatttcacc

SEQ ID NO: 163271 - DNA, 25 bp, Homo sapien
accaccattgccaggccaactattg

SEQ ID NO: 163272 - DNA, 25 bp, Homo sapien
aaatgccgactgacactgcaaaagc

SEQ ID NO: 163273 - DNA, 25 bp, Homo sapien
gcaaaagcccagttgtctatgaagt

SEQ ID NO: 163274 - DNA, 25 bp, Homo sapien
gtatttattgcaggatggtgtctct

SEQ ID NO: 163275 - DNA, 25 bp, Homo sapien
ggtgtctcttctttagaacagggaa

SEQ ID NO: 163276 - DNA, 25 bp, Homo sapien
ggaagcccaattgctggagtactta

SEQ ID NO: 163277 - DNA, 25 bp, Homo sapien
gtacttagctagttttattcttggt

SEQ ID NO: 163278 - DNA, 25 bp, Homo sapien
gacacggcaggatccaagaagcact

SEQ ID NO: 163279 - DNA, 25 bp, Homo sapien
tgaaatgtgtccagtcccaggagtc

SEQ ID NO: 163280 - DNA, 25 bp, Homo sapien
agtcccaggagtccttcagccttgg

SEQ ID NO: 163281 - DNA, 25 bp, Homo sapien
cccctttttcaagatgaggttggag

SEQ ID NO: 163282 - DNA, 25 bp, Homo sapien
gaggcttctgtatgtagagggcact

SEQ ID NO: 163283 - DNA, 25 bp, Homo sapien
agggcactggcttgggccaaatgcc

SEQ ID NO: 163284 - DNA, 25 bp, Homo sapien
tggcttgggccaaatgccaacaaaa

SEQ ID NO: 163285 - DNA, 25 bp, Homo sapien
caacaaaaccaacccttgaagacat

SEQ ID NO: 163286 - DNA, 25 bp, Homo sapien
cttgaagacatttcagggccatgct

SEQ ID NO: 163287 - DNA, 25 bp, Homo sapien
gccatgctcacttgggagggtttga

SEQ ID NO: 163288 - DNA, 25 bp, Homo sapien
ggacatgatttagcgagcctctgtt

SEQ ID NO: 163289 - DNA, 25 bp, Homo sapien
gcatctatatgtgtattatgtatgt

SEQ ID NO: 163290 - DNA, 25 bp, Homo sapien
gtgtgcatgcgtgcgcgcacacaca

SEQ ID NO: 163291 - DNA, 25 bp, Homo sapien
tttattcctaaatcttccagcatgc

SEQ ID NO: 163292 - DNA, 25 bp, Homo sapien
attcctaaatcttccagcatgcatc

SEQ ID NO: 163293 - DNA, 25 bp, Homo sapien
tcttccagcatgcatccccaaaaaa

SEQ ID NO: 163294 - DNA, 25 bp, Homo sapien
agcatgcatccccaaaaaacaagaa

SEQ ID NO: 163295 - DNA, 25 bp, Homo sapien
aagaaacttgtcttacataatcaca

SEQ ID NO: 163296 - DNA, 25 bp, Homo sapien
tcacaataatatatccacatctaag

SEQ ID NO: 163297 - DNA, 25 bp, Homo sapien
ttactgtaacttcttaatctaagaa

SEQ ID NO: 163298 - DNA, 25 bp, Homo sapien
gtatttttgtcatagcagcaaacag

SEQ ID NO: 163299 - DNA, 25 bp, Homo sapien
ttgtcatagcagcaaacagagtgaa

SEQ ID NO: 163300 - DNA, 25 bp, Homo sapien
cattgcatgaggtctgccagaaggc

SEQ ID NO: 163301 - DNA, 25 bp, Homo sapien
attgcatgaggtctgccagaaggcc

SEQ ID NO: 163302 - DNA, 25 bp, Homo sapien
ttgcatgaggtctgccagaaggccc

SEQ ID NO: 163303 - DNA, 25 bp, Homo sapien
tgcatgaggtctgccagaaggccct

SEQ ID NO: 163304 - DNA, 25 bp, Homo sapien
atgaggtctgccagaaggccctgcg

SEQ ID NO: 163305 - DNA, 25 bp, Homo sapien
tgaggtctgccagaaggccctgcgt

SEQ ID NO: 163306 - DNA, 25 bp, Homo sapien
aggtctgccagaaggccctgcgtgt

SEQ ID NO: 163307 - DNA, 25 bp, Homo sapien
acatggagggcattgcatgaggtct

SEQ ID NO: 163308 - DNA, 25 bp, Homo sapien
agggcattgcatgaggtctgccaga

SEQ ID NO: 163309 - DNA, 25 bp, Homo sapien
gggcattgcatgaggtctgccagaa

SEQ ID NO: 163310 - DNA, 25 bp, Homo sapien
gcattgcatgaggtctgccagaagg

SEQ ID NO: 163311 - DNA, 25 bp, Homo sapien
tttattcattcacattaggtcactg

SEQ ID NO: 163312 - DNA, 25 bp, Homo sapien
attaggtcactgtcatactgtcata

SEQ ID NO: 163313 - DNA, 25 bp, Homo sapien
gtcactgtcatactgtcataggctg

SEQ ID NO: 163314 - DNA, 25 bp, Homo sapien
catactgtcataggctgagagagtt

SEQ ID NO: 163315 - DNA, 25 bp, Homo sapien
gttttcccaagatcagttgcttata

SEQ ID NO: 163316 - DNA, 25 bp, Homo sapien
gatcagttgcttatagataatgttc

SEQ ID NO: 163317 - DNA, 25 bp, Homo sapien
gataatgttcaatgacctcaagaca

SEQ ID NO: 163318 - DNA, 25 bp, Homo sapien
gttcaatgacctcaagacatatatt

SEQ ID NO: 163319 - DNA, 25 bp, Homo sapien
tgttttcactgattccaatattatt

SEQ ID NO: 163320 - DNA, 25 bp, Homo sapien
attacttataacactgacctctgga

SEQ ID NO: 163321 - DNA, 25 bp, Homo sapien
ataacactgacctctggaaaatatt

SEQ ID NO: 163322 - DNA, 25 bp, Homo sapien
gaagcaatgcctatactatcacaac

SEQ ID NO: 163323 - DNA, 25 bp, Homo sapien
tcacaacaagttcaaggatggccaa

SEQ ID NO: 163324 - DNA, 25 bp, Homo sapien
aactacgttggcatttcagaaatcc

SEQ ID NO: 163325 - DNA, 25 bp, Homo sapien
agaaatcccttccatggccaaaact

SEQ ID NO: 163326 - DNA, 25 bp, Homo sapien
aaaactattaccaaagactcgatct

SEQ ID NO: 163327 - DNA, 25 bp, Homo sapien
ctcgatctatgactcatttgacaga

SEQ ID NO: 163328 - DNA, 25 bp, Homo sapien
aaaagcttgcttggcccattaactc

SEQ ID NO: 163329 - DNA, 25 bp, Homo sapien
gcccattaactcaaatccaccaaat

SEQ ID NO: 163330 - DNA, 25 bp, Homo sapien
tttgtctaagttctcattctttcaa

SEQ ID NO: 163331 - DNA, 25 bp, Homo sapien
ctttcaattgttatgcaccagagat

SEQ ID NO: 163332 - DNA, 25 bp, Homo sapien
tgttttcactcaactttccaaggga

SEQ ID NO: 163333 - DNA, 25 bp, Homo sapien
ctgagaccaccacactgcaaggaca

SEQ ID NO: 163334 - DNA, 25 bp, Homo sapien
gcaaggacacttgaaggtactcagg

SEQ ID NO: 163335 - DNA, 25 bp, Homo sapien
ggacacttgaaggtactcaggtttc

SEQ ID NO: 163336 - DNA, 25 bp, Homo sapien
gaaggtactcaggtttcagagccca

SEQ ID NO: 163337 - DNA, 25 bp, Homo sapien
aggtactcaggtttcagagcccaag

SEQ ID NO: 163338 - DNA, 25 bp, Homo sapien
tcaggaggtcaagtgtgcatgcaag

SEQ ID NO: 163339 - DNA, 25 bp, Homo sapien
tcaagtgtgcatgcaagaggtggca

SEQ ID NO: 163340 - DNA, 25 bp, Homo sapien
caggccacctgcacagctggatggt

SEQ ID NO: 163341 - DNA, 25 bp, Homo sapien
gctggatggtggaagcagttcactt

SEQ ID NO: 163342 - DNA, 25 bp, Homo sapien
gaagcagttcacttaaaggccatga

SEQ ID NO: 163343 - DNA, 25 bp, Homo sapien
gcagttcacttaaaggccatgagtt

SEQ ID NO: 163344 - DNA, 25 bp, Homo sapien
ttctctctaaagaccagtctggctc

SEQ ID NO: 163345 - DNA, 25 bp, Homo sapien
acagtttgactgaaggcatcccgcc

SEQ ID NO: 163346 - DNA, 25 bp, Homo sapien
caccacggctggtctggagggcatc

SEQ ID NO: 163347 - DNA, 25 bp, Homo sapien
ctggaagccggaaagcccgatttgg

SEQ ID NO: 163348 - DNA, 25 bp, Homo sapien
gcccgatttgggagtgagaagcctt

SEQ ID NO: 163349 - DNA, 25 bp, Homo sapien
aagcagatctgagtgtctgacccag

SEQ ID NO: 163350 - DNA, 25 bp, Homo sapien
tctgacccaggacagctgtggtttg

SEQ ID NO: 163351 - DNA, 25 bp, Homo sapien
acagctgtggtttgtcactctgaaa

SEQ ID NO: 163352 - DNA, 25 bp, Homo sapien
gtcactctgaaacctgatgcaacag

SEQ ID NO: 163353 - DNA, 25 bp, Homo sapien
gtaaaactctctgtgcatctaaata

SEQ ID NO: 163354 - DNA, 25 bp, Homo sapien
gcgacagattcatgccacggataaa

SEQ ID NO: 163355 - DNA, 25 bp, Homo sapien
aaagagttttttcaatgctgcagtg

SEQ ID NO: 163356 - DNA, 25 bp, Homo sapien
agtccactcccatgtaaccatgaaa

SEQ ID NO: 163357 - DNA, 25 bp, Homo sapien
ttgcaccatgcatttttactattat

SEQ ID NO: 163358 - DNA, 25 bp, Homo sapien
attttccaatacttagcaccatttc

SEQ ID NO: 163359 - DNA, 25 bp, Homo sapien
gcaccatttcactaaggaaccttga

SEQ ID NO: 163360 - DNA, 25 bp, Homo sapien
cttgaatacaaccaggatcctcctt

SEQ ID NO: 163361 - DNA, 25 bp, Homo sapien
gatcctcctttgcatgcgactgtag

SEQ ID NO: 163362 - DNA, 25 bp, Homo sapien
gcgactgtagctgcatttcatgaat

SEQ ID NO: 163363 - DNA, 25 bp, Homo sapien
gtttgaacccttgtcaatgcatttt

SEQ ID NO: 163364 - DNA, 25 bp, Homo sapien
aaaaacttcgtgtatgtgactcaaa

SEQ ID NO: 163365 - DNA, 25 bp, Homo sapien
gtgactcaaagcatgtaaccttaag

SEQ ID NO: 163366 - DNA, 25 bp, Homo sapien
cgagagttacgaacagcactggaca

SEQ ID NO: 163367 - DNA, 25 bp, Homo sapien
gatggagatgaccaacagccacctg

SEQ ID NO: 163368 - DNA, 25 bp, Homo sapien
gatgaaggccaataggacagcactt

SEQ ID NO: 163369 - DNA, 25 bp, Homo sapien
aataggacagcacttctggcccagc

SEQ ID NO: 163370 - DNA, 25 bp, Homo sapien
acttctggcccagcagtaggaaaac

SEQ ID NO: 163371 - DNA, 25 bp, Homo sapien
cagcagtaggaaaaccacccttcaa

SEQ ID NO: 163372 - DNA, 25 bp, Homo sapien
ttcaacctgggtgatgctccttggg

SEQ ID NO: 163373 - DNA, 25 bp, Homo sapien
ggccctacctagagggactgacttt

SEQ ID NO: 163374 - DNA, 25 bp, Homo sapien
gactgacttttgtccattgacacaa

SEQ ID NO: 163375 - DNA, 25 bp, Homo sapien
tgacacaaaccccttttagtactgt

SEQ ID NO: 163376 - DNA, 25 bp, Homo sapien
gtcattaaaacagccacctttgtat

SEQ ID NO: 163377 - DNA, 25 bp, Homo sapien
atacatcgtcgcgtctgctcaggtc

SEQ ID NO: 163378 - DNA, 25 bp, Homo sapien
gctcaggtctggatgataacacgct

SEQ ID NO: 163379 - DNA, 25 bp, Homo sapien
taacacgctatgatctgtaccacac

SEQ ID NO: 163380 - DNA, 25 bp, Homo sapien
gttcctcagagtttacaaggccttt

SEQ ID NO: 163381 - DNA, 25 bp, Homo sapien
caaggcctttgttatggagacgttt

SEQ ID NO: 163382 - DNA, 25 bp, Homo sapien
atggagacgtttgtccacctatgct

SEQ ID NO: 163383 - DNA, 25 bp, Homo sapien
acctatgctcgctgggcagttgggc

SEQ ID NO: 163384 - DNA, 25 bp, Homo sapien
gccatgtatgttgccgttgtcaatg

SEQ ID NO: 163385 - DNA, 25 bp, Homo sapien
gttgtcaatgtgcactcctaggctt

SEQ ID NO: 163386 - DNA, 25 bp, Homo sapien
tcctaggcttggtgtctcagacatt

SEQ ID NO: 163387 - DNA, 25 bp, Homo sapien
agacattgatgtaccttttccctgc

SEQ ID NO: 163388 - DNA, 25 bp, Homo sapien
agaacttatctactggatttccgta

SEQ ID NO: 163389 - DNA, 25 bp, Homo sapien
ctggatttccgtagtattgatgatg

SEQ ID NO: 163390 - DNA, 25 bp, Homo sapien
tacagaagccaaatcagggactgct

SEQ ID NO: 163391 - DNA, 25 bp, Homo sapien
aaatcagggactgctactccacaga

SEQ ID NO: 163392 - DNA, 25 bp, Homo sapien
gactgctactccacagagatcggga

SEQ ID NO: 163393 - DNA, 25 bp, Homo sapien
gagatcgggatcagttagcaactat

SEQ ID NO: 163394 - DNA, 25 bp, Homo sapien
gttagcaactatcgatcttgccaaa

SEQ ID NO: 163395 - DNA, 25 bp, Homo sapien
gatcttgccaaaggagtgattcaga

SEQ ID NO: 163396 - DNA, 25 bp, Homo sapien
aaggaaaatcctcagaagtttctct

SEQ ID NO: 163397 - DNA, 25 bp, Homo sapien
gtttctcttacctcatctgtgacct

SEQ ID NO: 163398 - DNA, 25 bp, Homo sapien
cttgcacaataaacagagaaacctt

SEQ ID NO: 163399 - DNA, 25 bp, Homo sapien
gtctctaaagctcctagtacctaga

SEQ ID NO: 163400 - DNA, 25 bp, Homo sapien
gaagcattatgaagcagtcaacaat

SEQ ID NO: 163401 - DNA, 25 bp, Homo sapien
gagagccttcaaagtctaccagcac

SEQ ID NO: 163402 - DNA, 25 bp, Homo sapien
gtctaccagcacaaagacccctgag

SEQ ID NO: 163403 - DNA, 25 bp, Homo sapien
tgagccccgcaattgtgatcccaca

SEQ ID NO: 163404 - DNA, 25 bp, Homo sapien
tgtgatcccacaagacatgcatctc

SEQ ID NO: 163405 - DNA, 25 bp, Homo sapien
gcatctccacaaggctactgtatta

SEQ ID NO: 163406 - DNA, 25 bp, Homo sapien
ctactgtattagaacgtgcaatgca

SEQ ID NO: 163407 - DNA, 25 bp, Homo sapien
gtatggaagacataggtgctctctt

SEQ ID NO: 163408 - DNA, 25 bp, Homo sapien
aggtgctctcttgaaatcttaaata

SEQ ID NO: 163409 - DNA, 25 bp, Homo sapien
atttgagctcatataaggtggattg

SEQ ID NO: 163410 - DNA, 25 bp, Homo sapien
gatctcaaaggactatggtgtatac

SEQ ID NO: 163411 - DNA, 25 bp, Homo sapien
tatggtgtatacctagaggactcag

SEQ ID NO: 163412 - DNA, 25 bp, Homo sapien
gaggactcaggccacactcttagag

SEQ ID NO: 163413 - DNA, 25 bp, Homo sapien
gccacactcttagaggtctcttcat

SEQ ID NO: 163414 - DNA, 25 bp, Homo sapien
gaggtctcttcattattgatgacaa

SEQ ID NO: 163415 - DNA, 25 bp, Homo sapien
ggaatcctaagacaaattactctga

SEQ ID NO: 163416 - DNA, 25 bp, Homo sapien
tactctgaatgatcttcctgtgggt

SEQ ID NO: 163417 - DNA, 25 bp, Homo sapien
gagacactacgtttggttcaagcat

SEQ ID NO: 163418 - DNA, 25 bp, Homo sapien
ggttcaagcattccagtacactgac

SEQ ID NO: 163419 - DNA, 25 bp, Homo sapien
aaacacggagaagtctgccctgctg

SEQ ID NO: 163420 - DNA, 25 bp, Homo sapien
gtagtgaaacaataatcccagatcc

SEQ ID NO: 163421 - DNA, 25 bp, Homo sapien
gggagaccgatgcttctaacccagc

SEQ ID NO: 163422 - DNA, 25 bp, Homo sapien
cgctttgactgcgtgttgtgcagct

SEQ ID NO: 163423 - DNA, 25 bp, Homo sapien
ttgtgcagctgagcgcgaggccaac

SEQ ID NO: 163424 - DNA, 25 bp, Homo sapien
cagctgagcgcgaggccaacgttga

SEQ ID NO: 163425 - DNA, 25 bp, Homo sapien
gccaacgttgagcaaggccttgcag

SEQ ID NO: 163426 - DNA, 25 bp, Homo sapien
caaggccttgcagggaggttgctcc

SEQ ID NO: 163427 - DNA, 25 bp, Homo sapien
gaggttgctcctgtgtaattacgaa

SEQ ID NO: 163428 - DNA, 25 bp, Homo sapien
taattacgaaagaaggctagtccga

SEQ ID NO: 163429 - DNA, 25 bp, Homo sapien
gaaggctagtccgaaggtgcaaaat

SEQ ID NO: 163430 - DNA, 25 bp, Homo sapien
ccttaggaacaagacctctggatgt

SEQ ID NO: 163431 - DNA, 25 bp, Homo sapien
gacctctggatgtttccagtttcaa

SEQ ID NO: 163432 - DNA, 25 bp, Homo sapien
agccacagttggtgtggctggttca

SEQ ID NO: 163433 - DNA, 25 bp, Homo sapien
gctggcattggaaccgtgtttggca

SEQ ID NO: 163434 - DNA, 25 bp, Homo sapien
ggaaccgtgtttggcagcttgatca

SEQ ID NO: 163435 - DNA, 25 bp, Homo sapien
gcagcttgatcattggctatgccag

SEQ ID NO: 163436 - DNA, 25 bp, Homo sapien
ggctatgccaggaacccgtctctca

SEQ ID NO: 163437 - DNA, 25 bp, Homo sapien
ggaacccgtctctcaagcagcagct

SEQ ID NO: 163438 - DNA, 25 bp, Homo sapien
cttttctgtttgatggtcgccttcc

SEQ ID NO: 163439 - DNA, 25 bp, Homo sapien
ctcttcgccatgtgaggctccatgg

SEQ ID NO: 163440 - DNA, 25 bp, Homo sapien
ggtcaccggcctgttgctactgcaa

SEQ ID NO: 163441 - DNA, 25 bp, Homo sapien
gttgctactgcaactccacaccatt

SEQ ID NO: 163442 - DNA, 25 bp, Homo sapien
gtgtgttaagctttaccattaaaca

SEQ ID NO: 163443 - DNA, 25 bp, Homo sapien
aggaggaaacagttaatgaccctga

SEQ ID NO: 163444 - DNA, 25 bp, Homo sapien
ggaaacagttaatgaccctgaggag

SEQ ID NO: 163445 - DNA, 25 bp, Homo sapien
ctccaaagaggagccggtcagcagt

SEQ ID NO: 163446 - DNA, 25 bp, Homo sapien
agccggtcagcagtgggcctgaaga

SEQ ID NO: 163447 - DNA, 25 bp, Homo sapien
catcccaggaagattagaatgcaaa

SEQ ID NO: 163448 - DNA, 25 bp, Homo sapien
aatgcaaatggacattctctgggag

SEQ ID NO: 163449 - DNA, 25 bp, Homo sapien
gcaaatggacattctctgggaggtg

SEQ ID NO: 163450 - DNA, 25 bp, Homo sapien
gggcataccatagcccaaggtgaca

SEQ ID NO: 163451 - DNA, 25 bp, Homo sapien
cataccatagcccaaggtgacattt

SEQ ID NO: 163452 - DNA, 25 bp, Homo sapien
taccatagcccaaggtgacatttcc

SEQ ID NO: 163453 - DNA, 25 bp, Homo sapien
catagcccaaggtgacatttcccac

SEQ ID NO: 163454 - DNA, 25 bp, Homo sapien
gatgtaatgtttataagctatgaga

SEQ ID NO: 163455 - DNA, 25 bp, Homo sapien
gtaatgtttataagctatgagaatc

SEQ ID NO: 163456 - DNA, 25 bp, Homo sapien
aatgtttataagctatgagaatcag

SEQ ID NO: 163457 - DNA, 25 bp, Homo sapien
tgtttataagctatgagaatcagtt

SEQ ID NO: 163458 - DNA, 25 bp, Homo sapien
gtttataagctatgagaatcagtta

SEQ ID NO: 163459 - DNA, 25 bp, Homo sapien
gaatcagttataaaagtattagcca

SEQ ID NO: 163460 - DNA, 25 bp, Homo sapien
cagttataaaagtattagccatttg

SEQ ID NO: 163461 - DNA, 25 bp, Homo sapien
gttataaaagtattagccatttgtt

SEQ ID NO: 163462 - DNA, 25 bp, Homo sapien
tataaaagtattagccatttgttgt

SEQ ID NO: 163463 - DNA, 25 bp, Homo sapien
ataaaagtattagccatttgttgta

SEQ ID NO: 163464 - DNA, 25 bp, Homo sapien
taaaagtattagccatttgttgtaa

SEQ ID NO: 163465 - DNA, 25 bp, Homo sapien
ttttttcctctcagctatccttcta

SEQ ID NO: 163466 - DNA, 25 bp, Homo sapien
gctatccttctaatttctctctaat

SEQ ID NO: 163467 - DNA, 25 bp, Homo sapien
gtttatatttacctctgggctcaat

SEQ ID NO: 163468 - DNA, 25 bp, Homo sapien
tgggctcaataagggcatctgtgca

SEQ ID NO: 163469 - DNA, 25 bp, Homo sapien
atctgtgcagaaatttggaagccat

SEQ ID NO: 163470 - DNA, 25 bp, Homo sapien
ggattttcctgtggtttatggcaat

SEQ ID NO: 163471 - DNA, 25 bp, Homo sapien
gggtgagggacagcttactccattt

SEQ ID NO: 163472 - DNA, 25 bp, Homo sapien
gcttactccatttgaccagattgtt

SEQ ID NO: 163473 - DNA, 25 bp, Homo sapien
gattgtttggctaacacatcccgaa

SEQ ID NO: 163474 - DNA, 25 bp, Homo sapien
acatcccgaagaatgattttgtcag

SEQ ID NO: 163475 - DNA, 25 bp, Homo sapien
ttcaggatatttttcctctacaata

SEQ ID NO: 163476 - DNA, 25 bp, Homo sapien
cacccgctgtgctcgtggactgagg

SEQ ID NO: 163477 - DNA, 25 bp, Homo sapien
gtggactgaggctgcgctgcccggg

SEQ ID NO: 163478 - DNA, 25 bp, Homo sapien
agactgcccagctcagagtgcccgt

SEQ ID NO: 163479 - DNA, 25 bp, Homo sapien
tgcccagctcagagtgcccgtcagg

SEQ ID NO: 163480 - DNA, 25 bp, Homo sapien
agagtgcccgtcagggcctgtgcat

SEQ ID NO: 163481 - DNA, 25 bp, Homo sapien
cagggcctgtgcatccgcacgcgga

SEQ ID NO: 163482 - DNA, 25 bp, Homo sapien
tgtgcatccgcacgcggagccgtct

SEQ ID NO: 163483 - DNA, 25 bp, Homo sapien
ctgttaggagcttccagagcgttct

SEQ ID NO: 163484 - DNA, 25 bp, Homo sapien
aggagcttccagagcgttctctcga

SEQ ID NO: 163485 - DNA, 25 bp, Homo sapien
agagcgttctctcgacactgccagc

SEQ ID NO: 163486 - DNA, 25 bp, Homo sapien
ccgtgttagcacctgggcctcagtc

SEQ ID NO: 163487 - DNA, 25 bp, Homo sapien
tcactgccctcaaggacaacagcag

SEQ ID NO: 163488 - DNA, 25 bp, Homo sapien
acaacagcagggtgtcacccagagc

SEQ ID NO: 163489 - DNA, 25 bp, Homo sapien
cctgctctccatcttatatgtattc

SEQ ID NO: 163490 - DNA, 25 bp, Homo sapien
catcttatatgtattctaaccagga

SEQ ID NO: 163491 - DNA, 25 bp, Homo sapien
atagcacatgggtagcctaggcagt

SEQ ID NO: 163492 - DNA, 25 bp, Homo sapien
gagtaaatacctcagatgtcctcct

SEQ ID NO: 163493 - DNA, 25 bp, Homo sapien
aaatacctcagatgtcctcctgcag

SEQ ID NO: 163494 - DNA, 25 bp, Homo sapien
ctcctgcagcaagtgtctatatgtt

SEQ ID NO: 163495 - DNA, 25 bp, Homo sapien
atgttgtggttattttctatcttac

SEQ ID NO: 163496 - DNA, 25 bp, Homo sapien
tattttctatcttacatgttctcga

SEQ ID NO: 163497 - DNA, 25 bp, Homo sapien
catgttctcgaatgtttatatttca

SEQ ID NO: 163498 - DNA, 25 bp, Homo sapien
gtaccaaatctgacatattatgcct

SEQ ID NO: 163499 - DNA, 25 bp, Homo sapien
attatgcctgaatgactccactgtt

SEQ ID NO: 163500 - DNA, 25 bp, Homo sapien
gaatgactccactgtttttctctaa

SEQ ID NO: 163501 - DNA, 25 bp, Homo sapien
gtttttctctaatgcttgatttagg

SEQ ID NO: 163502 - DNA, 25 bp, Homo sapien
gcttgatttaggtagccttgtgttc

SEQ ID NO: 163503 - DNA, 25 bp, Homo sapien
gccttgtgttctgagtagagcttgt

SEQ ID NO: 163504 - DNA, 25 bp, Homo sapien
ggaagcttctaaatggtgctgcaga

SEQ ID NO: 163505 - DNA, 25 bp, Homo sapien
cagatttgatatttgcattgaggaa

SEQ ID NO: 163506 - DNA, 25 bp, Homo sapien
agttgccacatttagtcctgtactg

SEQ ID NO: 163507 - DNA, 25 bp, Homo sapien
gtcctgtactgtatggaaacactga

SEQ ID NO: 163508 - DNA, 25 bp, Homo sapien
gaaacactgattttgtaaagttgcc

SEQ ID NO: 163509 - DNA, 25 bp, Homo sapien
acactgagaacgagatggctattta

SEQ ID NO: 163510 - DNA, 25 bp, Homo sapien
agatgagtatttcagccgagtgagt

SEQ ID NO: 163511 - DNA, 25 bp, Homo sapien
gatgagtatttcagccgagtgagtg

SEQ ID NO: 163512 - DNA, 25 bp, Homo sapien
atgagtatttcagccgagtgagtga

SEQ ID NO: 163513 - DNA, 25 bp, Homo sapien
tgagtatttcagccgagtgagtgaa

SEQ ID NO: 163514 - DNA, 25 bp, Homo sapien
gagtatttcagccgagtgagtgaat

SEQ ID NO: 163515 - DNA, 25 bp, Homo sapien
agtatttcagccgagtgagtgaatt

SEQ ID NO: 163516 - DNA, 25 bp, Homo sapien
gtatttcagccgagtgagtgaatta

SEQ ID NO: 163517 - DNA, 25 bp, Homo sapien
tatttcagccgagtgagtgaattag

SEQ ID NO: 163518 - DNA, 25 bp, Homo sapien
atttcagccgagtgagtgaattaga

SEQ ID NO: 163519 - DNA, 25 bp, Homo sapien
tttcagccgagtgagtgaattagat

SEQ ID NO: 163520 - DNA, 25 bp, Homo sapien
gtggactgaggctgcgctgcccggg

SEQ ID NO: 163521 - DNA, 25 bp, Homo sapien
tgcccagctcagagtgcccgtcagg

SEQ ID NO: 163522 - DNA, 25 bp, Homo sapien
ctcagagtgcccgtcagggcctgtg

SEQ ID NO: 163523 - DNA, 25 bp, Homo sapien
tcagagtgcccgtcagggcctgtgc

SEQ ID NO: 163524 - DNA, 25 bp, Homo sapien
agagtgcccgtcagggcctgtgcat

SEQ ID NO: 163525 - DNA, 25 bp, Homo sapien
gagtgcccgtcagggcctgtgcatc

SEQ ID NO: 163526 - DNA, 25 bp, Homo sapien
cagggcctgtgcatccgcacgcgga

SEQ ID NO: 163527 - DNA, 25 bp, Homo sapien
agggcctgtgcatccgcacgcggag

SEQ ID NO: 163528 - DNA, 25 bp, Homo sapien
tgtgcatccgcacgcggagccgtct

SEQ ID NO: 163529 - DNA, 25 bp, Homo sapien
tgccagccccgtgttagcacctggg

SEQ ID NO: 163530 - DNA, 25 bp, Homo sapien
gccccgtgttagcacctgggcctca

SEQ ID NO: 163531 - DNA, 25 bp, Homo sapien
gaatctagtatggtgttctgttttc

SEQ ID NO: 163532 - DNA, 25 bp, Homo sapien
gttctgttttcagctgacttggaca

SEQ ID NO: 163533 - DNA, 25 bp, Homo sapien
tgacttggacaacctgactggcttt

SEQ ID NO: 163534 - DNA, 25 bp, Homo sapien
tgactggctttgcacaggtgttccc

SEQ ID NO: 163535 - DNA, 25 bp, Homo sapien
caggtgttccctgagttgtttgcag

SEQ ID NO: 163536 - DNA, 25 bp, Homo sapien
gaggagaaccttcatggtggcccac

SEQ ID NO: 163537 - DNA, 25 bp, Homo sapien
acctggcctggttgtccaagctgtg

SEQ ID NO: 163538 - DNA, 25 bp, Homo sapien
ttgtccaagctgtgcctcgacacat

SEQ ID NO: 163539 - DNA, 25 bp, Homo sapien
acatcctcatcccaagcatgggaca

SEQ ID NO: 163540 - DNA, 25 bp, Homo sapien
aagcatgggacacctcaagatgaat

SEQ ID NO: 163541 - DNA, 25 bp, Homo sapien
aagaggagccacttatcaaagagat

SEQ ID NO: 163542 - DNA, 25 bp, Homo sapien
gagatgatcagcatgtacttgcccg

SEQ ID NO: 163543 - DNA, 25 bp, Homo sapien
gatgatcagcatgtacttgcccgcc

SEQ ID NO: 163544 - DNA, 25 bp, Homo sapien
tgatcagcatgtacttgcccgccgg

SEQ ID NO: 163545 - DNA, 25 bp, Homo sapien
tcagcatgtacttgcccgccggcga

SEQ ID NO: 163546 - DNA, 25 bp, Homo sapien
actcgctgccgcagcactaccaggg

SEQ ID NO: 163547 - DNA, 25 bp, Homo sapien
gcgcgggcgtgaacggcacggtgcc

SEQ ID NO: 163548 - DNA, 25 bp, Homo sapien
cacggtgcccctgacgcacatctag

SEQ ID NO: 163549 - DNA, 25 bp, Homo sapien
ggcgcgctgggctctctggtgaagt

SEQ ID NO: 163550 - DNA, 25 bp, Homo sapien
ggctctctggtgaagtcggagccca

SEQ ID NO: 163551 - DNA, 25 bp, Homo sapien
tctctggtgaagtcggagcccagcg

SEQ ID NO: 163552 - DNA, 25 bp, Homo sapien
gaagtcggagcccagcggcagcccg

SEQ ID NO: 163553 - DNA, 25 bp, Homo sapien
gaaatacgagaagttggtgagcagc

SEQ ID NO: 163554 - DNA, 25 bp, Homo sapien
gtgagcagcggcttccgagaaaacg

SEQ ID NO: 163555 - DNA, 25 bp, Homo sapien
tgagcagcggcttccgagaaaacgg

SEQ ID NO: 163556 - DNA, 25 bp, Homo sapien
gcagcggcttccgagaaaacggctc

SEQ ID NO: 163557 - DNA, 25 bp, Homo sapien
agcggcttccgagaaaacggctcga

SEQ ID NO: 163558 - DNA, 25 bp, Homo sapien
gcggcttccgagaaaacggctcgag

SEQ ID NO: 163559 - DNA, 25 bp, Homo sapien
ggcttccgagaaaacggctcgagca

SEQ ID NO: 163560 - DNA, 25 bp, Homo sapien
gagaaaacggctcgagcagcgacaa

SEQ ID NO: 163561 - DNA, 25 bp, Homo sapien
agaaaacggctcgagcagcgacaac

SEQ ID NO: 163562 - DNA, 25 bp, Homo sapien
gaaaacggctcgagcagcgacaacc

SEQ ID NO: 163563 - DNA, 25 bp, Homo sapien
aaacggctcgagcagcgacaacccg

SEQ ID NO: 163564 - DNA, 25 bp, Homo sapien
gccagcttcttcaacagtctgttga

SEQ ID NO: 163565 - DNA, 25 bp, Homo sapien
gaagaactggatagaatgactcgaa

SEQ ID NO: 163566 - DNA, 25 bp, Homo sapien
gaatgactcgaaagccagactctat

SEQ ID NO: 163567 - DNA, 25 bp, Homo sapien
gactctatggtaacaaactcttcaa

SEQ ID NO: 163568 - DNA, 25 bp, Homo sapien
gaaaatgaagcctgaacctccttaa

SEQ ID NO: 163569 - DNA, 25 bp, Homo sapien
gcctgaacctccttaaaaagtgcat

SEQ ID NO: 163570 - DNA, 25 bp, Homo sapien
aaagtgcatatgtcgaatgaccaaa

SEQ ID NO: 163571 - DNA, 25 bp, Homo sapien
gtcgaatgaccaaataactatgtat

SEQ ID NO: 163572 - DNA, 25 bp, Homo sapien
actatgtatattgatctgctaagac

SEQ ID NO: 163573 - DNA, 25 bp, Homo sapien
ctgctaagaccaggatttttctgat

SEQ ID NO: 163574 - DNA, 25 bp, Homo sapien
atggcacatgctatcagttttttgg

SEQ ID NO: 163575 - DNA, 25 bp, Homo sapien
gtacagtgccgatggagagttcctc

SEQ ID NO: 163576 - DNA, 25 bp, Homo sapien
ggagagttcctcttcaagtttggct

SEQ ID NO: 163577 - DNA, 25 bp, Homo sapien
ttcaagtttggctcccatggcgagg

SEQ ID NO: 163578 - DNA, 25 bp, Homo sapien
gagtagctgtggactccaatggaaa

SEQ ID NO: 163579 - DNA, 25 bp, Homo sapien
gcaacagccgcatccaggtattcga

SEQ ID NO: 163580 - DNA, 25 bp, Homo sapien
aggtattcgacagctctggctcctt

SEQ ID NO: 163581 - DNA, 25 bp, Homo sapien
ttcctgtcctatatcaacacatctg

SEQ ID NO: 163582 - DNA, 25 bp, Homo sapien
atcaacacatctgcagaaccactgt

SEQ ID NO: 163583 - DNA, 25 bp, Homo sapien
actgacctcggatggccatgtggtg

SEQ ID NO: 163584 - DNA, 25 bp, Homo sapien
ctgatgctggcaaccactgctttaa

SEQ ID NO: 163585 - DNA, 25 bp, Homo sapien
ctgctttaaagcctatcgctacctc

SEQ ID NO: 163586 - DNA, 25 bp, Homo sapien
ggaggatgaatctgaggacacagat

SEQ ID NO: 163587 - DNA, 25 bp, Homo sapien
gacgaagaagattacgactcctagc

SEQ ID NO: 163588 - DNA, 25 bp, Homo sapien
agaagattacgactcctagcgcctt

SEQ ID NO: 163589 - DNA, 25 bp, Homo sapien
agattacgactcctagcgccttctg

SEQ ID NO: 163590 - DNA, 25 bp, Homo sapien
ttggtttttcattcccgttgttatg

SEQ ID NO: 163591 - DNA, 25 bp, Homo sapien
ttcattcccgttgttatggagggcc

SEQ ID NO: 163592 - DNA, 25 bp, Homo sapien
attcccgttgttatggagggccaca

SEQ ID NO: 163593 - DNA, 25 bp, Homo sapien
cccgttgttatggagggccacatct

SEQ ID NO: 163594 - DNA, 25 bp, Homo sapien
gttatggagggccacatctgccaga

SEQ ID NO: 163595 - DNA, 25 bp, Homo sapien
tatggagggccacatctgccagagc

SEQ ID NO: 163596 - DNA, 25 bp, Homo sapien
gagggccacatctgccagagcctgg

SEQ ID NO: 163597 - DNA, 25 bp, Homo sapien
gaccttcgaaggctggctactgata

SEQ ID NO: 163598 - DNA, 25 bp, Homo sapien
taaaagcacaacacggaaccagaat

SEQ ID NO: 163599 - DNA, 25 bp, Homo sapien
tttatctcaagaagcttcacccgac

SEQ ID NO: 163600 - DNA, 25 bp, Homo sapien
ttcacccgacagtacaaactaccag

SEQ ID NO: 163601 - DNA, 25 bp, Homo sapien
aaagatttgtctgcagtcctctgtc

SEQ ID NO: 163602 - DNA, 25 bp, Homo sapien
tctgcagtcctctgtcatgatggaa

SEQ ID NO: 163603 - DNA, 25 bp, Homo sapien
gatccagttgggactaagtgacatc

SEQ ID NO: 163604 - DNA, 25 bp, Homo sapien
aagtgacatcgtatcggttcctgtt

SEQ ID NO: 163605 - DNA, 25 bp, Homo sapien
gtatcggttcctgttcagatgacat

SEQ ID NO: 163606 - DNA, 25 bp, Homo sapien
gatggttcagccactggtactacga

SEQ ID NO: 163607 - DNA, 25 bp, Homo sapien
tacgagaatgtttgtattacccaca

SEQ ID NO: 163608 - DNA, 25 bp, Homo sapien
gacgacccttgctctgaccggaaga

SEQ ID NO: 163609 - DNA, 25 bp, Homo sapien
gaccggaagagaagtccctatccca

SEQ ID NO: 163610 - DNA, 25 bp, Homo sapien
aagagaagtccctatcccacacctg

SEQ ID NO: 163611 - DNA, 25 bp, Homo sapien
tttccccagcgcactgttgagggca

SEQ ID NO: 163612 - DNA, 25 bp, Homo sapien
agcctctccagctctcttgtttatg

SEQ ID NO: 163613 - DNA, 25 bp, Homo sapien
ttgtttatgcaaacgccgagcgcct

SEQ ID NO: 163614 - DNA, 25 bp, Homo sapien
aggctcggtaggaggagtcttccac

SEQ ID NO: 163615 - DNA, 25 bp, Homo sapien
gtaggaggagtcttccacggccccg

SEQ ID NO: 163616 - DNA, 25 bp, Homo sapien
ggctgtggccgaaaggtttctgatc

SEQ ID NO: 163617 - DNA, 25 bp, Homo sapien
tggccgaaaggtttctgatctccgt

SEQ ID NO: 163618 - DNA, 25 bp, Homo sapien
ctccgtgtgtgcatgtgactgtgct

SEQ ID NO: 163619 - DNA, 25 bp, Homo sapien
aaaggcaaccttggagccaacctca

SEQ ID NO: 163620 - DNA, 25 bp, Homo sapien
aacctcagtgggttgggccgcaaca

SEQ ID NO: 163621 - DNA, 25 bp, Homo sapien
atgccagcaggcactaagctcattg

SEQ ID NO: 163622 - DNA, 25 bp, Homo sapien
ggcactaagctcattgctggcaata

SEQ ID NO: 163623 - DNA, 25 bp, Homo sapien
caataagcctgttagtttcctcact

SEQ ID NO: 163624 - DNA, 25 bp, Homo sapien
ttagtttcctcactgctcagcagtt

SEQ ID NO: 163625 - DNA, 25 bp, Homo sapien
aaggtcaggccacacaggtgcgcat

SEQ ID NO: 163626 - DNA, 25 bp, Homo sapien
atctccaacagggaacagcttctgg

SEQ ID NO: 163627 - DNA, 25 bp, Homo sapien
aagcagtctccactgttgttgtgac

SEQ ID NO: 163628 - DNA, 25 bp, Homo sapien
ttgtgactacagctccgtctcctaa

SEQ ID NO: 163629 - DNA, 25 bp, Homo sapien
tccgtctcctaaacaggcacctgag

SEQ ID NO: 163630 - DNA, 25 bp, Homo sapien
cctacacctgtgtcagctgcggtgc

SEQ ID NO: 163631 - DNA, 25 bp, Homo sapien
gtcagctgcggtgcccggtactgca

SEQ ID NO: 163632 - DNA, 25 bp, Homo sapien
cggtactgcactgtgcgctgtctgg

SEQ ID NO: 163633 - DNA, 25 bp, Homo sapien
acccaccaggagaccaggtgtctga

SEQ ID NO: 163634 - DNA, 25 bp, Homo sapien
accaggtgtctgaagtggactgtgt

SEQ ID NO: 163635 - DNA, 25 bp, Homo sapien
actgtgtgagcctgggcattcccag

SEQ ID NO: 163636 - DNA, 25 bp, Homo sapien
actgcccggccttcagaaagacaga

SEQ ID NO: 163637 - DNA, 25 bp, Homo sapien
cagaatttcatcacccaatgcaggg

SEQ ID NO: 163638 - DNA, 25 bp, Homo sapien
cattcacccaacaaaactgtgtctt

SEQ ID NO: 163639 - DNA, 25 bp, Homo sapien
aaaactgtgtcttatctgccaggaa

SEQ ID NO: 163640 - DNA, 25 bp, Homo sapien
gaaagaccagcctcactcctgggaa

SEQ ID NO: 163641 - DNA, 25 bp, Homo sapien
ctttgagtgtaagctctgccaccag

SEQ ID NO: 163642 - DNA, 25 bp, Homo sapien
gagtgtaagctctgccaccagcgct

SEQ ID NO: 163643 - DNA, 25 bp, Homo sapien
tactcggccatgatcaagcacctga

SEQ ID NO: 163644 - DNA, 25 bp, Homo sapien
aagcacctgagaacgcacaacggcg

SEQ ID NO: 163645 - DNA, 25 bp, Homo sapien
tgcaccatctgcacagagtactgcc

SEQ ID NO: 163646 - DNA, 25 bp, Homo sapien
atgcagaagcacatgaagggccaca

SEQ ID NO: 163647 - DNA, 25 bp, Homo sapien
gaagcacatgaagggccacaagccc

SEQ ID NO: 163648 - DNA, 25 bp, Homo sapien
gagatcccgcccgactggaggatag

SEQ ID NO: 163649 - DNA, 25 bp, Homo sapien
tcccgcccgactggaggatagagaa

SEQ ID NO: 163650 - DNA, 25 bp, Homo sapien
agagaagacgtacctctacctgtgc

SEQ ID NO: 163651 - DNA, 25 bp, Homo sapien
tacctctacctgtgctatgtgtgaa

SEQ ID NO: 163652 - DNA, 25 bp, Homo sapien
accagtgtgacagcaggacatccta

SEQ ID NO: 163653 - DNA, 25 bp, Homo sapien
ccagtgtgacagcaggacatcctaa

SEQ ID NO: 163654 - DNA, 25 bp, Homo sapien
cagtgtgacagcaggacatcctaat

SEQ ID NO: 163655 - DNA, 25 bp, Homo sapien
ggacatcctaatatatggatcttga

SEQ ID NO: 163656 - DNA, 25 bp, Homo sapien
atggatcttgatttttaagtttcag

SEQ ID NO: 163657 - DNA, 25 bp, Homo sapien
aagtttcagtatctgaacttcgtaa

SEQ ID NO: 163658 - DNA, 25 bp, Homo sapien
ttcagtatctgaacttcgtaaatta

SEQ ID NO: 163659 - DNA, 25 bp, Homo sapien
cagtatctgaacttcgtaaattagt

SEQ ID NO: 163660 - DNA, 25 bp, Homo sapien
tctgaacttcgtaaattagtaactt

SEQ ID NO: 163661 - DNA, 25 bp, Homo sapien
gctgggaaagtatagcatgaaacca

SEQ ID NO: 163662 - DNA, 25 bp, Homo sapien
gaaagtatagcatgaaaccagaggt

SEQ ID NO: 163663 - DNA, 25 bp, Homo sapien
aggaaaactcctgatcaagttccag

SEQ ID NO: 163664 - DNA, 25 bp, Homo sapien
tgatcaagttccagagcccatagaa

SEQ ID NO: 163665 - DNA, 25 bp, Homo sapien
atcctagaggagaaccttcggcgct

SEQ ID NO: 163666 - DNA, 25 bp, Homo sapien
ccttcggcgctctgacaaggagtta

SEQ ID NO: 163667 - DNA, 25 bp, Homo sapien
catatttataagaccctgctctcta

SEQ ID NO: 163668 - DNA, 25 bp, Homo sapien
ctgctctctattccagaggtggtga

SEQ ID NO: 163669 - DNA, 25 bp, Homo sapien
cagggattgctggaatttctgagct

SEQ ID NO: 163670 - DNA, 25 bp, Homo sapien
gaaagccagaatttgtttcacctct

SEQ ID NO: 163671 - DNA, 25 bp, Homo sapien
ttcacctctttttacctgcaatacc

SEQ ID NO: 163672 - DNA, 25 bp, Homo sapien
ttaccccaataccaagaccaactgg

SEQ ID NO: 163673 - DNA, 25 bp, Homo sapien
gaccaactggcatagagccaactga

SEQ ID NO: 163674 - DNA, 25 bp, Homo sapien
cacctgttgctgaagatcaggcggg

SEQ ID NO: 163675 - DNA, 25 bp, Homo sapien
atcaggcgggttgtgtttgcgcata

SEQ ID NO: 163676 - DNA, 25 bp, Homo sapien
tgtgtttgcgcatatgtttcataag

SEQ ID NO: 163677 - DNA, 25 bp, Homo sapien
atgtgtatgcccgactgcagatagt

SEQ ID NO: 163678 - DNA, 25 bp, Homo sapien
gtacaccttggcatgcttcactgtg

SEQ ID NO: 163679 - DNA, 25 bp, Homo sapien
gcatgcttcactgtgtgcgtagaca

SEQ ID NO: 163680 - DNA, 25 bp, Homo sapien
gtgcgtagacaggtgcacctctagt

SEQ ID NO: 163681 - DNA, 25 bp, Homo sapien
aggtgcacctctagtgaggctgcat

SEQ ID NO: 163682 - DNA, 25 bp, Homo sapien
tagtgaggctgcatccgtgtacgcc

SEQ ID NO: 163683 - DNA, 25 bp, Homo sapien
cgtgtacgcccgatgacagttgtgg

SEQ ID NO: 163684 - DNA, 25 bp, Homo sapien
cccgatgacagttgtggcacttgaa

SEQ ID NO: 163685 - DNA, 25 bp, Homo sapien
cctacacctgtgtcagctgcggtgc

SEQ ID NO: 163686 - DNA, 25 bp, Homo sapien
cctgtgtcagctgcggtgcccggta

SEQ ID NO: 163687 - DNA, 25 bp, Homo sapien
gtcagctgcggtgcccggtactgca

SEQ ID NO: 163688 - DNA, 25 bp, Homo sapien
tgcggtgcccggtactgcactgtgc

SEQ ID NO: 163689 - DNA, 25 bp, Homo sapien
tgcccggtactgcactgtgcgctgt

SEQ ID NO: 163690 - DNA, 25 bp, Homo sapien
cggtactgcactgtgcgctgtctgg

SEQ ID NO: 163691 - DNA, 25 bp, Homo sapien
tgagcctgggcattcccagagagga

SEQ ID NO: 163692 - DNA, 25 bp, Homo sapien
gaggaagggccgctgtgcactgccc

SEQ ID NO: 163693 - DNA, 25 bp, Homo sapien
actgcccggccttcagaaagacaga

SEQ ID NO: 163694 - DNA, 25 bp, Homo sapien
cagaaagacagaatttcatcaccca

SEQ ID NO: 163695 - DNA, 25 bp, Homo sapien
cagaatttcatcacccaatgcaggg

SEQ ID NO: 163696 - DNA, 25 bp, Homo sapien
ggattccagggaattcatactgtga

SEQ ID NO: 163697 - DNA, 25 bp, Homo sapien
atttgcattgaaacactggtccagt

SEQ ID NO: 163698 - DNA, 25 bp, Homo sapien
gaaacactggtccagtccattgaag

SEQ ID NO: 163699 - DNA, 25 bp, Homo sapien
agtccattgaagaccctattttggg

SEQ ID NO: 163700 - DNA, 25 bp, Homo sapien
attttgggtgatccctatcttgcag

SEQ ID NO: 163701 - DNA, 25 bp, Homo sapien
gatccctatcttgcagaatgtctgt

SEQ ID NO: 163702 - DNA, 25 bp, Homo sapien
atattcagcatgtaccgcatgtgta

SEQ ID NO: 163703 - DNA, 25 bp, Homo sapien
ccgcatgtgtaagtagtctggccca

SEQ ID NO: 163704 - DNA, 25 bp, Homo sapien
gtgtaagtagtctggcccacatttt

SEQ ID NO: 163705 - DNA, 25 bp, Homo sapien
tggcccacattttcaacctagtaga

SEQ ID NO: 163706 - DNA, 25 bp, Homo sapien
aaattcattttgcagaaagcctgaa

SEQ ID NO: 163707 - DNA, 25 bp, Homo sapien
agacatgaaattgcctcacctgcct

SEQ ID NO: 163708 - DNA, 25 bp, Homo sapien
acctgcctggcttagaagaccttgg

SEQ ID NO: 163709 - DNA, 25 bp, Homo sapien
ggtattcaggcaacaccactggaac

SEQ ID NO: 163710 - DNA, 25 bp, Homo sapien
ccattgaggtgctgcggcgtcatcg

SEQ ID NO: 163711 - DNA, 25 bp, Homo sapien
aagaccgtcaacatttagtgcctcc

SEQ ID NO: 163712 - DNA, 25 bp, Homo sapien
tgagcagctcttggttttggcgtct

SEQ ID NO: 163713 - DNA, 25 bp, Homo sapien
tttggcgtcttttgggtcggcccat

SEQ ID NO: 163714 - DNA, 25 bp, Homo sapien
ggtcggcccatgtggtttgagcacc

SEQ ID NO: 163715 - DNA, 25 bp, Homo sapien
cagccaggcggtctctttagaggat

SEQ ID NO: 163716 - DNA, 25 bp, Homo sapien
gaggatcctgtacacagttccacta

SEQ ID NO: 163717 - DNA, 25 bp, Homo sapien
gtggagcggatgcacatcacagaca

SEQ ID NO: 163718 - DNA, 25 bp, Homo sapien
tgatgatgacctgtatggctaagtg

SEQ ID NO: 163719 - DNA, 25 bp, Homo sapien
gatgatgacctgtatggctaagtgg

SEQ ID NO: 163720 - DNA, 25 bp, Homo sapien
tccattctccagtctgaacagttca

SEQ ID NO: 163721 - DNA, 25 bp, Homo sapien
ccattctccagtctgaacagttcag

SEQ ID NO: 163722 - DNA, 25 bp, Homo sapien
attctccagtctgaacagttcagct

SEQ ID NO: 163723 - DNA, 25 bp, Homo sapien
tccagtctgaacagttcagctacag

SEQ ID NO: 163724 - DNA, 25 bp, Homo sapien
agtctgaacagttcagctacagtct

SEQ ID NO: 163725 - DNA, 25 bp, Homo sapien
cagctacagtctgactctggacagg

SEQ ID NO: 163726 - DNA, 25 bp, Homo sapien
agctacagtctgactctggacaggg

SEQ ID NO: 163727 - DNA, 25 bp, Homo sapien
acagtctgactctggacagggggtt

SEQ ID NO: 163728 - DNA, 25 bp, Homo sapien
gacagggggtttctgttgcaaaaat

SEQ ID NO: 163729 - DNA, 25 bp, Homo sapien
ggtgctcgccgtgttccggagcgga

SEQ ID NO: 163730 - DNA, 25 bp, Homo sapien
ggagcggagaggagcgcgcgcggcg

SEQ ID NO: 163731 - DNA, 25 bp, Homo sapien
gcggcgcgggagtagcgcgctgtgg

SEQ ID NO: 163732 - DNA, 25 bp, Homo sapien
gcggaagcctcgtgctaccctggag

SEQ ID NO: 163733 - DNA, 25 bp, Homo sapien
cggaagcctcgtgctaccctggagg

SEQ ID NO: 163734 - DNA, 25 bp, Homo sapien
gaagcctcgtgctaccctggaggga

SEQ ID NO: 163735 - DNA, 25 bp, Homo sapien
aagcctcgtgctaccctggagggac

SEQ ID NO: 163736 - DNA, 25 bp, Homo sapien
ctcgtgctaccctggagggacgcgt

SEQ ID NO: 163737 - DNA, 25 bp, Homo sapien
gtgctaccctggagggacgcgtgga

SEQ ID NO: 163738 - DNA, 25 bp, Homo sapien
agggacgcgtggacgcggcgcctgc

SEQ ID NO: 163739 - DNA, 25 bp, Homo sapien
gaggctgcagcgacgcgaacggcgg

SEQ ID NO: 163740 - DNA, 25 bp, Homo sapien
gatctcgaagtgttttctacagact

SEQ ID NO: 163741 - DNA, 25 bp, Homo sapien
acagactgaccatactgatattagt

SEQ ID NO: 163742 - DNA, 25 bp, Homo sapien
atttgctgttagttggatgccacta

SEQ ID NO: 163743 - DNA, 25 bp, Homo sapien
ttagttggatgccactacacctttt

SEQ ID NO: 163744 - DNA, 25 bp, Homo sapien
tacaccttttccatgtggtaactga

SEQ ID NO: 163745 - DNA, 25 bp, Homo sapien
caagttggtgtattgcatttgtcat

SEQ ID NO: 163746 - DNA, 25 bp, Homo sapien
gtattgcatttgtcatttgttgggc

SEQ ID NO: 163747 - DNA, 25 bp, Homo sapien
catttgttgggcatgatgtcctgtt

SEQ ID NO: 163748 - DNA, 25 bp, Homo sapien
gatgtcctgttgtcttaatccaatt

SEQ ID NO: 163749 - DNA, 25 bp, Homo sapien
tccaattctatatgggtttcttaat

SEQ ID NO: 163750 - DNA, 25 bp, Homo sapien
aagctgatttagtgtcccttataca

SEQ ID NO: 163751 - DNA, 25 bp, Homo sapien
agaaaggcgatgaccagagccggca

SEQ ID NO: 163752 - DNA, 25 bp, Homo sapien
gcgatgaccagagccggcaaggcgg

SEQ ID NO: 163753 - DNA, 25 bp, Homo sapien
gagtgctaggcaaggctacttcaat

SEQ ID NO: 163754 - DNA, 25 bp, Homo sapien
gctaggcaaggctacttcaatgcac

SEQ ID NO: 163755 - DNA, 25 bp, Homo sapien
ggcaaggctacttcaatgcacagaa

SEQ ID NO: 163756 - DNA, 25 bp, Homo sapien
ggctacttcaatgcacagaaccagc

SEQ ID NO: 163757 - DNA, 25 bp, Homo sapien
acactgtggacgtctttgttcagaa

SEQ ID NO: 163758 - DNA, 25 bp, Homo sapien
actgtggacgtctttgttcagaagg

SEQ ID NO: 163759 - DNA, 25 bp, Homo sapien
agtccctttctgtcccagctcagtt

SEQ ID NO: 163760 - DNA, 25 bp, Homo sapien
agttttccaaaagacactgacatgt

SEQ ID NO: 163761 - DNA, 25 bp, Homo sapien
agacactgacatgtaattcttctct

SEQ ID NO: 163762 - DNA, 25 bp, Homo sapien
atggcttaagcctgtgtataaaaaa

SEQ ID NO: 163763 - DNA, 25 bp, Homo sapien
agaaaacttgtgttcaatctgtgaa

SEQ ID NO: 163764 - DNA, 25 bp, Homo sapien
tcaatctgtgaagcctttatctatg

SEQ ID NO: 163765 - DNA, 25 bp, Homo sapien
tatgaaccgcaatatgggaggaaca

SEQ ID NO: 163766 - DNA, 25 bp, Homo sapien
gctggtgtcagtccctacttaggaa

SEQ ID NO: 163767 - DNA, 25 bp, Homo sapien
cttaggaaatactcagcaactgtta

SEQ ID NO: 163768 - DNA, 25 bp, Homo sapien
gaagaatgtattcggcaccttcccc

SEQ ID NO: 163769 - DNA, 25 bp, Homo sapien
ttcccctgaggacctttctgaggag

SEQ ID NO: 163770 - DNA, 25 bp, Homo sapien
taaaaagactactggcctctgtgcc

SEQ ID NO: 163771 - DNA, 25 bp, Homo sapien
ggcctctgtgccatggatgattctt

SEQ ID NO: 163772 - DNA, 25 bp, Homo sapien
ggatgattcttttcccatcaccaga

SEQ ID NO: 163773 - DNA, 25 bp, Homo sapien
gcaggcactgtcagagccggcggtg

SEQ ID NO: 163774 - DNA, 25 bp, Homo sapien
tcagagccggcggtggtgcagaaga

SEQ ID NO: 163775 - DNA, 25 bp, Homo sapien
aggccctttgcactgaggacacaga

SEQ ID NO: 163776 - DNA, 25 bp, Homo sapien
agctgtgagggccaccggtgggcag

SEQ ID NO: 163777 - DNA, 25 bp, Homo sapien
accggtgggcagtgggtggatcctg

SEQ ID NO: 163778 - DNA, 25 bp, Homo sapien
gtggatcctggtttcgtgtgctgcc

SEQ ID NO: 163779 - DNA, 25 bp, Homo sapien
atcctggtttcgtgtgctgcccatg

SEQ ID NO: 163780 - DNA, 25 bp, Homo sapien
gtttcgtgtgctgcccatgcacctt

SEQ ID NO: 163781 - DNA, 25 bp, Homo sapien
ggccagcttggcagggatccccagg

SEQ ID NO: 163782 - DNA, 25 bp, Homo sapien
ggccccgacgtttgcggcagtgttc

SEQ ID NO: 163783 - DNA, 25 bp, Homo sapien
cgacgtttgcggcagtgttccttgt

SEQ ID NO: 163784 - DNA, 25 bp, Homo sapien
aaaccatctgtgtgcgtttctggcg

SEQ ID NO: 163785 - DNA, 25 bp, Homo sapien
atctgtgtgcgtttctggcgatgca

SEQ ID NO: 163786 - DNA, 25 bp, Homo sapien
gtgtgcgtttctggcgatgcagcaa

SEQ ID NO: 163787 - DNA, 25 bp, Homo sapien
gtttctggcgatgcagcaattccaa

SEQ ID NO: 163788 - DNA, 25 bp, Homo sapien
ttctggcgatgcagcaattccaaga

SEQ ID NO: 163789 - DNA, 25 bp, Homo sapien
cagcaattccaagaaggtgtggtat

SEQ ID NO: 163790 - DNA, 25 bp, Homo sapien
ggctgtgacagcaccagtctgttct

SEQ ID NO: 163791 - DNA, 25 bp, Homo sapien
cacaggccgctcatataccattggc

SEQ ID NO: 163792 - DNA, 25 bp, Homo sapien
agccctgcgtgccaagtgtccagag

SEQ ID NO: 163793 - DNA, 25 bp, Homo sapien
gtgccaagtgtccagagccttggaa

SEQ ID NO: 163794 - DNA, 25 bp, Homo sapien
gtgtccagagccttggaagcagctt

SEQ ID NO: 163795 - DNA, 25 bp, Homo sapien
ggtaccactcagaacctccaactga

SEQ ID NO: 163796 - DNA, 25 bp, Homo sapien
agaacctccaactgactgaatgcca

SEQ ID NO: 163797 - DNA, 25 bp, Homo sapien
tccaactgactgaatgccaggagct

SEQ ID NO: 163798 - DNA, 25 bp, Homo sapien
gactgaatgccaggagctgaacatt

SEQ ID NO: 163799 - DNA, 25 bp, Homo sapien
tgccaggagctgaacattaatatgt

SEQ ID NO: 163800 - DNA, 25 bp, Homo sapien
tgcaaagattggctctccaacaaga

SEQ ID NO: 163801 - DNA, 25 bp, Homo sapien
gattggctctccaacaagaaggaaa

SEQ ID NO: 163802 - DNA, 25 bp, Homo sapien
cctggaggagaagtcatctcatgac

SEQ ID NO: 163803 - DNA, 25 bp, Homo sapien
gtcatctcatgacaacagaagggag

SEQ ID NO: 163804 - DNA, 25 bp, Homo sapien
gcctttcatgggaacggcccacacg

SEQ ID NO: 163805 - DNA, 25 bp, Homo sapien
tgggaacggcccacacgcagtttga

SEQ ID NO: 163806 - DNA, 25 bp, Homo sapien
aaggttcagaacctctgcagggaag

SEQ ID NO: 163807 - DNA, 25 bp, Homo sapien
gaaaaccctcccattaggaagcatg

SEQ ID NO: 163808 - DNA, 25 bp, Homo sapien
ccctcccattaggaagcatgctttt

SEQ ID NO: 163809 - DNA, 25 bp, Homo sapien
gcatgcttttgcagttaaatggcga

SEQ ID NO: 163810 - DNA, 25 bp, Homo sapien
gaggtgatagggacttcaagagtaa

SEQ ID NO: 163811 - DNA, 25 bp, Homo sapien
aagagtaaaatgcaccttgtattgc

SEQ ID NO: 163812 - DNA, 25 bp, Homo sapien
gtaggactgaatcagggccttcaaa

SEQ ID NO: 163813 - DNA, 25 bp, Homo sapien
agggccttcaaagctggactgagtt

SEQ ID NO: 163814 - DNA, 25 bp, Homo sapien
actgagttggtcctgttctggcaca

SEQ ID NO: 163815 - DNA, 25 bp, Homo sapien
gttctggcacatatggtccactgga

SEQ ID NO: 163816 - DNA, 25 bp, Homo sapien
tggtccactggagacaatgtatgat

SEQ ID NO: 163817 - DNA, 25 bp, Homo sapien
gggccgaagccagcagtgtctaaac

SEQ ID NO: 163818 - DNA, 25 bp, Homo sapien
agcagtgtctaaacccccggagcca

SEQ ID NO: 163819 - DNA, 25 bp, Homo sapien
tcctgcagtatttatggcctcgtcc

SEQ ID NO: 163820 - DNA, 25 bp, Homo sapien
tgcagtatttatggcctcgtcctcc

SEQ ID NO: 163821 - DNA, 25 bp, Homo sapien
ccacctaggccacgtgtgagctgct

SEQ ID NO: 163822 - DNA, 25 bp, Homo sapien
acctaggccacgtgtgagctgctcc

SEQ ID NO: 163823 - DNA, 25 bp, Homo sapien
agctgctcctgtctctgtcttattg

SEQ ID NO: 163824 - DNA, 25 bp, Homo sapien
tgctcctgtctctgtcttattgcag

SEQ ID NO: 163825 - DNA, 25 bp, Homo sapien
tgtctctgtcttattgcagctccag

SEQ ID NO: 163826 - DNA, 25 bp, Homo sapien
tgtcttattgcagctccaggcctga

SEQ ID NO: 163827 - DNA, 25 bp, Homo sapien
ttattgcagctccaggcctgacgtt

SEQ ID NO: 163828 - DNA, 25 bp, Homo sapien
tacatctgggctctggccgagacac

SEQ ID NO: 163829 - DNA, 25 bp, Homo sapien
acatctgggctctggccgagacact

SEQ ID NO: 163830 - DNA, 25 bp, Homo sapien
catctgggctctggccgagacactg

SEQ ID NO: 163831 - DNA, 25 bp, Homo sapien
gggctctggccgagacactgcgcct

SEQ ID NO: 163832 - DNA, 25 bp, Homo sapien
gcgcctggcggatcaagggctgccc

SEQ ID NO: 163833 - DNA, 25 bp, Homo sapien
ctggcggatcaagggctgcccggag

SEQ ID NO: 163834 - DNA, 25 bp, Homo sapien
aagggctgcccggaggcggtgcccg

SEQ ID NO: 163835 - DNA, 25 bp, Homo sapien
caagccccgccagcgacgcggagtc

SEQ ID NO: 163836 - DNA, 25 bp, Homo sapien
agccgcctccgaagacttcacctac

SEQ ID NO: 163837 - DNA, 25 bp, Homo sapien
cccaagcctgcccaaagacttgctc

SEQ ID NO: 163838 - DNA, 25 bp, Homo sapien
gcccaaagacttgctccacacaacg

SEQ ID NO: 163839 - DNA, 25 bp, Homo sapien
tttccagaacaggccaatctgaaga

SEQ ID NO: 163840 - DNA, 25 bp, Homo sapien
ggactgaggagcgactgctaatcag

SEQ ID NO: 163841 - DNA, 25 bp, Homo sapien
gggatggtgaaaatgttccggacct

SEQ ID NO: 163842 - DNA, 25 bp, Homo sapien
gatggtgaaaatgttccggacctag

SEQ ID NO: 163843 - DNA, 25 bp, Homo sapien
atggtgaaaatgttccggacctaga

SEQ ID NO: 163844 - DNA, 25 bp, Homo sapien
gaaggtagcacgacactgtgagtgc

SEQ ID NO: 163845 - DNA, 25 bp, Homo sapien
aggtagcacgacactgtgagtgcac

SEQ ID NO: 163846 - DNA, 25 bp, Homo sapien
ggtagcacgacactgtgagtgcact

SEQ ID NO: 163847 - DNA, 25 bp, Homo sapien
gtagcacgacactgtgagtgcacta

SEQ ID NO: 163848 - DNA, 25 bp, Homo sapien
tagcacgacactgtgagtgcactaa

SEQ ID NO: 163849 - DNA, 25 bp, Homo sapien
gcacgacactgtgagtgcactaaat

SEQ ID NO: 163850 - DNA, 25 bp, Homo sapien
ggagccagctatggtgcggatcaat

SEQ ID NO: 163851 - DNA, 25 bp, Homo sapien
tggtgcggatcaatgcgctgacagc

SEQ ID NO: 163852 - DNA, 25 bp, Homo sapien
agcctctgaggctgcgtgcctgatc

SEQ ID NO: 163853 - DNA, 25 bp, Homo sapien
tgcgtgcctgatcgtgtctgtagat

SEQ ID NO: 163854 - DNA, 25 bp, Homo sapien
tgatcgtgtctgtagatgaaaccat

SEQ ID NO: 163855 - DNA, 25 bp, Homo sapien
gactgtggatgctcccacagcagca

SEQ ID NO: 163856 - DNA, 25 bp, Homo sapien
ctggctggctgctgggtgcacttac

SEQ ID NO: 163857 - DNA, 25 bp, Homo sapien
gcacttaccctccttggcttggtta

SEQ ID NO: 163858 - DNA, 25 bp, Homo sapien
cctccttggcttggttacttcattt

SEQ ID NO: 163859 - DNA, 25 bp, Homo sapien
tagtaattggcccactctcttctta

SEQ ID NO: 163860 - DNA, 25 bp, Homo sapien
ctcttcttactggaggctatttaaa

SEQ ID NO: 163861 - DNA, 25 bp, Homo sapien
gaacaagtttgtaacatgcagcaga

SEQ ID NO: 163862 - DNA, 25 bp, Homo sapien
gaaaaccttaatgactcagagagca

SEQ ID NO: 163863 - DNA, 25 bp, Homo sapien
gattaattagatatgcatctggcat

SEQ ID NO: 163864 - DNA, 25 bp, Homo sapien
gcatctggcattgttttatcttatc

SEQ ID NO: 163865 - DNA, 25 bp, Homo sapien
ggcattgttttatcttatcagtatt

SEQ ID NO: 163866 - DNA, 25 bp, Homo sapien
atcagtattatcactcttatgttgg

SEQ ID NO: 163867 - DNA, 25 bp, Homo sapien
tcactcttatgttggtttattctta

SEQ ID NO: 163868 - DNA, 25 bp, Homo sapien
tggtttattcttaagctgtacaatt

SEQ ID NO: 163869 - DNA, 25 bp, Homo sapien
ggtaaacatatgctaaatccgcttc

SEQ ID NO: 163870 - DNA, 25 bp, Homo sapien
atgctaaatccgcttcagtatttta

SEQ ID NO: 163871 - DNA, 25 bp, Homo sapien
tttaaaatgtgagaacttctgcact

SEQ ID NO: 163872 - DNA, 25 bp, Homo sapien
gttcggtgcatctggccaatgagtc

SEQ ID NO: 163873 - DNA, 25 bp, Homo sapien
atctggccaatgagtctgctgagac

SEQ ID NO: 163874 - DNA, 25 bp, Homo sapien
tgctgagactcttgacagcacctcc

SEQ ID NO: 163875 - DNA, 25 bp, Homo sapien
agctctgctgcttcaacaacagtga

SEQ ID NO: 163876 - DNA, 25 bp, Homo sapien
cttcaacaacagtgacttgctctcc

SEQ ID NO: 163877 - DNA, 25 bp, Homo sapien
caatggtatccagtgattcgttgaa

SEQ ID NO: 163878 - DNA, 25 bp, Homo sapien
ggtatccagtgattcgttgaagagg

SEQ ID NO: 163879 - DNA, 25 bp, Homo sapien
tgtagcagaaactgagctccgggtg

SEQ ID NO: 163880 - DNA, 25 bp, Homo sapien
tttttctgtcttaggtggtttcatt

SEQ ID NO: 163881 - DNA, 25 bp, Homo sapien
ggtggtttcattaaatgcagcactt

SEQ ID NO: 163882 - DNA, 25 bp, Homo sapien
ctacacctggaaatttactcttgaa

SEQ ID NO: 163883 - DNA, 25 bp, Homo sapien
gagaccaagggaggcagacttacct

SEQ ID NO: 163884 - DNA, 25 bp, Homo sapien
gggaggcagacttacctccctcaac

SEQ ID NO: 163885 - DNA, 25 bp, Homo sapien
ctcaaccagccatttgtcctgactc

SEQ ID NO: 163886 - DNA, 25 bp, Homo sapien
gtgtataagctgatgctcagctgct

SEQ ID NO: 163887 - DNA, 25 bp, Homo sapien
aagctgatgctcagctgctggagaa

SEQ ID NO: 163888 - DNA, 25 bp, Homo sapien
agagatacgaagaaccgtccctcat

SEQ ID NO: 163889 - DNA, 25 bp, Homo sapien
agatacgaagaaccgtccctcattc

SEQ ID NO: 163890 - DNA, 25 bp, Homo sapien
tatgccactccatctggacatttaa

SEQ ID NO: 163891 - DNA, 25 bp, Homo sapien
cactccatctggacatttaatgaaa

SEQ ID NO: 163892 - DNA, 25 bp, Homo sapien
gaggcttgtttgctttgccctcttt

SEQ ID NO: 163893 - DNA, 25 bp, Homo sapien
cttgtttgctttgccctcttttcct

SEQ ID NO: 163894 - DNA, 25 bp, Homo sapien
taaggtggaccttgttgctaaacaa

SEQ ID NO: 163895 - DNA, 25 bp, Homo sapien
gttgctaaacaatatcccaatagat

SEQ ID NO: 163896 - DNA, 25 bp, Homo sapien
gatttgttgacttgaggtctggttt

SEQ ID NO: 163897 - DNA, 25 bp, Homo sapien
tgttttgtttcccaatagaattaag

SEQ ID NO: 163898 - DNA, 25 bp, Homo sapien
tataaatttttatgggacaaagcct

SEQ ID NO: 163899 - DNA, 25 bp, Homo sapien
tgaatcataatctaaatcatcgtat

SEQ ID NO: 163900 - DNA, 25 bp, Homo sapien
gttttggtgccataatttctccttt

SEQ ID NO: 163901 - DNA, 25 bp, Homo sapien
tggtgccataatttctcctttcact

SEQ ID NO: 163902 - DNA, 25 bp, Homo sapien
tctcctttcactggtgttggactta

SEQ ID NO: 163903 - DNA, 25 bp, Homo sapien
tttcactggtgttggacttaaatca

SEQ ID NO: 163904 - DNA, 25 bp, Homo sapien
gaaatgtatttctgtaccacaattt

SEQ ID NO: 163905 - DNA, 25 bp, Homo sapien
gaccacgccggcctagggttccaga

SEQ ID NO: 163906 - DNA, 25 bp, Homo sapien
gccggcctagggttccagactggtt

SEQ ID NO: 163907 - DNA, 25 bp, Homo sapien
ctagggttccagactggttggactt

SEQ ID NO: 163908 - DNA, 25 bp, Homo sapien
cttgttcgtctggacgacactggag

SEQ ID NO: 163909 - DNA, 25 bp, Homo sapien
ttcgtctggacgacactggagtgga

SEQ ID NO: 163910 - DNA, 25 bp, Homo sapien
ctcccactttcttgggacttggagg

SEQ ID NO: 163911 - DNA, 25 bp, Homo sapien
ccactttcttgggacttggagggag

SEQ ID NO: 163912 - DNA, 25 bp, Homo sapien
ttctcccgtctctagggctgcatgg

SEQ ID NO: 163913 - DNA, 25 bp, Homo sapien
cccagagacttggttttggctccag

SEQ ID NO: 163914 - DNA, 25 bp, Homo sapien
agagacttggttttggctccagcct

SEQ ID NO: 163915 - DNA, 25 bp, Homo sapien
agacttggttttggctccagccttc

SEQ ID NO: 163916 - DNA, 25 bp, Homo sapien
tggcctctcatagttttctctctct

SEQ ID NO: 163917 - DNA, 25 bp, Homo sapien
ggcctctcatagttttctctctctt

SEQ ID NO: 163918 - DNA, 25 bp, Homo sapien
gcctctcatagttttctctctcttt

SEQ ID NO: 163919 - DNA, 25 bp, Homo sapien
cctctcatagttttctctctcttta

SEQ ID NO: 163920 - DNA, 25 bp, Homo sapien
ctctcatagttttctctctctttaa

SEQ ID NO: 163921 - DNA, 25 bp, Homo sapien
gttttctctctctttaaagagaata

SEQ ID NO: 163922 - DNA, 25 bp, Homo sapien
ttttctctctctttaaagagaataa

SEQ ID NO: 163923 - DNA, 25 bp, Homo sapien
tttctctctctttaaagagaataaa

SEQ ID NO: 163924 - DNA, 25 bp, Homo sapien
aagagaataaatagagggccaggtg

SEQ ID NO: 163925 - DNA, 25 bp, Homo sapien
agagaataaatagagggccaggtgt

SEQ ID NO: 163926 - DNA, 25 bp, Homo sapien
gagaataaatagagggccaggtgtg

SEQ ID NO: 163927 - DNA, 25 bp, Homo sapien
aacagttacggcttatttactgaat

SEQ ID NO: 163928 - DNA, 25 bp, Homo sapien
acaaactcaagttatgtcatacctt

SEQ ID NO: 163929 - DNA, 25 bp, Homo sapien
gtcatacctttggatacgaagacca

SEQ ID NO: 163930 - DNA, 25 bp, Homo sapien
ggatacgaagaccatacataataac

SEQ ID NO: 163931 - DNA, 25 bp, Homo sapien
gaagaccatacataataaccaaaca

SEQ ID NO: 163932 - DNA, 25 bp, Homo sapien
aatactttcattatttgtggaattt

SEQ ID NO: 163933 - DNA, 25 bp, Homo sapien
tggaatttagtgcatttcaaaaagt

SEQ ID NO: 163934 - DNA, 25 bp, Homo sapien
tcatatatcaaactaggcaccacac

SEQ ID NO: 163935 - DNA, 25 bp, Homo sapien
ggcaccacactaagttcctgattat

SEQ ID NO: 163936 - DNA, 25 bp, Homo sapien
cacactaagttcctgattattttgt

SEQ ID NO: 163937 - DNA, 25 bp, Homo sapien
atcttatgagccctatatattcaaa

SEQ ID NO: 163938 - DNA, 25 bp, Homo sapien
actgtttgcagctttgatgagcttc

SEQ ID NO: 163939 - DNA, 25 bp, Homo sapien
aggccaattattccagaagtctgtg

SEQ ID NO: 163940 - DNA, 25 bp, Homo sapien
ttccagaagtctgtggatgccgctc

SEQ ID NO: 163941 - DNA, 25 bp, Homo sapien
agaagtctgtggatgccgctcccac

SEQ ID NO: 163942 - DNA, 25 bp, Homo sapien
atgccgctcccacacagcaagagga

SEQ ID NO: 163943 - DNA, 25 bp, Homo sapien
cagcaagaggactcatggacgtctc

SEQ ID NO: 163944 - DNA, 25 bp, Homo sapien
ggactcatggacgtctctagaacat

SEQ ID NO: 163945 - DNA, 25 bp, Homo sapien
ggacgtctctagaacatatcttgtg

SEQ ID NO: 163946 - DNA, 25 bp, Homo sapien
agaacatatcttgtggccatttacc

SEQ ID NO: 163947 - DNA, 25 bp, Homo sapien
cttgtggccatttaccagactccga

SEQ ID NO: 163948 - DNA, 25 bp, Homo sapien
agactccgacacaatgggccaccac

SEQ ID NO: 163949 - DNA, 25 bp, Homo sapien
gtcaaatgaatggagcccctataca

SEQ ID NO: 163950 - DNA, 25 bp, Homo sapien
gaatggagcccctatacaaagattt

SEQ ID NO: 163951 - DNA, 25 bp, Homo sapien
atggagcccctatacaaagattttc

SEQ ID NO: 163952 - DNA, 25 bp, Homo sapien
ggagcccctatacaaagattttcca

SEQ ID NO: 163953 - DNA, 25 bp, Homo sapien
ggtacacttgtgaataaagagggtg

SEQ ID NO: 163954 - DNA, 25 bp, Homo sapien
gatgttgctaacagcaacacaaagc

SEQ ID NO: 163955 - DNA, 25 bp, Homo sapien
ttgcatattgcatactattaaacat

SEQ ID NO: 163956 - DNA, 25 bp, Homo sapien
aaacatgctgtacatactttttggg

SEQ ID NO: 163957 - DNA, 25 bp, Homo sapien
catgctgtacatactttttgggttt

SEQ ID NO: 163958 - DNA, 25 bp, Homo sapien
gctgtacatactttttgggtttatt

SEQ ID NO: 163959 - DNA, 25 bp, Homo sapien
tgtgtacttttaagactttggttat

SEQ ID NO: 163960 - DNA, 25 bp, Homo sapien
ccgccagttccacagatcaaagaca

SEQ ID NO: 163961 - DNA, 25 bp, Homo sapien
aaccatgaggtggaagacgagatca

SEQ ID NO: 163962 - DNA, 25 bp, Homo sapien
gatcatctgggaggaattcacccca

SEQ ID NO: 163963 - DNA, 25 bp, Homo sapien
tgggaggaattcaccccagaggaag

SEQ ID NO: 163964 - DNA, 25 bp, Homo sapien
aaggctaccgcgaagaggtcttgac

SEQ ID NO: 163965 - DNA, 25 bp, Homo sapien
gtcttgaccgtgaaggaaattacct

SEQ ID NO: 163966 - DNA, 25 bp, Homo sapien
aaattacctgagacccagagggtgt

SEQ ID NO: 163967 - DNA, 25 bp, Homo sapien
ggaactgttttcttgatgatgctgt

SEQ ID NO: 163968 - DNA, 25 bp, Homo sapien
tgctgtgaacctttatatcattttc

SEQ ID NO: 163969 - DNA, 25 bp, Homo sapien
ggttccttaggatacagcggctgtt

SEQ ID NO: 163970 - DNA, 25 bp, Homo sapien
gatacagcggctgttcccgccagtt

SEQ ID NO: 163971 - DNA, 25 bp, Homo sapien
agctgcaaaactgcaccgagccggg

SEQ ID NO: 163972 - DNA, 25 bp, Homo sapien
gagtctgtgaagatggcccagtctt

SEQ ID NO: 163973 - DNA, 25 bp, Homo sapien
tgaagatggcccagtcttctatccc

SEQ ID NO: 163974 - DNA, 25 bp, Homo sapien
agaccaagcattgatgcccaagttt

SEQ ID NO: 163975 - DNA, 25 bp, Homo sapien
gattttaaagatgcccttgccagag

SEQ ID NO: 163976 - DNA, 25 bp, Homo sapien
gatgcccttgccagagtatatggag

SEQ ID NO: 163977 - DNA, 25 bp, Homo sapien
gtgatacccaaaatccagtgccttc

SEQ ID NO: 163978 - DNA, 25 bp, Homo sapien
agtgccttccaccaagccaggatga

SEQ ID NO: 163979 - DNA, 25 bp, Homo sapien
gccaggatgaggaagtacagacaat

SEQ ID NO: 163980 - DNA, 25 bp, Homo sapien
atagaactgtgcctcactaagcaag

SEQ ID NO: 163981 - DNA, 25 bp, Homo sapien
cactaagcaagaccagcagctgcaa

SEQ ID NO: 163982 - DNA, 25 bp, Homo sapien
aagcaacgtgaccaagactatgaag

SEQ ID NO: 163983 - DNA, 25 bp, Homo sapien
gcactggcagctacagagaaggcca

SEQ ID NO: 163984 - DNA, 25 bp, Homo sapien
gcagctacagagaaggccaaggacc

SEQ ID NO: 163985 - DNA, 25 bp, Homo sapien
agaaggccaaggacctcgccagcaa

SEQ ID NO: 163986 - DNA, 25 bp, Homo sapien
aaggccaaggacctcgccagcaagg

SEQ ID NO: 163987 - DNA, 25 bp, Homo sapien
aaggacctcgccagcaaggcggcca

SEQ ID NO: 163988 - DNA, 25 bp, Homo sapien
agcaaggcggccaccaagaagcagc

SEQ ID NO: 163989 - DNA, 25 bp, Homo sapien
caaggcggccaccaagaagcagcag

SEQ ID NO: 163990 - DNA, 25 bp, Homo sapien
cagcaccccagacagctaggcttag

SEQ ID NO: 163991 - DNA, 25 bp, Homo sapien
agcaccccagacagctaggcttagc

SEQ ID NO: 163992 - DNA, 25 bp, Homo sapien
agacagctaggcttagcccctctgc

SEQ ID NO: 163993 - DNA, 25 bp, Homo sapien
gagtttgaagagttccctgccgaag

SEQ ID NO: 163994 - DNA, 25 bp, Homo sapien
agtttgaagagttccctgccgaaga

SEQ ID NO: 163995 - DNA, 25 bp, Homo sapien
gtttgaagagttccctgccgaagac

SEQ ID NO: 163996 - DNA, 25 bp, Homo sapien
tttgaagagttccctgccgaagact

SEQ ID NO: 163997 - DNA, 25 bp, Homo sapien
ttgaagagttccctgccgaagactg

SEQ ID NO: 163998 - DNA, 25 bp, Homo sapien
tgaagagttccctgccgaagactgg

SEQ ID NO: 163999 - DNA, 25 bp, Homo sapien
gaagagttccctgccgaagactggg

SEQ ID NO: 164000 - DNA, 25 bp, Homo sapien
aagagttccctgccgaagactgggc

SEQ ID NO: 164001 - DNA, 25 bp, Homo sapien
gagttccctgccgaagactgggctg

SEQ ID NO: 164002 - DNA, 25 bp, Homo sapien
agttccctgccgaagactgggctgg

SEQ ID NO: 164003 - DNA, 25 bp, Homo sapien
gttccctgccgaagactgggctggc

SEQ ID NO: 164004 - DNA, 25 bp, Homo sapien
gaaattcaacttaagaaaccattat

SEQ ID NO: 164005 - DNA, 25 bp, Homo sapien
cattatttacttggatgatggtgaa

SEQ ID NO: 164006 - DNA, 25 bp, Homo sapien
gatgatggtgaatagtacagtcgta

SEQ ID NO: 164007 - DNA, 25 bp, Homo sapien
gatggtgaatagtacagtcgtaagt

SEQ ID NO: 164008 - DNA, 25 bp, Homo sapien
actgtctggaggtgcctccattatc

SEQ ID NO: 164009 - DNA, 25 bp, Homo sapien
tggaggtgcctccattatcctcatg

SEQ ID NO: 164010 - DNA, 25 bp, Homo sapien
ggaggtgcctccattatcctcatgc

SEQ ID NO: 164011 - DNA, 25 bp, Homo sapien
ggtgcctccattatcctcatgcctt

SEQ ID NO: 164012 - DNA, 25 bp, Homo sapien
ggaactgagctaggcggtgaggtta

SEQ ID NO: 164013 - DNA, 25 bp, Homo sapien
gtgaggttagcctgccagttagaga

SEQ ID NO: 164014 - DNA, 25 bp, Homo sapien
tgaggttagcctgccagttagagac

SEQ ID NO: 164015 - DNA, 25 bp, Homo sapien
ttcctcttagcctctggatctagaa

SEQ ID NO: 164016 - DNA, 25 bp, Homo sapien
gcctctggatctagaagggaccata

SEQ ID NO: 164017 - DNA, 25 bp, Homo sapien
ataagaggagtaggccctggttcct

SEQ ID NO: 164018 - DNA, 25 bp, Homo sapien
ggagtaggccctggttcctgctgtc

SEQ ID NO: 164019 - DNA, 25 bp, Homo sapien
cactcttgaagtccaggactgggtc

SEQ ID NO: 164020 - DNA, 25 bp, Homo sapien
ttgaagtccaggactgggtctgacc

SEQ ID NO: 164021 - DNA, 25 bp, Homo sapien
tgacctggtgggagcacctgccaga

SEQ ID NO: 164022 - DNA, 25 bp, Homo sapien
agcacctgccagaggatgctctttc

SEQ ID NO: 164023 - DNA, 25 bp, Homo sapien
tgccagaggatgctctttcccagga

SEQ ID NO: 164024 - DNA, 25 bp, Homo sapien
tttcccaggacggatgggccctgtg

SEQ ID NO: 164025 - DNA, 25 bp, Homo sapien
gacggatgggccctgtgtctcagga

SEQ ID NO: 164026 - DNA, 25 bp, Homo sapien
gtcattcaagttttcatctgcttta

SEQ ID NO: 164027 - DNA, 25 bp, Homo sapien
tctgctttataattgatacaccttg

SEQ ID NO: 164028 - DNA, 25 bp, Homo sapien
gatacaccttgagggtcacttttct

SEQ ID NO: 164029 - DNA, 25 bp, Homo sapien
tgagggtcacttttctaatactttt

SEQ ID NO: 164030 - DNA, 25 bp, Homo sapien
aactgtgtacaaaaggattgcttgt

SEQ ID NO: 164031 - DNA, 25 bp, Homo sapien
atagttctgttaataacccactgtt

SEQ ID NO: 164032 - DNA, 25 bp, Homo sapien
acccactgttttacatttggtacat

SEQ ID NO: 164033 - DNA, 25 bp, Homo sapien
acatttggtacatctgtgtctgcta

SEQ ID NO: 164034 - DNA, 25 bp, Homo sapien
gtacatctgtgtctgctaatacagt

SEQ ID NO: 164035 - DNA, 25 bp, Homo sapien
acagttagctttctcacttttctgc

SEQ ID NO: 164036 - DNA, 25 bp, Homo sapien
tttctgcttgtttgttcagtctgaa

SEQ ID NO: 164037 - DNA, 25 bp, Homo sapien
atctctcctgcttggcgacttcagt

SEQ ID NO: 164038 - DNA, 25 bp, Homo sapien
tcctgcttggcgacttcagtaagct

SEQ ID NO: 164039 - DNA, 25 bp, Homo sapien
tgcttggcgacttcagtaagctaca

SEQ ID NO: 164040 - DNA, 25 bp, Homo sapien
ttggcgacttcagtaagctacagct

SEQ ID NO: 164041 - DNA, 25 bp, Homo sapien
ggcgacttcagtaagctacagctaa

SEQ ID NO: 164042 - DNA, 25 bp, Homo sapien
gtaagctacagctaagcccatcggc

SEQ ID NO: 164043 - DNA, 25 bp, Homo sapien
aagctacagctaagcccatcggccg

SEQ ID NO: 164044 - DNA, 25 bp, Homo sapien
tacagctaagcccatcggccggaaa

SEQ ID NO: 164045 - DNA, 25 bp, Homo sapien
agctaagcccatcggccggaaaaga

SEQ ID NO: 164046 - DNA, 25 bp, Homo sapien
gcccatcggccggaaaagaaagaca

SEQ ID NO: 164047 - DNA, 25 bp, Homo sapien
catcggccggaaaagaaagacaata

SEQ ID NO: 164048 - DNA, 25 bp, Homo sapien
atgcctagccagcaagcatcatttc

SEQ ID NO: 164049 - DNA, 25 bp, Homo sapien
gcatcatttctattataccttggtg

SEQ ID NO: 164050 - DNA, 25 bp, Homo sapien
tattataccttggtgtttgcctctt

SEQ ID NO: 164051 - DNA, 25 bp, Homo sapien
tctttctaagtttggactagcttcc

SEQ ID NO: 164052 - DNA, 25 bp, Homo sapien
gcttccaacatcttatcccttgaat

SEQ ID NO: 164053 - DNA, 25 bp, Homo sapien
cagaagatcctttcatgtgaagttt

SEQ ID NO: 164054 - DNA, 25 bp, Homo sapien
gctggcatttcaacctttgggacat

SEQ ID NO: 164055 - DNA, 25 bp, Homo sapien
tgggacatcttcagcccttttatta

SEQ ID NO: 164056 - DNA, 25 bp, Homo sapien
gtggcagtttgcgtttactacctcc

SEQ ID NO: 164057 - DNA, 25 bp, Homo sapien
tctggctgcctatctgaagttcctg

SEQ ID NO: 164058 - DNA, 25 bp, Homo sapien
gaagttcctgcatcagggtctacat

SEQ ID NO: 164059 - DNA, 25 bp, Homo sapien
ctggccttctcctacttagggaaga

SEQ ID NO: 164060 - DNA, 25 bp, Homo sapien
aaaagcaagtgttcactgctccttg

SEQ ID NO: 164061 - DNA, 25 bp, Homo sapien
gttcactgctccttgctgcattgat

SEQ ID NO: 164062 - DNA, 25 bp, Homo sapien
ttgctgcattgatccaggagataat

SEQ ID NO: 164063 - DNA, 25 bp, Homo sapien
ggagataattgtttcattcatcctg

SEQ ID NO: 164064 - DNA, 25 bp, Homo sapien
gtttcattcatcctgaccaagactg

SEQ ID NO: 164065 - DNA, 25 bp, Homo sapien
agactgagccagcttagcaactgct

SEQ ID NO: 164066 - DNA, 25 bp, Homo sapien
gaaccttgtcccagccagtgaggat

SEQ ID NO: 164067 - DNA, 25 bp, Homo sapien
gatgacagtgacacccagagggagt

SEQ ID NO: 164068 - DNA, 25 bp, Homo sapien
aatacgcagaactaccaggtggcaa

SEQ ID NO: 164069 - DNA, 25 bp, Homo sapien
gcaaagtacttgtcatagactcctt

SEQ ID NO: 164070 - DNA, 25 bp, Homo sapien
tacgccccttttggtacacctagag

SEQ ID NO: 164071 - DNA, 25 bp, Homo sapien
gtacacctagaggttgatttccttt

SEQ ID NO: 164072 - DNA, 25 bp, Homo sapien
gatttcctttttcatcgatggtact

SEQ ID NO: 164073 - DNA, 25 bp, Homo sapien
ggaacatatcttgcctcatgaagct

SEQ ID NO: 164074 - DNA, 25 bp, Homo sapien
tcagtttctccccatgaagcgctct

SEQ ID NO: 164075 - DNA, 25 bp, Homo sapien
aagcgctctcgtctgacatttgttt

SEQ ID NO: 164076 - DNA, 25 bp, Homo sapien
tttgtttggaatcgtgccactgctg

SEQ ID NO: 164077 - DNA, 25 bp, Homo sapien
cactgctggtctgcgccagatgtac

SEQ ID NO: 164078 - DNA, 25 bp, Homo sapien
agatgtaccgtcctttccaatacga

SEQ ID NO: 164079 - DNA, 25 bp, Homo sapien
ccaatacgattttctgttgcacctt

SEQ ID NO: 164080 - DNA, 25 bp, Homo sapien
tgttgcaccttgtagtggattctgc

SEQ ID NO: 164081 - DNA, 25 bp, Homo sapien
ccccagttcctatgacacagttatc

SEQ ID NO: 164082 - DNA, 25 bp, Homo sapien
aaagtattatcattgctcccctgat

SEQ ID NO: 164083 - DNA, 25 bp, Homo sapien
attgctcccctgatagaagattgtt

SEQ ID NO: 164084 - DNA, 25 bp, Homo sapien
caaggccttcagtttatttccacta

SEQ ID NO: 164085 - DNA, 25 bp, Homo sapien
gggtctgagtctatgttcaaagact

SEQ ID NO: 164086 - DNA, 25 bp, Homo sapien
aaagactgtgaacagcttgctgtca

SEQ ID NO: 164087 - DNA, 25 bp, Homo sapien
gcttgctgtcacttcttcacctctt

SEQ ID NO: 164088 - DNA, 25 bp, Homo sapien
tccttctctcactgtgttactgctt

SEQ ID NO: 164089 - DNA, 25 bp, Homo sapien
tgttactgctttgcaaagacccggg

SEQ ID NO: 164090 - DNA, 25 bp, Homo sapien
ggagtagctagtttgctttttgcgt

SEQ ID NO: 164091 - DNA, 25 bp, Homo sapien
tagtttgctttttgcgtacacagaa

SEQ ID NO: 164092 - DNA, 25 bp, Homo sapien
gaagacataggctaaatttctccag

SEQ ID NO: 164093 - DNA, 25 bp, Homo sapien
atttctccagcctcacaatggtctt

SEQ ID NO: 164094 - DNA, 25 bp, Homo sapien
caatggtcttcacttggtctgactt

SEQ ID NO: 164095 - DNA, 25 bp, Homo sapien
ggtctgacttgtaccaattctagca

SEQ ID NO: 164096 - DNA, 25 bp, Homo sapien
accaattctagcacccactgaaaaa

SEQ ID NO: 164097 - DNA, 25 bp, Homo sapien
agtgcagaaatgtggcttttgcccc

SEQ ID NO: 164098 - DNA, 25 bp, Homo sapien
ttttgccccactttgcatctccaaa

SEQ ID NO: 164099 - DNA, 25 bp, Homo sapien
tgcatctccaaaattacaacggttg

SEQ ID NO: 164100 - DNA, 25 bp, Homo sapien
ttagttataagtctccgagttggaa

SEQ ID NO: 164101 - DNA, 25 bp, Homo sapien
aaagccagagctgtctagtttcatt

SEQ ID NO: 164102 - DNA, 25 bp, Homo sapien
cagagctgtctagtttcattcattc

SEQ ID NO: 164103 - DNA, 25 bp, Homo sapien
tctgactcttgcaactgaaactgtt

SEQ ID NO: 164104 - DNA, 25 bp, Homo sapien
cttgcaactgaaactgttcggagca

SEQ ID NO: 164105 - DNA, 25 bp, Homo sapien
gaaactgttcggagcattctgaaaa

SEQ ID NO: 164106 - DNA, 25 bp, Homo sapien
gtggtaaacactcgataatctggat

SEQ ID NO: 164107 - DNA, 25 bp, Homo sapien
gataatctggataactgactagcac

SEQ ID NO: 164108 - DNA, 25 bp, Homo sapien
tctggataactgactagcaccatta

SEQ ID NO: 164109 - DNA, 25 bp, Homo sapien
gactagcaccattatgatcaccagt

SEQ ID NO: 164110 - DNA, 25 bp, Homo sapien
gcaccattatgatcaccagtattgt

SEQ ID NO: 164111 - DNA, 25 bp, Homo sapien
ggctggaatggaagaagatcacctt

SEQ ID NO: 164112 - DNA, 25 bp, Homo sapien
tgggcttggtcttccagttggcatt

SEQ ID NO: 164113 - DNA, 25 bp, Homo sapien
ccagttggcatttgcctgaagttgt

SEQ ID NO: 164114 - DNA, 25 bp, Homo sapien
ctagccctgggccaggaccggatac

SEQ ID NO: 164115 - DNA, 25 bp, Homo sapien
tagccctgggccaggaccggatact

SEQ ID NO: 164116 - DNA, 25 bp, Homo sapien
agccctgggccaggaccggatactt

SEQ ID NO: 164117 - DNA, 25 bp, Homo sapien
gccctgggccaggaccggatactta

SEQ ID NO: 164118 - DNA, 25 bp, Homo sapien
ccctgggccaggaccggatacttat

SEQ ID NO: 164119 - DNA, 25 bp, Homo sapien
cctgggccaggaccggatacttatc

SEQ ID NO: 164120 - DNA, 25 bp, Homo sapien
ctgggccaggaccggatacttatcc

SEQ ID NO: 164121 - DNA, 25 bp, Homo sapien
tgggccaggaccggatacttatccg

SEQ ID NO: 164122 - DNA, 25 bp, Homo sapien
gtacagtattttgtcctagcagcat

SEQ ID NO: 164123 - DNA, 25 bp, Homo sapien
aagacctagctcttttcttacaaga

SEQ ID NO: 164124 - DNA, 25 bp, Homo sapien
acaagacaggctagttcataaacaa

SEQ ID NO: 164125 - DNA, 25 bp, Homo sapien
gaatctatttcataactcggacaat

SEQ ID NO: 164126 - DNA, 25 bp, Homo sapien
ctcggacaatttctgggtggtgact

SEQ ID NO: 164127 - DNA, 25 bp, Homo sapien
tggtgactgagtacccctttagtga

SEQ ID NO: 164128 - DNA, 25 bp, Homo sapien
agtgagtacccctttagtgctatat

SEQ ID NO: 164129 - DNA, 25 bp, Homo sapien
agtgctatatttgtgccattcatta

SEQ ID NO: 164130 - DNA, 25 bp, Homo sapien
gtgccattcattatctggttcatat

SEQ ID NO: 164131 - DNA, 25 bp, Homo sapien
ctggttcatatttcttttctgttag

SEQ ID NO: 164132 - DNA, 25 bp, Homo sapien
aaatttctaatgtcacttttgtact

SEQ ID NO: 164133 - DNA, 25 bp, Homo sapien
aagagatcctcagtcaattgcccat

SEQ ID NO: 164134 - DNA, 25 bp, Homo sapien
caagggcttctggaatttgtcgata

SEQ ID NO: 164135 - DNA, 25 bp, Homo sapien
atttgtcgatatcacagccaccaac

SEQ ID NO: 164136 - DNA, 25 bp, Homo sapien
agccaccaaccacactaacgagatt

SEQ ID NO: 164137 - DNA, 25 bp, Homo sapien
attatttgcaacagctcacgggagc

SEQ ID NO: 164138 - DNA, 25 bp, Homo sapien
ggagcaagaacggtgcctcgagtct

SEQ ID NO: 164139 - DNA, 25 bp, Homo sapien
cagtgatctagtctctttgcaacag

SEQ ID NO: 164140 - DNA, 25 bp, Homo sapien
tgtgaactgcaaaatccagcctggg

SEQ ID NO: 164141 - DNA, 25 bp, Homo sapien
gctgacgcggctaaagcagattgga

SEQ ID NO: 164142 - DNA, 25 bp, Homo sapien
aaggtggttgtgttcatcaagccca

SEQ ID NO: 164143 - DNA, 25 bp, Homo sapien
cgtactgcaggagggcccaagagat

SEQ ID NO: 164144 - DNA, 25 bp, Homo sapien
gtctggcttgagaacgacctttctt

SEQ ID NO: 164145 - DNA, 25 bp, Homo sapien
ctggcttgagaacgacctttctttc

SEQ ID NO: 164146 - DNA, 25 bp, Homo sapien
ggcttgagaacgacctttctttctt

SEQ ID NO: 164147 - DNA, 25 bp, Homo sapien
gggtccaggaagaatttgtaccatt

SEQ ID NO: 164148 - DNA, 25 bp, Homo sapien
gtccaggaagaatttgtaccattta

SEQ ID NO: 164149 - DNA, 25 bp, Homo sapien
ggaagaatttgtaccatttaatggg

SEQ ID NO: 164150 - DNA, 25 bp, Homo sapien
accatttaatgggttgggagtcttg

SEQ ID NO: 164151 - DNA, 25 bp, Homo sapien
gaatcacacccttggaatagaaatt

SEQ ID NO: 164152 - DNA, 25 bp, Homo sapien
caacctttctctcagacagcttatc

SEQ ID NO: 164153 - DNA, 25 bp, Homo sapien
ctttctctcagacagcttatccttt

SEQ ID NO: 164154 - DNA, 25 bp, Homo sapien
ttctctcagacagcttatccttttt

SEQ ID NO: 164155 - DNA, 25 bp, Homo sapien
gaagaagaaggctgggtctcagtcc

SEQ ID NO: 164156 - DNA, 25 bp, Homo sapien
gtctcagtcctagtgggagaacccc

SEQ ID NO: 164157 - DNA, 25 bp, Homo sapien
ctagtccacctgaaagcaccaaatt

SEQ ID NO: 164158 - DNA, 25 bp, Homo sapien
gcaccaaattcaaccatcatctgtc

SEQ ID NO: 164159 - DNA, 25 bp, Homo sapien
gaacaacaccctagagagaagtcat

SEQ ID NO: 164160 - DNA, 25 bp, Homo sapien
gagagaagtcatccacacacaatcc

SEQ ID NO: 164161 - DNA, 25 bp, Homo sapien
acacaatccacacacgcatagcaaa

SEQ ID NO: 164162 - DNA, 25 bp, Homo sapien
agcaaacctccaatgcatgtacaga

SEQ ID NO: 164163 - DNA, 25 bp, Homo sapien
gaaacctgtgatatttatacccttg

SEQ ID NO: 164164 - DNA, 25 bp, Homo sapien
agcttaatctctatgtttctctcca

SEQ ID NO: 164165 - DNA, 25 bp, Homo sapien
tcctcctgcaactattttccttgat

SEQ ID NO: 164166 - DNA, 25 bp, Homo sapien
gaagaggtgagtgatccagctttct

SEQ ID NO: 164167 - DNA, 25 bp, Homo sapien
ttctccttttggattgaggctatgt

SEQ ID NO: 164168 - DNA, 25 bp, Homo sapien
ttggattgaggctatgtacttggtg

SEQ ID NO: 164169 - DNA, 25 bp, Homo sapien
atactattcagttgggataatggga

SEQ ID NO: 164170 - DNA, 25 bp, Homo sapien
aacagagtatatagggtatctaccc

SEQ ID NO: 164171 - DNA, 25 bp, Homo sapien
gggtatctacccagcctagaaagca

SEQ ID NO: 164172 - DNA, 25 bp, Homo sapien
aaagcacaggaacaatacgtcatat

SEQ ID NO: 164173 - DNA, 25 bp, Homo sapien
atacgtcatatatttggaacagtta

SEQ ID NO: 164174 - DNA, 25 bp, Homo sapien
ggaacagttattgtctgtgccatga

SEQ ID NO: 164175 - DNA, 25 bp, Homo sapien
tattgtctgtgccatgaccttcatg

SEQ ID NO: 164176 - DNA, 25 bp, Homo sapien
atgaccttcatgataccagtgagaa

SEQ ID NO: 164177 - DNA, 25 bp, Homo sapien
actggtgcagaaaattttcctctag

SEQ ID NO: 164178 - DNA, 25 bp, Homo sapien
gcagaaaattttcctctagatcaga

SEQ ID NO: 164179 - DNA, 25 bp, Homo sapien
gaatcttcagaatcagttaggttcc

SEQ ID NO: 164180 - DNA, 25 bp, Homo sapien
gaatcagttaggttcctcactgcaa

SEQ ID NO: 164181 - DNA, 25 bp, Homo sapien
gttaggttcctcactgcaagaaata

SEQ ID NO: 164182 - DNA, 25 bp, Homo sapien
gtacagtacactctgaaaagaaatc

SEQ ID NO: 164183 - DNA, 25 bp, Homo sapien
gcacaggcatggttacttaatattt

SEQ ID NO: 164184 - DNA, 25 bp, Homo sapien
gaaaagtcatccctatttccttgtt

SEQ ID NO: 164185 - DNA, 25 bp, Homo sapien
gtcatccctatttccttgttttact

SEQ ID NO: 164186 - DNA, 25 bp, Homo sapien
actgcacttaatattatttggttga

SEQ ID NO: 164187 - DNA, 25 bp, Homo sapien
atttgttcagtataagctcgttctt

SEQ ID NO: 164188 - DNA, 25 bp, Homo sapien
acttcttgtctaaaataaggcatgg

SEQ ID NO: 164189 - DNA, 25 bp, Homo sapien
aaggcatggtggaagatttgaagat

SEQ ID NO: 164190 - DNA, 25 bp, Homo sapien
tatgatagtatcagctgcaagtttc

SEQ ID NO: 164191 - DNA, 25 bp, Homo sapien
tatcagctgcaagtttcaagccatt

SEQ ID NO: 164192 - DNA, 25 bp, Homo sapien
cttttacttgaatttcttacattga

SEQ ID NO: 164193 - DNA, 25 bp, Homo sapien
gaaatatcaatgaaacatagctctt

SEQ ID NO: 164194 - DNA, 25 bp, Homo sapien
aacatagctcttacatttgtcacct

SEQ ID NO: 164195 - DNA, 25 bp, Homo sapien
agctcttacatttgtcaccttatga

SEQ ID NO: 164196 - DNA, 25 bp, Homo sapien
acatttgtcaccttatgatgatgat

SEQ ID NO: 164197 - DNA, 25 bp, Homo sapien
gtcaccttatgatgatgatggtaat

SEQ ID NO: 164198 - DNA, 25 bp, Homo sapien
gatggtaatgaaacttcttgtctaa

SEQ ID NO: 164199 - DNA, 25 bp, Homo sapien
tcaaattccagccaacgtccttgtt

SEQ ID NO: 164200 - DNA, 25 bp, Homo sapien
aacgtccttgttgcactttgggtat

SEQ ID NO: 164201 - DNA, 25 bp, Homo sapien
gcactttgggtattctgagattttc

SEQ ID NO: 164202 - DNA, 25 bp, Homo sapien
tgagattttctcttgccattccctt

SEQ ID NO: 164203 - DNA, 25 bp, Homo sapien
ttgccattcccttaggctttagcag

SEQ ID NO: 164204 - DNA, 25 bp, Homo sapien
ggctttagcagctttgcatttcctg

SEQ ID NO: 164205 - DNA, 25 bp, Homo sapien
gcatttcctgttgtatttattctca

SEQ ID NO: 164206 - DNA, 25 bp, Homo sapien
gtatttattctcagccattttgggc

SEQ ID NO: 164207 - DNA, 25 bp, Homo sapien
atcagactggaaacgggactttcta

SEQ ID NO: 164208 - DNA, 25 bp, Homo sapien
ccccaataactgtgggtctatacag

SEQ ID NO: 164209 - DNA, 25 bp, Homo sapien
tcagagaaagttagttcggctcgat

SEQ ID NO: 164210 - DNA, 25 bp, Homo sapien
cagaacccagtcaagtaccactatt

SEQ ID NO: 164211 - DNA, 25 bp, Homo sapien
agtaccactattatgacagcctcaa

SEQ ID NO: 164212 - DNA, 25 bp, Homo sapien
gacagcctcaagtatggctacacct

SEQ ID NO: 164213 - DNA, 25 bp, Homo sapien
atgcccttggagtttaaggccctca

SEQ ID NO: 164214 - DNA, 25 bp, Homo sapien
aggccctcaagagcctacatgagca

SEQ ID NO: 164215 - DNA, 25 bp, Homo sapien
gaaactgactgtcggccagtgcgat

SEQ ID NO: 164216 - DNA, 25 bp, Homo sapien
ccgttcgcggatactggctgaccaa

SEQ ID NO: 164217 - DNA, 25 bp, Homo sapien
tcttgatgtataccctggccacacg

SEQ ID NO: 164218 - DNA, 25 bp, Homo sapien
tggccacacgtttctgcaaacaaat

SEQ ID NO: 164219 - DNA, 25 bp, Homo sapien
acaaatctacctctacggcttctgg

SEQ ID NO: 164220 - DNA, 25 bp, Homo sapien
ggccctttccgctggatcagaacca

SEQ ID NO: 164221 - DNA, 25 bp, Homo sapien
tgaacccacacgtgcacgtcattgg

SEQ ID NO: 164222 - DNA, 25 bp, Homo sapien
acacgtgcacgtcattggagaggat

SEQ ID NO: 164223 - DNA, 25 bp, Homo sapien
cacgtcattggagaggatgccgcct

SEQ ID NO: 164224 - DNA, 25 bp, Homo sapien
tcattggagaggatgccgcctgcat

SEQ ID NO: 164225 - DNA, 25 bp, Homo sapien
attggagaggatgccgcctgcatcg

SEQ ID NO: 164226 - DNA, 25 bp, Homo sapien
aggatgccgcctgcatcgcttacat

SEQ ID NO: 164227 - DNA, 25 bp, Homo sapien
ttacatccggctcacgcagtacatt

SEQ ID NO: 164228 - DNA, 25 bp, Homo sapien
atccggctcacgcagtacattgacg

SEQ ID NO: 164229 - DNA, 25 bp, Homo sapien
gctcacgcagtacattgacgggcag

SEQ ID NO: 164230 - DNA, 25 bp, Homo sapien
agccagtctgaggagacccgcgtgt

SEQ ID NO: 164231 - DNA, 25 bp, Homo sapien
agtctgaggagacccgcgtgtggca

SEQ ID NO: 164232 - DNA, 25 bp, Homo sapien
gaaacggtgggagcccagagtatat

SEQ ID NO: 164233 - DNA, 25 bp, Homo sapien
gggagcccagagtatatgagatgtc

SEQ ID NO: 164234 - DNA, 25 bp, Homo sapien
gcccagagtatatgagatgtcttca

SEQ ID NO: 164235 - DNA, 25 bp, Homo sapien
gtatatgagatgtcttcagaggctc

SEQ ID NO: 164236 - DNA, 25 bp, Homo sapien
gagatgtcttcagaggctcatctaa

SEQ ID NO: 164237 - DNA, 25 bp, Homo sapien
gatgtcttcagaggctcatctaact

SEQ ID NO: 164238 - DNA, 25 bp, Homo sapien
atctaactctgtccttacatactca

SEQ ID NO: 164239 - DNA, 25 bp, Homo sapien
ctaactctgtccttacatactcaat

SEQ ID NO: 164240 - DNA, 25 bp, Homo sapien
aactctgtccttacatactcaatgc

SEQ ID NO: 164241 - DNA, 25 bp, Homo sapien
ctctgtccttacatactcaatgcat

SEQ ID NO: 164242 - DNA, 25 bp, Homo sapien
gtccttacatactcaatgcatatat

SEQ ID NO: 164243 - DNA, 25 bp, Homo sapien
agcgctggaatgtcgtgctggacaa

SEQ ID NO: 164244 - DNA, 25 bp, Homo sapien
aagccgggcaaggtcaccatcacag

SEQ ID NO: 164245 - DNA, 25 bp, Homo sapien
atcacaggcacctcgcagaactgga

SEQ ID NO: 164246 - DNA, 25 bp, Homo sapien
aacctcatgacacgccagctgctgg

SEQ ID NO: 164247 - DNA, 25 bp, Homo sapien
actgccatcttctggcgcaaggagg

SEQ ID NO: 164248 - DNA, 25 bp, Homo sapien
aaggaggactcggatgccatagatt

SEQ ID NO: 164249 - DNA, 25 bp, Homo sapien
tagattggaatgaggccgacgccct

SEQ ID NO: 164250 - DNA, 25 bp, Homo sapien
agcgcctgtcggacctggccaagat

SEQ ID NO: 164251 - DNA, 25 bp, Homo sapien
aagatccgcaaggtcatgtacttcc

SEQ ID NO: 164252 - DNA, 25 bp, Homo sapien
tgtacttcctcgtcacctttggcga

SEQ ID NO: 164253 - DNA, 25 bp, Homo sapien
ctccgtggtttttaaccagctctga

SEQ ID NO: 164254 - DNA, 25 bp, Homo sapien
gcctggtgtgcttcaccatggagga

SEQ ID NO: 164255 - DNA, 25 bp, Homo sapien
gaggacaaagtacccatgtttggcc

SEQ ID NO: 164256 - DNA, 25 bp, Homo sapien
aagtacccatgtttggcctggaggc

SEQ ID NO: 164257 - DNA, 25 bp, Homo sapien
ccatctggaggaacggccaagtggt

SEQ ID NO: 164258 - DNA, 25 bp, Homo sapien
ggccatgtccggagggctgactttg

SEQ ID NO: 164259 - DNA, 25 bp, Homo sapien
tttgggttcgccatcgacaagacca

SEQ ID NO: 164260 - DNA, 25 bp, Homo sapien
tcgacaagaccatcgcctacggtta

SEQ ID NO: 164261 - DNA, 25 bp, Homo sapien
catcgcctacggttacatccatgac

SEQ ID NO: 164262 - DNA, 25 bp, Homo sapien
acggttacatccatgaccccagcgg

SEQ ID NO: 164263 - DNA, 25 bp, Homo sapien
ccggtctcgctggactttgtgaaga

SEQ ID NO: 164264 - DNA, 25 bp, Homo sapien
caagagggtgaagggaatctactga

SEQ ID NO: 164265 - DNA, 25 bp, Homo sapien
acgccccgcctaaaatccatattca

SEQ ID NO: 164266 - DNA, 25 bp, Homo sapien
gaagcaatttcagttcctttctaag

SEQ ID NO: 164267 - DNA, 25 bp, Homo sapien
gcaatttcagttcctttctaagctt

SEQ ID NO: 164268 - DNA, 25 bp, Homo sapien
gttcctttctaagctttgtcagtca

SEQ ID NO: 164269 - DNA, 25 bp, Homo sapien
ctttctaagctttgtcagtcaaggg

SEQ ID NO: 164270 - DNA, 25 bp, Homo sapien
tccactgacttcctaggccctgtaa

SEQ ID NO: 164271 - DNA, 25 bp, Homo sapien
taggccctgtaatttaaccagtctt

SEQ ID NO: 164272 - DNA, 25 bp, Homo sapien
ttttgcaggaaagtcccttcttcca

SEQ ID NO: 164273 - DNA, 25 bp, Homo sapien
tcttccaagtggtttttccaaatcg

SEQ ID NO: 164274 - DNA, 25 bp, Homo sapien
ggtttttccaaatcgcacaatggca

SEQ ID NO: 164275 - DNA, 25 bp, Homo sapien
ttccaaatcgcacaatggcaaagcc

SEQ ID NO: 164276 - DNA, 25 bp, Homo sapien
aattgccaaagtttccacctgagga

SEQ ID NO: 164277 - DNA, 25 bp, Homo sapien
ttccacctgaggacggtgtttcgga

SEQ ID NO: 164278 - DNA, 25 bp, Homo sapien
gaggttgccttttggacctaccact

SEQ ID NO: 164279 - DNA, 25 bp, Homo sapien
tttgctcattcttgctaacctagtc

SEQ ID NO: 164280 - DNA, 25 bp, Homo sapien
taacctagtctaggtgacctacagt

SEQ ID NO: 164281 - DNA, 25 bp, Homo sapien
gtgacctacagtgccgtgcatttaa

SEQ ID NO: 164282 - DNA, 25 bp, Homo sapien
gtgccgtgcatttaagtcaatggtt

SEQ ID NO: 164283 - DNA, 25 bp, Homo sapien
gaagtttcccgtgttgtaaatcatg

SEQ ID NO: 164284 - DNA, 25 bp, Homo sapien
gtaaatcatgtttcccttatcagat

SEQ ID NO: 164285 - DNA, 25 bp, Homo sapien
tgtttcccttatcagatcatttgca

SEQ ID NO: 164286 - DNA, 25 bp, Homo sapien
gagagactcagctccttttatttat

SEQ ID NO: 164287 - DNA, 25 bp, Homo sapien
gtttttcataactgagcccactcgc

SEQ ID NO: 164288 - DNA, 25 bp, Homo sapien
gagcccactcgcaagttggagccat

SEQ ID NO: 164289 - DNA, 25 bp, Homo sapien
ttggagccatcagtgggatacgcca

SEQ ID NO: 164290 - DNA, 25 bp, Homo sapien
gtgggatacgccacattttggaagc

SEQ ID NO: 164291 - DNA, 25 bp, Homo sapien
ttttggaagccccagcatcgtgtac

SEQ ID NO: 164292 - DNA, 25 bp, Homo sapien
agcatcgtgtacttaccagtgtgtt

SEQ ID NO: 164293 - DNA, 25 bp, Homo sapien
gtgtacttaccagtgtgttcacaaa

SEQ ID NO: 164294 - DNA, 25 bp, Homo sapien
gaaatttgtgtgagagctgtacatt

SEQ ID NO: 164295 - DNA, 25 bp, Homo sapien
ttatttgcagtcatggagaaccacc

SEQ ID NO: 164296 - DNA, 25 bp, Homo sapien
agtcatggagaaccacctacccctg

SEQ ID NO: 164297 - DNA, 25 bp, Homo sapien
tacccctgacttctgtttagtctcc

SEQ ID NO: 164298 - DNA, 25 bp, Homo sapien
aacaacgtcggcaaaggccaggaca

SEQ ID NO: 164299 - DNA, 25 bp, Homo sapien
aggccaggacataccccagggaaca

SEQ ID NO: 164300 - DNA, 25 bp, Homo sapien
gaaacaggaggacccacgaatttga

SEQ ID NO: 164301 - DNA, 25 bp, Homo sapien
cacgaatttgagagggcacccagga

SEQ ID NO: 164302 - DNA, 25 bp, Homo sapien
gcacccaggagtgtctgagctgcat

SEQ ID NO: 164303 - DNA, 25 bp, Homo sapien
gtgtctgagctgcattacctctaga

SEQ ID NO: 164304 - DNA, 25 bp, Homo sapien
gctgcattacctctagaaacctcaa

SEQ ID NO: 164305 - DNA, 25 bp, Homo sapien
gaaacttgcctagacaataactgga

SEQ ID NO: 164306 - DNA, 25 bp, Homo sapien
catggcattatgtggatgtttacaa

SEQ ID NO: 164307 - DNA, 25 bp, Homo sapien
gaaattcagctgagttccaccaatt

SEQ ID NO: 164308 - DNA, 25 bp, Homo sapien
agctgagttccaccaattataaatt

SEQ ID NO: 164309 - DNA, 25 bp, Homo sapien
ggaacacttatcagtgatgattcaa

SEQ ID NO: 164310 - DNA, 25 bp, Homo sapien
gattcaaatgctgtacaattagcca

SEQ ID NO: 164311 - DNA, 25 bp, Homo sapien
aatgctgtacaattagccaagtctt

SEQ ID NO: 164312 - DNA, 25 bp, Homo sapien
tctttaggtgttgattctcaaataa

SEQ ID NO: 164313 - DNA, 25 bp, Homo sapien
gtatcagaaccagctaaagtaagtg

SEQ ID NO: 164314 - DNA, 25 bp, Homo sapien
gtaagtgaatgctgtagatttatcc

SEQ ID NO: 164315 - DNA, 25 bp, Homo sapien
gtgaatgctgtagatttatcctaaa

SEQ ID NO: 164316 - DNA, 25 bp, Homo sapien
tttatcctaaatttgctgtagcagt

SEQ ID NO: 164317 - DNA, 25 bp, Homo sapien
gaagagggacggatatttttaattg

SEQ ID NO: 164318 - DNA, 25 bp, Homo sapien
gtgtttttttcctcacatttgacat

SEQ ID NO: 164319 - DNA, 25 bp, Homo sapien
acatttgacatgactgataacagat

SEQ ID NO: 164320 - DNA, 25 bp, Homo sapien
actgtacgtagttaagtcgtagcta

SEQ ID NO: 164321 - DNA, 25 bp, Homo sapien
gtcgtagctataacttcaaattttt

SEQ ID NO: 164322 - DNA, 25 bp, Homo sapien
gcaatatttgtaaggcttgttccaa

SEQ ID NO: 164323 - DNA, 25 bp, Homo sapien
aaggcttgttccaatgccacatact

SEQ ID NO: 164324 - DNA, 25 bp, Homo sapien
gttccaatgccacatacttgcagct

SEQ ID NO: 164325 - DNA, 25 bp, Homo sapien
atacttgcagctcccattctatgtg

SEQ ID NO: 164326 - DNA, 25 bp, Homo sapien
agctcccattctatgtgtcatcaat

SEQ ID NO: 164327 - DNA, 25 bp, Homo sapien
gtgtcatcaatagtgtcctatgcaa

SEQ ID NO: 164328 - DNA, 25 bp, Homo sapien
tagtgtcctatgcaataaattattt

SEQ ID NO: 164329 - DNA, 25 bp, Homo sapien
ttcctaaaaatgcttcactgtacgt

SEQ ID NO: 164330 - DNA, 25 bp, Homo sapien
aatgcttcactgtacgtagttaagt

SEQ ID NO: 164331 - DNA, 25 bp, Homo sapien
gatgcatagtaaccagtgattatag

SEQ ID NO: 164332 - DNA, 25 bp, Homo sapien
gtgattataggatatacctgagacc

SEQ ID NO: 164333 - DNA, 25 bp, Homo sapien
gagaccatcaggaactgtcaacaaa

SEQ ID NO: 164334 - DNA, 25 bp, Homo sapien
ggaactgtcaacaaatgataccttt

SEQ ID NO: 164335 - DNA, 25 bp, Homo sapien
catcctcctcgacttatagtacagt

SEQ ID NO: 164336 - DNA, 25 bp, Homo sapien
tacagtggtgtatagtggcatttct

SEQ ID NO: 164337 - DNA, 25 bp, Homo sapien
aagacttgagtctttccactgggac

SEQ ID NO: 164338 - DNA, 25 bp, Homo sapien
ttgagtctttccactgggacacatc

SEQ ID NO: 164339 - DNA, 25 bp, Homo sapien
tgttttgatttaggccaggtatatt

SEQ ID NO: 164340 - DNA, 25 bp, Homo sapien
taggccaggtatattatcttcattt

SEQ ID NO: 164341 - DNA, 25 bp, Homo sapien
aaagtttcagggtgccattttctat

SEQ ID NO: 164342 - DNA, 25 bp, Homo sapien
gaaatgaccacgtgaaatttgcctc

SEQ ID NO: 164343 - DNA, 25 bp, Homo sapien
tctgtccaaacatttcatccgtgtg

SEQ ID NO: 164344 - DNA, 25 bp, Homo sapien
acatttcatccgtgtgtatgtgtat

SEQ ID NO: 164345 - DNA, 25 bp, Homo sapien
tgtgagtgtgtgaagccgccagttc

SEQ ID NO: 164346 - DNA, 25 bp, Homo sapien
gaagccgccagttcatctttttata

SEQ ID NO: 164347 - DNA, 25 bp, Homo sapien
gttgttgtctcattttggtctgttt

SEQ ID NO: 164348 - DNA, 25 bp, Homo sapien
gcttgtgctcgggatcaaacctttc

SEQ ID NO: 164349 - DNA, 25 bp, Homo sapien
ctcgggatcaaacctttctggcctg

SEQ ID NO: 164350 - DNA, 25 bp, Homo sapien
tttctggcctgttatgattctgaac

SEQ ID NO: 164351 - DNA, 25 bp, Homo sapien
gaacatttgacttgaaccacaagtg

SEQ ID NO: 164352 - DNA, 25 bp, Homo sapien
cttgaaccacaagtgaatctttctc

SEQ ID NO: 164353 - DNA, 25 bp, Homo sapien
actgcgccctgcctgtttgtagtaa

SEQ ID NO: 164354 - DNA, 25 bp, Homo sapien
tgcgccctgcctgtttgtagtaatt

SEQ ID NO: 164355 - DNA, 25 bp, Homo sapien
gcgccctgcctgtttgtagtaattt

SEQ ID NO: 164356 - DNA, 25 bp, Homo sapien
taatttttaggcaccaaatctccct

SEQ ID NO: 164357 - DNA, 25 bp, Homo sapien
atttttaggcaccaaatctccctca

SEQ ID NO: 164358 - DNA, 25 bp, Homo sapien
tttttaggcaccaaatctccctcat

SEQ ID NO: 164359 - DNA, 25 bp, Homo sapien
ttaggcaccaaatctccctcatctt

SEQ ID NO: 164360 - DNA, 25 bp, Homo sapien
atcttctagtgccattctcctctct

SEQ ID NO: 164361 - DNA, 25 bp, Homo sapien
ttctagtgccattctcctctctgtt

SEQ ID NO: 164362 - DNA, 25 bp, Homo sapien
tagtgccattctcctctctgttcag

SEQ ID NO: 164363 - DNA, 25 bp, Homo sapien
agtgccattctcctctctgttcagg

SEQ ID NO: 164364 - DNA, 25 bp, Homo sapien
gaaacaatcacagaccacatgagac

SEQ ID NO: 164365 - DNA, 25 bp, Homo sapien
gactaaggagacatgtgagccaaat

SEQ ID NO: 164366 - DNA, 25 bp, Homo sapien
gtgagccaaatgcaatgtgcttctt

SEQ ID NO: 164367 - DNA, 25 bp, Homo sapien
tgtgcttcttggatcagatcctgga

SEQ ID NO: 164368 - DNA, 25 bp, Homo sapien
gaagtctgaatagaatctggagtat

SEQ ID NO: 164369 - DNA, 25 bp, Homo sapien
gtagtgttgatttcttaatcttgac

SEQ ID NO: 164370 - DNA, 25 bp, Homo sapien
aatcttgacaaatatagcagggtaa

SEQ ID NO: 164371 - DNA, 25 bp, Homo sapien
ctgggtgagggctatctaggaattc

SEQ ID NO: 164372 - DNA, 25 bp, Homo sapien
tgagggctatctaggaattctctgt

SEQ ID NO: 164373 - DNA, 25 bp, Homo sapien
ctgtactatcttaccaaattttcgg

SEQ ID NO: 164374 - DNA, 25 bp, Homo sapien
ttcggtaagtctaagaaagcaatgc

SEQ ID NO: 164375 - DNA, 25 bp, Homo sapien
agctttattacctcatgcgaactca

SEQ ID NO: 164376 - DNA, 25 bp, Homo sapien
atgcgaactcatacaaaccaataga

SEQ ID NO: 164377 - DNA, 25 bp, Homo sapien
gaatttcaacatgttctgtagctta

SEQ ID NO: 164378 - DNA, 25 bp, Homo sapien
gttctgtagcttagagtgctcactt

SEQ ID NO: 164379 - DNA, 25 bp, Homo sapien
agagtgctcacttactacctctgaa

SEQ ID NO: 164380 - DNA, 25 bp, Homo sapien
tacctctgaacaatactcacgctgt

SEQ ID NO: 164381 - DNA, 25 bp, Homo sapien
aatactcacgctgtagtttgtctct

SEQ ID NO: 164382 - DNA, 25 bp, Homo sapien
ttgcatcttgtaattaactctttgt

SEQ ID NO: 164383 - DNA, 25 bp, Homo sapien
agaaaaatcagggttgcacttgcaa

SEQ ID NO: 164384 - DNA, 25 bp, Homo sapien
agtgtggaaacattgggtcttaatt

SEQ ID NO: 164385 - DNA, 25 bp, Homo sapien
ggtcttaattcaacacaggatcggt

SEQ ID NO: 164386 - DNA, 25 bp, Homo sapien
atgagggagccctgtctgcgttttt

SEQ ID NO: 164387 - DNA, 25 bp, Homo sapien
tgagggagccctgtctgcgtttttg

SEQ ID NO: 164388 - DNA, 25 bp, Homo sapien
gagggagccctgtctgcgtttttgg

SEQ ID NO: 164389 - DNA, 25 bp, Homo sapien
agggagccctgtctgcgtttttgga

SEQ ID NO: 164390 - DNA, 25 bp, Homo sapien
gggagccctgtctgcgtttttggat

SEQ ID NO: 164391 - DNA, 25 bp, Homo sapien
ggagccctgtctgcgtttttggatg

SEQ ID NO: 164392 - DNA, 25 bp, Homo sapien
agccctgtctgcgtttttggatgtg

SEQ ID NO: 164393 - DNA, 25 bp, Homo sapien
gccctgtctgcgtttttggatgtga

SEQ ID NO: 164394 - DNA, 25 bp, Homo sapien
ccctgtctgcgtttttggatgtgag

SEQ ID NO: 164395 - DNA, 25 bp, Homo sapien
cctgtctgcgtttttggatgtgagt

SEQ ID NO: 164396 - DNA, 25 bp, Homo sapien
tttggatgtgagtagaagagttagt

SEQ ID NO: 164397 - DNA, 25 bp, Homo sapien
gaaaactgtatgcacactaactaat

SEQ ID NO: 164398 - DNA, 25 bp, Homo sapien
aactaatgaaagtcctagaagccat

SEQ ID NO: 164399 - DNA, 25 bp, Homo sapien
gaagccataaaagagacactttcct

SEQ ID NO: 164400 - DNA, 25 bp, Homo sapien
actttcctgctggtggtatctatgg

SEQ ID NO: 164401 - DNA, 25 bp, Homo sapien
ctgctggtggtatctatggaaatga

SEQ ID NO: 164402 - DNA, 25 bp, Homo sapien
ggaaatgatgaagttacccaccaca

SEQ ID NO: 164403 - DNA, 25 bp, Homo sapien
tgaagttacccaccacattaaaaca

SEQ ID NO: 164404 - DNA, 25 bp, Homo sapien
cagattttaacttgtgcagtacttg

SEQ ID NO: 164405 - DNA, 25 bp, Homo sapien
acttgtgcagtacttgaagtgaaac

SEQ ID NO: 164406 - DNA, 25 bp, Homo sapien
actttaacagaaattgtctcttaat

SEQ ID NO: 164407 - DNA, 25 bp, Homo sapien
gtctcttaatacatttacagtcttg

SEQ ID NO: 164408 - DNA, 25 bp, Homo sapien
gggcaggaagcctatgcgccatcct

SEQ ID NO: 164409 - DNA, 25 bp, Homo sapien
aagcctatgcgccatcctccaaaga

SEQ ID NO: 164410 - DNA, 25 bp, Homo sapien
agacagaatcacctgaggcgttcaa

SEQ ID NO: 164411 - DNA, 25 bp, Homo sapien
tcacctgaggcgttcaaaagatata

SEQ ID NO: 164412 - DNA, 25 bp, Homo sapien
taaacaagtcatccacaatcaaaat

SEQ ID NO: 164413 - DNA, 25 bp, Homo sapien
atacaacattcaatacttccaggtg

SEQ ID NO: 164414 - DNA, 25 bp, Homo sapien
cttccaggtgtgtcagacttgggat

SEQ ID NO: 164415 - DNA, 25 bp, Homo sapien
gacttgggatgggacgctgatataa

SEQ ID NO: 164416 - DNA, 25 bp, Homo sapien
tccaagtcatatggcagtgatcaat

SEQ ID NO: 164417 - DNA, 25 bp, Homo sapien
gtatgctttgctgaattagtctgat

SEQ ID NO: 164418 - DNA, 25 bp, Homo sapien
agtgaatgtttatctatctttgtgg

SEQ ID NO: 164419 - DNA, 25 bp, Homo sapien
aagatgcccagatgttttaccagtc

SEQ ID NO: 164420 - DNA, 25 bp, Homo sapien
atgttttaccagtcacaccctatgg

SEQ ID NO: 164421 - DNA, 25 bp, Homo sapien
accctatggccatggctatacttgg

SEQ ID NO: 164422 - DNA, 25 bp, Homo sapien
atacttggaagttctccttgttggc

SEQ ID NO: 164423 - DNA, 25 bp, Homo sapien
tagaaatgctttaaccccaagcctt

SEQ ID NO: 164424 - DNA, 25 bp, Homo sapien
ggacttctagctttgtgtcttgttt

SEQ ID NO: 164425 - DNA, 25 bp, Homo sapien
gtgtcttgtttcagaccatgtggaa

SEQ ID NO: 164426 - DNA, 25 bp, Homo sapien
aaatactctttttgtgcttctgatc

SEQ ID NO: 164427 - DNA, 25 bp, Homo sapien
gcttctgatctatcgatttcactaa

SEQ ID NO: 164428 - DNA, 25 bp, Homo sapien
agtaggtgctttgaacccctttctg

SEQ ID NO: 164429 - DNA, 25 bp, Homo sapien
cctttctgtaggctcacaccttaat

SEQ ID NO: 164430 - DNA, 25 bp, Homo sapien
tgcctatcagaaccacaggatcacc

SEQ ID NO: 164431 - DNA, 25 bp, Homo sapien
tatcagaaccacaggatcacccagc

SEQ ID NO: 164432 - DNA, 25 bp, Homo sapien
ctgaaaatcgccagcaacccttttg

SEQ ID NO: 164433 - DNA, 25 bp, Homo sapien
aaaatcgccagcaacccttttgcca

SEQ ID NO: 164434 - DNA, 25 bp, Homo sapien
tcgccagcaacccttttgccaaagg

SEQ ID NO: 164435 - DNA, 25 bp, Homo sapien
agtgtcccagcccggagtcacagca

SEQ ID NO: 164436 - DNA, 25 bp, Homo sapien
cagcagcctcagtccctgtgtgctg

SEQ ID NO: 164437 - DNA, 25 bp, Homo sapien
ccctgtgtgctgaagggtgccacag

SEQ ID NO: 164438 - DNA, 25 bp, Homo sapien
ctgtgtgctgaagggtgccacagac

SEQ ID NO: 164439 - DNA, 25 bp, Homo sapien
gaaagagacccccaacaaagcttca

SEQ ID NO: 164440 - DNA, 25 bp, Homo sapien
tccatcatcaaggaggcctcgcctc

SEQ ID NO: 164441 - DNA, 25 bp, Homo sapien
cctgaggcagagatggtctttattg

SEQ ID NO: 164442 - DNA, 25 bp, Homo sapien
aggcagagatggtctttattgtgtg

SEQ ID NO: 164443 - DNA, 25 bp, Homo sapien
gtggttgtggtatttataataatgc

SEQ ID NO: 164444 - DNA, 25 bp, Homo sapien
aataatgcaagcataccctcccttg

SEQ ID NO: 164445 - DNA, 25 bp, Homo sapien
aatgcaagcataccctcccttgagt

SEQ ID NO: 164446 - DNA, 25 bp, Homo sapien
ataccctcccttgagtctcaattga

SEQ ID NO: 164447 - DNA, 25 bp, Homo sapien
accctcccttgagtctcaattgaag

SEQ ID NO: 164448 - DNA, 25 bp, Homo sapien
cccttgagtctcaattgaagataaa

SEQ ID NO: 164449 - DNA, 25 bp, Homo sapien
aaatgagatgccagtagtgttcaaa

SEQ ID NO: 164450 - DNA, 25 bp, Homo sapien
agatgccagtagtgttcaaagttgt

SEQ ID NO: 164451 - DNA, 25 bp, Homo sapien
gccagtagtgttcaaagttgtattt

SEQ ID NO: 164452 - DNA, 25 bp, Homo sapien
gtgcccagaaggagggttgtacctt

SEQ ID NO: 164453 - DNA, 25 bp, Homo sapien
agaatgggtgcaaatttgtcagggt

SEQ ID NO: 164454 - DNA, 25 bp, Homo sapien
gatcaactcagttgtcgcatcattc

SEQ ID NO: 164455 - DNA, 25 bp, Homo sapien
ttcatggttctatattgatgttctt

SEQ ID NO: 164456 - DNA, 25 bp, Homo sapien
gatgttcttcaagtcagtggcctga

SEQ ID NO: 164457 - DNA, 25 bp, Homo sapien
agtggcctgagatatcccagcctct

SEQ ID NO: 164458 - DNA, 25 bp, Homo sapien
ccagcctctcttctggtttggtgag

SEQ ID NO: 164459 - DNA, 25 bp, Homo sapien
taaagcatggtagtggaattgtttg

SEQ ID NO: 164460 - DNA, 25 bp, Homo sapien
gacatatgacccttggtcactggtg

SEQ ID NO: 164461 - DNA, 25 bp, Homo sapien
gtcactggtgtttcaaacattctgg

SEQ ID NO: 164462 - DNA, 25 bp, Homo sapien
acattctggacacatcaatagtcaa

SEQ ID NO: 164463 - DNA, 25 bp, Homo sapien
tgagaagccacgtgacaagtcatat

SEQ ID NO: 164464 - DNA, 25 bp, Homo sapien
gacaagtcatatcaggatgcagttt

SEQ ID NO: 164465 - DNA, 25 bp, Homo sapien
atggtgatggcttcatttctcccaa

SEQ ID NO: 164466 - DNA, 25 bp, Homo sapien
ttctcccaaggaatacaatgtatac

SEQ ID NO: 164467 - DNA, 25 bp, Homo sapien
aatgtataccaacacgatgaactat

SEQ ID NO: 164468 - DNA, 25 bp, Homo sapien
agctatttactgtactttatgtata

SEQ ID NO: 164469 - DNA, 25 bp, Homo sapien
caaagtcacttttctccaagttgta

SEQ ID NO: 164470 - DNA, 25 bp, Homo sapien
tccaagttgtatttgctatttttcc

SEQ ID NO: 164471 - DNA, 25 bp, Homo sapien
tttttcccctatgagaagatatttt

SEQ ID NO: 164472 - DNA, 25 bp, Homo sapien
gaagatattttgatctccccaatac

SEQ ID NO: 164473 - DNA, 25 bp, Homo sapien
ttgatctccccaatacattgatttt

SEQ ID NO: 164474 - DNA, 25 bp, Homo sapien
gaagcctctgatacttaaacagcat

SEQ ID NO: 164475 - DNA, 25 bp, Homo sapien
ctgatacttaaacagcatggcgctg

SEQ ID NO: 164476 - DNA, 25 bp, Homo sapien
aacagcatggcgctggtacgtaaat

SEQ ID NO: 164477 - DNA, 25 bp, Homo sapien
gcatggcgctggtacgtaaatagac

SEQ ID NO: 164478 - DNA, 25 bp, Homo sapien
gtacgtaaatagaccaatgcagtta

SEQ ID NO: 164479 - DNA, 25 bp, Homo sapien
gaccaatgcagttaggtggctcttt

SEQ ID NO: 164480 - DNA, 25 bp, Homo sapien
aatgcagttaggtggctctttccaa

SEQ ID NO: 164481 - DNA, 25 bp, Homo sapien
agttaggtggctctttccaagactc

SEQ ID NO: 164482 - DNA, 25 bp, Homo sapien
aggtggctctttccaagactctggg

SEQ ID NO: 164483 - DNA, 25 bp, Homo sapien
gctaaatgcaatcaatcagcaattg

SEQ ID NO: 164484 - DNA, 25 bp, Homo sapien
gagggcctccttggtggtaaaagag

SEQ ID NO: 164485 - DNA, 25 bp, Homo sapien
gagtgactgcctatcagaaccacag

SEQ ID NO: 164486 - DNA, 25 bp, Homo sapien
tatcagaaccacaggatcacccagc

SEQ ID NO: 164487 - DNA, 25 bp, Homo sapien
aggatcacccagctgaaaatcgcca

SEQ ID NO: 164488 - DNA, 25 bp, Homo sapien
tgaaaatcgccagcaacccttttgc

SEQ ID NO: 164489 - DNA, 25 bp, Homo sapien
tcgccagcaacccttttgccaaagg

SEQ ID NO: 164490 - DNA, 25 bp, Homo sapien
ttagagagagtgacctggactcctg

SEQ ID NO: 164491 - DNA, 25 bp, Homo sapien
agtgtcccagcccggagtcacagca

SEQ ID NO: 164492 - DNA, 25 bp, Homo sapien
cagcagcctcagtccctgtgtgctg

SEQ ID NO: 164493 - DNA, 25 bp, Homo sapien
ctgtgtgctgaagggtgccacagac

SEQ ID NO: 164494 - DNA, 25 bp, Homo sapien
gaaagagacccccaacaaagcttca

SEQ ID NO: 164495 - DNA, 25 bp, Homo sapien
ctgcttggctccatcatcaaggagg

SEQ ID NO: 164496 - DNA, 25 bp, Homo sapien
agtgtactgtgccttttatacgaaa

SEQ ID NO: 164497 - DNA, 25 bp, Homo sapien
gtgtactgtgccttttatacgaaat

SEQ ID NO: 164498 - DNA, 25 bp, Homo sapien
tgtactgtgccttttatacgaaatt

SEQ ID NO: 164499 - DNA, 25 bp, Homo sapien
gtactgtgccttttatacgaaattt

SEQ ID NO: 164500 - DNA, 25 bp, Homo sapien
tactgtgccttttatacgaaatttc

SEQ ID NO: 164501 - DNA, 25 bp, Homo sapien
ctgtgccttttatacgaaatttcca

SEQ ID NO: 164502 - DNA, 25 bp, Homo sapien
tgtgccttttatacgaaatttccag

SEQ ID NO: 164503 - DNA, 25 bp, Homo sapien
gctaatcagtatggggtttcctccc

SEQ ID NO: 164504 - DNA, 25 bp, Homo sapien
tcagtatggggtttcctcccgggat

SEQ ID NO: 164505 - DNA, 25 bp, Homo sapien
cagtatggggtttcctcccgggatg

SEQ ID NO: 164506 - DNA, 25 bp, Homo sapien
tatggggtttcctcccgggatggtg

SEQ ID NO: 164507 - DNA, 25 bp, Homo sapien
acgagctatgcaatctttttccaaa

SEQ ID NO: 164508 - DNA, 25 bp, Homo sapien
tgcaatctttttccaaaacccaagg

SEQ ID NO: 164509 - DNA, 25 bp, Homo sapien
ggcctccttcacaatgtgaagctgt

SEQ ID NO: 164510 - DNA, 25 bp, Homo sapien
gtctctgcctctgggtcatgagtac

SEQ ID NO: 164511 - DNA, 25 bp, Homo sapien
tgggtcatgagtaccaccctgcctg

SEQ ID NO: 164512 - DNA, 25 bp, Homo sapien
aacaccgtggaatcctcactggtgt

SEQ ID NO: 164513 - DNA, 25 bp, Homo sapien
ggaatcctcactggtgtgctgtcca

SEQ ID NO: 164514 - DNA, 25 bp, Homo sapien
tggtgtgctgtccacagatttgtga

SEQ ID NO: 164515 - DNA, 25 bp, Homo sapien
tggcagacaccctggtcacccagga

SEQ ID NO: 164516 - DNA, 25 bp, Homo sapien
gtcacccaggacagagcggaaaaaa

SEQ ID NO: 164517 - DNA, 25 bp, Homo sapien
aggtcagggttttaacgagctatgc

SEQ ID NO: 164518 - DNA, 25 bp, Homo sapien
agctgctgccagtgaaggcacccct

SEQ ID NO: 164519 - DNA, 25 bp, Homo sapien
tgaaggcacccctccgtgtggagca

SEQ ID NO: 164520 - DNA, 25 bp, Homo sapien
acccctccgtgtggagcactggaga

SEQ ID NO: 164521 - DNA, 25 bp, Homo sapien
agatagtgccaggtggctcagtgcc

SEQ ID NO: 164522 - DNA, 25 bp, Homo sapien
atagtgccaggtggctcagtgccca

SEQ ID NO: 164523 - DNA, 25 bp, Homo sapien
gccaggtggctcagtgcccacctat

SEQ ID NO: 164524 - DNA, 25 bp, Homo sapien
agtgcccacctatgccctgtggtga

SEQ ID NO: 164525 - DNA, 25 bp, Homo sapien
ctatgccctgtggtgaagtgttcct

SEQ ID NO: 164526 - DNA, 25 bp, Homo sapien
atgccctgtggtgaagtgttcctgg

SEQ ID NO: 164527 - DNA, 25 bp, Homo sapien
tgtggtgaagtgttcctggtgttcc

SEQ ID NO: 164528 - DNA, 25 bp, Homo sapien
gtgaagtgttcctggtgttcccttt

SEQ ID NO: 164529 - DNA, 25 bp, Homo sapien
gagggttttctgtgctcagactgta

SEQ ID NO: 164530 - DNA, 25 bp, Homo sapien
gctcagactgtagcctgtagctctt

SEQ ID NO: 164531 - DNA, 25 bp, Homo sapien
cctcagtggctgtcgtttgttaaca

SEQ ID NO: 164532 - DNA, 25 bp, Homo sapien
gtcgtttgttaacatcatcaggaag

SEQ ID NO: 164533 - DNA, 25 bp, Homo sapien
atgggaaaggtcaggcagaattttt

SEQ ID NO: 164534 - DNA, 25 bp, Homo sapien
cagaatttttctgccctacaaaggg

SEQ ID NO: 164535 - DNA, 25 bp, Homo sapien
ttttctgccctacaaagggtggaag

SEQ ID NO: 164536 - DNA, 25 bp, Homo sapien
aaggacacagtattttcatgaattt

SEQ ID NO: 164537 - DNA, 25 bp, Homo sapien
atttaccatatatctttgtttttct

SEQ ID NO: 164538 - DNA, 25 bp, Homo sapien
ttaattgaggcaatgtcatctgctc

SEQ ID NO: 164539 - DNA, 25 bp, Homo sapien
ggcaatgtcatctgctcaaagttga

SEQ ID NO: 164540 - DNA, 25 bp, Homo sapien
ggttgtactttaattcttggcatgt

SEQ ID NO: 164541 - DNA, 25 bp, Homo sapien
gtactttaattcttggcatgttgcc

SEQ ID NO: 164542 - DNA, 25 bp, Homo sapien
tttaattcttggcatgttgcctcta

SEQ ID NO: 164543 - DNA, 25 bp, Homo sapien
tacattctcattaactttagatggg

SEQ ID NO: 164544 - DNA, 25 bp, Homo sapien
ttttggcatgatgactgtactctca

SEQ ID NO: 164545 - DNA, 25 bp, Homo sapien
tggcatgatgactgtactctcaata

SEQ ID NO: 164546 - DNA, 25 bp, Homo sapien
ggctgaaattataggtacatctgtt

SEQ ID NO: 164547 - DNA, 25 bp, Homo sapien
aaattataggtacatctgttttcac

SEQ ID NO: 164548 - DNA, 25 bp, Homo sapien
gatattaagaaagcgtgaaatgact

SEQ ID NO: 164549 - DNA, 25 bp, Homo sapien
ttctgtatagatactttatcatgtt

SEQ ID NO: 164550 - DNA, 25 bp, Homo sapien
tcatgttttcatgattttaggaatt

SEQ ID NO: 164551 - DNA, 25 bp, Homo sapien
tcctggagaaggacctgagggacaa

SEQ ID NO: 164552 - DNA, 25 bp, Homo sapien
gagggacaaggtcaactccttcttc

SEQ ID NO: 164553 - DNA, 25 bp, Homo sapien
ccttcttcagcaccttcaaggagaa

SEQ ID NO: 164554 - DNA, 25 bp, Homo sapien
ctggagcaacagcaggaacagcatc

SEQ ID NO: 164555 - DNA, 25 bp, Homo sapien
gatgctggcccctttggagagctga

SEQ ID NO: 164556 - DNA, 25 bp, Homo sapien
ctttggagagctgagctgcccctgg

SEQ ID NO: 164557 - DNA, 25 bp, Homo sapien
cctgtctgtctgtcccaaagaagtt

SEQ ID NO: 164558 - DNA, 25 bp, Homo sapien
gtctgtctgtcccaaagaagttctg

SEQ ID NO: 164559 - DNA, 25 bp, Homo sapien
ttctggtatgaacttgaggacacat

SEQ ID NO: 164560 - DNA, 25 bp, Homo sapien
acacatgtccagtgggaggtgagac

SEQ ID NO: 164561 - DNA, 25 bp, Homo sapien
tgtccagtgggaggtgagaccacct

SEQ ID NO: 164562 - DNA, 25 bp, Homo sapien
aggctgaggagcacaacattgtctt

SEQ ID NO: 164563 - DNA, 25 bp, Homo sapien
aacattgtcttcatgcccgtcattg

SEQ ID NO: 164564 - DNA, 25 bp, Homo sapien
gcccgtcattgggaagcgacacgaa

SEQ ID NO: 164565 - DNA, 25 bp, Homo sapien
agggaagcagctctacacctttggc

SEQ ID NO: 164566 - DNA, 25 bp, Homo sapien
acctttggccgcattgtgatctaca

SEQ ID NO: 164567 - DNA, 25 bp, Homo sapien
agaagacgtgggtgcccacctcact

SEQ ID NO: 164568 - DNA, 25 bp, Homo sapien
tcactgcagagcctgatcgacatgg

SEQ ID NO: 164569 - DNA, 25 bp, Homo sapien
gatcgacatggccaagtgaactgtg

SEQ ID NO: 164570 - DNA, 25 bp, Homo sapien
tgtggcaggtccagaaccagtcaga

SEQ ID NO: 164571 - DNA, 25 bp, Homo sapien
cagtcagagacttgcccctaagagg

SEQ ID NO: 164572 - DNA, 25 bp, Homo sapien
cccctaagagggatgtactgtaaat

SEQ ID NO: 164573 - DNA, 25 bp, Homo sapien
ctccaaggccgctggtggaaacagc

SEQ ID NO: 164574 - DNA, 25 bp, Homo sapien
tccaaggccgctggtggaaacagcc

SEQ ID NO: 164575 - DNA, 25 bp, Homo sapien
ccaaggccgctggtggaaacagccg

SEQ ID NO: 164576 - DNA, 25 bp, Homo sapien
ctggtggaaacagccgggagcctag

SEQ ID NO: 164577 - DNA, 25 bp, Homo sapien
gtggaaacagccgggagcctagccc

SEQ ID NO: 164578 - DNA, 25 bp, Homo sapien
ggctctccgcaaagtaggggcccca

SEQ ID NO: 164579 - DNA, 25 bp, Homo sapien
caggccgggagtcgcccaagtgagg

SEQ ID NO: 164580 - DNA, 25 bp, Homo sapien
cctgctgcttgggacgtgtacagca

SEQ ID NO: 164581 - DNA, 25 bp, Homo sapien
ggacgtgtacagcacagaatgagta

SEQ ID NO: 164582 - DNA, 25 bp, Homo sapien
cgtgtacagcacagaatgagtattt

SEQ ID NO: 164583 - DNA, 25 bp, Homo sapien
gtacagcacagaatgagtatttatt

SEQ ID NO: 164584 - DNA, 25 bp, Homo sapien
taagacaattgtcaacacagttgag

SEQ ID NO: 164585 - DNA, 25 bp, Homo sapien
ggaatttgcctactgaaatagttat

SEQ ID NO: 164586 - DNA, 25 bp, Homo sapien
agatgattacttgtgatgtgaaact

SEQ ID NO: 164587 - DNA, 25 bp, Homo sapien
gaaactgaattgagcatgacaacca

SEQ ID NO: 164588 - DNA, 25 bp, Homo sapien
gacaaccagacatttccagttggtt

SEQ ID NO: 164589 - DNA, 25 bp, Homo sapien
accagacatttccagttggttttgt

SEQ ID NO: 164590 - DNA, 25 bp, Homo sapien
ggttttgtaagttttgagaatctag

SEQ ID NO: 164591 - DNA, 25 bp, Homo sapien
gagaatctagatactgggttttatt

SEQ ID NO: 164592 - DNA, 25 bp, Homo sapien
aaagattagctctgtttgtaagggc

SEQ ID NO: 164593 - DNA, 25 bp, Homo sapien
gctctgtttgtaagggctgattcct

SEQ ID NO: 164594 - DNA, 25 bp, Homo sapien
gtttgtaagggctgattccttgaaa

SEQ ID NO: 164595 - DNA, 25 bp, Homo sapien
atcggcaaatcgcaatggcagcatg

SEQ ID NO: 164596 - DNA, 25 bp, Homo sapien
tcggcaaatcgcaatggcagcatgt

SEQ ID NO: 164597 - DNA, 25 bp, Homo sapien
ggcaaatcgcaatggcagcatgtga

SEQ ID NO: 164598 - DNA, 25 bp, Homo sapien
gcaaatcgcaatggcagcatgtgag

SEQ ID NO: 164599 - DNA, 25 bp, Homo sapien
cagcatgtgagtggacccattcaga

SEQ ID NO: 164600 - DNA, 25 bp, Homo sapien
gtggacccattcagaaactttctgc

SEQ ID NO: 164601 - DNA, 25 bp, Homo sapien
tggacccattcagaaactttctgct

SEQ ID NO: 164602 - DNA, 25 bp, Homo sapien
tcagaaactttctgcttggtggaaa

SEQ ID NO: 164603 - DNA, 25 bp, Homo sapien
aataatgcaagcataccctcccttg

SEQ ID NO: 164604 - DNA, 25 bp, Homo sapien
taccctcccttgagtctcaattgaa

SEQ ID NO: 164605 - DNA, 25 bp, Homo sapien
agatgccagtagtgttcaaagttgt

SEQ ID NO: 164606 - DNA, 25 bp, Homo sapien
aaatactcttatacagtgcaaccca

SEQ ID NO: 164607 - DNA, 25 bp, Homo sapien
cagtgcaacccaaataccgcgaatg

SEQ ID NO: 164608 - DNA, 25 bp, Homo sapien
aataccgcgaatgcatcagctaaag

SEQ ID NO: 164609 - DNA, 25 bp, Homo sapien
atgcatcagctaaagcagcgtgtaa

SEQ ID NO: 164610 - DNA, 25 bp, Homo sapien
aaagcagcgtgtaaataggagtgat

SEQ ID NO: 164611 - DNA, 25 bp, Homo sapien
tttcaaagttcctgataagcattgg

SEQ ID NO: 164612 - DNA, 25 bp, Homo sapien
gacatggataatgaagatttccttt

SEQ ID NO: 164613 - DNA, 25 bp, Homo sapien
ttatatactactgaccaagatgttg

SEQ ID NO: 164614 - DNA, 25 bp, Homo sapien
aaaaatgtcattatcaggtcacata

SEQ ID NO: 164615 - DNA, 25 bp, Homo sapien
atcaggtcacataaatctgccttta

SEQ ID NO: 164616 - DNA, 25 bp, Homo sapien
atctgcctttatgttgcataagtga

SEQ ID NO: 164617 - DNA, 25 bp, Homo sapien
gatgaatcacacttgagatgtttct

SEQ ID NO: 164618 - DNA, 25 bp, Homo sapien
agatgtttcttactcactctgcaca

SEQ ID NO: 164619 - DNA, 25 bp, Homo sapien
gaaatgttatacagggaagtccgtt

SEQ ID NO: 164620 - DNA, 25 bp, Homo sapien
ggaagtccgttttcactattagtat

SEQ ID NO: 164621 - DNA, 25 bp, Homo sapien
aaacagtggtaggagcaatgctttc

SEQ ID NO: 164622 - DNA, 25 bp, Homo sapien
ggagcaatgctttcatagtttcaga

SEQ ID NO: 164623 - DNA, 25 bp, Homo sapien
aaacaatgtcatttgctgctattat

SEQ ID NO: 164624 - DNA, 25 bp, Homo sapien
aatggtactcctataatttttgatt

SEQ ID NO: 164625 - DNA, 25 bp, Homo sapien
ttttgattgtgagctcacctatttg

SEQ ID NO: 164626 - DNA, 25 bp, Homo sapien
tcacctatttgggttaagcatgcca

SEQ ID NO: 164627 - DNA, 25 bp, Homo sapien
gcatgccaatttaaagagaccaagt

SEQ ID NO: 164628 - DNA, 25 bp, Homo sapien
taaaagagactgtctactgcattgg

SEQ ID NO: 164629 - DNA, 25 bp, Homo sapien
ctgcattgggcagcgtaaattcagc

SEQ ID NO: 164630 - DNA, 25 bp, Homo sapien
ggcagcgtaaattcagcaccatgga

SEQ ID NO: 164631 - DNA, 25 bp, Homo sapien
aggcaccaatttttacaagtgaaca

SEQ ID NO: 164632 - DNA, 25 bp, Homo sapien
atatcttgtcaagcatttatcatga

SEQ ID NO: 164633 - DNA, 25 bp, Homo sapien
atttatcatgatactgctgaccaga

SEQ ID NO: 164634 - DNA, 25 bp, Homo sapien
tgatactgctgaccagaagtgactg

SEQ ID NO: 164635 - DNA, 25 bp, Homo sapien
agtgactgctgtgtagctgtaattt

SEQ ID NO: 164636 - DNA, 25 bp, Homo sapien
gctgtgtagctgtaatttgtcatgt

SEQ ID NO: 164637 - DNA, 25 bp, Homo sapien
gaaaatgttgggtccagtcgtgctt

SEQ ID NO: 164638 - DNA, 25 bp, Homo sapien
ggtccagtcgtgcttgattggaaat

SEQ ID NO: 164639 - DNA, 25 bp, Homo sapien
gttgatctgccggagtcttgaaatt

SEQ ID NO: 164640 - DNA, 25 bp, Homo sapien
aattcagctgattggaagtggtttc

SEQ ID NO: 164641 - DNA, 25 bp, Homo sapien
gaagtggtttctttgactttcaagg

SEQ ID NO: 164642 - DNA, 25 bp, Homo sapien
gactttcaaggtcattccctatcag

SEQ ID NO: 164643 - DNA, 25 bp, Homo sapien
attccctatcagttactactaagag

SEQ ID NO: 164644 - DNA, 25 bp, Homo sapien
ctaagagttctcttactgtcagaat

SEQ ID NO: 164645 - DNA, 25 bp, Homo sapien
gaatctctcttgcagtacagctcaa

SEQ ID NO: 164646 - DNA, 25 bp, Homo sapien
gtcatcaatatttctctacattttg

SEQ ID NO: 164647 - DNA, 25 bp, Homo sapien
gtttatctgtaagtcctttaaatct

SEQ ID NO: 164648 - DNA, 25 bp, Homo sapien
atctatttttgctaggcattcatta

SEQ ID NO: 164649 - DNA, 25 bp, Homo sapien
agacaacatttatgtcactccccac

SEQ ID NO: 164650 - DNA, 25 bp, Homo sapien
gaaccttgataattttgacccactg

SEQ ID NO: 164651 - DNA, 25 bp, Homo sapien
ttttgacccactgtaacttagccac

SEQ ID NO: 164652 - DNA, 25 bp, Homo sapien
gtaacttagccactgatgaacctta

SEQ ID NO: 164653 - DNA, 25 bp, Homo sapien
gccactgatgaaccttaaagctgag

SEQ ID NO: 164654 - DNA, 25 bp, Homo sapien
ttaacacctgatttgtattctatta

SEQ ID NO: 164655 - DNA, 25 bp, Homo sapien
atgcatctttggtattgtgcctctg

SEQ ID NO: 164656 - DNA, 25 bp, Homo sapien
tctctttgcctcatagatttagcta

SEQ ID NO: 164657 - DNA, 25 bp, Homo sapien
gatttagctatgttgggaagcacat

SEQ ID NO: 164658 - DNA, 25 bp, Homo sapien
ggaagcacatgcttgctctaggaat

SEQ ID NO: 164659 - DNA, 25 bp, Homo sapien
gcttgctctaggaatatctccaata

SEQ ID NO: 164660 - DNA, 25 bp, Homo sapien
taaagctgttaactatttggtggaa

SEQ ID NO: 164661 - DNA, 25 bp, Homo sapien
gtaaacaatttcttaggacaccatt

SEQ ID NO: 164662 - DNA, 25 bp, Homo sapien
aatttcttaggacaccatttgggct

SEQ ID NO: 164663 - DNA, 25 bp, Homo sapien
aggacaccatttgggctagtttctg

SEQ ID NO: 164664 - DNA, 25 bp, Homo sapien
ggctagtttctgtgtaagtgtaaat

SEQ ID NO: 164665 - DNA, 25 bp, Homo sapien
gtttctgtgtaagtgtaaatactac

SEQ ID NO: 164666 - DNA, 25 bp, Homo sapien
atactgttcttatgtcatttgttat

SEQ ID NO: 164667 - DNA, 25 bp, Homo sapien
gtcatttgttatattcatagattta

SEQ ID NO: 164668 - DNA, 25 bp, Homo sapien
atgatatgacatctggctaaaaaga

SEQ ID NO: 164669 - DNA, 25 bp, Homo sapien
gaaattattgcaaaactaaccacga

SEQ ID NO: 164670 - DNA, 25 bp, Homo sapien
tgcaaaactaaccacgatgtacttt

SEQ ID NO: 164671 - DNA, 25 bp, Homo sapien
ttttaagagctggtactaataaagg

SEQ ID NO: 164672 - DNA, 25 bp, Homo sapien
gattgcacggaggagctctttgact

SEQ ID NO: 164673 - DNA, 25 bp, Homo sapien
gagctctttgacttcttgcatgcga

SEQ ID NO: 164674 - DNA, 25 bp, Homo sapien
tgacttcttgcatgcgagggaccat

SEQ ID NO: 164675 - DNA, 25 bp, Homo sapien
atgcgagggaccattgcgtggccca

SEQ ID NO: 164676 - DNA, 25 bp, Homo sapien
ttgcgtggcccacaaactctttaac

SEQ ID NO: 164677 - DNA, 25 bp, Homo sapien
catctgggcatcagaatatttcctt

SEQ ID NO: 164678 - DNA, 25 bp, Homo sapien
tccttatggttttggatgtaccatt

SEQ ID NO: 164679 - DNA, 25 bp, Homo sapien
ggatgtaccatttgtttcttatttg

SEQ ID NO: 164680 - DNA, 25 bp, Homo sapien
aggctggtagcttctatgtaattcg

SEQ ID NO: 164681 - DNA, 25 bp, Homo sapien
ggtagcttctatgtaattcgcaatg

SEQ ID NO: 164682 - DNA, 25 bp, Homo sapien
gtaattcgcaatgattccatctaaa

SEQ ID NO: 164683 - DNA, 25 bp, Homo sapien
taccactgggtctgcgaggctggcc

SEQ ID NO: 164684 - DNA, 25 bp, Homo sapien
tgggtcagaccagccaggagagtca

SEQ ID NO: 164685 - DNA, 25 bp, Homo sapien
aggagagtcactgagctgcctttgg

SEQ ID NO: 164686 - DNA, 25 bp, Homo sapien
actgagctgcctttggtgggaccac

SEQ ID NO: 164687 - DNA, 25 bp, Homo sapien
ccacccggccacagaaatggcggtg

SEQ ID NO: 164688 - DNA, 25 bp, Homo sapien
gggaggaggactcttctcacgacct

SEQ ID NO: 164689 - DNA, 25 bp, Homo sapien
ctcgcaagaccgctctgggagagaa

SEQ ID NO: 164690 - DNA, 25 bp, Homo sapien
taagcactgggagattggaagcact

SEQ ID NO: 164691 - DNA, 25 bp, Homo sapien
gattggaagcactgctaacattttg

SEQ ID NO: 164692 - DNA, 25 bp, Homo sapien
gatggtatagtgttcttaagctttt

SEQ ID NO: 164693 - DNA, 25 bp, Homo sapien
tttgaaagtcaacttcatgaaggta

SEQ ID NO: 164694 - DNA, 25 bp, Homo sapien
caggcttcctggtgggtgcagccca

SEQ ID NO: 164695 - DNA, 25 bp, Homo sapien
atcagctgggaaagcccaggccgca

SEQ ID NO: 164696 - DNA, 25 bp, Homo sapien
tcagctgggaaagcccaggccgcag

SEQ ID NO: 164697 - DNA, 25 bp, Homo sapien
tgggaaagcccaggccgcaggagtg

SEQ ID NO: 164698 - DNA, 25 bp, Homo sapien
gcccaggccgcaggagtgggatgcc

SEQ ID NO: 164699 - DNA, 25 bp, Homo sapien
tcagctctcaaaggtcactcctggg

SEQ ID NO: 164700 - DNA, 25 bp, Homo sapien
agctctcaaaggtcactcctgggag

SEQ ID NO: 164701 - DNA, 25 bp, Homo sapien
ctctcaaaggtcactcctgggagtt

SEQ ID NO: 164702 - DNA, 25 bp, Homo sapien
tctcaaaggtcactcctgggagttt

SEQ ID NO: 164703 - DNA, 25 bp, Homo sapien
tggaagtggcttaagagccaaaact

SEQ ID NO: 164704 - DNA, 25 bp, Homo sapien
ggcttaagagccaaaactgaaataa

SEQ ID NO: 164705 - DNA, 25 bp, Homo sapien
atgagagccgataccaacgcttctt

SEQ ID NO: 164706 - DNA, 25 bp, Homo sapien
acgcttctttgcctggcgtgacagg

SEQ ID NO: 164707 - DNA, 25 bp, Homo sapien
gacaggctccgcgtgcgactgttca

SEQ ID NO: 164708 - DNA, 25 bp, Homo sapien
gactgttcaccgactggcgggaacg

SEQ ID NO: 164709 - DNA, 25 bp, Homo sapien
gggaacgtttctgtgccatctgtga

SEQ ID NO: 164710 - DNA, 25 bp, Homo sapien
taccccgcagccaagtctatgagga

SEQ ID NO: 164711 - DNA, 25 bp, Homo sapien
gaccttgagggttggtttcaggcct

SEQ ID NO: 164712 - DNA, 25 bp, Homo sapien
ggtttcaggcctgagatccgctggc

SEQ ID NO: 164713 - DNA, 25 bp, Homo sapien
gaagggctgggtgtcgaaatcaaac

SEQ ID NO: 164714 - DNA, 25 bp, Homo sapien
gaaatcaaaccaccaggcatccggc

SEQ ID NO: 164715 - DNA, 25 bp, Homo sapien
ttaccggcaagcagcgggctaacgg

SEQ ID NO: 164716 - DNA, 25 bp, Homo sapien
acactgaaagaatgggtgcaaattt

SEQ ID NO: 164717 - DNA, 25 bp, Homo sapien
agaatgggtgcaaatttgtcagggt

SEQ ID NO: 164718 - DNA, 25 bp, Homo sapien
aagatcaactcagttgtcgcatcat

SEQ ID NO: 164719 - DNA, 25 bp, Homo sapien
gatcaactcagttgtcgcatcattc

SEQ ID NO: 164720 - DNA, 25 bp, Homo sapien
ttcatggttctatattgatgttctt

SEQ ID NO: 164721 - DNA, 25 bp, Homo sapien
tgatgttcttcaagtcagtggcctg

SEQ ID NO: 164722 - DNA, 25 bp, Homo sapien
gatgttcttcaagtcagtggcctga

SEQ ID NO: 164723 - DNA, 25 bp, Homo sapien
gtgagtgctatataaagcatggtag

SEQ ID NO: 164724 - DNA, 25 bp, Homo sapien
taaagcatggtagtggaattgtttg

SEQ ID NO: 164725 - DNA, 25 bp, Homo sapien
gacatatgacccttggtcactggtg

SEQ ID NO: 164726 - DNA, 25 bp, Homo sapien
acattctggacacatcaatagtcaa

SEQ ID NO: 164727 - DNA, 25 bp, Homo sapien
gtgccaaggcaatcagatctttatg

SEQ ID NO: 164728 - DNA, 25 bp, Homo sapien
atgagagcagtattttctgtgtttt

SEQ ID NO: 164729 - DNA, 25 bp, Homo sapien
cagctttcagacagagcccacttag

SEQ ID NO: 164730 - DNA, 25 bp, Homo sapien
agcccacttagcttgtccacatgga

SEQ ID NO: 164731 - DNA, 25 bp, Homo sapien
tgtccacatggatctcaatgccaat

SEQ ID NO: 164732 - DNA, 25 bp, Homo sapien
atctcaatgccaatcctccattctt

SEQ ID NO: 164733 - DNA, 25 bp, Homo sapien
agtgacaaacattctctcatcctac

SEQ ID NO: 164734 - DNA, 25 bp, Homo sapien
acattctctcatcctacttagccta

SEQ ID NO: 164735 - DNA, 25 bp, Homo sapien
tagcctacctagatttctcatgacg

SEQ ID NO: 164736 - DNA, 25 bp, Homo sapien
gacgagttaatgcatgtccgtggtt

SEQ ID NO: 164737 - DNA, 25 bp, Homo sapien
atgtccgtggttgggtgcacctgta

SEQ ID NO: 164738 - DNA, 25 bp, Homo sapien
cgagcccaggcagctatttcagcct

SEQ ID NO: 164739 - DNA, 25 bp, Homo sapien
caatgtctgaaaagggactgtgagt

SEQ ID NO: 164740 - DNA, 25 bp, Homo sapien
aagggactgtgagtaatggctgtca

SEQ ID NO: 164741 - DNA, 25 bp, Homo sapien
atggctgtcacttgtcgggggccca

SEQ ID NO: 164742 - DNA, 25 bp, Homo sapien
ggtgctctggtctgaccgatgtgtc

SEQ ID NO: 164743 - DNA, 25 bp, Homo sapien
ggtctgaccgatgtgtctcccagaa

SEQ ID NO: 164744 - DNA, 25 bp, Homo sapien
tgaccgatgtgtctcccagaactat

SEQ ID NO: 164745 - DNA, 25 bp, Homo sapien
cgatgtgtctcccagaactattctg

SEQ ID NO: 164746 - DNA, 25 bp, Homo sapien
atgtgtctcccagaactattctggg

SEQ ID NO: 164747 - DNA, 25 bp, Homo sapien
aaaggcacactggtatttatatttc

SEQ ID NO: 164748 - DNA, 25 bp, Homo sapien
aggcacactggtatttatatttcaa

SEQ ID NO: 164749 - DNA, 25 bp, Homo sapien
gatgttttcctctttcagatttttg

SEQ ID NO: 164750 - DNA, 25 bp, Homo sapien
atccataaccaagtcctcctatggg

SEQ ID NO: 164751 - DNA, 25 bp, Homo sapien
aaccaagtcctcctatgggtacata

SEQ ID NO: 164752 - DNA, 25 bp, Homo sapien
gtcctcctatgggtacataaaccca

SEQ ID NO: 164753 - DNA, 25 bp, Homo sapien
agttataacatgtaccctgcttccc

SEQ ID NO: 164754 - DNA, 25 bp, Homo sapien
tcactaaataagcatgtagctcagt

SEQ ID NO: 164755 - DNA, 25 bp, Homo sapien
agtggtttccaaatttggctgcaca

SEQ ID NO: 164756 - DNA, 25 bp, Homo sapien
ttccaaatttggctgcacattcata

SEQ ID NO: 164757 - DNA, 25 bp, Homo sapien
tgcacattcataccaatcaccaggg

SEQ ID NO: 164758 - DNA, 25 bp, Homo sapien
tgatgcccaacttgcactccacatt

SEQ ID NO: 164759 - DNA, 25 bp, Homo sapien
aacttgcactccacattaattaaca

SEQ ID NO: 164760 - DNA, 25 bp, Homo sapien
agggactagccgctgtcgcacagcc

SEQ ID NO: 164761 - DNA, 25 bp, Homo sapien
gggtgcttggtctctgcaaagtcaa

SEQ ID NO: 164762 - DNA, 25 bp, Homo sapien
ggtctctgcaaagtcaaaggcctga

SEQ ID NO: 164763 - DNA, 25 bp, Homo sapien
tgcaaagtcaaaggcctgacagctc

SEQ ID NO: 164764 - DNA, 25 bp, Homo sapien
tgggaatccattttcctgcgggaga

SEQ ID NO: 164765 - DNA, 25 bp, Homo sapien
attttcctgcgggagagcagggcct

SEQ ID NO: 164766 - DNA, 25 bp, Homo sapien
aaccagggagctgtgggaagccaca

SEQ ID NO: 164767 - DNA, 25 bp, Homo sapien
gaaaaacaggtctcagcccagggtc

SEQ ID NO: 164768 - DNA, 25 bp, Homo sapien
actttgaagccatctctgttctgca

SEQ ID NO: 164769 - DNA, 25 bp, Homo sapien
aagccatctctgttctgcaggtgag

SEQ ID NO: 164770 - DNA, 25 bp, Homo sapien
tctgttctgcaggtgagaggattta

SEQ ID NO: 164771 - DNA, 25 bp, Homo sapien
tcccgggagggattccggaattgag

SEQ ID NO: 164772 - DNA, 25 bp, Homo sapien
gggcacgcaggattctgagcaccag

SEQ ID NO: 164773 - DNA, 25 bp, Homo sapien
ggcacgcaggattctgagcaccagg

SEQ ID NO: 164774 - DNA, 25 bp, Homo sapien
agaggcggccagacaacctcaggga

SEQ ID NO: 164775 - DNA, 25 bp, Homo sapien
ggcggccagacaacctcagggagga

SEQ ID NO: 164776 - DNA, 25 bp, Homo sapien
gacaacctcagggaggagtgtcctg

SEQ ID NO: 164777 - DNA, 25 bp, Homo sapien
caacctcagggaggagtgtcctggc

SEQ ID NO: 164778 - DNA, 25 bp, Homo sapien
tcagggaggagtgtcctggcgtccc

SEQ ID NO: 164779 - DNA, 25 bp, Homo sapien
ccatcctccaaagggcctgggcccg

SEQ ID NO: 164780 - DNA, 25 bp, Homo sapien
actttcccatctcctcggtataaat

SEQ ID NO: 164781 - DNA, 25 bp, Homo sapien
tggaagaaccgggacattttacaga

SEQ ID NO: 164782 - DNA, 25 bp, Homo sapien
aatgaaaccttgatgttacgggcta

SEQ ID NO: 164783 - DNA, 25 bp, Homo sapien
ttacgggctaaatcaagagcagctt

SEQ ID NO: 164784 - DNA, 25 bp, Homo sapien
caagagcagcttaatcctgtttaca

SEQ ID NO: 164785 - DNA, 25 bp, Homo sapien
tcctgtttacaatgtgagctttttg

SEQ ID NO: 164786 - DNA, 25 bp, Homo sapien
tgtgagctttttgtgcgtctgtgaa

SEQ ID NO: 164787 - DNA, 25 bp, Homo sapien
agttctgtctatgtatcttaatcac

SEQ ID NO: 164788 - DNA, 25 bp, Homo sapien
gtatcttaatcacaaatggtttcat

SEQ ID NO: 164789 - DNA, 25 bp, Homo sapien
gtacattgaacggaaagccttcctc

SEQ ID NO: 164790 - DNA, 25 bp, Homo sapien
gaaagccttcctcgaccgagtggat

SEQ ID NO: 164791 - DNA, 25 bp, Homo sapien
cgaccgagtggatcacaggcagttt

SEQ ID NO: 164792 - DNA, 25 bp, Homo sapien
aattgagcgagatctcaggctgagc

SEQ ID NO: 164793 - DNA, 25 bp, Homo sapien
acctcgtccggagcactgtgaggga

SEQ ID NO: 164794 - DNA, 25 bp, Homo sapien
tcctgctgtgcctccaaatacagat

SEQ ID NO: 164795 - DNA, 25 bp, Homo sapien
tgtgcctccaaatacagatgtcatg

SEQ ID NO: 164796 - DNA, 25 bp, Homo sapien
atacagatgtcatggcctgcacaca

SEQ ID NO: 164797 - DNA, 25 bp, Homo sapien
gatgtcatggcctgcacacagacag

SEQ ID NO: 164798 - DNA, 25 bp, Homo sapien
ttgcagaagctgacctgggcctctg

SEQ ID NO: 164799 - DNA, 25 bp, Homo sapien
tccctggagactagcatccagctgt

SEQ ID NO: 164800 - DNA, 25 bp, Homo sapien
gagactagcatccagctgtgtggcc

SEQ ID NO: 164801 - DNA, 25 bp, Homo sapien
ttatccgcgcatgtgcggaggccct

SEQ ID NO: 164802 - DNA, 25 bp, Homo sapien
agcctgcagcagctacagcactaag

SEQ ID NO: 164803 - DNA, 25 bp, Homo sapien
agctacagcactaagagaagcccct

SEQ ID NO: 164804 - DNA, 25 bp, Homo sapien
tggtactacgccaaggttgagctgg

SEQ ID NO: 164805 - DNA, 25 bp, Homo sapien
tactacgccaaggttgagctggttc

SEQ ID NO: 164806 - DNA, 25 bp, Homo sapien
tacgccaaggttgagctggttcctc

SEQ ID NO: 164807 - DNA, 25 bp, Homo sapien
gccaaggttgagctggttcctccca

SEQ ID NO: 164808 - DNA, 25 bp, Homo sapien
gccactgaggtgttgatgtggtttt

SEQ ID NO: 164809 - DNA, 25 bp, Homo sapien
atgtggttttatgtcggagagatta

SEQ ID NO: 164810 - DNA, 25 bp, Homo sapien
tatgtcggagagattataggcaagc

SEQ ID NO: 164811 - DNA, 25 bp, Homo sapien
gattataggcaagcggggcatcatt

SEQ ID NO: 164812 - DNA, 25 bp, Homo sapien
gtttgaagaccaatctttaacatct

SEQ ID NO: 164813 - DNA, 25 bp, Homo sapien
gaagaccaatctttaacatctgatt

SEQ ID NO: 164814 - DNA, 25 bp, Homo sapien
gaccaatctttaacatctgattata

SEQ ID NO: 164815 - DNA, 25 bp, Homo sapien
ggaatctctctccagttactgggag

SEQ ID NO: 164816 - DNA, 25 bp, Homo sapien
gagtcagcaaagacagccgcccaga

SEQ ID NO: 164817 - DNA, 25 bp, Homo sapien
tgtacgagaagacatacctgcccgc

SEQ ID NO: 164818 - DNA, 25 bp, Homo sapien
acctgcccgctgtagatgagaaact

SEQ ID NO: 164819 - DNA, 25 bp, Homo sapien
gaaactcagggacttgtacagcaaa

SEQ ID NO: 164820 - DNA, 25 bp, Homo sapien
aaaagcacagcagccatgagcactt

SEQ ID NO: 164821 - DNA, 25 bp, Homo sapien
gccatgagcacttagacaggcattt

SEQ ID NO: 164822 - DNA, 25 bp, Homo sapien
agacaggcatttttactgaccaagt

SEQ ID NO: 164823 - DNA, 25 bp, Homo sapien
aagttctttctgtgctgaagggaga

SEQ ID NO: 164824 - DNA, 25 bp, Homo sapien
gagaggagtaacagccagacacagc

SEQ ID NO: 164825 - DNA, 25 bp, Homo sapien
gccagacacagccagactggacaag

SEQ ID NO: 164826 - DNA, 25 bp, Homo sapien
tttcatttcacttatcttgcatatc

SEQ ID NO: 164827 - DNA, 25 bp, Homo sapien
tcatttcacttatcttgcatatctt

SEQ ID NO: 164828 - DNA, 25 bp, Homo sapien
atttcacttatcttgcatatcttaa

SEQ ID NO: 164829 - DNA, 25 bp, Homo sapien
tttcacttatcttgcatatcttaaa

SEQ ID NO: 164830 - DNA, 25 bp, Homo sapien
tttgtacagagttgaagttgttttt

SEQ ID NO: 164831 - DNA, 25 bp, Homo sapien
gaaatgccatatttgacttggcttc

SEQ ID NO: 164832 - DNA, 25 bp, Homo sapien
aatgccatatttgacttggcttctg

SEQ ID NO: 164833 - DNA, 25 bp, Homo sapien
atgccatatttgacttggcttctgg

SEQ ID NO: 164834 - DNA, 25 bp, Homo sapien
tgccatatttgacttggcttctggt

SEQ ID NO: 164835 - DNA, 25 bp, Homo sapien
cttctggtcttgatgtatttgataa

SEQ ID NO: 164836 - DNA, 25 bp, Homo sapien
tctggtcttgatgtatttgataaga

SEQ ID NO: 164837 - DNA, 25 bp, Homo sapien
ccagaaggaggtggacacttcagaa

SEQ ID NO: 164838 - DNA, 25 bp, Homo sapien
aaggaggtggacacttcagaaaaga

SEQ ID NO: 164839 - DNA, 25 bp, Homo sapien
gaaaagaaacttctcgagcggctcc

SEQ ID NO: 164840 - DNA, 25 bp, Homo sapien
aagaaacttctcgagcggctccctg

SEQ ID NO: 164841 - DNA, 25 bp, Homo sapien
ttctcgagcggctccctgaggttga

SEQ ID NO: 164842 - DNA, 25 bp, Homo sapien
tcaggattcctgatgctccaaggcg

SEQ ID NO: 164843 - DNA, 25 bp, Homo sapien
attcctgatgctccaaggcgactga

SEQ ID NO: 164844 - DNA, 25 bp, Homo sapien
atgctccaaggcgactgatgggcgc

SEQ ID NO: 164845 - DNA, 25 bp, Homo sapien
actgatgggcgctggatgaagtggc

SEQ ID NO: 164846 - DNA, 25 bp, Homo sapien
atgaagtggcacagtcagcttccct

SEQ ID NO: 164847 - DNA, 25 bp, Homo sapien
aagtggcacagtcagcttccctggg

SEQ ID NO: 164848 - DNA, 25 bp, Homo sapien
tccacctggagacccggagacagag

SEQ ID NO: 164849 - DNA, 25 bp, Homo sapien
agaggcctggacaaggagtgaacac

SEQ ID NO: 164850 - DNA, 25 bp, Homo sapien
gaacacgggaactgtcacgactgga

SEQ ID NO: 164851 - DNA, 25 bp, Homo sapien
aactgtcacgactggaagggcgtga

SEQ ID NO: 164852 - DNA, 25 bp, Homo sapien
gactggaagggcgtgaggcctccca

SEQ ID NO: 164853 - DNA, 25 bp, Homo sapien
cagcagtgccgcagcgtttcgaggg

SEQ ID NO: 164854 - DNA, 25 bp, Homo sapien
ggaccccaccactgtgggttgcagg

SEQ ID NO: 164855 - DNA, 25 bp, Homo sapien
ggttgcaggcccaatgcagaagagt

SEQ ID NO: 164856 - DNA, 25 bp, Homo sapien
caggcccaatgcagaagagtattaa

SEQ ID NO: 164857 - DNA, 25 bp, Homo sapien
aagatgctcaagtcccatggcacag

SEQ ID NO: 164858 - DNA, 25 bp, Homo sapien
gctcaagtcccatggcacagagcaa

SEQ ID NO: 164859 - DNA, 25 bp, Homo sapien
atgaggcccagcaaacaggcattct

SEQ ID NO: 164860 - DNA, 25 bp, Homo sapien
aggcattctcacagctgggtttata

SEQ ID NO: 164861 - DNA, 25 bp, Homo sapien
cagctgggtttatagtctttgggcc

SEQ ID NO: 164862 - DNA, 25 bp, Homo sapien
gtctttgggccccttactcagtatc

SEQ ID NO: 164863 - DNA, 25 bp, Homo sapien
tactcagtatcctgggaaccctggg

SEQ ID NO: 164864 - DNA, 25 bp, Homo sapien
caggaggttacagtggtcatcataa

SEQ ID NO: 164865 - DNA, 25 bp, Homo sapien
ggttacagtggtcatcataattgct

SEQ ID NO: 164866 - DNA, 25 bp, Homo sapien
ataattgctgaagagatcccctccc

SEQ ID NO: 164867 - DNA, 25 bp, Homo sapien
gcacccaggctttagagaagtatag

SEQ ID NO: 164868 - DNA, 25 bp, Homo sapien
tgggcttaccacactgctctcaggc

SEQ ID NO: 164869 - DNA, 25 bp, Homo sapien
tcaaaccctttcatacctttattct

SEQ ID NO: 164870 - DNA, 25 bp, Homo sapien
gttgggagagtctctgttcctgctg

SEQ ID NO: 164871 - DNA, 25 bp, Homo sapien
tacaactgtaccatagtcctgggaa

SEQ ID NO: 164872 - DNA, 25 bp, Homo sapien
aaagggtggactcaccgctgttgtt

SEQ ID NO: 164873 - DNA, 25 bp, Homo sapien
gactcaccgctgttgttttatggga

SEQ ID NO: 164874 - DNA, 25 bp, Homo sapien
ttatgggaagtcgtgtcatcctagg

SEQ ID NO: 164875 - DNA, 25 bp, Homo sapien
ccagggtgagcacaggacctctgta

SEQ ID NO: 164876 - DNA, 25 bp, Homo sapien
acaggacctctgtaagctgcttgtg

SEQ ID NO: 164877 - DNA, 25 bp, Homo sapien
aagctgcttgtgtattgtccacttt

SEQ ID NO: 164878 - DNA, 25 bp, Homo sapien
gtattgtccactttgacgatcagtc

SEQ ID NO: 164879 - DNA, 25 bp, Homo sapien
gacgatcagtcattcggtccgttga

SEQ ID NO: 164880 - DNA, 25 bp, Homo sapien
ggtccgttgatcaataatccttcga

SEQ ID NO: 164881 - DNA, 25 bp, Homo sapien
gtctcagttgcttgctcttgtgcct

SEQ ID NO: 164882 - DNA, 25 bp, Homo sapien
tgctcttgtgcctcctgggcaaggg

SEQ ID NO: 164883 - DNA, 25 bp, Homo sapien
aagggctgaaggaggccactccatc

SEQ ID NO: 164884 - DNA, 25 bp, Homo sapien
gctgccctcaatgtgggagtgaccc

SEQ ID NO: 164885 - DNA, 25 bp, Homo sapien
gaccccagccagatctgaaggacat

SEQ ID NO: 164886 - DNA, 25 bp, Homo sapien
agagggatgcccaggaacgcctcat

SEQ ID NO: 164887 - DNA, 25 bp, Homo sapien
aggaacgcctcatctcagcagcctg

SEQ ID NO: 164888 - DNA, 25 bp, Homo sapien
tgggctcggcattccgaagctgact

SEQ ID NO: 164889 - DNA, 25 bp, Homo sapien
gaagctgactttctataggcaattt

SEQ ID NO: 164890 - DNA, 25 bp, Homo sapien
aggcaattttgtacctttgtggaga

SEQ ID NO: 164891 - DNA, 25 bp, Homo sapien
ttgtggagaaatgtgtcacctcccc

SEQ ID NO: 164892 - DNA, 25 bp, Homo sapien
gaatctgtttcactcaatggattgt

SEQ ID NO: 164893 - DNA, 25 bp, Homo sapien
gaaggctcctaaatttgagttgttt

SEQ ID NO: 164894 - DNA, 25 bp, Homo sapien
gagttgtttgctaatcatttcattt

SEQ ID NO: 164895 - DNA, 25 bp, Homo sapien
tcatttgcatcattagggtatcctt

SEQ ID NO: 164896 - DNA, 25 bp, Homo sapien
gggtatccttaaactgattttctat

SEQ ID NO: 164897 - DNA, 25 bp, Homo sapien
gtggagaatatgtgcatctacacta

SEQ ID NO: 164898 - DNA, 25 bp, Homo sapien
agatatcaaaaacctctcctcgtgc

SEQ ID NO: 164899 - DNA, 25 bp, Homo sapien
ctctcctcgtgcttcaaaatgacag

SEQ ID NO: 164900 - DNA, 25 bp, Homo sapien
acaggaatcctgtgcattatactaa

SEQ ID NO: 164901 - DNA, 25 bp, Homo sapien
attacatgccataagatgacttcag

SEQ ID NO: 164902 - DNA, 25 bp, Homo sapien
gatgacttcagaaatcctacttcag

SEQ ID NO: 164903 - DNA, 25 bp, Homo sapien
cggaaaatccgccagagctactttg

SEQ ID NO: 164904 - DNA, 25 bp, Homo sapien
aaaatccgccagagctactttgcct

SEQ ID NO: 164905 - DNA, 25 bp, Homo sapien
agctactttgcctctgtgtcatatt

SEQ ID NO: 164906 - DNA, 25 bp, Homo sapien
actttgcctctgtgtcatatttgga

SEQ ID NO: 164907 - DNA, 25 bp, Homo sapien
ttgcctctgtgtcatatttggatac

SEQ ID NO: 164908 - DNA, 25 bp, Homo sapien
tatttggatacacaggtcggccgcc

SEQ ID NO: 164909 - DNA, 25 bp, Homo sapien
ggatacacaggtcggccgcctcttg

SEQ ID NO: 164910 - DNA, 25 bp, Homo sapien
ccgcctcttgagtgctttggacgat

SEQ ID NO: 164911 - DNA, 25 bp, Homo sapien
ctcttgagtgctttggacgatcttc

SEQ ID NO: 164912 - DNA, 25 bp, Homo sapien
agtgctttggacgatcttcagctgg

SEQ ID NO: 164913 - DNA, 25 bp, Homo sapien
tggacgatcttcagctggccaacag

SEQ ID NO: 164914 - DNA, 25 bp, Homo sapien
tacatctgggctctggccgagacac

SEQ ID NO: 164915 - DNA, 25 bp, Homo sapien
catctgggctctggccgagacactg

SEQ ID NO: 164916 - DNA, 25 bp, Homo sapien
gggctctggccgagacactgcgcct

SEQ ID NO: 164917 - DNA, 25 bp, Homo sapien
gctctggccgagacactgcgcctgg

SEQ ID NO: 164918 - DNA, 25 bp, Homo sapien
gcgcctggcggatcaagggctgccc

SEQ ID NO: 164919 - DNA, 25 bp, Homo sapien
ctggcggatcaagggctgcccggag

SEQ ID NO: 164920 - DNA, 25 bp, Homo sapien
aagggctgcccggaggcggtgcccg

SEQ ID NO: 164921 - DNA, 25 bp, Homo sapien
caagccccgccagcgacgcggagtc

SEQ ID NO: 164922 - DNA, 25 bp, Homo sapien
agccgcctccgaagacttcacctac

SEQ ID NO: 164923 - DNA, 25 bp, Homo sapien
tgcccaaagacttgctccacacaac

SEQ ID NO: 164924 - DNA, 25 bp, Homo sapien
gccctgtttcattccttaccactag

SEQ ID NO: 164925 - DNA, 25 bp, Homo sapien
agcatcagctccaagactctctgct

SEQ ID NO: 164926 - DNA, 25 bp, Homo sapien
gcctcgaagggattcctggagcagc

SEQ ID NO: 164927 - DNA, 25 bp, Homo sapien
gaagggattcctggagcagcaacca

SEQ ID NO: 164928 - DNA, 25 bp, Homo sapien
agcaaccactgcagcgactagggac

SEQ ID NO: 164929 - DNA, 25 bp, Homo sapien
gcagcgactagggacacttgtaaat

SEQ ID NO: 164930 - DNA, 25 bp, Homo sapien
gaaatcaggaacatttttgcagctt

SEQ ID NO: 164931 - DNA, 25 bp, Homo sapien
ggaacatttttgcagcttgtttctg

SEQ ID NO: 164932 - DNA, 25 bp, Homo sapien
ttctggagttgtttgcgcataaagg

SEQ ID NO: 164933 - DNA, 25 bp, Homo sapien
ttgcgcataaaggaatggtggactt

SEQ ID NO: 164934 - DNA, 25 bp, Homo sapien
gtggactttcacaaatatcttttta

SEQ ID NO: 164935 - DNA, 25 bp, Homo sapien
aaaccaacagcgatctcaagcttaa

SEQ ID NO: 164936 - DNA, 25 bp, Homo sapien
tcctggagaaggacctgagggacaa

SEQ ID NO: 164937 - DNA, 25 bp, Homo sapien
ctggagcaacagcaggaacagcatc

SEQ ID NO: 164938 - DNA, 25 bp, Homo sapien
gatgctggcccctttggagagctga

SEQ ID NO: 164939 - DNA, 25 bp, Homo sapien
gctgagctgcccctggtgcactggc

SEQ ID NO: 164940 - DNA, 25 bp, Homo sapien
cctgtctgtctgtcccaaagaagtt

SEQ ID NO: 164941 - DNA, 25 bp, Homo sapien
gtctgtctgtcccaaagaagttctg

SEQ ID NO: 164942 - DNA, 25 bp, Homo sapien
tctgtctgtcccaaagaagttctgg

SEQ ID NO: 164943 - DNA, 25 bp, Homo sapien
ttctggtatgaacttgaggacacat

SEQ ID NO: 164944 - DNA, 25 bp, Homo sapien
cttgaggacacatgtccagtgggag

SEQ ID NO: 164945 - DNA, 25 bp, Homo sapien
acacatgtccagtgggaggtgagac

SEQ ID NO: 164946 - DNA, 25 bp, Homo sapien
tgtccagtgggaggtgagaccacct

SEQ ID NO: 164947 - DNA, 25 bp, Homo sapien
cacggtcttcatgattaagtacctt

SEQ ID NO: 164948 - DNA, 25 bp, Homo sapien
taagtaccttatgacgctgatcgtg

SEQ ID NO: 164949 - DNA, 25 bp, Homo sapien
aagaccctcaactcctggaggaagt

SEQ ID NO: 164950 - DNA, 25 bp, Homo sapien
aggaagttctacacgaggctcacca

SEQ ID NO: 164951 - DNA, 25 bp, Homo sapien
gaggctcaccaacagcaaacaaggg

SEQ ID NO: 164952 - DNA, 25 bp, Homo sapien
tggagttcgtgccaatcctgacatc

SEQ ID NO: 164953 - DNA, 25 bp, Homo sapien
gtgccaatcctgacatctcgaggtt

SEQ ID NO: 164954 - DNA, 25 bp, Homo sapien
ctgacatctcgaggtttcctcacta

SEQ ID NO: 164955 - DNA, 25 bp, Homo sapien
tctttcgcaggctcctttgaacaac

SEQ ID NO: 164956 - DNA, 25 bp, Homo sapien
gcaggctcctttgaacaactcagct

SEQ ID NO: 164957 - DNA, 25 bp, Homo sapien
tttgaacaactcagctcctgcaaaa

SEQ ID NO: 164958 - DNA, 25 bp, Homo sapien
ggtgctcgccgtgttccggagcgga

SEQ ID NO: 164959 - DNA, 25 bp, Homo sapien
ggagcggagaggagcgcgcgcggcg

SEQ ID NO: 164960 - DNA, 25 bp, Homo sapien
gcggcgcgggagtagcgcgctgtgg

SEQ ID NO: 164961 - DNA, 25 bp, Homo sapien
gcggaagcctcgtgctaccctggag

SEQ ID NO: 164962 - DNA, 25 bp, Homo sapien
cggaagcctcgtgctaccctggagg

SEQ ID NO: 164963 - DNA, 25 bp, Homo sapien
gaagcctcgtgctaccctggaggga

SEQ ID NO: 164964 - DNA, 25 bp, Homo sapien
aagcctcgtgctaccctggagggac

SEQ ID NO: 164965 - DNA, 25 bp, Homo sapien
ctcgtgctaccctggagggacgcgt

SEQ ID NO: 164966 - DNA, 25 bp, Homo sapien
gtgctaccctggagggacgcgtgga

SEQ ID NO: 164967 - DNA, 25 bp, Homo sapien
ggaggctgcagcgacgcgaacggcg

SEQ ID NO: 164968 - DNA, 25 bp, Homo sapien
aggctgcagcgacgcgaacggcggg

SEQ ID NO: 164969 - DNA, 25 bp, Homo sapien
aaagaacagatttgcctccaggtcc

SEQ ID NO: 164970 - DNA, 25 bp, Homo sapien
gcctccaggtcccagtgaatgaaaa

SEQ ID NO: 164971 - DNA, 25 bp, Homo sapien
tccaggtcccagtgaatgaaaacga

SEQ ID NO: 164972 - DNA, 25 bp, Homo sapien
ggtcccagtgaatgaaaacgacatg

SEQ ID NO: 164973 - DNA, 25 bp, Homo sapien
aggtagatgaagtcctttacgaaga

SEQ ID NO: 164974 - DNA, 25 bp, Homo sapien
gaagtcctttacgaagactcgtcaa

SEQ ID NO: 164975 - DNA, 25 bp, Homo sapien
gaagactcgtcaacagcttaaatct

SEQ ID NO: 164976 - DNA, 25 bp, Homo sapien
gactcgtcaacagcttaaatctgga

SEQ ID NO: 164977 - DNA, 25 bp, Homo sapien
gcttaaatctggattactacagcca

SEQ ID NO: 164978 - DNA, 25 bp, Homo sapien
ttactacagccaaataatcagtgtt

SEQ ID NO: 164979 - DNA, 25 bp, Homo sapien
gaaataccttatataaaaccatctt

SEQ ID NO: 164980 - DNA, 25 bp, Homo sapien
actgtgctttatcaggacatcactc

SEQ ID NO: 164981 - DNA, 25 bp, Homo sapien
tgtgctttatcaggacatcactctg

SEQ ID NO: 164982 - DNA, 25 bp, Homo sapien
gctttatcaggacatcactctgagt

SEQ ID NO: 164983 - DNA, 25 bp, Homo sapien
tcaggacatcactctgagtatccgt

SEQ ID NO: 164984 - DNA, 25 bp, Homo sapien
ggacatcactctgagtatccgtcca

SEQ ID NO: 164985 - DNA, 25 bp, Homo sapien
acatcactctgagtatccgtccaga

SEQ ID NO: 164986 - DNA, 25 bp, Homo sapien
atcactctgagtatccgtccagaga

SEQ ID NO: 164987 - DNA, 25 bp, Homo sapien
tctgagtatccgtccagagactcac

SEQ ID NO: 164988 - DNA, 25 bp, Homo sapien
gagtatccgtccagagactcactct

SEQ ID NO: 164989 - DNA, 25 bp, Homo sapien
tcactctcctgggatgttctcatgg

SEQ ID NO: 164990 - DNA, 25 bp, Homo sapien
actctcctgggatgttctcatggtt

SEQ ID NO: 164991 - DNA, 25 bp, Homo sapien
gaactaaaatggtctactgcaaaat

SEQ ID NO: 164992 - DNA, 25 bp, Homo sapien
tgcaaaattgatcagacccagagaa

SEQ ID NO: 164993 - DNA, 25 bp, Homo sapien
cccagagaaaagtagttgtcagtca

SEQ ID NO: 164994 - DNA, 25 bp, Homo sapien
gttgtcagtcatagcacacatcgga

SEQ ID NO: 164995 - DNA, 25 bp, Homo sapien
agcacacatcggacatttggaaaac

SEQ ID NO: 164996 - DNA, 25 bp, Homo sapien
cagcggtggcaacaactgtatgaca

SEQ ID NO: 164997 - DNA, 25 bp, Homo sapien
ctgtatgacacacttaatgcctgga

SEQ ID NO: 164998 - DNA, 25 bp, Homo sapien
tgacacacttaatgcctggaaacaa

SEQ ID NO: 164999 - DNA, 25 bp, Homo sapien
ttgagtctttccgatacctgagttt

SEQ ID NO: 165000 - DNA, 25 bp, Homo sapien
ctttccgatacctgagtttttatgc

SEQ ID NO: 165001 - DNA, 25 bp, Homo sapien
catttgttattgacgccgtaagaac

SEQ ID NO: 165002 - DNA, 25 bp, Homo sapien
gtgggtcaaatgtttccattttcaa

SEQ ID NO: 165003 - DNA, 25 bp, Homo sapien
aatgaaactgttgctccattggagt

SEQ ID NO: 165004 - DNA, 25 bp, Homo sapien
gttgctccattggagtagtctccca

SEQ ID NO: 165005 - DNA, 25 bp, Homo sapien
gagtagtctcccacctaaatatcaa

SEQ ID NO: 165006 - DNA, 25 bp, Homo sapien
gtctcccacctaaatatcaagatgg

SEQ ID NO: 165007 - DNA, 25 bp, Homo sapien
gctaattgtcctatgatgctattat

SEQ ID NO: 165008 - DNA, 25 bp, Homo sapien
gatgctattatcatagactaatgac

SEQ ID NO: 165009 - DNA, 25 bp, Homo sapien
atgacatttatcttcaaaacaccaa

SEQ ID NO: 165010 - DNA, 25 bp, Homo sapien
atgtgattacaggtagaggccttct

SEQ ID NO: 165011 - DNA, 25 bp, Homo sapien
aggtagaggccttctaggtgagaca

SEQ ID NO: 165012 - DNA, 25 bp, Homo sapien
ggccttctaggtgagacacttttaa

SEQ ID NO: 165013 - DNA, 25 bp, Homo sapien
tgtgctgcttgtgcgcagggatcga

SEQ ID NO: 165014 - DNA, 25 bp, Homo sapien
tgcttgtgcgcagggatcgagacgg

SEQ ID NO: 165015 - DNA, 25 bp, Homo sapien
atcgagacgggcagcactcatgggt

SEQ ID NO: 165016 - DNA, 25 bp, Homo sapien
gacgggcagcactcatgggtgccaa

SEQ ID NO: 165017 - DNA, 25 bp, Homo sapien
agccccagtccagagttgggcacca

SEQ ID NO: 165018 - DNA, 25 bp, Homo sapien
cagagttgggcaccacaccggccag

SEQ ID NO: 165019 - DNA, 25 bp, Homo sapien
agttgggcaccacaccggccagcat

SEQ ID NO: 165020 - DNA, 25 bp, Homo sapien
tgcagctcgacccgcagcaggagca

SEQ ID NO: 165021 - DNA, 25 bp, Homo sapien
agcagcagctgttccggcgcctgga

SEQ ID NO: 165022 - DNA, 25 bp, Homo sapien
agcagctgttccggcgcctggaaga

SEQ ID NO: 165023 - DNA, 25 bp, Homo sapien
gaggagttcctggccaatgcccggg

SEQ ID NO: 165024 - DNA, 25 bp, Homo sapien
ctagtatctgccttattttcttaag

SEQ ID NO: 165025 - DNA, 25 bp, Homo sapien
ctgccttattttcttaagtctgatg

SEQ ID NO: 165026 - DNA, 25 bp, Homo sapien
aagtctgatgttaatttttgtttca

SEQ ID NO: 165027 - DNA, 25 bp, Homo sapien
aggagtgagatataaacattttgct

SEQ ID NO: 165028 - DNA, 25 bp, Homo sapien
gaaatatagtttgtcatcctgtgaa

SEQ ID NO: 165029 - DNA, 25 bp, Homo sapien
gtttgtcatcctgtgaaaaccacct

SEQ ID NO: 165030 - DNA, 25 bp, Homo sapien
tgaaaaccacctcgtttgctttttg

SEQ ID NO: 165031 - DNA, 25 bp, Homo sapien
atttttgcctataaacagtgaactt

SEQ ID NO: 165032 - DNA, 25 bp, Homo sapien
gaacttaatatgtttctgtgagagt

SEQ ID NO: 165033 - DNA, 25 bp, Homo sapien
gtgacagagctgtgcccgtttatct

SEQ ID NO: 165034 - DNA, 25 bp, Homo sapien
gctgtgcccgtttatcttcattgta

SEQ ID NO: 165035 - DNA, 25 bp, Homo sapien
gacaacatcatcaaagcggcaccca

SEQ ID NO: 165036 - DNA, 25 bp, Homo sapien
ggcacccaggaaacgtgtccctgat

SEQ ID NO: 165037 - DNA, 25 bp, Homo sapien
cacgtgctgtcgatctttggaccag

SEQ ID NO: 165038 - DNA, 25 bp, Homo sapien
tgctgtcgatctttggaccagtttc

SEQ ID NO: 165039 - DNA, 25 bp, Homo sapien
gaccagtttctagcaaagttgtgtt

SEQ ID NO: 165040 - DNA, 25 bp, Homo sapien
gaatctgtttatcggtgcccattat

SEQ ID NO: 165041 - DNA, 25 bp, Homo sapien
gatatttagctgaccttcgctttaa

SEQ ID NO: 165042 - DNA, 25 bp, Homo sapien
ttagctgaccttcgctttaacatag

SEQ ID NO: 165043 - DNA, 25 bp, Homo sapien
gatttaaaggagttcatttcgcata

SEQ ID NO: 165044 - DNA, 25 bp, Homo sapien
aaaggagttcatttcgcatactggg

SEQ ID NO: 165045 - DNA, 25 bp, Homo sapien
aggagttcatttcgcatactgggca

SEQ ID NO: 165046 - DNA, 25 bp, Homo sapien
cagaatagagaggtgtttttccttt

SEQ ID NO: 165047 - DNA, 25 bp, Homo sapien
ttaattttgtcaacactgcattgtc

SEQ ID NO: 165048 - DNA, 25 bp, Homo sapien
attccctccagttttattagcctct

SEQ ID NO: 165049 - DNA, 25 bp, Homo sapien
tccctccagttttattagcctcttt

SEQ ID NO: 165050 - DNA, 25 bp, Homo sapien
cctccagttttattagcctctttat

SEQ ID NO: 165051 - DNA, 25 bp, Homo sapien
ccagttttattagcctctttatatg

SEQ ID NO: 165052 - DNA, 25 bp, Homo sapien
gttttattagcctctttatatgtct

SEQ ID NO: 165053 - DNA, 25 bp, Homo sapien
tattagcctctttatatgtctcaaa

SEQ ID NO: 165054 - DNA, 25 bp, Homo sapien
tagcctctttatatgtctcaaattg

SEQ ID NO: 165055 - DNA, 25 bp, Homo sapien
gcctctttatatgtctcaaattgca

SEQ ID NO: 165056 - DNA, 25 bp, Homo sapien
gtctcaaattgcatgaattttttct

SEQ ID NO: 165057 - DNA, 25 bp, Homo sapien
gagaaaacctttagtgtgtacacca

SEQ ID NO: 165058 - DNA, 25 bp, Homo sapien
gtgtgtacaccaactctattcagta

SEQ ID NO: 165059 - DNA, 25 bp, Homo sapien
tacaccaactctattcagtaccaga

SEQ ID NO: 165060 - DNA, 25 bp, Homo sapien
agtaccagagacactgtaccagaaa

SEQ ID NO: 165061 - DNA, 25 bp, Homo sapien
gaatgctgttgattattgatgagta

SEQ ID NO: 165062 - DNA, 25 bp, Homo sapien
ggttttaatcagtgttcaactctta

SEQ ID NO: 165063 - DNA, 25 bp, Homo sapien
atcagtgttcaactcttatgctaca

SEQ ID NO: 165064 - DNA, 25 bp, Homo sapien
gtgttcaactcttatgctacattaa

SEQ ID NO: 165065 - DNA, 25 bp, Homo sapien
gctacattaaaaccgcactggatcc

SEQ ID NO: 165066 - DNA, 25 bp, Homo sapien
aaaccgcactggatccggatacgtg

SEQ ID NO: 165067 - DNA, 25 bp, Homo sapien
ggatccggatacgtgtggtggctca

SEQ ID NO: 165068 - DNA, 25 bp, Homo sapien
cacgtgctgtcgatctttggaccag

SEQ ID NO: 165069 - DNA, 25 bp, Homo sapien
acgtgctgtcgatctttggaccagt

SEQ ID NO: 165070 - DNA, 25 bp, Homo sapien
cgtgctgtcgatctttggaccagtt

SEQ ID NO: 165071 - DNA, 25 bp, Homo sapien
gtgctgtcgatctttggaccagttt

SEQ ID NO: 165072 - DNA, 25 bp, Homo sapien
tgctgtcgatctttggaccagtttc

SEQ ID NO: 165073 - DNA, 25 bp, Homo sapien
gaccagtttctagcaaagttgtgtt

SEQ ID NO: 165074 - DNA, 25 bp, Homo sapien
ccagtttctagcaaagttgtgtttg

SEQ ID NO: 165075 - DNA, 25 bp, Homo sapien
gatatttagctgaccttcgctttaa

SEQ ID NO: 165076 - DNA, 25 bp, Homo sapien
atatttagctgaccttcgctttaac

SEQ ID NO: 165077 - DNA, 25 bp, Homo sapien
atttagctgaccttcgctttaacat

SEQ ID NO: 165078 - DNA, 25 bp, Homo sapien
ttagctgaccttcgctttaacatag

SEQ ID NO: 165079 - DNA, 25 bp, Homo sapien
ccactggtgacatgccaacttacca

SEQ ID NO: 165080 - DNA, 25 bp, Homo sapien
tgacatgccaacttaccagatccga

SEQ ID NO: 165081 - DNA, 25 bp, Homo sapien
atgccaacttaccagatccgagctc

SEQ ID NO: 165082 - DNA, 25 bp, Homo sapien
ttaccagatccgagctcctactgct

SEQ ID NO: 165083 - DNA, 25 bp, Homo sapien
ccacagggagtggtgatggctgcat

SEQ ID NO: 165084 - DNA, 25 bp, Homo sapien
tgatggctgcatcgcccggaagttt

SEQ ID NO: 165085 - DNA, 25 bp, Homo sapien
agcagctggcagaagaagcaacacg

SEQ ID NO: 165086 - DNA, 25 bp, Homo sapien
gaagcaacacgcaaacgagagctga

SEQ ID NO: 165087 - DNA, 25 bp, Homo sapien
acacgcaaacgagagctgaggctaa

SEQ ID NO: 165088 - DNA, 25 bp, Homo sapien
ctgccaaagaatgtcgacgtcgaaa

SEQ ID NO: 165089 - DNA, 25 bp, Homo sapien
gttgcagtgctggaagtccagaaca

SEQ ID NO: 165090 - DNA, 25 bp, Homo sapien
gacacctctaacgaaggctataatg

SEQ ID NO: 165091 - DNA, 25 bp, Homo sapien
gctataatgtgccaagaagatgtga

SEQ ID NO: 165092 - DNA, 25 bp, Homo sapien
aaactattctgctagaccttggtgc

SEQ ID NO: 165093 - DNA, 25 bp, Homo sapien
gctgatccaaatattaccgatgtct

SEQ ID NO: 165094 - DNA, 25 bp, Homo sapien
attaccgatgtctatggcaacactg

SEQ ID NO: 165095 - DNA, 25 bp, Homo sapien
ctgctctccatatgctgtctataat

SEQ ID NO: 165096 - DNA, 25 bp, Homo sapien
aatggtagcaagactgttttcacac

SEQ ID NO: 165097 - DNA, 25 bp, Homo sapien
agcaagactgttttcacacaagaca

SEQ ID NO: 165098 - DNA, 25 bp, Homo sapien
caatgtagagcaaccaatgttattt

SEQ ID NO: 165099 - DNA, 25 bp, Homo sapien
ttgaaatccacttgttttaacattg

SEQ ID NO: 165100 - DNA, 25 bp, Homo sapien
catatgtaagggtcagtttttgcta

SEQ ID NO: 165101 - DNA, 25 bp, Homo sapien
ttggataaagtacacatcattttgg

SEQ ID NO: 165102 - DNA, 25 bp, Homo sapien
gatggtgttaaatggctgcattgtg

SEQ ID NO: 165103 - DNA, 25 bp, Homo sapien
ctgcattgtggaaactaacagggca

SEQ ID NO: 165104 - DNA, 25 bp, Homo sapien
ggcaagaattcttgcccctctacta

SEQ ID NO: 165105 - DNA, 25 bp, Homo sapien
ttgcccctctactaattcttgataa

SEQ ID NO: 165106 - DNA, 25 bp, Homo sapien
tcttgataagatgtcagaaagctga

SEQ ID NO: 165107 - DNA, 25 bp, Homo sapien
ttcgagacaatatggatttatcaga

SEQ ID NO: 165108 - DNA, 25 bp, Homo sapien
atttatcagaaatgcgagtaccgtg

SEQ ID NO: 165109 - DNA, 25 bp, Homo sapien
atgcgagtaccgtggaatacatctc

SEQ ID NO: 165110 - DNA, 25 bp, Homo sapien
agtaccgtggaatacatctcaacat

SEQ ID NO: 165111 - DNA, 25 bp, Homo sapien
catctcaacatgttaacccagaaga

SEQ ID NO: 165112 - DNA, 25 bp, Homo sapien
aaaagggtctttgcttctgattaca

SEQ ID NO: 165113 - DNA, 25 bp, Homo sapien
agggtctttgcttctgattacagga

SEQ ID NO: 165114 - DNA, 25 bp, Homo sapien
ttgcttctgattacaggagcactgt

SEQ ID NO: 165115 - DNA, 25 bp, Homo sapien
ggagcactgtggaacgtctgtaaat

SEQ ID NO: 165116 - DNA, 25 bp, Homo sapien
aattccatgtatagttggtgtacac

SEQ ID NO: 165117 - DNA, 25 bp, Homo sapien
gttggtgtacactcaaaacctgtcc

SEQ ID NO: 165118 - DNA, 25 bp, Homo sapien
cagtgctctctgtatagggccataa

SEQ ID NO: 165119 - DNA, 25 bp, Homo sapien
gctctctgtatagggccataatgga

SEQ ID NO: 165120 - DNA, 25 bp, Homo sapien
ttgtaagttgccactgccaacatga

SEQ ID NO: 165121 - DNA, 25 bp, Homo sapien
actgccaacatgagaccaaagtgtg

SEQ ID NO: 165122 - DNA, 25 bp, Homo sapien
gaccaaagtgtgtgactagtcaatg

SEQ ID NO: 165123 - DNA, 25 bp, Homo sapien
gttctccatatcaagatgtggccca

SEQ ID NO: 165124 - DNA, 25 bp, Homo sapien
gggaacaatcattatacggactctt

SEQ ID NO: 165125 - DNA, 25 bp, Homo sapien
gagaacttacacttcatctgttcca

SEQ ID NO: 165126 - DNA, 25 bp, Homo sapien
acctctcctgcgatagtcctgggtg

SEQ ID NO: 165127 - DNA, 25 bp, Homo sapien
agtcctgggtgctccactgattgga

SEQ ID NO: 165128 - DNA, 25 bp, Homo sapien
gccagctgtctgacacacaaatggt

SEQ ID NO: 165129 - DNA, 25 bp, Homo sapien
aaatggtcttttcagccacagtctt

SEQ ID NO: 165130 - DNA, 25 bp, Homo sapien
gccacagtcttatcaagtatcctat

SEQ ID NO: 165131 - DNA, 25 bp, Homo sapien
attcctttctaaactgctactcatg

SEQ ID NO: 165132 - DNA, 25 bp, Homo sapien
gtctgatgctaagatactgcctgca

SEQ ID NO: 165133 - DNA, 25 bp, Homo sapien
actgcctgcactggaatgttaaaca

SEQ ID NO: 165134 - DNA, 25 bp, Homo sapien
aagtgctgtttgagggattttatta

SEQ ID NO: 165135 - DNA, 25 bp, Homo sapien
gtacaaattgttcatgttaccaaag

SEQ ID NO: 165136 - DNA, 25 bp, Homo sapien
atgttaccaaagcaatatttccctg

SEQ ID NO: 165137 - DNA, 25 bp, Homo sapien
accaaagcaatatttccctggaatt

SEQ ID NO: 165138 - DNA, 25 bp, Homo sapien
gtttgtggcatacaacctgagcctt

SEQ ID NO: 165139 - DNA, 25 bp, Homo sapien
catacaacctgagccttttcttata

SEQ ID NO: 165140 - DNA, 25 bp, Homo sapien
aacctgagccttttcttatataaga

SEQ ID NO: 165141 - DNA, 25 bp, Homo sapien
acatcttggtatgtggccatattta

SEQ ID NO: 165142 - DNA, 25 bp, Homo sapien
gtatgtggccatatttatagaatgc

SEQ ID NO: 165143 - DNA, 25 bp, Homo sapien
gaatgctgaactcaatgtgcaagtt

SEQ ID NO: 165144 - DNA, 25 bp, Homo sapien
gtgcaagttgtactgtatgcagttt

SEQ ID NO: 165145 - DNA, 25 bp, Homo sapien
attgaaagctctatggattatccac

SEQ ID NO: 165146 - DNA, 25 bp, Homo sapien
ggattatccactgcaaagttttctt

SEQ ID NO: 165147 - DNA, 25 bp, Homo sapien
aaaatcaggctttgtctgctcccaa

SEQ ID NO: 165148 - DNA, 25 bp, Homo sapien
tgtctgctcccaattcacctcgtta

SEQ ID NO: 165149 - DNA, 25 bp, Homo sapien
gttactctcacctcgtgatatccac

SEQ ID NO: 165150 - DNA, 25 bp, Homo sapien
gtgatatccacaaatgctattcaga

SEQ ID NO: 165151 - DNA, 25 bp, Homo sapien
cagaactaggagtcttcactgctct

SEQ ID NO: 165152 - DNA, 25 bp, Homo sapien
gtgtcaccttcctagttcttatgag

SEQ ID NO: 165153 - DNA, 25 bp, Homo sapien
ttcttatgagctagcatggcccggg

SEQ ID NO: 165154 - DNA, 25 bp, Homo sapien
atggcccgggccttatccagtcaaa

SEQ ID NO: 165155 - DNA, 25 bp, Homo sapien
ccagtcaaagcggatgctggccaca

SEQ ID NO: 165156 - DNA, 25 bp, Homo sapien
gaagaagcacaagtccagcagcggc

SEQ ID NO: 165157 - DNA, 25 bp, Homo sapien
aagcacaagtccagcagcggcggcg

SEQ ID NO: 165158 - DNA, 25 bp, Homo sapien
ctactgcacgcgtccgagccggaga

SEQ ID NO: 165159 - DNA, 25 bp, Homo sapien
gtccgagccggagagctcatcctga

SEQ ID NO: 165160 - DNA, 25 bp, Homo sapien
gccggagagctcatcctgaacgccg

SEQ ID NO: 165161 - DNA, 25 bp, Homo sapien
aagcacgctgccgagatggccacgg

SEQ ID NO: 165162 - DNA, 25 bp, Homo sapien
acgctgccgagatggccacggccaa

SEQ ID NO: 165163 - DNA, 25 bp, Homo sapien
ggactcggagacagagcgcctcaag

SEQ ID NO: 165164 - DNA, 25 bp, Homo sapien
actcggagacagagcgcctcaaggg

SEQ ID NO: 165165 - DNA, 25 bp, Homo sapien
ggacgacgactacaataagcctctg

SEQ ID NO: 165166 - DNA, 25 bp, Homo sapien
acgactacaataagcctctggatcc

SEQ ID NO: 165167 - DNA, 25 bp, Homo sapien
atgtacttcatctggttgggctgga

SEQ ID NO: 165168 - DNA, 25 bp, Homo sapien
gataagccttcccagttgactgaaa

SEQ ID NO: 165169 - DNA, 25 bp, Homo sapien
ttgactgaaagatgaggctaggctc

SEQ ID NO: 165170 - DNA, 25 bp, Homo sapien
ctaggctctagcaagttgaagtcaa

SEQ ID NO: 165171 - DNA, 25 bp, Homo sapien
aagtcaaaccagctccttcaagaag

SEQ ID NO: 165172 - DNA, 25 bp, Homo sapien
aggaagcccactgtacctggagcca

SEQ ID NO: 165173 - DNA, 25 bp, Homo sapien
cctggagccatctgggataagactt

SEQ ID NO: 165174 - DNA, 25 bp, Homo sapien
gataagactttgacccatgactccc

SEQ ID NO: 165175 - DNA, 25 bp, Homo sapien
tagcccatcccagtttatcctgtat

SEQ ID NO: 165176 - DNA, 25 bp, Homo sapien
atttgagctgggattcccacatcct

SEQ ID NO: 165177 - DNA, 25 bp, Homo sapien
ctgggattcccacatcctctgagtt

SEQ ID NO: 165178 - DNA, 25 bp, Homo sapien
gtagcagcttcttagttactttgga

SEQ ID NO: 165179 - DNA, 25 bp, Homo sapien
gttactttggaacactactcttaca

SEQ ID NO: 165180 - DNA, 25 bp, Homo sapien
ggaacactactcttacatgtataaa

SEQ ID NO: 165181 - DNA, 25 bp, Homo sapien
gattgacttgactttctagcttccc

SEQ ID NO: 165182 - DNA, 25 bp, Homo sapien
tagcttcccttgtccggaggatatt

SEQ ID NO: 165183 - DNA, 25 bp, Homo sapien
ttgtccggaggatattaaaatgcta

SEQ ID NO: 165184 - DNA, 25 bp, Homo sapien
gggtgaggtttagccatcttacttg

SEQ ID NO: 165185 - DNA, 25 bp, Homo sapien
catcttacttggctttttactatta

SEQ ID NO: 165186 - DNA, 25 bp, Homo sapien
acttggctttttactattaacatga

SEQ ID NO: 165187 - DNA, 25 bp, Homo sapien
gatgtactaaagtagagccctttga

SEQ ID NO: 165188 - DNA, 25 bp, Homo sapien
gtagagccctttgagaatacaagat

SEQ ID NO: 165189 - DNA, 25 bp, Homo sapien
agggctcctgtgagtggattcaccc

SEQ ID NO: 165190 - DNA, 25 bp, Homo sapien
aggtcagaatggcaactcctggaac

SEQ ID NO: 165191 - DNA, 25 bp, Homo sapien
aactcctggaacagcacaacaagtg

SEQ ID NO: 165192 - DNA, 25 bp, Homo sapien
caaaggacacagctagcaacgggct

SEQ ID NO: 165193 - DNA, 25 bp, Homo sapien
gtgggagtgatcatctccaactcaa

SEQ ID NO: 165194 - DNA, 25 bp, Homo sapien
gtgatcatctccaactcaactcaat

SEQ ID NO: 165195 - DNA, 25 bp, Homo sapien
atactacctaaaatcggcactgaca

SEQ ID NO: 165196 - DNA, 25 bp, Homo sapien
taatccacctatccagtagaggcag

SEQ ID NO: 165197 - DNA, 25 bp, Homo sapien
gcactgatctggctgaattcctgga

SEQ ID NO: 165198 - DNA, 25 bp, Homo sapien
gatctggctgaattcctggatatgg

SEQ ID NO: 165199 - DNA, 25 bp, Homo sapien
atcctcgggatgaaacaaacttaca

SEQ ID NO: 165200 - DNA, 25 bp, Homo sapien
cccagggctcctgtgagtggattca

SEQ ID NO: 165201 - DNA, 25 bp, Homo sapien
agggctcctgtgagtggattcaccc

SEQ ID NO: 165202 - DNA, 25 bp, Homo sapien
gattcacccccaaggtcagaatggc

SEQ ID NO: 165203 - DNA, 25 bp, Homo sapien
gtcagaatggcaactcctggaacag

SEQ ID NO: 165204 - DNA, 25 bp, Homo sapien
cctggaacagcacaacaagtggcaa

SEQ ID NO: 165205 - DNA, 25 bp, Homo sapien
tggcaaaggacacagctagcaacgg

SEQ ID NO: 165206 - DNA, 25 bp, Homo sapien
gacacagctagcaacgggctggaaa

SEQ ID NO: 165207 - DNA, 25 bp, Homo sapien
ctagcaacgggctggaaaaaggcag

SEQ ID NO: 165208 - DNA, 25 bp, Homo sapien
ggcactgacaaagtacaaataatcc

SEQ ID NO: 165209 - DNA, 25 bp, Homo sapien
gtacaaataatccacctatccagta

SEQ ID NO: 165210 - DNA, 25 bp, Homo sapien
taatccacctatccagtagaggcag

SEQ ID NO: 165211 - DNA, 25 bp, Homo sapien
gcactcttaggtcttagtatggatt

SEQ ID NO: 165212 - DNA, 25 bp, Homo sapien
gtgtgtgtgtagtttatcctctctc

SEQ ID NO: 165213 - DNA, 25 bp, Homo sapien
gagattgactgatacctcattctgt

SEQ ID NO: 165214 - DNA, 25 bp, Homo sapien
attctgtttgtaaaaccagccagta

SEQ ID NO: 165215 - DNA, 25 bp, Homo sapien
agccagtaatttctgtgcaacctta

SEQ ID NO: 165216 - DNA, 25 bp, Homo sapien
gtgcaaccttactatgtgcaatatt

SEQ ID NO: 165217 - DNA, 25 bp, Homo sapien
ttaaatcctgagaaatgtgtgcttt

SEQ ID NO: 165218 - DNA, 25 bp, Homo sapien
gtgtgcttttgttttcggatagact

SEQ ID NO: 165219 - DNA, 25 bp, Homo sapien
ttctttagttctgcacttttccaca

SEQ ID NO: 165220 - DNA, 25 bp, Homo sapien
gcacttttccacattatactccata

SEQ ID NO: 165221 - DNA, 25 bp, Homo sapien
acaagtgtctcatacaacattgtat

SEQ ID NO: 165222 - DNA, 25 bp, Homo sapien
aggaacctcggcagcctactgaagc

SEQ ID NO: 165223 - DNA, 25 bp, Homo sapien
tcctggtgatcatggatgcgctcaa

SEQ ID NO: 165224 - DNA, 25 bp, Homo sapien
agagcagctactacatgattggtga

SEQ ID NO: 165225 - DNA, 25 bp, Homo sapien
tgattggtgagcagaagttctccag

SEQ ID NO: 165226 - DNA, 25 bp, Homo sapien
gaggctggctacacaatcgaatggt

SEQ ID NO: 165227 - DNA, 25 bp, Homo sapien
cgaatggtttgaggtgatctcgcaa

SEQ ID NO: 165228 - DNA, 25 bp, Homo sapien
gatctcgcaaagttattcttccacc

SEQ ID NO: 165229 - DNA, 25 bp, Homo sapien
catggccaacaacgaaggacttttc

SEQ ID NO: 165230 - DNA, 25 bp, Homo sapien
gacttttctccctggtggcgaggaa

SEQ ID NO: 165231 - DNA, 25 bp, Homo sapien
tggcgaggaagctgagcagacccct

SEQ ID NO: 165232 - DNA, 25 bp, Homo sapien
gagcagacccctgtgatgcctgtga

SEQ ID NO: 165233 - DNA, 25 bp, Homo sapien
tctccagtgtccatgcaatgaattg

SEQ ID NO: 165234 - DNA, 25 bp, Homo sapien
gtccatgcaatgaattgctgagcat

SEQ ID NO: 165235 - DNA, 25 bp, Homo sapien
tgagcatttaggaagcagcaccaag

SEQ ID NO: 165236 - DNA, 25 bp, Homo sapien
gcagcaccaagtctattacaggcat

SEQ ID NO: 165237 - DNA, 25 bp, Homo sapien
gcaccaagtctattacaggcatggt

SEQ ID NO: 165238 - DNA, 25 bp, Homo sapien
ttacaggcatggtgtgaaacttgat

SEQ ID NO: 165239 - DNA, 25 bp, Homo sapien
gaaacttgatgtttgacctgtgatc

SEQ ID NO: 165240 - DNA, 25 bp, Homo sapien
aacttgatgtttgacctgtgatcaa

SEQ ID NO: 165241 - DNA, 25 bp, Homo sapien
gattaatttgcgagactaactttga

SEQ ID NO: 165242 - DNA, 25 bp, Homo sapien
gcgagactaactttgagagtgtaac

SEQ ID NO: 165243 - DNA, 25 bp, Homo sapien
ctttgagagtgtaacagttttgaag

SEQ ID NO: 165244 - DNA, 25 bp, Homo sapien
ggactgcatgggaagcacggaatat

SEQ ID NO: 165245 - DNA, 25 bp, Homo sapien
gactgcatgggaagcacggaatata

SEQ ID NO: 165246 - DNA, 25 bp, Homo sapien
actgcatgggaagcacggaatatag

SEQ ID NO: 165247 - DNA, 25 bp, Homo sapien
atgggaagcacggaatatagggtta

SEQ ID NO: 165248 - DNA, 25 bp, Homo sapien
ggaagcacggaatatagggttagat

SEQ ID NO: 165249 - DNA, 25 bp, Homo sapien
aagcacggaatatagggttagatgt

SEQ ID NO: 165250 - DNA, 25 bp, Homo sapien
cggaatatagggttagatgtgtgtt

SEQ ID NO: 165251 - DNA, 25 bp, Homo sapien
aatatagggttagatgtgtgttatc

SEQ ID NO: 165252 - DNA, 25 bp, Homo sapien
atagggttagatgtgtgttatctgt

SEQ ID NO: 165253 - DNA, 25 bp, Homo sapien
gggttagatgtgtgttatctgtaac

SEQ ID NO: 165254 - DNA, 25 bp, Homo sapien
gttagatgtgtgttatctgtaacca

SEQ ID NO: 165255 - DNA, 25 bp, Homo sapien
gaagtacattactgcccatggactg

SEQ ID NO: 165256 - DNA, 25 bp, Homo sapien
tacattactgcccatggactgccgc

SEQ ID NO: 165257 - DNA, 25 bp, Homo sapien
gggccccgagccttgcgccagaaaa

SEQ ID NO: 165258 - DNA, 25 bp, Homo sapien
gagccttgcgccagaaaattgtcat

SEQ ID NO: 165259 - DNA, 25 bp, Homo sapien
tgcgccagaaaattgtcattaaatg

SEQ ID NO: 165260 - DNA, 25 bp, Homo sapien
aatgaagagatgtctagtcctcaga

SEQ ID NO: 165261 - DNA, 25 bp, Homo sapien
gagatgtctagtcctcagaaacttc

SEQ ID NO: 165262 - DNA, 25 bp, Homo sapien
gtctagtcctcagaaacttctttcc

SEQ ID NO: 165263 - DNA, 25 bp, Homo sapien
attggggctcttgctgttccgtttc

SEQ ID NO: 165264 - DNA, 25 bp, Homo sapien
atctctgatctttgcctaatctgtt

SEQ ID NO: 165265 - DNA, 25 bp, Homo sapien
gatctttgcctaatctgtttctttt

SEQ ID NO: 165266 - DNA, 25 bp, Homo sapien
cagagggagcccttcgatgggacct

SEQ ID NO: 165267 - DNA, 25 bp, Homo sapien
tcgatgggacctgcctcgggtgcaa

SEQ ID NO: 165268 - DNA, 25 bp, Homo sapien
gcctcgggtgcaaggaggctctcaa

SEQ ID NO: 165269 - DNA, 25 bp, Homo sapien
gaggctctcaactctcaggcctttt

SEQ ID NO: 165270 - DNA, 25 bp, Homo sapien
aggccttttccagatggacgtccca

SEQ ID NO: 165271 - DNA, 25 bp, Homo sapien
gagcttccccggcacacgtgctgtg

SEQ ID NO: 165272 - DNA, 25 bp, Homo sapien
acgtgctgtggcctccaggtccgat

SEQ ID NO: 165273 - DNA, 25 bp, Homo sapien
cgattcctcaggctggccttcaggc

SEQ ID NO: 165274 - DNA, 25 bp, Homo sapien
gccttcaggccatgcggcaatgcca

SEQ ID NO: 165275 - DNA, 25 bp, Homo sapien
aagtgggtgcgacacctaagccaca

SEQ ID NO: 165276 - DNA, 25 bp, Homo sapien
cacagcgacgcctatgtcattcgga

SEQ ID NO: 165277 - DNA, 25 bp, Homo sapien
caaacagagtgaactttctgccaag

SEQ ID NO: 165278 - DNA, 25 bp, Homo sapien
atgcgggagtggttttcagagacat

SEQ ID NO: 165279 - DNA, 25 bp, Homo sapien
gcgggagtggttttcagagacattt

SEQ ID NO: 165280 - DNA, 25 bp, Homo sapien
gggagtggttttcagagacatttca

SEQ ID NO: 165281 - DNA, 25 bp, Homo sapien
gagtggttttcagagacatttcaga

SEQ ID NO: 165282 - DNA, 25 bp, Homo sapien
gtggttttcagagacatttcagaaa

SEQ ID NO: 165283 - DNA, 25 bp, Homo sapien
cagagacatttcagaaagtgaagga

SEQ ID NO: 165284 - DNA, 25 bp, Homo sapien
gagaaactcaagattgactcatgag

SEQ ID NO: 165285 - DNA, 25 bp, Homo sapien
caagattgactcatgaggacctgaa

SEQ ID NO: 165286 - DNA, 25 bp, Homo sapien
catgaggacctgaagggtgacatcc

SEQ ID NO: 165287 - DNA, 25 bp, Homo sapien
ggaggggcctctgaaatttcccaca

SEQ ID NO: 165288 - DNA, 25 bp, Homo sapien
ttgtttacacttctatgaccaggcc

SEQ ID NO: 165289 - DNA, 25 bp, Homo sapien
aaccaagtagtgtcttcctacctat

SEQ ID NO: 165290 - DNA, 25 bp, Homo sapien
gtcttcctacctatctccagataca

SEQ ID NO: 165291 - DNA, 25 bp, Homo sapien
tcctacctatctccagatacatgtc

SEQ ID NO: 165292 - DNA, 25 bp, Homo sapien
tccgttttgtttctgctcagtaata

SEQ ID NO: 165293 - DNA, 25 bp, Homo sapien
ctcagtaatatagtcaagcaagttt

SEQ ID NO: 165294 - DNA, 25 bp, Homo sapien
atactatccatccataccacactat

SEQ ID NO: 165295 - DNA, 25 bp, Homo sapien
atccataccacactatcttctgtat

SEQ ID NO: 165296 - DNA, 25 bp, Homo sapien
taccacactatcttctgtatcaggt

SEQ ID NO: 165297 - DNA, 25 bp, Homo sapien
cactatcttctgtatcaggtagtct

SEQ ID NO: 165298 - DNA, 25 bp, Homo sapien
cttctgtatcaggtagtctaataga

SEQ ID NO: 165299 - DNA, 25 bp, Homo sapien
gacagagcatccctggattctgttc

SEQ ID NO: 165300 - DNA, 25 bp, Homo sapien
gcatccctggattctgttcagggtg

SEQ ID NO: 165301 - DNA, 25 bp, Homo sapien
ttcagggtgggaagtagtactgcta

SEQ ID NO: 165302 - DNA, 25 bp, Homo sapien
tagtactgctagtcatggtctcacc

SEQ ID NO: 165303 - DNA, 25 bp, Homo sapien
tagtcatggtctcaccccgagctga

SEQ ID NO: 165304 - DNA, 25 bp, Homo sapien
tctcccttgccaaagaagaaactct

SEQ ID NO: 165305 - DNA, 25 bp, Homo sapien
ccccaaaccaggtctgtacaggtgt

SEQ ID NO: 165306 - DNA, 25 bp, Homo sapien
aggtctgtacaggtgttctttattt

SEQ ID NO: 165307 - DNA, 25 bp, Homo sapien
gttctttattttacatgagggctac

SEQ ID NO: 165308 - DNA, 25 bp, Homo sapien
ttacatgagggctactttccaacca

SEQ ID NO: 165309 - DNA, 25 bp, Homo sapien
tgagggctactttccaaccaaataa

SEQ ID NO: 165310 - DNA, 25 bp, Homo sapien
aagaagtccccaagacaatctcgcc

SEQ ID NO: 165311 - DNA, 25 bp, Homo sapien
gtccccaagacaatctcgccaaagg

SEQ ID NO: 165312 - DNA, 25 bp, Homo sapien
agtttcccagctgcagcctaggcag

SEQ ID NO: 165313 - DNA, 25 bp, Homo sapien
atgcacagcccaggcgaggaagcct

SEQ ID NO: 165314 - DNA, 25 bp, Homo sapien
ggaagcctggcttctctgtgagcac

SEQ ID NO: 165315 - DNA, 25 bp, Homo sapien
ctctgtgagcacatacgtgggtcct

SEQ ID NO: 165316 - DNA, 25 bp, Homo sapien
gagcacatacgtgggtcctcggcag

SEQ ID NO: 165317 - DNA, 25 bp, Homo sapien
tccagacctgcacagggtgctcctg

SEQ ID NO: 165318 - DNA, 25 bp, Homo sapien
ctctgagggctgaggtgagacttct

SEQ ID NO: 165319 - DNA, 25 bp, Homo sapien
ttctcctgggatgacaatttgctga

SEQ ID NO: 165320 - DNA, 25 bp, Homo sapien
gtgcagcttttgtgaattaaacttg

SEQ ID NO: 165321 - DNA, 25 bp, Homo sapien
gaaaaacctgcctttggttgtgcat

SEQ ID NO: 165322 - DNA, 25 bp, Homo sapien
cctgcctttggttgtgcatacttta

SEQ ID NO: 165323 - DNA, 25 bp, Homo sapien
gcatactttaatcactttctgattt

SEQ ID NO: 165324 - DNA, 25 bp, Homo sapien
aaagatcagtctagagctcactact

SEQ ID NO: 165325 - DNA, 25 bp, Homo sapien
tagagctcactactgcacactacat

SEQ ID NO: 165326 - DNA, 25 bp, Homo sapien
ctactgcacactacatcaaactttg

SEQ ID NO: 165327 - DNA, 25 bp, Homo sapien
ttacctgttagtgatagtcaactta

SEQ ID NO: 165328 - DNA, 25 bp, Homo sapien
agagcccacacatttctatgcaaat

SEQ ID NO: 165329 - DNA, 25 bp, Homo sapien
gatgttctgatgtttaacccttagg

SEQ ID NO: 165330 - DNA, 25 bp, Homo sapien
aaggccaaagtgtgctgactggcta

SEQ ID NO: 165331 - DNA, 25 bp, Homo sapien
ctgactggctaatttgtatgcttta

SEQ ID NO: 165332 - DNA, 25 bp, Homo sapien
gactgacttgctatgtgggattaca

SEQ ID NO: 165333 - DNA, 25 bp, Homo sapien
ggattacaccagaagcttgcagtgg

SEQ ID NO: 165334 - DNA, 25 bp, Homo sapien
gcaaccttaaatatgtcggctgtat

SEQ ID NO: 165335 - DNA, 25 bp, Homo sapien
gtcggctgtataggagcatattcta

SEQ ID NO: 165336 - DNA, 25 bp, Homo sapien
tattctattgcagaagaccttccta

SEQ ID NO: 165337 - DNA, 25 bp, Homo sapien
gaagaccttcctatgaagatcatgg

SEQ ID NO: 165338 - DNA, 25 bp, Homo sapien
ttgaactaatacttggactttgata

SEQ ID NO: 165339 - DNA, 25 bp, Homo sapien
tctttaacaattttctctgcagtgc

SEQ ID NO: 165340 - DNA, 25 bp, Homo sapien
aaatgtgttccaacagaaatccttc

SEQ ID NO: 165341 - DNA, 25 bp, Homo sapien
gaaatccttcataactcctagcatg

SEQ ID NO: 165342 - DNA, 25 bp, Homo sapien
aactcctagcatggtatcttaataa

SEQ ID NO: 165343 - DNA, 25 bp, Homo sapien
gattttaggtggttcagtccttcac

SEQ ID NO: 165344 - DNA, 25 bp, Homo sapien
tggttcagtccttcacctggtgttg

SEQ ID NO: 165345 - DNA, 25 bp, Homo sapien
gtcttaggcagtgatggaccctcca

SEQ ID NO: 165346 - DNA, 25 bp, Homo sapien
gatggaccctccattttacctcttt

SEQ ID NO: 165347 - DNA, 25 bp, Homo sapien
tctttaccctgtcgctcataatgag

SEQ ID NO: 165348 - DNA, 25 bp, Homo sapien
atcatatatcctctcactctctggg

SEQ ID NO: 165349 - DNA, 25 bp, Homo sapien
gaggatcccaggattcagtattcct

SEQ ID NO: 165350 - DNA, 25 bp, Homo sapien
gcccagagggccttgctggctactg

SEQ ID NO: 165351 - DNA, 25 bp, Homo sapien
ggctactgggtgttagtttgcagtc

SEQ ID NO: 165352 - DNA, 25 bp, Homo sapien
ttagtttgcagtcctgtgtgcttcc

SEQ ID NO: 165353 - DNA, 25 bp, Homo sapien
ctgtgtgcttccctctcttatgact

SEQ ID NO: 165354 - DNA, 25 bp, Homo sapien
cgtcaatgggaaacccttggaagat

SEQ ID NO: 165355 - DNA, 25 bp, Homo sapien
atgggaaacccttggaagatcagac

SEQ ID NO: 165356 - DNA, 25 bp, Homo sapien
gaaacccttggaagatcagacccag

SEQ ID NO: 165357 - DNA, 25 bp, Homo sapien
cttggaagatcagacccagctcctt

SEQ ID NO: 165358 - DNA, 25 bp, Homo sapien
tccttacccttgtctgccagttgta

SEQ ID NO: 165359 - DNA, 25 bp, Homo sapien
ttacccttgtctgccagttgtacca

SEQ ID NO: 165360 - DNA, 25 bp, Homo sapien
ttgtctgccagttgtaccagggcaa

SEQ ID NO: 165361 - DNA, 25 bp, Homo sapien
gtctgccagttgtaccagggcaaga

SEQ ID NO: 165362 - DNA, 25 bp, Homo sapien
ctccggagtgtttgcttcgagtgtt

SEQ ID NO: 165363 - DNA, 25 bp, Homo sapien
tccggagtgtttgcttcgagtgttg

SEQ ID NO: 165364 - DNA, 25 bp, Homo sapien
tgcttcgagtgttggccggtgggct

SEQ ID NO: 165365 - DNA, 25 bp, Homo sapien
aaggtcagactgaggcaccaagtat

SEQ ID NO: 165366 - DNA, 25 bp, Homo sapien
aagtagatcttcattttattgcatt

SEQ ID NO: 165367 - DNA, 25 bp, Homo sapien
attagttcatgtagatgggcatctc

SEQ ID NO: 165368 - DNA, 25 bp, Homo sapien
agatgggcatctctatgaattagat

SEQ ID NO: 165369 - DNA, 25 bp, Homo sapien
aaactttattagaggatgccataga

SEQ ID NO: 165370 - DNA, 25 bp, Homo sapien
gaggatgccatagaagtttgcaaga

SEQ ID NO: 165371 - DNA, 25 bp, Homo sapien
aagaagtttatggagcgcgaccctg

SEQ ID NO: 165372 - DNA, 25 bp, Homo sapien
gagcgcgaccctgatgaactaagat

SEQ ID NO: 165373 - DNA, 25 bp, Homo sapien
ttaatgcgattgctctttctgcagc

SEQ ID NO: 165374 - DNA, 25 bp, Homo sapien
gctctttctgcagcatagcttgtca

SEQ ID NO: 165375 - DNA, 25 bp, Homo sapien
agcttgtcaataatggaaacaccaa

SEQ ID NO: 165376 - DNA, 25 bp, Homo sapien
tcaggatgtgtggtcttctcttcga

SEQ ID NO: 165377 - DNA, 25 bp, Homo sapien
ttctcttcgactacccagtggtctt

SEQ ID NO: 165378 - DNA, 25 bp, Homo sapien
cagtggtcttggctgttcaaccgta

SEQ ID NO: 165379 - DNA, 25 bp, Homo sapien
ttcaaccgtactttctccagaagga

SEQ ID NO: 165380 - DNA, 25 bp, Homo sapien
agaaggatcagctcaatttgctgct

SEQ ID NO: 165381 - DNA, 25 bp, Homo sapien
tttgctgctcagatatttgggttaa

SEQ ID NO: 165382 - DNA, 25 bp, Homo sapien
taagcaaccatttggtatggagcaa

SEQ ID NO: 165383 - DNA, 25 bp, Homo sapien
tatggagcaaactgcgagcaagcat

SEQ ID NO: 165384 - DNA, 25 bp, Homo sapien
tgcgagcaagcattttgaacacatg

SEQ ID NO: 165385 - DNA, 25 bp, Homo sapien
tgaacacatggatttccttgaagca

SEQ ID NO: 165386 - DNA, 25 bp, Homo sapien
atttccttgaagcaggctgacaaga

SEQ ID NO: 165387 - DNA, 25 bp, Homo sapien
aatagcattcgaagatccccagact

SEQ ID NO: 165388 - DNA, 25 bp, Homo sapien
gatccccagacttcatagaatactc

SEQ ID NO: 165389 - DNA, 25 bp, Homo sapien
catagaatactcagggaaagcattt

SEQ ID NO: 165390 - DNA, 25 bp, Homo sapien
tgtacacatgtatcctttcacacat

SEQ ID NO: 165391 - DNA, 25 bp, Homo sapien
gtatcctttcacacatttgccttga

SEQ ID NO: 165392 - DNA, 25 bp, Homo sapien
ttgccttgacaaacttctttcactc

SEQ ID NO: 165393 - DNA, 25 bp, Homo sapien
tgacaaacttctttcactcacatct

SEQ ID NO: 165394 - DNA, 25 bp, Homo sapien
gggactctggtatctaattctttaa

SEQ ID NO: 165395 - DNA, 25 bp, Homo sapien
ccatgtagtagatatcctctgctta

SEQ ID NO: 165396 - DNA, 25 bp, Homo sapien
cctctgcttaaaaactcactacgga

SEQ ID NO: 165397 - DNA, 25 bp, Homo sapien
tacggaggagaattaagtcctactt

SEQ ID NO: 165398 - DNA, 25 bp, Homo sapien
gttactgtgttacttaacccatgtt

SEQ ID NO: 165399 - DNA, 25 bp, Homo sapien
aacccatgttttctctttatataat

SEQ ID NO: 165400 - DNA, 25 bp, Homo sapien
tataatcacttatcgcttacaaatg

SEQ ID NO: 165401 - DNA, 25 bp, Homo sapien
agcatatattcctcatctcttaact

SEQ ID NO: 165402 - DNA, 25 bp, Homo sapien
attcctcatctcttaactagtctaa

SEQ ID NO: 165403 - DNA, 25 bp, Homo sapien
ttaactagtctaattatggtccaat

SEQ ID NO: 165404 - DNA, 25 bp, Homo sapien
ggtccaattattgtggttgtgattt

SEQ ID NO: 165405 - DNA, 25 bp, Homo sapien
ttgtggttgtgattttatgcatatc

SEQ ID NO: 165406 - DNA, 25 bp, Homo sapien
tttcttatgcgggtcttttatatat

SEQ ID NO: 165407 - DNA, 25 bp, Homo sapien
agggatcctgagatacccgattcta

SEQ ID NO: 165408 - DNA, 25 bp, Homo sapien
gagatacccgattctatatgtaaaa

SEQ ID NO: 165409 - DNA, 25 bp, Homo sapien
gttatacatatagatcactcaggga

SEQ ID NO: 165410 - DNA, 25 bp, Homo sapien
atgctgaacaatgtggtgagaccaa

SEQ ID NO: 165411 - DNA, 25 bp, Homo sapien
ggagaacaaggccatccatgacctg

SEQ ID NO: 165412 - DNA, 25 bp, Homo sapien
gggaaagcgcatggctctctcaagc

SEQ ID NO: 165413 - DNA, 25 bp, Homo sapien
atggctctctcaagccatgaccaca

SEQ ID NO: 165414 - DNA, 25 bp, Homo sapien
tattgtcaaccttaacacccatcac

SEQ ID NO: 165415 - DNA, 25 bp, Homo sapien
caccaaatcggtaatttcagggtct

SEQ ID NO: 165416 - DNA, 25 bp, Homo sapien
ttttactatcctcaggcatccattc

SEQ ID NO: 165417 - DNA, 25 bp, Homo sapien
gaaatgatggtgctctgcatcagtg

SEQ ID NO: 165418 - DNA, 25 bp, Homo sapien
ctctgcatcagtggttcagagcctg

SEQ ID NO: 165419 - DNA, 25 bp, Homo sapien
gttcagagcctggttatacatatag

SEQ ID NO: 165420 - DNA, 25 bp, Homo sapien
aacctggtctctgtgtcaagtctgg

SEQ ID NO: 165421 - DNA, 25 bp, Homo sapien
tgtcaagtctggacctgtggttccc

SEQ ID NO: 165422 - DNA, 25 bp, Homo sapien
tttgccttattcctacaacctatgt

SEQ ID NO: 165423 - DNA, 25 bp, Homo sapien
gacatactttgtggtgattcatctg

SEQ ID NO: 165424 - DNA, 25 bp, Homo sapien
ctttgtaattccagcgagtcgactt

SEQ ID NO: 165425 - DNA, 25 bp, Homo sapien
agcgagtcgacttcccatcctgagt

SEQ ID NO: 165426 - DNA, 25 bp, Homo sapien
tcccatcctgagttggtgagtttca

SEQ ID NO: 165427 - DNA, 25 bp, Homo sapien
ggtgagtttcatttatgtctattct

SEQ ID NO: 165428 - DNA, 25 bp, Homo sapien
tgtctattctttttcattacccacc

SEQ ID NO: 165429 - DNA, 25 bp, Homo sapien
tattctttttcattacccacccaat

SEQ ID NO: 165430 - DNA, 25 bp, Homo sapien
cattacccacccaattttctgtatt

SEQ ID NO: 165431 - DNA, 25 bp, Homo sapien
gacaacgtgagttttctaatattaa

SEQ ID NO: 165432 - DNA, 25 bp, Homo sapien
tttctaatattaacatccatctttc

SEQ ID NO: 165433 - DNA, 25 bp, Homo sapien
ttctaatattaacatccatctttcc

SEQ ID NO: 165434 - DNA, 25 bp, Homo sapien
tctaatattaacatccatctttccc

SEQ ID NO: 165435 - DNA, 25 bp, Homo sapien
ctaatattaacatccatctttccct

SEQ ID NO: 165436 - DNA, 25 bp, Homo sapien
taatattaacatccatctttccctc

SEQ ID NO: 165437 - DNA, 25 bp, Homo sapien
aatattaacatccatctttccctcc

SEQ ID NO: 165438 - DNA, 25 bp, Homo sapien
atattaacatccatctttccctccc

SEQ ID NO: 165439 - DNA, 25 bp, Homo sapien
tattaacatccatctttccctccca

SEQ ID NO: 165440 - DNA, 25 bp, Homo sapien
ttaacatccatctttccctcccaat

SEQ ID NO: 165441 - DNA, 25 bp, Homo sapien
taaatgtcacattcacccacttttt

SEQ ID NO: 165442 - DNA, 25 bp, Homo sapien
ttcgtcacccagacgcaagacagta

SEQ ID NO: 165443 - DNA, 25 bp, Homo sapien
atgacactggccctaagaagcacag

SEQ ID NO: 165444 - DNA, 25 bp, Homo sapien
tggccctaagaagcacagcagcaag

SEQ ID NO: 165445 - DNA, 25 bp, Homo sapien
gcagcaagaactcagagagagctca

SEQ ID NO: 165446 - DNA, 25 bp, Homo sapien
gcagaagctccccaaatccaggacg

SEQ ID NO: 165447 - DNA, 25 bp, Homo sapien
atccaggacggcctactctggtgga

SEQ ID NO: 165448 - DNA, 25 bp, Homo sapien
cctactctggtggagcagaggacct

SEQ ID NO: 165449 - DNA, 25 bp, Homo sapien
aaggagaaacccaagcacgagcaca

SEQ ID NO: 165450 - DNA, 25 bp, Homo sapien
agcacgagcacaagtcctcaagcag

SEQ ID NO: 165451 - DNA, 25 bp, Homo sapien
aaaagaccaggattagggacagagg

SEQ ID NO: 165452 - DNA, 25 bp, Homo sapien
ttcagatgcacattctagctggtat

SEQ ID NO: 165453 - DNA, 25 bp, Homo sapien
actttgtaattccagcgagtcgact

SEQ ID NO: 165454 - DNA, 25 bp, Homo sapien
ctttgtaattccagcgagtcgactt

SEQ ID NO: 165455 - DNA, 25 bp, Homo sapien
tttgtaattccagcgagtcgacttc

SEQ ID NO: 165456 - DNA, 25 bp, Homo sapien
tgtaattccagcgagtcgacttccc

SEQ ID NO: 165457 - DNA, 25 bp, Homo sapien
gtaattccagcgagtcgacttccca

SEQ ID NO: 165458 - DNA, 25 bp, Homo sapien
taattccagcgagtcgacttcccat

SEQ ID NO: 165459 - DNA, 25 bp, Homo sapien
aattccagcgagtcgacttcccatc

SEQ ID NO: 165460 - DNA, 25 bp, Homo sapien
cagcgagtcgacttcccatcctgag

SEQ ID NO: 165461 - DNA, 25 bp, Homo sapien
agcgagtcgacttcccatcctgagt

SEQ ID NO: 165462 - DNA, 25 bp, Homo sapien
gcgagtcgacttcccatcctgagtt

SEQ ID NO: 165463 - DNA, 25 bp, Homo sapien
cgagtcgacttcccatcctgagttg

SEQ ID NO: 165464 - DNA, 25 bp, Homo sapien
gctgtgagaaaaacgatcctttgtc

SEQ ID NO: 165465 - DNA, 25 bp, Homo sapien
gagaaaaacgatcctttgtctttgt

SEQ ID NO: 165466 - DNA, 25 bp, Homo sapien
tttgtctttgttagatgattcgaag

SEQ ID NO: 165467 - DNA, 25 bp, Homo sapien
gatgattcgaagtttcctatagagg

SEQ ID NO: 165468 - DNA, 25 bp, Homo sapien
ttcctatagaggataccccattggt

SEQ ID NO: 165469 - DNA, 25 bp, Homo sapien
ccccattggttccagtgagttttat

SEQ ID NO: 165470 - DNA, 25 bp, Homo sapien
cattggttccagtgagttttatttt

SEQ ID NO: 165471 - DNA, 25 bp, Homo sapien
ttactttgaagtttgcggcatgatg

SEQ ID NO: 165472 - DNA, 25 bp, Homo sapien
cggcatgatggtggaaagtgtaaat

SEQ ID NO: 165473 - DNA, 25 bp, Homo sapien
tggtggaaagtgtaaatgctaaaac

SEQ ID NO: 165474 - DNA, 25 bp, Homo sapien
aaatgctaaaacactgatgagtaga

SEQ ID NO: 165475 - DNA, 25 bp, Homo sapien
ttccacttcttcaaaatgaacttac

SEQ ID NO: 165476 - DNA, 25 bp, Homo sapien
gaacttactctagaaagcttaccct

SEQ ID NO: 165477 - DNA, 25 bp, Homo sapien
gaaagcttacccttggataaccagt

SEQ ID NO: 165478 - DNA, 25 bp, Homo sapien
tacccttggataaccagtttgactt

SEQ ID NO: 165479 - DNA, 25 bp, Homo sapien
gtttgactttcataatgtctctgtt

SEQ ID NO: 165480 - DNA, 25 bp, Homo sapien
tttttccaacaattacagactcagg

SEQ ID NO: 165481 - DNA, 25 bp, Homo sapien
cagactcaggttctcttattttgga

SEQ ID NO: 165482 - DNA, 25 bp, Homo sapien
aagtttctatctggttttgttctga

SEQ ID NO: 165483 - DNA, 25 bp, Homo sapien
tttgctcagggcatcaaaatgtgct

SEQ ID NO: 165484 - DNA, 25 bp, Homo sapien
aaatgttgttagcttggtgtaaaat

SEQ ID NO: 165485 - DNA, 25 bp, Homo sapien
aatgtatattgactgtattggtgaa

SEQ ID NO: 165486 - DNA, 25 bp, Homo sapien
ggtggagcctctgtgtgactccata

SEQ ID NO: 165487 - DNA, 25 bp, Homo sapien
agcctctgtgtgactccatactcct

SEQ ID NO: 165488 - DNA, 25 bp, Homo sapien
acaacactcatctgtcaaacaccaa

SEQ ID NO: 165489 - DNA, 25 bp, Homo sapien
atctgtcaaacaccaagcactctca

SEQ ID NO: 165490 - DNA, 25 bp, Homo sapien
tctctgcctttgtggttggaggcct

SEQ ID NO: 165491 - DNA, 25 bp, Homo sapien
ttggaactcttgctaacctgttcag

SEQ ID NO: 165492 - DNA, 25 bp, Homo sapien
ttgctaacctgttcagagccaggaa

SEQ ID NO: 165493 - DNA, 25 bp, Homo sapien
ccaggaaggagactgcacagttttg

SEQ ID NO: 165494 - DNA, 25 bp, Homo sapien
gcacagttttgaaagcacagcccgt

SEQ ID NO: 165495 - DNA, 25 bp, Homo sapien
ttttgaaagcacagcccgtcaggtc

SEQ ID NO: 165496 - DNA, 25 bp, Homo sapien
tctctgcagcctgtgtaagctatta

SEQ ID NO: 165497 - DNA, 25 bp, Homo sapien
gctgtgagaaaaacgatcctttgtc

SEQ ID NO: 165498 - DNA, 25 bp, Homo sapien
gtgagaaaaacgatcctttgtcttt

SEQ ID NO: 165499 - DNA, 25 bp, Homo sapien
gagaaaaacgatcctttgtctttgt

SEQ ID NO: 165500 - DNA, 25 bp, Homo sapien
tttgtctttgttagatgattcgaag

SEQ ID NO: 165501 - DNA, 25 bp, Homo sapien
tttgttagatgattcgaagtttcct

SEQ ID NO: 165502 - DNA, 25 bp, Homo sapien
gttagatgattcgaagtttcctata

SEQ ID NO: 165503 - DNA, 25 bp, Homo sapien
gatgattcgaagtttcctatagagg

SEQ ID NO: 165504 - DNA, 25 bp, Homo sapien
gaagtttcctatagaggatacccca

SEQ ID NO: 165505 - DNA, 25 bp, Homo sapien
ttcctatagaggataccccattggt

SEQ ID NO: 165506 - DNA, 25 bp, Homo sapien
tcctatagaggataccccattggtt

SEQ ID NO: 165507 - DNA, 25 bp, Homo sapien
ctatagaggataccccattggttcc

SEQ ID NO: 165508 - DNA, 25 bp, Homo sapien
taagggtggtttggcaacacctcct

SEQ ID NO: 165509 - DNA, 25 bp, Homo sapien
gctttgctgtttggtgtagtaaatc

SEQ ID NO: 165510 - DNA, 25 bp, Homo sapien
atctagtttacttcctaaatttcag

SEQ ID NO: 165511 - DNA, 25 bp, Homo sapien
taaatttcagtaggctttatgctgt

SEQ ID NO: 165512 - DNA, 25 bp, Homo sapien
gctttatgctgtgtttatcgcccaa

SEQ ID NO: 165513 - DNA, 25 bp, Homo sapien
tgctgtgtttatcgcccaatttatt

SEQ ID NO: 165514 - DNA, 25 bp, Homo sapien
tgaaatcttaaaacctgcctccaag

SEQ ID NO: 165515 - DNA, 25 bp, Homo sapien
tatttgtacaaatactgcctagtgt

SEQ ID NO: 165516 - DNA, 25 bp, Homo sapien
tactgcctagtgtattcaacagaag

SEQ ID NO: 165517 - DNA, 25 bp, Homo sapien
aacagaagactgtggtcatgtaaca

SEQ ID NO: 165518 - DNA, 25 bp, Homo sapien
gtaacaggtaaccacaattttcagg

SEQ ID NO: 165519 - DNA, 25 bp, Homo sapien
agacgcctatgaaacacctgaatga

SEQ ID NO: 165520 - DNA, 25 bp, Homo sapien
gaaacacctgaatgaactttgatga

SEQ ID NO: 165521 - DNA, 25 bp, Homo sapien
gtacagtctgagttaccatcatgca

SEQ ID NO: 165522 - DNA, 25 bp, Homo sapien
atcatgcacaagtagaactgctctt

SEQ ID NO: 165523 - DNA, 25 bp, Homo sapien
tcctgttgtttgtggaacctacgcg

SEQ ID NO: 165524 - DNA, 25 bp, Homo sapien
gaacctacgcgtttgaatggcttga

SEQ ID NO: 165525 - DNA, 25 bp, Homo sapien
tggcttgaacgttgcatcttttaaa

SEQ ID NO: 165526 - DNA, 25 bp, Homo sapien
ggtttcttggcatttatcctagttg

SEQ ID NO: 165527 - DNA, 25 bp, Homo sapien
tatcctagttgtccgtgtttggcaa

SEQ ID NO: 165528 - DNA, 25 bp, Homo sapien
gttttctctggagtacttggacaga

SEQ ID NO: 165529 - DNA, 25 bp, Homo sapien
ggacagatgttatagtggtttcttt

SEQ ID NO: 165530 - DNA, 25 bp, Homo sapien
tcgggaaggtactcgccctaaagag

SEQ ID NO: 165531 - DNA, 25 bp, Homo sapien
aaggtactcgccctaaagagctgaa

SEQ ID NO: 165532 - DNA, 25 bp, Homo sapien
agagctgaagggttacgccctgctt

SEQ ID NO: 165533 - DNA, 25 bp, Homo sapien
aagggttacgccctgcttgccaacg

SEQ ID NO: 165534 - DNA, 25 bp, Homo sapien
cctgcttgccaacgtgctttaaaaa

SEQ ID NO: 165535 - DNA, 25 bp, Homo sapien
aaaagaccgtttctgactctgtggc

SEQ ID NO: 165536 - DNA, 25 bp, Homo sapien
agaccgtttctgactctgtggccct

SEQ ID NO: 165537 - DNA, 25 bp, Homo sapien
gaccctgggaacatttgcgggccca

SEQ ID NO: 165538 - DNA, 25 bp, Homo sapien
atttgcgggcccattcagattccac

SEQ ID NO: 165539 - DNA, 25 bp, Homo sapien
gcccattcagattccacggtgactt

SEQ ID NO: 165540 - DNA, 25 bp, Homo sapien
cacggtgactttccgtttgccaaat

SEQ ID NO: 165541 - DNA, 25 bp, Homo sapien
taaagcataccgaaaattagcactg

SEQ ID NO: 165542 - DNA, 25 bp, Homo sapien
ggcacccagataacttccagaatga

SEQ ID NO: 165543 - DNA, 25 bp, Homo sapien
aagttcattgatatagcagctgcta

SEQ ID NO: 165544 - DNA, 25 bp, Homo sapien
tagcagctgctaaagaagtcctctc

SEQ ID NO: 165545 - DNA, 25 bp, Homo sapien
aaagaagtcctctctgatccagaaa

SEQ ID NO: 165546 - DNA, 25 bp, Homo sapien
gtttgacgacggagaagatcctttg

SEQ ID NO: 165547 - DNA, 25 bp, Homo sapien
gatcctttggatgcagagagccagc

SEQ ID NO: 165548 - DNA, 25 bp, Homo sapien
aggcggcggcaaccctttccacaga

SEQ ID NO: 165549 - DNA, 25 bp, Homo sapien
agaagctggaactcatggcaagggt

SEQ ID NO: 165550 - DNA, 25 bp, Homo sapien
tggcaagggttcaatcccttcagct

SEQ ID NO: 165551 - DNA, 25 bp, Homo sapien
tcagctcaggcggaccatttagatt

SEQ ID NO: 165552 - DNA, 25 bp, Homo sapien
tgggtgcttttcctccagtttgctg

SEQ ID NO: 165553 - DNA, 25 bp, Homo sapien
tttcctccagtttgctggctggctt

SEQ ID NO: 165554 - DNA, 25 bp, Homo sapien
gtttgatgtcactgactgtctacat

SEQ ID NO: 165555 - DNA, 25 bp, Homo sapien
tgatgtcactgactgtctacatgta

SEQ ID NO: 165556 - DNA, 25 bp, Homo sapien
cactgactgtctacatgtatttata

SEQ ID NO: 165557 - DNA, 25 bp, Homo sapien
tcttgatattttctaccctcactag

SEQ ID NO: 165558 - DNA, 25 bp, Homo sapien
tgatattttctaccctcactagaat

SEQ ID NO: 165559 - DNA, 25 bp, Homo sapien
tcttgttctcttctctatccctaga

SEQ ID NO: 165560 - DNA, 25 bp, Homo sapien
gttctcttctctatccctagagtaa

SEQ ID NO: 165561 - DNA, 25 bp, Homo sapien
ctatccctagagtaagaccaacttg

SEQ ID NO: 165562 - DNA, 25 bp, Homo sapien
gaccaacttgaacctggcatatagt

SEQ ID NO: 165563 - DNA, 25 bp, Homo sapien
cgagcctcttctgataactcaggat

SEQ ID NO: 165564 - DNA, 25 bp, Homo sapien
gagcctcttctgataactcaggatt

SEQ ID NO: 165565 - DNA, 25 bp, Homo sapien
agcctcttctgataactcaggattt

SEQ ID NO: 165566 - DNA, 25 bp, Homo sapien
gcctcttctgataactcaggattta

SEQ ID NO: 165567 - DNA, 25 bp, Homo sapien
cctcttctgataactcaggatttac

SEQ ID NO: 165568 - DNA, 25 bp, Homo sapien
ctcttctgataactcaggatttact

SEQ ID NO: 165569 - DNA, 25 bp, Homo sapien
tcttctgataactcaggatttactt

SEQ ID NO: 165570 - DNA, 25 bp, Homo sapien
cttctgataactcaggatttacttg

SEQ ID NO: 165571 - DNA, 25 bp, Homo sapien
ttctgataactcaggatttacttga

SEQ ID NO: 165572 - DNA, 25 bp, Homo sapien
tctgataactcaggatttacttgaa

SEQ ID NO: 165573 - DNA, 25 bp, Homo sapien
ctgataactcaggatttacttgaaa

SEQ ID NO: 165574 - DNA, 25 bp, Homo sapien
gcttttggtaagtgataggtcagga

SEQ ID NO: 165575 - DNA, 25 bp, Homo sapien
agtgataggtcaggagagtaacagc

SEQ ID NO: 165576 - DNA, 25 bp, Homo sapien
tataaagagacccagagagctccat

SEQ ID NO: 165577 - DNA, 25 bp, Homo sapien
ataaagagacccagagagctccatc

SEQ ID NO: 165578 - DNA, 25 bp, Homo sapien
taaagagacccagagagctccatca

SEQ ID NO: 165579 - DNA, 25 bp, Homo sapien
agagagctccatcaccccttctgcc

SEQ ID NO: 165580 - DNA, 25 bp, Homo sapien
gaagacaaacatccacgaaccagga

SEQ ID NO: 165581 - DNA, 25 bp, Homo sapien
aagacaaacatccacgaaccaggaa

SEQ ID NO: 165582 - DNA, 25 bp, Homo sapien
agacaaacatccacgaaccaggaag

SEQ ID NO: 165583 - DNA, 25 bp, Homo sapien
gacaaacatccacgaaccaggaagt

SEQ ID NO: 165584 - DNA, 25 bp, Homo sapien
acaaacatccacgaaccaggaagtg

SEQ ID NO: 165585 - DNA, 25 bp, Homo sapien
gaaggtgaagcttttgcacgagaac

SEQ ID NO: 165586 - DNA, 25 bp, Homo sapien
ttcatggaaacgtctgctaagactg

SEQ ID NO: 165587 - DNA, 25 bp, Homo sapien
gaaacgtctgctaagactgcttcca

SEQ ID NO: 165588 - DNA, 25 bp, Homo sapien
gtctgctaagactgcttccaatgta

SEQ ID NO: 165589 - DNA, 25 bp, Homo sapien
tgctaagactgcttccaatgtagaa

SEQ ID NO: 165590 - DNA, 25 bp, Homo sapien
gactgcttccaatgtagaagaggca

SEQ ID NO: 165591 - DNA, 25 bp, Homo sapien
gaagaggcatttattaatacagcaa

SEQ ID NO: 165592 - DNA, 25 bp, Homo sapien
ggcattaaaattggccctcagcatg

SEQ ID NO: 165593 - DNA, 25 bp, Homo sapien
aaattggccctcagcatgctgctac

SEQ ID NO: 165594 - DNA, 25 bp, Homo sapien
tggccctcagcatgctgctaccaat

SEQ ID NO: 165595 - DNA, 25 bp, Homo sapien
gctgctaccaatgcaacacatgcag

SEQ ID NO: 165596 - DNA, 25 bp, Homo sapien
ttgcccactgtgacttcaaacccaa

SEQ ID NO: 165597 - DNA, 25 bp, Homo sapien
gaggaactcttgatcaagatgccca

SEQ ID NO: 165598 - DNA, 25 bp, Homo sapien
agatgcccaaccctgtgatcagaac

SEQ ID NO: 165599 - DNA, 25 bp, Homo sapien
agaacctccaaatactgccatgaga

SEQ ID NO: 165600 - DNA, 25 bp, Homo sapien
ccttcctgccctgtgttaggagata

SEQ ID NO: 165601 - DNA, 25 bp, Homo sapien
gagatagggatattggcccctcact

SEQ ID NO: 165602 - DNA, 25 bp, Homo sapien
agctgccagcacttggtcagtcact

SEQ ID NO: 165603 - DNA, 25 bp, Homo sapien
tcactctcagccatagcactttgtt

SEQ ID NO: 165604 - DNA, 25 bp, Homo sapien
actttgttcactgtcctgtgtcaga

SEQ ID NO: 165605 - DNA, 25 bp, Homo sapien
tcctgtgtcagagcactgagctcca

SEQ ID NO: 165606 - DNA, 25 bp, Homo sapien
agctccacccttttctgagagttat

SEQ ID NO: 165607 - DNA, 25 bp, Homo sapien
ggcctcggacggcagtgacttcact

SEQ ID NO: 165608 - DNA, 25 bp, Homo sapien
ttctaagacccctcagcgttcagca

SEQ ID NO: 165609 - DNA, 25 bp, Homo sapien
gcagcccacagctctggcgctggag

SEQ ID NO: 165610 - DNA, 25 bp, Homo sapien
ctctaatacgctgcgggagcggagc

SEQ ID NO: 165611 - DNA, 25 bp, Homo sapien
agaagccgcccgtcctcataaggga

SEQ ID NO: 165612 - DNA, 25 bp, Homo sapien
ccgcccgtcctcataagggattgaa

SEQ ID NO: 165613 - DNA, 25 bp, Homo sapien
agggattgaacttgcatccactcct

SEQ ID NO: 165614 - DNA, 25 bp, Homo sapien
cggcttggtcgctggctgcgctcca

SEQ ID NO: 165615 - DNA, 25 bp, Homo sapien
ccgattctcgggatcattggaccgt

SEQ ID NO: 165616 - DNA, 25 bp, Homo sapien
gatcattggaccgtttgcgcgaaac

SEQ ID NO: 165617 - DNA, 25 bp, Homo sapien
ttgcgcgaaaccagagtggccgatt

SEQ ID NO: 165618 - DNA, 25 bp, Homo sapien
tgggtgttcggcatgaccccaacat

SEQ ID NO: 165619 - DNA, 25 bp, Homo sapien
gaccccaacatgaaatatgagctac

SEQ ID NO: 165620 - DNA, 25 bp, Homo sapien
atatgagctacagctggcgaacccc

SEQ ID NO: 165621 - DNA, 25 bp, Homo sapien
tacagctggcgaaccccaaagagtt

SEQ ID NO: 165622 - DNA, 25 bp, Homo sapien
gaaccccaaagagttctaccacgag

SEQ ID NO: 165623 - DNA, 25 bp, Homo sapien
gagttctaccacgaggtgcacaggc

SEQ ID NO: 165624 - DNA, 25 bp, Homo sapien
tcaactttgctctcctgcaggaggg

SEQ ID NO: 165625 - DNA, 25 bp, Homo sapien
tttactctgcggatcgggaggacct

SEQ ID NO: 165626 - DNA, 25 bp, Homo sapien
atcgggaggacctgtatgcctgacc

SEQ ID NO: 165627 - DNA, 25 bp, Homo sapien
gaggacctgtatgcctgaccgtttc

SEQ ID NO: 165628 - DNA, 25 bp, Homo sapien
gccgctgacattcagcagtttggcc

SEQ ID NO: 165629 - DNA, 25 bp, Homo sapien
cacttttctaagacccctcagcgtt

SEQ ID NO: 165630 - DNA, 25 bp, Homo sapien
tttctaagacccctcagcgttcagc

SEQ ID NO: 165631 - DNA, 25 bp, Homo sapien
ttctaagacccctcagcgttcagca

SEQ ID NO: 165632 - DNA, 25 bp, Homo sapien
tctaagacccctcagcgttcagcag

SEQ ID NO: 165633 - DNA, 25 bp, Homo sapien
taagacccctcagcgttcagcagcc

SEQ ID NO: 165634 - DNA, 25 bp, Homo sapien
gcagcccacagctctggcgctggag

SEQ ID NO: 165635 - DNA, 25 bp, Homo sapien
cagctctggcgctggagcctgacgc

SEQ ID NO: 165636 - DNA, 25 bp, Homo sapien
ggagcctgacgccatccggtcccgc

SEQ ID NO: 165637 - DNA, 25 bp, Homo sapien
ggtcccgctctaatacgctgcggga

SEQ ID NO: 165638 - DNA, 25 bp, Homo sapien
cccgctctaatacgctgcgggagcg

SEQ ID NO: 165639 - DNA, 25 bp, Homo sapien
cgctctaatacgctgcgggagcgga

SEQ ID NO: 165640 - DNA, 25 bp, Homo sapien
gcaggagatcaccaacctggccgac

SEQ ID NO: 165641 - DNA, 25 bp, Homo sapien
ctggccgacagcctgcagctcgaga

SEQ ID NO: 165642 - DNA, 25 bp, Homo sapien
agaagcgcatgacgccgcccgggat

SEQ ID NO: 165643 - DNA, 25 bp, Homo sapien
ggatccaacagcagacgcccgacga

SEQ ID NO: 165644 - DNA, 25 bp, Homo sapien
gcccgacgacgtctactcgcaggtg

SEQ ID NO: 165645 - DNA, 25 bp, Homo sapien
gacgacgtctactcgcaggtgggca

SEQ ID NO: 165646 - DNA, 25 bp, Homo sapien
acgacgtctactcgcaggtgggcac

SEQ ID NO: 165647 - DNA, 25 bp, Homo sapien
acgtctactcgcaggtgggcaccgt

SEQ ID NO: 165648 - DNA, 25 bp, Homo sapien
tcaccacgggctgcagacgagcgtt

SEQ ID NO: 165649 - DNA, 25 bp, Homo sapien
accacgggctgcagacgagcgttca

SEQ ID NO: 165650 - DNA, 25 bp, Homo sapien
cacgggctgcagacgagcgttcagt

SEQ ID NO: 165651 - DNA, 25 bp, Homo sapien
gtgttctctatgtagtggctgagaa

SEQ ID NO: 165652 - DNA, 25 bp, Homo sapien
gaagaccaaagagcaagtgacaaat

SEQ ID NO: 165653 - DNA, 25 bp, Homo sapien
acgggtgtgacagcagtagcccaga

SEQ ID NO: 165654 - DNA, 25 bp, Homo sapien
agggagcattgcagcagccactggc

SEQ ID NO: 165655 - DNA, 25 bp, Homo sapien
gcagccactggctttgtcaaaaagg

SEQ ID NO: 165656 - DNA, 25 bp, Homo sapien
ttgtcaaaaaggaccagttgggcaa

SEQ ID NO: 165657 - DNA, 25 bp, Homo sapien
aagaaggagccccacaggaaggaat

SEQ ID NO: 165658 - DNA, 25 bp, Homo sapien
gaattctggaagatatgcctgtgga

SEQ ID NO: 165659 - DNA, 25 bp, Homo sapien
tatgcctgtggatcctgacaatgag

SEQ ID NO: 165660 - DNA, 25 bp, Homo sapien
gtggatcctgacaatgaggcttatg

SEQ ID NO: 165661 - DNA, 25 bp, Homo sapien
ggcttatgaaatgccttctgaggaa

SEQ ID NO: 165662 - DNA, 25 bp, Homo sapien
ttaaaatcttaattgttggctgggc

SEQ ID NO: 165663 - DNA, 25 bp, Homo sapien
taaaatcttaattgttggctgggca

SEQ ID NO: 165664 - DNA, 25 bp, Homo sapien
aaaatcttaattgttggctgggcac

SEQ ID NO: 165665 - DNA, 25 bp, Homo sapien
aaatcttaattgttggctgggcaca

SEQ ID NO: 165666 - DNA, 25 bp, Homo sapien
aatcttaattgttggctgggcacag

SEQ ID NO: 165667 - DNA, 25 bp, Homo sapien
atcttaattgttggctgggcacagt

SEQ ID NO: 165668 - DNA, 25 bp, Homo sapien
tcttaattgttggctgggcacagtg

SEQ ID NO: 165669 - DNA, 25 bp, Homo sapien
cttaattgttggctgggcacagtgg

SEQ ID NO: 165670 - DNA, 25 bp, Homo sapien
ggcggatcatgaggttaggagagcg

SEQ ID NO: 165671 - DNA, 25 bp, Homo sapien
cggatcatgaggttaggagagcgag

SEQ ID NO: 165672 - DNA, 25 bp, Homo sapien
gtctctccacagcacctttgtgaac

SEQ ID NO: 165673 - DNA, 25 bp, Homo sapien
gtgaactcaggaatgtgcgccagtg

SEQ ID NO: 165674 - DNA, 25 bp, Homo sapien
gaagggctctcttgacagtcagcgt

SEQ ID NO: 165675 - DNA, 25 bp, Homo sapien
cagtcagcgtgccatcttgatgtgt

SEQ ID NO: 165676 - DNA, 25 bp, Homo sapien
gtgtgtatgtacattggtcaggtat

SEQ ID NO: 165677 - DNA, 25 bp, Homo sapien
ggtcaggtatattatctcaaaggat

SEQ ID NO: 165678 - DNA, 25 bp, Homo sapien
tattggcgcttttaactcagagttt

SEQ ID NO: 165679 - DNA, 25 bp, Homo sapien
tcagagttttaaaccccaggaacag

SEQ ID NO: 165680 - DNA, 25 bp, Homo sapien
gaacagagactcctagttgagtgat

SEQ ID NO: 165681 - DNA, 25 bp, Homo sapien
tgtttttcttctcccaatagctttc

SEQ ID NO: 165682 - DNA, 25 bp, Homo sapien
aatagctttcaattgttctttctgg

SEQ ID NO: 165683 - DNA, 25 bp, Homo sapien
tgttgagttttcctgacttggaaaa

SEQ ID NO: 165684 - DNA, 25 bp, Homo sapien
tggaaagcccatttgtgtacacagt

SEQ ID NO: 165685 - DNA, 25 bp, Homo sapien
atttgtgtacacagtcagctttggg

SEQ ID NO: 165686 - DNA, 25 bp, Homo sapien
gttccttttattagtgctttgccag

SEQ ID NO: 165687 - DNA, 25 bp, Homo sapien
ctttgccagaggctgatgtcaagca

SEQ ID NO: 165688 - DNA, 25 bp, Homo sapien
agaggctgatgtcaagcaccacacc

SEQ ID NO: 165689 - DNA, 25 bp, Homo sapien
tgagtccgacccagacatccaaact

SEQ ID NO: 165690 - DNA, 25 bp, Homo sapien
ggaagtcatccagtctattcacaga

SEQ ID NO: 165691 - DNA, 25 bp, Homo sapien
gattttgattgcttacctacatacg

SEQ ID NO: 165692 - DNA, 25 bp, Homo sapien
gcttacctacatacgtgttcctagt

SEQ ID NO: 165693 - DNA, 25 bp, Homo sapien
acgtgttcctagtttttatacatgt

SEQ ID NO: 165694 - DNA, 25 bp, Homo sapien
tggtaatctaccaccaagcttgtgg

SEQ ID NO: 165695 - DNA, 25 bp, Homo sapien
taccaccaagcttgtggacttcacc

SEQ ID NO: 165696 - DNA, 25 bp, Homo sapien
ttcaccccaacaaaattgtaagcgt

SEQ ID NO: 165697 - DNA, 25 bp, Homo sapien
gtgtaagattcttgctgtagcgtgg

SEQ ID NO: 165698 - DNA, 25 bp, Homo sapien
cttgctgtagcgtggatagctgtga

SEQ ID NO: 165699 - DNA, 25 bp, Homo sapien
ctgtgattggtgagtcaaccgtctg

SEQ ID NO: 165700 - DNA, 25 bp, Homo sapien
gtgagtcaaccgtctgtggctacca

SEQ ID NO: 165701 - DNA, 25 bp, Homo sapien
gtctgtggctaccagttacactgag

SEQ ID NO: 165702 - DNA, 25 bp, Homo sapien
gtggctaccagttacactgagattg

SEQ ID NO: 165703 - DNA, 25 bp, Homo sapien
tttgggtctgttttttcatgctttg

SEQ ID NO: 165704 - DNA, 25 bp, Homo sapien
ggacattttatgtgacaactgccaa

SEQ ID NO: 165705 - DNA, 25 bp, Homo sapien
atcagccaccctctttgtgaagatc

SEQ ID NO: 165706 - DNA, 25 bp, Homo sapien
tctttgtgaagatctccctccagga

SEQ ID NO: 165707 - DNA, 25 bp, Homo sapien
aagatctccctccaggactaggctg

SEQ ID NO: 165708 - DNA, 25 bp, Homo sapien
caggactaggctggaggaacccagt

SEQ ID NO: 165709 - DNA, 25 bp, Homo sapien
gacagggctggtgtgcctgctccca

SEQ ID NO: 165710 - DNA, 25 bp, Homo sapien
ttgctcagagctaggcccccaaatt

SEQ ID NO: 165711 - DNA, 25 bp, Homo sapien
aaattgccttcagccctaacatagt

SEQ ID NO: 165712 - DNA, 25 bp, Homo sapien
ttgccttcagccctaacatagtgtc

SEQ ID NO: 165713 - DNA, 25 bp, Homo sapien
gggaccaggagctagcccagtccct

SEQ ID NO: 165714 - DNA, 25 bp, Homo sapien
gagctgtccttcattccgttaggaa

SEQ ID NO: 165715 - DNA, 25 bp, Homo sapien
aggaataacaatgcagccctctcca

SEQ ID NO: 165716 - DNA, 25 bp, Homo sapien
atcatgctgtgcctcaaggaaaaaa

SEQ ID NO: 165717 - DNA, 25 bp, Homo sapien
gaagcaacagttgtgtctagatgtc

SEQ ID NO: 165718 - DNA, 25 bp, Homo sapien
tgtgtctagatgtcagaggcatggc

SEQ ID NO: 165719 - DNA, 25 bp, Homo sapien
agaggcatggctgggcctccatctc

SEQ ID NO: 165720 - DNA, 25 bp, Homo sapien
ctccatctctgcctaagggagatat

SEQ ID NO: 165721 - DNA, 25 bp, Homo sapien
aaaagagttcaaactattgcccatg

SEQ ID NO: 165722 - DNA, 25 bp, Homo sapien
aactattgcccatgttccccagggt

SEQ ID NO: 165723 - DNA, 25 bp, Homo sapien
gttccccagggtcagaagttctaat

SEQ ID NO: 165724 - DNA, 25 bp, Homo sapien
atagaggctgggttgtaagtagtaa

SEQ ID NO: 165725 - DNA, 25 bp, Homo sapien
ggtagcagaatatgccatctttggc

SEQ ID NO: 165726 - DNA, 25 bp, Homo sapien
tgccatctttggcataagaagtatt

SEQ ID NO: 165727 - DNA, 25 bp, Homo sapien
tggcgagtacgcccggctcgcactt

SEQ ID NO: 165728 - DNA, 25 bp, Homo sapien
gataactcaggatttacttgaaatg

SEQ ID NO: 165729 - DNA, 25 bp, Homo sapien
atgaaaggagattccaacctacttc

SEQ ID NO: 165730 - DNA, 25 bp, Homo sapien
gaaaggagattccaacctacttcag

SEQ ID NO: 165731 - DNA, 25 bp, Homo sapien
aaggagattccaacctacttcaggt

SEQ ID NO: 165732 - DNA, 25 bp, Homo sapien
tccaacctacttcaggtgagtttat

SEQ ID NO: 165733 - DNA, 25 bp, Homo sapien
ccaacctacttcaggtgagtttatt

SEQ ID NO: 165734 - DNA, 25 bp, Homo sapien
caacctacttcaggtgagtttattt

SEQ ID NO: 165735 - DNA, 25 bp, Homo sapien
acctacttcaggtgagtttatttat

SEQ ID NO: 165736 - DNA, 25 bp, Homo sapien
cttcaggtgagtttatttatttctt

SEQ ID NO: 165737 - DNA, 25 bp, Homo sapien
gaatgtggttattataaagctttaa

SEQ ID NO: 165738 - DNA, 25 bp, Homo sapien
ttgggcaagggcactcagcgcctcg

SEQ ID NO: 165739 - DNA, 25 bp, Homo sapien
tgccttggccaatgcgaggtccttc

SEQ ID NO: 165740 - DNA, 25 bp, Homo sapien
tggccaatgcgaggtccttccttat

SEQ ID NO: 165741 - DNA, 25 bp, Homo sapien
gggtccatggtctatttattctcgc

SEQ ID NO: 165742 - DNA, 25 bp, Homo sapien
atggtctatttattctcgcccagct

SEQ ID NO: 165743 - DNA, 25 bp, Homo sapien
cttccctcgctgtgtacttccttgt

SEQ ID NO: 165744 - DNA, 25 bp, Homo sapien
cgctgtgtacttccttgtccccttt

SEQ ID NO: 165745 - DNA, 25 bp, Homo sapien
gcaagaagagattcacagtgtcctg

SEQ ID NO: 165746 - DNA, 25 bp, Homo sapien
gggttcacagtaatcatggtctact

SEQ ID NO: 165747 - DNA, 25 bp, Homo sapien
agtaatcatggtctactcctctttc

SEQ ID NO: 165748 - DNA, 25 bp, Homo sapien
tcatggtctactcctctttccgtgg

SEQ ID NO: 165749 - DNA, 25 bp, Homo sapien
gaacatgataggcttacttctgctc

SEQ ID NO: 165750 - DNA, 25 bp, Homo sapien
taggcttacttctgctccataataa

SEQ ID NO: 165751 - DNA, 25 bp, Homo sapien
aacttaagactagataactgcgtac

SEQ ID NO: 165752 - DNA, 25 bp, Homo sapien
aactgcgtacatgatggaccatttt

SEQ ID NO: 165753 - DNA, 25 bp, Homo sapien
aaacgcaggctgtttagcatggaga

SEQ ID NO: 165754 - DNA, 25 bp, Homo sapien
gactctcagaacactgggagggtct

SEQ ID NO: 165755 - DNA, 25 bp, Homo sapien
gggttagttgcttggcagcctgcct

SEQ ID NO: 165756 - DNA, 25 bp, Homo sapien
gcctgccactgagggaagtcccatt

SEQ ID NO: 165757 - DNA, 25 bp, Homo sapien
gaagtcccattagagatgtatcacc

SEQ ID NO: 165758 - DNA, 25 bp, Homo sapien
tagagatgtatcaccaccttgtcac

SEQ ID NO: 165759 - DNA, 25 bp, Homo sapien
accaccttgtcaccaacaggatgat

SEQ ID NO: 165760 - DNA, 25 bp, Homo sapien
aactcaattagcattgtaatggcca

SEQ ID NO: 165761 - DNA, 25 bp, Homo sapien
tagcattgtaatggccaaatgcatt

SEQ ID NO: 165762 - DNA, 25 bp, Homo sapien
aacaaatcaactcttatccccaaca

SEQ ID NO: 165763 - DNA, 25 bp, Homo sapien
cttatccccaacagctgcctaattt

SEQ ID NO: 165764 - DNA, 25 bp, Homo sapien
tgaccctccacatctcactggtgtg

SEQ ID NO: 165765 - DNA, 25 bp, Homo sapien
ccacatctcactggtgtgggtgcat

SEQ ID NO: 165766 - DNA, 25 bp, Homo sapien
ggtgtcagtatggatgtgtctgaat

SEQ ID NO: 165767 - DNA, 25 bp, Homo sapien
gtctgaatgtgtgaggccttggaag

SEQ ID NO: 165768 - DNA, 25 bp, Homo sapien
ggccttggaagggactctttctgca

SEQ ID NO: 165769 - DNA, 25 bp, Homo sapien
gactctttctgcagatactgtaaat

SEQ ID NO: 165770 - DNA, 25 bp, Homo sapien
gatactgtaaatacaagtaccattt

SEQ ID NO: 165771 - DNA, 25 bp, Homo sapien
agaaaagcagatcccaattcatccc

SEQ ID NO: 165772 - DNA, 25 bp, Homo sapien
gggttttggaagtccctagcaagct

SEQ ID NO: 165773 - DNA, 25 bp, Homo sapien
agtccctagcaagctgttattggta

SEQ ID NO: 165774 - DNA, 25 bp, Homo sapien
atttggtttcagcattagtacctac

SEQ ID NO: 165775 - DNA, 25 bp, Homo sapien
tagtacctacatattgccagtgaga

SEQ ID NO: 165776 - DNA, 25 bp, Homo sapien
cagtgagaaactgggttggacctag

SEQ ID NO: 165777 - DNA, 25 bp, Homo sapien
ggtgttgtcgtgagtgccacctaac

SEQ ID NO: 165778 - DNA, 25 bp, Homo sapien
agtgccacctaaccaggaggccaga

SEQ ID NO: 165779 - DNA, 25 bp, Homo sapien
ggccagagcggtttgaaaacatcct

SEQ ID NO: 165780 - DNA, 25 bp, Homo sapien
gaaaactactaagcttgacatctgt

SEQ ID NO: 165781 - DNA, 25 bp, Homo sapien
aagcttgacatctgtgagtgactga

SEQ ID NO: 165782 - DNA, 25 bp, Homo sapien
ctggggagggcctgcccaaggcgga

SEQ ID NO: 165783 - DNA, 25 bp, Homo sapien
caccatgcccaatggtagatgtgga

SEQ ID NO: 165784 - DNA, 25 bp, Homo sapien
accatgcccaatggtagatgtggac

SEQ ID NO: 165785 - DNA, 25 bp, Homo sapien
ccatgcccaatggtagatgtggacg

SEQ ID NO: 165786 - DNA, 25 bp, Homo sapien
catgcccaatggtagatgtggacgg

SEQ ID NO: 165787 - DNA, 25 bp, Homo sapien
atgcccaatggtagatgtggacggg

SEQ ID NO: 165788 - DNA, 25 bp, Homo sapien
tgtggacggggaagatcagtctatt

SEQ ID NO: 165789 - DNA, 25 bp, Homo sapien
agatcagtctattggaggggaccac

SEQ ID NO: 165790 - DNA, 25 bp, Homo sapien
atcagtctattggaggggaccactc

SEQ ID NO: 165791 - DNA, 25 bp, Homo sapien
cagtctattggaggggaccactcta

SEQ ID NO: 165792 - DNA, 25 bp, Homo sapien
ctattggaggggaccactctaggaa

SEQ ID NO: 165793 - DNA, 25 bp, Homo sapien
ggcttggcgagtacgcccggctcgc

SEQ ID NO: 165794 - DNA, 25 bp, Homo sapien
gcttggcgagtacgcccggctcgca

SEQ ID NO: 165795 - DNA, 25 bp, Homo sapien
tggcgagtacgcccggctcgcactt

SEQ ID NO: 165796 - DNA, 25 bp, Homo sapien
ttgaaatgaaaggagattccaacct

SEQ ID NO: 165797 - DNA, 25 bp, Homo sapien
tgaaatgaaaggagattccaaccta

SEQ ID NO: 165798 - DNA, 25 bp, Homo sapien
gaaatgaaaggagattccaacctac

SEQ ID NO: 165799 - DNA, 25 bp, Homo sapien
aaatgaaaggagattccaacctact

SEQ ID NO: 165800 - DNA, 25 bp, Homo sapien
aatgaaaggagattccaacctactt

SEQ ID NO: 165801 - DNA, 25 bp, Homo sapien
atgaaaggagattccaacctacttc

SEQ ID NO: 165802 - DNA, 25 bp, Homo sapien
tgaaaggagattccaacctacttca

SEQ ID NO: 165803 - DNA, 25 bp, Homo sapien
gaaaggagattccaacctacttcag

SEQ ID NO: 165804 - DNA, 25 bp, Homo sapien
cgaacattaaccaactgagctccac

SEQ ID NO: 165805 - DNA, 25 bp, Homo sapien
gagctccaccgcctgtcaggttagc

SEQ ID NO: 165806 - DNA, 25 bp, Homo sapien
tcaggttagctgcagcattagatag

SEQ ID NO: 165807 - DNA, 25 bp, Homo sapien
tctcataagctcaaactgtattgtg

SEQ ID NO: 165808 - DNA, 25 bp, Homo sapien
atctaggtttcaggctccttgtgac

SEQ ID NO: 165809 - DNA, 25 bp, Homo sapien
aggctccttgtgacaatctaatgcc

SEQ ID NO: 165810 - DNA, 25 bp, Homo sapien
gttggagcagttttagtccggaaat

SEQ ID NO: 165811 - DNA, 25 bp, Homo sapien
tagtccggaaatcattgctcccagc

SEQ ID NO: 165812 - DNA, 25 bp, Homo sapien
ctggtccgtggtataattgtcttac

SEQ ID NO: 165813 - DNA, 25 bp, Homo sapien
attgtcttacacaaacggtctcttg

SEQ ID NO: 165814 - DNA, 25 bp, Homo sapien
caaacggtctcttgtgtcaaaaagg

SEQ ID NO: 165815 - DNA, 25 bp, Homo sapien
ttctatttaatgcagacccggccca

SEQ ID NO: 165816 - DNA, 25 bp, Homo sapien
atttaatgcagacccggcccagaga

SEQ ID NO: 165817 - DNA, 25 bp, Homo sapien
agacccggcccagagactgtgcgtg

SEQ ID NO: 165818 - DNA, 25 bp, Homo sapien
gagactgtgcgtgccactaccaaag

SEQ ID NO: 165819 - DNA, 25 bp, Homo sapien
gtgccactaccaaagccttctgggc

SEQ ID NO: 165820 - DNA, 25 bp, Homo sapien
ctccaagagtattattaacgctgct

SEQ ID NO: 165821 - DNA, 25 bp, Homo sapien
gtattattaacgctgctgtacctcg

SEQ ID NO: 165822 - DNA, 25 bp, Homo sapien
ttattaacgctgctgtacctcgatc

SEQ ID NO: 165823 - DNA, 25 bp, Homo sapien
taacgctgctgtacctcgatctgaa

SEQ ID NO: 165824 - DNA, 25 bp, Homo sapien
gctgctgtacctcgatctgaatctg

SEQ ID NO: 165825 - DNA, 25 bp, Homo sapien
tgtacctcgatctgaatctgccggg

SEQ ID NO: 165826 - DNA, 25 bp, Homo sapien
gttttgctggagaaacatcaggttt

SEQ ID NO: 165827 - DNA, 25 bp, Homo sapien
gactgagttgttagcaggtgtgctt

SEQ ID NO: 165828 - DNA, 25 bp, Homo sapien
tagcaggtgtgcttagctcttgata

SEQ ID NO: 165829 - DNA, 25 bp, Homo sapien
gctcttgatagtgaacgtgtacctt

SEQ ID NO: 165830 - DNA, 25 bp, Homo sapien
aacgtgtaccttgggaactggctca

SEQ ID NO: 165831 - DNA, 25 bp, Homo sapien
ctgctaatagcaccatcgtcactat

SEQ ID NO: 165832 - DNA, 25 bp, Homo sapien
agcaccatcgtcactattaagcaga

SEQ ID NO: 165833 - DNA, 25 bp, Homo sapien
cagacatttcagttggtagaatcca

SEQ ID NO: 165834 - DNA, 25 bp, Homo sapien
gaagtcatggacttttctgggaaat

SEQ ID NO: 165835 - DNA, 25 bp, Homo sapien
tgacttttctgggaaatgacagttt

SEQ ID NO: 165836 - DNA, 25 bp, Homo sapien
ttgacatattttctttgcccacttt

SEQ ID NO: 165837 - DNA, 25 bp, Homo sapien
gaaaatgtgctctgttgtcacagga

SEQ ID NO: 165838 - DNA, 25 bp, Homo sapien
gttgtcacaggatgtttctgttgat

SEQ ID NO: 165839 - DNA, 25 bp, Homo sapien
tttcctgggaattggtaaacatcat

SEQ ID NO: 165840 - DNA, 25 bp, Homo sapien
tcatgttcctgatgataacccagta

SEQ ID NO: 165841 - DNA, 25 bp, Homo sapien
gataacccagtagcaaaaacatttg

SEQ ID NO: 165842 - DNA, 25 bp, Homo sapien
tgtactgagtggtacaagccttggg

SEQ ID NO: 165843 - DNA, 25 bp, Homo sapien
aaagaaactcatttttacgctgaat

SEQ ID NO: 165844 - DNA, 25 bp, Homo sapien
ttatatgattgcattgggaccagtc

SEQ ID NO: 165845 - DNA, 25 bp, Homo sapien
attgggaccagtcatttcctaagct

SEQ ID NO: 165846 - DNA, 25 bp, Homo sapien
ttcctaagctacatatggccatctt

SEQ ID NO: 165847 - DNA, 25 bp, Homo sapien
atggccatcttgacagtgttttttc

SEQ ID NO: 165848 - DNA, 25 bp, Homo sapien
ggtggtgtccacaggcctgatccac

SEQ ID NO: 165849 - DNA, 25 bp, Homo sapien
gtgtccacaggcctgatccacaatg

SEQ ID NO: 165850 - DNA, 25 bp, Homo sapien
ggagcacccaagcgtgacaagccct

SEQ ID NO: 165851 - DNA, 25 bp, Homo sapien
gagcacccaagcgtgacaagccctc

SEQ ID NO: 165852 - DNA, 25 bp, Homo sapien
agcacccaagcgtgacaagccctct

SEQ ID NO: 165853 - DNA, 25 bp, Homo sapien
gcacccaagcgtgacaagccctctc

SEQ ID NO: 165854 - DNA, 25 bp, Homo sapien
cacccaagcgtgacaagccctctca

SEQ ID NO: 165855 - DNA, 25 bp, Homo sapien
aagcgtgacaagccctctcacagtg

SEQ ID NO: 165856 - DNA, 25 bp, Homo sapien
gtgacaagccctctcacagtggaat

SEQ ID NO: 165857 - DNA, 25 bp, Homo sapien
cacagtggaatggagagcacggtct

SEQ ID NO: 165858 - DNA, 25 bp, Homo sapien
gagagcacggtctgaatctgcacag

SEQ ID NO: 165859 - DNA, 25 bp, Homo sapien
ctcagttccaccagttcacagcagt

SEQ ID NO: 165860 - DNA, 25 bp, Homo sapien
agttcacagcagtgcctcatcccaa

SEQ ID NO: 165861 - DNA, 25 bp, Homo sapien
agcagtgcctcatcccaacgtcaag

SEQ ID NO: 165862 - DNA, 25 bp, Homo sapien
aacgtcaagcccatggcctatgcca

SEQ ID NO: 165863 - DNA, 25 bp, Homo sapien
catggcctatgccaacacgctgctg

SEQ ID NO: 165864 - DNA, 25 bp, Homo sapien
tatgccaacacgctgctgcagctag

SEQ ID NO: 165865 - DNA, 25 bp, Homo sapien
acgctgctgcagctaggaatgatgt

SEQ ID NO: 165866 - DNA, 25 bp, Homo sapien
gctgctgcagctaggaatgatgtga

SEQ ID NO: 165867 - DNA, 25 bp, Homo sapien
ctaggaatgatgtgaggtgacgggc

SEQ ID NO: 165868 - DNA, 25 bp, Homo sapien
aggccccgccccagggcaatgttgg

SEQ ID NO: 165869 - DNA, 25 bp, Homo sapien
ttattcccctttaggtttgcagagg

SEQ ID NO: 165870 - DNA, 25 bp, Homo sapien
tacaccggtctttctgtaaagacca

SEQ ID NO: 165871 - DNA, 25 bp, Homo sapien
caaggagaccacaatggagaaaact

SEQ ID NO: 165872 - DNA, 25 bp, Homo sapien
aaggagaccacaatggagaaaactc

SEQ ID NO: 165873 - DNA, 25 bp, Homo sapien
ataatacgtaatgatcaaattgatg

SEQ ID NO: 165874 - DNA, 25 bp, Homo sapien
taatacgtaatgatcaaattgatgt

SEQ ID NO: 165875 - DNA, 25 bp, Homo sapien
aatacgtaatgatcaaattgatgta

SEQ ID NO: 165876 - DNA, 25 bp, Homo sapien
tgatgtaattagtgtattaccttaa

SEQ ID NO: 165877 - DNA, 25 bp, Homo sapien
gatgtaattagtgtattaccttaaa

SEQ ID NO: 165878 - DNA, 25 bp, Homo sapien
taattagtgtattaccttaaacaat

SEQ ID NO: 165879 - DNA, 25 bp, Homo sapien
gtgtattaccttaaacaattaacat

SEQ ID NO: 165880 - DNA, 25 bp, Homo sapien
tgtattaccttaaacaattaacatt

SEQ ID NO: 165881 - DNA, 25 bp, Homo sapien
tcaggattagacttcaggcattcat

SEQ ID NO: 165882 - DNA, 25 bp, Homo sapien
aggcattcataaggcaggcactatc

SEQ ID NO: 165883 - DNA, 25 bp, Homo sapien
ggcactatcagaaagtgtacgccaa

SEQ ID NO: 165884 - DNA, 25 bp, Homo sapien
tgtacgccaactaagggacccacaa

SEQ ID NO: 165885 - DNA, 25 bp, Homo sapien
agaaatctgttttgttcccatgaaa

SEQ ID NO: 165886 - DNA, 25 bp, Homo sapien
gttttgttcccatgaaatcaccaat

SEQ ID NO: 165887 - DNA, 25 bp, Homo sapien
gaaatcaccaatcaaggcctccgtt

SEQ ID NO: 165888 - DNA, 25 bp, Homo sapien
aggcctccgttcttctaaagattag

SEQ ID NO: 165889 - DNA, 25 bp, Homo sapien
gattagtccatcatcattagcaact

SEQ ID NO: 165890 - DNA, 25 bp, Homo sapien
actgagatcaaagcactcttccact

SEQ ID NO: 165891 - DNA, 25 bp, Homo sapien
agcactcttccactttacgtgatta

SEQ ID NO: 165892 - DNA, 25 bp, Homo sapien
gagggccatatgacgtggcaaatct

SEQ ID NO: 165893 - DNA, 25 bp, Homo sapien
aaatctaggcttgctgtttgggctc

SEQ ID NO: 165894 - DNA, 25 bp, Homo sapien
ggcttgctgtttgggctctctgaaa

SEQ ID NO: 165895 - DNA, 25 bp, Homo sapien
ggtgtccaccaactgccgagcagcg

SEQ ID NO: 165896 - DNA, 25 bp, Homo sapien
aaactgcttttggaattatctctac

SEQ ID NO: 165897 - DNA, 25 bp, Homo sapien
agtgaagaaacctcggccatcagaa

SEQ ID NO: 165898 - DNA, 25 bp, Homo sapien
gaaacctcggccatcagaaggagat

SEQ ID NO: 165899 - DNA, 25 bp, Homo sapien
aggagatgaagattgtcttccagct

SEQ ID NO: 165900 - DNA, 25 bp, Homo sapien
gtcttccagcttccaagaaagccaa

SEQ ID NO: 165901 - DNA, 25 bp, Homo sapien
aaaagaatgccccagtctctgtcag

SEQ ID NO: 165902 - DNA, 25 bp, Homo sapien
ccttcttcccttttatagttcatca

SEQ ID NO: 165903 - DNA, 25 bp, Homo sapien
tctgtttaaagttgttctggttgat

SEQ ID NO: 165904 - DNA, 25 bp, Homo sapien
tttaaagttgttctggttgattgct

SEQ ID NO: 165905 - DNA, 25 bp, Homo sapien
attgcttgttgccacaaaggtgtgt

SEQ ID NO: 165906 - DNA, 25 bp, Homo sapien
gcttgttgccacaaaggtgtgttga

SEQ ID NO: 165907 - DNA, 25 bp, Homo sapien
gttgccacaaaggtgtgttgagccc

SEQ ID NO: 165908 - DNA, 25 bp, Homo sapien
gccacaaaggtgtgttgagcccatt

SEQ ID NO: 165909 - DNA, 25 bp, Homo sapien
cacaaaggtgtgttgagcccattca

SEQ ID NO: 165910 - DNA, 25 bp, Homo sapien
caaaggtgtgttgagcccattcatt

SEQ ID NO: 165911 - DNA, 25 bp, Homo sapien
tgagcccattcatttgctgattata

SEQ ID NO: 165912 - DNA, 25 bp, Homo sapien
ttctgagctgctaccacatgacaga

SEQ ID NO: 165913 - DNA, 25 bp, Homo sapien
tctgagctgctaccacatgacagac

SEQ ID NO: 165914 - DNA, 25 bp, Homo sapien
aggcataacccctcggaacggctgc

SEQ ID NO: 165915 - DNA, 25 bp, Homo sapien
ggccaactctcggagggtgctgcct

SEQ ID NO: 165916 - DNA, 25 bp, Homo sapien
tgcccttcaatctgtcgcctgatgg

SEQ ID NO: 165917 - DNA, 25 bp, Homo sapien
tgatggtccctgtcattcactcggg

SEQ ID NO: 165918 - DNA, 25 bp, Homo sapien
cactcgggtgcgtgtgtttgtatgt

SEQ ID NO: 165919 - DNA, 25 bp, Homo sapien
gggaacccatttgagagtgcatcac

SEQ ID NO: 165920 - DNA, 25 bp, Homo sapien
agtgcatcacacaacgagacctatc

SEQ ID NO: 165921 - DNA, 25 bp, Homo sapien
gacctatcgccgcatcgtcaaggtg

SEQ ID NO: 165922 - DNA, 25 bp, Homo sapien
tggacctaaagttccccgcttctgt

SEQ ID NO: 165923 - DNA, 25 bp, Homo sapien
gggagcccaggacctcatctccaaa

SEQ ID NO: 165924 - DNA, 25 bp, Homo sapien
tcatctccaaactgctcaggcataa

SEQ ID NO: 165925 - DNA, 25 bp, Homo sapien
atcctgccacttctatgtctctgga

SEQ ID NO: 165926 - DNA, 25 bp, Homo sapien
cacttctatgtctctggaccacagg

SEQ ID NO: 165927 - DNA, 25 bp, Homo sapien
gatggtggtggcattgcaggttggc

SEQ ID NO: 165928 - DNA, 25 bp, Homo sapien
agtctcctggacaaggagtttccag

SEQ ID NO: 165929 - DNA, 25 bp, Homo sapien
cctggacaaggagtttccagctgct

SEQ ID NO: 165930 - DNA, 25 bp, Homo sapien
ggctggagtctcaggccaaattgca

SEQ ID NO: 165931 - DNA, 25 bp, Homo sapien
ggccaaattgcagagggtcctccag

SEQ ID NO: 165932 - DNA, 25 bp, Homo sapien
cagggtcctgaagagcactggacta

SEQ ID NO: 165933 - DNA, 25 bp, Homo sapien
actggactaagagtctagtggttcc

SEQ ID NO: 165934 - DNA, 25 bp, Homo sapien
aagagtctagtggttccagggccct

SEQ ID NO: 165935 - DNA, 25 bp, Homo sapien
gagtctagtggttccagggccctga

SEQ ID NO: 165936 - DNA, 25 bp, Homo sapien
tacaccggtctttctgtaaagacca

SEQ ID NO: 165937 - DNA, 25 bp, Homo sapien
ttctgtaaagaccaacaaggagacc

SEQ ID NO: 165938 - DNA, 25 bp, Homo sapien
caaggagaccacaatggagaaaact

SEQ ID NO: 165939 - DNA, 25 bp, Homo sapien
aaggagaccacaatggagaaaactc

SEQ ID NO: 165940 - DNA, 25 bp, Homo sapien
ggagaccacaatggagaaaactcat

SEQ ID NO: 165941 - DNA, 25 bp, Homo sapien
ataatacgtaatgatcaaattgatg

SEQ ID NO: 165942 - DNA, 25 bp, Homo sapien
gatgtaattagtgtattaccttaaa

SEQ ID NO: 165943 - DNA, 25 bp, Homo sapien
taattagtgtattaccttaaacaat

SEQ ID NO: 165944 - DNA, 25 bp, Homo sapien
gtgtattaccttaaacaattaacat

SEQ ID NO: 165945 - DNA, 25 bp, Homo sapien
attcaaatccattgttctagcgatt

SEQ ID NO: 165946 - DNA, 25 bp, Homo sapien
aaatccattgttctagcgatttgaa

SEQ ID NO: 165947 - DNA, 25 bp, Homo sapien
tgatcccaagacaaaagcgtggttg

SEQ ID NO: 165948 - DNA, 25 bp, Homo sapien
agtttgtccggttcagctggcgcac

SEQ ID NO: 165949 - DNA, 25 bp, Homo sapien
aagatgttatatgggaggactcagc

SEQ ID NO: 165950 - DNA, 25 bp, Homo sapien
gaggactcagcatccgagaatcagg

SEQ ID NO: 165951 - DNA, 25 bp, Homo sapien
gcatccgagaatcaggagggactca

SEQ ID NO: 165952 - DNA, 25 bp, Homo sapien
gagggactcaggaagatcacatcct

SEQ ID NO: 165953 - DNA, 25 bp, Homo sapien
aagatcacatcctacttcctcaatg

SEQ ID NO: 165954 - DNA, 25 bp, Homo sapien
tcaatgaagggtcccaagcccgtcc

SEQ ID NO: 165955 - DNA, 25 bp, Homo sapien
tcttcccaccgatatttcctggaac

SEQ ID NO: 165956 - DNA, 25 bp, Homo sapien
gatatttcctggaacgcggcctgga

SEQ ID NO: 165957 - DNA, 25 bp, Homo sapien
gaacgcggcctggagtcagcaacca

SEQ ID NO: 165958 - DNA, 25 bp, Homo sapien
agaagccgcccgtcctcataaggga

SEQ ID NO: 165959 - DNA, 25 bp, Homo sapien
ccgcccgtcctcataagggattgaa

SEQ ID NO: 165960 - DNA, 25 bp, Homo sapien
agggattgaacttgcatccactcct

SEQ ID NO: 165961 - DNA, 25 bp, Homo sapien
tctccggccggcttggtcgctggct

SEQ ID NO: 165962 - DNA, 25 bp, Homo sapien
cggcttggtcgctggctgcgctcca

SEQ ID NO: 165963 - DNA, 25 bp, Homo sapien
gctccacccgattctcgggatcatt

SEQ ID NO: 165964 - DNA, 25 bp, Homo sapien
gattctcgggatcattggaccgttt

SEQ ID NO: 165965 - DNA, 25 bp, Homo sapien
gatcattggaccgtttgcgcgaaac

SEQ ID NO: 165966 - DNA, 25 bp, Homo sapien
attggaccgtttgcgcgaaaccaga

SEQ ID NO: 165967 - DNA, 25 bp, Homo sapien
tttgcgcgaaaccagagtggccgat

SEQ ID NO: 165968 - DNA, 25 bp, Homo sapien
gcgcgaaaccagagtggccgattaa

SEQ ID NO: 165969 - DNA, 25 bp, Homo sapien
atgatcagtgataccttagagactt

SEQ ID NO: 165970 - DNA, 25 bp, Homo sapien
tagagacttttcgaaagtccttgtt

SEQ ID NO: 165971 - DNA, 25 bp, Homo sapien
tacaatgtgtggttaaatgatgcta

SEQ ID NO: 165972 - DNA, 25 bp, Homo sapien
gatgctaaaatattttcacaaccag

SEQ ID NO: 165973 - DNA, 25 bp, Homo sapien
agagtagaaaacgtgctggaacaaa

SEQ ID NO: 165974 - DNA, 25 bp, Homo sapien
aaattgcgaaggcttttgcctccca

SEQ ID NO: 165975 - DNA, 25 bp, Homo sapien
aggcttttgcctcccagtaaataga

SEQ ID NO: 165976 - DNA, 25 bp, Homo sapien
ttctagtaggtaagactgctgactc

SEQ ID NO: 165977 - DNA, 25 bp, Homo sapien
gactgctgactctttgaaaatctga

SEQ ID NO: 165978 - DNA, 25 bp, Homo sapien
gaaaaattctgtgatagttgctatt

SEQ ID NO: 165979 - DNA, 25 bp, Homo sapien
tataaatcccattgacaaatgttga

SEQ ID NO: 165980 - DNA, 25 bp, Homo sapien
cttatgtcaacctgcacttcttgtt

SEQ ID NO: 165981 - DNA, 25 bp, Homo sapien
gaaaagatttgaagaccccaagtct

SEQ ID NO: 165982 - DNA, 25 bp, Homo sapien
gaccccaagtcttgtcaataacttg

SEQ ID NO: 165983 - DNA, 25 bp, Homo sapien
gtcaataacttgctgtgtggaagca

SEQ ID NO: 165984 - DNA, 25 bp, Homo sapien
ttccccagcacttggttttccaaca

SEQ ID NO: 165985 - DNA, 25 bp, Homo sapien
cccagcacttggttttccaacatga

SEQ ID NO: 165986 - DNA, 25 bp, Homo sapien
agcacttggttttccaacatgatat

SEQ ID NO: 165987 - DNA, 25 bp, Homo sapien
ggttttccaacatgatatttatgag

SEQ ID NO: 165988 - DNA, 25 bp, Homo sapien
tattttgatatgtacatctcttatt

SEQ ID NO: 165989 - DNA, 25 bp, Homo sapien
tatgtacatctcttattttcttaca

SEQ ID NO: 165990 - DNA, 25 bp, Homo sapien
gtatgtaagtgaggtttgttttgta

SEQ ID NO: 165991 - DNA, 25 bp, Homo sapien
ggagctatgagagatgtgtccatgt

SEQ ID NO: 165992 - DNA, 25 bp, Homo sapien
gtgtccatgtgaaatttacagttac

SEQ ID NO: 165993 - DNA, 25 bp, Homo sapien
tacagttactgcctaggagttaatg

SEQ ID NO: 165994 - DNA, 25 bp, Homo sapien
gagttaatgatcgttctgggtcagc

SEQ ID NO: 165995 - DNA, 25 bp, Homo sapien
tcgttctgggtcagcttgaatgtcc

SEQ ID NO: 165996 - DNA, 25 bp, Homo sapien
aatgtccccattctataaattcaac

SEQ ID NO: 165997 - DNA, 25 bp, Homo sapien
gagctataatgtttccctcaagaac

SEQ ID NO: 165998 - DNA, 25 bp, Homo sapien
acagaaacgagatttgccaaaaact

SEQ ID NO: 165999 - DNA, 25 bp, Homo sapien
ttgagtgggagattggctttgcctt

SEQ ID NO: 166000 - DNA, 25 bp, Homo sapien
ttggctttgcctttagcgtgtaaat

SEQ ID NO: 166001 - DNA, 25 bp, Homo sapien
ggaagcactgccattagactgaatt

SEQ ID NO: 166002 - DNA, 25 bp, Homo sapien
tgagcatgccccacactcttggatc

SEQ ID NO: 166003 - DNA, 25 bp, Homo sapien
acactcttggatcttctctctgttc

SEQ ID NO: 166004 - DNA, 25 bp, Homo sapien
tggtgtcttcactaatgtcctcatg

SEQ ID NO: 166005 - DNA, 25 bp, Homo sapien
gtcttcactaatgtcctcatgttgg

SEQ ID NO: 166006 - DNA, 25 bp, Homo sapien
aatgtcctcatgttggtgaagtgtt

SEQ ID NO: 166007 - DNA, 25 bp, Homo sapien
tgttttcctcacactccttacttga

SEQ ID NO: 166008 - DNA, 25 bp, Homo sapien
acactccttacttgactgctttctt

SEQ ID NO: 166009 - DNA, 25 bp, Homo sapien
ccactttcatgtcccctctggattg

SEQ ID NO: 166010 - DNA, 25 bp, Homo sapien
ggattgtccagtgtaatgcatggca

SEQ ID NO: 166011 - DNA, 25 bp, Homo sapien
atgcatggcattgtggtgtctgtct

SEQ ID NO: 166012 - DNA, 25 bp, Homo sapien
cattgtggtgtctgtctaggaagga

SEQ ID NO: 166013 - DNA, 25 bp, Homo sapien
atcaggagccctacgtctgcaaacc

SEQ ID NO: 166014 - DNA, 25 bp, Homo sapien
caaacccgaagagcgctttcgggca

SEQ ID NO: 166015 - DNA, 25 bp, Homo sapien
aggtcatcctgaacaaggacacggg

SEQ ID NO: 166016 - DNA, 25 bp, Homo sapien
gatttcctgtgatccagctttgctt

SEQ ID NO: 166017 - DNA, 25 bp, Homo sapien
agctttgcttcctgagcccaatcac

SEQ ID NO: 166018 - DNA, 25 bp, Homo sapien
tgagcccaatcacgtcatgctgaac

SEQ ID NO: 166019 - DNA, 25 bp, Homo sapien
tgaaccacctatacgcgctgtctat

SEQ ID NO: 166020 - DNA, 25 bp, Homo sapien
atacgcgctgtctatcaaggatgga

SEQ ID NO: 166021 - DNA, 25 bp, Homo sapien
tcagcgcaacccaccggtacaagaa

SEQ ID NO: 166022 - DNA, 25 bp, Homo sapien
agaagaagtacgtcaccaccttgtt

SEQ ID NO: 166023 - DNA, 25 bp, Homo sapien
gtacgtcaccaccttgttatacaag

SEQ ID NO: 166024 - DNA, 25 bp, Homo sapien
aaatttgtgaactcgtaattactgt

SEQ ID NO: 166025 - DNA, 25 bp, Homo sapien
ttgtgaactcgtaattactgtttta

SEQ ID NO: 166026 - DNA, 25 bp, Homo sapien
gttttaatgattcagtttcttcaga

SEQ ID NO: 166027 - DNA, 25 bp, Homo sapien
cagtttcttcagagtggtaattgta

SEQ ID NO: 166028 - DNA, 25 bp, Homo sapien
gtttcttcagagtggtaattgtata

SEQ ID NO: 166029 - DNA, 25 bp, Homo sapien
tcttcagagtggtaattgtataaaa

SEQ ID NO: 166030 - DNA, 25 bp, Homo sapien
gtataaaattgctattgcagcttta

SEQ ID NO: 166031 - DNA, 25 bp, Homo sapien
tgttagtctggtttttgttgcttat

SEQ ID NO: 166032 - DNA, 25 bp, Homo sapien
gttgcttatcgggtttaatattgtt

SEQ ID NO: 166033 - DNA, 25 bp, Homo sapien
tgcttatcgggtttaatattgttct

SEQ ID NO: 166034 - DNA, 25 bp, Homo sapien
ttatcgggtttaatattgttcttga

SEQ ID NO: 166035 - DNA, 25 bp, Homo sapien
aaaatcatcgatggacttctagtga

SEQ ID NO: 166036 - DNA, 25 bp, Homo sapien
atcgatggacttctagtgatgagaa

SEQ ID NO: 166037 - DNA, 25 bp, Homo sapien
gctacctgtggtgatctcgcagtgt

SEQ ID NO: 166038 - DNA, 25 bp, Homo sapien
gagatgtagtccagacaaagactga

SEQ ID NO: 166039 - DNA, 25 bp, Homo sapien
caaagactgaatcaggccttccctt

SEQ ID NO: 166040 - DNA, 25 bp, Homo sapien
aggccttcccttcttcttggtggtg

SEQ ID NO: 166041 - DNA, 25 bp, Homo sapien
cttcccttcttcttggtggtgttct

SEQ ID NO: 166042 - DNA, 25 bp, Homo sapien
gagtaagataatctggactggcccc

SEQ ID NO: 166043 - DNA, 25 bp, Homo sapien
catttgatcaagagaccatggaagt

SEQ ID NO: 166044 - DNA, 25 bp, Homo sapien
gaccatggaagtgtcagagattcag

SEQ ID NO: 166045 - DNA, 25 bp, Homo sapien
gattcagaatccaagattgtcttta

SEQ ID NO: 166046 - DNA, 25 bp, Homo sapien
gaccactctaggaaggtgggttatt

SEQ ID NO: 166047 - DNA, 25 bp, Homo sapien
cactctaggaaggtgggttattacg

SEQ ID NO: 166048 - DNA, 25 bp, Homo sapien
tgaataatattttctcttaccgcat

SEQ ID NO: 166049 - DNA, 25 bp, Homo sapien
tattttctcttaccgcattttctca

SEQ ID NO: 166050 - DNA, 25 bp, Homo sapien
tttctcttaccgcattttctcaaat

SEQ ID NO: 166051 - DNA, 25 bp, Homo sapien
ctcttaccgcattttctcaaatatg

SEQ ID NO: 166052 - DNA, 25 bp, Homo sapien
ccgcattttctcaaatatgtatcag

SEQ ID NO: 166053 - DNA, 25 bp, Homo sapien
tatttcatttttgtctacattccat

SEQ ID NO: 166054 - DNA, 25 bp, Homo sapien
tcatttttgtctacattccatttat

SEQ ID NO: 166055 - DNA, 25 bp, Homo sapien
aatatttctagtgatacctttgtaa

SEQ ID NO: 166056 - DNA, 25 bp, Homo sapien
tttctagtgatacctttgtaatata

SEQ ID NO: 166057 - DNA, 25 bp, Homo sapien
agatggtttgtcaacagtgaccctg

SEQ ID NO: 166058 - DNA, 25 bp, Homo sapien
tggtttgtcaacagtgaccctggtt

SEQ ID NO: 166059 - DNA, 25 bp, Homo sapien
tttgtcaacagtgaccctggttgga

SEQ ID NO: 166060 - DNA, 25 bp, Homo sapien
tgaccctggttggaatcatagttgg

SEQ ID NO: 166061 - DNA, 25 bp, Homo sapien
atagttggggtcttactagccatcg

SEQ ID NO: 166062 - DNA, 25 bp, Homo sapien
ttcattggtggaatcatcgttgtgg

SEQ ID NO: 166063 - DNA, 25 bp, Homo sapien
ttggtggaatcatcgttgtggttat

SEQ ID NO: 166064 - DNA, 25 bp, Homo sapien
ggtggaatcatcgttgtggttatgc

SEQ ID NO: 166065 - DNA, 25 bp, Homo sapien
gaatcatcgttgtggttatgcgaaa

SEQ ID NO: 166066 - DNA, 25 bp, Homo sapien
tcatcgttgtggttatgcgaaaaat

SEQ ID NO: 166067 - DNA, 25 bp, Homo sapien
atgcgaaaaatgtcgggaaggtact

SEQ ID NO: 166068 - DNA, 25 bp, Homo sapien
gcgcaagaagcggacctctatcgag

SEQ ID NO: 166069 - DNA, 25 bp, Homo sapien
caagggcgcgctggagagccacttc

SEQ ID NO: 166070 - DNA, 25 bp, Homo sapien
gcaggagatcaccaacctggccgac

SEQ ID NO: 166071 - DNA, 25 bp, Homo sapien
ctggccgacagcctgcagctcgaga

SEQ ID NO: 166072 - DNA, 25 bp, Homo sapien
agaagcgcatgacgccgcccgggat

SEQ ID NO: 166073 - DNA, 25 bp, Homo sapien
ggatccaacagcagacgcccgacga

SEQ ID NO: 166074 - DNA, 25 bp, Homo sapien
gacgacgtctactcgcaggtgggca

SEQ ID NO: 166075 - DNA, 25 bp, Homo sapien
acgtctactcgcaggtgggcaccgt

SEQ ID NO: 166076 - DNA, 25 bp, Homo sapien
aggtgggcaccgtgagcgccgacac

SEQ ID NO: 166077 - DNA, 25 bp, Homo sapien
tcaccacgggctgcagacgagcgtt

SEQ ID NO: 166078 - DNA, 25 bp, Homo sapien
cacgggctgcagacgagcgttcagt

SEQ ID NO: 166079 - DNA, 25 bp, Homo sapien
atcggccgcttcacgtagctcggag

SEQ ID NO: 166080 - DNA, 25 bp, Homo sapien
aggtcatctcttggaccagcgggca

SEQ ID NO: 166081 - DNA, 25 bp, Homo sapien
tcatctcttggaccagcgggcatca

SEQ ID NO: 166082 - DNA, 25 bp, Homo sapien
tctcttggaccagcgggcatcacat

SEQ ID NO: 166083 - DNA, 25 bp, Homo sapien
cagcgggcatcacattctccagcag

SEQ ID NO: 166084 - DNA, 25 bp, Homo sapien
catggacaaaggtctccatgcaggg

SEQ ID NO: 166085 - DNA, 25 bp, Homo sapien
ggaggaggcctgcttctttccccac

SEQ ID NO: 166086 - DNA, 25 bp, Homo sapien
ttctccctgcgggtgacaaagaagc

SEQ ID NO: 166087 - DNA, 25 bp, Homo sapien
gacaaagaagcccaaggaccacctc

SEQ ID NO: 166088 - DNA, 25 bp, Homo sapien
tccttcctgcctcattgtaataaaa

SEQ ID NO: 166089 - DNA, 25 bp, Homo sapien
tgtaataaaattccccacactgaga

SEQ ID NO: 166090 - DNA, 25 bp, Homo sapien
gaagtgatttatgcttgatttctaa

SEQ ID NO: 166091 - DNA, 25 bp, Homo sapien
gcttgatttctaaatgcaacttatg

SEQ ID NO: 166092 - DNA, 25 bp, Homo sapien
aagcatgcttatacaatcatgtgca

SEQ ID NO: 166093 - DNA, 25 bp, Homo sapien
caatcatgtgcaactttaaacttta

SEQ ID NO: 166094 - DNA, 25 bp, Homo sapien
aactctggatgaatacatggtggca

SEQ ID NO: 166095 - DNA, 25 bp, Homo sapien
tggcaacagtccatgacacctgaaa

SEQ ID NO: 166096 - DNA, 25 bp, Homo sapien
gtccatgacacctgaaaacatcatt

SEQ ID NO: 166097 - DNA, 25 bp, Homo sapien
aacatcatttgtggagtggcgtaga

SEQ ID NO: 166098 - DNA, 25 bp, Homo sapien
gtagagttcagtgttcgcagtcgca

SEQ ID NO: 166099 - DNA, 25 bp, Homo sapien
gttcgcagtcgcatattacaaccat

SEQ ID NO: 166100 - DNA, 25 bp, Homo sapien
attacaaccatgtttcacacagccc

SEQ ID NO: 166101 - DNA, 25 bp, Homo sapien
agacattgacaacgtcgacctggcc

SEQ ID NO: 166102 - DNA, 25 bp, Homo sapien
acattgacaacgtcgacctggccat

SEQ ID NO: 166103 - DNA, 25 bp, Homo sapien
ttgacaacgtcgacctggccatggg

SEQ ID NO: 166104 - DNA, 25 bp, Homo sapien
agcaggggccggtgctgatcatcac

SEQ ID NO: 166105 - DNA, 25 bp, Homo sapien
tgatggtggtcaggaaccccaaagg

SEQ ID NO: 166106 - DNA, 25 bp, Homo sapien
acccggacaaggtgctgcggatgct

SEQ ID NO: 166107 - DNA, 25 bp, Homo sapien
acaaggtgctgcggatgctgtacgt

SEQ ID NO: 166108 - DNA, 25 bp, Homo sapien
atgctgtacgtgtgggcgctctgcc

SEQ ID NO: 166109 - DNA, 25 bp, Homo sapien
acgtgtgggcgctctgccgagacca

SEQ ID NO: 166110 - DNA, 25 bp, Homo sapien
tctgccgagaccaggacgagctcaa

SEQ ID NO: 166111 - DNA, 25 bp, Homo sapien
tggcggctcctggacatctcggcct

SEQ ID NO: 166112 - DNA, 25 bp, Homo sapien
caataaaggtggttggtgtctaatt

SEQ ID NO: 166113 - DNA, 25 bp, Homo sapien
ctttcattcagttagctctttaccc

SEQ ID NO: 166114 - DNA, 25 bp, Homo sapien
ttcagttagctctttacccaagaag

SEQ ID NO: 166115 - DNA, 25 bp, Homo sapien
gtgaatgatttggagcttagggtat

SEQ ID NO: 166116 - DNA, 25 bp, Homo sapien
tggagcttagggtatgttttgtatc

SEQ ID NO: 166117 - DNA, 25 bp, Homo sapien
ggtatgttttgtatcccctttctga

SEQ ID NO: 166118 - DNA, 25 bp, Homo sapien
gtatcccctttctgataaacccatt

SEQ ID NO: 166119 - DNA, 25 bp, Homo sapien
tgataaacccattccctaccaattt

SEQ ID NO: 166120 - DNA, 25 bp, Homo sapien
cccattccctaccaattttatgtca

SEQ ID NO: 166121 - DNA, 25 bp, Homo sapien
atacatttcacatctagtcaagggc

SEQ ID NO: 166122 - DNA, 25 bp, Homo sapien
gtcaagggcataggaacggtgtcat

SEQ ID NO: 166123 - DNA, 25 bp, Homo sapien
acacctgggagccatttgcctctgg

SEQ ID NO: 166124 - DNA, 25 bp, Homo sapien
gagccatttgcctctgggaaaacca

SEQ ID NO: 166125 - DNA, 25 bp, Homo sapien
gtctggagagctgcatgggctcaca

SEQ ID NO: 166126 - DNA, 25 bp, Homo sapien
gaaatagacaccaaatcttactgga

SEQ ID NO: 166127 - DNA, 25 bp, Homo sapien
atcttactggaaggcacttggcatc

SEQ ID NO: 166128 - DNA, 25 bp, Homo sapien
tccccattccatgagcatgcagagg

SEQ ID NO: 166129 - DNA, 25 bp, Homo sapien
tgagcatgcagaggtggtattcaca

SEQ ID NO: 166130 - DNA, 25 bp, Homo sapien
gtggtattcacagccaacgactccg

SEQ ID NO: 166131 - DNA, 25 bp, Homo sapien
ctgtcgtcaccaatcccaaggaatg

SEQ ID NO: 166132 - DNA, 25 bp, Homo sapien
aggaatgagggacttctcctccagt

SEQ ID NO: 166133 - DNA, 25 bp, Homo sapien
gacttctcctccagtggacctgaag

SEQ ID NO: 166134 - DNA, 25 bp, Homo sapien
aaggagctagacgagaatggagacg

SEQ ID NO: 166135 - DNA, 25 bp, Homo sapien
agtatgtggtgcttgtggctgctct

SEQ ID NO: 166136 - DNA, 25 bp, Homo sapien
tatgtggtgcttgtggctgctctca

SEQ ID NO: 166137 - DNA, 25 bp, Homo sapien
atgtggtgcttgtggctgctctcac

SEQ ID NO: 166138 - DNA, 25 bp, Homo sapien
tggtgcttgtggctgctctcacagt

SEQ ID NO: 166139 - DNA, 25 bp, Homo sapien
cttgtggctgctctcacagtggcct

SEQ ID NO: 166140 - DNA, 25 bp, Homo sapien
ttcttctgggagaacagttgagcag

SEQ ID NO: 166141 - DNA, 25 bp, Homo sapien
gggagaacagttgagcagacagcca

SEQ ID NO: 166142 - DNA, 25 bp, Homo sapien
gagaacagttgagcagacagccaca

SEQ ID NO: 166143 - DNA, 25 bp, Homo sapien
gaacagttgagcagacagccacatt

SEQ ID NO: 166144 - DNA, 25 bp, Homo sapien
acagttgagcagacagccacattgg

SEQ ID NO: 166145 - DNA, 25 bp, Homo sapien
acaccagttccaagtgagcccgccc

SEQ ID NO: 166146 - DNA, 25 bp, Homo sapien
agttccaagtgagcccgcccaccgc

SEQ ID NO: 166147 - DNA, 25 bp, Homo sapien
gcccaccgcggaacgttcggtcagt

SEQ ID NO: 166148 - DNA, 25 bp, Homo sapien
caccgcggaacgttcggtcagtctc

SEQ ID NO: 166149 - DNA, 25 bp, Homo sapien
accgcggaacgttcggtcagtctcg

SEQ ID NO: 166150 - DNA, 25 bp, Homo sapien
gcggaacgttcggtcagtctcggcc

SEQ ID NO: 166151 - DNA, 25 bp, Homo sapien
ggaacgttcggtcagtctcggccca

SEQ ID NO: 166152 - DNA, 25 bp, Homo sapien
gaacgttcggtcagtctcggcccac

SEQ ID NO: 166153 - DNA, 25 bp, Homo sapien
aacgttcggtcagtctcggcccaca

SEQ ID NO: 166154 - DNA, 25 bp, Homo sapien
acgttcggtcagtctcggcccacac

SEQ ID NO: 166155 - DNA, 25 bp, Homo sapien
agtctcggcccacaccccaaaggct

SEQ ID NO: 166156 - DNA, 25 bp, Homo sapien
gtcctcacgctactgctgtacacag

SEQ ID NO: 166157 - DNA, 25 bp, Homo sapien
accgagggcgcgtgcacggcggaca

SEQ ID NO: 166158 - DNA, 25 bp, Homo sapien
gcacggcggacaagcccacgctggt

SEQ ID NO: 166159 - DNA, 25 bp, Homo sapien
agggcccacccaagatggatctcat

SEQ ID NO: 166160 - DNA, 25 bp, Homo sapien
ggcccacccaagatggatctcatgg

SEQ ID NO: 166161 - DNA, 25 bp, Homo sapien
acccaagatggatctcatggccttt

SEQ ID NO: 166162 - DNA, 25 bp, Homo sapien
gatggatctcatggcctttagcccc

SEQ ID NO: 166163 - DNA, 25 bp, Homo sapien
agcctttcaccttgtcctattatga

SEQ ID NO: 166164 - DNA, 25 bp, Homo sapien
tttcaccttgtcctattatgatggg

SEQ ID NO: 166165 - DNA, 25 bp, Homo sapien
accttgtcctattatgatgggtaag

SEQ ID NO: 166166 - DNA, 25 bp, Homo sapien
ttatgatgggtaaggcggagaatca

SEQ ID NO: 166167 - DNA, 25 bp, Homo sapien
cggccttcccgagtcaagcagatgt

SEQ ID NO: 166168 - DNA, 25 bp, Homo sapien
aagcagatgtttgcctccagagcct

SEQ ID NO: 166169 - DNA, 25 bp, Homo sapien
agcctgccggaagtcggtgatgatt

SEQ ID NO: 166170 - DNA, 25 bp, Homo sapien
tcggtgatgattgggactgctctca

SEQ ID NO: 166171 - DNA, 25 bp, Homo sapien
gggactgctctcaacacaagcgaga

SEQ ID NO: 166172 - DNA, 25 bp, Homo sapien
ggagatggaccacccctggaactgt

SEQ ID NO: 166173 - DNA, 25 bp, Homo sapien
ccctggaactgtccccatggaaggc

SEQ ID NO: 166174 - DNA, 25 bp, Homo sapien
ggaaggccaaccatgagacacatcg

SEQ ID NO: 166175 - DNA, 25 bp, Homo sapien
catgagacacatcgccaacctgggt

SEQ ID NO: 166176 - DNA, 25 bp, Homo sapien
caacctgggtgtcatttctcagaac

SEQ ID NO: 166177 - DNA, 25 bp, Homo sapien
gaactgaccgtagtcactgtatgga

SEQ ID NO: 166178 - DNA, 25 bp, Homo sapien
atcaaatcccgagaagatgtcagta

SEQ ID NO: 166179 - DNA, 25 bp, Homo sapien
cagtaattttgaccctgacttcata

SEQ ID NO: 166180 - DNA, 25 bp, Homo sapien
gaagagccagttttaactccaattg

SEQ ID NO: 166181 - DNA, 25 bp, Homo sapien
gatgagggacatcttccaatgatta

SEQ ID NO: 166182 - DNA, 25 bp, Homo sapien
aacttttcctatgtgtctccagaat

SEQ ID NO: 166183 - DNA, 25 bp, Homo sapien
gtgtctccagaattgcaaccatagc

SEQ ID NO: 166184 - DNA, 25 bp, Homo sapien
agagggcacgagaacccaaaggaat

SEQ ID NO: 166185 - DNA, 25 bp, Homo sapien
caggaatttcctctatcggaccttc

SEQ ID NO: 166186 - DNA, 25 bp, Homo sapien
ttcccagcatcagccttagaacaag

SEQ ID NO: 166187 - DNA, 25 bp, Homo sapien
agaaccttaccttcaaggagcaagt

SEQ ID NO: 166188 - DNA, 25 bp, Homo sapien
caagtgaagaactctgtcgaaggat

SEQ ID NO: 166189 - DNA, 25 bp, Homo sapien
aggtgctggaggcagactcgagggc

SEQ ID NO: 166190 - DNA, 25 bp, Homo sapien
tgctggaggcagactcgagggccga

SEQ ID NO: 166191 - DNA, 25 bp, Homo sapien
ctggaggcagactcgagggccgaat

SEQ ID NO: 166192 - DNA, 25 bp, Homo sapien
aggcagactcgagggccgaattgtt

SEQ ID NO: 166193 - DNA, 25 bp, Homo sapien
ggcagactcgagggccgaattgttt

SEQ ID NO: 166194 - DNA, 25 bp, Homo sapien
gcagactcgagggccgaattgtttc

SEQ ID NO: 166195 - DNA, 25 bp, Homo sapien
cagactcgagggccgaattgtttct

SEQ ID NO: 166196 - DNA, 25 bp, Homo sapien
cagtcgcaaaggtgaacactcatgc

SEQ ID NO: 166197 - DNA, 25 bp, Homo sapien
agtcgcaaaggtgaacactcatgcg

SEQ ID NO: 166198 - DNA, 25 bp, Homo sapien
gtcgcaaaggtgaacactcatgcgg

SEQ ID NO: 166199 - DNA, 25 bp, Homo sapien
tcgcaaaggtgaacactcatgcggc

SEQ ID NO: 166200 - DNA, 25 bp, Homo sapien
caggacagctgcatggcacccggcg

SEQ ID NO: 166201 - DNA, 25 bp, Homo sapien
aggacagctgcatggcacccggcgg

SEQ ID NO: 166202 - DNA, 25 bp, Homo sapien
ggacagctgcatggcacccggcggg

SEQ ID NO: 166203 - DNA, 25 bp, Homo sapien
agctgcatggcacccggcgggccga

SEQ ID NO: 166204 - DNA, 25 bp, Homo sapien
gctgcatggcacccggcgggccgag

SEQ ID NO: 166205 - DNA, 25 bp, Homo sapien
ctgcatggcacccggcgggccgagc

SEQ ID NO: 166206 - DNA, 25 bp, Homo sapien
tgcatggcacccggcgggccgagca

SEQ ID NO: 166207 - DNA, 25 bp, Homo sapien
gcatggcacccggcgggccgagcat

SEQ ID NO: 166208 - DNA, 25 bp, Homo sapien
catggcacccggcgggccgagcatg

SEQ ID NO: 166209 - DNA, 25 bp, Homo sapien
atggcacccggcgggccgagcatgc

SEQ ID NO: 166210 - DNA, 25 bp, Homo sapien
acccggcgggccgagcatgccatgg

SEQ ID NO: 166211 - DNA, 25 bp, Homo sapien
ggtacaggctttcctgcaaacctat

SEQ ID NO: 166212 - DNA, 25 bp, Homo sapien
gtctctctcattgcggactcgcaga

SEQ ID NO: 166213 - DNA, 25 bp, Homo sapien
gaaaagcgagccactcttgatagct

SEQ ID NO: 166214 - DNA, 25 bp, Homo sapien
gccactcttgatagctgaagactca

SEQ ID NO: 166215 - DNA, 25 bp, Homo sapien
gaagactcagctatcattttaggca

SEQ ID NO: 166216 - DNA, 25 bp, Homo sapien
caaatgtgacccgacaagtaatcag

SEQ ID NO: 166217 - DNA, 25 bp, Homo sapien
atttctctgcctcctaattgttggt

SEQ ID NO: 166218 - DNA, 25 bp, Homo sapien
ctcctaattgttggtgtcttggcac

SEQ ID NO: 166219 - DNA, 25 bp, Homo sapien
ttggtgtcttggcacaagtctttta

SEQ ID NO: 166220 - DNA, 25 bp, Homo sapien
cttggcacaagtcttttaaggagat

SEQ ID NO: 166221 - DNA, 25 bp, Homo sapien
ggagatgttttttgagcctgttatg

SEQ ID NO: 166222 - DNA, 25 bp, Homo sapien
gggttgcccaagaccgacctcatgg

SEQ ID NO: 166223 - DNA, 25 bp, Homo sapien
gacctcatggcttttagccctagcc

SEQ ID NO: 166224 - DNA, 25 bp, Homo sapien
tagccttcctccttgtccaattagc

SEQ ID NO: 166225 - DNA, 25 bp, Homo sapien
cttgtccaattagccgggatagaga

SEQ ID NO: 166226 - DNA, 25 bp, Homo sapien
aacaggatgtggacgttgatctctc

SEQ ID NO: 166227 - DNA, 25 bp, Homo sapien
atgtggacgttgatctctcagccaa

SEQ ID NO: 166228 - DNA, 25 bp, Homo sapien
gacgttgatctctcagccaaagtga

SEQ ID NO: 166229 - DNA, 25 bp, Homo sapien
gtctttgtttttcattcctcaatgt

SEQ ID NO: 166230 - DNA, 25 bp, Homo sapien
ttttcattcctcaatgtttccactc

SEQ ID NO: 166231 - DNA, 25 bp, Homo sapien
tcaatgtttccactcctctggaaat

SEQ ID NO: 166232 - DNA, 25 bp, Homo sapien
gtttccactcctctggaaatacatt

SEQ ID NO: 166233 - DNA, 25 bp, Homo sapien
gacgctgcaccagaatagcatcact

SEQ ID NO: 166234 - DNA, 25 bp, Homo sapien
gcatcactcaagtctctatttatga

SEQ ID NO: 166235 - DNA, 25 bp, Homo sapien
attttgcactactggcatcgatgga

SEQ ID NO: 166236 - DNA, 25 bp, Homo sapien
tgggatttcaagaccctcgagtctt

SEQ ID NO: 166237 - DNA, 25 bp, Homo sapien
tgcccaatgctctttatctacgatg

SEQ ID NO: 166238 - DNA, 25 bp, Homo sapien
ttatctacgatgaccgcggctgcct

SEQ ID NO: 166239 - DNA, 25 bp, Homo sapien
gaccttcgtctccaagttagatatt

SEQ ID NO: 166240 - DNA, 25 bp, Homo sapien
acagagcatccaacgcaacatgtct

SEQ ID NO: 166241 - DNA, 25 bp, Homo sapien
aacatgtctgccatggaacgcttcc

SEQ ID NO: 166242 - DNA, 25 bp, Homo sapien
agagagccacaactgaggaccgcaa

SEQ ID NO: 166243 - DNA, 25 bp, Homo sapien
gaggaccgcaacacggccttggaga

SEQ ID NO: 166244 - DNA, 25 bp, Homo sapien
aaagtatagcagcaacctggttctt

SEQ ID NO: 166245 - DNA, 25 bp, Homo sapien
tatagcagcaacctggttcttaaac

SEQ ID NO: 166246 - DNA, 25 bp, Homo sapien
ttaaacacaaagtaagttgcccatt

SEQ ID NO: 166247 - DNA, 25 bp, Homo sapien
gttgcccattaacaaatggctttta

SEQ ID NO: 166248 - DNA, 25 bp, Homo sapien
ctttccacaggtctaaaaattgctt

SEQ ID NO: 166249 - DNA, 25 bp, Homo sapien
cacaggtctaaaaattgcttccatt

SEQ ID NO: 166250 - DNA, 25 bp, Homo sapien
tgaggtgttgcatgggaattctaag

SEQ ID NO: 166251 - DNA, 25 bp, Homo sapien
gttgcatgggaattctaagctgatc

SEQ ID NO: 166252 - DNA, 25 bp, Homo sapien
gggaattctaagctgatccatcatg

SEQ ID NO: 166253 - DNA, 25 bp, Homo sapien
ttctaagctgatccatcatgatgta

SEQ ID NO: 166254 - DNA, 25 bp, Homo sapien
gctgatccatcatgatgtaaaagtt

SEQ ID NO: 166255 - DNA, 25 bp, Homo sapien
gaccgtgctggcttcagtgcggatc

SEQ ID NO: 166256 - DNA, 25 bp, Homo sapien
tgctggcttcagtgcggatctacta

SEQ ID NO: 166257 - DNA, 25 bp, Homo sapien
ttcagtgcggatctactaccagtac

SEQ ID NO: 166258 - DNA, 25 bp, Homo sapien
tctactaccagtaccgccgggtgaa

SEQ ID NO: 166259 - DNA, 25 bp, Homo sapien
agtaccgccgggtgaagcctgtgac

SEQ ID NO: 166260 - DNA, 25 bp, Homo sapien
tgtgacccgggagatcgtcatccga

SEQ ID NO: 166261 - DNA, 25 bp, Homo sapien
ggagatcgtcatccgagacccctat

SEQ ID NO: 166262 - DNA, 25 bp, Homo sapien
tcatcgacgcctacgctttccgaat

SEQ ID NO: 166263 - DNA, 25 bp, Homo sapien
acgctttccgaatctatggccactg

SEQ ID NO: 166264 - DNA, 25 bp, Homo sapien
cgggcagcccttttcgagaacacac

SEQ ID NO: 166265 - DNA, 25 bp, Homo sapien
tttcgagaacacacccaaggccgtg

SEQ ID NO: 166266 - DNA, 25 bp, Homo sapien
ggtctctctcattgcggactcgcag

SEQ ID NO: 166267 - DNA, 25 bp, Homo sapien
tctctcattgcggactcgcagaaga

SEQ ID NO: 166268 - DNA, 25 bp, Homo sapien
attgcggactcgcagaagagtcacc

SEQ ID NO: 166269 - DNA, 25 bp, Homo sapien
tgagaaaagcgagccactcttgata

SEQ ID NO: 166270 - DNA, 25 bp, Homo sapien
gaaaagcgagccactcttgatagct

SEQ ID NO: 166271 - DNA, 25 bp, Homo sapien
aagcgagccactcttgatagctgaa

SEQ ID NO: 166272 - DNA, 25 bp, Homo sapien
agccactcttgatagctgaagactc

SEQ ID NO: 166273 - DNA, 25 bp, Homo sapien
ccactcttgatagctgaagactcag

SEQ ID NO: 166274 - DNA, 25 bp, Homo sapien
gaagactcagctatcattttaggca

SEQ ID NO: 166275 - DNA, 25 bp, Homo sapien
gactcagctatcattttaggcaaat

SEQ ID NO: 166276 - DNA, 25 bp, Homo sapien
caaatgtgacccgacaagtaatcag

SEQ ID NO: 166277 - DNA, 25 bp, Homo sapien
ctggctttgctctatagtgcatttg

SEQ ID NO: 166278 - DNA, 25 bp, Homo sapien
tatagtgcatttggtgtcatcattg

SEQ ID NO: 166279 - DNA, 25 bp, Homo sapien
gtcatcattgagaaaacacgaggtg

SEQ ID NO: 166280 - DNA, 25 bp, Homo sapien
atcattgagaaaacacgaggtgcag

SEQ ID NO: 166281 - DNA, 25 bp, Homo sapien
cacagtagcagctggaaccatgaca

SEQ ID NO: 166282 - DNA, 25 bp, Homo sapien
gtagcagctggaaccatgacaggca

SEQ ID NO: 166283 - DNA, 25 bp, Homo sapien
cagctggaaccatgacaggcatgtt

SEQ ID NO: 166284 - DNA, 25 bp, Homo sapien
ggaaccatgacaggcatgttgtata

SEQ ID NO: 166285 - DNA, 25 bp, Homo sapien
gtataaatgtacaggtggtcttcga

SEQ ID NO: 166286 - DNA, 25 bp, Homo sapien
aaatgtacaggtggtcttcgaggga

SEQ ID NO: 166287 - DNA, 25 bp, Homo sapien
atgtacaggtggtcttcgagggata

SEQ ID NO: 166288 - DNA, 25 bp, Homo sapien
tgaaagttccttctcagcctgagag

SEQ ID NO: 166289 - DNA, 25 bp, Homo sapien
tcaggcatgactcagcccggctgat

SEQ ID NO: 166290 - DNA, 25 bp, Homo sapien
tgatgcctctgcagtgctgagtcag

SEQ ID NO: 166291 - DNA, 25 bp, Homo sapien
gcctctgcagtgctgagtcaggatt

SEQ ID NO: 166292 - DNA, 25 bp, Homo sapien
ttttcccaggtactgccttacaaag

SEQ ID NO: 166293 - DNA, 25 bp, Homo sapien
tgccttacaaagctgtggccaggaa

SEQ ID NO: 166294 - DNA, 25 bp, Homo sapien
aagtggccggtataaaggatgccca

SEQ ID NO: 166295 - DNA, 25 bp, Homo sapien
aaggatgcccaaggtctttgtacgt

SEQ ID NO: 166296 - DNA, 25 bp, Homo sapien
gcccaaggtctttgtacgtgtgtag

SEQ ID NO: 166297 - DNA, 25 bp, Homo sapien
ggagttagcgtgtttgatattgtta

SEQ ID NO: 166298 - DNA, 25 bp, Homo sapien
gtatgttgaacaggatccaggtttt

SEQ ID NO: 166299 - DNA, 25 bp, Homo sapien
ccaaccgaaggcgactgtgggccgg

SEQ ID NO: 166300 - DNA, 25 bp, Homo sapien
gaaggcgactgtgggccgggcaagc

SEQ ID NO: 166301 - DNA, 25 bp, Homo sapien
ccgacctcatggcttttagccctag

SEQ ID NO: 166302 - DNA, 25 bp, Homo sapien
gacctcatggcttttagccctagcc

SEQ ID NO: 166303 - DNA, 25 bp, Homo sapien
ctcatggcttttagccctagccttc

SEQ ID NO: 166304 - DNA, 25 bp, Homo sapien
ttttagccctagccttcctccttgt

SEQ ID NO: 166305 - DNA, 25 bp, Homo sapien
aggatgtggacgttgatctctcagc

SEQ ID NO: 166306 - DNA, 25 bp, Homo sapien
ggatgtggacgttgatctctcagcc

SEQ ID NO: 166307 - DNA, 25 bp, Homo sapien
gatgtggacgttgatctctcagcca

SEQ ID NO: 166308 - DNA, 25 bp, Homo sapien
atgtggacgttgatctctcagccaa

SEQ ID NO: 166309 - DNA, 25 bp, Homo sapien
tgtggacgttgatctctcagccaaa

SEQ ID NO: 166310 - DNA, 25 bp, Homo sapien
ggaaataagggaaacactcaccagt

SEQ ID NO: 166311 - DNA, 25 bp, Homo sapien
gaaacactcaccagtacagcatctt

SEQ ID NO: 166312 - DNA, 25 bp, Homo sapien
ggattctcaaaccaggctcaaccca

SEQ ID NO: 166313 - DNA, 25 bp, Homo sapien
aacccattcctatgagtttgatgca

SEQ ID NO: 166314 - DNA, 25 bp, Homo sapien
gatgcaaagctggatgttggaacaa

SEQ ID NO: 166315 - DNA, 25 bp, Homo sapien
taacaatgtgataaatccaaccctc

SEQ ID NO: 166316 - DNA, 25 bp, Homo sapien
tccccaaagtgggtgccaccaagat

SEQ ID NO: 166317 - DNA, 25 bp, Homo sapien
agtgggtgccaccaagatcactgtg

SEQ ID NO: 166318 - DNA, 25 bp, Homo sapien
gacagtgtacaacttctgtagcgaa

SEQ ID NO: 166319 - DNA, 25 bp, Homo sapien
ttctgtagcgaagacacagtgcggg

SEQ ID NO: 166320 - DNA, 25 bp, Homo sapien
acagtgcgggaagacacgctgctca

SEQ ID NO: 166321 - DNA, 25 bp, Homo sapien
gaaaatgcctaatcgatatatatat

SEQ ID NO: 166322 - DNA, 25 bp, Homo sapien
cgatatatatattcttgtgcctagt

SEQ ID NO: 166323 - DNA, 25 bp, Homo sapien
tattcttgtgcctagtactttacca

SEQ ID NO: 166324 - DNA, 25 bp, Homo sapien
gtgcctagtactttaccacaaatac

SEQ ID NO: 166325 - DNA, 25 bp, Homo sapien
gtactttaccacaaatacagtgtaa

SEQ ID NO: 166326 - DNA, 25 bp, Homo sapien
tacagtgtaatatcatcagtccaaa

SEQ ID NO: 166327 - DNA, 25 bp, Homo sapien
tcagtccaaaactgcattacttttg

SEQ ID NO: 166328 - DNA, 25 bp, Homo sapien
gatattatagagctttttatgcttt

SEQ ID NO: 166329 - DNA, 25 bp, Homo sapien
tcatcacttgaaatgtggtagctct

SEQ ID NO: 166330 - DNA, 25 bp, Homo sapien
tgtggtagctcttacaaagtttatt

SEQ ID NO: 166331 - DNA, 25 bp, Homo sapien
aaaagccaattgaacaacaggatat

SEQ ID NO: 166332 - DNA, 25 bp, Homo sapien
gaaaaaatcccacatcctgctcaag

SEQ ID NO: 166333 - DNA, 25 bp, Homo sapien
tgctcaagacgcttctaccagctca

SEQ ID NO: 166334 - DNA, 25 bp, Homo sapien
gagagctgcatcagttcacttttga

SEQ ID NO: 166335 - DNA, 25 bp, Homo sapien
agttcacttttgacctgctaatcaa

SEQ ID NO: 166336 - DNA, 25 bp, Homo sapien
cctgctaatcaagtcacacatggtg

SEQ ID NO: 166337 - DNA, 25 bp, Homo sapien
atggtgagcgtggactttccggaaa

SEQ ID NO: 166338 - DNA, 25 bp, Homo sapien
gagatcatctctgtgcaagtgccca

SEQ ID NO: 166339 - DNA, 25 bp, Homo sapien
gaaagtcaagcccatctatttccac

SEQ ID NO: 166340 - DNA, 25 bp, Homo sapien
tctatttccacacccagtgaagcat

SEQ ID NO: 166341 - DNA, 25 bp, Homo sapien
agtgaagcattggaaaccctatttc

SEQ ID NO: 166342 - DNA, 25 bp, Homo sapien
gatgtcttctgcctgttataactct

SEQ ID NO: 166343 - DNA, 25 bp, Homo sapien
gattaggggcctttccaagattgct

SEQ ID NO: 166344 - DNA, 25 bp, Homo sapien
gtttttgttttggagcttcaagact

SEQ ID NO: 166345 - DNA, 25 bp, Homo sapien
gagcttcaagactttgcatttccta

SEQ ID NO: 166346 - DNA, 25 bp, Homo sapien
ttgtcagttctcaatttcctgtgtt

SEQ ID NO: 166347 - DNA, 25 bp, Homo sapien
caatttcctgtgtttgcaatgttga

SEQ ID NO: 166348 - DNA, 25 bp, Homo sapien
ctttttttccggtttctacatgcag

SEQ ID NO: 166349 - DNA, 25 bp, Homo sapien
gtttctacatgcagagatgaattta

SEQ ID NO: 166350 - DNA, 25 bp, Homo sapien
tgaatttatactgccatcttacgac

SEQ ID NO: 166351 - DNA, 25 bp, Homo sapien
tgccatcttacgactatttcttctt

SEQ ID NO: 166352 - DNA, 25 bp, Homo sapien
ttaatacacttaactcaggccattt

SEQ ID NO: 166353 - DNA, 25 bp, Homo sapien
tacacttaactcaggccatttttta

SEQ ID NO: 166354 - DNA, 25 bp, Homo sapien
gacagagggctaaatccatgaagtt

SEQ ID NO: 166355 - DNA, 25 bp, Homo sapien
gagggctaaatccatgaagtttgtg

SEQ ID NO: 166356 - DNA, 25 bp, Homo sapien
aaatccatgaagtttgtggatggcc

SEQ ID NO: 166357 - DNA, 25 bp, Homo sapien
atggcctgatgatccacagcggaga

SEQ ID NO: 166358 - DNA, 25 bp, Homo sapien
ggcctgatgatccacagcggagacc

SEQ ID NO: 166359 - DNA, 25 bp, Homo sapien
tgatgatccacagcggagaccctgt

SEQ ID NO: 166360 - DNA, 25 bp, Homo sapien
tgatccacagcggagaccctgttaa

SEQ ID NO: 166361 - DNA, 25 bp, Homo sapien
gatccacagcggagaccctgttaac

SEQ ID NO: 166362 - DNA, 25 bp, Homo sapien
gagaccctgttaactactacgttga

SEQ ID NO: 166363 - DNA, 25 bp, Homo sapien
gaccctgttaactactacgttgaca

SEQ ID NO: 166364 - DNA, 25 bp, Homo sapien
ctgttaactactacgttgacactgc

SEQ ID NO: 166365 - DNA, 25 bp, Homo sapien
tgcgaccgccagattctcccttaag

SEQ ID NO: 166366 - DNA, 25 bp, Homo sapien
gaccgccagattctcccttaaggaa

SEQ ID NO: 166367 - DNA, 25 bp, Homo sapien
ccgccagattctcccttaaggaatt

SEQ ID NO: 166368 - DNA, 25 bp, Homo sapien
gattctcccttaaggaattgacttc

SEQ ID NO: 166369 - DNA, 25 bp, Homo sapien
ttctcccttaaggaattgacttcag

SEQ ID NO: 166370 - DNA, 25 bp, Homo sapien
tcccttaaggaattgacttcagcag

SEQ ID NO: 166371 - DNA, 25 bp, Homo sapien
ccttaaggaattgacttcagcaggg

SEQ ID NO: 166372 - DNA, 25 bp, Homo sapien
gtgttccaaagagaaggcctggtca

SEQ ID NO: 166373 - DNA, 25 bp, Homo sapien
aggcagactcgagggccgaattgtt

SEQ ID NO: 166374 - DNA, 25 bp, Homo sapien
aaggtgaacactcatgcggcagcca

SEQ ID NO: 166375 - DNA, 25 bp, Homo sapien
atgcggcagccatgggccctctgag

SEQ ID NO: 166376 - DNA, 25 bp, Homo sapien
tgtctttaacaatgtctattggtaa

SEQ ID NO: 166377 - DNA, 25 bp, Homo sapien
caatgtctattggtaaagcaaagtt

SEQ ID NO: 166378 - DNA, 25 bp, Homo sapien
aattgtattgtaattccatgaccca

SEQ ID NO: 166379 - DNA, 25 bp, Homo sapien
attccatgacccaagcatatggatt

SEQ ID NO: 166380 - DNA, 25 bp, Homo sapien
catgacccaagcatatggattttct

SEQ ID NO: 166381 - DNA, 25 bp, Homo sapien
gacccaagcatatggattttcttca

SEQ ID NO: 166382 - DNA, 25 bp, Homo sapien
ccaagcatatggattttcttcatta

SEQ ID NO: 166383 - DNA, 25 bp, Homo sapien
tactttttcttacttgttactgtag

SEQ ID NO: 166384 - DNA, 25 bp, Homo sapien
ttttcttacttgttactgtagtgtt

SEQ ID NO: 166385 - DNA, 25 bp, Homo sapien
cttacttgttactgtagtgtttata

SEQ ID NO: 166386 - DNA, 25 bp, Homo sapien
gttactgtagtgtttatataatttt

SEQ ID NO: 166387 - DNA, 25 bp, Homo sapien
ctatgagaaggagcgccagctgaat

SEQ ID NO: 166388 - DNA, 25 bp, Homo sapien
aatgtcacaccgctgcagctgctgg

SEQ ID NO: 166389 - DNA, 25 bp, Homo sapien
tgctggactggctgatggtgaacct

SEQ ID NO: 166390 - DNA, 25 bp, Homo sapien
tgaacctgtaatcggcaaccccact

SEQ ID NO: 166391 - DNA, 25 bp, Homo sapien
tgctttcccctcttctggcagtggg

SEQ ID NO: 166392 - DNA, 25 bp, Homo sapien
cagagccctaacattatcttcacac

SEQ ID NO: 166393 - DNA, 25 bp, Homo sapien
taacattatcttcacaccactctca

SEQ ID NO: 166394 - DNA, 25 bp, Homo sapien
accactctcatcaaagacatgtcat

SEQ ID NO: 166395 - DNA, 25 bp, Homo sapien
agacatgtcatcttgtgctagccac

SEQ ID NO: 166396 - DNA, 25 bp, Homo sapien
gtgctagccactggattttgcagat

SEQ ID NO: 166397 - DNA, 25 bp, Homo sapien
agattttcctgtccatgcaagcaag

SEQ ID NO: 166398 - DNA, 25 bp, Homo sapien
tatgaaaccaccgaagattgccctt

SEQ ID NO: 166399 - DNA, 25 bp, Homo sapien
gaagattgcccttccatcatggagc

SEQ ID NO: 166400 - DNA, 25 bp, Homo sapien
tcatggagcaatttcacatgcgaga

SEQ ID NO: 166401 - DNA, 25 bp, Homo sapien
acatgcgagagatccactcctgtaa

SEQ ID NO: 166402 - DNA, 25 bp, Homo sapien
gagatccactcctgtaaggtgctgg

SEQ ID NO: 166403 - DNA, 25 bp, Homo sapien
ggattttctatgagctacccaacta

SEQ ID NO: 166404 - DNA, 25 bp, Homo sapien
tacccaactaccgtggcaggcagta

SEQ ID NO: 166405 - DNA, 25 bp, Homo sapien
aaggagtaccggaagcccatcgatt

SEQ ID NO: 166406 - DNA, 25 bp, Homo sapien
gtctttccgccgcattgtggagtaa

SEQ ID NO: 166407 - DNA, 25 bp, Homo sapien
gggcccaaatgctggctggccttgt

SEQ ID NO: 166408 - DNA, 25 bp, Homo sapien
cttgtggtccaaataggcatcatca

SEQ ID NO: 166409 - DNA, 25 bp, Homo sapien
ggtgacgaaccatgcgggattcctc

SEQ ID NO: 166410 - DNA, 25 bp, Homo sapien
ccatgcgggattcctcaccatcggg

SEQ ID NO: 166411 - DNA, 25 bp, Homo sapien
gggctgatctccactttgccaaagg

SEQ ID NO: 166412 - DNA, 25 bp, Homo sapien
tgatctccactttgccaaagggctg

SEQ ID NO: 166413 - DNA, 25 bp, Homo sapien
gtgattgagaagaaccggcctgctg

SEQ ID NO: 166414 - DNA, 25 bp, Homo sapien
agaagaaccggcctgctgatgtcag

SEQ ID NO: 166415 - DNA, 25 bp, Homo sapien
ctgctgatgtcagggcgtccactgc

SEQ ID NO: 166416 - DNA, 25 bp, Homo sapien
cacagcagctgtctgagccctcaat

SEQ ID NO: 166417 - DNA, 25 bp, Homo sapien
ttttcccacattcatagcctgtagt

SEQ ID NO: 166418 - DNA, 25 bp, Homo sapien
gacgggatttgaagctgtacccaat

SEQ ID NO: 166419 - DNA, 25 bp, Homo sapien
gaagctgtacccaatttaattccat

SEQ ID NO: 166420 - DNA, 25 bp, Homo sapien
accaagacctactgctacaaggcct

SEQ ID NO: 166421 - DNA, 25 bp, Homo sapien
ctgtctgacagcaggctcagggagt

SEQ ID NO: 166422 - DNA, 25 bp, Homo sapien
gcaggctcagggagtgacactttca

SEQ ID NO: 166423 - DNA, 25 bp, Homo sapien
gctcagggagtgacactttcatgtt

SEQ ID NO: 166424 - DNA, 25 bp, Homo sapien
agggccttcgggagcccaagcagca

SEQ ID NO: 166425 - DNA, 25 bp, Homo sapien
tgactgacagcaggaatctcacagg

SEQ ID NO: 166426 - DNA, 25 bp, Homo sapien
cagcaggaatctcacaggccaaagt

SEQ ID NO: 166427 - DNA, 25 bp, Homo sapien
aaagtggtcagaatgctgggaacct

SEQ ID NO: 166428 - DNA, 25 bp, Homo sapien
aatgctgggaacctgattattctca

SEQ ID NO: 166429 - DNA, 25 bp, Homo sapien
gggaacctgattattctcaaaaatg

SEQ ID NO: 166430 - DNA, 25 bp, Homo sapien
aaatgaggctgtttctcaaaatgag

SEQ ID NO: 166431 - DNA, 25 bp, Homo sapien
aagcatacggcgctgttcctgccac

SEQ ID NO: 166432 - DNA, 25 bp, Homo sapien
cctgccactgtcctgaagatgtgaa

SEQ ID NO: 166433 - DNA, 25 bp, Homo sapien
gggtggtacgatttcaacactggtt

SEQ ID NO: 166434 - DNA, 25 bp, Homo sapien
aacactggttaatttcacactccat

SEQ ID NO: 166435 - DNA, 25 bp, Homo sapien
atctccccgctttgtaaatacccat

SEQ ID NO: 166436 - DNA, 25 bp, Homo sapien
cgctttgtaaatacccatcgggaag

SEQ ID NO: 166437 - DNA, 25 bp, Homo sapien
gagactttttttccatggtgaagag

SEQ ID NO: 166438 - DNA, 25 bp, Homo sapien
aaactctggatgtttgtgcgcgtgt

SEQ ID NO: 166439 - DNA, 25 bp, Homo sapien
agtcttatcttccagcatgatagga

SEQ ID NO: 166440 - DNA, 25 bp, Homo sapien
gcatgataggatttgaccattttgg

SEQ ID NO: 166441 - DNA, 25 bp, Homo sapien
ggatttgaccattttggtgtaaaca

SEQ ID NO: 166442 - DNA, 25 bp, Homo sapien
caagtatttacttggtgtttgcctt

SEQ ID NO: 166443 - DNA, 25 bp, Homo sapien
agcagtgagcacataggcagtagtc

SEQ ID NO: 166444 - DNA, 25 bp, Homo sapien
tgtcctgcacaaatttgaacaactc

SEQ ID NO: 166445 - DNA, 25 bp, Homo sapien
gaacaactcatctcgatatatttga

SEQ ID NO: 166446 - DNA, 25 bp, Homo sapien
atatttgatatttctctgtctgttg

SEQ ID NO: 166447 - DNA, 25 bp, Homo sapien
tttctctgtctgttgattttaattc

SEQ ID NO: 166448 - DNA, 25 bp, Homo sapien
aattctaaatgtgcaggatgctgcc

SEQ ID NO: 166449 - DNA, 25 bp, Homo sapien
gcaggatgctgccagaaactccaat

SEQ ID NO: 166450 - DNA, 25 bp, Homo sapien
gatgctgccagaaactccaatgtag

SEQ ID NO: 166451 - DNA, 25 bp, Homo sapien
gctgccagaaactccaatgtagaaa

SEQ ID NO: 166452 - DNA, 25 bp, Homo sapien
gaaactccaatgtagaaattcaaca

SEQ ID NO: 166453 - DNA, 25 bp, Homo sapien
gatgatgccgcagaacaggaggaat

SEQ ID NO: 166454 - DNA, 25 bp, Homo sapien
tgccgcagaacaggaggaatatgat

SEQ ID NO: 166455 - DNA, 25 bp, Homo sapien
aatgactacattaattcatactttg

SEQ ID NO: 166456 - DNA, 25 bp, Homo sapien
atgattttggcgcagacgtgatgac

SEQ ID NO: 166457 - DNA, 25 bp, Homo sapien
tggcgcagacgtgatgacaacatgg

SEQ ID NO: 166458 - DNA, 25 bp, Homo sapien
gacaacatggatgaggcaacctatt

SEQ ID NO: 166459 - DNA, 25 bp, Homo sapien
gatgaggcaacctattaggcatgaa

SEQ ID NO: 166460 - DNA, 25 bp, Homo sapien
aacctattaggcatgaaatttttca

SEQ ID NO: 166461 - DNA, 25 bp, Homo sapien
aatatttttatgatgcagcttctga

SEQ ID NO: 166462 - DNA, 25 bp, Homo sapien
gatgcagcttctgaacatttggaca

SEQ ID NO: 166463 - DNA, 25 bp, Homo sapien
gaacatttggacagacttgatttgt

SEQ ID NO: 166464 - DNA, 25 bp, Homo sapien
tggctaccaggacatgcccgagtat

SEQ ID NO: 166465 - DNA, 25 bp, Homo sapien
gaaaacttcaagcaccttctgcagg

SEQ ID NO: 166466 - DNA, 25 bp, Homo sapien
aggcaccactggatgatgctcaaga

SEQ ID NO: 166467 - DNA, 25 bp, Homo sapien
agaaattctgcaagcacgcttcccg

SEQ ID NO: 166468 - DNA, 25 bp, Homo sapien
gatgccacgttacatcaacacggag

SEQ ID NO: 166469 - DNA, 25 bp, Homo sapien
atggaggcagtcaggctcgattcct

SEQ ID NO: 166470 - DNA, 25 bp, Homo sapien
ggctcgattccttttgtccaaagtg

SEQ ID NO: 166471 - DNA, 25 bp, Homo sapien
tgaacccatctcagacacacaataa

SEQ ID NO: 166472 - DNA, 25 bp, Homo sapien
ggagcacccatcctaactgatgatg

SEQ ID NO: 166473 - DNA, 25 bp, Homo sapien
tagcctgcaggtgttcatggaccat

SEQ ID NO: 166474 - DNA, 25 bp, Homo sapien
gaagaagctggctgtctccagtgcc

SEQ ID NO: 166475 - DNA, 25 bp, Homo sapien
gagtaagctggattgtgacagttta

SEQ ID NO: 166476 - DNA, 25 bp, Homo sapien
tgtgtagatttgcaggtaacgttta

SEQ ID NO: 166477 - DNA, 25 bp, Homo sapien
gcaggtaacgtttaattactcgtgc

SEQ ID NO: 166478 - DNA, 25 bp, Homo sapien
aattactcgtgcttaatctcgcatg

SEQ ID NO: 166479 - DNA, 25 bp, Homo sapien
cgtgcttaatctcgcatgtttagga

SEQ ID NO: 166480 - DNA, 25 bp, Homo sapien
ctcgcatgtttaggatttgggcata

SEQ ID NO: 166481 - DNA, 25 bp, Homo sapien
agtagttaaagccactgttttctgc

SEQ ID NO: 166482 - DNA, 25 bp, Homo sapien
gccactgttttctgcttgagggaag

SEQ ID NO: 166483 - DNA, 25 bp, Homo sapien
tctgcttgagggaagttggtatgtt

SEQ ID NO: 166484 - DNA, 25 bp, Homo sapien
aatatgtttagctttcttgtggcat

SEQ ID NO: 166485 - DNA, 25 bp, Homo sapien
gtggcattttaacactagatatcag

SEQ ID NO: 166486 - DNA, 25 bp, Homo sapien
ttatgatagctctatagatgctgaa

SEQ ID NO: 166487 - DNA, 25 bp, Homo sapien
gtctggaaagaaacaccctaatcta

SEQ ID NO: 166488 - DNA, 25 bp, Homo sapien
gataaaggtctgtttcagaaaccaa

SEQ ID NO: 166489 - DNA, 25 bp, Homo sapien
gaaaccaacagtgatggcattctaa

SEQ ID NO: 166490 - DNA, 25 bp, Homo sapien
ggcattctaaagagtcagacgccac

SEQ ID NO: 166491 - DNA, 25 bp, Homo sapien
taaagagtcagacgccacaggcatt

SEQ ID NO: 166492 - DNA, 25 bp, Homo sapien
cacaggcattcccattaaagtcaga

SEQ ID NO: 166493 - DNA, 25 bp, Homo sapien
ttaaagtcagaaactagccaagggc

SEQ ID NO: 166494 - DNA, 25 bp, Homo sapien
agccaagggcaagctattattcagc

SEQ ID NO: 166495 - DNA, 25 bp, Homo sapien
agctattattcagcagtgtcccggc

SEQ ID NO: 166496 - DNA, 25 bp, Homo sapien
taacccctgcaacaagccagatgag

SEQ ID NO: 166497 - DNA, 25 bp, Homo sapien
gggccgtggcctttaacaagcggat

SEQ ID NO: 166498 - DNA, 25 bp, Homo sapien
ggccgtggcctttaacaagcggatc

SEQ ID NO: 166499 - DNA, 25 bp, Homo sapien
cgtggcctttaacaagcggatcctg

SEQ ID NO: 166500 - DNA, 25 bp, Homo sapien
gtggcctttaacaagcggatcctgt

SEQ ID NO: 166501 - DNA, 25 bp, Homo sapien
ggcctttaacaagcggatcctgtgc

SEQ ID NO: 166502 - DNA, 25 bp, Homo sapien
atcctgtgcctgttccgcccgcagt

SEQ ID NO: 166503 - DNA, 25 bp, Homo sapien
ggaggccctgctggatcgatacttc

SEQ ID NO: 166504 - DNA, 25 bp, Homo sapien
aggccctgctggatcgatacttcga

SEQ ID NO: 166505 - DNA, 25 bp, Homo sapien
ggccctgctggatcgatacttcgag

SEQ ID NO: 166506 - DNA, 25 bp, Homo sapien
gccctgctggatcgatacttcgagg

SEQ ID NO: 166507 - DNA, 25 bp, Homo sapien
ctgctggatcgatacttcgaggctg

SEQ ID NO: 166508 - DNA, 25 bp, Homo sapien
attatcggcagctggtgcacgagct

SEQ ID NO: 166509 - DNA, 25 bp, Homo sapien
atgaggcagagtaccgggacatccg

SEQ ID NO: 166510 - DNA, 25 bp, Homo sapien
gacatccggctgatggtcatggaga

SEQ ID NO: 166511 - DNA, 25 bp, Homo sapien
ggtcatggagatccgcaatgcttat

SEQ ID NO: 166512 - DNA, 25 bp, Homo sapien
gatccgcaatgcttatgctgtgtta

SEQ ID NO: 166513 - DNA, 25 bp, Homo sapien
gctgtgttatatgacatcatcctga

SEQ ID NO: 166514 - DNA, 25 bp, Homo sapien
ggaatgatctattgagagccctctc

SEQ ID NO: 166515 - DNA, 25 bp, Homo sapien
ctcccattctgtgatgagtacagca

SEQ ID NO: 166516 - DNA, 25 bp, Homo sapien
tgatgagtacagcagagaccttcct

SEQ ID NO: 166517 - DNA, 25 bp, Homo sapien
acagcagagaccttcctgcttttta

SEQ ID NO: 166518 - DNA, 25 bp, Homo sapien
tgttgagatttttccctcaccttgc

SEQ ID NO: 166519 - DNA, 25 bp, Homo sapien
agagattgtcatatacttttaccac

SEQ ID NO: 166520 - DNA, 25 bp, Homo sapien
atacttttaccacttgaattgatct

SEQ ID NO: 166521 - DNA, 25 bp, Homo sapien
gaattgatcttcttgccagcaatag

SEQ ID NO: 166522 - DNA, 25 bp, Homo sapien
ttgccagcaatagatctcattttca

SEQ ID NO: 166523 - DNA, 25 bp, Homo sapien
tgtagctggcagaaagttctgtcca

SEQ ID NO: 166524 - DNA, 25 bp, Homo sapien
agttctgtccagtaaacgcaggatg

SEQ ID NO: 166525 - DNA, 25 bp, Homo sapien
gaattttcctgggactctacaccca

SEQ ID NO: 166526 - DNA, 25 bp, Homo sapien
gactctacacccatcttaaggtggt

SEQ ID NO: 166527 - DNA, 25 bp, Homo sapien
aaggtggtataccttccaaatcctg

SEQ ID NO: 166528 - DNA, 25 bp, Homo sapien
taccttccaaatcctggttcagatg

SEQ ID NO: 166529 - DNA, 25 bp, Homo sapien
gagaggacccattagctggcagacc

SEQ ID NO: 166530 - DNA, 25 bp, Homo sapien
ctgaacaatctccaaaattgaaatg

SEQ ID NO: 166531 - DNA, 25 bp, Homo sapien
atgtatatttttgctaggagcccca

SEQ ID NO: 166532 - DNA, 25 bp, Homo sapien
gtatatttttgctaggagccccagc

SEQ ID NO: 166533 - DNA, 25 bp, Homo sapien
tatatttttgctaggagccccagct

SEQ ID NO: 166534 - DNA, 25 bp, Homo sapien
atatttttgctaggagccccagctt

SEQ ID NO: 166535 - DNA, 25 bp, Homo sapien
tatttttgctaggagccccagcttc

SEQ ID NO: 166536 - DNA, 25 bp, Homo sapien
taaatagtgtacacagactgacgaa

SEQ ID NO: 166537 - DNA, 25 bp, Homo sapien
tagtgtacacagactgacgaaactt

SEQ ID NO: 166538 - DNA, 25 bp, Homo sapien
gtgtacacagactgacgaaacttta

SEQ ID NO: 166539 - DNA, 25 bp, Homo sapien
gtacacagactgacgaaactttaaa

SEQ ID NO: 166540 - DNA, 25 bp, Homo sapien
cacagactgacgaaactttaaataa

SEQ ID NO: 166541 - DNA, 25 bp, Homo sapien
gggtgtcaagcgcatttctggtctc

SEQ ID NO: 166542 - DNA, 25 bp, Homo sapien
tgtcaagcgcatttctggtctcatc

SEQ ID NO: 166543 - DNA, 25 bp, Homo sapien
aaacgtgattcgtgatgctgtgact

SEQ ID NO: 166544 - DNA, 25 bp, Homo sapien
tgctgtgacttacacggagcacgcc

SEQ ID NO: 166545 - DNA, 25 bp, Homo sapien
tcggcggctaatgctaccgcttaaa

SEQ ID NO: 166546 - DNA, 25 bp, Homo sapien
taatgctaccgcttaaacgactcag

SEQ ID NO: 166547 - DNA, 25 bp, Homo sapien
ttaaacgactcagcatctcgacttc

SEQ ID NO: 166548 - DNA, 25 bp, Homo sapien
gcatctcgacttcccaaatcaaagg

SEQ ID NO: 166549 - DNA, 25 bp, Homo sapien
tcgacttcccaaatcaaaggccctt

SEQ ID NO: 166550 - DNA, 25 bp, Homo sapien
gcccacagttttccgcaaaagagct

SEQ ID NO: 166551 - DNA, 25 bp, Homo sapien
ttccgcaaaagagctcatgacttgt

SEQ ID NO: 166552 - DNA, 25 bp, Homo sapien
ctccagactctccattaaggagttg

SEQ ID NO: 166553 - DNA, 25 bp, Homo sapien
tccattaaggagttgacttcagcat

SEQ ID NO: 166554 - DNA, 25 bp, Homo sapien
taaggagttgacttcagcatgggag

SEQ ID NO: 166555 - DNA, 25 bp, Homo sapien
gtcccaccaggtcctggaggcagat

SEQ ID NO: 166556 - DNA, 25 bp, Homo sapien
atgcgagggcccagagttgtttgta

SEQ ID NO: 166557 - DNA, 25 bp, Homo sapien
gagggcccagagttgtttgtagtta

SEQ ID NO: 166558 - DNA, 25 bp, Homo sapien
gttgtttgtagttaggccacgcttc

SEQ ID NO: 166559 - DNA, 25 bp, Homo sapien
cacgcttctctgttcagtagcaaaa

SEQ ID NO: 166560 - DNA, 25 bp, Homo sapien
ttctctgttcagtagcaaaagcaaa

SEQ ID NO: 166561 - DNA, 25 bp, Homo sapien
gcaaaagcaaacactcgtgggccca

SEQ ID NO: 166562 - DNA, 25 bp, Homo sapien
aagcaaacactcgtgggcccagctg

SEQ ID NO: 166563 - DNA, 25 bp, Homo sapien
gcggcttagcgagcatgcccggttc

SEQ ID NO: 166564 - DNA, 25 bp, Homo sapien
agcatgcccggttcgcactttgtgg

SEQ ID NO: 166565 - DNA, 25 bp, Homo sapien
aaagggttttctatcagcaccccag

SEQ ID NO: 166566 - DNA, 25 bp, Homo sapien
tcagcaccccagtctttacttgaag

SEQ ID NO: 166567 - DNA, 25 bp, Homo sapien
agcaccccagtctttacttgaagac

SEQ ID NO: 166568 - DNA, 25 bp, Homo sapien
caccccagtctttacttgaagacaa

SEQ ID NO: 166569 - DNA, 25 bp, Homo sapien
gacaaaaaggaaccattttctcagg

SEQ ID NO: 166570 - DNA, 25 bp, Homo sapien
ttttctcaggtaaacttttgtgatg

SEQ ID NO: 166571 - DNA, 25 bp, Homo sapien
ggtaaacttttgtgatgaatgtatc

SEQ ID NO: 166572 - DNA, 25 bp, Homo sapien
atgaatgtatcagctatctagagaa

SEQ ID NO: 166573 - DNA, 25 bp, Homo sapien
gaatgtatcagctatctagagaaaa

SEQ ID NO: 166574 - DNA, 25 bp, Homo sapien
tgaagcatgtacgtcttctgtcccg

SEQ ID NO: 166575 - DNA, 25 bp, Homo sapien
ttctgtcccgtaaacagttccagct

SEQ ID NO: 166576 - DNA, 25 bp, Homo sapien
agttccagctgagggcactaatgca

SEQ ID NO: 166577 - DNA, 25 bp, Homo sapien
gaaagactgccggtctcagtgacct

SEQ ID NO: 166578 - DNA, 25 bp, Homo sapien
gtctcagtgacctctactgacttct

SEQ ID NO: 166579 - DNA, 25 bp, Homo sapien
actgacttctctgataccagctgga

SEQ ID NO: 166580 - DNA, 25 bp, Homo sapien
ttctcttccttttatcagtaggtgc

SEQ ID NO: 166581 - DNA, 25 bp, Homo sapien
cagtaggtgcccagaataagttatt

SEQ ID NO: 166582 - DNA, 25 bp, Homo sapien
gttattgcagtttatcattcaagtg

SEQ ID NO: 166583 - DNA, 25 bp, Homo sapien
aaagactggcttttattaatgcact

SEQ ID NO: 166584 - DNA, 25 bp, Homo sapien
aatgcactttctatcctctgtaaac

SEQ ID NO: 166585 - DNA, 25 bp, Homo sapien
ggctgagcttacctctacagtacac

SEQ ID NO: 166586 - DNA, 25 bp, Homo sapien
tacagtacactaccgcaaaaccaac

SEQ ID NO: 166587 - DNA, 25 bp, Homo sapien
gggccacctatccactcaggagaaa

SEQ ID NO: 166588 - DNA, 25 bp, Homo sapien
gaaagagtagtagtcactgctaaaa

SEQ ID NO: 166589 - DNA, 25 bp, Homo sapien
gtttcacgtgtttagtagctccggt

SEQ ID NO: 166590 - DNA, 25 bp, Homo sapien
gtagctccggttttcaagttaaatg

SEQ ID NO: 166591 - DNA, 25 bp, Homo sapien
aaatggtcttattacgccttggctt

SEQ ID NO: 166592 - DNA, 25 bp, Homo sapien
tacgccttggcttcatatcttactg

SEQ ID NO: 166593 - DNA, 25 bp, Homo sapien
tcatatcttactggccggtgaggca

SEQ ID NO: 166594 - DNA, 25 bp, Homo sapien
ggccggtgaggcattagtgtattaa

SEQ ID NO: 166595 - DNA, 25 bp, Homo sapien
agtttattttcactcttgctgtgtc

SEQ ID NO: 166596 - DNA, 25 bp, Homo sapien
aacaagtcctcagtggttggcaact

SEQ ID NO: 166597 - DNA, 25 bp, Homo sapien
ttggcaactgtttcaacctgtttga

SEQ ID NO: 166598 - DNA, 25 bp, Homo sapien
tgtttgaaccaagaaccttccagga

SEQ ID NO: 166599 - DNA, 25 bp, Homo sapien
aagggaaaccgaatttcacagccat

SEQ ID NO: 166600 - DNA, 25 bp, Homo sapien
ttcacagccatgattcttttgccca

SEQ ID NO: 166601 - DNA, 25 bp, Homo sapien
tttgcccacacttgggagcaaaaga

SEQ ID NO: 166602 - DNA, 25 bp, Homo sapien
agattctacaaagctcttttgagca

SEQ ID NO: 166603 - DNA, 25 bp, Homo sapien
gagcatttagactctcgactggcca

SEQ ID NO: 166604 - DNA, 25 bp, Homo sapien
agactctcgactggccaaggtttgg

SEQ ID NO: 166605 - DNA, 25 bp, Homo sapien
gggaagaacgaagccacctttgaag

SEQ ID NO: 166606 - DNA, 25 bp, Homo sapien
gatgtttccaatgctttgatccctt

SEQ ID NO: 166607 - DNA, 25 bp, Homo sapien
aacttgttcaggtatttcgatcgca

SEQ ID NO: 166608 - DNA, 25 bp, Homo sapien
atttcgatcgcaaacattcacagga

SEQ ID NO: 166609 - DNA, 25 bp, Homo sapien
aaatggtttgggaataccagcagcc

SEQ ID NO: 166610 - DNA, 25 bp, Homo sapien
ccagcagccttttatgacgtatgtg

SEQ ID NO: 166611 - DNA, 25 bp, Homo sapien
gacgtatgtgatgtgttttattccc

SEQ ID NO: 166612 - DNA, 25 bp, Homo sapien
gatgtgttttattcccacgtttctg

SEQ ID NO: 166613 - DNA, 25 bp, Homo sapien
cacgtttctgaaatttactcctatg

SEQ ID NO: 166614 - DNA, 25 bp, Homo sapien
tactcctatgttaggtggctgggac

SEQ ID NO: 166615 - DNA, 25 bp, Homo sapien
ttaggtggctgggacttaactacac

SEQ ID NO: 166616 - DNA, 25 bp, Homo sapien
ggctgggacttaactacactagcat

SEQ ID NO: 166617 - DNA, 25 bp, Homo sapien
aactacactagcattacatgtttag

SEQ ID NO: 166618 - DNA, 25 bp, Homo sapien
gggcatcaccaagatcttcagcaac

SEQ ID NO: 166619 - DNA, 25 bp, Homo sapien
agatcttcagcaacgaggccgacct

SEQ ID NO: 166620 - DNA, 25 bp, Homo sapien
aggccgacctctctggagtcagtca

SEQ ID NO: 166621 - DNA, 25 bp, Homo sapien
ctggagtcagtcaggaggcacccct

SEQ ID NO: 166622 - DNA, 25 bp, Homo sapien
agctctccaaggctgtgcatgtggc

SEQ ID NO: 166623 - DNA, 25 bp, Homo sapien
tggctgtgctcaccattgatgagaa

SEQ ID NO: 166624 - DNA, 25 bp, Homo sapien
gaaggcctggtctaagtatcagaca

SEQ ID NO: 166625 - DNA, 25 bp, Homo sapien
agacagtcatgttcaaccgaccctt

SEQ ID NO: 166626 - DNA, 25 bp, Homo sapien
tggtcatcatcaaggagtacatcac

SEQ ID NO: 166627 - DNA, 25 bp, Homo sapien
ccaactttccgctcttcattggaaa

SEQ ID NO: 166628 - DNA, 25 bp, Homo sapien
gagtccctaggaatctgggcatcac

SEQ ID NO: 166629 - DNA, 25 bp, Homo sapien
agaacgttattcgagacgccgtcac

SEQ ID NO: 166630 - DNA, 25 bp, Homo sapien
tcgagacgccgtcacctatacggag

SEQ ID NO: 166631 - DNA, 25 bp, Homo sapien
gccatggatgtagtatatgccctaa

SEQ ID NO: 166632 - DNA, 25 bp, Homo sapien
gtagtatatgccctaaaacgtcagg

SEQ ID NO: 166633 - DNA, 25 bp, Homo sapien
ggcttcggcggctgaatctaagaat

SEQ ID NO: 166634 - DNA, 25 bp, Homo sapien
gaatctaagaatacgcggtctcctg

SEQ ID NO: 166635 - DNA, 25 bp, Homo sapien
atacgcggtctcctgagaacttcaa

SEQ ID NO: 166636 - DNA, 25 bp, Homo sapien
ttttcagggccgctcacaaagtcgt

SEQ ID NO: 166637 - DNA, 25 bp, Homo sapien
gggccgctcacaaagtcgtttaaag

SEQ ID NO: 166638 - DNA, 25 bp, Homo sapien
aagagctgaaatgcgttgcgagaat

SEQ ID NO: 166639 - DNA, 25 bp, Homo sapien
gaaataaccgtgacagcctgcataa

SEQ ID NO: 166640 - DNA, 25 bp, Homo sapien
aagttcaactggactttggcctaca

SEQ ID NO: 166641 - DNA, 25 bp, Homo sapien
gactttggcctacaatttcccagtt

SEQ ID NO: 166642 - DNA, 25 bp, Homo sapien
atttcccagtttactcttagtgaag

SEQ ID NO: 166643 - DNA, 25 bp, Homo sapien
tattatcgcatcatcatacctgtcc

SEQ ID NO: 166644 - DNA, 25 bp, Homo sapien
catacctgtccttttgatgttagta

SEQ ID NO: 166645 - DNA, 25 bp, Homo sapien
tgatgttagtatttcttgctttatt

SEQ ID NO: 166646 - DNA, 25 bp, Homo sapien
tttttaagtttccagctcttcaccg

SEQ ID NO: 166647 - DNA, 25 bp, Homo sapien
gctcttcaccgaaatgttgtattct

SEQ ID NO: 166648 - DNA, 25 bp, Homo sapien
gttgtattcttatttcagtgtttcc

SEQ ID NO: 166649 - DNA, 25 bp, Homo sapien
tttcagtgtttccttccagacattt

SEQ ID NO: 166650 - DNA, 25 bp, Homo sapien
ccagacatttttaaggtaattggct

SEQ ID NO: 166651 - DNA, 25 bp, Homo sapien
taatttaagagctaaccagttacca

SEQ ID NO: 166652 - DNA, 25 bp, Homo sapien
agctaaccagttaccacacatctat

SEQ ID NO: 166653 - DNA, 25 bp, Homo sapien
taccacacatctatgatataaccct

SEQ ID NO: 166654 - DNA, 25 bp, Homo sapien
gggtacatttataattgcatctagg

SEQ ID NO: 166655 - DNA, 25 bp, Homo sapien
ttttaccctaatgtcttcataaagt

SEQ ID NO: 166656 - DNA, 25 bp, Homo sapien
gtcttcataaagtacttgagtgtaa

SEQ ID NO: 166657 - DNA, 25 bp, Homo sapien
gagtgtaatgtttgttacctccaac

SEQ ID NO: 166658 - DNA, 25 bp, Homo sapien
gtaatgtttgttacctccaacagaa

SEQ ID NO: 166659 - DNA, 25 bp, Homo sapien
tgtttgttacctccaacagaactaa

SEQ ID NO: 166660 - DNA, 25 bp, Homo sapien
gaactaaatgttctatggttatgaa

SEQ ID NO: 166661 - DNA, 25 bp, Homo sapien
gaaaagcttcttaattaatttgatt

SEQ ID NO: 166662 - DNA, 25 bp, Homo sapien
attttctcaggtaaacttttgtgat

SEQ ID NO: 166663 - DNA, 25 bp, Homo sapien
ttttctcaggtaaacttttgtgatg

SEQ ID NO: 166664 - DNA, 25 bp, Homo sapien
tttctcaggtaaacttttgtgatga

SEQ ID NO: 166665 - DNA, 25 bp, Homo sapien
tctcaggtaaacttttgtgatgaat

SEQ ID NO: 166666 - DNA, 25 bp, Homo sapien
caggtaaacttttgtgatgaatgta

SEQ ID NO: 166667 - DNA, 25 bp, Homo sapien
ggtaaacttttgtgatgaatgtatc

SEQ ID NO: 166668 - DNA, 25 bp, Homo sapien
aaacttttgtgatgaatgtatcagc

SEQ ID NO: 166669 - DNA, 25 bp, Homo sapien
atgaatgtatcagctatctagagaa

SEQ ID NO: 166670 - DNA, 25 bp, Homo sapien
gaatgtatcagctatctagagaaaa

SEQ ID NO: 166671 - DNA, 25 bp, Homo sapien
atgtatcagctatctagagaaaaat

SEQ ID NO: 166672 - DNA, 25 bp, Homo sapien
gtatcagctatctagagaaaaataa

SEQ ID NO: 166673 - DNA, 25 bp, Homo sapien
atgatggcagattacggcatcagaa

SEQ ID NO: 166674 - DNA, 25 bp, Homo sapien
gattacggcatcagaaagggcaact

SEQ ID NO: 166675 - DNA, 25 bp, Homo sapien
aaagggcaacttactcttcctggca

SEQ ID NO: 166676 - DNA, 25 bp, Homo sapien
actcttcctggcatcttattgtatt

SEQ ID NO: 166677 - DNA, 25 bp, Homo sapien
ttattgtattggagggtgaccaccc

SEQ ID NO: 166678 - DNA, 25 bp, Homo sapien
tcttttaatctcttactcaacgaac

SEQ ID NO: 166679 - DNA, 25 bp, Homo sapien
tctcttactcaacgaacacatcttc

SEQ ID NO: 166680 - DNA, 25 bp, Homo sapien
actcaacgaacacatcttctgatga

SEQ ID NO: 166681 - DNA, 25 bp, Homo sapien
ggatgaagtatattgcccaactcta

SEQ ID NO: 166682 - DNA, 25 bp, Homo sapien
attgcccaactctatgtttctttga

SEQ ID NO: 166683 - DNA, 25 bp, Homo sapien
tttactaatgtattactgagactag

SEQ ID NO: 166684 - DNA, 25 bp, Homo sapien
gatcactctctgctggcaggattct

SEQ ID NO: 166685 - DNA, 25 bp, Homo sapien
tctgctggcaggattcttcccgctc

SEQ ID NO: 166686 - DNA, 25 bp, Homo sapien
gggtgcttctttcagccaaggctat

SEQ ID NO: 166687 - DNA, 25 bp, Homo sapien
gtgcttctttcagccaaggctatga

SEQ ID NO: 166688 - DNA, 25 bp, Homo sapien
ccaaggctatgaagggacagctgct

SEQ ID NO: 166689 - DNA, 25 bp, Homo sapien
gctgaggatacagctcttctcagtg

SEQ ID NO: 166690 - DNA, 25 bp, Homo sapien
agctcttctcagtgtctgaacaatc

SEQ ID NO: 166691 - DNA, 25 bp, Homo sapien
gctcttctcagtgtctgaacaatct

SEQ ID NO: 166692 - DNA, 25 bp, Homo sapien
ctcttctcagtgtctgaacaatctc

SEQ ID NO: 166693 - DNA, 25 bp, Homo sapien
atatttttgctaggagccccagctt

SEQ ID NO: 166694 - DNA, 25 bp, Homo sapien
gtacacagactgacgaaactttaaa

SEQ ID NO: 166695 - DNA, 25 bp, Homo sapien
ggagaatactgccaaaacatttatg

SEQ ID NO: 166696 - DNA, 25 bp, Homo sapien
atttatgacaagctgtatcactgcc

SEQ ID NO: 166697 - DNA, 25 bp, Homo sapien
ctgtatcactgccttcgtttatatt

SEQ ID NO: 166698 - DNA, 25 bp, Homo sapien
tgtgataatccccacaggcacatta

SEQ ID NO: 166699 - DNA, 25 bp, Homo sapien
atccccacaggcacattaactgttg

SEQ ID NO: 166700 - DNA, 25 bp, Homo sapien
taactgttgcacttttgaatgtcca

SEQ ID NO: 166701 - DNA, 25 bp, Homo sapien
gaaagatacttacatgttcccaaaa

SEQ ID NO: 166702 - DNA, 25 bp, Homo sapien
atgttcccaaaacaatggtgtggtg

SEQ ID NO: 166703 - DNA, 25 bp, Homo sapien
aactaacttgatagggtctaccaat

SEQ ID NO: 166704 - DNA, 25 bp, Homo sapien
aaaatgtattacgaatgcccctgtt

SEQ ID NO: 166705 - DNA, 25 bp, Homo sapien
acgaatgcccctgttcatgtttttg

SEQ ID NO: 166706 - DNA, 25 bp, Homo sapien
tgcgaccgccagattctcccttaag

SEQ ID NO: 166707 - DNA, 25 bp, Homo sapien
gaccgccagattctcccttaaggaa

SEQ ID NO: 166708 - DNA, 25 bp, Homo sapien
accgccagattctcccttaaggaat

SEQ ID NO: 166709 - DNA, 25 bp, Homo sapien
ccgccagattctcccttaaggaatt

SEQ ID NO: 166710 - DNA, 25 bp, Homo sapien
agattctcccttaaggaattgactt

SEQ ID NO: 166711 - DNA, 25 bp, Homo sapien
gattctcccttaaggaattgacttc

SEQ ID NO: 166712 - DNA, 25 bp, Homo sapien
attctcccttaaggaattgacttca

SEQ ID NO: 166713 - DNA, 25 bp, Homo sapien
ttctcccttaaggaattgacttcag

SEQ ID NO: 166714 - DNA, 25 bp, Homo sapien
tcccttaaggaattgacttcagcag

SEQ ID NO: 166715 - DNA, 25 bp, Homo sapien
cccttaaggaattgacttcagcagg

SEQ ID NO: 166716 - DNA, 25 bp, Homo sapien
ccttaaggaattgacttcagcaggg

SEQ ID NO: 166717 - DNA, 25 bp, Homo sapien
agtggagcccgtggtctcaggcctc

SEQ ID NO: 166718 - DNA, 25 bp, Homo sapien
aggcctccaactttggccttcagga

SEQ ID NO: 166719 - DNA, 25 bp, Homo sapien
cctgtaagaacagagcacacttgct

SEQ ID NO: 166720 - DNA, 25 bp, Homo sapien
agcacacttgctggacagtgccagt

SEQ ID NO: 166721 - DNA, 25 bp, Homo sapien
gtgccagttccagatgggctgaccg

SEQ ID NO: 166722 - DNA, 25 bp, Homo sapien
tccagatgggctgaccggctcttct

SEQ ID NO: 166723 - DNA, 25 bp, Homo sapien
gagccccagcatggactcaagggac

SEQ ID NO: 166724 - DNA, 25 bp, Homo sapien
aagggacagagcacttccagtcgac

SEQ ID NO: 166725 - DNA, 25 bp, Homo sapien
ggatcactgaaccagacacagcatt

SEQ ID NO: 166726 - DNA, 25 bp, Homo sapien
acagcattgctgacacatgagacta

SEQ ID NO: 166727 - DNA, 25 bp, Homo sapien
catgagactaacacgtgcaattatt

SEQ ID NO: 166728 - DNA, 25 bp, Homo sapien
tctgctggcaggattcttcccgctc

SEQ ID NO: 166729 - DNA, 25 bp, Homo sapien
ctgctggcaggattcttcccgctcc

SEQ ID NO: 166730 - DNA, 25 bp, Homo sapien
tgctggcaggattcttcccgctccc

SEQ ID NO: 166731 - DNA, 25 bp, Homo sapien
gctggcaggattcttcccgctcccc

SEQ ID NO: 166732 - DNA, 25 bp, Homo sapien
ctggcaggattcttcccgctcccca

SEQ ID NO: 166733 - DNA, 25 bp, Homo sapien
tggcaggattcttcccgctccccac

SEQ ID NO: 166734 - DNA, 25 bp, Homo sapien
gctgaggatacagctcttctcagtg

SEQ ID NO: 166735 - DNA, 25 bp, Homo sapien
agctcttctcagtgtctgaacaatc

SEQ ID NO: 166736 - DNA, 25 bp, Homo sapien
gctcttctcagtgtctgaacaatct

SEQ ID NO: 166737 - DNA, 25 bp, Homo sapien
ctcttctcagtgtctgaacaatctc

SEQ ID NO: 166738 - DNA, 25 bp, Homo sapien
acaccagttccaagtgagcccgccc

SEQ ID NO: 166739 - DNA, 25 bp, Homo sapien
accagttccaagtgagcccgcccac

SEQ ID NO: 166740 - DNA, 25 bp, Homo sapien
agttccaagtgagcccgcccaccgc

SEQ ID NO: 166741 - DNA, 25 bp, Homo sapien
gcccaccgcggaacgttcggtcagt

SEQ ID NO: 166742 - DNA, 25 bp, Homo sapien
caccgcggaacgttcggtcagtctc

SEQ ID NO: 166743 - DNA, 25 bp, Homo sapien
accgcggaacgttcggtcagtctcg

SEQ ID NO: 166744 - DNA, 25 bp, Homo sapien
gcggaacgttcggtcagtctcggcc

SEQ ID NO: 166745 - DNA, 25 bp, Homo sapien
ggaacgttcggtcagtctcggccca

SEQ ID NO: 166746 - DNA, 25 bp, Homo sapien
gaacgttcggtcagtctcggcccac

SEQ ID NO: 166747 - DNA, 25 bp, Homo sapien
aacgttcggtcagtctcggcccaca

SEQ ID NO: 166748 - DNA, 25 bp, Homo sapien
gttcggtcagtctcggcccacaccc

SEQ ID NO: 166749 - DNA, 25 bp, Homo sapien
gcagacattgttacaaggacatggt

SEQ ID NO: 166750 - DNA, 25 bp, Homo sapien
tacaaggacatggtgagtctatttt

SEQ ID NO: 166751 - DNA, 25 bp, Homo sapien
gagtctatttttaatgcaccaatct

SEQ ID NO: 166752 - DNA, 25 bp, Homo sapien
atttttaatgcaccaatcttgttta

SEQ ID NO: 166753 - DNA, 25 bp, Homo sapien
tactgtatcaatttctaatgtttac

SEQ ID NO: 166754 - DNA, 25 bp, Homo sapien
tgtttactatatagaatttcctgta

SEQ ID NO: 166755 - DNA, 25 bp, Homo sapien
aaaatggagttatcagttatctgtt

SEQ ID NO: 166756 - DNA, 25 bp, Homo sapien
gttatctgtttgttactgcatcatc

SEQ ID NO: 166757 - DNA, 25 bp, Homo sapien
atctgtttgttactgcatcatctgt

SEQ ID NO: 166758 - DNA, 25 bp, Homo sapien
actgcatcatctgtttgtaatcatt

SEQ ID NO: 166759 - DNA, 25 bp, Homo sapien
catctgtttgtaatcattatctcac

SEQ ID NO: 166760 - DNA, 25 bp, Homo sapien
tgatccgtgacgctgtcacctatac

SEQ ID NO: 166761 - DNA, 25 bp, Homo sapien
ccgtgacgctgtcacctatacggag

SEQ ID NO: 166762 - DNA, 25 bp, Homo sapien
gcaccctttatggctttggcggtta

SEQ ID NO: 166763 - DNA, 25 bp, Homo sapien
gctttggcggttaaggttgctgatt

SEQ ID NO: 166764 - DNA, 25 bp, Homo sapien
gttgctgatttctccacagcttgca

SEQ ID NO: 166765 - DNA, 25 bp, Homo sapien
ttctccacagcttgcatttctgaac

SEQ ID NO: 166766 - DNA, 25 bp, Homo sapien
tgcatttctgaaccaaaggcccttt

SEQ ID NO: 166767 - DNA, 25 bp, Homo sapien
gaagagcttgtatccattaagtcaa

SEQ ID NO: 166768 - DNA, 25 bp, Homo sapien
taagtcaagaagctcaatgtgtaat

SEQ ID NO: 166769 - DNA, 25 bp, Homo sapien
gaatgatactgagctgacatcctaa

SEQ ID NO: 166770 - DNA, 25 bp, Homo sapien
atactgagctgacatcctaaaaagg

SEQ ID NO: 166771 - DNA, 25 bp, Homo sapien
cagcccatcgggggatccttgaact

SEQ ID NO: 166772 - DNA, 25 bp, Homo sapien
atgggtccgctctgcatgccctgtc

SEQ ID NO: 166773 - DNA, 25 bp, Homo sapien
atgccctgtctgtgccatgagtgtc

SEQ ID NO: 166774 - DNA, 25 bp, Homo sapien
tgccctgtctgtgccatgagtgtcc

SEQ ID NO: 166775 - DNA, 25 bp, Homo sapien
cctgtctgtgccatgagtgtccctg

SEQ ID NO: 166776 - DNA, 25 bp, Homo sapien
ctgtctgtgccatgagtgtccctgg

SEQ ID NO: 166777 - DNA, 25 bp, Homo sapien
cctgccatgggcaggcccgcaggaa

SEQ ID NO: 166778 - DNA, 25 bp, Homo sapien
gcaggcccgcaggaagagccggtag

SEQ ID NO: 166779 - DNA, 25 bp, Homo sapien
gggactcagatgagacacaccccac

SEQ ID NO: 166780 - DNA, 25 bp, Homo sapien
gactcagatgagacacaccccacag

SEQ ID NO: 166781 - DNA, 25 bp, Homo sapien
tcagatgagacacaccccacagctg

SEQ ID NO: 166782 - DNA, 25 bp, Homo sapien
tcttcgagggatagcacgaggtggt

SEQ ID NO: 166783 - DNA, 25 bp, Homo sapien
tgacaggactaacacttaccagcct

SEQ ID NO: 166784 - DNA, 25 bp, Homo sapien
ggactaacacttaccagcctctatg

SEQ ID NO: 166785 - DNA, 25 bp, Homo sapien
cacttaccagcctctatgcactata

SEQ ID NO: 166786 - DNA, 25 bp, Homo sapien
gcactatataataactgggagcaca

SEQ ID NO: 166787 - DNA, 25 bp, Homo sapien
gcacatgaaaggctccttgctccaa

SEQ ID NO: 166788 - DNA, 25 bp, Homo sapien
atgaaaggctccttgctccaacagt

SEQ ID NO: 166789 - DNA, 25 bp, Homo sapien
ttgctccaacagtcactctgaagat

SEQ ID NO: 166790 - DNA, 25 bp, Homo sapien
gtcactctgaagattttgccaactc

SEQ ID NO: 166791 - DNA, 25 bp, Homo sapien
gattttgccaactcatgaatggagg

SEQ ID NO: 166792 - DNA, 25 bp, Homo sapien
catgaatggaggacacttcagtagt

SEQ ID NO: 166793 - DNA, 25 bp, Homo sapien
gggaaactcttgtgggaggagcaga

SEQ ID NO: 166794 - DNA, 25 bp, Homo sapien
ggaaactcttgtgggaggagcagag

SEQ ID NO: 166795 - DNA, 25 bp, Homo sapien
gaaactcttgtgggaggagcagagg

SEQ ID NO: 166796 - DNA, 25 bp, Homo sapien
aaactcttgtgggaggagcagaggg

SEQ ID NO: 166797 - DNA, 25 bp, Homo sapien
agaggggctcacatctcccctctga

SEQ ID NO: 166798 - DNA, 25 bp, Homo sapien
gaggggctcacatctcccctctgat

SEQ ID NO: 166799 - DNA, 25 bp, Homo sapien
aggggctcacatctcccctctgatt

SEQ ID NO: 166800 - DNA, 25 bp, Homo sapien
gggctcacatctcccctctgattcc

SEQ ID NO: 166801 - DNA, 25 bp, Homo sapien
ggctcacatctcccctctgattccc

SEQ ID NO: 166802 - DNA, 25 bp, Homo sapien
ctctgattcccccatgcacattgcc

SEQ ID NO: 166803 - DNA, 25 bp, Homo sapien
atgcacattgccttatctctcccca

SEQ ID NO: 166804 - DNA, 25 bp, Homo sapien
cccttctgagggacataattaagat

SEQ ID NO: 166805 - DNA, 25 bp, Homo sapien
attaagatggcgaccgcacggcagg

SEQ ID NO: 166806 - DNA, 25 bp, Homo sapien
aggagaccaaggaaatggcccgcaa

SEQ ID NO: 166807 - DNA, 25 bp, Homo sapien
aatggcccgcaaggtgattgagcac

SEQ ID NO: 166808 - DNA, 25 bp, Homo sapien
ggtgattgagcactgcagtaacttt

SEQ ID NO: 166809 - DNA, 25 bp, Homo sapien
tgagcactgcagtaactttaaagag

SEQ ID NO: 166810 - DNA, 25 bp, Homo sapien
aggagaacatggacacgtctagata

SEQ ID NO: 166811 - DNA, 25 bp, Homo sapien
gacacgtctagatagaggcctccgt

SEQ ID NO: 166812 - DNA, 25 bp, Homo sapien
tagatagaggcctccgtccccatgg

SEQ ID NO: 166813 - DNA, 25 bp, Homo sapien
gggacttttgcacaaccgacgcttt

SEQ ID NO: 166814 - DNA, 25 bp, Homo sapien
ccgacgcttttccttaatgttagtg

SEQ ID NO: 166815 - DNA, 25 bp, Homo sapien
tgaactgctggaactcacacatgcc

SEQ ID NO: 166816 - DNA, 25 bp, Homo sapien
gctggaactcacacatgccctgata

SEQ ID NO: 166817 - DNA, 25 bp, Homo sapien
atgccctgatatgtaaatgatgatt

SEQ ID NO: 166818 - DNA, 25 bp, Homo sapien
atgatttatgttggcgagtctgaga

SEQ ID NO: 166819 - DNA, 25 bp, Homo sapien
gagtctgagagcaagcccaaatgtg

SEQ ID NO: 166820 - DNA, 25 bp, Homo sapien
aaatgtgttcttcaaaggacaatgg

SEQ ID NO: 166821 - DNA, 25 bp, Homo sapien
gaataaggcctttagaatctgacac

SEQ ID NO: 166822 - DNA, 25 bp, Homo sapien
ggcctttagaatctgacacatctgg

SEQ ID NO: 166823 - DNA, 25 bp, Homo sapien
gaaactgtcacttattacctgtatg

SEQ ID NO: 166824 - DNA, 25 bp, Homo sapien
ttacctgtatgaacatgggcaaatt

SEQ ID NO: 166825 - DNA, 25 bp, Homo sapien
actactttgtcggttgctctgaggg

SEQ ID NO: 166826 - DNA, 25 bp, Homo sapien
gaatagcatttccatgtgcattaaa

SEQ ID NO: 166827 - DNA, 25 bp, Homo sapien
tgcattaaatactttgccagcactg

SEQ ID NO: 166828 - DNA, 25 bp, Homo sapien
aatactttgccagcactgcctttgc

SEQ ID NO: 166829 - DNA, 25 bp, Homo sapien
tttgccagcatcctaaatctggagt

SEQ ID NO: 166830 - DNA, 25 bp, Homo sapien
cagcatcctaaatctggagttttac

SEQ ID NO: 166831 - DNA, 25 bp, Homo sapien
tatgcatttcatatagctttttcat

SEQ ID NO: 166832 - DNA, 25 bp, Homo sapien
aattcctatgaccaaattgcttgcc

SEQ ID NO: 166833 - DNA, 25 bp, Homo sapien
gaccaaattgcttgcctacagttcc

SEQ ID NO: 166834 - DNA, 25 bp, Homo sapien
ttccctgcagtaattgtatgatctc

SEQ ID NO: 166835 - DNA, 25 bp, Homo sapien
aattgtatgatctcacccagtgtgc

SEQ ID NO: 166836 - DNA, 25 bp, Homo sapien
gatctcacccagtgtgcaatttgtg

SEQ ID NO: 166837 - DNA, 25 bp, Homo sapien
ttctggctggctggtgcgggctcgg

SEQ ID NO: 166838 - DNA, 25 bp, Homo sapien
ctggtgcgggctcggccgtcttctg

SEQ ID NO: 166839 - DNA, 25 bp, Homo sapien
accctggtggtcatcggctcccacg

SEQ ID NO: 166840 - DNA, 25 bp, Homo sapien
cacgctgccttccaccagattgagg

SEQ ID NO: 166841 - DNA, 25 bp, Homo sapien
gctgccttccaccagattgaggctg

SEQ ID NO: 166842 - DNA, 25 bp, Homo sapien
tgccttccaccagattgaggctgtg

SEQ ID NO: 166843 - DNA, 25 bp, Homo sapien
gccttccaccagattgaggctgtgg

SEQ ID NO: 166844 - DNA, 25 bp, Homo sapien
tccaccagattgaggctgtggacgg

SEQ ID NO: 166845 - DNA, 25 bp, Homo sapien
tgaggtgtcttctgggacctgccgg

SEQ ID NO: 166846 - DNA, 25 bp, Homo sapien
tgtcctgcacggctctgctgctcgg

SEQ ID NO: 166847 - DNA, 25 bp, Homo sapien
agcgccgtcccatcacaagcccggg

SEQ ID NO: 166848 - DNA, 25 bp, Homo sapien
ccctctgcactttttgcaagacagt

SEQ ID NO: 166849 - DNA, 25 bp, Homo sapien
aagtgacaggccattttcggacgca

SEQ ID NO: 166850 - DNA, 25 bp, Homo sapien
attttcggacgcagccgttctgtgc

SEQ ID NO: 166851 - DNA, 25 bp, Homo sapien
ccattcttcaggcaactttcgattc

SEQ ID NO: 166852 - DNA, 25 bp, Homo sapien
actttcgattccttactgtagctaa

SEQ ID NO: 166853 - DNA, 25 bp, Homo sapien
tgtagctaattctagatgcccttca

SEQ ID NO: 166854 - DNA, 25 bp, Homo sapien
gatgcccttcagtattgtgaacaaa

SEQ ID NO: 166855 - DNA, 25 bp, Homo sapien
atagaccgtctggtgtcacagagcc

SEQ ID NO: 166856 - DNA, 25 bp, Homo sapien
gctcctccgagatacgtggcgtgta

SEQ ID NO: 166857 - DNA, 25 bp, Homo sapien
aggttgctgtagttacagcgcctcc

SEQ ID NO: 166858 - DNA, 25 bp, Homo sapien
tgttccgatccatttctgtgtgttc

SEQ ID NO: 166859 - DNA, 25 bp, Homo sapien
gcagcccaccgaggccgtgtgcaca

SEQ ID NO: 166860 - DNA, 25 bp, Homo sapien
acggggcaagcccactctgttgtgc

SEQ ID NO: 166861 - DNA, 25 bp, Homo sapien
actctgttgtgctccagcgcggtgg

SEQ ID NO: 166862 - DNA, 25 bp, Homo sapien
tctggggaagctccacccaaaacag

SEQ ID NO: 166863 - DNA, 25 bp, Homo sapien
ttcagtccaagccttcctcagggtc

SEQ ID NO: 166864 - DNA, 25 bp, Homo sapien
ggtcccacctctacagacaacgtga

SEQ ID NO: 166865 - DNA, 25 bp, Homo sapien
gacaacgtgagttttctaatattaa

SEQ ID NO: 166866 - DNA, 25 bp, Homo sapien
taatattaacatccatctttccctc

SEQ ID NO: 166867 - DNA, 25 bp, Homo sapien
aatattaacatccatctttccctcc

SEQ ID NO: 166868 - DNA, 25 bp, Homo sapien
tctttccctcccaattttcaaatat

SEQ ID NO: 166869 - DNA, 25 bp, Homo sapien
taaatgtcacattcacccacttttt

SEQ ID NO: 166870 - DNA, 25 bp, Homo sapien
ctgtttcctcgtctgttaagtgtga

SEQ ID NO: 166871 - DNA, 25 bp, Homo sapien
gtgtgaatatcaatacctgcctttc

SEQ ID NO: 166872 - DNA, 25 bp, Homo sapien
aatacctgcctttcataatcaccag

SEQ ID NO: 166873 - DNA, 25 bp, Homo sapien
aggtggcagatgttaacgcccttcc

SEQ ID NO: 166874 - DNA, 25 bp, Homo sapien
gtgcctacctctagcattgtaacga

SEQ ID NO: 166875 - DNA, 25 bp, Homo sapien
gcattgtaacgaccacatagtattg

SEQ ID NO: 166876 - DNA, 25 bp, Homo sapien
tgccttcctttccaagaccgttggt

SEQ ID NO: 166877 - DNA, 25 bp, Homo sapien
aagaccgttggtgcctagaggacta

SEQ ID NO: 166878 - DNA, 25 bp, Homo sapien
gaatcgtgtcctatttaactttgtg

SEQ ID NO: 166879 - DNA, 25 bp, Homo sapien
ttaactttgtgttcccaggtcctag

SEQ ID NO: 166880 - DNA, 25 bp, Homo sapien
caggtcctagctcaggagttggcaa

SEQ ID NO: 166881 - DNA, 25 bp, Homo sapien
tcagatgttttacgcaaggaaggac

SEQ ID NO: 166882 - DNA, 25 bp, Homo sapien
gaaggacttacccagtattactgct

SEQ ID NO: 166883 - DNA, 25 bp, Homo sapien
attactgctgctgtgcttttgatct

SEQ ID NO: 166884 - DNA, 25 bp, Homo sapien
ttgatctctgcttaccgttcaagag

SEQ ID NO: 166885 - DNA, 25 bp, Homo sapien
ttcaagaggcgtgtgcaggccgaca

SEQ ID NO: 166886 - DNA, 25 bp, Homo sapien
gcaggccgacagtcggtgaccccat

SEQ ID NO: 166887 - DNA, 25 bp, Homo sapien
ccttccttgggcagaatgaattcga

SEQ ID NO: 166888 - DNA, 25 bp, Homo sapien
aattcgatgcgtattctgtggccgc

SEQ ID NO: 166889 - DNA, 25 bp, Homo sapien
cgcagggtggtggtattctgtcatt

SEQ ID NO: 166890 - DNA, 25 bp, Homo sapien
attctgtcatttacacacgtcgttc

SEQ ID NO: 166891 - DNA, 25 bp, Homo sapien
tacacacgtcgttctaattaaaaag

SEQ ID NO: 166892 - DNA, 25 bp, Homo sapien
gatggttctgtggtgcagtttaaga

SEQ ID NO: 166893 - DNA, 25 bp, Homo sapien
gtttaagattaagaggcatacacca

SEQ ID NO: 166894 - DNA, 25 bp, Homo sapien
gaggcatacaccacttagtaaacta

SEQ ID NO: 166895 - DNA, 25 bp, Homo sapien
tattgtgaacgacagggattgtcaa

SEQ ID NO: 166896 - DNA, 25 bp, Homo sapien
ttgtgaacgacagggattgtcaatg

SEQ ID NO: 166897 - DNA, 25 bp, Homo sapien
aacgacagggattgtcaatgaggca

SEQ ID NO: 166898 - DNA, 25 bp, Homo sapien
gatttgacgggcaaccaatcaatga

SEQ ID NO: 166899 - DNA, 25 bp, Homo sapien
tgacgggcaaccaatcaatgaaaca

SEQ ID NO: 166900 - DNA, 25 bp, Homo sapien
agacacacctgcacagttggaaatg

SEQ ID NO: 166901 - DNA, 25 bp, Homo sapien
tacaattgatgtgttccaacagcag

SEQ ID NO: 166902 - DNA, 25 bp, Homo sapien
tgcttctttactccagaactctgtt

SEQ ID NO: 166903 - DNA, 25 bp, Homo sapien
gaagatccacacagtggctgagctg

SEQ ID NO: 166904 - DNA, 25 bp, Homo sapien
ctgagctggtctagggcttggctat

SEQ ID NO: 166905 - DNA, 25 bp, Homo sapien
tggtctagggcttggctatgagcaa

SEQ ID NO: 166906 - DNA, 25 bp, Homo sapien
ggctatgagcaagttttccagatca

SEQ ID NO: 166907 - DNA, 25 bp, Homo sapien
tgagcaagttttccagatcaccacc

SEQ ID NO: 166908 - DNA, 25 bp, Homo sapien
tttccagatcaccacccaagttgtg

SEQ ID NO: 166909 - DNA, 25 bp, Homo sapien
cagatcaccacccaagttgtgtggg

SEQ ID NO: 166910 - DNA, 25 bp, Homo sapien
ggttgagactagaaaatgcctcttt

SEQ ID NO: 166911 - DNA, 25 bp, Homo sapien
tgagactagaaaatgcctctttctt

SEQ ID NO: 166912 - DNA, 25 bp, Homo sapien
atgtgtttgaaacaaatcctgactt

SEQ ID NO: 166913 - DNA, 25 bp, Homo sapien
ttgaaacaaatcctgacttaaggcc

SEQ ID NO: 166914 - DNA, 25 bp, Homo sapien
attctcaagctcttgtccaacccaa

SEQ ID NO: 166915 - DNA, 25 bp, Homo sapien
ttctcaagctcttgtccaacccaaa

SEQ ID NO: 166916 - DNA, 25 bp, Homo sapien
ctcaagctcttgtccaacccaaagg

SEQ ID NO: 166917 - DNA, 25 bp, Homo sapien
tcaagctcttgtccaacccaaaggc

SEQ ID NO: 166918 - DNA, 25 bp, Homo sapien
ttcagagccactcactattatctaa

SEQ ID NO: 166919 - DNA, 25 bp, Homo sapien
aaagaagagctggttcgctcttcct

SEQ ID NO: 166920 - DNA, 25 bp, Homo sapien
agaagagctggttcgctcttcctat

SEQ ID NO: 166921 - DNA, 25 bp, Homo sapien
gaagagctggttcgctcttcctatc

SEQ ID NO: 166922 - DNA, 25 bp, Homo sapien
agagctggttcgctcttcctatcac

SEQ ID NO: 166923 - DNA, 25 bp, Homo sapien
agctggttcgctcttcctatcactg

SEQ ID NO: 166924 - DNA, 25 bp, Homo sapien
gctggttcgctcttcctatcactgg

SEQ ID NO: 166925 - DNA, 25 bp, Homo sapien
aaagtattccagcaaaagaggatgt

SEQ ID NO: 166926 - DNA, 25 bp, Homo sapien
aaagaggatgtagcctctgggaaaa

SEQ ID NO: 166927 - DNA, 25 bp, Homo sapien
cagtgttttttgtagattctcgttc

SEQ ID NO: 166928 - DNA, 25 bp, Homo sapien
gattctcgttctatatctcatcaca

SEQ ID NO: 166929 - DNA, 25 bp, Homo sapien
gttctatatctcatcacagcgccag

SEQ ID NO: 166930 - DNA, 25 bp, Homo sapien
atcacagcgccagccctgtttttag

SEQ ID NO: 166931 - DNA, 25 bp, Homo sapien
gccagccctgtttttagccggaaag

SEQ ID NO: 166932 - DNA, 25 bp, Homo sapien
tttttagccggaaaggattcaggat

SEQ ID NO: 166933 - DNA, 25 bp, Homo sapien
ggattcaggataaacattattatgc

SEQ ID NO: 166934 - DNA, 25 bp, Homo sapien
ggaaattcctaatgtcctgagtatt

SEQ ID NO: 166935 - DNA, 25 bp, Homo sapien
attcctaatgtcctgagtattaata

SEQ ID NO: 166936 - DNA, 25 bp, Homo sapien
gaggccaggaaagggtcagcttaac

SEQ ID NO: 166937 - DNA, 25 bp, Homo sapien
gggtcagcttaaccatttcctatgt

SEQ ID NO: 166938 - DNA, 25 bp, Homo sapien
taaccatttcctatgtgccaagctg

SEQ ID NO: 166939 - DNA, 25 bp, Homo sapien
agcagtccagggtaccctgactgtc

SEQ ID NO: 166940 - DNA, 25 bp, Homo sapien
tgactgtccctctgtagactgttga

SEQ ID NO: 166941 - DNA, 25 bp, Homo sapien
tagactgttgagactgagttcctgt

SEQ ID NO: 166942 - DNA, 25 bp, Homo sapien
tgagttcctgttgggacagtcagtt

SEQ ID NO: 166943 - DNA, 25 bp, Homo sapien
tggtatgtatccaagtccctgctga

SEQ ID NO: 166944 - DNA, 25 bp, Homo sapien
tgaccactaatgttctagctgatgg

SEQ ID NO: 166945 - DNA, 25 bp, Homo sapien
gatggtgagcggcacagtcccactt

SEQ ID NO: 166946 - DNA, 25 bp, Homo sapien
ccatctccccaagtaggtggtgtta

SEQ ID NO: 166947 - DNA, 25 bp, Homo sapien
gtgctcggcgcagcccaccgaggcc

SEQ ID NO: 166948 - DNA, 25 bp, Homo sapien
tcggcgcagcccaccgaggccgtgt

SEQ ID NO: 166949 - DNA, 25 bp, Homo sapien
gcgcagcccaccgaggccgtgtgca

SEQ ID NO: 166950 - DNA, 25 bp, Homo sapien
cgcagcccaccgaggccgtgtgcac

SEQ ID NO: 166951 - DNA, 25 bp, Homo sapien
gcagcccaccgaggccgtgtgcaca

SEQ ID NO: 166952 - DNA, 25 bp, Homo sapien
agcccaccgaggccgtgtgcacacg

SEQ ID NO: 166953 - DNA, 25 bp, Homo sapien
cccaccgaggccgtgtgcacacggg

SEQ ID NO: 166954 - DNA, 25 bp, Homo sapien
tgtgcacacggggcaagcccactct

SEQ ID NO: 166955 - DNA, 25 bp, Homo sapien
gctctggggaagctccacccaaaac

SEQ ID NO: 166956 - DNA, 25 bp, Homo sapien
ctctggggaagctccacccaaaaca

SEQ ID NO: 166957 - DNA, 25 bp, Homo sapien
tctggggaagctccacccaaaacag

SEQ ID NO: 166958 - DNA, 25 bp, Homo sapien
caagaggctttggagtatttcatga

SEQ ID NO: 166959 - DNA, 25 bp, Homo sapien
catcatggtggctggacaacaaaaa

SEQ ID NO: 166960 - DNA, 25 bp, Homo sapien
tggatcttccacacaattaaacagc

SEQ ID NO: 166961 - DNA, 25 bp, Homo sapien
gcatgcattgaactgaaagataact

SEQ ID NO: 166962 - DNA, 25 bp, Homo sapien
aaagctcactctggattccacactg

SEQ ID NO: 166963 - DNA, 25 bp, Homo sapien
ggattccacactgcactgttaataa

SEQ ID NO: 166964 - DNA, 25 bp, Homo sapien
tgttaataactctcagcaggcaaag

SEQ ID NO: 166965 - DNA, 25 bp, Homo sapien
actctcagcaggcaaagaccgattg

SEQ ID NO: 166966 - DNA, 25 bp, Homo sapien
agaccgattgcataggaattgcaca

SEQ ID NO: 166967 - DNA, 25 bp, Homo sapien
gaattgcacaatccatgaacagcat

SEQ ID NO: 166968 - DNA, 25 bp, Homo sapien
gaacagcattagatttacagcaaga

SEQ ID NO: 166969 - DNA, 25 bp, Homo sapien
gggccttcaagctgtactgtgagca

SEQ ID NO: 166970 - DNA, 25 bp, Homo sapien
gagcagacgcattggtattatcatt

SEQ ID NO: 166971 - DNA, 25 bp, Homo sapien
attatcattcaaagcagtctccctc

SEQ ID NO: 166972 - DNA, 25 bp, Homo sapien
agcagtctccctcttatttgtaagt

SEQ ID NO: 166973 - DNA, 25 bp, Homo sapien
ttttgggtggttcagccaaacctca

SEQ ID NO: 166974 - DNA, 25 bp, Homo sapien
tcaaaacagttaatctccctggttt

SEQ ID NO: 166975 - DNA, 25 bp, Homo sapien
taatctccctggtttaaaatcacac

SEQ ID NO: 166976 - DNA, 25 bp, Homo sapien
gtttaaaatcacaccagtggctttg

SEQ ID NO: 166977 - DNA, 25 bp, Homo sapien
agtggctttgatgttgtttctgccc

SEQ ID NO: 166978 - DNA, 25 bp, Homo sapien
ttctgccccgcattgtattttatag

SEQ ID NO: 166979 - DNA, 25 bp, Homo sapien
gggacacccaaagaatgatgcagta

SEQ ID NO: 166980 - DNA, 25 bp, Homo sapien
atggaggctttgagtcccacagtgt

SEQ ID NO: 166981 - DNA, 25 bp, Homo sapien
cccacagtgtggtgatacagagcac

SEQ ID NO: 166982 - DNA, 25 bp, Homo sapien
tacagagcactagttgtcactgcct

SEQ ID NO: 166983 - DNA, 25 bp, Homo sapien
actagttgtcactgcctggctttat

SEQ ID NO: 166984 - DNA, 25 bp, Homo sapien
ggaactgcagtaggcttcctctgta

SEQ ID NO: 166985 - DNA, 25 bp, Homo sapien
aggcttcctctgtagagctctgaaa

SEQ ID NO: 166986 - DNA, 25 bp, Homo sapien
agagctctgaaaaggttgactatat

SEQ ID NO: 166987 - DNA, 25 bp, Homo sapien
acttggtcaagtatttctcacatct

SEQ ID NO: 166988 - DNA, 25 bp, Homo sapien
ttctcacatcttttgttatcagagt

SEQ ID NO: 166989 - DNA, 25 bp, Homo sapien
gtaccattccaatctcttaacttgc

SEQ ID NO: 166990 - DNA, 25 bp, Homo sapien
caatctcttaacttgcagttgtgtg

SEQ ID NO: 166991 - DNA, 25 bp, Homo sapien
ccaccttatgtcaacctgcacttct

SEQ ID NO: 166992 - DNA, 25 bp, Homo sapien
gaccccaagtcttgtcaataacttg

SEQ ID NO: 166993 - DNA, 25 bp, Homo sapien
gtcaataacttgctgtgtggaagca

SEQ ID NO: 166994 - DNA, 25 bp, Homo sapien
gcagcgggggaagacctagaaccct

SEQ ID NO: 166995 - DNA, 25 bp, Homo sapien
ttccccagcacttggttttccaaca

SEQ ID NO: 166996 - DNA, 25 bp, Homo sapien
cccagcacttggttttccaacatga

SEQ ID NO: 166997 - DNA, 25 bp, Homo sapien
agcacttggttttccaacatgatat

SEQ ID NO: 166998 - DNA, 25 bp, Homo sapien
ggttttccaacatgatatttatgag

SEQ ID NO: 166999 - DNA, 25 bp, Homo sapien
tattttgatatgtacatctcttatt

SEQ ID NO: 167000 - DNA, 25 bp, Homo sapien
tatgtacatctcttattttcttaca

SEQ ID NO: 167001 - DNA, 25 bp, Homo sapien
gtatgtaagtgaggtttgttttgta

SEQ ID NO: 167002 - DNA, 25 bp, Homo sapien
ttcctcccagaactatatctgactc

SEQ ID NO: 167003 - DNA, 25 bp, Homo sapien
gaactatatctgactctcagtctgt

SEQ ID NO: 167004 - DNA, 25 bp, Homo sapien
gactctcagtctgtcccataaatta

SEQ ID NO: 167005 - DNA, 25 bp, Homo sapien
tatcaactcacactattcacacaac

SEQ ID NO: 167006 - DNA, 25 bp, Homo sapien
ataagttcctagacaacatttgttt

SEQ ID NO: 167007 - DNA, 25 bp, Homo sapien
atgttagtcaactctgatcttccag

SEQ ID NO: 167008 - DNA, 25 bp, Homo sapien
ttccaggacaggtggtattagctcc

SEQ ID NO: 167009 - DNA, 25 bp, Homo sapien
tggtattagctccactgtcttaaca

SEQ ID NO: 167010 - DNA, 25 bp, Homo sapien
tgtcttaacatagtacgtggcacgt

SEQ ID NO: 167011 - DNA, 25 bp, Homo sapien
agtacgtggcacgttatgcctttca

SEQ ID NO: 167012 - DNA, 25 bp, Homo sapien
atgcctttcagtgttaactcctttc

SEQ ID NO: 167013 - DNA, 25 bp, Homo sapien
agttcacagcagtgcctcatcccaa

SEQ ID NO: 167014 - DNA, 25 bp, Homo sapien
agcagtgcctcatcccaacgtcaag

SEQ ID NO: 167015 - DNA, 25 bp, Homo sapien
aacgtcaagcccatggcctatgcca

SEQ ID NO: 167016 - DNA, 25 bp, Homo sapien
catggcctatgccaacacgctgctg

SEQ ID NO: 167017 - DNA, 25 bp, Homo sapien
aacacgctgctgcagctaggaatga

SEQ ID NO: 167018 - DNA, 25 bp, Homo sapien
acgctgctgcagctaggaatgatgt

SEQ ID NO: 167019 - DNA, 25 bp, Homo sapien
gctgctgcagctaggaatgatgtga

SEQ ID NO: 167020 - DNA, 25 bp, Homo sapien
ctgctgcagctaggaatgatgtgag

SEQ ID NO: 167021 - DNA, 25 bp, Homo sapien
ctaggaatgatgtgaggtgacgggc

SEQ ID NO: 167022 - DNA, 25 bp, Homo sapien
gggcggcctgcatcccagggcccct

SEQ ID NO: 167023 - DNA, 25 bp, Homo sapien
aggccccgccccagggcaatgttgg

SEQ ID NO: 167024 - DNA, 25 bp, Homo sapien
gaacacatggactatcattttgcat

SEQ ID NO: 167025 - DNA, 25 bp, Homo sapien
tgcagaaatcctttttgcagcccca

SEQ ID NO: 167026 - DNA, 25 bp, Homo sapien
gttgtttctgccgtatctcatcaag

SEQ ID NO: 167027 - DNA, 25 bp, Homo sapien
gccgtatctcatcaaggcaaaagaa

SEQ ID NO: 167028 - DNA, 25 bp, Homo sapien
agaaatcccaagagccctttggcct

SEQ ID NO: 167029 - DNA, 25 bp, Homo sapien
ttggcctgcactaataaacgcccca

SEQ ID NO: 167030 - DNA, 25 bp, Homo sapien
taataaacgccccaggcctgagggc

SEQ ID NO: 167031 - DNA, 25 bp, Homo sapien
gcctgagggcatgcaaacattggaa

SEQ ID NO: 167032 - DNA, 25 bp, Homo sapien
acattggaatcattttttaagccat

SEQ ID NO: 167033 - DNA, 25 bp, Homo sapien
attaacacattagtgctgccctcag

SEQ ID NO: 167034 - DNA, 25 bp, Homo sapien
ttatctttacagatttccctgagaa

SEQ ID NO: 167035 - DNA, 25 bp, Homo sapien
gcccacgcaggcacctatgaggtta

SEQ ID NO: 167036 - DNA, 25 bp, Homo sapien
gcacctatgaggttagattcttcga

SEQ ID NO: 167037 - DNA, 25 bp, Homo sapien
ttagattcttcgacgaggagtccta

SEQ ID NO: 167038 - DNA, 25 bp, Homo sapien
taacgaggacatttccatcatcccg

SEQ ID NO: 167039 - DNA, 25 bp, Homo sapien
atcatcccgcctctgtttacagtca

SEQ ID NO: 167040 - DNA, 25 bp, Homo sapien
tttacagtcagcgtggaccatcggg

SEQ ID NO: 167041 - DNA, 25 bp, Homo sapien
gggtgtccactgaggtgctggctgc

SEQ ID NO: 167042 - DNA, 25 bp, Homo sapien
gcggcgatcggccttgtgatctact

SEQ ID NO: 167043 - DNA, 25 bp, Homo sapien
acttggccttcagtgcgaagagcca

SEQ ID NO: 167044 - DNA, 25 bp, Homo sapien
ttcagtgcgaagagccacatccagg

SEQ ID NO: 167045 - DNA, 25 bp, Homo sapien
cgaagagccacatccaggcctgagg

SEQ ID NO: 167046 - DNA, 25 bp, Homo sapien
agtatgtggtgcttgtggctgctct

SEQ ID NO: 167047 - DNA, 25 bp, Homo sapien
atgtggtgcttgtggctgctctcac

SEQ ID NO: 167048 - DNA, 25 bp, Homo sapien
tggtgcttgtggctgctctcacagt

SEQ ID NO: 167049 - DNA, 25 bp, Homo sapien
cttgtggctgctctcacagtggcct

SEQ ID NO: 167050 - DNA, 25 bp, Homo sapien
tgctctcacagtggcctgtaacaat

SEQ ID NO: 167051 - DNA, 25 bp, Homo sapien
ttcttctgggagaacagttgagcag

SEQ ID NO: 167052 - DNA, 25 bp, Homo sapien
gaacagttgagcagacagccacatt

SEQ ID NO: 167053 - DNA, 25 bp, Homo sapien
acagttgagcagacagccacattgg

SEQ ID NO: 167054 - DNA, 25 bp, Homo sapien
agacagccacattgggcagcgccct

SEQ ID NO: 167055 - DNA, 25 bp, Homo sapien
caagagtagcggtccaagcctgcaa

SEQ ID NO: 167056 - DNA, 25 bp, Homo sapien
agcctgcaactcatctttcattaaa

SEQ ID NO: 167057 - DNA, 25 bp, Homo sapien
gatcacttgaagaaacttgctgtgt

SEQ ID NO: 167058 - DNA, 25 bp, Homo sapien
tgaagaaacttgctgtgtccagtgc

SEQ ID NO: 167059 - DNA, 25 bp, Homo sapien
gctgtgtccagtgctgcttgaagtg

SEQ ID NO: 167060 - DNA, 25 bp, Homo sapien
gctgcttgaagtgctaataatgtta

SEQ ID NO: 167061 - DNA, 25 bp, Homo sapien
tttttgtattagtatggtttgagac

SEQ ID NO: 167062 - DNA, 25 bp, Homo sapien
atggtttgagacaacatatggaaaa

SEQ ID NO: 167063 - DNA, 25 bp, Homo sapien
gttcacatttgtagattaagctgga

SEQ ID NO: 167064 - DNA, 25 bp, Homo sapien
ttattttgcttaccacagtgttata

SEQ ID NO: 167065 - DNA, 25 bp, Homo sapien
ttgcttaccacagtgttatagctgg

SEQ ID NO: 167066 - DNA, 25 bp, Homo sapien
cacagtgttatagctggttctagaa

SEQ ID NO: 167067 - DNA, 25 bp, Homo sapien
gttatagctggttctagaaatttga

SEQ ID NO: 167068 - DNA, 25 bp, Homo sapien
actacctgaaccgtgctggctttga

SEQ ID NO: 167069 - DNA, 25 bp, Homo sapien
tgaggcctcagacccacgcataatt

SEQ ID NO: 167070 - DNA, 25 bp, Homo sapien
ataattcggctcatctccttagctg

SEQ ID NO: 167071 - DNA, 25 bp, Homo sapien
ttagctgcccagaaattcatctcag

SEQ ID NO: 167072 - DNA, 25 bp, Homo sapien
aatgatgccctacagcactgcaaaa

SEQ ID NO: 167073 - DNA, 25 bp, Homo sapien
aaaatgaagggcacggcctccggca

SEQ ID NO: 167074 - DNA, 25 bp, Homo sapien
agcaaggaccgcaagtacactctaa

SEQ ID NO: 167075 - DNA, 25 bp, Homo sapien
taaccatggaggacttgacccctgc

SEQ ID NO: 167076 - DNA, 25 bp, Homo sapien
gaagaagccgcactacttcacctga

SEQ ID NO: 167077 - DNA, 25 bp, Homo sapien
tgagccacccaacctaaatgtactt

SEQ ID NO: 167078 - DNA, 25 bp, Homo sapien
aaatgtacttatctgtccccatgtc

SEQ ID NO: 167079 - DNA, 25 bp, Homo sapien
gacaaaagagggtgttctctatgta

SEQ ID NO: 167080 - DNA, 25 bp, Homo sapien
gaagaccaaagagcaagtgacaaat

SEQ ID NO: 167081 - DNA, 25 bp, Homo sapien
gcaagtgacaaatgttggaggagca

SEQ ID NO: 167082 - DNA, 25 bp, Homo sapien
aggagcagtggtgacgggtgtgaca

SEQ ID NO: 167083 - DNA, 25 bp, Homo sapien
acgggtgtgacagcagtagcccaga

SEQ ID NO: 167084 - DNA, 25 bp, Homo sapien
agggagcattgcagcagccactggc

SEQ ID NO: 167085 - DNA, 25 bp, Homo sapien
tggctttgtcaaaaaggaccagttg

SEQ ID NO: 167086 - DNA, 25 bp, Homo sapien
agttgtggctgctgctgagaaaacc

SEQ ID NO: 167087 - DNA, 25 bp, Homo sapien
gtggctgctgctgagaaaaccaaac

SEQ ID NO: 167088 - DNA, 25 bp, Homo sapien
tgctgctgagaaaaccaaacagggt

SEQ ID NO: 167089 - DNA, 25 bp, Homo sapien
agaaaaccaaacagggtgtggcaga

SEQ ID NO: 167090 - DNA, 25 bp, Homo sapien
ttatgatccagaaacacgatggcat

SEQ ID NO: 167091 - DNA, 25 bp, Homo sapien
aacacgatggcatcacggtggcagt

SEQ ID NO: 167092 - DNA, 25 bp, Homo sapien
gcatcacggtggcagtgcacaaaat

SEQ ID NO: 167093 - DNA, 25 bp, Homo sapien
ttcagcagcctgtcataggaactgg

SEQ ID NO: 167094 - DNA, 25 bp, Homo sapien
actggatcctacctatgttaattac

SEQ ID NO: 167095 - DNA, 25 bp, Homo sapien
aagttccagtagttaggccattcat

SEQ ID NO: 167096 - DNA, 25 bp, Homo sapien
tagttaggccattcatttaatgtgc

SEQ ID NO: 167097 - DNA, 25 bp, Homo sapien
taatgtgcattaggcacttttctgt

SEQ ID NO: 167098 - DNA, 25 bp, Homo sapien
ttctgtttatttaagagtcaattgc

SEQ ID NO: 167099 - DNA, 25 bp, Homo sapien
gatcatgttttgaagcagcaggtcc

SEQ ID NO: 167100 - DNA, 25 bp, Homo sapien
gaagcagcaggtccaggtcactttg

SEQ ID NO: 167101 - DNA, 25 bp, Homo sapien
aagcaatcaaagtcttacgtcatag

SEQ ID NO: 167102 - DNA, 25 bp, Homo sapien
gtcttacgtcatagaggaccacctt

SEQ ID NO: 167103 - DNA, 25 bp, Homo sapien
gaggaccaccttttggatcataaat

SEQ ID NO: 167104 - DNA, 25 bp, Homo sapien
attctttccctataacattccttct

SEQ ID NO: 167105 - DNA, 25 bp, Homo sapien
tatggcccactttgaccactaacaa

SEQ ID NO: 167106 - DNA, 25 bp, Homo sapien
acatcaatttcattgagccattggt

SEQ ID NO: 167107 - DNA, 25 bp, Homo sapien
gtgaatgaagacacccatcacttgt

SEQ ID NO: 167108 - DNA, 25 bp, Homo sapien
atcacttgtcatgttggtttccaac

SEQ ID NO: 167109 - DNA, 25 bp, Homo sapien
ggtttccaacagtcctttcgattat

SEQ ID NO: 167110 - DNA, 25 bp, Homo sapien
cagtcctttcgattatcctttattt

SEQ ID NO: 167111 - DNA, 25 bp, Homo sapien
taagttaccattcctagtttctttg

SEQ ID NO: 167112 - DNA, 25 bp, Homo sapien
tctacatagtgacatgcacacggga

SEQ ID NO: 167113 - DNA, 25 bp, Homo sapien
acatgcacacgggaaagccttaaaa

SEQ ID NO: 167114 - DNA, 25 bp, Homo sapien
aatatccttgatgtacagattttat

SEQ ID NO: 167115 - DNA, 25 bp, Homo sapien
agcatgctgctttttgtacttggaa

SEQ ID NO: 167116 - DNA, 25 bp, Homo sapien
gaccatatttactctttctaacctt

SEQ ID NO: 167117 - DNA, 25 bp, Homo sapien
ttctaacctttctttactccatcat

SEQ ID NO: 167118 - DNA, 25 bp, Homo sapien
actccatcatggctggttgatttgt

SEQ ID NO: 167119 - DNA, 25 bp, Homo sapien
gaacccataaccatacacaggctat

SEQ ID NO: 167120 - DNA, 25 bp, Homo sapien
acacaggctatcaacatgttattca

SEQ ID NO: 167121 - DNA, 25 bp, Homo sapien
aacatgttattcaatgtgacaccta

SEQ ID NO: 167122 - DNA, 25 bp, Homo sapien
gtgacacctaactcttttctatttt

SEQ ID NO: 167123 - DNA, 25 bp, Homo sapien
tctctgtccacaccacgagtggcac

SEQ ID NO: 167124 - DNA, 25 bp, Homo sapien
tgtccacaccacgagtggcacatcc

SEQ ID NO: 167125 - DNA, 25 bp, Homo sapien
caccacgagtggcacatcccacctg

SEQ ID NO: 167126 - DNA, 25 bp, Homo sapien
tcctggaacccaggctctaaacaag

SEQ ID NO: 167127 - DNA, 25 bp, Homo sapien
ctggaacccaggctctaaacaagca

SEQ ID NO: 167128 - DNA, 25 bp, Homo sapien
tggaacccaggctctaaacaagcag

SEQ ID NO: 167129 - DNA, 25 bp, Homo sapien
ggaacccaggctctaaacaagcagg

SEQ ID NO: 167130 - DNA, 25 bp, Homo sapien
gaacccaggctctaaacaagcaggg

SEQ ID NO: 167131 - DNA, 25 bp, Homo sapien
acccaggctctaaacaagcagggag

SEQ ID NO: 167132 - DNA, 25 bp, Homo sapien
cccaggctctaaacaagcagggaga

SEQ ID NO: 167133 - DNA, 25 bp, Homo sapien
ccaggctctaaacaagcagggagag

SEQ ID NO: 167134 - DNA, 25 bp, Homo sapien
caggcggaagcgttggccctccagg

SEQ ID NO: 167135 - DNA, 25 bp, Homo sapien
gaaggagcagatgcgcatccagtcg

SEQ ID NO: 167136 - DNA, 25 bp, Homo sapien
atgcgcatccagtcgctggagaaga

SEQ ID NO: 167137 - DNA, 25 bp, Homo sapien
gactaaagagaacgaggagctgacc

SEQ ID NO: 167138 - DNA, 25 bp, Homo sapien
ggagctgaccaggatctgcgacgac

SEQ ID NO: 167139 - DNA, 25 bp, Homo sapien
tgaccaggatctgcgacgacctcat

SEQ ID NO: 167140 - DNA, 25 bp, Homo sapien
gagaagatctgacctccacggagcc

SEQ ID NO: 167141 - DNA, 25 bp, Homo sapien
tgctcccgtctgtctgtcctgtctg

SEQ ID NO: 167142 - DNA, 25 bp, Homo sapien
tgtcctgtctgattctcttaggtgt

SEQ ID NO: 167143 - DNA, 25 bp, Homo sapien
gattctcttaggtgtcatgttcttt

SEQ ID NO: 167144 - DNA, 25 bp, Homo sapien
ctcttaggtgtcatgttcttttttc

SEQ ID NO: 167145 - DNA, 25 bp, Homo sapien
cataactctgctgaatgtaaaagaa

SEQ ID NO: 167146 - DNA, 25 bp, Homo sapien
aaatgctgttaatgtatactactgg

SEQ ID NO: 167147 - DNA, 25 bp, Homo sapien
gtatactactggtggttgattggtt

SEQ ID NO: 167148 - DNA, 25 bp, Homo sapien
actactggtggttgattggttttat

SEQ ID NO: 167149 - DNA, 25 bp, Homo sapien
atgtagcttgacaattcagtgactt

SEQ ID NO: 167150 - DNA, 25 bp, Homo sapien
attcagtgacttaatatctattcca

SEQ ID NO: 167151 - DNA, 25 bp, Homo sapien
gtgacttaatatctattccatttgt

SEQ ID NO: 167152 - DNA, 25 bp, Homo sapien
tgaatagattttagcatgatgaaac

SEQ ID NO: 167153 - DNA, 25 bp, Homo sapien
tggtgaatgttcaatctgtgtaaga

SEQ ID NO: 167154 - DNA, 25 bp, Homo sapien
aactaaatgtagttgtcacactaaa

SEQ ID NO: 167155 - DNA, 25 bp, Homo sapien
agttgtcacactaaaatttaattgg

SEQ ID NO: 167156 - DNA, 25 bp, Homo sapien
aggtcaaaaacctgccctcctgtga

SEQ ID NO: 167157 - DNA, 25 bp, Homo sapien
aaaacctgccctcctgtgacttatt

SEQ ID NO: 167158 - DNA, 25 bp, Homo sapien
ctgagacttttcaggagagccagcc

SEQ ID NO: 167159 - DNA, 25 bp, Homo sapien
agagccagcccacagatgatgaaga

SEQ ID NO: 167160 - DNA, 25 bp, Homo sapien
gccagcccacagatgatgaagaaat

SEQ ID NO: 167161 - DNA, 25 bp, Homo sapien
aaaaactgcctttgatacaggcaat

SEQ ID NO: 167162 - DNA, 25 bp, Homo sapien
gatacaggcaattcagtggactata

SEQ ID NO: 167163 - DNA, 25 bp, Homo sapien
gaacagttgctgttcttacatctgt

SEQ ID NO: 167164 - DNA, 25 bp, Homo sapien
agttgctgttcttacatctgtaaag

SEQ ID NO: 167165 - DNA, 25 bp, Homo sapien
tgtctttaaatcactcttctgtaaa

SEQ ID NO: 167166 - DNA, 25 bp, Homo sapien
cactcttctgtaaatagatgacctt

SEQ ID NO: 167167 - DNA, 25 bp, Homo sapien
ttctggctggctggtgcgggctcgg

SEQ ID NO: 167168 - DNA, 25 bp, Homo sapien
gggctcggccgtcttctgggtgctg

SEQ ID NO: 167169 - DNA, 25 bp, Homo sapien
accctggtggtcatcggctcccacg

SEQ ID NO: 167170 - DNA, 25 bp, Homo sapien
cacgctgccttccaccagattgagg

SEQ ID NO: 167171 - DNA, 25 bp, Homo sapien
gctgccttccaccagattgaggctg

SEQ ID NO: 167172 - DNA, 25 bp, Homo sapien
gccttccaccagattgaggctgtgg

SEQ ID NO: 167173 - DNA, 25 bp, Homo sapien
tccaccagattgaggctgtggacgg

SEQ ID NO: 167174 - DNA, 25 bp, Homo sapien
gatggaacccgtgtgaggtgtcttc

SEQ ID NO: 167175 - DNA, 25 bp, Homo sapien
tgaggtgtcttctgggacctgccgg

SEQ ID NO: 167176 - DNA, 25 bp, Homo sapien
tgtcctgcacggctctgctgctcgg

SEQ ID NO: 167177 - DNA, 25 bp, Homo sapien
agcgccgtcccatcacaagcccggg

SEQ ID NO: 167178 - DNA, 25 bp, Homo sapien
ggcgaccgtcttgcatctgaagaag

SEQ ID NO: 167179 - DNA, 25 bp, Homo sapien
tcatcgccaaaaaactcaacctttc

SEQ ID NO: 167180 - DNA, 25 bp, Homo sapien
caacctttcatcctttaacgagctg

SEQ ID NO: 167181 - DNA, 25 bp, Homo sapien
cgtggttgtcactaggtggagattc

SEQ ID NO: 167182 - DNA, 25 bp, Homo sapien
gagattcaagaaggcgccgctcctg

SEQ ID NO: 167183 - DNA, 25 bp, Homo sapien
gctgcactacagacccaagatggac

SEQ ID NO: 167184 - DNA, 25 bp, Homo sapien
gacttgctgtgaatggtgccacaca

SEQ ID NO: 167185 - DNA, 25 bp, Homo sapien
acagactgggctcgcacccttgggt

SEQ ID NO: 167186 - DNA, 25 bp, Homo sapien
cggccgccgcgcttaagaacattgc

SEQ ID NO: 167187 - DNA, 25 bp, Homo sapien
aagaacattgcctctgggtgtcatg

SEQ ID NO: 167188 - DNA, 25 bp, Homo sapien
ggtgtcatgtggaccagacttctga

SEQ ID NO: 167189 - DNA, 25 bp, Homo sapien
gtgaggtccacacagtgtgtatcat

SEQ ID NO: 167190 - DNA, 25 bp, Homo sapien
tgctcaaggaagcagacctctgctt

SEQ ID NO: 167191 - DNA, 25 bp, Homo sapien
tcatgaatagtctgagtcttcctct

SEQ ID NO: 167192 - DNA, 25 bp, Homo sapien
ctctctgacaagttagggcatggac

SEQ ID NO: 167193 - DNA, 25 bp, Homo sapien
atggacttgacccagctttgtgcca

SEQ ID NO: 167194 - DNA, 25 bp, Homo sapien
atatgagtgttgttggcagcttgcc

SEQ ID NO: 167195 - DNA, 25 bp, Homo sapien
catactggtttcatgtgacacctcc

SEQ ID NO: 167196 - DNA, 25 bp, Homo sapien
catgtgacacctccatggatttttt

SEQ ID NO: 167197 - DNA, 25 bp, Homo sapien
agcctctaagtcaccaacttgggaa

SEQ ID NO: 167198 - DNA, 25 bp, Homo sapien
acttgggaactgcttgtctcacgtt

SEQ ID NO: 167199 - DNA, 25 bp, Homo sapien
gcttgtctcacgttgctttgttttt

SEQ ID NO: 167200 - DNA, 25 bp, Homo sapien
gaagatccacacagtggctgagctg

SEQ ID NO: 167201 - DNA, 25 bp, Homo sapien
ctgagctggtctagggcttggctat

SEQ ID NO: 167202 - DNA, 25 bp, Homo sapien
tggtctagggcttggctatgagcaa

SEQ ID NO: 167203 - DNA, 25 bp, Homo sapien
ggctatgagcaagttttccagatca

SEQ ID NO: 167204 - DNA, 25 bp, Homo sapien
tgagcaagttttccagatcaccacc

SEQ ID NO: 167205 - DNA, 25 bp, Homo sapien
tttccagatcaccacccaagttgtg

SEQ ID NO: 167206 - DNA, 25 bp, Homo sapien
cagatcaccacccaagttgtgtggg

SEQ ID NO: 167207 - DNA, 25 bp, Homo sapien
ggttgagactagaaaatgcctcttt

SEQ ID NO: 167208 - DNA, 25 bp, Homo sapien
ttcttcctttctccatgaaatgtgt

SEQ ID NO: 167209 - DNA, 25 bp, Homo sapien
tgtttgaaacaaatcctgacttaag

SEQ ID NO: 167210 - DNA, 25 bp, Homo sapien
tgacttaaggcccagggacttcctt

SEQ ID NO: 167211 - DNA, 25 bp, Homo sapien
aacttgttaccaacacatgtgaacc

SEQ ID NO: 167212 - DNA, 25 bp, Homo sapien
tgtgaaccattgctacattgtaggt

SEQ ID NO: 167213 - DNA, 25 bp, Homo sapien
tgtaggttgtgatcattttgcccca

SEQ ID NO: 167214 - DNA, 25 bp, Homo sapien
ttgtgatcattttgccccactgaag

SEQ ID NO: 167215 - DNA, 25 bp, Homo sapien
attttgccccactgaagcccatgta

SEQ ID NO: 167216 - DNA, 25 bp, Homo sapien
atgtatctgaccttacgtgcctttt

SEQ ID NO: 167217 - DNA, 25 bp, Homo sapien
gaccttacgtgccttttgaactagg

SEQ ID NO: 167218 - DNA, 25 bp, Homo sapien
aatgtatctgtacagcactttttac

SEQ ID NO: 167219 - DNA, 25 bp, Homo sapien
acagcactttttacatttgcgaagt

SEQ ID NO: 167220 - DNA, 25 bp, Homo sapien
gttagttactagttattacagctgt

SEQ ID NO: 167221 - DNA, 25 bp, Homo sapien
acacgtcatgtggattcattttgaa

SEQ ID NO: 167222 - DNA, 25 bp, Homo sapien
ttactcatactattaggcacacttt

SEQ ID NO: 167223 - DNA, 25 bp, Homo sapien
tattaggcacactttccccttagag

SEQ ID NO: 167224 - DNA, 25 bp, Homo sapien
tttttcccagacgaatctttataat

SEQ ID NO: 167225 - DNA, 25 bp, Homo sapien
cagacgaatctttataatttccttt

SEQ ID NO: 167226 - DNA, 25 bp, Homo sapien
aagataccaaataaacttcagtgtt

SEQ ID NO: 167227 - DNA, 25 bp, Homo sapien
cagtgttttcatctaattctcttaa

SEQ ID NO: 167228 - DNA, 25 bp, Homo sapien
atattttgtgttgatcattatttcc

SEQ ID NO: 167229 - DNA, 25 bp, Homo sapien
tgcacatttaattgtccctaataga

SEQ ID NO: 167230 - DNA, 25 bp, Homo sapien
attgtccctaatagaaagccaccta

SEQ ID NO: 167231 - DNA, 25 bp, Homo sapien
gaaagccacctattctttgttggat

SEQ ID NO: 167232 - DNA, 25 bp, Homo sapien
aagccacctattctttgttggattt

SEQ ID NO: 167233 - DNA, 25 bp, Homo sapien
agaagaaagttaagtctgaatgtaa

SEQ ID NO: 167234 - DNA, 25 bp, Homo sapien
gaagaaagttaagtctgaatgtaaa

SEQ ID NO: 167235 - DNA, 25 bp, Homo sapien
aagaaagttaagtctgaatgtaaat

SEQ ID NO: 167236 - DNA, 25 bp, Homo sapien
agaaagttaagtctgaatgtaaatt

SEQ ID NO: 167237 - DNA, 25 bp, Homo sapien
gaaagttaagtctgaatgtaaattc

SEQ ID NO: 167238 - DNA, 25 bp, Homo sapien
aaagttaagtctgaatgtaaattca

SEQ ID NO: 167239 - DNA, 25 bp, Homo sapien
gttaagtctgaatgtaaattcagtg

SEQ ID NO: 167240 - DNA, 25 bp, Homo sapien
aagtctgaatgtaaattcagtgtaa

SEQ ID NO: 167241 - DNA, 25 bp, Homo sapien
gaatgtaaattcagtgtaagatgaa

SEQ ID NO: 167242 - DNA, 25 bp, Homo sapien
ttatcaatacttatggaaattaggc

SEQ ID NO: 167243 - DNA, 25 bp, Homo sapien
tatggaaattaggctgggcgctgtg

SEQ ID NO: 167244 - DNA, 25 bp, Homo sapien
gtgctgtgggctggtcccacacatc

SEQ ID NO: 167245 - DNA, 25 bp, Homo sapien
tgggctggtcccacacatccaggaa

SEQ ID NO: 167246 - DNA, 25 bp, Homo sapien
gggctggtcccacacatccaggaaa

SEQ ID NO: 167247 - DNA, 25 bp, Homo sapien
catccaggaaagaggccagtagaga

SEQ ID NO: 167248 - DNA, 25 bp, Homo sapien
agaggccagtagagaattctgccca

SEQ ID NO: 167249 - DNA, 25 bp, Homo sapien
gaggccagtagagaattctgcccac

SEQ ID NO: 167250 - DNA, 25 bp, Homo sapien
aggccagtagagaattctgcccact

SEQ ID NO: 167251 - DNA, 25 bp, Homo sapien
accaaggcctagacacggcactggc

SEQ ID NO: 167252 - DNA, 25 bp, Homo sapien
caccgagaaggggacctcatctaga

SEQ ID NO: 167253 - DNA, 25 bp, Homo sapien
ggacctcatctagaaaagaggttac

SEQ ID NO: 167254 - DNA, 25 bp, Homo sapien
tcatctagaaaagaggttacaaacc

SEQ ID NO: 167255 - DNA, 25 bp, Homo sapien
gcttttctgtgctgttggttcccaa

SEQ ID NO: 167256 - DNA, 25 bp, Homo sapien
gtgctgttggttcccaaaactagaa

SEQ ID NO: 167257 - DNA, 25 bp, Homo sapien
ttatttccttgtttgtgctatgctg

SEQ ID NO: 167258 - DNA, 25 bp, Homo sapien
tttgtgctatgctgggcaggccttc

SEQ ID NO: 167259 - DNA, 25 bp, Homo sapien
aggccttctcttgtcccttataggt

SEQ ID NO: 167260 - DNA, 25 bp, Homo sapien
cttctcttgtcccttataggtacct

SEQ ID NO: 167261 - DNA, 25 bp, Homo sapien
tgaggaaggccggacccaggttcca

SEQ ID NO: 167262 - DNA, 25 bp, Homo sapien
tggctgtgtacatagggtgctttat

SEQ ID NO: 167263 - DNA, 25 bp, Homo sapien
gggtgctttattctccacagagtga

SEQ ID NO: 167264 - DNA, 25 bp, Homo sapien
tccacagagtgatacatgctaaggt

SEQ ID NO: 167265 - DNA, 25 bp, Homo sapien
gttgggcttggaccgatgtccccat

SEQ ID NO: 167266 - DNA, 25 bp, Homo sapien
aagtcctgcacttcaccaaggatgt

SEQ ID NO: 167267 - DNA, 25 bp, Homo sapien
caaggatgtcaaggccgctgctaat

SEQ ID NO: 167268 - DNA, 25 bp, Homo sapien
aggccgctgctaatcagatgcgcaa

SEQ ID NO: 167269 - DNA, 25 bp, Homo sapien
taatcagatgcgcaacttcctggtt

SEQ ID NO: 167270 - DNA, 25 bp, Homo sapien
agatgcgcaacttcctggttcgagc

SEQ ID NO: 167271 - DNA, 25 bp, Homo sapien
gaatatttgatcatgggtctggatg

SEQ ID NO: 167272 - DNA, 25 bp, Homo sapien
gggccacctatgacctcgagggaca

SEQ ID NO: 167273 - DNA, 25 bp, Homo sapien
aatagctggatcgaggagatgccct

SEQ ID NO: 167274 - DNA, 25 bp, Homo sapien
aggagatgccctctgaacgcctgtg

SEQ ID NO: 167275 - DNA, 25 bp, Homo sapien
agctcaacgacttcctccaggagta

SEQ ID NO: 167276 - DNA, 25 bp, Homo sapien
ttcctccaggagtatggcactcagg

SEQ ID NO: 167277 - DNA, 25 bp, Homo sapien
gtgctgtgggctggtcccacacatc

SEQ ID NO: 167278 - DNA, 25 bp, Homo sapien
tgggctggtcccacacatccaggaa

SEQ ID NO: 167279 - DNA, 25 bp, Homo sapien
gggctggtcccacacatccaggaaa

SEQ ID NO: 167280 - DNA, 25 bp, Homo sapien
catccaggaaagaggccagtagaga

SEQ ID NO: 167281 - DNA, 25 bp, Homo sapien
aggccagtagagaattctgcccact

SEQ ID NO: 167282 - DNA, 25 bp, Homo sapien
gagaattctgcccactttttataaa

SEQ ID NO: 167283 - DNA, 25 bp, Homo sapien
taaaaacttacagcgatggccccac

SEQ ID NO: 167284 - DNA, 25 bp, Homo sapien
accaaggcctagacacggcactggc

SEQ ID NO: 167285 - DNA, 25 bp, Homo sapien
tcccagcaggcatgggaagagcact

SEQ ID NO: 167286 - DNA, 25 bp, Homo sapien
ggttccaccgagaaggggacctcat

SEQ ID NO: 167287 - DNA, 25 bp, Homo sapien
ggacctcatctagaaaagaggttac

SEQ ID NO: 167288 - DNA, 25 bp, Homo sapien
gtctcacagacgctcctgaagttag

SEQ ID NO: 167289 - DNA, 25 bp, Homo sapien
tacttgaaagatgggtctccgcact

SEQ ID NO: 167290 - DNA, 25 bp, Homo sapien
ggtctccgcacttggaaaggtttca

SEQ ID NO: 167291 - DNA, 25 bp, Homo sapien
taaattatggctcttcacctgggcg

SEQ ID NO: 167292 - DNA, 25 bp, Homo sapien
ggcgccaactgctgatcaacgaaat

SEQ ID NO: 167293 - DNA, 25 bp, Homo sapien
aacggagtacagacgtctcaagact

SEQ ID NO: 167294 - DNA, 25 bp, Homo sapien
tctcaagactgaaacggccccattg

SEQ ID NO: 167295 - DNA, 25 bp, Homo sapien
attgcctggtctagtagcggatctc

SEQ ID NO: 167296 - DNA, 25 bp, Homo sapien
ggatctcactcagccgcagacaagt

SEQ ID NO: 167297 - DNA, 25 bp, Homo sapien
gcagacaagtaatcactaacccgtt

SEQ ID NO: 167298 - DNA, 25 bp, Homo sapien
acccgttttattctattcctatctg

SEQ ID NO: 167299 - DNA, 25 bp, Homo sapien
atgagctacgcctgggtcttctgca

SEQ ID NO: 167300 - DNA, 25 bp, Homo sapien
ttctgcagactcatgcagccctatg

SEQ ID NO: 167301 - DNA, 25 bp, Homo sapien
atggccgctcagaccaaggcgcaga

SEQ ID NO: 167302 - DNA, 25 bp, Homo sapien
aggcgcagagcaactatcagggcat

SEQ ID NO: 167303 - DNA, 25 bp, Homo sapien
aactatcagggcatgctctgcctcc

SEQ ID NO: 167304 - DNA, 25 bp, Homo sapien
agaggagtgtcctggccgctgtctc

SEQ ID NO: 167305 - DNA, 25 bp, Homo sapien
gcccatgatggccatagatttgcct

SEQ ID NO: 167306 - DNA, 25 bp, Homo sapien
tagatttgccttgtggtgttccatc

SEQ ID NO: 167307 - DNA, 25 bp, Homo sapien
gtgttccatcaggtactgtgtctgc

SEQ ID NO: 167308 - DNA, 25 bp, Homo sapien
ctgtgtctgctcataagtacttgtg

SEQ ID NO: 167309 - DNA, 25 bp, Homo sapien
gtacttgtgtcatccagaatgtttt

SEQ ID NO: 167310 - DNA, 25 bp, Homo sapien
gcaattaaagctgtggtggatctga

SEQ ID NO: 167311 - DNA, 25 bp, Homo sapien
caattaaagctgtggtggatctgaa

SEQ ID NO: 167312 - DNA, 25 bp, Homo sapien
aattaaagctgtggtggatctgaat

SEQ ID NO: 167313 - DNA, 25 bp, Homo sapien
attaaagctgtggtggatctgaatg

SEQ ID NO: 167314 - DNA, 25 bp, Homo sapien
ttaaagctgtggtggatctgaatgg

SEQ ID NO: 167315 - DNA, 25 bp, Homo sapien
aaagctgtggtggatctgaatggga

SEQ ID NO: 167316 - DNA, 25 bp, Homo sapien
gtggtggatctgaatgggaggtatt

SEQ ID NO: 167317 - DNA, 25 bp, Homo sapien
gggtcttggatctagcagagcaagt

SEQ ID NO: 167318 - DNA, 25 bp, Homo sapien
ggtcttggatctagcagagcaagtt

SEQ ID NO: 167319 - DNA, 25 bp, Homo sapien
gtcttggatctagcagagcaagttt

SEQ ID NO: 167320 - DNA, 25 bp, Homo sapien
cttggatctagcagagcaagtttga

SEQ ID NO: 167321 - DNA, 25 bp, Homo sapien
tcctcccagcattcgggttgtggtc

SEQ ID NO: 167322 - DNA, 25 bp, Homo sapien
ccagcattcgggttgtggtcacggt

SEQ ID NO: 167323 - DNA, 25 bp, Homo sapien
tggtcacggtggaacaaacagagga

SEQ ID NO: 167324 - DNA, 25 bp, Homo sapien
gagagctgcgtccaccatcaaggag

SEQ ID NO: 167325 - DNA, 25 bp, Homo sapien
gtccaccatcaaggaggtagcccag

SEQ ID NO: 167326 - DNA, 25 bp, Homo sapien
aggccgtcctgctctaggcagagtc

SEQ ID NO: 167327 - DNA, 25 bp, Homo sapien
gctctaggcagagtcccgggaccat

SEQ ID NO: 167328 - DNA, 25 bp, Homo sapien
agagtcccgggaccatggcctcctg

SEQ ID NO: 167329 - DNA, 25 bp, Homo sapien
tgccacacaacacgcagagaggact

SEQ ID NO: 167330 - DNA, 25 bp, Homo sapien
agagaggactcaagactcccgctgg

SEQ ID NO: 167331 - DNA, 25 bp, Homo sapien
tcaagactcccgctggccatgggag

SEQ ID NO: 167332 - DNA, 25 bp, Homo sapien
tgcgcgcgcgccaggaaagcccacg

SEQ ID NO: 167333 - DNA, 25 bp, Homo sapien
tggccttcagccctagcttatctca

SEQ ID NO: 167334 - DNA, 25 bp, Homo sapien
ttcagccctagcttatctcaaggtc

SEQ ID NO: 167335 - DNA, 25 bp, Homo sapien
agccctagcttatctcaaggtccag

SEQ ID NO: 167336 - DNA, 25 bp, Homo sapien
cctagcttatctcaaggtccagact

SEQ ID NO: 167337 - DNA, 25 bp, Homo sapien
tagcttatctcaaggtccagactcc

SEQ ID NO: 167338 - DNA, 25 bp, Homo sapien
agcttatctcaaggtccagactccg

SEQ ID NO: 167339 - DNA, 25 bp, Homo sapien
ttatctcaaggtccagactccgcag

SEQ ID NO: 167340 - DNA, 25 bp, Homo sapien
tctcaaggtccagactccgcagaag

SEQ ID NO: 167341 - DNA, 25 bp, Homo sapien
aacagctctcagaatcagaatacgt

SEQ ID NO: 167342 - DNA, 25 bp, Homo sapien
gctctcagaatcagaatacgtagga

SEQ ID NO: 167343 - DNA, 25 bp, Homo sapien
cttgaccttgacaatagtgtggatg

SEQ ID NO: 167344 - DNA, 25 bp, Homo sapien
gaatatcagttttttacacaagctc

SEQ ID NO: 167345 - DNA, 25 bp, Homo sapien
acacaagctctgataactgtgcaga

SEQ ID NO: 167346 - DNA, 25 bp, Homo sapien
aactgtgcagagtcgagatgcagcc

SEQ ID NO: 167347 - DNA, 25 bp, Homo sapien
gagtcgagatgcagcctggtaccag

SEQ ID NO: 167348 - DNA, 25 bp, Homo sapien
tggtaccagctgctgatggcaccac

SEQ ID NO: 167349 - DNA, 25 bp, Homo sapien
atggcaccactcagcgaggatcaga

SEQ ID NO: 167350 - DNA, 25 bp, Homo sapien
actcagcgaggatcagaggacagca

SEQ ID NO: 167351 - DNA, 25 bp, Homo sapien
cagcactgcaggaggtgtacacact

SEQ ID NO: 167352 - DNA, 25 bp, Homo sapien
tgtacacactggcagagcaccgacg

SEQ ID NO: 167353 - DNA, 25 bp, Homo sapien
cactggcagagcaccgacggacggt

SEQ ID NO: 167354 - DNA, 25 bp, Homo sapien
tctgatccctctgtacaggctggat

SEQ ID NO: 167355 - DNA, 25 bp, Homo sapien
tccacacttcctgggaggtcagaga

SEQ ID NO: 167356 - DNA, 25 bp, Homo sapien
gaggtcagagacaaactgtttcaga

SEQ ID NO: 167357 - DNA, 25 bp, Homo sapien
gtcagatggacttcccaagacttgt

SEQ ID NO: 167358 - DNA, 25 bp, Homo sapien
gtgacatggttcttggatttcctct

SEQ ID NO: 167359 - DNA, 25 bp, Homo sapien
tcttggatttcctctgtagcagcct

SEQ ID NO: 167360 - DNA, 25 bp, Homo sapien
gacttcctgaggactcgacattgtc

SEQ ID NO: 167361 - DNA, 25 bp, Homo sapien
gacattgtccacagatgtactggcc

SEQ ID NO: 167362 - DNA, 25 bp, Homo sapien
tgtactggccattacatgaaacaag

SEQ ID NO: 167363 - DNA, 25 bp, Homo sapien
agaaaccaagcatctttgctgttgt

SEQ ID NO: 167364 - DNA, 25 bp, Homo sapien
ttatatgtgccattgttacaggaga

SEQ ID NO: 167365 - DNA, 25 bp, Homo sapien
gtgttccaagtcctctgcataaacg

SEQ ID NO: 167366 - DNA, 25 bp, Homo sapien
gtcctctgcataaacgatgtatttt

SEQ ID NO: 167367 - DNA, 25 bp, Homo sapien
ggcctggaaaatggatgagcacttc

SEQ ID NO: 167368 - DNA, 25 bp, Homo sapien
tggatgagcacttcagaacaggtca

SEQ ID NO: 167369 - DNA, 25 bp, Homo sapien
gaacaggtcattttcctgatattgg

SEQ ID NO: 167370 - DNA, 25 bp, Homo sapien
ttggaagtgacatgtggccctatag

SEQ ID NO: 167371 - DNA, 25 bp, Homo sapien
ggccctataggaggcatgatgttag

SEQ ID NO: 167372 - DNA, 25 bp, Homo sapien
aaagccatgtgggtactgtaaacac

SEQ ID NO: 167373 - DNA, 25 bp, Homo sapien
acacacgtttatcttttggcccaat

SEQ ID NO: 167374 - DNA, 25 bp, Homo sapien
ttggcccaatgccatacatatggta

SEQ ID NO: 167375 - DNA, 25 bp, Homo sapien
taatttgggaattttcgactgtggt

SEQ ID NO: 167376 - DNA, 25 bp, Homo sapien
tcatcttcccagagtgcccgcatgt

SEQ ID NO: 167377 - DNA, 25 bp, Homo sapien
agtgcccgcatgtctacttttgtgg

SEQ ID NO: 167378 - DNA, 25 bp, Homo sapien
ttttgtggcaacacccccagctttg

SEQ ID NO: 167379 - DNA, 25 bp, Homo sapien
gctttggctccaaaatcatccgagg

SEQ ID NO: 167380 - DNA, 25 bp, Homo sapien
aaaatcatccgaggtcctgaggacc

SEQ ID NO: 167381 - DNA, 25 bp, Homo sapien
gacagtgctgttggtgactgtccct

SEQ ID NO: 167382 - DNA, 25 bp, Homo sapien
gtccctgacttcagtgccacgcaga

SEQ ID NO: 167383 - DNA, 25 bp, Homo sapien
agaccgcctgccttgtgaacctgcg

SEQ ID NO: 167384 - DNA, 25 bp, Homo sapien
tgccttgtgaacctgcgcagcctgg

SEQ ID NO: 167385 - DNA, 25 bp, Homo sapien
tgtgaacctgcgcagcctggcctgc

SEQ ID NO: 167386 - DNA, 25 bp, Homo sapien
gggctgggcccctgactcaaaaaag

SEQ ID NO: 167387 - DNA, 25 bp, Homo sapien
tatgcagtatgtataaacttataag

SEQ ID NO: 167388 - DNA, 25 bp, Homo sapien
gaatctttatgatttatgttaattc

SEQ ID NO: 167389 - DNA, 25 bp, Homo sapien
gaaagttaagtctgaatgtaaattc

SEQ ID NO: 167390 - DNA, 25 bp, Homo sapien
gaatgtaaattcagtgtaagatgaa

SEQ ID NO: 167391 - DNA, 25 bp, Homo sapien
ttatcaatacttatggaaattaggc

SEQ ID NO: 167392 - DNA, 25 bp, Homo sapien
tcaatacttatggaaattaggctgg

SEQ ID NO: 167393 - DNA, 25 bp, Homo sapien
aatacttatggaaattaggctgggc

SEQ ID NO: 167394 - DNA, 25 bp, Homo sapien
tacttatggaaattaggctgggcgc

SEQ ID NO: 167395 - DNA, 25 bp, Homo sapien
acttatggaaattaggctgggcgct

SEQ ID NO: 167396 - DNA, 25 bp, Homo sapien
cttatggaaattaggctgggcgctg

SEQ ID NO: 167397 - DNA, 25 bp, Homo sapien
ttatggaaattaggctgggcgctgt

SEQ ID NO: 167398 - DNA, 25 bp, Homo sapien
gatacccattatactaatgtgccaa

SEQ ID NO: 167399 - DNA, 25 bp, Homo sapien
aatgttcattgcacatctgcttcca

SEQ ID NO: 167400 - DNA, 25 bp, Homo sapien
tgcttccactgtgttcccacgggtg

SEQ ID NO: 167401 - DNA, 25 bp, Homo sapien
gttcccacgggtgccatgaagtgtg

SEQ ID NO: 167402 - DNA, 25 bp, Homo sapien
gaagtgtgtgaggagcccctcatct

SEQ ID NO: 167403 - DNA, 25 bp, Homo sapien
agggatgagtgctgcgttgactact

SEQ ID NO: 167404 - DNA, 25 bp, Homo sapien
gagtgctgcgttgactactgctatc

SEQ ID NO: 167405 - DNA, 25 bp, Homo sapien
gactactgctatcaggattgtgttg

SEQ ID NO: 167406 - DNA, 25 bp, Homo sapien
gtgtggaatattcatctacataaat

SEQ ID NO: 167407 - DNA, 25 bp, Homo sapien
atatgcacagtaatttcccttttta

SEQ ID NO: 167408 - DNA, 25 bp, Homo sapien
tttccatgtttcattgcctgaataa

SEQ ID NO: 167409 - DNA, 25 bp, Homo sapien
gggatgtgccctacagaagacatag

SEQ ID NO: 167410 - DNA, 25 bp, Homo sapien
gtgccctacagaagacatagaagat

SEQ ID NO: 167411 - DNA, 25 bp, Homo sapien
gggcaaagagctactttgaatacat

SEQ ID NO: 167412 - DNA, 25 bp, Homo sapien
gaatacataattctcttcaaagact

SEQ ID NO: 167413 - DNA, 25 bp, Homo sapien
agatgcttttttgggtgcaagtcta

SEQ ID NO: 167414 - DNA, 25 bp, Homo sapien
ggtgcaagtctaacctgtctagcat

SEQ ID NO: 167415 - DNA, 25 bp, Homo sapien
gtctaacctgtctagcatgagatct

SEQ ID NO: 167416 - DNA, 25 bp, Homo sapien
gtctagcatgagatcttcttgattt

SEQ ID NO: 167417 - DNA, 25 bp, Homo sapien
gacaaagtgaatcaacttccactta

SEQ ID NO: 167418 - DNA, 25 bp, Homo sapien
cttccacttagttgtaccgagcata

SEQ ID NO: 167419 - DNA, 25 bp, Homo sapien
tgggcttcctggcagtgaggccact

SEQ ID NO: 167420 - DNA, 25 bp, Homo sapien
atcgcccaacttcactgggactgga

SEQ ID NO: 167421 - DNA, 25 bp, Homo sapien
aagtctccgccctgattggatgagg

SEQ ID NO: 167422 - DNA, 25 bp, Homo sapien
gatgaggaaagctccaacccagtct

SEQ ID NO: 167423 - DNA, 25 bp, Homo sapien
ttttgaacctcattggacccaacca

SEQ ID NO: 167424 - DNA, 25 bp, Homo sapien
aaccaggtcccaagctccattggag

SEQ ID NO: 167425 - DNA, 25 bp, Homo sapien
ggagatgaccagtcctttctgggac

SEQ ID NO: 167426 - DNA, 25 bp, Homo sapien
tttctgggacctcaatgggtcacaa

SEQ ID NO: 167427 - DNA, 25 bp, Homo sapien
acttggctatgaacttgactggaaa

SEQ ID NO: 167428 - DNA, 25 bp, Homo sapien
ttgactggaaacacgcagcctgctc

SEQ ID NO: 167429 - DNA, 25 bp, Homo sapien
ggagcttcactggacatattcttta

SEQ ID NO: 167430 - DNA, 25 bp, Homo sapien
gacctggattggacgggatcgccca

SEQ ID NO: 167431 - DNA, 25 bp, Homo sapien
gacgagcggcggaaactcatccgat

SEQ ID NO: 167432 - DNA, 25 bp, Homo sapien
ggaaactcatccgatacgtcacagc

SEQ ID NO: 167433 - DNA, 25 bp, Homo sapien
ccgatacgtcacagccttcaatggg

SEQ ID NO: 167434 - DNA, 25 bp, Homo sapien
aggactatatgagtgaccgggttca

SEQ ID NO: 167435 - DNA, 25 bp, Homo sapien
ttcagtttgtgatcacagcacagga

SEQ ID NO: 167436 - DNA, 25 bp, Homo sapien
tcacagcacaggaatgggatcccag

SEQ ID NO: 167437 - DNA, 25 bp, Homo sapien
tgggatcccagctttgaggaggccc

SEQ ID NO: 167438 - DNA, 25 bp, Homo sapien
tggcattcgttcgtccccgatggat

SEQ ID NO: 167439 - DNA, 25 bp, Homo sapien
gtccccgatggatctacagttgcaa

SEQ ID NO: 167440 - DNA, 25 bp, Homo sapien
gtggtgccgcaagcctgaagtatgt

SEQ ID NO: 167441 - DNA, 25 bp, Homo sapien
aagcctgaagtatgtgctatacaca

SEQ ID NO: 167442 - DNA, 25 bp, Homo sapien
atgggttggctggtgtgcccacctc

SEQ ID NO: 167443 - DNA, 25 bp, Homo sapien
cacctcacactttgtgggtgtagat

SEQ ID NO: 167444 - DNA, 25 bp, Homo sapien
tcgagctttcctacagacctattct

SEQ ID NO: 167445 - DNA, 25 bp, Homo sapien
acagacctattctcaggagttctcc

SEQ ID NO: 167446 - DNA, 25 bp, Homo sapien
tattctcaggagttctccctcaccg

SEQ ID NO: 167447 - DNA, 25 bp, Homo sapien
ctgtgagaaaaatgagcctttgtgc

SEQ ID NO: 167448 - DNA, 25 bp, Homo sapien
aaaatgagcctttgtgcgtctctgt

SEQ ID NO: 167449 - DNA, 25 bp, Homo sapien
ctttgtgcgtctctgttgattccaa

SEQ ID NO: 167450 - DNA, 25 bp, Homo sapien
gtgcgtctctgttgattccaagttt

SEQ ID NO: 167451 - DNA, 25 bp, Homo sapien
gtctctgttgattccaagtttccta

SEQ ID NO: 167452 - DNA, 25 bp, Homo sapien
gttgattccaagtttcctatagaag

SEQ ID NO: 167453 - DNA, 25 bp, Homo sapien
tgaaagggaaccaaccaagaggctg

SEQ ID NO: 167454 - DNA, 25 bp, Homo sapien
aggctgggaatgacgggaaacatca

SEQ ID NO: 167455 - DNA, 25 bp, Homo sapien
gaaacatcaaaatccaccccttctt

SEQ ID NO: 167456 - DNA, 25 bp, Homo sapien
agaccataaactggactctgctgga

SEQ ID NO: 167457 - DNA, 25 bp, Homo sapien
aagcggaggttggagccacccttca

SEQ ID NO: 167458 - DNA, 25 bp, Homo sapien
aggcccaaagtgaagtcacccagag

SEQ ID NO: 167459 - DNA, 25 bp, Homo sapien
gagactacagtaactttgaccagga

SEQ ID NO: 167460 - DNA, 25 bp, Homo sapien
agttcctgaacgagaaggcgcgcct

SEQ ID NO: 167461 - DNA, 25 bp, Homo sapien
tctcctacagcgacaagaacctcat

SEQ ID NO: 167462 - DNA, 25 bp, Homo sapien
atggaccagtctgcattcgctggct

SEQ ID NO: 167463 - DNA, 25 bp, Homo sapien
tgcattcgctggcttctcctttgtg

SEQ ID NO: 167464 - DNA, 25 bp, Homo sapien
ggagcccagaccccagcacagatat

SEQ ID NO: 167465 - DNA, 25 bp, Homo sapien
agccctgcagtgtagctgaccctaa

SEQ ID NO: 167466 - DNA, 25 bp, Homo sapien
gcagtgtagctgaccctaatgtgac

SEQ ID NO: 167467 - DNA, 25 bp, Homo sapien
gtgtagctgaccctaatgtgacggt

SEQ ID NO: 167468 - DNA, 25 bp, Homo sapien
aatgtgacggtcatactgtcggtta

SEQ ID NO: 167469 - DNA, 25 bp, Homo sapien
gacggtcatactgtcggttaatcag

SEQ ID NO: 167470 - DNA, 25 bp, Homo sapien
catactgtcggttaatcagagagta

SEQ ID NO: 167471 - DNA, 25 bp, Homo sapien
actctgggaggtttgctaggccctg

SEQ ID NO: 167472 - DNA, 25 bp, Homo sapien
tagtgggagagatcgctggcaccat

SEQ ID NO: 167473 - DNA, 25 bp, Homo sapien
agatcgctggcaccatagccttatg

SEQ ID NO: 167474 - DNA, 25 bp, Homo sapien
ggcaccatagccttatggccaacag

SEQ ID NO: 167475 - DNA, 25 bp, Homo sapien
ttcctctttaaacacccgaagcgca

SEQ ID NO: 167476 - DNA, 25 bp, Homo sapien
tttaaacacccgaagcgcacggcca

SEQ ID NO: 167477 - DNA, 25 bp, Homo sapien
tcagcatgaggaacacgagcgtcat

SEQ ID NO: 167478 - DNA, 25 bp, Homo sapien
gggcatattctctgcagaatttctg

SEQ ID NO: 167479 - DNA, 25 bp, Homo sapien
ttctgaaagttttccttccatctct

SEQ ID NO: 167480 - DNA, 25 bp, Homo sapien
tctctcatttgctggccatcggatt

SEQ ID NO: 167481 - DNA, 25 bp, Homo sapien
tattggaaggcgtctgacaacctcc

SEQ ID NO: 167482 - DNA, 25 bp, Homo sapien
gaactggagtctgacttggttcgtt

SEQ ID NO: 167483 - DNA, 25 bp, Homo sapien
ctgacttggttcgttagtggattac

SEQ ID NO: 167484 - DNA, 25 bp, Homo sapien
gtggattacttctgagcttgcaaca

SEQ ID NO: 167485 - DNA, 25 bp, Homo sapien
gcttgcaacatagctcactgaagag

SEQ ID NO: 167486 - DNA, 25 bp, Homo sapien
actggaccgtttccaagctgcgggc

SEQ ID NO: 167487 - DNA, 25 bp, Homo sapien
aggatgctgagcttgtcttttctgc

SEQ ID NO: 167488 - DNA, 25 bp, Homo sapien
ctgctgaggagggtacttttcctgg

SEQ ID NO: 167489 - DNA, 25 bp, Homo sapien
ggtacttttcctgggtttcctgcag

SEQ ID NO: 167490 - DNA, 25 bp, Homo sapien
cctgggtttcctgcaggcatccgtg

SEQ ID NO: 167491 - DNA, 25 bp, Homo sapien
aaaaaatttgtcagagccctcaact

SEQ ID NO: 167492 - DNA, 25 bp, Homo sapien
agagccctcaactattctgttccac

SEQ ID NO: 167493 - DNA, 25 bp, Homo sapien
tccgcggctggagcgaagccttctg

SEQ ID NO: 167494 - DNA, 25 bp, Homo sapien
ggagcgaagccttctgcagcaggaa

SEQ ID NO: 167495 - DNA, 25 bp, Homo sapien
tgcagcaggaactctggacccctgg

SEQ ID NO: 167496 - DNA, 25 bp, Homo sapien
gggcctcatcacagcaatatttaac

SEQ ID NO: 167497 - DNA, 25 bp, Homo sapien
aattagaggctagagcggctgaaat

SEQ ID NO: 167498 - DNA, 25 bp, Homo sapien
tctcttctgtcttcccatgggaagt

SEQ ID NO: 167499 - DNA, 25 bp, Homo sapien
cctgtcctcctgaatacaagctgac

SEQ ID NO: 167500 - DNA, 25 bp, Homo sapien
gtcctcctgaatacaagctgactga

SEQ ID NO: 167501 - DNA, 25 bp, Homo sapien
tcctgaatacaagctgactgacatt

SEQ ID NO: 167502 - DNA, 25 bp, Homo sapien
acaagctgactgacattgactgtgt

SEQ ID NO: 167503 - DNA, 25 bp, Homo sapien
gctgactgacattgactgtgtctgt

SEQ ID NO: 167504 - DNA, 25 bp, Homo sapien
gactgacattgactgtgtctgtgga

SEQ ID NO: 167505 - DNA, 25 bp, Homo sapien
gacattgactgtgtctgtggaaaat

SEQ ID NO: 167506 - DNA, 25 bp, Homo sapien
ctcttgttgtggagagcatagtaaa

SEQ ID NO: 167507 - DNA, 25 bp, Homo sapien
catagtaaattttcagagaacttga

SEQ ID NO: 167508 - DNA, 25 bp, Homo sapien
gagactgaacctctggaaagccaag

SEQ ID NO: 167509 - DNA, 25 bp, Homo sapien
gacagagagcttttggacacttcat

SEQ ID NO: 167510 - DNA, 25 bp, Homo sapien
aaacctaagagaaagcttgctgacg

SEQ ID NO: 167511 - DNA, 25 bp, Homo sapien
aagagaaagcttgctgacggtcggc

SEQ ID NO: 167512 - DNA, 25 bp, Homo sapien
tgacggtcggcaggcttctgtaaca

SEQ ID NO: 167513 - DNA, 25 bp, Homo sapien
gtcggcaggcttctgtaacattaca

SEQ ID NO: 167514 - DNA, 25 bp, Homo sapien
aactgattccaaaccctaataagat

SEQ ID NO: 167515 - DNA, 25 bp, Homo sapien
aagctactccaaagtaatcttgcat

SEQ ID NO: 167516 - DNA, 25 bp, Homo sapien
gtaatcttgcataaacttgtcatgt

SEQ ID NO: 167517 - DNA, 25 bp, Homo sapien
acttgtcatgtcatacagtttgtga

SEQ ID NO: 167518 - DNA, 25 bp, Homo sapien
ggacaccttgtaaagaagccttgaa

SEQ ID NO: 167519 - DNA, 25 bp, Homo sapien
tggtggaccctgcacgggagctggg

SEQ ID NO: 167520 - DNA, 25 bp, Homo sapien
aagctgcaagccaagcgagttgagg

SEQ ID NO: 167521 - DNA, 25 bp, Homo sapien
ccaagcgagttgaggcccagcggca

SEQ ID NO: 167522 - DNA, 25 bp, Homo sapien
ggaacgccgtgctgcctcgggctat

SEQ ID NO: 167523 - DNA, 25 bp, Homo sapien
tgcctcgggctatcctgtcaaggtg

SEQ ID NO: 167524 - DNA, 25 bp, Homo sapien
atcctgtcaaggtgccgctcgaagt

SEQ ID NO: 167525 - DNA, 25 bp, Homo sapien
tcaaggtgccgctcgaagtccagga

SEQ ID NO: 167526 - DNA, 25 bp, Homo sapien
gcagatgaagccaagctccaacaga

SEQ ID NO: 167527 - DNA, 25 bp, Homo sapien
gaaggtggatgaggccatcgcccta

SEQ ID NO: 167528 - DNA, 25 bp, Homo sapien
ggccatcgccctattccagaagatg

SEQ ID NO: 167529 - DNA, 25 bp, Homo sapien
agaagatgctgtgatccaccaccca

SEQ ID NO: 167530 - DNA, 25 bp, Homo sapien
agaaaaccacttagactgcactttt

SEQ ID NO: 167531 - DNA, 25 bp, Homo sapien
tgcacttttctgttccgtttactct

SEQ ID NO: 167532 - DNA, 25 bp, Homo sapien
gttccgtttactctgtttacacatt

SEQ ID NO: 167533 - DNA, 25 bp, Homo sapien
gtttacacattttgcacttgggagg

SEQ ID NO: 167534 - DNA, 25 bp, Homo sapien
tgaggtttctcaggtggcaatgtaa

SEQ ID NO: 167535 - DNA, 25 bp, Homo sapien
caggtggcaatgtaactcatttttt

SEQ ID NO: 167536 - DNA, 25 bp, Homo sapien
atttatcttctctgcccaagccctg

SEQ ID NO: 167537 - DNA, 25 bp, Homo sapien
ccaagccctgtcttaaggcccaggg

SEQ ID NO: 167538 - DNA, 25 bp, Homo sapien
atagcatgtgatggctcaggctgaa

SEQ ID NO: 167539 - DNA, 25 bp, Homo sapien
ttaagtccctgcttttatcctggtg

SEQ ID NO: 167540 - DNA, 25 bp, Homo sapien
actgtcctactgtaacccctgtgaa

SEQ ID NO: 167541 - DNA, 25 bp, Homo sapien
gctgctgttttcctatgtcatttct

SEQ ID NO: 167542 - DNA, 25 bp, Homo sapien
tgttttcctatgtcatttctgcttc

SEQ ID NO: 167543 - DNA, 25 bp, Homo sapien
ctttgctgcttcacttctttgtaaa

SEQ ID NO: 167544 - DNA, 25 bp, Homo sapien
aacctgatggtaattagctggcttc

SEQ ID NO: 167545 - DNA, 25 bp, Homo sapien
gtagtacaaccgatatgttcattag

SEQ ID NO: 167546 - DNA, 25 bp, Homo sapien
ttgatactgtaagggtgtttcgttc

SEQ ID NO: 167547 - DNA, 25 bp, Homo sapien
tgtttcgttccctttaaatgaatca

SEQ ID NO: 167548 - DNA, 25 bp, Homo sapien
aaatgaatcaacactgccaccttct

SEQ ID NO: 167549 - DNA, 25 bp, Homo sapien
gccaccttctgtacgagtttgtttt

SEQ ID NO: 167550 - DNA, 25 bp, Homo sapien
tttttgcttggcgaaaacactacaa

SEQ ID NO: 167551 - DNA, 25 bp, Homo sapien
cgaaaacactacaaaggctgggaat

SEQ ID NO: 167552 - DNA, 25 bp, Homo sapien
cgggacgacaaggaggcccctgact

SEQ ID NO: 167553 - DNA, 25 bp, Homo sapien
ggacgacaaggaggcccctgactcg

SEQ ID NO: 167554 - DNA, 25 bp, Homo sapien
acaaggaggcccctgactcggatgc

SEQ ID NO: 167555 - DNA, 25 bp, Homo sapien
caaggaggcccctgactcggatgct

SEQ ID NO: 167556 - DNA, 25 bp, Homo sapien
aaggaggcccctgactcggatgctg

SEQ ID NO: 167557 - DNA, 25 bp, Homo sapien
aggaggcccctgactcggatgctga

SEQ ID NO: 167558 - DNA, 25 bp, Homo sapien
gcccctgactcggatgctgagggct

SEQ ID NO: 167559 - DNA, 25 bp, Homo sapien
cccctgactcggatgctgagggcta

SEQ ID NO: 167560 - DNA, 25 bp, Homo sapien
cctgactcggatgctgagggctacg

SEQ ID NO: 167561 - DNA, 25 bp, Homo sapien
gactcggatgctgagggctacgtgg

SEQ ID NO: 167562 - DNA, 25 bp, Homo sapien
agaagcgaaaacgagaacctgaaga

SEQ ID NO: 167563 - DNA, 25 bp, Homo sapien
gagcagacatcttgttatcctgctt

SEQ ID NO: 167564 - DNA, 25 bp, Homo sapien
cagacatcttgttatcctgctttgt

SEQ ID NO: 167565 - DNA, 25 bp, Homo sapien
agacatcttgttatcctgctttgtt

SEQ ID NO: 167566 - DNA, 25 bp, Homo sapien
gacatcttgttatcctgctttgttc

SEQ ID NO: 167567 - DNA, 25 bp, Homo sapien
catcttgttatcctgctttgttcca

SEQ ID NO: 167568 - DNA, 25 bp, Homo sapien
atcttgttatcctgctttgttccag

SEQ ID NO: 167569 - DNA, 25 bp, Homo sapien
tcttgttatcctgctttgttccaga

SEQ ID NO: 167570 - DNA, 25 bp, Homo sapien
cttgttatcctgctttgttccagat

SEQ ID NO: 167571 - DNA, 25 bp, Homo sapien
ttgttatcctgctttgttccagatt

SEQ ID NO: 167572 - DNA, 25 bp, Homo sapien
gttatcctgctttgttccagatttt

SEQ ID NO: 167573 - DNA, 25 bp, Homo sapien
tactgtgcacatgtgtagatttgca

SEQ ID NO: 167574 - DNA, 25 bp, Homo sapien
tcccatcctgagttggtgagtttca

SEQ ID NO: 167575 - DNA, 25 bp, Homo sapien
catcctgagttggtgagtttcattt

SEQ ID NO: 167576 - DNA, 25 bp, Homo sapien
cctgagttggtgagtttcatttatg

SEQ ID NO: 167577 - DNA, 25 bp, Homo sapien
gttggtgagtttcatttatgtctat

SEQ ID NO: 167578 - DNA, 25 bp, Homo sapien
ggtgagtttcatttatgtctattct

SEQ ID NO: 167579 - DNA, 25 bp, Homo sapien
tgtctattctttttcattacccacc

SEQ ID NO: 167580 - DNA, 25 bp, Homo sapien
tctattctttttcattacccaccca

SEQ ID NO: 167581 - DNA, 25 bp, Homo sapien
tattctttttcattacccacccaat

SEQ ID NO: 167582 - DNA, 25 bp, Homo sapien
ttttcattacccacccaattttctg

SEQ ID NO: 167583 - DNA, 25 bp, Homo sapien
tcattacccacccaattttctgtat

SEQ ID NO: 167584 - DNA, 25 bp, Homo sapien
cattacccacccaattttctgtatt

SEQ ID NO: 167585 - DNA, 25 bp, Homo sapien
aggacctggccgtcaacatcatctt

SEQ ID NO: 167586 - DNA, 25 bp, Homo sapien
aagatcgacatgaccaccttcagca

SEQ ID NO: 167587 - DNA, 25 bp, Homo sapien
aggagatctaagcagcgttcccaca

SEQ ID NO: 167588 - DNA, 25 bp, Homo sapien
ggagttccgcagagcttactatacg

SEQ ID NO: 167589 - DNA, 25 bp, Homo sapien
ttactatacgcggtctgtcctaatc

SEQ ID NO: 167590 - DNA, 25 bp, Homo sapien
aatctttgtggtgttcgctatctct

SEQ ID NO: 167591 - DNA, 25 bp, Homo sapien
tgttcgctatctcttgtgtcaaatc

SEQ ID NO: 167592 - DNA, 25 bp, Homo sapien
aaatctggtgaacgctacgcttaca

SEQ ID NO: 167593 - DNA, 25 bp, Homo sapien
acatatattgtctttgtgctgctgt

SEQ ID NO: 167594 - DNA, 25 bp, Homo sapien
tgtgctgctgtgtgacaaacgcaat

SEQ ID NO: 167595 - DNA, 25 bp, Homo sapien
tgcaaaaacaatcctctttctctct

SEQ ID NO: 167596 - DNA, 25 bp, Homo sapien
gagtttcagtacatgaactatagaa

SEQ ID NO: 167597 - DNA, 25 bp, Homo sapien
gaattgcttaaactgtgctgcattg

SEQ ID NO: 167598 - DNA, 25 bp, Homo sapien
aaactgtgctgcattgttggatgac

SEQ ID NO: 167599 - DNA, 25 bp, Homo sapien
gtgctgcattgttggatgacaactc

SEQ ID NO: 167600 - DNA, 25 bp, Homo sapien
ggatgacaactctttttgtcacagt

SEQ ID NO: 167601 - DNA, 25 bp, Homo sapien
caactctttttgtcacagttagaga

SEQ ID NO: 167602 - DNA, 25 bp, Homo sapien
gaatgaggttgactaatgcatatta

SEQ ID NO: 167603 - DNA, 25 bp, Homo sapien
atgcatattatgaattgagtccaca

SEQ ID NO: 167604 - DNA, 25 bp, Homo sapien
gaattgagtccacaaaggaacacaa

SEQ ID NO: 167605 - DNA, 25 bp, Homo sapien
ctctttgtaattctgttaaatcttt

SEQ ID NO: 167606 - DNA, 25 bp, Homo sapien
gatttatttatgatcagcctactaa

SEQ ID NO: 167607 - DNA, 25 bp, Homo sapien
aggccagttgcaatgtctgtcagta

SEQ ID NO: 167608 - DNA, 25 bp, Homo sapien
ggccagttgcaatgtctgtcagtaa

SEQ ID NO: 167609 - DNA, 25 bp, Homo sapien
gccagttgcaatgtctgtcagtaac

SEQ ID NO: 167610 - DNA, 25 bp, Homo sapien
ccagttgcaatgtctgtcagtaacg

SEQ ID NO: 167611 - DNA, 25 bp, Homo sapien
cagttgcaatgtctgtcagtaacga

SEQ ID NO: 167612 - DNA, 25 bp, Homo sapien
agttgcaatgtctgtcagtaacgag

SEQ ID NO: 167613 - DNA, 25 bp, Homo sapien
gttgcaatgtctgtcagtaacgagg

SEQ ID NO: 167614 - DNA, 25 bp, Homo sapien
ttgcaatgtctgtcagtaacgaggc

SEQ ID NO: 167615 - DNA, 25 bp, Homo sapien
tgcaatgtctgtcagtaacgaggct

SEQ ID NO: 167616 - DNA, 25 bp, Homo sapien
gcaatgtctgtcagtaacgaggctt

SEQ ID NO: 167617 - DNA, 25 bp, Homo sapien
aatgtctgtcagtaacgaggctttt

SEQ ID NO: 167618 - DNA, 25 bp, Homo sapien
catatttgtaaactcagaactgagc

SEQ ID NO: 167619 - DNA, 25 bp, Homo sapien
agaactgagcagaagtgactttact

SEQ ID NO: 167620 - DNA, 25 bp, Homo sapien
gcagaagtgactttactttctcaag

SEQ ID NO: 167621 - DNA, 25 bp, Homo sapien
gtgactttactttctcaagtttgat

SEQ ID NO: 167622 - DNA, 25 bp, Homo sapien
ctcaagtttgatactgagttgactg

SEQ ID NO: 167623 - DNA, 25 bp, Homo sapien
aggcaatagtgcacaacttaggtta

SEQ ID NO: 167624 - DNA, 25 bp, Homo sapien
gtgcacaacttaggttatttttgct

SEQ ID NO: 167625 - DNA, 25 bp, Homo sapien
taggttatttttgcttccgaatttg

SEQ ID NO: 167626 - DNA, 25 bp, Homo sapien
atttttgcttccgaatttgaatgaa

SEQ ID NO: 167627 - DNA, 25 bp, Homo sapien
tttttcttttgcaagacacctgttt

SEQ ID NO: 167628 - DNA, 25 bp, Homo sapien
tcttgtttaaatgtaaatgtcccct

SEQ ID NO: 167629 - DNA, 25 bp, Homo sapien
gactttgtgtctgtgtttggcatca

SEQ ID NO: 167630 - DNA, 25 bp, Homo sapien
tctgtgtttggcatcacaagagggc

SEQ ID NO: 167631 - DNA, 25 bp, Homo sapien
acaagagggcaatttgcagctctgc

SEQ ID NO: 167632 - DNA, 25 bp, Homo sapien
ggcttttctaaagcaagaaggccta

SEQ ID NO: 167633 - DNA, 25 bp, Homo sapien
agcaagaaggcctatacctattgca

SEQ ID NO: 167634 - DNA, 25 bp, Homo sapien
tatacctattgcaaggccacagaaa

SEQ ID NO: 167635 - DNA, 25 bp, Homo sapien
agagcagatagtgccaatatcagga

SEQ ID NO: 167636 - DNA, 25 bp, Homo sapien
aaataatttatccaccaatttctgc

SEQ ID NO: 167637 - DNA, 25 bp, Homo sapien
atttctgcctgacattcagctactt

SEQ ID NO: 167638 - DNA, 25 bp, Homo sapien
tagagtctgcaaatcacggcatgtt

SEQ ID NO: 167639 - DNA, 25 bp, Homo sapien
aatcacggcatgttctccatttttt

SEQ ID NO: 167640 - DNA, 25 bp, Homo sapien
gagatgaggccagaccatggacact

SEQ ID NO: 167641 - DNA, 25 bp, Homo sapien
tgaggccagaccatggacactacac

SEQ ID NO: 167642 - DNA, 25 bp, Homo sapien
agaccatggacactacacccagcaa

SEQ ID NO: 167643 - DNA, 25 bp, Homo sapien
cacccagcaatagagacgggactgc

SEQ ID NO: 167644 - DNA, 25 bp, Homo sapien
acccagcaatagagacgggactgcg

SEQ ID NO: 167645 - DNA, 25 bp, Homo sapien
cccagcaatagagacgggactgcgg

SEQ ID NO: 167646 - DNA, 25 bp, Homo sapien
ccagcaatagagacgggactgcgga

SEQ ID NO: 167647 - DNA, 25 bp, Homo sapien
gggactgcggaggaaggaggaccca

SEQ ID NO: 167648 - DNA, 25 bp, Homo sapien
aggacaggatccaggccggcttgcc

SEQ ID NO: 167649 - DNA, 25 bp, Homo sapien
ggacaggatccaggccggcttgcca

SEQ ID NO: 167650 - DNA, 25 bp, Homo sapien
ttattcccgctgactgagtctctga

SEQ ID NO: 167651 - DNA, 25 bp, Homo sapien
ctctttttaaccacatttctgaatg

SEQ ID NO: 167652 - DNA, 25 bp, Homo sapien
ataccaattattttcctacagccct

SEQ ID NO: 167653 - DNA, 25 bp, Homo sapien
caattattttcctacagccctttgt

SEQ ID NO: 167654 - DNA, 25 bp, Homo sapien
tcctacagccctttgtacttcaaaa

SEQ ID NO: 167655 - DNA, 25 bp, Homo sapien
aatatgtttttgtgtccatcagtat

SEQ ID NO: 167656 - DNA, 25 bp, Homo sapien
tttttgtgtccatcagtattaacta

SEQ ID NO: 167657 - DNA, 25 bp, Homo sapien
ttaactattggtatactactggttt

SEQ ID NO: 167658 - DNA, 25 bp, Homo sapien
tttttctttgagacaacagtacata

SEQ ID NO: 167659 - DNA, 25 bp, Homo sapien
tagaggtacaattcgttggattttt

SEQ ID NO: 167660 - DNA, 25 bp, Homo sapien
gatacttaagttgtcaaacagtaga

SEQ ID NO: 167661 - DNA, 25 bp, Homo sapien
agacattacgtgttttatttatgat

SEQ ID NO: 167662 - DNA, 25 bp, Homo sapien
atttactgttcaaaggcattatctg

SEQ ID NO: 167663 - DNA, 25 bp, Homo sapien
gcattatctgttggtcacaccagtg

SEQ ID NO: 167664 - DNA, 25 bp, Homo sapien
tggtcacaccagtgggtatatgatt

SEQ ID NO: 167665 - DNA, 25 bp, Homo sapien
ttagggaacagggttgacacagcag

SEQ ID NO: 167666 - DNA, 25 bp, Homo sapien
agggctagtcctgcatattttttct

SEQ ID NO: 167667 - DNA, 25 bp, Homo sapien
aatatttcccaattgtgtttttcat

SEQ ID NO: 167668 - DNA, 25 bp, Homo sapien
attagctttgatcttgtagtttaaa

SEQ ID NO: 167669 - DNA, 25 bp, Homo sapien
ggtaatcttttactgagctggatct

SEQ ID NO: 167670 - DNA, 25 bp, Homo sapien
tttactgagctggatcttagagaaa

SEQ ID NO: 167671 - DNA, 25 bp, Homo sapien
tttaaagtttgccacatttcatctt

SEQ ID NO: 167672 - DNA, 25 bp, Homo sapien
atctttgtcctaacatgagtgcttg

SEQ ID NO: 167673 - DNA, 25 bp, Homo sapien
aaggctaagtgatctttctctggct

SEQ ID NO: 167674 - DNA, 25 bp, Homo sapien
aagtgatctttctctggctatccag

SEQ ID NO: 167675 - DNA, 25 bp, Homo sapien
tctggctatccagctagtagtaatg

SEQ ID NO: 167676 - DNA, 25 bp, Homo sapien
atgaagtcaggtcttgaaccccggt

SEQ ID NO: 167677 - DNA, 25 bp, Homo sapien
gaaccccggttctgctgactgaatt

SEQ ID NO: 167678 - DNA, 25 bp, Homo sapien
gctgactgaattggatgcactatag

SEQ ID NO: 167679 - DNA, 25 bp, Homo sapien
ggatgcactatagtacaggctttta

SEQ ID NO: 167680 - DNA, 25 bp, Homo sapien
tacaggcttttagcaccgaagtgtg

SEQ ID NO: 167681 - DNA, 25 bp, Homo sapien
cttttagcaccgaagtgtggtcctc

SEQ ID NO: 167682 - DNA, 25 bp, Homo sapien
gatgttactggtctgtgaggaaata

SEQ ID NO: 167683 - DNA, 25 bp, Homo sapien
gtacagatactgacaggaagctttt

SEQ ID NO: 167684 - DNA, 25 bp, Homo sapien
gtaaatagcactagttagactcttt

SEQ ID NO: 167685 - DNA, 25 bp, Homo sapien
gttagactctttagaatactccaag

SEQ ID NO: 167686 - DNA, 25 bp, Homo sapien
atactccaagagttagggcagcaga

SEQ ID NO: 167687 - DNA, 25 bp, Homo sapien
gcagcagagtggagcgatttagaaa

SEQ ID NO: 167688 - DNA, 25 bp, Homo sapien
ggagcgatttagaaagaacatttta

SEQ ID NO: 167689 - DNA, 25 bp, Homo sapien
aacaatcagttaatttaccatgtaa

SEQ ID NO: 167690 - DNA, 25 bp, Homo sapien
aatgataatgtgtacagattttctg

SEQ ID NO: 167691 - DNA, 25 bp, Homo sapien
acagattttctgttcaaatattcaa

SEQ ID NO: 167692 - DNA, 25 bp, Homo sapien
taaacttcttgttaagactgttacg

SEQ ID NO: 167693 - DNA, 25 bp, Homo sapien
gactgttacgtttctattgcttttg

SEQ ID NO: 167694 - DNA, 25 bp, Homo sapien
ctattgcttttgtatgggatattgc

SEQ ID NO: 167695 - DNA, 25 bp, Homo sapien
atggcaagatccatctgcaggtcct

SEQ ID NO: 167696 - DNA, 25 bp, Homo sapien
aagatccatctgcaggtcctcatgg

SEQ ID NO: 167697 - DNA, 25 bp, Homo sapien
gatccatctgcaggtcctcatggaa

SEQ ID NO: 167698 - DNA, 25 bp, Homo sapien
atctgcaggtcctcatggaagagcc

SEQ ID NO: 167699 - DNA, 25 bp, Homo sapien
ctgcaggtcctcatggaagagcccc

SEQ ID NO: 167700 - DNA, 25 bp, Homo sapien
aggtcctcatggaagagccccctga

SEQ ID NO: 167701 - DNA, 25 bp, Homo sapien
tggccgtgattgtgggtgcctccgt

SEQ ID NO: 167702 - DNA, 25 bp, Homo sapien
gtgctgatggtggtcaagtgtgtga

SEQ ID NO: 167703 - DNA, 25 bp, Homo sapien
tgaagaccgaggaggagggcaagac

SEQ ID NO: 167704 - DNA, 25 bp, Homo sapien
gcaagacggacggtgaaggcaaccc

SEQ ID NO: 167705 - DNA, 25 bp, Homo sapien
gacggtgaaggcaacccggatgatg

SEQ ID NO: 167706 - DNA, 25 bp, Homo sapien
ttgtcgatctgttcagccctgaaaa

SEQ ID NO: 167707 - DNA, 25 bp, Homo sapien
gtcgatctgttcagccctgaaaagt

SEQ ID NO: 167708 - DNA, 25 bp, Homo sapien
tctgttcagccctgaaaagtccaaa

SEQ ID NO: 167709 - DNA, 25 bp, Homo sapien
aactcccaggtattgttgcagaagg

SEQ ID NO: 167710 - DNA, 25 bp, Homo sapien
cccaggtattgttgcagaaggccga

SEQ ID NO: 167711 - DNA, 25 bp, Homo sapien
attgttgcagaaggccgagatgacc

SEQ ID NO: 167712 - DNA, 25 bp, Homo sapien
ttgcagaaggccgagatgacctcta

SEQ ID NO: 167713 - DNA, 25 bp, Homo sapien
gaaggccgagatgacctctatgtct

SEQ ID NO: 167714 - DNA, 25 bp, Homo sapien
ccgagatgacctctatgtctcagat

SEQ ID NO: 167715 - DNA, 25 bp, Homo sapien
caacatgcctttcctggtttttata

SEQ ID NO: 167716 - DNA, 25 bp, Homo sapien
taagtaaaatgttctctagaggatc

SEQ ID NO: 167717 - DNA, 25 bp, Homo sapien
catcgagtatatgctctcatattgg

SEQ ID NO: 167718 - DNA, 25 bp, Homo sapien
tatatgctctcatattggtgtctgc

SEQ ID NO: 167719 - DNA, 25 bp, Homo sapien
tggtgtctgcatacacatcagagtt

SEQ ID NO: 167720 - DNA, 25 bp, Homo sapien
tgcatacacatcagagtttggagat

SEQ ID NO: 167721 - DNA, 25 bp, Homo sapien
agtgggtacttcagccgcccctggc

SEQ ID NO: 167722 - DNA, 25 bp, Homo sapien
tcagccgcccctggcagtgggagaa

SEQ ID NO: 167723 - DNA, 25 bp, Homo sapien
gaacaacaagaagtggcagatagct

SEQ ID NO: 167724 - DNA, 25 bp, Homo sapien
gcagatagctggacgccaaattgta

SEQ ID NO: 167725 - DNA, 25 bp, Homo sapien
gctggacgccaaattgtacaaattc

SEQ ID NO: 167726 - DNA, 25 bp, Homo sapien
aattgtacaaattcactgaccgtgg

SEQ ID NO: 167727 - DNA, 25 bp, Homo sapien
tacaaattcactgaccgtggtcact

SEQ ID NO: 167728 - DNA, 25 bp, Homo sapien
aaaggcctatcggagctatgtgctg

SEQ ID NO: 167729 - DNA, 25 bp, Homo sapien
taacaccccatgtgtgcccagagct

SEQ ID NO: 167730 - DNA, 25 bp, Homo sapien
ggctgcatcactcccagatgaaggt

SEQ ID NO: 167731 - DNA, 25 bp, Homo sapien
gaaggttttgttgcattcacagcaa

SEQ ID NO: 167732 - DNA, 25 bp, Homo sapien
attgtgtactcccagacaaatctga

SEQ ID NO: 167733 - DNA, 25 bp, Homo sapien
attcccaccgtcctatgagagtgtc

SEQ ID NO: 167734 - DNA, 25 bp, Homo sapien
tgagagtgtcactagaggccttagt

SEQ ID NO: 167735 - DNA, 25 bp, Homo sapien
gaggccttagtgatagagtcaacat

SEQ ID NO: 167736 - DNA, 25 bp, Homo sapien
gagtcaacatgaggacatctagctc

SEQ ID NO: 167737 - DNA, 25 bp, Homo sapien
gatgaagccaccagtatggagctga

SEQ ID NO: 167738 - DNA, 25 bp, Homo sapien
agtatggagctgattgcccctgggc

SEQ ID NO: 167739 - DNA, 25 bp, Homo sapien
gtacagggctctcaagcctgaggtt

SEQ ID NO: 167740 - DNA, 25 bp, Homo sapien
cttctctgggcttaattttctcttg

SEQ ID NO: 167741 - DNA, 25 bp, Homo sapien
gggtacgtgcctgacagtgtttaag

SEQ ID NO: 167742 - DNA, 25 bp, Homo sapien
cagtgtttaaggtgtccgttgaact

SEQ ID NO: 167743 - DNA, 25 bp, Homo sapien
tccgttgaactggagttgcagactt

SEQ ID NO: 167744 - DNA, 25 bp, Homo sapien
gcagacttttaaatagatgacccct

SEQ ID NO: 167745 - DNA, 25 bp, Homo sapien
agatgaccccttcagatcatctgtg

SEQ ID NO: 167746 - DNA, 25 bp, Homo sapien
tgtcactcagacacctgtggcatgt

SEQ ID NO: 167747 - DNA, 25 bp, Homo sapien
gcatgtggaggagactgccctgtcc

SEQ ID NO: 167748 - DNA, 25 bp, Homo sapien
aatgtgaaactgtctcctgcaacct

SEQ ID NO: 167749 - DNA, 25 bp, Homo sapien
tgtgggcctggctgtgttcaattgc

SEQ ID NO: 167750 - DNA, 25 bp, Homo sapien
atgaacccaattccagcaccgttgc

SEQ ID NO: 167751 - DNA, 25 bp, Homo sapien
cgttgcctcctgacataccaagctt

SEQ ID NO: 167752 - DNA, 25 bp, Homo sapien
tgcctcctgacataccaagcttcaa

SEQ ID NO: 167753 - DNA, 25 bp, Homo sapien
tgacataccaagcttcaacctcatt

SEQ ID NO: 167754 - DNA, 25 bp, Homo sapien
gcttcaacctcattggtgacagcct

SEQ ID NO: 167755 - DNA, 25 bp, Homo sapien
ttcaacctcattggtgacagcctgt

SEQ ID NO: 167756 - DNA, 25 bp, Homo sapien
tcaaagatactgacatgaagcggct

SEQ ID NO: 167757 - DNA, 25 bp, Homo sapien
gatactgacatgaagcggctttcca

SEQ ID NO: 167758 - DNA, 25 bp, Homo sapien
tactgacatgaagcggctttccatg

SEQ ID NO: 167759 - DNA, 25 bp, Homo sapien
gacatgaagcggctttccatggaga

SEQ ID NO: 167760 - DNA, 25 bp, Homo sapien
catgaagcggctttccatggagata

SEQ ID NO: 167761 - DNA, 25 bp, Homo sapien
ccatgggccacaaatctctacaagt

SEQ ID NO: 167762 - DNA, 25 bp, Homo sapien
atgggccacaaatctctacaagtgc

SEQ ID NO: 167763 - DNA, 25 bp, Homo sapien
gggccacaaatctctacaagtgcct

SEQ ID NO: 167764 - DNA, 25 bp, Homo sapien
ggccacaaatctctacaagtgcctg

SEQ ID NO: 167765 - DNA, 25 bp, Homo sapien
gccacaaatctctacaagtgcctgc

SEQ ID NO: 167766 - DNA, 25 bp, Homo sapien
ccacaaatctctacaagtgcctgct

SEQ ID NO: 167767 - DNA, 25 bp, Homo sapien
acaaatctctacaagtgcctgctat

SEQ ID NO: 167768 - DNA, 25 bp, Homo sapien
caaatctctacaagtgcctgctatc

SEQ ID NO: 167769 - DNA, 25 bp, Homo sapien
aaatctctacaagtgcctgctatcc

SEQ ID NO: 167770 - DNA, 25 bp, Homo sapien
aatctctacaagtgcctgctatccc

SEQ ID NO: 167771 - DNA, 25 bp, Homo sapien
tctacaagtgcctgctatccctctc

SEQ ID NO: 167772 - DNA, 25 bp, Homo sapien
tcaggctgagcatgtcgagtcaaaa

SEQ ID NO: 167773 - DNA, 25 bp, Homo sapien
tgtcgagtcaaaacaacttgtgggc

SEQ ID NO: 167774 - DNA, 25 bp, Homo sapien
aacttgtgggcgtagatttgaatac

SEQ ID NO: 167775 - DNA, 25 bp, Homo sapien
gagccaatggtagcagcagatgcag

SEQ ID NO: 167776 - DNA, 25 bp, Homo sapien
aaaaacaacttcttcactcttgcac

SEQ ID NO: 167777 - DNA, 25 bp, Homo sapien
caacattctcctggttgatgaaatt

SEQ ID NO: 167778 - DNA, 25 bp, Homo sapien
atgcgagctgggatgtcttctcaaa

SEQ ID NO: 167779 - DNA, 25 bp, Homo sapien
tcaaaatcaacccttctagaagatg

SEQ ID NO: 167780 - DNA, 25 bp, Homo sapien
aatttagtacactttacatctgact

SEQ ID NO: 167781 - DNA, 25 bp, Homo sapien
atctgactactattgtgtagcctga

SEQ ID NO: 167782 - DNA, 25 bp, Homo sapien
tgtagcctgagccattctgaatttc

SEQ ID NO: 167783 - DNA, 25 bp, Homo sapien
aaaagaagtctgtctatttcgaggg

SEQ ID NO: 167784 - DNA, 25 bp, Homo sapien
gttaagctagtatcatagtcattta

SEQ ID NO: 167785 - DNA, 25 bp, Homo sapien
tgtaatagatcttaaccattttccc

SEQ ID NO: 167786 - DNA, 25 bp, Homo sapien
taactctcttattctgccgccacaa

SEQ ID NO: 167787 - DNA, 25 bp, Homo sapien
ttctgccgccacaatgcaagcatag

SEQ ID NO: 167788 - DNA, 25 bp, Homo sapien
gcaagcatagtttgatgttttcgtt

SEQ ID NO: 167789 - DNA, 25 bp, Homo sapien
gatgttttcgttattgccttttttg

SEQ ID NO: 167790 - DNA, 25 bp, Homo sapien
ttcgttattgccttttttgagatgt

SEQ ID NO: 167791 - DNA, 25 bp, Homo sapien
ttgccttttttgagatgtatgtatc

SEQ ID NO: 167792 - DNA, 25 bp, Homo sapien
tctgtatctacctatatctatatgt

SEQ ID NO: 167793 - DNA, 25 bp, Homo sapien
acacacagatacaagtgtacacaca

SEQ ID NO: 167794 - DNA, 25 bp, Homo sapien
gatcatttccaggtctaaaattcca

SEQ ID NO: 167795 - DNA, 25 bp, Homo sapien
agagaggacggttttgtgtctttat

SEQ ID NO: 167796 - DNA, 25 bp, Homo sapien
ttgtgtctttatgaactttgttact

SEQ ID NO: 167797 - DNA, 25 bp, Homo sapien
tgttacttaagtactccattggaga

SEQ ID NO: 167798 - DNA, 25 bp, Homo sapien
tactccattggagacataatttttc

SEQ ID NO: 167799 - DNA, 25 bp, Homo sapien
gtggatctttttccactggaaagtg

SEQ ID NO: 167800 - DNA, 25 bp, Homo sapien
ctggaaagtgtgatagctcattgct

SEQ ID NO: 167801 - DNA, 25 bp, Homo sapien
agctcattgctaatttttcattcat

SEQ ID NO: 167802 - DNA, 25 bp, Homo sapien
ttcattcatagttcattgcttccat

SEQ ID NO: 167803 - DNA, 25 bp, Homo sapien
tagttcattgcttccatttgaccta

SEQ ID NO: 167804 - DNA, 25 bp, Homo sapien
catttgacctaagattggccatttg

SEQ ID NO: 167805 - DNA, 25 bp, Homo sapien
aggaacccccggcactgatgggctt

SEQ ID NO: 167806 - DNA, 25 bp, Homo sapien
gcactgatgggcttttgcccctgcc

SEQ ID NO: 167807 - DNA, 25 bp, Homo sapien
acactgacactttgtccccacatgg

SEQ ID NO: 167808 - DNA, 25 bp, Homo sapien
gcaaagtgcccgccccgtggagata

SEQ ID NO: 167809 - DNA, 25 bp, Homo sapien
aagtgcccgccccgtggagataccg

SEQ ID NO: 167810 - DNA, 25 bp, Homo sapien
ccccgtggagataccgccccagcgg

SEQ ID NO: 167811 - DNA, 25 bp, Homo sapien
ttgccggcctttgggcaaggcccct

SEQ ID NO: 167812 - DNA, 25 bp, Homo sapien
gagcatctcgcccaggctttttata

SEQ ID NO: 167813 - DNA, 25 bp, Homo sapien
agcatctcgcccaggctttttatac

SEQ ID NO: 167814 - DNA, 25 bp, Homo sapien
atctcgcccaggctttttatacctt

SEQ ID NO: 167815 - DNA, 25 bp, Homo sapien
tattttactctatgattattcagga

SEQ ID NO: 167816 - DNA, 25 bp, Homo sapien
tgtacaattatgtctcttgagcatc

SEQ ID NO: 167817 - DNA, 25 bp, Homo sapien
gtctcttgagcatcaatcttgttac

SEQ ID NO: 167818 - DNA, 25 bp, Homo sapien
atcttgttactgctgattcttgtaa

SEQ ID NO: 167819 - DNA, 25 bp, Homo sapien
ttcatcttaaactaatacgtgccag

SEQ ID NO: 167820 - DNA, 25 bp, Homo sapien
tacgtgccagatataactgtcttgt

SEQ ID NO: 167821 - DNA, 25 bp, Homo sapien
aactgtcttgtttcagtgagagacg

SEQ ID NO: 167822 - DNA, 25 bp, Homo sapien
gtgagagacgccctatttctatgtc

SEQ ID NO: 167823 - DNA, 25 bp, Homo sapien
aagaaaatgttacggcatcacactt

SEQ ID NO: 167824 - DNA, 25 bp, Homo sapien
gttacggcatcacacttatatttta

SEQ ID NO: 167825 - DNA, 25 bp, Homo sapien
acattgtactgttgctttaatatga

SEQ ID NO: 167826 - DNA, 25 bp, Homo sapien
gttgctttaatatgagcttcaatat

SEQ ID NO: 167827 - DNA, 25 bp, Homo sapien
gactctattttctctgattcggtgt

SEQ ID NO: 167828 - DNA, 25 bp, Homo sapien
ttttctctgattcggtgtgcgccaa

SEQ ID NO: 167829 - DNA, 25 bp, Homo sapien
ctgattcggtgtgcgccaagaagaa

SEQ ID NO: 167830 - DNA, 25 bp, Homo sapien
tttgtttcccataataatttctgat

SEQ ID NO: 167831 - DNA, 25 bp, Homo sapien
attgcttttaactgtgggacttagt

SEQ ID NO: 167832 - DNA, 25 bp, Homo sapien
ctgtgggacttagttaattcttcaa

SEQ ID NO: 167833 - DNA, 25 bp, Homo sapien
gaaaattattttggactatgacttt

SEQ ID NO: 167834 - DNA, 25 bp, Homo sapien
gacctcaacaagaatggcaactatt

SEQ ID NO: 167835 - DNA, 25 bp, Homo sapien
ggcaactattgattgcattcaaacg

SEQ ID NO: 167836 - DNA, 25 bp, Homo sapien
caaacgtacaattgtatctgtggga

SEQ ID NO: 167837 - DNA, 25 bp, Homo sapien
gtatctgtgggaagagaatagactc

SEQ ID NO: 167838 - DNA, 25 bp, Homo sapien
accttggcagcgacgtggctcgaga

SEQ ID NO: 167839 - DNA, 25 bp, Homo sapien
gcgacgtggctcgagaagcattcat

SEQ ID NO: 167840 - DNA, 25 bp, Homo sapien
gaagcattcatcattactgtggaca

SEQ ID NO: 167841 - DNA, 25 bp, Homo sapien
atggcagttgttgctccacccaaaa

SEQ ID NO: 167842 - DNA, 25 bp, Homo sapien
cttgccagtttaattccagccttac

SEQ ID NO: 167843 - DNA, 25 bp, Homo sapien
ccagccttacccattgactcaaggg

SEQ ID NO: 167844 - DNA, 25 bp, Homo sapien
agagtgacagtcatctttgcccacc

SEQ ID NO: 167845 - DNA, 25 bp, Homo sapien
tttgcccacccagtgtaatgtcact

SEQ ID NO: 167846 - DNA, 25 bp, Homo sapien
tctcttttcatactggctgttggca

SEQ ID NO: 167847 - DNA, 25 bp, Homo sapien
gcatttctgtaaactgcctgtccat

SEQ ID NO: 167848 - DNA, 25 bp, Homo sapien
gcctgtccatgctctttgtttttaa

SEQ ID NO: 167849 - DNA, 25 bp, Homo sapien
atcacgtaccgccacatggaacgga

SEQ ID NO: 167850 - DNA, 25 bp, Homo sapien
taccgccacatggaacggactctgt

SEQ ID NO: 167851 - DNA, 25 bp, Homo sapien
catggaacggactctgtcccagaga

SEQ ID NO: 167852 - DNA, 25 bp, Homo sapien
cccagagagaggtcaggcacatcca

SEQ ID NO: 167853 - DNA, 25 bp, Homo sapien
gagaggtcaggcacatccaccaggc

SEQ ID NO: 167854 - DNA, 25 bp, Homo sapien
aggccttgcaggaggctgcagtcca

SEQ ID NO: 167855 - DNA, 25 bp, Homo sapien
ctgcagtccagctgttgggtgtgga

SEQ ID NO: 167856 - DNA, 25 bp, Homo sapien
gagggcaggttctgatgtcaccact

SEQ ID NO: 167857 - DNA, 25 bp, Homo sapien
ttctgatgtcaccacttcactcagg

SEQ ID NO: 167858 - DNA, 25 bp, Homo sapien
gggctccaggatttgctgaaagaga

SEQ ID NO: 167859 - DNA, 25 bp, Homo sapien
gaactggggcatcaatcatcttttg

SEQ ID NO: 167860 - DNA, 25 bp, Homo sapien
tacacataggagctgcatttaaaac

SEQ ID NO: 167861 - DNA, 25 bp, Homo sapien
taggagctgcatttaaaacctgctg

SEQ ID NO: 167862 - DNA, 25 bp, Homo sapien
ggagctgcatttaaaacctgctggt

SEQ ID NO: 167863 - DNA, 25 bp, Homo sapien
agctgcatttaaaacctgctggttt

SEQ ID NO: 167864 - DNA, 25 bp, Homo sapien
aaacctgctggtttaaattctgtca

SEQ ID NO: 167865 - DNA, 25 bp, Homo sapien
atttcacttctagccttttagtatg

SEQ ID NO: 167866 - DNA, 25 bp, Homo sapien
ttcacttctagccttttagtatggc

SEQ ID NO: 167867 - DNA, 25 bp, Homo sapien
gcatttgtaatttggagtatctggt

SEQ ID NO: 167868 - DNA, 25 bp, Homo sapien
aatttggagtatctggtactagcta

SEQ ID NO: 167869 - DNA, 25 bp, Homo sapien
ggagtatctggtactagctaagaaa

SEQ ID NO: 167870 - DNA, 25 bp, Homo sapien
ccttgacgcaggataaattttttca

SEQ ID NO: 167871 - DNA, 25 bp, Homo sapien
ggaaaagttctggacaccaccatga

SEQ ID NO: 167872 - DNA, 25 bp, Homo sapien
gaaaagttctggacaccaccatgat

SEQ ID NO: 167873 - DNA, 25 bp, Homo sapien
aaagttctggacaccaccatgatgg

SEQ ID NO: 167874 - DNA, 25 bp, Homo sapien
agttctggacaccaccatgatggag

SEQ ID NO: 167875 - DNA, 25 bp, Homo sapien
ttctggacaccaccatgatggaggc

SEQ ID NO: 167876 - DNA, 25 bp, Homo sapien
ctggacaccaccatgatggaggcaa

SEQ ID NO: 167877 - DNA, 25 bp, Homo sapien
gacaccaccatgatggaggcaagtt

SEQ ID NO: 167878 - DNA, 25 bp, Homo sapien
accaccatgatggaggcaagttgtg

SEQ ID NO: 167879 - DNA, 25 bp, Homo sapien
atggaggcaagttgtgatcagttca

SEQ ID NO: 167880 - DNA, 25 bp, Homo sapien
gaggcaagttgtgatcagttcacat

SEQ ID NO: 167881 - DNA, 25 bp, Homo sapien
caagttgtgatcagttcacatgctg

SEQ ID NO: 167882 - DNA, 25 bp, Homo sapien
atttcacttctagccttttagtatg

SEQ ID NO: 167883 - DNA, 25 bp, Homo sapien
ttcacttctagccttttagtatggc

SEQ ID NO: 167884 - DNA, 25 bp, Homo sapien
cttaagcatttgtaatttggagtat

SEQ ID NO: 167885 - DNA, 25 bp, Homo sapien
gcatttgtaatttggagtatctggt

SEQ ID NO: 167886 - DNA, 25 bp, Homo sapien
gtaatttggagtatctggtactagc

SEQ ID NO: 167887 - DNA, 25 bp, Homo sapien
aatttggagtatctggtactagcta

SEQ ID NO: 167888 - DNA, 25 bp, Homo sapien
atttggagtatctggtactagctaa

SEQ ID NO: 167889 - DNA, 25 bp, Homo sapien
ttggagtatctggtactagctaaga

SEQ ID NO: 167890 - DNA, 25 bp, Homo sapien
tggagtatctggtactagctaagaa

SEQ ID NO: 167891 - DNA, 25 bp, Homo sapien
ggagtatctggtactagctaagaaa

SEQ ID NO: 167892 - DNA, 25 bp, Homo sapien
agtatctggtactagctaagaaata

SEQ ID NO: 167893 - DNA, 25 bp, Homo sapien
aattgtaacaatctcactggaggcc

SEQ ID NO: 167894 - DNA, 25 bp, Homo sapien
taacaatctcactggaggccaaaca

SEQ ID NO: 167895 - DNA, 25 bp, Homo sapien
aggccaaacaggaatggagaatcac

SEQ ID NO: 167896 - DNA, 25 bp, Homo sapien
ggagaatcacatttaatggagctgt

SEQ ID NO: 167897 - DNA, 25 bp, Homo sapien
catttaatggagctgtacaaagtca

SEQ ID NO: 167898 - DNA, 25 bp, Homo sapien
attactgaaatcctgcgagcaagaa

SEQ ID NO: 167899 - DNA, 25 bp, Homo sapien
atcctgcgagcaagaatttcatata

SEQ ID NO: 167900 - DNA, 25 bp, Homo sapien
gtaggcagtgcataaagtatttttc

SEQ ID NO: 167901 - DNA, 25 bp, Homo sapien
gttgtggaaattatactgagtatgc

SEQ ID NO: 167902 - DNA, 25 bp, Homo sapien
gtatgctaaaaattccatcttctgt

SEQ ID NO: 167903 - DNA, 25 bp, Homo sapien
aaaaattccatcttctgtatatgtg

SEQ ID NO: 167904 - DNA, 25 bp, Homo sapien
aggggtgccgcccatgggccacaaa

SEQ ID NO: 167905 - DNA, 25 bp, Homo sapien
ccatgggccacaaatctctacaagt

SEQ ID NO: 167906 - DNA, 25 bp, Homo sapien
aaatctctacaagtgcctgctatcc

SEQ ID NO: 167907 - DNA, 25 bp, Homo sapien
agctgctcctaggactggcccatgg

SEQ ID NO: 167908 - DNA, 25 bp, Homo sapien
tgctcctaggactggcccatgggca

SEQ ID NO: 167909 - DNA, 25 bp, Homo sapien
gctcctaggactggcccatgggcag

SEQ ID NO: 167910 - DNA, 25 bp, Homo sapien
ggtgccctgaaaccaaactggaagc

SEQ ID NO: 167911 - DNA, 25 bp, Homo sapien
gggctgtggtcaagccttattctgt

SEQ ID NO: 167912 - DNA, 25 bp, Homo sapien
ggctgtggtcaagccttattctgta

SEQ ID NO: 167913 - DNA, 25 bp, Homo sapien
ctgtggtcaagccttattctgtatt

SEQ ID NO: 167914 - DNA, 25 bp, Homo sapien
tgtggtcaagccttattctgtattg

SEQ ID NO: 167915 - DNA, 25 bp, Homo sapien
actcaggctgggagtatcgaaccct

SEQ ID NO: 167916 - DNA, 25 bp, Homo sapien
tgggagtatcgaaccctctgcctag

SEQ ID NO: 167917 - DNA, 25 bp, Homo sapien
gaaccctctgcctagggccggagtt

SEQ ID NO: 167918 - DNA, 25 bp, Homo sapien
tagggccggagttgctgccagtacc

SEQ ID NO: 167919 - DNA, 25 bp, Homo sapien
tctgctcatccatccttgattattt

SEQ ID NO: 167920 - DNA, 25 bp, Homo sapien
ttgattatttggcttctaggaacag

SEQ ID NO: 167921 - DNA, 25 bp, Homo sapien
ggcttctaggaacagttgacttccc

SEQ ID NO: 167922 - DNA, 25 bp, Homo sapien
ttgacttcccagaatgcagtgggct

SEQ ID NO: 167923 - DNA, 25 bp, Homo sapien
aatgcagtgggctgctgggcacccc

SEQ ID NO: 167924 - DNA, 25 bp, Homo sapien
gattctgtaaataaaggtgcccctt

SEQ ID NO: 167925 - DNA, 25 bp, Homo sapien
agagccctggataggaagccactga

SEQ ID NO: 167926 - DNA, 25 bp, Homo sapien
gtattaccctctacaatatactttt

SEQ ID NO: 167927 - DNA, 25 bp, Homo sapien
atactttttattgagcactttgctg

SEQ ID NO: 167928 - DNA, 25 bp, Homo sapien
tattgtttgttgtggtgtctatagc

SEQ ID NO: 167929 - DNA, 25 bp, Homo sapien
gtggtgtctatagcaaagtttttct

SEQ ID NO: 167930 - DNA, 25 bp, Homo sapien
cccaccctggactcatttgagaaga

SEQ ID NO: 167931 - DNA, 25 bp, Homo sapien
gaaatgtcttaatactcacactgct

SEQ ID NO: 167932 - DNA, 25 bp, Homo sapien
gtcttaatactcacactgctgcatg

SEQ ID NO: 167933 - DNA, 25 bp, Homo sapien
actgctgcatgtagctcttgcttat

SEQ ID NO: 167934 - DNA, 25 bp, Homo sapien
tgtagctcttgcttatttactggtc

SEQ ID NO: 167935 - DNA, 25 bp, Homo sapien
cttatttactggtctgggaaacagg

SEQ ID NO: 167936 - DNA, 25 bp, Homo sapien
caattttcttgtattaccctctaca

SEQ ID NO: 167937 - DNA, 25 bp, Homo sapien
atgcaaattcaaggaatctgtgttt

SEQ ID NO: 167938 - DNA, 25 bp, Homo sapien
gtgtttgaaaactactatgtgatct

SEQ ID NO: 167939 - DNA, 25 bp, Homo sapien
gatctattcttccacactgtaccgc

SEQ ID NO: 167940 - DNA, 25 bp, Homo sapien
acactgtaccgccagcaagaatcag

SEQ ID NO: 167941 - DNA, 25 bp, Homo sapien
aagaatcaggccgagcttggtttct

SEQ ID NO: 167942 - DNA, 25 bp, Homo sapien
tcaggccgagcttggtttctgggac

SEQ ID NO: 167943 - DNA, 25 bp, Homo sapien
aagccctcatcacattttgtaccga

SEQ ID NO: 167944 - DNA, 25 bp, Homo sapien
ttttgtaccgaaacctattgaagtg

SEQ ID NO: 167945 - DNA, 25 bp, Homo sapien
cgaaacctattgaagtgtgtatgta

SEQ ID NO: 167946 - DNA, 25 bp, Homo sapien
gtgtatgtacagagaaccatcgcta

SEQ ID NO: 167947 - DNA, 25 bp, Homo sapien
gagaaccatcgctacatgaaattgg

SEQ ID NO: 167948 - DNA, 25 bp, Homo sapien
gcattccaaatagatactacctgca

SEQ ID NO: 167949 - DNA, 25 bp, Homo sapien
agatactacctgcaattttatacat

SEQ ID NO: 167950 - DNA, 25 bp, Homo sapien
atttctatactattcatctcctgtc

SEQ ID NO: 167951 - DNA, 25 bp, Homo sapien
atctcctgtccttcagtttgtataa

SEQ ID NO: 167952 - DNA, 25 bp, Homo sapien
ggagagtgtgaaatccagcaactga

SEQ ID NO: 167953 - DNA, 25 bp, Homo sapien
ccagcaactgaattgtggtcacgat

SEQ ID NO: 167954 - DNA, 25 bp, Homo sapien
gtggtcacgattgtatgaaagttca

SEQ ID NO: 167955 - DNA, 25 bp, Homo sapien
acatatgtcagttttgttacagttg

SEQ ID NO: 167956 - DNA, 25 bp, Homo sapien
gttacagttgtagctacatactcaa

SEQ ID NO: 167957 - DNA, 25 bp, Homo sapien
tgtatcaacttttagcctgctcaac

SEQ ID NO: 167958 - DNA, 25 bp, Homo sapien
cctgctcaacttaggctcagtgaaa

SEQ ID NO: 167959 - DNA, 25 bp, Homo sapien
ggacaaatgtttaggacttcaagat

SEQ ID NO: 167960 - DNA, 25 bp, Homo sapien
gacttcaagatcacacttgtgggca

SEQ ID NO: 167961 - DNA, 25 bp, Homo sapien
caagatcacacttgtgggcaatctg

SEQ ID NO: 167962 - DNA, 25 bp, Homo sapien
gggagccacaacttttcatgaagtg

SEQ ID NO: 167963 - DNA, 25 bp, Homo sapien
catagttatgtccaaagaataggtt

SEQ ID NO: 167964 - DNA, 25 bp, Homo sapien
gttaacatgaaaacccagtaagact

SEQ ID NO: 167965 - DNA, 25 bp, Homo sapien
agtaagactttccatcttggcagcc

SEQ ID NO: 167966 - DNA, 25 bp, Homo sapien
cttggcagccatcctttttaagagt

SEQ ID NO: 167967 - DNA, 25 bp, Homo sapien
atagccttattttcatttagtttgt

SEQ ID NO: 167968 - DNA, 25 bp, Homo sapien
gttagcactatagtgagcttttcaa

SEQ ID NO: 167969 - DNA, 25 bp, Homo sapien
gagcttttcaaacactattttaatc

SEQ ID NO: 167970 - DNA, 25 bp, Homo sapien
tgaaatcagtgctctttcacttctt

SEQ ID NO: 167971 - DNA, 25 bp, Homo sapien
aagcagggatggtacctacccggca

SEQ ID NO: 167972 - DNA, 25 bp, Homo sapien
tacctacccggcaggtaggttagat

SEQ ID NO: 167973 - DNA, 25 bp, Homo sapien
atgtgggtggtgcatgttaatttcc

SEQ ID NO: 167974 - DNA, 25 bp, Homo sapien
agccctgtttcctgcgtaaaggtgg

SEQ ID NO: 167975 - DNA, 25 bp, Homo sapien
tttcctgcgtaaaggtggtatgtcc

SEQ ID NO: 167976 - DNA, 25 bp, Homo sapien
gcgtaaaggtggtatgtccagttca

SEQ ID NO: 167977 - DNA, 25 bp, Homo sapien
tgagcatggcttgttaagatcagga

SEQ ID NO: 167978 - DNA, 25 bp, Homo sapien
ccagacttgctcatttttcgagttt

SEQ ID NO: 167979 - DNA, 25 bp, Homo sapien
ttcgagtttttaactagactacact

SEQ ID NO: 167980 - DNA, 25 bp, Homo sapien
tgagtttaattttgtcctctaggat

SEQ ID NO: 167981 - DNA, 25 bp, Homo sapien
tggcaatcagtagctgccagtgctg

SEQ ID NO: 167982 - DNA, 25 bp, Homo sapien
gtagctgccagtgctgagatgacaa

SEQ ID NO: 167983 - DNA, 25 bp, Homo sapien
cagtgctgagatgacaatgagggtt

SEQ ID NO: 167984 - DNA, 25 bp, Homo sapien
tcataagcattctccagcaagtaat

SEQ ID NO: 167985 - DNA, 25 bp, Homo sapien
gcattctccagcaagtaatggcaaa

SEQ ID NO: 167986 - DNA, 25 bp, Homo sapien
aatggcaaacactcttgagataaat

SEQ ID NO: 167987 - DNA, 25 bp, Homo sapien
gaatgaccaagtgggaattgcacca

SEQ ID NO: 167988 - DNA, 25 bp, Homo sapien
gggaattgcaccactggaaacaaat

SEQ ID NO: 167989 - DNA, 25 bp, Homo sapien
aaagcagtctctggctgggccaaca

SEQ ID NO: 167990 - DNA, 25 bp, Homo sapien
gaaagagttgttatggcagttgtcc

SEQ ID NO: 167991 - DNA, 25 bp, Homo sapien
gcagttgtccaatttgaacaacaca

SEQ ID NO: 167992 - DNA, 25 bp, Homo sapien
catgcttctgaagtggacatattca

SEQ ID NO: 167993 - DNA, 25 bp, Homo sapien
gtggacatattcagccttggcgaga

SEQ ID NO: 167994 - DNA, 25 bp, Homo sapien
atattcagccttggcgagaagctcc

SEQ ID NO: 167995 - DNA, 25 bp, Homo sapien
ttcagccttggcgagaagctccgtt

SEQ ID NO: 167996 - DNA, 25 bp, Homo sapien
agccttggcgagaagctccgttgca

SEQ ID NO: 167997 - DNA, 25 bp, Homo sapien
gagaagctccgttgcacgggtttcc

SEQ ID NO: 167998 - DNA, 25 bp, Homo sapien
gtttccccttgagcccattttacag

SEQ ID NO: 167999 - DNA, 25 bp, Homo sapien
gtgcactagcttgttacagctgcct

SEQ ID NO: 168000 - DNA, 25 bp, Homo sapien
ggcaccttctccagtaggattcgga

SEQ ID NO: 168001 - DNA, 25 bp, Homo sapien
tcagagtcttcccaataaagatgag

SEQ ID NO: 168002 - DNA, 25 bp, Homo sapien
gagtcttcccaataaagatgagttt

SEQ ID NO: 168003 - DNA, 25 bp, Homo sapien
gaacctgcagatatgcgcccagaga

SEQ ID NO: 168004 - DNA, 25 bp, Homo sapien
acctgcagatatgcgcccagagata

SEQ ID NO: 168005 - DNA, 25 bp, Homo sapien
atatgcgcccagagatatggatcgc

SEQ ID NO: 168006 - DNA, 25 bp, Homo sapien
gcgcccagagatatggatcgcccaa

SEQ ID NO: 168007 - DNA, 25 bp, Homo sapien
cagagatatggatcgcccaagagtt

SEQ ID NO: 168008 - DNA, 25 bp, Homo sapien
atatggatcgcccaagagttgcggc

SEQ ID NO: 168009 - DNA, 25 bp, Homo sapien
ggatcgcccaagagttgcggcgtat

SEQ ID NO: 168010 - DNA, 25 bp, Homo sapien
ggagacgagtttaacgcttactatg

SEQ ID NO: 168011 - DNA, 25 bp, Homo sapien
agacgagtttaacgcttactatgca

SEQ ID NO: 168012 - DNA, 25 bp, Homo sapien
gagtttaacgcttactatgcaagga

SEQ ID NO: 168013 - DNA, 25 bp, Homo sapien
taacgcttactatgcaaggagggta

SEQ ID NO: 168014 - DNA, 25 bp, Homo sapien
taccctgttctgtcttatggagcag

SEQ ID NO: 168015 - DNA, 25 bp, Homo sapien
gagcagcccagattatctttactcc

SEQ ID NO: 168016 - DNA, 25 bp, Homo sapien
gcaaccctgaagataatcaaggcca

SEQ ID NO: 168017 - DNA, 25 bp, Homo sapien
atcaaggccagttactcatcatctc

SEQ ID NO: 168018 - DNA, 25 bp, Homo sapien
caactgcccttcatatgtcatggtt

SEQ ID NO: 168019 - DNA, 25 bp, Homo sapien
gtcatggttttcagatccattccaa

SEQ ID NO: 168020 - DNA, 25 bp, Homo sapien
cagatccattccaacctgactgaat

SEQ ID NO: 168021 - DNA, 25 bp, Homo sapien
gttaacagacagaattcttcacatt

SEQ ID NO: 168022 - DNA, 25 bp, Homo sapien
attcttcacattaaggaactgtctt

SEQ ID NO: 168023 - DNA, 25 bp, Homo sapien
gtcttcatcatcatacatgtagaaa

SEQ ID NO: 168024 - DNA, 25 bp, Homo sapien
atttaagtgcgaagttttctctaga

SEQ ID NO: 168025 - DNA, 25 bp, Homo sapien
tgaagaagttcttaaatacgttgtt

SEQ ID NO: 168026 - DNA, 25 bp, Homo sapien
aatggtattagttgaccagggcagt

SEQ ID NO: 168027 - DNA, 25 bp, Homo sapien
attagttgaccagggcagtgaaaat

SEQ ID NO: 168028 - DNA, 25 bp, Homo sapien
aatgaaaccgcattttgggtgccat

SEQ ID NO: 168029 - DNA, 25 bp, Homo sapien
gaaaccgcattttgggtgccattaa

SEQ ID NO: 168030 - DNA, 25 bp, Homo sapien
accgcattttgggtgccattaaata

SEQ ID NO: 168031 - DNA, 25 bp, Homo sapien
cattttgggtgccattaaataggga

SEQ ID NO: 168032 - DNA, 25 bp, Homo sapien
aaatggagaccaattgcactaggca

SEQ ID NO: 168033 - DNA, 25 bp, Homo sapien
tggagaccaattgcactaggcaagt

SEQ ID NO: 168034 - DNA, 25 bp, Homo sapien
gaccaattgcactaggcaagtgtat

SEQ ID NO: 168035 - DNA, 25 bp, Homo sapien
actaggcaagtgtatattttgtatt

SEQ ID NO: 168036 - DNA, 25 bp, Homo sapien
cagaggtgtccgtaatgggattttc

SEQ ID NO: 168037 - DNA, 25 bp, Homo sapien
tacctggcctggtgtaagtgaggca

SEQ ID NO: 168038 - DNA, 25 bp, Homo sapien
taagtgaggcacaccctggtggcta

SEQ ID NO: 168039 - DNA, 25 bp, Homo sapien
gtggctacaagtcctccttcaaaga

SEQ ID NO: 168040 - DNA, 25 bp, Homo sapien
gatgatgatcagacccaagcacttt

SEQ ID NO: 168041 - DNA, 25 bp, Homo sapien
gacccaagcactttaagccataaat

SEQ ID NO: 168042 - DNA, 25 bp, Homo sapien
agccataaatcactctgttcattcc

SEQ ID NO: 168043 - DNA, 25 bp, Homo sapien
tgttcattcctccaggtattcgtta

SEQ ID NO: 168044 - DNA, 25 bp, Homo sapien
ggtattcgttatctaatagggcaat

SEQ ID NO: 168045 - DNA, 25 bp, Homo sapien
gggcaattaattccttcagcacttt

SEQ ID NO: 168046 - DNA, 25 bp, Homo sapien
tccttcagcactttagaatatgcct

SEQ ID NO: 168047 - DNA, 25 bp, Homo sapien
gaatgtcttcttcttgctgtttgcc

SEQ ID NO: 168048 - DNA, 25 bp, Homo sapien
gctgtttgccgttaacctgttagga

SEQ ID NO: 168049 - DNA, 25 bp, Homo sapien
taacctgttaggactactcttctac

SEQ ID NO: 168050 - DNA, 25 bp, Homo sapien
ttaggactactcttctacctcatat

SEQ ID NO: 168051 - DNA, 25 bp, Homo sapien
actactcttctacctcatatttgga

SEQ ID NO: 168052 - DNA, 25 bp, Homo sapien
tacctcatatttggagaagcagatg

SEQ ID NO: 168053 - DNA, 25 bp, Homo sapien
gaagcagatgtccaagaatgggcta

SEQ ID NO: 168054 - DNA, 25 bp, Homo sapien
gagaaaactcactcgtttatgaagt

SEQ ID NO: 168055 - DNA, 25 bp, Homo sapien
actcgtttatgaagttatcccacct

SEQ ID NO: 168056 - DNA, 25 bp, Homo sapien
aaagtcattaggcaccgtattgcat

SEQ ID NO: 168057 - DNA, 25 bp, Homo sapien
attaggcaccgtattgcataaaata

SEQ ID NO: 168058 - DNA, 25 bp, Homo sapien
tttcccactgagcacatcatggcta

SEQ ID NO: 168059 - DNA, 25 bp, Homo sapien
agcacatcatggctacctgacttgg

SEQ ID NO: 168060 - DNA, 25 bp, Homo sapien
acctgacttggtgggagttccattc

SEQ ID NO: 168061 - DNA, 25 bp, Homo sapien
agttccattcagtcacttctgtttc

SEQ ID NO: 168062 - DNA, 25 bp, Homo sapien
atagctttactgaggtacaattcac

SEQ ID NO: 168063 - DNA, 25 bp, Homo sapien
cataccatgtaattcacccacggga

SEQ ID NO: 168064 - DNA, 25 bp, Homo sapien
tcacccacgggaagtgtatgattca

SEQ ID NO: 168065 - DNA, 25 bp, Homo sapien
ggtttctaatacacacttctgcagc

SEQ ID NO: 168066 - DNA, 25 bp, Homo sapien
attaccaccgtcaactttacgacat

SEQ ID NO: 168067 - DNA, 25 bp, Homo sapien
ctttacgacattttcatcagcccaa

SEQ ID NO: 168068 - DNA, 25 bp, Homo sapien
accccagtaaccactcagaataggt

SEQ ID NO: 168069 - DNA, 25 bp, Homo sapien
tactttttcattcttctctcagtct

SEQ ID NO: 168070 - DNA, 25 bp, Homo sapien
ctctcagtcttaaagatccgctctt

SEQ ID NO: 168071 - DNA, 25 bp, Homo sapien
taaagatccgctctttcagtgggag

SEQ ID NO: 168072 - DNA, 25 bp, Homo sapien
aagaagaccttttctacatgcgcct

SEQ ID NO: 168073 - DNA, 25 bp, Homo sapien
acctgacttcagtgacgatctacca

SEQ ID NO: 168074 - DNA, 25 bp, Homo sapien
taccaagggactctcctctttattt

SEQ ID NO: 168075 - DNA, 25 bp, Homo sapien
tctttatttactcacggcccagcta

SEQ ID NO: 168076 - DNA, 25 bp, Homo sapien
ctacctgtattctccaaacactgat

SEQ ID NO: 168077 - DNA, 25 bp, Homo sapien
agtgttctacaccattttcattcca

SEQ ID NO: 168078 - DNA, 25 bp, Homo sapien
ttcattccagtgctgaatccgttga

SEQ ID NO: 168079 - DNA, 25 bp, Homo sapien
aaggatgcagctgagaaagttctaa

SEQ ID NO: 168080 - DNA, 25 bp, Homo sapien
gaaggcgcttcccaacttcatactg

SEQ ID NO: 168081 - DNA, 25 bp, Homo sapien
gcttcccaacttcatactggcagga

SEQ ID NO: 168082 - DNA, 25 bp, Homo sapien
caacttcatactggcaggagggtga

SEQ ID NO: 168083 - DNA, 25 bp, Homo sapien
ggtgaggaggttcactgagctcccc

SEQ ID NO: 168084 - DNA, 25 bp, Homo sapien
gagacagaagcctggactctgcccc

SEQ ID NO: 168085 - DNA, 25 bp, Homo sapien
tggagggtcccggtttgtcagttct

SEQ ID NO: 168086 - DNA, 25 bp, Homo sapien
cccggtttgtcagttcttggtgctc

SEQ ID NO: 168087 - DNA, 25 bp, Homo sapien
agagagggatgggttcctgctccaa

SEQ ID NO: 168088 - DNA, 25 bp, Homo sapien
ggatgggttcctgctccaagggacc

SEQ ID NO: 168089 - DNA, 25 bp, Homo sapien
ggttcctgctccaagggaccctttg

SEQ ID NO: 168090 - DNA, 25 bp, Homo sapien
caagggaccctttgcctttcttctg

SEQ ID NO: 168091 - DNA, 25 bp, Homo sapien
tggaatcctttgtgagcctccttca

SEQ ID NO: 168092 - DNA, 25 bp, Homo sapien
tcctgagcatgctgggtgccgtcct

SEQ ID NO: 168093 - DNA, 25 bp, Homo sapien
ggtgccgtcctctgggtgaacagac

SEQ ID NO: 168094 - DNA, 25 bp, Homo sapien
gtcctctgggtgaacagacctcaga

SEQ ID NO: 168095 - DNA, 25 bp, Homo sapien
tcagagaagctctagaagcaggcag

SEQ ID NO: 168096 - DNA, 25 bp, Homo sapien
ctagaagcaggcagaattggcccaa

SEQ ID NO: 168097 - DNA, 25 bp, Homo sapien
ggcccaagggtgagaaccagtagca

SEQ ID NO: 168098 - DNA, 25 bp, Homo sapien
gaaccagtagcatctgctgtccatc

SEQ ID NO: 168099 - DNA, 25 bp, Homo sapien
gtagcatctgctgtccatcaaggcc

SEQ ID NO: 168100 - DNA, 25 bp, Homo sapien
aaggccctgtgctgcaacagagccc

SEQ ID NO: 168101 - DNA, 25 bp, Homo sapien
gaccatcaaggcctgcaacagagcc

SEQ ID NO: 168102 - DNA, 25 bp, Homo sapien
tgttcgactcctccaactatcatgg

SEQ ID NO: 168103 - DNA, 25 bp, Homo sapien
ctccaactatcatggccaagacctg

SEQ ID NO: 168104 - DNA, 25 bp, Homo sapien
ggccaagacctgcttttcaaggatg

SEQ ID NO: 168105 - DNA, 25 bp, Homo sapien
aagacctgcttttcaaggatgccac

SEQ ID NO: 168106 - DNA, 25 bp, Homo sapien
ttcaaggatgccaccgtccgggcgg

SEQ ID NO: 168107 - DNA, 25 bp, Homo sapien
gtgcctgtcggagagaaaaccacct

SEQ ID NO: 168108 - DNA, 25 bp, Homo sapien
ggagagaaaaccacctaccgcggct

SEQ ID NO: 168109 - DNA, 25 bp, Homo sapien
gaaaaccacctaccgcggctggctg

SEQ ID NO: 168110 - DNA, 25 bp, Homo sapien
gctggactacgtggcggcgctggaa

SEQ ID NO: 168111 - DNA, 25 bp, Homo sapien
gaagggatgtcgtctcagcagtgct

SEQ ID NO: 168112 - DNA, 25 bp, Homo sapien
tcgtctcagcagtgctcgggcgcag

SEQ ID NO: 168113 - DNA, 25 bp, Homo sapien
attcagataatctgttaacagcgtt

SEQ ID NO: 168114 - DNA, 25 bp, Homo sapien
tctgttaacagcgtttttctcgtcc

SEQ ID NO: 168115 - DNA, 25 bp, Homo sapien
cccttcaacttctacatttactggc

SEQ ID NO: 168116 - DNA, 25 bp, Homo sapien
caacttctacatttactggctttta

SEQ ID NO: 168117 - DNA, 25 bp, Homo sapien
aaatgcatacttttcagaagtgata

SEQ ID NO: 168118 - DNA, 25 bp, Homo sapien
gtgataaggatcatattcttgaaat

SEQ ID NO: 168119 - DNA, 25 bp, Homo sapien
tttaccagctttgtttacagaccca

SEQ ID NO: 168120 - DNA, 25 bp, Homo sapien
agctttgtttacagacccaaatgta

SEQ ID NO: 168121 - DNA, 25 bp, Homo sapien
aattttctacagaattgaatacctg

SEQ ID NO: 168122 - DNA, 25 bp, Homo sapien
agaataaacttgtgactggtcttgt

SEQ ID NO: 168123 - DNA, 25 bp, Homo sapien
taaacttgtgactggtcttgtttta

SEQ ID NO: 168124 - DNA, 25 bp, Homo sapien
tgggatgggccaccacaccactgga

SEQ ID NO: 168125 - DNA, 25 bp, Homo sapien
atgggccaccacaccactggatatt

SEQ ID NO: 168126 - DNA, 25 bp, Homo sapien
ctgggagtcactgctgacaccatct

SEQ ID NO: 168127 - DNA, 25 bp, Homo sapien
gggagtcactgctgacaccatctct

SEQ ID NO: 168128 - DNA, 25 bp, Homo sapien
gtctgggtgggaaacattggtctct

SEQ ID NO: 168129 - DNA, 25 bp, Homo sapien
gggaaacattggtctctaccaggat

SEQ ID NO: 168130 - DNA, 25 bp, Homo sapien
aaacattggtctctaccaggatccc

SEQ ID NO: 168131 - DNA, 25 bp, Homo sapien
attggtctctaccaggatccctgcc

SEQ ID NO: 168132 - DNA, 25 bp, Homo sapien
acctctccccaattaagtgccttca

SEQ ID NO: 168133 - DNA, 25 bp, Homo sapien
gtgccttcacacagcactggtttaa

SEQ ID NO: 168134 - DNA, 25 bp, Homo sapien
cttcacacagcactggtttaatgtt

SEQ ID NO: 168135 - DNA, 25 bp, Homo sapien
caggctgtgttcttgcatcttgtct

SEQ ID NO: 168136 - DNA, 25 bp, Homo sapien
atcttgtctgcaaacaggtccctgc

SEQ ID NO: 168137 - DNA, 25 bp, Homo sapien
gtccctgcctttttagaagcagcct

SEQ ID NO: 168138 - DNA, 25 bp, Homo sapien
tttttagaagcagcctcatggtctc

SEQ ID NO: 168139 - DNA, 25 bp, Homo sapien
tggtctcatgcttaatcttgtctct

SEQ ID NO: 168140 - DNA, 25 bp, Homo sapien
tcttctcttctttatgatgttcact

SEQ ID NO: 168141 - DNA, 25 bp, Homo sapien
aaaacccctgagctggactgttgag

SEQ ID NO: 168142 - DNA, 25 bp, Homo sapien
tggactgttgagcaggcctgtctct

SEQ ID NO: 168143 - DNA, 25 bp, Homo sapien
ggcctgtctctcctattaagtaaaa

SEQ ID NO: 168144 - DNA, 25 bp, Homo sapien
gtatgtttgtaagctattctgacag

SEQ ID NO: 168145 - DNA, 25 bp, Homo sapien
gaatgtacagcttatggacaaatgt

SEQ ID NO: 168146 - DNA, 25 bp, Homo sapien
gcgacctaggcgatggaagctccag

SEQ ID NO: 168147 - DNA, 25 bp, Homo sapien
taggcgatggaagctccagcactgg

SEQ ID NO: 168148 - DNA, 25 bp, Homo sapien
tccagcactggcagcgtgggcagtc

SEQ ID NO: 168149 - DNA, 25 bp, Homo sapien
tgggcagtccggatcagttgcccct

SEQ ID NO: 168150 - DNA, 25 bp, Homo sapien
tgttcccccgatgattgaaggcact

SEQ ID NO: 168151 - DNA, 25 bp, Homo sapien
cccgatgattgaaggcactgcttcc

SEQ ID NO: 168152 - DNA, 25 bp, Homo sapien
gggccgctggcatggactaagaaat

SEQ ID NO: 168153 - DNA, 25 bp, Homo sapien
cgctggcatggactaagaaatcctg

SEQ ID NO: 168154 - DNA, 25 bp, Homo sapien
gaaatcctgacaccaagaagggccc

SEQ ID NO: 168155 - DNA, 25 bp, Homo sapien
aagaagggcccctcgctcttgctgg

SEQ ID NO: 168156 - DNA, 25 bp, Homo sapien
ctcgctcttgctggcagggcagcag

SEQ ID NO: 168157 - DNA, 25 bp, Homo sapien
tattgcttttccttccctaattcat

SEQ ID NO: 168158 - DNA, 25 bp, Homo sapien
cttttccttccctaattcatacaat

SEQ ID NO: 168159 - DNA, 25 bp, Homo sapien
aaaataaactatacctcttcaagag

SEQ ID NO: 168160 - DNA, 25 bp, Homo sapien
ctcttcaagaggtatcctgttctgt

SEQ ID NO: 168161 - DNA, 25 bp, Homo sapien
ggtatcctgttctgtaagatcagat

SEQ ID NO: 168162 - DNA, 25 bp, Homo sapien
cagatgtttttattgcaggtcaata

SEQ ID NO: 168163 - DNA, 25 bp, Homo sapien
ggtcaatataatactgccagagaca

SEQ ID NO: 168164 - DNA, 25 bp, Homo sapien
cttatcagtcccttagtgcctcttt

SEQ ID NO: 168165 - DNA, 25 bp, Homo sapien
cctctttctgtttgtggcatggtga

SEQ ID NO: 168166 - DNA, 25 bp, Homo sapien
aacccatgctgaaaagattgtactt

SEQ ID NO: 168167 - DNA, 25 bp, Homo sapien
tgtactttgtgatcccaatcagagg

SEQ ID NO: 168168 - DNA, 25 bp, Homo sapien
aactgtatgtgctgtaatttaattt

SEQ ID NO: 168169 - DNA, 25 bp, Homo sapien
ggacacatttagatgcactaccatt

SEQ ID NO: 168170 - DNA, 25 bp, Homo sapien
agatgcactaccattgctgttctac

SEQ ID NO: 168171 - DNA, 25 bp, Homo sapien
actaccattgctgttctactttttg

SEQ ID NO: 168172 - DNA, 25 bp, Homo sapien
gctgttctactttttggtacaggta

SEQ ID NO: 168173 - DNA, 25 bp, Homo sapien
ggtacaggtatattttgacgtcact

SEQ ID NO: 168174 - DNA, 25 bp, Homo sapien
ggtatattttgacgtcactgatatt

SEQ ID NO: 168175 - DNA, 25 bp, Homo sapien
gatatacttactcatggccttgtct

SEQ ID NO: 168176 - DNA, 25 bp, Homo sapien
ggccttgtctaacttttgtgaagaa

SEQ ID NO: 168177 - DNA, 25 bp, Homo sapien
gactcattacaaatggttaccttgt

SEQ ID NO: 168178 - DNA, 25 bp, Homo sapien
gttctcttatgatcaccatgtattt

SEQ ID NO: 168179 - DNA, 25 bp, Homo sapien
gcatcacttcatggagttatgttgg

SEQ ID NO: 168180 - DNA, 25 bp, Homo sapien
gaagccagggaatcgcctagactct

SEQ ID NO: 168181 - DNA, 25 bp, Homo sapien
cctagactctcgcactgaaaattgt

SEQ ID NO: 168182 - DNA, 25 bp, Homo sapien
gaaaattgtctctccagctgtgtag

SEQ ID NO: 168183 - DNA, 25 bp, Homo sapien
tgtagaccgcttcattgacaccact

SEQ ID NO: 168184 - DNA, 25 bp, Homo sapien
actcttgccatcaccagtcggtttg

SEQ ID NO: 168185 - DNA, 25 bp, Homo sapien
agtcggtttgcccagattgtacaga

SEQ ID NO: 168186 - DNA, 25 bp, Homo sapien
gaaaggagggcagtaggccatcccc

SEQ ID NO: 168187 - DNA, 25 bp, Homo sapien
gcaaaggacttgttactaagcagat

SEQ ID NO: 168188 - DNA, 25 bp, Homo sapien
ggaaggctatcaacccattgtcaga

SEQ ID NO: 168189 - DNA, 25 bp, Homo sapien
cccattgtcagatcagcatcaggct

SEQ ID NO: 168190 - DNA, 25 bp, Homo sapien
acacagagcccccattcaaaatggg

SEQ ID NO: 168191 - DNA, 25 bp, Homo sapien
ggagtgtgcaaagccctgatctgga

SEQ ID NO: 168192 - DNA, 25 bp, Homo sapien
agccctgatctggagttacctgagg

SEQ ID NO: 168193 - DNA, 25 bp, Homo sapien
tctggagttacctgaggccatagct

SEQ ID NO: 168194 - DNA, 25 bp, Homo sapien
ttacctgaggccatagctgccctat

SEQ ID NO: 168195 - DNA, 25 bp, Homo sapien
atagctgccctattcacttctaagg

SEQ ID NO: 168196 - DNA, 25 bp, Homo sapien
ctattcacttctaagggccctgttt

SEQ ID NO: 168197 - DNA, 25 bp, Homo sapien
ctaagggccctgttttgagattgtt

SEQ ID NO: 168198 - DNA, 25 bp, Homo sapien
ggccctgttttgagattgtttgttc

SEQ ID NO: 168199 - DNA, 25 bp, Homo sapien
gagattgtttgttctaatttatttt

SEQ ID NO: 168200 - DNA, 25 bp, Homo sapien
ttattttaagctaggtaaggctggg

SEQ ID NO: 168201 - DNA, 25 bp, Homo sapien
ggacacgctatcaaaacactttagt

SEQ ID NO: 168202 - DNA, 25 bp, Homo sapien
gtgcagacatggatcattgtcctat

SEQ ID NO: 168203 - DNA, 25 bp, Homo sapien
atgagagtgtaagctcctcaagcac

SEQ ID NO: 168204 - DNA, 25 bp, Homo sapien
aagcacagctcgtgcttccgtttgt

SEQ ID NO: 168205 - DNA, 25 bp, Homo sapien
tgcttccgtttgtgcactctggctg

SEQ ID NO: 168206 - DNA, 25 bp, Homo sapien
actctggctgctgtagtgtatgctt

SEQ ID NO: 168207 - DNA, 25 bp, Homo sapien
ctgtagtgtatgcttctctgtgtcc

SEQ ID NO: 168208 - DNA, 25 bp, Homo sapien
ctctgtgtcctgatatatcaactta

SEQ ID NO: 168209 - DNA, 25 bp, Homo sapien
atcaacttattgctcatctcctttg

SEQ ID NO: 168210 - DNA, 25 bp, Homo sapien
gcatcagaggttaaggtcccctttc

SEQ ID NO: 168211 - DNA, 25 bp, Homo sapien
tccctattatggcatgcattacact

SEQ ID NO: 168212 - DNA, 25 bp, Homo sapien
agtttgacaagaacttctcagccca

SEQ ID NO: 168213 - DNA, 25 bp, Homo sapien
tcctggcccggctgagcatctatag

SEQ ID NO: 168214 - DNA, 25 bp, Homo sapien
tgagcatctatagcaccagtgactg

SEQ ID NO: 168215 - DNA, 25 bp, Homo sapien
gcaccagtgactgtgagcacggcat

SEQ ID NO: 168216 - DNA, 25 bp, Homo sapien
cagtgactgtgagcacggcatggcc

SEQ ID NO: 168217 - DNA, 25 bp, Homo sapien
atggccagcgtcatctccaggcttg

SEQ ID NO: 168218 - DNA, 25 bp, Homo sapien
atctccaggcttgacttcaatggtt

SEQ ID NO: 168219 - DNA, 25 bp, Homo sapien
ttcaatggtttctacacggagcgcc

SEQ ID NO: 168220 - DNA, 25 bp, Homo sapien
gtttctacacggagcgcctggagcg

SEQ ID NO: 168221 - DNA, 25 bp, Homo sapien
agggtcgcagtcaccgcacagtgag

SEQ ID NO: 168222 - DNA, 25 bp, Homo sapien
acagtgagccctggctgtgacagga

SEQ ID NO: 168223 - DNA, 25 bp, Homo sapien
atgtgtgtaagaatggatgctatat

SEQ ID NO: 168224 - DNA, 25 bp, Homo sapien
atggatgctatataggtattttacc

SEQ ID NO: 168225 - DNA, 25 bp, Homo sapien
atgctatataggtattttaccaacc

SEQ ID NO: 168226 - DNA, 25 bp, Homo sapien
gaaaattctatgatattaagcacag

SEQ ID NO: 168227 - DNA, 25 bp, Homo sapien
aattctatgatattaagcacagttt

SEQ ID NO: 168228 - DNA, 25 bp, Homo sapien
gtagtatatgtatagcttattaccc

SEQ ID NO: 168229 - DNA, 25 bp, Homo sapien
atgtatagcttattacccttttgac

SEQ ID NO: 168230 - DNA, 25 bp, Homo sapien
gtatagcttattacccttttgacag

SEQ ID NO: 168231 - DNA, 25 bp, Homo sapien
tccttttttgtatatgatgtgtcca

SEQ ID NO: 168232 - DNA, 25 bp, Homo sapien
gtatatgatgtgtccagtaagtatt

SEQ ID NO: 168233 - DNA, 25 bp, Homo sapien
atgatgtgtccagtaagtattcaat

SEQ ID NO: 168234 - DNA, 25 bp, Homo sapien
ccccaatacccaatgaacagcagtt

SEQ ID NO: 168235 - DNA, 25 bp, Homo sapien
gcagttagccagactgacggattat

SEQ ID NO: 168236 - DNA, 25 bp, Homo sapien
gacggattatgtggctttccttgaa

SEQ ID NO: 168237 - DNA, 25 bp, Homo sapien
aactgatttatcactctgagttcaa

SEQ ID NO: 168238 - DNA, 25 bp, Homo sapien
cactctgagttcaagattcatcttc

SEQ ID NO: 168239 - DNA, 25 bp, Homo sapien
attcatcttcagaatcctgtatact

SEQ ID NO: 168240 - DNA, 25 bp, Homo sapien
cctgtatactggacaaacgtaggaa

SEQ ID NO: 168241 - DNA, 25 bp, Homo sapien
atttattgggatgggctttaagcac

SEQ ID NO: 168242 - DNA, 25 bp, Homo sapien
caggcattcctttactatggtggat

SEQ ID NO: 168243 - DNA, 25 bp, Homo sapien
ttgttcccttaaacgtttatggctg

SEQ ID NO: 168244 - DNA, 25 bp, Homo sapien
cttaaacgtttatggctgaataggt

SEQ ID NO: 168245 - DNA, 25 bp, Homo sapien
ccccaatacccaatgaacagcagtt

SEQ ID NO: 168246 - DNA, 25 bp, Homo sapien
atgaacagcagttagccagactgac

SEQ ID NO: 168247 - DNA, 25 bp, Homo sapien
gcagttagccagactgacggattat

SEQ ID NO: 168248 - DNA, 25 bp, Homo sapien
cagactgacggattatgtggctttc

SEQ ID NO: 168249 - DNA, 25 bp, Homo sapien
gacggattatgtggctttccttgaa

SEQ ID NO: 168250 - DNA, 25 bp, Homo sapien
gattatgtggctttccttgaaaact

SEQ ID NO: 168251 - DNA, 25 bp, Homo sapien
tgaaaactgatttatcactctgagt

SEQ ID NO: 168252 - DNA, 25 bp, Homo sapien
aactgatttatcactctgagttcaa

SEQ ID NO: 168253 - DNA, 25 bp, Homo sapien
atcactctgagttcaagattcatct

SEQ ID NO: 168254 - DNA, 25 bp, Homo sapien
ctgagttcaagattcatcttcagaa

SEQ ID NO: 168255 - DNA, 25 bp, Homo sapien
ttcatcttcagaatcctgtatactg

SEQ ID NO: 168256 - DNA, 25 bp, Homo sapien
ctggatggtcacctcagtagatacc

SEQ ID NO: 168257 - DNA, 25 bp, Homo sapien
gtagataccagaacccacgagaagc

SEQ ID NO: 168258 - DNA, 25 bp, Homo sapien
cacgagaagctgatcccatgactaa

SEQ ID NO: 168259 - DNA, 25 bp, Homo sapien
gtgcaggccgaactagatgagacca

SEQ ID NO: 168260 - DNA, 25 bp, Homo sapien
attctgcacaacaccatggagtctc

SEQ ID NO: 168261 - DNA, 25 bp, Homo sapien
acttggtgtccaaatccgaggtgct

SEQ ID NO: 168262 - DNA, 25 bp, Homo sapien
gctgggaacacagtctaaagccttc

SEQ ID NO: 168263 - DNA, 25 bp, Homo sapien
taaagccttctataaaactgcccgg

SEQ ID NO: 168264 - DNA, 25 bp, Homo sapien
gaaacaaaactcatgctgtgccatc

SEQ ID NO: 168265 - DNA, 25 bp, Homo sapien
aggcccaatgctggaatggcaccat

SEQ ID NO: 168266 - DNA, 25 bp, Homo sapien
atggcaccatcattcacatcagaac

SEQ ID NO: 168267 - DNA, 25 bp, Homo sapien
gctagaggcacagcggccacatggt

SEQ ID NO: 168268 - DNA, 25 bp, Homo sapien
atggtgctggctctgaacgttggtt

SEQ ID NO: 168269 - DNA, 25 bp, Homo sapien
gtggctggaaaacagccctgcttct

SEQ ID NO: 168270 - DNA, 25 bp, Homo sapien
ttctgagggccgctcagttctgcac

SEQ ID NO: 168271 - DNA, 25 bp, Homo sapien
tgcacacgaaaccacctcctgaggg

SEQ ID NO: 168272 - DNA, 25 bp, Homo sapien
gcaagcaccaggcatcctttgtgtt

SEQ ID NO: 168273 - DNA, 25 bp, Homo sapien
atcctttgtgttgtcaactccgtgt

SEQ ID NO: 168274 - DNA, 25 bp, Homo sapien
gtcaactccgtgtaaccagtaacta

SEQ ID NO: 168275 - DNA, 25 bp, Homo sapien
gccatttacaattgactccgtttcc

SEQ ID NO: 168276 - DNA, 25 bp, Homo sapien
tccttttgtaggtttccctgtctgt

SEQ ID NO: 168277 - DNA, 25 bp, Homo sapien
ttccctgtctgtctgtgttagtaga

SEQ ID NO: 168278 - DNA, 25 bp, Homo sapien
gggtagacttaggaacgctctactt

SEQ ID NO: 168279 - DNA, 25 bp, Homo sapien
aacgctctacttcgtaaaagcatta

SEQ ID NO: 168280 - DNA, 25 bp, Homo sapien
acgctctacttcgtaaaagcattat

SEQ ID NO: 168281 - DNA, 25 bp, Homo sapien
cgctctacttcgtaaaagcattata

SEQ ID NO: 168282 - DNA, 25 bp, Homo sapien
gctctacttcgtaaaagcattatac

SEQ ID NO: 168283 - DNA, 25 bp, Homo sapien
aaagcattatacaaagtcacgggag

SEQ ID NO: 168284 - DNA, 25 bp, Homo sapien
aagcattatacaaagtcacgggaga

SEQ ID NO: 168285 - DNA, 25 bp, Homo sapien
gcattatacaaagtcacgggagaaa

SEQ ID NO: 168286 - DNA, 25 bp, Homo sapien
atgggacatttcttgattatactta

SEQ ID NO: 168287 - DNA, 25 bp, Homo sapien
aatttgattagattatagagtccta

SEQ ID NO: 168288 - DNA, 25 bp, Homo sapien
gattagattatagagtcctaagtat

SEQ ID NO: 168289 - DNA, 25 bp, Homo sapien
tgcgtctttgtttctatcagtcttt

SEQ ID NO: 168290 - DNA, 25 bp, Homo sapien
gtttctatcagtctttgtagaagca

SEQ ID NO: 168291 - DNA, 25 bp, Homo sapien
aggtgggtcccgcagaggccctgag

SEQ ID NO: 168292 - DNA, 25 bp, Homo sapien
gaggcctcacttttcggatcttctg

SEQ ID NO: 168293 - DNA, 25 bp, Homo sapien
acttttcggatcttctgtcccagat

SEQ ID NO: 168294 - DNA, 25 bp, Homo sapien
agccttctgaaagccggcgctgcag

SEQ ID NO: 168295 - DNA, 25 bp, Homo sapien
agccagaggccgcacgctgcactgt

SEQ ID NO: 168296 - DNA, 25 bp, Homo sapien
tgcactgtcgcgacgcagagaggct

SEQ ID NO: 168297 - DNA, 25 bp, Homo sapien
acgcagagaggcttctgtgcaggct

SEQ ID NO: 168298 - DNA, 25 bp, Homo sapien
ggatcgggccccatgtctgtgctgt

SEQ ID NO: 168299 - DNA, 25 bp, Homo sapien
gtctgtgctgtctagtttgtgttca

SEQ ID NO: 168300 - DNA, 25 bp, Homo sapien
tacagacatgaactgccaggcccgg

SEQ ID NO: 168301 - DNA, 25 bp, Homo sapien
acagacatgaactgccaggcccggc

SEQ ID NO: 168302 - DNA, 25 bp, Homo sapien
gacatgaactgccaggcccggccaa

SEQ ID NO: 168303 - DNA, 25 bp, Homo sapien
acatgaactgccaggcccggccaaa

SEQ ID NO: 168304 - DNA, 25 bp, Homo sapien
gccaggcccggccaaaataatgcac

SEQ ID NO: 168305 - DNA, 25 bp, Homo sapien
caggcccggccaaaataatgcacca

SEQ ID NO: 168306 - DNA, 25 bp, Homo sapien
aggcccggccaaaataatgcaccac

SEQ ID NO: 168307 - DNA, 25 bp, Homo sapien
ggcccggccaaaataatgcaccact

SEQ ID NO: 168308 - DNA, 25 bp, Homo sapien
cccggccaaaataatgcaccacttt

SEQ ID NO: 168309 - DNA, 25 bp, Homo sapien
ggccaaaataatgcaccacttttaa

SEQ ID NO: 168310 - DNA, 25 bp, Homo sapien
ccaaaataatgcaccacttttaaca

SEQ ID NO: 168311 - DNA, 25 bp, Homo sapien
aatttcttggtctccgaaaactcag

SEQ ID NO: 168312 - DNA, 25 bp, Homo sapien
ttggtctccgaaaactcagctgtga

SEQ ID NO: 168313 - DNA, 25 bp, Homo sapien
tcagctgtgactgctttccattaac

SEQ ID NO: 168314 - DNA, 25 bp, Homo sapien
ctttccattaacagttccagctcta

SEQ ID NO: 168315 - DNA, 25 bp, Homo sapien
ccagctctatgtgtttcctctaacg

SEQ ID NO: 168316 - DNA, 25 bp, Homo sapien
gtgtttcctctaacgctaaaggcac

SEQ ID NO: 168317 - DNA, 25 bp, Homo sapien
tactgcttcctaagagtctccatgg

SEQ ID NO: 168318 - DNA, 25 bp, Homo sapien
gtctccatggagtctattttacaac

SEQ ID NO: 168319 - DNA, 25 bp, Homo sapien
tggagtctattttacaacctccttt

SEQ ID NO: 168320 - DNA, 25 bp, Homo sapien
atgcttccgcggaggagtctatact

SEQ ID NO: 168321 - DNA, 25 bp, Homo sapien
ggaggagtctatactatctctatat

SEQ ID NO: 168322 - DNA, 25 bp, Homo sapien
gggtagcgtccattgcctgttcctc

SEQ ID NO: 168323 - DNA, 25 bp, Homo sapien
attgcctgttcctcatgcgtgcgag

SEQ ID NO: 168324 - DNA, 25 bp, Homo sapien
ttcctcatgcgtgcgagccgtggat

SEQ ID NO: 168325 - DNA, 25 bp, Homo sapien
tctgcggtcagtgtgagcgagccct

SEQ ID NO: 168326 - DNA, 25 bp, Homo sapien
tgtggcctcgtggactgcagtgaca

SEQ ID NO: 168327 - DNA, 25 bp, Homo sapien
gcctcgtggactgcagtgacatgta

SEQ ID NO: 168328 - DNA, 25 bp, Homo sapien
ctgcagtgacatgtacgagaaagtg

SEQ ID NO: 168329 - DNA, 25 bp, Homo sapien
tacgagaaagtgctgtgcaccagct

SEQ ID NO: 168330 - DNA, 25 bp, Homo sapien
tgcaccagctgtgccatgttcgaga

SEQ ID NO: 168331 - DNA, 25 bp, Homo sapien
ttcaccgggagccacgccgtgcatg

SEQ ID NO: 168332 - DNA, 25 bp, Homo sapien
tgcatggcagccttccctggacgag

SEQ ID NO: 168333 - DNA, 25 bp, Homo sapien
ctgtgatgtgaatggcaccgaagtc

SEQ ID NO: 168334 - DNA, 25 bp, Homo sapien
gcaccgaagtcagatgagtatccct

SEQ ID NO: 168335 - DNA, 25 bp, Homo sapien
gatgagtatccctgtaggtcacctg

SEQ ID NO: 168336 - DNA, 25 bp, Homo sapien
tgtaggtcacctgcagcctgcgttg

SEQ ID NO: 168337 - DNA, 25 bp, Homo sapien
agcctgcgttgccacttgtcttaac

SEQ ID NO: 168338 - DNA, 25 bp, Homo sapien
gttgccacttgtcttaactctgaat

SEQ ID NO: 168339 - DNA, 25 bp, Homo sapien
gtgctaaaatctgaaatctgctagt

SEQ ID NO: 168340 - DNA, 25 bp, Homo sapien
atctgctagtgtgaaacttgctcta

SEQ ID NO: 168341 - DNA, 25 bp, Homo sapien
tgaaacttgctctactctctgaaat

SEQ ID NO: 168342 - DNA, 25 bp, Homo sapien
ttgctctactctctgaaatgattca

SEQ ID NO: 168343 - DNA, 25 bp, Homo sapien
aatacactaattttccatactttat

SEQ ID NO: 168344 - DNA, 25 bp, Homo sapien
ttcctggtaaaaattacagggctct

SEQ ID NO: 168345 - DNA, 25 bp, Homo sapien
tcctggtaaaaattacagggctcta

SEQ ID NO: 168346 - DNA, 25 bp, Homo sapien
cctggtaaaaattacagggctctat

SEQ ID NO: 168347 - DNA, 25 bp, Homo sapien
ctggtaaaaattacagggctctatt

SEQ ID NO: 168348 - DNA, 25 bp, Homo sapien
tggtaaaaattacagggctctattt

SEQ ID NO: 168349 - DNA, 25 bp, Homo sapien
taaaaattacagggctctatttaag

SEQ ID NO: 168350 - DNA, 25 bp, Homo sapien
aaattacagggctctatttaaggat

SEQ ID NO: 168351 - DNA, 25 bp, Homo sapien
aattacagggctctatttaaggatg

SEQ ID NO: 168352 - DNA, 25 bp, Homo sapien
attacagggctctatttaaggatgt

SEQ ID NO: 168353 - DNA, 25 bp, Homo sapien
atgtctcagatctaatattaaaatc

SEQ ID NO: 168354 - DNA, 25 bp, Homo sapien
tgtctcagatctaatattaaaatca

SEQ ID NO: 168355 - DNA, 25 bp, Homo sapien
catgggctccagtcaactatgggac

SEQ ID NO: 168356 - DNA, 25 bp, Homo sapien
tgaaggtcctaattgctcacccaag

SEQ ID NO: 168357 - DNA, 25 bp, Homo sapien
aaacagcctcagacccgaggtttag

SEQ ID NO: 168358 - DNA, 25 bp, Homo sapien
atttgacaccaaccaatcatactgg

SEQ ID NO: 168359 - DNA, 25 bp, Homo sapien
atcatactggacaaggcccttagag

SEQ ID NO: 168360 - DNA, 25 bp, Homo sapien
ggcccttagaggacttgaaatatac

SEQ ID NO: 168361 - DNA, 25 bp, Homo sapien
aatatacttctcatgctgtagttta

SEQ ID NO: 168362 - DNA, 25 bp, Homo sapien
gtttatttaggctgtgactctctct

SEQ ID NO: 168363 - DNA, 25 bp, Homo sapien
taggctgtgactctctctctaatgc

SEQ ID NO: 168364 - DNA, 25 bp, Homo sapien
ctctcgggaaggacgaaagtgacct

SEQ ID NO: 168365 - DNA, 25 bp, Homo sapien
aaatgcaaccatacatgggctccag

SEQ ID NO: 168366 - DNA, 25 bp, Homo sapien
tttgcagttttttcagtgcaggcag

SEQ ID NO: 168367 - DNA, 25 bp, Homo sapien
agtgcaggcagtttttcctttcagg

SEQ ID NO: 168368 - DNA, 25 bp, Homo sapien
agatgctttgtagatgaacagatgc

SEQ ID NO: 168369 - DNA, 25 bp, Homo sapien
gcagagtatctgttatcattgtatt

SEQ ID NO: 168370 - DNA, 25 bp, Homo sapien
atcattgtattgtttagtgtcagtg

SEQ ID NO: 168371 - DNA, 25 bp, Homo sapien
gtttagtgtcagtgtatcatttagt

SEQ ID NO: 168372 - DNA, 25 bp, Homo sapien
cagtgtatcatttagtatttgtatc

SEQ ID NO: 168373 - DNA, 25 bp, Homo sapien
tgtatcactgtaccatttagtgttg

SEQ ID NO: 168374 - DNA, 25 bp, Homo sapien
agtcatttaatattggttatcacca

SEQ ID NO: 168375 - DNA, 25 bp, Homo sapien
gtatcatttggttcattgtatcgtt

SEQ ID NO: 168376 - DNA, 25 bp, Homo sapien
atttggttcattgtatcgtttagta

SEQ ID NO: 168377 - DNA, 25 bp, Homo sapien
agaccccacactccatggagtctgg

SEQ ID NO: 168378 - DNA, 25 bp, Homo sapien
gaccccacactccatggagtctgga

SEQ ID NO: 168379 - DNA, 25 bp, Homo sapien
accccacactccatggagtctggaa

SEQ ID NO: 168380 - DNA, 25 bp, Homo sapien
cccacactccatggagtctggaatg

SEQ ID NO: 168381 - DNA, 25 bp, Homo sapien
ccacactccatggagtctggaatgc

SEQ ID NO: 168382 - DNA, 25 bp, Homo sapien
acactccatggagtctggaatgcat

SEQ ID NO: 168383 - DNA, 25 bp, Homo sapien
cactccatggagtctggaatgcatg

SEQ ID NO: 168384 - DNA, 25 bp, Homo sapien
actccatggagtctggaatgcatgg

SEQ ID NO: 168385 - DNA, 25 bp, Homo sapien
agtctggaatgcatgggagctgccc

SEQ ID NO: 168386 - DNA, 25 bp, Homo sapien
cagtggacaccattggaccccaccc

SEQ ID NO: 168387 - DNA, 25 bp, Homo sapien
cacccagcctggatctaccccagga

SEQ ID NO: 168388 - DNA, 25 bp, Homo sapien
gctgtgcttgaagcctcgtgccaca

SEQ ID NO: 168389 - DNA, 25 bp, Homo sapien
tcgtgccacactggctttgaggtag

SEQ ID NO: 168390 - DNA, 25 bp, Homo sapien
ctggctttgaggtagcacgctgcaa

SEQ ID NO: 168391 - DNA, 25 bp, Homo sapien
gaggtagcacgctgcaagttagtga

SEQ ID NO: 168392 - DNA, 25 bp, Homo sapien
acgctgcaagttagtgagtggagtt

SEQ ID NO: 168393 - DNA, 25 bp, Homo sapien
tagtgagtggagttgcccaagtctg

SEQ ID NO: 168394 - DNA, 25 bp, Homo sapien
gggcttctgaaatgacctggtattt

SEQ ID NO: 168395 - DNA, 25 bp, Homo sapien
atgacctggtatttttatgttcctg

SEQ ID NO: 168396 - DNA, 25 bp, Homo sapien
ctgttagaaatggtgtggctttcac

SEQ ID NO: 168397 - DNA, 25 bp, Homo sapien
ggctttcacaaattaagtgccaggc

SEQ ID NO: 168398 - DNA, 25 bp, Homo sapien
ggcaggcgggttgcttgagctccgg

SEQ ID NO: 168399 - DNA, 25 bp, Homo sapien
gagaagtcgattctccggcaacgac

SEQ ID NO: 168400 - DNA, 25 bp, Homo sapien
gaagtcgattctccggcaacgacgc

SEQ ID NO: 168401 - DNA, 25 bp, Homo sapien
gattctccggcaacgacgctgtctg

SEQ ID NO: 168402 - DNA, 25 bp, Homo sapien
ggcaacgacgctgtctgccccagga

SEQ ID NO: 168403 - DNA, 25 bp, Homo sapien
cggctcagccacagatgcctgagga

SEQ ID NO: 168404 - DNA, 25 bp, Homo sapien
gctcagccacagatgcctgaggacc

SEQ ID NO: 168405 - DNA, 25 bp, Homo sapien
tgaggacctcgacaggggtcacccc

SEQ ID NO: 168406 - DNA, 25 bp, Homo sapien
cactggactgacctgccctgagcgg

SEQ ID NO: 168407 - DNA, 25 bp, Homo sapien
ggatgcagtgttgcactgatgactt

SEQ ID NO: 168408 - DNA, 25 bp, Homo sapien
cagtgttgcactgatgacttgacca

SEQ ID NO: 168409 - DNA, 25 bp, Homo sapien
gtgttgcactgatgacttgaccagc

SEQ ID NO: 168410 - DNA, 25 bp, Homo sapien
ctttagtttaaccatcagggcagac

SEQ ID NO: 168411 - DNA, 25 bp, Homo sapien
aaccatcagggcagacaggaacaaa

SEQ ID NO: 168412 - DNA, 25 bp, Homo sapien
agtatttcaaagcttgttccatcaa

SEQ ID NO: 168413 - DNA, 25 bp, Homo sapien
aagcttgttccatcaagttagggat

SEQ ID NO: 168414 - DNA, 25 bp, Homo sapien
gggattaatcgattcctttatgttt

SEQ ID NO: 168415 - DNA, 25 bp, Homo sapien
gagtttaccggccaaagcatattgt

SEQ ID NO: 168416 - DNA, 25 bp, Homo sapien
aaagcatattgtcatctttggtcat

SEQ ID NO: 168417 - DNA, 25 bp, Homo sapien
atctttggtcatttttctgctcctg

SEQ ID NO: 168418 - DNA, 25 bp, Homo sapien
tggtcatttttctgctcctgcttct

SEQ ID NO: 168419 - DNA, 25 bp, Homo sapien
gggtatcaacattaccgcccctgtc

SEQ ID NO: 168420 - DNA, 25 bp, Homo sapien
cctgtctcttctgtaactacttcag

SEQ ID NO: 168421 - DNA, 25 bp, Homo sapien
aggaagaaccagtcacctttcactt

SEQ ID NO: 168422 - DNA, 25 bp, Homo sapien
agaaccagtcacctttcacttcttg

SEQ ID NO: 168423 - DNA, 25 bp, Homo sapien
cacctttcacttcttggccaaattt

SEQ ID NO: 168424 - DNA, 25 bp, Homo sapien
cttcttggccaaattttatcctgag

SEQ ID NO: 168425 - DNA, 25 bp, Homo sapien
cttggccaaattttatcctgagaat

SEQ ID NO: 168426 - DNA, 25 bp, Homo sapien
attttatcctgagaatgctgaagag

SEQ ID NO: 168427 - DNA, 25 bp, Homo sapien
aagaggagctggttcaggagatcac

SEQ ID NO: 168428 - DNA, 25 bp, Homo sapien
gagctggttcaggagatcacacaac

SEQ ID NO: 168429 - DNA, 25 bp, Homo sapien
ggttcaggagatcacacaacattta

SEQ ID NO: 168430 - DNA, 25 bp, Homo sapien
ggagatcacacaacatttattcttc

SEQ ID NO: 168431 - DNA, 25 bp, Homo sapien
acatttattcttcttacaggtaaag

SEQ ID NO: 168432 - DNA, 25 bp, Homo sapien
gatacaagagaagccaggaggtcta

SEQ ID NO: 168433 - DNA, 25 bp, Homo sapien
ggaggtctatgatggtgacgatttt

SEQ ID NO: 168434 - DNA, 25 bp, Homo sapien
gatgccaaggccacaaaagccaaga

SEQ ID NO: 168435 - DNA, 25 bp, Homo sapien
gagtggtggaccaggctcgaacact

SEQ ID NO: 168436 - DNA, 25 bp, Homo sapien
ccaggctcgaacactggccgaggag

SEQ ID NO: 168437 - DNA, 25 bp, Homo sapien
gtcctgctcccacagtttggaggga

SEQ ID NO: 168438 - DNA, 25 bp, Homo sapien
ttggagggacaaagctaattgatct

SEQ ID NO: 168439 - DNA, 25 bp, Homo sapien
tgatctgtcacactcaggctcatgg

SEQ ID NO: 168440 - DNA, 25 bp, Homo sapien
actcaggctcatgggcaggcacaag

SEQ ID NO: 168441 - DNA, 25 bp, Homo sapien
gaaggcactgctgggagccattaga

SEQ ID NO: 168442 - DNA, 25 bp, Homo sapien
gggagccattagaacacagatacaa

SEQ ID NO: 168443 - DNA, 25 bp, Homo sapien
tagacttaggaattttctacttggt

SEQ ID NO: 168444 - DNA, 25 bp, Homo sapien
ggaattttctacttggtaaaagcat

SEQ ID NO: 168445 - DNA, 25 bp, Homo sapien
tttctacttggtaaaagcattatac

SEQ ID NO: 168446 - DNA, 25 bp, Homo sapien
aaagcattatacagtcataggagaa

SEQ ID NO: 168447 - DNA, 25 bp, Homo sapien
gcattatacagtcataggagaaaga

SEQ ID NO: 168448 - DNA, 25 bp, Homo sapien
gatatgggacatttctataatctat

SEQ ID NO: 168449 - DNA, 25 bp, Homo sapien
gacatttctataatctatattctaa

SEQ ID NO: 168450 - DNA, 25 bp, Homo sapien
atctatattctaatttgattcgatt

SEQ ID NO: 168451 - DNA, 25 bp, Homo sapien
taatttgattcgattattgagtcgt

SEQ ID NO: 168452 - DNA, 25 bp, Homo sapien
attcgattattgagtcgtaagtatt

SEQ ID NO: 168453 - DNA, 25 bp, Homo sapien
tcgattattgagtcgtaagtattaa

SEQ ID NO: 168454 - DNA, 25 bp, Homo sapien
cagttttattctcatgtacctaagt

SEQ ID NO: 168455 - DNA, 25 bp, Homo sapien
tattctcatgtacctaagttgtgga

SEQ ID NO: 168456 - DNA, 25 bp, Homo sapien
gcatcctataaactgcctgcagacg

SEQ ID NO: 168457 - DNA, 25 bp, Homo sapien
tgcagacgttagcaggctcttcaaa

SEQ ID NO: 168458 - DNA, 25 bp, Homo sapien
aggctcttcaaaataactccatggt

SEQ ID NO: 168459 - DNA, 25 bp, Homo sapien
atggtgcacaggagcacctgcatcc

SEQ ID NO: 168460 - DNA, 25 bp, Homo sapien
gcatccaagagcatgcttacatttt

SEQ ID NO: 168461 - DNA, 25 bp, Homo sapien
gcttacattttactgttctgcatat

SEQ ID NO: 168462 - DNA, 25 bp, Homo sapien
acttgcaacttcataacttctttga

SEQ ID NO: 168463 - DNA, 25 bp, Homo sapien
aataaactgcatcgagatccaaccg

SEQ ID NO: 168464 - DNA, 25 bp, Homo sapien
gagatccaaccgactgaattgttaa

SEQ ID NO: 168465 - DNA, 25 bp, Homo sapien
gaagcctcagagttaccctctttga

SEQ ID NO: 168466 - DNA, 25 bp, Homo sapien
aaacaagatagagcttgggcttgcg

SEQ ID NO: 168467 - DNA, 25 bp, Homo sapien
gcccagttccagaggtggaagttac

SEQ ID NO: 168468 - DNA, 25 bp, Homo sapien
tacagaagaggaggtacctgggcca

SEQ ID NO: 168469 - DNA, 25 bp, Homo sapien
ctgggccacacgacatgagctggaa

SEQ ID NO: 168470 - DNA, 25 bp, Homo sapien
gttggagtagcacaattgcctgttt

SEQ ID NO: 168471 - DNA, 25 bp, Homo sapien
ttgcctgttttagggcagaaaccat

SEQ ID NO: 168472 - DNA, 25 bp, Homo sapien
aaccatgggctatgttaatgtccta

SEQ ID NO: 168473 - DNA, 25 bp, Homo sapien
aatgtcctaatgtgtagctagcaga

SEQ ID NO: 168474 - DNA, 25 bp, Homo sapien
gcagatcgtagctagtttgtattgt

SEQ ID NO: 168475 - DNA, 25 bp, Homo sapien
tgtattgtcttgtcaattgtacaga

SEQ ID NO: 168476 - DNA, 25 bp, Homo sapien
aaggactactccaccaagtaccgct

SEQ ID NO: 168477 - DNA, 25 bp, Homo sapien
aagtaccgctactgaggcgccctca

SEQ ID NO: 168478 - DNA, 25 bp, Homo sapien
cgccctcagtctgcgcggataaatg

SEQ ID NO: 168479 - DNA, 25 bp, Homo sapien
ataaatgtcgtggagccctttttgt

SEQ ID NO: 168480 - DNA, 25 bp, Homo sapien
ggctggagcacctctgagatggaat

SEQ ID NO: 168481 - DNA, 25 bp, Homo sapien
gataacatggtcttaactcaccgaa

SEQ ID NO: 168482 - DNA, 25 bp, Homo sapien
aaacaagcacgtggtgagaggagca

SEQ ID NO: 168483 - DNA, 25 bp, Homo sapien
aggagcaggcctacttgtttgttct

SEQ ID NO: 168484 - DNA, 25 bp, Homo sapien
ggcctacttgtttgttctcaggaaa

SEQ ID NO: 168485 - DNA, 25 bp, Homo sapien
tactgattttcctagtcaaagttaa

SEQ ID NO: 168486 - DNA, 25 bp, Homo sapien
tcaaagttaattcttacccttggag

SEQ ID NO: 168487 - DNA, 25 bp, Homo sapien
gttcagattgctttgattaatccag

SEQ ID NO: 168488 - DNA, 25 bp, Homo sapien
gattaatccagaataactagcacca

SEQ ID NO: 168489 - DNA, 25 bp, Homo sapien
taactagcaccagggactatgaatg

SEQ ID NO: 168490 - DNA, 25 bp, Homo sapien
gggactatgaatgggcaaaactgaa

SEQ ID NO: 168491 - DNA, 25 bp, Homo sapien
gaggctgataattccagtggtccat

SEQ ID NO: 168492 - DNA, 25 bp, Homo sapien
ccagtggtccatggaatgcttgaaa

SEQ ID NO: 168493 - DNA, 25 bp, Homo sapien
atgtgcaaaacagcgtttaagactg

SEQ ID NO: 168494 - DNA, 25 bp, Homo sapien
gactgtaatgaatctaagcagcatt

SEQ ID NO: 168495 - DNA, 25 bp, Homo sapien
gcagcatttctgaagtggactcttt

SEQ ID NO: 168496 - DNA, 25 bp, Homo sapien
atttctgaagtggactctttggtgg

SEQ ID NO: 168497 - DNA, 25 bp, Homo sapien
aatgtctgccacacaaacgtatgta

SEQ ID NO: 168498 - DNA, 25 bp, Homo sapien
gttttcttgcattttgctctccatt

SEQ ID NO: 168499 - DNA, 25 bp, Homo sapien
cattttgctctccattcagcatgtg

SEQ ID NO: 168500 - DNA, 25 bp, Homo sapien
tgtgggtgtggatgtttataaacaa

SEQ ID NO: 168501 - DNA, 25 bp, Homo sapien
aagtctgacttcataagggctttct

SEQ ID NO: 168502 - DNA, 25 bp, Homo sapien
taagggctttctaaaaccatttctg

SEQ ID NO: 168503 - DNA, 25 bp, Homo sapien
aaatgactttttgctttgatattaa

SEQ ID NO: 168504 - DNA, 25 bp, Homo sapien
aagctagtcaaatgtgttagcagca

SEQ ID NO: 168505 - DNA, 25 bp, Homo sapien
ttctctctcactatacagtatattg

SEQ ID NO: 168506 - DNA, 25 bp, Homo sapien
gaaatgtcgatcctgttgtaactga

SEQ ID NO: 168507 - DNA, 25 bp, Homo sapien
gatcctgttgtaactgattgtgaac

SEQ ID NO: 168508 - DNA, 25 bp, Homo sapien
ctgattgtgaacacttttatgagct

SEQ ID NO: 168509 - DNA, 25 bp, Homo sapien
cggcagctcagcaagtggtggacca

SEQ ID NO: 168510 - DNA, 25 bp, Homo sapien
tcagcaagtggtggaccaggccaca

SEQ ID NO: 168511 - DNA, 25 bp, Homo sapien
tggccaagaccacccaggaaaccat

SEQ ID NO: 168512 - DNA, 25 bp, Homo sapien
gaccacccaggaaaccatcgacaag

SEQ ID NO: 168513 - DNA, 25 bp, Homo sapien
ggaaaccatcgacaagactgctaac

SEQ ID NO: 168514 - DNA, 25 bp, Homo sapien
aagactgctaaccaggcctctgaca

SEQ ID NO: 168515 - DNA, 25 bp, Homo sapien
gatcgggaaaaaattcggcctcctg

SEQ ID NO: 168516 - DNA, 25 bp, Homo sapien
attcggcctcctgaaatgacagcag

SEQ ID NO: 168517 - DNA, 25 bp, Homo sapien
acttgggtcggcctcctgaaatgat

SEQ ID NO: 168518 - DNA, 25 bp, Homo sapien
gggtcggcctcctgaaatgatagca

SEQ ID NO: 168519 - DNA, 25 bp, Homo sapien
tagcagggagacttgggtgaccccc

SEQ ID NO: 168520 - DNA, 25 bp, Homo sapien
ttcacacattcctgaccagagatcc

SEQ ID NO: 168521 - DNA, 25 bp, Homo sapien
acacattcctgaccagagatcccag

SEQ ID NO: 168522 - DNA, 25 bp, Homo sapien
gagggcaacttcagggctggccacc

SEQ ID NO: 168523 - DNA, 25 bp, Homo sapien
tcctcagttgaagtttgatgaattg

SEQ ID NO: 168524 - DNA, 25 bp, Homo sapien
tttgatgaattgaagtcgggcctct

SEQ ID NO: 168525 - DNA, 25 bp, Homo sapien
gatgaattgaagtcgggcctctatg

SEQ ID NO: 168526 - DNA, 25 bp, Homo sapien
ttgaagtcgggcctctatgccaact

SEQ ID NO: 168527 - DNA, 25 bp, Homo sapien
tctatgccaactggttccttttgtt

SEQ ID NO: 168528 - DNA, 25 bp, Homo sapien
atgccaactggttccttttgttctc

SEQ ID NO: 168529 - DNA, 25 bp, Homo sapien
caactggttccttttgttctcaata

SEQ ID NO: 168530 - DNA, 25 bp, Homo sapien
ctggttccttttgttctcaataaat

SEQ ID NO: 168531 - DNA, 25 bp, Homo sapien
accaatagataatgcgaagacttcc

SEQ ID NO: 168532 - DNA, 25 bp, Homo sapien
aagacttccttagaaattcatattt

SEQ ID NO: 168533 - DNA, 25 bp, Homo sapien
atttatttgtccacttgaagccata

SEQ ID NO: 168534 - DNA, 25 bp, Homo sapien
gaagccatattattttctgatttat

SEQ ID NO: 168535 - DNA, 25 bp, Homo sapien
tattttcttaagtgccaatgggccc

SEQ ID NO: 168536 - DNA, 25 bp, Homo sapien
tgccaatgggcccaccttttaaaca

SEQ ID NO: 168537 - DNA, 25 bp, Homo sapien
aataacttgggccatcctatcatct

SEQ ID NO: 168538 - DNA, 25 bp, Homo sapien
atcctatcatctggagccctagtat

SEQ ID NO: 168539 - DNA, 25 bp, Homo sapien
ctggagccctagtatctaatttttt

SEQ ID NO: 168540 - DNA, 25 bp, Homo sapien
tggtgattaaactccattgttcagg

SEQ ID NO: 168541 - DNA, 25 bp, Homo sapien
aactccattgttcagggtaaaggct

SEQ ID NO: 168542 - DNA, 25 bp, Homo sapien
aggagtttaatgcagtgatctttgt

SEQ ID NO: 168543 - DNA, 25 bp, Homo sapien
gtgatctttgtttttggcacatcaa

SEQ ID NO: 168544 - DNA, 25 bp, Homo sapien
atgtttcttttatgctgctggcttt

SEQ ID NO: 168545 - DNA, 25 bp, Homo sapien
gcttttgtgccctggaagatcataa

SEQ ID NO: 168546 - DNA, 25 bp, Homo sapien
tgtgccctggaagatcataatagtg

SEQ ID NO: 168547 - DNA, 25 bp, Homo sapien
atacatgcagacttgttttttatta

SEQ ID NO: 168548 - DNA, 25 bp, Homo sapien
tttttacctggtgaacttgctatct

SEQ ID NO: 168549 - DNA, 25 bp, Homo sapien
tacctggtgaacttgctatctgctc

SEQ ID NO: 168550 - DNA, 25 bp, Homo sapien
tggtgaacttgctatctgctctgtt

SEQ ID NO: 168551 - DNA, 25 bp, Homo sapien
gaacttgctatctgctctgtttcta

SEQ ID NO: 168552 - DNA, 25 bp, Homo sapien
gctatctgctctgtttctagttaaa

SEQ ID NO: 168553 - DNA, 25 bp, Homo sapien
tggagtccccagagatatcagccac

SEQ ID NO: 168554 - DNA, 25 bp, Homo sapien
agatatcagccaccgagtctcctgg

SEQ ID NO: 168555 - DNA, 25 bp, Homo sapien
gagtctcctggtctgtctccaggct

SEQ ID NO: 168556 - DNA, 25 bp, Homo sapien
agccgagacgtcaactgtgaagggt

SEQ ID NO: 168557 - DNA, 25 bp, Homo sapien
gacgtcaactgtgaagggttcctgt

SEQ ID NO: 168558 - DNA, 25 bp, Homo sapien
aagggttcctgtgattgcgtttagc

SEQ ID NO: 168559 - DNA, 25 bp, Homo sapien
tgtgattgcgtttagcgccctcccg

SEQ ID NO: 168560 - DNA, 25 bp, Homo sapien
cgttctgtccatttgtcttgtctgc

SEQ ID NO: 168561 - DNA, 25 bp, Homo sapien
atttgtcttgtctgccgactgtccg

SEQ ID NO: 168562 - DNA, 25 bp, Homo sapien
tctgccgactgtccgtgtgtgtttt

SEQ ID NO: 168563 - DNA, 25 bp, Homo sapien
cattttgtacctgttgattttattt

SEQ ID NO: 168564 - DNA, 25 bp, Homo sapien
gcctgaggatagcttcatgagtgtt

SEQ ID NO: 168565 - DNA, 25 bp, Homo sapien
gactgaacatcatcaaacacctctt

SEQ ID NO: 168566 - DNA, 25 bp, Homo sapien
aacacctcttgattataatcggcgt

SEQ ID NO: 168567 - DNA, 25 bp, Homo sapien
taatcggcgtggcacaagcctaatg

SEQ ID NO: 168568 - DNA, 25 bp, Homo sapien
gaagatgttatgatgtcctcagaag

SEQ ID NO: 168569 - DNA, 25 bp, Homo sapien
gaatggattttgacaccatggatat

SEQ ID NO: 168570 - DNA, 25 bp, Homo sapien
gatttgccaccatcaaagaacagac

SEQ ID NO: 168571 - DNA, 25 bp, Homo sapien
gaacagaactgaagcctgatttctt

SEQ ID NO: 168572 - DNA, 25 bp, Homo sapien
gaagcctgatttctttgatccagct

SEQ ID NO: 168573 - DNA, 25 bp, Homo sapien
gatttctttgatccagcttcaatta

SEQ ID NO: 168574 - DNA, 25 bp, Homo sapien
gaatcagttcttggagtgtcaatgt

SEQ ID NO: 168575 - DNA, 25 bp, Homo sapien
gtgggaaattcactcatattaatgg

SEQ ID NO: 168576 - DNA, 25 bp, Homo sapien
ggaggattgtacatataaatactat

SEQ ID NO: 168577 - DNA, 25 bp, Homo sapien
aagactttaatgatttggaatacta

SEQ ID NO: 168578 - DNA, 25 bp, Homo sapien
gaatattaagttttcctctgtgcaa

SEQ ID NO: 168579 - DNA, 25 bp, Homo sapien
tattaagttttcctctgtgcaaatt

SEQ ID NO: 168580 - DNA, 25 bp, Homo sapien
taagttttcctctgtgcaaatttaa

SEQ ID NO: 168581 - DNA, 25 bp, Homo sapien
aacaagagatcgtgttacagtcaca

SEQ ID NO: 168582 - DNA, 25 bp, Homo sapien
gatcgtgttacagtcacaatctact

SEQ ID NO: 168583 - DNA, 25 bp, Homo sapien
gttacagtcacaatctacttttctt

SEQ ID NO: 168584 - DNA, 25 bp, Homo sapien
gtcacaatctacttttcttaaactt

SEQ ID NO: 168585 - DNA, 25 bp, Homo sapien
tttcttaaactttgtatctctagga

SEQ ID NO: 168586 - DNA, 25 bp, Homo sapien
caagaaggccatccctgcgggctgc

SEQ ID NO: 168587 - DNA, 25 bp, Homo sapien
agcatcctggacacggtgctcaaat

SEQ ID NO: 168588 - DNA, 25 bp, Homo sapien
tggacacggtgctcaaatacctgcc

SEQ ID NO: 168589 - DNA, 25 bp, Homo sapien
ggtgctcaaatacctgcccgggccg

SEQ ID NO: 168590 - DNA, 25 bp, Homo sapien
gggccgctgcaggacatgttcaaga

SEQ ID NO: 168591 - DNA, 25 bp, Homo sapien
tgttcaagaagtaaccaggcctcct

SEQ ID NO: 168592 - DNA, 25 bp, Homo sapien
ttcaagaagtaaccaggcctcctgc

SEQ ID NO: 168593 - DNA, 25 bp, Homo sapien
tactccacctgttactacttctttt

SEQ ID NO: 168594 - DNA, 25 bp, Homo sapien
tccacctgttactacttctttttgg

SEQ ID NO: 168595 - DNA, 25 bp, Homo sapien
attaggttaagtctcaattctgaag

SEQ ID NO: 168596 - DNA, 25 bp, Homo sapien
gggaaaacctcagttggcctctgcc

SEQ ID NO: 168597 - DNA, 25 bp, Homo sapien
aagtgacagttgaaagtggtggcat

SEQ ID NO: 168598 - DNA, 25 bp, Homo sapien
gtacaggcaacaggagaaaggaatc

SEQ ID NO: 168599 - DNA, 25 bp, Homo sapien
cttctgcttcactattcagacaaag

SEQ ID NO: 168600 - DNA, 25 bp, Homo sapien
tattcagacaaagacagccctaatg

SEQ ID NO: 168601 - DNA, 25 bp, Homo sapien
acaaagacagccctaatgacatcac

SEQ ID NO: 168602 - DNA, 25 bp, Homo sapien
gacatcaccaacagtcaaagcaatt

SEQ ID NO: 168603 - DNA, 25 bp, Homo sapien
gtcaaagcaattagagaccatacct

SEQ ID NO: 168604 - DNA, 25 bp, Homo sapien
gagaccatacctaatattgtttaaa

SEQ ID NO: 168605 - DNA, 25 bp, Homo sapien
taaattctagatgtaggctaacaat

SEQ ID NO: 168606 - DNA, 25 bp, Homo sapien
tgaaaagtatttgccaaactgaata

SEQ ID NO: 168607 - DNA, 25 bp, Homo sapien
tgaataaaactgtcatggttacctt

SEQ ID NO: 168608 - DNA, 25 bp, Homo sapien
aacgctctacttcgtaaaagcatta

SEQ ID NO: 168609 - DNA, 25 bp, Homo sapien
acgctctacttcgtaaaagcattat

SEQ ID NO: 168610 - DNA, 25 bp, Homo sapien
cgctctacttcgtaaaagcattata

SEQ ID NO: 168611 - DNA, 25 bp, Homo sapien
gctctacttcgtaaaagcattatac

SEQ ID NO: 168612 - DNA, 25 bp, Homo sapien
aaaagcattatacaaagtcacggga

SEQ ID NO: 168613 - DNA, 25 bp, Homo sapien
aaagcattatacaaagtcacgggag

SEQ ID NO: 168614 - DNA, 25 bp, Homo sapien
aagcattatacaaagtcacgggaga

SEQ ID NO: 168615 - DNA, 25 bp, Homo sapien
agcattatacaaagtcacgggagaa

SEQ ID NO: 168616 - DNA, 25 bp, Homo sapien
gcattatacaaagtcacgggagaaa

SEQ ID NO: 168617 - DNA, 25 bp, Homo sapien
aatttgattagattatagagtccta

SEQ ID NO: 168618 - DNA, 25 bp, Homo sapien
gattagattatagagtcctaagtat

SEQ ID NO: 168619 - DNA, 25 bp, Homo sapien
aactctgtatgccataaacctccat

SEQ ID NO: 168620 - DNA, 25 bp, Homo sapien
caccaagtacttgcggttaccctat

SEQ ID NO: 168621 - DNA, 25 bp, Homo sapien
tatcctttttctaacaagcaagtgg

SEQ ID NO: 168622 - DNA, 25 bp, Homo sapien
ttctaagacctttgggacctcatgg

SEQ ID NO: 168623 - DNA, 25 bp, Homo sapien
gggacctcatggattactttccaaa

SEQ ID NO: 168624 - DNA, 25 bp, Homo sapien
ggattactttccaaatctgtccaac

SEQ ID NO: 168625 - DNA, 25 bp, Homo sapien
gtccaactcaatggtctaactctaa

SEQ ID NO: 168626 - DNA, 25 bp, Homo sapien
taatggaaaaacctctccggccagg

SEQ ID NO: 168627 - DNA, 25 bp, Homo sapien
tccggccaggaagttcactgggctt

SEQ ID NO: 168628 - DNA, 25 bp, Homo sapien
agttcactgggcttgccagctttct

SEQ ID NO: 168629 - DNA, 25 bp, Homo sapien
gccaaagttgctgcttgcatctgaa

SEQ ID NO: 168630 - DNA, 25 bp, Homo sapien
ctgctaactacagtgtggccctaaa

SEQ ID NO: 168631 - DNA, 25 bp, Homo sapien
gtggccctaaattacagcgtcatca

SEQ ID NO: 168632 - DNA, 25 bp, Homo sapien
agcgtcatcaaggagtcagaccatt

SEQ ID NO: 168633 - DNA, 25 bp, Homo sapien
gtcagaccatttcagcacagagctt

SEQ ID NO: 168634 - DNA, 25 bp, Homo sapien
tcttttgatgacacctgcttggctt

SEQ ID NO: 168635 - DNA, 25 bp, Homo sapien
tgcttggcttctgaggtatccttta

SEQ ID NO: 168636 - DNA, 25 bp, Homo sapien
aattggtttttgctcttttgcagaa

SEQ ID NO: 168637 - DNA, 25 bp, Homo sapien
tttgcatttatctcaacagtgccat

SEQ ID NO: 168638 - DNA, 25 bp, Homo sapien
acagtgccatcaacccggtgattta

SEQ ID NO: 168639 - DNA, 25 bp, Homo sapien
gtgatttacaatctcatgtcccaga

SEQ ID NO: 168640 - DNA, 25 bp, Homo sapien
gaaattccgtgcagccttcagaaag

SEQ ID NO: 168641 - DNA, 25 bp, Homo sapien
aattttcaatgattagccgtgtaac

SEQ ID NO: 168642 - DNA, 25 bp, Homo sapien
atgattagccgtgtaactcctgcaa

SEQ ID NO: 168643 - DNA, 25 bp, Homo sapien
ttagccgtgtaactcctgcaatgaa

SEQ ID NO: 168644 - DNA, 25 bp, Homo sapien
gccgtgtaactcctgcaatgaatgt

SEQ ID NO: 168645 - DNA, 25 bp, Homo sapien
ctcctgcaatgaatgtttatgtgat

SEQ ID NO: 168646 - DNA, 25 bp, Homo sapien
gaagcaaatgtgaatcgtattattt

SEQ ID NO: 168647 - DNA, 25 bp, Homo sapien
aaagtggcagagtgacttaactgat

SEQ ID NO: 168648 - DNA, 25 bp, Homo sapien
taactgatcatgcatgatccctcat

SEQ ID NO: 168649 - DNA, 25 bp, Homo sapien
atgatccctcatccctgaaattgag

SEQ ID NO: 168650 - DNA, 25 bp, Homo sapien
tccctcatccctgaaattgagttta

SEQ ID NO: 168651 - DNA, 25 bp, Homo sapien
attcattagctaactttgtctatgt

SEQ ID NO: 168652 - DNA, 25 bp, Homo sapien
ttccatgttttctgagtgctctatg

SEQ ID NO: 168653 - DNA, 25 bp, Homo sapien
gagtgctctatgataaatcagttgc

SEQ ID NO: 168654 - DNA, 25 bp, Homo sapien
gataaatcagttgcatctgtgataa

SEQ ID NO: 168655 - DNA, 25 bp, Homo sapien
cagtgacgctccgagttgaggatgt

SEQ ID NO: 168656 - DNA, 25 bp, Homo sapien
acgctccgagttgaggatgttgaac

SEQ ID NO: 168657 - DNA, 25 bp, Homo sapien
caacatgggaaggtcgcagcgtact

SEQ ID NO: 168658 - DNA, 25 bp, Homo sapien
aaggtcgcagcgtactaagtgaaga

SEQ ID NO: 168659 - DNA, 25 bp, Homo sapien
gaggacagaggaatttctctttcta

SEQ ID NO: 168660 - DNA, 25 bp, Homo sapien
gaggaatttctctttctaggagatt

SEQ ID NO: 168661 - DNA, 25 bp, Homo sapien
ctctttctaggagattttcattttg

SEQ ID NO: 168662 - DNA, 25 bp, Homo sapien
tttcattttgtgtgactcccatggg

SEQ ID NO: 168663 - DNA, 25 bp, Homo sapien
ttctatcatttaagagagcctaaat

SEQ ID NO: 168664 - DNA, 25 bp, Homo sapien
acagtgttagcacagagtaagatct

SEQ ID NO: 168665 - DNA, 25 bp, Homo sapien
gagtaagatctcaatgcacatttgt

SEQ ID NO: 168666 - DNA, 25 bp, Homo sapien
gatctcaatgcacatttgttggatg

SEQ ID NO: 168667 - DNA, 25 bp, Homo sapien
ataaatgcaattgaattcccagaaa

SEQ ID NO: 168668 - DNA, 25 bp, Homo sapien
aaggaagtgacagttctactttaga

SEQ ID NO: 168669 - DNA, 25 bp, Homo sapien
ttggagatgacttttatatcccatt

SEQ ID NO: 168670 - DNA, 25 bp, Homo sapien
ttatatcccattttggtaattattc

SEQ ID NO: 168671 - DNA, 25 bp, Homo sapien
acatagcacatatgaccatgatgtt

SEQ ID NO: 168672 - DNA, 25 bp, Homo sapien
accatgatgttcagggctttataga

SEQ ID NO: 168673 - DNA, 25 bp, Homo sapien
ttcagggctttatagaaccaaataa

SEQ ID NO: 168674 - DNA, 25 bp, Homo sapien
ggagtacgttttcatcgacttatct

SEQ ID NO: 168675 - DNA, 25 bp, Homo sapien
gacttatctatgagcatcttcaaca

SEQ ID NO: 168676 - DNA, 25 bp, Homo sapien
attcctacagttgtatgggtggcat

SEQ ID NO: 168677 - DNA, 25 bp, Homo sapien
gtgtgccaaagacttcaagattcca

SEQ ID NO: 168678 - DNA, 25 bp, Homo sapien
ctttttgatactctgcatgctcttt

SEQ ID NO: 168679 - DNA, 25 bp, Homo sapien
atgctctttgcaatcttctggtagt

SEQ ID NO: 168680 - DNA, 25 bp, Homo sapien
ggtagttgccccagataatttaaag

SEQ ID NO: 168681 - DNA, 25 bp, Homo sapien
gagaacaacttgctaatctggacaa

SEQ ID NO: 168682 - DNA, 25 bp, Homo sapien
agaatatacttcactccttcgtaca

SEQ ID NO: 168683 - DNA, 25 bp, Homo sapien
ccttcgtacaacttcgtgctgatta

SEQ ID NO: 168684 - DNA, 25 bp, Homo sapien
gtgctgattatagatctgcccgcct

SEQ ID NO: 168685 - DNA, 25 bp, Homo sapien
ctaccaggccttctactgccatggg

SEQ ID NO: 168686 - DNA, 25 bp, Homo sapien
tcaactcaaccaaccatgccattgt

SEQ ID NO: 168687 - DNA, 25 bp, Homo sapien
atgccattgtgcagaccctggtcaa

SEQ ID NO: 168688 - DNA, 25 bp, Homo sapien
gcagaccctggtcaattctgtcaat

SEQ ID NO: 168689 - DNA, 25 bp, Homo sapien
cagtatccccaaagcctgttgtgtg

SEQ ID NO: 168690 - DNA, 25 bp, Homo sapien
gttgtgtgcccactgaactgagtgc

SEQ ID NO: 168691 - DNA, 25 bp, Homo sapien
aactgagtgccatctccatgctgta

SEQ ID NO: 168692 - DNA, 25 bp, Homo sapien
tgagtgccatctccatgctgtacct

SEQ ID NO: 168693 - DNA, 25 bp, Homo sapien
gccgctgagatcaggcagtccttga

SEQ ID NO: 168694 - DNA, 25 bp, Homo sapien
atcaggcagtccttgaggatagaca

SEQ ID NO: 168695 - DNA, 25 bp, Homo sapien
ggatagacagatatacacaccacac

SEQ ID NO: 168696 - DNA, 25 bp, Homo sapien
ccctgcccacatctgctggtttggg

SEQ ID NO: 168697 - DNA, 25 bp, Homo sapien
ggagctgacagctgtgagcacacca

SEQ ID NO: 168698 - DNA, 25 bp, Homo sapien
tgcgtccctgcacactgcgaggact

SEQ ID NO: 168699 - DNA, 25 bp, Homo sapien
tccctacgacacgtgactcgtttta

SEQ ID NO: 168700 - DNA, 25 bp, Homo sapien
tgactcgttttagagctctgtccca

SEQ ID NO: 168701 - DNA, 25 bp, Homo sapien
tttagagctctgtcccagaggcgtt

SEQ ID NO: 168702 - DNA, 25 bp, Homo sapien
agaggcgttcgtatgtgacccacag

SEQ ID NO: 168703 - DNA, 25 bp, Homo sapien
tgtgacccacagatggcgtcaatgt

SEQ ID NO: 168704 - DNA, 25 bp, Homo sapien
ggcgtcaatgtgaacacctctcttt

SEQ ID NO: 168705 - DNA, 25 bp, Homo sapien
tctttgtgctgaatttctgggccat

SEQ ID NO: 168706 - DNA, 25 bp, Homo sapien
tgctgaatttctgggccattctttt

SEQ ID NO: 168707 - DNA, 25 bp, Homo sapien
aaggcgtcgggactgtacaccaaca

SEQ ID NO: 168708 - DNA, 25 bp, Homo sapien
gtacaccaacagtctttaactttga

SEQ ID NO: 168709 - DNA, 25 bp, Homo sapien
atcagacgcccaagtttagaacaca

SEQ ID NO: 168710 - DNA, 25 bp, Homo sapien
caggcagcttaattacatacaggtt

SEQ ID NO: 168711 - DNA, 25 bp, Homo sapien
aggtggcagtgactctgacaaccct

SEQ ID NO: 168712 - DNA, 25 bp, Homo sapien
tcagactccaaaaacgcctacaact

SEQ ID NO: 168713 - DNA, 25 bp, Homo sapien
taccaggcgcacagagctgtatgcc

SEQ ID NO: 168714 - DNA, 25 bp, Homo sapien
agctgtatgccgtgatagacatcga

SEQ ID NO: 168715 - DNA, 25 bp, Homo sapien
atcgagagaactgctgctatgtcaa

SEQ ID NO: 168716 - DNA, 25 bp, Homo sapien
aagcactgccacgagatgatggtac

SEQ ID NO: 168717 - DNA, 25 bp, Homo sapien
caatagtactgatctgcccatgtga

SEQ ID NO: 168718 - DNA, 25 bp, Homo sapien
gattcttgcacatgaactgtcacat

SEQ ID NO: 168719 - DNA, 25 bp, Homo sapien
tttttagagagcctcagtcttactg

SEQ ID NO: 168720 - DNA, 25 bp, Homo sapien
agagagcctcagtcttactgatttc

SEQ ID NO: 168721 - DNA, 25 bp, Homo sapien
gtgtattgcttttaagagagccatc

SEQ ID NO: 168722 - DNA, 25 bp, Homo sapien
gagagccatcagttagctatcagac

SEQ ID NO: 168723 - DNA, 25 bp, Homo sapien
agttagctatcagactctaggttga

SEQ ID NO: 168724 - DNA, 25 bp, Homo sapien
gactctaggttgatgcattttgtac

SEQ ID NO: 168725 - DNA, 25 bp, Homo sapien
gttgatgcattttgtacttagctgt

SEQ ID NO: 168726 - DNA, 25 bp, Homo sapien
tagctgtactgtgtgatatttttca

SEQ ID NO: 168727 - DNA, 25 bp, Homo sapien
ttttcattattttaggacgccaaca

SEQ ID NO: 168728 - DNA, 25 bp, Homo sapien
ggacgccaacatgagacctgtaata

SEQ ID NO: 168729 - DNA, 25 bp, Homo sapien
agtagacgattcctctgggtcaatc

SEQ ID NO: 168730 - DNA, 25 bp, Homo sapien
gggtcaatcggaaggcgctatgcca

SEQ ID NO: 168731 - DNA, 25 bp, Homo sapien
ggcgctatgccaggactgatgagat

SEQ ID NO: 168732 - DNA, 25 bp, Homo sapien
attggcgtggcttttggtgtcacca

SEQ ID NO: 168733 - DNA, 25 bp, Homo sapien
ggcttttggtgtcaccattgacttt

SEQ ID NO: 168734 - DNA, 25 bp, Homo sapien
acactgcaactctgagggaccgtga

SEQ ID NO: 168735 - DNA, 25 bp, Homo sapien
ggaccgtgactcaatgcggcagata

SEQ ID NO: 168736 - DNA, 25 bp, Homo sapien
gagatctctgagctgcccagcatag

SEQ ID NO: 168737 - DNA, 25 bp, Homo sapien
tagtccaagacctagccaatggcaa

SEQ ID NO: 168738 - DNA, 25 bp, Homo sapien
atgtggaggccaggtatcctctgtt

SEQ ID NO: 168739 - DNA, 25 bp, Homo sapien
ggtatcctctgtttgaagggcaaga

SEQ ID NO: 168740 - DNA, 25 bp, Homo sapien
ccaaaagggagtctcccatgatggg

SEQ ID NO: 168741 - DNA, 25 bp, Homo sapien
gggcgcactggtgtctgacactaag

SEQ ID NO: 168742 - DNA, 25 bp, Homo sapien
gcgcactggtgtctgacactaagga

SEQ ID NO: 168743 - DNA, 25 bp, Homo sapien
gtgtctgacactaaggagggtgtaa

SEQ ID NO: 168744 - DNA, 25 bp, Homo sapien
ggtgtaaaggccaaggtcagcatag

SEQ ID NO: 168745 - DNA, 25 bp, Homo sapien
catagactgaggcacactggctcct

SEQ ID NO: 168746 - DNA, 25 bp, Homo sapien
gaaattccaccagaaatcaccacat

SEQ ID NO: 168747 - DNA, 25 bp, Homo sapien
tttggaatcttcttccacgggacca

SEQ ID NO: 168748 - DNA, 25 bp, Homo sapien
ttggaatcttcttccacgggaccag

SEQ ID NO: 168749 - DNA, 25 bp, Homo sapien
ggaatcttcttccacgggaccagcc

SEQ ID NO: 168750 - DNA, 25 bp, Homo sapien
accagcccagagctatgccatggaa

SEQ ID NO: 168751 - DNA, 25 bp, Homo sapien
ggctcctggactcattgcttcacaa

SEQ ID NO: 168752 - DNA, 25 bp, Homo sapien
tacccctggatgaagttatctggct

SEQ ID NO: 168753 - DNA, 25 bp, Homo sapien
gttatctggcttcaaatattatgca

SEQ ID NO: 168754 - DNA, 25 bp, Homo sapien
acctgctgatgtggcaactgctgat

SEQ ID NO: 168755 - DNA, 25 bp, Homo sapien
gtggcaactgctgatgctcatggtc

SEQ ID NO: 168756 - DNA, 25 bp, Homo sapien
gatgctcatggtccccatggcatgg

SEQ ID NO: 168757 - DNA, 25 bp, Homo sapien
gagtactttgaagatgtcatcccat

SEQ ID NO: 168758 - DNA, 25 bp, Homo sapien
ttctgacctctataattgccactga

SEQ ID NO: 168759 - DNA, 25 bp, Homo sapien
tgagagatctgctgtcagtctgctt

SEQ ID NO: 168760 - DNA, 25 bp, Homo sapien
gtcagtctgcttatccttccacgga

SEQ ID NO: 168761 - DNA, 25 bp, Homo sapien
tccacggactcaagtttcttcaatc

SEQ ID NO: 168762 - DNA, 25 bp, Homo sapien
gtatgtggaacgttctactttggtt

SEQ ID NO: 168763 - DNA, 25 bp, Homo sapien
gcacaatatatttcttggtatccaa

SEQ ID NO: 168764 - DNA, 25 bp, Homo sapien
taaatttggttggtcctgttggctc

SEQ ID NO: 168765 - DNA, 25 bp, Homo sapien
aatggctgggtctctgggttgcttt

SEQ ID NO: 168766 - DNA, 25 bp, Homo sapien
tgctttttggctggagctgttctca

SEQ ID NO: 168767 - DNA, 25 bp, Homo sapien
tcacctgctgcttatatctttttaa

SEQ ID NO: 168768 - DNA, 25 bp, Homo sapien
gagaaactatccttattccttgagg

SEQ ID NO: 168769 - DNA, 25 bp, Homo sapien
gaggaaagcctattcagccgcgggt

SEQ ID NO: 168770 - DNA, 25 bp, Homo sapien
gcgggtgtttccatggccaagtcat

SEQ ID NO: 168771 - DNA, 25 bp, Homo sapien
cctcgcacagagacggccaaaatgt

SEQ ID NO: 168772 - DNA, 25 bp, Homo sapien
gacggccaaaatgtatgctgtagac

SEQ ID NO: 168773 - DNA, 25 bp, Homo sapien
tttgtgttgacctcatccctggctt

SEQ ID NO: 168774 - DNA, 25 bp, Homo sapien
tagttctccctatgcctgaatatcc

SEQ ID NO: 168775 - DNA, 25 bp, Homo sapien
ttttttataagcaaccacactgtat

SEQ ID NO: 168776 - DNA, 25 bp, Homo sapien
accacactgtattggatgaccctag

SEQ ID NO: 168777 - DNA, 25 bp, Homo sapien
ggatgaccctagatcttctttgaga

SEQ ID NO: 168778 - DNA, 25 bp, Homo sapien
tcttctttgagacaaggcaggctgt

SEQ ID NO: 168779 - DNA, 25 bp, Homo sapien
atgtagccccatcacactgtgtttg

SEQ ID NO: 168780 - DNA, 25 bp, Homo sapien
ctgtgtttgtgattgtctgtgtgtc

SEQ ID NO: 168781 - DNA, 25 bp, Homo sapien
ggcagggaccgtgtcttgtccgttc

SEQ ID NO: 168782 - DNA, 25 bp, Homo sapien
ttgtccgttctctgtatccccagtg

SEQ ID NO: 168783 - DNA, 25 bp, Homo sapien
gcgagtgctcactgtgtatttaata

SEQ ID NO: 168784 - DNA, 25 bp, Homo sapien
ataatttagtggacaagcctgtgaa

SEQ ID NO: 168785 - DNA, 25 bp, Homo sapien
caagcctgtgaaatgattgtacata

SEQ ID NO: 168786 - DNA, 25 bp, Homo sapien
aatggcatgttttattctcgtcaag

SEQ ID NO: 168787 - DNA, 25 bp, Homo sapien
tgttttattctcgtcaaggcacaaa

SEQ ID NO: 168788 - DNA, 25 bp, Homo sapien
gtcaaggcacaaaaccagttcatgc

SEQ ID NO: 168789 - DNA, 25 bp, Homo sapien
cagttcatgcttaacctttttcctt

SEQ ID NO: 168790 - DNA, 25 bp, Homo sapien
agataatattctaagaggctctaga

SEQ ID NO: 168791 - DNA, 25 bp, Homo sapien
atactcagtagtgatgggtttccca

SEQ ID NO: 168792 - DNA, 25 bp, Homo sapien
tgatgggtttcccacttctcctcaa

SEQ ID NO: 168793 - DNA, 25 bp, Homo sapien
aataattactatgtgccctaatgca

SEQ ID NO: 168794 - DNA, 25 bp, Homo sapien
tgtgccctaatgcacacaaatagct

SEQ ID NO: 168795 - DNA, 25 bp, Homo sapien
tgcccaaggagccttccaggggaat

SEQ ID NO: 168796 - DNA, 25 bp, Homo sapien
gggaattagtcctcctctcttctct

SEQ ID NO: 168797 - DNA, 25 bp, Homo sapien
tgccttctgagctgcactttccgtg

SEQ ID NO: 168798 - DNA, 25 bp, Homo sapien
ttctgagctgcactttccgtgggtg

SEQ ID NO: 168799 - DNA, 25 bp, Homo sapien
gagctgcactttccgtgggtgcctt

SEQ ID NO: 168800 - DNA, 25 bp, Homo sapien
actttccgtgggtgccttatgtggt

SEQ ID NO: 168801 - DNA, 25 bp, Homo sapien
ggtggtggttgtgcccagcacagac

SEQ ID NO: 168802 - DNA, 25 bp, Homo sapien
ggcagggttcttgccgtggctcttc

SEQ ID NO: 168803 - DNA, 25 bp, Homo sapien
agggttcttgccgtggctcttcctc

SEQ ID NO: 168804 - DNA, 25 bp, Homo sapien
caggcccaggaggagttttcccagg

SEQ ID NO: 168805 - DNA, 25 bp, Homo sapien
agcagaaccttccacagagctgctt

SEQ ID NO: 168806 - DNA, 25 bp, Homo sapien
gggcttttggaattcgcattgagaa

SEQ ID NO: 168807 - DNA, 25 bp, Homo sapien
attcgcattgagaatgttgtccttg

SEQ ID NO: 168808 - DNA, 25 bp, Homo sapien
ttgtccttgtggttcctgtgaagac

SEQ ID NO: 168809 - DNA, 25 bp, Homo sapien
ggaagcctgacctttgaacctctaa

SEQ ID NO: 168810 - DNA, 25 bp, Homo sapien
gacaaagagtgcgactggctcaaca

SEQ ID NO: 168811 - DNA, 25 bp, Homo sapien
gactggctcaacaattaccacctga

SEQ ID NO: 168812 - DNA, 25 bp, Homo sapien
aattaccacctgacctgcagggatg

SEQ ID NO: 168813 - DNA, 25 bp, Homo sapien
attgcagaaacagggccgccaggaa

SEQ ID NO: 168814 - DNA, 25 bp, Homo sapien
aggaagctctcgagtggctcatcag

SEQ ID NO: 168815 - DNA, 25 bp, Homo sapien
ggctcatcagagagacgcaacccat

SEQ ID NO: 168816 - DNA, 25 bp, Homo sapien
gcaacccatctccaaacagcattaa

SEQ ID NO: 168817 - DNA, 25 bp, Homo sapien
acatgacgggcctcagccggagagt

SEQ ID NO: 168818 - DNA, 25 bp, Homo sapien
tcagccggagagtcatccaggtgtg

SEQ ID NO: 168819 - DNA, 25 bp, Homo sapien
ccaggtgtggtttcaaaactgccgg

SEQ ID NO: 168820 - DNA, 25 bp, Homo sapien
tggtttcaaaactgccgggcgcgtc

SEQ ID NO: 168821 - DNA, 25 bp, Homo sapien
actgccgggcgcgtcataaaaagca

SEQ ID NO: 168822 - DNA, 25 bp, Homo sapien
gtcataaaaagcacacgccgcaaca

SEQ ID NO: 168823 - DNA, 25 bp, Homo sapien
agcgggcgcgcatggtcaccctgca

SEQ ID NO: 168824 - DNA, 25 bp, Homo sapien
accctgcacggctacattgagagtc

SEQ ID NO: 168825 - DNA, 25 bp, Homo sapien
gtcatcctttttcagtactaacgct

SEQ ID NO: 168826 - DNA, 25 bp, Homo sapien
tttttcagtactaacgctgccggca

SEQ ID NO: 168827 - DNA, 25 bp, Homo sapien
tcagtactaacgctgccggcacttc

SEQ ID NO: 168828 - DNA, 25 bp, Homo sapien
acattggaaggacacccctggatgc

SEQ ID NO: 168829 - DNA, 25 bp, Homo sapien
gacctgtaaaacttcactgcagtgg

SEQ ID NO: 168830 - DNA, 25 bp, Homo sapien
gccacttctgaatctctgtaaggtt

SEQ ID NO: 168831 - DNA, 25 bp, Homo sapien
gtttatttatcttcacccctctgga

SEQ ID NO: 168832 - DNA, 25 bp, Homo sapien
tcacccctctggagagaagatgttt

SEQ ID NO: 168833 - DNA, 25 bp, Homo sapien
gaagatgttttaccaaagcctctag

SEQ ID NO: 168834 - DNA, 25 bp, Homo sapien
ttaccaaagcctctagtgtaccgtc

SEQ ID NO: 168835 - DNA, 25 bp, Homo sapien
attctatagtatatccaggttctcc

SEQ ID NO: 168836 - DNA, 25 bp, Homo sapien
caggttctccagatctcttaagact

SEQ ID NO: 168837 - DNA, 25 bp, Homo sapien
taagactgtactatagaggcctggg

SEQ ID NO: 168838 - DNA, 25 bp, Homo sapien
atagccctgaggcaaactatgaatt

SEQ ID NO: 168839 - DNA, 25 bp, Homo sapien
aattttccagatacttgctttaaag

SEQ ID NO: 168840 - DNA, 25 bp, Homo sapien
gctttaaagctacttttgtccacaa

SEQ ID NO: 168841 - DNA, 25 bp, Homo sapien
atactgtcacagtagacgcttaaat

SEQ ID NO: 168842 - DNA, 25 bp, Homo sapien
gtagacgcttaaatgccacgttttc

SEQ ID NO: 168843 - DNA, 25 bp, Homo sapien
aaatgccacgttttcataccaagag

SEQ ID NO: 168844 - DNA, 25 bp, Homo sapien
gttttcataccaagagtcattcatt

SEQ ID NO: 168845 - DNA, 25 bp, Homo sapien
gggtttttcaatgagtggctttact

SEQ ID NO: 168846 - DNA, 25 bp, Homo sapien
ggctttacttatcaatcacaacagg

SEQ ID NO: 168847 - DNA, 25 bp, Homo sapien
gttagtgcaatacaaagtcaccctc

SEQ ID NO: 168848 - DNA, 25 bp, Homo sapien
aacatcagactagacctttgtatgg

SEQ ID NO: 168849 - DNA, 25 bp, Homo sapien
ctagacctttgtatgggagagaatt

SEQ ID NO: 168850 - DNA, 25 bp, Homo sapien
tctctgttgagagcatttcagccag

SEQ ID NO: 168851 - DNA, 25 bp, Homo sapien
tttcagccagaggactttggaactg

SEQ ID NO: 168852 - DNA, 25 bp, Homo sapien
ggactttggaactgtgaatatactt

SEQ ID NO: 168853 - DNA, 25 bp, Homo sapien
agggaggaagctcccatgttgttta

SEQ ID NO: 168854 - DNA, 25 bp, Homo sapien
tggagcagcttttggctgcgtaact

SEQ ID NO: 168855 - DNA, 25 bp, Homo sapien
cttttggctgcgtaactgtgaacta

SEQ ID NO: 168856 - DNA, 25 bp, Homo sapien
actgtgaactatggccatatataat

SEQ ID NO: 168857 - DNA, 25 bp, Homo sapien
gtgcattccttgttaataaactttt

SEQ ID NO: 168858 - DNA, 25 bp, Homo sapien
tttattacagcccaaagagcagtat

SEQ ID NO: 168859 - DNA, 25 bp, Homo sapien
tacagcccaaagagcagtatttatt

SEQ ID NO: 168860 - DNA, 25 bp, Homo sapien
ttgaccattttaaaccgttggcaat

SEQ ID NO: 168861 - DNA, 25 bp, Homo sapien
gtctgtaacatcaacatcttcgcaa

SEQ ID NO: 168862 - DNA, 25 bp, Homo sapien
taacatcaacatcttcgcaatccat

SEQ ID NO: 168863 - DNA, 25 bp, Homo sapien
tcaacatcttcgcaatccatcacaa

SEQ ID NO: 168864 - DNA, 25 bp, Homo sapien
tcgaccccgaaaacgcccagaagag

SEQ ID NO: 168865 - DNA, 25 bp, Homo sapien
aaacgcccagaagaggtcacctatg

SEQ ID NO: 168866 - DNA, 25 bp, Homo sapien
ccagaagaggtcacctatggctttt

SEQ ID NO: 168867 - DNA, 25 bp, Homo sapien
cgaccacagggagccacgcaggacg

SEQ ID NO: 168868 - DNA, 25 bp, Homo sapien
cgcaggacgccggagattgttttgc

SEQ ID NO: 168869 - DNA, 25 bp, Homo sapien
caggacgccggagattgttttgcgt

SEQ ID NO: 168870 - DNA, 25 bp, Homo sapien
gttttgcgtgcggaggacggacttt

SEQ ID NO: 168871 - DNA, 25 bp, Homo sapien
gaggacggactttggctgcgagtag

SEQ ID NO: 168872 - DNA, 25 bp, Homo sapien
gagcatcctggacacggtgctcaaa

SEQ ID NO: 168873 - DNA, 25 bp, Homo sapien
gcatcctggacacggtgctcaaata

SEQ ID NO: 168874 - DNA, 25 bp, Homo sapien
tggacacggtgctcaaatacctgcc

SEQ ID NO: 168875 - DNA, 25 bp, Homo sapien
ggtgctcaaatacctgcccgggccg

SEQ ID NO: 168876 - DNA, 25 bp, Homo sapien
gcaggacatgttcaagaagtaacca

SEQ ID NO: 168877 - DNA, 25 bp, Homo sapien
ttcaagaagtaaccaggcctcctgc

SEQ ID NO: 168878 - DNA, 25 bp, Homo sapien
tactccacctgttactacttctttt

SEQ ID NO: 168879 - DNA, 25 bp, Homo sapien
tccacctgttactacttctttttgg

SEQ ID NO: 168880 - DNA, 25 bp, Homo sapien
tctttttattaggttaagtctcaat

SEQ ID NO: 168881 - DNA, 25 bp, Homo sapien
taggttaagtctcaattctgaaggg

SEQ ID NO: 168882 - DNA, 25 bp, Homo sapien
gggaaaacctcagttggcctctgcc

SEQ ID NO: 168883 - DNA, 25 bp, Homo sapien
agcagcaagagacgtcaccctagaa

SEQ ID NO: 168884 - DNA, 25 bp, Homo sapien
acaggctgcagaacatggaggtcac

SEQ ID NO: 168885 - DNA, 25 bp, Homo sapien
gaggtcaccgatgcttgaacattcc

SEQ ID NO: 168886 - DNA, 25 bp, Homo sapien
ctccctatttgccaggctttcattt

SEQ ID NO: 168887 - DNA, 25 bp, Homo sapien
tgagatctcagagcctgcccaacag

SEQ ID NO: 168888 - DNA, 25 bp, Homo sapien
gcagggaagccaagcacccattcat

SEQ ID NO: 168889 - DNA, 25 bp, Homo sapien
ccccatctgactgcgtagctgagag

SEQ ID NO: 168890 - DNA, 25 bp, Homo sapien
ggaacagtgccatgtaccacacaga

SEQ ID NO: 168891 - DNA, 25 bp, Homo sapien
tgtaccacacagatgttcctgtctc

SEQ ID NO: 168892 - DNA, 25 bp, Homo sapien
ctgtctcctcgcatgggcataggga

SEQ ID NO: 168893 - DNA, 25 bp, Homo sapien
ggcatagggacccatcattgatgac

SEQ ID NO: 168894 - DNA, 25 bp, Homo sapien
aggaacccccggcactgatgggctt

SEQ ID NO: 168895 - DNA, 25 bp, Homo sapien
gcactgatgggcttttgcccctgcc

SEQ ID NO: 168896 - DNA, 25 bp, Homo sapien
acactgacactttgtccccacatgg

SEQ ID NO: 168897 - DNA, 25 bp, Homo sapien
gcaaagtgcccgccccgtggagata

SEQ ID NO: 168898 - DNA, 25 bp, Homo sapien
ttgccggcctttgggcaaggcccct

SEQ ID NO: 168899 - DNA, 25 bp, Homo sapien
gggcaaggcccctggagcatctcgc

SEQ ID NO: 168900 - DNA, 25 bp, Homo sapien
gagcatctcgcccaggctttttata

SEQ ID NO: 168901 - DNA, 25 bp, Homo sapien
atctcgcccaggctttttatacctt

SEQ ID NO: 168902 - DNA, 25 bp, Homo sapien
tcgcccaggctttttataccttaca

SEQ ID NO: 168903 - DNA, 25 bp, Homo sapien
gcccaggctttttataccttacaat

SEQ ID NO: 168904 - DNA, 25 bp, Homo sapien
tattttactctatgattattcagga

SEQ ID NO: 168905 - DNA, 25 bp, Homo sapien
ttcaccactgctatcaacacggaga

SEQ ID NO: 168906 - DNA, 25 bp, Homo sapien
actgctatcaacacggagaacatcc

SEQ ID NO: 168907 - DNA, 25 bp, Homo sapien
gagaacatccgccttgttttccgcg

SEQ ID NO: 168908 - DNA, 25 bp, Homo sapien
cttgttttccgcgacgtgaaggata

SEQ ID NO: 168909 - DNA, 25 bp, Homo sapien
gtgaaggatactattctgcatgaca

SEQ ID NO: 168910 - DNA, 25 bp, Homo sapien
gcatgacaacctcaagcagcttatg

SEQ ID NO: 168911 - DNA, 25 bp, Homo sapien
aacctcaagcagcttatgctacagt

SEQ ID NO: 168912 - DNA, 25 bp, Homo sapien
gcagcttatgctacagtgatgtaca

SEQ ID NO: 168913 - DNA, 25 bp, Homo sapien
gtgatgtacaaaagacttgctgttt

SEQ ID NO: 168914 - DNA, 25 bp, Homo sapien
caaaagacttgctgttttaatatct

SEQ ID NO: 168915 - DNA, 25 bp, Homo sapien
taaaatagcagtttacaaccagaat

SEQ ID NO: 168916 - DNA, 25 bp, Homo sapien
atattcataatgtcgtgtgcttaaa

SEQ ID NO: 168917 - DNA, 25 bp, Homo sapien
tgtcgtgtgcttaaaagtgggcttt

SEQ ID NO: 168918 - DNA, 25 bp, Homo sapien
gggctttgaagtgtgtgctgcttac

SEQ ID NO: 168919 - DNA, 25 bp, Homo sapien
tgtgtgctgcttactcctttcatct

SEQ ID NO: 168920 - DNA, 25 bp, Homo sapien
tactcagctacccagtagagcttga

SEQ ID NO: 168921 - DNA, 25 bp, Homo sapien
gagcttgaagctgacctttctgaga

SEQ ID NO: 168922 - DNA, 25 bp, Homo sapien
gagaagttggtatggtgtaacacta

SEQ ID NO: 168923 - DNA, 25 bp, Homo sapien
agtaggtggttcgtgtgtgttctca

SEQ ID NO: 168924 - DNA, 25 bp, Homo sapien
gtgtgttctcattacctggttatga

SEQ ID NO: 168925 - DNA, 25 bp, Homo sapien
gatagatatgcacatcaaagccttt

SEQ ID NO: 168926 - DNA, 25 bp, Homo sapien
aaagcctttaccagtatcttcctgt

SEQ ID NO: 168927 - DNA, 25 bp, Homo sapien
tgccgattcctgaccattcaccggg

SEQ ID NO: 168928 - DNA, 25 bp, Homo sapien
aagtggtgtatgtcttctccaagct

SEQ ID NO: 168929 - DNA, 25 bp, Homo sapien
ttctccaagctgaagggccgtgggc

SEQ ID NO: 168930 - DNA, 25 bp, Homo sapien
gcagcgttcagggagattactatgg

SEQ ID NO: 168931 - DNA, 25 bp, Homo sapien
tactatggagatctggctgctcgcc

SEQ ID NO: 168932 - DNA, 25 bp, Homo sapien
gcctgggctatttccccagtagcat

SEQ ID NO: 168933 - DNA, 25 bp, Homo sapien
ccccagtagcattgtccgagaggac

SEQ ID NO: 168934 - DNA, 25 bp, Homo sapien
ggaccagaccctgaaacctggcaaa

SEQ ID NO: 168935 - DNA, 25 bp, Homo sapien
ctgaaacctggcaaagtcgatgtga

SEQ ID NO: 168936 - DNA, 25 bp, Homo sapien
gacaaatgggatttctactgccagt

SEQ ID NO: 168937 - DNA, 25 bp, Homo sapien
gggatttctactgccagtgagctca

SEQ ID NO: 168938 - DNA, 25 bp, Homo sapien
atgacacctttgaccaaatgccttc

SEQ ID NO: 168939 - DNA, 25 bp, Homo sapien
aaatgccttctatggttcacagtgc

SEQ ID NO: 168940 - DNA, 25 bp, Homo sapien
gtgcaggcacaaaactacctctgat

SEQ ID NO: 168941 - DNA, 25 bp, Homo sapien
tacaagcttattttacataccgtga

SEQ ID NO: 168942 - DNA, 25 bp, Homo sapien
taccgtgaatccctcacctaaaggg

SEQ ID NO: 168943 - DNA, 25 bp, Homo sapien
gggagattgtgtccataccaagcca

SEQ ID NO: 168944 - DNA, 25 bp, Homo sapien
aagtatttcacttgcagtagaactg

SEQ ID NO: 168945 - DNA, 25 bp, Homo sapien
agaactgtggatttgtgctgtcatt

SEQ ID NO: 168946 - DNA, 25 bp, Homo sapien
tgtgctgtcatttcaccttggaata

SEQ ID NO: 168947 - DNA, 25 bp, Homo sapien
ggaataaacacctatctctaagcag

SEQ ID NO: 168948 - DNA, 25 bp, Homo sapien
cttgcaatctatatgtaatggctac

SEQ ID NO: 168949 - DNA, 25 bp, Homo sapien
attagatttctgacttgcaaatatg

SEQ ID NO: 168950 - DNA, 25 bp, Homo sapien
gcaaatatgtttgtactccagaaga

SEQ ID NO: 168951 - DNA, 25 bp, Homo sapien
atgtttgtactccagaagaattaga

SEQ ID NO: 168952 - DNA, 25 bp, Homo sapien
taattacatatacagccgtctttgt

SEQ ID NO: 168953 - DNA, 25 bp, Homo sapien
acagccgtctttgtttatagtgtag

SEQ ID NO: 168954 - DNA, 25 bp, Homo sapien
atgaaccatttacagttcggttttg

SEQ ID NO: 168955 - DNA, 25 bp, Homo sapien
agttcggttttggactctgagtcaa

SEQ ID NO: 168956 - DNA, 25 bp, Homo sapien
gactctgagtcaaaggattttcctt

SEQ ID NO: 168957 - DNA, 25 bp, Homo sapien
gattttcctttaaatgcttgtctca

SEQ ID NO: 168958 - DNA, 25 bp, Homo sapien
gcttgtctcaattttagtctggtct

SEQ ID NO: 168959 - DNA, 25 bp, Homo sapien
ggtacagttgcataaagtgggtttt

SEQ ID NO: 168960 - DNA, 25 bp, Homo sapien
gcccagcccgcgctatatatttgta

SEQ ID NO: 168961 - DNA, 25 bp, Homo sapien
cagcccgcgctatatatttgtacaa

SEQ ID NO: 168962 - DNA, 25 bp, Homo sapien
gtacaataggactgtttactgccca

SEQ ID NO: 168963 - DNA, 25 bp, Homo sapien
acaataggactgtttactgcccacc

SEQ ID NO: 168964 - DNA, 25 bp, Homo sapien
aataggactgtttactgcccacctc

SEQ ID NO: 168965 - DNA, 25 bp, Homo sapien
ggcgggtttgcttcctgcgctctga

SEQ ID NO: 168966 - DNA, 25 bp, Homo sapien
ggtttgcttcctgcgctctgagatg

SEQ ID NO: 168967 - DNA, 25 bp, Homo sapien
gggctggatagcttcccagcaccct

SEQ ID NO: 168968 - DNA, 25 bp, Homo sapien
ggatagcttcccagcaccctcagag

SEQ ID NO: 168969 - DNA, 25 bp, Homo sapien
tgtgccccgtctgaccaaagttata

SEQ ID NO: 168970 - DNA, 25 bp, Homo sapien
gccccgtctgaccaaagttataata

SEQ ID NO: 168971 - DNA, 25 bp, Homo sapien
gaacaacatgttcgtggtgctgaat

SEQ ID NO: 168972 - DNA, 25 bp, Homo sapien
acatgttcgtggtgctgaatgcctc

SEQ ID NO: 168973 - DNA, 25 bp, Homo sapien
tgttcgtggtgctgaatgcctctca

SEQ ID NO: 168974 - DNA, 25 bp, Homo sapien
gaatgcctctcagcatcatcaagga

SEQ ID NO: 168975 - DNA, 25 bp, Homo sapien
agcatcatcaaggataactgaaact

SEQ ID NO: 168976 - DNA, 25 bp, Homo sapien
gataactgaaactgggtctccctgg

SEQ ID NO: 168977 - DNA, 25 bp, Homo sapien
tgaaactgggtctccctgggaccct

SEQ ID NO: 168978 - DNA, 25 bp, Homo sapien
ccctccatgggcagttatattctgc

SEQ ID NO: 168979 - DNA, 25 bp, Homo sapien
tatattctgcatcaagccttagaag

SEQ ID NO: 168980 - DNA, 25 bp, Homo sapien
aagcaaaggcagattcagggaccaa

SEQ ID NO: 168981 - DNA, 25 bp, Homo sapien
ggcagattcagggaccaaaaggatt

SEQ ID NO: 168982 - DNA, 25 bp, Homo sapien
gaaaatcatagcttacagatggtat

SEQ ID NO: 168983 - DNA, 25 bp, Homo sapien
aggtgtgggaaaaacttgatctgaa

SEQ ID NO: 168984 - DNA, 25 bp, Homo sapien
aattatcagcttcaattggcgattg

SEQ ID NO: 168985 - DNA, 25 bp, Homo sapien
tggcgattgattcagtgcccacaat

SEQ ID NO: 168986 - DNA, 25 bp, Homo sapien
gtgcccacaatgtaaacagggttgg

SEQ ID NO: 168987 - DNA, 25 bp, Homo sapien
acagggttggtagttgttactcatt

SEQ ID NO: 168988 - DNA, 25 bp, Homo sapien
gttgttactcattttgaatatacct

SEQ ID NO: 168989 - DNA, 25 bp, Homo sapien
taccttttccttattgtattctgta

SEQ ID NO: 168990 - DNA, 25 bp, Homo sapien
gtattctgtaatataggatcctgga

SEQ ID NO: 168991 - DNA, 25 bp, Homo sapien
tattattttcaactgtagtctttct

SEQ ID NO: 168992 - DNA, 25 bp, Homo sapien
gtagtctttctatactgtggactaa

SEQ ID NO: 168993 - DNA, 25 bp, Homo sapien
ctcagtgtaatgaactgtctagcaa

SEQ ID NO: 168994 - DNA, 25 bp, Homo sapien
agtcaaaatgacacagctgaaaatg

SEQ ID NO: 168995 - DNA, 25 bp, Homo sapien
atgaataagcatctgattttatgac

SEQ ID NO: 168996 - DNA, 25 bp, Homo sapien
gattttatgactgagccttttcctg

SEQ ID NO: 168997 - DNA, 25 bp, Homo sapien
atgactgagccttttcctgtcccaa

SEQ ID NO: 168998 - DNA, 25 bp, Homo sapien
ttcctgtcccaagaggtctttaaca

SEQ ID NO: 168999 - DNA, 25 bp, Homo sapien
ggtctttaacaatattttctctatc

SEQ ID NO: 169000 - DNA, 25 bp, Homo sapien
ttttctctatcatcaatgagtatat

SEQ ID NO: 169001 - DNA, 25 bp, Homo sapien
aatgatattgtggtggactgctaaa

SEQ ID NO: 169002 - DNA, 25 bp, Homo sapien
gtggtggactgctaaaaatatcaca

SEQ ID NO: 169003 - DNA, 25 bp, Homo sapien
tatattgtcaatgttcacagaacta

SEQ ID NO: 169004 - DNA, 25 bp, Homo sapien
tgtgttagtctcaggagtcttaact

SEQ ID NO: 169005 - DNA, 25 bp, Homo sapien
tagtctcaggagtcttaacttttga

SEQ ID NO: 169006 - DNA, 25 bp, Homo sapien
gtctcaggagtcttaacttttgaaa

SEQ ID NO: 169007 - DNA, 25 bp, Homo sapien
aggagtcttaacttttgaaatatgt

SEQ ID NO: 169008 - DNA, 25 bp, Homo sapien
gaaatatgttttacttgaatgttac

SEQ ID NO: 169009 - DNA, 25 bp, Homo sapien
gaatgttacattagatattggtgtc

SEQ ID NO: 169010 - DNA, 25 bp, Homo sapien
acattagatattggtgtcagaattt

SEQ ID NO: 169011 - DNA, 25 bp, Homo sapien
gtatcttatgtatgtgctttatatt

SEQ ID NO: 169012 - DNA, 25 bp, Homo sapien
cttatgtatgtgctttatattgtta

SEQ ID NO: 169013 - DNA, 25 bp, Homo sapien
gatatgttgtattctgtatcttgaa

SEQ ID NO: 169014 - DNA, 25 bp, Homo sapien
gtattctgtatcttgaaatttttgt

SEQ ID NO: 169015 - DNA, 25 bp, Homo sapien
cttgtcgatctgttcagccctgaaa

SEQ ID NO: 169016 - DNA, 25 bp, Homo sapien
ttgtcgatctgttcagccctgaaaa

SEQ ID NO: 169017 - DNA, 25 bp, Homo sapien
gtcgatctgttcagccctgaaaagt

SEQ ID NO: 169018 - DNA, 25 bp, Homo sapien
atctgttcagccctgaaaagtccaa

SEQ ID NO: 169019 - DNA, 25 bp, Homo sapien
tctgttcagccctgaaaagtccaaa

SEQ ID NO: 169020 - DNA, 25 bp, Homo sapien
aactcccaggtattgttgcagaagg

SEQ ID NO: 169021 - DNA, 25 bp, Homo sapien
actcccaggtattgttgcagaaggc

SEQ ID NO: 169022 - DNA, 25 bp, Homo sapien
cccaggtattgttgcagaaggccga

SEQ ID NO: 169023 - DNA, 25 bp, Homo sapien
aggtattgttgcagaaggccgagat

SEQ ID NO: 169024 - DNA, 25 bp, Homo sapien
attgttgcagaaggccgagatgacc

SEQ ID NO: 169025 - DNA, 25 bp, Homo sapien
ttgcagaaggccgagatgacctcta

SEQ ID NO: 169026 - DNA, 25 bp, Homo sapien
ttctgcactccatgaaaagttcact

SEQ ID NO: 169027 - DNA, 25 bp, Homo sapien
atgaaaagttcacttggacgctggg

SEQ ID NO: 169028 - DNA, 25 bp, Homo sapien
gattttcttaagttgacggttgtca

SEQ ID NO: 169029 - DNA, 25 bp, Homo sapien
ttgtcaatatatcgaactgttccca

SEQ ID NO: 169030 - DNA, 25 bp, Homo sapien
gtcaagtatgtctcaacactagcat

SEQ ID NO: 169031 - DNA, 25 bp, Homo sapien
taaaaagggacactgcagctgaatg

SEQ ID NO: 169032 - DNA, 25 bp, Homo sapien
ggaatcaaaatccactttgtacata

SEQ ID NO: 169033 - DNA, 25 bp, Homo sapien
taattggatttgtaccgtcctccca

SEQ ID NO: 169034 - DNA, 25 bp, Homo sapien
ttgtaccgtcctcccattttgttct

SEQ ID NO: 169035 - DNA, 25 bp, Homo sapien
catgtgtaagtctgcctaaataggt

SEQ ID NO: 169036 - DNA, 25 bp, Homo sapien
ctgcctaaataggtagcttaaactt

SEQ ID NO: 169037 - DNA, 25 bp, Homo sapien
taatttcttctcaggtatggaacca

SEQ ID NO: 169038 - DNA, 25 bp, Homo sapien
tcttctcaggtatggaaccacggtc

SEQ ID NO: 169039 - DNA, 25 bp, Homo sapien
ggaaccacggtcataactaacatgt

SEQ ID NO: 169040 - DNA, 25 bp, Homo sapien
ggtcataactaacatgttggccaga

SEQ ID NO: 169041 - DNA, 25 bp, Homo sapien
gttggccagaatagaaccactggtt

SEQ ID NO: 169042 - DNA, 25 bp, Homo sapien
aacatattttattcaccattaagtg

SEQ ID NO: 169043 - DNA, 25 bp, Homo sapien
gtgatctttatcaatattctggatt

SEQ ID NO: 169044 - DNA, 25 bp, Homo sapien
atcaatattctggattagacaacaa

SEQ ID NO: 169045 - DNA, 25 bp, Homo sapien
tagacaacaaattacctttctgggt

SEQ ID NO: 169046 - DNA, 25 bp, Homo sapien
tttctgggtgtttcttgtaaactat

SEQ ID NO: 169047 - DNA, 25 bp, Homo sapien
actatactcctgtttgaatgttaaa

SEQ ID NO: 169048 - DNA, 25 bp, Homo sapien
ctggtgttgcgggaacgctggcatt

SEQ ID NO: 169049 - DNA, 25 bp, Homo sapien
ttgcgggaacgctggcatttctgcc

SEQ ID NO: 169050 - DNA, 25 bp, Homo sapien
tgcgggaacgctggcatttctgccg

SEQ ID NO: 169051 - DNA, 25 bp, Homo sapien
atttctgccgggacggccgggtgct

SEQ ID NO: 169052 - DNA, 25 bp, Homo sapien
gtgctgctgggctcgagggccctga

SEQ ID NO: 169053 - DNA, 25 bp, Homo sapien
gctgctgggctcgagggccctgagg

SEQ ID NO: 169054 - DNA, 25 bp, Homo sapien
agggccctgagggagcggcacctag

SEQ ID NO: 169055 - DNA, 25 bp, Homo sapien
ggccctgagggagcggcacctaggc

SEQ ID NO: 169056 - DNA, 25 bp, Homo sapien
tgagggagcggcacctaggcctgat

SEQ ID NO: 169057 - DNA, 25 bp, Homo sapien
cacctaggcctgatgggctaccagc

SEQ ID NO: 169058 - DNA, 25 bp, Homo sapien
acctaggcctgatgggctaccagct

SEQ ID NO: 169059 - DNA, 25 bp, Homo sapien
ccaaaagggagtctcccatgatggg

SEQ ID NO: 169060 - DNA, 25 bp, Homo sapien
gggcgcactggtgtctgacactaag

SEQ ID NO: 169061 - DNA, 25 bp, Homo sapien
gcgcactggtgtctgacactaagga

SEQ ID NO: 169062 - DNA, 25 bp, Homo sapien
gtgtctgacactaaggagggtgtaa

SEQ ID NO: 169063 - DNA, 25 bp, Homo sapien
ggtgtaaaggccaaggtcagcatag

SEQ ID NO: 169064 - DNA, 25 bp, Homo sapien
gtgtaaaggccaaggtcagcataga

SEQ ID NO: 169065 - DNA, 25 bp, Homo sapien
tcactcctgccatgtgcctgcactc

SEQ ID NO: 169066 - DNA, 25 bp, Homo sapien
cctgcactcccagcatgccatgcag

SEQ ID NO: 169067 - DNA, 25 bp, Homo sapien
tttggaatcttcttccacgggacca

SEQ ID NO: 169068 - DNA, 25 bp, Homo sapien
ttggaatcttcttccacgggaccag

SEQ ID NO: 169069 - DNA, 25 bp, Homo sapien
ggaatcttcttccacgggaccagcc

SEQ ID NO: 169070 - DNA, 25 bp, Homo sapien
tccctccttggaagaggactttact

SEQ ID NO: 169071 - DNA, 25 bp, Homo sapien
tactaaaagtcacaggtggtggcca

SEQ ID NO: 169072 - DNA, 25 bp, Homo sapien
gggatttccgaatctccatcaggcg

SEQ ID NO: 169073 - DNA, 25 bp, Homo sapien
gaatctccatcaggcgcgctcatag

SEQ ID NO: 169074 - DNA, 25 bp, Homo sapien
aggcgcgctcatagttgtccccatt

SEQ ID NO: 169075 - DNA, 25 bp, Homo sapien
tagttgtccccattgtctacccaca

SEQ ID NO: 169076 - DNA, 25 bp, Homo sapien
gtggccctgagggaggcattcacct

SEQ ID NO: 169077 - DNA, 25 bp, Homo sapien
gaggcattcacctttatgtgttaga

SEQ ID NO: 169078 - DNA, 25 bp, Homo sapien
gtcagagccccgaagcagctaatgt

SEQ ID NO: 169079 - DNA, 25 bp, Homo sapien
gagccccgaagcagctaatgtaata

SEQ ID NO: 169080 - DNA, 25 bp, Homo sapien
gctaatgtaataagcactcatgtta

SEQ ID NO: 169081 - DNA, 25 bp, Homo sapien
agtgaggacgcctacacggtgctga

SEQ ID NO: 169082 - DNA, 25 bp, Homo sapien
tgaggacgcctacacggtgctgacc

SEQ ID NO: 169083 - DNA, 25 bp, Homo sapien
aggacgcctacacggtgctgacccg

SEQ ID NO: 169084 - DNA, 25 bp, Homo sapien
cccgcatcgggctggagacgtcact

SEQ ID NO: 169085 - DNA, 25 bp, Homo sapien
agctcatcacagctgccagcttggt

SEQ ID NO: 169086 - DNA, 25 bp, Homo sapien
acagctgccagcttggtgtgccgga

SEQ ID NO: 169087 - DNA, 25 bp, Homo sapien
agctgccagcttggtgtgccggaaa

SEQ ID NO: 169088 - DNA, 25 bp, Homo sapien
gctgccagcttggtgtgccggaaac

SEQ ID NO: 169089 - DNA, 25 bp, Homo sapien
tgccagcttggtgtgccggaaacgc

SEQ ID NO: 169090 - DNA, 25 bp, Homo sapien
ccagcttggtgtgccggaaacgcaa

SEQ ID NO: 169091 - DNA, 25 bp, Homo sapien
gccggaaacgcaagggtacagaagt

SEQ ID NO: 169092 - DNA, 25 bp, Homo sapien
gaccactgtcttttgaatgggccca

SEQ ID NO: 169093 - DNA, 25 bp, Homo sapien
tgtcttttgaatgggcccacagtgt

SEQ ID NO: 169094 - DNA, 25 bp, Homo sapien
gggcccacagtgtttatgtactctt

SEQ ID NO: 169095 - DNA, 25 bp, Homo sapien
atgtactcttaacaactcacagaat

SEQ ID NO: 169096 - DNA, 25 bp, Homo sapien
aatggagtttcattgtaactgtcct

SEQ ID NO: 169097 - DNA, 25 bp, Homo sapien
cattgtaactgtcctttgtaattta

SEQ ID NO: 169098 - DNA, 25 bp, Homo sapien
ttcctatatccttggttcttttctg

SEQ ID NO: 169099 - DNA, 25 bp, Homo sapien
tccttggttcttttctgataattta

SEQ ID NO: 169100 - DNA, 25 bp, Homo sapien
tttgttatataaactgctagccaca

SEQ ID NO: 169101 - DNA, 25 bp, Homo sapien
actgctagccacaaattttagttat

SEQ ID NO: 169102 - DNA, 25 bp, Homo sapien
atgtaaaaggctacccttgacaaga

SEQ ID NO: 169103 - DNA, 25 bp, Homo sapien
gacggcaagggcaagctcgacttcc

SEQ ID NO: 169104 - DNA, 25 bp, Homo sapien
aagggcaagctcgacttccccgagg

SEQ ID NO: 169105 - DNA, 25 bp, Homo sapien
ttccccgagggcgtctttgctgtgg

SEQ ID NO: 169106 - DNA, 25 bp, Homo sapien
tctttgctgtggctcgcctcacggc

SEQ ID NO: 169107 - DNA, 25 bp, Homo sapien
cggccgagcagctgagcctgaagca

SEQ ID NO: 169108 - DNA, 25 bp, Homo sapien
agctgctggcgcagaccacgcactt

SEQ ID NO: 169109 - DNA, 25 bp, Homo sapien
tgcacgaccccaaggtggcgctgga

SEQ ID NO: 169110 - DNA, 25 bp, Homo sapien
tggagagcctctacccgctggccaa

SEQ ID NO: 169111 - DNA, 25 bp, Homo sapien
aagttcacggccgagctgggcctca

SEQ ID NO: 169112 - DNA, 25 bp, Homo sapien
aggtgctgagccagggcgctcacct

SEQ ID NO: 169113 - DNA, 25 bp, Homo sapien
gacggcgggaccatcgaccgtttct

SEQ ID NO: 169114 - DNA, 25 bp, Homo sapien
aagagcccacttgcctgggatggcc

SEQ ID NO: 169115 - DNA, 25 bp, Homo sapien
tgggatggccccacactgtcactca

SEQ ID NO: 169116 - DNA, 25 bp, Homo sapien
tttctagattgatgctcctttctcc

SEQ ID NO: 169117 - DNA, 25 bp, Homo sapien
atgctcctttctcccatgcattgag

SEQ ID NO: 169118 - DNA, 25 bp, Homo sapien
atgcattgagctcccatctagcttc

SEQ ID NO: 169119 - DNA, 25 bp, Homo sapien
atctagcttcagcagggcagaaccc

SEQ ID NO: 169120 - DNA, 25 bp, Homo sapien
agcagggcagaacccttctccagat

SEQ ID NO: 169121 - DNA, 25 bp, Homo sapien
gagtatctgggagtagttgaagaac

SEQ ID NO: 169122 - DNA, 25 bp, Homo sapien
agaacagataattccttccaaacat

SEQ ID NO: 169123 - DNA, 25 bp, Homo sapien
ttcttggagcaagcagaaagccagt

SEQ ID NO: 169124 - DNA, 25 bp, Homo sapien
aagcagaaagccagtaacttcgctc

SEQ ID NO: 169125 - DNA, 25 bp, Homo sapien
aacggcttagacttcgactcaggat

SEQ ID NO: 169126 - DNA, 25 bp, Homo sapien
tcaggatccagtcccttacacgtac

SEQ ID NO: 169127 - DNA, 25 bp, Homo sapien
ttacacgtacctctcatcagtgtcc

SEQ ID NO: 169128 - DNA, 25 bp, Homo sapien
tcatcagtgtcctcttgctcaaaaa

SEQ ID NO: 169129 - DNA, 25 bp, Homo sapien
gtgtcctcttgctcaaaaatctgtt

SEQ ID NO: 169130 - DNA, 25 bp, Homo sapien
aaatctgtttgatccctgttaccca

SEQ ID NO: 169131 - DNA, 25 bp, Homo sapien
tgtttgatccctgttacccagagaa

SEQ ID NO: 169132 - DNA, 25 bp, Homo sapien
atacattctttatcttgacattcaa

SEQ ID NO: 169133 - DNA, 25 bp, Homo sapien
cttgacattcaaggcatttctatca

SEQ ID NO: 169134 - DNA, 25 bp, Homo sapien
aaaacactagttttgtgccagccgt

SEQ ID NO: 169135 - DNA, 25 bp, Homo sapien
tgtgccagccgtgatgctcaggctt

SEQ ID NO: 169136 - DNA, 25 bp, Homo sapien
gctgctggtcgtctttctccctcag

SEQ ID NO: 169137 - DNA, 25 bp, Homo sapien
agtgacagcagtagtgccccacgga

SEQ ID NO: 169138 - DNA, 25 bp, Homo sapien
agtagtgccccacggacccaggatg

SEQ ID NO: 169139 - DNA, 25 bp, Homo sapien
ccacggacccaggatgcaggcattg

SEQ ID NO: 169140 - DNA, 25 bp, Homo sapien
ggatgcaggcattgcctcagggcct

SEQ ID NO: 169141 - DNA, 25 bp, Homo sapien
tcagggcctgggaactgacccagct

SEQ ID NO: 169142 - DNA, 25 bp, Homo sapien
actggccgattctggtctccaagga

SEQ ID NO: 169143 - DNA, 25 bp, Homo sapien
attctggtctccaaggaccttggtg

SEQ ID NO: 169144 - DNA, 25 bp, Homo sapien
tgcattcccgtcatgcacagacttg

SEQ ID NO: 169145 - DNA, 25 bp, Homo sapien
atgcacagacttgcccttgagcagg

SEQ ID NO: 169146 - DNA, 25 bp, Homo sapien
tgcccttgagcaggccgctgtactg

SEQ ID NO: 169147 - DNA, 25 bp, Homo sapien
tcctcagggctgtcaagagctccag

SEQ ID NO: 169148 - DNA, 25 bp, Homo sapien
aagagctccaggctagaccgttgcc

SEQ ID NO: 169149 - DNA, 25 bp, Homo sapien
cttctggccattctagatagtgctg

SEQ ID NO: 169150 - DNA, 25 bp, Homo sapien
ggccattctagatagtgctgcatta

SEQ ID NO: 169151 - DNA, 25 bp, Homo sapien
tgctgcattagggtgagtctgcctc

SEQ ID NO: 169152 - DNA, 25 bp, Homo sapien
attagggtgagtctgcctccctctc

SEQ ID NO: 169153 - DNA, 25 bp, Homo sapien
tctctttttaaacggctgggttcag

SEQ ID NO: 169154 - DNA, 25 bp, Homo sapien
ctgggttcagggttagtcctgtctc

SEQ ID NO: 169155 - DNA, 25 bp, Homo sapien
ctttcttcagctattagtagttgag

SEQ ID NO: 169156 - DNA, 25 bp, Homo sapien
gtagttgagcttattctatatgaaa

SEQ ID NO: 169157 - DNA, 25 bp, Homo sapien
aaagatattacgcttaatgctggta

SEQ ID NO: 169158 - DNA, 25 bp, Homo sapien
atgaagctgaaatggaatatctgaa

SEQ ID NO: 169159 - DNA, 25 bp, Homo sapien
agctcaggacctggagatgtacggt

SEQ ID NO: 169160 - DNA, 25 bp, Homo sapien
gatgtacggtgtgaactactttgca

SEQ ID NO: 169161 - DNA, 25 bp, Homo sapien
gtgtgaactactttgcaatccggaa

SEQ ID NO: 169162 - DNA, 25 bp, Homo sapien
gaactactttgcaatccggaataaa

SEQ ID NO: 169163 - DNA, 25 bp, Homo sapien
gggcttcacatttatgaccctgaga

SEQ ID NO: 169164 - DNA, 25 bp, Homo sapien
ttcacatttatgaccctgagaacag

SEQ ID NO: 169165 - DNA, 25 bp, Homo sapien
atgaccctgagaacagactgacccc

SEQ ID NO: 169166 - DNA, 25 bp, Homo sapien
ccccaagatctcctttccatggaga

SEQ ID NO: 169167 - DNA, 25 bp, Homo sapien
caagtcccgagtggccttctttgaa

SEQ ID NO: 169168 - DNA, 25 bp, Homo sapien
gaagagctctagcaggtgacccagc

SEQ ID NO: 169169 - DNA, 25 bp, Homo sapien
tcctggccgaggtgaggaacagaca

SEQ ID NO: 169170 - DNA, 25 bp, Homo sapien
tattgggcaaggcaggaaacctctg

SEQ ID NO: 169171 - DNA, 25 bp, Homo sapien
aacctctggagacctcattttctcc

SEQ ID NO: 169172 - DNA, 25 bp, Homo sapien
aagacagccatgctcttcaggagga

SEQ ID NO: 169173 - DNA, 25 bp, Homo sapien
ccatgctcttcaggaggagactcca

SEQ ID NO: 169174 - DNA, 25 bp, Homo sapien
aaaggagggtgtcttggctgtgctt

SEQ ID NO: 169175 - DNA, 25 bp, Homo sapien
gctgtgcttgaaggcgaaaccctgc

SEQ ID NO: 169176 - DNA, 25 bp, Homo sapien
ttgaaggcgaaaccctgccatatcc

SEQ ID NO: 169177 - DNA, 25 bp, Homo sapien
ggtggccttgcatcctgactggatg

SEQ ID NO: 169178 - DNA, 25 bp, Homo sapien
tgactggatgttctcagccccttgt

SEQ ID NO: 169179 - DNA, 25 bp, Homo sapien
tcagccccttgttctgggcaagaac

SEQ ID NO: 169180 - DNA, 25 bp, Homo sapien
gaagtactcagtcactttaagtgga

SEQ ID NO: 169181 - DNA, 25 bp, Homo sapien
tagggtttgcttttttgctgtttag

SEQ ID NO: 169182 - DNA, 25 bp, Homo sapien
gtttgcttttttgctgtttagatca

SEQ ID NO: 169183 - DNA, 25 bp, Homo sapien
gctgtttagatcaaagttttttctg

SEQ ID NO: 169184 - DNA, 25 bp, Homo sapien
ttctgattcttctgtcctcattgtg

SEQ ID NO: 169185 - DNA, 25 bp, Homo sapien
gtcctcattgtgaacataaccgtgt

SEQ ID NO: 169186 - DNA, 25 bp, Homo sapien
cattgtgaacataaccgtgtagttg

SEQ ID NO: 169187 - DNA, 25 bp, Homo sapien
ataaccgtgtagttgaaacagtcaa

SEQ ID NO: 169188 - DNA, 25 bp, Homo sapien
ccgtgtagttgaaacagtcaaactt

SEQ ID NO: 169189 - DNA, 25 bp, Homo sapien
gtaatgtatgttattgtgtgatgca

SEQ ID NO: 169190 - DNA, 25 bp, Homo sapien
atgttattgtgtgatgcagtttttt

SEQ ID NO: 169191 - DNA, 25 bp, Homo sapien
gaaaacaaattcttgtccccctcag

SEQ ID NO: 169192 - DNA, 25 bp, Homo sapien
gtggctctttctgatttgcaagggc

SEQ ID NO: 169193 - DNA, 25 bp, Homo sapien
atttgcaagggcactatggtcaggg

SEQ ID NO: 169194 - DNA, 25 bp, Homo sapien
atggtcagggcaaaggcatggccca

SEQ ID NO: 169195 - DNA, 25 bp, Homo sapien
tggcccaggtgtttaagtacagggt

SEQ ID NO: 169196 - DNA, 25 bp, Homo sapien
acagggtgacgtgtgcctatgcaat

SEQ ID NO: 169197 - DNA, 25 bp, Homo sapien
gtaaggcaggcacgaagagtccaaa

SEQ ID NO: 169198 - DNA, 25 bp, Homo sapien
aaaaatctaggtggcctctcagctc

SEQ ID NO: 169199 - DNA, 25 bp, Homo sapien
caagctatgtaaccccaattgcctg

SEQ ID NO: 169200 - DNA, 25 bp, Homo sapien
aattgcctgctccattaaagactgt

SEQ ID NO: 169201 - DNA, 25 bp, Homo sapien
gtttgtaaagctcttaacagtatgt

SEQ ID NO: 169202 - DNA, 25 bp, Homo sapien
ttcctggtaaaaattacagggctct

SEQ ID NO: 169203 - DNA, 25 bp, Homo sapien
tggtaaaaattacagggctctattt

SEQ ID NO: 169204 - DNA, 25 bp, Homo sapien
aattacagggctctatttaaggatg

SEQ ID NO: 169205 - DNA, 25 bp, Homo sapien
attacagggctctatttaaggatgt

SEQ ID NO: 169206 - DNA, 25 bp, Homo sapien
ccacagtcttcattctatttctctt

SEQ ID NO: 169207 - DNA, 25 bp, Homo sapien
cagtcttcattctatttctctttaa

SEQ ID NO: 169208 - DNA, 25 bp, Homo sapien
agtcttcattctatttctctttaat

SEQ ID NO: 169209 - DNA, 25 bp, Homo sapien
ttaattttattcactgaggcagaga

SEQ ID NO: 169210 - DNA, 25 bp, Homo sapien
ctgaggcagagaaacaatttttgaa

SEQ ID NO: 169211 - DNA, 25 bp, Homo sapien
agcaaacccatggaaaatgtctcag

SEQ ID NO: 169212 - DNA, 25 bp, Homo sapien
atgtctcagatctaatattaaaatc

SEQ ID NO: 169213 - DNA, 25 bp, Homo sapien
taacaatcttgggtgggtagtagga

SEQ ID NO: 169214 - DNA, 25 bp, Homo sapien
gttcttagctcttgaacagaagcct

SEQ ID NO: 169215 - DNA, 25 bp, Homo sapien
aagcctaaaattcctggttctctca

SEQ ID NO: 169216 - DNA, 25 bp, Homo sapien
aaaattcctggttctctcagggctt

SEQ ID NO: 169217 - DNA, 25 bp, Homo sapien
tcagggcttcgccttcaagggttct

SEQ ID NO: 169218 - DNA, 25 bp, Homo sapien
cttcgccttcaagggttctggagga

SEQ ID NO: 169219 - DNA, 25 bp, Homo sapien
tctgcaggttccatgggtgacagcc

SEQ ID NO: 169220 - DNA, 25 bp, Homo sapien
ggtgacagcctgagatctgtccctt

SEQ ID NO: 169221 - DNA, 25 bp, Homo sapien
agatctgtcccttcaacgggctggg

SEQ ID NO: 169222 - DNA, 25 bp, Homo sapien
ctgggctgggtatgtgcctaccgat

SEQ ID NO: 169223 - DNA, 25 bp, Homo sapien
atgtgcctaccgatgacaatgtgta

SEQ ID NO: 169224 - DNA, 25 bp, Homo sapien
acatgaacaggatagttctccctta

SEQ ID NO: 169225 - DNA, 25 bp, Homo sapien
gatagttctcccttaagcaacctca

SEQ ID NO: 169226 - DNA, 25 bp, Homo sapien
taagcaacctcacaaacaagccgct

SEQ ID NO: 169227 - DNA, 25 bp, Homo sapien
acaagccgcttctgttaggtacatg

SEQ ID NO: 169228 - DNA, 25 bp, Homo sapien
ttaggtacatgtcctgcccttgcaa

SEQ ID NO: 169229 - DNA, 25 bp, Homo sapien
cctgcccttgcaaatgaagctttta

SEQ ID NO: 169230 - DNA, 25 bp, Homo sapien
cagtatatcctgttctgtacattaa

SEQ ID NO: 169231 - DNA, 25 bp, Homo sapien
ggtgtgatatgcaacctggtataca

SEQ ID NO: 169232 - DNA, 25 bp, Homo sapien
acatttgtgcaatttcatttcatca

SEQ ID NO: 169233 - DNA, 25 bp, Homo sapien
tcatttcatcaaattctatctgcta

SEQ ID NO: 169234 - DNA, 25 bp, Homo sapien
aattctatctgctaatgttttatat

SEQ ID NO: 169235 - DNA, 25 bp, Homo sapien
tcagaaatcagctcagtggtcttcc

SEQ ID NO: 169236 - DNA, 25 bp, Homo sapien
ccccgccatgattcacatttgatga

SEQ ID NO: 169237 - DNA, 25 bp, Homo sapien
ccagtttgtggatgactatatttag

SEQ ID NO: 169238 - DNA, 25 bp, Homo sapien
atttagatttctctagactctagtg

SEQ ID NO: 169239 - DNA, 25 bp, Homo sapien
agactctagtggaagacctttggaa

SEQ ID NO: 169240 - DNA, 25 bp, Homo sapien
gacctttggaaaggccatgccaacc

SEQ ID NO: 169241 - DNA, 25 bp, Homo sapien
aaaggccatgccaaccgtgcttgta

SEQ ID NO: 169242 - DNA, 25 bp, Homo sapien
ccaaccgtgcttgtactgctagaag

SEQ ID NO: 169243 - DNA, 25 bp, Homo sapien
gctagaagcactttatgtttccttt

SEQ ID NO: 169244 - DNA, 25 bp, Homo sapien
gcactttatgtttcctttttgggtg

SEQ ID NO: 169245 - DNA, 25 bp, Homo sapien
ggatttatgtgagtgctttaaacaa

SEQ ID NO: 169246 - DNA, 25 bp, Homo sapien
aaatgcagtggtctgccaagctctt

SEQ ID NO: 169247 - DNA, 25 bp, Homo sapien
gccaagctcttggttctgaaatcac

SEQ ID NO: 169248 - DNA, 25 bp, Homo sapien
tcttggttctgaaatcacaggcttc

SEQ ID NO: 169249 - DNA, 25 bp, Homo sapien
gaaaacctgtgttcaagttccaact

SEQ ID NO: 169250 - DNA, 25 bp, Homo sapien
tttaaggcacctctggaagctgttg

SEQ ID NO: 169251 - DNA, 25 bp, Homo sapien
gaaatgcgtggatacgatggcctat

SEQ ID NO: 169252 - DNA, 25 bp, Homo sapien
gatggcctatgagaaaagagtgcta

SEQ ID NO: 169253 - DNA, 25 bp, Homo sapien
agagaaatgtgatcgctgagatgta

SEQ ID NO: 169254 - DNA, 25 bp, Homo sapien
agtttttaatgctagtttccaccat

SEQ ID NO: 169255 - DNA, 25 bp, Homo sapien
gctagtttccaccatctttcaatga

SEQ ID NO: 169256 - DNA, 25 bp, Homo sapien
catctttcaatgataccctgatctt

SEQ ID NO: 169257 - DNA, 25 bp, Homo sapien
tattactgtgcgaaagatcccctac

SEQ ID NO: 169258 - DNA, 25 bp, Homo sapien
attactgtgcgaaagatcccctacc

SEQ ID NO: 169259 - DNA, 25 bp, Homo sapien
ttactgtgcgaaagatcccctacct

SEQ ID NO: 169260 - DNA, 25 bp, Homo sapien
tactgtgcgaaagatcccctacctt

SEQ ID NO: 169261 - DNA, 25 bp, Homo sapien
tgtgcgaaagatcccctaccttcac

SEQ ID NO: 169262 - DNA, 25 bp, Homo sapien
gaaagatcccctaccttcacgtagc

SEQ ID NO: 169263 - DNA, 25 bp, Homo sapien
agatcccctaccttcacgtagcggg

SEQ ID NO: 169264 - DNA, 25 bp, Homo sapien
gggacctcacggagggtacttcgat

SEQ ID NO: 169265 - DNA, 25 bp, Homo sapien
ggacctcacggagggtacttcgatc

SEQ ID NO: 169266 - DNA, 25 bp, Homo sapien
acctcacggagggtacttcgatctc

SEQ ID NO: 169267 - DNA, 25 bp, Homo sapien
tcacggagggtacttcgatctctgg

SEQ ID NO: 169268 - DNA, 25 bp, Homo sapien
aatagatgcctcctatgtggaccca

SEQ ID NO: 169269 - DNA, 25 bp, Homo sapien
atgtggacccacttggccctcaaat

SEQ ID NO: 169270 - DNA, 25 bp, Homo sapien
cacttggccctcaaatagaacgacc

SEQ ID NO: 169271 - DNA, 25 bp, Homo sapien
gaacgaccaaaaactgcagccaaga

SEQ ID NO: 169272 - DNA, 25 bp, Homo sapien
cgatgaggatgattttgctgatgaa

SEQ ID NO: 169273 - DNA, 25 bp, Homo sapien
ttaggagatgatttgcttccagaat

SEQ ID NO: 169274 - DNA, 25 bp, Homo sapien
gatttgcttccagaataatattcac

SEQ ID NO: 169275 - DNA, 25 bp, Homo sapien
gaaattgccttatgagatcatcctc

SEQ ID NO: 169276 - DNA, 25 bp, Homo sapien
gagatcatcctcatgttaaaccttg

SEQ ID NO: 169277 - DNA, 25 bp, Homo sapien
ccttggattaaatatctaacctgta

SEQ ID NO: 169278 - DNA, 25 bp, Homo sapien
ttttcactgtcaaaacttaagtaag

SEQ ID NO: 169279 - DNA, 25 bp, Homo sapien
tcaggtatgcggatgaggagctcca

SEQ ID NO: 169280 - DNA, 25 bp, Homo sapien
gagctccagctggacttcgatgact

SEQ ID NO: 169281 - DNA, 25 bp, Homo sapien
tcgatgacttcctcaactgcctggt

SEQ ID NO: 169282 - DNA, 25 bp, Homo sapien
caactgcctggtccggctggagaat

SEQ ID NO: 169283 - DNA, 25 bp, Homo sapien
aatgcgagccgggtgttccaggctc

SEQ ID NO: 169284 - DNA, 25 bp, Homo sapien
tgttccaggctctcagtacaaagaa

SEQ ID NO: 169285 - DNA, 25 bp, Homo sapien
gaacaaggagttcattcatctcaat

SEQ ID NO: 169286 - DNA, 25 bp, Homo sapien
aatgagttcatccatttgacaatga

SEQ ID NO: 169287 - DNA, 25 bp, Homo sapien
gccttgtagagatgcagcctgccca

SEQ ID NO: 169288 - DNA, 25 bp, Homo sapien
tggaccttgaccttcagaacttctc

SEQ ID NO: 169289 - DNA, 25 bp, Homo sapien
tggtgtggaaccattacgcccaggg

SEQ ID NO: 169290 - DNA, 25 bp, Homo sapien
ggagagtggcactgatgacttcaat

SEQ ID NO: 169291 - DNA, 25 bp, Homo sapien
agagtggcactgatgacttcaatgt

SEQ ID NO: 169292 - DNA, 25 bp, Homo sapien
attggagccccaagcagtgttaatc

SEQ ID NO: 169293 - DNA, 25 bp, Homo sapien
gagccccaagcagtgttaatcctgg

SEQ ID NO: 169294 - DNA, 25 bp, Homo sapien
ccccaagcagtgttaatcctggcta

SEQ ID NO: 169295 - DNA, 25 bp, Homo sapien
aatcctggctactgtgtgagcctga

SEQ ID NO: 169296 - DNA, 25 bp, Homo sapien
gtgagcctgacctcaagcacaggat

SEQ ID NO: 169297 - DNA, 25 bp, Homo sapien
tgacctcaagcacaggattccagaa

SEQ ID NO: 169298 - DNA, 25 bp, Homo sapien
tcaagcacaggattccagaaatgga

SEQ ID NO: 169299 - DNA, 25 bp, Homo sapien
atggaaggatgtgccttgtgaagac

SEQ ID NO: 169300 - DNA, 25 bp, Homo sapien
gccttgtgaagacaagttctccttt

SEQ ID NO: 169301 - DNA, 25 bp, Homo sapien
cacactgaccacactgtatcgtgag

SEQ ID NO: 169302 - DNA, 25 bp, Homo sapien
cactgtatcgtgagtgtccgttgac

SEQ ID NO: 169303 - DNA, 25 bp, Homo sapien
gtgagtgtccgttgacgtgaccaat

SEQ ID NO: 169304 - DNA, 25 bp, Homo sapien
gtgtccgttgacgtgaccaattgcc

SEQ ID NO: 169305 - DNA, 25 bp, Homo sapien
tgacgtgaccaattgccctgccagg

SEQ ID NO: 169306 - DNA, 25 bp, Homo sapien
tgccaggctgtcagcgcctcaaggg

SEQ ID NO: 169307 - DNA, 25 bp, Homo sapien
gtagggtctgcgtgtgatttgtctc

SEQ ID NO: 169308 - DNA, 25 bp, Homo sapien
gtctgcgtgtgatttgtctctgagc

SEQ ID NO: 169309 - DNA, 25 bp, Homo sapien
tgcgtgtgatttgtctctgagcccc

SEQ ID NO: 169310 - DNA, 25 bp, Homo sapien
gggcccggcacagagtcgatgctca

SEQ ID NO: 169311 - DNA, 25 bp, Homo sapien
cccggcacagagtcgatgctcaata

SEQ ID NO: 169312 - DNA, 25 bp, Homo sapien
cagtcatgtatttcctgatgtccag

SEQ ID NO: 169313 - DNA, 25 bp, Homo sapien
cctgatgtccagtaacattcgcaaa

SEQ ID NO: 169314 - DNA, 25 bp, Homo sapien
gccaacttctttttagacgatttca

SEQ ID NO: 169315 - DNA, 25 bp, Homo sapien
gacgatttcaaggtgaaccaagtag

SEQ ID NO: 169316 - DNA, 25 bp, Homo sapien
agcacttcagaatttaaaccaggat

SEQ ID NO: 169317 - DNA, 25 bp, Homo sapien
taaaccaggatactccctgcatgat

SEQ ID NO: 169318 - DNA, 25 bp, Homo sapien
tactccctgcatgatacatctgtgg

SEQ ID NO: 169319 - DNA, 25 bp, Homo sapien
gtggcagtgaaaatacagtctagtt

SEQ ID NO: 169320 - DNA, 25 bp, Homo sapien
ataatgcagcctcttaattctttga

SEQ ID NO: 169321 - DNA, 25 bp, Homo sapien
agcatttacaaaactcagatctcaa

SEQ ID NO: 169322 - DNA, 25 bp, Homo sapien
tcagatctcaaagctctgcttgtat

SEQ ID NO: 169323 - DNA, 25 bp, Homo sapien
agtggaataccccagatgcgaataa

SEQ ID NO: 169324 - DNA, 25 bp, Homo sapien
ggaataccccagatgcgaataaggc

SEQ ID NO: 169325 - DNA, 25 bp, Homo sapien
tgcgaataaggcagcattgttaccc

SEQ ID NO: 169326 - DNA, 25 bp, Homo sapien
aaggcagcattgttaccctaaatgt

SEQ ID NO: 169327 - DNA, 25 bp, Homo sapien
agcattgttaccctaaatgtatgtc

SEQ ID NO: 169328 - DNA, 25 bp, Homo sapien
cacttctcactcttatggtctcaaa

SEQ ID NO: 169329 - DNA, 25 bp, Homo sapien
tctcactcttatggtctcaaagctt

SEQ ID NO: 169330 - DNA, 25 bp, Homo sapien
agatagcttctgatattgttgtaat

SEQ ID NO: 169331 - DNA, 25 bp, Homo sapien
aatagtttcaatttgcaacttaata

SEQ ID NO: 169332 - DNA, 25 bp, Homo sapien
actaaattattgcttatgcttgtac

SEQ ID NO: 169333 - DNA, 25 bp, Homo sapien
ttattgcttatgcttgtactaaaat

SEQ ID NO: 169334 - DNA, 25 bp, Homo sapien
gattctttcagtatcttaacacctt

SEQ ID NO: 169335 - DNA, 25 bp, Homo sapien
acaaagttcttgatagtaccactat

SEQ ID NO: 169336 - DNA, 25 bp, Homo sapien
cactattattgggtttgttttatgc

SEQ ID NO: 169337 - DNA, 25 bp, Homo sapien
attgggtttgttttatgccattatt

SEQ ID NO: 169338 - DNA, 25 bp, Homo sapien
atgccattattgattcttgatattc

SEQ ID NO: 169339 - DNA, 25 bp, Homo sapien
gattcttgatattcaagcatttaca

SEQ ID NO: 169340 - DNA, 25 bp, Homo sapien
acaatgtagcatatttgattttctt

SEQ ID NO: 169341 - DNA, 25 bp, Homo sapien
gttgcattttatcttagtgtttgga

SEQ ID NO: 169342 - DNA, 25 bp, Homo sapien
catttgtgttgtttagctttcattt

SEQ ID NO: 169343 - DNA, 25 bp, Homo sapien
atgtacctttattttccagtatgcc

SEQ ID NO: 169344 - DNA, 25 bp, Homo sapien
gtatgcctacattttgtattgcaca

SEQ ID NO: 169345 - DNA, 25 bp, Homo sapien
aacatcactgaaatgctagctgcaa

SEQ ID NO: 169346 - DNA, 25 bp, Homo sapien
tgctagctgcaagtgacatctcttt

SEQ ID NO: 169347 - DNA, 25 bp, Homo sapien
gtggagaaattccttgattcacaat

SEQ ID NO: 169348 - DNA, 25 bp, Homo sapien
tccttgattcacaatgaaatgctct

SEQ ID NO: 169349 - DNA, 25 bp, Homo sapien
agaccttttatccacttacctagat

SEQ ID NO: 169350 - DNA, 25 bp, Homo sapien
tatccacttacctagattctacata

SEQ ID NO: 169351 - DNA, 25 bp, Homo sapien
caccacttcttttataactagtcct

SEQ ID NO: 169352 - DNA, 25 bp, Homo sapien
tagtcctttactaatccaacccatg

SEQ ID NO: 169353 - DNA, 25 bp, Homo sapien
taatccaacccatgatgagctcctc

SEQ ID NO: 169354 - DNA, 25 bp, Homo sapien
tcttcctggcttcttactgaaaggt

SEQ ID NO: 169355 - DNA, 25 bp, Homo sapien
ggttaccctgtaacatgcaattttg

SEQ ID NO: 169356 - DNA, 25 bp, Homo sapien
atatctttgatatgcttacgagtaa

SEQ ID NO: 169357 - DNA, 25 bp, Homo sapien
gcttacgagtaagtgaatcctgatt

SEQ ID NO: 169358 - DNA, 25 bp, Homo sapien
gaatcctgattatttccagacccac

SEQ ID NO: 169359 - DNA, 25 bp, Homo sapien
gattatttccagacccaccaccaga

SEQ ID NO: 169360 - DNA, 25 bp, Homo sapien
accaccagagtggatcttattttca

SEQ ID NO: 169361 - DNA, 25 bp, Homo sapien
gacaattatgagtttgccctctttc

SEQ ID NO: 169362 - DNA, 25 bp, Homo sapien
aatccgaaaacttccattgtagtgg

SEQ ID NO: 169363 - DNA, 25 bp, Homo sapien
gtggcctgtgcttttcagatagtat

SEQ ID NO: 169364 - DNA, 25 bp, Homo sapien
agctcaattgtatctgacccttctt

SEQ ID NO: 169365 - DNA, 25 bp, Homo sapien
gtatctgacccttctttaagttatg

SEQ ID NO: 169366 - DNA, 25 bp, Homo sapien
gacccttctttaagttatgtgtgtg

SEQ ID NO: 169367 - DNA, 25 bp, Homo sapien
gcttatatctagcattagaattttg

SEQ ID NO: 169368 - DNA, 25 bp, Homo sapien
atctagcattagaattttgtcttaa

SEQ ID NO: 169369 - DNA, 25 bp, Homo sapien
ctagcattagaattttgtcttaaaa

SEQ ID NO: 169370 - DNA, 25 bp, Homo sapien
ttgtcttaaaataacagcggtaagt

SEQ ID NO: 169371 - DNA, 25 bp, Homo sapien
taaaataacagcggtaagtttcact

SEQ ID NO: 169372 - DNA, 25 bp, Homo sapien
tttattctgtattgtgcagttacac

SEQ ID NO: 169373 - DNA, 25 bp, Homo sapien
ttattctgtattgtgcagttacaca

SEQ ID NO: 169374 - DNA, 25 bp, Homo sapien
tattctgtattgtgcagttacacaa

SEQ ID NO: 169375 - DNA, 25 bp, Homo sapien
attctgtattgtgcagttacacaat

SEQ ID NO: 169376 - DNA, 25 bp, Homo sapien
ttctgtattgtgcagttacacaata

SEQ ID NO: 169377 - DNA, 25 bp, Homo sapien
tgtgcagttacacaataaggtaatt

SEQ ID NO: 169378 - DNA, 25 bp, Homo sapien
agggtgaggggtgccgcccatgggc

SEQ ID NO: 169379 - DNA, 25 bp, Homo sapien
ggtgaggggtgccgcccatgggcca

SEQ ID NO: 169380 - DNA, 25 bp, Homo sapien
aggggtgccgcccatgggccacaaa

SEQ ID NO: 169381 - DNA, 25 bp, Homo sapien
tgctcctaggactggcccatgggca

SEQ ID NO: 169382 - DNA, 25 bp, Homo sapien
gctcctaggactggcccatgggcag

SEQ ID NO: 169383 - DNA, 25 bp, Homo sapien
ctcctaggactggcccatgggcagg

SEQ ID NO: 169384 - DNA, 25 bp, Homo sapien
gggctgtggtcaagccttattctgt

SEQ ID NO: 169385 - DNA, 25 bp, Homo sapien
ggctgtggtcaagccttattctgta

SEQ ID NO: 169386 - DNA, 25 bp, Homo sapien
gctgtggtcaagccttattctgtat

SEQ ID NO: 169387 - DNA, 25 bp, Homo sapien
ctgtggtcaagccttattctgtatt

SEQ ID NO: 169388 - DNA, 25 bp, Homo sapien
tgtggtcaagccttattctgtattg

SEQ ID NO: 169389 - DNA, 25 bp, Homo sapien
ggctggaatggattggagaaattaa

SEQ ID NO: 169390 - DNA, 25 bp, Homo sapien
gatagtggaagtaccaattacaacc

SEQ ID NO: 169391 - DNA, 25 bp, Homo sapien
taccaattacaacccggccctcaag

SEQ ID NO: 169392 - DNA, 25 bp, Homo sapien
gtattattgtacgaggagggctata

SEQ ID NO: 169393 - DNA, 25 bp, Homo sapien
tattgtacgaggagggctataagtc

SEQ ID NO: 169394 - DNA, 25 bp, Homo sapien
gaggagggctataagtcctagacat

SEQ ID NO: 169395 - DNA, 25 bp, Homo sapien
agtcctagacatataacaggaggtc

SEQ ID NO: 169396 - DNA, 25 bp, Homo sapien
atataacaggaggtcgtacttcgcg

SEQ ID NO: 169397 - DNA, 25 bp, Homo sapien
tataacaggaggtcgtacttcgcgg

SEQ ID NO: 169398 - DNA, 25 bp, Homo sapien
gagtttttatcggtctggacgtctg

SEQ ID NO: 169399 - DNA, 25 bp, Homo sapien
agtttttatcggtctggacgtctgg

SEQ ID NO: 169400 - DNA, 25 bp, Homo sapien
cactattattgggtttgttttatgc

SEQ ID NO: 169401 - DNA, 25 bp, Homo sapien
ctattattgggtttgttttatgcca

SEQ ID NO: 169402 - DNA, 25 bp, Homo sapien
ttatgccattattgattcttgatat

SEQ ID NO: 169403 - DNA, 25 bp, Homo sapien
tatgccattattgattcttgatatt

SEQ ID NO: 169404 - DNA, 25 bp, Homo sapien
atgccattattgattcttgatattc

SEQ ID NO: 169405 - DNA, 25 bp, Homo sapien
tgccattattgattcttgatattca

SEQ ID NO: 169406 - DNA, 25 bp, Homo sapien
gccattattgattcttgatattcaa

SEQ ID NO: 169407 - DNA, 25 bp, Homo sapien
gattcttgatattcaagcatttaca

SEQ ID NO: 169408 - DNA, 25 bp, Homo sapien
agcatttacaatgtagcatatttga

SEQ ID NO: 169409 - DNA, 25 bp, Homo sapien
acaatgtagcatatttgattttctt

SEQ ID NO: 169410 - DNA, 25 bp, Homo sapien
tacattttgtattgcacaataaatt

SEQ ID NO: 169411 - DNA, 25 bp, Homo sapien
cgacaatgcccgaccgcatgttgca

SEQ ID NO: 169412 - DNA, 25 bp, Homo sapien
aatgcccgaccgcatgttgcacaac

SEQ ID NO: 169413 - DNA, 25 bp, Homo sapien
gcatgttgcacaacccacacttcaa

SEQ ID NO: 169414 - DNA, 25 bp, Homo sapien
tgccaaccaactaccacgtctttaa

SEQ ID NO: 169415 - DNA, 25 bp, Homo sapien
aaccaactaccacgtctttaagcat

SEQ ID NO: 169416 - DNA, 25 bp, Homo sapien
ccaactaccacgtctttaagcatct

SEQ ID NO: 169417 - DNA, 25 bp, Homo sapien
actaccacgtctttaagcatctcaa

SEQ ID NO: 169418 - DNA, 25 bp, Homo sapien
ctaccacgtctttaagcatctcaac

SEQ ID NO: 169419 - DNA, 25 bp, Homo sapien
accacgtctttaagcatctcaacaa

SEQ ID NO: 169420 - DNA, 25 bp, Homo sapien
cacgtctttaagcatctcaacaact

SEQ ID NO: 169421 - DNA, 25 bp, Homo sapien
gtctttaagcatctcaacaactttt

SEQ ID NO: 169422 - DNA, 25 bp, Homo sapien
tacacataggagctgcatttaaaac

SEQ ID NO: 169423 - DNA, 25 bp, Homo sapien
acacataggagctgcatttaaaacc

SEQ ID NO: 169424 - DNA, 25 bp, Homo sapien
cacataggagctgcatttaaaacct

SEQ ID NO: 169425 - DNA, 25 bp, Homo sapien
acataggagctgcatttaaaacctg

SEQ ID NO: 169426 - DNA, 25 bp, Homo sapien
cataggagctgcatttaaaacctgc

SEQ ID NO: 169427 - DNA, 25 bp, Homo sapien
ataggagctgcatttaaaacctgct

SEQ ID NO: 169428 - DNA, 25 bp, Homo sapien
taggagctgcatttaaaacctgctg

SEQ ID NO: 169429 - DNA, 25 bp, Homo sapien
aggagctgcatttaaaacctgctgg

SEQ ID NO: 169430 - DNA, 25 bp, Homo sapien
ggagctgcatttaaaacctgctggt

SEQ ID NO: 169431 - DNA, 25 bp, Homo sapien
gagctgcatttaaaacctgctggtt

SEQ ID NO: 169432 - DNA, 25 bp, Homo sapien
agctgcatttaaaacctgctggttt

SEQ ID NO: 169433 - DNA, 25 bp, Homo sapien
ctttgtgttgcactgatggctgttc

SEQ ID NO: 169434 - DNA, 25 bp, Homo sapien
atggctgttccatgactgatttgag

SEQ ID NO: 169435 - DNA, 25 bp, Homo sapien
gactgatttgagtgctctttgctaa

SEQ ID NO: 169436 - DNA, 25 bp, Homo sapien
atacccaatgggtggcagagcttta

SEQ ID NO: 169437 - DNA, 25 bp, Homo sapien
ggcagagctttatcacatgtttaat

SEQ ID NO: 169438 - DNA, 25 bp, Homo sapien
ttactgcctggtagaacactaatat

SEQ ID NO: 169439 - DNA, 25 bp, Homo sapien
aaaatgatggcttttgggtaggcaa

SEQ ID NO: 169440 - DNA, 25 bp, Homo sapien
agcggttgaaaccacagtgatctct

SEQ ID NO: 169441 - DNA, 25 bp, Homo sapien
acagtgatctctattttctcccttt

SEQ ID NO: 169442 - DNA, 25 bp, Homo sapien
tctccctttgccaaggttaatgaac

SEQ ID NO: 169443 - DNA, 25 bp, Homo sapien
gaactgttcttttcaaattctacta

SEQ ID NO: 169444 - DNA, 25 bp, Homo sapien
ttcttcttaacccagtcttaggctg

SEQ ID NO: 169445 - DNA, 25 bp, Homo sapien
tcttaggctggtattccctttttat

SEQ ID NO: 169446 - DNA, 25 bp, Homo sapien
tattacttttcacctctttttcact

SEQ ID NO: 169447 - DNA, 25 bp, Homo sapien
tcacctctttttcactttactttag

SEQ ID NO: 169448 - DNA, 25 bp, Homo sapien
taatatactactggcttcatgaccc

SEQ ID NO: 169449 - DNA, 25 bp, Homo sapien
ttcatgaccctgtagcatctttggc

SEQ ID NO: 169450 - DNA, 25 bp, Homo sapien
agcatctttggccactttaatctag

SEQ ID NO: 169451 - DNA, 25 bp, Homo sapien
tagggtgacctagcaatcctgcagc

SEQ ID NO: 169452 - DNA, 25 bp, Homo sapien
ggcagagagtactgtcttaggaatt

SEQ ID NO: 169453 - DNA, 25 bp, Homo sapien
acatttttccccatgaacggtgctg

SEQ ID NO: 169454 - DNA, 25 bp, Homo sapien
aacggtgctgttctgaagtcttcaa

SEQ ID NO: 169455 - DNA, 25 bp, Homo sapien
tggagggatccagcgtatcttgcca

SEQ ID NO: 169456 - DNA, 25 bp, Homo sapien
ggatccagcgtatcttgccagtaac

SEQ ID NO: 169457 - DNA, 25 bp, Homo sapien
agcgtatcttgccagtaaccagtga

SEQ ID NO: 169458 - DNA, 25 bp, Homo sapien
gtatcttgccagtaaccagtgaggt

SEQ ID NO: 169459 - DNA, 25 bp, Homo sapien
gccagtaaccagtgaggtgtatcag

SEQ ID NO: 169460 - DNA, 25 bp, Homo sapien
aggtgtatcagtaaggtgggattat

SEQ ID NO: 169461 - DNA, 25 bp, Homo sapien
gaatcatcagagtaaactgccagtt

SEQ ID NO: 169462 - DNA, 25 bp, Homo sapien
gtaaactgccagttgcaaatttgat

SEQ ID NO: 169463 - DNA, 25 bp, Homo sapien
ctgccagttgcaaatttgataggat

SEQ ID NO: 169464 - DNA, 25 bp, Homo sapien
aggattattaacctctgagcagtga

SEQ ID NO: 169465 - DNA, 25 bp, Homo sapien
acctctgagcagtgatatagcataa

SEQ ID NO: 169466 - DNA, 25 bp, Homo sapien
ttttttccttttgtgctgccaaatt

SEQ ID NO: 169467 - DNA, 25 bp, Homo sapien
tgtgctgccaaattggttttgctag

SEQ ID NO: 169468 - DNA, 25 bp, Homo sapien
ggttttgctagaacgactgctgaag

SEQ ID NO: 169469 - DNA, 25 bp, Homo sapien
gaacttcataagataaccacttgat

SEQ ID NO: 169470 - DNA, 25 bp, Homo sapien
aaccacttgattttgtgattccaat

SEQ ID NO: 169471 - DNA, 25 bp, Homo sapien
gattttgtgattccaattctttgta

SEQ ID NO: 169472 - DNA, 25 bp, Homo sapien
gtaattgtcttcagagcagccctac

SEQ ID NO: 169473 - DNA, 25 bp, Homo sapien
tactagcacataccgcgtggtgttt

SEQ ID NO: 169474 - DNA, 25 bp, Homo sapien
ccgcgtggtgtttgtatttctgtga

SEQ ID NO: 169475 - DNA, 25 bp, Homo sapien
tgaacacacagccagtccgtttcta

SEQ ID NO: 169476 - DNA, 25 bp, Homo sapien
cagtccgtttctaggctttgtttct

SEQ ID NO: 169477 - DNA, 25 bp, Homo sapien
caacacaataacactttctgtataa

SEQ ID NO: 169478 - DNA, 25 bp, Homo sapien
atattttatgtgatttattcctact

SEQ ID NO: 169479 - DNA, 25 bp, Homo sapien
tattcctactaaatgaaagtgcact

SEQ ID NO: 169480 - DNA, 25 bp, Homo sapien
gaaagtgcactactgcctcatgtaa

SEQ ID NO: 169481 - DNA, 25 bp, Homo sapien
tactgcctcatgtaaagactcttgc

SEQ ID NO: 169482 - DNA, 25 bp, Homo sapien
aagactcttgcacgcagagccttta

SEQ ID NO: 169483 - DNA, 25 bp, Homo sapien
gcacgcagagcctttaagtgactaa

SEQ ID NO: 169484 - DNA, 25 bp, Homo sapien
tagatagtgagcatagtccccacct

SEQ ID NO: 169485 - DNA, 25 bp, Homo sapien
gaatacttcaattgtgcctctcaat

SEQ ID NO: 169486 - DNA, 25 bp, Homo sapien
gtgcctctcaattttttgtaatgct

SEQ ID NO: 169487 - DNA, 25 bp, Homo sapien
aatcagtatctagatggtttttaaa

SEQ ID NO: 169488 - DNA, 25 bp, Homo sapien
attgggtttgttatctgtggtagta

SEQ ID NO: 169489 - DNA, 25 bp, Homo sapien
gtagtatatatcctagtgttcctat

SEQ ID NO: 169490 - DNA, 25 bp, Homo sapien
atatcctagtgttcctatagtgaaa

SEQ ID NO: 169491 - DNA, 25 bp, Homo sapien
gtagggttcagccaaagctttcttt

SEQ ID NO: 169492 - DNA, 25 bp, Homo sapien
tgttttgtaccttaaattgttcgat

SEQ ID NO: 169493 - DNA, 25 bp, Homo sapien
aattgttcgattacgtcatcaaaag

SEQ ID NO: 169494 - DNA, 25 bp, Homo sapien
gaaaggtatgtagaacaggttcacg

SEQ ID NO: 169495 - DNA, 25 bp, Homo sapien
caggttcacgtgattacctttttct

SEQ ID NO: 169496 - DNA, 25 bp, Homo sapien
aacgtgtttgtattgtaggtggtgt

SEQ ID NO: 169497 - DNA, 25 bp, Homo sapien
ggtggtgtttgtattatgcttatga

SEQ ID NO: 169498 - DNA, 25 bp, Homo sapien
atgcttatgactatgtatggtttga

SEQ ID NO: 169499 - DNA, 25 bp, Homo sapien
catattgtggaattgactcaaaaat

SEQ ID NO: 169500 - DNA, 25 bp, Homo sapien
ctcaaaaatgaggtacttcagtatt

SEQ ID NO: 169501 - DNA, 25 bp, Homo sapien
gatatcttcatagcaatgtctccta

SEQ ID NO: 169502 - DNA, 25 bp, Homo sapien
gcaatgtctcctaaaggtgttttgt

SEQ ID NO: 169503 - DNA, 25 bp, Homo sapien
gtgttttgtaaaggatatcaatgcc

SEQ ID NO: 169504 - DNA, 25 bp, Homo sapien
tcaatgccttgattagacctaattt

SEQ ID NO: 169505 - DNA, 25 bp, Homo sapien
gacctaatttgtagacttaagactt

SEQ ID NO: 169506 - DNA, 25 bp, Homo sapien
tttctaaaccttgtgattctgctta

SEQ ID NO: 169507 - DNA, 25 bp, Homo sapien
gtgattctgcttataagtcatttat

SEQ ID NO: 169508 - DNA, 25 bp, Homo sapien
tatgcagccgctgtaggaaccaatt

SEQ ID NO: 169509 - DNA, 25 bp, Homo sapien
gccgctgtaggaaccaattcttgat

SEQ ID NO: 169510 - DNA, 25 bp, Homo sapien
gcttcagcgaatccaccattgtctg

SEQ ID NO: 169511 - DNA, 25 bp, Homo sapien
aatccaccattgtctgcaactcatt

SEQ ID NO: 169512 - DNA, 25 bp, Homo sapien
attgtctgcaactcattggacggca

SEQ ID NO: 169513 - DNA, 25 bp, Homo sapien
gcaactcattggacggcagcaactg

SEQ ID NO: 169514 - DNA, 25 bp, Homo sapien
agaggtcaagttcacagtgaccttt

SEQ ID NO: 169515 - DNA, 25 bp, Homo sapien
acagtgacctttgagagtgacaaat

SEQ ID NO: 169516 - DNA, 25 bp, Homo sapien
tgccagatgggcacgagctgacttt

SEQ ID NO: 169517 - DNA, 25 bp, Homo sapien
ccagatgggcacgagctgacttttc

SEQ ID NO: 169518 - DNA, 25 bp, Homo sapien
gggcgggttcaacatgtcctctttc

SEQ ID NO: 169519 - DNA, 25 bp, Homo sapien
ggttcaacatgtcctctttcaagtt

SEQ ID NO: 169520 - DNA, 25 bp, Homo sapien
caacatgtcctctttcaagttaaaa

SEQ ID NO: 169521 - DNA, 25 bp, Homo sapien
ttagctagtgagcagaggtctgtat

SEQ ID NO: 169522 - DNA, 25 bp, Homo sapien
tctgtatattgtccttgccccagcc

SEQ ID NO: 169523 - DNA, 25 bp, Homo sapien
cagcctgcaatctgtggatgcccag

SEQ ID NO: 169524 - DNA, 25 bp, Homo sapien
gggaaggcatacaggcctcatccac

SEQ ID NO: 169525 - DNA, 25 bp, Homo sapien
tcatccaccaggcaatagacaggag

SEQ ID NO: 169526 - DNA, 25 bp, Homo sapien
gtagatacgcaaattgtcacaacta

SEQ ID NO: 169527 - DNA, 25 bp, Homo sapien
gagtgataatttggtagctctgtat

SEQ ID NO: 169528 - DNA, 25 bp, Homo sapien
gctctgtatgtatgctggttccaac

SEQ ID NO: 169529 - DNA, 25 bp, Homo sapien
gctggttccaactgtttaatccctt

SEQ ID NO: 169530 - DNA, 25 bp, Homo sapien
ttctgttctcacaaagatggaaaag

SEQ ID NO: 169531 - DNA, 25 bp, Homo sapien
aaagatgcaagagcttgccggaaat

SEQ ID NO: 169532 - DNA, 25 bp, Homo sapien
ttaagaatcaggcagtcgcccactt

SEQ ID NO: 169533 - DNA, 25 bp, Homo sapien
gcccacttctctccagatgaaggga

SEQ ID NO: 169534 - DNA, 25 bp, Homo sapien
gacattcataggtcccaaatctgcc

SEQ ID NO: 169535 - DNA, 25 bp, Homo sapien
ccaaatctgcccattcagatgtcac

SEQ ID NO: 169536 - DNA, 25 bp, Homo sapien
tggtgggatatcaatttacttcttc

SEQ ID NO: 169537 - DNA, 25 bp, Homo sapien
aatttacttcttccacacatgtggt

SEQ ID NO: 169538 - DNA, 25 bp, Homo sapien
gtgcacatgtgagcttgtgtgcttt

SEQ ID NO: 169539 - DNA, 25 bp, Homo sapien
gttgattggcaaaagcagcacagta

SEQ ID NO: 169540 - DNA, 25 bp, Homo sapien
tagagtaggatgcagcctcttatgc

SEQ ID NO: 169541 - DNA, 25 bp, Homo sapien
agcctcttatgcaccacagttaaat

SEQ ID NO: 169542 - DNA, 25 bp, Homo sapien
gacatgggacatttaaatcctcaag

SEQ ID NO: 169543 - DNA, 25 bp, Homo sapien
aggcgtgcggctgctgtcctaccag

SEQ ID NO: 169544 - DNA, 25 bp, Homo sapien
tgtcctaccagacttcactggtgtc

SEQ ID NO: 169545 - DNA, 25 bp, Homo sapien
gagacctggcacgtcatgggcatct

SEQ ID NO: 169546 - DNA, 25 bp, Homo sapien
acgtcatgggcatctcctccttgct

SEQ ID NO: 169547 - DNA, 25 bp, Homo sapien
tgcccagcctggaagcgtggaagca

SEQ ID NO: 169548 - DNA, 25 bp, Homo sapien
ttccagttccacttctaaccttgga

SEQ ID NO: 169549 - DNA, 25 bp, Homo sapien
taaccttggagctcactggtccctg

SEQ ID NO: 169550 - DNA, 25 bp, Homo sapien
ccactgtgatcaatagggagagaaa

SEQ ID NO: 169551 - DNA, 25 bp, Homo sapien
atccacattcttgggctgaacgcgg

SEQ ID NO: 169552 - DNA, 25 bp, Homo sapien
gaacgcgggcctctgacactgctta

SEQ ID NO: 169553 - DNA, 25 bp, Homo sapien
gcactctgaccctgtagtacagcaa

SEQ ID NO: 169554 - DNA, 25 bp, Homo sapien
tgaagcaaattctcagactgaacta

SEQ ID NO: 169555 - DNA, 25 bp, Homo sapien
gactgaactacttcttagacctcac

SEQ ID NO: 169556 - DNA, 25 bp, Homo sapien
gaactacttcttagacctcactgta

SEQ ID NO: 169557 - DNA, 25 bp, Homo sapien
gaatattttattcaatgtctcattt

SEQ ID NO: 169558 - DNA, 25 bp, Homo sapien
ttatgatagatttgcaagctgctca

SEQ ID NO: 169559 - DNA, 25 bp, Homo sapien
ttgcaagctgctcatttttgaacag

SEQ ID NO: 169560 - DNA, 25 bp, Homo sapien
gaacagctttttgcatgggatagga

SEQ ID NO: 169561 - DNA, 25 bp, Homo sapien
gggataggagcatgtctattctaac

SEQ ID NO: 169562 - DNA, 25 bp, Homo sapien
gtctattctaacacatcagcttatt

SEQ ID NO: 169563 - DNA, 25 bp, Homo sapien
aacgatcctgttaattaaaccacag

SEQ ID NO: 169564 - DNA, 25 bp, Homo sapien
aaccacagacaccatatatccttct

SEQ ID NO: 169565 - DNA, 25 bp, Homo sapien
gaacatcaagaaccccaccaaaata

SEQ ID NO: 169566 - DNA, 25 bp, Homo sapien
atgacaaaccacacaattgttgttg

SEQ ID NO: 169567 - DNA, 25 bp, Homo sapien
caattgttgttgagtaaaccacgca

SEQ ID NO: 169568 - DNA, 25 bp, Homo sapien
aagaaaccagaatagtcaacagtgt

SEQ ID NO: 169569 - DNA, 25 bp, Homo sapien
accagaatagtcaacagtgttcaaa

SEQ ID NO: 169570 - DNA, 25 bp, Homo sapien
atccctgaggccctttcaaacatga

SEQ ID NO: 169571 - DNA, 25 bp, Homo sapien
tgaggccctttcaaacatgatcaaa

SEQ ID NO: 169572 - DNA, 25 bp, Homo sapien
ggccctttcaaacatgatcaaagat

SEQ ID NO: 169573 - DNA, 25 bp, Homo sapien
caaagatttcccaatgtgatctcat

SEQ ID NO: 169574 - DNA, 25 bp, Homo sapien
gatttcccaatgtgatctcatcatc

SEQ ID NO: 169575 - DNA, 25 bp, Homo sapien
tcccaatgtgatctcatcatcatgg

SEQ ID NO: 169576 - DNA, 25 bp, Homo sapien
ttttccaactgggtgtgcatgctaa

SEQ ID NO: 169577 - DNA, 25 bp, Homo sapien
actgggtgtgcatgctaaaaacctg

SEQ ID NO: 169578 - DNA, 25 bp, Homo sapien
gtattttcatgcttttcaaacaaca

SEQ ID NO: 169579 - DNA, 25 bp, Homo sapien
aaacaacatgaatagtcagctgact

SEQ ID NO: 169580 - DNA, 25 bp, Homo sapien
gtcagctgactaaagactgtgtgtg

SEQ ID NO: 169581 - DNA, 25 bp, Homo sapien
gactgtgtgtgttgtggtaacacca

SEQ ID NO: 169582 - DNA, 25 bp, Homo sapien
gatagtttagcttcagtactgtgac

SEQ ID NO: 169583 - DNA, 25 bp, Homo sapien
actgtgacagttatgtttactggac

SEQ ID NO: 169584 - DNA, 25 bp, Homo sapien
gtttactggacatagtctttttggc

SEQ ID NO: 169585 - DNA, 25 bp, Homo sapien
caactatgatagatgcccaaagcat

SEQ ID NO: 169586 - DNA, 25 bp, Homo sapien
gaactggagatttcatttctctatc

SEQ ID NO: 169587 - DNA, 25 bp, Homo sapien
cagggcgttaaattcacagattttt

SEQ ID NO: 169588 - DNA, 25 bp, Homo sapien
gaagctacctcaggtgtttttacct

SEQ ID NO: 169589 - DNA, 25 bp, Homo sapien
tgtttttacctcagcaccttgatct

SEQ ID NO: 169590 - DNA, 25 bp, Homo sapien
accttgatcttgtgtttcccttaga

SEQ ID NO: 169591 - DNA, 25 bp, Homo sapien
ttgtgtttcccttagagattttgta

SEQ ID NO: 169592 - DNA, 25 bp, Homo sapien
taagatatcaactgccagcctggag

SEQ ID NO: 169593 - DNA, 25 bp, Homo sapien
aaggtgacagtccaagtgtgcaaca

SEQ ID NO: 169594 - DNA, 25 bp, Homo sapien
gtccaagtgtgcaacagctgttctg

SEQ ID NO: 169595 - DNA, 25 bp, Homo sapien
agctgttctgaattgtcttccgcta

SEQ ID NO: 169596 - DNA, 25 bp, Homo sapien
tcttccgctagccaagaacctatat

SEQ ID NO: 169597 - DNA, 25 bp, Homo sapien
aagaacctatatggccttcttttgg

SEQ ID NO: 169598 - DNA, 25 bp, Homo sapien
tccgccgtggcgacatcattgaggt

SEQ ID NO: 169599 - DNA, 25 bp, Homo sapien
cgacatcattgaggtcctggagcgc

SEQ ID NO: 169600 - DNA, 25 bp, Homo sapien
ttggcttcttcccacggagttacgt

SEQ ID NO: 169601 - DNA, 25 bp, Homo sapien
acggagttacgtgcagcccgtgcac

SEQ ID NO: 169602 - DNA, 25 bp, Homo sapien
tacgtgcagcccgtgcacctgtgag

SEQ ID NO: 169603 - DNA, 25 bp, Homo sapien
agcccggcggcgatcttgccaacgg

SEQ ID NO: 169604 - DNA, 25 bp, Homo sapien
ggctttttacaggaactgaggtcca

SEQ ID NO: 169605 - DNA, 25 bp, Homo sapien
cccagctctgtcagagtcacacggg

SEQ ID NO: 169606 - DNA, 25 bp, Homo sapien
agtggacggccttggactgaacgta

SEQ ID NO: 169607 - DNA, 25 bp, Homo sapien
ttggactgaacgtaggctcctaact

SEQ ID NO: 169608 - DNA, 25 bp, Homo sapien
tgaacgtaggctcctaactgcctcc

SEQ ID NO: 169609 - DNA, 25 bp, Homo sapien
gaagtgcaggtggatgacatcaagc

SEQ ID NO: 169610 - DNA, 25 bp, Homo sapien
ggatgacatcaagcgggtctactca

SEQ ID NO: 169611 - DNA, 25 bp, Homo sapien
gtctactcactcttcctggacgagt

SEQ ID NO: 169612 - DNA, 25 bp, Homo sapien
gagtcccgctccacgcagtacatga

SEQ ID NO: 169613 - DNA, 25 bp, Homo sapien
cccgctccacgcagtacatgaagga

SEQ ID NO: 169614 - DNA, 25 bp, Homo sapien
tcaacgaactcaaaggcgagaccat

SEQ ID NO: 169615 - DNA, 25 bp, Homo sapien
aaaggcgagaccatggacacctcct

SEQ ID NO: 169616 - DNA, 25 bp, Homo sapien
gagaccatggacacctcctgagttg

SEQ ID NO: 169617 - DNA, 25 bp, Homo sapien
accatggacacctcctgagttggat

SEQ ID NO: 169618 - DNA, 25 bp, Homo sapien
acacctcctgagttggatgtcatcc

SEQ ID NO: 169619 - DNA, 25 bp, Homo sapien
ccaccctgttttccaccagagttct

SEQ ID NO: 169620 - DNA, 25 bp, Homo sapien
agatgaggccagaccatggacacta

SEQ ID NO: 169621 - DNA, 25 bp, Homo sapien
gatgaggccagaccatggacactac

SEQ ID NO: 169622 - DNA, 25 bp, Homo sapien
atgaggccagaccatggacactaca

SEQ ID NO: 169623 - DNA, 25 bp, Homo sapien
tgaggccagaccatggacactacac

SEQ ID NO: 169624 - DNA, 25 bp, Homo sapien
gaggccagaccatggacactacacc

SEQ ID NO: 169625 - DNA, 25 bp, Homo sapien
aggccagaccatggacactacaccc

SEQ ID NO: 169626 - DNA, 25 bp, Homo sapien
ggccagaccatggacactacaccca

SEQ ID NO: 169627 - DNA, 25 bp, Homo sapien
gccagaccatggacactacacccag

SEQ ID NO: 169628 - DNA, 25 bp, Homo sapien
aagacaaaccgaagactctttgaag

SEQ ID NO: 169629 - DNA, 25 bp, Homo sapien
gactctttgaagacatcgtaacact

SEQ ID NO: 169630 - DNA, 25 bp, Homo sapien
gaagacatcgtaacactgaaaagta

SEQ ID NO: 169631 - DNA, 25 bp, Homo sapien
aagtacactttctactaaagatgca

SEQ ID NO: 169632 - DNA, 25 bp, Homo sapien
tcttggaattcatcataacatggaa

SEQ ID NO: 169633 - DNA, 25 bp, Homo sapien
ggaatctacagtactgaccatcaat

SEQ ID NO: 169634 - DNA, 25 bp, Homo sapien
ttcctttctgcttagtgaatgaata

SEQ ID NO: 169635 - DNA, 25 bp, Homo sapien
gaatactggaatccatctgtgttga

SEQ ID NO: 169636 - DNA, 25 bp, Homo sapien
gcagtgcccaatgtgcaggcagttt

SEQ ID NO: 169637 - DNA, 25 bp, Homo sapien
gcaggcagtttgttcaggaatcttt

SEQ ID NO: 169638 - DNA, 25 bp, Homo sapien
tcttttgcactttgcagtcaaaaag

SEQ ID NO: 169639 - DNA, 25 bp, Homo sapien
cttggtccctgaatatttctaggtt

SEQ ID NO: 169640 - DNA, 25 bp, Homo sapien
ttctaggtttgtaagtgcagcagtt

SEQ ID NO: 169641 - DNA, 25 bp, Homo sapien
gcagcagttttatttcctctagaac

SEQ ID NO: 169642 - DNA, 25 bp, Homo sapien
cctctagaactcatcctgtttcaag

SEQ ID NO: 169643 - DNA, 25 bp, Homo sapien
gtgtttctagggtaagggacctgca

SEQ ID NO: 169644 - DNA, 25 bp, Homo sapien
gggacctgcaggtgtaagcatagat

SEQ ID NO: 169645 - DNA, 25 bp, Homo sapien
ataactgtcctgtcacatgtgcagc

SEQ ID NO: 169646 - DNA, 25 bp, Homo sapien
cattcctgcagcatcaccataagca

SEQ ID NO: 169647 - DNA, 25 bp, Homo sapien
ccataagcagtgcagggtgtctcca

SEQ ID NO: 169648 - DNA, 25 bp, Homo sapien
gcagggtgtctccatcgagctgttt

SEQ ID NO: 169649 - DNA, 25 bp, Homo sapien
cgagctgtttggttccatgtgtgtt

SEQ ID NO: 169650 - DNA, 25 bp, Homo sapien
gaaacagaatacacgttcttgaaaa

SEQ ID NO: 169651 - DNA, 25 bp, Homo sapien
cacgttcttgaaaaatgttgttaat

SEQ ID NO: 169652 - DNA, 25 bp, Homo sapien
aatgttgttaatctctattatggaa

SEQ ID NO: 169653 - DNA, 25 bp, Homo sapien
attttggattgtatgttcaggagaa

SEQ ID NO: 169654 - DNA, 25 bp, Homo sapien
tagaggaagagctactaagagcaaa

SEQ ID NO: 169655 - DNA, 25 bp, Homo sapien
gtggagaagctgaaagcaattcgct

SEQ ID NO: 169656 - DNA, 25 bp, Homo sapien
aagcaattcgcttacggcatgatct

SEQ ID NO: 169657 - DNA, 25 bp, Homo sapien
ttcgcttacggcatgatctacctga

SEQ ID NO: 169658 - DNA, 25 bp, Homo sapien
tacggcatgatctacctgaatataa

SEQ ID NO: 169659 - DNA, 25 bp, Homo sapien
gatctacctgaatataacagtctct

SEQ ID NO: 169660 - DNA, 25 bp, Homo sapien
gaatataacagtctctaagtttttt

SEQ ID NO: 169661 - DNA, 25 bp, Homo sapien
gccagataagatttcaggagctgat

SEQ ID NO: 169662 - DNA, 25 bp, Homo sapien
agagtggaatgttggctgtccgtga

SEQ ID NO: 169663 - DNA, 25 bp, Homo sapien
gctgtccgtgaaaaccgctacattg

SEQ ID NO: 169664 - DNA, 25 bp, Homo sapien
accgctacattgtcctggccaagga

SEQ ID NO: 169665 - DNA, 25 bp, Homo sapien
gctacattgtcctggccaaggactt

SEQ ID NO: 169666 - DNA, 25 bp, Homo sapien
ctggccaaggacttcgagaaagcat

SEQ ID NO: 169667 - DNA, 25 bp, Homo sapien
gagaaagcatacaagactgtcatca

SEQ ID NO: 169668 - DNA, 25 bp, Homo sapien
ggacgagcaggagcatgagttttac

SEQ ID NO: 169669 - DNA, 25 bp, Homo sapien
tgagttttacaagtgacccttccct

SEQ ID NO: 169670 - DNA, 25 bp, Homo sapien
tttacccaggattggtttcttcaat

SEQ ID NO: 169671 - DNA, 25 bp, Homo sapien
tacccaggattggtttcttcaataa

SEQ ID NO: 169672 - DNA, 25 bp, Homo sapien
aagtcaacctttgtacttcatccca

SEQ ID NO: 169673 - DNA, 25 bp, Homo sapien
tgtacttcatcccagaaacatccac

SEQ ID NO: 169674 - DNA, 25 bp, Homo sapien
ggagttggtctcagcaggaccccat

SEQ ID NO: 169675 - DNA, 25 bp, Homo sapien
aggaccccattgcagcaaagacgaa

SEQ ID NO: 169676 - DNA, 25 bp, Homo sapien
atgtaagccactgcttctgtcgtat

SEQ ID NO: 169677 - DNA, 25 bp, Homo sapien
ctgtcgtatcgcctcatcagggaag

SEQ ID NO: 169678 - DNA, 25 bp, Homo sapien
atctgcattcatttcctccagtctc

SEQ ID NO: 169679 - DNA, 25 bp, Homo sapien
ccagtctcacagatcctttctgata

SEQ ID NO: 169680 - DNA, 25 bp, Homo sapien
tgatattcaggccaggacacccaca

SEQ ID NO: 169681 - DNA, 25 bp, Homo sapien
gccaggacacccacagataattcta

SEQ ID NO: 169682 - DNA, 25 bp, Homo sapien
gataattctattctctcttgcagag

SEQ ID NO: 169683 - DNA, 25 bp, Homo sapien
gactttgtgactgtcacttgctgct

SEQ ID NO: 169684 - DNA, 25 bp, Homo sapien
tgctgctttttctgcgcttcagtaa

SEQ ID NO: 169685 - DNA, 25 bp, Homo sapien
tttctgcgcttcagtaacaagtgtt

SEQ ID NO: 169686 - DNA, 25 bp, Homo sapien
ttggcaaacgagactttctcctggc

SEQ ID NO: 169687 - DNA, 25 bp, Homo sapien
agcatgcctgtcctttcagtctgat

SEQ ID NO: 169688 - DNA, 25 bp, Homo sapien
aggcagtccatctagggaatgggac

SEQ ID NO: 169689 - DNA, 25 bp, Homo sapien
ggactgtgaggccatacttgtgaaa

SEQ ID NO: 169690 - DNA, 25 bp, Homo sapien
atacttgtgaaacgtctggactgct

SEQ ID NO: 169691 - DNA, 25 bp, Homo sapien
gtctggactgctattctagagcttt

SEQ ID NO: 169692 - DNA, 25 bp, Homo sapien
agagcttttatttggtgtgttcgtt

SEQ ID NO: 169693 - DNA, 25 bp, Homo sapien
gtgttcgttgcacagctgtttgaaa

SEQ ID NO: 169694 - DNA, 25 bp, Homo sapien
gatacctgatcaacttcgacatttg

SEQ ID NO: 169695 - DNA, 25 bp, Homo sapien
gatcaacttcgacatttgggcaatg

SEQ ID NO: 169696 - DNA, 25 bp, Homo sapien
acttcgacatttgggcaatgccatc

SEQ ID NO: 169697 - DNA, 25 bp, Homo sapien
gggcaatgccatcaaacaggttact

SEQ ID NO: 169698 - DNA, 25 bp, Homo sapien
atgccatcaaacaggttactatgaa

SEQ ID NO: 169699 - DNA, 25 bp, Homo sapien
atggagaaggtgttgagtcttccaa

SEQ ID NO: 169700 - DNA, 25 bp, Homo sapien
tgttgagtcttccaaaacccaccat

SEQ ID NO: 169701 - DNA, 25 bp, Homo sapien
aaaacccaccattattctcagtgcc

SEQ ID NO: 169702 - DNA, 25 bp, Homo sapien
tctcagtgcctaccagcgaaagtgc

SEQ ID NO: 169703 - DNA, 25 bp, Homo sapien
gcgaaagtgcattcagtccatcctg

SEQ ID NO: 169704 - DNA, 25 bp, Homo sapien
gaaagtgcattcagtccatcctgaa

SEQ ID NO: 169705 - DNA, 25 bp, Homo sapien
gcttcaagtcagatgaggttaccca

SEQ ID NO: 169706 - DNA, 25 bp, Homo sapien
gaggttacccaggagatttcagatg

SEQ ID NO: 169707 - DNA, 25 bp, Homo sapien
gaaacaagagttttccgcttattag

SEQ ID NO: 169708 - DNA, 25 bp, Homo sapien
ccgcttattaggatcagacagggtt

SEQ ID NO: 169709 - DNA, 25 bp, Homo sapien
tcagacagggttgtcgttttggaaa

SEQ ID NO: 169710 - DNA, 25 bp, Homo sapien
aaatcctactgcacacagcaatctc

SEQ ID NO: 169711 - DNA, 25 bp, Homo sapien
gcaatctctacatcttggctggaca

SEQ ID NO: 169712 - DNA, 25 bp, Homo sapien
ctacatcttggctggacatgaaaat

SEQ ID NO: 169713 - DNA, 25 bp, Homo sapien
gcaacagaaactgatctcaaatgac

SEQ ID NO: 169714 - DNA, 25 bp, Homo sapien
ggaaattcaatacaaactgcactat

SEQ ID NO: 169715 - DNA, 25 bp, Homo sapien
aactgcactatgatttgctttaact

SEQ ID NO: 169716 - DNA, 25 bp, Homo sapien
agctccacaatgataacttctccct

SEQ ID NO: 169717 - DNA, 25 bp, Homo sapien
cgagggctctcacccaaatgatgat

SEQ ID NO: 169718 - DNA, 25 bp, Homo sapien
gctctcacccaaatgatgatcctag

SEQ ID NO: 169719 - DNA, 25 bp, Homo sapien
caaatgatgatcctagtgctcccca

SEQ ID NO: 169720 - DNA, 25 bp, Homo sapien
aaaatccaggaggttctcaagtcct

SEQ ID NO: 169721 - DNA, 25 bp, Homo sapien
caggaggttctcaagtcctgcctga

SEQ ID NO: 169722 - DNA, 25 bp, Homo sapien
gaggagtcatttaacatccagaact

SEQ ID NO: 169723 - DNA, 25 bp, Homo sapien
agaactccatgtcgcccaaacttga

SEQ ID NO: 169724 - DNA, 25 bp, Homo sapien
gtcgcccaaacttgagggtggcaaa

SEQ ID NO: 169725 - DNA, 25 bp, Homo sapien
gacttggatgtgaactgtcttcaga

SEQ ID NO: 169726 - DNA, 25 bp, Homo sapien
aatttaacctaaagcagagcaagaa

SEQ ID NO: 169727 - DNA, 25 bp, Homo sapien
attagtattacttgaatgcatccag

SEQ ID NO: 169728 - DNA, 25 bp, Homo sapien
attacttgaatgcatccagaggata

SEQ ID NO: 169729 - DNA, 25 bp, Homo sapien
accagaaggccatttggtgtcccct

SEQ ID NO: 169730 - DNA, 25 bp, Homo sapien
agaaggccatttggtgtcccctctc

SEQ ID NO: 169731 - DNA, 25 bp, Homo sapien
ccaggtgtccccttgtagcatatgc

SEQ ID NO: 169732 - DNA, 25 bp, Homo sapien
gcattatgtcatctgaattgaggcc

SEQ ID NO: 169733 - DNA, 25 bp, Homo sapien
gtcatctgaattgaggcctttctgt

SEQ ID NO: 169734 - DNA, 25 bp, Homo sapien
gaggcctttctgtgaacagcatcat

SEQ ID NO: 169735 - DNA, 25 bp, Homo sapien
gaacagcatcataacttctatcatg

SEQ ID NO: 169736 - DNA, 25 bp, Homo sapien
ttctatcatggaaagtgtactatat

SEQ ID NO: 169737 - DNA, 25 bp, Homo sapien
atgtttgtgtcatgtatatgcctaa

SEQ ID NO: 169738 - DNA, 25 bp, Homo sapien
catgcttctgaagtggacatattca

SEQ ID NO: 169739 - DNA, 25 bp, Homo sapien
gtggacatattcagccttggcgaga

SEQ ID NO: 169740 - DNA, 25 bp, Homo sapien
atattcagccttggcgagaagctcc

SEQ ID NO: 169741 - DNA, 25 bp, Homo sapien
ttcagccttggcgagaagctccgtt

SEQ ID NO: 169742 - DNA, 25 bp, Homo sapien
agccttggcgagaagctccgttgca

SEQ ID NO: 169743 - DNA, 25 bp, Homo sapien
ccttggcgagaagctccgttgcacg

SEQ ID NO: 169744 - DNA, 25 bp, Homo sapien
gcgagaagctccgttgcacgggttt

SEQ ID NO: 169745 - DNA, 25 bp, Homo sapien
gagaagctccgttgcacgggtttcc

SEQ ID NO: 169746 - DNA, 25 bp, Homo sapien
gtttccccttgagcccattttacag

SEQ ID NO: 169747 - DNA, 25 bp, Homo sapien
tcagagtcttcccaataaagatgag

SEQ ID NO: 169748 - DNA, 25 bp, Homo sapien
gagtcttcccaataaagatgagttt

SEQ ID NO: 169749 - DNA, 25 bp, Homo sapien
ctgctgtactcagctctaccgaaag

SEQ ID NO: 169750 - DNA, 25 bp, Homo sapien
taccgaaagccactctcagacaagc

SEQ ID NO: 169751 - DNA, 25 bp, Homo sapien
acaagctactgaggaaggtcatcca

SEQ ID NO: 169752 - DNA, 25 bp, Homo sapien
aggtcatccaggtggaactgcagga

SEQ ID NO: 169753 - DNA, 25 bp, Homo sapien
aggctttcgtgcttcacctggctca

SEQ ID NO: 169754 - DNA, 25 bp, Homo sapien
ttcacctggctcaacgcagcatctg

SEQ ID NO: 169755 - DNA, 25 bp, Homo sapien
agcctgtcacagtggtttgagcacc

SEQ ID NO: 169756 - DNA, 25 bp, Homo sapien
gagagaaagctccatgggactctgc

SEQ ID NO: 169757 - DNA, 25 bp, Homo sapien
actctgcccaagctgaattttggga

SEQ ID NO: 169758 - DNA, 25 bp, Homo sapien
tgagcccagaccctacagcagcatt

SEQ ID NO: 169759 - DNA, 25 bp, Homo sapien
agaccctacagcagcattcctactg

SEQ ID NO: 169760 - DNA, 25 bp, Homo sapien
gacgaagaattccaaagtccctttg

SEQ ID NO: 169761 - DNA, 25 bp, Homo sapien
aagtccctttgcaagtcaaagtcga

SEQ ID NO: 169762 - DNA, 25 bp, Homo sapien
gcaagtcaaagtcgaggatattttt

SEQ ID NO: 169763 - DNA, 25 bp, Homo sapien
tattttttattcaggccacggaatg

SEQ ID NO: 169764 - DNA, 25 bp, Homo sapien
caggccacggaatggaagaaggtca

SEQ ID NO: 169765 - DNA, 25 bp, Homo sapien
aaggtcagcagggttcatttaaaat

SEQ ID NO: 169766 - DNA, 25 bp, Homo sapien
aatggatgccagctaattttccaca

SEQ ID NO: 169767 - DNA, 25 bp, Homo sapien
aatccttgctaaatgtactctgttg

SEQ ID NO: 169768 - DNA, 25 bp, Homo sapien
actctgttgaaaatccctgtgttgt

SEQ ID NO: 169769 - DNA, 25 bp, Homo sapien
aatccctgtgttgtcaatgttctca

SEQ ID NO: 169770 - DNA, 25 bp, Homo sapien
tgttgtcaatgttctcagttgtaac

SEQ ID NO: 169771 - DNA, 25 bp, Homo sapien
acccacagaagtctcagtgccagaa

SEQ ID NO: 169772 - DNA, 25 bp, Homo sapien
tgccagaacataagccctgaagtgg

SEQ ID NO: 169773 - DNA, 25 bp, Homo sapien
gtacgctgggacaaggaccatctct

SEQ ID NO: 169774 - DNA, 25 bp, Homo sapien
tgggacaaggaccatctctgtgccc

SEQ ID NO: 169775 - DNA, 25 bp, Homo sapien
tggtcccagtaggtatcaggtcttt

SEQ ID NO: 169776 - DNA, 25 bp, Homo sapien
tatcaggtctttctatgcagctcag

SEQ ID NO: 169777 - DNA, 25 bp, Homo sapien
tctatgcagctcagggagaccctaa

SEQ ID NO: 169778 - DNA, 25 bp, Homo sapien
gaaacactggagtctaagaacaccc

SEQ ID NO: 169779 - DNA, 25 bp, Homo sapien
atgactttgaggtgcacattgttca

SEQ ID NO: 169780 - DNA, 25 bp, Homo sapien
ggtgcacattgttcaagtggagaat

SEQ ID NO: 169781 - DNA, 25 bp, Homo sapien
agatcttaagatacaggtacccaca

SEQ ID NO: 169782 - DNA, 25 bp, Homo sapien
agtctctgagcagcatctgtcccag

SEQ ID NO: 169783 - DNA, 25 bp, Homo sapien
gcaccatccgagacgtgtctttgag

SEQ ID NO: 169784 - DNA, 25 bp, Homo sapien
atcaaagttctcgactacgcgtaca

SEQ ID NO: 169785 - DNA, 25 bp, Homo sapien
tacgcgtacaaacacaacctggctt

SEQ ID NO: 169786 - DNA, 25 bp, Homo sapien
ctactacccagagcctaaggacaag

SEQ ID NO: 169787 - DNA, 25 bp, Homo sapien
ggcttttgtaagatccctggtctac

SEQ ID NO: 169788 - DNA, 25 bp, Homo sapien
tggtctacactccagactatgactc

SEQ ID NO: 169789 - DNA, 25 bp, Homo sapien
gactatgactcctttacactggaca

SEQ ID NO: 169790 - DNA, 25 bp, Homo sapien
tggacagctacacttggcccaagga

SEQ ID NO: 169791 - DNA, 25 bp, Homo sapien
gttcagacggtctgaggcagtctca

SEQ ID NO: 169792 - DNA, 25 bp, Homo sapien
gatgaagcccagagtaacacccaca

SEQ ID NO: 169793 - DNA, 25 bp, Homo sapien
aaggagtccttagtcctttcagcct

SEQ ID NO: 169794 - DNA, 25 bp, Homo sapien
tcagcctcagaggtcacagtgggtg

SEQ ID NO: 169795 - DNA, 25 bp, Homo sapien
tggcaggtgactttccggaggcctt

SEQ ID NO: 169796 - DNA, 25 bp, Homo sapien
gaggccttgagggaaatgcacactg

SEQ ID NO: 169797 - DNA, 25 bp, Homo sapien
ggaaatgcacactgtcccatagcct

SEQ ID NO: 169798 - DNA, 25 bp, Homo sapien
attgggctcccagacgtgctggaaa

SEQ ID NO: 169799 - DNA, 25 bp, Homo sapien
tggcagggatcgttgcactggactc

SEQ ID NO: 169800 - DNA, 25 bp, Homo sapien
atcgttgcactggactcttggcgtg

SEQ ID NO: 169801 - DNA, 25 bp, Homo sapien
gaagggatgctttctctttgtcgcc

SEQ ID NO: 169802 - DNA, 25 bp, Homo sapien
tcttcattcctgtttctcctcagtt

SEQ ID NO: 169803 - DNA, 25 bp, Homo sapien
tcagttcccctgtgcagatgggctg

SEQ ID NO: 169804 - DNA, 25 bp, Homo sapien
tcctcttttgaggagctggacttgg

SEQ ID NO: 169805 - DNA, 25 bp, Homo sapien
cctcttttgaggagctggacttgga

SEQ ID NO: 169806 - DNA, 25 bp, Homo sapien
ctcttttgaggagctggacttggag

SEQ ID NO: 169807 - DNA, 25 bp, Homo sapien
gggagtcacggctggaccctgggac

SEQ ID NO: 169808 - DNA, 25 bp, Homo sapien
ggactaccaagtggctctgggagcc

SEQ ID NO: 169809 - DNA, 25 bp, Homo sapien
actaccaagtggctctgggagccca

SEQ ID NO: 169810 - DNA, 25 bp, Homo sapien
accaagtggctctgggagcccactg

SEQ ID NO: 169811 - DNA, 25 bp, Homo sapien
agggcaaggagtaacccatggcctg

SEQ ID NO: 169812 - DNA, 25 bp, Homo sapien
cctcctgcagtgcagttgctgagga

SEQ ID NO: 169813 - DNA, 25 bp, Homo sapien
cctgcagtgcagttgctgaggaact

SEQ ID NO: 169814 - DNA, 25 bp, Homo sapien
gttgctgaggaactgagcagactct

SEQ ID NO: 169815 - DNA, 25 bp, Homo sapien
tttgatgaagccgagcaactctgtc

SEQ ID NO: 169816 - DNA, 25 bp, Homo sapien
tgatgaagccgagcaactctgtcca

SEQ ID NO: 169817 - DNA, 25 bp, Homo sapien
gatgaagccgagcaactctgtccaa

SEQ ID NO: 169818 - DNA, 25 bp, Homo sapien
atgaagccgagcaactctgtccaaa

SEQ ID NO: 169819 - DNA, 25 bp, Homo sapien
tgaagccgagcaactctgtccaaaa

SEQ ID NO: 169820 - DNA, 25 bp, Homo sapien
gaagccgagcaactctgtccaaaaa

SEQ ID NO: 169821 - DNA, 25 bp, Homo sapien
ttgtactcggaaaccacaaagtagt

SEQ ID NO: 169822 - DNA, 25 bp, Homo sapien
gtactcggaaaccacaaagtagtct

SEQ ID NO: 169823 - DNA, 25 bp, Homo sapien
tcggaaaccacaaagtagtctcaaa

SEQ ID NO: 169824 - DNA, 25 bp, Homo sapien
tgcatttgcttctaacggttccctc

SEQ ID NO: 169825 - DNA, 25 bp, Homo sapien
catttgcttctaacggttccctctc

SEQ ID NO: 169826 - DNA, 25 bp, Homo sapien
tccagcccaatcttctgggtccaga

SEQ ID NO: 169827 - DNA, 25 bp, Homo sapien
aatcttctgggtccagacctgcttg

SEQ ID NO: 169828 - DNA, 25 bp, Homo sapien
ccagacctgcttgtcccttttttag

SEQ ID NO: 169829 - DNA, 25 bp, Homo sapien
aaaccttttttcagcagatatggag

SEQ ID NO: 169830 - DNA, 25 bp, Homo sapien
gagagagctgacaatcaattcacat

SEQ ID NO: 169831 - DNA, 25 bp, Homo sapien
gctgacaatcaattcacatttttta

SEQ ID NO: 169832 - DNA, 25 bp, Homo sapien
gccattttagctaaactgtcattgt

SEQ ID NO: 169833 - DNA, 25 bp, Homo sapien
aactgtcattgtgcatctctgaggt

SEQ ID NO: 169834 - DNA, 25 bp, Homo sapien
attgtgcatctctgaggttccctca

SEQ ID NO: 169835 - DNA, 25 bp, Homo sapien
ttggctcaaaacgatctgaccacct

SEQ ID NO: 169836 - DNA, 25 bp, Homo sapien
accaggataagtgacacctaggacc

SEQ ID NO: 169837 - DNA, 25 bp, Homo sapien
gtgtagttccaaagcacataagcta

SEQ ID NO: 169838 - DNA, 25 bp, Homo sapien
gttttcaacatgaaatgccacacac

SEQ ID NO: 169839 - DNA, 25 bp, Homo sapien
tgaaatgccacacacatagaactcc

SEQ ID NO: 169840 - DNA, 25 bp, Homo sapien
tttcattgcacagactgactgtagt

SEQ ID NO: 169841 - DNA, 25 bp, Homo sapien
cattgcacagactgactgtagttaa

SEQ ID NO: 169842 - DNA, 25 bp, Homo sapien
gcacagactgactgtagttaatttt

SEQ ID NO: 169843 - DNA, 25 bp, Homo sapien
atctatggactgaatctaatgcttc

SEQ ID NO: 169844 - DNA, 25 bp, Homo sapien
ggactgaatctaatgcttccaaaaa

SEQ ID NO: 169845 - DNA, 25 bp, Homo sapien
ctgaatctaatgcttccaaaaatgt

SEQ ID NO: 169846 - DNA, 25 bp, Homo sapien
accattgtggtttaagctgtactga

SEQ ID NO: 169847 - DNA, 25 bp, Homo sapien
tgtggtttaagctgtactgaactaa

SEQ ID NO: 169848 - DNA, 25 bp, Homo sapien
aggccctgggcatgttcagcgcagc

SEQ ID NO: 169849 - DNA, 25 bp, Homo sapien
atgttcagcgcagccttggcctcgg

SEQ ID NO: 169850 - DNA, 25 bp, Homo sapien
gtgccagttcggtctgcctgcagag

SEQ ID NO: 169851 - DNA, 25 bp, Homo sapien
ccaacaagggcgatgtggaagcgtt

SEQ ID NO: 169852 - DNA, 25 bp, Homo sapien
gtggaagcgtttgccaaagccatgc

SEQ ID NO: 169853 - DNA, 25 bp, Homo sapien
aaagccatgcagaacaacgccaagc

SEQ ID NO: 169854 - DNA, 25 bp, Homo sapien
aacgccaagcccgagcagaaagagg

SEQ ID NO: 169855 - DNA, 25 bp, Homo sapien
agaaagagggcgacacgaaggacaa

SEQ ID NO: 169856 - DNA, 25 bp, Homo sapien
aggacatgagcctggactgagccac

SEQ ID NO: 169857 - DNA, 25 bp, Homo sapien
tcctccgaggaactgggcgcttgca

SEQ ID NO: 169858 - DNA, 25 bp, Homo sapien
tgggcgcttgcagtgcgttgcacac

SEQ ID NO: 169859 - DNA, 25 bp, Homo sapien
gcctgtccgactcgcccgtgttcga

SEQ ID NO: 169860 - DNA, 25 bp, Homo sapien
tgtcggaccgcgacagctacctaag

SEQ ID NO: 169861 - DNA, 25 bp, Homo sapien
tcggaccgcgacagctacctaagcg

SEQ ID NO: 169862 - DNA, 25 bp, Homo sapien
gaccgcgacagctacctaagcggct

SEQ ID NO: 169863 - DNA, 25 bp, Homo sapien
gacagctacctaagcggctccctga

SEQ ID NO: 169864 - DNA, 25 bp, Homo sapien
tccggcagcctcagcggctctgagt

SEQ ID NO: 169865 - DNA, 25 bp, Homo sapien
ggctctgagtctcccagcctcgacc

SEQ ID NO: 169866 - DNA, 25 bp, Homo sapien
ccatctccgacgactgaggcaagag

SEQ ID NO: 169867 - DNA, 25 bp, Homo sapien
tctccgacgactgaggcaagagggc

SEQ ID NO: 169868 - DNA, 25 bp, Homo sapien
gactgaggcaagagggcgccagtga

SEQ ID NO: 169869 - DNA, 25 bp, Homo sapien
aaggcggttcagagatgttggagga

SEQ ID NO: 169870 - DNA, 25 bp, Homo sapien
taagattcatcgaagcaagaacaaa

SEQ ID NO: 169871 - DNA, 25 bp, Homo sapien
gagagactatgtatttgcaaaagcc

SEQ ID NO: 169872 - DNA, 25 bp, Homo sapien
gcaaaagccattggtgatgcagagt

SEQ ID NO: 169873 - DNA, 25 bp, Homo sapien
agtggtaaaccttgtgagctcagta

SEQ ID NO: 169874 - DNA, 25 bp, Homo sapien
aaccttgtgagctcagtacatctat

SEQ ID NO: 169875 - DNA, 25 bp, Homo sapien
gagctcagtacatctattttgtgaa

SEQ ID NO: 169876 - DNA, 25 bp, Homo sapien
ctattttgtgaacatcagttggact

SEQ ID NO: 169877 - DNA, 25 bp, Homo sapien
atcagttggactatattgcatattg

SEQ ID NO: 169878 - DNA, 25 bp, Homo sapien
tttgaatatagtccagcacagagct

SEQ ID NO: 169879 - DNA, 25 bp, Homo sapien
gcacagagctgttcaaatttttagt

SEQ ID NO: 169880 - DNA, 25 bp, Homo sapien
caaatttttagttcactgtatggaa

SEQ ID NO: 169881 - DNA, 25 bp, Homo sapien
ggagacaggctggactcagctacat

SEQ ID NO: 169882 - DNA, 25 bp, Homo sapien
gctggactcagctacatccgatact

SEQ ID NO: 169883 - DNA, 25 bp, Homo sapien
atccgatactcccagatctgtgcaa

SEQ ID NO: 169884 - DNA, 25 bp, Homo sapien
gagatgcactgaagacagaattcaa

SEQ ID NO: 169885 - DNA, 25 bp, Homo sapien
agcaaatgctgagaagacttctggc

SEQ ID NO: 169886 - DNA, 25 bp, Homo sapien
gaagacttctggcagcaacgtaaaa

SEQ ID NO: 169887 - DNA, 25 bp, Homo sapien
gaataatctaccctgactaaagctt

SEQ ID NO: 169888 - DNA, 25 bp, Homo sapien
ctaccctgactaaagcttgaaatgc

SEQ ID NO: 169889 - DNA, 25 bp, Homo sapien
aaatgctacatttccaaggtgaaga

SEQ ID NO: 169890 - DNA, 25 bp, Homo sapien
gtgtgggcacatgttatggcagatt

SEQ ID NO: 169891 - DNA, 25 bp, Homo sapien
aatcctgtcttgttcataaattgac

SEQ ID NO: 169892 - DNA, 25 bp, Homo sapien
tatagagctatgtgagtactaatca

SEQ ID NO: 169893 - DNA, 25 bp, Homo sapien
gagtactaatcacattgaataatag

SEQ ID NO: 169894 - DNA, 25 bp, Homo sapien
tgcttcttaaacagattgtgagttc

SEQ ID NO: 169895 - DNA, 25 bp, Homo sapien
aaacagattgtgagttctttgagaa

SEQ ID NO: 169896 - DNA, 25 bp, Homo sapien
gagaaacagcgtggattttacttat

SEQ ID NO: 169897 - DNA, 25 bp, Homo sapien
aacagcgtggattttacttatctgt

SEQ ID NO: 169898 - DNA, 25 bp, Homo sapien
ctgtgtattcacagagcttagcaca

SEQ ID NO: 169899 - DNA, 25 bp, Homo sapien
cagtgcctggtaatgagcaagcata

SEQ ID NO: 169900 - DNA, 25 bp, Homo sapien
tgcctggtaatgagcaagcatactt

SEQ ID NO: 169901 - DNA, 25 bp, Homo sapien
gcaagcatacttgccattacttttc

SEQ ID NO: 169902 - DNA, 25 bp, Homo sapien
ctctccaacatcacattcactttaa

SEQ ID NO: 169903 - DNA, 25 bp, Homo sapien
tatcacggatttactggctgggtca

SEQ ID NO: 169904 - DNA, 25 bp, Homo sapien
tttactggctgggtcatgagggaac

SEQ ID NO: 169905 - DNA, 25 bp, Homo sapien
tgaaattccactgatgcccacagtt

SEQ ID NO: 169906 - DNA, 25 bp, Homo sapien
ccactgatgcccacagttgaacgat

SEQ ID NO: 169907 - DNA, 25 bp, Homo sapien
tcaagaagctcgttgttacccctga

SEQ ID NO: 169908 - DNA, 25 bp, Homo sapien
gaagctcgttgttacccctgaagac

SEQ ID NO: 169909 - DNA, 25 bp, Homo sapien
aatggcagaactagccacccaggca

SEQ ID NO: 169910 - DNA, 25 bp, Homo sapien
gcagctgctggaggtatacaaagtc

SEQ ID NO: 169911 - DNA, 25 bp, Homo sapien
atacaaagtcgtcttgtggcagaag

SEQ ID NO: 169912 - DNA, 25 bp, Homo sapien
aacccctgttcctctggaactggag

SEQ ID NO: 169913 - DNA, 25 bp, Homo sapien
atcaagacacgactccatcacaggg

SEQ ID NO: 169914 - DNA, 25 bp, Homo sapien
taaaatcgagtccttacagccatac

SEQ ID NO: 169915 - DNA, 25 bp, Homo sapien
aaatcgagtccttacagccatacca

SEQ ID NO: 169916 - DNA, 25 bp, Homo sapien
agtccttacagccataccacaaggt

SEQ ID NO: 169917 - DNA, 25 bp, Homo sapien
gccataccacaaggtacgtccattt

SEQ ID NO: 169918 - DNA, 25 bp, Homo sapien
taccacaaggtacgtccatttggac

SEQ ID NO: 169919 - DNA, 25 bp, Homo sapien
aggtacgtccatttggactacaaga

SEQ ID NO: 169920 - DNA, 25 bp, Homo sapien
tttggactacaagaagagcttcctt

SEQ ID NO: 169921 - DNA, 25 bp, Homo sapien
gaagagcttcctttaaagttcctat

SEQ ID NO: 169922 - DNA, 25 bp, Homo sapien
gcttcctttaaagttcctatttcag

SEQ ID NO: 169923 - DNA, 25 bp, Homo sapien
agttcctatttcagcataaagaggc

SEQ ID NO: 169924 - DNA, 25 bp, Homo sapien
ttcagcataaagaggctgtcctttt

SEQ ID NO: 169925 - DNA, 25 bp, Homo sapien
tgttcgttggactaaacccacaggt

SEQ ID NO: 169926 - DNA, 25 bp, Homo sapien
aacccacaggttagttcagtcaaag

SEQ ID NO: 169927 - DNA, 25 bp, Homo sapien
aggttagttcagtcaaagcaggcaa

SEQ ID NO: 169928 - DNA, 25 bp, Homo sapien
tagttcagtcaaagcaggcaacccc

SEQ ID NO: 169929 - DNA, 25 bp, Homo sapien
gcaggcaacccccttgtgggcactg

SEQ ID NO: 169930 - DNA, 25 bp, Homo sapien
ggtcctccagggagctgacccagag

SEQ ID NO: 169931 - DNA, 25 bp, Homo sapien
aaggctctgcaagagctccctggca

SEQ ID NO: 169932 - DNA, 25 bp, Homo sapien
tctgcaagagctccctggcaatacc

SEQ ID NO: 169933 - DNA, 25 bp, Homo sapien
ccccttgtgtaattgctttgtgtgc

SEQ ID NO: 169934 - DNA, 25 bp, Homo sapien
gtgtaattgctttgtgtgcgacagg

SEQ ID NO: 169935 - DNA, 25 bp, Homo sapien
taattgctttgtgtgcgacagggag

SEQ ID NO: 169936 - DNA, 25 bp, Homo sapien
gttcatattctacctctaaaaacag

SEQ ID NO: 169937 - DNA, 25 bp, Homo sapien
gtagtggtaacctgactcttctaat

SEQ ID NO: 169938 - DNA, 25 bp, Homo sapien
gactcttctaatcttgaaccaaaag

SEQ ID NO: 169939 - DNA, 25 bp, Homo sapien
gactgtaattggtttcttagaccac

SEQ ID NO: 169940 - DNA, 25 bp, Homo sapien
ttagaccacctaagatgccactttg

SEQ ID NO: 169941 - DNA, 25 bp, Homo sapien
gccactttgaattctctaagaccct

SEQ ID NO: 169942 - DNA, 25 bp, Homo sapien
ctaagaccctggagaattgcatttc

SEQ ID NO: 169943 - DNA, 25 bp, Homo sapien
atttctttcactgtgctactatgtg

SEQ ID NO: 169944 - DNA, 25 bp, Homo sapien
atgtggttcttacccatttatcatg

SEQ ID NO: 169945 - DNA, 25 bp, Homo sapien
agtgtgaattagagggactccttcc

SEQ ID NO: 169946 - DNA, 25 bp, Homo sapien
gagggactccttccaataaagttca

SEQ ID NO: 169947 - DNA, 25 bp, Homo sapien
tatcacggatttactggctgggtca

SEQ ID NO: 169948 - DNA, 25 bp, Homo sapien
cacggatttactggctgggtcatga

SEQ ID NO: 169949 - DNA, 25 bp, Homo sapien
tttactggctgggtcatgagggaac

SEQ ID NO: 169950 - DNA, 25 bp, Homo sapien
acagttgaacgatctcaagaagctc

SEQ ID NO: 169951 - DNA, 25 bp, Homo sapien
ttgaacgatctcaagaagctcgttg

SEQ ID NO: 169952 - DNA, 25 bp, Homo sapien
gcaaaatcaagacacgactccatca

SEQ ID NO: 169953 - DNA, 25 bp, Homo sapien
atcaagacacgactccatcacaggg

SEQ ID NO: 169954 - DNA, 25 bp, Homo sapien
aagacacgactccatcacagggagc

SEQ ID NO: 169955 - DNA, 25 bp, Homo sapien
acgactccatcacagggagcctgaa

SEQ ID NO: 169956 - DNA, 25 bp, Homo sapien
gactccatcacagggagcctgaaaa

SEQ ID NO: 169957 - DNA, 25 bp, Homo sapien
cacagggagcctgaaaaaattcaaa

SEQ ID NO: 169958 - DNA, 25 bp, Homo sapien
taaatcctagtgtgtttatacaagg

SEQ ID NO: 169959 - DNA, 25 bp, Homo sapien
gagacatctgtggtttccccaaccg

SEQ ID NO: 169960 - DNA, 25 bp, Homo sapien
tatttcaaaggaaccagcccacgta

SEQ ID NO: 169961 - DNA, 25 bp, Homo sapien
gaaccagcccacgtatgagaaatga

SEQ ID NO: 169962 - DNA, 25 bp, Homo sapien
aacactgtggacattgacttcccgc

SEQ ID NO: 169963 - DNA, 25 bp, Homo sapien
attgacttcccgcataaggcagggt

SEQ ID NO: 169964 - DNA, 25 bp, Homo sapien
cccctgaactccagatgtttgcaca

SEQ ID NO: 169965 - DNA, 25 bp, Homo sapien
gtatcttatgtgttgttttccgttg

SEQ ID NO: 169966 - DNA, 25 bp, Homo sapien
atgtgttgttttccgttgtgacgaa

SEQ ID NO: 169967 - DNA, 25 bp, Homo sapien
cagagggatttttcagtgggaagca

SEQ ID NO: 169968 - DNA, 25 bp, Homo sapien
gtgggaagcattacactttgctaaa

SEQ ID NO: 169969 - DNA, 25 bp, Homo sapien
tattcattcttgtttcacaaatgaa

SEQ ID NO: 169970 - DNA, 25 bp, Homo sapien
atgcatcataaaggaacctaagtga

SEQ ID NO: 169971 - DNA, 25 bp, Homo sapien
atgagtgtattgtctttgcacacac

SEQ ID NO: 169972 - DNA, 25 bp, Homo sapien
gtctttgcacacacatataggtata

SEQ ID NO: 169973 - DNA, 25 bp, Homo sapien
ttgttgtacagggattcaggtttct

SEQ ID NO: 169974 - DNA, 25 bp, Homo sapien
gtacagggattcaggtttcttattc

SEQ ID NO: 169975 - DNA, 25 bp, Homo sapien
ggtttcttattcttacaacatgatt

SEQ ID NO: 169976 - DNA, 25 bp, Homo sapien
catgattgtttatatgtgaagcaca

SEQ ID NO: 169977 - DNA, 25 bp, Homo sapien
tatgtgaagcacatcttgctgttgc

SEQ ID NO: 169978 - DNA, 25 bp, Homo sapien
agaatgtatatctttgccgcaacca

SEQ ID NO: 169979 - DNA, 25 bp, Homo sapien
tatctttgccgcaaccaatttaata

SEQ ID NO: 169980 - DNA, 25 bp, Homo sapien
gctataggataagcaaccaggtagt

SEQ ID NO: 169981 - DNA, 25 bp, Homo sapien
gcaaccaggtagtgttcctaacaat

SEQ ID NO: 169982 - DNA, 25 bp, Homo sapien
gtgttcctaacaattagcgttacca

SEQ ID NO: 169983 - DNA, 25 bp, Homo sapien
ttatactggactacttttacacctt

SEQ ID NO: 169984 - DNA, 25 bp, Homo sapien
tttacaccttctaatatcctgtcca

SEQ ID NO: 169985 - DNA, 25 bp, Homo sapien
caccttctaatatcctgtccaagtt

SEQ ID NO: 169986 - DNA, 25 bp, Homo sapien
atatcctgtccaagtttgggcgcag

SEQ ID NO: 169987 - DNA, 25 bp, Homo sapien
ctgtccaagtttgggcgcagatggt

SEQ ID NO: 169988 - DNA, 25 bp, Homo sapien
tggagttgggctggcatcatgtcct

SEQ ID NO: 169989 - DNA, 25 bp, Homo sapien
tgggctggcatcatgtcctgtggcc

SEQ ID NO: 169990 - DNA, 25 bp, Homo sapien
cacttgcctgttggtgccactccat

SEQ ID NO: 169991 - DNA, 25 bp, Homo sapien
acaaatataaggtttacgagctatg

SEQ ID NO: 169992 - DNA, 25 bp, Homo sapien
ataaggtttacgagctatgagaatt

SEQ ID NO: 169993 - DNA, 25 bp, Homo sapien
agctatgagaattggtgctatcacc

SEQ ID NO: 169994 - DNA, 25 bp, Homo sapien
gaattggtgctatcaccattagcta

SEQ ID NO: 169995 - DNA, 25 bp, Homo sapien
ggtgctatcaccattagctatttgc

SEQ ID NO: 169996 - DNA, 25 bp, Homo sapien
atcaccattagctatttgctgtaat

SEQ ID NO: 169997 - DNA, 25 bp, Homo sapien
tagctatttgctgtaatgtcaagaa

SEQ ID NO: 169998 - DNA, 25 bp, Homo sapien
gtcaagaaaatgttcaccagatgca

SEQ ID NO: 169999 - DNA, 25 bp, Homo sapien
gaaaatgttcaccagatgcaagaat

SEQ ID NO: 170000 - DNA, 25 bp, Homo sapien
tcaccagatgcaagaatgtaccttt

SEQ ID NO: 170001 - DNA, 25 bp, Homo sapien
cagatgcaagaatgtaccttttctt

SEQ ID NO: 170002 - DNA, 25 bp, Homo sapien
gggttcagccctcgatgccaacaga

SEQ ID NO: 170003 - DNA, 25 bp, Homo sapien
gatgccaacagacgactattcggag

SEQ ID NO: 170004 - DNA, 25 bp, Homo sapien
aacagacgactattcggaggagtct

SEQ ID NO: 170005 - DNA, 25 bp, Homo sapien
aggagtctgacacggatctcagcca

SEQ ID NO: 170006 - DNA, 25 bp, Homo sapien
gtctgacacggatctcagccaaaag

SEQ ID NO: 170007 - DNA, 25 bp, Homo sapien
gatctcagccaaaagtccgacggac

SEQ ID NO: 170008 - DNA, 25 bp, Homo sapien
gccaaaagtccgacggaccggcgag

SEQ ID NO: 170009 - DNA, 25 bp, Homo sapien
gtggagggtcccaaagaccccagct

SEQ ID NO: 170010 - DNA, 25 bp, Homo sapien
tggtctgaccagtgtaggaacggac

SEQ ID NO: 170011 - DNA, 25 bp, Homo sapien
gtaggaacggacaccttcagattgt

SEQ ID NO: 170012 - DNA, 25 bp, Homo sapien
aggaacggacaccttcagattgtaa

SEQ ID NO: 170013 - DNA, 25 bp, Homo sapien
atgaatgattaaggaattatgcatc

SEQ ID NO: 170014 - DNA, 25 bp, Homo sapien
atgcatcataaaggaacctaagtga

SEQ ID NO: 170015 - DNA, 25 bp, Homo sapien
aaggaacctaagtgaggtatatgat

SEQ ID NO: 170016 - DNA, 25 bp, Homo sapien
ctttttgttgtacagggattcaggt

SEQ ID NO: 170017 - DNA, 25 bp, Homo sapien
ttgttgtacagggattcaggtttct

SEQ ID NO: 170018 - DNA, 25 bp, Homo sapien
gttgtacagggattcaggtttctta

SEQ ID NO: 170019 - DNA, 25 bp, Homo sapien
ttgtacagggattcaggtttcttat

SEQ ID NO: 170020 - DNA, 25 bp, Homo sapien
gtacagggattcaggtttcttattc

SEQ ID NO: 170021 - DNA, 25 bp, Homo sapien
tattcttacaacatgattgtttata

SEQ ID NO: 170022 - DNA, 25 bp, Homo sapien
catgattgtttatatgtgaagcaca

SEQ ID NO: 170023 - DNA, 25 bp, Homo sapien
tgattgtttatatgtgaagcacatc

SEQ ID NO: 170024 - DNA, 25 bp, Homo sapien
tgagaatgcagcctcttaagcaccc

SEQ ID NO: 170025 - DNA, 25 bp, Homo sapien
atgcagcctcttaagcacccatgca

SEQ ID NO: 170026 - DNA, 25 bp, Homo sapien
tgaaggacaggatgctctccccaga

SEQ ID NO: 170027 - DNA, 25 bp, Homo sapien
cactcctctctctgtacgtcaatgt

SEQ ID NO: 170028 - DNA, 25 bp, Homo sapien
tctctgtacgtcaatgtccctattt

SEQ ID NO: 170029 - DNA, 25 bp, Homo sapien
gtcaatgtccctatttgaaagcagg

SEQ ID NO: 170030 - DNA, 25 bp, Homo sapien
aaagcagggatgatcccattccacc

SEQ ID NO: 170031 - DNA, 25 bp, Homo sapien
ccctgtccactctggatgagaattg

SEQ ID NO: 170032 - DNA, 25 bp, Homo sapien
atgagaattggccacctgatggtta

SEQ ID NO: 170033 - DNA, 25 bp, Homo sapien
ccacctgatggttatttatacgtcc

SEQ ID NO: 170034 - DNA, 25 bp, Homo sapien
tggttatttatacgtccagaagaac

SEQ ID NO: 170035 - DNA, 25 bp, Homo sapien
ggatttgccaattcatatattgcca

SEQ ID NO: 170036 - DNA, 25 bp, Homo sapien
tattgccatgcattatcacaccact

SEQ ID NO: 170037 - DNA, 25 bp, Homo sapien
tcacaccactaatgacttagtgcag

SEQ ID NO: 170038 - DNA, 25 bp, Homo sapien
ggaatatgacagcacttcagccaag

SEQ ID NO: 170039 - DNA, 25 bp, Homo sapien
cagtcccctccgtttaaagtcatgg

SEQ ID NO: 170040 - DNA, 25 bp, Homo sapien
agtcatggaggctataggatcttat

SEQ ID NO: 170041 - DNA, 25 bp, Homo sapien
ttctaacttgagatcagtggcggat

SEQ ID NO: 170042 - DNA, 25 bp, Homo sapien
gtggcggatcaaaacctacaagatt

SEQ ID NO: 170043 - DNA, 25 bp, Homo sapien
ttggcagttatggttttctttcatc

SEQ ID NO: 170044 - DNA, 25 bp, Homo sapien
atggttttctttcatctgatgtgtc

SEQ ID NO: 170045 - DNA, 25 bp, Homo sapien
gatgtgtcagtatctgttgatttgc

SEQ ID NO: 170046 - DNA, 25 bp, Homo sapien
tccaagtggatgagaacgccagtgt

SEQ ID NO: 170047 - DNA, 25 bp, Homo sapien
agagtccagcaatgactgaccggcc

SEQ ID NO: 170048 - DNA, 25 bp, Homo sapien
agcaatgactgaccggccctggtca

SEQ ID NO: 170049 - DNA, 25 bp, Homo sapien
accccaacctggaagcttgtggaca

SEQ ID NO: 170050 - DNA, 25 bp, Homo sapien
ttgtggacaccaggctctgtgcagc

SEQ ID NO: 170051 - DNA, 25 bp, Homo sapien
tctgtgcagcagctccgtggctagc

SEQ ID NO: 170052 - DNA, 25 bp, Homo sapien
gccactactcccaaatgcttctagt

SEQ ID NO: 170053 - DNA, 25 bp, Homo sapien
gacatcactgtggatgccatcaggg

SEQ ID NO: 170054 - DNA, 25 bp, Homo sapien
gatgccatcagggtggtctggttca

SEQ ID NO: 170055 - DNA, 25 bp, Homo sapien
atcagggtggtctggttcacttata

SEQ ID NO: 170056 - DNA, 25 bp, Homo sapien
gactggcttgtttccaagtggatga

SEQ ID NO: 170057 - DNA, 25 bp, Homo sapien
accgattggcggctgatcctggact

SEQ ID NO: 170058 - DNA, 25 bp, Homo sapien
tgatcctggactgggtaccttacat

SEQ ID NO: 170059 - DNA, 25 bp, Homo sapien
gggtaccttacatcaatggcaagtt

SEQ ID NO: 170060 - DNA, 25 bp, Homo sapien
gataattaattacacaaacccttca

SEQ ID NO: 170061 - DNA, 25 bp, Homo sapien
cttcacagactgctctggtgcctgg

SEQ ID NO: 170062 - DNA, 25 bp, Homo sapien
tggtgcctggtggtgctagctcctc

SEQ ID NO: 170063 - DNA, 25 bp, Homo sapien
tggacaagaggaaacccacagctca

SEQ ID NO: 170064 - DNA, 25 bp, Homo sapien
agctcagcttcaggcttcttatgtt

SEQ ID NO: 170065 - DNA, 25 bp, Homo sapien
caggcttcttatgtttctgaaaaca

SEQ ID NO: 170066 - DNA, 25 bp, Homo sapien
tggtcaagaactgggtcccgacggc

SEQ ID NO: 170067 - DNA, 25 bp, Homo sapien
aactgggtcccgacggcctacacat

SEQ ID NO: 170068 - DNA, 25 bp, Homo sapien
gatcacggtgtgagtttcgtagcta

SEQ ID NO: 170069 - DNA, 25 bp, Homo sapien
taagtgatacatacctctagttttt

SEQ ID NO: 170070 - DNA, 25 bp, Homo sapien
gtcttttgagatcctgagttcatcc

SEQ ID NO: 170071 - DNA, 25 bp, Homo sapien
gagttcatcccctgtgaatcagagt

SEQ ID NO: 170072 - DNA, 25 bp, Homo sapien
tgaatcagagtgcacaagcacctct

SEQ ID NO: 170073 - DNA, 25 bp, Homo sapien
aagcacctctcctgtgagtggctaa

SEQ ID NO: 170074 - DNA, 25 bp, Homo sapien
agaagagggacagaccgaccaccag

SEQ ID NO: 170075 - DNA, 25 bp, Homo sapien
cacagtagggcagatctggacagca

SEQ ID NO: 170076 - DNA, 25 bp, Homo sapien
ggacagcagaatgttataacgcaag

SEQ ID NO: 170077 - DNA, 25 bp, Homo sapien
acgcaagttcatgtgttgctcccaa

SEQ ID NO: 170078 - DNA, 25 bp, Homo sapien
tcttttctctcgtgcaaccagtttg

SEQ ID NO: 170079 - DNA, 25 bp, Homo sapien
gactcctgggcccttggatactctt

SEQ ID NO: 170080 - DNA, 25 bp, Homo sapien
gggcccttggatactcttctcccat

SEQ ID NO: 170081 - DNA, 25 bp, Homo sapien
atctcccttcacaggatgacaccct

SEQ ID NO: 170082 - DNA, 25 bp, Homo sapien
ttcacaggatgacaccctcccatac

SEQ ID NO: 170083 - DNA, 25 bp, Homo sapien
gctggtgtagggacccccaagagac

SEQ ID NO: 170084 - DNA, 25 bp, Homo sapien
ctgggccacagctcacattccactg

SEQ ID NO: 170085 - DNA, 25 bp, Homo sapien
tcacattccactgctgggagaagaa

SEQ ID NO: 170086 - DNA, 25 bp, Homo sapien
cattccactgctgggagaagaaaca

SEQ ID NO: 170087 - DNA, 25 bp, Homo sapien
actgctgggagaagaaacaggccga

SEQ ID NO: 170088 - DNA, 25 bp, Homo sapien
aaagaccccagtggccacactggga

SEQ ID NO: 170089 - DNA, 25 bp, Homo sapien
gaccccagtggccacactgggatag

SEQ ID NO: 170090 - DNA, 25 bp, Homo sapien
tgtatggccgccgtcgcaagaagca

SEQ ID NO: 170091 - DNA, 25 bp, Homo sapien
ggccgccgtcgcaagaagcatagat

SEQ ID NO: 170092 - DNA, 25 bp, Homo sapien
atagatcaagatcccgatcccggga

SEQ ID NO: 170093 - DNA, 25 bp, Homo sapien
ggagcgtcgttctcggtctagagac

SEQ ID NO: 170094 - DNA, 25 bp, Homo sapien
ttctcggtctagagaccgtggtcgt

SEQ ID NO: 170095 - DNA, 25 bp, Homo sapien
aaagatctgggcgattctgagccat

SEQ ID NO: 170096 - DNA, 25 bp, Homo sapien
gcgattctgagccatgccattttta

SEQ ID NO: 170097 - DNA, 25 bp, Homo sapien
gagccatgccatttttaccttatgt

SEQ ID NO: 170098 - DNA, 25 bp, Homo sapien
gccatttttaccttatgtctgctag

SEQ ID NO: 170099 - DNA, 25 bp, Homo sapien
gtgttgtagttgattgaccaaacca

SEQ ID NO: 170100 - DNA, 25 bp, Homo sapien
gattgaccaaaccagttcataaggg

SEQ ID NO: 170101 - DNA, 25 bp, Homo sapien
catactcttcagactgtgatattgt

SEQ ID NO: 170102 - DNA, 25 bp, Homo sapien
ttgtgtaaatgtctatctgccctgg

SEQ ID NO: 170103 - DNA, 25 bp, Homo sapien
taaatgtctatctgccctggtttgt

SEQ ID NO: 170104 - DNA, 25 bp, Homo sapien
atctgccctggtttgtgtgaactgg

SEQ ID NO: 170105 - DNA, 25 bp, Homo sapien
cctggtttgtgtgaactgggatgtt

SEQ ID NO: 170106 - DNA, 25 bp, Homo sapien
gggtgtttgtggttatcttacctgg

SEQ ID NO: 170107 - DNA, 25 bp, Homo sapien
ttgcttttcatgtgtctttctgtag

SEQ ID NO: 170108 - DNA, 25 bp, Homo sapien
gtctttctgtagacatatctgaaga

SEQ ID NO: 170109 - DNA, 25 bp, Homo sapien
ctttggattaaggattgtggagcac

SEQ ID NO: 170110 - DNA, 25 bp, Homo sapien
gtggagcacatttcaatcattttag

SEQ ID NO: 170111 - DNA, 25 bp, Homo sapien
ggatcagatcaataatggaggcaat

SEQ ID NO: 170112 - DNA, 25 bp, Homo sapien
gagaagaatgtacccttcagagtgg

SEQ ID NO: 170113 - DNA, 25 bp, Homo sapien
atgccaggaggttccgggagacaat

SEQ ID NO: 170114 - DNA, 25 bp, Homo sapien
ttccgggagacaatttagggctgat

SEQ ID NO: 170115 - DNA, 25 bp, Homo sapien
atctggactgtctgccaatcatttt

SEQ ID NO: 170116 - DNA, 25 bp, Homo sapien
ggactgtctgccaatcatttttaga

SEQ ID NO: 170117 - DNA, 25 bp, Homo sapien
gtctgccaatcatttttagagggag

SEQ ID NO: 170118 - DNA, 25 bp, Homo sapien
gccaatcatttttagagggaggaat

SEQ ID NO: 170119 - DNA, 25 bp, Homo sapien
gaatcagtgttggattgcagagaca

SEQ ID NO: 170120 - DNA, 25 bp, Homo sapien
gagacattttctggagtgatccatg

SEQ ID NO: 170121 - DNA, 25 bp, Homo sapien
ctggagtgatccatgaaggaccatt

SEQ ID NO: 170122 - DNA, 25 bp, Homo sapien
gaaggaccattaacatgtgatacct

SEQ ID NO: 170123 - DNA, 25 bp, Homo sapien
ggttcgcagcgagagtcccggactt

SEQ ID NO: 170124 - DNA, 25 bp, Homo sapien
gagtcccggacttgtctagaaatga

SEQ ID NO: 170125 - DNA, 25 bp, Homo sapien
gcaggtttacaagtactgttctaaa

SEQ ID NO: 170126 - DNA, 25 bp, Homo sapien
ttaacacctgttgcatttatattct

SEQ ID NO: 170127 - DNA, 25 bp, Homo sapien
attctttccatttgctatcatgtca

SEQ ID NO: 170128 - DNA, 25 bp, Homo sapien
gtcagtgaacgccaggagtgctttc

SEQ ID NO: 170129 - DNA, 25 bp, Homo sapien
agtgctttctttgcaacttgtgtaa

SEQ ID NO: 170130 - DNA, 25 bp, Homo sapien
caggttttactgatgaggcttgtga

SEQ ID NO: 170131 - DNA, 25 bp, Homo sapien
ggcttgtgaggccaatcaaaataat

SEQ ID NO: 170132 - DNA, 25 bp, Homo sapien
ataatgtttgtgatctctactactg

SEQ ID NO: 170133 - DNA, 25 bp, Homo sapien
gatctctactactgttgattttgcc

SEQ ID NO: 170134 - DNA, 25 bp, Homo sapien
gggcccaggagccaatgtgaacttt

SEQ ID NO: 170135 - DNA, 25 bp, Homo sapien
ggcccaggagccaatgtgaactttt

SEQ ID NO: 170136 - DNA, 25 bp, Homo sapien
gcccaggagccaatgtgaacttttt

SEQ ID NO: 170137 - DNA, 25 bp, Homo sapien
cccaggagccaatgtgaactttttt

SEQ ID NO: 170138 - DNA, 25 bp, Homo sapien
aaagaacaacaagatgaccttattt

SEQ ID NO: 170139 - DNA, 25 bp, Homo sapien
ggacaggtggcagagccgaggctta

SEQ ID NO: 170140 - DNA, 25 bp, Homo sapien
agagccgaggcttagggtctggcac

SEQ ID NO: 170141 - DNA, 25 bp, Homo sapien
acagctggagacggaggctctcctg

SEQ ID NO: 170142 - DNA, 25 bp, Homo sapien
tgtgtctacagatgggctgtggccc

SEQ ID NO: 170143 - DNA, 25 bp, Homo sapien
gtgtctacagatgggctgtggcccc

SEQ ID NO: 170144 - DNA, 25 bp, Homo sapien
ctacagatgggctgtggcccctgca

SEQ ID NO: 170145 - DNA, 25 bp, Homo sapien
ggagctgtaccgacggaccctggac

SEQ ID NO: 170146 - DNA, 25 bp, Homo sapien
cgacggaccctggactcagatgaag

SEQ ID NO: 170147 - DNA, 25 bp, Homo sapien
cagactggtcacatatgcgtggcat

SEQ ID NO: 170148 - DNA, 25 bp, Homo sapien
tatgcgtggcatcatcagcagtgat

SEQ ID NO: 170149 - DNA, 25 bp, Homo sapien
gcgagagtaactgagctctgccacc

SEQ ID NO: 170150 - DNA, 25 bp, Homo sapien
aggagggacccttgatacatgtaca

SEQ ID NO: 170151 - DNA, 25 bp, Homo sapien
gtacaaagcatacatagcacccctt

SEQ ID NO: 170152 - DNA, 25 bp, Homo sapien
ggaacagaagcagcttccttcagag

SEQ ID NO: 170153 - DNA, 25 bp, Homo sapien
agagaagactgcagctcccaaggac

SEQ ID NO: 170154 - DNA, 25 bp, Homo sapien
gcagctcccaaggacacaagctgtt

SEQ ID NO: 170155 - DNA, 25 bp, Homo sapien
agctgttgggatgctacttctcagc

SEQ ID NO: 170156 - DNA, 25 bp, Homo sapien
gacaaaactttcctaaaaacatgag

SEQ ID NO: 170157 - DNA, 25 bp, Homo sapien
aaacatgagagtccaggctgtctga

SEQ ID NO: 170158 - DNA, 25 bp, Homo sapien
agtccaggctgtctgagtcagcaca

SEQ ID NO: 170159 - DNA, 25 bp, Homo sapien
gagtcagcacagtaagaaagtcctt

SEQ ID NO: 170160 - DNA, 25 bp, Homo sapien
aagtcctttctgctttaactcttag

SEQ ID NO: 170161 - DNA, 25 bp, Homo sapien
tttatttatattcttctgttcctgg

SEQ ID NO: 170162 - DNA, 25 bp, Homo sapien
tatattcttctgttcctggattccc

SEQ ID NO: 170163 - DNA, 25 bp, Homo sapien
cttctgttcctggattcccatttta

SEQ ID NO: 170164 - DNA, 25 bp, Homo sapien
ctgttctactgttgtattgcccagt

SEQ ID NO: 170165 - DNA, 25 bp, Homo sapien
tgcccagtaggagctatcactatat

SEQ ID NO: 170166 - DNA, 25 bp, Homo sapien
ggagctatcactatattttgcagaa

SEQ ID NO: 170167 - DNA, 25 bp, Homo sapien
tgctactgctgatgccttcaaagat

SEQ ID NO: 170168 - DNA, 25 bp, Homo sapien
atgaccgaaagattgcctgtgccgc

SEQ ID NO: 170169 - DNA, 25 bp, Homo sapien
ctgtgccgctgttgactgtgtcaaa

SEQ ID NO: 170170 - DNA, 25 bp, Homo sapien
caagaaccaagacctgtgccagcag

SEQ ID NO: 170171 - DNA, 25 bp, Homo sapien
caggaggcggtcaagggctacccca

SEQ ID NO: 170172 - DNA, 25 bp, Homo sapien
actttccactactaccactatggga

SEQ ID NO: 170173 - DNA, 25 bp, Homo sapien
taccactatgggaagttcgcagaaa

SEQ ID NO: 170174 - DNA, 25 bp, Homo sapien
gaaaagtatgacagcgaccgcacag

SEQ ID NO: 170175 - DNA, 25 bp, Homo sapien
ttaccaattatattcgagccctccg

SEQ ID NO: 170176 - DNA, 25 bp, Homo sapien
aggaagagttataattcctgcctca

SEQ ID NO: 170177 - DNA, 25 bp, Homo sapien
aaagcttttccattacactgtgaat

SEQ ID NO: 170178 - DNA, 25 bp, Homo sapien
gaaacgccagaaatatgacatcacc

SEQ ID NO: 170179 - DNA, 25 bp, Homo sapien
gaaatatgacatcaccacgctcagg

SEQ ID NO: 170180 - DNA, 25 bp, Homo sapien
atatgacatcaccacgctcaggagc

SEQ ID NO: 170181 - DNA, 25 bp, Homo sapien
atcaccacgctcaggagccgcattg

SEQ ID NO: 170182 - DNA, 25 bp, Homo sapien
tcaggagccgcattgaccaggccca

SEQ ID NO: 170183 - DNA, 25 bp, Homo sapien
ccaagggcaaagtcggcgggcgctg

SEQ ID NO: 170184 - DNA, 25 bp, Homo sapien
gtcggcgggcgctggaagtagagag

SEQ ID NO: 170185 - DNA, 25 bp, Homo sapien
gtagagaggccagaaaggccctcga

SEQ ID NO: 170186 - DNA, 25 bp, Homo sapien
agaggccagaaaggccctcgaggca

SEQ ID NO: 170187 - DNA, 25 bp, Homo sapien
gaaaggccctcgaggcagagaccct

SEQ ID NO: 170188 - DNA, 25 bp, Homo sapien
ttgcacaccagggccgctcgtggga

SEQ ID NO: 170189 - DNA, 25 bp, Homo sapien
attagtggcccttttggcagcagga

SEQ ID NO: 170190 - DNA, 25 bp, Homo sapien
gcaggagctcagatacacccatgga

SEQ ID NO: 170191 - DNA, 25 bp, Homo sapien
gatacacccatggagtcttaatgaa

SEQ ID NO: 170192 - DNA, 25 bp, Homo sapien
agatcatctaatttcctgcttacct

SEQ ID NO: 170193 - DNA, 25 bp, Homo sapien
taatttcctgcttaccttaactggg

SEQ ID NO: 170194 - DNA, 25 bp, Homo sapien
aaaaatgttccatgcgtggcagcaa

SEQ ID NO: 170195 - DNA, 25 bp, Homo sapien
gtggcagcaaccatgcagagtgact

SEQ ID NO: 170196 - DNA, 25 bp, Homo sapien
catttctgactgacattcctttctg

SEQ ID NO: 170197 - DNA, 25 bp, Homo sapien
attcctttctgcaactgcggtggca

SEQ ID NO: 170198 - DNA, 25 bp, Homo sapien
gtggcaccacaaatatccggtcttt

SEQ ID NO: 170199 - DNA, 25 bp, Homo sapien
gtaaggctcttgttgcatttcttaa

SEQ ID NO: 170200 - DNA, 25 bp, Homo sapien
cctggacaacagcgagagctccatc

SEQ ID NO: 170201 - DNA, 25 bp, Homo sapien
tcaagaacatgattatccagcggta

SEQ ID NO: 170202 - DNA, 25 bp, Homo sapien
gaacatgattatccagcggtatttt

SEQ ID NO: 170203 - DNA, 25 bp, Homo sapien
gattatccagcggtattttctaatt

SEQ ID NO: 170204 - DNA, 25 bp, Homo sapien
gtattttctaattcagatcatcaaa

SEQ ID NO: 170205 - DNA, 25 bp, Homo sapien
aattcagatcatcaaactgattata

SEQ ID NO: 170206 - DNA, 25 bp, Homo sapien
actgattatatagaagagttggctt

SEQ ID NO: 170207 - DNA, 25 bp, Homo sapien
atgtttgcaaatgtcgatgttgaga

SEQ ID NO: 170208 - DNA, 25 bp, Homo sapien
gcaaatgtcgatgttgagaatggta

SEQ ID NO: 170209 - DNA, 25 bp, Homo sapien
atgtcgatgttgagaatggtatttc

SEQ ID NO: 170210 - DNA, 25 bp, Homo sapien
tgttgagaatggtatttcttcagtt

SEQ ID NO: 170211 - DNA, 25 bp, Homo sapien
agagccctgacccttgaatggttgt

SEQ ID NO: 170212 - DNA, 25 bp, Homo sapien
gaatggttgtccttgactctgtgct

SEQ ID NO: 170213 - DNA, 25 bp, Homo sapien
ccttctgcagagaggcacctaagct

SEQ ID NO: 170214 - DNA, 25 bp, Homo sapien
gagaggcacctaagctgtttaaaga

SEQ ID NO: 170215 - DNA, 25 bp, Homo sapien
aagagcccagtgattgtggctgctc

SEQ ID NO: 170216 - DNA, 25 bp, Homo sapien
attgtggctgctcctcctagaggtg

SEQ ID NO: 170217 - DNA, 25 bp, Homo sapien
tggtcagtgtccatgctttctgggc

SEQ ID NO: 170218 - DNA, 25 bp, Homo sapien
ttctgggcagggacttggttttttg

SEQ ID NO: 170219 - DNA, 25 bp, Homo sapien
tggttttttgttccaacagtggcct

SEQ ID NO: 170220 - DNA, 25 bp, Homo sapien
aacagtggccttctccgggcttcat

SEQ ID NO: 170221 - DNA, 25 bp, Homo sapien
ctccgggcttcatagttctttgtaa

SEQ ID NO: 170222 - DNA, 25 bp, Homo sapien
ggaagtattctaattaacaaggaca

SEQ ID NO: 170223 - DNA, 25 bp, Homo sapien
gaagtattctaattaacaaggacag

SEQ ID NO: 170224 - DNA, 25 bp, Homo sapien
aacaaggacagaggactgaccggtt

SEQ ID NO: 170225 - DNA, 25 bp, Homo sapien
acaaggacagaggactgaccggttc

SEQ ID NO: 170226 - DNA, 25 bp, Homo sapien
caaggacagaggactgaccggttcc

SEQ ID NO: 170227 - DNA, 25 bp, Homo sapien
aaggacagaggactgaccggttcca

SEQ ID NO: 170228 - DNA, 25 bp, Homo sapien
aggacagaggactgaccggttccat

SEQ ID NO: 170229 - DNA, 25 bp, Homo sapien
ggacagaggactgaccggttccatt

SEQ ID NO: 170230 - DNA, 25 bp, Homo sapien
gacagaggactgaccggttccattt

SEQ ID NO: 170231 - DNA, 25 bp, Homo sapien
acagaggactgaccggttccatttt

SEQ ID NO: 170232 - DNA, 25 bp, Homo sapien
cagaggactgaccggttccattttt

SEQ ID NO: 170233 - DNA, 25 bp, Homo sapien
gagaccaaattttgaacctcctcag

SEQ ID NO: 170234 - DNA, 25 bp, Homo sapien
tgaacctcctcagtatccatatatt

SEQ ID NO: 170235 - DNA, 25 bp, Homo sapien
cagtatccatatattcctgcacata

SEQ ID NO: 170236 - DNA, 25 bp, Homo sapien
attacaagctggtagctgcaccatt

SEQ ID NO: 170237 - DNA, 25 bp, Homo sapien
gtagctgcaccattgtttgaattgt

SEQ ID NO: 170238 - DNA, 25 bp, Homo sapien
ttgtatgacaatgcaccaggatatg

SEQ ID NO: 170239 - DNA, 25 bp, Homo sapien
gatatggacccatcatttctagtct

SEQ ID NO: 170240 - DNA, 25 bp, Homo sapien
tttctagtctccctcagctgttgag

SEQ ID NO: 170241 - DNA, 25 bp, Homo sapien
ctcagctgttgagcaggttcaattt

SEQ ID NO: 170242 - DNA, 25 bp, Homo sapien
ttacaactgaattcctgcgcagtgg

SEQ ID NO: 170243 - DNA, 25 bp, Homo sapien
aaagaagccgcttgtctctgtgagc

SEQ ID NO: 170244 - DNA, 25 bp, Homo sapien
atctccagaccgagcctggcttata

SEQ ID NO: 170245 - DNA, 25 bp, Homo sapien
accaaggaaagtccagaagcttcag

SEQ ID NO: 170246 - DNA, 25 bp, Homo sapien
cacctggatgatgagaccttggcaa

SEQ ID NO: 170247 - DNA, 25 bp, Homo sapien
gcaaagttaatagccaagataccaa

SEQ ID NO: 170248 - DNA, 25 bp, Homo sapien
aagataccaaccatcacggcagttt

SEQ ID NO: 170249 - DNA, 25 bp, Homo sapien
atcacggcagtttgcaacttgcacg

SEQ ID NO: 170250 - DNA, 25 bp, Homo sapien
ggtatttaagcaatctcatccagag

SEQ ID NO: 170251 - DNA, 25 bp, Homo sapien
atagtgaatacactgtttcctccgt

SEQ ID NO: 170252 - DNA, 25 bp, Homo sapien
ttcctccgttatacaaggagctctt

SEQ ID NO: 170253 - DNA, 25 bp, Homo sapien
tttaatcctgactgtgccaccgcgt

SEQ ID NO: 170254 - DNA, 25 bp, Homo sapien
ctgtgccaccgcgtgcaaatgaagg

SEQ ID NO: 170255 - DNA, 25 bp, Homo sapien
gggacccagatctcatactcaacag

SEQ ID NO: 170256 - DNA, 25 bp, Homo sapien
gacccagatctcatactcaacagaa

SEQ ID NO: 170257 - DNA, 25 bp, Homo sapien
gatctcatactcaacagaaggagac

SEQ ID NO: 170258 - DNA, 25 bp, Homo sapien
agaaggagactcagagactccagaa

SEQ ID NO: 170259 - DNA, 25 bp, Homo sapien
gagactcagagactccagaaggcac

SEQ ID NO: 170260 - DNA, 25 bp, Homo sapien
taacaaagaccaccaggacatcctg

SEQ ID NO: 170261 - DNA, 25 bp, Homo sapien
aaagaccaccaggacatcctgggaa

SEQ ID NO: 170262 - DNA, 25 bp, Homo sapien
caccaggacatcctgggaactctgg

SEQ ID NO: 170263 - DNA, 25 bp, Homo sapien
actcactagattctgcagtcaaaga

SEQ ID NO: 170264 - DNA, 25 bp, Homo sapien
actagattctgcagtcaaagatgac

SEQ ID NO: 170265 - DNA, 25 bp, Homo sapien
gtcaaagatgactaatatccttgca

SEQ ID NO: 170266 - DNA, 25 bp, Homo sapien
gttctcggagaaccaagttgctaca

SEQ ID NO: 170267 - DNA, 25 bp, Homo sapien
ggagaaccaagttgctacacaggaa

SEQ ID NO: 170268 - DNA, 25 bp, Homo sapien
aagttgctacacaggaagttctcca

SEQ ID NO: 170269 - DNA, 25 bp, Homo sapien
ttctccaaggtccagtttcctttct

SEQ ID NO: 170270 - DNA, 25 bp, Homo sapien
ttctcccaccagttggtggaggctt

SEQ ID NO: 170271 - DNA, 25 bp, Homo sapien
agagtcctggacagagagggtaaca

SEQ ID NO: 170272 - DNA, 25 bp, Homo sapien
aacatcaatcgtgtgtcctgatttg

SEQ ID NO: 170273 - DNA, 25 bp, Homo sapien
caatcgtgtgtcctgatttgggagt

SEQ ID NO: 170274 - DNA, 25 bp, Homo sapien
cgtgtgtcctgatttgggagtgatt

SEQ ID NO: 170275 - DNA, 25 bp, Homo sapien
tggtattctcatggcctgatttttt

SEQ ID NO: 170276 - DNA, 25 bp, Homo sapien
tatatcactgtgtttgaatcgaggg

SEQ ID NO: 170277 - DNA, 25 bp, Homo sapien
gtattttctaattcagatcatcaaa

SEQ ID NO: 170278 - DNA, 25 bp, Homo sapien
tattttctaattcagatcatcaaac

SEQ ID NO: 170279 - DNA, 25 bp, Homo sapien
attttctaattcagatcatcaaact

SEQ ID NO: 170280 - DNA, 25 bp, Homo sapien
ttctaattcagatcatcaaactgat

SEQ ID NO: 170281 - DNA, 25 bp, Homo sapien
tctaattcagatcatcaaactgatt

SEQ ID NO: 170282 - DNA, 25 bp, Homo sapien
ctaattcagatcatcaaactgatta

SEQ ID NO: 170283 - DNA, 25 bp, Homo sapien
aattcagatcatcaaactgattata

SEQ ID NO: 170284 - DNA, 25 bp, Homo sapien
actgattatatagaagagttggctt

SEQ ID NO: 170285 - DNA, 25 bp, Homo sapien
ctgattatatagaagagttggcttt

SEQ ID NO: 170286 - DNA, 25 bp, Homo sapien
gattatatagaagagttggctttaa

SEQ ID NO: 170287 - DNA, 25 bp, Homo sapien
tatagaagagttggctttaaaatgt

SEQ ID NO: 170288 - DNA, 25 bp, Homo sapien
aagtgcatgtcatttcttaatacac

SEQ ID NO: 170289 - DNA, 25 bp, Homo sapien
aaactttagtacttttccatgcaga

SEQ ID NO: 170290 - DNA, 25 bp, Homo sapien
tttccatgcagatttgtgcacatgt

SEQ ID NO: 170291 - DNA, 25 bp, Homo sapien
tgcacatgtgagagggtgtccagtt

SEQ ID NO: 170292 - DNA, 25 bp, Homo sapien
gagggtgtccagtttgtctagtgat

SEQ ID NO: 170293 - DNA, 25 bp, Homo sapien
gtccagtttgtctagtgattgttat

SEQ ID NO: 170294 - DNA, 25 bp, Homo sapien
ttgttatttagagagttggaccact

SEQ ID NO: 170295 - DNA, 25 bp, Homo sapien
gttggaccactattgtgtgttgcta

SEQ ID NO: 170296 - DNA, 25 bp, Homo sapien
gttgctaatcattgactgtagtccc

SEQ ID NO: 170297 - DNA, 25 bp, Homo sapien
aagccttgtgaaaatgttatgccct

SEQ ID NO: 170298 - DNA, 25 bp, Homo sapien
gttatgccctatgtaacagcagagt

SEQ ID NO: 170299 - DNA, 25 bp, Homo sapien
ctttcctgagttttactccacggag

SEQ ID NO: 170300 - DNA, 25 bp, Homo sapien
tactccacggagtcttaggtacctg

SEQ ID NO: 170301 - DNA, 25 bp, Homo sapien
tccacggagtcttaggtacctggta

SEQ ID NO: 170302 - DNA, 25 bp, Homo sapien
attaagggtcattgctttgttgtct

SEQ ID NO: 170303 - DNA, 25 bp, Homo sapien
agggtcattgctttgttgtctagct

SEQ ID NO: 170304 - DNA, 25 bp, Homo sapien
ggagttaatggtcactagattatca

SEQ ID NO: 170305 - DNA, 25 bp, Homo sapien
ggtcactagattatcagttatgagc

SEQ ID NO: 170306 - DNA, 25 bp, Homo sapien
gattatcagttatgagcagtgttaa

SEQ ID NO: 170307 - DNA, 25 bp, Homo sapien
aaatctcctattaatgtgtaatgta

SEQ ID NO: 170308 - DNA, 25 bp, Homo sapien
atgtgtaatgtacctgtcagtgcct

SEQ ID NO: 170309 - DNA, 25 bp, Homo sapien
ctgtcagtgcctcctttattaaggg

SEQ ID NO: 170310 - DNA, 25 bp, Homo sapien
ggcttctgaatgtttgaaacgattt

SEQ ID NO: 170311 - DNA, 25 bp, Homo sapien
ataagtagtgctatggttgtttcta

SEQ ID NO: 170312 - DNA, 25 bp, Homo sapien
gtgctatggttgtttctataattct

SEQ ID NO: 170313 - DNA, 25 bp, Homo sapien
gttgtttctataattctaacctttg

SEQ ID NO: 170314 - DNA, 25 bp, Homo sapien
gtttctataattctaacctttgata

SEQ ID NO: 170315 - DNA, 25 bp, Homo sapien
aattctaacctttgatagtaatcag

SEQ ID NO: 170316 - DNA, 25 bp, Homo sapien
acatttcatttctgaatagcttttg

SEQ ID NO: 170317 - DNA, 25 bp, Homo sapien
tctgaatagcttttgaatttatgaa

SEQ ID NO: 170318 - DNA, 25 bp, Homo sapien
ttctcttgcattaatagtactgctg

SEQ ID NO: 170319 - DNA, 25 bp, Homo sapien
cttctttatatttatgtctagcttt

SEQ ID NO: 170320 - DNA, 25 bp, Homo sapien
atttatgtctagcttttatatgtaa

SEQ ID NO: 170321 - DNA, 25 bp, Homo sapien
ccacttgctcagcagcttgggcttc

SEQ ID NO: 170322 - DNA, 25 bp, Homo sapien
ttgggcttccattctagttctttta

SEQ ID NO: 170323 - DNA, 25 bp, Homo sapien
gcttccattctagttcttttaccaa

SEQ ID NO: 170324 - DNA, 25 bp, Homo sapien
atttttgtgtgaccatgttgacttc

SEQ ID NO: 170325 - DNA, 25 bp, Homo sapien
tgttgacttcatttggattgccctc

SEQ ID NO: 170326 - DNA, 25 bp, Homo sapien
ttgccctctttcaatttccttgtga

SEQ ID NO: 170327 - DNA, 25 bp, Homo sapien
aaatgtttacatagcttctggtgat

SEQ ID NO: 170328 - DNA, 25 bp, Homo sapien
catagcttctggtgatatcttctca

SEQ ID NO: 170329 - DNA, 25 bp, Homo sapien
gtgatggatgtgacacctcataaaa

SEQ ID NO: 170330 - DNA, 25 bp, Homo sapien
aaaagtgagctttgaactgtagata

SEQ ID NO: 170331 - DNA, 25 bp, Homo sapien
cccttgtgtgatctgtttggactat

SEQ ID NO: 170332 - DNA, 25 bp, Homo sapien
tttctcgctgggtgcgacgtgaatt

SEQ ID NO: 170333 - DNA, 25 bp, Homo sapien
gaatttgtgaagctcaggatgccca

SEQ ID NO: 170334 - DNA, 25 bp, Homo sapien
caggatgcccatggattagactcat

SEQ ID NO: 170335 - DNA, 25 bp, Homo sapien
gtagcttaaagagtcattaggcgat

SEQ ID NO: 170336 - DNA, 25 bp, Homo sapien
gtctggatataattcagtgtccgta

SEQ ID NO: 170337 - DNA, 25 bp, Homo sapien
agtgtccgtaaatcccatgaagaga

SEQ ID NO: 170338 - DNA, 25 bp, Homo sapien
aatttgtgccagaagagcctgtgac

SEQ ID NO: 170339 - DNA, 25 bp, Homo sapien
gactacatttctttcaatctctttg

SEQ ID NO: 170340 - DNA, 25 bp, Homo sapien
ttcaatctctttggctgtttgtttc

SEQ ID NO: 170341 - DNA, 25 bp, Homo sapien
ttgtttcagtatacacactccctgt

SEQ ID NO: 170342 - DNA, 25 bp, Homo sapien
acactccctgttattgcttactatt

SEQ ID NO: 170343 - DNA, 25 bp, Homo sapien
tgtgatgaggtgaacgtgtacgggt

SEQ ID NO: 170344 - DNA, 25 bp, Homo sapien
gagaacaaccggtacgcgggcgagt

SEQ ID NO: 170345 - DNA, 25 bp, Homo sapien
cgagttccggaagactggcgtgcac

SEQ ID NO: 170346 - DNA, 25 bp, Homo sapien
gttccggaagactggcgtgcacgac

SEQ ID NO: 170347 - DNA, 25 bp, Homo sapien
agactggcgtgcacgacgcggactt

SEQ ID NO: 170348 - DNA, 25 bp, Homo sapien
acgacgcggacttcgaggcccacat

SEQ ID NO: 170349 - DNA, 25 bp, Homo sapien
gaggcccacatcatcgacatgctgg

SEQ ID NO: 170350 - DNA, 25 bp, Homo sapien
acatcatcgacatgctggccaaggc

SEQ ID NO: 170351 - DNA, 25 bp, Homo sapien
aaggccagcaagatcgaagtctacc

SEQ ID NO: 170352 - DNA, 25 bp, Homo sapien
gccagcaagatcgaagtctaccggg

SEQ ID NO: 170353 - DNA, 25 bp, Homo sapien
agcaacccgcgaccaatcatgctgc

SEQ ID NO: 170354 - DNA, 25 bp, Homo sapien
aaagcacaagagtgaagctcctgga

SEQ ID NO: 170355 - DNA, 25 bp, Homo sapien
agcacaagagtgaagctcctggagg

SEQ ID NO: 170356 - DNA, 25 bp, Homo sapien
gaggaactcagatggagaagtatcc

SEQ ID NO: 170357 - DNA, 25 bp, Homo sapien
gatggagaagtatccagtatgcatc

SEQ ID NO: 170358 - DNA, 25 bp, Homo sapien
atccagtatgcatctcggggagaga

SEQ ID NO: 170359 - DNA, 25 bp, Homo sapien
gagagagacattcagcctataatga

SEQ ID NO: 170360 - DNA, 25 bp, Homo sapien
ggagccggttacttcctgtggcaac

SEQ ID NO: 170361 - DNA, 25 bp, Homo sapien
agccggttacttcctgtggcaacag

SEQ ID NO: 170362 - DNA, 25 bp, Homo sapien
cggttacttcctgtggcaacagcag

SEQ ID NO: 170363 - DNA, 25 bp, Homo sapien
gttgagagaaatggcatggagcaca

SEQ ID NO: 170364 - DNA, 25 bp, Homo sapien
aatggcatggagcacaatgaagcaa

SEQ ID NO: 170365 - DNA, 25 bp, Homo sapien
ttgagaagccaaccatgcaagccag

SEQ ID NO: 170366 - DNA, 25 bp, Homo sapien
agaagccaaccatgcaagccagccg

SEQ ID NO: 170367 - DNA, 25 bp, Homo sapien
agccgccggtgctgttgacccaagg

SEQ ID NO: 170368 - DNA, 25 bp, Homo sapien
cgtggtccacggtacttgaagaagc

SEQ ID NO: 170369 - DNA, 25 bp, Homo sapien
agagcccacatcctgtgcactgctg

SEQ ID NO: 170370 - DNA, 25 bp, Homo sapien
tgtgcactgctgaaggaccctacgc

SEQ ID NO: 170371 - DNA, 25 bp, Homo sapien
tgaaggaccctacgctcggtggcct

SEQ ID NO: 170372 - DNA, 25 bp, Homo sapien
tggcctggcacctcactttgagaag

SEQ ID NO: 170373 - DNA, 25 bp, Homo sapien
gagtgagcacactggctttgcatcc

SEQ ID NO: 170374 - DNA, 25 bp, Homo sapien
ccacaaaatggcctttagtgtatga

SEQ ID NO: 170375 - DNA, 25 bp, Homo sapien
ctttagtgtatgaaatgcacatgga

SEQ ID NO: 170376 - DNA, 25 bp, Homo sapien
atacatatatatagttgacacttga

SEQ ID NO: 170377 - DNA, 25 bp, Homo sapien
acatatatatagttgacacttgaaa

SEQ ID NO: 170378 - DNA, 25 bp, Homo sapien
tgacacttgaaaaatgcaggtggta

SEQ ID NO: 170379 - DNA, 25 bp, Homo sapien
tacgccccgcacagtcaaaaatctg

SEQ ID NO: 170380 - DNA, 25 bp, Homo sapien
gccccgcacagtcaaaaatctgcat

SEQ ID NO: 170381 - DNA, 25 bp, Homo sapien
tccccaaagtcttaagtactagtag

SEQ ID NO: 170382 - DNA, 25 bp, Homo sapien
ttaagtactagtagcctgttattga

SEQ ID NO: 170383 - DNA, 25 bp, Homo sapien
taagtactagtagcctgttattgac

SEQ ID NO: 170384 - DNA, 25 bp, Homo sapien
agtactagtagcctgttattgactg

SEQ ID NO: 170385 - DNA, 25 bp, Homo sapien
gtactagtagcctgttattgactgg

SEQ ID NO: 170386 - DNA, 25 bp, Homo sapien
tactagtagcctgttattgactggg

SEQ ID NO: 170387 - DNA, 25 bp, Homo sapien
gattgagaagttactttccattgct

SEQ ID NO: 170388 - DNA, 25 bp, Homo sapien
tgagaagttactttccattgctatc

SEQ ID NO: 170389 - DNA, 25 bp, Homo sapien
gagaagttactttccattgctatct

SEQ ID NO: 170390 - DNA, 25 bp, Homo sapien
gaagttactttccattgctatctat

SEQ ID NO: 170391 - DNA, 25 bp, Homo sapien
agttactttccattgctatctattg

SEQ ID NO: 170392 - DNA, 25 bp, Homo sapien
gttactttccattgctatctattga

SEQ ID NO: 170393 - DNA, 25 bp, Homo sapien
ttactttccattgctatctattgat

SEQ ID NO: 170394 - DNA, 25 bp, Homo sapien
actttccattgctatctattgataa

SEQ ID NO: 170395 - DNA, 25 bp, Homo sapien
ttccattgctatctattgataattt

SEQ ID NO: 170396 - DNA, 25 bp, Homo sapien
tgataatttagacattgagttcaaa

SEQ ID NO: 170397 - DNA, 25 bp, Homo sapien
ttagacattgagttcaaattgcctt

SEQ ID NO: 170398 - DNA, 25 bp, Homo sapien
tgagattctgaaactccactgtagt

SEQ ID NO: 170399 - DNA, 25 bp, Homo sapien
actccactgtagtttactttgcctg

SEQ ID NO: 170400 - DNA, 25 bp, Homo sapien
ctgtagtttactttgcctgtaccat

SEQ ID NO: 170401 - DNA, 25 bp, Homo sapien
tgcctgtaccattaatgccaatgtt

SEQ ID NO: 170402 - DNA, 25 bp, Homo sapien
taaaccaacatgtggctgagccttt

SEQ ID NO: 170403 - DNA, 25 bp, Homo sapien
caacatgtggctgagccttttttct

SEQ ID NO: 170404 - DNA, 25 bp, Homo sapien
tttaactgcatatttgaacctacaa

SEQ ID NO: 170405 - DNA, 25 bp, Homo sapien
gaacctacaaactggtaaatcttat

SEQ ID NO: 170406 - DNA, 25 bp, Homo sapien
gaatgtacgtaaggccctctttcct

SEQ ID NO: 170407 - DNA, 25 bp, Homo sapien
aggccctctttccttatagtgtcga

SEQ ID NO: 170408 - DNA, 25 bp, Homo sapien
ctttccttatagtgtcgagttattt

SEQ ID NO: 170409 - DNA, 25 bp, Homo sapien
gaggctctggaggacaatctaggac

SEQ ID NO: 170410 - DNA, 25 bp, Homo sapien
tggaggacaatctaggacctacatt

SEQ ID NO: 170411 - DNA, 25 bp, Homo sapien
aatctaggacctacattatctggac

SEQ ID NO: 170412 - DNA, 25 bp, Homo sapien
aggacctacattatctggactgtat

SEQ ID NO: 170413 - DNA, 25 bp, Homo sapien
atctggactgtatgctggtcatttc

SEQ ID NO: 170414 - DNA, 25 bp, Homo sapien
gactgtatgctggtcatttctagag

SEQ ID NO: 170415 - DNA, 25 bp, Homo sapien
gtatgctggtcatttctagagacag

SEQ ID NO: 170416 - DNA, 25 bp, Homo sapien
ggtcatttctagagacagcaatcaa

SEQ ID NO: 170417 - DNA, 25 bp, Homo sapien
gagacagcaatcaatatttgagtgt

SEQ ID NO: 170418 - DNA, 25 bp, Homo sapien
tttgagtgtaaggaaactgtctggg

SEQ ID NO: 170419 - DNA, 25 bp, Homo sapien
aaactgtctggggtgattcctagaa

SEQ ID NO: 170420 - DNA, 25 bp, Homo sapien
aaatctcacatggtgggcactgcag

SEQ ID NO: 170421 - DNA, 25 bp, Homo sapien
agcgttggaacgtgagcctcggatt

SEQ ID NO: 170422 - DNA, 25 bp, Homo sapien
gaacgtgagcctcggatttcctggc

SEQ ID NO: 170423 - DNA, 25 bp, Homo sapien
tactgtaaatgtgccttagcctaag

SEQ ID NO: 170424 - DNA, 25 bp, Homo sapien
aagcctcccatcctgtgttagcgtt

SEQ ID NO: 170425 - DNA, 25 bp, Homo sapien
tcctgtgttagcgttgcctggtgcg

SEQ ID NO: 170426 - DNA, 25 bp, Homo sapien
tgggccctccaagccaggttgaggt

SEQ ID NO: 170427 - DNA, 25 bp, Homo sapien
gttgaggtctggtaacagaatgcca

SEQ ID NO: 170428 - DNA, 25 bp, Homo sapien
ccacacaggcatgagggatggcccg

SEQ ID NO: 170429 - DNA, 25 bp, Homo sapien
atggcccggccaaagtctaggcaga

SEQ ID NO: 170430 - DNA, 25 bp, Homo sapien
gacggtcctggaaatctcacatggt

SEQ ID NO: 170431 - DNA, 25 bp, Homo sapien
tcctgtgtccatgtgcagaacaata

SEQ ID NO: 170432 - DNA, 25 bp, Homo sapien
gtgtccatgtgcagaacaatattaa

SEQ ID NO: 170433 - DNA, 25 bp, Homo sapien
gaaaagcagtctagcaaatgtccct

SEQ ID NO: 170434 - DNA, 25 bp, Homo sapien
agtctagcaaatgtcccttctgtat

SEQ ID NO: 170435 - DNA, 25 bp, Homo sapien
tctagcaaatgtcccttctgtatgt

SEQ ID NO: 170436 - DNA, 25 bp, Homo sapien
cccttctgtatgtaaaaagcacgtt

SEQ ID NO: 170437 - DNA, 25 bp, Homo sapien
tatgagaatgcagcacacaaagaga

SEQ ID NO: 170438 - DNA, 25 bp, Homo sapien
gagatagagaatctcttttacttga

SEQ ID NO: 170439 - DNA, 25 bp, Homo sapien
tttacttgaaaaggccctgtctgac

SEQ ID NO: 170440 - DNA, 25 bp, Homo sapien
gccctgtctgaccttaattacacta

SEQ ID NO: 170441 - DNA, 25 bp, Homo sapien
tgtctgaccttaattacactattct

SEQ ID NO: 170442 - DNA, 25 bp, Homo sapien
tttttaggccaatcccatcccttct

SEQ ID NO: 170443 - DNA, 25 bp, Homo sapien
aatcccatcccttctggataaccag

SEQ ID NO: 170444 - DNA, 25 bp, Homo sapien
ggataaccagatgttaaatcatgag

SEQ ID NO: 170445 - DNA, 25 bp, Homo sapien
aatcatgagatcagagatgctgttc

SEQ ID NO: 170446 - DNA, 25 bp, Homo sapien
agatgctgttcatcagtcccaacaa

SEQ ID NO: 170447 - DNA, 25 bp, Homo sapien
atcagtcccaacaagatggcctaga

SEQ ID NO: 170448 - DNA, 25 bp, Homo sapien
acaagatggcctagaaatcgcattc

SEQ ID NO: 170449 - DNA, 25 bp, Homo sapien
tagaaatcgcattctcacctcgcct

SEQ ID NO: 170450 - DNA, 25 bp, Homo sapien
cccttatagttttctatgggaatga

SEQ ID NO: 170451 - DNA, 25 bp, Homo sapien
ggcggatacaggaaacaccctatct

SEQ ID NO: 170452 - DNA, 25 bp, Homo sapien
atacaggaaacaccctatctcctct

SEQ ID NO: 170453 - DNA, 25 bp, Homo sapien
acgtgagagatctcctcgatctgaa

SEQ ID NO: 170454 - DNA, 25 bp, Homo sapien
tgagagatctcctcgatctgaacct

SEQ ID NO: 170455 - DNA, 25 bp, Homo sapien
tcctcgatctgaacctccaattaaa

SEQ ID NO: 170456 - DNA, 25 bp, Homo sapien
gatctgaacctccaattaaaaaagc

SEQ ID NO: 170457 - DNA, 25 bp, Homo sapien
agaggagactccgaagactgacaat

SEQ ID NO: 170458 - DNA, 25 bp, Homo sapien
gagactccgaagactgacaatacta

SEQ ID NO: 170459 - DNA, 25 bp, Homo sapien
gactgacaatactaaatcatcatct

SEQ ID NO: 170460 - DNA, 25 bp, Homo sapien
tcatcatcttcctctcagaaggatg

SEQ ID NO: 170461 - DNA, 25 bp, Homo sapien
catcttcctctcagaaggatgaaaa

SEQ ID NO: 170462 - DNA, 25 bp, Homo sapien
gatgaaaaaatcactggaaccccca

SEQ ID NO: 170463 - DNA, 25 bp, Homo sapien
gaaaagctcactctaaatcagcaaa

SEQ ID NO: 170464 - DNA, 25 bp, Homo sapien
gagttacttcccttaggataacagc

SEQ ID NO: 170465 - DNA, 25 bp, Homo sapien
tcccttaggataacagcccccagtt

SEQ ID NO: 170466 - DNA, 25 bp, Homo sapien
cattattcttctttatggctgagta

SEQ ID NO: 170467 - DNA, 25 bp, Homo sapien
attattcttctttatggctgagtaa

SEQ ID NO: 170468 - DNA, 25 bp, Homo sapien
ggctgagtaatagtccatggtacat

SEQ ID NO: 170469 - DNA, 25 bp, Homo sapien
gtaatagtccatggtacatatatac

SEQ ID NO: 170470 - DNA, 25 bp, Homo sapien
gacacttaggttaattccattcaat

SEQ ID NO: 170471 - DNA, 25 bp, Homo sapien
attccattcaatttcattcaattta

SEQ ID NO: 170472 - DNA, 25 bp, Homo sapien
tatatttgtaaggagctaaagctga

SEQ ID NO: 170473 - DNA, 25 bp, Homo sapien
aattttagatctttcaatactctta

SEQ ID NO: 170474 - DNA, 25 bp, Homo sapien
gatctttcaatactcttaaatttta

SEQ ID NO: 170475 - DNA, 25 bp, Homo sapien
ttaccggacccttgaacctcaatga

SEQ ID NO: 170476 - DNA, 25 bp, Homo sapien
ttgaacctcaatgatccagatgcaa

SEQ ID NO: 170477 - DNA, 25 bp, Homo sapien
aatacagatgacacttatgaagagc

SEQ ID NO: 170478 - DNA, 25 bp, Homo sapien
gaagagctccatttaatcgtttata

SEQ ID NO: 170479 - DNA, 25 bp, Homo sapien
taatcgtttataaggccatgagtgc

SEQ ID NO: 170480 - DNA, 25 bp, Homo sapien
ccatgagtgcggctgtgtgctttat

SEQ ID NO: 170481 - DNA, 25 bp, Homo sapien
tgtgctttatgatcgacgcctctgt

SEQ ID NO: 170482 - DNA, 25 bp, Homo sapien
tctgtccacccaacgttggattttt

SEQ ID NO: 170483 - DNA, 25 bp, Homo sapien
caacgttggatttttgccgaagact

SEQ ID NO: 170484 - DNA, 25 bp, Homo sapien
ttgccgaagactggacagcatcgtt

SEQ ID NO: 170485 - DNA, 25 bp, Homo sapien
gtctgagaaagaaccccagtttaag

SEQ ID NO: 170486 - DNA, 25 bp, Homo sapien
agagtaaagcccatacaagtattca

SEQ ID NO: 170487 - DNA, 25 bp, Homo sapien
ttcctgggcaacctttttgatttct

SEQ ID NO: 170488 - DNA, 25 bp, Homo sapien
gcaacctttttgatttcttccagaa

SEQ ID NO: 170489 - DNA, 25 bp, Homo sapien
tccaggactccctctaagtggaata

SEQ ID NO: 170490 - DNA, 25 bp, Homo sapien
aagtggaatagcctccctgtaactc

SEQ ID NO: 170491 - DNA, 25 bp, Homo sapien
agctctgctccgtatgccaagagga

SEQ ID NO: 170492 - DNA, 25 bp, Homo sapien
gtatgccaagaggagactttaattc

SEQ ID NO: 170493 - DNA, 25 bp, Homo sapien
ttactgcttcttttcacttcagagc

SEQ ID NO: 170494 - DNA, 25 bp, Homo sapien
acttcagagcacacttatgggccaa

SEQ ID NO: 170495 - DNA, 25 bp, Homo sapien
acttatgggccaagcccagcttaat

SEQ ID NO: 170496 - DNA, 25 bp, Homo sapien
agcttaatggctcatgacctggaaa

SEQ ID NO: 170497 - DNA, 25 bp, Homo sapien
gaaacaatgtgttgtacatcagtac

SEQ ID NO: 170498 - DNA, 25 bp, Homo sapien
gaagagacggatgtgaagacaccaa

SEQ ID NO: 170499 - DNA, 25 bp, Homo sapien
acaccaagagagcaacgcttttcat

SEQ ID NO: 170500 - DNA, 25 bp, Homo sapien
gagcaacgcttttcatagttggata

SEQ ID NO: 170501 - DNA, 25 bp, Homo sapien
atttttgcttcttttgtgatacaat

SEQ ID NO: 170502 - DNA, 25 bp, Homo sapien
gatacaatttgtcctctttttataa

SEQ ID NO: 170503 - DNA, 25 bp, Homo sapien
gtcctctttttataatagttggtga

SEQ ID NO: 170504 - DNA, 25 bp, Homo sapien
tgaaatgttctttcacttgtaagtt

SEQ ID NO: 170505 - DNA, 25 bp, Homo sapien
ttcacttgtaagtttcagtcatttt

SEQ ID NO: 170506 - DNA, 25 bp, Homo sapien
cagtcattttcttttacctcgttgt

SEQ ID NO: 170507 - DNA, 25 bp, Homo sapien
tttacctcgttgtcagtgtacagaa

SEQ ID NO: 170508 - DNA, 25 bp, Homo sapien
ctgggcacctctgggacagcaaaaa

SEQ ID NO: 170509 - DNA, 25 bp, Homo sapien
gaatgcatccctaaaactcacgaga

SEQ ID NO: 170510 - DNA, 25 bp, Homo sapien
gagaggcagtaaggaacccagcaca

SEQ ID NO: 170511 - DNA, 25 bp, Homo sapien
ggaacccagcacaaaagaaccctca

SEQ ID NO: 170512 - DNA, 25 bp, Homo sapien
agcacaaaagaaccctcaacccata

SEQ ID NO: 170513 - DNA, 25 bp, Homo sapien
tcaacccatataccaccactggatt

SEQ ID NO: 170514 - DNA, 25 bp, Homo sapien
ccactggattccaagggagccaact

SEQ ID NO: 170515 - DNA, 25 bp, Homo sapien
aagggagccaactcggtctgagaga

SEQ ID NO: 170516 - DNA, 25 bp, Homo sapien
gtatcttgggatcaagactgcagtt

SEQ ID NO: 170517 - DNA, 25 bp, Homo sapien
tttgggaatgcatggacaccggatt

SEQ ID NO: 170518 - DNA, 25 bp, Homo sapien
gcatggacaccggatttgtttctta

SEQ ID NO: 170519 - DNA, 25 bp, Homo sapien
caaaggatttccatgggatgagtac

SEQ ID NO: 170520 - DNA, 25 bp, Homo sapien
ttccatgggatgagtacaagttact

SEQ ID NO: 170521 - DNA, 25 bp, Homo sapien
agttactgagcacctttcctaggag

SEQ ID NO: 170522 - DNA, 25 bp, Homo sapien
gagcacctttcctaggagagacgta

SEQ ID NO: 170523 - DNA, 25 bp, Homo sapien
gagacgtaactcaactggacccaaa

SEQ ID NO: 170524 - DNA, 25 bp, Homo sapien
gtaactcaactggacccaaataaat

SEQ ID NO: 170525 - DNA, 25 bp, Homo sapien
tggaggtaaagttgttccctcaaga

SEQ ID NO: 170526 - DNA, 25 bp, Homo sapien
caaaagagtaaacacggcccagcgg

SEQ ID NO: 170527 - DNA, 25 bp, Homo sapien
taaacacggcccagcggtggaacca

SEQ ID NO: 170528 - DNA, 25 bp, Homo sapien
acggcccagcggtggaaccagccat

SEQ ID NO: 170529 - DNA, 25 bp, Homo sapien
aagccagcagcctgcgtcaggagaa

SEQ ID NO: 170530 - DNA, 25 bp, Homo sapien
tatatgacaaaatgctctgattcct

SEQ ID NO: 170531 - DNA, 25 bp, Homo sapien
ataactgaacacactcatccatttg

SEQ ID NO: 170532 - DNA, 25 bp, Homo sapien
acacactcatccatttgtgcttttg

SEQ ID NO: 170533 - DNA, 25 bp, Homo sapien
aagtaaagagcccatcctttgcaag

SEQ ID NO: 170534 - DNA, 25 bp, Homo sapien
aaagagcccatcctttgcaagtcat

SEQ ID NO: 170535 - DNA, 25 bp, Homo sapien
catcctttgcaagtcatccatgttg

SEQ ID NO: 170536 - DNA, 25 bp, Homo sapien
acttaggcattttatcttggctcaa

SEQ ID NO: 170537 - DNA, 25 bp, Homo sapien
gaatggtggcttgtttcatggtttt

SEQ ID NO: 170538 - DNA, 25 bp, Homo sapien
gatagacgcaatgcattgtgtagct

SEQ ID NO: 170539 - DNA, 25 bp, Homo sapien
gcattgtgtagctagttttctggaa

SEQ ID NO: 170540 - DNA, 25 bp, Homo sapien
gctagttttctggaaaagtcaatct

SEQ ID NO: 170541 - DNA, 25 bp, Homo sapien
tgcattccagtatggtatcaaaatg

SEQ ID NO: 170542 - DNA, 25 bp, Homo sapien
gtatcaaaatgtctgaagggcggaa

SEQ ID NO: 170543 - DNA, 25 bp, Homo sapien
gaagggcggaaaaccaggcgcttca

SEQ ID NO: 170544 - DNA, 25 bp, Homo sapien
ggaaaccaatgacaaagcagagctt

SEQ ID NO: 170545 - DNA, 25 bp, Homo sapien
aagcagagcttgatcgccagtggaa

SEQ ID NO: 170546 - DNA, 25 bp, Homo sapien
actagttacaaccagagatgctcca

SEQ ID NO: 170547 - DNA, 25 bp, Homo sapien
gagatgctccacaaggatatgctcc

SEQ ID NO: 170548 - DNA, 25 bp, Homo sapien
acaaggatatgctccccactgtttt

SEQ ID NO: 170549 - DNA, 25 bp, Homo sapien
tatgctccccactgttttctttcta

SEQ ID NO: 170550 - DNA, 25 bp, Homo sapien
ttctttctacaatttccaaaggttg

SEQ ID NO: 170551 - DNA, 25 bp, Homo sapien
ttccaaaggttgcaagatgtttttt

SEQ ID NO: 170552 - DNA, 25 bp, Homo sapien
gatttgggtcagttgtagttgcctc

SEQ ID NO: 170553 - DNA, 25 bp, Homo sapien
ttgggtcagttgtagttgcctctcc

SEQ ID NO: 170554 - DNA, 25 bp, Homo sapien
tcccaaaggtgggtgttgaactagg

SEQ ID NO: 170555 - DNA, 25 bp, Homo sapien
ggatattgctgtcctgagggaccct

SEQ ID NO: 170556 - DNA, 25 bp, Homo sapien
attgctgtcctgagggaccctctca

SEQ ID NO: 170557 - DNA, 25 bp, Homo sapien
ggaccctctcatttctgacatttga

SEQ ID NO: 170558 - DNA, 25 bp, Homo sapien
taaatctttcttaaccgtgaaagca

SEQ ID NO: 170559 - DNA, 25 bp, Homo sapien
taaccgtgaaagcaaaagcctttgg

SEQ ID NO: 170560 - DNA, 25 bp, Homo sapien
caaacaaaaagcctaatccctctat

SEQ ID NO: 170561 - DNA, 25 bp, Homo sapien
aatccctctattttaagatttctga

SEQ ID NO: 170562 - DNA, 25 bp, Homo sapien
aaaacactccatgttatattctggg

SEQ ID NO: 170563 - DNA, 25 bp, Homo sapien
gtatataactgaacacactcatcca

SEQ ID NO: 170564 - DNA, 25 bp, Homo sapien
taactgaacacactcatccatttgt

SEQ ID NO: 170565 - DNA, 25 bp, Homo sapien
gaacacactcatccatttgtgcttt

SEQ ID NO: 170566 - DNA, 25 bp, Homo sapien
acacactcatccatttgtgcttttg

SEQ ID NO: 170567 - DNA, 25 bp, Homo sapien
acatgatagacgcaatgcattgtgt

SEQ ID NO: 170568 - DNA, 25 bp, Homo sapien
gatagacgcaatgcattgtgtagct

SEQ ID NO: 170569 - DNA, 25 bp, Homo sapien
gacgcaatgcattgtgtagctagtt

SEQ ID NO: 170570 - DNA, 25 bp, Homo sapien
aatgcattgtgtagctagttttctg

SEQ ID NO: 170571 - DNA, 25 bp, Homo sapien
gcattgtgtagctagttttctggaa

SEQ ID NO: 170572 - DNA, 25 bp, Homo sapien
gctagttttctggaaaagtcaatct

SEQ ID NO: 170573 - DNA, 25 bp, Homo sapien
gaaaagtcaatcttttaggaattgt

SEQ ID NO: 170574 - DNA, 25 bp, Homo sapien
gatttgggtcagttgtagttgcctc

SEQ ID NO: 170575 - DNA, 25 bp, Homo sapien
tttgggtcagttgtagttgcctctc

SEQ ID NO: 170576 - DNA, 25 bp, Homo sapien
ttgggtcagttgtagttgcctctcc

SEQ ID NO: 170577 - DNA, 25 bp, Homo sapien
gggtcagttgtagttgcctctcccc

SEQ ID NO: 170578 - DNA, 25 bp, Homo sapien
taaatctttcttaaccgtgaaagca

SEQ ID NO: 170579 - DNA, 25 bp, Homo sapien
tcttaaccgtgaaagcaaaagcctt

SEQ ID NO: 170580 - DNA, 25 bp, Homo sapien
taaccgtgaaagcaaaagcctttgg

SEQ ID NO: 170581 - DNA, 25 bp, Homo sapien
ttaggagctagggtagaatataatt

SEQ ID NO: 170582 - DNA, 25 bp, Homo sapien
caaacaaaaagcctaatccctctat

SEQ ID NO: 170583 - DNA, 25 bp, Homo sapien
aatccctctattttaagatttctga

SEQ ID NO: 170584 - DNA, 25 bp, Homo sapien
cactccatgttatattctggggaaa

SEQ ID NO: 170585 - DNA, 25 bp, Homo sapien
tcaacttcccacaaactgaggaatg

SEQ ID NO: 170586 - DNA, 25 bp, Homo sapien
ggaatgaattccacgagcctgttct

SEQ ID NO: 170587 - DNA, 25 bp, Homo sapien
attccacgagcctgttctgaaaatg

SEQ ID NO: 170588 - DNA, 25 bp, Homo sapien
gtaagacaaacacgtgctcgtcctt

SEQ ID NO: 170589 - DNA, 25 bp, Homo sapien
acacgtgctcgtcctttaatggagt

SEQ ID NO: 170590 - DNA, 25 bp, Homo sapien
taatggagttcaccagcacacttgt

SEQ ID NO: 170591 - DNA, 25 bp, Homo sapien
gcacacttgttaaccagtcctgttt

SEQ ID NO: 170592 - DNA, 25 bp, Homo sapien
aagtcaactgaccaagtgaccatga

SEQ ID NO: 170593 - DNA, 25 bp, Homo sapien
ggctcctgttttttagctgctgttc

SEQ ID NO: 170594 - DNA, 25 bp, Homo sapien
tgctgttcttcagctccgaccatgt

SEQ ID NO: 170595 - DNA, 25 bp, Homo sapien
ctccgaccatgttgctgtgtgatta

SEQ ID NO: 170596 - DNA, 25 bp, Homo sapien
ggtctgagtaccagccctagaactc

SEQ ID NO: 170597 - DNA, 25 bp, Homo sapien
gtaccagccctagaactcagcgttg

SEQ ID NO: 170598 - DNA, 25 bp, Homo sapien
tagaactcagcgttgccaggtgtgc

SEQ ID NO: 170599 - DNA, 25 bp, Homo sapien
agcgttgccaggtgtgctgccatct

SEQ ID NO: 170600 - DNA, 25 bp, Homo sapien
aggtgtgctgccatctgctgttcgg

SEQ ID NO: 170601 - DNA, 25 bp, Homo sapien
tgttcggcccaacctcagagtgaag

SEQ ID NO: 170602 - DNA, 25 bp, Homo sapien
cccaacctcagagtgaaggcagggt

SEQ ID NO: 170603 - DNA, 25 bp, Homo sapien
gcaaaggaggacctggctcctgact

SEQ ID NO: 170604 - DNA, 25 bp, Homo sapien
ctggctcctgactctcagagaggat

SEQ ID NO: 170605 - DNA, 25 bp, Homo sapien
ctcagagaggataggctggatccct

SEQ ID NO: 170606 - DNA, 25 bp, Homo sapien
aaggaagagctttgccatcccctgc

SEQ ID NO: 170607 - DNA, 25 bp, Homo sapien
tcctgatcctccaagtcaacattta

SEQ ID NO: 170608 - DNA, 25 bp, Homo sapien
tcaacatttacgtgggcatgggaca

SEQ ID NO: 170609 - DNA, 25 bp, Homo sapien
catgggacaggcttttgctttgatt

SEQ ID NO: 170610 - DNA, 25 bp, Homo sapien
tttgattccagctttgatgttcaca

SEQ ID NO: 170611 - DNA, 25 bp, Homo sapien
gatgttcacaagaagtgtcccctct

SEQ ID NO: 170612 - DNA, 25 bp, Homo sapien
gtgtcccctctgtgagttaatgttt

SEQ ID NO: 170613 - DNA, 25 bp, Homo sapien
aatgtttcctcctaactatgatcag

SEQ ID NO: 170614 - DNA, 25 bp, Homo sapien
aaagtcactggaaggtgtgcccgat

SEQ ID NO: 170615 - DNA, 25 bp, Homo sapien
tgtgcccgatgtgcagcgagcagtt

SEQ ID NO: 170616 - DNA, 25 bp, Homo sapien
agttccctcctgactatgaccagca

SEQ ID NO: 170617 - DNA, 25 bp, Homo sapien
aggcatgtgcagacccattttgatc

SEQ ID NO: 170618 - DNA, 25 bp, Homo sapien
tgtgatggcggctgcaatctgtctt

SEQ ID NO: 170619 - DNA, 25 bp, Homo sapien
atggcggctgcaatctgtcttgtgg

SEQ ID NO: 170620 - DNA, 25 bp, Homo sapien
gctgcaatctgtcttgtgggtatta

SEQ ID NO: 170621 - DNA, 25 bp, Homo sapien
tcttgtgggtattaatgcaatcttc

SEQ ID NO: 170622 - DNA, 25 bp, Homo sapien
tgcaatcttcagtggtggctactgt

SEQ ID NO: 170623 - DNA, 25 bp, Homo sapien
atcttcagtggtggctactgttctc

SEQ ID NO: 170624 - DNA, 25 bp, Homo sapien
ctactgttctctagctgttctacaa

SEQ ID NO: 170625 - DNA, 25 bp, Homo sapien
gttctctagctgttctacaaaactg

SEQ ID NO: 170626 - DNA, 25 bp, Homo sapien
tctacaaaactggagcatgctggct

SEQ ID NO: 170627 - DNA, 25 bp, Homo sapien
gagcatgctggcttgaaaaaccctt

SEQ ID NO: 170628 - DNA, 25 bp, Homo sapien
ctggcttgaaaaacccttgcccagt

SEQ ID NO: 170629 - DNA, 25 bp, Homo sapien
ccccgtctgacgaatgacaggaaga

SEQ ID NO: 170630 - DNA, 25 bp, Homo sapien
ataaaccccagttctgaatcaccta

SEQ ID NO: 170631 - DNA, 25 bp, Homo sapien
acctaccttcaccatctgtatatac

SEQ ID NO: 170632 - DNA, 25 bp, Homo sapien
agaattcttcggagcttgtcttatt

SEQ ID NO: 170633 - DNA, 25 bp, Homo sapien
cggagcttgtcttatttgctataga

SEQ ID NO: 170634 - DNA, 25 bp, Homo sapien
gagcttttgggaatggaatcactga

SEQ ID NO: 170635 - DNA, 25 bp, Homo sapien
ctttcctcctagaatctgtgatctg

SEQ ID NO: 170636 - DNA, 25 bp, Homo sapien
gagggtataaagacatttccaccaa

SEQ ID NO: 170637 - DNA, 25 bp, Homo sapien
tttccaccaagtttgagccctcaaa

SEQ ID NO: 170638 - DNA, 25 bp, Homo sapien
ttgagccctcaaaatgtcctgatta

SEQ ID NO: 170639 - DNA, 25 bp, Homo sapien
gtcctgattacaatgctgtctgtcc

SEQ ID NO: 170640 - DNA, 25 bp, Homo sapien
aaagccctggtgttgtgttttcatg

SEQ ID NO: 170641 - DNA, 25 bp, Homo sapien
atgtcttttttcagccctctcagat

SEQ ID NO: 170642 - DNA, 25 bp, Homo sapien
agccctctcagatccaaatgttatt

SEQ ID NO: 170643 - DNA, 25 bp, Homo sapien
gatccaaatgttattatgcactttt

SEQ ID NO: 170644 - DNA, 25 bp, Homo sapien
tagtgtgaattgcattctgatacaa

SEQ ID NO: 170645 - DNA, 25 bp, Homo sapien
aatactgtgtttgatggcctctgct

SEQ ID NO: 170646 - DNA, 25 bp, Homo sapien
tgctgtgttttaacatcgtgcttct

SEQ ID NO: 170647 - DNA, 25 bp, Homo sapien
aacatcgtgcttcttatatggaaag

SEQ ID NO: 170648 - DNA, 25 bp, Homo sapien
aagtttttgtgagctgtgtaatccc

SEQ ID NO: 170649 - DNA, 25 bp, Homo sapien
tgagctgtgtaatccctctggtcag

SEQ ID NO: 170650 - DNA, 25 bp, Homo sapien
atccctctggtcagtattatgaaat

SEQ ID NO: 170651 - DNA, 25 bp, Homo sapien
gcgggagcagcaggctcaagtagag

SEQ ID NO: 170652 - DNA, 25 bp, Homo sapien
cgggagcagcaggctcaagtagaga

SEQ ID NO: 170653 - DNA, 25 bp, Homo sapien
gggagcagcaggctcaagtagagaa

SEQ ID NO: 170654 - DNA, 25 bp, Homo sapien
ggagcagcaggctcaagtagagaag

SEQ ID NO: 170655 - DNA, 25 bp, Homo sapien
gagcagcaggctcaagtagagaagg

SEQ ID NO: 170656 - DNA, 25 bp, Homo sapien
agcagcaggctcaagtagagaagga

SEQ ID NO: 170657 - DNA, 25 bp, Homo sapien
gcagcaggctcaagtagagaaggag

SEQ ID NO: 170658 - DNA, 25 bp, Homo sapien
cagcaggctcaagtagagaaggagg

SEQ ID NO: 170659 - DNA, 25 bp, Homo sapien
agcaggctcaagtagagaaggagga

SEQ ID NO: 170660 - DNA, 25 bp, Homo sapien
caggctcaagtagagaaggaggact

SEQ ID NO: 170661 - DNA, 25 bp, Homo sapien
aggctcaagtagagaaggaggactt

SEQ ID NO: 170662 - DNA, 25 bp, Homo sapien
cgacgccacgaactggcctcgcgcg

SEQ ID NO: 170663 - DNA, 25 bp, Homo sapien
gacgccacgaactggcctcgcgcgg

SEQ ID NO: 170664 - DNA, 25 bp, Homo sapien
acgccacgaactggcctcgcgcggc

SEQ ID NO: 170665 - DNA, 25 bp, Homo sapien
gccacgaactggcctcgcgcggcaa

SEQ ID NO: 170666 - DNA, 25 bp, Homo sapien
ccacgaactggcctcgcgcggcaag

SEQ ID NO: 170667 - DNA, 25 bp, Homo sapien
cacgaactggcctcgcgcggcaaga

SEQ ID NO: 170668 - DNA, 25 bp, Homo sapien
cgaactggcctcgcgcggcaagaat

SEQ ID NO: 170669 - DNA, 25 bp, Homo sapien
gaactggcctcgcgcggcaagaatg

SEQ ID NO: 170670 - DNA, 25 bp, Homo sapien
aactggcctcgcgcggcaagaatgt

SEQ ID NO: 170671 - DNA, 25 bp, Homo sapien
atatttttgcttcttgtcatttgaa

SEQ ID NO: 170672 - DNA, 25 bp, Homo sapien
tatttttgcttcttgtcatttgaag

SEQ ID NO: 170673 - DNA, 25 bp, Homo sapien
atttttgcttcttgtcatttgaagg

SEQ ID NO: 170674 - DNA, 25 bp, Homo sapien
tttttgcttcttgtcatttgaagga

SEQ ID NO: 170675 - DNA, 25 bp, Homo sapien
ttttgcttcttgtcatttgaaggat

SEQ ID NO: 170676 - DNA, 25 bp, Homo sapien
tttgcttcttgtcatttgaaggatt

SEQ ID NO: 170677 - DNA, 25 bp, Homo sapien
ttgcttcttgtcatttgaaggatta

SEQ ID NO: 170678 - DNA, 25 bp, Homo sapien
gcttcttgtcatttgaaggattaag

SEQ ID NO: 170679 - DNA, 25 bp, Homo sapien
ttgtcatttgaaggattaagaaaca

SEQ ID NO: 170680 - DNA, 25 bp, Homo sapien
aacaatccagaaattgatcggtttt

SEQ ID NO: 170681 - DNA, 25 bp, Homo sapien
acaatccagaaattgatcggttttt

SEQ ID NO: 170682 - DNA, 25 bp, Homo sapien
gtaaataaaagttcactctgtgagt

SEQ ID NO: 170683 - DNA, 25 bp, Homo sapien
tcactctgtgagtgcacattttggt

SEQ ID NO: 170684 - DNA, 25 bp, Homo sapien
aaaaaatgcatttgaccaggataaa

SEQ ID NO: 170685 - DNA, 25 bp, Homo sapien
gaggtatgttgatcatggctttgct

SEQ ID NO: 170686 - DNA, 25 bp, Homo sapien
tgatcatggctttgctttatatctt

SEQ ID NO: 170687 - DNA, 25 bp, Homo sapien
taaagctggtttatcatcctggtat

SEQ ID NO: 170688 - DNA, 25 bp, Homo sapien
ctggtttatcatcctggtattttaa

SEQ ID NO: 170689 - DNA, 25 bp, Homo sapien
ttaatgtaaactaacctcctgcatg

SEQ ID NO: 170690 - DNA, 25 bp, Homo sapien
gaggttaaaattttgtctgcacttg

SEQ ID NO: 170691 - DNA, 25 bp, Homo sapien
gtctgcacttgagttcacttgagtt

SEQ ID NO: 170692 - DNA, 25 bp, Homo sapien
tgagttcacttgagtttacatttga

SEQ ID NO: 170693 - DNA, 25 bp, Homo sapien
ggacaatagtcctctttccaagtgt

SEQ ID NO: 170694 - DNA, 25 bp, Homo sapien
agtcctctttccaagtgtgttagca

SEQ ID NO: 170695 - DNA, 25 bp, Homo sapien
aagtgtgttagcatagacttctcta

SEQ ID NO: 170696 - DNA, 25 bp, Homo sapien
agacttctctatatgtttctactag

SEQ ID NO: 170697 - DNA, 25 bp, Homo sapien
ctatatgtttctactagacctaggg

SEQ ID NO: 170698 - DNA, 25 bp, Homo sapien
gacgtcttttaataatactggccct

SEQ ID NO: 170699 - DNA, 25 bp, Homo sapien
aatactggccctaaacatgtaaata

SEQ ID NO: 170700 - DNA, 25 bp, Homo sapien
aatcttgtaggtgagactttttctt

SEQ ID NO: 170701 - DNA, 25 bp, Homo sapien
gtgtttcggaaatttcctatgtggc

SEQ ID NO: 170702 - DNA, 25 bp, Homo sapien
tcctatgtggctttcagttgtctgt

SEQ ID NO: 170703 - DNA, 25 bp, Homo sapien
gttgtctgtttgtatagcctggatt

SEQ ID NO: 170704 - DNA, 25 bp, Homo sapien
gggacccagatctcatactcaacag

SEQ ID NO: 170705 - DNA, 25 bp, Homo sapien
gacccagatctcatactcaacagaa

SEQ ID NO: 170706 - DNA, 25 bp, Homo sapien
gatctcatactcaacagaaggagac

SEQ ID NO: 170707 - DNA, 25 bp, Homo sapien
gagactcagagactccagaaggcac

SEQ ID NO: 170708 - DNA, 25 bp, Homo sapien
actccagaaggcacaggagctgccc

SEQ ID NO: 170709 - DNA, 25 bp, Homo sapien
taacaaagaccaccaggacatcctg

SEQ ID NO: 170710 - DNA, 25 bp, Homo sapien
agaccaccaggacatcctgggaact

SEQ ID NO: 170711 - DNA, 25 bp, Homo sapien
atcctgggaactctgggactcacta

SEQ ID NO: 170712 - DNA, 25 bp, Homo sapien
actcactagattctgcagtcaaaga

SEQ ID NO: 170713 - DNA, 25 bp, Homo sapien
actagattctgcagtcaaagatgac

SEQ ID NO: 170714 - DNA, 25 bp, Homo sapien
gtcaaagatgactaatatccttgca

SEQ ID NO: 170715 - DNA, 25 bp, Homo sapien
gaaagtttccaagctaggtctggcc

SEQ ID NO: 170716 - DNA, 25 bp, Homo sapien
tttccaagctaggtctggcccgttg

SEQ ID NO: 170717 - DNA, 25 bp, Homo sapien
gagtcctgacccgagcctgttgtca

SEQ ID NO: 170718 - DNA, 25 bp, Homo sapien
gacccgagcctgttgtcagagttgg

SEQ ID NO: 170719 - DNA, 25 bp, Homo sapien
cccgagcctgttgtcagagttggga

SEQ ID NO: 170720 - DNA, 25 bp, Homo sapien
ctctgagcagtgttgggcaggccgg

SEQ ID NO: 170721 - DNA, 25 bp, Homo sapien
cttgccctgagccacatatgtctgt

SEQ ID NO: 170722 - DNA, 25 bp, Homo sapien
gagccacatatgtctgtgccatggg

SEQ ID NO: 170723 - DNA, 25 bp, Homo sapien
ccatgggctgagtgccacgacaggc

SEQ ID NO: 170724 - DNA, 25 bp, Homo sapien
gagtgccacgacaggcccgtgtgac

SEQ ID NO: 170725 - DNA, 25 bp, Homo sapien
acgacaggcccgtgtgacagctgct

SEQ ID NO: 170726 - DNA, 25 bp, Homo sapien
gaagatcagtttgggcttcacagtg

SEQ ID NO: 170727 - DNA, 25 bp, Homo sapien
gggcttcacagtgtcatttgaaaac

SEQ ID NO: 170728 - DNA, 25 bp, Homo sapien
agaaggatggtgtcctactgtggat

SEQ ID NO: 170729 - DNA, 25 bp, Homo sapien
gatggctttgatccaatggagcctg

SEQ ID NO: 170730 - DNA, 25 bp, Homo sapien
ggaggtgtgcccagaaagcttgtct

SEQ ID NO: 170731 - DNA, 25 bp, Homo sapien
aaagcttgtctgtagcgggttttgt

SEQ ID NO: 170732 - DNA, 25 bp, Homo sapien
gcgggttttgtgagagtgaacactt

SEQ ID NO: 170733 - DNA, 25 bp, Homo sapien
tgaacactttccactttttgacacc

SEQ ID NO: 170734 - DNA, 25 bp, Homo sapien
cactttttgacaccttatcctgatg

SEQ ID NO: 170735 - DNA, 25 bp, Homo sapien
accttatcctgatgtatggttccag

SEQ ID NO: 170736 - DNA, 25 bp, Homo sapien
ctgatgtatggttccaggatttgga

SEQ ID NO: 170737 - DNA, 25 bp, Homo sapien
acatcttcaagccatcctgtgtgcc

SEQ ID NO: 170738 - DNA, 25 bp, Homo sapien
actgaggagtccaacatcaccatgc

SEQ ID NO: 170739 - DNA, 25 bp, Homo sapien
tgaggagtccaacatcaccatgcag

SEQ ID NO: 170740 - DNA, 25 bp, Homo sapien
agattatgcggatcaaacctcacca

SEQ ID NO: 170741 - DNA, 25 bp, Homo sapien
ttatgcggatcaaacctcaccaagg

SEQ ID NO: 170742 - DNA, 25 bp, Homo sapien
atgcggatcaaacctcaccaaggcc

SEQ ID NO: 170743 - DNA, 25 bp, Homo sapien
tcaccaaggccagcacataggagag

SEQ ID NO: 170744 - DNA, 25 bp, Homo sapien
caaggccagcacataggagagatga

SEQ ID NO: 170745 - DNA, 25 bp, Homo sapien
ggagagatgagcttcctacagcaca

SEQ ID NO: 170746 - DNA, 25 bp, Homo sapien
gagatgagcttcctacagcacaaca

SEQ ID NO: 170747 - DNA, 25 bp, Homo sapien
gagcttcctacagcacaacaaatgt

SEQ ID NO: 170748 - DNA, 25 bp, Homo sapien
ttccttgagagaaaccgctgtcatt

SEQ ID NO: 170749 - DNA, 25 bp, Homo sapien
tgtgtcactgtctcccggtgctcag

SEQ ID NO: 170750 - DNA, 25 bp, Homo sapien
tttatgatcaatgcaacgacgtggg

SEQ ID NO: 170751 - DNA, 25 bp, Homo sapien
ggcaccatcaccaaaacgtgcaaca

SEQ ID NO: 170752 - DNA, 25 bp, Homo sapien
acgtgcaacaccatgaaccagtttg

SEQ ID NO: 170753 - DNA, 25 bp, Homo sapien
gaacaagttcaatgtcctctacgac

SEQ ID NO: 170754 - DNA, 25 bp, Homo sapien
atgtcctctacgaccgacaaggcat

SEQ ID NO: 170755 - DNA, 25 bp, Homo sapien
gaccgacaaggcatcggcaggagaa

SEQ ID NO: 170756 - DNA, 25 bp, Homo sapien
aatgcgcgggctctttttctgatga

SEQ ID NO: 170757 - DNA, 25 bp, Homo sapien
ggctctttttctgatgagggtactt

SEQ ID NO: 170758 - DNA, 25 bp, Homo sapien
gggagggcactacacttccttgaga

SEQ ID NO: 170759 - DNA, 25 bp, Homo sapien
tttatgcattagtctggtgatttca

SEQ ID NO: 170760 - DNA, 25 bp, Homo sapien
aacattttcatagttctgcctattg

SEQ ID NO: 170761 - DNA, 25 bp, Homo sapien
ttctgcctattgtccttccctgagg

SEQ ID NO: 170762 - DNA, 25 bp, Homo sapien
attgtccttccctgaggctccattg

SEQ ID NO: 170763 - DNA, 25 bp, Homo sapien
aggctccattgctgcttggtggcca

SEQ ID NO: 170764 - DNA, 25 bp, Homo sapien
tctgcctttttacagtcacctgaac

SEQ ID NO: 170765 - DNA, 25 bp, Homo sapien
tcacctgaacaatgacccatcatct

SEQ ID NO: 170766 - DNA, 25 bp, Homo sapien
aaatgttctcatttcctgtttgctg

SEQ ID NO: 170767 - DNA, 25 bp, Homo sapien
atttcctgtttgctgtatgggctcg

SEQ ID NO: 170768 - DNA, 25 bp, Homo sapien
tgttggctctgttgtgtttattcac

SEQ ID NO: 170769 - DNA, 25 bp, Homo sapien
gtgtttattcaccaatttgtacatt

SEQ ID NO: 170770 - DNA, 25 bp, Homo sapien
accggacaccaccagacaataggat

SEQ ID NO: 170771 - DNA, 25 bp, Homo sapien
ccggacaccaccagacaataggatg

SEQ ID NO: 170772 - DNA, 25 bp, Homo sapien
ggacaccaccagacaataggatggg

SEQ ID NO: 170773 - DNA, 25 bp, Homo sapien
acaccaccagacaataggatgggat

SEQ ID NO: 170774 - DNA, 25 bp, Homo sapien
caccagacaataggatgggatggat

SEQ ID NO: 170775 - DNA, 25 bp, Homo sapien
ctggggcgctccctccaattttgca

SEQ ID NO: 170776 - DNA, 25 bp, Homo sapien
gggagttccaagtgtgccctccttt

SEQ ID NO: 170777 - DNA, 25 bp, Homo sapien
gagttccaagtgtgccctccttttt

SEQ ID NO: 170778 - DNA, 25 bp, Homo sapien
aagccatgtgtggaaacccactatt

SEQ ID NO: 170779 - DNA, 25 bp, Homo sapien
gccatgtgtggaaacccactattta

SEQ ID NO: 170780 - DNA, 25 bp, Homo sapien
tgtgtggaaacccactatttaataa

SEQ ID NO: 170781 - DNA, 25 bp, Homo sapien
caggctggcccatatatccacgtaa

SEQ ID NO: 170782 - DNA, 25 bp, Homo sapien
gctggcccatatatccacgtaacag

SEQ ID NO: 170783 - DNA, 25 bp, Homo sapien
ggcccatatatccacgtaacagata

SEQ ID NO: 170784 - DNA, 25 bp, Homo sapien
cgtaacagatacacttctctctttc

SEQ ID NO: 170785 - DNA, 25 bp, Homo sapien
taacagatacacttctctctttctc

SEQ ID NO: 170786 - DNA, 25 bp, Homo sapien
agatacacttctctctttctcattg

SEQ ID NO: 170787 - DNA, 25 bp, Homo sapien
ctctttctcattgttaattcagtaa

SEQ ID NO: 170788 - DNA, 25 bp, Homo sapien
gtaattctaatactgtctgttataa

SEQ ID NO: 170789 - DNA, 25 bp, Homo sapien
ctgtctgttataattaccattttgg

SEQ ID NO: 170790 - DNA, 25 bp, Homo sapien
gttcttttggactaatacaattcag

SEQ ID NO: 170791 - DNA, 25 bp, Homo sapien
tggactaatacaattcaggaaagaa

SEQ ID NO: 170792 - DNA, 25 bp, Homo sapien
ccaccttaactgagcgattaacctg

SEQ ID NO: 170793 - DNA, 25 bp, Homo sapien
aactgagcgattaacctgtgaactt

SEQ ID NO: 170794 - DNA, 25 bp, Homo sapien
gagcgattaacctgtgaacttcctt

SEQ ID NO: 170795 - DNA, 25 bp, Homo sapien
gcgattaacctgtgaacttccttct

SEQ ID NO: 170796 - DNA, 25 bp, Homo sapien
attaacctgtgaacttccttctcct

SEQ ID NO: 170797 - DNA, 25 bp, Homo sapien
acctgtgaacttccttctcctggct

SEQ ID NO: 170798 - DNA, 25 bp, Homo sapien
ccttcgctgacactctctttggact

SEQ ID NO: 170799 - DNA, 25 bp, Homo sapien
cttcgctgacactctctttggactc

SEQ ID NO: 170800 - DNA, 25 bp, Homo sapien
ttcgctgacactctctttggactca

SEQ ID NO: 170801 - DNA, 25 bp, Homo sapien
tcgctgacactctctttggactcag

SEQ ID NO: 170802 - DNA, 25 bp, Homo sapien
cgctgacactctctttggactcagc

SEQ ID NO: 170803 - DNA, 25 bp, Homo sapien
aaatgctgtcataatggtttttaac

SEQ ID NO: 170804 - DNA, 25 bp, Homo sapien
ccttttactcttcttactggtgcta

SEQ ID NO: 170805 - DNA, 25 bp, Homo sapien
actcttcttactggtgctattttgt

SEQ ID NO: 170806 - DNA, 25 bp, Homo sapien
taaggaacaacgttgacaagttttg

SEQ ID NO: 170807 - DNA, 25 bp, Homo sapien
ttttttgtaactggagccacgacgt

SEQ ID NO: 170808 - DNA, 25 bp, Homo sapien
actggagccacgacgtaacaaatat

SEQ ID NO: 170809 - DNA, 25 bp, Homo sapien
gaaaaaactgtgccttgtttcaaca

SEQ ID NO: 170810 - DNA, 25 bp, Homo sapien
cttgtttcaacagtttttgctaatt

SEQ ID NO: 170811 - DNA, 25 bp, Homo sapien
ttttaggctgaaagatgacggatgc

SEQ ID NO: 170812 - DNA, 25 bp, Homo sapien
gacggatgcctagagtttaccttat

SEQ ID NO: 170813 - DNA, 25 bp, Homo sapien
gcctagagtttaccttatgtttaat

SEQ ID NO: 170814 - DNA, 25 bp, Homo sapien
agtgcctcaccttccaacactccat

SEQ ID NO: 170815 - DNA, 25 bp, Homo sapien
caacactccattattcctctcaccc

SEQ ID NO: 170816 - DNA, 25 bp, Homo sapien
actcctgtcagagttgactttcctc

SEQ ID NO: 170817 - DNA, 25 bp, Homo sapien
tgactttcctcccattttaccactt

SEQ ID NO: 170818 - DNA, 25 bp, Homo sapien
taacaattcccccatccttcagtga

SEQ ID NO: 170819 - DNA, 25 bp, Homo sapien
tccttcagtgaactaagtccctata

SEQ ID NO: 170820 - DNA, 25 bp, Homo sapien
ccttcagtgaactaagtccctataa

SEQ ID NO: 170821 - DNA, 25 bp, Homo sapien
cttcagtgaactaagtccctataat

SEQ ID NO: 170822 - DNA, 25 bp, Homo sapien
tcagtgaactaagtccctataataa

SEQ ID NO: 170823 - DNA, 25 bp, Homo sapien
agtgaactaagtccctataataaag

SEQ ID NO: 170824 - DNA, 25 bp, Homo sapien
tgaactaagtccctataataaaggc

SEQ ID NO: 170825 - DNA, 25 bp, Homo sapien
aactgtgaaaacatacatacctgta

SEQ ID NO: 170826 - DNA, 25 bp, Homo sapien
gctgctatatgttgaatggaccctt

SEQ ID NO: 170827 - DNA, 25 bp, Homo sapien
tgaatggacccttttgcttttctga

SEQ ID NO: 170828 - DNA, 25 bp, Homo sapien
tggacccttttgcttttctgatttt

SEQ ID NO: 170829 - DNA, 25 bp, Homo sapien
ttctgatttttagttctgacatgta

SEQ ID NO: 170830 - DNA, 25 bp, Homo sapien
agttctgacatgtatatattgcttc

SEQ ID NO: 170831 - DNA, 25 bp, Homo sapien
tatattgcttcagtagagccacaat

SEQ ID NO: 170832 - DNA, 25 bp, Homo sapien
gagccacaatatgtatctttgctgt

SEQ ID NO: 170833 - DNA, 25 bp, Homo sapien
tttaaattctgggacactgagttag

SEQ ID NO: 170834 - DNA, 25 bp, Homo sapien
gatggtaaatactgacttacgaaag

SEQ ID NO: 170835 - DNA, 25 bp, Homo sapien
acttacgaaagttgaattgggtgag

SEQ ID NO: 170836 - DNA, 25 bp, Homo sapien
catgctgggttactccaaaggaagg

SEQ ID NO: 170837 - DNA, 25 bp, Homo sapien
gccctgtacaaagtgggagctggca

SEQ ID NO: 170838 - DNA, 25 bp, Homo sapien
gcactgggcagatctggctggataa

SEQ ID NO: 170839 - DNA, 25 bp, Homo sapien
cggagagtaccctgtggagctgcac

SEQ ID NO: 170840 - DNA, 25 bp, Homo sapien
taccctgtggagctgcaccaagaat

SEQ ID NO: 170841 - DNA, 25 bp, Homo sapien
atagctggggccatcatgactgcag

SEQ ID NO: 170842 - DNA, 25 bp, Homo sapien
tggagtgcagcgtctgacccggaaa

SEQ ID NO: 170843 - DNA, 25 bp, Homo sapien
tgcagcgtctgacccggaaaccctt

SEQ ID NO: 170844 - DNA, 25 bp, Homo sapien
tttcacttctctgctcccgaggtgt

SEQ ID NO: 170845 - DNA, 25 bp, Homo sapien
gtgtcctcgggctcatatgtgggaa

SEQ ID NO: 170846 - DNA, 25 bp, Homo sapien
cctcgggctcatatgtgggaaggca

SEQ ID NO: 170847 - DNA, 25 bp, Homo sapien
gcgagaagtccttcagaaggctttg

SEQ ID NO: 170848 - DNA, 25 bp, Homo sapien
agtccttcagaaggctttggaggag

SEQ ID NO: 170849 - DNA, 25 bp, Homo sapien
ccgtgaggctaatctagctgctatt

SEQ ID NO: 170850 - DNA, 25 bp, Homo sapien
atctagctgctattattgaacgtct

SEQ ID NO: 170851 - DNA, 25 bp, Homo sapien
gctattattgaacgtctgcaggaaa

SEQ ID NO: 170852 - DNA, 25 bp, Homo sapien
tctgcaggaaaaggagaggcatgct

SEQ ID NO: 170853 - DNA, 25 bp, Homo sapien
gcgcaggaacaaggaactccaggtt

SEQ ID NO: 170854 - DNA, 25 bp, Homo sapien
aaggaactccaggttgaactgtctg

SEQ ID NO: 170855 - DNA, 25 bp, Homo sapien
ggttgaactgtctggctgaagcaag

SEQ ID NO: 170856 - DNA, 25 bp, Homo sapien
caagggagggtctggcacgccccac

SEQ ID NO: 170857 - DNA, 25 bp, Homo sapien
tggcacgccccaccaatagtaaatc

SEQ ID NO: 170858 - DNA, 25 bp, Homo sapien
aggctcatctaagctcccacaattt

SEQ ID NO: 170859 - DNA, 25 bp, Homo sapien
ctaagctcccacaatttcttacggg

SEQ ID NO: 170860 - DNA, 25 bp, Homo sapien
gggccagtcatgtgaagcgtttaca

SEQ ID NO: 170861 - DNA, 25 bp, Homo sapien
gtcatgtgaagcgtttacagcttaa

SEQ ID NO: 170862 - DNA, 25 bp, Homo sapien
aaaagcgcttgcctaactcatactt

SEQ ID NO: 170863 - DNA, 25 bp, Homo sapien
tgcctaactcatactttcccgttga

SEQ ID NO: 170864 - DNA, 25 bp, Homo sapien
tcatactttcccgttgacacttgat

SEQ ID NO: 170865 - DNA, 25 bp, Homo sapien
ttgacacttgatccacgcagcgtgg

SEQ ID NO: 170866 - DNA, 25 bp, Homo sapien
tccacgcagcgtggcactgggacgt

SEQ ID NO: 170867 - DNA, 25 bp, Homo sapien
cactgggacgtaagtggcgcagtct

SEQ ID NO: 170868 - DNA, 25 bp, Homo sapien
aaacgtgcgaagcacaggctgaaga

SEQ ID NO: 170869 - DNA, 25 bp, Homo sapien
aacatcaccatgcagattatgcgga

SEQ ID NO: 170870 - DNA, 25 bp, Homo sapien
catcaccatgcagattatgcggatc

SEQ ID NO: 170871 - DNA, 25 bp, Homo sapien
caaatgtgaatgcagaccaaagaaa

SEQ ID NO: 170872 - DNA, 25 bp, Homo sapien
ccctgtgggccttgctcagagcgga

SEQ ID NO: 170873 - DNA, 25 bp, Homo sapien
gccttgctcagagcggagaaagcat

SEQ ID NO: 170874 - DNA, 25 bp, Homo sapien
aagcatttgtttgtacaagatccgc

SEQ ID NO: 170875 - DNA, 25 bp, Homo sapien
ttgtttgtacaagatccgcagacgt

SEQ ID NO: 170876 - DNA, 25 bp, Homo sapien
gtttgtacaagatccgcagacgtgt

SEQ ID NO: 170877 - DNA, 25 bp, Homo sapien
gtacaagatccgcagacgtgtaaat

SEQ ID NO: 170878 - DNA, 25 bp, Homo sapien
gatccgcagacgtgtaaatgttcct

SEQ ID NO: 170879 - DNA, 25 bp, Homo sapien
gcagacgtgtaaatgttcctgcaaa

SEQ ID NO: 170880 - DNA, 25 bp, Homo sapien
tggaagatggacaccaccggacacc

SEQ ID NO: 170881 - DNA, 25 bp, Homo sapien
accggacaccaccagacaataggat

SEQ ID NO: 170882 - DNA, 25 bp, Homo sapien
acaccaccagacaataggatgggat

SEQ ID NO: 170883 - DNA, 25 bp, Homo sapien
taaggcttgctgtttgttttcctgg

SEQ ID NO: 170884 - DNA, 25 bp, Homo sapien
gctccctccaattttgcagattttt

SEQ ID NO: 170885 - DNA, 25 bp, Homo sapien
tcctgagccgggattgtccaattac

SEQ ID NO: 170886 - DNA, 25 bp, Homo sapien
gggagttccaagtgtgccctccttt

SEQ ID NO: 170887 - DNA, 25 bp, Homo sapien
gagttccaagtgtgccctccttttt

SEQ ID NO: 170888 - DNA, 25 bp, Homo sapien
ttcctgcctggattatttaaaaagc

SEQ ID NO: 170889 - DNA, 25 bp, Homo sapien
aagccatgtgtggaaacccactatt

SEQ ID NO: 170890 - DNA, 25 bp, Homo sapien
tgtgtggaaacccactatttaataa

SEQ ID NO: 170891 - DNA, 25 bp, Homo sapien
cagcaaaggcaggaaacttcggttt

SEQ ID NO: 170892 - DNA, 25 bp, Homo sapien
aacttcggtttcatgtccttagcaa

SEQ ID NO: 170893 - DNA, 25 bp, Homo sapien
gtttcatgtccttagcaagctactg

SEQ ID NO: 170894 - DNA, 25 bp, Homo sapien
aagctactgagtttcatggcaccta

SEQ ID NO: 170895 - DNA, 25 bp, Homo sapien
tggcacctattgaccatactacaat

SEQ ID NO: 170896 - DNA, 25 bp, Homo sapien
gatgatgccaggacagaactgtacc

SEQ ID NO: 170897 - DNA, 25 bp, Homo sapien
agaactgtaccgctctctttttggc

SEQ ID NO: 170898 - DNA, 25 bp, Homo sapien
tgagctagtagggaagcccctggaa

SEQ ID NO: 170899 - DNA, 25 bp, Homo sapien
gaagcccctggaaagatgctgcgtt

SEQ ID NO: 170900 - DNA, 25 bp, Homo sapien
gaaagatgctgcgttccgaacctgt

SEQ ID NO: 170901 - DNA, 25 bp, Homo sapien
gcgttccgaacctgtgcctaataca

SEQ ID NO: 170902 - DNA, 25 bp, Homo sapien
aaactgaggatccatgatacatgtg

SEQ ID NO: 170903 - DNA, 25 bp, Homo sapien
atacatgtggggtccataacctcca

SEQ ID NO: 170904 - DNA, 25 bp, Homo sapien
ccacggcttacctggtgtagtggga

SEQ ID NO: 170905 - DNA, 25 bp, Homo sapien
ggtgtagtgggaggccttgcaggca

SEQ ID NO: 170906 - DNA, 25 bp, Homo sapien
gccttgcaggcattgtggcagtagc

SEQ ID NO: 170907 - DNA, 25 bp, Homo sapien
attgtggcagtagcaatgggcgcct

SEQ ID NO: 170908 - DNA, 25 bp, Homo sapien
ggcagtagcaatgggcgcctccaac

SEQ ID NO: 170909 - DNA, 25 bp, Homo sapien
tacaagttcctgactccacttttta

SEQ ID NO: 170910 - DNA, 25 bp, Homo sapien
tcctgactccactttttactactaa

SEQ ID NO: 170911 - DNA, 25 bp, Homo sapien
gactccactttttactactaaactg

SEQ ID NO: 170912 - DNA, 25 bp, Homo sapien
tttactactaaactgaggatccatg

SEQ ID NO: 170913 - DNA, 25 bp, Homo sapien
aaggaagacagccagatccagtgat

SEQ ID NO: 170914 - DNA, 25 bp, Homo sapien
gacagccagatccagtgattgactt

SEQ ID NO: 170915 - DNA, 25 bp, Homo sapien
ccagtgattgacttggcatgaaaat

SEQ ID NO: 170916 - DNA, 25 bp, Homo sapien
acattcaacaacatccatacagcac

SEQ ID NO: 170917 - DNA, 25 bp, Homo sapien
acaacatccatacagcactgctgga

SEQ ID NO: 170918 - DNA, 25 bp, Homo sapien
aggaagatttgtgcagaccaagagc

SEQ ID NO: 170919 - DNA, 25 bp, Homo sapien
agaccaagagcaccacagactacaa

SEQ ID NO: 170920 - DNA, 25 bp, Homo sapien
acagactacaactgcccagcttcat

SEQ ID NO: 170921 - DNA, 25 bp, Homo sapien
aactgcccagcttcatctaaatact

SEQ ID NO: 170922 - DNA, 25 bp, Homo sapien
gcccagcttcatctaaatacttgtt

SEQ ID NO: 170923 - DNA, 25 bp, Homo sapien
aatacttgttaacctctttggtcat

SEQ ID NO: 170924 - DNA, 25 bp, Homo sapien
gggccgcccatgcagacttttggcc

SEQ ID NO: 170925 - DNA, 25 bp, Homo sapien
ggccgcccatgcagacttttggcct

SEQ ID NO: 170926 - DNA, 25 bp, Homo sapien
ccgcccatgcagacttttggcctgg

SEQ ID NO: 170927 - DNA, 25 bp, Homo sapien
gcccatgcagacttttggcctggcg

SEQ ID NO: 170928 - DNA, 25 bp, Homo sapien
ccatgcagacttttggcctggcgcg

SEQ ID NO: 170929 - DNA, 25 bp, Homo sapien
catgcagacttttggcctggcgcga

SEQ ID NO: 170930 - DNA, 25 bp, Homo sapien
atgcagacttttggcctggcgcgat

SEQ ID NO: 170931 - DNA, 25 bp, Homo sapien
cagacttttggcctggcgcgatccc

SEQ ID NO: 170932 - DNA, 25 bp, Homo sapien
agacttttggcctggcgcgatcccc

SEQ ID NO: 170933 - DNA, 25 bp, Homo sapien
tccagggccggcctgcggaggagcc

SEQ ID NO: 170934 - DNA, 25 bp, Homo sapien
tgcggaggagccgatcctcgcaccc

SEQ ID NO: 170935 - DNA, 25 bp, Homo sapien
ggactacaggagatgctgtcactta

SEQ ID NO: 170936 - DNA, 25 bp, Homo sapien
atgctgtcacttaataatcaacctg

SEQ ID NO: 170937 - DNA, 25 bp, Homo sapien
gttcgaaatcagtgagacctggatt

SEQ ID NO: 170938 - DNA, 25 bp, Homo sapien
gtgactctgggaatgacaacacctg

SEQ ID NO: 170939 - DNA, 25 bp, Homo sapien
atgacaacacctggtttgttctctg

SEQ ID NO: 170940 - DNA, 25 bp, Homo sapien
aaagacagctcctggccatatatca

SEQ ID NO: 170941 - DNA, 25 bp, Homo sapien
agaacaattagactggacccaccca

SEQ ID NO: 170942 - DNA, 25 bp, Homo sapien
atttccacttggtgtttggttcctg

SEQ ID NO: 170943 - DNA, 25 bp, Homo sapien
ttcctgttcactctgttaataagaa

SEQ ID NO: 170944 - DNA, 25 bp, Homo sapien
aagaccctctacgaacattctttgg

SEQ ID NO: 170945 - DNA, 25 bp, Homo sapien
attctttgggcctcctggactacag

SEQ ID NO: 170946 - DNA, 25 bp, Homo sapien
ttctcttctgtcttgtttggtaata

SEQ ID NO: 170947 - DNA, 25 bp, Homo sapien
ctcttctgtcttgtttggtaataaa

SEQ ID NO: 170948 - DNA, 25 bp, Homo sapien
gtcttgtttggtaataaacacattc

SEQ ID NO: 170949 - DNA, 25 bp, Homo sapien
tgtaacaagaatggactgtggtatc

SEQ ID NO: 170950 - DNA, 25 bp, Homo sapien
gagtgggctgtggtcggcccaatcg

SEQ ID NO: 170951 - DNA, 25 bp, Homo sapien
tggtcggcccaatcggcccggtgtc

SEQ ID NO: 170952 - DNA, 25 bp, Homo sapien
gtgtctacaccaatatcagccacca

SEQ ID NO: 170953 - DNA, 25 bp, Homo sapien
accaatatcagccaccactttgagt

SEQ ID NO: 170954 - DNA, 25 bp, Homo sapien
cactttgagtggatccagaagctga

SEQ ID NO: 170955 - DNA, 25 bp, Homo sapien
tccagaagctgatggcccagagtgg

SEQ ID NO: 170956 - DNA, 25 bp, Homo sapien
gggccggtctgagcctacctgagcc

SEQ ID NO: 170957 - DNA, 25 bp, Homo sapien
ggtgcggagcctgagacacaacaac

SEQ ID NO: 170958 - DNA, 25 bp, Homo sapien
ctgagacacaacaaccggcggctgc

SEQ ID NO: 170959 - DNA, 25 bp, Homo sapien
gcggagtctgagagtgcagccacac

SEQ ID NO: 170960 - DNA, 25 bp, Homo sapien
agtctgagagtgcagccacacgcct

SEQ ID NO: 170961 - DNA, 25 bp, Homo sapien
cgacctggcctgagccgtctggaac

SEQ ID NO: 170962 - DNA, 25 bp, Homo sapien
tgagccgtctggaaccacctgggcc

SEQ ID NO: 170963 - DNA, 25 bp, Homo sapien
tgtggtcacactgggccctcctcag

SEQ ID NO: 170964 - DNA, 25 bp, Homo sapien
ctgcgcagaggcgtgtcttagcact

SEQ ID NO: 170965 - DNA, 25 bp, Homo sapien
cgcagaggcgtgtcttagcactgcc

SEQ ID NO: 170966 - DNA, 25 bp, Homo sapien
tagcccccttatttggtggcggaag

SEQ ID NO: 170967 - DNA, 25 bp, Homo sapien
atttggtggcggaagtggcctccac

SEQ ID NO: 170968 - DNA, 25 bp, Homo sapien
gattctgatgactcgttttttcttc

SEQ ID NO: 170969 - DNA, 25 bp, Homo sapien
ggaagaagttgagtttgccggcata

SEQ ID NO: 170970 - DNA, 25 bp, Homo sapien
aagaagttgagtttgccggcatagc

SEQ ID NO: 170971 - DNA, 25 bp, Homo sapien
gaagttgagtttgccggcatagccc

SEQ ID NO: 170972 - DNA, 25 bp, Homo sapien
tgagtttgccggcatagccccggtc

SEQ ID NO: 170973 - DNA, 25 bp, Homo sapien
agtttgccggcatagccccggtcct

SEQ ID NO: 170974 - DNA, 25 bp, Homo sapien
tctctcctcggcagcagcgggaggc

SEQ ID NO: 170975 - DNA, 25 bp, Homo sapien
agatgaagagctttcccatccaggg

SEQ ID NO: 170976 - DNA, 25 bp, Homo sapien
ttttaagaacccacctcttgtgctc

SEQ ID NO: 170977 - DNA, 25 bp, Homo sapien
ggacagtggaggatccaggtcttgg

SEQ ID NO: 170978 - DNA, 25 bp, Homo sapien
ccaggtcttggggagctcaggactt

SEQ ID NO: 170979 - DNA, 25 bp, Homo sapien
tcttgctggtctgtgtgacaacggc

SEQ ID NO: 170980 - DNA, 25 bp, Homo sapien
tgctggtctgtgtgacaacggctat

SEQ ID NO: 170981 - DNA, 25 bp, Homo sapien
ctggtctgtgtgacaacggctatat

SEQ ID NO: 170982 - DNA, 25 bp, Homo sapien
gtctgtgtgacaacggctatatttt

SEQ ID NO: 170983 - DNA, 25 bp, Homo sapien
acaacggctatatttttggtcatac

SEQ ID NO: 170984 - DNA, 25 bp, Homo sapien
aacggctatatttttggtcatacaa

SEQ ID NO: 170985 - DNA, 25 bp, Homo sapien
ggctatatttttggtcatacaatgt

SEQ ID NO: 170986 - DNA, 25 bp, Homo sapien
atttttggtcatacaatgttgtttg

SEQ ID NO: 170987 - DNA, 25 bp, Homo sapien
tcctgagtagtggaagtcctattaa

SEQ ID NO: 170988 - DNA, 25 bp, Homo sapien
gtagtggaagtcctattaattccag

SEQ ID NO: 170989 - DNA, 25 bp, Homo sapien
tattaattccagacaaaagggagtt

SEQ ID NO: 170990 - DNA, 25 bp, Homo sapien
ttctcttgtcatctctgtacactac

SEQ ID NO: 170991 - DNA, 25 bp, Homo sapien
gtcatctctgtacactacttatatt

SEQ ID NO: 170992 - DNA, 25 bp, Homo sapien
actacttatattcactgtgggttgg

SEQ ID NO: 170993 - DNA, 25 bp, Homo sapien
gggagctaattttaagcatgttcag

SEQ ID NO: 170994 - DNA, 25 bp, Homo sapien
taagcatgttcagtggcagctcccc

SEQ ID NO: 170995 - DNA, 25 bp, Homo sapien
ggcagctcccctccagtttcagtgt

SEQ ID NO: 170996 - DNA, 25 bp, Homo sapien
cagtgtcactgttaaaatttatcaa

SEQ ID NO: 170997 - DNA, 25 bp, Homo sapien
gataaaggccttttacagaagctaa

SEQ ID NO: 170998 - DNA, 25 bp, Homo sapien
taaacccttccccacatgtggtaga

SEQ ID NO: 170999 - DNA, 25 bp, Homo sapien
acatgtggtagaatgtgctcttcta

SEQ ID NO: 171000 - DNA, 25 bp, Homo sapien
agaatgtgctcttctatatctactc

SEQ ID NO: 171001 - DNA, 25 bp, Homo sapien
taaagccacttcatataggacttaa

SEQ ID NO: 171002 - DNA, 25 bp, Homo sapien
aaatagccaagaggcccagaaatct

SEQ ID NO: 171003 - DNA, 25 bp, Homo sapien
gaggcccagaaatctaaagatcttt

SEQ ID NO: 171004 - DNA, 25 bp, Homo sapien
aagatctttgttctataactgtaag

SEQ ID NO: 171005 - DNA, 25 bp, Homo sapien
aagagatccctaatatgcctcctga

SEQ ID NO: 171006 - DNA, 25 bp, Homo sapien
aatatgcctcctgaaatgcagctta

SEQ ID NO: 171007 - DNA, 25 bp, Homo sapien
gcagcttaaggtcctgcattcagct

SEQ ID NO: 171008 - DNA, 25 bp, Homo sapien
gcattcagctcttttcacatttgat

SEQ ID NO: 171009 - DNA, 25 bp, Homo sapien
ttgaaagtgttctagctcgagtgga

SEQ ID NO: 171010 - DNA, 25 bp, Homo sapien
tctagctcgagtggaagaactcatt

SEQ ID NO: 171011 - DNA, 25 bp, Homo sapien
ataaaaacaaagtctacctctgaag

SEQ ID NO: 171012 - DNA, 25 bp, Homo sapien
acctgtttcttctacaagatcccta

SEQ ID NO: 171013 - DNA, 25 bp, Homo sapien
aagatccctatttgactgtaaaagt

SEQ ID NO: 171014 - DNA, 25 bp, Homo sapien
gtagctaatactcacatgttctcca

SEQ ID NO: 171015 - DNA, 25 bp, Homo sapien
tcacatgttctccaatcccaggtag

SEQ ID NO: 171016 - DNA, 25 bp, Homo sapien
caatcccaggtagccatggtagagt

SEQ ID NO: 171017 - DNA, 25 bp, Homo sapien
aggatccaaatgtggtgtctgaaat

SEQ ID NO: 171018 - DNA, 25 bp, Homo sapien
gaactaaggcaaccaggaaggcact

SEQ ID NO: 171019 - DNA, 25 bp, Homo sapien
gaaggcactgatctgccttataagc

SEQ ID NO: 171020 - DNA, 25 bp, Homo sapien
tgccttataagcacagtcatctgaa

SEQ ID NO: 171021 - DNA, 25 bp, Homo sapien
gtcatctgaaagtcaggcctgctgc

SEQ ID NO: 171022 - DNA, 25 bp, Homo sapien
atttgcctctcaacactcagacctt

SEQ ID NO: 171023 - DNA, 25 bp, Homo sapien
agctctgcgttccattggcttgaaa

SEQ ID NO: 171024 - DNA, 25 bp, Homo sapien
gctctgcgttccattggcttgaaat

SEQ ID NO: 171025 - DNA, 25 bp, Homo sapien
tctgcgttccattggcttgaaatgc

SEQ ID NO: 171026 - DNA, 25 bp, Homo sapien
gcgttccattggcttgaaatgcctg

SEQ ID NO: 171027 - DNA, 25 bp, Homo sapien
gttccattggcttgaaatgcctgga

SEQ ID NO: 171028 - DNA, 25 bp, Homo sapien
cattggcttgaaatgcctggagcac

SEQ ID NO: 171029 - DNA, 25 bp, Homo sapien
ttggcttgaaatgcctggagcacct

SEQ ID NO: 171030 - DNA, 25 bp, Homo sapien
gagatgttggagaccccgctgcaga

SEQ ID NO: 171031 - DNA, 25 bp, Homo sapien
agatgttggagaccccgctgcagat

SEQ ID NO: 171032 - DNA, 25 bp, Homo sapien
ttggagaccccgctgcagatcacct

SEQ ID NO: 171033 - DNA, 25 bp, Homo sapien
aggatgacccctgggcaggtgtgtg

SEQ ID NO: 171034 - DNA, 25 bp, Homo sapien
tggaggaccagattgctctgcccca

SEQ ID NO: 171035 - DNA, 25 bp, Homo sapien
cccaccttgccagggcagggtctgg

SEQ ID NO: 171036 - DNA, 25 bp, Homo sapien
tctgggctgggcacctgacttggct

SEQ ID NO: 171037 - DNA, 25 bp, Homo sapien
ggcagcctgtcacccgtgtgaagat

SEQ ID NO: 171038 - DNA, 25 bp, Homo sapien
agcctgtcacccgtgtgaagatgaa

SEQ ID NO: 171039 - DNA, 25 bp, Homo sapien
cctgtcacccgtgtgaagatgaagg

SEQ ID NO: 171040 - DNA, 25 bp, Homo sapien
atctgcctgcgctctcgtcggtttt

SEQ ID NO: 171041 - DNA, 25 bp, Homo sapien
gcgctctcgtcggtttttttaggat

SEQ ID NO: 171042 - DNA, 25 bp, Homo sapien
attgaaagagtctgggacccttgtt

SEQ ID NO: 171043 - DNA, 25 bp, Homo sapien
tgggctgctggccatgaatctctgc

SEQ ID NO: 171044 - DNA, 25 bp, Homo sapien
ctgctggccatgaatctctgcctct

SEQ ID NO: 171045 - DNA, 25 bp, Homo sapien
aagagggcttgcttagggcagcttc

SEQ ID NO: 171046 - DNA, 25 bp, Homo sapien
agggcttgcttagggcagcttcttg

SEQ ID NO: 171047 - DNA, 25 bp, Homo sapien
agggcagcttcttgctgctcagcag

SEQ ID NO: 171048 - DNA, 25 bp, Homo sapien
cagcagaccatgacctgtaggttca

SEQ ID NO: 171049 - DNA, 25 bp, Homo sapien
gaccatgacctgtaggttcacctat

SEQ ID NO: 171050 - DNA, 25 bp, Homo sapien
gacctgtaggttcacctataaaaca

SEQ ID NO: 171051 - DNA, 25 bp, Homo sapien
attgaataaccatctaccccattag

SEQ ID NO: 171052 - DNA, 25 bp, Homo sapien
atctaccccattagtcagcattttc

SEQ ID NO: 171053 - DNA, 25 bp, Homo sapien
taccccattagtcagcattttcttg

SEQ ID NO: 171054 - DNA, 25 bp, Homo sapien
gtcagcattttcttgagatacattt

SEQ ID NO: 171055 - DNA, 25 bp, Homo sapien
tcattctctctctagtaattgtaat

SEQ ID NO: 171056 - DNA, 25 bp, Homo sapien
ctcattgggaggacggacttccgcg

SEQ ID NO: 171057 - DNA, 25 bp, Homo sapien
gcgatggctccattgctgtataggg

SEQ ID NO: 171058 - DNA, 25 bp, Homo sapien
ctccattgctgtatagggccttgtg

SEQ ID NO: 171059 - DNA, 25 bp, Homo sapien
gtttggagtctcatcattgcttgcc

SEQ ID NO: 171060 - DNA, 25 bp, Homo sapien
gcctatcccatgaggcccagtgact

SEQ ID NO: 171061 - DNA, 25 bp, Homo sapien
tgactccacaacctccctgaggagg

SEQ ID NO: 171062 - DNA, 25 bp, Homo sapien
ggtcaaatctcagagaggctctctt

SEQ ID NO: 171063 - DNA, 25 bp, Homo sapien
agaggctctcttgtgagctcttgga

SEQ ID NO: 171064 - DNA, 25 bp, Homo sapien
tcacggacccaactgtgccgtttgt

SEQ ID NO: 171065 - DNA, 25 bp, Homo sapien
tgtcccctctcttatggagactgaa

SEQ ID NO: 171066 - DNA, 25 bp, Homo sapien
gagactgaataaaccacctctggcc

SEQ ID NO: 171067 - DNA, 25 bp, Homo sapien
atcacttcatatatcacgtgctgta

SEQ ID NO: 171068 - DNA, 25 bp, Homo sapien
aagaactagctgaagagacaaccaa

SEQ ID NO: 171069 - DNA, 25 bp, Homo sapien
gcaggttgatgctgatgggaccata

SEQ ID NO: 171070 - DNA, 25 bp, Homo sapien
aaatatttttacacgcagcctgagc

SEQ ID NO: 171071 - DNA, 25 bp, Homo sapien
gcagcctgagcggttattcttgaca

SEQ ID NO: 171072 - DNA, 25 bp, Homo sapien
gagcggttattcttgacactcttaa

SEQ ID NO: 171073 - DNA, 25 bp, Homo sapien
tgcaaatgcactgaaagggtagttc

SEQ ID NO: 171074 - DNA, 25 bp, Homo sapien
gggtagttcaagtctaaaatgccat

SEQ ID NO: 171075 - DNA, 25 bp, Homo sapien
ttgatttgccataagtcttcccttg

SEQ ID NO: 171076 - DNA, 25 bp, Homo sapien
ataagtcttcccttgcttgcatctt

SEQ ID NO: 171077 - DNA, 25 bp, Homo sapien
ttgcttgcatcttccaaagctattt

SEQ ID NO: 171078 - DNA, 25 bp, Homo sapien
gccaacgagctggatgccttcgctg

SEQ ID NO: 171079 - DNA, 25 bp, Homo sapien
aacgagctggatgccttcgctgtgc

SEQ ID NO: 171080 - DNA, 25 bp, Homo sapien
tggatgccttcgctgtgcacggctt

SEQ ID NO: 171081 - DNA, 25 bp, Homo sapien
tgcacggcttccctactctcaagta

SEQ ID NO: 171082 - DNA, 25 bp, Homo sapien
tactctcaagtacttcccagcaggg

SEQ ID NO: 171083 - DNA, 25 bp, Homo sapien
gccaggtcggaaggtgattgaatac

SEQ ID NO: 171084 - DNA, 25 bp, Homo sapien
tgaatacaaaagcaccagggacctg

SEQ ID NO: 171085 - DNA, 25 bp, Homo sapien
gcaccagggacctggagactttctc

SEQ ID NO: 171086 - DNA, 25 bp, Homo sapien
ggacctggagactttctccaagttc

SEQ ID NO: 171087 - DNA, 25 bp, Homo sapien
ggccaactccactatggggtccaag

SEQ ID NO: 171088 - DNA, 25 bp, Homo sapien
tggacaggagccacccccttgggta

SEQ ID NO: 171089 - DNA, 25 bp, Homo sapien
ggaagaagttgagtttgccggcata

SEQ ID NO: 171090 - DNA, 25 bp, Homo sapien
aagaagttgagtttgccggcatagc

SEQ ID NO: 171091 - DNA, 25 bp, Homo sapien
gaagttgagtttgccggcatagccc

SEQ ID NO: 171092 - DNA, 25 bp, Homo sapien
tgagtttgccggcatagccccggtc

SEQ ID NO: 171093 - DNA, 25 bp, Homo sapien
agtttgccggcatagccccggtcct

SEQ ID NO: 171094 - DNA, 25 bp, Homo sapien
tctctctcctcggcagcagcgggag

SEQ ID NO: 171095 - DNA, 25 bp, Homo sapien
gaggcagaggaaggcggcagaagat

SEQ ID NO: 171096 - DNA, 25 bp, Homo sapien
ttttaagaacccacctcttgtgctc

SEQ ID NO: 171097 - DNA, 25 bp, Homo sapien
tttaagaacccacctcttgtgctcc

SEQ ID NO: 171098 - DNA, 25 bp, Homo sapien
ggacagtggaggatccaggtcttgg

SEQ ID NO: 171099 - DNA, 25 bp, Homo sapien
ccaggtcttggggagctcaggactt

SEQ ID NO: 171100 - DNA, 25 bp, Homo sapien
gatccaagagtttagtgatttcaaa

SEQ ID NO: 171101 - DNA, 25 bp, Homo sapien
aaagccttggtctcaggagaagatt

SEQ ID NO: 171102 - DNA, 25 bp, Homo sapien
aaactttcatattgggcagtggttc

SEQ ID NO: 171103 - DNA, 25 bp, Homo sapien
gcagtggttcactttaaaacacaca

SEQ ID NO: 171104 - DNA, 25 bp, Homo sapien
gtaacatacccaaaatgctctgtct

SEQ ID NO: 171105 - DNA, 25 bp, Homo sapien
aaatgctctgtcttgagtcatgaga

SEQ ID NO: 171106 - DNA, 25 bp, Homo sapien
gagtcatgagaaccatcagttcttg

SEQ ID NO: 171107 - DNA, 25 bp, Homo sapien
agttcttgatattgtctagacttgc

SEQ ID NO: 171108 - DNA, 25 bp, Homo sapien
gacttgcatctagagctacgttgta

SEQ ID NO: 171109 - DNA, 25 bp, Homo sapien
gagctacgttgtaaaattcttttag

SEQ ID NO: 171110 - DNA, 25 bp, Homo sapien
gcatgtgttagatttctgtgtaaac

SEQ ID NO: 171111 - DNA, 25 bp, Homo sapien
aatcactcagctggaatgtctgctc

SEQ ID NO: 171112 - DNA, 25 bp, Homo sapien
agctggaatgtctgctctctattgg

SEQ ID NO: 171113 - DNA, 25 bp, Homo sapien
aatgtctgctctctattggtgcctt

SEQ ID NO: 171114 - DNA, 25 bp, Homo sapien
ctctctattggtgccttgcatttca

SEQ ID NO: 171115 - DNA, 25 bp, Homo sapien
aatacttcctatttgagcccatgtg

SEQ ID NO: 171116 - DNA, 25 bp, Homo sapien
cctatttgagcccatgtgtggaaga

SEQ ID NO: 171117 - DNA, 25 bp, Homo sapien
aatttaactgtacatttctttatgg

SEQ ID NO: 171118 - DNA, 25 bp, Homo sapien
ggaaattgattatctacactcagtt

SEQ ID NO: 171119 - DNA, 25 bp, Homo sapien
tctacactcagtttcattacaggga

SEQ ID NO: 171120 - DNA, 25 bp, Homo sapien
ttcattacagggaaggaacccatga

SEQ ID NO: 171121 - DNA, 25 bp, Homo sapien
gaaaacatcagtgttaagagcatga

SEQ ID NO: 171122 - DNA, 25 bp, Homo sapien
gaatatatattgaccctgaaatcct

SEQ ID NO: 171123 - DNA, 25 bp, Homo sapien
tatattgaccctgaaatcctagaaa

SEQ ID NO: 171124 - DNA, 25 bp, Homo sapien
gaccctgaaatcctagaaaaaactg

SEQ ID NO: 171125 - DNA, 25 bp, Homo sapien
aactggagtggctgaatataaaaac

SEQ ID NO: 171126 - DNA, 25 bp, Homo sapien
gtttaaatgtagtccatcatccttc

SEQ ID NO: 171127 - DNA, 25 bp, Homo sapien
tcttgagttacgctgtttccttttt

SEQ ID NO: 171128 - DNA, 25 bp, Homo sapien
gagttacgctgtttcctttttgcta

SEQ ID NO: 171129 - DNA, 25 bp, Homo sapien
acgctgtttcctttttgctacagga

SEQ ID NO: 171130 - DNA, 25 bp, Homo sapien
ctttttgctacaggaaagcccagaa

SEQ ID NO: 171131 - DNA, 25 bp, Homo sapien
gaagtagtgttcatcattcttccat

SEQ ID NO: 171132 - DNA, 25 bp, Homo sapien
gggcataaactgcaacaatcaatat

SEQ ID NO: 171133 - DNA, 25 bp, Homo sapien
aggtatggggcggcaaaacctatca

SEQ ID NO: 171134 - DNA, 25 bp, Homo sapien
aatggaacttgctcgggttcaatta

SEQ ID NO: 171135 - DNA, 25 bp, Homo sapien
atggaacttgctcgggttcaattaa

SEQ ID NO: 171136 - DNA, 25 bp, Homo sapien
tggaacttgctcgggttcaattaaa

SEQ ID NO: 171137 - DNA, 25 bp, Homo sapien
gaacttgctcgggttcaattaaagg

SEQ ID NO: 171138 - DNA, 25 bp, Homo sapien
acttgctcgggttcaattaaaggca

SEQ ID NO: 171139 - DNA, 25 bp, Homo sapien
gtaaattcattatgatcaacagacc

SEQ ID NO: 171140 - DNA, 25 bp, Homo sapien
taaattcattatgatcaacagacct

SEQ ID NO: 171141 - DNA, 25 bp, Homo sapien
aaattcattatgatcaacagacctc

SEQ ID NO: 171142 - DNA, 25 bp, Homo sapien
aattcattatgatcaacagacctca

SEQ ID NO: 171143 - DNA, 25 bp, Homo sapien
attcattatgatcaacagacctcac

SEQ ID NO: 171144 - DNA, 25 bp, Homo sapien
accaattgtgaaacctaaggaagct

SEQ ID NO: 171145 - DNA, 25 bp, Homo sapien
aggaagcttctactgaaactaaaat

SEQ ID NO: 171146 - DNA, 25 bp, Homo sapien
actgaaactaaaattgatgtggcca

SEQ ID NO: 171147 - DNA, 25 bp, Homo sapien
agaataagaaactgggagctcttac

SEQ ID NO: 171148 - DNA, 25 bp, Homo sapien
caccacaaccagaaagtcagatcga

SEQ ID NO: 171149 - DNA, 25 bp, Homo sapien
acaaccagaaagtcagatcgataaa

SEQ ID NO: 171150 - DNA, 25 bp, Homo sapien
gatcgataaagaattggctagtggt

SEQ ID NO: 171151 - DNA, 25 bp, Homo sapien
gaattggctagtggtgaatactttt

SEQ ID NO: 171152 - DNA, 25 bp, Homo sapien
agtggtgaatactttttgaaggcaa

SEQ ID NO: 171153 - DNA, 25 bp, Homo sapien
acaagcagaagccatcagtaagaga

SEQ ID NO: 171154 - DNA, 25 bp, Homo sapien
gaagccatcagtaagagacaagagg

SEQ ID NO: 171155 - DNA, 25 bp, Homo sapien
tcagtgacctggatctgacctcaca

SEQ ID NO: 171156 - DNA, 25 bp, Homo sapien
accatgcacacctgtctcggagtag

SEQ ID NO: 171157 - DNA, 25 bp, Homo sapien
acacctgtctcggagtaggcagctc

SEQ ID NO: 171158 - DNA, 25 bp, Homo sapien
tgtgcttagttactggttttctcca

SEQ ID NO: 171159 - DNA, 25 bp, Homo sapien
gttactggttttctccattgcattg

SEQ ID NO: 171160 - DNA, 25 bp, Homo sapien
cattgcattgttaggcatggtgaca

SEQ ID NO: 171161 - DNA, 25 bp, Homo sapien
gcatggtgacaagtgacagagttct

SEQ ID NO: 171162 - DNA, 25 bp, Homo sapien
agagttcttgccctctgtccagttt

SEQ ID NO: 171163 - DNA, 25 bp, Homo sapien
tgtccagtttcagcatctggttgct

SEQ ID NO: 171164 - DNA, 25 bp, Homo sapien
agtttcagcatctggttgcttttaa

SEQ ID NO: 171165 - DNA, 25 bp, Homo sapien
aagccaagtacatctagtttcccta

SEQ ID NO: 171166 - DNA, 25 bp, Homo sapien
actaacgtgggatcctcagggcgct

SEQ ID NO: 171167 - DNA, 25 bp, Homo sapien
cgggatccactgtccggcagaggaa

SEQ ID NO: 171168 - DNA, 25 bp, Homo sapien
acaaggagtgcaggccgcacaacct

SEQ ID NO: 171169 - DNA, 25 bp, Homo sapien
gggatgtggcgattctacacagaag

SEQ ID NO: 171170 - DNA, 25 bp, Homo sapien
tacacagaagattcacctgggctca

SEQ ID NO: 171171 - DNA, 25 bp, Homo sapien
acctgggctcaaagttggccctgtt

SEQ ID NO: 171172 - DNA, 25 bp, Homo sapien
ttggccctgttccagtattggttat

SEQ ID NO: 171173 - DNA, 25 bp, Homo sapien
gttatgagtcttctgttcatcgctt

SEQ ID NO: 171174 - DNA, 25 bp, Homo sapien
atcgcttctgtatttatgttgcaca

SEQ ID NO: 171175 - DNA, 25 bp, Homo sapien
gggcaagtacactcgttcgtagatt

SEQ ID NO: 171176 - DNA, 25 bp, Homo sapien
acactcgttcgtagattcagttaca

SEQ ID NO: 171177 - DNA, 25 bp, Homo sapien
cctggacaacagcgagagctccatc

SEQ ID NO: 171178 - DNA, 25 bp, Homo sapien
atgtttgcaaatgtcgatgttgaga

SEQ ID NO: 171179 - DNA, 25 bp, Homo sapien
tgtttgcaaatgtcgatgttgagaa

SEQ ID NO: 171180 - DNA, 25 bp, Homo sapien
gtttgcaaatgtcgatgttgagaat

SEQ ID NO: 171181 - DNA, 25 bp, Homo sapien
tttgcaaatgtcgatgttgagaatg

SEQ ID NO: 171182 - DNA, 25 bp, Homo sapien
tgcaaatgtcgatgttgagaatggt

SEQ ID NO: 171183 - DNA, 25 bp, Homo sapien
gcaaatgtcgatgttgagaatggta

SEQ ID NO: 171184 - DNA, 25 bp, Homo sapien
caaatgtcgatgttgagaatggtat

SEQ ID NO: 171185 - DNA, 25 bp, Homo sapien
aaatgtcgatgttgagaatggtatt

SEQ ID NO: 171186 - DNA, 25 bp, Homo sapien
aatgtcgatgttgagaatggtattt

SEQ ID NO: 171187 - DNA, 25 bp, Homo sapien
atgtcgatgttgagaatggtatttc

SEQ ID NO: 171188 - DNA, 25 bp, Homo sapien
aaatgggttcaccatctcaagggaa

SEQ ID NO: 171189 - DNA, 25 bp, Homo sapien
gaggctccagcagcatattgtaccg

SEQ ID NO: 171190 - DNA, 25 bp, Homo sapien
taccgctacccctttgaaaggctga

SEQ ID NO: 171191 - DNA, 25 bp, Homo sapien
gatggcatccgaaatctatacttgg

SEQ ID NO: 171192 - DNA, 25 bp, Homo sapien
atacttggattttggtggtcccgag

SEQ ID NO: 171193 - DNA, 25 bp, Homo sapien
ggagaactgaccatggacctgcact

SEQ ID NO: 171194 - DNA, 25 bp, Homo sapien
gcactcttgtccgaagccgattgta

SEQ ID NO: 171195 - DNA, 25 bp, Homo sapien
agccgattgtatttgtgttgcacac

SEQ ID NO: 171196 - DNA, 25 bp, Homo sapien
gtgttgcacacgtttttatcggcca

SEQ ID NO: 171197 - DNA, 25 bp, Homo sapien
ttttatcggccaaagtcactcgtat

SEQ ID NO: 171198 - DNA, 25 bp, Homo sapien
tcactcgtatgggactgcttgtatg

SEQ ID NO: 171199 - DNA, 25 bp, Homo sapien
gcagtgacccatgcgtgccgcctgc

SEQ ID NO: 171200 - DNA, 25 bp, Homo sapien
agtgacccatgcgtgccgcctgctc

SEQ ID NO: 171201 - DNA, 25 bp, Homo sapien
gcctgctcctcactggaggagcagc

SEQ ID NO: 171202 - DNA, 25 bp, Homo sapien
ctgctcctcactggaggagcagctt

SEQ ID NO: 171203 - DNA, 25 bp, Homo sapien
ttctgggactggacagctttgctcc

SEQ ID NO: 171204 - DNA, 25 bp, Homo sapien
tctgggactggacagctttgctccg

SEQ ID NO: 171205 - DNA, 25 bp, Homo sapien
ctgggactggacagctttgctccgc

SEQ ID NO: 171206 - DNA, 25 bp, Homo sapien
acactacacagcacaccagccgctg

SEQ ID NO: 171207 - DNA, 25 bp, Homo sapien
cgctgcagggctcccatgggctgag

SEQ ID NO: 171208 - DNA, 25 bp, Homo sapien
tgcagggctcccatgggctgagtgg

SEQ ID NO: 171209 - DNA, 25 bp, Homo sapien
gcagggctcccatgggctgagtggg

SEQ ID NO: 171210 - DNA, 25 bp, Homo sapien
ggtttagcgttgtctgcattgttct

SEQ ID NO: 171211 - DNA, 25 bp, Homo sapien
gtctgcattgttctagagtgaaaca

SEQ ID NO: 171212 - DNA, 25 bp, Homo sapien
acaggtgtcaggctgtcactgttca

SEQ ID NO: 171213 - DNA, 25 bp, Homo sapien
tgtcaggctgtcactgttcacacaa

SEQ ID NO: 171214 - DNA, 25 bp, Homo sapien
gaaacatttaccaagggagcatctt

SEQ ID NO: 171215 - DNA, 25 bp, Homo sapien
aagggagcatctttggactctctgt

SEQ ID NO: 171216 - DNA, 25 bp, Homo sapien
agcatctttggactctctgttttta

SEQ ID NO: 171217 - DNA, 25 bp, Homo sapien
aaaaccttctgaaccatgacttgga

SEQ ID NO: 171218 - DNA, 25 bp, Homo sapien
tgaaccatgacttggagccggcaga

SEQ ID NO: 171219 - DNA, 25 bp, Homo sapien
gaaattacagtttacgtccattcca

SEQ ID NO: 171220 - DNA, 25 bp, Homo sapien
acagtttacgtccattccaagttgt

SEQ ID NO: 171221 - DNA, 25 bp, Homo sapien
tgccagacacggtgcaggacctgga

SEQ ID NO: 171222 - DNA, 25 bp, Homo sapien
aaagggaaacagacgcgacagcaac

SEQ ID NO: 171223 - DNA, 25 bp, Homo sapien
gacagcaacaagagcaccagaagta

SEQ ID NO: 171224 - DNA, 25 bp, Homo sapien
gaagtatatggtcccactgcaggcc

SEQ ID NO: 171225 - DNA, 25 bp, Homo sapien
tgcaggcctcagcacaagagaagaa

SEQ ID NO: 171226 - DNA, 25 bp, Homo sapien
aagaatggactctgaggactgagaa

SEQ ID NO: 171227 - DNA, 25 bp, Homo sapien
ggaaggtcctacaggtctccggcca

SEQ ID NO: 171228 - DNA, 25 bp, Homo sapien
cggccacccacacaaggaggaggaa

SEQ ID NO: 171229 - DNA, 25 bp, Homo sapien
gaagaggaaatggtgacccaagtgt

SEQ ID NO: 171230 - DNA, 25 bp, Homo sapien
ggttgtggttcaggaaagcatcttc

SEQ ID NO: 171231 - DNA, 25 bp, Homo sapien
tttataaaccccaccagaaccacat

SEQ ID NO: 171232 - DNA, 25 bp, Homo sapien
aacgcatgaccgaaaatcagaagac

SEQ ID NO: 171233 - DNA, 25 bp, Homo sapien
gaagacaaacttgccaaagctacaa

SEQ ID NO: 171234 - DNA, 25 bp, Homo sapien
gagacagctgtaaaactaccataga

SEQ ID NO: 171235 - DNA, 25 bp, Homo sapien
gaagctatccatggattgatgtctc

SEQ ID NO: 171236 - DNA, 25 bp, Homo sapien
ttgatgtctcaggttattaaggata

SEQ ID NO: 171237 - DNA, 25 bp, Homo sapien
ttaacatctcttaaacagtctctga

SEQ ID NO: 171238 - DNA, 25 bp, Homo sapien
aacagtctctgagaagtactttacc

SEQ ID NO: 171239 - DNA, 25 bp, Homo sapien
gtactttacctgaaagacagtatga

SEQ ID NO: 171240 - DNA, 25 bp, Homo sapien
taaaaccagttacccaaaatctgat

SEQ ID NO: 171241 - DNA, 25 bp, Homo sapien
aggtgctctgaagtgtcctaaatat

SEQ ID NO: 171242 - DNA, 25 bp, Homo sapien
tgggtttagaaacgcatgaccgaaa

SEQ ID NO: 171243 - DNA, 25 bp, Homo sapien
agccatgtgggccaggtgcattcac

SEQ ID NO: 171244 - DNA, 25 bp, Homo sapien
atctacccagtttccacaagatgtg

SEQ ID NO: 171245 - DNA, 25 bp, Homo sapien
cccagtttccacaagatgtggctcc

SEQ ID NO: 171246 - DNA, 25 bp, Homo sapien
gggcctacccagaagcctccttgaa

SEQ ID NO: 171247 - DNA, 25 bp, Homo sapien
gaagcctccttgaaccagtctgcaa

SEQ ID NO: 171248 - DNA, 25 bp, Homo sapien
aaccctgctctatgctgacccttgt

SEQ ID NO: 171249 - DNA, 25 bp, Homo sapien
tctatgctgacccttgtcactgaac

SEQ ID NO: 171250 - DNA, 25 bp, Homo sapien
tgtcactgaaccctgatctagactt

SEQ ID NO: 171251 - DNA, 25 bp, Homo sapien
cactgaaccctgatctagacttata

SEQ ID NO: 171252 - DNA, 25 bp, Homo sapien
gaaccctgatctagacttatatgaa

SEQ ID NO: 171253 - DNA, 25 bp, Homo sapien
ttacatgccaagggccctaaaaagc

SEQ ID NO: 171254 - DNA, 25 bp, Homo sapien
aggtctcccgggtcgtcttcatcta

SEQ ID NO: 171255 - DNA, 25 bp, Homo sapien
cgggtcgtcttcatctacttcaact

SEQ ID NO: 171256 - DNA, 25 bp, Homo sapien
tcgtcttcatctacttcaactcctt

SEQ ID NO: 171257 - DNA, 25 bp, Homo sapien
ggcaccggtggcaggacaagcactc

SEQ ID NO: 171258 - DNA, 25 bp, Homo sapien
gtggcaggacaagcactcgatccgt

SEQ ID NO: 171259 - DNA, 25 bp, Homo sapien
acaagcactcgatccgtgcccgagt

SEQ ID NO: 171260 - DNA, 25 bp, Homo sapien
aacccgtgtcagctttcacagcatc

SEQ ID NO: 171261 - DNA, 25 bp, Homo sapien
cgtgtcagctttcacagcatcaagc

SEQ ID NO: 171262 - DNA, 25 bp, Homo sapien
accattcagtacaggaaggctgtga

SEQ ID NO: 171263 - DNA, 25 bp, Homo sapien
aaggctgtgaaagccactctggtgc

SEQ ID NO: 171264 - DNA, 25 bp, Homo sapien
gtgaaagccactctggtgctgctgc

SEQ ID NO: 171265 - DNA, 25 bp, Homo sapien
ttgcttagcccacaaggtatctatt

SEQ ID NO: 171266 - DNA, 25 bp, Homo sapien
tagcccacaaggtatctatttcact

SEQ ID NO: 171267 - DNA, 25 bp, Homo sapien
ccacaaggtatctatttcacttgac

SEQ ID NO: 171268 - DNA, 25 bp, Homo sapien
tttttataacttcagtgtagctctc

SEQ ID NO: 171269 - DNA, 25 bp, Homo sapien
ttttataacttcagtgtagctctct

SEQ ID NO: 171270 - DNA, 25 bp, Homo sapien
tttataacttcagtgtagctctctc

SEQ ID NO: 171271 - DNA, 25 bp, Homo sapien
ttataacttcagtgtagctctctcc

SEQ ID NO: 171272 - DNA, 25 bp, Homo sapien
tataacttcagtgtagctctctcct

SEQ ID NO: 171273 - DNA, 25 bp, Homo sapien
ataacttcagtgtagctctctcctc

SEQ ID NO: 171274 - DNA, 25 bp, Homo sapien
taacttcagtgtagctctctcctct

SEQ ID NO: 171275 - DNA, 25 bp, Homo sapien
aacttcagtgtagctctctcctctt

SEQ ID NO: 171276 - DNA, 25 bp, Homo sapien
tctacaaccacctgcgacgccacga

SEQ ID NO: 171277 - DNA, 25 bp, Homo sapien
ctacaaccacctgcgacgccacgaa

SEQ ID NO: 171278 - DNA, 25 bp, Homo sapien
caaccacctgcgacgccacgaactg

SEQ ID NO: 171279 - DNA, 25 bp, Homo sapien
cgggcaccgtctcctgcctgtgcgt

SEQ ID NO: 171280 - DNA, 25 bp, Homo sapien
gggcaccgtctcctgcctgtgcgtc

SEQ ID NO: 171281 - DNA, 25 bp, Homo sapien
gcaccgtctcctgcctgtgcgtccg

SEQ ID NO: 171282 - DNA, 25 bp, Homo sapien
ctgcctgtgcgtccgcccaccgctg

SEQ ID NO: 171283 - DNA, 25 bp, Homo sapien
caccgctgccctgtctgttgcgaca

SEQ ID NO: 171284 - DNA, 25 bp, Homo sapien
accgctgccctgtctgttgcgacac

SEQ ID NO: 171285 - DNA, 25 bp, Homo sapien
gctgccctgtctgttgcgacaccct

SEQ ID NO: 171286 - DNA, 25 bp, Homo sapien
tgccctgtctgttgcgacaccctcc

SEQ ID NO: 171287 - DNA, 25 bp, Homo sapien
aaaccactattccatgcttttaagt

SEQ ID NO: 171288 - DNA, 25 bp, Homo sapien
tccacctttttcttatgagtctcac

SEQ ID NO: 171289 - DNA, 25 bp, Homo sapien
gagtctcactagattgactgaggaa

SEQ ID NO: 171290 - DNA, 25 bp, Homo sapien
ggagtgttcaatagataccacgaat

SEQ ID NO: 171291 - DNA, 25 bp, Homo sapien
gggaaaattctatacaactcaatct

SEQ ID NO: 171292 - DNA, 25 bp, Homo sapien
aactcaatctaagtcagtccacttt

SEQ ID NO: 171293 - DNA, 25 bp, Homo sapien
gtcagtccactttgacttcgtactg

SEQ ID NO: 171294 - DNA, 25 bp, Homo sapien
tttgacttcgtactgtctttcacct

SEQ ID NO: 171295 - DNA, 25 bp, Homo sapien
tactgtctttcacctttccattgtt

SEQ ID NO: 171296 - DNA, 25 bp, Homo sapien
tcacctttccattgttgcatcttga

SEQ ID NO: 171297 - DNA, 25 bp, Homo sapien
ccattgttgcatcttgaatttttta

SEQ ID NO: 171298 - DNA, 25 bp, Homo sapien
aaaaatgcacatagctatcgagtgt

SEQ ID NO: 171299 - DNA, 25 bp, Homo sapien
gctatcgagtgtgctttagcttgaa

SEQ ID NO: 171300 - DNA, 25 bp, Homo sapien
gctttagcttgaaaaggtgaccttg

SEQ ID NO: 171301 - DNA, 25 bp, Homo sapien
ccttgcaacttcatgtcaactttct

SEQ ID NO: 171302 - DNA, 25 bp, Homo sapien
gcaacttcatgtcaactttctggct

SEQ ID NO: 171303 - DNA, 25 bp, Homo sapien
catgtcaactttctggctcctcaaa

SEQ ID NO: 171304 - DNA, 25 bp, Homo sapien
gctcctcaaacagtaggttggcagt

SEQ ID NO: 171305 - DNA, 25 bp, Homo sapien
ggcagtaaggcagggtcccatttct

SEQ ID NO: 171306 - DNA, 25 bp, Homo sapien
gcagggtcccatttctcactgagaa

SEQ ID NO: 171307 - DNA, 25 bp, Homo sapien
atggattttctattgttactctggt

SEQ ID NO: 171308 - DNA, 25 bp, Homo sapien
ttttctattgttactctggttcttt

SEQ ID NO: 171309 - DNA, 25 bp, Homo sapien
agaggccctgccaaactgaccacct

SEQ ID NO: 171310 - DNA, 25 bp, Homo sapien
gactgccactctggacctaatagct

SEQ ID NO: 171311 - DNA, 25 bp, Homo sapien
tgccactctggacctaatagctgtt

SEQ ID NO: 171312 - DNA, 25 bp, Homo sapien
actctggacctaatagctgttcctt

SEQ ID NO: 171313 - DNA, 25 bp, Homo sapien
ggacctaatagctgttccttaggcc

SEQ ID NO: 171314 - DNA, 25 bp, Homo sapien
taatagctgttccttaggccccact

SEQ ID NO: 171315 - DNA, 25 bp, Homo sapien
gcctcacagtgtgtcctttgtgcca

SEQ ID NO: 171316 - DNA, 25 bp, Homo sapien
tgtcctttgtgccagaccaagcggc

SEQ ID NO: 171317 - DNA, 25 bp, Homo sapien
cagggagtgtaccacacagggccat

SEQ ID NO: 171318 - DNA, 25 bp, Homo sapien
agggccattgtctcacctcccaaag

SEQ ID NO: 171319 - DNA, 25 bp, Homo sapien
tcatcccagagcgtccctgctgcaa

SEQ ID NO: 171320 - DNA, 25 bp, Homo sapien
ttcaagttttaggtcccctcacact

SEQ ID NO: 171321 - DNA, 25 bp, Homo sapien
caagttttaggtcccctcacactag

SEQ ID NO: 171322 - DNA, 25 bp, Homo sapien
tcacactagccctttttttggccct

SEQ ID NO: 171323 - DNA, 25 bp, Homo sapien
ttttttggccctacgtctggatgcc

SEQ ID NO: 171324 - DNA, 25 bp, Homo sapien
tttggccctacgtctggatgcctgg

SEQ ID NO: 171325 - DNA, 25 bp, Homo sapien
ggatgcctgggcttcacacaagaac

SEQ ID NO: 171326 - DNA, 25 bp, Homo sapien
atgcctgggcttcacacaagaacca

SEQ ID NO: 171327 - DNA, 25 bp, Homo sapien
tgggcttcacacaagaaccacctct

SEQ ID NO: 171328 - DNA, 25 bp, Homo sapien
cgcagttcccaaggacttgtcattt

SEQ ID NO: 171329 - DNA, 25 bp, Homo sapien
gttcccaaggacttgtcatttcatg

SEQ ID NO: 171330 - DNA, 25 bp, Homo sapien
caaggacttgtcatttcatgttctt

SEQ ID NO: 171331 - DNA, 25 bp, Homo sapien
gagatcttctgttaatacacattgg

SEQ ID NO: 171332 - DNA, 25 bp, Homo sapien
acccaaattctaggacaatgcttaa

SEQ ID NO: 171333 - DNA, 25 bp, Homo sapien
ataccctagatactgtgttatgtgc

SEQ ID NO: 171334 - DNA, 25 bp, Homo sapien
tatgtgcaactgtagaaaccctcca

SEQ ID NO: 171335 - DNA, 25 bp, Homo sapien
agaaaccctccagaaatttccactg

SEQ ID NO: 171336 - DNA, 25 bp, Homo sapien
gaaatttccactgctgttcttcact

SEQ ID NO: 171337 - DNA, 25 bp, Homo sapien
atcttgtctgctatcaaaccacttc

SEQ ID NO: 171338 - DNA, 25 bp, Homo sapien
aaaccacttctgacaaaattagctg

SEQ ID NO: 171339 - DNA, 25 bp, Homo sapien
gaattacccatatcactgccagttt

SEQ ID NO: 171340 - DNA, 25 bp, Homo sapien
ttgtgtttgaagtatctgtgcatgg

SEQ ID NO: 171341 - DNA, 25 bp, Homo sapien
ctgtgcatgggatcgttgatgttta

SEQ ID NO: 171342 - DNA, 25 bp, Homo sapien
aaaagctttgttatagaaatcagca

SEQ ID NO: 171343 - DNA, 25 bp, Homo sapien
ctggagagaagatattctggtgact

SEQ ID NO: 171344 - DNA, 25 bp, Homo sapien
aagtatggtcgggtgtcagatataa

SEQ ID NO: 171345 - DNA, 25 bp, Homo sapien
gatataaatgtgcaaatgccttctt

SEQ ID NO: 171346 - DNA, 25 bp, Homo sapien
aatgccttcttgctgtcctgtcggt

SEQ ID NO: 171347 - DNA, 25 bp, Homo sapien
tgtcctgtcggtctcagtacgttca

SEQ ID NO: 171348 - DNA, 25 bp, Homo sapien
gtcggtctcagtacgttcactttat

SEQ ID NO: 171349 - DNA, 25 bp, Homo sapien
acgttcactttatagctgctggcaa

SEQ ID NO: 171350 - DNA, 25 bp, Homo sapien
tgctggcaatatcgaaggttccttt

SEQ ID NO: 171351 - DNA, 25 bp, Homo sapien
gtttgtgtaaactctaatttctatc

SEQ ID NO: 171352 - DNA, 25 bp, Homo sapien
ctaatttctatcaaggtgtcatgga

SEQ ID NO: 171353 - DNA, 25 bp, Homo sapien
accagaactgtgatgatgtgtgccg

SEQ ID NO: 171354 - DNA, 25 bp, Homo sapien
aactgtgatgatgtgtgccgaatat

SEQ ID NO: 171355 - DNA, 25 bp, Homo sapien
tgtgtgccgaatattagtgggtaat

SEQ ID NO: 171356 - DNA, 25 bp, Homo sapien
ataagaatgacgaccctgagcggaa

SEQ ID NO: 171357 - DNA, 25 bp, Homo sapien
ggaagatgcctacaaattcgccggg

SEQ ID NO: 171358 - DNA, 25 bp, Homo sapien
aattcgccgggcagatgggcatcca

SEQ ID NO: 171359 - DNA, 25 bp, Homo sapien
gatgggcatccagttgttcgagacc

SEQ ID NO: 171360 - DNA, 25 bp, Homo sapien
agttgttcgagaccagcgccaagga

SEQ ID NO: 171361 - DNA, 25 bp, Homo sapien
ccagcgccaaggagaatgtcaacgt

SEQ ID NO: 171362 - DNA, 25 bp, Homo sapien
acgtggaagagatgttcaactgcat

SEQ ID NO: 171363 - DNA, 25 bp, Homo sapien
gatgttcaactgcatcacggagctg

SEQ ID NO: 171364 - DNA, 25 bp, Homo sapien
aacgctgcagatgtagaggttatgt

SEQ ID NO: 171365 - DNA, 25 bp, Homo sapien
aggttatgtgcaactgatctgtcca

SEQ ID NO: 171366 - DNA, 25 bp, Homo sapien
atgtgcaactgatctgtccagtttg

SEQ ID NO: 171367 - DNA, 25 bp, Homo sapien
gcaactgatctgtccagtttgtgta

SEQ ID NO: 171368 - DNA, 25 bp, Homo sapien
tgatctgtccagtttgtgtatgaaa

SEQ ID NO: 171369 - DNA, 25 bp, Homo sapien
tagttatgttgaacacagccagcac

SEQ ID NO: 171370 - DNA, 25 bp, Homo sapien
cacagccagcacagtttcgacaggt

SEQ ID NO: 171371 - DNA, 25 bp, Homo sapien
agccagcacagtttcgacaggtcaa

SEQ ID NO: 171372 - DNA, 25 bp, Homo sapien
ccagcacagtttcgacaggtcaagg

SEQ ID NO: 171373 - DNA, 25 bp, Homo sapien
cacagtttcgacaggtcaaggaaga

SEQ ID NO: 171374 - DNA, 25 bp, Homo sapien
agagctgtttcagtaaagaatgaag

SEQ ID NO: 171375 - DNA, 25 bp, Homo sapien
caacttctgacccacagaaccataa

SEQ ID NO: 171376 - DNA, 25 bp, Homo sapien
tctgacccacagaaccataagatgg

SEQ ID NO: 171377 - DNA, 25 bp, Homo sapien
ccactgagtcagtgataatttgctg

SEQ ID NO: 171378 - DNA, 25 bp, Homo sapien
gaagcaaatagattaacatagcaac

SEQ ID NO: 171379 - DNA, 25 bp, Homo sapien
agttgcattataggtgaagtccaaa

SEQ ID NO: 171380 - DNA, 25 bp, Homo sapien
ggtgaagtccaaaatacagtccttt

SEQ ID NO: 171381 - DNA, 25 bp, Homo sapien
atacagtcctttagtaaagtctcta

SEQ ID NO: 171382 - DNA, 25 bp, Homo sapien
aatctacctacccttctggaattgc

SEQ ID NO: 171383 - DNA, 25 bp, Homo sapien
tacctacccttctggaattgctaat

SEQ ID NO: 171384 - DNA, 25 bp, Homo sapien
acccttctggaattgctaatgttag

SEQ ID NO: 171385 - DNA, 25 bp, Homo sapien
tataaagtcttaaatgtgtgcataa

SEQ ID NO: 171386 - DNA, 25 bp, Homo sapien
gtattggttctaagatttctcatct

SEQ ID NO: 171387 - DNA, 25 bp, Homo sapien
atttctcatcttctcatccctagga

SEQ ID NO: 171388 - DNA, 25 bp, Homo sapien
atccctaggacaagcatagtgcctg

SEQ ID NO: 171389 - DNA, 25 bp, Homo sapien
tagtgcctgcatgcttcatgatcag

SEQ ID NO: 171390 - DNA, 25 bp, Homo sapien
atgatcagtaagtcctggctgcata

SEQ ID NO: 171391 - DNA, 25 bp, Homo sapien
tggctgcataaaggactctgatgtc

SEQ ID NO: 171392 - DNA, 25 bp, Homo sapien
gggacttaccttttcacatgactta

SEQ ID NO: 171393 - DNA, 25 bp, Homo sapien
tgacttacccctcatccgagtgtga

SEQ ID NO: 171394 - DNA, 25 bp, Homo sapien
gttacaagcaggtgtcatggcagga

SEQ ID NO: 171395 - DNA, 25 bp, Homo sapien
gaccagatctgtatgatttgttcca

SEQ ID NO: 171396 - DNA, 25 bp, Homo sapien
ataatgctcagagttctgtaggctc

SEQ ID NO: 171397 - DNA, 25 bp, Homo sapien
agatccagagatggtagaagtccat

SEQ ID NO: 171398 - DNA, 25 bp, Homo sapien
tccagagatggtagaagtccatgcc

SEQ ID NO: 171399 - DNA, 25 bp, Homo sapien
gagatggtagaagtccatgccagct

SEQ ID NO: 171400 - DNA, 25 bp, Homo sapien
agatggtagaagtccatgccagctc

SEQ ID NO: 171401 - DNA, 25 bp, Homo sapien
gatggtagaagtccatgccagctcc

SEQ ID NO: 171402 - DNA, 25 bp, Homo sapien
tccatgccagctccaaagaggaacg

SEQ ID NO: 171403 - DNA, 25 bp, Homo sapien
catgccagctccaaagaggaacgaa

SEQ ID NO: 171404 - DNA, 25 bp, Homo sapien
atgccagctccaaagaggaacgaaa

SEQ ID NO: 171405 - DNA, 25 bp, Homo sapien
gccagctccaaagaggaacgaaaca

SEQ ID NO: 171406 - DNA, 25 bp, Homo sapien
gctccaaagaggaacgaaacagctg

SEQ ID NO: 171407 - DNA, 25 bp, Homo sapien
gaggaacgaaacagctggattcaga

SEQ ID NO: 171408 - DNA, 25 bp, Homo sapien
ggcccaggagccaatgtgaactttt

SEQ ID NO: 171409 - DNA, 25 bp, Homo sapien
cccaggagccaatgtgaactttttt

SEQ ID NO: 171410 - DNA, 25 bp, Homo sapien
aaagaacaacaagatgaccttattt

SEQ ID NO: 171411 - DNA, 25 bp, Homo sapien
gatgaccttatttcttaactgtttc

SEQ ID NO: 171412 - DNA, 25 bp, Homo sapien
gcttcttgcccagcagggacaggtg

SEQ ID NO: 171413 - DNA, 25 bp, Homo sapien
ggacaggtggcagagccgaggctta

SEQ ID NO: 171414 - DNA, 25 bp, Homo sapien
agagccgaggcttagggtctggcac

SEQ ID NO: 171415 - DNA, 25 bp, Homo sapien
acagctggagacggaggctctcctg

SEQ ID NO: 171416 - DNA, 25 bp, Homo sapien
tgtgtctacagatgggctgtggccc

SEQ ID NO: 171417 - DNA, 25 bp, Homo sapien
ctacagatgggctgtggcccctgca

SEQ ID NO: 171418 - DNA, 25 bp, Homo sapien
agctgttgaacactggagggtcccc

SEQ ID NO: 171419 - DNA, 25 bp, Homo sapien
tgccaatgctccagctgtcgtctga

SEQ ID NO: 171420 - DNA, 25 bp, Homo sapien
ctgtcgtctgactctgggttcgttg

SEQ ID NO: 171421 - DNA, 25 bp, Homo sapien
tttttgtgagtgagactgagggatc

SEQ ID NO: 171422 - DNA, 25 bp, Homo sapien
gactgagggatcgtagatttttaca

SEQ ID NO: 171423 - DNA, 25 bp, Homo sapien
gatttttacaatctgtatctttgac

SEQ ID NO: 171424 - DNA, 25 bp, Homo sapien
tatctttgacaattctgggtgcgag

SEQ ID NO: 171425 - DNA, 25 bp, Homo sapien
ctcctgccaaccacaattcaatgaa

SEQ ID NO: 171426 - DNA, 25 bp, Homo sapien
taccccatgctgtacttgtggttct

SEQ ID NO: 171427 - DNA, 25 bp, Homo sapien
ttgtggttctctttttgtattttgc

SEQ ID NO: 171428 - DNA, 25 bp, Homo sapien
tttgtattttgcatctgaccccggg

SEQ ID NO: 171429 - DNA, 25 bp, Homo sapien
gacagattggcaatgggccgtcccc

SEQ ID NO: 171430 - DNA, 25 bp, Homo sapien
gcaggctcaacataacataagctag

SEQ ID NO: 171431 - DNA, 25 bp, Homo sapien
gatgactgaatttctatggcatatt

SEQ ID NO: 171432 - DNA, 25 bp, Homo sapien
aaattcattccatttgctgattgtc

SEQ ID NO: 171433 - DNA, 25 bp, Homo sapien
cattccatttgctgattgtctgaaa

SEQ ID NO: 171434 - DNA, 25 bp, Homo sapien
gattctttattagtgaagtatgcac

SEQ ID NO: 171435 - DNA, 25 bp, Homo sapien
gtatgcactaatcaatactttgaac

SEQ ID NO: 171436 - DNA, 25 bp, Homo sapien
acaaagcctgtgttactgatttggc

SEQ ID NO: 171437 - DNA, 25 bp, Homo sapien
ctgtgttactgatttggccgttttg

SEQ ID NO: 171438 - DNA, 25 bp, Homo sapien
actgatttggccgttttgtgaagaa

SEQ ID NO: 171439 - DNA, 25 bp, Homo sapien
gaaacatttatctttgtacgttctt

SEQ ID NO: 171440 - DNA, 25 bp, Homo sapien
tctttgtacgttcttctattgtgct

SEQ ID NO: 171441 - DNA, 25 bp, Homo sapien
aagtttgccgctgatgcagtgaagc

SEQ ID NO: 171442 - DNA, 25 bp, Homo sapien
tttgccgctgatgcagtgaagctgg

SEQ ID NO: 171443 - DNA, 25 bp, Homo sapien
gagcggatgctgacagaacgaatgt

SEQ ID NO: 171444 - DNA, 25 bp, Homo sapien
cagaacgaatgttcaatgcagagaa

SEQ ID NO: 171445 - DNA, 25 bp, Homo sapien
tggaaagtagcgcatccctgaggct

SEQ ID NO: 171446 - DNA, 25 bp, Homo sapien
agctgggatctgactgcacgtggct

SEQ ID NO: 171447 - DNA, 25 bp, Homo sapien
ctgactgcacgtggcttctgatgaa

SEQ ID NO: 171448 - DNA, 25 bp, Homo sapien
ttacaaattggagcagggacagatc

SEQ ID NO: 171449 - DNA, 25 bp, Homo sapien
tggagcagggacagatcatagattt

SEQ ID NO: 171450 - DNA, 25 bp, Homo sapien
gggacagatcatagatttctgattt

SEQ ID NO: 171451 - DNA, 25 bp, Homo sapien
gcctaatacattaaagcagtcactt

SEQ ID NO: 171452 - DNA, 25 bp, Homo sapien
tctctccggaggtcaccaaggaatg

SEQ ID NO: 171453 - DNA, 25 bp, Homo sapien
gaatgcacaggtttcgactaccaga

SEQ ID NO: 171454 - DNA, 25 bp, Homo sapien
aaaattcgtgaggagagctgtctac

SEQ ID NO: 171455 - DNA, 25 bp, Homo sapien
gggaatgcaggccaagtccttttat

SEQ ID NO: 171456 - DNA, 25 bp, Homo sapien
gatgtccatgaagaggtttgccgtc

SEQ ID NO: 171457 - DNA, 25 bp, Homo sapien
aagaggtttgccgtctgggcagccc

SEQ ID NO: 171458 - DNA, 25 bp, Homo sapien
agccctgtcggcaaggagcgtgcat

SEQ ID NO: 171459 - DNA, 25 bp, Homo sapien
gagcgtgcatactgcgtttgtgtaa

SEQ ID NO: 171460 - DNA, 25 bp, Homo sapien
gtgtaattgtttgctgtatctccct

SEQ ID NO: 171461 - DNA, 25 bp, Homo sapien
tccctctgagctgtattgttcttta

SEQ ID NO: 171462 - DNA, 25 bp, Homo sapien
ctgagctgtattgttctttaatggc

SEQ ID NO: 171463 - DNA, 25 bp, Homo sapien
gcaagaagcctgaccccaagtgtgt

SEQ ID NO: 171464 - DNA, 25 bp, Homo sapien
ccaagtgtgtcttcacctatgtgca

SEQ ID NO: 171465 - DNA, 25 bp, Homo sapien
tatgtgcagtcgctctacaaccacc

SEQ ID NO: 171466 - DNA, 25 bp, Homo sapien
aaccacctgcgacgccacgaactgg

SEQ ID NO: 171467 - DNA, 25 bp, Homo sapien
cacgaactggcctcgcgcggcaaga

SEQ ID NO: 171468 - DNA, 25 bp, Homo sapien
cgaactggcctcgcgcggcaagaat

SEQ ID NO: 171469 - DNA, 25 bp, Homo sapien
aactggcctcgcgcggcaagaatgt

SEQ ID NO: 171470 - DNA, 25 bp, Homo sapien
gcctcgcgcggcaagaatgtctagc

SEQ ID NO: 171471 - DNA, 25 bp, Homo sapien
cgcgcggcaagaatgtctagcctgc

SEQ ID NO: 171472 - DNA, 25 bp, Homo sapien
atggccagccagtggcaactgccgc

SEQ ID NO: 171473 - DNA, 25 bp, Homo sapien
accgctgccctgtctgttgcgacac

SEQ ID NO: 171474 - DNA, 25 bp, Homo sapien
gaagattcttgtaaaccaccaaagc

SEQ ID NO: 171475 - DNA, 25 bp, Homo sapien
aaccaccaaagctttcctaatgaag

SEQ ID NO: 171476 - DNA, 25 bp, Homo sapien
gagaacaaatcccagtgttgctgat

SEQ ID NO: 171477 - DNA, 25 bp, Homo sapien
gttgctgatatatggcttctgcttc

SEQ ID NO: 171478 - DNA, 25 bp, Homo sapien
ttgtgtgtgcctcagctctgaagaa

SEQ ID NO: 171479 - DNA, 25 bp, Homo sapien
atgtcatgttagctgggagtcttcc

SEQ ID NO: 171480 - DNA, 25 bp, Homo sapien
gggagtcttcccacatgtggcactt

SEQ ID NO: 171481 - DNA, 25 bp, Homo sapien
acatgtggcacttcaaaaggcagca

SEQ ID NO: 171482 - DNA, 25 bp, Homo sapien
actgggcgcctgcacttatttgaaa

SEQ ID NO: 171483 - DNA, 25 bp, Homo sapien
ggagaagtatccctgctagtggctc

SEQ ID NO: 171484 - DNA, 25 bp, Homo sapien
cctgctagtggctctgtaacttaac

SEQ ID NO: 171485 - DNA, 25 bp, Homo sapien
gttgcccaagtgaggacggacccct

SEQ ID NO: 171486 - DNA, 25 bp, Homo sapien
atctgtgctctcctagcccaagaga

SEQ ID NO: 171487 - DNA, 25 bp, Homo sapien
ggagtttatccagcgcctcgtcgta

SEQ ID NO: 171488 - DNA, 25 bp, Homo sapien
tcgtcgtatgtttggctgagcacct

SEQ ID NO: 171489 - DNA, 25 bp, Homo sapien
cctgggtgcaggttaacttcttgtt

SEQ ID NO: 171490 - DNA, 25 bp, Homo sapien
caaaggtcggcagccagcgaggcta

SEQ ID NO: 171491 - DNA, 25 bp, Homo sapien
gcgaggctatgaattggaccttttt

SEQ ID NO: 171492 - DNA, 25 bp, Homo sapien
ggacctttttggtatctgtgtgact

SEQ ID NO: 171493 - DNA, 25 bp, Homo sapien
ttagccaacttgctggcgtgacaag

SEQ ID NO: 171494 - DNA, 25 bp, Homo sapien
tggcgtgacaagtgcccacaagtaa

SEQ ID NO: 171495 - DNA, 25 bp, Homo sapien
taacacaccaggtacccagagcagg

SEQ ID NO: 171496 - DNA, 25 bp, Homo sapien
cccaccttgccagggcagggtctgg

SEQ ID NO: 171497 - DNA, 25 bp, Homo sapien
tctgggctgggcacctgacttggct

SEQ ID NO: 171498 - DNA, 25 bp, Homo sapien
ggcagcctgtcacccgtgtgaagat

SEQ ID NO: 171499 - DNA, 25 bp, Homo sapien
agcctgtcacccgtgtgaagatgaa

SEQ ID NO: 171500 - DNA, 25 bp, Homo sapien
gcctgtcacccgtgtgaagatgaag

SEQ ID NO: 171501 - DNA, 25 bp, Homo sapien
cctgtcacccgtgtgaagatgaagg

SEQ ID NO: 171502 - DNA, 25 bp, Homo sapien
atctgcctgcgctctcgtcggtttt

SEQ ID NO: 171503 - DNA, 25 bp, Homo sapien
ctgcctgcgctctcgtcggtttttt

SEQ ID NO: 171504 - DNA, 25 bp, Homo sapien
gcgctctcgtcggtttttttaggat

SEQ ID NO: 171505 - DNA, 25 bp, Homo sapien
gagtctgggacccttgttggggagt

SEQ ID NO: 171506 - DNA, 25 bp, Homo sapien
gctggccatgaatctctgcctctcc

SEQ ID NO: 171507 - DNA, 25 bp, Homo sapien
acgttctcaaagtttccacattagc

SEQ ID NO: 171508 - DNA, 25 bp, Homo sapien
gttctcaaagtttccacattagcac

SEQ ID NO: 171509 - DNA, 25 bp, Homo sapien
ctcaaagtttccacattagcactcc

SEQ ID NO: 171510 - DNA, 25 bp, Homo sapien
aaagtttccacattagcactcccta

SEQ ID NO: 171511 - DNA, 25 bp, Homo sapien
tttccacattagcactccctaagga

SEQ ID NO: 171512 - DNA, 25 bp, Homo sapien
cacattagcactccctaaggacgct

SEQ ID NO: 171513 - DNA, 25 bp, Homo sapien
agtttatgatctgacctaggtcccc

SEQ ID NO: 171514 - DNA, 25 bp, Homo sapien
ggccagatagcctgacagataggct

SEQ ID NO: 171515 - DNA, 25 bp, Homo sapien
tagcctgacagataggctagtggta

SEQ ID NO: 171516 - DNA, 25 bp, Homo sapien
ggcgggacgtgtgtgtcattattat

SEQ ID NO: 171517 - DNA, 25 bp, Homo sapien
ggacgtgtgtgtcattattatttga

SEQ ID NO: 171518 - DNA, 25 bp, Homo sapien
aattgcaatctaccatatcttaagg

SEQ ID NO: 171519 - DNA, 25 bp, Homo sapien
tatttcctagagaatagtaaccagg

SEQ ID NO: 171520 - DNA, 25 bp, Homo sapien
acctaattacttttgtgcctctcag

SEQ ID NO: 171521 - DNA, 25 bp, Homo sapien
taattacttttgtgcctctcagccg

SEQ ID NO: 171522 - DNA, 25 bp, Homo sapien
ttgtgcctctcagccgttgattgta

SEQ ID NO: 171523 - DNA, 25 bp, Homo sapien
gcctctcagccgttgattgtaactt

SEQ ID NO: 171524 - DNA, 25 bp, Homo sapien
ctcagccgttgattgtaactttaaa

SEQ ID NO: 171525 - DNA, 25 bp, Homo sapien
aatagattttgttatcggtgggcat

SEQ ID NO: 171526 - DNA, 25 bp, Homo sapien
tttgttatcggtgggcatgcactgc

SEQ ID NO: 171527 - DNA, 25 bp, Homo sapien
tgcactgcaagaattaagtatctca

SEQ ID NO: 171528 - DNA, 25 bp, Homo sapien
gcaagaattaagtatctcagactga

SEQ ID NO: 171529 - DNA, 25 bp, Homo sapien
ttatttatcctttgactcttgcaca

SEQ ID NO: 171530 - DNA, 25 bp, Homo sapien
tgactcttgcacattctatgtaccc

SEQ ID NO: 171531 - DNA, 25 bp, Homo sapien
ctatgtacccctccgatttgtgaag

SEQ ID NO: 171532 - DNA, 25 bp, Homo sapien
ccctccgatttgtgaagcctacagg

SEQ ID NO: 171533 - DNA, 25 bp, Homo sapien
gaagcctacaggaaatctgggtata

SEQ ID NO: 171534 - DNA, 25 bp, Homo sapien
tctgggtatatggatttgtaactgc

SEQ ID NO: 171535 - DNA, 25 bp, Homo sapien
gtcatgcacatttaacaattacagg

SEQ ID NO: 171536 - DNA, 25 bp, Homo sapien
taacgtttactggtactgctttcta

SEQ ID NO: 171537 - DNA, 25 bp, Homo sapien
tgctttctaaatactgttttacccg

SEQ ID NO: 171538 - DNA, 25 bp, Homo sapien
gtatagattatctgagtgttccaca

SEQ ID NO: 171539 - DNA, 25 bp, Homo sapien
gagtgttccacagttgtatgtcaaa

SEQ ID NO: 171540 - DNA, 25 bp, Homo sapien
atccaccctgcccacaaaacattgc

SEQ ID NO: 171541 - DNA, 25 bp, Homo sapien
gcccacaaaacattgctcttaactt

SEQ ID NO: 171542 - DNA, 25 bp, Homo sapien
cccacaaaacattgctcttaacttc

SEQ ID NO: 171543 - DNA, 25 bp, Homo sapien
ccacaaaacattgctcttaacttca

SEQ ID NO: 171544 - DNA, 25 bp, Homo sapien
aaaacattgctcttaacttcaccgc

SEQ ID NO: 171545 - DNA, 25 bp, Homo sapien
attgctcttaacttcaccgcctaac

SEQ ID NO: 171546 - DNA, 25 bp, Homo sapien
gctcttaacttcaccgcctaaccca

SEQ ID NO: 171547 - DNA, 25 bp, Homo sapien
taatgataatccatcacccttcgct

SEQ ID NO: 171548 - DNA, 25 bp, Homo sapien
aatgataatccatcacccttcgctg

SEQ ID NO: 171549 - DNA, 25 bp, Homo sapien
atgataatccatcacccttcgctga

SEQ ID NO: 171550 - DNA, 25 bp, Homo sapien
taatccatcacccttcgctgactct

SEQ ID NO: 171551 - DNA, 25 bp, Homo sapien
gaagcctacaagatgcagccgggag

SEQ ID NO: 171552 - DNA, 25 bp, Homo sapien
gagaggacaatgcatacttcagcgt

SEQ ID NO: 171553 - DNA, 25 bp, Homo sapien
aatgcatacttcagcgtggtggagc

SEQ ID NO: 171554 - DNA, 25 bp, Homo sapien
gaggctctggaggacaatctaggac

SEQ ID NO: 171555 - DNA, 25 bp, Homo sapien
tggaggacaatctaggacctacatt

SEQ ID NO: 171556 - DNA, 25 bp, Homo sapien
ctaggacctacattatctggactgt

SEQ ID NO: 171557 - DNA, 25 bp, Homo sapien
atctggactgtatgctggtcatttc

SEQ ID NO: 171558 - DNA, 25 bp, Homo sapien
gactgtatgctggtcatttctagag

SEQ ID NO: 171559 - DNA, 25 bp, Homo sapien
ggtcatttctagagacagcaatcaa

SEQ ID NO: 171560 - DNA, 25 bp, Homo sapien
gagacagcaatcaatatttgagtgt

SEQ ID NO: 171561 - DNA, 25 bp, Homo sapien
tttgagtgtaaggaaactgtctggg

SEQ ID NO: 171562 - DNA, 25 bp, Homo sapien
aacaggattttacagccttctgatg

SEQ ID NO: 171563 - DNA, 25 bp, Homo sapien
tacagccttctgatgattcattcaa

SEQ ID NO: 171564 - DNA, 25 bp, Homo sapien
gccttctgatgattcattcaaagca

SEQ ID NO: 171565 - DNA, 25 bp, Homo sapien
tatgtagcaatttgtgtgtccctcc

SEQ ID NO: 171566 - DNA, 25 bp, Homo sapien
tgtagcaatttgtgtgtccctccca

SEQ ID NO: 171567 - DNA, 25 bp, Homo sapien
tttgtgtgtccctcccacttcataa

SEQ ID NO: 171568 - DNA, 25 bp, Homo sapien
tcccacttcataactacaaaaacat

SEQ ID NO: 171569 - DNA, 25 bp, Homo sapien
tcaatgtgtacttaccagtttactg

SEQ ID NO: 171570 - DNA, 25 bp, Homo sapien
ctgtgtggttttatcttcaggtaca

SEQ ID NO: 171571 - DNA, 25 bp, Homo sapien
cttcaggtacagatagtttgtggta

SEQ ID NO: 171572 - DNA, 25 bp, Homo sapien
ttgtggtactacttgaaaatacctt

SEQ ID NO: 171573 - DNA, 25 bp, Homo sapien
agctctgcgttccattggcttgaaa

SEQ ID NO: 171574 - DNA, 25 bp, Homo sapien
tctgcgttccattggcttgaaatgc

SEQ ID NO: 171575 - DNA, 25 bp, Homo sapien
gcgttccattggcttgaaatgcctg

SEQ ID NO: 171576 - DNA, 25 bp, Homo sapien
cattggcttgaaatgcctggagcac

SEQ ID NO: 171577 - DNA, 25 bp, Homo sapien
ttggcttgaaatgcctggagcacct

SEQ ID NO: 171578 - DNA, 25 bp, Homo sapien
tgaaatgcctggagcacctcttctt

SEQ ID NO: 171579 - DNA, 25 bp, Homo sapien
gagatgttggagaccccgctgcaga

SEQ ID NO: 171580 - DNA, 25 bp, Homo sapien
agatgttggagaccccgctgcagat

SEQ ID NO: 171581 - DNA, 25 bp, Homo sapien
ttggagaccccgctgcagatcacct

SEQ ID NO: 171582 - DNA, 25 bp, Homo sapien
aggatgacccctgggcaggtgtgtg

SEQ ID NO: 171583 - DNA, 25 bp, Homo sapien
tgtccccaaaatgtgatgcttataa

SEQ ID NO: 171584 - DNA, 25 bp, Homo sapien
cgcagtctgaatggcggcacgctga

SEQ ID NO: 171585 - DNA, 25 bp, Homo sapien
gcagtctgaatggcggcacgctgaa

SEQ ID NO: 171586 - DNA, 25 bp, Homo sapien
agtctgaatggcggcacgctgaagg

SEQ ID NO: 171587 - DNA, 25 bp, Homo sapien
gtctgaatggcggcacgctgaagga

SEQ ID NO: 171588 - DNA, 25 bp, Homo sapien
aatggcggcacgctgaaggaaacgt

SEQ ID NO: 171589 - DNA, 25 bp, Homo sapien
atggcggcacgctgaaggaaacgtg

SEQ ID NO: 171590 - DNA, 25 bp, Homo sapien
tggcggcacgctgaaggaaacgtgc

SEQ ID NO: 171591 - DNA, 25 bp, Homo sapien
cggcacgctgaaggaaacgtgcgaa

SEQ ID NO: 171592 - DNA, 25 bp, Homo sapien
gcacgctgaaggaaacgtgcgaagc

SEQ ID NO: 171593 - DNA, 25 bp, Homo sapien
cacgctgaaggaaacgtgcgaagca

SEQ ID NO: 171594 - DNA, 25 bp, Homo sapien
acgctgaaggaaacgtgcgaagcac

SEQ ID NO: 171595 - DNA, 25 bp, Homo sapien
ggaaatgtgccttatgttaaacact

SEQ ID NO: 171596 - DNA, 25 bp, Homo sapien
tgttaaacactatgtacttttactt

SEQ ID NO: 171597 - DNA, 25 bp, Homo sapien
acttttactttttgcattgtccaga

SEQ ID NO: 171598 - DNA, 25 bp, Homo sapien
gcattgtccagacttctttattaga

SEQ ID NO: 171599 - DNA, 25 bp, Homo sapien
tattagatggagatgtttctttttc

SEQ ID NO: 171600 - DNA, 25 bp, Homo sapien
ctttttctgtcttctagactaaata

SEQ ID NO: 171601 - DNA, 25 bp, Homo sapien
gactaaatagagtatcatccaaata

SEQ ID NO: 171602 - DNA, 25 bp, Homo sapien
gggcctatgacttgaatgaatagaa

SEQ ID NO: 171603 - DNA, 25 bp, Homo sapien
aaatgaataagctggtgtttgtttt

SEQ ID NO: 171604 - DNA, 25 bp, Homo sapien
atttagatttgttctcctcatacat

SEQ ID NO: 171605 - DNA, 25 bp, Homo sapien
agatttgttctcctcatacataaaa

SEQ ID NO: 171606 - DNA, 25 bp, Homo sapien
aacagcagagaggacaatgcatact

SEQ ID NO: 171607 - DNA, 25 bp, Homo sapien
cagagaggacaatgcatacttcagc

SEQ ID NO: 171608 - DNA, 25 bp, Homo sapien
gagaggacaatgcatacttcagcgt

SEQ ID NO: 171609 - DNA, 25 bp, Homo sapien
agaggacaatgcatacttcagcgtg

SEQ ID NO: 171610 - DNA, 25 bp, Homo sapien
gaggacaatgcatacttcagcgtgg

SEQ ID NO: 171611 - DNA, 25 bp, Homo sapien
aggacaatgcatacttcagcgtggt

SEQ ID NO: 171612 - DNA, 25 bp, Homo sapien
ggacaatgcatacttcagcgtggtg

SEQ ID NO: 171613 - DNA, 25 bp, Homo sapien
gacaatgcatacttcagcgtggtgg

SEQ ID NO: 171614 - DNA, 25 bp, Homo sapien
acaatgcatacttcagcgtggtgga

SEQ ID NO: 171615 - DNA, 25 bp, Homo sapien
caatgcatacttcagcgtggtggag

SEQ ID NO: 171616 - DNA, 25 bp, Homo sapien
aatgcatacttcagcgtggtggagc

SEQ ID NO: 171617 - DNA, 25 bp, Homo sapien
agatcactgctggtcttgatagcca

SEQ ID NO: 171618 - DNA, 25 bp, Homo sapien
ctgctggtcttgatagccattaata

SEQ ID NO: 171619 - DNA, 25 bp, Homo sapien
atttaatattatgcccttggatctg

SEQ ID NO: 171620 - DNA, 25 bp, Homo sapien
gatctgttactgcatcactagcact

SEQ ID NO: 171621 - DNA, 25 bp, Homo sapien
gttactgcatcactagcacttgtga

SEQ ID NO: 171622 - DNA, 25 bp, Homo sapien
gatgcaatagaacacttcgcctgta

SEQ ID NO: 171623 - DNA, 25 bp, Homo sapien
aatagaacacttcgcctgtactgaa

SEQ ID NO: 171624 - DNA, 25 bp, Homo sapien
acttcgcctgtactgaaagggccaa

SEQ ID NO: 171625 - DNA, 25 bp, Homo sapien
gggccaagagtaaatgccttgtttt

SEQ ID NO: 171626 - DNA, 25 bp, Homo sapien
catgtctatagagttggcagttaat

SEQ ID NO: 171627 - DNA, 25 bp, Homo sapien
gctgaatttgtcaaataccccttcc

SEQ ID NO: 171628 - DNA, 25 bp, Homo sapien
ctgggctccctcttgtgggataatg

SEQ ID NO: 171629 - DNA, 25 bp, Homo sapien
ccctcttgtgggataatgggagaca

SEQ ID NO: 171630 - DNA, 25 bp, Homo sapien
gaatcctcagagagttgtctgtcca

SEQ ID NO: 171631 - DNA, 25 bp, Homo sapien
agagagttgtctgtccaggccctta

SEQ ID NO: 171632 - DNA, 25 bp, Homo sapien
gttgtctgtccaggcccttagggaa

SEQ ID NO: 171633 - DNA, 25 bp, Homo sapien
tctgtccaggcccttagggaagttg

SEQ ID NO: 171634 - DNA, 25 bp, Homo sapien
attcagatgttaatggggaccctcc

SEQ ID NO: 171635 - DNA, 25 bp, Homo sapien
gggttttcccatgactcttggagcc

SEQ ID NO: 171636 - DNA, 25 bp, Homo sapien
tcccatgactcttggagcctctttt

SEQ ID NO: 171637 - DNA, 25 bp, Homo sapien
gggataatttatcatactgagactt

SEQ ID NO: 171638 - DNA, 25 bp, Homo sapien
actgagacttgttcttggttcctgt

SEQ ID NO: 171639 - DNA, 25 bp, Homo sapien
cctcctccagcgtttgaaaaatgcc

SEQ ID NO: 171640 - DNA, 25 bp, Homo sapien
ctccagcgtttgaaaaatgccacaa

SEQ ID NO: 171641 - DNA, 25 bp, Homo sapien
atgccacaaagccaagcagagactg

SEQ ID NO: 171642 - DNA, 25 bp, Homo sapien
tggagcaccggacagggcgctacgc

SEQ ID NO: 171643 - DNA, 25 bp, Homo sapien
aggacggcttcgaggtccagtcact

SEQ ID NO: 171644 - DNA, 25 bp, Homo sapien
gtccagtcactgcacccggacaagg

SEQ ID NO: 171645 - DNA, 25 bp, Homo sapien
ggacaaggcgcagatccccattgtg

SEQ ID NO: 171646 - DNA, 25 bp, Homo sapien
caaggcgcagatccccattgtgggc

SEQ ID NO: 171647 - DNA, 25 bp, Homo sapien
tgtgggcagtaatggctccagccgc

SEQ ID NO: 171648 - DNA, 25 bp, Homo sapien
aggactcccggatatagcacagctg

SEQ ID NO: 171649 - DNA, 25 bp, Homo sapien
actcccggatatagcacagctgcca

SEQ ID NO: 171650 - DNA, 25 bp, Homo sapien
ttctcttctgtcttgtttggtaata

SEQ ID NO: 171651 - DNA, 25 bp, Homo sapien
ctcttctgtcttgtttggtaataaa

SEQ ID NO: 171652 - DNA, 25 bp, Homo sapien
tgtaacaagaatggactgtggtatc

SEQ ID NO: 171653 - DNA, 25 bp, Homo sapien
tggtcggcccaatcggcccggtgtc

SEQ ID NO: 171654 - DNA, 25 bp, Homo sapien
gtgtctacaccaatatcagccacca

SEQ ID NO: 171655 - DNA, 25 bp, Homo sapien
accaatatcagccaccactttgagt

SEQ ID NO: 171656 - DNA, 25 bp, Homo sapien
cactttgagtggatccagaagctga

SEQ ID NO: 171657 - DNA, 25 bp, Homo sapien
tccagaagctgatggcccagagtgg

SEQ ID NO: 171658 - DNA, 25 bp, Homo sapien
atggcccagagtggcatgtcccagc

SEQ ID NO: 171659 - DNA, 25 bp, Homo sapien
agagtggcatgtcccagccagaccc

SEQ ID NO: 171660 - DNA, 25 bp, Homo sapien
gtctgagcctacctgagcccatgca

SEQ ID NO: 171661 - DNA, 25 bp, Homo sapien
ggagatcgtaacattggctaatcac

SEQ ID NO: 171662 - DNA, 25 bp, Homo sapien
atttatagaagacccactgtgtgct

SEQ ID NO: 171663 - DNA, 25 bp, Homo sapien
aaatggctcctaatatatacttaag

SEQ ID NO: 171664 - DNA, 25 bp, Homo sapien
acttaagatattctcccagcttgga

SEQ ID NO: 171665 - DNA, 25 bp, Homo sapien
tcccagcttggaaattctgctcact

SEQ ID NO: 171666 - DNA, 25 bp, Homo sapien
tgctcacttcttgctcttgcttgct

SEQ ID NO: 171667 - DNA, 25 bp, Homo sapien
tcttgcttgcttctctggtgggctt

SEQ ID NO: 171668 - DNA, 25 bp, Homo sapien
ctggtgggcttccatccaaatttgg

SEQ ID NO: 171669 - DNA, 25 bp, Homo sapien
acaggttgtcaatttacgtactact

SEQ ID NO: 171670 - DNA, 25 bp, Homo sapien
acgtactactggtgccttatctgtt

SEQ ID NO: 171671 - DNA, 25 bp, Homo sapien
atctgtttttactgtcccatacact

SEQ ID NO: 171672 - DNA, 25 bp, Homo sapien
cgggctcctggggtctcgcctgaga

SEQ ID NO: 171673 - DNA, 25 bp, Homo sapien
gggctcctggggtctcgcctgagac

SEQ ID NO: 171674 - DNA, 25 bp, Homo sapien
ggctcctggggtctcgcctgagacg

SEQ ID NO: 171675 - DNA, 25 bp, Homo sapien
gctcctggggtctcgcctgagacgg

SEQ ID NO: 171676 - DNA, 25 bp, Homo sapien
ctcctggggtctcgcctgagacggg

SEQ ID NO: 171677 - DNA, 25 bp, Homo sapien
ggtctcgcctgagacggggcaccta

SEQ ID NO: 171678 - DNA, 25 bp, Homo sapien
gtctcgcctgagacggggcacctag

SEQ ID NO: 171679 - DNA, 25 bp, Homo sapien
tctcgcctgagacggggcacctagc

SEQ ID NO: 171680 - DNA, 25 bp, Homo sapien
ctcgcctgagacggggcacctagcc

SEQ ID NO: 171681 - DNA, 25 bp, Homo sapien
tcgcctgagacggggcacctagccc

SEQ ID NO: 171682 - DNA, 25 bp, Homo sapien
gcacctagccctgggcgagcgccgc

SEQ ID NO: 171683 - DNA, 25 bp, Homo sapien
ttgaactgcagcaatcacaaaggct

SEQ ID NO: 171684 - DNA, 25 bp, Homo sapien
acaaaggctgacattcactgagtgc

SEQ ID NO: 171685 - DNA, 25 bp, Homo sapien
caatccccgtgctaagcgttttatg

SEQ ID NO: 171686 - DNA, 25 bp, Homo sapien
ccgtgctaagcgttttatgtggact

SEQ ID NO: 171687 - DNA, 25 bp, Homo sapien
atgtggacttattcattcctcacaa

SEQ ID NO: 171688 - DNA, 25 bp, Homo sapien
cacattgagagtaagcacgttgccc

SEQ ID NO: 171689 - DNA, 25 bp, Homo sapien
agtaagcacgttgcccaaggttgca

SEQ ID NO: 171690 - DNA, 25 bp, Homo sapien
gattcaaacccaggctgtctagctc

SEQ ID NO: 171691 - DNA, 25 bp, Homo sapien
tacagcccttgcactcctactgagt

SEQ ID NO: 171692 - DNA, 25 bp, Homo sapien
gagtttgtggtaaccagccctgcac

SEQ ID NO: 171693 - DNA, 25 bp, Homo sapien
ccctgaatctgctgagaggcaccag

SEQ ID NO: 171694 - DNA, 25 bp, Homo sapien
tgtgctcctggacatgcggtactga

SEQ ID NO: 171695 - DNA, 25 bp, Homo sapien
gctcctggacatgcggtactgaggt

SEQ ID NO: 171696 - DNA, 25 bp, Homo sapien
cctggacatgcggtactgaggtgca

SEQ ID NO: 171697 - DNA, 25 bp, Homo sapien
gacatgcggtactgaggtgcagaca

SEQ ID NO: 171698 - DNA, 25 bp, Homo sapien
catgcggtactgaggtgcagacaag

SEQ ID NO: 171699 - DNA, 25 bp, Homo sapien
gtggtgactgggtcccttggccata

SEQ ID NO: 171700 - DNA, 25 bp, Homo sapien
tgactgggtcccttggccatatcaa

SEQ ID NO: 171701 - DNA, 25 bp, Homo sapien
gggtcccttggccatatcaaggcag

SEQ ID NO: 171702 - DNA, 25 bp, Homo sapien
cttggccatatcaaggcagcacggc

SEQ ID NO: 171703 - DNA, 25 bp, Homo sapien
cctccagtactgcacaaattcctaa

SEQ ID NO: 171704 - DNA, 25 bp, Homo sapien
ccagtactgcacaaattcctaaggg

SEQ ID NO: 171705 - DNA, 25 bp, Homo sapien
ccaaggctggtcaaggcaacatctc

SEQ ID NO: 171706 - DNA, 25 bp, Homo sapien
tcaaggcaacatctccacacagaaa

SEQ ID NO: 171707 - DNA, 25 bp, Homo sapien
aatctgcaccagttatgtaagctaa

SEQ ID NO: 171708 - DNA, 25 bp, Homo sapien
aaagctgtgtgaacccaggtgtccc

SEQ ID NO: 171709 - DNA, 25 bp, Homo sapien
tgtgaacccaggtgtcccggaaagg

SEQ ID NO: 171710 - DNA, 25 bp, Homo sapien
agcaaaatgccagcagcgtgccgga

SEQ ID NO: 171711 - DNA, 25 bp, Homo sapien
atcctcctctccaaagaacagaggt

SEQ ID NO: 171712 - DNA, 25 bp, Homo sapien
agaggtcaggaaaaacactggctgg

SEQ ID NO: 171713 - DNA, 25 bp, Homo sapien
aaaacactggctgggacgctagaag

SEQ ID NO: 171714 - DNA, 25 bp, Homo sapien
acgctagaagggtcatgtgttaact

SEQ ID NO: 171715 - DNA, 25 bp, Homo sapien
gaagggtcatgtgttaactataatc

SEQ ID NO: 171716 - DNA, 25 bp, Homo sapien
gtgattcaccttcagaattggccat

SEQ ID NO: 171717 - DNA, 25 bp, Homo sapien
tcaccttcagaattggccatttttt

SEQ ID NO: 171718 - DNA, 25 bp, Homo sapien
gtgagtttccttgcatcaaggacac

SEQ ID NO: 171719 - DNA, 25 bp, Homo sapien
cacagtcattgtcttaggtgttcta

SEQ ID NO: 171720 - DNA, 25 bp, Homo sapien
atagagcctttaggaacttcctggt

SEQ ID NO: 171721 - DNA, 25 bp, Homo sapien
aacttcctggtcaagcttatggtgc

SEQ ID NO: 171722 - DNA, 25 bp, Homo sapien
gcttatggtgcttattttgatctgg

SEQ ID NO: 171723 - DNA, 25 bp, Homo sapien
tgcttattttgatctgggccacttc

SEQ ID NO: 171724 - DNA, 25 bp, Homo sapien
acttccctccttccagtcatgagta

SEQ ID NO: 171725 - DNA, 25 bp, Homo sapien
gcaagttggagtgtttcaggtgtat

SEQ ID NO: 171726 - DNA, 25 bp, Homo sapien
gtagaacccaaaagattggagcctt

SEQ ID NO: 171727 - DNA, 25 bp, Homo sapien
gccaatatttcatgggccatgtaac

SEQ ID NO: 171728 - DNA, 25 bp, Homo sapien
tcatgggccatgtaacatacagtac

SEQ ID NO: 171729 - DNA, 25 bp, Homo sapien
taaaggataccacaataagctgctg

SEQ ID NO: 171730 - DNA, 25 bp, Homo sapien
ataccacaataagctgctgtgtgtg

SEQ ID NO: 171731 - DNA, 25 bp, Homo sapien
taaaggtcaagatattcagtgagac

SEQ ID NO: 171732 - DNA, 25 bp, Homo sapien
cagtgagaccagcttaaatgaatag

SEQ ID NO: 171733 - DNA, 25 bp, Homo sapien
aatctaagaatgaacctctgaaaag

SEQ ID NO: 171734 - DNA, 25 bp, Homo sapien
taaataggtttaccatgtgccagtc

SEQ ID NO: 171735 - DNA, 25 bp, Homo sapien
atgtgccagtctccacaaaccctgt

SEQ ID NO: 171736 - DNA, 25 bp, Homo sapien
cagtctccacaaaccctgttttagt

SEQ ID NO: 171737 - DNA, 25 bp, Homo sapien
tttctttttctattgtacaagtcaa

SEQ ID NO: 171738 - DNA, 25 bp, Homo sapien
cacatttttgtgttacagtcattga

SEQ ID NO: 171739 - DNA, 25 bp, Homo sapien
acagtcattgatggactctattttt

SEQ ID NO: 171740 - DNA, 25 bp, Homo sapien
ttattattacttggaccttggtcgt

SEQ ID NO: 171741 - DNA, 25 bp, Homo sapien
gaccttggtcgtttttatactagca

SEQ ID NO: 171742 - DNA, 25 bp, Homo sapien
ttatactagcaaaatgtcttgtttt

SEQ ID NO: 171743 - DNA, 25 bp, Homo sapien
gggagtgaacttgctgattctgtag

SEQ ID NO: 171744 - DNA, 25 bp, Homo sapien
gattctgtagcaaaacctgggtggg

SEQ ID NO: 171745 - DNA, 25 bp, Homo sapien
gtaaggacttgataacctggctaca

SEQ ID NO: 171746 - DNA, 25 bp, Homo sapien
gataacctggctacagcgttttcta

SEQ ID NO: 171747 - DNA, 25 bp, Homo sapien
tggctacagcgttttctatgaaatc

SEQ ID NO: 171748 - DNA, 25 bp, Homo sapien
tatgaaatctacttggatcccatgc

SEQ ID NO: 171749 - DNA, 25 bp, Homo sapien
gaggagatgcttgccgtgatgacgc

SEQ ID NO: 171750 - DNA, 25 bp, Homo sapien
atgcttgccgtgatgacgctgggca

SEQ ID NO: 171751 - DNA, 25 bp, Homo sapien
gcttgccgtgatgacgctgggcaca

SEQ ID NO: 171752 - DNA, 25 bp, Homo sapien
gacgctgggcacagagggtcaggtc

SEQ ID NO: 171753 - DNA, 25 bp, Homo sapien
gcacagagggtcaggtcctgtcaag

SEQ ID NO: 171754 - DNA, 25 bp, Homo sapien
acagagggtcaggtcctgtcaagag

SEQ ID NO: 171755 - DNA, 25 bp, Homo sapien
gggtcaggtcctgtcaagaggagct

SEQ ID NO: 171756 - DNA, 25 bp, Homo sapien
ggtcctgtcaagaggagctgggtgt

SEQ ID NO: 171757 - DNA, 25 bp, Homo sapien
ttatattcattccaacttgaagaat

SEQ ID NO: 171758 - DNA, 25 bp, Homo sapien
tcattccaacttgaagaattattca

SEQ ID NO: 171759 - DNA, 25 bp, Homo sapien
cacctttaacaatgtatatgtgaag

SEQ ID NO: 171760 - DNA, 25 bp, Homo sapien
gctggtgaacttctgtggccaccac

SEQ ID NO: 171761 - DNA, 25 bp, Homo sapien
ggtgaacttctgtggccaccacctc

SEQ ID NO: 171762 - DNA, 25 bp, Homo sapien
tgacctccctgggagggtgctatca

SEQ ID NO: 171763 - DNA, 25 bp, Homo sapien
gggagggtgctatcagttctgtcct

SEQ ID NO: 171764 - DNA, 25 bp, Homo sapien
agggtgctatcagttctgtcctggc

SEQ ID NO: 171765 - DNA, 25 bp, Homo sapien
gctatcagttctgtcctggcccttt

SEQ ID NO: 171766 - DNA, 25 bp, Homo sapien
tcctgacttctgtctgccacatgag

SEQ ID NO: 171767 - DNA, 25 bp, Homo sapien
ggtggaatagtggaggccttcaact

SEQ ID NO: 171768 - DNA, 25 bp, Homo sapien
tggaatagtggaggccttcaactga

SEQ ID NO: 171769 - DNA, 25 bp, Homo sapien
ttcaactgattagacaaggcccgcc

SEQ ID NO: 171770 - DNA, 25 bp, Homo sapien
actgattagacaaggcccgcccaca

SEQ ID NO: 171771 - DNA, 25 bp, Homo sapien
tcattaaccctttagagacaagctt

SEQ ID NO: 171772 - DNA, 25 bp, Homo sapien
caggctgcggaccagacagatgctt

SEQ ID NO: 171773 - DNA, 25 bp, Homo sapien
gcggaccagacagatgcttagggaa

SEQ ID NO: 171774 - DNA, 25 bp, Homo sapien
aaggttgataccagcttcagtctct

SEQ ID NO: 171775 - DNA, 25 bp, Homo sapien
gataccagcttcagtctctactgga

SEQ ID NO: 171776 - DNA, 25 bp, Homo sapien
gtctctactggattagccctactct

SEQ ID NO: 171777 - DNA, 25 bp, Homo sapien
actggattagccctactctttcctt

SEQ ID NO: 171778 - DNA, 25 bp, Homo sapien
gtaactataatgaaatctgctgcaa

SEQ ID NO: 171779 - DNA, 25 bp, Homo sapien
aatctgctgcaaaatctctcttgga

SEQ ID NO: 171780 - DNA, 25 bp, Homo sapien
tccatgtgcccaggattatattagc

SEQ ID NO: 171781 - DNA, 25 bp, Homo sapien
gcccaggattatattagcattattt

SEQ ID NO: 171782 - DNA, 25 bp, Homo sapien
aacaggaatacatggaagtccggga

SEQ ID NO: 171783 - DNA, 25 bp, Homo sapien
ggagagaatacacagagccatcaac

SEQ ID NO: 171784 - DNA, 25 bp, Homo sapien
acagagccatcaacgacaacacaaa

SEQ ID NO: 171785 - DNA, 25 bp, Homo sapien
ctcttgttctagttgccatgacatt

SEQ ID NO: 171786 - DNA, 25 bp, Homo sapien
ccatgacattgggacagatctacta

SEQ ID NO: 171787 - DNA, 25 bp, Homo sapien
ggacagatctactacctgaagagat

SEQ ID NO: 171788 - DNA, 25 bp, Homo sapien
gattttttgaagtccggagagttgt

SEQ ID NO: 171789 - DNA, 25 bp, Homo sapien
tcttcctgatgatcccaactcagaa

SEQ ID NO: 171790 - DNA, 25 bp, Homo sapien
gatgatcccaactcagaattcactg

SEQ ID NO: 171791 - DNA, 25 bp, Homo sapien
gatcccaactcagaattcactgttt

SEQ ID NO: 171792 - DNA, 25 bp, Homo sapien
tgtcattagtttctccatttttatt

SEQ ID NO: 171793 - DNA, 25 bp, Homo sapien
ggcatcatggactgttaatgtatgt

SEQ ID NO: 171794 - DNA, 25 bp, Homo sapien
gttccttgggcagtggccatgtcac

SEQ ID NO: 171795 - DNA, 25 bp, Homo sapien
gtggccatgtcaccattgagatgaa

SEQ ID NO: 171796 - DNA, 25 bp, Homo sapien
cagccctgcacattttgaactagtc

SEQ ID NO: 171797 - DNA, 25 bp, Homo sapien
attttgaactagtcactctcccaga

SEQ ID NO: 171798 - DNA, 25 bp, Homo sapien
cagacttggcggtgggtcagttctt

SEQ ID NO: 171799 - DNA, 25 bp, Homo sapien
agttctttcctgagtagaggacttg

SEQ ID NO: 171800 - DNA, 25 bp, Homo sapien
gggcagatgctttttattagtactg

SEQ ID NO: 171801 - DNA, 25 bp, Homo sapien
gtactgattaaaccacactgaggga

SEQ ID NO: 171802 - DNA, 25 bp, Homo sapien
atccctcttagctgggaaactgttt

SEQ ID NO: 171803 - DNA, 25 bp, Homo sapien
gaaactgtttactcttcaggagctt

SEQ ID NO: 171804 - DNA, 25 bp, Homo sapien
gcatgaaaatcacactgtctgctga

SEQ ID NO: 171805 - DNA, 25 bp, Homo sapien
atcacactgtctgctgatatctgca

SEQ ID NO: 171806 - DNA, 25 bp, Homo sapien
ctgtctgctgatatctgcagggaca

SEQ ID NO: 171807 - DNA, 25 bp, Homo sapien
aaatgtggattaaagtgcccagcac

SEQ ID NO: 171808 - DNA, 25 bp, Homo sapien
tgcccagcacaaagcagatcctcaa

SEQ ID NO: 171809 - DNA, 25 bp, Homo sapien
caaagcagatcctcaataaacattt

SEQ ID NO: 171810 - DNA, 25 bp, Homo sapien
ttccctaatcttccacttgagtgtc

SEQ ID NO: 171811 - DNA, 25 bp, Homo sapien
cttgagtgtcaagctgaccttgctg

SEQ ID NO: 171812 - DNA, 25 bp, Homo sapien
ccttgctgatggtgacattgcacct

SEQ ID NO: 171813 - DNA, 25 bp, Homo sapien
gacattgcacctggatgtactatcc

SEQ ID NO: 171814 - DNA, 25 bp, Homo sapien
gatgtactatccaatctgtgatgac

SEQ ID NO: 171815 - DNA, 25 bp, Homo sapien
agatgatatccctgtttgggaccaa

SEQ ID NO: 171816 - DNA, 25 bp, Homo sapien
tgggaccaagaattcctgaaagttg

SEQ ID NO: 171817 - DNA, 25 bp, Homo sapien
cctgaaagttgaccaaggaacactt

SEQ ID NO: 171818 - DNA, 25 bp, Homo sapien
aggaacactttttgaactcattctg

SEQ ID NO: 171819 - DNA, 25 bp, Homo sapien
ttctggctgcaaactacttagacat

SEQ ID NO: 171820 - DNA, 25 bp, Homo sapien
caaaggtttgcttgatgttacatgc

SEQ ID NO: 171821 - DNA, 25 bp, Homo sapien
gatgttacatgcaagactgttgcca

SEQ ID NO: 171822 - DNA, 25 bp, Homo sapien
caagactgttgccaatatgatcaag

SEQ ID NO: 171823 - DNA, 25 bp, Homo sapien
aactcctgaggagattcgcaagacc

SEQ ID NO: 171824 - DNA, 25 bp, Homo sapien
gagattcgcaagaccttcaatatca

SEQ ID NO: 171825 - DNA, 25 bp, Homo sapien
aggaggaagcccaggtacgcaaaga

SEQ ID NO: 171826 - DNA, 25 bp, Homo sapien
gccggactccagatgcatttatttc

SEQ ID NO: 171827 - DNA, 25 bp, Homo sapien
ttatttcaagtttcgctcaccatgc

SEQ ID NO: 171828 - DNA, 25 bp, Homo sapien
gctcaccatgcttcatgtcatttta

SEQ ID NO: 171829 - DNA, 25 bp, Homo sapien
taatgtgccagtagagacaactgat

SEQ ID NO: 171830 - DNA, 25 bp, Homo sapien
aaataccatttagtttctctgacag

SEQ ID NO: 171831 - DNA, 25 bp, Homo sapien
ttctctgacaggctcagaatttctg

SEQ ID NO: 171832 - DNA, 25 bp, Homo sapien
tgaaaaatgacctccttgtttttga

SEQ ID NO: 171833 - DNA, 25 bp, Homo sapien
ttagatgcctgtgaaatagtactgc

SEQ ID NO: 171834 - DNA, 25 bp, Homo sapien
gaaatagtactgcacttacataaag

SEQ ID NO: 171835 - DNA, 25 bp, Homo sapien
actgtttcatagcaaacttcaggac

SEQ ID NO: 171836 - DNA, 25 bp, Homo sapien
aaacttcaggactttgagatgttga

SEQ ID NO: 171837 - DNA, 25 bp, Homo sapien
gctcacatttttgtgaatgtctgaa

SEQ ID NO: 171838 - DNA, 25 bp, Homo sapien
atgtctgaagtatatagtttgtgta

SEQ ID NO: 171839 - DNA, 25 bp, Homo sapien
gtttgtgtatattgacagagctctt

SEQ ID NO: 171840 - DNA, 25 bp, Homo sapien
attcagaattagtttaatgccttaa

SEQ ID NO: 171841 - DNA, 25 bp, Homo sapien
actaattaatagctttggacactta

SEQ ID NO: 171842 - DNA, 25 bp, Homo sapien
agagctctaaatttgcttgtacata

SEQ ID NO: 171843 - DNA, 25 bp, Homo sapien
tgttagggtcaagggtgtcctccac

SEQ ID NO: 171844 - DNA, 25 bp, Homo sapien
aagggtgtcctccactctttaacag

SEQ ID NO: 171845 - DNA, 25 bp, Homo sapien
tgtcctccactctttaacagctgct

SEQ ID NO: 171846 - DNA, 25 bp, Homo sapien
cagctgctggacagacacattagag

SEQ ID NO: 171847 - DNA, 25 bp, Homo sapien
tggacagacacattagagcagctgt

SEQ ID NO: 171848 - DNA, 25 bp, Homo sapien
aaggtaatgcaggtcctggtggcca

SEQ ID NO: 171849 - DNA, 25 bp, Homo sapien
cctggtggccaggtatgcagatgat

SEQ ID NO: 171850 - DNA, 25 bp, Homo sapien
atagactttgacagcttcatcagct

SEQ ID NO: 171851 - DNA, 25 bp, Homo sapien
gaggctaaagaccatgttcacattc

SEQ ID NO: 171852 - DNA, 25 bp, Homo sapien
gaccatgttcacattctttctaacc

SEQ ID NO: 171853 - DNA, 25 bp, Homo sapien
attctttctaaccatggaccccaag

SEQ ID NO: 171854 - DNA, 25 bp, Homo sapien
ggaccccaagaatactggccatatt

SEQ ID NO: 171855 - DNA, 25 bp, Homo sapien
aatactggccatatttgcttgagcc

SEQ ID NO: 171856 - DNA, 25 bp, Homo sapien
gaacagtggctgcagatgaccatgt

SEQ ID NO: 171857 - DNA, 25 bp, Homo sapien
tgtaggagcctggtcatctctacca

SEQ ID NO: 171858 - DNA, 25 bp, Homo sapien
gggtgcttcttgtagccctcagctc

SEQ ID NO: 171859 - DNA, 25 bp, Homo sapien
gggaacgatgtgtctgtatttcatg

SEQ ID NO: 171860 - DNA, 25 bp, Homo sapien
gtgtctgtatttcatgtggctgtag

SEQ ID NO: 171861 - DNA, 25 bp, Homo sapien
atttcatgtggctgtagatcccaag

SEQ ID NO: 171862 - DNA, 25 bp, Homo sapien
aagggtcatagaaagggccttgaca

SEQ ID NO: 171863 - DNA, 25 bp, Homo sapien
gaaagggccttgacatcagttcctt

SEQ ID NO: 171864 - DNA, 25 bp, Homo sapien
ggccttgacatcagttcctttgtgt

SEQ ID NO: 171865 - DNA, 25 bp, Homo sapien
catcagttcctttgtgtgtactcac

SEQ ID NO: 171866 - DNA, 25 bp, Homo sapien
ttgtgtgtactcactgaagcctgcg

SEQ ID NO: 171867 - DNA, 25 bp, Homo sapien
ctgaagcctgcgttggtccagagcg

SEQ ID NO: 171868 - DNA, 25 bp, Homo sapien
tggtccagagcggaggctgtgtgcc

SEQ ID NO: 171869 - DNA, 25 bp, Homo sapien
gggagttttcctctatacatctctc

SEQ ID NO: 171870 - DNA, 25 bp, Homo sapien
tttatgttgagtcgcgcaccgaaaa

SEQ ID NO: 171871 - DNA, 25 bp, Homo sapien
gttgagtcgcgcaccgaaaaactaa

SEQ ID NO: 171872 - DNA, 25 bp, Homo sapien
actaaaaataatgggcgctttggag

SEQ ID NO: 171873 - DNA, 25 bp, Homo sapien
gagtgtggagtcattctcattgaat

SEQ ID NO: 171874 - DNA, 25 bp, Homo sapien
attgaattataaaagccagcaggct

SEQ ID NO: 171875 - DNA, 25 bp, Homo sapien
aatcttatcaagagttgtgacaact

SEQ ID NO: 171876 - DNA, 25 bp, Homo sapien
ttgtgacaacttcctgagggatcta

SEQ ID NO: 171877 - DNA, 25 bp, Homo sapien
cttcctgagggatctatacttgctt

SEQ ID NO: 171878 - DNA, 25 bp, Homo sapien
agggatctatacttgctttgtgttc

SEQ ID NO: 171879 - DNA, 25 bp, Homo sapien
atctatacttgctttgtgttctttg

SEQ ID NO: 171880 - DNA, 25 bp, Homo sapien
gctttgtgttctttgtgtcaacatg

SEQ ID NO: 171881 - DNA, 25 bp, Homo sapien
catccttcgagaagcttcccaggct

SEQ ID NO: 171882 - DNA, 25 bp, Homo sapien
ttcgagaagcttcccaggctcctct

SEQ ID NO: 171883 - DNA, 25 bp, Homo sapien
gagaagcttcccaggctcctctgct

SEQ ID NO: 171884 - DNA, 25 bp, Homo sapien
ttctctgtctcatgctcccaggctg

SEQ ID NO: 171885 - DNA, 25 bp, Homo sapien
caccccttcccatttcatcggtggg

SEQ ID NO: 171886 - DNA, 25 bp, Homo sapien
ccaccaccctgctgtgcttgggaac

SEQ ID NO: 171887 - DNA, 25 bp, Homo sapien
accaccctgctgtgcttgggaaccc

SEQ ID NO: 171888 - DNA, 25 bp, Homo sapien
cacatcccaacatcctggtgtctgt

SEQ ID NO: 171889 - DNA, 25 bp, Homo sapien
acatcctggtgtctgtccccagtgg

SEQ ID NO: 171890 - DNA, 25 bp, Homo sapien
ggttggcgtgcatgtgtacatatgt

SEQ ID NO: 171891 - DNA, 25 bp, Homo sapien
gttggcgtgcatgtgtacatatgta

SEQ ID NO: 171892 - DNA, 25 bp, Homo sapien
ggaattccgccccttcattcgaagg

SEQ ID NO: 171893 - DNA, 25 bp, Homo sapien
tcattcgaaggctcccagagtttaa

SEQ ID NO: 171894 - DNA, 25 bp, Homo sapien
gcatgcggctaccaagggcatcctt

SEQ ID NO: 171895 - DNA, 25 bp, Homo sapien
tggctatggtctgtactttcttcga

SEQ ID NO: 171896 - DNA, 25 bp, Homo sapien
gtactttcttcgacgctttcaacgt

SEQ ID NO: 171897 - DNA, 25 bp, Homo sapien
tcaacgtcccggtgttctggccgat

SEQ ID NO: 171898 - DNA, 25 bp, Homo sapien
tggccgattctggtgatgtacttca

SEQ ID NO: 171899 - DNA, 25 bp, Homo sapien
ttcatcatgctcttctgtatcacga

SEQ ID NO: 171900 - DNA, 25 bp, Homo sapien
aagcacatgattaagtaccggtaca

SEQ ID NO: 171901 - DNA, 25 bp, Homo sapien
ggtacatcccgttcacacatgggaa

SEQ ID NO: 171902 - DNA, 25 bp, Homo sapien
ttcgccagctagaagcgggactgag

SEQ ID NO: 171903 - DNA, 25 bp, Homo sapien
catccttcgagaagcttcccaggct

SEQ ID NO: 171904 - DNA, 25 bp, Homo sapien
atccttcgagaagcttcccaggctc

SEQ ID NO: 171905 - DNA, 25 bp, Homo sapien
ttcgagaagcttcccaggctcctct

SEQ ID NO: 171906 - DNA, 25 bp, Homo sapien
tcgagaagcttcccaggctcctctg

SEQ ID NO: 171907 - DNA, 25 bp, Homo sapien
ccttcccatttcatcggtggggacg

SEQ ID NO: 171908 - DNA, 25 bp, Homo sapien
ttcccatttcatcggtggggacgtg

SEQ ID NO: 171909 - DNA, 25 bp, Homo sapien
ccaccaccctgctgtgcttgggaac

SEQ ID NO: 171910 - DNA, 25 bp, Homo sapien
accaccctgctgtgcttgggaaccc

SEQ ID NO: 171911 - DNA, 25 bp, Homo sapien
tgctgtgcttgggaacccccactcc

SEQ ID NO: 171912 - DNA, 25 bp, Homo sapien
tccccacatcccaacatcctggtgt

SEQ ID NO: 171913 - DNA, 25 bp, Homo sapien
ggggttggcgtgcatgtgtacatat

SEQ ID NO: 171914 - DNA, 25 bp, Homo sapien
tcctccaagatgaaaatggaccagc

SEQ ID NO: 171915 - DNA, 25 bp, Homo sapien
ctccaagatgaaaatggaccagccg

SEQ ID NO: 171916 - DNA, 25 bp, Homo sapien
tccaagatgaaaatggaccagccgc

SEQ ID NO: 171917 - DNA, 25 bp, Homo sapien
ccaagatgaaaatggaccagccgca

SEQ ID NO: 171918 - DNA, 25 bp, Homo sapien
aagatgaaaatggaccagccgcagt

SEQ ID NO: 171919 - DNA, 25 bp, Homo sapien
agatgaaaatggaccagccgcagtg

SEQ ID NO: 171920 - DNA, 25 bp, Homo sapien
gatgaaaatggaccagccgcagtgc

SEQ ID NO: 171921 - DNA, 25 bp, Homo sapien
atgaaaatggaccagccgcagtgct

SEQ ID NO: 171922 - DNA, 25 bp, Homo sapien
tgaaaatggaccagccgcagtgctc

SEQ ID NO: 171923 - DNA, 25 bp, Homo sapien
gaaaatggaccagccgcagtgctca

SEQ ID NO: 171924 - DNA, 25 bp, Homo sapien
atggaccagccgcagtgctcacgcc

SEQ ID NO: 171925 - DNA, 25 bp, Homo sapien
aggatctgctctgtgccggtcctct

SEQ ID NO: 171926 - DNA, 25 bp, Homo sapien
tgcctaggcctgagcgttgcctgga

SEQ ID NO: 171927 - DNA, 25 bp, Homo sapien
aggcctgagcgttgcctggagccta

SEQ ID NO: 171928 - DNA, 25 bp, Homo sapien
gacgctggccttcagacctgatcag

SEQ ID NO: 171929 - DNA, 25 bp, Homo sapien
ttcagacctgatcagactcccaggg

SEQ ID NO: 171930 - DNA, 25 bp, Homo sapien
gggcagccaccacatgtatgacaga

SEQ ID NO: 171931 - DNA, 25 bp, Homo sapien
gtatgacagagaacagaggatgcct

SEQ ID NO: 171932 - DNA, 25 bp, Homo sapien
agaggatgcctgtttttgccccaaa

SEQ ID NO: 171933 - DNA, 25 bp, Homo sapien
ttttgccccaaagctggaaattcat

SEQ ID NO: 171934 - DNA, 25 bp, Homo sapien
ggaaattcatcacaacctgaggccc

SEQ ID NO: 171935 - DNA, 25 bp, Homo sapien
attcatcacaacctgaggcccagga

SEQ ID NO: 171936 - DNA, 25 bp, Homo sapien
tcaaagattgtaaatagttcattca

SEQ ID NO: 171937 - DNA, 25 bp, Homo sapien
agttcattcaatcaatggtatagag

SEQ ID NO: 171938 - DNA, 25 bp, Homo sapien
aatggtatagagttatttatttgct

SEQ ID NO: 171939 - DNA, 25 bp, Homo sapien
tttgctacataatagatactgtgcc

SEQ ID NO: 171940 - DNA, 25 bp, Homo sapien
gctacataatagatactgtgccaaa

SEQ ID NO: 171941 - DNA, 25 bp, Homo sapien
cataatagatactgtgccaaataat

SEQ ID NO: 171942 - DNA, 25 bp, Homo sapien
ttttcctgttttcacaattagacta

SEQ ID NO: 171943 - DNA, 25 bp, Homo sapien
tcctgttttcacaattagactacat

SEQ ID NO: 171944 - DNA, 25 bp, Homo sapien
gttttcacaattagactacatttaa

SEQ ID NO: 171945 - DNA, 25 bp, Homo sapien
acatttaatgtgtaggaattgtatg

SEQ ID NO: 171946 - DNA, 25 bp, Homo sapien
gtaaataacatctagtatcttcact

SEQ ID NO: 171947 - DNA, 25 bp, Homo sapien
atcaacaccctttccgggaatggat

SEQ ID NO: 171948 - DNA, 25 bp, Homo sapien
gaggtgctttaactgatgcgagtct

SEQ ID NO: 171949 - DNA, 25 bp, Homo sapien
gatgcgagtctcacagagtcctatt

SEQ ID NO: 171950 - DNA, 25 bp, Homo sapien
agagtcctatttcagcaccagcttt

SEQ ID NO: 171951 - DNA, 25 bp, Homo sapien
tcagcaccagctttattggagtcaa

SEQ ID NO: 171952 - DNA, 25 bp, Homo sapien
gagtcaatggatttggaagccctgt

SEQ ID NO: 171953 - DNA, 25 bp, Homo sapien
gaagccctgtagaaacaaagtatcc

SEQ ID NO: 171954 - DNA, 25 bp, Homo sapien
agtatcccttgatgcagtacactct

SEQ ID NO: 171955 - DNA, 25 bp, Homo sapien
gcagtacactctggttgtcttccaa

SEQ ID NO: 171956 - DNA, 25 bp, Homo sapien
ttgtcttccaacgtcttcgggtctg

SEQ ID NO: 171957 - DNA, 25 bp, Homo sapien
ggattcagcaataccaaaaacaccg

SEQ ID NO: 171958 - DNA, 25 bp, Homo sapien
caggagtggaatgaccctcttgacc

SEQ ID NO: 171959 - DNA, 25 bp, Homo sapien
aggagtggaatgaccctcttgacca

SEQ ID NO: 171960 - DNA, 25 bp, Homo sapien
ctcttgaccatgaccttgaggccca

SEQ ID NO: 171961 - DNA, 25 bp, Homo sapien
ggcgtggaggccatgctgtgggaga

SEQ ID NO: 171962 - DNA, 25 bp, Homo sapien
ctgtgggagaggcaccgggagctga

SEQ ID NO: 171963 - DNA, 25 bp, Homo sapien
gcagaggcaggcacggtgcccacga

SEQ ID NO: 171964 - DNA, 25 bp, Homo sapien
acgagccctggcaaagtccccgagg

SEQ ID NO: 171965 - DNA, 25 bp, Homo sapien
gagccctggcaaagtccccgaggac

SEQ ID NO: 171966 - DNA, 25 bp, Homo sapien
ctggcaaagtccccgaggactcatt

SEQ ID NO: 171967 - DNA, 25 bp, Homo sapien
cccgaggactcattggcccggctgc

SEQ ID NO: 171968 - DNA, 25 bp, Homo sapien
caggacctccgcgaggcccatagct

SEQ ID NO: 171969 - DNA, 25 bp, Homo sapien
ctccaactcaacaacattctataat

SEQ ID NO: 171970 - DNA, 25 bp, Homo sapien
attctataattgataactccctgag

SEQ ID NO: 171971 - DNA, 25 bp, Homo sapien
taattgataactccctgagcctcaa

SEQ ID NO: 171972 - DNA, 25 bp, Homo sapien
gctctaccctcagcggatgataatc

SEQ ID NO: 171973 - DNA, 25 bp, Homo sapien
gacacctgcggagtgtctgctctat

SEQ ID NO: 171974 - DNA, 25 bp, Homo sapien
acacctgcggagtgtctgctctatc

SEQ ID NO: 171975 - DNA, 25 bp, Homo sapien
acctgcggagtgtctgctctatccc

SEQ ID NO: 171976 - DNA, 25 bp, Homo sapien
ctgcggagtgtctgctctatcccct

SEQ ID NO: 171977 - DNA, 25 bp, Homo sapien
tgcggagtgtctgctctatcccctt

SEQ ID NO: 171978 - DNA, 25 bp, Homo sapien
agctccaccctcagcggatgataat

SEQ ID NO: 171979 - DNA, 25 bp, Homo sapien
aagacacctcccgagtgtgtctgct

SEQ ID NO: 171980 - DNA, 25 bp, Homo sapien
ggatattgaacctggacaagagaga

SEQ ID NO: 171981 - DNA, 25 bp, Homo sapien
gagagaaggaacacctccgatcgaa

SEQ ID NO: 171982 - DNA, 25 bp, Homo sapien
gaacacctccgatcgaagaacgtaa

SEQ ID NO: 171983 - DNA, 25 bp, Homo sapien
aacgtaaagtagaaggtgattgcca

SEQ ID NO: 171984 - DNA, 25 bp, Homo sapien
aaggtgattgccaggaaatggatct

SEQ ID NO: 171985 - DNA, 25 bp, Homo sapien
gatctggaaaagactcggagtgagc

SEQ ID NO: 171986 - DNA, 25 bp, Homo sapien
agagaagactccacctaatcctaag

SEQ ID NO: 171987 - DNA, 25 bp, Homo sapien
aatcctaagcatgctaagactaaag

SEQ ID NO: 171988 - DNA, 25 bp, Homo sapien
gatgggcagccataagttaaaaaga

SEQ ID NO: 171989 - DNA, 25 bp, Homo sapien
agctgaagctacacacatggctgat

SEQ ID NO: 171990 - DNA, 25 bp, Homo sapien
cacacatggctgatgtcacattgaa

SEQ ID NO: 171991 - DNA, 25 bp, Homo sapien
tcccttatactttttgatcagagaa

SEQ ID NO: 171992 - DNA, 25 bp, Homo sapien
ggaatcattggccagtgttacgttt

SEQ ID NO: 171993 - DNA, 25 bp, Homo sapien
ggccagtgttacgttttcacattgt

SEQ ID NO: 171994 - DNA, 25 bp, Homo sapien
acgttttcacattgtctgtctccca

SEQ ID NO: 171995 - DNA, 25 bp, Homo sapien
tcacgcctgccccagagcagtgtgt

SEQ ID NO: 171996 - DNA, 25 bp, Homo sapien
tgtgtggcggtgacaccgtcaccca

SEQ ID NO: 171997 - DNA, 25 bp, Homo sapien
accttgcagtggctttcttgtcatc

SEQ ID NO: 171998 - DNA, 25 bp, Homo sapien
tgcagtggctttcttgtcatcagag

SEQ ID NO: 171999 - DNA, 25 bp, Homo sapien
gtggctttcttgtcatcagagtaga

SEQ ID NO: 172000 - DNA, 25 bp, Homo sapien
tcagagtagagaatgcacaggtgtt

SEQ ID NO: 172001 - DNA, 25 bp, Homo sapien
gggcgtgtggctgagcactacatgt

SEQ ID NO: 172002 - DNA, 25 bp, Homo sapien
tcaacctcatcgtcctgtcccagca

SEQ ID NO: 172003 - DNA, 25 bp, Homo sapien
tcgtcctgtcccagcacctgggcaa

SEQ ID NO: 172004 - DNA, 25 bp, Homo sapien
ctgaaggatgcccacaggtcccatc

SEQ ID NO: 172005 - DNA, 25 bp, Homo sapien
ccatcccttcatcaaggagtaccag

SEQ ID NO: 172006 - DNA, 25 bp, Homo sapien
atcccttcatcaaggagtaccaggc

SEQ ID NO: 172007 - DNA, 25 bp, Homo sapien
gctggcccagagctgtcaggaccat

SEQ ID NO: 172008 - DNA, 25 bp, Homo sapien
ggcccagagctgtcaggaccatgaa

SEQ ID NO: 172009 - DNA, 25 bp, Homo sapien
gcccagagctgtcaggaccatgaag

SEQ ID NO: 172010 - DNA, 25 bp, Homo sapien
cccagagctgtcaggaccatgaagc

SEQ ID NO: 172011 - DNA, 25 bp, Homo sapien
cagagctgtcaggaccatgaagcca

SEQ ID NO: 172012 - DNA, 25 bp, Homo sapien
agagctgtcaggaccatgaagccag

SEQ ID NO: 172013 - DNA, 25 bp, Homo sapien
ggacagaaaattccctgacaggtgg

SEQ ID NO: 172014 - DNA, 25 bp, Homo sapien
gtgggcaagtatcaggttacctatt

SEQ ID NO: 172015 - DNA, 25 bp, Homo sapien
tacaaaagggttgaacgtcaggcta

SEQ ID NO: 172016 - DNA, 25 bp, Homo sapien
ggctaaaaaagcagccatgcattta

SEQ ID NO: 172017 - DNA, 25 bp, Homo sapien
tattaagcattttctaccgacaagg

SEQ ID NO: 172018 - DNA, 25 bp, Homo sapien
ttctaccgacaaggcactgtgctag

SEQ ID NO: 172019 - DNA, 25 bp, Homo sapien
gtgctaggtactgtaatctaccata

SEQ ID NO: 172020 - DNA, 25 bp, Homo sapien
agtaggtaggtatttcttccactgt

SEQ ID NO: 172021 - DNA, 25 bp, Homo sapien
atttcttccactgtaaatcataggg

SEQ ID NO: 172022 - DNA, 25 bp, Homo sapien
ttttatgtgagttagcctcttcccc

SEQ ID NO: 172023 - DNA, 25 bp, Homo sapien
gtcacctgtgaggttcccagaactg

SEQ ID NO: 172024 - DNA, 25 bp, Homo sapien
atttctcccttctgagttattctct

SEQ ID NO: 172025 - DNA, 25 bp, Homo sapien
ctgagttattctctctgttggtggc

SEQ ID NO: 172026 - DNA, 25 bp, Homo sapien
aaaccacttcatagcaccaacagag

SEQ ID NO: 172027 - DNA, 25 bp, Homo sapien
gtatttgtcatttctgagtcgcctg

SEQ ID NO: 172028 - DNA, 25 bp, Homo sapien
gtcatttctgagtcgcctgcattat

SEQ ID NO: 172029 - DNA, 25 bp, Homo sapien
tcgcctgcattatcccattcttatt

SEQ ID NO: 172030 - DNA, 25 bp, Homo sapien
attatcccattcttattctcctcaa

SEQ ID NO: 172031 - DNA, 25 bp, Homo sapien
aaacctgtgcatatatgacatgaaa

SEQ ID NO: 172032 - DNA, 25 bp, Homo sapien
gtgcctgccacaaaaacaagtgccc

SEQ ID NO: 172033 - DNA, 25 bp, Homo sapien
ccccgacaagatagttgctatgtta

SEQ ID NO: 172034 - DNA, 25 bp, Homo sapien
tgctatgttatgacactttctcaga

SEQ ID NO: 172035 - DNA, 25 bp, Homo sapien
agagagcttcgagggcaaggccacc

SEQ ID NO: 172036 - DNA, 25 bp, Homo sapien
gcttggcatgtgatggcagctccag

SEQ ID NO: 172037 - DNA, 25 bp, Homo sapien
gcatgtgatggcagctccagctcca

SEQ ID NO: 172038 - DNA, 25 bp, Homo sapien
agctccaggcatgccgctgcttgta

SEQ ID NO: 172039 - DNA, 25 bp, Homo sapien
aggcatgccgctgcttgtatggctt

SEQ ID NO: 172040 - DNA, 25 bp, Homo sapien
tgtatggctttctttggcctctgac

SEQ ID NO: 172041 - DNA, 25 bp, Homo sapien
agtggtggagccagtcgctgtaaca

SEQ ID NO: 172042 - DNA, 25 bp, Homo sapien
agtcgctgtaacactgagcctcaga

SEQ ID NO: 172043 - DNA, 25 bp, Homo sapien
tgagcctcagagacgaaccaaaacc

SEQ ID NO: 172044 - DNA, 25 bp, Homo sapien
gacgaaccaaaaccagctgggctga

SEQ ID NO: 172045 - DNA, 25 bp, Homo sapien
accaaaaccagctgggctgagctca

SEQ ID NO: 172046 - DNA, 25 bp, Homo sapien
taggcaaaccatttcttaaagttga

SEQ ID NO: 172047 - DNA, 25 bp, Homo sapien
catatcatttataatcttgtcacaa

SEQ ID NO: 172048 - DNA, 25 bp, Homo sapien
aatcttgtcacaatccacttaaaga

SEQ ID NO: 172049 - DNA, 25 bp, Homo sapien
gaagtttggttatatttcagtgaaa

SEQ ID NO: 172050 - DNA, 25 bp, Homo sapien
gtgaaaattttcttccagagtaggt

SEQ ID NO: 172051 - DNA, 25 bp, Homo sapien
gtaagtatggtgcagaatttcatgc

SEQ ID NO: 172052 - DNA, 25 bp, Homo sapien
tttcatgcaaatgaggagtgccagc

SEQ ID NO: 172053 - DNA, 25 bp, Homo sapien
gagtgccagcagtgtgataatttaa

SEQ ID NO: 172054 - DNA, 25 bp, Homo sapien
gaatgcacaaacttgctgctgctta

SEQ ID NO: 172055 - DNA, 25 bp, Homo sapien
aacttgctgctgcttagatcactgc

SEQ ID NO: 172056 - DNA, 25 bp, Homo sapien
gcttagatcactgcagcttctagga

SEQ ID NO: 172057 - DNA, 25 bp, Homo sapien
aagctggagatgaactatgtggtcg

SEQ ID NO: 172058 - DNA, 25 bp, Homo sapien
tcccaccgaaatgttgtcaacgtcc

SEQ ID NO: 172059 - DNA, 25 bp, Homo sapien
atcttcgtctctgagtactggttct

SEQ ID NO: 172060 - DNA, 25 bp, Homo sapien
tactggttctgagggctggtctgcc

SEQ ID NO: 172061 - DNA, 25 bp, Homo sapien
ggtctgccgcacagccgcaggtgca

SEQ ID NO: 172062 - DNA, 25 bp, Homo sapien
ggccaaatcattgctgccagtgact

SEQ ID NO: 172063 - DNA, 25 bp, Homo sapien
gccagtgactgtggtctgtacttgt

SEQ ID NO: 172064 - DNA, 25 bp, Homo sapien
ggtctgtacttgtttataccctcag

SEQ ID NO: 172065 - DNA, 25 bp, Homo sapien
tacttgtttataccctcagactttt

SEQ ID NO: 172066 - DNA, 25 bp, Homo sapien
gtccatctgatgtattttcggtgtt

SEQ ID NO: 172067 - DNA, 25 bp, Homo sapien
aaatgagcccagttgctcaactgtt

SEQ ID NO: 172068 - DNA, 25 bp, Homo sapien
gtcatggacagtggctatcggccta

SEQ ID NO: 172069 - DNA, 25 bp, Homo sapien
tatcggcctaatcttagccctgaag

SEQ ID NO: 172070 - DNA, 25 bp, Homo sapien
tagccctgaagaggcctatgacctt

SEQ ID NO: 172071 - DNA, 25 bp, Homo sapien
accttggccgcagggctattgctta

SEQ ID NO: 172072 - DNA, 25 bp, Homo sapien
tattgcttatgccactcacagagac

SEQ ID NO: 172073 - DNA, 25 bp, Homo sapien
agctattctggaggcgttgtcaata

SEQ ID NO: 172074 - DNA, 25 bp, Homo sapien
ggcgttgtcaatatgtaccacatga

SEQ ID NO: 172075 - DNA, 25 bp, Homo sapien
tgacctgctgcaccagtaccgggaa

SEQ ID NO: 172076 - DNA, 25 bp, Homo sapien
accagtaccgggaagccaatcaata

SEQ ID NO: 172077 - DNA, 25 bp, Homo sapien
ctctgggaggtcttggccgactcag

SEQ ID NO: 172078 - DNA, 25 bp, Homo sapien
actcagggacctaagccacgttaag

SEQ ID NO: 172079 - DNA, 25 bp, Homo sapien
aaaatggcagagatctcgtcgtcct

SEQ ID NO: 172080 - DNA, 25 bp, Homo sapien
aatggcagagatctcgtcgtcctcg

SEQ ID NO: 172081 - DNA, 25 bp, Homo sapien
tggcagagatctcgtcgtcctcgtc

SEQ ID NO: 172082 - DNA, 25 bp, Homo sapien
tcccgtacgcgtcgtcgctgggcta

SEQ ID NO: 172083 - DNA, 25 bp, Homo sapien
tacgcgtcgtcgctgggctacccga

SEQ ID NO: 172084 - DNA, 25 bp, Homo sapien
tgggctacccgaccgcgggcgcggg

SEQ ID NO: 172085 - DNA, 25 bp, Homo sapien
ggcaacccgggctacatgatcccgt

SEQ ID NO: 172086 - DNA, 25 bp, Homo sapien
aacccgggctacatgatcccgtgca

SEQ ID NO: 172087 - DNA, 25 bp, Homo sapien
gggctacatgatcccgtgcaactgc

SEQ ID NO: 172088 - DNA, 25 bp, Homo sapien
gcctacatcctgctgccgggcatgg

SEQ ID NO: 172089 - DNA, 25 bp, Homo sapien
tgctgccgggcatgggcaagcccca

SEQ ID NO: 172090 - DNA, 25 bp, Homo sapien
atgtcttatcaacagcagcagtgca

SEQ ID NO: 172091 - DNA, 25 bp, Homo sapien
gtcttatcaacagcagcagtgcaag

SEQ ID NO: 172092 - DNA, 25 bp, Homo sapien
agaaatatcctcctgtgacaccttc

SEQ ID NO: 172093 - DNA, 25 bp, Homo sapien
tgccagccaaagtatccaccgaaga

SEQ ID NO: 172094 - DNA, 25 bp, Homo sapien
gccagccaaagtatccaccgaagag

SEQ ID NO: 172095 - DNA, 25 bp, Homo sapien
ccagccaaagtatccaccgaagagc

SEQ ID NO: 172096 - DNA, 25 bp, Homo sapien
cagccaaagtatccaccgaagagca

SEQ ID NO: 172097 - DNA, 25 bp, Homo sapien
agccaaagtatccaccgaagagcaa

SEQ ID NO: 172098 - DNA, 25 bp, Homo sapien
gccaaagtatccaccgaagagcaag

SEQ ID NO: 172099 - DNA, 25 bp, Homo sapien
ccaaagtatccaccgaagagcaagt

SEQ ID NO: 172100 - DNA, 25 bp, Homo sapien
caaagtatccaccgaagagcaagta

SEQ ID NO: 172101 - DNA, 25 bp, Homo sapien
agtgcttagtgtttgatgtcattaa

SEQ ID NO: 172102 - DNA, 25 bp, Homo sapien
gtttcgtaaaactctacagtgtaga

SEQ ID NO: 172103 - DNA, 25 bp, Homo sapien
gattttgatactaaactgtgcgttg

SEQ ID NO: 172104 - DNA, 25 bp, Homo sapien
actgtgcgttgtacatagttctaat

SEQ ID NO: 172105 - DNA, 25 bp, Homo sapien
tctaatgcattgtattgaccaccag

SEQ ID NO: 172106 - DNA, 25 bp, Homo sapien
attgaccaccagtacttctataatg

SEQ ID NO: 172107 - DNA, 25 bp, Homo sapien
atggatcaaatcaaagaccgtgtag

SEQ ID NO: 172108 - DNA, 25 bp, Homo sapien
tgctgcaagttgaaatggactgtcc

SEQ ID NO: 172109 - DNA, 25 bp, Homo sapien
tggactgtccattgacgttcctaat

SEQ ID NO: 172110 - DNA, 25 bp, Homo sapien
tgacgttcctaatgtggtagcagaa

SEQ ID NO: 172111 - DNA, 25 bp, Homo sapien
aaaaatggtgtcttaagtgcttagt

SEQ ID NO: 172112 - DNA, 25 bp, Homo sapien
ttgggcttggcttcccgccttgtct

SEQ ID NO: 172113 - DNA, 25 bp, Homo sapien
agtggaccggctcaagaaatatgaa

SEQ ID NO: 172114 - DNA, 25 bp, Homo sapien
aaatatgaagctgcctatggaaaac

SEQ ID NO: 172115 - DNA, 25 bp, Homo sapien
gaagttctaccagtgagcaggcctc

SEQ ID NO: 172116 - DNA, 25 bp, Homo sapien
gttctaccagtgagcaggcctcatg

SEQ ID NO: 172117 - DNA, 25 bp, Homo sapien
aggcctcatgcctcgctcagtcagt

SEQ ID NO: 172118 - DNA, 25 bp, Homo sapien
tcagtcagtgcactaaccccagctg

SEQ ID NO: 172119 - DNA, 25 bp, Homo sapien
agctgccggcagtgctggttctcca

SEQ ID NO: 172120 - DNA, 25 bp, Homo sapien
ggcagtgctggttctccaacagagt

SEQ ID NO: 172121 - DNA, 25 bp, Homo sapien
tgctggttctccaacagagtggtgt

SEQ ID NO: 172122 - DNA, 25 bp, Homo sapien
tggtgtctagatttatcagagtaac

SEQ ID NO: 172123 - DNA, 25 bp, Homo sapien
gttcccgtcgctgacaaagccacca

SEQ ID NO: 172124 - DNA, 25 bp, Homo sapien
agctgcctcctttaagcttggtgct

SEQ ID NO: 172125 - DNA, 25 bp, Homo sapien
gcctcctttaagcttggtgctccgg

SEQ ID NO: 172126 - DNA, 25 bp, Homo sapien
tttaagcttggtgctccggctctgg

SEQ ID NO: 172127 - DNA, 25 bp, Homo sapien
ggctctgggcctttcttgcgctctt

SEQ ID NO: 172128 - DNA, 25 bp, Homo sapien
ctttcttgcgctctttctatttttt

SEQ ID NO: 172129 - DNA, 25 bp, Homo sapien
aacgtcatgtgagtgaagagatgtc

SEQ ID NO: 172130 - DNA, 25 bp, Homo sapien
aagagatgtcactgtctgtggtctt

SEQ ID NO: 172131 - DNA, 25 bp, Homo sapien
agatgtcactgtctgtggtcttgga

SEQ ID NO: 172132 - DNA, 25 bp, Homo sapien
cttggagaactagtctcgtagctga

SEQ ID NO: 172133 - DNA, 25 bp, Homo sapien
gggcactggcacccacagcaggact

SEQ ID NO: 172134 - DNA, 25 bp, Homo sapien
tctcttcttccattaggatgctaca

SEQ ID NO: 172135 - DNA, 25 bp, Homo sapien
ctcttcttccattaggatgctacaa

SEQ ID NO: 172136 - DNA, 25 bp, Homo sapien
tcttcttccattaggatgctacaag

SEQ ID NO: 172137 - DNA, 25 bp, Homo sapien
cttcttccattaggatgctacaagt

SEQ ID NO: 172138 - DNA, 25 bp, Homo sapien
ttcttccattaggatgctacaagta

SEQ ID NO: 172139 - DNA, 25 bp, Homo sapien
tcagtgaaggcccatgaagggaatt

SEQ ID NO: 172140 - DNA, 25 bp, Homo sapien
cagtgaaggcccatgaagggaattg

SEQ ID NO: 172141 - DNA, 25 bp, Homo sapien
gaacgtattcattacagtttataaa

SEQ ID NO: 172142 - DNA, 25 bp, Homo sapien
aacgtattcattacagtttataaag

SEQ ID NO: 172143 - DNA, 25 bp, Homo sapien
acgtattcattacagtttataaagg

SEQ ID NO: 172144 - DNA, 25 bp, Homo sapien
gtattcattacagtttataaaggcc

SEQ ID NO: 172145 - DNA, 25 bp, Homo sapien
ggtctgccgtcggtcctgctgctaa

SEQ ID NO: 172146 - DNA, 25 bp, Homo sapien
agtcccagggccatctcttggagtg

SEQ ID NO: 172147 - DNA, 25 bp, Homo sapien
ggccatctcttggagtgacaaagct

SEQ ID NO: 172148 - DNA, 25 bp, Homo sapien
agagcagtgccagagcatgggccca

SEQ ID NO: 172149 - DNA, 25 bp, Homo sapien
agtgccagagcatgggcccaggtcc

SEQ ID NO: 172150 - DNA, 25 bp, Homo sapien
caggccactggcatgtgctgagtag

SEQ ID NO: 172151 - DNA, 25 bp, Homo sapien
gcatgtgctgagtagcgcagagcta

SEQ ID NO: 172152 - DNA, 25 bp, Homo sapien
gcagagctacccagtgagaggcctt

SEQ ID NO: 172153 - DNA, 25 bp, Homo sapien
gtgagaggccttgtctaactgcctt

SEQ ID NO: 172154 - DNA, 25 bp, Homo sapien
ttgtctaactgcctttccttctaaa

SEQ ID NO: 172155 - DNA, 25 bp, Homo sapien
tgcctttccttctaaagggaatgtt

SEQ ID NO: 172156 - DNA, 25 bp, Homo sapien
ggaacctgtgtttcacgtgactcag

SEQ ID NO: 172157 - DNA, 25 bp, Homo sapien
agctatgcattcactccgtttccag

SEQ ID NO: 172158 - DNA, 25 bp, Homo sapien
tccgtttccagtgagcagatgtctt

SEQ ID NO: 172159 - DNA, 25 bp, Homo sapien
tgagcagatgtcttgcttggaaagt

SEQ ID NO: 172160 - DNA, 25 bp, Homo sapien
ggaaagtggacctgtgtctgtgtct

SEQ ID NO: 172161 - DNA, 25 bp, Homo sapien
gtctgtgtctgtcctgagaacttac

SEQ ID NO: 172162 - DNA, 25 bp, Homo sapien
gaacttaccagcagaaatcctcatt

SEQ ID NO: 172163 - DNA, 25 bp, Homo sapien
gaaatcctcatttctgtgctacgga

SEQ ID NO: 172164 - DNA, 25 bp, Homo sapien
atttctgtgctacggatttaccaaa

SEQ ID NO: 172165 - DNA, 25 bp, Homo sapien
tgtcaagtctttttcagtttaacag

SEQ ID NO: 172166 - DNA, 25 bp, Homo sapien
aacagttcctttacatgtgtagtat

SEQ ID NO: 172167 - DNA, 25 bp, Homo sapien
tgacgggccgcaagttcgccaacag

SEQ ID NO: 172168 - DNA, 25 bp, Homo sapien
ccgcaagttcgccaacagagtggtt

SEQ ID NO: 172169 - DNA, 25 bp, Homo sapien
cagagtggttgtcacaaaatactgt

SEQ ID NO: 172170 - DNA, 25 bp, Homo sapien
aaaatactgtgaccccgactcttat

SEQ ID NO: 172171 - DNA, 25 bp, Homo sapien
tatcaccgccgggacttctggtaga

SEQ ID NO: 172172 - DNA, 25 bp, Homo sapien
caccgccgggacttctggtagaggc

SEQ ID NO: 172173 - DNA, 25 bp, Homo sapien
cagaggagtgacagccgcagacaca

SEQ ID NO: 172174 - DNA, 25 bp, Homo sapien
agtgacagccgcagacacacgacag

SEQ ID NO: 172175 - DNA, 25 bp, Homo sapien
gcagacacacgacagccggcagcaa

SEQ ID NO: 172176 - DNA, 25 bp, Homo sapien
ccggcagcaactggaatggcagcaa

SEQ ID NO: 172177 - DNA, 25 bp, Homo sapien
gcagcaactggaatggcagcaatta

SEQ ID NO: 172178 - DNA, 25 bp, Homo sapien
agtgaaccatgtgccctgcccgaaa

SEQ ID NO: 172179 - DNA, 25 bp, Homo sapien
gaaccatgtgccctgcccgaaaggc

SEQ ID NO: 172180 - DNA, 25 bp, Homo sapien
gaaaggccttccctgtacaccaagg

SEQ ID NO: 172181 - DNA, 25 bp, Homo sapien
aaggccttccctgtacaccaaggtg

SEQ ID NO: 172182 - DNA, 25 bp, Homo sapien
tattgtagtaaacttggaaccttgg

SEQ ID NO: 172183 - DNA, 25 bp, Homo sapien
tggaaccttggaaatgaccaggcca

SEQ ID NO: 172184 - DNA, 25 bp, Homo sapien
ttggaaatgaccaggccaagactca

SEQ ID NO: 172185 - DNA, 25 bp, Homo sapien
agttctactgacctttgtccttagg

SEQ ID NO: 172186 - DNA, 25 bp, Homo sapien
tactgacctttgtccttaggtgtga

SEQ ID NO: 172187 - DNA, 25 bp, Homo sapien
ctttgtccttaggtgtgaggtccag

SEQ ID NO: 172188 - DNA, 25 bp, Homo sapien
gtgaggtccagggttgctaggaaaa

SEQ ID NO: 172189 - DNA, 25 bp, Homo sapien
ggtggagggtccctaattctcttcg

SEQ ID NO: 172190 - DNA, 25 bp, Homo sapien
taattctcttcgctgtgatgcatga

SEQ ID NO: 172191 - DNA, 25 bp, Homo sapien
ttcgctgtgatgcatgagctccctc

SEQ ID NO: 172192 - DNA, 25 bp, Homo sapien
tgagctccctcgctgtatgatttag

SEQ ID NO: 172193 - DNA, 25 bp, Homo sapien
ctcgctgtatgatttaggcttctat

SEQ ID NO: 172194 - DNA, 25 bp, Homo sapien
taggcttctatgtccaacagagtgg

SEQ ID NO: 172195 - DNA, 25 bp, Homo sapien
atccaccaccttgccaatggtgtag

SEQ ID NO: 172196 - DNA, 25 bp, Homo sapien
aatggtgtagctgtcctctcagaac

SEQ ID NO: 172197 - DNA, 25 bp, Homo sapien
cctctcagaactcctgtgtgtggaa

SEQ ID NO: 172198 - DNA, 25 bp, Homo sapien
tttccttgccttctttactcggcgt

SEQ ID NO: 172199 - DNA, 25 bp, Homo sapien
ttactcggcgtgctccttttctctt

SEQ ID NO: 172200 - DNA, 25 bp, Homo sapien
tgtgagatgatctgttactgcaact

SEQ ID NO: 172201 - DNA, 25 bp, Homo sapien
aacttcagcgaattgctctgctgcc

SEQ ID NO: 172202 - DNA, 25 bp, Homo sapien
gcgaattgctctgctgcccaaaaga

SEQ ID NO: 172203 - DNA, 25 bp, Homo sapien
gctgcccaaaagacgttttctttgg

SEQ ID NO: 172204 - DNA, 25 bp, Homo sapien
tctttggaccaaagatctctttcgt

SEQ ID NO: 172205 - DNA, 25 bp, Homo sapien
agatctctttcgtgattccttgcaa

SEQ ID NO: 172206 - DNA, 25 bp, Homo sapien
gtgattccttgcaacaatcaatgag

SEQ ID NO: 172207 - DNA, 25 bp, Homo sapien
aatgagaatcttcatgtattctgga

SEQ ID NO: 172208 - DNA, 25 bp, Homo sapien
attctggagaacaccattcctgatt

SEQ ID NO: 172209 - DNA, 25 bp, Homo sapien
cattcctgatttcccacaaactgca

SEQ ID NO: 172210 - DNA, 25 bp, Homo sapien
aactgcactacatcagtataactgc

SEQ ID NO: 172211 - DNA, 25 bp, Homo sapien
gagctagcttggaagattgctaaaa

SEQ ID NO: 172212 - DNA, 25 bp, Homo sapien
atagtcagtgacattatgcagcagg

SEQ ID NO: 172213 - DNA, 25 bp, Homo sapien
tgcagcaggctcagtatgatcaacc

SEQ ID NO: 172214 - DNA, 25 bp, Homo sapien
aggctcagtatgatcaaccgttaga

SEQ ID NO: 172215 - DNA, 25 bp, Homo sapien
ggttggattcttcaacacagccaat

SEQ ID NO: 172216 - DNA, 25 bp, Homo sapien
cagccaatgaaaacagcactatatt

SEQ ID NO: 172217 - DNA, 25 bp, Homo sapien
gcactatatttctgatctgtcactg

SEQ ID NO: 172218 - DNA, 25 bp, Homo sapien
gacaatcctaggacttccaccctaa

SEQ ID NO: 172219 - DNA, 25 bp, Homo sapien
ctaggacttccaccctaatgcagtt

SEQ ID NO: 172220 - DNA, 25 bp, Homo sapien
tacctgtagggcataattggatggc

SEQ ID NO: 172221 - DNA, 25 bp, Homo sapien
ataattggatggcacatgatgtttc

SEQ ID NO: 172222 - DNA, 25 bp, Homo sapien
tcatggacgcagacctcacgggacg

SEQ ID NO: 172223 - DNA, 25 bp, Homo sapien
gacgcagacctcacgggacgggcct

SEQ ID NO: 172224 - DNA, 25 bp, Homo sapien
tcatcctccttttttaatccagcag

SEQ ID NO: 172225 - DNA, 25 bp, Homo sapien
gtcaaccctttctcctgttggacta

SEQ ID NO: 172226 - DNA, 25 bp, Homo sapien
tttctcctgttggactacagttcag

SEQ ID NO: 172227 - DNA, 25 bp, Homo sapien
gactacagttcagaggcagcctgca

SEQ ID NO: 172228 - DNA, 25 bp, Homo sapien
acagttcagaggcagcctgcagtcc

SEQ ID NO: 172229 - DNA, 25 bp, Homo sapien
tgcagtcctcccatgatagccaggg

SEQ ID NO: 172230 - DNA, 25 bp, Homo sapien
atgatagccagggagagccgcacaa

SEQ ID NO: 172231 - DNA, 25 bp, Homo sapien
gggagagccgcacaacatacaatta

SEQ ID NO: 172232 - DNA, 25 bp, Homo sapien
gagccgcacaacatacaattatatt

SEQ ID NO: 172233 - DNA, 25 bp, Homo sapien
tttccagctggctcagaattggatc

SEQ ID NO: 172234 - DNA, 25 bp, Homo sapien
gctggctcagaattggatccgaacc

SEQ ID NO: 172235 - DNA, 25 bp, Homo sapien
ggatccgaaccaattttgatgtcta

SEQ ID NO: 172236 - DNA, 25 bp, Homo sapien
accaattttgatgtctactcgcaga

SEQ ID NO: 172237 - DNA, 25 bp, Homo sapien
gatgtctactcgcagaagtcagcca

SEQ ID NO: 172238 - DNA, 25 bp, Homo sapien
tactcgcagaagtcagccatgtatg

SEQ ID NO: 172239 - DNA, 25 bp, Homo sapien
gaagtcagccatgtatgagaagtat

SEQ ID NO: 172240 - DNA, 25 bp, Homo sapien
atgagaagtatgacgtcagcaacgg

SEQ ID NO: 172241 - DNA, 25 bp, Homo sapien
tgacgtcagcaacggtggacagccc

SEQ ID NO: 172242 - DNA, 25 bp, Homo sapien
tggaccgctatggtgaccggctgac

SEQ ID NO: 172243 - DNA, 25 bp, Homo sapien
aagctggctttcctggagccccact

SEQ ID NO: 172244 - DNA, 25 bp, Homo sapien
gaaagtcccaaaaagccgggcagag

SEQ ID NO: 172245 - DNA, 25 bp, Homo sapien
atcgagctggaaaatgacctaaagt

SEQ ID NO: 172246 - DNA, 25 bp, Homo sapien
gacctaaagtcattacagttttatt

SEQ ID NO: 172247 - DNA, 25 bp, Homo sapien
ttctgtggaaaatggagattgtcta

SEQ ID NO: 172248 - DNA, 25 bp, Homo sapien
tctattagtgcgatggtgacaacca

SEQ ID NO: 172249 - DNA, 25 bp, Homo sapien
gtgcgatggtgacaaccaactaata

SEQ ID NO: 172250 - DNA, 25 bp, Homo sapien
gaccacactgcttatcgtgtctggg

SEQ ID NO: 172251 - DNA, 25 bp, Homo sapien
gaacaattctactgtcaaaacaaag

SEQ ID NO: 172252 - DNA, 25 bp, Homo sapien
ttacaacttgtcctaagtataacaa

SEQ ID NO: 172253 - DNA, 25 bp, Homo sapien
gggaagtgaccatttctaggcttat

SEQ ID NO: 172254 - DNA, 25 bp, Homo sapien
gtgaccatttctaggcttatacata

SEQ ID NO: 172255 - DNA, 25 bp, Homo sapien
gatggtacagatgttcctgccttag

SEQ ID NO: 172256 - DNA, 25 bp, Homo sapien
acagatgttcctgccttagagtcat

SEQ ID NO: 172257 - DNA, 25 bp, Homo sapien
ttagagtcatctctagttccccacc

SEQ ID NO: 172258 - DNA, 25 bp, Homo sapien
gtgctagctccgtgggcccaccgtg

SEQ ID NO: 172259 - DNA, 25 bp, Homo sapien
gtgcggccttagaggtttccctcct

SEQ ID NO: 172260 - DNA, 25 bp, Homo sapien
tttccactgaaaagcacatggcctt

SEQ ID NO: 172261 - DNA, 25 bp, Homo sapien
aaagcacatggccttgggtgacaaa

SEQ ID NO: 172262 - DNA, 25 bp, Homo sapien
tggccttgggtgacaaattcctctt

SEQ ID NO: 172263 - DNA, 25 bp, Homo sapien
gggtgacaaattcctctttgatgaa

SEQ ID NO: 172264 - DNA, 25 bp, Homo sapien
tcctctttgatgaatgtaccctgtg

SEQ ID NO: 172265 - DNA, 25 bp, Homo sapien
gggatgtttcatactgacagattat

SEQ ID NO: 172266 - DNA, 25 bp, Homo sapien
gtgggaccgttgttaacacgtgaca

SEQ ID NO: 172267 - DNA, 25 bp, Homo sapien
gaccgttgttaacacgtgacactgt

SEQ ID NO: 172268 - DNA, 25 bp, Homo sapien
tgttaacacgtgacactgtgggtct

SEQ ID NO: 172269 - DNA, 25 bp, Homo sapien
aacacgtgacactgtgggtctgact

SEQ ID NO: 172270 - DNA, 25 bp, Homo sapien
acgtgacactgtgggtctgactttc

SEQ ID NO: 172271 - DNA, 25 bp, Homo sapien
gacactgtgggtctgactttctctt

SEQ ID NO: 172272 - DNA, 25 bp, Homo sapien
ctgtgggtctgactttctcttctac

SEQ ID NO: 172273 - DNA, 25 bp, Homo sapien
tcttctacacgtcctttcctgaagt

SEQ ID NO: 172274 - DNA, 25 bp, Homo sapien
tacacgtcctttcctgaagtgtcga

SEQ ID NO: 172275 - DNA, 25 bp, Homo sapien
gtcctttcctgaagtgtcgagtcca

SEQ ID NO: 172276 - DNA, 25 bp, Homo sapien
cctttcctgaagtgtcgagtccagt

SEQ ID NO: 172277 - DNA, 25 bp, Homo sapien
aatcttggtcatgttttggtgtgta

SEQ ID NO: 172278 - DNA, 25 bp, Homo sapien
tttcttaaattaacactttggcatg

SEQ ID NO: 172279 - DNA, 25 bp, Homo sapien
ttggcatgaacattactgcaggttt

SEQ ID NO: 172280 - DNA, 25 bp, Homo sapien
ttactgcaggtttttgatgaatata

SEQ ID NO: 172281 - DNA, 25 bp, Homo sapien
attgaatttgcatggtcttcggaat

SEQ ID NO: 172282 - DNA, 25 bp, Homo sapien
ggtcttcggaattttttctgtgtgt

SEQ ID NO: 172283 - DNA, 25 bp, Homo sapien
aatttagctgctattaacagaagag

SEQ ID NO: 172284 - DNA, 25 bp, Homo sapien
agaactttctgtgagtagccatgtg

SEQ ID NO: 172285 - DNA, 25 bp, Homo sapien
gagtagccatgtgtgttgatcagat

SEQ ID NO: 172286 - DNA, 25 bp, Homo sapien
gtgtgttgatcagatacagtttttc

SEQ ID NO: 172287 - DNA, 25 bp, Homo sapien
gtttttctgagatcttcaattaatc

SEQ ID NO: 172288 - DNA, 25 bp, Homo sapien
gtggatggctgattttaacctgaaa

SEQ ID NO: 172289 - DNA, 25 bp, Homo sapien
atccacagattgagagctagtgtag

SEQ ID NO: 172290 - DNA, 25 bp, Homo sapien
gagctagtgtagaattgtctgtgtt

SEQ ID NO: 172291 - DNA, 25 bp, Homo sapien
tatgcattttacctttgggaatatg

SEQ ID NO: 172292 - DNA, 25 bp, Homo sapien
tatgttaatttcaggcagcattccc

SEQ ID NO: 172293 - DNA, 25 bp, Homo sapien
tttcaggcagcattccctatgggaa

SEQ ID NO: 172294 - DNA, 25 bp, Homo sapien
ctatgggaaaggtgataccagctct

SEQ ID NO: 172295 - DNA, 25 bp, Homo sapien
ggtgataccagctctgatatgcaaa

SEQ ID NO: 172296 - DNA, 25 bp, Homo sapien
aatttatcattctaacttcaacgta

SEQ ID NO: 172297 - DNA, 25 bp, Homo sapien
taatagggattgtgacctgatattt

SEQ ID NO: 172298 - DNA, 25 bp, Homo sapien
ggagatgtaaatattgctcagcata

SEQ ID NO: 172299 - DNA, 25 bp, Homo sapien
gggactcatttcattcctaacacag

SEQ ID NO: 172300 - DNA, 25 bp, Homo sapien
tcatttcattcctaacacagcatgt

SEQ ID NO: 172301 - DNA, 25 bp, Homo sapien
acacagcatgtgtatttccagtgcc

SEQ ID NO: 172302 - DNA, 25 bp, Homo sapien
gaaaatatgggttgcatttggtcaa

SEQ ID NO: 172303 - DNA, 25 bp, Homo sapien
gggttgcatttggtcaagattttga

SEQ ID NO: 172304 - DNA, 25 bp, Homo sapien
caagattttgaatgcttcctgacaa

SEQ ID NO: 172305 - DNA, 25 bp, Homo sapien
gaatgcttcctgacaatcaactcta

SEQ ID NO: 172306 - DNA, 25 bp, Homo sapien
gacaatcaactctaatagtgcttaa

SEQ ID NO: 172307 - DNA, 25 bp, Homo sapien
aaaatcattgattgtcagctactaa

SEQ ID NO: 172308 - DNA, 25 bp, Homo sapien
tgtcagctactaatgatgttttcct

SEQ ID NO: 172309 - DNA, 25 bp, Homo sapien
atgtagatgtgcatttttgtgaaat

SEQ ID NO: 172310 - DNA, 25 bp, Homo sapien
aaaggagtcttaatgttctgcccca

SEQ ID NO: 172311 - DNA, 25 bp, Homo sapien
atgttctgccccataagactttcaa

SEQ ID NO: 172312 - DNA, 25 bp, Homo sapien
gccccataagactttcaaccttgtg

SEQ ID NO: 172313 - DNA, 25 bp, Homo sapien
gactttcaaccttgtggttgggagt

SEQ ID NO: 172314 - DNA, 25 bp, Homo sapien
gctggttttgtaggccctagggcct

SEQ ID NO: 172315 - DNA, 25 bp, Homo sapien
agggcctgcttctatgtatttatca

SEQ ID NO: 172316 - DNA, 25 bp, Homo sapien
tatacagggactgatttgcttccct

SEQ ID NO: 172317 - DNA, 25 bp, Homo sapien
cctgccatggctggagctttgggaa

SEQ ID NO: 172318 - DNA, 25 bp, Homo sapien
ggagctttgggaacagtctgtcctt

SEQ ID NO: 172319 - DNA, 25 bp, Homo sapien
cagtctgtccttacagagctgcaat

SEQ ID NO: 172320 - DNA, 25 bp, Homo sapien
agatgaagctggtcaaatattttca

SEQ ID NO: 172321 - DNA, 25 bp, Homo sapien
ccaccatgcttagctgattatgtaa

SEQ ID NO: 172322 - DNA, 25 bp, Homo sapien
aatacctgagcaagtagtgtccaac

SEQ ID NO: 172323 - DNA, 25 bp, Homo sapien
tgagcaagtagtgtccaactttttg

SEQ ID NO: 172324 - DNA, 25 bp, Homo sapien
gtgtttcttggagttattaacagtt

SEQ ID NO: 172325 - DNA, 25 bp, Homo sapien
gtgtgtaacattatcttcgtgcccc

SEQ ID NO: 172326 - DNA, 25 bp, Homo sapien
taacattatcttcgtgccccaagac

SEQ ID NO: 172327 - DNA, 25 bp, Homo sapien
tgtccccagacttaggcaatcccaa

SEQ ID NO: 172328 - DNA, 25 bp, Homo sapien
gacttaggcaatcccaaatctgatt

SEQ ID NO: 172329 - DNA, 25 bp, Homo sapien
aaatctgatttctgcctcgatggag

SEQ ID NO: 172330 - DNA, 25 bp, Homo sapien
atttctgcctcgatggagtttccta

SEQ ID NO: 172331 - DNA, 25 bp, Homo sapien
gatggagtttcctattctggacgtt

SEQ ID NO: 172332 - DNA, 25 bp, Homo sapien
tactccgccctgttcctcggtgtgg

SEQ ID NO: 172333 - DNA, 25 bp, Homo sapien
gttcctcggtgtggcctacggagcc

SEQ ID NO: 172334 - DNA, 25 bp, Homo sapien
gtgtggcctacggagccacgcgcta

SEQ ID NO: 172335 - DNA, 25 bp, Homo sapien
agccacgcgctacaattacctaaaa

SEQ ID NO: 172336 - DNA, 25 bp, Homo sapien
tacaattacctaaaacctcgggcag

SEQ ID NO: 172337 - DNA, 25 bp, Homo sapien
ttacctaaaacctcgggcagaagag

SEQ ID NO: 172338 - DNA, 25 bp, Homo sapien
gaactgaaacggattgccagagaat

SEQ ID NO: 172339 - DNA, 25 bp, Homo sapien
tggcagaagatgacagcatattaaa

SEQ ID NO: 172340 - DNA, 25 bp, Homo sapien
acagcatattaaagtgagtgaccct

SEQ ID NO: 172341 - DNA, 25 bp, Homo sapien
atggtgccaccggtgcaggtctctc

SEQ ID NO: 172342 - DNA, 25 bp, Homo sapien
aggtctctccgctcatcaagctcgg

SEQ ID NO: 172343 - DNA, 25 bp, Homo sapien
tctgtttgctcacccaggacctctg

SEQ ID NO: 172344 - DNA, 25 bp, Homo sapien
tgtttgctcacccaggacctctggg

SEQ ID NO: 172345 - DNA, 25 bp, Homo sapien
tgcgctgccctgcaaaccgtgaggt

SEQ ID NO: 172346 - DNA, 25 bp, Homo sapien
gcgctgccctgcaaaccgtgaggtc

SEQ ID NO: 172347 - DNA, 25 bp, Homo sapien
cgctgccctgcaaaccgtgaggtca

SEQ ID NO: 172348 - DNA, 25 bp, Homo sapien
gctgccctgcaaaccgtgaggtcac

SEQ ID NO: 172349 - DNA, 25 bp, Homo sapien
ctgccctgcaaaccgtgaggtcaca

SEQ ID NO: 172350 - DNA, 25 bp, Homo sapien
gccctgcaaaccgtgaggtcacaat

SEQ ID NO: 172351 - DNA, 25 bp, Homo sapien
ccctgcaaaccgtgaggtcacaata

SEQ ID NO: 172352 - DNA, 25 bp, Homo sapien
cctgcaaaccgtgaggtcacaataa

SEQ ID NO: 172353 - DNA, 25 bp, Homo sapien
ctgcaaaccgtgaggtcacaataaa

SEQ ID NO: 172354 - DNA, 25 bp, Homo sapien
aaccatttctaaacctctatcttag

SEQ ID NO: 172355 - DNA, 25 bp, Homo sapien
ctatcttagcagatcaatgcaggat

SEQ ID NO: 172356 - DNA, 25 bp, Homo sapien
tgcaggatctaattcttttgataag

SEQ ID NO: 172357 - DNA, 25 bp, Homo sapien
gataagttctagctctaaaagtgat

SEQ ID NO: 172358 - DNA, 25 bp, Homo sapien
tagtgggactgtatgttttctgata

SEQ ID NO: 172359 - DNA, 25 bp, Homo sapien
tctgatactggtggcttatgttatt

SEQ ID NO: 172360 - DNA, 25 bp, Homo sapien
taaaaaaggttcactctaaaagctg

SEQ ID NO: 172361 - DNA, 25 bp, Homo sapien
aaaagctgaactacatccttagttt

SEQ ID NO: 172362 - DNA, 25 bp, Homo sapien
gttttcagtctacttgactctatca

SEQ ID NO: 172363 - DNA, 25 bp, Homo sapien
acttgactctatcaggagcttttta

SEQ ID NO: 172364 - DNA, 25 bp, Homo sapien
gtattcattttggactcctgtcaat

SEQ ID NO: 172365 - DNA, 25 bp, Homo sapien
gagcaggcgcgccacaacaaccggt

SEQ ID NO: 172366 - DNA, 25 bp, Homo sapien
gcgccacaacaaccggtttcgagag

SEQ ID NO: 172367 - DNA, 25 bp, Homo sapien
ggtttcgagagatgacggactcctc

SEQ ID NO: 172368 - DNA, 25 bp, Homo sapien
agagatgacggactcctctcatatc

SEQ ID NO: 172369 - DNA, 25 bp, Homo sapien
atatccccgtgtcagacatggtcat

SEQ ID NO: 172370 - DNA, 25 bp, Homo sapien
gacatggtcatgtatggctacagga

SEQ ID NO: 172371 - DNA, 25 bp, Homo sapien
tacaggaagcagttcgaggccccaa

SEQ ID NO: 172372 - DNA, 25 bp, Homo sapien
aggccccaacgctggctgaaggctt

SEQ ID NO: 172373 - DNA, 25 bp, Homo sapien
tggagatcccgttccggctatgggt

SEQ ID NO: 172374 - DNA, 25 bp, Homo sapien
ggcggctgtactgccagttctccga

SEQ ID NO: 172375 - DNA, 25 bp, Homo sapien
tactgccagttctccgagggctgag

SEQ ID NO: 172376 - DNA, 25 bp, Homo sapien
tgccccgggatgcaccggttatttg

SEQ ID NO: 172377 - DNA, 25 bp, Homo sapien
cagtgcactccggtcccaaatgtag

SEQ ID NO: 172378 - DNA, 25 bp, Homo sapien
actccggtcccaaatgtagcaggtg

SEQ ID NO: 172379 - DNA, 25 bp, Homo sapien
ccggtcccaaatgtagcaggtgtaa

SEQ ID NO: 172380 - DNA, 25 bp, Homo sapien
tgtagcaggtgtaaccgtaacccac

SEQ ID NO: 172381 - DNA, 25 bp, Homo sapien
gttcaggaccactttttgtaatact

SEQ ID NO: 172382 - DNA, 25 bp, Homo sapien
tttgtaatctattcctgtaaataag

SEQ ID NO: 172383 - DNA, 25 bp, Homo sapien
tggggctgtatttatctctgaggca

SEQ ID NO: 172384 - DNA, 25 bp, Homo sapien
gtgtggtgctacagggaatttgtac

SEQ ID NO: 172385 - DNA, 25 bp, Homo sapien
gaatttgtacgtttataccgcaggc

SEQ ID NO: 172386 - DNA, 25 bp, Homo sapien
ttgtacgtttataccgcaggcgggc

SEQ ID NO: 172387 - DNA, 25 bp, Homo sapien
aggtgtggactagacgcgtggccaa

SEQ ID NO: 172388 - DNA, 25 bp, Homo sapien
tgagaaccggagaaccccaggacgc

SEQ ID NO: 172389 - DNA, 25 bp, Homo sapien
ttcctctctgcaatgaccttcaaca

SEQ ID NO: 172390 - DNA, 25 bp, Homo sapien
tgcaatgaccttcaacaaccggcca

SEQ ID NO: 172391 - DNA, 25 bp, Homo sapien
agatgtcgccctactcacctgaggc

SEQ ID NO: 172392 - DNA, 25 bp, Homo sapien
tgaggctcagcttcaagaaattact

SEQ ID NO: 172393 - DNA, 25 bp, Homo sapien
actggaaggcttccactagggtcca

SEQ ID NO: 172394 - DNA, 25 bp, Homo sapien
ctagggtccaccaggagttctccca

SEQ ID NO: 172395 - DNA, 25 bp, Homo sapien
acctcaccagtttccaggtggtaag

SEQ ID NO: 172396 - DNA, 25 bp, Homo sapien
accagtttccaggtggtaagcacca

SEQ ID NO: 172397 - DNA, 25 bp, Homo sapien
caggaggccctcgaggttgctctgg

SEQ ID NO: 172398 - DNA, 25 bp, Homo sapien
aaaggtgctgaataactgcaaaaca

SEQ ID NO: 172399 - DNA, 25 bp, Homo sapien
agttgaagaagctaatccgtctgca

SEQ ID NO: 172400 - DNA, 25 bp, Homo sapien
taatccgtctgcagacagagaagct

SEQ ID NO: 172401 - DNA, 25 bp, Homo sapien
gacagagaagcttcaatccattgag

SEQ ID NO: 172402 - DNA, 25 bp, Homo sapien
caatccattgagaaacagctggaat

SEQ ID NO: 172403 - DNA, 25 bp, Homo sapien
gaaacagctggaatctaatgaaata

SEQ ID NO: 172404 - DNA, 25 bp, Homo sapien
aagtataattccaaccttgaagagg

SEQ ID NO: 172405 - DNA, 25 bp, Homo sapien
ccttgaagaggaaattgtccgtcta

SEQ ID NO: 172406 - DNA, 25 bp, Homo sapien
aggaaattgtccgtctagagcaaaa

SEQ ID NO: 172407 - DNA, 25 bp, Homo sapien
ttgtccgtctagagcaaaagatcaa

SEQ ID NO: 172408 - DNA, 25 bp, Homo sapien
aacagctgaaggatcaacttcagaa

SEQ ID NO: 172409 - DNA, 25 bp, Homo sapien
gtcatgggtcatagtatctgatatc

SEQ ID NO: 172410 - DNA, 25 bp, Homo sapien
atatcgttgataacatatccacagg

SEQ ID NO: 172411 - DNA, 25 bp, Homo sapien
atatccacaggtaacaccatgatgt

SEQ ID NO: 172412 - DNA, 25 bp, Homo sapien
ggtaacaccatgatgtaggcataaa

SEQ ID NO: 172413 - DNA, 25 bp, Homo sapien
atttctgtaagccaactgtgtgcca

SEQ ID NO: 172414 - DNA, 25 bp, Homo sapien
gtaagccaactgtgtgccattttca

SEQ ID NO: 172415 - DNA, 25 bp, Homo sapien
gtgccattttcactggacttttaaa

SEQ ID NO: 172416 - DNA, 25 bp, Homo sapien
gactttagtgatgtctacattgtaa

SEQ ID NO: 172417 - DNA, 25 bp, Homo sapien
ggatatttgtcacttggtttcagaa

SEQ ID NO: 172418 - DNA, 25 bp, Homo sapien
atgtagcaacagctcacatgactga

SEQ ID NO: 172419 - DNA, 25 bp, Homo sapien
acagctcacatgactgagtaggtag

SEQ ID NO: 172420 - DNA, 25 bp, Homo sapien
atgtcaccttgtcctatgtccagat

SEQ ID NO: 172421 - DNA, 25 bp, Homo sapien
tatgtccagatctaatctattcctg

SEQ ID NO: 172422 - DNA, 25 bp, Homo sapien
cagaattatcccctaggactccttt

SEQ ID NO: 172423 - DNA, 25 bp, Homo sapien
gtggtccggaacagccttctgaatg

SEQ ID NO: 172424 - DNA, 25 bp, Homo sapien
agaagaagatcacccacaacccatt

SEQ ID NO: 172425 - DNA, 25 bp, Homo sapien
catttggtcccggacagttctttga

SEQ ID NO: 172426 - DNA, 25 bp, Homo sapien
agttctttgatctgtccattcgctg

SEQ ID NO: 172427 - DNA, 25 bp, Homo sapien
attcgctgtggcttggatcgcttca

SEQ ID NO: 172428 - DNA, 25 bp, Homo sapien
ggatcgcttcaaggtttacgccaat

SEQ ID NO: 172429 - DNA, 25 bp, Homo sapien
aaggtttacgccaatggccagcacc

SEQ ID NO: 172430 - DNA, 25 bp, Homo sapien
gccttccagagggtggacacattgg

SEQ ID NO: 172431 - DNA, 25 bp, Homo sapien
ggcttctggtactcctctctaaata

SEQ ID NO: 172432 - DNA, 25 bp, Homo sapien
gatgcccatagcactaggacttggt

SEQ ID NO: 172433 - DNA, 25 bp, Homo sapien
aggacttggtcatcatgcctacaga

SEQ ID NO: 172434 - DNA, 25 bp, Homo sapien
gacactattcaactttggcatcttg

SEQ ID NO: 172435 - DNA, 25 bp, Homo sapien
aagacccgagggaggctcagctctg

SEQ ID NO: 172436 - DNA, 25 bp, Homo sapien
tgccagctcagaggaccagctatat

SEQ ID NO: 172437 - DNA, 25 bp, Homo sapien
tatatccaggatcatttctctttct

SEQ ID NO: 172438 - DNA, 25 bp, Homo sapien
tttcttcagggccagacagctttta

SEQ ID NO: 172439 - DNA, 25 bp, Homo sapien
tgttatttcacaggccagggttcag

SEQ ID NO: 172440 - DNA, 25 bp, Homo sapien
ctgctcctccactataagtctaatg

SEQ ID NO: 172441 - DNA, 25 bp, Homo sapien
aagtctaatgttctgactctctcct

SEQ ID NO: 172442 - DNA, 25 bp, Homo sapien
tatgggctccttgaagaggaccaga

SEQ ID NO: 172443 - DNA, 25 bp, Homo sapien
cctggctgggagtggcatgtatgac

SEQ ID NO: 172444 - DNA, 25 bp, Homo sapien
catgtatgacgtgactggcctgctg

SEQ ID NO: 172445 - DNA, 25 bp, Homo sapien
tatgacgtgactggcctgctggatg

SEQ ID NO: 172446 - DNA, 25 bp, Homo sapien
gggctttagggacctgctgtttcct

SEQ ID NO: 172447 - DNA, 25 bp, Homo sapien
tagggacctgctgtttcctagcgca

SEQ ID NO: 172448 - DNA, 25 bp, Homo sapien
gtttcctagcgcagccatgtgatta

SEQ ID NO: 172449 - DNA, 25 bp, Homo sapien
gcagccatgtgattaccctctgggt

SEQ ID NO: 172450 - DNA, 25 bp, Homo sapien
tgattaccctctgggtctcagtgtc

SEQ ID NO: 172451 - DNA, 25 bp, Homo sapien
accacccttgccatggaggttaagc

SEQ ID NO: 172452 - DNA, 25 bp, Homo sapien
ggttaagcactttaacacagtgtct

SEQ ID NO: 172453 - DNA, 25 bp, Homo sapien
ggccaacattcaatttgaacagagc

SEQ ID NO: 172454 - DNA, 25 bp, Homo sapien
tcaatttgaacagagcatggaagac

SEQ ID NO: 172455 - DNA, 25 bp, Homo sapien
ggaagacctttcagttcatcgggaa

SEQ ID NO: 172456 - DNA, 25 bp, Homo sapien
gacctttcagttcatcgggaaagaa

SEQ ID NO: 172457 - DNA, 25 bp, Homo sapien
aataagtcagtcatgcatcagggca

SEQ ID NO: 172458 - DNA, 25 bp, Homo sapien
gtcagtcatgcatcagggcatttag

SEQ ID NO: 172459 - DNA, 25 bp, Homo sapien
gcatcagggcatttagaaagagcta

SEQ ID NO: 172460 - DNA, 25 bp, Homo sapien
agctatgtttctgtcacagagacag

SEQ ID NO: 172461 - DNA, 25 bp, Homo sapien
ttctgtcacagagacagcccttttc

SEQ ID NO: 172462 - DNA, 25 bp, Homo sapien
agcccttttctcagaactacccaga

SEQ ID NO: 172463 - DNA, 25 bp, Homo sapien
ttttctcagaactacccagaggagg

SEQ ID NO: 172464 - DNA, 25 bp, Homo sapien
gagcatcaggaaggcccagctgaaa

SEQ ID NO: 172465 - DNA, 25 bp, Homo sapien
atcagagaatctgctcgaagaagag

SEQ ID NO: 172466 - DNA, 25 bp, Homo sapien
gagaattaggacctgctatccactg

SEQ ID NO: 172467 - DNA, 25 bp, Homo sapien
atccactgggagaggctatcagcca

SEQ ID NO: 172468 - DNA, 25 bp, Homo sapien
gggacttggagacccagcatccttt

SEQ ID NO: 172469 - DNA, 25 bp, Homo sapien
cccagcatcctttgcattacttttt

SEQ ID NO: 172470 - DNA, 25 bp, Homo sapien
ttgcattactttttccttcaggatg

SEQ ID NO: 172471 - DNA, 25 bp, Homo sapien
ttcaggatgatctagagcagcatgg

SEQ ID NO: 172472 - DNA, 25 bp, Homo sapien
tagtttttaaccatacattgtccca

SEQ ID NO: 172473 - DNA, 25 bp, Homo sapien
cattgtcccaaaagtgtctgtgcat

SEQ ID NO: 172474 - DNA, 25 bp, Homo sapien
ccaaaagtgtctgtgcattgtgcaa

SEQ ID NO: 172475 - DNA, 25 bp, Homo sapien
aggaggcttccagcatcttcaagac

SEQ ID NO: 172476 - DNA, 25 bp, Homo sapien
ttcaagaccctgaggaccatcgcta

SEQ ID NO: 172477 - DNA, 25 bp, Homo sapien
ggaccatcgctaacgacgactgtga

SEQ ID NO: 172478 - DNA, 25 bp, Homo sapien
taacgacgactgtgagctgtgtgtg

SEQ ID NO: 172479 - DNA, 25 bp, Homo sapien
tgtgtgaacgttgcgtgtaccggct

SEQ ID NO: 172480 - DNA, 25 bp, Homo sapien
cgtgtaccggctgcctctgagatag

SEQ ID NO: 172481 - DNA, 25 bp, Homo sapien
tctgagatagccctgggtaccctga

SEQ ID NO: 172482 - DNA, 25 bp, Homo sapien
atccccgtccatgctcaagatgggt

SEQ ID NO: 172483 - DNA, 25 bp, Homo sapien
gtccatgctcaagatgggtccctgg

SEQ ID NO: 172484 - DNA, 25 bp, Homo sapien
cctgagcagctggatctggtacaaa

SEQ ID NO: 172485 - DNA, 25 bp, Homo sapien
tggatctggtacaaagcaatcggac

SEQ ID NO: 172486 - DNA, 25 bp, Homo sapien
gttgtaatggtctcaaatcccaaga

SEQ ID NO: 172487 - DNA, 25 bp, Homo sapien
aatcacttacctatttaattgtgga

SEQ ID NO: 172488 - DNA, 25 bp, Homo sapien
gaacatgtgtatttctatctggtag

SEQ ID NO: 172489 - DNA, 25 bp, Homo sapien
acatttgtcatttcagtgttactgg

SEQ ID NO: 172490 - DNA, 25 bp, Homo sapien
tcagtgttactggagttttcttcat

SEQ ID NO: 172491 - DNA, 25 bp, Homo sapien
ggagttttcttcattgtgcacacag

SEQ ID NO: 172492 - DNA, 25 bp, Homo sapien
ggacaaatctgatctctttgggaaa

SEQ ID NO: 172493 - DNA, 25 bp, Homo sapien
aacaatctccctccataatgtgagc

SEQ ID NO: 172494 - DNA, 25 bp, Homo sapien
gtgagcaatattacctcgtgcattg

SEQ ID NO: 172495 - DNA, 25 bp, Homo sapien
tacctcgtgcattgtataatttgat

SEQ ID NO: 172496 - DNA, 25 bp, Homo sapien
aatcaaaccgtccataagaatcttg

SEQ ID NO: 172497 - DNA, 25 bp, Homo sapien
agaactaaaggcaactttggcgatt

SEQ ID NO: 172498 - DNA, 25 bp, Homo sapien
gcaactttggcgattaaagccttga

SEQ ID NO: 172499 - DNA, 25 bp, Homo sapien
aaagccttgatttggttgaatgaga

SEQ ID NO: 172500 - DNA, 25 bp, Homo sapien
aatttttactttgatgttcctgtat

SEQ ID NO: 172501 - DNA, 25 bp, Homo sapien
ttgatgttcctgtatttgcatatat

SEQ ID NO: 172502 - DNA, 25 bp, Homo sapien
cattaatgtgtttctattagtttga

SEQ ID NO: 172503 - DNA, 25 bp, Homo sapien
aatggacatgtgtgtaatggatccc

SEQ ID NO: 172504 - DNA, 25 bp, Homo sapien
gtgtgtaatggatcccaaagaatca

SEQ ID NO: 172505 - DNA, 25 bp, Homo sapien
atactactataagacattggctttt

SEQ ID NO: 172506 - DNA, 25 bp, Homo sapien
ggctttttccagacatggatccggg

SEQ ID NO: 172507 - DNA, 25 bp, Homo sapien
gggttctgcatctacaagaaagttt

SEQ ID NO: 172508 - DNA, 25 bp, Homo sapien
acacacaagcttttttacacaaatg

SEQ ID NO: 172509 - DNA, 25 bp, Homo sapien
ggtagcatactttatattggtctgt

SEQ ID NO: 172510 - DNA, 25 bp, Homo sapien
ttatattggtctgtatcttgctttt

SEQ ID NO: 172511 - DNA, 25 bp, Homo sapien
ttttttcaccaatatttctcagaca

SEQ ID NO: 172512 - DNA, 25 bp, Homo sapien
tatttctcagacatcggttcatatt

SEQ ID NO: 172513 - DNA, 25 bp, Homo sapien
gacatcggttcatattaagacataa

SEQ ID NO: 172514 - DNA, 25 bp, Homo sapien
ttcattcttttataccgctgcatag

SEQ ID NO: 172515 - DNA, 25 bp, Homo sapien
ttccattgtgtgagtgtaccataat

SEQ ID NO: 172516 - DNA, 25 bp, Homo sapien
tttaaccagtcttcttttgatatac

SEQ ID NO: 172517 - DNA, 25 bp, Homo sapien
tcatctcttgttattgcatctgctg

SEQ ID NO: 172518 - DNA, 25 bp, Homo sapien
tcttgttattgcatctgctgagtta

SEQ ID NO: 172519 - DNA, 25 bp, Homo sapien
ttcatgaacacccagcaacctgagc

SEQ ID NO: 172520 - DNA, 25 bp, Homo sapien
gacagctcagtgttggagggccacc

SEQ ID NO: 172521 - DNA, 25 bp, Homo sapien
ttggagggccacctgaaccacgagc

SEQ ID NO: 172522 - DNA, 25 bp, Homo sapien
tatgacagcgtcaagactgcccttg

SEQ ID NO: 172523 - DNA, 25 bp, Homo sapien
aagactgcccttggcaccgtgctgt

SEQ ID NO: 172524 - DNA, 25 bp, Homo sapien
tctgagactccactgagacgtggct

SEQ ID NO: 172525 - DNA, 25 bp, Homo sapien
agacgtggctgagtgaaatcttcct

SEQ ID NO: 172526 - DNA, 25 bp, Homo sapien
gaaatcttcctcgtcagtggtcaag

SEQ ID NO: 172527 - DNA, 25 bp, Homo sapien
ctcgtcagtggtcaaggtgtgtcat

SEQ ID NO: 172528 - DNA, 25 bp, Homo sapien
aggtgtgtcatccatacagctccat

SEQ ID NO: 172529 - DNA, 25 bp, Homo sapien
cagctccatgcctttgtctttttta

SEQ ID NO: 172530 - DNA, 25 bp, Homo sapien
gtaggtacactgtctatgaaatact

SEQ ID NO: 172531 - DNA, 25 bp, Homo sapien
actgtctatgaaatactgtgaaaca

SEQ ID NO: 172532 - DNA, 25 bp, Homo sapien
gaaacaataaggtatctctgtatgt

SEQ ID NO: 172533 - DNA, 25 bp, Homo sapien
ggtatctctgtatgtactgatatca

SEQ ID NO: 172534 - DNA, 25 bp, Homo sapien
atgtactgatatcaaaagatctcta

SEQ ID NO: 172535 - DNA, 25 bp, Homo sapien
aagatctctaagatacagtatttag

SEQ ID NO: 172536 - DNA, 25 bp, Homo sapien
aaactacatctagaagtataagcat

SEQ ID NO: 172537 - DNA, 25 bp, Homo sapien
gttaatagtggttttctgcaggaaa

SEQ ID NO: 172538 - DNA, 25 bp, Homo sapien
gaaatgggatggaccagggttatat

SEQ ID NO: 172539 - DNA, 25 bp, Homo sapien
gaccagggttatatgcaatgttcag

SEQ ID NO: 172540 - DNA, 25 bp, Homo sapien
gttatatgcaatgttcagtttttac

SEQ ID NO: 172541 - DNA, 25 bp, Homo sapien
aggctccgggttgtacgcccagaag

SEQ ID NO: 172542 - DNA, 25 bp, Homo sapien
cctgcacagttcctttgtggcagta

SEQ ID NO: 172543 - DNA, 25 bp, Homo sapien
tggcagtaactgaggaaggcaccga

SEQ ID NO: 172544 - DNA, 25 bp, Homo sapien
accggcataggctttactgtcacat

SEQ ID NO: 172545 - DNA, 25 bp, Homo sapien
catccgccccaggtcatgaaaatgt

SEQ ID NO: 172546 - DNA, 25 bp, Homo sapien
aaatgttcactgcaatcatcccttc

SEQ ID NO: 172547 - DNA, 25 bp, Homo sapien
ttcggcagattttcttctccttaag

SEQ ID NO: 172548 - DNA, 25 bp, Homo sapien
ttctccttaagatgatcgttgccat

SEQ ID NO: 172549 - DNA, 25 bp, Homo sapien
gatcgttgccatggcattgctgctt

SEQ ID NO: 172550 - DNA, 25 bp, Homo sapien
agtgagcacaaagccgactactcgg

SEQ ID NO: 172551 - DNA, 25 bp, Homo sapien
actactcgggaatgtcgtcaggctc

SEQ ID NO: 172552 - DNA, 25 bp, Homo sapien
acggcgacgccaacaccatcgtgtg

SEQ ID NO: 172553 - DNA, 25 bp, Homo sapien
acaccatcgtgtgcaacagcaagga

SEQ ID NO: 172554 - DNA, 25 bp, Homo sapien
atcgtgtgcaacagcaaggacggcg

SEQ ID NO: 172555 - DNA, 25 bp, Homo sapien
accgagcagcgggaggctgtctttc

SEQ ID NO: 172556 - DNA, 25 bp, Homo sapien
agcagcgggaggctgtctttccctt

SEQ ID NO: 172557 - DNA, 25 bp, Homo sapien
gcgggaggctgtctttcccttccag

SEQ ID NO: 172558 - DNA, 25 bp, Homo sapien
ttccagcctggaagtgttgcagagg

SEQ ID NO: 172559 - DNA, 25 bp, Homo sapien
atcaccttcgaccaggccaacctga

SEQ ID NO: 172560 - DNA, 25 bp, Homo sapien
ctgaccgtcaagctgccagatggat

SEQ ID NO: 172561 - DNA, 25 bp, Homo sapien
gtcaagctgccagatggatacgaat

SEQ ID NO: 172562 - DNA, 25 bp, Homo sapien
gccagatggatacgaattcaagttc

SEQ ID NO: 172563 - DNA, 25 bp, Homo sapien
aataacaccttttcttgcattctga

SEQ ID NO: 172564 - DNA, 25 bp, Homo sapien
agccagacagcctttatactagatt

SEQ ID NO: 172565 - DNA, 25 bp, Homo sapien
gaacaacttctacccttaaacacat

SEQ ID NO: 172566 - DNA, 25 bp, Homo sapien
ttctacccttaaacacatcctttct

SEQ ID NO: 172567 - DNA, 25 bp, Homo sapien
tctcccctgggcttgtaagaagatg

SEQ ID NO: 172568 - DNA, 25 bp, Homo sapien
ttgatgcagctcctcaaacaccagg

SEQ ID NO: 172569 - DNA, 25 bp, Homo sapien
aatctgactactaggaagacttcta

SEQ ID NO: 172570 - DNA, 25 bp, Homo sapien
agacttctaggctatgaaactgact

SEQ ID NO: 172571 - DNA, 25 bp, Homo sapien
gaaactgacttctaggctatgaaac

SEQ ID NO: 172572 - DNA, 25 bp, Homo sapien
ctaggctatgaaacttacagggtat

SEQ ID NO: 172573 - DNA, 25 bp, Homo sapien
cttacagggtatgggtgggcacatt

SEQ ID NO: 172574 - DNA, 25 bp, Homo sapien
gcgcttgcaattgttgaagccctga

SEQ ID NO: 172575 - DNA, 25 bp, Homo sapien
tggcggctcaagtgaaggctccact

SEQ ID NO: 172576 - DNA, 25 bp, Homo sapien
gaaggctccacttgttcttaaagac

SEQ ID NO: 172577 - DNA, 25 bp, Homo sapien
gcagcgaactgcgacgatcacttag

SEQ ID NO: 172578 - DNA, 25 bp, Homo sapien
gatcacttagagaaacaggccgtta

SEQ ID NO: 172579 - DNA, 25 bp, Homo sapien
aggccgttaggaatccattctcact

SEQ ID NO: 172580 - DNA, 25 bp, Homo sapien
attctcactgtgttcgctctaaaca

SEQ ID NO: 172581 - DNA, 25 bp, Homo sapien
tggaagtcacaactacacagagatt

SEQ ID NO: 172582 - DNA, 25 bp, Homo sapien
gatttctcagcctacaaattgtgtc

SEQ ID NO: 172583 - DNA, 25 bp, Homo sapien
tgtgtctatacatttctaagccttg

SEQ ID NO: 172584 - DNA, 25 bp, Homo sapien
acatttctaagccttgtttgcagaa

SEQ ID NO: 172585 - DNA, 25 bp, Homo sapien
ttgttttgtgctaacgtcttactaa

SEQ ID NO: 172586 - DNA, 25 bp, Homo sapien
actaatttaaagatgctgtcggcac

SEQ ID NO: 172587 - DNA, 25 bp, Homo sapien
gatgctgtcggcaccatgtttattt

SEQ ID NO: 172588 - DNA, 25 bp, Homo sapien
tatttccagtggtcatgctcagcct

SEQ ID NO: 172589 - DNA, 25 bp, Homo sapien
tctgcgtggcgcaggtgccatgcct

SEQ ID NO: 172590 - DNA, 25 bp, Homo sapien
gcagggccatccactgtgacgtcgg

SEQ ID NO: 172591 - DNA, 25 bp, Homo sapien
tgacgtcggccgaccaggctggaca

SEQ ID NO: 172592 - DNA, 25 bp, Homo sapien
aggctggacaccctctgccgagtaa

SEQ ID NO: 172593 - DNA, 25 bp, Homo sapien
ccctctgccgagtaatgacgtgtgt

SEQ ID NO: 172594 - DNA, 25 bp, Homo sapien
tgggaccttctttattctgtgttaa

SEQ ID NO: 172595 - DNA, 25 bp, Homo sapien
atggctaacctgttacactgggctg

SEQ ID NO: 172596 - DNA, 25 bp, Homo sapien
gggccctgcctggtggcaagaggga

SEQ ID NO: 172597 - DNA, 25 bp, Homo sapien
tggcaagagggaatgtcagcaggac

SEQ ID NO: 172598 - DNA, 25 bp, Homo sapien
atccctgtgtctctacacgctgtat

SEQ ID NO: 172599 - DNA, 25 bp, Homo sapien
tgtgtctctacacgctgtattgtgt

SEQ ID NO: 172600 - DNA, 25 bp, Homo sapien
acacgctgtattgtgtatcaccggg

SEQ ID NO: 172601 - DNA, 25 bp, Homo sapien
caccgggggcattattttcattgta

SEQ ID NO: 172602 - DNA, 25 bp, Homo sapien
tgctccagcctcgatttggttttat

SEQ ID NO: 172603 - DNA, 25 bp, Homo sapien
ctccagcctcgatttggttttattt

SEQ ID NO: 172604 - DNA, 25 bp, Homo sapien
gggcacaagtgtctgtgcatgtccc

SEQ ID NO: 172605 - DNA, 25 bp, Homo sapien
gtgtctgtgcatgtcccccaggagc

SEQ ID NO: 172606 - DNA, 25 bp, Homo sapien
agaaacaagacagggcttctctcag

SEQ ID NO: 172607 - DNA, 25 bp, Homo sapien
tctcactcatctcttttacctaaat

SEQ ID NO: 172608 - DNA, 25 bp, Homo sapien
ttacctaaattgtcctgaactttgt

SEQ ID NO: 172609 - DNA, 25 bp, Homo sapien
tgttaagtgttctggacaaggccaa

SEQ ID NO: 172610 - DNA, 25 bp, Homo sapien
ctggacaaggccaagcttttcttta

SEQ ID NO: 172611 - DNA, 25 bp, Homo sapien
tattaaaacctcagcatgtctccct

SEQ ID NO: 172612 - DNA, 25 bp, Homo sapien
atgtctccctgatctgaactatttg

SEQ ID NO: 172613 - DNA, 25 bp, Homo sapien
tgctttctcttcaagataagttgta

SEQ ID NO: 172614 - DNA, 25 bp, Homo sapien
agtatctaacattaccattcacgtt

SEQ ID NO: 172615 - DNA, 25 bp, Homo sapien
gaagtttcctcataacatttatctt

SEQ ID NO: 172616 - DNA, 25 bp, Homo sapien
tagttttatgaagtcatcgtgacca

SEQ ID NO: 172617 - DNA, 25 bp, Homo sapien
gtcatcgtgaccaatgttacagtaa

SEQ ID NO: 172618 - DNA, 25 bp, Homo sapien
tgcccaccccgcctctgggctcaca

SEQ ID NO: 172619 - DNA, 25 bp, Homo sapien
gcctctgggctcacaccagccctgg

SEQ ID NO: 172620 - DNA, 25 bp, Homo sapien
cctctgggctcacaccagccctggt

SEQ ID NO: 172621 - DNA, 25 bp, Homo sapien
aagcctgccccggccactctgtttg

SEQ ID NO: 172622 - DNA, 25 bp, Homo sapien
gcctgccccggccactctgtttgct

SEQ ID NO: 172623 - DNA, 25 bp, Homo sapien
cctgccccggccactctgtttgctc

SEQ ID NO: 172624 - DNA, 25 bp, Homo sapien
ctgccccggccactctgtttgctca

SEQ ID NO: 172625 - DNA, 25 bp, Homo sapien
tgccccggccactctgtttgctcac

SEQ ID NO: 172626 - DNA, 25 bp, Homo sapien
gccccggccactctgtttgctcacc

SEQ ID NO: 172627 - DNA, 25 bp, Homo sapien
cttcgccatgtgctgtgcacccgtg

SEQ ID NO: 172628 - DNA, 25 bp, Homo sapien
ttcgccatgtgctgtgcacccgtgc

SEQ ID NO: 172629 - DNA, 25 bp, Homo sapien
gtgattgtatgatctccttgcaact

SEQ ID NO: 172630 - DNA, 25 bp, Homo sapien
gatctccttgcaactcagtgtgagt

SEQ ID NO: 172631 - DNA, 25 bp, Homo sapien
tgagttgattcctccaatatgggcc

SEQ ID NO: 172632 - DNA, 25 bp, Homo sapien
aatatgggccagatgcttttgaatg

SEQ ID NO: 172633 - DNA, 25 bp, Homo sapien
aaaatccagtgtcctctttattgag

SEQ ID NO: 172634 - DNA, 25 bp, Homo sapien
tatgtatccatctcagtgatccatg

SEQ ID NO: 172635 - DNA, 25 bp, Homo sapien
agtgatccatgtccttagtgaagtc

SEQ ID NO: 172636 - DNA, 25 bp, Homo sapien
tagtgaagtccacattattctctgt

SEQ ID NO: 172637 - DNA, 25 bp, Homo sapien
agctgggcagttttgaatgggtctt

SEQ ID NO: 172638 - DNA, 25 bp, Homo sapien
tcttgaggtgggtaccccatgtgca

SEQ ID NO: 172639 - DNA, 25 bp, Homo sapien
atgtgcactttctgaggatgcctca

SEQ ID NO: 172640 - DNA, 25 bp, Homo sapien
gacaggtttgtcaagggctatttaa

SEQ ID NO: 172641 - DNA, 25 bp, Homo sapien
caagggctatttaatgagttactag

SEQ ID NO: 172642 - DNA, 25 bp, Homo sapien
aaatgggatttctgtgtggcctggt

SEQ ID NO: 172643 - DNA, 25 bp, Homo sapien
gtgtggcctggttatttggaaacta

SEQ ID NO: 172644 - DNA, 25 bp, Homo sapien
ggaaactatgcagtcctcattggaa

SEQ ID NO: 172645 - DNA, 25 bp, Homo sapien
atgcagtcctcattggaacaacttt

SEQ ID NO: 172646 - DNA, 25 bp, Homo sapien
gatgaaatgagtattctcttcacag

SEQ ID NO: 172647 - DNA, 25 bp, Homo sapien
tattctcttcacagttttggttact

SEQ ID NO: 172648 - DNA, 25 bp, Homo sapien
cacagttttggttactgaaactact

SEQ ID NO: 172649 - DNA, 25 bp, Homo sapien
gaatggattaatacatctgagaagc

SEQ ID NO: 172650 - DNA, 25 bp, Homo sapien
taagtatatatcatcagctaagaat

SEQ ID NO: 172651 - DNA, 25 bp, Homo sapien
tacacagcacaaagaatgtcagaca

SEQ ID NO: 172652 - DNA, 25 bp, Homo sapien
atgtcagacagaatgccctgttcgt

SEQ ID NO: 172653 - DNA, 25 bp, Homo sapien
agacagaatgccctgttcgtgcagt

SEQ ID NO: 172654 - DNA, 25 bp, Homo sapien
agaatgccctgttcgtgcagtttgc

SEQ ID NO: 172655 - DNA, 25 bp, Homo sapien
atgccctgttcgtgcagtttgctga

SEQ ID NO: 172656 - DNA, 25 bp, Homo sapien
tcgtgcagtttgctgaggtgttccc

SEQ ID NO: 172657 - DNA, 25 bp, Homo sapien
agtttgctgaggtgttcccgctgaa

SEQ ID NO: 172658 - DNA, 25 bp, Homo sapien
gatcccctgaactaccaaatagctg

SEQ ID NO: 172659 - DNA, 25 bp, Homo sapien
gaactaccaaatagctgtgggcttt

SEQ ID NO: 172660 - DNA, 25 bp, Homo sapien
atagctgtgggctttctggaactgc

SEQ ID NO: 172661 - DNA, 25 bp, Homo sapien
tgtgggctttctggaactgctggct

SEQ ID NO: 172662 - DNA, 25 bp, Homo sapien
taattctaggtatttgatagggtat

SEQ ID NO: 172663 - DNA, 25 bp, Homo sapien
tgatagggtattgagtgtattttgt

SEQ ID NO: 172664 - DNA, 25 bp, Homo sapien
gagaggcgatgctattggccatcac

SEQ ID NO: 172665 - DNA, 25 bp, Homo sapien
gatgctattggccatcactaccaac

SEQ ID NO: 172666 - DNA, 25 bp, Homo sapien
tattggccatcactaccaaccaggg

SEQ ID NO: 172667 - DNA, 25 bp, Homo sapien
tggccatcactaccaaccagggttt

SEQ ID NO: 172668 - DNA, 25 bp, Homo sapien
catcactaccaaccagggtttcaaa

SEQ ID NO: 172669 - DNA, 25 bp, Homo sapien
gtaatttcttttatcactacctcaa

SEQ ID NO: 172670 - DNA, 25 bp, Homo sapien
atttcttttatcactacctcaactg

SEQ ID NO: 172671 - DNA, 25 bp, Homo sapien
cttttatcactacctcaactgagga

SEQ ID NO: 172672 - DNA, 25 bp, Homo sapien
aaaggctcaccacaagtggtgtgaa

SEQ ID NO: 172673 - DNA, 25 bp, Homo sapien
ttgtccaggctaagaggtgggattt

SEQ ID NO: 172674 - DNA, 25 bp, Homo sapien
gaatgcccaggagttaaatgtctta

SEQ ID NO: 172675 - DNA, 25 bp, Homo sapien
atgcccaggagttaaatgtcttaag

SEQ ID NO: 172676 - DNA, 25 bp, Homo sapien
gcccaggagttaaatgtcttaagat

SEQ ID NO: 172677 - DNA, 25 bp, Homo sapien
cttaagatatggagcaggccgttag

SEQ ID NO: 172678 - DNA, 25 bp, Homo sapien
taagatatggagcaggccgttagaa

SEQ ID NO: 172679 - DNA, 25 bp, Homo sapien
agatatggagcaggccgttagaaag

SEQ ID NO: 172680 - DNA, 25 bp, Homo sapien
gagcagcaactggaaggtagaatag

SEQ ID NO: 172681 - DNA, 25 bp, Homo sapien
gcaactggaaggtagaatagtctta

SEQ ID NO: 172682 - DNA, 25 bp, Homo sapien
ggtagaatagtcttattcaaggaat

SEQ ID NO: 172683 - DNA, 25 bp, Homo sapien
ggaataagaactatgtaatcacagc

SEQ ID NO: 172684 - DNA, 25 bp, Homo sapien
tagcagggctcccttcattgcatct

SEQ ID NO: 172685 - DNA, 25 bp, Homo sapien
cttcattgcatctgaggacttgttt

SEQ ID NO: 172686 - DNA, 25 bp, Homo sapien
tatattgcctagagactcagttact

SEQ ID NO: 172687 - DNA, 25 bp, Homo sapien
gagactcagttactacccagtttgt

SEQ ID NO: 172688 - DNA, 25 bp, Homo sapien
tcagttactacccagtttgtggttt

SEQ ID NO: 172689 - DNA, 25 bp, Homo sapien
aactggacagttagcttttcaatta

SEQ ID NO: 172690 - DNA, 25 bp, Homo sapien
aaaagacacttaacccatgtgggat

SEQ ID NO: 172691 - DNA, 25 bp, Homo sapien
aaattattcacactacttgcatgta

SEQ ID NO: 172692 - DNA, 25 bp, Homo sapien
tattcacactacttgcatgtaaaga

SEQ ID NO: 172693 - DNA, 25 bp, Homo sapien
gtaaaacccagaaagcatccatcat

SEQ ID NO: 172694 - DNA, 25 bp, Homo sapien
aacccagaaagcatccatcatgaat

SEQ ID NO: 172695 - DNA, 25 bp, Homo sapien
ctgcttggaagcctggacgtgacac

SEQ ID NO: 172696 - DNA, 25 bp, Homo sapien
gcttggaagcctggacgtgacacga

SEQ ID NO: 172697 - DNA, 25 bp, Homo sapien
ttggaagcctggacgtgacacgatt

SEQ ID NO: 172698 - DNA, 25 bp, Homo sapien
gattaagccgaacgtggatgacagc

SEQ ID NO: 172699 - DNA, 25 bp, Homo sapien
tgctgacccaggaaaggccagacct

SEQ ID NO: 172700 - DNA, 25 bp, Homo sapien
caaaatccacagtatgggaccctgg

SEQ ID NO: 172701 - DNA, 25 bp, Homo sapien
accctggagggctagcaaggccttc

SEQ ID NO: 172702 - DNA, 25 bp, Homo sapien
tggagggctagcaaggccttctcat

SEQ ID NO: 172703 - DNA, 25 bp, Homo sapien
gagggctagcaaggccttctcatgc

SEQ ID NO: 172704 - DNA, 25 bp, Homo sapien
ggctagcaaggccttctcatgcctc

SEQ ID NO: 172705 - DNA, 25 bp, Homo sapien
agaagctgaatagtgacgccctccc

SEQ ID NO: 172706 - DNA, 25 bp, Homo sapien
gagaacccaacattgatagtccctt

SEQ ID NO: 172707 - DNA, 25 bp, Homo sapien
gatagtcccttgaacacacatgctg

SEQ ID NO: 172708 - DNA, 25 bp, Homo sapien
acacatgctgccgagctctggaaaa

SEQ ID NO: 172709 - DNA, 25 bp, Homo sapien
gctctggaaaaaccccacagctttt

SEQ ID NO: 172710 - DNA, 25 bp, Homo sapien
acagcttttaagaagtacctgcaag

SEQ ID NO: 172711 - DNA, 25 bp, Homo sapien
gtacctgcaagaaacctactcaaag

SEQ ID NO: 172712 - DNA, 25 bp, Homo sapien
aaacctactcaaagcaggtcaccag

SEQ ID NO: 172713 - DNA, 25 bp, Homo sapien
atttttccttagatggtctgtcctt

SEQ ID NO: 172714 - DNA, 25 bp, Homo sapien
ggtctgtcctttttgtgatttctgt

SEQ ID NO: 172715 - DNA, 25 bp, Homo sapien
gtgatttctgtataggactctttat

SEQ ID NO: 172716 - DNA, 25 bp, Homo sapien
ggactctttatcttgagctgtggta

SEQ ID NO: 172717 - DNA, 25 bp, Homo sapien
gcaaaatcattgctttcagggctct

SEQ ID NO: 172718 - DNA, 25 bp, Homo sapien
tcattgctttcagggctcttgataa

SEQ ID NO: 172719 - DNA, 25 bp, Homo sapien
cagggctcttgataaaggatccaaa

SEQ ID NO: 172720 - DNA, 25 bp, Homo sapien
ggatccaaataaacgccttggtgga

SEQ ID NO: 172721 - DNA, 25 bp, Homo sapien
gagacacagtttcttctctggagta

SEQ ID NO: 172722 - DNA, 25 bp, Homo sapien
cttctctggagtaaactggcaagat

SEQ ID NO: 172723 - DNA, 25 bp, Homo sapien
atgataaaaagcttgtacctccttt

SEQ ID NO: 172724 - DNA, 25 bp, Homo sapien
ccttttaaacctcaagtaacatctg

SEQ ID NO: 172725 - DNA, 25 bp, Homo sapien
gagacagatactagatattttgatg

SEQ ID NO: 172726 - DNA, 25 bp, Homo sapien
gaagaatttacagctcagactatta

SEQ ID NO: 172727 - DNA, 25 bp, Homo sapien
gactattacaataacaccacctgaa

SEQ ID NO: 172728 - DNA, 25 bp, Homo sapien
ggacatgctggaagctggtattcta

SEQ ID NO: 172729 - DNA, 25 bp, Homo sapien
gtattctagatacttacctgggaaa

SEQ ID NO: 172730 - DNA, 25 bp, Homo sapien
ttacctgggaaaatattgggctatc

SEQ ID NO: 172731 - DNA, 25 bp, Homo sapien
ttgggctatcaaactcgctactaat

SEQ ID NO: 172732 - DNA, 25 bp, Homo sapien
aactcgctactaatgctgcagtcac

SEQ ID NO: 172733 - DNA, 25 bp, Homo sapien
aatgctgcagtcactgtacttagag

SEQ ID NO: 172734 - DNA, 25 bp, Homo sapien
gtggatcagatcatcatggcaaaac

SEQ ID NO: 172735 - DNA, 25 bp, Homo sapien
tttttactgtaggtgaaggctgtat

SEQ ID NO: 172736 - DNA, 25 bp, Homo sapien
aaggctgtatttgtagtagtactca

SEQ ID NO: 172737 - DNA, 25 bp, Homo sapien
gtagtactcaagaatcacctgatgt

SEQ ID NO: 172738 - DNA, 25 bp, Homo sapien
cacctgatgttttcttattctcctt

SEQ ID NO: 172739 - DNA, 25 bp, Homo sapien
gccttgctccgaaagcctagagacc

SEQ ID NO: 172740 - DNA, 25 bp, Homo sapien
gaaagcctagagaccgccactgtga

SEQ ID NO: 172741 - DNA, 25 bp, Homo sapien
tagagaccgccactgtgattcacct

SEQ ID NO: 172742 - DNA, 25 bp, Homo sapien
gagaccgccactgtgattcacctat

SEQ ID NO: 172743 - DNA, 25 bp, Homo sapien
aaagctgcagccagcatccttatct

SEQ ID NO: 172744 - DNA, 25 bp, Homo sapien
acagcctggacctgtcatagagctt

SEQ ID NO: 172745 - DNA, 25 bp, Homo sapien
tgtcatagagctttctcctgttctg

SEQ ID NO: 172746 - DNA, 25 bp, Homo sapien
gcctttcaggtcactcaataaatgt

SEQ ID NO: 172747 - DNA, 25 bp, Homo sapien
tttcaggtcactcaataaatgtgct

SEQ ID NO: 172748 - DNA, 25 bp, Homo sapien
atgtgctggagtaacacactcaaac

SEQ ID NO: 172749 - DNA, 25 bp, Homo sapien
tgctggagtaacacactcaaacgag

SEQ ID NO: 172750 - DNA, 25 bp, Homo sapien
gggcctccaccacttggagtaccga

SEQ ID NO: 172751 - DNA, 25 bp, Homo sapien
tccaccacttggagtaccgagctca

SEQ ID NO: 172752 - DNA, 25 bp, Homo sapien
accacttggagtaccgagctcagga

SEQ ID NO: 172753 - DNA, 25 bp, Homo sapien
tgaccccagtgtccgagagcagcaa

SEQ ID NO: 172754 - DNA, 25 bp, Homo sapien
accccagtgtccgagagcagcaagg

SEQ ID NO: 172755 - DNA, 25 bp, Homo sapien
cccagtgtccgagagcagcaaggtc

SEQ ID NO: 172756 - DNA, 25 bp, Homo sapien
cagtgtccgagagcagcaaggtcgt

SEQ ID NO: 172757 - DNA, 25 bp, Homo sapien
tgtccgagagcagcaaggtcgtcgt

SEQ ID NO: 172758 - DNA, 25 bp, Homo sapien
aggtcgtcgtggtggagagtgtcat

SEQ ID NO: 172759 - DNA, 25 bp, Homo sapien
tctggtagccatagcagcccctgct

SEQ ID NO: 172760 - DNA, 25 bp, Homo sapien
cctgcctttccctgacacttttggg

SEQ ID NO: 172761 - DNA, 25 bp, Homo sapien
gaacatgatattttatagcttggga

SEQ ID NO: 172762 - DNA, 25 bp, Homo sapien
atagcttgggaagaaacttgcagat

SEQ ID NO: 172763 - DNA, 25 bp, Homo sapien
agatgatatgtgctgcctttgcttc

SEQ ID NO: 172764 - DNA, 25 bp, Homo sapien
atatgtgctgcctttgcttcttatc

SEQ ID NO: 172765 - DNA, 25 bp, Homo sapien
ctgcctttgcttcttatcattcatg

SEQ ID NO: 172766 - DNA, 25 bp, Homo sapien
aaatcacttgatgtaacctggaaac

SEQ ID NO: 172767 - DNA, 25 bp, Homo sapien
gatgtaacctggaaactatgcttta

SEQ ID NO: 172768 - DNA, 25 bp, Homo sapien
ggaaactatgctttacatggcaatc

SEQ ID NO: 172769 - DNA, 25 bp, Homo sapien
ttacatggcaatcaaagccttttga

SEQ ID NO: 172770 - DNA, 25 bp, Homo sapien
caaagccttttgatcatgtacattt

SEQ ID NO: 172771 - DNA, 25 bp, Homo sapien
ggtggataacacctgcttttcaaat

SEQ ID NO: 172772 - DNA, 25 bp, Homo sapien
ttgagatcctcaatgcccactttga

SEQ ID NO: 172773 - DNA, 25 bp, Homo sapien
cactttgagaagaacacacaccctt

SEQ ID NO: 172774 - DNA, 25 bp, Homo sapien
ccttctgggcaggaaatgaccgaaa

SEQ ID NO: 172775 - DNA, 25 bp, Homo sapien
aagctgaactatgaccgagaagtag

SEQ ID NO: 172776 - DNA, 25 bp, Homo sapien
agtagttagagtttggttctgcaat

SEQ ID NO: 172777 - DNA, 25 bp, Homo sapien
ggttctgcaataagaggcaagccct

SEQ ID NO: 172778 - DNA, 25 bp, Homo sapien
aggcaagccctgaagaacacaatta

SEQ ID NO: 172779 - DNA, 25 bp, Homo sapien
ttaaaacagcacgagccggccacgg

SEQ ID NO: 172780 - DNA, 25 bp, Homo sapien
ggcagtccctttggagcccttaaca

SEQ ID NO: 172781 - DNA, 25 bp, Homo sapien
ttggagcccttaacagactctctgg

SEQ ID NO: 172782 - DNA, 25 bp, Homo sapien
agactctctggaagaaaactcctaa

SEQ ID NO: 172783 - DNA, 25 bp, Homo sapien
acgtgcaaggactcccggagcctgt

SEQ ID NO: 172784 - DNA, 25 bp, Homo sapien
gtgcagccttggtggcaaatatctc

SEQ ID NO: 172785 - DNA, 25 bp, Homo sapien
gtggcaaatatctcatctgccggcc

SEQ ID NO: 172786 - DNA, 25 bp, Homo sapien
ccccaggacaagtggtatgaccagt

SEQ ID NO: 172787 - DNA, 25 bp, Homo sapien
ggtatgaccagtgataatgccccaa

SEQ ID NO: 172788 - DNA, 25 bp, Homo sapien
gaccagtgataatgccccaaggaca

SEQ ID NO: 172789 - DNA, 25 bp, Homo sapien
cgcccagtggagtaatttatgcctt

SEQ ID NO: 172790 - DNA, 25 bp, Homo sapien
gtaatttatgccttagtcttgtttt

SEQ ID NO: 172791 - DNA, 25 bp, Homo sapien
agtcttgttttgaggtagaaatgca

SEQ ID NO: 172792 - DNA, 25 bp, Homo sapien
ccctgtgcatagtacgacctttact

SEQ ID NO: 172793 - DNA, 25 bp, Homo sapien
tagtacgacctttactgtcgtattt

SEQ ID NO: 172794 - DNA, 25 bp, Homo sapien
cagcagccagatgcacccttaggta

SEQ ID NO: 172795 - DNA, 25 bp, Homo sapien
gccagatgcacccttaggtacaggg

SEQ ID NO: 172796 - DNA, 25 bp, Homo sapien
caacagggacctggagctaccctgg

SEQ ID NO: 172797 - DNA, 25 bp, Homo sapien
agggcccagcctctcatcatcgaag

SEQ ID NO: 172798 - DNA, 25 bp, Homo sapien
gcctctcatcatcgaaggcagctgg

SEQ ID NO: 172799 - DNA, 25 bp, Homo sapien
gtggcagacccgtccaagaagcagg

SEQ ID NO: 172800 - DNA, 25 bp, Homo sapien
ccaagaagcagggaccatggctgga

SEQ ID NO: 172801 - DNA, 25 bp, Homo sapien
tatggatggatggacttcggccgcc

SEQ ID NO: 172802 - DNA, 25 bp, Homo sapien
tgctgaggatgagaactaacaatcc

SEQ ID NO: 172803 - DNA, 25 bp, Homo sapien
aactaacaatcctagaaccaagctt

SEQ ID NO: 172804 - DNA, 25 bp, Homo sapien
agaaccaagcttcagagcctagcca

SEQ ID NO: 172805 - DNA, 25 bp, Homo sapien
taagagctttattagttccactgtt

SEQ ID NO: 172806 - DNA, 25 bp, Homo sapien
tattagttccactgttgctcagcca

SEQ ID NO: 172807 - DNA, 25 bp, Homo sapien
tgttgctcagccatctgagatgccc

SEQ ID NO: 172808 - DNA, 25 bp, Homo sapien
gatgtaatgtagctttccactggag

SEQ ID NO: 172809 - DNA, 25 bp, Homo sapien
gtagctttccactggagtctgggat

SEQ ID NO: 172810 - DNA, 25 bp, Homo sapien
gagtctgggatttgcaattctggag

SEQ ID NO: 172811 - DNA, 25 bp, Homo sapien
aattctggaggttaatcatgcttgt

SEQ ID NO: 172812 - DNA, 25 bp, Homo sapien
ggttaatcatgcttgtactgtaatt

SEQ ID NO: 172813 - DNA, 25 bp, Homo sapien
aaccactacttgtatgatatgaata

SEQ ID NO: 172814 - DNA, 25 bp, Homo sapien
atgttactagacttttaatcttgta

SEQ ID NO: 172815 - DNA, 25 bp, Homo sapien
aatattttacccagagttgcacatg

SEQ ID NO: 172816 - DNA, 25 bp, Homo sapien
ttgccttcaatgcaatagcagcctg

SEQ ID NO: 172817 - DNA, 25 bp, Homo sapien
atagcagcctggtgtatggagcaaa

SEQ ID NO: 172818 - DNA, 25 bp, Homo sapien
agccattatcttcagttattcagtg

SEQ ID NO: 172819 - DNA, 25 bp, Homo sapien
gtagaaattcttggcagacgtgcag

SEQ ID NO: 172820 - DNA, 25 bp, Homo sapien
agacgtgcagaacaattacctcaaa

SEQ ID NO: 172821 - DNA, 25 bp, Homo sapien
ttgaaggtactctccaaatggtttg

SEQ ID NO: 172822 - DNA, 25 bp, Homo sapien
atggtttggattaatcgctgctttc

SEQ ID NO: 172823 - DNA, 25 bp, Homo sapien
taatcgctgctttccaggatatgga

SEQ ID NO: 172824 - DNA, 25 bp, Homo sapien
ggaatgaatgtccagcaacatccaa

SEQ ID NO: 172825 - DNA, 25 bp, Homo sapien
atccaaaatgtcctgagtgctgtgt

SEQ ID NO: 172826 - DNA, 25 bp, Homo sapien
ctgagtgctgtgtgatctgcagccc

SEQ ID NO: 172827 - DNA, 25 bp, Homo sapien
ccatgttctctccacatccgtaaat

SEQ ID NO: 172828 - DNA, 25 bp, Homo sapien
gaatttgctggaggactaggccaga

SEQ ID NO: 172829 - DNA, 25 bp, Homo sapien
ggactaggccagagcaagcctcact

SEQ ID NO: 172830 - DNA, 25 bp, Homo sapien
agagcaagcctcactgccactgtgc

SEQ ID NO: 172831 - DNA, 25 bp, Homo sapien
tcctctgtttcttctacctggataa

SEQ ID NO: 172832 - DNA, 25 bp, Homo sapien
tcttctacctggataattcttggcc

SEQ ID NO: 172833 - DNA, 25 bp, Homo sapien
ataattcttggccatgttctctctt

SEQ ID NO: 172834 - DNA, 25 bp, Homo sapien
tctcttctctaggttcaggtcagct

SEQ ID NO: 172835 - DNA, 25 bp, Homo sapien
ttctctaggttcaggtcagctctgc

SEQ ID NO: 172836 - DNA, 25 bp, Homo sapien
ctgccctggcttggagaatctgttt

SEQ ID NO: 172837 - DNA, 25 bp, Homo sapien
gagaatctgttttcaatctccactg

SEQ ID NO: 172838 - DNA, 25 bp, Homo sapien
ggacagggctgcttgttcagttatt

SEQ ID NO: 172839 - DNA, 25 bp, Homo sapien
gttattactgcctcggagctcaaat

SEQ ID NO: 172840 - DNA, 25 bp, Homo sapien
gagctcaaatcccaccgaagtcctg

SEQ ID NO: 172841 - DNA, 25 bp, Homo sapien
tccaggtctttcctaatgcacagta

SEQ ID NO: 172842 - DNA, 25 bp, Homo sapien
atgcacagtagtcagtctcagcttc

SEQ ID NO: 172843 - DNA, 25 bp, Homo sapien
tcagtctcagcttcggcagtattct

SEQ ID NO: 172844 - DNA, 25 bp, Homo sapien
agtattctcggctgtatgttctctg

SEQ ID NO: 172845 - DNA, 25 bp, Homo sapien
gttaagccacatgtctcaccaggaa

SEQ ID NO: 172846 - DNA, 25 bp, Homo sapien
tttatgccaggaaaccaggaagtca

SEQ ID NO: 172847 - DNA, 25 bp, Homo sapien
cattcaagttgttctctgaggccaa

SEQ ID NO: 172848 - DNA, 25 bp, Homo sapien
tgaggccaaagacactgagcacagc

SEQ ID NO: 172849 - DNA, 25 bp, Homo sapien
agctggagccgtacgagctggaaaa

SEQ ID NO: 172850 - DNA, 25 bp, Homo sapien
gaattctgtttgtctggtctttgaa

SEQ ID NO: 172851 - DNA, 25 bp, Homo sapien
ggtctttgaataaccaacccagtga

SEQ ID NO: 172852 - DNA, 25 bp, Homo sapien
taaccaacccagtgatttacatgct

SEQ ID NO: 172853 - DNA, 25 bp, Homo sapien
catgctgatagctaagtgagttttt

SEQ ID NO: 172854 - DNA, 25 bp, Homo sapien
gcacaactagttaaaagcctttcat

SEQ ID NO: 172855 - DNA, 25 bp, Homo sapien
tttcataccagtcagtatttcccag

SEQ ID NO: 172856 - DNA, 25 bp, Homo sapien
tcagtatttcccagccttgagcgca

SEQ ID NO: 172857 - DNA, 25 bp, Homo sapien
catacacacacgcattatttttgtt

SEQ ID NO: 172858 - DNA, 25 bp, Homo sapien
aaatcgtgtgacttttgagtatcgt

SEQ ID NO: 172859 - DNA, 25 bp, Homo sapien
ttgagtatcgtcagctggagccgta

SEQ ID NO: 172860 - DNA, 25 bp, Homo sapien
cgccttggcggacagtgggaacaga

SEQ ID NO: 172861 - DNA, 25 bp, Homo sapien
atgggaccttgaagactggctgctc

SEQ ID NO: 172862 - DNA, 25 bp, Homo sapien
gctgctccagcccaagaaagcctaa

SEQ ID NO: 172863 - DNA, 25 bp, Homo sapien
aagaaagcctaactgcatccctcat

SEQ ID NO: 172864 - DNA, 25 bp, Homo sapien
ctccttcgctgctggacagatggaa

SEQ ID NO: 172865 - DNA, 25 bp, Homo sapien
tgccggccgaaagtctgccagagtt

SEQ ID NO: 172866 - DNA, 25 bp, Homo sapien
aaagtctgccagagttcccggaggc

SEQ ID NO: 172867 - DNA, 25 bp, Homo sapien
ccggaggctcctgatgatgggtaaa

SEQ ID NO: 172868 - DNA, 25 bp, Homo sapien
gatgggtaaattggcacatgcttca

SEQ ID NO: 172869 - DNA, 25 bp, Homo sapien
ttggcacatgcttcactcaatgatt

SEQ ID NO: 172870 - DNA, 25 bp, Homo sapien
actcaatgattccacaagccctggg

SEQ ID NO: 172871 - DNA, 25 bp, Homo sapien
atgagtgtggccggtgtttcagcca

SEQ ID NO: 172872 - DNA, 25 bp, Homo sapien
tctcatctgaggcagcacatgaagg

SEQ ID NO: 172873 - DNA, 25 bp, Homo sapien
gaggcagcacatgaaggtgcataaa

SEQ ID NO: 172874 - DNA, 25 bp, Homo sapien
aaggtgcataaagaagagaagcctc

SEQ ID NO: 172875 - DNA, 25 bp, Homo sapien
ggcaaaaatatcagggtgaagactc

SEQ ID NO: 172876 - DNA, 25 bp, Homo sapien
gggtgaagactcacttaccctcttg

SEQ ID NO: 172877 - DNA, 25 bp, Homo sapien
tgaagactcacttaccctcttggaa

SEQ ID NO: 172878 - DNA, 25 bp, Homo sapien
aagactcacttaccctcttggaaag

SEQ ID NO: 172879 - DNA, 25 bp, Homo sapien
gaagtctgtggctggtctccgttaa

SEQ ID NO: 172880 - DNA, 25 bp, Homo sapien
gtctgtggctggtctccgttaagta

SEQ ID NO: 172881 - DNA, 25 bp, Homo sapien
ctgtggctggtctccgttaagtata

SEQ ID NO: 172882 - DNA, 25 bp, Homo sapien
gtaatacttatggatgttgtcaatt

SEQ ID NO: 172883 - DNA, 25 bp, Homo sapien
gaaagtattttgacaactcctagtg

SEQ ID NO: 172884 - DNA, 25 bp, Homo sapien
gacaactcctagtgaacttggactt

SEQ ID NO: 172885 - DNA, 25 bp, Homo sapien
gtgaacttggacttggttgctaaat

SEQ ID NO: 172886 - DNA, 25 bp, Homo sapien
tggttgctaaatttaacttacacta

SEQ ID NO: 172887 - DNA, 25 bp, Homo sapien
tccaaatgtgttttaatggcacctg

SEQ ID NO: 172888 - DNA, 25 bp, Homo sapien
gtgttttaatggcacctgggtgatt

SEQ ID NO: 172889 - DNA, 25 bp, Homo sapien
acctgggtgattcttcagctaaatt

SEQ ID NO: 172890 - DNA, 25 bp, Homo sapien
ggtgattcttcagctaaatttagtc

SEQ ID NO: 172891 - DNA, 25 bp, Homo sapien
ttttccatttggcatacatcgttct

SEQ ID NO: 172892 - DNA, 25 bp, Homo sapien
gcatacatcgttctttgttgtaatt

SEQ ID NO: 172893 - DNA, 25 bp, Homo sapien
attggttttccagaggcctgttttg

SEQ ID NO: 172894 - DNA, 25 bp, Homo sapien
taataatttttacctaatctccact

SEQ ID NO: 172895 - DNA, 25 bp, Homo sapien
atctccacttttttcataggttact

SEQ ID NO: 172896 - DNA, 25 bp, Homo sapien
aggttactacctatacaatgtatgt

SEQ ID NO: 172897 - DNA, 25 bp, Homo sapien
gtatgtaatttgtttcccctagctt

SEQ ID NO: 172898 - DNA, 25 bp, Homo sapien
tttgtttcccctagcttactgataa

SEQ ID NO: 172899 - DNA, 25 bp, Homo sapien
tttcccctagcttactgataaacct

SEQ ID NO: 172900 - DNA, 25 bp, Homo sapien
caatgaacttccatttgtattcaaa

SEQ ID NO: 172901 - DNA, 25 bp, Homo sapien
atttgtgtcataccagaaagctcta

SEQ ID NO: 172902 - DNA, 25 bp, Homo sapien
ccagaaagctctacatttgcagatg

SEQ ID NO: 172903 - DNA, 25 bp, Homo sapien
gtaaaactttggtgcattgttattt

SEQ ID NO: 172904 - DNA, 25 bp, Homo sapien
gttgtatcaacaatgattaactcct

SEQ ID NO: 172905 - DNA, 25 bp, Homo sapien
aactcctttattatacatacacatg

SEQ ID NO: 172906 - DNA, 25 bp, Homo sapien
gattctataatgtttactgatcttt

SEQ ID NO: 172907 - DNA, 25 bp, Homo sapien
accatctatagtgagcctctccata

SEQ ID NO: 172908 - DNA, 25 bp, Homo sapien
gtgagcctctccataattagtgcca

SEQ ID NO: 172909 - DNA, 25 bp, Homo sapien
aattagtgccaaccattagtctcgt

SEQ ID NO: 172910 - DNA, 25 bp, Homo sapien
gccaaccattagtctcgttcatatt

SEQ ID NO: 172911 - DNA, 25 bp, Homo sapien
gtctcgttcatatttttacaccagg

SEQ ID NO: 172912 - DNA, 25 bp, Homo sapien
tatttttacaccaggagtcaacaaa

SEQ ID NO: 172913 - DNA, 25 bp, Homo sapien
acaaactgtgccattggccaaatat

SEQ ID NO: 172914 - DNA, 25 bp, Homo sapien
gccattggccaaatatggcctccca

SEQ ID NO: 172915 - DNA, 25 bp, Homo sapien
aaaagtttttgtcactatcttcaca

SEQ ID NO: 172916 - DNA, 25 bp, Homo sapien
gtcactatcttcacaagtgtgtaaa

SEQ ID NO: 172917 - DNA, 25 bp, Homo sapien
gtgtaaagcacagatttcaacagag

SEQ ID NO: 172918 - DNA, 25 bp, Homo sapien
gatttcaacagagtgcttggcatat

SEQ ID NO: 172919 - DNA, 25 bp, Homo sapien
gtgcttggcatattgtagggtgctc

SEQ ID NO: 172920 - DNA, 25 bp, Homo sapien
attgtagggtgctcaatggtggttt

SEQ ID NO: 172921 - DNA, 25 bp, Homo sapien
tattactcagattccacagtggcaa

SEQ ID NO: 172922 - DNA, 25 bp, Homo sapien
gtggcaagaaacatcattctacata

SEQ ID NO: 172923 - DNA, 25 bp, Homo sapien
gaaaacatttacatcaaatcccact

SEQ ID NO: 172924 - DNA, 25 bp, Homo sapien
tcaaatcccacttactttaatgcga

SEQ ID NO: 172925 - DNA, 25 bp, Homo sapien
acttactttaatgcgaacttggaga

SEQ ID NO: 172926 - DNA, 25 bp, Homo sapien
tgaccttaggacttaaagaagccct

SEQ ID NO: 172927 - DNA, 25 bp, Homo sapien
aagaagccctaactggttcatcctt

SEQ ID NO: 172928 - DNA, 25 bp, Homo sapien
tggttcatccttaccagtggccaag

SEQ ID NO: 172929 - DNA, 25 bp, Homo sapien
gtggccaagcacattaactttctca

SEQ ID NO: 172930 - DNA, 25 bp, Homo sapien
aactttctcatacactgactgttac

SEQ ID NO: 172931 - DNA, 25 bp, Homo sapien
cactgactgttactttaactgttag

SEQ ID NO: 172932 - DNA, 25 bp, Homo sapien
agttgggacatcagctgactaatag

SEQ ID NO: 172933 - DNA, 25 bp, Homo sapien
gactaatagacctcagcctcaaaag

SEQ ID NO: 172934 - DNA, 25 bp, Homo sapien
aatgccagtaattcagctgctacat

SEQ ID NO: 172935 - DNA, 25 bp, Homo sapien
ttcagctgctacatccaagcactga

SEQ ID NO: 172936 - DNA, 25 bp, Homo sapien
aagcactgaagtcttacccgtcaac

SEQ ID NO: 172937 - DNA, 25 bp, Homo sapien
gcaaagatgtgaatggacccgaacc

SEQ ID NO: 172938 - DNA, 25 bp, Homo sapien
tgaatggacccgaaccactcaacag

SEQ ID NO: 172939 - DNA, 25 bp, Homo sapien
agccgaagcaacaaactgcactttg

SEQ ID NO: 172940 - DNA, 25 bp, Homo sapien
ctgcactttgcttttcgactatatg

SEQ ID NO: 172941 - DNA, 25 bp, Homo sapien
agatctcccgtgatgagctgttaca

SEQ ID NO: 172942 - DNA, 25 bp, Homo sapien
gagctgttacaggtgctacgcatga

SEQ ID NO: 172943 - DNA, 25 bp, Homo sapien
gtgctacgcatgatggtcggagtaa

SEQ ID NO: 172944 - DNA, 25 bp, Homo sapien
agctgggcagcatcgcagacaggac

SEQ ID NO: 172945 - DNA, 25 bp, Homo sapien
cgcagacaggaccattcaggaggct

SEQ ID NO: 172946 - DNA, 25 bp, Homo sapien
gggacagtgccatatctttcacaga

SEQ ID NO: 172947 - DNA, 25 bp, Homo sapien
atgagcatccgatttcttcactaaa

SEQ ID NO: 172948 - DNA, 25 bp, Homo sapien
ttgtcctttctctctaattcagtgt

SEQ ID NO: 172949 - DNA, 25 bp, Homo sapien
aattcagtgttttggaggcctgact

SEQ ID NO: 172950 - DNA, 25 bp, Homo sapien
tgttttccttcttcccaatagaaga

SEQ ID NO: 172951 - DNA, 25 bp, Homo sapien
agtcatggagcctgaagggtgccta

SEQ ID NO: 172952 - DNA, 25 bp, Homo sapien
gggtgcctagttgacttactgacaa

SEQ ID NO: 172953 - DNA, 25 bp, Homo sapien
aaaaggctctagttgggctgaacat

SEQ ID NO: 172954 - DNA, 25 bp, Homo sapien
gtgtggtggtgactcatttccatgc

SEQ ID NO: 172955 - DNA, 25 bp, Homo sapien
gtgactcatttccatgccattgtgg

SEQ ID NO: 172956 - DNA, 25 bp, Homo sapien
attgagcagagaacctgctctcgga

SEQ ID NO: 172957 - DNA, 25 bp, Homo sapien
ctgctctcggaggatgcctagaaga

SEQ ID NO: 172958 - DNA, 25 bp, Homo sapien
ggacttaaactgctgaattcacctg

SEQ ID NO: 172959 - DNA, 25 bp, Homo sapien
tctttttcgaattcacgaggaagta

SEQ ID NO: 172960 - DNA, 25 bp, Homo sapien
gaagtaaaccagtggcacccatgtg

SEQ ID NO: 172961 - DNA, 25 bp, Homo sapien
acccatgtgacataggcagcagctg

SEQ ID NO: 172962 - DNA, 25 bp, Homo sapien
agaccagcatgcctaggctgctcca

SEQ ID NO: 172963 - DNA, 25 bp, Homo sapien
ggcatgacaggagcctatggtacct

SEQ ID NO: 172964 - DNA, 25 bp, Homo sapien
ggagcctatggtaccttcagaggaa

SEQ ID NO: 172965 - DNA, 25 bp, Homo sapien
gaggaaaacctcctgttctgatgcc

SEQ ID NO: 172966 - DNA, 25 bp, Homo sapien
tcctgttctgatgcccagagctgct

SEQ ID NO: 172967 - DNA, 25 bp, Homo sapien
tgctgggataggcagagtacttctt

SEQ ID NO: 172968 - DNA, 25 bp, Homo sapien
gtacttcttggagggaatggcaccc

SEQ ID NO: 172969 - DNA, 25 bp, Homo sapien
agagtctagggcctgagtctctcct

SEQ ID NO: 172970 - DNA, 25 bp, Homo sapien
agcaaaagaaacaccagtgttagct

SEQ ID NO: 172971 - DNA, 25 bp, Homo sapien
ataactattacagtgttggagaaca

SEQ ID NO: 172972 - DNA, 25 bp, Homo sapien
tatttttccagctccgtgtttctct

SEQ ID NO: 172973 - DNA, 25 bp, Homo sapien
tccagctccgtgtttctctaaggaa

SEQ ID NO: 172974 - DNA, 25 bp, Homo sapien
gctccgtgtttctctaaggaattat

SEQ ID NO: 172975 - DNA, 25 bp, Homo sapien
aggaattatttcacacacggaccat

SEQ ID NO: 172976 - DNA, 25 bp, Homo sapien
attatttcacacacggaccatcttt

SEQ ID NO: 172977 - DNA, 25 bp, Homo sapien
acacacggaccatctttagcagttt

SEQ ID NO: 172978 - DNA, 25 bp, Homo sapien
ggaccatctttagcagtttcctcag

SEQ ID NO: 172979 - DNA, 25 bp, Homo sapien
ccatctttagcagtttcctcagtga

SEQ ID NO: 172980 - DNA, 25 bp, Homo sapien
gtgagtcattatgtagctgtcgtac

SEQ ID NO: 172981 - DNA, 25 bp, Homo sapien
cattttacaatctgacatctggagt

SEQ ID NO: 172982 - DNA, 25 bp, Homo sapien
ctgacatctggagtatattgaacat

SEQ ID NO: 172983 - DNA, 25 bp, Homo sapien
gaacataggctatttcttgatataa

SEQ ID NO: 172984 - DNA, 25 bp, Homo sapien
actcatttaattgtggccatccaaa

SEQ ID NO: 172985 - DNA, 25 bp, Homo sapien
gcagaatttatcttgttcataatga

SEQ ID NO: 172986 - DNA, 25 bp, Homo sapien
gtgttatagctgaatacctgtgcat

SEQ ID NO: 172987 - DNA, 25 bp, Homo sapien
gaatacctgtgcatgaatgggcaat

SEQ ID NO: 172988 - DNA, 25 bp, Homo sapien
tcatctgtttacttgtagtgccata

SEQ ID NO: 172989 - DNA, 25 bp, Homo sapien
gtagtgccatagaggccaatatgca

SEQ ID NO: 172990 - DNA, 25 bp, Homo sapien
actaatgccaagacatggctgttta

SEQ ID NO: 172991 - DNA, 25 bp, Homo sapien
cagttatcactgatgcttttgcact

SEQ ID NO: 172992 - DNA, 25 bp, Homo sapien
tttcctgacactctcaactgtgcag

SEQ ID NO: 172993 - DNA, 25 bp, Homo sapien
ttcctgacactctcaactgtgcaga

SEQ ID NO: 172994 - DNA, 25 bp, Homo sapien
tcctgacactctcaactgtgcagaa

SEQ ID NO: 172995 - DNA, 25 bp, Homo sapien
gtgcagaagtaaaaatctttcccca

SEQ ID NO: 172996 - DNA, 25 bp, Homo sapien
gcagaagtaaaaatctttccccaga

SEQ ID NO: 172997 - DNA, 25 bp, Homo sapien
aaatctttccccagaagaagtgtga

SEQ ID NO: 172998 - DNA, 25 bp, Homo sapien
aagaagtgtgaggatgcttacccgg

SEQ ID NO: 172999 - DNA, 25 bp, Homo sapien
gggcagatcacagatggcatggtct

SEQ ID NO: 173000 - DNA, 25 bp, Homo sapien
gcagatcacagatggcatggtctgt

SEQ ID NO: 173001 - DNA, 25 bp, Homo sapien
catggtctgtgcaggcagcagcaaa

SEQ ID NO: 173002 - DNA, 25 bp, Homo sapien
tgacacgtgccagggcgattctgga

SEQ ID NO: 173003 - DNA, 25 bp, Homo sapien
agtctcctttgcagcttaggatggc

SEQ ID NO: 173004 - DNA, 25 bp, Homo sapien
gcagcttaggatggctatgtgatca

SEQ ID NO: 173005 - DNA, 25 bp, Homo sapien
ctatgtgatcaggtgtggccaatga

SEQ ID NO: 173006 - DNA, 25 bp, Homo sapien
gggcttctgggaaagcttttccaat

SEQ ID NO: 173007 - DNA, 25 bp, Homo sapien
aagacacaggcatggctaacacctc

SEQ ID NO: 173008 - DNA, 25 bp, Homo sapien
ttcctaccttgattgagggtgtgat

SEQ ID NO: 173009 - DNA, 25 bp, Homo sapien
cagccactttgctaccatgacaaaa

SEQ ID NO: 173010 - DNA, 25 bp, Homo sapien
gagaatcacagagtcattgacccta

SEQ ID NO: 173011 - DNA, 25 bp, Homo sapien
gaccctatcattatttcaccaagcc

SEQ ID NO: 173012 - DNA, 25 bp, Homo sapien
attatttcaccaagccaataccagc

SEQ ID NO: 173013 - DNA, 25 bp, Homo sapien
ccatccttctccagaattcttgtaa

SEQ ID NO: 173014 - DNA, 25 bp, Homo sapien
gaaggctcaccggaggacacataca

SEQ ID NO: 173015 - DNA, 25 bp, Homo sapien
ctggaagttcgctcgttcagatgaa

SEQ ID NO: 173016 - DNA, 25 bp, Homo sapien
gaactgacgaggcattaccgcaaac

SEQ ID NO: 173017 - DNA, 25 bp, Homo sapien
gcaaacatacgggagtgaagccatt

SEQ ID NO: 173018 - DNA, 25 bp, Homo sapien
gaagccattcaagtgcgcggactgt

SEQ ID NO: 173019 - DNA, 25 bp, Homo sapien
gcgcggactgtgatcgcagcttttc

SEQ ID NO: 173020 - DNA, 25 bp, Homo sapien
agcttttcccggtcagatcatttgg

SEQ ID NO: 173021 - DNA, 25 bp, Homo sapien
ggtcagatcatttggccctgcaccg

SEQ ID NO: 173022 - DNA, 25 bp, Homo sapien
tgcaccgccggaggcatatgttggt

SEQ ID NO: 173023 - DNA, 25 bp, Homo sapien
gaaaacggcgtatccacagatgtga

SEQ ID NO: 173024 - DNA, 25 bp, Homo sapien
aaaaagttctcacctgaaggctcac

SEQ ID NO: 173025 - DNA, 25 bp, Homo sapien
ggccctgcctggtggcaagagggaa

SEQ ID NO: 173026 - DNA, 25 bp, Homo sapien
agggaatgtcagcaggaccccatcg

SEQ ID NO: 173027 - DNA, 25 bp, Homo sapien
atccctgtgtctctacacgctgtat

SEQ ID NO: 173028 - DNA, 25 bp, Homo sapien
tgtgtctctacacgctgtattgtgt

SEQ ID NO: 173029 - DNA, 25 bp, Homo sapien
acacgctgtattgtgtatcaccggg

SEQ ID NO: 173030 - DNA, 25 bp, Homo sapien
caccgggggcattattttcattgta

SEQ ID NO: 173031 - DNA, 25 bp, Homo sapien
tgtaatgttcatttcccacccctgc

SEQ ID NO: 173032 - DNA, 25 bp, Homo sapien
tgctccagcctcgatttggttttat

SEQ ID NO: 173033 - DNA, 25 bp, Homo sapien
ctccagcctcgatttggttttattt

SEQ ID NO: 173034 - DNA, 25 bp, Homo sapien
ggcacaagtgtctgtgcatgtcccc

SEQ ID NO: 173035 - DNA, 25 bp, Homo sapien
agaaacaagacagggcttctctcag

SEQ ID NO: 173036 - DNA, 25 bp, Homo sapien
ttcagtattttatcactaatgtatg

SEQ ID NO: 173037 - DNA, 25 bp, Homo sapien
taatgtatgagcaatgatctatatc

SEQ ID NO: 173038 - DNA, 25 bp, Homo sapien
gatctatatcaatttcaaggcacgt

SEQ ID NO: 173039 - DNA, 25 bp, Homo sapien
ctatatcaatttcaaggcacgtgaa

SEQ ID NO: 173040 - DNA, 25 bp, Homo sapien
tatagaaagatttctgcctgtttgg

SEQ ID NO: 173041 - DNA, 25 bp, Homo sapien
ttctgcctgtttggacaataggttt

SEQ ID NO: 173042 - DNA, 25 bp, Homo sapien
gataagtaagcttatatatgcacag

SEQ ID NO: 173043 - DNA, 25 bp, Homo sapien
atgcacagagattattgtattacct

SEQ ID NO: 173044 - DNA, 25 bp, Homo sapien
gtacttaaaagcgtggtccccagtg

SEQ ID NO: 173045 - DNA, 25 bp, Homo sapien
cttaaaagcgtggtccccagtgagg

SEQ ID NO: 173046 - DNA, 25 bp, Homo sapien
cagtgaggccaagaaagtttccggt

SEQ ID NO: 173047 - DNA, 25 bp, Homo sapien
ggacagtgccgcaccctcaacatag

SEQ ID NO: 173048 - DNA, 25 bp, Homo sapien
gacagtgccgcaccctcaacatagg

SEQ ID NO: 173049 - DNA, 25 bp, Homo sapien
cgcaccctcaacataggccatgtgg

SEQ ID NO: 173050 - DNA, 25 bp, Homo sapien
gcaccctcaacataggccatgtggg

SEQ ID NO: 173051 - DNA, 25 bp, Homo sapien
ttctcctgccatgcgagggcactcg

SEQ ID NO: 173052 - DNA, 25 bp, Homo sapien
agggcactcgccttctgccttctgg

SEQ ID NO: 173053 - DNA, 25 bp, Homo sapien
cccctcagaccagccaggaacctct

SEQ ID NO: 173054 - DNA, 25 bp, Homo sapien
cagaagtgccagatgacagtcagag

SEQ ID NO: 173055 - DNA, 25 bp, Homo sapien
gatgacagtcagaggcgcaggagcc

SEQ ID NO: 173056 - DNA, 25 bp, Homo sapien
gtgttgttcggggacagccaccgcc

SEQ ID NO: 173057 - DNA, 25 bp, Homo sapien
ggacagccaccgccttgagtctggc

SEQ ID NO: 173058 - DNA, 25 bp, Homo sapien
ctgtagcacctcactaaccattcga

SEQ ID NO: 173059 - DNA, 25 bp, Homo sapien
taaccattcgactgagcacactttc

SEQ ID NO: 173060 - DNA, 25 bp, Homo sapien
gagcacactttcatatttgtatcag

SEQ ID NO: 173061 - DNA, 25 bp, Homo sapien
gtatcagcttttgtgctaaaactct

SEQ ID NO: 173062 - DNA, 25 bp, Homo sapien
aaaactctctaagtacatccacctg

SEQ ID NO: 173063 - DNA, 25 bp, Homo sapien
agtacatccacctgtgtaataggaa

SEQ ID NO: 173064 - DNA, 25 bp, Homo sapien
ggaacctgtgaattgtactggatga

SEQ ID NO: 173065 - DNA, 25 bp, Homo sapien
ttactgattgtatgtgacctgaaaa

SEQ ID NO: 173066 - DNA, 25 bp, Homo sapien
ggtggagtcagtttgtatcagttaa

SEQ ID NO: 173067 - DNA, 25 bp, Homo sapien
taggatgttcatattccaaggatat

SEQ ID NO: 173068 - DNA, 25 bp, Homo sapien
aatcatcctatatggctaacattgt

SEQ ID NO: 173069 - DNA, 25 bp, Homo sapien
ctcaggctcctgaagggttgattct

SEQ ID NO: 173070 - DNA, 25 bp, Homo sapien
tgaagggttgattctcctgatagat

SEQ ID NO: 173071 - DNA, 25 bp, Homo sapien
gaagtactaccaaaatgtaactgct

SEQ ID NO: 173072 - DNA, 25 bp, Homo sapien
aactgctaatcaagggtgatgcaca

SEQ ID NO: 173073 - DNA, 25 bp, Homo sapien
gcacagcaaaagcaatggaccccat

SEQ ID NO: 173074 - DNA, 25 bp, Homo sapien
agcaatggaccccatccctctaaag

SEQ ID NO: 173075 - DNA, 25 bp, Homo sapien
ttgccttcaactgtatatgctgggt

SEQ ID NO: 173076 - DNA, 25 bp, Homo sapien
atgctgggtatttcatttgtctttt

SEQ ID NO: 173077 - DNA, 25 bp, Homo sapien
gagaaagcgtttttaactgcaactt

SEQ ID NO: 173078 - DNA, 25 bp, Homo sapien
actttctataatgccaaaatgacac

SEQ ID NO: 173079 - DNA, 25 bp, Homo sapien
tgacacatctgtgcaatagaatgat

SEQ ID NO: 173080 - DNA, 25 bp, Homo sapien
tctgcgaaataagcctcatccttaa

SEQ ID NO: 173081 - DNA, 25 bp, Homo sapien
tgcgaaataagcctcatccttaaag

SEQ ID NO: 173082 - DNA, 25 bp, Homo sapien
gcgaaataagcctcatccttaaaga

SEQ ID NO: 173083 - DNA, 25 bp, Homo sapien
cgaaataagcctcatccttaaagag

SEQ ID NO: 173084 - DNA, 25 bp, Homo sapien
gaaataagcctcatccttaaagaga

SEQ ID NO: 173085 - DNA, 25 bp, Homo sapien
aaataagcctcatccttaaagagaa

SEQ ID NO: 173086 - DNA, 25 bp, Homo sapien
aataagcctcatccttaaagagaag

SEQ ID NO: 173087 - DNA, 25 bp, Homo sapien
taagcctcatccttaaagagaagtc

SEQ ID NO: 173088 - DNA, 25 bp, Homo sapien
aagcctcatccttaaagagaagtca

SEQ ID NO: 173089 - DNA, 25 bp, Homo sapien
gcctcatccttaaagagaagtcacc

SEQ ID NO: 173090 - DNA, 25 bp, Homo sapien
aagagaagtcaccggccgggcacgg

SEQ ID NO: 173091 - DNA, 25 bp, Homo sapien
tttctgtgtgctccgaggagaatgc

SEQ ID NO: 173092 - DNA, 25 bp, Homo sapien
ctccgaggagaatgcaaaggctggt

SEQ ID NO: 173093 - DNA, 25 bp, Homo sapien
gctggtggatgtagtgcctttcctc

SEQ ID NO: 173094 - DNA, 25 bp, Homo sapien
gatgtagtgcctttcctctactgct

SEQ ID NO: 173095 - DNA, 25 bp, Homo sapien
ttcctctactgctctctcagctggg

SEQ ID NO: 173096 - DNA, 25 bp, Homo sapien
agaatgacaggacgtgaacatgcac

SEQ ID NO: 173097 - DNA, 25 bp, Homo sapien
tgaacatgcacacaagggcccggaa

SEQ ID NO: 173098 - DNA, 25 bp, Homo sapien
aaccccgcgcttgcaggatttaggg

SEQ ID NO: 173099 - DNA, 25 bp, Homo sapien
aggatttagggcactagcacagcac

SEQ ID NO: 173100 - DNA, 25 bp, Homo sapien
agttctgctctctgcagcaacatag

SEQ ID NO: 173101 - DNA, 25 bp, Homo sapien
gctctctgcagcaacatagagtaca

SEQ ID NO: 173102 - DNA, 25 bp, Homo sapien
ttgtacgcactggagctgcactgca

SEQ ID NO: 173103 - DNA, 25 bp, Homo sapien
agctgcactgcataattctaagtct

SEQ ID NO: 173104 - DNA, 25 bp, Homo sapien
tctaagtcttccaccctgtttaaag

SEQ ID NO: 173105 - DNA, 25 bp, Homo sapien
cttacatttttcagacttcatcttc

SEQ ID NO: 173106 - DNA, 25 bp, Homo sapien
aaactgccattaccaaacgattccg

SEQ ID NO: 173107 - DNA, 25 bp, Homo sapien
gccacacatccttttagctacaggg

SEQ ID NO: 173108 - DNA, 25 bp, Homo sapien
agggctgatacatccttctgtggct

SEQ ID NO: 173109 - DNA, 25 bp, Homo sapien
atccttctgtggcttggagatgaat

SEQ ID NO: 173110 - DNA, 25 bp, Homo sapien
gattccgtgtgtgtactgattcaag

SEQ ID NO: 173111 - DNA, 25 bp, Homo sapien
tagaaatgttcacaaggtaccccaa

SEQ ID NO: 173112 - DNA, 25 bp, Homo sapien
caaggtaccccaaaactctgtagct

SEQ ID NO: 173113 - DNA, 25 bp, Homo sapien
aatccattgcccgtgttctcacagt

SEQ ID NO: 173114 - DNA, 25 bp, Homo sapien
tccattgcccgtgttctcacagtta

SEQ ID NO: 173115 - DNA, 25 bp, Homo sapien
cattgcccgtgttctcacagttatt

SEQ ID NO: 173116 - DNA, 25 bp, Homo sapien
attgcccgtgttctcacagttatta

SEQ ID NO: 173117 - DNA, 25 bp, Homo sapien
ttgcccgtgttctcacagttattaa

SEQ ID NO: 173118 - DNA, 25 bp, Homo sapien
tgcccgtgttctcacagttattaac

SEQ ID NO: 173119 - DNA, 25 bp, Homo sapien
gcccgtgttctcacagttattaacc

SEQ ID NO: 173120 - DNA, 25 bp, Homo sapien
cccgtgttctcacagttattaacca

SEQ ID NO: 173121 - DNA, 25 bp, Homo sapien
gttctcacagttattaaccagactc

SEQ ID NO: 173122 - DNA, 25 bp, Homo sapien
cacagttattaaccagactcagaaa

SEQ ID NO: 173123 - DNA, 25 bp, Homo sapien
gttattaaccagactcagaaagaaa

SEQ ID NO: 173124 - DNA, 25 bp, Homo sapien
ggtgaatgtcatttaagggagttac

SEQ ID NO: 173125 - DNA, 25 bp, Homo sapien
gggagttacatctttattctgctaa

SEQ ID NO: 173126 - DNA, 25 bp, Homo sapien
ttctgctaaagaagaggatcattga

SEQ ID NO: 173127 - DNA, 25 bp, Homo sapien
ggatcattgatttctgtacagtcag

SEQ ID NO: 173128 - DNA, 25 bp, Homo sapien
tacagtcagaacagtacttgggtgt

SEQ ID NO: 173129 - DNA, 25 bp, Homo sapien
aacagtacttgggtgtgcaacagct

SEQ ID NO: 173130 - DNA, 25 bp, Homo sapien
acttgggtgtgcaacagctttctga

SEQ ID NO: 173131 - DNA, 25 bp, Homo sapien
gggtgtgcaacagctttctgagaaa

SEQ ID NO: 173132 - DNA, 25 bp, Homo sapien
taaaaagtaatgtgagcttctcctt

SEQ ID NO: 173133 - DNA, 25 bp, Homo sapien
agtaatgtgagcttctcctttttat

SEQ ID NO: 173134 - DNA, 25 bp, Homo sapien
ttttatacgagttggtaatttgtgc

SEQ ID NO: 173135 - DNA, 25 bp, Homo sapien
gtagttatgagtagcctaccacccc

SEQ ID NO: 173136 - DNA, 25 bp, Homo sapien
caccccttcaggatcagtcaaggga

SEQ ID NO: 173137 - DNA, 25 bp, Homo sapien
ggaaagcactagaacccctgggtag

SEQ ID NO: 173138 - DNA, 25 bp, Homo sapien
gtgaaggtttgtaaatagtccatga

SEQ ID NO: 173139 - DNA, 25 bp, Homo sapien
tagtccatgatgatgtcgtggcaga

SEQ ID NO: 173140 - DNA, 25 bp, Homo sapien
gtggcagagtctgatttctatatag

SEQ ID NO: 173141 - DNA, 25 bp, Homo sapien
ttttttaagtactgtgcaagctctg

SEQ ID NO: 173142 - DNA, 25 bp, Homo sapien
tactgtgcaagctctgtgcttctat

SEQ ID NO: 173143 - DNA, 25 bp, Homo sapien
agctctgtgcttctataatgtggga

SEQ ID NO: 173144 - DNA, 25 bp, Homo sapien
gaggatggcccctagcttaggaaga

SEQ ID NO: 173145 - DNA, 25 bp, Homo sapien
gcttaggaagactgttgtgttattt

SEQ ID NO: 173146 - DNA, 25 bp, Homo sapien
tacctagaccccctggtgatagtgg

SEQ ID NO: 173147 - DNA, 25 bp, Homo sapien
cccctggtgatagtggtaaccaaga

SEQ ID NO: 173148 - DNA, 25 bp, Homo sapien
gtaaccaagatgatggtcctcagca

SEQ ID NO: 173149 - DNA, 25 bp, Homo sapien
caagatgatggtcctcagcagagac

SEQ ID NO: 173150 - DNA, 25 bp, Homo sapien
agcagagaccaccaaaaccaggagg

SEQ ID NO: 173151 - DNA, 25 bp, Homo sapien
tttcaaaatcagcaacgaccacccc

SEQ ID NO: 173152 - DNA, 25 bp, Homo sapien
acgaggacaccgtcaactctctcta

SEQ ID NO: 173153 - DNA, 25 bp, Homo sapien
aagcatcatcattcttccggaggga

SEQ ID NO: 173154 - DNA, 25 bp, Homo sapien
atcatcattcttccggagggacaga

SEQ ID NO: 173155 - DNA, 25 bp, Homo sapien
ttcttccggagggacagaccagcaa

SEQ ID NO: 173156 - DNA, 25 bp, Homo sapien
agaccagcaagacatccccaggagc

SEQ ID NO: 173157 - DNA, 25 bp, Homo sapien
agagagcctcacacctcactaggtg

SEQ ID NO: 173158 - DNA, 25 bp, Homo sapien
tcactaggtgcagagagcccaggcc

SEQ ID NO: 173159 - DNA, 25 bp, Homo sapien
gagagcccaggccttatgttaaaat

SEQ ID NO: 173160 - DNA, 25 bp, Homo sapien
ggccttatgttaaaatcatgcactt

SEQ ID NO: 173161 - DNA, 25 bp, Homo sapien
aaagcaaaccttaatctgcaaagac

SEQ ID NO: 173162 - DNA, 25 bp, Homo sapien
cagcagcaagcattatacggtcatc

SEQ ID NO: 173163 - DNA, 25 bp, Homo sapien
ggtcatcttgaatgatccctttgaa

SEQ ID NO: 173164 - DNA, 25 bp, Homo sapien
acacccatattgtgtgttctgtgaa

SEQ ID NO: 173165 - DNA, 25 bp, Homo sapien
gtgtgttctgtgaatgctagctctc

SEQ ID NO: 173166 - DNA, 25 bp, Homo sapien
gaatgctagctctcttgaatttgga

SEQ ID NO: 173167 - DNA, 25 bp, Homo sapien
ttctgcaatgcgaacaggtacctat

SEQ ID NO: 173168 - DNA, 25 bp, Homo sapien
agaactaaaggcaactttggcgatt

SEQ ID NO: 173169 - DNA, 25 bp, Homo sapien
gcaactttggcgattaaagccttga

SEQ ID NO: 173170 - DNA, 25 bp, Homo sapien
aaagccttgatttggttgaatgaga

SEQ ID NO: 173171 - DNA, 25 bp, Homo sapien
aatttttactttgatgttcctgtat

SEQ ID NO: 173172 - DNA, 25 bp, Homo sapien
ttgatgttcctgtatttgcatatat

SEQ ID NO: 173173 - DNA, 25 bp, Homo sapien
cattaatgtgtttctattagtttga

SEQ ID NO: 173174 - DNA, 25 bp, Homo sapien
aatggacatgtgtgtaatggatccc

SEQ ID NO: 173175 - DNA, 25 bp, Homo sapien
gtgtgtaatggatcccaaagaatca

SEQ ID NO: 173176 - DNA, 25 bp, Homo sapien
atactactataagacattggctttt

SEQ ID NO: 173177 - DNA, 25 bp, Homo sapien
atccggggggttctgcatctacaag

SEQ ID NO: 173178 - DNA, 25 bp, Homo sapien
ctgcatctacaagaaagtttgttat

SEQ ID NO: 173179 - DNA, 25 bp, Homo sapien
ttcagctttttatataaacatccac

SEQ ID NO: 173180 - DNA, 25 bp, Homo sapien
gatactgattgattctggattgtgg

SEQ ID NO: 173181 - DNA, 25 bp, Homo sapien
gattgattctggattgtggtatagg

SEQ ID NO: 173182 - DNA, 25 bp, Homo sapien
gtggtatagggatatcttgtcttat

SEQ ID NO: 173183 - DNA, 25 bp, Homo sapien
ggatgggaatgctgtatctgtggaa

SEQ ID NO: 173184 - DNA, 25 bp, Homo sapien
atctgtggaagtcatgttatactgg

SEQ ID NO: 173185 - DNA, 25 bp, Homo sapien
gtcatgttatactggattcatttcc

SEQ ID NO: 173186 - DNA, 25 bp, Homo sapien
ctaaaattttatcacggatgaatgg

SEQ ID NO: 173187 - DNA, 25 bp, Homo sapien
gatgaatggatggacttgctctcta

SEQ ID NO: 173188 - DNA, 25 bp, Homo sapien
ggatggacttgctctctatgtaata

SEQ ID NO: 173189 - DNA, 25 bp, Homo sapien
ggacttgctctctatgtaatatgaa

SEQ ID NO: 173190 - DNA, 25 bp, Homo sapien
ctgtgcccagcgtttgtacttgcct

SEQ ID NO: 173191 - DNA, 25 bp, Homo sapien
gtgcccagcgtttgtacttgcctcc

SEQ ID NO: 173192 - DNA, 25 bp, Homo sapien
ttgtacttgcctcccccaacagtgg

SEQ ID NO: 173193 - DNA, 25 bp, Homo sapien
caacagtgggcctgttctacccgtg

SEQ ID NO: 173194 - DNA, 25 bp, Homo sapien
cagtgggcctgttctacccgtgcag

SEQ ID NO: 173195 - DNA, 25 bp, Homo sapien
gttctacccgtgcaggccccaggag

SEQ ID NO: 173196 - DNA, 25 bp, Homo sapien
tttcttggaagctggctctcactcc

SEQ ID NO: 173197 - DNA, 25 bp, Homo sapien
cctcagctagaggtaggatatccct

SEQ ID NO: 173198 - DNA, 25 bp, Homo sapien
ggtaggatatccctgattcctgggc

SEQ ID NO: 173199 - DNA, 25 bp, Homo sapien
aggatatccctgattcctgggctcc

SEQ ID NO: 173200 - DNA, 25 bp, Homo sapien
tgcctctctgccagtcagccacaga

SEQ ID NO: 173201 - DNA, 25 bp, Homo sapien
gcgtggtccatgctgatgattttgc

SEQ ID NO: 173202 - DNA, 25 bp, Homo sapien
gccaaaatgagttgtgatgaatcaa

SEQ ID NO: 173203 - DNA, 25 bp, Homo sapien
gatttcttcagaattagatggcctt

SEQ ID NO: 173204 - DNA, 25 bp, Homo sapien
ttaaaatattacacaggaggccttc

SEQ ID NO: 173205 - DNA, 25 bp, Homo sapien
aaatattacacaggaggccttcgga

SEQ ID NO: 173206 - DNA, 25 bp, Homo sapien
ggaggccttcggagtttcttagtca

SEQ ID NO: 173207 - DNA, 25 bp, Homo sapien
ttcccctacagaattttccctcttg

SEQ ID NO: 173208 - DNA, 25 bp, Homo sapien
ttccctcttggtgtgattgcacaga

SEQ ID NO: 173209 - DNA, 25 bp, Homo sapien
gcacagaatttgtatgtattttcag

SEQ ID NO: 173210 - DNA, 25 bp, Homo sapien
aattgcctgatttgttttcattata

SEQ ID NO: 173211 - DNA, 25 bp, Homo sapien
attatagacaacgatgaatttcttc

SEQ ID NO: 173212 - DNA, 25 bp, Homo sapien
ccccgctggagacggaagatctttt

SEQ ID NO: 173213 - DNA, 25 bp, Homo sapien
ctggagacggaagatcttttatttt

SEQ ID NO: 173214 - DNA, 25 bp, Homo sapien
ttataacttcagacttgggccccct

SEQ ID NO: 173215 - DNA, 25 bp, Homo sapien
tctttctttcccattaacttgagtg

SEQ ID NO: 173216 - DNA, 25 bp, Homo sapien
ttctttcccattaacttgagtgacc

SEQ ID NO: 173217 - DNA, 25 bp, Homo sapien
tttcccattaacttgagtgacctgt

SEQ ID NO: 173218 - DNA, 25 bp, Homo sapien
ccattaacttgagtgacctgtgtga

SEQ ID NO: 173219 - DNA, 25 bp, Homo sapien
aacttgagtgacctgtgtgagagac

SEQ ID NO: 173220 - DNA, 25 bp, Homo sapien
gtgacctgtgtgagagacagacaga

SEQ ID NO: 173221 - DNA, 25 bp, Homo sapien
ccccacgaggatggctggacaagga

SEQ ID NO: 173222 - DNA, 25 bp, Homo sapien
aggatggctggacaaggacttttac

SEQ ID NO: 173223 - DNA, 25 bp, Homo sapien
ggctcaggcatctgtgactgaccga

SEQ ID NO: 173224 - DNA, 25 bp, Homo sapien
ctcaggcatctgtgactgaccgatt

SEQ ID NO: 173225 - DNA, 25 bp, Homo sapien
caggcatctgtgactgaccgattga

SEQ ID NO: 173226 - DNA, 25 bp, Homo sapien
ggcatctgtgactgaccgattgatt

SEQ ID NO: 173227 - DNA, 25 bp, Homo sapien
gcatctgtgactgaccgattgattt

SEQ ID NO: 173228 - DNA, 25 bp, Homo sapien
ctgtgactgaccgattgatttgatt

SEQ ID NO: 173229 - DNA, 25 bp, Homo sapien
gtgactgaccgattgatttgatttg

SEQ ID NO: 173230 - DNA, 25 bp, Homo sapien
gactgaccgattgatttgatttgtt

SEQ ID NO: 173231 - DNA, 25 bp, Homo sapien
agagggagtctcgcctgggcaacaa

SEQ ID NO: 173232 - DNA, 25 bp, Homo sapien
agtgttacccatattcacattgttg

SEQ ID NO: 173233 - DNA, 25 bp, Homo sapien
ttgtcttttcatgcttcttttcttt

SEQ ID NO: 173234 - DNA, 25 bp, Homo sapien
ggtcatttttagtttgtgcttggaa

SEQ ID NO: 173235 - DNA, 25 bp, Homo sapien
atgacttaagtatctcctaaatgtg

SEQ ID NO: 173236 - DNA, 25 bp, Homo sapien
gtgatacagaagaacatctcatccc

SEQ ID NO: 173237 - DNA, 25 bp, Homo sapien
tgctcttctccacaatcaacagtag

SEQ ID NO: 173238 - DNA, 25 bp, Homo sapien
caacagtagcgccaaccctttcatt

SEQ ID NO: 173239 - DNA, 25 bp, Homo sapien
caaggagtccttaaaagttgttctg

SEQ ID NO: 173240 - DNA, 25 bp, Homo sapien
agttgttctgaccagggctttcaaa

SEQ ID NO: 173241 - DNA, 25 bp, Homo sapien
aaagatgaaatgcaacctcggcgcc

SEQ ID NO: 173242 - DNA, 25 bp, Homo sapien
acctcggcgccagaaagacaattgt

SEQ ID NO: 173243 - DNA, 25 bp, Homo sapien
atacggtcacagttgagactgtcgt

SEQ ID NO: 173244 - DNA, 25 bp, Homo sapien
gagactgtcgtctaagaactgtgag

SEQ ID NO: 173245 - DNA, 25 bp, Homo sapien
aacgttcttatcgtctgtgttccaa

SEQ ID NO: 173246 - DNA, 25 bp, Homo sapien
gtgttccaaatccaccaattgacga

SEQ ID NO: 173247 - DNA, 25 bp, Homo sapien
gacgagaagaatgccaccatgccag

SEQ ID NO: 173248 - DNA, 25 bp, Homo sapien
atgccagtcaccatgttgattcggg

SEQ ID NO: 173249 - DNA, 25 bp, Homo sapien
aaaccagcgaggatgcagacgagtt

SEQ ID NO: 173250 - DNA, 25 bp, Homo sapien
gaaaaaggatgcctgaacacgcaaa

SEQ ID NO: 173251 - DNA, 25 bp, Homo sapien
gaacacgcaaagtcggctgcagaat

SEQ ID NO: 173252 - DNA, 25 bp, Homo sapien
agtcggctgcagaattattgccaag

SEQ ID NO: 173253 - DNA, 25 bp, Homo sapien
tccaccgccccttaaagttagtcag

SEQ ID NO: 173254 - DNA, 25 bp, Homo sapien
tttcttctcttctttgacattctaa

SEQ ID NO: 173255 - DNA, 25 bp, Homo sapien
gattaatgtggccaataaaaccttt

SEQ ID NO: 173256 - DNA, 25 bp, Homo sapien
acaggatcagatttccacattggac

SEQ ID NO: 173257 - DNA, 25 bp, Homo sapien
ttccacattggacataaataagcat

SEQ ID NO: 173258 - DNA, 25 bp, Homo sapien
ggacataaataagcatattcagcaa

SEQ ID NO: 173259 - DNA, 25 bp, Homo sapien
gtctgaaaagcaagggaataccatt

SEQ ID NO: 173260 - DNA, 25 bp, Homo sapien
gcaagggaataccattattttcgga

SEQ ID NO: 173261 - DNA, 25 bp, Homo sapien
aataccattattttcggattagcgg

SEQ ID NO: 173262 - DNA, 25 bp, Homo sapien
ggattagcggtttattaagctcttc

SEQ ID NO: 173263 - DNA, 25 bp, Homo sapien
gcggtttattaagctcttctatatt

SEQ ID NO: 173264 - DNA, 25 bp, Homo sapien
ataacggagtaaactgttccagata

SEQ ID NO: 173265 - DNA, 25 bp, Homo sapien
gttgcaagaagtaaattctggcaca

SEQ ID NO: 173266 - DNA, 25 bp, Homo sapien
aaattctggcacaaagcgtaaaaat

SEQ ID NO: 173267 - DNA, 25 bp, Homo sapien
gcatcagcaaaagtttcaccactag

SEQ ID NO: 173268 - DNA, 25 bp, Homo sapien
aagtggaacctgtatcccagactac

SEQ ID NO: 173269 - DNA, 25 bp, Homo sapien
tcccagactaccgataacaattcag

SEQ ID NO: 173270 - DNA, 25 bp, Homo sapien
gtacgggagaatctgttatggcacc

SEQ ID NO: 173271 - DNA, 25 bp, Homo sapien
ttatggcaccagtagatgtagacct

SEQ ID NO: 173272 - DNA, 25 bp, Homo sapien
gatgtagacctgaacctggtttcaa

SEQ ID NO: 173273 - DNA, 25 bp, Homo sapien
ttggaatcctatagctcccaagctg

SEQ ID NO: 173274 - DNA, 25 bp, Homo sapien
tggcaggacctgcttccaatctttt

SEQ ID NO: 173275 - DNA, 25 bp, Homo sapien
agtgcagctgcctgacaacaccgat

SEQ ID NO: 173276 - DNA, 25 bp, Homo sapien
caacaccgatcacagaccaacaagt

SEQ ID NO: 173277 - DNA, 25 bp, Homo sapien
aaccagcacatttagcttctctttt

SEQ ID NO: 173278 - DNA, 25 bp, Homo sapien
atgttagtaggcttagttttttcag

SEQ ID NO: 173279 - DNA, 25 bp, Homo sapien
tttttcagttgcagtagtatcaaat

SEQ ID NO: 173280 - DNA, 25 bp, Homo sapien
gattatacaatctctttattactga

SEQ ID NO: 173281 - DNA, 25 bp, Homo sapien
ctctttattactgagggccaccaaa

SEQ ID NO: 173282 - DNA, 25 bp, Homo sapien
tgagggccaccaaatagcctaggaa

SEQ ID NO: 173283 - DNA, 25 bp, Homo sapien
aatagcctaggaagtgccctcgagc

SEQ ID NO: 173284 - DNA, 25 bp, Homo sapien
gaagtgccctcgagcactgaagtca

SEQ ID NO: 173285 - DNA, 25 bp, Homo sapien
cctcgagcactgaagtcaccattag

SEQ ID NO: 173286 - DNA, 25 bp, Homo sapien
gaagtcaccattaggtcactcaaga

SEQ ID NO: 173287 - DNA, 25 bp, Homo sapien
taggtcactcaagaagtaagcaact

SEQ ID NO: 173288 - DNA, 25 bp, Homo sapien
aagtaagcaactagctgggcacagt

SEQ ID NO: 173289 - DNA, 25 bp, Homo sapien
tcggcactgctgctccttattttaa

SEQ ID NO: 173290 - DNA, 25 bp, Homo sapien
cactgctgctccttattttaacttt

SEQ ID NO: 173291 - DNA, 25 bp, Homo sapien
gctgctccttattttaactttgtct

SEQ ID NO: 173292 - DNA, 25 bp, Homo sapien
cttattttaactttgtcttgcattg

SEQ ID NO: 173293 - DNA, 25 bp, Homo sapien
tcttgcattgtcctgtatttatcac

SEQ ID NO: 173294 - DNA, 25 bp, Homo sapien
acagtttctgttgaacagcttttca

SEQ ID NO: 173295 - DNA, 25 bp, Homo sapien
gggagtttatcttgccatcctcccc

SEQ ID NO: 173296 - DNA, 25 bp, Homo sapien
actgcagttccttccgtgctctgtg

SEQ ID NO: 173297 - DNA, 25 bp, Homo sapien
ccttccgtgctctgtgactttaaga

SEQ ID NO: 173298 - DNA, 25 bp, Homo sapien
gttttttctccttagcagtaggact

SEQ ID NO: 173299 - DNA, 25 bp, Homo sapien
tagcagtaggacttgatattttcaa

SEQ ID NO: 173300 - DNA, 25 bp, Homo sapien
accctgacagacttgactagcccca

SEQ ID NO: 173301 - DNA, 25 bp, Homo sapien
ctgccaactgtgacgtccgtcttaa

SEQ ID NO: 173302 - DNA, 25 bp, Homo sapien
gtgacgtccgtcttaacttctgtgc

SEQ ID NO: 173303 - DNA, 25 bp, Homo sapien
tcacaaacgactcttaccaaccttt

SEQ ID NO: 173304 - DNA, 25 bp, Homo sapien
gactcttaccaaccttttctaatga

SEQ ID NO: 173305 - DNA, 25 bp, Homo sapien
ttaccaaccttttctaatgactcgc

SEQ ID NO: 173306 - DNA, 25 bp, Homo sapien
caaccttttctaatgactcgcaacc

SEQ ID NO: 173307 - DNA, 25 bp, Homo sapien
gaggctttgagcaactaactaacca

SEQ ID NO: 173308 - DNA, 25 bp, Homo sapien
ttgagcaactaactaaccacatttt

SEQ ID NO: 173309 - DNA, 25 bp, Homo sapien
accacattttaggatctcgcctgga

SEQ ID NO: 173310 - DNA, 25 bp, Homo sapien
ggatctcgcctggaaacagaggtaa

SEQ ID NO: 173311 - DNA, 25 bp, Homo sapien
ccagctgcgcgtcgccaaagtgaca

SEQ ID NO: 173312 - DNA, 25 bp, Homo sapien
ctgcgcgtcgccaaagtgacaggcg

SEQ ID NO: 173313 - DNA, 25 bp, Homo sapien
aggcggtgcggcctccaagctctct

SEQ ID NO: 173314 - DNA, 25 bp, Homo sapien
gtgcggcctccaagctctctaagat

SEQ ID NO: 173315 - DNA, 25 bp, Homo sapien
ggcctccaagctctctaagatccga

SEQ ID NO: 173316 - DNA, 25 bp, Homo sapien
agctctctaagatccgagtcgtccg

SEQ ID NO: 173317 - DNA, 25 bp, Homo sapien
tgcccgtgttctcacagttattaac

SEQ ID NO: 173318 - DNA, 25 bp, Homo sapien
taagaagacacgtgccatgcgccgc

SEQ ID NO: 173319 - DNA, 25 bp, Homo sapien
gcgccgccggctcaacaagcacgag

SEQ ID NO: 173320 - DNA, 25 bp, Homo sapien
aggagcggctgtacccgctgcggaa

SEQ ID NO: 173321 - DNA, 25 bp, Homo sapien
acccgctgcggaagtacgcggtcaa

SEQ ID NO: 173322 - DNA, 25 bp, Homo sapien
ccatgagaaagtcattttggagcaa

SEQ ID NO: 173323 - DNA, 25 bp, Homo sapien
ggagcaaatagctagtctttaaaat

SEQ ID NO: 173324 - DNA, 25 bp, Homo sapien
agtttgcttttcattgagactggct

SEQ ID NO: 173325 - DNA, 25 bp, Homo sapien
gagactggctgctgatgcaccttgg

SEQ ID NO: 173326 - DNA, 25 bp, Homo sapien
ggctgctgatgcaccttggtaatga

SEQ ID NO: 173327 - DNA, 25 bp, Homo sapien
tgcaccttggtaatgaatcatgatt

SEQ ID NO: 173328 - DNA, 25 bp, Homo sapien
aatgcatgattaactactctctcag

SEQ ID NO: 173329 - DNA, 25 bp, Homo sapien
gattaactactctctcagtacatca

SEQ ID NO: 173330 - DNA, 25 bp, Homo sapien
tcagtacatcaaaatcattgcagag

SEQ ID NO: 173331 - DNA, 25 bp, Homo sapien
gtattagaaattgaaccattgagct

SEQ ID NO: 173332 - DNA, 25 bp, Homo sapien
aaaatgctcaacttctgctttatat

SEQ ID NO: 173333 - DNA, 25 bp, Homo sapien
ggcaaagcctataagtggccctcaa

SEQ ID NO: 173334 - DNA, 25 bp, Homo sapien
ggccctcaacccttagatatcacaa

SEQ ID NO: 173335 - DNA, 25 bp, Homo sapien
ctcaacccttagatatcacaagaaa

SEQ ID NO: 173336 - DNA, 25 bp, Homo sapien
gcctttagtacgttctcaatcctca

SEQ ID NO: 173337 - DNA, 25 bp, Homo sapien
tttagtacgttctcaatcctcacta

SEQ ID NO: 173338 - DNA, 25 bp, Homo sapien
agtacgttctcaatcctcactaaac

SEQ ID NO: 173339 - DNA, 25 bp, Homo sapien
tacgttctcaatcctcactaaacat

SEQ ID NO: 173340 - DNA, 25 bp, Homo sapien
acgttctcaatcctcactaaacata

SEQ ID NO: 173341 - DNA, 25 bp, Homo sapien
aaagccttcagctggttatcagtct

SEQ ID NO: 173342 - DNA, 25 bp, Homo sapien
aattcatactggagttcccaaccct

SEQ ID NO: 173343 - DNA, 25 bp, Homo sapien
gttcccaaccctcctacacataaga

SEQ ID NO: 173344 - DNA, 25 bp, Homo sapien
agcgggaagacgagcttcgagccat

SEQ ID NO: 173345 - DNA, 25 bp, Homo sapien
gaagacgagcttcgagccatggccc

SEQ ID NO: 173346 - DNA, 25 bp, Homo sapien
gagcttcgagccatggcccgcaaga

SEQ ID NO: 173347 - DNA, 25 bp, Homo sapien
atggcccgcaagatccgcatgaagg

SEQ ID NO: 173348 - DNA, 25 bp, Homo sapien
agtgggaacgccagtacagccggca

SEQ ID NO: 173349 - DNA, 25 bp, Homo sapien
gaacgccagtacagccggcagagcc

SEQ ID NO: 173350 - DNA, 25 bp, Homo sapien
gatacagtcgagaatacagctcttc

SEQ ID NO: 173351 - DNA, 25 bp, Homo sapien
gaatacagctcttctcgaaggcgct

SEQ ID NO: 173352 - DNA, 25 bp, Homo sapien
ttctcgaaggcgctcaaggtcccga

SEQ ID NO: 173353 - DNA, 25 bp, Homo sapien
ggcgctcaaggtcccgatcccgaag

SEQ ID NO: 173354 - DNA, 25 bp, Homo sapien
ccccattaccgacattaggcagaag

SEQ ID NO: 173355 - DNA, 25 bp, Homo sapien
gctgaacgcacttgcagcgtccgag

SEQ ID NO: 173356 - DNA, 25 bp, Homo sapien
gaacgcacttgcagcgtccgagggc

SEQ ID NO: 173357 - DNA, 25 bp, Homo sapien
accgggctggcattttgtgaccctt

SEQ ID NO: 173358 - DNA, 25 bp, Homo sapien
cattttgtgacccttccctgttgct

SEQ ID NO: 173359 - DNA, 25 bp, Homo sapien
tgttgctgtccctgcatctcgtctg

SEQ ID NO: 173360 - DNA, 25 bp, Homo sapien
tgcatctcgtctgtgtgcccagggt

SEQ ID NO: 173361 - DNA, 25 bp, Homo sapien
gctgagactagggtcccagcacagc

SEQ ID NO: 173362 - DNA, 25 bp, Homo sapien
agactagggtcccagcacagcccag

SEQ ID NO: 173363 - DNA, 25 bp, Homo sapien
agcccagaaacctttggccacaaga

SEQ ID NO: 173364 - DNA, 25 bp, Homo sapien
gaaacctttggccacaagaagtggg

SEQ ID NO: 173365 - DNA, 25 bp, Homo sapien
gtcactgcagtttgggatggttgaa

SEQ ID NO: 173366 - DNA, 25 bp, Homo sapien
gatgatatcaggttggtctaagact

SEQ ID NO: 173367 - DNA, 25 bp, Homo sapien
gtctaagacttttggtgaacacgtt

SEQ ID NO: 173368 - DNA, 25 bp, Homo sapien
gaacacgttcattcaactgtgatca

SEQ ID NO: 173369 - DNA, 25 bp, Homo sapien
gatcactttattactctgaatgcct

SEQ ID NO: 173370 - DNA, 25 bp, Homo sapien
tctgaatgcctactattatcctgat

SEQ ID NO: 173371 - DNA, 25 bp, Homo sapien
gtacacatacataccctataccaag

SEQ ID NO: 173372 - DNA, 25 bp, Homo sapien
aagagggccgaaactcttcaccttg

SEQ ID NO: 173373 - DNA, 25 bp, Homo sapien
cgaaactcttcaccttgatgtatgt

SEQ ID NO: 173374 - DNA, 25 bp, Homo sapien
caagttgttcagcttcttgtaaatg

SEQ ID NO: 173375 - DNA, 25 bp, Homo sapien
atgtgttttccttcggcttgttact

SEQ ID NO: 173376 - DNA, 25 bp, Homo sapien
cggcttgttactgccttttgtcaaa

SEQ ID NO: 173377 - DNA, 25 bp, Homo sapien
cagcttggtgtagtcctgctcctct

SEQ ID NO: 173378 - DNA, 25 bp, Homo sapien
gcttggtgtagtcctgctcctcttg

SEQ ID NO: 173379 - DNA, 25 bp, Homo sapien
accctccccttctggtagtcatagg

SEQ ID NO: 173380 - DNA, 25 bp, Homo sapien
ctccccttctggtagtcataggcag

SEQ ID NO: 173381 - DNA, 25 bp, Homo sapien
ccccttctggtagtcataggcagga

SEQ ID NO: 173382 - DNA, 25 bp, Homo sapien
ccttctggtagtcataggcaggatt

SEQ ID NO: 173383 - DNA, 25 bp, Homo sapien
tcataggcaggattgagtgacggtt

SEQ ID NO: 173384 - DNA, 25 bp, Homo sapien
agggcccaggtctgtgtgatatctg

SEQ ID NO: 173385 - DNA, 25 bp, Homo sapien
ggcccaggtctgtgtgatatctgta

SEQ ID NO: 173386 - DNA, 25 bp, Homo sapien
gcccaggtctgtgtgatatctgtat

SEQ ID NO: 173387 - DNA, 25 bp, Homo sapien
cccaggtctgtgtgatatctgtata

SEQ ID NO: 173388 - DNA, 25 bp, Homo sapien
ggttccaacagaagctccgcagtgt

SEQ ID NO: 173389 - DNA, 25 bp, Homo sapien
aagctccgcagtgtgtttagggttc

SEQ ID NO: 173390 - DNA, 25 bp, Homo sapien
agggttccaattacttggctccaag

SEQ ID NO: 173391 - DNA, 25 bp, Homo sapien
atgtcttgccggaaaagcagttctc

SEQ ID NO: 173392 - DNA, 25 bp, Homo sapien
gacctttgtgtcttaaacggagagc

SEQ ID NO: 173393 - DNA, 25 bp, Homo sapien
atgtaatcaacatggctacttgctt

SEQ ID NO: 173394 - DNA, 25 bp, Homo sapien
atggctacttgctttgaggctcacc

SEQ ID NO: 173395 - DNA, 25 bp, Homo sapien
gaggctcaccagaattatttttaag

SEQ ID NO: 173396 - DNA, 25 bp, Homo sapien
atttcccctaatcttttctgaatct

SEQ ID NO: 173397 - DNA, 25 bp, Homo sapien
aactatgtttatcgtccagtgactt

SEQ ID NO: 173398 - DNA, 25 bp, Homo sapien
gtgactttcaggaatgcccattgtt

SEQ ID NO: 173399 - DNA, 25 bp, Homo sapien
tctctccagcctctcttaggagggg

SEQ ID NO: 173400 - DNA, 25 bp, Homo sapien
ggtggagttggcatcttgtaactct

SEQ ID NO: 173401 - DNA, 25 bp, Homo sapien
ggagttggcatcttgtaactctcct

SEQ ID NO: 173402 - DNA, 25 bp, Homo sapien
agttggcatcttgtaactctccttt

SEQ ID NO: 173403 - DNA, 25 bp, Homo sapien
ttggcatcttgtaactctcctttct

SEQ ID NO: 173404 - DNA, 25 bp, Homo sapien
gcatcttgtaactctcctttctcct

SEQ ID NO: 173405 - DNA, 25 bp, Homo sapien
tcccatcctgctgtagacttcttga

SEQ ID NO: 173406 - DNA, 25 bp, Homo sapien
acttcttgattgtcagtctgtgtca

SEQ ID NO: 173407 - DNA, 25 bp, Homo sapien
cttgattgtcagtctgtgtcacatc

SEQ ID NO: 173408 - DNA, 25 bp, Homo sapien
gtctgtgtcacatccagtgattgtt

SEQ ID NO: 173409 - DNA, 25 bp, Homo sapien
tttctgactgcccaaggggctcaga

SEQ ID NO: 173410 - DNA, 25 bp, Homo sapien
aagaatggctacgtgactgtcagtg

SEQ ID NO: 173411 - DNA, 25 bp, Homo sapien
tgtcagtgagatcaaagccagtctt

SEQ ID NO: 173412 - DNA, 25 bp, Homo sapien
aagccagtcttaaatgggagaccga

SEQ ID NO: 173413 - DNA, 25 bp, Homo sapien
gcaagtgctggaacacctgctgaag

SEQ ID NO: 173414 - DNA, 25 bp, Homo sapien
tggcgtggctggacttacaggcccc

SEQ ID NO: 173415 - DNA, 25 bp, Homo sapien
gggaggcccactactggctgccagc

SEQ ID NO: 173416 - DNA, 25 bp, Homo sapien
actgacctctactcccaggagatta

SEQ ID NO: 173417 - DNA, 25 bp, Homo sapien
tactcccaggagattacacctgagg

SEQ ID NO: 173418 - DNA, 25 bp, Homo sapien
agccctcccctgactgcatgtggaa

SEQ ID NO: 173419 - DNA, 25 bp, Homo sapien
gactgcatgtggaagggcccacagc

SEQ ID NO: 173420 - DNA, 25 bp, Homo sapien
gaggtggcaaataaacctgggcaat

SEQ ID NO: 173421 - DNA, 25 bp, Homo sapien
tgatgctagtgttgattttgctctc

SEQ ID NO: 173422 - DNA, 25 bp, Homo sapien
gattttgctctcagatgaacacaat

SEQ ID NO: 173423 - DNA, 25 bp, Homo sapien
gaacacaatgtctcatactaaccaa

SEQ ID NO: 173424 - DNA, 25 bp, Homo sapien
ctttcatttttcacttggagtgaca

SEQ ID NO: 173425 - DNA, 25 bp, Homo sapien
gagaggtcaggaatcaagttcactt

SEQ ID NO: 173426 - DNA, 25 bp, Homo sapien
gttcactttcaagatctaagggagt

SEQ ID NO: 173427 - DNA, 25 bp, Homo sapien
aagggagtccactatctgtgcaatt

SEQ ID NO: 173428 - DNA, 25 bp, Homo sapien
ttttgcactgtttcaatgctggtaa

SEQ ID NO: 173429 - DNA, 25 bp, Homo sapien
gtattcactttatatgtccttccaa

SEQ ID NO: 173430 - DNA, 25 bp, Homo sapien
gttgttgtgtacataccatgctttc

SEQ ID NO: 173431 - DNA, 25 bp, Homo sapien
accatgctttcaatgttggcttcca

SEQ ID NO: 173432 - DNA, 25 bp, Homo sapien
acatgtggcccttgccttctgagca

SEQ ID NO: 173433 - DNA, 25 bp, Homo sapien
agtgccagggctttgagactttccc

SEQ ID NO: 173434 - DNA, 25 bp, Homo sapien
gctttgagactttcccacatgataa

SEQ ID NO: 173435 - DNA, 25 bp, Homo sapien
gaggtacagaagttccaattccctt

SEQ ID NO: 173436 - DNA, 25 bp, Homo sapien
tttattttgctggttggtatctgta

SEQ ID NO: 173437 - DNA, 25 bp, Homo sapien
gctggttggtatctgtaaatgttta

SEQ ID NO: 173438 - DNA, 25 bp, Homo sapien
gagcatgtatctatcaacgccaaga

SEQ ID NO: 173439 - DNA, 25 bp, Homo sapien
caacgccaagaatttcaaagtctcc

SEQ ID NO: 173440 - DNA, 25 bp, Homo sapien
gtctccttcaacaatatgaggcttt

SEQ ID NO: 173441 - DNA, 25 bp, Homo sapien
ttatattccttcatccctcttgttt

SEQ ID NO: 173442 - DNA, 25 bp, Homo sapien
ctcttgtttcccaggttttgcaggg

SEQ ID NO: 173443 - DNA, 25 bp, Homo sapien
aattccttatattctgaaacggcag

SEQ ID NO: 173444 - DNA, 25 bp, Homo sapien
tatattctgaaacggcagctgtatg

SEQ ID NO: 173445 - DNA, 25 bp, Homo sapien
gaaacggcagctgtatgagaataaa

SEQ ID NO: 173446 - DNA, 25 bp, Homo sapien
gagaataaacccagaagaccctaca

SEQ ID NO: 173447 - DNA, 25 bp, Homo sapien
taaacccagaagaccctacatactc

SEQ ID NO: 173448 - DNA, 25 bp, Homo sapien
agaagaccctacatactcaaaagag

SEQ ID NO: 173449 - DNA, 25 bp, Homo sapien
aagagattcttactattactgagag

SEQ ID NO: 173450 - DNA, 25 bp, Homo sapien
acatgtgattgtgattcatcatccc

SEQ ID NO: 173451 - DNA, 25 bp, Homo sapien
ttatctgtctcttctacaattgtgg

SEQ ID NO: 173452 - DNA, 25 bp, Homo sapien
gtctcttctacaattgtggtttatt

SEQ ID NO: 173453 - DNA, 25 bp, Homo sapien
tagactaagtgttttcaaataaatc

SEQ ID NO: 173454 - DNA, 25 bp, Homo sapien
tggctctcctatacgaagagccctt

SEQ ID NO: 173455 - DNA, 25 bp, Homo sapien
aagagcccttcaccgctgagatcta

SEQ ID NO: 173456 - DNA, 25 bp, Homo sapien
accgctgagatctaccggcagaaag

SEQ ID NO: 173457 - DNA, 25 bp, Homo sapien
ggcagaaagcctccgggtcccacaa

SEQ ID NO: 173458 - DNA, 25 bp, Homo sapien
tccgggtcccacaagaggagctgat

SEQ ID NO: 173459 - DNA, 25 bp, Homo sapien
gattgagctgcaacagctttgctga

SEQ ID NO: 173460 - DNA, 25 bp, Homo sapien
gggcgagaatggtgcctgctgctca

SEQ ID NO: 173461 - DNA, 25 bp, Homo sapien
gaccctggacgtgccgacatatggc

SEQ ID NO: 173462 - DNA, 25 bp, Homo sapien
ggacgtgccgacatatggccattga

SEQ ID NO: 173463 - DNA, 25 bp, Homo sapien
gacatatggccattgagctccaacc

SEQ ID NO: 173464 - DNA, 25 bp, Homo sapien
atatggccattgagctccaacccac

SEQ ID NO: 173465 - DNA, 25 bp, Homo sapien
aagccacaggcctgagatttcatct

SEQ ID NO: 173466 - DNA, 25 bp, Homo sapien
agccacaggcctgagatttcatctg

SEQ ID NO: 173467 - DNA, 25 bp, Homo sapien
gccacaggcctgagatttcatctgc

SEQ ID NO: 173468 - DNA, 25 bp, Homo sapien
ggaagaacggggctcttctcatttc

SEQ ID NO: 173469 - DNA, 25 bp, Homo sapien
gcagtgggtcccagattggctcaca

SEQ ID NO: 173470 - DNA, 25 bp, Homo sapien
agtgggtcccagattggctcacact

SEQ ID NO: 173471 - DNA, 25 bp, Homo sapien
tgggtcccagattggctcacactga

SEQ ID NO: 173472 - DNA, 25 bp, Homo sapien
gggtcccagattggctcacactgag

SEQ ID NO: 173473 - DNA, 25 bp, Homo sapien
gtcccagattggctcacactgagaa

SEQ ID NO: 173474 - DNA, 25 bp, Homo sapien
ccagattggctcacactgagaatgt

SEQ ID NO: 173475 - DNA, 25 bp, Homo sapien
gattggctcacactgagaatgtaag

SEQ ID NO: 173476 - DNA, 25 bp, Homo sapien
tttaccaactctatactcaatcaag

SEQ ID NO: 173477 - DNA, 25 bp, Homo sapien
aaaatttctgtatattccctgtgga

SEQ ID NO: 173478 - DNA, 25 bp, Homo sapien
ttccctgtggaatgtacctatgtga

SEQ ID NO: 173479 - DNA, 25 bp, Homo sapien
gtacctatgtgagtttcagaaattc

SEQ ID NO: 173480 - DNA, 25 bp, Homo sapien
atacgtgttcaaaaatttctgcttt

SEQ ID NO: 173481 - DNA, 25 bp, Homo sapien
ctgcttttgcatctttgggacacct

SEQ ID NO: 173482 - DNA, 25 bp, Homo sapien
gcatctttgggacacctcagaaaac

SEQ ID NO: 173483 - DNA, 25 bp, Homo sapien
agccctctatacataaatgcccagc

SEQ ID NO: 173484 - DNA, 25 bp, Homo sapien
aaatgcccagcacaattcattgtta

SEQ ID NO: 173485 - DNA, 25 bp, Homo sapien
aaccaaacctcacactactgtattt

SEQ ID NO: 173486 - DNA, 25 bp, Homo sapien
ttatctgtactgaaagcaaatgctt

SEQ ID NO: 173487 - DNA, 25 bp, Homo sapien
tttaccaagccgttggtctcctaag

SEQ ID NO: 173488 - DNA, 25 bp, Homo sapien
ctcctaagggcctcctgatggaaga

SEQ ID NO: 173489 - DNA, 25 bp, Homo sapien
gggtggttcaaagttatttctatgt

SEQ ID NO: 173490 - DNA, 25 bp, Homo sapien
taccatgttaacttttccccgagag

SEQ ID NO: 173491 - DNA, 25 bp, Homo sapien
ttaacattgagactctggccccaga

SEQ ID NO: 173492 - DNA, 25 bp, Homo sapien
ggccccagattggtatcttctatga

SEQ ID NO: 173493 - DNA, 25 bp, Homo sapien
gggtgacattgaaaacggcctgctt

SEQ ID NO: 173494 - DNA, 25 bp, Homo sapien
aaaacggcctgctttccaaatgtgg

SEQ ID NO: 173495 - DNA, 25 bp, Homo sapien
atgtaattggttagccccagacttg

SEQ ID NO: 173496 - DNA, 25 bp, Homo sapien
ccagggtggttattgctatatgtgt

SEQ ID NO: 173497 - DNA, 25 bp, Homo sapien
atatgtgttacagacctcggttctc

SEQ ID NO: 173498 - DNA, 25 bp, Homo sapien
ctgcttggaagcctggacgtgacac

SEQ ID NO: 173499 - DNA, 25 bp, Homo sapien
tgcttggaagcctggacgtgacacg

SEQ ID NO: 173500 - DNA, 25 bp, Homo sapien
gcttggaagcctggacgtgacacga

SEQ ID NO: 173501 - DNA, 25 bp, Homo sapien
cttggaagcctggacgtgacacgat

SEQ ID NO: 173502 - DNA, 25 bp, Homo sapien
ttggaagcctggacgtgacacgatt

SEQ ID NO: 173503 - DNA, 25 bp, Homo sapien
accctggagggctagcaaggccttc

SEQ ID NO: 173504 - DNA, 25 bp, Homo sapien
ctggagggctagcaaggccttctca

SEQ ID NO: 173505 - DNA, 25 bp, Homo sapien
tggagggctagcaaggccttctcat

SEQ ID NO: 173506 - DNA, 25 bp, Homo sapien
ggagggctagcaaggccttctcatg

SEQ ID NO: 173507 - DNA, 25 bp, Homo sapien
gagggctagcaaggccttctcatgc

SEQ ID NO: 173508 - DNA, 25 bp, Homo sapien
ggctagcaaggccttctcatgcctc

SEQ ID NO: 173509 - DNA, 25 bp, Homo sapien
gctgtccttgatgcagcccttggtt

SEQ ID NO: 173510 - DNA, 25 bp, Homo sapien
cttgatgcagcccttggttccagag

SEQ ID NO: 173511 - DNA, 25 bp, Homo sapien
tgatgcagcccttggttccagagcg

SEQ ID NO: 173512 - DNA, 25 bp, Homo sapien
atgcagcccttggttccagagcggg

SEQ ID NO: 173513 - DNA, 25 bp, Homo sapien
tcctgctggatgtccaggcggcctt

SEQ ID NO: 173514 - DNA, 25 bp, Homo sapien
ggcggccttgggaggcccagccctg

SEQ ID NO: 173515 - DNA, 25 bp, Homo sapien
gggctttaaccatttatagcactcc

SEQ ID NO: 173516 - DNA, 25 bp, Homo sapien
tttaaccatttatagcactcctgag

SEQ ID NO: 173517 - DNA, 25 bp, Homo sapien
aaccatttatagcactcctgagagc

SEQ ID NO: 173518 - DNA, 25 bp, Homo sapien
tgagagccggactgcctcctacttg

SEQ ID NO: 173519 - DNA, 25 bp, Homo sapien
actgcctcctacttgggcccggaag

SEQ ID NO: 173520 - DNA, 25 bp, Homo sapien
gggcttgtccctccaactgcaggaa

SEQ ID NO: 173521 - DNA, 25 bp, Homo sapien
gggaaacgactcacgactcccaaat

SEQ ID NO: 173522 - DNA, 25 bp, Homo sapien
tcacgactcccaaatcactcaggag

SEQ ID NO: 173523 - DNA, 25 bp, Homo sapien
aaatcactcaggaggctgttcccaa

SEQ ID NO: 173524 - DNA, 25 bp, Homo sapien
tcaggaggctgttcccaagtcgctg

SEQ ID NO: 173525 - DNA, 25 bp, Homo sapien
ggagtcttcctacacgtccgtgaac

SEQ ID NO: 173526 - DNA, 25 bp, Homo sapien
gacagggctgaggtgtattccagca

SEQ ID NO: 173527 - DNA, 25 bp, Homo sapien
ctgaggtgtattccagcaagctcca

SEQ ID NO: 173528 - DNA, 25 bp, Homo sapien
cagcaagctccaagactgagcccag

SEQ ID NO: 173529 - DNA, 25 bp, Homo sapien
ggccctgcagcggtggttgtcacac

SEQ ID NO: 173530 - DNA, 25 bp, Homo sapien
gttgtcacaccctgacttcagggaa

SEQ ID NO: 173531 - DNA, 25 bp, Homo sapien
tcgtcctgtcccagcacctgggcaa

SEQ ID NO: 173532 - DNA, 25 bp, Homo sapien
cgatacctgtcccagctgaaggatg

SEQ ID NO: 173533 - DNA, 25 bp, Homo sapien
ctgaaggatgcccacaggtcccatc

SEQ ID NO: 173534 - DNA, 25 bp, Homo sapien
ccatcccttcatcaaggagtaccag

SEQ ID NO: 173535 - DNA, 25 bp, Homo sapien
atcccttcatcaaggagtaccaggc

SEQ ID NO: 173536 - DNA, 25 bp, Homo sapien
cttcatcaaggagtaccaggccaag

SEQ ID NO: 173537 - DNA, 25 bp, Homo sapien
agaacgactttgacaggctggtgct

SEQ ID NO: 173538 - DNA, 25 bp, Homo sapien
gacaggctggtgctacagtacgctc

SEQ ID NO: 173539 - DNA, 25 bp, Homo sapien
gctggcccagagctgtcaggaccat

SEQ ID NO: 173540 - DNA, 25 bp, Homo sapien
ggcccagagctgtcaggaccatgaa

SEQ ID NO: 173541 - DNA, 25 bp, Homo sapien
agagctgtcaggaccatgaagccag

SEQ ID NO: 173542 - DNA, 25 bp, Homo sapien
acggcgacgccaacaccatcgtgtg

SEQ ID NO: 173543 - DNA, 25 bp, Homo sapien
acaccatcgtgtgcaacagcaagga

SEQ ID NO: 173544 - DNA, 25 bp, Homo sapien
atcgtgtgcaacagcaaggacggcg

SEQ ID NO: 173545 - DNA, 25 bp, Homo sapien
accgagcagcgggaggctgtctttc

SEQ ID NO: 173546 - DNA, 25 bp, Homo sapien
agcgggaggctgtctttcccttcca

SEQ ID NO: 173547 - DNA, 25 bp, Homo sapien
ttccagcctggaagtgttgcagagg

SEQ ID NO: 173548 - DNA, 25 bp, Homo sapien
agaggtgtgcatcaccttcgaccag

SEQ ID NO: 173549 - DNA, 25 bp, Homo sapien
ctgaccgtcaagctgccagatggat

SEQ ID NO: 173550 - DNA, 25 bp, Homo sapien
gtcaagctgccagatggatacgaat

SEQ ID NO: 173551 - DNA, 25 bp, Homo sapien
gccagatggatacgaattcaagttc

SEQ ID NO: 173552 - DNA, 25 bp, Homo sapien
acatggcagctgacggtgacttcaa

SEQ ID NO: 173553 - DNA, 25 bp, Homo sapien
aagggaggtggagttatcctcttat

SEQ ID NO: 173554 - DNA, 25 bp, Homo sapien
atcctcttatagtacagtggcctgt

SEQ ID NO: 173555 - DNA, 25 bp, Homo sapien
gtacagtggcctgttatctttttaa

SEQ ID NO: 173556 - DNA, 25 bp, Homo sapien
gaatatatacaagccaacatccaat

SEQ ID NO: 173557 - DNA, 25 bp, Homo sapien
caagccaacatccaatttctattat

SEQ ID NO: 173558 - DNA, 25 bp, Homo sapien
gggttcttgtagctgtttatgttaa

SEQ ID NO: 173559 - DNA, 25 bp, Homo sapien
gagaagaaaactatattggctgatt

SEQ ID NO: 173560 - DNA, 25 bp, Homo sapien
actggtttgatttctcgttcattgt

SEQ ID NO: 173561 - DNA, 25 bp, Homo sapien
gatttctcgttcattgtacactgcc

SEQ ID NO: 173562 - DNA, 25 bp, Homo sapien
gtacactgcctctgaacatctaatt

SEQ ID NO: 173563 - DNA, 25 bp, Homo sapien
gcctctgaacatctaattgttttta

SEQ ID NO: 173564 - DNA, 25 bp, Homo sapien
cagcctacaatgtcaactctgtgaa

SEQ ID NO: 173565 - DNA, 25 bp, Homo sapien
atgaacactctcaacgccatgaatg

SEQ ID NO: 173566 - DNA, 25 bp, Homo sapien
tacagcatgtcccagccaatgatga

SEQ ID NO: 173567 - DNA, 25 bp, Homo sapien
gtggctaccacagcaatcatggcta

SEQ ID NO: 173568 - DNA, 25 bp, Homo sapien
gctatatgaatcaaacgccccaata

SEQ ID NO: 173569 - DNA, 25 bp, Homo sapien
gccccaataccctatgcagatgcag

SEQ ID NO: 173570 - DNA, 25 bp, Homo sapien
gatgggcatgatgggcacccagcca

SEQ ID NO: 173571 - DNA, 25 bp, Homo sapien
ccaccccacggtaacatgatgtaca

SEQ ID NO: 173572 - DNA, 25 bp, Homo sapien
ggacatcacggctacatgaacacag

SEQ ID NO: 173573 - DNA, 25 bp, Homo sapien
aggcatgtccaaacagtctctcaat

SEQ ID NO: 173574 - DNA, 25 bp, Homo sapien
aacagtctctcaatggctcctacat

SEQ ID NO: 173575 - DNA, 25 bp, Homo sapien
agagctgtttgctggcttcaggagt

SEQ ID NO: 173576 - DNA, 25 bp, Homo sapien
aagggatataaaggcaccgagctga

SEQ ID NO: 173577 - DNA, 25 bp, Homo sapien
ggcaccgagctgatgcagtatttgt

SEQ ID NO: 173578 - DNA, 25 bp, Homo sapien
aacaaggtatttgcatgagtcacaa

SEQ ID NO: 173579 - DNA, 25 bp, Homo sapien
gcatgagtcacaattacaaagtttt

SEQ ID NO: 173580 - DNA, 25 bp, Homo sapien
gagcggttttgtaatttgacattta

SEQ ID NO: 173581 - DNA, 25 bp, Homo sapien
gaaagtctcctatttattctcatac

SEQ ID NO: 173582 - DNA, 25 bp, Homo sapien
tctcatactttacattcatgcttag

SEQ ID NO: 173583 - DNA, 25 bp, Homo sapien
tagtatactatagaggatgccagct

SEQ ID NO: 173584 - DNA, 25 bp, Homo sapien
ggatgccagctttaatctttctgtc

SEQ ID NO: 173585 - DNA, 25 bp, Homo sapien
ggtattcaataattgggtgccctaa

SEQ ID NO: 173586 - DNA, 25 bp, Homo sapien
gactagacagaattcagtaagtcac

SEQ ID NO: 173587 - DNA, 25 bp, Homo sapien
gtaagtcacatgaagtaatggtcat

SEQ ID NO: 173588 - DNA, 25 bp, Homo sapien
atggtcatgcctgtacataaagcat

SEQ ID NO: 173589 - DNA, 25 bp, Homo sapien
catgtttgatttagatgacattcaa

SEQ ID NO: 173590 - DNA, 25 bp, Homo sapien
aatcatgggactgaatatacctggg

SEQ ID NO: 173591 - DNA, 25 bp, Homo sapien
atacctggggtatcctatcttgtac

SEQ ID NO: 173592 - DNA, 25 bp, Homo sapien
tcctatcttgtacaaatgcatgctt

SEQ ID NO: 173593 - DNA, 25 bp, Homo sapien
catttccaccaaacattatttcctc

SEQ ID NO: 173594 - DNA, 25 bp, Homo sapien
gttaaaaccatcaccatttgaattt

SEQ ID NO: 173595 - DNA, 25 bp, Homo sapien
aaaccatcaccatttgaatttcaaa

SEQ ID NO: 173596 - DNA, 25 bp, Homo sapien
gaatttcaaatgtagttttcatgac

SEQ ID NO: 173597 - DNA, 25 bp, Homo sapien
tgtgctctgtgtttcaataccatcc

SEQ ID NO: 173598 - DNA, 25 bp, Homo sapien
gtttcaataccatccactatgcaat

SEQ ID NO: 173599 - DNA, 25 bp, Homo sapien
gtattcttaagacatcacttaccca

SEQ ID NO: 173600 - DNA, 25 bp, Homo sapien
agacatcacttacccaatttaagag

SEQ ID NO: 173601 - DNA, 25 bp, Homo sapien
gagtttaatttcaatttcttgctaa

SEQ ID NO: 173602 - DNA, 25 bp, Homo sapien
tttcttgctaataaactcacaaggg

SEQ ID NO: 173603 - DNA, 25 bp, Homo sapien
ctaattaagaagttgtgagccggaa

SEQ ID NO: 173604 - DNA, 25 bp, Homo sapien
ggcatggcctgtaaagtcccagcta

SEQ ID NO: 173605 - DNA, 25 bp, Homo sapien
ccagctactttaggcttgtggcaga

SEQ ID NO: 173606 - DNA, 25 bp, Homo sapien
ttgcttgaagccaaggcgtttgaat

SEQ ID NO: 173607 - DNA, 25 bp, Homo sapien
ggcgtttgaatctagcttaggcaac

SEQ ID NO: 173608 - DNA, 25 bp, Homo sapien
gtgactatatttaccaaagccccta

SEQ ID NO: 173609 - DNA, 25 bp, Homo sapien
gggtcccttgtagcacaggagactg

SEQ ID NO: 173610 - DNA, 25 bp, Homo sapien
agggaagggacaccatcaggcctct

SEQ ID NO: 173611 - DNA, 25 bp, Homo sapien
catcaggcctctggctgaggcagta

SEQ ID NO: 173612 - DNA, 25 bp, Homo sapien
ggcagtagcatagaggatccatttc

SEQ ID NO: 173613 - DNA, 25 bp, Homo sapien
tgcatttcccagaggactagcagga

SEQ ID NO: 173614 - DNA, 25 bp, Homo sapien
gaggcagccttgagaaaccggcagt

SEQ ID NO: 173615 - DNA, 25 bp, Homo sapien
gagaaaccggcagttcccaagccag

SEQ ID NO: 173616 - DNA, 25 bp, Homo sapien
tggctgttctctcattgtcactgcc

SEQ ID NO: 173617 - DNA, 25 bp, Homo sapien
actagagattgcctgtgtcctgcct

SEQ ID NO: 173618 - DNA, 25 bp, Homo sapien
gtcctgcctcttgcctcttgtagaa

SEQ ID NO: 173619 - DNA, 25 bp, Homo sapien
ctagcacagagagccggaagtcctt

SEQ ID NO: 173620 - DNA, 25 bp, Homo sapien
ggaagtccttgaccactcaaatcag

SEQ ID NO: 173621 - DNA, 25 bp, Homo sapien
ttgaccactcaaatcagcaactttg

SEQ ID NO: 173622 - DNA, 25 bp, Homo sapien
gataacatatcaaaactttctgagc

SEQ ID NO: 173623 - DNA, 25 bp, Homo sapien
agcaagttgtgctcactagcataag

SEQ ID NO: 173624 - DNA, 25 bp, Homo sapien
actagcataagcacactcccagcag

SEQ ID NO: 173625 - DNA, 25 bp, Homo sapien
taagcacactcccagcagccaatgg

SEQ ID NO: 173626 - DNA, 25 bp, Homo sapien
gagcaggaccacttcaaaactggta

SEQ ID NO: 173627 - DNA, 25 bp, Homo sapien
tattcatatgacaaggatacctgag

SEQ ID NO: 173628 - DNA, 25 bp, Homo sapien
tatcctatgatgtgaagctaaaatt

SEQ ID NO: 173629 - DNA, 25 bp, Homo sapien
aagctaaaattacttgtggatcttt

SEQ ID NO: 173630 - DNA, 25 bp, Homo sapien
atattgaactctaacagttttctac

SEQ ID NO: 173631 - DNA, 25 bp, Homo sapien
ttttctacatacaaaacacagtgtc

SEQ ID NO: 173632 - DNA, 25 bp, Homo sapien
aacacagtgtcatgaaggttattca

SEQ ID NO: 173633 - DNA, 25 bp, Homo sapien
gacattcaactgtagtatccatatg

SEQ ID NO: 173634 - DNA, 25 bp, Homo sapien
gtatccatatgttgcttaaatttcc

SEQ ID NO: 173635 - DNA, 25 bp, Homo sapien
tgcttaaatttccttatgagcccca

SEQ ID NO: 173636 - DNA, 25 bp, Homo sapien
atgagccccatgatggaaagactta

SEQ ID NO: 173637 - DNA, 25 bp, Homo sapien
gaaattagattatcaggttctgtta

SEQ ID NO: 173638 - DNA, 25 bp, Homo sapien
atcaggttctgttaaattgttacat

SEQ ID NO: 173639 - DNA, 25 bp, Homo sapien
aattgttacatgtatcttgcttaaa

SEQ ID NO: 173640 - DNA, 25 bp, Homo sapien
atgtatcttgcttaaatttctgttt

SEQ ID NO: 173641 - DNA, 25 bp, Homo sapien
aaaaataccaaacttcagcaactgt

SEQ ID NO: 173642 - DNA, 25 bp, Homo sapien
acttcagcaactgttaatactcaga

SEQ ID NO: 173643 - DNA, 25 bp, Homo sapien
aatactcagatcatatacctcttaa

SEQ ID NO: 173644 - DNA, 25 bp, Homo sapien
gatcatatacctcttaataaatagc

SEQ ID NO: 173645 - DNA, 25 bp, Homo sapien
gcatcttatgctaattagccctgct

SEQ ID NO: 173646 - DNA, 25 bp, Homo sapien
attagccctgctaaactatgtacag

SEQ ID NO: 173647 - DNA, 25 bp, Homo sapien
agccctgctaaactatgtacagagg

SEQ ID NO: 173648 - DNA, 25 bp, Homo sapien
tgctaaactatgtacagaggaaact

SEQ ID NO: 173649 - DNA, 25 bp, Homo sapien
gtgacttatgtttaacagaactaat

SEQ ID NO: 173650 - DNA, 25 bp, Homo sapien
gaactaatgatgtattgaaacactg

SEQ ID NO: 173651 - DNA, 25 bp, Homo sapien
aagtgtagactaatgtataatcaaa

SEQ ID NO: 173652 - DNA, 25 bp, Homo sapien
tactcgcctgcgcagcatgcaagag

SEQ ID NO: 173653 - DNA, 25 bp, Homo sapien
tgcgcagcatgcaagagctcagcac

SEQ ID NO: 173654 - DNA, 25 bp, Homo sapien
aagagctcagcacgatccacatcca

SEQ ID NO: 173655 - DNA, 25 bp, Homo sapien
tcagcacgatccacatccagggcag

SEQ ID NO: 173656 - DNA, 25 bp, Homo sapien
cacatccagggcagtgagcagccct

SEQ ID NO: 173657 - DNA, 25 bp, Homo sapien
aaccagtcgctccagccttaatttg

SEQ ID NO: 173658 - DNA, 25 bp, Homo sapien
gctccagccttaatttgaaagcaga

SEQ ID NO: 173659 - DNA, 25 bp, Homo sapien
ttaatttgaaagcagacgacggact

SEQ ID NO: 173660 - DNA, 25 bp, Homo sapien
agacgacggactgagaccaaactgc

SEQ ID NO: 173661 - DNA, 25 bp, Homo sapien
tgagaccaaactgcaaaacatccca

SEQ ID NO: 173662 - DNA, 25 bp, Homo sapien
aaactgcaaaacatcccagatcacc

SEQ ID NO: 173663 - DNA, 25 bp, Homo sapien
ttcagccactgatgaatcgcactgt

SEQ ID NO: 173664 - DNA, 25 bp, Homo sapien
tgaatcgcactgttcgttcatcctt

SEQ ID NO: 173665 - DNA, 25 bp, Homo sapien
tcgttcatccttccggcatgattat

SEQ ID NO: 173666 - DNA, 25 bp, Homo sapien
tccggcatgattatgtgctgaatgt

SEQ ID NO: 173667 - DNA, 25 bp, Homo sapien
gtacaagcaaaacccaagccggcca

SEQ ID NO: 173668 - DNA, 25 bp, Homo sapien
aagcaaccccctaaaacattcatat

SEQ ID NO: 173669 - DNA, 25 bp, Homo sapien
cattcatatctaggcagtattttgc

SEQ ID NO: 173670 - DNA, 25 bp, Homo sapien
ccgagtctgtcacctggatcattaa

SEQ ID NO: 173671 - DNA, 25 bp, Homo sapien
atcagcttgagcaatttcggaccct

SEQ ID NO: 173672 - DNA, 25 bp, Homo sapien
gagcaatttcggaccctgcttttca

SEQ ID NO: 173673 - DNA, 25 bp, Homo sapien
gaccctgcttttcacttccgaaggg

SEQ ID NO: 173674 - DNA, 25 bp, Homo sapien
ggaagcttcccaagagtagcctcaa

SEQ ID NO: 173675 - DNA, 25 bp, Homo sapien
gaagcttcccaagagtagcctcaac

SEQ ID NO: 173676 - DNA, 25 bp, Homo sapien
aagcttcccaagagtagcctcaacc

SEQ ID NO: 173677 - DNA, 25 bp, Homo sapien
agcttcccaagagtagcctcaacct

SEQ ID NO: 173678 - DNA, 25 bp, Homo sapien
gcttcccaagagtagcctcaacctg

SEQ ID NO: 173679 - DNA, 25 bp, Homo sapien
cttcccaagagtagcctcaacctgt

SEQ ID NO: 173680 - DNA, 25 bp, Homo sapien
ttcccaagagtagcctcaacctgtg

SEQ ID NO: 173681 - DNA, 25 bp, Homo sapien
tcccaagagtagcctcaacctgtgc

SEQ ID NO: 173682 - DNA, 25 bp, Homo sapien
cccaagagtagcctcaacctgtgct

SEQ ID NO: 173683 - DNA, 25 bp, Homo sapien
ccaagagtagcctcaacctgtgctt

SEQ ID NO: 173684 - DNA, 25 bp, Homo sapien
caagagtagcctcaacctgtgcttc

SEQ ID NO: 173685 - DNA, 25 bp, Homo sapien
ggtttgatagtgtcctaaacgactt

SEQ ID NO: 173686 - DNA, 25 bp, Homo sapien
aagatttacagggatttggtttctg

SEQ ID NO: 173687 - DNA, 25 bp, Homo sapien
gtttctgagtttgaggcacattccc

SEQ ID NO: 173688 - DNA, 25 bp, Homo sapien
gaggcacattcccagtgaataagct

SEQ ID NO: 173689 - DNA, 25 bp, Homo sapien
gaataagctgagtcccataccacac

SEQ ID NO: 173690 - DNA, 25 bp, Homo sapien
agtcccataccacactcaaaaggtt

SEQ ID NO: 173691 - DNA, 25 bp, Homo sapien
aatctaatcctatttcttcttaaag

SEQ ID NO: 173692 - DNA, 25 bp, Homo sapien
gttttcagacagtgctggtgcttct

SEQ ID NO: 173693 - DNA, 25 bp, Homo sapien
gtgcttctgcttcttaagttcatca

SEQ ID NO: 173694 - DNA, 25 bp, Homo sapien
tctgcttcttaagttcatcaaggga

SEQ ID NO: 173695 - DNA, 25 bp, Homo sapien
agggaatgaggagttcttgtccttc

SEQ ID NO: 173696 - DNA, 25 bp, Homo sapien
tcacccttcaacatgcctggtttag

SEQ ID NO: 173697 - DNA, 25 bp, Homo sapien
acatgcctggtttaggcagcagctt

SEQ ID NO: 173698 - DNA, 25 bp, Homo sapien
ggtggcagagtctcaaagctgagat

SEQ ID NO: 173699 - DNA, 25 bp, Homo sapien
tgagctgggccatctgacttctacc

SEQ ID NO: 173700 - DNA, 25 bp, Homo sapien
catgtttgctctcccaactcattag

SEQ ID NO: 173701 - DNA, 25 bp, Homo sapien
aactcattagctcctgggcagcatc

SEQ ID NO: 173702 - DNA, 25 bp, Homo sapien
ctgagccacatgtgcaggtactgga

SEQ ID NO: 173703 - DNA, 25 bp, Homo sapien
tactggaaaacctccatcttggctc

SEQ ID NO: 173704 - DNA, 25 bp, Homo sapien
atcttggctcccagagctctaggaa

SEQ ID NO: 173705 - DNA, 25 bp, Homo sapien
gatttgcctcttctaagtgtctatg

SEQ ID NO: 173706 - DNA, 25 bp, Homo sapien
gtgtctatgagcttgcaccatattt

SEQ ID NO: 173707 - DNA, 25 bp, Homo sapien
gccaaaatgagttgtgatgaatcaa

SEQ ID NO: 173708 - DNA, 25 bp, Homo sapien
gatttcttcagaattagatggcctt

SEQ ID NO: 173709 - DNA, 25 bp, Homo sapien
ttaaaatattacacaggaggccttc

SEQ ID NO: 173710 - DNA, 25 bp, Homo sapien
aaatattacacaggaggccttcgga

SEQ ID NO: 173711 - DNA, 25 bp, Homo sapien
ttcccctacagaattttccctcttg

SEQ ID NO: 173712 - DNA, 25 bp, Homo sapien
ttccctcttggtgtgattgcacaga

SEQ ID NO: 173713 - DNA, 25 bp, Homo sapien
cctcttggtgtgattgcacagaatt

SEQ ID NO: 173714 - DNA, 25 bp, Homo sapien
gcacagaatttgtatgtattttcag

SEQ ID NO: 173715 - DNA, 25 bp, Homo sapien
tgtaagtaaattgcctgatttgttt

SEQ ID NO: 173716 - DNA, 25 bp, Homo sapien
tgcctgatttgttttcattatagac

SEQ ID NO: 173717 - DNA, 25 bp, Homo sapien
attatagacaacgatgaatttcttc

SEQ ID NO: 173718 - DNA, 25 bp, Homo sapien
ccagctgcgcgtcgccaaagtgaca

SEQ ID NO: 173719 - DNA, 25 bp, Homo sapien
ctgcgcgtcgccaaagtgacaggcg

SEQ ID NO: 173720 - DNA, 25 bp, Homo sapien
gcgcgtcgccaaagtgacaggcggt

SEQ ID NO: 173721 - DNA, 25 bp, Homo sapien
aggcggtgcggcctccaagctctct

SEQ ID NO: 173722 - DNA, 25 bp, Homo sapien
ggcggtgcggcctccaagctctcta

SEQ ID NO: 173723 - DNA, 25 bp, Homo sapien
gcggtgcggcctccaagctctctaa

SEQ ID NO: 173724 - DNA, 25 bp, Homo sapien
ggtgcggcctccaagctctctaaga

SEQ ID NO: 173725 - DNA, 25 bp, Homo sapien
gtgcggcctccaagctctctaagat

SEQ ID NO: 173726 - DNA, 25 bp, Homo sapien
ggcctccaagctctctaagatccga

SEQ ID NO: 173727 - DNA, 25 bp, Homo sapien
atgcgccgccggctcaacaagcacg

SEQ ID NO: 173728 - DNA, 25 bp, Homo sapien
gcgccgccggctcaacaagcacgag

SEQ ID NO: 173729 - DNA, 25 bp, Homo sapien
gaaggatgttggcagcgacaccatc

SEQ ID NO: 173730 - DNA, 25 bp, Homo sapien
atgttggcagcgacaccatcccata

SEQ ID NO: 173731 - DNA, 25 bp, Homo sapien
tggcagcgacaccatcccatacagg

SEQ ID NO: 173732 - DNA, 25 bp, Homo sapien
caagctttattcaggacacacttct

SEQ ID NO: 173733 - DNA, 25 bp, Homo sapien
ttccgtggccacctccatgcagaag

SEQ ID NO: 173734 - DNA, 25 bp, Homo sapien
agctcacggtggtgcatgagtgtcc

SEQ ID NO: 173735 - DNA, 25 bp, Homo sapien
ggtggtgcatgagtgtccatcatct

SEQ ID NO: 173736 - DNA, 25 bp, Homo sapien
gtgcatgagtgtccatcatctgact

SEQ ID NO: 173737 - DNA, 25 bp, Homo sapien
catgagtgtccatcatctgactctt

SEQ ID NO: 173738 - DNA, 25 bp, Homo sapien
gactcttctcggagtctcatatttt

SEQ ID NO: 173739 - DNA, 25 bp, Homo sapien
ctcttctcggagtctcatattttgt

SEQ ID NO: 173740 - DNA, 25 bp, Homo sapien
gttgagaactggtcagggcaaacct

SEQ ID NO: 173741 - DNA, 25 bp, Homo sapien
atggatgcatgttctgattgcctct

SEQ ID NO: 173742 - DNA, 25 bp, Homo sapien
tgcatgttctgattgcctctttgga

SEQ ID NO: 173743 - DNA, 25 bp, Homo sapien
ttgcctctttggagaagctcatcag

SEQ ID NO: 173744 - DNA, 25 bp, Homo sapien
agaaggccactgtttgtctcaccta

SEQ ID NO: 173745 - DNA, 25 bp, Homo sapien
ttgtctcacctacccatgacctgaa

SEQ ID NO: 173746 - DNA, 25 bp, Homo sapien
ggaaccacgtactttttacatacat

SEQ ID NO: 173747 - DNA, 25 bp, Homo sapien
acattgattcatgtctcacgtctcc

SEQ ID NO: 173748 - DNA, 25 bp, Homo sapien
tgtctcacgtctccctaaaaatgcg

SEQ ID NO: 173749 - DNA, 25 bp, Homo sapien
cacgtctccctaaaaatgcgtaaga

SEQ ID NO: 173750 - DNA, 25 bp, Homo sapien
aatgcgtaagaccaagctgtgccct

SEQ ID NO: 173751 - DNA, 25 bp, Homo sapien
ataagtagaacactgaagatttgaa

SEQ ID NO: 173752 - DNA, 25 bp, Homo sapien
aaattagctaggcatagtacctgag

SEQ ID NO: 173753 - DNA, 25 bp, Homo sapien
attagctaggcatagtacctgaggc

SEQ ID NO: 173754 - DNA, 25 bp, Homo sapien
agctaggcatagtacctgaggccag

SEQ ID NO: 173755 - DNA, 25 bp, Homo sapien
ctaggcatagtacctgaggccagga

SEQ ID NO: 173756 - DNA, 25 bp, Homo sapien
ggtccaggccgcaatgagatgtgtt

SEQ ID NO: 173757 - DNA, 25 bp, Homo sapien
gtccaggccgcaatgagatgtgttt

SEQ ID NO: 173758 - DNA, 25 bp, Homo sapien
ccaggccgcaatgagatgtgtttgt

SEQ ID NO: 173759 - DNA, 25 bp, Homo sapien
aggccgcaatgagatgtgtttgtgc

SEQ ID NO: 173760 - DNA, 25 bp, Homo sapien
gccgcaatgagatgtgtttgtgcca

SEQ ID NO: 173761 - DNA, 25 bp, Homo sapien
cgcaatgagatgtgtttgtgccatt

SEQ ID NO: 173762 - DNA, 25 bp, Homo sapien
ttgtccaggctaagaggtgggattt

SEQ ID NO: 173763 - DNA, 25 bp, Homo sapien
atttgagctgagacttgaatgccca

SEQ ID NO: 173764 - DNA, 25 bp, Homo sapien
gaatgcccaggagttaaatgtctta

SEQ ID NO: 173765 - DNA, 25 bp, Homo sapien
gcccaggagttaaatgtcttaagat

SEQ ID NO: 173766 - DNA, 25 bp, Homo sapien
cttaagatatggagcaggccgttag

SEQ ID NO: 173767 - DNA, 25 bp, Homo sapien
agatatggagcaggccgttagaaag

SEQ ID NO: 173768 - DNA, 25 bp, Homo sapien
ccgttagaaaggagggagcagcaac

SEQ ID NO: 173769 - DNA, 25 bp, Homo sapien
gagcagcaactggaaggtagaatag

SEQ ID NO: 173770 - DNA, 25 bp, Homo sapien
ggtagaatagtcttattcaaggaat

SEQ ID NO: 173771 - DNA, 25 bp, Homo sapien
ggaataagaactatgtaatcacagc

SEQ ID NO: 173772 - DNA, 25 bp, Homo sapien
aagaactatgtaatcacagcatggt

SEQ ID NO: 173773 - DNA, 25 bp, Homo sapien
tcttatcctgaatgtagatggtctc

SEQ ID NO: 173774 - DNA, 25 bp, Homo sapien
agatggtctcatcggagtcgcattt

SEQ ID NO: 173775 - DNA, 25 bp, Homo sapien
ggagtcgcatttgtagacatgctta

SEQ ID NO: 173776 - DNA, 25 bp, Homo sapien
tagaaactgtgggtcctttactcgg

SEQ ID NO: 173777 - DNA, 25 bp, Homo sapien
gaatatattgacattggagccctca

SEQ ID NO: 173778 - DNA, 25 bp, Homo sapien
agccctcaatggcatctttgtgctg

SEQ ID NO: 173779 - DNA, 25 bp, Homo sapien
gggttcattggacactatcttgatc

SEQ ID NO: 173780 - DNA, 25 bp, Homo sapien
ggctgtatcgtcatccgtgggatga

SEQ ID NO: 173781 - DNA, 25 bp, Homo sapien
gatatttcatatgttcttccggaac

SEQ ID NO: 173782 - DNA, 25 bp, Homo sapien
gttcttccggaacacatgagcatgt

SEQ ID NO: 173783 - DNA, 25 bp, Homo sapien
gagccaggaaccctactgcagtaaa

SEQ ID NO: 173784 - DNA, 25 bp, Homo sapien
taacaagcaccccagtcactaggat

SEQ ID NO: 173785 - DNA, 25 bp, Homo sapien
gcaccccagtcactaggatgcagat

SEQ ID NO: 173786 - DNA, 25 bp, Homo sapien
actaggatgcagatggaccacactt

SEQ ID NO: 173787 - DNA, 25 bp, Homo sapien
actttttgcaccttattttctctgt

SEQ ID NO: 173788 - DNA, 25 bp, Homo sapien
gagcccccacattctctaggagaaa

SEQ ID NO: 173789 - DNA, 25 bp, Homo sapien
agattaaaattcacagacactacat

SEQ ID NO: 173790 - DNA, 25 bp, Homo sapien
gacactacatatctaaagctttgac

SEQ ID NO: 173791 - DNA, 25 bp, Homo sapien
agctttgacaagtccttgacctcta

SEQ ID NO: 173792 - DNA, 25 bp, Homo sapien
ttcagcagtgatgctttttagtttt

SEQ ID NO: 173793 - DNA, 25 bp, Homo sapien
tatgatctgatctggacttcctata

SEQ ID NO: 173794 - DNA, 25 bp, Homo sapien
atctggacttcctataatacaaata

SEQ ID NO: 173795 - DNA, 25 bp, Homo sapien
attcatactggagttcccaaccctc

SEQ ID NO: 173796 - DNA, 25 bp, Homo sapien
ttcatactggagttcccaaccctcc

SEQ ID NO: 173797 - DNA, 25 bp, Homo sapien
tcatactggagttcccaaccctcct

SEQ ID NO: 173798 - DNA, 25 bp, Homo sapien
catactggagttcccaaccctccta

SEQ ID NO: 173799 - DNA, 25 bp, Homo sapien
tactggagttcccaaccctcctaca

SEQ ID NO: 173800 - DNA, 25 bp, Homo sapien
ctggagttcccaaccctcctacaca

SEQ ID NO: 173801 - DNA, 25 bp, Homo sapien
tggagttcccaaccctcctacacat

SEQ ID NO: 173802 - DNA, 25 bp, Homo sapien
ggagttcccaaccctcctacacata

SEQ ID NO: 173803 - DNA, 25 bp, Homo sapien
gagttcccaaccctcctacacataa

SEQ ID NO: 173804 - DNA, 25 bp, Homo sapien
agttcccaaccctcctacacataag

SEQ ID NO: 173805 - DNA, 25 bp, Homo sapien
gttcccaaccctcctacacataaga

SEQ ID NO: 173806 - DNA, 25 bp, Homo sapien
ttgagttcctgtttttcgccttata

SEQ ID NO: 173807 - DNA, 25 bp, Homo sapien
gtttttcgccttatagttttgtgag

SEQ ID NO: 173808 - DNA, 25 bp, Homo sapien
ttgagggacaacgaccaaaggtctt

SEQ ID NO: 173809 - DNA, 25 bp, Homo sapien
aaagcaacccatgcttatggttaaa

SEQ ID NO: 173810 - DNA, 25 bp, Homo sapien
aagagtacaggatctggagtccgtt

SEQ ID NO: 173811 - DNA, 25 bp, Homo sapien
gatctggagtccgttgaagggtaaa

SEQ ID NO: 173812 - DNA, 25 bp, Homo sapien
agggtaaaggcctcgcgcaagctgc

SEQ ID NO: 173813 - DNA, 25 bp, Homo sapien
gcaagctgccagtcggctctttttc

SEQ ID NO: 173814 - DNA, 25 bp, Homo sapien
tctttttcgcaagccttccagaagt

SEQ ID NO: 173815 - DNA, 25 bp, Homo sapien
gccttccagaagttttctgtgctta

SEQ ID NO: 173816 - DNA, 25 bp, Homo sapien
aaagcgtatgtgtggcctttctctt

SEQ ID NO: 173817 - DNA, 25 bp, Homo sapien
agggccattccaatctggtgggtgc

SEQ ID NO: 173818 - DNA, 25 bp, Homo sapien
gccatgtggaaggtcggcttcttca

SEQ ID NO: 173819 - DNA, 25 bp, Homo sapien
aaccggccacccctggaagaagatg

SEQ ID NO: 173820 - DNA, 25 bp, Homo sapien
ggagtgatggtgcagcctacactat

SEQ ID NO: 173821 - DNA, 25 bp, Homo sapien
gcagcctacactattctagcaggag

SEQ ID NO: 173822 - DNA, 25 bp, Homo sapien
ggttgggcgtgctacctgcaccgcc

SEQ ID NO: 173823 - DNA, 25 bp, Homo sapien
ttctccaacaagttgcctccaagct

SEQ ID NO: 173824 - DNA, 25 bp, Homo sapien
caagctttgggttggagctgttcca

SEQ ID NO: 173825 - DNA, 25 bp, Homo sapien
gttggagctgttccattgggtcctc

SEQ ID NO: 173826 - DNA, 25 bp, Homo sapien
cattgggtcctcttggtgtcgtttc

SEQ ID NO: 173827 - DNA, 25 bp, Homo sapien
tttccctcccaacagagctgggcta

SEQ ID NO: 173828 - DNA, 25 bp, Homo sapien
gaatagatagttctgcctctttttt

SEQ ID NO: 173829 - DNA, 25 bp, Homo sapien
ttttttcctgtgtgtgtggcctttg

SEQ ID NO: 173830 - DNA, 25 bp, Homo sapien
gtggcctttgcatcatttatcttgt

SEQ ID NO: 173831 - DNA, 25 bp, Homo sapien
gcctttgcatcatttatcttgtgga

SEQ ID NO: 173832 - DNA, 25 bp, Homo sapien
gtggaaaagaagattcaggccctga

SEQ ID NO: 173833 - DNA, 25 bp, Homo sapien
gattcaggccctgagaggtctcagc

SEQ ID NO: 173834 - DNA, 25 bp, Homo sapien
gccctgagaggtctcagctcttgga

SEQ ID NO: 173835 - DNA, 25 bp, Homo sapien
ggctttagcattgtgaagcgctgca

SEQ ID NO: 173836 - DNA, 25 bp, Homo sapien
gggaaccctcactagcaggactggt

SEQ ID NO: 173837 - DNA, 25 bp, Homo sapien
cctcactagcaggactggtggtgga

SEQ ID NO: 173838 - DNA, 25 bp, Homo sapien
cacagatcccagactttgccagagg

SEQ ID NO: 173839 - DNA, 25 bp, Homo sapien
tattttgaccttaccattattccag

SEQ ID NO: 173840 - DNA, 25 bp, Homo sapien
ttgaccttaccattattccagagat

SEQ ID NO: 173841 - DNA, 25 bp, Homo sapien
gaccttaccattattccagagattc

SEQ ID NO: 173842 - DNA, 25 bp, Homo sapien
cttaccattattccagagattcagt

SEQ ID NO: 173843 - DNA, 25 bp, Homo sapien
cattattccagagattcagtattaa

SEQ ID NO: 173844 - DNA, 25 bp, Homo sapien
aattacactgtggtagtggcattta

SEQ ID NO: 173845 - DNA, 25 bp, Homo sapien
cactgtggtagtggcatttaaacaa

SEQ ID NO: 173846 - DNA, 25 bp, Homo sapien
gtggtagtggcatttaaacaatata

SEQ ID NO: 173847 - DNA, 25 bp, Homo sapien
tattgtaaacaaaacacagctctta

SEQ ID NO: 173848 - DNA, 25 bp, Homo sapien
aacaaaacacagctcttacctaata

SEQ ID NO: 173849 - DNA, 25 bp, Homo sapien
acacagctcttacctaataaacatt

SEQ ID NO: 173850 - DNA, 25 bp, Homo sapien
tacttaccatatgtgcttgcctcag

SEQ ID NO: 173851 - DNA, 25 bp, Homo sapien
gcttgcctcagtaaaatgaacccca

SEQ ID NO: 173852 - DNA, 25 bp, Homo sapien
taaaatgaaccccactgggtgggca

SEQ ID NO: 173853 - DNA, 25 bp, Homo sapien
taattttttagagagctgttcccaa

SEQ ID NO: 173854 - DNA, 25 bp, Homo sapien
tgttcccaaattttctaacgagtgg

SEQ ID NO: 173855 - DNA, 25 bp, Homo sapien
attttctaacgagtggaccattatc

SEQ ID NO: 173856 - DNA, 25 bp, Homo sapien
ggaccattatcactttaaagccctt

SEQ ID NO: 173857 - DNA, 25 bp, Homo sapien
aatacatttcctacgggctgtgttc

SEQ ID NO: 173858 - DNA, 25 bp, Homo sapien
gggctgtgttccaacaaccattttt

SEQ ID NO: 173859 - DNA, 25 bp, Homo sapien
aggccaaactggcaaacttcagact

SEQ ID NO: 173860 - DNA, 25 bp, Homo sapien
acttcagactgaacatgtacactgg

SEQ ID NO: 173861 - DNA, 25 bp, Homo sapien
gtatgatagaattgtttcctctaag

SEQ ID NO: 173862 - DNA, 25 bp, Homo sapien
agaattgtttcctctaagtgtagtt

SEQ ID NO: 173863 - DNA, 25 bp, Homo sapien
tgtttcctctaagtgtagtttttct

SEQ ID NO: 173864 - DNA, 25 bp, Homo sapien
tctaagtgtagtttttctttcaact

SEQ ID NO: 173865 - DNA, 25 bp, Homo sapien
tagaaatggagtgatttcacagtgt

SEQ ID NO: 173866 - DNA, 25 bp, Homo sapien
ttcacagtgtgtactgttttgccac

SEQ ID NO: 173867 - DNA, 25 bp, Homo sapien
cagtgtgtactgttttgccacatac

SEQ ID NO: 173868 - DNA, 25 bp, Homo sapien
gtactgttttgccacatacttctaa

SEQ ID NO: 173869 - DNA, 25 bp, Homo sapien
actgttttgccacatacttctaaag

SEQ ID NO: 173870 - DNA, 25 bp, Homo sapien
gttttgccacatacttctaaagaac

SEQ ID NO: 173871 - DNA, 25 bp, Homo sapien
ttgccacatacttctaaagaacaca

SEQ ID NO: 173872 - DNA, 25 bp, Homo sapien
gaactcagaacccaagtgttccatg

SEQ ID NO: 173873 - DNA, 25 bp, Homo sapien
tgttccatgcccctgtgtggatgga

SEQ ID NO: 173874 - DNA, 25 bp, Homo sapien
ccatgcccctgtgtggatggagtcg

SEQ ID NO: 173875 - DNA, 25 bp, Homo sapien
gatggagtcgggtatcctgactgtt

SEQ ID NO: 173876 - DNA, 25 bp, Homo sapien
agtcgggtatcctgactgttggacc

SEQ ID NO: 173877 - DNA, 25 bp, Homo sapien
gtatcctgactgttggacccctggt

SEQ ID NO: 173878 - DNA, 25 bp, Homo sapien
cctccagctctgcttaggcattttg

SEQ ID NO: 173879 - DNA, 25 bp, Homo sapien
tctgcttaggcattttgcccctcac

SEQ ID NO: 173880 - DNA, 25 bp, Homo sapien
gttccacaccatcgacaaccaaggg

SEQ ID NO: 173881 - DNA, 25 bp, Homo sapien
tgaaccctggaccaaagcttttcca

SEQ ID NO: 173882 - DNA, 25 bp, Homo sapien
tggaccaaagcttttccagacccca

SEQ ID NO: 173883 - DNA, 25 bp, Homo sapien
atgtcaggtatttacagtggttgga

SEQ ID NO: 173884 - DNA, 25 bp, Homo sapien
ggaagatagcagtattattagcata

SEQ ID NO: 173885 - DNA, 25 bp, Homo sapien
gcataagctgcatacgtaatattca

SEQ ID NO: 173886 - DNA, 25 bp, Homo sapien
atacgtaatattcagtaactgccat

SEQ ID NO: 173887 - DNA, 25 bp, Homo sapien
tacattcacaaattcagtatcctgt

SEQ ID NO: 173888 - DNA, 25 bp, Homo sapien
cagtatcctgttaagtgtcatattc

SEQ ID NO: 173889 - DNA, 25 bp, Homo sapien
catattcttgtaatctgcattctcc

SEQ ID NO: 173890 - DNA, 25 bp, Homo sapien
atacccaattatattctagttcctt

SEQ ID NO: 173891 - DNA, 25 bp, Homo sapien
ctagttcctttatgtcctgtacatc

SEQ ID NO: 173892 - DNA, 25 bp, Homo sapien
atgtcctgtacatcattctctgctt

SEQ ID NO: 173893 - DNA, 25 bp, Homo sapien
tacatcattctctgcttggatttcc

SEQ ID NO: 173894 - DNA, 25 bp, Homo sapien
aacaaaatagaaagttgcaaggcaa

SEQ ID NO: 173895 - DNA, 25 bp, Homo sapien
acaaaatagaaagttgcaaggcaaa

SEQ ID NO: 173896 - DNA, 25 bp, Homo sapien
caaaatagaaagttgcaaggcaaat

SEQ ID NO: 173897 - DNA, 25 bp, Homo sapien
aaagttgcaaggcaaatgtttattt

SEQ ID NO: 173898 - DNA, 25 bp, Homo sapien
aagttgcaaggcaaatgtttattta

SEQ ID NO: 173899 - DNA, 25 bp, Homo sapien
aatgtttatttaaaagagcaggcca

SEQ ID NO: 173900 - DNA, 25 bp, Homo sapien
atgtttatttaaaagagcaggccag

SEQ ID NO: 173901 - DNA, 25 bp, Homo sapien
tgtttatttaaaagagcaggccagg

SEQ ID NO: 173902 - DNA, 25 bp, Homo sapien
gtttatttaaaagagcaggccaggc

SEQ ID NO: 173903 - DNA, 25 bp, Homo sapien
tttatttaaaagagcaggccaggcg

SEQ ID NO: 173904 - DNA, 25 bp, Homo sapien
ttatttaaaagagcaggccaggcgc

SEQ ID NO: 173905 - DNA, 25 bp, Homo sapien
gtaagattacgttctgatgtaagct

SEQ ID NO: 173906 - DNA, 25 bp, Homo sapien
gatgtaagctttaaccacctattta

SEQ ID NO: 173907 - DNA, 25 bp, Homo sapien
ctatttataaggtctcacctgtggt

SEQ ID NO: 173908 - DNA, 25 bp, Homo sapien
acctgtggtccactgtgttgagact

SEQ ID NO: 173909 - DNA, 25 bp, Homo sapien
ggtccactgtgttgagacttctaca

SEQ ID NO: 173910 - DNA, 25 bp, Homo sapien
gaagagcttctgtatagtaaccatt

SEQ ID NO: 173911 - DNA, 25 bp, Homo sapien
accattttcttaggctgtctcactt

SEQ ID NO: 173912 - DNA, 25 bp, Homo sapien
ggctgtctcacttgtgtgaatcttc

SEQ ID NO: 173913 - DNA, 25 bp, Homo sapien
gaatcttctgacacatttattatag

SEQ ID NO: 173914 - DNA, 25 bp, Homo sapien
attatagctttgtcccatttcttat

SEQ ID NO: 173915 - DNA, 25 bp, Homo sapien
catttcttatcctttttgctcttta

SEQ ID NO: 173916 - DNA, 25 bp, Homo sapien
tgttttttgtcattggcgtgcacac

SEQ ID NO: 173917 - DNA, 25 bp, Homo sapien
tttgtcattggcgtgcacacgtgtg

SEQ ID NO: 173918 - DNA, 25 bp, Homo sapien
atcttttacctatttcttacaattg

SEQ ID NO: 173919 - DNA, 25 bp, Homo sapien
cttacaattgcaagatgactggctt

SEQ ID NO: 173920 - DNA, 25 bp, Homo sapien
tgactggctttactatttgaaaact

SEQ ID NO: 173921 - DNA, 25 bp, Homo sapien
aactggtttgtgtatcatatcatat

SEQ ID NO: 173922 - DNA, 25 bp, Homo sapien
aagcagtttgaaggcatacttttgc

SEQ ID NO: 173923 - DNA, 25 bp, Homo sapien
gaaggcatacttttgcatagaaata

SEQ ID NO: 173924 - DNA, 25 bp, Homo sapien
gggcaatgaggaatatttgacaatt

SEQ ID NO: 173925 - DNA, 25 bp, Homo sapien
taagttaatcttcacgtttttgcaa

SEQ ID NO: 173926 - DNA, 25 bp, Homo sapien
atcttcacgtttttgcaaactttga

SEQ ID NO: 173927 - DNA, 25 bp, Homo sapien
ataacaagcgttaacattttcatat

SEQ ID NO: 173928 - DNA, 25 bp, Homo sapien
gtacctatatgtatttgcatttgaa

SEQ ID NO: 173929 - DNA, 25 bp, Homo sapien
attttggaatcctgctctatgtaca

SEQ ID NO: 173930 - DNA, 25 bp, Homo sapien
ggaatcctgctctatgtacagtttt

SEQ ID NO: 173931 - DNA, 25 bp, Homo sapien
cctgctctatgtacagttttgtatt

SEQ ID NO: 173932 - DNA, 25 bp, Homo sapien
aaacatgattttaaacagctgtaaa

SEQ ID NO: 173933 - DNA, 25 bp, Homo sapien
gttttatgcattatttaagcctgtc

SEQ ID NO: 173934 - DNA, 25 bp, Homo sapien
tatgcattatttaagcctgtctcta

SEQ ID NO: 173935 - DNA, 25 bp, Homo sapien
aagcctgtctctattgttggaattt

SEQ ID NO: 173936 - DNA, 25 bp, Homo sapien
gtctctattgttggaatttcaggtc

SEQ ID NO: 173937 - DNA, 25 bp, Homo sapien
tgttggaatttcaggtcattttcat

SEQ ID NO: 173938 - DNA, 25 bp, Homo sapien
aagaagtgtctctgttgggggacag

SEQ ID NO: 173939 - DNA, 25 bp, Homo sapien
aggaacctggggagtccatcgcatg

SEQ ID NO: 173940 - DNA, 25 bp, Homo sapien
gaacctggggagtccatcgcatgtc

SEQ ID NO: 173941 - DNA, 25 bp, Homo sapien
aacctggggagtccatcgcatgtcc

SEQ ID NO: 173942 - DNA, 25 bp, Homo sapien
tctgctcttagacacggccttgcca

SEQ ID NO: 173943 - DNA, 25 bp, Homo sapien
ctgctcttagacacggccttgccag

SEQ ID NO: 173944 - DNA, 25 bp, Homo sapien
tgctcttagacacggccttgccagg

SEQ ID NO: 173945 - DNA, 25 bp, Homo sapien
cttagacacggccttgccaggagag

SEQ ID NO: 173946 - DNA, 25 bp, Homo sapien
ttagacacggccttgccaggagagc

SEQ ID NO: 173947 - DNA, 25 bp, Homo sapien
tgcctccatctttccaagcaccggg

SEQ ID NO: 173948 - DNA, 25 bp, Homo sapien
catctttccaagcaccggggcgaaa

SEQ ID NO: 173949 - DNA, 25 bp, Homo sapien
gtgcttactaaaaggaggcagccat

SEQ ID NO: 173950 - DNA, 25 bp, Homo sapien
ggaggcagccatataggccttttaa

SEQ ID NO: 173951 - DNA, 25 bp, Homo sapien
gttctaagtcctttttaaagccatg

SEQ ID NO: 173952 - DNA, 25 bp, Homo sapien
agccatggaacaaaacctgatacat

SEQ ID NO: 173953 - DNA, 25 bp, Homo sapien
gatacatcaccctaacagagcatta

SEQ ID NO: 173954 - DNA, 25 bp, Homo sapien
tgagattgcaatacctgtcaccatg

SEQ ID NO: 173955 - DNA, 25 bp, Homo sapien
atgcagccgctgatagttctctgaa

SEQ ID NO: 173956 - DNA, 25 bp, Homo sapien
aaggactaattgtactttgaggcca

SEQ ID NO: 173957 - DNA, 25 bp, Homo sapien
tactttgaggccaatgctgctttct

SEQ ID NO: 173958 - DNA, 25 bp, Homo sapien
ctttctggtgtatattctccataca

SEQ ID NO: 173959 - DNA, 25 bp, Homo sapien
attattaactgctctttttccctct

SEQ ID NO: 173960 - DNA, 25 bp, Homo sapien
gttgtgtgcaaatccagcttccatc

SEQ ID NO: 173961 - DNA, 25 bp, Homo sapien
gcaggattctccatgtgtaaacttc

SEQ ID NO: 173962 - DNA, 25 bp, Homo sapien
gggcatccctttgtgggtgggcaga

SEQ ID NO: 173963 - DNA, 25 bp, Homo sapien
acccacagctgtgttactgcttgga

SEQ ID NO: 173964 - DNA, 25 bp, Homo sapien
cagctgtgttactgcttggagaagc

SEQ ID NO: 173965 - DNA, 25 bp, Homo sapien
ggcataccctgtggtgttgtgctgt

SEQ ID NO: 173966 - DNA, 25 bp, Homo sapien
ggaatattgaaacatcgcctaggaa

SEQ ID NO: 173967 - DNA, 25 bp, Homo sapien
catcgcctaggaattgtggtttgta

SEQ ID NO: 173968 - DNA, 25 bp, Homo sapien
ttgtatataaccctctaagccccta

SEQ ID NO: 173969 - DNA, 25 bp, Homo sapien
aagcccctatcccttgtcgatgaca

SEQ ID NO: 173970 - DNA, 25 bp, Homo sapien
tatcccttgtcgatgacagtcatcc

SEQ ID NO: 173971 - DNA, 25 bp, Homo sapien
ggctcaggcatctgtgactgaccga

SEQ ID NO: 173972 - DNA, 25 bp, Homo sapien
gctcaggcatctgtgactgaccgat

SEQ ID NO: 173973 - DNA, 25 bp, Homo sapien
ctcaggcatctgtgactgaccgatt

SEQ ID NO: 173974 - DNA, 25 bp, Homo sapien
caggcatctgtgactgaccgattga

SEQ ID NO: 173975 - DNA, 25 bp, Homo sapien
aggcatctgtgactgaccgattgat

SEQ ID NO: 173976 - DNA, 25 bp, Homo sapien
ggcatctgtgactgaccgattgatt

SEQ ID NO: 173977 - DNA, 25 bp, Homo sapien
gcatctgtgactgaccgattgattt

SEQ ID NO: 173978 - DNA, 25 bp, Homo sapien
atctgtgactgaccgattgatttga

SEQ ID NO: 173979 - DNA, 25 bp, Homo sapien
ctgtgactgaccgattgatttgatt

SEQ ID NO: 173980 - DNA, 25 bp, Homo sapien
gtgactgaccgattgatttgatttg

SEQ ID NO: 173981 - DNA, 25 bp, Homo sapien
gactgaccgattgatttgatttgtt

SEQ ID NO: 173982 - DNA, 25 bp, Homo sapien
caaatgttggaaggcgtgtggttct

SEQ ID NO: 173983 - DNA, 25 bp, Homo sapien
gtgttccctgtgaaactgagcaggt

SEQ ID NO: 173984 - DNA, 25 bp, Homo sapien
ctgtgaaactgagcaggtgtgtgtt

SEQ ID NO: 173985 - DNA, 25 bp, Homo sapien
ctaagtgccacatgcttgtgtgtag

SEQ ID NO: 173986 - DNA, 25 bp, Homo sapien
gtgccacatgcttgtgtgtagagga

SEQ ID NO: 173987 - DNA, 25 bp, Homo sapien
agcagcactcactgcactcctttgt

SEQ ID NO: 173988 - DNA, 25 bp, Homo sapien
tcactgcactcctttgtcatatact

SEQ ID NO: 173989 - DNA, 25 bp, Homo sapien
ctgcactcctttgtcatatactctg

SEQ ID NO: 173990 - DNA, 25 bp, Homo sapien
gtcatatactctgcatcactgtcat

SEQ ID NO: 173991 - DNA, 25 bp, Homo sapien
atatactctgcatcactgtcatact

SEQ ID NO: 173992 - DNA, 25 bp, Homo sapien
tactctgcatcactgtcatactcac

SEQ ID NO: 173993 - DNA, 25 bp, Homo sapien
aaagtccagggctatagggtgtgat

SEQ ID NO: 173994 - DNA, 25 bp, Homo sapien
gtgtgatgaagtcacccctttctgt

SEQ ID NO: 173995 - DNA, 25 bp, Homo sapien
actacatctgggactgactttccga

SEQ ID NO: 173996 - DNA, 25 bp, Homo sapien
aaagccggcttgatttccgtgaact

SEQ ID NO: 173997 - DNA, 25 bp, Homo sapien
atttccgtgaactctggtgctcctg

SEQ ID NO: 173998 - DNA, 25 bp, Homo sapien
tggtgctcctgcatctcatgagtgt

SEQ ID NO: 173999 - DNA, 25 bp, Homo sapien
tgcatctcatgagtgtgccccatgg

SEQ ID NO: 174000 - DNA, 25 bp, Homo sapien
tcagcatttccttgtcccgtctgga

SEQ ID NO: 174001 - DNA, 25 bp, Homo sapien
ggcagcaagctttggtttatggttt

SEQ ID NO: 174002 - DNA, 25 bp, Homo sapien
tgctaaagcctgtgggtttggtcct

SEQ ID NO: 174003 - DNA, 25 bp, Homo sapien
ggtccttgaacaagatgtgggcctt

SEQ ID NO: 174004 - DNA, 25 bp, Homo sapien
tctctccagcctctcttaggagggg

SEQ ID NO: 174005 - DNA, 25 bp, Homo sapien
ggtggagttggcatcttgtaactct

SEQ ID NO: 174006 - DNA, 25 bp, Homo sapien
ggagttggcatcttgtaactctcct

SEQ ID NO: 174007 - DNA, 25 bp, Homo sapien
agttggcatcttgtaactctccttt

SEQ ID NO: 174008 - DNA, 25 bp, Homo sapien
ttggcatcttgtaactctcctttct

SEQ ID NO: 174009 - DNA, 25 bp, Homo sapien
tggcatcttgtaactctcctttctc

SEQ ID NO: 174010 - DNA, 25 bp, Homo sapien
gcatcttgtaactctcctttctcct

SEQ ID NO: 174011 - DNA, 25 bp, Homo sapien
acttcttgattgtcagtctgtgtca

SEQ ID NO: 174012 - DNA, 25 bp, Homo sapien
ttcttgattgtcagtctgtgtcaca

SEQ ID NO: 174013 - DNA, 25 bp, Homo sapien
cttgattgtcagtctgtgtcacatc

SEQ ID NO: 174014 - DNA, 25 bp, Homo sapien
tttctgactgcccaaggggctcaga

SEQ ID NO: 174015 - DNA, 25 bp, Homo sapien
ccaaaccctcaaacagagtgcctta

SEQ ID NO: 174016 - DNA, 25 bp, Homo sapien
tatcaggataattgtctcatgacca

SEQ ID NO: 174017 - DNA, 25 bp, Homo sapien
attgtctcatgaccaaatccacgct

SEQ ID NO: 174018 - DNA, 25 bp, Homo sapien
tgaccaaatccacgctcaattagag

SEQ ID NO: 174019 - DNA, 25 bp, Homo sapien
ttagagccattcaaaattccttaag

SEQ ID NO: 174020 - DNA, 25 bp, Homo sapien
attccttaagatcatgggttctgac

SEQ ID NO: 174021 - DNA, 25 bp, Homo sapien
ttgtaatgtcctctccatcatcctc

SEQ ID NO: 174022 - DNA, 25 bp, Homo sapien
atcatcctcagtgtgagtcctcaga

SEQ ID NO: 174023 - DNA, 25 bp, Homo sapien
agagcctccatctgccaagaacatt

SEQ ID NO: 174024 - DNA, 25 bp, Homo sapien
aagaacattcagttggattccatcg

SEQ ID NO: 174025 - DNA, 25 bp, Homo sapien
attcagttggattccatcgtttggt

SEQ ID NO: 174026 - DNA, 25 bp, Homo sapien
tgttctgtgctggttacaagcctga

SEQ ID NO: 174027 - DNA, 25 bp, Homo sapien
gtgctggttacaagcctgatgaagg

SEQ ID NO: 174028 - DNA, 25 bp, Homo sapien
gggaccctttgtcatgaagagcccc

SEQ ID NO: 174029 - DNA, 25 bp, Homo sapien
gaagagcccctttaacaaccgctgg

SEQ ID NO: 174030 - DNA, 25 bp, Homo sapien
caaccgctggtatcaaatgggcatc

SEQ ID NO: 174031 - DNA, 25 bp, Homo sapien
tatcaaatgggcatcgtctcatggg

SEQ ID NO: 174032 - DNA, 25 bp, Homo sapien
ggaaatatggcttctacacacatgt

SEQ ID NO: 174033 - DNA, 25 bp, Homo sapien
tacacacatgtgttccgcctgaaga

SEQ ID NO: 174034 - DNA, 25 bp, Homo sapien
gtgttccgcctgaagaagtggatac

SEQ ID NO: 174035 - DNA, 25 bp, Homo sapien
gaaggtcattgatcagtttggagag

SEQ ID NO: 174036 - DNA, 25 bp, Homo sapien
ggaaccaatcccgtgaaagaattat

SEQ ID NO: 174037 - DNA, 25 bp, Homo sapien
gtgaatttttcctacagcactgttt

SEQ ID NO: 174038 - DNA, 25 bp, Homo sapien
gttttccaactttctgtactaatag

SEQ ID NO: 174039 - DNA, 25 bp, Homo sapien
aatagatacatttctgtgcataaga

SEQ ID NO: 174040 - DNA, 25 bp, Homo sapien
ctcacagttcagtagttttcgttaa

SEQ ID NO: 174041 - DNA, 25 bp, Homo sapien
ggatttactgtgtgagtactttact

SEQ ID NO: 174042 - DNA, 25 bp, Homo sapien
gagtactttactgtgaggaattgca

SEQ ID NO: 174043 - DNA, 25 bp, Homo sapien
tactcttgtctaaaagttctgtgtg

SEQ ID NO: 174044 - DNA, 25 bp, Homo sapien
tggcacacagagatgcgacctactc

SEQ ID NO: 174045 - DNA, 25 bp, Homo sapien
tgcgacctactcaatctgacttagt

SEQ ID NO: 174046 - DNA, 25 bp, Homo sapien
aaaccatgctgtagaatttttgtct

SEQ ID NO: 174047 - DNA, 25 bp, Homo sapien
tcttaaaaagaccacatacccagca

SEQ ID NO: 174048 - DNA, 25 bp, Homo sapien
cttccctgaatgtgccttcttgtgg

SEQ ID NO: 174049 - DNA, 25 bp, Homo sapien
ttgtggctttagcatgtgccatgct

SEQ ID NO: 174050 - DNA, 25 bp, Homo sapien
tgcagactgccattctccttgcaga

SEQ ID NO: 174051 - DNA, 25 bp, Homo sapien
tctccttgcagacttggctcagaag

SEQ ID NO: 174052 - DNA, 25 bp, Homo sapien
agtgcagttagcctgagctcccctg

SEQ ID NO: 174053 - DNA, 25 bp, Homo sapien
ggtgcctccatcagagcatttaccc

SEQ ID NO: 174054 - DNA, 25 bp, Homo sapien
gcatttaccccattgtgttgtggct

SEQ ID NO: 174055 - DNA, 25 bp, Homo sapien
ttgtggctgttccttaacgtcccca

SEQ ID NO: 174056 - DNA, 25 bp, Homo sapien
ggattgtgtctggttaatttctgta

SEQ ID NO: 174057 - DNA, 25 bp, Homo sapien
taatttctgtattctctgcaacttt

SEQ ID NO: 174058 - DNA, 25 bp, Homo sapien
gcaactttgcaatgtttggcttgaa

SEQ ID NO: 174059 - DNA, 25 bp, Homo sapien
aagctctcaagttcaccctttaggg

SEQ ID NO: 174060 - DNA, 25 bp, Homo sapien
agctctcaagttcaccctttaggga

SEQ ID NO: 174061 - DNA, 25 bp, Homo sapien
gctctcaagttcaccctttagggaa

SEQ ID NO: 174062 - DNA, 25 bp, Homo sapien
aagggatttgtgatgtctgtaaagt

SEQ ID NO: 174063 - DNA, 25 bp, Homo sapien
acctaggaaagataattcaaccatc

SEQ ID NO: 174064 - DNA, 25 bp, Homo sapien
ctaggaaagataattcaaccatcta

SEQ ID NO: 174065 - DNA, 25 bp, Homo sapien
aggaaagataattcaaccatctaat

SEQ ID NO: 174066 - DNA, 25 bp, Homo sapien
ggaaagataattcaaccatctaatc

SEQ ID NO: 174067 - DNA, 25 bp, Homo sapien
gaaagataattcaaccatctaatca

SEQ ID NO: 174068 - DNA, 25 bp, Homo sapien
aagataattcaaccatctaatcaaa

SEQ ID NO: 174069 - DNA, 25 bp, Homo sapien
agataattcaaccatctaatcaaaa

SEQ ID NO: 174070 - DNA, 25 bp, Homo sapien
agtcctcagtgcaggaccagtggat

SEQ ID NO: 174071 - DNA, 25 bp, Homo sapien
agaggcccaagataggctggcttcc

SEQ ID NO: 174072 - DNA, 25 bp, Homo sapien
ccccgttcaaggtatagtctgcctt

SEQ ID NO: 174073 - DNA, 25 bp, Homo sapien
gggagttttagaaccaacatgcaag

SEQ ID NO: 174074 - DNA, 25 bp, Homo sapien
gcaagagccattattgacttagatc

SEQ ID NO: 174075 - DNA, 25 bp, Homo sapien
gacttagatccaaaacagcctctct

SEQ ID NO: 174076 - DNA, 25 bp, Homo sapien
aacagcctctctcatgtctaaaaag

SEQ ID NO: 174077 - DNA, 25 bp, Homo sapien
gggatgcattacctttttgcttctt

SEQ ID NO: 174078 - DNA, 25 bp, Homo sapien
gcttcttttcaattgcttagtgttt

SEQ ID NO: 174079 - DNA, 25 bp, Homo sapien
gtttctaatcatacttaatccacac

SEQ ID NO: 174080 - DNA, 25 bp, Homo sapien
ttaatccacactaatgtgcgcaatt

SEQ ID NO: 174081 - DNA, 25 bp, Homo sapien
ggaacacctgtccattgaagatttc

SEQ ID NO: 174082 - DNA, 25 bp, Homo sapien
gaagatttcactcaggcctttggga

SEQ ID NO: 174083 - DNA, 25 bp, Homo sapien
actcaggcctttgggatgactccag

SEQ ID NO: 174084 - DNA, 25 bp, Homo sapien
gcctttgggatgactccagctgcct

SEQ ID NO: 174085 - DNA, 25 bp, Homo sapien
gctctgcctcgatggaagcaacaaa

SEQ ID NO: 174086 - DNA, 25 bp, Homo sapien
ttgtaaagcagtaccctaccctgat

SEQ ID NO: 174087 - DNA, 25 bp, Homo sapien
tgattgtagggtctcattttctcac

SEQ ID NO: 174088 - DNA, 25 bp, Homo sapien
attttctcaccgatattagtcctac

SEQ ID NO: 174089 - DNA, 25 bp, Homo sapien
atattagtcctacaccaattgaagt

SEQ ID NO: 174090 - DNA, 25 bp, Homo sapien
tgtgcctatgagcacaaacttctgt

SEQ ID NO: 174091 - DNA, 25 bp, Homo sapien
gtggcaaatgccagttttgtttaat

SEQ ID NO: 174092 - DNA, 25 bp, Homo sapien
accccacagttctccctgagagaga

SEQ ID NO: 174093 - DNA, 25 bp, Homo sapien
cacagttctccctgagagagatcaa

SEQ ID NO: 174094 - DNA, 25 bp, Homo sapien
gttctccctgagagagatcaacctc

SEQ ID NO: 174095 - DNA, 25 bp, Homo sapien
cctgagagagatcaacctccctgag

SEQ ID NO: 174096 - DNA, 25 bp, Homo sapien
tgagagagatcaacctccctgagat

SEQ ID NO: 174097 - DNA, 25 bp, Homo sapien
agagagatcaacctccctgagatca

SEQ ID NO: 174098 - DNA, 25 bp, Homo sapien
tcaacctccctgagatcaaccaagg

SEQ ID NO: 174099 - DNA, 25 bp, Homo sapien
aacctccctgagatcaaccaaggca

SEQ ID NO: 174100 - DNA, 25 bp, Homo sapien
ctccctgagatcaaccaaggcagat

SEQ ID NO: 174101 - DNA, 25 bp, Homo sapien
agatgtgacagcaagggccacggac

SEQ ID NO: 174102 - DNA, 25 bp, Homo sapien
atgtgacagcaagggccacggaccc

SEQ ID NO: 174103 - DNA, 25 bp, Homo sapien
aattctgggctgagggtgatgaaat

SEQ ID NO: 174104 - DNA, 25 bp, Homo sapien
gaagaaattgggaatacagcctatt

SEQ ID NO: 174105 - DNA, 25 bp, Homo sapien
aatacagcctattcctatgatggac

SEQ ID NO: 174106 - DNA, 25 bp, Homo sapien
gaaggatgaagtcccccaaggccag

SEQ ID NO: 174107 - DNA, 25 bp, Homo sapien
caaggccagcttgggttctacaatg

SEQ ID NO: 174108 - DNA, 25 bp, Homo sapien
tgggttctacaatgccgtggccatt

SEQ ID NO: 174109 - DNA, 25 bp, Homo sapien
acggagcctcttctgaaagcatgca

SEQ ID NO: 174110 - DNA, 25 bp, Homo sapien
gcatgcagggataatctcagtcagt

SEQ ID NO: 174111 - DNA, 25 bp, Homo sapien
ctcagtcagtgggagaaggtgattc

SEQ ID NO: 174112 - DNA, 25 bp, Homo sapien
gaggagactgcaacctggatttcat

SEQ ID NO: 174113 - DNA, 25 bp, Homo sapien
cccatccgtggctcagaaggcagct

SEQ ID NO: 174114 - DNA, 25 bp, Homo sapien
cttgtaaatatctgaagctgtagct

SEQ ID NO: 174115 - DNA, 25 bp, Homo sapien
atgtctgccttacaaattcataaca

SEQ ID NO: 174116 - DNA, 25 bp, Homo sapien
caacaagatttgtcagtcagcattt

SEQ ID NO: 174117 - DNA, 25 bp, Homo sapien
tttccctgatttttatcttctcacc

SEQ ID NO: 174118 - DNA, 25 bp, Homo sapien
tatcttctcaccattttacctcttt

SEQ ID NO: 174119 - DNA, 25 bp, Homo sapien
ttacctcttttaacaggagcctgag

SEQ ID NO: 174120 - DNA, 25 bp, Homo sapien
caggagcctgagcacaaggtttaat

SEQ ID NO: 174121 - DNA, 25 bp, Homo sapien
atgtttgtacaaatctccatgatgt

SEQ ID NO: 174122 - DNA, 25 bp, Homo sapien
atctccatgatgtttgccaagtttg

SEQ ID NO: 174123 - DNA, 25 bp, Homo sapien
gatgtttgccaagtttgaatgcgca

SEQ ID NO: 174124 - DNA, 25 bp, Homo sapien
gtttgaatgcgcaaaacttggaaaa

SEQ ID NO: 174125 - DNA, 25 bp, Homo sapien
agtgacctgaccaacggtgcagatg

SEQ ID NO: 174126 - DNA, 25 bp, Homo sapien
ctgaccaacggtgcagatgggatgc

SEQ ID NO: 174127 - DNA, 25 bp, Homo sapien
tggccacaagctccaatgggtctca

SEQ ID NO: 174128 - DNA, 25 bp, Homo sapien
cacaagctccaatgggtctcagtac

SEQ ID NO: 174129 - DNA, 25 bp, Homo sapien
gtggagactccggtgtcctacgtcg

SEQ ID NO: 174130 - DNA, 25 bp, Homo sapien
ggaggacgatgacttcaacgagaat

SEQ ID NO: 174131 - DNA, 25 bp, Homo sapien
gacgatgacttcaacgagaatgacg

SEQ ID NO: 174132 - DNA, 25 bp, Homo sapien
aacgagaatgacgaggacgactgac

SEQ ID NO: 174133 - DNA, 25 bp, Homo sapien
cccacttcagattcggcttcaggaa

SEQ ID NO: 174134 - DNA, 25 bp, Homo sapien
cagattcggcttcaggaaaacgttt

SEQ ID NO: 174135 - DNA, 25 bp, Homo sapien
tcggcttcaggaaaacgtttagcga

SEQ ID NO: 174136 - DNA, 25 bp, Homo sapien
tgcacagccgcagcagagagagctc

SEQ ID NO: 174137 - DNA, 25 bp, Homo sapien
gagagagctcacaggccacctcaag

SEQ ID NO: 174138 - DNA, 25 bp, Homo sapien
ccacctcaaggtcagcaagcagaag

SEQ ID NO: 174139 - DNA, 25 bp, Homo sapien
acagagagaatgtcacggcctccct

SEQ ID NO: 174140 - DNA, 25 bp, Homo sapien
gcttcagggtagctcttgtgtttgc

SEQ ID NO: 174141 - DNA, 25 bp, Homo sapien
gggtagctcttgtgtttgctctaac

SEQ ID NO: 174142 - DNA, 25 bp, Homo sapien
tctaactcactccaggtaaccctga

SEQ ID NO: 174143 - DNA, 25 bp, Homo sapien
aggtaaccctgattcctgaactgct

SEQ ID NO: 174144 - DNA, 25 bp, Homo sapien
aaccctgattcctgaactgctggca

SEQ ID NO: 174145 - DNA, 25 bp, Homo sapien
acgccggctgggactgccaatgatg

SEQ ID NO: 174146 - DNA, 25 bp, Homo sapien
caacccacttgtgattctgtatcaa

SEQ ID NO: 174147 - DNA, 25 bp, Homo sapien
acatctgtcatgtcttctcggacaa

SEQ ID NO: 174148 - DNA, 25 bp, Homo sapien
gtcttctcggacaaagtatcatggt

SEQ ID NO: 174149 - DNA, 25 bp, Homo sapien
ttatgtctaaaagagctcgctggca

SEQ ID NO: 174150 - DNA, 25 bp, Homo sapien
aaaagagctcgctggcaagctgcct

SEQ ID NO: 174151 - DNA, 25 bp, Homo sapien
aagctgcctcttgagtttgttataa

SEQ ID NO: 174152 - DNA, 25 bp, Homo sapien
tgttataaaagcgaactgttcacaa

SEQ ID NO: 174153 - DNA, 25 bp, Homo sapien
aactgttcacaaaatgatcccatca

SEQ ID NO: 174154 - DNA, 25 bp, Homo sapien
catcaaggccctcccataattaaca

SEQ ID NO: 174155 - DNA, 25 bp, Homo sapien
gccctcccataattaacactcaaaa

SEQ ID NO: 174156 - DNA, 25 bp, Homo sapien
gcatttgaagcatctgttgattgta

SEQ ID NO: 174157 - DNA, 25 bp, Homo sapien
agtgttcttacatagttagttatat

SEQ ID NO: 174158 - DNA, 25 bp, Homo sapien
aaaccaaactggactctcgtgcaga

SEQ ID NO: 174159 - DNA, 25 bp, Homo sapien
accaaactggactctcgtgcagaaa

SEQ ID NO: 174160 - DNA, 25 bp, Homo sapien
acgggattacactggctgcagtaca

SEQ ID NO: 174161 - DNA, 25 bp, Homo sapien
gattacactggctgcagtacatcag

SEQ ID NO: 174162 - DNA, 25 bp, Homo sapien
gtacatcagagagtttgtcaccagt

SEQ ID NO: 174163 - DNA, 25 bp, Homo sapien
agagagtttgtcaccagttaagcag

SEQ ID NO: 174164 - DNA, 25 bp, Homo sapien
tttgtcaccagttaagcaggctcct

SEQ ID NO: 174165 - DNA, 25 bp, Homo sapien
agttaagcaggctcctcggaagtcc

SEQ ID NO: 174166 - DNA, 25 bp, Homo sapien
ctccgacactgagggtcttgtaaag

SEQ ID NO: 174167 - DNA, 25 bp, Homo sapien
ggtcttgtaaagagtctgccttctg

SEQ ID NO: 174168 - DNA, 25 bp, Homo sapien
tgtaaagagtctgccttctggatct

SEQ ID NO: 174169 - DNA, 25 bp, Homo sapien
ttccctgaacccctcttggattaag

SEQ ID NO: 174170 - DNA, 25 bp, Homo sapien
ctgaacccctcttggattaaggaag

SEQ ID NO: 174171 - DNA, 25 bp, Homo sapien
ggaagactgaagactagcccctttt

SEQ ID NO: 174172 - DNA, 25 bp, Homo sapien
agactgaagactagccccttttctg

SEQ ID NO: 174173 - DNA, 25 bp, Homo sapien
tttcctcctccctgtgttaactggg

SEQ ID NO: 174174 - DNA, 25 bp, Homo sapien
gggacagtgcgtgatttctcagtga

SEQ ID NO: 174175 - DNA, 25 bp, Homo sapien
gtgatttctcagtgatttcctacag

SEQ ID NO: 174176 - DNA, 25 bp, Homo sapien
agtgatttcctacagtgttgttccc

SEQ ID NO: 174177 - DNA, 25 bp, Homo sapien
ggaggagataaacaccaacccagga

SEQ ID NO: 174178 - DNA, 25 bp, Homo sapien
gcttctccagtttttgaggagccag

SEQ ID NO: 174179 - DNA, 25 bp, Homo sapien
tccagtttttgaggagccagccagg

SEQ ID NO: 174180 - DNA, 25 bp, Homo sapien
tcagaaacccttcagtgctacattt

SEQ ID NO: 174181 - DNA, 25 bp, Homo sapien
cagtgctacattttgtggcttttta

SEQ ID NO: 174182 - DNA, 25 bp, Homo sapien
accaagccaatgttatagacgtttg

SEQ ID NO: 174183 - DNA, 25 bp, Homo sapien
agacgtttggactgatttgtggaaa

SEQ ID NO: 174184 - DNA, 25 bp, Homo sapien
aggatcattcaaaagttacccaaag

SEQ ID NO: 174185 - DNA, 25 bp, Homo sapien
caaagggcttattgactctttctat

SEQ ID NO: 174186 - DNA, 25 bp, Homo sapien
aaatgatttccacaaacagatcagg

SEQ ID NO: 174187 - DNA, 25 bp, Homo sapien
ggaagcactaggttggcagagacac

SEQ ID NO: 174188 - DNA, 25 bp, Homo sapien
tttgtctagtgtattctcttcacag

SEQ ID NO: 174189 - DNA, 25 bp, Homo sapien
agagtggtttctgcgtgtgtatatt

SEQ ID NO: 174190 - DNA, 25 bp, Homo sapien
gatatttttcatgctccactatttt

SEQ ID NO: 174191 - DNA, 25 bp, Homo sapien
atctccctgcagtttgacttctttg

SEQ ID NO: 174192 - DNA, 25 bp, Homo sapien
ttctttgagacagagggcaatgatg

SEQ ID NO: 174193 - DNA, 25 bp, Homo sapien
caatgatgtgtgcaagtacgacttc

SEQ ID NO: 174194 - DNA, 25 bp, Homo sapien
gatgtgtgcaagtacgacttcgtgg

SEQ ID NO: 174195 - DNA, 25 bp, Homo sapien
aggtgcgcagtggactcacagctga

SEQ ID NO: 174196 - DNA, 25 bp, Homo sapien
agctgactccaagctgcatggcaag

SEQ ID NO: 174197 - DNA, 25 bp, Homo sapien
gctgcatggcaagttctgtggttct

SEQ ID NO: 174198 - DNA, 25 bp, Homo sapien
ctgtggttctgagaagcccgaggtc

SEQ ID NO: 174199 - DNA, 25 bp, Homo sapien
tccgacaacaccgtgtccaaaaagg

SEQ ID NO: 174200 - DNA, 25 bp, Homo sapien
caccgtgtccaaaaagggcttcaag

SEQ ID NO: 174201 - DNA, 25 bp, Homo sapien
tccaaaaagggcttcaaggcccact

SEQ ID NO: 174202 - DNA, 25 bp, Homo sapien
aacctgcagggcagcccggtgtacg

SEQ ID NO: 174203 - DNA, 25 bp, Homo sapien
tacgtgggcggcaacttcgtcgagt

SEQ ID NO: 174204 - DNA, 25 bp, Homo sapien
ggcaacttcgtcgagtccatggcgc

SEQ ID NO: 174205 - DNA, 25 bp, Homo sapien
gtccgggcctgtcttcaacctgggc

SEQ ID NO: 174206 - DNA, 25 bp, Homo sapien
tcgtcggccagcgtggactacagtt

SEQ ID NO: 174207 - DNA, 25 bp, Homo sapien
tggactacagttgcgccgcgcagat

SEQ ID NO: 174208 - DNA, 25 bp, Homo sapien
gttgcgccgcgcagattccaggcaa

SEQ ID NO: 174209 - DNA, 25 bp, Homo sapien
actcgtctcagggacgactgccgga

SEQ ID NO: 174210 - DNA, 25 bp, Homo sapien
gacgactgccggaggctcccaaact

SEQ ID NO: 174211 - DNA, 25 bp, Homo sapien
ggctcccaaactgacgcatctgtag

SEQ ID NO: 174212 - DNA, 25 bp, Homo sapien
catcccatggcgagcaacggcggcg

SEQ ID NO: 174213 - DNA, 25 bp, Homo sapien
atttgctgaggtaacttttgcagaa

SEQ ID NO: 174214 - DNA, 25 bp, Homo sapien
ttacgtgaacaccaaatactgattt

SEQ ID NO: 174215 - DNA, 25 bp, Homo sapien
cgtgaacaccaaatactgatttaaa

SEQ ID NO: 174216 - DNA, 25 bp, Homo sapien
gctcttcttctcttttcatactcac

SEQ ID NO: 174217 - DNA, 25 bp, Homo sapien
ttcttctcttttcatactcacacag

SEQ ID NO: 174218 - DNA, 25 bp, Homo sapien
cttctcttttcatactcacacagac

SEQ ID NO: 174219 - DNA, 25 bp, Homo sapien
tcttttcatactcacacagacactc

SEQ ID NO: 174220 - DNA, 25 bp, Homo sapien
ctgcccctgggcataactgaatagg

SEQ ID NO: 174221 - DNA, 25 bp, Homo sapien
gcccctgggcataactgaataggaa

SEQ ID NO: 174222 - DNA, 25 bp, Homo sapien
cctgggcataactgaataggaaatg

SEQ ID NO: 174223 - DNA, 25 bp, Homo sapien
aaaccttatctcaaacactgaaagt

SEQ ID NO: 174224 - DNA, 25 bp, Homo sapien
gtatgtaaacacctatggccggata

SEQ ID NO: 174225 - DNA, 25 bp, Homo sapien
ctatggccggataactaaggatgtg

SEQ ID NO: 174226 - DNA, 25 bp, Homo sapien
actaaggatgtggtgctccaatggg

SEQ ID NO: 174227 - DNA, 25 bp, Homo sapien
gtctgtggcctacattcattccaat

SEQ ID NO: 174228 - DNA, 25 bp, Homo sapien
aaagctattgagatccggtcagtgg

SEQ ID NO: 174229 - DNA, 25 bp, Homo sapien
gagtatttatgcataagcgagctca

SEQ ID NO: 174230 - DNA, 25 bp, Homo sapien
taagcgagctcaaaggttaaagttt

SEQ ID NO: 174231 - DNA, 25 bp, Homo sapien
ataaggtattttttgcatccgtgcg

SEQ ID NO: 174232 - DNA, 25 bp, Homo sapien
ttttgcatccgtgcgatctggagga

SEQ ID NO: 174233 - DNA, 25 bp, Homo sapien
agccaagtgtttttcatgaccctca

SEQ ID NO: 174234 - DNA, 25 bp, Homo sapien
atgaccctcaacagaaattccatga

SEQ ID NO: 174235 - DNA, 25 bp, Homo sapien
cataagtattttctgtgggaccgac

SEQ ID NO: 174236 - DNA, 25 bp, Homo sapien
tattttctgtgggaccgactctcaa

SEQ ID NO: 174237 - DNA, 25 bp, Homo sapien
ttctgtgggaccgactctcaaggca

SEQ ID NO: 174238 - DNA, 25 bp, Homo sapien
gaccgactctcaaggcactgtgtat

SEQ ID NO: 174239 - DNA, 25 bp, Homo sapien
aaggcactgtgtatgccctgcaagt

SEQ ID NO: 174240 - DNA, 25 bp, Homo sapien
tatgccctgcaagttggctgtctat

SEQ ID NO: 174241 - DNA, 25 bp, Homo sapien
gcaagttggctgtctatgagcattt

SEQ ID NO: 174242 - DNA, 25 bp, Homo sapien
ggctgtctatgagcatttagagatt

SEQ ID NO: 174243 - DNA, 25 bp, Homo sapien
aaacttgatagtgcttttggtccta

SEQ ID NO: 174244 - DNA, 25 bp, Homo sapien
gatagtgcttttggtcctagatgat

SEQ ID NO: 174245 - DNA, 25 bp, Homo sapien
gcttttggtcctagatgatttttat

SEQ ID NO: 174246 - DNA, 25 bp, Homo sapien
cggcccggagcggtgtattttgatt

SEQ ID NO: 174247 - DNA, 25 bp, Homo sapien
cggtgtattttgattgctggtgctt

SEQ ID NO: 174248 - DNA, 25 bp, Homo sapien
ttgctggtgctttaactatattgac

SEQ ID NO: 174249 - DNA, 25 bp, Homo sapien
gaccaaggtgtatagtaacctattt

SEQ ID NO: 174250 - DNA, 25 bp, Homo sapien
tatttatcacattttacgaagcaat

SEQ ID NO: 174251 - DNA, 25 bp, Homo sapien
ttaatcttaaacacatccagcaaat

SEQ ID NO: 174252 - DNA, 25 bp, Homo sapien
acatccagcaaatggtgtccctgct

SEQ ID NO: 174253 - DNA, 25 bp, Homo sapien
gtgtccctgctgaaacttttaactg

SEQ ID NO: 174254 - DNA, 25 bp, Homo sapien
ttttaactggaaacctcacacctgg

SEQ ID NO: 174255 - DNA, 25 bp, Homo sapien
aactggaaacctcacacctggcagg

SEQ ID NO: 174256 - DNA, 25 bp, Homo sapien
agccgtgcccttgtggagtcagcag

SEQ ID NO: 174257 - DNA, 25 bp, Homo sapien
atacagatattttcgtcgtgtccct

SEQ ID NO: 174258 - DNA, 25 bp, Homo sapien
tcgtcgtgtccctgtacaagaagca

SEQ ID NO: 174259 - DNA, 25 bp, Homo sapien
ggctacagctatgttccagtggtca

SEQ ID NO: 174260 - DNA, 25 bp, Homo sapien
ccagtggtcaccagaggttcaacaa

SEQ ID NO: 174261 - DNA, 25 bp, Homo sapien
ggttcaacaaactcatctggataca

SEQ ID NO: 174262 - DNA, 25 bp, Homo sapien
gactgcagtcagtgcttttgagatt

SEQ ID NO: 174263 - DNA, 25 bp, Homo sapien
gttcttcgccagagtaaggagctac

SEQ ID NO: 174264 - DNA, 25 bp, Homo sapien
aaggagctacacagctttctcagaa

SEQ ID NO: 174265 - DNA, 25 bp, Homo sapien
gaaaggcctctgtagagcctcaagt

SEQ ID NO: 174266 - DNA, 25 bp, Homo sapien
tagagcctcaagtccagtcctctat

SEQ ID NO: 174267 - DNA, 25 bp, Homo sapien
cagtcctctatcacttttgcatgaa

SEQ ID NO: 174268 - DNA, 25 bp, Homo sapien
tttgctcttcaagaaatctgtgcct

SEQ ID NO: 174269 - DNA, 25 bp, Homo sapien
ttgctcttcaagaaatctgtgcctg

SEQ ID NO: 174270 - DNA, 25 bp, Homo sapien
tgctcttcaagaaatctgtgcctga

SEQ ID NO: 174271 - DNA, 25 bp, Homo sapien
gctcttcaagaaatctgtgcctgag

SEQ ID NO: 174272 - DNA, 25 bp, Homo sapien
ctcttcaagaaatctgtgcctgaga

SEQ ID NO: 174273 - DNA, 25 bp, Homo sapien
tcttcaagaaatctgtgcctgagaa

SEQ ID NO: 174274 - DNA, 25 bp, Homo sapien
gatgggcttcatccaatggactgca

SEQ ID NO: 174275 - DNA, 25 bp, Homo sapien
atgggcttcatccaatggactgcat

SEQ ID NO: 174276 - DNA, 25 bp, Homo sapien
ccaatggactgcataaataaccggg

SEQ ID NO: 174277 - DNA, 25 bp, Homo sapien
ataaccggggattctgtacatgcat

SEQ ID NO: 174278 - DNA, 25 bp, Homo sapien
cggggattctgtacatgcattgagc

SEQ ID NO: 174279 - DNA, 25 bp, Homo sapien
tcactgggatgcctcttgcagggtc

SEQ ID NO: 174280 - DNA, 25 bp, Homo sapien
gatgcctcttgcagggtcttgcttt

SEQ ID NO: 174281 - DNA, 25 bp, Homo sapien
gtcttgctttctttgacctcttctc

SEQ ID NO: 174282 - DNA, 25 bp, Homo sapien
ctcccctacaccaacaaagaggaat

SEQ ID NO: 174283 - DNA, 25 bp, Homo sapien
gaatggctgcaagagcccagatcac

SEQ ID NO: 174284 - DNA, 25 bp, Homo sapien
agagcccagatcacccattccgggt

SEQ ID NO: 174285 - DNA, 25 bp, Homo sapien
cccagagcagggtctctctaaaggg

SEQ ID NO: 174286 - DNA, 25 bp, Homo sapien
gaaagactggccctctagcttctac

SEQ ID NO: 174287 - DNA, 25 bp, Homo sapien
tagcttctaccctttgtccctgtag

SEQ ID NO: 174288 - DNA, 25 bp, Homo sapien
tttgtccctgtagcctatacagttt

SEQ ID NO: 174289 - DNA, 25 bp, Homo sapien
gtccctgtagcctatacagtttaga

SEQ ID NO: 174290 - DNA, 25 bp, Homo sapien
tgtccatccttcaggcatccctaaa

SEQ ID NO: 174291 - DNA, 25 bp, Homo sapien
aggcatccctaaagctcactctgaa

SEQ ID NO: 174292 - DNA, 25 bp, Homo sapien
taaagctcactctgaagatgttaga

SEQ ID NO: 174293 - DNA, 25 bp, Homo sapien
acacaaactcttcgagttaaagttg

SEQ ID NO: 174294 - DNA, 25 bp, Homo sapien
tgacactgacatgaaggcaagcctt

SEQ ID NO: 174295 - DNA, 25 bp, Homo sapien
aggcaagccttgatttcgtatgaac

SEQ ID NO: 174296 - DNA, 25 bp, Homo sapien
ttcgtatgaacgttgctgaagtggt

SEQ ID NO: 174297 - DNA, 25 bp, Homo sapien
ttccccagattgttaagagttcact

SEQ ID NO: 174298 - DNA, 25 bp, Homo sapien
agagttcactgaagatattgacaca

SEQ ID NO: 174299 - DNA, 25 bp, Homo sapien
attgctctcgtgttttacagtaaga

SEQ ID NO: 174300 - DNA, 25 bp, Homo sapien
ttgttgctctcagactgtgtaaaac

SEQ ID NO: 174301 - DNA, 25 bp, Homo sapien
aagaaggacttctacgacctggcag

SEQ ID NO: 174302 - DNA, 25 bp, Homo sapien
acttctacgacctggcagccttcat

SEQ ID NO: 174303 - DNA, 25 bp, Homo sapien
gccttcatcaccgagggcctggagg

SEQ ID NO: 174304 - DNA, 25 bp, Homo sapien
gcctggaggtgcacttcgtggaaca

SEQ ID NO: 174305 - DNA, 25 bp, Homo sapien
ttcgtggaacactaccgggagatct

SEQ ID NO: 174306 - DNA, 25 bp, Homo sapien
gggagatcttcgacatcgccttccc

SEQ ID NO: 174307 - DNA, 25 bp, Homo sapien
agtggagccaccgagcgagcagctc

SEQ ID NO: 174308 - DNA, 25 bp, Homo sapien
agcagctcggtccagtgacccagat

SEQ ID NO: 174309 - DNA, 25 bp, Homo sapien
agatcccagggacctcagtcggctt

SEQ ID NO: 174310 - DNA, 25 bp, Homo sapien
gacctcagtcggcttaatcagagtg

SEQ ID NO: 174311 - DNA, 25 bp, Homo sapien
cggcttaatcagagtgtggcataga

SEQ ID NO: 174312 - DNA, 25 bp, Homo sapien
gctcatgggcgccaaaaaatactgg

SEQ ID NO: 174313 - DNA, 25 bp, Homo sapien
atgggcgccaaaaaatactggatct

SEQ ID NO: 174314 - DNA, 25 bp, Homo sapien
aaaatactggatctgctgaacgaag

SEQ ID NO: 174315 - DNA, 25 bp, Homo sapien
agcccgagatctccgcagtcttcag

SEQ ID NO: 174316 - DNA, 25 bp, Homo sapien
gagatctccgcagtcttcagcgcat

SEQ ID NO: 174317 - DNA, 25 bp, Homo sapien
atctccgcagtcttcagcgcattgg

SEQ ID NO: 174318 - DNA, 25 bp, Homo sapien
agtcttcagcgcattggcccgaaga

SEQ ID NO: 174319 - DNA, 25 bp, Homo sapien
cttcagcgcattggcccgaagaagg

SEQ ID NO: 174320 - DNA, 25 bp, Homo sapien
attggcccgaagaaggcccagctaa

SEQ ID NO: 174321 - DNA, 25 bp, Homo sapien
ccgaagaaggcccagctaatcgtgg

SEQ ID NO: 174322 - DNA, 25 bp, Homo sapien
aaggcccagctaatcgtgggctggc

SEQ ID NO: 174323 - DNA, 25 bp, Homo sapien
ggacaccagctgcttgactactgct

SEQ ID NO: 174324 - DNA, 25 bp, Homo sapien
gactactgctcaggctatgtggact

SEQ ID NO: 174325 - DNA, 25 bp, Homo sapien
ggctatgtggactgcatccctcaaa

SEQ ID NO: 174326 - DNA, 25 bp, Homo sapien
catccctcaaactcgcaacaaattt

SEQ ID NO: 174327 - DNA, 25 bp, Homo sapien
tcgcaacaaatttgccttccgagag

SEQ ID NO: 174328 - DNA, 25 bp, Homo sapien
ccttccgagaggctgtgagcaaact

SEQ ID NO: 174329 - DNA, 25 bp, Homo sapien
aactggaactcagcctgcaggagct

SEQ ID NO: 174330 - DNA, 25 bp, Homo sapien
aggagctacaggtttcttcagcagc

SEQ ID NO: 174331 - DNA, 25 bp, Homo sapien
agctgctggtgtgcccgggacaaac

SEQ ID NO: 174332 - DNA, 25 bp, Homo sapien
taacttattgtcatgtgtacaggaa

SEQ ID NO: 174333 - DNA, 25 bp, Homo sapien
cagaggtagccactgttagcctggt

SEQ ID NO: 174334 - DNA, 25 bp, Homo sapien
gcaaggagccagaacccaagggatc

SEQ ID NO: 174335 - DNA, 25 bp, Homo sapien
gaacccaagggatccactaagaaga

SEQ ID NO: 174336 - DNA, 25 bp, Homo sapien
aatgtgtttccccattatacctcct

SEQ ID NO: 174337 - DNA, 25 bp, Homo sapien
ttcaccccagaatatttgccgtctt

SEQ ID NO: 174338 - DNA, 25 bp, Homo sapien
atatttgccgtcttgtacccttaag

SEQ ID NO: 174339 - DNA, 25 bp, Homo sapien
ttgtacccttaagagctacagctag

SEQ ID NO: 174340 - DNA, 25 bp, Homo sapien
ctacagctagagaaaccttcacggg

SEQ ID NO: 174341 - DNA, 25 bp, Homo sapien
ttctaaggcttttctagcgtgaccc

SEQ ID NO: 174342 - DNA, 25 bp, Homo sapien
agcgtgacccttttcagtagtgcta

SEQ ID NO: 174343 - DNA, 25 bp, Homo sapien
tcagtagtgctagtcccttttttac

SEQ ID NO: 174344 - DNA, 25 bp, Homo sapien
gtcccttttttacttgatcttaatg

SEQ ID NO: 174345 - DNA, 25 bp, Homo sapien
agaaagcactgcttgccatctgtgc

SEQ ID NO: 174346 - DNA, 25 bp, Homo sapien
actgcttgccatctgtgctggtgat

SEQ ID NO: 174347 - DNA, 25 bp, Homo sapien
tggtgatgctgaggactactaaaat

SEQ ID NO: 174348 - DNA, 25 bp, Homo sapien
gaagaggacttggagtactgtgcac

SEQ ID NO: 174349 - DNA, 25 bp, Homo sapien
tactgtgcactcctctttctagaca

SEQ ID NO: 174350 - DNA, 25 bp, Homo sapien
tcctctttctagacacttccaaata

SEQ ID NO: 174351 - DNA, 25 bp, Homo sapien
agagattttctcacaaatttgtact

SEQ ID NO: 174352 - DNA, 25 bp, Homo sapien
aaatttgtactgttcatggcactat

SEQ ID NO: 174353 - DNA, 25 bp, Homo sapien
tttcctcttctatccttgaaattat

SEQ ID NO: 174354 - DNA, 25 bp, Homo sapien
tactgaatttgcctactatcctgaa

SEQ ID NO: 174355 - DNA, 25 bp, Homo sapien
tatcctgaatttgcctactatctaa

SEQ ID NO: 174356 - DNA, 25 bp, Homo sapien
tacagtcccgactaggtgagctgcc

SEQ ID NO: 174357 - DNA, 25 bp, Homo sapien
gtcccgactaggtgagctgccgacg

SEQ ID NO: 174358 - DNA, 25 bp, Homo sapien
gggactatgcaattccaaagggaat

SEQ ID NO: 174359 - DNA, 25 bp, Homo sapien
gggagatcctgaccctacccttgtg

SEQ ID NO: 174360 - DNA, 25 bp, Homo sapien
ctgaccctacccttgtgagagtcaa

SEQ ID NO: 174361 - DNA, 25 bp, Homo sapien
gagagtcaaggcacagagtcggtct

SEQ ID NO: 174362 - DNA, 25 bp, Homo sapien
aaggcacagagtcggtctcccatga

SEQ ID NO: 174363 - DNA, 25 bp, Homo sapien
gcacagagtcggtctcccatgagag

SEQ ID NO: 174364 - DNA, 25 bp, Homo sapien
gagtcggtctcccatgagagccgcc

SEQ ID NO: 174365 - DNA, 25 bp, Homo sapien
cgtccgtgaccctcttagtgtcaaa

SEQ ID NO: 174366 - DNA, 25 bp, Homo sapien
gtctatggaagtttttaagctgatt

SEQ ID NO: 174367 - DNA, 25 bp, Homo sapien
ccatccggcttgtgtccagctttta

SEQ ID NO: 174368 - DNA, 25 bp, Homo sapien
tttagctcttgccaatggtgctgca

SEQ ID NO: 174369 - DNA, 25 bp, Homo sapien
gctgcagtggccattcttgtagtta

SEQ ID NO: 174370 - DNA, 25 bp, Homo sapien
gtggccattcttgtagttatagctt

SEQ ID NO: 174371 - DNA, 25 bp, Homo sapien
agttatagctttgcgtactcaggaa

SEQ ID NO: 174372 - DNA, 25 bp, Homo sapien
tttgcgtactcaggaaggcccttct

SEQ ID NO: 174373 - DNA, 25 bp, Homo sapien
aaatgcagcctgtggtcgggcagac

SEQ ID NO: 174374 - DNA, 25 bp, Homo sapien
ggtgtggtgtccagctgttaccagc

SEQ ID NO: 174375 - DNA, 25 bp, Homo sapien
agctgttaccagcttctgagctaga

SEQ ID NO: 174376 - DNA, 25 bp, Homo sapien
tctgagctagagctgtactgcctca

SEQ ID NO: 174377 - DNA, 25 bp, Homo sapien
tagagctgtactgcctcacgtacac

SEQ ID NO: 174378 - DNA, 25 bp, Homo sapien
attccccgctcatgagtgtgtggag

SEQ ID NO: 174379 - DNA, 25 bp, Homo sapien
ttccccgctcatgagtgtgtggagg

SEQ ID NO: 174380 - DNA, 25 bp, Homo sapien
tccccgctcatgagtgtgtggagga

SEQ ID NO: 174381 - DNA, 25 bp, Homo sapien
ccccgctcatgagtgtgtggaggac

SEQ ID NO: 174382 - DNA, 25 bp, Homo sapien
cccgctcatgagtgtgtggaggaca

SEQ ID NO: 174383 - DNA, 25 bp, Homo sapien
ccgctcatgagtgtgtggaggacac

SEQ ID NO: 174384 - DNA, 25 bp, Homo sapien
gctcatgagtgtgtggaggacaccc

SEQ ID NO: 174385 - DNA, 25 bp, Homo sapien
ctcatgagtgtgtggaggacaccct

SEQ ID NO: 174386 - DNA, 25 bp, Homo sapien
catgagtgtgtggaggacaccctga

SEQ ID NO: 174387 - DNA, 25 bp, Homo sapien
atgagtgtgtggaggacaccctgaa

SEQ ID NO: 174388 - DNA, 25 bp, Homo sapien
tgagtgtgtggaggacaccctgaac

SEQ ID NO: 174389 - DNA, 25 bp, Homo sapien
ggttttgtttgctatcttaattttg

SEQ ID NO: 174390 - DNA, 25 bp, Homo sapien
gctatcttaattttggttgtattct

SEQ ID NO: 174391 - DNA, 25 bp, Homo sapien
ggttgtattctttgatgttaacaca

SEQ ID NO: 174392 - DNA, 25 bp, Homo sapien
gtatcgtatagctgtattgaatcat

SEQ ID NO: 174393 - DNA, 25 bp, Homo sapien
aatactgccagatgctgatgttcag

SEQ ID NO: 174394 - DNA, 25 bp, Homo sapien
gatgttcagtgtaatttctttgcct

SEQ ID NO: 174395 - DNA, 25 bp, Homo sapien
tttctttgcctgttcagttacagaa

SEQ ID NO: 174396 - DNA, 25 bp, Homo sapien
gttacagaaagtggtgctcagttgt

SEQ ID NO: 174397 - DNA, 25 bp, Homo sapien
gtggtgctcagttgtagaatgtatt

SEQ ID NO: 174398 - DNA, 25 bp, Homo sapien
gtattgtaccttttaacacctgatg

SEQ ID NO: 174399 - DNA, 25 bp, Homo sapien
acacctgatgtgtacatcccatgta

SEQ ID NO: 174400 - DNA, 25 bp, Homo sapien
ggcactgtcagagaatctggagttg

SEQ ID NO: 174401 - DNA, 25 bp, Homo sapien
actgtataacctgcataactttttg

SEQ ID NO: 174402 - DNA, 25 bp, Homo sapien
ataacctgcataactttttgtcttt

SEQ ID NO: 174403 - DNA, 25 bp, Homo sapien
tgtctttaagtcgtgtttgtaaaag

SEQ ID NO: 174404 - DNA, 25 bp, Homo sapien
tggttatatccaactttttgtaaat

SEQ ID NO: 174405 - DNA, 25 bp, Homo sapien
gtaaatatactggaagcttgataat

SEQ ID NO: 174406 - DNA, 25 bp, Homo sapien
tatttcctatcaccatacttttcca

SEQ ID NO: 174407 - DNA, 25 bp, Homo sapien
tcctatcaccatacttttccatgtg

SEQ ID NO: 174408 - DNA, 25 bp, Homo sapien
ttttccatgtgaaaacctgagccta

SEQ ID NO: 174409 - DNA, 25 bp, Homo sapien
aaaacctgagcctatttctagtata

SEQ ID NO: 174410 - DNA, 25 bp, Homo sapien
gcctatttctagtataagtatccaa

SEQ ID NO: 174411 - DNA, 25 bp, Homo sapien
agggtcaggcctttgagctcagaaa

SEQ ID NO: 174412 - DNA, 25 bp, Homo sapien
caggcctttgagctcagaaaatatc

SEQ ID NO: 174413 - DNA, 25 bp, Homo sapien
gaaaatatccctcctgttgggagag

SEQ ID NO: 174414 - DNA, 25 bp, Homo sapien
atccctcctgttgggagagggcgca

SEQ ID NO: 174415 - DNA, 25 bp, Homo sapien
gtgacgtctgggtggcccttatgac

SEQ ID NO: 174416 - DNA, 25 bp, Homo sapien
tgggtggcccttatgactgccaaga

SEQ ID NO: 174417 - DNA, 25 bp, Homo sapien
cttatgactgccaagactgctgtgg

SEQ ID NO: 174418 - DNA, 25 bp, Homo sapien
gagagcctgcaggatctcaccaggc

SEQ ID NO: 174419 - DNA, 25 bp, Homo sapien
tgcaggatctcaccaggcagcctct

SEQ ID NO: 174420 - DNA, 25 bp, Homo sapien
aaaaagcccaccatttggcatccct

SEQ ID NO: 174421 - DNA, 25 bp, Homo sapien
atttggcatccctgggccttgggct

SEQ ID NO: 174422 - DNA, 25 bp, Homo sapien
cctatggacctcaacaccaaggatt

SEQ ID NO: 174423 - DNA, 25 bp, Homo sapien
ctatggacctcaacaccaaggatta

SEQ ID NO: 174424 - DNA, 25 bp, Homo sapien
ataggtcattttgtatcaaaaggtc

SEQ ID NO: 174425 - DNA, 25 bp, Homo sapien
ggtcattttgtatcaaaaggtcaat

SEQ ID NO: 174426 - DNA, 25 bp, Homo sapien
attggttttatttgatgtacccaag

SEQ ID NO: 174427 - DNA, 25 bp, Homo sapien
tggttttatttgatgtacccaagtc

SEQ ID NO: 174428 - DNA, 25 bp, Homo sapien
gttttatttgatgtacccaagtctt

SEQ ID NO: 174429 - DNA, 25 bp, Homo sapien
tttatttgatgtacccaagtcttac

SEQ ID NO: 174430 - DNA, 25 bp, Homo sapien
ttatttgatgtacccaagtcttacg

SEQ ID NO: 174431 - DNA, 25 bp, Homo sapien
atttgatgtacccaagtcttacgtt

SEQ ID NO: 174432 - DNA, 25 bp, Homo sapien
tgatgtacccaagtcttacgtttcc

SEQ ID NO: 174433 - DNA, 25 bp, Homo sapien
tactataacatctaagcatcatctg

SEQ ID NO: 174434 - DNA, 25 bp, Homo sapien
gcatcatctgatttgatattcccta

SEQ ID NO: 174435 - DNA, 25 bp, Homo sapien
ttgatattccctaaaaaacatttgg

SEQ ID NO: 174436 - DNA, 25 bp, Homo sapien
tatagattcagtatctactacccat

SEQ ID NO: 174437 - DNA, 25 bp, Homo sapien
tctactacccatatttactttacca

SEQ ID NO: 174438 - DNA, 25 bp, Homo sapien
ttctcctcactgcataaggactact

SEQ ID NO: 174439 - DNA, 25 bp, Homo sapien
tgcataaggactactcttctcatat

SEQ ID NO: 174440 - DNA, 25 bp, Homo sapien
agtttattttgtgatgccctcttgg

SEQ ID NO: 174441 - DNA, 25 bp, Homo sapien
gatgccctcttggttttgatacttt

SEQ ID NO: 174442 - DNA, 25 bp, Homo sapien
tgtggcacccgttctacatgaatta

SEQ ID NO: 174443 - DNA, 25 bp, Homo sapien
gcacccgttctacatgaattatcaa

SEQ ID NO: 174444 - DNA, 25 bp, Homo sapien
agctctgggtttgccaggctcacca

SEQ ID NO: 174445 - DNA, 25 bp, Homo sapien
aggacccagtggaagatgtaaccca

SEQ ID NO: 174446 - DNA, 25 bp, Homo sapien
gatgtaacccagaagattgcctcta

SEQ ID NO: 174447 - DNA, 25 bp, Homo sapien
agaagattgcctctatcctgtgtct

SEQ ID NO: 174448 - DNA, 25 bp, Homo sapien
tgcccatcagcgcacaggtgggaat

SEQ ID NO: 174449 - DNA, 25 bp, Homo sapien
gaattgaacacacctgaagaagact

SEQ ID NO: 174450 - DNA, 25 bp, Homo sapien
agaagacttagttcctggtaacatt

SEQ ID NO: 174451 - DNA, 25 bp, Homo sapien
atttccttggacatggagctctctt

SEQ ID NO: 174452 - DNA, 25 bp, Homo sapien
tggagctctcttaataccgtcaaac

SEQ ID NO: 174453 - DNA, 25 bp, Homo sapien
ttaataccgtcaaaccctcatcatc

SEQ ID NO: 174454 - DNA, 25 bp, Homo sapien
agccaggcattaaaagcaaccgttt

SEQ ID NO: 174455 - DNA, 25 bp, Homo sapien
tactcacaccctgagaattctggga

SEQ ID NO: 174456 - DNA, 25 bp, Homo sapien
aattctgggagccagtctgccatgc

SEQ ID NO: 174457 - DNA, 25 bp, Homo sapien
agtctgccatgccaggagtcactgg

SEQ ID NO: 174458 - DNA, 25 bp, Homo sapien
gagtcactggacatgttcatcctag

SEQ ID NO: 174459 - DNA, 25 bp, Homo sapien
tgttcatcctagaatcctgtcacac

SEQ ID NO: 174460 - DNA, 25 bp, Homo sapien
gaatcctgtcacactacagtcattt

SEQ ID NO: 174461 - DNA, 25 bp, Homo sapien
tgcttcaaccccagagcctaagaat

SEQ ID NO: 174462 - DNA, 25 bp, Homo sapien
gaatggcagccgtttcttaacatgt

SEQ ID NO: 174463 - DNA, 25 bp, Homo sapien
gagagatgattctttcttggccctg

SEQ ID NO: 174464 - DNA, 25 bp, Homo sapien
gccctggccatctcgggaagcttga

SEQ ID NO: 174465 - DNA, 25 bp, Homo sapien
gggaagcttgatggcaatcctggaa

SEQ ID NO: 174466 - DNA, 25 bp, Homo sapien
tgtgtgtggaagccacgggctcaag

SEQ ID NO: 174467 - DNA, 25 bp, Homo sapien
cagtgtgagagagctagtgtaagct

SEQ ID NO: 174468 - DNA, 25 bp, Homo sapien
gagagagctagtgtaagctgttgat

SEQ ID NO: 174469 - DNA, 25 bp, Homo sapien
agagagctagtgtaagctgttgatg

SEQ ID NO: 174470 - DNA, 25 bp, Homo sapien
gagagctagtgtaagctgttgatga

SEQ ID NO: 174471 - DNA, 25 bp, Homo sapien
agagctagtgtaagctgttgatgag

SEQ ID NO: 174472 - DNA, 25 bp, Homo sapien
gagctagtgtaagctgttgatgaga

SEQ ID NO: 174473 - DNA, 25 bp, Homo sapien
gctagtgtaagctgttgatgagagc

SEQ ID NO: 174474 - DNA, 25 bp, Homo sapien
ctagtgtaagctgttgatgagagct

SEQ ID NO: 174475 - DNA, 25 bp, Homo sapien
tagtgtaagctgttgatgagagctg

SEQ ID NO: 174476 - DNA, 25 bp, Homo sapien
agtgtaagctgttgatgagagctgt

SEQ ID NO: 174477 - DNA, 25 bp, Homo sapien
attatccatagtttttttagtgctt

SEQ ID NO: 174478 - DNA, 25 bp, Homo sapien
tttagtgcttttaacattccgacat

SEQ ID NO: 174479 - DNA, 25 bp, Homo sapien
gtgcttttaacattccgacatacat

SEQ ID NO: 174480 - DNA, 25 bp, Homo sapien
taacattccgacatacatcattctg

SEQ ID NO: 174481 - DNA, 25 bp, Homo sapien
cattccgacatacatcattctgtga

SEQ ID NO: 174482 - DNA, 25 bp, Homo sapien
tccgacatacatcattctgtgatta

SEQ ID NO: 174483 - DNA, 25 bp, Homo sapien
tctgtaaatgatacctacattctaa

SEQ ID NO: 174484 - DNA, 25 bp, Homo sapien
gatacctacattctaaagagttaat

SEQ ID NO: 174485 - DNA, 25 bp, Homo sapien
ttaattctaattattccgatatgac

SEQ ID NO: 174486 - DNA, 25 bp, Homo sapien
gaagatattaagtccctttcaaaat

SEQ ID NO: 174487 - DNA, 25 bp, Homo sapien
gatattaagtccctttcaaaatgga

SEQ ID NO: 174488 - DNA, 25 bp, Homo sapien
cggtcactgatagtatgtatttctt

SEQ ID NO: 174489 - DNA, 25 bp, Homo sapien
gatgcagttctgtatttattgtgct

SEQ ID NO: 174490 - DNA, 25 bp, Homo sapien
atttattgtgctgtgtctggtccta

SEQ ID NO: 174491 - DNA, 25 bp, Homo sapien
gtgtctggtcctaagtggagccaat

SEQ ID NO: 174492 - DNA, 25 bp, Homo sapien
gtggagccaattaaacaagtttcat

SEQ ID NO: 174493 - DNA, 25 bp, Homo sapien
atgtatttttccagtgttgaatctc

SEQ ID NO: 174494 - DNA, 25 bp, Homo sapien
gttgaatctcacacactgtactttg

SEQ ID NO: 174495 - DNA, 25 bp, Homo sapien
atttccttccatcctgaataacgaa

SEQ ID NO: 174496 - DNA, 25 bp, Homo sapien
ggccatatatattgcctccttatcc

SEQ ID NO: 174497 - DNA, 25 bp, Homo sapien
ttgcctccttatccttgagatttca

SEQ ID NO: 174498 - DNA, 25 bp, Homo sapien
gagatttcactacctttatgttaaa

SEQ ID NO: 174499 - DNA, 25 bp, Homo sapien
tggccatccgcttcctgaatgctga

SEQ ID NO: 174500 - DNA, 25 bp, Homo sapien
catccgcttcctgaatgctgagaat

SEQ ID NO: 174501 - DNA, 25 bp, Homo sapien
cttcctgaatgctgagaatgcacag

SEQ ID NO: 174502 - DNA, 25 bp, Homo sapien
atgctgagaatgcacagaaattcaa

SEQ ID NO: 174503 - DNA, 25 bp, Homo sapien
gaatgcaggaaagagatcgaagaga

SEQ ID NO: 174504 - DNA, 25 bp, Homo sapien
aagaaagcaggatcaggcaaaaatg

SEQ ID NO: 174505 - DNA, 25 bp, Homo sapien
atgatcatgccgaaaaagtggcgga

SEQ ID NO: 174506 - DNA, 25 bp, Homo sapien
aaagtggcggaaaagctagaagctc

SEQ ID NO: 174507 - DNA, 25 bp, Homo sapien
aaagctagaagctctctcggtgaag

SEQ ID NO: 174508 - DNA, 25 bp, Homo sapien
agctagaagctctctcggtgaagga

SEQ ID NO: 174509 - DNA, 25 bp, Homo sapien
ctagaagctctctcggtgaaggagg

SEQ ID NO: 174510 - DNA, 25 bp, Homo sapien
tcaagtgagccaggaaagcagcaaa

SEQ ID NO: 174511 - DNA, 25 bp, Homo sapien
aagagaaacctgagtgacgacgtgg

SEQ ID NO: 174512 - DNA, 25 bp, Homo sapien
taatcagcctcgctcttgtctctgg

SEQ ID NO: 174513 - DNA, 25 bp, Homo sapien
ttgtctctggtgttctctggctctt

SEQ ID NO: 174514 - DNA, 25 bp, Homo sapien
tgttctctggctcttgtccatctgt

SEQ ID NO: 174515 - DNA, 25 bp, Homo sapien
tctttttgccagctattgactaatc

SEQ ID NO: 174516 - DNA, 25 bp, Homo sapien
tattgactaatctttgctgaagctg

SEQ ID NO: 174517 - DNA, 25 bp, Homo sapien
gaagctgagctagaattctggtgtt

SEQ ID NO: 174518 - DNA, 25 bp, Homo sapien
taagcaggtaactagctgagcacta

SEQ ID NO: 174519 - DNA, 25 bp, Homo sapien
tagctgagcactagttgataacttt

SEQ ID NO: 174520 - DNA, 25 bp, Homo sapien
actttggagttagtggataaccaca

SEQ ID NO: 174521 - DNA, 25 bp, Homo sapien
ttgtcctgtttgtaacgtagaacaa

SEQ ID NO: 174522 - DNA, 25 bp, Homo sapien
aagacttcagatctaaccctgttca

SEQ ID NO: 174523 - DNA, 25 bp, Homo sapien
gatctaaccctgttcaatgtgcatg

SEQ ID NO: 174524 - DNA, 25 bp, Homo sapien
aaccctgttcaatgtgcatgtggat

SEQ ID NO: 174525 - DNA, 25 bp, Homo sapien
atgtgcatgtggatgtttgcttaaa

SEQ ID NO: 174526 - DNA, 25 bp, Homo sapien
ccagttaatcaacccaaagaaagct

SEQ ID NO: 174527 - DNA, 25 bp, Homo sapien
cccaaagaaagctccagaagtactg

SEQ ID NO: 174528 - DNA, 25 bp, Homo sapien
ccagaagtactggtagctcaagtgg

SEQ ID NO: 174529 - DNA, 25 bp, Homo sapien
acagaaggctgtaacaagaacaaaa

SEQ ID NO: 174530 - DNA, 25 bp, Homo sapien
caaacaatcccaaacatacccttga

SEQ ID NO: 174531 - DNA, 25 bp, Homo sapien
caaacatacccttgatatatttttt

SEQ ID NO: 174532 - DNA, 25 bp, Homo sapien
tgaggaggccaaggccccgaaagca

SEQ ID NO: 174533 - DNA, 25 bp, Homo sapien
gaaagcaaccgccaactctgtgtgg

SEQ ID NO: 174534 - DNA, 25 bp, Homo sapien
caaccgccaactctgtgtggaggga

SEQ ID NO: 174535 - DNA, 25 bp, Homo sapien
cgactggccgagtgcctcagacgga

SEQ ID NO: 174536 - DNA, 25 bp, Homo sapien
cgagtgcctcagacggagctcagca

SEQ ID NO: 174537 - DNA, 25 bp, Homo sapien
tgcctcagacggagctcagcacctg

SEQ ID NO: 174538 - DNA, 25 bp, Homo sapien
caggatggccctgtccaagttctga

SEQ ID NO: 174539 - DNA, 25 bp, Homo sapien
gatggccctgtccaagttctgacac

SEQ ID NO: 174540 - DNA, 25 bp, Homo sapien
ctgtccaagttctgacacccacttg

SEQ ID NO: 174541 - DNA, 25 bp, Homo sapien
ttgccaacccattccgggagcctgt

SEQ ID NO: 174542 - DNA, 25 bp, Homo sapien
acccattccgggagcctgtagccgt

SEQ ID NO: 174543 - DNA, 25 bp, Homo sapien
ggtttcgctgtcattcatgatgcgg

SEQ ID NO: 174544 - DNA, 25 bp, Homo sapien
gctgtcattcatgatgcggccagag

SEQ ID NO: 174545 - DNA, 25 bp, Homo sapien
atgatgcggccagagcaggtttcct

SEQ ID NO: 174546 - DNA, 25 bp, Homo sapien
tcctggacactttacagactttgct

SEQ ID NO: 174547 - DNA, 25 bp, Homo sapien
gacactttacagactttgctggagt

SEQ ID NO: 174548 - DNA, 25 bp, Homo sapien
gactttgctggagtttcaagctgat

SEQ ID NO: 174549 - DNA, 25 bp, Homo sapien
agtttcaagctgatgttaacatcga

SEQ ID NO: 174550 - DNA, 25 bp, Homo sapien
tggtgaagcacacggccagcaatgt

SEQ ID NO: 174551 - DNA, 25 bp, Homo sapien
gggacaccgcctgtgatttggccag

SEQ ID NO: 174552 - DNA, 25 bp, Homo sapien
atttggccaggctctatgggaggaa

SEQ ID NO: 174553 - DNA, 25 bp, Homo sapien
atgaggttgttagcctgatgcaggc

SEQ ID NO: 174554 - DNA, 25 bp, Homo sapien
atgatatagctttccatgtggcaga

SEQ ID NO: 174555 - DNA, 25 bp, Homo sapien
atgtggcagatctacatgtctagag

SEQ ID NO: 174556 - DNA, 25 bp, Homo sapien
gagaacactgtgctctattaccatt

SEQ ID NO: 174557 - DNA, 25 bp, Homo sapien
agagatggtttctactggctgccag

SEQ ID NO: 174558 - DNA, 25 bp, Homo sapien
actggctgccagaatctagagcaaa

SEQ ID NO: 174559 - DNA, 25 bp, Homo sapien
gacatcgattgatatgcttctttgt

SEQ ID NO: 174560 - DNA, 25 bp, Homo sapien
ttctttgtgttatttccctcccaag

SEQ ID NO: 174561 - DNA, 25 bp, Homo sapien
tatttccctcccaagtaaatgtttg

SEQ ID NO: 174562 - DNA, 25 bp, Homo sapien
cttgggtccattttctatgcttgta

SEQ ID NO: 174563 - DNA, 25 bp, Homo sapien
tttctatgcttgtaactgtcttcta

SEQ ID NO: 174564 - DNA, 25 bp, Homo sapien
tgtcttctagcagtgagccaaatgt

SEQ ID NO: 174565 - DNA, 25 bp, Homo sapien
aggcagataatgatcccacggcccc

SEQ ID NO: 174566 - DNA, 25 bp, Homo sapien
ccgccatatgactccattcagatat

SEQ ID NO: 174567 - DNA, 25 bp, Homo sapien
gactccattcagatatatggctatg

SEQ ID NO: 174568 - DNA, 25 bp, Homo sapien
atatggctatgaaggccgagggtca

SEQ ID NO: 174569 - DNA, 25 bp, Homo sapien
ttggagtccaccacatcagactcag

SEQ ID NO: 174570 - DNA, 25 bp, Homo sapien
acatcagactcagaccagaattttg

SEQ ID NO: 174571 - DNA, 25 bp, Homo sapien
ggtccccgctttaagagactgggcg

SEQ ID NO: 174572 - DNA, 25 bp, Homo sapien
gagactgggcgaactctactctgtt

SEQ ID NO: 174573 - DNA, 25 bp, Homo sapien
ggcgaactctactctgttggtgaaa

SEQ ID NO: 174574 - DNA, 25 bp, Homo sapien
tctactctgttggtgaaagtgacaa

SEQ ID NO: 174575 - DNA, 25 bp, Homo sapien
tctgtaatattctagggtcactccc

SEQ ID NO: 174576 - DNA, 25 bp, Homo sapien
tgagccggagctcatgccgaccttt

SEQ ID NO: 174577 - DNA, 25 bp, Homo sapien
tccgagggccagagcaagcgctgta

SEQ ID NO: 174578 - DNA, 25 bp, Homo sapien
gagggccagagcaagcgctgtaaac

SEQ ID NO: 174579 - DNA, 25 bp, Homo sapien
agagcaagcgctgtaaaccctgacg

SEQ ID NO: 174580 - DNA, 25 bp, Homo sapien
agcaagcgctgtaaaccctgacggt

SEQ ID NO: 174581 - DNA, 25 bp, Homo sapien
caagcgctgtaaaccctgacggtgg

SEQ ID NO: 174582 - DNA, 25 bp, Homo sapien
gctgtaaaccctgacggtgggcctg

SEQ ID NO: 174583 - DNA, 25 bp, Homo sapien
aaaccctgacggtgggcctggcaca

SEQ ID NO: 174584 - DNA, 25 bp, Homo sapien
tgtattcccacaccaggtcttccga

SEQ ID NO: 174585 - DNA, 25 bp, Homo sapien
aggagaagcccctaccctgtgagcc

SEQ ID NO: 174586 - DNA, 25 bp, Homo sapien
gaagcccctaccctgtgagccggag

SEQ ID NO: 174587 - DNA, 25 bp, Homo sapien
cattttacgtgaacaccaaatactg

SEQ ID NO: 174588 - DNA, 25 bp, Homo sapien
ttacgtgaacaccaaatactgattt

SEQ ID NO: 174589 - DNA, 25 bp, Homo sapien
cgtgaacaccaaatactgatttaaa

SEQ ID NO: 174590 - DNA, 25 bp, Homo sapien
ttactccctcgttcctgctcttctt

SEQ ID NO: 174591 - DNA, 25 bp, Homo sapien
gctcttcttctcttttcatactcac

SEQ ID NO: 174592 - DNA, 25 bp, Homo sapien
ttcttctcttttcatactcacacag

SEQ ID NO: 174593 - DNA, 25 bp, Homo sapien
tcttctcttttcatactcacacaga

SEQ ID NO: 174594 - DNA, 25 bp, Homo sapien
cttctcttttcatactcacacagac

SEQ ID NO: 174595 - DNA, 25 bp, Homo sapien
ctgcccctgggcataactgaatagg

SEQ ID NO: 174596 - DNA, 25 bp, Homo sapien
gcccctgggcataactgaataggaa

SEQ ID NO: 174597 - DNA, 25 bp, Homo sapien
cctgggcataactgaataggaaatg

SEQ ID NO: 174598 - DNA, 25 bp, Homo sapien
cagggcgacagcattctgtgccgct

SEQ ID NO: 174599 - DNA, 25 bp, Homo sapien
gcgacagcattctgtgccgctgagc

SEQ ID NO: 174600 - DNA, 25 bp, Homo sapien
ctgtccaggtgtgcggccgcctgag

SEQ ID NO: 174601 - DNA, 25 bp, Homo sapien
gagcccgagccaggagcactagaga

SEQ ID NO: 174602 - DNA, 25 bp, Homo sapien
tcggccaacctagaaacgttttcat

SEQ ID NO: 174603 - DNA, 25 bp, Homo sapien
gaaacgttttcattcgtcattccaa

SEQ ID NO: 174604 - DNA, 25 bp, Homo sapien
gttttcattcgtcattccaagagag

SEQ ID NO: 174605 - DNA, 25 bp, Homo sapien
cattcgtcattccaagagagagaga

SEQ ID NO: 174606 - DNA, 25 bp, Homo sapien
acaactttcattctttctttgcacg

SEQ ID NO: 174607 - DNA, 25 bp, Homo sapien
tttcattctttctttgcacgttcat

SEQ ID NO: 174608 - DNA, 25 bp, Homo sapien
tctttctttgcacgttcataaacat

SEQ ID NO: 174609 - DNA, 25 bp, Homo sapien
aaatgaaagctatgggactcttgga

SEQ ID NO: 174610 - DNA, 25 bp, Homo sapien
gactcttggaggatacccagtgtct

SEQ ID NO: 174611 - DNA, 25 bp, Homo sapien
cagtgtctattctgggttagagaag

SEQ ID NO: 174612 - DNA, 25 bp, Homo sapien
cagccctaggagtctgcgagagcct

SEQ ID NO: 174613 - DNA, 25 bp, Homo sapien
gagtctgcgagagcctccttggttc

SEQ ID NO: 174614 - DNA, 25 bp, Homo sapien
tccttggttccatcgtgaagccata

SEQ ID NO: 174615 - DNA, 25 bp, Homo sapien
tgaagccataaacaggaatgccttt

SEQ ID NO: 174616 - DNA, 25 bp, Homo sapien
aatgcctttggcaatagccttgagc

SEQ ID NO: 174617 - DNA, 25 bp, Homo sapien
atagccttgagcctagagggccctc

SEQ ID NO: 174618 - DNA, 25 bp, Homo sapien
ccccactgaggtgctgttggtttat

SEQ ID NO: 174619 - DNA, 25 bp, Homo sapien
attgctggcaacgtgaattctctca

SEQ ID NO: 174620 - DNA, 25 bp, Homo sapien
tatggagttaccaatattgccaagt

SEQ ID NO: 174621 - DNA, 25 bp, Homo sapien
attgccaagtagactcactccttaa

SEQ ID NO: 174622 - DNA, 25 bp, Homo sapien
tttatggatatctacaagctgctta

SEQ ID NO: 174623 - DNA, 25 bp, Homo sapien
aagctgcttattaccagcaggaggg

SEQ ID NO: 174624 - DNA, 25 bp, Homo sapien
agcaggagggaaacacacttcacac

SEQ ID NO: 174625 - DNA, 25 bp, Homo sapien
ggcttatcagaaacctaccagatga

SEQ ID NO: 174626 - DNA, 25 bp, Homo sapien
catctggatatcttgtcacattttt

SEQ ID NO: 174627 - DNA, 25 bp, Homo sapien
gtgactgctttcaacatatacttca

SEQ ID NO: 174628 - DNA, 25 bp, Homo sapien
cttcatgtgtaattatagcttagac

SEQ ID NO: 174629 - DNA, 25 bp, Homo sapien
tagcttagactttagccttcttgga

SEQ ID NO: 174630 - DNA, 25 bp, Homo sapien
ttagactttagccttcttggacttc

SEQ ID NO: 174631 - DNA, 25 bp, Homo sapien
ctgctaatgctgtacaggggctctt

SEQ ID NO: 174632 - DNA, 25 bp, Homo sapien
tgctaatgctgtacaggggctcttg

SEQ ID NO: 174633 - DNA, 25 bp, Homo sapien
gctaatgctgtacaggggctcttgg

SEQ ID NO: 174634 - DNA, 25 bp, Homo sapien
gggttcggctcagctcaacatggct

SEQ ID NO: 174635 - DNA, 25 bp, Homo sapien
catggtgggcacactggcgcccagt

SEQ ID NO: 174636 - DNA, 25 bp, Homo sapien
tggtgggcacactggcgcccagtaa

SEQ ID NO: 174637 - DNA, 25 bp, Homo sapien
ggtgggcacactggcgcccagtaag

SEQ ID NO: 174638 - DNA, 25 bp, Homo sapien
gtgggcacactggcgcccagtaaga

SEQ ID NO: 174639 - DNA, 25 bp, Homo sapien
cacactggcgcccagtaagagagag

SEQ ID NO: 174640 - DNA, 25 bp, Homo sapien
acactggcgcccagtaagagagaga

SEQ ID NO: 174641 - DNA, 25 bp, Homo sapien
cactggcgcccagtaagagagagag

SEQ ID NO: 174642 - DNA, 25 bp, Homo sapien
caaatagatgctgggttatgagaac

SEQ ID NO: 174643 - DNA, 25 bp, Homo sapien
ggttatgagaaccagcgaaatcccc

SEQ ID NO: 174644 - DNA, 25 bp, Homo sapien
tatttgtcccattcttggagtagtt

SEQ ID NO: 174645 - DNA, 25 bp, Homo sapien
atgtctttacattaactactaacag

SEQ ID NO: 174646 - DNA, 25 bp, Homo sapien
gtataaataacttgacatcgtaatt

SEQ ID NO: 174647 - DNA, 25 bp, Homo sapien
atcgtaattgtctgcatcctgtcct

SEQ ID NO: 174648 - DNA, 25 bp, Homo sapien
tgcatcctgtccttgatatttttag

SEQ ID NO: 174649 - DNA, 25 bp, Homo sapien
gtccttgatatttttagcagttcca

SEQ ID NO: 174650 - DNA, 25 bp, Homo sapien
tagcagttccaaatctttgtttttg

SEQ ID NO: 174651 - DNA, 25 bp, Homo sapien
gtttgctgtgttcatgggcaaagta

SEQ ID NO: 174652 - DNA, 25 bp, Homo sapien
gtgttcatgggcaaagtaagtactt

SEQ ID NO: 174653 - DNA, 25 bp, Homo sapien
tgcacctgcacctttgttgaattgt

SEQ ID NO: 174654 - DNA, 25 bp, Homo sapien
aattgtggtagcttaggaggatgtc

SEQ ID NO: 174655 - DNA, 25 bp, Homo sapien
ggcaagaactctgggcttgggtaat

SEQ ID NO: 174656 - DNA, 25 bp, Homo sapien
ttttctgatcttaagcccagctctg

SEQ ID NO: 174657 - DNA, 25 bp, Homo sapien
tttcctctgtttgatactataaatt

SEQ ID NO: 174658 - DNA, 25 bp, Homo sapien
tataaattttctggttcccttggat

SEQ ID NO: 174659 - DNA, 25 bp, Homo sapien
gatttagggatagtgtccctctcca

SEQ ID NO: 174660 - DNA, 25 bp, Homo sapien
tagggatagtgtccctctccatgtc

SEQ ID NO: 174661 - DNA, 25 bp, Homo sapien
tctccatgtccaggaaacttgtaac

SEQ ID NO: 174662 - DNA, 25 bp, Homo sapien
ttgtaaccacccttttctaacagca

SEQ ID NO: 174663 - DNA, 25 bp, Homo sapien
aacagcaataaagaggtgtccttgt

SEQ ID NO: 174664 - DNA, 25 bp, Homo sapien
ttctttttccattggctgaagctct

SEQ ID NO: 174665 - DNA, 25 bp, Homo sapien
ggctgaagctctttgcaattcctat

SEQ ID NO: 174666 - DNA, 25 bp, Homo sapien
gcaattcctattctgttaatcgctg

SEQ ID NO: 174667 - DNA, 25 bp, Homo sapien
taatcgctgttttccttgtgttgac

SEQ ID NO: 174668 - DNA, 25 bp, Homo sapien
gttttccttgtgttgacctaatcat

SEQ ID NO: 174669 - DNA, 25 bp, Homo sapien
gacctaatcatcattttctctagga

SEQ ID NO: 174670 - DNA, 25 bp, Homo sapien
acaccacctgcttttctattcagca

SEQ ID NO: 174671 - DNA, 25 bp, Homo sapien
ttgcagtactctgtagacattagtc

SEQ ID NO: 174672 - DNA, 25 bp, Homo sapien
aatacagtgttatttctaggctctg

SEQ ID NO: 174673 - DNA, 25 bp, Homo sapien
ttctaggctctgaaatagccacttt

SEQ ID NO: 174674 - DNA, 25 bp, Homo sapien
agccactttaagaatcatgtcatga

SEQ ID NO: 174675 - DNA, 25 bp, Homo sapien
agaagtcagcagcaaccatgtcttg

SEQ ID NO: 174676 - DNA, 25 bp, Homo sapien
aaccatgtcttgatttaccttgata

SEQ ID NO: 174677 - DNA, 25 bp, Homo sapien
tcagacactgagcttgttcttcacg

SEQ ID NO: 174678 - DNA, 25 bp, Homo sapien
gagcttgttcttcacggttctgcaa

SEQ ID NO: 174679 - DNA, 25 bp, Homo sapien
tcttcacggttctgcaagatgtccc

SEQ ID NO: 174680 - DNA, 25 bp, Homo sapien
gatgtcccagtaagagatctcaaac

SEQ ID NO: 174681 - DNA, 25 bp, Homo sapien
gatctcaaaccagccatagtgaaag

SEQ ID NO: 174682 - DNA, 25 bp, Homo sapien
tgattactacgagacggatgagttt

SEQ ID NO: 174683 - DNA, 25 bp, Homo sapien
ggatgagtttgcaatcgctgagtac

SEQ ID NO: 174684 - DNA, 25 bp, Homo sapien
tcgctgagtacaatgctccttgcag

SEQ ID NO: 174685 - DNA, 25 bp, Homo sapien
gctccttgcagcaaagatcttggaa

SEQ ID NO: 174686 - DNA, 25 bp, Homo sapien
aggagggctatgagctcccctacaa

SEQ ID NO: 174687 - DNA, 25 bp, Homo sapien
tacaaccctgccactgatgactacg

SEQ ID NO: 174688 - DNA, 25 bp, Homo sapien
tgccactgatgactacgctgtgcca

SEQ ID NO: 174689 - DNA, 25 bp, Homo sapien
cctgaacctggtactgcaactggca

SEQ ID NO: 174690 - DNA, 25 bp, Homo sapien
tgcaactggcagtggcatcaaaagc

SEQ ID NO: 174691 - DNA, 25 bp, Homo sapien
tcaaaagccacaactcagccctgta

SEQ ID NO: 174692 - DNA, 25 bp, Homo sapien
tgtacagccaggtccagaagagcgg

SEQ ID NO: 174693 - DNA, 25 bp, Homo sapien
ggctctctagagtagggactgacaa

SEQ ID NO: 174694 - DNA, 25 bp, Homo sapien
agggcctttatgatctgcctcggga

SEQ ID NO: 174695 - DNA, 25 bp, Homo sapien
cctcgggagcccaaggatgcatggt

SEQ ID NO: 174696 - DNA, 25 bp, Homo sapien
aaggatgcatggtggtgccaagctc

SEQ ID NO: 174697 - DNA, 25 bp, Homo sapien
aactgcttcaagtgttacctaacaa

SEQ ID NO: 174698 - DNA, 25 bp, Homo sapien
atgtcatttcatacaaattttccca

SEQ ID NO: 174699 - DNA, 25 bp, Homo sapien
ggaaactctccatgattattagaag

SEQ ID NO: 174700 - DNA, 25 bp, Homo sapien
gaagaccaactatattgcgagaaac

SEQ ID NO: 174701 - DNA, 25 bp, Homo sapien
gagatcataaagagcacgttttcca

SEQ ID NO: 174702 - DNA, 25 bp, Homo sapien
aaagagcacgttttccattatgagg

SEQ ID NO: 174703 - DNA, 25 bp, Homo sapien
tgaggaaacttggacatttatgtac

SEQ ID NO: 174704 - DNA, 25 bp, Homo sapien
ttgataattcttactgttctgaaat

SEQ ID NO: 174705 - DNA, 25 bp, Homo sapien
gaaagtacttgcatgatcttacacg

SEQ ID NO: 174706 - DNA, 25 bp, Homo sapien
gtacttgcatgatcttacacgaaga

SEQ ID NO: 174707 - DNA, 25 bp, Homo sapien
taggcaaacttttatgtaggcagat

SEQ ID NO: 174708 - DNA, 25 bp, Homo sapien
acagccctctcaccctggtactgca

SEQ ID NO: 174709 - DNA, 25 bp, Homo sapien
agccctctcaccctggtactgcatg

SEQ ID NO: 174710 - DNA, 25 bp, Homo sapien
gccctctcaccctggtactgcatgc

SEQ ID NO: 174711 - DNA, 25 bp, Homo sapien
ccctctcaccctggtactgcatgca

SEQ ID NO: 174712 - DNA, 25 bp, Homo sapien
cctctcaccctggtactgcatgcac

SEQ ID NO: 174713 - DNA, 25 bp, Homo sapien
ctctcaccctggtactgcatgcacg

SEQ ID NO: 174714 - DNA, 25 bp, Homo sapien
tctcaccctggtactgcatgcacgc

SEQ ID NO: 174715 - DNA, 25 bp, Homo sapien
ctcaccctggtactgcatgcacgca

SEQ ID NO: 174716 - DNA, 25 bp, Homo sapien
ctagctgcccctttcccgtcctggg

SEQ ID NO: 174717 - DNA, 25 bp, Homo sapien
agctgcccctttcccgtcctgggca

SEQ ID NO: 174718 - DNA, 25 bp, Homo sapien
ttcccgtcctgggcaccccgagtct

SEQ ID NO: 174719 - DNA, 25 bp, Homo sapien
tccgcctcaatgcagaaccagtagt

SEQ ID NO: 174720 - DNA, 25 bp, Homo sapien
aaccagtagtgggagcactgtgttt

SEQ ID NO: 174721 - DNA, 25 bp, Homo sapien
gagcactgtgtttagagttaagagt

SEQ ID NO: 174722 - DNA, 25 bp, Homo sapien
gaacactgtttgattttacttggaa

SEQ ID NO: 174723 - DNA, 25 bp, Homo sapien
cttggaatttcctctgttatatagc

SEQ ID NO: 174724 - DNA, 25 bp, Homo sapien
ctctgttatatagcttttcccaatg

SEQ ID NO: 174725 - DNA, 25 bp, Homo sapien
gcttttcccaatgctaatttccaaa

SEQ ID NO: 174726 - DNA, 25 bp, Homo sapien
catgtttgcctgttaagttgtataa

SEQ ID NO: 174727 - DNA, 25 bp, Homo sapien
attactgttacatatactgcttgca

SEQ ID NO: 174728 - DNA, 25 bp, Homo sapien
catatactgcttgcaatttctgtat

SEQ ID NO: 174729 - DNA, 25 bp, Homo sapien
ttctgtatttattgttctctggaaa

SEQ ID NO: 174730 - DNA, 25 bp, Homo sapien
gaactacatccaaatacctgaattt

SEQ ID NO: 174731 - DNA, 25 bp, Homo sapien
ttggaatctgtttcatggatttttc

SEQ ID NO: 174732 - DNA, 25 bp, Homo sapien
tggatttttcatcttctaccgtatg

SEQ ID NO: 174733 - DNA, 25 bp, Homo sapien
ctaccgtatgtgaaattgcaagtgt

SEQ ID NO: 174734 - DNA, 25 bp, Homo sapien
gggaacatacaaatcttttaggtag

SEQ ID NO: 174735 - DNA, 25 bp, Homo sapien
gtaactgagtgttctcttgtttctt

SEQ ID NO: 174736 - DNA, 25 bp, Homo sapien
ctcttgtttctttgcattaatgtaa

SEQ ID NO: 174737 - DNA, 25 bp, Homo sapien
gtaactgtgtggtttgcctttgtcc

SEQ ID NO: 174738 - DNA, 25 bp, Homo sapien
cccctggatagaacgtgcatttaaa

SEQ ID NO: 174739 - DNA, 25 bp, Homo sapien
tatattgtacttactgtgacagcag

SEQ ID NO: 174740 - DNA, 25 bp, Homo sapien
agcagataataaaccagtctcttgg

SEQ ID NO: 174741 - DNA, 25 bp, Homo sapien
aagaagcctagggtgctcatgcctt

SEQ ID NO: 174742 - DNA, 25 bp, Homo sapien
ggtgctcatgccttacctaagagaa

SEQ ID NO: 174743 - DNA, 25 bp, Homo sapien
aagagaagaggctggccaagccaca

SEQ ID NO: 174744 - DNA, 25 bp, Homo sapien
aagccacagttctgacgctgacaat

SEQ ID NO: 174745 - DNA, 25 bp, Homo sapien
taatcctcactgttccttcttgagt

SEQ ID NO: 174746 - DNA, 25 bp, Homo sapien
gatctttgacataggttcttctata

SEQ ID NO: 174747 - DNA, 25 bp, Homo sapien
gatgatctcattcagaagatgctta

SEQ ID NO: 174748 - DNA, 25 bp, Homo sapien
agatgcttagctgtagtttccgctt

SEQ ID NO: 174749 - DNA, 25 bp, Homo sapien
gtagtttccgctttgcttgcttgtt

SEQ ID NO: 174750 - DNA, 25 bp, Homo sapien
aactaaagtgcttgaggctacctct

SEQ ID NO: 174751 - DNA, 25 bp, Homo sapien
gaggctacctctaccttcaaataaa

SEQ ID NO: 174752 - DNA, 25 bp, Homo sapien
gcagacacgagtggtcgggagactt

SEQ ID NO: 174753 - DNA, 25 bp, Homo sapien
cagacacgagtggtcgggagacttc

SEQ ID NO: 174754 - DNA, 25 bp, Homo sapien
agacacgagtggtcgggagacttca

SEQ ID NO: 174755 - DNA, 25 bp, Homo sapien
gacacgagtggtcgggagacttcag

SEQ ID NO: 174756 - DNA, 25 bp, Homo sapien
aatacccagacaggggctttgctat

SEQ ID NO: 174757 - DNA, 25 bp, Homo sapien
atacccagacaggggctttgctatt

SEQ ID NO: 174758 - DNA, 25 bp, Homo sapien
tacccagacaggggctttgctattt

SEQ ID NO: 174759 - DNA, 25 bp, Homo sapien
acccagacaggggctttgctattta

SEQ ID NO: 174760 - DNA, 25 bp, Homo sapien
cccagacaggggctttgctatttaa

SEQ ID NO: 174761 - DNA, 25 bp, Homo sapien
cccttttacatactgctgtctatgt

SEQ ID NO: 174762 - DNA, 25 bp, Homo sapien
actgctgtctatgtggctgtatctt

SEQ ID NO: 174763 - DNA, 25 bp, Homo sapien
ctgtctatgtggctgtatcttgttt

SEQ ID NO: 174764 - DNA, 25 bp, Homo sapien
ctgtatcttgtttttccactactgc

SEQ ID NO: 174765 - DNA, 25 bp, Homo sapien
tgtttttccactactgctaccacaa

SEQ ID NO: 174766 - DNA, 25 bp, Homo sapien
ccactactgctaccacaactatatt

SEQ ID NO: 174767 - DNA, 25 bp, Homo sapien
tcatgcaaatgctgtattcttcttt

SEQ ID NO: 174768 - DNA, 25 bp, Homo sapien
aatatcgacacagtgctttccgtgg

SEQ ID NO: 174769 - DNA, 25 bp, Homo sapien
tgctttccgtggcactgcatacaat

SEQ ID NO: 174770 - DNA, 25 bp, Homo sapien
ccgtggcactgcatacaatctgagg

SEQ ID NO: 174771 - DNA, 25 bp, Homo sapien
actgcatacaatctgaggcctcctc

SEQ ID NO: 174772 - DNA, 25 bp, Homo sapien
agtcctgtttctttaatgaaacact

SEQ ID NO: 174773 - DNA, 25 bp, Homo sapien
gaaacactttggattgtcagtgctg

SEQ ID NO: 174774 - DNA, 25 bp, Homo sapien
cactttggattgtcagtgctgaagt

SEQ ID NO: 174775 - DNA, 25 bp, Homo sapien
aagaatgtgctgtacattcggcaaa

SEQ ID NO: 174776 - DNA, 25 bp, Homo sapien
tgtgctgtacattcggcaaatagaa

SEQ ID NO: 174777 - DNA, 25 bp, Homo sapien
gaaattcttccaaattagcatcaga

SEQ ID NO: 174778 - DNA, 25 bp, Homo sapien
ttagcatcagacattctggtagaaa

SEQ ID NO: 174779 - DNA, 25 bp, Homo sapien
aagccagttgaatgttatgtgtgtt

SEQ ID NO: 174780 - DNA, 25 bp, Homo sapien
atgtgtgttttctaaggtatgactg

SEQ ID NO: 174781 - DNA, 25 bp, Homo sapien
ctaaggtatgactgaaatgttttta

SEQ ID NO: 174782 - DNA, 25 bp, Homo sapien
atgtttttaggaaatgtcaatcact

SEQ ID NO: 174783 - DNA, 25 bp, Homo sapien
gatggtgacgcagaggacgtctcta

SEQ ID NO: 174784 - DNA, 25 bp, Homo sapien
gcagaggacgtctctatgccggtga

SEQ ID NO: 174785 - DNA, 25 bp, Homo sapien
caactacagctgagtccataggcca

SEQ ID NO: 174786 - DNA, 25 bp, Homo sapien
tacagctgagtccataggccagaaa

SEQ ID NO: 174787 - DNA, 25 bp, Homo sapien
gctgagtccataggccagaaagaca

SEQ ID NO: 174788 - DNA, 25 bp, Homo sapien
tccataggccagaaagacaataaat

SEQ ID NO: 174789 - DNA, 25 bp, Homo sapien
agttccagttgactgcagaggacat

SEQ ID NO: 174790 - DNA, 25 bp, Homo sapien
gatggcctagacagaaatctccact

SEQ ID NO: 174791 - DNA, 25 bp, Homo sapien
ggcctagacagaaatctccactatt

SEQ ID NO: 174792 - DNA, 25 bp, Homo sapien
gaaatctccactattttaacagtga

SEQ ID NO: 174793 - DNA, 25 bp, Homo sapien
agccaccctaattatccatattcag

SEQ ID NO: 174794 - DNA, 25 bp, Homo sapien
agagccagggctgtccttagactcc

SEQ ID NO: 174795 - DNA, 25 bp, Homo sapien
aatcacgagatcttccttccgctct

SEQ ID NO: 174796 - DNA, 25 bp, Homo sapien
gagatcttccttccgctctgaggca

SEQ ID NO: 174797 - DNA, 25 bp, Homo sapien
cctcggagcctgtgttagtgtctgt

SEQ ID NO: 174798 - DNA, 25 bp, Homo sapien
gagcctgtgttagtgtctgtccatc

SEQ ID NO: 174799 - DNA, 25 bp, Homo sapien
tgtgttagtgtctgtccatctgtct

SEQ ID NO: 174800 - DNA, 25 bp, Homo sapien
agggccagggttgcggtcgcggctg

SEQ ID NO: 174801 - DNA, 25 bp, Homo sapien
agcgtctgcgcggatgtagcatgtt

SEQ ID NO: 174802 - DNA, 25 bp, Homo sapien
tctgcgcggatgtagcatgttctat

SEQ ID NO: 174803 - DNA, 25 bp, Homo sapien
gatgtagcatgttctatgtgttttt

SEQ ID NO: 174804 - DNA, 25 bp, Homo sapien
tttaaacgaagatccgagcgacggc

SEQ ID NO: 174805 - DNA, 25 bp, Homo sapien
aagaatgtgccctacgtgtttgtgc

SEQ ID NO: 174806 - DNA, 25 bp, Homo sapien
gccctacgtgtttgtgcgctccaag

SEQ ID NO: 174807 - DNA, 25 bp, Homo sapien
gggtctccaggcctgtcatcgcctg

SEQ ID NO: 174808 - DNA, 25 bp, Homo sapien
tcgcctgttctgtcaccatcaaaga

SEQ ID NO: 174809 - DNA, 25 bp, Homo sapien
accatcaaagaaggctcgcagctga

SEQ ID NO: 174810 - DNA, 25 bp, Homo sapien
gaaacagcagatccaatccattcag

SEQ ID NO: 174811 - DNA, 25 bp, Homo sapien
gatccaatccattcagcagtccatt

SEQ ID NO: 174812 - DNA, 25 bp, Homo sapien
gcagtccattgaaaggctcttagtc

SEQ ID NO: 174813 - DNA, 25 bp, Homo sapien
tcttagtctaaacctgtggcctctg

SEQ ID NO: 174814 - DNA, 25 bp, Homo sapien
ggttgtgtatcatattatctgtgtt

SEQ ID NO: 174815 - DNA, 25 bp, Homo sapien
tagcatgtagtattttcagctactc

SEQ ID NO: 174816 - DNA, 25 bp, Homo sapien
ccatcgtgaaagagtagccggcttc

SEQ ID NO: 174817 - DNA, 25 bp, Homo sapien
catcgtgaaagagtagccggcttca

SEQ ID NO: 174818 - DNA, 25 bp, Homo sapien
atcgtgaaagagtagccggcttcag

SEQ ID NO: 174819 - DNA, 25 bp, Homo sapien
tcgtgaaagagtagccggcttcagt

SEQ ID NO: 174820 - DNA, 25 bp, Homo sapien
cgtgaaagagtagccggcttcagtg

SEQ ID NO: 174821 - DNA, 25 bp, Homo sapien
aagagtagccggcttcagtgcctgc

SEQ ID NO: 174822 - DNA, 25 bp, Homo sapien
agagtagccggcttcagtgcctgcc

SEQ ID NO: 174823 - DNA, 25 bp, Homo sapien
gagtagccggcttcagtgcctgcct

SEQ ID NO: 174824 - DNA, 25 bp, Homo sapien
agtagccggcttcagtgcctgcctt

SEQ ID NO: 174825 - DNA, 25 bp, Homo sapien
gtagccggcttcagtgcctgccttg

SEQ ID NO: 174826 - DNA, 25 bp, Homo sapien
agccggcttcagtgcctgccttggg

SEQ ID NO: 174827 - DNA, 25 bp, Homo sapien
ttacagggatgtttttaatcccact

SEQ ID NO: 174828 - DNA, 25 bp, Homo sapien
acagggatgtttttaatcccactat

SEQ ID NO: 174829 - DNA, 25 bp, Homo sapien
ggatgtttttaatcccactatggac

SEQ ID NO: 174830 - DNA, 25 bp, Homo sapien
gatgtttttaatcccactatggact

SEQ ID NO: 174831 - DNA, 25 bp, Homo sapien
gtttttaatcccactatggactcag

SEQ ID NO: 174832 - DNA, 25 bp, Homo sapien
tttttaatcccactatggactcagt

SEQ ID NO: 174833 - DNA, 25 bp, Homo sapien
ttttaatcccactatggactcagtc

SEQ ID NO: 174834 - DNA, 25 bp, Homo sapien
tttaatcccactatggactcagtct

SEQ ID NO: 174835 - DNA, 25 bp, Homo sapien
ttaatcccactatggactcagtctc

SEQ ID NO: 174836 - DNA, 25 bp, Homo sapien
gcctgctagggaaaactgctcctca

SEQ ID NO: 174837 - DNA, 25 bp, Homo sapien
gctagggaaaactgctcctcattat

SEQ ID NO: 174838 - DNA, 25 bp, Homo sapien
gaaggcctggccagaatggagctct

SEQ ID NO: 174839 - DNA, 25 bp, Homo sapien
aaggcctggccagaatggagctctt

SEQ ID NO: 174840 - DNA, 25 bp, Homo sapien
aggcctggccagaatggagctcttt

SEQ ID NO: 174841 - DNA, 25 bp, Homo sapien
ggcctggccagaatggagctctttc

SEQ ID NO: 174842 - DNA, 25 bp, Homo sapien
gcctggccagaatggagctctttct

SEQ ID NO: 174843 - DNA, 25 bp, Homo sapien
ctggccagaatggagctctttctct

SEQ ID NO: 174844 - DNA, 25 bp, Homo sapien
tggccagaatggagctctttctctt

SEQ ID NO: 174845 - DNA, 25 bp, Homo sapien
ggccagaatggagctctttctcttc

SEQ ID NO: 174846 - DNA, 25 bp, Homo sapien
gccagaatggagctctttctcttct

SEQ ID NO: 174847 - DNA, 25 bp, Homo sapien
ccagaatggagctctttctcttctt

SEQ ID NO: 174848 - DNA, 25 bp, Homo sapien
cagaatggagctctttctcttcttc

SEQ ID NO: 174849 - DNA, 25 bp, Homo sapien
aagacctctggcatgaatatttcat

SEQ ID NO: 174850 - DNA, 25 bp, Homo sapien
ataaaatgacagatcccaccaggaa

SEQ ID NO: 174851 - DNA, 25 bp, Homo sapien
tgacagatcccaccaggaaggaagc

SEQ ID NO: 174852 - DNA, 25 bp, Homo sapien
ttttcctttgctccctgttgctgaa

SEQ ID NO: 174853 - DNA, 25 bp, Homo sapien
tttgctccctgttgctgaaaccata

SEQ ID NO: 174854 - DNA, 25 bp, Homo sapien
gttgctgaaaccatacagcttcata

SEQ ID NO: 174855 - DNA, 25 bp, Homo sapien
aaataattttgcttgctgaaggaag

SEQ ID NO: 174856 - DNA, 25 bp, Homo sapien
cataaacccattatccaggactgtt

SEQ ID NO: 174857 - DNA, 25 bp, Homo sapien
aggactgtttatagctgttggaagg

SEQ ID NO: 174858 - DNA, 25 bp, Homo sapien
tggaaggactaggtcttccctagcc

SEQ ID NO: 174859 - DNA, 25 bp, Homo sapien
agggcagtgaagacttgattgtaca

SEQ ID NO: 174860 - DNA, 25 bp, Homo sapien
gacccacccagatttgaccgttcag

SEQ ID NO: 174861 - DNA, 25 bp, Homo sapien
acccacccagatttgaccgttcagg

SEQ ID NO: 174862 - DNA, 25 bp, Homo sapien
cccacccagatttgaccgttcaggg

SEQ ID NO: 174863 - DNA, 25 bp, Homo sapien
cagatttgaccgttcagggggcctc

SEQ ID NO: 174864 - DNA, 25 bp, Homo sapien
tgctatccctcctcccatcctgtac

SEQ ID NO: 174865 - DNA, 25 bp, Homo sapien
gcctcatcactgtggaagacgggga

SEQ ID NO: 174866 - DNA, 25 bp, Homo sapien
gggaccaaccttgtctggtggatga

SEQ ID NO: 174867 - DNA, 25 bp, Homo sapien
ggaccaaccttgtctggtggatgag

SEQ ID NO: 174868 - DNA, 25 bp, Homo sapien
gaccaaccttgtctggtggatgaga

SEQ ID NO: 174869 - DNA, 25 bp, Homo sapien
ggatgagaaggcgtatttatttttc

SEQ ID NO: 174870 - DNA, 25 bp, Homo sapien
atgagaaggcgtatttatttttcac

SEQ ID NO: 174871 - DNA, 25 bp, Homo sapien
accacgggcaggactcactgaagga

SEQ ID NO: 174872 - DNA, 25 bp, Homo sapien
aggactcactgaaggagtttgtgca

SEQ ID NO: 174873 - DNA, 25 bp, Homo sapien
agtttgtgcagtttgtgtgctcgga

SEQ ID NO: 174874 - DNA, 25 bp, Homo sapien
tgcagtttgtgtgctcggatggctc

SEQ ID NO: 174875 - DNA, 25 bp, Homo sapien
atggctcgggccaggccaccggaca

SEQ ID NO: 174876 - DNA, 25 bp, Homo sapien
tgccaaccggtttgtcagcatcgga

SEQ ID NO: 174877 - DNA, 25 bp, Homo sapien
ggtttgtcagcatcggaccccggga

SEQ ID NO: 174878 - DNA, 25 bp, Homo sapien
ccgggacggcaactttctgaacatc

SEQ ID NO: 174879 - DNA, 25 bp, Homo sapien
aactttctgaacatcccacagcagt

SEQ ID NO: 174880 - DNA, 25 bp, Homo sapien
tgaacatcccacagcagtctcagtc

SEQ ID NO: 174881 - DNA, 25 bp, Homo sapien
gtctcagtcctggttcctctgataa

SEQ ID NO: 174882 - DNA, 25 bp, Homo sapien
gaacatgccctttcaggatggccaa

SEQ ID NO: 174883 - DNA, 25 bp, Homo sapien
tgccctttcaggatggccaagaatt

SEQ ID NO: 174884 - DNA, 25 bp, Homo sapien
gtaccaggtaatggtcaatggccaa

SEQ ID NO: 174885 - DNA, 25 bp, Homo sapien
atggtcaatggccaatcctcttaca

SEQ ID NO: 174886 - DNA, 25 bp, Homo sapien
tcctcttacacctttgaccatagaa

SEQ ID NO: 174887 - DNA, 25 bp, Homo sapien
ttgaccatagaatcaagcctgaggc

SEQ ID NO: 174888 - DNA, 25 bp, Homo sapien
atctccctgaccaaatttaatgtca

SEQ ID NO: 174889 - DNA, 25 bp, Homo sapien
gataaccagacttcatgttgccaag

SEQ ID NO: 174890 - DNA, 25 bp, Homo sapien
tgttgccaaggaatccctgtctcta

SEQ ID NO: 174891 - DNA, 25 bp, Homo sapien
gtctctacgtgaacttgggattcca

SEQ ID NO: 174892 - DNA, 25 bp, Homo sapien
acttcaatccttactcctgctcatt

SEQ ID NO: 174893 - DNA, 25 bp, Homo sapien
tgtgtaaccgacagtctgccctggg

SEQ ID NO: 174894 - DNA, 25 bp, Homo sapien
gtgtaaccgacagtctgccctgggc

SEQ ID NO: 174895 - DNA, 25 bp, Homo sapien
tgtaaccgacagtctgccctgggcc

SEQ ID NO: 174896 - DNA, 25 bp, Homo sapien
gtaaccgacagtctgccctgggcca

SEQ ID NO: 174897 - DNA, 25 bp, Homo sapien
agccctctcaccctggtactgcatg

SEQ ID NO: 174898 - DNA, 25 bp, Homo sapien
accctggtactgcatgcacgcaatg

SEQ ID NO: 174899 - DNA, 25 bp, Homo sapien
ggtactgcatgcacgcaatgctagc

SEQ ID NO: 174900 - DNA, 25 bp, Homo sapien
actgcatgcacgcaatgctagctgc

SEQ ID NO: 174901 - DNA, 25 bp, Homo sapien
atgcacgcaatgctagctgcccctt

SEQ ID NO: 174902 - DNA, 25 bp, Homo sapien
agctgcccctttcccgtcctgggca

SEQ ID NO: 174903 - DNA, 25 bp, Homo sapien
tcaccacctctgctagttccagaca

SEQ ID NO: 174904 - DNA, 25 bp, Homo sapien
ggagctgagggcaccacccagcaac

SEQ ID NO: 174905 - DNA, 25 bp, Homo sapien
gagctgagggcaccacccagcaacc

SEQ ID NO: 174906 - DNA, 25 bp, Homo sapien
agctgagggcaccacccagcaacct

SEQ ID NO: 174907 - DNA, 25 bp, Homo sapien
gctgagggcaccacccagcaacctg

SEQ ID NO: 174908 - DNA, 25 bp, Homo sapien
tgagggcaccacccagcaacctggg

SEQ ID NO: 174909 - DNA, 25 bp, Homo sapien
agcaacctgggcctgcattccatcc

SEQ ID NO: 174910 - DNA, 25 bp, Homo sapien
gcaacctgggcctgcattccatccg

SEQ ID NO: 174911 - DNA, 25 bp, Homo sapien
ctgggcctgcattccatccgctctg

SEQ ID NO: 174912 - DNA, 25 bp, Homo sapien
gggcctgcattccatccgctctgca

SEQ ID NO: 174913 - DNA, 25 bp, Homo sapien
gcctgcattccatccgctctgcagc

SEQ ID NO: 174914 - DNA, 25 bp, Homo sapien
gcattccatccgctctgcagcccca

SEQ ID NO: 174915 - DNA, 25 bp, Homo sapien
gtagaagttacacagcaatttagca

SEQ ID NO: 174916 - DNA, 25 bp, Homo sapien
cagacatacagaattgtgtgtgtgt

SEQ ID NO: 174917 - DNA, 25 bp, Homo sapien
tattttttatcacaagcacctttga

SEQ ID NO: 174918 - DNA, 25 bp, Homo sapien
agcacctttgaaatgtacgtggaaa

SEQ ID NO: 174919 - DNA, 25 bp, Homo sapien
tacgtggaaaacgtcggctgctcgt

SEQ ID NO: 174920 - DNA, 25 bp, Homo sapien
aaacgtcggctgctcgtgagaatca

SEQ ID NO: 174921 - DNA, 25 bp, Homo sapien
gctgctcgtgagaatcatgtgtgac

SEQ ID NO: 174922 - DNA, 25 bp, Homo sapien
aatcatgtgtgacttacgttcctta

SEQ ID NO: 174923 - DNA, 25 bp, Homo sapien
gtgtgacttacgttccttatgtttt

SEQ ID NO: 174924 - DNA, 25 bp, Homo sapien
ttttatggaactctcggaacagtgt

SEQ ID NO: 174925 - DNA, 25 bp, Homo sapien
gaactctcggaacagtgttttgttt

SEQ ID NO: 174926 - DNA, 25 bp, Homo sapien
gaattgtaatcatcaatctttcata

SEQ ID NO: 174927 - DNA, 25 bp, Homo sapien
gtaattattttctccccaacagtat

SEQ ID NO: 174928 - DNA, 25 bp, Homo sapien
tctccccaacagtattttccagtag

SEQ ID NO: 174929 - DNA, 25 bp, Homo sapien
gattctaatcatgtggtagggcaga

SEQ ID NO: 174930 - DNA, 25 bp, Homo sapien
atttgtttcttgtcaatagtcctga

SEQ ID NO: 174931 - DNA, 25 bp, Homo sapien
tgtcaatagtcctgattattttagc

SEQ ID NO: 174932 - DNA, 25 bp, Homo sapien
tttagctttgctatactgacttata

SEQ ID NO: 174933 - DNA, 25 bp, Homo sapien
tgctatactgacttatatctggaag

SEQ ID NO: 174934 - DNA, 25 bp, Homo sapien
atatgatcatcttaagctaattgta

SEQ ID NO: 174935 - DNA, 25 bp, Homo sapien
gaaaagaactaatggactgtcaata

SEQ ID NO: 174936 - DNA, 25 bp, Homo sapien
atggactgtcaatattcagaaaacc

SEQ ID NO: 174937 - DNA, 25 bp, Homo sapien
gaccacactcaactactgcgtatgg

SEQ ID NO: 174938 - DNA, 25 bp, Homo sapien
aactactgcgtatggcgggacaacc

SEQ ID NO: 174939 - DNA, 25 bp, Homo sapien
tatggcgggacaaccatggctggca

SEQ ID NO: 174940 - DNA, 25 bp, Homo sapien
cagcaggtgccatcacgcttgtgat

SEQ ID NO: 174941 - DNA, 25 bp, Homo sapien
atcacgcttgtgatgtggtggccgt

SEQ ID NO: 174942 - DNA, 25 bp, Homo sapien
tgtggtggccgtcacgctttcatga

SEQ ID NO: 174943 - DNA, 25 bp, Homo sapien
tttcatgaccactgggcctgctagt

SEQ ID NO: 174944 - DNA, 25 bp, Homo sapien
ctgctagtctgtcagggccttggcc

SEQ ID NO: 174945 - DNA, 25 bp, Homo sapien
gcagagcttcagaggttgccccacc

SEQ ID NO: 174946 - DNA, 25 bp, Homo sapien
acccgggagcagtgtcctgtgcttt

SEQ ID NO: 174947 - DNA, 25 bp, Homo sapien
tgtcctgtgctttctgcatgcttag

SEQ ID NO: 174948 - DNA, 25 bp, Homo sapien
gggcattccccgtaagaggcagtga

SEQ ID NO: 174949 - DNA, 25 bp, Homo sapien
cagtgagatgtagcctggccctgga

SEQ ID NO: 174950 - DNA, 25 bp, Homo sapien
ggctgctgtgctgtgcctagatgca

SEQ ID NO: 174951 - DNA, 25 bp, Homo sapien
gtgctgtgcctagatgcacgatgct

SEQ ID NO: 174952 - DNA, 25 bp, Homo sapien
gggtcaaagacttgtgtccccgcct

SEQ ID NO: 174953 - DNA, 25 bp, Homo sapien
agggctcccgagtcatcgactcagg

SEQ ID NO: 174954 - DNA, 25 bp, Homo sapien
catcgactcaggcagacagcaggct

SEQ ID NO: 174955 - DNA, 25 bp, Homo sapien
ttctgtctgtagagccgcatggcac

SEQ ID NO: 174956 - DNA, 25 bp, Homo sapien
tctgtagagccgcatggcactcttc

SEQ ID NO: 174957 - DNA, 25 bp, Homo sapien
acagccaaggtagggtcactaacca

SEQ ID NO: 174958 - DNA, 25 bp, Homo sapien
gggtcactaaccaagccagaaacgt

SEQ ID NO: 174959 - DNA, 25 bp, Homo sapien
gaactaaacagtcgcttggaagaga

SEQ ID NO: 174960 - DNA, 25 bp, Homo sapien
gactaatcagatggctgctaccatt

SEQ ID NO: 174961 - DNA, 25 bp, Homo sapien
ggctgctaccattaaacaacttgaa

SEQ ID NO: 174962 - DNA, 25 bp, Homo sapien
agtcctgtttctttaatgaaacact

SEQ ID NO: 174963 - DNA, 25 bp, Homo sapien
aacactttggattgtcagtgctgaa

SEQ ID NO: 174964 - DNA, 25 bp, Homo sapien
atgtgctgtacattcggcaaataga

SEQ ID NO: 174965 - DNA, 25 bp, Homo sapien
gaaattcttccaaattagcatcaga

SEQ ID NO: 174966 - DNA, 25 bp, Homo sapien
ttagcatcagacattctggtagaaa

SEQ ID NO: 174967 - DNA, 25 bp, Homo sapien
aagccagttgaatgttatgtgtgtt

SEQ ID NO: 174968 - DNA, 25 bp, Homo sapien
atgtgtgttttctaaggtatgactg

SEQ ID NO: 174969 - DNA, 25 bp, Homo sapien
atgtttttaggaaatgtcaatcact

SEQ ID NO: 174970 - DNA, 25 bp, Homo sapien
catcctacgaggtcacactttgttt

SEQ ID NO: 174971 - DNA, 25 bp, Homo sapien
tcctacgaggtcacactttgttttc

SEQ ID NO: 174972 - DNA, 25 bp, Homo sapien
cactttgttttcacataatcggata

SEQ ID NO: 174973 - DNA, 25 bp, Homo sapien
tatgaagccagccataaagcccagg

SEQ ID NO: 174974 - DNA, 25 bp, Homo sapien
agccagccataaagcccaggatgac

SEQ ID NO: 174975 - DNA, 25 bp, Homo sapien
gaatttgtttactatccttaatggt

SEQ ID NO: 174976 - DNA, 25 bp, Homo sapien
tatccttaatggtaagcatcacctt

SEQ ID NO: 174977 - DNA, 25 bp, Homo sapien
ggtaagcatcaccttaagcacatat

SEQ ID NO: 174978 - DNA, 25 bp, Homo sapien
aagcacatattatgccttgagacac

SEQ ID NO: 174979 - DNA, 25 bp, Homo sapien
ttatgccttgagacactagccaatt

SEQ ID NO: 174980 - DNA, 25 bp, Homo sapien
gacactagccaattgtggtacatga

SEQ ID NO: 174981 - DNA, 25 bp, Homo sapien
ctgtgcctacctctaagccaagatc

SEQ ID NO: 174982 - DNA, 25 bp, Homo sapien
acagtggacatctgctttatgctgg

SEQ ID NO: 174983 - DNA, 25 bp, Homo sapien
ggacatctgctttatgctggaccca

SEQ ID NO: 174984 - DNA, 25 bp, Homo sapien
atgctggacccagtaagatgaggaa

SEQ ID NO: 174985 - DNA, 25 bp, Homo sapien
ggaagaggagccaggcccttgtacc

SEQ ID NO: 174986 - DNA, 25 bp, Homo sapien
gagccaggcccttgtacctatggga

SEQ ID NO: 174987 - DNA, 25 bp, Homo sapien
gcccttgtacctatgggattggaca

SEQ ID NO: 174988 - DNA, 25 bp, Homo sapien
gctctggacctgcattaaaatgggt

SEQ ID NO: 174989 - DNA, 25 bp, Homo sapien
gcattaaaatgggtttcactgtgaa

SEQ ID NO: 174990 - DNA, 25 bp, Homo sapien
cgtgacaataagatattcccttgtt

SEQ ID NO: 174991 - DNA, 25 bp, Homo sapien
atcagtttattggatgtggtttttc

SEQ ID NO: 174992 - DNA, 25 bp, Homo sapien
aaacgtggctgcttcaaggatcctg

SEQ ID NO: 174993 - DNA, 25 bp, Homo sapien
aggatcctgagccagatttcactct

SEQ ID NO: 174994 - DNA, 25 bp, Homo sapien
agatttcactctccttggtgtcggg

SEQ ID NO: 174995 - DNA, 25 bp, Homo sapien
actctccttggtgtcgggcatgaca

SEQ ID NO: 174996 - DNA, 25 bp, Homo sapien
gggcatgacacgaatattgctgatg

SEQ ID NO: 174997 - DNA, 25 bp, Homo sapien
ttgctgatggtgcaatgacctttca

SEQ ID NO: 174998 - DNA, 25 bp, Homo sapien
ttccttcagtgccttatggaacact

SEQ ID NO: 174999 - DNA, 25 bp, Homo sapien
atggaacactctgagactcgcgaca

SEQ ID NO: 175000 - DNA, 25 bp, Homo sapien
gactcgcgacaatgcaaaccatcat

SEQ ID NO: 175001 - DNA, 25 bp, Homo sapien
atcattgaaatctttttgctttgct

SEQ ID NO: 175002 - DNA, 25 bp, Homo sapien
aaaatggacatgcatcaaacccttg

SEQ ID NO: 175003 - DNA, 25 bp, Homo sapien
gagttcagacttaggagtaaaacag

SEQ ID NO: 175004 - DNA, 25 bp, Homo sapien
tcagacttaggagtaaaacagaaaa

SEQ ID NO: 175005 - DNA, 25 bp, Homo sapien
agactaatcagatggctgctaccat

SEQ ID NO: 175006 - DNA, 25 bp, Homo sapien
gactaatcagatggctgctaccatt

SEQ ID NO: 175007 - DNA, 25 bp, Homo sapien
ctaatcagatggctgctaccattaa

SEQ ID NO: 175008 - DNA, 25 bp, Homo sapien
aatcagatggctgctaccattaaac

SEQ ID NO: 175009 - DNA, 25 bp, Homo sapien
tcagatggctgctaccattaaacaa

SEQ ID NO: 175010 - DNA, 25 bp, Homo sapien
gatggctgctaccattaaacaactt

SEQ ID NO: 175011 - DNA, 25 bp, Homo sapien
tggctgctaccattaaacaacttga

SEQ ID NO: 175012 - DNA, 25 bp, Homo sapien
ggctgctaccattaaacaacttgaa

SEQ ID NO: 175013 - DNA, 25 bp, Homo sapien
gctgctaccattaaacaacttgaac

SEQ ID NO: 175014 - DNA, 25 bp, Homo sapien
gtggatgggaataatcaaccctagt

SEQ ID NO: 175015 - DNA, 25 bp, Homo sapien
gggaataatcaaccctagtggtaat

SEQ ID NO: 175016 - DNA, 25 bp, Homo sapien
taatcaaccctagtggtaatagcac

SEQ ID NO: 175017 - DNA, 25 bp, Homo sapien
tcaaccctagtggtaatagcacaaa

SEQ ID NO: 175018 - DNA, 25 bp, Homo sapien
tggtaatagcacaaactacgcacag

SEQ ID NO: 175019 - DNA, 25 bp, Homo sapien
agggacacgtccacgagcacggtct

SEQ ID NO: 175020 - DNA, 25 bp, Homo sapien
gggacacgtccacgagcacggtcta

SEQ ID NO: 175021 - DNA, 25 bp, Homo sapien
gagagaaaaactcgcaactacgatt

SEQ ID NO: 175022 - DNA, 25 bp, Homo sapien
gagaaaaactcgcaactacgatttt

SEQ ID NO: 175023 - DNA, 25 bp, Homo sapien
aaactcgcaactacgatttttggag

SEQ ID NO: 175024 - DNA, 25 bp, Homo sapien
attataacggggatggactactggg

SEQ ID NO: 175025 - DNA, 25 bp, Homo sapien
tgctccagctgctaggcagtgtcag

SEQ ID NO: 175026 - DNA, 25 bp, Homo sapien
agctgctaggcagtgtcagccccaa

SEQ ID NO: 175027 - DNA, 25 bp, Homo sapien
agtgtcagccccaactctgtcaagc

SEQ ID NO: 175028 - DNA, 25 bp, Homo sapien
tcaagcccgagatggtggccgccta

SEQ ID NO: 175029 - DNA, 25 bp, Homo sapien
atggtggccgcctatcagggtgtcc

SEQ ID NO: 175030 - DNA, 25 bp, Homo sapien
tggccgcctatcagggtgtcctggt

SEQ ID NO: 175031 - DNA, 25 bp, Homo sapien
tggcgcgggccaaccggctgtgccg

SEQ ID NO: 175032 - DNA, 25 bp, Homo sapien
gaggagacggccagccactaccgca

SEQ ID NO: 175033 - DNA, 25 bp, Homo sapien
gccactaccgcatggctgccttgga

SEQ ID NO: 175034 - DNA, 25 bp, Homo sapien
ggctgccttggagcagtgcctgtca

SEQ ID NO: 175035 - DNA, 25 bp, Homo sapien
ccttggagcagtgcctgtcagagcc

SEQ ID NO: 175036 - DNA, 25 bp, Homo sapien
aaactacccaaatgactctatgttt

SEQ ID NO: 175037 - DNA, 25 bp, Homo sapien
aactacccaaatgactctatgtttg

SEQ ID NO: 175038 - DNA, 25 bp, Homo sapien
actacccaaatgactctatgtttgg

SEQ ID NO: 175039 - DNA, 25 bp, Homo sapien
caaatgactctatgtttgggaatgg

SEQ ID NO: 175040 - DNA, 25 bp, Homo sapien
actgggacgccacgccaagaatgga

SEQ ID NO: 175041 - DNA, 25 bp, Homo sapien
ggacgccacgccaagaatggactgc

SEQ ID NO: 175042 - DNA, 25 bp, Homo sapien
aagaatggactgcccaagagcccca

SEQ ID NO: 175043 - DNA, 25 bp, Homo sapien
agaatggactgcccaagagccccat

SEQ ID NO: 175044 - DNA, 25 bp, Homo sapien
actccagggacaagtccacgggcag

SEQ ID NO: 175045 - DNA, 25 bp, Homo sapien
tccagggacaagtccacgggcaggt

SEQ ID NO: 175046 - DNA, 25 bp, Homo sapien
agggacaagtccacgggcaggtctg

SEQ ID NO: 175047 - DNA, 25 bp, Homo sapien
gtcttcctgggaatcggtgtggcct

SEQ ID NO: 175048 - DNA, 25 bp, Homo sapien
tggcctggtccatcgctgccatcta

SEQ ID NO: 175049 - DNA, 25 bp, Homo sapien
tgccatctaccacgcagccaatggg

SEQ ID NO: 175050 - DNA, 25 bp, Homo sapien
ggaacagttcaaagtgtcccctggc

SEQ ID NO: 175051 - DNA, 25 bp, Homo sapien
tggcacactagctttctctgtcact

SEQ ID NO: 175052 - DNA, 25 bp, Homo sapien
ctcttcaccatttttgctttcatca

SEQ ID NO: 175053 - DNA, 25 bp, Homo sapien
gctgtatcggcggaggccagaaatc

SEQ ID NO: 175054 - DNA, 25 bp, Homo sapien
ttgtgctcctatggctcttgtacat

SEQ ID NO: 175055 - DNA, 25 bp, Homo sapien
atggctcttgtacattttcttctcc

SEQ ID NO: 175056 - DNA, 25 bp, Homo sapien
tacattttcttctcctccctggagg

SEQ ID NO: 175057 - DNA, 25 bp, Homo sapien
tggaggcctactgccacataaaagg

SEQ ID NO: 175058 - DNA, 25 bp, Homo sapien
aggtgtgccaggagagccagctcat

SEQ ID NO: 175059 - DNA, 25 bp, Homo sapien
agctcatctgcgagccttctttctt

SEQ ID NO: 175060 - DNA, 25 bp, Homo sapien
tgctgaagtacaaggtgacctgcca

SEQ ID NO: 175061 - DNA, 25 bp, Homo sapien
gtgacctgccaaagctcagagctgg

SEQ ID NO: 175062 - DNA, 25 bp, Homo sapien
tgccctcctttgaccctaagaataa

SEQ ID NO: 175063 - DNA, 25 bp, Homo sapien
gaccctaagaataagcactgtgtgt

SEQ ID NO: 175064 - DNA, 25 bp, Homo sapien
cactgtgtgtttcaaggtgacctcc

SEQ ID NO: 175065 - DNA, 25 bp, Homo sapien
aggtgacctcctgctcttcagctgt

SEQ ID NO: 175066 - DNA, 25 bp, Homo sapien
gggccaggtggctctctgcaaagac

SEQ ID NO: 175067 - DNA, 25 bp, Homo sapien
gtggctctctgcaaagactgcctat

SEQ ID NO: 175068 - DNA, 25 bp, Homo sapien
aagactgcctatagcagctacctgc

SEQ ID NO: 175069 - DNA, 25 bp, Homo sapien
atgctaatatcttaattctttgttc

SEQ ID NO: 175070 - DNA, 25 bp, Homo sapien
ttgtgagaactaattttgagggcat

SEQ ID NO: 175071 - DNA, 25 bp, Homo sapien
aactaattttgagggcatgaagctg

SEQ ID NO: 175072 - DNA, 25 bp, Homo sapien
aagctgcatatcatagatgacaaat

SEQ ID NO: 175073 - DNA, 25 bp, Homo sapien
gcaaatcatctgcattcctgatgac

SEQ ID NO: 175074 - DNA, 25 bp, Homo sapien
tctgcattcctgatgaccaatggga

SEQ ID NO: 175075 - DNA, 25 bp, Homo sapien
accaatgggatgaggtcactttttt

SEQ ID NO: 175076 - DNA, 25 bp, Homo sapien
ccttcgaaggattgtggaaaaccag

SEQ ID NO: 175077 - DNA, 25 bp, Homo sapien
aaaccaggaaaagggagctatgatt

SEQ ID NO: 175078 - DNA, 25 bp, Homo sapien
atatgattcacatgctaaagccagg

SEQ ID NO: 175079 - DNA, 25 bp, Homo sapien
tcacatgctaaagccaggattgtgt

SEQ ID NO: 175080 - DNA, 25 bp, Homo sapien
tacatctacagatattttcagggat

SEQ ID NO: 175081 - DNA, 25 bp, Homo sapien
tgaaaacaaatcacacaccgtttcc

SEQ ID NO: 175082 - DNA, 25 bp, Homo sapien
ttcccaaaccaacagtcttcacatt

SEQ ID NO: 175083 - DNA, 25 bp, Homo sapien
ttcacatttctatccctctgttatt

SEQ ID NO: 175084 - DNA, 25 bp, Homo sapien
tatccctctgttattgtcggcaggc

SEQ ID NO: 175085 - DNA, 25 bp, Homo sapien
aaaaccaccctgagtttctctggtg

SEQ ID NO: 175086 - DNA, 25 bp, Homo sapien
gagtttctctggtgacgccctcatt

SEQ ID NO: 175087 - DNA, 25 bp, Homo sapien
tcattctcctttcgttcaataactc

SEQ ID NO: 175088 - DNA, 25 bp, Homo sapien
tgagttgcagcaacagactgtatct

SEQ ID NO: 175089 - DNA, 25 bp, Homo sapien
agactgtatctttgtgacgccccgt

SEQ ID NO: 175090 - DNA, 25 bp, Homo sapien
gacgccccgtagtatgaatgtacat

SEQ ID NO: 175091 - DNA, 25 bp, Homo sapien
cctgctggcttggtagaagacagaa

SEQ ID NO: 175092 - DNA, 25 bp, Homo sapien
agaagacagaattcgatctgcctgt

SEQ ID NO: 175093 - DNA, 25 bp, Homo sapien
agaattcgatctgcctgtccctttt

SEQ ID NO: 175094 - DNA, 25 bp, Homo sapien
gggtttgacacacaggctcctctca

SEQ ID NO: 175095 - DNA, 25 bp, Homo sapien
gagcagtgaccaggacgcctctggc

SEQ ID NO: 175096 - DNA, 25 bp, Homo sapien
tgaccaggacgcctctggcccagtg

SEQ ID NO: 175097 - DNA, 25 bp, Homo sapien
gtcctcacaggccaggacgccatgg

SEQ ID NO: 175098 - DNA, 25 bp, Homo sapien
tcacaggccaggacgccatggcagg

SEQ ID NO: 175099 - DNA, 25 bp, Homo sapien
tttgtttcttgcctgacctcagttt

SEQ ID NO: 175100 - DNA, 25 bp, Homo sapien
tcttgcctgacctcagtttcatgaa

SEQ ID NO: 175101 - DNA, 25 bp, Homo sapien
aagtggaagctacagaattattttc

SEQ ID NO: 175102 - DNA, 25 bp, Homo sapien
taagcaggtgctggctcagggttca

SEQ ID NO: 175103 - DNA, 25 bp, Homo sapien
tcagggttcatcattctgccttgtc

SEQ ID NO: 175104 - DNA, 25 bp, Homo sapien
tcatcattctgccttgtccactggg

SEQ ID NO: 175105 - DNA, 25 bp, Homo sapien
gcagaccactctgacaagtcttcag

SEQ ID NO: 175106 - DNA, 25 bp, Homo sapien
tgacaagtcttcagcccacaccttg

SEQ ID NO: 175107 - DNA, 25 bp, Homo sapien
tgcacataagccataaccaatcctc

SEQ ID NO: 175108 - DNA, 25 bp, Homo sapien
ggaagccctggagcctgtgaagacc

SEQ ID NO: 175109 - DNA, 25 bp, Homo sapien
gtgaagaccctggaaacctcatgag

SEQ ID NO: 175110 - DNA, 25 bp, Homo sapien
cacagaccaggccttaaatgtcggt

SEQ ID NO: 175111 - DNA, 25 bp, Homo sapien
taaatgtcggtccaggccctgtgca

SEQ ID NO: 175112 - DNA, 25 bp, Homo sapien
ctgtgcaccttaccccagagacaga

SEQ ID NO: 175113 - DNA, 25 bp, Homo sapien
acccctgcctgacaagttccagttt

SEQ ID NO: 175114 - DNA, 25 bp, Homo sapien
atatcaatggcccagataccgtgca

SEQ ID NO: 175115 - DNA, 25 bp, Homo sapien
agataccgtgcacagcccaagaggc

SEQ ID NO: 175116 - DNA, 25 bp, Homo sapien
gattgtcaggagtcgaggaagctct

SEQ ID NO: 175117 - DNA, 25 bp, Homo sapien
gaagctctggatgcaaccatagcct

SEQ ID NO: 175118 - DNA, 25 bp, Homo sapien
gatgcaaccatagcctgggaggcat

SEQ ID NO: 175119 - DNA, 25 bp, Homo sapien
tccccggcccaggagtcgttggaag

SEQ ID NO: 175120 - DNA, 25 bp, Homo sapien
aggagtcgttggaagttatggcaca

SEQ ID NO: 175121 - DNA, 25 bp, Homo sapien
gttatggcacaggaagcatccctgg

SEQ ID NO: 175122 - DNA, 25 bp, Homo sapien
gagctggaggcagtgtatttgacac

SEQ ID NO: 175123 - DNA, 25 bp, Homo sapien
gcaggcacagtccacaggcagtgca

SEQ ID NO: 175124 - DNA, 25 bp, Homo sapien
tggctgctcagtttctgagtctggg

SEQ ID NO: 175125 - DNA, 25 bp, Homo sapien
taatgttctggaaggacatctgttc

SEQ ID NO: 175126 - DNA, 25 bp, Homo sapien
catctgttctttggtgtaatctctc

SEQ ID NO: 175127 - DNA, 25 bp, Homo sapien
gttctttggtgtaatctctcatggt

SEQ ID NO: 175128 - DNA, 25 bp, Homo sapien
tgtaatctctcatggtgaaatctgc

SEQ ID NO: 175129 - DNA, 25 bp, Homo sapien
aatctgctctgtacatcagacaatt

SEQ ID NO: 175130 - DNA, 25 bp, Homo sapien
acatcagacaattgcattgctacca

SEQ ID NO: 175131 - DNA, 25 bp, Homo sapien
gcattgctaccaagtttcataccaa

SEQ ID NO: 175132 - DNA, 25 bp, Homo sapien
gctaccaagtttcataccaaatatt

SEQ ID NO: 175133 - DNA, 25 bp, Homo sapien
tttttattaaactcatgggaaggct

SEQ ID NO: 175134 - DNA, 25 bp, Homo sapien
gaaggctaatatattccaacgtaaa

SEQ ID NO: 175135 - DNA, 25 bp, Homo sapien
ggttctgtgtgtttgtaatatgtct

SEQ ID NO: 175136 - DNA, 25 bp, Homo sapien
agaatctgagagcaatggtttttac

SEQ ID NO: 175137 - DNA, 25 bp, Homo sapien
gtttttacttctctgtgttaattgt

SEQ ID NO: 175138 - DNA, 25 bp, Homo sapien
gtaacttaagtttctgacctgtcgt

SEQ ID NO: 175139 - DNA, 25 bp, Homo sapien
gtttctgacctgtcgtacatttgtt

SEQ ID NO: 175140 - DNA, 25 bp, Homo sapien
tcgtacatttgtttgagtcgtttat

SEQ ID NO: 175141 - DNA, 25 bp, Homo sapien
gagtcgtttatgtactactgaactg

SEQ ID NO: 175142 - DNA, 25 bp, Homo sapien
gaactgtaccagttgcacatgcttg

SEQ ID NO: 175143 - DNA, 25 bp, Homo sapien
gttgcacatgcttgaactgtagtaa

SEQ ID NO: 175144 - DNA, 25 bp, Homo sapien
gttctaaagctatccattgtgtcat

SEQ ID NO: 175145 - DNA, 25 bp, Homo sapien
atccattgtgtcatatttactctaa

SEQ ID NO: 175146 - DNA, 25 bp, Homo sapien
cactgcaccgcctcagggttttggg

SEQ ID NO: 175147 - DNA, 25 bp, Homo sapien
agaactcccacaaccacatgtattt

SEQ ID NO: 175148 - DNA, 25 bp, Homo sapien
acatgtatttattcctctgtcctaa

SEQ ID NO: 175149 - DNA, 25 bp, Homo sapien
gggattctgagcagtgcctcttgtc

SEQ ID NO: 175150 - DNA, 25 bp, Homo sapien
gcagtgcctcttgtctgagggacat

SEQ ID NO: 175151 - DNA, 25 bp, Homo sapien
gggacatatcagtgacctcgacgtt

SEQ ID NO: 175152 - DNA, 25 bp, Homo sapien
ctcgacgttgcctttagactacagt

SEQ ID NO: 175153 - DNA, 25 bp, Homo sapien
gactacagttgtgttagcctcttgc

SEQ ID NO: 175154 - DNA, 25 bp, Homo sapien
ttgtgttagcctcttgcgtattggc

SEQ ID NO: 175155 - DNA, 25 bp, Homo sapien
gcgtattggctttttcagagtcatt

SEQ ID NO: 175156 - DNA, 25 bp, Homo sapien
gctttttcagagtcatttatgagca

SEQ ID NO: 175157 - DNA, 25 bp, Homo sapien
ttcagacttaaactgagccatgcta

SEQ ID NO: 175158 - DNA, 25 bp, Homo sapien
cagggtctccagcctacagatgagc

SEQ ID NO: 175159 - DNA, 25 bp, Homo sapien
gatgagctgttgtgcgatttcttag

SEQ ID NO: 175160 - DNA, 25 bp, Homo sapien
ttgtgcgatttcttagcctccataa

SEQ ID NO: 175161 - DNA, 25 bp, Homo sapien
cacatgagccaatctccttaataaa

SEQ ID NO: 175162 - DNA, 25 bp, Homo sapien
atctccttaataaatgcctgctcat

SEQ ID NO: 175163 - DNA, 25 bp, Homo sapien
aaatgcctgctcatagatctgtatc

SEQ ID NO: 175164 - DNA, 25 bp, Homo sapien
gcctgctcatagatctgtatctaca

SEQ ID NO: 175165 - DNA, 25 bp, Homo sapien
ctgtatctacatctatatctgtatg

SEQ ID NO: 175166 - DNA, 25 bp, Homo sapien
catctatatctgtatgtgcatctat

SEQ ID NO: 175167 - DNA, 25 bp, Homo sapien
gtgcatctatatctatgcctatatc

SEQ ID NO: 175168 - DNA, 25 bp, Homo sapien
taccttccttccttaaaatatctag

SEQ ID NO: 175169 - DNA, 25 bp, Homo sapien
cctgtgccctttcatagatattcga

SEQ ID NO: 175170 - DNA, 25 bp, Homo sapien
gtgccctttcatagatattcgatta

SEQ ID NO: 175171 - DNA, 25 bp, Homo sapien
taaacaagttgactatttcctttag

SEQ ID NO: 175172 - DNA, 25 bp, Homo sapien
gtttcaaacttttctgtcatctgtc

SEQ ID NO: 175173 - DNA, 25 bp, Homo sapien
acttttctgtcatctgtctctacta

SEQ ID NO: 175174 - DNA, 25 bp, Homo sapien
gtctctactacctcagaaactgcag

SEQ ID NO: 175175 - DNA, 25 bp, Homo sapien
gaaactgcagcttggttctgatgat

SEQ ID NO: 175176 - DNA, 25 bp, Homo sapien
ttgaatttttccttgtagttattgt

SEQ ID NO: 175177 - DNA, 25 bp, Homo sapien
agtctataccatgttctttcgttaa

SEQ ID NO: 175178 - DNA, 25 bp, Homo sapien
tttatacaagattgttgcagtacct

SEQ ID NO: 175179 - DNA, 25 bp, Homo sapien
tctgtgccgcaccattgaactgtac

SEQ ID NO: 175180 - DNA, 25 bp, Homo sapien
accattgaactgtaccatgtgctac

SEQ ID NO: 175181 - DNA, 25 bp, Homo sapien
gactgaccttgatgagctgtgcaca

SEQ ID NO: 175182 - DNA, 25 bp, Homo sapien
agtgtgaataaagtgctgcggagca

SEQ ID NO: 175183 - DNA, 25 bp, Homo sapien
agaggaggccgttgattcacttcac

SEQ ID NO: 175184 - DNA, 25 bp, Homo sapien
tgattcacttcacgctttcagcgaa

SEQ ID NO: 175185 - DNA, 25 bp, Homo sapien
aatcatctttgtgaaggcctcgcag

SEQ ID NO: 175186 - DNA, 25 bp, Homo sapien
aggcctcgcaggaagacgcaacaca

SEQ ID NO: 175187 - DNA, 25 bp, Homo sapien
ggaagacgcaacacatgggacctat

SEQ ID NO: 175188 - DNA, 25 bp, Homo sapien
atgggacctataactgcccagcgga

SEQ ID NO: 175189 - DNA, 25 bp, Homo sapien
tataactgcccagcggacagtggca

SEQ ID NO: 175190 - DNA, 25 bp, Homo sapien
gaagacaattttcataacttgataa

SEQ ID NO: 175191 - DNA, 25 bp, Homo sapien
tgtttgttagaaaagtagctcttaa

SEQ ID NO: 175192 - DNA, 25 bp, Homo sapien
ggcttcaaaatgtttatacgtggaa

SEQ ID NO: 175193 - DNA, 25 bp, Homo sapien
gtttatacgtggaaacacacctaca

SEQ ID NO: 175194 - DNA, 25 bp, Homo sapien
gtggaaacacacctacatgaaaagc

SEQ ID NO: 175195 - DNA, 25 bp, Homo sapien
acacacctacatgaaaagcagaaat

SEQ ID NO: 175196 - DNA, 25 bp, Homo sapien
agcagaaatcggttgctgttttgct

SEQ ID NO: 175197 - DNA, 25 bp, Homo sapien
tatttttgtattgtggtcatttcct

SEQ ID NO: 175198 - DNA, 25 bp, Homo sapien
gtattgtggtcatttcctatgcaaa

SEQ ID NO: 175199 - DNA, 25 bp, Homo sapien
atttcctatgcaaataatggagcaa

SEQ ID NO: 175200 - DNA, 25 bp, Homo sapien
gcaaacagctgtatagttgtagaat

SEQ ID NO: 175201 - DNA, 25 bp, Homo sapien
gaacggttctgtccatgggtccaaa

SEQ ID NO: 175202 - DNA, 25 bp, Homo sapien
gtccatgggtccaaagttcttacca

SEQ ID NO: 175203 - DNA, 25 bp, Homo sapien
agttcttaccatatctactctgaga

SEQ ID NO: 175204 - DNA, 25 bp, Homo sapien
tactctgagactgactatcacccaa

SEQ ID NO: 175205 - DNA, 25 bp, Homo sapien
caactgggcatcacatagggcaaat

SEQ ID NO: 175206 - DNA, 25 bp, Homo sapien
gatgtgtagcaaacccagagaattt

SEQ ID NO: 175207 - DNA, 25 bp, Homo sapien
agagaatttgcattggctttagcca

SEQ ID NO: 175208 - DNA, 25 bp, Homo sapien
ggctttagccattttggagtgtgca

SEQ ID NO: 175209 - DNA, 25 bp, Homo sapien
gagtgtgcagttaaaccagttgtga

SEQ ID NO: 175210 - DNA, 25 bp, Homo sapien
agttgtgatgctaccaatatggcga

SEQ ID NO: 175211 - DNA, 25 bp, Homo sapien
taggacataccaggttacaccggat

SEQ ID NO: 175212 - DNA, 25 bp, Homo sapien
aaagaatgttttcttggtgccattt

SEQ ID NO: 175213 - DNA, 25 bp, Homo sapien
tagctttagctttagcctggcaacc

SEQ ID NO: 175214 - DNA, 25 bp, Homo sapien
cctggcaacctggagaatccacata

SEQ ID NO: 175215 - DNA, 25 bp, Homo sapien
ggagaatccacataccttgtgtatt

SEQ ID NO: 175216 - DNA, 25 bp, Homo sapien
taccttgtgtattgaaccccaggaa

SEQ ID NO: 175217 - DNA, 25 bp, Homo sapien
ggaagaggtcgaaccaaccctgcgg

SEQ ID NO: 175218 - DNA, 25 bp, Homo sapien
cgaaccaaccctgcggaaggagcat

SEQ ID NO: 175219 - DNA, 25 bp, Homo sapien
aggagcatggtttcaggagtttatt

SEQ ID NO: 175220 - DNA, 25 bp, Homo sapien
ggaaacaggccccattttgtatata

SEQ ID NO: 175221 - DNA, 25 bp, Homo sapien
aggccccattttgtatatagttgca

SEQ ID NO: 175222 - DNA, 25 bp, Homo sapien
gcaacttaaactttttggcttgcaa

SEQ ID NO: 175223 - DNA, 25 bp, Homo sapien
cactgggcctgagtctagcctggga

SEQ ID NO: 175224 - DNA, 25 bp, Homo sapien
gtgtgaccttaggaagtctctgccc

SEQ ID NO: 175225 - DNA, 25 bp, Homo sapien
agggccccgaagcattccattctcg

SEQ ID NO: 175226 - DNA, 25 bp, Homo sapien
gaagcattccattctcgtggaggag

SEQ ID NO: 175227 - DNA, 25 bp, Homo sapien
attccattctcgtggaggagtttcc

SEQ ID NO: 175228 - DNA, 25 bp, Homo sapien
tgagatttcaaatagtcctccccac

SEQ ID NO: 175229 - DNA, 25 bp, Homo sapien
ctcaactgtcaccactgctaaggga

SEQ ID NO: 175230 - DNA, 25 bp, Homo sapien
gtcaccactgctaagggactctatc

SEQ ID NO: 175231 - DNA, 25 bp, Homo sapien
gggactctatccattgagcacattt

SEQ ID NO: 175232 - DNA, 25 bp, Homo sapien
tgagcacattttcctaaggccctgc

SEQ ID NO: 175233 - DNA, 25 bp, Homo sapien
acattttcctaaggccctgctgtct

SEQ ID NO: 175234 - DNA, 25 bp, Homo sapien
ggctaggcttccatttataagtctt

SEQ ID NO: 175235 - DNA, 25 bp, Homo sapien
gtcttagcattatttcctttgtgaa

SEQ ID NO: 175236 - DNA, 25 bp, Homo sapien
acagatgattgtttgctagattttg

SEQ ID NO: 175237 - DNA, 25 bp, Homo sapien
tcaaaatgttgacctgcaaagcagt

SEQ ID NO: 175238 - DNA, 25 bp, Homo sapien
gcaaagcagtgtaggattttctctc

SEQ ID NO: 175239 - DNA, 25 bp, Homo sapien
gattttctctcctcaagagcgtgta

SEQ ID NO: 175240 - DNA, 25 bp, Homo sapien
aagcattcccaaagacttggtccat

SEQ ID NO: 175241 - DNA, 25 bp, Homo sapien
gacttggtccatgcagataaggata

SEQ ID NO: 175242 - DNA, 25 bp, Homo sapien
gaaattgctcactctaatccttttt

SEQ ID NO: 175243 - DNA, 25 bp, Homo sapien
tgctcactctaatcctttttctaaa

SEQ ID NO: 175244 - DNA, 25 bp, Homo sapien
cagtgtttttcaagctggatgtaaa

SEQ ID NO: 175245 - DNA, 25 bp, Homo sapien
tgctgtgggccctgacctccaagct

SEQ ID NO: 175246 - DNA, 25 bp, Homo sapien
ggcccagccccaaagggcagtgaat

SEQ ID NO: 175247 - DNA, 25 bp, Homo sapien
gcagtgaatggccttctctgaaacc

SEQ ID NO: 175248 - DNA, 25 bp, Homo sapien
agtgaatggccttctctgaaaccct

SEQ ID NO: 175249 - DNA, 25 bp, Homo sapien
tgaatggccttctctgaaaccctgc

SEQ ID NO: 175250 - DNA, 25 bp, Homo sapien
aatggccttctctgaaaccctgcgt

SEQ ID NO: 175251 - DNA, 25 bp, Homo sapien
ttctctgaaaccctgcgtcaagcag

SEQ ID NO: 175252 - DNA, 25 bp, Homo sapien
tgaaaccctgcgtcaagcagtggga

SEQ ID NO: 175253 - DNA, 25 bp, Homo sapien
aaccctgcgtcaagcagtgggagag

SEQ ID NO: 175254 - DNA, 25 bp, Homo sapien
caagcagtgggagagggcagtgccc

SEQ ID NO: 175255 - DNA, 25 bp, Homo sapien
ctggcgcgtggctcctgcatagcta

SEQ ID NO: 175256 - DNA, 25 bp, Homo sapien
gaacaacctttcttgttagtaacat

SEQ ID NO: 175257 - DNA, 25 bp, Homo sapien
taacatatttgtggcaatacatgcc

SEQ ID NO: 175258 - DNA, 25 bp, Homo sapien
gcaatacatgccaacctgggcctgg

SEQ ID NO: 175259 - DNA, 25 bp, Homo sapien
gcctggtggataaccaacaagatgg

SEQ ID NO: 175260 - DNA, 25 bp, Homo sapien
agtggtgtggatgcagactcttctt

SEQ ID NO: 175261 - DNA, 25 bp, Homo sapien
aagagcacctgtacttttcaagcca

SEQ ID NO: 175262 - DNA, 25 bp, Homo sapien
acctgtacttttcaagccactggag

SEQ ID NO: 175263 - DNA, 25 bp, Homo sapien
acttttcaagccactggagggagaa

SEQ ID NO: 175264 - DNA, 25 bp, Homo sapien
gaaaacagcaatcttcttatgcttc

SEQ ID NO: 175265 - DNA, 25 bp, Homo sapien
tcttcttatgcttctgaataatcaa

SEQ ID NO: 175266 - DNA, 25 bp, Homo sapien
gatatgactttgcttccaacatgga

SEQ ID NO: 175267 - DNA, 25 bp, Homo sapien
tctgaatcgagtgagacaaaatttt

SEQ ID NO: 175268 - DNA, 25 bp, Homo sapien
taacaagtaccaaagttttatcaag

SEQ ID NO: 175269 - DNA, 25 bp, Homo sapien
tatcaagtttgggtctgtgctgctg

SEQ ID NO: 175270 - DNA, 25 bp, Homo sapien
gggcaaaaccttgctaattttctca

SEQ ID NO: 175271 - DNA, 25 bp, Homo sapien
aaccttgctaattttctcaaaagca

SEQ ID NO: 175272 - DNA, 25 bp, Homo sapien
aagcatttatcattcttgttgccac

SEQ ID NO: 175273 - DNA, 25 bp, Homo sapien
cttgttgccacagctggagctctca

SEQ ID NO: 175274 - DNA, 25 bp, Homo sapien
ggagctctcaaactaaaagacattt

SEQ ID NO: 175275 - DNA, 25 bp, Homo sapien
gaagaaagactctattctcaaagtt

SEQ ID NO: 175276 - DNA, 25 bp, Homo sapien
attctcaaagtttcctaatcagaaa

SEQ ID NO: 175277 - DNA, 25 bp, Homo sapien
atcagaaatttttatcagtttccag

SEQ ID NO: 175278 - DNA, 25 bp, Homo sapien
tttgtatttcagctagcttctaggt

SEQ ID NO: 175279 - DNA, 25 bp, Homo sapien
gctagcttctaggttagttggtcta

SEQ ID NO: 175280 - DNA, 25 bp, Homo sapien
agttggtctatctacttttatttga

SEQ ID NO: 175281 - DNA, 25 bp, Homo sapien
tagaatcttcgtgctttttctgagg

SEQ ID NO: 175282 - DNA, 25 bp, Homo sapien
gccagtttaggctcagtgaacaaac

SEQ ID NO: 175283 - DNA, 25 bp, Homo sapien
gtgaacaaactgatctagctctgaa

SEQ ID NO: 175284 - DNA, 25 bp, Homo sapien
agctctgaatgtatgtttcctgacg

SEQ ID NO: 175285 - DNA, 25 bp, Homo sapien
tttcctgacgttttacatttccact

SEQ ID NO: 175286 - DNA, 25 bp, Homo sapien
tccactttcctattccattcattaa

SEQ ID NO: 175287 - DNA, 25 bp, Homo sapien
attaagctagccaacaatccaccat

SEQ ID NO: 175288 - DNA, 25 bp, Homo sapien
atccaccatcctttaaagattgttc

SEQ ID NO: 175289 - DNA, 25 bp, Homo sapien
gcagtgaatggccttctctgaaacc

SEQ ID NO: 175290 - DNA, 25 bp, Homo sapien
agtgaatggccttctctgaaaccct

SEQ ID NO: 175291 - DNA, 25 bp, Homo sapien
tgaatggccttctctgaaaccctgc

SEQ ID NO: 175292 - DNA, 25 bp, Homo sapien
aatggccttctctgaaaccctgcgt

SEQ ID NO: 175293 - DNA, 25 bp, Homo sapien
ttctctgaaaccctgcgtcaagcag

SEQ ID NO: 175294 - DNA, 25 bp, Homo sapien
ctctgaaaccctgcgtcaagcagtg

SEQ ID NO: 175295 - DNA, 25 bp, Homo sapien
tgaaaccctgcgtcaagcagtggga

SEQ ID NO: 175296 - DNA, 25 bp, Homo sapien
aaaccctgcgtcaagcagtgggaga

SEQ ID NO: 175297 - DNA, 25 bp, Homo sapien
aaccctgcgtcaagcagtgggagag

SEQ ID NO: 175298 - DNA, 25 bp, Homo sapien
caagcagtgggagagggcagtgccc

SEQ ID NO: 175299 - DNA, 25 bp, Homo sapien
ctggcgcgtggctcctgcatagcta

SEQ ID NO: 175300 - DNA, 25 bp, Homo sapien
tgaagccaggtttacattcaccaaa

SEQ ID NO: 175301 - DNA, 25 bp, Homo sapien
ggtttacattcaccaaaaggaggca

SEQ ID NO: 175302 - DNA, 25 bp, Homo sapien
aaggaggcatcactgcagagcatgt

SEQ ID NO: 175303 - DNA, 25 bp, Homo sapien
gaaggttttctgtgcttcctgctgt

SEQ ID NO: 175304 - DNA, 25 bp, Homo sapien
gcttcctgctgtagcctgaaatgta

SEQ ID NO: 175305 - DNA, 25 bp, Homo sapien
gagtgtgtgtaatctgccattcagt

SEQ ID NO: 175306 - DNA, 25 bp, Homo sapien
agggaattacgatgagaagactttt

SEQ ID NO: 175307 - DNA, 25 bp, Homo sapien
ctgcctttctttacaagttgctcac

SEQ ID NO: 175308 - DNA, 25 bp, Homo sapien
tttacaagttgctcaccttctcaaa

SEQ ID NO: 175309 - DNA, 25 bp, Homo sapien
gttgctcaccttctcaaatgtcata

SEQ ID NO: 175310 - DNA, 25 bp, Homo sapien
tctcaaatgtcataactttaactga

SEQ ID NO: 175311 - DNA, 25 bp, Homo sapien
aaagtcacctgcctgttctaaaggc

SEQ ID NO: 175312 - DNA, 25 bp, Homo sapien
agccaatcagccgatttcctgagca

SEQ ID NO: 175313 - DNA, 25 bp, Homo sapien
tcctgagcagtgatgccacctccaa

SEQ ID NO: 175314 - DNA, 25 bp, Homo sapien
tccaagcttgtcctaggtgtctgct

SEQ ID NO: 175315 - DNA, 25 bp, Homo sapien
ggtgtctgctgtgaacctccagtga

SEQ ID NO: 175316 - DNA, 25 bp, Homo sapien
tgaccccagagactttgctgtaatt

SEQ ID NO: 175317 - DNA, 25 bp, Homo sapien
tttgctgtaattatctgccctgctg

SEQ ID NO: 175318 - DNA, 25 bp, Homo sapien
ctgaccctaaagaccttcctagaag

SEQ ID NO: 175319 - DNA, 25 bp, Homo sapien
caagagctagccttgagactgtgct

SEQ ID NO: 175320 - DNA, 25 bp, Homo sapien
cagttctctgggttgtgctttactc

SEQ ID NO: 175321 - DNA, 25 bp, Homo sapien
tgtgctttactccacgcatcaataa

SEQ ID NO: 175322 - DNA, 25 bp, Homo sapien
ctagaactcctgagacaccacttct

SEQ ID NO: 175323 - DNA, 25 bp, Homo sapien
tccctaccagcggtcaaggctttgg

SEQ ID NO: 175324 - DNA, 25 bp, Homo sapien
taccagcggtcaaggctttggagcc

SEQ ID NO: 175325 - DNA, 25 bp, Homo sapien
caaggctttggagccactcttttgt

SEQ ID NO: 175326 - DNA, 25 bp, Homo sapien
gccactcttttgtaactccagatta

SEQ ID NO: 175327 - DNA, 25 bp, Homo sapien
acagaaatcttctagcactttgtaa

SEQ ID NO: 175328 - DNA, 25 bp, Homo sapien
gtaaacacagtgaataacctcttgg

SEQ ID NO: 175329 - DNA, 25 bp, Homo sapien
ataacctcttggagtatttttggct

SEQ ID NO: 175330 - DNA, 25 bp, Homo sapien
ctcttggagtatttttggctttata

SEQ ID NO: 175331 - DNA, 25 bp, Homo sapien
aattgtaaagtataagtgccattag

SEQ ID NO: 175332 - DNA, 25 bp, Homo sapien
atgcacagggcatatctttgttaaa

SEQ ID NO: 175333 - DNA, 25 bp, Homo sapien
tggaagatccaaacgtgcatacagt

SEQ ID NO: 175334 - DNA, 25 bp, Homo sapien
gtgcatacagtagcaaatatttatt

SEQ ID NO: 175335 - DNA, 25 bp, Homo sapien
gggtgatttgcttcattgagatctt

SEQ ID NO: 175336 - DNA, 25 bp, Homo sapien
ttcattgagatcttgctcccaggta

SEQ ID NO: 175337 - DNA, 25 bp, Homo sapien
gatcttgctcccaggtaaccttaag

SEQ ID NO: 175338 - DNA, 25 bp, Homo sapien
aaatgaacctttccttatcaaatag

SEQ ID NO: 175339 - DNA, 25 bp, Homo sapien
aatatcactgatatactgctgcatg

SEQ ID NO: 175340 - DNA, 25 bp, Homo sapien
tatactgctgcatgaataagaacca

SEQ ID NO: 175341 - DNA, 25 bp, Homo sapien
aataagaaccattatgtgggcaggt

SEQ ID NO: 175342 - DNA, 25 bp, Homo sapien
gtgggcaggttatggaagcaaaatt

SEQ ID NO: 175343 - DNA, 25 bp, Homo sapien
aagcaaaattggttaatctacacct

SEQ ID NO: 175344 - DNA, 25 bp, Homo sapien
gagggttgcttcaatcagcttttgt

SEQ ID NO: 175345 - DNA, 25 bp, Homo sapien
tcaatcagcttttgtatgacatccg

SEQ ID NO: 175346 - DNA, 25 bp, Homo sapien
gtatgacatccgaactaatgcagtc

SEQ ID NO: 175347 - DNA, 25 bp, Homo sapien
actaatgcagtcaccgtgggtggtg

SEQ ID NO: 175348 - DNA, 25 bp, Homo sapien
gagctggctgccatgattgtttcca

SEQ ID NO: 175349 - DNA, 25 bp, Homo sapien
gattgtttccatgtatctgtactgc

SEQ ID NO: 175350 - DNA, 25 bp, Homo sapien
gtatctgtactgcaatctacaataa

SEQ ID NO: 175351 - DNA, 25 bp, Homo sapien
tacaataagtccacttctgcctctg

SEQ ID NO: 175352 - DNA, 25 bp, Homo sapien
cactactgctgccacatgggaaact

SEQ ID NO: 175353 - DNA, 25 bp, Homo sapien
gatctaacaatgtcacttgggccag

SEQ ID NO: 175354 - DNA, 25 bp, Homo sapien
gccagaatggacctggcctttctgc

SEQ ID NO: 175355 - DNA, 25 bp, Homo sapien
tgaagccaggtttacattcaccaaa

SEQ ID NO: 175356 - DNA, 25 bp, Homo sapien
gccaggtttacattcaccaaaagga

SEQ ID NO: 175357 - DNA, 25 bp, Homo sapien
ggtttacattcaccaaaaggaggca

SEQ ID NO: 175358 - DNA, 25 bp, Homo sapien
gaaggttttctgtgcttcctgctgt

SEQ ID NO: 175359 - DNA, 25 bp, Homo sapien
gtgcttcctgctgtagcctgaaatg

SEQ ID NO: 175360 - DNA, 25 bp, Homo sapien
gcttcctgctgtagcctgaaatgta

SEQ ID NO: 175361 - DNA, 25 bp, Homo sapien
atgtaaactgttatacatggacaga

SEQ ID NO: 175362 - DNA, 25 bp, Homo sapien
atacatggacagaaaggaagctaga

SEQ ID NO: 175363 - DNA, 25 bp, Homo sapien
aagctagagtgtgtgtaatctgcca

SEQ ID NO: 175364 - DNA, 25 bp, Homo sapien
gagtgtgtgtaatctgccattcagt

SEQ ID NO: 175365 - DNA, 25 bp, Homo sapien
gtgtgtgtaatctgccattcagtgc

SEQ ID NO: 175366 - DNA, 25 bp, Homo sapien
aatactttatagcacatggcagatt

SEQ ID NO: 175367 - DNA, 25 bp, Homo sapien
gcacatggcagatttgcaactagta

SEQ ID NO: 175368 - DNA, 25 bp, Homo sapien
aatgctggtgaaatgctgttggtaa

SEQ ID NO: 175369 - DNA, 25 bp, Homo sapien
gctgttggtaaagcacatggtccaa

SEQ ID NO: 175370 - DNA, 25 bp, Homo sapien
gcacatggtccaaatctagaagatg

SEQ ID NO: 175371 - DNA, 25 bp, Homo sapien
actcgagttgttagggctgaggaac

SEQ ID NO: 175372 - DNA, 25 bp, Homo sapien
ttagggctgaggaaccaatcaaggt

SEQ ID NO: 175373 - DNA, 25 bp, Homo sapien
gggtaaaagtgttgctgattgtcaa

SEQ ID NO: 175374 - DNA, 25 bp, Homo sapien
gctgattgtcaacacaaactggctt

SEQ ID NO: 175375 - DNA, 25 bp, Homo sapien
gaacctgtcttattaagactggctt

SEQ ID NO: 175376 - DNA, 25 bp, Homo sapien
taagactggctttagaaccgtaggt

SEQ ID NO: 175377 - DNA, 25 bp, Homo sapien
gttgggcatggtgcgtcacacctat

SEQ ID NO: 175378 - DNA, 25 bp, Homo sapien
tgcactctggcctgcatgcactctg

SEQ ID NO: 175379 - DNA, 25 bp, Homo sapien
actctggcctgcatggcagaacaag

SEQ ID NO: 175380 - DNA, 25 bp, Homo sapien
tctggcctgcatggcagaacaagac

SEQ ID NO: 175381 - DNA, 25 bp, Homo sapien
ggcctgcatggcagaacaagaccct

SEQ ID NO: 175382 - DNA, 25 bp, Homo sapien
gaaatcaaactaatcatgctgctca

SEQ ID NO: 175383 - DNA, 25 bp, Homo sapien
aaatcaaactaatcatgctgctcat

SEQ ID NO: 175384 - DNA, 25 bp, Homo sapien
tgctgctcatggatttttccaataa

SEQ ID NO: 175385 - DNA, 25 bp, Homo sapien
taaatttcttgttttggcaggaaga

SEQ ID NO: 175386 - DNA, 25 bp, Homo sapien
aatgaacactggtattagacttaaa

SEQ ID NO: 175387 - DNA, 25 bp, Homo sapien
gaacactggtattagacttaaagat

SEQ ID NO: 175388 - DNA, 25 bp, Homo sapien
cacgctcatcttgcaaagcgctatt

SEQ ID NO: 175389 - DNA, 25 bp, Homo sapien
aagcgctatttcaggcacatcattg

SEQ ID NO: 175390 - DNA, 25 bp, Homo sapien
tgagctcgccattcactgattggaa

SEQ ID NO: 175391 - DNA, 25 bp, Homo sapien
gagtgacctggcatcttggaaatca

SEQ ID NO: 175392 - DNA, 25 bp, Homo sapien
aaatcattgtgtgtcttcaggagaa

SEQ ID NO: 175393 - DNA, 25 bp, Homo sapien
gaatgtgcagtgtcttgtaacaact

SEQ ID NO: 175394 - DNA, 25 bp, Homo sapien
gggctacattgtaatctgctttgtt

SEQ ID NO: 175395 - DNA, 25 bp, Homo sapien
gaatattgacaagctaggacacctg

SEQ ID NO: 175396 - DNA, 25 bp, Homo sapien
gctaggacacctgtggtatctttaa

SEQ ID NO: 175397 - DNA, 25 bp, Homo sapien
gtatctttaattgtatctccttcag

SEQ ID NO: 175398 - DNA, 25 bp, Homo sapien
atctccttcagaagtttgcttctta

SEQ ID NO: 175399 - DNA, 25 bp, Homo sapien
cagcctgtctgggatatcatgtttc

SEQ ID NO: 175400 - DNA, 25 bp, Homo sapien
gtggctgtgccaaagtcaatgagag

SEQ ID NO: 175401 - DNA, 25 bp, Homo sapien
agtgaagctgcagccggcatccagc

SEQ ID NO: 175402 - DNA, 25 bp, Homo sapien
agctccaagcttcctgcattcagtc

SEQ ID NO: 175403 - DNA, 25 bp, Homo sapien
gcattcagtcctttgatgcctccag

SEQ ID NO: 175404 - DNA, 25 bp, Homo sapien
gtgatatctcagatgctgctgcttg

SEQ ID NO: 175405 - DNA, 25 bp, Homo sapien
ctgctgcttgacaatccacacaaag

SEQ ID NO: 175406 - DNA, 25 bp, Homo sapien
agaacctatccgcttacggtacaag

SEQ ID NO: 175407 - DNA, 25 bp, Homo sapien
acggtacaagctgacattcaaccaa

SEQ ID NO: 175408 - DNA, 25 bp, Homo sapien
ggtggacagcctttcagcgaagtag

SEQ ID NO: 175409 - DNA, 25 bp, Homo sapien
ctgtcttgggcgcagcctaactttt

SEQ ID NO: 175410 - DNA, 25 bp, Homo sapien
ctggacctgggtgcgaagctatgaa

SEQ ID NO: 175411 - DNA, 25 bp, Homo sapien
gtgcgaagctatgaattcaccagta

SEQ ID NO: 175412 - DNA, 25 bp, Homo sapien
aattcaccagtaacagctgctccca

SEQ ID NO: 175413 - DNA, 25 bp, Homo sapien
tcccagcgggctgtgatattcacta

SEQ ID NO: 175414 - DNA, 25 bp, Homo sapien
agaaagtctgtacccatccaaggaa

SEQ ID NO: 175415 - DNA, 25 bp, Homo sapien
aactccgaaacaattgtgactcagc

SEQ ID NO: 175416 - DNA, 25 bp, Homo sapien
gtgactcagctgaattttcatccga

SEQ ID NO: 175417 - DNA, 25 bp, Homo sapien
attttcatccgaggacgcttggacc

SEQ ID NO: 175418 - DNA, 25 bp, Homo sapien
ggagcctgcggaatcttttctgaag

SEQ ID NO: 175419 - DNA, 25 bp, Homo sapien
ttctgaaggctacatggacccgctg

SEQ ID NO: 175420 - DNA, 25 bp, Homo sapien
aggagagggtgtttcctcccagagt

SEQ ID NO: 175421 - DNA, 25 bp, Homo sapien
gaccctttatgctgccctgctggtg

SEQ ID NO: 175422 - DNA, 25 bp, Homo sapien
ctggtgctgaccagcccggcagcca

SEQ ID NO: 175423 - DNA, 25 bp, Homo sapien
tccttggcagcctgttcctgtggcg

SEQ ID NO: 175424 - DNA, 25 bp, Homo sapien
ggagctgcaggaggcgccactgtca

SEQ ID NO: 175425 - DNA, 25 bp, Homo sapien
aggaggcgccactgtcactggccga

SEQ ID NO: 175426 - DNA, 25 bp, Homo sapien
cgccactgtcactggccgagggctg

SEQ ID NO: 175427 - DNA, 25 bp, Homo sapien
tcctggcagcgctagcccagggtgt

SEQ ID NO: 175428 - DNA, 25 bp, Homo sapien
agggtgtgctggagcaccacaccta

SEQ ID NO: 175429 - DNA, 25 bp, Homo sapien
ttctggaatgtgctcttctggaagt

SEQ ID NO: 175430 - DNA, 25 bp, Homo sapien
gaagtgagatctgcctgtccgggct

SEQ ID NO: 175431 - DNA, 25 bp, Homo sapien
ggctgggacagagactccccaagga

SEQ ID NO: 175432 - DNA, 25 bp, Homo sapien
aaagctcagtttatgtcattgtctt

SEQ ID NO: 175433 - DNA, 25 bp, Homo sapien
gtttatgtcattgtcttaacttcag

SEQ ID NO: 175434 - DNA, 25 bp, Homo sapien
gtcattgtcttaacttcagatacaa

SEQ ID NO: 175435 - DNA, 25 bp, Homo sapien
agtattttcctttatgctaattcaa

SEQ ID NO: 175436 - DNA, 25 bp, Homo sapien
attatatacttctgaatggcacctt

SEQ ID NO: 175437 - DNA, 25 bp, Homo sapien
atacttctgaatggcaccttacttt

SEQ ID NO: 175438 - DNA, 25 bp, Homo sapien
tgaatggcaccttactttttggaaa

SEQ ID NO: 175439 - DNA, 25 bp, Homo sapien
gaaacaaatcttctgttatttacaa

SEQ ID NO: 175440 - DNA, 25 bp, Homo sapien
tccaaagctgctctcgataatagtc

SEQ ID NO: 175441 - DNA, 25 bp, Homo sapien
gctgctctcgataatagtcaacatt

SEQ ID NO: 175442 - DNA, 25 bp, Homo sapien
tctcgataatagtcaacatttgcat

SEQ ID NO: 175443 - DNA, 25 bp, Homo sapien
agctgcaatagctcagaggacgaat

SEQ ID NO: 175444 - DNA, 25 bp, Homo sapien
agaagaactcatgaagatgcacaca

SEQ ID NO: 175445 - DNA, 25 bp, Homo sapien
gatgcacacagctagggtgcgtgac

SEQ ID NO: 175446 - DNA, 25 bp, Homo sapien
tagggtgcgtgacattgaacatctc

SEQ ID NO: 175447 - DNA, 25 bp, Homo sapien
ttgaacatctcaccagcctggactt

SEQ ID NO: 175448 - DNA, 25 bp, Homo sapien
tcttccgaaagaccagccgcagcta

SEQ ID NO: 175449 - DNA, 25 bp, Homo sapien
gctacccagaaatcctgacactcaa

SEQ ID NO: 175450 - DNA, 25 bp, Homo sapien
cactcaagacatacctgcatacata

SEQ ID NO: 175451 - DNA, 25 bp, Homo sapien
gatttaactttctgagcatctgcag

SEQ ID NO: 175452 - DNA, 25 bp, Homo sapien
agcatctgcagtacagtcttatcaa

SEQ ID NO: 175453 - DNA, 25 bp, Homo sapien
gtacagtcttatcaactggttgtat

SEQ ID NO: 175454 - DNA, 25 bp, Homo sapien
tagtcaccgacagcggccttgaaga

SEQ ID NO: 175455 - DNA, 25 bp, Homo sapien
gactgcctgtctccatgaggtactg

SEQ ID NO: 175456 - DNA, 25 bp, Homo sapien
tgaggtactggtcccttccttttgt

SEQ ID NO: 175457 - DNA, 25 bp, Homo sapien
tccttttgttaacgtgatgtgccac

SEQ ID NO: 175458 - DNA, 25 bp, Homo sapien
gccactatattttacacgtatctct

SEQ ID NO: 175459 - DNA, 25 bp, Homo sapien
acacgtatctcttggtatgcatctt

SEQ ID NO: 175460 - DNA, 25 bp, Homo sapien
ggtatgcatcttttatagacgctct

SEQ ID NO: 175461 - DNA, 25 bp, Homo sapien
tatagacgctcttttctaagtggcg

SEQ ID NO: 175462 - DNA, 25 bp, Homo sapien
taagtggcgtgtgcatagcgtcctg

SEQ ID NO: 175463 - DNA, 25 bp, Homo sapien
gggtccagtgcattttgtttctgta

SEQ ID NO: 175464 - DNA, 25 bp, Homo sapien
ttctgtatatgattctctgtggttt

SEQ ID NO: 175465 - DNA, 25 bp, Homo sapien
tgcacctgcttcagaccaagggtta

SEQ ID NO: 175466 - DNA, 25 bp, Homo sapien
gcttcagaccaagggttagatggaa

SEQ ID NO: 175467 - DNA, 25 bp, Homo sapien
ggaagagagggctcacctgtgggca

SEQ ID NO: 175468 - DNA, 25 bp, Homo sapien
acctgtgggcaggatagactctatc

SEQ ID NO: 175469 - DNA, 25 bp, Homo sapien
tagactctatccaagaaggagaact

SEQ ID NO: 175470 - DNA, 25 bp, Homo sapien
gggaatttttcctggtgaatactga

SEQ ID NO: 175471 - DNA, 25 bp, Homo sapien
ttcctggtgaatactgaagttacta

SEQ ID NO: 175472 - DNA, 25 bp, Homo sapien
ttttgtcttgcaaaactcaagggaa

SEQ ID NO: 175473 - DNA, 25 bp, Homo sapien
tgtctattctgtgtccaaactgtcc

SEQ ID NO: 175474 - DNA, 25 bp, Homo sapien
tattctgtgtccaaactgtcctttt

SEQ ID NO: 175475 - DNA, 25 bp, Homo sapien
tgtccaaactgtccttttgaaacgg

SEQ ID NO: 175476 - DNA, 25 bp, Homo sapien
ttgcaggtttccctgtataacgtaa

SEQ ID NO: 175477 - DNA, 25 bp, Homo sapien
tataacgtaaacacacttgccctca

SEQ ID NO: 175478 - DNA, 25 bp, Homo sapien
tcatgcctcccagaatatgaggtct

SEQ ID NO: 175479 - DNA, 25 bp, Homo sapien
tgaggtctaattaagaagtcccatc

SEQ ID NO: 175480 - DNA, 25 bp, Homo sapien
gaagtcccatcaggtttattttgta

SEQ ID NO: 175481 - DNA, 25 bp, Homo sapien
gtcttttttagaggtcagacttcct

SEQ ID NO: 175482 - DNA, 25 bp, Homo sapien
agacttcctaatcaaaggcctgggc

SEQ ID NO: 175483 - DNA, 25 bp, Homo sapien
gggcctgcagtcctttcatcttaat

SEQ ID NO: 175484 - DNA, 25 bp, Homo sapien
aagaatattttgtctgagagcttta

SEQ ID NO: 175485 - DNA, 25 bp, Homo sapien
gtctgagagctttaaggatctggta

SEQ ID NO: 175486 - DNA, 25 bp, Homo sapien
ggatctggtaatagacttcaaaatg

SEQ ID NO: 175487 - DNA, 25 bp, Homo sapien
gggtttgccatcctgtacacgaagc

SEQ ID NO: 175488 - DNA, 25 bp, Homo sapien
catcctgtacacgaagcaccggagg

SEQ ID NO: 175489 - DNA, 25 bp, Homo sapien
gaagatgcccctatgataactggat

SEQ ID NO: 175490 - DNA, 25 bp, Homo sapien
atgcccctatgataactggattttc

SEQ ID NO: 175491 - DNA, 25 bp, Homo sapien
ctggattttcagatgacgtccccat

SEQ ID NO: 175492 - DNA, 25 bp, Homo sapien
attttcagatgacgtccccatggtg

SEQ ID NO: 175493 - DNA, 25 bp, Homo sapien
agatgacgtccccatggtgatagcc

SEQ ID NO: 175494 - DNA, 25 bp, Homo sapien
acgtccccatggtgatagcctgaaa

SEQ ID NO: 175495 - DNA, 25 bp, Homo sapien
ggtgatagcctgaaagagctttcct

SEQ ID NO: 175496 - DNA, 25 bp, Homo sapien
aaagagctttcctcactagaaacca

SEQ ID NO: 175497 - DNA, 25 bp, Homo sapien
ttttaaaagatgcactttgagttgc

SEQ ID NO: 175498 - DNA, 25 bp, Homo sapien
acatggttcaaattatatctaaaca

SEQ ID NO: 175499 - DNA, 25 bp, Homo sapien
tttgtttgatattttcctgatgcaa

SEQ ID NO: 175500 - DNA, 25 bp, Homo sapien
gtttgatattttcctgatgcaagta

SEQ ID NO: 175501 - DNA, 25 bp, Homo sapien
gatattttcctgatgcaagtatgtg

SEQ ID NO: 175502 - DNA, 25 bp, Homo sapien
attttcctgatgcaagtatgtggtt

SEQ ID NO: 175503 - DNA, 25 bp, Homo sapien
ttcctgatgcaagtatgtggtttat

SEQ ID NO: 175504 - DNA, 25 bp, Homo sapien
ctgatgcaagtatgtggtttatcac

SEQ ID NO: 175505 - DNA, 25 bp, Homo sapien
tatgtggtttatcacatgtagctct

SEQ ID NO: 175506 - DNA, 25 bp, Homo sapien
gtagctcttttgcatgctaaatgaa

SEQ ID NO: 175507 - DNA, 25 bp, Homo sapien
agctcttttgcatgctaaatgaaaa

SEQ ID NO: 175508 - DNA, 25 bp, Homo sapien
cttgccaataaatgaatagcttatt

SEQ ID NO: 175509 - DNA, 25 bp, Homo sapien
gcttggatctgaatgctgctgagtc

SEQ ID NO: 175510 - DNA, 25 bp, Homo sapien
ctgctgagtctggtgtacaacacaa

SEQ ID NO: 175511 - DNA, 25 bp, Homo sapien
ggtgtacaacacaaaccttcagccc

SEQ ID NO: 175512 - DNA, 25 bp, Homo sapien
gaggccggctaaccagtgaacccca

SEQ ID NO: 175513 - DNA, 25 bp, Homo sapien
agtgaaccccaaccccagagagaag

SEQ ID NO: 175514 - DNA, 25 bp, Homo sapien
gaaggctgtggctgctagtgacctc

SEQ ID NO: 175515 - DNA, 25 bp, Homo sapien
ctgctagtgacctctttgctgtggc

SEQ ID NO: 175516 - DNA, 25 bp, Homo sapien
ttgctgtggcccctcatttgacctt

SEQ ID NO: 175517 - DNA, 25 bp, Homo sapien
agtactttttactgcctcattgtct

SEQ ID NO: 175518 - DNA, 25 bp, Homo sapien
gcctcattgtcttctgtacatctta

SEQ ID NO: 175519 - DNA, 25 bp, Homo sapien
gtcttctgtacatcttactgggttt

SEQ ID NO: 175520 - DNA, 25 bp, Homo sapien
actctggcctgcatgcactctggcc

SEQ ID NO: 175521 - DNA, 25 bp, Homo sapien
actctggcctgcatggcagaacaag

SEQ ID NO: 175522 - DNA, 25 bp, Homo sapien
ctctggcctgcatggcagaacaaga

SEQ ID NO: 175523 - DNA, 25 bp, Homo sapien
tctggcctgcatggcagaacaagac

SEQ ID NO: 175524 - DNA, 25 bp, Homo sapien
ggcctgcatggcagaacaagaccct

SEQ ID NO: 175525 - DNA, 25 bp, Homo sapien
gaaatcaaactaatcatgctgctca

SEQ ID NO: 175526 - DNA, 25 bp, Homo sapien
aaatcaaactaatcatgctgctcat

SEQ ID NO: 175527 - DNA, 25 bp, Homo sapien
aatgaacactggtattagacttaaa

SEQ ID NO: 175528 - DNA, 25 bp, Homo sapien
tgaacactggtattagacttaaaga

SEQ ID NO: 175529 - DNA, 25 bp, Homo sapien
gaacactggtattagacttaaagat

SEQ ID NO: 175530 - DNA, 25 bp, Homo sapien
cactggtattagacttaaagattaa

SEQ ID NO: 175531 - DNA, 25 bp, Homo sapien
gcaaggactgttagaggcaggcttt

SEQ ID NO: 175532 - DNA, 25 bp, Homo sapien
gaggcaggctttatagtaacaagac

SEQ ID NO: 175533 - DNA, 25 bp, Homo sapien
gggaatgtcatggtcttgctttact

SEQ ID NO: 175534 - DNA, 25 bp, Homo sapien
gtcatggtcttgctttactaagttt

SEQ ID NO: 175535 - DNA, 25 bp, Homo sapien
tactaagttttgagactggcaggta

SEQ ID NO: 175536 - DNA, 25 bp, Homo sapien
gactggcaggtagtgaaactcatta

SEQ ID NO: 175537 - DNA, 25 bp, Homo sapien
gagaaccttgtggaatgcagctgac

SEQ ID NO: 175538 - DNA, 25 bp, Homo sapien
gaagtagccaggtgggagcctttcc

SEQ ID NO: 175539 - DNA, 25 bp, Homo sapien
agcctttcccagtgggtgtgggaca

SEQ ID NO: 175540 - DNA, 25 bp, Homo sapien
atctggcaagattttgtggcactcc

SEQ ID NO: 175541 - DNA, 25 bp, Homo sapien
gtggcactcctggttacagatactg

SEQ ID NO: 175542 - DNA, 25 bp, Homo sapien
gtctgatgtggcaaaaggccctctg

SEQ ID NO: 175543 - DNA, 25 bp, Homo sapien
ggccacgaggttaaagaagctgcat

SEQ ID NO: 175544 - DNA, 25 bp, Homo sapien
agctgcatgttaagtgccattacta

SEQ ID NO: 175545 - DNA, 25 bp, Homo sapien
attactactgtacacggaccatcgc

SEQ ID NO: 175546 - DNA, 25 bp, Homo sapien
tgtctcgcgcgactgagaaccgtga

SEQ ID NO: 175547 - DNA, 25 bp, Homo sapien
gaaccgtgacatcagcgtagtgttt

SEQ ID NO: 175548 - DNA, 25 bp, Homo sapien
gcgtagtgttttgacctttctaggt

SEQ ID NO: 175549 - DNA, 25 bp, Homo sapien
gttgtagtgttatcaggcgtcccat

SEQ ID NO: 175550 - DNA, 25 bp, Homo sapien
gcgtcccataccttgtttttaatct

SEQ ID NO: 175551 - DNA, 25 bp, Homo sapien
gcactgactgtgaaacctttacctt

SEQ ID NO: 175552 - DNA, 25 bp, Homo sapien
gttgttgttggcaagctgcaggttt

SEQ ID NO: 175553 - DNA, 25 bp, Homo sapien
tttttgccatgggttcttcactgac

SEQ ID NO: 175554 - DNA, 25 bp, Homo sapien
cttggactttggcatgattcttagt

SEQ ID NO: 175555 - DNA, 25 bp, Homo sapien
gtcatacttgaacttgtctcattcc

SEQ ID NO: 175556 - DNA, 25 bp, Homo sapien
ttctcagagcaactcttcctttggg

SEQ ID NO: 175557 - DNA, 25 bp, Homo sapien
agagttcttcagatcatagaccaaa

SEQ ID NO: 175558 - DNA, 25 bp, Homo sapien
aagtcataccttcgaggtggtagca

SEQ ID NO: 175559 - DNA, 25 bp, Homo sapien
gagaagggtacttgctaggtatcct

SEQ ID NO: 175560 - DNA, 25 bp, Homo sapien
tcctgggtcagtggcggtgcaaact

SEQ ID NO: 175561 - DNA, 25 bp, Homo sapien
caaactggtttcctcagctgcctgt

SEQ ID NO: 175562 - DNA, 25 bp, Homo sapien
tctgtgtgcttatgtctcttgtgac

SEQ ID NO: 175563 - DNA, 25 bp, Homo sapien
ttgtgacaattgttttcctccctgc

SEQ ID NO: 175564 - DNA, 25 bp, Homo sapien
atattattgctgtggagttctttac

SEQ ID NO: 175565 - DNA, 25 bp, Homo sapien
tgctgtggagttctttacaaagggc

SEQ ID NO: 175566 - DNA, 25 bp, Homo sapien
tacaaagggcttaggctgcatttcc

SEQ ID NO: 175567 - DNA, 25 bp, Homo sapien
ttaggctgcatttccttctatagag

SEQ ID NO: 175568 - DNA, 25 bp, Homo sapien
cttctatagaggtgcattcttgtag

SEQ ID NO: 175569 - DNA, 25 bp, Homo sapien
agcatggtagatcagaaaatcctct

SEQ ID NO: 175570 - DNA, 25 bp, Homo sapien
gaaaatcctcttaggttttaggcag

SEQ ID NO: 175571 - DNA, 25 bp, Homo sapien
taaacattgctttagattttcctaa

SEQ ID NO: 175572 - DNA, 25 bp, Homo sapien
gatttgatctgttagcttccagtaa

SEQ ID NO: 175573 - DNA, 25 bp, Homo sapien
gttgtttatcttttgaatgtctttt

SEQ ID NO: 175574 - DNA, 25 bp, Homo sapien
tgtgaaagctgtccacatttttgct

SEQ ID NO: 175575 - DNA, 25 bp, Homo sapien
attagaaacacaaacactgccttta

SEQ ID NO: 175576 - DNA, 25 bp, Homo sapien
attgtcctttttgatacgaagatgt

SEQ ID NO: 175577 - DNA, 25 bp, Homo sapien
gatacgaagatgtgctttttctaga

SEQ ID NO: 175578 - DNA, 25 bp, Homo sapien
gaagatgtgctttttctagatggaa

SEQ ID NO: 175579 - DNA, 25 bp, Homo sapien
gatgtgtgttattttttggatttgt

SEQ ID NO: 175580 - DNA, 25 bp, Homo sapien
gatatctgtaaagcttgagtatttt

SEQ ID NO: 175581 - DNA, 25 bp, Homo sapien
tgtgatgttcgttttttataattta

SEQ ID NO: 175582 - DNA, 25 bp, Homo sapien
aatatgtacaaaggcacttcgggtc

SEQ ID NO: 175583 - DNA, 25 bp, Homo sapien
gtacaaaggcacttcgggtctatgt

SEQ ID NO: 175584 - DNA, 25 bp, Homo sapien
ggcacttcgggtctatgtgactata

SEQ ID NO: 175585 - DNA, 25 bp, Homo sapien
tcgggtctatgtgactatatttttt

SEQ ID NO: 175586 - DNA, 25 bp, Homo sapien
ggtggcacttttacgatctccaatt

SEQ ID NO: 175587 - DNA, 25 bp, Homo sapien
tctgctattattaacccacctcaag

SEQ ID NO: 175588 - DNA, 25 bp, Homo sapien
ttaacccacctcaagcatgtatttt

SEQ ID NO: 175589 - DNA, 25 bp, Homo sapien
gtattttggcaattggtgcttcaga

SEQ ID NO: 175590 - DNA, 25 bp, Homo sapien
gaggataaactggtccctgcagata

SEQ ID NO: 175591 - DNA, 25 bp, Homo sapien
gtttgatgtggctagcatgatgtct

SEQ ID NO: 175592 - DNA, 25 bp, Homo sapien
gcatgatgtctgttacactcagttg

SEQ ID NO: 175593 - DNA, 25 bp, Homo sapien
cactcagttgtgatcaccgggtggt

SEQ ID NO: 175594 - DNA, 25 bp, Homo sapien
cagtggcttgctgagtttagaaagt

SEQ ID NO: 175595 - DNA, 25 bp, Homo sapien
aaacctatcactatgttgttgtaac

SEQ ID NO: 175596 - DNA, 25 bp, Homo sapien
agaatttctaaactctcccaggtca

SEQ ID NO: 175597 - DNA, 25 bp, Homo sapien
tgggctttgtacgttccttctcatg

SEQ ID NO: 175598 - DNA, 25 bp, Homo sapien
tgtacgttccttctcatgtcactta

SEQ ID NO: 175599 - DNA, 25 bp, Homo sapien
gttccttctcatgtcacttacgtca

SEQ ID NO: 175600 - DNA, 25 bp, Homo sapien
ttctcatgtcacttacgtcactact

SEQ ID NO: 175601 - DNA, 25 bp, Homo sapien
tcatgtcacttacgtcactacttcg

SEQ ID NO: 175602 - DNA, 25 bp, Homo sapien
ttacgtcactacttcgccatcaaat

SEQ ID NO: 175603 - DNA, 25 bp, Homo sapien
cactacttcgccatcaaattgaaca

SEQ ID NO: 175604 - DNA, 25 bp, Homo sapien
aacaagcttttaattagatcctgaa

SEQ ID NO: 175605 - DNA, 25 bp, Homo sapien
tagatcctgaaaattcactatgcta

SEQ ID NO: 175606 - DNA, 25 bp, Homo sapien
ttttttctcatgtaagttgagtgga

SEQ ID NO: 175607 - DNA, 25 bp, Homo sapien
gagtggaatgtggttagttaactga

SEQ ID NO: 175608 - DNA, 25 bp, Homo sapien
gatcctcgcgctggagctgtgtgag

SEQ ID NO: 175609 - DNA, 25 bp, Homo sapien
gatcgtggtctatgggatggtcagc

SEQ ID NO: 175610 - DNA, 25 bp, Homo sapien
gccggctagatgagtgtcagatgta

SEQ ID NO: 175611 - DNA, 25 bp, Homo sapien
gtcagatgtacctggcacacgagca

SEQ ID NO: 175612 - DNA, 25 bp, Homo sapien
tggcacacgagcaggcgccccgaag

SEQ ID NO: 175613 - DNA, 25 bp, Homo sapien
gcccaccgcttcatcactgagaagg

SEQ ID NO: 175614 - DNA, 25 bp, Homo sapien
gcttcatcactgagaaggcggtctt

SEQ ID NO: 175615 - DNA, 25 bp, Homo sapien
agaaggcggtcttctcccgctgggc

SEQ ID NO: 175616 - DNA, 25 bp, Homo sapien
ttctcccgctgggccaagaagaggc

SEQ ID NO: 175617 - DNA, 25 bp, Homo sapien
aggactgagtagcttccgtcgtcct

SEQ ID NO: 175618 - DNA, 25 bp, Homo sapien
tgagtagcttccgtcgtcctgccag

SEQ ID NO: 175619 - DNA, 25 bp, Homo sapien
aaggcagcacagactgccaagtact

SEQ ID NO: 175620 - DNA, 25 bp, Homo sapien
gcagcacagactgccaagtactgtt

SEQ ID NO: 175621 - DNA, 25 bp, Homo sapien
gggatattttttcctgcaacactgg

SEQ ID NO: 175622 - DNA, 25 bp, Homo sapien
ggatattttttcctgcaacactgga

SEQ ID NO: 175623 - DNA, 25 bp, Homo sapien
gttttttaagaagtactcatgcaga

SEQ ID NO: 175624 - DNA, 25 bp, Homo sapien
taagaagtactcatgcagatatata

SEQ ID NO: 175625 - DNA, 25 bp, Homo sapien
aagagacggtctttattgggtctgc

SEQ ID NO: 175626 - DNA, 25 bp, Homo sapien
agacggtctttattgggtctgcacc

SEQ ID NO: 175627 - DNA, 25 bp, Homo sapien
ctgttagtcgggttagagttggctc

SEQ ID NO: 175628 - DNA, 25 bp, Homo sapien
gttagtcgggttagagttggctcta

SEQ ID NO: 175629 - DNA, 25 bp, Homo sapien
agtcgggttagagttggctctacgc

SEQ ID NO: 175630 - DNA, 25 bp, Homo sapien
atgtcaaatgttatggcagggccca

SEQ ID NO: 175631 - DNA, 25 bp, Homo sapien
agggcccaaatagcatagccacaag

SEQ ID NO: 175632 - DNA, 25 bp, Homo sapien
attctaaccaaaccccagacatagg

SEQ ID NO: 175633 - DNA, 25 bp, Homo sapien
ggagtcatttggagaaagcctgtat

SEQ ID NO: 175634 - DNA, 25 bp, Homo sapien
gaagcgaacataaagcgggtcaagt

SEQ ID NO: 175635 - DNA, 25 bp, Homo sapien
gcgggtcaagtgtagtgcatctttt

SEQ ID NO: 175636 - DNA, 25 bp, Homo sapien
atcttttgtatctcaggcgtggctt

SEQ ID NO: 175637 - DNA, 25 bp, Homo sapien
caggcgtggcttcttcagtggacca

SEQ ID NO: 175638 - DNA, 25 bp, Homo sapien
gcagtattgacttgacagagcctct

SEQ ID NO: 175639 - DNA, 25 bp, Homo sapien
agagcctctacttctgtctcaaaat

SEQ ID NO: 175640 - DNA, 25 bp, Homo sapien
tacttctgtctcaaaatggctccaa

SEQ ID NO: 175641 - DNA, 25 bp, Homo sapien
gaagactcagcagcttctcaatccg

SEQ ID NO: 175642 - DNA, 25 bp, Homo sapien
agcagcttctcaatccggtggactg

SEQ ID NO: 175643 - DNA, 25 bp, Homo sapien
aatccggtggactggaacttcgcac

SEQ ID NO: 175644 - DNA, 25 bp, Homo sapien
ggactggaacttcgcacagccagaa

SEQ ID NO: 175645 - DNA, 25 bp, Homo sapien
cagctgctgcggaagaagaggccat

SEQ ID NO: 175646 - DNA, 25 bp, Homo sapien
aagaggccatagctgctccagccgg

SEQ ID NO: 175647 - DNA, 25 bp, Homo sapien
agagctggcacaccgattctgggaa

SEQ ID NO: 175648 - DNA, 25 bp, Homo sapien
accgattctgggaagccccgcgaat

SEQ ID NO: 175649 - DNA, 25 bp, Homo sapien
gccccgcgaatgatggcttttgaat

SEQ ID NO: 175650 - DNA, 25 bp, Homo sapien
gggaaatactaactttctttcgcat

SEQ ID NO: 175651 - DNA, 25 bp, Homo sapien
catattggacccataagaagactca

SEQ ID NO: 175652 - DNA, 25 bp, Homo sapien
actctctgattcatttccagggctt

SEQ ID NO: 175653 - DNA, 25 bp, Homo sapien
agggcttctttgttgcgaccatcta

SEQ ID NO: 175654 - DNA, 25 bp, Homo sapien
gaccatctactgcttctgcaacaat

SEQ ID NO: 175655 - DNA, 25 bp, Homo sapien
atgaggtccaaaccaccgtgaagcg

SEQ ID NO: 175656 - DNA, 25 bp, Homo sapien
tgaagcgccaatgggcccaattcaa

SEQ ID NO: 175657 - DNA, 25 bp, Homo sapien
aaaattcagtggaaccagcgttggg

SEQ ID NO: 175658 - DNA, 25 bp, Homo sapien
ggaggctggcgacatcccaatttac

SEQ ID NO: 175659 - DNA, 25 bp, Homo sapien
atcccaatttacatctgccatcagg

SEQ ID NO: 175660 - DNA, 25 bp, Homo sapien
gaggaatgaaccagccaacaaccaa

SEQ ID NO: 175661 - DNA, 25 bp, Homo sapien
acaaccaaggcgaggagagtgctga

SEQ ID NO: 175662 - DNA, 25 bp, Homo sapien
gagtgctgagatcatccctttgaat

SEQ ID NO: 175663 - DNA, 25 bp, Homo sapien
agcttcaaaaggcagctctcctgaa

SEQ ID NO: 175664 - DNA, 25 bp, Homo sapien
tctcctgaaagcttctcccaaaaaa

SEQ ID NO: 175665 - DNA, 25 bp, Homo sapien
aaagcacctggtactaagggtactg

SEQ ID NO: 175666 - DNA, 25 bp, Homo sapien
ctggtactaagggtactgctgctgc

SEQ ID NO: 175667 - DNA, 25 bp, Homo sapien
gctgctgctgctaaagttccagcaa

SEQ ID NO: 175668 - DNA, 25 bp, Homo sapien
gcaaaaaagatcaccgccgcgagta

SEQ ID NO: 175669 - DNA, 25 bp, Homo sapien
gatcaccgccgcgagtaaaaaggct

SEQ ID NO: 175670 - DNA, 25 bp, Homo sapien
gagtaaaaaggctccagcccagaag

SEQ ID NO: 175671 - DNA, 25 bp, Homo sapien
aaggttcctgcccagaaagccacag

SEQ ID NO: 175672 - DNA, 25 bp, Homo sapien
aaagccacaggccagaaagcagcgc

SEQ ID NO: 175673 - DNA, 25 bp, Homo sapien
agcgcctgctccaaaagctcagaag

SEQ ID NO: 175674 - DNA, 25 bp, Homo sapien
tggaattcaattccacacatggttt

SEQ ID NO: 175675 - DNA, 25 bp, Homo sapien
attccacacatggtttgttcaagca

SEQ ID NO: 175676 - DNA, 25 bp, Homo sapien
catggtttgttcaagcacacttaat

SEQ ID NO: 175677 - DNA, 25 bp, Homo sapien
gcacacttaataagtagcctatttt

SEQ ID NO: 175678 - DNA, 25 bp, Homo sapien
gatatattcatttgctacaccaact

SEQ ID NO: 175679 - DNA, 25 bp, Homo sapien
gctacaccaactatgttttcagaat

SEQ ID NO: 175680 - DNA, 25 bp, Homo sapien
tcagaattcatcttttgaacaactt

SEQ ID NO: 175681 - DNA, 25 bp, Homo sapien
atgactttaaggatcttgtgtatca

SEQ ID NO: 175682 - DNA, 25 bp, Homo sapien
ttgtgtatcaaacctatccccggat

SEQ ID NO: 175683 - DNA, 25 bp, Homo sapien
aacctatccccggatgtgtgagaat

SEQ ID NO: 175684 - DNA, 25 bp, Homo sapien
tccccggatgtgtgagaataatgtg

SEQ ID NO: 175685 - DNA, 25 bp, Homo sapien
aaagttccagcaaaaaagatcaccg

SEQ ID NO: 175686 - DNA, 25 bp, Homo sapien
gttccagcaaaaaagatcaccgccg

SEQ ID NO: 175687 - DNA, 25 bp, Homo sapien
agcaaaaaagatcaccgccgcgagt

SEQ ID NO: 175688 - DNA, 25 bp, Homo sapien
caaaaaagatcaccgccgcgagtaa

SEQ ID NO: 175689 - DNA, 25 bp, Homo sapien
gatcaccgccgcgagtaaaaaggct

SEQ ID NO: 175690 - DNA, 25 bp, Homo sapien
accgccgcgagtaaaaaggctccag

SEQ ID NO: 175691 - DNA, 25 bp, Homo sapien
ccgcgagtaaaaaggctccagccca

SEQ ID NO: 175692 - DNA, 25 bp, Homo sapien
gagtaaaaaggctccagcccagaag

SEQ ID NO: 175693 - DNA, 25 bp, Homo sapien
aagcagcgcctgctccaaaagctca

SEQ ID NO: 175694 - DNA, 25 bp, Homo sapien
agcgcctgctccaaaagctcagaag

SEQ ID NO: 175695 - DNA, 25 bp, Homo sapien
cgcctgctccaaaagctcagaaggg

SEQ ID NO: 175696 - DNA, 25 bp, Homo sapien
gtagactatctagcatgcagagtgt

SEQ ID NO: 175697 - DNA, 25 bp, Homo sapien
catgcagagtgtagtgtgttgaaac

SEQ ID NO: 175698 - DNA, 25 bp, Homo sapien
aacggtgtatgacattgctgtatca

SEQ ID NO: 175699 - DNA, 25 bp, Homo sapien
gtaaaaacctgatcacatagagaat

SEQ ID NO: 175700 - DNA, 25 bp, Homo sapien
ttgtgcttgtgcttcgatctaacca

SEQ ID NO: 175701 - DNA, 25 bp, Homo sapien
tgcttcgatctaaccagcttcttga

SEQ ID NO: 175702 - DNA, 25 bp, Homo sapien
ccccttggtatgcagtgttaatgct

SEQ ID NO: 175703 - DNA, 25 bp, Homo sapien
tgcagtgttaatgctcagggttgaa

SEQ ID NO: 175704 - DNA, 25 bp, Homo sapien
cagggttgaaaatagtacactccaa

SEQ ID NO: 175705 - DNA, 25 bp, Homo sapien
tacactccaatgtctcttttgcaag

SEQ ID NO: 175706 - DNA, 25 bp, Homo sapien
gcaagagtttttcacagaggattac

SEQ ID NO: 175707 - DNA, 25 bp, Homo sapien
ttcttatctcgggacacacacacaa

SEQ ID NO: 175708 - DNA, 25 bp, Homo sapien
cttatctcgggacacacacacaaat

SEQ ID NO: 175709 - DNA, 25 bp, Homo sapien
aatttgaagcatttgagcatgaaaa

SEQ ID NO: 175710 - DNA, 25 bp, Homo sapien
aattctacattaatccaggttctgc

SEQ ID NO: 175711 - DNA, 25 bp, Homo sapien
tctacattaatccaggttctgccac

SEQ ID NO: 175712 - DNA, 25 bp, Homo sapien
gcatataatgccttggaaacaaaca

SEQ ID NO: 175713 - DNA, 25 bp, Homo sapien
cattattccatcatttgtgttgatg

SEQ ID NO: 175714 - DNA, 25 bp, Homo sapien
aggcttctacagtggtcacctatgt

SEQ ID NO: 175715 - DNA, 25 bp, Homo sapien
gtggtcacctatgtgtatcagctaa

SEQ ID NO: 175716 - DNA, 25 bp, Homo sapien
acctatgtgtatcagctaattggag

SEQ ID NO: 175717 - DNA, 25 bp, Homo sapien
ccaggcctgtcttgatgatttttgg

SEQ ID NO: 175718 - DNA, 25 bp, Homo sapien
aggtggcatctctaattggaagaaa

SEQ ID NO: 175719 - DNA, 25 bp, Homo sapien
gaaattcctgtagcatcttctggag

SEQ ID NO: 175720 - DNA, 25 bp, Homo sapien
ctgtagcatcttctggagtctccag

SEQ ID NO: 175721 - DNA, 25 bp, Homo sapien
tggagtctccagtggttgctgttga

SEQ ID NO: 175722 - DNA, 25 bp, Homo sapien
ttgctgttgatgaggcctcttggac

SEQ ID NO: 175723 - DNA, 25 bp, Homo sapien
tgatgaggcctcttggacctctgct

SEQ ID NO: 175724 - DNA, 25 bp, Homo sapien
tggacctctgctctgaggcttccag

SEQ ID NO: 175725 - DNA, 25 bp, Homo sapien
aatcaagctagaaggccacatgtca

SEQ ID NO: 175726 - DNA, 25 bp, Homo sapien
aaggccacatgtcaccgtggacctt

SEQ ID NO: 175727 - DNA, 25 bp, Homo sapien
agtcactgtccctcaaatgacccaa

SEQ ID NO: 175728 - DNA, 25 bp, Homo sapien
tccctcaaatgacccaaagaccaat

SEQ ID NO: 175729 - DNA, 25 bp, Homo sapien
tagaaggatggttgtctcactgttt

SEQ ID NO: 175730 - DNA, 25 bp, Homo sapien
gtgcttctcctaactcaaggacttg

SEQ ID NO: 175731 - DNA, 25 bp, Homo sapien
aggacttggacccatgactctgtag

SEQ ID NO: 175732 - DNA, 25 bp, Homo sapien
gactctgtagccagaagacttcaat

SEQ ID NO: 175733 - DNA, 25 bp, Homo sapien
agaagagccttcacatgaaattagt

SEQ ID NO: 175734 - DNA, 25 bp, Homo sapien
taagagtgtaacatccagctctatg

SEQ ID NO: 175735 - DNA, 25 bp, Homo sapien
atcctggtttgtaatgtttgtcagt

SEQ ID NO: 175736 - DNA, 25 bp, Homo sapien
taaatactcccactatgcctgatgt

SEQ ID NO: 175737 - DNA, 25 bp, Homo sapien
atgcctgatgtgacgctactaacct

SEQ ID NO: 175738 - DNA, 25 bp, Homo sapien
actaacctgacatcaccaagtgtgg

SEQ ID NO: 175739 - DNA, 25 bp, Homo sapien
agcacaatcaacttttctgagctgg

SEQ ID NO: 175740 - DNA, 25 bp, Homo sapien
aggtgttatgtctggctgtagctgt

SEQ ID NO: 175741 - DNA, 25 bp, Homo sapien
tatgtctggctgtagctgttggtca

SEQ ID NO: 175742 - DNA, 25 bp, Homo sapien
gctgtagctgttggtcacgtgaaga

SEQ ID NO: 175743 - DNA, 25 bp, Homo sapien
tgttggtcacgtgaagatgacagac

SEQ ID NO: 175744 - DNA, 25 bp, Homo sapien
gatgacagacgatgagcttgtgtat

SEQ ID NO: 175745 - DNA, 25 bp, Homo sapien
gagcttgtgtataacattcacctgg

SEQ ID NO: 175746 - DNA, 25 bp, Homo sapien
tataacattcacctggctgtcaact

SEQ ID NO: 175747 - DNA, 25 bp, Homo sapien
attcacctggctgtcaacttcttgg

SEQ ID NO: 175748 - DNA, 25 bp, Homo sapien
ctggctgtcaacttcttggtgtcat

SEQ ID NO: 175749 - DNA, 25 bp, Homo sapien
gtcaacttcttggtgtcattgctca

SEQ ID NO: 175750 - DNA, 25 bp, Homo sapien
gtgtcattgctcaagaaaaactggc

SEQ ID NO: 175751 - DNA, 25 bp, Homo sapien
ccttcttcaagcataattacttact

SEQ ID NO: 175752 - DNA, 25 bp, Homo sapien
aattacttactgactttcctccaag

SEQ ID NO: 175753 - DNA, 25 bp, Homo sapien
ctccaagattggcatgatatctttg

SEQ ID NO: 175754 - DNA, 25 bp, Homo sapien
gatatctttgaatttgcttccagat

SEQ ID NO: 175755 - DNA, 25 bp, Homo sapien
ttgcttccagatgcacacttaagtt

SEQ ID NO: 175756 - DNA, 25 bp, Homo sapien
cacacttaagtttgagagcatttga

SEQ ID NO: 175757 - DNA, 25 bp, Homo sapien
ttgagagcatttgagtgtttgtttt

SEQ ID NO: 175758 - DNA, 25 bp, Homo sapien
tgagagaggatcatggacaatgaat

SEQ ID NO: 175759 - DNA, 25 bp, Homo sapien
gaataaatgcacacttctgactata

SEQ ID NO: 175760 - DNA, 25 bp, Homo sapien
gcacacttctgactataattttgag

SEQ ID NO: 175761 - DNA, 25 bp, Homo sapien
ggaaggatgactgcctgttacacag

SEQ ID NO: 175762 - DNA, 25 bp, Homo sapien
gactttcttagcacagtatggtaga

SEQ ID NO: 175763 - DNA, 25 bp, Homo sapien
ataacttaactgctttttgattggg

SEQ ID NO: 175764 - DNA, 25 bp, Homo sapien
tcatttagggcttcaggatcacgat

SEQ ID NO: 175765 - DNA, 25 bp, Homo sapien
agggcttcaggatcacgatttctaa

SEQ ID NO: 175766 - DNA, 25 bp, Homo sapien
tcacgatttctaaacatcagggatc

SEQ ID NO: 175767 - DNA, 25 bp, Homo sapien
acatcagggatcatatggttgcaga

SEQ ID NO: 175768 - DNA, 25 bp, Homo sapien
atggttgcagatgccgatgctataa

SEQ ID NO: 175769 - DNA, 25 bp, Homo sapien
gatgctataagtaatttggccggat

SEQ ID NO: 175770 - DNA, 25 bp, Homo sapien
taatttggccggatgcagctcctaa

SEQ ID NO: 175771 - DNA, 25 bp, Homo sapien
ggccggatgcagctcctaaggtaaa

SEQ ID NO: 175772 - DNA, 25 bp, Homo sapien
gctcctaaggtaaagcagggtactt

SEQ ID NO: 175773 - DNA, 25 bp, Homo sapien
agtgtgccccaggacgacacagcag

SEQ ID NO: 175774 - DNA, 25 bp, Homo sapien
gacacagcagtcaccagaggattgt

SEQ ID NO: 175775 - DNA, 25 bp, Homo sapien
accagaggattgtgacttcaagaag

SEQ ID NO: 175776 - DNA, 25 bp, Homo sapien
gggctcctttgacatcagttgtgat

SEQ ID NO: 175777 - DNA, 25 bp, Homo sapien
taacaagagatttgccctgctgggt

SEQ ID NO: 175778 - DNA, 25 bp, Homo sapien
cctgctgggtgatttcttccggaaa

SEQ ID NO: 175779 - DNA, 25 bp, Homo sapien
gaattgtccagagaatcaaggattt

SEQ ID NO: 175780 - DNA, 25 bp, Homo sapien
attttttgcggaatcttgtacccag

SEQ ID NO: 175781 - DNA, 25 bp, Homo sapien
cggaatcttgtacccaggacagagt

SEQ ID NO: 175782 - DNA, 25 bp, Homo sapien
aggacagagtcctagtgtgtgccct

SEQ ID NO: 175783 - DNA, 25 bp, Homo sapien
tagtgtgtgccctaccctggctcag

SEQ ID NO: 175784 - DNA, 25 bp, Homo sapien
gggctccaggtagcctgcaggttaa

SEQ ID NO: 175785 - DNA, 25 bp, Homo sapien
gcctgcaggttaactggcggtaagt

SEQ ID NO: 175786 - DNA, 25 bp, Homo sapien
tgcaggttaactggcggtaagtgct

SEQ ID NO: 175787 - DNA, 25 bp, Homo sapien
gatgcagtttggcatctgcagtaca

SEQ ID NO: 175788 - DNA, 25 bp, Homo sapien
atctgcagtacaccaagcacatgat

SEQ ID NO: 175789 - DNA, 25 bp, Homo sapien
agtacaccaagcacatgattcatgt

SEQ ID NO: 175790 - DNA, 25 bp, Homo sapien
tgattcatgtctgagccaggtctgc

SEQ ID NO: 175791 - DNA, 25 bp, Homo sapien
gtctgagccaggtctgcttattctc

SEQ ID NO: 175792 - DNA, 25 bp, Homo sapien
aggtctgcttattctcccattgggc

SEQ ID NO: 175793 - DNA, 25 bp, Homo sapien
tattctcccattgggcagctgagga

SEQ ID NO: 175794 - DNA, 25 bp, Homo sapien
tcccattgggcagctgaggaccgag

SEQ ID NO: 175795 - DNA, 25 bp, Homo sapien
aaagagctgaagagcaggccaggaa

SEQ ID NO: 175796 - DNA, 25 bp, Homo sapien
gagaggattcgtatggaaaacattc

SEQ ID NO: 175797 - DNA, 25 bp, Homo sapien
aggattcgtatggaaaacattctga

SEQ ID NO: 175798 - DNA, 25 bp, Homo sapien
aaaacattctgagcggaaaccctct

SEQ ID NO: 175799 - DNA, 25 bp, Homo sapien
attctgagcggaaaccctctcctta

SEQ ID NO: 175800 - DNA, 25 bp, Homo sapien
tctgagcggaaaccctctccttaat

SEQ ID NO: 175801 - DNA, 25 bp, Homo sapien
tgagcggaaaccctctccttaatct

SEQ ID NO: 175802 - DNA, 25 bp, Homo sapien
agcggaaaccctctccttaatctca

SEQ ID NO: 175803 - DNA, 25 bp, Homo sapien
gaaaccctctccttaatctcactgg

SEQ ID NO: 175804 - DNA, 25 bp, Homo sapien
aaaagatttgtaaatgacacactgc

SEQ ID NO: 175805 - DNA, 25 bp, Homo sapien
aaatagtacagttttatgtgcttaa

SEQ ID NO: 175806 - DNA, 25 bp, Homo sapien
gggtctcggtggtaccaggtctcct

SEQ ID NO: 175807 - DNA, 25 bp, Homo sapien
tctcggtggtaccaggtctcctcca

SEQ ID NO: 175808 - DNA, 25 bp, Homo sapien
tgaggcagtgggtcccacttcccct

SEQ ID NO: 175809 - DNA, 25 bp, Homo sapien
acagtcctctccacctagtggctgt

SEQ ID NO: 175810 - DNA, 25 bp, Homo sapien
acctagtggctgtccagtgcccatt

SEQ ID NO: 175811 - DNA, 25 bp, Homo sapien
tagtggctgtccagtgcccattcct

SEQ ID NO: 175812 - DNA, 25 bp, Homo sapien
gtggctgtccagtgcccattcctca

SEQ ID NO: 175813 - DNA, 25 bp, Homo sapien
gcagcttctgccacttcccaggtaa

SEQ ID NO: 175814 - DNA, 25 bp, Homo sapien
tctgccacttcccaggtaagcagga

SEQ ID NO: 175815 - DNA, 25 bp, Homo sapien
tgccacttcccaggtaagcaggagg

SEQ ID NO: 175816 - DNA, 25 bp, Homo sapien
gcaggaggaggtgccaacagtgtta

SEQ ID NO: 175817 - DNA, 25 bp, Homo sapien
cattttcagtattagattcctgtac

SEQ ID NO: 175818 - DNA, 25 bp, Homo sapien
gattcctgtactattgtgttttgag

SEQ ID NO: 175819 - DNA, 25 bp, Homo sapien
tattgtgttttgagtgtgttttgga

SEQ ID NO: 175820 - DNA, 25 bp, Homo sapien
gagtgtgttttggaaccttcataga

SEQ ID NO: 175821 - DNA, 25 bp, Homo sapien
tttggaaccttcatagaacacactt

SEQ ID NO: 175822 - DNA, 25 bp, Homo sapien
gtttaaacattgttttcacctcaat

SEQ ID NO: 175823 - DNA, 25 bp, Homo sapien
aacattgttttcacctcaatgtaga

SEQ ID NO: 175824 - DNA, 25 bp, Homo sapien
gtttactctttataccaaaattcag

SEQ ID NO: 175825 - DNA, 25 bp, Homo sapien
taccaaaattcagtgaaggcattct

SEQ ID NO: 175826 - DNA, 25 bp, Homo sapien
tgaaggcattctacaagttttgagt

SEQ ID NO: 175827 - DNA, 25 bp, Homo sapien
acaagttttgagttagcattacatt

SEQ ID NO: 175828 - DNA, 25 bp, Homo sapien
ctgaagccttttgagaccctgctgt

SEQ ID NO: 175829 - DNA, 25 bp, Homo sapien
tggctgcctggatgcgttccccctg

SEQ ID NO: 175830 - DNA, 25 bp, Homo sapien
ggctgcctggatgcgttccccctgc

SEQ ID NO: 175831 - DNA, 25 bp, Homo sapien
tgcctggatgcgttccccctgctct

SEQ ID NO: 175832 - DNA, 25 bp, Homo sapien
gatgcgttccccctgctctcagcat

SEQ ID NO: 175833 - DNA, 25 bp, Homo sapien
atgcgttccccctgctctcagcata

SEQ ID NO: 175834 - DNA, 25 bp, Homo sapien
tgcgttccccctgctctcagcatat

SEQ ID NO: 175835 - DNA, 25 bp, Homo sapien
gcgttccccctgctctcagcatatg

SEQ ID NO: 175836 - DNA, 25 bp, Homo sapien
cgttccccctgctctcagcatatgt

SEQ ID NO: 175837 - DNA, 25 bp, Homo sapien
ccctgctctcagcatatgtggggcg

SEQ ID NO: 175838 - DNA, 25 bp, Homo sapien
cctgctctcagcatatgtggggcgc

SEQ ID NO: 175839 - DNA, 25 bp, Homo sapien
gatgccggctttattaacaaaaact

SEQ ID NO: 175840 - DNA, 25 bp, Homo sapien
taacaagtcacctccactatgtggg

SEQ ID NO: 175841 - DNA, 25 bp, Homo sapien
acctccactatgtgggtcttccttt

SEQ ID NO: 175842 - DNA, 25 bp, Homo sapien
tcttcctttcccctcaagagaagga

SEQ ID NO: 175843 - DNA, 25 bp, Homo sapien
gaaggagcaattgttcccctgacat

SEQ ID NO: 175844 - DNA, 25 bp, Homo sapien
gcaattgttcccctgacatctgggt

SEQ ID NO: 175845 - DNA, 25 bp, Homo sapien
ctgtgagaaacagtgggtcccttca

SEQ ID NO: 175846 - DNA, 25 bp, Homo sapien
agtgggtcccttcaaatacatagtg

SEQ ID NO: 175847 - DNA, 25 bp, Homo sapien
atagtggatagctcatccctaggaa

SEQ ID NO: 175848 - DNA, 25 bp, Homo sapien
agctcatccctaggaattttcatta

SEQ ID NO: 175849 - DNA, 25 bp, Homo sapien
gaggaaatgctactaatatctgaaa

SEQ ID NO: 175850 - DNA, 25 bp, Homo sapien
tttcttccattataagacagggata

SEQ ID NO: 175851 - DNA, 25 bp, Homo sapien
ggatatacagacatgttaccagcac

SEQ ID NO: 175852 - DNA, 25 bp, Homo sapien
gacatgttaccagcacaaataaaga

SEQ ID NO: 175853 - DNA, 25 bp, Homo sapien
tatcgaaagcttcagacacatgcag

SEQ ID NO: 175854 - DNA, 25 bp, Homo sapien
gacacatgcagtcaaactcactgga

SEQ ID NO: 175855 - DNA, 25 bp, Homo sapien
ttttggattgctgccaatttctggg

SEQ ID NO: 175856 - DNA, 25 bp, Homo sapien
aatggctatttcaggattcttcgag

SEQ ID NO: 175857 - DNA, 25 bp, Homo sapien
atttcaggattcttcgaggagtaaa

SEQ ID NO: 175858 - DNA, 25 bp, Homo sapien
tcgaggagtaaatgagtccgacatt

SEQ ID NO: 175859 - DNA, 25 bp, Homo sapien
gagtccgacattgaaaagttggtta

SEQ ID NO: 175860 - DNA, 25 bp, Homo sapien
gaaaagttggttatcgcagcttggg

SEQ ID NO: 175861 - DNA, 25 bp, Homo sapien
tcttctatattcttactctgtacaa

SEQ ID NO: 175862 - DNA, 25 bp, Homo sapien
tgagaagtttaaccccgttgcttgt

SEQ ID NO: 175863 - DNA, 25 bp, Homo sapien
tgttctgcagccctgtctacttggg

SEQ ID NO: 175864 - DNA, 25 bp, Homo sapien
accacctgttagctgtggttgtgca

SEQ ID NO: 175865 - DNA, 25 bp, Homo sapien
ggttgtgcactgtcttttgtagctc

SEQ ID NO: 175866 - DNA, 25 bp, Homo sapien
gtgcactgtcttttgtagctctgga

SEQ ID NO: 175867 - DNA, 25 bp, Homo sapien
actgtcttttgtagctctggactgg

SEQ ID NO: 175868 - DNA, 25 bp, Homo sapien
gggagtcaattacccatcacataaa

SEQ ID NO: 175869 - DNA, 25 bp, Homo sapien
taaaatacctgactttagagagagt

SEQ ID NO: 175870 - DNA, 25 bp, Homo sapien
gagagtaaaatgtgccaggagccat

SEQ ID NO: 175871 - DNA, 25 bp, Homo sapien
taaaatgtgccaggagccataggaa

SEQ ID NO: 175872 - DNA, 25 bp, Homo sapien
gaaggacctggccacgaaaatcaat

SEQ ID NO: 175873 - DNA, 25 bp, Homo sapien
gacctggccacgaaaatcaatgaga

SEQ ID NO: 175874 - DNA, 25 bp, Homo sapien
gaaaatcaatgagaagccacaggtg

SEQ ID NO: 175875 - DNA, 25 bp, Homo sapien
agccacaggtgatcgcggactatga

SEQ ID NO: 175876 - DNA, 25 bp, Homo sapien
actatgagagcggacgggccatacc

SEQ ID NO: 175877 - DNA, 25 bp, Homo sapien
gagcggacgggccatacccaataac

SEQ ID NO: 175878 - DNA, 25 bp, Homo sapien
ggccatacccaataaccaggtgctt

SEQ ID NO: 175879 - DNA, 25 bp, Homo sapien
tacccaataaccaggtgcttggcaa

SEQ ID NO: 175880 - DNA, 25 bp, Homo sapien
aaccaggtgcttggcaaaatcgagc

SEQ ID NO: 175881 - DNA, 25 bp, Homo sapien
tgcttggcaaaatcgagcgggccat

SEQ ID NO: 175882 - DNA, 25 bp, Homo sapien
tggcaaaatcgagcgggccattggc

SEQ ID NO: 175883 - DNA, 25 bp, Homo sapien
aattcagtgatgtgcctaaataagt

SEQ ID NO: 175884 - DNA, 25 bp, Homo sapien
taggccaatcagaagctaacagcag

SEQ ID NO: 175885 - DNA, 25 bp, Homo sapien
gctaacagcagtttcaggtagaggt

SEQ ID NO: 175886 - DNA, 25 bp, Homo sapien
gaggtgcatgcctaatgttagttag

SEQ ID NO: 175887 - DNA, 25 bp, Homo sapien
tgtagattccatttactgcattctt

SEQ ID NO: 175888 - DNA, 25 bp, Homo sapien
aagtctcaaggtagggtaggcagcc

SEQ ID NO: 175889 - DNA, 25 bp, Homo sapien
gcagcctgagagtctagaggccttt

SEQ ID NO: 175890 - DNA, 25 bp, Homo sapien
gagtctagaggcctttagttataaa

SEQ ID NO: 175891 - DNA, 25 bp, Homo sapien
atctagccagtgaacataattctta

SEQ ID NO: 175892 - DNA, 25 bp, Homo sapien
ttattactagactgccacaaggaag

SEQ ID NO: 175893 - DNA, 25 bp, Homo sapien
gaaattaacttaccctgtatatcag

SEQ ID NO: 175894 - DNA, 25 bp, Homo sapien
acaaaaccagacacttttacattca

SEQ ID NO: 175895 - DNA, 25 bp, Homo sapien
ttacattcatggtccaacagaacac

SEQ ID NO: 175896 - DNA, 25 bp, Homo sapien
aacagaacacatggcctagaggcaa

SEQ ID NO: 175897 - DNA, 25 bp, Homo sapien
gcaatgttgcatataccttaatctt

SEQ ID NO: 175898 - DNA, 25 bp, Homo sapien
gaagcaatatccaaagatctcctga

SEQ ID NO: 175899 - DNA, 25 bp, Homo sapien
gggtcttttcagtcttccctctcct

SEQ ID NO: 175900 - DNA, 25 bp, Homo sapien
ctctcctcaaaccttgtgtagcatt

SEQ ID NO: 175901 - DNA, 25 bp, Homo sapien
agcattgcacaatatagatctcagt

SEQ ID NO: 175902 - DNA, 25 bp, Homo sapien
atagatctcagtcaacattcactga

SEQ ID NO: 175903 - DNA, 25 bp, Homo sapien
gtgagaaacactgtaccatgcctgt

SEQ ID NO: 175904 - DNA, 25 bp, Homo sapien
gaaacactgtaccatgcctgtcatg

SEQ ID NO: 175905 - DNA, 25 bp, Homo sapien
gtatgtaaaaattcctcccttgcca

SEQ ID NO: 175906 - DNA, 25 bp, Homo sapien
gccaggttcctgttatctctaatca

SEQ ID NO: 175907 - DNA, 25 bp, Homo sapien
gttatctctaatcaccaacattttg

SEQ ID NO: 175908 - DNA, 25 bp, Homo sapien
gtattttcaaactagagatggctgt

SEQ ID NO: 175909 - DNA, 25 bp, Homo sapien
ggctgttttggctccaactggagat

SEQ ID NO: 175910 - DNA, 25 bp, Homo sapien
tggagatacttttttcccttcaact

SEQ ID NO: 175911 - DNA, 25 bp, Homo sapien
aactcattttttgactatccctgtg

SEQ ID NO: 175912 - DNA, 25 bp, Homo sapien
tttttcatgaatgggctatcgctac

SEQ ID NO: 175913 - DNA, 25 bp, Homo sapien
tgggctatcgctaccatgtgttttg

SEQ ID NO: 175914 - DNA, 25 bp, Homo sapien
gttcatcacaggtgttgccctgcaa

SEQ ID NO: 175915 - DNA, 25 bp, Homo sapien
tgccctgcaacgtaaacccaagtgt

SEQ ID NO: 175916 - DNA, 25 bp, Homo sapien
atgccacagtatttgtctccatttg

SEQ ID NO: 175917 - DNA, 25 bp, Homo sapien
gcagaataacttgctcatcagagtc

SEQ ID NO: 175918 - DNA, 25 bp, Homo sapien
tgctcatcagagtcacacaacaatt

SEQ ID NO: 175919 - DNA, 25 bp, Homo sapien
aggacacacacccagtaagtctgat

SEQ ID NO: 175920 - DNA, 25 bp, Homo sapien
acacccagtaagtctgatgccagca

SEQ ID NO: 175921 - DNA, 25 bp, Homo sapien
gatgccagcatctgtatttcaacca

SEQ ID NO: 175922 - DNA, 25 bp, Homo sapien
catctgtatttcaaccaccaagcta

SEQ ID NO: 175923 - DNA, 25 bp, Homo sapien
caaccaccaagctatactacttctg

SEQ ID NO: 175924 - DNA, 25 bp, Homo sapien
actacttctgtataatcatttctac

SEQ ID NO: 175925 - DNA, 25 bp, Homo sapien
attgagtagcttgacctaaatgtta

SEQ ID NO: 175926 - DNA, 25 bp, Homo sapien
taaataaggtaggttcacaaaggct

SEQ ID NO: 175927 - DNA, 25 bp, Homo sapien
aaccctcggaagcacaagtttgctg

SEQ ID NO: 175928 - DNA, 25 bp, Homo sapien
gaagccccagcctatgatcaaaaag

SEQ ID NO: 175929 - DNA, 25 bp, Homo sapien
tctttgtccccgacgagcagaagga

SEQ ID NO: 175930 - DNA, 25 bp, Homo sapien
gaaaagtactggacaagacgcaaga

SEQ ID NO: 175931 - DNA, 25 bp, Homo sapien
aagaagaacaacgtggcagctaaac

SEQ ID NO: 175932 - DNA, 25 bp, Homo sapien
gcagctaaacggtcacgggatgccc

SEQ ID NO: 175933 - DNA, 25 bp, Homo sapien
gatgcccggcgcctgaaagagaatc

SEQ ID NO: 175934 - DNA, 25 bp, Homo sapien
gagaatcagatcaccatccgggcag

SEQ ID NO: 175935 - DNA, 25 bp, Homo sapien
tggagaaggagaacacagccctgcg

SEQ ID NO: 175936 - DNA, 25 bp, Homo sapien
aggtgggcaagtgcaagaccatcgt

SEQ ID NO: 175937 - DNA, 25 bp, Homo sapien
aagaccatcgtgtccaagtatgaga

SEQ ID NO: 175938 - DNA, 25 bp, Homo sapien
gaaactgacctttttctgcgaagtt

SEQ ID NO: 175939 - DNA, 25 bp, Homo sapien
actgacctttttctgcgaagttcac

SEQ ID NO: 175940 - DNA, 25 bp, Homo sapien
tgacctttttctgcgaagttcacgt

SEQ ID NO: 175941 - DNA, 25 bp, Homo sapien
ctttttctgcgaagttcacgttaat

SEQ ID NO: 175942 - DNA, 25 bp, Homo sapien
ttctgcgaagttcacgttaatacga

SEQ ID NO: 175943 - DNA, 25 bp, Homo sapien
gcgaagttcacgttaatacgagaaa

SEQ ID NO: 175944 - DNA, 25 bp, Homo sapien
cacgttaatacgagaaatttgatga

SEQ ID NO: 175945 - DNA, 25 bp, Homo sapien
cttttacgttgaatcagatgctttg

SEQ ID NO: 175946 - DNA, 25 bp, Homo sapien
ttacgttgaatcagatgctttgagt

SEQ ID NO: 175947 - DNA, 25 bp, Homo sapien
aaactgtctggactgctgacagtaa

SEQ ID NO: 175948 - DNA, 25 bp, Homo sapien
ctgtctggactgctgacagtaaatt

SEQ ID NO: 175949 - DNA, 25 bp, Homo sapien
ggataatcttctagaagccctacaa

SEQ ID NO: 175950 - DNA, 25 bp, Homo sapien
gaagccctacaatcaggtgcagcat

SEQ ID NO: 175951 - DNA, 25 bp, Homo sapien
gtgcagcattcagagaccgtcgaaa

SEQ ID NO: 175952 - DNA, 25 bp, Homo sapien
gagaccgtcgaaagcggattccaag

SEQ ID NO: 175953 - DNA, 25 bp, Homo sapien
ggaatccagtggtaaatcatccctg

SEQ ID NO: 175954 - DNA, 25 bp, Homo sapien
gtggtaaatcatccctgtgcaacaa

SEQ ID NO: 175955 - DNA, 25 bp, Homo sapien
tcatccctgtgcaacaagggctaat

SEQ ID NO: 175956 - DNA, 25 bp, Homo sapien
aagggctaatccaagatcagctaca

SEQ ID NO: 175957 - DNA, 25 bp, Homo sapien
gatcagctacataaacggcctgagt

SEQ ID NO: 175958 - DNA, 25 bp, Homo sapien
aacggcctgagtgctgttttaaaca

SEQ ID NO: 175959 - DNA, 25 bp, Homo sapien
ggtacaacatgactttttaagataa

SEQ ID NO: 175960 - DNA, 25 bp, Homo sapien
agattccacgaatcctcggcccagg

SEQ ID NO: 175961 - DNA, 25 bp, Homo sapien
attccacgaatcctcggcccaggtt

SEQ ID NO: 175962 - DNA, 25 bp, Homo sapien
tccacgaatcctcggcccaggttta

SEQ ID NO: 175963 - DNA, 25 bp, Homo sapien
ctcggcccaggtttaaataaggcag

SEQ ID NO: 175964 - DNA, 25 bp, Homo sapien
tcggcccaggtttaaataaggcagg

SEQ ID NO: 175965 - DNA, 25 bp, Homo sapien
taaggcaggaaagttcccttccctg

SEQ ID NO: 175966 - DNA, 25 bp, Homo sapien
cctgctcacacacaacgaaaacatg

SEQ ID NO: 175967 - DNA, 25 bp, Homo sapien
tgctcacacacaacgaaaacatggt

SEQ ID NO: 175968 - DNA, 25 bp, Homo sapien
acacacaacgaaaacatggtggcca

SEQ ID NO: 175969 - DNA, 25 bp, Homo sapien
acaacgaaaacatggtggccaaagt

SEQ ID NO: 175970 - DNA, 25 bp, Homo sapien
cgaaaacatggtggccaaagtggat

SEQ ID NO: 175971 - DNA, 25 bp, Homo sapien
gagcggttcctcaccgccgatggca

SEQ ID NO: 175972 - DNA, 25 bp, Homo sapien
taacaagcccttgagtgagaagatg

SEQ ID NO: 175973 - DNA, 25 bp, Homo sapien
tggcatgggcaagcgccggtgtatc

SEQ ID NO: 175974 - DNA, 25 bp, Homo sapien
tcctggccaagtgggagatcttcct

SEQ ID NO: 175975 - DNA, 25 bp, Homo sapien
ggccatcctgctacagcaactggag

SEQ ID NO: 175976 - DNA, 25 bp, Homo sapien
agcaactggagttcagcgtgccgcc

SEQ ID NO: 175977 - DNA, 25 bp, Homo sapien
ccgccgggcgtgaaagtcgacctga

SEQ ID NO: 175978 - DNA, 25 bp, Homo sapien
atctacgggctgaccatgaagcacg

SEQ ID NO: 175979 - DNA, 25 bp, Homo sapien
tgaccatgaagcacgcccgctgtga

SEQ ID NO: 175980 - DNA, 25 bp, Homo sapien
gaagcacgcccgctgtgaacatgtc

SEQ ID NO: 175981 - DNA, 25 bp, Homo sapien
cgctgtgaacatgtccaggcgcggc

SEQ ID NO: 175982 - DNA, 25 bp, Homo sapien
ctgagattctgtaatgtatttgcaa

SEQ ID NO: 175983 - DNA, 25 bp, Homo sapien
gaagctcatattgtatctttttaaa

SEQ ID NO: 175984 - DNA, 25 bp, Homo sapien
aaccatgttgtggaaaaaagccaga

SEQ ID NO: 175985 - DNA, 25 bp, Homo sapien
aaaagccagagtgacaagtgacaaa

SEQ ID NO: 175986 - DNA, 25 bp, Homo sapien
gagtgacaagtgacaaaatctattt

SEQ ID NO: 175987 - DNA, 25 bp, Homo sapien
aaatctatttaggaactctgtgtat

SEQ ID NO: 175988 - DNA, 25 bp, Homo sapien
gaactctgtgtatgaatcctgattt

SEQ ID NO: 175989 - DNA, 25 bp, Homo sapien
gattttaactgctaggattcagcta

SEQ ID NO: 175990 - DNA, 25 bp, Homo sapien
ggattcagctaaatttctgagcttt

SEQ ID NO: 175991 - DNA, 25 bp, Homo sapien
tctgagctttatgatctgtggaaat

SEQ ID NO: 175992 - DNA, 25 bp, Homo sapien
tgaaatcgaattcattttgtacata

SEQ ID NO: 175993 - DNA, 25 bp, Homo sapien
gagttatcaaggcacattctccacc

SEQ ID NO: 175994 - DNA, 25 bp, Homo sapien
ggacatgtcaatcttggtcatccat

SEQ ID NO: 175995 - DNA, 25 bp, Homo sapien
catgacaccacaccggtcatcagag

SEQ ID NO: 175996 - DNA, 25 bp, Homo sapien
accggtcatcagaggaccccagaaa

SEQ ID NO: 175997 - DNA, 25 bp, Homo sapien
aactacccaaatgactctatgtttg

SEQ ID NO: 175998 - DNA, 25 bp, Homo sapien
caaatgactctatgtttgggaatgg

SEQ ID NO: 175999 - DNA, 25 bp, Homo sapien
actgggacgccacgccaagaatgga

SEQ ID NO: 176000 - DNA, 25 bp, Homo sapien
ggacgccacgccaagaatggactgc

SEQ ID NO: 176001 - DNA, 25 bp, Homo sapien
agaatggactgcccaagagccccat

SEQ ID NO: 176002 - DNA, 25 bp, Homo sapien
gacacagcaggttcactccagggac

SEQ ID NO: 176003 - DNA, 25 bp, Homo sapien
tccagggacaagtccacgggcaggt

SEQ ID NO: 176004 - DNA, 25 bp, Homo sapien
gaacaagaaaagttagaacgccaga

SEQ ID NO: 176005 - DNA, 25 bp, Homo sapien
ggataatcttctagaagccctacaa

SEQ ID NO: 176006 - DNA, 25 bp, Homo sapien
aatcttctagaagccctacaatcag

SEQ ID NO: 176007 - DNA, 25 bp, Homo sapien
ttctagaagccctacaatcaggtgc

SEQ ID NO: 176008 - DNA, 25 bp, Homo sapien
gaagccctacaatcaggtgcagcat

SEQ ID NO: 176009 - DNA, 25 bp, Homo sapien
ccctacaatcaggtgcagcattcag

SEQ ID NO: 176010 - DNA, 25 bp, Homo sapien
tcaggtgcagcattcagagaccgtc

SEQ ID NO: 176011 - DNA, 25 bp, Homo sapien
gtgcagcattcagagaccgtcgaaa

SEQ ID NO: 176012 - DNA, 25 bp, Homo sapien
attcagagaccgtcgaaagcggatt

SEQ ID NO: 176013 - DNA, 25 bp, Homo sapien
gagaccgtcgaaagcggattccaag

SEQ ID NO: 176014 - DNA, 25 bp, Homo sapien
cgtcgaaagcggattccaaggaatc

SEQ ID NO: 176015 - DNA, 25 bp, Homo sapien
gaagaagtggaatctaagcgtgcaa

SEQ ID NO: 176016 - DNA, 25 bp, Homo sapien
aagcgtgcaagatgattctcttttc

SEQ ID NO: 176017 - DNA, 25 bp, Homo sapien
gtgcaagatgattctcttttcagat

SEQ ID NO: 176018 - DNA, 25 bp, Homo sapien
tctcttttcagatcttgggaactga

SEQ ID NO: 176019 - DNA, 25 bp, Homo sapien
atttattactaaggtcgtgatgtga

SEQ ID NO: 176020 - DNA, 25 bp, Homo sapien
tcgtgatgtgaatatttgctcagtc

SEQ ID NO: 176021 - DNA, 25 bp, Homo sapien
accttgtcctgcctttttgcagata

SEQ ID NO: 176022 - DNA, 25 bp, Homo sapien
gtcctgcctttttgcagataggctt

SEQ ID NO: 176023 - DNA, 25 bp, Homo sapien
tttcatttggacagctataactgct

SEQ ID NO: 176024 - DNA, 25 bp, Homo sapien
gctataactgctgtgttttttatat

SEQ ID NO: 176025 - DNA, 25 bp, Homo sapien
cagtcctagtatttagccccaaaat

SEQ ID NO: 176026 - DNA, 25 bp, Homo sapien
gtaacaggtcagaatttcaagctct

SEQ ID NO: 176027 - DNA, 25 bp, Homo sapien
caagctctgggtaataactgctgat

SEQ ID NO: 176028 - DNA, 25 bp, Homo sapien
aaatttacctcttttggctatgtct

SEQ ID NO: 176029 - DNA, 25 bp, Homo sapien
gctatgtcttgccaagtgtgtatga

SEQ ID NO: 176030 - DNA, 25 bp, Homo sapien
actttacaactgtctttgatggcat

SEQ ID NO: 176031 - DNA, 25 bp, Homo sapien
gtctttgatggcattttcagaacaa

SEQ ID NO: 176032 - DNA, 25 bp, Homo sapien
ttcctgctactttatcattttcaag

SEQ ID NO: 176033 - DNA, 25 bp, Homo sapien
atcattttcaagatgtcctctagga

SEQ ID NO: 176034 - DNA, 25 bp, Homo sapien
ttgcaatctacctaataagtaccta

SEQ ID NO: 176035 - DNA, 25 bp, Homo sapien
aagtacctaaatacgctgaaatgga

SEQ ID NO: 176036 - DNA, 25 bp, Homo sapien
atatcctactgtgtaacaggtcaga

SEQ ID NO: 176037 - DNA, 25 bp, Homo sapien
aagtcgggaaattctgctgcttgaa

SEQ ID NO: 176038 - DNA, 25 bp, Homo sapien
cttgaaacttcagccctgaaccttt

SEQ ID NO: 176039 - DNA, 25 bp, Homo sapien
ttgtccaccattcctttaaattctc

SEQ ID NO: 176040 - DNA, 25 bp, Homo sapien
taaattctccaacccaaagtattct

SEQ ID NO: 176041 - DNA, 25 bp, Homo sapien
gaagtactggcatcacacgcaggtt

SEQ ID NO: 176042 - DNA, 25 bp, Homo sapien
gcaggttaccttggcgtgtgtccct

SEQ ID NO: 176043 - DNA, 25 bp, Homo sapien
ccctgtggtaccctggcagagaaga

SEQ ID NO: 176044 - DNA, 25 bp, Homo sapien
gaagagaccaagcttgtttccctgc

SEQ ID NO: 176045 - DNA, 25 bp, Homo sapien
ttccctgctggccaaagtcagtagg

SEQ ID NO: 176046 - DNA, 25 bp, Homo sapien
acagtttgctatttgctttagagac

SEQ ID NO: 176047 - DNA, 25 bp, Homo sapien
attggtgcaaagattgcctcttgaa

SEQ ID NO: 176048 - DNA, 25 bp, Homo sapien
aatcaagtaaaaatgtgcacaaatg

SEQ ID NO: 176049 - DNA, 25 bp, Homo sapien
gttaatcagtgatatgctttagtca

SEQ ID NO: 176050 - DNA, 25 bp, Homo sapien
taatcagtgatatgctttagtcaat

SEQ ID NO: 176051 - DNA, 25 bp, Homo sapien
gaataacatggaatcatgctaactt

SEQ ID NO: 176052 - DNA, 25 bp, Homo sapien
acatggaatcatgctaacttatttt

SEQ ID NO: 176053 - DNA, 25 bp, Homo sapien
atggaatcatgctaacttattttca

SEQ ID NO: 176054 - DNA, 25 bp, Homo sapien
ggaatcatgctaacttattttcaaa

SEQ ID NO: 176055 - DNA, 25 bp, Homo sapien
aatcatgctaacttattttcaaagg

SEQ ID NO: 176056 - DNA, 25 bp, Homo sapien
atcatgctaacttattttcaaagga

SEQ ID NO: 176057 - DNA, 25 bp, Homo sapien
attttcaaaggaacactgagcaata

SEQ ID NO: 176058 - DNA, 25 bp, Homo sapien
tttcaaaggaacactgagcaataaa

SEQ ID NO: 176059 - DNA, 25 bp, Homo sapien
cgtcaaggtcgcttccagttttaga

SEQ ID NO: 176060 - DNA, 25 bp, Homo sapien
acagaaatctgcatctcagcctgag

SEQ ID NO: 176061 - DNA, 25 bp, Homo sapien
ctcagcctgagacgcacagagaggt

SEQ ID NO: 176062 - DNA, 25 bp, Homo sapien
agagaggtctcttcctgacccagac

SEQ ID NO: 176063 - DNA, 25 bp, Homo sapien
gacgcactcacgagccaggtcctgg

SEQ ID NO: 176064 - DNA, 25 bp, Homo sapien
gctgggcaggcgacctgctgaccca

SEQ ID NO: 176065 - DNA, 25 bp, Homo sapien
tatttcccgcctccatttgatgttt

SEQ ID NO: 176066 - DNA, 25 bp, Homo sapien
gcctccatttgatgtttccaggttt

SEQ ID NO: 176067 - DNA, 25 bp, Homo sapien
actgcatttaacctgcgccagagag

SEQ ID NO: 176068 - DNA, 25 bp, Homo sapien
aacctgcgccagagagttcaccgta

SEQ ID NO: 176069 - DNA, 25 bp, Homo sapien
gagagttcaccgtaggcatctttaa

SEQ ID NO: 176070 - DNA, 25 bp, Homo sapien
gctctagcagcaaggcagtaacacc

SEQ ID NO: 176071 - DNA, 25 bp, Homo sapien
gcaaggcagtaacaccacaaaagca

SEQ ID NO: 176072 - DNA, 25 bp, Homo sapien
aaccacatgggaaaactcagcactg

SEQ ID NO: 176073 - DNA, 25 bp, Homo sapien
aaactcagcactggtggtggtggca

SEQ ID NO: 176074 - DNA, 25 bp, Homo sapien
tgtgaacactgatgacatggtatag

SEQ ID NO: 176075 - DNA, 25 bp, Homo sapien
ggtgttgagccacccatcagaccct

SEQ ID NO: 176076 - DNA, 25 bp, Homo sapien
atcagaccctctttagctgtgcaag

SEQ ID NO: 176077 - DNA, 25 bp, Homo sapien
gccacaaggccatggttaattctta

SEQ ID NO: 176078 - DNA, 25 bp, Homo sapien
aggccatggttaattcttaaggcaa

SEQ ID NO: 176079 - DNA, 25 bp, Homo sapien
cttaaggcaaggcaaatccatggat

SEQ ID NO: 176080 - DNA, 25 bp, Homo sapien
aaggcaaggcaaatccatggatgag

SEQ ID NO: 176081 - DNA, 25 bp, Homo sapien
gcatctcacacgactttagtttggc

SEQ ID NO: 176082 - DNA, 25 bp, Homo sapien
cacgactttagtttggccaggtatt

SEQ ID NO: 176083 - DNA, 25 bp, Homo sapien
tatttatctgccaaaacaaggacaa

SEQ ID NO: 176084 - DNA, 25 bp, Homo sapien
ggacaaatcttgttgtattaacagc

SEQ ID NO: 176085 - DNA, 25 bp, Homo sapien
gtattaacagcagggtcacttctca

SEQ ID NO: 176086 - DNA, 25 bp, Homo sapien
aacagcagggtcacttctcattttc

SEQ ID NO: 176087 - DNA, 25 bp, Homo sapien
ttctttgctgacttacctttttact

SEQ ID NO: 176088 - DNA, 25 bp, Homo sapien
tacctttttactgaccgttgtgaat

SEQ ID NO: 176089 - DNA, 25 bp, Homo sapien
gaccgttgtgaatttctgtctcaaa

SEQ ID NO: 176090 - DNA, 25 bp, Homo sapien
gttgtgaatttctgtctcaaaatgt

SEQ ID NO: 176091 - DNA, 25 bp, Homo sapien
tttgatacctaatgtaagttttctt

SEQ ID NO: 176092 - DNA, 25 bp, Homo sapien
acctccccatcaatggcaacgggaa

SEQ ID NO: 176093 - DNA, 25 bp, Homo sapien
cctccccatcaatggcaacgggaaa

SEQ ID NO: 176094 - DNA, 25 bp, Homo sapien
ctccccatcaatggcaacgggaaac

SEQ ID NO: 176095 - DNA, 25 bp, Homo sapien
ccccatcaatggcaacgggaaacag

SEQ ID NO: 176096 - DNA, 25 bp, Homo sapien
cccatcaatggcaacgggaaacagt

SEQ ID NO: 176097 - DNA, 25 bp, Homo sapien
ccatcaatggcaacgggaaacagtg

SEQ ID NO: 176098 - DNA, 25 bp, Homo sapien
catcaatggcaacgggaaacagtga

SEQ ID NO: 176099 - DNA, 25 bp, Homo sapien
atcaatggcaacgggaaacagtgag

SEQ ID NO: 176100 - DNA, 25 bp, Homo sapien
caatggcaacgggaaacagtgaggg

SEQ ID NO: 176101 - DNA, 25 bp, Homo sapien
aatggcaacgggaaacagtgagggt

SEQ ID NO: 176102 - DNA, 25 bp, Homo sapien
atggcaacgggaaacagtgagggtt

SEQ ID NO: 176103 - DNA, 25 bp, Homo sapien
tgtgcccttgctctctaacttctga

SEQ ID NO: 176104 - DNA, 25 bp, Homo sapien
tgcccttgctctctaacttctgagc

SEQ ID NO: 176105 - DNA, 25 bp, Homo sapien
acctctttctcttgggtgaggctct

SEQ ID NO: 176106 - DNA, 25 bp, Homo sapien
ttctcttgggtgaggctctggcaag

SEQ ID NO: 176107 - DNA, 25 bp, Homo sapien
aggctctggcaaggagatctctctg

SEQ ID NO: 176108 - DNA, 25 bp, Homo sapien
ggcaaggagatctctctgctcaagc

SEQ ID NO: 176109 - DNA, 25 bp, Homo sapien
aggagatctctctgctcaagcacag

SEQ ID NO: 176110 - DNA, 25 bp, Homo sapien
gatctctctgctcaagcacagcaga

SEQ ID NO: 176111 - DNA, 25 bp, Homo sapien
ggcccctctccatgaattggaactt

SEQ ID NO: 176112 - DNA, 25 bp, Homo sapien
ccctctccatgaattggaacttggt

SEQ ID NO: 176113 - DNA, 25 bp, Homo sapien
tggaacttggtacaggttaagtatc

SEQ ID NO: 176114 - DNA, 25 bp, Homo sapien
acctgagggacatcacagacgaggc

SEQ ID NO: 176115 - DNA, 25 bp, Homo sapien
tgagggacatcacagacgaggcatt

SEQ ID NO: 176116 - DNA, 25 bp, Homo sapien
gagggacatcacagacgaggcattt

SEQ ID NO: 176117 - DNA, 25 bp, Homo sapien
gggacatcacagacgaggcatttaa

SEQ ID NO: 176118 - DNA, 25 bp, Homo sapien
gacatcacagacgaggcatttaagg

SEQ ID NO: 176119 - DNA, 25 bp, Homo sapien
cacagacgaggcatttaaggaccag

SEQ ID NO: 176120 - DNA, 25 bp, Homo sapien
gaagccaagacccaggctgcactgg

SEQ ID NO: 176121 - DNA, 25 bp, Homo sapien
aagccaagacccaggctgcactggt

SEQ ID NO: 176122 - DNA, 25 bp, Homo sapien
cactggtgctggactgcttggagac

SEQ ID NO: 176123 - DNA, 25 bp, Homo sapien
tgctggactgcttggagacccggca

SEQ ID NO: 176124 - DNA, 25 bp, Homo sapien
gactgcttggagacccggcaggagt

SEQ ID NO: 176125 - DNA, 25 bp, Homo sapien
gcgtgtgcggctggcctcagtccga

SEQ ID NO: 176126 - DNA, 25 bp, Homo sapien
cgcgctacggcaaccacgtggtgct

SEQ ID NO: 176127 - DNA, 25 bp, Homo sapien
gcctacgcgggcaagctgctcatca

SEQ ID NO: 176128 - DNA, 25 bp, Homo sapien
ctgctcatcagcctgtcggaggaac

SEQ ID NO: 176129 - DNA, 25 bp, Homo sapien
tcatcagcctgtcggaggaacgcat

SEQ ID NO: 176130 - DNA, 25 bp, Homo sapien
agcctgtcggaggaacgcatcagcg

SEQ ID NO: 176131 - DNA, 25 bp, Homo sapien
gaggaacgcatcagcgcgcaccacg

SEQ ID NO: 176132 - DNA, 25 bp, Homo sapien
gcgcaccacgtgcccaacatggtgg

SEQ ID NO: 176133 - DNA, 25 bp, Homo sapien
aacatggtggccaccgagtgtggct

SEQ ID NO: 176134 - DNA, 25 bp, Homo sapien
accgagtgtggctgccggtgacccc

SEQ ID NO: 176135 - DNA, 25 bp, Homo sapien
gcgccccttcccatatttattcgga

SEQ ID NO: 176136 - DNA, 25 bp, Homo sapien
atgtctaggcctatgctaggaggca

SEQ ID NO: 176137 - DNA, 25 bp, Homo sapien
agcacctgcctctgaatgggaaatc

SEQ ID NO: 176138 - DNA, 25 bp, Homo sapien
tactcagaatgtgtcctcctcatct

SEQ ID NO: 176139 - DNA, 25 bp, Homo sapien
ctcctcatctaatgctcatctgttt

SEQ ID NO: 176140 - DNA, 25 bp, Homo sapien
atctgtttaatggtgatgcctcgcg

SEQ ID NO: 176141 - DNA, 25 bp, Homo sapien
atgcctcgcgtacaggatctggtta

SEQ ID NO: 176142 - DNA, 25 bp, Homo sapien
gtgcagttgtgaatacccagaggtt

SEQ ID NO: 176143 - DNA, 25 bp, Homo sapien
ttgggcagatcagtgtctctagtcc

SEQ ID NO: 176144 - DNA, 25 bp, Homo sapien
tctctagtcctacccagttttaaag

SEQ ID NO: 176145 - DNA, 25 bp, Homo sapien
atggtaagatttgacctcatctccc

SEQ ID NO: 176146 - DNA, 25 bp, Homo sapien
cctcatctcccgcaaataaatgtat

SEQ ID NO: 176147 - DNA, 25 bp, Homo sapien
agatccttgtctggaagtacccctc

SEQ ID NO: 176148 - DNA, 25 bp, Homo sapien
aggtggccaagctgaccgggcactc

SEQ ID NO: 176149 - DNA, 25 bp, Homo sapien
taccgcgtgctgtacctggcaatgt

SEQ ID NO: 176150 - DNA, 25 bp, Homo sapien
tgtacctggcaatgtcccctgatgg

SEQ ID NO: 176151 - DNA, 25 bp, Homo sapien
tgctggagacgagaccctgaggttc

SEQ ID NO: 176152 - DNA, 25 bp, Homo sapien
gaggttctggaacgtctttagcaaa

SEQ ID NO: 176153 - DNA, 25 bp, Homo sapien
tctggaacgtctttagcaaaacccg

SEQ ID NO: 176154 - DNA, 25 bp, Homo sapien
atcgacacgggctcccaagtgtgca

SEQ ID NO: 176155 - DNA, 25 bp, Homo sapien
aagtgtgcaatctggcctggtccaa

SEQ ID NO: 176156 - DNA, 25 bp, Homo sapien
gtccaagcacgccaacgagctggtg

SEQ ID NO: 176157 - DNA, 25 bp, Homo sapien
ccaacgagctggtgagcacgcacgg

SEQ ID NO: 176158 - DNA, 25 bp, Homo sapien
cagtagtcacgggtggtaaccatgt

SEQ ID NO: 176159 - DNA, 25 bp, Homo sapien
cgggtggtaaccatgtagtcaggta

SEQ ID NO: 176160 - DNA, 25 bp, Homo sapien
ccatgtagtcaggtattgttattag

SEQ ID NO: 176161 - DNA, 25 bp, Homo sapien
gttattagtacctatcactgctgag

SEQ ID NO: 176162 - DNA, 25 bp, Homo sapien
agtacctatcactgctgagctgtat

SEQ ID NO: 176163 - DNA, 25 bp, Homo sapien
cactgctgagctgtatttaaaattt

SEQ ID NO: 176164 - DNA, 25 bp, Homo sapien
gcttgatattcaggtactaaccaca

SEQ ID NO: 176165 - DNA, 25 bp, Homo sapien
ggtactaaccacaactagtctgaca

SEQ ID NO: 176166 - DNA, 25 bp, Homo sapien
atagactactgaaatgtcattttag

SEQ ID NO: 176167 - DNA, 25 bp, Homo sapien
atttttcttatgaccacattgtaca

SEQ ID NO: 176168 - DNA, 25 bp, Homo sapien
gaccacattgtacaaatgaatctgt

SEQ ID NO: 176169 - DNA, 25 bp, Homo sapien
aagagggctttcacagtccacaggg

SEQ ID NO: 176170 - DNA, 25 bp, Homo sapien
cacagggttcaaatgacttgggtaa

SEQ ID NO: 176171 - DNA, 25 bp, Homo sapien
attcttagcttacctgttatgtgac

SEQ ID NO: 176172 - DNA, 25 bp, Homo sapien
agtgatttacctgtccatttccaac

SEQ ID NO: 176173 - DNA, 25 bp, Homo sapien
tccaacccaaaagcctgtcagaaag

SEQ ID NO: 176174 - DNA, 25 bp, Homo sapien
ttgttgttaaactcctgatcgctac

SEQ ID NO: 176175 - DNA, 25 bp, Homo sapien
actcctgatcgctactcttaagaat

SEQ ID NO: 176176 - DNA, 25 bp, Homo sapien
aggaacattttttctcaatatttgt

SEQ ID NO: 176177 - DNA, 25 bp, Homo sapien
attcgcttactgttattgtgctgag

SEQ ID NO: 176178 - DNA, 25 bp, Homo sapien
tgctgagtgagctcctgtgtgcttc

SEQ ID NO: 176179 - DNA, 25 bp, Homo sapien
agctcctgtgtgcttcagacaaaaa

SEQ ID NO: 176180 - DNA, 25 bp, Homo sapien
ctgctaatgctgtacaggggctctt

SEQ ID NO: 176181 - DNA, 25 bp, Homo sapien
tgctaatgctgtacaggggctcttg

SEQ ID NO: 176182 - DNA, 25 bp, Homo sapien
gctaatgctgtacaggggctcttgg

SEQ ID NO: 176183 - DNA, 25 bp, Homo sapien
gggttcggctcagctcaacatggct

SEQ ID NO: 176184 - DNA, 25 bp, Homo sapien
ggtgggcacactggcgcccagtaag

SEQ ID NO: 176185 - DNA, 25 bp, Homo sapien
gtgggcacactggcgcccagtaaga

SEQ ID NO: 176186 - DNA, 25 bp, Homo sapien
gggcacactggcgcccagtaagaga

SEQ ID NO: 176187 - DNA, 25 bp, Homo sapien
gcacactggcgcccagtaagagaga

SEQ ID NO: 176188 - DNA, 25 bp, Homo sapien
cacactggcgcccagtaagagagag

SEQ ID NO: 176189 - DNA, 25 bp, Homo sapien
acactggcgcccagtaagagagaga

SEQ ID NO: 176190 - DNA, 25 bp, Homo sapien
cactggcgcccagtaagagagagag

SEQ ID NO: 176191 - DNA, 25 bp, Homo sapien
ttttacctacccgtgcctgagaaag

SEQ ID NO: 176192 - DNA, 25 bp, Homo sapien
gcatacttgacaactgtggactcca

SEQ ID NO: 176193 - DNA, 25 bp, Homo sapien
gatgtaactcatgaatgtctcgatt

SEQ ID NO: 176194 - DNA, 25 bp, Homo sapien
gaatgtctcgattagactccatgta

SEQ ID NO: 176195 - DNA, 25 bp, Homo sapien
tagactccatgtagttacttccttt

SEQ ID NO: 176196 - DNA, 25 bp, Homo sapien
gttacttcctttaaaccatcagccg

SEQ ID NO: 176197 - DNA, 25 bp, Homo sapien
tttaaaccatcagccggccttttat

SEQ ID NO: 176198 - DNA, 25 bp, Homo sapien
ccttttatatgggtcttcactctga

SEQ ID NO: 176199 - DNA, 25 bp, Homo sapien
gggtcttcactctgactagaattta

SEQ ID NO: 176200 - DNA, 25 bp, Homo sapien
gtgtcagcacagtgtaatctctatt

SEQ ID NO: 176201 - DNA, 25 bp, Homo sapien
taatctctattgctattgcccctta

SEQ ID NO: 176202 - DNA, 25 bp, Homo sapien
tgaggcccgatctccactgttgggt

SEQ ID NO: 176203 - DNA, 25 bp, Homo sapien
atctccactgttgggtgggtggcct

SEQ ID NO: 176204 - DNA, 25 bp, Homo sapien
ggaccctgctcacaggcaggctttt

SEQ ID NO: 176205 - DNA, 25 bp, Homo sapien
ttttcctccaacctgtggcgctgca

SEQ ID NO: 176206 - DNA, 25 bp, Homo sapien
cagctgatgaactgtggtgccacat

SEQ ID NO: 176207 - DNA, 25 bp, Homo sapien
ggtgccacatgacccttgtggcaca

SEQ ID NO: 176208 - DNA, 25 bp, Homo sapien
ggcacagatgcccacgtatgtgaaa

SEQ ID NO: 176209 - DNA, 25 bp, Homo sapien
gatgcccacgtatgtgaaacacaca

SEQ ID NO: 176210 - DNA, 25 bp, Homo sapien
gtatgtgaaacacacatggacatgt

SEQ ID NO: 176211 - DNA, 25 bp, Homo sapien
tgtggctggctcacctttgctgagt

SEQ ID NO: 176212 - DNA, 25 bp, Homo sapien
tggctcacctttgctgagttccggg

SEQ ID NO: 176213 - DNA, 25 bp, Homo sapien
tttgtacctggtgaccccttttcag

SEQ ID NO: 176214 - DNA, 25 bp, Homo sapien
tgtacctggtgaccccttttcagct

SEQ ID NO: 176215 - DNA, 25 bp, Homo sapien
acctggtgaccccttttcagcttct

SEQ ID NO: 176216 - DNA, 25 bp, Homo sapien
cctggtgaccccttttcagcttctg

SEQ ID NO: 176217 - DNA, 25 bp, Homo sapien
accgccatggcttccaaggtggtct

SEQ ID NO: 176218 - DNA, 25 bp, Homo sapien
ccgccatggcttccaaggtggtctg

SEQ ID NO: 176219 - DNA, 25 bp, Homo sapien
gccatggcttccaaggtggtctgct

SEQ ID NO: 176220 - DNA, 25 bp, Homo sapien
catggcttccaaggtggtctgctcg

SEQ ID NO: 176221 - DNA, 25 bp, Homo sapien
atggcttccaaggtggtctgctcgg

SEQ ID NO: 176222 - DNA, 25 bp, Homo sapien
gcttccaaggtggtctgctcgggcc

SEQ ID NO: 176223 - DNA, 25 bp, Homo sapien
ttccaaggtggtctgctcgggccca

SEQ ID NO: 176224 - DNA, 25 bp, Homo sapien
cagggtcctaaaacttggatggact

SEQ ID NO: 176225 - DNA, 25 bp, Homo sapien
acttggatggacttgtatagtgaga

SEQ ID NO: 176226 - DNA, 25 bp, Homo sapien
aggcctggaccgagatgtgagtcct

SEQ ID NO: 176227 - DNA, 25 bp, Homo sapien
accgagatgtgagtcctgttgaaga

SEQ ID NO: 176228 - DNA, 25 bp, Homo sapien
ggtccctctcagatacccagtggaa

SEQ ID NO: 176229 - DNA, 25 bp, Homo sapien
gatacccagtggaattccaacttga

SEQ ID NO: 176230 - DNA, 25 bp, Homo sapien
ggaattccaacttgaaggattgcat

SEQ ID NO: 176231 - DNA, 25 bp, Homo sapien
gaacatgcctgccaaagacgtgtcc

SEQ ID NO: 176232 - DNA, 25 bp, Homo sapien
aagacgtgtccgacctacgttcctg

SEQ ID NO: 176233 - DNA, 25 bp, Homo sapien
agactgcccttctcacgggctctat

SEQ ID NO: 176234 - DNA, 25 bp, Homo sapien
cacgggctctatgcctgcactggga

SEQ ID NO: 176235 - DNA, 25 bp, Homo sapien
aatcaagtaaaaatgtgcacaaatg

SEQ ID NO: 176236 - DNA, 25 bp, Homo sapien
ctgcaagcacttctcttcaagaata

SEQ ID NO: 176237 - DNA, 25 bp, Homo sapien
aagcacttctcttcaagaatatgag

SEQ ID NO: 176238 - DNA, 25 bp, Homo sapien
gttaatcagtgatatgctttagtca

SEQ ID NO: 176239 - DNA, 25 bp, Homo sapien
taatcagtgatatgctttagtcaat

SEQ ID NO: 176240 - DNA, 25 bp, Homo sapien
gaataacatggaatcatgctaactt

SEQ ID NO: 176241 - DNA, 25 bp, Homo sapien
catggaatcatgctaacttattttc

SEQ ID NO: 176242 - DNA, 25 bp, Homo sapien
ggaatcatgctaacttattttcaaa

SEQ ID NO: 176243 - DNA, 25 bp, Homo sapien
atcatgctaacttattttcaaagga

SEQ ID NO: 176244 - DNA, 25 bp, Homo sapien
attttcaaaggaacactgagcaata

SEQ ID NO: 176245 - DNA, 25 bp, Homo sapien
tttcaaaggaacactgagcaataaa

SEQ ID NO: 176246 - DNA, 25 bp, Homo sapien
caactacgagcaggcccggaagtga

SEQ ID NO: 176247 - DNA, 25 bp, Homo sapien
aagctggaagacaggatcaggtgcc

SEQ ID NO: 176248 - DNA, 25 bp, Homo sapien
aagacaggatcaggtgccagcggac

SEQ ID NO: 176249 - DNA, 25 bp, Homo sapien
gacaggatcaggtgccagcggacca

SEQ ID NO: 176250 - DNA, 25 bp, Homo sapien
acaggatcaggtgccagcggaccat

SEQ ID NO: 176251 - DNA, 25 bp, Homo sapien
gatcaggtgccagcggaccatcggc

SEQ ID NO: 176252 - DNA, 25 bp, Homo sapien
tgcgcgtgtccactctgatcctgca

SEQ ID NO: 176253 - DNA, 25 bp, Homo sapien
gcgcgtgtccactctgatcctgcat

SEQ ID NO: 176254 - DNA, 25 bp, Homo sapien
gatcctgcatcccactccctgggag

SEQ ID NO: 176255 - DNA, 25 bp, Homo sapien
gacaactacgagcaggcccggaagt

SEQ ID NO: 176256 - DNA, 25 bp, Homo sapien
acaactacgagcaggcccggaagtg

SEQ ID NO: 176257 - DNA, 25 bp, Homo sapien
ctgaagccttttgagaccctgctgt

SEQ ID NO: 176258 - DNA, 25 bp, Homo sapien
aagaccttcattgtgggagaccaga

SEQ ID NO: 176259 - DNA, 25 bp, Homo sapien
gagaccagatctccttcgctgacta

SEQ ID NO: 176260 - DNA, 25 bp, Homo sapien
tgactacaacctgctggacttgctg

SEQ ID NO: 176261 - DNA, 25 bp, Homo sapien
ggacttgctgctgatccatgaggtc

SEQ ID NO: 176262 - DNA, 25 bp, Homo sapien
tgatccatgaggtcctagcccctgg

SEQ ID NO: 176263 - DNA, 25 bp, Homo sapien
tggctgcctggatgcgttccccctg

SEQ ID NO: 176264 - DNA, 25 bp, Homo sapien
cctgctctcagcatatgtggggcgc

SEQ ID NO: 176265 - DNA, 25 bp, Homo sapien
ggcccaagctcaaggccttcctggc

SEQ ID NO: 176266 - DNA, 25 bp, Homo sapien
tggcctcccctgagtacgtgaacct

SEQ ID NO: 176267 - DNA, 25 bp, Homo sapien
gaacctccccatcaatggcaacggg

SEQ ID NO: 176268 - DNA, 25 bp, Homo sapien
cagaatctttgttaaggtcctgaaa

SEQ ID NO: 176269 - DNA, 25 bp, Homo sapien
ggtcctgaaagtaactcataatcta

SEQ ID NO: 176270 - DNA, 25 bp, Homo sapien
gaaatattgctgtatagctcctttt

SEQ ID NO: 176271 - DNA, 25 bp, Homo sapien
tgtatagctccttttgaccttcatt

SEQ ID NO: 176272 - DNA, 25 bp, Homo sapien
gctccttttgaccttcatttcatgt

SEQ ID NO: 176273 - DNA, 25 bp, Homo sapien
atttcatgtatagttttccctattg

SEQ ID NO: 176274 - DNA, 25 bp, Homo sapien
gttttccctattgaatcagtttcca

SEQ ID NO: 176275 - DNA, 25 bp, Homo sapien
gaatcagtttccaattatttgactt

SEQ ID NO: 176276 - DNA, 25 bp, Homo sapien
gtaacttgaacctatgaagcaatgg

SEQ ID NO: 176277 - DNA, 25 bp, Homo sapien
aagcaatggatatttgtactgttta

SEQ ID NO: 176278 - DNA, 25 bp, Homo sapien
gtactgtttaatgttctgtgataca

SEQ ID NO: 176279 - DNA, 25 bp, Homo sapien
tgaaacgagagtacctgcttcagta

SEQ ID NO: 176280 - DNA, 25 bp, Homo sapien
tgcttcagtacaacgatcccaaccg

SEQ ID NO: 176281 - DNA, 25 bp, Homo sapien
gtacaacgatcccaaccgccgaggg

SEQ ID NO: 176282 - DNA, 25 bp, Homo sapien
gaaaatcctgccttgcttcgttggg

SEQ ID NO: 176283 - DNA, 25 bp, Homo sapien
gcttcgttgggcctatgcaagaaca

SEQ ID NO: 176284 - DNA, 25 bp, Homo sapien
taaatgtctatcctaatttcagacc

SEQ ID NO: 176285 - DNA, 25 bp, Homo sapien
gagctctgtgtggatttgggcccct

SEQ ID NO: 176286 - DNA, 25 bp, Homo sapien
ggcccctcatcttcatttattatat

SEQ ID NO: 176287 - DNA, 25 bp, Homo sapien
ttggatcgaacatttcacctctcat

SEQ ID NO: 176288 - DNA, 25 bp, Homo sapien
tcacctctcatattaagtctggcaa

SEQ ID NO: 176289 - DNA, 25 bp, Homo sapien
ggcaatgatgactatatgtattcct

SEQ ID NO: 176290 - DNA, 25 bp, Homo sapien
ggcacttctgcattgctctaggtta

SEQ ID NO: 176291 - DNA, 25 bp, Homo sapien
tctgcattgctctaggttacacaaa

SEQ ID NO: 176292 - DNA, 25 bp, Homo sapien
aggttacacaaacagctgcctcaac

SEQ ID NO: 176293 - DNA, 25 bp, Homo sapien
tcaacccagtcctttatgcatttct

SEQ ID NO: 176294 - DNA, 25 bp, Homo sapien
agtcctttatgcatttctggatgaa

SEQ ID NO: 176295 - DNA, 25 bp, Homo sapien
aaacttcaaacgatgcttcagagag

SEQ ID NO: 176296 - DNA, 25 bp, Homo sapien
agagagttctgtatcccaacctctt

SEQ ID NO: 176297 - DNA, 25 bp, Homo sapien
caacctcttccaacattgagcaaca

SEQ ID NO: 176298 - DNA, 25 bp, Homo sapien
aacaaaactccactcgaattcgtca

SEQ ID NO: 176299 - DNA, 25 bp, Homo sapien
cactcgaattcgtcagaacactaga

SEQ ID NO: 176300 - DNA, 25 bp, Homo sapien
ccctccacggccaatacagtggata

SEQ ID NO: 176301 - DNA, 25 bp, Homo sapien
aaagagctgaagagcaggccaggaa

SEQ ID NO: 176302 - DNA, 25 bp, Homo sapien
gaggattcgtatggaaaacattctg

SEQ ID NO: 176303 - DNA, 25 bp, Homo sapien
aaaacattctgagcggaaaccctct

SEQ ID NO: 176304 - DNA, 25 bp, Homo sapien
attctgagcggaaaccctctcctta

SEQ ID NO: 176305 - DNA, 25 bp, Homo sapien
tctgagcggaaaccctctccttaat

SEQ ID NO: 176306 - DNA, 25 bp, Homo sapien
tgagcggaaaccctctccttaatct

SEQ ID NO: 176307 - DNA, 25 bp, Homo sapien
agcggaaaccctctccttaatctca

SEQ ID NO: 176308 - DNA, 25 bp, Homo sapien
gaaaccctctccttaatctcactgg

SEQ ID NO: 176309 - DNA, 25 bp, Homo sapien
aaaagatttgtaaatgacacactgc

SEQ ID NO: 176310 - DNA, 25 bp, Homo sapien
gacacactgcgatctgaatttcaca

SEQ ID NO: 176311 - DNA, 25 bp, Homo sapien
aaatagtacagttttatgtgcttaa

SEQ ID NO: 176312 - DNA, 25 bp, Homo sapien
tcagtgcccggctggacctcaacgt

SEQ ID NO: 176313 - DNA, 25 bp, Homo sapien
ggctggacctcaacgtccggaacct

SEQ ID NO: 176314 - DNA, 25 bp, Homo sapien
tcaacgtccggaacctctccatgat

SEQ ID NO: 176315 - DNA, 25 bp, Homo sapien
gagatgaaggcagtggacacacagc

SEQ ID NO: 176316 - DNA, 25 bp, Homo sapien
cagtggacacacagcatggagaaat

SEQ ID NO: 176317 - DNA, 25 bp, Homo sapien
tggagaaatccttcgcaatgtcacc

SEQ ID NO: 176318 - DNA, 25 bp, Homo sapien
ggagaaatccttcgcaatgtcacca

SEQ ID NO: 176319 - DNA, 25 bp, Homo sapien
agaaatccttcgcaatgtcaccatc

SEQ ID NO: 176320 - DNA, 25 bp, Homo sapien
aatccttcgcaatgtcaccatccta

SEQ ID NO: 176321 - DNA, 25 bp, Homo sapien
ttcgcaatgtcaccatcctacgagg

SEQ ID NO: 176322 - DNA, 25 bp, Homo sapien
tcgcaatgtcaccatcctacgaggt

SEQ ID NO: 176323 - DNA, 25 bp, Homo sapien
aatacagggcactacagttcagaca

SEQ ID NO: 176324 - DNA, 25 bp, Homo sapien
gggcactacagttcagacaatacaa

SEQ ID NO: 176325 - DNA, 25 bp, Homo sapien
aatacaacaagagcgtccacgaggt

SEQ ID NO: 176326 - DNA, 25 bp, Homo sapien
agcgtccacgaggttaatctaaagg

SEQ ID NO: 176327 - DNA, 25 bp, Homo sapien
aaagggagcatgtttcacagtggct

SEQ ID NO: 176328 - DNA, 25 bp, Homo sapien
cacagtggctggactaccgagagct

SEQ ID NO: 176329 - DNA, 25 bp, Homo sapien
gactaccgagagcttggactacaca

SEQ ID NO: 176330 - DNA, 25 bp, Homo sapien
gagcttggactacacaatacagtat

SEQ ID NO: 176331 - DNA, 25 bp, Homo sapien
gagatctacacatgttgccttgcat

SEQ ID NO: 176332 - DNA, 25 bp, Homo sapien
gttgccttgcatttgtggtaatcta

SEQ ID NO: 176333 - DNA, 25 bp, Homo sapien
acatgtactacagctatatttgatt

SEQ ID NO: 176334 - DNA, 25 bp, Homo sapien
tatagtgttattcatgattcagctg

SEQ ID NO: 176335 - DNA, 25 bp, Homo sapien
catgattcagctgatcttaacaaaa

SEQ ID NO: 176336 - DNA, 25 bp, Homo sapien
cagctgatcttaacaaaattcgtag

SEQ ID NO: 176337 - DNA, 25 bp, Homo sapien
aaattcgtagcagtggaaccttgaa

SEQ ID NO: 176338 - DNA, 25 bp, Homo sapien
tggaaccttgaaatgcatgtggcta

SEQ ID NO: 176339 - DNA, 25 bp, Homo sapien
accttgaaatgcatgtggctagatt

SEQ ID NO: 176340 - DNA, 25 bp, Homo sapien
atgcatgtggctagatttatgctaa

SEQ ID NO: 176341 - DNA, 25 bp, Homo sapien
gatttatgctaaaatgattctcagt

SEQ ID NO: 176342 - DNA, 25 bp, Homo sapien
atctagttaaatttcccatttgtat

SEQ ID NO: 176343 - DNA, 25 bp, Homo sapien
aaaaatcattgcactttggtcagaa

SEQ ID NO: 176344 - DNA, 25 bp, Homo sapien
atcattgcactttggtcagaaaaat

SEQ ID NO: 176345 - DNA, 25 bp, Homo sapien
tgaaggccaagggagtccaggtggt

SEQ ID NO: 176346 - DNA, 25 bp, Homo sapien
tggtggcctgtctgagtgttaatga

SEQ ID NO: 176347 - DNA, 25 bp, Homo sapien
gtggcctgtctgagtgttaatgatg

SEQ ID NO: 176348 - DNA, 25 bp, Homo sapien
gcctgtctgagtgttaatgatgcct

SEQ ID NO: 176349 - DNA, 25 bp, Homo sapien
ctgtctgagtgttaatgatgccttt

SEQ ID NO: 176350 - DNA, 25 bp, Homo sapien
gtctgagtgttaatgatgcctttgt

SEQ ID NO: 176351 - DNA, 25 bp, Homo sapien
tgagtgttaatgatgcctttgtgac

SEQ ID NO: 176352 - DNA, 25 bp, Homo sapien
agtgttaatgatgcctttgtgactg

SEQ ID NO: 176353 - DNA, 25 bp, Homo sapien
ttaatgatgcctttgtgactggcga

SEQ ID NO: 176354 - DNA, 25 bp, Homo sapien
aatgatgcctttgtgactggcgagt

SEQ ID NO: 176355 - DNA, 25 bp, Homo sapien
atgatgcctttgtgactggcgagtg

SEQ ID NO: 176356 - DNA, 25 bp, Homo sapien
ttaactgcatggtgccagtgctaat

SEQ ID NO: 176357 - DNA, 25 bp, Homo sapien
atggtgccagtgctaatgcttcatc

SEQ ID NO: 176358 - DNA, 25 bp, Homo sapien
taatgcttcatcctgttgctggcag

SEQ ID NO: 176359 - DNA, 25 bp, Homo sapien
gcttcatcctgttgctggcagtggg

SEQ ID NO: 176360 - DNA, 25 bp, Homo sapien
cagtgggatgtggacttagaaaatc

SEQ ID NO: 176361 - DNA, 25 bp, Homo sapien
aatcaagttctagcattttagtagg

SEQ ID NO: 176362 - DNA, 25 bp, Homo sapien
aacactgaagttgtggttgttaggt

SEQ ID NO: 176363 - DNA, 25 bp, Homo sapien
atggcagaaccattgctgactttag

SEQ ID NO: 176364 - DNA, 25 bp, Homo sapien
gctgactttaggttcacatgaggaa

SEQ ID NO: 176365 - DNA, 25 bp, Homo sapien
ggttcacatgaggaatgtactttta

SEQ ID NO: 176366 - DNA, 25 bp, Homo sapien
atcactggcttctatgcgcttcttt

SEQ ID NO: 176367 - DNA, 25 bp, Homo sapien
gggagcactatgtccatgtgaacgc

SEQ ID NO: 176368 - DNA, 25 bp, Homo sapien
ctatgtccatgtgaacgctacttat

SEQ ID NO: 176369 - DNA, 25 bp, Homo sapien
gtgaacgctacttatgtgaacgtaa

SEQ ID NO: 176370 - DNA, 25 bp, Homo sapien
atgtgaacgtaaaatgtgtcgctcc

SEQ ID NO: 176371 - DNA, 25 bp, Homo sapien
cagaagataacgctgatgatgaggt

SEQ ID NO: 176372 - DNA, 25 bp, Homo sapien
gcctccttctgggagacatcatagt

SEQ ID NO: 176373 - DNA, 25 bp, Homo sapien
cttctgggagacatcatagtgctag

SEQ ID NO: 176374 - DNA, 25 bp, Homo sapien
tatgtcaaagcaacagtccacactt

SEQ ID NO: 176375 - DNA, 25 bp, Homo sapien
caatggttttttcactgcctgacct

SEQ ID NO: 176376 - DNA, 25 bp, Homo sapien
ttttcactgcctgacctttaaaagg

SEQ ID NO: 176377 - DNA, 25 bp, Homo sapien
aaaaggccatcgatattctttgctc

SEQ ID NO: 176378 - DNA, 25 bp, Homo sapien
agtgcctgccttgggctgtttctga

SEQ ID NO: 176379 - DNA, 25 bp, Homo sapien
tgtggacaccatgaggcttccactt

SEQ ID NO: 176380 - DNA, 25 bp, Homo sapien
gcttccacttcatcagaccatcagt

SEQ ID NO: 176381 - DNA, 25 bp, Homo sapien
ggccctggcatttaggagaacctct

SEQ ID NO: 176382 - DNA, 25 bp, Homo sapien
tttaggagaacctctgtgaacttag

SEQ ID NO: 176383 - DNA, 25 bp, Homo sapien
gaacttaggttcctgttgacccagt

SEQ ID NO: 176384 - DNA, 25 bp, Homo sapien
gacccagtgactttgctttggtgga

SEQ ID NO: 176385 - DNA, 25 bp, Homo sapien
taagtgtcccccaaagggttagctg

SEQ ID NO: 176386 - DNA, 25 bp, Homo sapien
gagatgtcagcagggctagactagc

SEQ ID NO: 176387 - DNA, 25 bp, Homo sapien
gggctagactagctgtgttcttaaa

SEQ ID NO: 176388 - DNA, 25 bp, Homo sapien
ctagctgtgttcttaaatataccat

SEQ ID NO: 176389 - DNA, 25 bp, Homo sapien
tagcgaactttcaccaaagttttca

SEQ ID NO: 176390 - DNA, 25 bp, Homo sapien
ggaaacccacagaataggataaaat

SEQ ID NO: 176391 - DNA, 25 bp, Homo sapien
tgataaaagtcttgtaaccagatac

SEQ ID NO: 176392 - DNA, 25 bp, Homo sapien
gtaaccagatacataaagagctctt

SEQ ID NO: 176393 - DNA, 25 bp, Homo sapien
gatacataaagagctcttacaactc

SEQ ID NO: 176394 - DNA, 25 bp, Homo sapien
caaaagaattgctggatggtatggt

SEQ ID NO: 176395 - DNA, 25 bp, Homo sapien
tttttaccctaactactctgacttg

SEQ ID NO: 176396 - DNA, 25 bp, Homo sapien
ttaccctaactactctgacttgatc

SEQ ID NO: 176397 - DNA, 25 bp, Homo sapien
aactactctgacttgatcatttaac

SEQ ID NO: 176398 - DNA, 25 bp, Homo sapien
ctgacttgatcatttaacattctgt

SEQ ID NO: 176399 - DNA, 25 bp, Homo sapien
gatcatttaacattctgtgtatgta

SEQ ID NO: 176400 - DNA, 25 bp, Homo sapien
ccagcagacaatggccctcctggtg

SEQ ID NO: 176401 - DNA, 25 bp, Homo sapien
tccccggaggcacagcagtgtcatg

SEQ ID NO: 176402 - DNA, 25 bp, Homo sapien
gggctgtctcccctgacaggcacaa

SEQ ID NO: 176403 - DNA, 25 bp, Homo sapien
acaggcacaactccccgggcagaaa

SEQ ID NO: 176404 - DNA, 25 bp, Homo sapien
gggcagaaaacgtgccccaccgcat

SEQ ID NO: 176405 - DNA, 25 bp, Homo sapien
accgcatccctacctggaaactgac

SEQ ID NO: 176406 - DNA, 25 bp, Homo sapien
aaactgaccagcctgcactgtggaa

SEQ ID NO: 176407 - DNA, 25 bp, Homo sapien
gcactgtggaaaagctggccctgtg

SEQ ID NO: 176408 - DNA, 25 bp, Homo sapien
aaaagctggccctgtggcgtgacgg

SEQ ID NO: 176409 - DNA, 25 bp, Homo sapien
atccagactgcgaagctgctctggg

SEQ ID NO: 176410 - DNA, 25 bp, Homo sapien
tgcgaagctgctctgggtctgcacc

SEQ ID NO: 176411 - DNA, 25 bp, Homo sapien
tcctgcaccccaaatatgaacaact

SEQ ID NO: 176412 - DNA, 25 bp, Homo sapien
tatgaacaactgcagcaggtgccac

SEQ ID NO: 176413 - DNA, 25 bp, Homo sapien
actacccttgtaactactgcttctg

SEQ ID NO: 176414 - DNA, 25 bp, Homo sapien
tactgcttctgctacccaaaatatg

SEQ ID NO: 176415 - DNA, 25 bp, Homo sapien
atgaattccaacactgcttccaaga

SEQ ID NO: 176416 - DNA, 25 bp, Homo sapien
ttccaacactgcttccaagagacat

SEQ ID NO: 176417 - DNA, 25 bp, Homo sapien
tgcttccaagagacatttacataaa

SEQ ID NO: 176418 - DNA, 25 bp, Homo sapien
gaaaaattccaaaagtgctgagctt

SEQ ID NO: 176419 - DNA, 25 bp, Homo sapien
aattccaaaagtgctgagctttggg

SEQ ID NO: 176420 - DNA, 25 bp, Homo sapien
gaaaaaacccatgcagacataacat

SEQ ID NO: 176421 - DNA, 25 bp, Homo sapien
acccatgcagacataacatttatac

SEQ ID NO: 176422 - DNA, 25 bp, Homo sapien
ggagcccttctcatagttcaaaaca

SEQ ID NO: 176423 - DNA, 25 bp, Homo sapien
aaatggaagcttttttgcgatctca

SEQ ID NO: 176424 - DNA, 25 bp, Homo sapien
ggaagcttttttgcgatctcagaaa

SEQ ID NO: 176425 - DNA, 25 bp, Homo sapien
gcgatctcagaaagaatgcatcaaa

SEQ ID NO: 176426 - DNA, 25 bp, Homo sapien
attggatcaagatattttggttcct

SEQ ID NO: 176427 - DNA, 25 bp, Homo sapien
ttttggttcctaatgctactgcagc

SEQ ID NO: 176428 - DNA, 25 bp, Homo sapien
gcagcattgcagatgtttcagagaa

SEQ ID NO: 176429 - DNA, 25 bp, Homo sapien
atgctacagttcatagtgtgttctg

SEQ ID NO: 176430 - DNA, 25 bp, Homo sapien
gtgtgttctggtttctaagctatga

SEQ ID NO: 176431 - DNA, 25 bp, Homo sapien
atagattcttccatgagtttacagt

SEQ ID NO: 176432 - DNA, 25 bp, Homo sapien
tgagtttacagttaagtagaccttt

SEQ ID NO: 176433 - DNA, 25 bp, Homo sapien
tgcagcccatttacaccccaaatgg

SEQ ID NO: 176434 - DNA, 25 bp, Homo sapien
taattacacagactgccatatcccc

SEQ ID NO: 176435 - DNA, 25 bp, Homo sapien
atccccaacaacatgcgatactgca

SEQ ID NO: 176436 - DNA, 25 bp, Homo sapien
gatactgcaacagcagcgtgccaga

SEQ ID NO: 176437 - DNA, 25 bp, Homo sapien
gagcactgccatacgtgacagccag

SEQ ID NO: 176438 - DNA, 25 bp, Homo sapien
gaggcccagcgttatcaaggcggac

SEQ ID NO: 176439 - DNA, 25 bp, Homo sapien
aaggcggacaattagactcttgaga

SEQ ID NO: 176440 - DNA, 25 bp, Homo sapien
agactcttgagaacacactcgtgtg

SEQ ID NO: 176441 - DNA, 25 bp, Homo sapien
acactcgtgtgtgcacataaagaca

SEQ ID NO: 176442 - DNA, 25 bp, Homo sapien
gacacgcagattacatttgataaat

SEQ ID NO: 176443 - DNA, 25 bp, Homo sapien
gcatttgtgcatttgaatactctgt

SEQ ID NO: 176444 - DNA, 25 bp, Homo sapien
agaaggtgacgtggcccagcgtcca

SEQ ID NO: 176445 - DNA, 25 bp, Homo sapien
acgtggcccagcgtccaagggacag

SEQ ID NO: 176446 - DNA, 25 bp, Homo sapien
gtccaagggacagactcagctccag

SEQ ID NO: 176447 - DNA, 25 bp, Homo sapien
ctgtgtgcatctttgagggtcctgg

SEQ ID NO: 176448 - DNA, 25 bp, Homo sapien
gtgcatctttgagggtcctgggcca

SEQ ID NO: 176449 - DNA, 25 bp, Homo sapien
atctttgagggtcctgggccaccag

SEQ ID NO: 176450 - DNA, 25 bp, Homo sapien
gggacttggcttccgcagggcaggg

SEQ ID NO: 176451 - DNA, 25 bp, Homo sapien
agggctcaaggctgctctggtgtat

SEQ ID NO: 176452 - DNA, 25 bp, Homo sapien
gggtggtgacccagtcacattggca

SEQ ID NO: 176453 - DNA, 25 bp, Homo sapien
tggcctggcagtatcttgggatagc

SEQ ID NO: 176454 - DNA, 25 bp, Homo sapien
gcctggcagtatcttgggatagcca

SEQ ID NO: 176455 - DNA, 25 bp, Homo sapien
gtgatggtgtgtgaatatccctgct

SEQ ID NO: 176456 - DNA, 25 bp, Homo sapien
gtgtgtgaatatccctgctggctct

SEQ ID NO: 176457 - DNA, 25 bp, Homo sapien
ggcagagcccatgtttcctgacata

SEQ ID NO: 176458 - DNA, 25 bp, Homo sapien
tcctgacatagctctacacctaaat

SEQ ID NO: 176459 - DNA, 25 bp, Homo sapien
ataagggactgaaccctcccaactg

SEQ ID NO: 176460 - DNA, 25 bp, Homo sapien
tcccaactgtgggagctccttaaac

SEQ ID NO: 176461 - DNA, 25 bp, Homo sapien
ctgtgggagctccttaaaccctctg

SEQ ID NO: 176462 - DNA, 25 bp, Homo sapien
gggagcatactgtgtgctctcccca

SEQ ID NO: 176463 - DNA, 25 bp, Homo sapien
ctctgggttcccaagttgaagccta

SEQ ID NO: 176464 - DNA, 25 bp, Homo sapien
gttgaagcctagacttctggctcaa

SEQ ID NO: 176465 - DNA, 25 bp, Homo sapien
tagacttctggctcaaatgaaatag

SEQ ID NO: 176466 - DNA, 25 bp, Homo sapien
gattctacagtaaccaaattggact

SEQ ID NO: 176467 - DNA, 25 bp, Homo sapien
attctacagtaaccaaattggactt

SEQ ID NO: 176468 - DNA, 25 bp, Homo sapien
ttctacagtaaccaaattggacttt

SEQ ID NO: 176469 - DNA, 25 bp, Homo sapien
tctacagtaaccaaattggactttg

SEQ ID NO: 176470 - DNA, 25 bp, Homo sapien
ctacagtaaccaaattggactttga

SEQ ID NO: 176471 - DNA, 25 bp, Homo sapien
tacagtaaccaaattggactttgat

SEQ ID NO: 176472 - DNA, 25 bp, Homo sapien
acagtaaccaaattggactttgatc

SEQ ID NO: 176473 - DNA, 25 bp, Homo sapien
cagtaaccaaattggactttgatct

SEQ ID NO: 176474 - DNA, 25 bp, Homo sapien
agtaaccaaattggactttgatctt

SEQ ID NO: 176475 - DNA, 25 bp, Homo sapien
ccaccacgagcttcttctcttggag

SEQ ID NO: 176476 - DNA, 25 bp, Homo sapien
aattccataccggaggatgctgaag

SEQ ID NO: 176477 - DNA, 25 bp, Homo sapien
gaccctgggccactttaaagagcag

SEQ ID NO: 176478 - DNA, 25 bp, Homo sapien
gggccactttaaagagcagctcagc

SEQ ID NO: 176479 - DNA, 25 bp, Homo sapien
caagcgatgagtttgcctgtggagc

SEQ ID NO: 176480 - DNA, 25 bp, Homo sapien
aggatgagacggtgctcccgatgta

SEQ ID NO: 176481 - DNA, 25 bp, Homo sapien
acggtgctcccgatgtatgaaggcc

SEQ ID NO: 176482 - DNA, 25 bp, Homo sapien
atgaaggccggattctgggcaaagt

SEQ ID NO: 176483 - DNA, 25 bp, Homo sapien
aagtggagcggatcgattgagccct

SEQ ID NO: 176484 - DNA, 25 bp, Homo sapien
ctttggtgaactgttggagcccgaa

SEQ ID NO: 176485 - DNA, 25 bp, Homo sapien
tgttggagcccgaagctcttgtgaa

SEQ ID NO: 176486 - DNA, 25 bp, Homo sapien
agctcttgtgaactgtcttggctgt

SEQ ID NO: 176487 - DNA, 25 bp, Homo sapien
gagggcacggagattcatgctcttc

SEQ ID NO: 176488 - DNA, 25 bp, Homo sapien
ggagattcatgctcttcaatgcctc

SEQ ID NO: 176489 - DNA, 25 bp, Homo sapien
attcatgctcttcaatgcctcagat

SEQ ID NO: 176490 - DNA, 25 bp, Homo sapien
atgctcttcaatgcctcagatcgga

SEQ ID NO: 176491 - DNA, 25 bp, Homo sapien
tgcctcagatcggaagtaacacctg

SEQ ID NO: 176492 - DNA, 25 bp, Homo sapien
gtaacacctgccatttcctgtgaga

SEQ ID NO: 176493 - DNA, 25 bp, Homo sapien
tgccatttcctgtgagagcccattg

SEQ ID NO: 176494 - DNA, 25 bp, Homo sapien
catttcctgtgagagcccattggct

SEQ ID NO: 176495 - DNA, 25 bp, Homo sapien
agcccattggctgacactggttcca

SEQ ID NO: 176496 - DNA, 25 bp, Homo sapien
ggctgacactggttccaaggtccca

SEQ ID NO: 176497 - DNA, 25 bp, Homo sapien
aaactaactacatgggaagcaggaa

SEQ ID NO: 176498 - DNA, 25 bp, Homo sapien
atcttagtgtggaagagctgatttc

SEQ ID NO: 176499 - DNA, 25 bp, Homo sapien
gaatatcaagagtcgtctccctgag

SEQ ID NO: 176500 - DNA, 25 bp, Homo sapien
tcgtctccctgagcctgtagttgga

SEQ ID NO: 176501 - DNA, 25 bp, Homo sapien
gcctgtagttggaagtgacgactgt

SEQ ID NO: 176502 - DNA, 25 bp, Homo sapien
gaagtgacgactgtaatggaatgat

SEQ ID NO: 176503 - DNA, 25 bp, Homo sapien
gtaatggaatgatgtcttgtataga

SEQ ID NO: 176504 - DNA, 25 bp, Homo sapien
cttgtatagaaatgcccttctctga

SEQ ID NO: 176505 - DNA, 25 bp, Homo sapien
agaggctgcgggaagccatcctcca

SEQ ID NO: 176506 - DNA, 25 bp, Homo sapien
tccactcccactgtgtgtgagagca

SEQ ID NO: 176507 - DNA, 25 bp, Homo sapien
cactcccactgtgtgtgagagcagt

SEQ ID NO: 176508 - DNA, 25 bp, Homo sapien
gagccggcgccagtaggaaagacct

SEQ ID NO: 176509 - DNA, 25 bp, Homo sapien
aaaagaagctgctccatttttcatc

SEQ ID NO: 176510 - DNA, 25 bp, Homo sapien
aagaagctgctccatttttcatcat

SEQ ID NO: 176511 - DNA, 25 bp, Homo sapien
agaagctgctccatttttcatcatc

SEQ ID NO: 176512 - DNA, 25 bp, Homo sapien
gaagctgctccatttttcatcatct

SEQ ID NO: 176513 - DNA, 25 bp, Homo sapien
aagctgctccatttttcatcatcta

SEQ ID NO: 176514 - DNA, 25 bp, Homo sapien
agctgctccatttttcatcatctac

SEQ ID NO: 176515 - DNA, 25 bp, Homo sapien
tcatctacccatctatttggaaagc

SEQ ID NO: 176516 - DNA, 25 bp, Homo sapien
atctacccatctatttggaaagcac

SEQ ID NO: 176517 - DNA, 25 bp, Homo sapien
tacccatctatttggaaagcactgg

SEQ ID NO: 176518 - DNA, 25 bp, Homo sapien
taaataatatccacctctccttttt

SEQ ID NO: 176519 - DNA, 25 bp, Homo sapien
aaataatatccacctctcctttttg

SEQ ID NO: 176520 - DNA, 25 bp, Homo sapien
aaacacattatgtatcttagttaca

SEQ ID NO: 176521 - DNA, 25 bp, Homo sapien
gtatcttagttacatttctatcagt

SEQ ID NO: 176522 - DNA, 25 bp, Homo sapien
ttacatttctatcagtacttttatt

SEQ ID NO: 176523 - DNA, 25 bp, Homo sapien
gaagacagcttaatagtagttagct

SEQ ID NO: 176524 - DNA, 25 bp, Homo sapien
gtagttagcttaagtagtttctcca

SEQ ID NO: 176525 - DNA, 25 bp, Homo sapien
gtagtttctccaagtacttttgtgc

SEQ ID NO: 176526 - DNA, 25 bp, Homo sapien
gtttctccaagtacttttgtgctat

SEQ ID NO: 176527 - DNA, 25 bp, Homo sapien
tctccaagtacttttgtgctatcaa

SEQ ID NO: 176528 - DNA, 25 bp, Homo sapien
ttgtgctatcaatgagttcttctca

SEQ ID NO: 176529 - DNA, 25 bp, Homo sapien
gctatcaatgagttcttctcaaaaa

SEQ ID NO: 176530 - DNA, 25 bp, Homo sapien
aataattagttaggccaggcacaat

SEQ ID NO: 176531 - DNA, 25 bp, Homo sapien
tgctgcaacttctcttctctctgga

SEQ ID NO: 176532 - DNA, 25 bp, Homo sapien
ttctcttctctctggacttcggtgt

SEQ ID NO: 176533 - DNA, 25 bp, Homo sapien
ggtgtcctcggctctgaaggcgctc

SEQ ID NO: 176534 - DNA, 25 bp, Homo sapien
ctgaaggcgctctctgcacttagat

SEQ ID NO: 176535 - DNA, 25 bp, Homo sapien
gctctctgcacttagatgctgtcag

SEQ ID NO: 176536 - DNA, 25 bp, Homo sapien
atgctgtcagccctcaacgtaggag

SEQ ID NO: 176537 - DNA, 25 bp, Homo sapien
taagtgattcttctccctggcaagg

SEQ ID NO: 176538 - DNA, 25 bp, Homo sapien
aaggctcttccttttcagggatatc

SEQ ID NO: 176539 - DNA, 25 bp, Homo sapien
ggcttggccctctctgcctgagaga

SEQ ID NO: 176540 - DNA, 25 bp, Homo sapien
gcctgagagagctcagcacacacac

SEQ ID NO: 176541 - DNA, 25 bp, Homo sapien
acacagctcagacccacggacagga

SEQ ID NO: 176542 - DNA, 25 bp, Homo sapien
agctggaagtgccttgttgcctctg

SEQ ID NO: 176543 - DNA, 25 bp, Homo sapien
ctctgccctttgaagtcggaacaat

SEQ ID NO: 176544 - DNA, 25 bp, Homo sapien
tcggaacaattcctagcacctgtcg

SEQ ID NO: 176545 - DNA, 25 bp, Homo sapien
attcctagcacctgtcggaaggtca

SEQ ID NO: 176546 - DNA, 25 bp, Homo sapien
gtcggaaggtcaaggccaaaggcaa

SEQ ID NO: 176547 - DNA, 25 bp, Homo sapien
gccaaaggcaaattcaaggccagac

SEQ ID NO: 176548 - DNA, 25 bp, Homo sapien
aaggccagactgtgacaaacccagg

SEQ ID NO: 176549 - DNA, 25 bp, Homo sapien
atgaagaggctgagccccctgaaac

SEQ ID NO: 176550 - DNA, 25 bp, Homo sapien
tgccccttgttggtacattccagag

SEQ ID NO: 176551 - DNA, 25 bp, Homo sapien
ttgttggtacattccagaggcgcag

SEQ ID NO: 176552 - DNA, 25 bp, Homo sapien
ccttgtcctggatccaacaccaaat

SEQ ID NO: 176553 - DNA, 25 bp, Homo sapien
aaagcgtggttccaagaaagatcca

SEQ ID NO: 176554 - DNA, 25 bp, Homo sapien
gaaagatccaccctcaaatgtcgga

SEQ ID NO: 176555 - DNA, 25 bp, Homo sapien
aaatgtcggagctatgttccctcca

SEQ ID NO: 176556 - DNA, 25 bp, Homo sapien
tggtattaatactgccggtcaccca

SEQ ID NO: 176557 - DNA, 25 bp, Homo sapien
aagccatggcttcgtcatttgcaag

SEQ ID NO: 176558 - DNA, 25 bp, Homo sapien
catttgcaagctgagtgactgtagg

SEQ ID NO: 176559 - DNA, 25 bp, Homo sapien
gtaggcagggaaccttaacctctct

SEQ ID NO: 176560 - DNA, 25 bp, Homo sapien
ggataataatcattccttcccctca

SEQ ID NO: 176561 - DNA, 25 bp, Homo sapien
ttcccctcagagctcttatgtggat

SEQ ID NO: 176562 - DNA, 25 bp, Homo sapien
gagctcttatgtggattaaacgaga

SEQ ID NO: 176563 - DNA, 25 bp, Homo sapien
aagtactttagcctggtacctagca

SEQ ID NO: 176564 - DNA, 25 bp, Homo sapien
gccagtgaacacagtttattccgaa

SEQ ID NO: 176565 - DNA, 25 bp, Homo sapien
agtttattccgaagtgcagtttgct

SEQ ID NO: 176566 - DNA, 25 bp, Homo sapien
ggacagtaaacctcctgggacttca

SEQ ID NO: 176567 - DNA, 25 bp, Homo sapien
tcagtgtttttgttccgtttgttca

SEQ ID NO: 176568 - DNA, 25 bp, Homo sapien
agacaaggtaggattttcccagaag

SEQ ID NO: 176569 - DNA, 25 bp, Homo sapien
cagaaggttcctgcttgaacacctt

SEQ ID NO: 176570 - DNA, 25 bp, Homo sapien
gaacaccttcactaagaacccttat

SEQ ID NO: 176571 - DNA, 25 bp, Homo sapien
taagaacccttatgctgcctcaaag

SEQ ID NO: 176572 - DNA, 25 bp, Homo sapien
tatcatggcttcaaggaacacccag

SEQ ID NO: 176573 - DNA, 25 bp, Homo sapien
ccagccagcagagtccagaatctat

SEQ ID NO: 176574 - DNA, 25 bp, Homo sapien
gaaatcctgcagtccaaggtgcttc

SEQ ID NO: 176575 - DNA, 25 bp, Homo sapien
tatcttatcagcatatcatatccat

SEQ ID NO: 176576 - DNA, 25 bp, Homo sapien
cagcatatcatatccatttcactcc

SEQ ID NO: 176577 - DNA, 25 bp, Homo sapien
atttcactccaacactctgtcttga

SEQ ID NO: 176578 - DNA, 25 bp, Homo sapien
aacactctgtcttgaatttggccct

SEQ ID NO: 176579 - DNA, 25 bp, Homo sapien
tctgtcttgaatttggccctccctc

SEQ ID NO: 176580 - DNA, 25 bp, Homo sapien
tcccctctctactttaattcattgg

SEQ ID NO: 176581 - DNA, 25 bp, Homo sapien
aattcattggagcatgggatttgga

SEQ ID NO: 176582 - DNA, 25 bp, Homo sapien
tttttggttgtgtgatagagttatt

SEQ ID NO: 176583 - DNA, 25 bp, Homo sapien
ctcagttccctcgtatgtaaaatga

SEQ ID NO: 176584 - DNA, 25 bp, Homo sapien
gttccctcgtatgtaaaatgatgat

SEQ ID NO: 176585 - DNA, 25 bp, Homo sapien
atattgtacgaaaagtgcctagcac

SEQ ID NO: 176586 - DNA, 25 bp, Homo sapien
ctggacaaggtcctgctggccgtct

SEQ ID NO: 176587 - DNA, 25 bp, Homo sapien
acaaggtcctgctggccgtctctga

SEQ ID NO: 176588 - DNA, 25 bp, Homo sapien
tgctggccgtctctgaggagtacct

SEQ ID NO: 176589 - DNA, 25 bp, Homo sapien
ggccgtctctgaggagtacctcgac

SEQ ID NO: 176590 - DNA, 25 bp, Homo sapien
tgaggagtacctcgacctccgcctg

SEQ ID NO: 176591 - DNA, 25 bp, Homo sapien
gctcctccagcgattctgtcttcag

SEQ ID NO: 176592 - DNA, 25 bp, Homo sapien
agcgattctgtcttcagccacgacc

SEQ ID NO: 176593 - DNA, 25 bp, Homo sapien
gcagacatgagcaaggctcaaggct

SEQ ID NO: 176594 - DNA, 25 bp, Homo sapien
agcaaggctcaaggctgtgcaggca

SEQ ID NO: 176595 - DNA, 25 bp, Homo sapien
aaggctcaaggctgtgcaggcacat

SEQ ID NO: 176596 - DNA, 25 bp, Homo sapien
tgcaggcacataggctggtggcctt

SEQ ID NO: 176597 - DNA, 25 bp, Homo sapien
gaaatttggactgttgttctgcttt

SEQ ID NO: 176598 - DNA, 25 bp, Homo sapien
gactgttgttctgcttttcctggca

SEQ ID NO: 176599 - DNA, 25 bp, Homo sapien
tgcttttcctggcactcaaattcat

SEQ ID NO: 176600 - DNA, 25 bp, Homo sapien
ctggcactcaaattcatgactagtt

SEQ ID NO: 176601 - DNA, 25 bp, Homo sapien
tcatgactagttttgaggtcaaacc

SEQ ID NO: 176602 - DNA, 25 bp, Homo sapien
gaggtcaaacctatgttcgtaatga

SEQ ID NO: 176603 - DNA, 25 bp, Homo sapien
gaagatataaaaccctagaatgctt

SEQ ID NO: 176604 - DNA, 25 bp, Homo sapien
cctagaatgcttaaatgtgctgtaa

SEQ ID NO: 176605 - DNA, 25 bp, Homo sapien
aaactattgtagatgtcactggatt

SEQ ID NO: 176606 - DNA, 25 bp, Homo sapien
gatgtcactggattttaccaagtaa

SEQ ID NO: 176607 - DNA, 25 bp, Homo sapien
ctgctgtggcttttcagttaaaatt

SEQ ID NO: 176608 - DNA, 25 bp, Homo sapien
atttaacttttctaccatttctgca

SEQ ID NO: 176609 - DNA, 25 bp, Homo sapien
accatttctgcaagttaggtatgtt

SEQ ID NO: 176610 - DNA, 25 bp, Homo sapien
aagtatcaagacgtttaactgcagt

SEQ ID NO: 176611 - DNA, 25 bp, Homo sapien
agacgtttaactgcagttgactttc

SEQ ID NO: 176612 - DNA, 25 bp, Homo sapien
tctccctgttcctttgagtgtcttc

SEQ ID NO: 176613 - DNA, 25 bp, Homo sapien
gttcctttgagtgtcttctaacttt

SEQ ID NO: 176614 - DNA, 25 bp, Homo sapien
gttctttatgtagaattgctgtcta

SEQ ID NO: 176615 - DNA, 25 bp, Homo sapien
attgctgtctatgattgtactttga

SEQ ID NO: 176616 - DNA, 25 bp, Homo sapien
gtgtattatcactgtctgttctgca

SEQ ID NO: 176617 - DNA, 25 bp, Homo sapien
atcactgtctgttctgcacaataaa

SEQ ID NO: 176618 - DNA, 25 bp, Homo sapien
ataaacataacagcctctgtgatcc

SEQ ID NO: 176619 - DNA, 25 bp, Homo sapien
gactttcactatttcgggcgggcgc

SEQ ID NO: 176620 - DNA, 25 bp, Homo sapien
actttcactatttcgggcgggcgcg

SEQ ID NO: 176621 - DNA, 25 bp, Homo sapien
ctttcactatttcgggcgggcgcgg

SEQ ID NO: 176622 - DNA, 25 bp, Homo sapien
tttcactatttcgggcgggcgcggt

SEQ ID NO: 176623 - DNA, 25 bp, Homo sapien
ttcactatttcgggcgggcgcggtg

SEQ ID NO: 176624 - DNA, 25 bp, Homo sapien
tcactatttcgggcgggcgcggtgg

SEQ ID NO: 176625 - DNA, 25 bp, Homo sapien
aaaattatccgggcgcgtggtggag

SEQ ID NO: 176626 - DNA, 25 bp, Homo sapien
aaattatccgggcgcgtggtggagg

SEQ ID NO: 176627 - DNA, 25 bp, Homo sapien
aattatccgggcgcgtggtggaggg

SEQ ID NO: 176628 - DNA, 25 bp, Homo sapien
attatccgggcgcgtggtggagggc

SEQ ID NO: 176629 - DNA, 25 bp, Homo sapien
ttatccgggcgcgtggtggagggcg

SEQ ID NO: 176630 - DNA, 25 bp, Homo sapien
ggtctgaaacagaaaacctcctttg

SEQ ID NO: 176631 - DNA, 25 bp, Homo sapien
agttttctacaatagctacctccca

SEQ ID NO: 176632 - DNA, 25 bp, Homo sapien
ccaagtctgtagtgggagttttctt

SEQ ID NO: 176633 - DNA, 25 bp, Homo sapien
gttttcttatgtggccctcggactt

SEQ ID NO: 176634 - DNA, 25 bp, Homo sapien
tggccctcggactttggcaaagagc

SEQ ID NO: 176635 - DNA, 25 bp, Homo sapien
aaagagcctgcgcaaatgctgtcac

SEQ ID NO: 176636 - DNA, 25 bp, Homo sapien
aatgctgtcaccgatattccagtct

SEQ ID NO: 176637 - DNA, 25 bp, Homo sapien
ttccagtctggatcctagaaaggtt

SEQ ID NO: 176638 - DNA, 25 bp, Homo sapien
agaaaggttcaattctacttcaaca

SEQ ID NO: 176639 - DNA, 25 bp, Homo sapien
acggtaatctgcattttgtctcttt

SEQ ID NO: 176640 - DNA, 25 bp, Homo sapien
gcattttgtctctttgtatcttcag

SEQ ID NO: 176641 - DNA, 25 bp, Homo sapien
atcagattgaccttgattgactgtc

SEQ ID NO: 176642 - DNA, 25 bp, Homo sapien
tgactgtcaggcatggctttgtttc

SEQ ID NO: 176643 - DNA, 25 bp, Homo sapien
tttcaatctgttctcgttccttgta

SEQ ID NO: 176644 - DNA, 25 bp, Homo sapien
ttctcgttccttgtaccggattatt

SEQ ID NO: 176645 - DNA, 25 bp, Homo sapien
ccggattattctactcctgcaatga

SEQ ID NO: 176646 - DNA, 25 bp, Homo sapien
tgcaatgaaccctgttgacaccgga

SEQ ID NO: 176647 - DNA, 25 bp, Homo sapien
ctgttgacaccggatttagctcttg

SEQ ID NO: 176648 - DNA, 25 bp, Homo sapien
atttagctcttgtcggccttcgtgg

SEQ ID NO: 176649 - DNA, 25 bp, Homo sapien
aactgggcttgtcacattgtattgt

SEQ ID NO: 176650 - DNA, 25 bp, Homo sapien
tactgcaagtaaaacctactcccca

SEQ ID NO: 176651 - DNA, 25 bp, Homo sapien
tactccccaaaaatgtgtggctttg

SEQ ID NO: 176652 - DNA, 25 bp, Homo sapien
agtcaccatacacactgttgtcaaa

SEQ ID NO: 176653 - DNA, 25 bp, Homo sapien
gttccatttttaaccccatttgcat

SEQ ID NO: 176654 - DNA, 25 bp, Homo sapien
ttaaccccatttgcattaatattgc

SEQ ID NO: 176655 - DNA, 25 bp, Homo sapien
tattgcagtcaatctctttacctcc

SEQ ID NO: 176656 - DNA, 25 bp, Homo sapien
tgacagtgacgcctttccccaaaac

SEQ ID NO: 176657 - DNA, 25 bp, Homo sapien
agtatgtatccccacttatctcggg

SEQ ID NO: 176658 - DNA, 25 bp, Homo sapien
gaaatgcaaccaactgctgctgtgc

SEQ ID NO: 176659 - DNA, 25 bp, Homo sapien
gtgcacatttatgaatcacagtatt

SEQ ID NO: 176660 - DNA, 25 bp, Homo sapien
atcacagtattgtttagtcggttct

SEQ ID NO: 176661 - DNA, 25 bp, Homo sapien
agtcggttctgtatctccagtagaa

SEQ ID NO: 176662 - DNA, 25 bp, Homo sapien
gatgacctttgtctcacctcatagc

SEQ ID NO: 176663 - DNA, 25 bp, Homo sapien
gactattttattcaggttgatctgt

SEQ ID NO: 176664 - DNA, 25 bp, Homo sapien
caggttgatctgttgaatatttgct

SEQ ID NO: 176665 - DNA, 25 bp, Homo sapien
gaatatttgctaaagaccagttctt

SEQ ID NO: 176666 - DNA, 25 bp, Homo sapien
aagaccagttctttaagctaagaca

SEQ ID NO: 176667 - DNA, 25 bp, Homo sapien
aatcccaaatggcagtacctcattg

SEQ ID NO: 176668 - DNA, 25 bp, Homo sapien
ggcagtacctcattgtttacttagc

SEQ ID NO: 176669 - DNA, 25 bp, Homo sapien
gtttacttagcttttgtacttatat

SEQ ID NO: 176670 - DNA, 25 bp, Homo sapien
acactactgtaaattgtgaatagcc

SEQ ID NO: 176671 - DNA, 25 bp, Homo sapien
gtgaatagccaatacataactgtat

SEQ ID NO: 176672 - DNA, 25 bp, Homo sapien
atctgtgattgttggcagtgtcatc

SEQ ID NO: 176673 - DNA, 25 bp, Homo sapien
ttggcagtgtcatctctgagaaaca

SEQ ID NO: 176674 - DNA, 25 bp, Homo sapien
tgagttggaaagctcgtcctctgca

SEQ ID NO: 176675 - DNA, 25 bp, Homo sapien
gtcctctgcagtcctacaaagatac

SEQ ID NO: 176676 - DNA, 25 bp, Homo sapien
aagatacagcaaggatatacccagt

SEQ ID NO: 176677 - DNA, 25 bp, Homo sapien
tatacccagttggtcaagtggtgaa

SEQ ID NO: 176678 - DNA, 25 bp, Homo sapien
gggagcccgatgacgctgaactagt

SEQ ID NO: 176679 - DNA, 25 bp, Homo sapien
gacgctgaactagtaaggctcagta

SEQ ID NO: 176680 - DNA, 25 bp, Homo sapien
agaacgcggtgctcaaggctgtcca

SEQ ID NO: 176681 - DNA, 25 bp, Homo sapien
tgctcaaggctgtccagcagtatct

SEQ ID NO: 176682 - DNA, 25 bp, Homo sapien
gtgaaaaccgaagcagctgatcaga

SEQ ID NO: 176683 - DNA, 25 bp, Homo sapien
gcagctgatcagaatggcaatgaca

SEQ ID NO: 176684 - DNA, 25 bp, Homo sapien
aacaggaaatgagcccggaacgcag

SEQ ID NO: 176685 - DNA, 25 bp, Homo sapien
agtcagcatctccaattttcagcag

SEQ ID NO: 176686 - DNA, 25 bp, Homo sapien
agcatctccaattttcagcagctca

SEQ ID NO: 176687 - DNA, 25 bp, Homo sapien
catctccaattttcagcagctcaag

SEQ ID NO: 176688 - DNA, 25 bp, Homo sapien
atctccaattttcagcagctcaaga

SEQ ID NO: 176689 - DNA, 25 bp, Homo sapien
cccacaggacttcgcagatgtcaca

SEQ ID NO: 176690 - DNA, 25 bp, Homo sapien
acaggacttcgcagatgtcacattg

SEQ ID NO: 176691 - DNA, 25 bp, Homo sapien
ggacttcgcagatgtcacattgccc

SEQ ID NO: 176692 - DNA, 25 bp, Homo sapien
ttcgcagatgtcacattgcccctca

SEQ ID NO: 176693 - DNA, 25 bp, Homo sapien
gcagatgtcacattgcccctcagtc

SEQ ID NO: 176694 - DNA, 25 bp, Homo sapien
tcagtcccctgaatgcccttcggac

SEQ ID NO: 176695 - DNA, 25 bp, Homo sapien
gcgcggtgggaacgagctgctggcc

SEQ ID NO: 176696 - DNA, 25 bp, Homo sapien
tgcctccgatgttccccatgcagcc

SEQ ID NO: 176697 - DNA, 25 bp, Homo sapien
tcccatgcttcctgatctgactctg

SEQ ID NO: 176698 - DNA, 25 bp, Homo sapien
ccatgcttcctgatctgactctgga

SEQ ID NO: 176699 - DNA, 25 bp, Homo sapien
catgcttcctgatctgactctggaa

SEQ ID NO: 176700 - DNA, 25 bp, Homo sapien
gggaatgaatacttcagatgctttc

SEQ ID NO: 176701 - DNA, 25 bp, Homo sapien
gaatgaatacttcagatgctttcag

SEQ ID NO: 176702 - DNA, 25 bp, Homo sapien
gaatacttcagatgctttcaggagt

SEQ ID NO: 176703 - DNA, 25 bp, Homo sapien
aatacttcagatgctttcaggagtg

SEQ ID NO: 176704 - DNA, 25 bp, Homo sapien
tacttcagatgctttcaggagtgac

SEQ ID NO: 176705 - DNA, 25 bp, Homo sapien
ctttcaggagtgacacaagaacaca

SEQ ID NO: 176706 - DNA, 25 bp, Homo sapien
ggagtgacacaagaacacaatgatt

SEQ ID NO: 176707 - DNA, 25 bp, Homo sapien
gggagcccgatgacgctgaactagt

SEQ ID NO: 176708 - DNA, 25 bp, Homo sapien
gcccgatgacgctgaactagtaagg

SEQ ID NO: 176709 - DNA, 25 bp, Homo sapien
gacgctgaactagtaaggctcagta

SEQ ID NO: 176710 - DNA, 25 bp, Homo sapien
tagtaaggctcagtaagaggctggt

SEQ ID NO: 176711 - DNA, 25 bp, Homo sapien
agaacgcggtgctcaaggctgtcca

SEQ ID NO: 176712 - DNA, 25 bp, Homo sapien
acgcggtgctcaaggctgtccagca

SEQ ID NO: 176713 - DNA, 25 bp, Homo sapien
gtgaaaaccgaagcagctgatcaga

SEQ ID NO: 176714 - DNA, 25 bp, Homo sapien
accgaagcagctgatcagaatggca

SEQ ID NO: 176715 - DNA, 25 bp, Homo sapien
gcagctgatcagaatggcaatgaca

SEQ ID NO: 176716 - DNA, 25 bp, Homo sapien
atggcaatgacaatgagaacaacag

SEQ ID NO: 176717 - DNA, 25 bp, Homo sapien
aacaggaaatgagcccggaacgcag

SEQ ID NO: 176718 - DNA, 25 bp, Homo sapien
gaactgttcgtactagaattcaagg

SEQ ID NO: 176719 - DNA, 25 bp, Homo sapien
ctgttcgtactagaattcaaggaga

SEQ ID NO: 176720 - DNA, 25 bp, Homo sapien
aagctgctccatttttcatcatcta

SEQ ID NO: 176721 - DNA, 25 bp, Homo sapien
ttcagatgcaagagaacaatgtttc

SEQ ID NO: 176722 - DNA, 25 bp, Homo sapien
atgcaagagaacaatgtttcttcag

SEQ ID NO: 176723 - DNA, 25 bp, Homo sapien
aatgtagccctgcatcctccagtgt

SEQ ID NO: 176724 - DNA, 25 bp, Homo sapien
ctgcatcctccagtgttacctggtg

SEQ ID NO: 176725 - DNA, 25 bp, Homo sapien
ttctgtacctttctaaacctctctt

SEQ ID NO: 176726 - DNA, 25 bp, Homo sapien
ttttgtgtttaaacagtcatcttct

SEQ ID NO: 176727 - DNA, 25 bp, Homo sapien
aataatatccacctctcctttttgc

SEQ ID NO: 176728 - DNA, 25 bp, Homo sapien
cctttttgccatttcacttattgat

SEQ ID NO: 176729 - DNA, 25 bp, Homo sapien
aggagaggaagagccgcacactttt

SEQ ID NO: 176730 - DNA, 25 bp, Homo sapien
gatctcgtgagaagctactccctcc

SEQ ID NO: 176731 - DNA, 25 bp, Homo sapien
gtgagaagctactccctccgcagca

SEQ ID NO: 176732 - DNA, 25 bp, Homo sapien
ccaccgccgattctgaggatgacaa

SEQ ID NO: 176733 - DNA, 25 bp, Homo sapien
tctgaggatgacaattccacatgag

SEQ ID NO: 176734 - DNA, 25 bp, Homo sapien
acatccaaactatattgtcaacctt

SEQ ID NO: 176735 - DNA, 25 bp, Homo sapien
actatattgtcaaccttctacacag

SEQ ID NO: 176736 - DNA, 25 bp, Homo sapien
acacagccaatgacttaacagcctc

SEQ ID NO: 176737 - DNA, 25 bp, Homo sapien
acagcctcattagaagttacagaaa

SEQ ID NO: 176738 - DNA, 25 bp, Homo sapien
caataaagttcggacaatgcagaga

SEQ ID NO: 176739 - DNA, 25 bp, Homo sapien
ttcggacaatgcagagaggtcacct

SEQ ID NO: 176740 - DNA, 25 bp, Homo sapien
ctgggccagtactgagggacctgcc

SEQ ID NO: 176741 - DNA, 25 bp, Homo sapien
tactgagggacctgcccctgggttc

SEQ ID NO: 176742 - DNA, 25 bp, Homo sapien
tgggttcccaccatggcagggagat

SEQ ID NO: 176743 - DNA, 25 bp, Homo sapien
gggtggctttaccaccacagagatg

SEQ ID NO: 176744 - DNA, 25 bp, Homo sapien
gctttaccaccacagagatggccca

SEQ ID NO: 176745 - DNA, 25 bp, Homo sapien
ggcattgtgccaggagagtaatatt

SEQ ID NO: 176746 - DNA, 25 bp, Homo sapien
ccaggagagtaatatttaggccatg

SEQ ID NO: 176747 - DNA, 25 bp, Homo sapien
atatttaggccatgtattctccaat

SEQ ID NO: 176748 - DNA, 25 bp, Homo sapien
ttaggccatgtattctccaatttcc

SEQ ID NO: 176749 - DNA, 25 bp, Homo sapien
ggccatgtattctccaatttcctac

SEQ ID NO: 176750 - DNA, 25 bp, Homo sapien
catgtattctccaatttcctacaga

SEQ ID NO: 176751 - DNA, 25 bp, Homo sapien
agaatttcataagagccatgctgtt

SEQ ID NO: 176752 - DNA, 25 bp, Homo sapien
gagccatgctgttgggcaaagcaac

SEQ ID NO: 176753 - DNA, 25 bp, Homo sapien
aagcaactctttttcaaccactgct

SEQ ID NO: 176754 - DNA, 25 bp, Homo sapien
accactgctcatcagtttctgtaga

SEQ ID NO: 176755 - DNA, 25 bp, Homo sapien
aatcatttgttacttaagtctgtga

SEQ ID NO: 176756 - DNA, 25 bp, Homo sapien
gtatgcatttataagtgttccatgg

SEQ ID NO: 176757 - DNA, 25 bp, Homo sapien
gtgttccatggaatcagtttttatt

SEQ ID NO: 176758 - DNA, 25 bp, Homo sapien
tattgtatcgatataattgtctcta

SEQ ID NO: 176759 - DNA, 25 bp, Homo sapien
gtctctaagtgttgactgtcttcat

SEQ ID NO: 176760 - DNA, 25 bp, Homo sapien
gtgttgactgtcttcattgcaatat

SEQ ID NO: 176761 - DNA, 25 bp, Homo sapien
aaatgtccatgttccataattacta

SEQ ID NO: 176762 - DNA, 25 bp, Homo sapien
gcgggtggattacctccatctgttt

SEQ ID NO: 176763 - DNA, 25 bp, Homo sapien
cgggtggattacctccatctgttta

SEQ ID NO: 176764 - DNA, 25 bp, Homo sapien
gggtggattacctccatctgtttag

SEQ ID NO: 176765 - DNA, 25 bp, Homo sapien
ggtggattacctccatctgtttagt

SEQ ID NO: 176766 - DNA, 25 bp, Homo sapien
tggattacctccatctgtttagtag

SEQ ID NO: 176767 - DNA, 25 bp, Homo sapien
ggattacctccatctgtttagtaga

SEQ ID NO: 176768 - DNA, 25 bp, Homo sapien
gattacctccatctgtttagtagaa

SEQ ID NO: 176769 - DNA, 25 bp, Homo sapien
attacctccatctgtttagtagaaa

SEQ ID NO: 176770 - DNA, 25 bp, Homo sapien
tacctccatctgtttagtagaaatg

SEQ ID NO: 176771 - DNA, 25 bp, Homo sapien
catctgtttagtagaaatgggcaaa

SEQ ID NO: 176772 - DNA, 25 bp, Homo sapien
tagtagaaatgggcaaaaccccatc

SEQ ID NO: 176773 - DNA, 25 bp, Homo sapien
gaaagctaatgctagtatatactgc

SEQ ID NO: 176774 - DNA, 25 bp, Homo sapien
gaacatgttttcctactgcattggg

SEQ ID NO: 176775 - DNA, 25 bp, Homo sapien
gggacttctagataggttaatgaaa

SEQ ID NO: 176776 - DNA, 25 bp, Homo sapien
aggccttttattctgttactggaca

SEQ ID NO: 176777 - DNA, 25 bp, Homo sapien
ctgttactggacatgaaaactttgt

SEQ ID NO: 176778 - DNA, 25 bp, Homo sapien
ctaatttcttactctattgtacgtt

SEQ ID NO: 176779 - DNA, 25 bp, Homo sapien
ttgtacgtttacagtcgcagcacta

SEQ ID NO: 176780 - DNA, 25 bp, Homo sapien
tacagtcgcagcactaaaaatggat

SEQ ID NO: 176781 - DNA, 25 bp, Homo sapien
ggatgacatcaaacatttttaacaa

SEQ ID NO: 176782 - DNA, 25 bp, Homo sapien
gataatgttttgctactcttgtcag

SEQ ID NO: 176783 - DNA, 25 bp, Homo sapien
gttttgctactcttgtcagacaatg

SEQ ID NO: 176784 - DNA, 25 bp, Homo sapien
gggacagacaaggtgcctgttatat

SEQ ID NO: 176785 - DNA, 25 bp, Homo sapien
aaggtgcctgttatatatttactca

SEQ ID NO: 176786 - DNA, 25 bp, Homo sapien
atatttactcagtctttgccctgaa

SEQ ID NO: 176787 - DNA, 25 bp, Homo sapien
agtctttgccctgaatggtctcagc

SEQ ID NO: 176788 - DNA, 25 bp, Homo sapien
ggtctcagcttgagaccatttcaaa

SEQ ID NO: 176789 - DNA, 25 bp, Homo sapien
cagggatttctgtttactgtcaaaa

SEQ ID NO: 176790 - DNA, 25 bp, Homo sapien
gtcaaaatatttctcatctgcacta

SEQ ID NO: 176791 - DNA, 25 bp, Homo sapien
ttctcatctgcactatgtttccatt

SEQ ID NO: 176792 - DNA, 25 bp, Homo sapien
atgtttccatttgtggtcctgaagg

SEQ ID NO: 176793 - DNA, 25 bp, Homo sapien
ggaaattcttataactcaacatttg

SEQ ID NO: 176794 - DNA, 25 bp, Homo sapien
ctcaacatttgtctggtcttataag

SEQ ID NO: 176795 - DNA, 25 bp, Homo sapien
agctgtgcggacctttgccctgacc

SEQ ID NO: 176796 - DNA, 25 bp, Homo sapien
tggccttgcagtgatccttgacttc

SEQ ID NO: 176797 - DNA, 25 bp, Homo sapien
ttgacttcctcctgcagatgtcagc

SEQ ID NO: 176798 - DNA, 25 bp, Homo sapien
ctgggccagtactgagggacctgcc

SEQ ID NO: 176799 - DNA, 25 bp, Homo sapien
tactgagggacctgcccctgggttc

SEQ ID NO: 176800 - DNA, 25 bp, Homo sapien
tgggttcccaccatggcagggagat

SEQ ID NO: 176801 - DNA, 25 bp, Homo sapien
gtggctttaccaccacagagatggc

SEQ ID NO: 176802 - DNA, 25 bp, Homo sapien
ggcattgtgccaggagagtaatatt

SEQ ID NO: 176803 - DNA, 25 bp, Homo sapien
ccaggagagtaatatttaggccatg

SEQ ID NO: 176804 - DNA, 25 bp, Homo sapien
ttaggccatgtattctccaatttcc

SEQ ID NO: 176805 - DNA, 25 bp, Homo sapien
catgtattctccaatttcctacaga

SEQ ID NO: 176806 - DNA, 25 bp, Homo sapien
gagaggcacttaatctgtaaccccc

SEQ ID NO: 176807 - DNA, 25 bp, Homo sapien
gtgccttttgtaggctgttcccttt

SEQ ID NO: 176808 - DNA, 25 bp, Homo sapien
tgccttaaacctgaagatgtctcct

SEQ ID NO: 176809 - DNA, 25 bp, Homo sapien
tgcccagattcccagaccttaagac

SEQ ID NO: 176810 - DNA, 25 bp, Homo sapien
gattcccagaccttaagacactgtg

SEQ ID NO: 176811 - DNA, 25 bp, Homo sapien
agacactgtgagagttgtctctgtt

SEQ ID NO: 176812 - DNA, 25 bp, Homo sapien
agagttgtctctgttggtccactgt

SEQ ID NO: 176813 - DNA, 25 bp, Homo sapien
gttggtccactgtgtttagttgcaa

SEQ ID NO: 176814 - DNA, 25 bp, Homo sapien
gtgtttagttgcaaggatttttcca

SEQ ID NO: 176815 - DNA, 25 bp, Homo sapien
taaagggtgcccatttgtgatcagc

SEQ ID NO: 176816 - DNA, 25 bp, Homo sapien
ggtgcccatttgtgatcagcattgt

SEQ ID NO: 176817 - DNA, 25 bp, Homo sapien
gcaagcacaggacgcactggacgcc

SEQ ID NO: 176818 - DNA, 25 bp, Homo sapien
aggacgcactggacgccctgtgcaa

SEQ ID NO: 176819 - DNA, 25 bp, Homo sapien
ggctgacattgcctgcaaggccaac

SEQ ID NO: 176820 - DNA, 25 bp, Homo sapien
gcaaggccaactccatgctgctgga

SEQ ID NO: 176821 - DNA, 25 bp, Homo sapien
tgctggacaccaagtgcatggacac

SEQ ID NO: 176822 - DNA, 25 bp, Homo sapien
aagtgcatggacacgcggcgcaagc

SEQ ID NO: 176823 - DNA, 25 bp, Homo sapien
tgcctgctgagaggttcgtgcctga

SEQ ID NO: 176824 - DNA, 25 bp, Homo sapien
gaggtggacaccttcacacgtacca

SEQ ID NO: 176825 - DNA, 25 bp, Homo sapien
acgtaccacaaatagcaccctgagt

SEQ ID NO: 176826 - DNA, 25 bp, Homo sapien
aaatagcaccctgagtccactcaaa

SEQ ID NO: 176827 - DNA, 25 bp, Homo sapien
gagtccactcaaaagctgccagctg

SEQ ID NO: 176828 - DNA, 25 bp, Homo sapien
cacctggcagaaaatctacttctac

SEQ ID NO: 176829 - DNA, 25 bp, Homo sapien
acctggcagaaaatctacttctaca

SEQ ID NO: 176830 - DNA, 25 bp, Homo sapien
atctacttctacagttggggctgac

SEQ ID NO: 176831 - DNA, 25 bp, Homo sapien
tctacttctacagttggggctgaca

SEQ ID NO: 176832 - DNA, 25 bp, Homo sapien
acttctacagttggggctgacagac

SEQ ID NO: 176833 - DNA, 25 bp, Homo sapien
ctacagttggggctgacagacctcc

SEQ ID NO: 176834 - DNA, 25 bp, Homo sapien
acagttggggctgacagacctcccg

SEQ ID NO: 176835 - DNA, 25 bp, Homo sapien
gttggggctgacagacctcccggaa

SEQ ID NO: 176836 - DNA, 25 bp, Homo sapien
ttggggctgacagacctcccggaag

SEQ ID NO: 176837 - DNA, 25 bp, Homo sapien
gggctgacagacctcccggaaggag

SEQ ID NO: 176838 - DNA, 25 bp, Homo sapien
ggctgacagacctcccggaaggagg

SEQ ID NO: 176839 - DNA, 25 bp, Homo sapien
gacctctggccttgcagtgatcctt

SEQ ID NO: 176840 - DNA, 25 bp, Homo sapien
cctctggccttgcagtgatccttga

SEQ ID NO: 176841 - DNA, 25 bp, Homo sapien
tctggccttgcagtgatccttgact

SEQ ID NO: 176842 - DNA, 25 bp, Homo sapien
ctggccttgcagtgatccttgactt

SEQ ID NO: 176843 - DNA, 25 bp, Homo sapien
tggccttgcagtgatccttgacttc

SEQ ID NO: 176844 - DNA, 25 bp, Homo sapien
gccttgcagtgatccttgacttcct

SEQ ID NO: 176845 - DNA, 25 bp, Homo sapien
ttgcagtgatccttgacttcctcct

SEQ ID NO: 176846 - DNA, 25 bp, Homo sapien
tgcagtgatccttgacttcctcctg

SEQ ID NO: 176847 - DNA, 25 bp, Homo sapien
cttgacttcctcctgcagatgtcag

SEQ ID NO: 176848 - DNA, 25 bp, Homo sapien
ttgacttcctcctgcagatgtcagc

SEQ ID NO: 176849 - DNA, 25 bp, Homo sapien
acttcctcctgcagatgtcagcctt

SEQ ID NO: 176850 - DNA, 25 bp, Homo sapien
gaagtacctggtcttagcatctgga

SEQ ID NO: 176851 - DNA, 25 bp, Homo sapien
agtacctggtcttagcatctggaca

SEQ ID NO: 176852 - DNA, 25 bp, Homo sapien
gcatctggacagacctcttattagc

SEQ ID NO: 176853 - DNA, 25 bp, Homo sapien
tggacagacctcttattagctcttc

SEQ ID NO: 176854 - DNA, 25 bp, Homo sapien
gacctcttattagctcttcgtagtg

SEQ ID NO: 176855 - DNA, 25 bp, Homo sapien
tagctcttcgtagtggtgcatttag

SEQ ID NO: 176856 - DNA, 25 bp, Homo sapien
cgtagtggtgcatttaggaaaagac

SEQ ID NO: 176857 - DNA, 25 bp, Homo sapien
gttttgggtctcagcgcaggcctca

SEQ ID NO: 176858 - DNA, 25 bp, Homo sapien
agcgcaggcctcagttctgtatagg

SEQ ID NO: 176859 - DNA, 25 bp, Homo sapien
gcaggcctcagttctgtataggcaa

SEQ ID NO: 176860 - DNA, 25 bp, Homo sapien
gttctgtataggcaatgctgtgtta

SEQ ID NO: 176861 - DNA, 25 bp, Homo sapien
ttaggcacatgtacttttccctgtt

SEQ ID NO: 176862 - DNA, 25 bp, Homo sapien
tctactttctattctccgtgttttt

SEQ ID NO: 176863 - DNA, 25 bp, Homo sapien
ttctccgtgtttttatcacacctgc

SEQ ID NO: 176864 - DNA, 25 bp, Homo sapien
cccatcagtccctttggttaattct

SEQ ID NO: 176865 - DNA, 25 bp, Homo sapien
tcagtccctttggttaattcttact

SEQ ID NO: 176866 - DNA, 25 bp, Homo sapien
cttacttcctgttcatctctaaagt

SEQ ID NO: 176867 - DNA, 25 bp, Homo sapien
ttcctgttcatctctaaagtgttaa

SEQ ID NO: 176868 - DNA, 25 bp, Homo sapien
aatatcacaaatcctactactcaga

SEQ ID NO: 176869 - DNA, 25 bp, Homo sapien
cctactactcagaaataggtggtca

SEQ ID NO: 176870 - DNA, 25 bp, Homo sapien
ggtcacattacatcagacatctctt

SEQ ID NO: 176871 - DNA, 25 bp, Homo sapien
agacatctctttatgcatgtgcatt

SEQ ID NO: 176872 - DNA, 25 bp, Homo sapien
agctataccagctatttagggaata

SEQ ID NO: 176873 - DNA, 25 bp, Homo sapien
tatttttccctgtttgcctataggt

SEQ ID NO: 176874 - DNA, 25 bp, Homo sapien
ttccctgtttgcctataggtggagg

SEQ ID NO: 176875 - DNA, 25 bp, Homo sapien
taggtggaggtatcctgtgtgtctt

SEQ ID NO: 176876 - DNA, 25 bp, Homo sapien
tggaggtatcctgtgtgtctttttt

SEQ ID NO: 176877 - DNA, 25 bp, Homo sapien
ttttttacttatgccgtctcatatt

SEQ ID NO: 176878 - DNA, 25 bp, Homo sapien
tatgccgtctcatatttttacaaat

SEQ ID NO: 176879 - DNA, 25 bp, Homo sapien
gtactatatgtatatctttgcactg

SEQ ID NO: 176880 - DNA, 25 bp, Homo sapien
gtatatctttgcactgaagttgtct

SEQ ID NO: 176881 - DNA, 25 bp, Homo sapien
cactgaagttgtctgaaggtaatac

SEQ ID NO: 176882 - DNA, 25 bp, Homo sapien
tggaaagattatcctgttactgaat

SEQ ID NO: 176883 - DNA, 25 bp, Homo sapien
gtctaccgctttgccactgatagga

SEQ ID NO: 176884 - DNA, 25 bp, Homo sapien
ctttgccactgataggaatgacttc

SEQ ID NO: 176885 - DNA, 25 bp, Homo sapien
gaatgacttccggaggaacttgata

SEQ ID NO: 176886 - DNA, 25 bp, Homo sapien
gaacttgatactaaatttgggactc

SEQ ID NO: 176887 - DNA, 25 bp, Homo sapien
aaatttgggactctttgctgcggga

SEQ ID NO: 176888 - DNA, 25 bp, Homo sapien
ctggccaggaacttgagtgacattg

SEQ ID NO: 176889 - DNA, 25 bp, Homo sapien
agtgacattgacctcatggcacctc

SEQ ID NO: 176890 - DNA, 25 bp, Homo sapien
aatggaatcctgtgctgaacccgaa

SEQ ID NO: 176891 - DNA, 25 bp, Homo sapien
gtgctgaacccgaatcttccaaaaa

SEQ ID NO: 176892 - DNA, 25 bp, Homo sapien
atggcttccagcactgtcccggtga

SEQ ID NO: 176893 - DNA, 25 bp, Homo sapien
actgtcccggtgagcgctgctggct

SEQ ID NO: 176894 - DNA, 25 bp, Homo sapien
tttaagactttcactatttcgggcg

SEQ ID NO: 176895 - DNA, 25 bp, Homo sapien
ttaagactttcactatttcgggcgg

SEQ ID NO: 176896 - DNA, 25 bp, Homo sapien
taagactttcactatttcgggcggg

SEQ ID NO: 176897 - DNA, 25 bp, Homo sapien
gactttcactatttcgggcgggcgc

SEQ ID NO: 176898 - DNA, 25 bp, Homo sapien
actttcactatttcgggcgggcgcg

SEQ ID NO: 176899 - DNA, 25 bp, Homo sapien
tttcactatttcgggcgggcgcggt

SEQ ID NO: 176900 - DNA, 25 bp, Homo sapien
ttcactatttcgggcgggcgcggtg

SEQ ID NO: 176901 - DNA, 25 bp, Homo sapien
tcactatttcgggcgggcgcggtgg

SEQ ID NO: 176902 - DNA, 25 bp, Homo sapien
aaaattatccgggcgcgtggtggag

SEQ ID NO: 176903 - DNA, 25 bp, Homo sapien
aattatccgggcgcgtggtggaggg

SEQ ID NO: 176904 - DNA, 25 bp, Homo sapien
ttatccgggcgcgtggtggagggcg

SEQ ID NO: 176905 - DNA, 25 bp, Homo sapien
ggaaataagcaccagtgagctgcga

SEQ ID NO: 176906 - DNA, 25 bp, Homo sapien
gcaccagtgagctgcgagaggctat

SEQ ID NO: 176907 - DNA, 25 bp, Homo sapien
ctatgaggaagctcctgggtcatca

SEQ ID NO: 176908 - DNA, 25 bp, Homo sapien
gtcatcaggtgggacaccgagacat

SEQ ID NO: 176909 - DNA, 25 bp, Homo sapien
gacaccgagacatagaggaaattat

SEQ ID NO: 176910 - DNA, 25 bp, Homo sapien
ttatccgagatgtggacctcaatgg

SEQ ID NO: 176911 - DNA, 25 bp, Homo sapien
agagtttgtccggatgatgtcccgc

SEQ ID NO: 176912 - DNA, 25 bp, Homo sapien
gtccggatgatgtcccgctgaggcc

SEQ ID NO: 176913 - DNA, 25 bp, Homo sapien
aggactgccaagctcccaaaggcgg

SEQ ID NO: 176914 - DNA, 25 bp, Homo sapien
aggagctagagcttgcctcacccgc

SEQ ID NO: 176915 - DNA, 25 bp, Homo sapien
cgccgagagcccaggatgtactggc

SEQ ID NO: 176916 - DNA, 25 bp, Homo sapien
gaagatccttattttgatgaccgag

SEQ ID NO: 176917 - DNA, 25 bp, Homo sapien
ttgatgaccgagttcactttccagc

SEQ ID NO: 176918 - DNA, 25 bp, Homo sapien
actttccagcttctactgattactc

SEQ ID NO: 176919 - DNA, 25 bp, Homo sapien
gattactcaacacagtatggactga

SEQ ID NO: 176920 - DNA, 25 bp, Homo sapien
ggactgaaatcgaccacaaattatg

SEQ ID NO: 176921 - DNA, 25 bp, Homo sapien
tgtagacttttattccactaaacga

SEQ ID NO: 176922 - DNA, 25 bp, Homo sapien
ctaaacgaccttcttatagagcaga

SEQ ID NO: 176923 - DNA, 25 bp, Homo sapien
agagcagaacagtacccagggtccc

SEQ ID NO: 176924 - DNA, 25 bp, Homo sapien
gatgcccaacagaggaactctttct

SEQ ID NO: 176925 - DNA, 25 bp, Homo sapien
actctttctttctaaccttgttcag

SEQ ID NO: 176926 - DNA, 25 bp, Homo sapien
ggtgaaaagtccatcttgctgattt

SEQ ID NO: 176927 - DNA, 25 bp, Homo sapien
atagaacataattgcaggagtactg

SEQ ID NO: 176928 - DNA, 25 bp, Homo sapien
aggagtactgtctcatctcatcata

SEQ ID NO: 176929 - DNA, 25 bp, Homo sapien
atctcatcatattcacgggttctgg

SEQ ID NO: 176930 - DNA, 25 bp, Homo sapien
gggcattttcaaattctgcctacca

SEQ ID NO: 176931 - DNA, 25 bp, Homo sapien
taccacaggcaataactgcccatct

SEQ ID NO: 176932 - DNA, 25 bp, Homo sapien
taactgcccatctcagctgtaggtg

SEQ ID NO: 176933 - DNA, 25 bp, Homo sapien
gctgtaggtggaatttttacccaga

SEQ ID NO: 176934 - DNA, 25 bp, Homo sapien
tttacccagaaaagataggccctag

SEQ ID NO: 176935 - DNA, 25 bp, Homo sapien
tctgctgcagcgttcaacttgtgtg

SEQ ID NO: 176936 - DNA, 25 bp, Homo sapien
gttcaacttgtgtgtttactgacag

SEQ ID NO: 176937 - DNA, 25 bp, Homo sapien
gtttactgacagagtgaactacaga

SEQ ID NO: 176938 - DNA, 25 bp, Homo sapien
gaacaatgtgtgttagtagaccata

SEQ ID NO: 176939 - DNA, 25 bp, Homo sapien
gaccatagagaaaggaatacggaca

SEQ ID NO: 176940 - DNA, 25 bp, Homo sapien
aaagagagtgtgtccattcaagtca

SEQ ID NO: 176941 - DNA, 25 bp, Homo sapien
gagtgtgtccattcaagtcagagaa

SEQ ID NO: 176942 - DNA, 25 bp, Homo sapien
gtggtggaggacacggttcctataa

SEQ ID NO: 176943 - DNA, 25 bp, Homo sapien
ggacacggttcctataataccaaag

SEQ ID NO: 176944 - DNA, 25 bp, Homo sapien
gaggactctagtatagactatgatc

SEQ ID NO: 176945 - DNA, 25 bp, Homo sapien
agactatgatctaaacctcccagac

SEQ ID NO: 176946 - DNA, 25 bp, Homo sapien
atgatctaaacctcccagacacagt

SEQ ID NO: 176947 - DNA, 25 bp, Homo sapien
gacacagtcacccacgaagattacg

SEQ ID NO: 176948 - DNA, 25 bp, Homo sapien
gaagattacgtgaccacaagattgt

SEQ ID NO: 176949 - DNA, 25 bp, Homo sapien
ccagcagacaatggccctcctggtg

SEQ ID NO: 176950 - DNA, 25 bp, Homo sapien
tcaccacagaccctcacccaaagga

SEQ ID NO: 176951 - DNA, 25 bp, Homo sapien
tcacccaaaggaaccgctccttgtc

SEQ ID NO: 176952 - DNA, 25 bp, Homo sapien
tggcctccccggaggcacagcagtg

SEQ ID NO: 176953 - DNA, 25 bp, Homo sapien
gggctgtctcccctgacaggcacaa

SEQ ID NO: 176954 - DNA, 25 bp, Homo sapien
tgacaggcacaactccccgggcaga

SEQ ID NO: 176955 - DNA, 25 bp, Homo sapien
acaggcacaactccccgggcagaaa

SEQ ID NO: 176956 - DNA, 25 bp, Homo sapien
gggcagaaaacgtgccccaccgcat

SEQ ID NO: 176957 - DNA, 25 bp, Homo sapien
accgcatccctacctggaaactgac

SEQ ID NO: 176958 - DNA, 25 bp, Homo sapien
aaaagctggccctgtggcgtgacgg

SEQ ID NO: 176959 - DNA, 25 bp, Homo sapien
atccagactgcgaagctgctctggg

SEQ ID NO: 176960 - DNA, 25 bp, Homo sapien
gaaagctctcaagttgctgaagact

SEQ ID NO: 176961 - DNA, 25 bp, Homo sapien
gctctcaagttgctgaagactgaat

SEQ ID NO: 176962 - DNA, 25 bp, Homo sapien
aatctccaagcccttctgtctgtca

SEQ ID NO: 176963 - DNA, 25 bp, Homo sapien
ttctgtctgtcaggccttgagactt

SEQ ID NO: 176964 - DNA, 25 bp, Homo sapien
gtcaggccttgagacttgaaaccag

SEQ ID NO: 176965 - DNA, 25 bp, Homo sapien
gaagactggctagtgtggaagcata

SEQ ID NO: 176966 - DNA, 25 bp, Homo sapien
gtggaagcatagtgaacacactgat

SEQ ID NO: 176967 - DNA, 25 bp, Homo sapien
acacactgattaggttatggtttaa

SEQ ID NO: 176968 - DNA, 25 bp, Homo sapien
gttatggtttaatgttacaacaact

SEQ ID NO: 176969 - DNA, 25 bp, Homo sapien
gaaatttggtttcaagtgtacatgt

SEQ ID NO: 176970 - DNA, 25 bp, Homo sapien
gtatactaccatagtgagccatgat

SEQ ID NO: 176971 - DNA, 25 bp, Homo sapien
gacatacaattggagtcccctggga

SEQ ID NO: 176972 - DNA, 25 bp, Homo sapien
cctgggagaagagggtaatgtcctt

SEQ ID NO: 176973 - DNA, 25 bp, Homo sapien
aatgtccttcaaatcttccagactc

SEQ ID NO: 176974 - DNA, 25 bp, Homo sapien
tcaaatcttccagactcctgaggac

SEQ ID NO: 176975 - DNA, 25 bp, Homo sapien
atcttccagactcctgaggaccaag

SEQ ID NO: 176976 - DNA, 25 bp, Homo sapien
gaggaccaagagctgacttacacgt

SEQ ID NO: 176977 - DNA, 25 bp, Homo sapien
ccaagagctgacttacacgtgtaca

SEQ ID NO: 176978 - DNA, 25 bp, Homo sapien
gacttacacgtgtacagcccagaac

SEQ ID NO: 176979 - DNA, 25 bp, Homo sapien
agcccagaaccctgtcagcaacaat

SEQ ID NO: 176980 - DNA, 25 bp, Homo sapien
agaaccctgtcagcaacaattctga

SEQ ID NO: 176981 - DNA, 25 bp, Homo sapien
agcaacaattctgactccatctctg

SEQ ID NO: 176982 - DNA, 25 bp, Homo sapien
gatgaacatttattgatcttctaca

SEQ ID NO: 176983 - DNA, 25 bp, Homo sapien
gaacatttattgatcttctacatac

SEQ ID NO: 176984 - DNA, 25 bp, Homo sapien
ttctacatacaagacttcaccataa

SEQ ID NO: 176985 - DNA, 25 bp, Homo sapien
tctacatacaagacttcaccataag

SEQ ID NO: 176986 - DNA, 25 bp, Homo sapien
tacatacaagacttcaccataaggc

SEQ ID NO: 176987 - DNA, 25 bp, Homo sapien
tacaagacttcaccataaggccagg

SEQ ID NO: 176988 - DNA, 25 bp, Homo sapien
gacttcaccataaggccaggagcag

SEQ ID NO: 176989 - DNA, 25 bp, Homo sapien
caggagcagtgctcacgccttgtaa

SEQ ID NO: 176990 - DNA, 25 bp, Homo sapien
ggagcagtgctcacgccttgtaatc

SEQ ID NO: 176991 - DNA, 25 bp, Homo sapien
acctgtagtcgcagcctttcgggag

SEQ ID NO: 176992 - DNA, 25 bp, Homo sapien
gtagtcgcagcctttcgggaggctg

SEQ ID NO: 176993 - DNA, 25 bp, Homo sapien
ctggcggggttgactcttccagtga

SEQ ID NO: 176994 - DNA, 25 bp, Homo sapien
cagtgagggcagaaccaggctggca

SEQ ID NO: 176995 - DNA, 25 bp, Homo sapien
ggacggtgtacctgctgctcagagc

SEQ ID NO: 176996 - DNA, 25 bp, Homo sapien
acggtgtacctgctgctcagagccc

SEQ ID NO: 176997 - DNA, 25 bp, Homo sapien
gacagagcagctcttgtcccaggtc

SEQ ID NO: 176998 - DNA, 25 bp, Homo sapien
acagagcagctcttgtcccaggtcc

SEQ ID NO: 176999 - DNA, 25 bp, Homo sapien
gctgagcgccgtgtcaccaggagaa

SEQ ID NO: 177000 - DNA, 25 bp, Homo sapien
tgtcaccaggagaatagtgctcaca

SEQ ID NO: 177001 - DNA, 25 bp, Homo sapien
caggagaatagtgctcacagcccag

SEQ ID NO: 177002 - DNA, 25 bp, Homo sapien
gtgtgtggctcctggatgggctcgt

SEQ ID NO: 177003 - DNA, 25 bp, Homo sapien
gacagggcacgggctctcagaaaat

SEQ ID NO: 177004 - DNA, 25 bp, Homo sapien
acgtggacgacatgcccaacgcgct

SEQ ID NO: 177005 - DNA, 25 bp, Homo sapien
cgtggacgacatgcccaacgcgctg

SEQ ID NO: 177006 - DNA, 25 bp, Homo sapien
gacctgcacgcgcacaagcttcggg

SEQ ID NO: 177007 - DNA, 25 bp, Homo sapien
acctgcacgcgcacaagcttcgggt

SEQ ID NO: 177008 - DNA, 25 bp, Homo sapien
cctgcacgcgcacaagcttcgggtg

SEQ ID NO: 177009 - DNA, 25 bp, Homo sapien
ctgcacgcgcacaagcttcgggtgg

SEQ ID NO: 177010 - DNA, 25 bp, Homo sapien
tgcacgcgcacaagcttcgggtgga

SEQ ID NO: 177011 - DNA, 25 bp, Homo sapien
gcacgcgcacaagcttcgggtggac

SEQ ID NO: 177012 - DNA, 25 bp, Homo sapien
ccgccgagttcacccctgcggtgca

SEQ ID NO: 177013 - DNA, 25 bp, Homo sapien
gccgagttcacccctgcggtgcacg

SEQ ID NO: 177014 - DNA, 25 bp, Homo sapien
ccgagttcacccctgcggtgcacgc

SEQ ID NO: 177015 - DNA, 25 bp, Homo sapien
taagtgcacttcttgtatttctaat

SEQ ID NO: 177016 - DNA, 25 bp, Homo sapien
gtatttctaataagatgactttcca

SEQ ID NO: 177017 - DNA, 25 bp, Homo sapien
gtgagatttgttatgttctggcttt

SEQ ID NO: 177018 - DNA, 25 bp, Homo sapien
gatttgttatgttctggcttttaaa

SEQ ID NO: 177019 - DNA, 25 bp, Homo sapien
tgagtgtatgtccacctcactggtg

SEQ ID NO: 177020 - DNA, 25 bp, Homo sapien
gtgtatgtccacctcactggtggca

SEQ ID NO: 177021 - DNA, 25 bp, Homo sapien
actggtggcaccgagaaacttactt

SEQ ID NO: 177022 - DNA, 25 bp, Homo sapien
gtggcaccgagaaacttacttcctt

SEQ ID NO: 177023 - DNA, 25 bp, Homo sapien
gcaccgagaaacttacttccttgta

SEQ ID NO: 177024 - DNA, 25 bp, Homo sapien
gagaaacttacttccttgtattaag

SEQ ID NO: 177025 - DNA, 25 bp, Homo sapien
cttccttgtattaagtgcacttctt

SEQ ID NO: 177026 - DNA, 25 bp, Homo sapien
ggatactacctgtacaacatctgtg

SEQ ID NO: 177027 - DNA, 25 bp, Homo sapien
tgtggacacctcatgctctgttcaa

SEQ ID NO: 177028 - DNA, 25 bp, Homo sapien
aaggccatcacaaaggaaccgccca

SEQ ID NO: 177029 - DNA, 25 bp, Homo sapien
cagggagaagcagccggctctcaaa

SEQ ID NO: 177030 - DNA, 25 bp, Homo sapien
gctggcgacccgatggaaggttttc

SEQ ID NO: 177031 - DNA, 25 bp, Homo sapien
aggttttcaggctcctcacaaagga

SEQ ID NO: 177032 - DNA, 25 bp, Homo sapien
gaaaagatcttttgccctggagata

SEQ ID NO: 177033 - DNA, 25 bp, Homo sapien
agatatggtcctgaaatctctcccc

SEQ ID NO: 177034 - DNA, 25 bp, Homo sapien
tcccctggcttattccataccattt

SEQ ID NO: 177035 - DNA, 25 bp, Homo sapien
ataccatttcccttgcagatttgca

SEQ ID NO: 177036 - DNA, 25 bp, Homo sapien
gatttgcagaaacatggcatctttc

SEQ ID NO: 177037 - DNA, 25 bp, Homo sapien
tcctgagtgacagaaagggcctgac

SEQ ID NO: 177038 - DNA, 25 bp, Homo sapien
cctgagtgacagaaagggcctgacc

SEQ ID NO: 177039 - DNA, 25 bp, Homo sapien
ctgagtgacagaaagggcctgaccc

SEQ ID NO: 177040 - DNA, 25 bp, Homo sapien
tgagtgacagaaagggcctgacccg

SEQ ID NO: 177041 - DNA, 25 bp, Homo sapien
tgctccagttgctggccgaccacgt

SEQ ID NO: 177042 - DNA, 25 bp, Homo sapien
gctccagttgctggccgaccacgtc

SEQ ID NO: 177043 - DNA, 25 bp, Homo sapien
agttgctggccgaccacgtccctgg

SEQ ID NO: 177044 - DNA, 25 bp, Homo sapien
tggccgaccacgtccctggcgttgg

SEQ ID NO: 177045 - DNA, 25 bp, Homo sapien
cgaccacgtccctggcgttggcctg

SEQ ID NO: 177046 - DNA, 25 bp, Homo sapien
gaccacgtccctggcgttggcctgg

SEQ ID NO: 177047 - DNA, 25 bp, Homo sapien
accacgtccctggcgttggcctggt

SEQ ID NO: 177048 - DNA, 25 bp, Homo sapien
cccaggtgattttatcaattccagt

SEQ ID NO: 177049 - DNA, 25 bp, Homo sapien
tatcaattccagtgttaccatctcc

SEQ ID NO: 177050 - DNA, 25 bp, Homo sapien
aattccagtgttaccatctcctgag

SEQ ID NO: 177051 - DNA, 25 bp, Homo sapien
agtgttaccatctcctgagttttgg

SEQ ID NO: 177052 - DNA, 25 bp, Homo sapien
taccatctcctgagttttggtttgt

SEQ ID NO: 177053 - DNA, 25 bp, Homo sapien
tcccacccccacagaagattttaag

SEQ ID NO: 177054 - DNA, 25 bp, Homo sapien
catccccatataacaccaacagtgt

SEQ ID NO: 177055 - DNA, 25 bp, Homo sapien
tataacaccaacagtgtacatgttt

SEQ ID NO: 177056 - DNA, 25 bp, Homo sapien
gtacatgtttactgtcacttttgat

SEQ ID NO: 177057 - DNA, 25 bp, Homo sapien
tgtttactgtcacttttgatatggt

SEQ ID NO: 177058 - DNA, 25 bp, Homo sapien
cagtgtgaacagcaatttattattt

SEQ ID NO: 177059 - DNA, 25 bp, Homo sapien
tcactctgttgccattaaatgtatg

SEQ ID NO: 177060 - DNA, 25 bp, Homo sapien
aatgtatgagactgggcatctctga

SEQ ID NO: 177061 - DNA, 25 bp, Homo sapien
agactgggcatctctgagcaattgt

SEQ ID NO: 177062 - DNA, 25 bp, Homo sapien
tctgagcaattgtagggcctgggat

SEQ ID NO: 177063 - DNA, 25 bp, Homo sapien
gcctgggatagagggtacttgaatc

SEQ ID NO: 177064 - DNA, 25 bp, Homo sapien
gagggtacttgaatcttcagaagtt

SEQ ID NO: 177065 - DNA, 25 bp, Homo sapien
agaagttgaagtagcttttatgccc

SEQ ID NO: 177066 - DNA, 25 bp, Homo sapien
agcttttatgccctcaggaaaggcc

SEQ ID NO: 177067 - DNA, 25 bp, Homo sapien
ttatgccctcaggaaaggccctggt

SEQ ID NO: 177068 - DNA, 25 bp, Homo sapien
ttcttaccactttcagcccctggga

SEQ ID NO: 177069 - DNA, 25 bp, Homo sapien
cagcccctgggattctagaactgtg

SEQ ID NO: 177070 - DNA, 25 bp, Homo sapien
agctgcaggcccgtctggatgacct

SEQ ID NO: 177071 - DNA, 25 bp, Homo sapien
cccgtctggatgacctgtgggaaga

SEQ ID NO: 177072 - DNA, 25 bp, Homo sapien
gatgacctgtgggaagacatcactc

SEQ ID NO: 177073 - DNA, 25 bp, Homo sapien
atcactcacagccttcatgaccagg

SEQ ID NO: 177074 - DNA, 25 bp, Homo sapien
acagccttcatgaccagggccacag

SEQ ID NO: 177075 - DNA, 25 bp, Homo sapien
ttggctctgagcctctagcatggtt

SEQ ID NO: 177076 - DNA, 25 bp, Homo sapien
cctctagcatggttcagtccttgaa

SEQ ID NO: 177077 - DNA, 25 bp, Homo sapien
agtccttgaaagtggcctgttgggt

SEQ ID NO: 177078 - DNA, 25 bp, Homo sapien
ggctgctgtctcctgcatatccagc

SEQ ID NO: 177079 - DNA, 25 bp, Homo sapien
gcgactccccaatctggatgcatta

SEQ ID NO: 177080 - DNA, 25 bp, Homo sapien
ggatgcattacattcaccaggcttt

SEQ ID NO: 177081 - DNA, 25 bp, Homo sapien
gcctaggaaagagccagggcagtct

SEQ ID NO: 177082 - DNA, 25 bp, Homo sapien
gagccagggcagtctattgaaaagg

SEQ ID NO: 177083 - DNA, 25 bp, Homo sapien
aggatataagaagcctttctctaca

SEQ ID NO: 177084 - DNA, 25 bp, Homo sapien
gaagcctttctctacaatgcaagtg

SEQ ID NO: 177085 - DNA, 25 bp, Homo sapien
gcctttctctacaatgcaagtgttg

SEQ ID NO: 177086 - DNA, 25 bp, Homo sapien
gcaagtgttgtgaagacaggtcttt

SEQ ID NO: 177087 - DNA, 25 bp, Homo sapien
gacaggtctttatgggctatttcaa

SEQ ID NO: 177088 - DNA, 25 bp, Homo sapien
gtctttatgggctatttcaacccca

SEQ ID NO: 177089 - DNA, 25 bp, Homo sapien
ccccaattgtcatattacatggtta

SEQ ID NO: 177090 - DNA, 25 bp, Homo sapien
tacatggttaggatgccaggagaca

SEQ ID NO: 177091 - DNA, 25 bp, Homo sapien
ttaggatgccaggagacagacagtt

SEQ ID NO: 177092 - DNA, 25 bp, Homo sapien
atcagtttcacaaagtttgttccct

SEQ ID NO: 177093 - DNA, 25 bp, Homo sapien
aaatcccattgtcacctaactctga

SEQ ID NO: 177094 - DNA, 25 bp, Homo sapien
aatcccattgtcacctaactctgaa

SEQ ID NO: 177095 - DNA, 25 bp, Homo sapien
tcccattgtcacctaactctgaaga

SEQ ID NO: 177096 - DNA, 25 bp, Homo sapien
cattgtcacctaactctgaagatct

SEQ ID NO: 177097 - DNA, 25 bp, Homo sapien
actctgaagatctaaatagcccttg

SEQ ID NO: 177098 - DNA, 25 bp, Homo sapien
ctgaagatctaaatagcccttggat

SEQ ID NO: 177099 - DNA, 25 bp, Homo sapien
aagatctaaatagcccttggatcag

SEQ ID NO: 177100 - DNA, 25 bp, Homo sapien
ccacagggccagatgtggagtctgt

SEQ ID NO: 177101 - DNA, 25 bp, Homo sapien
ttatgactgtaaacatagatagtgc

SEQ ID NO: 177102 - DNA, 25 bp, Homo sapien
catagatagtgctttattttgttaa

SEQ ID NO: 177103 - DNA, 25 bp, Homo sapien
acaggtgagttctatttgagacttc

SEQ ID NO: 177104 - DNA, 25 bp, Homo sapien
ggtgagttctatttgagacttccag

SEQ ID NO: 177105 - DNA, 25 bp, Homo sapien
aagctgcctccgtccagaaatgcct

SEQ ID NO: 177106 - DNA, 25 bp, Homo sapien
agaaatgcctctcacaccaggagct

SEQ ID NO: 177107 - DNA, 25 bp, Homo sapien
aatgcctctcacaccaggagctcgg

SEQ ID NO: 177108 - DNA, 25 bp, Homo sapien
tagctgtgactgtcaccctctcagg

SEQ ID NO: 177109 - DNA, 25 bp, Homo sapien
tctcaggctttgtctcatccttcat

SEQ ID NO: 177110 - DNA, 25 bp, Homo sapien
ctttgtctcatccttcattctgaat

SEQ ID NO: 177111 - DNA, 25 bp, Homo sapien
tgtctcatccttcattctgaataag

SEQ ID NO: 177112 - DNA, 25 bp, Homo sapien
tgaataagatggcagtgttctcctc

SEQ ID NO: 177113 - DNA, 25 bp, Homo sapien
ccctttctatcccaatcaccaatag

SEQ ID NO: 177114 - DNA, 25 bp, Homo sapien
ggagttcaacactgtctctcaatca

SEQ ID NO: 177115 - DNA, 25 bp, Homo sapien
actgtctctcaatcagatcatctgg

SEQ ID NO: 177116 - DNA, 25 bp, Homo sapien
gatcatctggatctttttctttatc

SEQ ID NO: 177117 - DNA, 25 bp, Homo sapien
atctggatctttttctttatctccc

SEQ ID NO: 177118 - DNA, 25 bp, Homo sapien
aaatattgcattattcacactttca

SEQ ID NO: 177119 - DNA, 25 bp, Homo sapien
tgcattattcacactttcaaactgt

SEQ ID NO: 177120 - DNA, 25 bp, Homo sapien
cactttcaaactgtgtattttctta

SEQ ID NO: 177121 - DNA, 25 bp, Homo sapien
ggctttacttcttttgcatgcactt

SEQ ID NO: 177122 - DNA, 25 bp, Homo sapien
tacttcttttgcatgcactttaaaa

SEQ ID NO: 177123 - DNA, 25 bp, Homo sapien
gagcatgataactgtcagagctttt

SEQ ID NO: 177124 - DNA, 25 bp, Homo sapien
taactgtcagagcttttaattatat

SEQ ID NO: 177125 - DNA, 25 bp, Homo sapien
aaattgtcagcgtatttttacacta

SEQ ID NO: 177126 - DNA, 25 bp, Homo sapien
gcgtatttttacactattggctcaa

SEQ ID NO: 177127 - DNA, 25 bp, Homo sapien
attggctcaagaatgttataatgct

SEQ ID NO: 177128 - DNA, 25 bp, Homo sapien
ctaagggacataagttggcaaccac

SEQ ID NO: 177129 - DNA, 25 bp, Homo sapien
ttggcaaccacttggtttttggaag

SEQ ID NO: 177130 - DNA, 25 bp, Homo sapien
gaaggactttcggtattgtattaga

SEQ ID NO: 177131 - DNA, 25 bp, Homo sapien
gtattagaagtctgccctagctgtt

SEQ ID NO: 177132 - DNA, 25 bp, Homo sapien
tctgccctagctgttaaatttctgg

SEQ ID NO: 177133 - DNA, 25 bp, Homo sapien
gagttaattgttcctttcttcagtg

SEQ ID NO: 177134 - DNA, 25 bp, Homo sapien
cctttcttcagtgggccattgtttt

SEQ ID NO: 177135 - DNA, 25 bp, Homo sapien
gtaaacacattattagcatggactt

SEQ ID NO: 177136 - DNA, 25 bp, Homo sapien
aacatgtttatctttacccttagca

SEQ ID NO: 177137 - DNA, 25 bp, Homo sapien
tgtttatctttacccttagcaggaa

SEQ ID NO: 177138 - DNA, 25 bp, Homo sapien
tacccttagcaggaagatgcttggc

SEQ ID NO: 177139 - DNA, 25 bp, Homo sapien
gatgcttggctggaactttgtgttc

SEQ ID NO: 177140 - DNA, 25 bp, Homo sapien
ggctggaactttgtgttcacagact

SEQ ID NO: 177141 - DNA, 25 bp, Homo sapien
ctttgtgttcacagacttagtcatt

SEQ ID NO: 177142 - DNA, 25 bp, Homo sapien
acagacttagtcattgcataccaaa

SEQ ID NO: 177143 - DNA, 25 bp, Homo sapien
ttgcataccaaaaccatatttactg

SEQ ID NO: 177144 - DNA, 25 bp, Homo sapien
gtttccatgatgaactgtgctgtta

SEQ ID NO: 177145 - DNA, 25 bp, Homo sapien
gaactgtgctgttaggattcttatt

SEQ ID NO: 177146 - DNA, 25 bp, Homo sapien
aggattcttatttgctactcataaa

SEQ ID NO: 177147 - DNA, 25 bp, Homo sapien
gcttagtaaaagaagtctacccaga

SEQ ID NO: 177148 - DNA, 25 bp, Homo sapien
aagggcactcacttcaattttgcaa

SEQ ID NO: 177149 - DNA, 25 bp, Homo sapien
aattttgcaatcgtttttacagatg

SEQ ID NO: 177150 - DNA, 25 bp, Homo sapien
gttaaaagacctggctatcgagtta

SEQ ID NO: 177151 - DNA, 25 bp, Homo sapien
gagttaaggagattggcagcaccat

SEQ ID NO: 177152 - DNA, 25 bp, Homo sapien
agattggcagcaccatgtctggcag

SEQ ID NO: 177153 - DNA, 25 bp, Homo sapien
ggactgatgattccatgaccctgca

SEQ ID NO: 177154 - DNA, 25 bp, Homo sapien
tgcagtcgcagaagttccagatagg

SEQ ID NO: 177155 - DNA, 25 bp, Homo sapien
gataggagattacttggacatagca

SEQ ID NO: 177156 - DNA, 25 bp, Homo sapien
ggacatagcaattacccctccaaat

SEQ ID NO: 177157 - DNA, 25 bp, Homo sapien
ttcagggcgcatgagaccatattaa

SEQ ID NO: 177158 - DNA, 25 bp, Homo sapien
aagtttttcaccgtggcgtgcacag

SEQ ID NO: 177159 - DNA, 25 bp, Homo sapien
gtgcacagccaatcaggacccgcag

SEQ ID NO: 177160 - DNA, 25 bp, Homo sapien
ggttcacctgctacgggcagaatca

SEQ ID NO: 177161 - DNA, 25 bp, Homo sapien
gaatcaaggtggacagcttctgagc

SEQ ID NO: 177162 - DNA, 25 bp, Homo sapien
ttctgagcaggagccggaaacgcgc

SEQ ID NO: 177163 - DNA, 25 bp, Homo sapien
gggccttcaaacaggcacgcctagt

SEQ ID NO: 177164 - DNA, 25 bp, Homo sapien
gagagaggaggacgcacacacacac

SEQ ID NO: 177165 - DNA, 25 bp, Homo sapien
ggtgaaacccaatttcttacatcat

SEQ ID NO: 177166 - DNA, 25 bp, Homo sapien
ttacatcatatctgtgctacccttt

SEQ ID NO: 177167 - DNA, 25 bp, Homo sapien
gctaccctttccaaacagcctaatt

SEQ ID NO: 177168 - DNA, 25 bp, Homo sapien
ttttctctcttcttgcacctttacc

SEQ ID NO: 177169 - DNA, 25 bp, Homo sapien
ggctttgctgccctcgaaggcatga

SEQ ID NO: 177170 - DNA, 25 bp, Homo sapien
gccctcgaaggcatgaatggcattc

SEQ ID NO: 177171 - DNA, 25 bp, Homo sapien
gttttaatcagctggatctgcctgc

SEQ ID NO: 177172 - DNA, 25 bp, Homo sapien
agctggatctgcctgcctatgagag

SEQ ID NO: 177173 - DNA, 25 bp, Homo sapien
atctgcctgcctatgagagctttga

SEQ ID NO: 177174 - DNA, 25 bp, Homo sapien
gcctgcctatgagagctttgagaag

SEQ ID NO: 177175 - DNA, 25 bp, Homo sapien
gagaagctccgccacatgctactgt

SEQ ID NO: 177176 - DNA, 25 bp, Homo sapien
cacatgctactgttggctatccagg

SEQ ID NO: 177177 - DNA, 25 bp, Homo sapien
gttggctatccaggagtgctctgaa

SEQ ID NO: 177178 - DNA, 25 bp, Homo sapien
gctatccaggagtgctctgaaggct

SEQ ID NO: 177179 - DNA, 25 bp, Homo sapien
gagtgctctgaaggctttgggctgg

SEQ ID NO: 177180 - DNA, 25 bp, Homo sapien
gcagggagatgcaggtctctctaaa

SEQ ID NO: 177181 - DNA, 25 bp, Homo sapien
gcaggtctctctaaacgcatgaatg

SEQ ID NO: 177182 - DNA, 25 bp, Homo sapien
tgtatatatgctccacactacgtct

SEQ ID NO: 177183 - DNA, 25 bp, Homo sapien
tgctccacactacgtctgataaaca

SEQ ID NO: 177184 - DNA, 25 bp, Homo sapien
gataaacacaaacctcagtattcag

SEQ ID NO: 177185 - DNA, 25 bp, Homo sapien
ctcagtattcagttattaggcacac

SEQ ID NO: 177186 - DNA, 25 bp, Homo sapien
ttaggcacactagttttatacgcaa

SEQ ID NO: 177187 - DNA, 25 bp, Homo sapien
tatacgcaactactgcttacatagt

SEQ ID NO: 177188 - DNA, 25 bp, Homo sapien
gactgttttgttgccaataatcttt

SEQ ID NO: 177189 - DNA, 25 bp, Homo sapien
gaggttcagatacacataccatgga

SEQ ID NO: 177190 - DNA, 25 bp, Homo sapien
tacttttcttgttactacacaaagc

SEQ ID NO: 177191 - DNA, 25 bp, Homo sapien
gctgctgcgactgatgccaggacaa

SEQ ID NO: 177192 - DNA, 25 bp, Homo sapien
tgctgcgactgatgccaggacaacc

SEQ ID NO: 177193 - DNA, 25 bp, Homo sapien
tgcgactgatgccaggacaaccttt

SEQ ID NO: 177194 - DNA, 25 bp, Homo sapien
gactgatgccaggacaacctttctc

SEQ ID NO: 177195 - DNA, 25 bp, Homo sapien
aggacaacctttctcccagatgtaa

SEQ ID NO: 177196 - DNA, 25 bp, Homo sapien
gagagacatgtacaaacctggattt

SEQ ID NO: 177197 - DNA, 25 bp, Homo sapien
agagacatgtacaaacctggatttt

SEQ ID NO: 177198 - DNA, 25 bp, Homo sapien
ttttataccaccttgacccatttgc

SEQ ID NO: 177199 - DNA, 25 bp, Homo sapien
ttataccaccttgacccatttgcta

SEQ ID NO: 177200 - DNA, 25 bp, Homo sapien
accaccttgacccatttgctacatt

SEQ ID NO: 177201 - DNA, 25 bp, Homo sapien
gataattaaacactttagacctgaa

SEQ ID NO: 177202 - DNA, 25 bp, Homo sapien
tggtctccggagtttcctcgcatta

SEQ ID NO: 177203 - DNA, 25 bp, Homo sapien
gtctccggagtttcctcgcattaaa

SEQ ID NO: 177204 - DNA, 25 bp, Homo sapien
ctccggagtttcctcgcattaaagg

SEQ ID NO: 177205 - DNA, 25 bp, Homo sapien
ccggagtttcctcgcattaaaggag

SEQ ID NO: 177206 - DNA, 25 bp, Homo sapien
gagtttcctcgcattaaaggagaga

SEQ ID NO: 177207 - DNA, 25 bp, Homo sapien
tttcctcgcattaaaggagagagag

SEQ ID NO: 177208 - DNA, 25 bp, Homo sapien
agagagtactcttttgggcaacggc

SEQ ID NO: 177209 - DNA, 25 bp, Homo sapien
gagagtactcttttgggcaacggcc

SEQ ID NO: 177210 - DNA, 25 bp, Homo sapien
gagtactcttttgggcaacggccct

SEQ ID NO: 177211 - DNA, 25 bp, Homo sapien
tgggcaacggccctccaaaattgcc

SEQ ID NO: 177212 - DNA, 25 bp, Homo sapien
tccaaaattgcccccacattggctg

SEQ ID NO: 177213 - DNA, 25 bp, Homo sapien
ttcaagtacacgacggtgaccaaga

SEQ ID NO: 177214 - DNA, 25 bp, Homo sapien
tgaccaagaggtcccgtcggatccg

SEQ ID NO: 177215 - DNA, 25 bp, Homo sapien
tcacactcccagaaaactgcatcag

SEQ ID NO: 177216 - DNA, 25 bp, Homo sapien
gaaaactgcatcagaggaatatttt

SEQ ID NO: 177217 - DNA, 25 bp, Homo sapien
attgttgacttgaaacccccgatga

SEQ ID NO: 177218 - DNA, 25 bp, Homo sapien
ccccgatgacaaaagactcacgcaa

SEQ ID NO: 177219 - DNA, 25 bp, Homo sapien
aaagactcacgcaaagggactgtag

SEQ ID NO: 177220 - DNA, 25 bp, Homo sapien
aagggactgtagtcaacccacaggt

SEQ ID NO: 177221 - DNA, 25 bp, Homo sapien
gtagtcaacccacaggtgcttgtct

SEQ ID NO: 177222 - DNA, 25 bp, Homo sapien
tgtctctctctaggaacagacaact

SEQ ID NO: 177223 - DNA, 25 bp, Homo sapien
gaatgaggaaaccaacactttgaga

SEQ ID NO: 177224 - DNA, 25 bp, Homo sapien
gtatatacacctaacaagagagccc

SEQ ID NO: 177225 - DNA, 25 bp, Homo sapien
atacacctaacaagagagccccaaa

SEQ ID NO: 177226 - DNA, 25 bp, Homo sapien
gagagccccaaaatgtatgaagcaa

SEQ ID NO: 177227 - DNA, 25 bp, Homo sapien
gacaaatagacaattcaatagtaat

SEQ ID NO: 177228 - DNA, 25 bp, Homo sapien
tatttggagacttcaatatcccact

SEQ ID NO: 177229 - DNA, 25 bp, Homo sapien
ggagacttcaatatcccactttcaa

SEQ ID NO: 177230 - DNA, 25 bp, Homo sapien
taggacaactaagcaaaagattaac

SEQ ID NO: 177231 - DNA, 25 bp, Homo sapien
aaagattaacaagaacactgaagac

SEQ ID NO: 177232 - DNA, 25 bp, Homo sapien
acactgaagacctgaaaagcactat

SEQ ID NO: 177233 - DNA, 25 bp, Homo sapien
taagctaactagacagaacacacat

SEQ ID NO: 177234 - DNA, 25 bp, Homo sapien
gctaactagacagaacacacatcta

SEQ ID NO: 177235 - DNA, 25 bp, Homo sapien
aagtcgcagtgccactgcaagccca

SEQ ID NO: 177236 - DNA, 25 bp, Homo sapien
agcgaagagtcacccccgacaggag

SEQ ID NO: 177237 - DNA, 25 bp, Homo sapien
ccgacaggagtcaaacctcacaaga

SEQ ID NO: 177238 - DNA, 25 bp, Homo sapien
tatatagctatataccacagaatga

SEQ ID NO: 177239 - DNA, 25 bp, Homo sapien
gatgatgagttggaactccgcgatg

SEQ ID NO: 177240 - DNA, 25 bp, Homo sapien
ggaactccgcgatggagatatcgtt

SEQ ID NO: 177241 - DNA, 25 bp, Homo sapien
ggagatatcgttgatgtcatggaaa

SEQ ID NO: 177242 - DNA, 25 bp, Homo sapien
acgatggatggtttgttggtacttc

SEQ ID NO: 177243 - DNA, 25 bp, Homo sapien
gatggtttgttggtacttcaagaag

SEQ ID NO: 177244 - DNA, 25 bp, Homo sapien
agcagtttggtacttttccaggcaa

SEQ ID NO: 177245 - DNA, 25 bp, Homo sapien
tggtacttttccaggcaactatgta

SEQ ID NO: 177246 - DNA, 25 bp, Homo sapien
ttttggttccattcatgagcttcct

SEQ ID NO: 177247 - DNA, 25 bp, Homo sapien
gttccattcatgagcttcctccagg

SEQ ID NO: 177248 - DNA, 25 bp, Homo sapien
agtcaggattgaactcataggcacc

SEQ ID NO: 177249 - DNA, 25 bp, Homo sapien
actcataggcaccatcttccctgaa

SEQ ID NO: 177250 - DNA, 25 bp, Homo sapien
gaagaaaaaatcatccgtgctgaaa

SEQ ID NO: 177251 - DNA, 25 bp, Homo sapien
tcatccgtgctgaaaatcagggccc

SEQ ID NO: 177252 - DNA, 25 bp, Homo sapien
agggccctgggaaagtcatgctgca

SEQ ID NO: 177253 - DNA, 25 bp, Homo sapien
agtcatgctgcaattgtctggccag

SEQ ID NO: 177254 - DNA, 25 bp, Homo sapien
gtctggccagtgtagttttcccgga

SEQ ID NO: 177255 - DNA, 25 bp, Homo sapien
gccagtgtagttttcccggagcccg

SEQ ID NO: 177256 - DNA, 25 bp, Homo sapien
ctcgcaggaggtagaggtgtttcct

SEQ ID NO: 177257 - DNA, 25 bp, Homo sapien
agcctctgtgatccccatgtgtttt

SEQ ID NO: 177258 - DNA, 25 bp, Homo sapien
ctctgtgatccccatgtgttttgat

SEQ ID NO: 177259 - DNA, 25 bp, Homo sapien
ctgtgatccccatgtgttttgattc

SEQ ID NO: 177260 - DNA, 25 bp, Homo sapien
gtgatccccatgtgttttgattcct

SEQ ID NO: 177261 - DNA, 25 bp, Homo sapien
gatccccatgtgttttgattcctgc

SEQ ID NO: 177262 - DNA, 25 bp, Homo sapien
ttgattcctgctctttgttacagtt

SEQ ID NO: 177263 - DNA, 25 bp, Homo sapien
gattcctgctctttgttacagttcc

SEQ ID NO: 177264 - DNA, 25 bp, Homo sapien
attcctgctctttgttacagttcca

SEQ ID NO: 177265 - DNA, 25 bp, Homo sapien
tcctgctctttgttacagttccatt

SEQ ID NO: 177266 - DNA, 25 bp, Homo sapien
ctgctctttgttacagttccattaa

SEQ ID NO: 177267 - DNA, 25 bp, Homo sapien
gctctttgttacagttccattaaat

SEQ ID NO: 177268 - DNA, 25 bp, Homo sapien
aaccaatgagcggtacaagctgctt

SEQ ID NO: 177269 - DNA, 25 bp, Homo sapien
aatgagcggtacaagctgcttccct

SEQ ID NO: 177270 - DNA, 25 bp, Homo sapien
tgagcggtacaagctgcttccctgt

SEQ ID NO: 177271 - DNA, 25 bp, Homo sapien
ggtacaagctgcttccctgtcctga

SEQ ID NO: 177272 - DNA, 25 bp, Homo sapien
ccctgtcctgacaagcacaataaaa

SEQ ID NO: 177273 - DNA, 25 bp, Homo sapien
gggacctcacagaggcaggcgcagc

SEQ ID NO: 177274 - DNA, 25 bp, Homo sapien
agccggctcatcgagatgtgtggac

SEQ ID NO: 177275 - DNA, 25 bp, Homo sapien
catcgagatgtgtggacagcagaaa

SEQ ID NO: 177276 - DNA, 25 bp, Homo sapien
acagcagaaagcgagtgaggcaaga

SEQ ID NO: 177277 - DNA, 25 bp, Homo sapien
aaaatcagcacagggtaaacatcag

SEQ ID NO: 177278 - DNA, 25 bp, Homo sapien
cagcacagggtaaacatcagagatc

SEQ ID NO: 177279 - DNA, 25 bp, Homo sapien
gttctatgagcccaggtgtgccagc

SEQ ID NO: 177280 - DNA, 25 bp, Homo sapien
tgcaactctcttgaaatgtgtcctt

SEQ ID NO: 177281 - DNA, 25 bp, Homo sapien
agcctattctagtttcccaatcagg

SEQ ID NO: 177282 - DNA, 25 bp, Homo sapien
ttcccaatcaggcaagaggtctaga

SEQ ID NO: 177283 - DNA, 25 bp, Homo sapien
ggtctagagtttcaagtcttcggtt

SEQ ID NO: 177284 - DNA, 25 bp, Homo sapien
gtcttcggttatgggaggcagcaat

SEQ ID NO: 177285 - DNA, 25 bp, Homo sapien
aaaggcatggatttgggaggcaacc

SEQ ID NO: 177286 - DNA, 25 bp, Homo sapien
ggaggcaaccaatcttcagtctgaa

SEQ ID NO: 177287 - DNA, 25 bp, Homo sapien
atcttcagtctgaatcctggctctg

SEQ ID NO: 177288 - DNA, 25 bp, Homo sapien
atttactacctgtgttgccttggac

SEQ ID NO: 177289 - DNA, 25 bp, Homo sapien
gttatttcaattccctgagcttcag

SEQ ID NO: 177290 - DNA, 25 bp, Homo sapien
gccttcaacagtaagatttttactg

SEQ ID NO: 177291 - DNA, 25 bp, Homo sapien
ccttcaacagtaagatttttactgg

SEQ ID NO: 177292 - DNA, 25 bp, Homo sapien
cttcaacagtaagatttttactggc

SEQ ID NO: 177293 - DNA, 25 bp, Homo sapien
ttcaacagtaagatttttactggcc

SEQ ID NO: 177294 - DNA, 25 bp, Homo sapien
tcaacagtaagatttttactggcca

SEQ ID NO: 177295 - DNA, 25 bp, Homo sapien
caacagtaagatttttactggccag

SEQ ID NO: 177296 - DNA, 25 bp, Homo sapien
aacagtaagatttttactggccagg

SEQ ID NO: 177297 - DNA, 25 bp, Homo sapien
acagtaagatttttactggccaggt

SEQ ID NO: 177298 - DNA, 25 bp, Homo sapien
accttgggggctgatgagggagaat

SEQ ID NO: 177299 - DNA, 25 bp, Homo sapien
gaatcacttgatcccggaaaggctg

SEQ ID NO: 177300 - DNA, 25 bp, Homo sapien
cacttgatcccggaaaggctgcagt

SEQ ID NO: 177301 - DNA, 25 bp, Homo sapien
aggactggtgttgccctttggagct

SEQ ID NO: 177302 - DNA, 25 bp, Homo sapien
gagcttggtgaggagggtgggccta

SEQ ID NO: 177303 - DNA, 25 bp, Homo sapien
ctagggcttggcgagtgccactttt

SEQ ID NO: 177304 - DNA, 25 bp, Homo sapien
ggcttggcgagtgccacttttggca

SEQ ID NO: 177305 - DNA, 25 bp, Homo sapien
ggcgagtgccacttttggcaggttt

SEQ ID NO: 177306 - DNA, 25 bp, Homo sapien
ttggcaggtttggaaatttccaaat

SEQ ID NO: 177307 - DNA, 25 bp, Homo sapien
gggacactccagttctctagcatgg

SEQ ID NO: 177308 - DNA, 25 bp, Homo sapien
actccagttctctagcatggcctga

SEQ ID NO: 177309 - DNA, 25 bp, Homo sapien
cagttctctagcatggcctgaggta

SEQ ID NO: 177310 - DNA, 25 bp, Homo sapien
gttctctagcatggcctgaggtatg

SEQ ID NO: 177311 - DNA, 25 bp, Homo sapien
tatgtgcatgtggaggccagggtaa

SEQ ID NO: 177312 - DNA, 25 bp, Homo sapien
atagctgcaaaccaagcatcagtca

SEQ ID NO: 177313 - DNA, 25 bp, Homo sapien
agcatcagtcatttcacaccagcat

SEQ ID NO: 177314 - DNA, 25 bp, Homo sapien
aaatgtgtttacttcagaacggcac

SEQ ID NO: 177315 - DNA, 25 bp, Homo sapien
cttcagaacggcactacataaatgt

SEQ ID NO: 177316 - DNA, 25 bp, Homo sapien
caagatagcacttttggcaaactct

SEQ ID NO: 177317 - DNA, 25 bp, Homo sapien
ggcaaactcttagccaaggcttctt

SEQ ID NO: 177318 - DNA, 25 bp, Homo sapien
ggtgctgttataagatggtatccta

SEQ ID NO: 177319 - DNA, 25 bp, Homo sapien
atggtatcctattttcttgtttata

SEQ ID NO: 177320 - DNA, 25 bp, Homo sapien
gtttatacgttcattctatttgtta

SEQ ID NO: 177321 - DNA, 25 bp, Homo sapien
ctatttgttattgctactatgtgaa

SEQ ID NO: 177322 - DNA, 25 bp, Homo sapien
gtgaaactttcacatgcaaccaatg

SEQ ID NO: 177323 - DNA, 25 bp, Homo sapien
acactgccaaaacaatgcccgtaag

SEQ ID NO: 177324 - DNA, 25 bp, Homo sapien
ctgccaaaacaatgcccgtaagatg

SEQ ID NO: 177325 - DNA, 25 bp, Homo sapien
aacaatgcccgtaagatggcttatt

SEQ ID NO: 177326 - DNA, 25 bp, Homo sapien
caatgcccgtaagatggcttatttg

SEQ ID NO: 177327 - DNA, 25 bp, Homo sapien
aatggtgttactaaagtcacatata

SEQ ID NO: 177328 - DNA, 25 bp, Homo sapien
aaaggtgctgcactggtcccaagta

SEQ ID NO: 177329 - DNA, 25 bp, Homo sapien
ggtgctgcactggtcccaagtagta

SEQ ID NO: 177330 - DNA, 25 bp, Homo sapien
tgctgcactggtcccaagtagtagt

SEQ ID NO: 177331 - DNA, 25 bp, Homo sapien
tgcactggtcccaagtagtagtgtc

SEQ ID NO: 177332 - DNA, 25 bp, Homo sapien
tatatctatatctctaaactgctgt

SEQ ID NO: 177333 - DNA, 25 bp, Homo sapien
tatctatatctctaaactgctgtta

SEQ ID NO: 177334 - DNA, 25 bp, Homo sapien
tgctccgggccttcatcctgaagat

SEQ ID NO: 177335 - DNA, 25 bp, Homo sapien
gaagatcagcgtgtgcgatgccgtc

SEQ ID NO: 177336 - DNA, 25 bp, Homo sapien
aggctgtaccttcacagtcctggtg

SEQ ID NO: 177337 - DNA, 25 bp, Homo sapien
ggtgcacacgagagaagccgccact

SEQ ID NO: 177338 - DNA, 25 bp, Homo sapien
agccgccactcgcaacatggagaag

SEQ ID NO: 177339 - DNA, 25 bp, Homo sapien
ggtcatcaaggatttcccctggatc

SEQ ID NO: 177340 - DNA, 25 bp, Homo sapien
atttcccctggatcctggcggatga

SEQ ID NO: 177341 - DNA, 25 bp, Homo sapien
tgagcaggatgtccacatgcatgac

SEQ ID NO: 177342 - DNA, 25 bp, Homo sapien
tgacgtcggacattttaaaggtgca

SEQ ID NO: 177343 - DNA, 25 bp, Homo sapien
gctttacgtggaagagcgcgctcat

SEQ ID NO: 177344 - DNA, 25 bp, Homo sapien
gagcgcgctcataaaggcagctgaa

SEQ ID NO: 177345 - DNA, 25 bp, Homo sapien
tgtgatacaacaatacgtattcttc

SEQ ID NO: 177346 - DNA, 25 bp, Homo sapien
gtgatacaacaatacgtattcttca

SEQ ID NO: 177347 - DNA, 25 bp, Homo sapien
tacaacaatacgtattcttcaaatg

SEQ ID NO: 177348 - DNA, 25 bp, Homo sapien
aacaatacgtattcttcaaatgcgc

SEQ ID NO: 177349 - DNA, 25 bp, Homo sapien
acaatacgtattcttcaaatgcgcc

SEQ ID NO: 177350 - DNA, 25 bp, Homo sapien
gtatctcccgaatcaataccttcat

SEQ ID NO: 177351 - DNA, 25 bp, Homo sapien
tatctcccgaatcaataccttcatg

SEQ ID NO: 177352 - DNA, 25 bp, Homo sapien
atctcccgaatcaataccttcatgt

SEQ ID NO: 177353 - DNA, 25 bp, Homo sapien
tctcccgaatcaataccttcatgtg

SEQ ID NO: 177354 - DNA, 25 bp, Homo sapien
ctcccgaatcaataccttcatgtgc

SEQ ID NO: 177355 - DNA, 25 bp, Homo sapien
tcccgaatcaataccttcatgtgcc

SEQ ID NO: 177356 - DNA, 25 bp, Homo sapien
gaactgttcgtactagaattcaagg

SEQ ID NO: 177357 - DNA, 25 bp, Homo sapien
aactgttcgtactagaattcaagga

SEQ ID NO: 177358 - DNA, 25 bp, Homo sapien
actgttcgtactagaattcaaggag

SEQ ID NO: 177359 - DNA, 25 bp, Homo sapien
ctgttcgtactagaattcaaggaga

SEQ ID NO: 177360 - DNA, 25 bp, Homo sapien
tgttcgtactagaattcaaggagaa

SEQ ID NO: 177361 - DNA, 25 bp, Homo sapien
ttcagatgcaagagaacaatgtttc

SEQ ID NO: 177362 - DNA, 25 bp, Homo sapien
cagatgcaagagaacaatgtttctt

SEQ ID NO: 177363 - DNA, 25 bp, Homo sapien
gatgcaagagaacaatgtttcttca

SEQ ID NO: 177364 - DNA, 25 bp, Homo sapien
atgcaagagaacaatgtttcttcag

SEQ ID NO: 177365 - DNA, 25 bp, Homo sapien
ctgcatcctccagtgttacctggtg

SEQ ID NO: 177366 - DNA, 25 bp, Homo sapien
ttttgtgtttaaacagtcatcttct

SEQ ID NO: 177367 - DNA, 25 bp, Homo sapien
aatcattgtcaagatctttgtggag

SEQ ID NO: 177368 - DNA, 25 bp, Homo sapien
ggagttttccatagcctctgagact

SEQ ID NO: 177369 - DNA, 25 bp, Homo sapien
tctgagactcataaggccatccagg

SEQ ID NO: 177370 - DNA, 25 bp, Homo sapien
ataaggccatccaggccctcaatgg

SEQ ID NO: 177371 - DNA, 25 bp, Homo sapien
aatggccgctggtttgctggccgca

SEQ ID NO: 177372 - DNA, 25 bp, Homo sapien
gtacgaccaggagcgttttgataac

SEQ ID NO: 177373 - DNA, 25 bp, Homo sapien
gataacagtgacctctctgcgtgac

SEQ ID NO: 177374 - DNA, 25 bp, Homo sapien
agtgacctctctgcgtgacagtggt

SEQ ID NO: 177375 - DNA, 25 bp, Homo sapien
gacttgcacttgttccttgtttcct

SEQ ID NO: 177376 - DNA, 25 bp, Homo sapien
tcctctgggttttatagtgatacag

SEQ ID NO: 177377 - DNA, 25 bp, Homo sapien
agcccagcctacagtgcggataaag

SEQ ID NO: 177378 - DNA, 25 bp, Homo sapien
gtcaccagagacctgattgttgcag

SEQ ID NO: 177379 - DNA, 25 bp, Homo sapien
gattgttgcagaggcctagatgctc

SEQ ID NO: 177380 - DNA, 25 bp, Homo sapien
tagatgctctgagggccattcacaa

SEQ ID NO: 177381 - DNA, 25 bp, Homo sapien
attcacaattctcagggctcagcag

SEQ ID NO: 177382 - DNA, 25 bp, Homo sapien
cagttccaggataaactgctgcctg

SEQ ID NO: 177383 - DNA, 25 bp, Homo sapien
ggatgaatcagtcaccccgaatctt

SEQ ID NO: 177384 - DNA, 25 bp, Homo sapien
atggcagacattgagtacaggcttt

SEQ ID NO: 177385 - DNA, 25 bp, Homo sapien
agtacaggctttctgttggcaccaa

SEQ ID NO: 177386 - DNA, 25 bp, Homo sapien
ggcaccaacgagaagatccagctga

SEQ ID NO: 177387 - DNA, 25 bp, Homo sapien
tgagctccctcattgctgcatttca

SEQ ID NO: 177388 - DNA, 25 bp, Homo sapien
tgctgcatttcaagtcaccagagac

SEQ ID NO: 177389 - DNA, 25 bp, Homo sapien
gctgctgaaggaaggacacagaatg

SEQ ID NO: 177390 - DNA, 25 bp, Homo sapien
gaatggataagccagccaactgcac

SEQ ID NO: 177391 - DNA, 25 bp, Homo sapien
gccaactgcaccaacgaactgtaca

SEQ ID NO: 177392 - DNA, 25 bp, Homo sapien
actgtacatgatgatgagggactgt

SEQ ID NO: 177393 - DNA, 25 bp, Homo sapien
tcccagagaccaacgttcaagcagt

SEQ ID NO: 177394 - DNA, 25 bp, Homo sapien
gcagttggtagaagacttggatcga

SEQ ID NO: 177395 - DNA, 25 bp, Homo sapien
ttggatcgaattctcactctcacaa

SEQ ID NO: 177396 - DNA, 25 bp, Homo sapien
gaattctcactctcacaaccaatga

SEQ ID NO: 177397 - DNA, 25 bp, Homo sapien
acaaccaatgagtaaagccaaggat

SEQ ID NO: 177398 - DNA, 25 bp, Homo sapien
atggaaagccagcttcttgctgaaa

SEQ ID NO: 177399 - DNA, 25 bp, Homo sapien
ccagcttcttgctgaaactccacta

SEQ ID NO: 177400 - DNA, 25 bp, Homo sapien
tgggagatcttcactttagggggct

SEQ ID NO: 177401 - DNA, 25 bp, Homo sapien
gccctacccagggattcccgtggag

SEQ ID NO: 177402 - DNA, 25 bp, Homo sapien
ggacacagaatggataagccagcca

SEQ ID NO: 177403 - DNA, 25 bp, Homo sapien
gaatggataagccagccaactgcac

SEQ ID NO: 177404 - DNA, 25 bp, Homo sapien
atggataagccagccaactgcacca

SEQ ID NO: 177405 - DNA, 25 bp, Homo sapien
agccaactgcaccaacgaactgtac

SEQ ID NO: 177406 - DNA, 25 bp, Homo sapien
gccaactgcaccaacgaactgtaca

SEQ ID NO: 177407 - DNA, 25 bp, Homo sapien
tcccagagaccaacgttcaagcagt

SEQ ID NO: 177408 - DNA, 25 bp, Homo sapien
gagaccaacgttcaagcagttggta

SEQ ID NO: 177409 - DNA, 25 bp, Homo sapien
gcagttggtagaagacttggatcga

SEQ ID NO: 177410 - DNA, 25 bp, Homo sapien
ttggtagaagacttggatcgaattc

SEQ ID NO: 177411 - DNA, 25 bp, Homo sapien
aagctaaagtggaagttattgccaa

SEQ ID NO: 177412 - DNA, 25 bp, Homo sapien
tattgccaaaggaactgtctgtaag

SEQ ID NO: 177413 - DNA, 25 bp, Homo sapien
atctttcacctgaaacaacctagtg

SEQ ID NO: 177414 - DNA, 25 bp, Homo sapien
gtgtttgagaaattttgccttgcca

SEQ ID NO: 177415 - DNA, 25 bp, Homo sapien
tgccttgccaagtataacttgtata

SEQ ID NO: 177416 - DNA, 25 bp, Homo sapien
aacttgtatatcttgactctgtggt

SEQ ID NO: 177417 - DNA, 25 bp, Homo sapien
gactctgtggtagatttcaagttca

SEQ ID NO: 177418 - DNA, 25 bp, Homo sapien
ggtagatttcaagttcaatgttatt

SEQ ID NO: 177419 - DNA, 25 bp, Homo sapien
ttccgtaaaccgtgtcacttataag

SEQ ID NO: 177420 - DNA, 25 bp, Homo sapien
aaccgtgtcacttataagcacagta

SEQ ID NO: 177421 - DNA, 25 bp, Homo sapien
aagatttgtcatgtgtttgaagaaa

SEQ ID NO: 177422 - DNA, 25 bp, Homo sapien
gatttcaaggcatggaagttctctg

SEQ ID NO: 177423 - DNA, 25 bp, Homo sapien
ggaagttctctgtgatacaacaata

SEQ ID NO: 177424 - DNA, 25 bp, Homo sapien
cttcaaatgcgccttatgctactta

SEQ ID NO: 177425 - DNA, 25 bp, Homo sapien
gcgccttatgctacttatctcagaa

SEQ ID NO: 177426 - DNA, 25 bp, Homo sapien
atgctacttatctcagaaacaggtt

SEQ ID NO: 177427 - DNA, 25 bp, Homo sapien
ggttttaaaatgaagtgctttccag

SEQ ID NO: 177428 - DNA, 25 bp, Homo sapien
acacccagggttactgaggacttat

SEQ ID NO: 177429 - DNA, 25 bp, Homo sapien
tactgaggacttatgctgcctgacc

SEQ ID NO: 177430 - DNA, 25 bp, Homo sapien
ttatgctgcctgacctggttagatg

SEQ ID NO: 177431 - DNA, 25 bp, Homo sapien
gcctgacctggttagatgtacatgg

SEQ ID NO: 177432 - DNA, 25 bp, Homo sapien
gtacatggaggtatctcccgaatca

SEQ ID NO: 177433 - DNA, 25 bp, Homo sapien
tctagtgatgattaactcccttggc

SEQ ID NO: 177434 - DNA, 25 bp, Homo sapien
ctggatatgtagtagtcccctttat

SEQ ID NO: 177435 - DNA, 25 bp, Homo sapien
tgtagtagtcccctttatccatggt

SEQ ID NO: 177436 - DNA, 25 bp, Homo sapien
gtcccctttatccatggttttgctt

SEQ ID NO: 177437 - DNA, 25 bp, Homo sapien
ttcagtaacacctagtcaactatgg

SEQ ID NO: 177438 - DNA, 25 bp, Homo sapien
acctagtcaactatggtctgaaaat

SEQ ID NO: 177439 - DNA, 25 bp, Homo sapien
ttaatagtacgatgtactgctcccc

SEQ ID NO: 177440 - DNA, 25 bp, Homo sapien
catcctttcatttaacttggagtca

SEQ ID NO: 177441 - DNA, 25 bp, Homo sapien
cttggagtcactttagcatttcttg

SEQ ID NO: 177442 - DNA, 25 bp, Homo sapien
gcatttcttgtgaggcagttctagt

SEQ ID NO: 177443 - DNA, 25 bp, Homo sapien
cttgtgaggcagttctagtgatgat

SEQ ID NO: 177444 - DNA, 25 bp, Homo sapien
ggacgcgtctggatgaccgaatcat

SEQ ID NO: 177445 - DNA, 25 bp, Homo sapien
ccgaatcattcgcacagactgggac

SEQ ID NO: 177446 - DNA, 25 bp, Homo sapien
caggctttaaggagggcaggcaata

SEQ ID NO: 177447 - DNA, 25 bp, Homo sapien
tcgggatgagtatcggcaggactac

SEQ ID NO: 177448 - DNA, 25 bp, Homo sapien
tatcggcaggactacgatgctggga

SEQ ID NO: 177449 - DNA, 25 bp, Homo sapien
agtggtgagagctctgtcagtgaca

SEQ ID NO: 177450 - DNA, 25 bp, Homo sapien
agtgacaaacactcctttggcctgt

SEQ ID NO: 177451 - DNA, 25 bp, Homo sapien
cctttggcctgttgaatttgctgaa

SEQ ID NO: 177452 - DNA, 25 bp, Homo sapien
gaacatcacctaaagtctgcacacg

SEQ ID NO: 177453 - DNA, 25 bp, Homo sapien
taaagtctgcacacgagcccatttt

SEQ ID NO: 177454 - DNA, 25 bp, Homo sapien
acacgagcccatttttaccaagatt

SEQ ID NO: 177455 - DNA, 25 bp, Homo sapien
gaataatagaagaacatccaaggag

SEQ ID NO: 177456 - DNA, 25 bp, Homo sapien
gaacatccaaggagaaacagagaca

SEQ ID NO: 177457 - DNA, 25 bp, Homo sapien
aacagagacaggcccaagagatgaa

SEQ ID NO: 177458 - DNA, 25 bp, Homo sapien
gagggcatgcgcacaaggctgacca

SEQ ID NO: 177459 - DNA, 25 bp, Homo sapien
ggcatgcgcacaaggctgaccaaga

SEQ ID NO: 177460 - DNA, 25 bp, Homo sapien
gcgcacaaggctgaccaagagagaa

SEQ ID NO: 177461 - DNA, 25 bp, Homo sapien
aaagaagtaggcatgagggatcaca

SEQ ID NO: 177462 - DNA, 25 bp, Homo sapien
aggcatgagggatcacagggcccca

SEQ ID NO: 177463 - DNA, 25 bp, Homo sapien
atgagggatcacagggccccagaag

SEQ ID NO: 177464 - DNA, 25 bp, Homo sapien
aaaggctctgaaagccagctgccga

SEQ ID NO: 177465 - DNA, 25 bp, Homo sapien
gagccccacacggaggcatctgcac

SEQ ID NO: 177466 - DNA, 25 bp, Homo sapien
gccttcaacagtaagatttttactg

SEQ ID NO: 177467 - DNA, 25 bp, Homo sapien
tcaacagtaagatttttactggcca

SEQ ID NO: 177468 - DNA, 25 bp, Homo sapien
caacagtaagatttttactggccag

SEQ ID NO: 177469 - DNA, 25 bp, Homo sapien
aacagtaagatttttactggccagg

SEQ ID NO: 177470 - DNA, 25 bp, Homo sapien
acagtaagatttttactggccaggt

SEQ ID NO: 177471 - DNA, 25 bp, Homo sapien
agtaagatttttactggccaggtgt

SEQ ID NO: 177472 - DNA, 25 bp, Homo sapien
caatttgggaagtctgggaggtcaa

SEQ ID NO: 177473 - DNA, 25 bp, Homo sapien
tttgggaagtctgggaggtcaaggc

SEQ ID NO: 177474 - DNA, 25 bp, Homo sapien
caaaaatacaaacgtcagccagctg

SEQ ID NO: 177475 - DNA, 25 bp, Homo sapien
gaatcacttgatcccggaaaggctg

SEQ ID NO: 177476 - DNA, 25 bp, Homo sapien
cacttgatcccggaaaggctgcagt

SEQ ID NO: 177477 - DNA, 25 bp, Homo sapien
aacatctggagttggagccgcacat

SEQ ID NO: 177478 - DNA, 25 bp, Homo sapien
gagttggagccgcacatctggtttc

SEQ ID NO: 177479 - DNA, 25 bp, Homo sapien
gagccgcacatctggtttcggagtt

SEQ ID NO: 177480 - DNA, 25 bp, Homo sapien
gcacatctggtttcggagttcgcct

SEQ ID NO: 177481 - DNA, 25 bp, Homo sapien
atctggtttcggagttcgcctgcgc

SEQ ID NO: 177482 - DNA, 25 bp, Homo sapien
tcggagttcgcctgcgccgctgtgc

SEQ ID NO: 177483 - DNA, 25 bp, Homo sapien
cccagtcaattcctgtccgggagca

SEQ ID NO: 177484 - DNA, 25 bp, Homo sapien
tcctgtccgggagcagtagtcattg

SEQ ID NO: 177485 - DNA, 25 bp, Homo sapien
ccgggagcagtagtcattgttgttt

SEQ ID NO: 177486 - DNA, 25 bp, Homo sapien
tcattgttgttttaacctcccctct

SEQ ID NO: 177487 - DNA, 25 bp, Homo sapien
gggaccgcgctagggctccgaggag

SEQ ID NO: 177488 - DNA, 25 bp, Homo sapien
ggttaattttacactagcttgctca

SEQ ID NO: 177489 - DNA, 25 bp, Homo sapien
tacactagcttgctcactgatgcat

SEQ ID NO: 177490 - DNA, 25 bp, Homo sapien
tagcttgctcactgatgcatctctc

SEQ ID NO: 177491 - DNA, 25 bp, Homo sapien
tgctcactgatgcatctctcatcaa

SEQ ID NO: 177492 - DNA, 25 bp, Homo sapien
gatgcatctctcatcaatgctacgg

SEQ ID NO: 177493 - DNA, 25 bp, Homo sapien
aatgctacggaaggctttgattcat

SEQ ID NO: 177494 - DNA, 25 bp, Homo sapien
ggaaggctttgattcatcagtctcg

SEQ ID NO: 177495 - DNA, 25 bp, Homo sapien
agtctcgggctcttggaatacctaa

SEQ ID NO: 177496 - DNA, 25 bp, Homo sapien
tcgggctcttggaatacctaatttt

SEQ ID NO: 177497 - DNA, 25 bp, Homo sapien
ggctcttggaatacctaattttaat

SEQ ID NO: 177498 - DNA, 25 bp, Homo sapien
ttccatttacagttatttcttgttt

SEQ ID NO: 177499 - DNA, 25 bp, Homo sapien
atgagtaaacttgtatgtctatttt

SEQ ID NO: 177500 - DNA, 25 bp, Homo sapien
gaatatgaaagagttcttgatccta

SEQ ID NO: 177501 - DNA, 25 bp, Homo sapien
atgaaagagttcttgatcctaaaga

SEQ ID NO: 177502 - DNA, 25 bp, Homo sapien
gatcctaaagaaatttagtggcaca

SEQ ID NO: 177503 - DNA, 25 bp, Homo sapien
gtggcacagaaaacaaagtgaattt

SEQ ID NO: 177504 - DNA, 25 bp, Homo sapien
tgttagcataattattcctattctt

SEQ ID NO: 177505 - DNA, 25 bp, Homo sapien
cttcattttaagtcattgcaatgga

SEQ ID NO: 177506 - DNA, 25 bp, Homo sapien
gtcattgcaatggaaagtaatatta

SEQ ID NO: 177507 - DNA, 25 bp, Homo sapien
ggtaattacaacatattatcagtca

SEQ ID NO: 177508 - DNA, 25 bp, Homo sapien
attatcagtcacagttttctttcca

SEQ ID NO: 177509 - DNA, 25 bp, Homo sapien
ttttgttattccctgtatataaata

SEQ ID NO: 177510 - DNA, 25 bp, Homo sapien
gttgtcacttatttccattgggatt

SEQ ID NO: 177511 - DNA, 25 bp, Homo sapien
tccattgtaagctgtgtatgtgcgt

SEQ ID NO: 177512 - DNA, 25 bp, Homo sapien
gcgtgtttggaaaagtgtattcata

SEQ ID NO: 177513 - DNA, 25 bp, Homo sapien
tttttcttcatctgttatcatactt

SEQ ID NO: 177514 - DNA, 25 bp, Homo sapien
gtgtaaaggcacaggttactcatga

SEQ ID NO: 177515 - DNA, 25 bp, Homo sapien
ttactcatgatgcttctgcagagac

SEQ ID NO: 177516 - DNA, 25 bp, Homo sapien
gagactgtgggctacaccacatatg

SEQ ID NO: 177517 - DNA, 25 bp, Homo sapien
tgggctacaccacatatgttatttg

SEQ ID NO: 177518 - DNA, 25 bp, Homo sapien
ttagtacagtacatacttgcattac

SEQ ID NO: 177519 - DNA, 25 bp, Homo sapien
tacttgcattacataggtacttcaa

SEQ ID NO: 177520 - DNA, 25 bp, Homo sapien
aggtacttcaagcaacacaataaaa

SEQ ID NO: 177521 - DNA, 25 bp, Homo sapien
tcatgttgcccggagtggtcgcaaa

SEQ ID NO: 177522 - DNA, 25 bp, Homo sapien
gttgcccggagtggtcgcaaactcc

SEQ ID NO: 177523 - DNA, 25 bp, Homo sapien
ttgcccggagtggtcgcaaactcct

SEQ ID NO: 177524 - DNA, 25 bp, Homo sapien
accatgcccggtctcatttatgttt

SEQ ID NO: 177525 - DNA, 25 bp, Homo sapien
ccatgcccggtctcatttatgtttc

SEQ ID NO: 177526 - DNA, 25 bp, Homo sapien
catgcccggtctcatttatgtttca

SEQ ID NO: 177527 - DNA, 25 bp, Homo sapien
atgcccggtctcatttatgtttcat

SEQ ID NO: 177528 - DNA, 25 bp, Homo sapien
tatacacatagcctagcattaattt

SEQ ID NO: 177529 - DNA, 25 bp, Homo sapien
atacacatagcctagcattaatttt

SEQ ID NO: 177530 - DNA, 25 bp, Homo sapien
acacatagcctagcattaattttat

SEQ ID NO: 177531 - DNA, 25 bp, Homo sapien
acatagcctagcattaattttatac

SEQ ID NO: 177532 - DNA, 25 bp, Homo sapien
ctgtatttttgtgtctggtcttccc

SEQ ID NO: 177533 - DNA, 25 bp, Homo sapien
gtatttttgtgtctggtcttccctt

SEQ ID NO: 177534 - DNA, 25 bp, Homo sapien
ggtcttccctttctggcttctagga

SEQ ID NO: 177535 - DNA, 25 bp, Homo sapien
tttctggcttctaggacatccatgc

SEQ ID NO: 177536 - DNA, 25 bp, Homo sapien
tacaagtacctgaatgctgcgacaa

SEQ ID NO: 177537 - DNA, 25 bp, Homo sapien
tacctgaatgctgcgacaagcagat

SEQ ID NO: 177538 - DNA, 25 bp, Homo sapien
agccagcctgggacttttgtaagaa

SEQ ID NO: 177539 - DNA, 25 bp, Homo sapien
tgtaagaatttttgggtgactcact

SEQ ID NO: 177540 - DNA, 25 bp, Homo sapien
gggtgactcacttagatgtcgtttc

SEQ ID NO: 177541 - DNA, 25 bp, Homo sapien
gactcacttagatgtcgtttccttc

SEQ ID NO: 177542 - DNA, 25 bp, Homo sapien
acttagatgtcgtttccttcttgcc

SEQ ID NO: 177543 - DNA, 25 bp, Homo sapien
gtggaattggaatttttatacttat

SEQ ID NO: 177544 - DNA, 25 bp, Homo sapien
gaaatcactggtaatttccacccca

SEQ ID NO: 177545 - DNA, 25 bp, Homo sapien
tcactggtaatttccaccccaaact

SEQ ID NO: 177546 - DNA, 25 bp, Homo sapien
tattttatgccttgattaatgaaac

SEQ ID NO: 177547 - DNA, 25 bp, Homo sapien
tgattttcagttttggtcacctgag

SEQ ID NO: 177548 - DNA, 25 bp, Homo sapien
tttcagttttggtcacctgaggaac

SEQ ID NO: 177549 - DNA, 25 bp, Homo sapien
gtcacctgaggaacctatctttgtt

SEQ ID NO: 177550 - DNA, 25 bp, Homo sapien
ggaaaagcccattttctaaacagat

SEQ ID NO: 177551 - DNA, 25 bp, Homo sapien
aagcccattttctaaacagatacaa

SEQ ID NO: 177552 - DNA, 25 bp, Homo sapien
atacaatattgccacaacaatgtgc

SEQ ID NO: 177553 - DNA, 25 bp, Homo sapien
caacaatgtgcagaaacctttttga

SEQ ID NO: 177554 - DNA, 25 bp, Homo sapien
caggatcttgtcatgttgcccggag

SEQ ID NO: 177555 - DNA, 25 bp, Homo sapien
tcatgttgcccggagtggtcgcaaa

SEQ ID NO: 177556 - DNA, 25 bp, Homo sapien
gttgcccggagtggtcgcaaactcc

SEQ ID NO: 177557 - DNA, 25 bp, Homo sapien
ttgcccggagtggtcgcaaactcct

SEQ ID NO: 177558 - DNA, 25 bp, Homo sapien
ggagtggtcgcaaactcctgagctc

SEQ ID NO: 177559 - DNA, 25 bp, Homo sapien
accatgcccggtctcatttatgttt

SEQ ID NO: 177560 - DNA, 25 bp, Homo sapien
catgcccggtctcatttatgtttca

SEQ ID NO: 177561 - DNA, 25 bp, Homo sapien
atgcccggtctcatttatgtttcat

SEQ ID NO: 177562 - DNA, 25 bp, Homo sapien
tatacacatagcctagcattaattt

SEQ ID NO: 177563 - DNA, 25 bp, Homo sapien
acacatagcctagcattaattttat

SEQ ID NO: 177564 - DNA, 25 bp, Homo sapien
acatagcctagcattaattttatac

SEQ ID NO: 177565 - DNA, 25 bp, Homo sapien
tgcctccgatgttccccatgcagcc

SEQ ID NO: 177566 - DNA, 25 bp, Homo sapien
catgcttcctgatctgactctggaa

SEQ ID NO: 177567 - DNA, 25 bp, Homo sapien
gactctggaagcttggccatcaaca

SEQ ID NO: 177568 - DNA, 25 bp, Homo sapien
ggccatcaacagacaagaccaagcg

SEQ ID NO: 177569 - DNA, 25 bp, Homo sapien
gggaatgaatacttcagatgctttc

SEQ ID NO: 177570 - DNA, 25 bp, Homo sapien
gaatgaatacttcagatgctttcag

SEQ ID NO: 177571 - DNA, 25 bp, Homo sapien
gaatacttcagatgctttcaggagt

SEQ ID NO: 177572 - DNA, 25 bp, Homo sapien
aatacttcagatgctttcaggagtg

SEQ ID NO: 177573 - DNA, 25 bp, Homo sapien
tacttcagatgctttcaggagtgac

SEQ ID NO: 177574 - DNA, 25 bp, Homo sapien
ctttcaggagtgacacaagaacaca

SEQ ID NO: 177575 - DNA, 25 bp, Homo sapien
ggagtgacacaagaacacaatgatt

SEQ ID NO: 177576 - DNA, 25 bp, Homo sapien
cgtggaggtccgattgtgtcagtct

SEQ ID NO: 177577 - DNA, 25 bp, Homo sapien
gattgtgtcagtctttagctttgca

SEQ ID NO: 177578 - DNA, 25 bp, Homo sapien
ctttagctttgcatgagagttgtca

SEQ ID NO: 177579 - DNA, 25 bp, Homo sapien
tgtcaagcgaatccgtaccttcaaa

SEQ ID NO: 177580 - DNA, 25 bp, Homo sapien
tcaaaacgccgtaagaccgatgtgt

SEQ ID NO: 177581 - DNA, 25 bp, Homo sapien
agaccgatgtgttattgttcccttc

SEQ ID NO: 177582 - DNA, 25 bp, Homo sapien
attgttcccttctgaatgagcaccg

SEQ ID NO: 177583 - DNA, 25 bp, Homo sapien
aatgagcaccgacgttgggatgatc

SEQ ID NO: 177584 - DNA, 25 bp, Homo sapien
agtgtgtaccaatgcgaaacccctt

SEQ ID NO: 177585 - DNA, 25 bp, Homo sapien
aatactcccctagagagtcacgtat

SEQ ID NO: 177586 - DNA, 25 bp, Homo sapien
agtcacgtatcgaactcatacccaa

SEQ ID NO: 177587 - DNA, 25 bp, Homo sapien
tcaggctctgcttcgtgacccgtga

SEQ ID NO: 177588 - DNA, 25 bp, Homo sapien
tctgcttcgtgacccgtgacccatg

SEQ ID NO: 177589 - DNA, 25 bp, Homo sapien
cgtgacccatgacccacagtgctgg

SEQ ID NO: 177590 - DNA, 25 bp, Homo sapien
gggccactatagcagccaccagaag

SEQ ID NO: 177591 - DNA, 25 bp, Homo sapien
ctcagggaagcccaaggcctgcaga

SEQ ID NO: 177592 - DNA, 25 bp, Homo sapien
gaagcccaaggcctgcagaagcctc

SEQ ID NO: 177593 - DNA, 25 bp, Homo sapien
ctgcgcccctgtctttgtaaattga

SEQ ID NO: 177594 - DNA, 25 bp, Homo sapien
tgtaaattgacccttctggagtggg

SEQ ID NO: 177595 - DNA, 25 bp, Homo sapien
tttcttagtctgatgccaagcaagg

SEQ ID NO: 177596 - DNA, 25 bp, Homo sapien
gtctgatgccaagcaaggccttttc

SEQ ID NO: 177597 - DNA, 25 bp, Homo sapien
tgatgccaagcaaggccttttctga

SEQ ID NO: 177598 - DNA, 25 bp, Homo sapien
gggaggtaccaattctggacaaagt

SEQ ID NO: 177599 - DNA, 25 bp, Homo sapien
tgccactacaacaacactaaacctg

SEQ ID NO: 177600 - DNA, 25 bp, Homo sapien
tgaactttttcaactccgttggtgg

SEQ ID NO: 177601 - DNA, 25 bp, Homo sapien
ttttcaactccgttggtggtgggag

SEQ ID NO: 177602 - DNA, 25 bp, Homo sapien
ggccagcgggcagaaatttactgtt

SEQ ID NO: 177603 - DNA, 25 bp, Homo sapien
agaaatttactgttggccactgcca

SEQ ID NO: 177604 - DNA, 25 bp, Homo sapien
actgccaggtctatttccatatttc

SEQ ID NO: 177605 - DNA, 25 bp, Homo sapien
ttcaaaggaatattgggtgctgcat

SEQ ID NO: 177606 - DNA, 25 bp, Homo sapien
ttgggtgctgcatataggaactgaa

SEQ ID NO: 177607 - DNA, 25 bp, Homo sapien
gggtcaatgtattaaacctgtgatt

SEQ ID NO: 177608 - DNA, 25 bp, Homo sapien
gcagatgttcaaaatacctggtaca

SEQ ID NO: 177609 - DNA, 25 bp, Homo sapien
tttctgctgcaaggtcccctggcag

SEQ ID NO: 177610 - DNA, 25 bp, Homo sapien
gtcttctacttgaaacgtctgagtc

SEQ ID NO: 177611 - DNA, 25 bp, Homo sapien
aaaagtagcctcaggtggccagaag

SEQ ID NO: 177612 - DNA, 25 bp, Homo sapien
gccagaaggccgagttgtgtaatga

SEQ ID NO: 177613 - DNA, 25 bp, Homo sapien
aggcccaagcagcttgttttgcaaa

SEQ ID NO: 177614 - DNA, 25 bp, Homo sapien
ttgttttgcaaaggcccaagtcctc

SEQ ID NO: 177615 - DNA, 25 bp, Homo sapien
aagtcctcctgctaggaaaagcttt

SEQ ID NO: 177616 - DNA, 25 bp, Homo sapien
gaaaagcttttgcatgtgtcctgaa

SEQ ID NO: 177617 - DNA, 25 bp, Homo sapien
cttttgcatgtgtcctgaatgtgtc

SEQ ID NO: 177618 - DNA, 25 bp, Homo sapien
tgtgtctctgtaaacatagctgtta

SEQ ID NO: 177619 - DNA, 25 bp, Homo sapien
ggacctttagcccatagcggatgcc

SEQ ID NO: 177620 - DNA, 25 bp, Homo sapien
atcgaagtcagttattggtctccag

SEQ ID NO: 177621 - DNA, 25 bp, Homo sapien
agtcagttattggtctccagagtgc

SEQ ID NO: 177622 - DNA, 25 bp, Homo sapien
ctccagagtgcagctctgggagcct

SEQ ID NO: 177623 - DNA, 25 bp, Homo sapien
gggagccttttgaagaatcagcact

SEQ ID NO: 177624 - DNA, 25 bp, Homo sapien
tgaagaatcagcactcattaagagc

SEQ ID NO: 177625 - DNA, 25 bp, Homo sapien
gacctgattgggtggttgactagca

SEQ ID NO: 177626 - DNA, 25 bp, Homo sapien
tgactagcagtcacagaacctgtcc

SEQ ID NO: 177627 - DNA, 25 bp, Homo sapien
tgtcctcccaggctgttcctgaggc

SEQ ID NO: 177628 - DNA, 25 bp, Homo sapien
tttattttggcatgtctctggcctt

SEQ ID NO: 177629 - DNA, 25 bp, Homo sapien
accctcatgggcattgtctctgttt

SEQ ID NO: 177630 - DNA, 25 bp, Homo sapien
acagtatatcagatggtcagaacaa

SEQ ID NO: 177631 - DNA, 25 bp, Homo sapien
tcaggctctgcttcgtgacccgtga

SEQ ID NO: 177632 - DNA, 25 bp, Homo sapien
caggctctgcttcgtgacccgtgac

SEQ ID NO: 177633 - DNA, 25 bp, Homo sapien
tctgcttcgtgacccgtgacccatg

SEQ ID NO: 177634 - DNA, 25 bp, Homo sapien
ctgcttcgtgacccgtgacccatga

SEQ ID NO: 177635 - DNA, 25 bp, Homo sapien
tgcttcgtgacccgtgacccatgac

SEQ ID NO: 177636 - DNA, 25 bp, Homo sapien
ttcgtgacccgtgacccatgaccca

SEQ ID NO: 177637 - DNA, 25 bp, Homo sapien
cgtgacccgtgacccatgacccaca

SEQ ID NO: 177638 - DNA, 25 bp, Homo sapien
gggccactatagcagccaccagaag

SEQ ID NO: 177639 - DNA, 25 bp, Homo sapien
cagccaccagaagccgcgaggccct

SEQ ID NO: 177640 - DNA, 25 bp, Homo sapien
tgtaaattgacccttctggagtggg

SEQ ID NO: 177641 - DNA, 25 bp, Homo sapien
taaattgacccttctggagtggggg

SEQ ID NO: 177642 - DNA, 25 bp, Homo sapien
aatgaagatgaacatttattgatct

SEQ ID NO: 177643 - DNA, 25 bp, Homo sapien
atgaagatgaacatttattgatctt

SEQ ID NO: 177644 - DNA, 25 bp, Homo sapien
tgaagatgaacatttattgatcttc

SEQ ID NO: 177645 - DNA, 25 bp, Homo sapien
ttctacatacaagacttcaccataa

SEQ ID NO: 177646 - DNA, 25 bp, Homo sapien
tctacatacaagacttcaccataag

SEQ ID NO: 177647 - DNA, 25 bp, Homo sapien
ctacatacaagacttcaccataagg

SEQ ID NO: 177648 - DNA, 25 bp, Homo sapien
tacatacaagacttcaccataaggc

SEQ ID NO: 177649 - DNA, 25 bp, Homo sapien
caggagcagtgctcacgccttgtaa

SEQ ID NO: 177650 - DNA, 25 bp, Homo sapien
tctctactaaatattagcggggtgt

SEQ ID NO: 177651 - DNA, 25 bp, Homo sapien
ctctactaaatattagcggggtgtg

SEQ ID NO: 177652 - DNA, 25 bp, Homo sapien
acctgtagtcgcagcctttcgggag

SEQ ID NO: 177653 - DNA, 25 bp, Homo sapien
tggacaaagaccaccaacccaatat

SEQ ID NO: 177654 - DNA, 25 bp, Homo sapien
caacccaatatcaagccccataaag

SEQ ID NO: 177655 - DNA, 25 bp, Homo sapien
aaacagcataagcttgggatgacag

SEQ ID NO: 177656 - DNA, 25 bp, Homo sapien
gggatgacaggcgtttctggactcc

SEQ ID NO: 177657 - DNA, 25 bp, Homo sapien
tttctggactccctgtgatctcttc

SEQ ID NO: 177658 - DNA, 25 bp, Homo sapien
tgtgatctcttccaggttcttggtc

SEQ ID NO: 177659 - DNA, 25 bp, Homo sapien
ttccaggttcttggtcttcctcgct

SEQ ID NO: 177660 - DNA, 25 bp, Homo sapien
tgtcttcgtcccctggactgtccaa

SEQ ID NO: 177661 - DNA, 25 bp, Homo sapien
tgtccaacggcctctggctcactgt

SEQ ID NO: 177662 - DNA, 25 bp, Homo sapien
tcttcagcaacctatcaggaaactt

SEQ ID NO: 177663 - DNA, 25 bp, Homo sapien
aggaaacttcttgcgcttcctgcgg

SEQ ID NO: 177664 - DNA, 25 bp, Homo sapien
ttccattaaagcctccacctctgga

SEQ ID NO: 177665 - DNA, 25 bp, Homo sapien
attaaagcctccacctctggaactt

SEQ ID NO: 177666 - DNA, 25 bp, Homo sapien
aagcctccacctctggaacttctaa

SEQ ID NO: 177667 - DNA, 25 bp, Homo sapien
aaattgctttgagtgattcatacag

SEQ ID NO: 177668 - DNA, 25 bp, Homo sapien
gctttgagtgattcatacagagatg

SEQ ID NO: 177669 - DNA, 25 bp, Homo sapien
gaatataagcttccatcaatagtga

SEQ ID NO: 177670 - DNA, 25 bp, Homo sapien
aagcttccatcaatagtgattttaa

SEQ ID NO: 177671 - DNA, 25 bp, Homo sapien
gcaagcaagggaatttttttgtact

SEQ ID NO: 177672 - DNA, 25 bp, Homo sapien
ttgtactgtaattttgaatggaact

SEQ ID NO: 177673 - DNA, 25 bp, Homo sapien
tggaactgaaaaattatgcacgaat

SEQ ID NO: 177674 - DNA, 25 bp, Homo sapien
attatgcacgaataaagtacttttc

SEQ ID NO: 177675 - DNA, 25 bp, Homo sapien
tgtctctttctctctaggtgcataa

SEQ ID NO: 177676 - DNA, 25 bp, Homo sapien
ctctttctctctaggtgcataaaaa

SEQ ID NO: 177677 - DNA, 25 bp, Homo sapien
aataaactgcatattctccctttgc

SEQ ID NO: 177678 - DNA, 25 bp, Homo sapien
actgcatattctccctttgctttta

SEQ ID NO: 177679 - DNA, 25 bp, Homo sapien
atattctccctttgcttttaaaatg

SEQ ID NO: 177680 - DNA, 25 bp, Homo sapien
ctccctttgcttttaaaatgatgat

SEQ ID NO: 177681 - DNA, 25 bp, Homo sapien
gtttcagccatgcaaagcagggtat

SEQ ID NO: 177682 - DNA, 25 bp, Homo sapien
aaataatatttcagtgtaaccactc

SEQ ID NO: 177683 - DNA, 25 bp, Homo sapien
gtgtaaccactcagcggaagaaata

SEQ ID NO: 177684 - DNA, 25 bp, Homo sapien
gaaataaaccattccagttgcaata

SEQ ID NO: 177685 - DNA, 25 bp, Homo sapien
accattccagttgcaatacctgaaa

SEQ ID NO: 177686 - DNA, 25 bp, Homo sapien
aactgctggcagaactacctggact

SEQ ID NO: 177687 - DNA, 25 bp, Homo sapien
ggcagaactacctggacttccaccg

SEQ ID NO: 177688 - DNA, 25 bp, Homo sapien
ttccaccgctgtcagaaggcaatga

SEQ ID NO: 177689 - DNA, 25 bp, Homo sapien
gcaatgaccgctaaaggaggcgata

SEQ ID NO: 177690 - DNA, 25 bp, Homo sapien
ggaggcgatatctctgtgtgcgaat

SEQ ID NO: 177691 - DNA, 25 bp, Homo sapien
ctctgtgtgcgaatggtaccagcgt

SEQ ID NO: 177692 - DNA, 25 bp, Homo sapien
ggtaccagcgtgtgtaccagtccct

SEQ ID NO: 177693 - DNA, 25 bp, Homo sapien
tgagcaacgggctgaaggcacgttt

SEQ ID NO: 177694 - DNA, 25 bp, Homo sapien
ctgaaggcacgtttcccgggaagat

SEQ ID NO: 177695 - DNA, 25 bp, Homo sapien
ccgggaagatctgaactggctgcat

SEQ ID NO: 177696 - DNA, 25 bp, Homo sapien
accccaggatcctaaatcatgactt

SEQ ID NO: 177697 - DNA, 25 bp, Homo sapien
gacattcacaaatttagggactaaa

SEQ ID NO: 177698 - DNA, 25 bp, Homo sapien
gactaaatgctacctgggtttccag

SEQ ID NO: 177699 - DNA, 25 bp, Homo sapien
agggcacacctagacaaacaaggga

SEQ ID NO: 177700 - DNA, 25 bp, Homo sapien
agagtgtcagaatcagaatcatgga

SEQ ID NO: 177701 - DNA, 25 bp, Homo sapien
ccttgctcattcttgaggagcatta

SEQ ID NO: 177702 - DNA, 25 bp, Homo sapien
ggtatttcgaaactgccaagggtgc

SEQ ID NO: 177703 - DNA, 25 bp, Homo sapien
aagaacgtcatgatgatccagtcct

SEQ ID NO: 177704 - DNA, 25 bp, Homo sapien
aaatgcaactacaactgcccgcatg

SEQ ID NO: 177705 - DNA, 25 bp, Homo sapien
tgcccgcatgccaatgaagcagcgt

SEQ ID NO: 177706 - DNA, 25 bp, Homo sapien
tgaagcagcgtttcccttctacagg

SEQ ID NO: 177707 - DNA, 25 bp, Homo sapien
tacaggctgttcaatgacattcaca

SEQ ID NO: 177708 - DNA, 25 bp, Homo sapien
tagcctttcctagcaccctatgatt

SEQ ID NO: 177709 - DNA, 25 bp, Homo sapien
tagcaccctatgatttattcccttg

SEQ ID NO: 177710 - DNA, 25 bp, Homo sapien
gcaccctatgatttattcccttgag

SEQ ID NO: 177711 - DNA, 25 bp, Homo sapien
accctatgatttattcccttgagag

SEQ ID NO: 177712 - DNA, 25 bp, Homo sapien
tattcccttgagaggagtgttccct

SEQ ID NO: 177713 - DNA, 25 bp, Homo sapien
tcccttgagaggagtgttccctgat

SEQ ID NO: 177714 - DNA, 25 bp, Homo sapien
ttgagaggagtgttccctgatccct

SEQ ID NO: 177715 - DNA, 25 bp, Homo sapien
gaggagtgttccctgatccctgtgc

SEQ ID NO: 177716 - DNA, 25 bp, Homo sapien
gtgttccctgatccctgtgcctctt

SEQ ID NO: 177717 - DNA, 25 bp, Homo sapien
ttcccatctcaaccaggatcctgat

SEQ ID NO: 177718 - DNA, 25 bp, Homo sapien
atctcaaccaggatcctgatgtatg

SEQ ID NO: 177719 - DNA, 25 bp, Homo sapien
ggtagggaagtcaatattttcgatt

SEQ ID NO: 177720 - DNA, 25 bp, Homo sapien
gttttgcttagatcagtgttgaact

SEQ ID NO: 177721 - DNA, 25 bp, Homo sapien
gaactaagttggcatagcacacact

SEQ ID NO: 177722 - DNA, 25 bp, Homo sapien
tggcatagcacacactaacagttgt

SEQ ID NO: 177723 - DNA, 25 bp, Homo sapien
acactaacagttgtaggagatccat

SEQ ID NO: 177724 - DNA, 25 bp, Homo sapien
ggagatccatgagcatgctggatat

SEQ ID NO: 177725 - DNA, 25 bp, Homo sapien
gggatccaatctgtgatctattttt

SEQ ID NO: 177726 - DNA, 25 bp, Homo sapien
tacacataatttcagatcgtttggc

SEQ ID NO: 177727 - DNA, 25 bp, Homo sapien
atttcagatcgtttggctgtaaaat

SEQ ID NO: 177728 - DNA, 25 bp, Homo sapien
aaatttgtctgttttccacttggag

SEQ ID NO: 177729 - DNA, 25 bp, Homo sapien
gtctgttttccacttggagttattt

SEQ ID NO: 177730 - DNA, 25 bp, Homo sapien
gaaatgccaattacaggccaaagcg

SEQ ID NO: 177731 - DNA, 25 bp, Homo sapien
aaatgccaattacaggccaaagcgt

SEQ ID NO: 177732 - DNA, 25 bp, Homo sapien
aatgccaattacaggccaaagcgtt

SEQ ID NO: 177733 - DNA, 25 bp, Homo sapien
atgccaattacaggccaaagcgtta

SEQ ID NO: 177734 - DNA, 25 bp, Homo sapien
tgccaattacaggccaaagcgttat

SEQ ID NO: 177735 - DNA, 25 bp, Homo sapien
ccaattacaggccaaagcgttattt

SEQ ID NO: 177736 - DNA, 25 bp, Homo sapien
caattacaggccaaagcgttatttg

SEQ ID NO: 177737 - DNA, 25 bp, Homo sapien
aattacaggccaaagcgttatttgc

SEQ ID NO: 177738 - DNA, 25 bp, Homo sapien
attacaggccaaagcgttatttgcc

SEQ ID NO: 177739 - DNA, 25 bp, Homo sapien
ttacaggccaaagcgttatttgcca

SEQ ID NO: 177740 - DNA, 25 bp, Homo sapien
acaggccaaagcgttatttgccaag

SEQ ID NO: 177741 - DNA, 25 bp, Homo sapien
tgtagattttactctatgtacagaa

SEQ ID NO: 177742 - DNA, 25 bp, Homo sapien
aacaaatctggcatggtttgcggag

SEQ ID NO: 177743 - DNA, 25 bp, Homo sapien
gtttgcggaggttagatttactgga

SEQ ID NO: 177744 - DNA, 25 bp, Homo sapien
actggaaatgtattcatactgtgaa

SEQ ID NO: 177745 - DNA, 25 bp, Homo sapien
aattgtgctctgatggttaaaagac

SEQ ID NO: 177746 - DNA, 25 bp, Homo sapien
gacaagattgtcaagcattccgtat

SEQ ID NO: 177747 - DNA, 25 bp, Homo sapien
gtcaagcattccgtattaacagtgg

SEQ ID NO: 177748 - DNA, 25 bp, Homo sapien
gtaaaaaattctgtacaactttctg

SEQ ID NO: 177749 - DNA, 25 bp, Homo sapien
gtacaatattgattcccatctggca

SEQ ID NO: 177750 - DNA, 25 bp, Homo sapien
ttgattcccatctggcatattctaa

SEQ ID NO: 177751 - DNA, 25 bp, Homo sapien
gcatattctaatcaggttataggtc

SEQ ID NO: 177752 - DNA, 25 bp, Homo sapien
actacctttatgagacgactctacc

SEQ ID NO: 177753 - DNA, 25 bp, Homo sapien
ttatgagacgactctacctttgctg

SEQ ID NO: 177754 - DNA, 25 bp, Homo sapien
atgagacgactctacctttgctgaa

SEQ ID NO: 177755 - DNA, 25 bp, Homo sapien
gagacgactctacctttgctgaagg

SEQ ID NO: 177756 - DNA, 25 bp, Homo sapien
gacgactctacctttgctgaaggaa

SEQ ID NO: 177757 - DNA, 25 bp, Homo sapien
gactctacctttgctgaaggaaaag

SEQ ID NO: 177758 - DNA, 25 bp, Homo sapien
tcctgcagcacccaagcaagttttc

SEQ ID NO: 177759 - DNA, 25 bp, Homo sapien
gcaagttttcccatttcgagacatc

SEQ ID NO: 177760 - DNA, 25 bp, Homo sapien
gttttcccatttcgagacatctttt

SEQ ID NO: 177761 - DNA, 25 bp, Homo sapien
ttcccatttcgagacatcttttatt

SEQ ID NO: 177762 - DNA, 25 bp, Homo sapien
catttcgagacatcttttattatga

SEQ ID NO: 177763 - DNA, 25 bp, Homo sapien
ccaactgcaggctctgtgggaggat

SEQ ID NO: 177764 - DNA, 25 bp, Homo sapien
aggatcagggctgggaactctagcc

SEQ ID NO: 177765 - DNA, 25 bp, Homo sapien
gctgggaactctagccctggccctg

SEQ ID NO: 177766 - DNA, 25 bp, Homo sapien
tcatcttgtggcaaaggcggcaacg

SEQ ID NO: 177767 - DNA, 25 bp, Homo sapien
gaggagcgtgcagaactgaatcagt

SEQ ID NO: 177768 - DNA, 25 bp, Homo sapien
gaactgaatcagtcggaggaacctg

SEQ ID NO: 177769 - DNA, 25 bp, Homo sapien
aatcagtcggaggaacctgaggcag

SEQ ID NO: 177770 - DNA, 25 bp, Homo sapien
cccaggaaagccgtgctgtcagcat

SEQ ID NO: 177771 - DNA, 25 bp, Homo sapien
gaaagccgtgctgtcagcatcagca

SEQ ID NO: 177772 - DNA, 25 bp, Homo sapien
atcagcatcatcgaaccaggcgagg

SEQ ID NO: 177773 - DNA, 25 bp, Homo sapien
cagcatcatcgaaccaggcgaggag

SEQ ID NO: 177774 - DNA, 25 bp, Homo sapien
aaagcacatgtgatcaatataacaa

SEQ ID NO: 177775 - DNA, 25 bp, Homo sapien
ggagaagccaatgcagaactgatgg

SEQ ID NO: 177776 - DNA, 25 bp, Homo sapien
gatgggaaaggaccaattatttata

SEQ ID NO: 177777 - DNA, 25 bp, Homo sapien
attttttacctctgcatcagtgcat

SEQ ID NO: 177778 - DNA, 25 bp, Homo sapien
acctctgcatcagtgcatttctatt

SEQ ID NO: 177779 - DNA, 25 bp, Homo sapien
ggtgctaaaatgattcaatttgcat

SEQ ID NO: 177780 - DNA, 25 bp, Homo sapien
atttgcattttctgatcctgtagtg

SEQ ID NO: 177781 - DNA, 25 bp, Homo sapien
tgcattttctgatcctgtagtgcct

SEQ ID NO: 177782 - DNA, 25 bp, Homo sapien
atcctgtagtgcctctatagaagta

SEQ ID NO: 177783 - DNA, 25 bp, Homo sapien
agtgcctctatagaagtacccacag

SEQ ID NO: 177784 - DNA, 25 bp, Homo sapien
aattttctagattactccaataaag

SEQ ID NO: 177785 - DNA, 25 bp, Homo sapien
tggatggaagaaacatacctatgtc

SEQ ID NO: 177786 - DNA, 25 bp, Homo sapien
aatgatattgtgaaacccggaatga

SEQ ID NO: 177787 - DNA, 25 bp, Homo sapien
gaagaattattggatatgggctgcc

SEQ ID NO: 177788 - DNA, 25 bp, Homo sapien
tggatatgggctgccatttccaaaa

SEQ ID NO: 177789 - DNA, 25 bp, Homo sapien
tttccaaaaaatcctgaccaacgtg

SEQ ID NO: 177790 - DNA, 25 bp, Homo sapien
gaccaacgtggtgaccttctaatag

SEQ ID NO: 177791 - DNA, 25 bp, Homo sapien
gaatttgaggtgtccttcccagata

SEQ ID NO: 177792 - DNA, 25 bp, Homo sapien
gtgtccttcccagatactatatctt

SEQ ID NO: 177793 - DNA, 25 bp, Homo sapien
ggaaacatcttcctgcctcatagaa

SEQ ID NO: 177794 - DNA, 25 bp, Homo sapien
acacatattttgataaggcactgaa

SEQ ID NO: 177795 - DNA, 25 bp, Homo sapien
aggactggtagtttactgatgtaga

SEQ ID NO: 177796 - DNA, 25 bp, Homo sapien
ctgcccctaactaacttctgtgtaa

SEQ ID NO: 177797 - DNA, 25 bp, Homo sapien
cctaactaacttctgtgtaaactca

SEQ ID NO: 177798 - DNA, 25 bp, Homo sapien
gtgtaaactcagataagtcaccttt

SEQ ID NO: 177799 - DNA, 25 bp, Homo sapien
agataagtcacctttctctgggatt

SEQ ID NO: 177800 - DNA, 25 bp, Homo sapien
gtcacctttctctgggattcaaatt

SEQ ID NO: 177801 - DNA, 25 bp, Homo sapien
ctgggattcaaatttttgcatcagt

SEQ ID NO: 177802 - DNA, 25 bp, Homo sapien
gagtcttagagacttgtaccaatgt

SEQ ID NO: 177803 - DNA, 25 bp, Homo sapien
gtaccaatgttatgctatgtctcta

SEQ ID NO: 177804 - DNA, 25 bp, Homo sapien
atgtctctaaatctttactctccta

SEQ ID NO: 177805 - DNA, 25 bp, Homo sapien
tactctcctaagtagacttgtcagc

SEQ ID NO: 177806 - DNA, 25 bp, Homo sapien
agacttgtcagcatctaggaagaac

SEQ ID NO: 177807 - DNA, 25 bp, Homo sapien
gtttaagtcaccttcattttaatgt

SEQ ID NO: 177808 - DNA, 25 bp, Homo sapien
aagcattgcccttctattggtatta

SEQ ID NO: 177809 - DNA, 25 bp, Homo sapien
tgcccttctattggtattaattcgg

SEQ ID NO: 177810 - DNA, 25 bp, Homo sapien
tctgtagtcctttctctcaattttc

SEQ ID NO: 177811 - DNA, 25 bp, Homo sapien
tacattttttactccatgaagaagc

SEQ ID NO: 177812 - DNA, 25 bp, Homo sapien
tgaagaagcttcatctcaacctccg

SEQ ID NO: 177813 - DNA, 25 bp, Homo sapien
atctcaacctccgtcatgttttaga

SEQ ID NO: 177814 - DNA, 25 bp, Homo sapien
gtcatgttttagaaaccttttatct

SEQ ID NO: 177815 - DNA, 25 bp, Homo sapien
ttcctcatgctactcttctaagtct

SEQ ID NO: 177816 - DNA, 25 bp, Homo sapien
cttctaagtcttcatattttctctt

SEQ ID NO: 177817 - DNA, 25 bp, Homo sapien
gcaatatcttagtaacctattgact

SEQ ID NO: 177818 - DNA, 25 bp, Homo sapien
aggatcagggctgggaactctagcc

SEQ ID NO: 177819 - DNA, 25 bp, Homo sapien
gatcagggctgggaactctagccct

SEQ ID NO: 177820 - DNA, 25 bp, Homo sapien
gctgggaactctagccctggccctg

SEQ ID NO: 177821 - DNA, 25 bp, Homo sapien
ggacagccgccctgctcattggggt

SEQ ID NO: 177822 - DNA, 25 bp, Homo sapien
ggcaaaggcggcaacgccgaggaga

SEQ ID NO: 177823 - DNA, 25 bp, Homo sapien
gaggagcgtgcagaactgaatcagt

SEQ ID NO: 177824 - DNA, 25 bp, Homo sapien
ggagcgtgcagaactgaatcagtcg

SEQ ID NO: 177825 - DNA, 25 bp, Homo sapien
gaactgaatcagtcggaggaacctg

SEQ ID NO: 177826 - DNA, 25 bp, Homo sapien
aatcagtcggaggaacctgaggcag

SEQ ID NO: 177827 - DNA, 25 bp, Homo sapien
aacctgaggcaggcgagagtagtac

SEQ ID NO: 177828 - DNA, 25 bp, Homo sapien
gcgagagtagtactggagggccttg

SEQ ID NO: 177829 - DNA, 25 bp, Homo sapien
atggacaacctcaagcccgcctttg

SEQ ID NO: 177830 - DNA, 25 bp, Homo sapien
agcccgcctttgctaagctgagtga

SEQ ID NO: 177831 - DNA, 25 bp, Homo sapien
tcaagctcctgggtaacgtgatggt

SEQ ID NO: 177832 - DNA, 25 bp, Homo sapien
acgtgatggtgattattctggctac

SEQ ID NO: 177833 - DNA, 25 bp, Homo sapien
tattctggctactcactttggcaag

SEQ ID NO: 177834 - DNA, 25 bp, Homo sapien
gagttcacccctgaagtgcaggctg

SEQ ID NO: 177835 - DNA, 25 bp, Homo sapien
agctggtgtctgctgtcgccattgc

SEQ ID NO: 177836 - DNA, 25 bp, Homo sapien
attgccctggcccataagtaccact

SEQ ID NO: 177837 - DNA, 25 bp, Homo sapien
ggcccataagtaccactgagttctc

SEQ ID NO: 177838 - DNA, 25 bp, Homo sapien
tgagttctcttccagtttgcaggtc

SEQ ID NO: 177839 - DNA, 25 bp, Homo sapien
gcttggccttgagagaaagccttct

SEQ ID NO: 177840 - DNA, 25 bp, Homo sapien
tccctcccatttacttctctattaa

SEQ ID NO: 177841 - DNA, 25 bp, Homo sapien
tacttctctattaaattcaggatgg

SEQ ID NO: 177842 - DNA, 25 bp, Homo sapien
ttcaggatggacaattctaaactat

SEQ ID NO: 177843 - DNA, 25 bp, Homo sapien
tctaaactattgctattgggaaaat

SEQ ID NO: 177844 - DNA, 25 bp, Homo sapien
atgtttccattgcatctgagtgtca

SEQ ID NO: 177845 - DNA, 25 bp, Homo sapien
attgcatctgagtgtcattcattca

SEQ ID NO: 177846 - DNA, 25 bp, Homo sapien
aaatgtttattgagctcctaaatgc

SEQ ID NO: 177847 - DNA, 25 bp, Homo sapien
ttgagctcctaaatgctaactgcct

SEQ ID NO: 177848 - DNA, 25 bp, Homo sapien
aatgctaactgccttaggacaagta

SEQ ID NO: 177849 - DNA, 25 bp, Homo sapien
gcagatcacaatcttgttgctagaa

SEQ ID NO: 177850 - DNA, 25 bp, Homo sapien
tacagtatgtacaaggcaccatcaa

SEQ ID NO: 177851 - DNA, 25 bp, Homo sapien
ttaatatgcctttaagtcttacctg

SEQ ID NO: 177852 - DNA, 25 bp, Homo sapien
gcctggaatgccctcttctatgtta

SEQ ID NO: 177853 - DNA, 25 bp, Homo sapien
aatgccctcttctatgttacctatt

SEQ ID NO: 177854 - DNA, 25 bp, Homo sapien
tatgttacctattctgtccgttgag

SEQ ID NO: 177855 - DNA, 25 bp, Homo sapien
tacctattctgtccgttgagatgcc

SEQ ID NO: 177856 - DNA, 25 bp, Homo sapien
tattctgtccgttgagatgccccaa

SEQ ID NO: 177857 - DNA, 25 bp, Homo sapien
tgagatgccccaacttgggccaaag

SEQ ID NO: 177858 - DNA, 25 bp, Homo sapien
tgggccaaagccaagagatctatgt

SEQ ID NO: 177859 - DNA, 25 bp, Homo sapien
aagccaagagatctatgtgccttct

SEQ ID NO: 177860 - DNA, 25 bp, Homo sapien
ccacatctatagcacctcaactgaa

SEQ ID NO: 177861 - DNA, 25 bp, Homo sapien
catctatagcacctcaactgaaata

SEQ ID NO: 177862 - DNA, 25 bp, Homo sapien
tcctaaagtgccgagggctttaatg

SEQ ID NO: 177863 - DNA, 25 bp, Homo sapien
gccgagggctttaatggtttcacat

SEQ ID NO: 177864 - DNA, 25 bp, Homo sapien
gaagcctgaagttgctaagacttag

SEQ ID NO: 177865 - DNA, 25 bp, Homo sapien
gacttaggttgtttcttatatctgg

SEQ ID NO: 177866 - DNA, 25 bp, Homo sapien
gtagatgaaacaaccagaaactttt

SEQ ID NO: 177867 - DNA, 25 bp, Homo sapien
cttttacttgtgatactctaccatg

SEQ ID NO: 177868 - DNA, 25 bp, Homo sapien
gatactctaccatgaaggatgcggt

SEQ ID NO: 177869 - DNA, 25 bp, Homo sapien
gtaaacatttaagattctcctgtgg

SEQ ID NO: 177870 - DNA, 25 bp, Homo sapien
aagattctcctgtggattttggtga

SEQ ID NO: 177871 - DNA, 25 bp, Homo sapien
tcctgtggattttggtgagtgatca

SEQ ID NO: 177872 - DNA, 25 bp, Homo sapien
gtgagtgatcattaaactgttttcc

SEQ ID NO: 177873 - DNA, 25 bp, Homo sapien
atatccacaatgttcatttaaccaa

SEQ ID NO: 177874 - DNA, 25 bp, Homo sapien
ttattccacaaatttagtccagcat

SEQ ID NO: 177875 - DNA, 25 bp, Homo sapien
aatttagtccagcattttattgagt

SEQ ID NO: 177876 - DNA, 25 bp, Homo sapien
agtccagcattttattgagtgcttt

SEQ ID NO: 177877 - DNA, 25 bp, Homo sapien
gagtgctttaataagttctggtgtg

SEQ ID NO: 177878 - DNA, 25 bp, Homo sapien
cttctctaagtctgaatttccatat

SEQ ID NO: 177879 - DNA, 25 bp, Homo sapien
aagtctgaatttccatattgtagaa

SEQ ID NO: 177880 - DNA, 25 bp, Homo sapien
gtacaaagaattcctgtatactctg

SEQ ID NO: 177881 - DNA, 25 bp, Homo sapien
aaagaattcctgtatactctgttat

SEQ ID NO: 177882 - DNA, 25 bp, Homo sapien
gtatactctgttattaactctatta

SEQ ID NO: 177883 - DNA, 25 bp, Homo sapien
taccttgtattattatggtacattt

SEQ ID NO: 177884 - DNA, 25 bp, Homo sapien
gcaaagaactactgggcatgtgctt

SEQ ID NO: 177885 - DNA, 25 bp, Homo sapien
gtattatcgggaaccatttgtgcaa

SEQ ID NO: 177886 - DNA, 25 bp, Homo sapien
gggaaccatttgtgcaacgacagag

SEQ ID NO: 177887 - DNA, 25 bp, Homo sapien
aacgacagaggacttccaggctctt

SEQ ID NO: 177888 - DNA, 25 bp, Homo sapien
aggctcttcagcatttccaacagga

SEQ ID NO: 177889 - DNA, 25 bp, Homo sapien
aacaggatcacagacctgggcctgt

SEQ ID NO: 177890 - DNA, 25 bp, Homo sapien
tcactgcgctcatggcaggtggaca

SEQ ID NO: 177891 - DNA, 25 bp, Homo sapien
ctcaggtaacctgcgtgctttataa

SEQ ID NO: 177892 - DNA, 25 bp, Homo sapien
cgtgctttataagcctctcacctgt

SEQ ID NO: 177893 - DNA, 25 bp, Homo sapien
gtcgcgttttccctgtgttgcgttt

SEQ ID NO: 177894 - DNA, 25 bp, Homo sapien
gtcgcgtttcccctgtgcaggctca

SEQ ID NO: 177895 - DNA, 25 bp, Homo sapien
taaacaattatttaagtgtacgtgt

SEQ ID NO: 177896 - DNA, 25 bp, Homo sapien
tgttatttatatgcctcccccaaca

SEQ ID NO: 177897 - DNA, 25 bp, Homo sapien
aacactacccttggggtctgggcat

SEQ ID NO: 177898 - DNA, 25 bp, Homo sapien
gggcattccccgtgtctggaggaca

SEQ ID NO: 177899 - DNA, 25 bp, Homo sapien
attccccgtgtctggaggacagccc

SEQ ID NO: 177900 - DNA, 25 bp, Homo sapien
ctcatctccagcctcagtagttggg

SEQ ID NO: 177901 - DNA, 25 bp, Homo sapien
ttccagcccttaaagctgcagaaaa

SEQ ID NO: 177902 - DNA, 25 bp, Homo sapien
gctgcagaaaaggtgtcacacggct

SEQ ID NO: 177903 - DNA, 25 bp, Homo sapien
gaaaaggtgtcacacggctgcctgt

SEQ ID NO: 177904 - DNA, 25 bp, Homo sapien
aaaggtgtcacacggctgcctgtac

SEQ ID NO: 177905 - DNA, 25 bp, Homo sapien
tcacacggctgcctgtaccttggct

SEQ ID NO: 177906 - DNA, 25 bp, Homo sapien
aatactgcatattagctcatgcggt

SEQ ID NO: 177907 - DNA, 25 bp, Homo sapien
ttagctcatgcggtattgtgtaata

SEQ ID NO: 177908 - DNA, 25 bp, Homo sapien
ctgcaaagaccgtacttacgtaaat

SEQ ID NO: 177909 - DNA, 25 bp, Homo sapien
aattatacaaagctccactctctac

SEQ ID NO: 177910 - DNA, 25 bp, Homo sapien
aagctccactctctacctaaaattt

SEQ ID NO: 177911 - DNA, 25 bp, Homo sapien
taaaattttaccatgtgcaaaacga

SEQ ID NO: 177912 - DNA, 25 bp, Homo sapien
ctctggttgactgtcattttcaaca

SEQ ID NO: 177913 - DNA, 25 bp, Homo sapien
tttacataaggtaggcttcctttat

SEQ ID NO: 177914 - DNA, 25 bp, Homo sapien
taggcttcctttattaaattcgtat

SEQ ID NO: 177915 - DNA, 25 bp, Homo sapien
gttaagagcatattttcaacttcat

SEQ ID NO: 177916 - DNA, 25 bp, Homo sapien
acttcattcaatgcattacctaaat

SEQ ID NO: 177917 - DNA, 25 bp, Homo sapien
gcaaagaactactgggcatgtgctt

SEQ ID NO: 177918 - DNA, 25 bp, Homo sapien
atgtgctttggggaccggtattatc

SEQ ID NO: 177919 - DNA, 25 bp, Homo sapien
gtattatcgggaaccatttgtgcaa

SEQ ID NO: 177920 - DNA, 25 bp, Homo sapien
tatcgggaaccatttgtgcaacgac

SEQ ID NO: 177921 - DNA, 25 bp, Homo sapien
gggaaccatttgtgcaacgacagag

SEQ ID NO: 177922 - DNA, 25 bp, Homo sapien
aggctcttcagcatttccaacagga

SEQ ID NO: 177923 - DNA, 25 bp, Homo sapien
gctcttcagcatttccaacaggatc

SEQ ID NO: 177924 - DNA, 25 bp, Homo sapien
gcatttccaacaggatcacagacct

SEQ ID NO: 177925 - DNA, 25 bp, Homo sapien
aacaggatcacagacctgggcctgt

SEQ ID NO: 177926 - DNA, 25 bp, Homo sapien
aggatcacagacctgggcctgtccc

SEQ ID NO: 177927 - DNA, 25 bp, Homo sapien
agcagcacgggggacactggcttca

SEQ ID NO: 177928 - DNA, 25 bp, Homo sapien
aactggggactcagacccgcaacct

SEQ ID NO: 177929 - DNA, 25 bp, Homo sapien
cccgcaacctgctcctaaaaaaatg

SEQ ID NO: 177930 - DNA, 25 bp, Homo sapien
gaaaacatctgagtcctcgaccata

SEQ ID NO: 177931 - DNA, 25 bp, Homo sapien
atctgagtcctcgaccatactagtg

SEQ ID NO: 177932 - DNA, 25 bp, Homo sapien
gagtcctcgaccatactagtggttc

SEQ ID NO: 177933 - DNA, 25 bp, Homo sapien
tcgaccatactagtggttcgctaca

SEQ ID NO: 177934 - DNA, 25 bp, Homo sapien
ccatactagtggttcgctacaggag

SEQ ID NO: 177935 - DNA, 25 bp, Homo sapien
actagtggttcgctacaggaggaac

SEQ ID NO: 177936 - DNA, 25 bp, Homo sapien
atgaccacgcccgagagaacagaat

SEQ ID NO: 177937 - DNA, 25 bp, Homo sapien
gaccacgcccgagagaacagaatca

SEQ ID NO: 177938 - DNA, 25 bp, Homo sapien
acgcccgagagaacagaatcaaccc

SEQ ID NO: 177939 - DNA, 25 bp, Homo sapien
gatttgtacctagtttccagctttt

SEQ ID NO: 177940 - DNA, 25 bp, Homo sapien
agaacagaaagtcttcagtttcttg

SEQ ID NO: 177941 - DNA, 25 bp, Homo sapien
agtttcttgaagcactcctgtcctc

SEQ ID NO: 177942 - DNA, 25 bp, Homo sapien
tgtcctcatccctctgagattttgg

SEQ ID NO: 177943 - DNA, 25 bp, Homo sapien
catccctctgagattttgggcacat

SEQ ID NO: 177944 - DNA, 25 bp, Homo sapien
gggcacattcaaatctatatcctgg

SEQ ID NO: 177945 - DNA, 25 bp, Homo sapien
tatcctgggaccctgtaaaggtcca

SEQ ID NO: 177946 - DNA, 25 bp, Homo sapien
ggtccatgacatccgttggaacttt

SEQ ID NO: 177947 - DNA, 25 bp, Homo sapien
tgatggaatccctgtcatgcgctgg

SEQ ID NO: 177948 - DNA, 25 bp, Homo sapien
cgggctacggtcagctcagtcaaga

SEQ ID NO: 177949 - DNA, 25 bp, Homo sapien
cagctcagtcaagacagacatcctg

SEQ ID NO: 177950 - DNA, 25 bp, Homo sapien
tttagaataagttgcgagaccagat

SEQ ID NO: 177951 - DNA, 25 bp, Homo sapien
gcgagaccagatgcaactaatatat

SEQ ID NO: 177952 - DNA, 25 bp, Homo sapien
atgaatgacatctactttcagtttt

SEQ ID NO: 177953 - DNA, 25 bp, Homo sapien
gtttcagaatgatattccctaaact

SEQ ID NO: 177954 - DNA, 25 bp, Homo sapien
gtctggtttacttaggaaatctcga

SEQ ID NO: 177955 - DNA, 25 bp, Homo sapien
aaaagattttggcttcttcactcca

SEQ ID NO: 177956 - DNA, 25 bp, Homo sapien
ttttggcttcttcactccaatgttt

SEQ ID NO: 177957 - DNA, 25 bp, Homo sapien
aatgttttcctttagcaggtaagat

SEQ ID NO: 177958 - DNA, 25 bp, Homo sapien
catggataactcagccttggcaaat

SEQ ID NO: 177959 - DNA, 25 bp, Homo sapien
tggcaaattcaaaagttcctcagga

SEQ ID NO: 177960 - DNA, 25 bp, Homo sapien
gttcctcaggaacaactttaagatt

SEQ ID NO: 177961 - DNA, 25 bp, Homo sapien
tcaacctggtggacaatgacttccc

SEQ ID NO: 177962 - DNA, 25 bp, Homo sapien
tggacaatgacttcccactggacaa

SEQ ID NO: 177963 - DNA, 25 bp, Homo sapien
cactggacaactgcctctggcaggt

SEQ ID NO: 177964 - DNA, 25 bp, Homo sapien
tggtggaagacacattggagcttct

SEQ ID NO: 177965 - DNA, 25 bp, Homo sapien
acaggcccacccagaatgcgagaga

SEQ ID NO: 177966 - DNA, 25 bp, Homo sapien
aatgcgagagaaacggaggctccat

SEQ ID NO: 177967 - DNA, 25 bp, Homo sapien
aaacggaggctccatgaccctgcgt

SEQ ID NO: 177968 - DNA, 25 bp, Homo sapien
gtcctgacgccctgcgttggagcca

SEQ ID NO: 177969 - DNA, 25 bp, Homo sapien
tcctccacagtgctgcttctcttgg

SEQ ID NO: 177970 - DNA, 25 bp, Homo sapien
ccacctgacaatggcagctagactg

SEQ ID NO: 177971 - DNA, 25 bp, Homo sapien
tggagtgaggcttccaggctcttcc

SEQ ID NO: 177972 - DNA, 25 bp, Homo sapien
ggcagctctgtgcagacatcgcaat

SEQ ID NO: 177973 - DNA, 25 bp, Homo sapien
gctctgtgcagacatcgcaatgggc

SEQ ID NO: 177974 - DNA, 25 bp, Homo sapien
atcgcaatgggcttccgtactcacc

SEQ ID NO: 177975 - DNA, 25 bp, Homo sapien
gtactcaccacaccgggttgctgag

SEQ ID NO: 177976 - DNA, 25 bp, Homo sapien
gttgctgagcgtgctggctatgttc

SEQ ID NO: 177977 - DNA, 25 bp, Homo sapien
agcgtgctggctatgttctttctgc

SEQ ID NO: 177978 - DNA, 25 bp, Homo sapien
gctatgttctttctgcttgttctca

SEQ ID NO: 177979 - DNA, 25 bp, Homo sapien
tgttctttctgcttgttctcattct

SEQ ID NO: 177980 - DNA, 25 bp, Homo sapien
tctgtcttcagtgtttttgttccgt

SEQ ID NO: 177981 - DNA, 25 bp, Homo sapien
tcagtgtttttgttccgtttgttca

SEQ ID NO: 177982 - DNA, 25 bp, Homo sapien
ttttgttccgtttgttcaagagaag

SEQ ID NO: 177983 - DNA, 25 bp, Homo sapien
gagtttattgttcatggtagattaa

SEQ ID NO: 177984 - DNA, 25 bp, Homo sapien
aagcttgcataaaggttgggctaag

SEQ ID NO: 177985 - DNA, 25 bp, Homo sapien
ttgggctaagtggtccttgggctac

SEQ ID NO: 177986 - DNA, 25 bp, Homo sapien
taagtggtccttgggctacagactc

SEQ ID NO: 177987 - DNA, 25 bp, Homo sapien
gggctacagactctgttgccttgaa

SEQ ID NO: 177988 - DNA, 25 bp, Homo sapien
acagactctgttgccttgaatataa

SEQ ID NO: 177989 - DNA, 25 bp, Homo sapien
gttgccttgaatataacagtacaat

SEQ ID NO: 177990 - DNA, 25 bp, Homo sapien
atttgtcaattactctgcaccaggc

SEQ ID NO: 177991 - DNA, 25 bp, Homo sapien
tactctgcaccaggctaaagtgagt

SEQ ID NO: 177992 - DNA, 25 bp, Homo sapien
ttgaaggtatcttgtttgtaaacat

SEQ ID NO: 177993 - DNA, 25 bp, Homo sapien
gtaaacatttgtcagattctaattt

SEQ ID NO: 177994 - DNA, 25 bp, Homo sapien
cagtgagctgctccccaatcgacag

SEQ ID NO: 177995 - DNA, 25 bp, Homo sapien
tccccaatcgacagggcctgaagaa

SEQ ID NO: 177996 - DNA, 25 bp, Homo sapien
tgaagaaagccgactgctccttctg

SEQ ID NO: 177997 - DNA, 25 bp, Homo sapien
tccttctggtccaagtacatctcgt

SEQ ID NO: 177998 - DNA, 25 bp, Homo sapien
ccaagtacatctcgtctctgaagac

SEQ ID NO: 177999 - DNA, 25 bp, Homo sapien
agagaagatctcctaagcctccagg

SEQ ID NO: 178000 - DNA, 25 bp, Homo sapien
aggaaccaggctctaagacctacag

SEQ ID NO: 178001 - DNA, 25 bp, Homo sapien
taagacctacagcaagtgaccagcc

SEQ ID NO: 178002 - DNA, 25 bp, Homo sapien
acagcaagtgaccagcccttgagct

SEQ ID NO: 178003 - DNA, 25 bp, Homo sapien
gaggctgcccactatggtcatcttt

SEQ ID NO: 178004 - DNA, 25 bp, Homo sapien
tttctctaaaatagccacttacctt

SEQ ID NO: 178005 - DNA, 25 bp, Homo sapien
ccatcccacacaaacccaattgtaa

SEQ ID NO: 178006 - DNA, 25 bp, Homo sapien
ataacatatgacttctgagtacttt

SEQ ID NO: 178007 - DNA, 25 bp, Homo sapien
cttttgggggcacaactgttttctg

SEQ ID NO: 178008 - DNA, 25 bp, Homo sapien
ggcacaactgttttctgtttgctgt

SEQ ID NO: 178009 - DNA, 25 bp, Homo sapien
ttttttctccagagcactttggtct

SEQ ID NO: 178010 - DNA, 25 bp, Homo sapien
actttggtctagactaggctttggg

SEQ ID NO: 178011 - DNA, 25 bp, Homo sapien
ctagactaggctttgggtggttcca

SEQ ID NO: 178012 - DNA, 25 bp, Homo sapien
aagctctgaggcacgtcatgcaggt

SEQ ID NO: 178013 - DNA, 25 bp, Homo sapien
tctttgcagtagcaccagttaaggt

SEQ ID NO: 178014 - DNA, 25 bp, Homo sapien
aggtgaatatgtattgtatcacaaa

SEQ ID NO: 178015 - DNA, 25 bp, Homo sapien
atccagatgaatatccgagatgttg

SEQ ID NO: 178016 - DNA, 25 bp, Homo sapien
acatgctgcaggctgaggcgcttca

SEQ ID NO: 178017 - DNA, 25 bp, Homo sapien
actccctccagcatcttatgaaagt

SEQ ID NO: 178018 - DNA, 25 bp, Homo sapien
acattgccaataaaaggtccctgaa

SEQ ID NO: 178019 - DNA, 25 bp, Homo sapien
gtgaggtaccaaatgcctgtgccaa

SEQ ID NO: 178020 - DNA, 25 bp, Homo sapien
gcctgtgccaagcaaaattcccaga

SEQ ID NO: 178021 - DNA, 25 bp, Homo sapien
agaaaggcctctagtttgactccct

SEQ ID NO: 178022 - DNA, 25 bp, Homo sapien
tttgactcccttggctgcccagaag

SEQ ID NO: 178023 - DNA, 25 bp, Homo sapien
aatagtgcctgctgtgatgtgcaaa

SEQ ID NO: 178024 - DNA, 25 bp, Homo sapien
gatctgggtttgaagctttcctgac

SEQ ID NO: 178025 - DNA, 25 bp, Homo sapien
tcctgacttctcctagctggcttat

SEQ ID NO: 178026 - DNA, 25 bp, Homo sapien
tggcttatgcccctgcactgaagtg

SEQ ID NO: 178027 - DNA, 25 bp, Homo sapien
gcaatattgactgtaaacccacatt

SEQ ID NO: 178028 - DNA, 25 bp, Homo sapien
taaggaaaccactacgggtctggca

SEQ ID NO: 178029 - DNA, 25 bp, Homo sapien
aaccactacgggtctggcagtgcgt

SEQ ID NO: 178030 - DNA, 25 bp, Homo sapien
gggtgtgcattttaaaactcgattc

SEQ ID NO: 178031 - DNA, 25 bp, Homo sapien
aactcgattcatagacacaggtacc

SEQ ID NO: 178032 - DNA, 25 bp, Homo sapien
gacacaggtaccatgttccatttcc

SEQ ID NO: 178033 - DNA, 25 bp, Homo sapien
gttccatttccgtcatggtgaagca

SEQ ID NO: 178034 - DNA, 25 bp, Homo sapien
aatgaattggcctggctaccactgt

SEQ ID NO: 178035 - DNA, 25 bp, Homo sapien
taccactgtggtcgcgtgctacagg

SEQ ID NO: 178036 - DNA, 25 bp, Homo sapien
tcgcgtgctacaggtttgacaaaaa

SEQ ID NO: 178037 - DNA, 25 bp, Homo sapien
gtgtggacaacaatatggaagctaa

SEQ ID NO: 178038 - DNA, 25 bp, Homo sapien
tgcgattttctgtcattagttctag

SEQ ID NO: 178039 - DNA, 25 bp, Homo sapien
gattttctgtcattagttctagata

SEQ ID NO: 178040 - DNA, 25 bp, Homo sapien
gttctagatatgtacttcatggtta

SEQ ID NO: 178041 - DNA, 25 bp, Homo sapien
atgtacttcatggttaaattctaaa

SEQ ID NO: 178042 - DNA, 25 bp, Homo sapien
tctaaatctgaaaatgctagtggga

SEQ ID NO: 178043 - DNA, 25 bp, Homo sapien
gctagtgggagatatcaagaaattt

SEQ ID NO: 178044 - DNA, 25 bp, Homo sapien
tttctttttgattactagtacctgt

SEQ ID NO: 178045 - DNA, 25 bp, Homo sapien
tttgaattttttgcccgtgttatca

SEQ ID NO: 178046 - DNA, 25 bp, Homo sapien
tttgcccgtgttatcagaatgatgg

SEQ ID NO: 178047 - DNA, 25 bp, Homo sapien
ggaaattgatcattttcagttgttc

SEQ ID NO: 178048 - DNA, 25 bp, Homo sapien
atcattttcagttgttcattgtgta

SEQ ID NO: 178049 - DNA, 25 bp, Homo sapien
agacccctttctgtatgctggcata

SEQ ID NO: 178050 - DNA, 25 bp, Homo sapien
tatgctggcatagggcagttatcta

SEQ ID NO: 178051 - DNA, 25 bp, Homo sapien
gttatctacaagatgccctaccttg

SEQ ID NO: 178052 - DNA, 25 bp, Homo sapien
ctaccttgcaggcacttatttgaac

SEQ ID NO: 178053 - DNA, 25 bp, Homo sapien
gaactgatactccagaatccactag

SEQ ID NO: 178054 - DNA, 25 bp, Homo sapien
ccactagaacccatatttctctctt

SEQ ID NO: 178055 - DNA, 25 bp, Homo sapien
tctctctttttatccaaatgtgtgg

SEQ ID NO: 178056 - DNA, 25 bp, Homo sapien
agtacccactatgtggcaggtatac

SEQ ID NO: 178057 - DNA, 25 bp, Homo sapien
ggcaggtatacacactagacagcat

SEQ ID NO: 178058 - DNA, 25 bp, Homo sapien
tttaatctacccaagagcctgagtg

SEQ ID NO: 178059 - DNA, 25 bp, Homo sapien
agatgggcagtcatttgatccccat

SEQ ID NO: 178060 - DNA, 25 bp, Homo sapien
cctgcaggaattgacaaccctgtgt

SEQ ID NO: 178061 - DNA, 25 bp, Homo sapien
gaattgacaaccctgtgttttctcc

SEQ ID NO: 178062 - DNA, 25 bp, Homo sapien
ttgacaaccctgtgttttctccgga

SEQ ID NO: 178063 - DNA, 25 bp, Homo sapien
caaccctgtgttttctccggacgag

SEQ ID NO: 178064 - DNA, 25 bp, Homo sapien
tgttttctccggacgaggccctgga

SEQ ID NO: 178065 - DNA, 25 bp, Homo sapien
ggagacggtggtcccctcgcagagg

SEQ ID NO: 178066 - DNA, 25 bp, Homo sapien
agagggcccgcacgcagattcccta

SEQ ID NO: 178067 - DNA, 25 bp, Homo sapien
ttccgcctcagcagcaagtccgtgg

SEQ ID NO: 178068 - DNA, 25 bp, Homo sapien
tcagcagcaagtccgtggactcctt

SEQ ID NO: 178069 - DNA, 25 bp, Homo sapien
aagtccgtggactccttcctgcagg

SEQ ID NO: 178070 - DNA, 25 bp, Homo sapien
gagtccacacacatgtgacaccggc

SEQ ID NO: 178071 - DNA, 25 bp, Homo sapien
taatgctttggttctgggttgtttc

SEQ ID NO: 178072 - DNA, 25 bp, Homo sapien
tgctttggttctgggttgtttccta

SEQ ID NO: 178073 - DNA, 25 bp, Homo sapien
tcctaaaatatctgggtggcttaaa

SEQ ID NO: 178074 - DNA, 25 bp, Homo sapien
tgtaataaacccttaactggcatag

SEQ ID NO: 178075 - DNA, 25 bp, Homo sapien
taactggcataggaaatggtatcca

SEQ ID NO: 178076 - DNA, 25 bp, Homo sapien
ggcaaagagacccagtcaattacat

SEQ ID NO: 178077 - DNA, 25 bp, Homo sapien
gtcaattacatgtttggtaccaaga

SEQ ID NO: 178078 - DNA, 25 bp, Homo sapien
ttggtaccaagaaaggaacctgtca

SEQ ID NO: 178079 - DNA, 25 bp, Homo sapien
aaggaacctgtcagggcagtacaat

SEQ ID NO: 178080 - DNA, 25 bp, Homo sapien
tcagggcagtacaatgtgactttga

SEQ ID NO: 178081 - DNA, 25 bp, Homo sapien
ccctatatctataaacactgtttgt

SEQ ID NO: 178082 - DNA, 25 bp, Homo sapien
tgatgagtaacttaaccagcacatt

SEQ ID NO: 178083 - DNA, 25 bp, Homo sapien
tgagtaacttaaccagcacatttct

SEQ ID NO: 178084 - DNA, 25 bp, Homo sapien
gtaacttaaccagcacatttctcct

SEQ ID NO: 178085 - DNA, 25 bp, Homo sapien
aacttaaccagcacatttctcctgt

SEQ ID NO: 178086 - DNA, 25 bp, Homo sapien
cttaaccagcacatttctcctgttt

SEQ ID NO: 178087 - DNA, 25 bp, Homo sapien
taaccagcacatttctcctgtttac

SEQ ID NO: 178088 - DNA, 25 bp, Homo sapien
aaccagcacatttctcctgtttaca

SEQ ID NO: 178089 - DNA, 25 bp, Homo sapien
accagcacatttctcctgtttacac

SEQ ID NO: 178090 - DNA, 25 bp, Homo sapien
agcacatttctcctgtttacactcg

SEQ ID NO: 178091 - DNA, 25 bp, Homo sapien
cacatttctcctgtttacactcggg

SEQ ID NO: 178092 - DNA, 25 bp, Homo sapien
ttctcctgtttacactcgggggatt

SEQ ID NO: 178093 - DNA, 25 bp, Homo sapien
cgccctacttcccatcccacacaaa

SEQ ID NO: 178094 - DNA, 25 bp, Homo sapien
ccaattgtaaataacatatgacttc

SEQ ID NO: 178095 - DNA, 25 bp, Homo sapien
cttttgggggcacaactgttttctg

SEQ ID NO: 178096 - DNA, 25 bp, Homo sapien
tttgggggcacaactgttttctgtt

SEQ ID NO: 178097 - DNA, 25 bp, Homo sapien
ttgggggcacaactgttttctgttt

SEQ ID NO: 178098 - DNA, 25 bp, Homo sapien
gggggcacaactgttttctgtttgc

SEQ ID NO: 178099 - DNA, 25 bp, Homo sapien
ggggcacaactgttttctgtttgct

SEQ ID NO: 178100 - DNA, 25 bp, Homo sapien
aagctctgaggcacgtcatgcaggt

SEQ ID NO: 178101 - DNA, 25 bp, Homo sapien
gttaaggtgaatatgtattgtatca

SEQ ID NO: 178102 - DNA, 25 bp, Homo sapien
aaggtgaatatgtattgtatcacaa

SEQ ID NO: 178103 - DNA, 25 bp, Homo sapien
gtgaatatgtattgtatcacaaaac

SEQ ID NO: 178104 - DNA, 25 bp, Homo sapien
aatagttggtgcttactttcattta

SEQ ID NO: 178105 - DNA, 25 bp, Homo sapien
gttggtgcttactttcatttatgtt

SEQ ID NO: 178106 - DNA, 25 bp, Homo sapien
tggtgcttactttcatttatgttta

SEQ ID NO: 178107 - DNA, 25 bp, Homo sapien
gcaattgatagattttacatctttg

SEQ ID NO: 178108 - DNA, 25 bp, Homo sapien
acatctttgatataaagcactgcca

SEQ ID NO: 178109 - DNA, 25 bp, Homo sapien
ttgatataaagcactgccatattta

SEQ ID NO: 178110 - DNA, 25 bp, Homo sapien
agacattttatatgtagctcagatt

SEQ ID NO: 178111 - DNA, 25 bp, Homo sapien
gtagctcagattaatgacattttta

SEQ ID NO: 178112 - DNA, 25 bp, Homo sapien
ttattttgtgtattagtttttgctt

SEQ ID NO: 178113 - DNA, 25 bp, Homo sapien
gtctaacaaatctttttagtcatct

SEQ ID NO: 178114 - DNA, 25 bp, Homo sapien
tagtcatcttttatatacttttagt

SEQ ID NO: 178115 - DNA, 25 bp, Homo sapien
gggccatgattatcttaaaggcatt

SEQ ID NO: 178116 - DNA, 25 bp, Homo sapien
ggcattattctccagccttaagatc

SEQ ID NO: 178117 - DNA, 25 bp, Homo sapien
tattctccagccttaagatcttagg

SEQ ID NO: 178118 - DNA, 25 bp, Homo sapien
gatcttaggacgtttcctttgctat

SEQ ID NO: 178119 - DNA, 25 bp, Homo sapien
cctttgctatgatttgtacttgctt

SEQ ID NO: 178120 - DNA, 25 bp, Homo sapien
tttgtacttgcttgagtcccatgac

SEQ ID NO: 178121 - DNA, 25 bp, Homo sapien
ttgagtcccatgactgtttctcttc

SEQ ID NO: 178122 - DNA, 25 bp, Homo sapien
aatatccatcctatgtttgtcccac

SEQ ID NO: 178123 - DNA, 25 bp, Homo sapien
atgtttgtcccactattgtattttg

SEQ ID NO: 178124 - DNA, 25 bp, Homo sapien
ttcacaggttcacagttaagaagga

SEQ ID NO: 178125 - DNA, 25 bp, Homo sapien
aggaattttgcctctgaataaatag

SEQ ID NO: 178126 - DNA, 25 bp, Homo sapien
gaaatgccaattacaggccaaagcg

SEQ ID NO: 178127 - DNA, 25 bp, Homo sapien
aaatgccaattacaggccaaagcgt

SEQ ID NO: 178128 - DNA, 25 bp, Homo sapien
aatgccaattacaggccaaagcgtt

SEQ ID NO: 178129 - DNA, 25 bp, Homo sapien
atgccaattacaggccaaagcgtta

SEQ ID NO: 178130 - DNA, 25 bp, Homo sapien
ccaattacaggccaaagcgttattt

SEQ ID NO: 178131 - DNA, 25 bp, Homo sapien
aattacaggccaaagcgttatttgc

SEQ ID NO: 178132 - DNA, 25 bp, Homo sapien
attacaggccaaagcgttatttgcc

SEQ ID NO: 178133 - DNA, 25 bp, Homo sapien
ttacaggccaaagcgttatttgcca

SEQ ID NO: 178134 - DNA, 25 bp, Homo sapien
acaggccaaagcgttatttgccaag

SEQ ID NO: 178135 - DNA, 25 bp, Homo sapien
tttaccaatgtatgagttcttgtta

SEQ ID NO: 178136 - DNA, 25 bp, Homo sapien
gagttcttgttaacagaatgtgtaa

SEQ ID NO: 178137 - DNA, 25 bp, Homo sapien
aagatgaagccccatgctcagtccc

SEQ ID NO: 178138 - DNA, 25 bp, Homo sapien
ccagtcccaagccaccagctgtctg

SEQ ID NO: 178139 - DNA, 25 bp, Homo sapien
tctctgacctttaacctcactctca

SEQ ID NO: 178140 - DNA, 25 bp, Homo sapien
actctcaccttgcaccgtgcaccaa

SEQ ID NO: 178141 - DNA, 25 bp, Homo sapien
ccctcctggaaagcaggcctgatgg

SEQ ID NO: 178142 - DNA, 25 bp, Homo sapien
tggaaagcaggcctgatggcttccc

SEQ ID NO: 178143 - DNA, 25 bp, Homo sapien
ggaaagcaggcctgatggcttccca

SEQ ID NO: 178144 - DNA, 25 bp, Homo sapien
gaaagcaggcctgatggcttcccac

SEQ ID NO: 178145 - DNA, 25 bp, Homo sapien
aaagcaggcctgatggcttcccact

SEQ ID NO: 178146 - DNA, 25 bp, Homo sapien
agcaggcctgatggcttcccactgg

SEQ ID NO: 178147 - DNA, 25 bp, Homo sapien
cacctgaccagagtgttctcttcag

SEQ ID NO: 178148 - DNA, 25 bp, Homo sapien
gatgtttcttgagtctcctgtgtat

SEQ ID NO: 178149 - DNA, 25 bp, Homo sapien
gtttcttgagtctcctgtgtatatt

SEQ ID NO: 178150 - DNA, 25 bp, Homo sapien
tcttgagtctcctgtgtatatttct

SEQ ID NO: 178151 - DNA, 25 bp, Homo sapien
ttttccacagttggctgagtgcctt

SEQ ID NO: 178152 - DNA, 25 bp, Homo sapien
cacagttggctgagtgccttcgtga

SEQ ID NO: 178153 - DNA, 25 bp, Homo sapien
cagttggctgagtgccttcgtgaga

SEQ ID NO: 178154 - DNA, 25 bp, Homo sapien
tggctgagtgccttcgtgagagtac

SEQ ID NO: 178155 - DNA, 25 bp, Homo sapien
gctgagtgccttcgtgagagtacaa

SEQ ID NO: 178156 - DNA, 25 bp, Homo sapien
ctgagtgccttcgtgagagtacaag

SEQ ID NO: 178157 - DNA, 25 bp, Homo sapien
ccttcgtgagagtacaaggcccgaa

SEQ ID NO: 178158 - DNA, 25 bp, Homo sapien
agtacaaggcccgaagggtagtgat

SEQ ID NO: 178159 - DNA, 25 bp, Homo sapien
tttattcattctgcagcagctacaa

SEQ ID NO: 178160 - DNA, 25 bp, Homo sapien
attctgcagcagctacaatctatgt

SEQ ID NO: 178161 - DNA, 25 bp, Homo sapien
gcagcagctacaatctatgtgcaca

SEQ ID NO: 178162 - DNA, 25 bp, Homo sapien
gcagctacaatctatgtgcacatca

SEQ ID NO: 178163 - DNA, 25 bp, Homo sapien
gctacaatctatgtgcacatcaggg

SEQ ID NO: 178164 - DNA, 25 bp, Homo sapien
tctatgtgcacatcagggtttccca

SEQ ID NO: 178165 - DNA, 25 bp, Homo sapien
tatgtgcacatcagggtttcccagg

SEQ ID NO: 178166 - DNA, 25 bp, Homo sapien
gtgcacatcagggtttcccaggagt

SEQ ID NO: 178167 - DNA, 25 bp, Homo sapien
gcacatcagggtttcccaggagttt

SEQ ID NO: 178168 - DNA, 25 bp, Homo sapien
acatcagggtttcccaggagtttgg

SEQ ID NO: 178169 - DNA, 25 bp, Homo sapien
gagtttgggaaggaatttgtcacct

SEQ ID NO: 178170 - DNA, 25 bp, Homo sapien
ttttcctctgtccatttagttttat

SEQ ID NO: 178171 - DNA, 25 bp, Homo sapien
cctctgtccatttagttttatattg

SEQ ID NO: 178172 - DNA, 25 bp, Homo sapien
gttttatattggctggtcttttcat

SEQ ID NO: 178173 - DNA, 25 bp, Homo sapien
gaaaatcctttatcgtttctagaag

SEQ ID NO: 178174 - DNA, 25 bp, Homo sapien
gtttctagaagataaacccatacta

SEQ ID NO: 178175 - DNA, 25 bp, Homo sapien
gagaaaagactatttaacctcaaag

SEQ ID NO: 178176 - DNA, 25 bp, Homo sapien
atttaacctcaaagtctacagcata

SEQ ID NO: 178177 - DNA, 25 bp, Homo sapien
tacagcataatgaacaaccacaggg

SEQ ID NO: 178178 - DNA, 25 bp, Homo sapien
gtataagagaaaaaatccttctgta

SEQ ID NO: 178179 - DNA, 25 bp, Homo sapien
gttcacatgtatattacatactggt

SEQ ID NO: 178180 - DNA, 25 bp, Homo sapien
atactggttgaattttttcctctgt

SEQ ID NO: 178181 - DNA, 25 bp, Homo sapien
tggagtccctctgcatagctgacta

SEQ ID NO: 178182 - DNA, 25 bp, Homo sapien
agctgactactcatgcattgctcaa

SEQ ID NO: 178183 - DNA, 25 bp, Homo sapien
aaagctggcttttcacattaagtca

SEQ ID NO: 178184 - DNA, 25 bp, Homo sapien
aagtcaacaccaaacgtggttgcca

SEQ ID NO: 178185 - DNA, 25 bp, Homo sapien
gtggttgccacatttcatcagacag

SEQ ID NO: 178186 - DNA, 25 bp, Homo sapien
atcagacagacacctccctctggag

SEQ ID NO: 178187 - DNA, 25 bp, Homo sapien
gatgcagttgagtgacaaccttgtt

SEQ ID NO: 178188 - DNA, 25 bp, Homo sapien
gacaaccttgttacattgtagccta

SEQ ID NO: 178189 - DNA, 25 bp, Homo sapien
ttgtagcctagaccaattctgtgtg

SEQ ID NO: 178190 - DNA, 25 bp, Homo sapien
gagattgtgtattttcagtgtccca

SEQ ID NO: 178191 - DNA, 25 bp, Homo sapien
gtattttcagtgtcccatgttccga

SEQ ID NO: 178192 - DNA, 25 bp, Homo sapien
aaataattccaatcactttgtgctc

SEQ ID NO: 178193 - DNA, 25 bp, Homo sapien
caatcactttgtgctcaaattgagc

SEQ ID NO: 178194 - DNA, 25 bp, Homo sapien
atctaatcatactaaagctcctcag

SEQ ID NO: 178195 - DNA, 25 bp, Homo sapien
taaagctcctcagaaacctaacaaa

SEQ ID NO: 178196 - DNA, 25 bp, Homo sapien
cagaaactatgctgattactctgga

SEQ ID NO: 178197 - DNA, 25 bp, Homo sapien
ctgattactctggaggaggatgcct

SEQ ID NO: 178198 - DNA, 25 bp, Homo sapien
cacctttttgcctcctacaagttat

SEQ ID NO: 178199 - DNA, 25 bp, Homo sapien
tgcctcctacaagttatccacaaaa

SEQ ID NO: 178200 - DNA, 25 bp, Homo sapien
gtaactaatcttgtacttgcaaagt

SEQ ID NO: 178201 - DNA, 25 bp, Homo sapien
aagtggcagagttccatatggactt

SEQ ID NO: 178202 - DNA, 25 bp, Homo sapien
gaatgtctgatggaaattactttca

SEQ ID NO: 178203 - DNA, 25 bp, Homo sapien
agccaactgcaccaacgaactgtac

SEQ ID NO: 178204 - DNA, 25 bp, Homo sapien
tcccagagaccaacgttcaagcagt

SEQ ID NO: 178205 - DNA, 25 bp, Homo sapien
acttggatcgaattctcactctcac

SEQ ID NO: 178206 - DNA, 25 bp, Homo sapien
aattctcactctcacaaccaatgag

SEQ ID NO: 178207 - DNA, 25 bp, Homo sapien
aatgagcggtacaagctgcttccct

SEQ ID NO: 178208 - DNA, 25 bp, Homo sapien
ggtacaagctgcttccctgtcctga

SEQ ID NO: 178209 - DNA, 25 bp, Homo sapien
ccctgtcctgacaagcacaataaaa

SEQ ID NO: 178210 - DNA, 25 bp, Homo sapien
agccggctcatcgagatgtgtggac

SEQ ID NO: 178211 - DNA, 25 bp, Homo sapien
catcgagatgtgtggacagcagaaa

SEQ ID NO: 178212 - DNA, 25 bp, Homo sapien
acagcagaaagcgagtgaggcaaga

SEQ ID NO: 178213 - DNA, 25 bp, Homo sapien
atcagcacagggtaaacatcagaga

SEQ ID NO: 178214 - DNA, 25 bp, Homo sapien
gggtccgtgctggttctgaataaag

SEQ ID NO: 178215 - DNA, 25 bp, Homo sapien
aataaagcaggacccgcctagtggc

SEQ ID NO: 178216 - DNA, 25 bp, Homo sapien
gacccgcctagtggctgcctgtgtg

SEQ ID NO: 178217 - DNA, 25 bp, Homo sapien
gctggaaggcactggtgatgtccca

SEQ ID NO: 178218 - DNA, 25 bp, Homo sapien
tccagccctgggtaccaagatgaat

SEQ ID NO: 178219 - DNA, 25 bp, Homo sapien
ggcctagcctagaatcctagcctag

SEQ ID NO: 178220 - DNA, 25 bp, Homo sapien
tagaatcctagcctagaagccctct

SEQ ID NO: 178221 - DNA, 25 bp, Homo sapien
tctccctctggctggagctcagtag

SEQ ID NO: 178222 - DNA, 25 bp, Homo sapien
gagctcagtagggacaactctctag

SEQ ID NO: 178223 - DNA, 25 bp, Homo sapien
aactctctagggacacctgtaccag

SEQ ID NO: 178224 - DNA, 25 bp, Homo sapien
gagatccctcagacagcatggccca

SEQ ID NO: 178225 - DNA, 25 bp, Homo sapien
agccccaatcacaaccccagcctca

SEQ ID NO: 178226 - DNA, 25 bp, Homo sapien
ccagcagctccacccgtatccgcat

SEQ ID NO: 178227 - DNA, 25 bp, Homo sapien
gtatccgcatccacatccacatcca

SEQ ID NO: 178228 - DNA, 25 bp, Homo sapien
acatccacactctcatcctcactcg

SEQ ID NO: 178229 - DNA, 25 bp, Homo sapien
acccgcatccgcaccaaataccgca

SEQ ID NO: 178230 - DNA, 25 bp, Homo sapien
atccgcaccaaataccgcacccaca

SEQ ID NO: 178231 - DNA, 25 bp, Homo sapien
ccaaataccgcacccacacccacag

SEQ ID NO: 178232 - DNA, 25 bp, Homo sapien
agccgcactcgcagccgcacgggca

SEQ ID NO: 178233 - DNA, 25 bp, Homo sapien
gcactcgcagccgcacgggcaccgg

SEQ ID NO: 178234 - DNA, 25 bp, Homo sapien
ggcaccggcttctccgcagcacctc

SEQ ID NO: 178235 - DNA, 25 bp, Homo sapien
gcagcacctccaactctgcctgaaa

SEQ ID NO: 178236 - DNA, 25 bp, Homo sapien
cgtcggtcctggtgccctggatgcc

SEQ ID NO: 178237 - DNA, 25 bp, Homo sapien
gtatatatttatggccgggcagggt

SEQ ID NO: 178238 - DNA, 25 bp, Homo sapien
gggccatgcctcctcaggagccgaa

SEQ ID NO: 178239 - DNA, 25 bp, Homo sapien
ccagcatgcaccacgggcccgggtt

SEQ ID NO: 178240 - DNA, 25 bp, Homo sapien
gagggctgagcctggtcccacgagg

SEQ ID NO: 178241 - DNA, 25 bp, Homo sapien
cctggtcccacgagggtgccgtgtc

SEQ ID NO: 178242 - DNA, 25 bp, Homo sapien
acgagggtgccgtgtcccctgacag

SEQ ID NO: 178243 - DNA, 25 bp, Homo sapien
cctgacagggccagtgcagtttggt

SEQ ID NO: 178244 - DNA, 25 bp, Homo sapien
gtttggtgtgtcctccgcctttcca

SEQ ID NO: 178245 - DNA, 25 bp, Homo sapien
gtcctccgcctttccaggagaagaa

SEQ ID NO: 178246 - DNA, 25 bp, Homo sapien
cgcctttccaggagaagaacctgaa

SEQ ID NO: 178247 - DNA, 25 bp, Homo sapien
gaaatgtgtatagcgcacttcccat

SEQ ID NO: 178248 - DNA, 25 bp, Homo sapien
atgtgtatagcgcacttcccatttg

SEQ ID NO: 178249 - DNA, 25 bp, Homo sapien
tgtatagcgcacttcccatttgtgt

SEQ ID NO: 178250 - DNA, 25 bp, Homo sapien
gtagaatataaacacataattgctt

SEQ ID NO: 178251 - DNA, 25 bp, Homo sapien
aattgcttatgtatgcctattcaga

SEQ ID NO: 178252 - DNA, 25 bp, Homo sapien
gcttatgtatgcctattcagaataa

SEQ ID NO: 178253 - DNA, 25 bp, Homo sapien
cagaataaatgggtaacactgatta

SEQ ID NO: 178254 - DNA, 25 bp, Homo sapien
gtaacactgattacttttgggaggg

SEQ ID NO: 178255 - DNA, 25 bp, Homo sapien
gaaccagtaggttgaggacaggaga

SEQ ID NO: 178256 - DNA, 25 bp, Homo sapien
ttaacacttacacccttttgtacat

SEQ ID NO: 178257 - DNA, 25 bp, Homo sapien
cacttacacccttttgtacattttg

SEQ ID NO: 178258 - DNA, 25 bp, Homo sapien
ggtcctgaggctgtatgaggcccac

SEQ ID NO: 178259 - DNA, 25 bp, Homo sapien
tgtatgaggcccacggcagccacgt

SEQ ID NO: 178260 - DNA, 25 bp, Homo sapien
acggcagccacgtggactgctggct

SEQ ID NO: 178261 - DNA, 25 bp, Homo sapien
gcacttgtcgctgccggttcaggag

SEQ ID NO: 178262 - DNA, 25 bp, Homo sapien
ttcaggaggccatcctctgcgatct

SEQ ID NO: 178263 - DNA, 25 bp, Homo sapien
tctgcgatctcttggagcgaccaga

SEQ ID NO: 178264 - DNA, 25 bp, Homo sapien
ttgacttcgggacaaccgcctgaag

SEQ ID NO: 178265 - DNA, 25 bp, Homo sapien
aagtgctgtccctgttgctcgtgct

SEQ ID NO: 178266 - DNA, 25 bp, Homo sapien
gggactcctaatttctgcttcccca

SEQ ID NO: 178267 - DNA, 25 bp, Homo sapien
tgcttccccagcctaaagcagggat

SEQ ID NO: 178268 - DNA, 25 bp, Homo sapien
agcagggatcagtcttttcttgtgg

SEQ ID NO: 178269 - DNA, 25 bp, Homo sapien
ccctagttcctagaggcatctggca

SEQ ID NO: 178270 - DNA, 25 bp, Homo sapien
agttcctagaggcatctggcagcaa

SEQ ID NO: 178271 - DNA, 25 bp, Homo sapien
ttcctagaggcatctggcagcaaga

SEQ ID NO: 178272 - DNA, 25 bp, Homo sapien
ctagaggcatctggcagcaagaagg

SEQ ID NO: 178273 - DNA, 25 bp, Homo sapien
ggtgaggcatcagggaacgggaatc

SEQ ID NO: 178274 - DNA, 25 bp, Homo sapien
agggaacgggaatcaggctgggact

SEQ ID NO: 178275 - DNA, 25 bp, Homo sapien
aatcaggctgggactgatcagaggt

SEQ ID NO: 178276 - DNA, 25 bp, Homo sapien
acctccttgctctgtgagctgtcag

SEQ ID NO: 178277 - DNA, 25 bp, Homo sapien
agctgtcagtctaggttattctctt

SEQ ID NO: 178278 - DNA, 25 bp, Homo sapien
ttctgtcttctgttaagtgtgtttt

SEQ ID NO: 178279 - DNA, 25 bp, Homo sapien
ttctctggagatagaatgtaaacca

SEQ ID NO: 178280 - DNA, 25 bp, Homo sapien
tttttcacctatctccttcctgtca

SEQ ID NO: 178281 - DNA, 25 bp, Homo sapien
tttcacctatctccttcctgtcaag

SEQ ID NO: 178282 - DNA, 25 bp, Homo sapien
acctatctccttcctgtcaaggcag

SEQ ID NO: 178283 - DNA, 25 bp, Homo sapien
ctatctccttcctgtcaaggcaggc

SEQ ID NO: 178284 - DNA, 25 bp, Homo sapien
atctccttcctgtcaaggcaggccg

SEQ ID NO: 178285 - DNA, 25 bp, Homo sapien
tctccttcctgtcaaggcaggccgg

SEQ ID NO: 178286 - DNA, 25 bp, Homo sapien
tgggggaggcgtctgcaggtcacct

SEQ ID NO: 178287 - DNA, 25 bp, Homo sapien
gggagccctggacaagccctcatag

SEQ ID NO: 178288 - DNA, 25 bp, Homo sapien
ggagccctggacaagccctcatagg

SEQ ID NO: 178289 - DNA, 25 bp, Homo sapien
gagccctggacaagccctcataggc

SEQ ID NO: 178290 - DNA, 25 bp, Homo sapien
ctggacaagccctcataggcaggga

SEQ ID NO: 178291 - DNA, 25 bp, Homo sapien
agagttgcaatcgtaatgtacagat

SEQ ID NO: 178292 - DNA, 25 bp, Homo sapien
aatctgatttgttttcctcttaacg

SEQ ID NO: 178293 - DNA, 25 bp, Homo sapien
ttcctcttaacgttagaccacaaat

SEQ ID NO: 178294 - DNA, 25 bp, Homo sapien
gaccacaaatagtgctcgctttcta

SEQ ID NO: 178295 - DNA, 25 bp, Homo sapien
gtgctcgctttctatgtagtttggt

SEQ ID NO: 178296 - DNA, 25 bp, Homo sapien
tagaagactctaccagactgtgtat

SEQ ID NO: 178297 - DNA, 25 bp, Homo sapien
gtaactgttaaattgctgtgtatct

SEQ ID NO: 178298 - DNA, 25 bp, Homo sapien
attgctgtgtatctgatagctcttt

SEQ ID NO: 178299 - DNA, 25 bp, Homo sapien
gagagaataagtcatgttccttcaa

SEQ ID NO: 178300 - DNA, 25 bp, Homo sapien
tgttccttcaagatcatgtacccca

SEQ ID NO: 178301 - DNA, 25 bp, Homo sapien
atgtaccccaatttacttgccatta

SEQ ID NO: 178302 - DNA, 25 bp, Homo sapien
gaaggtggcggacgcgctgagcctc

SEQ ID NO: 178303 - DNA, 25 bp, Homo sapien
gccgtggagcgcctggacgacctac

SEQ ID NO: 178304 - DNA, 25 bp, Homo sapien
acgcgtgccagctgcgagtggaccc

SEQ ID NO: 178305 - DNA, 25 bp, Homo sapien
tgcaggcgtcgctggacaagttcct

SEQ ID NO: 178306 - DNA, 25 bp, Homo sapien
aggcgtcgctggacaagttcctgag

SEQ ID NO: 178307 - DNA, 25 bp, Homo sapien
tggacaagttcctgagccacgttat

SEQ ID NO: 178308 - DNA, 25 bp, Homo sapien
aagttcctgagccacgttatctcgg

SEQ ID NO: 178309 - DNA, 25 bp, Homo sapien
agccacgttatctcggcgctggttt

SEQ ID NO: 178310 - DNA, 25 bp, Homo sapien
tatctcggcgctggtttccgagtac

SEQ ID NO: 178311 - DNA, 25 bp, Homo sapien
tggtttccgagtaccgctgactgtg

SEQ ID NO: 178312 - DNA, 25 bp, Homo sapien
actgtgggtgggtggccgcgggatc

SEQ ID NO: 178313 - DNA, 25 bp, Homo sapien
ggactatgaacactgctccaggtgg

SEQ ID NO: 178314 - DNA, 25 bp, Homo sapien
tatgaacactgctccaggtggaact

SEQ ID NO: 178315 - DNA, 25 bp, Homo sapien
acactgctccaggtggaactggtgg

SEQ ID NO: 178316 - DNA, 25 bp, Homo sapien
gggttcctccgtgaagaagaccatg

SEQ ID NO: 178317 - DNA, 25 bp, Homo sapien
tcctccgtgaagaagaccatggtgt

SEQ ID NO: 178318 - DNA, 25 bp, Homo sapien
catccgctccggctgcaatggtgac

SEQ ID NO: 178319 - DNA, 25 bp, Homo sapien
ttctgcctttggctgcaacacccgc

SEQ ID NO: 178320 - DNA, 25 bp, Homo sapien
aacacccgcaggaagcccacggtgt

SEQ ID NO: 178321 - DNA, 25 bp, Homo sapien
ccgcaggaagcccacggtgttcact

SEQ ID NO: 178322 - DNA, 25 bp, Homo sapien
gcaggaagcccacggtgttcactcg

SEQ ID NO: 178323 - DNA, 25 bp, Homo sapien
aggaagcccacggtgttcactcgag

SEQ ID NO: 178324 - DNA, 25 bp, Homo sapien
gacgcggtgaagagcatcgacgaca

SEQ ID NO: 178325 - DNA, 25 bp, Homo sapien
aagagcatcgacgacatcggcggcg

SEQ ID NO: 178326 - DNA, 25 bp, Homo sapien
atcggcggcgccctgtccaagctga

SEQ ID NO: 178327 - DNA, 25 bp, Homo sapien
aagctgagcgagctgcacgcctaca

SEQ ID NO: 178328 - DNA, 25 bp, Homo sapien
acatcctgcgcgtggacccggtcaa

SEQ ID NO: 178329 - DNA, 25 bp, Homo sapien
acgccgcctgggacaagttcctatc

SEQ ID NO: 178330 - DNA, 25 bp, Homo sapien
gggacaagttcctatcggtcgtatc

SEQ ID NO: 178331 - DNA, 25 bp, Homo sapien
agttcctatcggtcgtatcctctgt

SEQ ID NO: 178332 - DNA, 25 bp, Homo sapien
tgtcctgaccgagaagtaccgctga

SEQ ID NO: 178333 - DNA, 25 bp, Homo sapien
tgaccgagaagtaccgctgagcgcc

SEQ ID NO: 178334 - DNA, 25 bp, Homo sapien
gagaagtaccgctgagcgccgcctc

SEQ ID NO: 178335 - DNA, 25 bp, Homo sapien
aggagctggctgcagtttattctac

SEQ ID NO: 178336 - DNA, 25 bp, Homo sapien
tgcagtttattctacttaacccttt

SEQ ID NO: 178337 - DNA, 25 bp, Homo sapien
gtcaaatgtacattgttccatgtcg

SEQ ID NO: 178338 - DNA, 25 bp, Homo sapien
gtacattgttccatgtcgttagatg

SEQ ID NO: 178339 - DNA, 25 bp, Homo sapien
ggaagccattgtctaatcaactcta

SEQ ID NO: 178340 - DNA, 25 bp, Homo sapien
aatcaactctatcattagtgacttg

SEQ ID NO: 178341 - DNA, 25 bp, Homo sapien
cattagtgacttgatgtctcatacc

SEQ ID NO: 178342 - DNA, 25 bp, Homo sapien
gatgtctcataccttaattttgtaa

SEQ ID NO: 178343 - DNA, 25 bp, Homo sapien
gcacgttaatgttttgctttgcatt

SEQ ID NO: 178344 - DNA, 25 bp, Homo sapien
ttaggttcagattatgacttgattg

SEQ ID NO: 178345 - DNA, 25 bp, Homo sapien
tgtgcctatacattcatttgctttg

SEQ ID NO: 178346 - DNA, 25 bp, Homo sapien
tcctgcaccccaaatatgaacaact

SEQ ID NO: 178347 - DNA, 25 bp, Homo sapien
caaatatgaacaactgcagcaggtg

SEQ ID NO: 178348 - DNA, 25 bp, Homo sapien
tatgaacaactgcagcaggtgccac

SEQ ID NO: 178349 - DNA, 25 bp, Homo sapien
atatgaattccaacactgcttccaa

SEQ ID NO: 178350 - DNA, 25 bp, Homo sapien
tgaattccaacactgcttccaagag

SEQ ID NO: 178351 - DNA, 25 bp, Homo sapien
ttccaacactgcttccaagagacat

SEQ ID NO: 178352 - DNA, 25 bp, Homo sapien
tgcttccaagagacatttacataaa

SEQ ID NO: 178353 - DNA, 25 bp, Homo sapien
gaaaaattccaaaagtgctgagctt

SEQ ID NO: 178354 - DNA, 25 bp, Homo sapien
aattccaaaagtgctgagctttggg

SEQ ID NO: 178355 - DNA, 25 bp, Homo sapien
gaaaaaacccatgcagacataacat

SEQ ID NO: 178356 - DNA, 25 bp, Homo sapien
acccatgcagacataacatttatac

SEQ ID NO: 178357 - DNA, 25 bp, Homo sapien
caaggccttaagctttggacccaag

SEQ ID NO: 178358 - DNA, 25 bp, Homo sapien
ctttggacccaagggaaaactgcat

SEQ ID NO: 178359 - DNA, 25 bp, Homo sapien
aactgcatggagacgcatttcggtt

SEQ ID NO: 178360 - DNA, 25 bp, Homo sapien
atggagacgcatttcggttgagaat

SEQ ID NO: 178361 - DNA, 25 bp, Homo sapien
ttcggttgagaatggaaaccacaac

SEQ ID NO: 178362 - DNA, 25 bp, Homo sapien
ttaaagcaatgctgatgaatcactg

SEQ ID NO: 178363 - DNA, 25 bp, Homo sapien
gaatcactgtttttagacaccttca

SEQ ID NO: 178364 - DNA, 25 bp, Homo sapien
tcactgtttttagacaccttcattt

SEQ ID NO: 178365 - DNA, 25 bp, Homo sapien
gggaggagttccacagattgtttct

SEQ ID NO: 178366 - DNA, 25 bp, Homo sapien
gagttccacagattgtttctataca

SEQ ID NO: 178367 - DNA, 25 bp, Homo sapien
gttgttcaactattttattatccta

SEQ ID NO: 178368 - DNA, 25 bp, Homo sapien
agccacttcctttgctctgcagttt

SEQ ID NO: 178369 - DNA, 25 bp, Homo sapien
acttcctttgctctgcagtttctat

SEQ ID NO: 178370 - DNA, 25 bp, Homo sapien
ctttgctctgcagtttctatagtag

SEQ ID NO: 178371 - DNA, 25 bp, Homo sapien
tgctctgcagtttctatagtagttt

SEQ ID NO: 178372 - DNA, 25 bp, Homo sapien
ctgcagtttctatagtagttttaaa

SEQ ID NO: 178373 - DNA, 25 bp, Homo sapien
aaaagagaaccacacactaccatat

SEQ ID NO: 178374 - DNA, 25 bp, Homo sapien
gagaaccacacactaccatatccaa

SEQ ID NO: 178375 - DNA, 25 bp, Homo sapien
cacactaccatatccaaacaacttt

SEQ ID NO: 178376 - DNA, 25 bp, Homo sapien
aaattaatgcactggtacacccagt

SEQ ID NO: 178377 - DNA, 25 bp, Homo sapien
aatgcactggtacacccagtggctc

SEQ ID NO: 178378 - DNA, 25 bp, Homo sapien
actggtacacccagtggctcatatt

SEQ ID NO: 178379 - DNA, 25 bp, Homo sapien
ttacccttagagactgtgactcagt

SEQ ID NO: 178380 - DNA, 25 bp, Homo sapien
agggcccaggcatcttcattttgac

SEQ ID NO: 178381 - DNA, 25 bp, Homo sapien
ttcattttgacaggccgtcccggtg

SEQ ID NO: 178382 - DNA, 25 bp, Homo sapien
catgcgcaggcaggttttaggaaca

SEQ ID NO: 178383 - DNA, 25 bp, Homo sapien
atgggtggatgattcctggtctccc

SEQ ID NO: 178384 - DNA, 25 bp, Homo sapien
agccctcttgacctggccacagaga

SEQ ID NO: 178385 - DNA, 25 bp, Homo sapien
gcctttccagcgaggtcagccgaga

SEQ ID NO: 178386 - DNA, 25 bp, Homo sapien
tgccgggagagcagtcttctctgta

SEQ ID NO: 178387 - DNA, 25 bp, Homo sapien
agtcttctctgtagtccccggaggg

SEQ ID NO: 178388 - DNA, 25 bp, Homo sapien
atgagtctgagggttccggttgtct

SEQ ID NO: 178389 - DNA, 25 bp, Homo sapien
gttgtcttggcctgagaccacccaa

SEQ ID NO: 178390 - DNA, 25 bp, Homo sapien
tgtcaactgctgtgaatgctgtatg

SEQ ID NO: 178391 - DNA, 25 bp, Homo sapien
gaatgctgtatggtgtgtgttctct

SEQ ID NO: 178392 - DNA, 25 bp, Homo sapien
gtgttctcttctgttactgatatgt

SEQ ID NO: 178393 - DNA, 25 bp, Homo sapien
caatgtgaactgaagctgatgggct

SEQ ID NO: 178394 - DNA, 25 bp, Homo sapien
tgggctgagaacatggactgagctt

SEQ ID NO: 178395 - DNA, 25 bp, Homo sapien
gactgagcttgtggtgtgctttgca

SEQ ID NO: 178396 - DNA, 25 bp, Homo sapien
aggacttgaagcagagttcaccagt

SEQ ID NO: 178397 - DNA, 25 bp, Homo sapien
agagttcaccagtgagctcaggtgt

SEQ ID NO: 178398 - DNA, 25 bp, Homo sapien
agttctaatgtctgttagctaccca

SEQ ID NO: 178399 - DNA, 25 bp, Homo sapien
gtctgttagctacccataagaatgc

SEQ ID NO: 178400 - DNA, 25 bp, Homo sapien
aagaatgctgtttgctgcagttctg

SEQ ID NO: 178401 - DNA, 25 bp, Homo sapien
aaacagctcctgtgtctggcacgtg

SEQ ID NO: 178402 - DNA, 25 bp, Homo sapien
tggcacgtgcccttctccggaagac

SEQ ID NO: 178403 - DNA, 25 bp, Homo sapien
ttctccggaagacccagatcctcat

SEQ ID NO: 178404 - DNA, 25 bp, Homo sapien
ccatgctcgggagctggtttgcaca

SEQ ID NO: 178405 - DNA, 25 bp, Homo sapien
agctggtttgcacagtgcactgtgc

SEQ ID NO: 178406 - DNA, 25 bp, Homo sapien
acagtgcactgtgctgctcattgcc

SEQ ID NO: 178407 - DNA, 25 bp, Homo sapien
gcctgcgctccgtgatggactgtgc

SEQ ID NO: 178408 - DNA, 25 bp, Homo sapien
tccgtgatggactgtgcccgggttc

SEQ ID NO: 178409 - DNA, 25 bp, Homo sapien
tgcccgggttctggtcatggacaag

SEQ ID NO: 178410 - DNA, 25 bp, Homo sapien
agaagggcctgttttacagactggc

SEQ ID NO: 178411 - DNA, 25 bp, Homo sapien
ctgttttacagactggcccaggagt

SEQ ID NO: 178412 - DNA, 25 bp, Homo sapien
agggcactttttctcagctgagtga

SEQ ID NO: 178413 - DNA, 25 bp, Homo sapien
ggtgtgtgtgctggcccgcaacttt

SEQ ID NO: 178414 - DNA, 25 bp, Homo sapien
gctggcccgcaactttggcaaggaa

SEQ ID NO: 178415 - DNA, 25 bp, Homo sapien
cgcaactttggcaaggaattcaccc

SEQ ID NO: 178416 - DNA, 25 bp, Homo sapien
gtaccattgagatcctggactgttt

SEQ ID NO: 178417 - DNA, 25 bp, Homo sapien
tggactgtttcctgataaccataag

SEQ ID NO: 178418 - DNA, 25 bp, Homo sapien
tcctgataaccataagaagacccta

SEQ ID NO: 178419 - DNA, 25 bp, Homo sapien
aagaccctatttccctagattctat

SEQ ID NO: 178420 - DNA, 25 bp, Homo sapien
tctattttctgaacttgggaacaca

SEQ ID NO: 178421 - DNA, 25 bp, Homo sapien
gaacttgggaacacaatgcctactt

SEQ ID NO: 178422 - DNA, 25 bp, Homo sapien
atgcctacttcaagggtatggcttc

SEQ ID NO: 178423 - DNA, 25 bp, Homo sapien
tagacttagctttagtcagctgaag

SEQ ID NO: 178424 - DNA, 25 bp, Homo sapien
aagtgggacaactggattgtggctc

SEQ ID NO: 178425 - DNA, 25 bp, Homo sapien
attgtggctccgcacaggtacaacc

SEQ ID NO: 178426 - DNA, 25 bp, Homo sapien
ggtacaaccctcgatactgtaaagg

SEQ ID NO: 178427 - DNA, 25 bp, Homo sapien
gcagttggacatcggtatggctctc

SEQ ID NO: 178428 - DNA, 25 bp, Homo sapien
tctccagttcacaccatggtacaga

SEQ ID NO: 178429 - DNA, 25 bp, Homo sapien
ctcagtgccaagaccgtcatgtgta

SEQ ID NO: 178430 - DNA, 25 bp, Homo sapien
gaccgtcatgtgtacctgccaaata

SEQ ID NO: 178431 - DNA, 25 bp, Homo sapien
aatacagccccttgagtgttttgac

SEQ ID NO: 178432 - DNA, 25 bp, Homo sapien
gagtgttttgaccattgagcccgat

SEQ ID NO: 178433 - DNA, 25 bp, Homo sapien
agcccgatggctcaattgcctataa

SEQ ID NO: 178434 - DNA, 25 bp, Homo sapien
cactgccagaagtgtgttttggtat

SEQ ID NO: 178435 - DNA, 25 bp, Homo sapien
gttttggtatgcactggttccttaa

SEQ ID NO: 178436 - DNA, 25 bp, Homo sapien
ctggttccttaagtggctgtgatta

SEQ ID NO: 178437 - DNA, 25 bp, Homo sapien
ttgaagaccccaactactattgtag

SEQ ID NO: 178438 - DNA, 25 bp, Homo sapien
tagagtggtctatttctcccttcaa

SEQ ID NO: 178439 - DNA, 25 bp, Homo sapien
tatttctcccttcaatcctgtcaat

SEQ ID NO: 178440 - DNA, 25 bp, Homo sapien
cccttcaatcctgtcaatgtttgct

SEQ ID NO: 178441 - DNA, 25 bp, Homo sapien
ggaactgttgtttgatgtgtatgtg

SEQ ID NO: 178442 - DNA, 25 bp, Homo sapien
tatacatttttaattgagcctttta

SEQ ID NO: 178443 - DNA, 25 bp, Homo sapien
tgagccttttattaacatatattgt

SEQ ID NO: 178444 - DNA, 25 bp, Homo sapien
tctgatattggtgtgaatgctgtac

SEQ ID NO: 178445 - DNA, 25 bp, Homo sapien
aattattcattgtgattgtataggg

SEQ ID NO: 178446 - DNA, 25 bp, Homo sapien
gagtacatgatgtgttttgatagag

SEQ ID NO: 178447 - DNA, 25 bp, Homo sapien
tgatgtgttttgatagaggtatgca

SEQ ID NO: 178448 - DNA, 25 bp, Homo sapien
gaaaatagagtatccatccccacga

SEQ ID NO: 178449 - DNA, 25 bp, Homo sapien
aaaatagagtatccatccccacgag

SEQ ID NO: 178450 - DNA, 25 bp, Homo sapien
atagagtatccatccccacgagcat

SEQ ID NO: 178451 - DNA, 25 bp, Homo sapien
tatccatccccacgagcatttatat

SEQ ID NO: 178452 - DNA, 25 bp, Homo sapien
tccatccccacgagcatttatattt

SEQ ID NO: 178453 - DNA, 25 bp, Homo sapien
catccccacgagcatttatatttag

SEQ ID NO: 178454 - DNA, 25 bp, Homo sapien
tccctttctaattttcagagtgtaa

SEQ ID NO: 178455 - DNA, 25 bp, Homo sapien
tcagagtgtaagtctttcatttctt

SEQ ID NO: 178456 - DNA, 25 bp, Homo sapien
gtaagtgtgaccatactgcatgttt

SEQ ID NO: 178457 - DNA, 25 bp, Homo sapien
gcatgttttatggtgacctggtcca

SEQ ID NO: 178458 - DNA, 25 bp, Homo sapien
ctggtccagtactgcctttgttaaa

SEQ ID NO: 178459 - DNA, 25 bp, Homo sapien
ctatgaagatttttcccgtgggatt

SEQ ID NO: 178460 - DNA, 25 bp, Homo sapien
gataaaatacacctctgtctcttcc

SEQ ID NO: 178461 - DNA, 25 bp, Homo sapien
gtctcttcccatttgcctataagtt

SEQ ID NO: 178462 - DNA, 25 bp, Homo sapien
gccaagatgtgatacagcagctcaa

SEQ ID NO: 178463 - DNA, 25 bp, Homo sapien
gcagctcaaagaatgcttgccaagt

SEQ ID NO: 178464 - DNA, 25 bp, Homo sapien
gtcactaatagtctttgctctctct

SEQ ID NO: 178465 - DNA, 25 bp, Homo sapien
tgctctctctagttcagtgactttc

SEQ ID NO: 178466 - DNA, 25 bp, Homo sapien
gtgactttccgatactgtgtaacat

SEQ ID NO: 178467 - DNA, 25 bp, Homo sapien
gggcatcctgcggtgtcgagcaata

SEQ ID NO: 178468 - DNA, 25 bp, Homo sapien
gtgtcgagcaatagcctggcttcag

SEQ ID NO: 178469 - DNA, 25 bp, Homo sapien
gaaaggcaggaacaggaccttctct

SEQ ID NO: 178470 - DNA, 25 bp, Homo sapien
tggctgcagctgatctgtttcctta

SEQ ID NO: 178471 - DNA, 25 bp, Homo sapien
tgtttccttataccagatcctcagt

SEQ ID NO: 178472 - DNA, 25 bp, Homo sapien
ttataccagatcctcagtctcacta

SEQ ID NO: 178473 - DNA, 25 bp, Homo sapien
aaagacagcgatatgggagacaccc

SEQ ID NO: 178474 - DNA, 25 bp, Homo sapien
agcccaaaagatggtcatcgggaag

SEQ ID NO: 178475 - DNA, 25 bp, Homo sapien
aaaaatgctgcagttgttctctcaa

SEQ ID NO: 178476 - DNA, 25 bp, Homo sapien
agttgttctctcaagctagggcaga

SEQ ID NO: 178477 - DNA, 25 bp, Homo sapien
gaagagggtgtcaagctcctcaata

SEQ ID NO: 178478 - DNA, 25 bp, Homo sapien
tggaaccaatagtaattcgaggact

SEQ ID NO: 178479 - DNA, 25 bp, Homo sapien
attcgaggactagttgggagattct

SEQ ID NO: 178480 - DNA, 25 bp, Homo sapien
aatcagggaatattcctgcaacaca

SEQ ID NO: 178481 - DNA, 25 bp, Homo sapien
ggaatcatcccaattataacacgag

SEQ ID NO: 178482 - DNA, 25 bp, Homo sapien
tataacacgagctattgcataatac

SEQ ID NO: 178483 - DNA, 25 bp, Homo sapien
atacaaataaccctcttaagtctga

SEQ ID NO: 178484 - DNA, 25 bp, Homo sapien
aaccctcttaagtctgagagtctgt

SEQ ID NO: 178485 - DNA, 25 bp, Homo sapien
ctgagagtctgtgtctttatttgaa

SEQ ID NO: 178486 - DNA, 25 bp, Homo sapien
tcttcaaattgcgtacttactcctc

SEQ ID NO: 178487 - DNA, 25 bp, Homo sapien
tacttactcctccatattctttcaa

SEQ ID NO: 178488 - DNA, 25 bp, Homo sapien
aacccacatgagtctcctcgagaag

SEQ ID NO: 178489 - DNA, 25 bp, Homo sapien
ctccctttttgcaatatcccatgta

SEQ ID NO: 178490 - DNA, 25 bp, Homo sapien
cccatgtaactctgagctccattag

SEQ ID NO: 178491 - DNA, 25 bp, Homo sapien
agctccattagcaaaaccagaagtt

SEQ ID NO: 178492 - DNA, 25 bp, Homo sapien
agaagttccgccaaaagagatgaga

SEQ ID NO: 178493 - DNA, 25 bp, Homo sapien
tgcctcagtcagtggtgccatgaca

SEQ ID NO: 178494 - DNA, 25 bp, Homo sapien
tcagtcagtggtgccatgacacctg

SEQ ID NO: 178495 - DNA, 25 bp, Homo sapien
ggcaagacagcacagtgttcctccc

SEQ ID NO: 178496 - DNA, 25 bp, Homo sapien
gggaacatctcaaagcactctagtt

SEQ ID NO: 178497 - DNA, 25 bp, Homo sapien
caaagcactctagttttccttggga

SEQ ID NO: 178498 - DNA, 25 bp, Homo sapien
agttttccttgggagtcactcagat

SEQ ID NO: 178499 - DNA, 25 bp, Homo sapien
gagtcactcagataaacagcctttt

SEQ ID NO: 178500 - DNA, 25 bp, Homo sapien
cttgctttgctttttcctaaggatt

SEQ ID NO: 178501 - DNA, 25 bp, Homo sapien
tgcaaagtctccttcggaacccgaa

SEQ ID NO: 178502 - DNA, 25 bp, Homo sapien
ggaacccgaactgcaagctgagcgc

SEQ ID NO: 178503 - DNA, 25 bp, Homo sapien
tgcccagattctcccatgggtattt

SEQ ID NO: 178504 - DNA, 25 bp, Homo sapien
ctcccatgggtatttcacgtcgaaa

SEQ ID NO: 178505 - DNA, 25 bp, Homo sapien
gtcgaaaggacgctgttacatatgt

SEQ ID NO: 178506 - DNA, 25 bp, Homo sapien
acatatgtataactttcgctttaaa

SEQ ID NO: 178507 - DNA, 25 bp, Homo sapien
tacttatttaagagaccgccatggt

SEQ ID NO: 178508 - DNA, 25 bp, Homo sapien
gccatggtaggtttctctgtagctt

SEQ ID NO: 178509 - DNA, 25 bp, Homo sapien
gtttctaaacatgcaggctggtggt

SEQ ID NO: 178510 - DNA, 25 bp, Homo sapien
tgggttctgtgtggagaagccaaac

SEQ ID NO: 178511 - DNA, 25 bp, Homo sapien
ggagaaaaaacattgcccagggatt

SEQ ID NO: 178512 - DNA, 25 bp, Homo sapien
aaacattgcccagggattaggagca

SEQ ID NO: 178513 - DNA, 25 bp, Homo sapien
gctcctggaatggaagaaccccctt

SEQ ID NO: 178514 - DNA, 25 bp, Homo sapien
cttccacaatggtctcagcctaggc

SEQ ID NO: 178515 - DNA, 25 bp, Homo sapien
atggtctcagcctaggccctcatga

SEQ ID NO: 178516 - DNA, 25 bp, Homo sapien
agagctaacataaaggacaggccac

SEQ ID NO: 178517 - DNA, 25 bp, Homo sapien
cattgagatcactactcagtgcata

SEQ ID NO: 178518 - DNA, 25 bp, Homo sapien
gagatcactactcagtgcatagcga

SEQ ID NO: 178519 - DNA, 25 bp, Homo sapien
tactcagtgcatagcgaagaccagt

SEQ ID NO: 178520 - DNA, 25 bp, Homo sapien
gcatagcgaagaccagtatggcaaa

SEQ ID NO: 178521 - DNA, 25 bp, Homo sapien
cagtatggcaaaattagtcttggaa

SEQ ID NO: 178522 - DNA, 25 bp, Homo sapien
gtgtctgagattttaagcatctctt

SEQ ID NO: 178523 - DNA, 25 bp, Homo sapien
aagcatctcttatacaaagttattg

SEQ ID NO: 178524 - DNA, 25 bp, Homo sapien
gttattgggacattcttacgtactg

SEQ ID NO: 178525 - DNA, 25 bp, Homo sapien
gggacattcttacgtactgattata

SEQ ID NO: 178526 - DNA, 25 bp, Homo sapien
acgtactgattatagcaggtgtact

SEQ ID NO: 178527 - DNA, 25 bp, Homo sapien
aggtgtactgagtcttgcttttttc

SEQ ID NO: 178528 - DNA, 25 bp, Homo sapien
ttcccaagtagtattttgaaagtag

SEQ ID NO: 178529 - DNA, 25 bp, Homo sapien
agactttctattactgttttggtga

SEQ ID NO: 178530 - DNA, 25 bp, Homo sapien
gttttggtgagttactttatcttct

SEQ ID NO: 178531 - DNA, 25 bp, Homo sapien
gagttactttatcttctataagcga

SEQ ID NO: 178532 - DNA, 25 bp, Homo sapien
ttctataagcgattctacagtaacc

SEQ ID NO: 178533 - DNA, 25 bp, Homo sapien
aatttgtcgttaaacctgcaacaca

SEQ ID NO: 178534 - DNA, 25 bp, Homo sapien
aacctgcaacacattagaaacttat

SEQ ID NO: 178535 - DNA, 25 bp, Homo sapien
gaattaactcacatgaccaactttt

SEQ ID NO: 178536 - DNA, 25 bp, Homo sapien
aagaaatgtacaccactcctcatgt

SEQ ID NO: 178537 - DNA, 25 bp, Homo sapien
caccactcctcatgtgccattttgt

SEQ ID NO: 178538 - DNA, 25 bp, Homo sapien
ctcagagggcgcttactttttggta

SEQ ID NO: 178539 - DNA, 25 bp, Homo sapien
tcagagggcgcttactttttggtaa

SEQ ID NO: 178540 - DNA, 25 bp, Homo sapien
ggtaaagaacaagctgctgccttga

SEQ ID NO: 178541 - DNA, 25 bp, Homo sapien
aagctgctgccttgaccaggagttc

SEQ ID NO: 178542 - DNA, 25 bp, Homo sapien
gccttgaccaggagttcatatataa

SEQ ID NO: 178543 - DNA, 25 bp, Homo sapien
gaccaggagttcatatataactgtt

SEQ ID NO: 178544 - DNA, 25 bp, Homo sapien
caagtctcaacttttggcaaagagg

SEQ ID NO: 178545 - DNA, 25 bp, Homo sapien
agaggttgctggatctttccaatga

SEQ ID NO: 178546 - DNA, 25 bp, Homo sapien
gggaattcatgactgtccactgctg

SEQ ID NO: 178547 - DNA, 25 bp, Homo sapien
aagggcagtggaccttggaaatcca

SEQ ID NO: 178548 - DNA, 25 bp, Homo sapien
ggaaatccaagatctgccatcccag

SEQ ID NO: 178549 - DNA, 25 bp, Homo sapien
ggtgatcttgagactcctgttgcaa

SEQ ID NO: 178550 - DNA, 25 bp, Homo sapien
gaagagaggttcgtttccacaccct

SEQ ID NO: 178551 - DNA, 25 bp, Homo sapien
cacaccctcgattctgttccattgg

SEQ ID NO: 178552 - DNA, 25 bp, Homo sapien
ctgttccattggtctgtatatctat

SEQ ID NO: 178553 - DNA, 25 bp, Homo sapien
gtatatctatcttggagtcagtacc

SEQ ID NO: 178554 - DNA, 25 bp, Homo sapien
tggagtcagtaccatattgttttga

SEQ ID NO: 178555 - DNA, 25 bp, Homo sapien
aacctgcaacacattagaaacttat

SEQ ID NO: 178556 - DNA, 25 bp, Homo sapien
acctgcaacacattagaaacttata

SEQ ID NO: 178557 - DNA, 25 bp, Homo sapien
aaagaaatgtacaccactcctcatg

SEQ ID NO: 178558 - DNA, 25 bp, Homo sapien
aagaaatgtacaccactcctcatgt

SEQ ID NO: 178559 - DNA, 25 bp, Homo sapien
agaaatgtacaccactcctcatgtg

SEQ ID NO: 178560 - DNA, 25 bp, Homo sapien
gaaatgtacaccactcctcatgtgc

SEQ ID NO: 178561 - DNA, 25 bp, Homo sapien
aatgtacaccactcctcatgtgcca

SEQ ID NO: 178562 - DNA, 25 bp, Homo sapien
gtacaccactcctcatgtgccattt

SEQ ID NO: 178563 - DNA, 25 bp, Homo sapien
caccactcctcatgtgccattttgt

SEQ ID NO: 178564 - DNA, 25 bp, Homo sapien
gaccaggagttcatatataactgtt

SEQ ID NO: 178565 - DNA, 25 bp, Homo sapien
ggagttcatatataactgttattac

SEQ ID NO: 178566 - DNA, 25 bp, Homo sapien
gtctttagagctgacagtctgttag

SEQ ID NO: 178567 - DNA, 25 bp, Homo sapien
tttcttcatgctaaagtgtcagttg

SEQ ID NO: 178568 - DNA, 25 bp, Homo sapien
ctaaagtgtcagttggtggttttgt

SEQ ID NO: 178569 - DNA, 25 bp, Homo sapien
ggtcaaaaattcacaggtcttaaat

SEQ ID NO: 178570 - DNA, 25 bp, Homo sapien
gggaaatttatattggacactgctc

SEQ ID NO: 178571 - DNA, 25 bp, Homo sapien
ggacactgctctttgtctagcaaat

SEQ ID NO: 178572 - DNA, 25 bp, Homo sapien
gttaatatattcctgttactggcat

SEQ ID NO: 178573 - DNA, 25 bp, Homo sapien
tattcctgttactggcatgtgcacg

SEQ ID NO: 178574 - DNA, 25 bp, Homo sapien
actggcatgtgcacgactatgttat

SEQ ID NO: 178575 - DNA, 25 bp, Homo sapien
gactatgttattagaagccacttta

SEQ ID NO: 178576 - DNA, 25 bp, Homo sapien
atgtctatttatgaattctgcttgt

SEQ ID NO: 178577 - DNA, 25 bp, Homo sapien
gtgaaggagccgtctccacctccca

SEQ ID NO: 178578 - DNA, 25 bp, Homo sapien
ggagccgtctccacctcccatagtt

SEQ ID NO: 178579 - DNA, 25 bp, Homo sapien
tcccatagttctcccgcgtctggtt

SEQ ID NO: 178580 - DNA, 25 bp, Homo sapien
atagttctcccgcgtctggttggcc

SEQ ID NO: 178581 - DNA, 25 bp, Homo sapien
ccgcgtctggttggccccgtgtgtt

SEQ ID NO: 178582 - DNA, 25 bp, Homo sapien
tctggttggccccgtgtgttccttt

SEQ ID NO: 178583 - DNA, 25 bp, Homo sapien
cttttcctatacctccccaggcagc

SEQ ID NO: 178584 - DNA, 25 bp, Homo sapien
aacgtggttggctcagggtttgaca

SEQ ID NO: 178585 - DNA, 25 bp, Homo sapien
gttggctcagggtttgacagagaaa

SEQ ID NO: 178586 - DNA, 25 bp, Homo sapien
ttggctcagggtttgacagagaaaa

SEQ ID NO: 178587 - DNA, 25 bp, Homo sapien
gctcagggtttgacagagaaaagac

SEQ ID NO: 178588 - DNA, 25 bp, Homo sapien
caagtctcaacttttggcaaagagg

SEQ ID NO: 178589 - DNA, 25 bp, Homo sapien
gcaaagaggttgctggatctttcca

SEQ ID NO: 178590 - DNA, 25 bp, Homo sapien
gaggttgctggatctttccaatgaa

SEQ ID NO: 178591 - DNA, 25 bp, Homo sapien
ggatctttccaatgaagggtttaca

SEQ ID NO: 178592 - DNA, 25 bp, Homo sapien
tttacaaactgggaattcatgactg

SEQ ID NO: 178593 - DNA, 25 bp, Homo sapien
tgggaattcatgactgtccactgct

SEQ ID NO: 178594 - DNA, 25 bp, Homo sapien
gaattcatgactgtccactgctggg

SEQ ID NO: 178595 - DNA, 25 bp, Homo sapien
aagggcagtggaccttggaaatcca

SEQ ID NO: 178596 - DNA, 25 bp, Homo sapien
ggaccttggaaatccaagatctgcc

SEQ ID NO: 178597 - DNA, 25 bp, Homo sapien
atcccaggtccgcaacccggagaag

SEQ ID NO: 178598 - DNA, 25 bp, Homo sapien
ccaggtccgcaacccggagaagcaa

SEQ ID NO: 178599 - DNA, 25 bp, Homo sapien
gtgcacttgttctcacaggaaacac

SEQ ID NO: 178600 - DNA, 25 bp, Homo sapien
ggaaacacagtcatctttgcaacta

SEQ ID NO: 178601 - DNA, 25 bp, Homo sapien
ctatactaggctttttcttggtctt

SEQ ID NO: 178602 - DNA, 25 bp, Homo sapien
agctggcagcagtggtgaaaagaaa

SEQ ID NO: 178603 - DNA, 25 bp, Homo sapien
attgtcaaatggacttcctgtcatt

SEQ ID NO: 178604 - DNA, 25 bp, Homo sapien
ctgtcatttgttggccattcacgca

SEQ ID NO: 178605 - DNA, 25 bp, Homo sapien
gttggccattcacgcacacaggaga

SEQ ID NO: 178606 - DNA, 25 bp, Homo sapien
tgaatggtatagcaagcctcttggg

SEQ ID NO: 178607 - DNA, 25 bp, Homo sapien
gggtattttaggtgctcccttctca

SEQ ID NO: 178608 - DNA, 25 bp, Homo sapien
ttaggtgctcccttctcacttttat

SEQ ID NO: 178609 - DNA, 25 bp, Homo sapien
gtaagcatactattttcacagagac

SEQ ID NO: 178610 - DNA, 25 bp, Homo sapien
aagggaattgtgtggcctctagcct

SEQ ID NO: 178611 - DNA, 25 bp, Homo sapien
aattgtgtggcctctagcctagtca

SEQ ID NO: 178612 - DNA, 25 bp, Homo sapien
gcctctagcctagtcatttaaagaa

SEQ ID NO: 178613 - DNA, 25 bp, Homo sapien
gtagacattatgtatgtcacttaac

SEQ ID NO: 178614 - DNA, 25 bp, Homo sapien
ttatttgcctccagtctggctagga

SEQ ID NO: 178615 - DNA, 25 bp, Homo sapien
tgcctccagtctggctaggaaacca

SEQ ID NO: 178616 - DNA, 25 bp, Homo sapien
aagtcaatgtacacttcctccttat

SEQ ID NO: 178617 - DNA, 25 bp, Homo sapien
caatgtacacttcctccttattgga

SEQ ID NO: 178618 - DNA, 25 bp, Homo sapien
gtacacttcctccttattggaatat

SEQ ID NO: 178619 - DNA, 25 bp, Homo sapien
gtataatttagtcttttcatgaatg

SEQ ID NO: 178620 - DNA, 25 bp, Homo sapien
agtcttttcatgaatgtacatacat

SEQ ID NO: 178621 - DNA, 25 bp, Homo sapien
gcccgggtgaccaacagcagcgtgt

SEQ ID NO: 178622 - DNA, 25 bp, Homo sapien
aacagcagcgtgtgggtagaaccct

SEQ ID NO: 178623 - DNA, 25 bp, Homo sapien
tgggtagaaccctgagcgaccctgc

SEQ ID NO: 178624 - DNA, 25 bp, Homo sapien
ggtcgagggtagataggccttaact

SEQ ID NO: 178625 - DNA, 25 bp, Homo sapien
gtagataggccttaacttagtccat

SEQ ID NO: 178626 - DNA, 25 bp, Homo sapien
ttaacttagtccatagcgtcctcac

SEQ ID NO: 178627 - DNA, 25 bp, Homo sapien
cataggtttgcttaggtagccggct

SEQ ID NO: 178628 - DNA, 25 bp, Homo sapien
tttgcttaggtagccggcttctaga

SEQ ID NO: 178629 - DNA, 25 bp, Homo sapien
aggtagccggcttctagaatgtaga

SEQ ID NO: 178630 - DNA, 25 bp, Homo sapien
ctagaatgtagatccgtgagggcgt

SEQ ID NO: 178631 - DNA, 25 bp, Homo sapien
gcgtgagcttggactggacccactg

SEQ ID NO: 178632 - DNA, 25 bp, Homo sapien
gctgtggtggtaacctgcagatata

SEQ ID NO: 178633 - DNA, 25 bp, Homo sapien
acctgcagatatacacattcccatg

SEQ ID NO: 178634 - DNA, 25 bp, Homo sapien
acacattcccatgcactgacataag

SEQ ID NO: 178635 - DNA, 25 bp, Homo sapien
aacacatagtactttctagatggaa

SEQ ID NO: 178636 - DNA, 25 bp, Homo sapien
ttttctttaggcctcaatgaaatac

SEQ ID NO: 178637 - DNA, 25 bp, Homo sapien
atacatttcccctatataattccaa

SEQ ID NO: 178638 - DNA, 25 bp, Homo sapien
aattccaacagcagtttctctagtt

SEQ ID NO: 178639 - DNA, 25 bp, Homo sapien
cctaagttttgctgaaatctgattt

SEQ ID NO: 178640 - DNA, 25 bp, Homo sapien
tgtcattttaattacctagctggaa

SEQ ID NO: 178641 - DNA, 25 bp, Homo sapien
tgaaatgtactagaggagccctttt

SEQ ID NO: 178642 - DNA, 25 bp, Homo sapien
actagaggagcccttttccaatgga

SEQ ID NO: 178643 - DNA, 25 bp, Homo sapien
aggaatttcacaccgcagctgtttc

SEQ ID NO: 178644 - DNA, 25 bp, Homo sapien
tgtttccaccgccatgaaaaaggtt

SEQ ID NO: 178645 - DNA, 25 bp, Homo sapien
ggttttccgtgtgtatcagggccaa

SEQ ID NO: 178646 - DNA, 25 bp, Homo sapien
acagccagggacctgtatgggttcc

SEQ ID NO: 178647 - DNA, 25 bp, Homo sapien
tatgggttccaaaaggtcccaggtg

SEQ ID NO: 178648 - DNA, 25 bp, Homo sapien
gtgtcctctccgtgcagtcggaaaa

SEQ ID NO: 178649 - DNA, 25 bp, Homo sapien
gtgcagtcggaaaaagccccgcatg

SEQ ID NO: 178650 - DNA, 25 bp, Homo sapien
gcatgggccagcaagtcctggataa

SEQ ID NO: 178651 - DNA, 25 bp, Homo sapien
tggataatttctttcggtctcacat

SEQ ID NO: 178652 - DNA, 25 bp, Homo sapien
actgatgcacacagcctcaacagtg

SEQ ID NO: 178653 - DNA, 25 bp, Homo sapien
attccctgagaatcctgttgttagt

SEQ ID NO: 178654 - DNA, 25 bp, Homo sapien
ttgcccaccctagtttgcttttgta

SEQ ID NO: 178655 - DNA, 25 bp, Homo sapien
cccaccctagtttgcttttgtagtg

SEQ ID NO: 178656 - DNA, 25 bp, Homo sapien
caccctagtttgcttttgtagtggt

SEQ ID NO: 178657 - DNA, 25 bp, Homo sapien
agtttgcttttgtagtggtttggca

SEQ ID NO: 178658 - DNA, 25 bp, Homo sapien
gtgcctactctctgggccactgctg

SEQ ID NO: 178659 - DNA, 25 bp, Homo sapien
tggcacttgtcatgggtttggaaga

SEQ ID NO: 178660 - DNA, 25 bp, Homo sapien
gtttggaagacccagccatctgcag

SEQ ID NO: 178661 - DNA, 25 bp, Homo sapien
tttggaagacccagccatctgcagc

SEQ ID NO: 178662 - DNA, 25 bp, Homo sapien
gaactgaacggagtaattattctac

SEQ ID NO: 178663 - DNA, 25 bp, Homo sapien
ggagtaattattctactcttctttt

SEQ ID NO: 178664 - DNA, 25 bp, Homo sapien
tactgattattctttccagttctta

SEQ ID NO: 178665 - DNA, 25 bp, Homo sapien
gggtgtctacctaacttctcaggga

SEQ ID NO: 178666 - DNA, 25 bp, Homo sapien
ttctcagggactacacttggtagtt

SEQ ID NO: 178667 - DNA, 25 bp, Homo sapien
tacacttggtagttttccaccattt

SEQ ID NO: 178668 - DNA, 25 bp, Homo sapien
gaaacatttgttgagttaccagaat

SEQ ID NO: 178669 - DNA, 25 bp, Homo sapien
gttgagttaccagaattgccattaa

SEQ ID NO: 178670 - DNA, 25 bp, Homo sapien
gccattaacagtgttttctttccca

SEQ ID NO: 178671 - DNA, 25 bp, Homo sapien
tctttcccatattccatgctttctg

SEQ ID NO: 178672 - DNA, 25 bp, Homo sapien
tatgtatatgactgtgctgtgtatt

SEQ ID NO: 178673 - DNA, 25 bp, Homo sapien
gtgtatttatcgaagctagtaagca

SEQ ID NO: 178674 - DNA, 25 bp, Homo sapien
aatggccaagcaatataaggttaaa

SEQ ID NO: 178675 - DNA, 25 bp, Homo sapien
tataagtaacccttaccttatcttg

SEQ ID NO: 178676 - DNA, 25 bp, Homo sapien
aaaacctgtaccctgatgctgtata

SEQ ID NO: 178677 - DNA, 25 bp, Homo sapien
aatgtggtcccagattatttctgta

SEQ ID NO: 178678 - DNA, 25 bp, Homo sapien
atttctgtaagaagacactccatgt

SEQ ID NO: 178679 - DNA, 25 bp, Homo sapien
acactccatgttgtcagctttgtac

SEQ ID NO: 178680 - DNA, 25 bp, Homo sapien
gtcagctttgtactctttgttgata

SEQ ID NO: 178681 - DNA, 25 bp, Homo sapien
gggttcatataaacactcactctgt

SEQ ID NO: 178682 - DNA, 25 bp, Homo sapien
taaacactcactctgtgtcttcaac

SEQ ID NO: 178683 - DNA, 25 bp, Homo sapien
gtgtcttcaacagcatctttctttc

SEQ ID NO: 178684 - DNA, 25 bp, Homo sapien
tttccccatctttctattttctgca

SEQ ID NO: 178685 - DNA, 25 bp, Homo sapien
gttccctcatattctgttcttccga

SEQ ID NO: 178686 - DNA, 25 bp, Homo sapien
agggagtgcttatttccctttgtgt

SEQ ID NO: 178687 - DNA, 25 bp, Homo sapien
gtccagctgtggagattgcgaaact

SEQ ID NO: 178688 - DNA, 25 bp, Homo sapien
aactggacaaactgctgaacctggt

SEQ ID NO: 178689 - DNA, 25 bp, Homo sapien
gacaaactgctgaacctggtgaggg

SEQ ID NO: 178690 - DNA, 25 bp, Homo sapien
cagtctctgtcccatcgcttgaata

SEQ ID NO: 178691 - DNA, 25 bp, Homo sapien
gtcccatcgcttgaatacagtactc

SEQ ID NO: 178692 - DNA, 25 bp, Homo sapien
aatacagtactcctagggcttgacc

SEQ ID NO: 178693 - DNA, 25 bp, Homo sapien
tagggcttgaccctggtacccagcc

SEQ ID NO: 178694 - DNA, 25 bp, Homo sapien
atgtgaccccactcctgatcaggtc

SEQ ID NO: 178695 - DNA, 25 bp, Homo sapien
ttcccttcttgttctgttccttaag

SEQ ID NO: 178696 - DNA, 25 bp, Homo sapien
tgttccttaaggtcccagcacctta

SEQ ID NO: 178697 - DNA, 25 bp, Homo sapien
ttacccctctaactttgcacaaata

SEQ ID NO: 178698 - DNA, 25 bp, Homo sapien
ccctctggccgggtaataggcctgg

SEQ ID NO: 178699 - DNA, 25 bp, Homo sapien
atgccggcagctgtcaccatgtgat

SEQ ID NO: 178700 - DNA, 25 bp, Homo sapien
ggcagctgtcaccatgtgatttatt

SEQ ID NO: 178701 - DNA, 25 bp, Homo sapien
gtgatttattcttggatacctggga

SEQ ID NO: 178702 - DNA, 25 bp, Homo sapien
atttattcttggatacctgggaggg

SEQ ID NO: 178703 - DNA, 25 bp, Homo sapien
tctggaaatgtggttcccagggatg

SEQ ID NO: 178704 - DNA, 25 bp, Homo sapien
ggttcccagggatgggcctgtacat

SEQ ID NO: 178705 - DNA, 25 bp, Homo sapien
gcctgtacatagaagccaccggatg

SEQ ID NO: 178706 - DNA, 25 bp, Homo sapien
acatagaagccaccggatggcactt

SEQ ID NO: 178707 - DNA, 25 bp, Homo sapien
acttccccaccggatggacagttat

SEQ ID NO: 178708 - DNA, 25 bp, Homo sapien
tgttgataagtaaccctgtaatttt

SEQ ID NO: 178709 - DNA, 25 bp, Homo sapien
caccgcaccctgccaagttatttta

SEQ ID NO: 178710 - DNA, 25 bp, Homo sapien
ttgactatagtcacctggttgtgtt

SEQ ID NO: 178711 - DNA, 25 bp, Homo sapien
gactatagtcacctggttgtgttat

SEQ ID NO: 178712 - DNA, 25 bp, Homo sapien
atagtcacctggttgtgttatcaaa

SEQ ID NO: 178713 - DNA, 25 bp, Homo sapien
agtcacctggttgtgttatcaaata

SEQ ID NO: 178714 - DNA, 25 bp, Homo sapien
cacctggttgtgttatcaaatagta

SEQ ID NO: 178715 - DNA, 25 bp, Homo sapien
ggttgtgttatcaaatagtatgtct

SEQ ID NO: 178716 - DNA, 25 bp, Homo sapien
tgtggtacccattaaccttccccat

SEQ ID NO: 178717 - DNA, 25 bp, Homo sapien
tccaggaactatccatccactctta

SEQ ID NO: 178718 - DNA, 25 bp, Homo sapien
aggaactatccatccactcttatct

SEQ ID NO: 178719 - DNA, 25 bp, Homo sapien
atccatccactcttatctccatgag

SEQ ID NO: 178720 - DNA, 25 bp, Homo sapien
tgtgagccgccggtgcgcaatcaac

SEQ ID NO: 178721 - DNA, 25 bp, Homo sapien
gtgcgcaatcaacgcccggaacgct

SEQ ID NO: 178722 - DNA, 25 bp, Homo sapien
atcaacgcccggaacgctttgacag

SEQ ID NO: 178723 - DNA, 25 bp, Homo sapien
ggaacgctttgacagccctgttcac

SEQ ID NO: 178724 - DNA, 25 bp, Homo sapien
aacacccagcaaggtgacggctcga

SEQ ID NO: 178725 - DNA, 25 bp, Homo sapien
tcaacccgcctcaaaacctgataga

SEQ ID NO: 178726 - DNA, 25 bp, Homo sapien
aaacctgatagagggacctccctgt

SEQ ID NO: 178727 - DNA, 25 bp, Homo sapien
cctgggtccagatctgctaatgctt

SEQ ID NO: 178728 - DNA, 25 bp, Homo sapien
gctaatgctttttaggagtctgcct

SEQ ID NO: 178729 - DNA, 25 bp, Homo sapien
tgctttttaggagtctgcctggaaa

SEQ ID NO: 178730 - DNA, 25 bp, Homo sapien
ctggaaactttgacatggttcatgt

SEQ ID NO: 178731 - DNA, 25 bp, Homo sapien
catgttgtttggatttcaaaccggg

SEQ ID NO: 178732 - DNA, 25 bp, Homo sapien
cacctaactgcactgaaaccatttc

SEQ ID NO: 178733 - DNA, 25 bp, Homo sapien
tgaaaccatttctaaccacaaccct

SEQ ID NO: 178734 - DNA, 25 bp, Homo sapien
cccttggcccaaggacttggtacag

SEQ ID NO: 178735 - DNA, 25 bp, Homo sapien
gggtctggcttttgccaagaggaac

SEQ ID NO: 178736 - DNA, 25 bp, Homo sapien
gctttttccaccttcttcaaaagag

SEQ ID NO: 178737 - DNA, 25 bp, Homo sapien
aagagacaagggaaggccacctgtt

SEQ ID NO: 178738 - DNA, 25 bp, Homo sapien
aagggaaggccacctgttaaagcag

SEQ ID NO: 178739 - DNA, 25 bp, Homo sapien
aggccacctgttaaagcaggaagca

SEQ ID NO: 178740 - DNA, 25 bp, Homo sapien
aggaagcagcatcaagttgcccctt

SEQ ID NO: 178741 - DNA, 25 bp, Homo sapien
agcagcatcaagttgccccttgggc

SEQ ID NO: 178742 - DNA, 25 bp, Homo sapien
gacatgcggataaggccctgctgcg

SEQ ID NO: 178743 - DNA, 25 bp, Homo sapien
agatggaaggcatttacgctgacat

SEQ ID NO: 178744 - DNA, 25 bp, Homo sapien
aaggcatttacgctgacatccctgt

SEQ ID NO: 178745 - DNA, 25 bp, Homo sapien
gtgcacacgtgcaggagctgtacca

SEQ ID NO: 178746 - DNA, 25 bp, Homo sapien
gagaggtgctgcataccacgtacca

SEQ ID NO: 178747 - DNA, 25 bp, Homo sapien
aggtgctgcataccacgtaccagag

SEQ ID NO: 178748 - DNA, 25 bp, Homo sapien
tgcataccacgtaccagagccagga

SEQ ID NO: 178749 - DNA, 25 bp, Homo sapien
taccacgtaccagagccaggagcgt

SEQ ID NO: 178750 - DNA, 25 bp, Homo sapien
ggagcgtggcacacacagcctggac

SEQ ID NO: 178751 - DNA, 25 bp, Homo sapien
gcgtggcacacacagcctggacatc

SEQ ID NO: 178752 - DNA, 25 bp, Homo sapien
gacatcaagtggtgaagtcaggcca

SEQ ID NO: 178753 - DNA, 25 bp, Homo sapien
gacccgcaaaaaggcagacgaaagc

SEQ ID NO: 178754 - DNA, 25 bp, Homo sapien
agacgaaagcggactgccatcaccg

SEQ ID NO: 178755 - DNA, 25 bp, Homo sapien
acgaaagcggactgccatcaccgga

SEQ ID NO: 178756 - DNA, 25 bp, Homo sapien
ggactgccatcaccggatcccaaac

SEQ ID NO: 178757 - DNA, 25 bp, Homo sapien
gggacagtctggcagggcgcccacg

SEQ ID NO: 178758 - DNA, 25 bp, Homo sapien
cacgcaggcaagcatccggtgcaat

SEQ ID NO: 178759 - DNA, 25 bp, Homo sapien
gcaggcaagcatccggtgcaatgca

SEQ ID NO: 178760 - DNA, 25 bp, Homo sapien
aagcatccggtgcaatgcagcccca

SEQ ID NO: 178761 - DNA, 25 bp, Homo sapien
atccggtgcaatgcagccccaattg

SEQ ID NO: 178762 - DNA, 25 bp, Homo sapien
ccggtgcaatgcagccccaattggg

SEQ ID NO: 178763 - DNA, 25 bp, Homo sapien
gtgcaatgcagccccaattgggtga

SEQ ID NO: 178764 - DNA, 25 bp, Homo sapien
ccagcccagcggacgacagcatgga

SEQ ID NO: 178765 - DNA, 25 bp, Homo sapien
acgacagcatggatcggtgaaacca

SEQ ID NO: 178766 - DNA, 25 bp, Homo sapien
gatcggtgaaaccaggtggcttctt

SEQ ID NO: 178767 - DNA, 25 bp, Homo sapien
ggtgaaaccaggtggcttcttgccc

SEQ ID NO: 178768 - DNA, 25 bp, Homo sapien
aaggccctctcccaagggatcgcag

SEQ ID NO: 178769 - DNA, 25 bp, Homo sapien
tctcccaagggatcgcagggcctag

SEQ ID NO: 178770 - DNA, 25 bp, Homo sapien
atcgcagggcctaggtgcctggacc

SEQ ID NO: 178771 - DNA, 25 bp, Homo sapien
ggacccagggtgtgccagcccgtct

SEQ ID NO: 178772 - DNA, 25 bp, Homo sapien
agcccgtctctgtgcagtccctgga

SEQ ID NO: 178773 - DNA, 25 bp, Homo sapien
ggcgctgagaaaggcaccagctcct

SEQ ID NO: 178774 - DNA, 25 bp, Homo sapien
gctgagaaaggcaccagctccttgg

SEQ ID NO: 178775 - DNA, 25 bp, Homo sapien
gccctgcagtggctttaacagttag

SEQ ID NO: 178776 - DNA, 25 bp, Homo sapien
tgcagtggctttaacagttagtttt

SEQ ID NO: 178777 - DNA, 25 bp, Homo sapien
agttagttttgccaaagcctctcca

SEQ ID NO: 178778 - DNA, 25 bp, Homo sapien
ttagttttgccaaagcctctccact

SEQ ID NO: 178779 - DNA, 25 bp, Homo sapien
accagcaggcggtctctgtcttcag

SEQ ID NO: 178780 - DNA, 25 bp, Homo sapien
cagcaggcggtctctgtcttcaggg

SEQ ID NO: 178781 - DNA, 25 bp, Homo sapien
agggattgtgcctgcgtccctcggg

SEQ ID NO: 178782 - DNA, 25 bp, Homo sapien
ctgcggttcctccttagggccttct

SEQ ID NO: 178783 - DNA, 25 bp, Homo sapien
ttagggccttctccccgacaaggag

SEQ ID NO: 178784 - DNA, 25 bp, Homo sapien
gggcttgcaatcaataaatgccggg

SEQ ID NO: 178785 - DNA, 25 bp, Homo sapien
caatcaataaatgccgggagcttgc

SEQ ID NO: 178786 - DNA, 25 bp, Homo sapien
gagcatgtggtatagcttaagagag

SEQ ID NO: 178787 - DNA, 25 bp, Homo sapien
agcatgtggtatagcttaagagagg

SEQ ID NO: 178788 - DNA, 25 bp, Homo sapien
gcatgtggtatagcttaagagaggt

SEQ ID NO: 178789 - DNA, 25 bp, Homo sapien
catgtggtatagcttaagagaggtg

SEQ ID NO: 178790 - DNA, 25 bp, Homo sapien
tatagcttaagagaggtgggtggcc

SEQ ID NO: 178791 - DNA, 25 bp, Homo sapien
atagcttaagagaggtgggtggcca

SEQ ID NO: 178792 - DNA, 25 bp, Homo sapien
tagcttaagagaggtgggtggccag

SEQ ID NO: 178793 - DNA, 25 bp, Homo sapien
gcttaagagaggtgggtggccaggc

SEQ ID NO: 178794 - DNA, 25 bp, Homo sapien
cttaagagaggtgggtggccaggcg

SEQ ID NO: 178795 - DNA, 25 bp, Homo sapien
taagagaggtgggtggccaggcgcg

SEQ ID NO: 178796 - DNA, 25 bp, Homo sapien
aagagaggtgggtggccaggcgcgg

SEQ ID NO: 178797 - DNA, 25 bp, Homo sapien
gagccaacgcctcaggaatcaggag

SEQ ID NO: 178798 - DNA, 25 bp, Homo sapien
gcctcaggaatcaggaggccagcct

SEQ ID NO: 178799 - DNA, 25 bp, Homo sapien
aggaggccagcctggtaccaaaagg

SEQ ID NO: 178800 - DNA, 25 bp, Homo sapien
ggccagcctggtaccaaaaggagta

SEQ ID NO: 178801 - DNA, 25 bp, Homo sapien
taccaaaaggagtacccagggcctg

SEQ ID NO: 178802 - DNA, 25 bp, Homo sapien
tccagaatggccttggactcacctt

SEQ ID NO: 178803 - DNA, 25 bp, Homo sapien
gagctgctgggcctaaagcccactc

SEQ ID NO: 178804 - DNA, 25 bp, Homo sapien
gggtctcctgctgcttaggtccttt

SEQ ID NO: 178805 - DNA, 25 bp, Homo sapien
cctgctgcttaggtccttttgggac

SEQ ID NO: 178806 - DNA, 25 bp, Homo sapien
ggtttggccattagcatttcatgtc

SEQ ID NO: 178807 - DNA, 25 bp, Homo sapien
ggccattagcatttcatgtctttcc

SEQ ID NO: 178808 - DNA, 25 bp, Homo sapien
aaattggaaggcctcgcagatgaat

SEQ ID NO: 178809 - DNA, 25 bp, Homo sapien
aattggaaggcctcgcagatgaatt

SEQ ID NO: 178810 - DNA, 25 bp, Homo sapien
aatacaatcaacataggcctctcct

SEQ ID NO: 178811 - DNA, 25 bp, Homo sapien
atacaatcaacataggcctctcctc

SEQ ID NO: 178812 - DNA, 25 bp, Homo sapien
ttgaactaagcagtaacagagcctc

SEQ ID NO: 178813 - DNA, 25 bp, Homo sapien
ctaagcagtaacagagcctcagtgg

SEQ ID NO: 178814 - DNA, 25 bp, Homo sapien
cagtaacagagcctcagtgggccta

SEQ ID NO: 178815 - DNA, 25 bp, Homo sapien
gtaacagagcctcagtgggcctaga

SEQ ID NO: 178816 - DNA, 25 bp, Homo sapien
cagagcctcagtgggcctagaagta

SEQ ID NO: 178817 - DNA, 25 bp, Homo sapien
cctcagtgggcctagaagtattggc

SEQ ID NO: 178818 - DNA, 25 bp, Homo sapien
gtccaaacctcatacatctaaattt

SEQ ID NO: 178819 - DNA, 25 bp, Homo sapien
tagtgaatctcaagggatcatccca

SEQ ID NO: 178820 - DNA, 25 bp, Homo sapien
atctcaagggatcatcccatccttg

SEQ ID NO: 178821 - DNA, 25 bp, Homo sapien
atcccatccttgaccacagggacaa

SEQ ID NO: 178822 - DNA, 25 bp, Homo sapien
catccttgaccacagggacaagagg

SEQ ID NO: 178823 - DNA, 25 bp, Homo sapien
agccccaccccacatggagctcagg

SEQ ID NO: 178824 - DNA, 25 bp, Homo sapien
ggttcccaaaagagccctgcggagg

SEQ ID NO: 178825 - DNA, 25 bp, Homo sapien
ccaaaagagccctgcggaggctagg

SEQ ID NO: 178826 - DNA, 25 bp, Homo sapien
ctaggagtggttcttgatgctcacc

SEQ ID NO: 178827 - DNA, 25 bp, Homo sapien
tgaagcccctagacgctgctaggag

SEQ ID NO: 178828 - DNA, 25 bp, Homo sapien
aatacccctccgcttgccgctgcta

SEQ ID NO: 178829 - DNA, 25 bp, Homo sapien
cttgccgctgctagcgcacccctgc

SEQ ID NO: 178830 - DNA, 25 bp, Homo sapien
gcacagatattcgaatgtttccaat

SEQ ID NO: 178831 - DNA, 25 bp, Homo sapien
gtgtgtattgtgtatatacctcaag

SEQ ID NO: 178832 - DNA, 25 bp, Homo sapien
gtgtatatacctcaagttcaagtta

SEQ ID NO: 178833 - DNA, 25 bp, Homo sapien
ggcattgatttatgttccagacaaa

SEQ ID NO: 178834 - DNA, 25 bp, Homo sapien
aatatccttcgttataaccacaatg

SEQ ID NO: 178835 - DNA, 25 bp, Homo sapien
gataagtattggcattagtgttcag

SEQ ID NO: 178836 - DNA, 25 bp, Homo sapien
attagtgttcagtgccattttatac

SEQ ID NO: 178837 - DNA, 25 bp, Homo sapien
gccattttatactttctctctgtgt

SEQ ID NO: 178838 - DNA, 25 bp, Homo sapien
ctctgtattgtactaaccaacctcc

SEQ ID NO: 178839 - DNA, 25 bp, Homo sapien
ttttcttcttgttccattaagtcag

SEQ ID NO: 178840 - DNA, 25 bp, Homo sapien
agtcagaatacaaatcagcacagat

SEQ ID NO: 178841 - DNA, 25 bp, Homo sapien
gaggaagaaccatgtaccagcacag

SEQ ID NO: 178842 - DNA, 25 bp, Homo sapien
gaaccatgtaccagcacagcaattg

SEQ ID NO: 178843 - DNA, 25 bp, Homo sapien
agcacagcaattgctagtccagaga

SEQ ID NO: 178844 - DNA, 25 bp, Homo sapien
ggaattacgattatatcacccggac

SEQ ID NO: 178845 - DNA, 25 bp, Homo sapien
ttacgattatatcacccggacacac

SEQ ID NO: 178846 - DNA, 25 bp, Homo sapien
acccggacacacatcatgcttaaga

SEQ ID NO: 178847 - DNA, 25 bp, Homo sapien
caactgggagcataccagggatgct

SEQ ID NO: 178848 - DNA, 25 bp, Homo sapien
tcatctataacttcaaacctatttg

SEQ ID NO: 178849 - DNA, 25 bp, Homo sapien
atttgtcttgacatcaactctgtta

SEQ ID NO: 178850 - DNA, 25 bp, Homo sapien
aactctgttaaccttatgtcatcat

SEQ ID NO: 178851 - DNA, 25 bp, Homo sapien
atgtcatcatttcttagagtctttg

SEQ ID NO: 178852 - DNA, 25 bp, Homo sapien
tgctcaaggattggagaggagacaa

SEQ ID NO: 178853 - DNA, 25 bp, Homo sapien
gaggagacaaaaccaggagcagcac

SEQ ID NO: 178854 - DNA, 25 bp, Homo sapien
aggagacaaaaccaggagcagcaca

SEQ ID NO: 178855 - DNA, 25 bp, Homo sapien
gagacaaaaccaggagcagcacagt

SEQ ID NO: 178856 - DNA, 25 bp, Homo sapien
agacaaaaccaggagcagcacagtg

SEQ ID NO: 178857 - DNA, 25 bp, Homo sapien
gacaaaaccaggagcagcacagtgg

SEQ ID NO: 178858 - DNA, 25 bp, Homo sapien
acaaaaccaggagcagcacagtggg

SEQ ID NO: 178859 - DNA, 25 bp, Homo sapien
agcacagtggggacatctcccgtct

SEQ ID NO: 178860 - DNA, 25 bp, Homo sapien
gtggggacatctcccgtctcaacag

SEQ ID NO: 178861 - DNA, 25 bp, Homo sapien
aaggatgggccagcttgcaggggtt

SEQ ID NO: 178862 - DNA, 25 bp, Homo sapien
gggagggagacatccagcttgggct

SEQ ID NO: 178863 - DNA, 25 bp, Homo sapien
cacagggatcctgagacgtctggat

SEQ ID NO: 178864 - DNA, 25 bp, Homo sapien
gacgtctggatacctcgttaggatc

SEQ ID NO: 178865 - DNA, 25 bp, Homo sapien
gatacctcgttaggatcagctcgca

SEQ ID NO: 178866 - DNA, 25 bp, Homo sapien
ggatcagctcgcacagaggttgtct

SEQ ID NO: 178867 - DNA, 25 bp, Homo sapien
cacagaggttgtctgcaagcagtgt

SEQ ID NO: 178868 - DNA, 25 bp, Homo sapien
agcagtgtgaagctcatctaggtca

SEQ ID NO: 178869 - DNA, 25 bp, Homo sapien
ctaggtcacgtgtttcctgatggac

SEQ ID NO: 178870 - DNA, 25 bp, Homo sapien
tcctgatggacctgggcccaatggt

SEQ ID NO: 178871 - DNA, 25 bp, Homo sapien
gaggttttgcatcaacagtgtggct

SEQ ID NO: 178872 - DNA, 25 bp, Homo sapien
caacagtgtggctttgaagttcaaa

SEQ ID NO: 178873 - DNA, 25 bp, Homo sapien
ggaaacactgaccatcttcaagagt

SEQ ID NO: 178874 - DNA, 25 bp, Homo sapien
ggattatccataaaatgacccttta

SEQ ID NO: 178875 - DNA, 25 bp, Homo sapien
aaaatgaccctttacatatccctgc

SEQ ID NO: 178876 - DNA, 25 bp, Homo sapien
ttacatatccctgcagagttggcct

SEQ ID NO: 178877 - DNA, 25 bp, Homo sapien
agttggccttttgcccgtggtgtgc

SEQ ID NO: 178878 - DNA, 25 bp, Homo sapien
ttgcccgtggtgtgctagtagcttt

SEQ ID NO: 178879 - DNA, 25 bp, Homo sapien
gtgctagtagctttggctgatgcta

SEQ ID NO: 178880 - DNA, 25 bp, Homo sapien
gatgctaagctttcctggtatgcgc

SEQ ID NO: 178881 - DNA, 25 bp, Homo sapien
tggtatgcgccctatttttaagaag

SEQ ID NO: 178882 - DNA, 25 bp, Homo sapien
taatgactaggaaaccctctgtaat

SEQ ID NO: 178883 - DNA, 25 bp, Homo sapien
taggaaaccctctgtaatttacaag

SEQ ID NO: 178884 - DNA, 25 bp, Homo sapien
gagtcagaaatcagtttggcaaagt

SEQ ID NO: 178885 - DNA, 25 bp, Homo sapien
ggcaaaggctggctcatgcgcttct

SEQ ID NO: 178886 - DNA, 25 bp, Homo sapien
ggaatggagctgcttgccagacttc

SEQ ID NO: 178887 - DNA, 25 bp, Homo sapien
agacttccacccacactgtgtactt

SEQ ID NO: 178888 - DNA, 25 bp, Homo sapien
cacactgtgtacttggctgaaagca

SEQ ID NO: 178889 - DNA, 25 bp, Homo sapien
ggaccttcaaaacactgaagtgcca

SEQ ID NO: 178890 - DNA, 25 bp, Homo sapien
gaagtgccaattgcaacaacagcta

SEQ ID NO: 178891 - DNA, 25 bp, Homo sapien
taaagtaattgagcttttaccagaa

SEQ ID NO: 178892 - DNA, 25 bp, Homo sapien
gcaatatggtctagccttacacctc

SEQ ID NO: 178893 - DNA, 25 bp, Homo sapien
agctgtggaagccatatctcttcct

SEQ ID NO: 178894 - DNA, 25 bp, Homo sapien
aagccatatctcttccttctttatg

SEQ ID NO: 178895 - DNA, 25 bp, Homo sapien
tccttctttatgacacttacctact

SEQ ID NO: 178896 - DNA, 25 bp, Homo sapien
ggagctgaggcgttaccgctgtgtt

SEQ ID NO: 178897 - DNA, 25 bp, Homo sapien
gggcagcttggtgtcaggtgcagca

SEQ ID NO: 178898 - DNA, 25 bp, Homo sapien
ggtgcagcagggtcctccttgtctg

SEQ ID NO: 178899 - DNA, 25 bp, Homo sapien
tccttgtctggttctgcacccgtct

SEQ ID NO: 178900 - DNA, 25 bp, Homo sapien
cagccatttgctgggatgaccgtgc

SEQ ID NO: 178901 - DNA, 25 bp, Homo sapien
atttgctgggatgaccgtgcaggcc

SEQ ID NO: 178902 - DNA, 25 bp, Homo sapien
tccaagcctgagcatccacacaatt

SEQ ID NO: 178903 - DNA, 25 bp, Homo sapien
acacaattccagtgggccctcggtg

SEQ ID NO: 178904 - DNA, 25 bp, Homo sapien
ctcggtgcctgctgtgaactgcttt

SEQ ID NO: 178905 - DNA, 25 bp, Homo sapien
gtgaactgctttccctcggaatgtt

SEQ ID NO: 178906 - DNA, 25 bp, Homo sapien
ttccctcggaatgtttccgtaacag

SEQ ID NO: 178907 - DNA, 25 bp, Homo sapien
gtattggctgagtccattagctctc

SEQ ID NO: 178908 - DNA, 25 bp, Homo sapien
agtccattagctctccagttggttt

SEQ ID NO: 178909 - DNA, 25 bp, Homo sapien
cagttggtttaatgattgggtttat

SEQ ID NO: 178910 - DNA, 25 bp, Homo sapien
ggaactgtacacttgtttggtgcta

SEQ ID NO: 178911 - DNA, 25 bp, Homo sapien
cacttgtttggtgctaattaataca

SEQ ID NO: 178912 - DNA, 25 bp, Homo sapien
aagtgtgcatgattgtatatggaac

SEQ ID NO: 178913 - DNA, 25 bp, Homo sapien
gaacaaatactaaggtcccagggtg

SEQ ID NO: 178914 - DNA, 25 bp, Homo sapien
gatatggagttcttacttgacttga

SEQ ID NO: 178915 - DNA, 25 bp, Homo sapien
ttgacttgaatgtgcacctgagggt

SEQ ID NO: 178916 - DNA, 25 bp, Homo sapien
gtgcacctgagggtgctttgtgtaa

SEQ ID NO: 178917 - DNA, 25 bp, Homo sapien
gtacactacagcatcttatattttt

SEQ ID NO: 178918 - DNA, 25 bp, Homo sapien
ctcacatatctcgacagctgttact

SEQ ID NO: 178919 - DNA, 25 bp, Homo sapien
atatctcgacagctgttactgggac

SEQ ID NO: 178920 - DNA, 25 bp, Homo sapien
atctcgacagctgttactgggacca

SEQ ID NO: 178921 - DNA, 25 bp, Homo sapien
tcgacagctgttactgggaccacaa

SEQ ID NO: 178922 - DNA, 25 bp, Homo sapien
acagctgttactgggaccacaagga

SEQ ID NO: 178923 - DNA, 25 bp, Homo sapien
gctgttactgggaccacaaggaggc

SEQ ID NO: 178924 - DNA, 25 bp, Homo sapien
acaaggaggccccttactcagatat

SEQ ID NO: 178925 - DNA, 25 bp, Homo sapien
aaggaggccccttactcagatattg

SEQ ID NO: 178926 - DNA, 25 bp, Homo sapien
ggaggccccttactcagatattgag

SEQ ID NO: 178927 - DNA, 25 bp, Homo sapien
ggccccttactcagatattgaggac

SEQ ID NO: 178928 - DNA, 25 bp, Homo sapien
ctcagatattgaggaccacgtggag

SEQ ID NO: 178929 - DNA, 25 bp, Homo sapien
gaaatttgatgactctgtgatactt

SEQ ID NO: 178930 - DNA, 25 bp, Homo sapien
aatttgatgactctgtgatacttag

SEQ ID NO: 178931 - DNA, 25 bp, Homo sapien
ttgatgactctgtgatacttagacc

SEQ ID NO: 178932 - DNA, 25 bp, Homo sapien
gatgactctgtgatacttagaccaa

SEQ ID NO: 178933 - DNA, 25 bp, Homo sapien
atgactctgtgatacttagaccaag

SEQ ID NO: 178934 - DNA, 25 bp, Homo sapien
gactctgtgatacttagaccaagca

SEQ ID NO: 178935 - DNA, 25 bp, Homo sapien
ctctgtgatacttagaccaagcaag

SEQ ID NO: 178936 - DNA, 25 bp, Homo sapien
ctgtgatacttagaccaagcaagag

SEQ ID NO: 178937 - DNA, 25 bp, Homo sapien
gtgatacttagaccaagcaagagtg

SEQ ID NO: 178938 - DNA, 25 bp, Homo sapien
gcaagagtgtaaaactccgaagtcc

SEQ ID NO: 178939 - DNA, 25 bp, Homo sapien
gtaaaactccgaagtcctaaatcag

SEQ ID NO: 178940 - DNA, 25 bp, Homo sapien
atctggcatcctcctaaggaccggg

SEQ ID NO: 178941 - DNA, 25 bp, Homo sapien
taagaataggtgttcctttgtgctc

SEQ ID NO: 178942 - DNA, 25 bp, Homo sapien
ttgtgctcataaaacagaatgcggc

SEQ ID NO: 178943 - DNA, 25 bp, Homo sapien
agaatgcggcgatggttgctttagc

SEQ ID NO: 178944 - DNA, 25 bp, Homo sapien
gatggttgctttagccgtttctcac

SEQ ID NO: 178945 - DNA, 25 bp, Homo sapien
cgtttctcaccatgcaatgcagagg

SEQ ID NO: 178946 - DNA, 25 bp, Homo sapien
gggacaaagggctgtgctacacttc

SEQ ID NO: 178947 - DNA, 25 bp, Homo sapien
ctacacttcccagttacattctgaa

SEQ ID NO: 178948 - DNA, 25 bp, Homo sapien
acaaaaatgttgctgcttgaggcat

SEQ ID NO: 178949 - DNA, 25 bp, Homo sapien
ataggctttaaatgatcagggattc

SEQ ID NO: 178950 - DNA, 25 bp, Homo sapien
gatcagggattcaggttcataatga

SEQ ID NO: 178951 - DNA, 25 bp, Homo sapien
catgttgtttggatttcaaaccggg

SEQ ID NO: 178952 - DNA, 25 bp, Homo sapien
ccacctaactgcactgaaaccattt

SEQ ID NO: 178953 - DNA, 25 bp, Homo sapien
ctaactgcactgaaaccatttctaa

SEQ ID NO: 178954 - DNA, 25 bp, Homo sapien
cccttggcccaaggacttggtacag

SEQ ID NO: 178955 - DNA, 25 bp, Homo sapien
gctttttccaccttcttcaaaagag

SEQ ID NO: 178956 - DNA, 25 bp, Homo sapien
ttccaccttcttcaaaagagacaag

SEQ ID NO: 178957 - DNA, 25 bp, Homo sapien
aagagacaagggaaggccacctgtt

SEQ ID NO: 178958 - DNA, 25 bp, Homo sapien
aagggaaggccacctgttaaagcag

SEQ ID NO: 178959 - DNA, 25 bp, Homo sapien
aggccacctgttaaagcaggaagca

SEQ ID NO: 178960 - DNA, 25 bp, Homo sapien
aggaagcagcatcaagttgcccctt

SEQ ID NO: 178961 - DNA, 25 bp, Homo sapien
agcagcatcaagttgccccttgggc

SEQ ID NO: 178962 - DNA, 25 bp, Homo sapien
ggacatcccaaaggtataccctgct

SEQ ID NO: 178963 - DNA, 25 bp, Homo sapien
atcccaaaggtataccctgctctgc

SEQ ID NO: 178964 - DNA, 25 bp, Homo sapien
atccagccagtgagtggcacccaat

SEQ ID NO: 178965 - DNA, 25 bp, Homo sapien
tgagtggcacccaatgcctctcagg

SEQ ID NO: 178966 - DNA, 25 bp, Homo sapien
aggatgagaccagtaaatgccggag

SEQ ID NO: 178967 - DNA, 25 bp, Homo sapien
gggcagctgtggagccccacgcaca

SEQ ID NO: 178968 - DNA, 25 bp, Homo sapien
acaggccagtctcgcttggctctca

SEQ ID NO: 178969 - DNA, 25 bp, Homo sapien
aagaagtgcctttagctctggatcc

SEQ ID NO: 178970 - DNA, 25 bp, Homo sapien
tttagctctggatcccaaccgtttg

SEQ ID NO: 178971 - DNA, 25 bp, Homo sapien
gatcccaaccgtttggcacagcttt

SEQ ID NO: 178972 - DNA, 25 bp, Homo sapien
gcccctctggaattgtccttattaa

SEQ ID NO: 178973 - DNA, 25 bp, Homo sapien
acaccgggaaactgtgctggttctt

SEQ ID NO: 178974 - DNA, 25 bp, Homo sapien
aactgtgctggttcttggacgaggc

SEQ ID NO: 178975 - DNA, 25 bp, Homo sapien
tgaccgtgcccttcgagaagcattc

SEQ ID NO: 178976 - DNA, 25 bp, Homo sapien
gcccttcgagaagcattccactttg

SEQ ID NO: 178977 - DNA, 25 bp, Homo sapien
gaagcattccactttgtagctggcc

SEQ ID NO: 178978 - DNA, 25 bp, Homo sapien
attccactttgtagctggccagagg

SEQ ID NO: 178979 - DNA, 25 bp, Homo sapien
tctcctttcaaaaagccacgtcgtg

SEQ ID NO: 178980 - DNA, 25 bp, Homo sapien
ctttcaaaaagccacgtcgtgctgc

SEQ ID NO: 178981 - DNA, 25 bp, Homo sapien
aaaagccacgtcgtgctgctgctgg

SEQ ID NO: 178982 - DNA, 25 bp, Homo sapien
gctgctggaagccaacagcctccgg

SEQ ID NO: 178983 - DNA, 25 bp, Homo sapien
ggctcaacacacaggctgtggctct

SEQ ID NO: 178984 - DNA, 25 bp, Homo sapien
agtttcccagctctggcccggtgac

SEQ ID NO: 178985 - DNA, 25 bp, Homo sapien
acagccctaacatttgccaagtctt

SEQ ID NO: 178986 - DNA, 25 bp, Homo sapien
taacatttgccaagtcttcctgggc

SEQ ID NO: 178987 - DNA, 25 bp, Homo sapien
gcaggagcgcaagcaagcactatat

SEQ ID NO: 178988 - DNA, 25 bp, Homo sapien
gcaagcactatatgaatacgcaaga

SEQ ID NO: 178989 - DNA, 25 bp, Homo sapien
gattcacagagagacgagcccagga

SEQ ID NO: 178990 - DNA, 25 bp, Homo sapien
agcccaggaggctgactgagctcaa

SEQ ID NO: 178991 - DNA, 25 bp, Homo sapien
gaggctgactgagctcaaaggaaca

SEQ ID NO: 178992 - DNA, 25 bp, Homo sapien
agctcaaaggaacaggatggcaccc

SEQ ID NO: 178993 - DNA, 25 bp, Homo sapien
acccaactcacaacaggctggatgg

SEQ ID NO: 178994 - DNA, 25 bp, Homo sapien
gaaggatgaggctcccccaatgtca

SEQ ID NO: 178995 - DNA, 25 bp, Homo sapien
gtggaaactgttaaatgcataacct

SEQ ID NO: 178996 - DNA, 25 bp, Homo sapien
aatgcataacctaattttcctggga

SEQ ID NO: 178997 - DNA, 25 bp, Homo sapien
aacctaattttcctgggactgccat

SEQ ID NO: 178998 - DNA, 25 bp, Homo sapien
tcctgggactgccatattttctttt

SEQ ID NO: 178999 - DNA, 25 bp, Homo sapien
ccttttggtgcatggaactgtggtt

SEQ ID NO: 179000 - DNA, 25 bp, Homo sapien
ggaactgtggttgccaaggtattta

SEQ ID NO: 179001 - DNA, 25 bp, Homo sapien
tttcctgcctccttctctttgattt

SEQ ID NO: 179002 - DNA, 25 bp, Homo sapien
caggtttattcttttagcaggtgta

SEQ ID NO: 179003 - DNA, 25 bp, Homo sapien
ggtgtagttaaacgacctccactga

SEQ ID NO: 179004 - DNA, 25 bp, Homo sapien
taaacgacctccactgaactgggtt

SEQ ID NO: 179005 - DNA, 25 bp, Homo sapien
ccactgaactgggtttgacctctgt

SEQ ID NO: 179006 - DNA, 25 bp, Homo sapien
cattgttcctcaaacttggctacgt

SEQ ID NO: 179007 - DNA, 25 bp, Homo sapien
cttggctacgtattggaatcaccta

SEQ ID NO: 179008 - DNA, 25 bp, Homo sapien
aaaacatggatgtctgggtcccgcc

SEQ ID NO: 179009 - DNA, 25 bp, Homo sapien
gtcccgccccatagagaatgactta

SEQ ID NO: 179010 - DNA, 25 bp, Homo sapien
atgatttttagatttcccagttgga

SEQ ID NO: 179011 - DNA, 25 bp, Homo sapien
ttcccagttggaacttgtgcagcaa

SEQ ID NO: 179012 - DNA, 25 bp, Homo sapien
aagtttgggagctactgatggacat

SEQ ID NO: 179013 - DNA, 25 bp, Homo sapien
taggctaataggcttaacccaggaa

SEQ ID NO: 179014 - DNA, 25 bp, Homo sapien
gaaatcctaagttccttgaatatcc

SEQ ID NO: 179015 - DNA, 25 bp, Homo sapien
ccagtttgcatttgggactcctcat

SEQ ID NO: 179016 - DNA, 25 bp, Homo sapien
ggactcctcatcatatacttggtat

SEQ ID NO: 179017 - DNA, 25 bp, Homo sapien
aaggatgaactaaggctgctggtgc

SEQ ID NO: 179018 - DNA, 25 bp, Homo sapien
aactaaggctgctggtgccctgagc

SEQ ID NO: 179019 - DNA, 25 bp, Homo sapien
gctggtgccctgagcaactgataat

SEQ ID NO: 179020 - DNA, 25 bp, Homo sapien
gtgccctgagcaactgataatgcaa

SEQ ID NO: 179021 - DNA, 25 bp, Homo sapien
tggacaaagtgtctgttttctactc

SEQ ID NO: 179022 - DNA, 25 bp, Homo sapien
tgttttctactctagcctgttcata

SEQ ID NO: 179023 - DNA, 25 bp, Homo sapien
ttctactctagcctgttcatatgga

SEQ ID NO: 179024 - DNA, 25 bp, Homo sapien
cctgttcatatggaccaaatttcaa

SEQ ID NO: 179025 - DNA, 25 bp, Homo sapien
caaatttcaacaaggaactcaagga

SEQ ID NO: 179026 - DNA, 25 bp, Homo sapien
ggaactcaaggaaaatttgtacctg

SEQ ID NO: 179027 - DNA, 25 bp, Homo sapien
ttttccactgtttctgtctggtttt

SEQ ID NO: 179028 - DNA, 25 bp, Homo sapien
ttcctgtgcgactggatcttgctaa

SEQ ID NO: 179029 - DNA, 25 bp, Homo sapien
gactggatcttgctaacattcatga

SEQ ID NO: 179030 - DNA, 25 bp, Homo sapien
gaacaaaaacaaggtctacagccat

SEQ ID NO: 179031 - DNA, 25 bp, Homo sapien
aggtctacagccataagaaatttga

SEQ ID NO: 179032 - DNA, 25 bp, Homo sapien
accccaaaggtttggctcaactctg

SEQ ID NO: 179033 - DNA, 25 bp, Homo sapien
tcatcaaggcctacgggatccgcat

SEQ ID NO: 179034 - DNA, 25 bp, Homo sapien
ggatccgcattgacgtcattgtgca

SEQ ID NO: 179035 - DNA, 25 bp, Homo sapien
tcattgtgcatggacaggccgggaa

SEQ ID NO: 179036 - DNA, 25 bp, Homo sapien
aggccgggaagttcagcctgattcc

SEQ ID NO: 179037 - DNA, 25 bp, Homo sapien
agttcagcctgattcccaccattat

SEQ ID NO: 179038 - DNA, 25 bp, Homo sapien
ccaccattattaatctggccacagc

SEQ ID NO: 179039 - DNA, 25 bp, Homo sapien
acttcacagccaacggctatgacaa

SEQ ID NO: 179040 - DNA, 25 bp, Homo sapien
aacggctatgacaaaaccactccct

SEQ ID NO: 179041 - DNA, 25 bp, Homo sapien
aaaaccactccctggccaatggcat

SEQ ID NO: 179042 - DNA, 25 bp, Homo sapien
caatggcatcactcttcaggctggg

SEQ ID NO: 179043 - DNA, 25 bp, Homo sapien
gtgtgctccctgaccaatgacagag

SEQ ID NO: 179044 - DNA, 25 bp, Homo sapien
agagcctgaaaatgccctgtcagcc

SEQ ID NO: 179045 - DNA, 25 bp, Homo sapien
aaatgccctgtcagccaatggcagc

SEQ ID NO: 179046 - DNA, 25 bp, Homo sapien
actcccctgggccaatgatgttgcg

SEQ ID NO: 179047 - DNA, 25 bp, Homo sapien
tgatgttgcgtctaataccctttgt

SEQ ID NO: 179048 - DNA, 25 bp, Homo sapien
tctatgcgtgcccattgcagagaag

SEQ ID NO: 179049 - DNA, 25 bp, Homo sapien
ttgcatctgaataggcctaccctca

SEQ ID NO: 179050 - DNA, 25 bp, Homo sapien
acattcatcacattgtcctacatcc

SEQ ID NO: 179051 - DNA, 25 bp, Homo sapien
gtcctacatccagatatttatcaca

SEQ ID NO: 179052 - DNA, 25 bp, Homo sapien
ttatcacagtttttcgtttgcccca

SEQ ID NO: 179053 - DNA, 25 bp, Homo sapien
tttcgtttgccccagaaggaggcta

SEQ ID NO: 179054 - DNA, 25 bp, Homo sapien
ggtttaaagcattcaatacctgcat

SEQ ID NO: 179055 - DNA, 25 bp, Homo sapien
atacctgcattgctcacatctgtgt

SEQ ID NO: 179056 - DNA, 25 bp, Homo sapien
tcacacataggtttgggtctcacat

SEQ ID NO: 179057 - DNA, 25 bp, Homo sapien
ttctagcatttacttgctggtccct

SEQ ID NO: 179058 - DNA, 25 bp, Homo sapien
tccatttctcaatccacttgtctat

SEQ ID NO: 179059 - DNA, 25 bp, Homo sapien
aatccacttgtctatggtgcaaaga

SEQ ID NO: 179060 - DNA, 25 bp, Homo sapien
agaccacacagattcgcattcatgt

SEQ ID NO: 179061 - DNA, 25 bp, Homo sapien
ggctacggcgacatggtcccgcgca

SEQ ID NO: 179062 - DNA, 25 bp, Homo sapien
aggtggtggcgctcagcagcatcct

SEQ ID NO: 179063 - DNA, 25 bp, Homo sapien
gtggcgctcagcagcatcctcagcg

SEQ ID NO: 179064 - DNA, 25 bp, Homo sapien
atcctcagcggcatcctgctcatgg

SEQ ID NO: 179065 - DNA, 25 bp, Homo sapien
gcgctcctactccgagctcaaggag

SEQ ID NO: 179066 - DNA, 25 bp, Homo sapien
agccggccctgcaggaggacagcac

SEQ ID NO: 179067 - DNA, 25 bp, Homo sapien
tgcaggaggacagcacgcactcggc

SEQ ID NO: 179068 - DNA, 25 bp, Homo sapien
gaggacagcacgcactcggccacag

SEQ ID NO: 179069 - DNA, 25 bp, Homo sapien
cagccaccgaggacagctcgcaggg

SEQ ID NO: 179070 - DNA, 25 bp, Homo sapien
aggacagctcgcagggccccgacag

SEQ ID NO: 179071 - DNA, 25 bp, Homo sapien
gacgactccgcggatgcgctgtggg

SEQ ID NO: 179072 - DNA, 25 bp, Homo sapien
ccgtgaccctgaggtcgtcaatgat

SEQ ID NO: 179073 - DNA, 25 bp, Homo sapien
ggtcgtcaatgatgagtcctctctg

SEQ ID NO: 179074 - DNA, 25 bp, Homo sapien
tgatgagtcctctctggtcagacat

SEQ ID NO: 179075 - DNA, 25 bp, Homo sapien
ctctctggtcagacatcgctggaaa

SEQ ID NO: 179076 - DNA, 25 bp, Homo sapien
aatgaatagccaggcctgacctcaa

SEQ ID NO: 179077 - DNA, 25 bp, Homo sapien
tgacctcaagcaaccatgaactcag

SEQ ID NO: 179078 - DNA, 25 bp, Homo sapien
ccgggatcgatggtggcgctttctc

SEQ ID NO: 179079 - DNA, 25 bp, Homo sapien
acccgtcttcaatctctgttctgct

SEQ ID NO: 179080 - DNA, 25 bp, Homo sapien
gatgccttctagattcactgtcttt

SEQ ID NO: 179081 - DNA, 25 bp, Homo sapien
cactgtcttttgattcttgattttc

SEQ ID NO: 179082 - DNA, 25 bp, Homo sapien
ttttcaagctttcaaatcctcccta

SEQ ID NO: 179083 - DNA, 25 bp, Homo sapien
gaggaatggacccaggctgtcattc

SEQ ID NO: 179084 - DNA, 25 bp, Homo sapien
ggacccaggctgtcattccaggaag

SEQ ID NO: 179085 - DNA, 25 bp, Homo sapien
ggaagaactgcagagccttcagcct

SEQ ID NO: 179086 - DNA, 25 bp, Homo sapien
tcagcctctccaaacatgtaggagg

SEQ ID NO: 179087 - DNA, 25 bp, Homo sapien
gaaatcgctgtgttgttaatgcaga

SEQ ID NO: 179088 - DNA, 25 bp, Homo sapien
gaacaaactctgtttagttgcaggg

SEQ ID NO: 179089 - DNA, 25 bp, Homo sapien
tgggatataccccaaagtcctctac

SEQ ID NO: 179090 - DNA, 25 bp, Homo sapien
ttttatggccctttccctagatata

SEQ ID NO: 179091 - DNA, 25 bp, Homo sapien
cctagatatactgcgggatctctcc

SEQ ID NO: 179092 - DNA, 25 bp, Homo sapien
tgcgggatctctccttaggataaag

SEQ ID NO: 179093 - DNA, 25 bp, Homo sapien
aagagttgctgttgaagttgtatat

SEQ ID NO: 179094 - DNA, 25 bp, Homo sapien
atcatcgagcacctgaacacgtccg

SEQ ID NO: 179095 - DNA, 25 bp, Homo sapien
acaccagtgacccactgcagcagat

SEQ ID NO: 179096 - DNA, 25 bp, Homo sapien
gacccactgcagcagatctgcaaga

SEQ ID NO: 179097 - DNA, 25 bp, Homo sapien
atggactcactgcagtggatcgacc

SEQ ID NO: 179098 - DNA, 25 bp, Homo sapien
agtggatcgaccagaactcggccct

SEQ ID NO: 179099 - DNA, 25 bp, Homo sapien
agcttccggatcacctttgactgag

SEQ ID NO: 179100 - DNA, 25 bp, Homo sapien
ggatcacctttgactgagcgacagc

SEQ ID NO: 179101 - DNA, 25 bp, Homo sapien
tcacctttgactgagcgacagcagc

SEQ ID NO: 179102 - DNA, 25 bp, Homo sapien
ccgcaggtccctagggagttcatga

SEQ ID NO: 179103 - DNA, 25 bp, Homo sapien
gggaatgcgccctgttgtctgtagt

SEQ ID NO: 179104 - DNA, 25 bp, Homo sapien
atgcgccctgttgtctgtagtttgg

SEQ ID NO: 179105 - DNA, 25 bp, Homo sapien
tgaccgcgacattgaccgctacacg

SEQ ID NO: 179106 - DNA, 25 bp, Homo sapien
cgacattgaccgctacacggaagct

SEQ ID NO: 179107 - DNA, 25 bp, Homo sapien
gggctgcacctatagcctatggctt

SEQ ID NO: 179108 - DNA, 25 bp, Homo sapien
gcacctatagcctatggcttgcctg

SEQ ID NO: 179109 - DNA, 25 bp, Homo sapien
cctatagcctatggcttgcctgtct

SEQ ID NO: 179110 - DNA, 25 bp, Homo sapien
tgtctctctgcggtaaccccatgga

SEQ ID NO: 179111 - DNA, 25 bp, Homo sapien
tgcggtaaccccatggagctgtctt

SEQ ID NO: 179112 - DNA, 25 bp, Homo sapien
gtaaccccatggagctgtcttattg

SEQ ID NO: 179113 - DNA, 25 bp, Homo sapien
aaccccatggagctgtcttattgat

SEQ ID NO: 179114 - DNA, 25 bp, Homo sapien
ccatggagctgtcttattgatgcta

SEQ ID NO: 179115 - DNA, 25 bp, Homo sapien
gctgtcttattgatgctagaagcct

SEQ ID NO: 179116 - DNA, 25 bp, Homo sapien
aggccatgcatgcccagtcggccga

SEQ ID NO: 179117 - DNA, 25 bp, Homo sapien
ggtggccacctaccaagtcaggaag

SEQ ID NO: 179118 - DNA, 25 bp, Homo sapien
gtggccacctaccaagtcaggaaga

SEQ ID NO: 179119 - DNA, 25 bp, Homo sapien
ggccacctaccaagtcaggaagatt

SEQ ID NO: 179120 - DNA, 25 bp, Homo sapien
taccaagtcaggaagattattacag

SEQ ID NO: 179121 - DNA, 25 bp, Homo sapien
aggaagattattacagtcgactgaa

SEQ ID NO: 179122 - DNA, 25 bp, Homo sapien
ttacagtcgactgaagaaagaaggt

SEQ ID NO: 179123 - DNA, 25 bp, Homo sapien
gaaagaaggtgacaagcagttataa

SEQ ID NO: 179124 - DNA, 25 bp, Homo sapien
ggtgacaagcagttataagttattt

SEQ ID NO: 179125 - DNA, 25 bp, Homo sapien
tatttatttgttaacgctggctgtg

SEQ ID NO: 179126 - DNA, 25 bp, Homo sapien
tggctgtggaaaccccagttcttgg

SEQ ID NO: 179127 - DNA, 25 bp, Homo sapien
ttgcacatttatggtactacgagtt

SEQ ID NO: 179128 - DNA, 25 bp, Homo sapien
gtactacgagtttataaagtccaag

SEQ ID NO: 179129 - DNA, 25 bp, Homo sapien
aaatcacctgatgtagaagaagact

SEQ ID NO: 179130 - DNA, 25 bp, Homo sapien
actgtgatgagctcgtctgtggaac

SEQ ID NO: 179131 - DNA, 25 bp, Homo sapien
tgagctcgtctgtggaacatcacaa

SEQ ID NO: 179132 - DNA, 25 bp, Homo sapien
gtggaacatcacaagtatcgaaaat

SEQ ID NO: 179133 - DNA, 25 bp, Homo sapien
atggatgtttcctttctaatccaca

SEQ ID NO: 179134 - DNA, 25 bp, Homo sapien
tgtttcttttgaaatcacgtctaaa

SEQ ID NO: 179135 - DNA, 25 bp, Homo sapien
atatgactcagactatagccgttgt

SEQ ID NO: 179136 - DNA, 25 bp, Homo sapien
gactatagccgttgtttcccaaact

SEQ ID NO: 179137 - DNA, 25 bp, Homo sapien
acttcagtctctttagtactacttg

SEQ ID NO: 179138 - DNA, 25 bp, Homo sapien
ggcacatacaaaacctacattctct

SEQ ID NO: 179139 - DNA, 25 bp, Homo sapien
aaacctacattctctagttgggagt

SEQ ID NO: 179140 - DNA, 25 bp, Homo sapien
cattctctagttgggagtggatttt

SEQ ID NO: 179141 - DNA, 25 bp, Homo sapien
ttttttgtatgatgcactgagatgt

SEQ ID NO: 179142 - DNA, 25 bp, Homo sapien
gcactgagatgtgtactttctaaca

SEQ ID NO: 179143 - DNA, 25 bp, Homo sapien
aacgtggtagcattattcagaaaac

SEQ ID NO: 179144 - DNA, 25 bp, Homo sapien
attatactttcaaatgacacatagt

SEQ ID NO: 179145 - DNA, 25 bp, Homo sapien
gaatggaataatacatgttgcatat

SEQ ID NO: 179146 - DNA, 25 bp, Homo sapien
gatgtaatggtttgtcagctgtcac

SEQ ID NO: 179147 - DNA, 25 bp, Homo sapien
atggtttgtcagctgtcactgttgt

SEQ ID NO: 179148 - DNA, 25 bp, Homo sapien
tcagctgtcactgttgttttcttgt

SEQ ID NO: 179149 - DNA, 25 bp, Homo sapien
atcgtgatctcctactgcctcattg

SEQ ID NO: 179150 - DNA, 25 bp, Homo sapien
tcattgctcaggcagtgctgaaaat

SEQ ID NO: 179151 - DNA, 25 bp, Homo sapien
gtgctgaaaatccactctgcagagg

SEQ ID NO: 179152 - DNA, 25 bp, Homo sapien
aaaggcgttcaatacgtgcctctcc

SEQ ID NO: 179153 - DNA, 25 bp, Homo sapien
gtgttcctcttctatggctcagcca

SEQ ID NO: 179154 - DNA, 25 bp, Homo sapien
atggctcagccagctatgggtatct

SEQ ID NO: 179155 - DNA, 25 bp, Homo sapien
atgggtatctgcttccggccaagaa

SEQ ID NO: 179156 - DNA, 25 bp, Homo sapien
gaccagggcaagttcatttccctgt

SEQ ID NO: 179157 - DNA, 25 bp, Homo sapien
atttccctgttctactcgttggtca

SEQ ID NO: 179158 - DNA, 25 bp, Homo sapien
tcgttggtcacacccatggtgaatc

SEQ ID NO: 179159 - DNA, 25 bp, Homo sapien
tcatctacacgctgcggaacatgga

SEQ ID NO: 179160 - DNA, 25 bp, Homo sapien
tagacgctgctaggagggggggccc

SEQ ID NO: 179161 - DNA, 25 bp, Homo sapien
aatacccctccgcttgccgctgcta

SEQ ID NO: 179162 - DNA, 25 bp, Homo sapien
atacccctccgcttgccgctgctag

SEQ ID NO: 179163 - DNA, 25 bp, Homo sapien
tacccctccgcttgccgctgctagc

SEQ ID NO: 179164 - DNA, 25 bp, Homo sapien
acccctccgcttgccgctgctagcg

SEQ ID NO: 179165 - DNA, 25 bp, Homo sapien
ccctccgcttgccgctgctagcgca

SEQ ID NO: 179166 - DNA, 25 bp, Homo sapien
cctccgcttgccgctgctagcgcac

SEQ ID NO: 179167 - DNA, 25 bp, Homo sapien
ctccgcttgccgctgctagcgcacc

SEQ ID NO: 179168 - DNA, 25 bp, Homo sapien
tccgcttgccgctgctagcgcaccc

SEQ ID NO: 179169 - DNA, 25 bp, Homo sapien
ccgcttgccgctgctagcgcacccc

SEQ ID NO: 179170 - DNA, 25 bp, Homo sapien
cttgccgctgctagcgcacccctgc

SEQ ID NO: 179171 - DNA, 25 bp, Homo sapien
ctgtgtctgtctacaaaaagtgaaa

SEQ ID NO: 179172 - DNA, 25 bp, Homo sapien
ttaactttgtaactgcaagaattcc

SEQ ID NO: 179173 - DNA, 25 bp, Homo sapien
aactttgtaactgcaagaattccag

SEQ ID NO: 179174 - DNA, 25 bp, Homo sapien
aactgcaagaattccagttcagccg

SEQ ID NO: 179175 - DNA, 25 bp, Homo sapien
gttcagccgggcgaggattagtatt

SEQ ID NO: 179176 - DNA, 25 bp, Homo sapien
tcagccgggcgaggattagtattat

SEQ ID NO: 179177 - DNA, 25 bp, Homo sapien
gccgggcgaggattagtattatttt

SEQ ID NO: 179178 - DNA, 25 bp, Homo sapien
ttaactctcccgtaagatttttcag

SEQ ID NO: 179179 - DNA, 25 bp, Homo sapien
taactctcccgtaagatttttcagt

SEQ ID NO: 179180 - DNA, 25 bp, Homo sapien
ttcagtaccaccaaattggttttgg

SEQ ID NO: 179181 - DNA, 25 bp, Homo sapien
cagtaccaccaaattggttttggat

SEQ ID NO: 179182 - DNA, 25 bp, Homo sapien
aaagcatcagaagggcctgctttct

SEQ ID NO: 179183 - DNA, 25 bp, Homo sapien
ttccccgggcgatgtgcagagatct

SEQ ID NO: 179184 - DNA, 25 bp, Homo sapien
gggtccttcatcctgacgttatcac

SEQ ID NO: 179185 - DNA, 25 bp, Homo sapien
acgttatcaccaaatttgagctgac

SEQ ID NO: 179186 - DNA, 25 bp, Homo sapien
aaatttgagctgaccatgccctgct

SEQ ID NO: 179187 - DNA, 25 bp, Homo sapien
ctgctcctccctagaaatcaatatt

SEQ ID NO: 179188 - DNA, 25 bp, Homo sapien
tattggaccctttttgtgaagattg

SEQ ID NO: 179189 - DNA, 25 bp, Homo sapien
aagattggtctctgtggtgtgattc

SEQ ID NO: 179190 - DNA, 25 bp, Homo sapien
tggtgtgattctcttcccaggtgtc

SEQ ID NO: 179191 - DNA, 25 bp, Homo sapien
ttctcctcccctagtgtccttaagt

SEQ ID NO: 179192 - DNA, 25 bp, Homo sapien
cacagggaacatctatttgggcttt

SEQ ID NO: 179193 - DNA, 25 bp, Homo sapien
gttgccctgtgctatggtgtggcca

SEQ ID NO: 179194 - DNA, 25 bp, Homo sapien
tgtgctatggtgtggccattttcac

SEQ ID NO: 179195 - DNA, 25 bp, Homo sapien
cttcaggagaagttgttctctgtct

SEQ ID NO: 179196 - DNA, 25 bp, Homo sapien
ttatgccattttaacaccaatgctg

SEQ ID NO: 179197 - DNA, 25 bp, Homo sapien
tttaacaccaatgctgaaccccatg

SEQ ID NO: 179198 - DNA, 25 bp, Homo sapien
taacaccaatgctgaaccccatgat

SEQ ID NO: 179199 - DNA, 25 bp, Homo sapien
accaatgctgaaccccatgatttac

SEQ ID NO: 179200 - DNA, 25 bp, Homo sapien
gaaccccatgatttacagcctaagg

SEQ ID NO: 179201 - DNA, 25 bp, Homo sapien
accccatgatttacagcctaaggaa

SEQ ID NO: 179202 - DNA, 25 bp, Homo sapien
ccatgatttacagcctaaggaataa

SEQ ID NO: 179203 - DNA, 25 bp, Homo sapien
ggcctggcagaaactattatggaaa

SEQ ID NO: 179204 - DNA, 25 bp, Homo sapien
catggccaggttggcctcttctcag

SEQ ID NO: 179205 - DNA, 25 bp, Homo sapien
gtgccttgagccctcttgcaagggc

SEQ ID NO: 179206 - DNA, 25 bp, Homo sapien
ttgagccctcttgcaagggcggctg

SEQ ID NO: 179207 - DNA, 25 bp, Homo sapien
ggctgcttccttgagcctagttttt

SEQ ID NO: 179208 - DNA, 25 bp, Homo sapien
tgagcctagtttttttacgtgattt

SEQ ID NO: 179209 - DNA, 25 bp, Homo sapien
tacgtgatttttgtaacattcattt

SEQ ID NO: 179210 - DNA, 25 bp, Homo sapien
gataacaggagtttctgactaatca

SEQ ID NO: 179211 - DNA, 25 bp, Homo sapien
gagtttctgactaatcaaagctggt

SEQ ID NO: 179212 - DNA, 25 bp, Homo sapien
tcaaagctggtatttccccgcatgt

SEQ ID NO: 179213 - DNA, 25 bp, Homo sapien
aagctggtatttccccgcatgtctt

SEQ ID NO: 179214 - DNA, 25 bp, Homo sapien
tatttccccgcatgtcttattcttg

SEQ ID NO: 179215 - DNA, 25 bp, Homo sapien
gaatagtgacaccagacagttgatg

SEQ ID NO: 179216 - DNA, 25 bp, Homo sapien
acagttgatgtctagataggacctc

SEQ ID NO: 179217 - DNA, 25 bp, Homo sapien
gataggacctcaatgattcccttag

SEQ ID NO: 179218 - DNA, 25 bp, Homo sapien
aggacctcaatgattcccttagaat

SEQ ID NO: 179219 - DNA, 25 bp, Homo sapien
ttcccttagaatcttagataccagg

SEQ ID NO: 179220 - DNA, 25 bp, Homo sapien
gataccaggatattgttggccatgt

SEQ ID NO: 179221 - DNA, 25 bp, Homo sapien
caggatattgttggccatgtggcat

SEQ ID NO: 179222 - DNA, 25 bp, Homo sapien
ggccatgtggcatcattgagcagca

SEQ ID NO: 179223 - DNA, 25 bp, Homo sapien
atgtggcatcattgagcagcaggag

SEQ ID NO: 179224 - DNA, 25 bp, Homo sapien
agctggagcaccctgatgcactagc

SEQ ID NO: 179225 - DNA, 25 bp, Homo sapien
cctgatgcactagctaagaaggcta

SEQ ID NO: 179226 - DNA, 25 bp, Homo sapien
cgccaaagggcgacatgtcagcagt

SEQ ID NO: 179227 - DNA, 25 bp, Homo sapien
gggcgacatgtcagcagtcaatgat

SEQ ID NO: 179228 - DNA, 25 bp, Homo sapien
gtcaatgatgaatctttctgaaatt

SEQ ID NO: 179229 - DNA, 25 bp, Homo sapien
gtatgaaattcaaaacctccacctg

SEQ ID NO: 179230 - DNA, 25 bp, Homo sapien
agaatcttctgtggacatcgacctc

SEQ ID NO: 179231 - DNA, 25 bp, Homo sapien
atcgacctcttagtgatgctgccag

SEQ ID NO: 179232 - DNA, 25 bp, Homo sapien
gatgctgccaggataatttctgctt

SEQ ID NO: 179233 - DNA, 25 bp, Homo sapien
ataatttctgcttgccatgggcatc

SEQ ID NO: 179234 - DNA, 25 bp, Homo sapien
tgggcatctggccaccaaggaattt

SEQ ID NO: 179235 - DNA, 25 bp, Homo sapien
aaggaatttcgcaccctgacgatta

SEQ ID NO: 179236 - DNA, 25 bp, Homo sapien
ctgacgattactcttgacactttta

SEQ ID NO: 179237 - DNA, 25 bp, Homo sapien
taccaaccacgacaggcttcaccgg

SEQ ID NO: 179238 - DNA, 25 bp, Homo sapien
cacgacaggcttcaccgggacccgt

SEQ ID NO: 179239 - DNA, 25 bp, Homo sapien
agaaggcagtgcgatactttgccga

SEQ ID NO: 179240 - DNA, 25 bp, Homo sapien
gaaggcagtgcgatactttgccgat

SEQ ID NO: 179241 - DNA, 25 bp, Homo sapien
aaggcagtgcgatactttgccgatg

SEQ ID NO: 179242 - DNA, 25 bp, Homo sapien
aggcagtgcgatactttgccgatgc

SEQ ID NO: 179243 - DNA, 25 bp, Homo sapien
gcagtgcgatactttgccgatgctg

SEQ ID NO: 179244 - DNA, 25 bp, Homo sapien
cagtgcgatactttgccgatgctgg

SEQ ID NO: 179245 - DNA, 25 bp, Homo sapien
agtgcgatactttgccgatgctggg

SEQ ID NO: 179246 - DNA, 25 bp, Homo sapien
gtgcgatactttgccgatgctgggc

SEQ ID NO: 179247 - DNA, 25 bp, Homo sapien
gcgctggagcctgctacaactggcg

SEQ ID NO: 179248 - DNA, 25 bp, Homo sapien
aattatttcacgcagaattgtcact

SEQ ID NO: 179249 - DNA, 25 bp, Homo sapien
gaattgtcactgtttgtcaggaaga

SEQ ID NO: 179250 - DNA, 25 bp, Homo sapien
agtggaagcccagtcttgagttctt

SEQ ID NO: 179251 - DNA, 25 bp, Homo sapien
gagttcttgtcttgttaccatttaa

SEQ ID NO: 179252 - DNA, 25 bp, Homo sapien
attttcaaatcactgttggtgccta

SEQ ID NO: 179253 - DNA, 25 bp, Homo sapien
tggtgcctaatcacttaagttatta

SEQ ID NO: 179254 - DNA, 25 bp, Homo sapien
gtaacatatttatccggtgggtggg

SEQ ID NO: 179255 - DNA, 25 bp, Homo sapien
gagtgtgttcaagtgggtcatgttt

SEQ ID NO: 179256 - DNA, 25 bp, Homo sapien
gtcatgtttttgctgtggtgacaca

SEQ ID NO: 179257 - DNA, 25 bp, Homo sapien
gacacatggtacaggcttggagctt

SEQ ID NO: 179258 - DNA, 25 bp, Homo sapien
ttggagcttgcaggtccctttctac

SEQ ID NO: 179259 - DNA, 25 bp, Homo sapien
ggagctgccatccactgtataattt

SEQ ID NO: 179260 - DNA, 25 bp, Homo sapien
cactgtataatttcgcctggcaact

SEQ ID NO: 179261 - DNA, 25 bp, Homo sapien
atttcgcctggcaactggactgagg

SEQ ID NO: 179262 - DNA, 25 bp, Homo sapien
gtcagagtgcccagcgtttatcaga

SEQ ID NO: 179263 - DNA, 25 bp, Homo sapien
agcgtttatcagaggcagcatccaa

SEQ ID NO: 179264 - DNA, 25 bp, Homo sapien
aagcccagagccagtgtcgactctt

SEQ ID NO: 179265 - DNA, 25 bp, Homo sapien
agtgtcgactcttcggctggtgcct

SEQ ID NO: 179266 - DNA, 25 bp, Homo sapien
caatgtgtagataaagccctgagta

SEQ ID NO: 179267 - DNA, 25 bp, Homo sapien
gtaggcaagagcagtgagatccact

SEQ ID NO: 179268 - DNA, 25 bp, Homo sapien
gagatccactgctatggtcttgata

SEQ ID NO: 179269 - DNA, 25 bp, Homo sapien
ttgatacatcctcaaactttccctt

SEQ ID NO: 179270 - DNA, 25 bp, Homo sapien
ctagtgaactcaagctgtagccaaa

SEQ ID NO: 179271 - DNA, 25 bp, Homo sapien
tagtgaactcaagctgtagccaaac

SEQ ID NO: 179272 - DNA, 25 bp, Homo sapien
aggcttgatttggatccacaggcag

SEQ ID NO: 179273 - DNA, 25 bp, Homo sapien
attctgccccacattggcagtgcca

SEQ ID NO: 179274 - DNA, 25 bp, Homo sapien
acccgcaacaccatgtccttgttgg

SEQ ID NO: 179275 - DNA, 25 bp, Homo sapien
aacaccatgtccttgttggcagcta

SEQ ID NO: 179276 - DNA, 25 bp, Homo sapien
accatgtccttgttggcagctaaca

SEQ ID NO: 179277 - DNA, 25 bp, Homo sapien
gtccttgttggcagctaacaacttg

SEQ ID NO: 179278 - DNA, 25 bp, Homo sapien
gttggcagctaacaacttgctggct

SEQ ID NO: 179279 - DNA, 25 bp, Homo sapien
agctaacaacttgctggctggcctg

SEQ ID NO: 179280 - DNA, 25 bp, Homo sapien
taacaacttgctggctggcctgaga

SEQ ID NO: 179281 - DNA, 25 bp, Homo sapien
tagaagagtctgtgttgaaggcatc

SEQ ID NO: 179282 - DNA, 25 bp, Homo sapien
gctctggttctcagggcagcatttt

SEQ ID NO: 179283 - DNA, 25 bp, Homo sapien
gcagcattttccaggcgggtttgtt

SEQ ID NO: 179284 - DNA, 25 bp, Homo sapien
tttccaggcgggtttgttttgcatt

SEQ ID NO: 179285 - DNA, 25 bp, Homo sapien
tgttttgcatttcttggagcctctc

SEQ ID NO: 179286 - DNA, 25 bp, Homo sapien
gagcagcaaccagacgggagatttt

SEQ ID NO: 179287 - DNA, 25 bp, Homo sapien
taagctgttcatgctgggactgaca

SEQ ID NO: 179288 - DNA, 25 bp, Homo sapien
gactgacagcctgcagggtttcctt

SEQ ID NO: 179289 - DNA, 25 bp, Homo sapien
gcgcggccccaaaattgccttcaaa

SEQ ID NO: 179290 - DNA, 25 bp, Homo sapien
cggttgaaagccttcgaaccgtgca

SEQ ID NO: 179291 - DNA, 25 bp, Homo sapien
ttcgcttcctctcttgtgttatgga

SEQ ID NO: 179292 - DNA, 25 bp, Homo sapien
gagatctgtctatgggaccagtggc

SEQ ID NO: 179293 - DNA, 25 bp, Homo sapien
ctatgggaccagtggcttggattct

SEQ ID NO: 179294 - DNA, 25 bp, Homo sapien
cttggattctgccacacccataaat

SEQ ID NO: 179295 - DNA, 25 bp, Homo sapien
cacccataaatccttgtgtgttaac

SEQ ID NO: 179296 - DNA, 25 bp, Homo sapien
ttgtgtgttaacttctagctgcctg

SEQ ID NO: 179297 - DNA, 25 bp, Homo sapien
ggctggccctgctcagacaaatctg

SEQ ID NO: 179298 - DNA, 25 bp, Homo sapien
agacaaatctgctccctgggcatct

SEQ ID NO: 179299 - DNA, 25 bp, Homo sapien
tctttggccaggcttctgccctctg

SEQ ID NO: 179300 - DNA, 25 bp, Homo sapien
ctctgctcggcttcagtctccagga

SEQ ID NO: 179301 - DNA, 25 bp, Homo sapien
ggagacagtggtcacctctccctgc

SEQ ID NO: 179302 - DNA, 25 bp, Homo sapien
gggccaaaagtccagtgaaattgta

SEQ ID NO: 179303 - DNA, 25 bp, Homo sapien
gctgtgtattttaaccctctgtcct

SEQ ID NO: 179304 - DNA, 25 bp, Homo sapien
tgtattttaaccctctgtcctccca

SEQ ID NO: 179305 - DNA, 25 bp, Homo sapien
cactcagctgagaaagacactatgg

SEQ ID NO: 179306 - DNA, 25 bp, Homo sapien
gctgagaaagacactatggctactg

SEQ ID NO: 179307 - DNA, 25 bp, Homo sapien
cactatggctactgtgttgtataca

SEQ ID NO: 179308 - DNA, 25 bp, Homo sapien
gtgttgtatacagtagtgactccca

SEQ ID NO: 179309 - DNA, 25 bp, Homo sapien
gtatacagtagtgactcccatgcta

SEQ ID NO: 179310 - DNA, 25 bp, Homo sapien
agtagtgactcccatgctaaaccct

SEQ ID NO: 179311 - DNA, 25 bp, Homo sapien
tgactcccatgctaaaccctttcat

SEQ ID NO: 179312 - DNA, 25 bp, Homo sapien
cagcctgaggaacaggtacttgaaa

SEQ ID NO: 179313 - DNA, 25 bp, Homo sapien
agttggcagggtggtgttttctgtc

SEQ ID NO: 179314 - DNA, 25 bp, Homo sapien
caggagtgacacaggcagccagtac

SEQ ID NO: 179315 - DNA, 25 bp, Homo sapien
acaggcagccagtacatagaggata

SEQ ID NO: 179316 - DNA, 25 bp, Homo sapien
gtattagccaaggtgcagtctgcaa

SEQ ID NO: 179317 - DNA, 25 bp, Homo sapien
agcacttcctaaactctggatgcct

SEQ ID NO: 179318 - DNA, 25 bp, Homo sapien
tcgacggcctgaactgcaggcagtg

SEQ ID NO: 179319 - DNA, 25 bp, Homo sapien
tggcgctgctcaactccgtcgtgaa

SEQ ID NO: 179320 - DNA, 25 bp, Homo sapien
atcatctactcctacaaggacgagg

SEQ ID NO: 179321 - DNA, 25 bp, Homo sapien
aggacgaggacatgtatggcaccat

SEQ ID NO: 179322 - DNA, 25 bp, Homo sapien
gaagatgatctgctgcttctctcag

SEQ ID NO: 179323 - DNA, 25 bp, Homo sapien
tgatctgctgcttctctcaggagaa

SEQ ID NO: 179324 - DNA, 25 bp, Homo sapien
ggagaacccagagaggcgtccctct

SEQ ID NO: 179325 - DNA, 25 bp, Homo sapien
gtccggaatgacaccccctgtggaa

SEQ ID NO: 179326 - DNA, 25 bp, Homo sapien
tgtggaaccaccattggacctatct

SEQ ID NO: 179327 - DNA, 25 bp, Homo sapien
attggacctatcttggcttctcggc

SEQ ID NO: 179328 - DNA, 25 bp, Homo sapien
gacctatcttggcttctcggctggg

SEQ ID NO: 179329 - DNA, 25 bp, Homo sapien
ggtgctggatttaggcagcccccaa

SEQ ID NO: 179330 - DNA, 25 bp, Homo sapien
tcaccctcttcaagggcttctttga

SEQ ID NO: 179331 - DNA, 25 bp, Homo sapien
tcaagggcttctttgagctgttccc

SEQ ID NO: 179332 - DNA, 25 bp, Homo sapien
taagccataatctcttagtggattg

SEQ ID NO: 179333 - DNA, 25 bp, Homo sapien
ttagtggattgagccctcttggaaa

SEQ ID NO: 179334 - DNA, 25 bp, Homo sapien
ttgagccctcttggaaagacttctc

SEQ ID NO: 179335 - DNA, 25 bp, Homo sapien
ttggaaagacttctctgccatccct

SEQ ID NO: 179336 - DNA, 25 bp, Homo sapien
gcttatctttgccttctccaaacaa

SEQ ID NO: 179337 - DNA, 25 bp, Homo sapien
tatctttgccttctccaaacaagaa

SEQ ID NO: 179338 - DNA, 25 bp, Homo sapien
gcaatagtctccaagtcaatataaa

SEQ ID NO: 179339 - DNA, 25 bp, Homo sapien
gtctccaagtcaatataaattctac

SEQ ID NO: 179340 - DNA, 25 bp, Homo sapien
gtgagaatcattaaaacatgtgaca

SEQ ID NO: 179341 - DNA, 25 bp, Homo sapien
acatgtgacaatttagagattcttt

SEQ ID NO: 179342 - DNA, 25 bp, Homo sapien
gacaatttagagattctttgtttta

SEQ ID NO: 179343 - DNA, 25 bp, Homo sapien
cactgattaatatactgtggcaaat

SEQ ID NO: 179344 - DNA, 25 bp, Homo sapien
gtggcaaattacacagattattaaa

SEQ ID NO: 179345 - DNA, 25 bp, Homo sapien
aatgggaaaagtgcattttactgta

SEQ ID NO: 179346 - DNA, 25 bp, Homo sapien
tttgtttatttctcagaatatggaa

SEQ ID NO: 179347 - DNA, 25 bp, Homo sapien
aactgttaaacatggcgctggcgcg

SEQ ID NO: 179348 - DNA, 25 bp, Homo sapien
tggcgcggagatctccaccgtgaac

SEQ ID NO: 179349 - DNA, 25 bp, Homo sapien
ctccaccgtgaacccagaacagtat

SEQ ID NO: 179350 - DNA, 25 bp, Homo sapien
agcgctttttggactttattggcca

SEQ ID NO: 179351 - DNA, 25 bp, Homo sapien
tattggccacatcttgacgtaacct

SEQ ID NO: 179352 - DNA, 25 bp, Homo sapien
gcagcctcggacagacatgaacatt

SEQ ID NO: 179353 - DNA, 25 bp, Homo sapien
gaagtactcatcttgcaggaagcaa

SEQ ID NO: 179354 - DNA, 25 bp, Homo sapien
aaacctccttgtttacatcttcagg

SEQ ID NO: 179355 - DNA, 25 bp, Homo sapien
atcttcaggccaagatgactgattt

SEQ ID NO: 179356 - DNA, 25 bp, Homo sapien
ctactcgctttacagctacctgatt

SEQ ID NO: 179357 - DNA, 25 bp, Homo sapien
ctacctgattttcccagcatcgttg

SEQ ID NO: 179358 - DNA, 25 bp, Homo sapien
agccatggtgacacacagcagcact

SEQ ID NO: 179359 - DNA, 25 bp, Homo sapien
acagcagcactgcagatagccagac

SEQ ID NO: 179360 - DNA, 25 bp, Homo sapien
tagccagacacatggctatcctaga

SEQ ID NO: 179361 - DNA, 25 bp, Homo sapien
ccagacacatggctatcctagagag

SEQ ID NO: 179362 - DNA, 25 bp, Homo sapien
gacacatggctatcctagagaggct

SEQ ID NO: 179363 - DNA, 25 bp, Homo sapien
atggctatcctagagaggctggcaa

SEQ ID NO: 179364 - DNA, 25 bp, Homo sapien
gctatcctagagaggctggcaagga

SEQ ID NO: 179365 - DNA, 25 bp, Homo sapien
tcctagagaggctggcaaggagttc

SEQ ID NO: 179366 - DNA, 25 bp, Homo sapien
gagttcgtggctgcaaaagaagttt

SEQ ID NO: 179367 - DNA, 25 bp, Homo sapien
agagctcgctcttgggagtcaggac

SEQ ID NO: 179368 - DNA, 25 bp, Homo sapien
gagctcgctcttgggagtcaggacc

SEQ ID NO: 179369 - DNA, 25 bp, Homo sapien
gttgttataaaactatacccactgc

SEQ ID NO: 179370 - DNA, 25 bp, Homo sapien
atacccactgcaaaagtagtagtca

SEQ ID NO: 179371 - DNA, 25 bp, Homo sapien
gtagtagtcaagtgtctaggtcttt

SEQ ID NO: 179372 - DNA, 25 bp, Homo sapien
gtctaggtctttgatattgctcttt

SEQ ID NO: 179373 - DNA, 25 bp, Homo sapien
gatattgctcttttggttaacacta

SEQ ID NO: 179374 - DNA, 25 bp, Homo sapien
ggttaacactaagcttaagtagact

SEQ ID NO: 179375 - DNA, 25 bp, Homo sapien
gcttaagtagactatacagttgtat

SEQ ID NO: 179376 - DNA, 25 bp, Homo sapien
aaaagtatatgaacacctagtgaga

SEQ ID NO: 179377 - DNA, 25 bp, Homo sapien
gaacacctagtgagatttcaaactt

SEQ ID NO: 179378 - DNA, 25 bp, Homo sapien
gtattttcttgtgaactgtgtttta

SEQ ID NO: 179379 - DNA, 25 bp, Homo sapien
gaactgtgttttatgattttacctc

SEQ ID NO: 179380 - DNA, 25 bp, Homo sapien
aacagcagctgttgtccttaaaaat

SEQ ID NO: 179381 - DNA, 25 bp, Homo sapien
acagcagctgttgtccttaaaaatg

SEQ ID NO: 179382 - DNA, 25 bp, Homo sapien
cagcagctgttgtccttaaaaatga

SEQ ID NO: 179383 - DNA, 25 bp, Homo sapien
agcagctgttgtccttaaaaatgaa

SEQ ID NO: 179384 - DNA, 25 bp, Homo sapien
gcagctgttgtccttaaaaatgaat

SEQ ID NO: 179385 - DNA, 25 bp, Homo sapien
cagctgttgtccttaaaaatgaatt

SEQ ID NO: 179386 - DNA, 25 bp, Homo sapien
gctgttgtccttaaaaatgaattga

SEQ ID NO: 179387 - DNA, 25 bp, Homo sapien
ttaaaaatgaattgacctggccggg

SEQ ID NO: 179388 - DNA, 25 bp, Homo sapien
aaaaatgaattgacctggccgggcg

SEQ ID NO: 179389 - DNA, 25 bp, Homo sapien
aaaatgaattgacctggccgggcgc

SEQ ID NO: 179390 - DNA, 25 bp, Homo sapien
aatgaattgacctggccgggcgcgg

SEQ ID NO: 179391 - DNA, 25 bp, Homo sapien
aaaaatagtggtcagtcagtagtca

SEQ ID NO: 179392 - DNA, 25 bp, Homo sapien
tgagagggtggctgaactgaatttt

SEQ ID NO: 179393 - DNA, 25 bp, Homo sapien
gaattttggcagttcttggttaatt

SEQ ID NO: 179394 - DNA, 25 bp, Homo sapien
aatttcatgtgttcggacttttcct

SEQ ID NO: 179395 - DNA, 25 bp, Homo sapien
tcatgtgttcggacttttcctgtat

SEQ ID NO: 179396 - DNA, 25 bp, Homo sapien
tcctgtatcccttttctgttcatcc

SEQ ID NO: 179397 - DNA, 25 bp, Homo sapien
gttcatcctagtcaatgtcttatca

SEQ ID NO: 179398 - DNA, 25 bp, Homo sapien
attttctggatgcttgagccatcag

SEQ ID NO: 179399 - DNA, 25 bp, Homo sapien
gccatcagatatcagctagcttttt

SEQ ID NO: 179400 - DNA, 25 bp, Homo sapien
aacatcttatacatcttagctttca

SEQ ID NO: 179401 - DNA, 25 bp, Homo sapien
atacatcttagctttcatatatagg

SEQ ID NO: 179402 - DNA, 25 bp, Homo sapien
agatggaaggccttttgcccgttga

SEQ ID NO: 179403 - DNA, 25 bp, Homo sapien
gaaatctcctcttttgtacccaata

SEQ ID NO: 179404 - DNA, 25 bp, Homo sapien
acttatgttgtattgttggtgcgaa

SEQ ID NO: 179405 - DNA, 25 bp, Homo sapien
acactacctcttttgagactttgcc

SEQ ID NO: 179406 - DNA, 25 bp, Homo sapien
ttttgagactttgcccagggtcctg

SEQ ID NO: 179407 - DNA, 25 bp, Homo sapien
aagaattatcatcccaacagccaag

SEQ ID NO: 179408 - DNA, 25 bp, Homo sapien
agccaagacccaacaggtgctgaac

SEQ ID NO: 179409 - DNA, 25 bp, Homo sapien
aggtgctgaactgtgcatcaaccag

SEQ ID NO: 179410 - DNA, 25 bp, Homo sapien
aggaagagttctatccccaagctgg

SEQ ID NO: 179411 - DNA, 25 bp, Homo sapien
caagctggccactatcacatatgct

SEQ ID NO: 179412 - DNA, 25 bp, Homo sapien
atcacatatgcttactcttgcttaa

SEQ ID NO: 179413 - DNA, 25 bp, Homo sapien
tcaggtcttttccacagtcttccaa

SEQ ID NO: 179414 - DNA, 25 bp, Homo sapien
agtcttccaagttccatctaccaag

SEQ ID NO: 179415 - DNA, 25 bp, Homo sapien
gttccatctaccaagagtctattca

SEQ ID NO: 179416 - DNA, 25 bp, Homo sapien
tattcaaagccttctgcacctgtgg

SEQ ID NO: 179417 - DNA, 25 bp, Homo sapien
ttatattatggtacaacgatgggca

SEQ ID NO: 179418 - DNA, 25 bp, Homo sapien
aacgatgggcatgtatttccgccct

SEQ ID NO: 179419 - DNA, 25 bp, Homo sapien
atttccgccctctgaccagttacag

SEQ ID NO: 179420 - DNA, 25 bp, Homo sapien
gttacagccccaaagatgcagtgat

SEQ ID NO: 179421 - DNA, 25 bp, Homo sapien
atgtggcagtgaccccagcattaaa

SEQ ID NO: 179422 - DNA, 25 bp, Homo sapien
gaccccagcattaaatcctttcatc

SEQ ID NO: 179423 - DNA, 25 bp, Homo sapien
agccctacagaaactcttcagcaag

SEQ ID NO: 179424 - DNA, 25 bp, Homo sapien
atcgggagtgaaggagcactgcttc

SEQ ID NO: 179425 - DNA, 25 bp, Homo sapien
agcactgcttcattgtggctcagcc

SEQ ID NO: 179426 - DNA, 25 bp, Homo sapien
tgccctttgatgtccttgagctact

SEQ ID NO: 179427 - DNA, 25 bp, Homo sapien
ttgatgtccttgagctactcttcag

SEQ ID NO: 179428 - DNA, 25 bp, Homo sapien
tcagctctggaagttgtggacaaac

SEQ ID NO: 179429 - DNA, 25 bp, Homo sapien
gtctgtgaatgacaggccctggcta

SEQ ID NO: 179430 - DNA, 25 bp, Homo sapien
aggccctggctattgattgatgttg

SEQ ID NO: 179431 - DNA, 25 bp, Homo sapien
gatggcctgaatatatgtctgcact

SEQ ID NO: 179432 - DNA, 25 bp, Homo sapien
atgtctgcacttttaatgctcctct

SEQ ID NO: 179433 - DNA, 25 bp, Homo sapien
taatgctcctcttaaccagttgtaa

SEQ ID NO: 179434 - DNA, 25 bp, Homo sapien
tgtaacatcttaccatttccctacc

SEQ ID NO: 179435 - DNA, 25 bp, Homo sapien
gcaaaccttgtcatacccatatgca

SEQ ID NO: 179436 - DNA, 25 bp, Homo sapien
gtcatacccatatgcaaaactgtgt

SEQ ID NO: 179437 - DNA, 25 bp, Homo sapien
gtttgggttctcttttgtgctatca

SEQ ID NO: 179438 - DNA, 25 bp, Homo sapien
ttttgtgctatcaatcagttgtaaa

SEQ ID NO: 179439 - DNA, 25 bp, Homo sapien
attctactggaataactgcatcttc

SEQ ID NO: 179440 - DNA, 25 bp, Homo sapien
ggaataactgcatcttccactcagt

SEQ ID NO: 179441 - DNA, 25 bp, Homo sapien
atcttccactcagtcactacaaaaa

SEQ ID NO: 179442 - DNA, 25 bp, Homo sapien
cactcagtcactacaaaaaagcata

SEQ ID NO: 179443 - DNA, 25 bp, Homo sapien
aaaagcatagtttcagtttgcatga

SEQ ID NO: 179444 - DNA, 25 bp, Homo sapien
gcatagtttcagtttgcatgaattt

SEQ ID NO: 179445 - DNA, 25 bp, Homo sapien
ccatttctgggatagaattgtattt

SEQ ID NO: 179446 - DNA, 25 bp, Homo sapien
attgcaatttcttaggtaaccttat

SEQ ID NO: 179447 - DNA, 25 bp, Homo sapien
gaagattaccctcaaatgctagaag

SEQ ID NO: 179448 - DNA, 25 bp, Homo sapien
tagaagctgtctaggtccgtccggt

SEQ ID NO: 179449 - DNA, 25 bp, Homo sapien
taggtccgtccggtgtgtcagattt

SEQ ID NO: 179450 - DNA, 25 bp, Homo sapien
ttcctcagattagatgtgccaataa

SEQ ID NO: 179451 - DNA, 25 bp, Homo sapien
gtgccaataaccaagtttattcagt

SEQ ID NO: 179452 - DNA, 25 bp, Homo sapien
caacttgtacttgtttcatctggtt

SEQ ID NO: 179453 - DNA, 25 bp, Homo sapien
tttattactctcacccataaacagt

SEQ ID NO: 179454 - DNA, 25 bp, Homo sapien
cataaacagtaatgactctctgacc

SEQ ID NO: 179455 - DNA, 25 bp, Homo sapien
gaccctctggaaatatgtaatgctt

SEQ ID NO: 179456 - DNA, 25 bp, Homo sapien
tgtaatgcttccaatcttgctttgt

SEQ ID NO: 179457 - DNA, 25 bp, Homo sapien
tgatgtcatcaagccaggcaccgtg

SEQ ID NO: 179458 - DNA, 25 bp, Homo sapien
caggcaccgtgaagagactccgtgg

SEQ ID NO: 179459 - DNA, 25 bp, Homo sapien
aagtgccaactcagcgaggagacct

SEQ ID NO: 179460 - DNA, 25 bp, Homo sapien
gaggagacctcattgttgagttcaa

SEQ ID NO: 179461 - DNA, 25 bp, Homo sapien
aagttcgcttcccagacagattaac

SEQ ID NO: 179462 - DNA, 25 bp, Homo sapien
gattaacaccacagacaagacagat

SEQ ID NO: 179463 - DNA, 25 bp, Homo sapien
agacagatccttaagcagcacctac

SEQ ID NO: 179464 - DNA, 25 bp, Homo sapien
gagatggcaccaacgtgctctacag

SEQ ID NO: 179465 - DNA, 25 bp, Homo sapien
agtgccctgatcagcctcaaggagg

SEQ ID NO: 179466 - DNA, 25 bp, Homo sapien
gtgaacattcccactatcgacggcc

SEQ ID NO: 179467 - DNA, 25 bp, Homo sapien
tatcgacggccgagtgatccctttg

SEQ ID NO: 179468 - DNA, 25 bp, Homo sapien
gtgagctttacttctttggaatgga

SEQ ID NO: 179469 - DNA, 25 bp, Homo sapien
aaaaccttgtgaactgactccttgc

SEQ ID NO: 179470 - DNA, 25 bp, Homo sapien
gactccttgcactaacgcgagtttg

SEQ ID NO: 179471 - DNA, 25 bp, Homo sapien
gagtttgccccacctactctgtaat

SEQ ID NO: 179472 - DNA, 25 bp, Homo sapien
ccacctactctgtaatttgcttgtt

SEQ ID NO: 179473 - DNA, 25 bp, Homo sapien
acagagccttgatccagaagccaga

SEQ ID NO: 179474 - DNA, 25 bp, Homo sapien
gggtactacgatcacagacacagac

SEQ ID NO: 179475 - DNA, 25 bp, Homo sapien
acgatcacagacacagacatacttt

SEQ ID NO: 179476 - DNA, 25 bp, Homo sapien
acagacatacttttcctaaagttga

SEQ ID NO: 179477 - DNA, 25 bp, Homo sapien
aaagttgaagcatttgttcccagga

SEQ ID NO: 179478 - DNA, 25 bp, Homo sapien
gcatttgttcccaggatttatttta

SEQ ID NO: 179479 - DNA, 25 bp, Homo sapien
tgtcagaggtgaacataccgctgtc

SEQ ID NO: 179480 - DNA, 25 bp, Homo sapien
agaggtgaacataccgctgtcgctg

SEQ ID NO: 179481 - DNA, 25 bp, Homo sapien
tgaacataccgctgtcgctgggtgt

SEQ ID NO: 179482 - DNA, 25 bp, Homo sapien
ataccgctgtcgctgggtgtctgtc

SEQ ID NO: 179483 - DNA, 25 bp, Homo sapien
ctgtcgctgggtgtctgtccactgg

SEQ ID NO: 179484 - DNA, 25 bp, Homo sapien
agggccctgccctggaagactggag

SEQ ID NO: 179485 - DNA, 25 bp, Homo sapien
aagactggagggaggccccaagcca

SEQ ID NO: 179486 - DNA, 25 bp, Homo sapien
cctccccagtgagggacattttttg

SEQ ID NO: 179487 - DNA, 25 bp, Homo sapien
atagttttatatgacggctggcagc

SEQ ID NO: 179488 - DNA, 25 bp, Homo sapien
agttttatatgacggctggcagcag

SEQ ID NO: 179489 - DNA, 25 bp, Homo sapien
tatatgacggctggcagcagcggcc

SEQ ID NO: 179490 - DNA, 25 bp, Homo sapien
tgtgacttatgagctgtgactcaac

SEQ ID NO: 179491 - DNA, 25 bp, Homo sapien
gctgtgactcaactgcttcattaaa

SEQ ID NO: 179492 - DNA, 25 bp, Homo sapien
tcaacctacccaacctgtagctaag

SEQ ID NO: 179493 - DNA, 25 bp, Homo sapien
taagaatacctccatgagccctcga

SEQ ID NO: 179494 - DNA, 25 bp, Homo sapien
ccgggcccagcagcagagtcagaga

SEQ ID NO: 179495 - DNA, 25 bp, Homo sapien
aggttgtctacttcaccagatgtaa

SEQ ID NO: 179496 - DNA, 25 bp, Homo sapien
ccaagagacaaccacactgatcatg

SEQ ID NO: 179497 - DNA, 25 bp, Homo sapien
ggtcagctgtactgattgtcatcct

SEQ ID NO: 179498 - DNA, 25 bp, Homo sapien
ttgtcatcctgactttggcattggc

SEQ ID NO: 179499 - DNA, 25 bp, Homo sapien
tggcagctcttatattccgacgaat

SEQ ID NO: 179500 - DNA, 25 bp, Homo sapien
ttccgacgaatatatctggcaaacg

SEQ ID NO: 179501 - DNA, 25 bp, Homo sapien
cagaaccggattgccacctttgagg

SEQ ID NO: 179502 - DNA, 25 bp, Homo sapien
aagaggaggcccagaaacgccgtga

SEQ ID NO: 179503 - DNA, 25 bp, Homo sapien
acgccgtgagcgcatcgatgagatc

SEQ ID NO: 179504 - DNA, 25 bp, Homo sapien
tgaagagctgagagccactggcctt

SEQ ID NO: 179505 - DNA, 25 bp, Homo sapien
tggccttcccgagaagtactgcatt

SEQ ID NO: 179506 - DNA, 25 bp, Homo sapien
gtactgcattgaagctgagcgcaaa

SEQ ID NO: 179507 - DNA, 25 bp, Homo sapien
aaagctaacatcctgccagctacct

SEQ ID NO: 179508 - DNA, 25 bp, Homo sapien
ttcgtggccctcaggatgccttcgg

SEQ ID NO: 179509 - DNA, 25 bp, Homo sapien
gggacagattctgcccagtctctgg

SEQ ID NO: 179510 - DNA, 25 bp, Homo sapien
gtctctgggcatccataattgctgc

SEQ ID NO: 179511 - DNA, 25 bp, Homo sapien
attgctgctaacctagacatttcat

SEQ ID NO: 179512 - DNA, 25 bp, Homo sapien
ttttgcatgggctggtagtacctct

SEQ ID NO: 179513 - DNA, 25 bp, Homo sapien
tggtagtacctctgttatgctctca

SEQ ID NO: 179514 - DNA, 25 bp, Homo sapien
gttatgctctcagttacaatcaatt

SEQ ID NO: 179515 - DNA, 25 bp, Homo sapien
cagtcttggtacctaacagtagcta

SEQ ID NO: 179516 - DNA, 25 bp, Homo sapien
acagtagctatgcataatcctgtgg

SEQ ID NO: 179517 - DNA, 25 bp, Homo sapien
tatgctctcatagtggtttttctat

SEQ ID NO: 179518 - DNA, 25 bp, Homo sapien
tagtcttcaagccttggttctctaa

SEQ ID NO: 179519 - DNA, 25 bp, Homo sapien
ggttctctaatgcagctaccacaag

SEQ ID NO: 179520 - DNA, 25 bp, Homo sapien
gcagctaccacaagaggttgatatt

SEQ ID NO: 179521 - DNA, 25 bp, Homo sapien
atagtggcgtgtaatctccttttcg

SEQ ID NO: 179522 - DNA, 25 bp, Homo sapien
tgtaatctccttttcgggaggcttt

SEQ ID NO: 179523 - DNA, 25 bp, Homo sapien
aagaacagtttgacggcctaccagt

SEQ ID NO: 179524 - DNA, 25 bp, Homo sapien
tgacggcctaccagtacatctggat

SEQ ID NO: 179525 - DNA, 25 bp, Homo sapien
acatctggattggactccatgatcc

SEQ ID NO: 179526 - DNA, 25 bp, Homo sapien
atgatccctcacatggtacactacc

SEQ ID NO: 179527 - DNA, 25 bp, Homo sapien
ggtacactacccaacggaagtggat

SEQ ID NO: 179528 - DNA, 25 bp, Homo sapien
ggagcagttccaatgtgctgacctt

SEQ ID NO: 179529 - DNA, 25 bp, Homo sapien
gaggaacccctctattgctgctgac

SEQ ID NO: 179530 - DNA, 25 bp, Homo sapien
tgctgaccgtggttattgtgcagtt

SEQ ID NO: 179531 - DNA, 25 bp, Homo sapien
attgtgcagttttgtctcagaaatc

SEQ ID NO: 179532 - DNA, 25 bp, Homo sapien
atgagcttccctatatctgcaaatt

SEQ ID NO: 179533 - DNA, 25 bp, Homo sapien
gcaaattcaaggtctagggcagttc

SEQ ID NO: 179534 - DNA, 25 bp, Homo sapien
atgcaccctgttccctgacaaagtt

SEQ ID NO: 179535 - DNA, 25 bp, Homo sapien
cctgttccctgacaaagtttcaaca

SEQ ID NO: 179536 - DNA, 25 bp, Homo sapien
tggtgctaggagagggcctgtgctc

SEQ ID NO: 179537 - DNA, 25 bp, Homo sapien
tgtgctccacacagccgtggttttc

SEQ ID NO: 179538 - DNA, 25 bp, Homo sapien
cacacagccgtggttttctgatttt

SEQ ID NO: 179539 - DNA, 25 bp, Homo sapien
acagccgtggttttctgattttcac

SEQ ID NO: 179540 - DNA, 25 bp, Homo sapien
gccgtggttttctgattttcaccat

SEQ ID NO: 179541 - DNA, 25 bp, Homo sapien
ttttctgattttcaccatgcccggg

SEQ ID NO: 179542 - DNA, 25 bp, Homo sapien
cttcccacctgcctgtgagaattgg

SEQ ID NO: 179543 - DNA, 25 bp, Homo sapien
gtgcctgaagctcagagctacacat

SEQ ID NO: 179544 - DNA, 25 bp, Homo sapien
aagctcagagctacacatttttaat

SEQ ID NO: 179545 - DNA, 25 bp, Homo sapien
tgtcagaggtgaacataccgctgtc

SEQ ID NO: 179546 - DNA, 25 bp, Homo sapien
tcagaggtgaacataccgctgtcgc

SEQ ID NO: 179547 - DNA, 25 bp, Homo sapien
cagaggtgaacataccgctgtcgct

SEQ ID NO: 179548 - DNA, 25 bp, Homo sapien
agaggtgaacataccgctgtcgctg

SEQ ID NO: 179549 - DNA, 25 bp, Homo sapien
tgaacataccgctgtcgctgggtgt

SEQ ID NO: 179550 - DNA, 25 bp, Homo sapien
gaacataccgctgtcgctgggtgtc

SEQ ID NO: 179551 - DNA, 25 bp, Homo sapien
aacataccgctgtcgctgggtgtct

SEQ ID NO: 179552 - DNA, 25 bp, Homo sapien
acataccgctgtcgctgggtgtctg

SEQ ID NO: 179553 - DNA, 25 bp, Homo sapien
ataccgctgtcgctgggtgtctgtc

SEQ ID NO: 179554 - DNA, 25 bp, Homo sapien
accgctgtcgctgggtgtctgtcca

SEQ ID NO: 179555 - DNA, 25 bp, Homo sapien
ctgtcgctgggtgtctgtccactgg

SEQ ID NO: 179556 - DNA, 25 bp, Homo sapien
gaatcctttggtcaaccaggacctt

SEQ ID NO: 179557 - DNA, 25 bp, Homo sapien
ttggtcaaccaggaccttgattttt

SEQ ID NO: 179558 - DNA, 25 bp, Homo sapien
accaggaccttgatttttcaggcat

SEQ ID NO: 179559 - DNA, 25 bp, Homo sapien
gatttttcaggcattttggtctggg

SEQ ID NO: 179560 - DNA, 25 bp, Homo sapien
tttttctttccatcgtggttctgga

SEQ ID NO: 179561 - DNA, 25 bp, Homo sapien
ttccatcgtggttctggaagctttc

SEQ ID NO: 179562 - DNA, 25 bp, Homo sapien
ggaagctttctagcgtgtggcatct

SEQ ID NO: 179563 - DNA, 25 bp, Homo sapien
agctttctagcgtgtggcatctgac

SEQ ID NO: 179564 - DNA, 25 bp, Homo sapien
tagcgtgtggcatctgaccaatttt

SEQ ID NO: 179565 - DNA, 25 bp, Homo sapien
gtggcatctgaccaattttgaattg

SEQ ID NO: 179566 - DNA, 25 bp, Homo sapien
ttgaattggtccttttctataaatc

SEQ ID NO: 179567 - DNA, 25 bp, Homo sapien
cagcactggcattaatctcagtcct

SEQ ID NO: 179568 - DNA, 25 bp, Homo sapien
gcactggcattaatctcagtcctgg

SEQ ID NO: 179569 - DNA, 25 bp, Homo sapien
actggcattaatctcagtcctggcc

SEQ ID NO: 179570 - DNA, 25 bp, Homo sapien
tggcattaatctcagtcctggcctg

SEQ ID NO: 179571 - DNA, 25 bp, Homo sapien
ggcattaatctcagtcctggcctgg

SEQ ID NO: 179572 - DNA, 25 bp, Homo sapien
gcattaatctcagtcctggcctggg

SEQ ID NO: 179573 - DNA, 25 bp, Homo sapien
ggcctgggagatgcggcccacaaga

SEQ ID NO: 179574 - DNA, 25 bp, Homo sapien
ggcccacaagaaggcaggtgaaagc

SEQ ID NO: 179575 - DNA, 25 bp, Homo sapien
aagaaggcaggtgaaagcggaccac

SEQ ID NO: 179576 - DNA, 25 bp, Homo sapien
aggcaggtgaaagcggaccaccgtc

SEQ ID NO: 179577 - DNA, 25 bp, Homo sapien
aggtgaaagcggaccaccgtcaccg

SEQ ID NO: 179578 - DNA, 25 bp, Homo sapien
ccagctgggaagagggcgggatcgg

SEQ ID NO: 179579 - DNA, 25 bp, Homo sapien
aagagggcgggatcgggcactggtt

SEQ ID NO: 179580 - DNA, 25 bp, Homo sapien
ggatcgggcactggttcctccttgt

SEQ ID NO: 179581 - DNA, 25 bp, Homo sapien
actttttgtcttctattgtgtggct

SEQ ID NO: 179582 - DNA, 25 bp, Homo sapien
ctattgtgtggctttctgagtattt

SEQ ID NO: 179583 - DNA, 25 bp, Homo sapien
tgtgtggctttctgagtatttgaac

SEQ ID NO: 179584 - DNA, 25 bp, Homo sapien
ggagctgcgtcttgctagggcttcc

SEQ ID NO: 179585 - DNA, 25 bp, Homo sapien
ttctccccatcccggtctccagaga

SEQ ID NO: 179586 - DNA, 25 bp, Homo sapien
tctccagagacccagcttttgagag

SEQ ID NO: 179587 - DNA, 25 bp, Homo sapien
cagagacccagcttttgagagacag

SEQ ID NO: 179588 - DNA, 25 bp, Homo sapien
agagacagggtgtgggcatctccat

SEQ ID NO: 179589 - DNA, 25 bp, Homo sapien
cactctatccgggagatggcctgca

SEQ ID NO: 179590 - DNA, 25 bp, Homo sapien
actctatccgggagatggcctgcac

SEQ ID NO: 179591 - DNA, 25 bp, Homo sapien
tctatccgggagatggcctgcacca

SEQ ID NO: 179592 - DNA, 25 bp, Homo sapien
ctatccgggagatggcctgcaccac

SEQ ID NO: 179593 - DNA, 25 bp, Homo sapien
tatccgggagatggcctgcaccaca

SEQ ID NO: 179594 - DNA, 25 bp, Homo sapien
atccgggagatggcctgcaccacag

SEQ ID NO: 179595 - DNA, 25 bp, Homo sapien
cgggagatggcctgcaccacaggag

SEQ ID NO: 179596 - DNA, 25 bp, Homo sapien
gctgagctgaagctggattattaaa

SEQ ID NO: 179597 - DNA, 25 bp, Homo sapien
tgagctgaagctggattattaaagt

SEQ ID NO: 179598 - DNA, 25 bp, Homo sapien
gagctgaagctggattattaaagtg

SEQ ID NO: 179599 - DNA, 25 bp, Homo sapien
ctgaagctggattattaaagtggat

SEQ ID NO: 179600 - DNA, 25 bp, Homo sapien
atcaggtaaaaatttctcttggctt

SEQ ID NO: 179601 - DNA, 25 bp, Homo sapien
aaaatttctcttggctttagatgac

SEQ ID NO: 179602 - DNA, 25 bp, Homo sapien
ggctttagatgacatttagccctaa

SEQ ID NO: 179603 - DNA, 25 bp, Homo sapien
catttagccctaagattggaagaat

SEQ ID NO: 179604 - DNA, 25 bp, Homo sapien
gtttagagtaattcacttcaggaag

SEQ ID NO: 179605 - DNA, 25 bp, Homo sapien
cttcaggaagttacttggttcccat

SEQ ID NO: 179606 - DNA, 25 bp, Homo sapien
ggttcccataatagcttccagtatt

SEQ ID NO: 179607 - DNA, 25 bp, Homo sapien
atagcttccagtattcattgattta

SEQ ID NO: 179608 - DNA, 25 bp, Homo sapien
tatttctggctttcccagactagaa

SEQ ID NO: 179609 - DNA, 25 bp, Homo sapien
tggctttcccagactagaaattttg

SEQ ID NO: 179610 - DNA, 25 bp, Homo sapien
ggaagctagggctaaccagaaaata

SEQ ID NO: 179611 - DNA, 25 bp, Homo sapien
tttggacaaaggcaaaccgtctaat

SEQ ID NO: 179612 - DNA, 25 bp, Homo sapien
tttccggacttttaaatgctaactg

SEQ ID NO: 179613 - DNA, 25 bp, Homo sapien
tttccccttcctgtctaggaaaatg

SEQ ID NO: 179614 - DNA, 25 bp, Homo sapien
gaatgacttatacgttttgttttga

SEQ ID NO: 179615 - DNA, 25 bp, Homo sapien
tttgttttgaatacctaagagatac

SEQ ID NO: 179616 - DNA, 25 bp, Homo sapien
tggatatttatattgccatattctt

SEQ ID NO: 179617 - DNA, 25 bp, Homo sapien
tgccatattcttacttgaatgcttt

SEQ ID NO: 179618 - DNA, 25 bp, Homo sapien
gaatgctttgaatgactacatccag

SEQ ID NO: 179619 - DNA, 25 bp, Homo sapien
gaatgactacatccagttctgcacc

SEQ ID NO: 179620 - DNA, 25 bp, Homo sapien
agttctgcacctataccctctggtg

SEQ ID NO: 179621 - DNA, 25 bp, Homo sapien
acctataccctctggtgttgctttt

SEQ ID NO: 179622 - DNA, 25 bp, Homo sapien
cccgcccactctgtatatatgtaag

SEQ ID NO: 179623 - DNA, 25 bp, Homo sapien
gggctgtggccgtctttgtactctg

SEQ ID NO: 179624 - DNA, 25 bp, Homo sapien
gctgtggccgtctttgtactctggt

SEQ ID NO: 179625 - DNA, 25 bp, Homo sapien
tgtggccgtctttgtactctggtga

SEQ ID NO: 179626 - DNA, 25 bp, Homo sapien
gtggccgtctttgtactctggtgat

SEQ ID NO: 179627 - DNA, 25 bp, Homo sapien
tggccgtctttgtactctggtgatt

SEQ ID NO: 179628 - DNA, 25 bp, Homo sapien
ggccgtctttgtactctggtgattt

SEQ ID NO: 179629 - DNA, 25 bp, Homo sapien
gccgtctttgtactctggtgatttt

SEQ ID NO: 179630 - DNA, 25 bp, Homo sapien
aaattgaatctttgtacttgcattg

SEQ ID NO: 179631 - DNA, 25 bp, Homo sapien
tgagccaccaccaggcctgattgta

SEQ ID NO: 179632 - DNA, 25 bp, Homo sapien
gagaaataaaatcatcaaaccccaa

SEQ ID NO: 179633 - DNA, 25 bp, Homo sapien
tttatgccacggactaagacccagt

SEQ ID NO: 179634 - DNA, 25 bp, Homo sapien
gctctttgagagtttacgcccatga

SEQ ID NO: 179635 - DNA, 25 bp, Homo sapien
ttacgcccatgactgcagaagactg

SEQ ID NO: 179636 - DNA, 25 bp, Homo sapien
acaggtatcagcacatcagatgtct

SEQ ID NO: 179637 - DNA, 25 bp, Homo sapien
gtttcagtttcatctggcattccaa

SEQ ID NO: 179638 - DNA, 25 bp, Homo sapien
ggcattccaacatgtcagtgatact

SEQ ID NO: 179639 - DNA, 25 bp, Homo sapien
tgggtagagtaactctcccactcca

SEQ ID NO: 179640 - DNA, 25 bp, Homo sapien
actgtgtatagtcaacctcatcatt

SEQ ID NO: 179641 - DNA, 25 bp, Homo sapien
gttttgctaaaactggctcaatcct

SEQ ID NO: 179642 - DNA, 25 bp, Homo sapien
ggctcaatccttctgatcattgcag

SEQ ID NO: 179643 - DNA, 25 bp, Homo sapien
gcagagttttctctcaaacatgaac

SEQ ID NO: 179644 - DNA, 25 bp, Homo sapien
agctcttggttgcacatgttatgaa

SEQ ID NO: 179645 - DNA, 25 bp, Homo sapien
ctttgtcatggtaagttctactcat

SEQ ID NO: 179646 - DNA, 25 bp, Homo sapien
aagttctactcattttcacttcttt

SEQ ID NO: 179647 - DNA, 25 bp, Homo sapien
tacatttaaatttcttattgccaaa

SEQ ID NO: 179648 - DNA, 25 bp, Homo sapien
tattgccaaaagaacgtgttttatg

SEQ ID NO: 179649 - DNA, 25 bp, Homo sapien
gggagaaacaaactctttgaagcca

SEQ ID NO: 179650 - DNA, 25 bp, Homo sapien
aaactctttgaagccagttatgtca

SEQ ID NO: 179651 - DNA, 25 bp, Homo sapien
gaaaagattgtgtgtcacccctgtt

SEQ ID NO: 179652 - DNA, 25 bp, Homo sapien
gtgtgtcacccctgtttattcttga

SEQ ID NO: 179653 - DNA, 25 bp, Homo sapien
gtttattcttgaacagagggcaaag

SEQ ID NO: 179654 - DNA, 25 bp, Homo sapien
caaagagggcactgggcacttctca

SEQ ID NO: 179655 - DNA, 25 bp, Homo sapien
ggcatcttcgttctgattccggtga

SEQ ID NO: 179656 - DNA, 25 bp, Homo sapien
tgattccggtgagctggacagccaa

SEQ ID NO: 179657 - DNA, 25 bp, Homo sapien
gagatttctacaacccagccatcca

SEQ ID NO: 179658 - DNA, 25 bp, Homo sapien
gccatccacataggtcagaaacgag

SEQ ID NO: 179659 - DNA, 25 bp, Homo sapien
agctgggagcagcacttttccttgg

SEQ ID NO: 179660 - DNA, 25 bp, Homo sapien
acttttccttggctgggcaagcgct

SEQ ID NO: 179661 - DNA, 25 bp, Homo sapien
aagcgctgctgtcctcttcattgga

SEQ ID NO: 179662 - DNA, 25 bp, Homo sapien
gctttgtggattttgctgctgcaac

SEQ ID NO: 179663 - DNA, 25 bp, Homo sapien
gggtacagatatccagtgcctggct

SEQ ID NO: 179664 - DNA, 25 bp, Homo sapien
tggctaccgtgtgccacacacagat

SEQ ID NO: 179665 - DNA, 25 bp, Homo sapien
ttagtaagacctccaccagttatgt

SEQ ID NO: 179666 - DNA, 25 bp, Homo sapien
tgccttttcagacattgatttggac

SEQ ID NO: 179667 - DNA, 25 bp, Homo sapien
attgatttggacagctcaccaaccc

SEQ ID NO: 179668 - DNA, 25 bp, Homo sapien
ggacagctcaccaacccctgaaggg

SEQ ID NO: 179669 - DNA, 25 bp, Homo sapien
gccgttcagcctggttagttttcta

SEQ ID NO: 179670 - DNA, 25 bp, Homo sapien
ttagttttctacctactccgagtgt

SEQ ID NO: 179671 - DNA, 25 bp, Homo sapien
gccaaattgttgacacttctttttt

SEQ ID NO: 179672 - DNA, 25 bp, Homo sapien
ttcttttttcctatgcactggtttt

SEQ ID NO: 179673 - DNA, 25 bp, Homo sapien
ttttcctatgcactggttttacaca

SEQ ID NO: 179674 - DNA, 25 bp, Homo sapien
aaattgcagcagtcccacagatgtg

SEQ ID NO: 179675 - DNA, 25 bp, Homo sapien
ccacagatgtgtgcatttggacaaa

SEQ ID NO: 179676 - DNA, 25 bp, Homo sapien
cagctcctcaatactacctggaaaa

SEQ ID NO: 179677 - DNA, 25 bp, Homo sapien
attagtccggcgtggtggcacactc

SEQ ID NO: 179678 - DNA, 25 bp, Homo sapien
ttagtccggcgtggtggcacactcc

SEQ ID NO: 179679 - DNA, 25 bp, Homo sapien
agaatcacttggactccaaaggtgg

SEQ ID NO: 179680 - DNA, 25 bp, Homo sapien
gaatcacttggactccaaaggtgga

SEQ ID NO: 179681 - DNA, 25 bp, Homo sapien
tcacttggactccaaaggtggaggt

SEQ ID NO: 179682 - DNA, 25 bp, Homo sapien
actgcaccctagcttgggtggcaaa

SEQ ID NO: 179683 - DNA, 25 bp, Homo sapien
gcaccctagcttgggtggcaaagca

SEQ ID NO: 179684 - DNA, 25 bp, Homo sapien
ccctagcttgggtggcaaagcaaaa

SEQ ID NO: 179685 - DNA, 25 bp, Homo sapien
cttgggtggcaaagcaaaactctat

SEQ ID NO: 179686 - DNA, 25 bp, Homo sapien
ggtggcaaagcaaaactctatcaaa

SEQ ID NO: 179687 - DNA, 25 bp, Homo sapien
taaatttgttcaaaagtcctgccga

SEQ ID NO: 179688 - DNA, 25 bp, Homo sapien
gacaggctgttgtggcgtgaggcca

SEQ ID NO: 179689 - DNA, 25 bp, Homo sapien
gctgttgtggcgtgaggccaagctg

SEQ ID NO: 179690 - DNA, 25 bp, Homo sapien
ctgcttggacacagctcggtggaag

SEQ ID NO: 179691 - DNA, 25 bp, Homo sapien
tgcttggacacagctcggtggaaga

SEQ ID NO: 179692 - DNA, 25 bp, Homo sapien
cttggacacagctcggtggaagatg

SEQ ID NO: 179693 - DNA, 25 bp, Homo sapien
ggacacagctcggtggaagatgcga

SEQ ID NO: 179694 - DNA, 25 bp, Homo sapien
tgcgagggcaacgatggagctctat

SEQ ID NO: 179695 - DNA, 25 bp, Homo sapien
gagggcaacgatggagctctatcaa

SEQ ID NO: 179696 - DNA, 25 bp, Homo sapien
gggcaacgatggagctctatcaaat

SEQ ID NO: 179697 - DNA, 25 bp, Homo sapien
gcaacgatggagctctatcaaatct

SEQ ID NO: 179698 - DNA, 25 bp, Homo sapien
cgatggagctctatcaaatctccca

SEQ ID NO: 179699 - DNA, 25 bp, Homo sapien
acagaagggcagtgactcgacaaag

SEQ ID NO: 179700 - DNA, 25 bp, Homo sapien
cagaagggcagtgactcgacaaagg

SEQ ID NO: 179701 - DNA, 25 bp, Homo sapien
agaagggcagtgactcgacaaaggc

SEQ ID NO: 179702 - DNA, 25 bp, Homo sapien
gaagggcagtgactcgacaaaggcc

SEQ ID NO: 179703 - DNA, 25 bp, Homo sapien
aagggcagtgactcgacaaaggcca

SEQ ID NO: 179704 - DNA, 25 bp, Homo sapien
agggcagtgactcgacaaaggccac

SEQ ID NO: 179705 - DNA, 25 bp, Homo sapien
gggcagtgactcgacaaaggccaca

SEQ ID NO: 179706 - DNA, 25 bp, Homo sapien
ggcagtgactcgacaaaggccacag

SEQ ID NO: 179707 - DNA, 25 bp, Homo sapien
gcagtgactcgacaaaggccacagg

SEQ ID NO: 179708 - DNA, 25 bp, Homo sapien
cagtgactcgacaaaggccacaggc

SEQ ID NO: 179709 - DNA, 25 bp, Homo sapien
gccgtgagtatctaccagttctacg

SEQ ID NO: 179710 - DNA, 25 bp, Homo sapien
gagtatctaccagttctacggtcag

SEQ ID NO: 179711 - DNA, 25 bp, Homo sapien
atctaccagttctacggtcaggcta

SEQ ID NO: 179712 - DNA, 25 bp, Homo sapien
agttctacggtcaggctactgctga

SEQ ID NO: 179713 - DNA, 25 bp, Homo sapien
tacggtcaggctactgctgaggact

SEQ ID NO: 179714 - DNA, 25 bp, Homo sapien
cggtcaggctactgctgaggactca

SEQ ID NO: 179715 - DNA, 25 bp, Homo sapien
aggaagcccagaaatgcccagccga

SEQ ID NO: 179716 - DNA, 25 bp, Homo sapien
gcccagccgaaagtgagactcctaa

SEQ ID NO: 179717 - DNA, 25 bp, Homo sapien
agccgaaagtgagactcctaaaggg

SEQ ID NO: 179718 - DNA, 25 bp, Homo sapien
agatgtgctgctcaagggagcccca

SEQ ID NO: 179719 - DNA, 25 bp, Homo sapien
gctgctcaagggagccccaagggct

SEQ ID NO: 179720 - DNA, 25 bp, Homo sapien
gaattgattcttatttcactgatac

SEQ ID NO: 179721 - DNA, 25 bp, Homo sapien
gattcttatttcactgatactatta

SEQ ID NO: 179722 - DNA, 25 bp, Homo sapien
gatactattaatcatgcagtgtaca

SEQ ID NO: 179723 - DNA, 25 bp, Homo sapien
cagtgtacaattcaaaatcatgcaa

SEQ ID NO: 179724 - DNA, 25 bp, Homo sapien
aatcatgcaatgtttcactttagaa

SEQ ID NO: 179725 - DNA, 25 bp, Homo sapien
gcaatgtttcactttagaattggat

SEQ ID NO: 179726 - DNA, 25 bp, Homo sapien
agaattggatttgaagaactcgact

SEQ ID NO: 179727 - DNA, 25 bp, Homo sapien
agaactcgactttatgtgatcatgg

SEQ ID NO: 179728 - DNA, 25 bp, Homo sapien
ttatgtgatcatggtattggtatac

SEQ ID NO: 179729 - DNA, 25 bp, Homo sapien
tttttcattttgtcacaataggtat

SEQ ID NO: 179730 - DNA, 25 bp, Homo sapien
ataggtatatactgacaaggcttca

SEQ ID NO: 179731 - DNA, 25 bp, Homo sapien
atcaccgtggagtcggacttcagca

SEQ ID NO: 179732 - DNA, 25 bp, Homo sapien
ggacttcagcaacccgctgtatgaa

SEQ ID NO: 179733 - DNA, 25 bp, Homo sapien
tcagcaacccgctgtatgaagctgg

SEQ ID NO: 179734 - DNA, 25 bp, Homo sapien
tacgcgggagtatgaagtttccatc

SEQ ID NO: 179735 - DNA, 25 bp, Homo sapien
aagtttccatctgaaccccaagact

SEQ ID NO: 179736 - DNA, 25 bp, Homo sapien
tgaaccccaagactacagctgcagg

SEQ ID NO: 179737 - DNA, 25 bp, Homo sapien
ctcattcgggcagagggaaatacgg

SEQ ID NO: 179738 - DNA, 25 bp, Homo sapien
gaaatacgggacccggtctctgcct

SEQ ID NO: 179739 - DNA, 25 bp, Homo sapien
tccctggctgtgtaaatagtctccc

SEQ ID NO: 179740 - DNA, 25 bp, Homo sapien
tgtgtaaatagtctccctatcccac

SEQ ID NO: 179741 - DNA, 25 bp, Homo sapien
aaatagtctccctatcccacgaggg

SEQ ID NO: 179742 - DNA, 25 bp, Homo sapien
aatactgccctggtctagtgggagc

SEQ ID NO: 179743 - DNA, 25 bp, Homo sapien
ccaagaggccacctgtcactcatgg

SEQ ID NO: 179744 - DNA, 25 bp, Homo sapien
gagagtgacaccatggagggtacaa

SEQ ID NO: 179745 - DNA, 25 bp, Homo sapien
tggagggtacaattgccagctcccc

SEQ ID NO: 179746 - DNA, 25 bp, Homo sapien
tctgtgcaggattgtctgggttgaa

SEQ ID NO: 179747 - DNA, 25 bp, Homo sapien
gtctgggttgaatgacactctcaaa

SEQ ID NO: 179748 - DNA, 25 bp, Homo sapien
gaatgacactctcaaattgttcctg

SEQ ID NO: 179749 - DNA, 25 bp, Homo sapien
caaattgttcctgggatcgggctga

SEQ ID NO: 179750 - DNA, 25 bp, Homo sapien
tctctgcttggtctgaccccttggc

SEQ ID NO: 179751 - DNA, 25 bp, Homo sapien
ttggcctatccagttttcctggttc

SEQ ID NO: 179752 - DNA, 25 bp, Homo sapien
ttccctcacaggtttctccagaaag

SEQ ID NO: 179753 - DNA, 25 bp, Homo sapien
ttatggaccctggagttcttatgta

SEQ ID NO: 179754 - DNA, 25 bp, Homo sapien
tggaccctggagttcttatgtaccg

SEQ ID NO: 179755 - DNA, 25 bp, Homo sapien
tggagttcttatgtaccgcattatg

SEQ ID NO: 179756 - DNA, 25 bp, Homo sapien
gactccacatttatgaatatcaagc

SEQ ID NO: 179757 - DNA, 25 bp, Homo sapien
aagactgatcttccaagcaatttca

SEQ ID NO: 179758 - DNA, 25 bp, Homo sapien
gatcttccaagcaatttcagcaacc

SEQ ID NO: 179759 - DNA, 25 bp, Homo sapien
ttcagcaaccatgagtttctggccc

SEQ ID NO: 179760 - DNA, 25 bp, Homo sapien
agcaaccatgagtttctggccccat

SEQ ID NO: 179761 - DNA, 25 bp, Homo sapien
agtttctggccccatgccaagatta

SEQ ID NO: 179762 - DNA, 25 bp, Homo sapien
ccatgccaagattacccatatgtta

SEQ ID NO: 179763 - DNA, 25 bp, Homo sapien
acccatatgttatgacagataagtt

SEQ ID NO: 179764 - DNA, 25 bp, Homo sapien
gaccatggtgatgagatcttctcag

SEQ ID NO: 179765 - DNA, 25 bp, Homo sapien
tcttctcagtatttggatctccatt

SEQ ID NO: 179766 - DNA, 25 bp, Homo sapien
aagaggagaccaacctcagcaagat

SEQ ID NO: 179767 - DNA, 25 bp, Homo sapien
gaaccccaatggtggagggctgccc

SEQ ID NO: 179768 - DNA, 25 bp, Homo sapien
ccactggccaagaaatatgaccaag

SEQ ID NO: 179769 - DNA, 25 bp, Homo sapien
ggtatctgaagattggtgcctcaac

SEQ ID NO: 179770 - DNA, 25 bp, Homo sapien
aagattggtgcctcaactcaggcag

SEQ ID NO: 179771 - DNA, 25 bp, Homo sapien
tcaactcaggcagcccagaggctga

SEQ ID NO: 179772 - DNA, 25 bp, Homo sapien
gaagtgagtttttgggctgagctca

SEQ ID NO: 179773 - DNA, 25 bp, Homo sapien
agctcagggccaaggagtcagccca

SEQ ID NO: 179774 - DNA, 25 bp, Homo sapien
aggagtcagcccagaggccatccca

SEQ ID NO: 179775 - DNA, 25 bp, Homo sapien
ctctctgtgtactgccgctgtgtcc

SEQ ID NO: 179776 - DNA, 25 bp, Homo sapien
ccacagacctgcacattgttgtcac

SEQ ID NO: 179777 - DNA, 25 bp, Homo sapien
agcccagatgccatgccctgggcgg

SEQ ID NO: 179778 - DNA, 25 bp, Homo sapien
catcttctctggcagactcagccca

SEQ ID NO: 179779 - DNA, 25 bp, Homo sapien
tgccttgccagtcttgccaggtggt

SEQ ID NO: 179780 - DNA, 25 bp, Homo sapien
tgccagtcttgccaggtggtctacc

SEQ ID NO: 179781 - DNA, 25 bp, Homo sapien
tgtccctgcagactcagtgcagcac

SEQ ID NO: 179782 - DNA, 25 bp, Homo sapien
cagtgcagcacttccacaccaagaa

SEQ ID NO: 179783 - DNA, 25 bp, Homo sapien
tgaagcagccacaggttggccaagc

SEQ ID NO: 179784 - DNA, 25 bp, Homo sapien
acaggttggccaagcaccctcgagt

SEQ ID NO: 179785 - DNA, 25 bp, Homo sapien
gttggccaagcaccctcgagtgcca

SEQ ID NO: 179786 - DNA, 25 bp, Homo sapien
aaggagaccattggccatccaggaa

SEQ ID NO: 179787 - DNA, 25 bp, Homo sapien
gagaccattggccatccaggaaatt

SEQ ID NO: 179788 - DNA, 25 bp, Homo sapien
ggccatccaggaaatttcgtacagc

SEQ ID NO: 179789 - DNA, 25 bp, Homo sapien
tttcgtacagctgaaatataggcag

SEQ ID NO: 179790 - DNA, 25 bp, Homo sapien
aaatataggcaggatgttcaacatc

SEQ ID NO: 179791 - DNA, 25 bp, Homo sapien
gttcaacatcagtttacttgcagct

SEQ ID NO: 179792 - DNA, 25 bp, Homo sapien
atcagtttacttgcagctggaagca

SEQ ID NO: 179793 - DNA, 25 bp, Homo sapien
ttacttgcagctggaagcatttgtt

SEQ ID NO: 179794 - DNA, 25 bp, Homo sapien
gtcattgtacatgttgaaaggtttc

SEQ ID NO: 179795 - DNA, 25 bp, Homo sapien
tgaaaggtttctatggtactaaaag

SEQ ID NO: 179796 - DNA, 25 bp, Homo sapien
aattgggcagtgaaataaatgtatc

SEQ ID NO: 179797 - DNA, 25 bp, Homo sapien
taccaaccacgacaggcttcaccgg

SEQ ID NO: 179798 - DNA, 25 bp, Homo sapien
gaaggcagtgcgatactttgccgat

SEQ ID NO: 179799 - DNA, 25 bp, Homo sapien
gcagtgcgatactttgccgatgctg

SEQ ID NO: 179800 - DNA, 25 bp, Homo sapien
agtgcgatactttgccgatgctggg

SEQ ID NO: 179801 - DNA, 25 bp, Homo sapien
gtgcgatactttgccgatgctgggc

SEQ ID NO: 179802 - DNA, 25 bp, Homo sapien
gagaccacggtggacttctacggcg

SEQ ID NO: 179803 - DNA, 25 bp, Homo sapien
acggtggacttctacggcgcacgtc

SEQ ID NO: 179804 - DNA, 25 bp, Homo sapien
agttcggagcgctggagcctgctac

SEQ ID NO: 179805 - DNA, 25 bp, Homo sapien
gcgctggagcctgctacaactggcg

SEQ ID NO: 179806 - DNA, 25 bp, Homo sapien
gagcctgctacaactggcgggcagc

SEQ ID NO: 179807 - DNA, 25 bp, Homo sapien
gagggccagtgcaggcgcctaccat

SEQ ID NO: 179808 - DNA, 25 bp, Homo sapien
aatgcatctgtaatggaccaagggc

SEQ ID NO: 179809 - DNA, 25 bp, Homo sapien
tgcatctgtaatggaccaagggcct

SEQ ID NO: 179810 - DNA, 25 bp, Homo sapien
gcatctgtaatggaccaagggcctg

SEQ ID NO: 179811 - DNA, 25 bp, Homo sapien
catctgtaatggaccaagggcctgc

SEQ ID NO: 179812 - DNA, 25 bp, Homo sapien
atctgtaatggaccaagggcctgcg

SEQ ID NO: 179813 - DNA, 25 bp, Homo sapien
gaacagggaggattctgacgaacag

SEQ ID NO: 179814 - DNA, 25 bp, Homo sapien
aacagggaggattctgacgaacagg

SEQ ID NO: 179815 - DNA, 25 bp, Homo sapien
cagggaggattctgacgaacaggac

SEQ ID NO: 179816 - DNA, 25 bp, Homo sapien
agggaggattctgacgaacaggacc

SEQ ID NO: 179817 - DNA, 25 bp, Homo sapien
gggaggattctgacgaacaggacca

SEQ ID NO: 179818 - DNA, 25 bp, Homo sapien
ggaggattctgacgaacaggaccat

SEQ ID NO: 179819 - DNA, 25 bp, Homo sapien
gtgtttaatgcacagctacttcaca

SEQ ID NO: 179820 - DNA, 25 bp, Homo sapien
atgcacagctacttcacaccttaaa

SEQ ID NO: 179821 - DNA, 25 bp, Homo sapien
tcacaccttaaacttgctttgattt

SEQ ID NO: 179822 - DNA, 25 bp, Homo sapien
acttgctttgatttggtgatgtaaa

SEQ ID NO: 179823 - DNA, 25 bp, Homo sapien
tagaactggtcatagaggaagagct

SEQ ID NO: 179824 - DNA, 25 bp, Homo sapien
gagctagaaatccagtagcatgatt

SEQ ID NO: 179825 - DNA, 25 bp, Homo sapien
ataacctgtctttgtttttgatgtt

SEQ ID NO: 179826 - DNA, 25 bp, Homo sapien
gtaaatgccagtagtgaccaagaac

SEQ ID NO: 179827 - DNA, 25 bp, Homo sapien
tacactatactggagggatttcatt

SEQ ID NO: 179828 - DNA, 25 bp, Homo sapien
gaagatttagaactcattccttgtg

SEQ ID NO: 179829 - DNA, 25 bp, Homo sapien
gaactcattccttgtgtttaaaggg

SEQ ID NO: 179830 - DNA, 25 bp, Homo sapien
caaacagaggctgcggttcaaagac

SEQ ID NO: 179831 - DNA, 25 bp, Homo sapien
agaggctgcggttcaaagacccaca

SEQ ID NO: 179832 - DNA, 25 bp, Homo sapien
tgcggttcaaagacccacacacgca

SEQ ID NO: 179833 - DNA, 25 bp, Homo sapien
acaagacccggtgctgcgttatgta

SEQ ID NO: 179834 - DNA, 25 bp, Homo sapien
acccggtgctgcgttatgtagctca

SEQ ID NO: 179835 - DNA, 25 bp, Homo sapien
tgctgcgttatgtagctcaggacct

SEQ ID NO: 179836 - DNA, 25 bp, Homo sapien
cgttatgtagctcaggaccttggct

SEQ ID NO: 179837 - DNA, 25 bp, Homo sapien
gcctggtcgtcatgtaggtcaggac

SEQ ID NO: 179838 - DNA, 25 bp, Homo sapien
gtcatgtaggtcaggaccttggctg

SEQ ID NO: 179839 - DNA, 25 bp, Homo sapien
acctccgtgcacttgtgtccgagga

SEQ ID NO: 179840 - DNA, 25 bp, Homo sapien
ccgtgcacttgtgtccgaggagcga

SEQ ID NO: 179841 - DNA, 25 bp, Homo sapien
gggacatcccaaaggtataccctgc

SEQ ID NO: 179842 - DNA, 25 bp, Homo sapien
ggacatcccaaaggtataccctgct

SEQ ID NO: 179843 - DNA, 25 bp, Homo sapien
acatcccaaaggtataccctgctct

SEQ ID NO: 179844 - DNA, 25 bp, Homo sapien
catcccaaaggtataccctgctctg

SEQ ID NO: 179845 - DNA, 25 bp, Homo sapien
atcccaaaggtataccctgctctgc

SEQ ID NO: 179846 - DNA, 25 bp, Homo sapien
caaaggtataccctgctctgccacc

SEQ ID NO: 179847 - DNA, 25 bp, Homo sapien
tataccctgctctgccacccatgaa

SEQ ID NO: 179848 - DNA, 25 bp, Homo sapien
gtgagtggcacccaatgcctctcag

SEQ ID NO: 179849 - DNA, 25 bp, Homo sapien
tgagtggcacccaatgcctctcagg

SEQ ID NO: 179850 - DNA, 25 bp, Homo sapien
gggcagctgtggagccccacgcaca

SEQ ID NO: 179851 - DNA, 25 bp, Homo sapien
acgcacaggccagtctcgcttggct

SEQ ID NO: 179852 - DNA, 25 bp, Homo sapien
ccctagttcaatctgtagtgaaata

SEQ ID NO: 179853 - DNA, 25 bp, Homo sapien
ataagactacagaaggcattgtttt

SEQ ID NO: 179854 - DNA, 25 bp, Homo sapien
aaatatgttttattgtcttctctaa

SEQ ID NO: 179855 - DNA, 25 bp, Homo sapien
atagtatttctctctgcgtcctatt

SEQ ID NO: 179856 - DNA, 25 bp, Homo sapien
ttctctctgcgtcctatttcattag

SEQ ID NO: 179857 - DNA, 25 bp, Homo sapien
ctctgcgtcctatttcattagtgaa

SEQ ID NO: 179858 - DNA, 25 bp, Homo sapien
gcgtcctatttcattagtgaagaca

SEQ ID NO: 179859 - DNA, 25 bp, Homo sapien
atagttcacctaaaatggcatcctg

SEQ ID NO: 179860 - DNA, 25 bp, Homo sapien
tagaaatggcatatgtttttgatga

SEQ ID NO: 179861 - DNA, 25 bp, Homo sapien
gatatgtcaacattcaaaattgtcc

SEQ ID NO: 179862 - DNA, 25 bp, Homo sapien
gtcaacattcaaaattgtcctaatt

SEQ ID NO: 179863 - DNA, 25 bp, Homo sapien
ctgctcccctggaggacagagggag

SEQ ID NO: 179864 - DNA, 25 bp, Homo sapien
gggagacagggctgctccccaacac

SEQ ID NO: 179865 - DNA, 25 bp, Homo sapien
tctgaccccagcatttccagagcag

SEQ ID NO: 179866 - DNA, 25 bp, Homo sapien
ccagagcagagcctacagaagggca

SEQ ID NO: 179867 - DNA, 25 bp, Homo sapien
agagcagagcctacagaagggcagt

SEQ ID NO: 179868 - DNA, 25 bp, Homo sapien
agcagagcctacagaagggcagtga

SEQ ID NO: 179869 - DNA, 25 bp, Homo sapien
ggcagtgactcgacaaaggccacag

SEQ ID NO: 179870 - DNA, 25 bp, Homo sapien
aaggccacaggcagtccaggcctct

SEQ ID NO: 179871 - DNA, 25 bp, Homo sapien
ccacacctggcatggtgcagggaga

SEQ ID NO: 179872 - DNA, 25 bp, Homo sapien
tgcagggagacatctgcacccctga

SEQ ID NO: 179873 - DNA, 25 bp, Homo sapien
gcacccctgagttgggcagccagga

SEQ ID NO: 179874 - DNA, 25 bp, Homo sapien
tattgcccggctcctagaatttatt

SEQ ID NO: 179875 - DNA, 25 bp, Homo sapien
tatttcctgacttacagcaagcgag

SEQ ID NO: 179876 - DNA, 25 bp, Homo sapien
ttcctgacttacagcaagcgagtta

SEQ ID NO: 179877 - DNA, 25 bp, Homo sapien
tgacttacagcaagcgagttatcgt

SEQ ID NO: 179878 - DNA, 25 bp, Homo sapien
tacagcaagcgagttatcgtcttct

SEQ ID NO: 179879 - DNA, 25 bp, Homo sapien
gcaagcgagttatcgtcttctgtat

SEQ ID NO: 179880 - DNA, 25 bp, Homo sapien
agcgagttatcgtcttctgtatttt

SEQ ID NO: 179881 - DNA, 25 bp, Homo sapien
gcgagttatcgtcttctgtattttg

SEQ ID NO: 179882 - DNA, 25 bp, Homo sapien
gagttatcgtcttctgtattttgta

SEQ ID NO: 179883 - DNA, 25 bp, Homo sapien
gttatcgtcttctgtattttgtaga

SEQ ID NO: 179884 - DNA, 25 bp, Homo sapien
cttctgtattttgtagactttctaa

SEQ ID NO: 179885 - DNA, 25 bp, Homo sapien
gaactacctatccagtgcccagttt

SEQ ID NO: 179886 - DNA, 25 bp, Homo sapien
gtttgtacagccctcttgtatagca

SEQ ID NO: 179887 - DNA, 25 bp, Homo sapien
gctcttctcagaagtgacaccaacc

SEQ ID NO: 179888 - DNA, 25 bp, Homo sapien
accaaccccgtgttagagcattagc

SEQ ID NO: 179889 - DNA, 25 bp, Homo sapien
ttagcagatgtccactgcgttgtcc

SEQ ID NO: 179890 - DNA, 25 bp, Homo sapien
agcctccactcgtgtccatggtgtc

SEQ ID NO: 179891 - DNA, 25 bp, Homo sapien
tggcaaacttgggtttacctgcctg

SEQ ID NO: 179892 - DNA, 25 bp, Homo sapien
tttacctgcctgtagacaagtctct

SEQ ID NO: 179893 - DNA, 25 bp, Homo sapien
acaagtctctctcataccaacagaa

SEQ ID NO: 179894 - DNA, 25 bp, Homo sapien
ccaacagaacttccggtacttccag

SEQ ID NO: 179895 - DNA, 25 bp, Homo sapien
gtacttccagaaccaactcacctga

SEQ ID NO: 179896 - DNA, 25 bp, Homo sapien
ctgccccagggggatatgggtcctc

SEQ ID NO: 179897 - DNA, 25 bp, Homo sapien
tgccccagggggatatgggtcctct

SEQ ID NO: 179898 - DNA, 25 bp, Homo sapien
ggggatatgggtcctctggggcctt

SEQ ID NO: 179899 - DNA, 25 bp, Homo sapien
ggggcaggggtgcttcctcctcagg

SEQ ID NO: 179900 - DNA, 25 bp, Homo sapien
gggcaggggtgcttcctcctcaggc

SEQ ID NO: 179901 - DNA, 25 bp, Homo sapien
ggcaggggtgcttcctcctcaggcc

SEQ ID NO: 179902 - DNA, 25 bp, Homo sapien
gcaggggtgcttcctcctcaggccc

SEQ ID NO: 179903 - DNA, 25 bp, Homo sapien
caggggtgcttcctcctcaggccca

SEQ ID NO: 179904 - DNA, 25 bp, Homo sapien
aggatgtgtcgcaccagcagctctg

SEQ ID NO: 179905 - DNA, 25 bp, Homo sapien
agtgccgtggtctgcgtgctctgca

SEQ ID NO: 179906 - DNA, 25 bp, Homo sapien
tggcagccgcgtgtccacacagtta

SEQ ID NO: 179907 - DNA, 25 bp, Homo sapien
gtgtccacacagttagcggagcgca

SEQ ID NO: 179908 - DNA, 25 bp, Homo sapien
acagttagcggagcgcaggacttct

SEQ ID NO: 179909 - DNA, 25 bp, Homo sapien
gcaggacttctgcagtcctcaggtg

SEQ ID NO: 179910 - DNA, 25 bp, Homo sapien
cctgggtcgctgtcatctgtgttta

SEQ ID NO: 179911 - DNA, 25 bp, Homo sapien
cgctgtcatctgtgtttagctcggg

SEQ ID NO: 179912 - DNA, 25 bp, Homo sapien
gggcgaactgacctcaggcatgtct

SEQ ID NO: 179913 - DNA, 25 bp, Homo sapien
aggcatgtcttgtaactgtagaggc

SEQ ID NO: 179914 - DNA, 25 bp, Homo sapien
gtcttgtaactgtagaggcgcctgc

SEQ ID NO: 179915 - DNA, 25 bp, Homo sapien
gggaaatttttgtcactgcataata

SEQ ID NO: 179916 - DNA, 25 bp, Homo sapien
aatttttgtcactgcataatattac

SEQ ID NO: 179917 - DNA, 25 bp, Homo sapien
tgtcactgcataatattacaaatat

SEQ ID NO: 179918 - DNA, 25 bp, Homo sapien
acagtgtttccacatttaatggagt

SEQ ID NO: 179919 - DNA, 25 bp, Homo sapien
tttaatggagtatcagttgcttcag

SEQ ID NO: 179920 - DNA, 25 bp, Homo sapien
ggagtatcagttgcttcagattttc

SEQ ID NO: 179921 - DNA, 25 bp, Homo sapien
tgtcggaatcccgtgcttaaaatac

SEQ ID NO: 179922 - DNA, 25 bp, Homo sapien
ggaatcccgtgcttaaaatacgctc

SEQ ID NO: 179923 - DNA, 25 bp, Homo sapien
aatcccgtgcttaaaatacgctctt

SEQ ID NO: 179924 - DNA, 25 bp, Homo sapien
tcccgtgcttaaaatacgctcttaa

SEQ ID NO: 179925 - DNA, 25 bp, Homo sapien
gtgcttaaaatacgctcttaaatta

SEQ ID NO: 179926 - DNA, 25 bp, Homo sapien
cctgctctgtgcagcagtcgggctg

SEQ ID NO: 179927 - DNA, 25 bp, Homo sapien
tccaggaaccttgaagccaatctgg

SEQ ID NO: 179928 - DNA, 25 bp, Homo sapien
gatgtttgacaaagaggtaccaggc

SEQ ID NO: 179929 - DNA, 25 bp, Homo sapien
gaggtaccaggcaaacttcctgcta

SEQ ID NO: 179930 - DNA, 25 bp, Homo sapien
ttcctgctacacatgccctgaatga

SEQ ID NO: 179931 - DNA, 25 bp, Homo sapien
cacatgccctgaatgaattgctaaa

SEQ ID NO: 179932 - DNA, 25 bp, Homo sapien
atttcaaaggaaatggaccctgctt

SEQ ID NO: 179933 - DNA, 25 bp, Homo sapien
ggaaatggaccctgcttttaaggat

SEQ ID NO: 179934 - DNA, 25 bp, Homo sapien
agtatgtctgcatcgatgtctgtac

SEQ ID NO: 179935 - DNA, 25 bp, Homo sapien
gcatcgatgtctgtactgtaaattt

SEQ ID NO: 179936 - DNA, 25 bp, Homo sapien
ctgtacaaagaaaaccccttgctat

SEQ ID NO: 179937 - DNA, 25 bp, Homo sapien
acagctttcgatgctgctgcctgga

SEQ ID NO: 179938 - DNA, 25 bp, Homo sapien
gaagggttatgcagatatcgtccag

SEQ ID NO: 179939 - DNA, 25 bp, Homo sapien
atatcgtccagttgcttctggcaaa

SEQ ID NO: 179940 - DNA, 25 bp, Homo sapien
aagaagctggccttcgacatggcta

SEQ ID NO: 179941 - DNA, 25 bp, Homo sapien
atggctaccaatgctgcctgtgcat

SEQ ID NO: 179942 - DNA, 25 bp, Homo sapien
gcctgtgcatctctcctgaaaaaga

SEQ ID NO: 179943 - DNA, 25 bp, Homo sapien
gcaatgccgaggactatctcgatga

SEQ ID NO: 179944 - DNA, 25 bp, Homo sapien
gactcagattaattcctttctggag

SEQ ID NO: 179945 - DNA, 25 bp, Homo sapien
tcctttctggagctttgagatctaa

SEQ ID NO: 179946 - DNA, 25 bp, Homo sapien
aaacttctgttgcttttgccattcc

SEQ ID NO: 179947 - DNA, 25 bp, Homo sapien
ttgccattccaaaactttgtctttg

SEQ ID NO: 179948 - DNA, 25 bp, Homo sapien
actgaggccctctaggaggaaagcc

SEQ ID NO: 179949 - DNA, 25 bp, Homo sapien
tgaggccctctaggaggaaagccca

SEQ ID NO: 179950 - DNA, 25 bp, Homo sapien
gaggccctctaggaggaaagcccag

SEQ ID NO: 179951 - DNA, 25 bp, Homo sapien
aggccctctaggaggaaagcccaga

SEQ ID NO: 179952 - DNA, 25 bp, Homo sapien
ggccctctaggaggaaagcccagag

SEQ ID NO: 179953 - DNA, 25 bp, Homo sapien
gccctctaggaggaaagcccagagg

SEQ ID NO: 179954 - DNA, 25 bp, Homo sapien
tctaggaggaaagcccagagggagg

SEQ ID NO: 179955 - DNA, 25 bp, Homo sapien
gagggggccctcattccttcagacc

SEQ ID NO: 179956 - DNA, 25 bp, Homo sapien
tccttaccccgctgggctaggtctc

SEQ ID NO: 179957 - DNA, 25 bp, Homo sapien
tgggctaggtctccgccagggctgg

SEQ ID NO: 179958 - DNA, 25 bp, Homo sapien
ttccctccccgccacagtgaaataa

SEQ ID NO: 179959 - DNA, 25 bp, Homo sapien
gggcccgccttagccatgtgaaggt

SEQ ID NO: 179960 - DNA, 25 bp, Homo sapien
cccgccttagccatgtgaaggtgga

SEQ ID NO: 179961 - DNA, 25 bp, Homo sapien
tgtgaaggtggattggtcgccatct

SEQ ID NO: 179962 - DNA, 25 bp, Homo sapien
aaggtggattggtcgccatctgcac

SEQ ID NO: 179963 - DNA, 25 bp, Homo sapien
gattggtcgccatctgcacgccagg

SEQ ID NO: 179964 - DNA, 25 bp, Homo sapien
ggcatccttttctatgaagtgttga

SEQ ID NO: 179965 - DNA, 25 bp, Homo sapien
agtgttgactttgtaaatctgccca

SEQ ID NO: 179966 - DNA, 25 bp, Homo sapien
ttgactttgtaaatctgcccacacc

SEQ ID NO: 179967 - DNA, 25 bp, Homo sapien
actttgtaaatctgcccacacccag

SEQ ID NO: 179968 - DNA, 25 bp, Homo sapien
tgtaaatctgcccacacccagctgg

SEQ ID NO: 179969 - DNA, 25 bp, Homo sapien
atccacccctcgacgccgggatgag

SEQ ID NO: 179970 - DNA, 25 bp, Homo sapien
agctggaccactgcaggcgtgtctc

SEQ ID NO: 179971 - DNA, 25 bp, Homo sapien
tgagtgagcgcctcctgcacaagag

SEQ ID NO: 179972 - DNA, 25 bp, Homo sapien
agagcatccagaacagcctgcttgg

SEQ ID NO: 179973 - DNA, 25 bp, Homo sapien
tatcaaatctcccagagaatccgag

SEQ ID NO: 179974 - DNA, 25 bp, Homo sapien
ccagagaatccgagcccgccgaggg

SEQ ID NO: 179975 - DNA, 25 bp, Homo sapien
cccgcctggctgtgtcagactgaag

SEQ ID NO: 179976 - DNA, 25 bp, Homo sapien
tgtgtcagactgaagccccatccag

SEQ ID NO: 179977 - DNA, 25 bp, Homo sapien
atccagcccgttccgcagggactag

SEQ ID NO: 179978 - DNA, 25 bp, Homo sapien
cgcagggactagaggctttcggctt

SEQ ID NO: 179979 - DNA, 25 bp, Homo sapien
ggctttcggctttttgggacagcaa

SEQ ID NO: 179980 - DNA, 25 bp, Homo sapien
gggacagcaactaccttgcttttgg

SEQ ID NO: 179981 - DNA, 25 bp, Homo sapien
acctgtctctagtgtgtgacttcag

SEQ ID NO: 179982 - DNA, 25 bp, Homo sapien
ctgtctctagtgtgtgacttcagct

SEQ ID NO: 179983 - DNA, 25 bp, Homo sapien
gtctctagtgtgtgacttcagcttt

SEQ ID NO: 179984 - DNA, 25 bp, Homo sapien
ctctagtgtgtgacttcagctttac

SEQ ID NO: 179985 - DNA, 25 bp, Homo sapien
gacttcagctttactgaggaatctg

SEQ ID NO: 179986 - DNA, 25 bp, Homo sapien
gctttactgaggaatctgatggact

SEQ ID NO: 179987 - DNA, 25 bp, Homo sapien
ctgaggaatctgatggactttcata

SEQ ID NO: 179988 - DNA, 25 bp, Homo sapien
ttttgtctttttaatcacaggagtc

SEQ ID NO: 179989 - DNA, 25 bp, Homo sapien
tgtctttttaatcacaggagtctat

SEQ ID NO: 179990 - DNA, 25 bp, Homo sapien
tttttaatcacaggagtctattttt

SEQ ID NO: 179991 - DNA, 25 bp, Homo sapien
ctccagggcaactgggacaacaggc

SEQ ID NO: 179992 - DNA, 25 bp, Homo sapien
taccactctttagcagtgtgactgt

SEQ ID NO: 179993 - DNA, 25 bp, Homo sapien
agttctttaacttccatgagccaca

SEQ ID NO: 179994 - DNA, 25 bp, Homo sapien
acttccatgagccacaattttttca

SEQ ID NO: 179995 - DNA, 25 bp, Homo sapien
gaggcatcttatatcctacttagac

SEQ ID NO: 179996 - DNA, 25 bp, Homo sapien
atatcctacttagaccacaatgtgg

SEQ ID NO: 179997 - DNA, 25 bp, Homo sapien
atgtggtccgtaatgaatatctctt

SEQ ID NO: 179998 - DNA, 25 bp, Homo sapien
ttttcttttcatgtttaggtcttgt

SEQ ID NO: 179999 - DNA, 25 bp, Homo sapien
taggtcttgtagagtcagtgacact

SEQ ID NO: 180000 - DNA, 25 bp, Homo sapien
aaatctctaaatgttggtgctgtta

SEQ ID NO: 180001 - DNA, 25 bp, Homo sapien
tggtgctgttaataagttgtctaga

SEQ ID NO: 180002 - DNA, 25 bp, Homo sapien
gtctagagcaaatttatacagtgag

SEQ ID NO: 180003 - DNA, 25 bp, Homo sapien
aacccggacctgaatgtaatgcaag

SEQ ID NO: 180004 - DNA, 25 bp, Homo sapien
aaatgaccagctgcttagtcacctg

SEQ ID NO: 180005 - DNA, 25 bp, Homo sapien
tggcaaagcaggtgagcaacctcat

SEQ ID NO: 180006 - DNA, 25 bp, Homo sapien
agcaacctcatcactaatcattcaa

SEQ ID NO: 180007 - DNA, 25 bp, Homo sapien
aatcattcaagcttcgcagccaggg

SEQ ID NO: 180008 - DNA, 25 bp, Homo sapien
gcagccagggcgacttctatcaacc

SEQ ID NO: 180009 - DNA, 25 bp, Homo sapien
tatcaacccctgctctgctgagaac

SEQ ID NO: 180010 - DNA, 25 bp, Homo sapien
accatcaagcgcagggaagccacgt

SEQ ID NO: 180011 - DNA, 25 bp, Homo sapien
caggctccctcgtctgtgtagtgga

SEQ ID NO: 180012 - DNA, 25 bp, Homo sapien
gaacagcacccatctcttagtgttg

SEQ ID NO: 180013 - DNA, 25 bp, Homo sapien
gtgttgcctgagactaaagtgctta

SEQ ID NO: 180014 - DNA, 25 bp, Homo sapien
gtggaacccagcaggcatgagatga

SEQ ID NO: 180015 - DNA, 25 bp, Homo sapien
gcatgagatgaaccgcagtgcccat

SEQ ID NO: 180016 - DNA, 25 bp, Homo sapien
gagatgaaccgcagtgcccattggg

SEQ ID NO: 180017 - DNA, 25 bp, Homo sapien
atgaaccgcagtgcccattgggctg

SEQ ID NO: 180018 - DNA, 25 bp, Homo sapien
tgggctgggcagatgagatcctact

SEQ ID NO: 180019 - DNA, 25 bp, Homo sapien
ctgggcagatgagatcctactttct

SEQ ID NO: 180020 - DNA, 25 bp, Homo sapien
gatgagatcctactttctccccagg

SEQ ID NO: 180021 - DNA, 25 bp, Homo sapien
ccaggacctggaggcaggctgtctc

SEQ ID NO: 180022 - DNA, 25 bp, Homo sapien
ctctcaaggtggtcttttctgctgc

SEQ ID NO: 180023 - DNA, 25 bp, Homo sapien
aaggtggtcttttctgctgctagca

SEQ ID NO: 180024 - DNA, 25 bp, Homo sapien
gtcttttctgctgctagcaactcaa

SEQ ID NO: 180025 - DNA, 25 bp, Homo sapien
ataagctgcggctggggcgctacca

SEQ ID NO: 180026 - DNA, 25 bp, Homo sapien
cgctaccatggcaatgcgggtgact

SEQ ID NO: 180027 - DNA, 25 bp, Homo sapien
atggcaatgcgggtgactcctttac

SEQ ID NO: 180028 - DNA, 25 bp, Homo sapien
gcaatgcgggtgactcctttacatg

SEQ ID NO: 180029 - DNA, 25 bp, Homo sapien
ttacatggcacaacggcaagcagtt

SEQ ID NO: 180030 - DNA, 25 bp, Homo sapien
acagagatcatgatgtctacacagg

SEQ ID NO: 180031 - DNA, 25 bp, Homo sapien
gatcatgatgtctacacaggaaact

SEQ ID NO: 180032 - DNA, 25 bp, Homo sapien
tgatgtctacacaggaaactgtgcc

SEQ ID NO: 180033 - DNA, 25 bp, Homo sapien
gaaactgtgcccactaccagaaggg

SEQ ID NO: 180034 - DNA, 25 bp, Homo sapien
gctggtggtataacgcctgtgccca

SEQ ID NO: 180035 - DNA, 25 bp, Homo sapien
gtggtataacgcctgtgcccactcc

SEQ ID NO: 180036 - DNA, 25 bp, Homo sapien
gcagagatcttttagtgtaacatac

SEQ ID NO: 180037 - DNA, 25 bp, Homo sapien
tagagaattgttggctagctgtaca

SEQ ID NO: 180038 - DNA, 25 bp, Homo sapien
gttggctagctgtacatgttttgaa

SEQ ID NO: 180039 - DNA, 25 bp, Homo sapien
gctgtttagctagctataaggctat

SEQ ID NO: 180040 - DNA, 25 bp, Homo sapien
caaaacatttattcagtcatccagt

SEQ ID NO: 180041 - DNA, 25 bp, Homo sapien
atttattcagtcatccagtttgcta

SEQ ID NO: 180042 - DNA, 25 bp, Homo sapien
gttagaaattgtaaacactggtctt

SEQ ID NO: 180043 - DNA, 25 bp, Homo sapien
acactggtcttatgtttcatttgga

SEQ ID NO: 180044 - DNA, 25 bp, Homo sapien
ggtcttatgtttcatttggattcat

SEQ ID NO: 180045 - DNA, 25 bp, Homo sapien
attattgcattgtcttgttaccaga

SEQ ID NO: 180046 - DNA, 25 bp, Homo sapien
attgcattgtcttgttaccagaaac

SEQ ID NO: 180047 - DNA, 25 bp, Homo sapien
gtatgtgatgttgcacttagcagcc

SEQ ID NO: 180048 - DNA, 25 bp, Homo sapien
gttgcacttagcagccatgtggtgg

SEQ ID NO: 180049 - DNA, 25 bp, Homo sapien
tgtggtgggcatgtgtgactactct

SEQ ID NO: 180050 - DNA, 25 bp, Homo sapien
gactactctggttttcactttagtt

SEQ ID NO: 180051 - DNA, 25 bp, Homo sapien
ccctctcaagtccagcatggatggg

SEQ ID NO: 180052 - DNA, 25 bp, Homo sapien
cttgtttgcatttgtttccctttga

SEQ ID NO: 180053 - DNA, 25 bp, Homo sapien
tgctttgagctgtaccttgtccagt

SEQ ID NO: 180054 - DNA, 25 bp, Homo sapien
taccttgtccagtccattgtgaaat

SEQ ID NO: 180055 - DNA, 25 bp, Homo sapien
attgtgaaattatcccagcagctgt

SEQ ID NO: 180056 - DNA, 25 bp, Homo sapien
gtaatgtacagttccttctgaagca

SEQ ID NO: 180057 - DNA, 25 bp, Homo sapien
gttccttctgaagcaagcaacatca

SEQ ID NO: 180058 - DNA, 25 bp, Homo sapien
tatgtgacaaaacgccctgattcct

SEQ ID NO: 180059 - DNA, 25 bp, Homo sapien
gtgccaaaggttcaacttaatgtat

SEQ ID NO: 180060 - DNA, 25 bp, Homo sapien
tatggtgcttgaagtaaaacagccc

SEQ ID NO: 180061 - DNA, 25 bp, Homo sapien
agtaaaacagcccatcctctgcaag

SEQ ID NO: 180062 - DNA, 25 bp, Homo sapien
atcctctgcaagtccatctatgttg

SEQ ID NO: 180063 - DNA, 25 bp, Homo sapien
gtccatctatgttgttcttaggcat

SEQ ID NO: 180064 - DNA, 25 bp, Homo sapien
tcttaggcattctatctttgctcaa

SEQ ID NO: 180065 - DNA, 25 bp, Homo sapien
aggatggtgatttgtttcatggttt

SEQ ID NO: 180066 - DNA, 25 bp, Homo sapien
gaggcaatgcattattgtgtagcca

SEQ ID NO: 180067 - DNA, 25 bp, Homo sapien
tattgtgtagccacggttttctgga

SEQ ID NO: 180068 - DNA, 25 bp, Homo sapien
tgtagccacggttttctggaaaagt

SEQ ID NO: 180069 - DNA, 25 bp, Homo sapien
gggtgctttgcctgttttgggtaca

SEQ ID NO: 180070 - DNA, 25 bp, Homo sapien
ttggatttagcttgttaattgttca

SEQ ID NO: 180071 - DNA, 25 bp, Homo sapien
gttaattgttcaaactttctgcctt

SEQ ID NO: 180072 - DNA, 25 bp, Homo sapien
aaactttctgccttctacattccta

SEQ ID NO: 180073 - DNA, 25 bp, Homo sapien
ttctgccttctacattcctatctta

SEQ ID NO: 180074 - DNA, 25 bp, Homo sapien
cattcctatcttattgttcgtttaa

SEQ ID NO: 180075 - DNA, 25 bp, Homo sapien
tattgttcgtttaatcagtttctga

SEQ ID NO: 180076 - DNA, 25 bp, Homo sapien
gactattggtgagttgtgcctttta

SEQ ID NO: 180077 - DNA, 25 bp, Homo sapien
tactttttctcatatcctctataat

SEQ ID NO: 180078 - DNA, 25 bp, Homo sapien
tcatatcctctataattgacttcta

SEQ ID NO: 180079 - DNA, 25 bp, Homo sapien
tattttccttaatcaaaccagctct

SEQ ID NO: 180080 - DNA, 25 bp, Homo sapien
gaactccagaatgagtgttgaccac

SEQ ID NO: 180081 - DNA, 25 bp, Homo sapien
gagtgttgaccactgaagcatcttt

SEQ ID NO: 180082 - DNA, 25 bp, Homo sapien
agtctgtgttccattgtgccattca

SEQ ID NO: 180083 - DNA, 25 bp, Homo sapien
ctgtgttccattgtgccattcaggt

SEQ ID NO: 180084 - DNA, 25 bp, Homo sapien
gtgccattcaggtttgctgtcacat

SEQ ID NO: 180085 - DNA, 25 bp, Homo sapien
tcaggtttgctgtcacatatgcatc

SEQ ID NO: 180086 - DNA, 25 bp, Homo sapien
tgctgtcacatatgcatcatctgaa

SEQ ID NO: 180087 - DNA, 25 bp, Homo sapien
atatgcatcatctgaaatcatttga

SEQ ID NO: 180088 - DNA, 25 bp, Homo sapien
aatatcctggatttgatcctgaagg

SEQ ID NO: 180089 - DNA, 25 bp, Homo sapien
atcctgaaggaaactagtaagatca

SEQ ID NO: 180090 - DNA, 25 bp, Homo sapien
tagtaagatcagatttttgggtcat

SEQ ID NO: 180091 - DNA, 25 bp, Homo sapien
aagaaagctttccacacgtgtgcct

SEQ ID NO: 180092 - DNA, 25 bp, Homo sapien
gttgccctgtgctatggtgtggcca

SEQ ID NO: 180093 - DNA, 25 bp, Homo sapien
tgtgctatggtgtggccattttcac

SEQ ID NO: 180094 - DNA, 25 bp, Homo sapien
cttcaggagaagttgttctctgtct

SEQ ID NO: 180095 - DNA, 25 bp, Homo sapien
aagttgttctctgtcttttatgcca

SEQ ID NO: 180096 - DNA, 25 bp, Homo sapien
ttatgccattttaacaccaatgctg

SEQ ID NO: 180097 - DNA, 25 bp, Homo sapien
tttaacaccaatgctgaaccccatg

SEQ ID NO: 180098 - DNA, 25 bp, Homo sapien
accaatgctgaaccccatgatttac

SEQ ID NO: 180099 - DNA, 25 bp, Homo sapien
gaaccccatgatttacagcctaagg

SEQ ID NO: 180100 - DNA, 25 bp, Homo sapien
cccatgatttacagcctaaggaata

SEQ ID NO: 180101 - DNA, 25 bp, Homo sapien
ggcctggcagaaactattatggaaa

SEQ ID NO: 180102 - DNA, 25 bp, Homo sapien
tacggcgacatggtcccgcgcagcc

SEQ ID NO: 180103 - DNA, 25 bp, Homo sapien
atcttccacaccttttcgcgctcct

SEQ ID NO: 180104 - DNA, 25 bp, Homo sapien
gcgctcctactccgagctcaaggag

SEQ ID NO: 180105 - DNA, 25 bp, Homo sapien
tgcaggaggacagcacgcactcggc

SEQ ID NO: 180106 - DNA, 25 bp, Homo sapien
aggaggacagcacgcactcggccac

SEQ ID NO: 180107 - DNA, 25 bp, Homo sapien
gaggacagcacgcactcggccacag

SEQ ID NO: 180108 - DNA, 25 bp, Homo sapien
cagccaccgaggacagctcgcaggg

SEQ ID NO: 180109 - DNA, 25 bp, Homo sapien
aggacagctcgcagggccccgacag

SEQ ID NO: 180110 - DNA, 25 bp, Homo sapien
gggcctggccgacgactccgcggat

SEQ ID NO: 180111 - DNA, 25 bp, Homo sapien
acgactccgcggatgcgctgtgggt

SEQ ID NO: 180112 - DNA, 25 bp, Homo sapien
cgcggatgcgctgtgggtgcgggca

SEQ ID NO: 180113 - DNA, 25 bp, Homo sapien
gtcaagcttttaccaggcattctct

SEQ ID NO: 180114 - DNA, 25 bp, Homo sapien
taccaggcattctctagccttggta

SEQ ID NO: 180115 - DNA, 25 bp, Homo sapien
aacctgctggttgcgcagataccta

SEQ ID NO: 180116 - DNA, 25 bp, Homo sapien
gatacctaggcttgtccattttatg

SEQ ID NO: 180117 - DNA, 25 bp, Homo sapien
gtcattggagactattgcaacttgg

SEQ ID NO: 180118 - DNA, 25 bp, Homo sapien
attgcaacttgggaatactggtctg

SEQ ID NO: 180119 - DNA, 25 bp, Homo sapien
aatactggtctgcatcaagtttaat

SEQ ID NO: 180120 - DNA, 25 bp, Homo sapien
gtagtttgaccgctagtatgttgga

SEQ ID NO: 180121 - DNA, 25 bp, Homo sapien
gactggctgaattatggttggtata

SEQ ID NO: 180122 - DNA, 25 bp, Homo sapien
ggcaggcttatttatctgttgcact

SEQ ID NO: 180123 - DNA, 25 bp, Homo sapien
tctgttgcacttggttagctttaat

SEQ ID NO: 180124 - DNA, 25 bp, Homo sapien
tcatggcatcctccctgtacccagg

SEQ ID NO: 180125 - DNA, 25 bp, Homo sapien
atggcatcctccctgtacccaggtc

SEQ ID NO: 180126 - DNA, 25 bp, Homo sapien
tggcatcctccctgtacccaggtca

SEQ ID NO: 180127 - DNA, 25 bp, Homo sapien
ggcatcctccctgtacccaggtcag

SEQ ID NO: 180128 - DNA, 25 bp, Homo sapien
gcatcctccctgtacccaggtcagg

SEQ ID NO: 180129 - DNA, 25 bp, Homo sapien
atcctccctgtacccaggtcaggct

SEQ ID NO: 180130 - DNA, 25 bp, Homo sapien
ctgtacccaggtcaggctgtccaca

SEQ ID NO: 180131 - DNA, 25 bp, Homo sapien
tgtacccaggtcaggctgtccacac

SEQ ID NO: 180132 - DNA, 25 bp, Homo sapien
gtacccaggtcaggctgtccacacc

SEQ ID NO: 180133 - DNA, 25 bp, Homo sapien
tgtccacaccacatgggagcccaga

SEQ ID NO: 180134 - DNA, 25 bp, Homo sapien
gtccacaccacatgggagcccagag

SEQ ID NO: 180135 - DNA, 25 bp, Homo sapien
tgaagtttatgagggaaataccagt

SEQ ID NO: 180136 - DNA, 25 bp, Homo sapien
aataccagtgttcagttttgaacta

SEQ ID NO: 180137 - DNA, 25 bp, Homo sapien
tatcttctgttttggtctctggtga

SEQ ID NO: 180138 - DNA, 25 bp, Homo sapien
cttctgttttggtctctggtgatat

SEQ ID NO: 180139 - DNA, 25 bp, Homo sapien
ctgttttggtctctggtgatatttt

SEQ ID NO: 180140 - DNA, 25 bp, Homo sapien
ggtctctggtgatattttaaacaat

SEQ ID NO: 180141 - DNA, 25 bp, Homo sapien
aagtcagtatagaagtgttttagtt

SEQ ID NO: 180142 - DNA, 25 bp, Homo sapien
gaagtgttttagttaggaagtgata

SEQ ID NO: 180143 - DNA, 25 bp, Homo sapien
ggaagtgataaaacatctctcttct

SEQ ID NO: 180144 - DNA, 25 bp, Homo sapien
ttctccttcccaactactgcatgaa

SEQ ID NO: 180145 - DNA, 25 bp, Homo sapien
tccttcccaactactgcatgaagaa

SEQ ID NO: 180146 - DNA, 25 bp, Homo sapien
gaactgggtcttcctgattgttgaa

SEQ ID NO: 180147 - DNA, 25 bp, Homo sapien
gattgttgaaccctgacccgaagtc

SEQ ID NO: 180148 - DNA, 25 bp, Homo sapien
acccgaagtctctgggctagctact

SEQ ID NO: 180149 - DNA, 25 bp, Homo sapien
ccccagctcctagttgatagaaatg

SEQ ID NO: 180150 - DNA, 25 bp, Homo sapien
gatgatcccttccaatgtggtgcta

SEQ ID NO: 180151 - DNA, 25 bp, Homo sapien
tgtggtgctagcaggcaggatccct

SEQ ID NO: 180152 - DNA, 25 bp, Homo sapien
gggagagatcaccactctaacctcg

SEQ ID NO: 180153 - DNA, 25 bp, Homo sapien
atatttgtccaagtgttcctgcttc

SEQ ID NO: 180154 - DNA, 25 bp, Homo sapien
aagtgttcctgcttctaacagactt

SEQ ID NO: 180155 - DNA, 25 bp, Homo sapien
gaatggagcctgtgtatctactatc

SEQ ID NO: 180156 - DNA, 25 bp, Homo sapien
gtatctactatctccagtttgtatt

SEQ ID NO: 180157 - DNA, 25 bp, Homo sapien
gtacagcctagtgttaacattcttg

SEQ ID NO: 180158 - DNA, 25 bp, Homo sapien
tggtatctttttgtgccttatctaa

SEQ ID NO: 180159 - DNA, 25 bp, Homo sapien
aacatttctcgatcactggtttcag

SEQ ID NO: 180160 - DNA, 25 bp, Homo sapien
gattggcttttgtcatccactattg

SEQ ID NO: 180161 - DNA, 25 bp, Homo sapien
atgttttgtttcattgacctctagt

SEQ ID NO: 180162 - DNA, 25 bp, Homo sapien
attgacctctagtgataccttgatc

SEQ ID NO: 180163 - DNA, 25 bp, Homo sapien
gtgataccttgatctttcccacttt

SEQ ID NO: 180164 - DNA, 25 bp, Homo sapien
tcccactttctgttttcggattgga

SEQ ID NO: 180165 - DNA, 25 bp, Homo sapien
gatgtaccttttttgtcaactctta

SEQ ID NO: 180166 - DNA, 25 bp, Homo sapien
gtcaactcttacttttatcagatga

SEQ ID NO: 180167 - DNA, 25 bp, Homo sapien
actcacgtatttggatctttatttg

SEQ ID NO: 180168 - DNA, 25 bp, Homo sapien
ttctatgaacctttacttacttgac

SEQ ID NO: 180169 - DNA, 25 bp, Homo sapien
gaacctttacttacttgactggatt

SEQ ID NO: 180170 - DNA, 25 bp, Homo sapien
ttacttacttgactggattggacta

SEQ ID NO: 180171 - DNA, 25 bp, Homo sapien
ggattggactaaaagcactgatcag

SEQ ID NO: 180172 - DNA, 25 bp, Homo sapien
agcactgatcagaggccacgacata

SEQ ID NO: 180173 - DNA, 25 bp, Homo sapien
gatcagaggccacgacataaaaatt

SEQ ID NO: 180174 - DNA, 25 bp, Homo sapien
cataaaaattcagtccctttgtcct

SEQ ID NO: 180175 - DNA, 25 bp, Homo sapien
gtgcctcccaaagttactttaagat

SEQ ID NO: 180176 - DNA, 25 bp, Homo sapien
gttactttaagatccttagaatatt

SEQ ID NO: 180177 - DNA, 25 bp, Homo sapien
taaagactatctgtattgcaaaatt

SEQ ID NO: 180178 - DNA, 25 bp, Homo sapien
ttccaaaggtgaagtctttaagaat

SEQ ID NO: 180179 - DNA, 25 bp, Homo sapien
gttgccacctggatttgctgcattg

SEQ ID NO: 180180 - DNA, 25 bp, Homo sapien
gatttgctgcattgctctgctgagc

SEQ ID NO: 180181 - DNA, 25 bp, Homo sapien
gctctgctgagctgtattgaaacca

SEQ ID NO: 180182 - DNA, 25 bp, Homo sapien
attgaaaccatgactgggcccactg

SEQ ID NO: 180183 - DNA, 25 bp, Homo sapien
tgactgggcccactgtcagacagaa

SEQ ID NO: 180184 - DNA, 25 bp, Homo sapien
gcacattttttacctggtggttatg

SEQ ID NO: 180185 - DNA, 25 bp, Homo sapien
acctggtggttatgagcatggactt

SEQ ID NO: 180186 - DNA, 25 bp, Homo sapien
gactgagtttgattcccgacacagc

SEQ ID NO: 180187 - DNA, 25 bp, Homo sapien
ctccttgctgtgtagttttgggtaa

SEQ ID NO: 180188 - DNA, 25 bp, Homo sapien
tcagtttggtcacctgtaaaaggaa

SEQ ID NO: 180189 - DNA, 25 bp, Homo sapien
ggaaataacaagagcacttacttta

SEQ ID NO: 180190 - DNA, 25 bp, Homo sapien
aagtaaagcgtatcactccgcgtca

SEQ ID NO: 180191 - DNA, 25 bp, Homo sapien
aaagcgtatcactccgcgtcacttg

SEQ ID NO: 180192 - DNA, 25 bp, Homo sapien
gcgtcacttgcagcttgcaatccgt

SEQ ID NO: 180193 - DNA, 25 bp, Homo sapien
acttgcagcttgcaatccgtggtga

SEQ ID NO: 180194 - DNA, 25 bp, Homo sapien
gcagcttgcaatccgtggtgatgaa

SEQ ID NO: 180195 - DNA, 25 bp, Homo sapien
agcttgcaatccgtggtgatgaaga

SEQ ID NO: 180196 - DNA, 25 bp, Homo sapien
gttggattctcttatcaaggctacc

SEQ ID NO: 180197 - DNA, 25 bp, Homo sapien
ttctcttatcaaggctaccatagct

SEQ ID NO: 180198 - DNA, 25 bp, Homo sapien
ctgggggtggtgtgatccctcacat

SEQ ID NO: 180199 - DNA, 25 bp, Homo sapien
gcttagagggatgctttaaccaacc

SEQ ID NO: 180200 - DNA, 25 bp, Homo sapien
atatgtggaatttttaacaacagtt

SEQ ID NO: 180201 - DNA, 25 bp, Homo sapien
ctaccggatccgaggccgcgacgga

SEQ ID NO: 180202 - DNA, 25 bp, Homo sapien
gagggttctggtacacgggcagcca

SEQ ID NO: 180203 - DNA, 25 bp, Homo sapien
ggcagcgtgtgcagcgacggcgaac

SEQ ID NO: 180204 - DNA, 25 bp, Homo sapien
ggcgaacgcgccgaggacttcgtct

SEQ ID NO: 180205 - DNA, 25 bp, Homo sapien
gcgccgaggacttcgtcttcgagtt

SEQ ID NO: 180206 - DNA, 25 bp, Homo sapien
tcgtcttcgagttccgtgagcgcgg

SEQ ID NO: 180207 - DNA, 25 bp, Homo sapien
gccgggaccgcgctttgggagtact

SEQ ID NO: 180208 - DNA, 25 bp, Homo sapien
tttgggagtactgaggccgcgccca

SEQ ID NO: 180209 - DNA, 25 bp, Homo sapien
agaccagcctgtcgcgcattaaaac

SEQ ID NO: 180210 - DNA, 25 bp, Homo sapien
tgtcgcgcattaaaaccgtgtctct

SEQ ID NO: 180211 - DNA, 25 bp, Homo sapien
gcattaaaaccgtgtctctcccgca

SEQ ID NO: 180212 - DNA, 25 bp, Homo sapien
caaccgctgtcgctgagccggacga

SEQ ID NO: 180213 - DNA, 25 bp, Homo sapien
aaccgctgtcgctgagccggacgac

SEQ ID NO: 180214 - DNA, 25 bp, Homo sapien
ccgctgtcgctgagccggacgactg

SEQ ID NO: 180215 - DNA, 25 bp, Homo sapien
gagccggacgactgccaccatcgcg

SEQ ID NO: 180216 - DNA, 25 bp, Homo sapien
caccatcgcgcccattcttagcgtg

SEQ ID NO: 180217 - DNA, 25 bp, Homo sapien
ttcttagcgtgccactctccggaca

SEQ ID NO: 180218 - DNA, 25 bp, Homo sapien
ttagcgtgccactctccggacagtt

SEQ ID NO: 180219 - DNA, 25 bp, Homo sapien
tagcgtgccactctccggacagttt

SEQ ID NO: 180220 - DNA, 25 bp, Homo sapien
gccactctccggacagtttctgcag

SEQ ID NO: 180221 - DNA, 25 bp, Homo sapien
tccggacagtttctgcagcccgcag

SEQ ID NO: 180222 - DNA, 25 bp, Homo sapien
ggacagtttctgcagcccgcagcct

SEQ ID NO: 180223 - DNA, 25 bp, Homo sapien
aaggccttttgagttctgctggaca

SEQ ID NO: 180224 - DNA, 25 bp, Homo sapien
gctggacaggagcactttatctgaa

SEQ ID NO: 180225 - DNA, 25 bp, Homo sapien
tgacctctgcaaacagaatcttgga

SEQ ID NO: 180226 - DNA, 25 bp, Homo sapien
gaatcttggatatttcttctgaagg

SEQ ID NO: 180227 - DNA, 25 bp, Homo sapien
gaaggattatttgcacagacttaaa

SEQ ID NO: 180228 - DNA, 25 bp, Homo sapien
gaagactttgtacacactgtcacca

SEQ ID NO: 180229 - DNA, 25 bp, Homo sapien
gtacacactgtcaccagggttattt

SEQ ID NO: 180230 - DNA, 25 bp, Homo sapien
agggttatttgcatccaagggagct

SEQ ID NO: 180231 - DNA, 25 bp, Homo sapien
gggagctggaattgagtacctaaat

SEQ ID NO: 180232 - DNA, 25 bp, Homo sapien
aaatgtgccctatgtaagcttctac

SEQ ID NO: 180233 - DNA, 25 bp, Homo sapien
gtaagcttctacatcttgatttatt

SEQ ID NO: 180234 - DNA, 25 bp, Homo sapien
tctcaaagtaaagcgtatcactccg

SEQ ID NO: 180235 - DNA, 25 bp, Homo sapien
caaagtaaagcgtatcactccgcgt

SEQ ID NO: 180236 - DNA, 25 bp, Homo sapien
aagtaaagcgtatcactccgcgtca

SEQ ID NO: 180237 - DNA, 25 bp, Homo sapien
agtaaagcgtatcactccgcgtcac

SEQ ID NO: 180238 - DNA, 25 bp, Homo sapien
taaagcgtatcactccgcgtcactt

SEQ ID NO: 180239 - DNA, 25 bp, Homo sapien
aagcgtatcactccgcgtcacttgc

SEQ ID NO: 180240 - DNA, 25 bp, Homo sapien
gttggattctcttatcaaggctacc

SEQ ID NO: 180241 - DNA, 25 bp, Homo sapien
ggattctcttatcaaggctaccata

SEQ ID NO: 180242 - DNA, 25 bp, Homo sapien
gattctcttatcaaggctaccatag

SEQ ID NO: 180243 - DNA, 25 bp, Homo sapien
ttctcttatcaaggctaccatagct

SEQ ID NO: 180244 - DNA, 25 bp, Homo sapien
tcttatcaaggctaccatagctggg

SEQ ID NO: 180245 - DNA, 25 bp, Homo sapien
gaaatgatctatgactccaactgta

SEQ ID NO: 180246 - DNA, 25 bp, Homo sapien
actccaactgtatgattttcttgcc

SEQ ID NO: 180247 - DNA, 25 bp, Homo sapien
agttttcatcccagtggtaacgcct

SEQ ID NO: 180248 - DNA, 25 bp, Homo sapien
gtaacgcctgatttttggtagctat

SEQ ID NO: 180249 - DNA, 25 bp, Homo sapien
tggtagctatgccatcttctgctga

SEQ ID NO: 180250 - DNA, 25 bp, Homo sapien
gccatcttctgctgaggattaccat

SEQ ID NO: 180251 - DNA, 25 bp, Homo sapien
gattaccattactgggtgtatcacc

SEQ ID NO: 180252 - DNA, 25 bp, Homo sapien
aaatgcctctcctctattgattcag

SEQ ID NO: 180253 - DNA, 25 bp, Homo sapien
tgattcagttgttattgcagtgtct

SEQ ID NO: 180254 - DNA, 25 bp, Homo sapien
tgcagtgtctgcttcatccgtggaa

SEQ ID NO: 180255 - DNA, 25 bp, Homo sapien
catccgtggaacttgaggctcagat

SEQ ID NO: 180256 - DNA, 25 bp, Homo sapien
ggagaaggatccctgtcaccttctc

SEQ ID NO: 180257 - DNA, 25 bp, Homo sapien
agccctaggcctcatctgtgggaag

SEQ ID NO: 180258 - DNA, 25 bp, Homo sapien
cctcatctgtgggaagggagtccct

SEQ ID NO: 180259 - DNA, 25 bp, Homo sapien
ctggccagaactgctgtcgaagaaa

SEQ ID NO: 180260 - DNA, 25 bp, Homo sapien
tcgaagaaaatcaggccggaaggcc

SEQ ID NO: 180261 - DNA, 25 bp, Homo sapien
gggagggcaggttttccaggctgga

SEQ ID NO: 180262 - DNA, 25 bp, Homo sapien
tccaggctggagtcggttccaccca

SEQ ID NO: 180263 - DNA, 25 bp, Homo sapien
ttgtaagcaagtcagcagcacagct

SEQ ID NO: 180264 - DNA, 25 bp, Homo sapien
aagcaagtcagcagcacagctactc

SEQ ID NO: 180265 - DNA, 25 bp, Homo sapien
tactcacgctgccatctggacttat

SEQ ID NO: 180266 - DNA, 25 bp, Homo sapien
gctgccatctggacttattttatgt

SEQ ID NO: 180267 - DNA, 25 bp, Homo sapien
ataagctgcggctggggcgctacca

SEQ ID NO: 180268 - DNA, 25 bp, Homo sapien
atggcaatgcgggtgactcctttac

SEQ ID NO: 180269 - DNA, 25 bp, Homo sapien
tggcaatgcgggtgactcctttaca

SEQ ID NO: 180270 - DNA, 25 bp, Homo sapien
gcaatgcgggtgactcctttacatg

SEQ ID NO: 180271 - DNA, 25 bp, Homo sapien
acagagatcatgatgtctacacagg

SEQ ID NO: 180272 - DNA, 25 bp, Homo sapien
gagatcatgatgtctacacaggaaa

SEQ ID NO: 180273 - DNA, 25 bp, Homo sapien
gatcatgatgtctacacaggaaact

SEQ ID NO: 180274 - DNA, 25 bp, Homo sapien
tcatgatgtctacacaggaaactgt

SEQ ID NO: 180275 - DNA, 25 bp, Homo sapien
tgatgtctacacaggaaactgtgcc

SEQ ID NO: 180276 - DNA, 25 bp, Homo sapien
gctggtggtataacgcctgtgccca

SEQ ID NO: 180277 - DNA, 25 bp, Homo sapien
gtggtataacgcctgtgcccactcc

SEQ ID NO: 180278 - DNA, 25 bp, Homo sapien
gatgaccactcaacataatgcttaa

SEQ ID NO: 180279 - DNA, 25 bp, Homo sapien
gaatggaatttcctctctgtgacag

SEQ ID NO: 180280 - DNA, 25 bp, Homo sapien
ctctgtgacagaacccaggaattaa

SEQ ID NO: 180281 - DNA, 25 bp, Homo sapien
gtgacagaacccaggaattaattcc

SEQ ID NO: 180282 - DNA, 25 bp, Homo sapien
tacataacgttggtatattgaagac

SEQ ID NO: 180283 - DNA, 25 bp, Homo sapien
gtccttcagttttgaggccatgtgt

SEQ ID NO: 180284 - DNA, 25 bp, Homo sapien
tgaggccatgtgtaaagtttaacca

SEQ ID NO: 180285 - DNA, 25 bp, Homo sapien
ttgtaaaatatctattccgtattag

SEQ ID NO: 180286 - DNA, 25 bp, Homo sapien
gctagttgacagcttatacttctca

SEQ ID NO: 180287 - DNA, 25 bp, Homo sapien
gacagcttatacttctcaaaattca

SEQ ID NO: 180288 - DNA, 25 bp, Homo sapien
tgttatgtacacaaactaagtttct

SEQ ID NO: 180289 - DNA, 25 bp, Homo sapien
gcactctccatttccagagactaaa

SEQ ID NO: 180290 - DNA, 25 bp, Homo sapien
tcagagagttggagtgcttttcaca

SEQ ID NO: 180291 - DNA, 25 bp, Homo sapien
ttttcacatgagcattagccccagc

SEQ ID NO: 180292 - DNA, 25 bp, Homo sapien
ttagccccagctttgtaaccaatga

SEQ ID NO: 180293 - DNA, 25 bp, Homo sapien
gaagcaatttgaacacagtgtcccg

SEQ ID NO: 180294 - DNA, 25 bp, Homo sapien
acagtgtcccgtcatttctagaaac

SEQ ID NO: 180295 - DNA, 25 bp, Homo sapien
gaaacagaatggtctcttctagaga

SEQ ID NO: 180296 - DNA, 25 bp, Homo sapien
aatccttgccttggtttggaactgc

SEQ ID NO: 180297 - DNA, 25 bp, Homo sapien
ttggaactgccttcgggctccagaa

SEQ ID NO: 180298 - DNA, 25 bp, Homo sapien
cgggctccagaacttaaattgcttg

SEQ ID NO: 180299 - DNA, 25 bp, Homo sapien
aaattgcttggtccgtggcatctga

SEQ ID NO: 180300 - DNA, 25 bp, Homo sapien
tggccaaaaacccaattcacattga

SEQ ID NO: 180301 - DNA, 25 bp, Homo sapien
aacccaattcacattgagagctggt

SEQ ID NO: 180302 - DNA, 25 bp, Homo sapien
cacattgagagctggtgttgtctga

SEQ ID NO: 180303 - DNA, 25 bp, Homo sapien
ggtgttgtctgaagttttcgtatca

SEQ ID NO: 180304 - DNA, 25 bp, Homo sapien
gaagttttcgtatcacagtgttaac

SEQ ID NO: 180305 - DNA, 25 bp, Homo sapien
acagtgttaacctgtactctctcct

SEQ ID NO: 180306 - DNA, 25 bp, Homo sapien
agtgttaacctgtactctctcctgc

SEQ ID NO: 180307 - DNA, 25 bp, Homo sapien
gcaaacctacacaccaaagctttat

SEQ ID NO: 180308 - DNA, 25 bp, Homo sapien
atcaatgctacacagtgttgtcccg

SEQ ID NO: 180309 - DNA, 25 bp, Homo sapien
atgctacacagtgttgtcccgagcg

SEQ ID NO: 180310 - DNA, 25 bp, Homo sapien
tacacagtgttgtcccgagcgccgg

SEQ ID NO: 180311 - DNA, 25 bp, Homo sapien
gtatatgtttagaactctctgattt

SEQ ID NO: 180312 - DNA, 25 bp, Homo sapien
gaactctctgattttgatgaattat

SEQ ID NO: 180313 - DNA, 25 bp, Homo sapien
aagtggtatttgctggcgagttaaa

SEQ ID NO: 180314 - DNA, 25 bp, Homo sapien
gagttaaataggcaaggtacccagt

SEQ ID NO: 180315 - DNA, 25 bp, Homo sapien
ggtacccagtgataacaccaaccaa

SEQ ID NO: 180316 - DNA, 25 bp, Homo sapien
aaaccactcctatctgcatgattct

SEQ ID NO: 180317 - DNA, 25 bp, Homo sapien
catgattctgaacatctggatgcct

SEQ ID NO: 180318 - DNA, 25 bp, Homo sapien
gatgcctgttgttttactgtgtata

SEQ ID NO: 180319 - DNA, 25 bp, Homo sapien
gtggattcatttaaggtctactcaa

SEQ ID NO: 180320 - DNA, 25 bp, Homo sapien
ggtctactcaaaagtaacactgtcc

SEQ ID NO: 180321 - DNA, 25 bp, Homo sapien
gtaacactgtccaaaccactaatat

SEQ ID NO: 180322 - DNA, 25 bp, Homo sapien
catttttctggagatcatttaaatc

SEQ ID NO: 180323 - DNA, 25 bp, Homo sapien
ggagatcatttaaatcttacagatc

SEQ ID NO: 180324 - DNA, 25 bp, Homo sapien
cttacagatccttttcttgaaagaa

SEQ ID NO: 180325 - DNA, 25 bp, Homo sapien
tgtgtcattcatttttcagaatata

SEQ ID NO: 180326 - DNA, 25 bp, Homo sapien
tcagaatataaccactcaagctact

SEQ ID NO: 180327 - DNA, 25 bp, Homo sapien
ataaccactcaagctactggcacat

SEQ ID NO: 180328 - DNA, 25 bp, Homo sapien
aaccactcaagctactggcacatag

SEQ ID NO: 180329 - DNA, 25 bp, Homo sapien
tggcacatagtgaaagattacttct

SEQ ID NO: 180330 - DNA, 25 bp, Homo sapien
gtgaaagattacttctgacattcca

SEQ ID NO: 180331 - DNA, 25 bp, Homo sapien
ttctgacattccattgctcttcttt

SEQ ID NO: 180332 - DNA, 25 bp, Homo sapien
ctgacattccattgctcttcttttg

SEQ ID NO: 180333 - DNA, 25 bp, Homo sapien
cctcagaagaggagatcagacttag

SEQ ID NO: 180334 - DNA, 25 bp, Homo sapien
gagatcagacttagcaagatggtga

SEQ ID NO: 180335 - DNA, 25 bp, Homo sapien
aagggtatctgcagattggtgccaa

SEQ ID NO: 180336 - DNA, 25 bp, Homo sapien
ctgcagattggtgccaacacccagg

SEQ ID NO: 180337 - DNA, 25 bp, Homo sapien
acacccaggcggcccagaagctgaa

SEQ ID NO: 180338 - DNA, 25 bp, Homo sapien
aagaagtagctttctggaccaacct

SEQ ID NO: 180339 - DNA, 25 bp, Homo sapien
agtagctttctggaccaacctcttt

SEQ ID NO: 180340 - DNA, 25 bp, Homo sapien
tctggaccaacctctttgccaagaa

SEQ ID NO: 180341 - DNA, 25 bp, Homo sapien
gagaagccaccccagacagaacaca

SEQ ID NO: 180342 - DNA, 25 bp, Homo sapien
gccaccccagacagaacacatagag

SEQ ID NO: 180343 - DNA, 25 bp, Homo sapien
gacagaacacatagagctgtgaatg

SEQ ID NO: 180344 - DNA, 25 bp, Homo sapien
ttcatggtggtctttcaggttatct

SEQ ID NO: 180345 - DNA, 25 bp, Homo sapien
gtggtctttcaggttatcttggcaa

SEQ ID NO: 180346 - DNA, 25 bp, Homo sapien
tcaggttatcttggcaacatgtaca

SEQ ID NO: 180347 - DNA, 25 bp, Homo sapien
tttttgctttcattgtacagtcagt

SEQ ID NO: 180348 - DNA, 25 bp, Homo sapien
ttctcttttgagttttatacctttg

SEQ ID NO: 180349 - DNA, 25 bp, Homo sapien
atgacattgtgtttgtactttgttg

SEQ ID NO: 180350 - DNA, 25 bp, Homo sapien
ataaacccaagatcatctgagatga

SEQ ID NO: 180351 - DNA, 25 bp, Homo sapien
aagacattcaataactttggccaag

SEQ ID NO: 180352 - DNA, 25 bp, Homo sapien
aactttggccaaggtcattcagcta

SEQ ID NO: 180353 - DNA, 25 bp, Homo sapien
ggccaaggtcattcagctattaaat

SEQ ID NO: 180354 - DNA, 25 bp, Homo sapien
ggtcattcagctattaaattttaag

SEQ ID NO: 180355 - DNA, 25 bp, Homo sapien
ccagcatcaaaatcccaagttctca

SEQ ID NO: 180356 - DNA, 25 bp, Homo sapien
tcccaagttctcataccctgatgaa

SEQ ID NO: 180357 - DNA, 25 bp, Homo sapien
gaagcaccaagtattggtcagggaa

SEQ ID NO: 180358 - DNA, 25 bp, Homo sapien
gaattccatttttattccataaacg

SEQ ID NO: 180359 - DNA, 25 bp, Homo sapien
taagttacggtctggagaggaaatc

SEQ ID NO: 180360 - DNA, 25 bp, Homo sapien
gaaatcagcatcgaggtctccaacc

SEQ ID NO: 180361 - DNA, 25 bp, Homo sapien
ctccttactggatccggatcaggat

SEQ ID NO: 180362 - DNA, 25 bp, Homo sapien
ggatcaggatgcaacatactttggg

SEQ ID NO: 180363 - DNA, 25 bp, Homo sapien
cgagatatagattgagccccagttt

SEQ ID NO: 180364 - DNA, 25 bp, Homo sapien
cccagtttttggagtgttatgtatt

SEQ ID NO: 180365 - DNA, 25 bp, Homo sapien
gagtgttatgtatttcctggatgtt

SEQ ID NO: 180366 - DNA, 25 bp, Homo sapien
gggctgctccccaacacctgcctct

SEQ ID NO: 180367 - DNA, 25 bp, Homo sapien
ggctgctccccaacacctgcctctg

SEQ ID NO: 180368 - DNA, 25 bp, Homo sapien
gctgctccccaacacctgcctctga

SEQ ID NO: 180369 - DNA, 25 bp, Homo sapien
tgctccccaacacctgcctctgacc

SEQ ID NO: 180370 - DNA, 25 bp, Homo sapien
tccccaacacctgcctctgacccca

SEQ ID NO: 180371 - DNA, 25 bp, Homo sapien
tctgaccccagcatttccagagcag

SEQ ID NO: 180372 - DNA, 25 bp, Homo sapien
ccagagcagagcctacagaagggca

SEQ ID NO: 180373 - DNA, 25 bp, Homo sapien
cagagcagagcctacagaagggcag

SEQ ID NO: 180374 - DNA, 25 bp, Homo sapien
agagcagagcctacagaagggcagt

SEQ ID NO: 180375 - DNA, 25 bp, Homo sapien
gagcagagcctacagaagggcagtg

SEQ ID NO: 180376 - DNA, 25 bp, Homo sapien
agcagagcctacagaagggcagtga

SEQ ID NO: 180377 - DNA, 25 bp, Homo sapien
gcagctttttggcactaaccgagaa

SEQ ID NO: 180378 - DNA, 25 bp, Homo sapien
ctgcgagaccagatataaaactagc

SEQ ID NO: 180379 - DNA, 25 bp, Homo sapien
ggctccatgcagtttatgcagcact

SEQ ID NO: 180380 - DNA, 25 bp, Homo sapien
cactgggagcgggtgtatttacatt

SEQ ID NO: 180381 - DNA, 25 bp, Homo sapien
gtgtatttacattgttcctggcact

SEQ ID NO: 180382 - DNA, 25 bp, Homo sapien
tggcacttgacacccagttgctgat

SEQ ID NO: 180383 - DNA, 25 bp, Homo sapien
gttgctgatgggtaaccgacgccac

SEQ ID NO: 180384 - DNA, 25 bp, Homo sapien
gacgccactcgctgagccctgagga

SEQ ID NO: 180385 - DNA, 25 bp, Homo sapien
gagtatatttttggagccctcaaca

SEQ ID NO: 180386 - DNA, 25 bp, Homo sapien
cctcaacatttacctagacatcatc

SEQ ID NO: 180387 - DNA, 25 bp, Homo sapien
acatcatctatatcttcaccttctt

SEQ ID NO: 180388 - DNA, 25 bp, Homo sapien
gatttgtttctggtggtagcttgtc

SEQ ID NO: 180389 - DNA, 25 bp, Homo sapien
ggtagcttgtcctgaaatgtgtgta

SEQ ID NO: 180390 - DNA, 25 bp, Homo sapien
tgtgtagtgcatgctctgtgtggaa

SEQ ID NO: 180391 - DNA, 25 bp, Homo sapien
ggaaaacccagattcagtgattaac

SEQ ID NO: 180392 - DNA, 25 bp, Homo sapien
atgcaagtaactagccattgttcaa

SEQ ID NO: 180393 - DNA, 25 bp, Homo sapien
atgacagtggtgctatttctctttt

SEQ ID NO: 180394 - DNA, 25 bp, Homo sapien
tttctcttttgtggccttttagact

SEQ ID NO: 180395 - DNA, 25 bp, Homo sapien
tggccttttagacttttgttgccct

SEQ ID NO: 180396 - DNA, 25 bp, Homo sapien
tattgggaacccattttccacctgg

SEQ ID NO: 180397 - DNA, 25 bp, Homo sapien
attttccacctggtctttcttgaca

SEQ ID NO: 180398 - DNA, 25 bp, Homo sapien
cacctggtctttcttgacagggttt

SEQ ID NO: 180399 - DNA, 25 bp, Homo sapien
tacagaggtatcaatttggttaaaa

SEQ ID NO: 180400 - DNA, 25 bp, Homo sapien
aattcaccattttataagactaagc

SEQ ID NO: 180401 - DNA, 25 bp, Homo sapien
taatcttaacaacctctttcctgaa

SEQ ID NO: 180402 - DNA, 25 bp, Homo sapien
aaatgtgtttgtatggtgttatgac

SEQ ID NO: 180403 - DNA, 25 bp, Homo sapien
ggtgttatgactaattgttactgat

SEQ ID NO: 180404 - DNA, 25 bp, Homo sapien
attgttactgatttagagactaagc

SEQ ID NO: 180405 - DNA, 25 bp, Homo sapien
ttatatatatcttgcctccctgatg

SEQ ID NO: 180406 - DNA, 25 bp, Homo sapien
tatatcttgcctccctgatggaaaa

SEQ ID NO: 180407 - DNA, 25 bp, Homo sapien
ttgcctccctgatggaaaactatat

SEQ ID NO: 180408 - DNA, 25 bp, Homo sapien
gtggaaatacattaggatatcagaa

SEQ ID NO: 180409 - DNA, 25 bp, Homo sapien
ggagttgctttatgactattacatg

SEQ ID NO: 180410 - DNA, 25 bp, Homo sapien
gcagtgcgccttctagtgctccatc

SEQ ID NO: 180411 - DNA, 25 bp, Homo sapien
agacgcacccgaatttctgtccgtt

SEQ ID NO: 180412 - DNA, 25 bp, Homo sapien
aatttctgtccgttcccaaagatcg

SEQ ID NO: 180413 - DNA, 25 bp, Homo sapien
aaaaagtctgccccagaaactctca

SEQ ID NO: 180414 - DNA, 25 bp, Homo sapien
tcacacttccagaccctgagaaaaa

SEQ ID NO: 180415 - DNA, 25 bp, Homo sapien
gaccctgagaaaaaagccaccctga

SEQ ID NO: 180416 - DNA, 25 bp, Homo sapien
aagccaccctgaatttacccggcat

SEQ ID NO: 180417 - DNA, 25 bp, Homo sapien
gaatttacccggcatgcactcttca

SEQ ID NO: 180418 - DNA, 25 bp, Homo sapien
ggcatgcactcttcagataagccat

SEQ ID NO: 180419 - DNA, 25 bp, Homo sapien
agataagccatgtcggcccaaatct

SEQ ID NO: 180420 - DNA, 25 bp, Homo sapien
tgtcggcccaaatctgagtaacttt

SEQ ID NO: 180421 - DNA, 25 bp, Homo sapien
ggaagttaacgatccgcccgagtgc

SEQ ID NO: 180422 - DNA, 25 bp, Homo sapien
cgatccgcccgagtgcagaggaaaa

SEQ ID NO: 180423 - DNA, 25 bp, Homo sapien
cagaaacgccttgccttcagctgaa

SEQ ID NO: 180424 - DNA, 25 bp, Homo sapien
ttcagctgaaccaccgtttgtgcga

SEQ ID NO: 180425 - DNA, 25 bp, Homo sapien
gaaccaccgtttgtgcgagctggat

SEQ ID NO: 180426 - DNA, 25 bp, Homo sapien
gcgagctggatgtccttttcagtag

SEQ ID NO: 180427 - DNA, 25 bp, Homo sapien
gaatttataccattcatcaattttg

SEQ ID NO: 180428 - DNA, 25 bp, Homo sapien
tactgcccaagtatttgaatcgttt

SEQ ID NO: 180429 - DNA, 25 bp, Homo sapien
gaatcgtttagtagtaactgtccat

SEQ ID NO: 180430 - DNA, 25 bp, Homo sapien
gtagtaactgtccatttatcctatt

SEQ ID NO: 180431 - DNA, 25 bp, Homo sapien
gtagacagtattacaccctgaataa

SEQ ID NO: 180432 - DNA, 25 bp, Homo sapien
ccccggctcaagagtatttctgaga

SEQ ID NO: 180433 - DNA, 25 bp, Homo sapien
agtatttctgagagactgtctgtcc

SEQ ID NO: 180434 - DNA, 25 bp, Homo sapien
agagactgtctgtcctcaagggtgc

SEQ ID NO: 180435 - DNA, 25 bp, Homo sapien
tgtctgtcctcaagggtgccaaacc

SEQ ID NO: 180436 - DNA, 25 bp, Homo sapien
tgccaaacccgatgtctccaatgga

SEQ ID NO: 180437 - DNA, 25 bp, Homo sapien
tgtctccaatggacaaccagaggtc

SEQ ID NO: 180438 - DNA, 25 bp, Homo sapien
gggaacctgttgaactgaacaccca

SEQ ID NO: 180439 - DNA, 25 bp, Homo sapien
ctgttgaactgaacacccaggccct

SEQ ID NO: 180440 - DNA, 25 bp, Homo sapien
aggccctgtagaagctccagctgaa

SEQ ID NO: 180441 - DNA, 25 bp, Homo sapien
aaagcttctgagtttacgtggaggg

SEQ ID NO: 180442 - DNA, 25 bp, Homo sapien
tttagccagcccctagatgaagaaa

SEQ ID NO: 180443 - DNA, 25 bp, Homo sapien
catgcctaaactagtgctatgtaat

SEQ ID NO: 180444 - DNA, 25 bp, Homo sapien
tttcgatttcgtttaatgacaaaat

SEQ ID NO: 180445 - DNA, 25 bp, Homo sapien
taatctcttaatatgctgaaatcaa

SEQ ID NO: 180446 - DNA, 25 bp, Homo sapien
gctgaaatcaagcacgtgagagttt

SEQ ID NO: 180447 - DNA, 25 bp, Homo sapien
atcaagcacgtgagagtttttgttt

SEQ ID NO: 180448 - DNA, 25 bp, Homo sapien
ttaaaagataagagacacagcatgt

SEQ ID NO: 180449 - DNA, 25 bp, Homo sapien
gacacagcatgtattatgcacttca

SEQ ID NO: 180450 - DNA, 25 bp, Homo sapien
gagaatgttaaacgttatgcaaaat

SEQ ID NO: 180451 - DNA, 25 bp, Homo sapien
gttttgaaattactgtacctagtct

SEQ ID NO: 180452 - DNA, 25 bp, Homo sapien
attactgtacctagtcttttttgca

SEQ ID NO: 180453 - DNA, 25 bp, Homo sapien
ctgtacctagtcttttttgcattac

SEQ ID NO: 180454 - DNA, 25 bp, Homo sapien
cggcgcaggcagttcttcttaggtt

SEQ ID NO: 180455 - DNA, 25 bp, Homo sapien
aggcagttcttcttaggttccgtct

SEQ ID NO: 180456 - DNA, 25 bp, Homo sapien
tcttaggttccgtctcacggcgttt

SEQ ID NO: 180457 - DNA, 25 bp, Homo sapien
ttttcactgtcacacgcatagatcc

SEQ ID NO: 180458 - DNA, 25 bp, Homo sapien
gtcacacgcatagatccacgaggca

SEQ ID NO: 180459 - DNA, 25 bp, Homo sapien
atagatccacgaggcaccaaggcct

SEQ ID NO: 180460 - DNA, 25 bp, Homo sapien
agtcccacgtgtccggtgtgcttgg

SEQ ID NO: 180461 - DNA, 25 bp, Homo sapien
tgcttgggcggcatcgcatcaacgc

SEQ ID NO: 180462 - DNA, 25 bp, Homo sapien
gcatcaacgcgcagacctaaactga

SEQ ID NO: 180463 - DNA, 25 bp, Homo sapien
gcgcagacctaaactgatcctaaag

SEQ ID NO: 180464 - DNA, 25 bp, Homo sapien
ggctttggcagctatggaagaacca

SEQ ID NO: 180465 - DNA, 25 bp, Homo sapien
agtgtgcctctgatccgtgtgtcaa

SEQ ID NO: 180466 - DNA, 25 bp, Homo sapien
atggaggtctgtgccaggacttact

SEQ ID NO: 180467 - DNA, 25 bp, Homo sapien
gtgccaggacttactcaacaaattc

SEQ ID NO: 180468 - DNA, 25 bp, Homo sapien
agtgcctctgtgatgttgcctttgc

SEQ ID NO: 180469 - DNA, 25 bp, Homo sapien
tgtgatgttgcctttgctggcgagc

SEQ ID NO: 180470 - DNA, 25 bp, Homo sapien
aggtggacgtaagcagcctctcctt

SEQ ID NO: 180471 - DNA, 25 bp, Homo sapien
aagcagcctctccttttatgtctct

SEQ ID NO: 180472 - DNA, 25 bp, Homo sapien
atgtctctctcttattctggcagaa

SEQ ID NO: 180473 - DNA, 25 bp, Homo sapien
tttttcagcttctttcttacctcat

SEQ ID NO: 180474 - DNA, 25 bp, Homo sapien
tcttacctcattttgcgtatgaatg

SEQ ID NO: 180475 - DNA, 25 bp, Homo sapien
gtatgaatgacgagccagttgttga

SEQ ID NO: 180476 - DNA, 25 bp, Homo sapien
aatttttgccactgttttgtgaacg

SEQ ID NO: 180477 - DNA, 25 bp, Homo sapien
gccactgttttgtgaacggaggatt

SEQ ID NO: 180478 - DNA, 25 bp, Homo sapien
gtgaacggaggatttgtacgctaaa

SEQ ID NO: 180479 - DNA, 25 bp, Homo sapien
gatttgtacgctaaatttcatcctt

SEQ ID NO: 180480 - DNA, 25 bp, Homo sapien
aatttcatccttatttggcgtcaaa

SEQ ID NO: 180481 - DNA, 25 bp, Homo sapien
ccttatttggcgtcaaagttgatgc

SEQ ID NO: 180482 - DNA, 25 bp, Homo sapien
aagttgatgcaaagtttatgtacca

SEQ ID NO: 180483 - DNA, 25 bp, Homo sapien
gtttatgtaccatgagacttctagt

SEQ ID NO: 180484 - DNA, 25 bp, Homo sapien
gagacttctagtgattgcctacttt

SEQ ID NO: 180485 - DNA, 25 bp, Homo sapien
tagtgattgcctactttcacattta

SEQ ID NO: 180486 - DNA, 25 bp, Homo sapien
atcataactgatacttagctaacaa

SEQ ID NO: 180487 - DNA, 25 bp, Homo sapien
acacgacagggctggcagcggtact

SEQ ID NO: 180488 - DNA, 25 bp, Homo sapien
cagcggtactactttgagggcatta

SEQ ID NO: 180489 - DNA, 25 bp, Homo sapien
gggcattaaacagacctttggctat

SEQ ID NO: 180490 - DNA, 25 bp, Homo sapien
agacctttggctatggcgcacgctt

SEQ ID NO: 180491 - DNA, 25 bp, Homo sapien
ggcgcacgcttattttagggccagc

SEQ ID NO: 180492 - DNA, 25 bp, Homo sapien
gggcttgcgactcacaggattgcat

SEQ ID NO: 180493 - DNA, 25 bp, Homo sapien
aggattgcatcgtcccagctgctaa

SEQ ID NO: 180494 - DNA, 25 bp, Homo sapien
tcccttccacatataccttgggttt

SEQ ID NO: 180495 - DNA, 25 bp, Homo sapien
cttgggtttgtgcatgttttctgct

SEQ ID NO: 180496 - DNA, 25 bp, Homo sapien
tttgtgcatgttttctgctgggtgg

SEQ ID NO: 180497 - DNA, 25 bp, Homo sapien
ggcaatttctcttttatgtgtacat

SEQ ID NO: 180498 - DNA, 25 bp, Homo sapien
ttctacttgaacactacctcttgtg

SEQ ID NO: 180499 - DNA, 25 bp, Homo sapien
gaacactacctcttgtgaagtctac

SEQ ID NO: 180500 - DNA, 25 bp, Homo sapien
acctcttgtgaagtctactgtagat

SEQ ID NO: 180501 - DNA, 25 bp, Homo sapien
agataagacgattgtcatttccact

SEQ ID NO: 180502 - DNA, 25 bp, Homo sapien
cacttggaaagtgaatctcccataa

SEQ ID NO: 180503 - DNA, 25 bp, Homo sapien
gtgaatctcccataataattgtatt

SEQ ID NO: 180504 - DNA, 25 bp, Homo sapien
aagctgtcctcagattttaacttga

SEQ ID NO: 180505 - DNA, 25 bp, Homo sapien
gtcctcagattttaacttgactcaa

SEQ ID NO: 180506 - DNA, 25 bp, Homo sapien
acatttttcaattatgacagcctgt

SEQ ID NO: 180507 - DNA, 25 bp, Homo sapien
gacagcctgttaatatgacttgtac

SEQ ID NO: 180508 - DNA, 25 bp, Homo sapien
gacttgtactattttggtattatac

SEQ ID NO: 180509 - DNA, 25 bp, Homo sapien
ccctagttcaatctgtagtgaaata

SEQ ID NO: 180510 - DNA, 25 bp, Homo sapien
ataagactacagaaggcattgtttt

SEQ ID NO: 180511 - DNA, 25 bp, Homo sapien
aaatatgttttattgtcttctctaa

SEQ ID NO: 180512 - DNA, 25 bp, Homo sapien
aaacatagtatttctctctgcgtcc

SEQ ID NO: 180513 - DNA, 25 bp, Homo sapien
atagtatttctctctgcgtcctatt

SEQ ID NO: 180514 - DNA, 25 bp, Homo sapien
ttctctctgcgtcctatttcattag

SEQ ID NO: 180515 - DNA, 25 bp, Homo sapien
ctctgcgtcctatttcattagtgaa

SEQ ID NO: 180516 - DNA, 25 bp, Homo sapien
gcgtcctatttcattagtgaagaca

SEQ ID NO: 180517 - DNA, 25 bp, Homo sapien
atagttcacctaaaatggcatcctg

SEQ ID NO: 180518 - DNA, 25 bp, Homo sapien
atggcatcctgctctgaatctagac

SEQ ID NO: 180519 - DNA, 25 bp, Homo sapien
gtcaacattcaaaattgtcctaatt

SEQ ID NO: 180520 - DNA, 25 bp, Homo sapien
tattttagtgcttcaagactgctga

SEQ ID NO: 180521 - DNA, 25 bp, Homo sapien
agactgctgaaagcaatccagttgc

SEQ ID NO: 180522 - DNA, 25 bp, Homo sapien
aatccagttgctcctgtgctagatg

SEQ ID NO: 180523 - DNA, 25 bp, Homo sapien
ttgctcctgtgctagatggtagcca

SEQ ID NO: 180524 - DNA, 25 bp, Homo sapien
gatggtagccagagaattttatagt

SEQ ID NO: 180525 - DNA, 25 bp, Homo sapien
tttatagtaatggaggttagccctt

SEQ ID NO: 180526 - DNA, 25 bp, Homo sapien
ggaggttagcccttaatctcttcat

SEQ ID NO: 180527 - DNA, 25 bp, Homo sapien
agcccttaatctcttcattgcattt

SEQ ID NO: 180528 - DNA, 25 bp, Homo sapien
ctcttcattgcatttcatttctgta

SEQ ID NO: 180529 - DNA, 25 bp, Homo sapien
gtgtgtaattgccattaaattttca

SEQ ID NO: 180530 - DNA, 25 bp, Homo sapien
gaactatcaagcatatactgtatac

SEQ ID NO: 180531 - DNA, 25 bp, Homo sapien
aaagacaccgatttttcgaccagat

SEQ ID NO: 180532 - DNA, 25 bp, Homo sapien
tttcgaccagattagcatttacttt

SEQ ID NO: 180533 - DNA, 25 bp, Homo sapien
atagagactttccaagtatgttgtc

SEQ ID NO: 180534 - DNA, 25 bp, Homo sapien
gtatgttgtctttccaatggtgcct

SEQ ID NO: 180535 - DNA, 25 bp, Homo sapien
cttgcttggtgctctcctggtggtg

SEQ ID NO: 180536 - DNA, 25 bp, Homo sapien
ggtggtgacataacattggttctac

SEQ ID NO: 180537 - DNA, 25 bp, Homo sapien
ggttctacagaatcgtgtggtgttt

SEQ ID NO: 180538 - DNA, 25 bp, Homo sapien
aaccgcatgttctaagtgtgcattt

SEQ ID NO: 180539 - DNA, 25 bp, Homo sapien
gcatttttgtcaatctttgcaacag

SEQ ID NO: 180540 - DNA, 25 bp, Homo sapien
ttgcaacagttatttcatacagatg

SEQ ID NO: 180541 - DNA, 25 bp, Homo sapien
gttattgtgctcttttctgttatgt

SEQ ID NO: 180542 - DNA, 25 bp, Homo sapien
atggataagtgatcatggtgtgcga

SEQ ID NO: 180543 - DNA, 25 bp, Homo sapien
tgatcatggtgtgcgagtggtcaat

SEQ ID NO: 180544 - DNA, 25 bp, Homo sapien
atcatggtgtgcgagtggtcaattg

SEQ ID NO: 180545 - DNA, 25 bp, Homo sapien
tcatggtgtgcgagtggtcaattga

SEQ ID NO: 180546 - DNA, 25 bp, Homo sapien
gtgcgagtggtcaattgagtagtac

SEQ ID NO: 180547 - DNA, 25 bp, Homo sapien
tgcgagtggtcaattgagtagtaca

SEQ ID NO: 180548 - DNA, 25 bp, Homo sapien
gcgagtggtcaattgagtagtacag

SEQ ID NO: 180549 - DNA, 25 bp, Homo sapien
cgagtggtcaattgagtagtacagt

SEQ ID NO: 180550 - DNA, 25 bp, Homo sapien
gtggtcaattgagtagtacagtgga

SEQ ID NO: 180551 - DNA, 25 bp, Homo sapien
gtcaattgagtagtacagtggaaac

SEQ ID NO: 180552 - DNA, 25 bp, Homo sapien
caattgagtagtacagtggaaactg

SEQ ID NO: 180553 - DNA, 25 bp, Homo sapien
tccctcctggccagatgtcgctggg

SEQ ID NO: 180554 - DNA, 25 bp, Homo sapien
agatgtcgctgggtcctctgcagtg

SEQ ID NO: 180555 - DNA, 25 bp, Homo sapien
tgcagtgtggcaagcaagagctctt

SEQ ID NO: 180556 - DNA, 25 bp, Homo sapien
gctcttgtgaatattgtggctccct

SEQ ID NO: 180557 - DNA, 25 bp, Homo sapien
cttgtgaatattgtggctccctggg

SEQ ID NO: 180558 - DNA, 25 bp, Homo sapien
gcttgctttcttctcctgtgatgtc

SEQ ID NO: 180559 - DNA, 25 bp, Homo sapien
tgatgtcccagtttcccactctgaa

SEQ ID NO: 180560 - DNA, 25 bp, Homo sapien
agtttcccactctgaagatcccaac

SEQ ID NO: 180561 - DNA, 25 bp, Homo sapien
gaagatcccaacatggtcctagcac

SEQ ID NO: 180562 - DNA, 25 bp, Homo sapien
tggtcctagcactgcacactcagtt

SEQ ID NO: 180563 - DNA, 25 bp, Homo sapien
acactcagttctgctctaagaagct

SEQ ID NO: 180564 - DNA, 25 bp, Homo sapien
ggaagtgctgtatttaagatcaaat

SEQ ID NO: 180565 - DNA, 25 bp, Homo sapien
gctcctcccatcttattgtagtttt

SEQ ID NO: 180566 - DNA, 25 bp, Homo sapien
tattttatggcccagccatcagcat

SEQ ID NO: 180567 - DNA, 25 bp, Homo sapien
tccatctcaagggatcaacccaagt

SEQ ID NO: 180568 - DNA, 25 bp, Homo sapien
gggatcaacccaagttcatggccct

SEQ ID NO: 180569 - DNA, 25 bp, Homo sapien
aagttcatggccctcttctatggag

SEQ ID NO: 180570 - DNA, 25 bp, Homo sapien
atggccctcttctatggagtggtga

SEQ ID NO: 180571 - DNA, 25 bp, Homo sapien
atggagtggtgactccctcactcaa

SEQ ID NO: 180572 - DNA, 25 bp, Homo sapien
ctacaccctgcggaataagaatgta

SEQ ID NO: 180573 - DNA, 25 bp, Homo sapien
ttacgcaacttggtgaggagcattt

SEQ ID NO: 180574 - DNA, 25 bp, Homo sapien
gaggagcatttcagctttaagtgat

SEQ ID NO: 180575 - DNA, 25 bp, Homo sapien
ttcattcagtctacactttggcatt

SEQ ID NO: 180576 - DNA, 25 bp, Homo sapien
ttcagtctacactttggcattctct

SEQ ID NO: 180577 - DNA, 25 bp, Homo sapien
agtctacactttggcattctctctg

SEQ ID NO: 180578 - DNA, 25 bp, Homo sapien
ggcattctctctggcgatggagtgt

SEQ ID NO: 180579 - DNA, 25 bp, Homo sapien
gatggagtgtggctgggctgaccgc

SEQ ID NO: 180580 - DNA, 25 bp, Homo sapien
ggctgaccgcaaaaggtgccttaca

SEQ ID NO: 180581 - DNA, 25 bp, Homo sapien
gaccgcaaaaggtgccttacacact

SEQ ID NO: 180582 - DNA, 25 bp, Homo sapien
gcaaaaggtgccttacacactgccc

SEQ ID NO: 180583 - DNA, 25 bp, Homo sapien
tgattaccccccatgttgcatatca

SEQ ID NO: 180584 - DNA, 25 bp, Homo sapien
ccatgttgcatatcagggtgctcaa

SEQ ID NO: 180585 - DNA, 25 bp, Homo sapien
tgttgcatatcagggtgctcaagga

SEQ ID NO: 180586 - DNA, 25 bp, Homo sapien
agtccagaccccacaacttcaggag

SEQ ID NO: 180587 - DNA, 25 bp, Homo sapien
aacttcaggagctctttcccggcag

SEQ ID NO: 180588 - DNA, 25 bp, Homo sapien
gctctttcccggcagcagagatctg

SEQ ID NO: 180589 - DNA, 25 bp, Homo sapien
agcagagatctgcaggctgcctctt

SEQ ID NO: 180590 - DNA, 25 bp, Homo sapien
gaccttggcagtgtggacatgagca

SEQ ID NO: 180591 - DNA, 25 bp, Homo sapien
agagcgatggagcagtctcctgccc

SEQ ID NO: 180592 - DNA, 25 bp, Homo sapien
ctgtcctgatggcactctgttgtat

SEQ ID NO: 180593 - DNA, 25 bp, Homo sapien
atggcactctgttgtattttcttac

SEQ ID NO: 180594 - DNA, 25 bp, Homo sapien
gttgtattttcttactgaagttcag

SEQ ID NO: 180595 - DNA, 25 bp, Homo sapien
gaagttcagtgataactctgagcag

SEQ ID NO: 180596 - DNA, 25 bp, Homo sapien
tgataactctgagcagtttcattgt

SEQ ID NO: 180597 - DNA, 25 bp, Homo sapien
taaataaccctttcaatatacctgg

SEQ ID NO: 180598 - DNA, 25 bp, Homo sapien
tatacctggtttttacagcattgca

SEQ ID NO: 180599 - DNA, 25 bp, Homo sapien
aatgttttatgtactccttttgtgt

SEQ ID NO: 180600 - DNA, 25 bp, Homo sapien
atgtactccttttgtgttttatctt

SEQ ID NO: 180601 - DNA, 25 bp, Homo sapien
tgtttttccatctgtactcccctca

SEQ ID NO: 180602 - DNA, 25 bp, Homo sapien
cccctcatcctcctaatgttgagaa

SEQ ID NO: 180603 - DNA, 25 bp, Homo sapien
aaatcaaatttcctgggtgtgtcct

SEQ ID NO: 180604 - DNA, 25 bp, Homo sapien
caaatttcctgggtgtgtccttgtt

SEQ ID NO: 180605 - DNA, 25 bp, Homo sapien
ttcctgggtgtgtccttgttaagtg

SEQ ID NO: 180606 - DNA, 25 bp, Homo sapien
ggtgtgtccttgttaagtgatcaaa

SEQ ID NO: 180607 - DNA, 25 bp, Homo sapien
agtgatcaaaagtaaatgttctctt

SEQ ID NO: 180608 - DNA, 25 bp, Homo sapien
tgaagccaacgtctgggccccaaag

SEQ ID NO: 180609 - DNA, 25 bp, Homo sapien
aaagccggtgcaggctctgctgtca

SEQ ID NO: 180610 - DNA, 25 bp, Homo sapien
aggctctgctgtcatcgtcaggact

SEQ ID NO: 180611 - DNA, 25 bp, Homo sapien
gtcatcgtcaggactccttgtgggc

SEQ ID NO: 180612 - DNA, 25 bp, Homo sapien
agctcaccctgcattggtccaggac

SEQ ID NO: 180613 - DNA, 25 bp, Homo sapien
gcattggtccaggaccccaaggtca

SEQ ID NO: 180614 - DNA, 25 bp, Homo sapien
ttccccagatgccatcgaggacact

SEQ ID NO: 180615 - DNA, 25 bp, Homo sapien
atgccatcgaggacactgaatctca

SEQ ID NO: 180616 - DNA, 25 bp, Homo sapien
ctgaatctcagaaagccatggacaa

SEQ ID NO: 180617 - DNA, 25 bp, Homo sapien
gaaacttcaacccaaagccaatctg

SEQ ID NO: 180618 - DNA, 25 bp, Homo sapien
gccaatctgactggtccagaaatgg

SEQ ID NO: 180619 - DNA, 25 bp, Homo sapien
tctaggtgatgccaagaaaacatgt

SEQ ID NO: 180620 - DNA, 25 bp, Homo sapien
agaaaacatgtgacgcgctccaggc

SEQ ID NO: 180621 - DNA, 25 bp, Homo sapien
tgtgacgcgctccaggcgaaagtta

SEQ ID NO: 180622 - DNA, 25 bp, Homo sapien
gcgctccaggcgaaagttagagaat

SEQ ID NO: 180623 - DNA, 25 bp, Homo sapien
gttagagaatcctatcagaagtaaa

SEQ ID NO: 180624 - DNA, 25 bp, Homo sapien
atattaaggatcaagctgttagcta

SEQ ID NO: 180625 - DNA, 25 bp, Homo sapien
ctctgcagttttgggaacaggcaaa

SEQ ID NO: 180626 - DNA, 25 bp, Homo sapien
atcagtatacatggtgatgtacatc

SEQ ID NO: 180627 - DNA, 25 bp, Homo sapien
gatgtacatctgtagcaaagctctt

SEQ ID NO: 180628 - DNA, 25 bp, Homo sapien
tacatctgtagcaaagctcttggag

SEQ ID NO: 180629 - DNA, 25 bp, Homo sapien
tttcaaaagcagtaatccctcaatt

SEQ ID NO: 180630 - DNA, 25 bp, Homo sapien
gacttcacaatgttggcctgtcaga

SEQ ID NO: 180631 - DNA, 25 bp, Homo sapien
ttggcctgtcagagcttgattagaa

SEQ ID NO: 180632 - DNA, 25 bp, Homo sapien
gagcttgattagaagccaagacagt

SEQ ID NO: 180633 - DNA, 25 bp, Homo sapien
gcagcaaaggaagacttggcccagg

SEQ ID NO: 180634 - DNA, 25 bp, Homo sapien
gacttggcccaggaaaaacctgtgg

SEQ ID NO: 180635 - DNA, 25 bp, Homo sapien
gggttgtgctaatttctgtccagaa

SEQ ID NO: 180636 - DNA, 25 bp, Homo sapien
gggacctggttatgttgttattctc

SEQ ID NO: 180637 - DNA, 25 bp, Homo sapien
ggttatgttgttattctcggactgt

SEQ ID NO: 180638 - DNA, 25 bp, Homo sapien
gttattctcggactgtgaattttgg

SEQ ID NO: 180639 - DNA, 25 bp, Homo sapien
tattctgtaaacctaatgtctgtat

SEQ ID NO: 180640 - DNA, 25 bp, Homo sapien
gagcgttaacacagtaaaatattca

SEQ ID NO: 180641 - DNA, 25 bp, Homo sapien
acaccagtgtgctacagtggcgggt

SEQ ID NO: 180642 - DNA, 25 bp, Homo sapien
acagtggcgggtggtctgatgcggc

SEQ ID NO: 180643 - DNA, 25 bp, Homo sapien
gtctgatgcggccagggaagagtca

SEQ ID NO: 180644 - DNA, 25 bp, Homo sapien
tattttcgggagatgtctattgccg

SEQ ID NO: 180645 - DNA, 25 bp, Homo sapien
gagatgtctattgccgagtagagta

SEQ ID NO: 180646 - DNA, 25 bp, Homo sapien
gagtagagtaatatatacccagagt

SEQ ID NO: 180647 - DNA, 25 bp, Homo sapien
tacccagagtatgtctatagcagag

SEQ ID NO: 180648 - DNA, 25 bp, Homo sapien
ggtagactgacatacagaagtctct

SEQ ID NO: 180649 - DNA, 25 bp, Homo sapien
gaagtctctatttatccgggtggga

SEQ ID NO: 180650 - DNA, 25 bp, Homo sapien
gtctctatttatccgggtgggaaga

SEQ ID NO: 180651 - DNA, 25 bp, Homo sapien
tgggaagagggagtcacatcgcttt

SEQ ID NO: 180652 - DNA, 25 bp, Homo sapien
gctggggaccatattctgcaatgca

SEQ ID NO: 180653 - DNA, 25 bp, Homo sapien
ttctgcaatgcagccaaatccgagg

SEQ ID NO: 180654 - DNA, 25 bp, Homo sapien
aatgcagccaaatccgaggaagaga

SEQ ID NO: 180655 - DNA, 25 bp, Homo sapien
gaagtagatggcaatggttatgata

SEQ ID NO: 180656 - DNA, 25 bp, Homo sapien
aatcttcgggacttctttaatgcta

SEQ ID NO: 180657 - DNA, 25 bp, Homo sapien
tcgggacttctttaatgctacgtta

SEQ ID NO: 180658 - DNA, 25 bp, Homo sapien
tgctacgttaatgtttcactgctcg

SEQ ID NO: 180659 - DNA, 25 bp, Homo sapien
gttaatgtttcactgctcgtctaga

SEQ ID NO: 180660 - DNA, 25 bp, Homo sapien
cactgctcgtctagaaactcctaaa

SEQ ID NO: 180661 - DNA, 25 bp, Homo sapien
aactcctaaatccagctttctatca

SEQ ID NO: 180662 - DNA, 25 bp, Homo sapien
ctttctatcatctgccccacattgg

SEQ ID NO: 180663 - DNA, 25 bp, Homo sapien
atctaagatcattttccctaagcat

SEQ ID NO: 180664 - DNA, 25 bp, Homo sapien
gcattgacacatagcttcatctgag

SEQ ID NO: 180665 - DNA, 25 bp, Homo sapien
atggcagctgtttgtatctgcactg

SEQ ID NO: 180666 - DNA, 25 bp, Homo sapien
ctgtgtctgtctacaaaaagtgaaa

SEQ ID NO: 180667 - DNA, 25 bp, Homo sapien
ttaactttgtaactgcaagaattcc

SEQ ID NO: 180668 - DNA, 25 bp, Homo sapien
aactgcaagaattccagttcagccg

SEQ ID NO: 180669 - DNA, 25 bp, Homo sapien
gttcagccgggcgaggattagtatt

SEQ ID NO: 180670 - DNA, 25 bp, Homo sapien
gccgggcgaggattagtattatttt

SEQ ID NO: 180671 - DNA, 25 bp, Homo sapien
ttaactctcccgtaagatttttcag

SEQ ID NO: 180672 - DNA, 25 bp, Homo sapien
taactctcccgtaagatttttcagt

SEQ ID NO: 180673 - DNA, 25 bp, Homo sapien
ttcagtaccaccaaattggttttgg

SEQ ID NO: 180674 - DNA, 25 bp, Homo sapien
ctcattatctctacaatcctcaaga

SEQ ID NO: 180675 - DNA, 25 bp, Homo sapien
agattgcttcagttgagggccggaa

SEQ ID NO: 180676 - DNA, 25 bp, Homo sapien
gccggaagaaggcttttgccacctg

SEQ ID NO: 180677 - DNA, 25 bp, Homo sapien
ctcactgtggtcattgtccactaca

SEQ ID NO: 180678 - DNA, 25 bp, Homo sapien
gtccactacagctgtgcctccattg

SEQ ID NO: 180679 - DNA, 25 bp, Homo sapien
ttgcctacctcaagcccaagtcaga

SEQ ID NO: 180680 - DNA, 25 bp, Homo sapien
agaacaccagagaacatgaccagct

SEQ ID NO: 180681 - DNA, 25 bp, Homo sapien
gaacatgaccagctgatctcggtga

SEQ ID NO: 180682 - DNA, 25 bp, Homo sapien
tgatctcggtgacctacactgtcat

SEQ ID NO: 180683 - DNA, 25 bp, Homo sapien
tgaaccctgtggtatacaccctgag

SEQ ID NO: 180684 - DNA, 25 bp, Homo sapien
caaagatgctctgtgcagggctgtt

SEQ ID NO: 180685 - DNA, 25 bp, Homo sapien
ggggctgtggccgtctttgtactct

SEQ ID NO: 180686 - DNA, 25 bp, Homo sapien
gggctgtggccgtctttgtactctg

SEQ ID NO: 180687 - DNA, 25 bp, Homo sapien
ggctgtggccgtctttgtactctgg

SEQ ID NO: 180688 - DNA, 25 bp, Homo sapien
gctgtggccgtctttgtactctggt

SEQ ID NO: 180689 - DNA, 25 bp, Homo sapien
ctgtggccgtctttgtactctggtg

SEQ ID NO: 180690 - DNA, 25 bp, Homo sapien
tgtggccgtctttgtactctggtga

SEQ ID NO: 180691 - DNA, 25 bp, Homo sapien
gtggccgtctttgtactctggtgat

SEQ ID NO: 180692 - DNA, 25 bp, Homo sapien
tggccgtctttgtactctggtgatt

SEQ ID NO: 180693 - DNA, 25 bp, Homo sapien
ggccgtctttgtactctggtgattt

SEQ ID NO: 180694 - DNA, 25 bp, Homo sapien
gccgtctttgtactctggtgatttt

SEQ ID NO: 180695 - DNA, 25 bp, Homo sapien
ggagtcctggggacgcagtgcccca

SEQ ID NO: 180696 - DNA, 25 bp, Homo sapien
tcctggggacgcagtgccccagctg

SEQ ID NO: 180697 - DNA, 25 bp, Homo sapien
ccagctgggaagagggcgggatcgg

SEQ ID NO: 180698 - DNA, 25 bp, Homo sapien
cagctgggaagagggcgggatcggg

SEQ ID NO: 180699 - DNA, 25 bp, Homo sapien
agctgggaagagggcgggatcgggc

SEQ ID NO: 180700 - DNA, 25 bp, Homo sapien
gctgggaagagggcgggatcgggca

SEQ ID NO: 180701 - DNA, 25 bp, Homo sapien
ctgggaagagggcgggatcgggcac

SEQ ID NO: 180702 - DNA, 25 bp, Homo sapien
atgtcccctctctgcggggggggcg

SEQ ID NO: 180703 - DNA, 25 bp, Homo sapien
ttctccccatcccggtctccagaga

SEQ ID NO: 180704 - DNA, 25 bp, Homo sapien
tctccccatcccggtctccagagac

SEQ ID NO: 180705 - DNA, 25 bp, Homo sapien
ctccccatcccggtctccagagacc

SEQ ID NO: 180706 - DNA, 25 bp, Homo sapien
catgcctaaactagtgctatgtaat

SEQ ID NO: 180707 - DNA, 25 bp, Homo sapien
tttcgatttcgtttaatgacaaaat

SEQ ID NO: 180708 - DNA, 25 bp, Homo sapien
taatctcttaatatgctgaaatcaa

SEQ ID NO: 180709 - DNA, 25 bp, Homo sapien
gctgaaatcaagcacgtgagagttt

SEQ ID NO: 180710 - DNA, 25 bp, Homo sapien
atcaagcacgtgagagtttttgttt

SEQ ID NO: 180711 - DNA, 25 bp, Homo sapien
gagacacagcatgtattatgcactt

SEQ ID NO: 180712 - DNA, 25 bp, Homo sapien
ttatgcacttcatttctctactgtg

SEQ ID NO: 180713 - DNA, 25 bp, Homo sapien
gagaatgttaaacgttatgcaaaat

SEQ ID NO: 180714 - DNA, 25 bp, Homo sapien
gttttgaaattactgtacctagtct

SEQ ID NO: 180715 - DNA, 25 bp, Homo sapien
actgtacctagtcttttttgcatta

SEQ ID NO: 180716 - DNA, 25 bp, Homo sapien
gtaacctttttctatgcaagagtct

SEQ ID NO: 180717 - DNA, 25 bp, Homo sapien
gaacttgaccagttagacttacgaa

SEQ ID NO: 180718 - DNA, 25 bp, Homo sapien
gacttacgaagagatattgcctaca

SEQ ID NO: 180719 - DNA, 25 bp, Homo sapien
gatattgcctacaacttgtctctca

SEQ ID NO: 180720 - DNA, 25 bp, Homo sapien
ttgtctctcatctatcagagcagtg

SEQ ID NO: 180721 - DNA, 25 bp, Homo sapien
tatcagagcagtgggaataccggaa

SEQ ID NO: 180722 - DNA, 25 bp, Homo sapien
taccggaatggctcaaacgcttttg

SEQ ID NO: 180723 - DNA, 25 bp, Homo sapien
acgcttttgtatacctattgttcta

SEQ ID NO: 180724 - DNA, 25 bp, Homo sapien
ctattgttctatataaagcaccgca

SEQ ID NO: 180725 - DNA, 25 bp, Homo sapien
taaagcaccgcaactgagaacagag

SEQ ID NO: 180726 - DNA, 25 bp, Homo sapien
tgaggaccagtgtcttctgtctcag

SEQ ID NO: 180727 - DNA, 25 bp, Homo sapien
cagggcttattatttgtaactccaa

SEQ ID NO: 180728 - DNA, 25 bp, Homo sapien
gtttattctactgcagtagccagtg

SEQ ID NO: 180729 - DNA, 25 bp, Homo sapien
gtagccagtggaacaaagtttgtag

SEQ ID NO: 180730 - DNA, 25 bp, Homo sapien
ttgtagttattttgccacttacttt

SEQ ID NO: 180731 - DNA, 25 bp, Homo sapien
tagttattttgccacttacttttct

SEQ ID NO: 180732 - DNA, 25 bp, Homo sapien
tgtcattatatgcttatttgttttg

SEQ ID NO: 180733 - DNA, 25 bp, Homo sapien
gcttatttgttttgtcatttacgtg

SEQ ID NO: 180734 - DNA, 25 bp, Homo sapien
catttacgtgaccatttgattctca

SEQ ID NO: 180735 - DNA, 25 bp, Homo sapien
ttacgtgaccatttgattctcaaac

SEQ ID NO: 180736 - DNA, 25 bp, Homo sapien
gaactttgatttgaacaggtgcatt

SEQ ID NO: 180737 - DNA, 25 bp, Homo sapien
caggtgcatttaaacaaccggaaat

SEQ ID NO: 180738 - DNA, 25 bp, Homo sapien
aaccggaaatgatcacttagaaaat

SEQ ID NO: 180739 - DNA, 25 bp, Homo sapien
tccgctaggcccatcgtttctcagg

SEQ ID NO: 180740 - DNA, 25 bp, Homo sapien
taggcccatcgtttctcaggctgcc

SEQ ID NO: 180741 - DNA, 25 bp, Homo sapien
ggctgcccaaggctcttctgtaaca

SEQ ID NO: 180742 - DNA, 25 bp, Homo sapien
tgcccaaggctcttctgtaacatct

SEQ ID NO: 180743 - DNA, 25 bp, Homo sapien
cccaaggctcttctgtaacatcttt

SEQ ID NO: 180744 - DNA, 25 bp, Homo sapien
aaggctcttctgtaacatcttttgt

SEQ ID NO: 180745 - DNA, 25 bp, Homo sapien
aggctcttctgtaacatcttttgtt

SEQ ID NO: 180746 - DNA, 25 bp, Homo sapien
ggctcttctgtaacatcttttgtta

SEQ ID NO: 180747 - DNA, 25 bp, Homo sapien
aacatcttttgttactcacattttc

SEQ ID NO: 180748 - DNA, 25 bp, Homo sapien
atcttttgttactcacattttcttt

SEQ ID NO: 180749 - DNA, 25 bp, Homo sapien
tgttactcacattttctttaattta

SEQ ID NO: 180750 - DNA, 25 bp, Homo sapien
gagacagacacacactggctcctgg

SEQ ID NO: 180751 - DNA, 25 bp, Homo sapien
acacactggctcctggacctaaagg

SEQ ID NO: 180752 - DNA, 25 bp, Homo sapien
gacctaaagggtatgagctggagct

SEQ ID NO: 180753 - DNA, 25 bp, Homo sapien
taaggccagctagagcttccactgt

SEQ ID NO: 180754 - DNA, 25 bp, Homo sapien
ggcactgggcactagctagatgctt

SEQ ID NO: 180755 - DNA, 25 bp, Homo sapien
agatgctttaggttgcttcagctga

SEQ ID NO: 180756 - DNA, 25 bp, Homo sapien
taggttgcttcagctgatccttcaa

SEQ ID NO: 180757 - DNA, 25 bp, Homo sapien
agctgatccttcaactctgtgaggt

SEQ ID NO: 180758 - DNA, 25 bp, Homo sapien
ggtggataccaatattctattttgc

SEQ ID NO: 180759 - DNA, 25 bp, Homo sapien
gaggttaactaatatatccatgatc

SEQ ID NO: 180760 - DNA, 25 bp, Homo sapien
atatatccatgatcacacagctaat

SEQ ID NO: 180761 - DNA, 25 bp, Homo sapien
tttctatgacccagctaactctctc

SEQ ID NO: 180762 - DNA, 25 bp, Homo sapien
taactctctccatcttcatactttt

SEQ ID NO: 180763 - DNA, 25 bp, Homo sapien
tttgatgtgaccttcattcttccag

SEQ ID NO: 180764 - DNA, 25 bp, Homo sapien
taatgatcctgtctggcttgcctgc

SEQ ID NO: 180765 - DNA, 25 bp, Homo sapien
gcctgccccagattttattgattac

SEQ ID NO: 180766 - DNA, 25 bp, Homo sapien
gattttattgattaccctgagcggc

SEQ ID NO: 180767 - DNA, 25 bp, Homo sapien
gaatgcaactgcaggcctcaagaat

SEQ ID NO: 180768 - DNA, 25 bp, Homo sapien
aggcctcaagaatccccttatgttt

SEQ ID NO: 180769 - DNA, 25 bp, Homo sapien
gtttctgggatgaaaacctgtcatt

SEQ ID NO: 180770 - DNA, 25 bp, Homo sapien
taattcactggctctctagttcagc

SEQ ID NO: 180771 - DNA, 25 bp, Homo sapien
cctcctacacctaagttagcgttca

SEQ ID NO: 180772 - DNA, 25 bp, Homo sapien
gctacacggaagctctgctgcaagg

SEQ ID NO: 180773 - DNA, 25 bp, Homo sapien
tacacggaagctctgctgcaaggct

SEQ ID NO: 180774 - DNA, 25 bp, Homo sapien
cacggaagctctgctgcaaggctgg

SEQ ID NO: 180775 - DNA, 25 bp, Homo sapien
gcaaggctggcttggagcaggccca

SEQ ID NO: 180776 - DNA, 25 bp, Homo sapien
ccccttctctactatgtaaaccagg

SEQ ID NO: 180777 - DNA, 25 bp, Homo sapien
ttctctactatgtaaaccaggcccg

SEQ ID NO: 180778 - DNA, 25 bp, Homo sapien
tactatgtaaaccaggcccgccaag

SEQ ID NO: 180779 - DNA, 25 bp, Homo sapien
aagctccccgactcaagtatcttat

SEQ ID NO: 180780 - DNA, 25 bp, Homo sapien
ctccccgactcaagtatcttattgg

SEQ ID NO: 180781 - DNA, 25 bp, Homo sapien
gatttaatccttaggataactcttt

SEQ ID NO: 180782 - DNA, 25 bp, Homo sapien
tccttaggataactcttttaaagtg

SEQ ID NO: 180783 - DNA, 25 bp, Homo sapien
cacactcatctttttaaggtcaggt

SEQ ID NO: 180784 - DNA, 25 bp, Homo sapien
taaggtcaggttggttcctggcaaa

SEQ ID NO: 180785 - DNA, 25 bp, Homo sapien
ggttcctggcaaaaatgtacctcca

SEQ ID NO: 180786 - DNA, 25 bp, Homo sapien
gggcctccaagcataggatttggaa

SEQ ID NO: 180787 - DNA, 25 bp, Homo sapien
tttggaagacaggaacggcacaggc

SEQ ID NO: 180788 - DNA, 25 bp, Homo sapien
aggaaagcagctgcactcagacaat

SEQ ID NO: 180789 - DNA, 25 bp, Homo sapien
gacaatgccttctccattacttgaa

SEQ ID NO: 180790 - DNA, 25 bp, Homo sapien
ttgaagcttctttctgttcagccat

SEQ ID NO: 180791 - DNA, 25 bp, Homo sapien
aacctttgtgcagggacagttggct

SEQ ID NO: 180792 - DNA, 25 bp, Homo sapien
acagttggcttccagaggtttcagc

SEQ ID NO: 180793 - DNA, 25 bp, Homo sapien
agaggtttcagctttcagttatttg

SEQ ID NO: 180794 - DNA, 25 bp, Homo sapien
cctttgttttcccatcagggacttg

SEQ ID NO: 180795 - DNA, 25 bp, Homo sapien
aaggtatttggtcattatcttctac

SEQ ID NO: 180796 - DNA, 25 bp, Homo sapien
atttggtcattatcttctacagcag

SEQ ID NO: 180797 - DNA, 25 bp, Homo sapien
tacagcagtggaatgagtggtcccg

SEQ ID NO: 180798 - DNA, 25 bp, Homo sapien
agtggtcccggagatgtgctatatg

SEQ ID NO: 180799 - DNA, 25 bp, Homo sapien
gtgctatatgaaacattctttctga

SEQ ID NO: 180800 - DNA, 25 bp, Homo sapien
ttctgagatatatcaaccacacgtg

SEQ ID NO: 180801 - DNA, 25 bp, Homo sapien
atcaaccacacgtggaaaagccttt

SEQ ID NO: 180802 - DNA, 25 bp, Homo sapien
aaaagcctttcagtcatacatgcaa

SEQ ID NO: 180803 - DNA, 25 bp, Homo sapien
gtcatacatgcaaatccacaaagag

SEQ ID NO: 180804 - DNA, 25 bp, Homo sapien
gaccttgctgggaagcctcaccctt

SEQ ID NO: 180805 - DNA, 25 bp, Homo sapien
aaccaggatttcactcttcaaagcc

SEQ ID NO: 180806 - DNA, 25 bp, Homo sapien
aaagaggctacactgctcctggctg

SEQ ID NO: 180807 - DNA, 25 bp, Homo sapien
tggctgtgtcgaacctgtgctttga

SEQ ID NO: 180808 - DNA, 25 bp, Homo sapien
tgtgctttgatcctatcctgtacta

SEQ ID NO: 180809 - DNA, 25 bp, Homo sapien
tatcctgtactatcacctctcaaaa

SEQ ID NO: 180810 - DNA, 25 bp, Homo sapien
aagcattccgctcaaaggtcactga

SEQ ID NO: 180811 - DNA, 25 bp, Homo sapien
gagacttttgcctcacctaaagaga

SEQ ID NO: 180812 - DNA, 25 bp, Homo sapien
gacaggattttttgtgctaccaatt

SEQ ID NO: 180813 - DNA, 25 bp, Homo sapien
tgctaccaattctggccttactgga

SEQ ID NO: 180814 - DNA, 25 bp, Homo sapien
tataccctcagccagacagaagtca

SEQ ID NO: 180815 - DNA, 25 bp, Homo sapien
gaagtcataactgattgctcaacca

SEQ ID NO: 180816 - DNA, 25 bp, Homo sapien
caactcatctaacccatcagagact

SEQ ID NO: 180817 - DNA, 25 bp, Homo sapien
aaactacttcaatgtgaggactgtg

SEQ ID NO: 180818 - DNA, 25 bp, Homo sapien
gactgtgggaagagcattgtgcaca

SEQ ID NO: 180819 - DNA, 25 bp, Homo sapien
gagcattgtgcacagttcatgcctt

SEQ ID NO: 180820 - DNA, 25 bp, Homo sapien
gtgcacagttcatgccttaaagacc

SEQ ID NO: 180821 - DNA, 25 bp, Homo sapien
gttcatgccttaaagaccaacaaag

SEQ ID NO: 180822 - DNA, 25 bp, Homo sapien
gaccaaagtggagagaaaacatcta

SEQ ID NO: 180823 - DNA, 25 bp, Homo sapien
gcttgaatcttgatacgcttttgtc

SEQ ID NO: 180824 - DNA, 25 bp, Homo sapien
cttgatacgcttttgtcattatttt

SEQ ID NO: 180825 - DNA, 25 bp, Homo sapien
gacacataactgttgtactcattta

SEQ ID NO: 180826 - DNA, 25 bp, Homo sapien
gggtacagtgtgatagttaatgcaa

SEQ ID NO: 180827 - DNA, 25 bp, Homo sapien
atgttggtacagcagtaaacttgga

SEQ ID NO: 180828 - DNA, 25 bp, Homo sapien
gaagatgaagccaatatagcctgga

SEQ ID NO: 180829 - DNA, 25 bp, Homo sapien
gaagccaatatagcctggaagtatt

SEQ ID NO: 180830 - DNA, 25 bp, Homo sapien
aatatagcctggaagtattacaagt

SEQ ID NO: 180831 - DNA, 25 bp, Homo sapien
gatgtagagtttttaccacctcaac

SEQ ID NO: 180832 - DNA, 25 bp, Homo sapien
ttaccacctcaacttccaagtgata

SEQ ID NO: 180833 - DNA, 25 bp, Homo sapien
tcaacttccaagtgataaattcaag

SEQ ID NO: 180834 - DNA, 25 bp, Homo sapien
ttcaaggatgatccagttggacctt

SEQ ID NO: 180835 - DNA, 25 bp, Homo sapien
gatgatccagttggaccttttggac

SEQ ID NO: 180836 - DNA, 25 bp, Homo sapien
tccagttggaccttttggacaggaa

SEQ ID NO: 180837 - DNA, 25 bp, Homo sapien
ccttttggacaggaaagtgtaacat

SEQ ID NO: 180838 - DNA, 25 bp, Homo sapien
ctgctgcacccatctgcggatggta

SEQ ID NO: 180839 - DNA, 25 bp, Homo sapien
acccatctgcggatggtactccctt

SEQ ID NO: 180840 - DNA, 25 bp, Homo sapien
actgatggcaggaatccaagtgcat

SEQ ID NO: 180841 - DNA, 25 bp, Homo sapien
tccaagtgcatttcttaaataagtt

SEQ ID NO: 180842 - DNA, 25 bp, Homo sapien
ctccctctcccttgagaagctgagt

SEQ ID NO: 180843 - DNA, 25 bp, Homo sapien
gaagctgagtcttctgcatcagatt

SEQ ID NO: 180844 - DNA, 25 bp, Homo sapien
gagtcttctgcatcagattattgca

SEQ ID NO: 180845 - DNA, 25 bp, Homo sapien
agattattgcaacatttaacctgaa

SEQ ID NO: 180846 - DNA, 25 bp, Homo sapien
tcagagtctgggtaccccaggctcc

SEQ ID NO: 180847 - DNA, 25 bp, Homo sapien
tcttccttctgctagtctcctgtgt

SEQ ID NO: 180848 - DNA, 25 bp, Homo sapien
tgctagtctcctgtgtcctgctggc

SEQ ID NO: 180849 - DNA, 25 bp, Homo sapien
tcctcctcctgcaggataaagtcat

SEQ ID NO: 180850 - DNA, 25 bp, Homo sapien
aggataaagtcatccccaaggctcc

SEQ ID NO: 180851 - DNA, 25 bp, Homo sapien
ccaaggctccagctactctaaatta

SEQ ID NO: 180852 - DNA, 25 bp, Homo sapien
gtctccttataagttattgctgctc

SEQ ID NO: 180853 - DNA, 25 bp, Homo sapien
tataagttattgctgctccaggaga

SEQ ID NO: 180854 - DNA, 25 bp, Homo sapien
aggagattgtccttcatcgtccagg

SEQ ID NO: 180855 - DNA, 25 bp, Homo sapien
ctggctcccacgtggttgcagatac

SEQ ID NO: 180856 - DNA, 25 bp, Homo sapien
gttgcagatacctcagacctggtgc

SEQ ID NO: 180857 - DNA, 25 bp, Homo sapien
gcggtttcggaagcgtcagtgtttc

SEQ ID NO: 180858 - DNA, 25 bp, Homo sapien
aagcgtcagtgtttccatgttatgg

SEQ ID NO: 180859 - DNA, 25 bp, Homo sapien
gtttccatgttatggatctctctgc

SEQ ID NO: 180860 - DNA, 25 bp, Homo sapien
gatgagaaacaacacgctctccttc

SEQ ID NO: 180861 - DNA, 25 bp, Homo sapien
aacaacacgctctccttcagacaat

SEQ ID NO: 180862 - DNA, 25 bp, Homo sapien
gacaatgaggcattctgtcctcctg

SEQ ID NO: 180863 - DNA, 25 bp, Homo sapien
tgccattcttcatctccactgagag

SEQ ID NO: 180864 - DNA, 25 bp, Homo sapien
atctccactgagagccagagctggt

SEQ ID NO: 180865 - DNA, 25 bp, Homo sapien
acaggcattctgcattgctctactc

SEQ ID NO: 180866 - DNA, 25 bp, Homo sapien
gcattgctctactcttaggtttgtg

SEQ ID NO: 180867 - DNA, 25 bp, Homo sapien
tactcttaggtttgtgtgtgtgatc

SEQ ID NO: 180868 - DNA, 25 bp, Homo sapien
tatcctaccctgtctgtgggctctt

SEQ ID NO: 180869 - DNA, 25 bp, Homo sapien
gtgggctcttttactaccagcctat

SEQ ID NO: 180870 - DNA, 25 bp, Homo sapien
gtgggactgtcatggcatttagttc

SEQ ID NO: 180871 - DNA, 25 bp, Homo sapien
tctactaccgctcggaggaggatca

SEQ ID NO: 180872 - DNA, 25 bp, Homo sapien
aggaggatcaccaccggcctgctga

SEQ ID NO: 180873 - DNA, 25 bp, Homo sapien
tgacatccccgatcgattctcggca

SEQ ID NO: 180874 - DNA, 25 bp, Homo sapien
atcgattctcggcagccaaggatga

SEQ ID NO: 180875 - DNA, 25 bp, Homo sapien
accattagtcccgtgcagcctgaag

SEQ ID NO: 180876 - DNA, 25 bp, Homo sapien
gtgcagcctgaagacgacgcggatt

SEQ ID NO: 180877 - DNA, 25 bp, Homo sapien
gacgcggattactactgctctgttg

SEQ ID NO: 180878 - DNA, 25 bp, Homo sapien
tgctctgttggctacggctttagtc

SEQ ID NO: 180879 - DNA, 25 bp, Homo sapien
ttggctacggctttagtccctaggg

SEQ ID NO: 180880 - DNA, 25 bp, Homo sapien
ccttttaaactttctctgagccttg

SEQ ID NO: 180881 - DNA, 25 bp, Homo sapien
tgagccttgcttcccctctgtaaaa

SEQ ID NO: 180882 - DNA, 25 bp, Homo sapien
cccttgccccattttaagcaggagc

SEQ ID NO: 180883 - DNA, 25 bp, Homo sapien
gccccattttaagcaggagcaggtg

SEQ ID NO: 180884 - DNA, 25 bp, Homo sapien
agcaggtggctggtttgaagcccca

SEQ ID NO: 180885 - DNA, 25 bp, Homo sapien
tggctggtttgaagccccaggtatc

SEQ ID NO: 180886 - DNA, 25 bp, Homo sapien
ccttccctgctatgggaaaggccaa

SEQ ID NO: 180887 - DNA, 25 bp, Homo sapien
tgctatgggaaaggccaagctgctg

SEQ ID NO: 180888 - DNA, 25 bp, Homo sapien
gcagccgtgctgtcaacatcatccg

SEQ ID NO: 180889 - DNA, 25 bp, Homo sapien
gggtaggagaacagccattccacat

SEQ ID NO: 180890 - DNA, 25 bp, Homo sapien
ggagaacagccattccacatgtgtt

SEQ ID NO: 180891 - DNA, 25 bp, Homo sapien
agccattccacatgtgttccctcta

SEQ ID NO: 180892 - DNA, 25 bp, Homo sapien
tatccgtcctgcttcctgggcagct

SEQ ID NO: 180893 - DNA, 25 bp, Homo sapien
agaggacagagatgaccacatccct

SEQ ID NO: 180894 - DNA, 25 bp, Homo sapien
agagatgaccacatccctgctggat

SEQ ID NO: 180895 - DNA, 25 bp, Homo sapien
atgaccacatccctgctggatgcag

SEQ ID NO: 180896 - DNA, 25 bp, Homo sapien
gctggatgcaggacccgtccaaaga

SEQ ID NO: 180897 - DNA, 25 bp, Homo sapien
gatgcaggacccgtccaaagatgcc

SEQ ID NO: 180898 - DNA, 25 bp, Homo sapien
tcagcccacgttgctggcctttggg

SEQ ID NO: 180899 - DNA, 25 bp, Homo sapien
accagtgtgtgaggttggacttaga

SEQ ID NO: 180900 - DNA, 25 bp, Homo sapien
tgaggtggtaacagcggccgcagca

SEQ ID NO: 180901 - DNA, 25 bp, Homo sapien
gttggcctagacctgggatttgtgg

SEQ ID NO: 180902 - DNA, 25 bp, Homo sapien
gaaagctgctggtgtgaccagctga

SEQ ID NO: 180903 - DNA, 25 bp, Homo sapien
ctggtgtgaccagctgagcacccag

SEQ ID NO: 180904 - DNA, 25 bp, Homo sapien
gcatatgtagtcgatacagacacac

SEQ ID NO: 180905 - DNA, 25 bp, Homo sapien
tacagacacactttttgtccctgca

SEQ ID NO: 180906 - DNA, 25 bp, Homo sapien
agacacactttttgtccctgcatgt

SEQ ID NO: 180907 - DNA, 25 bp, Homo sapien
ctttttgtccctgcatgtctacaga

SEQ ID NO: 180908 - DNA, 25 bp, Homo sapien
gcaaacaaaggacaccaaccacact

SEQ ID NO: 180909 - DNA, 25 bp, Homo sapien
acactccccagactaagccgagata

SEQ ID NO: 180910 - DNA, 25 bp, Homo sapien
tccccagactaagccgagatagaaa

SEQ ID NO: 180911 - DNA, 25 bp, Homo sapien
atggaagctagtgctttagggatat

SEQ ID NO: 180912 - DNA, 25 bp, Homo sapien
gctttagggatattgtgttccataa

SEQ ID NO: 180913 - DNA, 25 bp, Homo sapien
gtgttccataaattatcttgccttt

SEQ ID NO: 180914 - DNA, 25 bp, Homo sapien
tccactgttgttattatatcgtttc

SEQ ID NO: 180915 - DNA, 25 bp, Homo sapien
agagcccttggtctgctccatggag

SEQ ID NO: 180916 - DNA, 25 bp, Homo sapien
ctgctccatggagggcacgtggtac

SEQ ID NO: 180917 - DNA, 25 bp, Homo sapien
aggctgccagaagagcgaggcccca

SEQ ID NO: 180918 - DNA, 25 bp, Homo sapien
aggtctcctcctaccaacactggat

SEQ ID NO: 180919 - DNA, 25 bp, Homo sapien
aacactggatctgggactgcctcaa

SEQ ID NO: 180920 - DNA, 25 bp, Homo sapien
ggttcagatcatcaagtcccagatg

SEQ ID NO: 180921 - DNA, 25 bp, Homo sapien
atcaagtcccagatgatgtgtgcgg

SEQ ID NO: 180922 - DNA, 25 bp, Homo sapien
tgatgtgtgcggaggacacccacag

SEQ ID NO: 180923 - DNA, 25 bp, Homo sapien
acccacagggagaagttctgctatg

SEQ ID NO: 180924 - DNA, 25 bp, Homo sapien
aagttctgctatgagctaactggag

SEQ ID NO: 180925 - DNA, 25 bp, Homo sapien
gagctaactggagagcccttggtct

SEQ ID NO: 180926 - DNA, 25 bp, Homo sapien
ggaactgaaatacattctgaaccac

SEQ ID NO: 180927 - DNA, 25 bp, Homo sapien
aaccactttttccaccagcttgaat

SEQ ID NO: 180928 - DNA, 25 bp, Homo sapien
aatggctgctctatcttgggctgta

SEQ ID NO: 180929 - DNA, 25 bp, Homo sapien
aagggagtgaagtgcaccacgccca

SEQ ID NO: 180930 - DNA, 25 bp, Homo sapien
cgtccaccttcgttgtaagcaaaca

SEQ ID NO: 180931 - DNA, 25 bp, Homo sapien
ttctgtggcatgatatgtggcatag

SEQ ID NO: 180932 - DNA, 25 bp, Homo sapien
gtgtgatcaatcaactcatccttgt

SEQ ID NO: 180933 - DNA, 25 bp, Homo sapien
gggctgtcaacagcctgttttcata

SEQ ID NO: 180934 - DNA, 25 bp, Homo sapien
tcataaacagacctttccacgtact

SEQ ID NO: 180935 - DNA, 25 bp, Homo sapien
gtacttcggtttcatctctaggcat

SEQ ID NO: 180936 - DNA, 25 bp, Homo sapien
gatggtacattctggattcgcaaat

SEQ ID NO: 180937 - DNA, 25 bp, Homo sapien
caacacagtgtggaagatcgcaagt

SEQ ID NO: 180938 - DNA, 25 bp, Homo sapien
aagatcgcaagtgactgcttccgct

SEQ ID NO: 180939 - DNA, 25 bp, Homo sapien
aagtgactgcttccgcttccaggac

SEQ ID NO: 180940 - DNA, 25 bp, Homo sapien
gcttccaggactgggccagctagtg

SEQ ID NO: 180941 - DNA, 25 bp, Homo sapien
gttcatttctgttgttgcggagaca

SEQ ID NO: 180942 - DNA, 25 bp, Homo sapien
gttgttgcggagacactgcagactc

SEQ ID NO: 180943 - DNA, 25 bp, Homo sapien
tgcagactccactgtgccgaggttg

SEQ ID NO: 180944 - DNA, 25 bp, Homo sapien
cactgtgccgaggttgaactctttt

SEQ ID NO: 180945 - DNA, 25 bp, Homo sapien
ttgaactcttttttgttgctcaagt

SEQ ID NO: 180946 - DNA, 25 bp, Homo sapien
cttttttgttgctcaagttctagga

SEQ ID NO: 180947 - DNA, 25 bp, Homo sapien
taggagtccctttcctgaatatata

SEQ ID NO: 180948 - DNA, 25 bp, Homo sapien
tcaactgattgtcgaaagggtaata

SEQ ID NO: 180949 - DNA, 25 bp, Homo sapien
tgaaaaatagtcaccaactgtatat

SEQ ID NO: 180950 - DNA, 25 bp, Homo sapien
accaactgtatatacttcctcaaga

SEQ ID NO: 180951 - DNA, 25 bp, Homo sapien
aattcattatatcatcagatagctt

SEQ ID NO: 180952 - DNA, 25 bp, Homo sapien
tattaagcatctgtgggaatataca

SEQ ID NO: 180953 - DNA, 25 bp, Homo sapien
tatacagttgggtggaatgataatc

SEQ ID NO: 180954 - DNA, 25 bp, Homo sapien
ttaagtttccgttgacttctgtaca

SEQ ID NO: 180955 - DNA, 25 bp, Homo sapien
tttccgttgacttctgtacatctac

SEQ ID NO: 180956 - DNA, 25 bp, Homo sapien
gttgacttctgtacatctacaatga

SEQ ID NO: 180957 - DNA, 25 bp, Homo sapien
gacttctgtacatctacaatgaata

SEQ ID NO: 180958 - DNA, 25 bp, Homo sapien
caatgaatacctcctcatagaagtg

SEQ ID NO: 180959 - DNA, 25 bp, Homo sapien
gaatctggtgttgatgcaatgcctc

SEQ ID NO: 180960 - DNA, 25 bp, Homo sapien
tggtgttgatgcaatgcctcagtga

SEQ ID NO: 180961 - DNA, 25 bp, Homo sapien
cctcagtgatgcattagatctctaa

SEQ ID NO: 180962 - DNA, 25 bp, Homo sapien
agtctgtatatacatgtacactttg

SEQ ID NO: 180963 - DNA, 25 bp, Homo sapien
actttgatcctgctggaaaatttta

SEQ ID NO: 180964 - DNA, 25 bp, Homo sapien
gcaaacacattgtctaatctttcaa

SEQ ID NO: 180965 - DNA, 25 bp, Homo sapien
gactgaacagtgtggttctttgaaa

SEQ ID NO: 180966 - DNA, 25 bp, Homo sapien
ccatttccattttgaactgctattt

SEQ ID NO: 180967 - DNA, 25 bp, Homo sapien
gaactgctatttgtattgtgctttt

SEQ ID NO: 180968 - DNA, 25 bp, Homo sapien
tattgtgctttttacttgagtcgtc

SEQ ID NO: 180969 - DNA, 25 bp, Homo sapien
acttgagtcgtcttcaatgttaata

SEQ ID NO: 180970 - DNA, 25 bp, Homo sapien
tgtgtcttagatcctcattatttta

SEQ ID NO: 180971 - DNA, 25 bp, Homo sapien
agatttagtaatttcttaccatgct

SEQ ID NO: 180972 - DNA, 25 bp, Homo sapien
tatgtaaagttcatgccatccaggc

SEQ ID NO: 180973 - DNA, 25 bp, Homo sapien
tgccatccaggcatttaagagcgat

SEQ ID NO: 180974 - DNA, 25 bp, Homo sapien
ttaagagcgatcctcatcccttcag

SEQ ID NO: 180975 - DNA, 25 bp, Homo sapien
gcaatatgtatttgagttcacacta

SEQ ID NO: 180976 - DNA, 25 bp, Homo sapien
gtatttgagttcacactatttctgt

SEQ ID NO: 180977 - DNA, 25 bp, Homo sapien
ttctgttttacagcagttttgaaaa

SEQ ID NO: 180978 - DNA, 25 bp, Homo sapien
gaaaaacacatactatgccaccaat

SEQ ID NO: 180979 - DNA, 25 bp, Homo sapien
ctatgccaccaattgtcatattatt

SEQ ID NO: 180980 - DNA, 25 bp, Homo sapien
atgtaatgcctaatacttagtatgt

SEQ ID NO: 180981 - DNA, 25 bp, Homo sapien
gaagaaagaaatccccaccacctca

SEQ ID NO: 180982 - DNA, 25 bp, Homo sapien
tcaacctctgctgagattgtgtgct

SEQ ID NO: 180983 - DNA, 25 bp, Homo sapien
gattgtgtgctaggaacagccttcc

SEQ ID NO: 180984 - DNA, 25 bp, Homo sapien
tttcccctcagtcaaacttgagcca

SEQ ID NO: 180985 - DNA, 25 bp, Homo sapien
agccagcctctggatcgatgtgatc

SEQ ID NO: 180986 - DNA, 25 bp, Homo sapien
gtgatcttattgcatgtttccatgg

SEQ ID NO: 180987 - DNA, 25 bp, Homo sapien
gggtgtacctatactttaagccaat

SEQ ID NO: 180988 - DNA, 25 bp, Homo sapien
aatcctgctgcattcactgctaagt

SEQ ID NO: 180989 - DNA, 25 bp, Homo sapien
tgtgcagatcctttgctatctgact

SEQ ID NO: 180990 - DNA, 25 bp, Homo sapien
tttgctatctgacttgcatctcttc

SEQ ID NO: 180991 - DNA, 25 bp, Homo sapien
ctgcttgtttgtgttgggatatttt

SEQ ID NO: 180992 - DNA, 25 bp, Homo sapien
tttaacacgtgtaatctgcagtcct

SEQ ID NO: 180993 - DNA, 25 bp, Homo sapien
acacgtgtaatctgcagtccttaac

SEQ ID NO: 180994 - DNA, 25 bp, Homo sapien
tgcagtccttaacagtggcgtaatt

SEQ ID NO: 180995 - DNA, 25 bp, Homo sapien
aacagtggcgtaattgtacgtacct

SEQ ID NO: 180996 - DNA, 25 bp, Homo sapien
aattgtacgtacctgttgtgtttca

SEQ ID NO: 180997 - DNA, 25 bp, Homo sapien
gtacctgttgtgtttcagtttgttt

SEQ ID NO: 180998 - DNA, 25 bp, Homo sapien
gtttttcacctataatgaattgtaa

SEQ ID NO: 180999 - DNA, 25 bp, Homo sapien
gggtctgatagcaaacatagaaatg

SEQ ID NO: 181000 - DNA, 25 bp, Homo sapien
gatgtatattgttttttgttatcta

SEQ ID NO: 181001 - DNA, 25 bp, Homo sapien
agattggttcaagatttgtttggat

SEQ ID NO: 181002 - DNA, 25 bp, Homo sapien
tttggattattgttcctgtaaagaa

SEQ ID NO: 181003 - DNA, 25 bp, Homo sapien
ggcatttgtaaaggtgtccctggaa

SEQ ID NO: 181004 - DNA, 25 bp, Homo sapien
cattgccaagtgtgtgtcgctcata

SEQ ID NO: 181005 - DNA, 25 bp, Homo sapien
gtgtcgctcataggactagtgtata

SEQ ID NO: 181006 - DNA, 25 bp, Homo sapien
tcactgaaagttaacctgatgattt

SEQ ID NO: 181007 - DNA, 25 bp, Homo sapien
gttattgtttgaaccatatgctgat

SEQ ID NO: 181008 - DNA, 25 bp, Homo sapien
tatgctgatttgcttctggtttctg

SEQ ID NO: 181009 - DNA, 25 bp, Homo sapien
agattctgcatcacacatcctctga

SEQ ID NO: 181010 - DNA, 25 bp, Homo sapien
acacatcctctgagacctaccatgt

SEQ ID NO: 181011 - DNA, 25 bp, Homo sapien
taccatgtcgcacactttgttaatg

SEQ ID NO: 181012 - DNA, 25 bp, Homo sapien
gttaatgacaaacttcactctacac

SEQ ID NO: 181013 - DNA, 25 bp, Homo sapien
cactctacactatacagtaccttgt

SEQ ID NO: 181014 - DNA, 25 bp, Homo sapien
gtataaaattagttggaagccatgt

SEQ ID NO: 181015 - DNA, 25 bp, Homo sapien
ataacatctgaaaattcttgaactt

SEQ ID NO: 181016 - DNA, 25 bp, Homo sapien
attcttgaacttaaaatcatgctta

SEQ ID NO: 181017 - DNA, 25 bp, Homo sapien
tggttgattctccaatttctttttt

SEQ ID NO: 181018 - DNA, 25 bp, Homo sapien
tttgcaggttgacactctcacctga

SEQ ID NO: 181019 - DNA, 25 bp, Homo sapien
ttgacactctcacctgacagatgat

SEQ ID NO: 181020 - DNA, 25 bp, Homo sapien
cactctcacctgacagatgatgtaa

SEQ ID NO: 181021 - DNA, 25 bp, Homo sapien
gacagatgatgtaattcttcaattt

SEQ ID NO: 181022 - DNA, 25 bp, Homo sapien
acagtacacattttatttcttggat

SEQ ID NO: 181023 - DNA, 25 bp, Homo sapien
attggcattgcgaaagacttgaaaa

SEQ ID NO: 181024 - DNA, 25 bp, Homo sapien
aaaactaatgagtaaagtctgctga

SEQ ID NO: 181025 - DNA, 25 bp, Homo sapien
ataatgctgatacttacatgtaagt

SEQ ID NO: 181026 - DNA, 25 bp, Homo sapien
atgtaagttgttcatgttgcagaaa

SEQ ID NO: 181027 - DNA, 25 bp, Homo sapien
catgttgcagaaaaaggttatacgt

SEQ ID NO: 181028 - DNA, 25 bp, Homo sapien
ggttatacgtaccacggattctctt

SEQ ID NO: 181029 - DNA, 25 bp, Homo sapien
tacgtaccacggattctctttaata

SEQ ID NO: 181030 - DNA, 25 bp, Homo sapien
gtaccacggattctctttaatattg

SEQ ID NO: 181031 - DNA, 25 bp, Homo sapien
acggattctctttaatattgtacag

SEQ ID NO: 181032 - DNA, 25 bp, Homo sapien
acagttaaactgtatttctgatgtt

SEQ ID NO: 181033 - DNA, 25 bp, Homo sapien
actgtatttctgatgttgcaagcca

SEQ ID NO: 181034 - DNA, 25 bp, Homo sapien
gacacattgtctctttaaaatgctg

SEQ ID NO: 181035 - DNA, 25 bp, Homo sapien
gtagagagtatagccaaaacagtaa

SEQ ID NO: 181036 - DNA, 25 bp, Homo sapien
ctctactgagtaaaccctatctgtg

SEQ ID NO: 181037 - DNA, 25 bp, Homo sapien
gagtaaaccctatctgtgattcccc

SEQ ID NO: 181038 - DNA, 25 bp, Homo sapien
aaacatctggcatggctcccttttg

SEQ ID NO: 181039 - DNA, 25 bp, Homo sapien
atctggcatggctcccttttgtcct

SEQ ID NO: 181040 - DNA, 25 bp, Homo sapien
tgtccttcctgtgccctgcaaatat

SEQ ID NO: 181041 - DNA, 25 bp, Homo sapien
aaagaagcttcatgccaggttagga

SEQ ID NO: 181042 - DNA, 25 bp, Homo sapien
tcatgccaggttaggaaggcagcat

SEQ ID NO: 181043 - DNA, 25 bp, Homo sapien
gaaggcagcattccatgaccagaaa

SEQ ID NO: 181044 - DNA, 25 bp, Homo sapien
gcattccatgaccagaaacagggac

SEQ ID NO: 181045 - DNA, 25 bp, Homo sapien
aagaaatccccccttcagaacagag

SEQ ID NO: 181046 - DNA, 25 bp, Homo sapien
agtgcttctccaacactgaagtgct

SEQ ID NO: 181047 - DNA, 25 bp, Homo sapien
taaggtggcattgtctcatggctct

SEQ ID NO: 181048 - DNA, 25 bp, Homo sapien
attgtctcatggctctcgtttttgg

SEQ ID NO: 181049 - DNA, 25 bp, Homo sapien
gcatagccacttttgccctgaggga

SEQ ID NO: 181050 - DNA, 25 bp, Homo sapien
ccctgagggactcctgtgtgcttca

SEQ ID NO: 181051 - DNA, 25 bp, Homo sapien
gcttcacatcactgagcactcattt

SEQ ID NO: 181052 - DNA, 25 bp, Homo sapien
gagacagaagtctaggcccagggat

SEQ ID NO: 181053 - DNA, 25 bp, Homo sapien
ctaggcccagggatggctccagttg

SEQ ID NO: 181054 - DNA, 25 bp, Homo sapien
gagaccctctgcacatgaggctggt

SEQ ID NO: 181055 - DNA, 25 bp, Homo sapien
gaggctggtttaccaacatctactc

SEQ ID NO: 181056 - DNA, 25 bp, Homo sapien
atctactccctcaggatgagcgtga

SEQ ID NO: 181057 - DNA, 25 bp, Homo sapien
ggaaacaagcgttcctggaattaat

SEQ ID NO: 181058 - DNA, 25 bp, Homo sapien
acgagcaggacagggttcctccggt

SEQ ID NO: 181059 - DNA, 25 bp, Homo sapien
gggttcctccggtggacgacaagca

SEQ ID NO: 181060 - DNA, 25 bp, Homo sapien
gtggacgacaagcacctattgaaaa

SEQ ID NO: 181061 - DNA, 25 bp, Homo sapien
aacgaaatccaatagttttatctct

SEQ ID NO: 181062 - DNA, 25 bp, Homo sapien
gttttatctctatacccaaaatgga

SEQ ID NO: 181063 - DNA, 25 bp, Homo sapien
taaaaataacacgattgcaccaaag

SEQ ID NO: 181064 - DNA, 25 bp, Homo sapien
tgcaccaaagaaagcgtcccatcgt

SEQ ID NO: 181065 - DNA, 25 bp, Homo sapien
aagctgagactctcggcacatacga

SEQ ID NO: 181066 - DNA, 25 bp, Homo sapien
gcacatacgatattgcctggtagta

SEQ ID NO: 181067 - DNA, 25 bp, Homo sapien
tggtagtaagacacgagagccttct

SEQ ID NO: 181068 - DNA, 25 bp, Homo sapien
gagagccttctaatgccaagcagca

SEQ ID NO: 181069 - DNA, 25 bp, Homo sapien
actatacagactttagtcagactgc

SEQ ID NO: 181070 - DNA, 25 bp, Homo sapien
taaagctgaaaatcgcatggcgctc

SEQ ID NO: 181071 - DNA, 25 bp, Homo sapien
aatcgcatggcgctcagacatttta

SEQ ID NO: 181072 - DNA, 25 bp, Homo sapien
ggcgctcagacattttaaccggaac

SEQ ID NO: 181073 - DNA, 25 bp, Homo sapien
gttgcagtattactttgcttttatc

SEQ ID NO: 181074 - DNA, 25 bp, Homo sapien
tttctttctcaacagctttccattc

SEQ ID NO: 181075 - DNA, 25 bp, Homo sapien
aacagctttccattcagtctggatc

SEQ ID NO: 181076 - DNA, 25 bp, Homo sapien
agtctggatccttccatgactacag

SEQ ID NO: 181077 - DNA, 25 bp, Homo sapien
tccttccatgactacagccatttaa

SEQ ID NO: 181078 - DNA, 25 bp, Homo sapien
tacagccatttaagtgttcagcact

SEQ ID NO: 181079 - DNA, 25 bp, Homo sapien
gtgttcagcactgtgtacgatacat

SEQ ID NO: 181080 - DNA, 25 bp, Homo sapien
gtagatgacagagcaccttccaaaa

SEQ ID NO: 181081 - DNA, 25 bp, Homo sapien
aacattcaaataaagctcccagggc

SEQ ID NO: 181082 - DNA, 25 bp, Homo sapien
ctcccagggcgcttacatcaaaaga

SEQ ID NO: 181083 - DNA, 25 bp, Homo sapien
gggcgcttacatcaaaagaacggag

SEQ ID NO: 181084 - DNA, 25 bp, Homo sapien
aagaacggaggcgagcagtacgaca

SEQ ID NO: 181085 - DNA, 25 bp, Homo sapien
gcagtacgacagcaacggccgaaaa

SEQ ID NO: 181086 - DNA, 25 bp, Homo sapien
ggccgaaaaaagttggtgtgcgcta

SEQ ID NO: 181087 - DNA, 25 bp, Homo sapien
agttggtgtgcgctactatgaaaca

SEQ ID NO: 181088 - DNA, 25 bp, Homo sapien
gcgctactatgaaacacacaacgtg

SEQ ID NO: 181089 - DNA, 25 bp, Homo sapien
agaagaccaatgactcagagggaca

SEQ ID NO: 181090 - DNA, 25 bp, Homo sapien
gagggacagaaacacaaacgcaaaa

SEQ ID NO: 181091 - DNA, 25 bp, Homo sapien
ggtttatctacaatctcaaatccta

SEQ ID NO: 181092 - DNA, 25 bp, Homo sapien
caatctcaaatcctaagtgtataat

SEQ ID NO: 181093 - DNA, 25 bp, Homo sapien
tgtgcaatgttcaatacctcatata

SEQ ID NO: 181094 - DNA, 25 bp, Homo sapien
atacctcatataatacttgctcaac

SEQ ID NO: 181095 - DNA, 25 bp, Homo sapien
acttgctcaacagtatagtggtacc

SEQ ID NO: 181096 - DNA, 25 bp, Homo sapien
aacagtatagtggtaccaatggcat

SEQ ID NO: 181097 - DNA, 25 bp, Homo sapien
ggtaccaatggcattaagatggtgt

SEQ ID NO: 181098 - DNA, 25 bp, Homo sapien
aagatggtgtttttgttctacatat

SEQ ID NO: 181099 - DNA, 25 bp, Homo sapien
gaaattatatcaggctttaccggtt

SEQ ID NO: 181100 - DNA, 25 bp, Homo sapien
aaataaccaatgatatctcttggaa

SEQ ID NO: 181101 - DNA, 25 bp, Homo sapien
atctcttggaataatctgtaaaacg

SEQ ID NO: 181102 - DNA, 25 bp, Homo sapien
acataactgtaagtcctgtttggtt

SEQ ID NO: 181103 - DNA, 25 bp, Homo sapien
tcctgtttggttgttgttggacgca

SEQ ID NO: 181104 - DNA, 25 bp, Homo sapien
acgcagggcggcacatgagtgtttt

SEQ ID NO: 181105 - DNA, 25 bp, Homo sapien
acatgagtgtttttggttagagcca

SEQ ID NO: 181106 - DNA, 25 bp, Homo sapien
aagatagctcccatgcaccggaatt

SEQ ID NO: 181107 - DNA, 25 bp, Homo sapien
atgcaccggaattcctttgggatga

SEQ ID NO: 181108 - DNA, 25 bp, Homo sapien
tcctttgggatgaatcagcatcatt

SEQ ID NO: 181109 - DNA, 25 bp, Homo sapien
tttacagatcagaatgtggcaccag

SEQ ID NO: 181110 - DNA, 25 bp, Homo sapien
tcagaatgtggcaccagaggactgt

SEQ ID NO: 181111 - DNA, 25 bp, Homo sapien
agaggactgtgtctcattaaagtga

SEQ ID NO: 181112 - DNA, 25 bp, Homo sapien
tcattaaagtgattgctgggagcaa

SEQ ID NO: 181113 - DNA, 25 bp, Homo sapien
tgcagcagaacctgactgtcggcag

SEQ ID NO: 181114 - DNA, 25 bp, Homo sapien
gaacctgactgtcggcagccagaca

SEQ ID NO: 181115 - DNA, 25 bp, Homo sapien
gagacaagatcacagagaatccagt

SEQ ID NO: 181116 - DNA, 25 bp, Homo sapien
gagaatccagtcagtaccggcgaga

SEQ ID NO: 181117 - DNA, 25 bp, Homo sapien
aatccagtcagtaccggcgagaaaa

SEQ ID NO: 181118 - DNA, 25 bp, Homo sapien
taccggcgagaaaaacgcggccacg

SEQ ID NO: 181119 - DNA, 25 bp, Homo sapien
cggccacgtggagcatcctggctgt

SEQ ID NO: 181120 - DNA, 25 bp, Homo sapien
ccacgtggagcatcctggctgtcct

SEQ ID NO: 181121 - DNA, 25 bp, Homo sapien
tgtcctgtgcctgcttgtggtcgtg

SEQ ID NO: 181122 - DNA, 25 bp, Homo sapien
agctatgcaggtgcctgggctgtga

SEQ ID NO: 181123 - DNA, 25 bp, Homo sapien
gctgtgagtccggagacagagctca

SEQ ID NO: 181124 - DNA, 25 bp, Homo sapien
gtggtaaccctacattttatagttg

SEQ ID NO: 181125 - DNA, 25 bp, Homo sapien
ttatagttgccatatcaaagccatg

SEQ ID NO: 181126 - DNA, 25 bp, Homo sapien
gccatgggagagttttaattcgtta

SEQ ID NO: 181127 - DNA, 25 bp, Homo sapien
tagttacaatcccttctttacctct

SEQ ID NO: 181128 - DNA, 25 bp, Homo sapien
ctttacctctacttaatgttccata

SEQ ID NO: 181129 - DNA, 25 bp, Homo sapien
agtttcaggaattacttttatgtca

SEQ ID NO: 181130 - DNA, 25 bp, Homo sapien
tcacattgagtggtaggcttcatcc

SEQ ID NO: 181131 - DNA, 25 bp, Homo sapien
aggcttcatccaattgctttgctat

SEQ ID NO: 181132 - DNA, 25 bp, Homo sapien
attgctttgctatggaaatcttggt

SEQ ID NO: 181133 - DNA, 25 bp, Homo sapien
tggaaatcttggtggtgtagctttt

SEQ ID NO: 181134 - DNA, 25 bp, Homo sapien
ggtgtagcttttcatgctaatttaa

SEQ ID NO: 181135 - DNA, 25 bp, Homo sapien
aaacccgagctgagcatcaggacct

SEQ ID NO: 181136 - DNA, 25 bp, Homo sapien
tgagcatcaggaccttgcctcgaat

SEQ ID NO: 181137 - DNA, 25 bp, Homo sapien
ttgcctcgaattgtcttccagtatt

SEQ ID NO: 181138 - DNA, 25 bp, Homo sapien
gtcttccagtattacggtgcctctt

SEQ ID NO: 181139 - DNA, 25 bp, Homo sapien
cagtattacggtgcctcttctctgc

SEQ ID NO: 181140 - DNA, 25 bp, Homo sapien
ttcccagggtatctgtgggttgcca

SEQ ID NO: 181141 - DNA, 25 bp, Homo sapien
gagggcaaccatagccacaccacag

SEQ ID NO: 181142 - DNA, 25 bp, Homo sapien
gccacaccacaggatttcctgaaag

SEQ ID NO: 181143 - DNA, 25 bp, Homo sapien
gtttacaatgcagtagcattttggg

SEQ ID NO: 181144 - DNA, 25 bp, Homo sapien
tgtagggtggcagctccccaaggcc

SEQ ID NO: 181145 - DNA, 25 bp, Homo sapien
gatatttattgcagaatttctattc

SEQ ID NO: 181146 - DNA, 25 bp, Homo sapien
agtgacctgcgggacctgctatcca

SEQ ID NO: 181147 - DNA, 25 bp, Homo sapien
cagctgcctttaaagggtacacaga

SEQ ID NO: 181148 - DNA, 25 bp, Homo sapien
tgcctttaaagggtacacagaccag

SEQ ID NO: 181149 - DNA, 25 bp, Homo sapien
cctgccttggtcagcatccatgctg

SEQ ID NO: 181150 - DNA, 25 bp, Homo sapien
ttggtcagcatccatgctgctgggc

SEQ ID NO: 181151 - DNA, 25 bp, Homo sapien
gaggccagaccacccaggaagagcc

SEQ ID NO: 181152 - DNA, 25 bp, Homo sapien
gatttggtgtggctaaaagtgttta

SEQ ID NO: 181153 - DNA, 25 bp, Homo sapien
aaagtgtttaagactggacagatga

SEQ ID NO: 181154 - DNA, 25 bp, Homo sapien
gactggacagatgatcatattctaa

SEQ ID NO: 181155 - DNA, 25 bp, Homo sapien
atgagacatctatttatttggaaaa

SEQ ID NO: 181156 - DNA, 25 bp, Homo sapien
aagttatatccttacctcacaaaag

SEQ ID NO: 181157 - DNA, 25 bp, Homo sapien
gtggcttgtaagttgacttctgttg

SEQ ID NO: 181158 - DNA, 25 bp, Homo sapien
gacttctgttgagatctgaccacat

SEQ ID NO: 181159 - DNA, 25 bp, Homo sapien
atctgaccacatttgatctcttgtt

SEQ ID NO: 181160 - DNA, 25 bp, Homo sapien
gatctcttgttttaattttccaact

SEQ ID NO: 181161 - DNA, 25 bp, Homo sapien
accaagttttaatctgatgcctaat

SEQ ID NO: 181162 - DNA, 25 bp, Homo sapien
agcaagactgtgctctcttaaaaat

SEQ ID NO: 181163 - DNA, 25 bp, Homo sapien
gaaagagcctcttcatcttcaaaag

SEQ ID NO: 181164 - DNA, 25 bp, Homo sapien
gagcctcttcatcttcaaaaggact

SEQ ID NO: 181165 - DNA, 25 bp, Homo sapien
aggactacatctgaagtttccccag

SEQ ID NO: 181166 - DNA, 25 bp, Homo sapien
gtttccccagaaggacaaatgtcta

SEQ ID NO: 181167 - DNA, 25 bp, Homo sapien
ggacaaatgtctacttagaccttat

SEQ ID NO: 181168 - DNA, 25 bp, Homo sapien
gaatgttagagctactcatgattat

SEQ ID NO: 181169 - DNA, 25 bp, Homo sapien
agctactcatgattatttgtgtttc

SEQ ID NO: 181170 - DNA, 25 bp, Homo sapien
agtgggtctctgtggctctcactga

SEQ ID NO: 181171 - DNA, 25 bp, Homo sapien
tgtggctctcactgatgttcactct

SEQ ID NO: 181172 - DNA, 25 bp, Homo sapien
ctctcactgatgttcactctggcat

SEQ ID NO: 181173 - DNA, 25 bp, Homo sapien
acccactctttgcacaaaactgttc

SEQ ID NO: 181174 - DNA, 25 bp, Homo sapien
ctttgcacaaaactgttctcgctgg

SEQ ID NO: 181175 - DNA, 25 bp, Homo sapien
aaactgttctcgctggtttggaata

SEQ ID NO: 181176 - DNA, 25 bp, Homo sapien
actgttctcgctggtttggaatagg

SEQ ID NO: 181177 - DNA, 25 bp, Homo sapien
tcgctggtttggaataggctcccgt

SEQ ID NO: 181178 - DNA, 25 bp, Homo sapien
gtttggaataggctcccgtgctttt

SEQ ID NO: 181179 - DNA, 25 bp, Homo sapien
attggtgtgttttgtatcttgcttg

SEQ ID NO: 181180 - DNA, 25 bp, Homo sapien
atcttgcttgaacttcctgttcttc

SEQ ID NO: 181181 - DNA, 25 bp, Homo sapien
gaacttcctgttcttcttggtatac

SEQ ID NO: 181182 - DNA, 25 bp, Homo sapien
acttcctgttcttcttggtatactt

SEQ ID NO: 181183 - DNA, 25 bp, Homo sapien
cattattattatgtgggattccaaa

SEQ ID NO: 181184 - DNA, 25 bp, Homo sapien
aatcagctagctgtattcctaaaca

SEQ ID NO: 181185 - DNA, 25 bp, Homo sapien
agctgtattcctaaacaaattgttt

SEQ ID NO: 181186 - DNA, 25 bp, Homo sapien
tgctgaaaggttttgtgaacttttt

SEQ ID NO: 181187 - DNA, 25 bp, Homo sapien
attttgagaaccatggaaccacagg

SEQ ID NO: 181188 - DNA, 25 bp, Homo sapien
gaaccatggaaccacaggaaaggaa

SEQ ID NO: 181189 - DNA, 25 bp, Homo sapien
gaaaagtcattgttgtctacacaaa

SEQ ID NO: 181190 - DNA, 25 bp, Homo sapien
aatacacgtatgttataaccatcag

SEQ ID NO: 181191 - DNA, 25 bp, Homo sapien
gtatgttataaccatcagcccgcca

SEQ ID NO: 181192 - DNA, 25 bp, Homo sapien
gttataaccatcagcccgccagggt

SEQ ID NO: 181193 - DNA, 25 bp, Homo sapien
ccgccagggtcagggaaaggactca

SEQ ID NO: 181194 - DNA, 25 bp, Homo sapien
gaaaggactcacctgactttggaca

SEQ ID NO: 181195 - DNA, 25 bp, Homo sapien
aggactcacctgactttggacagct

SEQ ID NO: 181196 - DNA, 25 bp, Homo sapien
actttggacagctggcctgggctcc

SEQ ID NO: 181197 - DNA, 25 bp, Homo sapien
gggaatggcccacatctcaagaagc

SEQ ID NO: 181198 - DNA, 25 bp, Homo sapien
atggcccacatctcaagaagcaaga

SEQ ID NO: 181199 - DNA, 25 bp, Homo sapien
caagaagcaagatattgtttgtggt

SEQ ID NO: 181200 - DNA, 25 bp, Homo sapien
ttccttttgtcttcatcactttctg

SEQ ID NO: 181201 - DNA, 25 bp, Homo sapien
tggagccaaggcctccaaccccttc

SEQ ID NO: 181202 - DNA, 25 bp, Homo sapien
ctccaaccccttcctgccaggcgga

SEQ ID NO: 181203 - DNA, 25 bp, Homo sapien
aggcggaggcccagccactggccct

SEQ ID NO: 181204 - DNA, 25 bp, Homo sapien
gaaccagctccgtctcagtcctgtg

SEQ ID NO: 181205 - DNA, 25 bp, Homo sapien
tggagcgccacccacgtacatctct

SEQ ID NO: 181206 - DNA, 25 bp, Homo sapien
cacgtacatctctccccttggcggg

SEQ ID NO: 181207 - DNA, 25 bp, Homo sapien
aacactaatcccttcctcctataat

SEQ ID NO: 181208 - DNA, 25 bp, Homo sapien
cttcctcctataatccagggcggaa

SEQ ID NO: 181209 - DNA, 25 bp, Homo sapien
ttcctcctataatccagggcggaag

SEQ ID NO: 181210 - DNA, 25 bp, Homo sapien
tcctcctataatccagggcggaagg

SEQ ID NO: 181211 - DNA, 25 bp, Homo sapien
cctcctataatccagggcggaaggg

SEQ ID NO: 181212 - DNA, 25 bp, Homo sapien
atggagtgcccatgcatactctgct

SEQ ID NO: 181213 - DNA, 25 bp, Homo sapien
agtgtccacagtcactgagccagac

SEQ ID NO: 181214 - DNA, 25 bp, Homo sapien
tgagccagacggtcggttggaacat

SEQ ID NO: 181215 - DNA, 25 bp, Homo sapien
aacatgagactcgaggctgagcgtg

SEQ ID NO: 181216 - DNA, 25 bp, Homo sapien
aggctgagcgtggatctgaacacca

SEQ ID NO: 181217 - DNA, 25 bp, Homo sapien
acaccacagcccctgtacttgggtt

SEQ ID NO: 181218 - DNA, 25 bp, Homo sapien
acttgggttgcctcttgtccctgaa

SEQ ID NO: 181219 - DNA, 25 bp, Homo sapien
ttgtccctgaacttcgttgtaccag

SEQ ID NO: 181220 - DNA, 25 bp, Homo sapien
gaacttcgttgtaccagtgcatgga

SEQ ID NO: 181221 - DNA, 25 bp, Homo sapien
gaaaattttgtcctcttgtcttaga

SEQ ID NO: 181222 - DNA, 25 bp, Homo sapien
cttgtcttagagttgtgtgtaaatc

SEQ ID NO: 181223 - DNA, 25 bp, Homo sapien
aaggtgtctgtgcagattttcccac

SEQ ID NO: 181224 - DNA, 25 bp, Homo sapien
gtgtctgtgcagattttcccactga

SEQ ID NO: 181225 - DNA, 25 bp, Homo sapien
ctgtgcagattttcccactgattta

SEQ ID NO: 181226 - DNA, 25 bp, Homo sapien
gcagattttcccactgatttatttg

SEQ ID NO: 181227 - DNA, 25 bp, Homo sapien
aaaaatactcatcttttcagacttt

SEQ ID NO: 181228 - DNA, 25 bp, Homo sapien
atactcatcttttcagacttttttg

SEQ ID NO: 181229 - DNA, 25 bp, Homo sapien
ccccagttgtgaaaactgcagttta

SEQ ID NO: 181230 - DNA, 25 bp, Homo sapien
ctgcagtttagcagtgacctcagca

SEQ ID NO: 181231 - DNA, 25 bp, Homo sapien
ggatttgttttatcgtatcctaaag

SEQ ID NO: 181232 - DNA, 25 bp, Homo sapien
ttatcgtatcctaaagtctttgttg

SEQ ID NO: 181233 - DNA, 25 bp, Homo sapien
catgctcttaatgttgattttacaa

SEQ ID NO: 181234 - DNA, 25 bp, Homo sapien
agtacgacatcctggtggccgagga

SEQ ID NO: 181235 - DNA, 25 bp, Homo sapien
cgacatcctggtggccgaggagacc

SEQ ID NO: 181236 - DNA, 25 bp, Homo sapien
aggagaccgcgggagagccctggga

SEQ ID NO: 181237 - DNA, 25 bp, Homo sapien
gagagccctgggaggacgggttcga

SEQ ID NO: 181238 - DNA, 25 bp, Homo sapien
tgggaggacgggttcgaggccgagc

SEQ ID NO: 181239 - DNA, 25 bp, Homo sapien
agctcagccctgtggagcagaagct

SEQ ID NO: 181240 - DNA, 25 bp, Homo sapien
agcagaagctgagtgcgctgcgctc

SEQ ID NO: 181241 - DNA, 25 bp, Homo sapien
ggccaccgcggctcgtgtaaaaact

SEQ ID NO: 181242 - DNA, 25 bp, Homo sapien
gccaccgcggctcgtgtaaaaactg

SEQ ID NO: 181243 - DNA, 25 bp, Homo sapien
ccaccgcggctcgtgtaaaaactgt

SEQ ID NO: 181244 - DNA, 25 bp, Homo sapien
accgcggctcgtgtaaaaactgttg

SEQ ID NO: 181245 - DNA, 25 bp, Homo sapien
ttgaatgttagagctactcatgatt

SEQ ID NO: 181246 - DNA, 25 bp, Homo sapien
aaagttaaaagagagtgggtctctg

SEQ ID NO: 181247 - DNA, 25 bp, Homo sapien
acccactctttgcacaaaactgttc

SEQ ID NO: 181248 - DNA, 25 bp, Homo sapien
cccactctttgcacaaaactgttct

SEQ ID NO: 181249 - DNA, 25 bp, Homo sapien
cactctttgcacaaaactgttctcg

SEQ ID NO: 181250 - DNA, 25 bp, Homo sapien
ctctttgcacaaaactgttctcgct

SEQ ID NO: 181251 - DNA, 25 bp, Homo sapien
tctttgcacaaaactgttctcgctg

SEQ ID NO: 181252 - DNA, 25 bp, Homo sapien
ctttgcacaaaactgttctcgctgg

SEQ ID NO: 181253 - DNA, 25 bp, Homo sapien
aaactgttctcgctggtttggaata

SEQ ID NO: 181254 - DNA, 25 bp, Homo sapien
aactgttctcgctggtttggaatag

SEQ ID NO: 181255 - DNA, 25 bp, Homo sapien
actgttctcgctggtttggaatagg

SEQ ID NO: 181256 - DNA, 25 bp, Homo sapien
tggagcgccacccacgtacatctct

SEQ ID NO: 181257 - DNA, 25 bp, Homo sapien
ggagcgccacccacgtacatctctc

SEQ ID NO: 181258 - DNA, 25 bp, Homo sapien
gagcgccacccacgtacatctctcc

SEQ ID NO: 181259 - DNA, 25 bp, Homo sapien
cacccacgtacatctctccccttgg

SEQ ID NO: 181260 - DNA, 25 bp, Homo sapien
cccaacactaatcccttcctcctat

SEQ ID NO: 181261 - DNA, 25 bp, Homo sapien
ccttcctcctataatccagggcgga

SEQ ID NO: 181262 - DNA, 25 bp, Homo sapien
cttcctcctataatccagggcggaa

SEQ ID NO: 181263 - DNA, 25 bp, Homo sapien
ttcctcctataatccagggcggaag

SEQ ID NO: 181264 - DNA, 25 bp, Homo sapien
tcctcctataatccagggcggaagg

SEQ ID NO: 181265 - DNA, 25 bp, Homo sapien
cctcctataatccagggcggaaggg

SEQ ID NO: 181266 - DNA, 25 bp, Homo sapien
ccatccggctgccccattccggctc

SEQ ID NO: 181267 - DNA, 25 bp, Homo sapien
aaattgtcagagttctagtccctaa

SEQ ID NO: 181268 - DNA, 25 bp, Homo sapien
ttagcattgctgaattcactttatt

SEQ ID NO: 181269 - DNA, 25 bp, Homo sapien
cactttatttatcctgcagtcacag

SEQ ID NO: 181270 - DNA, 25 bp, Homo sapien
gcagtcacagacttgagagcaataa

SEQ ID NO: 181271 - DNA, 25 bp, Homo sapien
agaaaatggaatccctgacagctgt

SEQ ID NO: 181272 - DNA, 25 bp, Homo sapien
tgacagctgtgtccgtatcaagcat

SEQ ID NO: 181273 - DNA, 25 bp, Homo sapien
gtgtccgtatcaagcatcagtctct

SEQ ID NO: 181274 - DNA, 25 bp, Homo sapien
atcagtctctcaaacagttgcccca

SEQ ID NO: 181275 - DNA, 25 bp, Homo sapien
agcctgacagtgctagtctctgttt

SEQ ID NO: 181276 - DNA, 25 bp, Homo sapien
ggagactttgccataattttcagat

SEQ ID NO: 181277 - DNA, 25 bp, Homo sapien
ttcagatgaagatgtttcccaaaca

SEQ ID NO: 181278 - DNA, 25 bp, Homo sapien
gacatcctggtggccgaggagaccg

SEQ ID NO: 181279 - DNA, 25 bp, Homo sapien
ctgggaggacgggttcgaggccgag

SEQ ID NO: 181280 - DNA, 25 bp, Homo sapien
tgggaggacgggttcgaggccgagc

SEQ ID NO: 181281 - DNA, 25 bp, Homo sapien
cacgtgccaccaccgggccaccgcg

SEQ ID NO: 181282 - DNA, 25 bp, Homo sapien
ggccaccgcggctcgtgtaaaaact

SEQ ID NO: 181283 - DNA, 25 bp, Homo sapien
gccaccgcggctcgtgtaaaaactg

SEQ ID NO: 181284 - DNA, 25 bp, Homo sapien
ccaccgcggctcgtgtaaaaactgt

SEQ ID NO: 181285 - DNA, 25 bp, Homo sapien
caccgcggctcgtgtaaaaactgtt

SEQ ID NO: 181286 - DNA, 25 bp, Homo sapien
accgcggctcgtgtaaaaactgttg

SEQ ID NO: 181287 - DNA, 25 bp, Homo sapien
gtgagtcaacacaagatggcaaatc

SEQ ID NO: 181288 - DNA, 25 bp, Homo sapien
gatggcaaatcaggatcaggtgaaa

SEQ ID NO: 181289 - DNA, 25 bp, Homo sapien
gaaacgtgtgaaaactccctattct

SEQ ID NO: 181290 - DNA, 25 bp, Homo sapien
aactccctattctcttaagcggtgg

SEQ ID NO: 181291 - DNA, 25 bp, Homo sapien
tcatctccactgaatcgctggactg

SEQ ID NO: 181292 - DNA, 25 bp, Homo sapien
cactgaatcgctggactgtgaagtc

SEQ ID NO: 181293 - DNA, 25 bp, Homo sapien
cagtaacagggcagttcattccaaa

SEQ ID NO: 181294 - DNA, 25 bp, Homo sapien
agggcagttcattccaaatccagca

SEQ ID NO: 181295 - DNA, 25 bp, Homo sapien
ccaaatccagcactgctgtttacct

SEQ ID NO: 181296 - DNA, 25 bp, Homo sapien
gaaggaggcactgctacaaccatgg

SEQ ID NO: 181297 - DNA, 25 bp, Homo sapien
gcactgctacaaccatggtgtctaa

SEQ ID NO: 181298 - DNA, 25 bp, Homo sapien
gaaaatccaggaccactttaacagc

SEQ ID NO: 181299 - DNA, 25 bp, Homo sapien
ggaccactttaacagcagtattaag

SEQ ID NO: 181300 - DNA, 25 bp, Homo sapien
gcagtattaagcaactcaacgctga

SEQ ID NO: 181301 - DNA, 25 bp, Homo sapien
gcaactcaacgctgaagacatggat

SEQ ID NO: 181302 - DNA, 25 bp, Homo sapien
attgtttgtgcagtatcctagttta

SEQ ID NO: 181303 - DNA, 25 bp, Homo sapien
atcctagtttatgtgagaatgtctc

SEQ ID NO: 181304 - DNA, 25 bp, Homo sapien
gaatgtctcagtgggttttgaaggt

SEQ ID NO: 181305 - DNA, 25 bp, Homo sapien
atgttgaggctttttcgacgtgaaa

SEQ ID NO: 181306 - DNA, 25 bp, Homo sapien
gacgtgaaactgtcacagatggcaa

SEQ ID NO: 181307 - DNA, 25 bp, Homo sapien
gatgtgaagcttgtgatccttttga

SEQ ID NO: 181308 - DNA, 25 bp, Homo sapien
gaagcttgtgatccttttgaataaa

SEQ ID NO: 181309 - DNA, 25 bp, Homo sapien
agtttcaaagacagattctcagagt

SEQ ID NO: 181310 - DNA, 25 bp, Homo sapien
ggatcgtgatgagttcccaatgatt

SEQ ID NO: 181311 - DNA, 25 bp, Homo sapien
ggatcatcaaagacaggtaacacag

SEQ ID NO: 181312 - DNA, 25 bp, Homo sapien
aaggacaacagttagcacggcagct

SEQ ID NO: 181313 - DNA, 25 bp, Homo sapien
gcacggcagcttaaggtaacataca

SEQ ID NO: 181314 - DNA, 25 bp, Homo sapien
gtaacatacatggaggcatcagcaa

SEQ ID NO: 181315 - DNA, 25 bp, Homo sapien
aagctttccatgaacttgtccgggt

SEQ ID NO: 181316 - DNA, 25 bp, Homo sapien
gaacttgtccgggttatcaggaaat

SEQ ID NO: 181317 - DNA, 25 bp, Homo sapien
tcaagagcaggaatgtcctccttca

SEQ ID NO: 181318 - DNA, 25 bp, Homo sapien
tccttcaccagaaccaacacggaaa

SEQ ID NO: 181319 - DNA, 25 bp, Homo sapien
aaggctgccattgtgtcattttcta

SEQ ID NO: 181320 - DNA, 25 bp, Homo sapien
tcaagagagagagccagatgagact

SEQ ID NO: 181321 - DNA, 25 bp, Homo sapien
gtgtggagtatttacttgctcagta

SEQ ID NO: 181322 - DNA, 25 bp, Homo sapien
tgctcagtaactgtgactgttgtct

SEQ ID NO: 181323 - DNA, 25 bp, Homo sapien
gactgttgtctattgagacctagcc

SEQ ID NO: 181324 - DNA, 25 bp, Homo sapien
agacctagcctagttttcctgcaga

SEQ ID NO: 181325 - DNA, 25 bp, Homo sapien
agcctagttttcctgcagacaatga

SEQ ID NO: 181326 - DNA, 25 bp, Homo sapien
gagtcaaatcgctattgttgtttta

SEQ ID NO: 181327 - DNA, 25 bp, Homo sapien
aatgatctgtttttagctggatggt

SEQ ID NO: 181328 - DNA, 25 bp, Homo sapien
ctggatggtctttattacaaagtat

SEQ ID NO: 181329 - DNA, 25 bp, Homo sapien
aaaacttgactttggtgaatgtgca

SEQ ID NO: 181330 - DNA, 25 bp, Homo sapien
gtgaatgtgcattacttccttttat

SEQ ID NO: 181331 - DNA, 25 bp, Homo sapien
tgggttgtgtttgtgcttctcccac

SEQ ID NO: 181332 - DNA, 25 bp, Homo sapien
gaccacttacttttatgtgacacta

SEQ ID NO: 181333 - DNA, 25 bp, Homo sapien
gttttgtgtaagaacagctgcatat

SEQ ID NO: 181334 - DNA, 25 bp, Homo sapien
agctgcatatgagtaaagttacccc

SEQ ID NO: 181335 - DNA, 25 bp, Homo sapien
aagttaccccaaccacagtgaggag

SEQ ID NO: 181336 - DNA, 25 bp, Homo sapien
tcacatactggaactgtcctgccaa

SEQ ID NO: 181337 - DNA, 25 bp, Homo sapien
taaattttgcccctattgtgctctg

SEQ ID NO: 181338 - DNA, 25 bp, Homo sapien
gcccctattgtgctctgttttaatt

SEQ ID NO: 181339 - DNA, 25 bp, Homo sapien
tttggagtgggcaaagtaacctctt

SEQ ID NO: 181340 - DNA, 25 bp, Homo sapien
gtaacctcttgcttggtgcaactat

SEQ ID NO: 181341 - DNA, 25 bp, Homo sapien
gcttggtgcaactatttgtttcaaa

SEQ ID NO: 181342 - DNA, 25 bp, Homo sapien
cttggttttgattaccagtgaaaag

SEQ ID NO: 181343 - DNA, 25 bp, Homo sapien
acacaatacaatcaggagttttcaa

SEQ ID NO: 181344 - DNA, 25 bp, Homo sapien
tggaatttatcctagtatttttctt

SEQ ID NO: 181345 - DNA, 25 bp, Homo sapien
ttttctttacctgaaggagggccat

SEQ ID NO: 181346 - DNA, 25 bp, Homo sapien
ttacctgaaggagggccatttattt

SEQ ID NO: 181347 - DNA, 25 bp, Homo sapien
ctgttgtgtttctcactggaggctg

SEQ ID NO: 181348 - DNA, 25 bp, Homo sapien
ctggaggctggaatgaatgatcact

SEQ ID NO: 181349 - DNA, 25 bp, Homo sapien
gaatgatcactagaacacaaaagag

SEQ ID NO: 181350 - DNA, 25 bp, Homo sapien
gagtgaatgatgacacttgaagtca

SEQ ID NO: 181351 - DNA, 25 bp, Homo sapien
cacttgaagtcaaagcagttgtact

SEQ ID NO: 181352 - DNA, 25 bp, Homo sapien
tcaaagcagttgtactgatcaccag

SEQ ID NO: 181353 - DNA, 25 bp, Homo sapien
ggcatccatgtccaccatagaattt

SEQ ID NO: 181354 - DNA, 25 bp, Homo sapien
tttggttacttggactatgcccagt

SEQ ID NO: 181355 - DNA, 25 bp, Homo sapien
tatgcccagtctcggttccagttct

SEQ ID NO: 181356 - DNA, 25 bp, Homo sapien
gttccagttctacttccagcagaag

SEQ ID NO: 181357 - DNA, 25 bp, Homo sapien
gggcagctgaccagtgtccactcct

SEQ ID NO: 181358 - DNA, 25 bp, Homo sapien
actccttggatttctcctggagcct

SEQ ID NO: 181359 - DNA, 25 bp, Homo sapien
acaacgagcagaaggccctggcgac

SEQ ID NO: 181360 - DNA, 25 bp, Homo sapien
aaactgaggttcaggagaccggcct

SEQ ID NO: 181361 - DNA, 25 bp, Homo sapien
agaccggcctgttcctgagtttgag

SEQ ID NO: 181362 - DNA, 25 bp, Homo sapien
tgagtttgagtaggtccccatggct

SEQ ID NO: 181363 - DNA, 25 bp, Homo sapien
agtaggtccccatggctggcaggcc

SEQ ID NO: 181364 - DNA, 25 bp, Homo sapien
gcgtacgacaatgcggtcaacctta

SEQ ID NO: 181365 - DNA, 25 bp, Homo sapien
tacgacaatgcggtcaaccttagct

SEQ ID NO: 181366 - DNA, 25 bp, Homo sapien
tggctctcaacttattcccttcaat

SEQ ID NO: 181367 - DNA, 25 bp, Homo sapien
tctcaacttattcccttcaattcaa

SEQ ID NO: 181368 - DNA, 25 bp, Homo sapien
tattcccttcaattcaagtaacagg

SEQ ID NO: 181369 - DNA, 25 bp, Homo sapien
aagattttggtgaagcagtcgccca

SEQ ID NO: 181370 - DNA, 25 bp, Homo sapien
attttggtgaagcagtcgcccatgc

SEQ ID NO: 181371 - DNA, 25 bp, Homo sapien
gaagcagtcgcccatgcttgtagcg

SEQ ID NO: 181372 - DNA, 25 bp, Homo sapien
agtcgcccatgcttgtagcgtacga

SEQ ID NO: 181373 - DNA, 25 bp, Homo sapien
gcccatgcttgtagcgtacgacaat

SEQ ID NO: 181374 - DNA, 25 bp, Homo sapien
cttgtagcgtacgacaatgcggtca

SEQ ID NO: 181375 - DNA, 25 bp, Homo sapien
gagtccaggaggtcctttccgctct

SEQ ID NO: 181376 - DNA, 25 bp, Homo sapien
aggtcctttccgctctcctaagagc

SEQ ID NO: 181377 - DNA, 25 bp, Homo sapien
gaatgaatgaacaccctgtctgcag

SEQ ID NO: 181378 - DNA, 25 bp, Homo sapien
ggacatggacaaataggctctgcca

SEQ ID NO: 181379 - DNA, 25 bp, Homo sapien
taggctctgccatcaggaaatggga

SEQ ID NO: 181380 - DNA, 25 bp, Homo sapien
tgggaagcaagaaaacggtaactca

SEQ ID NO: 181381 - DNA, 25 bp, Homo sapien
acggtaactcaagaggacagaggct

SEQ ID NO: 181382 - DNA, 25 bp, Homo sapien
aggaggtaaagcaggcccagtgaaa

SEQ ID NO: 181383 - DNA, 25 bp, Homo sapien
aaagcaggcccagtgaaatggacct

SEQ ID NO: 181384 - DNA, 25 bp, Homo sapien
gaaatggacctgacagcccaaactg

SEQ ID NO: 181385 - DNA, 25 bp, Homo sapien
gacagcccaaactgtcagagaggag

SEQ ID NO: 181386 - DNA, 25 bp, Homo sapien
gacaagcactgacagacctcacaat

SEQ ID NO: 181387 - DNA, 25 bp, Homo sapien
gacctcacaatcaagccagcctggg

SEQ ID NO: 181388 - DNA, 25 bp, Homo sapien
cagcactgggcttcagccaggtgct

SEQ ID NO: 181389 - DNA, 25 bp, Homo sapien
ttcagccaggtgctcgagagctttg

SEQ ID NO: 181390 - DNA, 25 bp, Homo sapien
ctcgagagctttgaggccatgatct

SEQ ID NO: 181391 - DNA, 25 bp, Homo sapien
gctcttccctctcccagattggtgg

SEQ ID NO: 181392 - DNA, 25 bp, Homo sapien
gatataggcctgttctttttagcaa

SEQ ID NO: 181393 - DNA, 25 bp, Homo sapien
gtgattcttgttgttgattctctct

SEQ ID NO: 181394 - DNA, 25 bp, Homo sapien
tcttgttgttgattctctctctgga

SEQ ID NO: 181395 - DNA, 25 bp, Homo sapien
tctctctggagttcatgtgctgcct

SEQ ID NO: 181396 - DNA, 25 bp, Homo sapien
gctgcctcaggagactctgatttta

SEQ ID NO: 181397 - DNA, 25 bp, Homo sapien
gatttaatgtcatctgccgttccca

SEQ ID NO: 181398 - DNA, 25 bp, Homo sapien
tgccgttcccatgacacctgaagat

SEQ ID NO: 181399 - DNA, 25 bp, Homo sapien
tgacacctgaagatccttcattttg

SEQ ID NO: 181400 - DNA, 25 bp, Homo sapien
cattttgggactgtttttgcttcac

SEQ ID NO: 181401 - DNA, 25 bp, Homo sapien
gggactgtttttgcttcacagaaga

SEQ ID NO: 181402 - DNA, 25 bp, Homo sapien
aagtcatgatgattccctgagtaac

SEQ ID NO: 181403 - DNA, 25 bp, Homo sapien
gtttgtgatcttccgtattcactga

SEQ ID NO: 181404 - DNA, 25 bp, Homo sapien
ttgcagttgctcttaggaaacccga

SEQ ID NO: 181405 - DNA, 25 bp, Homo sapien
gacatcaggatgttccatctcagga

SEQ ID NO: 181406 - DNA, 25 bp, Homo sapien
aggatgattccaaaccaacccagag

SEQ ID NO: 181407 - DNA, 25 bp, Homo sapien
ccaacccagaggcaatttactattc

SEQ ID NO: 181408 - DNA, 25 bp, Homo sapien
tggagccaaggcctccaaccccttc

SEQ ID NO: 181409 - DNA, 25 bp, Homo sapien
ctccaaccccttcctgccaggcgga

SEQ ID NO: 181410 - DNA, 25 bp, Homo sapien
aggcggaggcccagccactggccct

SEQ ID NO: 181411 - DNA, 25 bp, Homo sapien
ggcggaggcccagccactggccctt

SEQ ID NO: 181412 - DNA, 25 bp, Homo sapien
ggaggcccagccactggcccttccg

SEQ ID NO: 181413 - DNA, 25 bp, Homo sapien
gaggcccagccactggcccttccgt

SEQ ID NO: 181414 - DNA, 25 bp, Homo sapien
ggcccagccactggcccttccgtca

SEQ ID NO: 181415 - DNA, 25 bp, Homo sapien
cagccactggcccttccgtcaccaa

SEQ ID NO: 181416 - DNA, 25 bp, Homo sapien
agccactggcccttccgtcaccaac

SEQ ID NO: 181417 - DNA, 25 bp, Homo sapien
gccactggcccttccgtcaccaacc

SEQ ID NO: 181418 - DNA, 25 bp, Homo sapien
cgcctcccgcgacgctcaccctgaa

SEQ ID NO: 181419 - DNA, 25 bp, Homo sapien
tcaactcatctgacccatcaattct

SEQ ID NO: 181420 - DNA, 25 bp, Homo sapien
tgacccatcaattctccacagcaga

SEQ ID NO: 181421 - DNA, 25 bp, Homo sapien
gacccatcaattctccacagcagag

SEQ ID NO: 181422 - DNA, 25 bp, Homo sapien
cattcaaatatgagaactgtgggaa

SEQ ID NO: 181423 - DNA, 25 bp, Homo sapien
gtgggaagagctttgtacatagatc

SEQ ID NO: 181424 - DNA, 25 bp, Homo sapien
gggaagagctttgtacatagatcat

SEQ ID NO: 181425 - DNA, 25 bp, Homo sapien
ggaagagctttgtacatagatcata

SEQ ID NO: 181426 - DNA, 25 bp, Homo sapien
aagagctttgtacatagatcatatc

SEQ ID NO: 181427 - DNA, 25 bp, Homo sapien
gagctttgtacatagatcatatctt

SEQ ID NO: 181428 - DNA, 25 bp, Homo sapien
agctttgtacatagatcatatcttt

SEQ ID NO: 181429 - DNA, 25 bp, Homo sapien
tttgtacatagatcatatctttttt

SEQ ID NO: 181430 - DNA, 25 bp, Homo sapien
catgaggaagctgcctaaggagccc

SEQ ID NO: 181431 - DNA, 25 bp, Homo sapien
tgcagctggaatggaacccagcatt

SEQ ID NO: 181432 - DNA, 25 bp, Homo sapien
accacggagaggacagcgcctcttg

SEQ ID NO: 181433 - DNA, 25 bp, Homo sapien
ttgggctgctccctcgtgcacagcg

SEQ ID NO: 181434 - DNA, 25 bp, Homo sapien
atgtgagggcatgttgtccatatcc

SEQ ID NO: 181435 - DNA, 25 bp, Homo sapien
gcatgttgtccatatccctgtggaa

SEQ ID NO: 181436 - DNA, 25 bp, Homo sapien
tgttgtccatatccctgtggaatac

SEQ ID NO: 181437 - DNA, 25 bp, Homo sapien
tatccctgtggaatacagaccgtgt

SEQ ID NO: 181438 - DNA, 25 bp, Homo sapien
atacagaccgtgtaactggacagct

SEQ ID NO: 181439 - DNA, 25 bp, Homo sapien
accgtgtaactggacagctgagtgt

SEQ ID NO: 181440 - DNA, 25 bp, Homo sapien
gacagctgagtgtcataaactctaa

SEQ ID NO: 181441 - DNA, 25 bp, Homo sapien
gaaagaagattcctaaatggcctat

SEQ ID NO: 181442 - DNA, 25 bp, Homo sapien
aaatggcctatttagcaagctgcaa

SEQ ID NO: 181443 - DNA, 25 bp, Homo sapien
ttagcaagctgcaaccaagagatgc

SEQ ID NO: 181444 - DNA, 25 bp, Homo sapien
aagagatgcacaaccctccacaaat

SEQ ID NO: 181445 - DNA, 25 bp, Homo sapien
acaaccctccacaaatacacatttt

SEQ ID NO: 181446 - DNA, 25 bp, Homo sapien
atcaacacatttctgccttggcaag

SEQ ID NO: 181447 - DNA, 25 bp, Homo sapien
gccttggcaagtttatatctactgt

SEQ ID NO: 181448 - DNA, 25 bp, Homo sapien
atctactgttcatcctatttaggta

SEQ ID NO: 181449 - DNA, 25 bp, Homo sapien
ggctgtaaacactcctaaaaagctg

SEQ ID NO: 181450 - DNA, 25 bp, Homo sapien
gagtttcctcaatagctgtaagcag

SEQ ID NO: 181451 - DNA, 25 bp, Homo sapien
taagcagatagccagattccaacaa

SEQ ID NO: 181452 - DNA, 25 bp, Homo sapien
cagctttggcatcctcaagtatccc

SEQ ID NO: 181453 - DNA, 25 bp, Homo sapien
agcagaataggtactccacttccgg

SEQ ID NO: 181454 - DNA, 25 bp, Homo sapien
ccggactcctggactgcattaggaa

SEQ ID NO: 181455 - DNA, 25 bp, Homo sapien
taggaagacctctttccctgtccca

SEQ ID NO: 181456 - DNA, 25 bp, Homo sapien
ttctcttccctgttcttgtaacatt

SEQ ID NO: 181457 - DNA, 25 bp, Homo sapien
aacattcttgtgctttgactccttc

SEQ ID NO: 181458 - DNA, 25 bp, Homo sapien
ttctacctgaccctggtgtggaaac

SEQ ID NO: 181459 - DNA, 25 bp, Homo sapien
gaccctggtgtggaaactgcatagt

SEQ ID NO: 181460 - DNA, 25 bp, Homo sapien
tgcatagtgaatatccccaacccca

SEQ ID NO: 181461 - DNA, 25 bp, Homo sapien
atgggcattgactgtagaataccct

SEQ ID NO: 181462 - DNA, 25 bp, Homo sapien
ataccctagagttcctgtagtgtcc

SEQ ID NO: 181463 - DNA, 25 bp, Homo sapien
aatacacgtatgttataaccatcag

SEQ ID NO: 181464 - DNA, 25 bp, Homo sapien
gtatgttataaccatcagcccgcca

SEQ ID NO: 181465 - DNA, 25 bp, Homo sapien
gttataaccatcagcccgccagggt

SEQ ID NO: 181466 - DNA, 25 bp, Homo sapien
ccgccagggtcagggaaaggactca

SEQ ID NO: 181467 - DNA, 25 bp, Homo sapien
gaaaggactcacctgactttggaca

SEQ ID NO: 181468 - DNA, 25 bp, Homo sapien
aggactcacctgactttggacagct

SEQ ID NO: 181469 - DNA, 25 bp, Homo sapien
gggaatggcccacatctcaagaagc

SEQ ID NO: 181470 - DNA, 25 bp, Homo sapien
gaatggcccacatctcaagaagcaa

SEQ ID NO: 181471 - DNA, 25 bp, Homo sapien
atggcccacatctcaagaagcaaga

SEQ ID NO: 181472 - DNA, 25 bp, Homo sapien
ggcccacatctcaagaagcaagata

SEQ ID NO: 181473 - DNA, 25 bp, Homo sapien
caagaagcaagatattgtttgtggt

SEQ ID NO: 181474 - DNA, 25 bp, Homo sapien
gtgtgtgtacctgttgtatgtccta

SEQ ID NO: 181475 - DNA, 25 bp, Homo sapien
gtacctgttgtatgtcctaacttat

SEQ ID NO: 181476 - DNA, 25 bp, Homo sapien
ggcagaaggtaaagcatgtttgact

SEQ ID NO: 181477 - DNA, 25 bp, Homo sapien
ggtaaagcatgtttgacttgtgaaa

SEQ ID NO: 181478 - DNA, 25 bp, Homo sapien
gacttgtgaaaatgggatgtcaaac

SEQ ID NO: 181479 - DNA, 25 bp, Homo sapien
gggatgtcaaacagccataagttcc

SEQ ID NO: 181480 - DNA, 25 bp, Homo sapien
acagccataagttccctggtattca

SEQ ID NO: 181481 - DNA, 25 bp, Homo sapien
taagttccctggtattcaccttcct

SEQ ID NO: 181482 - DNA, 25 bp, Homo sapien
catcggtatacctttatccctttga

SEQ ID NO: 181483 - DNA, 25 bp, Homo sapien
tttgaaagggtgcttgtacaatttg

SEQ ID NO: 181484 - DNA, 25 bp, Homo sapien
gagttatctcttattctgaattaaa

SEQ ID NO: 181485 - DNA, 25 bp, Homo sapien
aattgctattagagttccagttatt

SEQ ID NO: 181486 - DNA, 25 bp, Homo sapien
tccagttattacagggtcatttgtt

SEQ ID NO: 181487 - DNA, 25 bp, Homo sapien
gtcatttgttgacttatctgttgaa

SEQ ID NO: 181488 - DNA, 25 bp, Homo sapien
aatcaaatccaagcgttgaagaagt

SEQ ID NO: 181489 - DNA, 25 bp, Homo sapien
gaagaagttaatgccgaaatgaaaa

SEQ ID NO: 181490 - DNA, 25 bp, Homo sapien
gaatcattccaatacaacgaagatc

SEQ ID NO: 181491 - DNA, 25 bp, Homo sapien
aagatcaagttgtttcttcagatat

SEQ ID NO: 181492 - DNA, 25 bp, Homo sapien
gttaacaatacacatggttccattt

SEQ ID NO: 181493 - DNA, 25 bp, Homo sapien
ggttccatttttgatgcaacattaa

SEQ ID NO: 181494 - DNA, 25 bp, Homo sapien
aagattatacaaactctatgcttga

SEQ ID NO: 181495 - DNA, 25 bp, Homo sapien
aactctatgcttgatatgacaatga

SEQ ID NO: 181496 - DNA, 25 bp, Homo sapien
gtgtcgtacgaacagtacctgtcca

SEQ ID NO: 181497 - DNA, 25 bp, Homo sapien
agtacctgtccatggtcttcagtat

SEQ ID NO: 181498 - DNA, 25 bp, Homo sapien
gtcttcagtatcgtatgaccctggc

SEQ ID NO: 181499 - DNA, 25 bp, Homo sapien
gaccctggcctctcgtgaagagcag

SEQ ID NO: 181500 - DNA, 25 bp, Homo sapien
gagcagcacaacatggaaagagcca

SEQ ID NO: 181501 - DNA, 25 bp, Homo sapien
gtcacagttcctatctgtgagggaa

SEQ ID NO: 181502 - DNA, 25 bp, Homo sapien
gcagttagatgctgttcttccttta

SEQ ID NO: 181503 - DNA, 25 bp, Homo sapien
cttcctttagattttgtcacgtggg

SEQ ID NO: 181504 - DNA, 25 bp, Homo sapien
gcaactgtaatagtagctgtatcgt

SEQ ID NO: 181505 - DNA, 25 bp, Homo sapien
agctgtatcgttctaatgcagacat

SEQ ID NO: 181506 - DNA, 25 bp, Homo sapien
tttggtgactgtctcattgtgccat

SEQ ID NO: 181507 - DNA, 25 bp, Homo sapien
gctgatagaaagcactatacatcct

SEQ ID NO: 181508 - DNA, 25 bp, Homo sapien
gaaagcactatacatcctattgttt

SEQ ID NO: 181509 - DNA, 25 bp, Homo sapien
gcactatacatcctattgtttcttt

SEQ ID NO: 181510 - DNA, 25 bp, Homo sapien
agccttctgtctgtaacaaaaatgt

SEQ ID NO: 181511 - DNA, 25 bp, Homo sapien
aatgtactttatagagatggaggaa

SEQ ID NO: 181512 - DNA, 25 bp, Homo sapien
ggaggaaaaggtctaatactacata

SEQ ID NO: 181513 - DNA, 25 bp, Homo sapien
ggtctaatactacatagccttaagt

SEQ ID NO: 181514 - DNA, 25 bp, Homo sapien
catagccttaagtgtttctgtcatt

SEQ ID NO: 181515 - DNA, 25 bp, Homo sapien
gtaaatatacttgtcttacctctca

SEQ ID NO: 181516 - DNA, 25 bp, Homo sapien
atatacttgtcttacctctcaataa

SEQ ID NO: 181517 - DNA, 25 bp, Homo sapien
ttgtcttacctctcaataaaagggt

SEQ ID NO: 181518 - DNA, 25 bp, Homo sapien
tctgtgtgtgtacctgttgtatgtc

SEQ ID NO: 181519 - DNA, 25 bp, Homo sapien
tgtgtgtgtacctgttgtatgtcct

SEQ ID NO: 181520 - DNA, 25 bp, Homo sapien
gtgtgtgtacctgttgtatgtccta

SEQ ID NO: 181521 - DNA, 25 bp, Homo sapien
tgtgtgtacctgttgtatgtcctaa

SEQ ID NO: 181522 - DNA, 25 bp, Homo sapien
tttgaaagggtgcttgtacaatttg

SEQ ID NO: 181523 - DNA, 25 bp, Homo sapien
tatattttattgaagagttatctct

SEQ ID NO: 181524 - DNA, 25 bp, Homo sapien
attgaagagttatctcttattctga

SEQ ID NO: 181525 - DNA, 25 bp, Homo sapien
ttgaagagttatctcttattctgaa

SEQ ID NO: 181526 - DNA, 25 bp, Homo sapien
tgaagagttatctcttattctgaat

SEQ ID NO: 181527 - DNA, 25 bp, Homo sapien
gagttatctcttattctgaattaaa

SEQ ID NO: 181528 - DNA, 25 bp, Homo sapien
ttctgaattaaattaagcatttgtt

SEQ ID NO: 181529 - DNA, 25 bp, Homo sapien
caaaggatctcccagtgaccaaagg

SEQ ID NO: 181530 - DNA, 25 bp, Homo sapien
gtgaccaaaggatgcgaagagtgat

SEQ ID NO: 181531 - DNA, 25 bp, Homo sapien
gagtgatagttacgtgctcctgact

SEQ ID NO: 181532 - DNA, 25 bp, Homo sapien
atagttacgtgctcctgactgatca

SEQ ID NO: 181533 - DNA, 25 bp, Homo sapien
tgactgatcacaccgcagacattta

SEQ ID NO: 181534 - DNA, 25 bp, Homo sapien
tttagatttttatacccaaggcact

SEQ ID NO: 181535 - DNA, 25 bp, Homo sapien
tctctgtaccattcattctccctga

SEQ ID NO: 181536 - DNA, 25 bp, Homo sapien
tgaccggcctttcttgccgagggtt

SEQ ID NO: 181537 - DNA, 25 bp, Homo sapien
ttgccgagggttctgtggctcttac

SEQ ID NO: 181538 - DNA, 25 bp, Homo sapien
ttctgtggctcttacccttgtgaag

SEQ ID NO: 181539 - DNA, 25 bp, Homo sapien
tttagcctgggacagaaggacctcc

SEQ ID NO: 181540 - DNA, 25 bp, Homo sapien
tctattgtccgctttggctaccact

SEQ ID NO: 181541 - DNA, 25 bp, Homo sapien
ttggctaccactttacacagcaggg

SEQ ID NO: 181542 - DNA, 25 bp, Homo sapien
cccaggccatgacccgaaacaatga

SEQ ID NO: 181543 - DNA, 25 bp, Homo sapien
gaaacaatgaactacgtcgccagca

SEQ ID NO: 181544 - DNA, 25 bp, Homo sapien
actgcatttccctttaccaactagc

SEQ ID NO: 181545 - DNA, 25 bp, Homo sapien
accaactagcgctgggagcactgga

SEQ ID NO: 181546 - DNA, 25 bp, Homo sapien
tgtgctgaaggcagttcgggaaaat

SEQ ID NO: 181547 - DNA, 25 bp, Homo sapien
tcgggaaaatgccacactcactgag

SEQ ID NO: 181548 - DNA, 25 bp, Homo sapien
actcactgagctccgtgtagacaat

SEQ ID NO: 181549 - DNA, 25 bp, Homo sapien
gtgtagacaatcagcgccagtggcc

SEQ ID NO: 181550 - DNA, 25 bp, Homo sapien
gtgctagagcagtgtccctctattg

SEQ ID NO: 181551 - DNA, 25 bp, Homo sapien
gacaccttagtaaatttctttcctg

SEQ ID NO: 181552 - DNA, 25 bp, Homo sapien
gtaaatttctttcctgacagcatga

SEQ ID NO: 181553 - DNA, 25 bp, Homo sapien
acagcatgactcctcctaaaggcaa

SEQ ID NO: 181554 - DNA, 25 bp, Homo sapien
aaaggcaacctcgtagacctgatca

SEQ ID NO: 181555 - DNA, 25 bp, Homo sapien
gtagacctgatcacactgtaactga

SEQ ID NO: 181556 - DNA, 25 bp, Homo sapien
acaggagtcgattttccgtcttttg

SEQ ID NO: 181557 - DNA, 25 bp, Homo sapien
gtcttttggattgcagctccactga

SEQ ID NO: 181558 - DNA, 25 bp, Homo sapien
tgattgaggactggcaccgagagtt

SEQ ID NO: 181559 - DNA, 25 bp, Homo sapien
gcaccgagagttctgaagggatctt

SEQ ID NO: 181560 - DNA, 25 bp, Homo sapien
gaagggatcttaaccgatcacaagt

SEQ ID NO: 181561 - DNA, 25 bp, Homo sapien
gatcacaagtttttaccctcttcct

SEQ ID NO: 181562 - DNA, 25 bp, Homo sapien
gggtccccctgaactccctgtatat

SEQ ID NO: 181563 - DNA, 25 bp, Homo sapien
aaataacgggattttcatggcgccg

SEQ ID NO: 181564 - DNA, 25 bp, Homo sapien
taacgggattttcatggcgccgccc

SEQ ID NO: 181565 - DNA, 25 bp, Homo sapien
ccacccgcattatcactgtgtgatg

SEQ ID NO: 181566 - DNA, 25 bp, Homo sapien
tatcactgtgtgatggtctcagtca

SEQ ID NO: 181567 - DNA, 25 bp, Homo sapien
actgtgtgatggtctcagtcagtct

SEQ ID NO: 181568 - DNA, 25 bp, Homo sapien
tgtctccactctttccctctattta

SEQ ID NO: 181569 - DNA, 25 bp, Homo sapien
ccctctatttatttcactctcttgt

SEQ ID NO: 181570 - DNA, 25 bp, Homo sapien
cactctcttgtttggttctaccctg

SEQ ID NO: 181571 - DNA, 25 bp, Homo sapien
tctcttgtttggttctaccctgcac

SEQ ID NO: 181572 - DNA, 25 bp, Homo sapien
tgtttggttctaccctgcaccctcg

SEQ ID NO: 181573 - DNA, 25 bp, Homo sapien
cagccttttcctgggatgcagtgaa

SEQ ID NO: 181574 - DNA, 25 bp, Homo sapien
gtgaaatcccatccatgaactcgat

SEQ ID NO: 181575 - DNA, 25 bp, Homo sapien
ttcacgacgtgactgctggacctgg

SEQ ID NO: 181576 - DNA, 25 bp, Homo sapien
tgaggccacatgtgaagggtcctgc

SEQ ID NO: 181577 - DNA, 25 bp, Homo sapien
tgaagggtcctgctgtggtcatctt

SEQ ID NO: 181578 - DNA, 25 bp, Homo sapien
tggtcatcttggtgactcggtcaca

SEQ ID NO: 181579 - DNA, 25 bp, Homo sapien
ggtcacagcagctactggccaagat

SEQ ID NO: 181580 - DNA, 25 bp, Homo sapien
tactggccaagatcagacgtcgctg

SEQ ID NO: 181581 - DNA, 25 bp, Homo sapien
atcctcgttctccagggtcaaggaa

SEQ ID NO: 181582 - DNA, 25 bp, Homo sapien
tcgtgttttcgacttgaccttgtgg

SEQ ID NO: 181583 - DNA, 25 bp, Homo sapien
tgtggtatttttcttggcctagttg

SEQ ID NO: 181584 - DNA, 25 bp, Homo sapien
tcgcttcctggagatggagccagtc

SEQ ID NO: 181585 - DNA, 25 bp, Homo sapien
atgtccacggcggatccttgcagaa

SEQ ID NO: 181586 - DNA, 25 bp, Homo sapien
ggatccttgcagaatgctgtccgcg

SEQ ID NO: 181587 - DNA, 25 bp, Homo sapien
aatgctgtccgcgtgtggagcaaca

SEQ ID NO: 181588 - DNA, 25 bp, Homo sapien
gtggagcaacatcccagccataagg

SEQ ID NO: 181589 - DNA, 25 bp, Homo sapien
ctgggctctggtttcggaagaagaa

SEQ ID NO: 181590 - DNA, 25 bp, Homo sapien
tcggaagaagaattgtccctgctgg

SEQ ID NO: 181591 - DNA, 25 bp, Homo sapien
agagctcgaagctcgcggccaagtg

SEQ ID NO: 181592 - DNA, 25 bp, Homo sapien
ttttcaacagaactcacttcctctt

SEQ ID NO: 181593 - DNA, 25 bp, Homo sapien
cagaactcacttcctctttataaat

SEQ ID NO: 181594 - DNA, 25 bp, Homo sapien
aaatgagtcactatactgtgaagaa

SEQ ID NO: 181595 - DNA, 25 bp, Homo sapien
tgggcctgcatgaggtccctgtcag

SEQ ID NO: 181596 - DNA, 25 bp, Homo sapien
aggtccctgtcagtatacaccctgg

SEQ ID NO: 181597 - DNA, 25 bp, Homo sapien
tgtgaagactgccaggcctaggctc

SEQ ID NO: 181598 - DNA, 25 bp, Homo sapien
gccaggcctaggctctctgtagaga

SEQ ID NO: 181599 - DNA, 25 bp, Homo sapien
aggcctaggctctctgtagagagtc

SEQ ID NO: 181600 - DNA, 25 bp, Homo sapien
gagtcttcaagatcccggagtggta

SEQ ID NO: 181601 - DNA, 25 bp, Homo sapien
aagatcccggagtggtagcgctgtc

SEQ ID NO: 181602 - DNA, 25 bp, Homo sapien
agtggtagcgctgtctcctggtgaa

SEQ ID NO: 181603 - DNA, 25 bp, Homo sapien
gcgctgtctcctggtgaaggagtat

SEQ ID NO: 181604 - DNA, 25 bp, Homo sapien
gaaggagtatttgtcacactggaat

SEQ ID NO: 181605 - DNA, 25 bp, Homo sapien
ttgtcacactggaatgtgactgtgt

SEQ ID NO: 181606 - DNA, 25 bp, Homo sapien
gaataaagcctcatatccaggaaaa

SEQ ID NO: 181607 - DNA, 25 bp, Homo sapien
aaagctgcatcaagacccatttggc

SEQ ID NO: 181608 - DNA, 25 bp, Homo sapien
cccatttggcaagaggttgtccgaa

SEQ ID NO: 181609 - DNA, 25 bp, Homo sapien
ggttgtccgaaaataattccttgat

SEQ ID NO: 181610 - DNA, 25 bp, Homo sapien
ccttgatcatatctgaagtggttat

SEQ ID NO: 181611 - DNA, 25 bp, Homo sapien
aaatcaatttctcccctgcgtcgct

SEQ ID NO: 181612 - DNA, 25 bp, Homo sapien
ccctgcgtcgctaagactgtcataa

SEQ ID NO: 181613 - DNA, 25 bp, Homo sapien
taagactgtcataaaatggccttga

SEQ ID NO: 181614 - DNA, 25 bp, Homo sapien
atggccttgacatttaatcacaggt

SEQ ID NO: 181615 - DNA, 25 bp, Homo sapien
tcacaggttactttccagaaaggtt

SEQ ID NO: 181616 - DNA, 25 bp, Homo sapien
aaagttacagattcagcttttcaaa

SEQ ID NO: 181617 - DNA, 25 bp, Homo sapien
aagaatgtgaccatttggaaaaggc

SEQ ID NO: 181618 - DNA, 25 bp, Homo sapien
aaaggagcaaaatgaagcattcccc

SEQ ID NO: 181619 - DNA, 25 bp, Homo sapien
gagttgggcattgtttttctaacct

SEQ ID NO: 181620 - DNA, 25 bp, Homo sapien
ctttttcctgttctgtttggagtgg

SEQ ID NO: 181621 - DNA, 25 bp, Homo sapien
ttcctgttctgtttggagtggagaa

SEQ ID NO: 181622 - DNA, 25 bp, Homo sapien
agaagggcagcacctctgtgtttaa

SEQ ID NO: 181623 - DNA, 25 bp, Homo sapien
agcacctctgtgtttaatggaaata

SEQ ID NO: 181624 - DNA, 25 bp, Homo sapien
ggaaatagcccatagtctcctggat

SEQ ID NO: 181625 - DNA, 25 bp, Homo sapien
agcccatagtctcctggatttttgg

SEQ ID NO: 181626 - DNA, 25 bp, Homo sapien
atagtctcctggatttttggaacat

SEQ ID NO: 181627 - DNA, 25 bp, Homo sapien
ctttctcagcctattttgtgtccta

SEQ ID NO: 181628 - DNA, 25 bp, Homo sapien
cccctgtgcggtttactgtgggaga

SEQ ID NO: 181629 - DNA, 25 bp, Homo sapien
actgtgggagacagcccaccttgaa

SEQ ID NO: 181630 - DNA, 25 bp, Homo sapien
ttgcagctgaaagtcccactggctg

SEQ ID NO: 181631 - DNA, 25 bp, Homo sapien
gaaagtcccactggctggcctcagg

SEQ ID NO: 181632 - DNA, 25 bp, Homo sapien
caggctgtcttattccgcttgaaaa

SEQ ID NO: 181633 - DNA, 25 bp, Homo sapien
agccaaaaagtctactgtggtattt

SEQ ID NO: 181634 - DNA, 25 bp, Homo sapien
aactctatctgctgaaagggcctgc

SEQ ID NO: 181635 - DNA, 25 bp, Homo sapien
gccttcccatctaatttattgtgaa

SEQ ID NO: 181636 - DNA, 25 bp, Homo sapien
gaagtcatatagtccatgtctgtga

SEQ ID NO: 181637 - DNA, 25 bp, Homo sapien
atgtctgtgatgtgagccaagtgat

SEQ ID NO: 181638 - DNA, 25 bp, Homo sapien
gagccaagtgatatcctgtagtaca

SEQ ID NO: 181639 - DNA, 25 bp, Homo sapien
aagccatgaccgaccaatatgttga

SEQ ID NO: 181640 - DNA, 25 bp, Homo sapien
atatgttgacatactgatcctctac

SEQ ID NO: 181641 - DNA, 25 bp, Homo sapien
atactgatcctctactctgagtggg

SEQ ID NO: 181642 - DNA, 25 bp, Homo sapien
agttattttctctgaccgcctactg

SEQ ID NO: 181643 - DNA, 25 bp, Homo sapien
tctctgaccgcctactggaaatatt

SEQ ID NO: 181644 - DNA, 25 bp, Homo sapien
gtggaaccaaaataggcatccttac

SEQ ID NO: 181645 - DNA, 25 bp, Homo sapien
gaagactgacttgacacgtttgtaa

SEQ ID NO: 181646 - DNA, 25 bp, Homo sapien
aatggtagaacggtggctactgtga

SEQ ID NO: 181647 - DNA, 25 bp, Homo sapien
ggagcagaaccgcaccactgttata

SEQ ID NO: 181648 - DNA, 25 bp, Homo sapien
ccgcaccactgttatactgggataa

SEQ ID NO: 181649 - DNA, 25 bp, Homo sapien
cagttatccttgtatccatgtaatt

SEQ ID NO: 181650 - DNA, 25 bp, Homo sapien
tatatctttttacatgtggggggca

SEQ ID NO: 181651 - DNA, 25 bp, Homo sapien
ggcagaaggtaaagcatgtttgact

SEQ ID NO: 181652 - DNA, 25 bp, Homo sapien
ggtaaagcatgtttgacttgtgaaa

SEQ ID NO: 181653 - DNA, 25 bp, Homo sapien
gacttgtgaaaatgggatgtcaaac

SEQ ID NO: 181654 - DNA, 25 bp, Homo sapien
tgggatgtcaaacagccataagttc

SEQ ID NO: 181655 - DNA, 25 bp, Homo sapien
gtcaaacagccataagttccctggt

SEQ ID NO: 181656 - DNA, 25 bp, Homo sapien
acagccataagttccctggtattca

SEQ ID NO: 181657 - DNA, 25 bp, Homo sapien
gccataagttccctggtattcacct

SEQ ID NO: 181658 - DNA, 25 bp, Homo sapien
cataagttccctggtattcaccttc

SEQ ID NO: 181659 - DNA, 25 bp, Homo sapien
taagttccctggtattcaccttcct

SEQ ID NO: 181660 - DNA, 25 bp, Homo sapien
atctgtcccctccatcggtatacct

SEQ ID NO: 181661 - DNA, 25 bp, Homo sapien
acatcaggcctggttcacctctggg

SEQ ID NO: 181662 - DNA, 25 bp, Homo sapien
gggtcacgagactgagtctacagga

SEQ ID NO: 181663 - DNA, 25 bp, Homo sapien
actgagtctacaggagctttgggcc

SEQ ID NO: 181664 - DNA, 25 bp, Homo sapien
gcacaagagtgcaaaggttcctcga

SEQ ID NO: 181665 - DNA, 25 bp, Homo sapien
aaaggttcctcgaactctgcacctt

SEQ ID NO: 181666 - DNA, 25 bp, Homo sapien
agcctgggatatggctccatctgcc

SEQ ID NO: 181667 - DNA, 25 bp, Homo sapien
ggatatggctccatctgccttcagg

SEQ ID NO: 181668 - DNA, 25 bp, Homo sapien
cctggactgcactcacagaggcaag

SEQ ID NO: 181669 - DNA, 25 bp, Homo sapien
acagaggcaagtgttgtagactaac

SEQ ID NO: 181670 - DNA, 25 bp, Homo sapien
gatactccaaaatacaatggcttaa

SEQ ID NO: 181671 - DNA, 25 bp, Homo sapien
acaatggcttaaagaatgtggtcat

SEQ ID NO: 181672 - DNA, 25 bp, Homo sapien
cagtgtgatggagagtctctgccgt

SEQ ID NO: 181673 - DNA, 25 bp, Homo sapien
agtctctgccgtgccatctgggatg

SEQ ID NO: 181674 - DNA, 25 bp, Homo sapien
tctgccgtgccatctgggatgcaaa

SEQ ID NO: 181675 - DNA, 25 bp, Homo sapien
gtgccatctgggatgcaaaccgtcc

SEQ ID NO: 181676 - DNA, 25 bp, Homo sapien
tctgggatgcaaaccgtccctgtgt

SEQ ID NO: 181677 - DNA, 25 bp, Homo sapien
acgtccaggccgtagatgctccccg

SEQ ID NO: 181678 - DNA, 25 bp, Homo sapien
gccggtcagtcacttagtcgtcaga

SEQ ID NO: 181679 - DNA, 25 bp, Homo sapien
gtcagtcacttagtcgtcagatcgc

SEQ ID NO: 181680 - DNA, 25 bp, Homo sapien
gtcacttagtcgtcagatcgcccgt

SEQ ID NO: 181681 - DNA, 25 bp, Homo sapien
ttagtcgtcagatcgcccgtcctgg

SEQ ID NO: 181682 - DNA, 25 bp, Homo sapien
gatcgcccgtcctggtatcacagtg

SEQ ID NO: 181683 - DNA, 25 bp, Homo sapien
tacctttttgtccagtcatgtttct

SEQ ID NO: 181684 - DNA, 25 bp, Homo sapien
gtttctgcatgcctgtacatatttc

SEQ ID NO: 181685 - DNA, 25 bp, Homo sapien
ctgcatgcctgtacatatttcgtta

SEQ ID NO: 181686 - DNA, 25 bp, Homo sapien
gcctgtacatatttcgttaaaccta

SEQ ID NO: 181687 - DNA, 25 bp, Homo sapien
acctaaacatagtagacaatttctc

SEQ ID NO: 181688 - DNA, 25 bp, Homo sapien
tggtcttcagttaaggtcataaaac

SEQ ID NO: 181689 - DNA, 25 bp, Homo sapien
tgccccatacccagaaggaaagaat

SEQ ID NO: 181690 - DNA, 25 bp, Homo sapien
tctggacggacaggccttgtgttgt

SEQ ID NO: 181691 - DNA, 25 bp, Homo sapien
gacggacaggccttgtgttgtcttc

SEQ ID NO: 181692 - DNA, 25 bp, Homo sapien
tctcttgagcagtagatcatacctt

SEQ ID NO: 181693 - DNA, 25 bp, Homo sapien
gatcatacctttttgtccagtcatg

SEQ ID NO: 181694 - DNA, 25 bp, Homo sapien
agcccacgcttaggaatgcttgcct

SEQ ID NO: 181695 - DNA, 25 bp, Homo sapien
acgcttaggaatgcttgcctctggc

SEQ ID NO: 181696 - DNA, 25 bp, Homo sapien
ttaggaatgcttgcctctggcaggc

SEQ ID NO: 181697 - DNA, 25 bp, Homo sapien
gctggaaggcaccaggcctcaggag

SEQ ID NO: 181698 - DNA, 25 bp, Homo sapien
gcctgcagcctgtaaccatcggctg

SEQ ID NO: 181699 - DNA, 25 bp, Homo sapien
gcctgtaaccatcggctgggccctg

SEQ ID NO: 181700 - DNA, 25 bp, Homo sapien
acactcacgccctgtgggtgatggt

SEQ ID NO: 181701 - DNA, 25 bp, Homo sapien
ctcacgccctgtgggtgatggtcac

SEQ ID NO: 181702 - DNA, 25 bp, Homo sapien
gggactgtcactgtggacgccaaaa

SEQ ID NO: 181703 - DNA, 25 bp, Homo sapien
tgtcactgtggacgccaaaatggca

SEQ ID NO: 181704 - DNA, 25 bp, Homo sapien
caaaatggcataactgagataaggt

SEQ ID NO: 181705 - DNA, 25 bp, Homo sapien
gatattgtatatgttttgtcccagt

SEQ ID NO: 181706 - DNA, 25 bp, Homo sapien
gttttgtcccagttgtatagtaatg

SEQ ID NO: 181707 - DNA, 25 bp, Homo sapien
gtaatgtttcagtccatcatccagc

SEQ ID NO: 181708 - DNA, 25 bp, Homo sapien
catcatccagctttggctgctgaaa

SEQ ID NO: 181709 - DNA, 25 bp, Homo sapien
ggctgctgaaatcatacagctgtga

SEQ ID NO: 181710 - DNA, 25 bp, Homo sapien
gtttctgttagactgcttttcagtt

SEQ ID NO: 181711 - DNA, 25 bp, Homo sapien
ctgcttttcagttctgtattgagta

SEQ ID NO: 181712 - DNA, 25 bp, Homo sapien
atgtcacttcttcctttaaggctgt

SEQ ID NO: 181713 - DNA, 25 bp, Homo sapien
caatatactatctgtgttttcacca

SEQ ID NO: 181714 - DNA, 25 bp, Homo sapien
gtgttttcaccattcaaagtgctgt

SEQ ID NO: 181715 - DNA, 25 bp, Homo sapien
ccattcaaagtgctgtttagtagtt

SEQ ID NO: 181716 - DNA, 25 bp, Homo sapien
atcagccaaacttaaccttggtggg

SEQ ID NO: 181717 - DNA, 25 bp, Homo sapien
gatagccaattagttctgtgctggt

SEQ ID NO: 181718 - DNA, 25 bp, Homo sapien
gttctgtgctggttgcaaagaattg

SEQ ID NO: 181719 - DNA, 25 bp, Homo sapien
tttaatactcagcagattgtcttcc

SEQ ID NO: 181720 - DNA, 25 bp, Homo sapien
tgttgcttttgttatcagcctgatt

SEQ ID NO: 181721 - DNA, 25 bp, Homo sapien
atcagcctgattttttgctcagtat

SEQ ID NO: 181722 - DNA, 25 bp, Homo sapien
gtatatgatagttctgctgatgttt

SEQ ID NO: 181723 - DNA, 25 bp, Homo sapien
ctgatgttttgtttattgggcagac

SEQ ID NO: 181724 - DNA, 25 bp, Homo sapien
ttgggcagacatatcttcattaaga

SEQ ID NO: 181725 - DNA, 25 bp, Homo sapien
gaatacattttcttcataacccatt

SEQ ID NO: 181726 - DNA, 25 bp, Homo sapien
cataacccatttggaattattccta

SEQ ID NO: 181727 - DNA, 25 bp, Homo sapien
tacaaactggcccaaccacaggagc

SEQ ID NO: 181728 - DNA, 25 bp, Homo sapien
aaccacaggagctgccagtatccag

SEQ ID NO: 181729 - DNA, 25 bp, Homo sapien
gagctgccagtatccagcagtatct

SEQ ID NO: 181730 - DNA, 25 bp, Homo sapien
cagtatctggaccacaggcaaagaa

SEQ ID NO: 181731 - DNA, 25 bp, Homo sapien
gaaaaccactaggaccaccaggagc

SEQ ID NO: 181732 - DNA, 25 bp, Homo sapien
agaagattccgccacctcaagtgaa

SEQ ID NO: 181733 - DNA, 25 bp, Homo sapien
tcaagtgaactgcaggaatcctcca

SEQ ID NO: 181734 - DNA, 25 bp, Homo sapien
aggaatcctccaacaaccacaaaca

SEQ ID NO: 181735 - DNA, 25 bp, Homo sapien
accacaaacacatcgttcgctgtta

SEQ ID NO: 181736 - DNA, 25 bp, Homo sapien
gttcgctgttagtgtcttcttcctg

SEQ ID NO: 181737 - DNA, 25 bp, Homo sapien
gtttcaatacaaccataggctcaca

SEQ ID NO: 181738 - DNA, 25 bp, Homo sapien
cccggcacccagttgtgatgtggag

SEQ ID NO: 181739 - DNA, 25 bp, Homo sapien
atgtggagaatgaaggctcctgcaa

SEQ ID NO: 181740 - DNA, 25 bp, Homo sapien
agagaagccagaggaaacgtgtgca

SEQ ID NO: 181741 - DNA, 25 bp, Homo sapien
gcagctgtcagacgaggctcagcaa

SEQ ID NO: 181742 - DNA, 25 bp, Homo sapien
gtcagacgaggctcagcaaagaaaa

SEQ ID NO: 181743 - DNA, 25 bp, Homo sapien
aaaaaatccatccattgcaagtcat

SEQ ID NO: 181744 - DNA, 25 bp, Homo sapien
catccattgcaagtcatgagtgaat

SEQ ID NO: 181745 - DNA, 25 bp, Homo sapien
gaagacaaatctactgaaaccacta

SEQ ID NO: 181746 - DNA, 25 bp, Homo sapien
aatctactgaaaccactattctaca

SEQ ID NO: 181747 - DNA, 25 bp, Homo sapien
tgcctatatgacaaaatcctgccta

SEQ ID NO: 181748 - DNA, 25 bp, Homo sapien
cctgcctaaccacactgctttattt

SEQ ID NO: 181749 - DNA, 25 bp, Homo sapien
gatgctggtttcaaccatctatata

SEQ ID NO: 181750 - DNA, 25 bp, Homo sapien
atctatatatggcatccacgcatgg

SEQ ID NO: 181751 - DNA, 25 bp, Homo sapien
tggcatccacgcatgggatctgcaa

SEQ ID NO: 181752 - DNA, 25 bp, Homo sapien
atgggatctgcaagctggagccctc

SEQ ID NO: 181753 - DNA, 25 bp, Homo sapien
tacccgcaggcttgagcacagcatc

SEQ ID NO: 181754 - DNA, 25 bp, Homo sapien
gaggcgcacccttaagcaagacaga

SEQ ID NO: 181755 - DNA, 25 bp, Homo sapien
gaggctgacaggcagaagactaaca

SEQ ID NO: 181756 - DNA, 25 bp, Homo sapien
taacagagcgcagtctgcacacgca

SEQ ID NO: 181757 - DNA, 25 bp, Homo sapien
tgcacacgcaggttctgggcgacct

SEQ ID NO: 181758 - DNA, 25 bp, Homo sapien
atctctgcactaactcatctgaatt

SEQ ID NO: 181759 - DNA, 25 bp, Homo sapien
aggtggcagtcttggtcagtagttt

SEQ ID NO: 181760 - DNA, 25 bp, Homo sapien
gaattccagtttgatgtttgtctct

SEQ ID NO: 181761 - DNA, 25 bp, Homo sapien
gtttgtctctagttgtctgtgtata

SEQ ID NO: 181762 - DNA, 25 bp, Homo sapien
gtgtataatatttccaaagctcctt

SEQ ID NO: 181763 - DNA, 25 bp, Homo sapien
tttcattcagagagtcagagacggt

SEQ ID NO: 181764 - DNA, 25 bp, Homo sapien
gagtcagagacggtatctcctcctc

SEQ ID NO: 181765 - DNA, 25 bp, Homo sapien
cctgcctcttctattgttctgatta

SEQ ID NO: 181766 - DNA, 25 bp, Homo sapien
ctattgttctgattagtctacttaa

SEQ ID NO: 181767 - DNA, 25 bp, Homo sapien
gtctacttaaattcacttgatgctc

SEQ ID NO: 181768 - DNA, 25 bp, Homo sapien
tcacttgatgctctttttattttac

SEQ ID NO: 181769 - DNA, 25 bp, Homo sapien
gttcctaatggcaaactactttagc

SEQ ID NO: 181770 - DNA, 25 bp, Homo sapien
ttagctgggaaaattcatttcaact

SEQ ID NO: 181771 - DNA, 25 bp, Homo sapien
ggttctttacaacctgttcaccaag

SEQ ID NO: 181772 - DNA, 25 bp, Homo sapien
gtcccagcaagaaaggcggcatccg

SEQ ID NO: 181773 - DNA, 25 bp, Homo sapien
caagaaaggcggcatccgtctgtgc

SEQ ID NO: 181774 - DNA, 25 bp, Homo sapien
agaaaggcggcatccgtctgtgccc

SEQ ID NO: 181775 - DNA, 25 bp, Homo sapien
aaggcggcatccgtctgtgccctgt

SEQ ID NO: 181776 - DNA, 25 bp, Homo sapien
ggcatccgtctgtgccctgtgcctt

SEQ ID NO: 181777 - DNA, 25 bp, Homo sapien
tgcctttccagggagccaggcgcca

SEQ ID NO: 181778 - DNA, 25 bp, Homo sapien
agccaggcgccatgggcttttggtc

SEQ ID NO: 181779 - DNA, 25 bp, Homo sapien
gcgccatgggcttttggtccaagct

SEQ ID NO: 181780 - DNA, 25 bp, Homo sapien
gtccaagctgtgttgactgtcatcc

SEQ ID NO: 181781 - DNA, 25 bp, Homo sapien
ccatgtagttcccagtgggcaagag

SEQ ID NO: 181782 - DNA, 25 bp, Homo sapien
cggagactcatggacttggggctct

SEQ ID NO: 181783 - DNA, 25 bp, Homo sapien
gggctctgcctgtaggaaggaggct

SEQ ID NO: 181784 - DNA, 25 bp, Homo sapien
agccaccattgtctctgttcagcca

SEQ ID NO: 181785 - DNA, 25 bp, Homo sapien
ctctgttcagccaagtgtgcaagta

SEQ ID NO: 181786 - DNA, 25 bp, Homo sapien
aagtgtgcaagtaggctgcccgcca

SEQ ID NO: 181787 - DNA, 25 bp, Homo sapien
tgcaagtaggctgcccgccaagagg

SEQ ID NO: 181788 - DNA, 25 bp, Homo sapien
ttcccatgcttgtaaccagctctgg

SEQ ID NO: 181789 - DNA, 25 bp, Homo sapien
gggcttgcacctccacaaagtaagg

SEQ ID NO: 181790 - DNA, 25 bp, Homo sapien
cacaaagtaaggttggcccttggag

SEQ ID NO: 181791 - DNA, 25 bp, Homo sapien
catgtttgggtctccggccagggcc

SEQ ID NO: 181792 - DNA, 25 bp, Homo sapien
agggcctagggctaggccatgcacc

SEQ ID NO: 181793 - DNA, 25 bp, Homo sapien
taactttaggaactgaattgtacct

SEQ ID NO: 181794 - DNA, 25 bp, Homo sapien
tgtacctttgtcctgtcctttccct

SEQ ID NO: 181795 - DNA, 25 bp, Homo sapien
tgtcctttccctaggaggcacagac

SEQ ID NO: 181796 - DNA, 25 bp, Homo sapien
gaggcacagacttcgggttggattt

SEQ ID NO: 181797 - DNA, 25 bp, Homo sapien
acttcgggttggatttgtcagcaag

SEQ ID NO: 181798 - DNA, 25 bp, Homo sapien
ttctaagtgggatagggacatacct

SEQ ID NO: 181799 - DNA, 25 bp, Homo sapien
gggacatacctacctggatttacat

SEQ ID NO: 181800 - DNA, 25 bp, Homo sapien
cctggatttacatgtgagctgcgat

SEQ ID NO: 181801 - DNA, 25 bp, Homo sapien
gagatgtgcttataaccctgtttca

SEQ ID NO: 181802 - DNA, 25 bp, Homo sapien
tgtttcatatctactcccacgactt

SEQ ID NO: 181803 - DNA, 25 bp, Homo sapien
actcccacgacttactcatatttaa

SEQ ID NO: 181804 - DNA, 25 bp, Homo sapien
acttccaaggctgcaagtttgacct

SEQ ID NO: 181805 - DNA, 25 bp, Homo sapien
aggctgcaagtttgacctcgttgat

SEQ ID NO: 181806 - DNA, 25 bp, Homo sapien
tttgacctcgttgatgactacccat

SEQ ID NO: 181807 - DNA, 25 bp, Homo sapien
atgtgggttccctcaaagtcagctc

SEQ ID NO: 181808 - DNA, 25 bp, Homo sapien
ctcaaagtcagctccggagcgtggg

SEQ ID NO: 181809 - DNA, 25 bp, Homo sapien
aggctaccgaggctaccagtatgtg

SEQ ID NO: 181810 - DNA, 25 bp, Homo sapien
accggcacagcggagagttctgtac

SEQ ID NO: 181811 - DNA, 25 bp, Homo sapien
agttctgtacttacggtgagctcgg

SEQ ID NO: 181812 - DNA, 25 bp, Homo sapien
ttacggtgagctcggcacacaggcc

SEQ ID NO: 181813 - DNA, 25 bp, Homo sapien
agtccatccggagagtccagcacta

SEQ ID NO: 181814 - DNA, 25 bp, Homo sapien
gagagtccagcactaggctccacgg

SEQ ID NO: 181815 - DNA, 25 bp, Homo sapien
gctgagggaagttctttgcctgctg

SEQ ID NO: 181816 - DNA, 25 bp, Homo sapien
ggagcagctatctgattggaaacct

SEQ ID NO: 181817 - DNA, 25 bp, Homo sapien
gacttagtgcggtgataggaagcta

SEQ ID NO: 181818 - DNA, 25 bp, Homo sapien
gaagctaaaagtgtcaagcgttgac

SEQ ID NO: 181819 - DNA, 25 bp, Homo sapien
tcaagcgttgacagcttggaagcgt

SEQ ID NO: 181820 - DNA, 25 bp, Homo sapien
ggaagcgtttatttatacatctctg

SEQ ID NO: 181821 - DNA, 25 bp, Homo sapien
atttgtttcaccttcaagcctttgc

SEQ ID NO: 181822 - DNA, 25 bp, Homo sapien
aagcctttgccctgaggtgttacaa

SEQ ID NO: 181823 - DNA, 25 bp, Homo sapien
tgccctgaggtgttacaatcttgtc

SEQ ID NO: 181824 - DNA, 25 bp, Homo sapien
acaatcttgtcttgcgttttctaaa

SEQ ID NO: 181825 - DNA, 25 bp, Homo sapien
tgcgttttctaaatcaatgcttaat

SEQ ID NO: 181826 - DNA, 25 bp, Homo sapien
agccccaactaatctttagaagcat

SEQ ID NO: 181827 - DNA, 25 bp, Homo sapien
aatctttagaagcatattggaactg

SEQ ID NO: 181828 - DNA, 25 bp, Homo sapien
agaagcatattggaactgataactc

SEQ ID NO: 181829 - DNA, 25 bp, Homo sapien
gcatattggaactgataactccatt

SEQ ID NO: 181830 - DNA, 25 bp, Homo sapien
ggaactgataactccattttaaaat

SEQ ID NO: 181831 - DNA, 25 bp, Homo sapien
ctcaatatcactaataactgggaaa

SEQ ID NO: 181832 - DNA, 25 bp, Homo sapien
tacctgttctcccactgctaatgac

SEQ ID NO: 181833 - DNA, 25 bp, Homo sapien
ctgttctcccactgctaatgacata

SEQ ID NO: 181834 - DNA, 25 bp, Homo sapien
tgttctcccactgctaatgacatac

SEQ ID NO: 181835 - DNA, 25 bp, Homo sapien
gttctcccactgctaatgacatacc

SEQ ID NO: 181836 - DNA, 25 bp, Homo sapien
ctcccactgctaatgacatacccga

SEQ ID NO: 181837 - DNA, 25 bp, Homo sapien
gtcttatcttccaccattaagctgt

SEQ ID NO: 181838 - DNA, 25 bp, Homo sapien
gcaaggctaagattagaacagctca

SEQ ID NO: 181839 - DNA, 25 bp, Homo sapien
gaacagctcataggagagtcatgat

SEQ ID NO: 181840 - DNA, 25 bp, Homo sapien
gtcatgattttgaatcacccagata

SEQ ID NO: 181841 - DNA, 25 bp, Homo sapien
cacccagataaaggtggatctcctt

SEQ ID NO: 181842 - DNA, 25 bp, Homo sapien
tggatctccttacgtagcagccaaa

SEQ ID NO: 181843 - DNA, 25 bp, Homo sapien
aagacttgctagaaacaaccaccaa

SEQ ID NO: 181844 - DNA, 25 bp, Homo sapien
aaccaccaaacattgatgcttaagg

SEQ ID NO: 181845 - DNA, 25 bp, Homo sapien
gatgcttaaggaccacactgaagga

SEQ ID NO: 181846 - DNA, 25 bp, Homo sapien
acatggtcttcttaattttctatat

SEQ ID NO: 181847 - DNA, 25 bp, Homo sapien
atggattgaccacagtcttatcttc

SEQ ID NO: 181848 - DNA, 25 bp, Homo sapien
agttcacaattcaagagcatttcta

SEQ ID NO: 181849 - DNA, 25 bp, Homo sapien
gatgactgtaatttctctaacaacc

SEQ ID NO: 181850 - DNA, 25 bp, Homo sapien
aggcaatggatccttatctcggcct

SEQ ID NO: 181851 - DNA, 25 bp, Homo sapien
tatctcggccttgtccatatgaaat

SEQ ID NO: 181852 - DNA, 25 bp, Homo sapien
tgaaatgtgttcagccactggcact

SEQ ID NO: 181853 - DNA, 25 bp, Homo sapien
ttcagccactggcactggtaatagt

SEQ ID NO: 181854 - DNA, 25 bp, Homo sapien
ggtaatagtgagtttcgctttctta

SEQ ID NO: 181855 - DNA, 25 bp, Homo sapien
gctttcttaagcgttttatgcccaa

SEQ ID NO: 181856 - DNA, 25 bp, Homo sapien
ttttatgcccaacttgcctttccct

SEQ ID NO: 181857 - DNA, 25 bp, Homo sapien
tctcagagattagagggccatgacc

SEQ ID NO: 181858 - DNA, 25 bp, Homo sapien
ggccatgaccaggtatctgatgact

SEQ ID NO: 181859 - DNA, 25 bp, Homo sapien
gattgcgctgttatccctagggtaa

SEQ ID NO: 181860 - DNA, 25 bp, Homo sapien
acttgttccgttggtcaagttattg

SEQ ID NO: 181861 - DNA, 25 bp, Homo sapien
gttccgttggtcaagttattggatc

SEQ ID NO: 181862 - DNA, 25 bp, Homo sapien
cgttggtcaagttattggatcaatt

SEQ ID NO: 181863 - DNA, 25 bp, Homo sapien
gatcaattgagtatagtagttcgct

SEQ ID NO: 181864 - DNA, 25 bp, Homo sapien
atagtagttcgctttgactggtgaa

SEQ ID NO: 181865 - DNA, 25 bp, Homo sapien
tagttcgctttgactggtgaagtct

SEQ ID NO: 181866 - DNA, 25 bp, Homo sapien
atgtactgctcggaggttgggttct

SEQ ID NO: 181867 - DNA, 25 bp, Homo sapien
actgctcggaggttgggttctgctc

SEQ ID NO: 181868 - DNA, 25 bp, Homo sapien
ttgggttctgctccgaggtcgcccc

SEQ ID NO: 181869 - DNA, 25 bp, Homo sapien
taatgcaggtttggtagtttaggac

SEQ ID NO: 181870 - DNA, 25 bp, Homo sapien
ggcgctgctgcgtgtgaaacgccta

SEQ ID NO: 181871 - DNA, 25 bp, Homo sapien
cgctgctgcgtgtgaaacgcctaga

SEQ ID NO: 181872 - DNA, 25 bp, Homo sapien
ctgctgcgtgtgaaacgcctagaga

SEQ ID NO: 181873 - DNA, 25 bp, Homo sapien
gctgcgtgtgaaacgcctagagacc

SEQ ID NO: 181874 - DNA, 25 bp, Homo sapien
cgtgtgaaacgcctagagaccccgg

SEQ ID NO: 181875 - DNA, 25 bp, Homo sapien
gtgtgaaacgcctagagaccccggc

SEQ ID NO: 181876 - DNA, 25 bp, Homo sapien
tgtgaaacgcctagagaccccggcg

SEQ ID NO: 181877 - DNA, 25 bp, Homo sapien
gagcactgcccggatcccgtgcacc

SEQ ID NO: 181878 - DNA, 25 bp, Homo sapien
gtgcaccctgggacccagaagtgcc

SEQ ID NO: 181879 - DNA, 25 bp, Homo sapien
cgccagcacgtccagagcaacttac

SEQ ID NO: 181880 - DNA, 25 bp, Homo sapien
gtccagagcaacttaccccggccag

SEQ ID NO: 181881 - DNA, 25 bp, Homo sapien
ctgaggatgtgatcaccggagcctt

SEQ ID NO: 181882 - DNA, 25 bp, Homo sapien
atgtgatcaccggagccttcaaggt

SEQ ID NO: 181883 - DNA, 25 bp, Homo sapien
gagccttcaaggtcttggaccctga

SEQ ID NO: 181884 - DNA, 25 bp, Homo sapien
tcaaggtcttggaccctgagggaaa

SEQ ID NO: 181885 - DNA, 25 bp, Homo sapien
aaagggcaccatcaagaagaagttc

SEQ ID NO: 181886 - DNA, 25 bp, Homo sapien
agtgtgaccgcttctcccaggagga

SEQ ID NO: 181887 - DNA, 25 bp, Homo sapien
atcaagaacatgtgggcggccttcc

SEQ ID NO: 181888 - DNA, 25 bp, Homo sapien
gtgggcggcaacgtcgactacaaaa

SEQ ID NO: 181889 - DNA, 25 bp, Homo sapien
ggcggcaacgtcgactacaaaaaca

SEQ ID NO: 181890 - DNA, 25 bp, Homo sapien
aaaaacatctgctacgtcatcacgc

SEQ ID NO: 181891 - DNA, 25 bp, Homo sapien
tgctacgtcatcacgcacggcgacg

SEQ ID NO: 181892 - DNA, 25 bp, Homo sapien
ctgggccggccaatggacagtcagt

SEQ ID NO: 181893 - DNA, 25 bp, Homo sapien
ggacagtcagtggatcccgcacgca

SEQ ID NO: 181894 - DNA, 25 bp, Homo sapien
gtggatcccgcacgcacaatcgtga

SEQ ID NO: 181895 - DNA, 25 bp, Homo sapien
tcttcatcttcaccagaggaatcac

SEQ ID NO: 181896 - DNA, 25 bp, Homo sapien
cagaggaatcactcttgtggatgtt

SEQ ID NO: 181897 - DNA, 25 bp, Homo sapien
ggatgttttaattccatgaatcgct

SEQ ID NO: 181898 - DNA, 25 bp, Homo sapien
aattccatgaatcgcttctcttttg

SEQ ID NO: 181899 - DNA, 25 bp, Homo sapien
gaatcgcttctcttttgaaacaata

SEQ ID NO: 181900 - DNA, 25 bp, Homo sapien
agtgttaatactagttgtgacctta

SEQ ID NO: 181901 - DNA, 25 bp, Homo sapien
gcgttggtgcacgttatggtgtttc

SEQ ID NO: 181902 - DNA, 25 bp, Homo sapien
ggtgcacgttatggtgtttctccct

SEQ ID NO: 181903 - DNA, 25 bp, Homo sapien
cagagtccccactggcacagtggct

SEQ ID NO: 181904 - DNA, 25 bp, Homo sapien
agagtccccactggcacagtggctc

SEQ ID NO: 181905 - DNA, 25 bp, Homo sapien
ccaggcatgagggtacacacctgta

SEQ ID NO: 181906 - DNA, 25 bp, Homo sapien
caggcatgagggtacacacctgtag

SEQ ID NO: 181907 - DNA, 25 bp, Homo sapien
aggcatgagggtacacacctgtagt

SEQ ID NO: 181908 - DNA, 25 bp, Homo sapien
gcatgagggtacacacctgtagtcc

SEQ ID NO: 181909 - DNA, 25 bp, Homo sapien
ggctgcagtgagcctaggtggtgcc

SEQ ID NO: 181910 - DNA, 25 bp, Homo sapien
acagaggaggccctgtcccgagtgc

SEQ ID NO: 181911 - DNA, 25 bp, Homo sapien
cagaggaggccctgtcccgagtgcg

SEQ ID NO: 181912 - DNA, 25 bp, Homo sapien
agaggaggccctgtcccgagtgcgg

SEQ ID NO: 181913 - DNA, 25 bp, Homo sapien
gaggaggccctgtcccgagtgcggc

SEQ ID NO: 181914 - DNA, 25 bp, Homo sapien
gatgatgatatctaggcataaccta

SEQ ID NO: 181915 - DNA, 25 bp, Homo sapien
taggcataacctagcctgtgaggaa

SEQ ID NO: 181916 - DNA, 25 bp, Homo sapien
agcctgtgaggaacctagttaggaa

SEQ ID NO: 181917 - DNA, 25 bp, Homo sapien
gttaggaaagacaactgacatttat

SEQ ID NO: 181918 - DNA, 25 bp, Homo sapien
attgaatatcatgcactagtccctt

SEQ ID NO: 181919 - DNA, 25 bp, Homo sapien
actagtcccttacatatgtcatatt

SEQ ID NO: 181920 - DNA, 25 bp, Homo sapien
gggattttccatctgacttccctgg

SEQ ID NO: 181921 - DNA, 25 bp, Homo sapien
atccttgcactaccagaagattcat

SEQ ID NO: 181922 - DNA, 25 bp, Homo sapien
gattcatacacttttgagactccag

SEQ ID NO: 181923 - DNA, 25 bp, Homo sapien
agactccagtgagacgctgttttca

SEQ ID NO: 181924 - DNA, 25 bp, Homo sapien
agtgagacgctgttttcaccccttc

SEQ ID NO: 181925 - DNA, 25 bp, Homo sapien
gttgctgcaacagtatattgcatgc

SEQ ID NO: 181926 - DNA, 25 bp, Homo sapien
attgcatgctctttggcacttacat

SEQ ID NO: 181927 - DNA, 25 bp, Homo sapien
gagtgtaagcctgaaggtcttttta

SEQ ID NO: 181928 - DNA, 25 bp, Homo sapien
aggtctttttagaaggcttcctcat

SEQ ID NO: 181929 - DNA, 25 bp, Homo sapien
ttagaaggcttcctcatttggatat

SEQ ID NO: 181930 - DNA, 25 bp, Homo sapien
gttgaatattccagattgtcatcat

SEQ ID NO: 181931 - DNA, 25 bp, Homo sapien
tgtcatcatcttccatctttggatt

SEQ ID NO: 181932 - DNA, 25 bp, Homo sapien
tccatctttggatttgttaaggcaa

SEQ ID NO: 181933 - DNA, 25 bp, Homo sapien
gattagggccctacgtaataggcta

SEQ ID NO: 181934 - DNA, 25 bp, Homo sapien
taataggctaattgtactgctctta

SEQ ID NO: 181935 - DNA, 25 bp, Homo sapien
actgctcttagaatgtaagcgttca

SEQ ID NO: 181936 - DNA, 25 bp, Homo sapien
gagagactgggcttcaaggtacagc

SEQ ID NO: 181937 - DNA, 25 bp, Homo sapien
aaggtacagcctaatggcttgcccc

SEQ ID NO: 181938 - DNA, 25 bp, Homo sapien
aatggcttgccccactcaaaaccat

SEQ ID NO: 181939 - DNA, 25 bp, Homo sapien
gaaaccatcatgagagagatactct

SEQ ID NO: 181940 - DNA, 25 bp, Homo sapien
gatactctggtggagggactctagc

SEQ ID NO: 181941 - DNA, 25 bp, Homo sapien
ggactctagctaccatgcacatgta

SEQ ID NO: 181942 - DNA, 25 bp, Homo sapien
atgcacatgtacatatccacagaat

SEQ ID NO: 181943 - DNA, 25 bp, Homo sapien
gggaatggctatatacatggcttta

SEQ ID NO: 181944 - DNA, 25 bp, Homo sapien
gtctggagaaatctactccccttgg

SEQ ID NO: 181945 - DNA, 25 bp, Homo sapien
atctactccccttggccaggacatg

SEQ ID NO: 181946 - DNA, 25 bp, Homo sapien
gctgctactgctaacagccaatttt

SEQ ID NO: 181947 - DNA, 25 bp, Homo sapien
cattttactacatgatcttccaatt

SEQ ID NO: 181948 - DNA, 25 bp, Homo sapien
atgatcttccaattagatagcttgt

SEQ ID NO: 181949 - DNA, 25 bp, Homo sapien
agatagcttgtaatctgttccttac

SEQ ID NO: 181950 - DNA, 25 bp, Homo sapien
aatctgttccttacagcacttgctg

SEQ ID NO: 181951 - DNA, 25 bp, Homo sapien
gcacttgctgttgttacatgtgaag

SEQ ID NO: 181952 - DNA, 25 bp, Homo sapien
tggatgtatctattcaatttctcag

SEQ ID NO: 181953 - DNA, 25 bp, Homo sapien
aatttctcagtttatgttgggcctt

SEQ ID NO: 181954 - DNA, 25 bp, Homo sapien
ttctcagtttatgttgggccttcct

SEQ ID NO: 181955 - DNA, 25 bp, Homo sapien
gccttcctttttggaatgtacgctg

SEQ ID NO: 181956 - DNA, 25 bp, Homo sapien
tcctttttggaatgtacgctgttat

SEQ ID NO: 181957 - DNA, 25 bp, Homo sapien
gaatgtacgctgttatgctatgata

SEQ ID NO: 181958 - DNA, 25 bp, Homo sapien
tgggactggcactatttgaggttaa

SEQ ID NO: 181959 - DNA, 25 bp, Homo sapien
gacaaactgcatatgtacttcaatt

SEQ ID NO: 181960 - DNA, 25 bp, Homo sapien
aattgctttgcacttttccgtttca

SEQ ID NO: 181961 - DNA, 25 bp, Homo sapien
gcacttttccgtttcagcggaagac

SEQ ID NO: 181962 - DNA, 25 bp, Homo sapien
ggccaggtacaacacctttttcata

SEQ ID NO: 181963 - DNA, 25 bp, Homo sapien
acctttttcatacaaggcccaggag

SEQ ID NO: 181964 - DNA, 25 bp, Homo sapien
gcccaggaggcttagtccagtctgt

SEQ ID NO: 181965 - DNA, 25 bp, Homo sapien
tagtccagtctgtgctcctgggcta

SEQ ID NO: 181966 - DNA, 25 bp, Homo sapien
tacaaggacccagcctgagatggtc

SEQ ID NO: 181967 - DNA, 25 bp, Homo sapien
agcctgagatggtcccatctgcagg

SEQ ID NO: 181968 - DNA, 25 bp, Homo sapien
gggcccgcaccagttggagcagata

SEQ ID NO: 181969 - DNA, 25 bp, Homo sapien
agatacctagaatagccatgtacta

SEQ ID NO: 181970 - DNA, 25 bp, Homo sapien
gccatgtactataatgtgatgattc

SEQ ID NO: 181971 - DNA, 25 bp, Homo sapien
gtgatgattctaaatttgtacctat

SEQ ID NO: 181972 - DNA, 25 bp, Homo sapien
ctaaatttgtacctatgtgacagac

SEQ ID NO: 181973 - DNA, 25 bp, Homo sapien
gaactgctgatttgatggagctact

SEQ ID NO: 181974 - DNA, 25 bp, Homo sapien
atactgttggttgaactatgctgaa

SEQ ID NO: 181975 - DNA, 25 bp, Homo sapien
gtgagcgattagttgagcccttgcc

SEQ ID NO: 181976 - DNA, 25 bp, Homo sapien
attagttgagcccttgccgggcctt

SEQ ID NO: 181977 - DNA, 25 bp, Homo sapien
ttttttccacctgccaattctacat

SEQ ID NO: 181978 - DNA, 25 bp, Homo sapien
tccacctgccaattctacatgtatt

SEQ ID NO: 181979 - DNA, 25 bp, Homo sapien
tgcagtacacatcagcctcactgag

SEQ ID NO: 181980 - DNA, 25 bp, Homo sapien
aattggagtctaatctttcaaggag

SEQ ID NO: 181981 - DNA, 25 bp, Homo sapien
taatctttcaaggaggtgggctccc

SEQ ID NO: 181982 - DNA, 25 bp, Homo sapien
aggatggtaccattgctctttccta

SEQ ID NO: 181983 - DNA, 25 bp, Homo sapien
gctctttcctagctaaccctagata

SEQ ID NO: 181984 - DNA, 25 bp, Homo sapien
ctaaccctagatatggcagctcttt

SEQ ID NO: 181985 - DNA, 25 bp, Homo sapien
ggcagctctttaatgtacttcaaaa

SEQ ID NO: 181986 - DNA, 25 bp, Homo sapien
agttatttataattgccttgtcata

SEQ ID NO: 181987 - DNA, 25 bp, Homo sapien
taaggtgttctagagccatttgcat

SEQ ID NO: 181988 - DNA, 25 bp, Homo sapien
gttctagagccatttgcatacaatt

SEQ ID NO: 181989 - DNA, 25 bp, Homo sapien
tcattccattctattgtttacacaa

SEQ ID NO: 181990 - DNA, 25 bp, Homo sapien
gtttacacaacgattactcgaagat

SEQ ID NO: 181991 - DNA, 25 bp, Homo sapien
ataaagaaagctgggcctgtcgaag

SEQ ID NO: 181992 - DNA, 25 bp, Homo sapien
aagctgggcctgtcgaaggatgaca

SEQ ID NO: 181993 - DNA, 25 bp, Homo sapien
ggatgtgctgccaggttgctataga

SEQ ID NO: 181994 - DNA, 25 bp, Homo sapien
ggctctgcctcttgcaccttgaggg

SEQ ID NO: 181995 - DNA, 25 bp, Homo sapien
gcctcctgatttcataaccaggccg

SEQ ID NO: 181996 - DNA, 25 bp, Homo sapien
tgatttcataaccaggccggaccac

SEQ ID NO: 181997 - DNA, 25 bp, Homo sapien
aaccaggccggaccacgtgcaatag

SEQ ID NO: 181998 - DNA, 25 bp, Homo sapien
gaccacgtgcaatagggtggaaacc

SEQ ID NO: 181999 - DNA, 25 bp, Homo sapien
ggtggaaaccaaactgctccatgcc

SEQ ID NO: 182000 - DNA, 25 bp, Homo sapien
aaactgctccatgccgggttattta

SEQ ID NO: 182001 - DNA, 25 bp, Homo sapien
gctccatgccgggttatttaaaaga

SEQ ID NO: 182002 - DNA, 25 bp, Homo sapien
cctgaactccctgtatatctgtata

SEQ ID NO: 182003 - DNA, 25 bp, Homo sapien
aaataacgggattttcatggcgccg

SEQ ID NO: 182004 - DNA, 25 bp, Homo sapien
taacgggattttcatggcgccgccc

SEQ ID NO: 182005 - DNA, 25 bp, Homo sapien
ccacccgcattatcactgtgtgatg

SEQ ID NO: 182006 - DNA, 25 bp, Homo sapien
tatcactgtgtgatggtctcagtca

SEQ ID NO: 182007 - DNA, 25 bp, Homo sapien
actgtgtgatggtctcagtcagtct

SEQ ID NO: 182008 - DNA, 25 bp, Homo sapien
tgtctccactctttccctctattta

SEQ ID NO: 182009 - DNA, 25 bp, Homo sapien
ccctctatttatttcactctcttgt

SEQ ID NO: 182010 - DNA, 25 bp, Homo sapien
cactctcttgtttggttctaccctg

SEQ ID NO: 182011 - DNA, 25 bp, Homo sapien
ttgtttggttctaccctgcaccctc

SEQ ID NO: 182012 - DNA, 25 bp, Homo sapien
tccaggttcctgtttataagcccca

SEQ ID NO: 182013 - DNA, 25 bp, Homo sapien
tcctcctggctatgttctgcagcct

SEQ ID NO: 182014 - DNA, 25 bp, Homo sapien
gttgttcaccttgtaccagtggtta

SEQ ID NO: 182015 - DNA, 25 bp, Homo sapien
cagtggttatttgagtttgttccta

SEQ ID NO: 182016 - DNA, 25 bp, Homo sapien
ttgttcctattacaccaatccttac

SEQ ID NO: 182017 - DNA, 25 bp, Homo sapien
caatccttacttgaggtggttcgga

SEQ ID NO: 182018 - DNA, 25 bp, Homo sapien
gaggtggttcggattacagtttcca

SEQ ID NO: 182019 - DNA, 25 bp, Homo sapien
ggattacagtttccaaatgcattct

SEQ ID NO: 182020 - DNA, 25 bp, Homo sapien
tgggattgcctattccagagagggt

SEQ ID NO: 182021 - DNA, 25 bp, Homo sapien
gcctattccagagagggtacagaaa

SEQ ID NO: 182022 - DNA, 25 bp, Homo sapien
agcacacagatggcttgtctcagga

SEQ ID NO: 182023 - DNA, 25 bp, Homo sapien
agtgttgaatgtgtgccccgctgct

SEQ ID NO: 182024 - DNA, 25 bp, Homo sapien
taatgtctgatattggaagcgtttg

SEQ ID NO: 182025 - DNA, 25 bp, Homo sapien
tgttgtgaccagacatttgccttag

SEQ ID NO: 182026 - DNA, 25 bp, Homo sapien
gacatttgccttaggaacttaactc

SEQ ID NO: 182027 - DNA, 25 bp, Homo sapien
aagttgcagttcctaagaacctatt

SEQ ID NO: 182028 - DNA, 25 bp, Homo sapien
gttcctaagaacctattgatgatgt

SEQ ID NO: 182029 - DNA, 25 bp, Homo sapien
gttcagtgcagacttactgtacctt

SEQ ID NO: 182030 - DNA, 25 bp, Homo sapien
gcagacttactgtacctttgggaat

SEQ ID NO: 182031 - DNA, 25 bp, Homo sapien
gaatttaggctggagagacgtccat

SEQ ID NO: 182032 - DNA, 25 bp, Homo sapien
gagagacgtccatagccttaggtat

SEQ ID NO: 182033 - DNA, 25 bp, Homo sapien
catagccttaggtatatcatttata

SEQ ID NO: 182034 - DNA, 25 bp, Homo sapien
catttataccagacattatgaagtt

SEQ ID NO: 182035 - DNA, 25 bp, Homo sapien
tgtactgtacatttgccatataatt

SEQ ID NO: 182036 - DNA, 25 bp, Homo sapien
gtttcaaatttcaggttactgctgc

SEQ ID NO: 182037 - DNA, 25 bp, Homo sapien
tcaggttactgctgcgattgatgta

SEQ ID NO: 182038 - DNA, 25 bp, Homo sapien
ctgcgattgatgtagtggagatgcc

SEQ ID NO: 182039 - DNA, 25 bp, Homo sapien
ggagatgcctgaacacaattctata

SEQ ID NO: 182040 - DNA, 25 bp, Homo sapien
ttgtactgtattttccttgcaaata

SEQ ID NO: 182041 - DNA, 25 bp, Homo sapien
atttactttgtgttctactgagtaa

SEQ ID NO: 182042 - DNA, 25 bp, Homo sapien
gtaagatgacttgttgactgtgaaa

SEQ ID NO: 182043 - DNA, 25 bp, Homo sapien
aattttcttgctgtgtcgaacaatc

SEQ ID NO: 182044 - DNA, 25 bp, Homo sapien
gtgtcgaacaatcaggactgcattc

SEQ ID NO: 182045 - DNA, 25 bp, Homo sapien
atcaggactgcattcatatgagatc

SEQ ID NO: 182046 - DNA, 25 bp, Homo sapien
cctcccctctgcactttgtttactt

SEQ ID NO: 182047 - DNA, 25 bp, Homo sapien
tgtttacttgttttgcacagacgtg

SEQ ID NO: 182048 - DNA, 25 bp, Homo sapien
gtttacttgttttgcacagacgtgg

SEQ ID NO: 182049 - DNA, 25 bp, Homo sapien
tttacttgttttgcacagacgtggg

SEQ ID NO: 182050 - DNA, 25 bp, Homo sapien
tacttgttttgcacagacgtgggcc

SEQ ID NO: 182051 - DNA, 25 bp, Homo sapien
acttgttttgcacagacgtgggcct

SEQ ID NO: 182052 - DNA, 25 bp, Homo sapien
ttgttttgcacagacgtgggcctgg

SEQ ID NO: 182053 - DNA, 25 bp, Homo sapien
tctcagcagccgccttctagttggg

SEQ ID NO: 182054 - DNA, 25 bp, Homo sapien
gggctagtcgctgatctgccggctc

SEQ ID NO: 182055 - DNA, 25 bp, Homo sapien
ggctagtcgctgatctgccggctcc

SEQ ID NO: 182056 - DNA, 25 bp, Homo sapien
actaggggagccgaattctacaatc

SEQ ID NO: 182057 - DNA, 25 bp, Homo sapien
acttagtgcgtaagagacgagttga

SEQ ID NO: 182058 - DNA, 25 bp, Homo sapien
gacgagttgaaggagatcaccagta

SEQ ID NO: 182059 - DNA, 25 bp, Homo sapien
tgaaggagatcaccagtaagtctgc

SEQ ID NO: 182060 - DNA, 25 bp, Homo sapien
ggagatcaccagtaagtctgcaaag

SEQ ID NO: 182061 - DNA, 25 bp, Homo sapien
ccagtaagtctgcaaaggtgtaatc

SEQ ID NO: 182062 - DNA, 25 bp, Homo sapien
gtaagtctgcaaaggtgtaatcttt

SEQ ID NO: 182063 - DNA, 25 bp, Homo sapien
gcaaaggtgtaatctttggaagact

SEQ ID NO: 182064 - DNA, 25 bp, Homo sapien
gaagatcaccaagggctcatgttgg

SEQ ID NO: 182065 - DNA, 25 bp, Homo sapien
caagggctcatgttggtgacatcat

SEQ ID NO: 182066 - DNA, 25 bp, Homo sapien
ggctcatgttggtgacatcatgtaa

SEQ ID NO: 182067 - DNA, 25 bp, Homo sapien
catgtaaaattttcctgggtagaag

SEQ ID NO: 182068 - DNA, 25 bp, Homo sapien
tgccagttatgtggctgccaagccc

SEQ ID NO: 182069 - DNA, 25 bp, Homo sapien
tacaggctgtcatggtggctcttgc

SEQ ID NO: 182070 - DNA, 25 bp, Homo sapien
ttcctgagctgacctgacctcactg

SEQ ID NO: 182071 - DNA, 25 bp, Homo sapien
ccacctcttgcattgggatcctgag

SEQ ID NO: 182072 - DNA, 25 bp, Homo sapien
gtgaaggagcttaagcttggcttct

SEQ ID NO: 182073 - DNA, 25 bp, Homo sapien
gagcttaagcttggcttcttggcaa

SEQ ID NO: 182074 - DNA, 25 bp, Homo sapien
ttaagcttggcttcttggcaattca

SEQ ID NO: 182075 - DNA, 25 bp, Homo sapien
tggaagcgtcccctatgggtcttcc

SEQ ID NO: 182076 - DNA, 25 bp, Homo sapien
atgggtcttcctgcttgtggcttgg

SEQ ID NO: 182077 - DNA, 25 bp, Homo sapien
gttccggcttcaggatctctcttaa

SEQ ID NO: 182078 - DNA, 25 bp, Homo sapien
ccggcttcaggatctctcttaactg

SEQ ID NO: 182079 - DNA, 25 bp, Homo sapien
acacatacatacattgacccacagg

SEQ ID NO: 182080 - DNA, 25 bp, Homo sapien
catacattgacccacaggacattgt

SEQ ID NO: 182081 - DNA, 25 bp, Homo sapien
cattgacccacaggacattgtaaaa

SEQ ID NO: 182082 - DNA, 25 bp, Homo sapien
attatcacatgacatcttaagtaga

SEQ ID NO: 182083 - DNA, 25 bp, Homo sapien
aattattacaagttgctcctgcccc

SEQ ID NO: 182084 - DNA, 25 bp, Homo sapien
ccctccctgaactattttgtgctgt

SEQ ID NO: 182085 - DNA, 25 bp, Homo sapien
tccctgaactattttgtgctgtgta

SEQ ID NO: 182086 - DNA, 25 bp, Homo sapien
tgctgtgtatatcactgctttatat

SEQ ID NO: 182087 - DNA, 25 bp, Homo sapien
aggtgaactcagatgttatggtttt

SEQ ID NO: 182088 - DNA, 25 bp, Homo sapien
cagatgttatggttttgtatatgtc

SEQ ID NO: 182089 - DNA, 25 bp, Homo sapien
gtatatgtctgcaatcatggatagg

SEQ ID NO: 182090 - DNA, 25 bp, Homo sapien
agcagcaacttggtggtgtactact

SEQ ID NO: 182091 - DNA, 25 bp, Homo sapien
ggtgtactactggaactaatgactg

SEQ ID NO: 182092 - DNA, 25 bp, Homo sapien
atgactgcaaagtgttaaacgactg

SEQ ID NO: 182093 - DNA, 25 bp, Homo sapien
tacaaacagtctcttagttactcat

SEQ ID NO: 182094 - DNA, 25 bp, Homo sapien
tagttactcatttccatcttctctt

SEQ ID NO: 182095 - DNA, 25 bp, Homo sapien
aactttcacatcagtcttccggaat

SEQ ID NO: 182096 - DNA, 25 bp, Homo sapien
agtcttccggaatcaagatcaacat

SEQ ID NO: 182097 - DNA, 25 bp, Homo sapien
acatatcaggtggtcattgcctttc

SEQ ID NO: 182098 - DNA, 25 bp, Homo sapien
attgcctttctccattgtctagtag

SEQ ID NO: 182099 - DNA, 25 bp, Homo sapien
gtagacatgtctaaagttcaaactt

SEQ ID NO: 182100 - DNA, 25 bp, Homo sapien
atagattatctgtcacttgtggttg

SEQ ID NO: 182101 - DNA, 25 bp, Homo sapien
ttcaggaacaggaacgccttctcaa

SEQ ID NO: 182102 - DNA, 25 bp, Homo sapien
aacgccttctcaaggagggattcga

SEQ ID NO: 182103 - DNA, 25 bp, Homo sapien
gacatatgggatatccagatgagaa

SEQ ID NO: 182104 - DNA, 25 bp, Homo sapien
tgagaagcaaatcattggagccaat

SEQ ID NO: 182105 - DNA, 25 bp, Homo sapien
cattggagccaatatgtaacatact

SEQ ID NO: 182106 - DNA, 25 bp, Homo sapien
gtaacatactctaaaagtccaagga

SEQ ID NO: 182107 - DNA, 25 bp, Homo sapien
ggagcaaaatttgcctgtccagctc

SEQ ID NO: 182108 - DNA, 25 bp, Homo sapien
ctctccccaagaaacaacatgaatg

SEQ ID NO: 182109 - DNA, 25 bp, Homo sapien
gaatgagcaacttcagagtgtcaaa

SEQ ID NO: 182110 - DNA, 25 bp, Homo sapien
gtgtcaaacaactgccattaaactt

SEQ ID NO: 182111 - DNA, 25 bp, Homo sapien
gcatgcatttttgttgaaccataaa

SEQ ID NO: 182112 - DNA, 25 bp, Homo sapien
tgccctttgaggatggcaaacaatt

SEQ ID NO: 182113 - DNA, 25 bp, Homo sapien
tgagctgtgcatctacgtacattac

SEQ ID NO: 182114 - DNA, 25 bp, Homo sapien
gtgcatctacgtacattacaatgag

SEQ ID NO: 182115 - DNA, 25 bp, Homo sapien
gagataaaggtcaatggcatacgca

SEQ ID NO: 182116 - DNA, 25 bp, Homo sapien
atggcatacgcatttacggctttgt

SEQ ID NO: 182117 - DNA, 25 bp, Homo sapien
gcatacgcatttacggctttgtcca

SEQ ID NO: 182118 - DNA, 25 bp, Homo sapien
gcatttacggctttgtccatcgaat

SEQ ID NO: 182119 - DNA, 25 bp, Homo sapien
tgtgtctgcaattgagggagatgat

SEQ ID NO: 182120 - DNA, 25 bp, Homo sapien
acagaataatccctgctcacatttt

SEQ ID NO: 182121 - DNA, 25 bp, Homo sapien
agaataatccctgctcacattttcc

SEQ ID NO: 182122 - DNA, 25 bp, Homo sapien
tcacattttcccctacactttgtca

SEQ ID NO: 182123 - DNA, 25 bp, Homo sapien
tgccagttatgtggctgccaagccc

SEQ ID NO: 182124 - DNA, 25 bp, Homo sapien
tggtggctcttgccacacttccctt

SEQ ID NO: 182125 - DNA, 25 bp, Homo sapien
tgccacacttcccttcctgagctga

SEQ ID NO: 182126 - DNA, 25 bp, Homo sapien
ttcctgagctgacctgacctcactg

SEQ ID NO: 182127 - DNA, 25 bp, Homo sapien
tcctgagctgacctgacctcactgc

SEQ ID NO: 182128 - DNA, 25 bp, Homo sapien
tgagctgacctgacctcactgccac

SEQ ID NO: 182129 - DNA, 25 bp, Homo sapien
tgacctgacctcactgccacctctt

SEQ ID NO: 182130 - DNA, 25 bp, Homo sapien
ccacctcttgcattgggatcctgag

SEQ ID NO: 182131 - DNA, 25 bp, Homo sapien
cacctcttgcattgggatcctgagg

SEQ ID NO: 182132 - DNA, 25 bp, Homo sapien
acctcttgcattgggatcctgaggg

SEQ ID NO: 182133 - DNA, 25 bp, Homo sapien
tgggatcctgagggctggcccctgc

SEQ ID NO: 182134 - DNA, 25 bp, Homo sapien
gaaaagtctgcaatgatcgaaatca

SEQ ID NO: 182135 - DNA, 25 bp, Homo sapien
actataattttaaccctgtgattgg

SEQ ID NO: 182136 - DNA, 25 bp, Homo sapien
gaatgaatatggtttgtgctggaag

SEQ ID NO: 182137 - DNA, 25 bp, Homo sapien
gactcgtgcaatggagattctggaa

SEQ ID NO: 182138 - DNA, 25 bp, Homo sapien
aagccctttgttgtgcgagggtgtt

SEQ ID NO: 182139 - DNA, 25 bp, Homo sapien
tttgttgtgcgagggtgttttccga

SEQ ID NO: 182140 - DNA, 25 bp, Homo sapien
ataaatgcggagaccctcgtgggcc

SEQ ID NO: 182141 - DNA, 25 bp, Homo sapien
cgtgggcctggtgtctatattcttc

SEQ ID NO: 182142 - DNA, 25 bp, Homo sapien
gaaacacctcaactggataattatg

SEQ ID NO: 182143 - DNA, 25 bp, Homo sapien
taattatgactatcaagggagcagt

SEQ ID NO: 182144 - DNA, 25 bp, Homo sapien
tcaagggagcagtttaaataaccgt

SEQ ID NO: 182145 - DNA, 25 bp, Homo sapien
gggaccatcttcttattccctcttt

SEQ ID NO: 182146 - DNA, 25 bp, Homo sapien
tcttcttattccctcttttctcatt

SEQ ID NO: 182147 - DNA, 25 bp, Homo sapien
tcttttctcattcctccaacttcct

SEQ ID NO: 182148 - DNA, 25 bp, Homo sapien
ttttttgtaaagttgatgccttact

SEQ ID NO: 182149 - DNA, 25 bp, Homo sapien
gttgatgccttactttttggataaa

SEQ ID NO: 182150 - DNA, 25 bp, Homo sapien
gatgccttactttttggataaatat

SEQ ID NO: 182151 - DNA, 25 bp, Homo sapien
ttttgaagctggtatttctatttct

SEQ ID NO: 182152 - DNA, 25 bp, Homo sapien
gggatggagttagaaccttaatgat

SEQ ID NO: 182153 - DNA, 25 bp, Homo sapien
gaaccttaatgataatttctttcgt

SEQ ID NO: 182154 - DNA, 25 bp, Homo sapien
ttcgtttggtgtaggttttagagat

SEQ ID NO: 182155 - DNA, 25 bp, Homo sapien
gtaggttttagagatttgttttgtg

SEQ ID NO: 182156 - DNA, 25 bp, Homo sapien
tatggtgaagcagtttcttcggcac

SEQ ID NO: 182157 - DNA, 25 bp, Homo sapien
ttcttcggcaccttcgacgataaag

SEQ ID NO: 182158 - DNA, 25 bp, Homo sapien
aaatactcggcaactgcgctagacg

SEQ ID NO: 182159 - DNA, 25 bp, Homo sapien
gctagacgcgcagttaaattgcctt

SEQ ID NO: 182160 - DNA, 25 bp, Homo sapien
aaattgcctttatcgtcgtcaacac

SEQ ID NO: 182161 - DNA, 25 bp, Homo sapien
aacaccgcggccatatagcttacca

SEQ ID NO: 182162 - DNA, 25 bp, Homo sapien
gtgctgacaatgtccaaggcgccgt

SEQ ID NO: 182163 - DNA, 25 bp, Homo sapien
aaggcgccgtcgtccacaggtcaag

SEQ ID NO: 182164 - DNA, 25 bp, Homo sapien
gcgggttggacatcatagtggttat

SEQ ID NO: 182165 - DNA, 25 bp, Homo sapien
atcacaagggtcttggcatcgggtt

SEQ ID NO: 182166 - DNA, 25 bp, Homo sapien
gcatcgggttggtcactggtgaatt

SEQ ID NO: 182167 - DNA, 25 bp, Homo sapien
ggcgcggcgagatccagcatcgcat

SEQ ID NO: 182168 - DNA, 25 bp, Homo sapien
gagatccagcatcgcatgcagcgca

SEQ ID NO: 182169 - DNA, 25 bp, Homo sapien
agcatcgcatgcagcgcaaggttct

SEQ ID NO: 182170 - DNA, 25 bp, Homo sapien
gcatgcagcgcaaggttctctaccg

SEQ ID NO: 182171 - DNA, 25 bp, Homo sapien
caaggttctctaccgcctcaagtga

SEQ ID NO: 182172 - DNA, 25 bp, Homo sapien
tctctaccgcctcaagtgagtcgcg

SEQ ID NO: 182173 - DNA, 25 bp, Homo sapien
ctgcctgccattgacaatgttgctg

SEQ ID NO: 182174 - DNA, 25 bp, Homo sapien
attgacaatgttgctgggacctctg

SEQ ID NO: 182175 - DNA, 25 bp, Homo sapien
gacaatgttgctgggacctctgcct

SEQ ID NO: 182176 - DNA, 25 bp, Homo sapien
gaaggagctgtagtgtcctgctgcc

SEQ ID NO: 182177 - DNA, 25 bp, Homo sapien
tctgggaagtgtgcttttggcatcc

SEQ ID NO: 182178 - DNA, 25 bp, Homo sapien
gtaattagcacatttatcacctcaa

SEQ ID NO: 182179 - DNA, 25 bp, Homo sapien
tttatcacctcaattatctcttttt

SEQ ID NO: 182180 - DNA, 25 bp, Homo sapien
ttaaaaattcattgttccagcagtt

SEQ ID NO: 182181 - DNA, 25 bp, Homo sapien
aaattgttgtcgatgatagtcacct

SEQ ID NO: 182182 - DNA, 25 bp, Homo sapien
gatagtcacctttagtgctgcagaa

SEQ ID NO: 182183 - DNA, 25 bp, Homo sapien
agtcacctttagtgctgcagaacag

SEQ ID NO: 182184 - DNA, 25 bp, Homo sapien
gaacagcagaacttcttcctcttat

SEQ ID NO: 182185 - DNA, 25 bp, Homo sapien
tcttcctcttatctacctgtacttt

SEQ ID NO: 182186 - DNA, 25 bp, Homo sapien
tatctacctgtacttttgcatccat

SEQ ID NO: 182187 - DNA, 25 bp, Homo sapien
gtacttttgcatccattagccaacc

SEQ ID NO: 182188 - DNA, 25 bp, Homo sapien
tttgcatccattagccaacctttgg

SEQ ID NO: 182189 - DNA, 25 bp, Homo sapien
agggtccatcccgtcttcaggatca

SEQ ID NO: 182190 - DNA, 25 bp, Homo sapien
cgtcttcaggatcatctacactgca

SEQ ID NO: 182191 - DNA, 25 bp, Homo sapien
caggatcatctacactgcactaggg

SEQ ID NO: 182192 - DNA, 25 bp, Homo sapien
tgaggacaggagaccctaaggcccc

SEQ ID NO: 182193 - DNA, 25 bp, Homo sapien
gttgtgcaggcaaggagaccaaaga

SEQ ID NO: 182194 - DNA, 25 bp, Homo sapien
agaccaaagattgatgagaagaccc

SEQ ID NO: 182195 - DNA, 25 bp, Homo sapien
tgggtacccggcaggccagtgccct

SEQ ID NO: 182196 - DNA, 25 bp, Homo sapien
agtgccctcacagttgacttggacc

SEQ ID NO: 182197 - DNA, 25 bp, Homo sapien
acagttgacttggaccagggtggct

SEQ ID NO: 182198 - DNA, 25 bp, Homo sapien
ccagggtggctgtgaagggaagtct

SEQ ID NO: 182199 - DNA, 25 bp, Homo sapien
aagggaagtctttgttgcaaaggag

SEQ ID NO: 182200 - DNA, 25 bp, Homo sapien
atataatgagtgtagaaaacccttt

SEQ ID NO: 182201 - DNA, 25 bp, Homo sapien
tagaaaaccctttatcaataagtca

SEQ ID NO: 182202 - DNA, 25 bp, Homo sapien
tcaataagtcaaacctcaggataca

SEQ ID NO: 182203 - DNA, 25 bp, Homo sapien
gtttcaccaaaagtcgttcctcact

SEQ ID NO: 182204 - DNA, 25 bp, Homo sapien
aaaagtcgttcctcactgtccatca

SEQ ID NO: 182205 - DNA, 25 bp, Homo sapien
tcgttcctcactgtccatcaaagga

SEQ ID NO: 182206 - DNA, 25 bp, Homo sapien
tcaaaggactcacaggcggaaaaaa

SEQ ID NO: 182207 - DNA, 25 bp, Homo sapien
gggaaaacctttcactgtaagtcat

SEQ ID NO: 182208 - DNA, 25 bp, Homo sapien
tcactgtaagtcattcctcactgtc

SEQ ID NO: 182209 - DNA, 25 bp, Homo sapien
tcattcctcactgtccatcagaaaa

SEQ ID NO: 182210 - DNA, 25 bp, Homo sapien
ggaaaaacatatagccacaagtcat

SEQ ID NO: 182211 - DNA, 25 bp, Homo sapien
gacaacttgactctgctgattcttt

SEQ ID NO: 182212 - DNA, 25 bp, Homo sapien
atactattaactgggacttcctaat

SEQ ID NO: 182213 - DNA, 25 bp, Homo sapien
tgggacttcctaatatatacttcta

SEQ ID NO: 182214 - DNA, 25 bp, Homo sapien
ggaaaggaaattccaggcccatgga

SEQ ID NO: 182215 - DNA, 25 bp, Homo sapien
ccaggcccatggaaacttggatatg

SEQ ID NO: 182216 - DNA, 25 bp, Homo sapien
tcttcactaaaggtcatgtacaggt

SEQ ID NO: 182217 - DNA, 25 bp, Homo sapien
caggtttttatacttcccagctatt

SEQ ID NO: 182218 - DNA, 25 bp, Homo sapien
acttcccagctattccatctgtgga

SEQ ID NO: 182219 - DNA, 25 bp, Homo sapien
gtaaacaatgttggccacgtatatt

SEQ ID NO: 182220 - DNA, 25 bp, Homo sapien
ggccacgtatattttacacctcgaa

SEQ ID NO: 182221 - DNA, 25 bp, Homo sapien
aaaaatgtgaatactgctccaaaaa

SEQ ID NO: 182222 - DNA, 25 bp, Homo sapien
agatattacacctagtctgtggctt

SEQ ID NO: 182223 - DNA, 25 bp, Homo sapien
tctgtggcttgactgttttctttat

SEQ ID NO: 182224 - DNA, 25 bp, Homo sapien
tggcttgactgttttctttatgtct

SEQ ID NO: 182225 - DNA, 25 bp, Homo sapien
tgatattttttctctccaatttaac

SEQ ID NO: 182226 - DNA, 25 bp, Homo sapien
ccaatttaaccccaagatttcagat

SEQ ID NO: 182227 - DNA, 25 bp, Homo sapien
aaccccaagatttcagatattctgc

SEQ ID NO: 182228 - DNA, 25 bp, Homo sapien
gatattctgctctattatataaact

SEQ ID NO: 182229 - DNA, 25 bp, Homo sapien
atatttgtgatctaccttgaattga

SEQ ID NO: 182230 - DNA, 25 bp, Homo sapien
gaattatggatcagggttctttttt

SEQ ID NO: 182231 - DNA, 25 bp, Homo sapien
tttttcccccatacaagtatccagt

SEQ ID NO: 182232 - DNA, 25 bp, Homo sapien
gtatccagtcattgtaacactgttt

SEQ ID NO: 182233 - DNA, 25 bp, Homo sapien
gaagagctttagacatgcttctagt

SEQ ID NO: 182234 - DNA, 25 bp, Homo sapien
gagctttagacatgcttctagtatt

SEQ ID NO: 182235 - DNA, 25 bp, Homo sapien
gctttagacatgcttctagtatttt

SEQ ID NO: 182236 - DNA, 25 bp, Homo sapien
gacatgcttctagtattttgaatca

SEQ ID NO: 182237 - DNA, 25 bp, Homo sapien
ctccactgccaaagaaagccattga

SEQ ID NO: 182238 - DNA, 25 bp, Homo sapien
cactgccaaagaaagccattgaaat

SEQ ID NO: 182239 - DNA, 25 bp, Homo sapien
gaaagccattgaaatgtgaagactg

SEQ ID NO: 182240 - DNA, 25 bp, Homo sapien
aagaggcttgtatgccggtcatact

SEQ ID NO: 182241 - DNA, 25 bp, Homo sapien
agaggcttgtatgccggtcatactg

SEQ ID NO: 182242 - DNA, 25 bp, Homo sapien
ggcttgtatgccggtcatactgtaa

SEQ ID NO: 182243 - DNA, 25 bp, Homo sapien
ggagtgtgaaatttgatacatgtat

SEQ ID NO: 182244 - DNA, 25 bp, Homo sapien
tattaagctcttggttaaatgtttt

SEQ ID NO: 182245 - DNA, 25 bp, Homo sapien
tggttaaatgtttttcagccattga

SEQ ID NO: 182246 - DNA, 25 bp, Homo sapien
aaaatgttatgaaaaagccttgaat

SEQ ID NO: 182247 - DNA, 25 bp, Homo sapien
agccttgaatatgcatgctgctttc

SEQ ID NO: 182248 - DNA, 25 bp, Homo sapien
gaatatgcatgctgctttcattttt

SEQ ID NO: 182249 - DNA, 25 bp, Homo sapien
ctatagctttattagtaattccaaa

SEQ ID NO: 182250 - DNA, 25 bp, Homo sapien
ttagtaattccaaaatgctgcaatg

SEQ ID NO: 182251 - DNA, 25 bp, Homo sapien
gaagctgatttcctcactcaaacag

SEQ ID NO: 182252 - DNA, 25 bp, Homo sapien
gggtggcttttttcaaactactgct

SEQ ID NO: 182253 - DNA, 25 bp, Homo sapien
aagcaatgtaaagcccgtaatgcac

SEQ ID NO: 182254 - DNA, 25 bp, Homo sapien
tgtaaagcccgtaatgcactaagct

SEQ ID NO: 182255 - DNA, 25 bp, Homo sapien
gctgtagatggcttattttgcattc

SEQ ID NO: 182256 - DNA, 25 bp, Homo sapien
actatgttgcaagtctgtttcatct

SEQ ID NO: 182257 - DNA, 25 bp, Homo sapien
aattattgcttaatcaaactgccgt

SEQ ID NO: 182258 - DNA, 25 bp, Homo sapien
tattgcttaatcaaactgccgtttg

SEQ ID NO: 182259 - DNA, 25 bp, Homo sapien
gcttaatcaaactgccgtttgtctt

SEQ ID NO: 182260 - DNA, 25 bp, Homo sapien
caaactgccgtttgtcttttatatt

SEQ ID NO: 182261 - DNA, 25 bp, Homo sapien
cccttccttatgagttctaacttag

SEQ ID NO: 182262 - DNA, 25 bp, Homo sapien
aacttagtaatttcaaatgtgacct

SEQ ID NO: 182263 - DNA, 25 bp, Homo sapien
aatgtgaccttttatatctaagacc

SEQ ID NO: 182264 - DNA, 25 bp, Homo sapien
gtgaccttttatatctaagaccagt

SEQ ID NO: 182265 - DNA, 25 bp, Homo sapien
tatctaagaccagtatagtaaactt

SEQ ID NO: 182266 - DNA, 25 bp, Homo sapien
tgttgggcacccagctactcaacaa

SEQ ID NO: 182267 - DNA, 25 bp, Homo sapien
ttgggcacccagctactcaacaaat

SEQ ID NO: 182268 - DNA, 25 bp, Homo sapien
tgggcacccagctactcaacaaatt

SEQ ID NO: 182269 - DNA, 25 bp, Homo sapien
gggcacccagctactcaacaaattt

SEQ ID NO: 182270 - DNA, 25 bp, Homo sapien
ggcacccagctactcaacaaatttg

SEQ ID NO: 182271 - DNA, 25 bp, Homo sapien
agtatgccgaaattcttgcagattg

SEQ ID NO: 182272 - DNA, 25 bp, Homo sapien
gtatgccgaaattcttgcagattgt

SEQ ID NO: 182273 - DNA, 25 bp, Homo sapien
atgccgaaattcttgcagattgtcc

SEQ ID NO: 182274 - DNA, 25 bp, Homo sapien
gccgaaattcttgcagattgtcccg

SEQ ID NO: 182275 - DNA, 25 bp, Homo sapien
ccgaaattcttgcagattgtcccga

SEQ ID NO: 182276 - DNA, 25 bp, Homo sapien
cgaaattcttgcagattgtcccgat

SEQ ID NO: 182277 - DNA, 25 bp, Homo sapien
tattaagctcttggttaaatgtttt

SEQ ID NO: 182278 - DNA, 25 bp, Homo sapien
aaaatgttatgaaaaagccttgaat

SEQ ID NO: 182279 - DNA, 25 bp, Homo sapien
aaaagccttgaatatgcatgctgct

SEQ ID NO: 182280 - DNA, 25 bp, Homo sapien
aaagccttgaatatgcatgctgctt

SEQ ID NO: 182281 - DNA, 25 bp, Homo sapien
agccttgaatatgcatgctgctttc

SEQ ID NO: 182282 - DNA, 25 bp, Homo sapien
gccttgaatatgcatgctgctttca

SEQ ID NO: 182283 - DNA, 25 bp, Homo sapien
ccttgaatatgcatgctgctttcat

SEQ ID NO: 182284 - DNA, 25 bp, Homo sapien
cttgaatatgcatgctgctttcatt

SEQ ID NO: 182285 - DNA, 25 bp, Homo sapien
ctatagctttattagtaattccaaa

SEQ ID NO: 182286 - DNA, 25 bp, Homo sapien
ttattagtaattccaaaatgctgca

SEQ ID NO: 182287 - DNA, 25 bp, Homo sapien
ttagtaattccaaaatgctgcaatg

SEQ ID NO: 182288 - DNA, 25 bp, Homo sapien
tgcctgcatgttctctctgttgttg

SEQ ID NO: 182289 - DNA, 25 bp, Homo sapien
tgcatgttctctctgttgttggagc

SEQ ID NO: 182290 - DNA, 25 bp, Homo sapien
gttctctctgttgttggagcctgga

SEQ ID NO: 182291 - DNA, 25 bp, Homo sapien
tctgttgttggagcctggagccttg

SEQ ID NO: 182292 - DNA, 25 bp, Homo sapien
gttgttggagcctggagccttgctc

SEQ ID NO: 182293 - DNA, 25 bp, Homo sapien
ttggagcctggagccttgctctctg

SEQ ID NO: 182294 - DNA, 25 bp, Homo sapien
agccttgctctctgggcacagaggg

SEQ ID NO: 182295 - DNA, 25 bp, Homo sapien
cccctcttccagaggaggagcaggg

SEQ ID NO: 182296 - DNA, 25 bp, Homo sapien
tctgttttgggtgtactctaggggc

SEQ ID NO: 182297 - DNA, 25 bp, Homo sapien
aaggtgagggcttcgggtggtgcta

SEQ ID NO: 182298 - DNA, 25 bp, Homo sapien
tcgggtggtgctataatgtggcact

SEQ ID NO: 182299 - DNA, 25 bp, Homo sapien
tggtcatggattagcccctcctgga

SEQ ID NO: 182300 - DNA, 25 bp, Homo sapien
ttagcccctcctggaaaatggtgtt

SEQ ID NO: 182301 - DNA, 25 bp, Homo sapien
tggtgttgggtttggtctccagctc

SEQ ID NO: 182302 - DNA, 25 bp, Homo sapien
gggtttggtctccagctccaatact

SEQ ID NO: 182303 - DNA, 25 bp, Homo sapien
aatacttattaaggctgttgctgcc

SEQ ID NO: 182304 - DNA, 25 bp, Homo sapien
gccagtcaaggccacccaggagtct

SEQ ID NO: 182305 - DNA, 25 bp, Homo sapien
cagcccaacccgagcttttggacag

SEQ ID NO: 182306 - DNA, 25 bp, Homo sapien
aacccgagcttttggacagctctcc

SEQ ID NO: 182307 - DNA, 25 bp, Homo sapien
gacagctctccagaagcatgaactg

SEQ ID NO: 182308 - DNA, 25 bp, Homo sapien
cagaagcatgaactgcagtggagat

SEQ ID NO: 182309 - DNA, 25 bp, Homo sapien
ctggctctgtgctgtgcacataggt

SEQ ID NO: 182310 - DNA, 25 bp, Homo sapien
gatgcacccatgtcccaggtgtatg

SEQ ID NO: 182311 - DNA, 25 bp, Homo sapien
gcacccatgtcccaggtgtatggag

SEQ ID NO: 182312 - DNA, 25 bp, Homo sapien
gagaagagccttgctttattactca

SEQ ID NO: 182313 - DNA, 25 bp, Homo sapien
gaagagccttgctttattactcaat

SEQ ID NO: 182314 - DNA, 25 bp, Homo sapien
gagccttgctttattactcaattat

SEQ ID NO: 182315 - DNA, 25 bp, Homo sapien
gctttattactcaattatcttcacg

SEQ ID NO: 182316 - DNA, 25 bp, Homo sapien
actcaattatcttcacgatttccta

SEQ ID NO: 182317 - DNA, 25 bp, Homo sapien
aattatcttcacgatttcctaaagt

SEQ ID NO: 182318 - DNA, 25 bp, Homo sapien
ttcacgatttcctaaagtacctggc

SEQ ID NO: 182319 - DNA, 25 bp, Homo sapien
cgatttcctaaagtacctggcaaag

SEQ ID NO: 182320 - DNA, 25 bp, Homo sapien
agtgccagcgattatgaagtggctc

SEQ ID NO: 182321 - DNA, 25 bp, Homo sapien
ggattaacttctgtctttctggtga

SEQ ID NO: 182322 - DNA, 25 bp, Homo sapien
taacttctgtctttctggtgaacaa

SEQ ID NO: 182323 - DNA, 25 bp, Homo sapien
ttctgtctttctggtgaacaatata

SEQ ID NO: 182324 - DNA, 25 bp, Homo sapien
gaacaatatagcaattcacgcattc

SEQ ID NO: 182325 - DNA, 25 bp, Homo sapien
agcaattcacgcattcttcaagcag

SEQ ID NO: 182326 - DNA, 25 bp, Homo sapien
attcacgcattcttcaagcagcaaa

SEQ ID NO: 182327 - DNA, 25 bp, Homo sapien
tcaagcagcaaaagttcccggaaca

SEQ ID NO: 182328 - DNA, 25 bp, Homo sapien
gaacaattagggaagacgtatggtc

SEQ ID NO: 182329 - DNA, 25 bp, Homo sapien
acgtatggtctgaatttatccaggc

SEQ ID NO: 182330 - DNA, 25 bp, Homo sapien
tgaatttatccaggcagtgggtctg

SEQ ID NO: 182331 - DNA, 25 bp, Homo sapien
gaaatttatatcagtgtctgggctc

SEQ ID NO: 182332 - DNA, 25 bp, Homo sapien
gtgaaggagcttaagcttggcttct

SEQ ID NO: 182333 - DNA, 25 bp, Homo sapien
aggagcttaagcttggcttcttggc

SEQ ID NO: 182334 - DNA, 25 bp, Homo sapien
gagcttaagcttggcttcttggcaa

SEQ ID NO: 182335 - DNA, 25 bp, Homo sapien
ttaagcttggcttcttggcaattca

SEQ ID NO: 182336 - DNA, 25 bp, Homo sapien
tggaagcgtcccctatgggtcttcc

SEQ ID NO: 182337 - DNA, 25 bp, Homo sapien
gaagcgtcccctatgggtcttcctg

SEQ ID NO: 182338 - DNA, 25 bp, Homo sapien
ctatgggtcttcctgcttgtggctt

SEQ ID NO: 182339 - DNA, 25 bp, Homo sapien
atgggtcttcctgcttgtggcttgg

SEQ ID NO: 182340 - DNA, 25 bp, Homo sapien
ggcgttccggcttcaggatctctct

SEQ ID NO: 182341 - DNA, 25 bp, Homo sapien
gttccggcttcaggatctctcttaa

SEQ ID NO: 182342 - DNA, 25 bp, Homo sapien
ccggcttcaggatctctcttaactg

SEQ ID NO: 182343 - DNA, 25 bp, Homo sapien
acttgttccgttggtcaagttattg

SEQ ID NO: 182344 - DNA, 25 bp, Homo sapien
gttccgttggtcaagttattggatc

SEQ ID NO: 182345 - DNA, 25 bp, Homo sapien
cgttggtcaagttattggatcaatt

SEQ ID NO: 182346 - DNA, 25 bp, Homo sapien
gatcaattgagtatagtagttcgct

SEQ ID NO: 182347 - DNA, 25 bp, Homo sapien
attgagtatagtagttcgctttgac

SEQ ID NO: 182348 - DNA, 25 bp, Homo sapien
atagtagttcgctttgactggtgaa

SEQ ID NO: 182349 - DNA, 25 bp, Homo sapien
tagttcgctttgactggtgaagtct

SEQ ID NO: 182350 - DNA, 25 bp, Homo sapien
atgtactgctcggaggttgggttct

SEQ ID NO: 182351 - DNA, 25 bp, Homo sapien
actgctcggaggttgggttctgctc

SEQ ID NO: 182352 - DNA, 25 bp, Homo sapien
ttgggttctgctccgaggtcgcccc

SEQ ID NO: 182353 - DNA, 25 bp, Homo sapien
taatgcaggtttggtagtttaggac

SEQ ID NO: 182354 - DNA, 25 bp, Homo sapien
tcttctctctcctttggcgtttgtt

SEQ ID NO: 182355 - DNA, 25 bp, Homo sapien
ctttggcgtttgttcctgtagtcac

SEQ ID NO: 182356 - DNA, 25 bp, Homo sapien
ttcctgtagtcactgggctaatctc

SEQ ID NO: 182357 - DNA, 25 bp, Homo sapien
cccttagaagcctgcgtgtgcatag

SEQ ID NO: 182358 - DNA, 25 bp, Homo sapien
gaagcctgcgtgtgcatagagcgcc

SEQ ID NO: 182359 - DNA, 25 bp, Homo sapien
cagttcttctccctgagcttggtat

SEQ ID NO: 182360 - DNA, 25 bp, Homo sapien
ttctccctgagcttggtatttgtca

SEQ ID NO: 182361 - DNA, 25 bp, Homo sapien
ggtatttgtcatgtgccaactctga

SEQ ID NO: 182362 - DNA, 25 bp, Homo sapien
atgtgccaactctgactctgaggtg

SEQ ID NO: 182363 - DNA, 25 bp, Homo sapien
gcttgcttcctgtccccgaaatgtt

SEQ ID NO: 182364 - DNA, 25 bp, Homo sapien
cgaaatgttcgtttcttctgaagta

SEQ ID NO: 182365 - DNA, 25 bp, Homo sapien
aaagcacggagaatttatccatcag

SEQ ID NO: 182366 - DNA, 25 bp, Homo sapien
ggagaatttatccatcagattttgc

SEQ ID NO: 182367 - DNA, 25 bp, Homo sapien
aaatgacttccagtgatgttgtagc

SEQ ID NO: 182368 - DNA, 25 bp, Homo sapien
cagtgatgttgtagctggatccgat

SEQ ID NO: 182369 - DNA, 25 bp, Homo sapien
tccaaccctgccacatgttcatata

SEQ ID NO: 182370 - DNA, 25 bp, Homo sapien
aaccctgccacatgttcatatatcc

SEQ ID NO: 182371 - DNA, 25 bp, Homo sapien
ctgccacatgttcatatatcctaaa

SEQ ID NO: 182372 - DNA, 25 bp, Homo sapien
gttcatatatcctaaatctatccta

SEQ ID NO: 182373 - DNA, 25 bp, Homo sapien
tctatcctaaatgttcccttgaagt

SEQ ID NO: 182374 - DNA, 25 bp, Homo sapien
atcctaaatgttcccttgaagtatt

SEQ ID NO: 182375 - DNA, 25 bp, Homo sapien
atatgtttatacatgttcttcaata

SEQ ID NO: 182376 - DNA, 25 bp, Homo sapien
ggaagcagtggcaattctagatatc

SEQ ID NO: 182377 - DNA, 25 bp, Homo sapien
gatatctgagattttgctggttcca

SEQ ID NO: 182378 - DNA, 25 bp, Homo sapien
gctggttccagtttgcccaatggag

SEQ ID NO: 182379 - DNA, 25 bp, Homo sapien
atgacttcttgtggttctgtaatgc

SEQ ID NO: 182380 - DNA, 25 bp, Homo sapien
aaggctccagggatacagagttgtc

SEQ ID NO: 182381 - DNA, 25 bp, Homo sapien
gagttgtccattaccaaagcctgga

SEQ ID NO: 182382 - DNA, 25 bp, Homo sapien
aaagcctggaagttctcatcacctc

SEQ ID NO: 182383 - DNA, 25 bp, Homo sapien
acctccaggtggactgcttggcagt

SEQ ID NO: 182384 - DNA, 25 bp, Homo sapien
gaggtggactcaggacttcagaagc

SEQ ID NO: 182385 - DNA, 25 bp, Homo sapien
agaagcaacatttctggcctgacct

SEQ ID NO: 182386 - DNA, 25 bp, Homo sapien
atttctggcctgacctggaaggtga

SEQ ID NO: 182387 - DNA, 25 bp, Homo sapien
ttcagtccttctcctctgtcggaat

SEQ ID NO: 182388 - DNA, 25 bp, Homo sapien
cttctcctctgtcggaatctttttt

SEQ ID NO: 182389 - DNA, 25 bp, Homo sapien
ttttaccataaattcacctgacgag

SEQ ID NO: 182390 - DNA, 25 bp, Homo sapien
attcacctgacgagggcactctgag

SEQ ID NO: 182391 - DNA, 25 bp, Homo sapien
gcactctgagatagcactgctctgg

SEQ ID NO: 182392 - DNA, 25 bp, Homo sapien
gggccatctgatcaccatcgggagc

SEQ ID NO: 182393 - DNA, 25 bp, Homo sapien
gatcaccatcgggagcaaatctctg

SEQ ID NO: 182394 - DNA, 25 bp, Homo sapien
tcgggagcaaatctctgacctcctt

SEQ ID NO: 182395 - DNA, 25 bp, Homo sapien
tgacctccttgcctgcagcttttac

SEQ ID NO: 182396 - DNA, 25 bp, Homo sapien
taaccctgtagtttctggacgtttg

SEQ ID NO: 182397 - DNA, 25 bp, Homo sapien
accctgtagtttctggacgtttgtg

SEQ ID NO: 182398 - DNA, 25 bp, Homo sapien
taaggagaaaactcttcattctatt

SEQ ID NO: 182399 - DNA, 25 bp, Homo sapien
tcattctatttcattctagtctttt

SEQ ID NO: 182400 - DNA, 25 bp, Homo sapien
attctatttcattctagtctttttt

SEQ ID NO: 182401 - DNA, 25 bp, Homo sapien
tttgtattttcactgtcttcaaaat

SEQ ID NO: 182402 - DNA, 25 bp, Homo sapien
ttttcactgtcttcaaaatatttac

SEQ ID NO: 182403 - DNA, 25 bp, Homo sapien
ttttggtttgaattgaaactggttg

SEQ ID NO: 182404 - DNA, 25 bp, Homo sapien
ttgaaactggttggccaactgttaa

SEQ ID NO: 182405 - DNA, 25 bp, Homo sapien
ttaaacaacatctcttaactcccct

SEQ ID NO: 182406 - DNA, 25 bp, Homo sapien
taaacaacatctcttaactccccta

SEQ ID NO: 182407 - DNA, 25 bp, Homo sapien
cagttttggccggtagaattcaatt

SEQ ID NO: 182408 - DNA, 25 bp, Homo sapien
ttttggccggtagaattcaattgtt

SEQ ID NO: 182409 - DNA, 25 bp, Homo sapien
caagaaaggcggcatccgtctgtgc

SEQ ID NO: 182410 - DNA, 25 bp, Homo sapien
aagaaaggcggcatccgtctgtgcc

SEQ ID NO: 182411 - DNA, 25 bp, Homo sapien
gaaaggcggcatccgtctgtgccct

SEQ ID NO: 182412 - DNA, 25 bp, Homo sapien
aaggcggcatccgtctgtgccctgt

SEQ ID NO: 182413 - DNA, 25 bp, Homo sapien
aggcggcatccgtctgtgccctgtg

SEQ ID NO: 182414 - DNA, 25 bp, Homo sapien
ggcatccgtctgtgccctgtgcctt

SEQ ID NO: 182415 - DNA, 25 bp, Homo sapien
tgcctttccagggagccaggcgcca

SEQ ID NO: 182416 - DNA, 25 bp, Homo sapien
agccaggcgccatgggcttttggtc

SEQ ID NO: 182417 - DNA, 25 bp, Homo sapien
ggcgccatgggcttttggtccaagc

SEQ ID NO: 182418 - DNA, 25 bp, Homo sapien
gcgccatgggcttttggtccaagct

SEQ ID NO: 182419 - DNA, 25 bp, Homo sapien
ccatgtagttcccagtgggcaagag

SEQ ID NO: 182420 - DNA, 25 bp, Homo sapien
gtgggctcggagatgacctggtgca

SEQ ID NO: 182421 - DNA, 25 bp, Homo sapien
aggcactgggactaagcaagggtcc

SEQ ID NO: 182422 - DNA, 25 bp, Homo sapien
aagggtcctggcctggaggtgtgaa

SEQ ID NO: 182423 - DNA, 25 bp, Homo sapien
gtgaaggtgctgtatcccggaaatc

SEQ ID NO: 182424 - DNA, 25 bp, Homo sapien
cccggaaatctatctggaccctgga

SEQ ID NO: 182425 - DNA, 25 bp, Homo sapien
ggcccagagcagaattctggcccca

SEQ ID NO: 182426 - DNA, 25 bp, Homo sapien
ggccccagaactctgtgcccaggag

SEQ ID NO: 182427 - DNA, 25 bp, Homo sapien
caggagccatgccttgagcagtatt

SEQ ID NO: 182428 - DNA, 25 bp, Homo sapien
tgagcagtattagccgtgtgtgtat

SEQ ID NO: 182429 - DNA, 25 bp, Homo sapien
tgtgcatgcatatgcatgtgcatgt

SEQ ID NO: 182430 - DNA, 25 bp, Homo sapien
gtgagctccttgaacgcacggagca

SEQ ID NO: 182431 - DNA, 25 bp, Homo sapien
actaagggcacatgtcttaatcaaa

SEQ ID NO: 182432 - DNA, 25 bp, Homo sapien
agggcacatgtcttaatcaaagtta

SEQ ID NO: 182433 - DNA, 25 bp, Homo sapien
gcacatgtcttaatcaaagttagtt

SEQ ID NO: 182434 - DNA, 25 bp, Homo sapien
atgacttaaatatctttacgtgtgt

SEQ ID NO: 182435 - DNA, 25 bp, Homo sapien
tatctttacgtgtgttttttagagc

SEQ ID NO: 182436 - DNA, 25 bp, Homo sapien
tttacgtgtgttttttagagcttgg

SEQ ID NO: 182437 - DNA, 25 bp, Homo sapien
tttagagcttggttctttaaagatt

SEQ ID NO: 182438 - DNA, 25 bp, Homo sapien
gagcttggttctttaaagatttgga

SEQ ID NO: 182439 - DNA, 25 bp, Homo sapien
gatatgtaaattaccaaggcacttg

SEQ ID NO: 182440 - DNA, 25 bp, Homo sapien
taccaaggcacttggtttttctgtt

SEQ ID NO: 182441 - DNA, 25 bp, Homo sapien
ttatatactaataatcagggcctaa

SEQ ID NO: 182442 - DNA, 25 bp, Homo sapien
aagtgatcagttaatgcctaagagt

SEQ ID NO: 182443 - DNA, 25 bp, Homo sapien
aaagtagttctattgacattcctca

SEQ ID NO: 182444 - DNA, 25 bp, Homo sapien
tattatgtctgcttaaatcatttaa

SEQ ID NO: 182445 - DNA, 25 bp, Homo sapien
ctatgaggtaccttgctgtgtagga

SEQ ID NO: 182446 - DNA, 25 bp, Homo sapien
gtaccttgctgtgtaggaggatgaa

SEQ ID NO: 182447 - DNA, 25 bp, Homo sapien
gggagttgatagtctcataaaacta

SEQ ID NO: 182448 - DNA, 25 bp, Homo sapien
gtctcataaaactaatttggcttca

SEQ ID NO: 182449 - DNA, 25 bp, Homo sapien
ttggcttcaagtttcatgaatctgt

SEQ ID NO: 182450 - DNA, 25 bp, Homo sapien
gaatttaattttcaccccaataatg

SEQ ID NO: 182451 - DNA, 25 bp, Homo sapien
aattttcaccccaataatgttctat

SEQ ID NO: 182452 - DNA, 25 bp, Homo sapien
taatgttctatatagcctttgctaa

SEQ ID NO: 182453 - DNA, 25 bp, Homo sapien
tgcctgcatgttctctctgttgttg

SEQ ID NO: 182454 - DNA, 25 bp, Homo sapien
tgcatgttctctctgttgttggagc

SEQ ID NO: 182455 - DNA, 25 bp, Homo sapien
gttctctctgttgttggagcctgga

SEQ ID NO: 182456 - DNA, 25 bp, Homo sapien
gttgttggagcctggagccttgctc

SEQ ID NO: 182457 - DNA, 25 bp, Homo sapien
agccttgctctctgggcacagaggg

SEQ ID NO: 182458 - DNA, 25 bp, Homo sapien
cctgcctgctgggacctatggaagg

SEQ ID NO: 182459 - DNA, 25 bp, Homo sapien
cccctcttccagaggaggagcaggg

SEQ ID NO: 182460 - DNA, 25 bp, Homo sapien
ggagcagggatctgggtttcctttt

SEQ ID NO: 182461 - DNA, 25 bp, Homo sapien
tttctgttttgggtgtactctaggg

SEQ ID NO: 182462 - DNA, 25 bp, Homo sapien
aaggtgagggcttcgggtggtgcta

SEQ ID NO: 182463 - DNA, 25 bp, Homo sapien
tcgggtggtgctataatgtggcact

SEQ ID NO: 182464 - DNA, 25 bp, Homo sapien
gtctgcaaggaaccactgcactttc

SEQ ID NO: 182465 - DNA, 25 bp, Homo sapien
aggccaagaaactctttcagtcctc

SEQ ID NO: 182466 - DNA, 25 bp, Homo sapien
gaaactctttcagtcctcaagttca

SEQ ID NO: 182467 - DNA, 25 bp, Homo sapien
tttcagtcctcaagttcaccaagtc

SEQ ID NO: 182468 - DNA, 25 bp, Homo sapien
aagttcaccaagtcttagcatacag

SEQ ID NO: 182469 - DNA, 25 bp, Homo sapien
aagtcttagcatacagtgtgtgccc

SEQ ID NO: 182470 - DNA, 25 bp, Homo sapien
tactggaaactgaatgcatttagca

SEQ ID NO: 182471 - DNA, 25 bp, Homo sapien
gaagtcattcattaggtaacaagga

SEQ ID NO: 182472 - DNA, 25 bp, Homo sapien
aaggtggaacattccctttcagtca

SEQ ID NO: 182473 - DNA, 25 bp, Homo sapien
tccctttcagtcaggcctatagaat

SEQ ID NO: 182474 - DNA, 25 bp, Homo sapien
aggcctatagaattatttgcacaag

SEQ ID NO: 182475 - DNA, 25 bp, Homo sapien
cgctctttgcagttttgaccatttt

SEQ ID NO: 182476 - DNA, 25 bp, Homo sapien
ttctgatcatggaagggctttctgc

SEQ ID NO: 182477 - DNA, 25 bp, Homo sapien
gaagggctttctgcgtttcttcacg

SEQ ID NO: 182478 - DNA, 25 bp, Homo sapien
atacgcctccactgggtagaatttc

SEQ ID NO: 182479 - DNA, 25 bp, Homo sapien
acaaattctacgttggtgcaggcac

SEQ ID NO: 182480 - DNA, 25 bp, Homo sapien
gtgcaggcaccaaatttgttccttt

SEQ ID NO: 182481 - DNA, 25 bp, Homo sapien
gttcctttctcattcagtctacttt

SEQ ID NO: 182482 - DNA, 25 bp, Homo sapien
cgacgacagtgtggcatgatcatat

SEQ ID NO: 182483 - DNA, 25 bp, Homo sapien
attgctgtaaccaacaagctttcag

SEQ ID NO: 182484 - DNA, 25 bp, Homo sapien
gaccatgttatagactttcacttat

SEQ ID NO: 182485 - DNA, 25 bp, Homo sapien
aaattccatcttcattactgcctta

SEQ ID NO: 182486 - DNA, 25 bp, Homo sapien
atggcgtttctccgaagcatgtggg

SEQ ID NO: 182487 - DNA, 25 bp, Homo sapien
tttctccgaagcatgtggggcgtgc

SEQ ID NO: 182488 - DNA, 25 bp, Homo sapien
ctgtgcaccggctgtggaagtcgac

SEQ ID NO: 182489 - DNA, 25 bp, Homo sapien
tgtgcaccggctgtggaagtcgact

SEQ ID NO: 182490 - DNA, 25 bp, Homo sapien
tgcaccggctgtggaagtcgactgc

SEQ ID NO: 182491 - DNA, 25 bp, Homo sapien
caccggctgtggaagtcgactgcgc

SEQ ID NO: 182492 - DNA, 25 bp, Homo sapien
accggctgtggaagtcgactgcgct

SEQ ID NO: 182493 - DNA, 25 bp, Homo sapien
ccggctgtggaagtcgactgcgctc

SEQ ID NO: 182494 - DNA, 25 bp, Homo sapien
cggctgtggaagtcgactgcgctcc

SEQ ID NO: 182495 - DNA, 25 bp, Homo sapien
ggctgtggaagtcgactgcgctccc

SEQ ID NO: 182496 - DNA, 25 bp, Homo sapien
gtggaagtcgactgcgctccccctt

SEQ ID NO: 182497 - DNA, 25 bp, Homo sapien
gggactttgccagtgacaaagccgg

SEQ ID NO: 182498 - DNA, 25 bp, Homo sapien
agccctgtgccggtgccagactggt

SEQ ID NO: 182499 - DNA, 25 bp, Homo sapien
gccagactggttggcatgtctacaa

SEQ ID NO: 182500 - DNA, 25 bp, Homo sapien
ggttggcatgtctacaatgactctc

SEQ ID NO: 182501 - DNA, 25 bp, Homo sapien
atgtctacaatgactctcgtgtctc

SEQ ID NO: 182502 - DNA, 25 bp, Homo sapien
gtcagtgaaaaccaggtggcatcca

SEQ ID NO: 182503 - DNA, 25 bp, Homo sapien
tgaaaaccaggtggcatccagcgag

SEQ ID NO: 182504 - DNA, 25 bp, Homo sapien
tacgtgctgttctaccaactgatgc

SEQ ID NO: 182505 - DNA, 25 bp, Homo sapien
gttctaccaactgatgcaggagcca

SEQ ID NO: 182506 - DNA, 25 bp, Homo sapien
atgcaggagccaccccggtgcctgt

SEQ ID NO: 182507 - DNA, 25 bp, Homo sapien
ggcacctgtgaagccctttaaacac

SEQ ID NO: 182508 - DNA, 25 bp, Homo sapien
gggcgagcccacagaaccagaaata

SEQ ID NO: 182509 - DNA, 25 bp, Homo sapien
aggctggctgccgagtctgtataac

SEQ ID NO: 182510 - DNA, 25 bp, Homo sapien
ctgtataactcagggtgctctgggt

SEQ ID NO: 182511 - DNA, 25 bp, Homo sapien
ggtggcccagtgacttgggaacaca

SEQ ID NO: 182512 - DNA, 25 bp, Homo sapien
gtgacttgggaacacagcttcttgt

SEQ ID NO: 182513 - DNA, 25 bp, Homo sapien
ggaacacagcttcttgtctcagaga

SEQ ID NO: 182514 - DNA, 25 bp, Homo sapien
gcttcttgtctcagagagcctggta

SEQ ID NO: 182515 - DNA, 25 bp, Homo sapien
tctcagagagcctggtacgctggga

SEQ ID NO: 182516 - DNA, 25 bp, Homo sapien
gggtccacgtctgggctccagttga

SEQ ID NO: 182517 - DNA, 25 bp, Homo sapien
cagttgatcccctgggtgtctggga

SEQ ID NO: 182518 - DNA, 25 bp, Homo sapien
atggagcaacaggaaactggtgata

SEQ ID NO: 182519 - DNA, 25 bp, Homo sapien
attgactttttatggcactagtatt

SEQ ID NO: 182520 - DNA, 25 bp, Homo sapien
gggccatgaatcaccttttggtctg

SEQ ID NO: 182521 - DNA, 25 bp, Homo sapien
caccttttggtctggagggaagcct

SEQ ID NO: 182522 - DNA, 25 bp, Homo sapien
gggctgatcgagttgttgcccacag

SEQ ID NO: 182523 - DNA, 25 bp, Homo sapien
agttgttgcccacagctgtatgatt

SEQ ID NO: 182524 - DNA, 25 bp, Homo sapien
tgtatgattcccagccagacacagc

SEQ ID NO: 182525 - DNA, 25 bp, Homo sapien
cagcctcttagatgcagttctgaag

SEQ ID NO: 182526 - DNA, 25 bp, Homo sapien
aagatggtaccaccagtctgactgt

SEQ ID NO: 182527 - DNA, 25 bp, Homo sapien
caccagtctgactgtttccatcaag

SEQ ID NO: 182528 - DNA, 25 bp, Homo sapien
atcaagggtacactgccttctcaac

SEQ ID NO: 182529 - DNA, 25 bp, Homo sapien
caactccaaactgactcttaagaag

SEQ ID NO: 182530 - DNA, 25 bp, Homo sapien
taagaaacgtagtagcgggacagca

SEQ ID NO: 182531 - DNA, 25 bp, Homo sapien
agaaacgtagtagcgggacagcagt

SEQ ID NO: 182532 - DNA, 25 bp, Homo sapien
agccggagcaggattgtgccgtaac

SEQ ID NO: 182533 - DNA, 25 bp, Homo sapien
ccggagcaggattgtgccgtaacct

SEQ ID NO: 182534 - DNA, 25 bp, Homo sapien
ggagcaggattgtgccgtaacctcg

SEQ ID NO: 182535 - DNA, 25 bp, Homo sapien
gagcaggattgtgccgtaacctcgg

SEQ ID NO: 182536 - DNA, 25 bp, Homo sapien
aggattgtgccgtaacctcgggcga

SEQ ID NO: 182537 - DNA, 25 bp, Homo sapien
attgtgccgtaacctcgggcgagga

SEQ ID NO: 182538 - DNA, 25 bp, Homo sapien
gtcgctgctcgggagggccgactgc

SEQ ID NO: 182539 - DNA, 25 bp, Homo sapien
gtcgcgccacgtcgaccgcaggaac

SEQ ID NO: 182540 - DNA, 25 bp, Homo sapien
cacgtcgaccgcaggaaccccggtg

SEQ ID NO: 182541 - DNA, 25 bp, Homo sapien
aacacaaaagattccaccagactga

SEQ ID NO: 182542 - DNA, 25 bp, Homo sapien
tccaccagactgaagtatgcagtta

SEQ ID NO: 182543 - DNA, 25 bp, Homo sapien
aagatcaataccattgcttcagaca

SEQ ID NO: 182544 - DNA, 25 bp, Homo sapien
attgcttcagacactttcccaaagt

SEQ ID NO: 182545 - DNA, 25 bp, Homo sapien
gagtcagctattgaagtggtcatcc

SEQ ID NO: 182546 - DNA, 25 bp, Homo sapien
tgaagtggtcatccatttcttttta

SEQ ID NO: 182547 - DNA, 25 bp, Homo sapien
gaagctcatgtggacttgttctatt

SEQ ID NO: 182548 - DNA, 25 bp, Homo sapien
gacttgttctattgcctgacctgat

SEQ ID NO: 182549 - DNA, 25 bp, Homo sapien
ttgcctgacctgatgaactgttaat

SEQ ID NO: 182550 - DNA, 25 bp, Homo sapien
aactgttaatatctggtgaggttga

SEQ ID NO: 182551 - DNA, 25 bp, Homo sapien
gtgaggttgagttatcatgctacta

SEQ ID NO: 182552 - DNA, 25 bp, Homo sapien
tttggctgaaggaagctgtgcgtgt

SEQ ID NO: 182553 - DNA, 25 bp, Homo sapien
gtgtatctcacactcatgcattgtc

SEQ ID NO: 182554 - DNA, 25 bp, Homo sapien
cactcatgcattgtcctctttttat

SEQ ID NO: 182555 - DNA, 25 bp, Homo sapien
cctctttttatttagattggcagtg

SEQ ID NO: 182556 - DNA, 25 bp, Homo sapien
gtgaagtgagaccttccttttactt

SEQ ID NO: 182557 - DNA, 25 bp, Homo sapien
ttcttctattgcctctgagagcata

SEQ ID NO: 182558 - DNA, 25 bp, Homo sapien
tattgcctctgagagcatagctaga

SEQ ID NO: 182559 - DNA, 25 bp, Homo sapien
gagagcatagctagaggcctgactg

SEQ ID NO: 182560 - DNA, 25 bp, Homo sapien
atagctagaggcctgactgccaagc

SEQ ID NO: 182561 - DNA, 25 bp, Homo sapien
gagatggtggatgatccccacgcca

SEQ ID NO: 182562 - DNA, 25 bp, Homo sapien
atggtggatgatccccacgccacag

SEQ ID NO: 182563 - DNA, 25 bp, Homo sapien
gcaacatttgttgaggccttatgat

SEQ ID NO: 182564 - DNA, 25 bp, Homo sapien
gattcagcagcttggtcacttgatt

SEQ ID NO: 182565 - DNA, 25 bp, Homo sapien
aaaccattgtttcttcaattgtgac

SEQ ID NO: 182566 - DNA, 25 bp, Homo sapien
agcaacttatgtgttcgatcatgta

SEQ ID NO: 182567 - DNA, 25 bp, Homo sapien
atcactgagcagttgtttatactgt

SEQ ID NO: 182568 - DNA, 25 bp, Homo sapien
gtatggtaccatagtattctcactg

SEQ ID NO: 182569 - DNA, 25 bp, Homo sapien
attctcactggactgtggatacgtt

SEQ ID NO: 182570 - DNA, 25 bp, Homo sapien
gaaatgtttttcaatcaggatcatc

SEQ ID NO: 182571 - DNA, 25 bp, Homo sapien
aggatcatcctccaagcagtcctgt

SEQ ID NO: 182572 - DNA, 25 bp, Homo sapien
tccaagcagtcctgttcattcatgt

SEQ ID NO: 182573 - DNA, 25 bp, Homo sapien
attcatgtctgcctcaaattgctgg

SEQ ID NO: 182574 - DNA, 25 bp, Homo sapien
atctctctctgccaagaatggagat

SEQ ID NO: 182575 - DNA, 25 bp, Homo sapien
ttctcctttttctcaagtgatattt

SEQ ID NO: 182576 - DNA, 25 bp, Homo sapien
atttgccttaggtcagattctacta

SEQ ID NO: 182577 - DNA, 25 bp, Homo sapien
aaagcaaaacgatctcctggtctga

SEQ ID NO: 182578 - DNA, 25 bp, Homo sapien
aaaacgatctcctggtctgattcct

SEQ ID NO: 182579 - DNA, 25 bp, Homo sapien
tcctttgggtctctaataatggaaa

SEQ ID NO: 182580 - DNA, 25 bp, Homo sapien
taaagtgttcctttgttctgacgtt

SEQ ID NO: 182581 - DNA, 25 bp, Homo sapien
ctgacgttggtataacattgcttga

SEQ ID NO: 182582 - DNA, 25 bp, Homo sapien
gaaagtatttggacatgcagacaga

SEQ ID NO: 182583 - DNA, 25 bp, Homo sapien
agcaatattattcaggtcttccttg

SEQ ID NO: 182584 - DNA, 25 bp, Homo sapien
attcaggtcttccttgttgcaagtg

SEQ ID NO: 182585 - DNA, 25 bp, Homo sapien
gaccggtatgagatcaattccctgg

SEQ ID NO: 182586 - DNA, 25 bp, Homo sapien
agatcaattccctggtgcggtacca

SEQ ID NO: 182587 - DNA, 25 bp, Homo sapien
ccctggtgcggtaccagtgcacaga

SEQ ID NO: 182588 - DNA, 25 bp, Homo sapien
gcactgggaggagcctcggatcacc

SEQ ID NO: 182589 - DNA, 25 bp, Homo sapien
aggagcctcggatcacctgcacaga

SEQ ID NO: 182590 - DNA, 25 bp, Homo sapien
accacctacaaacgcagactacaga

SEQ ID NO: 182591 - DNA, 25 bp, Homo sapien
cagactacagaagcggagctcacgg

SEQ ID NO: 182592 - DNA, 25 bp, Homo sapien
tgagaagagcttccaggacgcaccc

SEQ ID NO: 182593 - DNA, 25 bp, Homo sapien
ttccaggacgcacccaggacgctga

SEQ ID NO: 182594 - DNA, 25 bp, Homo sapien
tgacgtgcatcccacccagacggtg

SEQ ID NO: 182595 - DNA, 25 bp, Homo sapien
agacggtgtcctcttcttgtcgctt

SEQ ID NO: 182596 - DNA, 25 bp, Homo sapien
gttgaaatatcctcaatttctctat

SEQ ID NO: 182597 - DNA, 25 bp, Homo sapien
tatcctcaatttctctatattttaa

SEQ ID NO: 182598 - DNA, 25 bp, Homo sapien
aatggacatttattaaggttacaga

SEQ ID NO: 182599 - DNA, 25 bp, Homo sapien
ctccatttgacttctgtatcgctga

SEQ ID NO: 182600 - DNA, 25 bp, Homo sapien
atttgacttctgtatcgctgatgtt

SEQ ID NO: 182601 - DNA, 25 bp, Homo sapien
acttctgtatcgctgatgttcacct

SEQ ID NO: 182602 - DNA, 25 bp, Homo sapien
tatcgctgatgttcacctcctgtaa

SEQ ID NO: 182603 - DNA, 25 bp, Homo sapien
gatgttcacctcctgtaaatagttt

SEQ ID NO: 182604 - DNA, 25 bp, Homo sapien
cacctcctgtaaatagtttggcaat

SEQ ID NO: 182605 - DNA, 25 bp, Homo sapien
ggagtgaattctcgtgttattttaa

SEQ ID NO: 182606 - DNA, 25 bp, Homo sapien
gaattctcgtgttattttaatctca

SEQ ID NO: 182607 - DNA, 25 bp, Homo sapien
gtacacccctgctggcagaagtacc

SEQ ID NO: 182608 - DNA, 25 bp, Homo sapien
tggtggctgccctgttcgcatcagt

SEQ ID NO: 182609 - DNA, 25 bp, Homo sapien
gttcgcatcagtggcgatgacttta

SEQ ID NO: 182610 - DNA, 25 bp, Homo sapien
tggcgatgactttatttgcggagca

SEQ ID NO: 182611 - DNA, 25 bp, Homo sapien
actttatttgcggagcatttctgca

SEQ ID NO: 182612 - DNA, 25 bp, Homo sapien
atttctgcaagcgttgcctggatgc

SEQ ID NO: 182613 - DNA, 25 bp, Homo sapien
gcctcaaaatgtcagtgagcaccat

SEQ ID NO: 182614 - DNA, 25 bp, Homo sapien
gagcaccatgctggaagtcaccatc

SEQ ID NO: 182615 - DNA, 25 bp, Homo sapien
catgctggaagtcaccatcactgtg

SEQ ID NO: 182616 - DNA, 25 bp, Homo sapien
ggaagtcaccatcactgtggcagcg

SEQ ID NO: 182617 - DNA, 25 bp, Homo sapien
atcactgtggcagcgcccaggaagg

SEQ ID NO: 182618 - DNA, 25 bp, Homo sapien
actccgaactcctgtatgtgcctgg

SEQ ID NO: 182619 - DNA, 25 bp, Homo sapien
tgcctggctgagtcacctaattcat

SEQ ID NO: 182620 - DNA, 25 bp, Homo sapien
gagtcacctaattcatactgtcata

SEQ ID NO: 182621 - DNA, 25 bp, Homo sapien
gttttgtttgactcttggctgccta

SEQ ID NO: 182622 - DNA, 25 bp, Homo sapien
actcttggctgcctacgtctgtagg

SEQ ID NO: 182623 - DNA, 25 bp, Homo sapien
cttcctgtctacctcatactagaat

SEQ ID NO: 182624 - DNA, 25 bp, Homo sapien
agaatgatcgtgactacccgggcag

SEQ ID NO: 182625 - DNA, 25 bp, Homo sapien
acccgggcagacattttactgtgtt

SEQ ID NO: 182626 - DNA, 25 bp, Homo sapien
ttactgtgtttctcagaccaagtgt

SEQ ID NO: 182627 - DNA, 25 bp, Homo sapien
gaccaagtgtctactgatggcccaa

SEQ ID NO: 182628 - DNA, 25 bp, Homo sapien
gatggcccaaacatggagttttgtg

SEQ ID NO: 182629 - DNA, 25 bp, Homo sapien
aaaacacacacccagaagacgacct

SEQ ID NO: 182630 - DNA, 25 bp, Homo sapien
caagtgaggaagacccaacctttga

SEQ ID NO: 182631 - DNA, 25 bp, Homo sapien
aagacaaccctgaagtgcctccgct

SEQ ID NO: 182632 - DNA, 25 bp, Homo sapien
aagtgcctccgctgatttgaaacat

SEQ ID NO: 182633 - DNA, 25 bp, Homo sapien
gaaacatctggctgcgttgccattg

SEQ ID NO: 182634 - DNA, 25 bp, Homo sapien
gttgccattggctgagacccaccag

SEQ ID NO: 182635 - DNA, 25 bp, Homo sapien
ccaggtccagttttggttggtgtag

SEQ ID NO: 182636 - DNA, 25 bp, Homo sapien
gagaccatatgcatattattcctgg

SEQ ID NO: 182637 - DNA, 25 bp, Homo sapien
tatttgtcaatatcgctgctccagt

SEQ ID NO: 182638 - DNA, 25 bp, Homo sapien
gctgctccagtgttttaactcttac

SEQ ID NO: 182639 - DNA, 25 bp, Homo sapien
gtgttttaactcttactttgcatag

SEQ ID NO: 182640 - DNA, 25 bp, Homo sapien
tcctgcagaaacagtttctcctcct

SEQ ID NO: 182641 - DNA, 25 bp, Homo sapien
agttcctcttcacatgaagcccctg

SEQ ID NO: 182642 - DNA, 25 bp, Homo sapien
acatgaagcccctggcatttgctgg

SEQ ID NO: 182643 - DNA, 25 bp, Homo sapien
gactggcctggtacttgctgttagg

SEQ ID NO: 182644 - DNA, 25 bp, Homo sapien
ctggtacttgctgttagggcaggaa

SEQ ID NO: 182645 - DNA, 25 bp, Homo sapien
ttcagatgggtagcactaagccagc

SEQ ID NO: 182646 - DNA, 25 bp, Homo sapien
gtagcactaagccagctggcctaaa

SEQ ID NO: 182647 - DNA, 25 bp, Homo sapien
agccagctggcctaaagatgcaata

SEQ ID NO: 182648 - DNA, 25 bp, Homo sapien
agatgcaataagttcctaggtagtc

SEQ ID NO: 182649 - DNA, 25 bp, Homo sapien
tgcaataagttcctaggtagtctac

SEQ ID NO: 182650 - DNA, 25 bp, Homo sapien
cctcagcccattaggcaggaaaagt

SEQ ID NO: 182651 - DNA, 25 bp, Homo sapien
tagcatttattaacaggtactctaa

SEQ ID NO: 182652 - DNA, 25 bp, Homo sapien
gcatttattaacaggtactctaaga

SEQ ID NO: 182653 - DNA, 25 bp, Homo sapien
tttattaacaggtactctaagaatg

SEQ ID NO: 182654 - DNA, 25 bp, Homo sapien
ttaacaggtactctaagaatgatga

SEQ ID NO: 182655 - DNA, 25 bp, Homo sapien
tctaagaatgatgaagcattgtttt

SEQ ID NO: 182656 - DNA, 25 bp, Homo sapien
atcttaagactatgaaggtttttct

SEQ ID NO: 182657 - DNA, 25 bp, Homo sapien
gactatgaaggtttttcttagttct

SEQ ID NO: 182658 - DNA, 25 bp, Homo sapien
tttgaatacttgcaggctttgtatg

SEQ ID NO: 182659 - DNA, 25 bp, Homo sapien
tgaatacttgcaggctttgtatgtg

SEQ ID NO: 182660 - DNA, 25 bp, Homo sapien
aatacttgcaggctttgtatgtgaa

SEQ ID NO: 182661 - DNA, 25 bp, Homo sapien
atacttgcaggctttgtatgtgaat

SEQ ID NO: 182662 - DNA, 25 bp, Homo sapien
tggtggctgccctgttcgcatcagt

SEQ ID NO: 182663 - DNA, 25 bp, Homo sapien
gccctgttcgcatcagtggcgatga

SEQ ID NO: 182664 - DNA, 25 bp, Homo sapien
gttcgcatcagtggcgatgacttta

SEQ ID NO: 182665 - DNA, 25 bp, Homo sapien
gtggcgatgactttatttgcggagc

SEQ ID NO: 182666 - DNA, 25 bp, Homo sapien
gcgatgactttatttgcggagcatt

SEQ ID NO: 182667 - DNA, 25 bp, Homo sapien
actttatttgcggagcatttctgca

SEQ ID NO: 182668 - DNA, 25 bp, Homo sapien
gagcatttctgcaagcgttgcctgg

SEQ ID NO: 182669 - DNA, 25 bp, Homo sapien
atttctgcaagcgttgcctggatgc

SEQ ID NO: 182670 - DNA, 25 bp, Homo sapien
tctgcaagcgttgcctggatgcggt

SEQ ID NO: 182671 - DNA, 25 bp, Homo sapien
aagcgttgcctggatgcggtggtgc

SEQ ID NO: 182672 - DNA, 25 bp, Homo sapien
gcggtggtgcattgtgggccctctg

SEQ ID NO: 182673 - DNA, 25 bp, Homo sapien
gaataactttattctgcagatcatt

SEQ ID NO: 182674 - DNA, 25 bp, Homo sapien
aataactttattctgcagatcattt

SEQ ID NO: 182675 - DNA, 25 bp, Homo sapien
ataactttattctgcagatcattta

SEQ ID NO: 182676 - DNA, 25 bp, Homo sapien
aactttattctgcagatcatttaag

SEQ ID NO: 182677 - DNA, 25 bp, Homo sapien
actttattctgcagatcatttaaga

SEQ ID NO: 182678 - DNA, 25 bp, Homo sapien
ttattctgcagatcatttaagaagt

SEQ ID NO: 182679 - DNA, 25 bp, Homo sapien
tctgcagatcatttaagaagtaaca

SEQ ID NO: 182680 - DNA, 25 bp, Homo sapien
gatcatttaagaagtaacaggccgg

SEQ ID NO: 182681 - DNA, 25 bp, Homo sapien
atcatttaagaagtaacaggccggg

SEQ ID NO: 182682 - DNA, 25 bp, Homo sapien
tcatttaagaagtaacaggccgggc

SEQ ID NO: 182683 - DNA, 25 bp, Homo sapien
catttaagaagtaacaggccgggcg

SEQ ID NO: 182684 - DNA, 25 bp, Homo sapien
agcgtcgccaaaactagtgttcttt

SEQ ID NO: 182685 - DNA, 25 bp, Homo sapien
gtcgccaaaactagtgttctttatt

SEQ ID NO: 182686 - DNA, 25 bp, Homo sapien
agtgcctctcacaaaagatcctgga

SEQ ID NO: 182687 - DNA, 25 bp, Homo sapien
gcctctcacaaaagatcctggatgg

SEQ ID NO: 182688 - DNA, 25 bp, Homo sapien
atgctattatatgatgctgtttgta

SEQ ID NO: 182689 - DNA, 25 bp, Homo sapien
gaattagtactattcctgttgtaaa

SEQ ID NO: 182690 - DNA, 25 bp, Homo sapien
gattttaagttgtctactgagcaga

SEQ ID NO: 182691 - DNA, 25 bp, Homo sapien
gttgtctactgagcagatttctgca

SEQ ID NO: 182692 - DNA, 25 bp, Homo sapien
agatttctgcattggttttccagtc

SEQ ID NO: 182693 - DNA, 25 bp, Homo sapien
agaaacttcatatgtgtcatcacag

SEQ ID NO: 182694 - DNA, 25 bp, Homo sapien
atatgtgtcatcacagcttttgtaa

SEQ ID NO: 182695 - DNA, 25 bp, Homo sapien
gagacactgtccccgcccagaagga

SEQ ID NO: 182696 - DNA, 25 bp, Homo sapien
gaagaggcggcgagtgccacgggat

SEQ ID NO: 182697 - DNA, 25 bp, Homo sapien
agtgccacgggatggacgccgagca

SEQ ID NO: 182698 - DNA, 25 bp, Homo sapien
acgccgagcaggaaatgcgctgact

SEQ ID NO: 182699 - DNA, 25 bp, Homo sapien
cgagcaggaaatgcgctgactccag

SEQ ID NO: 182700 - DNA, 25 bp, Homo sapien
ccccggtgcagattaaggttgagga

SEQ ID NO: 182701 - DNA, 25 bp, Homo sapien
aggttgaggaagactttggctttga

SEQ ID NO: 182702 - DNA, 25 bp, Homo sapien
gaggaagactttggctttgaagcag

SEQ ID NO: 182703 - DNA, 25 bp, Homo sapien
actttggctttgaagcagatgaggc

SEQ ID NO: 182704 - DNA, 25 bp, Homo sapien
gccctggattccagttgggtttctc

SEQ ID NO: 182705 - DNA, 25 bp, Homo sapien
gggtccagacaaactgctgccctac

SEQ ID NO: 182706 - DNA, 25 bp, Homo sapien
aagatgtttttctcttctggcttca

SEQ ID NO: 182707 - DNA, 25 bp, Homo sapien
tgtttttctcttctggcttcataaa

SEQ ID NO: 182708 - DNA, 25 bp, Homo sapien
ggcttcataaatgccttgctgtata

SEQ ID NO: 182709 - DNA, 25 bp, Homo sapien
tgaactgtctttttaatgatgacct

SEQ ID NO: 182710 - DNA, 25 bp, Homo sapien
gacctaactttattcaacccatcgg

SEQ ID NO: 182711 - DNA, 25 bp, Homo sapien
tattcaacccatcggaatttacttt

SEQ ID NO: 182712 - DNA, 25 bp, Homo sapien
tgaaataagatcttttccactggtc

SEQ ID NO: 182713 - DNA, 25 bp, Homo sapien
cactggtctactacctgaccataaa

SEQ ID NO: 182714 - DNA, 25 bp, Homo sapien
ctgaccataaacatgtctgcatttg

SEQ ID NO: 182715 - DNA, 25 bp, Homo sapien
gaattctctaaaccctaaatctgtg

SEQ ID NO: 182716 - DNA, 25 bp, Homo sapien
tctaaaccctaaatctgtgtctatg

SEQ ID NO: 182717 - DNA, 25 bp, Homo sapien
ggcagcgtccactatggccactaca

SEQ ID NO: 182718 - DNA, 25 bp, Homo sapien
gcagcgtccactatggccactacac

SEQ ID NO: 182719 - DNA, 25 bp, Homo sapien
cagcgtccactatggccactacaca

SEQ ID NO: 182720 - DNA, 25 bp, Homo sapien
agcgtccactatggccactacacag

SEQ ID NO: 182721 - DNA, 25 bp, Homo sapien
gcgtccactatggccactacacagc

SEQ ID NO: 182722 - DNA, 25 bp, Homo sapien
cgtccactatggccactacacagcc

SEQ ID NO: 182723 - DNA, 25 bp, Homo sapien
gtccactatggccactacacagccc

SEQ ID NO: 182724 - DNA, 25 bp, Homo sapien
tccactatggccactacacagccct

SEQ ID NO: 182725 - DNA, 25 bp, Homo sapien
cctttagtcttgaatgtcttatgct

SEQ ID NO: 182726 - DNA, 25 bp, Homo sapien
attatttggtgttgagcctctcttc

SEQ ID NO: 182727 - DNA, 25 bp, Homo sapien
gtgttgagcctctcttccacaagag

SEQ ID NO: 182728 - DNA, 25 bp, Homo sapien
cacaagagctcctccatgtttggat

SEQ ID NO: 182729 - DNA, 25 bp, Homo sapien
gctcctccatgtttggatagcagtt

SEQ ID NO: 182730 - DNA, 25 bp, Homo sapien
tggagtgttcagtgcccatttctca

SEQ ID NO: 182731 - DNA, 25 bp, Homo sapien
ttcagtgcccatttctcattttaca

SEQ ID NO: 182732 - DNA, 25 bp, Homo sapien
aagtcgttcctccaacatagtgtgt

SEQ ID NO: 182733 - DNA, 25 bp, Homo sapien
tgggatgccaaagcctgctcaagtt

SEQ ID NO: 182734 - DNA, 25 bp, Homo sapien
aaagcctgctcaagttatggacatt

SEQ ID NO: 182735 - DNA, 25 bp, Homo sapien
acattgtggccaccatgtggcttaa

SEQ ID NO: 182736 - DNA, 25 bp, Homo sapien
cttctcccttgagagacagtttcga

SEQ ID NO: 182737 - DNA, 25 bp, Homo sapien
gagacagtttcgaagccaggccttc

SEQ ID NO: 182738 - DNA, 25 bp, Homo sapien
tcgaagccaggccttcaacaaactg

SEQ ID NO: 182739 - DNA, 25 bp, Homo sapien
aaactgccccagaggactgccaagc

SEQ ID NO: 182740 - DNA, 25 bp, Homo sapien
agaggactgccaagctcaacctcct

SEQ ID NO: 182741 - DNA, 25 bp, Homo sapien
gggacttttctatgtctttggcatc

SEQ ID NO: 182742 - DNA, 25 bp, Homo sapien
tttggcatcattctggcaccagcag

SEQ ID NO: 182743 - DNA, 25 bp, Homo sapien
aggcagtctgcccaaaatttaaggg

SEQ ID NO: 182744 - DNA, 25 bp, Homo sapien
aatgtgatttggcagtcagggtact

SEQ ID NO: 182745 - DNA, 25 bp, Homo sapien
ggtactaagcatgggtgggaactcc

SEQ ID NO: 182746 - DNA, 25 bp, Homo sapien
atgggtgggaactcctgccttataa

SEQ ID NO: 182747 - DNA, 25 bp, Homo sapien
aaatggcaaaagatccaggagtctt

SEQ ID NO: 182748 - DNA, 25 bp, Homo sapien
caggagtctttcaactgtttcagaa

SEQ ID NO: 182749 - DNA, 25 bp, Homo sapien
aaaacacttctaattctgtgattaa

SEQ ID NO: 182750 - DNA, 25 bp, Homo sapien
tgacccaagggttattagaaagtgc

SEQ ID NO: 182751 - DNA, 25 bp, Homo sapien
gtgctgaatttacagtagttaacct

SEQ ID NO: 182752 - DNA, 25 bp, Homo sapien
gctttcttcccgtaaaaactatctg

SEQ ID NO: 182753 - DNA, 25 bp, Homo sapien
gtaaagttgtatgtaagctgagatt

SEQ ID NO: 182754 - DNA, 25 bp, Homo sapien
gagattttgtatacaggaatcctta

SEQ ID NO: 182755 - DNA, 25 bp, Homo sapien
gaatccttatttcctcatagcttat

SEQ ID NO: 182756 - DNA, 25 bp, Homo sapien
aatcaggaatatgttgctttggaaa

SEQ ID NO: 182757 - DNA, 25 bp, Homo sapien
gttgctttggaaaaagcctcttaat

SEQ ID NO: 182758 - DNA, 25 bp, Homo sapien
gattcactgcatcatagctatgcct

SEQ ID NO: 182759 - DNA, 25 bp, Homo sapien
agctatgcctgtatggagtctaaca

SEQ ID NO: 182760 - DNA, 25 bp, Homo sapien
ggagtctaacatatgaccaatacca

SEQ ID NO: 182761 - DNA, 25 bp, Homo sapien
aataccaacccataatccagctgaa

SEQ ID NO: 182762 - DNA, 25 bp, Homo sapien
cattatgatttgagtggtgcttttc

SEQ ID NO: 182763 - DNA, 25 bp, Homo sapien
tttccttgctttgttaaccatcacg

SEQ ID NO: 182764 - DNA, 25 bp, Homo sapien
taaccatcacgagagtctgcagcac

SEQ ID NO: 182765 - DNA, 25 bp, Homo sapien
gagtctgcagcacaacttttaacaa

SEQ ID NO: 182766 - DNA, 25 bp, Homo sapien
atttgggtaggttaagctgccatac

SEQ ID NO: 182767 - DNA, 25 bp, Homo sapien
ggttaagctgccatacgtgttcagt

SEQ ID NO: 182768 - DNA, 25 bp, Homo sapien
gctgccatacgtgttcagtgtgaat

SEQ ID NO: 182769 - DNA, 25 bp, Homo sapien
tagaaagcactatacatcctattgt

SEQ ID NO: 182770 - DNA, 25 bp, Homo sapien
gcactatacatcctattgtttcttt

SEQ ID NO: 182771 - DNA, 25 bp, Homo sapien
tctttccaaaatcagccttctgtct

SEQ ID NO: 182772 - DNA, 25 bp, Homo sapien
agccttctgtctgtaacaaaaatgt

SEQ ID NO: 182773 - DNA, 25 bp, Homo sapien
aatgtactttatagagatggaggaa

SEQ ID NO: 182774 - DNA, 25 bp, Homo sapien
ggaggaaaaggtctaatactacata

SEQ ID NO: 182775 - DNA, 25 bp, Homo sapien
ggtctaatactacatagccttaagt

SEQ ID NO: 182776 - DNA, 25 bp, Homo sapien
catagccttaagtgtttctgtcatt

SEQ ID NO: 182777 - DNA, 25 bp, Homo sapien
gtgtttctgtcattgttcaagtgta

SEQ ID NO: 182778 - DNA, 25 bp, Homo sapien
aatatacttgtcttacctctcaata

SEQ ID NO: 182779 - DNA, 25 bp, Homo sapien
ttgtcttacctctcaataaaagggt

SEQ ID NO: 182780 - DNA, 25 bp, Homo sapien
ctttggcctgcactgtactggaatg

SEQ ID NO: 182781 - DNA, 25 bp, Homo sapien
tggcctgcactgtactggaatgcct

SEQ ID NO: 182782 - DNA, 25 bp, Homo sapien
gcctgcactgtactggaatgcctat

SEQ ID NO: 182783 - DNA, 25 bp, Homo sapien
tgcactgtactggaatgcctattaa

SEQ ID NO: 182784 - DNA, 25 bp, Homo sapien
gaatgcctattaaggcatgtgctga

SEQ ID NO: 182785 - DNA, 25 bp, Homo sapien
agaaatagagctgtatggttgcccc

SEQ ID NO: 182786 - DNA, 25 bp, Homo sapien
tggttgcccccctgattttccagat

SEQ ID NO: 182787 - DNA, 25 bp, Homo sapien
taaagctggatcttctaaataccag

SEQ ID NO: 182788 - DNA, 25 bp, Homo sapien
gctggatcttctaaataccagtggg

SEQ ID NO: 182789 - DNA, 25 bp, Homo sapien
agtggggcattatgaaatcccttgg

SEQ ID NO: 182790 - DNA, 25 bp, Homo sapien
aattttctgaagcagaacattggct

SEQ ID NO: 182791 - DNA, 25 bp, Homo sapien
tattgattatacatccaggcctgcc

SEQ ID NO: 182792 - DNA, 25 bp, Homo sapien
caggcctgccattgtgttcaggata

SEQ ID NO: 182793 - DNA, 25 bp, Homo sapien
gccattgtgttcaggatatcagcaa

SEQ ID NO: 182794 - DNA, 25 bp, Homo sapien
aaaagggatatggaccagctacaca

SEQ ID NO: 182795 - DNA, 25 bp, Homo sapien
gaccagctacacaagttcggtggct

SEQ ID NO: 182796 - DNA, 25 bp, Homo sapien
gttcggtggcttcaaggtaacaata

SEQ ID NO: 182797 - DNA, 25 bp, Homo sapien
tactgaagctattgtgatgatgatt

SEQ ID NO: 182798 - DNA, 25 bp, Homo sapien
tagtaactggttatgaagatttgtc

SEQ ID NO: 182799 - DNA, 25 bp, Homo sapien
gtattctctggctgtatttccagca

SEQ ID NO: 182800 - DNA, 25 bp, Homo sapien
ttccagcagttatgaacttgagttt

SEQ ID NO: 182801 - DNA, 25 bp, Homo sapien
atgtatttgctgaattatagatcca

SEQ ID NO: 182802 - DNA, 25 bp, Homo sapien
aggtcggggcactctgagtcccagt

SEQ ID NO: 182803 - DNA, 25 bp, Homo sapien
ccagttcccagtgcagctgtaggtc

SEQ ID NO: 182804 - DNA, 25 bp, Homo sapien
ttcccagtgcagctgtaggtcgtca

SEQ ID NO: 182805 - DNA, 25 bp, Homo sapien
ccagtgcagctgtaggtcgtcatca

SEQ ID NO: 182806 - DNA, 25 bp, Homo sapien
agtgcagctgtaggtcgtcatcacc

SEQ ID NO: 182807 - DNA, 25 bp, Homo sapien
gcagctgtaggtcgtcatcacctaa

SEQ ID NO: 182808 - DNA, 25 bp, Homo sapien
tgtaggtcgtcatcacctaaccaca

SEQ ID NO: 182809 - DNA, 25 bp, Homo sapien
accacacgtgcaataaagtcctcgt

SEQ ID NO: 182810 - DNA, 25 bp, Homo sapien
acgtgcaataaagtcctcgtgcctg

SEQ ID NO: 182811 - DNA, 25 bp, Homo sapien
gcaataaagtcctcgtgcctgctgc

SEQ ID NO: 182812 - DNA, 25 bp, Homo sapien
ataaagtcctcgtgcctgctgctca

SEQ ID NO: 182813 - DNA, 25 bp, Homo sapien
tctccggaatctgaaccctcattcc

SEQ ID NO: 182814 - DNA, 25 bp, Homo sapien
ctccggaatctgaaccctcattccc

SEQ ID NO: 182815 - DNA, 25 bp, Homo sapien
tccggaatctgaaccctcattcccc

SEQ ID NO: 182816 - DNA, 25 bp, Homo sapien
ccggaatctgaaccctcattccccg

SEQ ID NO: 182817 - DNA, 25 bp, Homo sapien
cggaatctgaaccctcattccccgt

SEQ ID NO: 182818 - DNA, 25 bp, Homo sapien
ggaatctgaaccctcattccccgtc

SEQ ID NO: 182819 - DNA, 25 bp, Homo sapien
gaatctgaaccctcattccccgtca

SEQ ID NO: 182820 - DNA, 25 bp, Homo sapien
aatctgaaccctcattccccgtcac

SEQ ID NO: 182821 - DNA, 25 bp, Homo sapien
atctgaaccctcattccccgtcacc

SEQ ID NO: 182822 - DNA, 25 bp, Homo sapien
tctgaaccctcattccccgtcaccc

SEQ ID NO: 182823 - DNA, 25 bp, Homo sapien
ctgaaccctcattccccgtcacccg

SEQ ID NO: 182824 - DNA, 25 bp, Homo sapien
tttcccttgtgcattgttctgagca

SEQ ID NO: 182825 - DNA, 25 bp, Homo sapien
ttcccttgtgcattgttctgagcag

SEQ ID NO: 182826 - DNA, 25 bp, Homo sapien
tcccttgtgcattgttctgagcagt

SEQ ID NO: 182827 - DNA, 25 bp, Homo sapien
ccttgtgcattgttctgagcagtgt

SEQ ID NO: 182828 - DNA, 25 bp, Homo sapien
ttgtgcattgttctgagcagtgtga

SEQ ID NO: 182829 - DNA, 25 bp, Homo sapien
gtgcattgttctgagcagtgtgatg

SEQ ID NO: 182830 - DNA, 25 bp, Homo sapien
tgcttctgttcaggtcagtcttttt

SEQ ID NO: 182831 - DNA, 25 bp, Homo sapien
gcttctgttcaggtcagtctttttt

SEQ ID NO: 182832 - DNA, 25 bp, Homo sapien
tcaggtcagtctttttttacttcat

SEQ ID NO: 182833 - DNA, 25 bp, Homo sapien
atgctggtagtgatgctggctgttc

SEQ ID NO: 182834 - DNA, 25 bp, Homo sapien
tggtagtgatgctggctgttcggat

SEQ ID NO: 182835 - DNA, 25 bp, Homo sapien
aaacctgccagatatcaaacctgag

SEQ ID NO: 182836 - DNA, 25 bp, Homo sapien
taaaacgagcatttggagggcccac

SEQ ID NO: 182837 - DNA, 25 bp, Homo sapien
gagggcccacggcttcactcaggac

SEQ ID NO: 182838 - DNA, 25 bp, Homo sapien
tgggcttgtgtaccccaggagccct

SEQ ID NO: 182839 - DNA, 25 bp, Homo sapien
caggagcccttttaagtatcttttg

SEQ ID NO: 182840 - DNA, 25 bp, Homo sapien
taagtatcttttgtacgcttttcac

SEQ ID NO: 182841 - DNA, 25 bp, Homo sapien
ccaagtcctgggagaaatgcaggca

SEQ ID NO: 182842 - DNA, 25 bp, Homo sapien
gaaatgcaggcaacactgagacatg

SEQ ID NO: 182843 - DNA, 25 bp, Homo sapien
caacactgagacatgggagaggcca

SEQ ID NO: 182844 - DNA, 25 bp, Homo sapien
gagaggccaagatatgcttgacaga

SEQ ID NO: 182845 - DNA, 25 bp, Homo sapien
aaagggtgattttgaggctcagtta

SEQ ID NO: 182846 - DNA, 25 bp, Homo sapien
cctgctcccaaaaccgctggaagga

SEQ ID NO: 182847 - DNA, 25 bp, Homo sapien
ctcccaaaaccgctggaaggactgg

SEQ ID NO: 182848 - DNA, 25 bp, Homo sapien
gaaggactggggcactttctgccac

SEQ ID NO: 182849 - DNA, 25 bp, Homo sapien
tttctgccacagtagaacacagaca

SEQ ID NO: 182850 - DNA, 25 bp, Homo sapien
tagaacacagacagggcttcagatc

SEQ ID NO: 182851 - DNA, 25 bp, Homo sapien
gtggccatgcagacacgcgccctgg

SEQ ID NO: 182852 - DNA, 25 bp, Homo sapien
atcagagcccactcaggaccagcgt

SEQ ID NO: 182853 - DNA, 25 bp, Homo sapien
agcccactcaggaccagcgttcgga

SEQ ID NO: 182854 - DNA, 25 bp, Homo sapien
tcaggaccagcgttcggagctccca

SEQ ID NO: 182855 - DNA, 25 bp, Homo sapien
gttcggagctcccacctggacgcat

SEQ ID NO: 182856 - DNA, 25 bp, Homo sapien
caccacgtccggatttccttctttg

SEQ ID NO: 182857 - DNA, 25 bp, Homo sapien
gaatctgaggacatggcacagcgca

SEQ ID NO: 182858 - DNA, 25 bp, Homo sapien
ggcattacaaggagccagtcaaatt

SEQ ID NO: 182859 - DNA, 25 bp, Homo sapien
aatccgggagactcatctttggtga

SEQ ID NO: 182860 - DNA, 25 bp, Homo sapien
gactttgttgactcaaaacttgcta

SEQ ID NO: 182861 - DNA, 25 bp, Homo sapien
aaacttgctagttactgcctacctg

SEQ ID NO: 182862 - DNA, 25 bp, Homo sapien
gctagttactgcctacctgagtaga

SEQ ID NO: 182863 - DNA, 25 bp, Homo sapien
aatcttatttatgaactcctgtgta

SEQ ID NO: 182864 - DNA, 25 bp, Homo sapien
gaactcctgtgtattgcaatggtat

SEQ ID NO: 182865 - DNA, 25 bp, Homo sapien
gcaatggtatgaatctgctcatgtg

SEQ ID NO: 182866 - DNA, 25 bp, Homo sapien
gctcatgtggagactggctataaac

SEQ ID NO: 182867 - DNA, 25 bp, Homo sapien
agaacacatcacacatttaatccaa

SEQ ID NO: 182868 - DNA, 25 bp, Homo sapien
attacacatgtgagatttgctgctg

SEQ ID NO: 182869 - DNA, 25 bp, Homo sapien
acatgtgagatttgctgctgttgca

SEQ ID NO: 182870 - DNA, 25 bp, Homo sapien
gctgctgttgcagtataaacactag

SEQ ID NO: 182871 - DNA, 25 bp, Homo sapien
aacctgcaagtgaaacatttgaaac

SEQ ID NO: 182872 - DNA, 25 bp, Homo sapien
tactttctacataagacatggttgg

SEQ ID NO: 182873 - DNA, 25 bp, Homo sapien
gacatggttgggacatcagatactt

SEQ ID NO: 182874 - DNA, 25 bp, Homo sapien
ggttgggacatcagatacttacaaa

SEQ ID NO: 182875 - DNA, 25 bp, Homo sapien
ctttctctttggtttattgatttgg

SEQ ID NO: 182876 - DNA, 25 bp, Homo sapien
gatttggtttaatttccattatgct

SEQ ID NO: 182877 - DNA, 25 bp, Homo sapien
gctattttgcataatcaaggcactg

SEQ ID NO: 182878 - DNA, 25 bp, Homo sapien
atcaaggcactgtaaatcttataat

SEQ ID NO: 182879 - DNA, 25 bp, Homo sapien
tgaatatttccttgatgctggtctc

SEQ ID NO: 182880 - DNA, 25 bp, Homo sapien
ttgatgctggtctctgcacacatat

SEQ ID NO: 182881 - DNA, 25 bp, Homo sapien
atgctggtctctgcacacatatgct

SEQ ID NO: 182882 - DNA, 25 bp, Homo sapien
gcacacatatgcttggttacttgca

SEQ ID NO: 182883 - DNA, 25 bp, Homo sapien
gcttggttacttgcatgcattcatt

SEQ ID NO: 182884 - DNA, 25 bp, Homo sapien
acttgcatgcattcattggttgttc

SEQ ID NO: 182885 - DNA, 25 bp, Homo sapien
gcatgcattcattggttgttcaata

SEQ ID NO: 182886 - DNA, 25 bp, Homo sapien
gttcaataagtgagatgattacaga

SEQ ID NO: 182887 - DNA, 25 bp, Homo sapien
tatggaaaaccgttatagacccaat

SEQ ID NO: 182888 - DNA, 25 bp, Homo sapien
gaatgttgattttcataccaaagaa

SEQ ID NO: 182889 - DNA, 25 bp, Homo sapien
gagtctaaaatttggatatgattct

SEQ ID NO: 182890 - DNA, 25 bp, Homo sapien
taaggtcccaaaagtggccaggctg

SEQ ID NO: 182891 - DNA, 25 bp, Homo sapien
caggctggaggtcttctaatgtaat

SEQ ID NO: 182892 - DNA, 25 bp, Homo sapien
tttattttgagaacactgccattgg

SEQ ID NO: 182893 - DNA, 25 bp, Homo sapien
gaacactgccattggaatgtttcta

SEQ ID NO: 182894 - DNA, 25 bp, Homo sapien
ggaatgtttctacacgatcctatta

SEQ ID NO: 182895 - DNA, 25 bp, Homo sapien
aagaataatgtgatgccctttcaat

SEQ ID NO: 182896 - DNA, 25 bp, Homo sapien
tattttgttagcgtgattttagctc

SEQ ID NO: 182897 - DNA, 25 bp, Homo sapien
gattttagctctgtttgtattatga

SEQ ID NO: 182898 - DNA, 25 bp, Homo sapien
gtgacaatgtttagcaatcaaattt

SEQ ID NO: 182899 - DNA, 25 bp, Homo sapien
aatttacatgtatagatcgtcaggg

SEQ ID NO: 182900 - DNA, 25 bp, Homo sapien
gtatagatcgtcagggaatagccca

SEQ ID NO: 182901 - DNA, 25 bp, Homo sapien
catccttgtctggatattccaggcc

SEQ ID NO: 182902 - DNA, 25 bp, Homo sapien
aggcctacctggcattccaggacct

SEQ ID NO: 182903 - DNA, 25 bp, Homo sapien
tggcattccaggacctccgaaatga

SEQ ID NO: 182904 - DNA, 25 bp, Homo sapien
aggacctccgaaatgatgctccagt

SEQ ID NO: 182905 - DNA, 25 bp, Homo sapien
aaatgatgctccagtcccttacaag

SEQ ID NO: 182906 - DNA, 25 bp, Homo sapien
ccttacaagcgcttcctggatgagg

SEQ ID NO: 182907 - DNA, 25 bp, Homo sapien
actggccccaacagcctgagttatg

SEQ ID NO: 182908 - DNA, 25 bp, Homo sapien
agcctgagttatgctagctctgccc

SEQ ID NO: 182909 - DNA, 25 bp, Homo sapien
ggcttgctatgatgcctgacaacta

SEQ ID NO: 182910 - DNA, 25 bp, Homo sapien
gatgcctgacaactaaatatcctta

SEQ ID NO: 182911 - DNA, 25 bp, Homo sapien
aactaaatatccttatccaaatcaa

SEQ ID NO: 182912 - DNA, 25 bp, Homo sapien
atgacactacgggtctcacggccaa

SEQ ID NO: 182913 - DNA, 25 bp, Homo sapien
gatgaggtcttcaccaaagtgtaca

SEQ ID NO: 182914 - DNA, 25 bp, Homo sapien
tgtacaaagccaaataccccatcgt

SEQ ID NO: 182915 - DNA, 25 bp, Homo sapien
atcgtcggctacactgcccggagaa

SEQ ID NO: 182916 - DNA, 25 bp, Homo sapien
tacactgcccggagaattctcaatg

SEQ ID NO: 182917 - DNA, 25 bp, Homo sapien
attctcaatgaggatggcagcccta

SEQ ID NO: 182918 - DNA, 25 bp, Homo sapien
aggatggcagccctaacctggactt

SEQ ID NO: 182919 - DNA, 25 bp, Homo sapien
ggacttcaagcctgaagaccagccc

SEQ ID NO: 182920 - DNA, 25 bp, Homo sapien
accagccccattttgacatcaagga

SEQ ID NO: 182921 - DNA, 25 bp, Homo sapien
acactaggtgctgaatctcctgcaa

SEQ ID NO: 182922 - DNA, 25 bp, Homo sapien
cctgagccacccagatctgaataaa

SEQ ID NO: 182923 - DNA, 25 bp, Homo sapien
aacaccaagtgttagctgccttaag

SEQ ID NO: 182924 - DNA, 25 bp, Homo sapien
tggtggccatgacaacatttctgca

SEQ ID NO: 182925 - DNA, 25 bp, Homo sapien
gactgaagacaacatgcttttctat

SEQ ID NO: 182926 - DNA, 25 bp, Homo sapien
gcttttctatacaatattccgcttt

SEQ ID NO: 182927 - DNA, 25 bp, Homo sapien
gcttttttgaacagcgaaaccagcg

SEQ ID NO: 182928 - DNA, 25 bp, Homo sapien
gaaaccagcgtttgcgagggagccc

SEQ ID NO: 182929 - DNA, 25 bp, Homo sapien
gcgagggagccccaatttcacacca

SEQ ID NO: 182930 - DNA, 25 bp, Homo sapien
cactgtgaagaacatgttgcttttt

SEQ ID NO: 182931 - DNA, 25 bp, Homo sapien
ggagaccaagctctaatgaggccta

SEQ ID NO: 182932 - DNA, 25 bp, Homo sapien
gaggcctacaacattctgaaatcac

SEQ ID NO: 182933 - DNA, 25 bp, Homo sapien
attctgaaatcacttgctgtttttt

SEQ ID NO: 182934 - DNA, 25 bp, Homo sapien
ccagcagactggcttctccgactca

SEQ ID NO: 182935 - DNA, 25 bp, Homo sapien
catgcacccccaggctctgcatcca

SEQ ID NO: 182936 - DNA, 25 bp, Homo sapien
cagcccctggactccttgcttcccc

SEQ ID NO: 182937 - DNA, 25 bp, Homo sapien
cagctccctgtgcagatgcagccag

SEQ ID NO: 182938 - DNA, 25 bp, Homo sapien
agctccctgtgcagatgcagccagc

SEQ ID NO: 182939 - DNA, 25 bp, Homo sapien
ctccctgtgcagatgcagccagcag

SEQ ID NO: 182940 - DNA, 25 bp, Homo sapien
tccctgtgcagatgcagccagcagg

SEQ ID NO: 182941 - DNA, 25 bp, Homo sapien
ccctgtgcagatgcagccagcagga

SEQ ID NO: 182942 - DNA, 25 bp, Homo sapien
cctgtgcagatgcagccagcaggaa

SEQ ID NO: 182943 - DNA, 25 bp, Homo sapien
ctgtgcagatgcagccagcaggaaa

SEQ ID NO: 182944 - DNA, 25 bp, Homo sapien
tggccctcggctccccttcatccaa

SEQ ID NO: 182945 - DNA, 25 bp, Homo sapien
gggctccctggttctgagcatcatc

SEQ ID NO: 182946 - DNA, 25 bp, Homo sapien
ccctctgcactttgtttacttgttt

SEQ ID NO: 182947 - DNA, 25 bp, Homo sapien
tgtttacttgttttgcacagacgtg

SEQ ID NO: 182948 - DNA, 25 bp, Homo sapien
tttacttgttttgcacagacgtggg

SEQ ID NO: 182949 - DNA, 25 bp, Homo sapien
acttgttttgcacagacgtgggcct

SEQ ID NO: 182950 - DNA, 25 bp, Homo sapien
ttgttttgcacagacgtgggcctgg

SEQ ID NO: 182951 - DNA, 25 bp, Homo sapien
tttgcacagacgtgggcctgggcct

SEQ ID NO: 182952 - DNA, 25 bp, Homo sapien
tctcagcagccgccttctagttggg

SEQ ID NO: 182953 - DNA, 25 bp, Homo sapien
gggctagtcgctgatctgccggctc

SEQ ID NO: 182954 - DNA, 25 bp, Homo sapien
actaggggagccgaattctacaatc

SEQ ID NO: 182955 - DNA, 25 bp, Homo sapien
agccgaattctacaatcccgctggg

SEQ ID NO: 182956 - DNA, 25 bp, Homo sapien
tacgcccaagttttgctccttgaga

SEQ ID NO: 182957 - DNA, 25 bp, Homo sapien
agcagattggctgatgcccctgcaa

SEQ ID NO: 182958 - DNA, 25 bp, Homo sapien
agctctgcctcaaagaccgagtgac

SEQ ID NO: 182959 - DNA, 25 bp, Homo sapien
gaccgagtgacataagccattccca

SEQ ID NO: 182960 - DNA, 25 bp, Homo sapien
tcctaggttcacatccagggctgtg

SEQ ID NO: 182961 - DNA, 25 bp, Homo sapien
acatccagggctgtgtcttccttgg

SEQ ID NO: 182962 - DNA, 25 bp, Homo sapien
ttagatcagggtaaggcagtcaggc

SEQ ID NO: 182963 - DNA, 25 bp, Homo sapien
gcagtcaggcgggtgttcaccactg

SEQ ID NO: 182964 - DNA, 25 bp, Homo sapien
ttttcttcctctgagcgtgagaaca

SEQ ID NO: 182965 - DNA, 25 bp, Homo sapien
gtgagaacactgaacccagccactg

SEQ ID NO: 182966 - DNA, 25 bp, Homo sapien
gggtccctgtcctggaaatggtcta

SEQ ID NO: 182967 - DNA, 25 bp, Homo sapien
atttcatttctggagctccatttgt

SEQ ID NO: 182968 - DNA, 25 bp, Homo sapien
aaactacagatgtcaactccttggg

SEQ ID NO: 182969 - DNA, 25 bp, Homo sapien
ggtgctgatctcgagtgttattttc

SEQ ID NO: 182970 - DNA, 25 bp, Homo sapien
ggtgttgagagttgcactcccagaa

SEQ ID NO: 182971 - DNA, 25 bp, Homo sapien
aagagatacatttatagccctaggg

SEQ ID NO: 182972 - DNA, 25 bp, Homo sapien
tggtatgacccaaaggttcctctgt

SEQ ID NO: 182973 - DNA, 25 bp, Homo sapien
gttcctctgtgacaaggttggcctt

SEQ ID NO: 182974 - DNA, 25 bp, Homo sapien
ttggccttgggaatagttggctgcc

SEQ ID NO: 182975 - DNA, 25 bp, Homo sapien
gaatagttggctgccaatctccctg

SEQ ID NO: 182976 - DNA, 25 bp, Homo sapien
ctgctcttggttctcctctagattg

SEQ ID NO: 182977 - DNA, 25 bp, Homo sapien
gattgaagtttgttttctgatgctg

SEQ ID NO: 182978 - DNA, 25 bp, Homo sapien
gcgtacgacaatgcggtcaacctta

SEQ ID NO: 182979 - DNA, 25 bp, Homo sapien
ggtcaaccttagctggaaacacctt

SEQ ID NO: 182980 - DNA, 25 bp, Homo sapien
accttctaagcccttttgggtgctg

SEQ ID NO: 182981 - DNA, 25 bp, Homo sapien
tggtggagtcctggcttgctatagc

SEQ ID NO: 182982 - DNA, 25 bp, Homo sapien
agtcctggcttgctatagcttgcta

SEQ ID NO: 182983 - DNA, 25 bp, Homo sapien
tagcttgctagtaacagtggccttt

SEQ ID NO: 182984 - DNA, 25 bp, Homo sapien
aacagtggcctttattattttctgg

SEQ ID NO: 182985 - DNA, 25 bp, Homo sapien
aggctcctgcacagtgactacatga

SEQ ID NO: 182986 - DNA, 25 bp, Homo sapien
tgactacatgaacatgactccccgc

SEQ ID NO: 182987 - DNA, 25 bp, Homo sapien
agtcgcccatgcttgtagcgtacga

SEQ ID NO: 182988 - DNA, 25 bp, Homo sapien
gcccatgcttgtagcgtacgacaat

SEQ ID NO: 182989 - DNA, 25 bp, Homo sapien
actgccattgagatgccttgccatc

SEQ ID NO: 182990 - DNA, 25 bp, Homo sapien
atcaccttttccattccagctgcat

SEQ ID NO: 182991 - DNA, 25 bp, Homo sapien
attctgccctggctaagcaagacaa

SEQ ID NO: 182992 - DNA, 25 bp, Homo sapien
gcaagacaaattcctgtcccttgtg

SEQ ID NO: 182993 - DNA, 25 bp, Homo sapien
tgtgccgctatgagctgcccactga

SEQ ID NO: 182994 - DNA, 25 bp, Homo sapien
tgcccactgatgacgacacttatga

SEQ ID NO: 182995 - DNA, 25 bp, Homo sapien
gacacttatgaggagcacagacgag

SEQ ID NO: 182996 - DNA, 25 bp, Homo sapien
agcaacaccgactggagaacctcca

SEQ ID NO: 182997 - DNA, 25 bp, Homo sapien
ccatggagccatgtacacgtgagga

SEQ ID NO: 182998 - DNA, 25 bp, Homo sapien
ctgcgtcttccttattaaccttgaa

SEQ ID NO: 182999 - DNA, 25 bp, Homo sapien
tgaatcctcattaaaggtttcttta

SEQ ID NO: 183000 - DNA, 25 bp, Homo sapien
gccaaccttcaacgggatcactact

SEQ ID NO: 183001 - DNA, 25 bp, Homo sapien
ccaaccttcaacgggatcactactt

SEQ ID NO: 183002 - DNA, 25 bp, Homo sapien
caaccttcaacgggatcactacttt

SEQ ID NO: 183003 - DNA, 25 bp, Homo sapien
ccttcaacgggatcactactttact

SEQ ID NO: 183004 - DNA, 25 bp, Homo sapien
cttcaacgggatcactactttactt

SEQ ID NO: 183005 - DNA, 25 bp, Homo sapien
ttcaacgggatcactactttactta

SEQ ID NO: 183006 - DNA, 25 bp, Homo sapien
tcaacgggatcactactttacttag

SEQ ID NO: 183007 - DNA, 25 bp, Homo sapien
caacgggatcactactttacttagg

SEQ ID NO: 183008 - DNA, 25 bp, Homo sapien
gggcttctccagaggctcgagagca

SEQ ID NO: 183009 - DNA, 25 bp, Homo sapien
tcgagagcaggccatttcccaagaa

SEQ ID NO: 183010 - DNA, 25 bp, Homo sapien
gagcaggccatttcccaagaagatg

SEQ ID NO: 183011 - DNA, 25 bp, Homo sapien
tagtatagactcctccgcggaagat

SEQ ID NO: 183012 - DNA, 25 bp, Homo sapien
gactccatggagactcttaggaagc

SEQ ID NO: 183013 - DNA, 25 bp, Homo sapien
agcgttagaggaaaccacataggag

SEQ ID NO: 183014 - DNA, 25 bp, Homo sapien
gaggaaaccacataggagctggaac

SEQ ID NO: 183015 - DNA, 25 bp, Homo sapien
ataggagctggaacctgttaatgga

SEQ ID NO: 183016 - DNA, 25 bp, Homo sapien
aagcagtcacagctggaggtttttc

SEQ ID NO: 183017 - DNA, 25 bp, Homo sapien
agtcacagctggaggtttttcggaa

SEQ ID NO: 183018 - DNA, 25 bp, Homo sapien
cacagctggaggtttttcggaagaa

SEQ ID NO: 183019 - DNA, 25 bp, Homo sapien
ggaaagaggactttctgtctgtgtc

SEQ ID NO: 183020 - DNA, 25 bp, Homo sapien
cagatattattgactacttcaggaa

SEQ ID NO: 183021 - DNA, 25 bp, Homo sapien
ggaaaatgccacttctgctcattga

SEQ ID NO: 183022 - DNA, 25 bp, Homo sapien
gccacttctgctcattgatgggaaa

SEQ ID NO: 183023 - DNA, 25 bp, Homo sapien
aaccgaggttccagataccagtgca

SEQ ID NO: 183024 - DNA, 25 bp, Homo sapien
taccagtgcacattaacgcatgctg

SEQ ID NO: 183025 - DNA, 25 bp, Homo sapien
taacgcatgctgcagggtacccata

SEQ ID NO: 183026 - DNA, 25 bp, Homo sapien
ggtacccatagcaagttatagccga

SEQ ID NO: 183027 - DNA, 25 bp, Homo sapien
tctgttgccaacacgagatcaatca

SEQ ID NO: 183028 - DNA, 25 bp, Homo sapien
gatcaatcagccttggtcaatggac

SEQ ID NO: 183029 - DNA, 25 bp, Homo sapien
cacttaggactgaactgaacccctc

SEQ ID NO: 183030 - DNA, 25 bp, Homo sapien
ttgggccatgagagcaatgcagcat

SEQ ID NO: 183031 - DNA, 25 bp, Homo sapien
gcagcatgctgaagtctattacaag

SEQ ID NO: 183032 - DNA, 25 bp, Homo sapien
agtctattacaagctgatttcatca

SEQ ID NO: 183033 - DNA, 25 bp, Homo sapien
gatttcatcagttgacccacagttc

SEQ ID NO: 183034 - DNA, 25 bp, Homo sapien
agttgacccacagttcctgaaactc

SEQ ID NO: 183035 - DNA, 25 bp, Homo sapien
gaaactcaccaaagtagatgaccaa

SEQ ID NO: 183036 - DNA, 25 bp, Homo sapien
gatgaccaaatttactctgagttcc

SEQ ID NO: 183037 - DNA, 25 bp, Homo sapien
taggatagatgtgttggacccagaa

SEQ ID NO: 183038 - DNA, 25 bp, Homo sapien
agtggaggccattctgcttgaagtt

SEQ ID NO: 183039 - DNA, 25 bp, Homo sapien
gacttcaactatggtactttgctgc

SEQ ID NO: 183040 - DNA, 25 bp, Homo sapien
atggtactttgctgcgactagattg

SEQ ID NO: 183041 - DNA, 25 bp, Homo sapien
tctgatgtcaccctggtacctgtgt

SEQ ID NO: 183042 - DNA, 25 bp, Homo sapien
tgatgtcaccctggtacctgtgtcc

SEQ ID NO: 183043 - DNA, 25 bp, Homo sapien
aactggagaaggctggcgccgggct

SEQ ID NO: 183044 - DNA, 25 bp, Homo sapien
agctccctctgcttggtgctcagca

SEQ ID NO: 183045 - DNA, 25 bp, Homo sapien
tctgcttggtgctcagcacacgccc

SEQ ID NO: 183046 - DNA, 25 bp, Homo sapien
gagggttagatagagaatgctgaat

SEQ ID NO: 183047 - DNA, 25 bp, Homo sapien
gagaatgctgaataggcagtagttg

SEQ ID NO: 183048 - DNA, 25 bp, Homo sapien
gcagtagttgggagagagcctcaat

SEQ ID NO: 183049 - DNA, 25 bp, Homo sapien
gtagttgggagagagcctcaatatt

SEQ ID NO: 183050 - DNA, 25 bp, Homo sapien
agttgggagagagcctcaatattgg

SEQ ID NO: 183051 - DNA, 25 bp, Homo sapien
gatccactgggtgaatcctccctct

SEQ ID NO: 183052 - DNA, 25 bp, Homo sapien
gtcttccggccacactgaggacaag

SEQ ID NO: 183053 - DNA, 25 bp, Homo sapien
acactgaggacaaggccggcggctc

SEQ ID NO: 183054 - DNA, 25 bp, Homo sapien
cagtggccaacgcacccgcaaaaag

SEQ ID NO: 183055 - DNA, 25 bp, Homo sapien
tataccaagtaccagatccgagagc

SEQ ID NO: 183056 - DNA, 25 bp, Homo sapien
gagctggaacgggagttcttcttca

SEQ ID NO: 183057 - DNA, 25 bp, Homo sapien
aacgggagttcttcttcagcgtcta

SEQ ID NO: 183058 - DNA, 25 bp, Homo sapien
agttcttcttcagcgtctacattaa

SEQ ID NO: 183059 - DNA, 25 bp, Homo sapien
ttcttcagcgtctacattaacaaag

SEQ ID NO: 183060 - DNA, 25 bp, Homo sapien
attaacaaagagaagcgcctgcaac

SEQ ID NO: 183061 - DNA, 25 bp, Homo sapien
agaagcgcctgcaactgtcccgcat

SEQ ID NO: 183062 - DNA, 25 bp, Homo sapien
aacagagaccgtttacagtactact

SEQ ID NO: 183063 - DNA, 25 bp, Homo sapien
aggtgtttgctgacgtccagtgtac

SEQ ID NO: 183064 - DNA, 25 bp, Homo sapien
gctgacgtccagtgtacagtgaatc

SEQ ID NO: 183065 - DNA, 25 bp, Homo sapien
cagtgtacagtgaatctggtaggcg

SEQ ID NO: 183066 - DNA, 25 bp, Homo sapien
tgaaccagcctggtccactgggaac

SEQ ID NO: 183067 - DNA, 25 bp, Homo sapien
agcctggtccactgggaactcaaaa

SEQ ID NO: 183068 - DNA, 25 bp, Homo sapien
gggaactcaaaagcccacgtcagga

SEQ ID NO: 183069 - DNA, 25 bp, Homo sapien
aaaagcccacgtcaggaccacagac

SEQ ID NO: 183070 - DNA, 25 bp, Homo sapien
aggcccagcagaagagcctccttca

SEQ ID NO: 183071 - DNA, 25 bp, Homo sapien
aagagcctccttcagcagctactga

SEQ ID NO: 183072 - DNA, 25 bp, Homo sapien
gctactgactgaataaccactttta

SEQ ID NO: 183073 - DNA, 25 bp, Homo sapien
gagatttttgatatctcaatctgca

SEQ ID NO: 183074 - DNA, 25 bp, Homo sapien
ctccagaggctcgagagcaggccat

SEQ ID NO: 183075 - DNA, 25 bp, Homo sapien
tccagaggctcgagagcaggccatt

SEQ ID NO: 183076 - DNA, 25 bp, Homo sapien
ccagaggctcgagagcaggccattt

SEQ ID NO: 183077 - DNA, 25 bp, Homo sapien
cagaggctcgagagcaggccatttc

SEQ ID NO: 183078 - DNA, 25 bp, Homo sapien
agaggctcgagagcaggccatttcc

SEQ ID NO: 183079 - DNA, 25 bp, Homo sapien
gaggctcgagagcaggccatttccc

SEQ ID NO: 183080 - DNA, 25 bp, Homo sapien
aggctcgagagcaggccatttccca

SEQ ID NO: 183081 - DNA, 25 bp, Homo sapien
ggctcgagagcaggccatttcccaa

SEQ ID NO: 183082 - DNA, 25 bp, Homo sapien
tcgagagcaggccatttcccaagaa

SEQ ID NO: 183083 - DNA, 25 bp, Homo sapien
cgagagcaggccatttcccaagaag

SEQ ID NO: 183084 - DNA, 25 bp, Homo sapien
ctgtgtttttattgaaggaatttca

SEQ ID NO: 183085 - DNA, 25 bp, Homo sapien
attgtctccccacaactgtgacatt

SEQ ID NO: 183086 - DNA, 25 bp, Homo sapien
aactgtgacattccggcatcgctgg

SEQ ID NO: 183087 - DNA, 25 bp, Homo sapien
catcgctggcgttcaagggaatgca

SEQ ID NO: 183088 - DNA, 25 bp, Homo sapien
gcgttcaagggaatgcaggcagcca

SEQ ID NO: 183089 - DNA, 25 bp, Homo sapien
aaggtagtcattctgtcacggcttc

SEQ ID NO: 183090 - DNA, 25 bp, Homo sapien
ggcttccgcgctctgatgggaaatt

SEQ ID NO: 183091 - DNA, 25 bp, Homo sapien
atgggaaattccgtctccagcagct

SEQ ID NO: 183092 - DNA, 25 bp, Homo sapien
acccttctgccttgaaagctggctg

SEQ ID NO: 183093 - DNA, 25 bp, Homo sapien
gaaagctggctgtacggactcacat

SEQ ID NO: 183094 - DNA, 25 bp, Homo sapien
tacggactcacatcctttgtgctaa

SEQ ID NO: 183095 - DNA, 25 bp, Homo sapien
atcctttgtgctaatgacacttaca

SEQ ID NO: 183096 - DNA, 25 bp, Homo sapien
aatatcacttaaatcgaggcagaaa

SEQ ID NO: 183097 - DNA, 25 bp, Homo sapien
gcatttaaaataccactgtaattga

SEQ ID NO: 183098 - DNA, 25 bp, Homo sapien
caaaaccttgtgtaagaggctgact

SEQ ID NO: 183099 - DNA, 25 bp, Homo sapien
tgtgtaagaggctgacttttccaaa

SEQ ID NO: 183100 - DNA, 25 bp, Homo sapien
aggaaaatattgctgtgtcttcatt

SEQ ID NO: 183101 - DNA, 25 bp, Homo sapien
gtcttcattttcattaccaggtttc

SEQ ID NO: 183102 - DNA, 25 bp, Homo sapien
taccaggtttcattttgggccttgc

SEQ ID NO: 183103 - DNA, 25 bp, Homo sapien
caggtttcattttgggccttgctaa

SEQ ID NO: 183104 - DNA, 25 bp, Homo sapien
ttgggccttgctaaattgattgaat

SEQ ID NO: 183105 - DNA, 25 bp, Homo sapien
ttgaattaaatcctccagcttttga

SEQ ID NO: 183106 - DNA, 25 bp, Homo sapien
taaatcctccagcttttgaaccttg

SEQ ID NO: 183107 - DNA, 25 bp, Homo sapien
ttctggtgagaaaaagcgtgacatt

SEQ ID NO: 183108 - DNA, 25 bp, Homo sapien
tgacatttgctctgatccctggaat

SEQ ID NO: 183109 - DNA, 25 bp, Homo sapien
tgctctgatccctggaataggtgtt

SEQ ID NO: 183110 - DNA, 25 bp, Homo sapien
ccctggaataggtgttgcgtatcaa

SEQ ID NO: 183111 - DNA, 25 bp, Homo sapien
aggtgttgcgtatcaaatacagatg

SEQ ID NO: 183112 - DNA, 25 bp, Homo sapien
gaaaccagagatggatggcagatct

SEQ ID NO: 183113 - DNA, 25 bp, Homo sapien
agatggatggcagatctgggatcta

SEQ ID NO: 183114 - DNA, 25 bp, Homo sapien
taaaatataagctcccggaaggcag

SEQ ID NO: 183115 - DNA, 25 bp, Homo sapien
taagctcccggaaggcagggatgtt

SEQ ID NO: 183116 - DNA, 25 bp, Homo sapien
gatgttgaagtatcccaagggctta

SEQ ID NO: 183117 - DNA, 25 bp, Homo sapien
tgaagtatcccaagggcttaaagga

SEQ ID NO: 183118 - DNA, 25 bp, Homo sapien
tcacgatggcgcgacgtctgcagaa

SEQ ID NO: 183119 - DNA, 25 bp, Homo sapien
tggcgcgacgtctgcagaaatttca

SEQ ID NO: 183120 - DNA, 25 bp, Homo sapien
aaatttcatgaggaggtatcagtct

SEQ ID NO: 183121 - DNA, 25 bp, Homo sapien
catgaggaggtatcagtctagagtt

SEQ ID NO: 183122 - DNA, 25 bp, Homo sapien
cctcgtggccggagaaactgcccag

SEQ ID NO: 183123 - DNA, 25 bp, Homo sapien
aactgcccagcagatctgtgaggac

SEQ ID NO: 183124 - DNA, 25 bp, Homo sapien
cagcagatctgtgaggacctcaggt

SEQ ID NO: 183125 - DNA, 25 bp, Homo sapien
ggacctcaggttgtgtataccttct

SEQ ID NO: 183126 - DNA, 25 bp, Homo sapien
gttgtgtataccttctacaggtccc

SEQ ID NO: 183127 - DNA, 25 bp, Homo sapien
tataccttctacaggtcccctctga

SEQ ID NO: 183128 - DNA, 25 bp, Homo sapien
agaagcacaggctcctgtcctcaga

SEQ ID NO: 183129 - DNA, 25 bp, Homo sapien
ggcccaagtttctaagggaggcact

SEQ ID NO: 183130 - DNA, 25 bp, Homo sapien
ctgaggcaagccatggagtgagacc

SEQ ID NO: 183131 - DNA, 25 bp, Homo sapien
gcaagccatggagtgagacccagga

SEQ ID NO: 183132 - DNA, 25 bp, Homo sapien
gagtgagacccaggagccggacact

SEQ ID NO: 183133 - DNA, 25 bp, Homo sapien
aggagccggacacttctcaggaaat

SEQ ID NO: 183134 - DNA, 25 bp, Homo sapien
ccggacacttctcaggaaatggctt

SEQ ID NO: 183135 - DNA, 25 bp, Homo sapien
acttctcaggaaatggcttttccca

SEQ ID NO: 183136 - DNA, 25 bp, Homo sapien
cttcctgttctgtgactgtgtatag

SEQ ID NO: 183137 - DNA, 25 bp, Homo sapien
tgtgactgtgtatagtgccaccaca

SEQ ID NO: 183138 - DNA, 25 bp, Homo sapien
agcttatggcatctcattgaggaca

SEQ ID NO: 183139 - DNA, 25 bp, Homo sapien
atggcatctcattgaggacaaagaa

SEQ ID NO: 183140 - DNA, 25 bp, Homo sapien
cttggacacagctggcttatcctat

SEQ ID NO: 183141 - DNA, 25 bp, Homo sapien
tggcttatcctatacagttgtcaat

SEQ ID NO: 183142 - DNA, 25 bp, Homo sapien
acagaatacaacctcatgctccctg

SEQ ID NO: 183143 - DNA, 25 bp, Homo sapien
ctggcattctgcatgtttagtgatt

SEQ ID NO: 183144 - DNA, 25 bp, Homo sapien
tgattgtcttgggaatgtttcactg

SEQ ID NO: 183145 - DNA, 25 bp, Homo sapien
aatgtttcactgctacccgcatcca

SEQ ID NO: 183146 - DNA, 25 bp, Homo sapien
atccagcgactgcagcaccagaaaa

SEQ ID NO: 183147 - DNA, 25 bp, Homo sapien
tgcagcaccagaaaacgactaatgt

SEQ ID NO: 183148 - DNA, 25 bp, Homo sapien
tgcagagttgtttggacttcttcct

SEQ ID NO: 183149 - DNA, 25 bp, Homo sapien
agttgtttggacttcttcctgtgcc

SEQ ID NO: 183150 - DNA, 25 bp, Homo sapien
ggacctgaagaatcaatctgtgtga

SEQ ID NO: 183151 - DNA, 25 bp, Homo sapien
taaaatcctcaggaagtgggaagag

SEQ ID NO: 183152 - DNA, 25 bp, Homo sapien
ggaagagaatactgcctcccagcct

SEQ ID NO: 183153 - DNA, 25 bp, Homo sapien
gctgatatgttattggagacaggct

SEQ ID NO: 183154 - DNA, 25 bp, Homo sapien
gagacaggcttttgaaactgctcca

SEQ ID NO: 183155 - DNA, 25 bp, Homo sapien
ggcttttgaaactgctccagctatt

SEQ ID NO: 183156 - DNA, 25 bp, Homo sapien
gctccagctatttctctgtaacctt

SEQ ID NO: 183157 - DNA, 25 bp, Homo sapien
gctatttctctgtaacctttagtta

SEQ ID NO: 183158 - DNA, 25 bp, Homo sapien
ggaggctcaggaaattttctaaatt

SEQ ID NO: 183159 - DNA, 25 bp, Homo sapien
cacacatatacacccgtggagggag

SEQ ID NO: 183160 - DNA, 25 bp, Homo sapien
ggaagagtatacagtcctgtttgaa

SEQ ID NO: 183161 - DNA, 25 bp, Homo sapien
atacagtcctgtttgaatcatttgg

SEQ ID NO: 183162 - DNA, 25 bp, Homo sapien
tcaggctctgcttcgtgacccgtga

SEQ ID NO: 183163 - DNA, 25 bp, Homo sapien
tctgcttcgtgacccgtgacccatg

SEQ ID NO: 183164 - DNA, 25 bp, Homo sapien
cgtgacccatgacccacagtgctgg

SEQ ID NO: 183165 - DNA, 25 bp, Homo sapien
gggccactatagcagccaccagaag

SEQ ID NO: 183166 - DNA, 25 bp, Homo sapien
ggccctcagggaagcccaaggcctg

SEQ ID NO: 183167 - DNA, 25 bp, Homo sapien
ctgcgcccctgtctttgtaaattga

SEQ ID NO: 183168 - DNA, 25 bp, Homo sapien
tgtaaattgacccttctggagtggg

SEQ ID NO: 183169 - DNA, 25 bp, Homo sapien
cgggcagggcttgcctttcttagtc

SEQ ID NO: 183170 - DNA, 25 bp, Homo sapien
agggcttgcctttcttagtctgatg

SEQ ID NO: 183171 - DNA, 25 bp, Homo sapien
tttcttagtctgatgccaagcaagg

SEQ ID NO: 183172 - DNA, 25 bp, Homo sapien
ttagtctgatgccaagcaaggcctt

SEQ ID NO: 183173 - DNA, 25 bp, Homo sapien
ttgagggaaaaaaccatgaccaagt

SEQ ID NO: 183174 - DNA, 25 bp, Homo sapien
gataaattcaaaaaatagcctcatg

SEQ ID NO: 183175 - DNA, 25 bp, Homo sapien
agcctcatgagacttggcatacaca

SEQ ID NO: 183176 - DNA, 25 bp, Homo sapien
atgagacttggcatacacactcgtg

SEQ ID NO: 183177 - DNA, 25 bp, Homo sapien
gacttggcatacacactcgtgggat

SEQ ID NO: 183178 - DNA, 25 bp, Homo sapien
gcatacacactcgtgggattccagt

SEQ ID NO: 183179 - DNA, 25 bp, Homo sapien
acactcgtgggattccagttattat

SEQ ID NO: 183180 - DNA, 25 bp, Homo sapien
gttattatggagtgcttccatccct

SEQ ID NO: 183181 - DNA, 25 bp, Homo sapien
attatggagtgcttccatccctctc

SEQ ID NO: 183182 - DNA, 25 bp, Homo sapien
caaaaggttttctttgcaagtgctt

SEQ ID NO: 183183 - DNA, 25 bp, Homo sapien
gttttctttgcaagtgcttttggaa

SEQ ID NO: 183184 - DNA, 25 bp, Homo sapien
actctgttctaaggtgtttattgta

SEQ ID NO: 183185 - DNA, 25 bp, Homo sapien
gtaatgggtttgcagtgataagtca

SEQ ID NO: 183186 - DNA, 25 bp, Homo sapien
tgataagtcatacttttccaccgaa

SEQ ID NO: 183187 - DNA, 25 bp, Homo sapien
gagggcttgggaatccctgagatta

SEQ ID NO: 183188 - DNA, 25 bp, Homo sapien
aatccctgagattagctaaagttaa

SEQ ID NO: 183189 - DNA, 25 bp, Homo sapien
gggatgctcctggtttgtccatcta

SEQ ID NO: 183190 - DNA, 25 bp, Homo sapien
gtttgtccatctactgctttgattc

SEQ ID NO: 183191 - DNA, 25 bp, Homo sapien
tactgctttgattccttggatccca

SEQ ID NO: 183192 - DNA, 25 bp, Homo sapien
tcccacccattctttcactttaaga

SEQ ID NO: 183193 - DNA, 25 bp, Homo sapien
caaataattgttgcagaggtctctg

SEQ ID NO: 183194 - DNA, 25 bp, Homo sapien
gaggtctctgtattttgcagctgcc

SEQ ID NO: 183195 - DNA, 25 bp, Homo sapien
atgatctacattttttatgaagatg

SEQ ID NO: 183196 - DNA, 25 bp, Homo sapien
ggttggagaaattagcacttgcctt

SEQ ID NO: 183197 - DNA, 25 bp, Homo sapien
ttggagaaattagcacttgccttga

SEQ ID NO: 183198 - DNA, 25 bp, Homo sapien
agcacttgccttgaaaagatattat

SEQ ID NO: 183199 - DNA, 25 bp, Homo sapien
gagaggttagtttcagagtgctcca

SEQ ID NO: 183200 - DNA, 25 bp, Homo sapien
ggttagtttcagagtgctccaaaaa

SEQ ID NO: 183201 - DNA, 25 bp, Homo sapien
gaacattctcaaaacgtaaataggt

SEQ ID NO: 183202 - DNA, 25 bp, Homo sapien
gtatctagagaagtgagtactcaac

SEQ ID NO: 183203 - DNA, 25 bp, Homo sapien
gtgagtactcaacatttggtatatt

SEQ ID NO: 183204 - DNA, 25 bp, Homo sapien
caacatttggtatattgttttgagt

SEQ ID NO: 183205 - DNA, 25 bp, Homo sapien
tgttttgagtaatggatgtttgttt

SEQ ID NO: 183206 - DNA, 25 bp, Homo sapien
gttttctgacttacaattgaaagag

SEQ ID NO: 183207 - DNA, 25 bp, Homo sapien
ttctgacttacaattgaaagagttc

SEQ ID NO: 183208 - DNA, 25 bp, Homo sapien
aaagccaaaaggtggccaggcttgg

SEQ ID NO: 183209 - DNA, 25 bp, Homo sapien
aagccaaaaggtggccaggcttggt

SEQ ID NO: 183210 - DNA, 25 bp, Homo sapien
aggtagtggtgagcaaagatcgtac

SEQ ID NO: 183211 - DNA, 25 bp, Homo sapien
gtagtggtgagcaaagatcgtaccg

SEQ ID NO: 183212 - DNA, 25 bp, Homo sapien
tagtggtgagcaaagatcgtaccgc

SEQ ID NO: 183213 - DNA, 25 bp, Homo sapien
agtggtgagcaaagatcgtaccgct

SEQ ID NO: 183214 - DNA, 25 bp, Homo sapien
gtggtgagcaaagatcgtaccgctg

SEQ ID NO: 183215 - DNA, 25 bp, Homo sapien
tggtgagcaaagatcgtaccgctgc

SEQ ID NO: 183216 - DNA, 25 bp, Homo sapien
ggtgagcaaagatcgtaccgctgca

SEQ ID NO: 183217 - DNA, 25 bp, Homo sapien
tctttctgacacttctctcctattt

SEQ ID NO: 183218 - DNA, 25 bp, Homo sapien
acattatcacttatctcttcttcaa

SEQ ID NO: 183219 - DNA, 25 bp, Homo sapien
aagacccgttcttgtagcatgctct

SEQ ID NO: 183220 - DNA, 25 bp, Homo sapien
gcatgctctgtaaagcactgtccac

SEQ ID NO: 183221 - DNA, 25 bp, Homo sapien
gtgcctcccacttcatggtagttat

SEQ ID NO: 183222 - DNA, 25 bp, Homo sapien
atgcacctgttcttttcacctatat

SEQ ID NO: 183223 - DNA, 25 bp, Homo sapien
atccatcctgcgttagagagcttca

SEQ ID NO: 183224 - DNA, 25 bp, Homo sapien
cttcatggaccaggaccggattgtt

SEQ ID NO: 183225 - DNA, 25 bp, Homo sapien
ggattgttgccatcatgtacactgt

SEQ ID NO: 183226 - DNA, 25 bp, Homo sapien
tgtggtcactcctgtactaaaccca

SEQ ID NO: 183227 - DNA, 25 bp, Homo sapien
ctaaacccactgatctatactttga

SEQ ID NO: 183228 - DNA, 25 bp, Homo sapien
aagaggaggacgtgccagaccagga

SEQ ID NO: 183229 - DNA, 25 bp, Homo sapien
gacgtgccagaccaggaacagagca

SEQ ID NO: 183230 - DNA, 25 bp, Homo sapien
tgccagaccaggaacagagcagcag

SEQ ID NO: 183231 - DNA, 25 bp, Homo sapien
ccagaccaggaacagagcagcagca

SEQ ID NO: 183232 - DNA, 25 bp, Homo sapien
gcagcagcatcgagaccccatcaga

SEQ ID NO: 183233 - DNA, 25 bp, Homo sapien
agcagcatcgagaccccatcagagg

SEQ ID NO: 183234 - DNA, 25 bp, Homo sapien
gagagctagcagatatgcctgttca

SEQ ID NO: 183235 - DNA, 25 bp, Homo sapien
tagcagatatgcctgttcacccctc

SEQ ID NO: 183236 - DNA, 25 bp, Homo sapien
gttcacccctctctggtacttgtgg

SEQ ID NO: 183237 - DNA, 25 bp, Homo sapien
taatctcgggcattgtttgcattgt

SEQ ID NO: 183238 - DNA, 25 bp, Homo sapien
cgggcattgtttgcattgtgtttat

SEQ ID NO: 183239 - DNA, 25 bp, Homo sapien
cagtacctcaagatcatggcaggca

SEQ ID NO: 183240 - DNA, 25 bp, Homo sapien
gcaggcagcaagtgaagccccagct

SEQ ID NO: 183241 - DNA, 25 bp, Homo sapien
agctggactcatggatgtgcaccct

SEQ ID NO: 183242 - DNA, 25 bp, Homo sapien
gactcatggatgtgcaccctttgct

SEQ ID NO: 183243 - DNA, 25 bp, Homo sapien
ctctttctgcctctgggctcatgta

SEQ ID NO: 183244 - DNA, 25 bp, Homo sapien
tctgggctcatgtatctgcgcagct

SEQ ID NO: 183245 - DNA, 25 bp, Homo sapien
atgtatctgcgcagctctggtaccc

SEQ ID NO: 183246 - DNA, 25 bp, Homo sapien
tctggtaccctctgtgggtgccatc

SEQ ID NO: 183247 - DNA, 25 bp, Homo sapien
ctctgtgggtgccatctctacctct

SEQ ID NO: 183248 - DNA, 25 bp, Homo sapien
aaggagccaaggaccacagagcctc

SEQ ID NO: 183249 - DNA, 25 bp, Homo sapien
ccaggatccgtcctcattttattgg

SEQ ID NO: 183250 - DNA, 25 bp, Homo sapien
agtaccaagaacagtcaaacccatg

SEQ ID NO: 183251 - DNA, 25 bp, Homo sapien
aacagtcaaacccatggagacagaa

SEQ ID NO: 183252 - DNA, 25 bp, Homo sapien
ctttgtgtcgtgatgaaaactttct

SEQ ID NO: 183253 - DNA, 25 bp, Homo sapien
gtgtcgtgatgaaaactttctaaat

SEQ ID NO: 183254 - DNA, 25 bp, Homo sapien
gtgcatgaaatgtatgctttgtaca

SEQ ID NO: 183255 - DNA, 25 bp, Homo sapien
ttgctcaacatggtatttgtggttt

SEQ ID NO: 183256 - DNA, 25 bp, Homo sapien
tcaacatggtatttgtggttttcag

SEQ ID NO: 183257 - DNA, 25 bp, Homo sapien
tttcagcctttctaaaagttgcatg

SEQ ID NO: 183258 - DNA, 25 bp, Homo sapien
aagttgcatgttatgtgagtcagct

SEQ ID NO: 183259 - DNA, 25 bp, Homo sapien
gtgagtcagcttataggaagtacca

SEQ ID NO: 183260 - DNA, 25 bp, Homo sapien
agtcagcttataggaagtaccaaga

SEQ ID NO: 183261 - DNA, 25 bp, Homo sapien
gccaaactaaatactgtaacactgt

SEQ ID NO: 183262 - DNA, 25 bp, Homo sapien
aatactgtaacactgtataacattt

SEQ ID NO: 183263 - DNA, 25 bp, Homo sapien
atgttaaagaactgcttagtattag

SEQ ID NO: 183264 - DNA, 25 bp, Homo sapien
gaagcagatcatttcccaaaattct

SEQ ID NO: 183265 - DNA, 25 bp, Homo sapien
agcagatcatttcccaaaattctaa

SEQ ID NO: 183266 - DNA, 25 bp, Homo sapien
atttttagactaacttccatggtgc

SEQ ID NO: 183267 - DNA, 25 bp, Homo sapien
ttagactaacttccatggtgccctg

SEQ ID NO: 183268 - DNA, 25 bp, Homo sapien
tagactaacttccatggtgccctgt

SEQ ID NO: 183269 - DNA, 25 bp, Homo sapien
accattgtaccctgctgtataataa

SEQ ID NO: 183270 - DNA, 25 bp, Homo sapien
tgtaccctgctgtataataaacaat

SEQ ID NO: 183271 - DNA, 25 bp, Homo sapien
accctgctgtataataaacaatctt

SEQ ID NO: 183272 - DNA, 25 bp, Homo sapien
cctctccgtgcaaatgcacatgcaa

SEQ ID NO: 183273 - DNA, 25 bp, Homo sapien
tctccgtgcaaatgcacatgcaaga

SEQ ID NO: 183274 - DNA, 25 bp, Homo sapien
aatgcacatgcaagaaggagccctc

SEQ ID NO: 183275 - DNA, 25 bp, Homo sapien
gaaggagccctcttcggtgtccccg

SEQ ID NO: 183276 - DNA, 25 bp, Homo sapien
aggagccctcttcggtgtccccgag

SEQ ID NO: 183277 - DNA, 25 bp, Homo sapien
acggtcaagacccgcagcaccaaag

SEQ ID NO: 183278 - DNA, 25 bp, Homo sapien
gccggccctgacccgggcggtggag

SEQ ID NO: 183279 - DNA, 25 bp, Homo sapien
tggagggcgtccagtacattgcaga

SEQ ID NO: 183280 - DNA, 25 bp, Homo sapien
cagtacattgcagaccacctgaagg

SEQ ID NO: 183281 - DNA, 25 bp, Homo sapien
agtacattgcagaccacctgaaggc

SEQ ID NO: 183282 - DNA, 25 bp, Homo sapien
acctgaaggccgaagacacagactt

SEQ ID NO: 183283 - DNA, 25 bp, Homo sapien
gcaggactgttgagcccttttggtg

SEQ ID NO: 183284 - DNA, 25 bp, Homo sapien
agcccttttggtgttgcgagttgaa

SEQ ID NO: 183285 - DNA, 25 bp, Homo sapien
gcgagttgaagttcaaggtttctaa

SEQ ID NO: 183286 - DNA, 25 bp, Homo sapien
aggtttctaaaatgttgtcttgtat

SEQ ID NO: 183287 - DNA, 25 bp, Homo sapien
gtattgaaaggagctaatgccatta

SEQ ID NO: 183288 - DNA, 25 bp, Homo sapien
cacatttcctaagcagcctagagta

SEQ ID NO: 183289 - DNA, 25 bp, Homo sapien
gcagcctagagtacagggtgagcat

SEQ ID NO: 183290 - DNA, 25 bp, Homo sapien
agggtgagcatttttagatctccta

SEQ ID NO: 183291 - DNA, 25 bp, Homo sapien
gatctcctaatgtattgtgccgtgg

SEQ ID NO: 183292 - DNA, 25 bp, Homo sapien
tgccgtggaagtactgtgtgtgaat

SEQ ID NO: 183293 - DNA, 25 bp, Homo sapien
tttgttgtagaaatggaccagtgaa

SEQ ID NO: 183294 - DNA, 25 bp, Homo sapien
ggcaaatgcagatatatattacaga

SEQ ID NO: 183295 - DNA, 25 bp, Homo sapien
cagacaaatactctagattccacga

SEQ ID NO: 183296 - DNA, 25 bp, Homo sapien
atactctagattccacgagcagcag

SEQ ID NO: 183297 - DNA, 25 bp, Homo sapien
tagattccacgagcagcagcctgtg

SEQ ID NO: 183298 - DNA, 25 bp, Homo sapien
attccacgagcagcagcctgtggca

SEQ ID NO: 183299 - DNA, 25 bp, Homo sapien
agcagcagcctgtggcacccgctgg

SEQ ID NO: 183300 - DNA, 25 bp, Homo sapien
gaagagggagcaaggcattgtccac

SEQ ID NO: 183301 - DNA, 25 bp, Homo sapien
gggagcaaggcattgtccacagact

SEQ ID NO: 183302 - DNA, 25 bp, Homo sapien
gcaaggcattgtccacagactgctg

SEQ ID NO: 183303 - DNA, 25 bp, Homo sapien
aaggcattgtccacagactgctggg

SEQ ID NO: 183304 - DNA, 25 bp, Homo sapien
gggtcacttctttgcccacgggctc

SEQ ID NO: 183305 - DNA, 25 bp, Homo sapien
gtgctcctttgcctcgggaccggct

SEQ ID NO: 183306 - DNA, 25 bp, Homo sapien
gtctgtgcccgggaaagatgccata

SEQ ID NO: 183307 - DNA, 25 bp, Homo sapien
gtgcccgggaaagatgccatatatt

SEQ ID NO: 183308 - DNA, 25 bp, Homo sapien
aagatgccatatattcactgggtgg

SEQ ID NO: 183309 - DNA, 25 bp, Homo sapien
ttcactgggtggcaagacactgcaa

SEQ ID NO: 183310 - DNA, 25 bp, Homo sapien
ggcaagacactgcaagataccctct

SEQ ID NO: 183311 - DNA, 25 bp, Homo sapien
cctctccaacgcagtcatttattat

SEQ ID NO: 183312 - DNA, 25 bp, Homo sapien
gcagtcatttattatcgcgtaggtg

SEQ ID NO: 183313 - DNA, 25 bp, Homo sapien
agagacaactcagctagaggtggct

SEQ ID NO: 183314 - DNA, 25 bp, Homo sapien
tgtggaagtgcaacaatgccaccgt

SEQ ID NO: 183315 - DNA, 25 bp, Homo sapien
acaatgccaccgttgactgggagtg

SEQ ID NO: 183316 - DNA, 25 bp, Homo sapien
atctccgtggccaatgtgactaccg

SEQ ID NO: 183317 - DNA, 25 bp, Homo sapien
gccaatgtgactaccgtgccagcag

SEQ ID NO: 183318 - DNA, 25 bp, Homo sapien
atgtgactaccgtgccagcagcggg

SEQ ID NO: 183319 - DNA, 25 bp, Homo sapien
acgggcctctgcttgccagccagga

SEQ ID NO: 183320 - DNA, 25 bp, Homo sapien
cgggcctctgcttgccagccaggag

SEQ ID NO: 183321 - DNA, 25 bp, Homo sapien
ctctgcttgccagccaggagtgcgg

SEQ ID NO: 183322 - DNA, 25 bp, Homo sapien
tgcttgccagccaggagtgcggaca

SEQ ID NO: 183323 - DNA, 25 bp, Homo sapien
gcttgccagccaggagtgcggacac

SEQ ID NO: 183324 - DNA, 25 bp, Homo sapien
tgccagccaggagtgcggacaccat

SEQ ID NO: 183325 - DNA, 25 bp, Homo sapien
aggagtgcggacaccatgttcccag

SEQ ID NO: 183326 - DNA, 25 bp, Homo sapien
atgttcccagctcagtgccaaagag

SEQ ID NO: 183327 - DNA, 25 bp, Homo sapien
ggaacacaggcgcttgaaaaagaaa

SEQ ID NO: 183328 - DNA, 25 bp, Homo sapien
gagagaacagcccataatgctcccc

SEQ ID NO: 183329 - DNA, 25 bp, Homo sapien
tccccgggagcagaggccactaatg

SEQ ID NO: 183330 - DNA, 25 bp, Homo sapien
ggtatggaagactcagcaggaacaa

SEQ ID NO: 183331 - DNA, 25 bp, Homo sapien
gaagaggtcacacgcagagactgct

SEQ ID NO: 183332 - DNA, 25 bp, Homo sapien
ggtcacacgcagagactgctactac

SEQ ID NO: 183333 - DNA, 25 bp, Homo sapien
ctgctactacatcttattcacctgc

SEQ ID NO: 183334 - DNA, 25 bp, Homo sapien
tactacatcttattcacctgccaag

SEQ ID NO: 183335 - DNA, 25 bp, Homo sapien
attcacctgccaaggcttggtggcc

SEQ ID NO: 183336 - DNA, 25 bp, Homo sapien
gccaaggcttggtggccaacaccca

SEQ ID NO: 183337 - DNA, 25 bp, Homo sapien
gtggccaacacccagaggaacaaat

SEQ ID NO: 183338 - DNA, 25 bp, Homo sapien
acatcttatgccagaattgtggtgg

SEQ ID NO: 183339 - DNA, 25 bp, Homo sapien
cacctagctgtagtgaccacattct

SEQ ID NO: 183340 - DNA, 25 bp, Homo sapien
gaccacattctatggaacgctcatg

SEQ ID NO: 183341 - DNA, 25 bp, Homo sapien
ttctatggaacgctcatgatctttt

SEQ ID NO: 183342 - DNA, 25 bp, Homo sapien
atgatcttttatgttgcaccctctg

SEQ ID NO: 183343 - DNA, 25 bp, Homo sapien
cctctcttcaatcctgtgatctata

SEQ ID NO: 183344 - DNA, 25 bp, Homo sapien
ctgtgatctataccatgaggaacaa

SEQ ID NO: 183345 - DNA, 25 bp, Homo sapien
gaacaaggaggtgcatcaggcactt

SEQ ID NO: 183346 - DNA, 25 bp, Homo sapien
gtgcatcaggcacttcggaagattc

SEQ ID NO: 183347 - DNA, 25 bp, Homo sapien
ggcacttcggaagattctctgtatc

SEQ ID NO: 183348 - DNA, 25 bp, Homo sapien
cggaagattctctgtatcaaacaaa

SEQ ID NO: 183349 - DNA, 25 bp, Homo sapien
aaagtatttgcctctggaaagaaca

SEQ ID NO: 183350 - DNA, 25 bp, Homo sapien
gaaagaacaactggcaggactgttg

SEQ ID NO: 183351 - DNA, 25 bp, Homo sapien
aaagaacaactggcaggactgttgt

SEQ ID NO: 183352 - DNA, 25 bp, Homo sapien
aagaacaactggcaggactgttgtt

SEQ ID NO: 183353 - DNA, 25 bp, Homo sapien
agaacaactggcaggactgttgttt

SEQ ID NO: 183354 - DNA, 25 bp, Homo sapien
gaacaactggcaggactgttgtttt

SEQ ID NO: 183355 - DNA, 25 bp, Homo sapien
aacaactggcaggactgttgttttc

SEQ ID NO: 183356 - DNA, 25 bp, Homo sapien
acaactggcaggactgttgttttca

SEQ ID NO: 183357 - DNA, 25 bp, Homo sapien
caactggcaggactgttgttttcat

SEQ ID NO: 183358 - DNA, 25 bp, Homo sapien
aactggcaggactgttgttttcatt

SEQ ID NO: 183359 - DNA, 25 bp, Homo sapien
aaatcaaaaacaggcaggtacaggt

SEQ ID NO: 183360 - DNA, 25 bp, Homo sapien
caggcaggtacaggtagtgggctca

SEQ ID NO: 183361 - DNA, 25 bp, Homo sapien
gtgggctcacaacgtttgacctcga

SEQ ID NO: 183362 - DNA, 25 bp, Homo sapien
gggctcacaacgtttgacctcgact

SEQ ID NO: 183363 - DNA, 25 bp, Homo sapien
gctcacaacgtttgacctcgactgg

SEQ ID NO: 183364 - DNA, 25 bp, Homo sapien
tcacaacgtttgacctcgactggtt

SEQ ID NO: 183365 - DNA, 25 bp, Homo sapien
gggaagagcctttatacaattggac

SEQ ID NO: 183366 - DNA, 25 bp, Homo sapien
aagagcctttatacaattggacgca

SEQ ID NO: 183367 - DNA, 25 bp, Homo sapien
gagcctttatacaattggacgcatt

SEQ ID NO: 183368 - DNA, 25 bp, Homo sapien
gcctttatacaattggacgcatttt

SEQ ID NO: 183369 - DNA, 25 bp, Homo sapien
tttatacaattggacgcattttggt

SEQ ID NO: 183370 - DNA, 25 bp, Homo sapien
tccgcggaagatggaccccccggag

SEQ ID NO: 183371 - DNA, 25 bp, Homo sapien
agcgttagaggaaaccacataggag

SEQ ID NO: 183372 - DNA, 25 bp, Homo sapien
gttagaggaaaccacataggagctg

SEQ ID NO: 183373 - DNA, 25 bp, Homo sapien
gaggaaaccacataggagctggaac

SEQ ID NO: 183374 - DNA, 25 bp, Homo sapien
ataggagctggaacctgttaatgga

SEQ ID NO: 183375 - DNA, 25 bp, Homo sapien
aagcagtcacagctggaggtttttc

SEQ ID NO: 183376 - DNA, 25 bp, Homo sapien
agcagtcacagctggaggtttttcg

SEQ ID NO: 183377 - DNA, 25 bp, Homo sapien
agtcacagctggaggtttttcggaa

SEQ ID NO: 183378 - DNA, 25 bp, Homo sapien
gtcacagctggaggtttttcggaag

SEQ ID NO: 183379 - DNA, 25 bp, Homo sapien
tcacagctggaggtttttcggaaga

SEQ ID NO: 183380 - DNA, 25 bp, Homo sapien
cacagctggaggtttttcggaagaa

SEQ ID NO: 183381 - DNA, 25 bp, Homo sapien
gcggatgataactactgacgaaaga

SEQ ID NO: 183382 - DNA, 25 bp, Homo sapien
gaaagagtcatcgacctcagttagt

SEQ ID NO: 183383 - DNA, 25 bp, Homo sapien
cctcagttagtggttggatgtagtc

SEQ ID NO: 183384 - DNA, 25 bp, Homo sapien
tgtagtcacattagtttgcctctcc

SEQ ID NO: 183385 - DNA, 25 bp, Homo sapien
gacatgatgctaagagccctgggta

SEQ ID NO: 183386 - DNA, 25 bp, Homo sapien
aatgtggtgagaatgcacgcgtgca

SEQ ID NO: 183387 - DNA, 25 bp, Homo sapien
tgcacgcgtgcatatgctacacata

SEQ ID NO: 183388 - DNA, 25 bp, Homo sapien
acacatatgtgcttctcagttgcag

SEQ ID NO: 183389 - DNA, 25 bp, Homo sapien
aaatgaactgctttgggagattatc

SEQ ID NO: 183390 - DNA, 25 bp, Homo sapien
ttatcatattggtgctgagtgctat

SEQ ID NO: 183391 - DNA, 25 bp, Homo sapien
tgctgagtgctatgtgtgcttatac

SEQ ID NO: 183392 - DNA, 25 bp, Homo sapien
gaggccaacgaggccaatgaggcca

SEQ ID NO: 183393 - DNA, 25 bp, Homo sapien
gccaatgaggccaacaagacgatgc

SEQ ID NO: 183394 - DNA, 25 bp, Homo sapien
caatgaggccaacaagacgatgccg

SEQ ID NO: 183395 - DNA, 25 bp, Homo sapien
aatgaggccaacaagacgatgccgg

SEQ ID NO: 183396 - DNA, 25 bp, Homo sapien
atgaggccaacaagacgatgccgga

SEQ ID NO: 183397 - DNA, 25 bp, Homo sapien
tgaggccaacaagacgatgccggag

SEQ ID NO: 183398 - DNA, 25 bp, Homo sapien
aggaattcatagaaataacgactga

SEQ ID NO: 183399 - DNA, 25 bp, Homo sapien
tcatagaaataacgactgaaagacc

SEQ ID NO: 183400 - DNA, 25 bp, Homo sapien
caagaagctacatccctcaaacttc

SEQ ID NO: 183401 - DNA, 25 bp, Homo sapien
aagaagctacatccctcaaacttcg

SEQ ID NO: 183402 - DNA, 25 bp, Homo sapien
agaagctacatccctcaaacttcgg

SEQ ID NO: 183403 - DNA, 25 bp, Homo sapien
ttaacttattgcataacagcagatg

SEQ ID NO: 183404 - DNA, 25 bp, Homo sapien
aaaagcatctcactgcaagtcacat

SEQ ID NO: 183405 - DNA, 25 bp, Homo sapien
agcatctcactgcaagtcacataaa

SEQ ID NO: 183406 - DNA, 25 bp, Homo sapien
aaaatgcaacgctgtaatatggctg

SEQ ID NO: 183407 - DNA, 25 bp, Homo sapien
tatggctgtatcagagggctttgaa

SEQ ID NO: 183408 - DNA, 25 bp, Homo sapien
gagggctttgaaaacatacactgag

SEQ ID NO: 183409 - DNA, 25 bp, Homo sapien
ttgaaaacatacactgagctgcttc

SEQ ID NO: 183410 - DNA, 25 bp, Homo sapien
tgcgctgttgttgtccgtatttaaa

SEQ ID NO: 183411 - DNA, 25 bp, Homo sapien
cgtatttaaacaacagctcccctgt

SEQ ID NO: 183412 - DNA, 25 bp, Homo sapien
tttaaacaacagctcccctgtattc

SEQ ID NO: 183413 - DNA, 25 bp, Homo sapien
ccccatctagccatttcggaagaca

SEQ ID NO: 183414 - DNA, 25 bp, Homo sapien
gaatttaagtccatgtcgggcacca

SEQ ID NO: 183415 - DNA, 25 bp, Homo sapien
atttaagtccatgtcgggcaccatc

SEQ ID NO: 183416 - DNA, 25 bp, Homo sapien
atgtcgggcaccatccagctgggcc

SEQ ID NO: 183417 - DNA, 25 bp, Homo sapien
cagctgggccggaagcttatcacaa

SEQ ID NO: 183418 - DNA, 25 bp, Homo sapien
tgcgctacgcctgtttcttgctacg

SEQ ID NO: 183419 - DNA, 25 bp, Homo sapien
tacgcctgtttcttgctacggtcct

SEQ ID NO: 183420 - DNA, 25 bp, Homo sapien
ttgtgagatcccaaaggtgccagtt

SEQ ID NO: 183421 - DNA, 25 bp, Homo sapien
tgagatcccaaaggtgccagttctg

SEQ ID NO: 183422 - DNA, 25 bp, Homo sapien
gatcccaaaggtgccagttctggcc

SEQ ID NO: 183423 - DNA, 25 bp, Homo sapien
tcctgtttcaggatctgtcctggtt

SEQ ID NO: 183424 - DNA, 25 bp, Homo sapien
gtttcaggatctgtcctggttcctg

SEQ ID NO: 183425 - DNA, 25 bp, Homo sapien
atggatatagttttagatttgtggt

SEQ ID NO: 183426 - DNA, 25 bp, Homo sapien
ttgcaaacttccctcatgtaaggaa

SEQ ID NO: 183427 - DNA, 25 bp, Homo sapien
caaacttccctcatgtaaggaaggt

SEQ ID NO: 183428 - DNA, 25 bp, Homo sapien
ttccctcatgtaaggaaggtacttt

SEQ ID NO: 183429 - DNA, 25 bp, Homo sapien
gaaggtactttaaatgtagcagcca

SEQ ID NO: 183430 - DNA, 25 bp, Homo sapien
aggtactttaaatgtagcagccact

SEQ ID NO: 183431 - DNA, 25 bp, Homo sapien
atgtagcagccactgacatttcttt

SEQ ID NO: 183432 - DNA, 25 bp, Homo sapien
gtagcagccactgacatttcttttt

SEQ ID NO: 183433 - DNA, 25 bp, Homo sapien
tgagaagtctacttccttttaactt

SEQ ID NO: 183434 - DNA, 25 bp, Homo sapien
taagaaattaaggtctattccattc

SEQ ID NO: 183435 - DNA, 25 bp, Homo sapien
atatcctgggtaagaatgtaaataa

SEQ ID NO: 183436 - DNA, 25 bp, Homo sapien
gtagccggagaagggcctctggagc

SEQ ID NO: 183437 - DNA, 25 bp, Homo sapien
gacacagtcgggttgacccagggct

SEQ ID NO: 183438 - DNA, 25 bp, Homo sapien
acagtcgggttgacccagggctgtc

SEQ ID NO: 183439 - DNA, 25 bp, Homo sapien
tcgggttgacccagggctgtctccc

SEQ ID NO: 183440 - DNA, 25 bp, Homo sapien
cagagcctccctccggacaatgagt

SEQ ID NO: 183441 - DNA, 25 bp, Homo sapien
gtgctgcctgttgttatgggttttt

SEQ ID NO: 183442 - DNA, 25 bp, Homo sapien
tgctgcctgttgttatgggtttttt

SEQ ID NO: 183443 - DNA, 25 bp, Homo sapien
ttctggggtctttgagctccaaaaa

SEQ ID NO: 183444 - DNA, 25 bp, Homo sapien
gagctccaaaaaataaacacttcct

SEQ ID NO: 183445 - DNA, 25 bp, Homo sapien
aaacacttcctttgagggagagcaa

SEQ ID NO: 183446 - DNA, 25 bp, Homo sapien
cacttcctttgagggagagcaaaaa

SEQ ID NO: 183447 - DNA, 25 bp, Homo sapien
atgagatatggctatttggaagaca

SEQ ID NO: 183448 - DNA, 25 bp, Homo sapien
cactgcattttagccagtgtacctg

SEQ ID NO: 183449 - DNA, 25 bp, Homo sapien
agccagtgtacctgggcacagactc

SEQ ID NO: 183450 - DNA, 25 bp, Homo sapien
aagggctgagccacatgaaggcagc

SEQ ID NO: 183451 - DNA, 25 bp, Homo sapien
gccacatgaaggcagcactcagggc

SEQ ID NO: 183452 - DNA, 25 bp, Homo sapien
aggatcagcagtgcagccccaggat

SEQ ID NO: 183453 - DNA, 25 bp, Homo sapien
tcgcaggtaccctgcctccattttg

SEQ ID NO: 183454 - DNA, 25 bp, Homo sapien
ggttaccatccccacttattatggg

SEQ ID NO: 183455 - DNA, 25 bp, Homo sapien
catccccacttattatgggctgtgg

SEQ ID NO: 183456 - DNA, 25 bp, Homo sapien
cttattatgggctgtgggctgttat

SEQ ID NO: 183457 - DNA, 25 bp, Homo sapien
gctgtgggctgttatggtgatggat

SEQ ID NO: 183458 - DNA, 25 bp, Homo sapien
cgagtcgagctggacacccggagat

SEQ ID NO: 183459 - DNA, 25 bp, Homo sapien
gtcgagctggacacccggagatcag

SEQ ID NO: 183460 - DNA, 25 bp, Homo sapien
ggcctcagggtcacagaaagcaaag

SEQ ID NO: 183461 - DNA, 25 bp, Homo sapien
caaagggcactcagaatcatggcac

SEQ ID NO: 183462 - DNA, 25 bp, Homo sapien
gggcactcagaatcatggcacctaa

SEQ ID NO: 183463 - DNA, 25 bp, Homo sapien
cagaatcatggcacctaagtctgga

SEQ ID NO: 183464 - DNA, 25 bp, Homo sapien
ccatcagggttgcattggctgtcgc

SEQ ID NO: 183465 - DNA, 25 bp, Homo sapien
tcagggttgcattggctgtcgctgt

SEQ ID NO: 183466 - DNA, 25 bp, Homo sapien
gctgtcgctgtgctcaaaactgtca

SEQ ID NO: 183467 - DNA, 25 bp, Homo sapien
gtcgctgtgctcaaaactgtcattt

SEQ ID NO: 183468 - DNA, 25 bp, Homo sapien
tgtgctcaaaactgtcattttggga

SEQ ID NO: 183469 - DNA, 25 bp, Homo sapien
ggcccggagttagggctgagccagt

SEQ ID NO: 183470 - DNA, 25 bp, Homo sapien
agttctgtggcagcctgaagcaggc

SEQ ID NO: 183471 - DNA, 25 bp, Homo sapien
tgtggaagcctgcaacctcattgcc

SEQ ID NO: 183472 - DNA, 25 bp, Homo sapien
ggaagcctgcaacctcattgcctgt

SEQ ID NO: 183473 - DNA, 25 bp, Homo sapien
cggcaccagcagagtcactttgaca

SEQ ID NO: 183474 - DNA, 25 bp, Homo sapien
gagtcactttgacaatgggaatgag

SEQ ID NO: 183475 - DNA, 25 bp, Homo sapien
gccgagtgctggaccgcgtctgctt

SEQ ID NO: 183476 - DNA, 25 bp, Homo sapien
gtgctggaccgcgtctgcttcctgg

SEQ ID NO: 183477 - DNA, 25 bp, Homo sapien
catgctctcgctcttcatctgtggc

SEQ ID NO: 183478 - DNA, 25 bp, Homo sapien
atctgtggcacagctggcatcttcc

SEQ ID NO: 183479 - DNA, 25 bp, Homo sapien
atggcccactacaaccgggtgccgg

SEQ ID NO: 183480 - DNA, 25 bp, Homo sapien
aatgagatatggctatttggaagac

SEQ ID NO: 183481 - DNA, 25 bp, Homo sapien
atgagatatggctatttggaagaca

SEQ ID NO: 183482 - DNA, 25 bp, Homo sapien
gacactgcattttagccagtgtacc

SEQ ID NO: 183483 - DNA, 25 bp, Homo sapien
cactgcattttagccagtgtacctg

SEQ ID NO: 183484 - DNA, 25 bp, Homo sapien
agccagtgtacctgggcacagactc

SEQ ID NO: 183485 - DNA, 25 bp, Homo sapien
gccagtgtacctgggcacagactcg

SEQ ID NO: 183486 - DNA, 25 bp, Homo sapien
cagtgtacctgggcacagactcggg

SEQ ID NO: 183487 - DNA, 25 bp, Homo sapien
ttgaaggacggaagggctgagccac

SEQ ID NO: 183488 - DNA, 25 bp, Homo sapien
aagggctgagccacatgaaggcagc

SEQ ID NO: 183489 - DNA, 25 bp, Homo sapien
gagccacatgaaggcagcactcagg

SEQ ID NO: 183490 - DNA, 25 bp, Homo sapien
gccacatgaaggcagcactcagggc

SEQ ID NO: 183491 - DNA, 25 bp, Homo sapien
tgaatgaatccaatcttataacctt

SEQ ID NO: 183492 - DNA, 25 bp, Homo sapien
gaatccaatcttataaccttgaagt

SEQ ID NO: 183493 - DNA, 25 bp, Homo sapien
ccaatcttataaccttgaagtgctg

SEQ ID NO: 183494 - DNA, 25 bp, Homo sapien
gtgctggctgcaggtattaagtcca

SEQ ID NO: 183495 - DNA, 25 bp, Homo sapien
gctgcaggtattaagtccaagttta

SEQ ID NO: 183496 - DNA, 25 bp, Homo sapien
gcaggtattaagtccaagtttatta

SEQ ID NO: 183497 - DNA, 25 bp, Homo sapien
ttaagtccaagtttattaactagat

SEQ ID NO: 183498 - DNA, 25 bp, Homo sapien
ttttattcctctaacttccttaatg

SEQ ID NO: 183499 - DNA, 25 bp, Homo sapien
attcctctaacttccttaatgatca

SEQ ID NO: 183500 - DNA, 25 bp, Homo sapien
ctaacttccttaatgatcaatcaaa

SEQ ID NO: 183501 - DNA, 25 bp, Homo sapien
acagttctttcagctttacagaact

SEQ ID NO: 183502 - DNA, 25 bp, Homo sapien
ctgaagctgtattccctagagggtt

SEQ ID NO: 183503 - DNA, 25 bp, Homo sapien
gggttacgggacagatgcagttatc

SEQ ID NO: 183504 - DNA, 25 bp, Homo sapien
gcagttatctacattaaggctctgt

SEQ ID NO: 183505 - DNA, 25 bp, Homo sapien
taaggctctgtcaacagactcaata

SEQ ID NO: 183506 - DNA, 25 bp, Homo sapien
gactcaatagaaagactcccagtgt

SEQ ID NO: 183507 - DNA, 25 bp, Homo sapien
aaagctgcctggaagcattacaaca

SEQ ID NO: 183508 - DNA, 25 bp, Homo sapien
ttacaacaccaaccacgaggctgat

SEQ ID NO: 183509 - DNA, 25 bp, Homo sapien
atgactggtgcgtccccagcagaga

SEQ ID NO: 183510 - DNA, 25 bp, Homo sapien
tccccagcagagaacccaaagacat

SEQ ID NO: 183511 - DNA, 25 bp, Homo sapien
aagacatgacgacgttccgcagtgc

SEQ ID NO: 183512 - DNA, 25 bp, Homo sapien
gttccgcagtgcctagacacactgg

SEQ ID NO: 183513 - DNA, 25 bp, Homo sapien
aaggcatcgggcaggccatccgaaa

SEQ ID NO: 183514 - DNA, 25 bp, Homo sapien
attgccaacggcactgtgaagagaa

SEQ ID NO: 183515 - DNA, 25 bp, Homo sapien
tttcccgcccagaattggtccaaag

SEQ ID NO: 183516 - DNA, 25 bp, Homo sapien
gaattggtccaaagaggccttgaaa

SEQ ID NO: 183517 - DNA, 25 bp, Homo sapien
gaggccttgaaatgtcactgaagaa

SEQ ID NO: 183518 - DNA, 25 bp, Homo sapien
cagctgagctacatggatctttacc

SEQ ID NO: 183519 - DNA, 25 bp, Homo sapien
tttcccagtacctttgcagcctggg

SEQ ID NO: 183520 - DNA, 25 bp, Homo sapien
aggagcttttgctgacggatgcaca

SEQ ID NO: 183521 - DNA, 25 bp, Homo sapien
atcatgtttgacacagtgggtctct

SEQ ID NO: 183522 - DNA, 25 bp, Homo sapien
cagtgggtctctgcagcacatggga

SEQ ID NO: 183523 - DNA, 25 bp, Homo sapien
tctctgcagcacatgggaggccctg

SEQ ID NO: 183524 - DNA, 25 bp, Homo sapien
ctggagggcaacaggctgccgggcc

SEQ ID NO: 183525 - DNA, 25 bp, Homo sapien
ggcccaaacaggctgaagctcctaa

SEQ ID NO: 183526 - DNA, 25 bp, Homo sapien
tgaagctcctaaacttggccattcc

SEQ ID NO: 183527 - DNA, 25 bp, Homo sapien
aagctcctaaacttggccattccca

SEQ ID NO: 183528 - DNA, 25 bp, Homo sapien
cctaaacttggccattcccaggagg

SEQ ID NO: 183529 - DNA, 25 bp, Homo sapien
taaacttggccattcccaggaggct

SEQ ID NO: 183530 - DNA, 25 bp, Homo sapien
aacttggccattcccaggaggcttg

SEQ ID NO: 183531 - DNA, 25 bp, Homo sapien
ggagacccccagataaccataacag

SEQ ID NO: 183532 - DNA, 25 bp, Homo sapien
agataaccataacagggaagcaggg

SEQ ID NO: 183533 - DNA, 25 bp, Homo sapien
gtttcaaactatttgagaggagaat

SEQ ID NO: 183534 - DNA, 25 bp, Homo sapien
agaattaaagacatgcttgttttgt

SEQ ID NO: 183535 - DNA, 25 bp, Homo sapien
agtgccaaaggatcttccccctgac

SEQ ID NO: 183536 - DNA, 25 bp, Homo sapien
gtgccaaaggatcttccccctgaca

SEQ ID NO: 183537 - DNA, 25 bp, Homo sapien
tgccaaaggatcttccccctgacac

SEQ ID NO: 183538 - DNA, 25 bp, Homo sapien
ccaaaggatcttccccctgacacaa

SEQ ID NO: 183539 - DNA, 25 bp, Homo sapien
aaaggatcttccccctgacacaact

SEQ ID NO: 183540 - DNA, 25 bp, Homo sapien
ctgacacaactctgctagacctgca

SEQ ID NO: 183541 - DNA, 25 bp, Homo sapien
tgacacaactctgctagacctgcaa

SEQ ID NO: 183542 - DNA, 25 bp, Homo sapien
gacacaactctgctagacctgcaaa

SEQ ID NO: 183543 - DNA, 25 bp, Homo sapien
acacaactctgctagacctgcaaaa

SEQ ID NO: 183544 - DNA, 25 bp, Homo sapien
aaagatggagactttaagaacctga

SEQ ID NO: 183545 - DNA, 25 bp, Homo sapien
aagatggagactttaagaacctgaa

SEQ ID NO: 183546 - DNA, 25 bp, Homo sapien
gtttcttggagacatcccacaatgg

SEQ ID NO: 183547 - DNA, 25 bp, Homo sapien
ggagacatcccacaatgggctctgt

SEQ ID NO: 183548 - DNA, 25 bp, Homo sapien
ggaagactcattgaacatatgcaag

SEQ ID NO: 183549 - DNA, 25 bp, Homo sapien
atatgcaagaatatgcctgttcctg

SEQ ID NO: 183550 - DNA, 25 bp, Homo sapien
tttccgcaaggttcgattttcattt

SEQ ID NO: 183551 - DNA, 25 bp, Homo sapien
aaggttcgattttcatttgagcagc

SEQ ID NO: 183552 - DNA, 25 bp, Homo sapien
ttgagcagccagatggtagagcgca

SEQ ID NO: 183553 - DNA, 25 bp, Homo sapien
gatggtagagcgcagatgcccacca

SEQ ID NO: 183554 - DNA, 25 bp, Homo sapien
tagagcgcagatgcccaccactgaa

SEQ ID NO: 183555 - DNA, 25 bp, Homo sapien
ccaccactgaaagagtgactttgac

SEQ ID NO: 183556 - DNA, 25 bp, Homo sapien
gactttgacaagatgtttctacctc

SEQ ID NO: 183557 - DNA, 25 bp, Homo sapien
aagcctgtctttcccagcgtcatgt

SEQ ID NO: 183558 - DNA, 25 bp, Homo sapien
cccagcgtcatgtttgtgtcacaaa

SEQ ID NO: 183559 - DNA, 25 bp, Homo sapien
tttgtgtcacaaaagcagttatttt

SEQ ID NO: 183560 - DNA, 25 bp, Homo sapien
ttttaaaatctgatcccctctctac

SEQ ID NO: 183561 - DNA, 25 bp, Homo sapien
atcaaagtcctgtccaccaccaaaa

SEQ ID NO: 183562 - DNA, 25 bp, Homo sapien
tgtccaccaccaaaactaagttctt

SEQ ID NO: 183563 - DNA, 25 bp, Homo sapien
taaacgatgagaagggaatccggtt

SEQ ID NO: 183564 - DNA, 25 bp, Homo sapien
ccggttatgttgatttctagtgtac

SEQ ID NO: 183565 - DNA, 25 bp, Homo sapien
tctagtgtacaagatactgtctgct

SEQ ID NO: 183566 - DNA, 25 bp, Homo sapien
agatactgtctgctgtggttctgta

SEQ ID NO: 183567 - DNA, 25 bp, Homo sapien
ttttattttttgaccaactgtatgg

SEQ ID NO: 183568 - DNA, 25 bp, Homo sapien
ttctcatcaattctctatcatgttg

SEQ ID NO: 183569 - DNA, 25 bp, Homo sapien
catcaattctctatcatgttgaagt

SEQ ID NO: 183570 - DNA, 25 bp, Homo sapien
gaatttgtagacatacttgtacgct

SEQ ID NO: 183571 - DNA, 25 bp, Homo sapien
tagacatacttgtacgctcacttgc

SEQ ID NO: 183572 - DNA, 25 bp, Homo sapien
gacatacttgtacgctcacttgccc

SEQ ID NO: 183573 - DNA, 25 bp, Homo sapien
ttctctcccacacaagcagtctttt

SEQ ID NO: 183574 - DNA, 25 bp, Homo sapien
tcccacacaagcagtctttttctac

SEQ ID NO: 183575 - DNA, 25 bp, Homo sapien
acacaagcagtctttttctacagcc

SEQ ID NO: 183576 - DNA, 25 bp, Homo sapien
cagaccttcttccacagcaaatgag

SEQ ID NO: 183577 - DNA, 25 bp, Homo sapien
ccttcttccacagcaaatgagatgt

SEQ ID NO: 183578 - DNA, 25 bp, Homo sapien
aatgagatgtatgcccaaagcggta

SEQ ID NO: 183579 - DNA, 25 bp, Homo sapien
agatgaattcctatggctctgcaat

SEQ ID NO: 183580 - DNA, 25 bp, Homo sapien
atggctctgcaattgtcaccggtta

SEQ ID NO: 183581 - DNA, 25 bp, Homo sapien
ttgtcaccggttaactgtggcctgt

SEQ ID NO: 183582 - DNA, 25 bp, Homo sapien
actgtggcctgtgtttaggaagagc

SEQ ID NO: 183583 - DNA, 25 bp, Homo sapien
aggaagagccattcactcctgccct

SEQ ID NO: 183584 - DNA, 25 bp, Homo sapien
ggtacgcccctgtgtgatatgttga

SEQ ID NO: 183585 - DNA, 25 bp, Homo sapien
tgtgatatgttgatccctcggcaaa

SEQ ID NO: 183586 - DNA, 25 bp, Homo sapien
atccctcggcaaagaatctactgga

SEQ ID NO: 183587 - DNA, 25 bp, Homo sapien
atagattccgaggagcaggtgtgct

SEQ ID NO: 183588 - DNA, 25 bp, Homo sapien
aaaccccgagatagtgctggaacac

SEQ ID NO: 183589 - DNA, 25 bp, Homo sapien
ggaacactgctgaggttttatactc

SEQ ID NO: 183590 - DNA, 25 bp, Homo sapien
aatggagtcctctagcctaaagata

SEQ ID NO: 183591 - DNA, 25 bp, Homo sapien
aagatatcagctgttccatggcaga

SEQ ID NO: 183592 - DNA, 25 bp, Homo sapien
gtggtgtgtaaagtctctggcctca

SEQ ID NO: 183593 - DNA, 25 bp, Homo sapien
gtctctggcctcataaaaggtggct

SEQ ID NO: 183594 - DNA, 25 bp, Homo sapien
gtgggtcgtcaggaatctgcgccat

SEQ ID NO: 183595 - DNA, 25 bp, Homo sapien
gcctgagactgatcaaacaataaac

SEQ ID NO: 183596 - DNA, 25 bp, Homo sapien
aacaataaacacgtttcccactctg

SEQ ID NO: 183597 - DNA, 25 bp, Homo sapien
tgagtaatcttcaggtcctccgtgt

SEQ ID NO: 183598 - DNA, 25 bp, Homo sapien
tcctccgtgttctggagctgagatg

SEQ ID NO: 183599 - DNA, 25 bp, Homo sapien
agctgagatgggaatgagcccctac

SEQ ID NO: 183600 - DNA, 25 bp, Homo sapien
tgagcccctacacagaatggagtcc

SEQ ID NO: 183601 - DNA, 25 bp, Homo sapien
agtgggagagacaagccagtcctaa

SEQ ID NO: 183602 - DNA, 25 bp, Homo sapien
ggtggcagccacaaattctaggtac

SEQ ID NO: 183603 - DNA, 25 bp, Homo sapien
aaattctaggtacactggctgctgc

SEQ ID NO: 183604 - DNA, 25 bp, Homo sapien
atcctgtccctggatctgaggcctt

SEQ ID NO: 183605 - DNA, 25 bp, Homo sapien
aggcctttcccttgccatagaaatg

SEQ ID NO: 183606 - DNA, 25 bp, Homo sapien
gttgctggtagcagtagagagcact

SEQ ID NO: 183607 - DNA, 25 bp, Homo sapien
gcactgtgcacctgggaatgaggaa

SEQ ID NO: 183608 - DNA, 25 bp, Homo sapien
gaatgaggaatcaggccccaagaca

SEQ ID NO: 183609 - DNA, 25 bp, Homo sapien
atcaggccccaagacagaagtactt

SEQ ID NO: 183610 - DNA, 25 bp, Homo sapien
aggagccagctgcagtagtatccgc

SEQ ID NO: 183611 - DNA, 25 bp, Homo sapien
gctgcagtagtatccgcctgtagtc

SEQ ID NO: 183612 - DNA, 25 bp, Homo sapien
gaacggtgaaagtgggagatacatt

SEQ ID NO: 183613 - DNA, 25 bp, Homo sapien
gatacattggatcttctcattggag

SEQ ID NO: 183614 - DNA, 25 bp, Homo sapien
ggatcttctcattggagaggataaa

SEQ ID NO: 183615 - DNA, 25 bp, Homo sapien
gaagcaggaacagagacagttatgc

SEQ ID NO: 183616 - DNA, 25 bp, Homo sapien
gacagttatgcggattctcttgaaa

SEQ ID NO: 183617 - DNA, 25 bp, Homo sapien
gttatgcggattctcttgaaaaaag

SEQ ID NO: 183618 - DNA, 25 bp, Homo sapien
aaatacagagtggtgttacggcggt

SEQ ID NO: 183619 - DNA, 25 bp, Homo sapien
taaagttgcctaagaagagaatgtc

SEQ ID NO: 183620 - DNA, 25 bp, Homo sapien
gcaatagagctgctttctagtggta

SEQ ID NO: 183621 - DNA, 25 bp, Homo sapien
gagctgctttctagtggtaaaggaa

SEQ ID NO: 183622 - DNA, 25 bp, Homo sapien
gggtcacctgaaaaataggacattt

SEQ ID NO: 183623 - DNA, 25 bp, Homo sapien
tccttgatcaccgtggccagagcat

SEQ ID NO: 183624 - DNA, 25 bp, Homo sapien
agagcatctcgtgtggaccatctag

SEQ ID NO: 183625 - DNA, 25 bp, Homo sapien
tgtggaccatctaggctccttgggc

SEQ ID NO: 183626 - DNA, 25 bp, Homo sapien
tccttgggcttcaagcaggacctga

SEQ ID NO: 183627 - DNA, 25 bp, Homo sapien
tgagccacatgctccctgtacgagc

SEQ ID NO: 183628 - DNA, 25 bp, Homo sapien
tgtacgagctgtgctatacctgtcc

SEQ ID NO: 183629 - DNA, 25 bp, Homo sapien
tgtcccacatgagcacggagagcct

SEQ ID NO: 183630 - DNA, 25 bp, Homo sapien
gagagcctcatgttggtgggtttcc

SEQ ID NO: 183631 - DNA, 25 bp, Homo sapien
gagtgatgtgaaagcctctcacccc

SEQ ID NO: 183632 - DNA, 25 bp, Homo sapien
tcaccccaatcctcggagactgagt

SEQ ID NO: 183633 - DNA, 25 bp, Homo sapien
ggagactgagttccacaactttttt

SEQ ID NO: 183634 - DNA, 25 bp, Homo sapien
agataatttatcctcattcaacaca

SEQ ID NO: 183635 - DNA, 25 bp, Homo sapien
ctcattcaacacaggcccagaaaat

SEQ ID NO: 183636 - DNA, 25 bp, Homo sapien
aggcccagaaaattgtgtcccagaa

SEQ ID NO: 183637 - DNA, 25 bp, Homo sapien
gtcccagaaggatgtcagtaattgt

SEQ ID NO: 183638 - DNA, 25 bp, Homo sapien
tagcattttgctaagacttgaaaca

SEQ ID NO: 183639 - DNA, 25 bp, Homo sapien
gatgccttctagaacttactgtgta

SEQ ID NO: 183640 - DNA, 25 bp, Homo sapien
ataaattgtcactttcattgtcttt

SEQ ID NO: 183641 - DNA, 25 bp, Homo sapien
cattgtctttattgtaactccattg

SEQ ID NO: 183642 - DNA, 25 bp, Homo sapien
taactccattgatcccgtatcttaa

SEQ ID NO: 183643 - DNA, 25 bp, Homo sapien
gtatcttaacggttcacgtctagcc

SEQ ID NO: 183644 - DNA, 25 bp, Homo sapien
ggttcacgtctagccaaataactgt

SEQ ID NO: 183645 - DNA, 25 bp, Homo sapien
tgtatcatcaaactctctctctaaa

SEQ ID NO: 183646 - DNA, 25 bp, Homo sapien
aatgctgttgaatatgatacttttg

SEQ ID NO: 183647 - DNA, 25 bp, Homo sapien
gagagagtgtgctcagaacttagac

SEQ ID NO: 183648 - DNA, 25 bp, Homo sapien
gtgtgctcagaacttagacgggatt

SEQ ID NO: 183649 - DNA, 25 bp, Homo sapien
cttagacgggatttggtaggccaag

SEQ ID NO: 183650 - DNA, 25 bp, Homo sapien
gtaggccaagtatgctaagtgtaca

SEQ ID NO: 183651 - DNA, 25 bp, Homo sapien
atgtactcttgctttgtcaagctgt

SEQ ID NO: 183652 - DNA, 25 bp, Homo sapien
gtcaagctgtttgctatagtttcca

SEQ ID NO: 183653 - DNA, 25 bp, Homo sapien
tttgctatagtttccaaggtattat

SEQ ID NO: 183654 - DNA, 25 bp, Homo sapien
ggtattatgttactctaactctgaa

SEQ ID NO: 183655 - DNA, 25 bp, Homo sapien
gttactctaactctgaaaagtgatg

SEQ ID NO: 183656 - DNA, 25 bp, Homo sapien
ccctacactttaatggagactttgg

SEQ ID NO: 183657 - DNA, 25 bp, Homo sapien
tgctatgcgtgcgacagtgccttct

SEQ ID NO: 183658 - DNA, 25 bp, Homo sapien
tgtgggaacgtattctgctccagtt

SEQ ID NO: 183659 - DNA, 25 bp, Homo sapien
tgctccagttgttgtaaccagaagg

SEQ ID NO: 183660 - DNA, 25 bp, Homo sapien
tgttgtaaccagaaggttccagttc

SEQ ID NO: 183661 - DNA, 25 bp, Homo sapien
agcagctctttgaacccagtcgagt

SEQ ID NO: 183662 - DNA, 25 bp, Homo sapien
gaacccagtcgagtatgcaagtctt

SEQ ID NO: 183663 - DNA, 25 bp, Homo sapien
gcaagtcttgctatagcagcctaca

SEQ ID NO: 183664 - DNA, 25 bp, Homo sapien
tatagcagcctacatcccacaagct

SEQ ID NO: 183665 - DNA, 25 bp, Homo sapien
aagctccagcattgaccttgaactg

SEQ ID NO: 183666 - DNA, 25 bp, Homo sapien
gaccttgaactggataagcccattg

SEQ ID NO: 183667 - DNA, 25 bp, Homo sapien
gggttggctggttccctgccaacta

SEQ ID NO: 183668 - DNA, 25 bp, Homo sapien
ccaactacgtggaggaagattattc

SEQ ID NO: 183669 - DNA, 25 bp, Homo sapien
ttattctgaatactgctgagccctg

SEQ ID NO: 183670 - DNA, 25 bp, Homo sapien
ttctgaatactgctgagccctggtg

SEQ ID NO: 183671 - DNA, 25 bp, Homo sapien
ccctggtgccttggcagagagacga

SEQ ID NO: 183672 - DNA, 25 bp, Homo sapien
gtgccttggcagagagacgagaaac

SEQ ID NO: 183673 - DNA, 25 bp, Homo sapien
agacgagaaactccaggctctgagc

SEQ ID NO: 183674 - DNA, 25 bp, Homo sapien
ggagactttgggatggactggagga

SEQ ID NO: 183675 - DNA, 25 bp, Homo sapien
cagctggcggtgctcccgggatgtg

SEQ ID NO: 183676 - DNA, 25 bp, Homo sapien
ccgggatgtgccctgacatggttaa

SEQ ID NO: 183677 - DNA, 25 bp, Homo sapien
atgtgccctgacatggttaatttat

SEQ ID NO: 183678 - DNA, 25 bp, Homo sapien
agtgccaaaggatcttccccctgac

SEQ ID NO: 183679 - DNA, 25 bp, Homo sapien
tgacacaactctgctagacctgcaa

SEQ ID NO: 183680 - DNA, 25 bp, Homo sapien
acacaactctgctagacctgcaaaa

SEQ ID NO: 183681 - DNA, 25 bp, Homo sapien
acaactctgctagacctgcaaaaca

SEQ ID NO: 183682 - DNA, 25 bp, Homo sapien
aataaccgaaatcaaagatggagac

SEQ ID NO: 183683 - DNA, 25 bp, Homo sapien
agatggagactttaagaacctgaag

SEQ ID NO: 183684 - DNA, 25 bp, Homo sapien
tggagactttaagaacctgaagaac

SEQ ID NO: 183685 - DNA, 25 bp, Homo sapien
tgaagaaccttcacgttgtctacct

SEQ ID NO: 183686 - DNA, 25 bp, Homo sapien
gaagaaccttcacgttgtctacctt

SEQ ID NO: 183687 - DNA, 25 bp, Homo sapien
agaaccttcacgttgtctaccttca

SEQ ID NO: 183688 - DNA, 25 bp, Homo sapien
gaaccttcacgttgtctaccttcat

SEQ ID NO: 183689 - DNA, 25 bp, Homo sapien
gaacttcaaagatagaatcccattt

SEQ ID NO: 183690 - DNA, 25 bp, Homo sapien
gaactgaagtagcaaaatcatcttt

SEQ ID NO: 183691 - DNA, 25 bp, Homo sapien
attctttaggaaatagctattgcca

SEQ ID NO: 183692 - DNA, 25 bp, Homo sapien
atagctattgccaaagtgaaggtgt

SEQ ID NO: 183693 - DNA, 25 bp, Homo sapien
ggtgtagataatacctagtcttgtt

SEQ ID NO: 183694 - DNA, 25 bp, Homo sapien
gataatacctagtcttgttacataa

SEQ ID NO: 183695 - DNA, 25 bp, Homo sapien
atacctagtcttgttacataaaggg

SEQ ID NO: 183696 - DNA, 25 bp, Homo sapien
gtggtttgcagaagaattttcttta

SEQ ID NO: 183697 - DNA, 25 bp, Homo sapien
ttgaagttttaagggacgtcagtgt

SEQ ID NO: 183698 - DNA, 25 bp, Homo sapien
cagttccaaaatgattccattccat

SEQ ID NO: 183699 - DNA, 25 bp, Homo sapien
gtatgtaacctgaaatccttaataa

SEQ ID NO: 183700 - DNA, 25 bp, Homo sapien
tgtggccttttttgatgttatgttt

SEQ ID NO: 183701 - DNA, 25 bp, Homo sapien
gttatgttttatccagtagctttac

SEQ ID NO: 183702 - DNA, 25 bp, Homo sapien
tatccagtagctttactaaggtata

SEQ ID NO: 183703 - DNA, 25 bp, Homo sapien
gacaaattttgacatggtgtatacc

SEQ ID NO: 183704 - DNA, 25 bp, Homo sapien
ggtgtataccttcgaaactatgcca

SEQ ID NO: 183705 - DNA, 25 bp, Homo sapien
accttcgaaactatgccacagtctg

SEQ ID NO: 183706 - DNA, 25 bp, Homo sapien
cgaaactatgccacagtctggatgt

SEQ ID NO: 183707 - DNA, 25 bp, Homo sapien
gccacagtctggatgtgtttactga

SEQ ID NO: 183708 - DNA, 25 bp, Homo sapien
gtctggatgtgtttactgaaacatt

SEQ ID NO: 183709 - DNA, 25 bp, Homo sapien
taaaatcttttactaaccccatgat

SEQ ID NO: 183710 - DNA, 25 bp, Homo sapien
ttactaaccccatgataaaaggaga

SEQ ID NO: 183711 - DNA, 25 bp, Homo sapien
tggaggaagatctcagcagcactcc

SEQ ID NO: 183712 - DNA, 25 bp, Homo sapien
agcagcactcccctattgaaagacc

SEQ ID NO: 183713 - DNA, 25 bp, Homo sapien
actcccctattgaaagacctgctgg

SEQ ID NO: 183714 - DNA, 25 bp, Homo sapien
acctgctggagctcacaaggcggga

SEQ ID NO: 183715 - DNA, 25 bp, Homo sapien
tcacaaggcgggagttccagagaga

SEQ ID NO: 183716 - DNA, 25 bp, Homo sapien
ggacatagctctgaattaccgggac

SEQ ID NO: 183717 - DNA, 25 bp, Homo sapien
agctctgaattaccgggacgctgag

SEQ ID NO: 183718 - DNA, 25 bp, Homo sapien
atctggttcggctgctgtcggatga

SEQ ID NO: 183719 - DNA, 25 bp, Homo sapien
ctgtcggatgaggacgtagcgctca

SEQ ID NO: 183720 - DNA, 25 bp, Homo sapien
gtagcgctcatggtgcggcaggctc

SEQ ID NO: 183721 - DNA, 25 bp, Homo sapien
ggaagctgcacatcacgcagaagga

SEQ ID NO: 183722 - DNA, 25 bp, Homo sapien
ttgacccacgctgtacaagtaacat

SEQ ID NO: 183723 - DNA, 25 bp, Homo sapien
agtaacatccaagagcccattctac

SEQ ID NO: 183724 - DNA, 25 bp, Homo sapien
tctacaagtgggtggttttggtctt

SEQ ID NO: 183725 - DNA, 25 bp, Homo sapien
aagtcactgatgtttgttcctgtta

SEQ ID NO: 183726 - DNA, 25 bp, Homo sapien
tagcattgtaatgagagcccatcaa

SEQ ID NO: 183727 - DNA, 25 bp, Homo sapien
gagagcccatcaaatcctgagtgtc

SEQ ID NO: 183728 - DNA, 25 bp, Homo sapien
tcctgagtgtcagtttgttgtccct

SEQ ID NO: 183729 - DNA, 25 bp, Homo sapien
gtcagtttgttgtccctattgtaga

SEQ ID NO: 183730 - DNA, 25 bp, Homo sapien
gaatgcttttccacgtagacttatc

SEQ ID NO: 183731 - DNA, 25 bp, Homo sapien
gaatgtgaacacaactctttggtta

SEQ ID NO: 183732 - DNA, 25 bp, Homo sapien
aatgcttaactgtagtcctgagtag

SEQ ID NO: 183733 - DNA, 25 bp, Homo sapien
ggcccagacttctccaaggacaaca

SEQ ID NO: 183734 - DNA, 25 bp, Homo sapien
gccagaagtgccagtcagaggtaca

SEQ ID NO: 183735 - DNA, 25 bp, Homo sapien
agaggtacagcagccttttaccatc

SEQ ID NO: 183736 - DNA, 25 bp, Homo sapien
tctcccagctgccagtgggtgcaag

SEQ ID NO: 183737 - DNA, 25 bp, Homo sapien
gtgggtgcaagcagacctctactaa

SEQ ID NO: 183738 - DNA, 25 bp, Homo sapien
aagcagacctctactaaacgcaaag

SEQ ID NO: 183739 - DNA, 25 bp, Homo sapien
atgatggaatcaaacggctctataa

SEQ ID NO: 183740 - DNA, 25 bp, Homo sapien
gggttctgtgtgtggcactgattta

SEQ ID NO: 183741 - DNA, 25 bp, Homo sapien
aagagggacatgcttccccttgtcc

SEQ ID NO: 183742 - DNA, 25 bp, Homo sapien
ttgcagcctgtttctgtcatgtagt

SEQ ID NO: 183743 - DNA, 25 bp, Homo sapien
atgtagtttcaacaagtgctacctt

SEQ ID NO: 183744 - DNA, 25 bp, Homo sapien
atgaatcccaatggcctgcacttgt

SEQ ID NO: 183745 - DNA, 25 bp, Homo sapien
ccaatggcctgcacttgtacagttt

SEQ ID NO: 183746 - DNA, 25 bp, Homo sapien
tggcctgcacttgtacagtttgggt

SEQ ID NO: 183747 - DNA, 25 bp, Homo sapien
ggtgtttgatagataaagcacgtat

SEQ ID NO: 183748 - DNA, 25 bp, Homo sapien
tttttcttttcaattctagctcaga

SEQ ID NO: 183749 - DNA, 25 bp, Homo sapien
gcagaaggtaaataatgtcaggtca

SEQ ID NO: 183750 - DNA, 25 bp, Homo sapien
tgtcaggtcaatgaatatcagatat

SEQ ID NO: 183751 - DNA, 25 bp, Homo sapien
gaagtgtaatctttttacacctgca

SEQ ID NO: 183752 - DNA, 25 bp, Homo sapien
tatttattcttgtaaatgttccctg

SEQ ID NO: 183753 - DNA, 25 bp, Homo sapien
atgttccctgacaatgtttgtaata

SEQ ID NO: 183754 - DNA, 25 bp, Homo sapien
ccctgacaatgtttgtaatatggct

SEQ ID NO: 183755 - DNA, 25 bp, Homo sapien
tgtatgccagctacacctttttcta

SEQ ID NO: 183756 - DNA, 25 bp, Homo sapien
tttccccacaccaatggtaatttat

SEQ ID NO: 183757 - DNA, 25 bp, Homo sapien
ccaatggtaatttatcttcacagat

SEQ ID NO: 183758 - DNA, 25 bp, Homo sapien
ttcacagattgttcttcatttctag

SEQ ID NO: 183759 - DNA, 25 bp, Homo sapien
cagattgttcttcatttctagaaat

SEQ ID NO: 183760 - DNA, 25 bp, Homo sapien
gttacttcatggtaattacttgagc

SEQ ID NO: 183761 - DNA, 25 bp, Homo sapien
aaagcttgaaaatccctgacaagta

SEQ ID NO: 183762 - DNA, 25 bp, Homo sapien
atccctgacaagtacttttcatctc

SEQ ID NO: 183763 - DNA, 25 bp, Homo sapien
gacaagtacttttcatctcatagta

SEQ ID NO: 183764 - DNA, 25 bp, Homo sapien
agtatattagttttcactcagtcat

SEQ ID NO: 183765 - DNA, 25 bp, Homo sapien
attagttttcactcagtcattttat

SEQ ID NO: 183766 - DNA, 25 bp, Homo sapien
gaaaatgtttacacactgtgctgca

SEQ ID NO: 183767 - DNA, 25 bp, Homo sapien
cacactgtgctgcaatctactgttt

SEQ ID NO: 183768 - DNA, 25 bp, Homo sapien
ggaaacatggctatacgatcgcaga

SEQ ID NO: 183769 - DNA, 25 bp, Homo sapien
atacgatcgcagagttgtatttcct

SEQ ID NO: 183770 - DNA, 25 bp, Homo sapien
gagttgtatttcctcacaaacttct

SEQ ID NO: 183771 - DNA, 25 bp, Homo sapien
cacaaacttctttacgaagagtgaa

SEQ ID NO: 183772 - DNA, 25 bp, Homo sapien
cctctcagtttcagtcagggacata

SEQ ID NO: 183773 - DNA, 25 bp, Homo sapien
ctgtgattgtgcctatgcgtgatga

SEQ ID NO: 183774 - DNA, 25 bp, Homo sapien
tgtgcctatgcgtgatgagtgaatg

SEQ ID NO: 183775 - DNA, 25 bp, Homo sapien
atgcatttcaatcatacattgccta

SEQ ID NO: 183776 - DNA, 25 bp, Homo sapien
aatcataacttgatgatgcttggga

SEQ ID NO: 183777 - DNA, 25 bp, Homo sapien
aaaaggtgcttggagaccatccctc

SEQ ID NO: 183778 - DNA, 25 bp, Homo sapien
atccctcaacatcgcaactgtgttg

SEQ ID NO: 183779 - DNA, 25 bp, Homo sapien
aactgtgttgacctctattcagctg

SEQ ID NO: 183780 - DNA, 25 bp, Homo sapien
tctattcagctgctcatgtcagaac

SEQ ID NO: 183781 - DNA, 25 bp, Homo sapien
tgatgacccgctcatggctgacata

SEQ ID NO: 183782 - DNA, 25 bp, Homo sapien
taataagccagccttcctcaagaat

SEQ ID NO: 183783 - DNA, 25 bp, Homo sapien
ctcaagaatgccagacagtggacag

SEQ ID NO: 183784 - DNA, 25 bp, Homo sapien
cagtggacagagaagcatgcaagac

SEQ ID NO: 183785 - DNA, 25 bp, Homo sapien
atctaccagaggctggtgactccag

SEQ ID NO: 183786 - DNA, 25 bp, Homo sapien
ggtgactccagagtacacaactcaa

SEQ ID NO: 183787 - DNA, 25 bp, Homo sapien
gaaggccagtcagctagtaggcata

SEQ ID NO: 183788 - DNA, 25 bp, Homo sapien
agccgactgcatgaaccaaagttct

SEQ ID NO: 183789 - DNA, 25 bp, Homo sapien
caaagttctcacctaatggtatcat

SEQ ID NO: 183790 - DNA, 25 bp, Homo sapien
aatggtatcatcacgcagtgcacaa

SEQ ID NO: 183791 - DNA, 25 bp, Homo sapien
tcacgcagtgcacaatcatttatct

SEQ ID NO: 183792 - DNA, 25 bp, Homo sapien
atcatttatctatgttttgccaggg

SEQ ID NO: 183793 - DNA, 25 bp, Homo sapien
tattgacatacaacgcagcatgcta

SEQ ID NO: 183794 - DNA, 25 bp, Homo sapien
gggtacaccattgacttcatttgta

SEQ ID NO: 183795 - DNA, 25 bp, Homo sapien
gttagaggatgcattttgggttcat

SEQ ID NO: 183796 - DNA, 25 bp, Homo sapien
ttgggttcatctttcttgagtggag

SEQ ID NO: 183797 - DNA, 25 bp, Homo sapien
ttaatctgctaattggttgcctatg

SEQ ID NO: 183798 - DNA, 25 bp, Homo sapien
ggttgcctatgaaatcacattgtct

SEQ ID NO: 183799 - DNA, 25 bp, Homo sapien
accgtggtgaccttcttctgccggc

SEQ ID NO: 183800 - DNA, 25 bp, Homo sapien
tcttctgccggccacataacatttg

SEQ ID NO: 183801 - DNA, 25 bp, Homo sapien
tgccggccacataacatttgcactt

SEQ ID NO: 183802 - DNA, 25 bp, Homo sapien
taacatttgcactttcgtccctcgc

SEQ ID NO: 183803 - DNA, 25 bp, Homo sapien
gcaaggccggcatctgcttcggaga

SEQ ID NO: 183804 - DNA, 25 bp, Homo sapien
atctgcttcggagactcaggtggcc

SEQ ID NO: 183805 - DNA, 25 bp, Homo sapien
caggtggccccctgatctgtgatgg

SEQ ID NO: 183806 - DNA, 25 bp, Homo sapien
ctgtgatggcatcatccaaggaata

SEQ ID NO: 183807 - DNA, 25 bp, Homo sapien
ggaatagactccttcgtgatctggg

SEQ ID NO: 183808 - DNA, 25 bp, Homo sapien
ttccctgacttcttcacgcgggtag

SEQ ID NO: 183809 - DNA, 25 bp, Homo sapien
ctgacttcttcacgcgggtagccct

SEQ ID NO: 183810 - DNA, 25 bp, Homo sapien
taatcatttgtatccatgtggaata

SEQ ID NO: 183811 - DNA, 25 bp, Homo sapien
gtgacaatttcctacgcacacagta

SEQ ID NO: 183812 - DNA, 25 bp, Homo sapien
ttcctacgcacacagtattttttca

SEQ ID NO: 183813 - DNA, 25 bp, Homo sapien
aaacatttccctcccatttgccttg

SEQ ID NO: 183814 - DNA, 25 bp, Homo sapien
ttaaaagacgtttgtaaccactgtg

SEQ ID NO: 183815 - DNA, 25 bp, Homo sapien
gtaaccactgtgttttatctactgt

SEQ ID NO: 183816 - DNA, 25 bp, Homo sapien
ctgtgttttatctactgtgtgttgt

SEQ ID NO: 183817 - DNA, 25 bp, Homo sapien
ctgtgtgttgtggtggcctgttgga

SEQ ID NO: 183818 - DNA, 25 bp, Homo sapien
gttggaggcaaatagatcagatttt

SEQ ID NO: 183819 - DNA, 25 bp, Homo sapien
ttttgtacctacgtaagagtacttg

SEQ ID NO: 183820 - DNA, 25 bp, Homo sapien
ttcactatgtgtggcacggatacaa

SEQ ID NO: 183821 - DNA, 25 bp, Homo sapien
ccaataccaacatgccatcagacat

SEQ ID NO: 183822 - DNA, 25 bp, Homo sapien
accaacatgccatcagacatgaggg

SEQ ID NO: 183823 - DNA, 25 bp, Homo sapien
agggagtgttggttgctacggtgat

SEQ ID NO: 183824 - DNA, 25 bp, Homo sapien
gggctcagagcagaaccaaagcatg

SEQ ID NO: 183825 - DNA, 25 bp, Homo sapien
aagcatgattgtgacctccagaggt

SEQ ID NO: 183826 - DNA, 25 bp, Homo sapien
tgacctccagaggtgatggtaactg

SEQ ID NO: 183827 - DNA, 25 bp, Homo sapien
gatggtaactgcacacatggtttcc

SEQ ID NO: 183828 - DNA, 25 bp, Homo sapien
gtaactgcacacatggtttccaagg

SEQ ID NO: 183829 - DNA, 25 bp, Homo sapien
acacatggtttccaagggtcttcct

SEQ ID NO: 183830 - DNA, 25 bp, Homo sapien
catggtttccaagggtcttcctcct

SEQ ID NO: 183831 - DNA, 25 bp, Homo sapien
gggcctcccaaggaaaatggacata

SEQ ID NO: 183832 - DNA, 25 bp, Homo sapien
ggccacatctctgaggtgtcagaat

SEQ ID NO: 183833 - DNA, 25 bp, Homo sapien
gtgtcagaattaagctgcctcagta

SEQ ID NO: 183834 - DNA, 25 bp, Homo sapien
aagccagaagctctagctttaccca

SEQ ID NO: 183835 - DNA, 25 bp, Homo sapien
gctctgcctggagactaaggcaaat

SEQ ID NO: 183836 - DNA, 25 bp, Homo sapien
aaattgggccattaaaagctcagct

SEQ ID NO: 183837 - DNA, 25 bp, Homo sapien
taaaagctcagctcctatgttggta

SEQ ID NO: 183838 - DNA, 25 bp, Homo sapien
ttttgttgctttcacactctatcca

SEQ ID NO: 183839 - DNA, 25 bp, Homo sapien
gctttcacactctatccacaggata

SEQ ID NO: 183840 - DNA, 25 bp, Homo sapien
tagattgaaactgccagcttccacc

SEQ ID NO: 183841 - DNA, 25 bp, Homo sapien
gatccctgaccctgggatggctgga

SEQ ID NO: 183842 - DNA, 25 bp, Homo sapien
tgagcagagccaagcagcacagagt

SEQ ID NO: 183843 - DNA, 25 bp, Homo sapien
ctatacgatcgcagagttgtatttc

SEQ ID NO: 183844 - DNA, 25 bp, Homo sapien
tatacgatcgcagagttgtatttcc

SEQ ID NO: 183845 - DNA, 25 bp, Homo sapien
atacgatcgcagagttgtatttcct

SEQ ID NO: 183846 - DNA, 25 bp, Homo sapien
tgaatgcatttcaatcatacattgc

SEQ ID NO: 183847 - DNA, 25 bp, Homo sapien
gaatgcatttcaatcatacattgcc

SEQ ID NO: 183848 - DNA, 25 bp, Homo sapien
aatgcatttcaatcatacattgcct

SEQ ID NO: 183849 - DNA, 25 bp, Homo sapien
atgcatttcaatcatacattgccta

SEQ ID NO: 183850 - DNA, 25 bp, Homo sapien
tgcatttcaatcatacattgcctaa

SEQ ID NO: 183851 - DNA, 25 bp, Homo sapien
cagcaccaaggccagccacttggag

SEQ ID NO: 183852 - DNA, 25 bp, Homo sapien
ccagccacttggagcagagccaggg

SEQ ID NO: 183853 - DNA, 25 bp, Homo sapien
ctgcaggaccagcatcatctgagag

SEQ ID NO: 183854 - DNA, 25 bp, Homo sapien
tggagcagggtcacccacggacaga

SEQ ID NO: 183855 - DNA, 25 bp, Homo sapien
gaccaagagaggtcctgcgaaggct

SEQ ID NO: 183856 - DNA, 25 bp, Homo sapien
aggctgggcactgctgtgggacagc

SEQ ID NO: 183857 - DNA, 25 bp, Homo sapien
tgtgtcctccttcagctgaagatgc

SEQ ID NO: 183858 - DNA, 25 bp, Homo sapien
ccttggactcttccgaagggatgtg

SEQ ID NO: 183859 - DNA, 25 bp, Homo sapien
ctcttccgaagggatgtgaggcact

SEQ ID NO: 183860 - DNA, 25 bp, Homo sapien
ggcctgggatttggttcgtttgctc

SEQ ID NO: 183861 - DNA, 25 bp, Homo sapien
tttggttcgtttgctcttctgggaa

SEQ ID NO: 183862 - DNA, 25 bp, Homo sapien
tatctggatggtgcctctcaaacaa

SEQ ID NO: 183863 - DNA, 25 bp, Homo sapien
aagtccaattcccatgggatgcctt

SEQ ID NO: 183864 - DNA, 25 bp, Homo sapien
tttagacctaggactgccaaagctt

SEQ ID NO: 183865 - DNA, 25 bp, Homo sapien
aaagcttccctattgctgctagtca

SEQ ID NO: 183866 - DNA, 25 bp, Homo sapien
atggagtactgcactaccgcctgta

SEQ ID NO: 183867 - DNA, 25 bp, Homo sapien
tgtagtttcccttcactctatccac

SEQ ID NO: 183868 - DNA, 25 bp, Homo sapien
tatccacgcatttcatgaactctct

SEQ ID NO: 183869 - DNA, 25 bp, Homo sapien
gaactctcttcaaattactcaatat

SEQ ID NO: 183870 - DNA, 25 bp, Homo sapien
atatgggtagccatcgacttcttac

SEQ ID NO: 183871 - DNA, 25 bp, Homo sapien
gacttcttaccaaggccctgactga

SEQ ID NO: 183872 - DNA, 25 bp, Homo sapien
aggccctgactgagacactttcatt

SEQ ID NO: 183873 - DNA, 25 bp, Homo sapien
tagtgattcacagtatccctcttag

SEQ ID NO: 183874 - DNA, 25 bp, Homo sapien
agtatccctcttagcattaatttaa

SEQ ID NO: 183875 - DNA, 25 bp, Homo sapien
aggcagattgattttccctctttcc

SEQ ID NO: 183876 - DNA, 25 bp, Homo sapien
tccctctttcctggtaattcctaag

SEQ ID NO: 183877 - DNA, 25 bp, Homo sapien
cccaccatgtccttagatctaatct

SEQ ID NO: 183878 - DNA, 25 bp, Homo sapien
gatctaatctgtgctaccttattaa

SEQ ID NO: 183879 - DNA, 25 bp, Homo sapien
ccttattaactcacagcaggcttac

SEQ ID NO: 183880 - DNA, 25 bp, Homo sapien
gcaggcttactgaatggcttcattt

SEQ ID NO: 183881 - DNA, 25 bp, Homo sapien
atggcttcatttcagatttagttga

SEQ ID NO: 183882 - DNA, 25 bp, Homo sapien
cagatttagttgatttctccaccaa

SEQ ID NO: 183883 - DNA, 25 bp, Homo sapien
gcatgtcatgtattctcaataggct

SEQ ID NO: 183884 - DNA, 25 bp, Homo sapien
tttcaaggtggctggttccatttaa

SEQ ID NO: 183885 - DNA, 25 bp, Homo sapien
ctttttatatgtgtcttcggttcta

SEQ ID NO: 183886 - DNA, 25 bp, Homo sapien
ttcggttctagacttcagcttttgg

SEQ ID NO: 183887 - DNA, 25 bp, Homo sapien
gacttcagcttttggaaattgctaa

SEQ ID NO: 183888 - DNA, 25 bp, Homo sapien
gaattcaaaaatctctgcatcctga

SEQ ID NO: 183889 - DNA, 25 bp, Homo sapien
ctgcatcctgaggtgatatacttca

SEQ ID NO: 183890 - DNA, 25 bp, Homo sapien
gtaatcaactgaaagagctgtgcat

SEQ ID NO: 183891 - DNA, 25 bp, Homo sapien
gaacaattcttatttatgcccacaa

SEQ ID NO: 183892 - DNA, 25 bp, Homo sapien
ttatttatgcccacaaccattgcta

SEQ ID NO: 183893 - DNA, 25 bp, Homo sapien
attgctatattttgtatggatgtca

SEQ ID NO: 183894 - DNA, 25 bp, Homo sapien
aaagtctatttaacctctgtaatga

SEQ ID NO: 183895 - DNA, 25 bp, Homo sapien
aactggaggactggacctgccaact

SEQ ID NO: 183896 - DNA, 25 bp, Homo sapien
actggtgcctccctgaagttttacg

SEQ ID NO: 183897 - DNA, 25 bp, Homo sapien
ccctgaagttttacgtgccttgcaa

SEQ ID NO: 183898 - DNA, 25 bp, Homo sapien
tgaagttttacgtgccttgcaagca

SEQ ID NO: 183899 - DNA, 25 bp, Homo sapien
gagtcagttatctgctgatgggcca

SEQ ID NO: 183900 - DNA, 25 bp, Homo sapien
ttatctgctgatgggccaggtagaa

SEQ ID NO: 183901 - DNA, 25 bp, Homo sapien
tagaagagaacagaggccccgtcct

SEQ ID NO: 183902 - DNA, 25 bp, Homo sapien
agagagctttgtggttctccaccgg

SEQ ID NO: 183903 - DNA, 25 bp, Homo sapien
aagcaagaggaagtgcccctctcaa

SEQ ID NO: 183904 - DNA, 25 bp, Homo sapien
aagtgcccctctcaacctgtgcggg

SEQ ID NO: 183905 - DNA, 25 bp, Homo sapien
gtcccaggactgagacgcaggccag

SEQ ID NO: 183906 - DNA, 25 bp, Homo sapien
gcagcacagacaacgctgtggataa

SEQ ID NO: 183907 - DNA, 25 bp, Homo sapien
aaggagagtagagacttcctcttcc

SEQ ID NO: 183908 - DNA, 25 bp, Homo sapien
tgcctcctgtcttctggagttgtga

SEQ ID NO: 183909 - DNA, 25 bp, Homo sapien
tcttctggagttgtgaccgcagggt

SEQ ID NO: 183910 - DNA, 25 bp, Homo sapien
tgcagccgaaaagcaggagcctcac

SEQ ID NO: 183911 - DNA, 25 bp, Homo sapien
aggagcctcacccacggtctgtggc

SEQ ID NO: 183912 - DNA, 25 bp, Homo sapien
gtctgtggctctgactaagcctgga

SEQ ID NO: 183913 - DNA, 25 bp, Homo sapien
tctcggctgtgctccgtggactggc

SEQ ID NO: 183914 - DNA, 25 bp, Homo sapien
gctccccagggatccatgtgagaga

SEQ ID NO: 183915 - DNA, 25 bp, Homo sapien
gatccatgtgagagaccggagtatg

SEQ ID NO: 183916 - DNA, 25 bp, Homo sapien
gaccggagtatgatcctcagtgcga

SEQ ID NO: 183917 - DNA, 25 bp, Homo sapien
ggatccacagaaccctcataaactg

SEQ ID NO: 183918 - DNA, 25 bp, Homo sapien
agaaccctcataaactgcatattgt

SEQ ID NO: 183919 - DNA, 25 bp, Homo sapien
taaactgcatattgttaccagaata

SEQ ID NO: 183920 - DNA, 25 bp, Homo sapien
aaaaagtacaagaagacgtccatat

SEQ ID NO: 183921 - DNA, 25 bp, Homo sapien
agaaaaagcacatacccctcaagtt

SEQ ID NO: 183922 - DNA, 25 bp, Homo sapien
acatacccctcaagttcacaagaat

SEQ ID NO: 183923 - DNA, 25 bp, Homo sapien
caagaatatcccttcagtgaatgca

SEQ ID NO: 183924 - DNA, 25 bp, Homo sapien
aaggtttgttgtttcttctcagctc

SEQ ID NO: 183925 - DNA, 25 bp, Homo sapien
tgtttcttctcagctctttttaaaa

SEQ ID NO: 183926 - DNA, 25 bp, Homo sapien
aaaatgtattgcctagtgtaattct

SEQ ID NO: 183927 - DNA, 25 bp, Homo sapien
gtattgcctagtgtaattctaaatg

SEQ ID NO: 183928 - DNA, 25 bp, Homo sapien
accgggcaaatggagggccgcttca

SEQ ID NO: 183929 - DNA, 25 bp, Homo sapien
cgcttcacaggacagcgtcgctgaa

SEQ ID NO: 183930 - DNA, 25 bp, Homo sapien
gtcgctgaagctccactgttggcaa

SEQ ID NO: 183931 - DNA, 25 bp, Homo sapien
ctccactgttggcaaagtcttggca

SEQ ID NO: 183932 - DNA, 25 bp, Homo sapien
gtcttggcagtggtacattattcat

SEQ ID NO: 183933 - DNA, 25 bp, Homo sapien
attcatcgtgtttgcattcttgtta

SEQ ID NO: 183934 - DNA, 25 bp, Homo sapien
gaatgtgacacagcctttttgatca

SEQ ID NO: 183935 - DNA, 25 bp, Homo sapien
gaaaagcatctttggttatcagtta

SEQ ID NO: 183936 - DNA, 25 bp, Homo sapien
attgaggtggacattatttccccaa

SEQ ID NO: 183937 - DNA, 25 bp, Homo sapien
attatttccccaatttcacaacagg

SEQ ID NO: 183938 - DNA, 25 bp, Homo sapien
gaccatatcttaaactatctacgac

SEQ ID NO: 183939 - DNA, 25 bp, Homo sapien
gagccagccgagagcccatcggaga

SEQ ID NO: 183940 - DNA, 25 bp, Homo sapien
cagcccggcaggacctacaagggat

SEQ ID NO: 183941 - DNA, 25 bp, Homo sapien
gacctacaagggatgagccagccaa

SEQ ID NO: 183942 - DNA, 25 bp, Homo sapien
ctacaagggatgagccagccaaggc

SEQ ID NO: 183943 - DNA, 25 bp, Homo sapien
ctttgttaatcgacccttctggagc

SEQ ID NO: 183944 - DNA, 25 bp, Homo sapien
tgttaatcgacccttctggagcggg

SEQ ID NO: 183945 - DNA, 25 bp, Homo sapien
agggcttgcctttcttagtctgatg

SEQ ID NO: 183946 - DNA, 25 bp, Homo sapien
ttagtctgatgccaagcaaggcctt

SEQ ID NO: 183947 - DNA, 25 bp, Homo sapien
caagctgcggaggttcaagcccagc

SEQ ID NO: 183948 - DNA, 25 bp, Homo sapien
gcggaggttcaagcccagctctctg

SEQ ID NO: 183949 - DNA, 25 bp, Homo sapien
cgcatccgctcgagggctccaggaa

SEQ ID NO: 183950 - DNA, 25 bp, Homo sapien
atgccatgacattggaagaaggtgg

SEQ ID NO: 183951 - DNA, 25 bp, Homo sapien
tgccatgacattggaagaaggtggt

SEQ ID NO: 183952 - DNA, 25 bp, Homo sapien
gcctccccagtaatcaaggttcaat

SEQ ID NO: 183953 - DNA, 25 bp, Homo sapien
cctccccagtaatcaaggttcaatg

SEQ ID NO: 183954 - DNA, 25 bp, Homo sapien
ccccagtaatcaaggttcaatgaca

SEQ ID NO: 183955 - DNA, 25 bp, Homo sapien
cccagtaatcaaggttcaatgacag

SEQ ID NO: 183956 - DNA, 25 bp, Homo sapien
agtaatcaaggttcaatgacaggaa

SEQ ID NO: 183957 - DNA, 25 bp, Homo sapien
gtaatcaaggttcaatgacaggaag

SEQ ID NO: 183958 - DNA, 25 bp, Homo sapien
gaagaccaggactacagctttccta

SEQ ID NO: 183959 - DNA, 25 bp, Homo sapien
agctttcctatatcttctattctag

SEQ ID NO: 183960 - DNA, 25 bp, Homo sapien
gtgttccctctgtgatgagctgtgc

SEQ ID NO: 183961 - DNA, 25 bp, Homo sapien
agctgtgccctgacagtaagtcgga

SEQ ID NO: 183962 - DNA, 25 bp, Homo sapien
taagtcggatgagcctgtctgtgcc

SEQ ID NO: 183963 - DNA, 25 bp, Homo sapien
tgtctgtgccagtgacaatgccact

SEQ ID NO: 183964 - DNA, 25 bp, Homo sapien
gacaatgccacttatgccagcgagt

SEQ ID NO: 183965 - DNA, 25 bp, Homo sapien
acttatgccagcgagtgtgccatga

SEQ ID NO: 183966 - DNA, 25 bp, Homo sapien
gtgtgccatgaaggaagctgcctgc

SEQ ID NO: 183967 - DNA, 25 bp, Homo sapien
ctgctcctcaggtgtgctactggaa

SEQ ID NO: 183968 - DNA, 25 bp, Homo sapien
gaagtaaagcactccggatcttgca

SEQ ID NO: 183969 - DNA, 25 bp, Homo sapien
gggatccacagaaccctcataaact

SEQ ID NO: 183970 - DNA, 25 bp, Homo sapien
atccacagaaccctcataaactgca

SEQ ID NO: 183971 - DNA, 25 bp, Homo sapien
agaaccctcataaactgcatattgt

SEQ ID NO: 183972 - DNA, 25 bp, Homo sapien
taaactgcatattgttaccagaata

SEQ ID NO: 183973 - DNA, 25 bp, Homo sapien
gattagaaaaagcacatacccctca

SEQ ID NO: 183974 - DNA, 25 bp, Homo sapien
gaaaaagcacatacccctcaagttc

SEQ ID NO: 183975 - DNA, 25 bp, Homo sapien
acatacccctcaagttcacaagaat

SEQ ID NO: 183976 - DNA, 25 bp, Homo sapien
agttcacaagaatatcccttcagtg

SEQ ID NO: 183977 - DNA, 25 bp, Homo sapien
caagaatatcccttcagtgaatgca

SEQ ID NO: 183978 - DNA, 25 bp, Homo sapien
gaatatcccttcagtgaatgcaaaa

SEQ ID NO: 183979 - DNA, 25 bp, Homo sapien
atcccttcagtgaatgcaaaattga

SEQ ID NO: 183980 - DNA, 25 bp, Homo sapien
gagccagccgagagcccatcggaga

SEQ ID NO: 183981 - DNA, 25 bp, Homo sapien
gagagcccatcggagaccccaggcc

SEQ ID NO: 183982 - DNA, 25 bp, Homo sapien
cagcccggcaggacctacaagggat

SEQ ID NO: 183983 - DNA, 25 bp, Homo sapien
ccggcaggacctacaagggatgagc

SEQ ID NO: 183984 - DNA, 25 bp, Homo sapien
ggcaggacctacaagggatgagcca

SEQ ID NO: 183985 - DNA, 25 bp, Homo sapien
gcaggacctacaagggatgagccag

SEQ ID NO: 183986 - DNA, 25 bp, Homo sapien
caggacctacaagggatgagccagc

SEQ ID NO: 183987 - DNA, 25 bp, Homo sapien
ggacctacaagggatgagccagcca

SEQ ID NO: 183988 - DNA, 25 bp, Homo sapien
gacctacaagggatgagccagccaa

SEQ ID NO: 183989 - DNA, 25 bp, Homo sapien
acctacaagggatgagccagccaag

SEQ ID NO: 183990 - DNA, 25 bp, Homo sapien
acgagccagccgagagcccatcgga

SEQ ID NO: 183991 - DNA, 25 bp, Homo sapien
ttgtacttacattgtgccaaaggct

SEQ ID NO: 183992 - DNA, 25 bp, Homo sapien
tgttctaccgtactttagtagtttg

SEQ ID NO: 183993 - DNA, 25 bp, Homo sapien
gaagttttcaagtgcataactattt

SEQ ID NO: 183994 - DNA, 25 bp, Homo sapien
gcataactatttttgaccagcagaa

SEQ ID NO: 183995 - DNA, 25 bp, Homo sapien
ttgaccagcagaaggcgatacgctt

SEQ ID NO: 183996 - DNA, 25 bp, Homo sapien
gaaggcgatacgcttcagtatttta

SEQ ID NO: 183997 - DNA, 25 bp, Homo sapien
ctactcttaattttcatgttggtga

SEQ ID NO: 183998 - DNA, 25 bp, Homo sapien
ggtgatgaaattcccagtggtgttt

SEQ ID NO: 183999 - DNA, 25 bp, Homo sapien
tcccagtggtgtttcttaaggttct

SEQ ID NO: 184000 - DNA, 25 bp, Homo sapien
cttaaggttctatcttgtgccatga

SEQ ID NO: 184001 - DNA, 25 bp, Homo sapien
ggttctatcttgtgccatgatgaat

SEQ ID NO: 184002 - DNA, 25 bp, Homo sapien
ggccgctcccttcggaggattcaaa

SEQ ID NO: 184003 - DNA, 25 bp, Homo sapien
cccttcggaggattcaaacagtctg

SEQ ID NO: 184004 - DNA, 25 bp, Homo sapien
aaacagtctggatttggcaaagatc

SEQ ID NO: 184005 - DNA, 25 bp, Homo sapien
gcaaagatctaggagaggcggctct

SEQ ID NO: 184006 - DNA, 25 bp, Homo sapien
gaggcggctctgaacgagtacctgc

SEQ ID NO: 184007 - DNA, 25 bp, Homo sapien
gagtacctgcgggtcaagacagtga

SEQ ID NO: 184008 - DNA, 25 bp, Homo sapien
gacagtgaccttcgaatactgaaga

SEQ ID NO: 184009 - DNA, 25 bp, Homo sapien
aaggtctgtgtgagaagaaagtccc

SEQ ID NO: 184010 - DNA, 25 bp, Homo sapien
tcttgagcctgggtgcacagcacct

SEQ ID NO: 184011 - DNA, 25 bp, Homo sapien
atcttggacgccctctgtccagtca

SEQ ID NO: 184012 - DNA, 25 bp, Homo sapien
tgtccagtcagaagcagcccttggc

SEQ ID NO: 184013 - DNA, 25 bp, Homo sapien
tgttaacatcccattgtacatttaa

SEQ ID NO: 184014 - DNA, 25 bp, Homo sapien
taaatggccattgtctttgtctcag

SEQ ID NO: 184015 - DNA, 25 bp, Homo sapien
gtgtaggtggacaatcttcctgtga

SEQ ID NO: 184016 - DNA, 25 bp, Homo sapien
gtggacaatcttcctgtgatatgta

SEQ ID NO: 184017 - DNA, 25 bp, Homo sapien
gtgacattggtcatgtagctagata

SEQ ID NO: 184018 - DNA, 25 bp, Homo sapien
tcgtaataaatcatgtgccacatct

SEQ ID NO: 184019 - DNA, 25 bp, Homo sapien
gccacatcttgtcttacacataaaa

SEQ ID NO: 184020 - DNA, 25 bp, Homo sapien
gtcttacacataaaagccactgctt

SEQ ID NO: 184021 - DNA, 25 bp, Homo sapien
aaagccactgcttttaacatcccat

SEQ ID NO: 184022 - DNA, 25 bp, Homo sapien
ccactgcttttaacatcccattgta

SEQ ID NO: 184023 - DNA, 25 bp, Homo sapien
tttaacatcccattgtacatttaac

SEQ ID NO: 184024 - DNA, 25 bp, Homo sapien
ccaggtgctctgggtcacggtccct

SEQ ID NO: 184025 - DNA, 25 bp, Homo sapien
tgctctgggtcacggtccctgtccc

SEQ ID NO: 184026 - DNA, 25 bp, Homo sapien
ctctgggtcacggtccctgtccccg

SEQ ID NO: 184027 - DNA, 25 bp, Homo sapien
tctgggtcacggtccctgtccccgc

SEQ ID NO: 184028 - DNA, 25 bp, Homo sapien
acccccaccggcctgacgctgtggc

SEQ ID NO: 184029 - DNA, 25 bp, Homo sapien
ccccaccggcctgacgctgtggccc

SEQ ID NO: 184030 - DNA, 25 bp, Homo sapien
ccaccggcctgacgctgtggccccg

SEQ ID NO: 184031 - DNA, 25 bp, Homo sapien
caccggcctgacgctgtggccccgg

SEQ ID NO: 184032 - DNA, 25 bp, Homo sapien
accggcctgacgctgtggccccggg

SEQ ID NO: 184033 - DNA, 25 bp, Homo sapien
agggatcagcccccaaagaaatggg

SEQ ID NO: 184034 - DNA, 25 bp, Homo sapien
tggcccacccccactttccagggca

SEQ ID NO: 184035 - DNA, 25 bp, Homo sapien
cccagaggtgctgcaagccctgaaa

SEQ ID NO: 184036 - DNA, 25 bp, Homo sapien
agaggtgctgcaagccctgaaacag

SEQ ID NO: 184037 - DNA, 25 bp, Homo sapien
gtgctgcaagccctgaaacagcttc

SEQ ID NO: 184038 - DNA, 25 bp, Homo sapien
gcaagccctgaaacagcttcagctg

SEQ ID NO: 184039 - DNA, 25 bp, Homo sapien
ttcagctgctcaaggcccagttaga

SEQ ID NO: 184040 - DNA, 25 bp, Homo sapien
tcaaggcccagttagacgcagctgt

SEQ ID NO: 184041 - DNA, 25 bp, Homo sapien
ggcccagttagacgcagctgtgacc

SEQ ID NO: 184042 - DNA, 25 bp, Homo sapien
tggcctgggcatgtgatggctcctc

SEQ ID NO: 184043 - DNA, 25 bp, Homo sapien
tgtgatggctcctcactgggagcct

SEQ ID NO: 184044 - DNA, 25 bp, Homo sapien
gggtttgtgcctgataacgtaataa

SEQ ID NO: 184045 - DNA, 25 bp, Homo sapien
tgataacgtaataacaccagtggag

SEQ ID NO: 184046 - DNA, 25 bp, Homo sapien
tcctcatgtacgtccacgactacta

SEQ ID NO: 184047 - DNA, 25 bp, Homo sapien
tcatgtacgtccacgactactacgt

SEQ ID NO: 184048 - DNA, 25 bp, Homo sapien
tactacgtgctcaactatgaggccc

SEQ ID NO: 184049 - DNA, 25 bp, Homo sapien
gtgctcaactatgaggccccagcgg

SEQ ID NO: 184050 - DNA, 25 bp, Homo sapien
tctcctcctaggcctcgagtgctgg

SEQ ID NO: 184051 - DNA, 25 bp, Homo sapien
gtcctgcacccctcagggatggcga

SEQ ID NO: 184052 - DNA, 25 bp, Homo sapien
cacccctcagggatggcgacagcag

SEQ ID NO: 184053 - DNA, 25 bp, Homo sapien
gcgacagcaggccagacacagtctg

SEQ ID NO: 184054 - DNA, 25 bp, Homo sapien
agacacagtctgatgccagctggga

SEQ ID NO: 184055 - DNA, 25 bp, Homo sapien
acagtctgatgccagctgggagtct

SEQ ID NO: 184056 - DNA, 25 bp, Homo sapien
agtctgatgccagctgggagtcttg

SEQ ID NO: 184057 - DNA, 25 bp, Homo sapien
aaaggttcaggcattcctagccgag

SEQ ID NO: 184058 - DNA, 25 bp, Homo sapien
cattcctagccgagtgtgacacagt

SEQ ID NO: 184059 - DNA, 25 bp, Homo sapien
tgagcggctgcagtctacaaacttt

SEQ ID NO: 184060 - DNA, 25 bp, Homo sapien
tctacaaactttgccctggccgagt

SEQ ID NO: 184061 - DNA, 25 bp, Homo sapien
gcagaaaaaggctgtgctgccctga

SEQ ID NO: 184062 - DNA, 25 bp, Homo sapien
tgtgctgccctgaagaatggcgcca

SEQ ID NO: 184063 - DNA, 25 bp, Homo sapien
agctctgccgtctctggatcggaat

SEQ ID NO: 184064 - DNA, 25 bp, Homo sapien
ggatcggaatttacctgatttcttc

SEQ ID NO: 184065 - DNA, 25 bp, Homo sapien
acctgatttcttcagggctgctggg

SEQ ID NO: 184066 - DNA, 25 bp, Homo sapien
gggcaactggccatttgccaatttt

SEQ ID NO: 184067 - DNA, 25 bp, Homo sapien
ggccatttgccaattttcctactct

SEQ ID NO: 184068 - DNA, 25 bp, Homo sapien
atcagcccgcccttgtcagtatcag

SEQ ID NO: 184069 - DNA, 25 bp, Homo sapien
cttgtcagtatcagccacgtccagt

SEQ ID NO: 184070 - DNA, 25 bp, Homo sapien
agtcctcagcagaccagcagtggaa

SEQ ID NO: 184071 - DNA, 25 bp, Homo sapien
gcagtggaacaaacaataaacctta

SEQ ID NO: 184072 - DNA, 25 bp, Homo sapien
tttcttgaacttcttgcaatagtaa

SEQ ID NO: 184073 - DNA, 25 bp, Homo sapien
gcaatagtaactgaatgtcctccat

SEQ ID NO: 184074 - DNA, 25 bp, Homo sapien
actgaatgtcctccatttcagagtc

SEQ ID NO: 184075 - DNA, 25 bp, Homo sapien
gagtcagcttaaaacctctgcaccc

SEQ ID NO: 184076 - DNA, 25 bp, Homo sapien
gcttaaaacctctgcaccctgaagg

SEQ ID NO: 184077 - DNA, 25 bp, Homo sapien
gcaccctgaaggtagccatacagat

SEQ ID NO: 184078 - DNA, 25 bp, Homo sapien
gtagccatacagatgccgacagatc

SEQ ID NO: 184079 - DNA, 25 bp, Homo sapien
ggcggatcacgagagaggaacataa

SEQ ID NO: 184080 - DNA, 25 bp, Homo sapien
taaaaagcattcgtccggttgcgct

SEQ ID NO: 184081 - DNA, 25 bp, Homo sapien
ttgcgctttcctttctgtcaagaag

SEQ ID NO: 184082 - DNA, 25 bp, Homo sapien
tttcctttctgtcaagaagcagttt

SEQ ID NO: 184083 - DNA, 25 bp, Homo sapien
ttgaagaattaacccttggtgaatt

SEQ ID NO: 184084 - DNA, 25 bp, Homo sapien
cttggtgaatttttgaaactggaca

SEQ ID NO: 184085 - DNA, 25 bp, Homo sapien
ctgcgaagaaagtgcgccgtgccat

SEQ ID NO: 184086 - DNA, 25 bp, Homo sapien
gaaagtgcgccgtgccatcgagcag

SEQ ID NO: 184087 - DNA, 25 bp, Homo sapien
agctggctgccatggattgaggcct

SEQ ID NO: 184088 - DNA, 25 bp, Homo sapien
attgaggcctctggccggagctgcc

SEQ ID NO: 184089 - DNA, 25 bp, Homo sapien
ctgcctggtcccagagtggctgcac

SEQ ID NO: 184090 - DNA, 25 bp, Homo sapien
agtttccatcactatctccagagat

SEQ ID NO: 184091 - DNA, 25 bp, Homo sapien
agatgtagctattatgcgcccgtct

SEQ ID NO: 184092 - DNA, 25 bp, Homo sapien
gacgatgacggtgccttcgcagtca

SEQ ID NO: 184093 - DNA, 25 bp, Homo sapien
ggtcccaaggtttggctttcacgcg

SEQ ID NO: 184094 - DNA, 25 bp, Homo sapien
aaggtttggctttcacgcgctccat

SEQ ID NO: 184095 - DNA, 25 bp, Homo sapien
attgccccggcgtggcaggccattc

SEQ ID NO: 184096 - DNA, 25 bp, Homo sapien
aggagcctcgggtgtatcgtacgcc

SEQ ID NO: 184097 - DNA, 25 bp, Homo sapien
tatcgtacgccctggtgttggtgtt

SEQ ID NO: 184098 - DNA, 25 bp, Homo sapien
tggtgttggtgttgcctcactcctc

SEQ ID NO: 184099 - DNA, 25 bp, Homo sapien
ttctttctgatcaagccctgcttaa

SEQ ID NO: 184100 - DNA, 25 bp, Homo sapien
gatcaagccctgcttaaagttaaat

SEQ ID NO: 184101 - DNA, 25 bp, Homo sapien
ggcccggagttagggctgagccagt

SEQ ID NO: 184102 - DNA, 25 bp, Homo sapien
tgtggaagcctgcaacctcattgcc

SEQ ID NO: 184103 - DNA, 25 bp, Homo sapien
ggaagcctgcaacctcattgcctgt

SEQ ID NO: 184104 - DNA, 25 bp, Homo sapien
cggcaccagcagagtcactttgaca

SEQ ID NO: 184105 - DNA, 25 bp, Homo sapien
gcaccagcagagtcactttgacaat

SEQ ID NO: 184106 - DNA, 25 bp, Homo sapien
gagtcactttgacaatgggaatgag

SEQ ID NO: 184107 - DNA, 25 bp, Homo sapien
acaatgggaatgaggagtggttcct

SEQ ID NO: 184108 - DNA, 25 bp, Homo sapien
gccgagtgctggaccgcgtctgctt

SEQ ID NO: 184109 - DNA, 25 bp, Homo sapien
gtgctggaccgcgtctgcttcctgg

SEQ ID NO: 184110 - DNA, 25 bp, Homo sapien
catgctctcgctcttcatctgtggc

SEQ ID NO: 184111 - DNA, 25 bp, Homo sapien
atggcccactacaaccgggtgccgg

SEQ ID NO: 184112 - DNA, 25 bp, Homo sapien
gctactacgccttcccacagatgat

SEQ ID NO: 184113 - DNA, 25 bp, Homo sapien
ccacagatgatcacgcccctggtga

SEQ ID NO: 184114 - DNA, 25 bp, Homo sapien
atgatcacgcccctggtgaccaaag

SEQ ID NO: 184115 - DNA, 25 bp, Homo sapien
tgatcacgcccctggtgaccaaagg

SEQ ID NO: 184116 - DNA, 25 bp, Homo sapien
acgcccctggtgaccaaaggctgag

SEQ ID NO: 184117 - DNA, 25 bp, Homo sapien
gcccctggtgaccaaaggctgagcc

SEQ ID NO: 184118 - DNA, 25 bp, Homo sapien
tggccgggagtccagggtgtcgcac

SEQ ID NO: 184119 - DNA, 25 bp, Homo sapien
agtccagggtgtcgcaccagccctg

SEQ ID NO: 184120 - DNA, 25 bp, Homo sapien
ggtgtcgcaccagccctgggctgat

SEQ ID NO: 184121 - DNA, 25 bp, Homo sapien
tttcccggcttctctgtgaggggtc

SEQ ID NO: 184122 - DNA, 25 bp, Homo sapien
agcttctctgtgagggtcactgctg

SEQ ID NO: 184123 - DNA, 25 bp, Homo sapien
aagaatttgaggaaactgcgaagaa

SEQ ID NO: 184124 - DNA, 25 bp, Homo sapien
ctgcgaagaaagtgcgccgtgccat

SEQ ID NO: 184125 - DNA, 25 bp, Homo sapien
agaaagtgcgccgtgccatcgagca

SEQ ID NO: 184126 - DNA, 25 bp, Homo sapien
aaagtgcgccgtgccatcgagcagc

SEQ ID NO: 184127 - DNA, 25 bp, Homo sapien
gccgtgccatcgagcagctggctgc

SEQ ID NO: 184128 - DNA, 25 bp, Homo sapien
agctggctgccatggattgaggcct

SEQ ID NO: 184129 - DNA, 25 bp, Homo sapien
tggctgccatggattgaggcctctg

SEQ ID NO: 184130 - DNA, 25 bp, Homo sapien
tgccatggattgaggcctctggccg

SEQ ID NO: 184131 - DNA, 25 bp, Homo sapien
attgaggcctctggccggagctgcc

SEQ ID NO: 184132 - DNA, 25 bp, Homo sapien
tctggccggagctgcctggtcccag

SEQ ID NO: 184133 - DNA, 25 bp, Homo sapien
gagctgcctggtcccagagtggctg

SEQ ID NO: 184134 - DNA, 25 bp, Homo sapien
gaaagcaaagcactggtacagttat

SEQ ID NO: 184135 - DNA, 25 bp, Homo sapien
gcactggtacagttatttaacaggc

SEQ ID NO: 184136 - DNA, 25 bp, Homo sapien
tttaacaggcatacacaagcaggga

SEQ ID NO: 184137 - DNA, 25 bp, Homo sapien
gatctttaatgctttggaaatgcgt

SEQ ID NO: 184138 - DNA, 25 bp, Homo sapien
gaaatgcgtgtaacagtactgcaat

SEQ ID NO: 184139 - DNA, 25 bp, Homo sapien
cagctctgggaaaaacaacgaaact

SEQ ID NO: 184140 - DNA, 25 bp, Homo sapien
ccttgtggagaggagggattttcct

SEQ ID NO: 184141 - DNA, 25 bp, Homo sapien
agggattttcctgctctatataagc

SEQ ID NO: 184142 - DNA, 25 bp, Homo sapien
tgcaggtaattgttgacttttttaa

SEQ ID NO: 184143 - DNA, 25 bp, Homo sapien
ctatattaagtgttaagctgacaac

SEQ ID NO: 184144 - DNA, 25 bp, Homo sapien
aactgtcaaagaagaccatgttgta

SEQ ID NO: 184145 - DNA, 25 bp, Homo sapien
catgagaggcagtccgagggatcct

SEQ ID NO: 184146 - DNA, 25 bp, Homo sapien
gaggcagtccgagggatcctccagc

SEQ ID NO: 184147 - DNA, 25 bp, Homo sapien
gtcggaggcctcttgttctacaggt

SEQ ID NO: 184148 - DNA, 25 bp, Homo sapien
gaggcctcttgttctacaggtggag

SEQ ID NO: 184149 - DNA, 25 bp, Homo sapien
ctcttgttctacaggtggaggcggc

SEQ ID NO: 184150 - DNA, 25 bp, Homo sapien
ggcggagccatcaagagcctcagag

SEQ ID NO: 184151 - DNA, 25 bp, Homo sapien
agagcctcagagagcggattctccc

SEQ ID NO: 184152 - DNA, 25 bp, Homo sapien
agagagcggattctcccttggagca

SEQ ID NO: 184153 - DNA, 25 bp, Homo sapien
cttggagcaaccagagggcagcccc

SEQ ID NO: 184154 - DNA, 25 bp, Homo sapien
gacagacaggtggaactgccagtgt

SEQ ID NO: 184155 - DNA, 25 bp, Homo sapien
ggaactgccagtgtagagggaattc

SEQ ID NO: 184156 - DNA, 25 bp, Homo sapien
gtcttccggccacactgaggacaag

SEQ ID NO: 184157 - DNA, 25 bp, Homo sapien
acactgaggacaaggccggcggctc

SEQ ID NO: 184158 - DNA, 25 bp, Homo sapien
cagtggccaacgcacccgcaaaaag

SEQ ID NO: 184159 - DNA, 25 bp, Homo sapien
gagctggaacgggagttcttcttca

SEQ ID NO: 184160 - DNA, 25 bp, Homo sapien
ggaacgggagttcttcttcagcgtc

SEQ ID NO: 184161 - DNA, 25 bp, Homo sapien
gggagttcttcttcagcgtctacat

SEQ ID NO: 184162 - DNA, 25 bp, Homo sapien
agttcttcttcagcgtctacattaa

SEQ ID NO: 184163 - DNA, 25 bp, Homo sapien
tcttcttcagcgtctacattaacaa

SEQ ID NO: 184164 - DNA, 25 bp, Homo sapien
cttcagcgtctacattaacaaagag

SEQ ID NO: 184165 - DNA, 25 bp, Homo sapien
taacaaagagaagcgcctgcaactg

SEQ ID NO: 184166 - DNA, 25 bp, Homo sapien
agaagcgcctgcaactgtcccgcat

SEQ ID NO: 184167 - DNA, 25 bp, Homo sapien
tcctattcccagctgattctttttc

SEQ ID NO: 184168 - DNA, 25 bp, Homo sapien
cctccagcatcctaggaactttatg

SEQ ID NO: 184169 - DNA, 25 bp, Homo sapien
gtatactggatttgggttgcatatt

SEQ ID NO: 184170 - DNA, 25 bp, Homo sapien
atatttgctagtctgaggtgccacc

SEQ ID NO: 184171 - DNA, 25 bp, Homo sapien
aggtgccacccaattactgctgtta

SEQ ID NO: 184172 - DNA, 25 bp, Homo sapien
caagctgaacctactatatgtatga

SEQ ID NO: 184173 - DNA, 25 bp, Homo sapien
gtatgaagacaaccttccagaacca

SEQ ID NO: 184174 - DNA, 25 bp, Homo sapien
gagagcactatactgggagtcacaa

SEQ ID NO: 184175 - DNA, 25 bp, Homo sapien
tgggagtcacaaacctgctctgcca

SEQ ID NO: 184176 - DNA, 25 bp, Homo sapien
tgcaggatctccagtgagcgattga

SEQ ID NO: 184177 - DNA, 25 bp, Homo sapien
gtgagcgattgagcttcccagagtc

SEQ ID NO: 184178 - DNA, 25 bp, Homo sapien
tcctatgcaggcttctcttgagccc

SEQ ID NO: 184179 - DNA, 25 bp, Homo sapien
ctcttgagcccagagacaaggcagc

SEQ ID NO: 184180 - DNA, 25 bp, Homo sapien
caaggcagcttggtctagtggagat

SEQ ID NO: 184181 - DNA, 25 bp, Homo sapien
gtctagtggagatagcactgtgctt

SEQ ID NO: 184182 - DNA, 25 bp, Homo sapien
ttcactgtgctcctgtttcctcagc

SEQ ID NO: 184183 - DNA, 25 bp, Homo sapien
taggaagaaggtttttgctcagtac

SEQ ID NO: 184184 - DNA, 25 bp, Homo sapien
aaggtttttgctcagtacctggcat

SEQ ID NO: 184185 - DNA, 25 bp, Homo sapien
gtacctggcatgcaacagacattgg

SEQ ID NO: 184186 - DNA, 25 bp, Homo sapien
ggcatgcaacagacattggataaat

SEQ ID NO: 184187 - DNA, 25 bp, Homo sapien
tgttagttggatccagatatacaca

SEQ ID NO: 184188 - DNA, 25 bp, Homo sapien
cagaaagatatctgcttcctgccag

SEQ ID NO: 184189 - DNA, 25 bp, Homo sapien
aaagtctctgagacagcatctcccc

SEQ ID NO: 184190 - DNA, 25 bp, Homo sapien
tctgagacagcatctccccaggtta

SEQ ID NO: 184191 - DNA, 25 bp, Homo sapien
acagcatctccccaggttacctatg

SEQ ID NO: 184192 - DNA, 25 bp, Homo sapien
atctccccaggttacctatgctggt

SEQ ID NO: 184193 - DNA, 25 bp, Homo sapien
caggttacctatgctggtccaaaca

SEQ ID NO: 184194 - DNA, 25 bp, Homo sapien
ggttacctatgctggtccaaacacc

SEQ ID NO: 184195 - DNA, 25 bp, Homo sapien
ttacctatgctggtccaaacacctg

SEQ ID NO: 184196 - DNA, 25 bp, Homo sapien
acctatgctggtccaaacacctggt

SEQ ID NO: 184197 - DNA, 25 bp, Homo sapien
tatgctggtccaaacacctggtttc

SEQ ID NO: 184198 - DNA, 25 bp, Homo sapien
gtttcaagaaatccttctgctgtga

SEQ ID NO: 184199 - DNA, 25 bp, Homo sapien
ttcaagaaatccttctgctgtgacc

SEQ ID NO: 184200 - DNA, 25 bp, Homo sapien
ctggcatctgtgtgcgtggctatca

SEQ ID NO: 184201 - DNA, 25 bp, Homo sapien
atctgtgtgcgtggctatcaggagt

SEQ ID NO: 184202 - DNA, 25 bp, Homo sapien
agttctaggaactcagtgcaatacg

SEQ ID NO: 184203 - DNA, 25 bp, Homo sapien
gtgcaatacgggagtgacccagcta

SEQ ID NO: 184204 - DNA, 25 bp, Homo sapien
gggagtgacccagctactgaaccag

SEQ ID NO: 184205 - DNA, 25 bp, Homo sapien
agctactgaaccagccacgaacagc

SEQ ID NO: 184206 - DNA, 25 bp, Homo sapien
gaacagcccgccagaggcctgaagc

SEQ ID NO: 184207 - DNA, 25 bp, Homo sapien
ggcctgaagctgagcgtgtacgtta

SEQ ID NO: 184208 - DNA, 25 bp, Homo sapien
gagcgtgtacgttaatgtgaatgta

SEQ ID NO: 184209 - DNA, 25 bp, Homo sapien
gtatatagtctttgcagaggtccaa

SEQ ID NO: 184210 - DNA, 25 bp, Homo sapien
tgcagaggtccaaatgatattcatg

SEQ ID NO: 184211 - DNA, 25 bp, Homo sapien
agaacgagaccctgtactctgtctt

SEQ ID NO: 184212 - DNA, 25 bp, Homo sapien
gagaccctgtactctgtcttaaagg

SEQ ID NO: 184213 - DNA, 25 bp, Homo sapien
gtactctgtcttaaaggcctaacca

SEQ ID NO: 184214 - DNA, 25 bp, Homo sapien
tcttaaaggcctaaccaatggacag

SEQ ID NO: 184215 - DNA, 25 bp, Homo sapien
aaaggcctaaccaatggacagccct

SEQ ID NO: 184216 - DNA, 25 bp, Homo sapien
tggacagccctctcaaaactgaatg

SEQ ID NO: 184217 - DNA, 25 bp, Homo sapien
actgaatggtgaggccaggtacagt

SEQ ID NO: 184218 - DNA, 25 bp, Homo sapien
ggcaaaatcaagtgagcccaggagt

SEQ ID NO: 184219 - DNA, 25 bp, Homo sapien
tcagggccagctttggataatggga

SEQ ID NO: 184220 - DNA, 25 bp, Homo sapien
taatgggagcgaggatgccatctct

SEQ ID NO: 184221 - DNA, 25 bp, Homo sapien
gagcgaggatgccatctctagttaa

SEQ ID NO: 184222 - DNA, 25 bp, Homo sapien
attcgaggtcaagagctccagtctt

SEQ ID NO: 184223 - DNA, 25 bp, Homo sapien
tccagtcttcaatacctgcagagga

SEQ ID NO: 184224 - DNA, 25 bp, Homo sapien
gcagaggaggcatgaccccaaacca

SEQ ID NO: 184225 - DNA, 25 bp, Homo sapien
aaccaccatctctttactgtactag

SEQ ID NO: 184226 - DNA, 25 bp, Homo sapien
actgtactagtcttgtgctggtcac

SEQ ID NO: 184227 - DNA, 25 bp, Homo sapien
ggtcacagtgtatcttatttatgca

SEQ ID NO: 184228 - DNA, 25 bp, Homo sapien
atttatgcattacttgcttccttgc

SEQ ID NO: 184229 - DNA, 25 bp, Homo sapien
tgcttccttgcatgattgtctttat

SEQ ID NO: 184230 - DNA, 25 bp, Homo sapien
attgtctttatgcatccccaatctt

SEQ ID NO: 184231 - DNA, 25 bp, Homo sapien
gcatccccaatcttaattgagacca

SEQ ID NO: 184232 - DNA, 25 bp, Homo sapien
ttgtaatatctttctgctattggat

SEQ ID NO: 184233 - DNA, 25 bp, Homo sapien
ggcccgatccagtgggcaggccaag

SEQ ID NO: 184234 - DNA, 25 bp, Homo sapien
atccagtgggcaggccaaggcctgc

SEQ ID NO: 184235 - DNA, 25 bp, Homo sapien
aggtgctctgggtcacggtccctgt

SEQ ID NO: 184236 - DNA, 25 bp, Homo sapien
gtgctctgggtcacggtccctgtcc

SEQ ID NO: 184237 - DNA, 25 bp, Homo sapien
ctgggtcacggtccctgtccccgca

SEQ ID NO: 184238 - DNA, 25 bp, Homo sapien
cgcttctgtctgccccattgtggct

SEQ ID NO: 184239 - DNA, 25 bp, Homo sapien
tgtctgccccattgtggctcctcag

SEQ ID NO: 184240 - DNA, 25 bp, Homo sapien
gtggccccgggacccagcagagctg

SEQ ID NO: 184241 - DNA, 25 bp, Homo sapien
ggccccgggacccagcagagctggg

SEQ ID NO: 184242 - DNA, 25 bp, Homo sapien
agggatcagcccccaaagaaatggg

SEQ ID NO: 184243 - DNA, 25 bp, Homo sapien
atgggggtgcatgctggcctgcccc

SEQ ID NO: 184244 - DNA, 25 bp, Homo sapien
gggacaaccgaggaggctgcggcac

SEQ ID NO: 184245 - DNA, 25 bp, Homo sapien
agtgaccctgctgggacaccaggac

SEQ ID NO: 184246 - DNA, 25 bp, Homo sapien
acaccaggacaaggaagacagtttc

SEQ ID NO: 184247 - DNA, 25 bp, Homo sapien
aaggaagacagtttcgcctctcgaa

SEQ ID NO: 184248 - DNA, 25 bp, Homo sapien
agtttcgcctctcgaaagccgcagc

SEQ ID NO: 184249 - DNA, 25 bp, Homo sapien
aaagccgcagctgcgcctaggctgg

SEQ ID NO: 184250 - DNA, 25 bp, Homo sapien
gggtgggtgaatccggcttgggcat

SEQ ID NO: 184251 - DNA, 25 bp, Homo sapien
ttgggcatccccaatgaactctgcc

SEQ ID NO: 184252 - DNA, 25 bp, Homo sapien
tgccctgcctgggactctatttatt

SEQ ID NO: 184253 - DNA, 25 bp, Homo sapien
gcctgggactctatttattctgatt

SEQ ID NO: 184254 - DNA, 25 bp, Homo sapien
gggactctatttattctgattaaag

SEQ ID NO: 184255 - DNA, 25 bp, Homo sapien
actggatcgtatctacaacatgctc

SEQ ID NO: 184256 - DNA, 25 bp, Homo sapien
atcgtatctacaacatgctccgcat

SEQ ID NO: 184257 - DNA, 25 bp, Homo sapien
catgctccgcatgtttgtggtgact

SEQ ID NO: 184258 - DNA, 25 bp, Homo sapien
tgctccgcatgtttgtggtgactgg

SEQ ID NO: 184259 - DNA, 25 bp, Homo sapien
tttgtggtgactgggcctgcactgg

SEQ ID NO: 184260 - DNA, 25 bp, Homo sapien
tgcactggccgagattgacctgcag

SEQ ID NO: 184261 - DNA, 25 bp, Homo sapien
gggaccagcagctcgtctactcggc

SEQ ID NO: 184262 - DNA, 25 bp, Homo sapien
agctcgtctactcggccggcgtcta

SEQ ID NO: 184263 - DNA, 25 bp, Homo sapien
aagaactgcagctgacacatcgccc

SEQ ID NO: 184264 - DNA, 25 bp, Homo sapien
ccgtgtcccagaatgcactgctgag

SEQ ID NO: 184265 - DNA, 25 bp, Homo sapien
tgtcccagaatgcactgctgaggag

SEQ ID NO: 184266 - DNA, 25 bp, Homo sapien
tgactctgtcactcaagcctttctc

SEQ ID NO: 184267 - DNA, 25 bp, Homo sapien
gagtggtgtgactaattccttacct

SEQ ID NO: 184268 - DNA, 25 bp, Homo sapien
taattccttacctctcccaaggagg

SEQ ID NO: 184269 - DNA, 25 bp, Homo sapien
tcccaaggagggtacacaactagca

SEQ ID NO: 184270 - DNA, 25 bp, Homo sapien
ggtacacaactagcaccattcttga

SEQ ID NO: 184271 - DNA, 25 bp, Homo sapien
gtgccctgggctaatgttagggctt

SEQ ID NO: 184272 - DNA, 25 bp, Homo sapien
atgttagggcttaattttctcaaag

SEQ ID NO: 184273 - DNA, 25 bp, Homo sapien
aagcctgacctttcaaatccatgat

SEQ ID NO: 184274 - DNA, 25 bp, Homo sapien
atccatgatgaatgccatcagtccc

SEQ ID NO: 184275 - DNA, 25 bp, Homo sapien
gacagtgtgtgccatgtctcccata

SEQ ID NO: 184276 - DNA, 25 bp, Homo sapien
gtgtgtgccatgtctcccatactag

SEQ ID NO: 184277 - DNA, 25 bp, Homo sapien
atgaagtcatcagctttgtgccacc

SEQ ID NO: 184278 - DNA, 25 bp, Homo sapien
caccaccccttgaccaagaagagat

SEQ ID NO: 184279 - DNA, 25 bp, Homo sapien
gatgccgaagatgaactttgcgaat

SEQ ID NO: 184280 - DNA, 25 bp, Homo sapien
gtatttattggtgccaatcccctgg

SEQ ID NO: 184281 - DNA, 25 bp, Homo sapien
ccctggctgtcgacttgctggagaa

SEQ ID NO: 184282 - DNA, 25 bp, Homo sapien
gaagatgcttgtattggactcagat

SEQ ID NO: 184283 - DNA, 25 bp, Homo sapien
ataagagaattacagcggcccaagc

SEQ ID NO: 184284 - DNA, 25 bp, Homo sapien
ttgcacatgcctactttgctcagta

SEQ ID NO: 184285 - DNA, 25 bp, Homo sapien
ttgctcagtaccacgatcctgatga

SEQ ID NO: 184286 - DNA, 25 bp, Homo sapien
gaaccagtggccgatccttatgatc

SEQ ID NO: 184287 - DNA, 25 bp, Homo sapien
gatccttatgatcagtcctttgaaa

SEQ ID NO: 184288 - DNA, 25 bp, Homo sapien
acctgagctgcggacttttccagct

SEQ ID NO: 184289 - DNA, 25 bp, Homo sapien
tctccacgcgattcatcaggatcta

SEQ ID NO: 184290 - DNA, 25 bp, Homo sapien
gattcatcaggatctaccccgagag

SEQ ID NO: 184291 - DNA, 25 bp, Homo sapien
ggatctaccccgagagagccactca

SEQ ID NO: 184292 - DNA, 25 bp, Homo sapien
agagagccactcatggcggactggg

SEQ ID NO: 184293 - DNA, 25 bp, Homo sapien
ggctgtgaagtggaagcccctacag

SEQ ID NO: 184294 - DNA, 25 bp, Homo sapien
gtggaagcccctacagctggaccga

SEQ ID NO: 184295 - DNA, 25 bp, Homo sapien
ctcccaacgggaacttggtggatga

SEQ ID NO: 184296 - DNA, 25 bp, Homo sapien
gaatgtgatgacgaccaggccaact

SEQ ID NO: 184297 - DNA, 25 bp, Homo sapien
gaccaggccaactgccacagtggaa

SEQ ID NO: 184298 - DNA, 25 bp, Homo sapien
gtggaacaggtgatgacttccagct

SEQ ID NO: 184299 - DNA, 25 bp, Homo sapien
agaggtcaaaagcagctgcctgaat

SEQ ID NO: 184300 - DNA, 25 bp, Homo sapien
gcctgaatgagttgttgtttcctta

SEQ ID NO: 184301 - DNA, 25 bp, Homo sapien
tgttgtttccttatcactcctggtc

SEQ ID NO: 184302 - DNA, 25 bp, Homo sapien
actcctggtccctttgcaagtgaac

SEQ ID NO: 184303 - DNA, 25 bp, Homo sapien
ctttgcaagtgaaccctgcagctca

SEQ ID NO: 184304 - DNA, 25 bp, Homo sapien
ccaacttccttcattcagcaggagg

SEQ ID NO: 184305 - DNA, 25 bp, Homo sapien
atagtgagaatatagcctcccaccc

SEQ ID NO: 184306 - DNA, 25 bp, Homo sapien
cattaacttcgctcccatgggagat

SEQ ID NO: 184307 - DNA, 25 bp, Homo sapien
acttcgctcccatgggagatggctt

SEQ ID NO: 184308 - DNA, 25 bp, Homo sapien
agatggcttcccctcatgcaacagg

SEQ ID NO: 184309 - DNA, 25 bp, Homo sapien
catgcaacaggcaggtttgggagtt

SEQ ID NO: 184310 - DNA, 25 bp, Homo sapien
aagtgctcatcaactgccgcaacaa

SEQ ID NO: 184311 - DNA, 25 bp, Homo sapien
aataagaaactcctgggccgcgtga

SEQ ID NO: 184312 - DNA, 25 bp, Homo sapien
ctgggccgcgtgaaggccttcgata

SEQ ID NO: 184313 - DNA, 25 bp, Homo sapien
gaaggccttcgataggcactgcaac

SEQ ID NO: 184314 - DNA, 25 bp, Homo sapien
ataggcactgcaacatggtgctgga

SEQ ID NO: 184315 - DNA, 25 bp, Homo sapien
aaggagatgtggactgaggtaccca

SEQ ID NO: 184316 - DNA, 25 bp, Homo sapien
actgaggtacccaagagtggcaagg

SEQ ID NO: 184317 - DNA, 25 bp, Homo sapien
agtcaacaaagaccgctacatctcc

SEQ ID NO: 184318 - DNA, 25 bp, Homo sapien
gaacccgctcatcgccggcaagtag

SEQ ID NO: 184319 - DNA, 25 bp, Homo sapien
gggccgcctgtctgttgacagaact

SEQ ID NO: 184320 - DNA, 25 bp, Homo sapien
tctgtcctatgaagaccgctgccat

SEQ ID NO: 184321 - DNA, 25 bp, Homo sapien
ggtgcgggactggatcctacggcag

SEQ ID NO: 184322 - DNA, 25 bp, Homo sapien
cgggactggatcctacggcagcggc

SEQ ID NO: 184323 - DNA, 25 bp, Homo sapien
agcggcaggacgacctggacacgct

SEQ ID NO: 184324 - DNA, 25 bp, Homo sapien
tacagggcggcatccccaacggcta

SEQ ID NO: 184325 - DNA, 25 bp, Homo sapien
acggctacctggtcctagacctcag

SEQ ID NO: 184326 - DNA, 25 bp, Homo sapien
tggtcctagacctcagcgtgcaaga

SEQ ID NO: 184327 - DNA, 25 bp, Homo sapien
ggtcctagacctcagcgtgcaagag

SEQ ID NO: 184328 - DNA, 25 bp, Homo sapien
taggacctggacctgttctcaccgt

SEQ ID NO: 184329 - DNA, 25 bp, Homo sapien
tggacctgttctcaccgtcctggca

SEQ ID NO: 184330 - DNA, 25 bp, Homo sapien
ccaggagcaggcacgggtgatcccc

SEQ ID NO: 184331 - DNA, 25 bp, Homo sapien
gttccaccccaagagaactcgcgct

SEQ ID NO: 184332 - DNA, 25 bp, Homo sapien
tgtcccttcgagtccaggacaacaa

SEQ ID NO: 184333 - DNA, 25 bp, Homo sapien
gtccaggacaacaacgggcagaaat

SEQ ID NO: 184334 - DNA, 25 bp, Homo sapien
gaaatcgagagtgtgctctccccgg

SEQ ID NO: 184335 - DNA, 25 bp, Homo sapien
aatgagtgggaatccgggacacctg

SEQ ID NO: 184336 - DNA, 25 bp, Homo sapien
gctgtagatcaggtttgcccacttg

SEQ ID NO: 184337 - DNA, 25 bp, Homo sapien
caggtttgcccacttgattgagaaa

SEQ ID NO: 184338 - DNA, 25 bp, Homo sapien
gttccagtgaggaaccctgatctct

SEQ ID NO: 184339 - DNA, 25 bp, Homo sapien
gaaattctagcgcaaggcactttta

SEQ ID NO: 184340 - DNA, 25 bp, Homo sapien
gcgcaaggcacttttaaacgtggat

SEQ ID NO: 184341 - DNA, 25 bp, Homo sapien
tgtttaaagaagctctccaggcccc

SEQ ID NO: 184342 - DNA, 25 bp, Homo sapien
ccaagagggtggatcacacctcagt

SEQ ID NO: 184343 - DNA, 25 bp, Homo sapien
cctggttctgtattgaggagaagga

SEQ ID NO: 184344 - DNA, 25 bp, Homo sapien
gcaacatgaaacattagccctcctt

SEQ ID NO: 184345 - DNA, 25 bp, Homo sapien
aacatgaaacattagccctcctttt

SEQ ID NO: 184346 - DNA, 25 bp, Homo sapien
tgttaattgttcttaaaactggatt

SEQ ID NO: 184347 - DNA, 25 bp, Homo sapien
agctgaagccagtttgacatagaga

SEQ ID NO: 184348 - DNA, 25 bp, Homo sapien
ctgaagccagtttgacatagagaga

SEQ ID NO: 184349 - DNA, 25 bp, Homo sapien
gaagccagtttgacatagagagatg

SEQ ID NO: 184350 - DNA, 25 bp, Homo sapien
acatagagagatgtcagattgattt

SEQ ID NO: 184351 - DNA, 25 bp, Homo sapien
agattgatttgaaaggtgtgcagcc

SEQ ID NO: 184352 - DNA, 25 bp, Homo sapien
gattgatttgaaaggtgtgcagcct

SEQ ID NO: 184353 - DNA, 25 bp, Homo sapien
gaacaataaaacatattttacacgc

SEQ ID NO: 184354 - DNA, 25 bp, Homo sapien
atgccatgacattggaagaaggtgg

SEQ ID NO: 184355 - DNA, 25 bp, Homo sapien
tgccatgacattggaagaaggtggt

SEQ ID NO: 184356 - DNA, 25 bp, Homo sapien
ccatgacattggaagaaggtggtca

SEQ ID NO: 184357 - DNA, 25 bp, Homo sapien
cattggaagaaggtggtcatagctc

SEQ ID NO: 184358 - DNA, 25 bp, Homo sapien
gcagaccacacagacctccccaggg

SEQ ID NO: 184359 - DNA, 25 bp, Homo sapien
gcctccccagtaatcaaggttcaat

SEQ ID NO: 184360 - DNA, 25 bp, Homo sapien
cctccccagtaatcaaggttcaatg

SEQ ID NO: 184361 - DNA, 25 bp, Homo sapien
ccccagtaatcaaggttcaatgaca

SEQ ID NO: 184362 - DNA, 25 bp, Homo sapien
cccagtaatcaaggttcaatgacag

SEQ ID NO: 184363 - DNA, 25 bp, Homo sapien
agtaatcaaggttcaatgacaggaa

SEQ ID NO: 184364 - DNA, 25 bp, Homo sapien
gtaatcaaggttcaatgacaggaag

SEQ ID NO: 184365 - DNA, 25 bp, Homo sapien
gagtcctatattcaactaaagttac

SEQ ID NO: 184366 - DNA, 25 bp, Homo sapien
tacaacttccataacttctaaaaag

SEQ ID NO: 184367 - DNA, 25 bp, Homo sapien
gggaaccagagatctacaggtaaaa

SEQ ID NO: 184368 - DNA, 25 bp, Homo sapien
gtaaaacctggtgaatctctagaag

SEQ ID NO: 184369 - DNA, 25 bp, Homo sapien
gttatacaaaccacagatgacacaa

SEQ ID NO: 184370 - DNA, 25 bp, Homo sapien
gatgacacaaaagttctctgcagaa

SEQ ID NO: 184371 - DNA, 25 bp, Homo sapien
gaaatatggttatgtccttcggagt

SEQ ID NO: 184372 - DNA, 25 bp, Homo sapien
atgtccttcggagttacctagcgga

SEQ ID NO: 184373 - DNA, 25 bp, Homo sapien
gttacctagcggacaatgatggaga

SEQ ID NO: 184374 - DNA, 25 bp, Homo sapien
gatattgctgatggctgcatctatg

SEQ ID NO: 184375 - DNA, 25 bp, Homo sapien
gatggctgcatctatgacaatgact

SEQ ID NO: 184376 - DNA, 25 bp, Homo sapien
tctgggaccgctacatgggcaccct

SEQ ID NO: 184377 - DNA, 25 bp, Homo sapien
tcctgcgcctgtatcatgactgagg

SEQ ID NO: 184378 - DNA, 25 bp, Homo sapien
gtatcatgactgaggtgcctcccaa

SEQ ID NO: 184379 - DNA, 25 bp, Homo sapien
tcttctctgagatggaagccaactt

SEQ ID NO: 184380 - DNA, 25 bp, Homo sapien
gccaagctgacccacaataaagatg

SEQ ID NO: 184381 - DNA, 25 bp, Homo sapien
agatgtcagagacctgtttgtggac

SEQ ID NO: 184382 - DNA, 25 bp, Homo sapien
gacctcgtggagaagtttgtggaac

SEQ ID NO: 184383 - DNA, 25 bp, Homo sapien
actggccactcagcgacgtgcggtt

SEQ ID NO: 184384 - DNA, 25 bp, Homo sapien
cgacgtgcggttcttcctgaatcag

SEQ ID NO: 184385 - DNA, 25 bp, Homo sapien
gcggttcttcctgaatcagtattca

SEQ ID NO: 184386 - DNA, 25 bp, Homo sapien
agtattcagcgtctgtccactccct

SEQ ID NO: 184387 - DNA, 25 bp, Homo sapien
gaggctgcagcctcgacacttggcg

SEQ ID NO: 184388 - DNA, 25 bp, Homo sapien
cttggcgcggcctgatactgaaata

SEQ ID NO: 184389 - DNA, 25 bp, Homo sapien
gcggcctgatactgaaatagcgtct

SEQ ID NO: 184390 - DNA, 25 bp, Homo sapien
aaatagcgtctactcgtgcactgaa

SEQ ID NO: 184391 - DNA, 25 bp, Homo sapien
gcgtctactcgtgcactgaataaaa

SEQ ID NO: 184392 - DNA, 25 bp, Homo sapien
tagattttatcactctctgctaaga

SEQ ID NO: 184393 - DNA, 25 bp, Homo sapien
atcactctctgctaagacaatatag

SEQ ID NO: 184394 - DNA, 25 bp, Homo sapien
tactgtgaactctaataatgtggaa

SEQ ID NO: 184395 - DNA, 25 bp, Homo sapien
catatttcttaggacatgcatcttt

SEQ ID NO: 184396 - DNA, 25 bp, Homo sapien
ttaggacatgcatctttaagcttta

SEQ ID NO: 184397 - DNA, 25 bp, Homo sapien
aagctttatcattgcccatatgtac

SEQ ID NO: 184398 - DNA, 25 bp, Homo sapien
cccgcgaaagactgcgcgtgcgtag

SEQ ID NO: 184399 - DNA, 25 bp, Homo sapien
gaaagactgcgcgtgcgtagagcac

SEQ ID NO: 184400 - DNA, 25 bp, Homo sapien
gggactctcgcgataactgtactga

SEQ ID NO: 184401 - DNA, 25 bp, Homo sapien
tcgcgataactgtactgagataaag

SEQ ID NO: 184402 - DNA, 25 bp, Homo sapien
gataaagtgtggcaactcgaaaaaa

SEQ ID NO: 184403 - DNA, 25 bp, Homo sapien
acggcctacgaggacgaggtgtcct

SEQ ID NO: 184404 - DNA, 25 bp, Homo sapien
tacgaggacgaggtgtccttcctgg

SEQ ID NO: 184405 - DNA, 25 bp, Homo sapien
aggtgtccttcctggacgcgcacag

SEQ ID NO: 184406 - DNA, 25 bp, Homo sapien
acacggtgcacgagctgtcggcgcg

SEQ ID NO: 184407 - DNA, 25 bp, Homo sapien
gcgagtgcgcctgcgtgtgacccta

SEQ ID NO: 184408 - DNA, 25 bp, Homo sapien
agtgcgcctgcgtgtgaccctacct

SEQ ID NO: 184409 - DNA, 25 bp, Homo sapien
gcactcagctatacctcattcacag

SEQ ID NO: 184410 - DNA, 25 bp, Homo sapien
tatacctcattcacagctccttgtg

SEQ ID NO: 184411 - DNA, 25 bp, Homo sapien
cacagctccttgtgagtgtgtgcac

SEQ ID NO: 184412 - DNA, 25 bp, Homo sapien
cacaggaaataagccgagggtatta

SEQ ID NO: 184413 - DNA, 25 bp, Homo sapien
gagtcttgtaattaaaccgtgattc

SEQ ID NO: 184414 - DNA, 25 bp, Homo sapien
ccgtgattcttgaaaggtgtaggtt

SEQ ID NO: 184415 - DNA, 25 bp, Homo sapien
gtttgattactaggagataccaccg

SEQ ID NO: 184416 - DNA, 25 bp, Homo sapien
ggagataccaccgacatttttcaat

SEQ ID NO: 184417 - DNA, 25 bp, Homo sapien
ttgtgtctaccttgttattaacttt

SEQ ID NO: 184418 - DNA, 25 bp, Homo sapien
aaatcaaggctatcggagcagttca

SEQ ID NO: 184419 - DNA, 25 bp, Homo sapien
ggctatcggagcagttcaataacaa

SEQ ID NO: 184420 - DNA, 25 bp, Homo sapien
gtaaatttttgtacacattgattgt

SEQ ID NO: 184421 - DNA, 25 bp, Homo sapien
acattgattgttatcttgactgaca

SEQ ID NO: 184422 - DNA, 25 bp, Homo sapien
gttatcttgactgacaaatattcta

SEQ ID NO: 184423 - DNA, 25 bp, Homo sapien
tatagttcttaaaagcataaccctt

SEQ ID NO: 184424 - DNA, 25 bp, Homo sapien
taccccatttaattctagagtctag

SEQ ID NO: 184425 - DNA, 25 bp, Homo sapien
gagtctagaacgcaaggatctcttg

SEQ ID NO: 184426 - DNA, 25 bp, Homo sapien
caaggatctcttggaatgacaaatg

SEQ ID NO: 184427 - DNA, 25 bp, Homo sapien
gaatgacaaatgataggtacctaaa

SEQ ID NO: 184428 - DNA, 25 bp, Homo sapien
gataggtacctaaaatgtaacatga

SEQ ID NO: 184429 - DNA, 25 bp, Homo sapien
aattatatttccctttaggctgtga

SEQ ID NO: 184430 - DNA, 25 bp, Homo sapien
ttccctttaggctgtgatagttttt

SEQ ID NO: 184431 - DNA, 25 bp, Homo sapien
ggccacatgctgaccagcctgatga

SEQ ID NO: 184432 - DNA, 25 bp, Homo sapien
atgctgaccagcctgatgaggcaag

SEQ ID NO: 184433 - DNA, 25 bp, Homo sapien
agcctgatgaggcaagagcctgccc

SEQ ID NO: 184434 - DNA, 25 bp, Homo sapien
tctcctctcagcaagggatgggcct

SEQ ID NO: 184435 - DNA, 25 bp, Homo sapien
tctcagcaagggatgggcctctctg

SEQ ID NO: 184436 - DNA, 25 bp, Homo sapien
taaggcctctgtctccatagctctg

SEQ ID NO: 184437 - DNA, 25 bp, Homo sapien
gtctccatagctctggtttccctgg

SEQ ID NO: 184438 - DNA, 25 bp, Homo sapien
tctgtctccctgtcactaatgtgag

SEQ ID NO: 184439 - DNA, 25 bp, Homo sapien
ctccctgtcactaatgtgaggtttc

SEQ ID NO: 184440 - DNA, 25 bp, Homo sapien
gtgaggtttctttgtgcacattaaa

SEQ ID NO: 184441 - DNA, 25 bp, Homo sapien
tttgtgcacattaaagtcttctttc

SEQ ID NO: 184442 - DNA, 25 bp, Homo sapien
gagaagtggtgctcacttttcccat

SEQ ID NO: 184443 - DNA, 25 bp, Homo sapien
tatgctagaagtggcatccagcggc

SEQ ID NO: 184444 - DNA, 25 bp, Homo sapien
gcatccagcggccacagctagaaaa

SEQ ID NO: 184445 - DNA, 25 bp, Homo sapien
ggccacagctagaaaacagtctgca

SEQ ID NO: 184446 - DNA, 25 bp, Homo sapien
gtctgcagtgtgacttaacttgtgt

SEQ ID NO: 184447 - DNA, 25 bp, Homo sapien
agcagaccactgaaccagacagcga

SEQ ID NO: 184448 - DNA, 25 bp, Homo sapien
actgaaccagacagcgaagccaaga

SEQ ID NO: 184449 - DNA, 25 bp, Homo sapien
atcagttgattctacttcaggtcct

SEQ ID NO: 184450 - DNA, 25 bp, Homo sapien
gattctacttcaggtccttgcttaa

SEQ ID NO: 184451 - DNA, 25 bp, Homo sapien
acttcaggtccttgcttaaattcct

SEQ ID NO: 184452 - DNA, 25 bp, Homo sapien
tgcttaaattcctgtcactaaatgg

SEQ ID NO: 184453 - DNA, 25 bp, Homo sapien
gtgaatccaacgaggccaacgaggc

SEQ ID NO: 184454 - DNA, 25 bp, Homo sapien
ggccaacgaggccaatgaggccaac

SEQ ID NO: 184455 - DNA, 25 bp, Homo sapien
gccaatgaggccaacaagacgatgc

SEQ ID NO: 184456 - DNA, 25 bp, Homo sapien
aatgaggccaacaagacgatgccgg

SEQ ID NO: 184457 - DNA, 25 bp, Homo sapien
tgaggccaacaagacgatgccggag

SEQ ID NO: 184458 - DNA, 25 bp, Homo sapien
gaaaacatctgagtcctcgaccata

SEQ ID NO: 184459 - DNA, 25 bp, Homo sapien
ccatactagtggttcgctacaggag

SEQ ID NO: 184460 - DNA, 25 bp, Homo sapien
gagagaacagaatcaaccccgacca

SEQ ID NO: 184461 - DNA, 25 bp, Homo sapien
aggaattcatagaaataacgactga

SEQ ID NO: 184462 - DNA, 25 bp, Homo sapien
tcatagaaataacgactgaaagacc

SEQ ID NO: 184463 - DNA, 25 bp, Homo sapien
aagaagctacatccctcaaacttcg

SEQ ID NO: 184464 - DNA, 25 bp, Homo sapien
gggcggccacagacggcctcgaaac

SEQ ID NO: 184465 - DNA, 25 bp, Homo sapien
gccaacgaaccacaggtgctgggct

SEQ ID NO: 184466 - DNA, 25 bp, Homo sapien
tgctgggctttagagaacatgggaa

SEQ ID NO: 184467 - DNA, 25 bp, Homo sapien
agaacatgggaaggcggccccagac

SEQ ID NO: 184468 - DNA, 25 bp, Homo sapien
ctgggaagctcatcttgcgaagctg

SEQ ID NO: 184469 - DNA, 25 bp, Homo sapien
catcttgcgaagctgagggagctca

SEQ ID NO: 184470 - DNA, 25 bp, Homo sapien
aaaggccaggctagcgcggaccgga

SEQ ID NO: 184471 - DNA, 25 bp, Homo sapien
acgggcctctgccagaacgctcagg

SEQ ID NO: 184472 - DNA, 25 bp, Homo sapien
agaacgctcaggacatcccggcctg

SEQ ID NO: 184473 - DNA, 25 bp, Homo sapien
gacatcccggcctgggtttacaacg

SEQ ID NO: 184474 - DNA, 25 bp, Homo sapien
cggcctgggtttacaacgctgttag

SEQ ID NO: 184475 - DNA, 25 bp, Homo sapien
gaaccagtaattttccatgctgtct

SEQ ID NO: 184476 - DNA, 25 bp, Homo sapien
tgctgtcttttccatgatcaaacca

SEQ ID NO: 184477 - DNA, 25 bp, Homo sapien
ccatgatcaaaccattcctgactga

SEQ ID NO: 184478 - DNA, 25 bp, Homo sapien
taaggaacggattcacatgcatggg

SEQ ID NO: 184479 - DNA, 25 bp, Homo sapien
tcacatgcatgggaacaactacaaa

SEQ ID NO: 184480 - DNA, 25 bp, Homo sapien
ttgcttcagcatttcccagacattc

SEQ ID NO: 184481 - DNA, 25 bp, Homo sapien
atggtggtgaagaattctccatgga

SEQ ID NO: 184482 - DNA, 25 bp, Homo sapien
ttctccatggaggacatttgtcagg

SEQ ID NO: 184483 - DNA, 25 bp, Homo sapien
aggagcatttctgagagcattcaat

SEQ ID NO: 184484 - DNA, 25 bp, Homo sapien
gttatgtcatgtgaatgcgttccta

SEQ ID NO: 184485 - DNA, 25 bp, Homo sapien
tgtgaatgcgttcctaactaaaatc

SEQ ID NO: 184486 - DNA, 25 bp, Homo sapien
aggtgacatcaggattatgtgcccc

SEQ ID NO: 184487 - DNA, 25 bp, Homo sapien
gattatgtgccccaggccgggctca

SEQ ID NO: 184488 - DNA, 25 bp, Homo sapien
gagtttgcgacaagcctgccaacaa

SEQ ID NO: 184489 - DNA, 25 bp, Homo sapien
agtttgcgacaagcctgccaacaag

SEQ ID NO: 184490 - DNA, 25 bp, Homo sapien
tttgcgacaagcctgccaacaagct

SEQ ID NO: 184491 - DNA, 25 bp, Homo sapien
ttgcgacaagcctgccaacaagctg

SEQ ID NO: 184492 - DNA, 25 bp, Homo sapien
tgcgacaagcctgccaacaagctga

SEQ ID NO: 184493 - DNA, 25 bp, Homo sapien
cgacaagcctgccaacaagctgaaa

SEQ ID NO: 184494 - DNA, 25 bp, Homo sapien
gacaagcctgccaacaagctgaaac

SEQ ID NO: 184495 - DNA, 25 bp, Homo sapien
acaagcctgccaacaagctgaaacc

SEQ ID NO: 184496 - DNA, 25 bp, Homo sapien
gcctgccaacaagctgaaaccccat

SEQ ID NO: 184497 - DNA, 25 bp, Homo sapien
gagtgtggaatctagtttgcccctt

SEQ ID NO: 184498 - DNA, 25 bp, Homo sapien
gtgtggaatctagtttgccccttaa

SEQ ID NO: 184499 - DNA, 25 bp, Homo sapien
tagtttgccccttaatgccattgaa

SEQ ID NO: 184500 - DNA, 25 bp, Homo sapien
cttaatgccattgaaccttgtgtga

SEQ ID NO: 184501 - DNA, 25 bp, Homo sapien
gccattgaaccttgtgtgatttgtc

SEQ ID NO: 184502 - DNA, 25 bp, Homo sapien
gtgtgatttgtcaaggtcgacctaa

SEQ ID NO: 184503 - DNA, 25 bp, Homo sapien
aaggtcgacctaaaaatggttgcat

SEQ ID NO: 184504 - DNA, 25 bp, Homo sapien
tccatggcaaaacaggacatcttat

SEQ ID NO: 184505 - DNA, 25 bp, Homo sapien
aggacatcttatggcctgctttaca

SEQ ID NO: 184506 - DNA, 25 bp, Homo sapien
atcttatggcctgctttacatgtgc

SEQ ID NO: 184507 - DNA, 25 bp, Homo sapien
atggcctgctttacatgtgcaaaga

SEQ ID NO: 184508 - DNA, 25 bp, Homo sapien
aatgctgttcactgtactgatctgc

SEQ ID NO: 184509 - DNA, 25 bp, Homo sapien
atgctgttcactgtactgatctgcc

SEQ ID NO: 184510 - DNA, 25 bp, Homo sapien
tgctgttcactgtactgatctgcca

SEQ ID NO: 184511 - DNA, 25 bp, Homo sapien
ctgttcactgtactgatctgccaga

SEQ ID NO: 184512 - DNA, 25 bp, Homo sapien
gttcactgtactgatctgccagagg

SEQ ID NO: 184513 - DNA, 25 bp, Homo sapien
tcactgtactgatctgccagaggat

SEQ ID NO: 184514 - DNA, 25 bp, Homo sapien
cactgtactgatctgccagaggatg

SEQ ID NO: 184515 - DNA, 25 bp, Homo sapien
ccagaggatggcctattagaggttc

SEQ ID NO: 184516 - DNA, 25 bp, Homo sapien
gaggatggcctattagaggttcaat

SEQ ID NO: 184517 - DNA, 25 bp, Homo sapien
gatggcctattagaggttcaatact

SEQ ID NO: 184518 - DNA, 25 bp, Homo sapien
ggcctattagaggttcaatacttct

SEQ ID NO: 184519 - DNA, 25 bp, Homo sapien
ttaaccctcgggactactgtggctg

SEQ ID NO: 184520 - DNA, 25 bp, Homo sapien
aaccctcgggactactgtggctgga

SEQ ID NO: 184521 - DNA, 25 bp, Homo sapien
ggactactgtggctggacacctctg

SEQ ID NO: 184522 - DNA, 25 bp, Homo sapien
gcacgaggcctgcaactacgggcat

SEQ ID NO: 184523 - DNA, 25 bp, Homo sapien
aggcctgcaactacgggcatctaga

SEQ ID NO: 184524 - DNA, 25 bp, Homo sapien
acgggcatctagaaattgtccgctt

SEQ ID NO: 184525 - DNA, 25 bp, Homo sapien
ccgcagtggacgacccaggtggcca

SEQ ID NO: 184526 - DNA, 25 bp, Homo sapien
ggtggccagggctgcgaaggcatca

SEQ ID NO: 184527 - DNA, 25 bp, Homo sapien
actcgaaaggcctcagcgcgctgga

SEQ ID NO: 184528 - DNA, 25 bp, Homo sapien
tcagcgcgctggagacgctgcagca

SEQ ID NO: 184529 - DNA, 25 bp, Homo sapien
agcagtgggtgaagctgtaccgcgg

SEQ ID NO: 184530 - DNA, 25 bp, Homo sapien
cgttgggataggtatgactggctta

SEQ ID NO: 184531 - DNA, 25 bp, Homo sapien
gactggcttaagagaccacaggcaa

SEQ ID NO: 184532 - DNA, 25 bp, Homo sapien
gagaccacaggcaagggaacaacag

SEQ ID NO: 184533 - DNA, 25 bp, Homo sapien
tgttccataccctctgtgtgggatg

SEQ ID NO: 184534 - DNA, 25 bp, Homo sapien
ataccctctgtgtgggatggaaagg

SEQ ID NO: 184535 - DNA, 25 bp, Homo sapien
aaatgtctggctgagttgctggaag

SEQ ID NO: 184536 - DNA, 25 bp, Homo sapien
agtgcatccaggtcctgccttgtga

SEQ ID NO: 184537 - DNA, 25 bp, Homo sapien
tgccttgtgagatgtggccccagct

SEQ ID NO: 184538 - DNA, 25 bp, Homo sapien
agcttcctaagctgccacctctgtg

SEQ ID NO: 184539 - DNA, 25 bp, Homo sapien
cctgtcatagcaaatatgggaccat

SEQ ID NO: 184540 - DNA, 25 bp, Homo sapien
atatgggaccatcaccagcttacca

SEQ ID NO: 184541 - DNA, 25 bp, Homo sapien
gagagggaaggctggcccaactcac

SEQ ID NO: 184542 - DNA, 25 bp, Homo sapien
gggtcacggtcttatcgaggatcct

SEQ ID NO: 184543 - DNA, 25 bp, Homo sapien
acggtcttatcgaggatcctggcca

SEQ ID NO: 184544 - DNA, 25 bp, Homo sapien
tcctggccaggcgtctggatgagaa

SEQ ID NO: 184545 - DNA, 25 bp, Homo sapien
gattctggtgaatgcgtgctgccca

SEQ ID NO: 184546 - DNA, 25 bp, Homo sapien
tgaatgcgtgctgcccaggaccagt

SEQ ID NO: 184547 - DNA, 25 bp, Homo sapien
ggctgagacccctgtctacttggcc

SEQ ID NO: 184548 - DNA, 25 bp, Homo sapien
agatgccactgagccacaaggccag

SEQ ID NO: 184549 - DNA, 25 bp, Homo sapien
gagccacaaggccagttggtccatg

SEQ ID NO: 184550 - DNA, 25 bp, Homo sapien
gttggtccatgacaaagttgtgcaa

SEQ ID NO: 184551 - DNA, 25 bp, Homo sapien
caaaactggtaaacgtctgcttcgg

SEQ ID NO: 184552 - DNA, 25 bp, Homo sapien
accatgaacttgatacgtccgtgtg

SEQ ID NO: 184553 - DNA, 25 bp, Homo sapien
atgaacttgatacgtccgtgtgtcc

SEQ ID NO: 184554 - DNA, 25 bp, Homo sapien
aacttgatacgtccgtgtgtcccag

SEQ ID NO: 184555 - DNA, 25 bp, Homo sapien
ttgatacgtccgtgtgtcccagatg

SEQ ID NO: 184556 - DNA, 25 bp, Homo sapien
gatacgtccgtgtgtcccagatgct

SEQ ID NO: 184557 - DNA, 25 bp, Homo sapien
tacgtccgtgtgtcccagatgctgt

SEQ ID NO: 184558 - DNA, 25 bp, Homo sapien
gtccgtgtgtcccagatgctgtcat

SEQ ID NO: 184559 - DNA, 25 bp, Homo sapien
agatgctgtcattagtctatatggt

SEQ ID NO: 184560 - DNA, 25 bp, Homo sapien
acaacgcattgccacggaaacatac

SEQ ID NO: 184561 - DNA, 25 bp, Homo sapien
gcattgccacggaaacatacagagg

SEQ ID NO: 184562 - DNA, 25 bp, Homo sapien
gctaattgtactaatctgagattgt

SEQ ID NO: 184563 - DNA, 25 bp, Homo sapien
gatacctagtatgatggagctgcaa

SEQ ID NO: 184564 - DNA, 25 bp, Homo sapien
ggagctgcaaatttcatggcagttc

SEQ ID NO: 184565 - DNA, 25 bp, Homo sapien
atggcagttcatgcagtcggtcaag

SEQ ID NO: 184566 - DNA, 25 bp, Homo sapien
cagttcatgcagtcggtcaagagga

SEQ ID NO: 184567 - DNA, 25 bp, Homo sapien
tgcagtcggtcaagaggaggatttt

SEQ ID NO: 184568 - DNA, 25 bp, Homo sapien
ttctaaagcattttcccttgctgta

SEQ ID NO: 184569 - DNA, 25 bp, Homo sapien
agcattttcccttgctgtatttttt

SEQ ID NO: 184570 - DNA, 25 bp, Homo sapien
acattggacttcatatatataattt

SEQ ID NO: 184571 - DNA, 25 bp, Homo sapien
ttttttacattatatgtctcttgta

SEQ ID NO: 184572 - DNA, 25 bp, Homo sapien
gaaactcttgtatttatgatatagc

SEQ ID NO: 184573 - DNA, 25 bp, Homo sapien
cttatatgatttttttgccttggta

SEQ ID NO: 184574 - DNA, 25 bp, Homo sapien
gagaaggagaccttagcttccccgg

SEQ ID NO: 184575 - DNA, 25 bp, Homo sapien
tagcttccccggcttcaagtagaac

SEQ ID NO: 184576 - DNA, 25 bp, Homo sapien
caagtagaacagaagcccgtttcct

SEQ ID NO: 184577 - DNA, 25 bp, Homo sapien
aggaacatagaatctgttttacaga

SEQ ID NO: 184578 - DNA, 25 bp, Homo sapien
ttacagaagtaaatcgaccgtcaag

SEQ ID NO: 184579 - DNA, 25 bp, Homo sapien
ctttgcactttggtttgatattaag

SEQ ID NO: 184580 - DNA, 25 bp, Homo sapien
ttcttcagtgaaattttgggtgcca

SEQ ID NO: 184581 - DNA, 25 bp, Homo sapien
tgaaattttgggtgccaaacaccta

SEQ ID NO: 184582 - DNA, 25 bp, Homo sapien
caaacacctacccagaatgtccagg

SEQ ID NO: 184583 - DNA, 25 bp, Homo sapien
tacccagaatgtccagggctttcat

SEQ ID NO: 184584 - DNA, 25 bp, Homo sapien
ccagaatgtccagggctttcatttt

SEQ ID NO: 184585 - DNA, 25 bp, Homo sapien
atcatcacatggaccccgtataaca

SEQ ID NO: 184586 - DNA, 25 bp, Homo sapien
accccgtataacatcatggtcctgg

SEQ ID NO: 184587 - DNA, 25 bp, Homo sapien
aacatcatggtcctggtttctacct

SEQ ID NO: 184588 - DNA, 25 bp, Homo sapien
tggtttctaccttctgtgacaagtg

SEQ ID NO: 184589 - DNA, 25 bp, Homo sapien
tgacaagtgtgtcccagtcaccctg

SEQ ID NO: 184590 - DNA, 25 bp, Homo sapien
aagtgtgtcccagtcaccctgtggc

SEQ ID NO: 184591 - DNA, 25 bp, Homo sapien
cttgggctattggttgtgctatgtc

SEQ ID NO: 184592 - DNA, 25 bp, Homo sapien
ctatgtcaatagcactgtcaacccc

SEQ ID NO: 184593 - DNA, 25 bp, Homo sapien
atctgctatgccctctgcaacagaa

SEQ ID NO: 184594 - DNA, 25 bp, Homo sapien
tgccctctgcaacagaaccttcagg

SEQ ID NO: 184595 - DNA, 25 bp, Homo sapien
gaagacctttaagatgctgcttctc

SEQ ID NO: 184596 - DNA, 25 bp, Homo sapien
ggacacattaggctctatgtcgtag

SEQ ID NO: 184597 - DNA, 25 bp, Homo sapien
gaatttgcctgtgtttccagtttgg

SEQ ID NO: 184598 - DNA, 25 bp, Homo sapien
tagtggtgggcatagttactgctgt

SEQ ID NO: 184599 - DNA, 25 bp, Homo sapien
gttactgctgtggtcctaggtctca

SEQ ID NO: 184600 - DNA, 25 bp, Homo sapien
taggtctcactctgctcatcagcat

SEQ ID NO: 184601 - DNA, 25 bp, Homo sapien
tctgctcatcagcatgattctggct

SEQ ID NO: 184602 - DNA, 25 bp, Homo sapien
gattctggctgtcctctatagaagg

SEQ ID NO: 184603 - DNA, 25 bp, Homo sapien
gggcccagtcatatatgcacagtta

SEQ ID NO: 184604 - DNA, 25 bp, Homo sapien
atatgcacagttagaccactccggc

SEQ ID NO: 184605 - DNA, 25 bp, Homo sapien
actccggcggacatcacagtgacaa

SEQ ID NO: 184606 - DNA, 25 bp, Homo sapien
gagtctgtggtgtatgcggatatcc

SEQ ID NO: 184607 - DNA, 25 bp, Homo sapien
gaggactttcataccgacaacatct

SEQ ID NO: 184608 - DNA, 25 bp, Homo sapien
aggactagaatgttcacaccacgat

SEQ ID NO: 184609 - DNA, 25 bp, Homo sapien
gttcacaccacgatctggatttctt

SEQ ID NO: 184610 - DNA, 25 bp, Homo sapien
ttttgttgttctctagttctacggg

SEQ ID NO: 184611 - DNA, 25 bp, Homo sapien
gttctctagttctacgggtttgatt

SEQ ID NO: 184612 - DNA, 25 bp, Homo sapien
gattactcacacatagatcaagaga

SEQ ID NO: 184613 - DNA, 25 bp, Homo sapien
atcaagagagacacggctcctgcct

SEQ ID NO: 184614 - DNA, 25 bp, Homo sapien
atgaagtggctcttgcagctagagt

SEQ ID NO: 184615 - DNA, 25 bp, Homo sapien
tggctcttgcagctagagttgactc

SEQ ID NO: 184616 - DNA, 25 bp, Homo sapien
gactcagaagccgaaattcctagaa

SEQ ID NO: 184617 - DNA, 25 bp, Homo sapien
aaatcaggtttctactgctaggcaa

SEQ ID NO: 184618 - DNA, 25 bp, Homo sapien
aagttccttggtcccagctttgaca

SEQ ID NO: 184619 - DNA, 25 bp, Homo sapien
gttcgttctgtgcacccttacgaag

SEQ ID NO: 184620 - DNA, 25 bp, Homo sapien
gcacccttacgaagtggccgaggta

SEQ ID NO: 184621 - DNA, 25 bp, Homo sapien
tggccgaggtaattgcattgcctgt

SEQ ID NO: 184622 - DNA, 25 bp, Homo sapien
ggtaattgcattgcctgtggaacag

SEQ ID NO: 184623 - DNA, 25 bp, Homo sapien
ggaactttccgtacctgcagtgggt

SEQ ID NO: 184624 - DNA, 25 bp, Homo sapien
tgcgccaggtcacagagtcagtttc

SEQ ID NO: 184625 - DNA, 25 bp, Homo sapien
agtttctgactctatcacagtcctg

SEQ ID NO: 184626 - DNA, 25 bp, Homo sapien
agtcctgccatgatgagccctgttc

SEQ ID NO: 184627 - DNA, 25 bp, Homo sapien
tgctcatcatgaagatccccgcgat

SEQ ID NO: 184628 - DNA, 25 bp, Homo sapien
ttcaacgccttctgacttccaggtg

SEQ ID NO: 184629 - DNA, 25 bp, Homo sapien
cccagctcagagactcgtgaccaaa

SEQ ID NO: 184630 - DNA, 25 bp, Homo sapien
tgaccaaatggccttggtcccgcag

SEQ ID NO: 184631 - DNA, 25 bp, Homo sapien
tcccgcagcttgtgtgcgtgagtgc

SEQ ID NO: 184632 - DNA, 25 bp, Homo sapien
gtgtgtgtctctcactgaaataaaa

SEQ ID NO: 184633 - DNA, 25 bp, Homo sapien
ccttcgagccatacagctggctaga

SEQ ID NO: 184634 - DNA, 25 bp, Homo sapien
ctagaacggaaagtgggcagcgcca

SEQ ID NO: 184635 - DNA, 25 bp, Homo sapien
gcgccagcagctgcaagaaagctaa

SEQ ID NO: 184636 - DNA, 25 bp, Homo sapien
gaaagctaacacttaagactcccac

SEQ ID NO: 184637 - DNA, 25 bp, Homo sapien
aagactcccaccctgtgacactgag

SEQ ID NO: 184638 - DNA, 25 bp, Homo sapien
gtgacactgagtcccgagcacagca

SEQ ID NO: 184639 - DNA, 25 bp, Homo sapien
agcggacagcactgagcaggccccg

SEQ ID NO: 184640 - DNA, 25 bp, Homo sapien
tttgcctccgtcatttacctgaagc

SEQ ID NO: 184641 - DNA, 25 bp, Homo sapien
ccgtcatttacctgaagcccaaaag

SEQ ID NO: 184642 - DNA, 25 bp, Homo sapien
gaagcccaaaagtccccagtctctg

SEQ ID NO: 184643 - DNA, 25 bp, Homo sapien
aaaagtccccagtctctggaaggag

SEQ ID NO: 184644 - DNA, 25 bp, Homo sapien
gtccccagtctctggaaggagacac

SEQ ID NO: 184645 - DNA, 25 bp, Homo sapien
aaggagacaccttgatgggcatcac

SEQ ID NO: 184646 - DNA, 25 bp, Homo sapien
agacaccttgatgggcatcacctac

SEQ ID NO: 184647 - DNA, 25 bp, Homo sapien
acaaggagctgaaggtcgccatgaa

SEQ ID NO: 184648 - DNA, 25 bp, Homo sapien
aaggtcgccatgaagaagaccttct

SEQ ID NO: 184649 - DNA, 25 bp, Homo sapien
gaccttcttcagtaaactctaccca

SEQ ID NO: 184650 - DNA, 25 bp, Homo sapien
tcttcagtaaactctacccagaaaa

SEQ ID NO: 184651 - DNA, 25 bp, Homo sapien
gcctggacacattaggctctatgtc

SEQ ID NO: 184652 - DNA, 25 bp, Homo sapien
ggacacattaggctctatgtcgtag

SEQ ID NO: 184653 - DNA, 25 bp, Homo sapien
cacattaggctctatgtcgtagaaa

SEQ ID NO: 184654 - DNA, 25 bp, Homo sapien
tgcctgtgtttccagtttgggtagt

SEQ ID NO: 184655 - DNA, 25 bp, Homo sapien
ctgtgtttccagtttgggtagtggt

SEQ ID NO: 184656 - DNA, 25 bp, Homo sapien
tagtggtgggcatagttactgctgt

SEQ ID NO: 184657 - DNA, 25 bp, Homo sapien
taggtctcactctgctcatcagcat

SEQ ID NO: 184658 - DNA, 25 bp, Homo sapien
gtctcactctgctcatcagcatgat

SEQ ID NO: 184659 - DNA, 25 bp, Homo sapien
tctgctcatcagcatgattctggct

SEQ ID NO: 184660 - DNA, 25 bp, Homo sapien
gattctggctgtcctctatagaagg

SEQ ID NO: 184661 - DNA, 25 bp, Homo sapien
ctggctgtcctctatagaaggaaaa

SEQ ID NO: 184662 - DNA, 25 bp, Homo sapien
tgaccagcgccctggaccatgcagt

SEQ ID NO: 184663 - DNA, 25 bp, Homo sapien
cagcgccctggaccatgcagttcgg

SEQ ID NO: 184664 - DNA, 25 bp, Homo sapien
agcgccctggaccatgcagttcggc

SEQ ID NO: 184665 - DNA, 25 bp, Homo sapien
cctggaccatgcagttcggcggccg

SEQ ID NO: 184666 - DNA, 25 bp, Homo sapien
ggaccatgcagttcggcggccgcgg

SEQ ID NO: 184667 - DNA, 25 bp, Homo sapien
ggagagagagacacagtcatggccc

SEQ ID NO: 184668 - DNA, 25 bp, Homo sapien
agagagacacagtcatggccccctt

SEQ ID NO: 184669 - DNA, 25 bp, Homo sapien
ttcctcccttgctggccctgatggg

SEQ ID NO: 184670 - DNA, 25 bp, Homo sapien
cgggaggctgtgtccgtgggtgtgc

SEQ ID NO: 184671 - DNA, 25 bp, Homo sapien
gcagtgcccagcacgggacccggct

SEQ ID NO: 184672 - DNA, 25 bp, Homo sapien
ggacccggctgcaggggaccttcaa

SEQ ID NO: 184673 - DNA, 25 bp, Homo sapien
gtccagaattttccctaaaggcagg

SEQ ID NO: 184674 - DNA, 25 bp, Homo sapien
aaggcagggattcttaacctggata

SEQ ID NO: 184675 - DNA, 25 bp, Homo sapien
tgaaatttagccttactcccaagtt

SEQ ID NO: 184676 - DNA, 25 bp, Homo sapien
tactcccaagttataaatgctggca

SEQ ID NO: 184677 - DNA, 25 bp, Homo sapien
aatgctggcaacaaatcacagtagt

SEQ ID NO: 184678 - DNA, 25 bp, Homo sapien
gcagtacctgggattttcccaccaa

SEQ ID NO: 184679 - DNA, 25 bp, Homo sapien
tcccaccaatacaaaccagttacag

SEQ ID NO: 184680 - DNA, 25 bp, Homo sapien
gaagtattgttcatatttgtcacct

SEQ ID NO: 184681 - DNA, 25 bp, Homo sapien
gttcatatttgtcacctcttggaat

SEQ ID NO: 184682 - DNA, 25 bp, Homo sapien
gtcacctcttggaatgatagcagat

SEQ ID NO: 184683 - DNA, 25 bp, Homo sapien
agcagatcctgtaagttgatgtatt

SEQ ID NO: 184684 - DNA, 25 bp, Homo sapien
gggaaatagatcagccacttttaag

SEQ ID NO: 184685 - DNA, 25 bp, Homo sapien
gccacttttaaggtgctgtcatata

SEQ ID NO: 184686 - DNA, 25 bp, Homo sapien
tgctgtcatatatcttggaatgaat

SEQ ID NO: 184687 - DNA, 25 bp, Homo sapien
atcattttaaccattgctactggaa

SEQ ID NO: 184688 - DNA, 25 bp, Homo sapien
aaccattgctactggaaagtaacag

SEQ ID NO: 184689 - DNA, 25 bp, Homo sapien
ttcctttctaaagagctcttctatt

SEQ ID NO: 184690 - DNA, 25 bp, Homo sapien
tatacatgcctaaattcttttaaaa

SEQ ID NO: 184691 - DNA, 25 bp, Homo sapien
atgtagagggatacctgtctgcata

SEQ ID NO: 184692 - DNA, 25 bp, Homo sapien
gatacctgtctgcataataaagctg

SEQ ID NO: 184693 - DNA, 25 bp, Homo sapien
aaagctgatcatgttttgctacagt

SEQ ID NO: 184694 - DNA, 25 bp, Homo sapien
ttttgctacagtttgcaggtgaaaa

SEQ ID NO: 184695 - DNA, 25 bp, Homo sapien
caacaaagattggtaatggcataag

SEQ ID NO: 184696 - DNA, 25 bp, Homo sapien
gtgttgggacaatgggtgtccacat

SEQ ID NO: 184697 - DNA, 25 bp, Homo sapien
gacaatgggtgtccacatgcaaaag

SEQ ID NO: 184698 - DNA, 25 bp, Homo sapien
acaatgggtgtccacatgcaaaaga

SEQ ID NO: 184699 - DNA, 25 bp, Homo sapien
gttgtccccttaccttacaccatct

SEQ ID NO: 184700 - DNA, 25 bp, Homo sapien
gtcaaagacataaacgtaagagcta

SEQ ID NO: 184701 - DNA, 25 bp, Homo sapien
gacataaacgtaagagctaaaactg

SEQ ID NO: 184702 - DNA, 25 bp, Homo sapien
gaccttggattaggccattgtgtct

SEQ ID NO: 184703 - DNA, 25 bp, Homo sapien
cttggattaggccattgtgtcttaa

SEQ ID NO: 184704 - DNA, 25 bp, Homo sapien
ggattaggccattgtgtcttaaata

SEQ ID NO: 184705 - DNA, 25 bp, Homo sapien
taggccattgtgtcttaaatataac

SEQ ID NO: 184706 - DNA, 25 bp, Homo sapien
ggtcccaaaatgtcattgccataca

SEQ ID NO: 184707 - DNA, 25 bp, Homo sapien
atgtcattgccatacagcttcacta

SEQ ID NO: 184708 - DNA, 25 bp, Homo sapien
tataaaggtggtgggcaaaaacaat

SEQ ID NO: 184709 - DNA, 25 bp, Homo sapien
ggcaaaaacaatgtaaggagccttt

SEQ ID NO: 184710 - DNA, 25 bp, Homo sapien
aggagcctttccagttatcttgagt

SEQ ID NO: 184711 - DNA, 25 bp, Homo sapien
gagcctttccagttatcttgagttg

SEQ ID NO: 184712 - DNA, 25 bp, Homo sapien
ttccagttatcttgagttgcagctc

SEQ ID NO: 184713 - DNA, 25 bp, Homo sapien
gagttgcagctctgtagtttcttga

SEQ ID NO: 184714 - DNA, 25 bp, Homo sapien
agctctgtagtttcttgaggccaaa

SEQ ID NO: 184715 - DNA, 25 bp, Homo sapien
tcttgaggccaaacacactgtattt

SEQ ID NO: 184716 - DNA, 25 bp, Homo sapien
gtaaaacattcttttgcattgatga

SEQ ID NO: 184717 - DNA, 25 bp, Homo sapien
gatggaggagatcccattcaaccct

SEQ ID NO: 184718 - DNA, 25 bp, Homo sapien
tggaggagatcccattcaaccctgt

SEQ ID NO: 184719 - DNA, 25 bp, Homo sapien
gagatcccattcaaccctgtccggt

SEQ ID NO: 184720 - DNA, 25 bp, Homo sapien
ctgtccggtcctggctgaaacatga

SEQ ID NO: 184721 - DNA, 25 bp, Homo sapien
tccggtcctggctgaaacatgacag

SEQ ID NO: 184722 - DNA, 25 bp, Homo sapien
aaacatgacagcagtcaagcacccc

SEQ ID NO: 184723 - DNA, 25 bp, Homo sapien
agccgagttcttccaccctgcagtg

SEQ ID NO: 184724 - DNA, 25 bp, Homo sapien
gaaaagggcactggcactggaaccc

SEQ ID NO: 184725 - DNA, 25 bp, Homo sapien
aaagggcactggcactggaaccctc

SEQ ID NO: 184726 - DNA, 25 bp, Homo sapien
tggaaccctccccaagattgcgctg

SEQ ID NO: 184727 - DNA, 25 bp, Homo sapien
ccaagattgcgctgcagggctcctg

SEQ ID NO: 184728 - DNA, 25 bp, Homo sapien
gtggtgtccatgctgaacacggctc

SEQ ID NO: 184729 - DNA, 25 bp, Homo sapien
acggctcccttacctgtcaagagca

SEQ ID NO: 184730 - DNA, 25 bp, Homo sapien
ctgcaggctgcagtgcccaagtcaa

SEQ ID NO: 184731 - DNA, 25 bp, Homo sapien
tgcagccaccttctgggacagaact

SEQ ID NO: 184732 - DNA, 25 bp, Homo sapien
tgggacagaactctctccatttagc

SEQ ID NO: 184733 - DNA, 25 bp, Homo sapien
atcacccaggtcatgttgctggcca

SEQ ID NO: 184734 - DNA, 25 bp, Homo sapien
gttgctggccaatccactgaaggag

SEQ ID NO: 184735 - DNA, 25 bp, Homo sapien
agaaggtgcggcttcggtataagct

SEQ ID NO: 184736 - DNA, 25 bp, Homo sapien
gcggcttcggtataagctgaccttc

SEQ ID NO: 184737 - DNA, 25 bp, Homo sapien
ggtataagctgaccttcgccctggg

SEQ ID NO: 184738 - DNA, 25 bp, Homo sapien
ggaccagttccctcctgtggaacag

SEQ ID NO: 184739 - DNA, 25 bp, Homo sapien
gggctctgcgttctgctctgggccg

SEQ ID NO: 184740 - DNA, 25 bp, Homo sapien
tgctcccctggcagcagaagtgggt

SEQ ID NO: 184741 - DNA, 25 bp, Homo sapien
tgaccagcgccctggaccatgcagt

SEQ ID NO: 184742 - DNA, 25 bp, Homo sapien
agcgccctggaccatgcagttcggc

SEQ ID NO: 184743 - DNA, 25 bp, Homo sapien
cctggaccatgcagttcggcggccg

SEQ ID NO: 184744 - DNA, 25 bp, Homo sapien
ggagagagagacacagtcatggccc

SEQ ID NO: 184745 - DNA, 25 bp, Homo sapien
agagagacacagtcatggccccctt

SEQ ID NO: 184746 - DNA, 25 bp, Homo sapien
ttcctcccttgctggccctgatggg

SEQ ID NO: 184747 - DNA, 25 bp, Homo sapien
cgggaggctgtgtccgtgggtgtgc

SEQ ID NO: 184748 - DNA, 25 bp, Homo sapien
tgtgcagtgcccagcacgggacccg

SEQ ID NO: 184749 - DNA, 25 bp, Homo sapien
ggacccggctgcaggggaccttcaa

SEQ ID NO: 184750 - DNA, 25 bp, Homo sapien
cagtagtggcaggatctattggcat

SEQ ID NO: 184751 - DNA, 25 bp, Homo sapien
atctattggcatattcgggagcttc

SEQ ID NO: 184752 - DNA, 25 bp, Homo sapien
atattcgggagcttcttagagggat

SEQ ID NO: 184753 - DNA, 25 bp, Homo sapien
gatgaggttctttgaacacagtgaa

SEQ ID NO: 184754 - DNA, 25 bp, Homo sapien
acttttttgcaagcagtttattgac

SEQ ID NO: 184755 - DNA, 25 bp, Homo sapien
gtttattgactgttattgctaagaa

SEQ ID NO: 184756 - DNA, 25 bp, Homo sapien
aagcctgttggcaatcttggttatt

SEQ ID NO: 184757 - DNA, 25 bp, Homo sapien
tttctttaagatttctggcagtgtg

SEQ ID NO: 184758 - DNA, 25 bp, Homo sapien
ggcaagttaaatgggacagccttcc

SEQ ID NO: 184759 - DNA, 25 bp, Homo sapien
acagccttccatgttcatttgtcta

SEQ ID NO: 184760 - DNA, 25 bp, Homo sapien
gttcatttgtctacctcttaactga

SEQ ID NO: 184761 - DNA, 25 bp, Homo sapien
ttggtgtccaggctgcacccacaga

SEQ ID NO: 184762 - DNA, 25 bp, Homo sapien
gatgtctgttgccaaacagcctgcc

SEQ ID NO: 184763 - DNA, 25 bp, Homo sapien
ctctgccagccccagattgggaagt

SEQ ID NO: 184764 - DNA, 25 bp, Homo sapien
attgggaagtctccccgctggagaa

SEQ ID NO: 184765 - DNA, 25 bp, Homo sapien
gcctcctccatcagatcctttggga

SEQ ID NO: 184766 - DNA, 25 bp, Homo sapien
aagtttctgggagatgcccgcagct

SEQ ID NO: 184767 - DNA, 25 bp, Homo sapien
aaaggctggcctgtgtgtaagtcaa

SEQ ID NO: 184768 - DNA, 25 bp, Homo sapien
tgtaagtcaaagtcactcccgcaaa

SEQ ID NO: 184769 - DNA, 25 bp, Homo sapien
gcaaacctgaatctcgagctaccta

SEQ ID NO: 184770 - DNA, 25 bp, Homo sapien
tgaatctcgagctacctattggttc

SEQ ID NO: 184771 - DNA, 25 bp, Homo sapien
acctattggttctgtgaatgttctg

SEQ ID NO: 184772 - DNA, 25 bp, Homo sapien
cctacactgccagccgccaccgggg

SEQ ID NO: 184773 - DNA, 25 bp, Homo sapien
tacactgccagccgccaccggggca

SEQ ID NO: 184774 - DNA, 25 bp, Homo sapien
actgccagccgccaccggggcacac

SEQ ID NO: 184775 - DNA, 25 bp, Homo sapien
tgccagccgccaccggggcacacgg

SEQ ID NO: 184776 - DNA, 25 bp, Homo sapien
gggcacacgggcctctgcttgccag

SEQ ID NO: 184777 - DNA, 25 bp, Homo sapien
ggcacacgggcctctgcttgccagc

SEQ ID NO: 184778 - DNA, 25 bp, Homo sapien
gcacacgggcctctgcttgccagcc

SEQ ID NO: 184779 - DNA, 25 bp, Homo sapien
cacacgggcctctgcttgccagcca

SEQ ID NO: 184780 - DNA, 25 bp, Homo sapien
acacgggcctctgcttgccagccag

SEQ ID NO: 184781 - DNA, 25 bp, Homo sapien
acgggcctctgcttgccagccagga

SEQ ID NO: 184782 - DNA, 25 bp, Homo sapien
cgggcctctgcttgccagccaggag

SEQ ID NO: 184783 - DNA, 25 bp, Homo sapien
tacgggcgtatcctcgttaccatct

SEQ ID NO: 184784 - DNA, 25 bp, Homo sapien
gtatcctcgttaccatcttccggat

SEQ ID NO: 184785 - DNA, 25 bp, Homo sapien
ttccggatcccatctgttgcgggcc

SEQ ID NO: 184786 - DNA, 25 bp, Homo sapien
tatggcaccgcactctttatctata

SEQ ID NO: 184787 - DNA, 25 bp, Homo sapien
tttatctatattcgccctaaggcca

SEQ ID NO: 184788 - DNA, 25 bp, Homo sapien
atattcgccctaaggccagctacga

SEQ ID NO: 184789 - DNA, 25 bp, Homo sapien
aggccagctacgatccggccactga

SEQ ID NO: 184790 - DNA, 25 bp, Homo sapien
acagcctgcggaacacagaggtcaa

SEQ ID NO: 184791 - DNA, 25 bp, Homo sapien
gtcaaagctgccctaaagagaacca

SEQ ID NO: 184792 - DNA, 25 bp, Homo sapien
gaaccatccagaaaacggtgcctat

SEQ ID NO: 184793 - DNA, 25 bp, Homo sapien
gaaaacggtgcctatggagatttga

SEQ ID NO: 184794 - DNA, 25 bp, Homo sapien
attcccgacgacacatatacatatg

SEQ ID NO: 184795 - DNA, 25 bp, Homo sapien
gtaggtgtctgccttcacaaatgtc

SEQ ID NO: 184796 - DNA, 25 bp, Homo sapien
aggtgtctgccttcacaaatgtcat

SEQ ID NO: 184797 - DNA, 25 bp, Homo sapien
caaatgtcattgtctactcctagaa

SEQ ID NO: 184798 - DNA, 25 bp, Homo sapien
aatgtcattgtctactcctagaaga

SEQ ID NO: 184799 - DNA, 25 bp, Homo sapien
gtcattgtctactcctagaagaacc

SEQ ID NO: 184800 - DNA, 25 bp, Homo sapien
gtctactcctagaagaaccaaatac

SEQ ID NO: 184801 - DNA, 25 bp, Homo sapien
tagaagaaccaaatacctcaatttt

SEQ ID NO: 184802 - DNA, 25 bp, Homo sapien
ctgtactatcctgtaaatatatctt

SEQ ID NO: 184803 - DNA, 25 bp, Homo sapien
atatcttaagcaggtttgttttcag

SEQ ID NO: 184804 - DNA, 25 bp, Homo sapien
tcttctaagaagacattttgttaca

SEQ ID NO: 184805 - DNA, 25 bp, Homo sapien
gagcgaagatgcgatgcctgttata

SEQ ID NO: 184806 - DNA, 25 bp, Homo sapien
gatgcgatgcctgttataaattatg

SEQ ID NO: 184807 - DNA, 25 bp, Homo sapien
tactctgtgctgtttccaaattggg

SEQ ID NO: 184808 - DNA, 25 bp, Homo sapien
aatatgaacttcacgcgggaacaga

SEQ ID NO: 184809 - DNA, 25 bp, Homo sapien
ggaacagagtcgacacccagcgtgg

SEQ ID NO: 184810 - DNA, 25 bp, Homo sapien
gagtcgacacccagcgtggtggttc

SEQ ID NO: 184811 - DNA, 25 bp, Homo sapien
ggttcatgtctgtgaaagtgaaact

SEQ ID NO: 184812 - DNA, 25 bp, Homo sapien
gaccgcagcgttgaatgagccccag

SEQ ID NO: 184813 - DNA, 25 bp, Homo sapien
cagcgttgaatgagccccagacctt

SEQ ID NO: 184814 - DNA, 25 bp, Homo sapien
cagacctttgattgcgcgctgtgag

SEQ ID NO: 184815 - DNA, 25 bp, Homo sapien
attgcgcgctgtgaggcccttggtt

SEQ ID NO: 184816 - DNA, 25 bp, Homo sapien
gaaatgctaactgaaaagccgcctt

SEQ ID NO: 184817 - DNA, 25 bp, Homo sapien
aaaagccgccttgggctgaatttga

SEQ ID NO: 184818 - DNA, 25 bp, Homo sapien
caatggctgccatctttaaaatcgc

SEQ ID NO: 184819 - DNA, 25 bp, Homo sapien
ttaaaatcgccactcagccaacaaa

SEQ ID NO: 184820 - DNA, 25 bp, Homo sapien
tcatgtctcagactatactcgagat

SEQ ID NO: 184821 - DNA, 25 bp, Homo sapien
tactcgagatttcctcaaacggatt

SEQ ID NO: 184822 - DNA, 25 bp, Homo sapien
gaggccaaactgagaccttcagctg

SEQ ID NO: 184823 - DNA, 25 bp, Homo sapien
ctgatgaactcttaaggcacatgtt

SEQ ID NO: 184824 - DNA, 25 bp, Homo sapien
gtgcattatcactagcagccagtaa

SEQ ID NO: 184825 - DNA, 25 bp, Homo sapien
atctattcattcaccttctctctga

SEQ ID NO: 184826 - DNA, 25 bp, Homo sapien
tctctctgactgcacttttcttttt

SEQ ID NO: 184827 - DNA, 25 bp, Homo sapien
gctactacgccttcccacagatgat

SEQ ID NO: 184828 - DNA, 25 bp, Homo sapien
cacagatgatcacgcccctggtgac

SEQ ID NO: 184829 - DNA, 25 bp, Homo sapien
acgcccctggtgaccaaaggctgag

SEQ ID NO: 184830 - DNA, 25 bp, Homo sapien
tggccgggagtccagggtgtcgcac

SEQ ID NO: 184831 - DNA, 25 bp, Homo sapien
ggtgtcgcaccagccctgggctgat

SEQ ID NO: 184832 - DNA, 25 bp, Homo sapien
tgatcccagctgtgtgtcaccagaa

SEQ ID NO: 184833 - DNA, 25 bp, Homo sapien
tgtgtgtcaccagaagctttcccgg

SEQ ID NO: 184834 - DNA, 25 bp, Homo sapien
aagctttcccggcttctctgtgagg

SEQ ID NO: 184835 - DNA, 25 bp, Homo sapien
gctgatcccagctgtgtgtcaccag

SEQ ID NO: 184836 - DNA, 25 bp, Homo sapien
agcagctttcccagcttctctgtga

SEQ ID NO: 184837 - DNA, 25 bp, Homo sapien
agcttctctgtgagggtcactgctg

SEQ ID NO: 184838 - DNA, 25 bp, Homo sapien
gaaactgctgtgacctacttacacc

SEQ ID NO: 184839 - DNA, 25 bp, Homo sapien
gtgacctacttacaccatgtctgta

SEQ ID NO: 184840 - DNA, 25 bp, Homo sapien
accatgtctgtagctattttcctcc

SEQ ID NO: 184841 - DNA, 25 bp, Homo sapien
ctttctctgtacctctaagaagaaa

SEQ ID NO: 184842 - DNA, 25 bp, Homo sapien
tcagaggaagaaggtccatgtcttt

SEQ ID NO: 184843 - DNA, 25 bp, Homo sapien
agtctggtgactttgtttcgatgta

SEQ ID NO: 184844 - DNA, 25 bp, Homo sapien
gtttcgatgtattcaaaatatgcct

SEQ ID NO: 184845 - DNA, 25 bp, Homo sapien
aaatatgcctgaaacactacccaat

SEQ ID NO: 184846 - DNA, 25 bp, Homo sapien
aacactacccaataattcctgctat

SEQ ID NO: 184847 - DNA, 25 bp, Homo sapien
ctgctattcagctggcattgcaaaa

SEQ ID NO: 184848 - DNA, 25 bp, Homo sapien
tatcactggatggagatgtcacatt

SEQ ID NO: 184849 - DNA, 25 bp, Homo sapien
cgcagctggtgcagatcatcaagaa

SEQ ID NO: 184850 - DNA, 25 bp, Homo sapien
agatcatcaagaagacggagtcgga

SEQ ID NO: 184851 - DNA, 25 bp, Homo sapien
cgctgcacccgctactgcaggagat

SEQ ID NO: 184852 - DNA, 25 bp, Homo sapien
cagggacatgtactgagttccttca

SEQ ID NO: 184853 - DNA, 25 bp, Homo sapien
agttccttcagatcagccacacctt

SEQ ID NO: 184854 - DNA, 25 bp, Homo sapien
gccacaccttttccaggagttctga

SEQ ID NO: 184855 - DNA, 25 bp, Homo sapien
aggagttctgaagctgacagcacta

SEQ ID NO: 184856 - DNA, 25 bp, Homo sapien
gattttgcacaaatatccaccactt

SEQ ID NO: 184857 - DNA, 25 bp, Homo sapien
tatccaccactttaaccttagagct

SEQ ID NO: 184858 - DNA, 25 bp, Homo sapien
cagtctgagctgtaggtaaccggca

SEQ ID NO: 184859 - DNA, 25 bp, Homo sapien
ggtaaccggcatattattccatatc

SEQ ID NO: 184860 - DNA, 25 bp, Homo sapien
tttgtcttcattgtggctgccatct

SEQ ID NO: 184861 - DNA, 25 bp, Homo sapien
catcttgaggattccttctgctgag

SEQ ID NO: 184862 - DNA, 25 bp, Homo sapien
gctgagggccggcacaagactttct

SEQ ID NO: 184863 - DNA, 25 bp, Homo sapien
aagactttctccacttgtgtatccc

SEQ ID NO: 184864 - DNA, 25 bp, Homo sapien
ctgtggtggtcatgcactatagttt

SEQ ID NO: 184865 - DNA, 25 bp, Homo sapien
tgcactatagttttgcctcccttat

SEQ ID NO: 184866 - DNA, 25 bp, Homo sapien
ttatctacctcaaacccaagggcct

SEQ ID NO: 184867 - DNA, 25 bp, Homo sapien
agggcctccattctatgtacagtga

SEQ ID NO: 184868 - DNA, 25 bp, Homo sapien
agtgatgccttgatggccaccacct

SEQ ID NO: 184869 - DNA, 25 bp, Homo sapien
ctcagcccaatcattttcagtctaa

SEQ ID NO: 184870 - DNA, 25 bp, Homo sapien
tgcagaaggttctgccctctaagct

SEQ ID NO: 184871 - DNA, 25 bp, Homo sapien
gtcaatagaccctctccttataaat

SEQ ID NO: 184872 - DNA, 25 bp, Homo sapien
ttcctgttgcatttcatgggcctgg

SEQ ID NO: 184873 - DNA, 25 bp, Homo sapien
gcagaggatattggagccccttttt

SEQ ID NO: 184874 - DNA, 25 bp, Homo sapien
agcccctttttgtgacattaccaat

SEQ ID NO: 184875 - DNA, 25 bp, Homo sapien
taccaattacatctttgtccacgtt

SEQ ID NO: 184876 - DNA, 25 bp, Homo sapien
tgtccacgtttaatactttgttttg

SEQ ID NO: 184877 - DNA, 25 bp, Homo sapien
aatgctgcagatttgtgtagagttc

SEQ ID NO: 184878 - DNA, 25 bp, Homo sapien
gttttccatatactttgtcttgcct

SEQ ID NO: 184879 - DNA, 25 bp, Homo sapien
atactttgtcttgcctgtatgcagc

SEQ ID NO: 184880 - DNA, 25 bp, Homo sapien
ttgcctgtatgcagcccttgtgtaa

SEQ ID NO: 184881 - DNA, 25 bp, Homo sapien
gcagcccttgtgtaatatggtgaat

SEQ ID NO: 184882 - DNA, 25 bp, Homo sapien
caccttgaagtatggggttcgcaca

SEQ ID NO: 184883 - DNA, 25 bp, Homo sapien
gggttcgcacaggtcatcctcgatt

SEQ ID NO: 184884 - DNA, 25 bp, Homo sapien
gcacaggtcatcctcgatttttcaa

SEQ ID NO: 184885 - DNA, 25 bp, Homo sapien
aggtcatcctcgatttttcaaccag

SEQ ID NO: 184886 - DNA, 25 bp, Homo sapien
gtcatcctcgatttttcaaccagct

SEQ ID NO: 184887 - DNA, 25 bp, Homo sapien
atcctcgatttttcaaccagctctc

SEQ ID NO: 184888 - DNA, 25 bp, Homo sapien
gatttttcaaccagctctccactgg

SEQ ID NO: 184889 - DNA, 25 bp, Homo sapien
cactggattggatattattggccta

SEQ ID NO: 184890 - DNA, 25 bp, Homo sapien
attggatattattggcctagctgga

SEQ ID NO: 184891 - DNA, 25 bp, Homo sapien
gatattattggcctagctggagaat

SEQ ID NO: 184892 - DNA, 25 bp, Homo sapien
gcctagctggagaatggctgacatc

SEQ ID NO: 184893 - DNA, 25 bp, Homo sapien
gcgccccctttctgtggctggatgg

SEQ ID NO: 184894 - DNA, 25 bp, Homo sapien
cagcccctgcagcaaatgactactg

SEQ ID NO: 184895 - DNA, 25 bp, Homo sapien
agcaaatgactactgcacctggaca

SEQ ID NO: 184896 - DNA, 25 bp, Homo sapien
aaatgactactgcacctggacagcc

SEQ ID NO: 184897 - DNA, 25 bp, Homo sapien
tggacagcctcctcttttctagaag

SEQ ID NO: 184898 - DNA, 25 bp, Homo sapien
gacagcctcctcttttctagaagtc

SEQ ID NO: 184899 - DNA, 25 bp, Homo sapien
cagcctcctcttttctagaagtcta

SEQ ID NO: 184900 - DNA, 25 bp, Homo sapien
gtcattttataacactctagcccct

SEQ ID NO: 184901 - DNA, 25 bp, Homo sapien
attttataacactctagcccctgcc

SEQ ID NO: 184902 - DNA, 25 bp, Homo sapien
tagcccctgcccttattgggggaca

SEQ ID NO: 184903 - DNA, 25 bp, Homo sapien
ccctgcctcgagttagttttacaat

SEQ ID NO: 184904 - DNA, 25 bp, Homo sapien
gagatctatggaccaatattggagc

SEQ ID NO: 184905 - DNA, 25 bp, Homo sapien
ggagcgaattaaagcagaaggcatt

SEQ ID NO: 184906 - DNA, 25 bp, Homo sapien
aggcattatatatactacacagagt

SEQ ID NO: 184907 - DNA, 25 bp, Homo sapien
ctacacagagtacaattaaaccata

SEQ ID NO: 184908 - DNA, 25 bp, Homo sapien
ttttttcttcccaggcaatacacct

SEQ ID NO: 184909 - DNA, 25 bp, Homo sapien
caggcaatacacctctgaacatgtg

SEQ ID NO: 184910 - DNA, 25 bp, Homo sapien
aatacacctctgaacatgtgtgtga

SEQ ID NO: 184911 - DNA, 25 bp, Homo sapien
atgtgtgtgataaatgggtttgcta

SEQ ID NO: 184912 - DNA, 25 bp, Homo sapien
atgggtttgctaatgtgctgtttta

SEQ ID NO: 184913 - DNA, 25 bp, Homo sapien
ggaacaggagatgcaagccactaac

SEQ ID NO: 184914 - DNA, 25 bp, Homo sapien
agccactaacagagaactttaataa

SEQ ID NO: 184915 - DNA, 25 bp, Homo sapien
acttatccaagtccactagaggcca

SEQ ID NO: 184916 - DNA, 25 bp, Homo sapien
tagaggccactgtcttcaaagcttc

SEQ ID NO: 184917 - DNA, 25 bp, Homo sapien
tgtcttcaaagcttctctcacccta

SEQ ID NO: 184918 - DNA, 25 bp, Homo sapien
tctcaccctagccaaaggtcctaag

SEQ ID NO: 184919 - DNA, 25 bp, Homo sapien
acagctgtgaagttgggcgtgctct

SEQ ID NO: 184920 - DNA, 25 bp, Homo sapien
ttgggcgtgctctgtggtaccagct

SEQ ID NO: 184921 - DNA, 25 bp, Homo sapien
ggtaccagctgtgacttttctattt

SEQ ID NO: 184922 - DNA, 25 bp, Homo sapien
tcctagttttaggttgttcatgaaa

SEQ ID NO: 184923 - DNA, 25 bp, Homo sapien
gaaatgtcatcctgcttgatttttc

SEQ ID NO: 184924 - DNA, 25 bp, Homo sapien
gcttgatttttcatcagccaagtta

SEQ ID NO: 184925 - DNA, 25 bp, Homo sapien
agccaagttaaacccctgctttctg

SEQ ID NO: 184926 - DNA, 25 bp, Homo sapien
gctgtccaggaactttccagcagta

SEQ ID NO: 184927 - DNA, 25 bp, Homo sapien
gtatcctcgctggtgaagacccaga

SEQ ID NO: 184928 - DNA, 25 bp, Homo sapien
aaaacttggattgggagatttcatt

SEQ ID NO: 184929 - DNA, 25 bp, Homo sapien
ttcattttctacagtgttctggttg

SEQ ID NO: 184930 - DNA, 25 bp, Homo sapien
gttctggttggtaaagcctcagcaa

SEQ ID NO: 184931 - DNA, 25 bp, Homo sapien
gactggaacacaaccatagcctgtt

SEQ ID NO: 184932 - DNA, 25 bp, Homo sapien
tagcctgtttcgtagccatattaat

SEQ ID NO: 184933 - DNA, 25 bp, Homo sapien
tgtgccttacattattactccttgc

SEQ ID NO: 184934 - DNA, 25 bp, Homo sapien
acattattactccttgccattttca

SEQ ID NO: 184935 - DNA, 25 bp, Homo sapien
aaagcattgccagctcttccaatct

SEQ ID NO: 184936 - DNA, 25 bp, Homo sapien
cagattatcttgtacagccttttat

SEQ ID NO: 184937 - DNA, 25 bp, Homo sapien
ggactgttatctacctctaactgtg

SEQ ID NO: 184938 - DNA, 25 bp, Homo sapien
aactgtgtaacattttagacttctt

SEQ ID NO: 184939 - DNA, 25 bp, Homo sapien
gaatgtaacaccttttgttcactga

SEQ ID NO: 184940 - DNA, 25 bp, Homo sapien
aacaccttttgttcactgattctga

SEQ ID NO: 184941 - DNA, 25 bp, Homo sapien
cactgattctgaagtgttcttccct

SEQ ID NO: 184942 - DNA, 25 bp, Homo sapien
tgttcttccctaatacttctttact

SEQ ID NO: 184943 - DNA, 25 bp, Homo sapien
aacaaagggctctgattgctttagg

SEQ ID NO: 184944 - DNA, 25 bp, Homo sapien
gatttaatatccacaaacgtcccca

SEQ ID NO: 184945 - DNA, 25 bp, Homo sapien
cactccccaaaagtaactatatctg

SEQ ID NO: 184946 - DNA, 25 bp, Homo sapien
ctatatctggatttcaacttttctt

SEQ ID NO: 184947 - DNA, 25 bp, Homo sapien
tttcttctaattgtgaatccttctg

SEQ ID NO: 184948 - DNA, 25 bp, Homo sapien
ttttcaaatgtctggccatttagca

SEQ ID NO: 184949 - DNA, 25 bp, Homo sapien
gtctggccatttagcaaagttattt

SEQ ID NO: 184950 - DNA, 25 bp, Homo sapien
tatgtgtggtgtatctaaatttttt

SEQ ID NO: 184951 - DNA, 25 bp, Homo sapien
gctgaaatacattatggtcaatcaa

SEQ ID NO: 184952 - DNA, 25 bp, Homo sapien
ggtcaatcaagccaagcctgcatgt

SEQ ID NO: 184953 - DNA, 25 bp, Homo sapien
aagccaagcctgcatgtacagaatt

SEQ ID NO: 184954 - DNA, 25 bp, Homo sapien
agcctgcatgtacagaatttgtttt

SEQ ID NO: 184955 - DNA, 25 bp, Homo sapien
tttggcttagtatgttgaaataaac

SEQ ID NO: 184956 - DNA, 25 bp, Homo sapien
taaactatggtatcttcatcatttt

SEQ ID NO: 184957 - DNA, 25 bp, Homo sapien
gaggaaggtttctttataagtgcaa

SEQ ID NO: 184958 - DNA, 25 bp, Homo sapien
ctttataagtgcaagggctacccta

SEQ ID NO: 184959 - DNA, 25 bp, Homo sapien
ggtgcctacaatgcctttcagatcc

SEQ ID NO: 184960 - DNA, 25 bp, Homo sapien
aatgcctttcagatccgtgctggaa

SEQ ID NO: 184961 - DNA, 25 bp, Homo sapien
tcagatccgtgctggaaactcgcag

SEQ ID NO: 184962 - DNA, 25 bp, Homo sapien
gggacttttacattaggcaaatcaa

SEQ ID NO: 184963 - DNA, 25 bp, Homo sapien
aaatcaacaacgtcagcgccatgct

SEQ ID NO: 184964 - DNA, 25 bp, Homo sapien
gtgctggacctggagatggtcacca

SEQ ID NO: 184965 - DNA, 25 bp, Homo sapien
agatggtcaccatgaattccctcat

SEQ ID NO: 184966 - DNA, 25 bp, Homo sapien
atgaattccctcatgagctaccggg

SEQ ID NO: 184967 - DNA, 25 bp, Homo sapien
taccgggccagctctgtactgaggc

SEQ ID NO: 184968 - DNA, 25 bp, Homo sapien
tactgaggctcaccgtctttgtagg

SEQ ID NO: 184969 - DNA, 25 bp, Homo sapien
ggcctacaccttctgaggagcagga

SEQ ID NO: 184970 - DNA, 25 bp, Homo sapien
gccaagagcctctctggaggctggt

SEQ ID NO: 184971 - DNA, 25 bp, Homo sapien
tggtggtttggcacctgcagccatt

SEQ ID NO: 184972 - DNA, 25 bp, Homo sapien
ggtttggcacctgcagccattccaa

SEQ ID NO: 184973 - DNA, 25 bp, Homo sapien
attccaacctcaacggccagtactt

SEQ ID NO: 184974 - DNA, 25 bp, Homo sapien
ccacagcagcggcagaagcttaaga

SEQ ID NO: 184975 - DNA, 25 bp, Homo sapien
aagggaatcttctggaagacctggc

SEQ ID NO: 184976 - DNA, 25 bp, Homo sapien
accaccatgttgatccagcccatgg

SEQ ID NO: 184977 - DNA, 25 bp, Homo sapien
gatccagcccatggcagcagaggca

SEQ ID NO: 184978 - DNA, 25 bp, Homo sapien
cagaggcagcctcctagcgtcctgg

SEQ ID NO: 184979 - DNA, 25 bp, Homo sapien
aggcccacgaaagacggtgactctt

SEQ ID NO: 184980 - DNA, 25 bp, Homo sapien
gtgactcttggctctgcccgaggat

SEQ ID NO: 184981 - DNA, 25 bp, Homo sapien
atgccttcatgcatgagaagaacga

SEQ ID NO: 184982 - DNA, 25 bp, Homo sapien
agaacgaggactgagcggctgcggt

SEQ ID NO: 184983 - DNA, 25 bp, Homo sapien
ggctgcggtcccaggaaggtcttac

SEQ ID NO: 184984 - DNA, 25 bp, Homo sapien
tttattaatttgcagacccagcccc

SEQ ID NO: 184985 - DNA, 25 bp, Homo sapien
tcccctactttttggtcagctacgt

SEQ ID NO: 184986 - DNA, 25 bp, Homo sapien
tactttttggtcagctacgtctcta

SEQ ID NO: 184987 - DNA, 25 bp, Homo sapien
ttttggtcagctacgtctctagaat

SEQ ID NO: 184988 - DNA, 25 bp, Homo sapien
gtcagctacgtctctagaataagat

SEQ ID NO: 184989 - DNA, 25 bp, Homo sapien
ggtgcccgaccagacgaggctgtct

SEQ ID NO: 184990 - DNA, 25 bp, Homo sapien
gtcttccccctgcttgtggctgaaa

SEQ ID NO: 184991 - DNA, 25 bp, Homo sapien
gtggctgaaacctttgcccagaaga

SEQ ID NO: 184992 - DNA, 25 bp, Homo sapien
ctggagctctgctagggacagaagt

SEQ ID NO: 184993 - DNA, 25 bp, Homo sapien
gaagtgatgcttccaggatttgttt

SEQ ID NO: 184994 - DNA, 25 bp, Homo sapien
gtgtcacattcatcacaggtttcat

SEQ ID NO: 184995 - DNA, 25 bp, Homo sapien
ggtttcataccaacacaggcttcag

SEQ ID NO: 184996 - DNA, 25 bp, Homo sapien
acaggcttcagcacttcctttggtg

SEQ ID NO: 184997 - DNA, 25 bp, Homo sapien
agcacttcctttggtgtgtttcctg

SEQ ID NO: 184998 - DNA, 25 bp, Homo sapien
tgtttcctgtcccagtgaagttgga

SEQ ID NO: 184999 - DNA, 25 bp, Homo sapien
gtgtagtctctataaccaatacctt

SEQ ID NO: 185000 - DNA, 25 bp, Homo sapien
accaatacctttgttttcatgtgta

SEQ ID NO: 185001 - DNA, 25 bp, Homo sapien
aggcccattacttttaaggtatgtg

SEQ ID NO: 185002 - DNA, 25 bp, Homo sapien
aggtatgtgctgtcctattgagcaa

SEQ ID NO: 185003 - DNA, 25 bp, Homo sapien
tgtgcctctcaccttattgtggtca

SEQ ID NO: 185004 - DNA, 25 bp, Homo sapien
gcctctcaccttattgtggtcattg

SEQ ID NO: 185005 - DNA, 25 bp, Homo sapien
tctcaccttattgtggtcattgtgc

SEQ ID NO: 185006 - DNA, 25 bp, Homo sapien
caccttattgtggtcattgtgcact

SEQ ID NO: 185007 - DNA, 25 bp, Homo sapien
tggctttgcctctgtcatctacctc

SEQ ID NO: 185008 - DNA, 25 bp, Homo sapien
tttgcctctgtcatctacctcaagc

SEQ ID NO: 185009 - DNA, 25 bp, Homo sapien
tgtcatctacctcaagcccaaaggt

SEQ ID NO: 185010 - DNA, 25 bp, Homo sapien
aaaggtccccactctcaggagggtg

SEQ ID NO: 185011 - DNA, 25 bp, Homo sapien
ggtccccactctcaggagggtgaca

SEQ ID NO: 185012 - DNA, 25 bp, Homo sapien
gagggtgacaccctgatggccacca

SEQ ID NO: 185013 - DNA, 25 bp, Homo sapien
tcagcacactctattcctcaggcac

SEQ ID NO: 185014 - DNA, 25 bp, Homo sapien
ttaacctctctccacatggaacctt

SEQ ID NO: 185015 - DNA, 25 bp, Homo sapien
tctctccacatggaaccttcctggg

SEQ ID NO: 185016 - DNA, 25 bp, Homo sapien
gactttgattttacggatatcttgc

SEQ ID NO: 185017 - DNA, 25 bp, Homo sapien
attttacggatatcttgcttctgtt

SEQ ID NO: 185018 - DNA, 25 bp, Homo sapien
attctgagtgtcataattccccggg

SEQ ID NO: 185019 - DNA, 25 bp, Homo sapien
tctgagtgtcataattccccgggca

SEQ ID NO: 185020 - DNA, 25 bp, Homo sapien
tgagtgtcataattccccgggcaag

SEQ ID NO: 185021 - DNA, 25 bp, Homo sapien
agtgtcataattccccgggcaaggg

SEQ ID NO: 185022 - DNA, 25 bp, Homo sapien
ggcaagggcgaaacttaacctctct

SEQ ID NO: 185023 - DNA, 25 bp, Homo sapien
gggcgaaacttaacctctctccaca

SEQ ID NO: 185024 - DNA, 25 bp, Homo sapien
aaacttaacctctctccacatggaa

SEQ ID NO: 185025 - DNA, 25 bp, Homo sapien
gggcacagacccctctaaccttggg

SEQ ID NO: 185026 - DNA, 25 bp, Homo sapien
agaaaaaactcagcccgcctagtat

SEQ ID NO: 185027 - DNA, 25 bp, Homo sapien
agccctggtatctgcctccggagga

SEQ ID NO: 185028 - DNA, 25 bp, Homo sapien
atctgcctccggaggagggctccgt

SEQ ID NO: 185029 - DNA, 25 bp, Homo sapien
aggagggctccgtccagcgactcca

SEQ ID NO: 185030 - DNA, 25 bp, Homo sapien
gtccagcgactccaaggatcccttg

SEQ ID NO: 185031 - DNA, 25 bp, Homo sapien
tcgccctccccaaagaaagatgtgc

SEQ ID NO: 185032 - DNA, 25 bp, Homo sapien
ccctccccaaagaaagatgtgctga

SEQ ID NO: 185033 - DNA, 25 bp, Homo sapien
gtgctgagtctctccggtttatcct

SEQ ID NO: 185034 - DNA, 25 bp, Homo sapien
tgagtctctccggtttatcctctga

SEQ ID NO: 185035 - DNA, 25 bp, Homo sapien
tttatcctctgacccagcagacctg

SEQ ID NO: 185036 - DNA, 25 bp, Homo sapien
gctcgtgggtgagccagcactgcaa

SEQ ID NO: 185037 - DNA, 25 bp, Homo sapien
gggtgagccagcactgcaagagcct

SEQ ID NO: 185038 - DNA, 25 bp, Homo sapien
actgcaagagcctggccatcccgtg

SEQ ID NO: 185039 - DNA, 25 bp, Homo sapien
gcatgtcgcccgacttcacggtcta

SEQ ID NO: 185040 - DNA, 25 bp, Homo sapien
gacttcacggtctacatgatcaaat

SEQ ID NO: 185041 - DNA, 25 bp, Homo sapien
gatcaaatacctcatgacgctcatc

SEQ ID NO: 185042 - DNA, 25 bp, Homo sapien
aaatacctcatgacgctcatcgtgg

SEQ ID NO: 185043 - DNA, 25 bp, Homo sapien
gcaagacgctgcactcgtggaggaa

SEQ ID NO: 185044 - DNA, 25 bp, Homo sapien
gctgcactcgtggaggaagttctac

SEQ ID NO: 185045 - DNA, 25 bp, Homo sapien
aggaagttctacactcgcctcacca

SEQ ID NO: 185046 - DNA, 25 bp, Homo sapien
cagccgacacggtgagaccaccgtg

SEQ ID NO: 185047 - DNA, 25 bp, Homo sapien
tgccaggcaccacagtgagcattgt

SEQ ID NO: 185048 - DNA, 25 bp, Homo sapien
acagtgagcattgtgttcttggcat

SEQ ID NO: 185049 - DNA, 25 bp, Homo sapien
tcttggcatgtgatctgggaaactg

SEQ ID NO: 185050 - DNA, 25 bp, Homo sapien
gattgaataatacacttttcttgct

SEQ ID NO: 185051 - DNA, 25 bp, Homo sapien
tttcttgctttggtgctcaaagtgg

SEQ ID NO: 185052 - DNA, 25 bp, Homo sapien
caggacagctcagacgcgatcgtga

SEQ ID NO: 185053 - DNA, 25 bp, Homo sapien
agacgcgatcgtgagcaaggccatt

SEQ ID NO: 185054 - DNA, 25 bp, Homo sapien
aggccattgacttgtggcacaaaca

SEQ ID NO: 185055 - DNA, 25 bp, Homo sapien
gggaccccggtccattcaagctgaa

SEQ ID NO: 185056 - DNA, 25 bp, Homo sapien
aagctgaacgcacccgctggttgtg

SEQ ID NO: 185057 - DNA, 25 bp, Homo sapien
tggttgtggaccgtctgccaggcac

SEQ ID NO: 185058 - DNA, 25 bp, Homo sapien
aaaacattccatctttcatttaata

SEQ ID NO: 185059 - DNA, 25 bp, Homo sapien
cattccatctttcatttaatatcaa

SEQ ID NO: 185060 - DNA, 25 bp, Homo sapien
gacaaacatctatctttctcatcta

SEQ ID NO: 185061 - DNA, 25 bp, Homo sapien
aacatctatctttctcatctatatt

SEQ ID NO: 185062 - DNA, 25 bp, Homo sapien
tttctcatctatatttaagtacctt

SEQ ID NO: 185063 - DNA, 25 bp, Homo sapien
gtacctttttgtaatgtagtatcaa

SEQ ID NO: 185064 - DNA, 25 bp, Homo sapien
gaatgaatggtaaaactaatctgat

SEQ ID NO: 185065 - DNA, 25 bp, Homo sapien
ttctgcaatattgtaattcatagtt

SEQ ID NO: 185066 - DNA, 25 bp, Homo sapien
gtaattcatagtttgacttttcata

SEQ ID NO: 185067 - DNA, 25 bp, Homo sapien
aaatccctaggatgtaatcaggact

SEQ ID NO: 185068 - DNA, 25 bp, Homo sapien
gatgtaatcaggacttcaaatgtgt

SEQ ID NO: 185069 - DNA, 25 bp, Homo sapien
tatggcagaccgtagcttccttgga

SEQ ID NO: 185070 - DNA, 25 bp, Homo sapien
gtagcttccttggatatttgcctaa

SEQ ID NO: 185071 - DNA, 25 bp, Homo sapien
tttgcctaatatctgttttaacatc

SEQ ID NO: 185072 - DNA, 25 bp, Homo sapien
gacattttcataaactggtatctct

SEQ ID NO: 185073 - DNA, 25 bp, Homo sapien
gtatctctggaggaactgtgaaaca

SEQ ID NO: 185074 - DNA, 25 bp, Homo sapien
gaaagtgttcacctcatggttgtat

SEQ ID NO: 185075 - DNA, 25 bp, Homo sapien
aaacccaatgggagcatactgtaaa

SEQ ID NO: 185076 - DNA, 25 bp, Homo sapien
gttcccaaatatcatatagctactg

SEQ ID NO: 185077 - DNA, 25 bp, Homo sapien
gtttgtttataccagtgacctctac

SEQ ID NO: 185078 - DNA, 25 bp, Homo sapien
cagtgacctctactctgatgacagc

SEQ ID NO: 185079 - DNA, 25 bp, Homo sapien
atgacagctatccttattcgagtag

SEQ ID NO: 185080 - DNA, 25 bp, Homo sapien
ctggcggccgactccaaggaccagg

SEQ ID NO: 185081 - DNA, 25 bp, Homo sapien
caaggaccaggctccctgcaagggt

SEQ ID NO: 185082 - DNA, 25 bp, Homo sapien
gaccaggctccctgcaagggtgact

SEQ ID NO: 185083 - DNA, 25 bp, Homo sapien
caggctccctgcaagggtgactcgg

SEQ ID NO: 185084 - DNA, 25 bp, Homo sapien
gcgggcccctggtgtgtggcaaagg

SEQ ID NO: 185085 - DNA, 25 bp, Homo sapien
gtgttggccggagtcctgtccttca

SEQ ID NO: 185086 - DNA, 25 bp, Homo sapien
gagtcctgtccttcagctccagggt

SEQ ID NO: 185087 - DNA, 25 bp, Homo sapien
tccttcagctccagggtctgcactg

SEQ ID NO: 185088 - DNA, 25 bp, Homo sapien
tggatcaggaaggtcaccggccgat

SEQ ID NO: 185089 - DNA, 25 bp, Homo sapien
atcaggaaggtcaccggccgatcgg

SEQ ID NO: 185090 - DNA, 25 bp, Homo sapien
aggtcaccggccgatcggcctgatg

SEQ ID NO: 185091 - DNA, 25 bp, Homo sapien
cagtcctcagtctggtcaagttgtt

SEQ ID NO: 185092 - DNA, 25 bp, Homo sapien
ttgtgagcagttcaggctatctcct

SEQ ID NO: 185093 - DNA, 25 bp, Homo sapien
aggccaaggctttcttatcttttgg

SEQ ID NO: 185094 - DNA, 25 bp, Homo sapien
tatcttttggttgtctctgcttaat

SEQ ID NO: 185095 - DNA, 25 bp, Homo sapien
gtctctgcttaatggaggagcctgg

SEQ ID NO: 185096 - DNA, 25 bp, Homo sapien
tggaggcctggcttagatctttcat

SEQ ID NO: 185097 - DNA, 25 bp, Homo sapien
tagatctttcattccacctcaggaa

SEQ ID NO: 185098 - DNA, 25 bp, Homo sapien
atgaggttgtgatctttcctgtcct

SEQ ID NO: 185099 - DNA, 25 bp, Homo sapien
ctgtcctgaccctctctgaattatg

SEQ ID NO: 185100 - DNA, 25 bp, Homo sapien
atagtactcttgattgtctgccatg

SEQ ID NO: 185101 - DNA, 25 bp, Homo sapien
ttgattgtctgccatgttgttgaag

SEQ ID NO: 185102 - DNA, 25 bp, Homo sapien
acaggtggacatggtcctgagctct

SEQ ID NO: 185103 - DNA, 25 bp, Homo sapien
atggtcctgagctctggacggagca

SEQ ID NO: 185104 - DNA, 25 bp, Homo sapien
aggcaccctgatctcattctgaggt

SEQ ID NO: 185105 - DNA, 25 bp, Homo sapien
tctgaggtccacatggcaccttctg

SEQ ID NO: 185106 - DNA, 25 bp, Homo sapien
ggccggtgtatcaagggcgccctta

SEQ ID NO: 185107 - DNA, 25 bp, Homo sapien
aagggcgcccttaaagctggaacat

SEQ ID NO: 185108 - DNA, 25 bp, Homo sapien
ggaacattccagcaagcttcttgcg

SEQ ID NO: 185109 - DNA, 25 bp, Homo sapien
ctggcaccctcgactttatataaaa

SEQ ID NO: 185110 - DNA, 25 bp, Homo sapien
agttgcactgcgtttcaaaaaccca

SEQ ID NO: 185111 - DNA, 25 bp, Homo sapien
gcgtttcaaaaacccaccctgaatg

SEQ ID NO: 185112 - DNA, 25 bp, Homo sapien
taaaaggagccctggctggacgtaa

SEQ ID NO: 185113 - DNA, 25 bp, Homo sapien
gggagcatccattattggtacatgt

SEQ ID NO: 185114 - DNA, 25 bp, Homo sapien
ttattggtacatgtgggcttttaaa

SEQ ID NO: 185115 - DNA, 25 bp, Homo sapien
aaactccatcctttataaatagtca

SEQ ID NO: 185116 - DNA, 25 bp, Homo sapien
aatagtcaaggtttgggccacacaa

SEQ ID NO: 185117 - DNA, 25 bp, Homo sapien
aaggtttgggccacacaaagtatat

SEQ ID NO: 185118 - DNA, 25 bp, Homo sapien
atttcaactcctcaagccgtaatgt

SEQ ID NO: 185119 - DNA, 25 bp, Homo sapien
actcctcaagccgtaatgttgaaca

SEQ ID NO: 185120 - DNA, 25 bp, Homo sapien
gaacaggcaaatgaaagcttattat

SEQ ID NO: 185121 - DNA, 25 bp, Homo sapien
atctttggaacatcagcaccagtat

SEQ ID NO: 185122 - DNA, 25 bp, Homo sapien
gcaccagtatattgctggcagctat

SEQ ID NO: 185123 - DNA, 25 bp, Homo sapien
tattgctggcagctattgtattaaa

SEQ ID NO: 185124 - DNA, 25 bp, Homo sapien
ggtggccctggcagaaccactgcct

SEQ ID NO: 185125 - DNA, 25 bp, Homo sapien
tggccctggcagaaccactgcctga

SEQ ID NO: 185126 - DNA, 25 bp, Homo sapien
gccctggcagaaccactgcctgaag

SEQ ID NO: 185127 - DNA, 25 bp, Homo sapien
cctggcagaaccactgcctgaagaa

SEQ ID NO: 185128 - DNA, 25 bp, Homo sapien
ggcagaaccactgcctgaagaacca

SEQ ID NO: 185129 - DNA, 25 bp, Homo sapien
gcctgaagaaccaggttcctgcccg

SEQ ID NO: 185130 - DNA, 25 bp, Homo sapien
ctgaagaaccaggttcctgcccggt

SEQ ID NO: 185131 - DNA, 25 bp, Homo sapien
tgaagaaccaggttcctgcccggtc

SEQ ID NO: 185132 - DNA, 25 bp, Homo sapien
gaagaaccaggttcctgcccggtca

SEQ ID NO: 185133 - DNA, 25 bp, Homo sapien
aagaaccaggttcctgcccggtcag

SEQ ID NO: 185134 - DNA, 25 bp, Homo sapien
agaaccaggttcctgcccggtcagc

SEQ ID NO: 185135 - DNA, 25 bp, Homo sapien
gtctctggacctgccttaggaagga

SEQ ID NO: 185136 - DNA, 25 bp, Homo sapien
ggcaggagtccgagccctgctcctt

SEQ ID NO: 185137 - DNA, 25 bp, Homo sapien
gagtccgagccctgctccttgtggg

SEQ ID NO: 185138 - DNA, 25 bp, Homo sapien
gagccctgctccttgtgggcgctca

SEQ ID NO: 185139 - DNA, 25 bp, Homo sapien
ggccagccgtggacagctgaggttg

SEQ ID NO: 185140 - DNA, 25 bp, Homo sapien
gttggggtcaatgcctcctgggcac

SEQ ID NO: 185141 - DNA, 25 bp, Homo sapien
acctcggcggcctttatttattctg

SEQ ID NO: 185142 - DNA, 25 bp, Homo sapien
ctcggcggcctttatttattctgtt

SEQ ID NO: 185143 - DNA, 25 bp, Homo sapien
tttatttattctgttcccccagctc

SEQ ID NO: 185144 - DNA, 25 bp, Homo sapien
agctcggccacttctctgaaggagg

SEQ ID NO: 185145 - DNA, 25 bp, Homo sapien
cggccacttctctgaaggagggctg

SEQ ID NO: 185146 - DNA, 25 bp, Homo sapien
ctctatgccctgagccctggtagtc

SEQ ID NO: 185147 - DNA, 25 bp, Homo sapien
ctgtggaaagcccatcctgagacat

SEQ ID NO: 185148 - DNA, 25 bp, Homo sapien
ggaaagcccatcctgagacatcttg

SEQ ID NO: 185149 - DNA, 25 bp, Homo sapien
aagcccatcctgagacatcttgctg

SEQ ID NO: 185150 - DNA, 25 bp, Homo sapien
cccatcctgagacatcttgctggaa

SEQ ID NO: 185151 - DNA, 25 bp, Homo sapien
tcctgagacatcttgctggaaccaa

SEQ ID NO: 185152 - DNA, 25 bp, Homo sapien
gacatcttgctggaaccaaggcaat

SEQ ID NO: 185153 - DNA, 25 bp, Homo sapien
tgctggaaccaaggcaatcctggat

SEQ ID NO: 185154 - DNA, 25 bp, Homo sapien
ggaaccaaggcaatcctggatgtcc

SEQ ID NO: 185155 - DNA, 25 bp, Homo sapien
tgtgaatgtgtccactctcttctgc

SEQ ID NO: 185156 - DNA, 25 bp, Homo sapien
taagaaaatgcagccggagcctcag

SEQ ID NO: 185157 - DNA, 25 bp, Homo sapien
tcctccttaggatgcataacctacc

SEQ ID NO: 185158 - DNA, 25 bp, Homo sapien
gatgcataacctaccttgtcttttt

SEQ ID NO: 185159 - DNA, 25 bp, Homo sapien
ttttctttccaggtagagtagctct

SEQ ID NO: 185160 - DNA, 25 bp, Homo sapien
gtagagtagctctttgtacataaag

SEQ ID NO: 185161 - DNA, 25 bp, Homo sapien
agacagagtctcctagttttgtatc

SEQ ID NO: 185162 - DNA, 25 bp, Homo sapien
ttgtatcttgttgtatgactgccat

SEQ ID NO: 185163 - DNA, 25 bp, Homo sapien
tgactgccatgagttccaccagaaa

SEQ ID NO: 185164 - DNA, 25 bp, Homo sapien
gaaagccactctattttggtctctg

SEQ ID NO: 185165 - DNA, 25 bp, Homo sapien
cactctattttggtctctgtgacat

SEQ ID NO: 185166 - DNA, 25 bp, Homo sapien
ctctgtgacattttaaatgcgtgac

SEQ ID NO: 185167 - DNA, 25 bp, Homo sapien
aaatgcgtgacagaagtgagcaaat

SEQ ID NO: 185168 - DNA, 25 bp, Homo sapien
gttagcctgcatggttaaattcgac

SEQ ID NO: 185169 - DNA, 25 bp, Homo sapien
gcatggttaaattcgacaacttgta

SEQ ID NO: 185170 - DNA, 25 bp, Homo sapien
gacaacttgtaactctatgaactta

SEQ ID NO: 185171 - DNA, 25 bp, Homo sapien
agagtttactattttagcagctaaa

SEQ ID NO: 185172 - DNA, 25 bp, Homo sapien
agcagctaaaaatgcatcacatatt

SEQ ID NO: 185173 - DNA, 25 bp, Homo sapien
gattgttttcatcctgatactgtag

SEQ ID NO: 185174 - DNA, 25 bp, Homo sapien
cctgatactgtagttcactgtagaa

SEQ ID NO: 185175 - DNA, 25 bp, Homo sapien
actgtagaaatgtggctgctgaaac

SEQ ID NO: 185176 - DNA, 25 bp, Homo sapien
ctgctgaaactcatttgattgtcat

SEQ ID NO: 185177 - DNA, 25 bp, Homo sapien
gtcatttttatctatcctatgttaa

SEQ ID NO: 185178 - DNA, 25 bp, Homo sapien
attgaaacgtttatgcttttgccaa

SEQ ID NO: 185179 - DNA, 25 bp, Homo sapien
accctgcattccagatgggggagcc

SEQ ID NO: 185180 - DNA, 25 bp, Homo sapien
gtgtgtccgttcctccactcatctg

SEQ ID NO: 185181 - DNA, 25 bp, Homo sapien
tccactcatctgtttctccggttct

SEQ ID NO: 185182 - DNA, 25 bp, Homo sapien
ccgcccatctgcctttatcagaggg

SEQ ID NO: 185183 - DNA, 25 bp, Homo sapien
catctgcctttatcagagggactgt

SEQ ID NO: 185184 - DNA, 25 bp, Homo sapien
tgcctttatcagagggactgtcccc

SEQ ID NO: 185185 - DNA, 25 bp, Homo sapien
ttatcagagggactgtccccgtcga

SEQ ID NO: 185186 - DNA, 25 bp, Homo sapien
cagagggactgtccccgtcgacatg

SEQ ID NO: 185187 - DNA, 25 bp, Homo sapien
gactgtccccgtcgacatgttcagt

SEQ ID NO: 185188 - DNA, 25 bp, Homo sapien
tgtccccgtcgacatgttcagtgcc

SEQ ID NO: 185189 - DNA, 25 bp, Homo sapien
gggctgcggagtccactcatccttg

SEQ ID NO: 185190 - DNA, 25 bp, Homo sapien
gaaaacgttctagcaactgtataaa

SEQ ID NO: 185191 - DNA, 25 bp, Homo sapien
aactgtataaaagcgttgggcatgt

SEQ ID NO: 185192 - DNA, 25 bp, Homo sapien
gcgttgggcatgtttgttatttcta

SEQ ID NO: 185193 - DNA, 25 bp, Homo sapien
atactcactctgtcatgaagaaggg

SEQ ID NO: 185194 - DNA, 25 bp, Homo sapien
ctgtcatgaagaagggtctcagcct

SEQ ID NO: 185195 - DNA, 25 bp, Homo sapien
gtctcagccttttgtggagcattga

SEQ ID NO: 185196 - DNA, 25 bp, Homo sapien
gagttgcttcttaggcctcaggtgc

SEQ ID NO: 185197 - DNA, 25 bp, Homo sapien
gaattgtaaagatctctgctgtgca

SEQ ID NO: 185198 - DNA, 25 bp, Homo sapien
ctctgctgtgcaggtgctaagatta

SEQ ID NO: 185199 - DNA, 25 bp, Homo sapien
tgtaatgtacaactgacactgccat

SEQ ID NO: 185200 - DNA, 25 bp, Homo sapien
tacaactgacactgccatttttcct

SEQ ID NO: 185201 - DNA, 25 bp, Homo sapien
tatatataactgaccacgctcaccc

SEQ ID NO: 185202 - DNA, 25 bp, Homo sapien
accctcatccagtccatactgatat

SEQ ID NO: 185203 - DNA, 25 bp, Homo sapien
agtccatactgatatttttgcaagg

SEQ ID NO: 185204 - DNA, 25 bp, Homo sapien
ggaactcaatccttttttaatcatc

SEQ ID NO: 185205 - DNA, 25 bp, Homo sapien
tccttttttaatcatccctccatat

SEQ ID NO: 185206 - DNA, 25 bp, Homo sapien
gactgactgaactcgtactttggga

SEQ ID NO: 185207 - DNA, 25 bp, Homo sapien
ggaaggtttgtgcatgaactataca

SEQ ID NO: 185208 - DNA, 25 bp, Homo sapien
gtatctgaaactaactgttgcctgc

SEQ ID NO: 185209 - DNA, 25 bp, Homo sapien
tgttgcctgcatagtcatatcgagt

SEQ ID NO: 185210 - DNA, 25 bp, Homo sapien
atagtcatatcgagtgtgcacttac

SEQ ID NO: 185211 - DNA, 25 bp, Homo sapien
gtgcacttactgtatatcttttcat

SEQ ID NO: 185212 - DNA, 25 bp, Homo sapien
gggaactgtagatgacaggcttaat

SEQ ID NO: 185213 - DNA, 25 bp, Homo sapien
gacaggcttaattgggccttcaacc

SEQ ID NO: 185214 - DNA, 25 bp, Homo sapien
gcttaattgggccttcaacctgtat

SEQ ID NO: 185215 - DNA, 25 bp, Homo sapien
aattgggccttcaacctgtatgacc

SEQ ID NO: 185216 - DNA, 25 bp, Homo sapien
gccttcaacctgtatgaccttaaca

SEQ ID NO: 185217 - DNA, 25 bp, Homo sapien
cctgtatgaccttaacaaggacggc

SEQ ID NO: 185218 - DNA, 25 bp, Homo sapien
ggctgcatcaccaaggaggaaatgc

SEQ ID NO: 185219 - DNA, 25 bp, Homo sapien
gatgggcaagtacacgtaccctgca

SEQ ID NO: 185220 - DNA, 25 bp, Homo sapien
tgaggaattcattgagtcttgtcaa

SEQ ID NO: 185221 - DNA, 25 bp, Homo sapien
gtcttgtcaaaaggatgagaacatc

SEQ ID NO: 185222 - DNA, 25 bp, Homo sapien
acatcatgaggtccatgcagctctt

SEQ ID NO: 185223 - DNA, 25 bp, Homo sapien
atggagttccttttctttctgttgt

SEQ ID NO: 185224 - DNA, 25 bp, Homo sapien
tttctgttgttgtttcccagctaca

SEQ ID NO: 185225 - DNA, 25 bp, Homo sapien
gtttcccagctacaaccaactaaag

SEQ ID NO: 185226 - DNA, 25 bp, Homo sapien
aaagacacaaatggcgttctgcaag

SEQ ID NO: 185227 - DNA, 25 bp, Homo sapien
tgggaggagttttccagaatgcaat

SEQ ID NO: 185228 - DNA, 25 bp, Homo sapien
cagaatgcaattccgagtgagcaaa

SEQ ID NO: 185229 - DNA, 25 bp, Homo sapien
gtgagcaaatcgcatagctgtagaa

SEQ ID NO: 185230 - DNA, 25 bp, Homo sapien
gctgtagaatgtgcgtgcttttttg

SEQ ID NO: 185231 - DNA, 25 bp, Homo sapien
ttttgtggacacaggagctcctcca

SEQ ID NO: 185232 - DNA, 25 bp, Homo sapien
aggctgggatcccaactatcgcttg

SEQ ID NO: 185233 - DNA, 25 bp, Homo sapien
ctatcgcttgttgcctctttttcaa

SEQ ID NO: 185234 - DNA, 25 bp, Homo sapien
agcacggcctggcaccatgggaaca

SEQ ID NO: 185235 - DNA, 25 bp, Homo sapien
tgcaggaggctgtgccacggacaca

SEQ ID NO: 185236 - DNA, 25 bp, Homo sapien
gaggctgtgccacggacacaagcca

SEQ ID NO: 185237 - DNA, 25 bp, Homo sapien
tgtgccacggacacaagccacgggc

SEQ ID NO: 185238 - DNA, 25 bp, Homo sapien
gccagaagacgtctctagtgttgcg

SEQ ID NO: 185239 - DNA, 25 bp, Homo sapien
gaagacgtctctagtgttgcgaaca

SEQ ID NO: 185240 - DNA, 25 bp, Homo sapien
agacgtctctagtgttgcgaacact

SEQ ID NO: 185241 - DNA, 25 bp, Homo sapien
gtctctagtgttgcgaacactctgt

SEQ ID NO: 185242 - DNA, 25 bp, Homo sapien
ctctagtgttgcgaacactctgtat

SEQ ID NO: 185243 - DNA, 25 bp, Homo sapien
tgtgcacttgtatgttttgtaaact

SEQ ID NO: 185244 - DNA, 25 bp, Homo sapien
ttgtaaacttggcatctgtaaaaat

SEQ ID NO: 185245 - DNA, 25 bp, Homo sapien
gcctggccctcggcgcgggctcctt

SEQ ID NO: 185246 - DNA, 25 bp, Homo sapien
ttcacacggcggcttcggaccaact

SEQ ID NO: 185247 - DNA, 25 bp, Homo sapien
tcacacggcggcttcggaccaactc

SEQ ID NO: 185248 - DNA, 25 bp, Homo sapien
cacacggcggcttcggaccaactcc

SEQ ID NO: 185249 - DNA, 25 bp, Homo sapien
gcggcttcggaccaactccctcact

SEQ ID NO: 185250 - DNA, 25 bp, Homo sapien
caactccctcactcccgcccgaggg

SEQ ID NO: 185251 - DNA, 25 bp, Homo sapien
gggcaggcctcaaagcccgccttgg

SEQ ID NO: 185252 - DNA, 25 bp, Homo sapien
tcaaagcccgccttggccccgcttt

SEQ ID NO: 185253 - DNA, 25 bp, Homo sapien
ggcgcgcttcctgcgccccgggact

SEQ ID NO: 185254 - DNA, 25 bp, Homo sapien
tcctgcgccccgggactcaattaaa

SEQ ID NO: 185255 - DNA, 25 bp, Homo sapien
gagaccacgcgggcccagcgaaaaa

SEQ ID NO: 185256 - DNA, 25 bp, Homo sapien
gacatcctcatcatcacggggtgaa

SEQ ID NO: 185257 - DNA, 25 bp, Homo sapien
taaggcagccttcttcacaggctga

SEQ ID NO: 185258 - DNA, 25 bp, Homo sapien
gccaaaaattacaccagagagacag

SEQ ID NO: 185259 - DNA, 25 bp, Homo sapien
tacaccagagagacagagtcctccc

SEQ ID NO: 185260 - DNA, 25 bp, Homo sapien
agagtcctccccattgggaacaggg

SEQ ID NO: 185261 - DNA, 25 bp, Homo sapien
agtcctccccattgggaacagggtg

SEQ ID NO: 185262 - DNA, 25 bp, Homo sapien
aacagggtgattgaggaaagtgaac

SEQ ID NO: 185263 - DNA, 25 bp, Homo sapien
gtgtgagggaccaatcctgtgacct

SEQ ID NO: 185264 - DNA, 25 bp, Homo sapien
ctgtgacctcccagaaccatggaag

SEQ ID NO: 185265 - DNA, 25 bp, Homo sapien
gacctcccagaaccatggaagccag

SEQ ID NO: 185266 - DNA, 25 bp, Homo sapien
caacacctcagaccttctgaagcag

SEQ ID NO: 185267 - DNA, 25 bp, Homo sapien
gaaattccggacattaatctggatg

SEQ ID NO: 185268 - DNA, 25 bp, Homo sapien
attaatctggatgtcccacattcat

SEQ ID NO: 185269 - DNA, 25 bp, Homo sapien
tggatgtcccacattcatactctgt

SEQ ID NO: 185270 - DNA, 25 bp, Homo sapien
tgtcccacattcatactctgtgctg

SEQ ID NO: 185271 - DNA, 25 bp, Homo sapien
catactctgtgctggagcggtttgt

SEQ ID NO: 185272 - DNA, 25 bp, Homo sapien
ctctgtgctggagcggtttgtagaa

SEQ ID NO: 185273 - DNA, 25 bp, Homo sapien
agaagaatgttttcaggctggaata

SEQ ID NO: 185274 - DNA, 25 bp, Homo sapien
aactcagagatctttgtccttcaag

SEQ ID NO: 185275 - DNA, 25 bp, Homo sapien
gggcagaaagcgttttgtaagcgaa

SEQ ID NO: 185276 - DNA, 25 bp, Homo sapien
aaagcgttttgtaagcgaaggagat

SEQ ID NO: 185277 - DNA, 25 bp, Homo sapien
ttaaaccagagagctactgaatata

SEQ ID NO: 185278 - DNA, 25 bp, Homo sapien
ggttttcattagtggaagctcttca

SEQ ID NO: 185279 - DNA, 25 bp, Homo sapien
ggaagctcttcatttataaagctat

SEQ ID NO: 185280 - DNA, 25 bp, Homo sapien
ggaatttatatcacatggtaattgt

SEQ ID NO: 185281 - DNA, 25 bp, Homo sapien
gaagctatatacctcaaaatcgtgc

SEQ ID NO: 185282 - DNA, 25 bp, Homo sapien
tatatacctcaaaatcgtgccctct

SEQ ID NO: 185283 - DNA, 25 bp, Homo sapien
aaaatcgtgccctctttacatatgt

SEQ ID NO: 185284 - DNA, 25 bp, Homo sapien
tcgtgccctctttacatatgtctta

SEQ ID NO: 185285 - DNA, 25 bp, Homo sapien
gccctctttacatatgtcttatcag

SEQ ID NO: 185286 - DNA, 25 bp, Homo sapien
gtcttatcaggtataacatgttgaa

SEQ ID NO: 185287 - DNA, 25 bp, Homo sapien
agaaatgtcagtttacactgctgta

SEQ ID NO: 185288 - DNA, 25 bp, Homo sapien
atgtcagtttacactgctgtatact

SEQ ID NO: 185289 - DNA, 25 bp, Homo sapien
gggaactgtagatgacaggcttaat

SEQ ID NO: 185290 - DNA, 25 bp, Homo sapien
ggaactgtagatgacaggcttaatt

SEQ ID NO: 185291 - DNA, 25 bp, Homo sapien
gaactgtagatgacaggcttaattg

SEQ ID NO: 185292 - DNA, 25 bp, Homo sapien
aactgtagatgacaggcttaattgg

SEQ ID NO: 185293 - DNA, 25 bp, Homo sapien
actgtagatgacaggcttaattggg

SEQ ID NO: 185294 - DNA, 25 bp, Homo sapien
ctgtagatgacaggcttaattgggc

SEQ ID NO: 185295 - DNA, 25 bp, Homo sapien
tgtagatgacaggcttaattgggcc

SEQ ID NO: 185296 - DNA, 25 bp, Homo sapien
gacaggcttaattgggccttcaacc

SEQ ID NO: 185297 - DNA, 25 bp, Homo sapien
acaggcttaattgggccttcaacct

SEQ ID NO: 185298 - DNA, 25 bp, Homo sapien
caggcttaattgggccttcaacctg

SEQ ID NO: 185299 - DNA, 25 bp, Homo sapien
gcttaattgggccttcaacctgtat

SEQ ID NO: 185300 - DNA, 25 bp, Homo sapien
gggagaagggacattccacaaccat

SEQ ID NO: 185301 - DNA, 25 bp, Homo sapien
agaagggacattccacaaccatttt

SEQ ID NO: 185302 - DNA, 25 bp, Homo sapien
catcccagaatgtgtcactgtctta

SEQ ID NO: 185303 - DNA, 25 bp, Homo sapien
cccagaatgtgtcactgtcttacct

SEQ ID NO: 185304 - DNA, 25 bp, Homo sapien
cagaatgtgtcactgtcttaccttt

SEQ ID NO: 185305 - DNA, 25 bp, Homo sapien
ctgtcttacctttctgggtctcctc

SEQ ID NO: 185306 - DNA, 25 bp, Homo sapien
ccactcgagctgtgtcctgtgcaga

SEQ ID NO: 185307 - DNA, 25 bp, Homo sapien
actcgagctgtgtcctgtgcagacc

SEQ ID NO: 185308 - DNA, 25 bp, Homo sapien
cagaccccagccaagggagatgagg

SEQ ID NO: 185309 - DNA, 25 bp, Homo sapien
gaccccagccaagggagatgaggca

SEQ ID NO: 185310 - DNA, 25 bp, Homo sapien
agcgagcccatcctctgctgtcttc

SEQ ID NO: 185311 - DNA, 25 bp, Homo sapien
agaactgcgtaagtgttgtgctcag

SEQ ID NO: 185312 - DNA, 25 bp, Homo sapien
aagtgttgtgctcagtatcccaagg

SEQ ID NO: 185313 - DNA, 25 bp, Homo sapien
tatcccaagggaagatctgtcgtct

SEQ ID NO: 185314 - DNA, 25 bp, Homo sapien
gatctgtcgtctgttcaggatttga

SEQ ID NO: 185315 - DNA, 25 bp, Homo sapien
gaaaacctaacacggaagtctgcat

SEQ ID NO: 185316 - DNA, 25 bp, Homo sapien
aacacggaagtctgcatcaaagtaa

SEQ ID NO: 185317 - DNA, 25 bp, Homo sapien
agttcttctgaagtgctgctccatg

SEQ ID NO: 185318 - DNA, 25 bp, Homo sapien
ctgctccatgtttccaccaaatgaa

SEQ ID NO: 185319 - DNA, 25 bp, Homo sapien
tcctgactcttcaggccaggtagca

SEQ ID NO: 185320 - DNA, 25 bp, Homo sapien
ggccaggtagcagcaaatagcaaat

SEQ ID NO: 185321 - DNA, 25 bp, Homo sapien
gaatatgccatctatgcagaacagg

SEQ ID NO: 185322 - DNA, 25 bp, Homo sapien
ggatgtattgttcacattatggctt

SEQ ID NO: 185323 - DNA, 25 bp, Homo sapien
gaggtagtgaacatcctaaatttct

SEQ ID NO: 185324 - DNA, 25 bp, Homo sapien
gaacatcctaaatttctacactgga

SEQ ID NO: 185325 - DNA, 25 bp, Homo sapien
tatatgttaaatgacatcactggat

SEQ ID NO: 185326 - DNA, 25 bp, Homo sapien
ggatgaacttgaagatcttttactt

SEQ ID NO: 185327 - DNA, 25 bp, Homo sapien
tgaagatcttttacttgttaacaaa

SEQ ID NO: 185328 - DNA, 25 bp, Homo sapien
aaaatactatggacagctttctgat

SEQ ID NO: 185329 - DNA, 25 bp, Homo sapien
tatggacagctttctgattgttggg

SEQ ID NO: 185330 - DNA, 25 bp, Homo sapien
atgttcaaactttgcaggcattttg

SEQ ID NO: 185331 - DNA, 25 bp, Homo sapien
ttgacattcatcataacaacacaat

SEQ ID NO: 185332 - DNA, 25 bp, Homo sapien
ataacaacacaattcctagacattg

SEQ ID NO: 185333 - DNA, 25 bp, Homo sapien
ttgcgcaaaggacctccctcttgca

SEQ ID NO: 185334 - DNA, 25 bp, Homo sapien
cctcttgcactctaagccttagttt

SEQ ID NO: 185335 - DNA, 25 bp, Homo sapien
gggtctctaaacaggagctacctca

SEQ ID NO: 185336 - DNA, 25 bp, Homo sapien
gtgaaccaatacatatacagtgctt

SEQ ID NO: 185337 - DNA, 25 bp, Homo sapien
agcacttaataagtattcccccctg

SEQ ID NO: 185338 - DNA, 25 bp, Homo sapien
ctgcgacacctagctgaactatggt

SEQ ID NO: 185339 - DNA, 25 bp, Homo sapien
gaactatggtttggtgtctgatctt

SEQ ID NO: 185340 - DNA, 25 bp, Homo sapien
tctgatcttgagaggttgatgtaac

SEQ ID NO: 185341 - DNA, 25 bp, Homo sapien
tgggtctaagaatagcactgatctc

SEQ ID NO: 185342 - DNA, 25 bp, Homo sapien
atagcactgatctcacagggttgtg

SEQ ID NO: 185343 - DNA, 25 bp, Homo sapien
cacagggttgtgatgcagattaaag

SEQ ID NO: 185344 - DNA, 25 bp, Homo sapien
tcacccagccggctaatttagataa

SEQ ID NO: 185345 - DNA, 25 bp, Homo sapien
cacccagccggctaatttagataaa

SEQ ID NO: 185346 - DNA, 25 bp, Homo sapien
tggcttcatgcaatccttccaaatg

SEQ ID NO: 185347 - DNA, 25 bp, Homo sapien
ggcttcatgcaatccttccaaatga

SEQ ID NO: 185348 - DNA, 25 bp, Homo sapien
atgcaatccttccaaatgagccaca

SEQ ID NO: 185349 - DNA, 25 bp, Homo sapien
tgcaatccttccaaatgagccacaa

SEQ ID NO: 185350 - DNA, 25 bp, Homo sapien
aatccttccaaatgagccacaacac

SEQ ID NO: 185351 - DNA, 25 bp, Homo sapien
acaacacccagccagtcacattttt

SEQ ID NO: 185352 - DNA, 25 bp, Homo sapien
tacatctttattttagtatactaga

SEQ ID NO: 185353 - DNA, 25 bp, Homo sapien
taaacatgtcaaacctgcaaattca

SEQ ID NO: 185354 - DNA, 25 bp, Homo sapien
gcaaattcagtagtaacagagttct

SEQ ID NO: 185355 - DNA, 25 bp, Homo sapien
gctaaggataatggtttccagttct

SEQ ID NO: 185356 - DNA, 25 bp, Homo sapien
gtttccagttctaccgatgttccca

SEQ ID NO: 185357 - DNA, 25 bp, Homo sapien
agttctaccgatgttcccacaaaag

SEQ ID NO: 185358 - DNA, 25 bp, Homo sapien
tcacattttctctatccaatctatt

SEQ ID NO: 185359 - DNA, 25 bp, Homo sapien
attttctctatccaatctattgttg

SEQ ID NO: 185360 - DNA, 25 bp, Homo sapien
atccaatctattgttgactcacatt

SEQ ID NO: 185361 - DNA, 25 bp, Homo sapien
caatctattgttgactcacatttag

SEQ ID NO: 185362 - DNA, 25 bp, Homo sapien
gactcacatttagattgattccatg

SEQ ID NO: 185363 - DNA, 25 bp, Homo sapien
aagatttatatttctctgagtatgt

SEQ ID NO: 185364 - DNA, 25 bp, Homo sapien
atttctctgagtatgtatccagtaa

SEQ ID NO: 185365 - DNA, 25 bp, Homo sapien
tgagtatgtatccagtaatagccca

SEQ ID NO: 185366 - DNA, 25 bp, Homo sapien
ctcagggtctattccttgcgtggat

SEQ ID NO: 185367 - DNA, 25 bp, Homo sapien
tccttgcgtggattatgtggccgta

SEQ ID NO: 185368 - DNA, 25 bp, Homo sapien
atgtggccgtagcatgttacagttc

SEQ ID NO: 185369 - DNA, 25 bp, Homo sapien
gttacagttcaaacatgtctccact

SEQ ID NO: 185370 - DNA, 25 bp, Homo sapien
gtctccactaccctgttaagagcag

SEQ ID NO: 185371 - DNA, 25 bp, Homo sapien
gagcagcctgggaacgtacaggcca

SEQ ID NO: 185372 - DNA, 25 bp, Homo sapien
gaacgtacaggccatcaagactatt

SEQ ID NO: 185373 - DNA, 25 bp, Homo sapien
accaatgtctgttttgttacatacc

SEQ ID NO: 185374 - DNA, 25 bp, Homo sapien
gttacatacctttcatgtcgtgctt

SEQ ID NO: 185375 - DNA, 25 bp, Homo sapien
tacctttcatgtcgtgctttgtaaa

SEQ ID NO: 185376 - DNA, 25 bp, Homo sapien
gtcgtgctttgtaaatgtcttattt

SEQ ID NO: 185377 - DNA, 25 bp, Homo sapien
aatgctggtccaatctattcataat

SEQ ID NO: 185378 - DNA, 25 bp, Homo sapien
tcttcaagttcaggagccgcagaga

SEQ ID NO: 185379 - DNA, 25 bp, Homo sapien
ggagccgcagagacgcacaacttta

SEQ ID NO: 185380 - DNA, 25 bp, Homo sapien
gacgcacaactttacacttatcatt

SEQ ID NO: 185381 - DNA, 25 bp, Homo sapien
tatatactgtaaggccttctttagg

SEQ ID NO: 185382 - DNA, 25 bp, Homo sapien
ttctttaggcctttagctctgttcc

SEQ ID NO: 185383 - DNA, 25 bp, Homo sapien
gctctgttcctccagtaataaaaaa

SEQ ID NO: 185384 - DNA, 25 bp, Homo sapien
atatgcttcactagtcacacattcc

SEQ ID NO: 185385 - DNA, 25 bp, Homo sapien
ttccccataccatttcgtgttattc

SEQ ID NO: 185386 - DNA, 25 bp, Homo sapien
tttcgtgttattcacattccccgta

SEQ ID NO: 185387 - DNA, 25 bp, Homo sapien
cattccccgtaccatttcttgttat

SEQ ID NO: 185388 - DNA, 25 bp, Homo sapien
aagcagtttgtgtggtgtttctata

SEQ ID NO: 185389 - DNA, 25 bp, Homo sapien
cagtttgtgtggtgtttctatataa

SEQ ID NO: 185390 - DNA, 25 bp, Homo sapien
gtttgtgtggtgtttctatataatt

SEQ ID NO: 185391 - DNA, 25 bp, Homo sapien
gaaatgaaaatctgctggccagcta

SEQ ID NO: 185392 - DNA, 25 bp, Homo sapien
aaatgaaaatctgctggccagctat

SEQ ID NO: 185393 - DNA, 25 bp, Homo sapien
tgctggccagctatgtcctctagga

SEQ ID NO: 185394 - DNA, 25 bp, Homo sapien
tggccagctatgtcctctaggaaat

SEQ ID NO: 185395 - DNA, 25 bp, Homo sapien
gccagctatgtcctctaggaaatga

SEQ ID NO: 185396 - DNA, 25 bp, Homo sapien
taggaaatgacagacccaaccacca

SEQ ID NO: 185397 - DNA, 25 bp, Homo sapien
ggaaatgacagacccaaccaccagc

SEQ ID NO: 185398 - DNA, 25 bp, Homo sapien
gacagacccaaccaccagcaataaa

SEQ ID NO: 185399 - DNA, 25 bp, Homo sapien
ggacatgtttttgtgacacacagtt

SEQ ID NO: 185400 - DNA, 25 bp, Homo sapien
gtgacacacagttatctctaggagt

SEQ ID NO: 185401 - DNA, 25 bp, Homo sapien
tatctctaggagttgacgtctgtgg

SEQ ID NO: 185402 - DNA, 25 bp, Homo sapien
taggagttgacgtctgtgggcacta

SEQ ID NO: 185403 - DNA, 25 bp, Homo sapien
gagcatttcaggatttgcagtcccc

SEQ ID NO: 185404 - DNA, 25 bp, Homo sapien
tccacatgtatccacatctgagctg

SEQ ID NO: 185405 - DNA, 25 bp, Homo sapien
acatgtatccacatctgagctggtg

SEQ ID NO: 185406 - DNA, 25 bp, Homo sapien
tgagctggtggtgttccaataatga

SEQ ID NO: 185407 - DNA, 25 bp, Homo sapien
atagctttatgtggagcaaacttga

SEQ ID NO: 185408 - DNA, 25 bp, Homo sapien
gcaaacttgaggatcaattggagtt

SEQ ID NO: 185409 - DNA, 25 bp, Homo sapien
tggcacaggaagctgtatcatttac

SEQ ID NO: 185410 - DNA, 25 bp, Homo sapien
tgcccggaaacaggccgtggctaga

SEQ ID NO: 185411 - DNA, 25 bp, Homo sapien
gagatcatctttaccgggcccggaa

SEQ ID NO: 185412 - DNA, 25 bp, Homo sapien
cggaaaaagtgccagttcctcctgg

SEQ ID NO: 185413 - DNA, 25 bp, Homo sapien
ctcctggcctggaccaacgaaaatg

SEQ ID NO: 185414 - DNA, 25 bp, Homo sapien
gaccaacgaaaatgaggcggccctc

SEQ ID NO: 185415 - DNA, 25 bp, Homo sapien
tggctctagactgcgccagggctca

SEQ ID NO: 185416 - DNA, 25 bp, Homo sapien
gctcaccaagcccatgctgtggtag

SEQ ID NO: 185417 - DNA, 25 bp, Homo sapien
acctgccccaagaactctcattgag

SEQ ID NO: 185418 - DNA, 25 bp, Homo sapien
gaactctcattgaggagctccctag

SEQ ID NO: 185419 - DNA, 25 bp, Homo sapien
aggagctccctagctgaacgggtta

SEQ ID NO: 185420 - DNA, 25 bp, Homo sapien
gacctggcacagaccctgggccgtg

SEQ ID NO: 185421 - DNA, 25 bp, Homo sapien
gcgcgggattgctggccctgatgct

SEQ ID NO: 185422 - DNA, 25 bp, Homo sapien
cgcgggattgctggccctgatgctg

SEQ ID NO: 185423 - DNA, 25 bp, Homo sapien
cctgatgctgcaccagacgatccag

SEQ ID NO: 185424 - DNA, 25 bp, Homo sapien
ctgatgctgcaccagacgatccagc

SEQ ID NO: 185425 - DNA, 25 bp, Homo sapien
tgatgctgcaccagacgatccagca

SEQ ID NO: 185426 - DNA, 25 bp, Homo sapien
atgctgcaccagacgatccagcacg

SEQ ID NO: 185427 - DNA, 25 bp, Homo sapien
tgctgcaccagacgatccagcacga

SEQ ID NO: 185428 - DNA, 25 bp, Homo sapien
tgcaccagacgatccagcacgatcc

SEQ ID NO: 185429 - DNA, 25 bp, Homo sapien
agacgatccagcacgatcccctcac

SEQ ID NO: 185430 - DNA, 25 bp, Homo sapien
tcactaccgacctgcgctccagtgc

SEQ ID NO: 185431 - DNA, 25 bp, Homo sapien
ctgcgctccagtgccgaccgctgag

SEQ ID NO: 185432 - DNA, 25 bp, Homo sapien
atcattgtctcctatattcgagtct

SEQ ID NO: 185433 - DNA, 25 bp, Homo sapien
atattcgagtcttctccacagtctt

SEQ ID NO: 185434 - DNA, 25 bp, Homo sapien
ttccttccaccaagggcgtgctcaa

SEQ ID NO: 185435 - DNA, 25 bp, Homo sapien
acctcacggttgtctctttgtatta

SEQ ID NO: 185436 - DNA, 25 bp, Homo sapien
acagtcatgggcacgtatttccgcc

SEQ ID NO: 185437 - DNA, 25 bp, Homo sapien
atttccgccctttgaccaattatag

SEQ ID NO: 185438 - DNA, 25 bp, Homo sapien
ttatagcctaaaagacgcagtgatc

SEQ ID NO: 185439 - DNA, 25 bp, Homo sapien
gcagtgatcactgtaatgtacacgg

SEQ ID NO: 185440 - DNA, 25 bp, Homo sapien
taatgtacacggcagtgaccccaat

SEQ ID NO: 185441 - DNA, 25 bp, Homo sapien
cagtgaccccaatgttaaatccttt

SEQ ID NO: 185442 - DNA, 25 bp, Homo sapien
ctgccctgcggaaactcttcaacaa

SEQ ID NO: 185443 - DNA, 25 bp, Homo sapien
agccgtcgcgcaagcacacacgagg

SEQ ID NO: 185444 - DNA, 25 bp, Homo sapien
tcgcgcaagcacacacgagggacgt

SEQ ID NO: 185445 - DNA, 25 bp, Homo sapien
acacgagggacgtgtgccagagccc

SEQ ID NO: 185446 - DNA, 25 bp, Homo sapien
gttagattttatgcttgggccttat

SEQ ID NO: 185447 - DNA, 25 bp, Homo sapien
ttatgcttgggccttatttgtatat

SEQ ID NO: 185448 - DNA, 25 bp, Homo sapien
gcttgggccttatttgtatattttt

SEQ ID NO: 185449 - DNA, 25 bp, Homo sapien
taaatagcgatttgtataggaagca

SEQ ID NO: 185450 - DNA, 25 bp, Homo sapien
gggctaccctcgactttggagcgcg

SEQ ID NO: 185451 - DNA, 25 bp, Homo sapien
ctcgactttggagcgcgctctgcga

SEQ ID NO: 185452 - DNA, 25 bp, Homo sapien
gcgattggagcagggccggagccga

SEQ ID NO: 185453 - DNA, 25 bp, Homo sapien
ggagccgaacgcctggaacgctctc

SEQ ID NO: 185454 - DNA, 25 bp, Homo sapien
tttctctggaaagccgttctttaca

SEQ ID NO: 185455 - DNA, 25 bp, Homo sapien
agccgttctttacaggatgtcttgc

SEQ ID NO: 185456 - DNA, 25 bp, Homo sapien
ggatgtcttgcttcatcgtaaacct

SEQ ID NO: 185457 - DNA, 25 bp, Homo sapien
tgcttcatcgtaaacctaaactggg

SEQ ID NO: 185458 - DNA, 25 bp, Homo sapien
ctaaactgggacaggaactgggccg

SEQ ID NO: 185459 - DNA, 25 bp, Homo sapien
ggccagtatggtgtggtatacctgt

SEQ ID NO: 185460 - DNA, 25 bp, Homo sapien
gtggtatacctgtgtgacaactggg

SEQ ID NO: 185461 - DNA, 25 bp, Homo sapien
tcaaatcagttgtccctccagatga

SEQ ID NO: 185462 - DNA, 25 bp, Homo sapien
ttgtccctccagatgagaagcactg

SEQ ID NO: 185463 - DNA, 25 bp, Homo sapien
gcactggaatgatctggctttggaa

SEQ ID NO: 185464 - DNA, 25 bp, Homo sapien
ggctttggaatttcactatatgagg

SEQ ID NO: 185465 - DNA, 25 bp, Homo sapien
ctcaaaggtgccagctacaggaaaa

SEQ ID NO: 185466 - DNA, 25 bp, Homo sapien
acacttacagaactttccatcaatg

SEQ ID NO: 185467 - DNA, 25 bp, Homo sapien
cttacagaactttccatcaatgagg

SEQ ID NO: 185468 - DNA, 25 bp, Homo sapien
gaatggacctttgagttaaatccag

SEQ ID NO: 185469 - DNA, 25 bp, Homo sapien
gggatcaaaaacctctatagtagcc

SEQ ID NO: 185470 - DNA, 25 bp, Homo sapien
aaacctctatagtagccactagggc

SEQ ID NO: 185471 - DNA, 25 bp, Homo sapien
ctctatagtagccactagggcaaaa

SEQ ID NO: 185472 - DNA, 25 bp, Homo sapien
ctagggcaaaaactgtgtgtatgtg

SEQ ID NO: 185473 - DNA, 25 bp, Homo sapien
gttcaatatggttcaatatggtacc

SEQ ID NO: 185474 - DNA, 25 bp, Homo sapien
ggttcaatatggtaccaatagccac

SEQ ID NO: 185475 - DNA, 25 bp, Homo sapien
caatatggtaccaatagccacatgt

SEQ ID NO: 185476 - DNA, 25 bp, Homo sapien
tccgcttgtcctcttgtgatgttag

SEQ ID NO: 185477 - DNA, 25 bp, Homo sapien
tcctcttgtgatgttaggacagagt

SEQ ID NO: 185478 - DNA, 25 bp, Homo sapien
gagaggatgctaagcttcctactca

SEQ ID NO: 185479 - DNA, 25 bp, Homo sapien
gatgctaagcttcctactcactttc

SEQ ID NO: 185480 - DNA, 25 bp, Homo sapien
tagccagcctggactttggagcgtg

SEQ ID NO: 185481 - DNA, 25 bp, Homo sapien
tgggacaatggctccccactctaag

SEQ ID NO: 185482 - DNA, 25 bp, Homo sapien
gaatcggttccccatatgtcttcct

SEQ ID NO: 185483 - DNA, 25 bp, Homo sapien
ttccccatatgtcttccttactaga

SEQ ID NO: 185484 - DNA, 25 bp, Homo sapien
agggcagggaccgtgccttatgtct

SEQ ID NO: 185485 - DNA, 25 bp, Homo sapien
accgtgccttatgtctgtgtgtgat

SEQ ID NO: 185486 - DNA, 25 bp, Homo sapien
tctgtgtgtgatcagtttctggcac

SEQ ID NO: 185487 - DNA, 25 bp, Homo sapien
ggagaggacagttcttagtccagta

SEQ ID NO: 185488 - DNA, 25 bp, Homo sapien
gttcttagtccagtaaaaatatgca

SEQ ID NO: 185489 - DNA, 25 bp, Homo sapien
atttctgtcaaatgtattctttact

SEQ ID NO: 185490 - DNA, 25 bp, Homo sapien
tttatatctgatgactccgagtgtg

SEQ ID NO: 185491 - DNA, 25 bp, Homo sapien
atgactccgagtgtgtgccatccat

SEQ ID NO: 185492 - DNA, 25 bp, Homo sapien
gagtgtgtgccatccatttgttaag

SEQ ID NO: 185493 - DNA, 25 bp, Homo sapien
gtaactggcctttagcagatctgtt

SEQ ID NO: 185494 - DNA, 25 bp, Homo sapien
ggcctttagcagatctgtttcaaaa

SEQ ID NO: 185495 - DNA, 25 bp, Homo sapien
aagtttgcttaagactaagtccagt

SEQ ID NO: 185496 - DNA, 25 bp, Homo sapien
ttttccctttggctgaatatttcaa

SEQ ID NO: 185497 - DNA, 25 bp, Homo sapien
atatttcaattgacaaaccagcagg

SEQ ID NO: 185498 - DNA, 25 bp, Homo sapien
ggaattgtctgcgtatccttatggg

SEQ ID NO: 185499 - DNA, 25 bp, Homo sapien
ggagctctctaatcaccatgaccat

SEQ ID NO: 185500 - DNA, 25 bp, Homo sapien
ttatgccttgactcctgccatttat

SEQ ID NO: 185501 - DNA, 25 bp, Homo sapien
gattaatactgtgattcccgctgtt

SEQ ID NO: 185502 - DNA, 25 bp, Homo sapien
tttttccttgcattttcctaatatg

SEQ ID NO: 185503 - DNA, 25 bp, Homo sapien
taatatgcctttactgatccgtttg

SEQ ID NO: 185504 - DNA, 25 bp, Homo sapien
gtgaaccctatgttatttccatgtg

SEQ ID NO: 185505 - DNA, 25 bp, Homo sapien
aagtgggtcttgtgttgccagcttc

SEQ ID NO: 185506 - DNA, 25 bp, Homo sapien
ttgcactcagtgtaagtttctgtca

SEQ ID NO: 185507 - DNA, 25 bp, Homo sapien
ttctgtcagcagtagtttcacccat

SEQ ID NO: 185508 - DNA, 25 bp, Homo sapien
gtagtttcacccatttgcatggaaa

SEQ ID NO: 185509 - DNA, 25 bp, Homo sapien
agcggtgcgacagtggcctcaacat

SEQ ID NO: 185510 - DNA, 25 bp, Homo sapien
gacagtggcctcaacatcctccaaa

SEQ ID NO: 185511 - DNA, 25 bp, Homo sapien
tggcctcaacatcctccaaacagag

SEQ ID NO: 185512 - DNA, 25 bp, Homo sapien
catcctccaaacagagaatcaagtg

SEQ ID NO: 185513 - DNA, 25 bp, Homo sapien
aaacagagaatcaagtgatcctctt

SEQ ID NO: 185514 - DNA, 25 bp, Homo sapien
gtatctgggactacacgcgaacacc

SEQ ID NO: 185515 - DNA, 25 bp, Homo sapien
atctgggactacacgcgaacaccac

SEQ ID NO: 185516 - DNA, 25 bp, Homo sapien
atttttatacagtctgggtcccact

SEQ ID NO: 185517 - DNA, 25 bp, Homo sapien
tacagtctgggtcccactatattgc

SEQ ID NO: 185518 - DNA, 25 bp, Homo sapien
ctcagcttcaaaaactgctgggatt

SEQ ID NO: 185519 - DNA, 25 bp, Homo sapien
ctgtgcctggctagattttttttta

SEQ ID NO: 185520 - DNA, 25 bp, Homo sapien
cattccttccgtgccatggttttaa

SEQ ID NO: 185521 - DNA, 25 bp, Homo sapien
ccttccgtgccatggttttaattga

SEQ ID NO: 185522 - DNA, 25 bp, Homo sapien
attcttctggtagttttctctattt

SEQ ID NO: 185523 - DNA, 25 bp, Homo sapien
ttctagattttaccccatgtcaatg

SEQ ID NO: 185524 - DNA, 25 bp, Homo sapien
gatttgatgctctgatcctttctca

SEQ ID NO: 185525 - DNA, 25 bp, Homo sapien
cctgtctccccattttggatagtta

SEQ ID NO: 185526 - DNA, 25 bp, Homo sapien
gggtcatctcggtgatttttgtaac

SEQ ID NO: 185527 - DNA, 25 bp, Homo sapien
tttgtaactttacgcaggacactta

SEQ ID NO: 185528 - DNA, 25 bp, Homo sapien
tacgcaggacacttagagctctcta

SEQ ID NO: 185529 - DNA, 25 bp, Homo sapien
ttagagctctctagaatcccactga

SEQ ID NO: 185530 - DNA, 25 bp, Homo sapien
tctctagaatcccactgactttagt

SEQ ID NO: 185531 - DNA, 25 bp, Homo sapien
actgaccctaagtcatcaaggtgga

SEQ ID NO: 185532 - DNA, 25 bp, Homo sapien
gaccctaagtcatcaaggtggaaaa

SEQ ID NO: 185533 - DNA, 25 bp, Homo sapien
agctgtcatcatcaaaacaactcat

SEQ ID NO: 185534 - DNA, 25 bp, Homo sapien
gtcatcatcaaaacaactcataaca

SEQ ID NO: 185535 - DNA, 25 bp, Homo sapien
aaaatgttcaggtagcagtgagcat

SEQ ID NO: 185536 - DNA, 25 bp, Homo sapien
gctgggtgatctctttgctgaatta

SEQ ID NO: 185537 - DNA, 25 bp, Homo sapien
aatgagttcttaacatgtggaccca

SEQ ID NO: 185538 - DNA, 25 bp, Homo sapien
ttaacatgtggacccaactgcctgt

SEQ ID NO: 185539 - DNA, 25 bp, Homo sapien
catgtggacccaactgcctgtgtga

SEQ ID NO: 185540 - DNA, 25 bp, Homo sapien
ccaactgcctgtgtgagatctgtgt

SEQ ID NO: 185541 - DNA, 25 bp, Homo sapien
attattgcaaattgtaatgctggaa

SEQ ID NO: 185542 - DNA, 25 bp, Homo sapien
actgaccctaagtcatcaaggtgga

SEQ ID NO: 185543 - DNA, 25 bp, Homo sapien
gaccctaagtcatcaaggtggaaaa

SEQ ID NO: 185544 - DNA, 25 bp, Homo sapien
agctgtcatcatcaaaacaactcat

SEQ ID NO: 185545 - DNA, 25 bp, Homo sapien
gtcatcatcaaaacaactcataaca

SEQ ID NO: 185546 - DNA, 25 bp, Homo sapien
aaaatgttcaggtagcagtgagcat

SEQ ID NO: 185547 - DNA, 25 bp, Homo sapien
aatgagttcttaacatgtggaccca

SEQ ID NO: 185548 - DNA, 25 bp, Homo sapien
tgagttcttaacatgtggacccaac

SEQ ID NO: 185549 - DNA, 25 bp, Homo sapien
gttcttaacatgtggacccaactgc

SEQ ID NO: 185550 - DNA, 25 bp, Homo sapien
ttaacatgtggacccaactgcctgt

SEQ ID NO: 185551 - DNA, 25 bp, Homo sapien
catgtggacccaactgcctgtgtga

SEQ ID NO: 185552 - DNA, 25 bp, Homo sapien
attattgcaaattgtaatgctggaa

SEQ ID NO: 185553 - DNA, 25 bp, Homo sapien
agaaatgcttggttgtaagacacca

SEQ ID NO: 185554 - DNA, 25 bp, Homo sapien
gacaccaataggaaaaccagccact

SEQ ID NO: 185555 - DNA, 25 bp, Homo sapien
agccactgcaaaactttaataatca

SEQ ID NO: 185556 - DNA, 25 bp, Homo sapien
aattcggtcacgtaattactctcat

SEQ ID NO: 185557 - DNA, 25 bp, Homo sapien
attactctcatcgaaggactcatta

SEQ ID NO: 185558 - DNA, 25 bp, Homo sapien
ggactcattacaacaaacagggaag

SEQ ID NO: 185559 - DNA, 25 bp, Homo sapien
ggaagagacacatcctctcatactc

SEQ ID NO: 185560 - DNA, 25 bp, Homo sapien
tctcatactccctgagactctgaga

SEQ ID NO: 185561 - DNA, 25 bp, Homo sapien
gacgcagagggaagagatgatcatt

SEQ ID NO: 185562 - DNA, 25 bp, Homo sapien
caccacagtggttaaaaggcgtttg

SEQ ID NO: 185563 - DNA, 25 bp, Homo sapien
aaggcgtttgtatctgacactatgt

SEQ ID NO: 185564 - DNA, 25 bp, Homo sapien
aggcttcactgctaatcacatcgtg

SEQ ID NO: 185565 - DNA, 25 bp, Homo sapien
ggcttcactgctaatcacatcgtgc

SEQ ID NO: 185566 - DNA, 25 bp, Homo sapien
gcttcactgctaatcacatcgtgca

SEQ ID NO: 185567 - DNA, 25 bp, Homo sapien
cttcactgctaatcacatcgtgcat

SEQ ID NO: 185568 - DNA, 25 bp, Homo sapien
ttcactgctaatcacatcgtgcatc

SEQ ID NO: 185569 - DNA, 25 bp, Homo sapien
tcactgctaatcacatcgtgcatct

SEQ ID NO: 185570 - DNA, 25 bp, Homo sapien
cactgctaatcacatcgtgcatctg

SEQ ID NO: 185571 - DNA, 25 bp, Homo sapien
actgctaatcacatcgtgcatctgt

SEQ ID NO: 185572 - DNA, 25 bp, Homo sapien
ctgctaatcacatcgtgcatctgtg

SEQ ID NO: 185573 - DNA, 25 bp, Homo sapien
tgctaatcacatcgtgcatctgtgt

SEQ ID NO: 185574 - DNA, 25 bp, Homo sapien
aaatctcttgtacggctaagcttag

SEQ ID NO: 185575 - DNA, 25 bp, Homo sapien
atgttagccaactcatggaactgcc

SEQ ID NO: 185576 - DNA, 25 bp, Homo sapien
catggaactgccttccaaaacactt

SEQ ID NO: 185577 - DNA, 25 bp, Homo sapien
acttcacagtgttaatcagaggttt

SEQ ID NO: 185578 - DNA, 25 bp, Homo sapien
ttctggatcttaaggcttcataaat

SEQ ID NO: 185579 - DNA, 25 bp, Homo sapien
taatgcctatgatcaccttgcatgg

SEQ ID NO: 185580 - DNA, 25 bp, Homo sapien
accttgcatggacagcaatcctgta

SEQ ID NO: 185581 - DNA, 25 bp, Homo sapien
atcacagagtggcatcatttgtata

SEQ ID NO: 185582 - DNA, 25 bp, Homo sapien
attgttgtagtttgcacctgttggt

SEQ ID NO: 185583 - DNA, 25 bp, Homo sapien
tttaatgtgcatgtgaatggcctag

SEQ ID NO: 185584 - DNA, 25 bp, Homo sapien
aatggcctagagaacctatttttgt

SEQ ID NO: 185585 - DNA, 25 bp, Homo sapien
atggtctccccacagagggttacca

SEQ ID NO: 185586 - DNA, 25 bp, Homo sapien
agagggttaccaggctctgtaccac

SEQ ID NO: 185587 - DNA, 25 bp, Homo sapien
tctgtaccacgctgtggtggagcca

SEQ ID NO: 185588 - DNA, 25 bp, Homo sapien
ggtggagccaatgctgtggaatcct

SEQ ID NO: 185589 - DNA, 25 bp, Homo sapien
ccccaagaggtacagcctggagctg

SEQ ID NO: 185590 - DNA, 25 bp, Homo sapien
gcaaggccattaaacaaaagctctg

SEQ ID NO: 185591 - DNA, 25 bp, Homo sapien
gctctttgcagtcagggtgccatct

SEQ ID NO: 185592 - DNA, 25 bp, Homo sapien
gtcagggtgccatctctgaaggtgc

SEQ ID NO: 185593 - DNA, 25 bp, Homo sapien
caggaagcagccaggtgtccacgag

SEQ ID NO: 185594 - DNA, 25 bp, Homo sapien
gtgtccacgaggagcctgtactcaa

SEQ ID NO: 185595 - DNA, 25 bp, Homo sapien
ctgtactcaagaaatggcccaagtt

SEQ ID NO: 185596 - DNA, 25 bp, Homo sapien
ggagatgggattgggcacctccccc

SEQ ID NO: 185597 - DNA, 25 bp, Homo sapien
tttcccaagcgtttctttccacctg

SEQ ID NO: 185598 - DNA, 25 bp, Homo sapien
cccaagcgtttctttccacctggag

SEQ ID NO: 185599 - DNA, 25 bp, Homo sapien
gtgagattcaaatcacgcatctcta

SEQ ID NO: 185600 - DNA, 25 bp, Homo sapien
attcaaatcacgcatctctactcct

SEQ ID NO: 185601 - DNA, 25 bp, Homo sapien
tctctactcctctgcgtgagtgcgt

SEQ ID NO: 185602 - DNA, 25 bp, Homo sapien
ctctactcctctgcgtgagtgcgtg

SEQ ID NO: 185603 - DNA, 25 bp, Homo sapien
gcgtgtgtacatgtgcactccccac

SEQ ID NO: 185604 - DNA, 25 bp, Homo sapien
tcccttcccagagggattgctgtga

SEQ ID NO: 185605 - DNA, 25 bp, Homo sapien
cttcccagagggattgctgtgaaat

SEQ ID NO: 185606 - DNA, 25 bp, Homo sapien
cccagagggattgctgtgaaatttt

SEQ ID NO: 185607 - DNA, 25 bp, Homo sapien
agccttccacaacaacactatattt

SEQ ID NO: 185608 - DNA, 25 bp, Homo sapien
tttatgctactttcctgtttgcact

SEQ ID NO: 185609 - DNA, 25 bp, Homo sapien
aagctcgcaaacacacatgtcccag

SEQ ID NO: 185610 - DNA, 25 bp, Homo sapien
acatgtcccagaatagctctgttgg

SEQ ID NO: 185611 - DNA, 25 bp, Homo sapien
gaagcggctggagttcattctctca

SEQ ID NO: 185612 - DNA, 25 bp, Homo sapien
ccccttatgttggtgtttggcgtgt

SEQ ID NO: 185613 - DNA, 25 bp, Homo sapien
gtttggcgtgtgacagcagttctac

SEQ ID NO: 185614 - DNA, 25 bp, Homo sapien
acagcagttctacagagctctgtgt

SEQ ID NO: 185615 - DNA, 25 bp, Homo sapien
atgagcggctctcttggctcttaaa

SEQ ID NO: 185616 - DNA, 25 bp, Homo sapien
cctctctcttcttgcctttaaagaa

SEQ ID NO: 185617 - DNA, 25 bp, Homo sapien
tttaaagaatcctccttcctcacac

SEQ ID NO: 185618 - DNA, 25 bp, Homo sapien
gcctggccctcggcgcgggctcctt

SEQ ID NO: 185619 - DNA, 25 bp, Homo sapien
ttcacacggcggcttcggaccaact

SEQ ID NO: 185620 - DNA, 25 bp, Homo sapien
tcacacggcggcttcggaccaactc

SEQ ID NO: 185621 - DNA, 25 bp, Homo sapien
cacacggcggcttcggaccaactcc

SEQ ID NO: 185622 - DNA, 25 bp, Homo sapien
cggcggcttcggaccaactccctca

SEQ ID NO: 185623 - DNA, 25 bp, Homo sapien
gcggcttcggaccaactccctcact

SEQ ID NO: 185624 - DNA, 25 bp, Homo sapien
ggcttcggaccaactccctcactcc

SEQ ID NO: 185625 - DNA, 25 bp, Homo sapien
caactccctcactcccgcccgaggg

SEQ ID NO: 185626 - DNA, 25 bp, Homo sapien
tcaaagcccgccttggccccgcttt

SEQ ID NO: 185627 - DNA, 25 bp, Homo sapien
ggcgcgcttcctgcgccccgggact

SEQ ID NO: 185628 - DNA, 25 bp, Homo sapien
tcctgcgccccgggactcaattaaa

SEQ ID NO: 185629 - DNA, 25 bp, Homo sapien
ttttattgttttgatccaagtcaag

SEQ ID NO: 185630 - DNA, 25 bp, Homo sapien
tgatccaagtcaagtgtagcctctc

SEQ ID NO: 185631 - DNA, 25 bp, Homo sapien
gatccaagtcaagtgtagcctctca

SEQ ID NO: 185632 - DNA, 25 bp, Homo sapien
tccaagtcaagtgtagcctctcagc

SEQ ID NO: 185633 - DNA, 25 bp, Homo sapien
aagtcaagtgtagcctctcagcctt

SEQ ID NO: 185634 - DNA, 25 bp, Homo sapien
tcaagtgtagcctctcagccttttg

SEQ ID NO: 185635 - DNA, 25 bp, Homo sapien
aagtgtagcctctcagccttttgga

SEQ ID NO: 185636 - DNA, 25 bp, Homo sapien
agtgtagcctctcagccttttggag

SEQ ID NO: 185637 - DNA, 25 bp, Homo sapien
tgtagcctctcagccttttggagaa

SEQ ID NO: 185638 - DNA, 25 bp, Homo sapien
tagcctctcagccttttggagaaaa

SEQ ID NO: 185639 - DNA, 25 bp, Homo sapien
gcctctcagccttttggagaaaaat

SEQ ID NO: 185640 - DNA, 25 bp, Homo sapien
catctcccatctgggatagggacct

SEQ ID NO: 185641 - DNA, 25 bp, Homo sapien
atctgggatagggaccttccatcag

SEQ ID NO: 185642 - DNA, 25 bp, Homo sapien
tgggatagggaccttccatcagcct

SEQ ID NO: 185643 - DNA, 25 bp, Homo sapien
cttccatcagccttaaccctgggaa

SEQ ID NO: 185644 - DNA, 25 bp, Homo sapien
tgactcttggtttcgtctcccacat

SEQ ID NO: 185645 - DNA, 25 bp, Homo sapien
ttggtttcgtctcccacatacagaa

SEQ ID NO: 185646 - DNA, 25 bp, Homo sapien
gtttcgtctcccacatacagaagca

SEQ ID NO: 185647 - DNA, 25 bp, Homo sapien
ttcgtctcccacatacagaagcagg

SEQ ID NO: 185648 - DNA, 25 bp, Homo sapien
gtctcccacatacagaagcagggtg

SEQ ID NO: 185649 - DNA, 25 bp, Homo sapien
atgcctctctggtcagtgtgcctta

SEQ ID NO: 185650 - DNA, 25 bp, Homo sapien
gcctctctggtcagtgtgccttagg

SEQ ID NO: 185651 - DNA, 25 bp, Homo sapien
cagtggttagatgatctttgtctga

SEQ ID NO: 185652 - DNA, 25 bp, Homo sapien
gttttagtgtgtccttaaagccaag

SEQ ID NO: 185653 - DNA, 25 bp, Homo sapien
agccaagtatatgctttaacatcaa

SEQ ID NO: 185654 - DNA, 25 bp, Homo sapien
tagagagagctaaactgtgtaattt

SEQ ID NO: 185655 - DNA, 25 bp, Homo sapien
tttaatggtatcttccttgctggat

SEQ ID NO: 185656 - DNA, 25 bp, Homo sapien
tatcttccttgctggatgtggcaga

SEQ ID NO: 185657 - DNA, 25 bp, Homo sapien
gatgtggcagaatccacaccagctt

SEQ ID NO: 185658 - DNA, 25 bp, Homo sapien
agaatccacaccagcttatcaacca

SEQ ID NO: 185659 - DNA, 25 bp, Homo sapien
agaataggtcctttatctttccata

SEQ ID NO: 185660 - DNA, 25 bp, Homo sapien
tatctttccatatggcacacgtaag

SEQ ID NO: 185661 - DNA, 25 bp, Homo sapien
ggcacacgtaagaaagtgtttttct

SEQ ID NO: 185662 - DNA, 25 bp, Homo sapien
gaaagcagcgaagacactgggtata

SEQ ID NO: 185663 - DNA, 25 bp, Homo sapien
cttgctggttgccttgttttcttgc

SEQ ID NO: 185664 - DNA, 25 bp, Homo sapien
gttttcttgctgttctgattgaccc

SEQ ID NO: 185665 - DNA, 25 bp, Homo sapien
gctgttctgattgacccatacctag

SEQ ID NO: 185666 - DNA, 25 bp, Homo sapien
ctactccactcccatactaatattg

SEQ ID NO: 185667 - DNA, 25 bp, Homo sapien
aatattggatcttttagtgtggctc

SEQ ID NO: 185668 - DNA, 25 bp, Homo sapien
tttagtgtggctccggtacttcaac

SEQ ID NO: 185669 - DNA, 25 bp, Homo sapien
gtacttcaactctacttgcaaccct

SEQ ID NO: 185670 - DNA, 25 bp, Homo sapien
ttgcaaccctcttattcatggcttt

SEQ ID NO: 185671 - DNA, 25 bp, Homo sapien
aaagcattcaagtacatagtgtcag

SEQ ID NO: 185672 - DNA, 25 bp, Homo sapien
tatttagctcccattcagaaactgc

SEQ ID NO: 185673 - DNA, 25 bp, Homo sapien
tcttgctgcagtgcaacaggaggct

SEQ ID NO: 185674 - DNA, 25 bp, Homo sapien
aggaggctttttcagtgatcttcac

SEQ ID NO: 185675 - DNA, 25 bp, Homo sapien
ggctttttcagtgatcttcactgta

SEQ ID NO: 185676 - DNA, 25 bp, Homo sapien
atcttcactgtatatgtaaattaca

SEQ ID NO: 185677 - DNA, 25 bp, Homo sapien
caaatgtggctgtaaaacttattcc

SEQ ID NO: 185678 - DNA, 25 bp, Homo sapien
gctgtaaaacttattccaggtatta

SEQ ID NO: 185679 - DNA, 25 bp, Homo sapien
aaaggttaaattgctttctatatct

SEQ ID NO: 185680 - DNA, 25 bp, Homo sapien
tccttttgtccacttgtaagaatgt

SEQ ID NO: 185681 - DNA, 25 bp, Homo sapien
tttgtttaaattaggcatatctctg

SEQ ID NO: 185682 - DNA, 25 bp, Homo sapien
taggcatatctctgccatcacatag

SEQ ID NO: 185683 - DNA, 25 bp, Homo sapien
gtcaccataatgaacaattgctatt

SEQ ID NO: 185684 - DNA, 25 bp, Homo sapien
acagcaggtgaacagtctacaaggt

SEQ ID NO: 185685 - DNA, 25 bp, Homo sapien
aggtgaacagtctacaaggtctttt

SEQ ID NO: 185686 - DNA, 25 bp, Homo sapien
tgaacagtctacaaggtcttttatc

SEQ ID NO: 185687 - DNA, 25 bp, Homo sapien
gaggatgatgcttatgacttcagta

SEQ ID NO: 185688 - DNA, 25 bp, Homo sapien
gatgcttatgacttcagtacagatt

SEQ ID NO: 185689 - DNA, 25 bp, Homo sapien
gacttcagtacagattatgtgtaac

SEQ ID NO: 185690 - DNA, 25 bp, Homo sapien
tatgtgtaacagaacaatggctttt

SEQ ID NO: 185691 - DNA, 25 bp, Homo sapien
cagaacaatggctttttatgatttt

SEQ ID NO: 185692 - DNA, 25 bp, Homo sapien
ttttaacattttaagcagactgcta

SEQ ID NO: 185693 - DNA, 25 bp, Homo sapien
agttatggtatgcatgagctgtgta

SEQ ID NO: 185694 - DNA, 25 bp, Homo sapien
gtatgcatgagctgtgtaaattttg

SEQ ID NO: 185695 - DNA, 25 bp, Homo sapien
caggacacacaggaagcccctgtgt

SEQ ID NO: 185696 - DNA, 25 bp, Homo sapien
ccctgtgtgacatcaggagcagaac

SEQ ID NO: 185697 - DNA, 25 bp, Homo sapien
tacaagggcctggactcagaggaca

SEQ ID NO: 185698 - DNA, 25 bp, Homo sapien
tcagaggacagtgcacaggctagcc

SEQ ID NO: 185699 - DNA, 25 bp, Homo sapien
agaggacagtgcacaggctagcctg

SEQ ID NO: 185700 - DNA, 25 bp, Homo sapien
agtgcacaggctagcctggagctca

SEQ ID NO: 185701 - DNA, 25 bp, Homo sapien
cacaggctagcctggagctcaccag

SEQ ID NO: 185702 - DNA, 25 bp, Homo sapien
aggctagcctggagctcaccaggcc

SEQ ID NO: 185703 - DNA, 25 bp, Homo sapien
tgccggacctgcagccctggacaga

SEQ ID NO: 185704 - DNA, 25 bp, Homo sapien
aacactgtgcctccctgaacagaaa

SEQ ID NO: 185705 - DNA, 25 bp, Homo sapien
ggttgggaggtataaccctgctcct

SEQ ID NO: 185706 - DNA, 25 bp, Homo sapien
aaagagtatcttttgacgtcctgct

SEQ ID NO: 185707 - DNA, 25 bp, Homo sapien
atcttttgacgtcctgcttggaaaa

SEQ ID NO: 185708 - DNA, 25 bp, Homo sapien
agtatactggtaactcagtctccag

SEQ ID NO: 185709 - DNA, 25 bp, Homo sapien
gtcacctctgtgtctcttaagcaag

SEQ ID NO: 185710 - DNA, 25 bp, Homo sapien
gaaaacatatcctccaaaacctgcc

SEQ ID NO: 185711 - DNA, 25 bp, Homo sapien
aaacctgcctttgcctaaccattat

SEQ ID NO: 185712 - DNA, 25 bp, Homo sapien
gcctttgcctaaccattatttttca

SEQ ID NO: 185713 - DNA, 25 bp, Homo sapien
tcaccagattacttcttaagagagg

SEQ ID NO: 185714 - DNA, 25 bp, Homo sapien
ttctatctcaaaaagcactgggctt

SEQ ID NO: 185715 - DNA, 25 bp, Homo sapien
aaagcactgggcttccttattcatc

SEQ ID NO: 185716 - DNA, 25 bp, Homo sapien
gcttccttattcatctgttcttgtt

SEQ ID NO: 185717 - DNA, 25 bp, Homo sapien
gcaaggcccggatccgggtacagat

SEQ ID NO: 185718 - DNA, 25 bp, Homo sapien
ccgggtacagatctcagcagtgcat

SEQ ID NO: 185719 - DNA, 25 bp, Homo sapien
agatctcagcagtgcatagcgagga

SEQ ID NO: 185720 - DNA, 25 bp, Homo sapien
gcagtgcatagcgaggaagacattg

SEQ ID NO: 185721 - DNA, 25 bp, Homo sapien
aggaagacattgaccgctgcgtgga

SEQ ID NO: 185722 - DNA, 25 bp, Homo sapien
ttgaccgctgcgtggaggccttcgt

SEQ ID NO: 185723 - DNA, 25 bp, Homo sapien
tgccctgagctctgggtaaggacga

SEQ ID NO: 185724 - DNA, 25 bp, Homo sapien
aggacgagaagagccaaggtccgcc

SEQ ID NO: 185725 - DNA, 25 bp, Homo sapien
agccctgaaccaaagtcccagagct

SEQ ID NO: 185726 - DNA, 25 bp, Homo sapien
agctgggctgggacgtgacctgtgc

SEQ ID NO: 185727 - DNA, 25 bp, Homo sapien
acgtgacctgtgctgagggctgtga

SEQ ID NO: 185728 - DNA, 25 bp, Homo sapien
aaagctgagtgcctttgtggatgaa

SEQ ID NO: 185729 - DNA, 25 bp, Homo sapien
tatgcagccgaatacaccctgcaga

SEQ ID NO: 185730 - DNA, 25 bp, Homo sapien
gggcatccccactgatggaggcgat

SEQ ID NO: 185731 - DNA, 25 bp, Homo sapien
aggcgatggcaccatggctactgct

SEQ ID NO: 185732 - DNA, 25 bp, Homo sapien
tgctactgctttcccaggatatgct

SEQ ID NO: 185733 - DNA, 25 bp, Homo sapien
aggatatgctgtccctaatgcaact

SEQ ID NO: 185734 - DNA, 25 bp, Homo sapien
taatgcaactgcacccgtgtctgca

SEQ ID NO: 185735 - DNA, 25 bp, Homo sapien
gcagcccagctcaagcaagcggtaa

SEQ ID NO: 185736 - DNA, 25 bp, Homo sapien
ctatgaggtctacccaacttttgca

SEQ ID NO: 185737 - DNA, 25 bp, Homo sapien
aacttttgcagtgactgcccgaggg

SEQ ID NO: 185738 - DNA, 25 bp, Homo sapien
gatggatatggcaccttctgaagat

SEQ ID NO: 185739 - DNA, 25 bp, Homo sapien
aaatccagtggttcataactcccaa

SEQ ID NO: 185740 - DNA, 25 bp, Homo sapien
agtggttcataactcccaaacgctt

SEQ ID NO: 185741 - DNA, 25 bp, Homo sapien
tggttcataactcccaaacgcttag

SEQ ID NO: 185742 - DNA, 25 bp, Homo sapien
cataactcccaaacgcttagtcttt

SEQ ID NO: 185743 - DNA, 25 bp, Homo sapien
ctcccaaacgcttagtctttgtatt

SEQ ID NO: 185744 - DNA, 25 bp, Homo sapien
cacagtggaggactgcttatagagc

SEQ ID NO: 185745 - DNA, 25 bp, Homo sapien
gaggactgcttatagagcacagacc

SEQ ID NO: 185746 - DNA, 25 bp, Homo sapien
ttgctttcaaatgccatgggttaca

SEQ ID NO: 185747 - DNA, 25 bp, Homo sapien
caaatgccatgggttacacttttat

SEQ ID NO: 185748 - DNA, 25 bp, Homo sapien
gggttacacttttatgggcatgact

SEQ ID NO: 185749 - DNA, 25 bp, Homo sapien
acttttatgggcatgactataacca

SEQ ID NO: 185750 - DNA, 25 bp, Homo sapien
gttcataacagcgattttgcctaac

SEQ ID NO: 185751 - DNA, 25 bp, Homo sapien
agcgattttgcctaacattatatca

SEQ ID NO: 185752 - DNA, 25 bp, Homo sapien
cattatatcataagcgtgttccaat

SEQ ID NO: 185753 - DNA, 25 bp, Homo sapien
tcataagcgtgttccaatgtttttt

SEQ ID NO: 185754 - DNA, 25 bp, Homo sapien
tgtatggtccacagtgtatataacc

SEQ ID NO: 185755 - DNA, 25 bp, Homo sapien
tgtatataaccaacaactcaccgtt

SEQ ID NO: 185756 - DNA, 25 bp, Homo sapien
aacaactcaccgttgcgcatgtagg

SEQ ID NO: 185757 - DNA, 25 bp, Homo sapien
accgttgcgcatgtaggctgccggt

SEQ ID NO: 185758 - DNA, 25 bp, Homo sapien
gctgccggtggctttctataatcaa

SEQ ID NO: 185759 - DNA, 25 bp, Homo sapien
tatgcaatgtggctgctttgactgt

SEQ ID NO: 185760 - DNA, 25 bp, Homo sapien
gctttgactgtactggacataaaaa

SEQ ID NO: 185761 - DNA, 25 bp, Homo sapien
ttttctttgtgcagcggtctggtta

SEQ ID NO: 185762 - DNA, 25 bp, Homo sapien
gtctggttatcgtctatccccaggg

SEQ ID NO: 185763 - DNA, 25 bp, Homo sapien
gcccgctcccaggagctaatggtag

SEQ ID NO: 185764 - DNA, 25 bp, Homo sapien
atggtagagcgtccttgaggctcca

SEQ ID NO: 185765 - DNA, 25 bp, Homo sapien
gaggctccattattcgttcattcag

SEQ ID NO: 185766 - DNA, 25 bp, Homo sapien
tgcacctactatgtggcgggcattt

SEQ ID NO: 185767 - DNA, 25 bp, Homo sapien
atgtggcgggcatttgggataccaa

SEQ ID NO: 185768 - DNA, 25 bp, Homo sapien
gataaattgcatgcggcatggcccc

SEQ ID NO: 185769 - DNA, 25 bp, Homo sapien
gaaggaacttaaccgctagtgccga

SEQ ID NO: 185770 - DNA, 25 bp, Homo sapien
accgctagtgccgaggacacgttaa

SEQ ID NO: 185771 - DNA, 25 bp, Homo sapien
taaacgaacaggatgggccgggcac

SEQ ID NO: 185772 - DNA, 25 bp, Homo sapien
agttttagcactgaattccttcttc

SEQ ID NO: 185773 - DNA, 25 bp, Homo sapien
gaattccttcttcactgttgtttgt

SEQ ID NO: 185774 - DNA, 25 bp, Homo sapien
ccttcttcactgttgtttgtattta

SEQ ID NO: 185775 - DNA, 25 bp, Homo sapien
aagttattcatcaccaggctgtaag

SEQ ID NO: 185776 - DNA, 25 bp, Homo sapien
caggctgtaagcaatatcttgagtt

SEQ ID NO: 185777 - DNA, 25 bp, Homo sapien
cttgagtttgtagcttagaattggg

SEQ ID NO: 185778 - DNA, 25 bp, Homo sapien
ggaggatacttaacatctggaagac

SEQ ID NO: 185779 - DNA, 25 bp, Homo sapien
gttcatttcatcttgagatcatggt

SEQ ID NO: 185780 - DNA, 25 bp, Homo sapien
aattccttaagctattgtaaccatg

SEQ ID NO: 185781 - DNA, 25 bp, Homo sapien
tgtaaccatgttttattgcaaagat

SEQ ID NO: 185782 - DNA, 25 bp, Homo sapien
gccagatgtgtgtgagttggaaatc

SEQ ID NO: 185783 - DNA, 25 bp, Homo sapien
acagtttctactctaggagatcctg

SEQ ID NO: 185784 - DNA, 25 bp, Homo sapien
taggagatcctggtccccatggctt

SEQ ID NO: 185785 - DNA, 25 bp, Homo sapien
cctggtccccatggctttctgagga

SEQ ID NO: 185786 - DNA, 25 bp, Homo sapien
ctttctgaggaaatctagtggtgac

SEQ ID NO: 185787 - DNA, 25 bp, Homo sapien
aatataccttctgggatcttcaata

SEQ ID NO: 185788 - DNA, 25 bp, Homo sapien
tcattcctagtacctttttgcctaa

SEQ ID NO: 185789 - DNA, 25 bp, Homo sapien
ggactttaatagtattatccccatc

SEQ ID NO: 185790 - DNA, 25 bp, Homo sapien
ttatccccatcaagatcacacaact

SEQ ID NO: 185791 - DNA, 25 bp, Homo sapien
gaaatctcaagttactggcttttat

SEQ ID NO: 185792 - DNA, 25 bp, Homo sapien
tatacttaccaaacatcagttcttc

SEQ ID NO: 185793 - DNA, 25 bp, Homo sapien
aggacgcaaatcttcaggacagtaa

SEQ ID NO: 185794 - DNA, 25 bp, Homo sapien
gttagtattaatgcgttggcccacg

SEQ ID NO: 185795 - DNA, 25 bp, Homo sapien
aatgcgttggcccacgtagcaaaaa

SEQ ID NO: 185796 - DNA, 25 bp, Homo sapien
gttggcccacgtagcaaaaagatat

SEQ ID NO: 185797 - DNA, 25 bp, Homo sapien
taccgttttcatgaaagttctcagt

SEQ ID NO: 185798 - DNA, 25 bp, Homo sapien
gttctcagtattgtaacagcaactt

SEQ ID NO: 185799 - DNA, 25 bp, Homo sapien
gtaacagcaacttgtcaaacctaag

SEQ ID NO: 185800 - DNA, 25 bp, Homo sapien
gcaacttgtcaaacctaagcatatt

SEQ ID NO: 185801 - DNA, 25 bp, Homo sapien
gcatatttgaatatgatctcccata

SEQ ID NO: 185802 - DNA, 25 bp, Homo sapien
tgaatatgatctcccataatttgaa

SEQ ID NO: 185803 - DNA, 25 bp, Homo sapien
gaaatcgtattgtgtggctctgtat

SEQ ID NO: 185804 - DNA, 25 bp, Homo sapien
gtgtggctctgtatattctgttaaa

SEQ ID NO: 185805 - DNA, 25 bp, Homo sapien
gtgcaccaaggtgggaacctcctaa

SEQ ID NO: 185806 - DNA, 25 bp, Homo sapien
gaacctcctaatgggtgtgggaact

SEQ ID NO: 185807 - DNA, 25 bp, Homo sapien
gtgtgggacaccctaatagtcaaag

SEQ ID NO: 185808 - DNA, 25 bp, Homo sapien
tagtcaaagcccaaggatttcgagc

SEQ ID NO: 185809 - DNA, 25 bp, Homo sapien
ctgaggtggtgctacagctcgtgac

SEQ ID NO: 185810 - DNA, 25 bp, Homo sapien
agctcgtgactgtagatgaaatcgt

SEQ ID NO: 185811 - DNA, 25 bp, Homo sapien
tagatgaaatcgtagtggccaagaa

SEQ ID NO: 185812 - DNA, 25 bp, Homo sapien
ggccaagaaaagtcccacacatcag

SEQ ID NO: 185813 - DNA, 25 bp, Homo sapien
aagtcccacacatcaggagatctgg

SEQ ID NO: 185814 - DNA, 25 bp, Homo sapien
ggagatctggaatcctgactctaag

SEQ ID NO: 185815 - DNA, 25 bp, Homo sapien
ggattgaataactagtgataccctc

SEQ ID NO: 185816 - DNA, 25 bp, Homo sapien
ggatcgctcttcctcaaaccacgaa

SEQ ID NO: 185817 - DNA, 25 bp, Homo sapien
gatcgctcttcctcaaaccacgaat

SEQ ID NO: 185818 - DNA, 25 bp, Homo sapien
cttcctcaaaccacgaatctgaaca

SEQ ID NO: 185819 - DNA, 25 bp, Homo sapien
ttcctcaaaccacgaatctgaacat

SEQ ID NO: 185820 - DNA, 25 bp, Homo sapien
tcctcaaaccacgaatctgaacatg

SEQ ID NO: 185821 - DNA, 25 bp, Homo sapien
cctcaaaccacgaatctgaacatgc

SEQ ID NO: 185822 - DNA, 25 bp, Homo sapien
ctcaaaccacgaatctgaacatgcc

SEQ ID NO: 185823 - DNA, 25 bp, Homo sapien
tcaaaccacgaatctgaacatgcct

SEQ ID NO: 185824 - DNA, 25 bp, Homo sapien
caaaccacgaatctgaacatgcctc

SEQ ID NO: 185825 - DNA, 25 bp, Homo sapien
aaaccacgaatctgaacatgcctct

SEQ ID NO: 185826 - DNA, 25 bp, Homo sapien
acgaatctgaacatgcctctctcct

SEQ ID NO: 185827 - DNA, 25 bp, Homo sapien
atctgaccgtggtgcttttggccat

SEQ ID NO: 185828 - DNA, 25 bp, Homo sapien
tttggccattggcatgttcttcacc

SEQ ID NO: 185829 - DNA, 25 bp, Homo sapien
gcctggttcttcgtttacgaggtca

SEQ ID NO: 185830 - DNA, 25 bp, Homo sapien
gtttacgaggtcacctctaccaagt

SEQ ID NO: 185831 - DNA, 25 bp, Homo sapien
acctctaccaagtacactcgtgata

SEQ ID NO: 185832 - DNA, 25 bp, Homo sapien
aagagctcctcatctccttagtggc

SEQ ID NO: 185833 - DNA, 25 bp, Homo sapien
tagtggcctcactcttcatgggctt

SEQ ID NO: 185834 - DNA, 25 bp, Homo sapien
atgggctttggagtcctcttcctgc

SEQ ID NO: 185835 - DNA, 25 bp, Homo sapien
ctgctctgggttggcatctacgtgt

SEQ ID NO: 185836 - DNA, 25 bp, Homo sapien
gcatctacgtgtgagcacccaaggg

SEQ ID NO: 185837 - DNA, 25 bp, Homo sapien
ttactgttgctggaagtgtcccacc

SEQ ID NO: 185838 - DNA, 25 bp, Homo sapien
ataccacttgatgggtgaaggcttt

SEQ ID NO: 185839 - DNA, 25 bp, Homo sapien
tgggtgaaggctttggcaatagaaa

SEQ ID NO: 185840 - DNA, 25 bp, Homo sapien
gttttatgttattcctctgtgttca

SEQ ID NO: 185841 - DNA, 25 bp, Homo sapien
atgttattcctctgtgttcacttcg

SEQ ID NO: 185842 - DNA, 25 bp, Homo sapien
tgttcacttcgccttgctcttgaaa

SEQ ID NO: 185843 - DNA, 25 bp, Homo sapien
ttcgccttgctcttgaaagtgcagt

SEQ ID NO: 185844 - DNA, 25 bp, Homo sapien
atttttctacatcatgtcgagaatg

SEQ ID NO: 185845 - DNA, 25 bp, Homo sapien
gtatatcctatacacacatctcctt

SEQ ID NO: 185846 - DNA, 25 bp, Homo sapien
cacatctccttcatcatcatatatg

SEQ ID NO: 185847 - DNA, 25 bp, Homo sapien
gagaagtctacattgcttacatttt

SEQ ID NO: 185848 - DNA, 25 bp, Homo sapien
gaaggcttaatgatttattgaacca

SEQ ID NO: 185849 - DNA, 25 bp, Homo sapien
gttactgcggcatcggtggctccca

SEQ ID NO: 185850 - DNA, 25 bp, Homo sapien
actggccggtggaccagactgactg

SEQ ID NO: 185851 - DNA, 25 bp, Homo sapien
acgactgctgctacgggcgtctgga

SEQ ID NO: 185852 - DNA, 25 bp, Homo sapien
aaagtatcttttctctgtcagcgaa

SEQ ID NO: 185853 - DNA, 25 bp, Homo sapien
ttttctctgtcagcgaacgtggcat

SEQ ID NO: 185854 - DNA, 25 bp, Homo sapien
gtcagcgaacgtggcattttctgcg

SEQ ID NO: 185855 - DNA, 25 bp, Homo sapien
gtggcattttctgcgccggcaggac

SEQ ID NO: 185856 - DNA, 25 bp, Homo sapien
agcggctgacctgcgagtgtgacaa

SEQ ID NO: 185857 - DNA, 25 bp, Homo sapien
ctgggcacctacaaccgcaaatatg

SEQ ID NO: 185858 - DNA, 25 bp, Homo sapien
gcaaatatgcccattatcccaacaa

SEQ ID NO: 185859 - DNA, 25 bp, Homo sapien
attatcccaacaagctgtgcaccgg

SEQ ID NO: 185860 - DNA, 25 bp, Homo sapien
ctggcagggcgtgaggaactctcct

SEQ ID NO: 185861 - DNA, 25 bp, Homo sapien
gtgaggaactctcctgtggcctgct

SEQ ID NO: 185862 - DNA, 25 bp, Homo sapien
atcacccttccgacaggagcactgc

SEQ ID NO: 185863 - DNA, 25 bp, Homo sapien
ggagcactgcatgtcagagcacttt

SEQ ID NO: 185864 - DNA, 25 bp, Homo sapien
gcactgcatgtcagagcactttaaa

SEQ ID NO: 185865 - DNA, 25 bp, Homo sapien
agcactttaaaaacaggccagcctg

SEQ ID NO: 185866 - DNA, 25 bp, Homo sapien
taaaaacaggccagcctgcttgggc

SEQ ID NO: 185867 - DNA, 25 bp, Homo sapien
gggagagagcccttcccagggcacc

SEQ ID NO: 185868 - DNA, 25 bp, Homo sapien
gcaggtgcagggaagtgcagagctt

SEQ ID NO: 185869 - DNA, 25 bp, Homo sapien
gggctaggtcttgccaactccatct

SEQ ID NO: 185870 - DNA, 25 bp, Homo sapien
ggtcttgccaactccatcttcaata

SEQ ID NO: 185871 - DNA, 25 bp, Homo sapien
agtcgaggggcatcttccacccgga

SEQ ID NO: 185872 - DNA, 25 bp, Homo sapien
tggtcctacagggtcggctgcttac

SEQ ID NO: 185873 - DNA, 25 bp, Homo sapien
gtcctacagggtcggctgcttacgt

SEQ ID NO: 185874 - DNA, 25 bp, Homo sapien
tacagggtcggctgcttacgtggct

SEQ ID NO: 185875 - DNA, 25 bp, Homo sapien
tcggctgcttacgtggctgttccca

SEQ ID NO: 185876 - DNA, 25 bp, Homo sapien
gaggccagcgggagccatgctctac

SEQ ID NO: 185877 - DNA, 25 bp, Homo sapien
gggagccatgctctaccactcctgg

SEQ ID NO: 185878 - DNA, 25 bp, Homo sapien
gagccatgctctaccactcctgggt

SEQ ID NO: 185879 - DNA, 25 bp, Homo sapien
ctctaccactcctgggtctctgaaa

SEQ ID NO: 185880 - DNA, 25 bp, Homo sapien
tctgaaatcactgaaatcggggctt

SEQ ID NO: 185881 - DNA, 25 bp, Homo sapien
tgaaatcggggctttctgagctgcc

SEQ ID NO: 185882 - DNA, 25 bp, Homo sapien
acttgttgctgtggcggtagctcac

SEQ ID NO: 185883 - DNA, 25 bp, Homo sapien
gtagctcaccaatccaatgcgtgca

SEQ ID NO: 185884 - DNA, 25 bp, Homo sapien
cacccgctcctttattaggctatag

SEQ ID NO: 185885 - DNA, 25 bp, Homo sapien
tattaggctatagggcccagtggct

SEQ ID NO: 185886 - DNA, 25 bp, Homo sapien
ccagtggctgcgacagggacctgat

SEQ ID NO: 185887 - DNA, 25 bp, Homo sapien
gggacctgatacaacagtgcgttaa

SEQ ID NO: 185888 - DNA, 25 bp, Homo sapien
agcttattgagctatcatgtcgtaa

SEQ ID NO: 185889 - DNA, 25 bp, Homo sapien
tgtcgtaagccggtggagaagtcca

SEQ ID NO: 185890 - DNA, 25 bp, Homo sapien
acggttcacaggtctcggtcttcgg

SEQ ID NO: 185891 - DNA, 25 bp, Homo sapien
aggtctcggtcttcggagccttcag

SEQ ID NO: 185892 - DNA, 25 bp, Homo sapien
gaacagtccacacggcggcgccaga

SEQ ID NO: 185893 - DNA, 25 bp, Homo sapien
tgtgtctgggctgtgtgaacccctt

SEQ ID NO: 185894 - DNA, 25 bp, Homo sapien
tgaaccccttcaccatgcaggagga

SEQ ID NO: 185895 - DNA, 25 bp, Homo sapien
agcgtgccggtgttcagccaggttc

SEQ ID NO: 185896 - DNA, 25 bp, Homo sapien
tgttcagccaggttcctgtgcgccg

SEQ ID NO: 185897 - DNA, 25 bp, Homo sapien
gccagcgcgcagtcatggagaccat

SEQ ID NO: 185898 - DNA, 25 bp, Homo sapien
tcatggagaccatcgctgtgggctg

SEQ ID NO: 185899 - DNA, 25 bp, Homo sapien
atcgctgtgggctgcacctgcatct

SEQ ID NO: 185900 - DNA, 25 bp, Homo sapien
acctgcatcttctgaatcacctggc

SEQ ID NO: 185901 - DNA, 25 bp, Homo sapien
atcttctgaatcacctggcccagaa

SEQ ID NO: 185902 - DNA, 25 bp, Homo sapien
agaagccaggccagcagcccgagac

SEQ ID NO: 185903 - DNA, 25 bp, Homo sapien
atcctccttgcacctttgtgccaag

SEQ ID NO: 185904 - DNA, 25 bp, Homo sapien
gaaacatttcttgcaggtttgcttc

SEQ ID NO: 185905 - DNA, 25 bp, Homo sapien
tttcttgcaggtttgcttcaagctg

SEQ ID NO: 185906 - DNA, 25 bp, Homo sapien
ccatttgttttcaacctcatgtaat

SEQ ID NO: 185907 - DNA, 25 bp, Homo sapien
tcaacctcatgtaatttgtgcagat

SEQ ID NO: 185908 - DNA, 25 bp, Homo sapien
ttgttggtaaaatacatcttggcac

SEQ ID NO: 185909 - DNA, 25 bp, Homo sapien
atcttggcacaatgagtgtctctgc

SEQ ID NO: 185910 - DNA, 25 bp, Homo sapien
acaatgagtgtctctgctggtgctt

SEQ ID NO: 185911 - DNA, 25 bp, Homo sapien
gctggtgcttctcccaagactatct

SEQ ID NO: 185912 - DNA, 25 bp, Homo sapien
actatcttgaaggtgggctgtttgc

SEQ ID NO: 185913 - DNA, 25 bp, Homo sapien
gggctgtttgcctttcgtgaacaca

SEQ ID NO: 185914 - DNA, 25 bp, Homo sapien
gcctttcgtgaacacattcttggta

SEQ ID NO: 185915 - DNA, 25 bp, Homo sapien
atggtcacccctgcacatgatctga

SEQ ID NO: 185916 - DNA, 25 bp, Homo sapien
ctgcacatgatctgaggccagctcc

SEQ ID NO: 185917 - DNA, 25 bp, Homo sapien
ttttaagccctctcttcctcgcttt

SEQ ID NO: 185918 - DNA, 25 bp, Homo sapien
ttcctacctagctccttgttggtga

SEQ ID NO: 185919 - DNA, 25 bp, Homo sapien
tccttgttggtgagcttcttgtgcc

SEQ ID NO: 185920 - DNA, 25 bp, Homo sapien
agcttcttgtgccttaatcctgtga

SEQ ID NO: 185921 - DNA, 25 bp, Homo sapien
ttgtgccttaatcctgtgacccagc

SEQ ID NO: 185922 - DNA, 25 bp, Homo sapien
tttccaccttcctgtccgaagtaca

SEQ ID NO: 185923 - DNA, 25 bp, Homo sapien
cgaagtacacggacactagctgccc

SEQ ID NO: 185924 - DNA, 25 bp, Homo sapien
actagctgccccaggaagttgtgtg

SEQ ID NO: 185925 - DNA, 25 bp, Homo sapien
gctggaaagtgtatttgtgcataaa

SEQ ID NO: 185926 - DNA, 25 bp, Homo sapien
gtgttcccagcaccaaagttgtggg

SEQ ID NO: 185927 - DNA, 25 bp, Homo sapien
tgtgggacatgttgctgtagactgc

SEQ ID NO: 185928 - DNA, 25 bp, Homo sapien
actgctgcgcagtcctgggtgcatt

SEQ ID NO: 185929 - DNA, 25 bp, Homo sapien
agtcctgggtgcattcagtctctct

SEQ ID NO: 185930 - DNA, 25 bp, Homo sapien
tggtccccactttaaaggctgtgca

SEQ ID NO: 185931 - DNA, 25 bp, Homo sapien
tttaaaggctgtgcagctccttaaa

SEQ ID NO: 185932 - DNA, 25 bp, Homo sapien
ggctgtgcagctccttaaataataa

SEQ ID NO: 185933 - DNA, 25 bp, Homo sapien
ttttagtcgggttatcaaatttgat

SEQ ID NO: 185934 - DNA, 25 bp, Homo sapien
gtactttgtattctggaagcgtgaa

SEQ ID NO: 185935 - DNA, 25 bp, Homo sapien
gcgtgaattgcttttgaagtctgtc

SEQ ID NO: 185936 - DNA, 25 bp, Homo sapien
gaagtctgtcagtattactggtatt

SEQ ID NO: 185937 - DNA, 25 bp, Homo sapien
tttgttgacttctttgggaacatta

SEQ ID NO: 185938 - DNA, 25 bp, Homo sapien
gacttctttgggaacattatctcta

SEQ ID NO: 185939 - DNA, 25 bp, Homo sapien
gggaacattatctctagagtctgct

SEQ ID NO: 185940 - DNA, 25 bp, Homo sapien
ctagagtctgcttttttgtgggcca

SEQ ID NO: 185941 - DNA, 25 bp, Homo sapien
ctgcttttttgtgggccagtttgta

SEQ ID NO: 185942 - DNA, 25 bp, Homo sapien
ttgtgggccagtttgtagagatgta

SEQ ID NO: 185943 - DNA, 25 bp, Homo sapien
gagatgtaacatgaagccattccag

SEQ ID NO: 185944 - DNA, 25 bp, Homo sapien
gtaacatgaagccattccagaaatg

SEQ ID NO: 185945 - DNA, 25 bp, Homo sapien
gaagccattccagaaatggtaactt

SEQ ID NO: 185946 - DNA, 25 bp, Homo sapien
agactacatgtctaggaaactgttg

SEQ ID NO: 185947 - DNA, 25 bp, Homo sapien
gtctaggaaactgttgagattcaaa

SEQ ID NO: 185948 - DNA, 25 bp, Homo sapien
agtctctgccagttggttttatttg

SEQ ID NO: 185949 - DNA, 25 bp, Homo sapien
ctgccagttggttttatttggaggt

SEQ ID NO: 185950 - DNA, 25 bp, Homo sapien
tgtgatttttctgatacgtccattc

SEQ ID NO: 185951 - DNA, 25 bp, Homo sapien
gatttttctgatacgtccattctca

SEQ ID NO: 185952 - DNA, 25 bp, Homo sapien
tttctgatacgtccattctcaaatg

SEQ ID NO: 185953 - DNA, 25 bp, Homo sapien
gatacgtccattctcaaatgccagt

SEQ ID NO: 185954 - DNA, 25 bp, Homo sapien
tacgtccattctcaaatgccagtgt

SEQ ID NO: 185955 - DNA, 25 bp, Homo sapien
gtccattctcaaatgccagtgtgtt

SEQ ID NO: 185956 - DNA, 25 bp, Homo sapien
attctcaaatgccagtgtgttcaca

SEQ ID NO: 185957 - DNA, 25 bp, Homo sapien
aatgccagtgtgttcacatcttcgc

SEQ ID NO: 185958 - DNA, 25 bp, Homo sapien
agtgtgttcacatcttcgctctggc

SEQ ID NO: 185959 - DNA, 25 bp, Homo sapien
gaccttgcaagaagtactaactatg

SEQ ID NO: 185960 - DNA, 25 bp, Homo sapien
aagtcaagcttgtatgagaggtcat

SEQ ID NO: 185961 - DNA, 25 bp, Homo sapien
aaggcgttagagctgttttaattga

SEQ ID NO: 185962 - DNA, 25 bp, Homo sapien
gataaagaccagagtccaaaatgga

SEQ ID NO: 185963 - DNA, 25 bp, Homo sapien
ggaaaccagctgatctaaaagaagt

SEQ ID NO: 185964 - DNA, 25 bp, Homo sapien
gaaattttgaggtgacaggctttta

SEQ ID NO: 185965 - DNA, 25 bp, Homo sapien
gaggtgacaggcttttaaggtatat

SEQ ID NO: 185966 - DNA, 25 bp, Homo sapien
cttttaaggtatattttgtagcatg

SEQ ID NO: 185967 - DNA, 25 bp, Homo sapien
agcatgggttggcaatctacagcat

SEQ ID NO: 185968 - DNA, 25 bp, Homo sapien
gcaatctacagcatgtgggccaaat

SEQ ID NO: 185969 - DNA, 25 bp, Homo sapien
tctacagcatgtgggccaaatccag

SEQ ID NO: 185970 - DNA, 25 bp, Homo sapien
tgcttatatgcagcgttagccgaat

SEQ ID NO: 185971 - DNA, 25 bp, Homo sapien
gcagcgttagccgaattagatttac

SEQ ID NO: 185972 - DNA, 25 bp, Homo sapien
caagacaatctaagctttccggata

SEQ ID NO: 185973 - DNA, 25 bp, Homo sapien
ctaagctttccggataattttatat

SEQ ID NO: 185974 - DNA, 25 bp, Homo sapien
acaggatggatacatagttggcaac

SEQ ID NO: 185975 - DNA, 25 bp, Homo sapien
agttggcaacagtctaccttattta

SEQ ID NO: 185976 - DNA, 25 bp, Homo sapien
ccttatttaaagcttctactgggat

SEQ ID NO: 185977 - DNA, 25 bp, Homo sapien
gcttctactgggataaacctcaatt

SEQ ID NO: 185978 - DNA, 25 bp, Homo sapien
gataaacctcaattcctttattcag

SEQ ID NO: 185979 - DNA, 25 bp, Homo sapien
gggtttaaagctacagaggcactga

SEQ ID NO: 185980 - DNA, 25 bp, Homo sapien
agaggcactgacctttttctagtta

SEQ ID NO: 185981 - DNA, 25 bp, Homo sapien
gatgatttcccttctgtaactccct

SEQ ID NO: 185982 - DNA, 25 bp, Homo sapien
ttctgtaactccctagagccacagg

SEQ ID NO: 185983 - DNA, 25 bp, Homo sapien
tagagccacaggttctcattccttt

SEQ ID NO: 185984 - DNA, 25 bp, Homo sapien
ccttttcccattatacttctcacaa

SEQ ID NO: 185985 - DNA, 25 bp, Homo sapien
acttctcacaattcagtttctatga

SEQ ID NO: 185986 - DNA, 25 bp, Homo sapien
ttctatgagtttgatcacctgattt

SEQ ID NO: 185987 - DNA, 25 bp, Homo sapien
aaatgtggttgtatgagccaatcat

SEQ ID NO: 185988 - DNA, 25 bp, Homo sapien
ggaaatatctgttctgaaaccccac

SEQ ID NO: 185989 - DNA, 25 bp, Homo sapien
atatctgttctgaaaccccacttaa

SEQ ID NO: 185990 - DNA, 25 bp, Homo sapien
gttctgaaaccccacttaagcattg

SEQ ID NO: 185991 - DNA, 25 bp, Homo sapien
tgaaaccccacttaagcattgtttt

SEQ ID NO: 185992 - DNA, 25 bp, Homo sapien
agtctctgccagttggttttatttg

SEQ ID NO: 185993 - DNA, 25 bp, Homo sapien
ctgccagttggttttatttggaggt

SEQ ID NO: 185994 - DNA, 25 bp, Homo sapien
caaagactatgtcctagtggaggga

SEQ ID NO: 185995 - DNA, 25 bp, Homo sapien
tgtgatttttctgatacgtccattc

SEQ ID NO: 185996 - DNA, 25 bp, Homo sapien
gatttttctgatacgtccattctca

SEQ ID NO: 185997 - DNA, 25 bp, Homo sapien
gatacgtccattctcaaatgccagt

SEQ ID NO: 185998 - DNA, 25 bp, Homo sapien
gtccattctcaaatgccagtgtgtt

SEQ ID NO: 185999 - DNA, 25 bp, Homo sapien
attctcaaatgccagtgtgttcaca

SEQ ID NO: 186000 - DNA, 25 bp, Homo sapien
aatgccagtgtgttcacatcttcgc

SEQ ID NO: 186001 - DNA, 25 bp, Homo sapien
agtgtgttcacatcttcgctctggc

SEQ ID NO: 186002 - DNA, 25 bp, Homo sapien
gcccattctgtatttaaagcttttt

SEQ ID NO: 186003 - DNA, 25 bp, Homo sapien
agcctcttagattcctggcagtaga

SEQ ID NO: 186004 - DNA, 25 bp, Homo sapien
gtaaattgacctctgaagtccctga

SEQ ID NO: 186005 - DNA, 25 bp, Homo sapien
agtccctgaccattagcatggtcta

SEQ ID NO: 186006 - DNA, 25 bp, Homo sapien
gcatggtctaggatcctttctagaa

SEQ ID NO: 186007 - DNA, 25 bp, Homo sapien
gatggcttgggccttttctctcaac

SEQ ID NO: 186008 - DNA, 25 bp, Homo sapien
tgagcctaccccttactttgccaaa

SEQ ID NO: 186009 - DNA, 25 bp, Homo sapien
tttgccaaagacttgaggaccctgt

SEQ ID NO: 186010 - DNA, 25 bp, Homo sapien
gaggaccctgtatgtctggagttca

SEQ ID NO: 186011 - DNA, 25 bp, Homo sapien
tgtatgtctggagttcagtcccctc

SEQ ID NO: 186012 - DNA, 25 bp, Homo sapien
gtggatgaaacatttctctacttca

SEQ ID NO: 186013 - DNA, 25 bp, Homo sapien
atttctctacttcaagaccacctct

SEQ ID NO: 186014 - DNA, 25 bp, Homo sapien
ttttatatgtgcagtatgacaaaga

SEQ ID NO: 186015 - DNA, 25 bp, Homo sapien
gtgcagtatgacaaagaggagtttc

SEQ ID NO: 186016 - DNA, 25 bp, Homo sapien
gaatctacaaggcaaactcccatat

SEQ ID NO: 186017 - DNA, 25 bp, Homo sapien
atctacaaggcaaactcccatatat

SEQ ID NO: 186018 - DNA, 25 bp, Homo sapien
ctacaaggcaaactcccatatattt

SEQ ID NO: 186019 - DNA, 25 bp, Homo sapien
acaaggcaaactcccatatatttgc

SEQ ID NO: 186020 - DNA, 25 bp, Homo sapien
tgcccctacagactcaaagctcttt

SEQ ID NO: 186021 - DNA, 25 bp, Homo sapien
ccctacagactcaaagctctttttc

SEQ ID NO: 186022 - DNA, 25 bp, Homo sapien
tacagactcaaagctctttttcttt

SEQ ID NO: 186023 - DNA, 25 bp, Homo sapien
acagactcaaagctctttttctttg

SEQ ID NO: 186024 - DNA, 25 bp, Homo sapien
atatattacatatacccgctaataa

SEQ ID NO: 186025 - DNA, 25 bp, Homo sapien
ccattcccctatagtaacctcaggg

SEQ ID NO: 186026 - DNA, 25 bp, Homo sapien
ggccccgtgtcttgcactctcatgg

SEQ ID NO: 186027 - DNA, 25 bp, Homo sapien
ctccaggccaagaactgctcttggg

SEQ ID NO: 186028 - DNA, 25 bp, Homo sapien
agaactgctcttgggaagtcgcata

SEQ ID NO: 186029 - DNA, 25 bp, Homo sapien
tgctcttgggaagtcgcatatctcc

SEQ ID NO: 186030 - DNA, 25 bp, Homo sapien
gcatatctcccctctgaggctggat

SEQ ID NO: 186031 - DNA, 25 bp, Homo sapien
ggatccctcatcttctgaccctggg

SEQ ID NO: 186032 - DNA, 25 bp, Homo sapien
ctgaccctgggttctgggctgtgaa

SEQ ID NO: 186033 - DNA, 25 bp, Homo sapien
acggtgtccccgcacgtttgtattg

SEQ ID NO: 186034 - DNA, 25 bp, Homo sapien
tccccgcacgtttgtattgtgtata

SEQ ID NO: 186035 - DNA, 25 bp, Homo sapien
ctacgtgtagcagctctggcccgtg

SEQ ID NO: 186036 - DNA, 25 bp, Homo sapien
tgaaaaagaaagacattatgccctt

SEQ ID NO: 186037 - DNA, 25 bp, Homo sapien
acattatgccctttctccactatag

SEQ ID NO: 186038 - DNA, 25 bp, Homo sapien
tatgccctttctccactatagccaa

SEQ ID NO: 186039 - DNA, 25 bp, Homo sapien
tagccaacactcagtcaagcagaaa

SEQ ID NO: 186040 - DNA, 25 bp, Homo sapien
gccaacactcagtcaagcagaaaat

SEQ ID NO: 186041 - DNA, 25 bp, Homo sapien
agtcaagcagaaaatacaaatcccc

SEQ ID NO: 186042 - DNA, 25 bp, Homo sapien
cccaaaactttgagacatagcttat

SEQ ID NO: 186043 - DNA, 25 bp, Homo sapien
aactttgagacatagcttatataat

SEQ ID NO: 186044 - DNA, 25 bp, Homo sapien
gaataaatctcctaagcataatatg

SEQ ID NO: 186045 - DNA, 25 bp, Homo sapien
aaatctcctaagcataatatgtata

SEQ ID NO: 186046 - DNA, 25 bp, Homo sapien
atgtttttacacttttcttgataag

SEQ ID NO: 186047 - DNA, 25 bp, Homo sapien
aaatatacacaccagtagaagagag

SEQ ID NO: 186048 - DNA, 25 bp, Homo sapien
atagatttcatgatgtatcgttcaa

SEQ ID NO: 186049 - DNA, 25 bp, Homo sapien
agatttcatgatgtatcgttcaata

SEQ ID NO: 186050 - DNA, 25 bp, Homo sapien
gtgactttaaaatgagacgaaaatc

SEQ ID NO: 186051 - DNA, 25 bp, Homo sapien
gacgaaaatcattaaacgtatcttt

SEQ ID NO: 186052 - DNA, 25 bp, Homo sapien
tcattaaacgtatctttgttttatc

SEQ ID NO: 186053 - DNA, 25 bp, Homo sapien
aataatatatcatgtacctttattg

SEQ ID NO: 186054 - DNA, 25 bp, Homo sapien
ctttattgaacaaggcatccgttat

SEQ ID NO: 186055 - DNA, 25 bp, Homo sapien
ttgaacaaggcatccgttatatcta

SEQ ID NO: 186056 - DNA, 25 bp, Homo sapien
acaaggcatccgttatatctaattt

SEQ ID NO: 186057 - DNA, 25 bp, Homo sapien
ggcatccgttatatctaattttgta

SEQ ID NO: 186058 - DNA, 25 bp, Homo sapien
ctgagtgaaagtgacatcctggcca

SEQ ID NO: 186059 - DNA, 25 bp, Homo sapien
tgaaagtgacatcctggccacctca

SEQ ID NO: 186060 - DNA, 25 bp, Homo sapien
acctcacgcatttgatcacagactg

SEQ ID NO: 186061 - DNA, 25 bp, Homo sapien
acgcatttgatcacagactgtagag

SEQ ID NO: 186062 - DNA, 25 bp, Homo sapien
agaaacagtggcatagactccttca

SEQ ID NO: 186063 - DNA, 25 bp, Homo sapien
cagtggcatagactccttcacacat

SEQ ID NO: 186064 - DNA, 25 bp, Homo sapien
tgtggcaccagcaactacttcttta

SEQ ID NO: 186065 - DNA, 25 bp, Homo sapien
ggcaccagcaactacttctttatat

SEQ ID NO: 186066 - DNA, 25 bp, Homo sapien
ttcttcatatcccaaattagagttt

SEQ ID NO: 186067 - DNA, 25 bp, Homo sapien
ttagagtttacagggacagtcttca

SEQ ID NO: 186068 - DNA, 25 bp, Homo sapien
gggacagtcttcatttacttgtaaa

SEQ ID NO: 186069 - DNA, 25 bp, Homo sapien
gagaggagctcttccgtgaagtcct

SEQ ID NO: 186070 - DNA, 25 bp, Homo sapien
aggagctcttccgtgaagtcctgga

SEQ ID NO: 186071 - DNA, 25 bp, Homo sapien
tccgtgaagtcctggaagacattca

SEQ ID NO: 186072 - DNA, 25 bp, Homo sapien
gaagacattcagaactcgctgctga

SEQ ID NO: 186073 - DNA, 25 bp, Homo sapien
gctgctgaaccgctcccaggaatca

SEQ ID NO: 186074 - DNA, 25 bp, Homo sapien
acccggacgcggatgcggccacaga

SEQ ID NO: 186075 - DNA, 25 bp, Homo sapien
atgcggccacagaacggccaggcct

SEQ ID NO: 186076 - DNA, 25 bp, Homo sapien
aggcctgcagcgtcccagcaggaca

SEQ ID NO: 186077 - DNA, 25 bp, Homo sapien
ccagcaggacagcatgtgagcgttt

SEQ ID NO: 186078 - DNA, 25 bp, Homo sapien
cagcatgtgagcgtttccctatggg

SEQ ID NO: 186079 - DNA, 25 bp, Homo sapien
cccagttgggcgtcccggagctcag

SEQ ID NO: 186080 - DNA, 25 bp, Homo sapien
tgcccgggacggacgactacgtctt

SEQ ID NO: 186081 - DNA, 25 bp, Homo sapien
ggacggacgactacgtcttttactg

SEQ ID NO: 186082 - DNA, 25 bp, Homo sapien
gacggacgactacgtcttttactgc

SEQ ID NO: 186083 - DNA, 25 bp, Homo sapien
acggacgactacgtcttttactgca

SEQ ID NO: 186084 - DNA, 25 bp, Homo sapien
cggacgactacgtcttttactgcaa

SEQ ID NO: 186085 - DNA, 25 bp, Homo sapien
ggtaggaatcctaataccaacctgg

SEQ ID NO: 186086 - DNA, 25 bp, Homo sapien
gtaggaatcctaataccaacctgga

SEQ ID NO: 186087 - DNA, 25 bp, Homo sapien
taggaatcctaataccaacctggag

SEQ ID NO: 186088 - DNA, 25 bp, Homo sapien
aggaatcctaataccaacctggagg

SEQ ID NO: 186089 - DNA, 25 bp, Homo sapien
ggaatcctaataccaacctggaggc

SEQ ID NO: 186090 - DNA, 25 bp, Homo sapien
gaatcctaataccaacctggaggcc

SEQ ID NO: 186091 - DNA, 25 bp, Homo sapien
aagtgtgcagctgtaactgctcacg

SEQ ID NO: 186092 - DNA, 25 bp, Homo sapien
tgtaactgctcacgccaaaatggct

SEQ ID NO: 186093 - DNA, 25 bp, Homo sapien
tgcttgtaaaataaccttccaggaa

SEQ ID NO: 186094 - DNA, 25 bp, Homo sapien
ggcacattgcccacctttggaaagg

SEQ ID NO: 186095 - DNA, 25 bp, Homo sapien
gaatatgccttctccttggttgttc

SEQ ID NO: 186096 - DNA, 25 bp, Homo sapien
gatgggtagatgtcaaactgcctta

SEQ ID NO: 186097 - DNA, 25 bp, Homo sapien
aactgccttacgcagtcatactgat

SEQ ID NO: 186098 - DNA, 25 bp, Homo sapien
gcagtcatactgatctttagccatc

SEQ ID NO: 186099 - DNA, 25 bp, Homo sapien
agattgatcttcttcacaccaagct

SEQ ID NO: 186100 - DNA, 25 bp, Homo sapien
acaccaagctctgtttacattccga

SEQ ID NO: 186101 - DNA, 25 bp, Homo sapien
gtttacattccgagaggtgtcatga

SEQ ID NO: 186102 - DNA, 25 bp, Homo sapien
atgggtggcgaaattcacgagtcta

SEQ ID NO: 186103 - DNA, 25 bp, Homo sapien
ggcgaaattcacgagtctacaaata

SEQ ID NO: 186104 - DNA, 25 bp, Homo sapien
tgaagcagctggatgtagccgacca

SEQ ID NO: 186105 - DNA, 25 bp, Homo sapien
tggatgtagccgaccagtggatctg

SEQ ID NO: 186106 - DNA, 25 bp, Homo sapien
cagggtgatgtgcagatcctccacc

SEQ ID NO: 186107 - DNA, 25 bp, Homo sapien
gatcctccaccctgcgttgggtcaa

SEQ ID NO: 186108 - DNA, 25 bp, Homo sapien
tgcgttgggtcaagcgccgctgcac

SEQ ID NO: 186109 - DNA, 25 bp, Homo sapien
gctccgcatcacttgaaatgcctat

SEQ ID NO: 186110 - DNA, 25 bp, Homo sapien
gcctatgtggcatccatacaaggtt

SEQ ID NO: 186111 - DNA, 25 bp, Homo sapien
gttgatgtgacctggacgagagcca

SEQ ID NO: 186112 - DNA, 25 bp, Homo sapien
tggagatcgcgccatcagctgaagg

SEQ ID NO: 186113 - DNA, 25 bp, Homo sapien
gccacagctgtctctgggaaagcaa

SEQ ID NO: 186114 - DNA, 25 bp, Homo sapien
ttcctggaggaagcggcattgttat

SEQ ID NO: 186115 - DNA, 25 bp, Homo sapien
aagcggcattgttatgagccttgaa

SEQ ID NO: 186116 - DNA, 25 bp, Homo sapien
gagacagactctgctacattcaacc

SEQ ID NO: 186117 - DNA, 25 bp, Homo sapien
tgctacattcaacctcgtgacttca

SEQ ID NO: 186118 - DNA, 25 bp, Homo sapien
aacctcgtgacttcatgatcctggg

SEQ ID NO: 186119 - DNA, 25 bp, Homo sapien
atgatcctgggcctgagaacacagg

SEQ ID NO: 186120 - DNA, 25 bp, Homo sapien
acaggaatgattcatagcccacccc

SEQ ID NO: 186121 - DNA, 25 bp, Homo sapien
tccatgcatacaccagagctctgtg

SEQ ID NO: 186122 - DNA, 25 bp, Homo sapien
tacaccagagctctgtggaccaagg

SEQ ID NO: 186123 - DNA, 25 bp, Homo sapien
aaatgtatttgagcacacaccagca

SEQ ID NO: 186124 - DNA, 25 bp, Homo sapien
aacgaaacggaatattccaatgctc

SEQ ID NO: 186125 - DNA, 25 bp, Homo sapien
gagatggcgttgtcctggttgcccc

SEQ ID NO: 186126 - DNA, 25 bp, Homo sapien
tggttgcccctccactgagagttgg

SEQ ID NO: 186127 - DNA, 25 bp, Homo sapien
cctccactgagagttggctgaaaca

SEQ ID NO: 186128 - DNA, 25 bp, Homo sapien
ttgtcctgtatggaaaacgggagac

SEQ ID NO: 186129 - DNA, 25 bp, Homo sapien
aacgggagactttgtacagtggcct

SEQ ID NO: 186130 - DNA, 25 bp, Homo sapien
actttgtacagtggcctctctaaaa

SEQ ID NO: 186131 - DNA, 25 bp, Homo sapien
cagtggcctctctaaaagtacaaaa

SEQ ID NO: 186132 - DNA, 25 bp, Homo sapien
gggattcttccactcctgaaatgag

SEQ ID NO: 186133 - DNA, 25 bp, Homo sapien
ctcctgaaatgagttgatttgcaga

SEQ ID NO: 186134 - DNA, 25 bp, Homo sapien
ctcacaacttcttaagctaaatggt

SEQ ID NO: 186135 - DNA, 25 bp, Homo sapien
gggcaccccaacaggaacagaagcg

SEQ ID NO: 186136 - DNA, 25 bp, Homo sapien
aacagaagcgtggtcctgcggctgc

SEQ ID NO: 186137 - DNA, 25 bp, Homo sapien
gagtttcactttccccttgctcgtt

SEQ ID NO: 186138 - DNA, 25 bp, Homo sapien
tcgtttctcccttgttgtaagtgtt

SEQ ID NO: 186139 - DNA, 25 bp, Homo sapien
gtgtttacaactggcatgtgctttt

SEQ ID NO: 186140 - DNA, 25 bp, Homo sapien
gcatgtgcttttaaacgtcaggtaa

SEQ ID NO: 186141 - DNA, 25 bp, Homo sapien
gtacatcgtcctggcgagtgacaat

SEQ ID NO: 186142 - DNA, 25 bp, Homo sapien
tgacagaagcctgggcgaggccctc

SEQ ID NO: 186143 - DNA, 25 bp, Homo sapien
gctactgggtttggcctggacagca

SEQ ID NO: 186144 - DNA, 25 bp, Homo sapien
cctggacagcactgatttgtggatg

SEQ ID NO: 186145 - DNA, 25 bp, Homo sapien
ggcacgttgtccgtgataaaagtac

SEQ ID NO: 186146 - DNA, 25 bp, Homo sapien
caaagcatgcaattatccaggcctt

SEQ ID NO: 186147 - DNA, 25 bp, Homo sapien
aggccttggtccacctcaagaattc

SEQ ID NO: 186148 - DNA, 25 bp, Homo sapien
gtgtgcccacaaagctagagcccat

SEQ ID NO: 186149 - DNA, 25 bp, Homo sapien
ccatctccatcctctatttagacaa

SEQ ID NO: 186150 - DNA, 25 bp, Homo sapien
tagacaaaggcgtcgtcacctacaa

SEQ ID NO: 186151 - DNA, 25 bp, Homo sapien
ggcgtcgtcacctacaagtttaaat

SEQ ID NO: 186152 - DNA, 25 bp, Homo sapien
aaatacgaaggcatggccgtctccg

SEQ ID NO: 186153 - DNA, 25 bp, Homo sapien
ggccgtctccgaatgtggctgtaga

SEQ ID NO: 186154 - DNA, 25 bp, Homo sapien
gaagagtcctatggcttatttaata

SEQ ID NO: 186155 - DNA, 25 bp, Homo sapien
aaatgtgtatatttggtgttcctat

SEQ ID NO: 186156 - DNA, 25 bp, Homo sapien
atagaggcttgctgccttcaggaaa

SEQ ID NO: 186157 - DNA, 25 bp, Homo sapien
ccacccccttcccccgcatgctgat

SEQ ID NO: 186158 - DNA, 25 bp, Homo sapien
cacccccttcccccgcatgctgatc

SEQ ID NO: 186159 - DNA, 25 bp, Homo sapien
acccccttcccccgcatgctgatcc

SEQ ID NO: 186160 - DNA, 25 bp, Homo sapien
cccccttcccccgcatgctgatccc

SEQ ID NO: 186161 - DNA, 25 bp, Homo sapien
ccccttcccccgcatgctgatcccc

SEQ ID NO: 186162 - DNA, 25 bp, Homo sapien
cccttcccccgcatgctgatccccc

SEQ ID NO: 186163 - DNA, 25 bp, Homo sapien
ccttcccccgcatgctgatccccct

SEQ ID NO: 186164 - DNA, 25 bp, Homo sapien
cttcccccgcatgctgatccccctg

SEQ ID NO: 186165 - DNA, 25 bp, Homo sapien
ttcccccgcatgctgatccccctgc

SEQ ID NO: 186166 - DNA, 25 bp, Homo sapien
gtagtcccagatgcacagaattatg

SEQ ID NO: 186167 - DNA, 25 bp, Homo sapien
gatttctatacagtgtggcgcgctt

SEQ ID NO: 186168 - DNA, 25 bp, Homo sapien
gtgtggcgcgcttttttaataatca

SEQ ID NO: 186169 - DNA, 25 bp, Homo sapien
cttatggctgtcaacaactgtggtc

SEQ ID NO: 186170 - DNA, 25 bp, Homo sapien
aacaactgtggtcttgctggtggat

SEQ ID NO: 186171 - DNA, 25 bp, Homo sapien
tgtggtcttgctggtggatgccctc

SEQ ID NO: 186172 - DNA, 25 bp, Homo sapien
tccttactccccaatatatacgtct

SEQ ID NO: 186173 - DNA, 25 bp, Homo sapien
gatagactgttggtgcatgctacaa

SEQ ID NO: 186174 - DNA, 25 bp, Homo sapien
atgagccgaggaaatagcttatttt

SEQ ID NO: 186175 - DNA, 25 bp, Homo sapien
tcccctttgggaagacttattgttg

SEQ ID NO: 186176 - DNA, 25 bp, Homo sapien
gggaagacttattgttgtgacctga

SEQ ID NO: 186177 - DNA, 25 bp, Homo sapien
gcaatgctggcctgttaactgataa

SEQ ID NO: 186178 - DNA, 25 bp, Homo sapien
gctggcctgttaactgataactaga

SEQ ID NO: 186179 - DNA, 25 bp, Homo sapien
gataactagaacttaggttcacgtt

SEQ ID NO: 186180 - DNA, 25 bp, Homo sapien
tagaacttaggttcacgtttatgta

SEQ ID NO: 186181 - DNA, 25 bp, Homo sapien
gtgtgtaaaacctagtagagcttgc

SEQ ID NO: 186182 - DNA, 25 bp, Homo sapien
gtagagcttgcatagtcggcactca

SEQ ID NO: 186183 - DNA, 25 bp, Homo sapien
gagcttgcatagtcggcactcagta

SEQ ID NO: 186184 - DNA, 25 bp, Homo sapien
ttgcatagtcggcactcagtaaatg

SEQ ID NO: 186185 - DNA, 25 bp, Homo sapien
aatcaacatgtggaccagagtgtta

SEQ ID NO: 186186 - DNA, 25 bp, Homo sapien
gaccagagtgttaatgagatgttat

SEQ ID NO: 186187 - DNA, 25 bp, Homo sapien
gagaaaattggtatatcatgcagat

SEQ ID NO: 186188 - DNA, 25 bp, Homo sapien
ggctcaccttgccatgccaggtggt

SEQ ID NO: 186189 - DNA, 25 bp, Homo sapien
atcaggatcctaatggtgctgccct

SEQ ID NO: 186190 - DNA, 25 bp, Homo sapien
gatcctaatggtgctgccctattta

SEQ ID NO: 186191 - DNA, 25 bp, Homo sapien
aatggtgctgccctatttatacctg

SEQ ID NO: 186192 - DNA, 25 bp, Homo sapien
gccctatttatacctgggtctgtat

SEQ ID NO: 186193 - DNA, 25 bp, Homo sapien
tatacctgggtctgtattaaaaggg

SEQ ID NO: 186194 - DNA, 25 bp, Homo sapien
tcctccttagggaaggctgggatat

SEQ ID NO: 186195 - DNA, 25 bp, Homo sapien
gatatgatgagagattccagcccaa

SEQ ID NO: 186196 - DNA, 25 bp, Homo sapien
atgagagattccagcccaagcccgg

SEQ ID NO: 186197 - DNA, 25 bp, Homo sapien
caccgccaggccatagggcataatt

SEQ ID NO: 186198 - DNA, 25 bp, Homo sapien
gggcataatttgcatctcaaatctg

SEQ ID NO: 186199 - DNA, 25 bp, Homo sapien
gaccccagacttactgagcctaagc

SEQ ID NO: 186200 - DNA, 25 bp, Homo sapien
cagacttactgagcctaagcctctg

SEQ ID NO: 186201 - DNA, 25 bp, Homo sapien
tctcggtctgttttgacaaaacttc

SEQ ID NO: 186202 - DNA, 25 bp, Homo sapien
gttggacggcagcattgagtttcct

SEQ ID NO: 186203 - DNA, 25 bp, Homo sapien
agcattgagtttcctgccgtgccct

SEQ ID NO: 186204 - DNA, 25 bp, Homo sapien
acctgctctggctgtgaaccacctg

SEQ ID NO: 186205 - DNA, 25 bp, Homo sapien
tgggcttcatctcaagcctgcctgg

SEQ ID NO: 186206 - DNA, 25 bp, Homo sapien
ctcaagcctgcctggcgtctctgtg

SEQ ID NO: 186207 - DNA, 25 bp, Homo sapien
gacccacactgggttgaggccagtg

SEQ ID NO: 186208 - DNA, 25 bp, Homo sapien
agtgtctcctgctgtgagaacaagt

SEQ ID NO: 186209 - DNA, 25 bp, Homo sapien
gagaacaagtggatgtccctctccc

SEQ ID NO: 186210 - DNA, 25 bp, Homo sapien
ctgatcccctcgtgacagaaccttt

SEQ ID NO: 186211 - DNA, 25 bp, Homo sapien
acagaacctttcagcataacgcctc

SEQ ID NO: 186212 - DNA, 25 bp, Homo sapien
taacgcctcacatcccaagtctata

SEQ ID NO: 186213 - DNA, 25 bp, Homo sapien
aagtctatacccttacctgaagaat

SEQ ID NO: 186214 - DNA, 25 bp, Homo sapien
aagaatgctgttctttcctagccac

SEQ ID NO: 186215 - DNA, 25 bp, Homo sapien
acttgccctgaaaggccaagatcaa

SEQ ID NO: 186216 - DNA, 25 bp, Homo sapien
agcctgactgctgctacatctaatc

SEQ ID NO: 186217 - DNA, 25 bp, Homo sapien
tgctacatctaatcccctaccaatg

SEQ ID NO: 186218 - DNA, 25 bp, Homo sapien
taaactccccagcatactgatgaca

SEQ ID NO: 186219 - DNA, 25 bp, Homo sapien
agccctctctgactttaccttgaga

SEQ ID NO: 186220 - DNA, 25 bp, Homo sapien
taccttgagatctgtcttcataccc

SEQ ID NO: 186221 - DNA, 25 bp, Homo sapien
tataatgcaatccttagtcctaccc

SEQ ID NO: 186222 - DNA, 25 bp, Homo sapien
ttagtcctaccctgaacctatgtgt

SEQ ID NO: 186223 - DNA, 25 bp, Homo sapien
tatgtgtcctctaagtcaggccctg

SEQ ID NO: 186224 - DNA, 25 bp, Homo sapien
gtcaggccctgatctagtgcagtaa

SEQ ID NO: 186225 - DNA, 25 bp, Homo sapien
gggagctttgcctgggacctgaacc

SEQ ID NO: 186226 - DNA, 25 bp, Homo sapien
tgaacctggagcacttaccgcatta

SEQ ID NO: 186227 - DNA, 25 bp, Homo sapien
aggagctccccgtaatcgttcctga

SEQ ID NO: 186228 - DNA, 25 bp, Homo sapien
gttcctgacccttgtgtctcatata

SEQ ID NO: 186229 - DNA, 25 bp, Homo sapien
gtctcatataccctatcctggtgga

SEQ ID NO: 186230 - DNA, 25 bp, Homo sapien
atcctggtggaaatgaccctatttg

SEQ ID NO: 186231 - DNA, 25 bp, Homo sapien
accctatttgatatgctgtccctta

SEQ ID NO: 186232 - DNA, 25 bp, Homo sapien
atagatatattccaagccgcctgac

SEQ ID NO: 186233 - DNA, 25 bp, Homo sapien
gatatattccaagccgcctgacgat

SEQ ID NO: 186234 - DNA, 25 bp, Homo sapien
caagccgcctgacgatctaattgta

SEQ ID NO: 186235 - DNA, 25 bp, Homo sapien
gccgcctgacgatctaattgtaaaa

SEQ ID NO: 186236 - DNA, 25 bp, Homo sapien
gacattatatgtgacttaaaaccta

SEQ ID NO: 186237 - DNA, 25 bp, Homo sapien
actattgatcaattttaactacata

SEQ ID NO: 186238 - DNA, 25 bp, Homo sapien
tataggacaagaaaaaccccaccat

SEQ ID NO: 186239 - DNA, 25 bp, Homo sapien
cataacccaaggcaaacaatgtatt

SEQ ID NO: 186240 - DNA, 25 bp, Homo sapien
aacaatgtattgacaggattccaat

SEQ ID NO: 186241 - DNA, 25 bp, Homo sapien
taacatgtaaagatgctcaccttgt

SEQ ID NO: 186242 - DNA, 25 bp, Homo sapien
catgtaaagatgctcaccttgttca

SEQ ID NO: 186243 - DNA, 25 bp, Homo sapien
gtaattgtcaatgcttccctggaca

SEQ ID NO: 186244 - DNA, 25 bp, Homo sapien
gtcaatgcttccctggacatagacc

SEQ ID NO: 186245 - DNA, 25 bp, Homo sapien
ggacatagacctccagattgtaaat

SEQ ID NO: 186246 - DNA, 25 bp, Homo sapien
cagattgtaaattccagtttggttc

SEQ ID NO: 186247 - DNA, 25 bp, Homo sapien
aaaggctacaatacacactggaaca

SEQ ID NO: 186248 - DNA, 25 bp, Homo sapien
cactggaacaactggtttattctga

SEQ ID NO: 186249 - DNA, 25 bp, Homo sapien
ttctgcatttttctgccgtttttca

SEQ ID NO: 186250 - DNA, 25 bp, Homo sapien
gccgtttttcatagttttcaccact

SEQ ID NO: 186251 - DNA, 25 bp, Homo sapien
gagtataatcgtaattcatccgttg

SEQ ID NO: 186252 - DNA, 25 bp, Homo sapien
attcatccgttgtatcagaaagcga

SEQ ID NO: 186253 - DNA, 25 bp, Homo sapien
tcagaaagcgatgacgtgggacatt

SEQ ID NO: 186254 - DNA, 25 bp, Homo sapien
cagtcttccttggtgcatgttctag

SEQ ID NO: 186255 - DNA, 25 bp, Homo sapien
ttggtgcatgttctagctccacaca

SEQ ID NO: 186256 - DNA, 25 bp, Homo sapien
tccacacactagtccttggaggaag

SEQ ID NO: 186257 - DNA, 25 bp, Homo sapien
gaaggttgagaccaatgatttcctg

SEQ ID NO: 186258 - DNA, 25 bp, Homo sapien
tgatttcctgttatgagtcatgagg

SEQ ID NO: 186259 - DNA, 25 bp, Homo sapien
tggaataatgtgctcagggtcacca

SEQ ID NO: 186260 - DNA, 25 bp, Homo sapien
agggtcaccatagcccattagtgga

SEQ ID NO: 186261 - DNA, 25 bp, Homo sapien
ccttaggctgtctgtcatcactgta

SEQ ID NO: 186262 - DNA, 25 bp, Homo sapien
tgtctgtcatcactgtacccaagtg

SEQ ID NO: 186263 - DNA, 25 bp, Homo sapien
agtgatgtcactaccaaggccaaat

SEQ ID NO: 186264 - DNA, 25 bp, Homo sapien
gaggctaatattgtcttctaagttc

SEQ ID NO: 186265 - DNA, 25 bp, Homo sapien
ttcactgactctgctaggtggtgcc

SEQ ID NO: 186266 - DNA, 25 bp, Homo sapien
taggtggtgccctgattgttggcat

SEQ ID NO: 186267 - DNA, 25 bp, Homo sapien
tgagattaacacaacacctgtcctt

SEQ ID NO: 186268 - DNA, 25 bp, Homo sapien
acaacacctgtccttactgtgtgaa

SEQ ID NO: 186269 - DNA, 25 bp, Homo sapien
aagtaccttatatagaacagcatca

SEQ ID NO: 186270 - DNA, 25 bp, Homo sapien
gaacagcatcagttcaaactgtgca

SEQ ID NO: 186271 - DNA, 25 bp, Homo sapien
gaaatcttaagacggtggccaaatt

SEQ ID NO: 186272 - DNA, 25 bp, Homo sapien
ccaaattaaagtgctggccttcaga

SEQ ID NO: 186273 - DNA, 25 bp, Homo sapien
gctggccttcagatgtctgtgattt

SEQ ID NO: 186274 - DNA, 25 bp, Homo sapien
gcaactgaggacctaattatgcctg

SEQ ID NO: 186275 - DNA, 25 bp, Homo sapien
ggacctaattatgcctgtctgcaaa

SEQ ID NO: 186276 - DNA, 25 bp, Homo sapien
gaatccactgattacctctacaagg

SEQ ID NO: 186277 - DNA, 25 bp, Homo sapien
acctctacaaggacccaaagcagca

SEQ ID NO: 186278 - DNA, 25 bp, Homo sapien
aagatgtacgacctattccagaagt

SEQ ID NO: 186279 - DNA, 25 bp, Homo sapien
atatggagctcgtggaagcagcaga

SEQ ID NO: 186280 - DNA, 25 bp, Homo sapien
aagcagcagagtcctttgacccagg

SEQ ID NO: 186281 - DNA, 25 bp, Homo sapien
acccaggaagtggttcaggaacatc

SEQ ID NO: 186282 - DNA, 25 bp, Homo sapien
gttcccagaacatgggagacaccct

SEQ ID NO: 186283 - DNA, 25 bp, Homo sapien
gagacaccctggatgaaagctcatt

SEQ ID NO: 186284 - DNA, 25 bp, Homo sapien
aaagctcattgacagccagtccaca

SEQ ID NO: 186285 - DNA, 25 bp, Homo sapien
ataactgggacagctttacgtctcc

SEQ ID NO: 186286 - DNA, 25 bp, Homo sapien
cagctttacgtctcccctgtaaaag

SEQ ID NO: 186287 - DNA, 25 bp, Homo sapien
gaattgctagctgtagtgtgacaca

SEQ ID NO: 186288 - DNA, 25 bp, Homo sapien
gacacattgtagtgtttgccaggaa

SEQ ID NO: 186289 - DNA, 25 bp, Homo sapien
gtttgccaggaaaggagccagtcat

SEQ ID NO: 186290 - DNA, 25 bp, Homo sapien
aaggagccagtcatgccggaaacac

SEQ ID NO: 186291 - DNA, 25 bp, Homo sapien
atgccggaaacactgacttctggga

SEQ ID NO: 186292 - DNA, 25 bp, Homo sapien
aacactgacttctgggaagccaccc

SEQ ID NO: 186293 - DNA, 25 bp, Homo sapien
tcattcctccctgctgttggaggca

SEQ ID NO: 186294 - DNA, 25 bp, Homo sapien
gcaacatctcctctttttacagagg

SEQ ID NO: 186295 - DNA, 25 bp, Homo sapien
tttgaccccattaagaggcaagcct

SEQ ID NO: 186296 - DNA, 25 bp, Homo sapien
cacatctatccctgggcctttagaa

SEQ ID NO: 186297 - DNA, 25 bp, Homo sapien
atttgcctcaaatggctatagggtt

SEQ ID NO: 186298 - DNA, 25 bp, Homo sapien
gaaggagatggaggtcgtcttaaac

SEQ ID NO: 186299 - DNA, 25 bp, Homo sapien
gagatggaggtcgtcttaaaccaga

SEQ ID NO: 186300 - DNA, 25 bp, Homo sapien
agatggaggtcgtcttaaaccagag

SEQ ID NO: 186301 - DNA, 25 bp, Homo sapien
tggaggtcgtcttaaaccagagagc

SEQ ID NO: 186302 - DNA, 25 bp, Homo sapien
ggaggtcgtcttaaaccagagagct

SEQ ID NO: 186303 - DNA, 25 bp, Homo sapien
tgaatataagaactcttgcagtctt

SEQ ID NO: 186304 - DNA, 25 bp, Homo sapien
agaactcttgcagtcttagatgtta

SEQ ID NO: 186305 - DNA, 25 bp, Homo sapien
gaactcttgcagtcttagatgttat

SEQ ID NO: 186306 - DNA, 25 bp, Homo sapien
aactcttgcagtcttagatgttata

SEQ ID NO: 186307 - DNA, 25 bp, Homo sapien
gaattgtaagagttgttagcacaag

SEQ ID NO: 186308 - DNA, 25 bp, Homo sapien
taagagttgttagcacaagtttttt

SEQ ID NO: 186309 - DNA, 25 bp, Homo sapien
actgtgtcttgcctttcagatctta

SEQ ID NO: 186310 - DNA, 25 bp, Homo sapien
gtgtcttgcctttcagatcttaaca

SEQ ID NO: 186311 - DNA, 25 bp, Homo sapien
cttgcctttcagatcttaacagagc

SEQ ID NO: 186312 - DNA, 25 bp, Homo sapien
tttcagatcttaacagagcagcagg

SEQ ID NO: 186313 - DNA, 25 bp, Homo sapien
gatcttaacagagcagcagggctta

SEQ ID NO: 186314 - DNA, 25 bp, Homo sapien
ttaacagagcagcagggcttaactt

SEQ ID NO: 186315 - DNA, 25 bp, Homo sapien
agcagcagggcttaacttgttgatt

SEQ ID NO: 186316 - DNA, 25 bp, Homo sapien
gcagcagggcttaacttgttgattt

SEQ ID NO: 186317 - DNA, 25 bp, Homo sapien
atgacactttttctaggctctacca

SEQ ID NO: 186318 - DNA, 25 bp, Homo sapien
acactttttctaggctctaccaata

SEQ ID NO: 186319 - DNA, 25 bp, Homo sapien
ttctaggctctaccaataaaagcca

SEQ ID NO: 186320 - DNA, 25 bp, Homo sapien
gtgtgatggatcccctttaggttat

SEQ ID NO: 186321 - DNA, 25 bp, Homo sapien
ttaggggtatatgtcccctgcttga

SEQ ID NO: 186322 - DNA, 25 bp, Homo sapien
caggtaatgagccatggccattgtc

SEQ ID NO: 186323 - DNA, 25 bp, Homo sapien
gtaatgagccatggccattgtcccc

SEQ ID NO: 186324 - DNA, 25 bp, Homo sapien
agagtatgcgagaacctaccaagaa

SEQ ID NO: 186325 - DNA, 25 bp, Homo sapien
tgcgagaacctaccaagaaaaacag

SEQ ID NO: 186326 - DNA, 25 bp, Homo sapien
aaacagtctcattactcatatacag

SEQ ID NO: 186327 - DNA, 25 bp, Homo sapien
gtctcattactcatatacagcaggc

SEQ ID NO: 186328 - DNA, 25 bp, Homo sapien
attactcatatacagcaggcaaaga

SEQ ID NO: 186329 - DNA, 25 bp, Homo sapien
ggaggccggatctctagagccatcc

SEQ ID NO: 186330 - DNA, 25 bp, Homo sapien
aggccggatctctagagccatcctg

SEQ ID NO: 186331 - DNA, 25 bp, Homo sapien
tttgtattagaaatgcgcatacatt

SEQ ID NO: 186332 - DNA, 25 bp, Homo sapien
gaaatgcgcatacatttatatgaat

SEQ ID NO: 186333 - DNA, 25 bp, Homo sapien
taggtctagagcttcttttatattc

SEQ ID NO: 186334 - DNA, 25 bp, Homo sapien
ggtctagagcttcttttatattcaa

SEQ ID NO: 186335 - DNA, 25 bp, Homo sapien
gtctagagcttcttttatattcaag

SEQ ID NO: 186336 - DNA, 25 bp, Homo sapien
agagcttcttttatattcaagctaa

SEQ ID NO: 186337 - DNA, 25 bp, Homo sapien
gcttcttttatattcaagctaaaca

SEQ ID NO: 186338 - DNA, 25 bp, Homo sapien
gattatgtgatgttggaaagctcat

SEQ ID NO: 186339 - DNA, 25 bp, Homo sapien
gtgatgttggaaagctcattgattt

SEQ ID NO: 186340 - DNA, 25 bp, Homo sapien
gttggaaagctcattgatttgtata

SEQ ID NO: 186341 - DNA, 25 bp, Homo sapien
tggcttccagttcccaggtgttctt

SEQ ID NO: 186342 - DNA, 25 bp, Homo sapien
accttgaagtctatatccgtgatat

SEQ ID NO: 186343 - DNA, 25 bp, Homo sapien
atccgtgatattatgtcgattttta

SEQ ID NO: 186344 - DNA, 25 bp, Homo sapien
tagtccagcctaaaatgcttctttt

SEQ ID NO: 186345 - DNA, 25 bp, Homo sapien
aatgcttcttttaatctgcattctg

SEQ ID NO: 186346 - DNA, 25 bp, Homo sapien
gtttcctcttctagttgtgccatta

SEQ ID NO: 186347 - DNA, 25 bp, Homo sapien
gttgtgccattactagtgatcatgt

SEQ ID NO: 186348 - DNA, 25 bp, Homo sapien
ttgagacaattaaaatccttctggg

SEQ ID NO: 186349 - DNA, 25 bp, Homo sapien
ggcactggaagcacaatacggtgac

SEQ ID NO: 186350 - DNA, 25 bp, Homo sapien
atacggtgaccaatcttgctttcat

SEQ ID NO: 186351 - DNA, 25 bp, Homo sapien
aatttgaaccatgattttgctagaa

SEQ ID NO: 186352 - DNA, 25 bp, Homo sapien
tgctagaaatagaaggcccagtggt

SEQ ID NO: 186353 - DNA, 25 bp, Homo sapien
ggagcaacagtggtagccctgagta

SEQ ID NO: 186354 - DNA, 25 bp, Homo sapien
gtagccctgagtaaaacccattgtc

SEQ ID NO: 186355 - DNA, 25 bp, Homo sapien
tgagtaaaacccattgtccctcttt

SEQ ID NO: 186356 - DNA, 25 bp, Homo sapien
gtccctctttggaggagcggccaga

SEQ ID NO: 186357 - DNA, 25 bp, Homo sapien
gcaggctgatccagcagagcactaa

SEQ ID NO: 186358 - DNA, 25 bp, Homo sapien
gatccagcagagcactaatgggtca

SEQ ID NO: 186359 - DNA, 25 bp, Homo sapien
ggtcagtttcatgtattggcagatg

SEQ ID NO: 186360 - DNA, 25 bp, Homo sapien
atgtggtgtagcatggcaaggctac

SEQ ID NO: 186361 - DNA, 25 bp, Homo sapien
gcatggcaaggctacaagttttaag

SEQ ID NO: 186362 - DNA, 25 bp, Homo sapien
ttcaaccaaatattcccactatgtg

SEQ ID NO: 186363 - DNA, 25 bp, Homo sapien
aatattcccactatgtgctatatgt

SEQ ID NO: 186364 - DNA, 25 bp, Homo sapien
atctgtgccaaaaatgtgttttcag

SEQ ID NO: 186365 - DNA, 25 bp, Homo sapien
attcagactttgtattgcccactca

SEQ ID NO: 186366 - DNA, 25 bp, Homo sapien
tgtattgcccactcatttgtataag

SEQ ID NO: 186367 - DNA, 25 bp, Homo sapien
catttgtataagtgcgcttcggtac

SEQ ID NO: 186368 - DNA, 25 bp, Homo sapien
gcttcggtacagcacgggtcctgct

SEQ ID NO: 186369 - DNA, 25 bp, Homo sapien
tgctcccgcgatgtggaagtgtcac

SEQ ID NO: 186370 - DNA, 25 bp, Homo sapien
gtgtcacacggcacctgtacaaaaa

SEQ ID NO: 186371 - DNA, 25 bp, Homo sapien
tacaaaaagactggctaacccctct

SEQ ID NO: 186372 - DNA, 25 bp, Homo sapien
tcttcctattaccttgatctcttcc

SEQ ID NO: 186373 - DNA, 25 bp, Homo sapien
gaaactgtttttctcagcgcagttt

SEQ ID NO: 186374 - DNA, 25 bp, Homo sapien
ttctcagcgcagttttgttttgtgt

SEQ ID NO: 186375 - DNA, 25 bp, Homo sapien
aaatcttgtgttaacttgcctccat

SEQ ID NO: 186376 - DNA, 25 bp, Homo sapien
tgttaacttgcctccatctttttct

SEQ ID NO: 186377 - DNA, 25 bp, Homo sapien
ggaatgacccttttgtgtctatgat

SEQ ID NO: 186378 - DNA, 25 bp, Homo sapien
tgtctatgatgttgctgttcacagc

SEQ ID NO: 186379 - DNA, 25 bp, Homo sapien
gttcacagcttttcttgataggcct

SEQ ID NO: 186380 - DNA, 25 bp, Homo sapien
gataggcctagtacaatcttgggaa

SEQ ID NO: 186381 - DNA, 25 bp, Homo sapien
acaatcttgggaacagggttactgt

SEQ ID NO: 186382 - DNA, 25 bp, Homo sapien
ggttactgtatactgaaggtctgac

SEQ ID NO: 186383 - DNA, 25 bp, Homo sapien
tgacagtagctcttagactcgccta

SEQ ID NO: 186384 - DNA, 25 bp, Homo sapien
gactcgcctatcttaggtagtcatg

SEQ ID NO: 186385 - DNA, 25 bp, Homo sapien
ggtgtactgtgtttgatttgtctca

SEQ ID NO: 186386 - DNA, 25 bp, Homo sapien
gaactggacctacaaggcatccgaa

SEQ ID NO: 186387 - DNA, 25 bp, Homo sapien
aaggcatccgaatcgactcagatat

SEQ ID NO: 186388 - DNA, 25 bp, Homo sapien
gactcagatattagcggcaccctca

SEQ ID NO: 186389 - DNA, 25 bp, Homo sapien
ggcaccctcaagtttgcgtgtgaga

SEQ ID NO: 186390 - DNA, 25 bp, Homo sapien
gaactcattgaattcttttcccgag

SEQ ID NO: 186391 - DNA, 25 bp, Homo sapien
tttcccgagaggctgacaatgttaa

SEQ ID NO: 186392 - DNA, 25 bp, Homo sapien
agtaagcgaacagatctttgtgacc

SEQ ID NO: 186393 - DNA, 25 bp, Homo sapien
atgccctgcacatatcgcatgatga

SEQ ID NO: 186394 - DNA, 25 bp, Homo sapien
tcgcatgatgagctatgaaccactg

SEQ ID NO: 186395 - DNA, 25 bp, Homo sapien
agctatgaaccactggagcagccca

SEQ ID NO: 186396 - DNA, 25 bp, Homo sapien
agcagcccacactggcttgatggat

SEQ ID NO: 186397 - DNA, 25 bp, Homo sapien
agcggtgcgacagtggcctcaacat

SEQ ID NO: 186398 - DNA, 25 bp, Homo sapien
gcggtgcgacagtggcctcaacatc

SEQ ID NO: 186399 - DNA, 25 bp, Homo sapien
gacagtggcctcaacatcctccaaa

SEQ ID NO: 186400 - DNA, 25 bp, Homo sapien
agtggcctcaacatcctccaaacag

SEQ ID NO: 186401 - DNA, 25 bp, Homo sapien
tggcctcaacatcctccaaacagag

SEQ ID NO: 186402 - DNA, 25 bp, Homo sapien
catcctccaaacagagaatcaagtg

SEQ ID NO: 186403 - DNA, 25 bp, Homo sapien
aaacagagaatcaagtgatcctctt

SEQ ID NO: 186404 - DNA, 25 bp, Homo sapien
gtatctgggactacacgcgaacacc

SEQ ID NO: 186405 - DNA, 25 bp, Homo sapien
tatctgggactacacgcgaacacca

SEQ ID NO: 186406 - DNA, 25 bp, Homo sapien
atctgggactacacgcgaacaccac

SEQ ID NO: 186407 - DNA, 25 bp, Homo sapien
ctcagcttcaaaaactgctgggatt

SEQ ID NO: 186408 - DNA, 25 bp, Homo sapien
tctgactgttctgtctctcgcctga

SEQ ID NO: 186409 - DNA, 25 bp, Homo sapien
tgactgttctgtctctcgcctgatg

SEQ ID NO: 186410 - DNA, 25 bp, Homo sapien
tctgtctctcgcctgatgctggaag

SEQ ID NO: 186411 - DNA, 25 bp, Homo sapien
aggagcaaacactggcctctggtgt

SEQ ID NO: 186412 - DNA, 25 bp, Homo sapien
gcaaacactggcctctggtgtccac

SEQ ID NO: 186413 - DNA, 25 bp, Homo sapien
tttggctgtcactccctgtgcatgg

SEQ ID NO: 186414 - DNA, 25 bp, Homo sapien
tgtcactccctgtgcatggtctgac

SEQ ID NO: 186415 - DNA, 25 bp, Homo sapien
gggaagatgtctcactgtccacctc

SEQ ID NO: 186416 - DNA, 25 bp, Homo sapien
gggttggacaggacagtgaccttgg

SEQ ID NO: 186417 - DNA, 25 bp, Homo sapien
gacaggacagtgaccttgggaggaa

SEQ ID NO: 186418 - DNA, 25 bp, Homo sapien
gggctactccgccatccttaaaagc

SEQ ID NO: 186419 - DNA, 25 bp, Homo sapien
gataagcttttgcaagactgccggg

SEQ ID NO: 186420 - DNA, 25 bp, Homo sapien
gaaacgaccctgtggctgtgagaaa

SEQ ID NO: 186421 - DNA, 25 bp, Homo sapien
aaggcattggcattttcttgtctct

SEQ ID NO: 186422 - DNA, 25 bp, Homo sapien
cattttcttgtctcttctgttgatt

SEQ ID NO: 186423 - DNA, 25 bp, Homo sapien
aaaatgatccctcctggtgataacc

SEQ ID NO: 186424 - DNA, 25 bp, Homo sapien
ggtgataacccattttacagggatg

SEQ ID NO: 186425 - DNA, 25 bp, Homo sapien
gaaagaccaatgctgctttaaggct

SEQ ID NO: 186426 - DNA, 25 bp, Homo sapien
ttttagtgaacatctgaagtgccca

SEQ ID NO: 186427 - DNA, 25 bp, Homo sapien
gaagtgcccacaagtatgttctttc

SEQ ID NO: 186428 - DNA, 25 bp, Homo sapien
gtatgttctttccactgctgatttc

SEQ ID NO: 186429 - DNA, 25 bp, Homo sapien
ctttccactgctgatttctttttca

SEQ ID NO: 186430 - DNA, 25 bp, Homo sapien
cagaaggctaacttgagaggtttgg

SEQ ID NO: 186431 - DNA, 25 bp, Homo sapien
ggactctgcagtgtccttggcaaat

SEQ ID NO: 186432 - DNA, 25 bp, Homo sapien
ttggcaaatccccactgtactcaat

SEQ ID NO: 186433 - DNA, 25 bp, Homo sapien
gtactcaatgccctacattctcttc

SEQ ID NO: 186434 - DNA, 25 bp, Homo sapien
tcatggccactgaaccaatcacttt

SEQ ID NO: 186435 - DNA, 25 bp, Homo sapien
caatcactttgtatgctatgctcct

SEQ ID NO: 186436 - DNA, 25 bp, Homo sapien
ttgtatgctatgctcctactgtgat

SEQ ID NO: 186437 - DNA, 25 bp, Homo sapien
tatgctcctactgtgatggaaaaca

SEQ ID NO: 186438 - DNA, 25 bp, Homo sapien
gagaatattctatgcatctatgacg

SEQ ID NO: 186439 - DNA, 25 bp, Homo sapien
atctatgacgtgcttactactgcag

SEQ ID NO: 186440 - DNA, 25 bp, Homo sapien
gacgtgcttactactgcagtgcatt

SEQ ID NO: 186441 - DNA, 25 bp, Homo sapien
actcccttagtacactggagtgccg

SEQ ID NO: 186442 - DNA, 25 bp, Homo sapien
cttagtacactggagtgccgagccc

SEQ ID NO: 186443 - DNA, 25 bp, Homo sapien
cctatcttcctgtgtcttgtgcatg

SEQ ID NO: 186444 - DNA, 25 bp, Homo sapien
atcttcctgtgtcttgtgcatggga

SEQ ID NO: 186445 - DNA, 25 bp, Homo sapien
tcctgtgtcttgtgcatgggaagca

SEQ ID NO: 186446 - DNA, 25 bp, Homo sapien
cttcagtgccttcatgaattcacct

SEQ ID NO: 186447 - DNA, 25 bp, Homo sapien
tcagtgccttcatgaattcaccttc

SEQ ID NO: 186448 - DNA, 25 bp, Homo sapien
gtgccttcatgaattcaccttccag

SEQ ID NO: 186449 - DNA, 25 bp, Homo sapien
ttcatgaattcaccttccagcttcc

SEQ ID NO: 186450 - DNA, 25 bp, Homo sapien
agcttcctcagaataaaatgctgcc

SEQ ID NO: 186451 - DNA, 25 bp, Homo sapien
tcctcagaataaaatgctgcctggg

SEQ ID NO: 186452 - DNA, 25 bp, Homo sapien
gacagaaatctagctctaccacaag

SEQ ID NO: 186453 - DNA, 25 bp, Homo sapien
ccacaagttgcacaaatgttatcta

SEQ ID NO: 186454 - DNA, 25 bp, Homo sapien
gtaattgtagaacataggactgcta

SEQ ID NO: 186455 - DNA, 25 bp, Homo sapien
aggactgctaatctcagttcgctct

SEQ ID NO: 186456 - DNA, 25 bp, Homo sapien
atctcagttcgctctgtgatgtcaa

SEQ ID NO: 186457 - DNA, 25 bp, Homo sapien
gtgatgtcaagtgcagaatgtacaa

SEQ ID NO: 186458 - DNA, 25 bp, Homo sapien
attaactggtgatttcctcatactt

SEQ ID NO: 186459 - DNA, 25 bp, Homo sapien
tcctcatacttttgatactacttgt

SEQ ID NO: 186460 - DNA, 25 bp, Homo sapien
tactacttgtacctgtatgtctttt

SEQ ID NO: 186461 - DNA, 25 bp, Homo sapien
aagacattggtggagtctgtatccc

SEQ ID NO: 186462 - DNA, 25 bp, Homo sapien
actatgtttatgcttctacatccag

SEQ ID NO: 186463 - DNA, 25 bp, Homo sapien
tgggagtgcacaggagtccacctaa

SEQ ID NO: 186464 - DNA, 25 bp, Homo sapien
gggagtgcacaggagtccacctaaa

SEQ ID NO: 186465 - DNA, 25 bp, Homo sapien
ggagtgcacaggagtccacctaaaa

SEQ ID NO: 186466 - DNA, 25 bp, Homo sapien
gagtgcacaggagtccacctaaaaa

SEQ ID NO: 186467 - DNA, 25 bp, Homo sapien
agtgcacaggagtccacctaaaaaa

SEQ ID NO: 186468 - DNA, 25 bp, Homo sapien
tgcacaggagtccacctaaaaaaaa

SEQ ID NO: 186469 - DNA, 25 bp, Homo sapien
atactgttgcctgcctttttagtca

SEQ ID NO: 186470 - DNA, 25 bp, Homo sapien
actgttgcctgcctttttagtcacc

SEQ ID NO: 186471 - DNA, 25 bp, Homo sapien
tgttgcctgcctttttagtcacccc

SEQ ID NO: 186472 - DNA, 25 bp, Homo sapien
ttagtcaccccgtaacaagggcaca

SEQ ID NO: 186473 - DNA, 25 bp, Homo sapien
tagtcaccccgtaacaagggcacac

SEQ ID NO: 186474 - DNA, 25 bp, Homo sapien
tgggagtgcacaggagtccacctaa

SEQ ID NO: 186475 - DNA, 25 bp, Homo sapien
ggagtgcacaggagtccacctaaaa

SEQ ID NO: 186476 - DNA, 25 bp, Homo sapien
agtgcacaggagtccacctaaaaaa

SEQ ID NO: 186477 - DNA, 25 bp, Homo sapien
aaaaatccttgatactgttgcctgc

SEQ ID NO: 186478 - DNA, 25 bp, Homo sapien
atactgttgcctgcctttttagtca

SEQ ID NO: 186479 - DNA, 25 bp, Homo sapien
actgttgcctgcctttttagtcacc

SEQ ID NO: 186480 - DNA, 25 bp, Homo sapien
tgttgcctgcctttttagtcacccc

SEQ ID NO: 186481 - DNA, 25 bp, Homo sapien
ttagtcaccccgtaacaagggcaca

SEQ ID NO: 186482 - DNA, 25 bp, Homo sapien
tagtcaccccgtaacaagggcacac

SEQ ID NO: 186483 - DNA, 25 bp, Homo sapien
gcactgtgtcttgcctttcagatct

SEQ ID NO: 186484 - DNA, 25 bp, Homo sapien
atgacactttttctaggctctacca

SEQ ID NO: 186485 - DNA, 25 bp, Homo sapien
tgcccttaagtgcttttgctgctat

SEQ ID NO: 186486 - DNA, 25 bp, Homo sapien
gttccacaagatccaaccaagaatt

SEQ ID NO: 186487 - DNA, 25 bp, Homo sapien
ccaagaattctgtatcctggcaaca

SEQ ID NO: 186488 - DNA, 25 bp, Homo sapien
tcctggcaacagtcagattcttcta

SEQ ID NO: 186489 - DNA, 25 bp, Homo sapien
ttcttctaaatcagccagcaagagg

SEQ ID NO: 186490 - DNA, 25 bp, Homo sapien
gagagatggtattcccagatcattc

SEQ ID NO: 186491 - DNA, 25 bp, Homo sapien
agatgttggctgctgtacttactcc

SEQ ID NO: 186492 - DNA, 25 bp, Homo sapien
tggtgatcgagtggtctgtgttcct

SEQ ID NO: 186493 - DNA, 25 bp, Homo sapien
agtggtctgtgttcctattgctggt

SEQ ID NO: 186494 - DNA, 25 bp, Homo sapien
tagggtgggctaaaaaccatgcact

SEQ ID NO: 186495 - DNA, 25 bp, Homo sapien
aaccatgcactctggaatttgttgt

SEQ ID NO: 186496 - DNA, 25 bp, Homo sapien
gtcctttgaaagttgtgagagctca

SEQ ID NO: 186497 - DNA, 25 bp, Homo sapien
attaggagcccccatccctgtgttc

SEQ ID NO: 186498 - DNA, 25 bp, Homo sapien
caagaattcagagaacagcactggg

SEQ ID NO: 186499 - DNA, 25 bp, Homo sapien
gctggaatgatctttaatgggccca

SEQ ID NO: 186500 - DNA, 25 bp, Homo sapien
gaatgatctttaatgggcccaaggc

SEQ ID NO: 186501 - DNA, 25 bp, Homo sapien
atgatctttaatgggcccaaggcca

SEQ ID NO: 186502 - DNA, 25 bp, Homo sapien
tgggcccaaggccaacaggcatatg

SEQ ID NO: 186503 - DNA, 25 bp, Homo sapien
aggccaacaggcatatgcctcacta

SEQ ID NO: 186504 - DNA, 25 bp, Homo sapien
ggcatatgcctcactactgcctgga

SEQ ID NO: 186505 - DNA, 25 bp, Homo sapien
tgtctgccagtcaagcttcacaggc

SEQ ID NO: 186506 - DNA, 25 bp, Homo sapien
gccagtcaagcttcacaggcattgt

SEQ ID NO: 186507 - DNA, 25 bp, Homo sapien
ggagattagactatttggattcatg

SEQ ID NO: 186508 - DNA, 25 bp, Homo sapien
tggattcatgtgtagctgccctgtc

SEQ ID NO: 186509 - DNA, 25 bp, Homo sapien
atctcatccatgcaaactaccatct

SEQ ID NO: 186510 - DNA, 25 bp, Homo sapien
atgcaaactaccatctgctcaactt

SEQ ID NO: 186511 - DNA, 25 bp, Homo sapien
ggacttgctggttgaaggagctcat

SEQ ID NO: 186512 - DNA, 25 bp, Homo sapien
aaggagctcatcttgcaggctggaa

SEQ ID NO: 186513 - DNA, 25 bp, Homo sapien
tcatcttgcaggctggaagcaccag

SEQ ID NO: 186514 - DNA, 25 bp, Homo sapien
cccagtcaaccaatggcatccagag

SEQ ID NO: 186515 - DNA, 25 bp, Homo sapien
gcatggaggctccatacaacctctt

SEQ ID NO: 186516 - DNA, 25 bp, Homo sapien
catctttctttgtcctatacatgtc

SEQ ID NO: 186517 - DNA, 25 bp, Homo sapien
cctatacatgtcttccatttggctg

SEQ ID NO: 186518 - DNA, 25 bp, Homo sapien
cagatgttggctgctgtacttactc

SEQ ID NO: 186519 - DNA, 25 bp, Homo sapien
agatgttggctgctgtacttactcc

SEQ ID NO: 186520 - DNA, 25 bp, Homo sapien
tggtgatcgagtggtctgtgttcct

SEQ ID NO: 186521 - DNA, 25 bp, Homo sapien
ggtgatcgagtggtctgtgttccta

SEQ ID NO: 186522 - DNA, 25 bp, Homo sapien
tgatcgagtggtctgtgttcctatt

SEQ ID NO: 186523 - DNA, 25 bp, Homo sapien
gatcgagtggtctgtgttcctattg

SEQ ID NO: 186524 - DNA, 25 bp, Homo sapien
atcgagtggtctgtgttcctattgc

SEQ ID NO: 186525 - DNA, 25 bp, Homo sapien
cgagtggtctgtgttcctattgctg

SEQ ID NO: 186526 - DNA, 25 bp, Homo sapien
agtggtctgtgttcctattgctggt

SEQ ID NO: 186527 - DNA, 25 bp, Homo sapien
ggtctgtgttcctattgctggtggg

SEQ ID NO: 186528 - DNA, 25 bp, Homo sapien
tagggtgggctaaaaaccatgcact

SEQ ID NO: 186529 - DNA, 25 bp, Homo sapien
ccaacagataccagcatgtacatag

SEQ ID NO: 186530 - DNA, 25 bp, Homo sapien
gataccagcatgtacatagaacttc

SEQ ID NO: 186531 - DNA, 25 bp, Homo sapien
ccagcatgtacatagaacttccaaa

SEQ ID NO: 186532 - DNA, 25 bp, Homo sapien
aaaatccctttcaccatcctcctct

SEQ ID NO: 186533 - DNA, 25 bp, Homo sapien
gaccatcaggaggtgtcatacgcat

SEQ ID NO: 186534 - DNA, 25 bp, Homo sapien
ggaggtgtcatacgcataattggat

SEQ ID NO: 186535 - DNA, 25 bp, Homo sapien
aggtgtcatacgcataattggatca

SEQ ID NO: 186536 - DNA, 25 bp, Homo sapien
gtcatacgcataattggatcactgt

SEQ ID NO: 186537 - DNA, 25 bp, Homo sapien
tacgcataattggatcactgtgttt

SEQ ID NO: 186538 - DNA, 25 bp, Homo sapien
cataattggatcactgtgttttcac

SEQ ID NO: 186539 - DNA, 25 bp, Homo sapien
taattggatcactgtgttttcacac

SEQ ID NO: 186540 - DNA, 25 bp, Homo sapien
gacggcatcagcagcccagtgagca

SEQ ID NO: 186541 - DNA, 25 bp, Homo sapien
catcagcagcccagtgagcaccagg

SEQ ID NO: 186542 - DNA, 25 bp, Homo sapien
atagggcacccatgaggctgcgctg

SEQ ID NO: 186543 - DNA, 25 bp, Homo sapien
agggctcagggtgggctcagaggcc

SEQ ID NO: 186544 - DNA, 25 bp, Homo sapien
tcagaggccactgagatgccagttc

SEQ ID NO: 186545 - DNA, 25 bp, Homo sapien
cactgagatgccagttccttgagag

SEQ ID NO: 186546 - DNA, 25 bp, Homo sapien
ggtgtcccaggccagagcagcctct

SEQ ID NO: 186547 - DNA, 25 bp, Homo sapien
tcctggtcccagaaaaacccttgca

SEQ ID NO: 186548 - DNA, 25 bp, Homo sapien
aacccttgcagtaaatggtggcctc

SEQ ID NO: 186549 - DNA, 25 bp, Homo sapien
cttgcagtaaatggtggcctctggg

SEQ ID NO: 186550 - DNA, 25 bp, Homo sapien
taaatggtggcctctgggtggttaa

SEQ ID NO: 186551 - DNA, 25 bp, Homo sapien
ccacctagtcgacactaagaatgag

SEQ ID NO: 186552 - DNA, 25 bp, Homo sapien
aatagttttctcctcgttggttcat

SEQ ID NO: 186553 - DNA, 25 bp, Homo sapien
tcctcgttggttcatgtgttgttgt

SEQ ID NO: 186554 - DNA, 25 bp, Homo sapien
gttgtttttgataatccaaagcgat

SEQ ID NO: 186555 - DNA, 25 bp, Homo sapien
aaagcgatcatgtcagttggccctt

SEQ ID NO: 186556 - DNA, 25 bp, Homo sapien
gtcagttggccctttaatatttcca

SEQ ID NO: 186557 - DNA, 25 bp, Homo sapien
gcttttaaatctgcagcacattgat

SEQ ID NO: 186558 - DNA, 25 bp, Homo sapien
cattgataagatggtttccgtgagc

SEQ ID NO: 186559 - DNA, 25 bp, Homo sapien
tccgtgagctatgataagattgaaa

SEQ ID NO: 186560 - DNA, 25 bp, Homo sapien
gaaattccagttgcaattcataact

SEQ ID NO: 186561 - DNA, 25 bp, Homo sapien
gttatttctgcctataaatttactc

SEQ ID NO: 186562 - DNA, 25 bp, Homo sapien
cacgggagggacaaggcttctctgt

SEQ ID NO: 186563 - DNA, 25 bp, Homo sapien
gagggacaaggcttctctgtccgcc

SEQ ID NO: 186564 - DNA, 25 bp, Homo sapien
ctcacgttcacttaggcacatcaca

SEQ ID NO: 186565 - DNA, 25 bp, Homo sapien
taggcactgggcattaccatagaga

SEQ ID NO: 186566 - DNA, 25 bp, Homo sapien
tgggcattaccatagagaacaaaat

SEQ ID NO: 186567 - DNA, 25 bp, Homo sapien
agacaaatacatctgccctcatgga

SEQ ID NO: 186568 - DNA, 25 bp, Homo sapien
tctgccctcatggaaggtgacgttc

SEQ ID NO: 186569 - DNA, 25 bp, Homo sapien
gtgacgttcccggagagggcaccta

SEQ ID NO: 186570 - DNA, 25 bp, Homo sapien
ccggagagggcacctacacagtcac

SEQ ID NO: 186571 - DNA, 25 bp, Homo sapien
tacacagtcacgcaaacacacacta

SEQ ID NO: 186572 - DNA, 25 bp, Homo sapien
aaacacacactaattcctggcaggc

SEQ ID NO: 186573 - DNA, 25 bp, Homo sapien
ggacttagcctaacagatgagctgt

SEQ ID NO: 186574 - DNA, 25 bp, Homo sapien
cttagcctaacagatgagctgtcga

SEQ ID NO: 186575 - DNA, 25 bp, Homo sapien
gcctaacagatgagctgtcgaacct

SEQ ID NO: 186576 - DNA, 25 bp, Homo sapien
taacagatgagctgtcgaacctccc

SEQ ID NO: 186577 - DNA, 25 bp, Homo sapien
acagatgagctgtcgaacctcccct

SEQ ID NO: 186578 - DNA, 25 bp, Homo sapien
gatgagctgtcgaacctcccctcaa

SEQ ID NO: 186579 - DNA, 25 bp, Homo sapien
gcagcctcagccctagctgatgctg

SEQ ID NO: 186580 - DNA, 25 bp, Homo sapien
gaggaacggcttaagaacctgcgga

SEQ ID NO: 186581 - DNA, 25 bp, Homo sapien
aggaacggcttaagaacctgcggag

SEQ ID NO: 186582 - DNA, 25 bp, Homo sapien
gatgcccaggatcttttaccacaac

SEQ ID NO: 186583 - DNA, 25 bp, Homo sapien
atgcccaggatcttttaccacaacc

SEQ ID NO: 186584 - DNA, 25 bp, Homo sapien
ggagatatctgatgcccagtgggaa

SEQ ID NO: 186585 - DNA, 25 bp, Homo sapien
tgtggtacagaaagccctccaagcc

SEQ ID NO: 186586 - DNA, 25 bp, Homo sapien
gtgagagctgccttatattcctaca

SEQ ID NO: 186587 - DNA, 25 bp, Homo sapien
atattcctacattccaggccagaac

SEQ ID NO: 186588 - DNA, 25 bp, Homo sapien
attccaggccagaaccagcacagga

SEQ ID NO: 186589 - DNA, 25 bp, Homo sapien
ggactgaacacatccctggttgtaa

SEQ ID NO: 186590 - DNA, 25 bp, Homo sapien
ctggttgtaatgtccatttccatct

SEQ ID NO: 186591 - DNA, 25 bp, Homo sapien
tttccacatcaaggcacatcagact

SEQ ID NO: 186592 - DNA, 25 bp, Homo sapien
aggcacatcagacttctcagagacc

SEQ ID NO: 186593 - DNA, 25 bp, Homo sapien
gagacccactttattcagttctgta

SEQ ID NO: 186594 - DNA, 25 bp, Homo sapien
aaccaccttagcatgtatcactctg

SEQ ID NO: 186595 - DNA, 25 bp, Homo sapien
aggcaccaagcatgagacctggtct

SEQ ID NO: 186596 - DNA, 25 bp, Homo sapien
gagacctggtctggacatgtcatca

SEQ ID NO: 186597 - DNA, 25 bp, Homo sapien
gacatgtcatcagctcctaggagat

SEQ ID NO: 186598 - DNA, 25 bp, Homo sapien
ggagatggtggaagcaccccttgtc

SEQ ID NO: 186599 - DNA, 25 bp, Homo sapien
gtggaagcaccccttgtcctgtgct

SEQ ID NO: 186600 - DNA, 25 bp, Homo sapien
tgtcctgtgcttgaggagactttgc

SEQ ID NO: 186601 - DNA, 25 bp, Homo sapien
aggcagcagacactggagatgacat

SEQ ID NO: 186602 - DNA, 25 bp, Homo sapien
gagatgacattcttccacacgagac

SEQ ID NO: 186603 - DNA, 25 bp, Homo sapien
atgacattcttccacacgagacggg

SEQ ID NO: 186604 - DNA, 25 bp, Homo sapien
gggatggtccctctcaagtatctcc

SEQ ID NO: 186605 - DNA, 25 bp, Homo sapien
ccctctcaagtatctcctggaggaa

SEQ ID NO: 186606 - DNA, 25 bp, Homo sapien
atccttgcctacaccgaggatgagg

SEQ ID NO: 186607 - DNA, 25 bp, Homo sapien
aggatgaggtcgtctctacggactt

SEQ ID NO: 186608 - DNA, 25 bp, Homo sapien
gtctctacggacttcctcggtgata

SEQ ID NO: 186609 - DNA, 25 bp, Homo sapien
actcgtccatcttcgatgctaaggc

SEQ ID NO: 186610 - DNA, 25 bp, Homo sapien
tgctaaggccggcattgcgctcaat

SEQ ID NO: 186611 - DNA, 25 bp, Homo sapien
ttgcgctcaatgacaatttcgtgaa

SEQ ID NO: 186612 - DNA, 25 bp, Homo sapien
gaagctcatttcatggtacgacaac

SEQ ID NO: 186613 - DNA, 25 bp, Homo sapien
acgaatatggctacagtcaccgggt

SEQ ID NO: 186614 - DNA, 25 bp, Homo sapien
acagtcaccgggtggtcgacctcct

SEQ ID NO: 186615 - DNA, 25 bp, Homo sapien
gtaccaaccccggatgtgtctgtcg

SEQ ID NO: 186616 - DNA, 25 bp, Homo sapien
cggatgtgtctgtcgtggacctgac

SEQ ID NO: 186617 - DNA, 25 bp, Homo sapien
gaaatgcactcaccatgagcaccaa

SEQ ID NO: 186618 - DNA, 25 bp, Homo sapien
aacttctgcatctgcctgatcatat

SEQ ID NO: 186619 - DNA, 25 bp, Homo sapien
tgcatctgcctgatcatatttaaag

SEQ ID NO: 186620 - DNA, 25 bp, Homo sapien
atctgcccagtaaataccagctcgt

SEQ ID NO: 186621 - DNA, 25 bp, Homo sapien
taccagctcgtagcagttggcaggt

SEQ ID NO: 186622 - DNA, 25 bp, Homo sapien
gttggcaggtgcatgtctagataaa

SEQ ID NO: 186623 - DNA, 25 bp, Homo sapien
aatttaaactttctacacgcaccag

SEQ ID NO: 186624 - DNA, 25 bp, Homo sapien
tacacgcaccagtagataatctcaa

SEQ ID NO: 186625 - DNA, 25 bp, Homo sapien
gatcttgacttatattctgtaccac

SEQ ID NO: 186626 - DNA, 25 bp, Homo sapien
attctgtaccacatacacttctgtg

SEQ ID NO: 186627 - DNA, 25 bp, Homo sapien
atacacttctgtggacttttagcat

SEQ ID NO: 186628 - DNA, 25 bp, Homo sapien
ttaggattccaaaaatgtcaagttt

SEQ ID NO: 186629 - DNA, 25 bp, Homo sapien
tgtcaagtttgagttccagaggaat

SEQ ID NO: 186630 - DNA, 25 bp, Homo sapien
ttcttagaacctagcacccattttc

SEQ ID NO: 186631 - DNA, 25 bp, Homo sapien
gtgatttttcactgttttgctattc

SEQ ID NO: 186632 - DNA, 25 bp, Homo sapien
gctattcagccacttatctgatgaa

SEQ ID NO: 186633 - DNA, 25 bp, Homo sapien
gccacttatctgatgaataaaacca

SEQ ID NO: 186634 - DNA, 25 bp, Homo sapien
gagagttttttgaaagcaaatcatt

SEQ ID NO: 186635 - DNA, 25 bp, Homo sapien
cattctgtatatatgctctccagcc

SEQ ID NO: 186636 - DNA, 25 bp, Homo sapien
tctgtatatatgctctccagcctct

SEQ ID NO: 186637 - DNA, 25 bp, Homo sapien
gcctctgacacaagatgcgttctta

SEQ ID NO: 186638 - DNA, 25 bp, Homo sapien
gatgcgttcttaatacagacttgtt

SEQ ID NO: 186639 - DNA, 25 bp, Homo sapien
tgatgtgatttctaccaaatccagt

SEQ ID NO: 186640 - DNA, 25 bp, Homo sapien
gtgatttctaccaaatccagttttg

SEQ ID NO: 186641 - DNA, 25 bp, Homo sapien
gttttggtcctactaaatatactct

SEQ ID NO: 186642 - DNA, 25 bp, Homo sapien
ggtcctactaaatatactcttttga

SEQ ID NO: 186643 - DNA, 25 bp, Homo sapien
atactcttttgagactggcctcttt

SEQ ID NO: 186644 - DNA, 25 bp, Homo sapien
tttgagactggcctcttttactcac

SEQ ID NO: 186645 - DNA, 25 bp, Homo sapien
tggcctcttttactcaccataatgc

SEQ ID NO: 186646 - DNA, 25 bp, Homo sapien
ttttactcaccataatgcctttgta

SEQ ID NO: 186647 - DNA, 25 bp, Homo sapien
atgcctttgtaattcatccatgctg

SEQ ID NO: 186648 - DNA, 25 bp, Homo sapien
catgctgttgtgtgtatcagcagtt

SEQ ID NO: 186649 - DNA, 25 bp, Homo sapien
tctattgtagagatgtaccacagtt

SEQ ID NO: 186650 - DNA, 25 bp, Homo sapien
ccctgtgtgacatcaggagcagaac

SEQ ID NO: 186651 - DNA, 25 bp, Homo sapien
cctgtgtgacatcaggagcagaaca

SEQ ID NO: 186652 - DNA, 25 bp, Homo sapien
ctcagaggacagtgcacaggctagc

SEQ ID NO: 186653 - DNA, 25 bp, Homo sapien
tcagaggacagtgcacaggctagcc

SEQ ID NO: 186654 - DNA, 25 bp, Homo sapien
cagaggacagtgcacaggctagcct

SEQ ID NO: 186655 - DNA, 25 bp, Homo sapien
agaggacagtgcacaggctagcctg

SEQ ID NO: 186656 - DNA, 25 bp, Homo sapien
acagtgcacaggctagcctggagct

SEQ ID NO: 186657 - DNA, 25 bp, Homo sapien
agtgcacaggctagcctggagctca

SEQ ID NO: 186658 - DNA, 25 bp, Homo sapien
cacaggctagcctggagctcaccag

SEQ ID NO: 186659 - DNA, 25 bp, Homo sapien
acaggctagcctggagctcaccagg

SEQ ID NO: 186660 - DNA, 25 bp, Homo sapien
aggctagcctggagctcaccaggcc

SEQ ID NO: 186661 - DNA, 25 bp, Homo sapien
taccccagagggagttgtcacgcta

SEQ ID NO: 186662 - DNA, 25 bp, Homo sapien
tcacgctacagtgagtggctggcct

SEQ ID NO: 186663 - DNA, 25 bp, Homo sapien
tggctggccttttaaatcgacgtct

SEQ ID NO: 186664 - DNA, 25 bp, Homo sapien
gacgtctctctcaccaggatttggt

SEQ ID NO: 186665 - DNA, 25 bp, Homo sapien
ccaggatttggtgtttagctgtttc

SEQ ID NO: 186666 - DNA, 25 bp, Homo sapien
ctgtttctctctttaatctcacgta

SEQ ID NO: 186667 - DNA, 25 bp, Homo sapien
ttaatctcacgtagcctttttcagg

SEQ ID NO: 186668 - DNA, 25 bp, Homo sapien
gtagcctttttcaggttagtacgtg

SEQ ID NO: 186669 - DNA, 25 bp, Homo sapien
ttagtacgtgttcttctgtcagggc

SEQ ID NO: 186670 - DNA, 25 bp, Homo sapien
ctgtcagggccaaaactcaaatctc

SEQ ID NO: 186671 - DNA, 25 bp, Homo sapien
gataaagcggatcgttctcaggccc

SEQ ID NO: 186672 - DNA, 25 bp, Homo sapien
gcacggcgacgctcagcaacgggaa

SEQ ID NO: 186673 - DNA, 25 bp, Homo sapien
acggcgacgctcagcaacgggaagc

SEQ ID NO: 186674 - DNA, 25 bp, Homo sapien
cggcgacgctcagcaacgggaagct

SEQ ID NO: 186675 - DNA, 25 bp, Homo sapien
gggagcccgaccagctcgcgcagag

SEQ ID NO: 186676 - DNA, 25 bp, Homo sapien
accagctcgcgcagagactggcgca

SEQ ID NO: 186677 - DNA, 25 bp, Homo sapien
gcggctgcacgcacatccgcgtctg

SEQ ID NO: 186678 - DNA, 25 bp, Homo sapien
gcacatccgcgtctgccccgagtgc

SEQ ID NO: 186679 - DNA, 25 bp, Homo sapien
agcctggagtgggagaaaaccacca

SEQ ID NO: 186680 - DNA, 25 bp, Homo sapien
gagaaaaccaccaacagcagcgagc

SEQ ID NO: 186681 - DNA, 25 bp, Homo sapien
agaaaaccaccaacagcagcgagcc

SEQ ID NO: 186682 - DNA, 25 bp, Homo sapien
caccaacagcagcgagcccgagtag

SEQ ID NO: 186683 - DNA, 25 bp, Homo sapien
atattgagaagcctagcttcacttg

SEQ ID NO: 186684 - DNA, 25 bp, Homo sapien
cttgggaaaatctgtggctgttcac

SEQ ID NO: 186685 - DNA, 25 bp, Homo sapien
tgtggctgttcacagaaattcagca

SEQ ID NO: 186686 - DNA, 25 bp, Homo sapien
gaaattcagcaccaagttattcccc

SEQ ID NO: 186687 - DNA, 25 bp, Homo sapien
caggccttcaggtcctcataaagaa

SEQ ID NO: 186688 - DNA, 25 bp, Homo sapien
ggtcctcataaagaaaagtgtcgtt

SEQ ID NO: 186689 - DNA, 25 bp, Homo sapien
gaaaagtgtcgttttcagattagga

SEQ ID NO: 186690 - DNA, 25 bp, Homo sapien
ggtgcatcaaatctacagtcacaca

SEQ ID NO: 186691 - DNA, 25 bp, Homo sapien
atgaaagcctactcattctcatctt

SEQ ID NO: 186692 - DNA, 25 bp, Homo sapien
ctcattctcatctttaagccagaga

SEQ ID NO: 186693 - DNA, 25 bp, Homo sapien
tgaggtctctggatagctatttaaa

SEQ ID NO: 186694 - DNA, 25 bp, Homo sapien
gttctgggctgggatcctggctcca

SEQ ID NO: 186695 - DNA, 25 bp, Homo sapien
ggccatgtccagggctctggtgttt

SEQ ID NO: 186696 - DNA, 25 bp, Homo sapien
tttgcctgggttggtgcatgttgat

SEQ ID NO: 186697 - DNA, 25 bp, Homo sapien
gctgcaggcaggtgtgaccatctct

SEQ ID NO: 186698 - DNA, 25 bp, Homo sapien
aggcaggtgtgaccatctctcgtgc

SEQ ID NO: 186699 - DNA, 25 bp, Homo sapien
aggtgtgaccatctctcgtgcctgc

SEQ ID NO: 186700 - DNA, 25 bp, Homo sapien
ccaggcttttttgctgtgagggagc

SEQ ID NO: 186701 - DNA, 25 bp, Homo sapien
gcttttttgctgtgagggagccacc

SEQ ID NO: 186702 - DNA, 25 bp, Homo sapien
ttttttgctgtgagggagccaccag

SEQ ID NO: 186703 - DNA, 25 bp, Homo sapien
ggcttctctcttaagactctgagat

SEQ ID NO: 186704 - DNA, 25 bp, Homo sapien
ttctctcttaagactctgagattca

SEQ ID NO: 186705 - DNA, 25 bp, Homo sapien
agaacttttgactgtggccctggac

SEQ ID NO: 186706 - DNA, 25 bp, Homo sapien
tggccctggactttgctgtgctcgt

SEQ ID NO: 186707 - DNA, 25 bp, Homo sapien
gaaaatttgtaagccagtccttttg

SEQ ID NO: 186708 - DNA, 25 bp, Homo sapien
agtccttttggagggacaggtctgc

SEQ ID NO: 186709 - DNA, 25 bp, Homo sapien
acaggtctgctccagaagagggcat

SEQ ID NO: 186710 - DNA, 25 bp, Homo sapien
aaagacactgctcaagctccagaaa

SEQ ID NO: 186711 - DNA, 25 bp, Homo sapien
tgctcaagctccagaaatcttccag

SEQ ID NO: 186712 - DNA, 25 bp, Homo sapien
gccctggactactgtgtcgaagcca

SEQ ID NO: 186713 - DNA, 25 bp, Homo sapien
gtcgaagccaattgaccagcaatcg

SEQ ID NO: 186714 - DNA, 25 bp, Homo sapien
cagcaatcggcagcatgctcgatta

SEQ ID NO: 186715 - DNA, 25 bp, Homo sapien
catgctcgattaagagtatgccaaa

SEQ ID NO: 186716 - DNA, 25 bp, Homo sapien
ttgtgatccaataacactttgtatt

SEQ ID NO: 186717 - DNA, 25 bp, Homo sapien
aattgtttagcagccatttgtgttg

SEQ ID NO: 186718 - DNA, 25 bp, Homo sapien
tgtttagcagccatttgtgttgtga

SEQ ID NO: 186719 - DNA, 25 bp, Homo sapien
ggtagaagatctctgaaacttgtct

SEQ ID NO: 186720 - DNA, 25 bp, Homo sapien
attgaactcattccctgttccacaa

SEQ ID NO: 186721 - DNA, 25 bp, Homo sapien
gttccacaaacccatatgtatcctt

SEQ ID NO: 186722 - DNA, 25 bp, Homo sapien
cacaaacccatatgtatcctttcct

SEQ ID NO: 186723 - DNA, 25 bp, Homo sapien
tcctttcccaattaatttcaaccat

SEQ ID NO: 186724 - DNA, 25 bp, Homo sapien
tttcaaccatagtacgatgtttggg

SEQ ID NO: 186725 - DNA, 25 bp, Homo sapien
agaatttatgagttggcttggacaa

SEQ ID NO: 186726 - DNA, 25 bp, Homo sapien
gagttggcttggacaagtttaactt

SEQ ID NO: 186727 - DNA, 25 bp, Homo sapien
caaggactgccgcattggtgatgga

SEQ ID NO: 186728 - DNA, 25 bp, Homo sapien
gcctctgcttgagcacttaggtgac

SEQ ID NO: 186729 - DNA, 25 bp, Homo sapien
cacttaggtgacaggaacttccgca

SEQ ID NO: 186730 - DNA, 25 bp, Homo sapien
tgacaggaacttccgcacctcctga

SEQ ID NO: 186731 - DNA, 25 bp, Homo sapien
ctcctgaggccctggatgattctaa

SEQ ID NO: 186732 - DNA, 25 bp, Homo sapien
ggccctggatgattctaattgttag

SEQ ID NO: 186733 - DNA, 25 bp, Homo sapien
gttagaaatccttccttataatgaa

SEQ ID NO: 186734 - DNA, 25 bp, Homo sapien
ttctgctttcctataatttctacct

SEQ ID NO: 186735 - DNA, 25 bp, Homo sapien
cctataatttctacctattgggcct

SEQ ID NO: 186736 - DNA, 25 bp, Homo sapien
tacctattgggccttgttctgttct

SEQ ID NO: 186737 - DNA, 25 bp, Homo sapien
gccttgttctgttctctggaactaa

SEQ ID NO: 186738 - DNA, 25 bp, Homo sapien
aaggtccgcctgctgccacagggtc

SEQ ID NO: 186739 - DNA, 25 bp, Homo sapien
tgctgccacagggtcaaaggaggtt

SEQ ID NO: 186740 - DNA, 25 bp, Homo sapien
tgccacagggtcaaaggaggttttc

SEQ ID NO: 186741 - DNA, 25 bp, Homo sapien
cagggtcaaaggaggttttcgatca

SEQ ID NO: 186742 - DNA, 25 bp, Homo sapien
gtcaaaggaggttttcgatcagccc

SEQ ID NO: 186743 - DNA, 25 bp, Homo sapien
caaaggaggttttcgatcagcccag

SEQ ID NO: 186744 - DNA, 25 bp, Homo sapien
aaggaggttttcgatcagcccagac

SEQ ID NO: 186745 - DNA, 25 bp, Homo sapien
aggaggttttcgatcagcccagacc

SEQ ID NO: 186746 - DNA, 25 bp, Homo sapien
gaggttttcgatcagcccagaccag

SEQ ID NO: 186747 - DNA, 25 bp, Homo sapien
ggttttcgatcagcccagaccagag

SEQ ID NO: 186748 - DNA, 25 bp, Homo sapien
tttcgatcagcccagaccagaggct

SEQ ID NO: 186749 - DNA, 25 bp, Homo sapien
ctctacctttctaatggcggcatga

SEQ ID NO: 186750 - DNA, 25 bp, Homo sapien
aatggcggcatgatgtgtaaactct

SEQ ID NO: 186751 - DNA, 25 bp, Homo sapien
catgatgtgtaaactctgtgcaggg

SEQ ID NO: 186752 - DNA, 25 bp, Homo sapien
gggcgggtctaactgtcttaacatt

SEQ ID NO: 186753 - DNA, 25 bp, Homo sapien
gggtctaactgtcttaacattcaag

SEQ ID NO: 186754 - DNA, 25 bp, Homo sapien
ttaacattcaagtcactgctcttca

SEQ ID NO: 186755 - DNA, 25 bp, Homo sapien
ttcagaatacactctagacccaaag

SEQ ID NO: 186756 - DNA, 25 bp, Homo sapien
agacccaaaggtgtgctaatcactt

SEQ ID NO: 186757 - DNA, 25 bp, Homo sapien
aggtgtgctaatcacttcacagtga

SEQ ID NO: 186758 - DNA, 25 bp, Homo sapien
cacagtgaccactacagagtactaa

SEQ ID NO: 186759 - DNA, 25 bp, Homo sapien
tgagttgatgtacccttatatatat

SEQ ID NO: 186760 - DNA, 25 bp, Homo sapien
aaatcgagcgctttggcctcttctg

SEQ ID NO: 186761 - DNA, 25 bp, Homo sapien
gagcgctttggcctcttctgtgcag

SEQ ID NO: 186762 - DNA, 25 bp, Homo sapien
tttggcctcttctgtgcagcatcca

SEQ ID NO: 186763 - DNA, 25 bp, Homo sapien
tcccggagacctctgcagccgtggt

SEQ ID NO: 186764 - DNA, 25 bp, Homo sapien
gagacctctgcagccgtggtggtca

SEQ ID NO: 186765 - DNA, 25 bp, Homo sapien
acctctgcagccgtggtggtcagag

SEQ ID NO: 186766 - DNA, 25 bp, Homo sapien
ccgtggtggtcagaggctgctcacc

SEQ ID NO: 186767 - DNA, 25 bp, Homo sapien
tcacctcactccctctgtcttatga

SEQ ID NO: 186768 - DNA, 25 bp, Homo sapien
tcatctaaagacaccttcctttcca

SEQ ID NO: 186769 - DNA, 25 bp, Homo sapien
tttccactggctgtcaagccacagg

SEQ ID NO: 186770 - DNA, 25 bp, Homo sapien
cactggctgtcaagccacagggcac

SEQ ID NO: 186771 - DNA, 25 bp, Homo sapien
ttttggggggtcaccagccactcca

SEQ ID NO: 186772 - DNA, 25 bp, Homo sapien
gggcagggaccatttcttcattttc

SEQ ID NO: 186773 - DNA, 25 bp, Homo sapien
ggcagggaccatttcttcattttct

SEQ ID NO: 186774 - DNA, 25 bp, Homo sapien
gcagggaccatttcttcattttctg

SEQ ID NO: 186775 - DNA, 25 bp, Homo sapien
agggaccatttcttcattttctgaa

SEQ ID NO: 186776 - DNA, 25 bp, Homo sapien
ctgaaagcactttaatgattcccct

SEQ ID NO: 186777 - DNA, 25 bp, Homo sapien
gaaagcactttaatgattccccttc

SEQ ID NO: 186778 - DNA, 25 bp, Homo sapien
ttcccccaaactccagggaatggag

SEQ ID NO: 186779 - DNA, 25 bp, Homo sapien
gccccttgcttgcatctgtatatag

SEQ ID NO: 186780 - DNA, 25 bp, Homo sapien
agtgtgagcagcaagtaacccttct

SEQ ID NO: 186781 - DNA, 25 bp, Homo sapien
tgagcagcaagtaacccttctccct

SEQ ID NO: 186782 - DNA, 25 bp, Homo sapien
tatgttggtttccttgtttcttcac

SEQ ID NO: 186783 - DNA, 25 bp, Homo sapien
tcacaattttattggatcccttttt

SEQ ID NO: 186784 - DNA, 25 bp, Homo sapien
tttttgaacttctctactcctgtag

SEQ ID NO: 186785 - DNA, 25 bp, Homo sapien
ctactcctgtagttttgtttgatgc

SEQ ID NO: 186786 - DNA, 25 bp, Homo sapien
tgatgccttgacatggtttggctat

SEQ ID NO: 186787 - DNA, 25 bp, Homo sapien
ggtttggctattttaactccacatg

SEQ ID NO: 186788 - DNA, 25 bp, Homo sapien
aactccacatgtaatccgttaatat

SEQ ID NO: 186789 - DNA, 25 bp, Homo sapien
aatatatggtttcttctatccctgg

SEQ ID NO: 186790 - DNA, 25 bp, Homo sapien
tatccctggtttcgcagagcactga

SEQ ID NO: 186791 - DNA, 25 bp, Homo sapien
gcactgaagtacattttgctaggta

SEQ ID NO: 186792 - DNA, 25 bp, Homo sapien
ttttcagctcatgtttccataatac

SEQ ID NO: 186793 - DNA, 25 bp, Homo sapien
agggacggtttacggacgtgcagct

SEQ ID NO: 186794 - DNA, 25 bp, Homo sapien
tgcagctgagctgtccgtgtcccat

SEQ ID NO: 186795 - DNA, 25 bp, Homo sapien
tcagccagtggaacgtgccggaact

SEQ ID NO: 186796 - DNA, 25 bp, Homo sapien
gaacgtgccggaactttttgtccat

SEQ ID NO: 186797 - DNA, 25 bp, Homo sapien
tttgtccattccctagtaggcctgc

SEQ ID NO: 186798 - DNA, 25 bp, Homo sapien
tagtaggcctgccacagcctagatg

SEQ ID NO: 186799 - DNA, 25 bp, Homo sapien
gccacagcctagatgggcagttttt

SEQ ID NO: 186800 - DNA, 25 bp, Homo sapien
gttttcttttcttgcactgatcttt

SEQ ID NO: 186801 - DNA, 25 bp, Homo sapien
tccttctgtgactccagtgactcag

SEQ ID NO: 186802 - DNA, 25 bp, Homo sapien
gtgactccagtgactcagacgttag

SEQ ID NO: 186803 - DNA, 25 bp, Homo sapien
gtgactcagacgttagacctcttga

SEQ ID NO: 186804 - DNA, 25 bp, Homo sapien
ctctacagcattttaaggaacattt

SEQ ID NO: 186805 - DNA, 25 bp, Homo sapien
aaacctggtaagaagatctaatgca

SEQ ID NO: 186806 - DNA, 25 bp, Homo sapien
gatctaatgcatcctatatccagta

SEQ ID NO: 186807 - DNA, 25 bp, Homo sapien
atgcatcctatatccagtaagtaga

SEQ ID NO: 186808 - DNA, 25 bp, Homo sapien
tctgggacctggaaatcctgaaata

SEQ ID NO: 186809 - DNA, 25 bp, Homo sapien
cagttgcaggaaagtatgttagcta

SEQ ID NO: 186810 - DNA, 25 bp, Homo sapien
gctatatactatgaagtactcttag

SEQ ID NO: 186811 - DNA, 25 bp, Homo sapien
gtactcttagtttacttatgttgaa

SEQ ID NO: 186812 - DNA, 25 bp, Homo sapien
tacttatgttgaatggcttagctat

SEQ ID NO: 186813 - DNA, 25 bp, Homo sapien
gtattacatttcatggtacattagt

SEQ ID NO: 186814 - DNA, 25 bp, Homo sapien
tttcatggtacattagtagttcttt

SEQ ID NO: 186815 - DNA, 25 bp, Homo sapien
gcaaaagacgatgccacattgtcag

SEQ ID NO: 186816 - DNA, 25 bp, Homo sapien
aagacgatgccacattgtcaggaaa

SEQ ID NO: 186817 - DNA, 25 bp, Homo sapien
atgccacattgtcaggaaaacgaat

SEQ ID NO: 186818 - DNA, 25 bp, Homo sapien
gaaaacgaatgcagtcactctccct

SEQ ID NO: 186819 - DNA, 25 bp, Homo sapien
gaatgcagtcactctccctgaataa

SEQ ID NO: 186820 - DNA, 25 bp, Homo sapien
tgcagtcactctccctgaataagta

SEQ ID NO: 186821 - DNA, 25 bp, Homo sapien
gtcactctccctgaataagtaactg

SEQ ID NO: 186822 - DNA, 25 bp, Homo sapien
ctctccctgaataagtaactgcgac

SEQ ID NO: 186823 - DNA, 25 bp, Homo sapien
gaataagtaactgcgacccgtggga

SEQ ID NO: 186824 - DNA, 25 bp, Homo sapien
taagtaactgcgacccgtgggagga

SEQ ID NO: 186825 - DNA, 25 bp, Homo sapien
tgcaacagcccctcatggccaggag

SEQ ID NO: 186826 - DNA, 25 bp, Homo sapien
gctcaaccttcctcatcatggagta

SEQ ID NO: 186827 - DNA, 25 bp, Homo sapien
tcaaccttcctcatcatggagtaag

SEQ ID NO: 186828 - DNA, 25 bp, Homo sapien
accttcctcatcatggagtaagaaa

SEQ ID NO: 186829 - DNA, 25 bp, Homo sapien
ctcatcatggagtaagaaaattcta

SEQ ID NO: 186830 - DNA, 25 bp, Homo sapien
taaagaatccatgtaagtctaattt

SEQ ID NO: 186831 - DNA, 25 bp, Homo sapien
gaatccatgtaagtctaattttaaa

SEQ ID NO: 186832 - DNA, 25 bp, Homo sapien
aatgaagtatttatgaactgtgata

SEQ ID NO: 186833 - DNA, 25 bp, Homo sapien
gaactgtgataaagcatcaaatctt

SEQ ID NO: 186834 - DNA, 25 bp, Homo sapien
tgatgaaggattgtagatttttgct

SEQ ID NO: 186835 - DNA, 25 bp, Homo sapien
taaaacttattccaattgctaaatt

SEQ ID NO: 186836 - DNA, 25 bp, Homo sapien
tttcagtctttataaatacaggatt

SEQ ID NO: 186837 - DNA, 25 bp, Homo sapien
tataaacaggttgctataagcttgg

SEQ ID NO: 186838 - DNA, 25 bp, Homo sapien
aacaggttgctataagcttggtgaa

SEQ ID NO: 186839 - DNA, 25 bp, Homo sapien
gttgctataagcttggtgaaatgaa

SEQ ID NO: 186840 - DNA, 25 bp, Homo sapien
atatttacaatttggtttctgcaat

SEQ ID NO: 186841 - DNA, 25 bp, Homo sapien
tacaatttggtttctgcaatatttt

SEQ ID NO: 186842 - DNA, 25 bp, Homo sapien
tttcttatagagatatttcttacag

SEQ ID NO: 186843 - DNA, 25 bp, Homo sapien
tttcttacagaaagctttgtagcag

SEQ ID NO: 186844 - DNA, 25 bp, Homo sapien
tacagaaagctttgtagcagaatat

SEQ ID NO: 186845 - DNA, 25 bp, Homo sapien
gcagaatatatttgcagctattgac

SEQ ID NO: 186846 - DNA, 25 bp, Homo sapien
atatttgcagctattgactttgtaa

SEQ ID NO: 186847 - DNA, 25 bp, Homo sapien
gcagctattgactttgtaatttagg

SEQ ID NO: 186848 - DNA, 25 bp, Homo sapien
cttccttcctatctatctgcaaaat

SEQ ID NO: 186849 - DNA, 25 bp, Homo sapien
gaaatctagacctccttcttcatcc

SEQ ID NO: 186850 - DNA, 25 bp, Homo sapien
atccataagtggactgtgccagtac

SEQ ID NO: 186851 - DNA, 25 bp, Homo sapien
gtgccagtacaatacatgcctcagc

SEQ ID NO: 186852 - DNA, 25 bp, Homo sapien
agcctagaaggacctctagtctcct

SEQ ID NO: 186853 - DNA, 25 bp, Homo sapien
atccctcccaagttgcctgtattga

SEQ ID NO: 186854 - DNA, 25 bp, Homo sapien
ttgataatgtactcactcatgctgt

SEQ ID NO: 186855 - DNA, 25 bp, Homo sapien
cactcatgctgtactaggtgctgaa

SEQ ID NO: 186856 - DNA, 25 bp, Homo sapien
tgctgaagcctggacacccttggtg

SEQ ID NO: 186857 - DNA, 25 bp, Homo sapien
ggtgatggtttgcatccttcctcct

SEQ ID NO: 186858 - DNA, 25 bp, Homo sapien
ttcctcctttgtcccaataaagtat

SEQ ID NO: 186859 - DNA, 25 bp, Homo sapien
gcggatgcggcatgtgatcagctac

SEQ ID NO: 186860 - DNA, 25 bp, Homo sapien
tgatcagctacagcttgtcaccgtt

SEQ ID NO: 186861 - DNA, 25 bp, Homo sapien
agcttgtcaccgttcgagcagcgcg

SEQ ID NO: 186862 - DNA, 25 bp, Homo sapien
tatccgcacgtcttcactaaaggaa

SEQ ID NO: 186863 - DNA, 25 bp, Homo sapien
taaaggaatccccaatgttctgcgc

SEQ ID NO: 186864 - DNA, 25 bp, Homo sapien
gttctgcgccgcattcgggagtctt

SEQ ID NO: 186865 - DNA, 25 bp, Homo sapien
attcgggagtctttctttcgcgtgg

SEQ ID NO: 186866 - DNA, 25 bp, Homo sapien
ctttcgcgtggtgccgcagtttgta

SEQ ID NO: 186867 - DNA, 25 bp, Homo sapien
gaggaggatccagctgcctatgaaa

SEQ ID NO: 186868 - DNA, 25 bp, Homo sapien
aaatgagcaacgcatccggatgacg

SEQ ID NO: 186869 - DNA, 25 bp, Homo sapien
tgtctctgaaagacctttctctgga

SEQ ID NO: 186870 - DNA, 25 bp, Homo sapien
gggaaaatgcttgtgtcgcctttgg

SEQ ID NO: 186871 - DNA, 25 bp, Homo sapien
gcttgtgtcgcctttggtgggccat

SEQ ID NO: 186872 - DNA, 25 bp, Homo sapien
tggtgggccatgtcctaattagttt

SEQ ID NO: 186873 - DNA, 25 bp, Homo sapien
agtttcatctgcttccctgggaact

SEQ ID NO: 186874 - DNA, 25 bp, Homo sapien
tgcttccctgggaacttactaaggg

SEQ ID NO: 186875 - DNA, 25 bp, Homo sapien
ggcccagagcactgttggaagtctg

SEQ ID NO: 186876 - DNA, 25 bp, Homo sapien
tggaagtctggttagagtccccaga

SEQ ID NO: 186877 - DNA, 25 bp, Homo sapien
gagtccccagagagttactctaagt

SEQ ID NO: 186878 - DNA, 25 bp, Homo sapien
aagttaaaatgagccactgaccttg

SEQ ID NO: 186879 - DNA, 25 bp, Homo sapien
tgaccttggctcaccttagaggaat

SEQ ID NO: 186880 - DNA, 25 bp, Homo sapien
gaggaatttcctcgagaacaacaga

SEQ ID NO: 186881 - DNA, 25 bp, Homo sapien
gtacacacgatgatagcttcaagga

SEQ ID NO: 186882 - DNA, 25 bp, Homo sapien
ggaatacaactgactttatgatatg

SEQ ID NO: 186883 - DNA, 25 bp, Homo sapien
gaattttcaaggaacgtatcttata

SEQ ID NO: 186884 - DNA, 25 bp, Homo sapien
ggaacgtatcttatatggattttga

SEQ ID NO: 186885 - DNA, 25 bp, Homo sapien
gaatcttgtttgcttataagaactt

SEQ ID NO: 186886 - DNA, 25 bp, Homo sapien
gaacttcaagaagcctaagcttggc

SEQ ID NO: 186887 - DNA, 25 bp, Homo sapien
gaagcctaagcttggctttaatttt

SEQ ID NO: 186888 - DNA, 25 bp, Homo sapien
tttcttgtactctctgtactcctca

SEQ ID NO: 186889 - DNA, 25 bp, Homo sapien
gtactcctcaagcactggaacacga

SEQ ID NO: 186890 - DNA, 25 bp, Homo sapien
cactggaacacgatcctctttctgg

SEQ ID NO: 186891 - DNA, 25 bp, Homo sapien
aatatgagacatactgttactaaac

SEQ ID NO: 186892 - DNA, 25 bp, Homo sapien
ttgacaatttgcctgactcattcct

SEQ ID NO: 186893 - DNA, 25 bp, Homo sapien
aatttgcctgactcattcctgacct

SEQ ID NO: 186894 - DNA, 25 bp, Homo sapien
tgacctcttgtcattttggcctgaa

SEQ ID NO: 186895 - DNA, 25 bp, Homo sapien
gtcattttggcctgaaggctacaaa

SEQ ID NO: 186896 - DNA, 25 bp, Homo sapien
ggctacaaattcagggtcagctgta

SEQ ID NO: 186897 - DNA, 25 bp, Homo sapien
gggtcagctgtatgcactaagtcaa

SEQ ID NO: 186898 - DNA, 25 bp, Homo sapien
caaataatgaatttcttcctccctc

SEQ ID NO: 186899 - DNA, 25 bp, Homo sapien
ctctcgcaaccgaccaaaattttga

SEQ ID NO: 186900 - DNA, 25 bp, Homo sapien
gacaacgatgatgttcaccagaagg

SEQ ID NO: 186901 - DNA, 25 bp, Homo sapien
atcagttttatgcactttattttgt

SEQ ID NO: 186902 - DNA, 25 bp, Homo sapien
aatttaccttctctgtatatatgtg

SEQ ID NO: 186903 - DNA, 25 bp, Homo sapien
ttacggatacatgtggcaacacagg

SEQ ID NO: 186904 - DNA, 25 bp, Homo sapien
ggcaacacaggtaaactacacagac

SEQ ID NO: 186905 - DNA, 25 bp, Homo sapien
gttgaatgaaagaagccaggccgaa

SEQ ID NO: 186906 - DNA, 25 bp, Homo sapien
gaagccaggccgaagttccatttat

SEQ ID NO: 186907 - DNA, 25 bp, Homo sapien
ggccgaagttccatttatgcagagt

SEQ ID NO: 186908 - DNA, 25 bp, Homo sapien
ccatttatgcagagttcaggaacag

SEQ ID NO: 186909 - DNA, 25 bp, Homo sapien
ggaacaggcaagactaattgacaat

SEQ ID NO: 186910 - DNA, 25 bp, Homo sapien
aagttggaatagtggttacttctgg

SEQ ID NO: 186911 - DNA, 25 bp, Homo sapien
cttggtgtaccagaaatgttgattt

SEQ ID NO: 186912 - DNA, 25 bp, Homo sapien
aaatgttgattttgatctgggcagt

SEQ ID NO: 186913 - DNA, 25 bp, Homo sapien
tgattttgatctgggcagtggtttc

SEQ ID NO: 186914 - DNA, 25 bp, Homo sapien
aaaatgatagagatggcttccccaa

SEQ ID NO: 186915 - DNA, 25 bp, Homo sapien
gcttccccaagtacttccagattgg

SEQ ID NO: 186916 - DNA, 25 bp, Homo sapien
ggaaccattgttgacaatccagctg

SEQ ID NO: 186917 - DNA, 25 bp, Homo sapien
tgacaatccagctgatttctaccat

SEQ ID NO: 186918 - DNA, 25 bp, Homo sapien
tttctaccattcacgaattcccaag

SEQ ID NO: 186919 - DNA, 25 bp, Homo sapien
gaactattgtggaagactgctggct

SEQ ID NO: 186920 - DNA, 25 bp, Homo sapien
agactgctggctgattctgaattca

SEQ ID NO: 186921 - DNA, 25 bp, Homo sapien
gatacaaccgaaggaagtactcaga

SEQ ID NO: 186922 - DNA, 25 bp, Homo sapien
gaagtactcagagatcatggctgaa

SEQ ID NO: 186923 - DNA, 25 bp, Homo sapien
atttcgcaattaagatttaccaagc

SEQ ID NO: 186924 - DNA, 25 bp, Homo sapien
actgcaacattttacattgctcctt

SEQ ID NO: 186925 - DNA, 25 bp, Homo sapien
gaaggaaggcttcacctttgagtac

SEQ ID NO: 186926 - DNA, 25 bp, Homo sapien
ggaaggcttcacctttgagtaccgc

SEQ ID NO: 186927 - DNA, 25 bp, Homo sapien
aaggcttcacctttgagtaccgcta

SEQ ID NO: 186928 - DNA, 25 bp, Homo sapien
aggcttcacctttgagtaccgctac

SEQ ID NO: 186929 - DNA, 25 bp, Homo sapien
tcacctttgagtaccgctacctgga

SEQ ID NO: 186930 - DNA, 25 bp, Homo sapien
ctttgagtaccgctacctggaggac

SEQ ID NO: 186931 - DNA, 25 bp, Homo sapien
ttgagtaccgctacctggaggaccg

SEQ ID NO: 186932 - DNA, 25 bp, Homo sapien
aggaccgggacctccagtgacaccg

SEQ ID NO: 186933 - DNA, 25 bp, Homo sapien
agggccctgccctggaagactggag

SEQ ID NO: 186934 - DNA, 25 bp, Homo sapien
aagactggagggaggccccaagcca

SEQ ID NO: 186935 - DNA, 25 bp, Homo sapien
cctccccagtgagggacattttttg

SEQ ID NO: 186936 - DNA, 25 bp, Homo sapien
aagaaggaaggcttcacctttgagt

SEQ ID NO: 186937 - DNA, 25 bp, Homo sapien
agaaggaaggcttcacctttgagta

SEQ ID NO: 186938 - DNA, 25 bp, Homo sapien
gaaggaaggcttcacctttgagtac

SEQ ID NO: 186939 - DNA, 25 bp, Homo sapien
aggaaggcttcacctttgagtaccg

SEQ ID NO: 186940 - DNA, 25 bp, Homo sapien
ggaaggcttcacctttgagtaccgc

SEQ ID NO: 186941 - DNA, 25 bp, Homo sapien
gaaggcttcacctttgagtaccgct

SEQ ID NO: 186942 - DNA, 25 bp, Homo sapien
aaggcttcacctttgagtaccgcta

SEQ ID NO: 186943 - DNA, 25 bp, Homo sapien
aggcttcacctttgagtaccgctac

SEQ ID NO: 186944 - DNA, 25 bp, Homo sapien
gcttcacctttgagtaccgctacct

SEQ ID NO: 186945 - DNA, 25 bp, Homo sapien
gaccgggacctccagtgacaccggc

SEQ ID NO: 186946 - DNA, 25 bp, Homo sapien
gggacctccagtgacaccggcccct

SEQ ID NO: 186947 - DNA, 25 bp, Homo sapien
tgttgttgttctggagagcttctag

SEQ ID NO: 186948 - DNA, 25 bp, Homo sapien
ctggagagcttctaggaacttgaaa

SEQ ID NO: 186949 - DNA, 25 bp, Homo sapien
atatgccacactcttaagacccggt

SEQ ID NO: 186950 - DNA, 25 bp, Homo sapien
gacccggtggttcttaatcagggat

SEQ ID NO: 186951 - DNA, 25 bp, Homo sapien
actgtaaagacttccaggtcccatc

SEQ ID NO: 186952 - DNA, 25 bp, Homo sapien
ggtcccatccaaggagattttgctt

SEQ ID NO: 186953 - DNA, 25 bp, Homo sapien
gattttgcttctgattgactggcta

SEQ ID NO: 186954 - DNA, 25 bp, Homo sapien
tgattgactggctagtggcctggcc

SEQ ID NO: 186955 - DNA, 25 bp, Homo sapien
gtggcctggccattggtattttgaa

SEQ ID NO: 186956 - DNA, 25 bp, Homo sapien
gaaaaatccctccaagtgattcttt

SEQ ID NO: 186957 - DNA, 25 bp, Homo sapien
ttacatcccagatagaaaaccctaa

SEQ ID NO: 186958 - DNA, 25 bp, Homo sapien
gggagaactgtcaaaggtcaccaaa

SEQ ID NO: 186959 - DNA, 25 bp, Homo sapien
gaaaacagatcgacctttaccggag

SEQ ID NO: 186960 - DNA, 25 bp, Homo sapien
ttaccggagaatccctatcactcaa

SEQ ID NO: 186961 - DNA, 25 bp, Homo sapien
atcactcaagaccaagaccggatcc

SEQ ID NO: 186962 - DNA, 25 bp, Homo sapien
atcgagggagatctgcagcctgcca

SEQ ID NO: 186963 - DNA, 25 bp, Homo sapien
atggcagccgcttttatttctggac

SEQ ID NO: 186964 - DNA, 25 bp, Homo sapien
gtaaagatgggtccgtggcccacac

SEQ ID NO: 186965 - DNA, 25 bp, Homo sapien
acactcggtcatgtgctcagacaac

SEQ ID NO: 186966 - DNA, 25 bp, Homo sapien
gacaacgactgatgaaaacgcccat

SEQ ID NO: 186967 - DNA, 25 bp, Homo sapien
atgaaaacgcccatgcggtttgcat

SEQ ID NO: 186968 - DNA, 25 bp, Homo sapien
atgcggtttgcatcgactgatagtg

SEQ ID NO: 186969 - DNA, 25 bp, Homo sapien
gtggcactgaagcttcctccaccga

SEQ ID NO: 186970 - DNA, 25 bp, Homo sapien
tgaagcttcctccaccgaccctggg

SEQ ID NO: 186971 - DNA, 25 bp, Homo sapien
catggccaagaagcatgctggcgag

SEQ ID NO: 186972 - DNA, 25 bp, Homo sapien
gcgataagaagctggcggccaagaa

SEQ ID NO: 186973 - DNA, 25 bp, Homo sapien
aaaagacggacaagaagcgggcgct

SEQ ID NO: 186974 - DNA, 25 bp, Homo sapien
aagacggacaagaagcgggcgctgc

SEQ ID NO: 186975 - DNA, 25 bp, Homo sapien
agacggacaagaagcgggcgctgcg

SEQ ID NO: 186976 - DNA, 25 bp, Homo sapien
gctgtagtgggctctcttcctcctt

SEQ ID NO: 186977 - DNA, 25 bp, Homo sapien
gtagtgggctctcttcctccttcca

SEQ ID NO: 186978 - DNA, 25 bp, Homo sapien
cctccaactctgtctctaagttatt

SEQ ID NO: 186979 - DNA, 25 bp, Homo sapien
tccaactctgtctctaagttattta

SEQ ID NO: 186980 - DNA, 25 bp, Homo sapien
ttcgctcatgtaagagtttttaaga

SEQ ID NO: 186981 - DNA, 25 bp, Homo sapien
gtttttaagagagggctgattatca

SEQ ID NO: 186982 - DNA, 25 bp, Homo sapien
gctgattatcacagccctcttttct

SEQ ID NO: 186983 - DNA, 25 bp, Homo sapien
ggaaagtgattctgtgaaaaggaca

SEQ ID NO: 186984 - DNA, 25 bp, Homo sapien
ttaccgagtacacagagtacccaag

SEQ ID NO: 186985 - DNA, 25 bp, Homo sapien
gtacacagagtacccaagtgaagag

SEQ ID NO: 186986 - DNA, 25 bp, Homo sapien
gtacccaagtgaagagaacgtcatg

SEQ ID NO: 186987 - DNA, 25 bp, Homo sapien
gaacgtcatgagtgtaagtgcaaat

SEQ ID NO: 186988 - DNA, 25 bp, Homo sapien
gagtgtaagtgcaaatcagtggaag

SEQ ID NO: 186989 - DNA, 25 bp, Homo sapien
caaatcagtggaaggagcggcaaac

SEQ ID NO: 186990 - DNA, 25 bp, Homo sapien
gaaggagcggcaaactgggacatgc

SEQ ID NO: 186991 - DNA, 25 bp, Homo sapien
gggagttttcttcataatatgcata

SEQ ID NO: 186992 - DNA, 25 bp, Homo sapien
gcatattcatcttgtaatgcataca

SEQ ID NO: 186993 - DNA, 25 bp, Homo sapien
gcatacatagttatcatcctccttc

SEQ ID NO: 186994 - DNA, 25 bp, Homo sapien
ccacatgcttgccagttcttgaagg

SEQ ID NO: 186995 - DNA, 25 bp, Homo sapien
gcttgccagttcttgaagggataaa

SEQ ID NO: 186996 - DNA, 25 bp, Homo sapien
taatgttttacttctctctgttcaa

SEQ ID NO: 186997 - DNA, 25 bp, Homo sapien
gttttacttctctctgttcaattta

SEQ ID NO: 186998 - DNA, 25 bp, Homo sapien
aaatattttggacagttgcttaaca

SEQ ID NO: 186999 - DNA, 25 bp, Homo sapien
ggacagttgcttaacatggtcataa

SEQ ID NO: 187000 - DNA, 25 bp, Homo sapien
catggtcataagaggatttgtacta

SEQ ID NO: 187001 - DNA, 25 bp, Homo sapien
atttctctcactggatagtttttag

SEQ ID NO: 187002 - DNA, 25 bp, Homo sapien
gctgttcacacagcctgccgagtag

SEQ ID NO: 187003 - DNA, 25 bp, Homo sapien
aggctcagccccctaagatttgaaa

SEQ ID NO: 187004 - DNA, 25 bp, Homo sapien
tttgaaacactttaaatggcccatg

SEQ ID NO: 187005 - DNA, 25 bp, Homo sapien
aaatggcccatggtagggttcctgc

SEQ ID NO: 187006 - DNA, 25 bp, Homo sapien
atggcccatggtagggttcctgcta

SEQ ID NO: 187007 - DNA, 25 bp, Homo sapien
cccatggtagggttcctgctaggat

SEQ ID NO: 187008 - DNA, 25 bp, Homo sapien
atggtagggttcctgctaggataaa

SEQ ID NO: 187009 - DNA, 25 bp, Homo sapien
gggttcctgctaggataaaacatta

SEQ ID NO: 187010 - DNA, 25 bp, Homo sapien
ggataaaacattaagtggctgttaa

SEQ ID NO: 187011 - DNA, 25 bp, Homo sapien
aaaaggaggacacgtctctgtgcaa

SEQ ID NO: 187012 - DNA, 25 bp, Homo sapien
aggaggacacgtctctgtgcaaaaa

SEQ ID NO: 187013 - DNA, 25 bp, Homo sapien
gaggagcacaaaggagttagcatta

SEQ ID NO: 187014 - DNA, 25 bp, Homo sapien
agttagcattagtctctactgagca

SEQ ID NO: 187015 - DNA, 25 bp, Homo sapien
tactgagcaattcctattccaacca

SEQ ID NO: 187016 - DNA, 25 bp, Homo sapien
tccaaccacgccctaaatgatgagt

SEQ ID NO: 187017 - DNA, 25 bp, Homo sapien
atgatgagttggatcctagcagaaa

SEQ ID NO: 187018 - DNA, 25 bp, Homo sapien
ctagcagaaagggaacacatgttat

SEQ ID NO: 187019 - DNA, 25 bp, Homo sapien
gtaacctatcaggagctcttaataa

SEQ ID NO: 187020 - DNA, 25 bp, Homo sapien
aagagatctgtgaccttgcaccctg

SEQ ID NO: 187021 - DNA, 25 bp, Homo sapien
tgaccttgcaccctgagatctcagg

SEQ ID NO: 187022 - DNA, 25 bp, Homo sapien
gagatctcaggctcaattaagagac

SEQ ID NO: 187023 - DNA, 25 bp, Homo sapien
caggcaatgcagtatcagtgcagat

SEQ ID NO: 187024 - DNA, 25 bp, Homo sapien
agccaactataatgtcttcctcaac

SEQ ID NO: 187025 - DNA, 25 bp, Homo sapien
taatgtcttcctcaacagctccaag

SEQ ID NO: 187026 - DNA, 25 bp, Homo sapien
gctccaagctagctgagtggcgtat

SEQ ID NO: 187027 - DNA, 25 bp, Homo sapien
gcgtatgcaggtggagctgaatatt

SEQ ID NO: 187028 - DNA, 25 bp, Homo sapien
gagctgaatattggctctggcctct

SEQ ID NO: 187029 - DNA, 25 bp, Homo sapien
cattggattcaatggtcaaggagaa

SEQ ID NO: 187030 - DNA, 25 bp, Homo sapien
gagaatatttctgagttgctgaaga

SEQ ID NO: 187031 - DNA, 25 bp, Homo sapien
agaagagcaggtgaccctaggcgca

SEQ ID NO: 187032 - DNA, 25 bp, Homo sapien
gcaggtgaccctaggcgcagcctgt

SEQ ID NO: 187033 - DNA, 25 bp, Homo sapien
ctggctggcttagcaatctgagcca

SEQ ID NO: 187034 - DNA, 25 bp, Homo sapien
ttagcaatctgagccaccttcctta

SEQ ID NO: 187035 - DNA, 25 bp, Homo sapien
gggagatttgcagtaccacactttt

SEQ ID NO: 187036 - DNA, 25 bp, Homo sapien
ccacacttttggtctttaagcctga

SEQ ID NO: 187037 - DNA, 25 bp, Homo sapien
aagcctgacctgttagacaaccatc

SEQ ID NO: 187038 - DNA, 25 bp, Homo sapien
catccaaggctggtgactttacgga

SEQ ID NO: 187039 - DNA, 25 bp, Homo sapien
gaagaaagtccaagccattcctgcc

SEQ ID NO: 187040 - DNA, 25 bp, Homo sapien
cctgccgtcgctaactggataaaac

SEQ ID NO: 187041 - DNA, 25 bp, Homo sapien
gaaggccccaaaccaaactctagct

SEQ ID NO: 187042 - DNA, 25 bp, Homo sapien
aaactctagctgatccatgttgcct

SEQ ID NO: 187043 - DNA, 25 bp, Homo sapien
gatccatgttgccttcaagtttgtt

SEQ ID NO: 187044 - DNA, 25 bp, Homo sapien
atcagcctgccagataatccacatg

SEQ ID NO: 187045 - DNA, 25 bp, Homo sapien
cccagctccactaagattttcactt

SEQ ID NO: 187046 - DNA, 25 bp, Homo sapien
gccctcgcttcccttggatggagct

SEQ ID NO: 187047 - DNA, 25 bp, Homo sapien
cccttggatggagctgccctgctgg

SEQ ID NO: 187048 - DNA, 25 bp, Homo sapien
cctgctggtgcctggtcagagaaga

SEQ ID NO: 187049 - DNA, 25 bp, Homo sapien
agcctgattctctgctcccaggagc

SEQ ID NO: 187050 - DNA, 25 bp, Homo sapien
tcccaggagccagtgacatgaggtg

SEQ ID NO: 187051 - DNA, 25 bp, Homo sapien
ccaggagccagtgacatgaggtgca

SEQ ID NO: 187052 - DNA, 25 bp, Homo sapien
cacacagttggacccgtgattctca

SEQ ID NO: 187053 - DNA, 25 bp, Homo sapien
cagttggacccgtgattctcagggt

SEQ ID NO: 187054 - DNA, 25 bp, Homo sapien
acccgtgattctcagggtgctgtga

SEQ ID NO: 187055 - DNA, 25 bp, Homo sapien
ccgtgattctcagggtgctgtgatg

SEQ ID NO: 187056 - DNA, 25 bp, Homo sapien
gggagcatttgttattaaatgactg

SEQ ID NO: 187057 - DNA, 25 bp, Homo sapien
tccacctggactgatgggcacagga

SEQ ID NO: 187058 - DNA, 25 bp, Homo sapien
gcacaggaggcaccaatagcgatta

SEQ ID NO: 187059 - DNA, 25 bp, Homo sapien
acaggaggcaccaatagcgattatt

SEQ ID NO: 187060 - DNA, 25 bp, Homo sapien
ggaggcaccaatagcgattattggg

SEQ ID NO: 187061 - DNA, 25 bp, Homo sapien
ggcaatgcgaggtctcctcctatgc

SEQ ID NO: 187062 - DNA, 25 bp, Homo sapien
aatgcgaggtctcctcctatgccct

SEQ ID NO: 187063 - DNA, 25 bp, Homo sapien
cttcctacccctgagtgggacaaga

SEQ ID NO: 187064 - DNA, 25 bp, Homo sapien
ttcctacccctgagtgggacaagaa

SEQ ID NO: 187065 - DNA, 25 bp, Homo sapien
cctacccctgagtgggacaagaagg

SEQ ID NO: 187066 - DNA, 25 bp, Homo sapien
aggagtgccccacgttctgagaagg

SEQ ID NO: 187067 - DNA, 25 bp, Homo sapien
cggcagggagatttcggttttgagg

SEQ ID NO: 187068 - DNA, 25 bp, Homo sapien
aagcggcagggatctcggagggcgc

SEQ ID NO: 187069 - DNA, 25 bp, Homo sapien
cggcagggatctcggagggcgcaga

SEQ ID NO: 187070 - DNA, 25 bp, Homo sapien
gcagggatctcggagggcgcagagg

SEQ ID NO: 187071 - DNA, 25 bp, Homo sapien
agggatctcggagggcgcagagggc

SEQ ID NO: 187072 - DNA, 25 bp, Homo sapien
ggatctcggagggcgcagagggcgt

SEQ ID NO: 187073 - DNA, 25 bp, Homo sapien
gggcgccgtgcccttgctgggaggg

SEQ ID NO: 187074 - DNA, 25 bp, Homo sapien
ggcatcccgggcctcgacgtggagg

SEQ ID NO: 187075 - DNA, 25 bp, Homo sapien
gcatcccgggcctcgacgtggagga

SEQ ID NO: 187076 - DNA, 25 bp, Homo sapien
atcccgggcctcgacgtggaggacg

SEQ ID NO: 187077 - DNA, 25 bp, Homo sapien
gggcgccccgtgacccgagctcggg

SEQ ID NO: 187078 - DNA, 25 bp, Homo sapien
gcggagcccgcgtggccgaagctgg

SEQ ID NO: 187079 - DNA, 25 bp, Homo sapien
cacatcatttcactctggtctgagt

SEQ ID NO: 187080 - DNA, 25 bp, Homo sapien
gtctgagtggtggcctgagaaccat

SEQ ID NO: 187081 - DNA, 25 bp, Homo sapien
gaaccatggtggcatggaccaccct

SEQ ID NO: 187082 - DNA, 25 bp, Homo sapien
gtggcatggaccaccctcatccatg

SEQ ID NO: 187083 - DNA, 25 bp, Homo sapien
tccaggccccatgggaacggatgtg

SEQ ID NO: 187084 - DNA, 25 bp, Homo sapien
ttaaggcccagggtcggagcccagg

SEQ ID NO: 187085 - DNA, 25 bp, Homo sapien
tctcccttcctgtcgttcaatggac

SEQ ID NO: 187086 - DNA, 25 bp, Homo sapien
cttcctgtcgttcaatggacgtggt

SEQ ID NO: 187087 - DNA, 25 bp, Homo sapien
cctgtcgttcaatggacgtggtggt

SEQ ID NO: 187088 - DNA, 25 bp, Homo sapien
tgttccacacccattttgttgcagt

SEQ ID NO: 187089 - DNA, 25 bp, Homo sapien
aggagggcttgtgcagggttttgta

SEQ ID NO: 187090 - DNA, 25 bp, Homo sapien
tgcagcgctactacgtctataactc

SEQ ID NO: 187091 - DNA, 25 bp, Homo sapien
cgtctataactcagtcagctactct

SEQ ID NO: 187092 - DNA, 25 bp, Homo sapien
tgcagcatgcagcacgtgtgtgcca

SEQ ID NO: 187093 - DNA, 25 bp, Homo sapien
cagcacgtgtgtgccatgcgccagg

SEQ ID NO: 187094 - DNA, 25 bp, Homo sapien
cgccaggtggacattgacgcttaca

SEQ ID NO: 187095 - DNA, 25 bp, Homo sapien
tggacattgacgcttacaccacctg

SEQ ID NO: 187096 - DNA, 25 bp, Homo sapien
gacgcttacaccacctgtctgtatg

SEQ ID NO: 187097 - DNA, 25 bp, Homo sapien
tgtctgtatgcctctggcaccacgc

SEQ ID NO: 187098 - DNA, 25 bp, Homo sapien
acgactcgtgctgtgacctgccagg

SEQ ID NO: 187099 - DNA, 25 bp, Homo sapien
gctgtgacctgccaggctcaccatt

SEQ ID NO: 187100 - DNA, 25 bp, Homo sapien
aggctcaccattcttcctggtaacg

SEQ ID NO: 187101 - DNA, 25 bp, Homo sapien
gatgcggagagcctgaaactcttaa

SEQ ID NO: 187102 - DNA, 25 bp, Homo sapien
gctgtccccatttatgtgatttgca

SEQ ID NO: 187103 - DNA, 25 bp, Homo sapien
tttgcaaactgggaaatgactcaca

SEQ ID NO: 187104 - DNA, 25 bp, Homo sapien
agaaagccgtgaagatcctccagtc

SEQ ID NO: 187105 - DNA, 25 bp, Homo sapien
tccagtccttatcagcagctcaaga

SEQ ID NO: 187106 - DNA, 25 bp, Homo sapien
gcagctcaagagttagaccctttaa

SEQ ID NO: 187107 - DNA, 25 bp, Homo sapien
gaccctttaacagttcgggatgttg

SEQ ID NO: 187108 - DNA, 25 bp, Homo sapien
catggcctgggctgccaaaatcgat

SEQ ID NO: 187109 - DNA, 25 bp, Homo sapien
ggctgccaaaatcgatggaacattt

SEQ ID NO: 187110 - DNA, 25 bp, Homo sapien
gaacatttccacagtactgaggtga

SEQ ID NO: 187111 - DNA, 25 bp, Homo sapien
atgtggattgccataatacctcaaa

SEQ ID NO: 187112 - DNA, 25 bp, Homo sapien
aatctatgaggcttgctcctatggc

SEQ ID NO: 187113 - DNA, 25 bp, Homo sapien
ctatggctccattcctgtggtggaa

SEQ ID NO: 187114 - DNA, 25 bp, Homo sapien
tcctgtggtggaagacgtgatgaca

SEQ ID NO: 187115 - DNA, 25 bp, Homo sapien
agctggcaactgtgggaatacatct

SEQ ID NO: 187116 - DNA, 25 bp, Homo sapien
atacatctgtgcaccacggtgctcc

SEQ ID NO: 187117 - DNA, 25 bp, Homo sapien
ggtgctcctctgcagttactcaagt

SEQ ID NO: 187118 - DNA, 25 bp, Homo sapien
agttactcaagtccatgggtgctcc

SEQ ID NO: 187119 - DNA, 25 bp, Homo sapien
atgggtgctccctttatctttatca

SEQ ID NO: 187120 - DNA, 25 bp, Homo sapien
aagaactggaaggaactccctgctg

SEQ ID NO: 187121 - DNA, 25 bp, Homo sapien
gaactccctgctgttttagaaaaag

SEQ ID NO: 187122 - DNA, 25 bp, Homo sapien
tggtatcagcacttcaagacagagc

SEQ ID NO: 187123 - DNA, 25 bp, Homo sapien
ggaagaccacagctagatggacaaa

SEQ ID NO: 187124 - DNA, 25 bp, Homo sapien
tggacaaacagcattgggaggcctt

SEQ ID NO: 187125 - DNA, 25 bp, Homo sapien
aacagcattgggaggccttagccct

SEQ ID NO: 187126 - DNA, 25 bp, Homo sapien
tcctctcaattccatcctgtagaga

SEQ ID NO: 187127 - DNA, 25 bp, Homo sapien
tagagaacaggagtcaggagccgct

SEQ ID NO: 187128 - DNA, 25 bp, Homo sapien
agcatgtcacccaggactctgccgg

SEQ ID NO: 187129 - DNA, 25 bp, Homo sapien
acccaggactctgccggtgcagaat

SEQ ID NO: 187130 - DNA, 25 bp, Homo sapien
gtgcagaatatgagcaatgccatgt

SEQ ID NO: 187131 - DNA, 25 bp, Homo sapien
gagcaggacaactgacctgtctcct

SEQ ID NO: 187132 - DNA, 25 bp, Homo sapien
tgtctccttcacatagtccatatca

SEQ ID NO: 187133 - DNA, 25 bp, Homo sapien
tagtccatatcaccacaaatcacac

SEQ ID NO: 187134 - DNA, 25 bp, Homo sapien
gaggaactgtccacgagaaactaag

SEQ ID NO: 187135 - DNA, 25 bp, Homo sapien
tatgacatcaacaaggacggataca

SEQ ID NO: 187136 - DNA, 25 bp, Homo sapien
tggacattgtcaaagccatctatga

SEQ ID NO: 187137 - DNA, 25 bp, Homo sapien
tacacatatcctgtgctcaaagagg

SEQ ID NO: 187138 - DNA, 25 bp, Homo sapien
gacactccaaggcagcatgtggacg

SEQ ID NO: 187139 - DNA, 25 bp, Homo sapien
atgtggacgtcttcttccagaaaat

SEQ ID NO: 187140 - DNA, 25 bp, Homo sapien
aaagatggcatcgtaactttagatg

SEQ ID NO: 187141 - DNA, 25 bp, Homo sapien
gaatttcttgaatcatgtcaggagg

SEQ ID NO: 187142 - DNA, 25 bp, Homo sapien
gtcaggaggacgacaacatcatgag

SEQ ID NO: 187143 - DNA, 25 bp, Homo sapien
aacatcatgaggtctctccagctgt

SEQ ID NO: 187144 - DNA, 25 bp, Homo sapien
tctccagctgtttcaaaatgtcatg

SEQ ID NO: 187145 - DNA, 25 bp, Homo sapien
gaacttcttacaatatacgctgcct

SEQ ID NO: 187146 - DNA, 25 bp, Homo sapien
ttacaatatacgctgccttgccgta

SEQ ID NO: 187147 - DNA, 25 bp, Homo sapien
cgctgccttgccgtatgtgaagaaa

SEQ ID NO: 187148 - DNA, 25 bp, Homo sapien
ataagacttcctaacaaatacaatg

SEQ ID NO: 187149 - DNA, 25 bp, Homo sapien
attttcttcttataaccatggcatc

SEQ ID NO: 187150 - DNA, 25 bp, Homo sapien
atggcatcatatatacctttgtttc

SEQ ID NO: 187151 - DNA, 25 bp, Homo sapien
gtttccacaactctattttcatatg

SEQ ID NO: 187152 - DNA, 25 bp, Homo sapien
aaaggtgcttcatggagaggtgatt

SEQ ID NO: 187153 - DNA, 25 bp, Homo sapien
ggatgattaaatgatctctgcaaac

SEQ ID NO: 187154 - DNA, 25 bp, Homo sapien
gcaaacaaggtgctttttccagaat

SEQ ID NO: 187155 - DNA, 25 bp, Homo sapien
gaataaccaagattacctgagtcca

SEQ ID NO: 187156 - DNA, 25 bp, Homo sapien
tctaaatccagaaaatggcagtcct

SEQ ID NO: 187157 - DNA, 25 bp, Homo sapien
aatgttcatgagacagattgtatta

SEQ ID NO: 187158 - DNA, 25 bp, Homo sapien
tgtattaatttaaccaggactatgt

SEQ ID NO: 187159 - DNA, 25 bp, Homo sapien
taaccaggactatgtagaagtagaa

SEQ ID NO: 187160 - DNA, 25 bp, Homo sapien
tttggattccaaacattttcgacag

SEQ ID NO: 187161 - DNA, 25 bp, Homo sapien
gattccaaacattttcgacagtgta

SEQ ID NO: 187162 - DNA, 25 bp, Homo sapien
ctgtaattttcttaccatcgggtat

SEQ ID NO: 187163 - DNA, 25 bp, Homo sapien
taaagtattcattgagtttaccaaa

SEQ ID NO: 187164 - DNA, 25 bp, Homo sapien
gagtttaccaaaagttactgtagct

SEQ ID NO: 187165 - DNA, 25 bp, Homo sapien
ttttgtgagcactaactattggcag

SEQ ID NO: 187166 - DNA, 25 bp, Homo sapien
gagcactaactattggcagaaactg

SEQ ID NO: 187167 - DNA, 25 bp, Homo sapien
aggcacaatacatatgaacgctttt

SEQ ID NO: 187168 - DNA, 25 bp, Homo sapien
gaacgcttttagagaactttgggag

SEQ ID NO: 187169 - DNA, 25 bp, Homo sapien
gagcaaagcaactgatgtcctgcgt

SEQ ID NO: 187170 - DNA, 25 bp, Homo sapien
atgtcctgcgtggaaagtcctcttc

SEQ ID NO: 187171 - DNA, 25 bp, Homo sapien
catgaaattatctcaaggatcttcc

SEQ ID NO: 187172 - DNA, 25 bp, Homo sapien
cttccatgggaagatgtgacagaac

SEQ ID NO: 187173 - DNA, 25 bp, Homo sapien
gacagaaccaggacactactgctta

SEQ ID NO: 187174 - DNA, 25 bp, Homo sapien
gagcataactaaagtattcttcgtt

SEQ ID NO: 187175 - DNA, 25 bp, Homo sapien
gtattcttcgtttctttagtcaaat

SEQ ID NO: 187176 - DNA, 25 bp, Homo sapien
ttagtcaaatctccttttctataaa

SEQ ID NO: 187177 - DNA, 25 bp, Homo sapien
gagacggctttcatatgtttgggaa

SEQ ID NO: 187178 - DNA, 25 bp, Homo sapien
taccgtaacaatgtttgtcattttg

SEQ ID NO: 187179 - DNA, 25 bp, Homo sapien
atgccaagtaacaatgcatgctttg

SEQ ID NO: 187180 - DNA, 25 bp, Homo sapien
caatgcatgctttggaaatttggaa

SEQ ID NO: 187181 - DNA, 25 bp, Homo sapien
aagatggttttattctttgagaagc

SEQ ID NO: 187182 - DNA, 25 bp, Homo sapien
caagaaattgattgaacgttctcaa

SEQ ID NO: 187183 - DNA, 25 bp, Homo sapien
tctcaaaccctgtttacggtacttg

SEQ ID NO: 187184 - DNA, 25 bp, Homo sapien
agccggtttgggagagaccattgca

SEQ ID NO: 187185 - DNA, 25 bp, Homo sapien
gagagaccattgcatcgctgtccaa

SEQ ID NO: 187186 - DNA, 25 bp, Homo sapien
tgcatcgctgtccaagtgtttcttg

SEQ ID NO: 187187 - DNA, 25 bp, Homo sapien
gtccaagtgtttcttgttaagtgct

SEQ ID NO: 187188 - DNA, 25 bp, Homo sapien
gcttttaaactggagaggctaacct

SEQ ID NO: 187189 - DNA, 25 bp, Homo sapien
agccctgacccctcatgctctctgg

SEQ ID NO: 187190 - DNA, 25 bp, Homo sapien
gctctctggctgggccagtgggcag

SEQ ID NO: 187191 - DNA, 25 bp, Homo sapien
ctctctggctgggccagtgggcagc

SEQ ID NO: 187192 - DNA, 25 bp, Homo sapien
ctctggctgggccagtgggcagccc

SEQ ID NO: 187193 - DNA, 25 bp, Homo sapien
tggctgggccagtgggcagccctcg

SEQ ID NO: 187194 - DNA, 25 bp, Homo sapien
ggctgggccagtgggcagccctcgc

SEQ ID NO: 187195 - DNA, 25 bp, Homo sapien
ctgggccagtgggcagccctcgctt

SEQ ID NO: 187196 - DNA, 25 bp, Homo sapien
tgggccagtgggcagccctcgcttc

SEQ ID NO: 187197 - DNA, 25 bp, Homo sapien
gggccagtgggcagccctcgcttcc

SEQ ID NO: 187198 - DNA, 25 bp, Homo sapien
ggccagtgggcagccctcgcttccc

SEQ ID NO: 187199 - DNA, 25 bp, Homo sapien
gccagtgggcagccctcgcttccct

SEQ ID NO: 187200 - DNA, 25 bp, Homo sapien
tgaatggactcaatctctgcctgat

SEQ ID NO: 187201 - DNA, 25 bp, Homo sapien
tctgcctgatgtgtgctaaagtcgg

SEQ ID NO: 187202 - DNA, 25 bp, Homo sapien
atggatttgtacaaccaacccgagc

SEQ ID NO: 187203 - DNA, 25 bp, Homo sapien
accaacccgagcctgtgaagtcctt

SEQ ID NO: 187204 - DNA, 25 bp, Homo sapien
tgaagtcctttctcttctaccacag

SEQ ID NO: 187205 - DNA, 25 bp, Homo sapien
ttctaccacagccagagtggcagga

SEQ ID NO: 187206 - DNA, 25 bp, Homo sapien
aggaactccaccttcgagtctgtgg

SEQ ID NO: 187207 - DNA, 25 bp, Homo sapien
tggctggttcatcgctgtcagctct

SEQ ID NO: 187208 - DNA, 25 bp, Homo sapien
ctctcatccttacccaagaactggg

SEQ ID NO: 187209 - DNA, 25 bp, Homo sapien
gggaaagccaacactactgactttg

SEQ ID NO: 187210 - DNA, 25 bp, Homo sapien
ctgactttgggttaactatgctgtt

SEQ ID NO: 187211 - DNA, 25 bp, Homo sapien
gtcctttgaaagttgtgagagctca

SEQ ID NO: 187212 - DNA, 25 bp, Homo sapien
cctgtgttccccaagaattcagaga

SEQ ID NO: 187213 - DNA, 25 bp, Homo sapien
caagaattcagagaacagcactggg

SEQ ID NO: 187214 - DNA, 25 bp, Homo sapien
gctggaatgatctttaatgggccca

SEQ ID NO: 187215 - DNA, 25 bp, Homo sapien
atgatctttaatgggcccaaggcca

SEQ ID NO: 187216 - DNA, 25 bp, Homo sapien
tgggcccaaggccaacaggcatatg

SEQ ID NO: 187217 - DNA, 25 bp, Homo sapien
aggccaacaggcatatgcctcacta

SEQ ID NO: 187218 - DNA, 25 bp, Homo sapien
ggcatatgcctcactactgcctgga

SEQ ID NO: 187219 - DNA, 25 bp, Homo sapien
tactgcctggagaagggagagattc

SEQ ID NO: 187220 - DNA, 25 bp, Homo sapien
caggcctcagtgtctgccagtcaag

SEQ ID NO: 187221 - DNA, 25 bp, Homo sapien
gccagtcaagcttcacaggcattgt

SEQ ID NO: 187222 - DNA, 25 bp, Homo sapien
gatcgagcctcgagagagagccaag

SEQ ID NO: 187223 - DNA, 25 bp, Homo sapien
gagagccaagttcaaacgcaagtac

SEQ ID NO: 187224 - DNA, 25 bp, Homo sapien
caagttcaaacgcaagtacaaggtg

SEQ ID NO: 187225 - DNA, 25 bp, Homo sapien
agaagcgggcgttccgtgagatcca

SEQ ID NO: 187226 - DNA, 25 bp, Homo sapien
gggcgttccgtgagatccagttgta

SEQ ID NO: 187227 - DNA, 25 bp, Homo sapien
gttccgtgagatccagttgtagctg

SEQ ID NO: 187228 - DNA, 25 bp, Homo sapien
gtgagatccagttgtagctgccatc

SEQ ID NO: 187229 - DNA, 25 bp, Homo sapien
gatccagttgtagctgccatcagat

SEQ ID NO: 187230 - DNA, 25 bp, Homo sapien
agttgtagctgccatcagatgccgg

SEQ ID NO: 187231 - DNA, 25 bp, Homo sapien
gtagctgccatcagatgccggagac

SEQ ID NO: 187232 - DNA, 25 bp, Homo sapien
gctgccatcagatgccggagactcg

SEQ ID NO: 187233 - DNA, 25 bp, Homo sapien
tgatgggcaagtacacgtaccctgc

SEQ ID NO: 187234 - DNA, 25 bp, Homo sapien
gatgggcaagtacacgtaccctgca

SEQ ID NO: 187235 - DNA, 25 bp, Homo sapien
atgggcaagtacacgtaccctgcac

SEQ ID NO: 187236 - DNA, 25 bp, Homo sapien
tgggcaagtacacgtaccctgcact

SEQ ID NO: 187237 - DNA, 25 bp, Homo sapien
gggcaagtacacgtaccctgcactc

SEQ ID NO: 187238 - DNA, 25 bp, Homo sapien
ggcaagtacacgtaccctgcactcc

SEQ ID NO: 187239 - DNA, 25 bp, Homo sapien
gcaagtacacgtaccctgcactccg

SEQ ID NO: 187240 - DNA, 25 bp, Homo sapien
caagtacacgtaccctgcactccgg

SEQ ID NO: 187241 - DNA, 25 bp, Homo sapien
agtacacgtaccctgcactccggga

SEQ ID NO: 187242 - DNA, 25 bp, Homo sapien
gtacacgtaccctgcactccgggag

SEQ ID NO: 187243 - DNA, 25 bp, Homo sapien
cttccagaagatggacagaaacaag

SEQ ID NO: 187244 - DNA, 25 bp, Homo sapien
gtacagttttttttcaagcttcaca

SEQ ID NO: 187245 - DNA, 25 bp, Homo sapien
ttttttcaagcttcacatttgcgtg

SEQ ID NO: 187246 - DNA, 25 bp, Homo sapien
ttcaagcttcacatttgcgtgtatc

SEQ ID NO: 187247 - DNA, 25 bp, Homo sapien
agcttcacatttgcgtgtatctaat

SEQ ID NO: 187248 - DNA, 25 bp, Homo sapien
cacatttgcgtgtatctaattcagc

SEQ ID NO: 187249 - DNA, 25 bp, Homo sapien
atttgcgtgtatctaattcagctga

SEQ ID NO: 187250 - DNA, 25 bp, Homo sapien
gcgtgtatctaattcagctgatgct

SEQ ID NO: 187251 - DNA, 25 bp, Homo sapien
gtatctaattcagctgatgctcaag

SEQ ID NO: 187252 - DNA, 25 bp, Homo sapien
taattcagctgatgctcaagtccaa

SEQ ID NO: 187253 - DNA, 25 bp, Homo sapien
gggtagtctgccttcccaggctgcc

SEQ ID NO: 187254 - DNA, 25 bp, Homo sapien
tgcccccagggtttctgcactggtc

SEQ ID NO: 187255 - DNA, 25 bp, Homo sapien
ccaactggtctgatgtaggtaaaag

SEQ ID NO: 187256 - DNA, 25 bp, Homo sapien
agttgaaatcaatcctcctgatgat

SEQ ID NO: 187257 - DNA, 25 bp, Homo sapien
atcaatcctcctgatgatatggaat

SEQ ID NO: 187258 - DNA, 25 bp, Homo sapien
cgccaaaacaattcgtagcagatgt

SEQ ID NO: 187259 - DNA, 25 bp, Homo sapien
gtaaagaacctatatccatcatcat

SEQ ID NO: 187260 - DNA, 25 bp, Homo sapien
atccatcatcatctccttatacaag

SEQ ID NO: 187261 - DNA, 25 bp, Homo sapien
agttggagggagatgcagctttaaa

SEQ ID NO: 187262 - DNA, 25 bp, Homo sapien
gattatttcagcagatctattcaga

SEQ ID NO: 187263 - DNA, 25 bp, Homo sapien
gaaacgtgccatgaacaaatccttt

SEQ ID NO: 187264 - DNA, 25 bp, Homo sapien
atcctttatggagtcgggtggtaca

SEQ ID NO: 187265 - DNA, 25 bp, Homo sapien
gtacagttttgagtaccaactggtc

SEQ ID NO: 187266 - DNA, 25 bp, Homo sapien
caagctcgagggggccacaccgtgt

SEQ ID NO: 187267 - DNA, 25 bp, Homo sapien
aagctcgagggggccacaccgtgtc

SEQ ID NO: 187268 - DNA, 25 bp, Homo sapien
tcgagggggccacaccgtgtcccag

SEQ ID NO: 187269 - DNA, 25 bp, Homo sapien
gagggggccacaccgtgtcccaggg

SEQ ID NO: 187270 - DNA, 25 bp, Homo sapien
agggagcccagcctattcccgttgg

SEQ ID NO: 187271 - DNA, 25 bp, Homo sapien
gggagcccagcctattcccgttggc

SEQ ID NO: 187272 - DNA, 25 bp, Homo sapien
ggagcccagcctattcccgttggct

SEQ ID NO: 187273 - DNA, 25 bp, Homo sapien
gagcccagcctattcccgttggctg

SEQ ID NO: 187274 - DNA, 25 bp, Homo sapien
agcccagcctattcccgttggctgg

SEQ ID NO: 187275 - DNA, 25 bp, Homo sapien
gcccagcctattcccgttggctggc

SEQ ID NO: 187276 - DNA, 25 bp, Homo sapien
cccagcctattcccgttggctggct

SEQ ID NO: 187277 - DNA, 25 bp, Homo sapien
gaaagctccctttctcaagaatgcc

SEQ ID NO: 187278 - DNA, 25 bp, Homo sapien
ctttctcaagaatgcccatctgtga

SEQ ID NO: 187279 - DNA, 25 bp, Homo sapien
aagaatgcccatctgtgaacacatg

SEQ ID NO: 187280 - DNA, 25 bp, Homo sapien
gaacacatggtagagtctccaacct

SEQ ID NO: 187281 - DNA, 25 bp, Homo sapien
tagagtctccaacctgttcccagat

SEQ ID NO: 187282 - DNA, 25 bp, Homo sapien
gttcccagatgtccaacctggtctg

SEQ ID NO: 187283 - DNA, 25 bp, Homo sapien
tgtccaacctggtctgcggcactga

SEQ ID NO: 187284 - DNA, 25 bp, Homo sapien
tgcggcactgatgggctcacatata

SEQ ID NO: 187285 - DNA, 25 bp, Homo sapien
tgatgggctcacatatacgaatgaa

SEQ ID NO: 187286 - DNA, 25 bp, Homo sapien
atacgaatgaatgccagctctgctt

SEQ ID NO: 187287 - DNA, 25 bp, Homo sapien
gaatgccagctctgcttggcccgga

SEQ ID NO: 187288 - DNA, 25 bp, Homo sapien
aactaagctgcgtggatcgacaccc

SEQ ID NO: 187289 - DNA, 25 bp, Homo sapien
atcgacacccgttctggttatgtaa

SEQ ID NO: 187290 - DNA, 25 bp, Homo sapien
ggttatgtaagcactagtcacctac

SEQ ID NO: 187291 - DNA, 25 bp, Homo sapien
acctacttagactcacaattacttg

SEQ ID NO: 187292 - DNA, 25 bp, Homo sapien
aaagaccagtttgcaggtcctctcc

SEQ ID NO: 187293 - DNA, 25 bp, Homo sapien
gactctccttcacctacagtgtttc

SEQ ID NO: 187294 - DNA, 25 bp, Homo sapien
caccagctctgatctgttacttgta

SEQ ID NO: 187295 - DNA, 25 bp, Homo sapien
gtaacgatcgtgctttgtagaacaa

SEQ ID NO: 187296 - DNA, 25 bp, Homo sapien
gtagaacaatcccagtctttgatgt

SEQ ID NO: 187297 - DNA, 25 bp, Homo sapien
tgtttgggaggctgtttgacttgca

SEQ ID NO: 187298 - DNA, 25 bp, Homo sapien
gacggtacctacaaaacagctagta

SEQ ID NO: 187299 - DNA, 25 bp, Homo sapien
tgatggtggagatggaagcagcagt

SEQ ID NO: 187300 - DNA, 25 bp, Homo sapien
ttaggattccaaaaatgtcaagttt

SEQ ID NO: 187301 - DNA, 25 bp, Homo sapien
tgtcaagtttgagttccagaggaat

SEQ ID NO: 187302 - DNA, 25 bp, Homo sapien
gctattcagccacttatctgatgaa

SEQ ID NO: 187303 - DNA, 25 bp, Homo sapien
gccacttatctgatgaataaaacca

SEQ ID NO: 187304 - DNA, 25 bp, Homo sapien
gagagttttttgaaagcaaatcatt

SEQ ID NO: 187305 - DNA, 25 bp, Homo sapien
cattctgtatatatgctctccagcc

SEQ ID NO: 187306 - DNA, 25 bp, Homo sapien
tctgtatatatgctctccagcctct

SEQ ID NO: 187307 - DNA, 25 bp, Homo sapien
gcctctgacacaagatgcgttctta

SEQ ID NO: 187308 - DNA, 25 bp, Homo sapien
gacacaagatgcgttcttaatacag

SEQ ID NO: 187309 - DNA, 25 bp, Homo sapien
gatgcgttcttaatacagacttgtt

SEQ ID NO: 187310 - DNA, 25 bp, Homo sapien
ttctacttgggatcacaaagcaaaa

SEQ ID NO: 187311 - DNA, 25 bp, Homo sapien
caaagcaaaaggacacttcaactgt

SEQ ID NO: 187312 - DNA, 25 bp, Homo sapien
gacacttcaactgtccagagggtta

SEQ ID NO: 187313 - DNA, 25 bp, Homo sapien
tgtccagagggttattcaggaggct

SEQ ID NO: 187314 - DNA, 25 bp, Homo sapien
aaccaagagcaaaatctaagccaga

SEQ ID NO: 187315 - DNA, 25 bp, Homo sapien
aggattatcttggaagtctcaaaat

SEQ ID NO: 187316 - DNA, 25 bp, Homo sapien
gtctcaaaatggaaggttatactct

SEQ ID NO: 187317 - DNA, 25 bp, Homo sapien
aaaatgttgatccatccaacagatt

SEQ ID NO: 187318 - DNA, 25 bp, Homo sapien
gaaagctttgaatgaactgaggcaa

SEQ ID NO: 187319 - DNA, 25 bp, Homo sapien
atttaaacattaacctcattccaag

SEQ ID NO: 187320 - DNA, 25 bp, Homo sapien
ttaacctcattccaagttaatgtgg

SEQ ID NO: 187321 - DNA, 25 bp, Homo sapien
ttttctgttcccatgtttgctaagg

SEQ ID NO: 187322 - DNA, 25 bp, Homo sapien
gctaaggataatggtttccagttct

SEQ ID NO: 187323 - DNA, 25 bp, Homo sapien
gtttccagttctaccgatgttccca

SEQ ID NO: 187324 - DNA, 25 bp, Homo sapien
agttctaccgatgttcccacaaaag

SEQ ID NO: 187325 - DNA, 25 bp, Homo sapien
taaggctgcttagtattccatggta

SEQ ID NO: 187326 - DNA, 25 bp, Homo sapien
catggtatctatgtatcacattttc

SEQ ID NO: 187327 - DNA, 25 bp, Homo sapien
cacattttctctatccaatctattg

SEQ ID NO: 187328 - DNA, 25 bp, Homo sapien
atccaatctattgttgactcacatt

SEQ ID NO: 187329 - DNA, 25 bp, Homo sapien
gactcacatttagattgattccatg

SEQ ID NO: 187330 - DNA, 25 bp, Homo sapien
aagatttatatttctctgagtatgt

SEQ ID NO: 187331 - DNA, 25 bp, Homo sapien
tgagtatgtatccagtaatagccca

SEQ ID NO: 187332 - DNA, 25 bp, Homo sapien
gtgcccgcaggcacccgtgtgacat

SEQ ID NO: 187333 - DNA, 25 bp, Homo sapien
gcacgtccagctccgtgacctgtgt

SEQ ID NO: 187334 - DNA, 25 bp, Homo sapien
gtgagtgagagatttcgaacgccca

SEQ ID NO: 187335 - DNA, 25 bp, Homo sapien
agtgagagatttcgaacgcccaccc

SEQ ID NO: 187336 - DNA, 25 bp, Homo sapien
ccacccctcgactttgaaatctgag

SEQ ID NO: 187337 - DNA, 25 bp, Homo sapien
ccctcgactttgaaatctgagcaaa

SEQ ID NO: 187338 - DNA, 25 bp, Homo sapien
aatctgagcaaaacaagaaactggg

SEQ ID NO: 187339 - DNA, 25 bp, Homo sapien
agctagtcttccctctgttcttcct

SEQ ID NO: 187340 - DNA, 25 bp, Homo sapien
agccgcccgcgccagattttgaaat

SEQ ID NO: 187341 - DNA, 25 bp, Homo sapien
cgcccgcgccagattttgaaatctc

SEQ ID NO: 187342 - DNA, 25 bp, Homo sapien
aatctcggagacaaaactagtactg

SEQ ID NO: 187343 - DNA, 25 bp, Homo sapien
aaatagatagatactccagcctggg

SEQ ID NO: 187344 - DNA, 25 bp, Homo sapien
cagagcgagacttatagatagatag

SEQ ID NO: 187345 - DNA, 25 bp, Homo sapien
aacggaattggagccattttgcttt

SEQ ID NO: 187346 - DNA, 25 bp, Homo sapien
cggaattggagccattttgctttaa

SEQ ID NO: 187347 - DNA, 25 bp, Homo sapien
aattggagccattttgctttaagtg

SEQ ID NO: 187348 - DNA, 25 bp, Homo sapien
gaatggcagtcccttgtcttattca

SEQ ID NO: 187349 - DNA, 25 bp, Homo sapien
tggcagtcccttgtcttattcagaa

SEQ ID NO: 187350 - DNA, 25 bp, Homo sapien
gcagtcccttgtcttattcagaata

SEQ ID NO: 187351 - DNA, 25 bp, Homo sapien
agtcccttgtcttattcagaatata

SEQ ID NO: 187352 - DNA, 25 bp, Homo sapien
cagtctgaatggcatcttacagatt

SEQ ID NO: 187353 - DNA, 25 bp, Homo sapien
gaatggcatcttacagattttactt

SEQ ID NO: 187354 - DNA, 25 bp, Homo sapien
cagaaactgcctgggtggtttgaga

SEQ ID NO: 187355 - DNA, 25 bp, Homo sapien
gagacaacccagtttgatctgcaat

SEQ ID NO: 187356 - DNA, 25 bp, Homo sapien
aaggatccattcgtaatctctctct

SEQ ID NO: 187357 - DNA, 25 bp, Homo sapien
gtaatctctctctcactgatgttat

SEQ ID NO: 187358 - DNA, 25 bp, Homo sapien
ggttcatctcaccacagaagggcat

SEQ ID NO: 187359 - DNA, 25 bp, Homo sapien
acagaagggcatttagtcctaccca

SEQ ID NO: 187360 - DNA, 25 bp, Homo sapien
atgacagcaggatggcacttcccat

SEQ ID NO: 187361 - DNA, 25 bp, Homo sapien
catttctctgtggttagtgctcgag

SEQ ID NO: 187362 - DNA, 25 bp, Homo sapien
gttagtgctcgagtgaaaacctctt

SEQ ID NO: 187363 - DNA, 25 bp, Homo sapien
aaaacctctttcagctgagtcctct

SEQ ID NO: 187364 - DNA, 25 bp, Homo sapien
ctgaggttctgctgttgagtcctgg

SEQ ID NO: 187365 - DNA, 25 bp, Homo sapien
aaatcgagcgctttggcctcttctg

SEQ ID NO: 187366 - DNA, 25 bp, Homo sapien
gagcgctttggcctcttctgtgcag

SEQ ID NO: 187367 - DNA, 25 bp, Homo sapien
tttggcctcttctgtgcagcatcca

SEQ ID NO: 187368 - DNA, 25 bp, Homo sapien
tcccggagacctctgcagccgtggt

SEQ ID NO: 187369 - DNA, 25 bp, Homo sapien
gagacctctgcagccgtggtggtca

SEQ ID NO: 187370 - DNA, 25 bp, Homo sapien
ccgtggtggtcagaggctgctcacc

SEQ ID NO: 187371 - DNA, 25 bp, Homo sapien
tgctcacctgagcacaaagacagct

SEQ ID NO: 187372 - DNA, 25 bp, Homo sapien
agacagctctgcacattcaccgcag

SEQ ID NO: 187373 - DNA, 25 bp, Homo sapien
tcatctaaagacaccttcctttcca

SEQ ID NO: 187374 - DNA, 25 bp, Homo sapien
tttccactggctgtcaagccacagg

SEQ ID NO: 187375 - DNA, 25 bp, Homo sapien
cactggctgtcaagccacagggcac

SEQ ID NO: 187376 - DNA, 25 bp, Homo sapien
aaacctagaggcacaatcttgactt

SEQ ID NO: 187377 - DNA, 25 bp, Homo sapien
gaggcacaatcttgacttgtcaatt

SEQ ID NO: 187378 - DNA, 25 bp, Homo sapien
ttgacttgtcaattactaccctttc

SEQ ID NO: 187379 - DNA, 25 bp, Homo sapien
gacttgtcaattactaccctttcac

SEQ ID NO: 187380 - DNA, 25 bp, Homo sapien
tgtcaattactaccctttcacaagc

SEQ ID NO: 187381 - DNA, 25 bp, Homo sapien
tcaattactaccctttcacaagcta

SEQ ID NO: 187382 - DNA, 25 bp, Homo sapien
ttactaccctttcacaagctaccat

SEQ ID NO: 187383 - DNA, 25 bp, Homo sapien
ctttcacaagctaccatctcagata

SEQ ID NO: 187384 - DNA, 25 bp, Homo sapien
tcacaagctaccatctcagatatat

SEQ ID NO: 187385 - DNA, 25 bp, Homo sapien
agctaccatctcagatatatatata

SEQ ID NO: 187386 - DNA, 25 bp, Homo sapien
tcaataaagctttctgtttgtgttc

SEQ ID NO: 187387 - DNA, 25 bp, Homo sapien
gtttctgtgagatgagctaaattgc

SEQ ID NO: 187388 - DNA, 25 bp, Homo sapien
gagctaaattgctttcataccccag

SEQ ID NO: 187389 - DNA, 25 bp, Homo sapien
tttcataccccagataagagctaaa

SEQ ID NO: 187390 - DNA, 25 bp, Homo sapien
ataccccagataagagctaaaacca

SEQ ID NO: 187391 - DNA, 25 bp, Homo sapien
gctaaaaccacctaatgctcttatg

SEQ ID NO: 187392 - DNA, 25 bp, Homo sapien
accacctaatgctcttatggcacag

SEQ ID NO: 187393 - DNA, 25 bp, Homo sapien
atgctcttatggcacagctgtgtat

SEQ ID NO: 187394 - DNA, 25 bp, Homo sapien
gcacagctgtgtatagatttagttc

SEQ ID NO: 187395 - DNA, 25 bp, Homo sapien
gctgtgtatagatttagttctcttt

SEQ ID NO: 187396 - DNA, 25 bp, Homo sapien
gttctctttatacttcatttctagc

SEQ ID NO: 187397 - DNA, 25 bp, Homo sapien
ctttatacttcatttctagcccagt

SEQ ID NO: 187398 - DNA, 25 bp, Homo sapien
taggaccctggttattggctctctt

SEQ ID NO: 187399 - DNA, 25 bp, Homo sapien
tgttgtctgtggttctgcaattttc

SEQ ID NO: 187400 - DNA, 25 bp, Homo sapien
gatgggcatgtgaagtgactgacct

SEQ ID NO: 187401 - DNA, 25 bp, Homo sapien
gactgaccttaagatgtttccattc

SEQ ID NO: 187402 - DNA, 25 bp, Homo sapien
cctgatgtttgataccctggttgaa

SEQ ID NO: 187403 - DNA, 25 bp, Homo sapien
atcctgcctcagaatgactttccta

SEQ ID NO: 187404 - DNA, 25 bp, Homo sapien
tgactttcctatcatgcttcatgtg

SEQ ID NO: 187405 - DNA, 25 bp, Homo sapien
gcttcatgtgtcattccaaggtttc

SEQ ID NO: 187406 - DNA, 25 bp, Homo sapien
caaggtttcttcatgagtcattcca

SEQ ID NO: 187407 - DNA, 25 bp, Homo sapien
gtcattccaagttttctagtccata

SEQ ID NO: 187408 - DNA, 25 bp, Homo sapien
tagtccataccacagtgccttgcaa

SEQ ID NO: 187409 - DNA, 25 bp, Homo sapien
caggaaactaagtttactatctgta

SEQ ID NO: 187410 - DNA, 25 bp, Homo sapien
gtaaatgtaaacatatgtccattaa

SEQ ID NO: 187411 - DNA, 25 bp, Homo sapien
atgtccattaagaaacatgtagttt

SEQ ID NO: 187412 - DNA, 25 bp, Homo sapien
ggaactaatatctcttgttctgaag

SEQ ID NO: 187413 - DNA, 25 bp, Homo sapien
gaaacatttatctgacgttcagcag

SEQ ID NO: 187414 - DNA, 25 bp, Homo sapien
atttatctgacgttcagcagttcct

SEQ ID NO: 187415 - DNA, 25 bp, Homo sapien
ttatctgacgttcagcagttcctac

SEQ ID NO: 187416 - DNA, 25 bp, Homo sapien
cagcagttcctacagttttacttca

SEQ ID NO: 187417 - DNA, 25 bp, Homo sapien
agcagttcctacagttttacttcag

SEQ ID NO: 187418 - DNA, 25 bp, Homo sapien
atattttgactaacatgtcttttct

SEQ ID NO: 187419 - DNA, 25 bp, Homo sapien
tctgtttgtatcatttaaaggcaaa

SEQ ID NO: 187420 - DNA, 25 bp, Homo sapien
tctttgagagaatacttgttgattt

SEQ ID NO: 187421 - DNA, 25 bp, Homo sapien
acttgttgatttctgatgtgcaggg

SEQ ID NO: 187422 - DNA, 25 bp, Homo sapien
ggtggctacagaaaagcccctttct

SEQ ID NO: 187423 - DNA, 25 bp, Homo sapien
gtggctacagaaaagcccctttctt

SEQ ID NO: 187424 - DNA, 25 bp, Homo sapien
tggctacagaaaagcccctttcttc

SEQ ID NO: 187425 - DNA, 25 bp, Homo sapien
agcccctttcttcctctgtttgcag

SEQ ID NO: 187426 - DNA, 25 bp, Homo sapien
cccctttcttcctctgtttgcaggg

SEQ ID NO: 187427 - DNA, 25 bp, Homo sapien
tggcctgggtggagcagtcatcctc

SEQ ID NO: 187428 - DNA, 25 bp, Homo sapien
gcctgggtggagcagtcatcctccc

SEQ ID NO: 187429 - DNA, 25 bp, Homo sapien
tgcagggagcaggaaatcagtgctg

SEQ ID NO: 187430 - DNA, 25 bp, Homo sapien
cctgccagatcttcaaacttttata

SEQ ID NO: 187431 - DNA, 25 bp, Homo sapien
gaagcactaaagcagttggctgagt

SEQ ID NO: 187432 - DNA, 25 bp, Homo sapien
tggctgagtgggtatcctgataaat

SEQ ID NO: 187433 - DNA, 25 bp, Homo sapien
aaatctgggcttgtcttcctaatgc

SEQ ID NO: 187434 - DNA, 25 bp, Homo sapien
ttcttccttaagtgccaagtgctga

SEQ ID NO: 187435 - DNA, 25 bp, Homo sapien
ccttaagtgccaagtgctgagctaa

SEQ ID NO: 187436 - DNA, 25 bp, Homo sapien
gtggtagtgtgaccctgcctgaaaa

SEQ ID NO: 187437 - DNA, 25 bp, Homo sapien
agccctggctcaactctgaagaagg

SEQ ID NO: 187438 - DNA, 25 bp, Homo sapien
gatcttgctacagaaggagcccttg

SEQ ID NO: 187439 - DNA, 25 bp, Homo sapien
gctcccttctctttgatagcagtta

SEQ ID NO: 187440 - DNA, 25 bp, Homo sapien
agcagttataatgcccttgttccca

SEQ ID NO: 187441 - DNA, 25 bp, Homo sapien
aatgcccttgttcccaataaaactg

SEQ ID NO: 187442 - DNA, 25 bp, Homo sapien
gggatgtaatctacaaaggctttga

SEQ ID NO: 187443 - DNA, 25 bp, Homo sapien
aaggctttgaagatggcattgtaca

SEQ ID NO: 187444 - DNA, 25 bp, Homo sapien
gatggcattgtacagctgaaactcc

SEQ ID NO: 187445 - DNA, 25 bp, Homo sapien
ggcattgtacagctgaaactccagg

SEQ ID NO: 187446 - DNA, 25 bp, Homo sapien
aactccagggttcttgtaccagctg

SEQ ID NO: 187447 - DNA, 25 bp, Homo sapien
tcttgtaccagctgccctagttcaa

SEQ ID NO: 187448 - DNA, 25 bp, Homo sapien
gtaccagctgccctagttcaatcat

SEQ ID NO: 187449 - DNA, 25 bp, Homo sapien
agctgccctagttcaatcattactc

SEQ ID NO: 187450 - DNA, 25 bp, Homo sapien
gccctagttcaatcattactctgaa

SEQ ID NO: 187451 - DNA, 25 bp, Homo sapien
gttcaatcattactctgaaaaatgg

SEQ ID NO: 187452 - DNA, 25 bp, Homo sapien
tgaaaaagaagcaaactcaccttaa

SEQ ID NO: 187453 - DNA, 25 bp, Homo sapien
tggtcagcctaaatcttcccagtcc

SEQ ID NO: 187454 - DNA, 25 bp, Homo sapien
aaatcttcccagtcccgctgtggag

SEQ ID NO: 187455 - DNA, 25 bp, Homo sapien
tggagctgtcagtcaccggagtaat

SEQ ID NO: 187456 - DNA, 25 bp, Homo sapien
ggagtaatgagctcctggttcctcg

SEQ ID NO: 187457 - DNA, 25 bp, Homo sapien
gttcctcgggagtccttcgtgctgt

SEQ ID NO: 187458 - DNA, 25 bp, Homo sapien
ttcgtgctgtgtggcagggttcctc

SEQ ID NO: 187459 - DNA, 25 bp, Homo sapien
gggttcctctctagacaagtacaca

SEQ ID NO: 187460 - DNA, 25 bp, Homo sapien
gttgtactatgatcacagtccctgt

SEQ ID NO: 187461 - DNA, 25 bp, Homo sapien
tgtgccatccttttccaagactggg

SEQ ID NO: 187462 - DNA, 25 bp, Homo sapien
ccacttgtttccttggagatgtttt

SEQ ID NO: 187463 - DNA, 25 bp, Homo sapien
gtttttccaagagcataatgtacat

SEQ ID NO: 187464 - DNA, 25 bp, Homo sapien
gaaactatgtaattttctggctaat

SEQ ID NO: 187465 - DNA, 25 bp, Homo sapien
gggagtggttaattgaaatagtcaa

SEQ ID NO: 187466 - DNA, 25 bp, Homo sapien
ctctgaagcaaaatgataggcatca

SEQ ID NO: 187467 - DNA, 25 bp, Homo sapien
aatgataggcatcattctaacttca

SEQ ID NO: 187468 - DNA, 25 bp, Homo sapien
caaaagccagttctgttttatgaaa

SEQ ID NO: 187469 - DNA, 25 bp, Homo sapien
acttgtatattctaatgtttgccag

SEQ ID NO: 187470 - DNA, 25 bp, Homo sapien
tgtatattctaatgtttgccaggaa

SEQ ID NO: 187471 - DNA, 25 bp, Homo sapien
gtttgccaggaaaggctaggttcag

SEQ ID NO: 187472 - DNA, 25 bp, Homo sapien
gccaggaaaggctaggttcagtaga

SEQ ID NO: 187473 - DNA, 25 bp, Homo sapien
ggctaggttcagtagatgagacatt

SEQ ID NO: 187474 - DNA, 25 bp, Homo sapien
aggttcagtagatgagacattattt

SEQ ID NO: 187475 - DNA, 25 bp, Homo sapien
gttactgtacactctgtttgttcaa

SEQ ID NO: 187476 - DNA, 25 bp, Homo sapien
aataaactgcatatcaacttcccac

SEQ ID NO: 187477 - DNA, 25 bp, Homo sapien
caacttcccacaaaagctgactttt

SEQ ID NO: 187478 - DNA, 25 bp, Homo sapien
gacttttttgggtctcttacatata

SEQ ID NO: 187479 - DNA, 25 bp, Homo sapien
tctcatattggtcgaattcttctgg

SEQ ID NO: 187480 - DNA, 25 bp, Homo sapien
gaattcttctggtatggactcttgc

SEQ ID NO: 187481 - DNA, 25 bp, Homo sapien
ggtatggactcttgccttatataga

SEQ ID NO: 187482 - DNA, 25 bp, Homo sapien
ttctatttctcttaagtcaccatca

SEQ ID NO: 187483 - DNA, 25 bp, Homo sapien
gtcaccatcaatacaacggccggag

SEQ ID NO: 187484 - DNA, 25 bp, Homo sapien
gactggaatacacctttggaacgga

SEQ ID NO: 187485 - DNA, 25 bp, Homo sapien
ctttggaacggaattctttatcaat

SEQ ID NO: 187486 - DNA, 25 bp, Homo sapien
gggaagtgacccgtgtccgttctca

SEQ ID NO: 187487 - DNA, 25 bp, Homo sapien
gtgtccgttctcagggctttgtcac

SEQ ID NO: 187488 - DNA, 25 bp, Homo sapien
agggctttgtcaccctcctcttcaa

SEQ ID NO: 187489 - DNA, 25 bp, Homo sapien
aggaaactgggctatgacactgggc

SEQ ID NO: 187490 - DNA, 25 bp, Homo sapien
ggctatgacactgggccttctgata

SEQ ID NO: 187491 - DNA, 25 bp, Homo sapien
atgacactgggccttctgatacaca

SEQ ID NO: 187492 - DNA, 25 bp, Homo sapien
ctgggccttctgatacacagggtgt

SEQ ID NO: 187493 - DNA, 25 bp, Homo sapien
ggccttctgatacacagggtgtgtt

SEQ ID NO: 187494 - DNA, 25 bp, Homo sapien
agtgaaggctccacaggctgcacag

SEQ ID NO: 187495 - DNA, 25 bp, Homo sapien
tgataatgaagggctgccttcccga

SEQ ID NO: 187496 - DNA, 25 bp, Homo sapien
ttgataataaagtctcattttcaga

SEQ ID NO: 187497 - DNA, 25 bp, Homo sapien
tcatgatcccagctggcatgctggt

SEQ ID NO: 187498 - DNA, 25 bp, Homo sapien
gctggtggctgtgcttcgagaagag

SEQ ID NO: 187499 - DNA, 25 bp, Homo sapien
gctcactctgggagcggctccaaca

SEQ ID NO: 187500 - DNA, 25 bp, Homo sapien
gaccatcgctggaggagaaccggac

SEQ ID NO: 187501 - DNA, 25 bp, Homo sapien
atgtatgtggccacgctggctggga

SEQ ID NO: 187502 - DNA, 25 bp, Homo sapien
agtcaccaaagccactgatggtgca

SEQ ID NO: 187503 - DNA, 25 bp, Homo sapien
aagccactgatggtgcacatgcgca

SEQ ID NO: 187504 - DNA, 25 bp, Homo sapien
tgatggtgcacatgcgcaagtacgg

SEQ ID NO: 187505 - DNA, 25 bp, Homo sapien
gggcatcaccagcttcgagaacacg

SEQ ID NO: 187506 - DNA, 25 bp, Homo sapien
gcttcgagaacacggccatcgaggt

SEQ ID NO: 187507 - DNA, 25 bp, Homo sapien
ccatcgaggtggaccgtgagattgc

SEQ ID NO: 187508 - DNA, 25 bp, Homo sapien
tttgcagtcctatttatctgcagtc

SEQ ID NO: 187509 - DNA, 25 bp, Homo sapien
agtcctatttatctgcagtcgtatt

SEQ ID NO: 187510 - DNA, 25 bp, Homo sapien
tatttatctgcagtcgtattaagtc

SEQ ID NO: 187511 - DNA, 25 bp, Homo sapien
gtattgccatttaaattacacactg

SEQ ID NO: 187512 - DNA, 25 bp, Homo sapien
gccatttaaattacacactgagagc

SEQ ID NO: 187513 - DNA, 25 bp, Homo sapien
cacactgagagcatgtcctatgcag

SEQ ID NO: 187514 - DNA, 25 bp, Homo sapien
actgagagcatgtcctatgcagaca

SEQ ID NO: 187515 - DNA, 25 bp, Homo sapien
cattgcagtggattgatttgataaa

SEQ ID NO: 187516 - DNA, 25 bp, Homo sapien
gtgttgaattactacatttgctgta

SEQ ID NO: 187517 - DNA, 25 bp, Homo sapien
gaattactacatttgctgtacatat

SEQ ID NO: 187518 - DNA, 25 bp, Homo sapien
acatttgctgtacatattatttaat

SEQ ID NO: 187519 - DNA, 25 bp, Homo sapien
ttgatcacatgggtaactaccctat

SEQ ID NO: 187520 - DNA, 25 bp, Homo sapien
gtaactaccctatcgttttgctaat

SEQ ID NO: 187521 - DNA, 25 bp, Homo sapien
taccctatcgttttgctaatagaaa

SEQ ID NO: 187522 - DNA, 25 bp, Homo sapien
gcagatgatttgcagtgaccatttt

SEQ ID NO: 187523 - DNA, 25 bp, Homo sapien
gatttgcagtgaccattttgttgca

SEQ ID NO: 187524 - DNA, 25 bp, Homo sapien
ttttgttgcagttgactcacgatta

SEQ ID NO: 187525 - DNA, 25 bp, Homo sapien
gttgcagttgactcacgattatagt

SEQ ID NO: 187526 - DNA, 25 bp, Homo sapien
ctcacgattatagtcataggtatgt

SEQ ID NO: 187527 - DNA, 25 bp, Homo sapien
ataggtatgtcctttttgcccattt

SEQ ID NO: 187528 - DNA, 25 bp, Homo sapien
gcccatttcattatagtcaagtttg

SEQ ID NO: 187529 - DNA, 25 bp, Homo sapien
gtcaagtttgtttcttcctgtgttt

SEQ ID NO: 187530 - DNA, 25 bp, Homo sapien
ttacattttcagctatatttacttt

SEQ ID NO: 187531 - DNA, 25 bp, Homo sapien
ctttttaaatgcttgagtttcccat

SEQ ID NO: 187532 - DNA, 25 bp, Homo sapien
taaatgcttgagtttcccattttaa

SEQ ID NO: 187533 - DNA, 25 bp, Homo sapien
aaactagacatcttaattggtgaaa

SEQ ID NO: 187534 - DNA, 25 bp, Homo sapien
aaactacttattgttggtaggcaca

SEQ ID NO: 187535 - DNA, 25 bp, Homo sapien
ttattgttggtaggcacatcgtgtc

SEQ ID NO: 187536 - DNA, 25 bp, Homo sapien
tgttggtaggcacatcgtgtcaagt

SEQ ID NO: 187537 - DNA, 25 bp, Homo sapien
gtaggcacatcgtgtcaagtgaagt

SEQ ID NO: 187538 - DNA, 25 bp, Homo sapien
catcgtgtcaagtgaagtagtttta

SEQ ID NO: 187539 - DNA, 25 bp, Homo sapien
ttctcccccttcaccagggtgggtg

SEQ ID NO: 187540 - DNA, 25 bp, Homo sapien
ggtggaataagttgatttggccaat

SEQ ID NO: 187541 - DNA, 25 bp, Homo sapien
aaagctgtttgctgctttatgcagg

SEQ ID NO: 187542 - DNA, 25 bp, Homo sapien
tatgcaggtgcagtgttcagtcagc

SEQ ID NO: 187543 - DNA, 25 bp, Homo sapien
tgcagtgttcagtcagcaaggaagt

SEQ ID NO: 187544 - DNA, 25 bp, Homo sapien
ggacatggtattgtgtctacaccca

SEQ ID NO: 187545 - DNA, 25 bp, Homo sapien
tgtgtctacacccaagttcttaact

SEQ ID NO: 187546 - DNA, 25 bp, Homo sapien
gttcttaactaagcttctcgctcta

SEQ ID NO: 187547 - DNA, 25 bp, Homo sapien
aagcttctcgctctaatactgcatt

SEQ ID NO: 187548 - DNA, 25 bp, Homo sapien
atactgcattctgtttctccttttg

SEQ ID NO: 187549 - DNA, 25 bp, Homo sapien
tccttttgtgccctgattgtaatcc

SEQ ID NO: 187550 - DNA, 25 bp, Homo sapien
aacaatacatgttcttctggtagtg

SEQ ID NO: 187551 - DNA, 25 bp, Homo sapien
catgttcttctggtagtgtttggat

SEQ ID NO: 187552 - DNA, 25 bp, Homo sapien
ctttctctctttcttatgaacaaaa

SEQ ID NO: 187553 - DNA, 25 bp, Homo sapien
aagaactgttttttgcctgctggta

SEQ ID NO: 187554 - DNA, 25 bp, Homo sapien
gttttttgcctgctggtacattaca

SEQ ID NO: 187555 - DNA, 25 bp, Homo sapien
ggtacattacatttccggaggcttg

SEQ ID NO: 187556 - DNA, 25 bp, Homo sapien
tacatttccggaggcttgggtgaat

SEQ ID NO: 187557 - DNA, 25 bp, Homo sapien
gaataatagttttcccagtctccct

SEQ ID NO: 187558 - DNA, 25 bp, Homo sapien
agtctccctcggatggtggccttaa

SEQ ID NO: 187559 - DNA, 25 bp, Homo sapien
ggccttaaggcctggtagtgcttca

SEQ ID NO: 187560 - DNA, 25 bp, Homo sapien
gtagtgcttcaagaggtccactggt

SEQ ID NO: 187561 - DNA, 25 bp, Homo sapien
ggtccactggttggatctctagcta

SEQ ID NO: 187562 - DNA, 25 bp, Homo sapien
atctctagctactggcctctaaata

SEQ ID NO: 187563 - DNA, 25 bp, Homo sapien
gcattggttttcttacctccaaatg

SEQ ID NO: 187564 - DNA, 25 bp, Homo sapien
gttttcttacctccaaatggttctg

SEQ ID NO: 187565 - DNA, 25 bp, Homo sapien
ccaaatggttctgacaatgactgag

SEQ ID NO: 187566 - DNA, 25 bp, Homo sapien
atgatctttgtataggacgtgtgtt

SEQ ID NO: 187567 - DNA, 25 bp, Homo sapien
aggacgtgtgttgtcattatttgta

SEQ ID NO: 187568 - DNA, 25 bp, Homo sapien
gtaactacatatccaatacagctgt

SEQ ID NO: 187569 - DNA, 25 bp, Homo sapien
ccaatacagctgtatgtttcttttt

SEQ ID NO: 187570 - DNA, 25 bp, Homo sapien
tcttttctaatttggtggcactggt

SEQ ID NO: 187571 - DNA, 25 bp, Homo sapien
gtggcactggtataaccacccatta

SEQ ID NO: 187572 - DNA, 25 bp, Homo sapien
ggtataaccacccattaaagtcagt

SEQ ID NO: 187573 - DNA, 25 bp, Homo sapien
cacccattaaagtcagtagtacatt

SEQ ID NO: 187574 - DNA, 25 bp, Homo sapien
aggcttcccttgtgcagagggagaa

SEQ ID NO: 187575 - DNA, 25 bp, Homo sapien
gtttttaaatggagccctgaggcat

SEQ ID NO: 187576 - DNA, 25 bp, Homo sapien
ctgaggcatcagctattatacttgg

SEQ ID NO: 187577 - DNA, 25 bp, Homo sapien
attatacttgggactctacctctca

SEQ ID NO: 187578 - DNA, 25 bp, Homo sapien
tacctctcactcactatatgctaac

SEQ ID NO: 187579 - DNA, 25 bp, Homo sapien
aagccattcaacaaggagtcaagta

SEQ ID NO: 187580 - DNA, 25 bp, Homo sapien
taaatactcaacagactcctccttt

SEQ ID NO: 187581 - DNA, 25 bp, Homo sapien
ttcaggtactgtgtggtgaccgccc

SEQ ID NO: 187582 - DNA, 25 bp, Homo sapien
cactggtgtctattacaggccactt

SEQ ID NO: 187583 - DNA, 25 bp, Homo sapien
caggccactttggtagttgtgtatc

SEQ ID NO: 187584 - DNA, 25 bp, Homo sapien
gttgtgtatctgctcatgtatgtga

SEQ ID NO: 187585 - DNA, 25 bp, Homo sapien
tcagagaccctctcaactggtcaaa

SEQ ID NO: 187586 - DNA, 25 bp, Homo sapien
actggtcaaaaactgaggaggcctt

SEQ ID NO: 187587 - DNA, 25 bp, Homo sapien
ccgctgggagccttgagagccatgt

SEQ ID NO: 187588 - DNA, 25 bp, Homo sapien
tgggagccttgagagccatgtgcaa

SEQ ID NO: 187589 - DNA, 25 bp, Homo sapien
agccatgtgcaagaggacagatcct

SEQ ID NO: 187590 - DNA, 25 bp, Homo sapien
gcaagaggacagatcctgttcctgt

SEQ ID NO: 187591 - DNA, 25 bp, Homo sapien
gacagatcctgttcctgtcaccatt

SEQ ID NO: 187592 - DNA, 25 bp, Homo sapien
tcctgtcaccattgctctcgattca

SEQ ID NO: 187593 - DNA, 25 bp, Homo sapien
attgctctcgattcactcagctggc

SEQ ID NO: 187594 - DNA, 25 bp, Homo sapien
gattcactcagctggctgctacttc

SEQ ID NO: 187595 - DNA, 25 bp, Homo sapien
tcctgcatgctgtgagccatcagga

SEQ ID NO: 187596 - DNA, 25 bp, Homo sapien
cgcgcagctgcctaggatgttctgg

SEQ ID NO: 187597 - DNA, 25 bp, Homo sapien
gctgcctaggatgttctgggctaat

SEQ ID NO: 187598 - DNA, 25 bp, Homo sapien
atgttctgggctaatatacttgtaa

SEQ ID NO: 187599 - DNA, 25 bp, Homo sapien
tacttgtaaaaccaccgcattctag

SEQ ID NO: 187600 - DNA, 25 bp, Homo sapien
ccgcattctagggttttctttcatt

SEQ ID NO: 187601 - DNA, 25 bp, Homo sapien
aaacaaacgagcaggcatttctgtg

SEQ ID NO: 187602 - DNA, 25 bp, Homo sapien
gaaggtgggttctgcgtgtcccttc

SEQ ID NO: 187603 - DNA, 25 bp, Homo sapien
cccagcgctgctggtcagtcgtgga

SEQ ID NO: 187604 - DNA, 25 bp, Homo sapien
gtggagcgccatcatgtcttaccag

SEQ ID NO: 187605 - DNA, 25 bp, Homo sapien
atgtcttaccagtgacgctgctgac

SEQ ID NO: 187606 - DNA, 25 bp, Homo sapien
gctgacacccctgacttttattaaa

SEQ ID NO: 187607 - DNA, 25 bp, Homo sapien
ttccttgggagactttattcagctg

SEQ ID NO: 187608 - DNA, 25 bp, Homo sapien
ggagactttattcagctgagagtgc

SEQ ID NO: 187609 - DNA, 25 bp, Homo sapien
tcagctgagagtgccctagacagta

SEQ ID NO: 187610 - DNA, 25 bp, Homo sapien
gagagtgccctagacagtaacttct

SEQ ID NO: 187611 - DNA, 25 bp, Homo sapien
gagtgccctagacagtaacttctaa

SEQ ID NO: 187612 - DNA, 25 bp, Homo sapien
gacagtaacttctaaggtcacgttt

SEQ ID NO: 187613 - DNA, 25 bp, Homo sapien
taaggtcacgtttactatttcagag

SEQ ID NO: 187614 - DNA, 25 bp, Homo sapien
ggtcacgtttactatttcagaggaa

SEQ ID NO: 187615 - DNA, 25 bp, Homo sapien
ttcagaggaaatatcttgccaggat

SEQ ID NO: 187616 - DNA, 25 bp, Homo sapien
aatatcttgccaggatacctaccca

SEQ ID NO: 187617 - DNA, 25 bp, Homo sapien
ttgccaggatacctacccatcctta

SEQ ID NO: 187618 - DNA, 25 bp, Homo sapien
aaactcttccttgacttagcatgcc

SEQ ID NO: 187619 - DNA, 25 bp, Homo sapien
ttagcatgccgactcatcagtgaag

SEQ ID NO: 187620 - DNA, 25 bp, Homo sapien
gaagccagacagaacacacttgtga

SEQ ID NO: 187621 - DNA, 25 bp, Homo sapien
tgtatcctcacccttacctggagaa

SEQ ID NO: 187622 - DNA, 25 bp, Homo sapien
gcatcagctatttgacttgttgtaa

SEQ ID NO: 187623 - DNA, 25 bp, Homo sapien
atttcaactaaaggctgaggcacgg

SEQ ID NO: 187624 - DNA, 25 bp, Homo sapien
gaaaaggaatcagcaactgccctga

SEQ ID NO: 187625 - DNA, 25 bp, Homo sapien
aactgccctgatgcggcaatgagat

SEQ ID NO: 187626 - DNA, 25 bp, Homo sapien
tctggcgatgactgtggctcccgct

SEQ ID NO: 187627 - DNA, 25 bp, Homo sapien
gtgggctcctgagcttacaaagcat

SEQ ID NO: 187628 - DNA, 25 bp, Homo sapien
caagggctcgaccacaggccagcat

SEQ ID NO: 187629 - DNA, 25 bp, Homo sapien
tatggcattggctggctcatggccc

SEQ ID NO: 187630 - DNA, 25 bp, Homo sapien
gatctgcatcacagtgtggaagacg

SEQ ID NO: 187631 - DNA, 25 bp, Homo sapien
cccagcacagatctgaaaatgcggg

SEQ ID NO: 187632 - DNA, 25 bp, Homo sapien
gtgagcccacggatggtgacagtta

SEQ ID NO: 187633 - DNA, 25 bp, Homo sapien
ccacggatggtgacagttaatgact

SEQ ID NO: 187634 - DNA, 25 bp, Homo sapien
gttaatgactgtgatgccaaactca

SEQ ID NO: 187635 - DNA, 25 bp, Homo sapien
ctgtgatgccaaactcaagagtgac

SEQ ID NO: 187636 - DNA, 25 bp, Homo sapien
aagagtgacgggaccatcgcagcca

SEQ ID NO: 187637 - DNA, 25 bp, Homo sapien
gggaccatcgcagccatcacagaga

SEQ ID NO: 187638 - DNA, 25 bp, Homo sapien
aaggagacgcacttctgagcggcca

SEQ ID NO: 187639 - DNA, 25 bp, Homo sapien
tctgagcggccaccagccatctggg

SEQ ID NO: 187640 - DNA, 25 bp, Homo sapien
ttagaatcgctgttctggcatccat

SEQ ID NO: 187641 - DNA, 25 bp, Homo sapien
tggcatccatttgcgttactcaggc

SEQ ID NO: 187642 - DNA, 25 bp, Homo sapien
gcgttactcaggcatttatgatgtg

SEQ ID NO: 187643 - DNA, 25 bp, Homo sapien
gttcattaattttcagcttcgaagg

SEQ ID NO: 187644 - DNA, 25 bp, Homo sapien
gcttcgaaggtggagggaacattct

SEQ ID NO: 187645 - DNA, 25 bp, Homo sapien
tgcttttcaggcaccagctgtgaag

SEQ ID NO: 187646 - DNA, 25 bp, Homo sapien
aacttcaaatgtagcagactctccc

SEQ ID NO: 187647 - DNA, 25 bp, Homo sapien
gtagcagactctccccggaataaaa

SEQ ID NO: 187648 - DNA, 25 bp, Homo sapien
gttttggccttgcaagagcagaaaa

SEQ ID NO: 187649 - DNA, 25 bp, Homo sapien
ctggatttcagtactggaaacttca

SEQ ID NO: 187650 - DNA, 25 bp, Homo sapien
ggaaacttcaatgtgttagctgtta

SEQ ID NO: 187651 - DNA, 25 bp, Homo sapien
gtacctctactgtgtgctgtttata

SEQ ID NO: 187652 - DNA, 25 bp, Homo sapien
gctgtttatattaagcggcctttta

SEQ ID NO: 187653 - DNA, 25 bp, Homo sapien
tttacttcctgtttgtccactacaa

SEQ ID NO: 187654 - DNA, 25 bp, Homo sapien
ccactacaagtttggatgggctcag

SEQ ID NO: 187655 - DNA, 25 bp, Homo sapien
gaaaatctcaaagccgattaccatg

SEQ ID NO: 187656 - DNA, 25 bp, Homo sapien
gattaccatgcaccttcagatgcta

SEQ ID NO: 187657 - DNA, 25 bp, Homo sapien
gctaatggaagtggtcccaccggag

SEQ ID NO: 187658 - DNA, 25 bp, Homo sapien
tggtcccaccggaggaagaccctga

SEQ ID NO: 187659 - DNA, 25 bp, Homo sapien
gaagaccctgagtaacaagctccgt

SEQ ID NO: 187660 - DNA, 25 bp, Homo sapien
gagtaacaagctccgtctcttgtag

SEQ ID NO: 187661 - DNA, 25 bp, Homo sapien
gtctcttgtagccaagtcagctgaa

SEQ ID NO: 187662 - DNA, 25 bp, Homo sapien
ccaatgtgcctttttaatgcttgaa

SEQ ID NO: 187663 - DNA, 25 bp, Homo sapien
tgaagttttatctacatacacaggt

SEQ ID NO: 187664 - DNA, 25 bp, Homo sapien
cacaggtaacagaggacagtagtct

SEQ ID NO: 187665 - DNA, 25 bp, Homo sapien
gtctgtaaacatataaatcggtcat

SEQ ID NO: 187666 - DNA, 25 bp, Homo sapien
cagtcctgtcaaattgcttaataga

SEQ ID NO: 187667 - DNA, 25 bp, Homo sapien
ggaagttctgctgtcagaggcaaaa

SEQ ID NO: 187668 - DNA, 25 bp, Homo sapien
gctgtcagaggcaaaacatctgttt

SEQ ID NO: 187669 - DNA, 25 bp, Homo sapien
aacatctgtttatcatagacatcaa

SEQ ID NO: 187670 - DNA, 25 bp, Homo sapien
tagacatcaacatgacctataagta

SEQ ID NO: 187671 - DNA, 25 bp, Homo sapien
aaagtgcgtgtctagtgtcttctat

SEQ ID NO: 187672 - DNA, 25 bp, Homo sapien
gtgtcttctattgagagtactacta

SEQ ID NO: 187673 - DNA, 25 bp, Homo sapien
ggcagacgggccgtttccatgctga

SEQ ID NO: 187674 - DNA, 25 bp, Homo sapien
agacgggccgtttccatgctgatca

SEQ ID NO: 187675 - DNA, 25 bp, Homo sapien
acgggccgtttccatgctgatcatt

SEQ ID NO: 187676 - DNA, 25 bp, Homo sapien
gccgtttccatgctgatcattggca

SEQ ID NO: 187677 - DNA, 25 bp, Homo sapien
ttcctacccgggatttaccactgcg

SEQ ID NO: 187678 - DNA, 25 bp, Homo sapien
ctacccgggatttaccactgcgcat

SEQ ID NO: 187679 - DNA, 25 bp, Homo sapien
cgggatttaccactgcgcatcgtta

SEQ ID NO: 187680 - DNA, 25 bp, Homo sapien
ggatttaccactgcgcatcgttata

SEQ ID NO: 187681 - DNA, 25 bp, Homo sapien
taccactgcgcatcgttatatgcat

SEQ ID NO: 187682 - DNA, 25 bp, Homo sapien
cactgcgcatcgttatatgcatcca

SEQ ID NO: 187683 - DNA, 25 bp, Homo sapien
caccccatagtgaggaggatcacat

SEQ ID NO: 187684 - DNA, 25 bp, Homo sapien
gggctgaaggatctatattccctta

SEQ ID NO: 187685 - DNA, 25 bp, Homo sapien
tattcccttattgcattttccttat

SEQ ID NO: 187686 - DNA, 25 bp, Homo sapien
cttatgtataattttccagatggtg

SEQ ID NO: 187687 - DNA, 25 bp, Homo sapien
ccagatggtgatgttacttttcagt

SEQ ID NO: 187688 - DNA, 25 bp, Homo sapien
atgctctgtactaggaaggatccaa

SEQ ID NO: 187689 - DNA, 25 bp, Homo sapien
actaggaaggatccaaggcagattt

SEQ ID NO: 187690 - DNA, 25 bp, Homo sapien
gaatatggccgataagaaaatccta

SEQ ID NO: 187691 - DNA, 25 bp, Homo sapien
gaaaatcctaaaacctacagatgaa

SEQ ID NO: 187692 - DNA, 25 bp, Homo sapien
gaaaatctccttaagtattatacct

SEQ ID NO: 187693 - DNA, 25 bp, Homo sapien
tacctcatgaattcccgtccaagga

SEQ ID NO: 187694 - DNA, 25 bp, Homo sapien
cccgtccaaggaagcagagttgtta

SEQ ID NO: 187695 - DNA, 25 bp, Homo sapien
ttcctgaggacgctggccccagtgc

SEQ ID NO: 187696 - DNA, 25 bp, Homo sapien
tatgggaccttgcaagtcatcccac

SEQ ID NO: 187697 - DNA, 25 bp, Homo sapien
cttgcaagtcatcccacaggctgca

SEQ ID NO: 187698 - DNA, 25 bp, Homo sapien
gctgcactgtcaggaagaggaccct

SEQ ID NO: 187699 - DNA, 25 bp, Homo sapien
cagcactgggcttcacctagaactt

SEQ ID NO: 187700 - DNA, 25 bp, Homo sapien
gggcttcacctagaacttcagtggg

SEQ ID NO: 187701 - DNA, 25 bp, Homo sapien
ggccaagggtgctgagaacccagca

SEQ ID NO: 187702 - DNA, 25 bp, Homo sapien
tgagaacccagcaatgaccaggaag

SEQ ID NO: 187703 - DNA, 25 bp, Homo sapien
gaccaggaagatacagtcactaact

SEQ ID NO: 187704 - DNA, 25 bp, Homo sapien
gatacagtcactaacttcatctgtc

SEQ ID NO: 187705 - DNA, 25 bp, Homo sapien
caggtcctgcctccacaggtttaac

SEQ ID NO: 187706 - DNA, 25 bp, Homo sapien
gtgaactgattgaggaagggtctat

SEQ ID NO: 187707 - DNA, 25 bp, Homo sapien
ctgattgaggaagggtctattgtct

SEQ ID NO: 187708 - DNA, 25 bp, Homo sapien
attgaggaagggtctattgtctttt

SEQ ID NO: 187709 - DNA, 25 bp, Homo sapien
tgaggaagggtctattgtcttttta

SEQ ID NO: 187710 - DNA, 25 bp, Homo sapien
tgtctttttaaatggcacaatttta

SEQ ID NO: 187711 - DNA, 25 bp, Homo sapien
aatggcacaattttaagggtttgag

SEQ ID NO: 187712 - DNA, 25 bp, Homo sapien
tttgagggtacagtcccttaacctg

SEQ ID NO: 187713 - DNA, 25 bp, Homo sapien
tgagggtacagtcccttaacctgcc

SEQ ID NO: 187714 - DNA, 25 bp, Homo sapien
ggagcagggatatctaagctgtggt

SEQ ID NO: 187715 - DNA, 25 bp, Homo sapien
gggtgctgtgttctagaccccccat

SEQ ID NO: 187716 - DNA, 25 bp, Homo sapien
ctgtgttctagaccccccatattat

SEQ ID NO: 187717 - DNA, 25 bp, Homo sapien
cctgggacttccacaaactggaact

SEQ ID NO: 187718 - DNA, 25 bp, Homo sapien
caaactggaactgctctttgagggt

SEQ ID NO: 187719 - DNA, 25 bp, Homo sapien
ctggaactgctctttgagggtggat

SEQ ID NO: 187720 - DNA, 25 bp, Homo sapien
atcaacaggacatggcctgcagctt

SEQ ID NO: 187721 - DNA, 25 bp, Homo sapien
agctccctgctgatgaagtcaatgc

SEQ ID NO: 187722 - DNA, 25 bp, Homo sapien
tgaagtcaatgctgttctctgccca

SEQ ID NO: 187723 - DNA, 25 bp, Homo sapien
aatgctgttctctgcccaggcgagc

SEQ ID NO: 187724 - DNA, 25 bp, Homo sapien
gagcctctggtctctgttcagaacc

SEQ ID NO: 187725 - DNA, 25 bp, Homo sapien
gtctctgttcagaaccagacctgtg

SEQ ID NO: 187726 - DNA, 25 bp, Homo sapien
agacctgtgggcaccttcgtggttc

SEQ ID NO: 187727 - DNA, 25 bp, Homo sapien
ttcgtggttcctctttgcaggagaa

SEQ ID NO: 187728 - DNA, 25 bp, Homo sapien
gccatcacactccacaaaaacattt

SEQ ID NO: 187729 - DNA, 25 bp, Homo sapien
ttaatttatggatcctgcctcctgc

SEQ ID NO: 187730 - DNA, 25 bp, Homo sapien
tttccactccctgagtaattcatgg

SEQ ID NO: 187731 - DNA, 25 bp, Homo sapien
tggcacacgagcaggcgccccgaag

SEQ ID NO: 187732 - DNA, 25 bp, Homo sapien
gcccaccgcttcatcactgagaagg

SEQ ID NO: 187733 - DNA, 25 bp, Homo sapien
ttcatcactgagaaggcggtcttct

SEQ ID NO: 187734 - DNA, 25 bp, Homo sapien
gtcttctcccgctgggccaagaaga

SEQ ID NO: 187735 - DNA, 25 bp, Homo sapien
aagaagaggcccatcgtgttcgccc

SEQ ID NO: 187736 - DNA, 25 bp, Homo sapien
gtgttcgcccatccgtcctggagga

SEQ ID NO: 187737 - DNA, 25 bp, Homo sapien
ggactgagtagcttccgtcgtcctg

SEQ ID NO: 187738 - DNA, 25 bp, Homo sapien
cgttgcgaggcctccgggatgtccc

SEQ ID NO: 187739 - DNA, 25 bp, Homo sapien
acagctccctgctgatgaagtcaat

SEQ ID NO: 187740 - DNA, 25 bp, Homo sapien
agctccctgctgatgaagtcaatgc

SEQ ID NO: 187741 - DNA, 25 bp, Homo sapien
ctccctgctgatgaagtcaatgctg

SEQ ID NO: 187742 - DNA, 25 bp, Homo sapien
tcaatgctgttctctgcccaggcga

SEQ ID NO: 187743 - DNA, 25 bp, Homo sapien
aatgctgttctctgcccaggcgagc

SEQ ID NO: 187744 - DNA, 25 bp, Homo sapien
tgttctctgcccaggcgagcctctg

SEQ ID NO: 187745 - DNA, 25 bp, Homo sapien
gagcctctggtctctgttcagaacc

SEQ ID NO: 187746 - DNA, 25 bp, Homo sapien
gtctctgttcagaaccagacctgtg

SEQ ID NO: 187747 - DNA, 25 bp, Homo sapien
tctctgttcagaaccagacctgtgg

SEQ ID NO: 187748 - DNA, 25 bp, Homo sapien
accttcgtggttcctctttgcagga

SEQ ID NO: 187749 - DNA, 25 bp, Homo sapien
ttcgtggttcctctttgcaggagaa

SEQ ID NO: 187750 - DNA, 25 bp, Homo sapien
ttttgggcttaagattgccagcagc

SEQ ID NO: 187751 - DNA, 25 bp, Homo sapien
ttgccagcagcacacatcagatgca

SEQ ID NO: 187752 - DNA, 25 bp, Homo sapien
atgcagtcattgttgctatcagtgt

SEQ ID NO: 187753 - DNA, 25 bp, Homo sapien
gatagagtctagactcgggccactt

SEQ ID NO: 187754 - DNA, 25 bp, Homo sapien
tcgggccacttggagttgtgtactc

SEQ ID NO: 187755 - DNA, 25 bp, Homo sapien
gttgtgtactccaaagctaaggaca

SEQ ID NO: 187756 - DNA, 25 bp, Homo sapien
ggactggagcagtccctcctcatgg

SEQ ID NO: 187757 - DNA, 25 bp, Homo sapien
tcatggcggcctgtgaccaaggtcg

SEQ ID NO: 187758 - DNA, 25 bp, Homo sapien
gaggagtggagctatccttccatga

SEQ ID NO: 187759 - DNA, 25 bp, Homo sapien
agctatccttccatgatctgatcat

SEQ ID NO: 187760 - DNA, 25 bp, Homo sapien
gatcatgtacagttccctttttaaa

SEQ ID NO: 187761 - DNA, 25 bp, Homo sapien
tatagcagtgtagctgttctctcta

SEQ ID NO: 187762 - DNA, 25 bp, Homo sapien
gcagtgtagctgttctctctagatg

SEQ ID NO: 187763 - DNA, 25 bp, Homo sapien
gtagctgttctctctagatggtgtc

SEQ ID NO: 187764 - DNA, 25 bp, Homo sapien
gttctctctagatggtgtctcacaa

SEQ ID NO: 187765 - DNA, 25 bp, Homo sapien
tggtgtctcacaatggatttctgtt

SEQ ID NO: 187766 - DNA, 25 bp, Homo sapien
caatggatttctgttgcttgactat

SEQ ID NO: 187767 - DNA, 25 bp, Homo sapien
gttgcttgactattttcttagtgaa

SEQ ID NO: 187768 - DNA, 25 bp, Homo sapien
gtgactgagatttggtgatctggct

SEQ ID NO: 187769 - DNA, 25 bp, Homo sapien
gtgatctggctgagtattttgaaac

SEQ ID NO: 187770 - DNA, 25 bp, Homo sapien
aataatatggcttagtgttaacggg

SEQ ID NO: 187771 - DNA, 25 bp, Homo sapien
caccttccctgtactgtatgtttgg

SEQ ID NO: 187772 - DNA, 25 bp, Homo sapien
aaagtttgctacttatctgtatgta

SEQ ID NO: 187773 - DNA, 25 bp, Homo sapien
acttatctgtatgtaggttgctaaa

SEQ ID NO: 187774 - DNA, 25 bp, Homo sapien
ctgtatgtaggttgctaaaaaggat

SEQ ID NO: 187775 - DNA, 25 bp, Homo sapien
gattttcttaactcagattttaagc

SEQ ID NO: 187776 - DNA, 25 bp, Homo sapien
ctcagattttaagccaaataaccat

SEQ ID NO: 187777 - DNA, 25 bp, Homo sapien
agccaaataaccatttaacactagt

SEQ ID NO: 187778 - DNA, 25 bp, Homo sapien
ataaccatttaacactagtatttgt

SEQ ID NO: 187779 - DNA, 25 bp, Homo sapien
tatttgtatgtttcactataataag

SEQ ID NO: 187780 - DNA, 25 bp, Homo sapien
ttgactcaaattttatttcttggtc

SEQ ID NO: 187781 - DNA, 25 bp, Homo sapien
attttatttcttggtcttttgctgt

SEQ ID NO: 187782 - DNA, 25 bp, Homo sapien
tttatttcttggtcttttgctgttt

SEQ ID NO: 187783 - DNA, 25 bp, Homo sapien
aaatgggactggctttccacaggaa

SEQ ID NO: 187784 - DNA, 25 bp, Homo sapien
ttccacaggaagtaaactgcttcag

SEQ ID NO: 187785 - DNA, 25 bp, Homo sapien
ccctgctcagtgtccggaaagaagt

SEQ ID NO: 187786 - DNA, 25 bp, Homo sapien
ggaaagaagtcagtcatccctgttg

SEQ ID NO: 187787 - DNA, 25 bp, Homo sapien
gtcatccctgttggcagtaaatctt

SEQ ID NO: 187788 - DNA, 25 bp, Homo sapien
gtaaatcttcccacaggccgtccat

SEQ ID NO: 187789 - DNA, 25 bp, Homo sapien
caggccgtccattagagatttaact

SEQ ID NO: 187790 - DNA, 25 bp, Homo sapien
ttcattctgtttgcttaattcagag

SEQ ID NO: 187791 - DNA, 25 bp, Homo sapien
taattcagagtacagtttgtgctat

SEQ ID NO: 187792 - DNA, 25 bp, Homo sapien
gtgctatttcatatctgtactccag

SEQ ID NO: 187793 - DNA, 25 bp, Homo sapien
tcatatctgtactccaggcagaaat

SEQ ID NO: 187794 - DNA, 25 bp, Homo sapien
aaatcttatctagaattgtaatcag

SEQ ID NO: 187795 - DNA, 25 bp, Homo sapien
aatcttatctagaattgtaatcaga

SEQ ID NO: 187796 - DNA, 25 bp, Homo sapien
atcttatctagaattgtaatcagaa

SEQ ID NO: 187797 - DNA, 25 bp, Homo sapien
cttatctagaattgtaatcagaatt

SEQ ID NO: 187798 - DNA, 25 bp, Homo sapien
aatcagaattataatccccatgtgt

SEQ ID NO: 187799 - DNA, 25 bp, Homo sapien
gtaagtggtggtttcccctgctctt

SEQ ID NO: 187800 - DNA, 25 bp, Homo sapien
taagtggtggtttcccctgctcttc

SEQ ID NO: 187801 - DNA, 25 bp, Homo sapien
aagtggtggtttcccctgctcttct

SEQ ID NO: 187802 - DNA, 25 bp, Homo sapien
tggtggtttcccctgctcttctctc

SEQ ID NO: 187803 - DNA, 25 bp, Homo sapien
ggtggtttcccctgctcttctctct

SEQ ID NO: 187804 - DNA, 25 bp, Homo sapien
tggtttcccctgctcttctctcttg

SEQ ID NO: 187805 - DNA, 25 bp, Homo sapien
gatcctgtttggcattcctacctta

SEQ ID NO: 187806 - DNA, 25 bp, Homo sapien
tgtttggcattcctaccttacggac

SEQ ID NO: 187807 - DNA, 25 bp, Homo sapien
attcctaccttacggacgtctcagg

SEQ ID NO: 187808 - DNA, 25 bp, Homo sapien
gcagagccccggtacaaacagacaa

SEQ ID NO: 187809 - DNA, 25 bp, Homo sapien
ggctgcagtcaaatgggagggtcca

SEQ ID NO: 187810 - DNA, 25 bp, Homo sapien
ggagggtccaggtgtccgtgttgga

SEQ ID NO: 187811 - DNA, 25 bp, Homo sapien
gctgggatcttgtagggcctgtgcg

SEQ ID NO: 187812 - DNA, 25 bp, Homo sapien
gcctgtgcgtcctggctgaggatca

SEQ ID NO: 187813 - DNA, 25 bp, Homo sapien
ggctgaggatcaaaccacatatgtt

SEQ ID NO: 187814 - DNA, 25 bp, Homo sapien
aaccacatatgttattgggagaaac

SEQ ID NO: 187815 - DNA, 25 bp, Homo sapien
gaaacgatttctgttgacgtagata

SEQ ID NO: 187816 - DNA, 25 bp, Homo sapien
atgaccatagcgcgcctgaatgcca

SEQ ID NO: 187817 - DNA, 25 bp, Homo sapien
aaggcccttaccatgctggcagagg

SEQ ID NO: 187818 - DNA, 25 bp, Homo sapien
gcccactttccgtgccatggaggtg

SEQ ID NO: 187819 - DNA, 25 bp, Homo sapien
ggtggagacttacgaaaagcctcaa

SEQ ID NO: 187820 - DNA, 25 bp, Homo sapien
aaagcctcaagtggccgaagcctta

SEQ ID NO: 187821 - DNA, 25 bp, Homo sapien
tggccgaagccttacagcgggcagc

SEQ ID NO: 187822 - DNA, 25 bp, Homo sapien
gggcagcccggatcgccatcagtgt

SEQ ID NO: 187823 - DNA, 25 bp, Homo sapien
ggatcgccatcagtgtcatcgagtt

SEQ ID NO: 187824 - DNA, 25 bp, Homo sapien
gtgtcatcgagttcaaaccctgagc

SEQ ID NO: 187825 - DNA, 25 bp, Homo sapien
agtgaataaatgtgctaagtctctt

SEQ ID NO: 187826 - DNA, 25 bp, Homo sapien
ggaggcacaagccatcggcctgctc

SEQ ID NO: 187827 - DNA, 25 bp, Homo sapien
ggtccccgactcagctggtggctgt

SEQ ID NO: 187828 - DNA, 25 bp, Homo sapien
gtccccgactcagctggtggctgtg

SEQ ID NO: 187829 - DNA, 25 bp, Homo sapien
gtaacctctgcaaggccagcaccca

SEQ ID NO: 187830 - DNA, 25 bp, Homo sapien
aggccagcacccaccatcactacct

SEQ ID NO: 187831 - DNA, 25 bp, Homo sapien
tacctgcacctgctgtggtcccacc

SEQ ID NO: 187832 - DNA, 25 bp, Homo sapien
tggaggcctgggaacctggctgcag

SEQ ID NO: 187833 - DNA, 25 bp, Homo sapien
gaggcctgggaacctggctgcagcc

SEQ ID NO: 187834 - DNA, 25 bp, Homo sapien
gctggagaggcagacggtgggaccc

SEQ ID NO: 187835 - DNA, 25 bp, Homo sapien
aggcagacggtgggacccaccagct

SEQ ID NO: 187836 - DNA, 25 bp, Homo sapien
gtgggctgtcaagacgtgtcatgta

SEQ ID NO: 187837 - DNA, 25 bp, Homo sapien
tgggctgtcaagacgtgtcatgtac

SEQ ID NO: 187838 - DNA, 25 bp, Homo sapien
ttcgtgctatgatggcagagttaag

SEQ ID NO: 187839 - DNA, 25 bp, Homo sapien
aagtaattgccacagagaccatatg

SEQ ID NO: 187840 - DNA, 25 bp, Homo sapien
atcctccatcttccttccttatgtt

SEQ ID NO: 187841 - DNA, 25 bp, Homo sapien
ttccttatgtttcccttggttgtag

SEQ ID NO: 187842 - DNA, 25 bp, Homo sapien
cttatgtttcccttggttgtagaag

SEQ ID NO: 187843 - DNA, 25 bp, Homo sapien
atgtttcccttggttgtagaagaga

SEQ ID NO: 187844 - DNA, 25 bp, Homo sapien
atggaaaggcagctacctttgcaga

SEQ ID NO: 187845 - DNA, 25 bp, Homo sapien
aaggcagctacctttgcagagcagg

SEQ ID NO: 187846 - DNA, 25 bp, Homo sapien
ctttgcagagcaggaccaagtgtaa

SEQ ID NO: 187847 - DNA, 25 bp, Homo sapien
gcaggaccaagtgtaaaagttgata

SEQ ID NO: 187848 - DNA, 25 bp, Homo sapien
aagttgataacatatgtgaacattt

SEQ ID NO: 187849 - DNA, 25 bp, Homo sapien
aaacccaccttgctctgtgttctca

SEQ ID NO: 187850 - DNA, 25 bp, Homo sapien
accttgctctgtgttctcaggcccc

SEQ ID NO: 187851 - DNA, 25 bp, Homo sapien
acccctccagttagtccctatctgg

SEQ ID NO: 187852 - DNA, 25 bp, Homo sapien
atctgggtaagggtcttcccttgag

SEQ ID NO: 187853 - DNA, 25 bp, Homo sapien
ctgggtaagggtcttcccttgagct

SEQ ID NO: 187854 - DNA, 25 bp, Homo sapien
ggtcttcccttgagctccagggggt

SEQ ID NO: 187855 - DNA, 25 bp, Homo sapien
caatgtttacattctcttctgtctc

SEQ ID NO: 187856 - DNA, 25 bp, Homo sapien
aatgtttacattctcttctgtctct

SEQ ID NO: 187857 - DNA, 25 bp, Homo sapien
atgtttacattctcttctgtctctg

SEQ ID NO: 187858 - DNA, 25 bp, Homo sapien
tgtttacattctcttctgtctctgc

SEQ ID NO: 187859 - DNA, 25 bp, Homo sapien
tttacattctcttctgtctctgccc

SEQ ID NO: 187860 - DNA, 25 bp, Homo sapien
gattgtttcacatgtgtaacgtttt

SEQ ID NO: 187861 - DNA, 25 bp, Homo sapien
taaatggtggacgagtactgtggat

SEQ ID NO: 187862 - DNA, 25 bp, Homo sapien
atatgtaattggtcacaaggcctaa

SEQ ID NO: 187863 - DNA, 25 bp, Homo sapien
tggtcacaaggcctaatttgcagta

SEQ ID NO: 187864 - DNA, 25 bp, Homo sapien
aaggcctaatttgcagtaactattg

SEQ ID NO: 187865 - DNA, 25 bp, Homo sapien
ttgcagtaactattgctgttttatt

SEQ ID NO: 187866 - DNA, 25 bp, Homo sapien
gtaaagattgtgtgtctatccaaca

SEQ ID NO: 187867 - DNA, 25 bp, Homo sapien
ttgtgtgtctatccaacagggagcc

SEQ ID NO: 187868 - DNA, 25 bp, Homo sapien
gtatttaaattgaccaacctaatgt

SEQ ID NO: 187869 - DNA, 25 bp, Homo sapien
gaccaacctaatgttacaactactt

SEQ ID NO: 187870 - DNA, 25 bp, Homo sapien
gttacaactactttgaggtggccaa

SEQ ID NO: 187871 - DNA, 25 bp, Homo sapien
aaaaactgagatgtagcccctctcc

SEQ ID NO: 187872 - DNA, 25 bp, Homo sapien
agatgtagcccctctcctggaagtg

SEQ ID NO: 187873 - DNA, 25 bp, Homo sapien
gaaaaactgctcatatgatgtacat

SEQ ID NO: 187874 - DNA, 25 bp, Homo sapien
gatgtacatgtactgattactgcct

SEQ ID NO: 187875 - DNA, 25 bp, Homo sapien
gtactgattactgcctattttaata

SEQ ID NO: 187876 - DNA, 25 bp, Homo sapien
atcattggtacccacttgcttttaa

SEQ ID NO: 187877 - DNA, 25 bp, Homo sapien
tgcttttaaaatccactttatcttg

SEQ ID NO: 187878 - DNA, 25 bp, Homo sapien
agtatttaattcatgttgccttgca

SEQ ID NO: 187879 - DNA, 25 bp, Homo sapien
tgttgccttgcataatggtcagagg

SEQ ID NO: 187880 - DNA, 25 bp, Homo sapien
cttgcataatggtcagaggcgcatg

SEQ ID NO: 187881 - DNA, 25 bp, Homo sapien
cagaggcgcatgaatttgtgaaggt

SEQ ID NO: 187882 - DNA, 25 bp, Homo sapien
acccatatttccttattgatattat

SEQ ID NO: 187883 - DNA, 25 bp, Homo sapien
ttgatattattggtacaggcagaca

SEQ ID NO: 187884 - DNA, 25 bp, Homo sapien
ttggtacaggcagacaaccctggta

SEQ ID NO: 187885 - DNA, 25 bp, Homo sapien
aaccctggtaggagagatggattct

SEQ ID NO: 187886 - DNA, 25 bp, Homo sapien
gggtcatgacctttcgtgattatcc

SEQ ID NO: 187887 - DNA, 25 bp, Homo sapien
gacctttcgtgattatccgcaaatg

SEQ ID NO: 187888 - DNA, 25 bp, Homo sapien
atccgcaaatgcaaacagtttcaga

SEQ ID NO: 187889 - DNA, 25 bp, Homo sapien
acagtttcagatctaatggtttaat

SEQ ID NO: 187890 - DNA, 25 bp, Homo sapien
cagagtgttctgttattctcaatct

SEQ ID NO: 187891 - DNA, 25 bp, Homo sapien
gttctgttattctcaatctttatag

SEQ ID NO: 187892 - DNA, 25 bp, Homo sapien
ctttatagaaacgattctgctggtt

SEQ ID NO: 187893 - DNA, 25 bp, Homo sapien
aaaccaagttggaagctattcggat

SEQ ID NO: 187894 - DNA, 25 bp, Homo sapien
gttggaagctattcggataatttct

SEQ ID NO: 187895 - DNA, 25 bp, Homo sapien
gaactttggagtactgtttcttcct

SEQ ID NO: 187896 - DNA, 25 bp, Homo sapien
tggagtactgtttcttccttcaaac

SEQ ID NO: 187897 - DNA, 25 bp, Homo sapien
aaatgcaccttatatgtttaaacaa

SEQ ID NO: 187898 - DNA, 25 bp, Homo sapien
aacaatctttgtatacttttgggat

SEQ ID NO: 187899 - DNA, 25 bp, Homo sapien
ttgggatttttggtgcttatatgct

SEQ ID NO: 187900 - DNA, 25 bp, Homo sapien
tttttggtgcttatatgctaaatca

SEQ ID NO: 187901 - DNA, 25 bp, Homo sapien
aaatacttccctcaattctgtaaat

SEQ ID NO: 187902 - DNA, 25 bp, Homo sapien
tacttccctcaattctgtaaattaa

SEQ ID NO: 187903 - DNA, 25 bp, Homo sapien
tttacagttccagggattgtgaaat

SEQ ID NO: 187904 - DNA, 25 bp, Homo sapien
ggccatccgggatggactccgcaag

SEQ ID NO: 187905 - DNA, 25 bp, Homo sapien
ccatccgggatggactccgcaaggg

SEQ ID NO: 187906 - DNA, 25 bp, Homo sapien
gatggactccgcaaggggacccaca

SEQ ID NO: 187907 - DNA, 25 bp, Homo sapien
gggacccacaaggacgtcctagaag

SEQ ID NO: 187908 - DNA, 25 bp, Homo sapien
gacccacaaggacgtcctagaagag

SEQ ID NO: 187909 - DNA, 25 bp, Homo sapien
cccacaaggacgtcctagaagaggg

SEQ ID NO: 187910 - DNA, 25 bp, Homo sapien
gaagaggggaccgagagctcctccc

SEQ ID NO: 187911 - DNA, 25 bp, Homo sapien
cacttactgtacatcctcaggccct

SEQ ID NO: 187912 - DNA, 25 bp, Homo sapien
ctcaggccctctcggcagctgtagg

SEQ ID NO: 187913 - DNA, 25 bp, Homo sapien
ctgccccaagcaccatatggaaata

SEQ ID NO: 187914 - DNA, 25 bp, Homo sapien
gccccaagcaccatatggaaataaa

SEQ ID NO: 187915 - DNA, 25 bp, Homo sapien
gaccagtggatgatctaggtagaca

SEQ ID NO: 187916 - DNA, 25 bp, Homo sapien
gcagggtggcctcagggagattcca

SEQ ID NO: 187917 - DNA, 25 bp, Homo sapien
tgatggccccagtgcctgaaagtgc

SEQ ID NO: 187918 - DNA, 25 bp, Homo sapien
cagtgcctgaaagtgcccttgggca

SEQ ID NO: 187919 - DNA, 25 bp, Homo sapien
gctgccaggatctggtctctttggc

SEQ ID NO: 187920 - DNA, 25 bp, Homo sapien
caggccatcagtctgcacttgaaat

SEQ ID NO: 187921 - DNA, 25 bp, Homo sapien
atcagtctgcacttgaaatccccag

SEQ ID NO: 187922 - DNA, 25 bp, Homo sapien
tgcacttgaaatccccagggcctga

SEQ ID NO: 187923 - DNA, 25 bp, Homo sapien
tggccagtacctcaccccttgattg

SEQ ID NO: 187924 - DNA, 25 bp, Homo sapien
cccttgattgccaggtctggtctaa

SEQ ID NO: 187925 - DNA, 25 bp, Homo sapien
attgccaggtctggtctaagtttct

SEQ ID NO: 187926 - DNA, 25 bp, Homo sapien
catatgcgagtgaacttgagccagg

SEQ ID NO: 187927 - DNA, 25 bp, Homo sapien
ttgagccagggcatggttaaagtca

SEQ ID NO: 187928 - DNA, 25 bp, Homo sapien
ggaaaagctcctctagttagctgaa

SEQ ID NO: 187929 - DNA, 25 bp, Homo sapien
ctctagttagctgaaactgggacct

SEQ ID NO: 187930 - DNA, 25 bp, Homo sapien
ggaaatgttttcccacagttctagg

SEQ ID NO: 187931 - DNA, 25 bp, Homo sapien
acagttctagggacaggactctgag

SEQ ID NO: 187932 - DNA, 25 bp, Homo sapien
tgaggtgggtgagtttgacaaatcc

SEQ ID NO: 187933 - DNA, 25 bp, Homo sapien
gtttgacaaatcctgcagtgtttcc

SEQ ID NO: 187934 - DNA, 25 bp, Homo sapien
agtgtttccaggcatccttttagga

SEQ ID NO: 187935 - DNA, 25 bp, Homo sapien
caggcatccttttaggactgtgtaa

SEQ ID NO: 187936 - DNA, 25 bp, Homo sapien
gactgtgtaatagtttccctagaag

SEQ ID NO: 187937 - DNA, 25 bp, Homo sapien
aattatctagatttttgtccacagt

SEQ ID NO: 187938 - DNA, 25 bp, Homo sapien
gtccacagtatatgatccatccaga

SEQ ID NO: 187939 - DNA, 25 bp, Homo sapien
agacatttgcaaacgtcaggagaaa

SEQ ID NO: 187940 - DNA, 25 bp, Homo sapien
ttatccagatgcatgttatctcaag

SEQ ID NO: 187941 - DNA, 25 bp, Homo sapien
gttatctcaaggacaaagcctgtga

SEQ ID NO: 187942 - DNA, 25 bp, Homo sapien
cattgtagtatgcattaatccttca

SEQ ID NO: 187943 - DNA, 25 bp, Homo sapien
atgaagcaggtgactgcagcctttg

SEQ ID NO: 187944 - DNA, 25 bp, Homo sapien
tgcagcctttggctcaagctcacaa

SEQ ID NO: 187945 - DNA, 25 bp, Homo sapien
aagctcacaactctgataactgtca

SEQ ID NO: 187946 - DNA, 25 bp, Homo sapien
aactgtcagtgcctgaggttgtgat

SEQ ID NO: 187947 - DNA, 25 bp, Homo sapien
gtgattggtgacattctgacactgc

SEQ ID NO: 187948 - DNA, 25 bp, Homo sapien
gacacttctcaataatcataagctt

SEQ ID NO: 187949 - DNA, 25 bp, Homo sapien
cacttctcaataatcataagctttt

SEQ ID NO: 187950 - DNA, 25 bp, Homo sapien
ataatgcaagaataccagttagaac

SEQ ID NO: 187951 - DNA, 25 bp, Homo sapien
tcctcatccctcctgctgtatattt

SEQ ID NO: 187952 - DNA, 25 bp, Homo sapien
cctcatccctcctgctgtatatttt

SEQ ID NO: 187953 - DNA, 25 bp, Homo sapien
tcatccctcctgctgtatattttct

SEQ ID NO: 187954 - DNA, 25 bp, Homo sapien
catccctcctgctgtatattttctc

SEQ ID NO: 187955 - DNA, 25 bp, Homo sapien
atccctcctgctgtatattttctca

SEQ ID NO: 187956 - DNA, 25 bp, Homo sapien
tccctcctgctgtatattttctcat

SEQ ID NO: 187957 - DNA, 25 bp, Homo sapien
ttttctcattttttgcgtaataaat

SEQ ID NO: 187958 - DNA, 25 bp, Homo sapien
ttctcattttttgcgtaataaatta

SEQ ID NO: 187959 - DNA, 25 bp, Homo sapien
acctgaagaaggtgtttctcaaagt

SEQ ID NO: 187960 - DNA, 25 bp, Homo sapien
caaagtgaagttgaaggctccaaaa

SEQ ID NO: 187961 - DNA, 25 bp, Homo sapien
agaagtctaaggtgggcccactagt

SEQ ID NO: 187962 - DNA, 25 bp, Homo sapien
gtgggcccactagtgtgcattttaa

SEQ ID NO: 187963 - DNA, 25 bp, Homo sapien
taaacaaacttcctaggtgattatt

SEQ ID NO: 187964 - DNA, 25 bp, Homo sapien
atctgagaactaatgccctgtggga

SEQ ID NO: 187965 - DNA, 25 bp, Homo sapien
atgccctgtgggaaacagcaccact

SEQ ID NO: 187966 - DNA, 25 bp, Homo sapien
cagcaccacttaaaagcaaggccat

SEQ ID NO: 187967 - DNA, 25 bp, Homo sapien
gcaaggccataacatatttctgaca

SEQ ID NO: 187968 - DNA, 25 bp, Homo sapien
ggccataacatatttctgacatgag

SEQ ID NO: 187969 - DNA, 25 bp, Homo sapien
tatgatttgaagtgaatactgcttt

SEQ ID NO: 187970 - DNA, 25 bp, Homo sapien
tttccataagaattgtaaacattga

SEQ ID NO: 187971 - DNA, 25 bp, Homo sapien
aacattgaactgaacaaattaccta

SEQ ID NO: 187972 - DNA, 25 bp, Homo sapien
taatggatttggttaatgacttatg

SEQ ID NO: 187973 - DNA, 25 bp, Homo sapien
gagcaagctggtttggccagacagt

SEQ ID NO: 187974 - DNA, 25 bp, Homo sapien
ctggtttggccagacagtataccca

SEQ ID NO: 187975 - DNA, 25 bp, Homo sapien
ggccagacagtatacccaaactttt

SEQ ID NO: 187976 - DNA, 25 bp, Homo sapien
gacagtatacccaaacttttatata

SEQ ID NO: 187977 - DNA, 25 bp, Homo sapien
tatacagaaggctatcacacttgtg

SEQ ID NO: 187978 - DNA, 25 bp, Homo sapien
tacagaaggctatcacacttgtgaa

SEQ ID NO: 187979 - DNA, 25 bp, Homo sapien
agaaggctatcacacttgtgaaatt

SEQ ID NO: 187980 - DNA, 25 bp, Homo sapien
aatctgaatttgcattccatggtgt

SEQ ID NO: 187981 - DNA, 25 bp, Homo sapien
attgccatttctggcctcgctaggc

SEQ ID NO: 187982 - DNA, 25 bp, Homo sapien
aagccagtcgggtttcctggagcaa

SEQ ID NO: 187983 - DNA, 25 bp, Homo sapien
ggagcaatgggtgtgccagccctca

SEQ ID NO: 187984 - DNA, 25 bp, Homo sapien
ctgccaagcatccagaccacaaatg

SEQ ID NO: 187985 - DNA, 25 bp, Homo sapien
tgaggagcagctttaggtatggatt

SEQ ID NO: 187986 - DNA, 25 bp, Homo sapien
gatgactaagtcaagctacttcctg

SEQ ID NO: 187987 - DNA, 25 bp, Homo sapien
tacttcctgagcttctctcagattt

SEQ ID NO: 187988 - DNA, 25 bp, Homo sapien
tctcagatttccaagagccagagat

SEQ ID NO: 187989 - DNA, 25 bp, Homo sapien
agccagagatgaattgtgctgcatc

SEQ ID NO: 187990 - DNA, 25 bp, Homo sapien
cttgccccaattcttaggatttctt

SEQ ID NO: 187991 - DNA, 25 bp, Homo sapien
ttcctccgccactgcagtgattgtt

SEQ ID NO: 187992 - DNA, 25 bp, Homo sapien
ttccaacaggccctctggacaaata

SEQ ID NO: 187993 - DNA, 25 bp, Homo sapien
acaggccctctggacaaatacaaga

SEQ ID NO: 187994 - DNA, 25 bp, Homo sapien
ggccctctggacaaatacaagattc

SEQ ID NO: 187995 - DNA, 25 bp, Homo sapien
aatacaagattcaggcgatcgacgc

SEQ ID NO: 187996 - DNA, 25 bp, Homo sapien
agattcaggcgatcgacgccaccga

SEQ ID NO: 187997 - DNA, 25 bp, Homo sapien
gacgccaccgactcttgtatcatga

SEQ ID NO: 187998 - DNA, 25 bp, Homo sapien
gccaccgactcttgtatcatgagca

SEQ ID NO: 187999 - DNA, 25 bp, Homo sapien
accgactcttgtatcatgagcattg

SEQ ID NO: 188000 - DNA, 25 bp, Homo sapien
gactcttgtatcatgagcattggat

SEQ ID NO: 188001 - DNA, 25 bp, Homo sapien
tcatgagcattggatttgatcacat

SEQ ID NO: 188002 - DNA, 25 bp, Homo sapien
atgagcattggatttgatcacatgg

SEQ ID NO: 188003 - DNA, 25 bp, Homo sapien
aggtattattatcccgtatccctgt

SEQ ID NO: 188004 - DNA, 25 bp, Homo sapien
ccgtatccctgttttacagctgtgg

SEQ ID NO: 188005 - DNA, 25 bp, Homo sapien
gtgccagaactgacttgaacctagc

SEQ ID NO: 188006 - DNA, 25 bp, Homo sapien
aactgacttgaacctagctctctgt

SEQ ID NO: 188007 - DNA, 25 bp, Homo sapien
cctagctctctgtcttgattcagga

SEQ ID NO: 188008 - DNA, 25 bp, Homo sapien
aggaactactgctctttccattggt

SEQ ID NO: 188009 - DNA, 25 bp, Homo sapien
ctacagttgccagcttatggtaaaa

SEQ ID NO: 188010 - DNA, 25 bp, Homo sapien
tgggttaaggccttccagcatcagt

SEQ ID NO: 188011 - DNA, 25 bp, Homo sapien
gccttccagcatcagtcacatgtaa

SEQ ID NO: 188012 - DNA, 25 bp, Homo sapien
aacagctacattgtgtgcttacttt

SEQ ID NO: 188013 - DNA, 25 bp, Homo sapien
gtgcttactttttgctagatgtttc

SEQ ID NO: 188014 - DNA, 25 bp, Homo sapien
cacctggacccctgcattggaactg

SEQ ID NO: 188015 - DNA, 25 bp, Homo sapien
acctggacccctgcattggaactgg

SEQ ID NO: 188016 - DNA, 25 bp, Homo sapien
gaggaggagggtcggtgccttcaag

SEQ ID NO: 188017 - DNA, 25 bp, Homo sapien
gaggagggtcggtgccttcaagaaa

SEQ ID NO: 188018 - DNA, 25 bp, Homo sapien
gagggtcggtgccttcaagaaaaca

SEQ ID NO: 188019 - DNA, 25 bp, Homo sapien
aaaacaggcactgccctggtggccc

SEQ ID NO: 188020 - DNA, 25 bp, Homo sapien
aaacaggcactgccctggtggccct

SEQ ID NO: 188021 - DNA, 25 bp, Homo sapien
acaggcactgccctggtggccctct

SEQ ID NO: 188022 - DNA, 25 bp, Homo sapien
caggcactgccctggtggccctctc

SEQ ID NO: 188023 - DNA, 25 bp, Homo sapien
aggcactgccctggtggccctctcc

SEQ ID NO: 188024 - DNA, 25 bp, Homo sapien
gcctggacccgttcatgggggaggg

SEQ ID NO: 188025 - DNA, 25 bp, Homo sapien
ttgttgcctttttaacggagtgtca

SEQ ID NO: 188026 - DNA, 25 bp, Homo sapien
taacggagtgtcactttcaaccggc

SEQ ID NO: 188027 - DNA, 25 bp, Homo sapien
ggagacatgtcatttgtaaaagcag

SEQ ID NO: 188028 - DNA, 25 bp, Homo sapien
gcagaaaaaggttgcatttgttcac

SEQ ID NO: 188029 - DNA, 25 bp, Homo sapien
ttttgtaatattgtcctgggcctgt

SEQ ID NO: 188030 - DNA, 25 bp, Homo sapien
taatattgtcctgggcctgtgttgg

SEQ ID NO: 188031 - DNA, 25 bp, Homo sapien
ggaagctgggcatcagtggccacat

SEQ ID NO: 188032 - DNA, 25 bp, Homo sapien
ccacagagaccccacagggcagtga

SEQ ID NO: 188033 - DNA, 25 bp, Homo sapien
acagggcagtgagctctgtcttccc

SEQ ID NO: 188034 - DNA, 25 bp, Homo sapien
ctagcccatcatctatctaaccggt

SEQ ID NO: 188035 - DNA, 25 bp, Homo sapien
ctatctaaccggtccttgatttaat

SEQ ID NO: 188036 - DNA, 25 bp, Homo sapien
gaggctctggctcaaacagcaatag

SEQ ID NO: 188037 - DNA, 25 bp, Homo sapien
acagcaatagggtcttcctcactga

SEQ ID NO: 188038 - DNA, 25 bp, Homo sapien
gtggccttgtgataaaatgtgggaa

SEQ ID NO: 188039 - DNA, 25 bp, Homo sapien
ctggccacaggtgaggtctgtgatt

SEQ ID NO: 188040 - DNA, 25 bp, Homo sapien
aggtgaggtctgtgatttccgagca

SEQ ID NO: 188041 - DNA, 25 bp, Homo sapien
aggtctgtgatttccgagcacgctc

SEQ ID NO: 188042 - DNA, 25 bp, Homo sapien
tgatttccgagcacgctccaccttg

SEQ ID NO: 188043 - DNA, 25 bp, Homo sapien
cttgcactcaacttggccttttgat

SEQ ID NO: 188044 - DNA, 25 bp, Homo sapien
tcaacttggccttttgattgcacaa

SEQ ID NO: 188045 - DNA, 25 bp, Homo sapien
cttggccttttgattgcacaagcct

SEQ ID NO: 188046 - DNA, 25 bp, Homo sapien
cctttgttttcagtcctagtgaata

SEQ ID NO: 188047 - DNA, 25 bp, Homo sapien
gtgaactgattgaggaagggtctat

SEQ ID NO: 188048 - DNA, 25 bp, Homo sapien
tgaggaagggtctattgtcttttta

SEQ ID NO: 188049 - DNA, 25 bp, Homo sapien
tgtctttttaaatggcacaatttta

SEQ ID NO: 188050 - DNA, 25 bp, Homo sapien
aatggcacaattttaagggtttgag

SEQ ID NO: 188051 - DNA, 25 bp, Homo sapien
ttgagggtacagtcccttaacctgc

SEQ ID NO: 188052 - DNA, 25 bp, Homo sapien
cagtcccttaacctgccacgggagg

SEQ ID NO: 188053 - DNA, 25 bp, Homo sapien
acacttctggttttctgtgtggagg

SEQ ID NO: 188054 - DNA, 25 bp, Homo sapien
ggagcagggatatctaagctgtggt

SEQ ID NO: 188055 - DNA, 25 bp, Homo sapien
gggtgctgtgttctagaccccccat

SEQ ID NO: 188056 - DNA, 25 bp, Homo sapien
ctgtgttctagaccccccatattat

SEQ ID NO: 188057 - DNA, 25 bp, Homo sapien
attctgtggcgcatccagattgtga

SEQ ID NO: 188058 - DNA, 25 bp, Homo sapien
gatgtaatggcctgttatgtcttga

SEQ ID NO: 188059 - DNA, 25 bp, Homo sapien
aaatacttgttttgcctcttccagg

SEQ ID NO: 188060 - DNA, 25 bp, Homo sapien
tgtggatcagtttgaacagcttctc

SEQ ID NO: 188061 - DNA, 25 bp, Homo sapien
tttgaacagcttctccaccttattt

SEQ ID NO: 188062 - DNA, 25 bp, Homo sapien
tctccaccttatttggacagtgata

SEQ ID NO: 188063 - DNA, 25 bp, Homo sapien
attgaaccaagagtgtagatttaca

SEQ ID NO: 188064 - DNA, 25 bp, Homo sapien
gtagatttacaagtgtaaccttcaa

SEQ ID NO: 188065 - DNA, 25 bp, Homo sapien
gtaggtaatgaacagtcacaccaaa

SEQ ID NO: 188066 - DNA, 25 bp, Homo sapien
tagatattttccgtgtcctaaataa

SEQ ID NO: 188067 - DNA, 25 bp, Homo sapien
ttccgtgtcctaaataattttcaat

SEQ ID NO: 188068 - DNA, 25 bp, Homo sapien
ataatctataatccctaaaatgcaa

SEQ ID NO: 188069 - DNA, 25 bp, Homo sapien
tttaaactcaagcaggccaaaacca

SEQ ID NO: 188070 - DNA, 25 bp, Homo sapien
aggccaaaaccaatatgcttataag

SEQ ID NO: 188071 - DNA, 25 bp, Homo sapien
taatgaaaagttcatccatttctga

SEQ ID NO: 188072 - DNA, 25 bp, Homo sapien
tttctgataaagttctctatggcaa

SEQ ID NO: 188073 - DNA, 25 bp, Homo sapien
gataaagttctctatggcaaagtct

SEQ ID NO: 188074 - DNA, 25 bp, Homo sapien
ggcaaagtctttcaaatacgagata

SEQ ID NO: 188075 - DNA, 25 bp, Homo sapien
attctgtggtgccagtgcacactac

SEQ ID NO: 188076 - DNA, 25 bp, Homo sapien
tgtggtgccagtgcacactaccttc

SEQ ID NO: 188077 - DNA, 25 bp, Homo sapien
acccatacacatccatgttcactgt

SEQ ID NO: 188078 - DNA, 25 bp, Homo sapien
atccatgttcactgtaacaaactga

SEQ ID NO: 188079 - DNA, 25 bp, Homo sapien
aaagcttctgagtaacactttctga

SEQ ID NO: 188080 - DNA, 25 bp, Homo sapien
actcaccttcactgctgctgttgca

SEQ ID NO: 188081 - DNA, 25 bp, Homo sapien
tgctgttgcaactcggctgttctgg

SEQ ID NO: 188082 - DNA, 25 bp, Homo sapien
tgttctggactctgatgtgtgtgga

SEQ ID NO: 188083 - DNA, 25 bp, Homo sapien
acattgactgtgttgattaccttca

SEQ ID NO: 188084 - DNA, 25 bp, Homo sapien
ttaccttcactattcggccagcctg

SEQ ID NO: 188085 - DNA, 25 bp, Homo sapien
ggccagcctgaccttttaataactt

SEQ ID NO: 188086 - DNA, 25 bp, Homo sapien
tatatcttaaaagcagagcacctgt

SEQ ID NO: 188087 - DNA, 25 bp, Homo sapien
agcacctgtttaagcattgtacccc

SEQ ID NO: 188088 - DNA, 25 bp, Homo sapien
agcattgtacccctattgttaaaga

SEQ ID NO: 188089 - DNA, 25 bp, Homo sapien
ttgttaaagatttgtgtcctctcat

SEQ ID NO: 188090 - DNA, 25 bp, Homo sapien
tcctcttgtaagtgcccttctaata

SEQ ID NO: 188091 - DNA, 25 bp, Homo sapien
gatagatttccagtatgaggcactt

SEQ ID NO: 188092 - DNA, 25 bp, Homo sapien
ggttactgtaagtcagttggaagct

SEQ ID NO: 188093 - DNA, 25 bp, Homo sapien
agctggcatgtatgtaaattacttg

SEQ ID NO: 188094 - DNA, 25 bp, Homo sapien
ggtgttacaccatatccgaagaagt

SEQ ID NO: 188095 - DNA, 25 bp, Homo sapien
aagaagttcctatgtgcagtgcaga

SEQ ID NO: 188096 - DNA, 25 bp, Homo sapien
aatcactgctacaaatcttccaacc

SEQ ID NO: 188097 - DNA, 25 bp, Homo sapien
cactgctacaaatcttccaaccaag

SEQ ID NO: 188098 - DNA, 25 bp, Homo sapien
ccaaccaagaaggaaaactgctatt

SEQ ID NO: 188099 - DNA, 25 bp, Homo sapien
ggaaaactgctattcttcataaatc

SEQ ID NO: 188100 - DNA, 25 bp, Homo sapien
taatttttagtatatgcttcctttc

SEQ ID NO: 188101 - DNA, 25 bp, Homo sapien
gcttcctttcatcttatacttttat

SEQ ID NO: 188102 - DNA, 25 bp, Homo sapien
gcctgtaagatttgtggtgttccta

SEQ ID NO: 188103 - DNA, 25 bp, Homo sapien
gtggtgttcctaggccaaactggat

SEQ ID NO: 188104 - DNA, 25 bp, Homo sapien
gtggcttttttcctattcttatcaa

SEQ ID NO: 188105 - DNA, 25 bp, Homo sapien
ttatcaaaggcatcgttgtctgcta

SEQ ID NO: 188106 - DNA, 25 bp, Homo sapien
atcgttgtctgctaaattacttgaa

SEQ ID NO: 188107 - DNA, 25 bp, Homo sapien
aaaaccattcacaggtccacaatat

SEQ ID NO: 188108 - DNA, 25 bp, Homo sapien
acaggtccacaatattcatactatg

SEQ ID NO: 188109 - DNA, 25 bp, Homo sapien
tatgtgtttgcagtagtgttcaagt

SEQ ID NO: 188110 - DNA, 25 bp, Homo sapien
gtgttcaagtgtttatttaagcata

SEQ ID NO: 188111 - DNA, 25 bp, Homo sapien
ttaagcatataattggtgtccacca

SEQ ID NO: 188112 - DNA, 25 bp, Homo sapien
attggtgtccaccaggtcctcacaa

SEQ ID NO: 188113 - DNA, 25 bp, Homo sapien
tgcagttgcagccttttcagcagac

SEQ ID NO: 188114 - DNA, 25 bp, Homo sapien
agacgccctgagaacgggaggtcaa

SEQ ID NO: 188115 - DNA, 25 bp, Homo sapien
gacgggcctcagacctaaggcagga

SEQ ID NO: 188116 - DNA, 25 bp, Homo sapien
aaggcaggagcacccctatgccaga

SEQ ID NO: 188117 - DNA, 25 bp, Homo sapien
tgccagacctcctgggtcacaggat

SEQ ID NO: 188118 - DNA, 25 bp, Homo sapien
ggtcacaggatatgccacggacatt

SEQ ID NO: 188119 - DNA, 25 bp, Homo sapien
aaggacgtgcagttgcagctctttc

SEQ ID NO: 188120 - DNA, 25 bp, Homo sapien
gcagctctttctgcagatgccctga

SEQ ID NO: 188121 - DNA, 25 bp, Homo sapien
gaaggtcctcgccagatgctcctgg

SEQ ID NO: 188122 - DNA, 25 bp, Homo sapien
agatgctcctggacttgctttggac

SEQ ID NO: 188123 - DNA, 25 bp, Homo sapien
gacttgctttggactttcccttgct

SEQ ID NO: 188124 - DNA, 25 bp, Homo sapien
caggaaactaagtttactatctgta

SEQ ID NO: 188125 - DNA, 25 bp, Homo sapien
gtaaatgtaaacatatgtccattaa

SEQ ID NO: 188126 - DNA, 25 bp, Homo sapien
atgtccattaagaaacatgtagttt

SEQ ID NO: 188127 - DNA, 25 bp, Homo sapien
ttttagaatgtaataacccagtggc

SEQ ID NO: 188128 - DNA, 25 bp, Homo sapien
gtggcttactgtttttcttaatctc

SEQ ID NO: 188129 - DNA, 25 bp, Homo sapien
ggaactaatatctcttgttctgaag

SEQ ID NO: 188130 - DNA, 25 bp, Homo sapien
gaaacatttatctgacgttcagcag

SEQ ID NO: 188131 - DNA, 25 bp, Homo sapien
ttatctgacgttcagcagttcctac

SEQ ID NO: 188132 - DNA, 25 bp, Homo sapien
agcagttcctacagttttacttcag

SEQ ID NO: 188133 - DNA, 25 bp, Homo sapien
atattttgactaacatgtcttttct

SEQ ID NO: 188134 - DNA, 25 bp, Homo sapien
tctgtttgtatcatttaaaggcaaa

SEQ ID NO: 188135 - DNA, 25 bp, Homo sapien
tgtatagtttttgtacccagagact

SEQ ID NO: 188136 - DNA, 25 bp, Homo sapien
tatattgattgcacttgcctgccat

SEQ ID NO: 188137 - DNA, 25 bp, Homo sapien
gcacttgcctgccatgatttagata

SEQ ID NO: 188138 - DNA, 25 bp, Homo sapien
ttgcatggtttttattctttcctaa

SEQ ID NO: 188139 - DNA, 25 bp, Homo sapien
ctttcctaatggatcctgttttata

SEQ ID NO: 188140 - DNA, 25 bp, Homo sapien
atacttccaagcctgtccatggata

SEQ ID NO: 188141 - DNA, 25 bp, Homo sapien
ggatatatcaaatgtcttcacttgt

SEQ ID NO: 188142 - DNA, 25 bp, Homo sapien
tgtcttcacttgtatgttttcatgg

SEQ ID NO: 188143 - DNA, 25 bp, Homo sapien
atgttttcatggctaggtatttcta

SEQ ID NO: 188144 - DNA, 25 bp, Homo sapien
atgtttattcttccctgtgtacttc

SEQ ID NO: 188145 - DNA, 25 bp, Homo sapien
gtacttctacacatagctatgcact

SEQ ID NO: 188146 - DNA, 25 bp, Homo sapien
gaagatagcttttgccattataata

SEQ ID NO: 188147 - DNA, 25 bp, Homo sapien
atatgtttaaccatcatttctttga

SEQ ID NO: 188148 - DNA, 25 bp, Homo sapien
aagactgcccttgaagtatgcagag

SEQ ID NO: 188149 - DNA, 25 bp, Homo sapien
tatgcagagcatttttacaggaaga

SEQ ID NO: 188150 - DNA, 25 bp, Homo sapien
aaaggcgaaggaatcattatggtga

SEQ ID NO: 188151 - DNA, 25 bp, Homo sapien
aatcattatggtgacggatcctccg

SEQ ID NO: 188152 - DNA, 25 bp, Homo sapien
attatggtgacggatcctccgtttg

SEQ ID NO: 188153 - DNA, 25 bp, Homo sapien
tcctccgtttggtggcttggttgaa

SEQ ID NO: 188154 - DNA, 25 bp, Homo sapien
gcttggttgaacctctggctattac

SEQ ID NO: 188155 - DNA, 25 bp, Homo sapien
gaacctctggctattacattcaaga

SEQ ID NO: 188156 - DNA, 25 bp, Homo sapien
aagaagttaattgctatgtggaaag

SEQ ID NO: 188157 - DNA, 25 bp, Homo sapien
tttgttttgccctgttactccactg

SEQ ID NO: 188158 - DNA, 25 bp, Homo sapien
ttttgccctgttactccactggtag

SEQ ID NO: 188159 - DNA, 25 bp, Homo sapien
ttactccactggtagtcatctggtg

SEQ ID NO: 188160 - DNA, 25 bp, Homo sapien
agtcatctggtgtttgtactataac

SEQ ID NO: 188161 - DNA, 25 bp, Homo sapien
gtttgtactataacaacagcaagaa

SEQ ID NO: 188162 - DNA, 25 bp, Homo sapien
tgcacctcctttttttagtcgagat

SEQ ID NO: 188163 - DNA, 25 bp, Homo sapien
gggagagaaatatctacaggtatat

SEQ ID NO: 188164 - DNA, 25 bp, Homo sapien
gaaacaaataatgtggtctgcttta

SEQ ID NO: 188165 - DNA, 25 bp, Homo sapien
tgctttataagatggccagatctac

SEQ ID NO: 188166 - DNA, 25 bp, Homo sapien
gatggccagatctacattaggaaaa

SEQ ID NO: 188167 - DNA, 25 bp, Homo sapien
gttgtatgtctttgggtgtttgttt

SEQ ID NO: 188168 - DNA, 25 bp, Homo sapien
tagcagaggtctggatttttatacc

SEQ ID NO: 188169 - DNA, 25 bp, Homo sapien
agaggtctggatttttatacctaag

SEQ ID NO: 188170 - DNA, 25 bp, Homo sapien
ctggatttttatacctaagttgttg

SEQ ID NO: 188171 - DNA, 25 bp, Homo sapien
ctaagttgttgtttaggctaacagt

SEQ ID NO: 188172 - DNA, 25 bp, Homo sapien
ttaggctaacagtgataattttaac

SEQ ID NO: 188173 - DNA, 25 bp, Homo sapien
ttcatctacataatgcacgtgttct

SEQ ID NO: 188174 - DNA, 25 bp, Homo sapien
atctacataatgcacgtgttctgga

SEQ ID NO: 188175 - DNA, 25 bp, Homo sapien
cataatgcacgtgttctggatgtat

SEQ ID NO: 188176 - DNA, 25 bp, Homo sapien
ataatgcacgtgttctggatgtata

SEQ ID NO: 188177 - DNA, 25 bp, Homo sapien
ttctggatgtataacatgaagctga

SEQ ID NO: 188178 - DNA, 25 bp, Homo sapien
atatgttagaactatcttatgggat

SEQ ID NO: 188179 - DNA, 25 bp, Homo sapien
agatgtccctttcactgtatgtcct

SEQ ID NO: 188180 - DNA, 25 bp, Homo sapien
tctgacccctttggcaaggttgcca

SEQ ID NO: 188181 - DNA, 25 bp, Homo sapien
ttcctacaagcacctatcattgggc

SEQ ID NO: 188182 - DNA, 25 bp, Homo sapien
tatcattgggcttgtcacactctat

SEQ ID NO: 188183 - DNA, 25 bp, Homo sapien
ttgtcacactctattgctcttctgt

SEQ ID NO: 188184 - DNA, 25 bp, Homo sapien
ttctgtcccgaagatgcagtcttct

SEQ ID NO: 188185 - DNA, 25 bp, Homo sapien
gtcttctctccaatgatactaccaa

SEQ ID NO: 188186 - DNA, 25 bp, Homo sapien
ttagttttcctcaaccacactcaat

SEQ ID NO: 188187 - DNA, 25 bp, Homo sapien
tcaatctttttgctccaccctgaat

SEQ ID NO: 188188 - DNA, 25 bp, Homo sapien
cacacctaaccctgatagttaccta

SEQ ID NO: 188189 - DNA, 25 bp, Homo sapien
gagatgtacttggagtcggatatac

SEQ ID NO: 188190 - DNA, 25 bp, Homo sapien
ttgagtgtctttacagcctttgttt

SEQ ID NO: 188191 - DNA, 25 bp, Homo sapien
tgttttctggtacccttgggaggca

SEQ ID NO: 188192 - DNA, 25 bp, Homo sapien
ttgggaggcatccatccgtttaata

SEQ ID NO: 188193 - DNA, 25 bp, Homo sapien
ggcatccatccgtttaataaaaggt

SEQ ID NO: 188194 - DNA, 25 bp, Homo sapien
acaggaaactcccttcctttgtcat

SEQ ID NO: 188195 - DNA, 25 bp, Homo sapien
tttgtcatctttggtatccccatct

SEQ ID NO: 188196 - DNA, 25 bp, Homo sapien
atctccatcttccacaacagacagt

SEQ ID NO: 188197 - DNA, 25 bp, Homo sapien
acagacagtttgaacagccgcacca

SEQ ID NO: 188198 - DNA, 25 bp, Homo sapien
tttccagaatcttctattcccactt

SEQ ID NO: 188199 - DNA, 25 bp, Homo sapien
aaatcatttgacctgtcgtacgtac

SEQ ID NO: 188200 - DNA, 25 bp, Homo sapien
tgacctgtcgtacgtacaaagtaaa

SEQ ID NO: 188201 - DNA, 25 bp, Homo sapien
tttgggttgatctataaacactgtc

SEQ ID NO: 188202 - DNA, 25 bp, Homo sapien
gttgatctataaacactgtcagact

SEQ ID NO: 188203 - DNA, 25 bp, Homo sapien
gcatttatgaatttgcaacattggc

SEQ ID NO: 188204 - DNA, 25 bp, Homo sapien
caacattggcaagtgatttgggatt

SEQ ID NO: 188205 - DNA, 25 bp, Homo sapien
gaatacacgttgaacacatccacat

SEQ ID NO: 188206 - DNA, 25 bp, Homo sapien
gttgaacacatccacattgtatagg

SEQ ID NO: 188207 - DNA, 25 bp, Homo sapien
taggatgtggtaattagcttgtaac

SEQ ID NO: 188208 - DNA, 25 bp, Homo sapien
tggtaattagcttgtaaccagggta

SEQ ID NO: 188209 - DNA, 25 bp, Homo sapien
ggtatgatctgctattgttatttct

SEQ ID NO: 188210 - DNA, 25 bp, Homo sapien
gatctgctattgttatttctcctct

SEQ ID NO: 188211 - DNA, 25 bp, Homo sapien
tgctattgttatttctcctctttat

SEQ ID NO: 188212 - DNA, 25 bp, Homo sapien
gaaaggctcggctactgacacactg

SEQ ID NO: 188213 - DNA, 25 bp, Homo sapien
gacacactgggagcaaatggactat

SEQ ID NO: 188214 - DNA, 25 bp, Homo sapien
ggactatgggctccagtttacctct

SEQ ID NO: 188215 - DNA, 25 bp, Homo sapien
tcagcatctctcctattgtgctcta

SEQ ID NO: 188216 - DNA, 25 bp, Homo sapien
tattgtgctctatctcctggccagc

SEQ ID NO: 188217 - DNA, 25 bp, Homo sapien
cctggccagcttctataccaagtat

SEQ ID NO: 188218 - DNA, 25 bp, Homo sapien
aagtatgatgctgcgcacttcctca

SEQ ID NO: 188219 - DNA, 25 bp, Homo sapien
gcctcattgctaagtgtactgctgc

SEQ ID NO: 188220 - DNA, 25 bp, Homo sapien
tgctgccgaagttgccccagttcca

SEQ ID NO: 188221 - DNA, 25 bp, Homo sapien
gggttcgtgtctttggcatcaacaa

SEQ ID NO: 188222 - DNA, 25 bp, Homo sapien
ggttttgggacagctccatgggcat

SEQ ID NO: 188223 - DNA, 25 bp, Homo sapien
tgctgacctgggctaagaaaaactc

SEQ ID NO: 188224 - DNA, 25 bp, Homo sapien
agaaaaactctttggacagaatgtt

SEQ ID NO: 188225 - DNA, 25 bp, Homo sapien
tttaagaacctcctacagcctgatg

SEQ ID NO: 188226 - DNA, 25 bp, Homo sapien
agcctgatgcttaaccctttccatt

SEQ ID NO: 188227 - DNA, 25 bp, Homo sapien
tttccatttcctctcattccattca

SEQ ID NO: 188228 - DNA, 25 bp, Homo sapien
tttcctctcattccattcatgggtg

SEQ ID NO: 188229 - DNA, 25 bp, Homo sapien
aactttgcacttgatggaacacctc

SEQ ID NO: 188230 - DNA, 25 bp, Homo sapien
ttgcacttgatggaacacctcaatt

SEQ ID NO: 188231 - DNA, 25 bp, Homo sapien
ggaacacctcaattgcaggttttgt

SEQ ID NO: 188232 - DNA, 25 bp, Homo sapien
ttcctcctttacctcatgtttgtta

SEQ ID NO: 188233 - DNA, 25 bp, Homo sapien
ctcctttacctcatgtttgttaata

SEQ ID NO: 188234 - DNA, 25 bp, Homo sapien
acaagaagtctaacattaaaagcct

SEQ ID NO: 188235 - DNA, 25 bp, Homo sapien
aaaagccttttattggatattgatt

SEQ ID NO: 188236 - DNA, 25 bp, Homo sapien
gccttttattggatattgattttcg

SEQ ID NO: 188237 - DNA, 25 bp, Homo sapien
tattggatattgattttcggtattc

SEQ ID NO: 188238 - DNA, 25 bp, Homo sapien
ttggatattgattttcggtattcac

SEQ ID NO: 188239 - DNA, 25 bp, Homo sapien
ggatattgattttcggtattcacag

SEQ ID NO: 188240 - DNA, 25 bp, Homo sapien
gatattgattttcggtattcacagt

SEQ ID NO: 188241 - DNA, 25 bp, Homo sapien
tattgattttcggtattcacagttt

SEQ ID NO: 188242 - DNA, 25 bp, Homo sapien
attgattttcggtattcacagtttt

SEQ ID NO: 188243 - DNA, 25 bp, Homo sapien
tgattttcggtattcacagttttta

SEQ ID NO: 188244 - DNA, 25 bp, Homo sapien
gtcaaagccaaggtgtataatttat

SEQ ID NO: 188245 - DNA, 25 bp, Homo sapien
tctgttccagttttgctggatttgt

SEQ ID NO: 188246 - DNA, 25 bp, Homo sapien
ggatttgtacatagccattctagaa

SEQ ID NO: 188247 - DNA, 25 bp, Homo sapien
gggaaattatccatatacatatcac

SEQ ID NO: 188248 - DNA, 25 bp, Homo sapien
acatatcactaataggcttcttgga

SEQ ID NO: 188249 - DNA, 25 bp, Homo sapien
aataggcttcttggaattatttaga

SEQ ID NO: 188250 - DNA, 25 bp, Homo sapien
ttaaactggcagtggatgactgaat

SEQ ID NO: 188251 - DNA, 25 bp, Homo sapien
gaataggcatcatatttctttttgt

SEQ ID NO: 188252 - DNA, 25 bp, Homo sapien
ctgccatttgacagtaaaggctctt

SEQ ID NO: 188253 - DNA, 25 bp, Homo sapien
aaggctcttggcttctgttggaggc

SEQ ID NO: 188254 - DNA, 25 bp, Homo sapien
tggaggcatgggaaattgtctcaat

SEQ ID NO: 188255 - DNA, 25 bp, Homo sapien
attgtctcaatttgtacagtttgta

SEQ ID NO: 188256 - DNA, 25 bp, Homo sapien
gcgaaagcgaggcacactgcttact

SEQ ID NO: 188257 - DNA, 25 bp, Homo sapien
gaggcacactgcttactgccttggg

SEQ ID NO: 188258 - DNA, 25 bp, Homo sapien
gatggacccgtgacctcgtggaggc

SEQ ID NO: 188259 - DNA, 25 bp, Homo sapien
cctgtgccatggtgggtgtcctggg

SEQ ID NO: 188260 - DNA, 25 bp, Homo sapien
ggcctgtgcggagggagccacctca

SEQ ID NO: 188261 - DNA, 25 bp, Homo sapien
ttgtttctccttgcccagcagtgct

SEQ ID NO: 188262 - DNA, 25 bp, Homo sapien
agtgctgccttcagcggccgtgacg

SEQ ID NO: 188263 - DNA, 25 bp, Homo sapien
ggccagctggacacacggtgagatt

SEQ ID NO: 188264 - DNA, 25 bp, Homo sapien
tggacacacggtgagattttctcgt

SEQ ID NO: 188265 - DNA, 25 bp, Homo sapien
acacggtgagattttctcgtatgta

SEQ ID NO: 188266 - DNA, 25 bp, Homo sapien
gtgagattttctcgtatgtaaataa

SEQ ID NO: 188267 - DNA, 25 bp, Homo sapien
acctcattctgaataatgtccctca

SEQ ID NO: 188268 - DNA, 25 bp, Homo sapien
aatgtccctcattttgactataact

SEQ ID NO: 188269 - DNA, 25 bp, Homo sapien
gactataactgtgcttggtttcaaa

SEQ ID NO: 188270 - DNA, 25 bp, Homo sapien
taaacaaaaatctcagtcccctccg

SEQ ID NO: 188271 - DNA, 25 bp, Homo sapien
agtcccctccgaagtgaactttgtg

SEQ ID NO: 188272 - DNA, 25 bp, Homo sapien
aagtgaactttgtgttaccctgcgt

SEQ ID NO: 188273 - DNA, 25 bp, Homo sapien
aactttgtgttaccctgcgtcagaa

SEQ ID NO: 188274 - DNA, 25 bp, Homo sapien
ccctgcgtcagaaatgccaagttgt

SEQ ID NO: 188275 - DNA, 25 bp, Homo sapien
acatgctgttataggatctacagat

SEQ ID NO: 188276 - DNA, 25 bp, Homo sapien
tacaaccagattatattcttgacgt

SEQ ID NO: 188277 - DNA, 25 bp, Homo sapien
atattcttgacgttgacttcattaa

SEQ ID NO: 188278 - DNA, 25 bp, Homo sapien
gggaacatctcaaaatgccaatgta

SEQ ID NO: 188279 - DNA, 25 bp, Homo sapien
aacttacagcaatattcaccagcag

SEQ ID NO: 188280 - DNA, 25 bp, Homo sapien
tattcaccagcagaaaatgtctttc

SEQ ID NO: 188281 - DNA, 25 bp, Homo sapien
gaattcaatttgtagtcctgatttg

SEQ ID NO: 188282 - DNA, 25 bp, Homo sapien
gtcctgatttgaatactagaatgtt

SEQ ID NO: 188283 - DNA, 25 bp, Homo sapien
tataatagttctgttcttacaacac

SEQ ID NO: 188284 - DNA, 25 bp, Homo sapien
agtgcatgttcatttctactcacaa

SEQ ID NO: 188285 - DNA, 25 bp, Homo sapien
gttcatttctactcacaaacatgtt

SEQ ID NO: 188286 - DNA, 25 bp, Homo sapien
aaacatgttcttggtgtatttctta

SEQ ID NO: 188287 - DNA, 25 bp, Homo sapien
tttcttatgcaaacaatcttcaggc

SEQ ID NO: 188288 - DNA, 25 bp, Homo sapien
caggcagcaaagatgtctgttacat

SEQ ID NO: 188289 - DNA, 25 bp, Homo sapien
gaaagtagaaagtgcccaaacagcc

SEQ ID NO: 188290 - DNA, 25 bp, Homo sapien
gtagaaagtgcccaaacagccatca

SEQ ID NO: 188291 - DNA, 25 bp, Homo sapien
caaacagccatcagttccatcctga

SEQ ID NO: 188292 - DNA, 25 bp, Homo sapien
acagccatcagttccatcctgactg

SEQ ID NO: 188293 - DNA, 25 bp, Homo sapien
atcagttccatcctgactgcttgtt

SEQ ID NO: 188294 - DNA, 25 bp, Homo sapien
agttccatcctgactgcttgttaag

SEQ ID NO: 188295 - DNA, 25 bp, Homo sapien
gttccatcctgactgcttgttaaga

SEQ ID NO: 188296 - DNA, 25 bp, Homo sapien
tccatcctgactgcttgttaagaat

SEQ ID NO: 188297 - DNA, 25 bp, Homo sapien
catcctgactgcttgttaagaattc

SEQ ID NO: 188298 - DNA, 25 bp, Homo sapien
tgactgcttgttaagaattctctgc

SEQ ID NO: 188299 - DNA, 25 bp, Homo sapien
ataaaaagaataaagcggccaggca

SEQ ID NO: 188300 - DNA, 25 bp, Homo sapien
tctttccccacagtgcaattcagaa

SEQ ID NO: 188301 - DNA, 25 bp, Homo sapien
tgcaattcagaatatgctcagggaa

SEQ ID NO: 188302 - DNA, 25 bp, Homo sapien
atatgctcagggaatgccagccacc

SEQ ID NO: 188303 - DNA, 25 bp, Homo sapien
atgccagccaccttgtaaaactgct

SEQ ID NO: 188304 - DNA, 25 bp, Homo sapien
caccttgtaaaactgctgggagaaa

SEQ ID NO: 188305 - DNA, 25 bp, Homo sapien
gagaaaagcatgattcccacaagga

SEQ ID NO: 188306 - DNA, 25 bp, Homo sapien
gattcccacaaggactaagtatcag

SEQ ID NO: 188307 - DNA, 25 bp, Homo sapien
ttttgtattatctgctttgctgatg

SEQ ID NO: 188308 - DNA, 25 bp, Homo sapien
atctgctttgctgatgtagacaaga

SEQ ID NO: 188309 - DNA, 25 bp, Homo sapien
gagttaactgagtagcatgctttat

SEQ ID NO: 188310 - DNA, 25 bp, Homo sapien
acccaaaactttaataatgtgtctg

SEQ ID NO: 188311 - DNA, 25 bp, Homo sapien
ttcagttgctcgcttctgggtgtgc

SEQ ID NO: 188312 - DNA, 25 bp, Homo sapien
ttctgggtgtgctcccttcgaaggc

SEQ ID NO: 188313 - DNA, 25 bp, Homo sapien
gctcccttcgaaggcccagataaga

SEQ ID NO: 188314 - DNA, 25 bp, Homo sapien
agagcagcatctgatgccctgtggt

SEQ ID NO: 188315 - DNA, 25 bp, Homo sapien
gcagcatctgatgccctgtggtgtt

SEQ ID NO: 188316 - DNA, 25 bp, Homo sapien
gtctactgaccaatcagtgtggcat

SEQ ID NO: 188317 - DNA, 25 bp, Homo sapien
aatcagtgtggcatgaggcccacgc

SEQ ID NO: 188318 - DNA, 25 bp, Homo sapien
tttcactttccaaagagctagccgt

SEQ ID NO: 188319 - DNA, 25 bp, Homo sapien
tttccaaagagctagccgtcctcca

SEQ ID NO: 188320 - DNA, 25 bp, Homo sapien
agtaccatgtcctagcctgtctgca

SEQ ID NO: 188321 - DNA, 25 bp, Homo sapien
tgtcctagcctgtctgcatttgtta

SEQ ID NO: 188322 - DNA, 25 bp, Homo sapien
atggggtgctcatcttgttcagcat

SEQ ID NO: 188323 - DNA, 25 bp, Homo sapien
tagtcaaagctcatatctaagtcag

SEQ ID NO: 188324 - DNA, 25 bp, Homo sapien
catatctaagtcagcatcggagaat

SEQ ID NO: 188325 - DNA, 25 bp, Homo sapien
gcttatggatggtgctcagagctca

SEQ ID NO: 188326 - DNA, 25 bp, Homo sapien
ggtgctcagagctcattagacatcg

SEQ ID NO: 188327 - DNA, 25 bp, Homo sapien
cagagctcattagacatcggagagt

SEQ ID NO: 188328 - DNA, 25 bp, Homo sapien
acatcggagagttcatgccagaaaa

SEQ ID NO: 188329 - DNA, 25 bp, Homo sapien
atgccagaaaagagccttcccattg

SEQ ID NO: 188330 - DNA, 25 bp, Homo sapien
gaaaagagccttcccattgaattga

SEQ ID NO: 188331 - DNA, 25 bp, Homo sapien
gacagaattctacatcggtctaatc

SEQ ID NO: 188332 - DNA, 25 bp, Homo sapien
ttctacatcggtctaatctacttta

SEQ ID NO: 188333 - DNA, 25 bp, Homo sapien
attttactgaagtactggctctttc

SEQ ID NO: 188334 - DNA, 25 bp, Homo sapien
gctctttcctgctctggacaagaat

SEQ ID NO: 188335 - DNA, 25 bp, Homo sapien
gagcaacttgtctgatgactgggaa

SEQ ID NO: 188336 - DNA, 25 bp, Homo sapien
tgcaaccatctgacttggtctctgt

SEQ ID NO: 188337 - DNA, 25 bp, Homo sapien
tggtctctgttaatgacgtctctcc

SEQ ID NO: 188338 - DNA, 25 bp, Homo sapien
tgttaatgacgtctctccctctaaa

SEQ ID NO: 188339 - DNA, 25 bp, Homo sapien
tctaaaccccattaaggactgggag

SEQ ID NO: 188340 - DNA, 25 bp, Homo sapien
gagaggcagagcaagcctcagagcc

SEQ ID NO: 188341 - DNA, 25 bp, Homo sapien
aggcctcagtggtcattaagatgtt

SEQ ID NO: 188342 - DNA, 25 bp, Homo sapien
gatgttaagtcttttgcggcagatt

SEQ ID NO: 188343 - DNA, 25 bp, Homo sapien
gcggcagattcctggtgatttgatc

SEQ ID NO: 188344 - DNA, 25 bp, Homo sapien
aactatcatctttgtagatatctta

SEQ ID NO: 188345 - DNA, 25 bp, Homo sapien
taacactgtggtcaggtacattcct

SEQ ID NO: 188346 - DNA, 25 bp, Homo sapien
gtggtcaggtacattccttaaaact

SEQ ID NO: 188347 - DNA, 25 bp, Homo sapien
tgctctacgggctttccctggcact

SEQ ID NO: 188348 - DNA, 25 bp, Homo sapien
tgggatggaacttcacccatactct

SEQ ID NO: 188349 - DNA, 25 bp, Homo sapien
tcacccatactctctgttctttcta

SEQ ID NO: 188350 - DNA, 25 bp, Homo sapien
tgttctttctataagtacagagtga

SEQ ID NO: 188351 - DNA, 25 bp, Homo sapien
gattcaatcgtaactgtgtctacag

SEQ ID NO: 188352 - DNA, 25 bp, Homo sapien
gtaactgtgtctacagtattgtgaa

SEQ ID NO: 188353 - DNA, 25 bp, Homo sapien
gtgaagtgatcatttcttgtaaaac

SEQ ID NO: 188354 - DNA, 25 bp, Homo sapien
gtgatcatttcttgtaaaacttgta

SEQ ID NO: 188355 - DNA, 25 bp, Homo sapien
tcatcgcgaagcttggcctgagggt

SEQ ID NO: 188356 - DNA, 25 bp, Homo sapien
tgagggtccggtttcctagctactg

SEQ ID NO: 188357 - DNA, 25 bp, Homo sapien
tgcgtcccgccaaagaggtttgtaa

SEQ ID NO: 188358 - DNA, 25 bp, Homo sapien
aatcatgaaagttcacccttccggg

SEQ ID NO: 188359 - DNA, 25 bp, Homo sapien
ccttccgggtgttaattcctgagag

SEQ ID NO: 188360 - DNA, 25 bp, Homo sapien
tgagaggatctactccactgtctac

SEQ ID NO: 188361 - DNA, 25 bp, Homo sapien
tgtctaccactcattcctgctgcat

SEQ ID NO: 188362 - DNA, 25 bp, Homo sapien
tcctgctgcattaaccttcattgtt

SEQ ID NO: 188363 - DNA, 25 bp, Homo sapien
gttatcccggataccatgctggcag

SEQ ID NO: 188364 - DNA, 25 bp, Homo sapien
tgctggcaggatccactttgcgaaa

SEQ ID NO: 188365 - DNA, 25 bp, Homo sapien
ttgcgaaattgtggactgttggact

SEQ ID NO: 188366 - DNA, 25 bp, Homo sapien
tgctgacctgggctaagaaaaactc

SEQ ID NO: 188367 - DNA, 25 bp, Homo sapien
agaaaaactctttggacagaatgtt

SEQ ID NO: 188368 - DNA, 25 bp, Homo sapien
tttccatttcctctcattccattca

SEQ ID NO: 188369 - DNA, 25 bp, Homo sapien
aactttgcacttgatggaacacctc

SEQ ID NO: 188370 - DNA, 25 bp, Homo sapien
ttgcacttgatggaacacctcaatt

SEQ ID NO: 188371 - DNA, 25 bp, Homo sapien
tgatggaacacctcaattgcaggtt

SEQ ID NO: 188372 - DNA, 25 bp, Homo sapien
ggaacacctcaattgcaggttttgt

SEQ ID NO: 188373 - DNA, 25 bp, Homo sapien
aacacctcaattgcaggttttgttt

SEQ ID NO: 188374 - DNA, 25 bp, Homo sapien
tttcctcctttacctcatgtttgtt

SEQ ID NO: 188375 - DNA, 25 bp, Homo sapien
tcctcctttacctcatgtttgttaa

SEQ ID NO: 188376 - DNA, 25 bp, Homo sapien
tcctttacctcatgtttgttaataa

SEQ ID NO: 188377 - DNA, 25 bp, Homo sapien
accagggtccggttgcggctattag

SEQ ID NO: 188378 - DNA, 25 bp, Homo sapien
tccggttgcggctattagatcttga

SEQ ID NO: 188379 - DNA, 25 bp, Homo sapien
ggctattagatcttgaacttacgtc

SEQ ID NO: 188380 - DNA, 25 bp, Homo sapien
acttacgtctaggttcctgggagca

SEQ ID NO: 188381 - DNA, 25 bp, Homo sapien
taggttcctgggagcaacaacagat

SEQ ID NO: 188382 - DNA, 25 bp, Homo sapien
gatacaactgtactagaggctaatg

SEQ ID NO: 188383 - DNA, 25 bp, Homo sapien
aggctaatgcagttctcttgggaat

SEQ ID NO: 188384 - DNA, 25 bp, Homo sapien
gttctcttgggaatccaggagagta

SEQ ID NO: 188385 - DNA, 25 bp, Homo sapien
gagtaaagactcaagatcgaaagaa

SEQ ID NO: 188386 - DNA, 25 bp, Homo sapien
gactcctttgctgaagtcagttatt

SEQ ID NO: 188387 - DNA, 25 bp, Homo sapien
gctgaagtcagttattcatcaagaa

SEQ ID NO: 188388 - DNA, 25 bp, Homo sapien
ggcattatcccaggaaacttatgtt

SEQ ID NO: 188389 - DNA, 25 bp, Homo sapien
gttttctagaagctaagcagctgct

SEQ ID NO: 188390 - DNA, 25 bp, Homo sapien
taggctgagtggcagctcagtccta

SEQ ID NO: 188391 - DNA, 25 bp, Homo sapien
gtggcagctcagtcctagaaggtct

SEQ ID NO: 188392 - DNA, 25 bp, Homo sapien
tagaaggtctctgaagatctggact

SEQ ID NO: 188393 - DNA, 25 bp, Homo sapien
gcctgtggagtgctgagctcaacca

SEQ ID NO: 188394 - DNA, 25 bp, Homo sapien
gtgctgagctcaaccaaaggctggc

SEQ ID NO: 188395 - DNA, 25 bp, Homo sapien
tcaaccaaaggctggcaagctctgg

SEQ ID NO: 188396 - DNA, 25 bp, Homo sapien
caagctctgggcctcatttaaggga

SEQ ID NO: 188397 - DNA, 25 bp, Homo sapien
tgggcctcatttaagggattctgat

SEQ ID NO: 188398 - DNA, 25 bp, Homo sapien
ggattctgatgagccgatgggccct

SEQ ID NO: 188399 - DNA, 25 bp, Homo sapien
gttatctgcaattgacaccataaag

SEQ ID NO: 188400 - DNA, 25 bp, Homo sapien
aatggagacctccagatcaccaagc

SEQ ID NO: 188401 - DNA, 25 bp, Homo sapien
cagatcaccaagcttggctgattta

SEQ ID NO: 188402 - DNA, 25 bp, Homo sapien
ggctgatttaaaccacctctatttc

SEQ ID NO: 188403 - DNA, 25 bp, Homo sapien
aggatcacgtgccacaactatctga

SEQ ID NO: 188404 - DNA, 25 bp, Homo sapien
aactatctgactgttggtctggaag

SEQ ID NO: 188405 - DNA, 25 bp, Homo sapien
gtgtcctagcaagatctggagactt

SEQ ID NO: 188406 - DNA, 25 bp, Homo sapien
gtggtttgcccttaagaagaaagct

SEQ ID NO: 188407 - DNA, 25 bp, Homo sapien
gggacaaagacaccgagccattata

SEQ ID NO: 188408 - DNA, 25 bp, Homo sapien
acaccgagccattatacccagaata

SEQ ID NO: 188409 - DNA, 25 bp, Homo sapien
tatgctggattttattcagaccaaa

SEQ ID NO: 188410 - DNA, 25 bp, Homo sapien
aggaggaaggttgttagcatctact

SEQ ID NO: 188411 - DNA, 25 bp, Homo sapien
gttgttagcatctactgctgccgta

SEQ ID NO: 188412 - DNA, 25 bp, Homo sapien
actgctgccgtaccctaggaatatg

SEQ ID NO: 188413 - DNA, 25 bp, Homo sapien
gacatggacatggtgtcccatgccc

SEQ ID NO: 188414 - DNA, 25 bp, Homo sapien
atggtgtcccatgcccagatgataa

SEQ ID NO: 188415 - DNA, 25 bp, Homo sapien
gtgtcccatgcccagatgataaaca

SEQ ID NO: 188416 - DNA, 25 bp, Homo sapien
atgataaacactgagctgccaaaac

SEQ ID NO: 188417 - DNA, 25 bp, Homo sapien
acactgagctgccaaaacatttttt

SEQ ID NO: 188418 - DNA, 25 bp, Homo sapien
gaagggcaatgcctacccccagcgt

SEQ ID NO: 188419 - DNA, 25 bp, Homo sapien
attaactgacctgttttgggacctg

SEQ ID NO: 188420 - DNA, 25 bp, Homo sapien
taactgacctgttttgggacctgtt

SEQ ID NO: 188421 - DNA, 25 bp, Homo sapien
gtcttcctaaatcagcacaactttt

SEQ ID NO: 188422 - DNA, 25 bp, Homo sapien
tggttgggctacacagttaactagt

SEQ ID NO: 188423 - DNA, 25 bp, Homo sapien
gagctgtgtgggttcagtttaatga

SEQ ID NO: 188424 - DNA, 25 bp, Homo sapien
atgatgggtcccagttggttgtgca

SEQ ID NO: 188425 - DNA, 25 bp, Homo sapien
gttgtgcaggcaggagtgtcttcta

SEQ ID NO: 188426 - DNA, 25 bp, Homo sapien
aggagtgtcttctatcagttatacc

SEQ ID NO: 188427 - DNA, 25 bp, Homo sapien
cagttatacctcaccaaatggtcaa

SEQ ID NO: 188428 - DNA, 25 bp, Homo sapien
aaatggtcaaacaactaggtatgga

SEQ ID NO: 188429 - DNA, 25 bp, Homo sapien
aaattaccagactacatcaaacaga

SEQ ID NO: 188430 - DNA, 25 bp, Homo sapien
tcttccatccttttgatgttttcta

SEQ ID NO: 188431 - DNA, 25 bp, Homo sapien
gatgttttctaatccgactcctaat

SEQ ID NO: 188432 - DNA, 25 bp, Homo sapien
gctcatattcgtaagctggctgagt

SEQ ID NO: 188433 - DNA, 25 bp, Homo sapien
ccgggattgtcctcaggcttggcaa

SEQ ID NO: 188434 - DNA, 25 bp, Homo sapien
ggcaacatcgctcggttggaactta

SEQ ID NO: 188435 - DNA, 25 bp, Homo sapien
aacatcgctcggttggaacttaatt

SEQ ID NO: 188436 - DNA, 25 bp, Homo sapien
tggaacttaattactgcgtccccat

SEQ ID NO: 188437 - DNA, 25 bp, Homo sapien
aacttaattactgcgtccccatggg

SEQ ID NO: 188438 - DNA, 25 bp, Homo sapien
taattactgcgtccccatgggagta

SEQ ID NO: 188439 - DNA, 25 bp, Homo sapien
tactgcgtccccatgggagtacaga

SEQ ID NO: 188440 - DNA, 25 bp, Homo sapien
tccccatgggagtacagacaggcga

SEQ ID NO: 188441 - DNA, 25 bp, Homo sapien
ggagtacagacaggcgacaggatat

SEQ ID NO: 188442 - DNA, 25 bp, Homo sapien
acagacaggcgacaggatatgtgat

SEQ ID NO: 188443 - DNA, 25 bp, Homo sapien
tgcctgatctcacttctgtcagatg

SEQ ID NO: 188444 - DNA, 25 bp, Homo sapien
gatgctcccatccactattaatgca

SEQ ID NO: 188445 - DNA, 25 bp, Homo sapien
gtctgatctaccctgctcacgatta

SEQ ID NO: 188446 - DNA, 25 bp, Homo sapien
gattaccatgggttcacagtgtcca

SEQ ID NO: 188447 - DNA, 25 bp, Homo sapien
aggagaggactctgaaccctcggct

SEQ ID NO: 188448 - DNA, 25 bp, Homo sapien
ggctcaccctcagctgtgaggagtt

SEQ ID NO: 188449 - DNA, 25 bp, Homo sapien
gagtttgtcaaaatcatgggcaacc

SEQ ID NO: 188450 - DNA, 25 bp, Homo sapien
atcatgggcaacctgaacttgccta

SEQ ID NO: 188451 - DNA, 25 bp, Homo sapien
acttgcctaaacctcagcagataga

SEQ ID NO: 188452 - DNA, 25 bp, Homo sapien
cagatagactttgctgttccagcca

SEQ ID NO: 188453 - DNA, 25 bp, Homo sapien
tgttccagccaacatgcgctgtggg

SEQ ID NO: 188454 - DNA, 25 bp, Homo sapien
ttttcattcttcactgtagttttaa

SEQ ID NO: 188455 - DNA, 25 bp, Homo sapien
agaactgtaaatgacggtgctatac

SEQ ID NO: 188456 - DNA, 25 bp, Homo sapien
aaaatacatgcctgcctcgtagtga

SEQ ID NO: 188457 - DNA, 25 bp, Homo sapien
atgcctgcctcgtagtgaagttgta

SEQ ID NO: 188458 - DNA, 25 bp, Homo sapien
agtgaagttgtagctctccgtaata

SEQ ID NO: 188459 - DNA, 25 bp, Homo sapien
gtagctctccgtaatatgtatattt

SEQ ID NO: 188460 - DNA, 25 bp, Homo sapien
gaatgttgactacctgaagttcctt

SEQ ID NO: 188461 - DNA, 25 bp, Homo sapien
tgaagttcctttttagatgtgctat

SEQ ID NO: 188462 - DNA, 25 bp, Homo sapien
gctattaacattctgttggattcag

SEQ ID NO: 188463 - DNA, 25 bp, Homo sapien
ctgttggattcagagggttccttga

SEQ ID NO: 188464 - DNA, 25 bp, Homo sapien
cagagggttccttgaaagttttatg

SEQ ID NO: 188465 - DNA, 25 bp, Homo sapien
ataaatgtgatagctgtgcatgcat

SEQ ID NO: 188466 - DNA, 25 bp, Homo sapien
agctgtgcatgcattatatatttgc

SEQ ID NO: 188467 - DNA, 25 bp, Homo sapien
agctgtgtggctgactttcaatttt

SEQ ID NO: 188468 - DNA, 25 bp, Homo sapien
ggctgactttcaattttaagacgtg

SEQ ID NO: 188469 - DNA, 25 bp, Homo sapien
agacgtgaattgacatacagcccat

SEQ ID NO: 188470 - DNA, 25 bp, Homo sapien
gacatacagcccataactttataat

SEQ ID NO: 188471 - DNA, 25 bp, Homo sapien
aatggctgctcatttatcttatctt

SEQ ID NO: 188472 - DNA, 25 bp, Homo sapien
tatcttatctttcagttagtggaaa

SEQ ID NO: 188473 - DNA, 25 bp, Homo sapien
tgtgtctttttatgttccatcctct

SEQ ID NO: 188474 - DNA, 25 bp, Homo sapien
ttatgttccatcctctgttgttact

SEQ ID NO: 188475 - DNA, 25 bp, Homo sapien
catcctctgttgttactagatttag

SEQ ID NO: 188476 - DNA, 25 bp, Homo sapien
gaaatattaaagtttggtcctcaat

SEQ ID NO: 188477 - DNA, 25 bp, Homo sapien
tggctgaggcagctttatttcctac

SEQ ID NO: 188478 - DNA, 25 bp, Homo sapien
atttcctacagagtttctctgtcct

SEQ ID NO: 188479 - DNA, 25 bp, Homo sapien
agtttctctgtcctcttgttaggac

SEQ ID NO: 188480 - DNA, 25 bp, Homo sapien
tgttaggacaatcagcctgctgctt

SEQ ID NO: 188481 - DNA, 25 bp, Homo sapien
gcttttccaagagcctatttttcat

SEQ ID NO: 188482 - DNA, 25 bp, Homo sapien
ttttgcactttgtgacatgctttaa

SEQ ID NO: 188483 - DNA, 25 bp, Homo sapien
gaggtaatcaactttaactttcaga

SEQ ID NO: 188484 - DNA, 25 bp, Homo sapien
atcttggtttggtggcatgaatgaa

SEQ ID NO: 188485 - DNA, 25 bp, Homo sapien
tgaaaggttatgtaaccccaccagt

SEQ ID NO: 188486 - DNA, 25 bp, Homo sapien
gtaaccccaccagtaactcatttgg

SEQ ID NO: 188487 - DNA, 25 bp, Homo sapien
taaatgtttcaagccattattgctg

SEQ ID NO: 188488 - DNA, 25 bp, Homo sapien
gccattattgctgaatggttcttta

SEQ ID NO: 188489 - DNA, 25 bp, Homo sapien
tgctgaatggttctttagttattaa

SEQ ID NO: 188490 - DNA, 25 bp, Homo sapien
aagaccagttggatttatgatattt

SEQ ID NO: 188491 - DNA, 25 bp, Homo sapien
ttttttatttgttcttgcagccaaa

SEQ ID NO: 188492 - DNA, 25 bp, Homo sapien
cttgcagccaaagtgccagtttctt

SEQ ID NO: 188493 - DNA, 25 bp, Homo sapien
tgcagccaaagtgccagtttcttta

SEQ ID NO: 188494 - DNA, 25 bp, Homo sapien
agccaaagtgccagtttctttaata

SEQ ID NO: 188495 - DNA, 25 bp, Homo sapien
gaccaagaacacaaggagcatccat

SEQ ID NO: 188496 - DNA, 25 bp, Homo sapien
acaaggagcatccatatggccaaat

SEQ ID NO: 188497 - DNA, 25 bp, Homo sapien
ggagcatccatatggccaaataaat

SEQ ID NO: 188498 - DNA, 25 bp, Homo sapien
tgtcttcattagaaaatagcagaac

SEQ ID NO: 188499 - DNA, 25 bp, Homo sapien
gaaaatagcagaaccgctcttgtct

SEQ ID NO: 188500 - DNA, 25 bp, Homo sapien
atagcagaaccgctcttgtctttta

SEQ ID NO: 188501 - DNA, 25 bp, Homo sapien
tagcagaaccgctcttgtcttttag

SEQ ID NO: 188502 - DNA, 25 bp, Homo sapien
gcagaaccgctcttgtcttttagtg

SEQ ID NO: 188503 - DNA, 25 bp, Homo sapien
agaaccgctcttgtcttttagtgta

SEQ ID NO: 188504 - DNA, 25 bp, Homo sapien
gaaccgctcttgtcttttagtgtat

SEQ ID NO: 188505 - DNA, 25 bp, Homo sapien
aaccgctcttgtcttttagtgtatt

SEQ ID NO: 188506 - DNA, 25 bp, Homo sapien
accgctcttgtcttttagtgtattt

SEQ ID NO: 188507 - DNA, 25 bp, Homo sapien
cgctcttgtcttttagtgtattttt

SEQ ID NO: 188508 - DNA, 25 bp, Homo sapien
ctcttgtcttttagtgtatttttca

SEQ ID NO: 188509 - DNA, 25 bp, Homo sapien
ggactgaaggtaattcactcctaga

SEQ ID NO: 188510 - DNA, 25 bp, Homo sapien
aaggtaattcactcctagatcgcag

SEQ ID NO: 188511 - DNA, 25 bp, Homo sapien
aattcactcctagatcgcagtggct

SEQ ID NO: 188512 - DNA, 25 bp, Homo sapien
actcctagatcgcagtggctggctg

SEQ ID NO: 188513 - DNA, 25 bp, Homo sapien
atcgcagtggctggctgcttggcca

SEQ ID NO: 188514 - DNA, 25 bp, Homo sapien
ggctgcttggccaggacagtgatgc

SEQ ID NO: 188515 - DNA, 25 bp, Homo sapien
agagcttccgcttggtgaccaggga

SEQ ID NO: 188516 - DNA, 25 bp, Homo sapien
gtcccagatggacatagaagcccct

SEQ ID NO: 188517 - DNA, 25 bp, Homo sapien
agatggacatagaagcccctctctg

SEQ ID NO: 188518 - DNA, 25 bp, Homo sapien
ctgcctccctgggattttttagact

SEQ ID NO: 188519 - DNA, 25 bp, Homo sapien
ttgatttccctaggatggaagagta

SEQ ID NO: 188520 - DNA, 25 bp, Homo sapien
ttttcctggtctcagacctatgatg

SEQ ID NO: 188521 - DNA, 25 bp, Homo sapien
cctatgatgacttgtccctttgatg

SEQ ID NO: 188522 - DNA, 25 bp, Homo sapien
gatgacttgtccctttgatgtcact

SEQ ID NO: 188523 - DNA, 25 bp, Homo sapien
tgtccctttgatgtcactactgtga

SEQ ID NO: 188524 - DNA, 25 bp, Homo sapien
gtcactactgtgaattgaatataat

SEQ ID NO: 188525 - DNA, 25 bp, Homo sapien
gaaaacaatatattttggccatcta

SEQ ID NO: 188526 - DNA, 25 bp, Homo sapien
tattttggccatctaaaaatgagaa

SEQ ID NO: 188527 - DNA, 25 bp, Homo sapien
gaagccattattctcaattaagtac

SEQ ID NO: 188528 - DNA, 25 bp, Homo sapien
agtactacaactatgacaatgcttg

SEQ ID NO: 188529 - DNA, 25 bp, Homo sapien
aactatgacaatgcttgacctacat

SEQ ID NO: 188530 - DNA, 25 bp, Homo sapien
gacaatgcttgacctacatttctaa

SEQ ID NO: 188531 - DNA, 25 bp, Homo sapien
aagaagtgagtttatctcgtttgtt

SEQ ID NO: 188532 - DNA, 25 bp, Homo sapien
atttagcattcctttttgggtctca

SEQ ID NO: 188533 - DNA, 25 bp, Homo sapien
gcattcctttttgggtctcaagatt

SEQ ID NO: 188534 - DNA, 25 bp, Homo sapien
ttttgggtctcaagatttatggaac

SEQ ID NO: 188535 - DNA, 25 bp, Homo sapien
tgtcatttaatgctgtgtgcttatt

SEQ ID NO: 188536 - DNA, 25 bp, Homo sapien
gtgcttattttgaattcctcatcag

SEQ ID NO: 188537 - DNA, 25 bp, Homo sapien
ttcctcatcaggttttagaagcggg

SEQ ID NO: 188538 - DNA, 25 bp, Homo sapien
cttagatgcttatcagacttgaaat

SEQ ID NO: 188539 - DNA, 25 bp, Homo sapien
tatactgagtggcattgaacgtgag

SEQ ID NO: 188540 - DNA, 25 bp, Homo sapien
tgaacgtgagtttgtcccagtgaaa

SEQ ID NO: 188541 - DNA, 25 bp, Homo sapien
tgagtttgtcccagtgaaacaggct

SEQ ID NO: 188542 - DNA, 25 bp, Homo sapien
aggtccaatttatatatagctgagt

SEQ ID NO: 188543 - DNA, 25 bp, Homo sapien
gtccaatttatatatagctgagtcc

SEQ ID NO: 188544 - DNA, 25 bp, Homo sapien
caatttatatatagctgagtccacc

SEQ ID NO: 188545 - DNA, 25 bp, Homo sapien
aatttatatatagctgagtccacct

SEQ ID NO: 188546 - DNA, 25 bp, Homo sapien
atttatatatagctgagtccacctc

SEQ ID NO: 188547 - DNA, 25 bp, Homo sapien
tttatatatagctgagtccacctca

SEQ ID NO: 188548 - DNA, 25 bp, Homo sapien
tatatatagctgagtccacctcagg

SEQ ID NO: 188549 - DNA, 25 bp, Homo sapien
atatatagctgagtccacctcagga

SEQ ID NO: 188550 - DNA, 25 bp, Homo sapien
agtccacctcaggacgaggccagtg

SEQ ID NO: 188551 - DNA, 25 bp, Homo sapien
gtccacctcaggacgaggccagtgc

SEQ ID NO: 188552 - DNA, 25 bp, Homo sapien
acctcaggacgaggccagtgcctga

SEQ ID NO: 188553 - DNA, 25 bp, Homo sapien
aagaagactgctgaccaagcccgaa

SEQ ID NO: 188554 - DNA, 25 bp, Homo sapien
gaccaagcccgaacactaaatcaat

SEQ ID NO: 188555 - DNA, 25 bp, Homo sapien
ggctcctgggtacattccattgaga

SEQ ID NO: 188556 - DNA, 25 bp, Homo sapien
attccattgagacagcgggagagca

SEQ ID NO: 188557 - DNA, 25 bp, Homo sapien
agcactggtgccagcccaacctgga

SEQ ID NO: 188558 - DNA, 25 bp, Homo sapien
gtgactgggtcagcaagtgcactgc

SEQ ID NO: 188559 - DNA, 25 bp, Homo sapien
agcaagtgcactgctgagcctcagt

SEQ ID NO: 188560 - DNA, 25 bp, Homo sapien
gggaatgatgctttccttgtagcac

SEQ ID NO: 188561 - DNA, 25 bp, Homo sapien
atgctttccttgtagcactgctgtg

SEQ ID NO: 188562 - DNA, 25 bp, Homo sapien
ttcagtccctggcttaactcagaaa

SEQ ID NO: 188563 - DNA, 25 bp, Homo sapien
gctgcacatgcctgcagtgggacaa

SEQ ID NO: 188564 - DNA, 25 bp, Homo sapien
gggatcccagcccacaagtgatcag

SEQ ID NO: 188565 - DNA, 25 bp, Homo sapien
gtgatcagcagagttgcatttccaa

SEQ ID NO: 188566 - DNA, 25 bp, Homo sapien
aggctatgagatgagctgagttata

SEQ ID NO: 188567 - DNA, 25 bp, Homo sapien
ggaggctaacctgcactgagtactt

SEQ ID NO: 188568 - DNA, 25 bp, Homo sapien
gcactgagtacttcattaggacaag

SEQ ID NO: 188569 - DNA, 25 bp, Homo sapien
atcagctattgataatggccagaga

SEQ ID NO: 188570 - DNA, 25 bp, Homo sapien
tggccagagatatccacagcttgga

SEQ ID NO: 188571 - DNA, 25 bp, Homo sapien
ttggaggagcccagagaccgtttgc

SEQ ID NO: 188572 - DNA, 25 bp, Homo sapien
agagaccgtttgctttatacccaca

SEQ ID NO: 188573 - DNA, 25 bp, Homo sapien
gctttatacccacacagcaactggt

SEQ ID NO: 188574 - DNA, 25 bp, Homo sapien
agcaactggtccactgctttactgt

SEQ ID NO: 188575 - DNA, 25 bp, Homo sapien
tgccagcatcatacaagtttcacaa

SEQ ID NO: 188576 - DNA, 25 bp, Homo sapien
agtctgatcatctaaatcacccgaa

SEQ ID NO: 188577 - DNA, 25 bp, Homo sapien
aaatcacccgaaaatttcagcaagc

SEQ ID NO: 188578 - DNA, 25 bp, Homo sapien
gaaaatttcagcaagcatccaatct

SEQ ID NO: 188579 - DNA, 25 bp, Homo sapien
aagcatccaatcttttcttctagag

SEQ ID NO: 188580 - DNA, 25 bp, Homo sapien
ttaaaagcaacaacagaccagaaat

SEQ ID NO: 188581 - DNA, 25 bp, Homo sapien
agaccagaaatgactcacaccacct

SEQ ID NO: 188582 - DNA, 25 bp, Homo sapien
agaaatgactcacaccaccttatag

SEQ ID NO: 188583 - DNA, 25 bp, Homo sapien
tgactcacaccaccttatagctata

SEQ ID NO: 188584 - DNA, 25 bp, Homo sapien
acaccaccttatagctatacaagaa

SEQ ID NO: 188585 - DNA, 25 bp, Homo sapien
agactagaaaccaaaatgctatttt

SEQ ID NO: 188586 - DNA, 25 bp, Homo sapien
ctagccttcactctccattgtcttt

SEQ ID NO: 188587 - DNA, 25 bp, Homo sapien
tgtattacagccctctgtggatctt

SEQ ID NO: 188588 - DNA, 25 bp, Homo sapien
agccctctgtggatcttcaactctg

SEQ ID NO: 188589 - DNA, 25 bp, Homo sapien
tgctgcctccactgtgatgcagcag

SEQ ID NO: 188590 - DNA, 25 bp, Homo sapien
gtgatgcagcagtccaactgtaact

SEQ ID NO: 188591 - DNA, 25 bp, Homo sapien
ccaactgtaactgacagtggctgcc

SEQ ID NO: 188592 - DNA, 25 bp, Homo sapien
ttctctgggccatggatcacacctg

SEQ ID NO: 188593 - DNA, 25 bp, Homo sapien
ggatcacacctgtaaggtactaatt

SEQ ID NO: 188594 - DNA, 25 bp, Homo sapien
agatcaggagaggtctgcatagtta

SEQ ID NO: 188595 - DNA, 25 bp, Homo sapien
tattgtaaatgcatgaagcactgtt

SEQ ID NO: 188596 - DNA, 25 bp, Homo sapien
ttaaacccaagtaaagactgcttga

SEQ ID NO: 188597 - DNA, 25 bp, Homo sapien
gatattctcgaaagacctgaccttt

SEQ ID NO: 188598 - DNA, 25 bp, Homo sapien
ggagccataagtcccgatttcttca

SEQ ID NO: 188599 - DNA, 25 bp, Homo sapien
gatttcttcaatgattaccaccttc

SEQ ID NO: 188600 - DNA, 25 bp, Homo sapien
tgttgttgggcagcattcatttcct

SEQ ID NO: 188601 - DNA, 25 bp, Homo sapien
gcattcatttcctggcagccttgga

SEQ ID NO: 188602 - DNA, 25 bp, Homo sapien
gatggctttggccaaccagttggca

SEQ ID NO: 188603 - DNA, 25 bp, Homo sapien
tggacgccctgccacagcatatgga

SEQ ID NO: 188604 - DNA, 25 bp, Homo sapien
agcatatggattccgccctgatgaa

SEQ ID NO: 188605 - DNA, 25 bp, Homo sapien
cgccctgatgaaccttactactatg

SEQ ID NO: 188606 - DNA, 25 bp, Homo sapien
tactactatggctatggatcttgat

SEQ ID NO: 188607 - DNA, 25 bp, Homo sapien
gtatctgtttccatgtgtaatctca

SEQ ID NO: 188608 - DNA, 25 bp, Homo sapien
atagtcagagtgacccatgtatctg

SEQ ID NO: 188609 - DNA, 25 bp, Homo sapien
ccatgtatctgggaagactctagtc

SEQ ID NO: 188610 - DNA, 25 bp, Homo sapien
aagactctagtctggactgtggccc

SEQ ID NO: 188611 - DNA, 25 bp, Homo sapien
tagtctggactgtggcccagcttgg

SEQ ID NO: 188612 - DNA, 25 bp, Homo sapien
ggaccttgtgtgctcagatcatctt

SEQ ID NO: 188613 - DNA, 25 bp, Homo sapien
tgtgtgctcagatcatcttcaggaa

SEQ ID NO: 188614 - DNA, 25 bp, Homo sapien
tcctggagacaggagtccattcact

SEQ ID NO: 188615 - DNA, 25 bp, Homo sapien
cccactcatttgcttgccaaactta

SEQ ID NO: 188616 - DNA, 25 bp, Homo sapien
gcttgccaaacttagctttgccagt

SEQ ID NO: 188617 - DNA, 25 bp, Homo sapien
gctttgccagtgatagtcaatatta

SEQ ID NO: 188618 - DNA, 25 bp, Homo sapien
tttcccctttaatccaatatagttg

SEQ ID NO: 188619 - DNA, 25 bp, Homo sapien
tcagctttttcgtatttggagatat

SEQ ID NO: 188620 - DNA, 25 bp, Homo sapien
ctgatcacctgaacaatctagatgt

SEQ ID NO: 188621 - DNA, 25 bp, Homo sapien
gatgtggacaaaaccattgggacct

SEQ ID NO: 188622 - DNA, 25 bp, Homo sapien
ccattgggacctagtttattatttg

SEQ ID NO: 188623 - DNA, 25 bp, Homo sapien
ctaactgtgtgtttagaaggcactg

SEQ ID NO: 188624 - DNA, 25 bp, Homo sapien
agaaggcactgtaactggtagctag

SEQ ID NO: 188625 - DNA, 25 bp, Homo sapien
ctggtagctagttcttgattcaata

SEQ ID NO: 188626 - DNA, 25 bp, Homo sapien
aacttttaataacagtctctctaca

SEQ ID NO: 188627 - DNA, 25 bp, Homo sapien
tctctctacatgacttaaggaactt

SEQ ID NO: 188628 - DNA, 25 bp, Homo sapien
gtaacatttttctaccatttgtccg

SEQ ID NO: 188629 - DNA, 25 bp, Homo sapien
tctaccatttgtccgtaataaacca

SEQ ID NO: 188630 - DNA, 25 bp, Homo sapien
agtcctccatctacatttgcctgtg

SEQ ID NO: 188631 - DNA, 25 bp, Homo sapien
atttgcctgtgcttcagggtaatta

SEQ ID NO: 188632 - DNA, 25 bp, Homo sapien
gtgcttcagggtaattactagtagt

SEQ ID NO: 188633 - DNA, 25 bp, Homo sapien
ctagtagtgttacatgaacatgtgc

SEQ ID NO: 188634 - DNA, 25 bp, Homo sapien
atgtgcatagtggtaggatgccatc

SEQ ID NO: 188635 - DNA, 25 bp, Homo sapien
ggatgccatcagattaaagcattga

SEQ ID NO: 188636 - DNA, 25 bp, Homo sapien
gaagtgtttcattgttacctgtacc

SEQ ID NO: 188637 - DNA, 25 bp, Homo sapien
cattgttacctgtacctaatggttt

SEQ ID NO: 188638 - DNA, 25 bp, Homo sapien
aaatgtcatagttacaatgcaagta

SEQ ID NO: 188639 - DNA, 25 bp, Homo sapien
taaactggatacttgttcttttgtc

SEQ ID NO: 188640 - DNA, 25 bp, Homo sapien
gatacttgttcttttgtcagatttg

SEQ ID NO: 188641 - DNA, 25 bp, Homo sapien
tgctgctctgaggactcaggaacac

SEQ ID NO: 188642 - DNA, 25 bp, Homo sapien
gaggactcaggaacaccttcgagct

SEQ ID NO: 188643 - DNA, 25 bp, Homo sapien
aggaacaccttcgagctttgcagac

SEQ ID NO: 188644 - DNA, 25 bp, Homo sapien
accttcgagctttgcagacctgcgg

SEQ ID NO: 188645 - DNA, 25 bp, Homo sapien
gagctttgcagacctgcggtcagcc

SEQ ID NO: 188646 - DNA, 25 bp, Homo sapien
tgcggtcagccctccatgcgcaaga

SEQ ID NO: 188647 - DNA, 25 bp, Homo sapien
gccctccatgcgcaagactaaagca

SEQ ID NO: 188648 - DNA, 25 bp, Homo sapien
ggtgggcctctaggatctttgtctt

SEQ ID NO: 188649 - DNA, 25 bp, Homo sapien
tcttctggctggaggtgcttttgga

SEQ ID NO: 188650 - DNA, 25 bp, Homo sapien
ggtgctgggcattcggtcgctcctc

SEQ ID NO: 188651 - DNA, 25 bp, Homo sapien
acgcggctgccttatcgggaaggaa

SEQ ID NO: 188652 - DNA, 25 bp, Homo sapien
actcctgcagactcctccaagggtg

SEQ ID NO: 188653 - DNA, 25 bp, Homo sapien
tgcagactcctccaagggtgccagg

SEQ ID NO: 188654 - DNA, 25 bp, Homo sapien
agactcctccaagggtgccaggaca

SEQ ID NO: 188655 - DNA, 25 bp, Homo sapien
tcctccaagggtgccaggacaacaa

SEQ ID NO: 188656 - DNA, 25 bp, Homo sapien
caagggaatcagtgtctcattatct

SEQ ID NO: 188657 - DNA, 25 bp, Homo sapien
gggaatcagtgtctcattatctcta

SEQ ID NO: 188658 - DNA, 25 bp, Homo sapien
atcagtgtctcattatctctaccat

SEQ ID NO: 188659 - DNA, 25 bp, Homo sapien
tgtctcattatctctaccatctcta

SEQ ID NO: 188660 - DNA, 25 bp, Homo sapien
catctctaccatctcggagagggag

SEQ ID NO: 188661 - DNA, 25 bp, Homo sapien
agatgtggcaggataatagggtaat

SEQ ID NO: 188662 - DNA, 25 bp, Homo sapien
gtctctgtgtcataaacaaggttaa

SEQ ID NO: 188663 - DNA, 25 bp, Homo sapien
atcagtgtttgtgaagaggcaggac

SEQ ID NO: 188664 - DNA, 25 bp, Homo sapien
ggccagagtgacagacatacggtga

SEQ ID NO: 188665 - DNA, 25 bp, Homo sapien
agacatacggtgatccaggaggctc

SEQ ID NO: 188666 - DNA, 25 bp, Homo sapien
tacggtgatccaggaggctcaaaga

SEQ ID NO: 188667 - DNA, 25 bp, Homo sapien
ggctcaaagagaagccaagtcagct

SEQ ID NO: 188668 - DNA, 25 bp, Homo sapien
gccaagtcagctttgttgtgatttg

SEQ ID NO: 188669 - DNA, 25 bp, Homo sapien
aactgatctaattcttcactcctgc

SEQ ID NO: 188670 - DNA, 25 bp, Homo sapien
gatctaattcttcactcctgctcca

SEQ ID NO: 188671 - DNA, 25 bp, Homo sapien
ttttctctccttagactccctcaga

SEQ ID NO: 188672 - DNA, 25 bp, Homo sapien
gacctgtaaccagctttgtgtcttt

SEQ ID NO: 188673 - DNA, 25 bp, Homo sapien
ctgtaaccagctttgtgtctttttt

SEQ ID NO: 188674 - DNA, 25 bp, Homo sapien
acattcaccgtcacatccctgtagt

SEQ ID NO: 188675 - DNA, 25 bp, Homo sapien
attcaccgtcacatccctgtagtgc

SEQ ID NO: 188676 - DNA, 25 bp, Homo sapien
tgtagtgccaactgaagtgccgact

SEQ ID NO: 188677 - DNA, 25 bp, Homo sapien
gtgccaactgaagtgccgactggac

SEQ ID NO: 188678 - DNA, 25 bp, Homo sapien
aactgaagtgccgactggaccgcga

SEQ ID NO: 188679 - DNA, 25 bp, Homo sapien
actggaccgcgaggttttgttcctg

SEQ ID NO: 188680 - DNA, 25 bp, Homo sapien
gaccgcgaggttttgttcctggctt

SEQ ID NO: 188681 - DNA, 25 bp, Homo sapien
atcgtcctctggcaggagctcctgc

SEQ ID NO: 188682 - DNA, 25 bp, Homo sapien
ctccacgcagaagccgaaggtgagc

SEQ ID NO: 188683 - DNA, 25 bp, Homo sapien
cacgcagaagccgaaggtgagccct

SEQ ID NO: 188684 - DNA, 25 bp, Homo sapien
agccctttctgcacaaaaccagcaa

SEQ ID NO: 188685 - DNA, 25 bp, Homo sapien
accctatggcttacaaagtagagtt

SEQ ID NO: 188686 - DNA, 25 bp, Homo sapien
ttacaaagtagagttggcccagttt

SEQ ID NO: 188687 - DNA, 25 bp, Homo sapien
tagagttggcccagtttccttccac

SEQ ID NO: 188688 - DNA, 25 bp, Homo sapien
ctggctgtcaagaaaggccgggcat

SEQ ID NO: 188689 - DNA, 25 bp, Homo sapien
ggccgggcatgctttctaaacacag

SEQ ID NO: 188690 - DNA, 25 bp, Homo sapien
aggaggcttgtagggcatcttccag

SEQ ID NO: 188691 - DNA, 25 bp, Homo sapien
gtaaggtgacttgcctaaggcctcc

SEQ ID NO: 188692 - DNA, 25 bp, Homo sapien
ccttgatcttggagtctcacagcag

SEQ ID NO: 188693 - DNA, 25 bp, Homo sapien
gagtctcacagcagactgcatgtga

SEQ ID NO: 188694 - DNA, 25 bp, Homo sapien
ctgcatgtgaacaactggagccgaa

SEQ ID NO: 188695 - DNA, 25 bp, Homo sapien
tggagccgaaaacatgcctcagtat

SEQ ID NO: 188696 - DNA, 25 bp, Homo sapien
tgggtggcttgctgcccacatccac

SEQ ID NO: 188697 - DNA, 25 bp, Homo sapien
gcttgctgcccacatccaccaagtg

SEQ ID NO: 188698 - DNA, 25 bp, Homo sapien
cttgctgcccacatccaccaagtgc

SEQ ID NO: 188699 - DNA, 25 bp, Homo sapien
ttgctgcccacatccaccaagtgca

SEQ ID NO: 188700 - DNA, 25 bp, Homo sapien
tgctgcccacatccaccaagtgcac

SEQ ID NO: 188701 - DNA, 25 bp, Homo sapien
gctgcccacatccaccaagtgcact

SEQ ID NO: 188702 - DNA, 25 bp, Homo sapien
ccacatccaccaagtgcactttggg

SEQ ID NO: 188703 - DNA, 25 bp, Homo sapien
cacatccaccaagtgcactttggga

SEQ ID NO: 188704 - DNA, 25 bp, Homo sapien
acatccaccaagtgcactttgggag

SEQ ID NO: 188705 - DNA, 25 bp, Homo sapien
catccaccaagtgcactttgggagg

SEQ ID NO: 188706 - DNA, 25 bp, Homo sapien
atccaccaagtgcactttgggaggc

SEQ ID NO: 188707 - DNA, 25 bp, Homo sapien
agagcaggccacacagttcagcgcc

SEQ ID NO: 188708 - DNA, 25 bp, Homo sapien
tcagcgcctttctgctgcccatgat

SEQ ID NO: 188709 - DNA, 25 bp, Homo sapien
gcccatgatggagtacatccccgaa

SEQ ID NO: 188710 - DNA, 25 bp, Homo sapien
gtacatccccgaaaagcgggccagt

SEQ ID NO: 188711 - DNA, 25 bp, Homo sapien
agctctccgtgccttaagggaaaag

SEQ ID NO: 188712 - DNA, 25 bp, Homo sapien
gggaaaagcgggacagctcccacca

SEQ ID NO: 188713 - DNA, 25 bp, Homo sapien
agttctccacaaccacagggcagag

SEQ ID NO: 188714 - DNA, 25 bp, Homo sapien
tccacaaccacagggcagagagacg

SEQ ID NO: 188715 - DNA, 25 bp, Homo sapien
aggcccggctctcagagcgtgttct

SEQ ID NO: 188716 - DNA, 25 bp, Homo sapien
tcagagcgtgttctgcctgagaccc

SEQ ID NO: 188717 - DNA, 25 bp, Homo sapien
agacccccgtgagggctctcggaga

SEQ ID NO: 188718 - DNA, 25 bp, Homo sapien
ccatttgcaaagtgactagagaaaa

SEQ ID NO: 188719 - DNA, 25 bp, Homo sapien
atccttagaaattgtctttatacct

SEQ ID NO: 188720 - DNA, 25 bp, Homo sapien
aatgtgattacaaagaagtctgact

SEQ ID NO: 188721 - DNA, 25 bp, Homo sapien
agaagtctgactaccatgtctttaa

SEQ ID NO: 188722 - DNA, 25 bp, Homo sapien
gtctttaaacatatggcatctctca

SEQ ID NO: 188723 - DNA, 25 bp, Homo sapien
atatggcatctctcaacttttcttc

SEQ ID NO: 188724 - DNA, 25 bp, Homo sapien
gggctacatttgttcatttccagca

SEQ ID NO: 188725 - DNA, 25 bp, Homo sapien
tttgttcatttccagcagtagcata

SEQ ID NO: 188726 - DNA, 25 bp, Homo sapien
tccagcagtagcataaacttacggt

SEQ ID NO: 188727 - DNA, 25 bp, Homo sapien
aaacttacggtgacatggtagactt

SEQ ID NO: 188728 - DNA, 25 bp, Homo sapien
gacatggtagacttgtctctaaata

SEQ ID NO: 188729 - DNA, 25 bp, Homo sapien
gtgaatttgaagaatccgtctactg

SEQ ID NO: 188730 - DNA, 25 bp, Homo sapien
ttgaagaatccgtctactgtattat

SEQ ID NO: 188731 - DNA, 25 bp, Homo sapien
gaatccgtctactgtattattgcta

SEQ ID NO: 188732 - DNA, 25 bp, Homo sapien
ccgtctactgtattattgctaaata

SEQ ID NO: 188733 - DNA, 25 bp, Homo sapien
tgtttatactaagggacaattattt

SEQ ID NO: 188734 - DNA, 25 bp, Homo sapien
gccaaagaagcaatacagcatatct

SEQ ID NO: 188735 - DNA, 25 bp, Homo sapien
gaagcaatacagcatatctgctttt

SEQ ID NO: 188736 - DNA, 25 bp, Homo sapien
ccttctgttgtttatcttacctgca

SEQ ID NO: 188737 - DNA, 25 bp, Homo sapien
ctgttgtttatcttacctgcagata

SEQ ID NO: 188738 - DNA, 25 bp, Homo sapien
gtttatcttacctgcagatattaag

SEQ ID NO: 188739 - DNA, 25 bp, Homo sapien
ttacctgcagatattaagaatgtat

SEQ ID NO: 188740 - DNA, 25 bp, Homo sapien
ggatggcactgaaggccagcagaca

SEQ ID NO: 188741 - DNA, 25 bp, Homo sapien
gcagggtcacggctggcctttacct

SEQ ID NO: 188742 - DNA, 25 bp, Homo sapien
acggctggcctttacctgctcaggc

SEQ ID NO: 188743 - DNA, 25 bp, Homo sapien
gagcactggccgtggtctacagcgt

SEQ ID NO: 188744 - DNA, 25 bp, Homo sapien
ggtctacagcgtgtggtagtcagaa

SEQ ID NO: 188745 - DNA, 25 bp, Homo sapien
agtcagaaggtttagctgggcccag

SEQ ID NO: 188746 - DNA, 25 bp, Homo sapien
gcccagggcaggtattgcgcctgct

SEQ ID NO: 188747 - DNA, 25 bp, Homo sapien
tattgcgcctgcttgggttctgcca

SEQ ID NO: 188748 - DNA, 25 bp, Homo sapien
tggagcatgaccctgagatcgtgac

SEQ ID NO: 188749 - DNA, 25 bp, Homo sapien
atgaccctgagatcgtgacaccact

SEQ ID NO: 188750 - DNA, 25 bp, Homo sapien
gagatcgtgacaccacttgagtgga

SEQ ID NO: 188751 - DNA, 25 bp, Homo sapien
gactggattgtggaccggaccacca

SEQ ID NO: 188752 - DNA, 25 bp, Homo sapien
attgtggaccggaccaccacggtgg

SEQ ID NO: 188753 - DNA, 25 bp, Homo sapien
atgccctgggtgcaggcattctcca

SEQ ID NO: 188754 - DNA, 25 bp, Homo sapien
attctccaccacctgaatcagaagg

SEQ ID NO: 188755 - DNA, 25 bp, Homo sapien
agaaaggcgagcaggaacttgctga

SEQ ID NO: 188756 - DNA, 25 bp, Homo sapien
gccatccccaactgcaagtctgagg

SEQ ID NO: 188757 - DNA, 25 bp, Homo sapien
tctgaggaggagacatcgcccctgg

SEQ ID NO: 188758 - DNA, 25 bp, Homo sapien
tggtgacacaccagaaccccgctgg

SEQ ID NO: 188759 - DNA, 25 bp, Homo sapien
agtgccccagaactggaatccaagg

SEQ ID NO: 188760 - DNA, 25 bp, Homo sapien
gaatccaaggagtcggttctgtgat

SEQ ID NO: 188761 - DNA, 25 bp, Homo sapien
ggctttgggcttgcctgccagcagt

SEQ ID NO: 188762 - DNA, 25 bp, Homo sapien
agtttagaaattacaggaccagctt

SEQ ID NO: 188763 - DNA, 25 bp, Homo sapien
ggaccagcttgttacagattataca

SEQ ID NO: 188764 - DNA, 25 bp, Homo sapien
gattatacactattctgttactttt

SEQ ID NO: 188765 - DNA, 25 bp, Homo sapien
ttttctgtgtttctaggttagaact

SEQ ID NO: 188766 - DNA, 25 bp, Homo sapien
attttattgcacactgaacagatac

SEQ ID NO: 188767 - DNA, 25 bp, Homo sapien
aacagatactgttgcttattgaata

SEQ ID NO: 188768 - DNA, 25 bp, Homo sapien
atattgtgtaaacccttctttggct

SEQ ID NO: 188769 - DNA, 25 bp, Homo sapien
ttggctttccttgcccattgcaatt

SEQ ID NO: 188770 - DNA, 25 bp, Homo sapien
attgcaatttgatttaagcctacta

SEQ ID NO: 188771 - DNA, 25 bp, Homo sapien
aagcctactagagccattgtatgtg

SEQ ID NO: 188772 - DNA, 25 bp, Homo sapien
gtatgtgacagctatattgtattac

SEQ ID NO: 188773 - DNA, 25 bp, Homo sapien
aaacagatgcatgccagggtgactc

SEQ ID NO: 188774 - DNA, 25 bp, Homo sapien
tgactctggaggaccactggttagt

SEQ ID NO: 188775 - DNA, 25 bp, Homo sapien
ggaccactggttagttcagatgcta

SEQ ID NO: 188776 - DNA, 25 bp, Homo sapien
gagatatctggtaccttgctggaat

SEQ ID NO: 188777 - DNA, 25 bp, Homo sapien
gaatgtgcgaaacccaacaagcctg

SEQ ID NO: 188778 - DNA, 25 bp, Homo sapien
acaagcctggtgtttatactagagt

SEQ ID NO: 188779 - DNA, 25 bp, Homo sapien
atactagagttacggccttgcggga

SEQ ID NO: 188780 - DNA, 25 bp, Homo sapien
gccttgcgggactggattacttcaa

SEQ ID NO: 188781 - DNA, 25 bp, Homo sapien
aaaagcctcatggaacagataacat

SEQ ID NO: 188782 - DNA, 25 bp, Homo sapien
ggaggccatttttagagatacagaa

SEQ ID NO: 188783 - DNA, 25 bp, Homo sapien
gaagacttgcaaaacagctagattt

SEQ ID NO: 188784 - DNA, 25 bp, Homo sapien
ggctacattgaccttcagtttaaga

SEQ ID NO: 188785 - DNA, 25 bp, Homo sapien
ggcagacgggccgtttccatgctga

SEQ ID NO: 188786 - DNA, 25 bp, Homo sapien
agacgggccgtttccatgctgatca

SEQ ID NO: 188787 - DNA, 25 bp, Homo sapien
gccgtttccatgctgatcattggca

SEQ ID NO: 188788 - DNA, 25 bp, Homo sapien
gatcattggcatctggtgttcctac

SEQ ID NO: 188789 - DNA, 25 bp, Homo sapien
ttcctacccgggatttaccactgcg

SEQ ID NO: 188790 - DNA, 25 bp, Homo sapien
ggatttaccactgcgcatcgttata

SEQ ID NO: 188791 - DNA, 25 bp, Homo sapien
taccactgcgcatcgttatatgcat

SEQ ID NO: 188792 - DNA, 25 bp, Homo sapien
cactgcgcatcgttatatgcatcca

SEQ ID NO: 188793 - DNA, 25 bp, Homo sapien
ctacgtggttactcctatgatgaca

SEQ ID NO: 188794 - DNA, 25 bp, Homo sapien
caccccatagtgaggaggatcacat

SEQ ID NO: 188795 - DNA, 25 bp, Homo sapien
acaatctcaaattcatcctcatgga

SEQ ID NO: 188796 - DNA, 25 bp, Homo sapien
gcatggagggccgtgtagccatcac

SEQ ID NO: 188797 - DNA, 25 bp, Homo sapien
gtgtagccatcacccgagtggccaa

SEQ ID NO: 188798 - DNA, 25 bp, Homo sapien
tggccaaccttctgctgtgtatgta

SEQ ID NO: 188799 - DNA, 25 bp, Homo sapien
tgctgtgtatgtatgccaaggagac

SEQ ID NO: 188800 - DNA, 25 bp, Homo sapien
tatgccaaggagaccgtgggctttg

SEQ ID NO: 188801 - DNA, 25 bp, Homo sapien
agaccgtgggctttggaatgctcaa

SEQ ID NO: 188802 - DNA, 25 bp, Homo sapien
ggcccaggctttggtgcagtacctg

SEQ ID NO: 188803 - DNA, 25 bp, Homo sapien
caagtggcggcatcttaacggcatt

SEQ ID NO: 188804 - DNA, 25 bp, Homo sapien
catcttaacggcattggtggaagct

SEQ ID NO: 188805 - DNA, 25 bp, Homo sapien
gcctcctagaagaaccttcttagac

SEQ ID NO: 188806 - DNA, 25 bp, Homo sapien
gaagagtggccttatgtccacctga

SEQ ID NO: 188807 - DNA, 25 bp, Homo sapien
cttatgtccacctgaatgactgcgt

SEQ ID NO: 188808 - DNA, 25 bp, Homo sapien
atgactgcgtgtgtccaaggtggct

SEQ ID NO: 188809 - DNA, 25 bp, Homo sapien
aagggacacagaggtccagtccttc

SEQ ID NO: 188810 - DNA, 25 bp, Homo sapien
agaggtccagtccttctgaagggct

SEQ ID NO: 188811 - DNA, 25 bp, Homo sapien
ttctgaagggctaggatcgggttct

SEQ ID NO: 188812 - DNA, 25 bp, Homo sapien
tggccccattgctgggactgcccag

SEQ ID NO: 188813 - DNA, 25 bp, Homo sapien
cccagtatgggctagagcaggtctt

SEQ ID NO: 188814 - DNA, 25 bp, Homo sapien
agcaggtcttcatcatgccttgtct

SEQ ID NO: 188815 - DNA, 25 bp, Homo sapien
catcatgccttgtcttttttaactg

SEQ ID NO: 188816 - DNA, 25 bp, Homo sapien
atgccttgtcttttttaactgagaa

SEQ ID NO: 188817 - DNA, 25 bp, Homo sapien
gtcctgtcaactctgcctataaaat

SEQ ID NO: 188818 - DNA, 25 bp, Homo sapien
atatccctgtctacttttctaatct

SEQ ID NO: 188819 - DNA, 25 bp, Homo sapien
tttctaatctgtactgtagccaccc

SEQ ID NO: 188820 - DNA, 25 bp, Homo sapien
gtactgtagccaccctactctaagt

SEQ ID NO: 188821 - DNA, 25 bp, Homo sapien
tactctaagtcaccaccatcttttg

SEQ ID NO: 188822 - DNA, 25 bp, Homo sapien
ccatcttttgccttgactactgcaa

SEQ ID NO: 188823 - DNA, 25 bp, Homo sapien
tgcaataaccttcaaagtagcctct

SEQ ID NO: 188824 - DNA, 25 bp, Homo sapien
aagtagcctctgattgcattcttcc

SEQ ID NO: 188825 - DNA, 25 bp, Homo sapien
tgattgcattcttcccctaatccat

SEQ ID NO: 188826 - DNA, 25 bp, Homo sapien
tccattttccatgtagcagccaaaa

SEQ ID NO: 188827 - DNA, 25 bp, Homo sapien
taggccttgctatgccttctaaagc

SEQ ID NO: 188828 - DNA, 25 bp, Homo sapien
gtaagtggtgactttttgagcacct

SEQ ID NO: 188829 - DNA, 25 bp, Homo sapien
agtggtgactttttgagcacctttc

SEQ ID NO: 188830 - DNA, 25 bp, Homo sapien
gtggtgactttttgagcacctttca

SEQ ID NO: 188831 - DNA, 25 bp, Homo sapien
tggtgactttttgagcacctttcag

SEQ ID NO: 188832 - DNA, 25 bp, Homo sapien
gtgactttttgagcacctttcagta

SEQ ID NO: 188833 - DNA, 25 bp, Homo sapien
tgactttttgagcacctttcagtat

SEQ ID NO: 188834 - DNA, 25 bp, Homo sapien
gactttttgagcacctttcagtatt

SEQ ID NO: 188835 - DNA, 25 bp, Homo sapien
actttttgagcacctttcagtatta

SEQ ID NO: 188836 - DNA, 25 bp, Homo sapien
tttttgagcacctttcagtattatg

SEQ ID NO: 188837 - DNA, 25 bp, Homo sapien
tttgagcacctttcagtattatgta

SEQ ID NO: 188838 - DNA, 25 bp, Homo sapien
ttttggatataaagctaataagcac

SEQ ID NO: 188839 - DNA, 25 bp, Homo sapien
cttttttaagatctgatatgctatc

SEQ ID NO: 188840 - DNA, 25 bp, Homo sapien
gatatgctatcattgccttaataat

SEQ ID NO: 188841 - DNA, 25 bp, Homo sapien
tatgctatcattgccttaataatgg

SEQ ID NO: 188842 - DNA, 25 bp, Homo sapien
gctatcattgccttaataatggaac

SEQ ID NO: 188843 - DNA, 25 bp, Homo sapien
atcattgccttaataatggaacaaa

SEQ ID NO: 188844 - DNA, 25 bp, Homo sapien
aatagaagcatatctaacacttttt

SEQ ID NO: 188845 - DNA, 25 bp, Homo sapien
tagaagcatatctaacactttttaa

SEQ ID NO: 188846 - DNA, 25 bp, Homo sapien
aattgattacgttgaatgcttttta

SEQ ID NO: 188847 - DNA, 25 bp, Homo sapien
tgattacgttgaatgctttttaaga

SEQ ID NO: 188848 - DNA, 25 bp, Homo sapien
aaaattgtcaatatcttaatgtatt

SEQ ID NO: 188849 - DNA, 25 bp, Homo sapien
atttaatgtagaatattgcttttta

SEQ ID NO: 188850 - DNA, 25 bp, Homo sapien
attaagctgccacggcggaggtccc

SEQ ID NO: 188851 - DNA, 25 bp, Homo sapien
ggaggtcccaccaggatgccctgga

SEQ ID NO: 188852 - DNA, 25 bp, Homo sapien
gccactggctcagcgagaagcgaca

SEQ ID NO: 188853 - DNA, 25 bp, Homo sapien
gccatccgggatggactccgcaagg

SEQ ID NO: 188854 - DNA, 25 bp, Homo sapien
gggacccacaaggacgtcctagaag

SEQ ID NO: 188855 - DNA, 25 bp, Homo sapien
acccacaaggacgtcctagaagagg

SEQ ID NO: 188856 - DNA, 25 bp, Homo sapien
gaagaggggaccgagagctcctccc

SEQ ID NO: 188857 - DNA, 25 bp, Homo sapien
cacttactgtacatcctcaggccct

SEQ ID NO: 188858 - DNA, 25 bp, Homo sapien
ctcaggccctctcggcagctgtagg

SEQ ID NO: 188859 - DNA, 25 bp, Homo sapien
ctgccccaagcaccatatggaaata

SEQ ID NO: 188860 - DNA, 25 bp, Homo sapien
gccccaagcaccatatggaaataaa

SEQ ID NO: 188861 - DNA, 25 bp, Homo sapien
aggcgtccgctacttcagaagagtg

SEQ ID NO: 188862 - DNA, 25 bp, Homo sapien
tcagaagagtgtactgtcgcatggg

SEQ ID NO: 188863 - DNA, 25 bp, Homo sapien
ctgcatctctcgctggctcaaaaca

SEQ ID NO: 188864 - DNA, 25 bp, Homo sapien
tcgctggctcaaaacacgacaggtg

SEQ ID NO: 188865 - DNA, 25 bp, Homo sapien
cacgacaggtgtgtccattggacaa

SEQ ID NO: 188866 - DNA, 25 bp, Homo sapien
gacaacagagagtgggaattccaaa

SEQ ID NO: 188867 - DNA, 25 bp, Homo sapien
gggaattccaaaagtatgggcacta

SEQ ID NO: 188868 - DNA, 25 bp, Homo sapien
ttattcatttaattgactttccctg

SEQ ID NO: 188869 - DNA, 25 bp, Homo sapien
acaaattggatggaactgtgttttt

SEQ ID NO: 188870 - DNA, 25 bp, Homo sapien
tcagtttgctgtttctgtagccata

SEQ ID NO: 188871 - DNA, 25 bp, Homo sapien
gctgtttctgtagccatattgtatt

SEQ ID NO: 188872 - DNA, 25 bp, Homo sapien
ttcatggcctttattgccttgtggg

SEQ ID NO: 188873 - DNA, 25 bp, Homo sapien
ttcctggcttttctgatggacctat

SEQ ID NO: 188874 - DNA, 25 bp, Homo sapien
ggacctatttaggacaacctctcta

SEQ ID NO: 188875 - DNA, 25 bp, Homo sapien
gggagacctcccaaatggctttgac

SEQ ID NO: 188876 - DNA, 25 bp, Homo sapien
atggctttgaccctcagacatttct

SEQ ID NO: 188877 - DNA, 25 bp, Homo sapien
cagacatttctttactcagactaaa

SEQ ID NO: 188878 - DNA, 25 bp, Homo sapien
tggaccccaggtttcctttacatga

SEQ ID NO: 188879 - DNA, 25 bp, Homo sapien
gtttcctttacatgagatcccattt

SEQ ID NO: 188880 - DNA, 25 bp, Homo sapien
catttctcaccctggactaagacaa

SEQ ID NO: 188881 - DNA, 25 bp, Homo sapien
gaattggtacagagacgctccagat

SEQ ID NO: 188882 - DNA, 25 bp, Homo sapien
gagacgctccagattttattcttat

SEQ ID NO: 188883 - DNA, 25 bp, Homo sapien
gtagaagcattgacacttctcaata

SEQ ID NO: 188884 - DNA, 25 bp, Homo sapien
gacacttctcaataatcataagctt

SEQ ID NO: 188885 - DNA, 25 bp, Homo sapien
tcataagcttttcccagaaacctgg

SEQ ID NO: 188886 - DNA, 25 bp, Homo sapien
agaaacctggactgctgagaaaata

SEQ ID NO: 188887 - DNA, 25 bp, Homo sapien
ataatgcaagaataccagttagaac

SEQ ID NO: 188888 - DNA, 25 bp, Homo sapien
ttgaagtcgaaatcttccctcctga

SEQ ID NO: 188889 - DNA, 25 bp, Homo sapien
gaaatttcctatgtgtactcctcat

SEQ ID NO: 188890 - DNA, 25 bp, Homo sapien
tcatccctcctgctgtatattttct

SEQ ID NO: 188891 - DNA, 25 bp, Homo sapien
atccctcctgctgtatattttctca

SEQ ID NO: 188892 - DNA, 25 bp, Homo sapien
tccctcctgctgtatattttctcat

SEQ ID NO: 188893 - DNA, 25 bp, Homo sapien
ttttctcattttttgcgtaataaat

SEQ ID NO: 188894 - DNA, 25 bp, Homo sapien
ggtccccgactcagctggtggctgt

SEQ ID NO: 188895 - DNA, 25 bp, Homo sapien
tggctgtggagctgagtcccctccc

SEQ ID NO: 188896 - DNA, 25 bp, Homo sapien
gtggagctgagtcccctccccgtaa

SEQ ID NO: 188897 - DNA, 25 bp, Homo sapien
gtaacctctgcaaggccagcaccca

SEQ ID NO: 188898 - DNA, 25 bp, Homo sapien
atcactacctgcacctgctgtggtc

SEQ ID NO: 188899 - DNA, 25 bp, Homo sapien
ggaggcctgggaacctggctgcagc

SEQ ID NO: 188900 - DNA, 25 bp, Homo sapien
gctggagaggcagacggtgggaccc

SEQ ID NO: 188901 - DNA, 25 bp, Homo sapien
aggcagacggtgggacccaccagct

SEQ ID NO: 188902 - DNA, 25 bp, Homo sapien
aggccctacctgtgtggtggtgggt

SEQ ID NO: 188903 - DNA, 25 bp, Homo sapien
gtgggctgtcaagacgtgtcatgta

SEQ ID NO: 188904 - DNA, 25 bp, Homo sapien
tgggctgtcaagacgtgtcatgtac

SEQ ID NO: 188905 - DNA, 25 bp, Homo sapien
gcatctctactaaggtttacacagg

SEQ ID NO: 188906 - DNA, 25 bp, Homo sapien
ggaattccacctgaagacttgtgtt

SEQ ID NO: 188907 - DNA, 25 bp, Homo sapien
gtgttaaagttctacagcgcgcact

SEQ ID NO: 188908 - DNA, 25 bp, Homo sapien
agcgcgcactgttaactgaacgtct

SEQ ID NO: 188909 - DNA, 25 bp, Homo sapien
tttttcttcagcctatacgcggatc

SEQ ID NO: 188910 - DNA, 25 bp, Homo sapien
atacgcggatccttgttttgagctc

SEQ ID NO: 188911 - DNA, 25 bp, Homo sapien
gagctctcagaatcactcagacaac

SEQ ID NO: 188912 - DNA, 25 bp, Homo sapien
tgctgctgttgctttctacatacac

SEQ ID NO: 188913 - DNA, 25 bp, Homo sapien
taaggtgccacagttttaaaccaga

SEQ ID NO: 188914 - DNA, 25 bp, Homo sapien
accagaaggtggcactctgtggctc

SEQ ID NO: 188915 - DNA, 25 bp, Homo sapien
actctgtggctccttgtagtattat

SEQ ID NO: 188916 - DNA, 25 bp, Homo sapien
acatgcctcttcatggttgcccttt

SEQ ID NO: 188917 - DNA, 25 bp, Homo sapien
ttcatggttgccctttccctctatt

SEQ ID NO: 188918 - DNA, 25 bp, Homo sapien
tttccctctattcggacccatttag

SEQ ID NO: 188919 - DNA, 25 bp, Homo sapien
tctattcggacccatttagtacagg

SEQ ID NO: 188920 - DNA, 25 bp, Homo sapien
ttagtacagggattggcttcgtcat

SEQ ID NO: 188921 - DNA, 25 bp, Homo sapien
gggattggcttcgtcatcactctga

SEQ ID NO: 188922 - DNA, 25 bp, Homo sapien
atcactctgactggagtccctgcgt

SEQ ID NO: 188923 - DNA, 25 bp, Homo sapien
gagtccctgcgtattatctctttat

SEQ ID NO: 188924 - DNA, 25 bp, Homo sapien
ttatctctttattatatgggacaag

SEQ ID NO: 188925 - DNA, 25 bp, Homo sapien
tatgggacaagaaacccaggtggtt

SEQ ID NO: 188926 - DNA, 25 bp, Homo sapien
acccaggtggtttagaataatgtca

SEQ ID NO: 188927 - DNA, 25 bp, Homo sapien
agctctaattagttcatttccaatc

SEQ ID NO: 188928 - DNA, 25 bp, Homo sapien
atttccaatcccagaacacatggag

SEQ ID NO: 188929 - DNA, 25 bp, Homo sapien
aatcggacaggtgatgccagcagtt

SEQ ID NO: 188930 - DNA, 25 bp, Homo sapien
gctcctctgtcagggaagccaggca

SEQ ID NO: 188931 - DNA, 25 bp, Homo sapien
gcagagcccacagagcatggtccat

SEQ ID NO: 188932 - DNA, 25 bp, Homo sapien
atggtccatccagagtgttccctga

SEQ ID NO: 188933 - DNA, 25 bp, Homo sapien
acccctcttcagtgtaggaagtctg

SEQ ID NO: 188934 - DNA, 25 bp, Homo sapien
aaatgggtgctaattcccttcttca

SEQ ID NO: 188935 - DNA, 25 bp, Homo sapien
ttcttcatgaaaccagggccctctt

SEQ ID NO: 188936 - DNA, 25 bp, Homo sapien
tcttccttcatctaatgcagccact

SEQ ID NO: 188937 - DNA, 25 bp, Homo sapien
tgcagccactcctaggtgaagaagt

SEQ ID NO: 188938 - DNA, 25 bp, Homo sapien
cacaattatttggtttaggatggtt

SEQ ID NO: 188939 - DNA, 25 bp, Homo sapien
ggatggttattagggcccattagaa

SEQ ID NO: 188940 - DNA, 25 bp, Homo sapien
tattttacccattcttaaagctcta

SEQ ID NO: 188941 - DNA, 25 bp, Homo sapien
aagctctaaaaaaccatctcatgga

SEQ ID NO: 188942 - DNA, 25 bp, Homo sapien
accatctcatggactgaaaggtaga

SEQ ID NO: 188943 - DNA, 25 bp, Homo sapien
tagacagatggaccacaatgggaaa

SEQ ID NO: 188944 - DNA, 25 bp, Homo sapien
tgggaaataggatgtccatttgtac

SEQ ID NO: 188945 - DNA, 25 bp, Homo sapien
ggcttaatttgtgatatcatgttct

SEQ ID NO: 188946 - DNA, 25 bp, Homo sapien
gaaatacctgcaacatgacagtcta

SEQ ID NO: 188947 - DNA, 25 bp, Homo sapien
gacagtctaatcagtagtctattaa

SEQ ID NO: 188948 - DNA, 25 bp, Homo sapien
aatgtgtataatttcctggtaaggc

SEQ ID NO: 188949 - DNA, 25 bp, Homo sapien
actctttgcccctacaaacaaacag

SEQ ID NO: 188950 - DNA, 25 bp, Homo sapien
aaacaaacagcagtacttgccagaa

SEQ ID NO: 188951 - DNA, 25 bp, Homo sapien
agcagtacttgccagaaccattctt

SEQ ID NO: 188952 - DNA, 25 bp, Homo sapien
aaccattcttgggattcaggagctc

SEQ ID NO: 188953 - DNA, 25 bp, Homo sapien
aggagctcgggcgactgccttgcct

SEQ ID NO: 188954 - DNA, 25 bp, Homo sapien
tggatctgtgtagttgccaggccca

SEQ ID NO: 188955 - DNA, 25 bp, Homo sapien
gggctgactggatccatgctttact

SEQ ID NO: 188956 - DNA, 25 bp, Homo sapien
ggatccatgctttactgtgtttaat

SEQ ID NO: 188957 - DNA, 25 bp, Homo sapien
catttggaacaaaacaccagccctt

SEQ ID NO: 188958 - DNA, 25 bp, Homo sapien
aaacaccagcccttttgtagtggat

SEQ ID NO: 188959 - DNA, 25 bp, Homo sapien
cagcccttttgtagtggatgcagaa

SEQ ID NO: 188960 - DNA, 25 bp, Homo sapien
cctgtcattgacatttagtataaca

SEQ ID NO: 188961 - DNA, 25 bp, Homo sapien
gaagtcgttccatcataatctatga

SEQ ID NO: 188962 - DNA, 25 bp, Homo sapien
taatctatgatcttgtacagcactt

SEQ ID NO: 188963 - DNA, 25 bp, Homo sapien
gatcttgtacagcacttatagaaat

SEQ ID NO: 188964 - DNA, 25 bp, Homo sapien
aggatttcttcatatctgacgtttc

SEQ ID NO: 188965 - DNA, 25 bp, Homo sapien
tcatatctgacgtttctgaaaccct

SEQ ID NO: 188966 - DNA, 25 bp, Homo sapien
acgtttctgaaaccctttgtgtctg

SEQ ID NO: 188967 - DNA, 25 bp, Homo sapien
gttgtgtgaagattgacatttacca

SEQ ID NO: 188968 - DNA, 25 bp, Homo sapien
gacatttaccatgattttccttagt

SEQ ID NO: 188969 - DNA, 25 bp, Homo sapien
catgattttccttagttacttgacg

SEQ ID NO: 188970 - DNA, 25 bp, Homo sapien
ttttccttagttacttgacgtcttg

SEQ ID NO: 188971 - DNA, 25 bp, Homo sapien
aaagtagccctgaaggtggatacca

SEQ ID NO: 188972 - DNA, 25 bp, Homo sapien
gaaggtggataccatgagctcttca

SEQ ID NO: 188973 - DNA, 25 bp, Homo sapien
ggactggcaggcttcacaatgtgtg

SEQ ID NO: 188974 - DNA, 25 bp, Homo sapien
tttccttaatggtggctgctagagc

SEQ ID NO: 188975 - DNA, 25 bp, Homo sapien
tggctgctagagctttggcccctgc

SEQ ID NO: 188976 - DNA, 25 bp, Homo sapien
agctttggcccctgcttaggattag

SEQ ID NO: 188977 - DNA, 25 bp, Homo sapien
tggcccctgcttaggattaggtggt

SEQ ID NO: 188978 - DNA, 25 bp, Homo sapien
ttaggattaggtggtcctcacaggg

SEQ ID NO: 188979 - DNA, 25 bp, Homo sapien
tgcatgctgccagttcctgttctgt

SEQ ID NO: 188980 - DNA, 25 bp, Homo sapien
agttcctgttctgtgttcaccacat

SEQ ID NO: 188981 - DNA, 25 bp, Homo sapien
acaccccattgccacttatttattc

SEQ ID NO: 188982 - DNA, 25 bp, Homo sapien
agcctgccagtgttgtgactgtggc

SEQ ID NO: 188983 - DNA, 25 bp, Homo sapien
gtggcagagtcttcagtcggaattc

SEQ ID NO: 188984 - DNA, 25 bp, Homo sapien
aggccttaccagtgtcagctatgtg

SEQ ID NO: 188985 - DNA, 25 bp, Homo sapien
tgtgggaaatgtttcggccgaccct

SEQ ID NO: 188986 - DNA, 25 bp, Homo sapien
tcactcaacattatcaactccattc

SEQ ID NO: 188987 - DNA, 25 bp, Homo sapien
gtgcgatcactgttgagaaaccttt

SEQ ID NO: 188988 - DNA, 25 bp, Homo sapien
cagcacacacttttctcaacattat

SEQ ID NO: 188989 - DNA, 25 bp, Homo sapien
aacattattggcttcctcctagagt

SEQ ID NO: 188990 - DNA, 25 bp, Homo sapien
ggcttcctcctagagtgttgtgagt

SEQ ID NO: 188991 - DNA, 25 bp, Homo sapien
gtgtgagaaggcctttcactagccc

SEQ ID NO: 188992 - DNA, 25 bp, Homo sapien
ctagccccaccttgttaacaacttg

SEQ ID NO: 188993 - DNA, 25 bp, Homo sapien
tgatgggcccactgacacagcagat

SEQ ID NO: 188994 - DNA, 25 bp, Homo sapien
atgaatcacctttcgttgggcacaa

SEQ ID NO: 188995 - DNA, 25 bp, Homo sapien
gaacgtatatgactgctgctgctcc

SEQ ID NO: 188996 - DNA, 25 bp, Homo sapien
tgcaagggacctacattcctcagta

SEQ ID NO: 188997 - DNA, 25 bp, Homo sapien
gcctccgacagctgtttctattgaa

SEQ ID NO: 188998 - DNA, 25 bp, Homo sapien
tgaaggtgttgttgctgatacctct

SEQ ID NO: 188999 - DNA, 25 bp, Homo sapien
ttcatcccaggacaccagtggtcag

SEQ ID NO: 189000 - DNA, 25 bp, Homo sapien
gcagcaacagatagcagtggacaca

SEQ ID NO: 189001 - DNA, 25 bp, Homo sapien
tggacacatccaacgaacatgcacc

SEQ ID NO: 189002 - DNA, 25 bp, Homo sapien
atgcacctgcatattcttaccaaca

SEQ ID NO: 189003 - DNA, 25 bp, Homo sapien
gtctaagtaagtctgggctgtgcta

SEQ ID NO: 189004 - DNA, 25 bp, Homo sapien
gggcgtctgaccaaacacaccaagt

SEQ ID NO: 189005 - DNA, 25 bp, Homo sapien
gaccaaacacaccaagttcgtgcgg

SEQ ID NO: 189006 - DNA, 25 bp, Homo sapien
aaacacaccaagttcgtgcgggaca

SEQ ID NO: 189007 - DNA, 25 bp, Homo sapien
acacaccaagttcgtgcgggacatg

SEQ ID NO: 189008 - DNA, 25 bp, Homo sapien
caccaagttcgtgcgggacatgatt

SEQ ID NO: 189009 - DNA, 25 bp, Homo sapien
tcgtgcgggacatgattcgggaggt

SEQ ID NO: 189010 - DNA, 25 bp, Homo sapien
aggtgtgtggctttgccccgtacga

SEQ ID NO: 189011 - DNA, 25 bp, Homo sapien
gcgcgccatggagttactgaaggtc

SEQ ID NO: 189012 - DNA, 25 bp, Homo sapien
gagttactgaaggtctccaaggaca

SEQ ID NO: 189013 - DNA, 25 bp, Homo sapien
gacaaacgggccctcaaatttatca

SEQ ID NO: 189014 - DNA, 25 bp, Homo sapien
aggagctgagcaacgtactggccgc

SEQ ID NO: 189015 - DNA, 25 bp, Homo sapien
gatataggacaggaaaaccacgtgc

SEQ ID NO: 189016 - DNA, 25 bp, Homo sapien
agtgactctgcagggaaagactggc

SEQ ID NO: 189017 - DNA, 25 bp, Homo sapien
gctcaggtgcttccatctgtggtga

SEQ ID NO: 189018 - DNA, 25 bp, Homo sapien
tctgtggtgactggaatgggaccca

SEQ ID NO: 189019 - DNA, 25 bp, Homo sapien
ggacccacgtggagtaggtgacata

SEQ ID NO: 189020 - DNA, 25 bp, Homo sapien
gagtaggtgacatatgcttcccaga

SEQ ID NO: 189021 - DNA, 25 bp, Homo sapien
agagactggtattgtggctgtgcca

SEQ ID NO: 189022 - DNA, 25 bp, Homo sapien
ctgtgccaggagtacatgtgagact

SEQ ID NO: 189023 - DNA, 25 bp, Homo sapien
agaaggagaaacattgcagtggcta

SEQ ID NO: 189024 - DNA, 25 bp, Homo sapien
gttggcccagtagaaattgacagta

SEQ ID NO: 189025 - DNA, 25 bp, Homo sapien
atatatgtgcccatttatctttttc

SEQ ID NO: 189026 - DNA, 25 bp, Homo sapien
gctagccacggagctgctgcacaga

SEQ ID NO: 189027 - DNA, 25 bp, Homo sapien
gctgcacagagcctggtgtccacaa

SEQ ID NO: 189028 - DNA, 25 bp, Homo sapien
tggtgtccacaagcttccaggttgg

SEQ ID NO: 189029 - DNA, 25 bp, Homo sapien
ggccggtcagtcattgctggactct

SEQ ID NO: 189030 - DNA, 25 bp, Homo sapien
tctggccacacactggcgttctcat

SEQ ID NO: 189031 - DNA, 25 bp, Homo sapien
ggcgttctcatccacttggaaacaa

SEQ ID NO: 189032 - DNA, 25 bp, Homo sapien
ggaaacaagccagtcttttctgcaa

SEQ ID NO: 189033 - DNA, 25 bp, Homo sapien
gtcttttctgcaaggtctgttgacc

SEQ ID NO: 189034 - DNA, 25 bp, Homo sapien
gtctgttgaccaagagcatatttcc

SEQ ID NO: 189035 - DNA, 25 bp, Homo sapien
atatttcccctctgttgtacatcgt

SEQ ID NO: 189036 - DNA, 25 bp, Homo sapien
tcccctctgttgtacatcgttgttt

SEQ ID NO: 189037 - DNA, 25 bp, Homo sapien
ggacaatcctttggtaaattataca

SEQ ID NO: 189038 - DNA, 25 bp, Homo sapien
acacatctaccaactacagtgatgg

SEQ ID NO: 189039 - DNA, 25 bp, Homo sapien
cagtgatggatcatagcaaatcccc

SEQ ID NO: 189040 - DNA, 25 bp, Homo sapien
ctttatgcgtaaagggacggctggt

SEQ ID NO: 189041 - DNA, 25 bp, Homo sapien
acggctggtgactggaagaattact

SEQ ID NO: 189042 - DNA, 25 bp, Homo sapien
gaagaattacttcaccgtggcccaa

SEQ ID NO: 189043 - DNA, 25 bp, Homo sapien
ttacttcaccgtggcccaaaatgag

SEQ ID NO: 189044 - DNA, 25 bp, Homo sapien
aaaactgcacttcaattccgcacag

SEQ ID NO: 189045 - DNA, 25 bp, Homo sapien
ttccgcacagagatttaaagtgtct

SEQ ID NO: 189046 - DNA, 25 bp, Homo sapien
aagtgtctaaatcacaaatctgaga

SEQ ID NO: 189047 - DNA, 25 bp, Homo sapien
gagattgtctgtagttgattgaaac

SEQ ID NO: 189048 - DNA, 25 bp, Homo sapien
gaagtctcagttctgtcatttgtcc

SEQ ID NO: 189049 - DNA, 25 bp, Homo sapien
gtcctggagcaggttattgagtctc

SEQ ID NO: 189050 - DNA, 25 bp, Homo sapien
attgagtctctttgaatcttggttt

SEQ ID NO: 189051 - DNA, 25 bp, Homo sapien
aaaatggaaagtcctgcttgtttca

SEQ ID NO: 189052 - DNA, 25 bp, Homo sapien
cctgcttgtttcatgggatgggtgt

SEQ ID NO: 189053 - DNA, 25 bp, Homo sapien
gttcttacagcacttgtttgtgaca

SEQ ID NO: 189054 - DNA, 25 bp, Homo sapien
agcacttgtttgtgacattcagtca

SEQ ID NO: 189055 - DNA, 25 bp, Homo sapien
ttcagtcagataatggccagaagtt

SEQ ID NO: 189056 - DNA, 25 bp, Homo sapien
gccagaagtttttgttaagagccag

SEQ ID NO: 189057 - DNA, 25 bp, Homo sapien
gttcttagaagaacctatgccaagg

SEQ ID NO: 189058 - DNA, 25 bp, Homo sapien
aaggtcacccatagagtccattggt

SEQ ID NO: 189059 - DNA, 25 bp, Homo sapien
gtccatcccttggtacatatatgca

SEQ ID NO: 189060 - DNA, 25 bp, Homo sapien
gatgccagttatcatgctgccacta

SEQ ID NO: 189061 - DNA, 25 bp, Homo sapien
gctgccactacatcgttatctggag

SEQ ID NO: 189062 - DNA, 25 bp, Homo sapien
tggaggcaacttctggtggtttttt

SEQ ID NO: 189063 - DNA, 25 bp, Homo sapien
acgctgatggcttggcagagcacct

SEQ ID NO: 189064 - DNA, 25 bp, Homo sapien
gcagagcaccttcggttaacttgca

SEQ ID NO: 189065 - DNA, 25 bp, Homo sapien
tcggttaacttgcatctccagattg

SEQ ID NO: 189066 - DNA, 25 bp, Homo sapien
gattactcaagcagacagcacacga

SEQ ID NO: 189067 - DNA, 25 bp, Homo sapien
tttttctcctaatatgctgtttcca

SEQ ID NO: 189068 - DNA, 25 bp, Homo sapien
gacacagcagctcctttgtaagtac

SEQ ID NO: 189069 - DNA, 25 bp, Homo sapien
tgtaagtaccaggtcatgtccatcc

SEQ ID NO: 189070 - DNA, 25 bp, Homo sapien
agtctgtccttatgggaagaagcag

SEQ ID NO: 189071 - DNA, 25 bp, Homo sapien
gtctgtccttatgggaagaagcagg

SEQ ID NO: 189072 - DNA, 25 bp, Homo sapien
tgtaccccaagctgctttctctgga

SEQ ID NO: 189073 - DNA, 25 bp, Homo sapien
cagccaaagccccagtaatagaatt

SEQ ID NO: 189074 - DNA, 25 bp, Homo sapien
gccaaagccccagtaatagaattaa

SEQ ID NO: 189075 - DNA, 25 bp, Homo sapien
aagccccagtaatagaattaagatc

SEQ ID NO: 189076 - DNA, 25 bp, Homo sapien
gaattaagatcatccaagaccatgg

SEQ ID NO: 189077 - DNA, 25 bp, Homo sapien
ttaagatcatccaagaccatggcat

SEQ ID NO: 189078 - DNA, 25 bp, Homo sapien
aagatcatccaagaccatggcatcc

SEQ ID NO: 189079 - DNA, 25 bp, Homo sapien
gatcatccaagaccatggcatcccg

SEQ ID NO: 189080 - DNA, 25 bp, Homo sapien
aagaccatggcatcccgcctgagaa

SEQ ID NO: 189081 - DNA, 25 bp, Homo sapien
ttgcaggaggctcagcaaagctgaa

SEQ ID NO: 189082 - DNA, 25 bp, Homo sapien
gcaaagctgaattaactcaggcaga

SEQ ID NO: 189083 - DNA, 25 bp, Homo sapien
tgaattaactcaggcagaagagcac

SEQ ID NO: 189084 - DNA, 25 bp, Homo sapien
gggacaagattttttatctccaagt

SEQ ID NO: 189085 - DNA, 25 bp, Homo sapien
ttatctccaagtgaattttctaaaa

SEQ ID NO: 189086 - DNA, 25 bp, Homo sapien
tgcatgtgcacttcaccgccctggg

SEQ ID NO: 189087 - DNA, 25 bp, Homo sapien
tgctggctgaggtgatcgagaactt

SEQ ID NO: 189088 - DNA, 25 bp, Homo sapien
atcgagaacttggagtgtgacccta

SEQ ID NO: 189089 - DNA, 25 bp, Homo sapien
acttggagtgtgaccctaggcacta

SEQ ID NO: 189090 - DNA, 25 bp, Homo sapien
ggagtgtgaccctaggcactaccag

SEQ ID NO: 189091 - DNA, 25 bp, Homo sapien
gtgaccctaggcactaccagcagcg

SEQ ID NO: 189092 - DNA, 25 bp, Homo sapien
agctgggacagaagtccgatctccc

SEQ ID NO: 189093 - DNA, 25 bp, Homo sapien
gacagaagtccgatctccctagggc

SEQ ID NO: 189094 - DNA, 25 bp, Homo sapien
ttctttccaaattggatcgctctgg

SEQ ID NO: 189095 - DNA, 25 bp, Homo sapien
caaattggatcgctctgggatttct

SEQ ID NO: 189096 - DNA, 25 bp, Homo sapien
aggacagcgaggttctttctgatac

SEQ ID NO: 189097 - DNA, 25 bp, Homo sapien
agcgaggttctttctgatactaaaa

SEQ ID NO: 189098 - DNA, 25 bp, Homo sapien
acctttctttcaggcagcaaatgaa

SEQ ID NO: 189099 - DNA, 25 bp, Homo sapien
aacttgaaaggttgcctggactcgc

SEQ ID NO: 189100 - DNA, 25 bp, Homo sapien
aaaggttgcctggactcgctggagc

SEQ ID NO: 189101 - DNA, 25 bp, Homo sapien
gcctggactcgctggagcaaaggaa

SEQ ID NO: 189102 - DNA, 25 bp, Homo sapien
gtataattaaatgatctgttcttct

SEQ ID NO: 189103 - DNA, 25 bp, Homo sapien
taatgccccccaagaatgttaatgt

SEQ ID NO: 189104 - DNA, 25 bp, Homo sapien
ccccaagaatgttaatgtcaatcat

SEQ ID NO: 189105 - DNA, 25 bp, Homo sapien
atgtcaatcatgtcagtggactagc

SEQ ID NO: 189106 - DNA, 25 bp, Homo sapien
caatcatgtcagtggactagcacat

SEQ ID NO: 189107 - DNA, 25 bp, Homo sapien
atgtcagtggactagcacatggcag

SEQ ID NO: 189108 - DNA, 25 bp, Homo sapien
gtggactagcacatggcagtcgctt

SEQ ID NO: 189109 - DNA, 25 bp, Homo sapien
actagcacatggcagtcgcttggaa

SEQ ID NO: 189110 - DNA, 25 bp, Homo sapien
gcacatggcagtcgcttggaaccca

SEQ ID NO: 189111 - DNA, 25 bp, Homo sapien
atggcagtcgcttggaacccactca

SEQ ID NO: 189112 - DNA, 25 bp, Homo sapien
actcacaccaatccagtgaccgtgt

SEQ ID NO: 189113 - DNA, 25 bp, Homo sapien
accaatccagtgaccgtgtgtgggc

SEQ ID NO: 189114 - DNA, 25 bp, Homo sapien
ggttttgagaaactcgctggcacca

SEQ ID NO: 189115 - DNA, 25 bp, Homo sapien
gttttgagaaactcgctggcaccac

SEQ ID NO: 189116 - DNA, 25 bp, Homo sapien
ttttgagaaactcgctggcaccaca

SEQ ID NO: 189117 - DNA, 25 bp, Homo sapien
ttgagaaactcgctggcaccacagt

SEQ ID NO: 189118 - DNA, 25 bp, Homo sapien
tgagaaactcgctggcaccacagtg

SEQ ID NO: 189119 - DNA, 25 bp, Homo sapien
gagaaactcgctggcaccacagtgg

SEQ ID NO: 189120 - DNA, 25 bp, Homo sapien
gaaactcgctggcaccacagtgggc

SEQ ID NO: 189121 - DNA, 25 bp, Homo sapien
aaactcgctggcaccacagtgggcc

SEQ ID NO: 189122 - DNA, 25 bp, Homo sapien
cacggccagcaggatgggctgtcgt

SEQ ID NO: 189123 - DNA, 25 bp, Homo sapien
caggatgggctgtcgtgtatatagc

SEQ ID NO: 189124 - DNA, 25 bp, Homo sapien
atgggctgtcgtgtatatagctggg

SEQ ID NO: 189125 - DNA, 25 bp, Homo sapien
ttagtggatagcgttgttggaattc

SEQ ID NO: 189126 - DNA, 25 bp, Homo sapien
gcattaccttatgtgattgtattaa

SEQ ID NO: 189127 - DNA, 25 bp, Homo sapien
gttttcctcagttgtttcctgtaag

SEQ ID NO: 189128 - DNA, 25 bp, Homo sapien
tcctcagttgtttcctgtaagtgct

SEQ ID NO: 189129 - DNA, 25 bp, Homo sapien
gtaagtgctgtgaccttttctggaa

SEQ ID NO: 189130 - DNA, 25 bp, Homo sapien
gctgtgaccttttctggaatccacc

SEQ ID NO: 189131 - DNA, 25 bp, Homo sapien
ggaatccacctgttgagatgcttta

SEQ ID NO: 189132 - DNA, 25 bp, Homo sapien
gagatgctttatagccagtgtaaca

SEQ ID NO: 189133 - DNA, 25 bp, Homo sapien
gccagtgtaacaggaagtcttgact

SEQ ID NO: 189134 - DNA, 25 bp, Homo sapien
gaagtcttgactaatggttcccggt

SEQ ID NO: 189135 - DNA, 25 bp, Homo sapien
atggttcccggtttagctgaagatt

SEQ ID NO: 189136 - DNA, 25 bp, Homo sapien
gggctgctgaagtcagctccgcggg

SEQ ID NO: 189137 - DNA, 25 bp, Homo sapien
gggagctgaccctgacgtcagcaga

SEQ ID NO: 189138 - DNA, 25 bp, Homo sapien
tgaccctgacgtcagcagaccgaga

SEQ ID NO: 189139 - DNA, 25 bp, Homo sapien
tgacgtcagcagaccgagaccagtc

SEQ ID NO: 189140 - DNA, 25 bp, Homo sapien
agcagaccgagaccagtcccagttc

SEQ ID NO: 189141 - DNA, 25 bp, Homo sapien
ttcactcccccaagtctttggaaat

SEQ ID NO: 189142 - DNA, 25 bp, Homo sapien
tttgttcttttcctttgaagtcaca

SEQ ID NO: 189143 - DNA, 25 bp, Homo sapien
gttcttttcctttgaagtcacattt

SEQ ID NO: 189144 - DNA, 25 bp, Homo sapien
tcttttcctttgaagtcacattttc

SEQ ID NO: 189145 - DNA, 25 bp, Homo sapien
tttgttttgcatccgaaaccgaaag

SEQ ID NO: 189146 - DNA, 25 bp, Homo sapien
ttttgcatccgaaaccgaaagaaat

SEQ ID NO: 189147 - DNA, 25 bp, Homo sapien
cagaagacctgaagaacagcgccca

SEQ ID NO: 189148 - DNA, 25 bp, Homo sapien
gtttgcagaaactgcgcacaagctt

SEQ ID NO: 189149 - DNA, 25 bp, Homo sapien
aaactgcgcacaagcttgccatgaa

SEQ ID NO: 189150 - DNA, 25 bp, Homo sapien
cttgccatgaagcacaaatgttgag

SEQ ID NO: 189151 - DNA, 25 bp, Homo sapien
atgttgagaaactgcctatcctggt

SEQ ID NO: 189152 - DNA, 25 bp, Homo sapien
tgagaaactgcctatcctggtgact

SEQ ID NO: 189153 - DNA, 25 bp, Homo sapien
tatcctggtgactcttcttaagaga

SEQ ID NO: 189154 - DNA, 25 bp, Homo sapien
aagaattcgggacctccgcttgctt

SEQ ID NO: 189155 - DNA, 25 bp, Homo sapien
tccaatatttggacacttagagtgg

SEQ ID NO: 189156 - DNA, 25 bp, Homo sapien
agaaagggtgttgcatttttacatt

SEQ ID NO: 189157 - DNA, 25 bp, Homo sapien
atttccctaatgatcttgctaataa

SEQ ID NO: 189158 - DNA, 25 bp, Homo sapien
gcctggcaaccaaatcgaatctctc

SEQ ID NO: 189159 - DNA, 25 bp, Homo sapien
gttagttttgcctagaatcctgttc

SEQ ID NO: 189160 - DNA, 25 bp, Homo sapien
gaatcctgttctcttctgaatttgc

SEQ ID NO: 189161 - DNA, 25 bp, Homo sapien
tcctgttctcttctgaatttgcagc

SEQ ID NO: 189162 - DNA, 25 bp, Homo sapien
tgttcaacacagtaagccctgctcc

SEQ ID NO: 189163 - DNA, 25 bp, Homo sapien
ctaatacactacctgtacaaaggtt

SEQ ID NO: 189164 - DNA, 25 bp, Homo sapien
agagacctcttgtgttcctgccaca

SEQ ID NO: 189165 - DNA, 25 bp, Homo sapien
tgttcctgccacatagctgccaggg

SEQ ID NO: 189166 - DNA, 25 bp, Homo sapien
tgccacatagctgccagggcttaag

SEQ ID NO: 189167 - DNA, 25 bp, Homo sapien
gggcttaagtgtgcctggcaaccaa

SEQ ID NO: 189168 - DNA, 25 bp, Homo sapien
agtgtgcctggcaaccaaatcgaat

SEQ ID NO: 189169 - DNA, 25 bp, Homo sapien
tgtgaggaggaggctttatacctga

SEQ ID NO: 189170 - DNA, 25 bp, Homo sapien
tgttaacttcagacaagatggagct

SEQ ID NO: 189171 - DNA, 25 bp, Homo sapien
atggagctgctcacttttgccgggt

SEQ ID NO: 189172 - DNA, 25 bp, Homo sapien
gctgctcacttttgccgggtttggt

SEQ ID NO: 189173 - DNA, 25 bp, Homo sapien
ccccattatccctcctcaattggag

SEQ ID NO: 189174 - DNA, 25 bp, Homo sapien
cagagctgaataggaaagacttgct

SEQ ID NO: 189175 - DNA, 25 bp, Homo sapien
gaaagacttgctattgcctaaggct

SEQ ID NO: 189176 - DNA, 25 bp, Homo sapien
aagacttgctattgcctaaggctat

SEQ ID NO: 189177 - DNA, 25 bp, Homo sapien
attgcctaaggctatgtgtgacacc

SEQ ID NO: 189178 - DNA, 25 bp, Homo sapien
gcctaaggctatgtgtgacaccctc

SEQ ID NO: 189179 - DNA, 25 bp, Homo sapien
tgtaatggcccttcatggcagggac

SEQ ID NO: 189180 - DNA, 25 bp, Homo sapien
tgtgtgcaccaaccttccccagagc

SEQ ID NO: 189181 - DNA, 25 bp, Homo sapien
tcacttccaggttttggagcaagag

SEQ ID NO: 189182 - DNA, 25 bp, Homo sapien
cttccaggttttggagcaagagctt

SEQ ID NO: 189183 - DNA, 25 bp, Homo sapien
ccaggttttggagcaagagcttgca

SEQ ID NO: 189184 - DNA, 25 bp, Homo sapien
gcaagagcttgcaggaagcccgcac

SEQ ID NO: 189185 - DNA, 25 bp, Homo sapien
gagcttgcaggaagcccgcacccag

SEQ ID NO: 189186 - DNA, 25 bp, Homo sapien
ttcagttcactttgtcgcccttgga

SEQ ID NO: 189187 - DNA, 25 bp, Homo sapien
tcagttcactttgtcgcccttggag

SEQ ID NO: 189188 - DNA, 25 bp, Homo sapien
agttcactttgtcgcccttggagaa

SEQ ID NO: 189189 - DNA, 25 bp, Homo sapien
cactttgtcgcccttggagaaagct

SEQ ID NO: 189190 - DNA, 25 bp, Homo sapien
actttgtcgcccttggagaaagctg

SEQ ID NO: 189191 - DNA, 25 bp, Homo sapien
gtaagtggtgactttttgagcacct

SEQ ID NO: 189192 - DNA, 25 bp, Homo sapien
agtggtgactttttgagcacctttc

SEQ ID NO: 189193 - DNA, 25 bp, Homo sapien
gtgactttttgagcacctttcagta

SEQ ID NO: 189194 - DNA, 25 bp, Homo sapien
gactttttgagcacctttcagtatt

SEQ ID NO: 189195 - DNA, 25 bp, Homo sapien
tttgagcacctttcagtattatgta

SEQ ID NO: 189196 - DNA, 25 bp, Homo sapien
ttttggatataaagctaataagcac

SEQ ID NO: 189197 - DNA, 25 bp, Homo sapien
aaggcagcctttactattttttctg

SEQ ID NO: 189198 - DNA, 25 bp, Homo sapien
tctggttgagtcattgctctttaga

SEQ ID NO: 189199 - DNA, 25 bp, Homo sapien
gctctttagacctagcatcagcaat

SEQ ID NO: 189200 - DNA, 25 bp, Homo sapien
gtattaagcgctaccctaaagtgtg

SEQ ID NO: 189201 - DNA, 25 bp, Homo sapien
acacagcttatatgtatttacaaga

SEQ ID NO: 189202 - DNA, 25 bp, Homo sapien
tcagtgtctcctcaggcacaggaag

SEQ ID NO: 189203 - DNA, 25 bp, Homo sapien
gtctcctcaggcacaggaagtgggc

SEQ ID NO: 189204 - DNA, 25 bp, Homo sapien
ggtgggtatattcctcaggagtcca

SEQ ID NO: 189205 - DNA, 25 bp, Homo sapien
gtatattcctcaggagtccacagac

SEQ ID NO: 189206 - DNA, 25 bp, Homo sapien
ggacccgagcctggcttttgaccta

SEQ ID NO: 189207 - DNA, 25 bp, Homo sapien
gcctggcttttgacctaagaaccct

SEQ ID NO: 189208 - DNA, 25 bp, Homo sapien
tttgacctaagaaccctagcaggag

SEQ ID NO: 189209 - DNA, 25 bp, Homo sapien
gaaccctagcaggagaatacagtct

SEQ ID NO: 189210 - DNA, 25 bp, Homo sapien
acagtctccatcctgctgtctctgt

SEQ ID NO: 189211 - DNA, 25 bp, Homo sapien
ctcacttccttcttctggagtttaa

SEQ ID NO: 189212 - DNA, 25 bp, Homo sapien
tggagtttaaccagatcctccccac

SEQ ID NO: 189213 - DNA, 25 bp, Homo sapien
taaaaacaattcttgtgggtgccag

SEQ ID NO: 189214 - DNA, 25 bp, Homo sapien
aaaaacaattcttgtgggtgccagt

SEQ ID NO: 189215 - DNA, 25 bp, Homo sapien
aaaacaattcttgtgggtgccagtg

SEQ ID NO: 189216 - DNA, 25 bp, Homo sapien
aaacaattcttgtgggtgccagtgg

SEQ ID NO: 189217 - DNA, 25 bp, Homo sapien
aacaattcttgtgggtgccagtgga

SEQ ID NO: 189218 - DNA, 25 bp, Homo sapien
caattcttgtgggtgccagtggacc

SEQ ID NO: 189219 - DNA, 25 bp, Homo sapien
aattcttgtgggtgccagtggacct

SEQ ID NO: 189220 - DNA, 25 bp, Homo sapien
attcttgtgggtgccagtggacctg

SEQ ID NO: 189221 - DNA, 25 bp, Homo sapien
ctgtcagcgatagagggaacccttc

SEQ ID NO: 189222 - DNA, 25 bp, Homo sapien
tgtcagcgatagagggaacccttcc

SEQ ID NO: 189223 - DNA, 25 bp, Homo sapien
gtcagcgatagagggaacccttcca

SEQ ID NO: 189224 - DNA, 25 bp, Homo sapien
agctcttagaagcaactccttggcc

SEQ ID NO: 189225 - DNA, 25 bp, Homo sapien
aactccttggcccaggaatgcgtga

SEQ ID NO: 189226 - DNA, 25 bp, Homo sapien
atgcgtgacccctgagatgggtcca

SEQ ID NO: 189227 - DNA, 25 bp, Homo sapien
tgagatgggtccacgcatctctcta

SEQ ID NO: 189228 - DNA, 25 bp, Homo sapien
ttctctccgtgggatactggactcg

SEQ ID NO: 189229 - DNA, 25 bp, Homo sapien
gtgggatactggactcgtgcctctg

SEQ ID NO: 189230 - DNA, 25 bp, Homo sapien
attctcttctcacgcatatccatga

SEQ ID NO: 189231 - DNA, 25 bp, Homo sapien
ttctcacgcatatccatgagcttta

SEQ ID NO: 189232 - DNA, 25 bp, Homo sapien
aatttcactttctgatcacggtacg

SEQ ID NO: 189233 - DNA, 25 bp, Homo sapien
atcacggtacgtccataaagccagt

SEQ ID NO: 189234 - DNA, 25 bp, Homo sapien
gtccataaagccagtattacactta

SEQ ID NO: 189235 - DNA, 25 bp, Homo sapien
tcagcatcgttttcatacatggaaa

SEQ ID NO: 189236 - DNA, 25 bp, Homo sapien
ggaaaaaactcctgttgcaagtgca

SEQ ID NO: 189237 - DNA, 25 bp, Homo sapien
gttgcaagtgcaacctcagaaaaaa

SEQ ID NO: 189238 - DNA, 25 bp, Homo sapien
atgatgatgtaatcccaagaaacgt

SEQ ID NO: 189239 - DNA, 25 bp, Homo sapien
tgtaatcccaagaaacgtatacttt

SEQ ID NO: 189240 - DNA, 25 bp, Homo sapien
ggaattacaacagaagtactggaaa

SEQ ID NO: 189241 - DNA, 25 bp, Homo sapien
gtactggaaaccatctgcttgttca

SEQ ID NO: 189242 - DNA, 25 bp, Homo sapien
catctgcttgttcaacttagcaaag

SEQ ID NO: 189243 - DNA, 25 bp, Homo sapien
tatcctctttttctagacataactg

SEQ ID NO: 189244 - DNA, 25 bp, Homo sapien
ttttctagacataactgttggtgta

SEQ ID NO: 189245 - DNA, 25 bp, Homo sapien
aactgttggtgtaatggttatcaaa

SEQ ID NO: 189246 - DNA, 25 bp, Homo sapien
gtgaatgaaatccaaaagcacgcat

SEQ ID NO: 189247 - DNA, 25 bp, Homo sapien
aagcacgcatgagaccaatgaaagt

SEQ ID NO: 189248 - DNA, 25 bp, Homo sapien
caatgaaagtttccgcctgttgtaa

SEQ ID NO: 189249 - DNA, 25 bp, Homo sapien
ggaaagtccttgcacagacaccagt

SEQ ID NO: 189250 - DNA, 25 bp, Homo sapien
acagacaccagtgagtgagttctaa

SEQ ID NO: 189251 - DNA, 25 bp, Homo sapien
tggaattatcagactcagaaacttt

SEQ ID NO: 189252 - DNA, 25 bp, Homo sapien
ttttctgtaacagtctcaccagact

SEQ ID NO: 189253 - DNA, 25 bp, Homo sapien
gtctcaccagacttctcataatgct

SEQ ID NO: 189254 - DNA, 25 bp, Homo sapien
agacttctcataatgctcttaatat

SEQ ID NO: 189255 - DNA, 25 bp, Homo sapien
cttaatatattgcacttttctaatc

SEQ ID NO: 189256 - DNA, 25 bp, Homo sapien
ttttctaatcaaagtgcgagtttat

SEQ ID NO: 189257 - DNA, 25 bp, Homo sapien
gattgagcccaagaaaccagggact

SEQ ID NO: 189258 - DNA, 25 bp, Homo sapien
cagggacttacgcatttggccaatg

SEQ ID NO: 189259 - DNA, 25 bp, Homo sapien
ccactgcacacttgctgtgtacaat

SEQ ID NO: 189260 - DNA, 25 bp, Homo sapien
ctgtgtacaatgactgagccctttc

SEQ ID NO: 189261 - DNA, 25 bp, Homo sapien
atgactgagccctttcttgtagttt

SEQ ID NO: 189262 - DNA, 25 bp, Homo sapien
gtttccttgtttgagaggtgtgcat

SEQ ID NO: 189263 - DNA, 25 bp, Homo sapien
aggtgtgcatgcgaccgtggctttt

SEQ ID NO: 189264 - DNA, 25 bp, Homo sapien
accttccagggacgcagttgttacg

SEQ ID NO: 189265 - DNA, 25 bp, Homo sapien
acgaggttagacgtggcagctctgt

SEQ ID NO: 189266 - DNA, 25 bp, Homo sapien
gcagctctgtgcagtgtttgagcct

SEQ ID NO: 189267 - DNA, 25 bp, Homo sapien
tttgagcctacagtgggatacatag

SEQ ID NO: 189268 - DNA, 25 bp, Homo sapien
gtgtcggtagcgtcttagccaagag

SEQ ID NO: 189269 - DNA, 25 bp, Homo sapien
gtcttagccaagagtccaattaaag

SEQ ID NO: 189270 - DNA, 25 bp, Homo sapien
aagcgggccggctcggcttctgacc

SEQ ID NO: 189271 - DNA, 25 bp, Homo sapien
ttctgacctggcaccgctgctacgg

SEQ ID NO: 189272 - DNA, 25 bp, Homo sapien
tgctacggcggcctagcaaattccg

SEQ ID NO: 189273 - DNA, 25 bp, Homo sapien
ggcctagcaaattccgccccagaag

SEQ ID NO: 189274 - DNA, 25 bp, Homo sapien
tctcctggacgatcgcgggtcgcag

SEQ ID NO: 189275 - DNA, 25 bp, Homo sapien
gacgatcgcgggtcgcagaagccca

SEQ ID NO: 189276 - DNA, 25 bp, Homo sapien
gccagcgagccctacagagtgagga

SEQ ID NO: 189277 - DNA, 25 bp, Homo sapien
gagccctacagagtgaggacactga

SEQ ID NO: 189278 - DNA, 25 bp, Homo sapien
aagtgtgcaggagcgaaggttaaca

SEQ ID NO: 189279 - DNA, 25 bp, Homo sapien
tctccccgggtgaggcctggccttt

SEQ ID NO: 189280 - DNA, 25 bp, Homo sapien
gaggcctggccttttgagagtgtat

SEQ ID NO: 189281 - DNA, 25 bp, Homo sapien
gcctggccttttgagagtgtatgaa

SEQ ID NO: 189282 - DNA, 25 bp, Homo sapien
tttgagagtgtatgaagctggctgc

SEQ ID NO: 189283 - DNA, 25 bp, Homo sapien
atgctcttctgtactgtcatgcccg

SEQ ID NO: 189284 - DNA, 25 bp, Homo sapien
ttctgtactgtcatgcccgtctctg

SEQ ID NO: 189285 - DNA, 25 bp, Homo sapien
actgtcatgcccgtctctggaatgt

SEQ ID NO: 189286 - DNA, 25 bp, Homo sapien
gtcatgcccgtctctggaatgtcca

SEQ ID NO: 189287 - DNA, 25 bp, Homo sapien
catgcccgtctctggaatgtccact

SEQ ID NO: 189288 - DNA, 25 bp, Homo sapien
gtctctggaatgtccactcccagag

SEQ ID NO: 189289 - DNA, 25 bp, Homo sapien
tggaatgtccactcccagagcctgc

SEQ ID NO: 189290 - DNA, 25 bp, Homo sapien
gttaaaagatgcactaaacctgata

SEQ ID NO: 189291 - DNA, 25 bp, Homo sapien
gatgcactaaacctgatagaaaaga

SEQ ID NO: 189292 - DNA, 25 bp, Homo sapien
gccatggcaacagcaataggatttg

SEQ ID NO: 189293 - DNA, 25 bp, Homo sapien
aatgggattcattggcttctttgtg

SEQ ID NO: 189294 - DNA, 25 bp, Homo sapien
ggattcattggcttctttgtgaaat

SEQ ID NO: 189295 - DNA, 25 bp, Homo sapien
gtgaaattgatccatattcctatta

SEQ ID NO: 189296 - DNA, 25 bp, Homo sapien
gatccatattcctattaataacatc

SEQ ID NO: 189297 - DNA, 25 bp, Homo sapien
attaataacatcattgttggtggct

SEQ ID NO: 189298 - DNA, 25 bp, Homo sapien
cattgttggtggctgaatacatttt

SEQ ID NO: 189299 - DNA, 25 bp, Homo sapien
agagagtttttcatcttagagattg

SEQ ID NO: 189300 - DNA, 25 bp, Homo sapien
caaatttgcctgtatgttttgtggg

SEQ ID NO: 189301 - DNA, 25 bp, Homo sapien
ttctgggtttgtatcatgaccagag

SEQ ID NO: 189302 - DNA, 25 bp, Homo sapien
actatagggttggtttatactgcaa

SEQ ID NO: 189303 - DNA, 25 bp, Homo sapien
gcaatatagaggatcagaagccatt

SEQ ID NO: 189304 - DNA, 25 bp, Homo sapien
ggatcagaagccatttgatttggta

SEQ ID NO: 189305 - DNA, 25 bp, Homo sapien
gccatttgatttggtaggtgtgtca

SEQ ID NO: 189306 - DNA, 25 bp, Homo sapien
gaatgatggcagacgaactgctgga

SEQ ID NO: 189307 - DNA, 25 bp, Homo sapien
gatagccatgctaaaatgcaattat

SEQ ID NO: 189308 - DNA, 25 bp, Homo sapien
ttatatcctcatgtttatcccaaac

SEQ ID NO: 189309 - DNA, 25 bp, Homo sapien
atgtttatcccaaactaatcttgga

SEQ ID NO: 189310 - DNA, 25 bp, Homo sapien
gacttttccactcattagctttgtt

SEQ ID NO: 189311 - DNA, 25 bp, Homo sapien
actcattagctttgttttgcccttg

SEQ ID NO: 189312 - DNA, 25 bp, Homo sapien
aggatatgtgatggcgtccagtttg

SEQ ID NO: 189313 - DNA, 25 bp, Homo sapien
cagtttggagctgggataaggttcc

SEQ ID NO: 189314 - DNA, 25 bp, Homo sapien
tgccacacaccgtctctcgaggaaa

SEQ ID NO: 189315 - DNA, 25 bp, Homo sapien
acaccgtctctcgaggaaacgcggt

SEQ ID NO: 189316 - DNA, 25 bp, Homo sapien
gtctctcgaggaaacgcggttcagc

SEQ ID NO: 189317 - DNA, 25 bp, Homo sapien
gaggaaacgcggttcagcgattctt

SEQ ID NO: 189318 - DNA, 25 bp, Homo sapien
gaaacgcggttcagcgattctttga

SEQ ID NO: 189319 - DNA, 25 bp, Homo sapien
acgcggttcagcgattctttgactg

SEQ ID NO: 189320 - DNA, 25 bp, Homo sapien
gcggttcagcgattctttgactgcg

SEQ ID NO: 189321 - DNA, 25 bp, Homo sapien
ggttcagcgattctttgactgcgga

SEQ ID NO: 189322 - DNA, 25 bp, Homo sapien
ttcagcgattctttgactgcggacc

SEQ ID NO: 189323 - DNA, 25 bp, Homo sapien
ggaacctcagagaatctatgaataa

SEQ ID NO: 189324 - DNA, 25 bp, Homo sapien
tggaagcattaattgttttgaacat

SEQ ID NO: 189325 - DNA, 25 bp, Homo sapien
ataaatctgtcagccactacagcca

SEQ ID NO: 189326 - DNA, 25 bp, Homo sapien
gtcagccactacagccatcaaaaga

SEQ ID NO: 189327 - DNA, 25 bp, Homo sapien
aaagagagcatctggaagaacagcc

SEQ ID NO: 189328 - DNA, 25 bp, Homo sapien
gttttacagcaataatgttgcagtg

SEQ ID NO: 189329 - DNA, 25 bp, Homo sapien
ttatttgtagttaaggtcatcctcc

SEQ ID NO: 189330 - DNA, 25 bp, Homo sapien
ttgtagttaaggtcatcctcctccc

SEQ ID NO: 189331 - DNA, 25 bp, Homo sapien
ctctcttgggcttcagaagcatcta

SEQ ID NO: 189332 - DNA, 25 bp, Homo sapien
aagcatctaagaaaagcagtcatca

SEQ ID NO: 189333 - DNA, 25 bp, Homo sapien
aaagcagtcatcaattataattaac

SEQ ID NO: 189334 - DNA, 25 bp, Homo sapien
gatcatcaataggatttgctaattt

SEQ ID NO: 189335 - DNA, 25 bp, Homo sapien
aggatttgctaatttcagtgaagtc

SEQ ID NO: 189336 - DNA, 25 bp, Homo sapien
tttcagtgaagtcattttgcttcag

SEQ ID NO: 189337 - DNA, 25 bp, Homo sapien
taaattatcctagttaccaagtcct

SEQ ID NO: 189338 - DNA, 25 bp, Homo sapien
tatcctagttaccaagtcctatttg

SEQ ID NO: 189339 - DNA, 25 bp, Homo sapien
tcctagttaccaagtcctatttgga

SEQ ID NO: 189340 - DNA, 25 bp, Homo sapien
tggacataaagaaaatcctacttat

SEQ ID NO: 189341 - DNA, 25 bp, Homo sapien
aaatatgttcgtttatcatttcaga

SEQ ID NO: 189342 - DNA, 25 bp, Homo sapien
atgttcgtttatcatttcagaaatt

SEQ ID NO: 189343 - DNA, 25 bp, Homo sapien
acactggaaaattcctgaacaatat

SEQ ID NO: 189344 - DNA, 25 bp, Homo sapien
tcctgaacaatatagattttatcgt

SEQ ID NO: 189345 - DNA, 25 bp, Homo sapien
tacttcagtccaaaatccaactcgc

SEQ ID NO: 189346 - DNA, 25 bp, Homo sapien
tcgcctccgagaagcatccaaaagc

SEQ ID NO: 189347 - DNA, 25 bp, Homo sapien
acccaatgtgaatgtctgtagtcag

SEQ ID NO: 189348 - DNA, 25 bp, Homo sapien
gtcagttgtttacaaactccctctc

SEQ ID NO: 189349 - DNA, 25 bp, Homo sapien
tccctctcctgcacaattcatttag

SEQ ID NO: 189350 - DNA, 25 bp, Homo sapien
gcacaattcatttagaggcttcaat

SEQ ID NO: 189351 - DNA, 25 bp, Homo sapien
gaggcttcaatcatagaattctgca

SEQ ID NO: 189352 - DNA, 25 bp, Homo sapien
gacaactcatgccttaattttgtat

SEQ ID NO: 189353 - DNA, 25 bp, Homo sapien
gaatgtacacgcatgctgaagctaa

SEQ ID NO: 189354 - DNA, 25 bp, Homo sapien
aggcaaatcttactatactatgaaa

SEQ ID NO: 189355 - DNA, 25 bp, Homo sapien
atgaaaagcattaccttgcctattt

SEQ ID NO: 189356 - DNA, 25 bp, Homo sapien
gtattgttgtcaaagaaaagcttgg

SEQ ID NO: 189357 - DNA, 25 bp, Homo sapien
tattcagtcttttaggtgatacacc

SEQ ID NO: 189358 - DNA, 25 bp, Homo sapien
cagtcttttaggtgatacaccagag

SEQ ID NO: 189359 - DNA, 25 bp, Homo sapien
gggctgggaattgtctctttgttcc

SEQ ID NO: 189360 - DNA, 25 bp, Homo sapien
gggaattgtctctttgttcctataa

SEQ ID NO: 189361 - DNA, 25 bp, Homo sapien
gtctctttgttcctataagtagatc

SEQ ID NO: 189362 - DNA, 25 bp, Homo sapien
aatacagcctgtgctaattgggagc

SEQ ID NO: 189363 - DNA, 25 bp, Homo sapien
tacagcctgtgctaattgggagcac

SEQ ID NO: 189364 - DNA, 25 bp, Homo sapien
gagtaacttttgagcaagtaattct

SEQ ID NO: 189365 - DNA, 25 bp, Homo sapien
aagtaattctaagctttgtcttgta

SEQ ID NO: 189366 - DNA, 25 bp, Homo sapien
aattctaagctttgtcttgtatcct

SEQ ID NO: 189367 - DNA, 25 bp, Homo sapien
tccccagcgtcacttctgctaagga

SEQ ID NO: 189368 - DNA, 25 bp, Homo sapien
cccagcgtcacttctgctaaggagg

SEQ ID NO: 189369 - DNA, 25 bp, Homo sapien
cagcgtcacttctgctaaggaggga

SEQ ID NO: 189370 - DNA, 25 bp, Homo sapien
gcgtcacttctgctaaggagggacc

SEQ ID NO: 189371 - DNA, 25 bp, Homo sapien
tcacttctgctaaggagggacccgt

SEQ ID NO: 189372 - DNA, 25 bp, Homo sapien
acttctgctaaggagggacccgtgt

SEQ ID NO: 189373 - DNA, 25 bp, Homo sapien
cttctgctaaggagggacccgtgtt

SEQ ID NO: 189374 - DNA, 25 bp, Homo sapien
tgctaaggagggacccgtgttgccc

SEQ ID NO: 189375 - DNA, 25 bp, Homo sapien
gagggacccgtgttgccccaccagg

SEQ ID NO: 189376 - DNA, 25 bp, Homo sapien
gtgttgccccaccaggcaagaatag

SEQ ID NO: 189377 - DNA, 25 bp, Homo sapien
gttgccccaccaggcaagaatagtc

SEQ ID NO: 189378 - DNA, 25 bp, Homo sapien
aagatattctgtgcccgacagaact

SEQ ID NO: 189379 - DNA, 25 bp, Homo sapien
cgacagaactgcagccatgactggg

SEQ ID NO: 189380 - DNA, 25 bp, Homo sapien
gggaatccatgtgaagtacaagaca

SEQ ID NO: 189381 - DNA, 25 bp, Homo sapien
gtggaggatattgcaactggagttc

SEQ ID NO: 189382 - DNA, 25 bp, Homo sapien
actggagttcagacactgtactcga

SEQ ID NO: 189383 - DNA, 25 bp, Homo sapien
gtactcgaagtggaaggactttcat

SEQ ID NO: 189384 - DNA, 25 bp, Homo sapien
tttgagaagataccatttgatccag

SEQ ID NO: 189385 - DNA, 25 bp, Homo sapien
tgatccagcagaaatgtccaaatga

SEQ ID NO: 189386 - DNA, 25 bp, Homo sapien
gtccaaatgatatcaggtcctcaat

SEQ ID NO: 189387 - DNA, 25 bp, Homo sapien
ggtcctcaatcttcagctacaggga

SEQ ID NO: 189388 - DNA, 25 bp, Homo sapien
ataatcatggatcgcttgtacccct

SEQ ID NO: 189389 - DNA, 25 bp, Homo sapien
attattctctgtatataactgagga

SEQ ID NO: 189390 - DNA, 25 bp, Homo sapien
ataagaatagtcctacaaagagaaa

SEQ ID NO: 189391 - DNA, 25 bp, Homo sapien
gaaaaatatacatgtcaccgaagca

SEQ ID NO: 189392 - DNA, 25 bp, Homo sapien
atgtcaccgaagcaagtgtaccctt

SEQ ID NO: 189393 - DNA, 25 bp, Homo sapien
tcaccgaagcaagtgtaccctttat

SEQ ID NO: 189394 - DNA, 25 bp, Homo sapien
gaagcaagtgtaccctttataggaa

SEQ ID NO: 189395 - DNA, 25 bp, Homo sapien
gtcttttaatggatgagagggaacc

SEQ ID NO: 189396 - DNA, 25 bp, Homo sapien
atggatgagagggaaccactataac

SEQ ID NO: 189397 - DNA, 25 bp, Homo sapien
aaccactataacatgagtccaagcc

SEQ ID NO: 189398 - DNA, 25 bp, Homo sapien
tataacatgagtccaagcccagaag

SEQ ID NO: 189399 - DNA, 25 bp, Homo sapien
ccagaagacttctgtctatacaata

SEQ ID NO: 189400 - DNA, 25 bp, Homo sapien
aggagccaagaacagccagataaaa

SEQ ID NO: 189401 - DNA, 25 bp, Homo sapien
gatataagtgatttggccaccaaac

SEQ ID NO: 189402 - DNA, 25 bp, Homo sapien
tcctggacagttggaaagacctaaa

SEQ ID NO: 189403 - DNA, 25 bp, Homo sapien
ggaaaacacaagaaatcagcctgaa

SEQ ID NO: 189404 - DNA, 25 bp, Homo sapien
ggaatgacttgtctgcctcacatat

SEQ ID NO: 189405 - DNA, 25 bp, Homo sapien
tgcctcacatattctaaggtgcaga

SEQ ID NO: 189406 - DNA, 25 bp, Homo sapien
gtgcagagtcagaatatgaactgtt

SEQ ID NO: 189407 - DNA, 25 bp, Homo sapien
tgaactgttgcaactgaacgaggaa

SEQ ID NO: 189408 - DNA, 25 bp, Homo sapien
gctgttggcttcagagatcaaacac

SEQ ID NO: 189409 - DNA, 25 bp, Homo sapien
agagatcaaacacctgccccgaaga

SEQ ID NO: 189410 - DNA, 25 bp, Homo sapien
cctgccccgaagactcctaataggt

SEQ ID NO: 189411 - DNA, 25 bp, Homo sapien
aagaactcctagtactctgaccagc

SEQ ID NO: 189412 - DNA, 25 bp, Homo sapien
gagaagcagcactcttaggcttgct

SEQ ID NO: 189413 - DNA, 25 bp, Homo sapien
actcttaggcttgcttactctacaa

SEQ ID NO: 189414 - DNA, 25 bp, Homo sapien
ttgcttactctacaagggacagttg

SEQ ID NO: 189415 - DNA, 25 bp, Homo sapien
agggacagttgcatttgttgagact

SEQ ID NO: 189416 - DNA, 25 bp, Homo sapien
aagatgtgatcctggctgacttact

SEQ ID NO: 189417 - DNA, 25 bp, Homo sapien
acttactgccttccttggctgttta

SEQ ID NO: 189418 - DNA, 25 bp, Homo sapien
tggctgtttatcttcgaactctggc

SEQ ID NO: 189419 - DNA, 25 bp, Homo sapien
ttatcttcgaactctggctcctggg

SEQ ID NO: 189420 - DNA, 25 bp, Homo sapien
ctccagggccagaaaagagcggaaa

SEQ ID NO: 189421 - DNA, 25 bp, Homo sapien
gagcggaaatccaagaactcctagt

SEQ ID NO: 189422 - DNA, 25 bp, Homo sapien
gtcccaaagagtttgatgaggccct

SEQ ID NO: 189423 - DNA, 25 bp, Homo sapien
aaagagtttgatgaggccctccaca

SEQ ID NO: 189424 - DNA, 25 bp, Homo sapien
ttgatgaggccctccacacctgcgg

SEQ ID NO: 189425 - DNA, 25 bp, Homo sapien
acacctgcggcccaatccaaggtgg

SEQ ID NO: 189426 - DNA, 25 bp, Homo sapien
acctggacccctgcattggaactgg

SEQ ID NO: 189427 - DNA, 25 bp, Homo sapien
ctggacccctgcattggaactggag

SEQ ID NO: 189428 - DNA, 25 bp, Homo sapien
gacccctgcattggaactggaggca

SEQ ID NO: 189429 - DNA, 25 bp, Homo sapien
gagggtcggtgccttcaagaaaaca

SEQ ID NO: 189430 - DNA, 25 bp, Homo sapien
agaaaacaggcactgccctggtggc

SEQ ID NO: 189431 - DNA, 25 bp, Homo sapien
caggaaggagctgcctggacccgtt

SEQ ID NO: 189432 - DNA, 25 bp, Homo sapien
aggagctgcctggacccgttcatgg

SEQ ID NO: 189433 - DNA, 25 bp, Homo sapien
aataccagctgttctaagaacagag

SEQ ID NO: 189434 - DNA, 25 bp, Homo sapien
aagaacagagggagaaccactgcac

SEQ ID NO: 189435 - DNA, 25 bp, Homo sapien
gaaccactgcacacaccaagtgttg

SEQ ID NO: 189436 - DNA, 25 bp, Homo sapien
actgcacacaccaagtgttggtatg

SEQ ID NO: 189437 - DNA, 25 bp, Homo sapien
caccaagtgttggtatgagggaaac

SEQ ID NO: 189438 - DNA, 25 bp, Homo sapien
acatagtgaggcctccaacattgaa

SEQ ID NO: 189439 - DNA, 25 bp, Homo sapien
gaggcctccaacattgaataaaact

SEQ ID NO: 189440 - DNA, 25 bp, Homo sapien
agtttgcatcaaactagatgtattt

SEQ ID NO: 189441 - DNA, 25 bp, Homo sapien
gttaccacccttgaaacaattagct

SEQ ID NO: 189442 - DNA, 25 bp, Homo sapien
gctttttctttaggactgacctgtt

SEQ ID NO: 189443 - DNA, 25 bp, Homo sapien
tttctttaggactgacctgttaggg

SEQ ID NO: 189444 - DNA, 25 bp, Homo sapien
gccaagaacagccagataaaacagt

SEQ ID NO: 189445 - DNA, 25 bp, Homo sapien
gccagataaaacagtggatataagt

SEQ ID NO: 189446 - DNA, 25 bp, Homo sapien
ggatataagtgatttggccaccaaa

SEQ ID NO: 189447 - DNA, 25 bp, Homo sapien
tataagtgatttggccaccaaactc

SEQ ID NO: 189448 - DNA, 25 bp, Homo sapien
cctaaaggaggtatatcgaattcca

SEQ ID NO: 189449 - DNA, 25 bp, Homo sapien
gaggtatatcgaattccaaagaaaa

SEQ ID NO: 189450 - DNA, 25 bp, Homo sapien
caactgaacgaggaagggatgctgt

SEQ ID NO: 189451 - DNA, 25 bp, Homo sapien
gctgttggcttcagagatcaaacac

SEQ ID NO: 189452 - DNA, 25 bp, Homo sapien
ggcttcagagatcaaacacctgccc

SEQ ID NO: 189453 - DNA, 25 bp, Homo sapien
agagatcaaacacctgccccgaaga

SEQ ID NO: 189454 - DNA, 25 bp, Homo sapien
cctgccccgaagactcctaataggt

SEQ ID NO: 189455 - DNA, 25 bp, Homo sapien
aacaatcaggtttcttcaggctgag

SEQ ID NO: 189456 - DNA, 25 bp, Homo sapien
aggaggacttgctcaggccgattcc

SEQ ID NO: 189457 - DNA, 25 bp, Homo sapien
ggccgattccaaacattgtgctcgt

SEQ ID NO: 189458 - DNA, 25 bp, Homo sapien
ttgtgctcgttcaatgcgtagaaat

SEQ ID NO: 189459 - DNA, 25 bp, Homo sapien
gatggcatgccgtgatcagaagtca

SEQ ID NO: 189460 - DNA, 25 bp, Homo sapien
atgcatgagatccatacaccacagg

SEQ ID NO: 189461 - DNA, 25 bp, Homo sapien
gacactactaatctagtcccttgca

SEQ ID NO: 189462 - DNA, 25 bp, Homo sapien
cctgcaccgttcactgtatttggag

SEQ ID NO: 189463 - DNA, 25 bp, Homo sapien
aagagttccataccgggctacaatt

SEQ ID NO: 189464 - DNA, 25 bp, Homo sapien
ccgggctacaattctttgagttctt

SEQ ID NO: 189465 - DNA, 25 bp, Homo sapien
taaaagtccttcatacaccttctgg

SEQ ID NO: 189466 - DNA, 25 bp, Homo sapien
aaatcttatctagaattgtaatcag

SEQ ID NO: 189467 - DNA, 25 bp, Homo sapien
aatcttatctagaattgtaatcaga

SEQ ID NO: 189468 - DNA, 25 bp, Homo sapien
atcttatctagaattgtaatcagaa

SEQ ID NO: 189469 - DNA, 25 bp, Homo sapien
tcttatctagaattgtaatcagaat

SEQ ID NO: 189470 - DNA, 25 bp, Homo sapien
cttatctagaattgtaatcagaatt

SEQ ID NO: 189471 - DNA, 25 bp, Homo sapien
ttatctagaattgtaatcagaatta

SEQ ID NO: 189472 - DNA, 25 bp, Homo sapien
tatctagaattgtaatcagaattat

SEQ ID NO: 189473 - DNA, 25 bp, Homo sapien
atctagaattgtaatcagaattata

SEQ ID NO: 189474 - DNA, 25 bp, Homo sapien
gtggtggtttcccctgctcttctct

SEQ ID NO: 189475 - DNA, 25 bp, Homo sapien
tggtggtttcccctgctcttctctc

SEQ ID NO: 189476 - DNA, 25 bp, Homo sapien
ggtggtttcccctgctcttctctct

SEQ ID NO: 189477 - DNA, 25 bp, Homo sapien
ggaattactactggatccctaacat

SEQ ID NO: 189478 - DNA, 25 bp, Homo sapien
atccctaacatataagatctgcttt

SEQ ID NO: 189479 - DNA, 25 bp, Homo sapien
taaactttggacttggagttgtcaa

SEQ ID NO: 189480 - DNA, 25 bp, Homo sapien
aatacatttgatgcttaccacacat

SEQ ID NO: 189481 - DNA, 25 bp, Homo sapien
taatgttgactattccttctgctga

SEQ ID NO: 189482 - DNA, 25 bp, Homo sapien
gactattccttctgctgatttcaat

SEQ ID NO: 189483 - DNA, 25 bp, Homo sapien
cttctgctgatttcaatttgaggat

SEQ ID NO: 189484 - DNA, 25 bp, Homo sapien
caccagattaacttttctgttggga

SEQ ID NO: 189485 - DNA, 25 bp, Homo sapien
gggatcattgatttatctaccttgt

SEQ ID NO: 189486 - DNA, 25 bp, Homo sapien
tatctaccttgtcatttagagcagg

SEQ ID NO: 189487 - DNA, 25 bp, Homo sapien
atttagagcaggtcagcggactata

SEQ ID NO: 189488 - DNA, 25 bp, Homo sapien
gagtttgaaaccgtcatacctcctt

SEQ ID NO: 189489 - DNA, 25 bp, Homo sapien
ccgtcatacctccttctattaggaa

SEQ ID NO: 189490 - DNA, 25 bp, Homo sapien
aatggcatatactgaggtggtcgta

SEQ ID NO: 189491 - DNA, 25 bp, Homo sapien
gaggtggtcgtaagtcttaacttct

SEQ ID NO: 189492 - DNA, 25 bp, Homo sapien
gggcgcatgtgcaccacagagtgca

SEQ ID NO: 189493 - DNA, 25 bp, Homo sapien
gggactttcagtcacaggatttcat

SEQ ID NO: 189494 - DNA, 25 bp, Homo sapien
aggatttcataattgtcattgtcac

SEQ ID NO: 189495 - DNA, 25 bp, Homo sapien
gtcattgtcacactttcaaattttt

SEQ ID NO: 189496 - DNA, 25 bp, Homo sapien
agcccccagtgtttgtattttgaag

SEQ ID NO: 189497 - DNA, 25 bp, Homo sapien
cacttctaaagtgcctacagagact

SEQ ID NO: 189498 - DNA, 25 bp, Homo sapien
tgcagctctgcacgagtttgaaacc

SEQ ID NO: 189499 - DNA, 25 bp, Homo sapien
gggtcccaaagagtttgatgaggcc

SEQ ID NO: 189500 - DNA, 25 bp, Homo sapien
gtcccaaagagtttgatgaggccct

SEQ ID NO: 189501 - DNA, 25 bp, Homo sapien
tcccaaagagtttgatgaggccctc

SEQ ID NO: 189502 - DNA, 25 bp, Homo sapien
ccaaagagtttgatgaggccctcca

SEQ ID NO: 189503 - DNA, 25 bp, Homo sapien
caaagagtttgatgaggccctccac

SEQ ID NO: 189504 - DNA, 25 bp, Homo sapien
aaagagtttgatgaggccctccaca

SEQ ID NO: 189505 - DNA, 25 bp, Homo sapien
aagagtttgatgaggccctccacac

SEQ ID NO: 189506 - DNA, 25 bp, Homo sapien
agagtttgatgaggccctccacacc

SEQ ID NO: 189507 - DNA, 25 bp, Homo sapien
agtttgatgaggccctccacacctg

SEQ ID NO: 189508 - DNA, 25 bp, Homo sapien
acacctgcggcccaatccaaggtgg

SEQ ID NO: 189509 - DNA, 25 bp, Homo sapien
cacctgcggcccaatccaaggtggg

SEQ ID NO: 189510 - DNA, 25 bp, Homo sapien
tatctaaaacttttatactgcactt

SEQ ID NO: 189511 - DNA, 25 bp, Homo sapien
aggaaaagggcatttgtctaaacat

SEQ ID NO: 189512 - DNA, 25 bp, Homo sapien
ggcatttgtctaaacatggattctg

SEQ ID NO: 189513 - DNA, 25 bp, Homo sapien
gattctgagttgtatatatttccta

SEQ ID NO: 189514 - DNA, 25 bp, Homo sapien
tatttcctatcattctaaaaaagtg

SEQ ID NO: 189515 - DNA, 25 bp, Homo sapien
gaatttgtgaagcaaagttttgcca

SEQ ID NO: 189516 - DNA, 25 bp, Homo sapien
gttttgccagatgttaaactttgaa

SEQ ID NO: 189517 - DNA, 25 bp, Homo sapien
aatattgtccattaactagttcata

SEQ ID NO: 189518 - DNA, 25 bp, Homo sapien
gtccattaactagttcatagatttt

SEQ ID NO: 189519 - DNA, 25 bp, Homo sapien
aaatacttctgactgttaaaactat

SEQ ID NO: 189520 - DNA, 25 bp, Homo sapien
gaaaatctcatttgtctaattgcaa

SEQ ID NO: 189521 - DNA, 25 bp, Homo sapien
gccagtgcctgaaacgcatccgcta

SEQ ID NO: 189522 - DNA, 25 bp, Homo sapien
aaacgcatccgctaccatggcagag

SEQ ID NO: 189523 - DNA, 25 bp, Homo sapien
cgctaccatggcagaggtcgctttg

SEQ ID NO: 189524 - DNA, 25 bp, Homo sapien
agaggtcgctttgggatcatggaga

SEQ ID NO: 189525 - DNA, 25 bp, Homo sapien
cattattttgtgaagttggtggaag

SEQ ID NO: 189526 - DNA, 25 bp, Homo sapien
tgagccaccaaagacggcagttgcc

SEQ ID NO: 189527 - DNA, 25 bp, Homo sapien
aaagacggcagttgcccatgccaaa

SEQ ID NO: 189528 - DNA, 25 bp, Homo sapien
gcagttgcccatgccaaagagtata

SEQ ID NO: 189529 - DNA, 25 bp, Homo sapien
tgcccatgccaaagagtatattcag

SEQ ID NO: 189530 - DNA, 25 bp, Homo sapien
ggaccatcgttcacactctatgatg

SEQ ID NO: 189531 - DNA, 25 bp, Homo sapien
ctctatgatgaggagattcagactc

SEQ ID NO: 189532 - DNA, 25 bp, Homo sapien
tgttaaacattttgttcctacaggt

SEQ ID NO: 189533 - DNA, 25 bp, Homo sapien
caggttaaaatatctgctgcctatt

SEQ ID NO: 189534 - DNA, 25 bp, Homo sapien
gctgcctattaggttcttctgtgac

SEQ ID NO: 189535 - DNA, 25 bp, Homo sapien
gtgacatgtgcctcccagcagtgaa

SEQ ID NO: 189536 - DNA, 25 bp, Homo sapien
gcagtgaactaaatttgtcgacata

SEQ ID NO: 189537 - DNA, 25 bp, Homo sapien
tgtcgacataaactggattgctaaa

SEQ ID NO: 189538 - DNA, 25 bp, Homo sapien
actggattgctaaactatgctaaat

SEQ ID NO: 189539 - DNA, 25 bp, Homo sapien
tttcttatttatttgcctctgaagg

SEQ ID NO: 189540 - DNA, 25 bp, Homo sapien
ggaaggttggcctgaagaactgaaa

SEQ ID NO: 189541 - DNA, 25 bp, Homo sapien
gaacctcttattttgcaagacaggc

SEQ ID NO: 189542 - DNA, 25 bp, Homo sapien
gacaggcccaagcatgtaatacttt

SEQ ID NO: 189543 - DNA, 25 bp, Homo sapien
tcttggtgctgtatttgaaacgggt

SEQ ID NO: 189544 - DNA, 25 bp, Homo sapien
ttgaaacgggtgtagagagaagctt

SEQ ID NO: 189545 - DNA, 25 bp, Homo sapien
ccaggcagtggcacgtggcatcgca

SEQ ID NO: 189546 - DNA, 25 bp, Homo sapien
cgcatggtgggctcggcagcacctt

SEQ ID NO: 189547 - DNA, 25 bp, Homo sapien
cagcaccttgcctgtgtttctgtga

SEQ ID NO: 189548 - DNA, 25 bp, Homo sapien
accttgcctgtgtttctgtgaggga

SEQ ID NO: 189549 - DNA, 25 bp, Homo sapien
gtatggatgttactgagcactacac

SEQ ID NO: 189550 - DNA, 25 bp, Homo sapien
tgagcactacacatgatccttctgt

SEQ ID NO: 189551 - DNA, 25 bp, Homo sapien
acatgatccttctgtgcttgcttgc

SEQ ID NO: 189552 - DNA, 25 bp, Homo sapien
ctgtgcttgcttgcatctttaataa

SEQ ID NO: 189553 - DNA, 25 bp, Homo sapien
taataaagacatgttcccggcaaaa

SEQ ID NO: 189554 - DNA, 25 bp, Homo sapien
atagccccatcttgtggtaacttgc

SEQ ID NO: 189555 - DNA, 25 bp, Homo sapien
tgtggtaacttgctgcttctgcact

SEQ ID NO: 189556 - DNA, 25 bp, Homo sapien
gcttctgcacttcatatccatattt

SEQ ID NO: 189557 - DNA, 25 bp, Homo sapien
atccatatttcctattgttcacttt

SEQ ID NO: 189558 - DNA, 25 bp, Homo sapien
gttcactttattctgtagagcagcc

SEQ ID NO: 189559 - DNA, 25 bp, Homo sapien
aaagtccacataaccctagaattct

SEQ ID NO: 189560 - DNA, 25 bp, Homo sapien
caagtcagcctagagaccatgttga

SEQ ID NO: 189561 - DNA, 25 bp, Homo sapien
gagaccatgttgactttcctcatgt

SEQ ID NO: 189562 - DNA, 25 bp, Homo sapien
catgtgtttccttatgactcagtaa

SEQ ID NO: 189563 - DNA, 25 bp, Homo sapien
tgactcagtaagttggcaaggtcct

SEQ ID NO: 189564 - DNA, 25 bp, Homo sapien
ggcaaggtcctgactttagtcttaa

SEQ ID NO: 189565 - DNA, 25 bp, Homo sapien
cttggcgcttgaaaatgcagtagtg

SEQ ID NO: 189566 - DNA, 25 bp, Homo sapien
agtgaatgtggaaccaagcctgtct

SEQ ID NO: 189567 - DNA, 25 bp, Homo sapien
gcctgtctgtatatctggtagctcc

SEQ ID NO: 189568 - DNA, 25 bp, Homo sapien
tgttttttcttaccagtattctgcc

SEQ ID NO: 189569 - DNA, 25 bp, Homo sapien
agtattctgcctaacgtttgcttct

SEQ ID NO: 189570 - DNA, 25 bp, Homo sapien
tctgcctaacgtttgcttctgtgat

SEQ ID NO: 189571 - DNA, 25 bp, Homo sapien
gtgatggttatattgcctagcaagc

SEQ ID NO: 189572 - DNA, 25 bp, Homo sapien
ctagcaagcacacccgtggttgtga

SEQ ID NO: 189573 - DNA, 25 bp, Homo sapien
aatccccggttattgatgtactaga

SEQ ID NO: 189574 - DNA, 25 bp, Homo sapien
gtgtatgtcttttaaacagttctag

SEQ ID NO: 189575 - DNA, 25 bp, Homo sapien
acagttctagtttcaccttacacag

SEQ ID NO: 189576 - DNA, 25 bp, Homo sapien
tgtgaatatgagtatgccagctgca

SEQ ID NO: 189577 - DNA, 25 bp, Homo sapien
gtgaatatgagtatgccagctgcat

SEQ ID NO: 189578 - DNA, 25 bp, Homo sapien
ttagaccttttgaagtctgtataaa

SEQ ID NO: 189579 - DNA, 25 bp, Homo sapien
gaccttttgaagtctgtataaactt

SEQ ID NO: 189580 - DNA, 25 bp, Homo sapien
gaagtctgtataaacttgttttgaa

SEQ ID NO: 189581 - DNA, 25 bp, Homo sapien
attctttcatggtttctgcaatgag

SEQ ID NO: 189582 - DNA, 25 bp, Homo sapien
tctttcatggtttctgcaatgagag

SEQ ID NO: 189583 - DNA, 25 bp, Homo sapien
tttcatggtttctgcaatgagagga

SEQ ID NO: 189584 - DNA, 25 bp, Homo sapien
catggtttctgcaatgagaggaagt

SEQ ID NO: 189585 - DNA, 25 bp, Homo sapien
ggtttctgcaatgagaggaagtgta

SEQ ID NO: 189586 - DNA, 25 bp, Homo sapien
ctgcaatgagaggaagtgtaatgat

SEQ ID NO: 189587 - DNA, 25 bp, Homo sapien
attgtctgaggcagcaatctttggc

SEQ ID NO: 189588 - DNA, 25 bp, Homo sapien
agcaatctttggcatctacaggtgg

SEQ ID NO: 189589 - DNA, 25 bp, Homo sapien
tttggcatctacaggtggcagcagc

SEQ ID NO: 189590 - DNA, 25 bp, Homo sapien
ttcaccagggctccatctgtgaaga

SEQ ID NO: 189591 - DNA, 25 bp, Homo sapien
agggctccatctgtgaagagtctca

SEQ ID NO: 189592 - DNA, 25 bp, Homo sapien
gagtctcagccatgactttgagctg

SEQ ID NO: 189593 - DNA, 25 bp, Homo sapien
gccatgactttgagctgagcttggg

SEQ ID NO: 189594 - DNA, 25 bp, Homo sapien
aaagcaactgttaaggccagccctt

SEQ ID NO: 189595 - DNA, 25 bp, Homo sapien
gcccctcagacctgccatgaaagga

SEQ ID NO: 189596 - DNA, 25 bp, Homo sapien
aaggaatgagccctagactgactcc

SEQ ID NO: 189597 - DNA, 25 bp, Homo sapien
aggctgggaccagctgtttgtctcc

SEQ ID NO: 189598 - DNA, 25 bp, Homo sapien
gaagaattgggcctgtgctgatcca

SEQ ID NO: 189599 - DNA, 25 bp, Homo sapien
agaattgggcctgtgctgatccagg

SEQ ID NO: 189600 - DNA, 25 bp, Homo sapien
tgtgctgatccaggaaggttttatt

SEQ ID NO: 189601 - DNA, 25 bp, Homo sapien
ctgatccaggaaggttttattgttt

SEQ ID NO: 189602 - DNA, 25 bp, Homo sapien
tgttttttgtatttactcgtgacta

SEQ ID NO: 189603 - DNA, 25 bp, Homo sapien
tttactcgtgactaaattttattca

SEQ ID NO: 189604 - DNA, 25 bp, Homo sapien
tatttgaaataagactactttccct

SEQ ID NO: 189605 - DNA, 25 bp, Homo sapien
aaattctaaatgtgatctttgccat

SEQ ID NO: 189606 - DNA, 25 bp, Homo sapien
ttcatcacatataactcacagtttc

SEQ ID NO: 189607 - DNA, 25 bp, Homo sapien
cacatataactcacagtttcatttt

SEQ ID NO: 189608 - DNA, 25 bp, Homo sapien
ttttgcattgttggattagacttaa

SEQ ID NO: 189609 - DNA, 25 bp, Homo sapien
gtaaatcgaggtgccattattcttt

SEQ ID NO: 189610 - DNA, 25 bp, Homo sapien
gaggtgccattattctttctagcct

SEQ ID NO: 189611 - DNA, 25 bp, Homo sapien
attattctttctagcctcctccaga

SEQ ID NO: 189612 - DNA, 25 bp, Homo sapien
cctccagagttgtgacctggaagtt

SEQ ID NO: 189613 - DNA, 25 bp, Homo sapien
acctggaagttgcaaacaaagtcaa

SEQ ID NO: 189614 - DNA, 25 bp, Homo sapien
aacaaagtcaaagctgcactgaaaa

SEQ ID NO: 189615 - DNA, 25 bp, Homo sapien
tgaaaagcttgattcctacactgga

SEQ ID NO: 189616 - DNA, 25 bp, Homo sapien
aaccaaaagcaccagcaaaggaata

SEQ ID NO: 189617 - DNA, 25 bp, Homo sapien
attctacttgaaaaactgagcacat

SEQ ID NO: 189618 - DNA, 25 bp, Homo sapien
tctgttctgtttcccaatgcagaaa

SEQ ID NO: 189619 - DNA, 25 bp, Homo sapien
gggtagggtccaccatactggtaat

SEQ ID NO: 189620 - DNA, 25 bp, Homo sapien
gacaagctgaagaagttcacagaat

SEQ ID NO: 189621 - DNA, 25 bp, Homo sapien
agttcacagaatgggtcttcaacac

SEQ ID NO: 189622 - DNA, 25 bp, Homo sapien
tgggtcttcaacaccatagacatga

SEQ ID NO: 189623 - DNA, 25 bp, Homo sapien
aacaccatagacatgagctagggaa

SEQ ID NO: 189624 - DNA, 25 bp, Homo sapien
aggacaggagaagggcccagacact

SEQ ID NO: 189625 - DNA, 25 bp, Homo sapien
agtgagtgtcctgcagcccttattc

SEQ ID NO: 189626 - DNA, 25 bp, Homo sapien
gcccttattccctccatagaaagca

SEQ ID NO: 189627 - DNA, 25 bp, Homo sapien
atagaaagcatcctcagagcacctt

SEQ ID NO: 189628 - DNA, 25 bp, Homo sapien
gagtgcacaacacaatagttgcaga

SEQ ID NO: 189629 - DNA, 25 bp, Homo sapien
gttgcagatcaacaatcatcacctg

SEQ ID NO: 189630 - DNA, 25 bp, Homo sapien
atcatcacctgccttttgtagaaaa

SEQ ID NO: 189631 - DNA, 25 bp, Homo sapien
ttgtttaatttgagccattcaatct

SEQ ID NO: 189632 - DNA, 25 bp, Homo sapien
tgagccattcaatctaaaccaatgt

SEQ ID NO: 189633 - DNA, 25 bp, Homo sapien
ttagttatttttcccaacacagtgt

SEQ ID NO: 189634 - DNA, 25 bp, Homo sapien
agttttgatgttgcagctttgctca

SEQ ID NO: 189635 - DNA, 25 bp, Homo sapien
ttgatgttgcagctttgctcacttc

SEQ ID NO: 189636 - DNA, 25 bp, Homo sapien
tgttgcagctttgctcacttcctgg

SEQ ID NO: 189637 - DNA, 25 bp, Homo sapien
tggcaagggcaggtcatgcctcaat

SEQ ID NO: 189638 - DNA, 25 bp, Homo sapien
ggcaggtcatgcctcaatttgtaat

SEQ ID NO: 189639 - DNA, 25 bp, Homo sapien
atgcctcaatttgtaatgggagtct

SEQ ID NO: 189640 - DNA, 25 bp, Homo sapien
gttgttatctttaaatacatgtaca

SEQ ID NO: 189641 - DNA, 25 bp, Homo sapien
tacatgtacaaatcgttgtcaaaag

SEQ ID NO: 189642 - DNA, 25 bp, Homo sapien
aaactagctttagagtaaggatgag

SEQ ID NO: 189643 - DNA, 25 bp, Homo sapien
agataaaagcctgtgttttacacat

SEQ ID NO: 189644 - DNA, 25 bp, Homo sapien
aaaagcctgtgttttacacattctt

SEQ ID NO: 189645 - DNA, 25 bp, Homo sapien
tttttggtgttcatagcttcttctc

SEQ ID NO: 189646 - DNA, 25 bp, Homo sapien
tggtgttcatagcttcttctcatac

SEQ ID NO: 189647 - DNA, 25 bp, Homo sapien
gttcatagcttcttctcatacaggt

SEQ ID NO: 189648 - DNA, 25 bp, Homo sapien
atagcttcttctcatacaggtgcca

SEQ ID NO: 189649 - DNA, 25 bp, Homo sapien
ttcttctcatacaggtgccagacac

SEQ ID NO: 189650 - DNA, 25 bp, Homo sapien
gtgccagacactgtttgtgcttttg

SEQ ID NO: 189651 - DNA, 25 bp, Homo sapien
gacactgtttgtgcttttgatggat

SEQ ID NO: 189652 - DNA, 25 bp, Homo sapien
ttttactttgagtggaatgttcatt

SEQ ID NO: 189653 - DNA, 25 bp, Homo sapien
cgctcaccggagaccatgatcaagt

SEQ ID NO: 189654 - DNA, 25 bp, Homo sapien
ggagaccatgatcaagtggactcgt

SEQ ID NO: 189655 - DNA, 25 bp, Homo sapien
ccatgatcaagtggactcgtgagaa

SEQ ID NO: 189656 - DNA, 25 bp, Homo sapien
tgctggcgcccgagagggaaggagc

SEQ ID NO: 189657 - DNA, 25 bp, Homo sapien
tccaaggccgccagctgtgatgcat

SEQ ID NO: 189658 - DNA, 25 bp, Homo sapien
aaggccgccagctgtgatgcatcct

SEQ ID NO: 189659 - DNA, 25 bp, Homo sapien
agctgtgatgcatcctcccggcctg

SEQ ID NO: 189660 - DNA, 25 bp, Homo sapien
ccctgatgctgctgtcagagaagga

SEQ ID NO: 189661 - DNA, 25 bp, Homo sapien
gtcagagaaggacactgcgtcccca

SEQ ID NO: 189662 - DNA, 25 bp, Homo sapien
agagaaggacactgcgtccccacgg

SEQ ID NO: 189663 - DNA, 25 bp, Homo sapien
gtcccccacgtgtactgtagagttt

SEQ ID NO: 189664 - DNA, 25 bp, Homo sapien
accactcctgtcagcaagtgctcag

SEQ ID NO: 189665 - DNA, 25 bp, Homo sapien
ctgtcagcaagtgctcagagcaggt

SEQ ID NO: 189666 - DNA, 25 bp, Homo sapien
acagattgtccgtgggagggctcca

SEQ ID NO: 189667 - DNA, 25 bp, Homo sapien
ggcccccatgaatgtcctcggaagg

SEQ ID NO: 189668 - DNA, 25 bp, Homo sapien
gggtggctcctggtagcatcctttt

SEQ ID NO: 189669 - DNA, 25 bp, Homo sapien
tggtagcatccttttccttcaccat

SEQ ID NO: 189670 - DNA, 25 bp, Homo sapien
ttttccttcaccatctatgggatat

SEQ ID NO: 189671 - DNA, 25 bp, Homo sapien
aatctgccacttcttgcccaggagt

SEQ ID NO: 189672 - DNA, 25 bp, Homo sapien
tgcccaggagtgtgcacagatgtaa

SEQ ID NO: 189673 - DNA, 25 bp, Homo sapien
aatgtaccatagactctcaccaact

SEQ ID NO: 189674 - DNA, 25 bp, Homo sapien
ccatagactctcaccaactgtatat

SEQ ID NO: 189675 - DNA, 25 bp, Homo sapien
ttattctaatgctagtcaccaagag

SEQ ID NO: 189676 - DNA, 25 bp, Homo sapien
gctagtcaccaagagctagactcca

SEQ ID NO: 189677 - DNA, 25 bp, Homo sapien
aaaaatgagccctatgtagcactag

SEQ ID NO: 189678 - DNA, 25 bp, Homo sapien
gtagcactaggtttgaattctaaaa

SEQ ID NO: 189679 - DNA, 25 bp, Homo sapien
attttcttaaggcacacttcctaca

SEQ ID NO: 189680 - DNA, 25 bp, Homo sapien
cacttcctacacacagctatcaggg

SEQ ID NO: 189681 - DNA, 25 bp, Homo sapien
gctataaatgtcctgttctttttct

SEQ ID NO: 189682 - DNA, 25 bp, Homo sapien
tttaacagctgacttacatgatcgt

SEQ ID NO: 189683 - DNA, 25 bp, Homo sapien
tacatgatcgttttcctaatacagg

SEQ ID NO: 189684 - DNA, 25 bp, Homo sapien
caggaatacagcgacagacctatct

SEQ ID NO: 189685 - DNA, 25 bp, Homo sapien
gacctatctgaaaagtctgtttggg

SEQ ID NO: 189686 - DNA, 25 bp, Homo sapien
atgaggcatctctatctatagtcca

SEQ ID NO: 189687 - DNA, 25 bp, Homo sapien
ggcatctctatctatagtccagcag

SEQ ID NO: 189688 - DNA, 25 bp, Homo sapien
tatctatagtccagcagccctacag

SEQ ID NO: 189689 - DNA, 25 bp, Homo sapien
tatagtccagcagccctacaggagg

SEQ ID NO: 189690 - DNA, 25 bp, Homo sapien
tccagcagccctacaggaggcagga

SEQ ID NO: 189691 - DNA, 25 bp, Homo sapien
taaaaggcacttaggagtgagcaga

SEQ ID NO: 189692 - DNA, 25 bp, Homo sapien
aagcagtctgcttgagtctgtgcta

SEQ ID NO: 189693 - DNA, 25 bp, Homo sapien
agtctgcttgagtctgtgctaaata

SEQ ID NO: 189694 - DNA, 25 bp, Homo sapien
gcttgagtctgtgctaaataaacaa

SEQ ID NO: 189695 - DNA, 25 bp, Homo sapien
aaggaagttccatttagagctctac

SEQ ID NO: 189696 - DNA, 25 bp, Homo sapien
gttccatttagagctctacagaggg

SEQ ID NO: 189697 - DNA, 25 bp, Homo sapien
ggcctcgtatcctacctttccttgt

SEQ ID NO: 189698 - DNA, 25 bp, Homo sapien
gctggctgcacagaggattgcccct

SEQ ID NO: 189699 - DNA, 25 bp, Homo sapien
gattgccccttctcttttcagagct

SEQ ID NO: 189700 - DNA, 25 bp, Homo sapien
tcttttcagagctggccctcgatgc

SEQ ID NO: 189701 - DNA, 25 bp, Homo sapien
gctggccctcgatgccaaattagca

SEQ ID NO: 189702 - DNA, 25 bp, Homo sapien
aagtctaagggaccatggctgcctg

SEQ ID NO: 189703 - DNA, 25 bp, Homo sapien
ggaggaaccatagctccctctgggc

SEQ ID NO: 189704 - DNA, 25 bp, Homo sapien
tggcctcttggagccatgggccaaa

SEQ ID NO: 189705 - DNA, 25 bp, Homo sapien
cctcttggagccatgggccaaaggc

SEQ ID NO: 189706 - DNA, 25 bp, Homo sapien
tcttggagccatgggccaaaggcca

SEQ ID NO: 189707 - DNA, 25 bp, Homo sapien
gtctgtgtttggtctggcccagttc

SEQ ID NO: 189708 - DNA, 25 bp, Homo sapien
tgagggccaattgcagtgagccttt

SEQ ID NO: 189709 - DNA, 25 bp, Homo sapien
gactgtccctggatctgcggaggta

SEQ ID NO: 189710 - DNA, 25 bp, Homo sapien
atgacacgtcagtgggaaagagctc

SEQ ID NO: 189711 - DNA, 25 bp, Homo sapien
acacgtcagtgggaaagagctcaag

SEQ ID NO: 189712 - DNA, 25 bp, Homo sapien
cgtcagtgggaaagagctcaagaga

SEQ ID NO: 189713 - DNA, 25 bp, Homo sapien
agatgtctctactcaaactgtgcct

SEQ ID NO: 189714 - DNA, 25 bp, Homo sapien
aacagagaagcctgggctgctggga

SEQ ID NO: 189715 - DNA, 25 bp, Homo sapien
gctgctgggactgggttcattctca

SEQ ID NO: 189716 - DNA, 25 bp, Homo sapien
tgctgggactgggttcattctcatg

SEQ ID NO: 189717 - DNA, 25 bp, Homo sapien
gctgggactgggttcattctcatga

SEQ ID NO: 189718 - DNA, 25 bp, Homo sapien
ctgggactgggttcattctcatgac

SEQ ID NO: 189719 - DNA, 25 bp, Homo sapien
gtttacatatgtcaactgtaacagt

SEQ ID NO: 189720 - DNA, 25 bp, Homo sapien
tgtaacagtaggtcccaaatgggcc

SEQ ID NO: 189721 - DNA, 25 bp, Homo sapien
caaatgggcccattcccctaatagt

SEQ ID NO: 189722 - DNA, 25 bp, Homo sapien
gccatacatagaatgcttcaagcta

SEQ ID NO: 189723 - DNA, 25 bp, Homo sapien
gaatgcttcaagctatcttgctatg

SEQ ID NO: 189724 - DNA, 25 bp, Homo sapien
agctatcttgctatgcacattatac

SEQ ID NO: 189725 - DNA, 25 bp, Homo sapien
cattatacttgtactgttttgtgca

SEQ ID NO: 189726 - DNA, 25 bp, Homo sapien
gttttgtgcagtttgtctactttct

SEQ ID NO: 189727 - DNA, 25 bp, Homo sapien
gcagtttgtctactttcttagtgaa

SEQ ID NO: 189728 - DNA, 25 bp, Homo sapien
tgtgtttcttaaattgagcctaaga

SEQ ID NO: 189729 - DNA, 25 bp, Homo sapien
ggtaagcattgttaatttctgtaat

SEQ ID NO: 189730 - DNA, 25 bp, Homo sapien
tgagtatgccagctgcatacgatgt

SEQ ID NO: 189731 - DNA, 25 bp, Homo sapien
ttcactttctctttgactttagacc

SEQ ID NO: 189732 - DNA, 25 bp, Homo sapien
tttgaaatatagtctctgcttacga

SEQ ID NO: 189733 - DNA, 25 bp, Homo sapien
tgaaatatagtctctgcttacgaat

SEQ ID NO: 189734 - DNA, 25 bp, Homo sapien
gaaatatagtctctgcttacgaatg

SEQ ID NO: 189735 - DNA, 25 bp, Homo sapien
aaatatagtctctgcttacgaatgt

SEQ ID NO: 189736 - DNA, 25 bp, Homo sapien
aatatagtctctgcttacgaatgtc

SEQ ID NO: 189737 - DNA, 25 bp, Homo sapien
atatagtctctgcttacgaatgtca

SEQ ID NO: 189738 - DNA, 25 bp, Homo sapien
tatagtctctgcttacgaatgtcat

SEQ ID NO: 189739 - DNA, 25 bp, Homo sapien
atagtctctgcttacgaatgtcata

SEQ ID NO: 189740 - DNA, 25 bp, Homo sapien
caaaaggcgtattctttcatggttt

SEQ ID NO: 189741 - DNA, 25 bp, Homo sapien
ctctgcacagcccttctgggtggtc

SEQ ID NO: 189742 - DNA, 25 bp, Homo sapien
ccttctgggtggtcctcaccaggtc

SEQ ID NO: 189743 - DNA, 25 bp, Homo sapien
tgagctgggtgggaggccatcctgg

SEQ ID NO: 189744 - DNA, 25 bp, Homo sapien
actgtacctgccctagaacctgggc

SEQ ID NO: 189745 - DNA, 25 bp, Homo sapien
tgccctagaacctgggcctaggcca

SEQ ID NO: 189746 - DNA, 25 bp, Homo sapien
atatgaacagactcagctttgggac

SEQ ID NO: 189747 - DNA, 25 bp, Homo sapien
acagactcagctttgggacgtccaa

SEQ ID NO: 189748 - DNA, 25 bp, Homo sapien
tcagctttgggacgtccaaccacaa

SEQ ID NO: 189749 - DNA, 25 bp, Homo sapien
gctttgggacgtccaaccacaaaag

SEQ ID NO: 189750 - DNA, 25 bp, Homo sapien
tatatatctctaccatatgtgatgg

SEQ ID NO: 189751 - DNA, 25 bp, Homo sapien
tatctctaccatatgtgatggaaag

SEQ ID NO: 189752 - DNA, 25 bp, Homo sapien
tgcacatacacacatctacatccat

SEQ ID NO: 189753 - DNA, 25 bp, Homo sapien
atctacatccatatcatgcccatgc

SEQ ID NO: 189754 - DNA, 25 bp, Homo sapien
atgcccatgcatctgtaacttgctt

SEQ ID NO: 189755 - DNA, 25 bp, Homo sapien
tgtaacttgcttttcccgtgtaaga

SEQ ID NO: 189756 - DNA, 25 bp, Homo sapien
gcttttcccgtgtaagaacacttct

SEQ ID NO: 189757 - DNA, 25 bp, Homo sapien
gagtttgttcaatgcatgtgtctgt

SEQ ID NO: 189758 - DNA, 25 bp, Homo sapien
ggctacttaggaccatatggatgtt

SEQ ID NO: 189759 - DNA, 25 bp, Homo sapien
gatgttgtactgatgtcatttgacc

SEQ ID NO: 189760 - DNA, 25 bp, Homo sapien
atttgaccacgtccattgtttccat

SEQ ID NO: 189761 - DNA, 25 bp, Homo sapien
tttactttccatgtaacactgtgac

SEQ ID NO: 189762 - DNA, 25 bp, Homo sapien
acactgtgacattgagaattggtac

SEQ ID NO: 189763 - DNA, 25 bp, Homo sapien
ggagatgctgtagtagtagagataa

SEQ ID NO: 189764 - DNA, 25 bp, Homo sapien
gataatcaggttctattttaagcaa

SEQ ID NO: 189765 - DNA, 25 bp, Homo sapien
aggttctattttaagcaatcagcag

SEQ ID NO: 189766 - DNA, 25 bp, Homo sapien
atcagcagagatcaatattgtacag

SEQ ID NO: 189767 - DNA, 25 bp, Homo sapien
gtacagatacaagcaaaggtttaat

SEQ ID NO: 189768 - DNA, 25 bp, Homo sapien
tatttctgtagttgtgccagggaca

SEQ ID NO: 189769 - DNA, 25 bp, Homo sapien
gttgtgccagggacagactggccaa

SEQ ID NO: 189770 - DNA, 25 bp, Homo sapien
ggacagactggccaaagaccaaaca

SEQ ID NO: 189771 - DNA, 25 bp, Homo sapien
tgcagggtccccaagaaatttgtcc

SEQ ID NO: 189772 - DNA, 25 bp, Homo sapien
tgtccttatatcattgtgtctgagg

SEQ ID NO: 189773 - DNA, 25 bp, Homo sapien
cttatatcattgtgtctgagggcca

SEQ ID NO: 189774 - DNA, 25 bp, Homo sapien
agtgcttggatttccgtctgtagat

SEQ ID NO: 189775 - DNA, 25 bp, Homo sapien
tccgtctgtagatttaactgctgaa

SEQ ID NO: 189776 - DNA, 25 bp, Homo sapien
gctgaaattgtatctctcagtaatt

SEQ ID NO: 189777 - DNA, 25 bp, Homo sapien
acaaagtgttagactgtgtgcgtgt

SEQ ID NO: 189778 - DNA, 25 bp, Homo sapien
tgcgtgtgcgttgatgggcactcaa

SEQ ID NO: 189779 - DNA, 25 bp, Homo sapien
tgatgggcactcaagagtcccgtga

SEQ ID NO: 189780 - DNA, 25 bp, Homo sapien
tcaagagtcccgtgagtcatccagc

SEQ ID NO: 189781 - DNA, 25 bp, Homo sapien
tcgtgtcgtctttatctgcctatta

SEQ ID NO: 189782 - DNA, 25 bp, Homo sapien
tatctgcctattactcagcctaagg

SEQ ID NO: 189783 - DNA, 25 bp, Homo sapien
aaacaagtacactccacacatgcat

SEQ ID NO: 189784 - DNA, 25 bp, Homo sapien
agtacactccacacatgcataaagg

SEQ ID NO: 189785 - DNA, 25 bp, Homo sapien
ttaatttctgtttgtatcagtagaa

SEQ ID NO: 189786 - DNA, 25 bp, Homo sapien
gaattaaggtagttggacttcatct

SEQ ID NO: 189787 - DNA, 25 bp, Homo sapien
gtagttggacttcatctatagatgc

SEQ ID NO: 189788 - DNA, 25 bp, Homo sapien
atctatagatgcacagttccctttg

SEQ ID NO: 189789 - DNA, 25 bp, Homo sapien
atagatgcacagttccctttgtttt

SEQ ID NO: 189790 - DNA, 25 bp, Homo sapien
tatgttctcacttaattgctttgct

SEQ ID NO: 189791 - DNA, 25 bp, Homo sapien
ttgctttgctgctagacttgcaact

SEQ ID NO: 189792 - DNA, 25 bp, Homo sapien
gctttgctgctagacttgcaactaa

SEQ ID NO: 189793 - DNA, 25 bp, Homo sapien
gctgctagacttgcaactaattttt

SEQ ID NO: 189794 - DNA, 25 bp, Homo sapien
gcatttttgatgtgtcaaaactttg

SEQ ID NO: 189795 - DNA, 25 bp, Homo sapien
attgttacatatgtttgcatcaagc

SEQ ID NO: 189796 - DNA, 25 bp, Homo sapien
ggcacgctgagacgccatgacgacc

SEQ ID NO: 189797 - DNA, 25 bp, Homo sapien
acgctgagacgccatgacgaccggc

SEQ ID NO: 189798 - DNA, 25 bp, Homo sapien
ggccccaggtgctgtcctatgcagt

SEQ ID NO: 189799 - DNA, 25 bp, Homo sapien
aggtgctgtcctatgcagtccctgt

SEQ ID NO: 189800 - DNA, 25 bp, Homo sapien
tgctgtcctatgcagtccctgtgac

SEQ ID NO: 189801 - DNA, 25 bp, Homo sapien
tatgcagtccctgtgactgtcatgg

SEQ ID NO: 189802 - DNA, 25 bp, Homo sapien
gcagtccctgtgactgtcatggagc

SEQ ID NO: 189803 - DNA, 25 bp, Homo sapien
ctcacactgagtccctgaacccagg

SEQ ID NO: 189804 - DNA, 25 bp, Homo sapien
tcaccttccataccctacagattcg

SEQ ID NO: 189805 - DNA, 25 bp, Homo sapien
ctacagattcgctcccggggtgtgc

SEQ ID NO: 189806 - DNA, 25 bp, Homo sapien
tccggtagccctagacttggggtca

SEQ ID NO: 189807 - DNA, 25 bp, Homo sapien
gagcagcaggtcatgtgcacatgcc

SEQ ID NO: 189808 - DNA, 25 bp, Homo sapien
gtcatgtgcacatgccgttgcagca

SEQ ID NO: 189809 - DNA, 25 bp, Homo sapien
atgccgttgcagcacaagcttatgc

SEQ ID NO: 189810 - DNA, 25 bp, Homo sapien
aagcttatgcttcccgtagccgtgg

SEQ ID NO: 189811 - DNA, 25 bp, Homo sapien
tagccgtggcttttcattctgcaca

SEQ ID NO: 189812 - DNA, 25 bp, Homo sapien
tcccctcttatggtttctgtcataa

SEQ ID NO: 189813 - DNA, 25 bp, Homo sapien
atgtgctttatctgattgactccaa

SEQ ID NO: 189814 - DNA, 25 bp, Homo sapien
gattgactccaaacatcccgaaatg

SEQ ID NO: 189815 - DNA, 25 bp, Homo sapien
aaacatcccgaaatgtcacctgcag

SEQ ID NO: 189816 - DNA, 25 bp, Homo sapien
gtcacctgcagatttctcgtgggaa

SEQ ID NO: 189817 - DNA, 25 bp, Homo sapien
tcgtgggaaccaatatgtacatgtt

SEQ ID NO: 189818 - DNA, 25 bp, Homo sapien
gtgaagaaacttatttcccagtgta

SEQ ID NO: 189819 - DNA, 25 bp, Homo sapien
aacttatttcccagtgtaaacgcag

SEQ ID NO: 189820 - DNA, 25 bp, Homo sapien
atttcccagtgtaaacgcagttgta

SEQ ID NO: 189821 - DNA, 25 bp, Homo sapien
ccagtgtaaacgcagttgtacagaa

SEQ ID NO: 189822 - DNA, 25 bp, Homo sapien
aaattatgctgctattacagattta

SEQ ID NO: 189823 - DNA, 25 bp, Homo sapien
aaggaaagtctacattttctgcctg

SEQ ID NO: 189824 - DNA, 25 bp, Homo sapien
ttaatagcagttactcttgagtgta

SEQ ID NO: 189825 - DNA, 25 bp, Homo sapien
gttactcttgagtgtatttaccttt

SEQ ID NO: 189826 - DNA, 25 bp, Homo sapien
tccttaaagccgaaaatattgacaa

SEQ ID NO: 189827 - DNA, 25 bp, Homo sapien
gacaaatggatatggttagccttta

SEQ ID NO: 189828 - DNA, 25 bp, Homo sapien
tggatatggttagcctttataaata

SEQ ID NO: 189829 - DNA, 25 bp, Homo sapien
ctatgaattctaaagttcggcaaac

SEQ ID NO: 189830 - DNA, 25 bp, Homo sapien
tgaattctaaagttcggcaaaccaa

SEQ ID NO: 189831 - DNA, 25 bp, Homo sapien
aatcttgtaacctatttatctagtg

SEQ ID NO: 189832 - DNA, 25 bp, Homo sapien
cttgtaacctatttatctagtgatt

SEQ ID NO: 189833 - DNA, 25 bp, Homo sapien
ctagactctaatggatatgtttata

SEQ ID NO: 189834 - DNA, 25 bp, Homo sapien
atataattccaaacactcaggtgtg

SEQ ID NO: 189835 - DNA, 25 bp, Homo sapien
cactcaggtgtgtgaatgcatttaa

SEQ ID NO: 189836 - DNA, 25 bp, Homo sapien
taattgatcatgcaattccttcaat

SEQ ID NO: 189837 - DNA, 25 bp, Homo sapien
tgatcatgcaattccttcaattatg

SEQ ID NO: 189838 - DNA, 25 bp, Homo sapien
atgcaattccttcaattatgatgga

SEQ ID NO: 189839 - DNA, 25 bp, Homo sapien
tccttcaattatgatggaaagactt

SEQ ID NO: 189840 - DNA, 25 bp, Homo sapien
cattgttgtttttatgttcatttgc

SEQ ID NO: 189841 - DNA, 25 bp, Homo sapien
ttttatgttcatttgctggagcgca

SEQ ID NO: 189842 - DNA, 25 bp, Homo sapien
gttcatttgctggagcgcaagacgt

SEQ ID NO: 189843 - DNA, 25 bp, Homo sapien
tgctggagcgcaagacgtgctgaca

SEQ ID NO: 189844 - DNA, 25 bp, Homo sapien
ggagcgcaagacgtgctgacacagt

SEQ ID NO: 189845 - DNA, 25 bp, Homo sapien
agacgtgctgacacagtgagttttc

SEQ ID NO: 189846 - DNA, 25 bp, Homo sapien
gtgctgacacagtgagttttctctg

SEQ ID NO: 189847 - DNA, 25 bp, Homo sapien
gagttactcctgtatcattgctcat

SEQ ID NO: 189848 - DNA, 25 bp, Homo sapien
gttactcctgtatcattgctcataa

SEQ ID NO: 189849 - DNA, 25 bp, Homo sapien
actcctgtatcattgctcataatat

SEQ ID NO: 189850 - DNA, 25 bp, Homo sapien
gtatcattgctcataatattggaaa

SEQ ID NO: 189851 - DNA, 25 bp, Homo sapien
aggcagcacttttagatcctttgtg

SEQ ID NO: 189852 - DNA, 25 bp, Homo sapien
gatcctttgtgagcaagttctattt

SEQ ID NO: 189853 - DNA, 25 bp, Homo sapien
agttctatttgttcattgcttgcca

SEQ ID NO: 189854 - DNA, 25 bp, Homo sapien
atttgttcattgcttgccagagatg

SEQ ID NO: 189855 - DNA, 25 bp, Homo sapien
tgcttgccagagatgaacacagaat

SEQ ID NO: 189856 - DNA, 25 bp, Homo sapien
gtttcattttacaagaactatcctg

SEQ ID NO: 189857 - DNA, 25 bp, Homo sapien
tacaagaactatcctgagtttctgt

SEQ ID NO: 189858 - DNA, 25 bp, Homo sapien
ttctgtggatggaaacattacatgt

SEQ ID NO: 189859 - DNA, 25 bp, Homo sapien
actttataaattagtccctcattag

SEQ ID NO: 189860 - DNA, 25 bp, Homo sapien
gtagaatcaggcactgctcgcagaa

SEQ ID NO: 189861 - DNA, 25 bp, Homo sapien
ggcactgctcgcagaaggaacacag

SEQ ID NO: 189862 - DNA, 25 bp, Homo sapien
ttttggtttgattctgcctctgtag

SEQ ID NO: 189863 - DNA, 25 bp, Homo sapien
tgattctgcctctgtagctcaaggg

SEQ ID NO: 189864 - DNA, 25 bp, Homo sapien
agagtcctgtgcattctgccaaggc

SEQ ID NO: 189865 - DNA, 25 bp, Homo sapien
aggctccatagctttgccaaatgca

SEQ ID NO: 189866 - DNA, 25 bp, Homo sapien
gccaaatgcacggagctctgccatt

SEQ ID NO: 189867 - DNA, 25 bp, Homo sapien
cagtgcaggccttgcgaagggttta

SEQ ID NO: 189868 - DNA, 25 bp, Homo sapien
gaagggtttatctgcgttcgtctcg

SEQ ID NO: 189869 - DNA, 25 bp, Homo sapien
tcctgcatgggagttgtgttcctgt

SEQ ID NO: 189870 - DNA, 25 bp, Homo sapien
gatgactgtcttccctattcttagg

SEQ ID NO: 189871 - DNA, 25 bp, Homo sapien
gggacaagtcccaagatgccagaaa

SEQ ID NO: 189872 - DNA, 25 bp, Homo sapien
tgccagaaaggcagtctcccaagga

SEQ ID NO: 189873 - DNA, 25 bp, Homo sapien
agcgcaggggtatcttacagcactt

SEQ ID NO: 189874 - DNA, 25 bp, Homo sapien
ctctctgacctaggggacaatgcaa

SEQ ID NO: 189875 - DNA, 25 bp, Homo sapien
aggtcacagtgcattcccatattag

SEQ ID NO: 189876 - DNA, 25 bp, Homo sapien
agtgcattcccatattaggccatcc

SEQ ID NO: 189877 - DNA, 25 bp, Homo sapien
ttaggccatccccttcacgaagaat

SEQ ID NO: 189878 - DNA, 25 bp, Homo sapien
ccatccccttcacgaagaattcagg

SEQ ID NO: 189879 - DNA, 25 bp, Homo sapien
gggagggatcttgactcttgtctcc

SEQ ID NO: 189880 - DNA, 25 bp, Homo sapien
agggatcttgactcttgtctccttt

SEQ ID NO: 189881 - DNA, 25 bp, Homo sapien
gatcttgactcttgtctcctttgtc

SEQ ID NO: 189882 - DNA, 25 bp, Homo sapien
ctttgtccttttgttcagacagagt

SEQ ID NO: 189883 - DNA, 25 bp, Homo sapien
cagacagagttgtacctgcagcaga

SEQ ID NO: 189884 - DNA, 25 bp, Homo sapien
gatttcctcatgatacaagatacta

SEQ ID NO: 189885 - DNA, 25 bp, Homo sapien
gatactacagtaacaggctttaatt

SEQ ID NO: 189886 - DNA, 25 bp, Homo sapien
gggtattatttgtgactctcctgaa

SEQ ID NO: 189887 - DNA, 25 bp, Homo sapien
gtgactctcctgaaattgtaaactt

SEQ ID NO: 189888 - DNA, 25 bp, Homo sapien
tgtaaacttgtgcttctgtgtccag

SEQ ID NO: 189889 - DNA, 25 bp, Homo sapien
ttctgtgtccagttttctaatgagt

SEQ ID NO: 189890 - DNA, 25 bp, Homo sapien
gagtaggttcgtagcttgattgaat

SEQ ID NO: 189891 - DNA, 25 bp, Homo sapien
gtgagcccatagacacaagggaagt

SEQ ID NO: 189892 - DNA, 25 bp, Homo sapien
aacagtgctctggtgacatgataaa

SEQ ID NO: 189893 - DNA, 25 bp, Homo sapien
aaatatatgtgtcaaccaccatttc

SEQ ID NO: 189894 - DNA, 25 bp, Homo sapien
aactcctgttatctccttgtttgaa

SEQ ID NO: 189895 - DNA, 25 bp, Homo sapien
gctcgagactctgaaggcagggacc

SEQ ID NO: 189896 - DNA, 25 bp, Homo sapien
ctcgagactctgaaggcagggaccc

SEQ ID NO: 189897 - DNA, 25 bp, Homo sapien
agggaccctctgaccatcgccatgg

SEQ ID NO: 189898 - DNA, 25 bp, Homo sapien
ggaccctctgaccatcgccatggaa

SEQ ID NO: 189899 - DNA, 25 bp, Homo sapien
gaccctctgaccatcgccatggaaa

SEQ ID NO: 189900 - DNA, 25 bp, Homo sapien
tctgaccatcgccatggaaacagcc

SEQ ID NO: 189901 - DNA, 25 bp, Homo sapien
ctgaccatcgccatggaaacagcca

SEQ ID NO: 189902 - DNA, 25 bp, Homo sapien
catggaaacagccaacgctgacatc

SEQ ID NO: 189903 - DNA, 25 bp, Homo sapien
gacatcgtcaccctgctacgactgg

SEQ ID NO: 189904 - DNA, 25 bp, Homo sapien
atcgtcaccctgctacgactggcaa

SEQ ID NO: 189905 - DNA, 25 bp, Homo sapien
tcgtcaccctgctacgactggcaaa

SEQ ID NO: 189906 - DNA, 25 bp, Homo sapien
tcctgctgccgtcgctgccatcttg

SEQ ID NO: 189907 - DNA, 25 bp, Homo sapien
cccaccctcatgttcagggtggatg

SEQ ID NO: 189908 - DNA, 25 bp, Homo sapien
accctcatgttcagggtggatgtgg

SEQ ID NO: 189909 - DNA, 25 bp, Homo sapien
tcagggtggatgtgggcatgcaggt

SEQ ID NO: 189910 - DNA, 25 bp, Homo sapien
catgcaggtgacaagggccctgcct

SEQ ID NO: 189911 - DNA, 25 bp, Homo sapien
gggcccaggatgtagatattgtaca

SEQ ID NO: 189912 - DNA, 25 bp, Homo sapien
gcccaggatgtagatattgtacaaa

SEQ ID NO: 189913 - DNA, 25 bp, Homo sapien
gatattgtacaaaggtttctaaatc

SEQ ID NO: 189914 - DNA, 25 bp, Homo sapien
gtttctaaatcccttcttttctatg

SEQ ID NO: 189915 - DNA, 25 bp, Homo sapien
tctaaatcccttcttttctatgcac

SEQ ID NO: 189916 - DNA, 25 bp, Homo sapien
aaatcccttcttttctatgcacttt

SEQ ID NO: 189917 - DNA, 25 bp, Homo sapien
gacactctcggggttgtctgcagga

SEQ ID NO: 189918 - DNA, 25 bp, Homo sapien
ttgtctgcaggagagcaagccagga

SEQ ID NO: 189919 - DNA, 25 bp, Homo sapien
gagcaagccaggaggacatgggcct

SEQ ID NO: 189920 - DNA, 25 bp, Homo sapien
gacatgggcctggacgacacggcct

SEQ ID NO: 189921 - DNA, 25 bp, Homo sapien
ggacgacacggcctcgcagcaaagt

SEQ ID NO: 189922 - DNA, 25 bp, Homo sapien
gacacggcctcgcagcaaagtgtgt

SEQ ID NO: 189923 - DNA, 25 bp, Homo sapien
cacggcctcgcagcaaagtgtgtca

SEQ ID NO: 189924 - DNA, 25 bp, Homo sapien
aaagtgtgtcagacgagcagtgacg

SEQ ID NO: 189925 - DNA, 25 bp, Homo sapien
agacgagcagtgacgggcgtgcggc

SEQ ID NO: 189926 - DNA, 25 bp, Homo sapien
aaatcaccacaaccaaccaataccg

SEQ ID NO: 189927 - DNA, 25 bp, Homo sapien
gagggactcctcctgtggaaaagga

SEQ ID NO: 189928 - DNA, 25 bp, Homo sapien
gtgattggcctaaagtcaggaacta

SEQ ID NO: 189929 - DNA, 25 bp, Homo sapien
tcaggaactaggcaagtggtcaagc

SEQ ID NO: 189930 - DNA, 25 bp, Homo sapien
taggcaagtggtcaagccatgcttt

SEQ ID NO: 189931 - DNA, 25 bp, Homo sapien
gtggtcaagccatgctttgtgactt

SEQ ID NO: 189932 - DNA, 25 bp, Homo sapien
tcaagccatgctttgtgactttcaa

SEQ ID NO: 189933 - DNA, 25 bp, Homo sapien
gccatgctttgtgactttcaagtta

SEQ ID NO: 189934 - DNA, 25 bp, Homo sapien
gtgactttcaagttaattcttcttg

SEQ ID NO: 189935 - DNA, 25 bp, Homo sapien
gtgtgtgaaacagtgaagtctcaac

SEQ ID NO: 189936 - DNA, 25 bp, Homo sapien
tggttctggttatacttccattatc

SEQ ID NO: 189937 - DNA, 25 bp, Homo sapien
atacttccattatcaaggctaatta

SEQ ID NO: 189938 - DNA, 25 bp, Homo sapien
ggctaattaagagattttgccttga

SEQ ID NO: 189939 - DNA, 25 bp, Homo sapien
gtgaaattgttcaacctactttgta

SEQ ID NO: 189940 - DNA, 25 bp, Homo sapien
gaagcaaagctgtgtaatggagttt

SEQ ID NO: 189941 - DNA, 25 bp, Homo sapien
tagtgttttctcagtcacaattttc

SEQ ID NO: 189942 - DNA, 25 bp, Homo sapien
gtcacaattttctttactgtctagc

SEQ ID NO: 189943 - DNA, 25 bp, Homo sapien
actgtctagcatgatctgcatgacc

SEQ ID NO: 189944 - DNA, 25 bp, Homo sapien
gatctgcatgacctataatctttga

SEQ ID NO: 189945 - DNA, 25 bp, Homo sapien
taatctttgaaccactttcgtacct

SEQ ID NO: 189946 - DNA, 25 bp, Homo sapien
tgaaccactttcgtacctcatgttt

SEQ ID NO: 189947 - DNA, 25 bp, Homo sapien
gtacctcatgtttttatccagcact

SEQ ID NO: 189948 - DNA, 25 bp, Homo sapien
tatccagcactcttattgtaatatg

SEQ ID NO: 189949 - DNA, 25 bp, Homo sapien
gtactagtctgtgaacaatgtcaaa

SEQ ID NO: 189950 - DNA, 25 bp, Homo sapien
ggtctgcatgcagcagcactgacgt

SEQ ID NO: 189951 - DNA, 25 bp, Homo sapien
gtctgcatgcagcagcactgacgtc

SEQ ID NO: 189952 - DNA, 25 bp, Homo sapien
tgcatgcagcagcactgacgtcctc

SEQ ID NO: 189953 - DNA, 25 bp, Homo sapien
gcatgcagcagcactgacgtcctct

SEQ ID NO: 189954 - DNA, 25 bp, Homo sapien
gcagcactgacgtcctctcctgcat

SEQ ID NO: 189955 - DNA, 25 bp, Homo sapien
gcatcctacacctcctgggcaaggg

SEQ ID NO: 189956 - DNA, 25 bp, Homo sapien
ctcctgggcaagggcacgctgagac

SEQ ID NO: 189957 - DNA, 25 bp, Homo sapien
gcaagggcacgctgagacgccatga

SEQ ID NO: 189958 - DNA, 25 bp, Homo sapien
aggtgctgtcctatgcagtccctgt

SEQ ID NO: 189959 - DNA, 25 bp, Homo sapien
atgcagtccctgtgactgtcatgga

SEQ ID NO: 189960 - DNA, 25 bp, Homo sapien
taccttccggtagccctagacttgg

SEQ ID NO: 189961 - DNA, 25 bp, Homo sapien
atagcccaagccaacttgtatcttg

SEQ ID NO: 189962 - DNA, 25 bp, Homo sapien
caagccaacttgtatcttggtgata

SEQ ID NO: 189963 - DNA, 25 bp, Homo sapien
caacttgtatcttggtgatatggtt

SEQ ID NO: 189964 - DNA, 25 bp, Homo sapien
tggtttggctgcgtcacgacacaaa

SEQ ID NO: 189965 - DNA, 25 bp, Homo sapien
gtttggctgcgtcacgacacaaatc

SEQ ID NO: 189966 - DNA, 25 bp, Homo sapien
ttggctgcgtcacgacacaaatctc

SEQ ID NO: 189967 - DNA, 25 bp, Homo sapien
ggctgcgtcacgacacaaatctcac

SEQ ID NO: 189968 - DNA, 25 bp, Homo sapien
tgcacatgcccttttgcctgtgtca

SEQ ID NO: 189969 - DNA, 25 bp, Homo sapien
gcacatgcccttttgcctgtgtcat

SEQ ID NO: 189970 - DNA, 25 bp, Homo sapien
cctgtgtcatgtaagatgtggcttt

SEQ ID NO: 189971 - DNA, 25 bp, Homo sapien
tgtcatgtaagatgtggctttgctc

SEQ ID NO: 189972 - DNA, 25 bp, Homo sapien
attttcctgatgctgtaatgtttac

SEQ ID NO: 189973 - DNA, 25 bp, Homo sapien
aatgtttacttcagcttgttgacct

SEQ ID NO: 189974 - DNA, 25 bp, Homo sapien
cagcttgttgacctttctttgtgtt

SEQ ID NO: 189975 - DNA, 25 bp, Homo sapien
ttctttgtgttatctgcatgttgta

SEQ ID NO: 189976 - DNA, 25 bp, Homo sapien
atctgcatgttgtaacgtgtgataa

SEQ ID NO: 189977 - DNA, 25 bp, Homo sapien
gaatgtaaaggctgtggcaactgta

SEQ ID NO: 189978 - DNA, 25 bp, Homo sapien
gtaaagggctggtcacacgtggatc

SEQ ID NO: 189979 - DNA, 25 bp, Homo sapien
tggtcacacgtggatctggtttatg

SEQ ID NO: 189980 - DNA, 25 bp, Homo sapien
cgtggatctggtttatgaatgcatt

SEQ ID NO: 189981 - DNA, 25 bp, Homo sapien
ttgggatgattttggtaaccagatc

SEQ ID NO: 189982 - DNA, 25 bp, Homo sapien
gtaaccagatcaccttttcagaaat

SEQ ID NO: 189983 - DNA, 25 bp, Homo sapien
gcataatttacttggacaacttcgt

SEQ ID NO: 189984 - DNA, 25 bp, Homo sapien
acttggacaacttcgtaggtagcct

SEQ ID NO: 189985 - DNA, 25 bp, Homo sapien
tggacaacttcgtaggtagccttaa

SEQ ID NO: 189986 - DNA, 25 bp, Homo sapien
gacaacttcgtaggtagccttaact

SEQ ID NO: 189987 - DNA, 25 bp, Homo sapien
acttcgtaggtagccttaacttctg

SEQ ID NO: 189988 - DNA, 25 bp, Homo sapien
ggttgtaaattcatacacttatcac

SEQ ID NO: 189989 - DNA, 25 bp, Homo sapien
ttcatacacttatcacatgaatgtg

SEQ ID NO: 189990 - DNA, 25 bp, Homo sapien
cacatgaatgtgttactgtatacaa

SEQ ID NO: 189991 - DNA, 25 bp, Homo sapien
actgtatacaaaactcttaatgctt

SEQ ID NO: 189992 - DNA, 25 bp, Homo sapien
aaaactcttaatgctttattctcaa

SEQ ID NO: 189993 - DNA, 25 bp, Homo sapien
attctcaaatgctgggttgaaaaat

SEQ ID NO: 189994 - DNA, 25 bp, Homo sapien
gaaagctgtttaagaaggccatgac

SEQ ID NO: 189995 - DNA, 25 bp, Homo sapien
aggccatgactctttaggtgtgtat

SEQ ID NO: 189996 - DNA, 25 bp, Homo sapien
gtgtatgtgtacctttcagcatcct

SEQ ID NO: 189997 - DNA, 25 bp, Homo sapien
gtacctttcagcatcctaggaattt

SEQ ID NO: 189998 - DNA, 25 bp, Homo sapien
tttttccagttagtcttcttcaagg

SEQ ID NO: 189999 - DNA, 25 bp, Homo sapien
gtcttcttcaaggaattactattgt

SEQ ID NO: 190000 - DNA, 25 bp, Homo sapien
attactattgttccttttgtcacag

SEQ ID NO: 190001 - DNA, 25 bp, Homo sapien
gttccttttgtcacaggtaaaatca

SEQ ID NO: 190002 - DNA, 25 bp, Homo sapien
gatggctaaacgattcttactcagt

SEQ ID NO: 190003 - DNA, 25 bp, Homo sapien
aacgattcttactcagtgtgatgta

SEQ ID NO: 190004 - DNA, 25 bp, Homo sapien
tgatgtataatgatgcaacagggac

SEQ ID NO: 190005 - DNA, 25 bp, Homo sapien
atggccaaaccccaggcatcaggtc

SEQ ID NO: 190006 - DNA, 25 bp, Homo sapien
gcatcaggtctgtccagaggctgac

SEQ ID NO: 190007 - DNA, 25 bp, Homo sapien
gtccagaggctgacgtagacagtga

SEQ ID NO: 190008 - DNA, 25 bp, Homo sapien
gattatttggttacattttgggatt

SEQ ID NO: 190009 - DNA, 25 bp, Homo sapien
ctgctggtctctgtgtaacggatgg

SEQ ID NO: 190010 - DNA, 25 bp, Homo sapien
gtctctgtgtaacggatggcttaaa

SEQ ID NO: 190011 - DNA, 25 bp, Homo sapien
aaggttgtctgcgtcttggattact

SEQ ID NO: 190012 - DNA, 25 bp, Homo sapien
gtcttggattactgtctgccattca

SEQ ID NO: 190013 - DNA, 25 bp, Homo sapien
tgtctgccattcagcctttgccaaa

SEQ ID NO: 190014 - DNA, 25 bp, Homo sapien
aaaatttggcactgatctgcacatt

SEQ ID NO: 190015 - DNA, 25 bp, Homo sapien
tgatctgcacatttttatagtcatt

SEQ ID NO: 190016 - DNA, 25 bp, Homo sapien
cagcctcttcctctataaacaatga

SEQ ID NO: 190017 - DNA, 25 bp, Homo sapien
caatgaccaattagacgtttccgta

SEQ ID NO: 190018 - DNA, 25 bp, Homo sapien
agacgtttccgtaattccatgtatt

SEQ ID NO: 190019 - DNA, 25 bp, Homo sapien
gtttccgtaattccatgtattatgt

SEQ ID NO: 190020 - DNA, 25 bp, Homo sapien
gtaatgcttgtctaaaaagtgcaat

SEQ ID NO: 190021 - DNA, 25 bp, Homo sapien
gcaatttattgtacattgtcccaac

SEQ ID NO: 190022 - DNA, 25 bp, Homo sapien
ggattagtatcttgtttttatgtgt

SEQ ID NO: 190023 - DNA, 25 bp, Homo sapien
caactgagaaggtaacaaggtgact

SEQ ID NO: 190024 - DNA, 25 bp, Homo sapien
tgtgagccagtgatgttttcaatgc

SEQ ID NO: 190025 - DNA, 25 bp, Homo sapien
tgttttcaatgctttgtgttgcccc

SEQ ID NO: 190026 - DNA, 25 bp, Homo sapien
aatgctttgtgttgcccctttggcc

SEQ ID NO: 190027 - DNA, 25 bp, Homo sapien
tgtttcttattttggccagttcttt

SEQ ID NO: 190028 - DNA, 25 bp, Homo sapien
tcttattttggccagttcttttatt

SEQ ID NO: 190029 - DNA, 25 bp, Homo sapien
tttatttatgtccttgtgacccagg

SEQ ID NO: 190030 - DNA, 25 bp, Homo sapien
atgtccttgtgacccaggtacttgg

SEQ ID NO: 190031 - DNA, 25 bp, Homo sapien
agctacccttctggccttttagcgt

SEQ ID NO: 190032 - DNA, 25 bp, Homo sapien
ttctggccttttagcgtctttgaag

SEQ ID NO: 190033 - DNA, 25 bp, Homo sapien
gaaggagaccagacatgagtgaata

SEQ ID NO: 190034 - DNA, 25 bp, Homo sapien
acctaggagagtgtcagcatgtttc

SEQ ID NO: 190035 - DNA, 25 bp, Homo sapien
tgcagattcgtcaggccaggtgaaa

SEQ ID NO: 190036 - DNA, 25 bp, Homo sapien
aaagggccaggcagttgcagctgat

SEQ ID NO: 190037 - DNA, 25 bp, Homo sapien
cagttgcagctgatgatgtaaatat

SEQ ID NO: 190038 - DNA, 25 bp, Homo sapien
gttgccagaattatactaaactgtt

SEQ ID NO: 190039 - DNA, 25 bp, Homo sapien
aactgttggatgagattaggagatc

SEQ ID NO: 190040 - DNA, 25 bp, Homo sapien
aggctggaccttctcttgataatgc

SEQ ID NO: 190041 - DNA, 25 bp, Homo sapien
gatgaagattaaagacccttatttt

SEQ ID NO: 190042 - DNA, 25 bp, Homo sapien
aaacctttatttatgatcaagtaat

SEQ ID NO: 190043 - DNA, 25 bp, Homo sapien
tattctacttgtgggatcttacatt

SEQ ID NO: 190044 - DNA, 25 bp, Homo sapien
acttgtgggatcttacattatggaa

SEQ ID NO: 190045 - DNA, 25 bp, Homo sapien
atagtttgacgtttttgacctcaag

SEQ ID NO: 190046 - DNA, 25 bp, Homo sapien
gacgtttttgacctcaagagtatgt

SEQ ID NO: 190047 - DNA, 25 bp, Homo sapien
agatactttgtaactatgcttgggt

SEQ ID NO: 190048 - DNA, 25 bp, Homo sapien
tactttgtaactatgcttgggtgat

SEQ ID NO: 190049 - DNA, 25 bp, Homo sapien
gatgattgtccaagcagctttagat

SEQ ID NO: 190050 - DNA, 25 bp, Homo sapien
ctttagatgtgtttagggccaggca

SEQ ID NO: 190051 - DNA, 25 bp, Homo sapien
gggccaggcaaaaggtttgcttgtt

SEQ ID NO: 190052 - DNA, 25 bp, Homo sapien
ctttttgcttaagatctgggagatt

SEQ ID NO: 190053 - DNA, 25 bp, Homo sapien
ttctcaagactatagactgaactgt

SEQ ID NO: 190054 - DNA, 25 bp, Homo sapien
atttttaccaactcttgctcatgag

SEQ ID NO: 190055 - DNA, 25 bp, Homo sapien
aactcttgctcatgagcctcaaaat

SEQ ID NO: 190056 - DNA, 25 bp, Homo sapien
atagatacatctctctattatccat

SEQ ID NO: 190057 - DNA, 25 bp, Homo sapien
gtggatatgtgttccagtcactcat

SEQ ID NO: 190058 - DNA, 25 bp, Homo sapien
gttccagtcactcatggatccatgg

SEQ ID NO: 190059 - DNA, 25 bp, Homo sapien
ccatggaaatggaccgtgtttaaat

SEQ ID NO: 190060 - DNA, 25 bp, Homo sapien
tttagttttcagtcattcaagggca

SEQ ID NO: 190061 - DNA, 25 bp, Homo sapien
gttttcagtcattcaagggcacatt

SEQ ID NO: 190062 - DNA, 25 bp, Homo sapien
aagggcacatttggctgacggagct

SEQ ID NO: 190063 - DNA, 25 bp, Homo sapien
ggctgacggagctaataagcgtaat

SEQ ID NO: 190064 - DNA, 25 bp, Homo sapien
tgcttagtagtttataccatctttt

SEQ ID NO: 190065 - DNA, 25 bp, Homo sapien
tgtactttgcggaaattaacctgtt

SEQ ID NO: 190066 - DNA, 25 bp, Homo sapien
acctgtttgtatgcctggctttgtt

SEQ ID NO: 190067 - DNA, 25 bp, Homo sapien
gcctggctttgtttacaaacatata

SEQ ID NO: 190068 - DNA, 25 bp, Homo sapien
aagaaatacctgtaccattcccact

SEQ ID NO: 190069 - DNA, 25 bp, Homo sapien
attcccacttgctctttgatagcca

SEQ ID NO: 190070 - DNA, 25 bp, Homo sapien
tctttgatagccacctcctaggaat

SEQ ID NO: 190071 - DNA, 25 bp, Homo sapien
agttattttcttctgctggacagta

SEQ ID NO: 190072 - DNA, 25 bp, Homo sapien
tttcttctgctggacagtattaaat

SEQ ID NO: 190073 - DNA, 25 bp, Homo sapien
cagtattaaatagagcaggatgttg

SEQ ID NO: 190074 - DNA, 25 bp, Homo sapien
ggatgttgagttaatctgctagatt

SEQ ID NO: 190075 - DNA, 25 bp, Homo sapien
tgctagattgcagtactaatggtag

SEQ ID NO: 190076 - DNA, 25 bp, Homo sapien
taatggtagtggtttagtgtcttca

SEQ ID NO: 190077 - DNA, 25 bp, Homo sapien
agtggtttagtgtcttcatgttaat

SEQ ID NO: 190078 - DNA, 25 bp, Homo sapien
agtgtcttcatgttaatattatttg

SEQ ID NO: 190079 - DNA, 25 bp, Homo sapien
ccagagagcaaagtgcattacttaa

SEQ ID NO: 190080 - DNA, 25 bp, Homo sapien
agatgcagtatatacttttctcatt

SEQ ID NO: 190081 - DNA, 25 bp, Homo sapien
aaacagcacatatttattaagagaa

SEQ ID NO: 190082 - DNA, 25 bp, Homo sapien
tattatttttccctatgtgttgaca

SEQ ID NO: 190083 - DNA, 25 bp, Homo sapien
ttttccctatgtgttgacaaggtat

SEQ ID NO: 190084 - DNA, 25 bp, Homo sapien
gacaaggtatttctaatatcacact

SEQ ID NO: 190085 - DNA, 25 bp, Homo sapien
ttatgcttcagggtagagggattcc

SEQ ID NO: 190086 - DNA, 25 bp, Homo sapien
gagggattcccttgagtataggtca

SEQ ID NO: 190087 - DNA, 25 bp, Homo sapien
attcccttgagtataggtcagcaaa

SEQ ID NO: 190088 - DNA, 25 bp, Homo sapien
agcctgtgtgtgcacgccccatgag

SEQ ID NO: 190089 - DNA, 25 bp, Homo sapien
gtgcacgccccatgagccgaaaagt

SEQ ID NO: 190090 - DNA, 25 bp, Homo sapien
ccatgagccgaaaagtgggtcttat

SEQ ID NO: 190091 - DNA, 25 bp, Homo sapien
gtgggtcttatgttttcaaatggtt

SEQ ID NO: 190092 - DNA, 25 bp, Homo sapien
gaactatatgacattcagatttgtg

SEQ ID NO: 190093 - DNA, 25 bp, Homo sapien
gagttttcgggtgggcagacgcact

SEQ ID NO: 190094 - DNA, 25 bp, Homo sapien
gtgggcagacgcactgttgaatctg

SEQ ID NO: 190095 - DNA, 25 bp, Homo sapien
gacgcactgttgaatctggtagcca

SEQ ID NO: 190096 - DNA, 25 bp, Homo sapien
ttgaatctggtagccagggttccct

SEQ ID NO: 190097 - DNA, 25 bp, Homo sapien
atctggtagccagggttccctcgaa

SEQ ID NO: 190098 - DNA, 25 bp, Homo sapien
gtagccagggttccctcgaacttgg

SEQ ID NO: 190099 - DNA, 25 bp, Homo sapien
aggtttctgttaacgaggcattcca

SEQ ID NO: 190100 - DNA, 25 bp, Homo sapien
gttaacgaggcattccattttccat

SEQ ID NO: 190101 - DNA, 25 bp, Homo sapien
cattaataaagtttaccattcgcaa

SEQ ID NO: 190102 - DNA, 25 bp, Homo sapien
aatcaaggtttctgttaacgaggca

SEQ ID NO: 190103 - DNA, 25 bp, Homo sapien
caaggtttctgttaacgaggcattc

SEQ ID NO: 190104 - DNA, 25 bp, Homo sapien
cagatgttgcctccggtgtccaagc

SEQ ID NO: 190105 - DNA, 25 bp, Homo sapien
gaagatggccaggaatggactcata

SEQ ID NO: 190106 - DNA, 25 bp, Homo sapien
tggactcataccattggcacattag

SEQ ID NO: 190107 - DNA, 25 bp, Homo sapien
taccattggcacattaggctaatcc

SEQ ID NO: 190108 - DNA, 25 bp, Homo sapien
gtcagcaattaagtgttcccactag

SEQ ID NO: 190109 - DNA, 25 bp, Homo sapien
gtgttcccactagaactgacctaag

SEQ ID NO: 190110 - DNA, 25 bp, Homo sapien
gaactgacctaagccactgattaat

SEQ ID NO: 190111 - DNA, 25 bp, Homo sapien
gaatctagccattttataatgccag

SEQ ID NO: 190112 - DNA, 25 bp, Homo sapien
atctatatatgttatctgatgccat

SEQ ID NO: 190113 - DNA, 25 bp, Homo sapien
tctgaagtagcctcacatgtggtcc

SEQ ID NO: 190114 - DNA, 25 bp, Homo sapien
gcagttcagcagttaacagatgact

SEQ ID NO: 190115 - DNA, 25 bp, Homo sapien
gcaggccatatgtgcgcatgaccga

SEQ ID NO: 190116 - DNA, 25 bp, Homo sapien
gtgcgcatgaccgagattttgaaaa

SEQ ID NO: 190117 - DNA, 25 bp, Homo sapien
gtacatagtgacatgtttggtgcat

SEQ ID NO: 190118 - DNA, 25 bp, Homo sapien
catggtttttgaggagggcttttgt

SEQ ID NO: 190119 - DNA, 25 bp, Homo sapien
cagacctgagagctgtgccttttct

SEQ ID NO: 190120 - DNA, 25 bp, Homo sapien
ttctatgcaatattacagacgttac

SEQ ID NO: 190121 - DNA, 25 bp, Homo sapien
acagacgttacatcggaacccagat

SEQ ID NO: 190122 - DNA, 25 bp, Homo sapien
gaacccagatggctgtattcacatg

SEQ ID NO: 190123 - DNA, 25 bp, Homo sapien
attcacatgtaggtttgggctgtaa

SEQ ID NO: 190124 - DNA, 25 bp, Homo sapien
tgggctgtaatctaaacaattggac

SEQ ID NO: 190125 - DNA, 25 bp, Homo sapien
ggaaatgagcagtcttacttttgta

SEQ ID NO: 190126 - DNA, 25 bp, Homo sapien
atgtcagtgatgctgccgtcagtga

SEQ ID NO: 190127 - DNA, 25 bp, Homo sapien
tgtcagtgatgctgccgtcagtgaa

SEQ ID NO: 190128 - DNA, 25 bp, Homo sapien
gtcagtgatgctgccgtcagtgaac

SEQ ID NO: 190129 - DNA, 25 bp, Homo sapien
agtgatgctgccgtcagtgaacctc

SEQ ID NO: 190130 - DNA, 25 bp, Homo sapien
tgatgctgccgtcagtgaacctcga

SEQ ID NO: 190131 - DNA, 25 bp, Homo sapien
gatgctgccgtcagtgaacctcgag

SEQ ID NO: 190132 - DNA, 25 bp, Homo sapien
atgctgccgtcagtgaacctcgagg

SEQ ID NO: 190133 - DNA, 25 bp, Homo sapien
tgctgccgtcagtgaacctcgagga

SEQ ID NO: 190134 - DNA, 25 bp, Homo sapien
gctgccgtcagtgaacctcgaggac

SEQ ID NO: 190135 - DNA, 25 bp, Homo sapien
tgccgtcagtgaacctcgaggactg

SEQ ID NO: 190136 - DNA, 25 bp, Homo sapien
cgtcagtgaacctcgaggactgctc

SEQ ID NO: 190137 - DNA, 25 bp, Homo sapien
atgccaccgagcaggggcagcttca

SEQ ID NO: 190138 - DNA, 25 bp, Homo sapien
gggcagcttcatgaccgatgtctgg

SEQ ID NO: 190139 - DNA, 25 bp, Homo sapien
ggcagcttcatgaccgatgtctggc

SEQ ID NO: 190140 - DNA, 25 bp, Homo sapien
gcagcttcatgaccgatgtctggct

SEQ ID NO: 190141 - DNA, 25 bp, Homo sapien
agcttcatgaccgatgtctggctga

SEQ ID NO: 190142 - DNA, 25 bp, Homo sapien
tcatgaccgatgtctggctgaggct

SEQ ID NO: 190143 - DNA, 25 bp, Homo sapien
atgaccgatgtctggctgaggctgt

SEQ ID NO: 190144 - DNA, 25 bp, Homo sapien
ttgtctgcaggagagcaagccagga

SEQ ID NO: 190145 - DNA, 25 bp, Homo sapien
gacacggcctcgcagcaaagtgtgt

SEQ ID NO: 190146 - DNA, 25 bp, Homo sapien
aaccaataccgcgatccatgaggga

SEQ ID NO: 190147 - DNA, 25 bp, Homo sapien
catgagggactcctcctgtggaaaa

SEQ ID NO: 190148 - DNA, 25 bp, Homo sapien
caagactggccacccgctgcgtgtg

SEQ ID NO: 190149 - DNA, 25 bp, Homo sapien
cgcgcgtgtacgtgtggccccacat

SEQ ID NO: 190150 - DNA, 25 bp, Homo sapien
ccgccttccacgctaggatgtaaga

SEQ ID NO: 190151 - DNA, 25 bp, Homo sapien
gctaggatgtaagaggtcgcctcct

SEQ ID NO: 190152 - DNA, 25 bp, Homo sapien
aagaggtcgcctcctattgtacatt

SEQ ID NO: 190153 - DNA, 25 bp, Homo sapien
ggtcgcctcctattgtacatttggg

SEQ ID NO: 190154 - DNA, 25 bp, Homo sapien
gaaagccttgggtgtaaatcagtgt

SEQ ID NO: 190155 - DNA, 25 bp, Homo sapien
gccttgggtgtaaatcagtgtaaac

SEQ ID NO: 190156 - DNA, 25 bp, Homo sapien
tcagtgtaaacttggaggagagatt

SEQ ID NO: 190157 - DNA, 25 bp, Homo sapien
ggaggagagatttttctatcatgta

SEQ ID NO: 190158 - DNA, 25 bp, Homo sapien
tatcatgtagagtaggtatttttta

SEQ ID NO: 190159 - DNA, 25 bp, Homo sapien
atgcctgcaatcctgtagggaaaag

SEQ ID NO: 190160 - DNA, 25 bp, Homo sapien
aaattccattttgacctgtaccttg

SEQ ID NO: 190161 - DNA, 25 bp, Homo sapien
tccattttgacctgtaccttgaaca

SEQ ID NO: 190162 - DNA, 25 bp, Homo sapien
tttgacctgtaccttgaacaattgg

SEQ ID NO: 190163 - DNA, 25 bp, Homo sapien
accttgaacaattggttggctgaga

SEQ ID NO: 190164 - DNA, 25 bp, Homo sapien
aattggttggctgagatgctgttaa

SEQ ID NO: 190165 - DNA, 25 bp, Homo sapien
gctgttaatttgtgactttgcccca

SEQ ID NO: 190166 - DNA, 25 bp, Homo sapien
gttaatttgtgactttgccccaaat

SEQ ID NO: 190167 - DNA, 25 bp, Homo sapien
gtgactttgccccaaatttgagctc

SEQ ID NO: 190168 - DNA, 25 bp, Homo sapien
ctttgccccaaatttgagctcacaa

SEQ ID NO: 190169 - DNA, 25 bp, Homo sapien
atttgagctcacaaaaacatgtgtt

SEQ ID NO: 190170 - DNA, 25 bp, Homo sapien
aaatttcaatgtaactttctggtag

SEQ ID NO: 190171 - DNA, 25 bp, Homo sapien
aactttctggtagaagtgcttcttc

SEQ ID NO: 190172 - DNA, 25 bp, Homo sapien
gaagtgcttcttcatggatctgtga

SEQ ID NO: 190173 - DNA, 25 bp, Homo sapien
gtgcttcttcatggatctgtgacag

SEQ ID NO: 190174 - DNA, 25 bp, Homo sapien
cttcttcatggatctgtgacagaga

SEQ ID NO: 190175 - DNA, 25 bp, Homo sapien
gagtggatatggtatctaggcaata

SEQ ID NO: 190176 - DNA, 25 bp, Homo sapien
aggcaatagattgctgggtcattta

SEQ ID NO: 190177 - DNA, 25 bp, Homo sapien
agattgctgggtcatttagaataat

SEQ ID NO: 190178 - DNA, 25 bp, Homo sapien
gaagactgaactccacagtcgtagt

SEQ ID NO: 190179 - DNA, 25 bp, Homo sapien
gaactccacagtcgtagtcagtgct

SEQ ID NO: 190180 - DNA, 25 bp, Homo sapien
actccacagtcgtagtcagtgctgt

SEQ ID NO: 190181 - DNA, 25 bp, Homo sapien
atcctggtctcctagccaaaaaaat

SEQ ID NO: 190182 - DNA, 25 bp, Homo sapien
aaaacgaatctgtatgttgaggcaa

SEQ ID NO: 190183 - DNA, 25 bp, Homo sapien
aagtctgggactttatcatagaaac

SEQ ID NO: 190184 - DNA, 25 bp, Homo sapien
aacaaagtctcagatattttagttc

SEQ ID NO: 190185 - DNA, 25 bp, Homo sapien
aaaagcatttgacctgtcactgtac

SEQ ID NO: 190186 - DNA, 25 bp, Homo sapien
tttgacctgtcactgtactatctac

SEQ ID NO: 190187 - DNA, 25 bp, Homo sapien
gtcactgtactatctacatgtggaa

SEQ ID NO: 190188 - DNA, 25 bp, Homo sapien
tgttcaagttgaatcctaatgccgt

SEQ ID NO: 190189 - DNA, 25 bp, Homo sapien
gttgaatcctaatgccgtgaatgaa

SEQ ID NO: 190190 - DNA, 25 bp, Homo sapien
cacagtctgtgtagggaatgagcaa

SEQ ID NO: 190191 - DNA, 25 bp, Homo sapien
aaagttgaattccaattgctttttg

SEQ ID NO: 190192 - DNA, 25 bp, Homo sapien
aaaggagacctgtagcagtcaaaga

SEQ ID NO: 190193 - DNA, 25 bp, Homo sapien
acctgtagcagtcaaagattttatt

SEQ ID NO: 190194 - DNA, 25 bp, Homo sapien
ttttctgctgtaattctgcattaag

SEQ ID NO: 190195 - DNA, 25 bp, Homo sapien
gtaattctgcattaagctcacatga

SEQ ID NO: 190196 - DNA, 25 bp, Homo sapien
tgcattaagctcacatgaaaatcat

SEQ ID NO: 190197 - DNA, 25 bp, Homo sapien
catgattctagagtttggaatgcaa

SEQ ID NO: 190198 - DNA, 25 bp, Homo sapien
ttttaccctcaagctgggaatattt

SEQ ID NO: 190199 - DNA, 25 bp, Homo sapien
gatatcaaattattacctccccatg

SEQ ID NO: 190200 - DNA, 25 bp, Homo sapien
caaattattacctccccatgttatg

SEQ ID NO: 190201 - DNA, 25 bp, Homo sapien
tattacctccccatgttatgttgaa

SEQ ID NO: 190202 - DNA, 25 bp, Homo sapien
acctccccatgttatgttgaaaatt

SEQ ID NO: 190203 - DNA, 25 bp, Homo sapien
atgggaaaggagaccattttcttag

SEQ ID NO: 190204 - DNA, 25 bp, Homo sapien
aaggagaccattttcttagaaagca

SEQ ID NO: 190205 - DNA, 25 bp, Homo sapien
tctggaaaacagacggattttactt

SEQ ID NO: 190206 - DNA, 25 bp, Homo sapien
gacggattttacttctggagacatg

SEQ ID NO: 190207 - DNA, 25 bp, Homo sapien
gagacatggcatacggttactgact

SEQ ID NO: 190208 - DNA, 25 bp, Homo sapien
atacggttactgacttatgagctac

SEQ ID NO: 190209 - DNA, 25 bp, Homo sapien
gttactgacttatgagctaccaaaa

SEQ ID NO: 190210 - DNA, 25 bp, Homo sapien
tgagctaccaaaactaaattctttc

SEQ ID NO: 190211 - DNA, 25 bp, Homo sapien
tttctctgctattaactggctagaa

SEQ ID NO: 190212 - DNA, 25 bp, Homo sapien
actggctagaagacattcatctatt

SEQ ID NO: 190213 - DNA, 25 bp, Homo sapien
gtttgtatctatttcatgctttact

SEQ ID NO: 190214 - DNA, 25 bp, Homo sapien
ataagcactctaatggataacaatc

SEQ ID NO: 190215 - DNA, 25 bp, Homo sapien
ttgtaaaagatgatgccgaagagtt

SEQ ID NO: 190216 - DNA, 25 bp, Homo sapien
gatgccgaagagttgatgtcaatct

SEQ ID NO: 190217 - DNA, 25 bp, Homo sapien
tactttgtatatctcattattccta

SEQ ID NO: 190218 - DNA, 25 bp, Homo sapien
gtatatctcattattcctattttgg

SEQ ID NO: 190219 - DNA, 25 bp, Homo sapien
tctttaatcatatacttgtcttttg

SEQ ID NO: 190220 - DNA, 25 bp, Homo sapien
acttgtcttttgtaaatagcagctt

SEQ ID NO: 190221 - DNA, 25 bp, Homo sapien
ttttgtgtcattctccccactttat

SEQ ID NO: 190222 - DNA, 25 bp, Homo sapien
gtcattctccccactttattagtta

SEQ ID NO: 190223 - DNA, 25 bp, Homo sapien
cattctccccactttattagttaat

SEQ ID NO: 190224 - DNA, 25 bp, Homo sapien
accctcaaactaatattcttgtctg

SEQ ID NO: 190225 - DNA, 25 bp, Homo sapien
tcagtttacctttggagtcttccct

SEQ ID NO: 190226 - DNA, 25 bp, Homo sapien
tggagtcttccctgcagatcgcaga

SEQ ID NO: 190227 - DNA, 25 bp, Homo sapien
agatcgcagacctgtttccaggctg

SEQ ID NO: 190228 - DNA, 25 bp, Homo sapien
aggctgatgtttctggtgtgtaatt

SEQ ID NO: 190229 - DNA, 25 bp, Homo sapien
tctggtgtgtaattgctagcgtttc

SEQ ID NO: 190230 - DNA, 25 bp, Homo sapien
tgctagcgtttctgaagggttttcc

SEQ ID NO: 190231 - DNA, 25 bp, Homo sapien
ttttcccaattgttttagccttgtg

SEQ ID NO: 190232 - DNA, 25 bp, Homo sapien
taattataacttgcctttcagcgat

SEQ ID NO: 190233 - DNA, 25 bp, Homo sapien
gacttgattcaacgtttggttctga

SEQ ID NO: 190234 - DNA, 25 bp, Homo sapien
cactgatgcgtttactcatctaaca

SEQ ID NO: 190235 - DNA, 25 bp, Homo sapien
taacataatctgacagggcctcagc

SEQ ID NO: 190236 - DNA, 25 bp, Homo sapien
aagtagcaagtacatgtatcggaac

SEQ ID NO: 190237 - DNA, 25 bp, Homo sapien
gtagcaagtacatgtatcggaactt

SEQ ID NO: 190238 - DNA, 25 bp, Homo sapien
gtacatgtatcggaacttagaactg

SEQ ID NO: 190239 - DNA, 25 bp, Homo sapien
acatgtatcggaacttagaactggt

SEQ ID NO: 190240 - DNA, 25 bp, Homo sapien
tgtatcggaacttagaactggtggg

SEQ ID NO: 190241 - DNA, 25 bp, Homo sapien
gagatggagacaatcctggtttcat

SEQ ID NO: 190242 - DNA, 25 bp, Homo sapien
tggagacaatcctggtttcatcacg

SEQ ID NO: 190243 - DNA, 25 bp, Homo sapien
gagacaatcctggtttcatcacggt

SEQ ID NO: 190244 - DNA, 25 bp, Homo sapien
gacaatcctggtttcatcacggtga

SEQ ID NO: 190245 - DNA, 25 bp, Homo sapien
acaatcctggtttcatcacggtgaa

SEQ ID NO: 190246 - DNA, 25 bp, Homo sapien
aatcctggtttcatcacggtgaaac

SEQ ID NO: 190247 - DNA, 25 bp, Homo sapien
tccggtgtccaagccacagcggtct

SEQ ID NO: 190248 - DNA, 25 bp, Homo sapien
ccggtgtccaagccacagcggtctg

SEQ ID NO: 190249 - DNA, 25 bp, Homo sapien
cggtgtccaagccacagcggtctgg

SEQ ID NO: 190250 - DNA, 25 bp, Homo sapien
ggtgtccaagccacagcggtctggc

SEQ ID NO: 190251 - DNA, 25 bp, Homo sapien
gtgtccaagccacagcggtctggct

SEQ ID NO: 190252 - DNA, 25 bp, Homo sapien
tgtccaagccacagcggtctggctg

SEQ ID NO: 190253 - DNA, 25 bp, Homo sapien
gtccaagccacagcggtctggctgt

SEQ ID NO: 190254 - DNA, 25 bp, Homo sapien
tccaagccacagcggtctggctgtt

SEQ ID NO: 190255 - DNA, 25 bp, Homo sapien
ccaagccacagcggtctggctgttg

SEQ ID NO: 190256 - DNA, 25 bp, Homo sapien
caagccacagcggtctggctgttgg

SEQ ID NO: 190257 - DNA, 25 bp, Homo sapien
aagccacagcggtctggctgttggg

SEQ ID NO: 190258 - DNA, 25 bp, Homo sapien
aactgtcactgattcttgcgcccta

SEQ ID NO: 190259 - DNA, 25 bp, Homo sapien
ttgcgccctagacaagctaaccagg

SEQ ID NO: 190260 - DNA, 25 bp, Homo sapien
agctaaccaggtttaccatctcact

SEQ ID NO: 190261 - DNA, 25 bp, Homo sapien
gtttaccatctcactcccagtaata

SEQ ID NO: 190262 - DNA, 25 bp, Homo sapien
agtaatacccagctcctatctaaag

SEQ ID NO: 190263 - DNA, 25 bp, Homo sapien
gtttggaatgttttctgactcttgg

SEQ ID NO: 190264 - DNA, 25 bp, Homo sapien
gggcgggattcctcgccttatcatc

SEQ ID NO: 190265 - DNA, 25 bp, Homo sapien
gccttatcatcctcactgtggagta

SEQ ID NO: 190266 - DNA, 25 bp, Homo sapien
ggagaatctttatcagaaactggtt

SEQ ID NO: 190267 - DNA, 25 bp, Homo sapien
tgtgtagtaaactttcttttgtggt

SEQ ID NO: 190268 - DNA, 25 bp, Homo sapien
tttgtctgtgcaagacctgcagctg

SEQ ID NO: 190269 - DNA, 25 bp, Homo sapien
gaatgtgacaacacaccttgggtag

SEQ ID NO: 190270 - DNA, 25 bp, Homo sapien
aacacaccttgggtagttctgcttg

SEQ ID NO: 190271 - DNA, 25 bp, Homo sapien
tgggtagttctgcttgtgtttttgc

SEQ ID NO: 190272 - DNA, 25 bp, Homo sapien
gtaaaagcagtgtcacagctaaaaa

SEQ ID NO: 190273 - DNA, 25 bp, Homo sapien
aaattattgtgctttagttgctagt

SEQ ID NO: 190274 - DNA, 25 bp, Homo sapien
gctttagttgctagtttgtactgag

SEQ ID NO: 190275 - DNA, 25 bp, Homo sapien
ttgtactgagagttgacctctccct

SEQ ID NO: 190276 - DNA, 25 bp, Homo sapien
gagttgacctctccctgtgcagttt

SEQ ID NO: 190277 - DNA, 25 bp, Homo sapien
gcagttttttgttctaaacttgtat

SEQ ID NO: 190278 - DNA, 25 bp, Homo sapien
aattgtgtaatgtgtctccctccta

SEQ ID NO: 190279 - DNA, 25 bp, Homo sapien
gtctccctcctacattgtaacaatt

SEQ ID NO: 190280 - DNA, 25 bp, Homo sapien
ggcctcaagtgccatcgcagctcaa

SEQ ID NO: 190281 - DNA, 25 bp, Homo sapien
aagtgccatcgcagctcaaagtggg

SEQ ID NO: 190282 - DNA, 25 bp, Homo sapien
atcgcagctcaaagtgggcaggcct

SEQ ID NO: 190283 - DNA, 25 bp, Homo sapien
ctgggtctgggctcataggcacatt

SEQ ID NO: 190284 - DNA, 25 bp, Homo sapien
gctgctggcctcagaggttgacgcc

SEQ ID NO: 190285 - DNA, 25 bp, Homo sapien
ggcctcagaggttgacgcccacctg

SEQ ID NO: 190286 - DNA, 25 bp, Homo sapien
caacctgagtctgcacaagtgcttt

SEQ ID NO: 190287 - DNA, 25 bp, Homo sapien
tggagttccgcaagaaacggagcca

SEQ ID NO: 190288 - DNA, 25 bp, Homo sapien
aaacggagccagaggcccagcaggt

SEQ ID NO: 190289 - DNA, 25 bp, Homo sapien
gccagaggcccagcaggtgttccaa

SEQ ID NO: 190290 - DNA, 25 bp, Homo sapien
gcaggtgttccaaccctacacctgg

SEQ ID NO: 190291 - DNA, 25 bp, Homo sapien
aggcaatagactggccccaactcag

SEQ ID NO: 190292 - DNA, 25 bp, Homo sapien
ggctggactaaggtgtgattaattc

SEQ ID NO: 190293 - DNA, 25 bp, Homo sapien
gttttttgtgtggaacagctcacct

SEQ ID NO: 190294 - DNA, 25 bp, Homo sapien
tggaacagctcaccttgtcagacag

SEQ ID NO: 190295 - DNA, 25 bp, Homo sapien
tcaccttgtcagacagcctcagggc

SEQ ID NO: 190296 - DNA, 25 bp, Homo sapien
gcctcagggcatctctgagacacag

SEQ ID NO: 190297 - DNA, 25 bp, Homo sapien
acattcatcttttgagtcctcatcc

SEQ ID NO: 190298 - DNA, 25 bp, Homo sapien
tcctcatccatggagtgctgtgttt

SEQ ID NO: 190299 - DNA, 25 bp, Homo sapien
aggatgcccattctccaggacttct

SEQ ID NO: 190300 - DNA, 25 bp, Homo sapien
caggacttctccaacttactattag

SEQ ID NO: 190301 - DNA, 25 bp, Homo sapien
caacaaactgtatttatgcaagcaa

SEQ ID NO: 190302 - DNA, 25 bp, Homo sapien
caacctgagtctgcacaagtgcttt

SEQ ID NO: 190303 - DNA, 25 bp, Homo sapien
cctgagtctgcacaagtgctttgtg

SEQ ID NO: 190304 - DNA, 25 bp, Homo sapien
acaagtgctttgtgcgggtggagag

SEQ ID NO: 190305 - DNA, 25 bp, Homo sapien
gggctgtgtggaccgtggatgagct

SEQ ID NO: 190306 - DNA, 25 bp, Homo sapien
gaccgtggatgagctggagttccgc

SEQ ID NO: 190307 - DNA, 25 bp, Homo sapien
tggagttccgcaagaaacggagcca

SEQ ID NO: 190308 - DNA, 25 bp, Homo sapien
cgcaagaaacggagccagaggccca

SEQ ID NO: 190309 - DNA, 25 bp, Homo sapien
aaacggagccagaggcccagcaggt

SEQ ID NO: 190310 - DNA, 25 bp, Homo sapien
gccagaggcccagcaggtgttccaa

SEQ ID NO: 190311 - DNA, 25 bp, Homo sapien
aggcccagcaggtgttccaacccta

SEQ ID NO: 190312 - DNA, 25 bp, Homo sapien
gcaggtgttccaaccctacacctgg

SEQ ID NO: 190313 - DNA, 25 bp, Homo sapien
gataggatagtctgaccttctagca

SEQ ID NO: 190314 - DNA, 25 bp, Homo sapien
ggatagtctgaccttctagcatagt

SEQ ID NO: 190315 - DNA, 25 bp, Homo sapien
gaccttctagcatagtctttttggc

SEQ ID NO: 190316 - DNA, 25 bp, Homo sapien
gggcgacagatagcacataggctgt

SEQ ID NO: 190317 - DNA, 25 bp, Homo sapien
agatagcacataggctgtttctggg

SEQ ID NO: 190318 - DNA, 25 bp, Homo sapien
gtgggtgttgccgtgcttcaggaag

SEQ ID NO: 190319 - DNA, 25 bp, Homo sapien
cttcaggaagtgtggcgaccagaaa

SEQ ID NO: 190320 - DNA, 25 bp, Homo sapien
gtggcgaccagaaagcgtagacccg

SEQ ID NO: 190321 - DNA, 25 bp, Homo sapien
gcacaggctgtggcttgcactccag

SEQ ID NO: 190322 - DNA, 25 bp, Homo sapien
agccgctctagtctctcaggaattt

SEQ ID NO: 190323 - DNA, 25 bp, Homo sapien
gtctctcaggaatttgcttgttact

SEQ ID NO: 190324 - DNA, 25 bp, Homo sapien
attcgtttcctgttaaatctgttgc

SEQ ID NO: 190325 - DNA, 25 bp, Homo sapien
taaatctgttgcactctcctgggct

SEQ ID NO: 190326 - DNA, 25 bp, Homo sapien
ctgggctgtctttttctccagcaga

SEQ ID NO: 190327 - DNA, 25 bp, Homo sapien
agcagacccctgcatgcagttgtgt

SEQ ID NO: 190328 - DNA, 25 bp, Homo sapien
gcagttgtgtaaggactttctctaa

SEQ ID NO: 190329 - DNA, 25 bp, Homo sapien
ggactttctctaattcttgtgaatc

SEQ ID NO: 190330 - DNA, 25 bp, Homo sapien
ttgtgaatcgtctcacccgcagtaa

SEQ ID NO: 190331 - DNA, 25 bp, Homo sapien
cccgcagtaaccactgaacgtcaat

SEQ ID NO: 190332 - DNA, 25 bp, Homo sapien
tgaacgtcaatcagccctccatggg

SEQ ID NO: 190333 - DNA, 25 bp, Homo sapien
gaagtattttgttacctcagtcttg

SEQ ID NO: 190334 - DNA, 25 bp, Homo sapien
acctcagtcttgtatcaagttgctg

SEQ ID NO: 190335 - DNA, 25 bp, Homo sapien
tattcttgccaaacaaactcagcca

SEQ ID NO: 190336 - DNA, 25 bp, Homo sapien
ggatgactaatcgttctgcttctga

SEQ ID NO: 190337 - DNA, 25 bp, Homo sapien
tcgttctgcttctgagtacattttc

SEQ ID NO: 190338 - DNA, 25 bp, Homo sapien
gaaacttctgaattgaaatcttgaa

SEQ ID NO: 190339 - DNA, 25 bp, Homo sapien
aaatcttgaatgtattgaatctgtc

SEQ ID NO: 190340 - DNA, 25 bp, Homo sapien
gaatctgtcaaggtacacagcggtg

SEQ ID NO: 190341 - DNA, 25 bp, Homo sapien
ggtacacagcggtgcctttgtaaat

SEQ ID NO: 190342 - DNA, 25 bp, Homo sapien
gcggtgcctttgtaaatgttcatta

SEQ ID NO: 190343 - DNA, 25 bp, Homo sapien
agtggtgtaatgtagcagagcttaa

SEQ ID NO: 190344 - DNA, 25 bp, Homo sapien
tagaactcaattatcactttttgtg

SEQ ID NO: 190345 - DNA, 25 bp, Homo sapien
gttggaattgtcatgttactgtgta

SEQ ID NO: 190346 - DNA, 25 bp, Homo sapien
gtatctctctaataactaaatgcca

SEQ ID NO: 190347 - DNA, 25 bp, Homo sapien
tatttgcattctccttgtggatttt

SEQ ID NO: 190348 - DNA, 25 bp, Homo sapien
tgtggattttttgtcacctaaggaa

SEQ ID NO: 190349 - DNA, 25 bp, Homo sapien
gatgagtgctggaaacttcttaagt

SEQ ID NO: 190350 - DNA, 25 bp, Homo sapien
agtgctttacagtttgttttcattg

SEQ ID NO: 190351 - DNA, 25 bp, Homo sapien
tgttttcattgtttgcagcggatca

SEQ ID NO: 190352 - DNA, 25 bp, Homo sapien
gtttgcagcggatcactggacatca

SEQ ID NO: 190353 - DNA, 25 bp, Homo sapien
ggacatcaaagattcattgcactta

SEQ ID NO: 190354 - DNA, 25 bp, Homo sapien
ggaaccttcttttcaatttctgtgt

SEQ ID NO: 190355 - DNA, 25 bp, Homo sapien
atttctgtgtaatttgcaaggctgt

SEQ ID NO: 190356 - DNA, 25 bp, Homo sapien
ggctgtacaatgtgtgctgatgcaa

SEQ ID NO: 190357 - DNA, 25 bp, Homo sapien
atcctggtggccttaactacagtgg

SEQ ID NO: 190358 - DNA, 25 bp, Homo sapien
tcctggtggccttaactacagtgga

SEQ ID NO: 190359 - DNA, 25 bp, Homo sapien
cctggtggccttaactacagtggag

SEQ ID NO: 190360 - DNA, 25 bp, Homo sapien
ctggtggccttaactacagtggagg

SEQ ID NO: 190361 - DNA, 25 bp, Homo sapien
ggccttaactacagtggaggtggaa

SEQ ID NO: 190362 - DNA, 25 bp, Homo sapien
ttaactacagtggaggtggaacttc

SEQ ID NO: 190363 - DNA, 25 bp, Homo sapien
actacagtggaggtggaacttccca

SEQ ID NO: 190364 - DNA, 25 bp, Homo sapien
tacagtggaggtggaacttcccagg

SEQ ID NO: 190365 - DNA, 25 bp, Homo sapien
acagtggaggtggaacttcccagga

SEQ ID NO: 190366 - DNA, 25 bp, Homo sapien
gtggaggtggaacttcccaggaggg

SEQ ID NO: 190367 - DNA, 25 bp, Homo sapien
agccgctgggccaacttccaatcat

SEQ ID NO: 190368 - DNA, 25 bp, Homo sapien
ggagcaggacggcttgcttcatcta

SEQ ID NO: 190369 - DNA, 25 bp, Homo sapien
aggacggcttgcttcatctaacaat

SEQ ID NO: 190370 - DNA, 25 bp, Homo sapien
ggcttgcttcatctaacaatctcag

SEQ ID NO: 190371 - DNA, 25 bp, Homo sapien
catctaacaatctcagtttccttta

SEQ ID NO: 190372 - DNA, 25 bp, Homo sapien
aaagatttcataagcaggtgtcagt

SEQ ID NO: 190373 - DNA, 25 bp, Homo sapien
tttcataagcaggtgtcagtggaca

SEQ ID NO: 190374 - DNA, 25 bp, Homo sapien
tctttcttcttatggatgtgaactg

SEQ ID NO: 190375 - DNA, 25 bp, Homo sapien
gaactgtgctgtggataaatcattt

SEQ ID NO: 190376 - DNA, 25 bp, Homo sapien
ttcttgaatgttctctatgactaac

SEQ ID NO: 190377 - DNA, 25 bp, Homo sapien
gaatgttctctatgactaacagtta

SEQ ID NO: 190378 - DNA, 25 bp, Homo sapien
acagttattaagtcggttgtgtata

SEQ ID NO: 190379 - DNA, 25 bp, Homo sapien
tcttattttcaaccagggagctatc

SEQ ID NO: 190380 - DNA, 25 bp, Homo sapien
cagggagctatctggcaccttttgt

SEQ ID NO: 190381 - DNA, 25 bp, Homo sapien
caccttttgtgctcctggctttttt

SEQ ID NO: 190382 - DNA, 25 bp, Homo sapien
tcctggcttttttcaatcatagcac

SEQ ID NO: 190383 - DNA, 25 bp, Homo sapien
agcactattgcatctcctagctatt

SEQ ID NO: 190384 - DNA, 25 bp, Homo sapien
tagctatttcttttgcccagcaggg

SEQ ID NO: 190385 - DNA, 25 bp, Homo sapien
ggtaatattgagtcccattgcaagt

SEQ ID NO: 190386 - DNA, 25 bp, Homo sapien
aagtatggacaaggcctctggttct

SEQ ID NO: 190387 - DNA, 25 bp, Homo sapien
gaaaatgcctaatgcctggatctgt

SEQ ID NO: 190388 - DNA, 25 bp, Homo sapien
ggatctgtgttctactttagtttca

SEQ ID NO: 190389 - DNA, 25 bp, Homo sapien
tttagtttcactgggaagtctttca

SEQ ID NO: 190390 - DNA, 25 bp, Homo sapien
tgtccacactactcaccaaatatga

SEQ ID NO: 190391 - DNA, 25 bp, Homo sapien
gggacaagtgcaggtttcttacatg

SEQ ID NO: 190392 - DNA, 25 bp, Homo sapien
caggtttcttacatgcatatattgc

SEQ ID NO: 190393 - DNA, 25 bp, Homo sapien
atattgcatgcatagaggtgaagtc

SEQ ID NO: 190394 - DNA, 25 bp, Homo sapien
ttagtgtgcgcatcgcccaaatagt

SEQ ID NO: 190395 - DNA, 25 bp, Homo sapien
tgcgcatcgcccaaatagtgaacat

SEQ ID NO: 190396 - DNA, 25 bp, Homo sapien
tagtgaacatcatacccaataggta

SEQ ID NO: 190397 - DNA, 25 bp, Homo sapien
ttctcacctttcatagtctccgatg

SEQ ID NO: 190398 - DNA, 25 bp, Homo sapien
gtctccgatgtcttttattccactc

SEQ ID NO: 190399 - DNA, 25 bp, Homo sapien
gatgtcttttattccactctatatg

SEQ ID NO: 190400 - DNA, 25 bp, Homo sapien
ccactctatatgtccatgtataccc

SEQ ID NO: 190401 - DNA, 25 bp, Homo sapien
aatactagttttatgtggccaagga

SEQ ID NO: 190402 - DNA, 25 bp, Homo sapien
ttcttttcagtttgtgttatttgga

SEQ ID NO: 190403 - DNA, 25 bp, Homo sapien
aaacatcttgtctacatcctttggc

SEQ ID NO: 190404 - DNA, 25 bp, Homo sapien
tgtctacatcctttggctgtttgta

SEQ ID NO: 190405 - DNA, 25 bp, Homo sapien
ctttggctgtttgtaggatcacgtt

SEQ ID NO: 190406 - DNA, 25 bp, Homo sapien
ggatcacgttgtccttacgatactg

SEQ ID NO: 190407 - DNA, 25 bp, Homo sapien
ttgtccttacgatactgaaacttta

SEQ ID NO: 190408 - DNA, 25 bp, Homo sapien
gatactgaaactttacagctgctgt

SEQ ID NO: 190409 - DNA, 25 bp, Homo sapien
taatgggactgtaggttgtttttct

SEQ ID NO: 190410 - DNA, 25 bp, Homo sapien
gtaggttgtttttctacatcttcat

SEQ ID NO: 190411 - DNA, 25 bp, Homo sapien
ttcattatttggacctaaaaccagt

SEQ ID NO: 190412 - DNA, 25 bp, Homo sapien
atcagatgttaattcctgtgactga

SEQ ID NO: 190413 - DNA, 25 bp, Homo sapien
tcagatgttaattcctgtgactgac

SEQ ID NO: 190414 - DNA, 25 bp, Homo sapien
cagatgttaattcctgtgactgact

SEQ ID NO: 190415 - DNA, 25 bp, Homo sapien
tcctgtgactgactgaatatagaaa

SEQ ID NO: 190416 - DNA, 25 bp, Homo sapien
cctgtgactgactgaatatagaaag

SEQ ID NO: 190417 - DNA, 25 bp, Homo sapien
ctgtgactgactgaatatagaaagg

SEQ ID NO: 190418 - DNA, 25 bp, Homo sapien
tgtgactgactgaatatagaaaggt

SEQ ID NO: 190419 - DNA, 25 bp, Homo sapien
gtgactgactgaatatagaaaggta

SEQ ID NO: 190420 - DNA, 25 bp, Homo sapien
gactgactgaatatagaaaggtaac

SEQ ID NO: 190421 - DNA, 25 bp, Homo sapien
ctgactgaatatagaaaggtaacct

SEQ ID NO: 190422 - DNA, 25 bp, Homo sapien
gaaaggtaacctaaggctgggcacg

SEQ ID NO: 190423 - DNA, 25 bp, Homo sapien
agccagggctgagaggattcgaggt

SEQ ID NO: 190424 - DNA, 25 bp, Homo sapien
cccttccccacaaactgggtgatag

SEQ ID NO: 190425 - DNA, 25 bp, Homo sapien
caaactgggtgatagggcggactta

SEQ ID NO: 190426 - DNA, 25 bp, Homo sapien
tgatagggcggacttacctggccca

SEQ ID NO: 190427 - DNA, 25 bp, Homo sapien
tagggcggacttacctggcccagcc

SEQ ID NO: 190428 - DNA, 25 bp, Homo sapien
agcccttgggctgtctgtgtcagtg

SEQ ID NO: 190429 - DNA, 25 bp, Homo sapien
gtctgtgtcagtggtttccggtctt

SEQ ID NO: 190430 - DNA, 25 bp, Homo sapien
tgtgtcagtggtttccggtcttttt

SEQ ID NO: 190431 - DNA, 25 bp, Homo sapien
tttctggctaaaatagtttgcaaag

SEQ ID NO: 190432 - DNA, 25 bp, Homo sapien
aatagtttgcaaaggaccaggtaat

SEQ ID NO: 190433 - DNA, 25 bp, Homo sapien
catctccttggaggcagtggtgtga

SEQ ID NO: 190434 - DNA, 25 bp, Homo sapien
caggtttattgctgccgggagacta

SEQ ID NO: 190435 - DNA, 25 bp, Homo sapien
tgctgccgggagactacactgcaaa

SEQ ID NO: 190436 - DNA, 25 bp, Homo sapien
gccgggagactacactgcaaaatag

SEQ ID NO: 190437 - DNA, 25 bp, Homo sapien
gaaaccaacagacctgatagcaaga

SEQ ID NO: 190438 - DNA, 25 bp, Homo sapien
gatagcaagaactggcagtaccaag

SEQ ID NO: 190439 - DNA, 25 bp, Homo sapien
ggcagtaccaagaaactatcaagaa

SEQ ID NO: 190440 - DNA, 25 bp, Homo sapien
ctatcaagaaaggagatctgctact

SEQ ID NO: 190441 - DNA, 25 bp, Homo sapien
ggagatctgctactaaacagagttc

SEQ ID NO: 190442 - DNA, 25 bp, Homo sapien
gccatgtaactaacaaaggatttgc

SEQ ID NO: 190443 - DNA, 25 bp, Homo sapien
ggaatttttatagcttacttcacaa

SEQ ID NO: 190444 - DNA, 25 bp, Homo sapien
ttacttcacaatgtgcccaggtcag

SEQ ID NO: 190445 - DNA, 25 bp, Homo sapien
gccagcggtggaggtgtcttgctcc

SEQ ID NO: 190446 - DNA, 25 bp, Homo sapien
gaggtgtcttgctccgggcccgtag

SEQ ID NO: 190447 - DNA, 25 bp, Homo sapien
tggcagggccttctgaaggaaactt

SEQ ID NO: 190448 - DNA, 25 bp, Homo sapien
aaggaaacttgcaggcgagcccaac

SEQ ID NO: 190449 - DNA, 25 bp, Homo sapien
aaacttgcaggcgagcccaacgtgg

SEQ ID NO: 190450 - DNA, 25 bp, Homo sapien
acttgcaggcgagcccaacgtggtg

SEQ ID NO: 190451 - DNA, 25 bp, Homo sapien
gaggcccaggcgtgctccctcttat

SEQ ID NO: 190452 - DNA, 25 bp, Homo sapien
aggcgtgctccctcttatggagccc

SEQ ID NO: 190453 - DNA, 25 bp, Homo sapien
tatggagcccctcccatggagctct

SEQ ID NO: 190454 - DNA, 25 bp, Homo sapien
aggcgcttgcccacgggacgtttgg

SEQ ID NO: 190455 - DNA, 25 bp, Homo sapien
tgcagtcagcgtcagtgctcatcta

SEQ ID NO: 190456 - DNA, 25 bp, Homo sapien
gggcttcccgttatccacgaggatt

SEQ ID NO: 190457 - DNA, 25 bp, Homo sapien
tatccacgaggatttgtgggtgtca

SEQ ID NO: 190458 - DNA, 25 bp, Homo sapien
gtgggtgtcagagcccataggcatc

SEQ ID NO: 190459 - DNA, 25 bp, Homo sapien
agagcccataggcatcactcttcag

SEQ ID NO: 190460 - DNA, 25 bp, Homo sapien
atcactcttcagcacctggtctgtt

SEQ ID NO: 190461 - DNA, 25 bp, Homo sapien
acctggtctgttcgctgcagggcat

SEQ ID NO: 190462 - DNA, 25 bp, Homo sapien
gtaatgctgagttctgtctcacact

SEQ ID NO: 190463 - DNA, 25 bp, Homo sapien
gagttctgtctcacactgatcaggc

SEQ ID NO: 190464 - DNA, 25 bp, Homo sapien
cactgatcaggctcagggccagaga

SEQ ID NO: 190465 - DNA, 25 bp, Homo sapien
ggccagagaggcaacaagagagcaa

SEQ ID NO: 190466 - DNA, 25 bp, Homo sapien
cagggcaggaccctattcccttggg

SEQ ID NO: 190467 - DNA, 25 bp, Homo sapien
agcaaagtaaatcctgccaccatgt

SEQ ID NO: 190468 - DNA, 25 bp, Homo sapien
gcaaagtaaatcctgccaccatgtt

SEQ ID NO: 190469 - DNA, 25 bp, Homo sapien
aaagtaaatcctgccaccatgttgt

SEQ ID NO: 190470 - DNA, 25 bp, Homo sapien
agtaaatcctgccaccatgttgtag

SEQ ID NO: 190471 - DNA, 25 bp, Homo sapien
aaatcctgccaccatgttgtagctc

SEQ ID NO: 190472 - DNA, 25 bp, Homo sapien
aatcctgccaccatgttgtagctca

SEQ ID NO: 190473 - DNA, 25 bp, Homo sapien
atcctgccaccatgttgtagctcaa

SEQ ID NO: 190474 - DNA, 25 bp, Homo sapien
tcctgccaccatgttgtagctcaat

SEQ ID NO: 190475 - DNA, 25 bp, Homo sapien
cctgccaccatgttgtagctcaata

SEQ ID NO: 190476 - DNA, 25 bp, Homo sapien
ctgccaccatgttgtagctcaatac

SEQ ID NO: 190477 - DNA, 25 bp, Homo sapien
tgccaccatgttgtagctcaataca

SEQ ID NO: 190478 - DNA, 25 bp, Homo sapien
aattttagatccatagccctatttg

SEQ ID NO: 190479 - DNA, 25 bp, Homo sapien
gatccatagccctatttgatacttg

SEQ ID NO: 190480 - DNA, 25 bp, Homo sapien
tccatagccctatttgatacttgac

SEQ ID NO: 190481 - DNA, 25 bp, Homo sapien
ttgatacttgacagtgcaagtttct

SEQ ID NO: 190482 - DNA, 25 bp, Homo sapien
aaaaagatgtggtggcctgacgcct

SEQ ID NO: 190483 - DNA, 25 bp, Homo sapien
aaaagatgtggtggcctgacgcctg

SEQ ID NO: 190484 - DNA, 25 bp, Homo sapien
tgacgcctgcggtccccgttttggg

SEQ ID NO: 190485 - DNA, 25 bp, Homo sapien
gagggtcccttccttgagcccagca

SEQ ID NO: 190486 - DNA, 25 bp, Homo sapien
agcagtttgagaccaatgtagtgag

SEQ ID NO: 190487 - DNA, 25 bp, Homo sapien
agtttgagaccaatgtagtgagact

SEQ ID NO: 190488 - DNA, 25 bp, Homo sapien
gtgagactcatctctgccagaaaaa

SEQ ID NO: 190489 - DNA, 25 bp, Homo sapien
cccctctctatgtgtatatttctaa

SEQ ID NO: 190490 - DNA, 25 bp, Homo sapien
gagagttctaacaattctagtgtga

SEQ ID NO: 190491 - DNA, 25 bp, Homo sapien
ctagtgtgaagccaaatagtgatct

SEQ ID NO: 190492 - DNA, 25 bp, Homo sapien
aatagtgatcttttagtgctttggg

SEQ ID NO: 190493 - DNA, 25 bp, Homo sapien
gatgggcaacagtgactttgattac

SEQ ID NO: 190494 - DNA, 25 bp, Homo sapien
agtgactttgattacccttgctgct

SEQ ID NO: 190495 - DNA, 25 bp, Homo sapien
ttgattacccttgctgctctgcatt

SEQ ID NO: 190496 - DNA, 25 bp, Homo sapien
ttgctgctctgcatttgccagttta

SEQ ID NO: 190497 - DNA, 25 bp, Homo sapien
ctgcatttgccagtttattcttttg

SEQ ID NO: 190498 - DNA, 25 bp, Homo sapien
tgtttcttttatctgactgactctg

SEQ ID NO: 190499 - DNA, 25 bp, Homo sapien
ctgactctgtcaaacaagtgtcaaa

SEQ ID NO: 190500 - DNA, 25 bp, Homo sapien
cctctgaaagttgatgcagcatttt

SEQ ID NO: 190501 - DNA, 25 bp, Homo sapien
gttgatgcagcatttttgcctttcc

SEQ ID NO: 190502 - DNA, 25 bp, Homo sapien
aagtatttatcctcactgctttttg

SEQ ID NO: 190503 - DNA, 25 bp, Homo sapien
gctttttgcagtacttgtattttca

SEQ ID NO: 190504 - DNA, 25 bp, Homo sapien
aaagggagtttgttatacacagtga

SEQ ID NO: 190505 - DNA, 25 bp, Homo sapien
gatgacaaacatctgaaaccccctc

SEQ ID NO: 190506 - DNA, 25 bp, Homo sapien
gacttgttatagctcagtgtgccct

SEQ ID NO: 190507 - DNA, 25 bp, Homo sapien
ttgttatagctcagtgtgcccttga

SEQ ID NO: 190508 - DNA, 25 bp, Homo sapien
agtgtgcccttgaatccatacagtt

SEQ ID NO: 190509 - DNA, 25 bp, Homo sapien
gtgcccttgaatccatacagtttct

SEQ ID NO: 190510 - DNA, 25 bp, Homo sapien
aatccatacagtttcttaaaagaca

SEQ ID NO: 190511 - DNA, 25 bp, Homo sapien
aaaatgccttttactgctaagtggg

SEQ ID NO: 190512 - DNA, 25 bp, Homo sapien
attgattgtacatcagtctcttcat

SEQ ID NO: 190513 - DNA, 25 bp, Homo sapien
gtacatcagtctcttcatatcacat

SEQ ID NO: 190514 - DNA, 25 bp, Homo sapien
gtctcttcatatcacatatacatgt

SEQ ID NO: 190515 - DNA, 25 bp, Homo sapien
taaggtttcaaaaactctttgacat

SEQ ID NO: 190516 - DNA, 25 bp, Homo sapien
aactctttgacattagatttcacaa

SEQ ID NO: 190517 - DNA, 25 bp, Homo sapien
ttagatttcacaactgcacaattga

SEQ ID NO: 190518 - DNA, 25 bp, Homo sapien
gcacaattgaacttattggcctgta

SEQ ID NO: 190519 - DNA, 25 bp, Homo sapien
gaacttattggcctgtaacttattt

SEQ ID NO: 190520 - DNA, 25 bp, Homo sapien
cttatttactaaatgctcagtgcta

SEQ ID NO: 190521 - DNA, 25 bp, Homo sapien
gctcagtgctatttatatactacag

SEQ ID NO: 190522 - DNA, 25 bp, Homo sapien
atttttggtgcccatgcagctgtag

SEQ ID NO: 190523 - DNA, 25 bp, Homo sapien
gcccatgcagctgtagttgttcact

SEQ ID NO: 190524 - DNA, 25 bp, Homo sapien
agttgttcactgctttcctggatgg

SEQ ID NO: 190525 - DNA, 25 bp, Homo sapien
ggatgggactcttatgtcataactt

SEQ ID NO: 190526 - DNA, 25 bp, Homo sapien
atgtcataacttctgttactccttt

SEQ ID NO: 190527 - DNA, 25 bp, Homo sapien
ctgttactcctttggcccatagcta

SEQ ID NO: 190528 - DNA, 25 bp, Homo sapien
tggcccatagctaaggtcatccttc

SEQ ID NO: 190529 - DNA, 25 bp, Homo sapien
ggatgatacagcttttgcttctgtg

SEQ ID NO: 190530 - DNA, 25 bp, Homo sapien
tttgcttctgtgtagtatacctgta

SEQ ID NO: 190531 - DNA, 25 bp, Homo sapien
gtacatacttgtttcaggcagcctt

SEQ ID NO: 190532 - DNA, 25 bp, Homo sapien
tcaggcagcctttctttaatgtttt

SEQ ID NO: 190533 - DNA, 25 bp, Homo sapien
aaatttcagtgaatagcaccttgac

SEQ ID NO: 190534 - DNA, 25 bp, Homo sapien
tagcaccttgacatctacaacttaa

SEQ ID NO: 190535 - DNA, 25 bp, Homo sapien
gtgatcgtgtgctttggaacagagt

SEQ ID NO: 190536 - DNA, 25 bp, Homo sapien
gatatattaaggtgttcctggtaat

SEQ ID NO: 190537 - DNA, 25 bp, Homo sapien
gtgttcctggtaatgaaggcatgta

SEQ ID NO: 190538 - DNA, 25 bp, Homo sapien
gttataataattgtagctttctgaa

SEQ ID NO: 190539 - DNA, 25 bp, Homo sapien
gtagctttctgaataagtgtcaaac

SEQ ID NO: 190540 - DNA, 25 bp, Homo sapien
atatctttaagtgtgctgtatgctg

SEQ ID NO: 190541 - DNA, 25 bp, Homo sapien
gtatgctgagttacaagttaggtca

SEQ ID NO: 190542 - DNA, 25 bp, Homo sapien
gagttacaagttaggtcatttatga

SEQ ID NO: 190543 - DNA, 25 bp, Homo sapien
aatgcttcaataacttatcttggta

SEQ ID NO: 190544 - DNA, 25 bp, Homo sapien
tcctgagttatgatccttgagtaat

SEQ ID NO: 190545 - DNA, 25 bp, Homo sapien
aatagttggttctgtgttgcaacat

SEQ ID NO: 190546 - DNA, 25 bp, Homo sapien
aacatatatctttagtgctgacact

SEQ ID NO: 190547 - DNA, 25 bp, Homo sapien
gacactaactttgtccaactctgtc

SEQ ID NO: 190548 - DNA, 25 bp, Homo sapien
tttgtccaactctgtctgtaagctg

SEQ ID NO: 190549 - DNA, 25 bp, Homo sapien
aagctggagcatttttctgatgcca

SEQ ID NO: 190550 - DNA, 25 bp, Homo sapien
ttctgatgccagctgaatattagag

SEQ ID NO: 190551 - DNA, 25 bp, Homo sapien
gatatttgtcttgtccacattgtga

SEQ ID NO: 190552 - DNA, 25 bp, Homo sapien
gagcaatcataaataagccaccctt

SEQ ID NO: 190553 - DNA, 25 bp, Homo sapien
aaataagccacccttctgattgtcg

SEQ ID NO: 190554 - DNA, 25 bp, Homo sapien
ccttctgattgtcgttctactgtat

SEQ ID NO: 190555 - DNA, 25 bp, Homo sapien
caggcagagcctggtgggtgattct

SEQ ID NO: 190556 - DNA, 25 bp, Homo sapien
ctggtgggtgattctgtcaacagaa

SEQ ID NO: 190557 - DNA, 25 bp, Homo sapien
ggtgggactagagggcaatactgaa

SEQ ID NO: 190558 - DNA, 25 bp, Homo sapien
aaacaggtttttgctcctcaagaat

SEQ ID NO: 190559 - DNA, 25 bp, Homo sapien
aggtttttgctcctcaagaatttgt

SEQ ID NO: 190560 - DNA, 25 bp, Homo sapien
caagaatttgtttgcctgggcccag

SEQ ID NO: 190561 - DNA, 25 bp, Homo sapien
ggcccaggattggagggcttcacac

SEQ ID NO: 190562 - DNA, 25 bp, Homo sapien
gagggcttcacaccaataccctgtg

SEQ ID NO: 190563 - DNA, 25 bp, Homo sapien
gcttcacaccaataccctgtgtata

SEQ ID NO: 190564 - DNA, 25 bp, Homo sapien
ataccctgtgtatacaagaatcaga

SEQ ID NO: 190565 - DNA, 25 bp, Homo sapien
tcagatttataatacttcccctttt

SEQ ID NO: 190566 - DNA, 25 bp, Homo sapien
caagtatgctactgtctccagaaca

SEQ ID NO: 190567 - DNA, 25 bp, Homo sapien
aagtatgctactgtctccagaacac

SEQ ID NO: 190568 - DNA, 25 bp, Homo sapien
agtatgctactgtctccagaacacg

SEQ ID NO: 190569 - DNA, 25 bp, Homo sapien
gtatgctactgtctccagaacacga

SEQ ID NO: 190570 - DNA, 25 bp, Homo sapien
tatgctactgtctccagaacacgaa

SEQ ID NO: 190571 - DNA, 25 bp, Homo sapien
atgctactgtctccagaacacgaaa

SEQ ID NO: 190572 - DNA, 25 bp, Homo sapien
tgctactgtctccagaacacgaaaa

SEQ ID NO: 190573 - DNA, 25 bp, Homo sapien
gctactgtctccagaacacgaaaat

SEQ ID NO: 190574 - DNA, 25 bp, Homo sapien
tactgtctccagaacacgaaaatga

SEQ ID NO: 190575 - DNA, 25 bp, Homo sapien
actgtctccagaacacgaaaatgat

SEQ ID NO: 190576 - DNA, 25 bp, Homo sapien
gtctccagaacacgaaaatgatagg

SEQ ID NO: 190577 - DNA, 25 bp, Homo sapien
catttagttgagcagtttttgacca

SEQ ID NO: 190578 - DNA, 25 bp, Homo sapien
gagcagtttttgaccaagaatcaga

SEQ ID NO: 190579 - DNA, 25 bp, Homo sapien
gggtacatttattgctttaatctgc

SEQ ID NO: 190580 - DNA, 25 bp, Homo sapien
tgctttaatctgcactcattgaagt

SEQ ID NO: 190581 - DNA, 25 bp, Homo sapien
atctgcactcattgaagtcatttat

SEQ ID NO: 190582 - DNA, 25 bp, Homo sapien
attaccatatactacagctttgtgg

SEQ ID NO: 190583 - DNA, 25 bp, Homo sapien
agctttgtggtaggccattattttc

SEQ ID NO: 190584 - DNA, 25 bp, Homo sapien
catttttggctcttcagaaacttga

SEQ ID NO: 190585 - DNA, 25 bp, Homo sapien
gaatacttaagcttgtacatgatct

SEQ ID NO: 190586 - DNA, 25 bp, Homo sapien
gcttgtacatgatcttgtgttttgc

SEQ ID NO: 190587 - DNA, 25 bp, Homo sapien
gtgttttgctatcctttttactgta

SEQ ID NO: 190588 - DNA, 25 bp, Homo sapien
aatgacacgtcagtgggaaagagct

SEQ ID NO: 190589 - DNA, 25 bp, Homo sapien
atgacacgtcagtgggaaagagctc

SEQ ID NO: 190590 - DNA, 25 bp, Homo sapien
tgacacgtcagtgggaaagagctca

SEQ ID NO: 190591 - DNA, 25 bp, Homo sapien
acacgtcagtgggaaagagctcaag

SEQ ID NO: 190592 - DNA, 25 bp, Homo sapien
cacgtcagtgggaaagagctcaaga

SEQ ID NO: 190593 - DNA, 25 bp, Homo sapien
acgtcagtgggaaagagctcaagag

SEQ ID NO: 190594 - DNA, 25 bp, Homo sapien
cgtcagtgggaaagagctcaagaga

SEQ ID NO: 190595 - DNA, 25 bp, Homo sapien
gctgctgggactgggttcattctca

SEQ ID NO: 190596 - DNA, 25 bp, Homo sapien
tgctgggactgggttcattctcatg

SEQ ID NO: 190597 - DNA, 25 bp, Homo sapien
gctgggactgggttcattctcatga

SEQ ID NO: 190598 - DNA, 25 bp, Homo sapien
ctgggactgggttcattctcatgac

SEQ ID NO: 190599 - DNA, 25 bp, Homo sapien
ttcaagcctattttatttgtacctg

SEQ ID NO: 190600 - DNA, 25 bp, Homo sapien
tcaagcctattttatttgtacctgt

SEQ ID NO: 190601 - DNA, 25 bp, Homo sapien
gcctattttatttgtacctgtaaat

SEQ ID NO: 190602 - DNA, 25 bp, Homo sapien
tgtaaatactgtacagctaatatat

SEQ ID NO: 190603 - DNA, 25 bp, Homo sapien
gtgtgtttatagagatacacacaca

SEQ ID NO: 190604 - DNA, 25 bp, Homo sapien
tatacacacacgcatttgcacagac

SEQ ID NO: 190605 - DNA, 25 bp, Homo sapien
acacacgcatttgcacagacacaca

SEQ ID NO: 190606 - DNA, 25 bp, Homo sapien
tatcaattctcatgagtgtattata

SEQ ID NO: 190607 - DNA, 25 bp, Homo sapien
tgagtgtattataatctctggtggg

SEQ ID NO: 190608 - DNA, 25 bp, Homo sapien
ataatctctggtgggggcaagtgtc

SEQ ID NO: 190609 - DNA, 25 bp, Homo sapien
gagaggtagggagccaggtgcagca

SEQ ID NO: 190610 - DNA, 25 bp, Homo sapien
aaagagtccccatgcacttggagtc

SEQ ID NO: 190611 - DNA, 25 bp, Homo sapien
atgcacttggagtccatgagccaat

SEQ ID NO: 190612 - DNA, 25 bp, Homo sapien
gccaatgggatatgcaaagacgctt

SEQ ID NO: 190613 - DNA, 25 bp, Homo sapien
gacgcttaaacatttcagggctggt

SEQ ID NO: 190614 - DNA, 25 bp, Homo sapien
ggtttctctgttcatatccaattct

SEQ ID NO: 190615 - DNA, 25 bp, Homo sapien
atccaattctggtgcttaggaacag

SEQ ID NO: 190616 - DNA, 25 bp, Homo sapien
ggacccatgctgatgcccaagggca

SEQ ID NO: 190617 - DNA, 25 bp, Homo sapien
tgcccaagggcaaaaagccccactt

SEQ ID NO: 190618 - DNA, 25 bp, Homo sapien
taaggaagtgaacaggcctgaccct

SEQ ID NO: 190619 - DNA, 25 bp, Homo sapien
gcctgaccctgatgcccaataacgg

SEQ ID NO: 190620 - DNA, 25 bp, Homo sapien
gccttgtgctgcgtttgtttacaaa

SEQ ID NO: 190621 - DNA, 25 bp, Homo sapien
ggctcctgaaacacctcgttttgaa

SEQ ID NO: 190622 - DNA, 25 bp, Homo sapien
ggtgaatctttggttttctcccaga

SEQ ID NO: 190623 - DNA, 25 bp, Homo sapien
tttctcccagaagagggtctgcctt

SEQ ID NO: 190624 - DNA, 25 bp, Homo sapien
gccttgagatgattggagctcttac

SEQ ID NO: 190625 - DNA, 25 bp, Homo sapien
ggagctcttaccatcaaaatcagtt

SEQ ID NO: 190626 - DNA, 25 bp, Homo sapien
tcagttattcaagtgcttgcccagt

SEQ ID NO: 190627 - DNA, 25 bp, Homo sapien
cttgcccagtgcttcttgaaactca

SEQ ID NO: 190628 - DNA, 25 bp, Homo sapien
ttgaaactcacctctactctgtatt

SEQ ID NO: 190629 - DNA, 25 bp, Homo sapien
actcacctctactctgtattttcta

SEQ ID NO: 190630 - DNA, 25 bp, Homo sapien
gtattttctacagttggttcttgtg

SEQ ID NO: 190631 - DNA, 25 bp, Homo sapien
atgcttacctaggattctcattata

SEQ ID NO: 190632 - DNA, 25 bp, Homo sapien
tttagcacaggtgccagggctcctg

SEQ ID NO: 190633 - DNA, 25 bp, Homo sapien
tcctcctgtgttagctctgtgaagt

SEQ ID NO: 190634 - DNA, 25 bp, Homo sapien
gtgttagctctgtgaagttcattta

SEQ ID NO: 190635 - DNA, 25 bp, Homo sapien
tttattatagcaacctcagaaaaga

SEQ ID NO: 190636 - DNA, 25 bp, Homo sapien
ctcattcatagtctcagttacccag

SEQ ID NO: 190637 - DNA, 25 bp, Homo sapien
cagttacccagataacctcggttgt

SEQ ID NO: 190638 - DNA, 25 bp, Homo sapien
gataacctcggttgtcaccttggag

SEQ ID NO: 190639 - DNA, 25 bp, Homo sapien
ggttgtcaccttggagtatcttgtt

SEQ ID NO: 190640 - DNA, 25 bp, Homo sapien
gagtatcttgttgtagtccctttac

SEQ ID NO: 190641 - DNA, 25 bp, Homo sapien
gttgtagtccctttactatgtgtat

SEQ ID NO: 190642 - DNA, 25 bp, Homo sapien
agtccctttactatgtgtatgtata

SEQ ID NO: 190643 - DNA, 25 bp, Homo sapien
gggctgaatgtagccttttcaacag

SEQ ID NO: 190644 - DNA, 25 bp, Homo sapien
aatgtagccttttcaacagagaagg

SEQ ID NO: 190645 - DNA, 25 bp, Homo sapien
agaaggctcccacttgagagcagcc

SEQ ID NO: 190646 - DNA, 25 bp, Homo sapien
ggctcccacttgagagcagcctcta

SEQ ID NO: 190647 - DNA, 25 bp, Homo sapien
ccacttgagagcagcctctacctga

SEQ ID NO: 190648 - DNA, 25 bp, Homo sapien
cgcttcttcagctaaaactccaaag

SEQ ID NO: 190649 - DNA, 25 bp, Homo sapien
tcagctaaaactccaaaggtttggt

SEQ ID NO: 190650 - DNA, 25 bp, Homo sapien
tgggtcattgcggtcttagattatg

SEQ ID NO: 190651 - DNA, 25 bp, Homo sapien
gtcattgcggtcttagattatgttt

SEQ ID NO: 190652 - DNA, 25 bp, Homo sapien
ttgctaccaaacagtcatgtattaa

SEQ ID NO: 190653 - DNA, 25 bp, Homo sapien
acagtcatgtattaactctctttgg

SEQ ID NO: 190654 - DNA, 25 bp, Homo sapien
agagcttgaagcagatggaatttta

SEQ ID NO: 190655 - DNA, 25 bp, Homo sapien
atagttacactatatatgctcttag

SEQ ID NO: 190656 - DNA, 25 bp, Homo sapien
tatatatgctcttagtaggtttttt

SEQ ID NO: 190657 - DNA, 25 bp, Homo sapien
gtagtggaaacataactgttagcat

SEQ ID NO: 190658 - DNA, 25 bp, Homo sapien
taactgttagcatatttcttaggat

SEQ ID NO: 190659 - DNA, 25 bp, Homo sapien
atatttcttaggatgttttttcttg

SEQ ID NO: 190660 - DNA, 25 bp, Homo sapien
ttcttatttcactcatcctttactc

SEQ ID NO: 190661 - DNA, 25 bp, Homo sapien
atcctttactctcccctcaagtatt

SEQ ID NO: 190662 - DNA, 25 bp, Homo sapien
tcccctcaagtattctacactttaa

SEQ ID NO: 190663 - DNA, 25 bp, Homo sapien
agtattctacactttaatttcctga

SEQ ID NO: 190664 - DNA, 25 bp, Homo sapien
aagaagtaggaatgggtgcagcaca

SEQ ID NO: 190665 - DNA, 25 bp, Homo sapien
tttgtaatagatcagtaccatttat

SEQ ID NO: 190666 - DNA, 25 bp, Homo sapien
gacttgtcccttttaaagcaaaatg

SEQ ID NO: 190667 - DNA, 25 bp, Homo sapien
gaagggacttataatttctgttgtt

SEQ ID NO: 190668 - DNA, 25 bp, Homo sapien
ttgtttctaattaaagtccctgaag

SEQ ID NO: 190669 - DNA, 25 bp, Homo sapien
gtccctgaagatcatataccaaagt

SEQ ID NO: 190670 - DNA, 25 bp, Homo sapien
caaagtgtttgagaacttcatccaa

SEQ ID NO: 190671 - DNA, 25 bp, Homo sapien
ttcatccaaacctactttaaagcat

SEQ ID NO: 190672 - DNA, 25 bp, Homo sapien
aaagcattatgtgcaattaagttgt

SEQ ID NO: 190673 - DNA, 25 bp, Homo sapien
tatattgcctaattgttgggtcttt

SEQ ID NO: 190674 - DNA, 25 bp, Homo sapien
ttgttgggtcttttttcttgagctt

SEQ ID NO: 190675 - DNA, 25 bp, Homo sapien
cttgagcttataatgtacctggaaa

SEQ ID NO: 190676 - DNA, 25 bp, Homo sapien
attcctcaagtctgggtggtgacaa

SEQ ID NO: 190677 - DNA, 25 bp, Homo sapien
gctaggtactggactaccacaggtt

SEQ ID NO: 190678 - DNA, 25 bp, Homo sapien
tactggactaccacaggtttttagg

SEQ ID NO: 190679 - DNA, 25 bp, Homo sapien
ggaactaaggtgtttctcataaaca

SEQ ID NO: 190680 - DNA, 25 bp, Homo sapien
aactgggaacaactactcagaagct

SEQ ID NO: 190681 - DNA, 25 bp, Homo sapien
cagagctgttgcacagacagagatt

SEQ ID NO: 190682 - DNA, 25 bp, Homo sapien
gcacagacagagattgtacttggta

SEQ ID NO: 190683 - DNA, 25 bp, Homo sapien
cagagattgtacttggtaagatacc

SEQ ID NO: 190684 - DNA, 25 bp, Homo sapien
ggtaagataccaaacaagacagata

SEQ ID NO: 190685 - DNA, 25 bp, Homo sapien
aatgtgttctatgggtttcaattct

SEQ ID NO: 190686 - DNA, 25 bp, Homo sapien
gtgttctatgggtttcaattctgaa

SEQ ID NO: 190687 - DNA, 25 bp, Homo sapien
acccgcatgttgcttggtctgctca

SEQ ID NO: 190688 - DNA, 25 bp, Homo sapien
ttgcttggtctgctcaagtcggagt

SEQ ID NO: 190689 - DNA, 25 bp, Homo sapien
ggtctgctcaagtcggagtcaggtt

SEQ ID NO: 190690 - DNA, 25 bp, Homo sapien
tcggagtcaggtttcagtgtctttt

SEQ ID NO: 190691 - DNA, 25 bp, Homo sapien
gtctcctaagcatgctgactgcatc

SEQ ID NO: 190692 - DNA, 25 bp, Homo sapien
atgctgactgcatccgaaaggcccc

SEQ ID NO: 190693 - DNA, 25 bp, Homo sapien
acatatgtgtgtacacgcgcacgcc

SEQ ID NO: 190694 - DNA, 25 bp, Homo sapien
gtgtacacgcgcacgcctgtatgtg

SEQ ID NO: 190695 - DNA, 25 bp, Homo sapien
tgtgcgctgccctcagacatgcaag

SEQ ID NO: 190696 - DNA, 25 bp, Homo sapien
gctgccctcagacatgcaagtgaaa

SEQ ID NO: 190697 - DNA, 25 bp, Homo sapien
ttctgtgtaaatgcactttcttcct

SEQ ID NO: 190698 - DNA, 25 bp, Homo sapien
attatttattctggagccacagccc

SEQ ID NO: 190699 - DNA, 25 bp, Homo sapien
ccccttgcttatgaggttcttatgg

SEQ ID NO: 190700 - DNA, 25 bp, Homo sapien
aatagggcaccatggtccggtggtt

SEQ ID NO: 190701 - DNA, 25 bp, Homo sapien
catggtccggtggtttgtagttcct

SEQ ID NO: 190702 - DNA, 25 bp, Homo sapien
tgtagttccttcaaagtcaggcact

SEQ ID NO: 190703 - DNA, 25 bp, Homo sapien
ttcaaagtcaggcactgggagctag

SEQ ID NO: 190704 - DNA, 25 bp, Homo sapien
tagaggagtctcaagctccccttag

SEQ ID NO: 190705 - DNA, 25 bp, Homo sapien
gctccccttaggaagaactggtgcc

SEQ ID NO: 190706 - DNA, 25 bp, Homo sapien
aggtcctgacctgtgcaataaggat

SEQ ID NO: 190707 - DNA, 25 bp, Homo sapien
gtgcaataaggattgttccctgcga

SEQ ID NO: 190708 - DNA, 25 bp, Homo sapien
attgttccctgcgaagttttgttgg

SEQ ID NO: 190709 - DNA, 25 bp, Homo sapien
atatgttaagcagcatactcttctg

SEQ ID NO: 190710 - DNA, 25 bp, Homo sapien
agcagcatactcttctgatttttat

SEQ ID NO: 190711 - DNA, 25 bp, Homo sapien
ctgatttttattgcaatcttttacc

SEQ ID NO: 190712 - DNA, 25 bp, Homo sapien
agtggtgcacaaacttggtattgat

SEQ ID NO: 190713 - DNA, 25 bp, Homo sapien
ggtattgatgtctttattccatttt

SEQ ID NO: 190714 - DNA, 25 bp, Homo sapien
tgtctttattccattttgagtttag

SEQ ID NO: 190715 - DNA, 25 bp, Homo sapien
attttctgaaggcagagatatctac

SEQ ID NO: 190716 - DNA, 25 bp, Homo sapien
gatatctactgtataattgcaccaa

SEQ ID NO: 190717 - DNA, 25 bp, Homo sapien
gtataattgcaccaaagtacatttg

SEQ ID NO: 190718 - DNA, 25 bp, Homo sapien
ttcaatagtgtaatactgcagcgat

SEQ ID NO: 190719 - DNA, 25 bp, Homo sapien
actgcagcgatgtagataaaatcac

SEQ ID NO: 190720 - DNA, 25 bp, Homo sapien
cagttggctgggtgtttaatagtca

SEQ ID NO: 190721 - DNA, 25 bp, Homo sapien
taatagtcactgaaaactcccagcc

SEQ ID NO: 190722 - DNA, 25 bp, Homo sapien
agccctgctgcacactagaggcagg

SEQ ID NO: 190723 - DNA, 25 bp, Homo sapien
tagaggcaggtcctctcggtcctct

SEQ ID NO: 190724 - DNA, 25 bp, Homo sapien
gaggagagagacatacaaggacagt

SEQ ID NO: 190725 - DNA, 25 bp, Homo sapien
acagtgggtcatgggtagtaccagc

SEQ ID NO: 190726 - DNA, 25 bp, Homo sapien
ggtcatgggtagtaccagcctcaaa

SEQ ID NO: 190727 - DNA, 25 bp, Homo sapien
atgggtagtaccagcctcaaattcc

SEQ ID NO: 190728 - DNA, 25 bp, Homo sapien
agtaccagcctcaaattcccacagg

SEQ ID NO: 190729 - DNA, 25 bp, Homo sapien
aggctcatactcagacaattgtatt

SEQ ID NO: 190730 - DNA, 25 bp, Homo sapien
gacaattgtattactgccttatgtt

SEQ ID NO: 190731 - DNA, 25 bp, Homo sapien
ggacaagtccatcctcgtcatccag

SEQ ID NO: 190732 - DNA, 25 bp, Homo sapien
caggccccagcgagtcatcgaggac

SEQ ID NO: 190733 - DNA, 25 bp, Homo sapien
agtcatcgaggaccgcgactctcaa

SEQ ID NO: 190734 - DNA, 25 bp, Homo sapien
gcgactctcaactccgaagtcaagc

SEQ ID NO: 190735 - DNA, 25 bp, Homo sapien
cgcactctgattacctttgctggaa

SEQ ID NO: 190736 - DNA, 25 bp, Homo sapien
ggaatgataccataccgaacgtctg

SEQ ID NO: 190737 - DNA, 25 bp, Homo sapien
ctggtgcagatggaggtcctcatga

SEQ ID NO: 190738 - DNA, 25 bp, Homo sapien
ggaggtcctcatgaattaagtgcca

SEQ ID NO: 190739 - DNA, 25 bp, Homo sapien
taagtgccatgctttgtgggagtct

SEQ ID NO: 190740 - DNA, 25 bp, Homo sapien
agtctgggtcggcacactgtcagta

SEQ ID NO: 190741 - DNA, 25 bp, Homo sapien
tgtcagtacatcaggcacatgggcc

SEQ ID NO: 190742 - DNA, 25 bp, Homo sapien
tcagctttctcgcaagataacatct

SEQ ID NO: 190743 - DNA, 25 bp, Homo sapien
aatctacagagatcttccaagccca

SEQ ID NO: 190744 - DNA, 25 bp, Homo sapien
aaggtatcatgcagcccctaggaaa

SEQ ID NO: 190745 - DNA, 25 bp, Homo sapien
agaggactcctccatgtaccgagag

SEQ ID NO: 190746 - DNA, 25 bp, Homo sapien
taccgagagtacatcaggaaccgct

SEQ ID NO: 190747 - DNA, 25 bp, Homo sapien
aaagagcgcaggtccacctggtgga

SEQ ID NO: 190748 - DNA, 25 bp, Homo sapien
cctggtggacacgtctgattagctt

SEQ ID NO: 190749 - DNA, 25 bp, Homo sapien
gattagcttagaacctgtcttgtct

SEQ ID NO: 190750 - DNA, 25 bp, Homo sapien
acctgtcttgtctcatcttcaaaag

SEQ ID NO: 190751 - DNA, 25 bp, Homo sapien
taaaagtcctttgcgtctgaagcct

SEQ ID NO: 190752 - DNA, 25 bp, Homo sapien
tgaagcctttctccttttctgtcat

SEQ ID NO: 190753 - DNA, 25 bp, Homo sapien
tttgaaatatagtctctgcttacga

SEQ ID NO: 190754 - DNA, 25 bp, Homo sapien
ttgaaatatagtctctgcttacgaa

SEQ ID NO: 190755 - DNA, 25 bp, Homo sapien
tgaaatatagtctctgcttacgaat

SEQ ID NO: 190756 - DNA, 25 bp, Homo sapien
gaaatatagtctctgcttacgaatg

SEQ ID NO: 190757 - DNA, 25 bp, Homo sapien
aaatatagtctctgcttacgaatgt

SEQ ID NO: 190758 - DNA, 25 bp, Homo sapien
aatatagtctctgcttacgaatgtc

SEQ ID NO: 190759 - DNA, 25 bp, Homo sapien
atatagtctctgcttacgaatgtca

SEQ ID NO: 190760 - DNA, 25 bp, Homo sapien
tatagtctctgcttacgaatgtcat

SEQ ID NO: 190761 - DNA, 25 bp, Homo sapien
atagtctctgcttacgaatgtcata

SEQ ID NO: 190762 - DNA, 25 bp, Homo sapien
ttttatgatagggaagatgcggcca

SEQ ID NO: 190763 - DNA, 25 bp, Homo sapien
agatgcggccatcactgggatattt

SEQ ID NO: 190764 - DNA, 25 bp, Homo sapien
ggatattttcaaatcccaaggacat

SEQ ID NO: 190765 - DNA, 25 bp, Homo sapien
atcccaaggacatcagagtgaagtg

SEQ ID NO: 190766 - DNA, 25 bp, Homo sapien
cagagtgaagtgtcagttgtcagat

SEQ ID NO: 190767 - DNA, 25 bp, Homo sapien
agtgtcagttgtcagatgattttaa

SEQ ID NO: 190768 - DNA, 25 bp, Homo sapien
taaaagttatgtcttcagagaaaaa

SEQ ID NO: 190769 - DNA, 25 bp, Homo sapien
ttaagccaattaaatattctgagtg

SEQ ID NO: 190770 - DNA, 25 bp, Homo sapien
gagactaatcactcatttgcctacg

SEQ ID NO: 190771 - DNA, 25 bp, Homo sapien
actaatcactcatttgcctacgacc

SEQ ID NO: 190772 - DNA, 25 bp, Homo sapien
acgcttaatctaaatttgcattgac

SEQ ID NO: 190773 - DNA, 25 bp, Homo sapien
tcaggttactaacaaaatttcgtag

SEQ ID NO: 190774 - DNA, 25 bp, Homo sapien
aaatttcgtagctaaagaatgccat

SEQ ID NO: 190775 - DNA, 25 bp, Homo sapien
aatttcgtagctaaagaatgccatg

SEQ ID NO: 190776 - DNA, 25 bp, Homo sapien
atttcgtagctaaagaatgccatgg

SEQ ID NO: 190777 - DNA, 25 bp, Homo sapien
tttcgtagctaaagaatgccatggc

SEQ ID NO: 190778 - DNA, 25 bp, Homo sapien
ttcgtagctaaagaatgccatggcc

SEQ ID NO: 190779 - DNA, 25 bp, Homo sapien
tcgtagctaaagaatgccatggccg

SEQ ID NO: 190780 - DNA, 25 bp, Homo sapien
cgtagctaaagaatgccatggccgg

SEQ ID NO: 190781 - DNA, 25 bp, Homo sapien
gtagctaaagaatgccatggccggg

SEQ ID NO: 190782 - DNA, 25 bp, Homo sapien
tagctaaagaatgccatggccgggt

SEQ ID NO: 190783 - DNA, 25 bp, Homo sapien
gctaaagaatgccatggccgggtgc

SEQ ID NO: 190784 - DNA, 25 bp, Homo sapien
gtaattcttcaaatgagactcttct

SEQ ID NO: 190785 - DNA, 25 bp, Homo sapien
tgagactcttctcaccttaaatagt

SEQ ID NO: 190786 - DNA, 25 bp, Homo sapien
ctcttctcaccttaaatagtcatat

SEQ ID NO: 190787 - DNA, 25 bp, Homo sapien
tagctgttttaaaaggtaccagatg

SEQ ID NO: 190788 - DNA, 25 bp, Homo sapien
aaggtaccagatgtaagagtcataa

SEQ ID NO: 190789 - DNA, 25 bp, Homo sapien
tgtgttatatggagacatgtcttgt

SEQ ID NO: 190790 - DNA, 25 bp, Homo sapien
atatggagacatgtcttgtaaacag

SEQ ID NO: 190791 - DNA, 25 bp, Homo sapien
gtagttaatgtactcactgtggagg

SEQ ID NO: 190792 - DNA, 25 bp, Homo sapien
aatgtactcactgtggaggtcataa

SEQ ID NO: 190793 - DNA, 25 bp, Homo sapien
cactgtggaggtcataaggaagcta

SEQ ID NO: 190794 - DNA, 25 bp, Homo sapien
gaggtcataaggaagctactttttt

SEQ ID NO: 190795 - DNA, 25 bp, Homo sapien
tcctcaccggcccttccgcggttca

SEQ ID NO: 190796 - DNA, 25 bp, Homo sapien
ggcccttccgcggttcagccgcaga

SEQ ID NO: 190797 - DNA, 25 bp, Homo sapien
gcccttccgcggttcagccgcagac

SEQ ID NO: 190798 - DNA, 25 bp, Homo sapien
cccttccgcggttcagccgcagacg

SEQ ID NO: 190799 - DNA, 25 bp, Homo sapien
cttccgcggttcagccgcagacgcg

SEQ ID NO: 190800 - DNA, 25 bp, Homo sapien
ttccgcggttcagccgcagacgcgt

SEQ ID NO: 190801 - DNA, 25 bp, Homo sapien
tccgcggttcagccgcagacgcgtg

SEQ ID NO: 190802 - DNA, 25 bp, Homo sapien
cggttcagccgcagacgcgtgccct

SEQ ID NO: 190803 - DNA, 25 bp, Homo sapien
ggttcagccgcagacgcgtgccctc

SEQ ID NO: 190804 - DNA, 25 bp, Homo sapien
agacgcgtgccctcctgaaacacag

SEQ ID NO: 190805 - DNA, 25 bp, Homo sapien
gacgcgtgccctcctgaaacacagg

SEQ ID NO: 190806 - DNA, 25 bp, Homo sapien
gtgtgggtgtgatacagcctacata

SEQ ID NO: 190807 - DNA, 25 bp, Homo sapien
gactgttatgatcgctttgatttta

SEQ ID NO: 190808 - DNA, 25 bp, Homo sapien
gttcattggaactaccaacttgttt

SEQ ID NO: 190809 - DNA, 25 bp, Homo sapien
caacttgtttctaaagagctatctt

SEQ ID NO: 190810 - DNA, 25 bp, Homo sapien
gagctatcttaagaccaatatctct

SEQ ID NO: 190811 - DNA, 25 bp, Homo sapien
gaatctaaatcaagcccatctgtca

SEQ ID NO: 190812 - DNA, 25 bp, Homo sapien
agcccatctgtcattatgttactgt

SEQ ID NO: 190813 - DNA, 25 bp, Homo sapien
actttcttagattcacttccatatg

SEQ ID NO: 190814 - DNA, 25 bp, Homo sapien
cttccatatgtgaatgtaagctctt

SEQ ID NO: 190815 - DNA, 25 bp, Homo sapien
gtaagctcttaactatgtctctttg

SEQ ID NO: 190816 - DNA, 25 bp, Homo sapien
aactatgtctctttgtaatgtgtaa

SEQ ID NO: 190817 - DNA, 25 bp, Homo sapien
attctgagttttccaattgttgaac

SEQ ID NO: 190818 - DNA, 25 bp, Homo sapien
attgttgaacatggtgtactgcccc

SEQ ID NO: 190819 - DNA, 25 bp, Homo sapien
gtgtactgccccatttatttagatc

SEQ ID NO: 190820 - DNA, 25 bp, Homo sapien
tgttaatttctctcagtttgcagct

SEQ ID NO: 190821 - DNA, 25 bp, Homo sapien
gtttgcagctctcacattttgttaa

SEQ ID NO: 190822 - DNA, 25 bp, Homo sapien
ttctgcatgctattgcaagtggtaa

SEQ ID NO: 190823 - DNA, 25 bp, Homo sapien
gctattgcaagtggtaaggttttca

SEQ ID NO: 190824 - DNA, 25 bp, Homo sapien
gcattagacttgtacattgatcttg

SEQ ID NO: 190825 - DNA, 25 bp, Homo sapien
tcttgtatcaagcaacttagatcag

SEQ ID NO: 190826 - DNA, 25 bp, Homo sapien
gatcagttaacttattctagtagct

SEQ ID NO: 190827 - DNA, 25 bp, Homo sapien
gtagcttttttctagattctttagc

SEQ ID NO: 190828 - DNA, 25 bp, Homo sapien
gaagtcagtagtgcctgcaggtgaa

SEQ ID NO: 190829 - DNA, 25 bp, Homo sapien
agtgcctgcaggtgaaaccaaccag

SEQ ID NO: 190830 - DNA, 25 bp, Homo sapien
aaccaaccagccctgtgttagagga

SEQ ID NO: 190831 - DNA, 25 bp, Homo sapien
gacatggaagtctccaagcctgtgc

SEQ ID NO: 190832 - DNA, 25 bp, Homo sapien
gcacaaggtgctatctacttttctc

SEQ ID NO: 190833 - DNA, 25 bp, Homo sapien
gattatcatttatgtgctgttgcac

SEQ ID NO: 190834 - DNA, 25 bp, Homo sapien
tgctgttgcacagtgaaacctcacc

SEQ ID NO: 190835 - DNA, 25 bp, Homo sapien
aaacctcacctgtgtgggcgtgaaa

SEQ ID NO: 190836 - DNA, 25 bp, Homo sapien
ttggcattgtttttgattcagcttt

SEQ ID NO: 190837 - DNA, 25 bp, Homo sapien
tggatggctaattgttttcactgtg

SEQ ID NO: 190838 - DNA, 25 bp, Homo sapien
ttcactgtgctgtgggaatgcctct

SEQ ID NO: 190839 - DNA, 25 bp, Homo sapien
atgttctttaactatatactatgta

SEQ ID NO: 190840 - DNA, 25 bp, Homo sapien
tactatgtaacagggtaaacagtgt

SEQ ID NO: 190841 - DNA, 25 bp, Homo sapien
cagggtaaacagtgttatgtagaat

SEQ ID NO: 190842 - DNA, 25 bp, Homo sapien
gtgtaaactagatctttagagaagt

SEQ ID NO: 190843 - DNA, 25 bp, Homo sapien
tagagaagttgccattgagcaaagt

SEQ ID NO: 190844 - DNA, 25 bp, Homo sapien
gttgccattgagcaaagttatttaa

SEQ ID NO: 190845 - DNA, 25 bp, Homo sapien
aatgagttagttgagttggatgaga

SEQ ID NO: 190846 - DNA, 25 bp, Homo sapien
gttgagttggatgagaattgtttga

SEQ ID NO: 190847 - DNA, 25 bp, Homo sapien
gaattgtttgaggtttgttgctaga

SEQ ID NO: 190848 - DNA, 25 bp, Homo sapien
tgtttgaggtttgttgctagagaac

SEQ ID NO: 190849 - DNA, 25 bp, Homo sapien
aacatcatagtgtatagaaaactga

SEQ ID NO: 190850 - DNA, 25 bp, Homo sapien
tgaccttcactgacagctcctagtg

SEQ ID NO: 190851 - DNA, 25 bp, Homo sapien
tgacagctcctagtggaagcccaag

SEQ ID NO: 190852 - DNA, 25 bp, Homo sapien
agtggaagcccaagggcctctgaaa

SEQ ID NO: 190853 - DNA, 25 bp, Homo sapien
caagggcctctgaaagcctcctgct

SEQ ID NO: 190854 - DNA, 25 bp, Homo sapien
tgtagcgggtactggttcctgtgtc

SEQ ID NO: 190855 - DNA, 25 bp, Homo sapien
tactggttcctgtgtcttagggcac

SEQ ID NO: 190856 - DNA, 25 bp, Homo sapien
gtgtcttagggcacaagccttagca

SEQ ID NO: 190857 - DNA, 25 bp, Homo sapien
aagccttagcaaatgattgattctc

SEQ ID NO: 190858 - DNA, 25 bp, Homo sapien
gcaaatgattgattctccctggaca

SEQ ID NO: 190859 - DNA, 25 bp, Homo sapien
gattgattctccctggacaaagcag

SEQ ID NO: 190860 - DNA, 25 bp, Homo sapien
gattctccctggacaaagcaggaaa

SEQ ID NO: 190861 - DNA, 25 bp, Homo sapien
atcagatgttaattcctgtgactga

SEQ ID NO: 190862 - DNA, 25 bp, Homo sapien
tcagatgttaattcctgtgactgac

SEQ ID NO: 190863 - DNA, 25 bp, Homo sapien
cagatgttaattcctgtgactgact

SEQ ID NO: 190864 - DNA, 25 bp, Homo sapien
gatgttaattcctgtgactgactga

SEQ ID NO: 190865 - DNA, 25 bp, Homo sapien
tcctgtgactgactgaatatagaaa

SEQ ID NO: 190866 - DNA, 25 bp, Homo sapien
cctgtgactgactgaatatagaaag

SEQ ID NO: 190867 - DNA, 25 bp, Homo sapien
gtgactgactgaatatagaaaggta

SEQ ID NO: 190868 - DNA, 25 bp, Homo sapien
ctgactgaatatagaaaggtaacct

SEQ ID NO: 190869 - DNA, 25 bp, Homo sapien
gaaaggtaacctaaggctgggcacg

SEQ ID NO: 190870 - DNA, 25 bp, Homo sapien
gcctatagtcctggcactttgagtg

SEQ ID NO: 190871 - DNA, 25 bp, Homo sapien
agtcctggcactttgagtggctgag

SEQ ID NO: 190872 - DNA, 25 bp, Homo sapien
ttctgtaccaagtactggagaaaaa

SEQ ID NO: 190873 - DNA, 25 bp, Homo sapien
aaaagcatcaagttcttagcccttg

SEQ ID NO: 190874 - DNA, 25 bp, Homo sapien
aagttcttagcccttgtagcttcta

SEQ ID NO: 190875 - DNA, 25 bp, Homo sapien
ttgtagcttctaccctagtttccca

SEQ ID NO: 190876 - DNA, 25 bp, Homo sapien
gtggaggccaaaccaactctttgcc

SEQ ID NO: 190877 - DNA, 25 bp, Homo sapien
aggccaaaccaactctttgccagca

SEQ ID NO: 190878 - DNA, 25 bp, Homo sapien
tttgccagcagccacaacatgcatt

SEQ ID NO: 190879 - DNA, 25 bp, Homo sapien
caacatgcattgacagcggcacagt

SEQ ID NO: 190880 - DNA, 25 bp, Homo sapien
attgacagcggcacagtgagatata

SEQ ID NO: 190881 - DNA, 25 bp, Homo sapien
gtgagatataactgatgggctttga

SEQ ID NO: 190882 - DNA, 25 bp, Homo sapien
caggatgtttttcactgtccattgc

SEQ ID NO: 190883 - DNA, 25 bp, Homo sapien
ttaatttctgtttgtatcagtagaa

SEQ ID NO: 190884 - DNA, 25 bp, Homo sapien
atcagtagaattaaggtagttggac

SEQ ID NO: 190885 - DNA, 25 bp, Homo sapien
aaggtagttggacttcatctataga

SEQ ID NO: 190886 - DNA, 25 bp, Homo sapien
gtagttggacttcatctatagatgc

SEQ ID NO: 190887 - DNA, 25 bp, Homo sapien
atctatagatgcacagttccctttg

SEQ ID NO: 190888 - DNA, 25 bp, Homo sapien
ctatagatgcacagttccctttgtt

SEQ ID NO: 190889 - DNA, 25 bp, Homo sapien
atagatgcacagttccctttgtttt

SEQ ID NO: 190890 - DNA, 25 bp, Homo sapien
ttgctttgctgctagacttgcaact

SEQ ID NO: 190891 - DNA, 25 bp, Homo sapien
gctttgctgctagacttgcaactaa

SEQ ID NO: 190892 - DNA, 25 bp, Homo sapien
gctgctagacttgcaactaattttt

SEQ ID NO: 190893 - DNA, 25 bp, Homo sapien
gcatttttgatgtgtcaaaactttg

SEQ ID NO: 190894 - DNA, 25 bp, Homo sapien
aaactttcagaacaattgggagttg

SEQ ID NO: 190895 - DNA, 25 bp, Homo sapien
gggagttgaattaactagccctgtt

SEQ ID NO: 190896 - DNA, 25 bp, Homo sapien
ttgaattaactagccctgttgctgc

SEQ ID NO: 190897 - DNA, 25 bp, Homo sapien
ctgttgctgcttctgaagagtttga

SEQ ID NO: 190898 - DNA, 25 bp, Homo sapien
gatgaagaagaaagtcctgttaatt

SEQ ID NO: 190899 - DNA, 25 bp, Homo sapien
tccccatttactaaaggtcacctat

SEQ ID NO: 190900 - DNA, 25 bp, Homo sapien
acttggaaataagcagttctccgaa

SEQ ID NO: 190901 - DNA, 25 bp, Homo sapien
gttctccgaactgtagtatttcctt

SEQ ID NO: 190902 - DNA, 25 bp, Homo sapien
gtagtatttccttctcactaccttg

SEQ ID NO: 190903 - DNA, 25 bp, Homo sapien
ttctcactaccttgtacctttatac

SEQ ID NO: 190904 - DNA, 25 bp, Homo sapien
gtacctttatacttagattggaatt

SEQ ID NO: 190905 - DNA, 25 bp, Homo sapien
aagcgtttaaatgctatttgtagtc

SEQ ID NO: 190906 - DNA, 25 bp, Homo sapien
aaatgctatttgtagtcttgatata

SEQ ID NO: 190907 - DNA, 25 bp, Homo sapien
gctatttgtagtcttgatatacaga

SEQ ID NO: 190908 - DNA, 25 bp, Homo sapien
ttttaggttttatgttgaatgttct

SEQ ID NO: 190909 - DNA, 25 bp, Homo sapien
ggttttatgttgaatgttctatatc

SEQ ID NO: 190910 - DNA, 25 bp, Homo sapien
gttctatatcttattagttaatttg

SEQ ID NO: 190911 - DNA, 25 bp, Homo sapien
ggaaatagcatatctgagactgagg

SEQ ID NO: 190912 - DNA, 25 bp, Homo sapien
aaatagcatatctgagactgaggag

SEQ ID NO: 190913 - DNA, 25 bp, Homo sapien
aattgacaattcacttatttgtggt

SEQ ID NO: 190914 - DNA, 25 bp, Homo sapien
gacaattcacttatttgtggttttt

SEQ ID NO: 190915 - DNA, 25 bp, Homo sapien
tttttctcagctattctgagcttat

SEQ ID NO: 190916 - DNA, 25 bp, Homo sapien
gtgaatgatcagttacttatgatat

SEQ ID NO: 190917 - DNA, 25 bp, Homo sapien
tcctcttgtggtttaataaagtgaa

SEQ ID NO: 190918 - DNA, 25 bp, Homo sapien
aactaatatggcttatatatctgaa

SEQ ID NO: 190919 - DNA, 25 bp, Homo sapien
ctgaattatgccctttttagtgtgt

SEQ ID NO: 190920 - DNA, 25 bp, Homo sapien
ttatgccctttttagtgtgtattag

SEQ ID NO: 190921 - DNA, 25 bp, Homo sapien
taggatgtgggctggtttgcttttc

SEQ ID NO: 190922 - DNA, 25 bp, Homo sapien
gatgtgggctggtttgcttttctac

SEQ ID NO: 190923 - DNA, 25 bp, Homo sapien
tttatgtatcccatctcctttgtgt

SEQ ID NO: 190924 - DNA, 25 bp, Homo sapien
tgtatcccatctcctttgtgtgaat

SEQ ID NO: 190925 - DNA, 25 bp, Homo sapien
gagacatgggactgtttgcaatacc

SEQ ID NO: 190926 - DNA, 25 bp, Homo sapien
gggactgtttgcaataccatatgga

SEQ ID NO: 190927 - DNA, 25 bp, Homo sapien
gtttgctgcacacctcattggcttg

SEQ ID NO: 190928 - DNA, 25 bp, Homo sapien
tcattggcttgcttaccaacaccag

SEQ ID NO: 190929 - DNA, 25 bp, Homo sapien
aacaccagctagaagtggtccctct

SEQ ID NO: 190930 - DNA, 25 bp, Homo sapien
aagtggtccctctttcatatccaaa

SEQ ID NO: 190931 - DNA, 25 bp, Homo sapien
gaacacatttgggtattcctgagac

SEQ ID NO: 190932 - DNA, 25 bp, Homo sapien
gagactttatagagcgtgtattgtt

SEQ ID NO: 190933 - DNA, 25 bp, Homo sapien
tatacgaacctaacctaccttgttg

SEQ ID NO: 190934 - DNA, 25 bp, Homo sapien
cctaccttgttgttttctcatatta

SEQ ID NO: 190935 - DNA, 25 bp, Homo sapien
agcaattttggttctgtttagggag

SEQ ID NO: 190936 - DNA, 25 bp, Homo sapien
ggagaattcagggtttccatgactt

SEQ ID NO: 190937 - DNA, 25 bp, Homo sapien
tccatgacttgatttgagctttgca

SEQ ID NO: 190938 - DNA, 25 bp, Homo sapien
ctgaagtaagtgctctttccagatg

SEQ ID NO: 190939 - DNA, 25 bp, Homo sapien
gtaagtgctctttccagatgaaaac

SEQ ID NO: 190940 - DNA, 25 bp, Homo sapien
ttccagatgaaaactactcttttgg

SEQ ID NO: 190941 - DNA, 25 bp, Homo sapien
aataattatgttcagcctatgatga

SEQ ID NO: 190942 - DNA, 25 bp, Homo sapien
gaagtatttgattattagacagcaa

SEQ ID NO: 190943 - DNA, 25 bp, Homo sapien
gacagcaatgtcactaataagtttt

SEQ ID NO: 190944 - DNA, 25 bp, Homo sapien
ttgtaaacatcatcagtacagtact

SEQ ID NO: 190945 - DNA, 25 bp, Homo sapien
tcagtacagtactcttagttacagt

SEQ ID NO: 190946 - DNA, 25 bp, Homo sapien
tagttacagtaaagcaattgttgca

SEQ ID NO: 190947 - DNA, 25 bp, Homo sapien
caattgttgcaagatgaatggctaa

SEQ ID NO: 190948 - DNA, 25 bp, Homo sapien
gctaatattttggtgcagtgtttga

SEQ ID NO: 190949 - DNA, 25 bp, Homo sapien
gccggcaaggccatacctcggtgag

SEQ ID NO: 190950 - DNA, 25 bp, Homo sapien
caaggccatacctcggtgagggaca

SEQ ID NO: 190951 - DNA, 25 bp, Homo sapien
ggacaggtggacaacggtcacctat

SEQ ID NO: 190952 - DNA, 25 bp, Homo sapien
gtggacaacggtcacctatctgtag

SEQ ID NO: 190953 - DNA, 25 bp, Homo sapien
aacggtcacctatctgtagccaggg

SEQ ID NO: 190954 - DNA, 25 bp, Homo sapien
cagttgtgtggccagctgtctctct

SEQ ID NO: 190955 - DNA, 25 bp, Homo sapien
cagctgtctctctgggatgagtcag

SEQ ID NO: 190956 - DNA, 25 bp, Homo sapien
tctctctgggatgagtcaggaggcc

SEQ ID NO: 190957 - DNA, 25 bp, Homo sapien
gaaggagagaacatggcccaggccc

SEQ ID NO: 190958 - DNA, 25 bp, Homo sapien
aggagagaacatggcccaggccctt

SEQ ID NO: 190959 - DNA, 25 bp, Homo sapien
gagaacatggcccaggccctttcct

SEQ ID NO: 190960 - DNA, 25 bp, Homo sapien
gagtcgtgtccctcagctgcagggc

SEQ ID NO: 190961 - DNA, 25 bp, Homo sapien
ctgcagggcactgtgttgggaaacc

SEQ ID NO: 190962 - DNA, 25 bp, Homo sapien
gcactgtgttgggaaaccattggct

SEQ ID NO: 190963 - DNA, 25 bp, Homo sapien
aaaccattggctgggcctttgagga

SEQ ID NO: 190964 - DNA, 25 bp, Homo sapien
gaaagacaactttcctctgcgcgga

SEQ ID NO: 190965 - DNA, 25 bp, Homo sapien
tctgcgcggaacactcacacggaag

SEQ ID NO: 190966 - DNA, 25 bp, Homo sapien
aacactcacacggaagggctggccg

SEQ ID NO: 190967 - DNA, 25 bp, Homo sapien
tgggagtggacgacaggacctacct

SEQ ID NO: 190968 - DNA, 25 bp, Homo sapien
aagctgccgcggaaccccgctagtg

SEQ ID NO: 190969 - DNA, 25 bp, Homo sapien
tccgtcggtatgtcctgctttccag

SEQ ID NO: 190970 - DNA, 25 bp, Homo sapien
tttccagctgaacccaaactacaag

SEQ ID NO: 190971 - DNA, 25 bp, Homo sapien
ctcaatgccatccagacatggtttt

SEQ ID NO: 190972 - DNA, 25 bp, Homo sapien
ggcccggctcttgctgacagaatag

SEQ ID NO: 190973 - DNA, 25 bp, Homo sapien
gacagaataggttccgttctgggcg

SEQ ID NO: 190974 - DNA, 25 bp, Homo sapien
tggttctcgagcctgccattcaaaa

SEQ ID NO: 190975 - DNA, 25 bp, Homo sapien
ggagcatttctcacaacatggtatt

SEQ ID NO: 190976 - DNA, 25 bp, Homo sapien
tgaagttcctttttgttctcaaaag

SEQ ID NO: 190977 - DNA, 25 bp, Homo sapien
tgttctcaaaagttgtgaccgtgtt

SEQ ID NO: 190978 - DNA, 25 bp, Homo sapien
gtgaccgtgttaaattgtactccct

SEQ ID NO: 190979 - DNA, 25 bp, Homo sapien
aattgtactcccttagtcctgtaag

SEQ ID NO: 190980 - DNA, 25 bp, Homo sapien
tgttaagtgaatcgcagttacgctg

SEQ ID NO: 190981 - DNA, 25 bp, Homo sapien
cgcagttacgctgtacttttattaa

SEQ ID NO: 190982 - DNA, 25 bp, Homo sapien
gtacgaggaatttcaaatcatcaga

SEQ ID NO: 190983 - DNA, 25 bp, Homo sapien
aatcatcagatgtttgcttggctag

SEQ ID NO: 190984 - DNA, 25 bp, Homo sapien
atgtttgcttggctaggttctactt

SEQ ID NO: 190985 - DNA, 25 bp, Homo sapien
gcttggctaggttctactttgttta

SEQ ID NO: 190986 - DNA, 25 bp, Homo sapien
ggttctactttgtttatttgatatc

SEQ ID NO: 190987 - DNA, 25 bp, Homo sapien
aataggtttgtagatgtttatggca

SEQ ID NO: 190988 - DNA, 25 bp, Homo sapien
gtcagatatatgttgtctgctttaa

SEQ ID NO: 190989 - DNA, 25 bp, Homo sapien
tctttttatatccatcaagggaagg

SEQ ID NO: 190990 - DNA, 25 bp, Homo sapien
actaattcagtaagaagtcctaggg

SEQ ID NO: 190991 - DNA, 25 bp, Homo sapien
gggtttaactgtacatactacctga

SEQ ID NO: 190992 - DNA, 25 bp, Homo sapien
ctgaactggcttttctgagagatga

SEQ ID NO: 190993 - DNA, 25 bp, Homo sapien
aacatcaaaacagtgcttcagccaa

SEQ ID NO: 190994 - DNA, 25 bp, Homo sapien
aaacagtgcttcagccaaattccat

SEQ ID NO: 190995 - DNA, 25 bp, Homo sapien
cagtgcttcagccaaattccatatg

SEQ ID NO: 190996 - DNA, 25 bp, Homo sapien
gactaaaatatcattcgtcagggaa

SEQ ID NO: 190997 - DNA, 25 bp, Homo sapien
tcagttgtaaatttcaattacccca

SEQ ID NO: 190998 - DNA, 25 bp, Homo sapien
tcaattaccccaaaatgtatttgct

SEQ ID NO: 190999 - DNA, 25 bp, Homo sapien
tgtcttatatagtccagttttccaa

SEQ ID NO: 191000 - DNA, 25 bp, Homo sapien
tatagtccagttttccaagataagc

SEQ ID NO: 191001 - DNA, 25 bp, Homo sapien
gtccagttttccaagataagctcag

SEQ ID NO: 191002 - DNA, 25 bp, Homo sapien
agttttccaagataagctcagtcct

SEQ ID NO: 191003 - DNA, 25 bp, Homo sapien
ttttccaagataagctcagtccttt

SEQ ID NO: 191004 - DNA, 25 bp, Homo sapien
tttatttattggtctgaaaggcatt

SEQ ID NO: 191005 - DNA, 25 bp, Homo sapien
gaaaggcatttcaaaggtattataa

SEQ ID NO: 191006 - DNA, 25 bp, Homo sapien
attggtgtaatttaattggtgcaac

SEQ ID NO: 191007 - DNA, 25 bp, Homo sapien
ggtgcaacatgctttatggctcctg

SEQ ID NO: 191008 - DNA, 25 bp, Homo sapien
catgctttatggctcctgtcaaaat

SEQ ID NO: 191009 - DNA, 25 bp, Homo sapien
ggctcctgtcaaaattggttttcac

SEQ ID NO: 191010 - DNA, 25 bp, Homo sapien
gttttcactcatttgattggtttga

SEQ ID NO: 191011 - DNA, 25 bp, Homo sapien
tgattggtttgagcccagaacagcc

SEQ ID NO: 191012 - DNA, 25 bp, Homo sapien
gtttgagcccagaacagcctacagg

SEQ ID NO: 191013 - DNA, 25 bp, Homo sapien
agctggataaccacccaaagtgttt

SEQ ID NO: 191014 - DNA, 25 bp, Homo sapien
gtgtttgtattttcgttggaaactg

SEQ ID NO: 191015 - DNA, 25 bp, Homo sapien
cttcctcttcaagcgtttcatgttg

SEQ ID NO: 191016 - DNA, 25 bp, Homo sapien
tttcatgttgaacacagctctctcc

SEQ ID NO: 191017 - DNA, 25 bp, Homo sapien
tctccactcccttgtgatttctgag

SEQ ID NO: 191018 - DNA, 25 bp, Homo sapien
cttgtgatttctgagggtcaccact

SEQ ID NO: 191019 - DNA, 25 bp, Homo sapien
caggcaacatagagagcctcctgtt

SEQ ID NO: 191020 - DNA, 25 bp, Homo sapien
aacatagagagcctcctgttctttc

SEQ ID NO: 191021 - DNA, 25 bp, Homo sapien
gttctttctatgcttggtctgactg

SEQ ID NO: 191022 - DNA, 25 bp, Homo sapien
gcttggtctgactgagcctaaagtt

SEQ ID NO: 191023 - DNA, 25 bp, Homo sapien
tgaggctccagctggtcctgggaca

SEQ ID NO: 191024 - DNA, 25 bp, Homo sapien
gactgtgagtctgggcacgtccaag

SEQ ID NO: 191025 - DNA, 25 bp, Homo sapien
agtctgggcacgtccaaggcctgca

SEQ ID NO: 191026 - DNA, 25 bp, Homo sapien
ccttctcctgggaggtcctgctgca

SEQ ID NO: 191027 - DNA, 25 bp, Homo sapien
gaggtcctgctgcaactcaagttcc

SEQ ID NO: 191028 - DNA, 25 bp, Homo sapien
gctgcaactcaagttccacaggatg

SEQ ID NO: 191029 - DNA, 25 bp, Homo sapien
tcaagttccacaggatggtcaagct

SEQ ID NO: 191030 - DNA, 25 bp, Homo sapien
gatggtcaagctgtcagacatccaa

SEQ ID NO: 191031 - DNA, 25 bp, Homo sapien
gtcagacatccaagtttacatcatt

SEQ ID NO: 191032 - DNA, 25 bp, Homo sapien
actggtatttacaatttgcaagagt

SEQ ID NO: 191033 - DNA, 25 bp, Homo sapien
caatttgcaagagttttgggttagt

SEQ ID NO: 191034 - DNA, 25 bp, Homo sapien
attttaatcccaaacatcttcctga

SEQ ID NO: 191035 - DNA, 25 bp, Homo sapien
taatcccaaacatcttcctgaaaat

SEQ ID NO: 191036 - DNA, 25 bp, Homo sapien
atcttcctgaaaataacattccctt

SEQ ID NO: 191037 - DNA, 25 bp, Homo sapien
tggtgggacttaggccaaaagctca

SEQ ID NO: 191038 - DNA, 25 bp, Homo sapien
agaagcttgctactcctacgactcg

SEQ ID NO: 191039 - DNA, 25 bp, Homo sapien
tactcctacgactcggcctataagg

SEQ ID NO: 191040 - DNA, 25 bp, Homo sapien
aaaaatcactccctggctaattaag

SEQ ID NO: 191041 - DNA, 25 bp, Homo sapien
tccctggctaattaagattgcttcc

SEQ ID NO: 191042 - DNA, 25 bp, Homo sapien
gtgtcatttcctttaccaaggccag

SEQ ID NO: 191043 - DNA, 25 bp, Homo sapien
atttcctttaccaaggccagtcatc

SEQ ID NO: 191044 - DNA, 25 bp, Homo sapien
tgcttccacccatggtcaggacagt

SEQ ID NO: 191045 - DNA, 25 bp, Homo sapien
gtcaggacagtcagccactacgtga

SEQ ID NO: 191046 - DNA, 25 bp, Homo sapien
agccactacgtgatgctgtataaat

SEQ ID NO: 191047 - DNA, 25 bp, Homo sapien
tggattacaaaccatattcttgttc

SEQ ID NO: 191048 - DNA, 25 bp, Homo sapien
ccaccgtggcgctgtagcagcggca

SEQ ID NO: 191049 - DNA, 25 bp, Homo sapien
gtggcgctgtagcagcggcaggctg

SEQ ID NO: 191050 - DNA, 25 bp, Homo sapien
ggcgcggagcggcagtagtagcagc

SEQ ID NO: 191051 - DNA, 25 bp, Homo sapien
ctcctgaaacacaggttggcaggcc

SEQ ID NO: 191052 - DNA, 25 bp, Homo sapien
ttggcaggccagtctcggcagtcga

SEQ ID NO: 191053 - DNA, 25 bp, Homo sapien
tcggcagtcgagagccagccaatag

SEQ ID NO: 191054 - DNA, 25 bp, Homo sapien
gcagtcgagagccagccaatagatg

SEQ ID NO: 191055 - DNA, 25 bp, Homo sapien
tcgagagccagccaatagatggaat

SEQ ID NO: 191056 - DNA, 25 bp, Homo sapien
atagatggaatggaggcctgcacct

SEQ ID NO: 191057 - DNA, 25 bp, Homo sapien
tagatggaatggaggcctgcacctg

SEQ ID NO: 191058 - DNA, 25 bp, Homo sapien
cctgcacctgcgtctaacttttgac

SEQ ID NO: 191059 - DNA, 25 bp, Homo sapien
gctgtgtttggggggctgcatctgc

SEQ ID NO: 191060 - DNA, 25 bp, Homo sapien
ctgtgtttggggggctgcatctgct

SEQ ID NO: 191061 - DNA, 25 bp, Homo sapien
gtgtttggggggctgcatctgctga

SEQ ID NO: 191062 - DNA, 25 bp, Homo sapien
tgtttggggggctgcatctgctgaa

SEQ ID NO: 191063 - DNA, 25 bp, Homo sapien
gtttggggggctgcatctgctgaag

SEQ ID NO: 191064 - DNA, 25 bp, Homo sapien
tttggggggctgcatctgctgaagc

SEQ ID NO: 191065 - DNA, 25 bp, Homo sapien
ttggggggctgcatctgctgaagcg

SEQ ID NO: 191066 - DNA, 25 bp, Homo sapien
tggggggctgcatctgctgaagcga

SEQ ID NO: 191067 - DNA, 25 bp, Homo sapien
ggggggctgcatctgctgaagcgag

SEQ ID NO: 191068 - DNA, 25 bp, Homo sapien
gggggctgcatctgctgaagcgaga

SEQ ID NO: 191069 - DNA, 25 bp, Homo sapien
gggctgcatctgctgaagcgagaac

SEQ ID NO: 191070 - DNA, 25 bp, Homo sapien
aaagttcacccttggcatgctgttc

SEQ ID NO: 191071 - DNA, 25 bp, Homo sapien
gcatgctgttccaagaacctgggtt

SEQ ID NO: 191072 - DNA, 25 bp, Homo sapien
gggtttgaatcccaatcgttgtgaa

SEQ ID NO: 191073 - DNA, 25 bp, Homo sapien
gcagccaaggatatgttgacccaga

SEQ ID NO: 191074 - DNA, 25 bp, Homo sapien
gacccagatgtcaaccaggctattt

SEQ ID NO: 191075 - DNA, 25 bp, Homo sapien
tgtcaaccaggctatttttatactt

SEQ ID NO: 191076 - DNA, 25 bp, Homo sapien
aacatgtcagcagagcataggcaga

SEQ ID NO: 191077 - DNA, 25 bp, Homo sapien
atggtttaaataccccacagcaaat

SEQ ID NO: 191078 - DNA, 25 bp, Homo sapien
atagagtaactgacaaaccaccaaa

SEQ ID NO: 191079 - DNA, 25 bp, Homo sapien
gacaagtgtctagcaatgccttggt

SEQ ID NO: 191080 - DNA, 25 bp, Homo sapien
tagcaatgccttggtacctgatctt

SEQ ID NO: 191081 - DNA, 25 bp, Homo sapien
ggaataatgccaccagagactgagt

SEQ ID NO: 191082 - DNA, 25 bp, Homo sapien
caccagagactgagtggaaatcgcc

SEQ ID NO: 191083 - DNA, 25 bp, Homo sapien
gccccttttgaaggtgccattctta

SEQ ID NO: 191084 - DNA, 25 bp, Homo sapien
gaaggtgccattcttatgagccaaa

SEQ ID NO: 191085 - DNA, 25 bp, Homo sapien
ggtgccattcttatgagccaaaagt

SEQ ID NO: 191086 - DNA, 25 bp, Homo sapien
aagttcattttgagggaataacatg

SEQ ID NO: 191087 - DNA, 25 bp, Homo sapien
gaacattataactgattgttgtgaa

SEQ ID NO: 191088 - DNA, 25 bp, Homo sapien
catgcacaggcaaaatgtattcact

SEQ ID NO: 191089 - DNA, 25 bp, Homo sapien
aaatgtattcactagatttctacgt

SEQ ID NO: 191090 - DNA, 25 bp, Homo sapien
tgtattcactagatttctacgtagt

SEQ ID NO: 191091 - DNA, 25 bp, Homo sapien
gtaatttgtagttctcaaaagactt

SEQ ID NO: 191092 - DNA, 25 bp, Homo sapien
tgcaagggcatttcaccacagagag

SEQ ID NO: 191093 - DNA, 25 bp, Homo sapien
gcatttcaccacagagaggaccttt

SEQ ID NO: 191094 - DNA, 25 bp, Homo sapien
agaggacctttgtgctcactttggc

SEQ ID NO: 191095 - DNA, 25 bp, Homo sapien
aggcagtgatgctcatggttgcatg

SEQ ID NO: 191096 - DNA, 25 bp, Homo sapien
atgactttatgagtcgctgggccag

SEQ ID NO: 191097 - DNA, 25 bp, Homo sapien
tggcccagagttcttgtccatcagt

SEQ ID NO: 191098 - DNA, 25 bp, Homo sapien
gttcttgtccatcagttcatactgc

SEQ ID NO: 191099 - DNA, 25 bp, Homo sapien
aagcattatgactgtcctacccatg

SEQ ID NO: 191100 - DNA, 25 bp, Homo sapien
gactgtcctacccatgggagagtaa

SEQ ID NO: 191101 - DNA, 25 bp, Homo sapien
gagtatagattttgaggtccccatt

SEQ ID NO: 191102 - DNA, 25 bp, Homo sapien
tccccatttgggaaacatgtgccag

SEQ ID NO: 191103 - DNA, 25 bp, Homo sapien
ttatctgaaattcctatttcctgtt

SEQ ID NO: 191104 - DNA, 25 bp, Homo sapien
gaaattcctatttcctgttaacata

SEQ ID NO: 191105 - DNA, 25 bp, Homo sapien
tttcctgttaacataggaggtgtgt

SEQ ID NO: 191106 - DNA, 25 bp, Homo sapien
aggaggtgtgtgcagactttattaa

SEQ ID NO: 191107 - DNA, 25 bp, Homo sapien
gtgtgtgcagactttattaatgtga

SEQ ID NO: 191108 - DNA, 25 bp, Homo sapien
gtgcagactttattaatgtgaggaa

SEQ ID NO: 191109 - DNA, 25 bp, Homo sapien
gctcaattgaaggacatttccctgt

SEQ ID NO: 191110 - DNA, 25 bp, Homo sapien
gacatttccctgttttctataaagc

SEQ ID NO: 191111 - DNA, 25 bp, Homo sapien
catttccctgttttctataaagcaa

SEQ ID NO: 191112 - DNA, 25 bp, Homo sapien
ttccctgttttctataaagcaatgg

SEQ ID NO: 191113 - DNA, 25 bp, Homo sapien
aaagcaatggttgaactcattttct

SEQ ID NO: 191114 - DNA, 25 bp, Homo sapien
aagtggcagctatctttagccagac

SEQ ID NO: 191115 - DNA, 25 bp, Homo sapien
gttgcagttattgctcgatgccact

SEQ ID NO: 191116 - DNA, 25 bp, Homo sapien
gctcgatgccactcatggtgtccta

SEQ ID NO: 191117 - DNA, 25 bp, Homo sapien
tggtgtcctacctcctatttggaaa

SEQ ID NO: 191118 - DNA, 25 bp, Homo sapien
gtgagtagatttgagggtccagtta

SEQ ID NO: 191119 - DNA, 25 bp, Homo sapien
gtccagttatggagtgctactaaaa

SEQ ID NO: 191120 - DNA, 25 bp, Homo sapien
ctggcctctggaagcatctttagct

SEQ ID NO: 191121 - DNA, 25 bp, Homo sapien
catctttagctttgactttgggcaa

SEQ ID NO: 191122 - DNA, 25 bp, Homo sapien
aagtctctgtacttttctggccagc

SEQ ID NO: 191123 - DNA, 25 bp, Homo sapien
tctggccagcttttccaggatttat

SEQ ID NO: 191124 - DNA, 25 bp, Homo sapien
aaaattagagcttcggcttgacctc

SEQ ID NO: 191125 - DNA, 25 bp, Homo sapien
aaatagcaaaacacaagctgcattt

SEQ ID NO: 191126 - DNA, 25 bp, Homo sapien
gaaaacttacggaaatacacaaatg

SEQ ID NO: 191127 - DNA, 25 bp, Homo sapien
ggaaatacacaaatgcttctctgta

SEQ ID NO: 191128 - DNA, 25 bp, Homo sapien
acaaatgcttctctgtaatgtgcaa

SEQ ID NO: 191129 - DNA, 25 bp, Homo sapien
gcttctctgtaatgtgcaatatgct

SEQ ID NO: 191130 - DNA, 25 bp, Homo sapien
ttctctgtaatgtgcaatatgcttt

SEQ ID NO: 191131 - DNA, 25 bp, Homo sapien
atgtgcaatatgctttgcaactgta

SEQ ID NO: 191132 - DNA, 25 bp, Homo sapien
atatgctttgcaactgtagatgata

SEQ ID NO: 191133 - DNA, 25 bp, Homo sapien
gctttgcaactgtagatgatatttt

SEQ ID NO: 191134 - DNA, 25 bp, Homo sapien
tgcaactgtagatgatattttatgt

SEQ ID NO: 191135 - DNA, 25 bp, Homo sapien
gtaataaggaatatcttgctcttta

SEQ ID NO: 191136 - DNA, 25 bp, Homo sapien
aaagaatgacgacatccgcatcctc

SEQ ID NO: 191137 - DNA, 25 bp, Homo sapien
gacatccgcatcctcagagatatcg

SEQ ID NO: 191138 - DNA, 25 bp, Homo sapien
gagatatcgagcagtactattccac

SEQ ID NO: 191139 - DNA, 25 bp, Homo sapien
gcagtactattccactcagattgat

SEQ ID NO: 191140 - DNA, 25 bp, Homo sapien
gattgatgagatgccgatgaacgtt

SEQ ID NO: 191141 - DNA, 25 bp, Homo sapien
tgaacgttgctgatcttatctgaag

SEQ ID NO: 191142 - DNA, 25 bp, Homo sapien
gggagactgttcacctgctgtgtac

SEQ ID NO: 191143 - DNA, 25 bp, Homo sapien
gctgtgtactcctgtttggaagtat

SEQ ID NO: 191144 - DNA, 25 bp, Homo sapien
ggaagtatttagatccagattctac

SEQ ID NO: 191145 - DNA, 25 bp, Homo sapien
tcttctcataaatggcctgccgtct

SEQ ID NO: 191146 - DNA, 25 bp, Homo sapien
cgtctcccttcctttgaagaggata

SEQ ID NO: 191147 - DNA, 25 bp, Homo sapien
cagcagccacagcatattgtaaact

SEQ ID NO: 191148 - DNA, 25 bp, Homo sapien
ccagctcgtgggaccatctagataa

SEQ ID NO: 191149 - DNA, 25 bp, Homo sapien
tcgtgggaccatctagataagcttg

SEQ ID NO: 191150 - DNA, 25 bp, Homo sapien
aaaatgcatccttaacacctgagcc

SEQ ID NO: 191151 - DNA, 25 bp, Homo sapien
tgagcctctggtcatcttcagtatt

SEQ ID NO: 191152 - DNA, 25 bp, Homo sapien
ttgcaaaagctttcagagggcattg

SEQ ID NO: 191153 - DNA, 25 bp, Homo sapien
gagggcattgtgtatccgtaataat

SEQ ID NO: 191154 - DNA, 25 bp, Homo sapien
taatgtccttgaagtcagagactgg

SEQ ID NO: 191155 - DNA, 25 bp, Homo sapien
agactggaaatgttgatctcttagt

SEQ ID NO: 191156 - DNA, 25 bp, Homo sapien
aatgttgatctcttagtcttctata

SEQ ID NO: 191157 - DNA, 25 bp, Homo sapien
gtcttctatagacaaggaggtcaga

SEQ ID NO: 191158 - DNA, 25 bp, Homo sapien
atttgctatgacttcaggttaattt

SEQ ID NO: 191159 - DNA, 25 bp, Homo sapien
gtttgcatagtttgagcaggatgtt

SEQ ID NO: 191160 - DNA, 25 bp, Homo sapien
gcaggatgttttgtgaagtatgttt

SEQ ID NO: 191161 - DNA, 25 bp, Homo sapien
atttatttgcctactttgtacttga

SEQ ID NO: 191162 - DNA, 25 bp, Homo sapien
gcctactttgtacttgatgtgtttt

SEQ ID NO: 191163 - DNA, 25 bp, Homo sapien
gatgtgttttgtaatgtgcactgaa

SEQ ID NO: 191164 - DNA, 25 bp, Homo sapien
atgtgcactgaatttgttttctttt

SEQ ID NO: 191165 - DNA, 25 bp, Homo sapien
caactatgttaatgatcaatactgt

SEQ ID NO: 191166 - DNA, 25 bp, Homo sapien
gtttgtttgtatactgtttctccaa

SEQ ID NO: 191167 - DNA, 25 bp, Homo sapien
gtatactgtttctccaaacacttaa

SEQ ID NO: 191168 - DNA, 25 bp, Homo sapien
aaattgtgttcagtgctgtacattt

SEQ ID NO: 191169 - DNA, 25 bp, Homo sapien
ctgttgctgactcttaattcctatt

SEQ ID NO: 191170 - DNA, 25 bp, Homo sapien
aattcctatttcaatatgtgtttcc

SEQ ID NO: 191171 - DNA, 25 bp, Homo sapien
gaattcaggatacaacttcttgtgt

SEQ ID NO: 191172 - DNA, 25 bp, Homo sapien
acttcttgtgtatgacagctttcct

SEQ ID NO: 191173 - DNA, 25 bp, Homo sapien
tatgacagctttccttcacacacta

SEQ ID NO: 191174 - DNA, 25 bp, Homo sapien
cttcacacactatttttgtgggtgt

SEQ ID NO: 191175 - DNA, 25 bp, Homo sapien
ttgtgggtgtgtatatatctgattt

SEQ ID NO: 191176 - DNA, 25 bp, Homo sapien
tgtttgaaacagactttctgcctgt

SEQ ID NO: 191177 - DNA, 25 bp, Homo sapien
gactttctgcctgttacatttttgc

SEQ ID NO: 191178 - DNA, 25 bp, Homo sapien
gtgttttccactagtatatccctgt

SEQ ID NO: 191179 - DNA, 25 bp, Homo sapien
atccctgttgatttgtttgtgcctt

SEQ ID NO: 191180 - DNA, 25 bp, Homo sapien
gtggtgccaggcagattagcatgtt

SEQ ID NO: 191181 - DNA, 25 bp, Homo sapien
agcatgttcaaagctgacaccactg

SEQ ID NO: 191182 - DNA, 25 bp, Homo sapien
caccactgaggtcgtgttttttggg

SEQ ID NO: 191183 - DNA, 25 bp, Homo sapien
agaaaggccaaatattccagccctg

SEQ ID NO: 191184 - DNA, 25 bp, Homo sapien
agccctggccgaaagatgatcactc

SEQ ID NO: 191185 - DNA, 25 bp, Homo sapien
gatgatcactcaccagacggaagca

SEQ ID NO: 191186 - DNA, 25 bp, Homo sapien
aagcaagcgtgctgcgtggagcatc

SEQ ID NO: 191187 - DNA, 25 bp, Homo sapien
ctgcgtggagcatccatgcgaagat

SEQ ID NO: 191188 - DNA, 25 bp, Homo sapien
tgcgaagatgtcaattccatagatc

SEQ ID NO: 191189 - DNA, 25 bp, Homo sapien
atatagcaaacttaccatgatccgg

SEQ ID NO: 191190 - DNA, 25 bp, Homo sapien
acttaccatgatccggttttctctt

SEQ ID NO: 191191 - DNA, 25 bp, Homo sapien
tttctaattgcatctccatgggctg

SEQ ID NO: 191192 - DNA, 25 bp, Homo sapien
ctgtgagactgtgtgaagccgtttg

SEQ ID NO: 191193 - DNA, 25 bp, Homo sapien
aagccgtttgtgtggtctccatgta

SEQ ID NO: 191194 - DNA, 25 bp, Homo sapien
tccatgtaggtgctgtgttcccggc

SEQ ID NO: 191195 - DNA, 25 bp, Homo sapien
accgccttgctctgaacactggtaa

SEQ ID NO: 191196 - DNA, 25 bp, Homo sapien
gtaattccaggtgctgcgcttggca

SEQ ID NO: 191197 - DNA, 25 bp, Homo sapien
gggtctcgccaaagcgcatgtgtgt

SEQ ID NO: 191198 - DNA, 25 bp, Homo sapien
gaacgtgtgtgtcctttgcatggtt

SEQ ID NO: 191199 - DNA, 25 bp, Homo sapien
tgggtgccttgctagggcatcagca

SEQ ID NO: 191200 - DNA, 25 bp, Homo sapien
gtgtatagttacaatgcttccaaac

SEQ ID NO: 191201 - DNA, 25 bp, Homo sapien
gtatcttttaaagctcctataagta

SEQ ID NO: 191202 - DNA, 25 bp, Homo sapien
agtaatccatttactcagctggaga

SEQ ID NO: 191203 - DNA, 25 bp, Homo sapien
gagaggagacatcaagaacatgcca

SEQ ID NO: 191204 - DNA, 25 bp, Homo sapien
gaacatgccagacacatttcttttg

SEQ ID NO: 191205 - DNA, 25 bp, Homo sapien
tgccagacacatttcttttggtggt

SEQ ID NO: 191206 - DNA, 25 bp, Homo sapien
gtaacctgattactttttcacctct

SEQ ID NO: 191207 - DNA, 25 bp, Homo sapien
ctttttcacctctacaaccaggaga

SEQ ID NO: 191208 - DNA, 25 bp, Homo sapien
attttccttcatattatcaatgctt

SEQ ID NO: 191209 - DNA, 25 bp, Homo sapien
caatgcttatatattccttagacta

SEQ ID NO: 191210 - DNA, 25 bp, Homo sapien
atttgtgttcacttctatagcatat

SEQ ID NO: 191211 - DNA, 25 bp, Homo sapien
aatattctgtgttcatcaaagtgta

SEQ ID NO: 191212 - DNA, 25 bp, Homo sapien
gatatactctttctcaagggaagtg

SEQ ID NO: 191213 - DNA, 25 bp, Homo sapien
ggctgtgactgtgactgtaatcatt

SEQ ID NO: 191214 - DNA, 25 bp, Homo sapien
atcattgctgaacaacatctctttg

SEQ ID NO: 191215 - DNA, 25 bp, Homo sapien
tcaaaggttgattttcccagagggt

SEQ ID NO: 191216 - DNA, 25 bp, Homo sapien
gctgggtcaggcatttctattagga

SEQ ID NO: 191217 - DNA, 25 bp, Homo sapien
aaaaatgggtccatagacactctat

SEQ ID NO: 191218 - DNA, 25 bp, Homo sapien
acactctatggaggtgtccctttct

SEQ ID NO: 191219 - DNA, 25 bp, Homo sapien
gctgtgtcctttcagaatttttacc

SEQ ID NO: 191220 - DNA, 25 bp, Homo sapien
tggagctagagttgcttcctggtga

SEQ ID NO: 191221 - DNA, 25 bp, Homo sapien
agaggaagcaactctccttctggtt

SEQ ID NO: 191222 - DNA, 25 bp, Homo sapien
tcccctcagatttcctgataggctg

SEQ ID NO: 191223 - DNA, 25 bp, Homo sapien
cctgataggctgatggcatgtggct

SEQ ID NO: 191224 - DNA, 25 bp, Homo sapien
agggtcatattgtgaatgtctcact

SEQ ID NO: 191225 - DNA, 25 bp, Homo sapien
atgtctcactacaaaatgacttgag

SEQ ID NO: 191226 - DNA, 25 bp, Homo sapien
gtctcactacaaaatgacttgagtc

SEQ ID NO: 191227 - DNA, 25 bp, Homo sapien
gacttgagtccagtgaaatctcatt

SEQ ID NO: 191228 - DNA, 25 bp, Homo sapien
catctaaattgtgtgttctgtacat

SEQ ID NO: 191229 - DNA, 25 bp, Homo sapien
gtgatgtttgactgtaccattgact

SEQ ID NO: 191230 - DNA, 25 bp, Homo sapien
atgtttgactgtaccattgactgtt

SEQ ID NO: 191231 - DNA, 25 bp, Homo sapien
gactgtaccattgactgttatggaa

SEQ ID NO: 191232 - DNA, 25 bp, Homo sapien
gttcagcgttgtatgtctctctcta

SEQ ID NO: 191233 - DNA, 25 bp, Homo sapien
atgtctctctctacactgtggtgca

SEQ ID NO: 191234 - DNA, 25 bp, Homo sapien
actgtggtgcacttaacttgtggaa

SEQ ID NO: 191235 - DNA, 25 bp, Homo sapien
gaagatgcatgcgatgaataccaac

SEQ ID NO: 191236 - DNA, 25 bp, Homo sapien
gatgaataccaacaatatcactgag

SEQ ID NO: 191237 - DNA, 25 bp, Homo sapien
cactgagctagtgaactatttggca

SEQ ID NO: 191238 - DNA, 25 bp, Homo sapien
gtttagatgaagcttcagtcttgat

SEQ ID NO: 191239 - DNA, 25 bp, Homo sapien
actgaatattcaaagcactgcggga

SEQ ID NO: 191240 - DNA, 25 bp, Homo sapien
actgcgggaaacctgtgcctccaga

SEQ ID NO: 191241 - DNA, 25 bp, Homo sapien
actgctccctgtgaaattctgaaga

SEQ ID NO: 191242 - DNA, 25 bp, Homo sapien
gatgtttcttagtggattatcgtaa

SEQ ID NO: 191243 - DNA, 25 bp, Homo sapien
gattatcgtaaatcactgaaccttt

SEQ ID NO: 191244 - DNA, 25 bp, Homo sapien
ggagtctgctattaatggaccatat

SEQ ID NO: 191245 - DNA, 25 bp, Homo sapien
aattgtacaatctctgtattatagc

SEQ ID NO: 191246 - DNA, 25 bp, Homo sapien
cttcttgcccttgtggagattggga

SEQ ID NO: 191247 - DNA, 25 bp, Homo sapien
tttcctgtccatcttgtattatgaa

SEQ ID NO: 191248 - DNA, 25 bp, Homo sapien
aaaggctgtttctggcacacccggg

SEQ ID NO: 191249 - DNA, 25 bp, Homo sapien
ccgggctcctctgtgtggtttctgg

SEQ ID NO: 191250 - DNA, 25 bp, Homo sapien
ggccgctggtaccttccctattgaa

SEQ ID NO: 191251 - DNA, 25 bp, Homo sapien
attgaacccttctttaggcttgctc

SEQ ID NO: 191252 - DNA, 25 bp, Homo sapien
cttctttaggcttgctcactctttt

SEQ ID NO: 191253 - DNA, 25 bp, Homo sapien
tgctcactctttttgatgggtgtct

SEQ ID NO: 191254 - DNA, 25 bp, Homo sapien
atgggtgtctttccaaagctggctg

SEQ ID NO: 191255 - DNA, 25 bp, Homo sapien
ggccagttctgttgctgtggctaca

SEQ ID NO: 191256 - DNA, 25 bp, Homo sapien
gttgctgtggctacacgggaataat

SEQ ID NO: 191257 - DNA, 25 bp, Homo sapien
gtaacctgtttattaaccatacctg

SEQ ID NO: 191258 - DNA, 25 bp, Homo sapien
gtttattaaccatacctgtcctgag

SEQ ID NO: 191259 - DNA, 25 bp, Homo sapien
attaaccatacctgtcctgagttca

SEQ ID NO: 191260 - DNA, 25 bp, Homo sapien
taaccatacctgtcctgagttcatg

SEQ ID NO: 191261 - DNA, 25 bp, Homo sapien
atacctgtcctgagttcatggccaa

SEQ ID NO: 191262 - DNA, 25 bp, Homo sapien
tacctgtcctgagttcatggccaaa

SEQ ID NO: 191263 - DNA, 25 bp, Homo sapien
gttcatggccaaaaccttaaataag

SEQ ID NO: 191264 - DNA, 25 bp, Homo sapien
cactgcgggtactctcctgttccag

SEQ ID NO: 191265 - DNA, 25 bp, Homo sapien
tactctcctgttccagccttgtgaa

SEQ ID NO: 191266 - DNA, 25 bp, Homo sapien
tctcctgttccagccttgtgaagga

SEQ ID NO: 191267 - DNA, 25 bp, Homo sapien
tcctgttccagccttgtgaaggaac

SEQ ID NO: 191268 - DNA, 25 bp, Homo sapien
aaatttgcactgaagtcttgtttca

SEQ ID NO: 191269 - DNA, 25 bp, Homo sapien
cagaccactgaggagagcctgctga

SEQ ID NO: 191270 - DNA, 25 bp, Homo sapien
tgagttggtggataccttctgggct

SEQ ID NO: 191271 - DNA, 25 bp, Homo sapien
taccttctgggcttttgaacttgcc

SEQ ID NO: 191272 - DNA, 25 bp, Homo sapien
atgtgtctgaccctgtcttacccat

SEQ ID NO: 191273 - DNA, 25 bp, Homo sapien
gtcttacccatttcaagttcaagcg

SEQ ID NO: 191274 - DNA, 25 bp, Homo sapien
tttcaagttcaagcggtgcagcacc

SEQ ID NO: 191275 - DNA, 25 bp, Homo sapien
gtgcagcaccttcgaagcatcaatg

SEQ ID NO: 191276 - DNA, 25 bp, Homo sapien
gcatcaatgcacacacctgctgttg

SEQ ID NO: 191277 - DNA, 25 bp, Homo sapien
ctgctgttgcttttgatttctggaa

SEQ ID NO: 191278 - DNA, 25 bp, Homo sapien
tggaaggcatgtagtttcaacttgt

SEQ ID NO: 191279 - DNA, 25 bp, Homo sapien
ggtgttggtgtggaattcattgatc

SEQ ID NO: 191280 - DNA, 25 bp, Homo sapien
gtgttggtgtggaattcattgatca

SEQ ID NO: 191281 - DNA, 25 bp, Homo sapien
gttggtgtggaattcattgatcagg

SEQ ID NO: 191282 - DNA, 25 bp, Homo sapien
ttggtgtggaattcattgatcagga

SEQ ID NO: 191283 - DNA, 25 bp, Homo sapien
ggtgtggaattcattgatcaggaac

SEQ ID NO: 191284 - DNA, 25 bp, Homo sapien
gtgtggaattcattgatcaggaact

SEQ ID NO: 191285 - DNA, 25 bp, Homo sapien
gtggaattcattgatcaggaactgt

SEQ ID NO: 191286 - DNA, 25 bp, Homo sapien
ggaattcattgatcaggaactgtcc

SEQ ID NO: 191287 - DNA, 25 bp, Homo sapien
gaattcattgatcaggaactgtcca

SEQ ID NO: 191288 - DNA, 25 bp, Homo sapien
aattcattgatcaggaactgtccag

SEQ ID NO: 191289 - DNA, 25 bp, Homo sapien
atggcagaagcgtttggtgttggtg

SEQ ID NO: 191290 - DNA, 25 bp, Homo sapien
tagtctgtcagtttctacgtgtgag

SEQ ID NO: 191291 - DNA, 25 bp, Homo sapien
aagcaagcttgtgggccagtgtcct

SEQ ID NO: 191292 - DNA, 25 bp, Homo sapien
gtgtccttgtacatgctgtagcact

SEQ ID NO: 191293 - DNA, 25 bp, Homo sapien
agtcccagggttcctatgatctgta

SEQ ID NO: 191294 - DNA, 25 bp, Homo sapien
tataactggttttgggtacctgaat

SEQ ID NO: 191295 - DNA, 25 bp, Homo sapien
ctgaattttgattggttagccttaa

SEQ ID NO: 191296 - DNA, 25 bp, Homo sapien
ccttaattatagtctggcgtgatca

SEQ ID NO: 191297 - DNA, 25 bp, Homo sapien
ggcgtgatcatgtagaatcttttct

SEQ ID NO: 191298 - DNA, 25 bp, Homo sapien
tatcaaggagttctatcaaggcatc

SEQ ID NO: 191299 - DNA, 25 bp, Homo sapien
tcaaggcatccatgtcagtggtgct

SEQ ID NO: 191300 - DNA, 25 bp, Homo sapien
gtggtgctatgctggttacaacttg

SEQ ID NO: 191301 - DNA, 25 bp, Homo sapien
gaggactgctctcagtctctgagtc

SEQ ID NO: 191302 - DNA, 25 bp, Homo sapien
agtctctgagtctcagcacaatgca

SEQ ID NO: 191303 - DNA, 25 bp, Homo sapien
cacaatgcaggaggacatggagtct

SEQ ID NO: 191304 - DNA, 25 bp, Homo sapien
gggcagataccttctgaacgggaag

SEQ ID NO: 191305 - DNA, 25 bp, Homo sapien
gataccttctgaacgggaagagaca

SEQ ID NO: 191306 - DNA, 25 bp, Homo sapien
gaagagacagccagcacagtgttta

SEQ ID NO: 191307 - DNA, 25 bp, Homo sapien
agcacagtgtttatgccactggttt

SEQ ID NO: 191308 - DNA, 25 bp, Homo sapien
taccttggcttaaaaccctctctca

SEQ ID NO: 191309 - DNA, 25 bp, Homo sapien
aaaaccctctctcagactgtttggt

SEQ ID NO: 191310 - DNA, 25 bp, Homo sapien
gactgtttggtttttgagcatattc

SEQ ID NO: 191311 - DNA, 25 bp, Homo sapien
gtttggtttttgagcatattctgaa

SEQ ID NO: 191312 - DNA, 25 bp, Homo sapien
tttctattattttcatatgttaaga

SEQ ID NO: 191313 - DNA, 25 bp, Homo sapien
ttttcatatgttaagatattccatt

SEQ ID NO: 191314 - DNA, 25 bp, Homo sapien
ttcatatgttaagatattccattaa

SEQ ID NO: 191315 - DNA, 25 bp, Homo sapien
gaattgtatgtataaattggcatta

SEQ ID NO: 191316 - DNA, 25 bp, Homo sapien
gtatgtataaattggcattaggata

SEQ ID NO: 191317 - DNA, 25 bp, Homo sapien
aattggcattaggatacaaatgtaa

SEQ ID NO: 191318 - DNA, 25 bp, Homo sapien
ttttaacatagttttctatttgtct

SEQ ID NO: 191319 - DNA, 25 bp, Homo sapien
gtctttatttcaagtaccagaatta

SEQ ID NO: 191320 - DNA, 25 bp, Homo sapien
ctttatttcaagtaccagaattaca

SEQ ID NO: 191321 - DNA, 25 bp, Homo sapien
ttatttcaagtaccagaattacaaa

SEQ ID NO: 191322 - DNA, 25 bp, Homo sapien
gtaccagaattacaaaatatctaag

SEQ ID NO: 191323 - DNA, 25 bp, Homo sapien
ctcttctaggatgagccactgtaga

SEQ ID NO: 191324 - DNA, 25 bp, Homo sapien
cttctaggatgagccactgtagatc

SEQ ID NO: 191325 - DNA, 25 bp, Homo sapien
ctaggatgagccactgtagatcatt

SEQ ID NO: 191326 - DNA, 25 bp, Homo sapien
gggagagcccttgtctctggtcagc

SEQ ID NO: 191327 - DNA, 25 bp, Homo sapien
ggagagcccttgtctctggtcagcc

SEQ ID NO: 191328 - DNA, 25 bp, Homo sapien
agcccttgtctctggtcagccctgg

SEQ ID NO: 191329 - DNA, 25 bp, Homo sapien
ggtcagccctggagcatgggatcgt

SEQ ID NO: 191330 - DNA, 25 bp, Homo sapien
cctggagcatgggatcgtgggaaag

SEQ ID NO: 191331 - DNA, 25 bp, Homo sapien
gagatctctccgccttagttaagag

SEQ ID NO: 191332 - DNA, 25 bp, Homo sapien
tgctcagagtccctgtatttttata

SEQ ID NO: 191333 - DNA, 25 bp, Homo sapien
tcagagtccctgtatttttatacct

SEQ ID NO: 191334 - DNA, 25 bp, Homo sapien
acttcaggatagatgttgggatgcc

SEQ ID NO: 191335 - DNA, 25 bp, Homo sapien
gatgcctgggcatggccacatgtta

SEQ ID NO: 191336 - DNA, 25 bp, Homo sapien
gggcatggccacatgttacatgtac

SEQ ID NO: 191337 - DNA, 25 bp, Homo sapien
gtacagaactttgtctacagcacaa

SEQ ID NO: 191338 - DNA, 25 bp, Homo sapien
gtgactggtatttaatgctgatcta

SEQ ID NO: 191339 - DNA, 25 bp, Homo sapien
gctgatctactataaggtattctat

SEQ ID NO: 191340 - DNA, 25 bp, Homo sapien
cagagacgcgtatgtaataaaggac

SEQ ID NO: 191341 - DNA, 25 bp, Homo sapien
acatccagttcaccccagagggtcg

SEQ ID NO: 191342 - DNA, 25 bp, Homo sapien
agggtcgggcaggttgacatattta

SEQ ID NO: 191343 - DNA, 25 bp, Homo sapien
gtctattctgtaggcttccatgtcc

SEQ ID NO: 191344 - DNA, 25 bp, Homo sapien
ttccatgtccagaatcctgcttaag

SEQ ID NO: 191345 - DNA, 25 bp, Homo sapien
agagatgtacgtgggctgtgtggca

SEQ ID NO: 191346 - DNA, 25 bp, Homo sapien
tgccctggcttcttcaggttatcgc

SEQ ID NO: 191347 - DNA, 25 bp, Homo sapien
ttcttcaggttatcgcaccactatg

SEQ ID NO: 191348 - DNA, 25 bp, Homo sapien
atcgcaccactatggaatcctttgc

SEQ ID NO: 191349 - DNA, 25 bp, Homo sapien
gaatcctttgcagaatggtactcat

SEQ ID NO: 191350 - DNA, 25 bp, Homo sapien
acattcataattgactctgtgcagg

SEQ ID NO: 191351 - DNA, 25 bp, Homo sapien
gactctgtgcaggatgtcactcaat

SEQ ID NO: 191352 - DNA, 25 bp, Homo sapien
gtgcaggatgtcactcaatcagttt

SEQ ID NO: 191353 - DNA, 25 bp, Homo sapien
actcaatcagtttgggtttgcttta

SEQ ID NO: 191354 - DNA, 25 bp, Homo sapien
attttttggtatcctgtacattgca

SEQ ID NO: 191355 - DNA, 25 bp, Homo sapien
tcctgtacattgcagtgggtgtgaa

SEQ ID NO: 191356 - DNA, 25 bp, Homo sapien
ggaggagaatatcagccttctggaa

SEQ ID NO: 191357 - DNA, 25 bp, Homo sapien
tcagccttctggaagtagctacttc

SEQ ID NO: 191358 - DNA, 25 bp, Homo sapien
ttcctgaacaatgtaaagtgtcgca

SEQ ID NO: 191359 - DNA, 25 bp, Homo sapien
gtaaagtgtcgcagatattcaataa

SEQ ID NO: 191360 - DNA, 25 bp, Homo sapien
aatggcaacctgttataatttgtga

SEQ ID NO: 191361 - DNA, 25 bp, Homo sapien
gaaaacaattgcatatcaaacccaa

SEQ ID NO: 191362 - DNA, 25 bp, Homo sapien
atagtgtatgtattctgccatgtaa

SEQ ID NO: 191363 - DNA, 25 bp, Homo sapien
gccatgtaagtaattgaacagtctt

SEQ ID NO: 191364 - DNA, 25 bp, Homo sapien
taaccaaatggtagagggctgttcc

SEQ ID NO: 191365 - DNA, 25 bp, Homo sapien
gttccatgatgggacagctttggat

SEQ ID NO: 191366 - DNA, 25 bp, Homo sapien
ggacagctttggatttgttttcata

SEQ ID NO: 191367 - DNA, 25 bp, Homo sapien
acttatgcactacatctggagtgtg

SEQ ID NO: 191368 - DNA, 25 bp, Homo sapien
gagccttagcaaatcaccatgacct

SEQ ID NO: 191369 - DNA, 25 bp, Homo sapien
accatgacctcttagtgaaagtgaa

SEQ ID NO: 191370 - DNA, 25 bp, Homo sapien
aattctgattggttatgtaccgtca

SEQ ID NO: 191371 - DNA, 25 bp, Homo sapien
attttgcagtgtggaagcgttgaaa

SEQ ID NO: 191372 - DNA, 25 bp, Homo sapien
gaaagttactgcttttccacttgct

SEQ ID NO: 191373 - DNA, 25 bp, Homo sapien
gcttttccacttgctcatatagtaa

SEQ ID NO: 191374 - DNA, 25 bp, Homo sapien
tgctcatatagtaaagggatccttt

SEQ ID NO: 191375 - DNA, 25 bp, Homo sapien
agctgccagtgttgaataatgtatc

SEQ ID NO: 191376 - DNA, 25 bp, Homo sapien
agagtgatgttatctgtgacagtca

SEQ ID NO: 191377 - DNA, 25 bp, Homo sapien
tgtgacagtcaccagctttaagctg

SEQ ID NO: 191378 - DNA, 25 bp, Homo sapien
gagtagagattcacttttaagttct

SEQ ID NO: 191379 - DNA, 25 bp, Homo sapien
gaaaatatatgcattctcctaaata

SEQ ID NO: 191380 - DNA, 25 bp, Homo sapien
gacatggcttgattgttctgtttaa

SEQ ID NO: 191381 - DNA, 25 bp, Homo sapien
aaatttgtactgtggcttatgttac

SEQ ID NO: 191382 - DNA, 25 bp, Homo sapien
gtggcttatgttacacatgttcatg

SEQ ID NO: 191383 - DNA, 25 bp, Homo sapien
tgttcatgttcacctctcattcacc

SEQ ID NO: 191384 - DNA, 25 bp, Homo sapien
cacctctcattcacctgttttatat

SEQ ID NO: 191385 - DNA, 25 bp, Homo sapien
tcacctgaaacgtattttgacctaa

SEQ ID NO: 191386 - DNA, 25 bp, Homo sapien
gaaacatatttttgtatcagtattg

SEQ ID NO: 191387 - DNA, 25 bp, Homo sapien
agtattgaattttggacagtgcccc

SEQ ID NO: 191388 - DNA, 25 bp, Homo sapien
gtgcccccatataaggaagttactg

SEQ ID NO: 191389 - DNA, 25 bp, Homo sapien
aaggattgtccttagatcttcccac

SEQ ID NO: 191390 - DNA, 25 bp, Homo sapien
cttagatcttcccaccatcacaaat

SEQ ID NO: 191391 - DNA, 25 bp, Homo sapien
tgctcatacaactgcattttttctg

SEQ ID NO: 191392 - DNA, 25 bp, Homo sapien
ttctgtctattatgggaaacatcag

SEQ ID NO: 191393 - DNA, 25 bp, Homo sapien
gggaaacatcagacgttctgagtaa

SEQ ID NO: 191394 - DNA, 25 bp, Homo sapien
gtaagatatatctcatggcattagt

SEQ ID NO: 191395 - DNA, 25 bp, Homo sapien
ggtattacatgcaatttatatcaga

SEQ ID NO: 191396 - DNA, 25 bp, Homo sapien
gaacacatttttgtactgcctctct

SEQ ID NO: 191397 - DNA, 25 bp, Homo sapien
acatttttgtactgcctctcttaaa

SEQ ID NO: 191398 - DNA, 25 bp, Homo sapien
gtactgcctctcttaaatgctgaat

SEQ ID NO: 191399 - DNA, 25 bp, Homo sapien
aaatgctgaatgtaactgttatgta

SEQ ID NO: 191400 - DNA, 25 bp, Homo sapien
agtagcccagcatggtttatctcca

SEQ ID NO: 191401 - DNA, 25 bp, Homo sapien
ctgaattcaatactgcaggcacaat

SEQ ID NO: 191402 - DNA, 25 bp, Homo sapien
atgacttaatgctctagggaccgta

SEQ ID NO: 191403 - DNA, 25 bp, Homo sapien
ggaccgtagtgggagattgttacat

SEQ ID NO: 191404 - DNA, 25 bp, Homo sapien
attcttttctaatcctatttgtgtt

SEQ ID NO: 191405 - DNA, 25 bp, Homo sapien
taagtctgtaatgaggtgcatgcct

SEQ ID NO: 191406 - DNA, 25 bp, Homo sapien
tgaggtgcatgccttgaatattcaa

SEQ ID NO: 191407 - DNA, 25 bp, Homo sapien
agatctttcacattgcttttgactt

SEQ ID NO: 191408 - DNA, 25 bp, Homo sapien
acagtttgcattaaatacccaggtg

SEQ ID NO: 191409 - DNA, 25 bp, Homo sapien
taaatacccaggtgcttcggtcagt

SEQ ID NO: 191410 - DNA, 25 bp, Homo sapien
aggtgcttcggtcagtattatctct

SEQ ID NO: 191411 - DNA, 25 bp, Homo sapien
taatttgttgtcatactgtctgtgc

SEQ ID NO: 191412 - DNA, 25 bp, Homo sapien
gttgtcatactgtctgtgctgatgg

SEQ ID NO: 191413 - DNA, 25 bp, Homo sapien
ctgtgctgatggcttggcttaagat

SEQ ID NO: 191414 - DNA, 25 bp, Homo sapien
gcttggcttaagattttgatgcata

SEQ ID NO: 191415 - DNA, 25 bp, Homo sapien
ttgatgcataaatgaggtcactgtt

SEQ ID NO: 191416 - DNA, 25 bp, Homo sapien
gaggtcactgttgatcagtgttgct

SEQ ID NO: 191417 - DNA, 25 bp, Homo sapien
tgttgatcagtgttgctagtagctt

SEQ ID NO: 191418 - DNA, 25 bp, Homo sapien
gtgttgctagtagcttggcagctct

SEQ ID NO: 191419 - DNA, 25 bp, Homo sapien
tgctagtagcttggcagctcttcat

SEQ ID NO: 191420 - DNA, 25 bp, Homo sapien
gcagctcttcataaaagcatattgg

SEQ ID NO: 191421 - DNA, 25 bp, Homo sapien
tggaaaggtgtttgcctatttttca

SEQ ID NO: 191422 - DNA, 25 bp, Homo sapien
gtgggagcttaacacctgtataaaa

SEQ ID NO: 191423 - DNA, 25 bp, Homo sapien
gcacaaggttatcaccttttttatc

SEQ ID NO: 191424 - DNA, 25 bp, Homo sapien
ttttttatccgtccaccgtgacatg

SEQ ID NO: 191425 - DNA, 25 bp, Homo sapien
ccgtgacatggttatgcatccttta

SEQ ID NO: 191426 - DNA, 25 bp, Homo sapien
gcatcctttagattaacctcaccaa

SEQ ID NO: 191427 - DNA, 25 bp, Homo sapien
taacctcaccaaatgaagctttttc

SEQ ID NO: 191428 - DNA, 25 bp, Homo sapien
atccatttttaatattgtccttaca

SEQ ID NO: 191429 - DNA, 25 bp, Homo sapien
tgtccttacataatattgtccttag

SEQ ID NO: 191430 - DNA, 25 bp, Homo sapien
gattttgatcaattctatgtctgac

SEQ ID NO: 191431 - DNA, 25 bp, Homo sapien
aaaccataaagtaacatccaagtgt

SEQ ID NO: 191432 - DNA, 25 bp, Homo sapien
caagtgtttcatggtttgttgggaa

SEQ ID NO: 191433 - DNA, 25 bp, Homo sapien
gtgttttggaacattaattgtgaga

SEQ ID NO: 191434 - DNA, 25 bp, Homo sapien
atttgggaacttttgatacgatctt

SEQ ID NO: 191435 - DNA, 25 bp, Homo sapien
ggaacttttgatacgatcttgtgaa

SEQ ID NO: 191436 - DNA, 25 bp, Homo sapien
gatacgatcttgtgaaaacactgta

SEQ ID NO: 191437 - DNA, 25 bp, Homo sapien
gaaaacactgtattttcgactgaaa

SEQ ID NO: 191438 - DNA, 25 bp, Homo sapien
tttcgactgaaaattccactttctt

SEQ ID NO: 191439 - DNA, 25 bp, Homo sapien
aaaattccactttcttcatcttgtt

SEQ ID NO: 191440 - DNA, 25 bp, Homo sapien
agagggactgttaaatacaatgtat

SEQ ID NO: 191441 - DNA, 25 bp, Homo sapien
gataccatgacaaaaatctttcctg

SEQ ID NO: 191442 - DNA, 25 bp, Homo sapien
aaatctttcctgaattgtctttgta

SEQ ID NO: 191443 - DNA, 25 bp, Homo sapien
tttcctgaattgtctttgtaaaagt

SEQ ID NO: 191444 - DNA, 25 bp, Homo sapien
ttggaactatcagtggcgtctccca

SEQ ID NO: 191445 - DNA, 25 bp, Homo sapien
tttctctttcctagactcgcggtgc

SEQ ID NO: 191446 - DNA, 25 bp, Homo sapien
tcgcggtgctcacatccagacatta

SEQ ID NO: 191447 - DNA, 25 bp, Homo sapien
cagacattaccttgttggtagcccc

SEQ ID NO: 191448 - DNA, 25 bp, Homo sapien
agtggcgtgcagtgacaccagtatc

SEQ ID NO: 191449 - DNA, 25 bp, Homo sapien
gtatcttctctgttgcatttttgca

SEQ ID NO: 191450 - DNA, 25 bp, Homo sapien
atttttgcaatcttgtgtcccgctc

SEQ ID NO: 191451 - DNA, 25 bp, Homo sapien
gtcccgctcggtgatgttctacaaa

SEQ ID NO: 191452 - DNA, 25 bp, Homo sapien
ggtgatgttctacaaactctgtttt

SEQ ID NO: 191453 - DNA, 25 bp, Homo sapien
gtgaagatctcaaaacagtgctaaa

SEQ ID NO: 191454 - DNA, 25 bp, Homo sapien
tgtatatattgcaccttgagttgtc

SEQ ID NO: 191455 - DNA, 25 bp, Homo sapien
tacagttttgcatggcctggtgtga

SEQ ID NO: 191456 - DNA, 25 bp, Homo sapien
ttgcatggcctggtgtgatcatttt

SEQ ID NO: 191457 - DNA, 25 bp, Homo sapien
ggtgtgatcattttttggttagaat

SEQ ID NO: 191458 - DNA, 25 bp, Homo sapien
gggaagatactgctttagcctatca

SEQ ID NO: 191459 - DNA, 25 bp, Homo sapien
tgctttagcctatcactccttattt

SEQ ID NO: 191460 - DNA, 25 bp, Homo sapien
tagcctatcactccttattttattt

SEQ ID NO: 191461 - DNA, 25 bp, Homo sapien
ttgtttggttttatgccctcagtgt

SEQ ID NO: 191462 - DNA, 25 bp, Homo sapien
atgccctcagtgtcttagggaactt

SEQ ID NO: 191463 - DNA, 25 bp, Homo sapien
ctcagtgtcttagggaactttataa

SEQ ID NO: 191464 - DNA, 25 bp, Homo sapien
tcctctgctaccaaacaatgatgtg

SEQ ID NO: 191465 - DNA, 25 bp, Homo sapien
ctcctcaccaatactttatgttgat

SEQ ID NO: 191466 - DNA, 25 bp, Homo sapien
acttgtacaccagtttattactcta

SEQ ID NO: 191467 - DNA, 25 bp, Homo sapien
tggaccaatgtccatttgcttattg

SEQ ID NO: 191468 - DNA, 25 bp, Homo sapien
atgtccatttgcttattggaggcaa

SEQ ID NO: 191469 - DNA, 25 bp, Homo sapien
ttgcttattggaggcaaagctacaa

SEQ ID NO: 191470 - DNA, 25 bp, Homo sapien
atagaagtcagagcatcaccagaat

SEQ ID NO: 191471 - DNA, 25 bp, Homo sapien
agcatcaccagaatggtctttaatg

SEQ ID NO: 191472 - DNA, 25 bp, Homo sapien
gtgaaacaattcataagcacaatat

SEQ ID NO: 191473 - DNA, 25 bp, Homo sapien
ataagcacaatatgatttacagaat

SEQ ID NO: 191474 - DNA, 25 bp, Homo sapien
aaacattcatgtacccactatcagg

SEQ ID NO: 191475 - DNA, 25 bp, Homo sapien
ttcatgtacccactatcaggttaag

SEQ ID NO: 191476 - DNA, 25 bp, Homo sapien
gtacccactatcaggttaagaaata

SEQ ID NO: 191477 - DNA, 25 bp, Homo sapien
tgcttaccacctccctgggtactta

SEQ ID NO: 191478 - DNA, 25 bp, Homo sapien
ttaccacctccctgggtacttacag

SEQ ID NO: 191479 - DNA, 25 bp, Homo sapien
ggtacttacagccttctcttgggaa

SEQ ID NO: 191480 - DNA, 25 bp, Homo sapien
acttacagccttctcttgggaacag

SEQ ID NO: 191481 - DNA, 25 bp, Homo sapien
tacagccttctcttgggaacagccg

SEQ ID NO: 191482 - DNA, 25 bp, Homo sapien
cagccttctcttgggaacagccggg

SEQ ID NO: 191483 - DNA, 25 bp, Homo sapien
tgcagttcccagtctcttctgtcct

SEQ ID NO: 191484 - DNA, 25 bp, Homo sapien
agtctcttctgtcctgcagcccttg

SEQ ID NO: 191485 - DNA, 25 bp, Homo sapien
tttcccacaggttccactttatatc

SEQ ID NO: 191486 - DNA, 25 bp, Homo sapien
acaggttccactttatatccacctt

SEQ ID NO: 191487 - DNA, 25 bp, Homo sapien
tatccaccttttccttttgttcaat

SEQ ID NO: 191488 - DNA, 25 bp, Homo sapien
ttctcctctccccttgtgaagagga

SEQ ID NO: 191489 - DNA, 25 bp, Homo sapien
ttgtgaagaggacccagatctggct

SEQ ID NO: 191490 - DNA, 25 bp, Homo sapien
aagaggacccagatctggcttcttt

SEQ ID NO: 191491 - DNA, 25 bp, Homo sapien
gatctggcttctttcccaaggaggg

SEQ ID NO: 191492 - DNA, 25 bp, Homo sapien
tcgcgtccctgtccttgaaggacct

SEQ ID NO: 191493 - DNA, 25 bp, Homo sapien
atgcagagccccaccggtgggaaag

SEQ ID NO: 191494 - DNA, 25 bp, Homo sapien
cccaccggtgggaaagttgcctgtg

SEQ ID NO: 191495 - DNA, 25 bp, Homo sapien
agttgcctgtggaagggagcctttt

SEQ ID NO: 191496 - DNA, 25 bp, Homo sapien
ggaagggagccttttgctacaattt

SEQ ID NO: 191497 - DNA, 25 bp, Homo sapien
aagggagccttttgctacaatttgt

SEQ ID NO: 191498 - DNA, 25 bp, Homo sapien
ttctaaagtctattttgtaacaatt

SEQ ID NO: 191499 - DNA, 25 bp, Homo sapien
ccccaccttgaatagctaaagtctc

SEQ ID NO: 191500 - DNA, 25 bp, Homo sapien
atagctaaagtctcttatgaaacag

SEQ ID NO: 191501 - DNA, 25 bp, Homo sapien
cagagaagagttgttgacgtctaac

SEQ ID NO: 191502 - DNA, 25 bp, Homo sapien
agttgttgacgtctaactccttcca

SEQ ID NO: 191503 - DNA, 25 bp, Homo sapien
gacgtctaactccttccattaaatt

SEQ ID NO: 191504 - DNA, 25 bp, Homo sapien
ttaataagtactgacctcctaatat

SEQ ID NO: 191505 - DNA, 25 bp, Homo sapien
ctgacctcctaatatttaagtgttt

SEQ ID NO: 191506 - DNA, 25 bp, Homo sapien
tttttccccaaatagtagatgtcta

SEQ ID NO: 191507 - DNA, 25 bp, Homo sapien
atcattgtacatctgattcttttat

SEQ ID NO: 191508 - DNA, 25 bp, Homo sapien
gattcttttatattccattgttcag

SEQ ID NO: 191509 - DNA, 25 bp, Homo sapien
tccattgttcagcacaaagtgtggt

SEQ ID NO: 191510 - DNA, 25 bp, Homo sapien
gtagaaatgaagtccatattgggcc

SEQ ID NO: 191511 - DNA, 25 bp, Homo sapien
agaaatgaagtccatattgggccag

SEQ ID NO: 191512 - DNA, 25 bp, Homo sapien
gaaatgaagtccatattgggccagg

SEQ ID NO: 191513 - DNA, 25 bp, Homo sapien
aaatgaagtccatattgggccaggt

SEQ ID NO: 191514 - DNA, 25 bp, Homo sapien
aatgaagtccatattgggccaggtg

SEQ ID NO: 191515 - DNA, 25 bp, Homo sapien
atgaagtccatattgggccaggtgc

SEQ ID NO: 191516 - DNA, 25 bp, Homo sapien
tgaagtccatattgggccaggtgcg

SEQ ID NO: 191517 - DNA, 25 bp, Homo sapien
gaagtccatattgggccaggtgcgg

SEQ ID NO: 191518 - DNA, 25 bp, Homo sapien
gtggctcccgcctgtgtaatgccag

SEQ ID NO: 191519 - DNA, 25 bp, Homo sapien
ggctcccgcctgtgtaatgccagca

SEQ ID NO: 191520 - DNA, 25 bp, Homo sapien
ctcccgcctgtgtaatgccagcatt

SEQ ID NO: 191521 - DNA, 25 bp, Homo sapien
ttggccgacgcgtccaactcccaag

SEQ ID NO: 191522 - DNA, 25 bp, Homo sapien
cgtccaactcccaaggctgccgtgg

SEQ ID NO: 191523 - DNA, 25 bp, Homo sapien
ggagtctcccgcctgaacctgaaga

SEQ ID NO: 191524 - DNA, 25 bp, Homo sapien
gctgcctgtcagtcttggggaatct

SEQ ID NO: 191525 - DNA, 25 bp, Homo sapien
tcttggggaatctggcccaggtctc

SEQ ID NO: 191526 - DNA, 25 bp, Homo sapien
ctctgccccagttctgggagaagtt

SEQ ID NO: 191527 - DNA, 25 bp, Homo sapien
cccagttctgggagaagtttctact

SEQ ID NO: 191528 - DNA, 25 bp, Homo sapien
ttctgggagaagtttctactggtgt

SEQ ID NO: 191529 - DNA, 25 bp, Homo sapien
gggagaagtttctactggtgtatat

SEQ ID NO: 191530 - DNA, 25 bp, Homo sapien
tctactggtgtatattttttactgg

SEQ ID NO: 191531 - DNA, 25 bp, Homo sapien
ctggtgtatattttttactggaaat

SEQ ID NO: 191532 - DNA, 25 bp, Homo sapien
tgcttattcttttcagttctaaaac

SEQ ID NO: 191533 - DNA, 25 bp, Homo sapien
ttcagttctaaaacctgtaggaaag

SEQ ID NO: 191534 - DNA, 25 bp, Homo sapien
gtttagaagctgtcaacaagttgat

SEQ ID NO: 191535 - DNA, 25 bp, Homo sapien
aagttgataatgtagcccgatctct

SEQ ID NO: 191536 - DNA, 25 bp, Homo sapien
gcccgatctctacccatgataggag

SEQ ID NO: 191537 - DNA, 25 bp, Homo sapien
cccatgataggagagtaaggcttat

SEQ ID NO: 191538 - DNA, 25 bp, Homo sapien
tagggcactaaatacaggaaccatg

SEQ ID NO: 191539 - DNA, 25 bp, Homo sapien
atctcagaattctaggtgtccctct

SEQ ID NO: 191540 - DNA, 25 bp, Homo sapien
gaattctaggtgtccctctgctgta

SEQ ID NO: 191541 - DNA, 25 bp, Homo sapien
cctctgctgtacatccctaaatttt

SEQ ID NO: 191542 - DNA, 25 bp, Homo sapien
gctgtacatccctaaattttttgcg

SEQ ID NO: 191543 - DNA, 25 bp, Homo sapien
tcctgctgccgtcgctgccatcttg

SEQ ID NO: 191544 - DNA, 25 bp, Homo sapien
tcgctgccatcttgcccctagcctg

SEQ ID NO: 191545 - DNA, 25 bp, Homo sapien
cccaccctcatgttcagggtggatg

SEQ ID NO: 191546 - DNA, 25 bp, Homo sapien
accctcatgttcagggtggatgtgg

SEQ ID NO: 191547 - DNA, 25 bp, Homo sapien
tcatgttcagggtggatgtgggcat

SEQ ID NO: 191548 - DNA, 25 bp, Homo sapien
tgttcagggtggatgtgggcatgca

SEQ ID NO: 191549 - DNA, 25 bp, Homo sapien
tcagggtggatgtgggcatgcaggt

SEQ ID NO: 191550 - DNA, 25 bp, Homo sapien
gggcccaggatgtagatattgtaca

SEQ ID NO: 191551 - DNA, 25 bp, Homo sapien
ggcccaggatgtagatattgtacaa

SEQ ID NO: 191552 - DNA, 25 bp, Homo sapien
gcccaggatgtagatattgtacaaa

SEQ ID NO: 191553 - DNA, 25 bp, Homo sapien
gatattgtacaaaggtttctaaatc

SEQ ID NO: 191554 - DNA, 25 bp, Homo sapien
gaaatgcatgtttatggcttttttg

SEQ ID NO: 191555 - DNA, 25 bp, Homo sapien
ataaatgcagtgatctatggcttaa

SEQ ID NO: 191556 - DNA, 25 bp, Homo sapien
aatgcagtgatctatggcttaaaaa

SEQ ID NO: 191557 - DNA, 25 bp, Homo sapien
aaaaaatttgtttctgtgacaatgt

SEQ ID NO: 191558 - DNA, 25 bp, Homo sapien
gacaatgtttgtaaatctagccaat

SEQ ID NO: 191559 - DNA, 25 bp, Homo sapien
ctagccaatagagtcatttacagaa

SEQ ID NO: 191560 - DNA, 25 bp, Homo sapien
ttgaacgtactcataaatatgactt

SEQ ID NO: 191561 - DNA, 25 bp, Homo sapien
aatatgacttattgtattgccttaa

SEQ ID NO: 191562 - DNA, 25 bp, Homo sapien
tattgccttaagttttcactcattg

SEQ ID NO: 191563 - DNA, 25 bp, Homo sapien
gccttaagttttcactcattgtctt

SEQ ID NO: 191564 - DNA, 25 bp, Homo sapien
taagttttcactcattgtcttttga

SEQ ID NO: 191565 - DNA, 25 bp, Homo sapien
ggtctgcatgcagcagcactgacgt

SEQ ID NO: 191566 - DNA, 25 bp, Homo sapien
gtctgcatgcagcagcactgacgtc

SEQ ID NO: 191567 - DNA, 25 bp, Homo sapien
tctgcatgcagcagcactgacgtcc

SEQ ID NO: 191568 - DNA, 25 bp, Homo sapien
tgcatgcagcagcactgacgtcctc

SEQ ID NO: 191569 - DNA, 25 bp, Homo sapien
gcatgcagcagcactgacgtcctct

SEQ ID NO: 191570 - DNA, 25 bp, Homo sapien
atgcagcagcactgacgtcctctcc

SEQ ID NO: 191571 - DNA, 25 bp, Homo sapien
gcagcagcactgacgtcctctcctg

SEQ ID NO: 191572 - DNA, 25 bp, Homo sapien
gcagcactgacgtcctctcctgcat

SEQ ID NO: 191573 - DNA, 25 bp, Homo sapien
gcatcctacacctcctgggcaaggg

SEQ ID NO: 191574 - DNA, 25 bp, Homo sapien
ctcctgggcaagggcacgctgagac

SEQ ID NO: 191575 - DNA, 25 bp, Homo sapien
tcctgggcaagggcacgctgagacg

SEQ ID NO: 191576 - DNA, 25 bp, Homo sapien
atgactgaagtttatgtatagacac

SEQ ID NO: 191577 - DNA, 25 bp, Homo sapien
aatgttgtatgatagcccttctcca

SEQ ID NO: 191578 - DNA, 25 bp, Homo sapien
gatagcccttctccaaagcagaggt

SEQ ID NO: 191579 - DNA, 25 bp, Homo sapien
tagaatgttcaggtttcaccatgga

SEQ ID NO: 191580 - DNA, 25 bp, Homo sapien
accatggattttctacttatttcgt

SEQ ID NO: 191581 - DNA, 25 bp, Homo sapien
tctacttatttcgtttttggaatca

SEQ ID NO: 191582 - DNA, 25 bp, Homo sapien
ttccaggtcccttttgtatatattc

SEQ ID NO: 191583 - DNA, 25 bp, Homo sapien
attagtcaatgtttcgtgttccgca

SEQ ID NO: 191584 - DNA, 25 bp, Homo sapien
tcgtgttccgcattatttgaaccat

SEQ ID NO: 191585 - DNA, 25 bp, Homo sapien
tatttgaaccatttgcccttacaga

SEQ ID NO: 191586 - DNA, 25 bp, Homo sapien
gaaccatttgcccttacagaaagag

SEQ ID NO: 191587 - DNA, 25 bp, Homo sapien
atatttgggtactgattatatccac

SEQ ID NO: 191588 - DNA, 25 bp, Homo sapien
tttgggtactgattatatccacatg

SEQ ID NO: 191589 - DNA, 25 bp, Homo sapien
gggtactgattatatccacatggaa

SEQ ID NO: 191590 - DNA, 25 bp, Homo sapien
ggtactgattatatccacatggaag

SEQ ID NO: 191591 - DNA, 25 bp, Homo sapien
gtactgattatatccacatggaagt

SEQ ID NO: 191592 - DNA, 25 bp, Homo sapien
atatccacatggaagtagaaggtaa

SEQ ID NO: 191593 - DNA, 25 bp, Homo sapien
ggaaaatactagaatctactctgct

SEQ ID NO: 191594 - DNA, 25 bp, Homo sapien
atactagaatctactctgcttacat

SEQ ID NO: 191595 - DNA, 25 bp, Homo sapien
tgtatgaatacattatcctccttat

SEQ ID NO: 191596 - DNA, 25 bp, Homo sapien
gtatgaatacattatcctccttatt

SEQ ID NO: 191597 - DNA, 25 bp, Homo sapien
tatgaatacattatcctccttattt

SEQ ID NO: 191598 - DNA, 25 bp, Homo sapien
gctccgcctctgaccgtcagtggtg

SEQ ID NO: 191599 - DNA, 25 bp, Homo sapien
ctctgaccgtcagtggtgggaacct

SEQ ID NO: 191600 - DNA, 25 bp, Homo sapien
tggtgggaacctgggcggctctgga

SEQ ID NO: 191601 - DNA, 25 bp, Homo sapien
gaacctgggcggctctggaggccca

SEQ ID NO: 191602 - DNA, 25 bp, Homo sapien
tgggcgtgttgtttgctcaggaaac

SEQ ID NO: 191603 - DNA, 25 bp, Homo sapien
gtttgctcaggaaacagggcagcca

SEQ ID NO: 191604 - DNA, 25 bp, Homo sapien
tttgctcaggaaacagggcagccag

SEQ ID NO: 191605 - DNA, 25 bp, Homo sapien
ttcccggcgttttaggatctgtaca

SEQ ID NO: 191606 - DNA, 25 bp, Homo sapien
cccggcgttttaggatctgtacata

SEQ ID NO: 191607 - DNA, 25 bp, Homo sapien
cggcgttttaggatctgtacataga

SEQ ID NO: 191608 - DNA, 25 bp, Homo sapien
gcgttttaggatctgtacatagaga

SEQ ID NO: 191609 - DNA, 25 bp, Homo sapien
tatatactgctgtatcatgccagga

SEQ ID NO: 191610 - DNA, 25 bp, Homo sapien
catgccaggatttatcagcattccc

SEQ ID NO: 191611 - DNA, 25 bp, Homo sapien
gcattcccaagggagcttgcacggt

SEQ ID NO: 191612 - DNA, 25 bp, Homo sapien
aagggagcttgcacggtactgaccg

SEQ ID NO: 191613 - DNA, 25 bp, Homo sapien
gtactgaccgagtgctgagactact

SEQ ID NO: 191614 - DNA, 25 bp, Homo sapien
tgagactactggtattcccagctgc

SEQ ID NO: 191615 - DNA, 25 bp, Homo sapien
ggagctactagaatattctcagcac

SEQ ID NO: 191616 - DNA, 25 bp, Homo sapien
ttctcagcacaggaatgaggcttcc

SEQ ID NO: 191617 - DNA, 25 bp, Homo sapien
gaatgaggcttccttggtttccatg

SEQ ID NO: 191618 - DNA, 25 bp, Homo sapien
ggtttccatgtctgtaagggttact

SEQ ID NO: 191619 - DNA, 25 bp, Homo sapien
gggttactgatcacttaccttcttc

SEQ ID NO: 191620 - DNA, 25 bp, Homo sapien
aattgcattcttgtagtgagcagtg

SEQ ID NO: 191621 - DNA, 25 bp, Homo sapien
agcagtgtatggtctcttttgttca

SEQ ID NO: 191622 - DNA, 25 bp, Homo sapien
ttctcttattcctctaccgtcattt

SEQ ID NO: 191623 - DNA, 25 bp, Homo sapien
tattcctctaccgtcatttacatga

SEQ ID NO: 191624 - DNA, 25 bp, Homo sapien
tactaagtggtactagggaactaca

SEQ ID NO: 191625 - DNA, 25 bp, Homo sapien
ggtactagggaactacaagaatact

SEQ ID NO: 191626 - DNA, 25 bp, Homo sapien
agaatactgtaaagcttaagccatt

SEQ ID NO: 191627 - DNA, 25 bp, Homo sapien
atcactgtcatttagcatttaataa

SEQ ID NO: 191628 - DNA, 25 bp, Homo sapien
aactatacagaattatgtgcatacc

SEQ ID NO: 191629 - DNA, 25 bp, Homo sapien
attatgtgcataccaatgaatgttt

SEQ ID NO: 191630 - DNA, 25 bp, Homo sapien
gaatgttttgtaccatctagttaaa

SEQ ID NO: 191631 - DNA, 25 bp, Homo sapien
ttcaagcctattttatttgtacctg

SEQ ID NO: 191632 - DNA, 25 bp, Homo sapien
tcaagcctattttatttgtacctgt

SEQ ID NO: 191633 - DNA, 25 bp, Homo sapien
gcctattttatttgtacctgtaaat

SEQ ID NO: 191634 - DNA, 25 bp, Homo sapien
tgtaaatactgtacagctaatatat

SEQ ID NO: 191635 - DNA, 25 bp, Homo sapien
gtgtgtttatagagatacacacaca

SEQ ID NO: 191636 - DNA, 25 bp, Homo sapien
acacacgcatttgcacagacacaca

SEQ ID NO: 191637 - DNA, 25 bp, Homo sapien
tatcaattctcatgagtgtattata

SEQ ID NO: 191638 - DNA, 25 bp, Homo sapien
tgagtgtattataatctctggtggg

SEQ ID NO: 191639 - DNA, 25 bp, Homo sapien
ataatctctggtgggggcaagtgtc

SEQ ID NO: 191640 - DNA, 25 bp, Homo sapien
aaggcctgaggggcacttcagatga

SEQ ID NO: 191641 - DNA, 25 bp, Homo sapien
gagaggtagggagccaggtgcagca

SEQ ID NO: 191642 - DNA, 25 bp, Homo sapien
tgggtgcccggcagctccactagat

SEQ ID NO: 191643 - DNA, 25 bp, Homo sapien
gcccggcagctccactagatttttg

SEQ ID NO: 191644 - DNA, 25 bp, Homo sapien
ggattcattcctttgaagggagtcg

SEQ ID NO: 191645 - DNA, 25 bp, Homo sapien
gggagtcgggttcacccttccatcg

SEQ ID NO: 191646 - DNA, 25 bp, Homo sapien
gggttcacccttccatcgtattctc

SEQ ID NO: 191647 - DNA, 25 bp, Homo sapien
atcgtattctcccaactacacattg

SEQ ID NO: 191648 - DNA, 25 bp, Homo sapien
gtattctcccaactacacattgtaa

SEQ ID NO: 191649 - DNA, 25 bp, Homo sapien
tacacattgtaaagcctgagaaact

SEQ ID NO: 191650 - DNA, 25 bp, Homo sapien
aagcctgagaaacttctagaacctc

SEQ ID NO: 191651 - DNA, 25 bp, Homo sapien
agaaacttctagaacctcaggaagc

SEQ ID NO: 191652 - DNA, 25 bp, Homo sapien
agggcccacggctcctgagcaacag

SEQ ID NO: 191653 - DNA, 25 bp, Homo sapien
gccacataggtggaggttttccatg

SEQ ID NO: 191654 - DNA, 25 bp, Homo sapien
ggttttccatgtccaaatgaggtca

SEQ ID NO: 191655 - DNA, 25 bp, Homo sapien
tgaggtcaagatgccgaaatcccag

SEQ ID NO: 191656 - DNA, 25 bp, Homo sapien
gaaatcccagatctgacttcacact

SEQ ID NO: 191657 - DNA, 25 bp, Homo sapien
tcacacttcccttttctagaacctt

SEQ ID NO: 191658 - DNA, 25 bp, Homo sapien
tctgtgtctgttgtgccttgcccgg

SEQ ID NO: 191659 - DNA, 25 bp, Homo sapien
ggcgcctcacggatggcaaagctct

SEQ ID NO: 191660 - DNA, 25 bp, Homo sapien
ctcacccatgggactgtagtgcaat

SEQ ID NO: 191661 - DNA, 25 bp, Homo sapien
agtgcaattaaacccgcgtctaggt

SEQ ID NO: 191662 - DNA, 25 bp, Homo sapien
cccgcgtctaggtgatgcttttaaa

SEQ ID NO: 191663 - DNA, 25 bp, Homo sapien
aaagttgtagcttcgtgctttgtac

SEQ ID NO: 191664 - DNA, 25 bp, Homo sapien
tagcatgtaaactcacagaaggcaa

SEQ ID NO: 191665 - DNA, 25 bp, Homo sapien
tagactttccaaatgcatcctgcaa

SEQ ID NO: 191666 - DNA, 25 bp, Homo sapien
gagagatagctgatagggactgaca

SEQ ID NO: 191667 - DNA, 25 bp, Homo sapien
gggactgacaagcacactgtttaga

SEQ ID NO: 191668 - DNA, 25 bp, Homo sapien
gataagaagcaattacccttttata

SEQ ID NO: 191669 - DNA, 25 bp, Homo sapien
atctgtgctctatacattttctatg

SEQ ID NO: 191670 - DNA, 25 bp, Homo sapien
cattttctatgtgcagcatctttcc

SEQ ID NO: 191671 - DNA, 25 bp, Homo sapien
agggactgccggctgtttcgtacaa

SEQ ID NO: 191672 - DNA, 25 bp, Homo sapien
gtttcgtacaacattcttgccaatt

SEQ ID NO: 191673 - DNA, 25 bp, Homo sapien
attcttgccaattcccttgaggaga

SEQ ID NO: 191674 - DNA, 25 bp, Homo sapien
aaaattcttcacatggcttctgcat

SEQ ID NO: 191675 - DNA, 25 bp, Homo sapien
ggcctcgtatcctacctttccttgt

SEQ ID NO: 191676 - DNA, 25 bp, Homo sapien
ggctggctgcacagaggattgcccc

SEQ ID NO: 191677 - DNA, 25 bp, Homo sapien
ctggctgcacagaggattgcccctt

SEQ ID NO: 191678 - DNA, 25 bp, Homo sapien
ggctgcacagaggattgccccttct

SEQ ID NO: 191679 - DNA, 25 bp, Homo sapien
tgcacagaggattgccccttctctt

SEQ ID NO: 191680 - DNA, 25 bp, Homo sapien
agaggattgccccttctcttttcag

SEQ ID NO: 191681 - DNA, 25 bp, Homo sapien
gaggattgccccttctcttttcaga

SEQ ID NO: 191682 - DNA, 25 bp, Homo sapien
ctggccctcgatgccaaattagcat

SEQ ID NO: 191683 - DNA, 25 bp, Homo sapien
gccctcgatgccaaattagcattta

SEQ ID NO: 191684 - DNA, 25 bp, Homo sapien
cgatgccaaattagcatttagtatt

SEQ ID NO: 191685 - DNA, 25 bp, Homo sapien
ctctgggccgcttctggcctcttgg

SEQ ID NO: 191686 - DNA, 25 bp, Homo sapien
gactaattatggtaacttagcttag

SEQ ID NO: 191687 - DNA, 25 bp, Homo sapien
ggtaacttagcttagtattcaatat

SEQ ID NO: 191688 - DNA, 25 bp, Homo sapien
aaattaagtgtctagttcttgctaa

SEQ ID NO: 191689 - DNA, 25 bp, Homo sapien
agtgtctagttcttgctaaaatcaa

SEQ ID NO: 191690 - DNA, 25 bp, Homo sapien
aatcaagtcattgcattgtgttcta

SEQ ID NO: 191691 - DNA, 25 bp, Homo sapien
agtcattgcattgtgttctaattac

SEQ ID NO: 191692 - DNA, 25 bp, Homo sapien
gcttagattgttgtactgctgccat

SEQ ID NO: 191693 - DNA, 25 bp, Homo sapien
gattgttgtactgctgccattttta

SEQ ID NO: 191694 - DNA, 25 bp, Homo sapien
gtactgctgccatttttattggtgt

SEQ ID NO: 191695 - DNA, 25 bp, Homo sapien
gaatggtgccatattgtcactcctt

SEQ ID NO: 191696 - DNA, 25 bp, Homo sapien
gtcactccttctacttgctttaaaa

SEQ ID NO: 191697 - DNA, 25 bp, Homo sapien
ttctttccttctttgctcactttac

SEQ ID NO: 191698 - DNA, 25 bp, Homo sapien
cttctttgctcactttactatgggt

SEQ ID NO: 191699 - DNA, 25 bp, Homo sapien
gctcactttactatgggtgtatttt

SEQ ID NO: 191700 - DNA, 25 bp, Homo sapien
gagtcatgcacatgtatacgttatg

SEQ ID NO: 191701 - DNA, 25 bp, Homo sapien
atacgttatgtatttgacaagtggt

SEQ ID NO: 191702 - DNA, 25 bp, Homo sapien
atgtcagtacattttgtgccactaa

SEQ ID NO: 191703 - DNA, 25 bp, Homo sapien
ttttgtgccactaacactgtgatgt

SEQ ID NO: 191704 - DNA, 25 bp, Homo sapien
gtgccactaacactgtgatgtataa

SEQ ID NO: 191705 - DNA, 25 bp, Homo sapien
agagctgtttgaatgccttttaatg

SEQ ID NO: 191706 - DNA, 25 bp, Homo sapien
atgttgtgttttgtactctggaatc

SEQ ID NO: 191707 - DNA, 25 bp, Homo sapien
tttgtactctggaatcatatggaaa

SEQ ID NO: 191708 - DNA, 25 bp, Homo sapien
agccttaggaaggaagcacgtggag

SEQ ID NO: 191709 - DNA, 25 bp, Homo sapien
ggaaggaagcacgtggaggagggac

SEQ ID NO: 191710 - DNA, 25 bp, Homo sapien
gagggacggaggaggttcccttgct

SEQ ID NO: 191711 - DNA, 25 bp, Homo sapien
ggacggaggaggttcccttgctggg

SEQ ID NO: 191712 - DNA, 25 bp, Homo sapien
gacggaggaggttcccttgctgggc

SEQ ID NO: 191713 - DNA, 25 bp, Homo sapien
aggaggttcccttgctgggcatgct

SEQ ID NO: 191714 - DNA, 25 bp, Homo sapien
ggaggttcccttgctgggcatgctt

SEQ ID NO: 191715 - DNA, 25 bp, Homo sapien
tgctgggcatgcttcgtagagggcc

SEQ ID NO: 191716 - DNA, 25 bp, Homo sapien
gctgggcatgcttcgtagagggcca

SEQ ID NO: 191717 - DNA, 25 bp, Homo sapien
catgcttcgtagagggccaggagca

SEQ ID NO: 191718 - DNA, 25 bp, Homo sapien
atgcttcgtagagggccaggagcag

SEQ ID NO: 191719 - DNA, 25 bp, Homo sapien
aggagtcaacgtatttcgcagcgta

SEQ ID NO: 191720 - DNA, 25 bp, Homo sapien
ggagtcaacgtatttcgcagcgtat

SEQ ID NO: 191721 - DNA, 25 bp, Homo sapien
gagtcaacgtatttcgcagcgtatt

SEQ ID NO: 191722 - DNA, 25 bp, Homo sapien
gtcaacgtatttcgcagcgtattac

SEQ ID NO: 191723 - DNA, 25 bp, Homo sapien
aacgtatttcgcagcgtattacgta

SEQ ID NO: 191724 - DNA, 25 bp, Homo sapien
gtatttcgcagcgtattacgtaaaa

SEQ ID NO: 191725 - DNA, 25 bp, Homo sapien
cagcgtattacgtaaaatgattttt

SEQ ID NO: 191726 - DNA, 25 bp, Homo sapien
atgtgcttatatatgtcagtctatt

SEQ ID NO: 191727 - DNA, 25 bp, Homo sapien
gtgcttatatatgtcagtctattaa

SEQ ID NO: 191728 - DNA, 25 bp, Homo sapien
agtctattaaatgtacaccaagtaa

SEQ ID NO: 191729 - DNA, 25 bp, Homo sapien
aatgtacaccaagtaatgtaatact

SEQ ID NO: 191730 - DNA, 25 bp, Homo sapien
gtctatgaactttgtgaatttccca

SEQ ID NO: 191731 - DNA, 25 bp, Homo sapien
gataatcccagtagctgttacctgt

SEQ ID NO: 191732 - DNA, 25 bp, Homo sapien
ctgttacctgtctccatgtatcaaa

SEQ ID NO: 191733 - DNA, 25 bp, Homo sapien
gatgtggtttctctatagtgcaaca

SEQ ID NO: 191734 - DNA, 25 bp, Homo sapien
atggtttctcaatgttctgctgtgc

SEQ ID NO: 191735 - DNA, 25 bp, Homo sapien
ttctgctgtgcagcaagcagggtct

SEQ ID NO: 191736 - DNA, 25 bp, Homo sapien
ggtttcaggagcagtcactattgta

SEQ ID NO: 191737 - DNA, 25 bp, Homo sapien
gtcactattgtaggatgggcttcca

SEQ ID NO: 191738 - DNA, 25 bp, Homo sapien
aggatgggcttccaatcaaacctca

SEQ ID NO: 191739 - DNA, 25 bp, Homo sapien
aaacctcagactaaactcttgtact

SEQ ID NO: 191740 - DNA, 25 bp, Homo sapien
ctcttgtactgaactgattctacct

SEQ ID NO: 191741 - DNA, 25 bp, Homo sapien
aagctaaacactacattgaaacgca

SEQ ID NO: 191742 - DNA, 25 bp, Homo sapien
gaaacgcaaacaaaattctggtgaa

SEQ ID NO: 191743 - DNA, 25 bp, Homo sapien
attctggtgaaataactgggctgtt

SEQ ID NO: 191744 - DNA, 25 bp, Homo sapien
ataactgggctgttgatgcaggtca

SEQ ID NO: 191745 - DNA, 25 bp, Homo sapien
gtagctgaggatattaattcccatt

SEQ ID NO: 191746 - DNA, 25 bp, Homo sapien
gaggatattaattcccattatataa

SEQ ID NO: 191747 - DNA, 25 bp, Homo sapien
gtaataaaccaagctgtacaattta

SEQ ID NO: 191748 - DNA, 25 bp, Homo sapien
accaagctgtacaatttagtttata

SEQ ID NO: 191749 - DNA, 25 bp, Homo sapien
tagtttataatagcagtatctgagc

SEQ ID NO: 191750 - DNA, 25 bp, Homo sapien
aatagcagtatctgagctgctccaa

SEQ ID NO: 191751 - DNA, 25 bp, Homo sapien
gagctgctccaaaatatatatatca

SEQ ID NO: 191752 - DNA, 25 bp, Homo sapien
gaatcactcagatgccccaagatgt

SEQ ID NO: 191753 - DNA, 25 bp, Homo sapien
caagatgtccgttgggaagctccca

SEQ ID NO: 191754 - DNA, 25 bp, Homo sapien
gaagctcccaggacagcacttttta

SEQ ID NO: 191755 - DNA, 25 bp, Homo sapien
actttttatacagaggacaccgcct

SEQ ID NO: 191756 - DNA, 25 bp, Homo sapien
tgaaaactgcaatcacagccgtccg

SEQ ID NO: 191757 - DNA, 25 bp, Homo sapien
cacagccgtccgctggaaaaacgtt

SEQ ID NO: 191758 - DNA, 25 bp, Homo sapien
aaacgtttcgaagcacagtggccag

SEQ ID NO: 191759 - DNA, 25 bp, Homo sapien
tggctactccctgttgcatgtcaaa

SEQ ID NO: 191760 - DNA, 25 bp, Homo sapien
gttgcatgtcaaatccacacagatg

SEQ ID NO: 191761 - DNA, 25 bp, Homo sapien
gcctgggtgggttcatgtccaatct

SEQ ID NO: 191762 - DNA, 25 bp, Homo sapien
tgtccaatcttgttcgatcactaga

SEQ ID NO: 191763 - DNA, 25 bp, Homo sapien
ggaaagggcttcaaggcaccaccag

SEQ ID NO: 191764 - DNA, 25 bp, Homo sapien
gaaagggcttcaaggcaccaccagt

SEQ ID NO: 191765 - DNA, 25 bp, Homo sapien
aaggcaccaccagtggtatttaata

SEQ ID NO: 191766 - DNA, 25 bp, Homo sapien
aggcaccaccagtggtatttaatat

SEQ ID NO: 191767 - DNA, 25 bp, Homo sapien
gcaccaccagtggtatttaatattc

SEQ ID NO: 191768 - DNA, 25 bp, Homo sapien
accaccagtggtatttaatattcat

SEQ ID NO: 191769 - DNA, 25 bp, Homo sapien
ccaccagtggtatttaatattcata

SEQ ID NO: 191770 - DNA, 25 bp, Homo sapien
gtggtatttaatattcatacttggg

SEQ ID NO: 191771 - DNA, 25 bp, Homo sapien
atttaatattcatacttggggccag

SEQ ID NO: 191772 - DNA, 25 bp, Homo sapien
tttaatattcatacttggggccagg

SEQ ID NO: 191773 - DNA, 25 bp, Homo sapien
atattcatacttggggccaggcatg

SEQ ID NO: 191774 - DNA, 25 bp, Homo sapien
agggtagctgcctgcataggagcct

SEQ ID NO: 191775 - DNA, 25 bp, Homo sapien
ataggagcctcgcttccgattattc

SEQ ID NO: 191776 - DNA, 25 bp, Homo sapien
ccgattattcccttcccaatattat

SEQ ID NO: 191777 - DNA, 25 bp, Homo sapien
attattcatccagacttagccacag

SEQ ID NO: 191778 - DNA, 25 bp, Homo sapien
gtgccttttacatcgggtttgttct

SEQ ID NO: 191779 - DNA, 25 bp, Homo sapien
ggtttgttctccttccatggtgtgt

SEQ ID NO: 191780 - DNA, 25 bp, Homo sapien
ccatggtgtgttgctgacattgtca

SEQ ID NO: 191781 - DNA, 25 bp, Homo sapien
gacattgtcactgagtcccatgtga

SEQ ID NO: 191782 - DNA, 25 bp, Homo sapien
gagtattacctttcatctgtgccat

SEQ ID NO: 191783 - DNA, 25 bp, Homo sapien
tctgtgccatgctctagaaccttga

SEQ ID NO: 191784 - DNA, 25 bp, Homo sapien
aaccttgaccttgatagttcaccac

SEQ ID NO: 191785 - DNA, 25 bp, Homo sapien
cttccatgcttgctttgtttctgaa

SEQ ID NO: 191786 - DNA, 25 bp, Homo sapien
atagcctgtggactgtatgctgaca

SEQ ID NO: 191787 - DNA, 25 bp, Homo sapien
gatcaagtcactcaactcgtgttga

SEQ ID NO: 191788 - DNA, 25 bp, Homo sapien
ctcgtgttgacataagcttacccca

SEQ ID NO: 191789 - DNA, 25 bp, Homo sapien
gcttaccccaacttgaattactcag

SEQ ID NO: 191790 - DNA, 25 bp, Homo sapien
aattactcagccctgttgttgcaga

SEQ ID NO: 191791 - DNA, 25 bp, Homo sapien
aacatggctacttttcgttggatcc

SEQ ID NO: 191792 - DNA, 25 bp, Homo sapien
gttggatccatgtctcctgcgtttc

SEQ ID NO: 191793 - DNA, 25 bp, Homo sapien
tcctgcgtttcggagagctgcatat

SEQ ID NO: 191794 - DNA, 25 bp, Homo sapien
atgtcagtcataacctttgtccctg

SEQ ID NO: 191795 - DNA, 25 bp, Homo sapien
ttgtccctgtaacctgtcagttaac

SEQ ID NO: 191796 - DNA, 25 bp, Homo sapien
ttcataataacgagaagaattcaga

SEQ ID NO: 191797 - DNA, 25 bp, Homo sapien
agaattcagaaaaccacttaagcaa

SEQ ID NO: 191798 - DNA, 25 bp, Homo sapien
gaattcagaaaaccacttaagcaag

SEQ ID NO: 191799 - DNA, 25 bp, Homo sapien
aattcagaaaaccacttaagcaaga

SEQ ID NO: 191800 - DNA, 25 bp, Homo sapien
attcagaaaaccacttaagcaagac

SEQ ID NO: 191801 - DNA, 25 bp, Homo sapien
cacttaagcaagacccttctgaaat

SEQ ID NO: 191802 - DNA, 25 bp, Homo sapien
acttaagcaagacccttctgaaata

SEQ ID NO: 191803 - DNA, 25 bp, Homo sapien
ttaagcaagacccttctgaaataaa

SEQ ID NO: 191804 - DNA, 25 bp, Homo sapien
taagcaagacccttctgaaataaaa

SEQ ID NO: 191805 - DNA, 25 bp, Homo sapien
aacatgtcaaccttatgtaaggaaa

SEQ ID NO: 191806 - DNA, 25 bp, Homo sapien
catgtcaaccttatgtaaggaaaaa

SEQ ID NO: 191807 - DNA, 25 bp, Homo sapien
tctctaaactagctcttttgttagt

SEQ ID NO: 191808 - DNA, 25 bp, Homo sapien
ctcttttgttagtatcgtctcacaa

SEQ ID NO: 191809 - DNA, 25 bp, Homo sapien
gttagtatcgtctcacaaactgatt

SEQ ID NO: 191810 - DNA, 25 bp, Homo sapien
acaaactgattattttcctctttct

SEQ ID NO: 191811 - DNA, 25 bp, Homo sapien
caataactgggagatggacaaacta

SEQ ID NO: 191812 - DNA, 25 bp, Homo sapien
atctattcagtagaagctcttcctg

SEQ ID NO: 191813 - DNA, 25 bp, Homo sapien
tcagtagaagctcttcctgttgctg

SEQ ID NO: 191814 - DNA, 25 bp, Homo sapien
gctgctgtaaatgtgcaaagcacac

SEQ ID NO: 191815 - DNA, 25 bp, Homo sapien
aaaatcaaccttttcatattaggag

SEQ ID NO: 191816 - DNA, 25 bp, Homo sapien
acaagtcagttgtcaatggaattga

SEQ ID NO: 191817 - DNA, 25 bp, Homo sapien
ggaattgagctatctgctaagacaa

SEQ ID NO: 191818 - DNA, 25 bp, Homo sapien
ttgccacccagtcttgtattctgtc

SEQ ID NO: 191819 - DNA, 25 bp, Homo sapien
gtattctgtctttagctagccaaat

SEQ ID NO: 191820 - DNA, 25 bp, Homo sapien
tagctagccaaattgtccttgaatt

SEQ ID NO: 191821 - DNA, 25 bp, Homo sapien
tgtccttgaatttgggttttccaca

SEQ ID NO: 191822 - DNA, 25 bp, Homo sapien
tgaatttgggttttccacaacctca

SEQ ID NO: 191823 - DNA, 25 bp, Homo sapien
ggaagagctgctaattttattttaa

SEQ ID NO: 191824 - DNA, 25 bp, Homo sapien
gttgtgaaaacatgcctccttttta

SEQ ID NO: 191825 - DNA, 25 bp, Homo sapien
ggatatggaatccagcaccacagtg

SEQ ID NO: 191826 - DNA, 25 bp, Homo sapien
cacagtgcacaggtcagggctcgga

SEQ ID NO: 191827 - DNA, 25 bp, Homo sapien
agggagcctctgtgcagatgtgctt

SEQ ID NO: 191828 - DNA, 25 bp, Homo sapien
gatgtgctttctttacagtggctgt

SEQ ID NO: 191829 - DNA, 25 bp, Homo sapien
agatttttgcagctcatccttgtat

SEQ ID NO: 191830 - DNA, 25 bp, Homo sapien
gctcatccttgtattctcagtagtt

SEQ ID NO: 191831 - DNA, 25 bp, Homo sapien
agtagttccgatatgtaccctcgac

SEQ ID NO: 191832 - DNA, 25 bp, Homo sapien
tgtaccctcgacatgtgaatgttat

SEQ ID NO: 191833 - DNA, 25 bp, Homo sapien
ttggctttctgtgaactgaggtctt

SEQ ID NO: 191834 - DNA, 25 bp, Homo sapien
gaggtcttaatatcagctcatttta

SEQ ID NO: 191835 - DNA, 25 bp, Homo sapien
ttgcagtggtattcggatctatcct

SEQ ID NO: 191836 - DNA, 25 bp, Homo sapien
gatctatcctgtgtgtgcctatgag

SEQ ID NO: 191837 - DNA, 25 bp, Homo sapien
gtgcagtgtatcctgttagctccat

SEQ ID NO: 191838 - DNA, 25 bp, Homo sapien
gctccattctcagggcgtttgaatg

SEQ ID NO: 191839 - DNA, 25 bp, Homo sapien
ggaccagcgcaatgaatgctcaagt

SEQ ID NO: 191840 - DNA, 25 bp, Homo sapien
tgcctggtcccttctcactgtgagg

SEQ ID NO: 191841 - DNA, 25 bp, Homo sapien
ttctcactgtgaggacgcccttggc

SEQ ID NO: 191842 - DNA, 25 bp, Homo sapien
tgtgaggacgcccttggcacacctt

SEQ ID NO: 191843 - DNA, 25 bp, Homo sapien
ttggcacacctttctcaagtcacac

SEQ ID NO: 191844 - DNA, 25 bp, Homo sapien
cacacctttctcaagtcacacaaat

SEQ ID NO: 191845 - DNA, 25 bp, Homo sapien
gtcacacaaattattgcagttacat

SEQ ID NO: 191846 - DNA, 25 bp, Homo sapien
attattgcagttacatacagaattg

SEQ ID NO: 191847 - DNA, 25 bp, Homo sapien
gagggaaacagctggcaatgtgaca

SEQ ID NO: 191848 - DNA, 25 bp, Homo sapien
gctggcaatgtgacaaaagtctttt

SEQ ID NO: 191849 - DNA, 25 bp, Homo sapien
tttctgggacaacaatcaaatcatg

SEQ ID NO: 191850 - DNA, 25 bp, Homo sapien
aagtttaccaatgaattgtacaaca

SEQ ID NO: 191851 - DNA, 25 bp, Homo sapien
attctggtttatttcctagactgtt

SEQ ID NO: 191852 - DNA, 25 bp, Homo sapien
tggtttatttcctagactgttattt

SEQ ID NO: 191853 - DNA, 25 bp, Homo sapien
acatatcaatgtttgtcctgtataa

SEQ ID NO: 191854 - DNA, 25 bp, Homo sapien
tatcaatgtttgtcctgtataagaa

SEQ ID NO: 191855 - DNA, 25 bp, Homo sapien
acttctaggttaagtttgagcctga

SEQ ID NO: 191856 - DNA, 25 bp, Homo sapien
gaagtgcaatactgagtgtgcctca

SEQ ID NO: 191857 - DNA, 25 bp, Homo sapien
tgagtgtgcctcattatcttgcagc

SEQ ID NO: 191858 - DNA, 25 bp, Homo sapien
tgtgcctcattatcttgcagctgta

SEQ ID NO: 191859 - DNA, 25 bp, Homo sapien
gcctcattatcttgcagctgtaaac

SEQ ID NO: 191860 - DNA, 25 bp, Homo sapien
atcttgcagctgtaaacatattgga

SEQ ID NO: 191861 - DNA, 25 bp, Homo sapien
ggaatgtacatgtcaataaaaccac

SEQ ID NO: 191862 - DNA, 25 bp, Homo sapien
aagctgcaagcaaaggtgaaatcct

SEQ ID NO: 191863 - DNA, 25 bp, Homo sapien
agcaaaggtgaaatcctacaagaga

SEQ ID NO: 191864 - DNA, 25 bp, Homo sapien
gaagcggaggaacaatccaacgtca

SEQ ID NO: 191865 - DNA, 25 bp, Homo sapien
aatccaacgtcaacctctccaaatt

SEQ ID NO: 191866 - DNA, 25 bp, Homo sapien
gtcaacctctccaaattccggagga

SEQ ID NO: 191867 - DNA, 25 bp, Homo sapien
tccaaattccggaggatccagcacg

SEQ ID NO: 191868 - DNA, 25 bp, Homo sapien
attccggaggatccagcacgagctg

SEQ ID NO: 191869 - DNA, 25 bp, Homo sapien
ttatctaactgctgaaaggtgacca

SEQ ID NO: 191870 - DNA, 25 bp, Homo sapien
tctaactgctgaaaggtgaccaaag

SEQ ID NO: 191871 - DNA, 25 bp, Homo sapien
aatgtgaaaatctttgtcactccat

SEQ ID NO: 191872 - DNA, 25 bp, Homo sapien
ctttgtcactccattttgtacttat

SEQ ID NO: 191873 - DNA, 25 bp, Homo sapien
gtgttcagtgaacccaagaaatgta

SEQ ID NO: 191874 - DNA, 25 bp, Homo sapien
aaaattcttgcatatattatcatca

SEQ ID NO: 191875 - DNA, 25 bp, Homo sapien
aaactattttggtaagtgcagcttg

SEQ ID NO: 191876 - DNA, 25 bp, Homo sapien
ggtaagtgcagcttgaatttcaaat

SEQ ID NO: 191877 - DNA, 25 bp, Homo sapien
gaatttcaaatatcccgtgttacct

SEQ ID NO: 191878 - DNA, 25 bp, Homo sapien
ttcaaatatcccgtgttacctttct

SEQ ID NO: 191879 - DNA, 25 bp, Homo sapien
tatcccgtgttacctttctctatta

SEQ ID NO: 191880 - DNA, 25 bp, Homo sapien
cgtgttacctttctctattacagct

SEQ ID NO: 191881 - DNA, 25 bp, Homo sapien
gttacctttctctattacagcttaa

SEQ ID NO: 191882 - DNA, 25 bp, Homo sapien
taaagtatgctacaatctgtgtcat

SEQ ID NO: 191883 - DNA, 25 bp, Homo sapien
gctacaatctgtgtcatatagttaa

SEQ ID NO: 191884 - DNA, 25 bp, Homo sapien
tcaataactgggagatggacaaact

SEQ ID NO: 191885 - DNA, 25 bp, Homo sapien
actgggagatggacaaactagagat

SEQ ID NO: 191886 - DNA, 25 bp, Homo sapien
gacaaactagagatggaagatgcag

SEQ ID NO: 191887 - DNA, 25 bp, Homo sapien
atctattcagtagaagctcttcctg

SEQ ID NO: 191888 - DNA, 25 bp, Homo sapien
attcagtagaagctcttcctgttgc

SEQ ID NO: 191889 - DNA, 25 bp, Homo sapien
tcagtagaagctcttcctgttgctg

SEQ ID NO: 191890 - DNA, 25 bp, Homo sapien
atgtgcaaagcacacaataaagtga

SEQ ID NO: 191891 - DNA, 25 bp, Homo sapien
caaccttttcatattaggagacatg

SEQ ID NO: 191892 - DNA, 25 bp, Homo sapien
ccttttcatattaggagacatgcat

SEQ ID NO: 191893 - DNA, 25 bp, Homo sapien
catattaggagacatgcatttgtaa

SEQ ID NO: 191894 - DNA, 25 bp, Homo sapien
ggagacatgcatttgtaaaaattaa

SEQ ID NO: 191895 - DNA, 25 bp, Homo sapien
gttttctttttcacacttcagaaga

SEQ ID NO: 191896 - DNA, 25 bp, Homo sapien
taaggactagactccgctcagtgca

SEQ ID NO: 191897 - DNA, 25 bp, Homo sapien
agtgcattcctttttcatacactga

SEQ ID NO: 191898 - DNA, 25 bp, Homo sapien
ttcatacactgatctcaagtacaat

SEQ ID NO: 191899 - DNA, 25 bp, Homo sapien
ttgaaaatccatgtagtcctcccta

SEQ ID NO: 191900 - DNA, 25 bp, Homo sapien
aatccatgtagtcctccctaaataa

SEQ ID NO: 191901 - DNA, 25 bp, Homo sapien
ggataggtttctatttccttccgat

SEQ ID NO: 191902 - DNA, 25 bp, Homo sapien
tttccttccgattacctagatacct

SEQ ID NO: 191903 - DNA, 25 bp, Homo sapien
tagatacctccgtcttctggaaaac

SEQ ID NO: 191904 - DNA, 25 bp, Homo sapien
aaggtcctaggagtgattcctccaa

SEQ ID NO: 191905 - DNA, 25 bp, Homo sapien
gcggagtttccaagataacagctat

SEQ ID NO: 191906 - DNA, 25 bp, Homo sapien
ggttttagacttttgctttcatttg

SEQ ID NO: 191907 - DNA, 25 bp, Homo sapien
aggtttaactagatactttatggat

SEQ ID NO: 191908 - DNA, 25 bp, Homo sapien
atggatattatgaacctgcacaaaa

SEQ ID NO: 191909 - DNA, 25 bp, Homo sapien
gcacaaaagaatgggcagtacaaat

SEQ ID NO: 191910 - DNA, 25 bp, Homo sapien
gttcatgtggactatggcactctgt

SEQ ID NO: 191911 - DNA, 25 bp, Homo sapien
ggcactctgtaggtaatgaccaact

SEQ ID NO: 191912 - DNA, 25 bp, Homo sapien
aacactgaagcacaaattgcccaga

SEQ ID NO: 191913 - DNA, 25 bp, Homo sapien
gcacaaattgcccagacctaacaaa

SEQ ID NO: 191914 - DNA, 25 bp, Homo sapien
cccagacctaacaaaagcggcaatg

SEQ ID NO: 191915 - DNA, 25 bp, Homo sapien
agcggcaatgtcaggtaaagattca

SEQ ID NO: 191916 - DNA, 25 bp, Homo sapien
aaacatagtactcttctgtacgctg

SEQ ID NO: 191917 - DNA, 25 bp, Homo sapien
acacctgaccgactcggacatcgag

SEQ ID NO: 191918 - DNA, 25 bp, Homo sapien
accgactcggacatcgagcagggcg

SEQ ID NO: 191919 - DNA, 25 bp, Homo sapien
aaaaggactaggtggctgccaacgc

SEQ ID NO: 191920 - DNA, 25 bp, Homo sapien
taggtggctgccaacgcgcacgctc

SEQ ID NO: 191921 - DNA, 25 bp, Homo sapien
gagcagcgacatccactcgccattt

SEQ ID NO: 191922 - DNA, 25 bp, Homo sapien
actcgccatttgctgacatgagatt

SEQ ID NO: 191923 - DNA, 25 bp, Homo sapien
tttgctgacatgagattgggaggaa

SEQ ID NO: 191924 - DNA, 25 bp, Homo sapien
ggagacggctcttagctgcgttcaa

SEQ ID NO: 191925 - DNA, 25 bp, Homo sapien
cggctcttagctgcgttcaaggcgg

SEQ ID NO: 191926 - DNA, 25 bp, Homo sapien
tcgggagcccaggtgcagagcgagg

SEQ ID NO: 191927 - DNA, 25 bp, Homo sapien
agagcgaggccgtgtccaggagccg

SEQ ID NO: 191928 - DNA, 25 bp, Homo sapien
gggctacttcttaaatgccgtcact

SEQ ID NO: 191929 - DNA, 25 bp, Homo sapien
tgccgtcactcctgctgagataaat

SEQ ID NO: 191930 - DNA, 25 bp, Homo sapien
aatagtctctgtggcaggtcactgg

SEQ ID NO: 191931 - DNA, 25 bp, Homo sapien
tggccatccacttctttttcacttc

SEQ ID NO: 191932 - DNA, 25 bp, Homo sapien
tcacttcatgttctaccccaagaga

SEQ ID NO: 191933 - DNA, 25 bp, Homo sapien
agagactcccgatgtcggctgtgga

SEQ ID NO: 191934 - DNA, 25 bp, Homo sapien
atctgttcacagttcttgatgatgt

SEQ ID NO: 191935 - DNA, 25 bp, Homo sapien
atgtattttatgatgcccagcttgg

SEQ ID NO: 191936 - DNA, 25 bp, Homo sapien
aaatagttgctttccatagtctcaa

SEQ ID NO: 191937 - DNA, 25 bp, Homo sapien
caactgtattgtgtcatctcctgat

SEQ ID NO: 191938 - DNA, 25 bp, Homo sapien
catctcctgatgctgatttttgatc

SEQ ID NO: 191939 - DNA, 25 bp, Homo sapien
acattagcagtgttactcttggaac

SEQ ID NO: 191940 - DNA, 25 bp, Homo sapien
gttactcttggaactgcctttactt

SEQ ID NO: 191941 - DNA, 25 bp, Homo sapien
tgcctttacttttaacgctctctgt

SEQ ID NO: 191942 - DNA, 25 bp, Homo sapien
gtttggttacgtgtgagccaacatc

SEQ ID NO: 191943 - DNA, 25 bp, Homo sapien
gagccaacatcacgttttgttagct

SEQ ID NO: 191944 - DNA, 25 bp, Homo sapien
tagctgtgatttacctttgtccgtt

SEQ ID NO: 191945 - DNA, 25 bp, Homo sapien
taaaagacttcacggagccattctg

SEQ ID NO: 191946 - DNA, 25 bp, Homo sapien
gagccattctgtatacaaggtgtgc

SEQ ID NO: 191947 - DNA, 25 bp, Homo sapien
caaggtgtgctctttccaatgtaga

SEQ ID NO: 191948 - DNA, 25 bp, Homo sapien
ggtgcgatcctttgctgtaaactgg

SEQ ID NO: 191949 - DNA, 25 bp, Homo sapien
gaattttaagcccttctcatcaccc

SEQ ID NO: 191950 - DNA, 25 bp, Homo sapien
ctagggattgaagtcctggacagtg

SEQ ID NO: 191951 - DNA, 25 bp, Homo sapien
ggacagtgacagaggataccacagt

SEQ ID NO: 191952 - DNA, 25 bp, Homo sapien
gataccacagtagttcaagacttag

SEQ ID NO: 191953 - DNA, 25 bp, Homo sapien
gacttagcacaagtcaccaactgct

SEQ ID NO: 191954 - DNA, 25 bp, Homo sapien
tcaccaactgcttcagggatacctg

SEQ ID NO: 191955 - DNA, 25 bp, Homo sapien
tagagtgttggtggcccaagcaaac

SEQ ID NO: 191956 - DNA, 25 bp, Homo sapien
aagcaaaccagtgttgccaatacca

SEQ ID NO: 191957 - DNA, 25 bp, Homo sapien
gttgccaataccattgccaaaaggg

SEQ ID NO: 191958 - DNA, 25 bp, Homo sapien
ggatcctggacaaagcttggctgcc

SEQ ID NO: 191959 - DNA, 25 bp, Homo sapien
cttggctgccggcttcatttattcc

SEQ ID NO: 191960 - DNA, 25 bp, Homo sapien
ttgcctgtcccaagttttgttccat

SEQ ID NO: 191961 - DNA, 25 bp, Homo sapien
tatagaaaacctgacttcagtgaat

SEQ ID NO: 191962 - DNA, 25 bp, Homo sapien
tttgtattttacatgggccagttta

SEQ ID NO: 191963 - DNA, 25 bp, Homo sapien
actgctatttacactattatttcct

SEQ ID NO: 191964 - DNA, 25 bp, Homo sapien
attatttcctatagctacatgttct

SEQ ID NO: 191965 - DNA, 25 bp, Homo sapien
tatagctacatgttctttgtacctt

SEQ ID NO: 191966 - DNA, 25 bp, Homo sapien
gtattactagattcataccttgatg

SEQ ID NO: 191967 - DNA, 25 bp, Homo sapien
taccttgatggtaacgctctatctg

SEQ ID NO: 191968 - DNA, 25 bp, Homo sapien
acgctctatctggttttgggtgttt

SEQ ID NO: 191969 - DNA, 25 bp, Homo sapien
ctatctggttttgggtgtttttcat

SEQ ID NO: 191970 - DNA, 25 bp, Homo sapien
accactagttgatgtatggtatctt

SEQ ID NO: 191971 - DNA, 25 bp, Homo sapien
tagatatttgcctgtctgtttgctc

SEQ ID NO: 191972 - DNA, 25 bp, Homo sapien
aggagagcaaacaaacagtcatggt

SEQ ID NO: 191973 - DNA, 25 bp, Homo sapien
ctaaaacccacatagcactttgctc

SEQ ID NO: 191974 - DNA, 25 bp, Homo sapien
atagcactttgctcttagttacatg

SEQ ID NO: 191975 - DNA, 25 bp, Homo sapien
ctttgctcttagttacatgtaaaat

SEQ ID NO: 191976 - DNA, 25 bp, Homo sapien
tagatttctaaaacaggtgggcaat

SEQ ID NO: 191977 - DNA, 25 bp, Homo sapien
ggtgggcaatcattttgaatactgt

SEQ ID NO: 191978 - DNA, 25 bp, Homo sapien
tatgtgtggccatcctccatgtccc

SEQ ID NO: 191979 - DNA, 25 bp, Homo sapien
gtccctgtagctgctctgtttagac

SEQ ID NO: 191980 - DNA, 25 bp, Homo sapien
ttagacagcggacagacgctcacgc

SEQ ID NO: 191981 - DNA, 25 bp, Homo sapien
ttcccttcgcagatgtgtatactca

SEQ ID NO: 191982 - DNA, 25 bp, Homo sapien
cttcgcagatgtgtatactcatgat

SEQ ID NO: 191983 - DNA, 25 bp, Homo sapien
ctgggttggcttctggtcctcatga

SEQ ID NO: 191984 - DNA, 25 bp, Homo sapien
ggcttttatcctcctgggacacttt

SEQ ID NO: 191985 - DNA, 25 bp, Homo sapien
tcctcctgggacactttgggtatat

SEQ ID NO: 191986 - DNA, 25 bp, Homo sapien
acactttgggtatattcatgggcat

SEQ ID NO: 191987 - DNA, 25 bp, Homo sapien
tcatgggcattgtttccatctgtct

SEQ ID NO: 191988 - DNA, 25 bp, Homo sapien
tttccatctgtcttttctacctgtg

SEQ ID NO: 191989 - DNA, 25 bp, Homo sapien
atctgtcttttctacctgtgccacc

SEQ ID NO: 191990 - DNA, 25 bp, Homo sapien
tgattccacggctgcctcaggcagg

SEQ ID NO: 191991 - DNA, 25 bp, Homo sapien
ttgtgcagttggagatgctgccgtt

SEQ ID NO: 191992 - DNA, 25 bp, Homo sapien
gatgctctctgatgtttgttccgtt

SEQ ID NO: 191993 - DNA, 25 bp, Homo sapien
tctgatgtttgttccgttgtttaaa

SEQ ID NO: 191994 - DNA, 25 bp, Homo sapien
taccggtaatttcccagtagctttg

SEQ ID NO: 191995 - DNA, 25 bp, Homo sapien
tttcccagtagctttgaatattcac

SEQ ID NO: 191996 - DNA, 25 bp, Homo sapien
gaatattcacagcagagctttatta

SEQ ID NO: 191997 - DNA, 25 bp, Homo sapien
gcagagctttattacttgagagaaa

SEQ ID NO: 191998 - DNA, 25 bp, Homo sapien
gagaaagactggaagacctgaaagc

SEQ ID NO: 191999 - DNA, 25 bp, Homo sapien
ttctgctttctaaccccagttcctt

SEQ ID NO: 192000 - DNA, 25 bp, Homo sapien
tctaaccccagttccttaaatattg

SEQ ID NO: 192001 - DNA, 25 bp, Homo sapien
attgaaatcttgtacattttgtgaa

SEQ ID NO: 192002 - DNA, 25 bp, Homo sapien
gtgaaattccagtatgttttgctta

SEQ ID NO: 192003 - DNA, 25 bp, Homo sapien
agtttgcatcatgtagtcattgagt

SEQ ID NO: 192004 - DNA, 25 bp, Homo sapien
ggagatataagccaaggattttaaa

SEQ ID NO: 192005 - DNA, 25 bp, Homo sapien
aaatgttttgcctgccaattgaatg

SEQ ID NO: 192006 - DNA, 25 bp, Homo sapien
ttgcctgccaattgaatgatttcgt

SEQ ID NO: 192007 - DNA, 25 bp, Homo sapien
aacatttaggtttctgtagcattaa

SEQ ID NO: 192008 - DNA, 25 bp, Homo sapien
aactggagtggtacttactgaagaa

SEQ ID NO: 192009 - DNA, 25 bp, Homo sapien
gaagaaactctctgtatgtcctaga

SEQ ID NO: 192010 - DNA, 25 bp, Homo sapien
gcaatgatgtgctgcttctgatttt

SEQ ID NO: 192011 - DNA, 25 bp, Homo sapien
attctcagccaacctacagccatga

SEQ ID NO: 192012 - DNA, 25 bp, Homo sapien
tacagccatgatctttagcacagtg

SEQ ID NO: 192013 - DNA, 25 bp, Homo sapien
gatctttagcacagtgatatcacca

SEQ ID NO: 192014 - DNA, 25 bp, Homo sapien
gatatcaccatgacttcacagacat

SEQ ID NO: 192015 - DNA, 25 bp, Homo sapien
tggtctagaatctgtacccttaccc

SEQ ID NO: 192016 - DNA, 25 bp, Homo sapien
gtttttcaaaagtgtgccatatcta

SEQ ID NO: 192017 - DNA, 25 bp, Homo sapien
aagtgtgccatatctacagcttcca

SEQ ID NO: 192018 - DNA, 25 bp, Homo sapien
tgtgccatatctacagcttccagca

SEQ ID NO: 192019 - DNA, 25 bp, Homo sapien
cagtgtgtggcgagtgcgttacttt

SEQ ID NO: 192020 - DNA, 25 bp, Homo sapien
ggcgagtgcgttacttttctatact

SEQ ID NO: 192021 - DNA, 25 bp, Homo sapien
agtgcgttacttttctatactctca

SEQ ID NO: 192022 - DNA, 25 bp, Homo sapien
gttacttttctatactctcactcag

SEQ ID NO: 192023 - DNA, 25 bp, Homo sapien
acttttctatactctcactcagctg

SEQ ID NO: 192024 - DNA, 25 bp, Homo sapien
tctatactctcactcagctggctga

SEQ ID NO: 192025 - DNA, 25 bp, Homo sapien
ttattccttttttggccaggtgcaa

SEQ ID NO: 192026 - DNA, 25 bp, Homo sapien
tattccttttttggccaggtgcaat

SEQ ID NO: 192027 - DNA, 25 bp, Homo sapien
tatcttctccacgacctcacctata

SEQ ID NO: 192028 - DNA, 25 bp, Homo sapien
cacaccatcctccaggtctgggaaa

SEQ ID NO: 192029 - DNA, 25 bp, Homo sapien
gaaatatccatttttctggccagtc

SEQ ID NO: 192030 - DNA, 25 bp, Homo sapien
ggccagtcttagcatgttttcttaa

SEQ ID NO: 192031 - DNA, 25 bp, Homo sapien
ttcttaatgtcacattcccacgcca

SEQ ID NO: 192032 - DNA, 25 bp, Homo sapien
ttaatgtcacattcccacgccaggc

SEQ ID NO: 192033 - DNA, 25 bp, Homo sapien
cacgccaggcccaagagagattcta

SEQ ID NO: 192034 - DNA, 25 bp, Homo sapien
acgccaggcccaagagagattctat

SEQ ID NO: 192035 - DNA, 25 bp, Homo sapien
cgccaggcccaagagagattctatg

SEQ ID NO: 192036 - DNA, 25 bp, Homo sapien
agagagaattctatatcaatatata

SEQ ID NO: 192037 - DNA, 25 bp, Homo sapien
atgggctcaaatgcccactgccagt

SEQ ID NO: 192038 - DNA, 25 bp, Homo sapien
agttcctctcccaattgcaatgaga

SEQ ID NO: 192039 - DNA, 25 bp, Homo sapien
tttctaaaaccatgtaactccattg

SEQ ID NO: 192040 - DNA, 25 bp, Homo sapien
atgtaactccattgaacatttttca

SEQ ID NO: 192041 - DNA, 25 bp, Homo sapien
gaacatttttcaacttaaggtctgc

SEQ ID NO: 192042 - DNA, 25 bp, Homo sapien
ttcaacttaaggtctgcatagcaga

SEQ ID NO: 192043 - DNA, 25 bp, Homo sapien
atagcagacttttaataaccttggg

SEQ ID NO: 192044 - DNA, 25 bp, Homo sapien
ataaccttgggatttatctggtaga

SEQ ID NO: 192045 - DNA, 25 bp, Homo sapien
gttgttttgtctgtaaaactgtctt

SEQ ID NO: 192046 - DNA, 25 bp, Homo sapien
tgtctttatcaatatgcttaatggt

SEQ ID NO: 192047 - DNA, 25 bp, Homo sapien
atgcttaatggttctttgtacaatt

SEQ ID NO: 192048 - DNA, 25 bp, Homo sapien
gaaagtttctacctgtatataatgg

SEQ ID NO: 192049 - DNA, 25 bp, Homo sapien
ttcctgcccttgcagtcctgaggtc

SEQ ID NO: 192050 - DNA, 25 bp, Homo sapien
gcccttgcagtcctgaggtcctgca

SEQ ID NO: 192051 - DNA, 25 bp, Homo sapien
ctccgtgacctggtgtggccaggct

SEQ ID NO: 192052 - DNA, 25 bp, Homo sapien
gggccccgggtgtacatatataatg

SEQ ID NO: 192053 - DNA, 25 bp, Homo sapien
gtatattttttcaatgttgtcgtga

SEQ ID NO: 192054 - DNA, 25 bp, Homo sapien
tttcaatgttgtcgtgagtgcagcc

SEQ ID NO: 192055 - DNA, 25 bp, Homo sapien
gtgagtgcagcccatgttcctgcgt

SEQ ID NO: 192056 - DNA, 25 bp, Homo sapien
gtgcagcccatgttcctgcgtgcag

SEQ ID NO: 192057 - DNA, 25 bp, Homo sapien
catgttcctgcgtgcagctcacggc

SEQ ID NO: 192058 - DNA, 25 bp, Homo sapien
gcagctcacggccttgtgtgtatgt

SEQ ID NO: 192059 - DNA, 25 bp, Homo sapien
gtgtgtgaggcatcgtcatgtcctg

SEQ ID NO: 192060 - DNA, 25 bp, Homo sapien
aggtagatgattcttccgggtcctg

SEQ ID NO: 192061 - DNA, 25 bp, Homo sapien
tagatgattcttccgggtcctgagc

SEQ ID NO: 192062 - DNA, 25 bp, Homo sapien
gaaggaagataggtagcccagagaa

SEQ ID NO: 192063 - DNA, 25 bp, Homo sapien
ggacttaacaacataccaaggcagc

SEQ ID NO: 192064 - DNA, 25 bp, Homo sapien
aacataccaaggcagctctggcctg

SEQ ID NO: 192065 - DNA, 25 bp, Homo sapien
gcctgtgactcaggcgtttgttgga

SEQ ID NO: 192066 - DNA, 25 bp, Homo sapien
tgcaggaaaaccactgcagtgtgcc

SEQ ID NO: 192067 - DNA, 25 bp, Homo sapien
aacaggacaagacccactcctgttt

SEQ ID NO: 192068 - DNA, 25 bp, Homo sapien
cagctaccctggaatggtggcgtgt

SEQ ID NO: 192069 - DNA, 25 bp, Homo sapien
ctaccctggaatggtggcgtgtcct

SEQ ID NO: 192070 - DNA, 25 bp, Homo sapien
ctgtgaccacagctcaagtaaaaaa

SEQ ID NO: 192071 - DNA, 25 bp, Homo sapien
ctgaaattttcaacagctgtgggaa

SEQ ID NO: 192072 - DNA, 25 bp, Homo sapien
attgttagtgcattattgagtatac

SEQ ID NO: 192073 - DNA, 25 bp, Homo sapien
ttgagtatactaaatatctgtgatt

SEQ ID NO: 192074 - DNA, 25 bp, Homo sapien
ataaagggagtgttgttttcatggt

SEQ ID NO: 192075 - DNA, 25 bp, Homo sapien
gttttcatggttatgccttgtttgt

SEQ ID NO: 192076 - DNA, 25 bp, Homo sapien
tgccttgtttgtggagtcaagtgtt

SEQ ID NO: 192077 - DNA, 25 bp, Homo sapien
aagtgttgatatacttgaggcatgt

SEQ ID NO: 192078 - DNA, 25 bp, Homo sapien
acttgaggcatgttatgtgtcttct

SEQ ID NO: 192079 - DNA, 25 bp, Homo sapien
gcatgttatgtgtcttctaattaat

SEQ ID NO: 192080 - DNA, 25 bp, Homo sapien
atcaccttgaatttgtgtctcttcc

SEQ ID NO: 192081 - DNA, 25 bp, Homo sapien
gtgtctcttccaagcattaaagata

SEQ ID NO: 192082 - DNA, 25 bp, Homo sapien
tgcagctacccaatagcccttggag

SEQ ID NO: 192083 - DNA, 25 bp, Homo sapien
cactgaaccaggctgcaagatttga

SEQ ID NO: 192084 - DNA, 25 bp, Homo sapien
ggctgcaagatttgactgccttaaa

SEQ ID NO: 192085 - DNA, 25 bp, Homo sapien
acaaggccctctaggcctggcaggg

SEQ ID NO: 192086 - DNA, 25 bp, Homo sapien
gggctcgaagactggtttctagcac

SEQ ID NO: 192087 - DNA, 25 bp, Homo sapien
tggtttctagcactaccggtcacgg

SEQ ID NO: 192088 - DNA, 25 bp, Homo sapien
ggtcacggccatgtcgtcctagaag

SEQ ID NO: 192089 - DNA, 25 bp, Homo sapien
catgtcgtcctagaagggtccagaa

SEQ ID NO: 192090 - DNA, 25 bp, Homo sapien
gaagattattttacgttgagtccat

SEQ ID NO: 192091 - DNA, 25 bp, Homo sapien
gttgagtccatttttaatgttctga

SEQ ID NO: 192092 - DNA, 25 bp, Homo sapien
atgttctgatcacctgacagggcac

SEQ ID NO: 192093 - DNA, 25 bp, Homo sapien
aaaattagcattgtcatacagtaca

SEQ ID NO: 192094 - DNA, 25 bp, Homo sapien
atacagtacaattcttagtgaagtg

SEQ ID NO: 192095 - DNA, 25 bp, Homo sapien
cttagtgaagtgtattgtggaacaa

SEQ ID NO: 192096 - DNA, 25 bp, Homo sapien
tcccctagattaaggatactttcct

SEQ ID NO: 192097 - DNA, 25 bp, Homo sapien
ctttccttgacttgagacttgtggt

SEQ ID NO: 192098 - DNA, 25 bp, Homo sapien
gacttgagacttgtggtcttcagga

SEQ ID NO: 192099 - DNA, 25 bp, Homo sapien
gtggtcttcaggaaaactactcaga

SEQ ID NO: 192100 - DNA, 25 bp, Homo sapien
actactcagaatataatgactcctc

SEQ ID NO: 192101 - DNA, 25 bp, Homo sapien
gaatataatgactcctcatcagtat

SEQ ID NO: 192102 - DNA, 25 bp, Homo sapien
tgactcctcatcagtatcatattgt

SEQ ID NO: 192103 - DNA, 25 bp, Homo sapien
tcctcatcagtatcatattgtatat

SEQ ID NO: 192104 - DNA, 25 bp, Homo sapien
gataacaaagcttccttgatttcct

SEQ ID NO: 192105 - DNA, 25 bp, Homo sapien
gatttgttgactagtgcttgggcac

SEQ ID NO: 192106 - DNA, 25 bp, Homo sapien
aatcagtgttatttgctcttggagc

SEQ ID NO: 192107 - DNA, 25 bp, Homo sapien
gtgttatttgctcttggagccattt

SEQ ID NO: 192108 - DNA, 25 bp, Homo sapien
ggcagtgagcagttgaatttatctt

SEQ ID NO: 192109 - DNA, 25 bp, Homo sapien
tatttctgaagcagctacatagcag

SEQ ID NO: 192110 - DNA, 25 bp, Homo sapien
cagctacatagcagaacattttaag

SEQ ID NO: 192111 - DNA, 25 bp, Homo sapien
taagagattctgttagcccacatgt

SEQ ID NO: 192112 - DNA, 25 bp, Homo sapien
ttctgttagcccacatgttcatgtt

SEQ ID NO: 192113 - DNA, 25 bp, Homo sapien
acatgttcatgttggttgctgctga

SEQ ID NO: 192114 - DNA, 25 bp, Homo sapien
tcatgttggttgctgctgaatggta

SEQ ID NO: 192115 - DNA, 25 bp, Homo sapien
cccctgtgtgtaacatgcagattca

SEQ ID NO: 192116 - DNA, 25 bp, Homo sapien
tgcacggactgcaatcccttgtggg

SEQ ID NO: 192117 - DNA, 25 bp, Homo sapien
tgcaatcccttgtgggccccaatgg

SEQ ID NO: 192118 - DNA, 25 bp, Homo sapien
ggctgtgtgacctctttgagccaca

SEQ ID NO: 192119 - DNA, 25 bp, Homo sapien
tgagccacattctatctgaaacatg

SEQ ID NO: 192120 - DNA, 25 bp, Homo sapien
aattatattttctcacgctgcttac

SEQ ID NO: 192121 - DNA, 25 bp, Homo sapien
tcacgctgcttactcatggaatcga

SEQ ID NO: 192122 - DNA, 25 bp, Homo sapien
tagaacgtgcttcataaacattatg

SEQ ID NO: 192123 - DNA, 25 bp, Homo sapien
atggagttgttatcaccagctccct

SEQ ID NO: 192124 - DNA, 25 bp, Homo sapien
ttcattgggagtccattcttctggc

SEQ ID NO: 192125 - DNA, 25 bp, Homo sapien
ggagtccattcttctggcttcctat

SEQ ID NO: 192126 - DNA, 25 bp, Homo sapien
agagctacaaactcagctgtacagt

SEQ ID NO: 192127 - DNA, 25 bp, Homo sapien
aactcagctgtacagttcgtacact

SEQ ID NO: 192128 - DNA, 25 bp, Homo sapien
tcgtacactaaactcttcttgcttt

SEQ ID NO: 192129 - DNA, 25 bp, Homo sapien
aaactcttcttgcttttgcattata

SEQ ID NO: 192130 - DNA, 25 bp, Homo sapien
gtctccgattattaggtgatcaccc

SEQ ID NO: 192131 - DNA, 25 bp, Homo sapien
gtgatcaccctggatgatcagtttt

SEQ ID NO: 192132 - DNA, 25 bp, Homo sapien
gatcagttttctgctgaaggcacct

SEQ ID NO: 192133 - DNA, 25 bp, Homo sapien
gctgaaggcacctactcagtatctt

SEQ ID NO: 192134 - DNA, 25 bp, Homo sapien
actctgcattggtgaatttaatcct

SEQ ID NO: 192135 - DNA, 25 bp, Homo sapien
atttaatcctctcctttgtgttcaa

SEQ ID NO: 192136 - DNA, 25 bp, Homo sapien
gtgttcaacttttgtgtgcttttaa

SEQ ID NO: 192137 - DNA, 25 bp, Homo sapien
attggtctgatatatgctgctcttg

SEQ ID NO: 192138 - DNA, 25 bp, Homo sapien
atatgctgctcttggttctataaac

SEQ ID NO: 192139 - DNA, 25 bp, Homo sapien
aaagcagtgctttgtgaaatgcagt

SEQ ID NO: 192140 - DNA, 25 bp, Homo sapien
agtgttctctcttaacgccactggt

SEQ ID NO: 192141 - DNA, 25 bp, Homo sapien
aacgccactggtgataggaagtagt

SEQ ID NO: 192142 - DNA, 25 bp, Homo sapien
ggaagtagttcccttcagttcaaat

SEQ ID NO: 192143 - DNA, 25 bp, Homo sapien
aaatcctgtgcccttatttgctgct

SEQ ID NO: 192144 - DNA, 25 bp, Homo sapien
ccttatttgctgcttgctgacgtaa

SEQ ID NO: 192145 - DNA, 25 bp, Homo sapien
gacgtaagcaataagtaaccctcta

SEQ ID NO: 192146 - DNA, 25 bp, Homo sapien
gtaaccctctaactaatggtatcta

SEQ ID NO: 192147 - DNA, 25 bp, Homo sapien
atgatggtgtacctggtgattgtaa

SEQ ID NO: 192148 - DNA, 25 bp, Homo sapien
ttcatccttccctattcccaaagag

SEQ ID NO: 192149 - DNA, 25 bp, Homo sapien
catccttccctattcccaaagagta

SEQ ID NO: 192150 - DNA, 25 bp, Homo sapien
tccctattcccaaagagtaaacctg

SEQ ID NO: 192151 - DNA, 25 bp, Homo sapien
aaagagtaaacctggaccctcactg

SEQ ID NO: 192152 - DNA, 25 bp, Homo sapien
accaccacctaactgaaagcctggg

SEQ ID NO: 192153 - DNA, 25 bp, Homo sapien
cacctaactgaaagcctgggtccag

SEQ ID NO: 192154 - DNA, 25 bp, Homo sapien
tactgtagccaagccacctaggctg

SEQ ID NO: 192155 - DNA, 25 bp, Homo sapien
ctgtagccaagccacctaggctgga

SEQ ID NO: 192156 - DNA, 25 bp, Homo sapien
ctggagcccttcagaatactgtcat

SEQ ID NO: 192157 - DNA, 25 bp, Homo sapien
gagcccttcagaatactgtcattgt

SEQ ID NO: 192158 - DNA, 25 bp, Homo sapien
cttcagaatactgtcattgtccttg

SEQ ID NO: 192159 - DNA, 25 bp, Homo sapien
acatgctcataatacaggatatcag

SEQ ID NO: 192160 - DNA, 25 bp, Homo sapien
atcagcatatttgtgcaccttatta

SEQ ID NO: 192161 - DNA, 25 bp, Homo sapien
tgcaccttattaagccccatcttaa

SEQ ID NO: 192162 - DNA, 25 bp, Homo sapien
gaaaacacaaagtctaagtctgctg

SEQ ID NO: 192163 - DNA, 25 bp, Homo sapien
aagtctgctgttacaacttgtcaat

SEQ ID NO: 192164 - DNA, 25 bp, Homo sapien
acaacttgtcaatggtatacgaata

SEQ ID NO: 192165 - DNA, 25 bp, Homo sapien
gaaaggccttgttggcagtactcct

SEQ ID NO: 192166 - DNA, 25 bp, Homo sapien
gcagtactcctgttaagccattagt

SEQ ID NO: 192167 - DNA, 25 bp, Homo sapien
aagccattagtctctaaattccagc

SEQ ID NO: 192168 - DNA, 25 bp, Homo sapien
gcttcacacagttccttaaaatcag

SEQ ID NO: 192169 - DNA, 25 bp, Homo sapien
gaactttggtcatagagtcttcata

SEQ ID NO: 192170 - DNA, 25 bp, Homo sapien
acaagaccatctacatacacagtgg

SEQ ID NO: 192171 - DNA, 25 bp, Homo sapien
tacatacacagtggccaagcggcat

SEQ ID NO: 192172 - DNA, 25 bp, Homo sapien
tggccaagcggcatcctaaatgagt

SEQ ID NO: 192173 - DNA, 25 bp, Homo sapien
gcatcctaaatgagtaaacccagct

SEQ ID NO: 192174 - DNA, 25 bp, Homo sapien
gagtaaacccagctgtgagacaaga

SEQ ID NO: 192175 - DNA, 25 bp, Homo sapien
cccagctgtgagacaagagggacaa

SEQ ID NO: 192176 - DNA, 25 bp, Homo sapien
gggactgcagctaacttatcatcac

SEQ ID NO: 192177 - DNA, 25 bp, Homo sapien
gctaacttatcatcacacaactcag

SEQ ID NO: 192178 - DNA, 25 bp, Homo sapien
atcacacaactcagcctggctgatt

SEQ ID NO: 192179 - DNA, 25 bp, Homo sapien
tggctgattatcaccatccaggaat

SEQ ID NO: 192180 - DNA, 25 bp, Homo sapien
tcaccatccaggaatgggagcccgg

SEQ ID NO: 192181 - DNA, 25 bp, Homo sapien
gaaaacttagtgatctctacctcaa

SEQ ID NO: 192182 - DNA, 25 bp, Homo sapien
ttagtgatctctacctcaaatccac

SEQ ID NO: 192183 - DNA, 25 bp, Homo sapien
tacctcaaatccacgggcttcaaat

SEQ ID NO: 192184 - DNA, 25 bp, Homo sapien
gagaactacttgagcaagatgcagc

SEQ ID NO: 192185 - DNA, 25 bp, Homo sapien
actagagaactcaaagaagctgctg

SEQ ID NO: 192186 - DNA, 25 bp, Homo sapien
gctgctgaattggaatctggatcaa

SEQ ID NO: 192187 - DNA, 25 bp, Homo sapien
gaatctggatcaatagcttcccctc

SEQ ID NO: 192188 - DNA, 25 bp, Homo sapien
ttcccctctagggtctactgatgag

SEQ ID NO: 192189 - DNA, 25 bp, Homo sapien
gggtctactgatgagtcaaatctaa

SEQ ID NO: 192190 - DNA, 25 bp, Homo sapien
gataagattttattactgggctgtt

SEQ ID NO: 192191 - DNA, 25 bp, Homo sapien
ttattactgggctgtttatgtgaca

SEQ ID NO: 192192 - DNA, 25 bp, Homo sapien
attaccaaaggtactgtcattgaag

SEQ ID NO: 192193 - DNA, 25 bp, Homo sapien
ggaaaatatgcccaggttaccaaca

SEQ ID NO: 192194 - DNA, 25 bp, Homo sapien
atatgcccaggttaccaacaatcct

SEQ ID NO: 192195 - DNA, 25 bp, Homo sapien
aggttaccaacaatcctgaaaatga

SEQ ID NO: 192196 - DNA, 25 bp, Homo sapien
ataattattgaggactacacaccaa

SEQ ID NO: 192197 - DNA, 25 bp, Homo sapien
tgaggactacacaccaattgaagaa

SEQ ID NO: 192198 - DNA, 25 bp, Homo sapien
aattgaagaaactgccattactgtg

SEQ ID NO: 192199 - DNA, 25 bp, Homo sapien
aaactgccattactgtgatgtttct

SEQ ID NO: 192200 - DNA, 25 bp, Homo sapien
atactaccaaacagccatacatgtc

SEQ ID NO: 192201 - DNA, 25 bp, Homo sapien
acagccatacatgtctgcaatgaag

SEQ ID NO: 192202 - DNA, 25 bp, Homo sapien
acatgtctgcaatgaagagatttat

SEQ ID NO: 192203 - DNA, 25 bp, Homo sapien
gttacccacagcaaacaggctggtt

SEQ ID NO: 192204 - DNA, 25 bp, Homo sapien
gaaggcagcatgcagctccgttttg

SEQ ID NO: 192205 - DNA, 25 bp, Homo sapien
tgagcaggccacaaccctgactcag

SEQ ID NO: 192206 - DNA, 25 bp, Homo sapien
tgactcagggatccacacaggccac

SEQ ID NO: 192207 - DNA, 25 bp, Homo sapien
aggccacaggctatgacctcaacgg

SEQ ID NO: 192208 - DNA, 25 bp, Homo sapien
gacctcaacggtgcctatgatgata

SEQ ID NO: 192209 - DNA, 25 bp, Homo sapien
tggacattcagatagctcttccttc

SEQ ID NO: 192210 - DNA, 25 bp, Homo sapien
tagctcttccttctggatgttacag

SEQ ID NO: 192211 - DNA, 25 bp, Homo sapien
gttacagaagagtagctccatggtt

SEQ ID NO: 192212 - DNA, 25 bp, Homo sapien
gctccatggtttggattagctgcaa

SEQ ID NO: 192213 - DNA, 25 bp, Homo sapien
actgaggaaatgttggtgctgtact

SEQ ID NO: 192214 - DNA, 25 bp, Homo sapien
gcaggaagtgcattctctggtcctt

SEQ ID NO: 192215 - DNA, 25 bp, Homo sapien
tccctattttctgttctggatgtca

SEQ ID NO: 192216 - DNA, 25 bp, Homo sapien
agtgcactgctactgttttatccac

SEQ ID NO: 192217 - DNA, 25 bp, Homo sapien
ttttatccacttggccacagacttt

SEQ ID NO: 192218 - DNA, 25 bp, Homo sapien
agactttttctaacagctgcgtatt

SEQ ID NO: 192219 - DNA, 25 bp, Homo sapien
aacagctgcgtattatttctatata

SEQ ID NO: 192220 - DNA, 25 bp, Homo sapien
tctatatactaattgcattggcagc

SEQ ID NO: 192221 - DNA, 25 bp, Homo sapien
ttggcagcattgtgtctttgacctt

SEQ ID NO: 192222 - DNA, 25 bp, Homo sapien
ctttgaccttgtatactagcttgac

SEQ ID NO: 192223 - DNA, 25 bp, Homo sapien
agcttgacatagtgctgtctctgat

SEQ ID NO: 192224 - DNA, 25 bp, Homo sapien
gtctctgatttctaggctagttact

SEQ ID NO: 192225 - DNA, 25 bp, Homo sapien
aagtttcaatggctgctctcgcagg

SEQ ID NO: 192226 - DNA, 25 bp, Homo sapien
aatggctgctctcgcaggaattcca

SEQ ID NO: 192227 - DNA, 25 bp, Homo sapien
ctccgccacttcaagtttcataagc

SEQ ID NO: 192228 - DNA, 25 bp, Homo sapien
aagtttcataagctcaccctatacc

SEQ ID NO: 192229 - DNA, 25 bp, Homo sapien
atacctctgtggatgaatattctta

SEQ ID NO: 192230 - DNA, 25 bp, Homo sapien
ttcttaattccatttcctgaggtaa

SEQ ID NO: 192231 - DNA, 25 bp, Homo sapien
attagtgtgagaccatcatggtgcc

SEQ ID NO: 192232 - DNA, 25 bp, Homo sapien
catcatggtgccagtctaggacccc

SEQ ID NO: 192233 - DNA, 25 bp, Homo sapien
ggaccccattctcctatttatcagt

SEQ ID NO: 192234 - DNA, 25 bp, Homo sapien
tcctgtcctatataccctctagaaa

SEQ ID NO: 192235 - DNA, 25 bp, Homo sapien
gcaatttttaggcagctatggtcaa

SEQ ID NO: 192236 - DNA, 25 bp, Homo sapien
ggccaccatctcactgagcgacagt

SEQ ID NO: 192237 - DNA, 25 bp, Homo sapien
gcgacagtgacctgctgcggctgga

SEQ ID NO: 192238 - DNA, 25 bp, Homo sapien
tgcggctggagggtgactcgcgtac

SEQ ID NO: 192239 - DNA, 25 bp, Homo sapien
actcgcgtaccgtgcggctgctgaa

SEQ ID NO: 192240 - DNA, 25 bp, Homo sapien
ttccccccagcgtacaggaggagca

SEQ ID NO: 192241 - DNA, 25 bp, Homo sapien
tgcgctactggcagagctgctgcga

SEQ ID NO: 192242 - DNA, 25 bp, Homo sapien
tactggcagagctgctgcgaggacc

SEQ ID NO: 192243 - DNA, 25 bp, Homo sapien
ggaccctgtggcagctttgatgtgc

SEQ ID NO: 192244 - DNA, 25 bp, Homo sapien
tggcagctttgatgtgcgcaagaca

SEQ ID NO: 192245 - DNA, 25 bp, Homo sapien
tgtgcgcaagacagctgacgactga

SEQ ID NO: 192246 - DNA, 25 bp, Homo sapien
gacagctgacgactgagccctgctt

SEQ ID NO: 192247 - DNA, 25 bp, Homo sapien
gagggccacgacgtcactatgcagg

SEQ ID NO: 192248 - DNA, 25 bp, Homo sapien
ggccacgacgtcactatgcagggca

SEQ ID NO: 192249 - DNA, 25 bp, Homo sapien
acgacgtcactatgcagggcacacg

SEQ ID NO: 192250 - DNA, 25 bp, Homo sapien
gacgtcactatgcagggcacacgtg

SEQ ID NO: 192251 - DNA, 25 bp, Homo sapien
actatgcagggcacacgtggcttgg

SEQ ID NO: 192252 - DNA, 25 bp, Homo sapien
gcagggcacacgtggcttggtttaa

SEQ ID NO: 192253 - DNA, 25 bp, Homo sapien
ggcacacgtggcttggtttaaaaag

SEQ ID NO: 192254 - DNA, 25 bp, Homo sapien
gcttggtttaaaaaggtcatcttag

SEQ ID NO: 192255 - DNA, 25 bp, Homo sapien
ttaaatgtgctttctttttgaaatt

SEQ ID NO: 192256 - DNA, 25 bp, Homo sapien
tcaaataaaatctccctaaagcaat

SEQ ID NO: 192257 - DNA, 25 bp, Homo sapien
taaaatctccctaaagcaatattta

SEQ ID NO: 192258 - DNA, 25 bp, Homo sapien
aacaccagaccacttagactcaggc

SEQ ID NO: 192259 - DNA, 25 bp, Homo sapien
agactcaggctgaaccatactcttt

SEQ ID NO: 192260 - DNA, 25 bp, Homo sapien
ttatttttcatccttgttcctcacg

SEQ ID NO: 192261 - DNA, 25 bp, Homo sapien
tccttgttcctcacggttcagtgaa

SEQ ID NO: 192262 - DNA, 25 bp, Homo sapien
ggttcagtgaacaggctcatatcat

SEQ ID NO: 192263 - DNA, 25 bp, Homo sapien
gctcatatcatgacagaatggactt

SEQ ID NO: 192264 - DNA, 25 bp, Homo sapien
gtcagtgaactttattagcaccaga

SEQ ID NO: 192265 - DNA, 25 bp, Homo sapien
tattagcaccagaaatctctattga

SEQ ID NO: 192266 - DNA, 25 bp, Homo sapien
gatgcttttaatgcattgcctgcct

SEQ ID NO: 192267 - DNA, 25 bp, Homo sapien
aatgcattgcctgccttcaggtttt

SEQ ID NO: 192268 - DNA, 25 bp, Homo sapien
acccctcaataagatttggtgaatt

SEQ ID NO: 192269 - DNA, 25 bp, Homo sapien
tagaataacccaaagcctaggtgag

SEQ ID NO: 192270 - DNA, 25 bp, Homo sapien
gcctaggtgagggttgatatataat

SEQ ID NO: 192271 - DNA, 25 bp, Homo sapien
tataatgtcccatgatttaatatat

SEQ ID NO: 192272 - DNA, 25 bp, Homo sapien
tccacatataagaaggtagttgccc

SEQ ID NO: 192273 - DNA, 25 bp, Homo sapien
ggtagttgcccatttacaagttcca

SEQ ID NO: 192274 - DNA, 25 bp, Homo sapien
gttgcccatttacaagttccagtta

SEQ ID NO: 192275 - DNA, 25 bp, Homo sapien
caagttccagttatgtgtgtaaaac

SEQ ID NO: 192276 - DNA, 25 bp, Homo sapien
aacttaaattactgtgtacttgagg

SEQ ID NO: 192277 - DNA, 25 bp, Homo sapien
ctgtgtacttgaggttggctttgga

SEQ ID NO: 192278 - DNA, 25 bp, Homo sapien
cttgaggttggctttggatatggat

SEQ ID NO: 192279 - DNA, 25 bp, Homo sapien
attgtttatcatctaatggctgtaa

SEQ ID NO: 192280 - DNA, 25 bp, Homo sapien
ttaatagtatacttgccatttgagc

SEQ ID NO: 192281 - DNA, 25 bp, Homo sapien
catttgagcctcactgcaaaattag

SEQ ID NO: 192282 - DNA, 25 bp, Homo sapien
tgagcctcactgcaaaattagtgca

SEQ ID NO: 192283 - DNA, 25 bp, Homo sapien
tagtgcagaggagaaaacaattttt

SEQ ID NO: 192284 - DNA, 25 bp, Homo sapien
tgattttacctcatatactgtacat

SEQ ID NO: 192285 - DNA, 25 bp, Homo sapien
tatactgtacattccaaaaactcta

SEQ ID NO: 192286 - DNA, 25 bp, Homo sapien
tgtacattccaaaaactctaaactt

SEQ ID NO: 192287 - DNA, 25 bp, Homo sapien
aagattatagatacactaccaaaca

SEQ ID NO: 192288 - DNA, 25 bp, Homo sapien
acactaccaaacatatcaccttaaa

SEQ ID NO: 192289 - DNA, 25 bp, Homo sapien
attgtataaggctgaatgaacttca

SEQ ID NO: 192290 - DNA, 25 bp, Homo sapien
aactatgtagcaaaagtatctgtaa

SEQ ID NO: 192291 - DNA, 25 bp, Homo sapien
tttttgctggtctcatctttggtaa

SEQ ID NO: 192292 - DNA, 25 bp, Homo sapien
ggtaatatgctataccccactgctg

SEQ ID NO: 192293 - DNA, 25 bp, Homo sapien
gacactgccctttagctgcagagct

SEQ ID NO: 192294 - DNA, 25 bp, Homo sapien
gcagagctggattagctgttgacca

SEQ ID NO: 192295 - DNA, 25 bp, Homo sapien
agctgttgaccatttgatgctgttg

SEQ ID NO: 192296 - DNA, 25 bp, Homo sapien
tttgatgctgttgtctgtctggcag

SEQ ID NO: 192297 - DNA, 25 bp, Homo sapien
ctgtctggcagggactgaatgacct

SEQ ID NO: 192298 - DNA, 25 bp, Homo sapien
gatgtcagatttagattcttcctgg

SEQ ID NO: 192299 - DNA, 25 bp, Homo sapien
tatttgcttctaaaacctcccaaag

SEQ ID NO: 192300 - DNA, 25 bp, Homo sapien
aaacctcccaaagtgaatctaatct

SEQ ID NO: 192301 - DNA, 25 bp, Homo sapien
atcaggtagtgttgctttttacagc

SEQ ID NO: 192302 - DNA, 25 bp, Homo sapien
agcagagaaggtacgttagcactat

SEQ ID NO: 192303 - DNA, 25 bp, Homo sapien
ggtacgttagcactattatctcttt

SEQ ID NO: 192304 - DNA, 25 bp, Homo sapien
gcactattatctctttttgacattg

SEQ ID NO: 192305 - DNA, 25 bp, Homo sapien
tttgcaggctatctcagccataata

SEQ ID NO: 192306 - DNA, 25 bp, Homo sapien
ggctatctcagccataatagtgaat

SEQ ID NO: 192307 - DNA, 25 bp, Homo sapien
ttctttgaggcatcttgtgtaatat

SEQ ID NO: 192308 - DNA, 25 bp, Homo sapien
aaattcattttagccatgtactata

SEQ ID NO: 192309 - DNA, 25 bp, Homo sapien
tcagattagttataaagcactcctc

SEQ ID NO: 192310 - DNA, 25 bp, Homo sapien
taaagcactcctcttgagctgacat

SEQ ID NO: 192311 - DNA, 25 bp, Homo sapien
cactcctcttgagctgacattgttc

SEQ ID NO: 192312 - DNA, 25 bp, Homo sapien
tttttgattaaccacttacaggaag

SEQ ID NO: 192313 - DNA, 25 bp, Homo sapien
catgatatctcatttctacgtgaaa

SEQ ID NO: 192314 - DNA, 25 bp, Homo sapien
gatatctcatttctacgtgaaaaga

SEQ ID NO: 192315 - DNA, 25 bp, Homo sapien
tctcatttctacgtgaaaagaagtt

SEQ ID NO: 192316 - DNA, 25 bp, Homo sapien
gagttccatgagaaaaatatacttg

SEQ ID NO: 192317 - DNA, 25 bp, Homo sapien
atacttgctatttatagaaaacgag

SEQ ID NO: 192318 - DNA, 25 bp, Homo sapien
ctaggcttttccttgatcttcagag

SEQ ID NO: 192319 - DNA, 25 bp, Homo sapien
aggcttttccttgatcttcagaggc

SEQ ID NO: 192320 - DNA, 25 bp, Homo sapien
gcttttccttgatcttcagaggcac

SEQ ID NO: 192321 - DNA, 25 bp, Homo sapien
ttttccttgatcttcagaggcacac

SEQ ID NO: 192322 - DNA, 25 bp, Homo sapien
ttccttgatcttcagaggcacacag

SEQ ID NO: 192323 - DNA, 25 bp, Homo sapien
ccttgatcttcagaggcacacaggg

SEQ ID NO: 192324 - DNA, 25 bp, Homo sapien
tgggaaacaggtaaaagcaaggacg

SEQ ID NO: 192325 - DNA, 25 bp, Homo sapien
aggacgggggccgggcgcagtgact

SEQ ID NO: 192326 - DNA, 25 bp, Homo sapien
ggacgggggccgggcgcagtgactc

SEQ ID NO: 192327 - DNA, 25 bp, Homo sapien
gacgggggccgggcgcagtgactca

SEQ ID NO: 192328 - DNA, 25 bp, Homo sapien
acgggggccgggcgcagtgactcac

SEQ ID NO: 192329 - DNA, 25 bp, Homo sapien
cgggggccgggcgcagtgactcacg

SEQ ID NO: 192330 - DNA, 25 bp, Homo sapien
gggggccgggcgcagtgactcacgc

SEQ ID NO: 192331 - DNA, 25 bp, Homo sapien
attagctgggcacggtggtgcgtgc

SEQ ID NO: 192332 - DNA, 25 bp, Homo sapien
ttagctgggcacggtggtgcgtgcc

SEQ ID NO: 192333 - DNA, 25 bp, Homo sapien
tagctgggcacggtggtgcgtgcct

SEQ ID NO: 192334 - DNA, 25 bp, Homo sapien
cactgacctctagcctggtggcaga

SEQ ID NO: 192335 - DNA, 25 bp, Homo sapien
ctacaggcggtttctctgttatcaa

SEQ ID NO: 192336 - DNA, 25 bp, Homo sapien
ggtttctctgttatcaaaggcattt

SEQ ID NO: 192337 - DNA, 25 bp, Homo sapien
agtgaagaacactttgcctgaatgt

SEQ ID NO: 192338 - DNA, 25 bp, Homo sapien
gtgatcagggcacataagtgacatt

SEQ ID NO: 192339 - DNA, 25 bp, Homo sapien
ataagtgacattggcgtgcttcata

SEQ ID NO: 192340 - DNA, 25 bp, Homo sapien
gcgtgcttcatatggcgtgcttgga

SEQ ID NO: 192341 - DNA, 25 bp, Homo sapien
ggcgtgcttggagccagaaaaactt

SEQ ID NO: 192342 - DNA, 25 bp, Homo sapien
gagccagaaaaacttagcggtttat

SEQ ID NO: 192343 - DNA, 25 bp, Homo sapien
attcattatcgtttattcagtgtcc

SEQ ID NO: 192344 - DNA, 25 bp, Homo sapien
ttcagtgtccgaattgaggccattt

SEQ ID NO: 192345 - DNA, 25 bp, Homo sapien
tgtccgaattgaggccatttgggaa

SEQ ID NO: 192346 - DNA, 25 bp, Homo sapien
tggtaagtggcttttctgaacgcac

SEQ ID NO: 192347 - DNA, 25 bp, Homo sapien
ggcttttctgaacgcactgtacatg

SEQ ID NO: 192348 - DNA, 25 bp, Homo sapien
aacgcactgtacatgtgctgagaga

SEQ ID NO: 192349 - DNA, 25 bp, Homo sapien
ctgagagaagcatcctgcccagaaa

SEQ ID NO: 192350 - DNA, 25 bp, Homo sapien
gagaagcatcctgcccagaaaggca

SEQ ID NO: 192351 - DNA, 25 bp, Homo sapien
gcaaatatttcaagttgtggattct

SEQ ID NO: 192352 - DNA, 25 bp, Homo sapien
ttcagagttattccatcccttgtct

SEQ ID NO: 192353 - DNA, 25 bp, Homo sapien
agagttattccatcccttgtctgct

SEQ ID NO: 192354 - DNA, 25 bp, Homo sapien
tattccatcccttgtctgctttctt

SEQ ID NO: 192355 - DNA, 25 bp, Homo sapien
agttataacttgagagacattttga

SEQ ID NO: 192356 - DNA, 25 bp, Homo sapien
gctcttcctagatgaatacgttgcc

SEQ ID NO: 192357 - DNA, 25 bp, Homo sapien
acctgagggatgtggtgtacaccta

SEQ ID NO: 192358 - DNA, 25 bp, Homo sapien
gtgtacacctaccatcagtttatag

SEQ ID NO: 192359 - DNA, 25 bp, Homo sapien
tagaggctgctaaatcgacctgcga

SEQ ID NO: 192360 - DNA, 25 bp, Homo sapien
aatcgacctgcgagagaggctacca

SEQ ID NO: 192361 - DNA, 25 bp, Homo sapien
gaggctaccacgacctgagtgtgaa

SEQ ID NO: 192362 - DNA, 25 bp, Homo sapien
gagtgtgaaactcctggcccgtcag

SEQ ID NO: 192363 - DNA, 25 bp, Homo sapien
gccgccgtgttctgtttgacccaga

SEQ ID NO: 192364 - DNA, 25 bp, Homo sapien
gtttgacccagaagttccgggcatc

SEQ ID NO: 192365 - DNA, 25 bp, Homo sapien
atccacggccctgtaaacaggtcaa

SEQ ID NO: 192366 - DNA, 25 bp, Homo sapien
tgtaaacaggtcaacggcccaaggg

SEQ ID NO: 192367 - DNA, 25 bp, Homo sapien
ttggacacttccctgagaagcccct

SEQ ID NO: 192368 - DNA, 25 bp, Homo sapien
gtatgtgtgcattcactgcaagtaa

SEQ ID NO: 192369 - DNA, 25 bp, Homo sapien
gaaaaccatggactgaatggaccat

SEQ ID NO: 192370 - DNA, 25 bp, Homo sapien
aatggaccattttatgtattcagag

SEQ ID NO: 192371 - DNA, 25 bp, Homo sapien
gtattcagagagagaagccactcat

SEQ ID NO: 192372 - DNA, 25 bp, Homo sapien
gaagccactcatcattgccagaaat

SEQ ID NO: 192373 - DNA, 25 bp, Homo sapien
catcattgccagaaataccatgtaa

SEQ ID NO: 192374 - DNA, 25 bp, Homo sapien
ttggcagttcagaggttgcaatact

SEQ ID NO: 192375 - DNA, 25 bp, Homo sapien
tcagaggttgcaatacttagtatag

SEQ ID NO: 192376 - DNA, 25 bp, Homo sapien
aaacggtcaacattgtgcaaccact

SEQ ID NO: 192377 - DNA, 25 bp, Homo sapien
gtgcaaccactaccaaaaagtgtgt

SEQ ID NO: 192378 - DNA, 25 bp, Homo sapien
aaaagtgtgttgtaatgcatcaaaa

SEQ ID NO: 192379 - DNA, 25 bp, Homo sapien
atcagctactagaatctgctgccag

SEQ ID NO: 192380 - DNA, 25 bp, Homo sapien
gggacaaagacgtgcactcaacctt

SEQ ID NO: 192381 - DNA, 25 bp, Homo sapien
gctcaccttaaaatcagcccttgat

SEQ ID NO: 192382 - DNA, 25 bp, Homo sapien
aaatcagcccttgatcccatttctg

SEQ ID NO: 192383 - DNA, 25 bp, Homo sapien
tgggcaatttagacagtgaaactga

SEQ ID NO: 192384 - DNA, 25 bp, Homo sapien
aactgactttgtttacctgcttgca

SEQ ID NO: 192385 - DNA, 25 bp, Homo sapien
gactttgtttacctgcttgcagcat

SEQ ID NO: 192386 - DNA, 25 bp, Homo sapien
gcttgcagcatattagaacagacga

SEQ ID NO: 192387 - DNA, 25 bp, Homo sapien
gaacagacgatccatgctaatattg

SEQ ID NO: 192388 - DNA, 25 bp, Homo sapien
taaaacatagctttcctgtaattta

SEQ ID NO: 192389 - DNA, 25 bp, Homo sapien
tagcagtaagctttcccattataat

SEQ ID NO: 192390 - DNA, 25 bp, Homo sapien
tacatgatacatgtgggcctgttag

SEQ ID NO: 192391 - DNA, 25 bp, Homo sapien
acatgtgggcctgttagtcttcgaa

SEQ ID NO: 192392 - DNA, 25 bp, Homo sapien
tgggcctgttagtcttcgaagcttc

SEQ ID NO: 192393 - DNA, 25 bp, Homo sapien
gttagtcttcgaagcttccagatgg

SEQ ID NO: 192394 - DNA, 25 bp, Homo sapien
gtcttcgaagcttccagatggtttg

SEQ ID NO: 192395 - DNA, 25 bp, Homo sapien
ccagatggtttgtgttttgaggtac

SEQ ID NO: 192396 - DNA, 25 bp, Homo sapien
aatgctgcagatctagaaatgcata

SEQ ID NO: 192397 - DNA, 25 bp, Homo sapien
atgcatatatttagcgggtatttga

SEQ ID NO: 192398 - DNA, 25 bp, Homo sapien
tatcttcttaagtaaatgctctcat

SEQ ID NO: 192399 - DNA, 25 bp, Homo sapien
tgctctcataacttgtatacatttt

SEQ ID NO: 192400 - DNA, 25 bp, Homo sapien
aacttgtatacatttttgcaggtac

SEQ ID NO: 192401 - DNA, 25 bp, Homo sapien
ccaaagagaggaaatcagtcgctga

SEQ ID NO: 192402 - DNA, 25 bp, Homo sapien
gagaggaaatcagtcgctgagtatt

SEQ ID NO: 192403 - DNA, 25 bp, Homo sapien
aatcagtcgctgagtattatttgac

SEQ ID NO: 192404 - DNA, 25 bp, Homo sapien
gtcgctgagtattatttgactccgg

SEQ ID NO: 192405 - DNA, 25 bp, Homo sapien
gagtattatttgactccggtctcct

SEQ ID NO: 192406 - DNA, 25 bp, Homo sapien
tattatttgactccggtctccttgg

SEQ ID NO: 192407 - DNA, 25 bp, Homo sapien
agctaataatagcatttcgagtata

SEQ ID NO: 192408 - DNA, 25 bp, Homo sapien
ttcgagtatatttcgtaaactaagg

SEQ ID NO: 192409 - DNA, 25 bp, Homo sapien
gagatatttgatgtccttttgccga

SEQ ID NO: 192410 - DNA, 25 bp, Homo sapien
gatatttgatgtccttttgccgagg

SEQ ID NO: 192411 - DNA, 25 bp, Homo sapien
cctggaccacgttgcccaagtcaca

SEQ ID NO: 192412 - DNA, 25 bp, Homo sapien
actggctgaggctaggcgctctcat

SEQ ID NO: 192413 - DNA, 25 bp, Homo sapien
gaggctaggcgctctcatgatccac

SEQ ID NO: 192414 - DNA, 25 bp, Homo sapien
gaaaagcaaacacattcctcctcag

SEQ ID NO: 192415 - DNA, 25 bp, Homo sapien
acccacctggagacgaatgtagcca

SEQ ID NO: 192416 - DNA, 25 bp, Homo sapien
tcggccttctctctgctagagttgc

SEQ ID NO: 192417 - DNA, 25 bp, Homo sapien
tagagttgccgctcagaggcttcag

SEQ ID NO: 192418 - DNA, 25 bp, Homo sapien
tcagaggcttcagcctgacttccag

SEQ ID NO: 192419 - DNA, 25 bp, Homo sapien
agcctgacttccagcggtcccaaga

SEQ ID NO: 192420 - DNA, 25 bp, Homo sapien
agcggtcccaagaacacctactaat

SEQ ID NO: 192421 - DNA, 25 bp, Homo sapien
gtcccaagaacacctactaattcct

SEQ ID NO: 192422 - DNA, 25 bp, Homo sapien
tctccactccttcatggctgggaca

SEQ ID NO: 192423 - DNA, 25 bp, Homo sapien
taaaaacccacaggcaccaaacagg

SEQ ID NO: 192424 - DNA, 25 bp, Homo sapien
cacaggcaccaaacaggctgcttaa

SEQ ID NO: 192425 - DNA, 25 bp, Homo sapien
aaaacagtatatcaccattgggtag

SEQ ID NO: 192426 - DNA, 25 bp, Homo sapien
gacgggactcatgtaaggactcaat

SEQ ID NO: 192427 - DNA, 25 bp, Homo sapien
ttcagtggcatgctgttagaggact

SEQ ID NO: 192428 - DNA, 25 bp, Homo sapien
gcatgctgttagaggactagtgtcc

SEQ ID NO: 192429 - DNA, 25 bp, Homo sapien
tagtgtccgagaatctcctcacagt

SEQ ID NO: 192430 - DNA, 25 bp, Homo sapien
atctcctcacagtatcatgttgcag

SEQ ID NO: 192431 - DNA, 25 bp, Homo sapien
tgttgcaggaattccccattgctct

SEQ ID NO: 192432 - DNA, 25 bp, Homo sapien
cattgctctgcaacttccaaaccag

SEQ ID NO: 192433 - DNA, 25 bp, Homo sapien
tccaaaccagtttgagtcatacaaa

SEQ ID NO: 192434 - DNA, 25 bp, Homo sapien
agtatggcaggataattacccacct

SEQ ID NO: 192435 - DNA, 25 bp, Homo sapien
gataattacccacctgttcctcttt

SEQ ID NO: 192436 - DNA, 25 bp, Homo sapien
acctgttcctcttttcagcttagaa

SEQ ID NO: 192437 - DNA, 25 bp, Homo sapien
ttagaaacataacggttcattcctt

SEQ ID NO: 192438 - DNA, 25 bp, Homo sapien
ttattgctagagaatgtcattcctg

SEQ ID NO: 192439 - DNA, 25 bp, Homo sapien
atttcccaaatcataacagttctat

SEQ ID NO: 192440 - DNA, 25 bp, Homo sapien
ggaatgatacccacaactctacaag

SEQ ID NO: 192441 - DNA, 25 bp, Homo sapien
tgatacccacaactctacaagcatc

SEQ ID NO: 192442 - DNA, 25 bp, Homo sapien
tacaagcatcttatccctctacagg

SEQ ID NO: 192443 - DNA, 25 bp, Homo sapien
atccctctacaggaatgactacctt

SEQ ID NO: 192444 - DNA, 25 bp, Homo sapien
caggaatgactaccttattaattaa

SEQ ID NO: 192445 - DNA, 25 bp, Homo sapien
gaaaggagatgaaggccctcctccc

SEQ ID NO: 192446 - DNA, 25 bp, Homo sapien
tgaaggccctcctcccaggaggtag

SEQ ID NO: 192447 - DNA, 25 bp, Homo sapien
gtagggtcttggctgccccgaactt

SEQ ID NO: 192448 - DNA, 25 bp, Homo sapien
ttggctgccccgaacttaaatgctt

SEQ ID NO: 192449 - DNA, 25 bp, Homo sapien
tgccccgaacttaaatgcttttgaa

SEQ ID NO: 192450 - DNA, 25 bp, Homo sapien
atctcttagatgtggaaatattttt

SEQ ID NO: 192451 - DNA, 25 bp, Homo sapien
tttttcgaacctgaaaatgcagctg

SEQ ID NO: 192452 - DNA, 25 bp, Homo sapien
atgcagctggtagaatttcaatgga

SEQ ID NO: 192453 - DNA, 25 bp, Homo sapien
ttttgtaaaatgcactttttgtgtg

SEQ ID NO: 192454 - DNA, 25 bp, Homo sapien
cctggtttcccagatctgtatttca

SEQ ID NO: 192455 - DNA, 25 bp, Homo sapien
ctcacctcccttttgacagagatta

SEQ ID NO: 192456 - DNA, 25 bp, Homo sapien
gtaaaaattgtcagtgcttgaagct

SEQ ID NO: 192457 - DNA, 25 bp, Homo sapien
tgcttgaagctgtttcctttactca

SEQ ID NO: 192458 - DNA, 25 bp, Homo sapien
aagctgtttcctttactcacattga

SEQ ID NO: 192459 - DNA, 25 bp, Homo sapien
tttactcacattgaagggacttcgt

SEQ ID NO: 192460 - DNA, 25 bp, Homo sapien
ttggttgtgactccaagagcagagt

SEQ ID NO: 192461 - DNA, 25 bp, Homo sapien
ccaagcatagactcgggtactgtga

SEQ ID NO: 192462 - DNA, 25 bp, Homo sapien
agactcgggtactgtgatgatggct

SEQ ID NO: 192463 - DNA, 25 bp, Homo sapien
gatgatggctgcagtccagttttat

SEQ ID NO: 192464 - DNA, 25 bp, Homo sapien
atgattctgcttttatgtgtccctt

SEQ ID NO: 192465 - DNA, 25 bp, Homo sapien
atgtgtcccttgataacagtgactt

SEQ ID NO: 192466 - DNA, 25 bp, Homo sapien
gacttaacaatatacattcctcata

SEQ ID NO: 192467 - DNA, 25 bp, Homo sapien
acctgagtatcattgcatgaatttt

SEQ ID NO: 192468 - DNA, 25 bp, Homo sapien
atcattgcatgaatttttatctccc

SEQ ID NO: 192469 - DNA, 25 bp, Homo sapien
atctccctatggttatatcctgcat

SEQ ID NO: 192470 - DNA, 25 bp, Homo sapien
ctccctatggttatatcctgcatca

SEQ ID NO: 192471 - DNA, 25 bp, Homo sapien
tatggttatatcctgcatcaagtgg

SEQ ID NO: 192472 - DNA, 25 bp, Homo sapien
tcctgcatcaagtggataattttga

SEQ ID NO: 192473 - DNA, 25 bp, Homo sapien
gttgttgaaaatcctgacttgttga

SEQ ID NO: 192474 - DNA, 25 bp, Homo sapien
gtacatggatttctatagatgtgtt

SEQ ID NO: 192475 - DNA, 25 bp, Homo sapien
cagggtttgccttgaaaccattaca

SEQ ID NO: 192476 - DNA, 25 bp, Homo sapien
gccttgaaaccattacattctacat

SEQ ID NO: 192477 - DNA, 25 bp, Homo sapien
accattacattctacatttaccaaa

SEQ ID NO: 192478 - DNA, 25 bp, Homo sapien
caattgtgctgaatctgtctgacta

SEQ ID NO: 192479 - DNA, 25 bp, Homo sapien
gaatctgtctgactataactctgac

SEQ ID NO: 192480 - DNA, 25 bp, Homo sapien
taactctgaccacacagaaccaggg

SEQ ID NO: 192481 - DNA, 25 bp, Homo sapien
taatccccacagtaagaaagttgta

SEQ ID NO: 192482 - DNA, 25 bp, Homo sapien
gttgtatggcatattccaacaagta

SEQ ID NO: 192483 - DNA, 25 bp, Homo sapien
acaagtattggttcgtctggtgtct

SEQ ID NO: 192484 - DNA, 25 bp, Homo sapien
gtctggtgtctttagagctttactc

SEQ ID NO: 192485 - DNA, 25 bp, Homo sapien
gagctttactctgttgaagtgactg

SEQ ID NO: 192486 - DNA, 25 bp, Homo sapien
gaagtgactgattctcaactgaaca

SEQ ID NO: 192487 - DNA, 25 bp, Homo sapien
ctgaacattatgtcgttactttgat

SEQ ID NO: 192488 - DNA, 25 bp, Homo sapien
gttactttgataagcattccacttt

SEQ ID NO: 192489 - DNA, 25 bp, Homo sapien
ccttttttggtctttatgaatatat

SEQ ID NO: 192490 - DNA, 25 bp, Homo sapien
agataaacaaaattgattgccccat

SEQ ID NO: 192491 - DNA, 25 bp, Homo sapien
tgtcttcctagaccccacagagtta

SEQ ID NO: 192492 - DNA, 25 bp, Homo sapien
ctagaccccacagagttaaaacttg

SEQ ID NO: 192493 - DNA, 25 bp, Homo sapien
ccccagaacacttgtatattgtttg

SEQ ID NO: 192494 - DNA, 25 bp, Homo sapien
atattgtttgtttgaggttcgtgcc

SEQ ID NO: 192495 - DNA, 25 bp, Homo sapien
ttgtttgaggttcgtgccgcagtaa

SEQ ID NO: 192496 - DNA, 25 bp, Homo sapien
ggttcgtgccgcagtaacagacaca

SEQ ID NO: 192497 - DNA, 25 bp, Homo sapien
cagtatttaattgcacatacagatg

SEQ ID NO: 192498 - DNA, 25 bp, Homo sapien
acatacagatgtttgctgggtatat

SEQ ID NO: 192499 - DNA, 25 bp, Homo sapien
tgtttgctgggtatattcactgtaa

SEQ ID NO: 192500 - DNA, 25 bp, Homo sapien
agctttaaaggccaggacgcgcgac

SEQ ID NO: 192501 - DNA, 25 bp, Homo sapien
ttaaaggccaggacgcgcgacacgt

SEQ ID NO: 192502 - DNA, 25 bp, Homo sapien
tccagtggcggcacgtccttggcgt

SEQ ID NO: 192503 - DNA, 25 bp, Homo sapien
tccttggcgtctctaatgtctgcag

SEQ ID NO: 192504 - DNA, 25 bp, Homo sapien
agctcaagggctggcacttttttaa

SEQ ID NO: 192505 - DNA, 25 bp, Homo sapien
caagggctggcacttttttaaatat

SEQ ID NO: 192506 - DNA, 25 bp, Homo sapien
cttctgttgacattcgggtgatcct

SEQ ID NO: 192507 - DNA, 25 bp, Homo sapien
tgatcctgttctgcgctgtgtacaa

SEQ ID NO: 192508 - DNA, 25 bp, Homo sapien
gtacaatgtgagatcggtgcgttct

SEQ ID NO: 192509 - DNA, 25 bp, Homo sapien
attgtacacgggaccagctcacgta

SEQ ID NO: 192510 - DNA, 25 bp, Homo sapien
agctcacgtaatgcattgcctgtaa

SEQ ID NO: 192511 - DNA, 25 bp, Homo sapien
ctgtagtggattatgtcttgttaga

SEQ ID NO: 192512 - DNA, 25 bp, Homo sapien
atgtcttgttagaaaattgccctaa

SEQ ID NO: 192513 - DNA, 25 bp, Homo sapien
gaaaattgccctaatatgggtgact

SEQ ID NO: 192514 - DNA, 25 bp, Homo sapien
atgggtgactatgtcgttgctcctc

SEQ ID NO: 192515 - DNA, 25 bp, Homo sapien
actatgtcgttgctcctcaatttat

SEQ ID NO: 192516 - DNA, 25 bp, Homo sapien
ctcctcaatttatgaccgacaatta

SEQ ID NO: 192517 - DNA, 25 bp, Homo sapien
atgaccgacaattatgttcgtgtga

SEQ ID NO: 192518 - DNA, 25 bp, Homo sapien
tagcaattcttgtggttctgagata

SEQ ID NO: 192519 - DNA, 25 bp, Homo sapien
tcatgggctgcaagcccctgctcgt

SEQ ID NO: 192520 - DNA, 25 bp, Homo sapien
cctgctcgtgcaccatggatgattt

SEQ ID NO: 192521 - DNA, 25 bp, Homo sapien
gattttgccaaagaaagtttcactg

SEQ ID NO: 192522 - DNA, 25 bp, Homo sapien
tttgtgaacagacccatcatatgca

SEQ ID NO: 192523 - DNA, 25 bp, Homo sapien
gacccatcatatgcagacttctggt

SEQ ID NO: 192524 - DNA, 25 bp, Homo sapien
gacttctggtctactgaggagcatg

SEQ ID NO: 192525 - DNA, 25 bp, Homo sapien
gaggagcatgtgtctctacatgttt

SEQ ID NO: 192526 - DNA, 25 bp, Homo sapien
gtgtctctacatgtttacagtggtg

SEQ ID NO: 192527 - DNA, 25 bp, Homo sapien
ccctctgccaataaccacaaaatga

SEQ ID NO: 192528 - DNA, 25 bp, Homo sapien
gaatttcatgatactctcatgcttt

SEQ ID NO: 192529 - DNA, 25 bp, Homo sapien
catgctttgtattatcagtgacttc

SEQ ID NO: 192530 - DNA, 25 bp, Homo sapien
tctcttggcaaatttttaatgcatc

SEQ ID NO: 192531 - DNA, 25 bp, Homo sapien
taatgcatctgtgcttggcccaggg

SEQ ID NO: 192532 - DNA, 25 bp, Homo sapien
tttgtaatagcaacagtggtttggg

SEQ ID NO: 192533 - DNA, 25 bp, Homo sapien
gggtgatcctgttctgcgctgtgta

SEQ ID NO: 192534 - DNA, 25 bp, Homo sapien
tgatcctgttctgcgctgtgtacaa

SEQ ID NO: 192535 - DNA, 25 bp, Homo sapien
ctgttctgcgctgtgtacaatgtga

SEQ ID NO: 192536 - DNA, 25 bp, Homo sapien
tctgcgctgtgtacaatgtgagatc

SEQ ID NO: 192537 - DNA, 25 bp, Homo sapien
gtacaatgtgagatcggtgcgttct

SEQ ID NO: 192538 - DNA, 25 bp, Homo sapien
gattgtacacgggaccagctcacgt

SEQ ID NO: 192539 - DNA, 25 bp, Homo sapien
gtacacgggaccagctcacgtaatg

SEQ ID NO: 192540 - DNA, 25 bp, Homo sapien
gggaccagctcacgtaatgcattgc

SEQ ID NO: 192541 - DNA, 25 bp, Homo sapien
gaccagctcacgtaatgcattgcct

SEQ ID NO: 192542 - DNA, 25 bp, Homo sapien
agctcacgtaatgcattgcctgtaa

SEQ ID NO: 192543 - DNA, 25 bp, Homo sapien
cacgtaatgcattgcctgtaacaat

SEQ ID NO: 192544 - DNA, 25 bp, Homo sapien
gagagagtttcatcagtacagttgg

SEQ ID NO: 192545 - DNA, 25 bp, Homo sapien
tcatcagtacagttggtggacgtta

SEQ ID NO: 192546 - DNA, 25 bp, Homo sapien
gttggtggacgttaattgtttgaat

SEQ ID NO: 192547 - DNA, 25 bp, Homo sapien
atcaagaaactacctggaaccagtg

SEQ ID NO: 192548 - DNA, 25 bp, Homo sapien
ggaaagctggacttaaataatctta

SEQ ID NO: 192549 - DNA, 25 bp, Homo sapien
atgtctcttttaaaatctactgtat

SEQ ID NO: 192550 - DNA, 25 bp, Homo sapien
acccttgaaggtgatctcttgtttt

SEQ ID NO: 192551 - DNA, 25 bp, Homo sapien
aggtgatctcttgttttgtgttgta

SEQ ID NO: 192552 - DNA, 25 bp, Homo sapien
tattgtttgtatgtttcccttcttg

SEQ ID NO: 192553 - DNA, 25 bp, Homo sapien
gtttgtatgtttcccttcttgcctt

SEQ ID NO: 192554 - DNA, 25 bp, Homo sapien
ttcttgccttctgttataagtctct

SEQ ID NO: 192555 - DNA, 25 bp, Homo sapien
aatctgtattatcaatttctcatag

SEQ ID NO: 192556 - DNA, 25 bp, Homo sapien
attatcaatttctcatagacactgt

SEQ ID NO: 192557 - DNA, 25 bp, Homo sapien
tagacactgtgctaatgtgaatttt

SEQ ID NO: 192558 - DNA, 25 bp, Homo sapien
gtgaattttaaatgacctgcatcaa

SEQ ID NO: 192559 - DNA, 25 bp, Homo sapien
aatgacctgcatcaagtcttctgat

SEQ ID NO: 192560 - DNA, 25 bp, Homo sapien
tgcatcaagtcttctgatctcagat

SEQ ID NO: 192561 - DNA, 25 bp, Homo sapien
gtcttctgatctcagataactcagt

SEQ ID NO: 192562 - DNA, 25 bp, Homo sapien
gataactcagtacagatagcaatta

SEQ ID NO: 192563 - DNA, 25 bp, Homo sapien
atagcaattagtcagctgatttgat

SEQ ID NO: 192564 - DNA, 25 bp, Homo sapien
tagtcagctgatttgattacaatgg

SEQ ID NO: 192565 - DNA, 25 bp, Homo sapien
tggagtaaccgacaatatatttatt

SEQ ID NO: 192566 - DNA, 25 bp, Homo sapien
gggcgactcctgatgaagcacaact

SEQ ID NO: 192567 - DNA, 25 bp, Homo sapien
ggcgactcctgatgaagcacaactc

SEQ ID NO: 192568 - DNA, 25 bp, Homo sapien
atgaagcacaactccccgcagggcc

SEQ ID NO: 192569 - DNA, 25 bp, Homo sapien
ggtggccatatttgggcagttccca

SEQ ID NO: 192570 - DNA, 25 bp, Homo sapien
atatttgggcagttcccagtcctgt

SEQ ID NO: 192571 - DNA, 25 bp, Homo sapien
tgggcagttcccagtcctgtgggct

SEQ ID NO: 192572 - DNA, 25 bp, Homo sapien
ttcccagtcctgtgggctcggctat

SEQ ID NO: 192573 - DNA, 25 bp, Homo sapien
agtcctgtgggctcggctatctggg

SEQ ID NO: 192574 - DNA, 25 bp, Homo sapien
agcagattttgggtctggatctccc

SEQ ID NO: 192575 - DNA, 25 bp, Homo sapien
tgggtcctgggcttggatctttccc

SEQ ID NO: 192576 - DNA, 25 bp, Homo sapien
cctgggcttggatctttccctaggg

SEQ ID NO: 192577 - DNA, 25 bp, Homo sapien
acgcaagctttgagatagggctttg

SEQ ID NO: 192578 - DNA, 25 bp, Homo sapien
gagatagggctttgttcactcagca

SEQ ID NO: 192579 - DNA, 25 bp, Homo sapien
ttacccttaagatctatccaagttg

SEQ ID NO: 192580 - DNA, 25 bp, Homo sapien
gatctatccaagttgttaggtgtct

SEQ ID NO: 192581 - DNA, 25 bp, Homo sapien
ctatccaagttgttaggtgtctaaa

SEQ ID NO: 192582 - DNA, 25 bp, Homo sapien
tttgttactgagttagtattctttt

SEQ ID NO: 192583 - DNA, 25 bp, Homo sapien
gtattcttttaaatggatgcaccag

SEQ ID NO: 192584 - DNA, 25 bp, Homo sapien
gatgcaccagggtttgtgtatccat

SEQ ID NO: 192585 - DNA, 25 bp, Homo sapien
gcaccagggtttgtgtatccattca

SEQ ID NO: 192586 - DNA, 25 bp, Homo sapien
gggtttgtgtatccattcactgttg

SEQ ID NO: 192587 - DNA, 25 bp, Homo sapien
ttgtgtatccattcactgttgatgg

SEQ ID NO: 192588 - DNA, 25 bp, Homo sapien
cttttgtaacgagtctttcatgatg

SEQ ID NO: 192589 - DNA, 25 bp, Homo sapien
gtctttcatgatgtgactttgaggc

SEQ ID NO: 192590 - DNA, 25 bp, Homo sapien
ggcacaggccatcccgagtgcatgt

SEQ ID NO: 192591 - DNA, 25 bp, Homo sapien
gagtgcatgtccctgttgcccactg

SEQ ID NO: 192592 - DNA, 25 bp, Homo sapien
gttgcccactgcactgatcatgaag

SEQ ID NO: 192593 - DNA, 25 bp, Homo sapien
actgcactgatcatgaagccaccgg

SEQ ID NO: 192594 - DNA, 25 bp, Homo sapien
tgatcatgaagccaccggccactgc

SEQ ID NO: 192595 - DNA, 25 bp, Homo sapien
cactgccacgcatgttgcacctgtg

SEQ ID NO: 192596 - DNA, 25 bp, Homo sapien
atgttgcacctgtgccatcgtgctc

SEQ ID NO: 192597 - DNA, 25 bp, Homo sapien
gctccctcctgatgggcaccgtggt

SEQ ID NO: 192598 - DNA, 25 bp, Homo sapien
ccggtggctggttttgaacttgtgt

SEQ ID NO: 192599 - DNA, 25 bp, Homo sapien
attttctacattccaaggagagatt

SEQ ID NO: 192600 - DNA, 25 bp, Homo sapien
tttcaatctctatataactgtcaac

SEQ ID NO: 192601 - DNA, 25 bp, Homo sapien
aactgtcaacaccatgaatcttcca

SEQ ID NO: 192602 - DNA, 25 bp, Homo sapien
accatgaatcttccaaagcgcaaag

SEQ ID NO: 192603 - DNA, 25 bp, Homo sapien
aagaagttatttgccgaggatctga

SEQ ID NO: 192604 - DNA, 25 bp, Homo sapien
tgccgaggatctgatgacgattact

SEQ ID NO: 192605 - DNA, 25 bp, Homo sapien
gacgattactctttttgcagagctc

SEQ ID NO: 192606 - DNA, 25 bp, Homo sapien
ttgcagagctctgaagggagagact

SEQ ID NO: 192607 - DNA, 25 bp, Homo sapien
tatcattctccttcaagggaataaa

SEQ ID NO: 192608 - DNA, 25 bp, Homo sapien
gttgaagctatttctgggagcccag

SEQ ID NO: 192609 - DNA, 25 bp, Homo sapien
aatgctcttttgcttggagtttgtc

SEQ ID NO: 192610 - DNA, 25 bp, Homo sapien
ctgtactgctacaagttcctttggc

SEQ ID NO: 192611 - DNA, 25 bp, Homo sapien
actgctacaagttcctttggcaatg

SEQ ID NO: 192612 - DNA, 25 bp, Homo sapien
acaagttcctttggcaatgaccact

SEQ ID NO: 192613 - DNA, 25 bp, Homo sapien
ggcaatgaccactttgctgtaaaca

SEQ ID NO: 192614 - DNA, 25 bp, Homo sapien
gaccactttgctgtaaacattctta

SEQ ID NO: 192615 - DNA, 25 bp, Homo sapien
aaaagtaggaattaggcttggcgcg

SEQ ID NO: 192616 - DNA, 25 bp, Homo sapien
aatgcatcgaaaagggtcaagttat

SEQ ID NO: 192617 - DNA, 25 bp, Homo sapien
aatggttgagaaattagtcacatca

SEQ ID NO: 192618 - DNA, 25 bp, Homo sapien
gtcacatcaatagacttctttcatt

SEQ ID NO: 192619 - DNA, 25 bp, Homo sapien
cttctttcatttctgagcccatctt

SEQ ID NO: 192620 - DNA, 25 bp, Homo sapien
atcttctgtactgctacaagttcct

SEQ ID NO: 192621 - DNA, 25 bp, Homo sapien
agattttgaatttaggctgggtgca

SEQ ID NO: 192622 - DNA, 25 bp, Homo sapien
aggccagagtaggtggattgcttca

SEQ ID NO: 192623 - DNA, 25 bp, Homo sapien
ggccagagtaggtggattgcttcaa

SEQ ID NO: 192624 - DNA, 25 bp, Homo sapien
gccagagtaggtggattgcttcaac

SEQ ID NO: 192625 - DNA, 25 bp, Homo sapien
ccagagtaggtggattgcttcaacc

SEQ ID NO: 192626 - DNA, 25 bp, Homo sapien
cagagtaggtggattgcttcaaccc

SEQ ID NO: 192627 - DNA, 25 bp, Homo sapien
gagtaggtggattgcttcaacccag

SEQ ID NO: 192628 - DNA, 25 bp, Homo sapien
ggattgcttcaacccaggcattcga

SEQ ID NO: 192629 - DNA, 25 bp, Homo sapien
agtaggctgaagtcatgccactgca

SEQ ID NO: 192630 - DNA, 25 bp, Homo sapien
tgcactcaaacctggcggacagagt

SEQ ID NO: 192631 - DNA, 25 bp, Homo sapien
gcactcaaacctggcggacagagtg

SEQ ID NO: 192632 - DNA, 25 bp, Homo sapien
gtgaaaaatactgttgcagccccaa

SEQ ID NO: 192633 - DNA, 25 bp, Homo sapien
tgttgcagccccaagagagtccaga

SEQ ID NO: 192634 - DNA, 25 bp, Homo sapien
gagagtccagatgcaccctgaagat

SEQ ID NO: 192635 - DNA, 25 bp, Homo sapien
accctgaagatgtgtagtggaccgc

SEQ ID NO: 192636 - DNA, 25 bp, Homo sapien
agatgtgtagtggaccgcactccgc

SEQ ID NO: 192637 - DNA, 25 bp, Homo sapien
aatcatctcgatctggttgtgactg

SEQ ID NO: 192638 - DNA, 25 bp, Homo sapien
tggttgtgactgtggcccctgccgt

SEQ ID NO: 192639 - DNA, 25 bp, Homo sapien
ggagacttttaggaggccgcagcct

SEQ ID NO: 192640 - DNA, 25 bp, Homo sapien
tttaggaggccgcagccttccatca

SEQ ID NO: 192641 - DNA, 25 bp, Homo sapien
cagccttccatcaccggatcagttt

SEQ ID NO: 192642 - DNA, 25 bp, Homo sapien
cagcgttcccgctggctgtgggaca

SEQ ID NO: 192643 - DNA, 25 bp, Homo sapien
gatggcctgaagcaagtggagaatc

SEQ ID NO: 192644 - DNA, 25 bp, Homo sapien
aaaatggcctgttgctgccttaaca

SEQ ID NO: 192645 - DNA, 25 bp, Homo sapien
tgctgccttaacagatgacattact

SEQ ID NO: 192646 - DNA, 25 bp, Homo sapien
gctgccttaacagatgacattactt

SEQ ID NO: 192647 - DNA, 25 bp, Homo sapien
ctgccttaacagatgacattacttt

SEQ ID NO: 192648 - DNA, 25 bp, Homo sapien
aacagatgacattactttgtgaaat

SEQ ID NO: 192649 - DNA, 25 bp, Homo sapien
cagatgacattactttgtgaaattc

SEQ ID NO: 192650 - DNA, 25 bp, Homo sapien
tgcctgccagagaataatccccttt

SEQ ID NO: 192651 - DNA, 25 bp, Homo sapien
gcctgccagagaataatcccctttg

SEQ ID NO: 192652 - DNA, 25 bp, Homo sapien
ctgccagagaataatcccctttgac

SEQ ID NO: 192653 - DNA, 25 bp, Homo sapien
tgccagagaataatcccctttgact

SEQ ID NO: 192654 - DNA, 25 bp, Homo sapien
gccagagggaagtctgctgtgttct

SEQ ID NO: 192655 - DNA, 25 bp, Homo sapien
tctgctgtgttctcatgtaggatgt

SEQ ID NO: 192656 - DNA, 25 bp, Homo sapien
gttctcatgtaggatgtcagccctc

SEQ ID NO: 192657 - DNA, 25 bp, Homo sapien
tgtaggatgtcagccctccctgcaa

SEQ ID NO: 192658 - DNA, 25 bp, Homo sapien
ttttggccaatgtcttttcactttc

SEQ ID NO: 192659 - DNA, 25 bp, Homo sapien
actttcctgaccctttagaatcatc

SEQ ID NO: 192660 - DNA, 25 bp, Homo sapien
atccccagccagacgcaatcatgga

SEQ ID NO: 192661 - DNA, 25 bp, Homo sapien
gacgcaatcatggaagttgccttat

SEQ ID NO: 192662 - DNA, 25 bp, Homo sapien
gaagttgccttattgtcactggtta

SEQ ID NO: 192663 - DNA, 25 bp, Homo sapien
gtcactggttaagaacttggcgaga

SEQ ID NO: 192664 - DNA, 25 bp, Homo sapien
aacttggcgagattgaagggctttt

SEQ ID NO: 192665 - DNA, 25 bp, Homo sapien
aaggtatgtgtcagccatgaccacc

SEQ ID NO: 192666 - DNA, 25 bp, Homo sapien
ggctcgtatgtcacctgtagatttc

SEQ ID NO: 192667 - DNA, 25 bp, Homo sapien
atgtcacctgtagatttccacacgc

SEQ ID NO: 192668 - DNA, 25 bp, Homo sapien
tgtagatttccacacgccaagctcc

SEQ ID NO: 192669 - DNA, 25 bp, Homo sapien
ttcggaaatgtctccacccgtgtcc

SEQ ID NO: 192670 - DNA, 25 bp, Homo sapien
ggcggtcagccccttcatggaagaa

SEQ ID NO: 192671 - DNA, 25 bp, Homo sapien
ggtcagccccttcatggaagaagag

SEQ ID NO: 192672 - DNA, 25 bp, Homo sapien
gaagagagacctctacttctcgtga

SEQ ID NO: 192673 - DNA, 25 bp, Homo sapien
gagacctctacttctcgtgacacca

SEQ ID NO: 192674 - DNA, 25 bp, Homo sapien
acaccaccaaggctgcgggagaaga

SEQ ID NO: 192675 - DNA, 25 bp, Homo sapien
gaagaagtttgaccatcaccctcag

SEQ ID NO: 192676 - DNA, 25 bp, Homo sapien
ccgggatttggtgcaactgccaaga

SEQ ID NO: 192677 - DNA, 25 bp, Homo sapien
caggtggtggtgacttcactacgat

SEQ ID NO: 192678 - DNA, 25 bp, Homo sapien
ggtgacttcactacgatgccatctg

SEQ ID NO: 192679 - DNA, 25 bp, Homo sapien
gatgccatctgccagtacatgggcc

SEQ ID NO: 192680 - DNA, 25 bp, Homo sapien
gtacatgggccctagtgacacagat

SEQ ID NO: 192681 - DNA, 25 bp, Homo sapien
agatgatgactgacccatgggactc

SEQ ID NO: 192682 - DNA, 25 bp, Homo sapien
ggctggtaccagttctgtaccatat

SEQ ID NO: 192683 - DNA, 25 bp, Homo sapien
gtaccatatgagaaagttgccttca

SEQ ID NO: 192684 - DNA, 25 bp, Homo sapien
ggaagatcattgttccatcctctac

SEQ ID NO: 192685 - DNA, 25 bp, Homo sapien
ctctacttctggtgcagtcctggga

SEQ ID NO: 192686 - DNA, 25 bp, Homo sapien
gaaccagtagggaagctagaaacaa

SEQ ID NO: 192687 - DNA, 25 bp, Homo sapien
atcatctactgctgcctcaatgaca

SEQ ID NO: 192688 - DNA, 25 bp, Homo sapien
tcatctactgctgcctcaatgacag

SEQ ID NO: 192689 - DNA, 25 bp, Homo sapien
atctactgctgcctcaatgacaggt

SEQ ID NO: 192690 - DNA, 25 bp, Homo sapien
atcaacccagatctctacctgaaga

SEQ ID NO: 192691 - DNA, 25 bp, Homo sapien
tcaacccagatctctacctgaagaa

SEQ ID NO: 192692 - DNA, 25 bp, Homo sapien
ccagatctctacctgaagaagttta

SEQ ID NO: 192693 - DNA, 25 bp, Homo sapien
cagatctctacctgaagaagtttat

SEQ ID NO: 192694 - DNA, 25 bp, Homo sapien
gatctctacctgaagaagtttatcc

SEQ ID NO: 192695 - DNA, 25 bp, Homo sapien
ctctacctgaagaagtttatccagc

SEQ ID NO: 192696 - DNA, 25 bp, Homo sapien
ggtctacctggccatcatgtggctg

SEQ ID NO: 192697 - DNA, 25 bp, Homo sapien
gtctacctggccatcatgtggctgg

SEQ ID NO: 192698 - DNA, 25 bp, Homo sapien
aaatatttgagccattactgaattc

SEQ ID NO: 192699 - DNA, 25 bp, Homo sapien
atatttgagccattactgaattcac

SEQ ID NO: 192700 - DNA, 25 bp, Homo sapien
ttactgaattcacatatgtatgttt

SEQ ID NO: 192701 - DNA, 25 bp, Homo sapien
gttacattcttaaacaatgacattg

SEQ ID NO: 192702 - DNA, 25 bp, Homo sapien
atgacattgtcgaaagaaagttctt

SEQ ID NO: 192703 - DNA, 25 bp, Homo sapien
gaaagttcttataagctgttttttg

SEQ ID NO: 192704 - DNA, 25 bp, Homo sapien
acttggttatactatattctgtttc

SEQ ID NO: 192705 - DNA, 25 bp, Homo sapien
tatattctgtttccaagtaaccttt

SEQ ID NO: 192706 - DNA, 25 bp, Homo sapien
ttgttgggttttagatctcttttca

SEQ ID NO: 192707 - DNA, 25 bp, Homo sapien
gttgggttttagatctcttttcatt

SEQ ID NO: 192708 - DNA, 25 bp, Homo sapien
ggttttagatctcttttcatttgtc

SEQ ID NO: 192709 - DNA, 25 bp, Homo sapien
cagcccatctcttctgacatggaag

SEQ ID NO: 192710 - DNA, 25 bp, Homo sapien
gctgagcggcttatgttctgaattt

SEQ ID NO: 192711 - DNA, 25 bp, Homo sapien
gcggcttatgttctgaatttgttta

SEQ ID NO: 192712 - DNA, 25 bp, Homo sapien
gaactgatcattagtgagactggcc

SEQ ID NO: 192713 - DNA, 25 bp, Homo sapien
attagtgagactggccacagtattt

SEQ ID NO: 192714 - DNA, 25 bp, Homo sapien
gcacatgcatgctcagtgaagccta

SEQ ID NO: 192715 - DNA, 25 bp, Homo sapien
tgcatgctcagtgaagcctagacat

SEQ ID NO: 192716 - DNA, 25 bp, Homo sapien
agcctagacattcagagcagcagaa

SEQ ID NO: 192717 - DNA, 25 bp, Homo sapien
tttctttccaccttgcctgagactg

SEQ ID NO: 192718 - DNA, 25 bp, Homo sapien
ttccaccttgcctgagactggcatt

SEQ ID NO: 192719 - DNA, 25 bp, Homo sapien
gactggcattttagagacctgttaa

SEQ ID NO: 192720 - DNA, 25 bp, Homo sapien
ggccctgttccttgcacattttaca

SEQ ID NO: 192721 - DNA, 25 bp, Homo sapien
cttgcacattttacagttacctcat

SEQ ID NO: 192722 - DNA, 25 bp, Homo sapien
gttacctcatttttcccatgtatgt

SEQ ID NO: 192723 - DNA, 25 bp, Homo sapien
ttcccatgtatgtatttgagaaaat

SEQ ID NO: 192724 - DNA, 25 bp, Homo sapien
gtgtggttttttccattccatggga

SEQ ID NO: 192725 - DNA, 25 bp, Homo sapien
cattccatgggattcacattggttt

SEQ ID NO: 192726 - DNA, 25 bp, Homo sapien
gggattcacattggtttgtagcatt

SEQ ID NO: 192727 - DNA, 25 bp, Homo sapien
ggtttgtagcatttaacataactag

SEQ ID NO: 192728 - DNA, 25 bp, Homo sapien
aaatgaaagttgctagttctgcttg

SEQ ID NO: 192729 - DNA, 25 bp, Homo sapien
gctagttctgcttgaccaagtagtg

SEQ ID NO: 192730 - DNA, 25 bp, Homo sapien
gcttgaccaagtagtgcaatcatta

SEQ ID NO: 192731 - DNA, 25 bp, Homo sapien
gctagcctatttatggttattcgtt

SEQ ID NO: 192732 - DNA, 25 bp, Homo sapien
tattcgttttagtaagttctgtggg

SEQ ID NO: 192733 - DNA, 25 bp, Homo sapien
gttctgtgggagcaaggtatttaaa

SEQ ID NO: 192734 - DNA, 25 bp, Homo sapien
actaataactacatcatggtttttg

SEQ ID NO: 192735 - DNA, 25 bp, Homo sapien
tcatggtttttgattaggatctaaa

SEQ ID NO: 192736 - DNA, 25 bp, Homo sapien
ttcaggttttaagcctgctgcaaac

SEQ ID NO: 192737 - DNA, 25 bp, Homo sapien
ttaagcctgctgcaaacttttaaaa

SEQ ID NO: 192738 - DNA, 25 bp, Homo sapien
gatagattctgtactacatgtggga

SEQ ID NO: 192739 - DNA, 25 bp, Homo sapien
ctgtactacatgtgggaaacaagca

SEQ ID NO: 192740 - DNA, 25 bp, Homo sapien
aaataatcaaatgttgtcaaccaaa

SEQ ID NO: 192741 - DNA, 25 bp, Homo sapien
gtttttatgttattagctatttgga

SEQ ID NO: 192742 - DNA, 25 bp, Homo sapien
agctcctacaaatcagtaacatgaa

SEQ ID NO: 192743 - DNA, 25 bp, Homo sapien
aatcgccaggatcccctgaagggtc

SEQ ID NO: 192744 - DNA, 25 bp, Homo sapien
caggatcccctgaagggtctgggat

SEQ ID NO: 192745 - DNA, 25 bp, Homo sapien
caaggattcattctgttacttactt

SEQ ID NO: 192746 - DNA, 25 bp, Homo sapien
tgcccctttttatctttccctcttg

SEQ ID NO: 192747 - DNA, 25 bp, Homo sapien
cagcttcatgtgaagctctgcacag

SEQ ID NO: 192748 - DNA, 25 bp, Homo sapien
gacaagacactcagtgtccttggca

SEQ ID NO: 192749 - DNA, 25 bp, Homo sapien
ttggcagtgctgctactcctcaggt

SEQ ID NO: 192750 - DNA, 25 bp, Homo sapien
ctactcctcaggtgcagcatacata

SEQ ID NO: 192751 - DNA, 25 bp, Homo sapien
gtgcagcatacataaccagtaagag

SEQ ID NO: 192752 - DNA, 25 bp, Homo sapien
accagtaagagactaaatctgcaat

SEQ ID NO: 192753 - DNA, 25 bp, Homo sapien
gcagggctacggtactgtgttccct

SEQ ID NO: 192754 - DNA, 25 bp, Homo sapien
tgtgttcccttctgccacctggtgg

SEQ ID NO: 192755 - DNA, 25 bp, Homo sapien
tggccggcggcaggaactatcagta

SEQ ID NO: 192756 - DNA, 25 bp, Homo sapien
aactatcagtagacagctgctgctt

SEQ ID NO: 192757 - DNA, 25 bp, Homo sapien
ttagcctatctccttaaacctcttc

SEQ ID NO: 192758 - DNA, 25 bp, Homo sapien
tcattccctcggttttattctgaac

SEQ ID NO: 192759 - DNA, 25 bp, Homo sapien
tctgaacccgtaaggtggtgttctc

SEQ ID NO: 192760 - DNA, 25 bp, Homo sapien
tggtgttctcaatatttcctgtccc

SEQ ID NO: 192761 - DNA, 25 bp, Homo sapien
gagatccatacttagtcctcacatc

SEQ ID NO: 192762 - DNA, 25 bp, Homo sapien
ttagtcctcacatcgcccgtttttt

SEQ ID NO: 192763 - DNA, 25 bp, Homo sapien
tttttcctctgacagcctaagccta

SEQ ID NO: 192764 - DNA, 25 bp, Homo sapien
tggagctaagctttaccctgctgca

SEQ ID NO: 192765 - DNA, 25 bp, Homo sapien
ctaagctttaccctgctgcagtaga

SEQ ID NO: 192766 - DNA, 25 bp, Homo sapien
accctgctgcagtagataccattgt

SEQ ID NO: 192767 - DNA, 25 bp, Homo sapien
gataccattgttgctatcatggcag

SEQ ID NO: 192768 - DNA, 25 bp, Homo sapien
attgttgctatcatggcagaaggaa

SEQ ID NO: 192769 - DNA, 25 bp, Homo sapien
gcagaaggaaaacagcatgctctat

SEQ ID NO: 192770 - DNA, 25 bp, Homo sapien
cagcatgctctatgtgttggagtca

SEQ ID NO: 192771 - DNA, 25 bp, Homo sapien
gttggagtcatgaagatgtctgcag

SEQ ID NO: 192772 - DNA, 25 bp, Homo sapien
cctcagaaggaatgcacttgggcta

SEQ ID NO: 192773 - DNA, 25 bp, Homo sapien
tgcacttgggctaaatatggatatt

SEQ ID NO: 192774 - DNA, 25 bp, Homo sapien
atggatattgtgctgtatctgtgtt

SEQ ID NO: 192775 - DNA, 25 bp, Homo sapien
atgagcagccgtggcgctcgactgc

SEQ ID NO: 192776 - DNA, 25 bp, Homo sapien
gactgcacaggagcccgagacaata

SEQ ID NO: 192777 - DNA, 25 bp, Homo sapien
aatgctactgctttttccaagaata

SEQ ID NO: 192778 - DNA, 25 bp, Homo sapien
atattatgtcattgagtgtcgccaa

SEQ ID NO: 192779 - DNA, 25 bp, Homo sapien
attgagtgtcgccaaagcccttgac

SEQ ID NO: 192780 - DNA, 25 bp, Homo sapien
aaagcccttgactggcgagtcaaaa

SEQ ID NO: 192781 - DNA, 25 bp, Homo sapien
gatctatcttaagagtgaccaggaa

SEQ ID NO: 192782 - DNA, 25 bp, Homo sapien
atgaagcgccaaagatgcaccatgt

SEQ ID NO: 192783 - DNA, 25 bp, Homo sapien
gatgcaccatgtagaattttcactt

SEQ ID NO: 192784 - DNA, 25 bp, Homo sapien
attttcactttgtactggcaggctc

SEQ ID NO: 192785 - DNA, 25 bp, Homo sapien
tttgtactggcaggctcgttttacc

SEQ ID NO: 192786 - DNA, 25 bp, Homo sapien
gtaggtgaagatacgcctttcctgg

SEQ ID NO: 192787 - DNA, 25 bp, Homo sapien
atacgcctttcctgggcatacagaa

SEQ ID NO: 192788 - DNA, 25 bp, Homo sapien
gcagccagtcttgaggcaacacctg

SEQ ID NO: 192789 - DNA, 25 bp, Homo sapien
tgacagcaggactaacccagcaggc

SEQ ID NO: 192790 - DNA, 25 bp, Homo sapien
aggccgcttctcgacacaggaagaa

SEQ ID NO: 192791 - DNA, 25 bp, Homo sapien
cacaggaagaaatccaggccaggct

SEQ ID NO: 192792 - DNA, 25 bp, Homo sapien
caggccaggctgtctagtgtaattg

SEQ ID NO: 192793 - DNA, 25 bp, Homo sapien
ggctgtctagtgtaattgctaacca

SEQ ID NO: 192794 - DNA, 25 bp, Homo sapien
ttgctaaccaagaccctattgctgt

SEQ ID NO: 192795 - DNA, 25 bp, Homo sapien
gaccctattgctgtataaaacctaa

SEQ ID NO: 192796 - DNA, 25 bp, Homo sapien
tagattcacctgtaaaactttattt

SEQ ID NO: 192797 - DNA, 25 bp, Homo sapien
atgtctttcaaactagcttcagata

SEQ ID NO: 192798 - DNA, 25 bp, Homo sapien
taatactatgtaactgggtccccta

SEQ ID NO: 192799 - DNA, 25 bp, Homo sapien
tgggtcccctatggctcaatcaata

SEQ ID NO: 192800 - DNA, 25 bp, Homo sapien
gtcccctatggctcaatcaatattg

SEQ ID NO: 192801 - DNA, 25 bp, Homo sapien
atggctcaatcaatattgcttattt

SEQ ID NO: 192802 - DNA, 25 bp, Homo sapien
gtgaaatttcctttagttggataag

SEQ ID NO: 192803 - DNA, 25 bp, Homo sapien
aatgatatttcatactgtgcaatga

SEQ ID NO: 192804 - DNA, 25 bp, Homo sapien
ttttttcttcctgtcaccgcagtgt

SEQ ID NO: 192805 - DNA, 25 bp, Homo sapien
ttcctgtcaccgcagtgtgtggtat

SEQ ID NO: 192806 - DNA, 25 bp, Homo sapien
accgcagtgtgtggtattgcataat

SEQ ID NO: 192807 - DNA, 25 bp, Homo sapien
attgcataatgtgaatacctgtaaa

SEQ ID NO: 192808 - DNA, 25 bp, Homo sapien
gtagctctgatcttaatctttgaca

SEQ ID NO: 192809 - DNA, 25 bp, Homo sapien
gtggagtggacctaaactacagtta

SEQ ID NO: 192810 - DNA, 25 bp, Homo sapien
actacagttatgcttggattttggg

SEQ ID NO: 192811 - DNA, 25 bp, Homo sapien
actgtgtccctcctggaagcataca

SEQ ID NO: 192812 - DNA, 25 bp, Homo sapien
ggaagcatacactacacagatagac

SEQ ID NO: 192813 - DNA, 25 bp, Homo sapien
acagatagacaatctccttctgcct

SEQ ID NO: 192814 - DNA, 25 bp, Homo sapien
tctctacctcctgatattgctgatg

SEQ ID NO: 192815 - DNA, 25 bp, Homo sapien
tgatggcctagctgttacagtgcag

SEQ ID NO: 192816 - DNA, 25 bp, Homo sapien
gtgaacagtccccacagcagacagc

SEQ ID NO: 192817 - DNA, 25 bp, Homo sapien
cagcagacagctacttgggcatgaa

SEQ ID NO: 192818 - DNA, 25 bp, Homo sapien
gagccaaggtgtgaaaagcagattt

SEQ ID NO: 192819 - DNA, 25 bp, Homo sapien
acattgggagttagagtcctgctcc

SEQ ID NO: 192820 - DNA, 25 bp, Homo sapien
cccttgctgtgtgggctcaatccag

SEQ ID NO: 192821 - DNA, 25 bp, Homo sapien
gtgggctcaatccaggccctgttaa

SEQ ID NO: 192822 - DNA, 25 bp, Homo sapien
aggccctgttaacatgtttccagca

SEQ ID NO: 192823 - DNA, 25 bp, Homo sapien
gttaacatgtttccagcactatccc

SEQ ID NO: 192824 - DNA, 25 bp, Homo sapien
gaatattaatcggtatccaggaggc

SEQ ID NO: 192825 - DNA, 25 bp, Homo sapien
ggaatattcatctatacccaggtat

SEQ ID NO: 192826 - DNA, 25 bp, Homo sapien
caggtatcaataacccatttcctcc

SEQ ID NO: 192827 - DNA, 25 bp, Homo sapien
tggctcttcttggaacatcccagct

SEQ ID NO: 192828 - DNA, 25 bp, Homo sapien
gaacatcccagctggcttccctaat

SEQ ID NO: 192829 - DNA, 25 bp, Homo sapien
tagagcacgatagagggaaacccaa

SEQ ID NO: 192830 - DNA, 25 bp, Homo sapien
agcacactgttatgtcctaactgaa

SEQ ID NO: 192831 - DNA, 25 bp, Homo sapien
gttatgtcctaactgaatgtattca

SEQ ID NO: 192832 - DNA, 25 bp, Homo sapien
gatatactcttccatttgttgtgtc

SEQ ID NO: 192833 - DNA, 25 bp, Homo sapien
gaaaattccaaatactcatgtctca

SEQ ID NO: 192834 - DNA, 25 bp, Homo sapien
atactcatgtctcaagtaagcttaa

SEQ ID NO: 192835 - DNA, 25 bp, Homo sapien
gtaagcttaaactacaacttgtcac

SEQ ID NO: 192836 - DNA, 25 bp, Homo sapien
aaggaagtcttaagtggagttcaca

SEQ ID NO: 192837 - DNA, 25 bp, Homo sapien
gtatctatttgtcatttgtgttata

SEQ ID NO: 192838 - DNA, 25 bp, Homo sapien
tttaattgtattgctgccagtgcta

SEQ ID NO: 192839 - DNA, 25 bp, Homo sapien
tgtattgctgccagtgctatttttt

SEQ ID NO: 192840 - DNA, 25 bp, Homo sapien
aaaaattttattcttagcacactgt

SEQ ID NO: 192841 - DNA, 25 bp, Homo sapien
aaaataagactgctaaaagtatttg

SEQ ID NO: 192842 - DNA, 25 bp, Homo sapien
aaataagactgctaaaagtatttgg

SEQ ID NO: 192843 - DNA, 25 bp, Homo sapien
aataagactgctaaaagtatttggt

SEQ ID NO: 192844 - DNA, 25 bp, Homo sapien
ataagactgctaaaagtatttggta

SEQ ID NO: 192845 - DNA, 25 bp, Homo sapien
taagactgctaaaagtatttggtat

SEQ ID NO: 192846 - DNA, 25 bp, Homo sapien
aagactgctaaaagtatttggtata

SEQ ID NO: 192847 - DNA, 25 bp, Homo sapien
agactgctaaaagtatttggtatac

SEQ ID NO: 192848 - DNA, 25 bp, Homo sapien
gactgctaaaagtatttggtataca

SEQ ID NO: 192849 - DNA, 25 bp, Homo sapien
gtatttggtatacagtctggaaaat

SEQ ID NO: 192850 - DNA, 25 bp, Homo sapien
tatttggtatacagtctggaaaata

SEQ ID NO: 192851 - DNA, 25 bp, Homo sapien
atttggtatacagtctggaaaataa

SEQ ID NO: 192852 - DNA, 25 bp, Homo sapien
ataaaccacaccttgcagatagaaa

SEQ ID NO: 192853 - DNA, 25 bp, Homo sapien
tcttgtttcaatactgccactgggt

SEQ ID NO: 192854 - DNA, 25 bp, Homo sapien
tactgccactgggtataaggaaaaa

SEQ ID NO: 192855 - DNA, 25 bp, Homo sapien
aaaagcatcctccaagaattaaatg

SEQ ID NO: 192856 - DNA, 25 bp, Homo sapien
gataagctaggattcagtccggttc

SEQ ID NO: 192857 - DNA, 25 bp, Homo sapien
gattcagtccggttcagaggcctga

SEQ ID NO: 192858 - DNA, 25 bp, Homo sapien
gaggcctgaattcatgctacctatg

SEQ ID NO: 192859 - DNA, 25 bp, Homo sapien
ctatgtggtctaaaaaggctcaagc

SEQ ID NO: 192860 - DNA, 25 bp, Homo sapien
aaatggcactcccaagtgactagta

SEQ ID NO: 192861 - DNA, 25 bp, Homo sapien
aagaattcaaattctgtcagcccaa

SEQ ID NO: 192862 - DNA, 25 bp, Homo sapien
ttctgtcagcccaacagcaaattta

SEQ ID NO: 192863 - DNA, 25 bp, Homo sapien
ctttggtgaacagagccgagcttgg

SEQ ID NO: 192864 - DNA, 25 bp, Homo sapien
gagccgagcttggtttcaacatcta

SEQ ID NO: 192865 - DNA, 25 bp, Homo sapien
atctaattcaatttgttctgccgag

SEQ ID NO: 192866 - DNA, 25 bp, Homo sapien
tgttctgccgagattgaaatatgaa

SEQ ID NO: 192867 - DNA, 25 bp, Homo sapien
aatggttgccagtcaaacgttcaaa

SEQ ID NO: 192868 - DNA, 25 bp, Homo sapien
gagagtgagcgcatgctgaaattta

SEQ ID NO: 192869 - DNA, 25 bp, Homo sapien
taatgaaaatgactttaaccctttg

SEQ ID NO: 192870 - DNA, 25 bp, Homo sapien
accctttggtacaccttgcaaaatg

SEQ ID NO: 192871 - DNA, 25 bp, Homo sapien
catcctgtgaaagcggcctctcggg

SEQ ID NO: 192872 - DNA, 25 bp, Homo sapien
gcggcctctcgggttagagcttttc

SEQ ID NO: 192873 - DNA, 25 bp, Homo sapien
tctcttccactgagcttcactaata

SEQ ID NO: 192874 - DNA, 25 bp, Homo sapien
ggagtgctttctcaatcattaatag

SEQ ID NO: 192875 - DNA, 25 bp, Homo sapien
aatagagttgtttctgggagggact

SEQ ID NO: 192876 - DNA, 25 bp, Homo sapien
gttgtttctgggagggactttcata

SEQ ID NO: 192877 - DNA, 25 bp, Homo sapien
tctgggagggactttcatatctggt

SEQ ID NO: 192878 - DNA, 25 bp, Homo sapien
ttcatatctggtcaatgtcataata

SEQ ID NO: 192879 - DNA, 25 bp, Homo sapien
gaaatgcaaagctttatgtattaac

SEQ ID NO: 192880 - DNA, 25 bp, Homo sapien
gctttatgtattaacttgctgatgt

SEQ ID NO: 192881 - DNA, 25 bp, Homo sapien
gtattaacttgctgatgtggtttac

SEQ ID NO: 192882 - DNA, 25 bp, Homo sapien
gtggtttacaatagtgtgacaacga

SEQ ID NO: 192883 - DNA, 25 bp, Homo sapien
gtgacaacgatgaaaatgcttggtt

SEQ ID NO: 192884 - DNA, 25 bp, Homo sapien
cgatgaaaatgcttggttatgtaaa

SEQ ID NO: 192885 - DNA, 25 bp, Homo sapien
gaagatttaaactttgcactccaaa

SEQ ID NO: 192886 - DNA, 25 bp, Homo sapien
actttgcactccaaaagcttatttg

SEQ ID NO: 192887 - DNA, 25 bp, Homo sapien
tttcttgcactgttttgtgtaatgc

SEQ ID NO: 192888 - DNA, 25 bp, Homo sapien
acagctttgtagattctaacattta

SEQ ID NO: 192889 - DNA, 25 bp, Homo sapien
tcaaatgcagttgtattagttctca

SEQ ID NO: 192890 - DNA, 25 bp, Homo sapien
gcagttgtattagttctcattattg

SEQ ID NO: 192891 - DNA, 25 bp, Homo sapien
ctcattattgaactgtctgtgcact

SEQ ID NO: 192892 - DNA, 25 bp, Homo sapien
gaactgtctgtgcactgtatgtagc

SEQ ID NO: 192893 - DNA, 25 bp, Homo sapien
gtctgtgcactgtatgtagcaagca

SEQ ID NO: 192894 - DNA, 25 bp, Homo sapien
gtagcaagcatttttcatctgttgt

SEQ ID NO: 192895 - DNA, 25 bp, Homo sapien
ttttcatctgttgtatacaagtgga

SEQ ID NO: 192896 - DNA, 25 bp, Homo sapien
gacagccacagcacgcgggccagca

SEQ ID NO: 192897 - DNA, 25 bp, Homo sapien
agcagcagacacagccgcgggccgc

SEQ ID NO: 192898 - DNA, 25 bp, Homo sapien
gcccgccccactatctttaaggaga

SEQ ID NO: 192899 - DNA, 25 bp, Homo sapien
gccccactatctttaaggagaccag

SEQ ID NO: 192900 - DNA, 25 bp, Homo sapien
tatctttaaggagaccagagaccgc

SEQ ID NO: 192901 - DNA, 25 bp, Homo sapien
aggagaccagagaccgcctactgga

SEQ ID NO: 192902 - DNA, 25 bp, Homo sapien
ccagagaccgcctactggagagaaa

SEQ ID NO: 192903 - DNA, 25 bp, Homo sapien
aattgtcttataatactagctaacg

SEQ ID NO: 192904 - DNA, 25 bp, Homo sapien
gtcttataatactagctaacggcaa

SEQ ID NO: 192905 - DNA, 25 bp, Homo sapien
taatactagctaacggcaaaggcgt

SEQ ID NO: 192906 - DNA, 25 bp, Homo sapien
gctaacggcaaaggcgtttttatag

SEQ ID NO: 192907 - DNA, 25 bp, Homo sapien
ggacacctggtctacagccattgat

SEQ ID NO: 192908 - DNA, 25 bp, Homo sapien
ggtctacagccattgatctggcgaa

SEQ ID NO: 192909 - DNA, 25 bp, Homo sapien
gatctggcgaaagctttaattttta

SEQ ID NO: 192910 - DNA, 25 bp, Homo sapien
tagagcagtttcatgtttacagaga

SEQ ID NO: 192911 - DNA, 25 bp, Homo sapien
agagtcctcatatagcatctctccc

SEQ ID NO: 192912 - DNA, 25 bp, Homo sapien
ctacacacagtttcccttattattc

SEQ ID NO: 192913 - DNA, 25 bp, Homo sapien
gaattactgtgatacatctttgcaa

SEQ ID NO: 192914 - DNA, 25 bp, Homo sapien
gaaccaatattgacctagtcattga

SEQ ID NO: 192915 - DNA, 25 bp, Homo sapien
gatcaggttacatgagggttcactc

SEQ ID NO: 192916 - DNA, 25 bp, Homo sapien
ggttcactcttcttgttgtacatgc

SEQ ID NO: 192917 - DNA, 25 bp, Homo sapien
gtacatgctgtgagttcgggcaaat

SEQ ID NO: 192918 - DNA, 25 bp, Homo sapien
tcaaaattcaccttcgtcatgctgc

SEQ ID NO: 192919 - DNA, 25 bp, Homo sapien
accttcgtcatgctgcgtccagtgc

SEQ ID NO: 192920 - DNA, 25 bp, Homo sapien
actctccccattttgtaacactgta

SEQ ID NO: 192921 - DNA, 25 bp, Homo sapien
gtaacactgtaccaggtggtgactg

SEQ ID NO: 192922 - DNA, 25 bp, Homo sapien
gtggtgactgtttaactctttggtg

SEQ ID NO: 192923 - DNA, 25 bp, Homo sapien
tttggtgtctgtgctcaaaagactg

SEQ ID NO: 192924 - DNA, 25 bp, Homo sapien
tgtgctcaaaagactgccttctcca

SEQ ID NO: 192925 - DNA, 25 bp, Homo sapien
tcaaaagactgccttctccagtgcc

SEQ ID NO: 192926 - DNA, 25 bp, Homo sapien
tccagtgcccagtgtatgagtgtgt

SEQ ID NO: 192927 - DNA, 25 bp, Homo sapien
acatgctggacgtagccctcttcct

SEQ ID NO: 192928 - DNA, 25 bp, Homo sapien
tgggagggacccatccatctccctt

SEQ ID NO: 192929 - DNA, 25 bp, Homo sapien
agcccttgtatgtataccaacactg

SEQ ID NO: 192930 - DNA, 25 bp, Homo sapien
gcccttgtatgtataccaacactgc

SEQ ID NO: 192931 - DNA, 25 bp, Homo sapien
cttgtatgtataccaacactgccaa

SEQ ID NO: 192932 - DNA, 25 bp, Homo sapien
ttgtatgtataccaacactgccaaa

SEQ ID NO: 192933 - DNA, 25 bp, Homo sapien
tgtatgtataccaacactgccaaag

SEQ ID NO: 192934 - DNA, 25 bp, Homo sapien
gtatgtataccaacactgccaaagt

SEQ ID NO: 192935 - DNA, 25 bp, Homo sapien
tatgtataccaacactgccaaagta

SEQ ID NO: 192936 - DNA, 25 bp, Homo sapien
atgtataccaacactgccaaagtaa

SEQ ID NO: 192937 - DNA, 25 bp, Homo sapien
gtataccaacactgccaaagtaaaa

SEQ ID NO: 192938 - DNA, 25 bp, Homo sapien
caaagtaaaacattaggtcaggcat

SEQ ID NO: 192939 - DNA, 25 bp, Homo sapien
agtaaaacattaggtcaggcatggt

SEQ ID NO: 192940 - DNA, 25 bp, Homo sapien
ttcccctattggagtccccagtgtc

SEQ ID NO: 192941 - DNA, 25 bp, Homo sapien
ccagtgtctgttatctccatcttta

SEQ ID NO: 192942 - DNA, 25 bp, Homo sapien
agtgtctgttatctccatctttatg

SEQ ID NO: 192943 - DNA, 25 bp, Homo sapien
atttagttcacataggataatggcc

SEQ ID NO: 192944 - DNA, 25 bp, Homo sapien
tatagttgcataatactccatttat

SEQ ID NO: 192945 - DNA, 25 bp, Homo sapien
aatactccatttatatatctctctc

SEQ ID NO: 192946 - DNA, 25 bp, Homo sapien
ctctatatatatctcacgttttctt

SEQ ID NO: 192947 - DNA, 25 bp, Homo sapien
atatatatctcacgttttctttatc

SEQ ID NO: 192948 - DNA, 25 bp, Homo sapien
ttctttatccagtcaattgttggta

SEQ ID NO: 192949 - DNA, 25 bp, Homo sapien
tccagtcaattgttggtagatactt

SEQ ID NO: 192950 - DNA, 25 bp, Homo sapien
tgttggtagatacttaggttggttc

SEQ ID NO: 192951 - DNA, 25 bp, Homo sapien
ctgctgtcatcatagaggtagaaag

SEQ ID NO: 192952 - DNA, 25 bp, Homo sapien
gtcatcatagaggtagaaagcaaac

SEQ ID NO: 192953 - DNA, 25 bp, Homo sapien
aggctgggcattgccactagaacct

SEQ ID NO: 192954 - DNA, 25 bp, Homo sapien
tgggcattgccactagaacctgagc

SEQ ID NO: 192955 - DNA, 25 bp, Homo sapien
ggcattgccactagaacctgagctc

SEQ ID NO: 192956 - DNA, 25 bp, Homo sapien
ctcctagagagcaaggacctgggtg

SEQ ID NO: 192957 - DNA, 25 bp, Homo sapien
aaggacctgggtggcctcgcttact

SEQ ID NO: 192958 - DNA, 25 bp, Homo sapien
tgggtggcctcgcttactgttccag

SEQ ID NO: 192959 - DNA, 25 bp, Homo sapien
acagggcctggctcgtggcaaacct

SEQ ID NO: 192960 - DNA, 25 bp, Homo sapien
cctggctcgtggcaaaccttgaata

SEQ ID NO: 192961 - DNA, 25 bp, Homo sapien
tggctcgtggcaaaccttgaataaa

SEQ ID NO: 192962 - DNA, 25 bp, Homo sapien
atattttcctttgccctcatgagcg

SEQ ID NO: 192963 - DNA, 25 bp, Homo sapien
gccctcatgagcgtgtttataatag

SEQ ID NO: 192964 - DNA, 25 bp, Homo sapien
agcgtgtttataatagctgccttca

SEQ ID NO: 192965 - DNA, 25 bp, Homo sapien
caaattcttgtctgccgtttacatc

SEQ ID NO: 192966 - DNA, 25 bp, Homo sapien
ttgtctgccgtttacatcttggaca

SEQ ID NO: 192967 - DNA, 25 bp, Homo sapien
catcttggagatggctactgcctgc

SEQ ID NO: 192968 - DNA, 25 bp, Homo sapien
gagatggctactgcctgctttttat

SEQ ID NO: 192969 - DNA, 25 bp, Homo sapien
tattacattttcacgtgtcttcacg

SEQ ID NO: 192970 - DNA, 25 bp, Homo sapien
gtgtcttcacgcatctcttgaattg

SEQ ID NO: 192971 - DNA, 25 bp, Homo sapien
atctcttgaattggaaattgtgccc

SEQ ID NO: 192972 - DNA, 25 bp, Homo sapien
ggaaattgtgccctggagactgtat

SEQ ID NO: 192973 - DNA, 25 bp, Homo sapien
ggtaagtaaatatagccacctgtta

SEQ ID NO: 192974 - DNA, 25 bp, Homo sapien
tatagccacctgttaacatgtaaat

SEQ ID NO: 192975 - DNA, 25 bp, Homo sapien
attgaaacttagttcatgtctgctg

SEQ ID NO: 192976 - DNA, 25 bp, Homo sapien
tgctgctgggcatttcacttaaaga

SEQ ID NO: 192977 - DNA, 25 bp, Homo sapien
gaacttaatgtcaacagctacaaca

SEQ ID NO: 192978 - DNA, 25 bp, Homo sapien
aagaccaaatctgaactgctaatgt

SEQ ID NO: 192979 - DNA, 25 bp, Homo sapien
gaactgctaatgtggctgctttgta

SEQ ID NO: 192980 - DNA, 25 bp, Homo sapien
ggctgctttgtagggaatggactaa

SEQ ID NO: 192981 - DNA, 25 bp, Homo sapien
cagtgtgttagatcttaaggtatca

SEQ ID NO: 192982 - DNA, 25 bp, Homo sapien
cagtatttcagaatcctgcgacgat

SEQ ID NO: 192983 - DNA, 25 bp, Homo sapien
atcctgcgacgattttatttctaaa

SEQ ID NO: 192984 - DNA, 25 bp, Homo sapien
gggcgactcctgatgaagcacaact

SEQ ID NO: 192985 - DNA, 25 bp, Homo sapien
tgatgaagcacaactccccgcaggg

SEQ ID NO: 192986 - DNA, 25 bp, Homo sapien
ggtggccatatttgggcagttccca

SEQ ID NO: 192987 - DNA, 25 bp, Homo sapien
atatttgggcagttcccagtcctgt

SEQ ID NO: 192988 - DNA, 25 bp, Homo sapien
tgggcagttcccagtcctgtgggct

SEQ ID NO: 192989 - DNA, 25 bp, Homo sapien
ttcccagtcctgtgggctcggctat

SEQ ID NO: 192990 - DNA, 25 bp, Homo sapien
agtcctgtgggctcggctatctggg

SEQ ID NO: 192991 - DNA, 25 bp, Homo sapien
agcagattttgggtctggatctccc

SEQ ID NO: 192992 - DNA, 25 bp, Homo sapien
tgggtcctgggcttggatctttccc

SEQ ID NO: 192993 - DNA, 25 bp, Homo sapien
cctgggcttggatctttccctaggg

SEQ ID NO: 192994 - DNA, 25 bp, Homo sapien
tccttccccattgctgtaaatattt

SEQ ID NO: 192995 - DNA, 25 bp, Homo sapien
taaaaccaacttgtgccaaccagat

SEQ ID NO: 192996 - DNA, 25 bp, Homo sapien
ttgtgccaaccagatttacagattg

SEQ ID NO: 192997 - DNA, 25 bp, Homo sapien
tgtgaagttatcagttggaggagct

SEQ ID NO: 192998 - DNA, 25 bp, Homo sapien
gataataagagaacgtgccatctgt

SEQ ID NO: 192999 - DNA, 25 bp, Homo sapien
gaacgtgccatctgtaaagcactca

SEQ ID NO: 193000 - DNA, 25 bp, Homo sapien
aaagcactcagaaggcagccatccc

SEQ ID NO: 193001 - DNA, 25 bp, Homo sapien
agaaggcagccatccctagatgttg

SEQ ID NO: 193002 - DNA, 25 bp, Homo sapien
catccctagatgttggtttcatgta

SEQ ID NO: 193003 - DNA, 25 bp, Homo sapien
tattacactatctactactatccat

SEQ ID NO: 193004 - DNA, 25 bp, Homo sapien
atctactactatccataaatgcaat

SEQ ID NO: 193005 - DNA, 25 bp, Homo sapien
acagcaaacagcaatctaagtacag

SEQ ID NO: 193006 - DNA, 25 bp, Homo sapien
gtgaccaccatcattgttttcccca

SEQ ID NO: 193007 - DNA, 25 bp, Homo sapien
tgcacaacacatatacaatactagt

SEQ ID NO: 193008 - DNA, 25 bp, Homo sapien
tactagtgatgtctaccagtcctgc

SEQ ID NO: 193009 - DNA, 25 bp, Homo sapien
atgtctaccagtcctgctacttctg

SEQ ID NO: 193010 - DNA, 25 bp, Homo sapien
gttggtgaataaatcagtctactgg

SEQ ID NO: 193011 - DNA, 25 bp, Homo sapien
tctactggaactccaaggactggat

SEQ ID NO: 193012 - DNA, 25 bp, Homo sapien
ttttttcctatagatgtctcagatg

SEQ ID NO: 193013 - DNA, 25 bp, Homo sapien
gtctcagatgttcagttttcctgtc

SEQ ID NO: 193014 - DNA, 25 bp, Homo sapien
gttcagttttcctgtcacaaggctt

SEQ ID NO: 193015 - DNA, 25 bp, Homo sapien
gtcacaaggcttccagtctgtatta

SEQ ID NO: 193016 - DNA, 25 bp, Homo sapien
aggcttccagtctgtattagttcat

SEQ ID NO: 193017 - DNA, 25 bp, Homo sapien
ttctagtaaattctcccataaacat

SEQ ID NO: 193018 - DNA, 25 bp, Homo sapien
aacattatgtaagtcatttgccaaa

SEQ ID NO: 193019 - DNA, 25 bp, Homo sapien
tgccaaattacctaactactcctac

SEQ ID NO: 193020 - DNA, 25 bp, Homo sapien
tcctgttccctctctaaaacgtgaa

SEQ ID NO: 193021 - DNA, 25 bp, Homo sapien
gactgttggcagtgttagtatgctg

SEQ ID NO: 193022 - DNA, 25 bp, Homo sapien
agtatgctgaatgcttgtggttagt

SEQ ID NO: 193023 - DNA, 25 bp, Homo sapien
gttagtggtcttgtatacttctctc

SEQ ID NO: 193024 - DNA, 25 bp, Homo sapien
tacttctctcaccattcgagttgta

SEQ ID NO: 193025 - DNA, 25 bp, Homo sapien
ttcgagttgtatgcccttcaagagt

SEQ ID NO: 193026 - DNA, 25 bp, Homo sapien
tcaagagttagttgtgttcccaaac

SEQ ID NO: 193027 - DNA, 25 bp, Homo sapien
gtgttcccaaacttgttcatgtcag

SEQ ID NO: 193028 - DNA, 25 bp, Homo sapien
gccatggtgctagctgcaagtccat

SEQ ID NO: 193029 - DNA, 25 bp, Homo sapien
gtgctagctgcaagtccatcagtat

SEQ ID NO: 193030 - DNA, 25 bp, Homo sapien
catcagtattgaccgtctcgctcca

SEQ ID NO: 193031 - DNA, 25 bp, Homo sapien
tattgaccgtctcgctccatcttgg

SEQ ID NO: 193032 - DNA, 25 bp, Homo sapien
catcttggtcctccggagtcccaag

SEQ ID NO: 193033 - DNA, 25 bp, Homo sapien
gtcccaagtttccttttcatcaaat

SEQ ID NO: 193034 - DNA, 25 bp, Homo sapien
gcctggtggtgatggacctccccgc

SEQ ID NO: 193035 - DNA, 25 bp, Homo sapien
gctccctcaagctctggatggctgc

SEQ ID NO: 193036 - DNA, 25 bp, Homo sapien
ctctggatggctgcagtgttgtact

SEQ ID NO: 193037 - DNA, 25 bp, Homo sapien
gtactagactttgttcaggctgttc

SEQ ID NO: 193038 - DNA, 25 bp, Homo sapien
agactttgttcaggctgttctcatc

SEQ ID NO: 193039 - DNA, 25 bp, Homo sapien
gagctgtttgcatcagtcctgccaa

SEQ ID NO: 193040 - DNA, 25 bp, Homo sapien
tttgcatcagtcctgccaatggctc

SEQ ID NO: 193041 - DNA, 25 bp, Homo sapien
tccggaagaagctgccaggctccag

SEQ ID NO: 193042 - DNA, 25 bp, Homo sapien
ggaatccacctatccgcctctagga

SEQ ID NO: 193043 - DNA, 25 bp, Homo sapien
taggaccttggctccaactctattg

SEQ ID NO: 193044 - DNA, 25 bp, Homo sapien
ggctccaactctattgtactcgtct

SEQ ID NO: 193045 - DNA, 25 bp, Homo sapien
tttggtctcagctccttgatctaag

SEQ ID NO: 193046 - DNA, 25 bp, Homo sapien
agacccctagaatgtttccctcaag

SEQ ID NO: 193047 - DNA, 25 bp, Homo sapien
aatgtttccctcaaggacctttctg

SEQ ID NO: 193048 - DNA, 25 bp, Homo sapien
tgcctggaagtctgttagcctttca

SEQ ID NO: 193049 - DNA, 25 bp, Homo sapien
gcctttcagaagtaacatgtccaaa

SEQ ID NO: 193050 - DNA, 25 bp, Homo sapien
tggcatgtgcctgcacgtgcagtgc

SEQ ID NO: 193051 - DNA, 25 bp, Homo sapien
gcacgtgcagtgcagctacccgaga

SEQ ID NO: 193052 - DNA, 25 bp, Homo sapien
tgcagtgcagctacccgagactggg

SEQ ID NO: 193053 - DNA, 25 bp, Homo sapien
ttaaaagaacctaatgtgcacacta

SEQ ID NO: 193054 - DNA, 25 bp, Homo sapien
atgtgcacactaggcactgttctca

SEQ ID NO: 193055 - DNA, 25 bp, Homo sapien
cacactaggcactgttctcaatcag

SEQ ID NO: 193056 - DNA, 25 bp, Homo sapien
tgttctcaatcagtgctggtgatgt

SEQ ID NO: 193057 - DNA, 25 bp, Homo sapien
caatcagtgctggtgatgtggcagt

SEQ ID NO: 193058 - DNA, 25 bp, Homo sapien
tgatgtggcagtgaatgacacaaac

SEQ ID NO: 193059 - DNA, 25 bp, Homo sapien
aactccctgatcctgaaaagctttt

SEQ ID NO: 193060 - DNA, 25 bp, Homo sapien
ttttattttacccagtgtggagttg

SEQ ID NO: 193061 - DNA, 25 bp, Homo sapien
ggtatctttagagaaggtacaaaag

SEQ ID NO: 193062 - DNA, 25 bp, Homo sapien
gtatctttagagaaggtacaaaagg

SEQ ID NO: 193063 - DNA, 25 bp, Homo sapien
tatctttagagaaggtacaaaagga

SEQ ID NO: 193064 - DNA, 25 bp, Homo sapien
ttagagaaggtacaaaaggaggccg

SEQ ID NO: 193065 - DNA, 25 bp, Homo sapien
tagagaaggtacaaaaggaggccgg

SEQ ID NO: 193066 - DNA, 25 bp, Homo sapien
catggtggcaggcctctgtattccc

SEQ ID NO: 193067 - DNA, 25 bp, Homo sapien
caggcctctgtattcccagctattt

SEQ ID NO: 193068 - DNA, 25 bp, Homo sapien
aggcctctgtattcccagctatttg

SEQ ID NO: 193069 - DNA, 25 bp, Homo sapien
ggcctctgtattcccagctatttgg

SEQ ID NO: 193070 - DNA, 25 bp, Homo sapien
attcgggaggcagagctgagatcac

SEQ ID NO: 193071 - DNA, 25 bp, Homo sapien
ttcgggaggcagagctgagatcaca

SEQ ID NO: 193072 - DNA, 25 bp, Homo sapien
gaaaagacctttacaacagcaacaa

SEQ ID NO: 193073 - DNA, 25 bp, Homo sapien
caaaaaataccatggcaaaacctat

SEQ ID NO: 193074 - DNA, 25 bp, Homo sapien
aataccatggcaaaacctatatgaa

SEQ ID NO: 193075 - DNA, 25 bp, Homo sapien
attcttatatacaaagtctcagcat

SEQ ID NO: 193076 - DNA, 25 bp, Homo sapien
aagtctcagcattattattagttct

SEQ ID NO: 193077 - DNA, 25 bp, Homo sapien
tcagcattattattagttcttccta

SEQ ID NO: 193078 - DNA, 25 bp, Homo sapien
acagattttcccctggagctataca

SEQ ID NO: 193079 - DNA, 25 bp, Homo sapien
gattttcccctggagctatacaagt

SEQ ID NO: 193080 - DNA, 25 bp, Homo sapien
ttttcccctggagctatacaagtta

SEQ ID NO: 193081 - DNA, 25 bp, Homo sapien
ttcccctggagctatacaagttaca

SEQ ID NO: 193082 - DNA, 25 bp, Homo sapien
ccctggagctatacaagttacaaat

SEQ ID NO: 193083 - DNA, 25 bp, Homo sapien
gcctggtggtttaacagccgaagac

SEQ ID NO: 193084 - DNA, 25 bp, Homo sapien
agccgaagacacacgcctagggatg

SEQ ID NO: 193085 - DNA, 25 bp, Homo sapien
agacacacgcctagggatgagcacc

SEQ ID NO: 193086 - DNA, 25 bp, Homo sapien
ggatgagcaccctctttgtgacact

SEQ ID NO: 193087 - DNA, 25 bp, Homo sapien
tttgtgacacttcatcctgatgcca

SEQ ID NO: 193088 - DNA, 25 bp, Homo sapien
gacacttcatcctgatgccaagatt

SEQ ID NO: 193089 - DNA, 25 bp, Homo sapien
ggagaacatctgcactttcttatat

SEQ ID NO: 193090 - DNA, 25 bp, Homo sapien
aagcaactgggtatatatcactaac

SEQ ID NO: 193091 - DNA, 25 bp, Homo sapien
atatcactaacagctttgtaggaag

SEQ ID NO: 193092 - DNA, 25 bp, Homo sapien
acagctttgtaggaagcacttttaa

SEQ ID NO: 193093 - DNA, 25 bp, Homo sapien
tctctctcacacacaaagattcaaa

SEQ ID NO: 193094 - DNA, 25 bp, Homo sapien
agccgtggatggaaactcgcaaatg

SEQ ID NO: 193095 - DNA, 25 bp, Homo sapien
gatggaaactcgcaaatgtgatatt

SEQ ID NO: 193096 - DNA, 25 bp, Homo sapien
atgtgatattaaagactagcactat

SEQ ID NO: 193097 - DNA, 25 bp, Homo sapien
aaagactagcactataagactgagt

SEQ ID NO: 193098 - DNA, 25 bp, Homo sapien
gaaaggaggcttttagttaatatag

SEQ ID NO: 193099 - DNA, 25 bp, Homo sapien
gagtgtgatctcatgtattagttat

SEQ ID NO: 193100 - DNA, 25 bp, Homo sapien
gatctcatgtattagttattcggtt

SEQ ID NO: 193101 - DNA, 25 bp, Homo sapien
ggttgcaattctgaattatgggaga

SEQ ID NO: 193102 - DNA, 25 bp, Homo sapien
tatttgcaaagtggctcaggaggaa

SEQ ID NO: 193103 - DNA, 25 bp, Homo sapien
caggaggaaggagctgaaaccctaa

SEQ ID NO: 193104 - DNA, 25 bp, Homo sapien
gaaggagctgaaaccctaagaatgg

SEQ ID NO: 193105 - DNA, 25 bp, Homo sapien
ggcaaacgtttataagggctgttat

SEQ ID NO: 193106 - DNA, 25 bp, Homo sapien
tatgaaatgtgcctctgacccaaat

SEQ ID NO: 193107 - DNA, 25 bp, Homo sapien
tgacccaaatccacggactttgcga

SEQ ID NO: 193108 - DNA, 25 bp, Homo sapien
tccacggactttgcgaaaatcacca

SEQ ID NO: 193109 - DNA, 25 bp, Homo sapien
aaatcaccaaggagactttgcatta

SEQ ID NO: 193110 - DNA, 25 bp, Homo sapien
gtacaatacaaactgggcctagctc

SEQ ID NO: 193111 - DNA, 25 bp, Homo sapien
ctgggcctagctctgtatttagtca

SEQ ID NO: 193112 - DNA, 25 bp, Homo sapien
tagtcagtatgtgcacgtgggaaac

SEQ ID NO: 193113 - DNA, 25 bp, Homo sapien
aatatcacctccttattgagacaag

SEQ ID NO: 193114 - DNA, 25 bp, Homo sapien
tggacatctggccttaagcctctgt

SEQ ID NO: 193115 - DNA, 25 bp, Homo sapien
ggccttaagcctctgttgaacagga

SEQ ID NO: 193116 - DNA, 25 bp, Homo sapien
ttcattcagagggtgatgtgtacat

SEQ ID NO: 193117 - DNA, 25 bp, Homo sapien
aaatgcattggctttttgtgcagat

SEQ ID NO: 193118 - DNA, 25 bp, Homo sapien
ttgtgcagatacaacctgctctctg

SEQ ID NO: 193119 - DNA, 25 bp, Homo sapien
ctgctctctgtactgctgttggaca

SEQ ID NO: 193120 - DNA, 25 bp, Homo sapien
gctgttggacagtcagtgttttaat

SEQ ID NO: 193121 - DNA, 25 bp, Homo sapien
gtttctacagttttgctattgcacg

SEQ ID NO: 193122 - DNA, 25 bp, Homo sapien
attgcacgatttcatattttgcctc

SEQ ID NO: 193123 - DNA, 25 bp, Homo sapien
gcctctatgatgaacggcaaccatt

SEQ ID NO: 193124 - DNA, 25 bp, Homo sapien
tgaacggcaaccattatttgtaact

SEQ ID NO: 193125 - DNA, 25 bp, Homo sapien
aagaaatattccaagtgtcattagg

SEQ ID NO: 193126 - DNA, 25 bp, Homo sapien
gctgccagaactgatatgcatgaat

SEQ ID NO: 193127 - DNA, 25 bp, Homo sapien
gaaaagaggccctgccatacaccct

SEQ ID NO: 193128 - DNA, 25 bp, Homo sapien
aggaccctctcagacaagcgtggca

SEQ ID NO: 193129 - DNA, 25 bp, Homo sapien
tgaccttccatctggtgaaccaagt

SEQ ID NO: 193130 - DNA, 25 bp, Homo sapien
tggtgaaccaagtggcagccccagg

SEQ ID NO: 193131 - DNA, 25 bp, Homo sapien
tgccctgcaggtcacagctaaacaa

SEQ ID NO: 193132 - DNA, 25 bp, Homo sapien
agaagccacgcttgttccccatgta

SEQ ID NO: 193133 - DNA, 25 bp, Homo sapien
tgttccccatgtacctctagagaag

SEQ ID NO: 193134 - DNA, 25 bp, Homo sapien
ggccgtctaatttattactgcccag

SEQ ID NO: 193135 - DNA, 25 bp, Homo sapien
ccagcattccttccaacgggaagta

SEQ ID NO: 193136 - DNA, 25 bp, Homo sapien
gtagatgggcgactgctttgttcac

SEQ ID NO: 193137 - DNA, 25 bp, Homo sapien
ggcgactgctttgttcacacacatt

SEQ ID NO: 193138 - DNA, 25 bp, Homo sapien
gtcacagctgcttagtacaaccatc

SEQ ID NO: 193139 - DNA, 25 bp, Homo sapien
agtacaaccatctgggttgctcaag

SEQ ID NO: 193140 - DNA, 25 bp, Homo sapien
ggttgctcaagtagatgcccataat

SEQ ID NO: 193141 - DNA, 25 bp, Homo sapien
gagactattttctgataagactgac

SEQ ID NO: 193142 - DNA, 25 bp, Homo sapien
gactgactggaatcaagctgccgac

SEQ ID NO: 193143 - DNA, 25 bp, Homo sapien
acagctttctccatccagattgtga

SEQ ID NO: 193144 - DNA, 25 bp, Homo sapien
atccagattgtgacggttgctacct

SEQ ID NO: 193145 - DNA, 25 bp, Homo sapien
gttgctacctggatccatcatttta

SEQ ID NO: 193146 - DNA, 25 bp, Homo sapien
gatccatcattttactggtatggca

SEQ ID NO: 193147 - DNA, 25 bp, Homo sapien
ggcaaaaaatcacccatgtgacact

SEQ ID NO: 193148 - DNA, 25 bp, Homo sapien
atgtgacactgggtgacatggtaaa

SEQ ID NO: 193149 - DNA, 25 bp, Homo sapien
ggtgcccgcatgtccctgtctaggg

SEQ ID NO: 193150 - DNA, 25 bp, Homo sapien
catgtccctgtctagggcagcccag

SEQ ID NO: 193151 - DNA, 25 bp, Homo sapien
actctggggttctcaagtccatgaa

SEQ ID NO: 193152 - DNA, 25 bp, Homo sapien
aacagatattgttgcattttccaca

SEQ ID NO: 193153 - DNA, 25 bp, Homo sapien
agatattgttgcattttccacaatg

SEQ ID NO: 193154 - DNA, 25 bp, Homo sapien
attgttgcattttccacaatgactg

SEQ ID NO: 193155 - DNA, 25 bp, Homo sapien
aggaaggatcagagaagaggctact

SEQ ID NO: 193156 - DNA, 25 bp, Homo sapien
gggagaattcagtgcccccttcgcc

SEQ ID NO: 193157 - DNA, 25 bp, Homo sapien
cttcgccctctagggagcagacctc

SEQ ID NO: 193158 - DNA, 25 bp, Homo sapien
tctagggagcagacctccactgcca

SEQ ID NO: 193159 - DNA, 25 bp, Homo sapien
cattgtcctgtgagccgccaaagac

SEQ ID NO: 193160 - DNA, 25 bp, Homo sapien
agccgcacactgagaaagcaattgg

SEQ ID NO: 193161 - DNA, 25 bp, Homo sapien
gcaattggatcacaacctcaccttc

SEQ ID NO: 193162 - DNA, 25 bp, Homo sapien
caagctggtggcctatatgatctgc

SEQ ID NO: 193163 - DNA, 25 bp, Homo sapien
gtggcctatatgatctgcctacata

SEQ ID NO: 193164 - DNA, 25 bp, Homo sapien
gcctacatacagctattcacatcat

SEQ ID NO: 193165 - DNA, 25 bp, Homo sapien
attcacatcattgcacacctgttta

SEQ ID NO: 193166 - DNA, 25 bp, Homo sapien
ttgcacacctgtttaactttgactg

SEQ ID NO: 193167 - DNA, 25 bp, Homo sapien
tgtttaactttgactgctatagcag

SEQ ID NO: 193168 - DNA, 25 bp, Homo sapien
tgctatagcagaagccgacaggcca

SEQ ID NO: 193169 - DNA, 25 bp, Homo sapien
ctctccagcctatctcatgatgaga

SEQ ID NO: 193170 - DNA, 25 bp, Homo sapien
ggggttcttggctaaatcccatcca

SEQ ID NO: 193171 - DNA, 25 bp, Homo sapien
gttttggagccctaataaatttcag

SEQ ID NO: 193172 - DNA, 25 bp, Homo sapien
atctcaaaatgccaacgcctgtatt

SEQ ID NO: 193173 - DNA, 25 bp, Homo sapien
gccaacgcctgtattaaggttcaaa

SEQ ID NO: 193174 - DNA, 25 bp, Homo sapien
gatagggtggtcatcctttccgatc

SEQ ID NO: 193175 - DNA, 25 bp, Homo sapien
catcctttccgatcatctgctaaaa

SEQ ID NO: 193176 - DNA, 25 bp, Homo sapien
taaggtcattcgtacctgctgttgt

SEQ ID NO: 193177 - DNA, 25 bp, Homo sapien
gtacctgctgttgtctatctattaa

SEQ ID NO: 193178 - DNA, 25 bp, Homo sapien
ataggtttcccataatcctaaggat

SEQ ID NO: 193179 - DNA, 25 bp, Homo sapien
aaggatacttgacttagaactcagt

SEQ ID NO: 193180 - DNA, 25 bp, Homo sapien
gaactcagtcattctgatctgcttt

SEQ ID NO: 193181 - DNA, 25 bp, Homo sapien
attctgatctgctttggccatggct

SEQ ID NO: 193182 - DNA, 25 bp, Homo sapien
acgcccggaagtgcaacgagacagc

SEQ ID NO: 193183 - DNA, 25 bp, Homo sapien
acgagacagccaagtcctattgcgt

SEQ ID NO: 193184 - DNA, 25 bp, Homo sapien
acagccaagtcctattgcgtcaatg

SEQ ID NO: 193185 - DNA, 25 bp, Homo sapien
attgcgtcaatggaggcgtctgcta

SEQ ID NO: 193186 - DNA, 25 bp, Homo sapien
tggaggcgtctgctactacatcgag

SEQ ID NO: 193187 - DNA, 25 bp, Homo sapien
gtctgctactacatcgagggcatca

SEQ ID NO: 193188 - DNA, 25 bp, Homo sapien
tacatcgagggcatcaaccagctct

SEQ ID NO: 193189 - DNA, 25 bp, Homo sapien
taccagaagagggtcctgaccatca

SEQ ID NO: 193190 - DNA, 25 bp, Homo sapien
gaagagggtcctgaccatcacgggc

SEQ ID NO: 193191 - DNA, 25 bp, Homo sapien
atcacgggcatctgcgtggctctgc

SEQ ID NO: 193192 - DNA, 25 bp, Homo sapien
catctgcgtggctctgctggtcgtg

SEQ ID NO: 193193 - DNA, 25 bp, Homo sapien
gcatgtccctgtctagggcagccca

SEQ ID NO: 193194 - DNA, 25 bp, Homo sapien
catgtccctgtctagggcagcccag

SEQ ID NO: 193195 - DNA, 25 bp, Homo sapien
actcctggctcctcacacttgcctc

SEQ ID NO: 193196 - DNA, 25 bp, Homo sapien
acttgcctcccctatggccgctctc

SEQ ID NO: 193197 - DNA, 25 bp, Homo sapien
ttctccccacatccgcacctgctgt

SEQ ID NO: 193198 - DNA, 25 bp, Homo sapien
tgctgttcccactctggggttctca

SEQ ID NO: 193199 - DNA, 25 bp, Homo sapien
actctggggttctcaagtccatgaa

SEQ ID NO: 193200 - DNA, 25 bp, Homo sapien
ctctggggttctcaagtccatgaac

SEQ ID NO: 193201 - DNA, 25 bp, Homo sapien
gggagaattcagtgcccccttcgcc

SEQ ID NO: 193202 - DNA, 25 bp, Homo sapien
cttcgccctctagggagcagacctc

SEQ ID NO: 193203 - DNA, 25 bp, Homo sapien
ccctctagggagcagacctccactg

SEQ ID NO: 193204 - DNA, 25 bp, Homo sapien
attagccctgttttataggtgagga

SEQ ID NO: 193205 - DNA, 25 bp, Homo sapien
gggaaagccttgttccatgtcacac

SEQ ID NO: 193206 - DNA, 25 bp, Homo sapien
gttccatgtcacacaggtaggccat

SEQ ID NO: 193207 - DNA, 25 bp, Homo sapien
caggtaggccatgacagttctggat

SEQ ID NO: 193208 - DNA, 25 bp, Homo sapien
gatggaaacccaggtcggtctgatt

SEQ ID NO: 193209 - DNA, 25 bp, Homo sapien
caggtcggtctgattccaaaactgc

SEQ ID NO: 193210 - DNA, 25 bp, Homo sapien
tgcatataatactgcctgcaacagt

SEQ ID NO: 193211 - DNA, 25 bp, Homo sapien
ctgcaacagttgcttaatgtatggg

SEQ ID NO: 193212 - DNA, 25 bp, Homo sapien
ggcttaggaaccaaatcaactttct

SEQ ID NO: 193213 - DNA, 25 bp, Homo sapien
gcattgaaaaccacaacttttacct

SEQ ID NO: 193214 - DNA, 25 bp, Homo sapien
ggacattaaggagcctggtctgccc

SEQ ID NO: 193215 - DNA, 25 bp, Homo sapien
ctttatatgaaagaagtgccatggc

SEQ ID NO: 193216 - DNA, 25 bp, Homo sapien
agtgccatggcaaattagttgggaa

SEQ ID NO: 193217 - DNA, 25 bp, Homo sapien
gtgggaaggagtacctgttcagtaa

SEQ ID NO: 193218 - DNA, 25 bp, Homo sapien
gtacctgttcagtaaaatgctgctg

SEQ ID NO: 193219 - DNA, 25 bp, Homo sapien
aaatgctgctgctgggacaactggc

SEQ ID NO: 193220 - DNA, 25 bp, Homo sapien
ggacaactggcaattcaaatgggaa

SEQ ID NO: 193221 - DNA, 25 bp, Homo sapien
tgtaaagttagatcctaccttacgt

SEQ ID NO: 193222 - DNA, 25 bp, Homo sapien
gatcctaccttacgttaggcacaga

SEQ ID NO: 193223 - DNA, 25 bp, Homo sapien
gttaggcacagaaatctcttctagg

SEQ ID NO: 193224 - DNA, 25 bp, Homo sapien
gagatacacacacatctcagggtgt

SEQ ID NO: 193225 - DNA, 25 bp, Homo sapien
tacacacacatctcagggtgtggaa

SEQ ID NO: 193226 - DNA, 25 bp, Homo sapien
cattcatctattgcctttatgttgt

SEQ ID NO: 193227 - DNA, 25 bp, Homo sapien
catgatgcctttgtatttgctggtt

SEQ ID NO: 193228 - DNA, 25 bp, Homo sapien
gtatttgctggttgcacccctgaaa

SEQ ID NO: 193229 - DNA, 25 bp, Homo sapien
ttgcacccctgaaatcaatccatat

SEQ ID NO: 193230 - DNA, 25 bp, Homo sapien
caatccatatcatgtttgaatgcca

SEQ ID NO: 193231 - DNA, 25 bp, Homo sapien
gtttgaatgccatacattttgcaca

SEQ ID NO: 193232 - DNA, 25 bp, Homo sapien
acattttgcacatgtactgtacata

SEQ ID NO: 193233 - DNA, 25 bp, Homo sapien
tgtgtgcacatttatcatcagatct

SEQ ID NO: 193234 - DNA, 25 bp, Homo sapien
cagatcttttgtacatagtggcagt

SEQ ID NO: 193235 - DNA, 25 bp, Homo sapien
gcagtattgtagctgatcgggaaat

SEQ ID NO: 193236 - DNA, 25 bp, Homo sapien
gtttgatatctcagcaattttgcat

SEQ ID NO: 193237 - DNA, 25 bp, Homo sapien
cctgtctcttaaaaagcaagaaaag

SEQ ID NO: 193238 - DNA, 25 bp, Homo sapien
gagaataagaagatctctttgaaaa

SEQ ID NO: 193239 - DNA, 25 bp, Homo sapien
ataagactgctaaaagtatttggta

SEQ ID NO: 193240 - DNA, 25 bp, Homo sapien
taagactgctaaaagtatttggtat

SEQ ID NO: 193241 - DNA, 25 bp, Homo sapien
aagactgctaaaagtatttggtata

SEQ ID NO: 193242 - DNA, 25 bp, Homo sapien
agactgctaaaagtatttggtatac

SEQ ID NO: 193243 - DNA, 25 bp, Homo sapien
gactgctaaaagtatttggtataca

SEQ ID NO: 193244 - DNA, 25 bp, Homo sapien
gtatttggtatacagtctggaaaat

SEQ ID NO: 193245 - DNA, 25 bp, Homo sapien
tatttggtatacagtctggaaaata

SEQ ID NO: 193246 - DNA, 25 bp, Homo sapien
atttggtatacagtctggaaaataa

SEQ ID NO: 193247 - DNA, 25 bp, Homo sapien
gtatacagtctggaaaataaagttg

SEQ ID NO: 193248 - DNA, 25 bp, Homo sapien
tgtgcagcctgcagatgtgaaggaa

SEQ ID NO: 193249 - DNA, 25 bp, Homo sapien
aagttgttgagaagggtgtacagac

SEQ ID NO: 193250 - DNA, 25 bp, Homo sapien
agttgttgagaagggtgtacagact

SEQ ID NO: 193251 - DNA, 25 bp, Homo sapien
ttgttgagaagggtgtacagactct

SEQ ID NO: 193252 - DNA, 25 bp, Homo sapien
tgttgagaagggtgtacagactctt

SEQ ID NO: 193253 - DNA, 25 bp, Homo sapien
gttgagaagggtgtacagactcttg

SEQ ID NO: 193254 - DNA, 25 bp, Homo sapien
ttgagaagggtgtacagactcttgt

SEQ ID NO: 193255 - DNA, 25 bp, Homo sapien
ttgtgattggccgagggatgagtga

SEQ ID NO: 193256 - DNA, 25 bp, Homo sapien
tgtgattggccgagggatgagtgag

SEQ ID NO: 193257 - DNA, 25 bp, Homo sapien
gtgattggccgagggatgagtgagg

SEQ ID NO: 193258 - DNA, 25 bp, Homo sapien
tgattggccgagggatgagtgaggc

SEQ ID NO: 193259 - DNA, 25 bp, Homo sapien
accagcctggccaatttgtacctgc

SEQ ID NO: 193260 - DNA, 25 bp, Homo sapien
ccagcctggccaatttgtacctgca

SEQ ID NO: 193261 - DNA, 25 bp, Homo sapien
ccaatttgtacctgcaggcctccta

SEQ ID NO: 193262 - DNA, 25 bp, Homo sapien
gcttctatttcgaccgcgatgatgt

SEQ ID NO: 193263 - DNA, 25 bp, Homo sapien
gcgatgatgtggctctggaaggcgt

SEQ ID NO: 193264 - DNA, 25 bp, Homo sapien
ggcgtgagccacttcttccgcgaat

SEQ ID NO: 193265 - DNA, 25 bp, Homo sapien
gcgtgagccacttcttccgcgaatt

SEQ ID NO: 193266 - DNA, 25 bp, Homo sapien
cgtgagccacttcttccgcgaattg

SEQ ID NO: 193267 - DNA, 25 bp, Homo sapien
gtgagccacttcttccgcgaattgg

SEQ ID NO: 193268 - DNA, 25 bp, Homo sapien
acttcttccgcgaattggccgagga

SEQ ID NO: 193269 - DNA, 25 bp, Homo sapien
tcttccgcgaattggccgaggagaa

SEQ ID NO: 193270 - DNA, 25 bp, Homo sapien
aagctaatgcacctacagatggccc

SEQ ID NO: 193271 - DNA, 25 bp, Homo sapien
ttccttttgcttctagtcaacctta

SEQ ID NO: 193272 - DNA, 25 bp, Homo sapien
gtcaaccttaatgggctgttacaga

SEQ ID NO: 193273 - DNA, 25 bp, Homo sapien
ggctgttacagaaactagttcgtgt

SEQ ID NO: 193274 - DNA, 25 bp, Homo sapien
gaaactagttcgtgtttatatacta

SEQ ID NO: 193275 - DNA, 25 bp, Homo sapien
tttgatgtcctataagtcggaaaag

SEQ ID NO: 193276 - DNA, 25 bp, Homo sapien
aagagaacctattatttgccagttt

SEQ ID NO: 193277 - DNA, 25 bp, Homo sapien
gggttcctgactgataccagcagtt

SEQ ID NO: 193278 - DNA, 25 bp, Homo sapien
tgaaggaagagagtgcatggcacct

SEQ ID NO: 193279 - DNA, 25 bp, Homo sapien
gtaacgacacaatcagcacaactgg

SEQ ID NO: 193280 - DNA, 25 bp, Homo sapien
tcagcacaactggagagaggcatta

SEQ ID NO: 193281 - DNA, 25 bp, Homo sapien
taagttggtcctttacactcaggct

SEQ ID NO: 193282 - DNA, 25 bp, Homo sapien
cctttacactcaggctttcactatt

SEQ ID NO: 193283 - DNA, 25 bp, Homo sapien
ggatgattattttcaaggccctcag

SEQ ID NO: 193284 - DNA, 25 bp, Homo sapien
ttcaaggccctcagcatatttgtat

SEQ ID NO: 193285 - DNA, 25 bp, Homo sapien
catatttgtatagttgcttgcctga

SEQ ID NO: 193286 - DNA, 25 bp, Homo sapien
atagttgcttgcctgatataaatgc

SEQ ID NO: 193287 - DNA, 25 bp, Homo sapien
ctatgccaaagatcacttgttgttt

SEQ ID NO: 193288 - DNA, 25 bp, Homo sapien
aaaatcatgtttgctctcccggttc

SEQ ID NO: 193289 - DNA, 25 bp, Homo sapien
tcccggttcttccagtggtttgaga

SEQ ID NO: 193290 - DNA, 25 bp, Homo sapien
ggtttacactttatgccggatgtgc

SEQ ID NO: 193291 - DNA, 25 bp, Homo sapien
tatgccggatgtgcttttctccaat

SEQ ID NO: 193292 - DNA, 25 bp, Homo sapien
gggaactctttataacctgtccagt

SEQ ID NO: 193293 - DNA, 25 bp, Homo sapien
tttataacctgtccagtgccgtcat

SEQ ID NO: 193294 - DNA, 25 bp, Homo sapien
agtgccgtcatctgggatttttctc

SEQ ID NO: 193295 - DNA, 25 bp, Homo sapien
atctgggatttttctctgaagtaca

SEQ ID NO: 193296 - DNA, 25 bp, Homo sapien
gaatttcaggtgatttaagctgctt

SEQ ID NO: 193297 - DNA, 25 bp, Homo sapien
aagctgcttgatcacacttatttgt

SEQ ID NO: 193298 - DNA, 25 bp, Homo sapien
catttaatgttaatgttttcctgct

SEQ ID NO: 193299 - DNA, 25 bp, Homo sapien
aagagcttcaaggtaaattacaggg

SEQ ID NO: 193300 - DNA, 25 bp, Homo sapien
cacttgaattaataggagcaccggt

SEQ ID NO: 193301 - DNA, 25 bp, Homo sapien
ggagcaccggttgttgctagtataa

SEQ ID NO: 193302 - DNA, 25 bp, Homo sapien
aagtaatttgtgtggcagtttgtac

SEQ ID NO: 193303 - DNA, 25 bp, Homo sapien
accgtggagctggtccgggcgctgc

SEQ ID NO: 193304 - DNA, 25 bp, Homo sapien
tggtccgggcgctgccgctggcgct

SEQ ID NO: 193305 - DNA, 25 bp, Homo sapien
gcagagctgctggtcgacgtgggtc

SEQ ID NO: 193306 - DNA, 25 bp, Homo sapien
gagctgctggtcgacgtgggtcaga

SEQ ID NO: 193307 - DNA, 25 bp, Homo sapien
tgctggtcgacgtgggtcagaggct

SEQ ID NO: 193308 - DNA, 25 bp, Homo sapien
gtcgacgtgggtcagaggctgcgcc

SEQ ID NO: 193309 - DNA, 25 bp, Homo sapien
tgggtcagaggctgcgccgtgggac

SEQ ID NO: 193310 - DNA, 25 bp, Homo sapien
ccctggctccgcgtgcaccgggacg

SEQ ID NO: 193311 - DNA, 25 bp, Homo sapien
tgcaggaggcgctcgtactctccga

SEQ ID NO: 193312 - DNA, 25 bp, Homo sapien
aggaggcgctcgtactctccgaccg

SEQ ID NO: 193313 - DNA, 25 bp, Homo sapien
ctcgcccttcgcagagctcgttctg

SEQ ID NO: 193314 - DNA, 25 bp, Homo sapien
gattattgactatacaacctaccag

SEQ ID NO: 193315 - DNA, 25 bp, Homo sapien
gactatacaacctaccagctgaaag

SEQ ID NO: 193316 - DNA, 25 bp, Homo sapien
gaaagatcttcatcaacatctgtat

SEQ ID NO: 193317 - DNA, 25 bp, Homo sapien
aacatctgtatctttccagaggtat

SEQ ID NO: 193318 - DNA, 25 bp, Homo sapien
atcttcaagctttaatgatccagtt

SEQ ID NO: 193319 - DNA, 25 bp, Homo sapien
gatccagttttaagtcaacggcaga

SEQ ID NO: 193320 - DNA, 25 bp, Homo sapien
gaatatttcatcactcaatcttgaa

SEQ ID NO: 193321 - DNA, 25 bp, Homo sapien
cttgaactgatttagaagagactct

SEQ ID NO: 193322 - DNA, 25 bp, Homo sapien
gaagagactctttgctgaaattgaa

SEQ ID NO: 193323 - DNA, 25 bp, Homo sapien
tgctgaaattgaattgcacttatac

SEQ ID NO: 193324 - DNA, 25 bp, Homo sapien
gcacttatacatgtaaattgtcaac

SEQ ID NO: 193325 - DNA, 25 bp, Homo sapien
ggccgttgaccttagagttaaggcg

SEQ ID NO: 193326 - DNA, 25 bp, Homo sapien
gaccttagagttaaggcggttgctt

SEQ ID NO: 193327 - DNA, 25 bp, Homo sapien
atcaccaaagtttctgggaaactat

SEQ ID NO: 193328 - DNA, 25 bp, Homo sapien
caaactaggttacaggttcttatct

SEQ ID NO: 193329 - DNA, 25 bp, Homo sapien
ggttacaggttcttatctgcaaggt

SEQ ID NO: 193330 - DNA, 25 bp, Homo sapien
ggttcttatctgcaaggttcaagtt

SEQ ID NO: 193331 - DNA, 25 bp, Homo sapien
ggttcaagttgcttagacattgttt

SEQ ID NO: 193332 - DNA, 25 bp, Homo sapien
agacattgttttccagtattctgca

SEQ ID NO: 193333 - DNA, 25 bp, Homo sapien
gttttccagtattctgcagggccag

SEQ ID NO: 193334 - DNA, 25 bp, Homo sapien
tgcagggccagtcagttgtacagaa

SEQ ID NO: 193335 - DNA, 25 bp, Homo sapien
agggccagtcagttgtacagaagtt

SEQ ID NO: 193336 - DNA, 25 bp, Homo sapien
aatcttggccaggtatgtgggagga

SEQ ID NO: 193337 - DNA, 25 bp, Homo sapien
tcacagcaacttcaaactcctgagc

SEQ ID NO: 193338 - DNA, 25 bp, Homo sapien
cacagcaacttcaaactcctgagca

SEQ ID NO: 193339 - DNA, 25 bp, Homo sapien
agtgagccgtcatcacaccagtaca

SEQ ID NO: 193340 - DNA, 25 bp, Homo sapien
accagtacactccaggctaggtcac

SEQ ID NO: 193341 - DNA, 25 bp, Homo sapien
cagtacactccaggctaggtcacag

SEQ ID NO: 193342 - DNA, 25 bp, Homo sapien
ctccaggctaggtcacagagaccgt

SEQ ID NO: 193343 - DNA, 25 bp, Homo sapien
ccaggctaggtcacagagaccgtgt

SEQ ID NO: 193344 - DNA, 25 bp, Homo sapien
ctcaagatcctcatagtagacgcaa

SEQ ID NO: 193345 - DNA, 25 bp, Homo sapien
gatcctcatagtagacgcaaacttc

SEQ ID NO: 193346 - DNA, 25 bp, Homo sapien
tagtagacgcaaacttcctttgttg

SEQ ID NO: 193347 - DNA, 25 bp, Homo sapien
tcagtcaaactatatttaaagccag

SEQ ID NO: 193348 - DNA, 25 bp, Homo sapien
aaagccagcctgttttcagagtatg

SEQ ID NO: 193349 - DNA, 25 bp, Homo sapien
cagagtatgatgtcctttaatgtaa

SEQ ID NO: 193350 - DNA, 25 bp, Homo sapien
atgtccggataatattctagaggtt

SEQ ID NO: 193351 - DNA, 25 bp, Homo sapien
gacaataaagtacacaagtcgttaa

SEQ ID NO: 193352 - DNA, 25 bp, Homo sapien
gggctattcactttatcctgtactt

SEQ ID NO: 193353 - DNA, 25 bp, Homo sapien
cactttatcctgtactttcaatgaa

SEQ ID NO: 193354 - DNA, 25 bp, Homo sapien
gaaattgtgatcatttcctaagaaa

SEQ ID NO: 193355 - DNA, 25 bp, Homo sapien
tcatattttgtgtccccaccttgat

SEQ ID NO: 193356 - DNA, 25 bp, Homo sapien
gtccccaccttgatgttacatgact

SEQ ID NO: 193357 - DNA, 25 bp, Homo sapien
gttacatgactctggaacaatatga

SEQ ID NO: 193358 - DNA, 25 bp, Homo sapien
gcctgggcttatctgggccttctca

SEQ ID NO: 193359 - DNA, 25 bp, Homo sapien
ggccttctcactcagggactctctt

SEQ ID NO: 193360 - DNA, 25 bp, Homo sapien
agggactctcttgacgctgacttgc

SEQ ID NO: 193361 - DNA, 25 bp, Homo sapien
cggtgccattggtctggtgcagcat

SEQ ID NO: 193362 - DNA, 25 bp, Homo sapien
attggtctggtgcagcatagccctg

SEQ ID NO: 193363 - DNA, 25 bp, Homo sapien
tggtgcagcatagccctggccagtg

SEQ ID NO: 193364 - DNA, 25 bp, Homo sapien
tgcagcatagccctggccagtggcc

SEQ ID NO: 193365 - DNA, 25 bp, Homo sapien
tcccgtgcctctgccagcaaggagg

SEQ ID NO: 193366 - DNA, 25 bp, Homo sapien
gccggccagctctgcttgcacaggg

SEQ ID NO: 193367 - DNA, 25 bp, Homo sapien
gtcagcgcacgctcatgtcactgag

SEQ ID NO: 193368 - DNA, 25 bp, Homo sapien
agcgcacgctcatgtcactgagttc

SEQ ID NO: 193369 - DNA, 25 bp, Homo sapien
tgttcgcgactagttggctctgaga

SEQ ID NO: 193370 - DNA, 25 bp, Homo sapien
ttggctctgagatactaataggtgt

SEQ ID NO: 193371 - DNA, 25 bp, Homo sapien
ctaataggtgtgtgaggctccggat

SEQ ID NO: 193372 - DNA, 25 bp, Homo sapien
gtgaggctccggatgtttctggaat

SEQ ID NO: 193373 - DNA, 25 bp, Homo sapien
aataaaggcatttcaaagtctcact

SEQ ID NO: 193374 - DNA, 25 bp, Homo sapien
aaaaatcattctactgaacagtcca

SEQ ID NO: 193375 - DNA, 25 bp, Homo sapien
gaacagtccatcttctttatacaat

SEQ ID NO: 193376 - DNA, 25 bp, Homo sapien
ttctttatacaatgaccacatcctg

SEQ ID NO: 193377 - DNA, 25 bp, Homo sapien
gaccacatcctgaaaagggtgttgc

SEQ ID NO: 193378 - DNA, 25 bp, Homo sapien
aagggtgttgctaagctgtaaccga

SEQ ID NO: 193379 - DNA, 25 bp, Homo sapien
gctgtaaccgatatgcacttgaaat

SEQ ID NO: 193380 - DNA, 25 bp, Homo sapien
tattcgcagctcacacagtttacct

SEQ ID NO: 193381 - DNA, 25 bp, Homo sapien
acactcgactcttgccagtgcaaac

SEQ ID NO: 193382 - DNA, 25 bp, Homo sapien
cagcaggacctttgtttaccgggat

SEQ ID NO: 193383 - DNA, 25 bp, Homo sapien
taccgggatgtgacggactgtacca

SEQ ID NO: 193384 - DNA, 25 bp, Homo sapien
gtcactggcactttcaaactgttct

SEQ ID NO: 193385 - DNA, 25 bp, Homo sapien
aactgttcttactcatccagatgat

SEQ ID NO: 193386 - DNA, 25 bp, Homo sapien
atgattcttaatttggtctgcggcc

SEQ ID NO: 193387 - DNA, 25 bp, Homo sapien
gcttgttggcctgctttgtgatgtg

SEQ ID NO: 193388 - DNA, 25 bp, Homo sapien
gtggaaacataggtaccaggtcttc

SEQ ID NO: 193389 - DNA, 25 bp, Homo sapien
caggtcttctatgtgggtgtcagga

SEQ ID NO: 193390 - DNA, 25 bp, Homo sapien
tgggtgtcaggatatgctccctcac

SEQ ID NO: 193391 - DNA, 25 bp, Homo sapien
ttacattttttcagatgactagcaa

SEQ ID NO: 193392 - DNA, 25 bp, Homo sapien
ttcagatgactagcaattttgatag

SEQ ID NO: 193393 - DNA, 25 bp, Homo sapien
tgcaaagaactttctctgacaaact

SEQ ID NO: 193394 - DNA, 25 bp, Homo sapien
gaactttctctgacaaactaactgc

SEQ ID NO: 193395 - DNA, 25 bp, Homo sapien
tttctctgacaaactaactgcagta

SEQ ID NO: 193396 - DNA, 25 bp, Homo sapien
aactgcagtaacagaaacctttctt

SEQ ID NO: 193397 - DNA, 25 bp, Homo sapien
ttcttttcagttactctttttcaag

SEQ ID NO: 193398 - DNA, 25 bp, Homo sapien
tcagttactctttttcaagaatgaa

SEQ ID NO: 193399 - DNA, 25 bp, Homo sapien
aaattgtatactacttgatggaacc

SEQ ID NO: 193400 - DNA, 25 bp, Homo sapien
gtatactacttgatggaaccaactt

SEQ ID NO: 193401 - DNA, 25 bp, Homo sapien
tacttgatggaaccaactttgtaca

SEQ ID NO: 193402 - DNA, 25 bp, Homo sapien
aacagaaacagaagctcctgttcag

SEQ ID NO: 193403 - DNA, 25 bp, Homo sapien
agcacctcagtcgtccacaccaagt

SEQ ID NO: 193404 - DNA, 25 bp, Homo sapien
ctcagtcgtccacaccaagtgacac

SEQ ID NO: 193405 - DNA, 25 bp, Homo sapien
aagtgacactactggcccaggctac

SEQ ID NO: 193406 - DNA, 25 bp, Homo sapien
tgacactactggcccaggctacctt

SEQ ID NO: 193407 - DNA, 25 bp, Homo sapien
aggctaccttctccatctggttttt

SEQ ID NO: 193408 - DNA, 25 bp, Homo sapien
ctaccttctccatctggtttttgtt

SEQ ID NO: 193409 - DNA, 25 bp, Homo sapien
catgcttttgtttggctgctgtaat

SEQ ID NO: 193410 - DNA, 25 bp, Homo sapien
tttgagtttgaacagattagctctg

SEQ ID NO: 193411 - DNA, 25 bp, Homo sapien
gtttccacaatgtgagggggaacca

SEQ ID NO: 193412 - DNA, 25 bp, Homo sapien
aatacagtgtattttccagcttcct

SEQ ID NO: 193413 - DNA, 25 bp, Homo sapien
tctgcttccagatgagccagtgcct

SEQ ID NO: 193414 - DNA, 25 bp, Homo sapien
agatgagccagtgcctcgcatgata

SEQ ID NO: 193415 - DNA, 25 bp, Homo sapien
agtgcctcgcatgataccagaggag

SEQ ID NO: 193416 - DNA, 25 bp, Homo sapien
gctcaggcacagcaacttgcccagg

SEQ ID NO: 193417 - DNA, 25 bp, Homo sapien
acttgcccaggactgacactgtcac

SEQ ID NO: 193418 - DNA, 25 bp, Homo sapien
gacactgtcaccctgactgcaggag

SEQ ID NO: 193419 - DNA, 25 bp, Homo sapien
ctcagagggcgaagagcactggcat

SEQ ID NO: 193420 - DNA, 25 bp, Homo sapien
aagagcactggcatttggcatgtcc

SEQ ID NO: 193421 - DNA, 25 bp, Homo sapien
ctggcatttggcatgtccatgacat

SEQ ID NO: 193422 - DNA, 25 bp, Homo sapien
gtccatgacattggagactccccta

SEQ ID NO: 193423 - DNA, 25 bp, Homo sapien
gagactcccctagcagggtgcctga

SEQ ID NO: 193424 - DNA, 25 bp, Homo sapien
ggaacccctttaccagcagctatta

SEQ ID NO: 193425 - DNA, 25 bp, Homo sapien
accagcagctattatctttcgaaga

SEQ ID NO: 193426 - DNA, 25 bp, Homo sapien
ggaaaagttttacagatcatcgtct

SEQ ID NO: 193427 - DNA, 25 bp, Homo sapien
tatggccgcatggatcacaaatctt

SEQ ID NO: 193428 - DNA, 25 bp, Homo sapien
acaaatcttttatgggagtggccca

SEQ ID NO: 193429 - DNA, 25 bp, Homo sapien
gagtggcccagatacttttagatga

SEQ ID NO: 193430 - DNA, 25 bp, Homo sapien
gaactagagctatccaatatggtga

SEQ ID NO: 193431 - DNA, 25 bp, Homo sapien
tagtagatccaaccttggctcctct

SEQ ID NO: 193432 - DNA, 25 bp, Homo sapien
gaagagcttcccaatcatctctgga

SEQ ID NO: 193433 - DNA, 25 bp, Homo sapien
tcaactggaccttcttactctcgtt

SEQ ID NO: 193434 - DNA, 25 bp, Homo sapien
tcttactctcgttcatagcagctgt

SEQ ID NO: 193435 - DNA, 25 bp, Homo sapien
acctcagtcgtccacaccaagtgac

SEQ ID NO: 193436 - DNA, 25 bp, Homo sapien
cctcagtcgtccacaccaagtgaca

SEQ ID NO: 193437 - DNA, 25 bp, Homo sapien
ctcagtcgtccacaccaagtgacac

SEQ ID NO: 193438 - DNA, 25 bp, Homo sapien
aagtgacactactggcccaggctac

SEQ ID NO: 193439 - DNA, 25 bp, Homo sapien
agtgacactactggcccaggctacc

SEQ ID NO: 193440 - DNA, 25 bp, Homo sapien
gtgacactactggcccaggctacct

SEQ ID NO: 193441 - DNA, 25 bp, Homo sapien
tgacactactggcccaggctacctt

SEQ ID NO: 193442 - DNA, 25 bp, Homo sapien
gacactactggcccaggctaccttc

SEQ ID NO: 193443 - DNA, 25 bp, Homo sapien
gtttccacaatgtgagggggaacca

SEQ ID NO: 193444 - DNA, 25 bp, Homo sapien
ttccacaatgtgagggggaaccaag

SEQ ID NO: 193445 - DNA, 25 bp, Homo sapien
tccacaatgtgagggggaaccaaga

SEQ ID NO: 193446 - DNA, 25 bp, Homo sapien
ggactaacataatacccctaccata

SEQ ID NO: 193447 - DNA, 25 bp, Homo sapien
acataatacccctaccatacaaaat

SEQ ID NO: 193448 - DNA, 25 bp, Homo sapien
atacccctaccatacaaaatatcgc

SEQ ID NO: 193449 - DNA, 25 bp, Homo sapien
ccatacaaaatatcgccaaggacta

SEQ ID NO: 193450 - DNA, 25 bp, Homo sapien
atatcgccaaggactaatataatac

SEQ ID NO: 193451 - DNA, 25 bp, Homo sapien
ggactaatataatacccctaccata

SEQ ID NO: 193452 - DNA, 25 bp, Homo sapien
atataatacccctaccatacaaagt

SEQ ID NO: 193453 - DNA, 25 bp, Homo sapien
atacccctaccatacaaagtatcgc

SEQ ID NO: 193454 - DNA, 25 bp, Homo sapien
ccatacaaagtatcgccaaggacta

SEQ ID NO: 193455 - DNA, 25 bp, Homo sapien
caaagtatcgccaaggactaatata

SEQ ID NO: 193456 - DNA, 25 bp, Homo sapien
aggactaatataatacccctaccat

SEQ ID NO: 193457 - DNA, 25 bp, Homo sapien
tacggcgaaagcctgccaccccaca

SEQ ID NO: 193458 - DNA, 25 bp, Homo sapien
acaatgaatccaccctgctccactg

SEQ ID NO: 193459 - DNA, 25 bp, Homo sapien
agcagtggccgctaccgacagcgca

SEQ ID NO: 193460 - DNA, 25 bp, Homo sapien
cagtggccgctaccgacagcgcatg

SEQ ID NO: 193461 - DNA, 25 bp, Homo sapien
gacagcgcatgtcccgctcttatcc

SEQ ID NO: 193462 - DNA, 25 bp, Homo sapien
gctcttatccaactcttccaggccc

SEQ ID NO: 193463 - DNA, 25 bp, Homo sapien
gcacccctcccctctatagagcagg

SEQ ID NO: 193464 - DNA, 25 bp, Homo sapien
aggggccaaggacacgtcattgtac

SEQ ID NO: 193465 - DNA, 25 bp, Homo sapien
gtcattgtaccctgagcgtccccag

SEQ ID NO: 193466 - DNA, 25 bp, Homo sapien
attgtaccctgagcgtccccaggga

SEQ ID NO: 193467 - DNA, 25 bp, Homo sapien
ctgagcgtccccagggagtggaaat

SEQ ID NO: 193468 - DNA, 25 bp, Homo sapien
ttcctatctggctagttcctcttca

SEQ ID NO: 193469 - DNA, 25 bp, Homo sapien
ctatctggctagttcctcttcaatt

SEQ ID NO: 193470 - DNA, 25 bp, Homo sapien
atctggctagttcctcttcaattag

SEQ ID NO: 193471 - DNA, 25 bp, Homo sapien
ctggctagttcctcttcaattagga

SEQ ID NO: 193472 - DNA, 25 bp, Homo sapien
ggctagttcctcttcaattaggagt

SEQ ID NO: 193473 - DNA, 25 bp, Homo sapien
agttcctcttcaattaggagtgaga

SEQ ID NO: 193474 - DNA, 25 bp, Homo sapien
caattaggagtgagaggccaagcgt

SEQ ID NO: 193475 - DNA, 25 bp, Homo sapien
ggaagccaagatgagtagatcacct

SEQ ID NO: 193476 - DNA, 25 bp, Homo sapien
ccaagatgagtagatcacctggcat

SEQ ID NO: 193477 - DNA, 25 bp, Homo sapien
atgagtagatcacctggcatcagga

SEQ ID NO: 193478 - DNA, 25 bp, Homo sapien
tgagtagatcacctggcatcaggag

SEQ ID NO: 193479 - DNA, 25 bp, Homo sapien
ctgcggctggaggttctcgcgctct

SEQ ID NO: 193480 - DNA, 25 bp, Homo sapien
aggttctcgcgctctgacgagctgt

SEQ ID NO: 193481 - DNA, 25 bp, Homo sapien
tctgacgagctgtcgcggcacaggc

SEQ ID NO: 193482 - DNA, 25 bp, Homo sapien
acaggcgctcgcattcaggtgtgaa

SEQ ID NO: 193483 - DNA, 25 bp, Homo sapien
aggtgtgaagccgtaccagtgtcct

SEQ ID NO: 193484 - DNA, 25 bp, Homo sapien
accagtgtcctgtgtgcgagaagaa

SEQ ID NO: 193485 - DNA, 25 bp, Homo sapien
gaagttcgcgcggagcgaccacctt

SEQ ID NO: 193486 - DNA, 25 bp, Homo sapien
gaccacctttccaagcacatcaagg

SEQ ID NO: 193487 - DNA, 25 bp, Homo sapien
ccgctccgtgcgttccgtgaactga

SEQ ID NO: 193488 - DNA, 25 bp, Homo sapien
atgcacaaatgtactttccctggct

SEQ ID NO: 193489 - DNA, 25 bp, Homo sapien
gcagcaagatgtacaccaaaagcag

SEQ ID NO: 193490 - DNA, 25 bp, Homo sapien
gtgctggcaggagcttcagacacgc

SEQ ID NO: 193491 - DNA, 25 bp, Homo sapien
ggagcttcagacacgccaagtggat

SEQ ID NO: 193492 - DNA, 25 bp, Homo sapien
gagacgggttctcatgtgagatcaa

SEQ ID NO: 193493 - DNA, 25 bp, Homo sapien
gtgagatcaaagctcctccaaagcc

SEQ ID NO: 193494 - DNA, 25 bp, Homo sapien
aagcctgttcaagctctaagcgatt

SEQ ID NO: 193495 - DNA, 25 bp, Homo sapien
taagcgattctcaaatgttaccatt

SEQ ID NO: 193496 - DNA, 25 bp, Homo sapien
tacacctgttgaaggccaagttcag

SEQ ID NO: 193497 - DNA, 25 bp, Homo sapien
atgcttgacttttaaaatcctgggc

SEQ ID NO: 193498 - DNA, 25 bp, Homo sapien
gcataaatagtgcagagcctcgtat

SEQ ID NO: 193499 - DNA, 25 bp, Homo sapien
cagagcctcgtatgtttgtcagttc

SEQ ID NO: 193500 - DNA, 25 bp, Homo sapien
cgtatgtttgtcagttcatgccgag

SEQ ID NO: 193501 - DNA, 25 bp, Homo sapien
agaaactgacacttggctactttaa

SEQ ID NO: 193502 - DNA, 25 bp, Homo sapien
gctactttaagtaacctgcccatag

SEQ ID NO: 193503 - DNA, 25 bp, Homo sapien
gcccatagttacacagccagcaaat

SEQ ID NO: 193504 - DNA, 25 bp, Homo sapien
tgaaaaatccattcttagcatctaa

SEQ ID NO: 193505 - DNA, 25 bp, Homo sapien
tcttagcatctaatgcctaataggc

SEQ ID NO: 193506 - DNA, 25 bp, Homo sapien
ccaaggctatctggctttaatgcaa

SEQ ID NO: 193507 - DNA, 25 bp, Homo sapien
atctggctttaatgcaacgttgttc

SEQ ID NO: 193508 - DNA, 25 bp, Homo sapien
atatcaaaggatttctctctcacaa

SEQ ID NO: 193509 - DNA, 25 bp, Homo sapien
ttctctctcacaatccttattttta

SEQ ID NO: 193510 - DNA, 25 bp, Homo sapien
gtaatcatagcaaacacatctaact

SEQ ID NO: 193511 - DNA, 25 bp, Homo sapien
gaacaatttaaccttccacatcaag

SEQ ID NO: 193512 - DNA, 25 bp, Homo sapien
ggctagcagttctaatgtgacattc

SEQ ID NO: 193513 - DNA, 25 bp, Homo sapien
tgtgacattctttaagcatatctta

SEQ ID NO: 193514 - DNA, 25 bp, Homo sapien
aatttctacataattattgcactga

SEQ ID NO: 193515 - DNA, 25 bp, Homo sapien
ataagctcagctaattcaagacact

SEQ ID NO: 193516 - DNA, 25 bp, Homo sapien
aagacactgtagtcacttgtgcatc

SEQ ID NO: 193517 - DNA, 25 bp, Homo sapien
acttgtgcatcagtgtgcttgaatt

SEQ ID NO: 193518 - DNA, 25 bp, Homo sapien
gtgcttgaatttagtagcttacagc

SEQ ID NO: 193519 - DNA, 25 bp, Homo sapien
gtagcttacagcattatttatgaag

SEQ ID NO: 193520 - DNA, 25 bp, Homo sapien
gaagtacctcatgttgaatgttatt

SEQ ID NO: 193521 - DNA, 25 bp, Homo sapien
taacagtgcagatcttgttagacac

SEQ ID NO: 193522 - DNA, 25 bp, Homo sapien
gcagatcttgttagacacatgaatg

SEQ ID NO: 193523 - DNA, 25 bp, Homo sapien
aaattatgcaccttctgataacccc

SEQ ID NO: 193524 - DNA, 25 bp, Homo sapien
aaatgttctacatctctgaatgacc

SEQ ID NO: 193525 - DNA, 25 bp, Homo sapien
tctctgaatgacctctgactttaaa

SEQ ID NO: 193526 - DNA, 25 bp, Homo sapien
tttgcatggctgtatttacattaac

SEQ ID NO: 193527 - DNA, 25 bp, Homo sapien
actgacattttcttctactcttctc

SEQ ID NO: 193528 - DNA, 25 bp, Homo sapien
aaactgaagcatgtgccattctata

SEQ ID NO: 193529 - DNA, 25 bp, Homo sapien
gtgccattctatactgtcattccaa

SEQ ID NO: 193530 - DNA, 25 bp, Homo sapien
aaattctcatggactattgcctgtt

SEQ ID NO: 193531 - DNA, 25 bp, Homo sapien
ggactattgcctgttgtgaaaatgt

SEQ ID NO: 193532 - DNA, 25 bp, Homo sapien
aatgtttgaaactgcactgaaagct

SEQ ID NO: 193533 - DNA, 25 bp, Homo sapien
actgaaagctgcatctgtctgtatc

SEQ ID NO: 193534 - DNA, 25 bp, Homo sapien
cttccctggtgtggtaagtgaacca

SEQ ID NO: 193535 - DNA, 25 bp, Homo sapien
aggttctaaaacttgctccatcagc

SEQ ID NO: 193536 - DNA, 25 bp, Homo sapien
atgataagtattaagcacccaccag

SEQ ID NO: 193537 - DNA, 25 bp, Homo sapien
gggagacgttttatcacatgactgg

SEQ ID NO: 193538 - DNA, 25 bp, Homo sapien
ttatcacatgactggcactaaaagg

SEQ ID NO: 193539 - DNA, 25 bp, Homo sapien
ggcactaaaaggcagaaggtgtcta

SEQ ID NO: 193540 - DNA, 25 bp, Homo sapien
aggtgtctaaactatctttggcttc

SEQ ID NO: 193541 - DNA, 25 bp, Homo sapien
ttggcttcccctttagaacccagtg

SEQ ID NO: 193542 - DNA, 25 bp, Homo sapien
ttcccctttagaacccagtggagtg

SEQ ID NO: 193543 - DNA, 25 bp, Homo sapien
gacagagtagatgctgcgtaagtct

SEQ ID NO: 193544 - DNA, 25 bp, Homo sapien
gatgctgcgtaagtctctaaacaaa

SEQ ID NO: 193545 - DNA, 25 bp, Homo sapien
aaggggcctagatttgacctctgtc

SEQ ID NO: 193546 - DNA, 25 bp, Homo sapien
gtgcaggaacatctgaggccactct

SEQ ID NO: 193547 - DNA, 25 bp, Homo sapien
aggaacatctgaggccactctgctg

SEQ ID NO: 193548 - DNA, 25 bp, Homo sapien
acatctgaggccactctgctggcca

SEQ ID NO: 193549 - DNA, 25 bp, Homo sapien
gtgctgaccacaggatgggctttgt

SEQ ID NO: 193550 - DNA, 25 bp, Homo sapien
acaggatgggctttgtttacactca

SEQ ID NO: 193551 - DNA, 25 bp, Homo sapien
atgggctttgtttacactcattttc

SEQ ID NO: 193552 - DNA, 25 bp, Homo sapien
tcttgcccccactttcataaaagaa

SEQ ID NO: 193553 - DNA, 25 bp, Homo sapien
agaaacttcaaaatgctgacgcttt

SEQ ID NO: 193554 - DNA, 25 bp, Homo sapien
aaaatgctgacgctttggagagtaa

SEQ ID NO: 193555 - DNA, 25 bp, Homo sapien
gtaagaaaatcaatcttggctgggc

SEQ ID NO: 193556 - DNA, 25 bp, Homo sapien
taaaaaagtttgccggctaggtgcg

SEQ ID NO: 193557 - DNA, 25 bp, Homo sapien
aaagtttgccggctaggtgcggtgg

SEQ ID NO: 193558 - DNA, 25 bp, Homo sapien
aacttagctgggtgtaacggcggat

SEQ ID NO: 193559 - DNA, 25 bp, Homo sapien
acttagctgggtgtaacggcggatg

SEQ ID NO: 193560 - DNA, 25 bp, Homo sapien
cttagctgggtgtaacggcggatgc

SEQ ID NO: 193561 - DNA, 25 bp, Homo sapien
ttagctgggtgtaacggcggatgcc

SEQ ID NO: 193562 - DNA, 25 bp, Homo sapien
tagctgggtgtaacggcggatgcct

SEQ ID NO: 193563 - DNA, 25 bp, Homo sapien
agctgggtgtaacggcggatgcctg

SEQ ID NO: 193564 - DNA, 25 bp, Homo sapien
gctgggtgtaacggcggatgcctgt

SEQ ID NO: 193565 - DNA, 25 bp, Homo sapien
ctgggtgtaacggcggatgcctgta

SEQ ID NO: 193566 - DNA, 25 bp, Homo sapien
tgggtgtaacggcggatgcctgtaa

SEQ ID NO: 193567 - DNA, 25 bp, Homo sapien
ctgaggccaagtgagctgttaagat

SEQ ID NO: 193568 - DNA, 25 bp, Homo sapien
gagctgttaagataacccacactta

SEQ ID NO: 193569 - DNA, 25 bp, Homo sapien
ggtaggctgagtattgggaatccaa

SEQ ID NO: 193570 - DNA, 25 bp, Homo sapien
gattctccttggcagtgaactactt

SEQ ID NO: 193571 - DNA, 25 bp, Homo sapien
agtggtcaatgggttgttgctgcca

SEQ ID NO: 193572 - DNA, 25 bp, Homo sapien
gttgttgctgccatgagcatgtaca

SEQ ID NO: 193573 - DNA, 25 bp, Homo sapien
gagcatgtacaacctctggagctag

SEQ ID NO: 193574 - DNA, 25 bp, Homo sapien
aggaaagccagttctccaagttctt

SEQ ID NO: 193575 - DNA, 25 bp, Homo sapien
tccaagttcttaacctgtggcactg

SEQ ID NO: 193576 - DNA, 25 bp, Homo sapien
ggaatgttgagttacctcttcatgt

SEQ ID NO: 193577 - DNA, 25 bp, Homo sapien
acctcttcatgttttagacagcaaa

SEQ ID NO: 193578 - DNA, 25 bp, Homo sapien
agtggtggtatatcttatccatatc

SEQ ID NO: 193579 - DNA, 25 bp, Homo sapien
tatccatatctttaggctgctgcag

SEQ ID NO: 193580 - DNA, 25 bp, Homo sapien
ggctgctgcagaattttaaggttat

SEQ ID NO: 193581 - DNA, 25 bp, Homo sapien
ttttatgcaaagactggctctaggt

SEQ ID NO: 193582 - DNA, 25 bp, Homo sapien
aagactggctctaggtatttgagga

SEQ ID NO: 193583 - DNA, 25 bp, Homo sapien
gaggagcacaatacagagattttaa

SEQ ID NO: 193584 - DNA, 25 bp, Homo sapien
atctacactatggtctctgtttctc

SEQ ID NO: 193585 - DNA, 25 bp, Homo sapien
tctctgtttctccaaagtaagtgtt

SEQ ID NO: 193586 - DNA, 25 bp, Homo sapien
aagtgtttgtgatttgttcctcata

SEQ ID NO: 193587 - DNA, 25 bp, Homo sapien
tgatttgttcctcatactgcagtga

SEQ ID NO: 193588 - DNA, 25 bp, Homo sapien
ttaaagtacgtttcaatgttgggtg

SEQ ID NO: 193589 - DNA, 25 bp, Homo sapien
tctctcccagaactggttgcagcta

SEQ ID NO: 193590 - DNA, 25 bp, Homo sapien
ggttgcagctaaaacagagagatct

SEQ ID NO: 193591 - DNA, 25 bp, Homo sapien
gagagatctgactgctggctatagg

SEQ ID NO: 193592 - DNA, 25 bp, Homo sapien
gctggctataggattttggacttaa

SEQ ID NO: 193593 - DNA, 25 bp, Homo sapien
gactgaaattgcaaattgtcctttt

SEQ ID NO: 193594 - DNA, 25 bp, Homo sapien
attgtcctttttcttggcattacag

SEQ ID NO: 193595 - DNA, 25 bp, Homo sapien
gtgaaagtgaaggagctagtctgct

SEQ ID NO: 193596 - DNA, 25 bp, Homo sapien
ggagctagtctgctgaaccaggaat

SEQ ID NO: 193597 - DNA, 25 bp, Homo sapien
tgaactgtcatttttgcacatttga

SEQ ID NO: 193598 - DNA, 25 bp, Homo sapien
gcaggctggctttgtataaacttat

SEQ ID NO: 193599 - DNA, 25 bp, Homo sapien
tatcctctggtttcctatatgttgt

SEQ ID NO: 193600 - DNA, 25 bp, Homo sapien
agagccgggcagctttcttatgcca

SEQ ID NO: 193601 - DNA, 25 bp, Homo sapien
tatgccattttctacactgtgcttc

SEQ ID NO: 193602 - DNA, 25 bp, Homo sapien
tacactgtgcttcatgagtaggact

SEQ ID NO: 193603 - DNA, 25 bp, Homo sapien
agtaggactttcttgcactagttcc

SEQ ID NO: 193604 - DNA, 25 bp, Homo sapien
cactagttcctatgactgagtctcc

SEQ ID NO: 193605 - DNA, 25 bp, Homo sapien
gagtctccaaactggtttcctagta

SEQ ID NO: 193606 - DNA, 25 bp, Homo sapien
agctatgattcagttgtctctgccc

SEQ ID NO: 193607 - DNA, 25 bp, Homo sapien
accctgcctctgtgtttcggtgaga

SEQ ID NO: 193608 - DNA, 25 bp, Homo sapien
gagtctctgtatatgtactgctttc

SEQ ID NO: 193609 - DNA, 25 bp, Homo sapien
cagaggcctctctgctcttgtttaa

SEQ ID NO: 193610 - DNA, 25 bp, Homo sapien
tctgctcttgtttaaccccataaag

SEQ ID NO: 193611 - DNA, 25 bp, Homo sapien
tattgttccttggttgtcagccaag

SEQ ID NO: 193612 - DNA, 25 bp, Homo sapien
gtaattgagttagcttggctgcctt

SEQ ID NO: 193613 - DNA, 25 bp, Homo sapien
aaatcagtctattgcctggcttctt

SEQ ID NO: 193614 - DNA, 25 bp, Homo sapien
ttcttctacacctttcattcttttt

SEQ ID NO: 193615 - DNA, 25 bp, Homo sapien
gtttttgcctcatattccttgttga

SEQ ID NO: 193616 - DNA, 25 bp, Homo sapien
cttgttgaactaaggccagccagac

SEQ ID NO: 193617 - DNA, 25 bp, Homo sapien
taaggccagccagacatcattctct

SEQ ID NO: 193618 - DNA, 25 bp, Homo sapien
tctggactactttggcactacatga

SEQ ID NO: 193619 - DNA, 25 bp, Homo sapien
gcactacatgaatgccttgcctgca

SEQ ID NO: 193620 - DNA, 25 bp, Homo sapien
ttgcctgcaactatcagtgtcccat

SEQ ID NO: 193621 - DNA, 25 bp, Homo sapien
gtgtcccatgcagtaataccatcag

SEQ ID NO: 193622 - DNA, 25 bp, Homo sapien
tattaccaataattaaaggtgccag

SEQ ID NO: 193623 - DNA, 25 bp, Homo sapien
caaataatttttgattgactggtgg

SEQ ID NO: 193624 - DNA, 25 bp, Homo sapien
gattgactggtggaattagatttac

SEQ ID NO: 193625 - DNA, 25 bp, Homo sapien
tgactggtggaattagatttactaa

SEQ ID NO: 193626 - DNA, 25 bp, Homo sapien
ggcttaaattttgactgtactaact

SEQ ID NO: 193627 - DNA, 25 bp, Homo sapien
gcttaaattttgactgtactaacta

SEQ ID NO: 193628 - DNA, 25 bp, Homo sapien
tttgactgtactaactataaatgta

SEQ ID NO: 193629 - DNA, 25 bp, Homo sapien
atggtataaatgcattctacaatgt

SEQ ID NO: 193630 - DNA, 25 bp, Homo sapien
taaatgcattctacaatgtgattat

SEQ ID NO: 193631 - DNA, 25 bp, Homo sapien
tattacatttcttaatccattgttt

SEQ ID NO: 193632 - DNA, 25 bp, Homo sapien
tacatttcttaatccattgttttta

SEQ ID NO: 193633 - DNA, 25 bp, Homo sapien
cccgaagccagctcagtacctgagg

SEQ ID NO: 193634 - DNA, 25 bp, Homo sapien
ctcagtacctgaggggctgctctat

SEQ ID NO: 193635 - DNA, 25 bp, Homo sapien
ctatgctgtgtatgcgcctctctgg

SEQ ID NO: 193636 - DNA, 25 bp, Homo sapien
gtatgcgcctctctggcatccgaga

SEQ ID NO: 193637 - DNA, 25 bp, Homo sapien
tctggcatccgagacatcctcttgg

SEQ ID NO: 193638 - DNA, 25 bp, Homo sapien
atccgagacatcctcttggctggcg

SEQ ID NO: 193639 - DNA, 25 bp, Homo sapien
gagacatcctcttggctggcgcttg

SEQ ID NO: 193640 - DNA, 25 bp, Homo sapien
atcctcttggctggcgcttgctgca

SEQ ID NO: 193641 - DNA, 25 bp, Homo sapien
tccccaggtgaaccaagggtctgct

SEQ ID NO: 193642 - DNA, 25 bp, Homo sapien
atttccagcttggccgccgtctgtg

SEQ ID NO: 193643 - DNA, 25 bp, Homo sapien
cttggccgccgtctgtgaccttggg

SEQ ID NO: 193644 - DNA, 25 bp, Homo sapien
aagatgttctcgatacagtctggca

SEQ ID NO: 193645 - DNA, 25 bp, Homo sapien
gttctcgatacagtctggcaaagac

SEQ ID NO: 193646 - DNA, 25 bp, Homo sapien
ggcaaagactatcccaaggttattt

SEQ ID NO: 193647 - DNA, 25 bp, Homo sapien
gactatcccaaggttattttaatga

SEQ ID NO: 193648 - DNA, 25 bp, Homo sapien
agacattttttcctgtggatatttc

SEQ ID NO: 193649 - DNA, 25 bp, Homo sapien
tgtggatatttctccatcctaaaaa

SEQ ID NO: 193650 - DNA, 25 bp, Homo sapien
ttagatgcaacttactagagtgatg

SEQ ID NO: 193651 - DNA, 25 bp, Homo sapien
ggtgattctggtatcatggtgttta

SEQ ID NO: 193652 - DNA, 25 bp, Homo sapien
aactgcagagaaaatatcctgacta

SEQ ID NO: 193653 - DNA, 25 bp, Homo sapien
tcctttcttttacaaattgtgctga

SEQ ID NO: 193654 - DNA, 25 bp, Homo sapien
attgtgctgaggcaactatggcata

SEQ ID NO: 193655 - DNA, 25 bp, Homo sapien
aaaatgctacttgttgtaataaagg

SEQ ID NO: 193656 - DNA, 25 bp, Homo sapien
aaggttactttatgattttagatat

SEQ ID NO: 193657 - DNA, 25 bp, Homo sapien
ttttcagactcacaatttttatttg

SEQ ID NO: 193658 - DNA, 25 bp, Homo sapien
gcaatgtatcatttcttaatttcct

SEQ ID NO: 193659 - DNA, 25 bp, Homo sapien
cttaatttcctttatgatgcatcac

SEQ ID NO: 193660 - DNA, 25 bp, Homo sapien
ttaatttcctttatgatgcatcact

SEQ ID NO: 193661 - DNA, 25 bp, Homo sapien
taatatcagacctattttttaaagg

SEQ ID NO: 193662 - DNA, 25 bp, Homo sapien
ggaagcaattgatagctacgatgca

SEQ ID NO: 193663 - DNA, 25 bp, Homo sapien
gcaattgatagctacgatgcaaatg

SEQ ID NO: 193664 - DNA, 25 bp, Homo sapien
gctacgatgcaaatgctattcttat

SEQ ID NO: 193665 - DNA, 25 bp, Homo sapien
gatgcaaatgctattcttattaaaa

SEQ ID NO: 193666 - DNA, 25 bp, Homo sapien
tctgcttgtcaggaagagtcacatt

SEQ ID NO: 193667 - DNA, 25 bp, Homo sapien
gagtcacattgctgcttaacatgct

SEQ ID NO: 193668 - DNA, 25 bp, Homo sapien
taacatgctggattgccctagtctt

SEQ ID NO: 193669 - DNA, 25 bp, Homo sapien
ttgccctagtcttcagaatggtcct

SEQ ID NO: 193670 - DNA, 25 bp, Homo sapien
tggtcctgagaaaacatcactactt

SEQ ID NO: 193671 - DNA, 25 bp, Homo sapien
ttcgatgttctactttgctttccaa

SEQ ID NO: 193672 - DNA, 25 bp, Homo sapien
aataactttggagccttctgggaag

SEQ ID NO: 193673 - DNA, 25 bp, Homo sapien
ttctgggaagtgtgcctgggattct

SEQ ID NO: 193674 - DNA, 25 bp, Homo sapien
ctttggcaagaatcccaggcttgac

SEQ ID NO: 193675 - DNA, 25 bp, Homo sapien
caggcttgaccaactggtaccaggt

SEQ ID NO: 193676 - DNA, 25 bp, Homo sapien
ctggtaccaggtcaaagatttttgt

SEQ ID NO: 193677 - DNA, 25 bp, Homo sapien
tgtatgcagtaatcagccaatgtat

SEQ ID NO: 193678 - DNA, 25 bp, Homo sapien
gccaatgtatttatcggcatcgcaa

SEQ ID NO: 193679 - DNA, 25 bp, Homo sapien
ttatcggcatcgcaaggaccatgat

SEQ ID NO: 193680 - DNA, 25 bp, Homo sapien
gaaaacttcagttgttccagatgat

SEQ ID NO: 193681 - DNA, 25 bp, Homo sapien
gatgatgtcatggtatcgagtattc

SEQ ID NO: 193682 - DNA, 25 bp, Homo sapien
tcgagtattctttatattcagttcc

SEQ ID NO: 193683 - DNA, 25 bp, Homo sapien
attcagttcctatttaagtcatttt

SEQ ID NO: 193684 - DNA, 25 bp, Homo sapien
aagtcatttttgtcatgtccgccta

SEQ ID NO: 193685 - DNA, 25 bp, Homo sapien
gtcatgtccgcctaattgatgtagt

SEQ ID NO: 193686 - DNA, 25 bp, Homo sapien
atgtagtatgaaaccctgcatcttt

SEQ ID NO: 193687 - DNA, 25 bp, Homo sapien
tatgaaaccctgcatctttaaggaa

SEQ ID NO: 193688 - DNA, 25 bp, Homo sapien
aggtgtcaaaatcgcctccggtgga

SEQ ID NO: 193689 - DNA, 25 bp, Homo sapien
gcctccggtggatctagctagagca

SEQ ID NO: 193690 - DNA, 25 bp, Homo sapien
atctagctagagcaccgccgcgatt

SEQ ID NO: 193691 - DNA, 25 bp, Homo sapien
cgccgcgattctcaagttgcaaggt

SEQ ID NO: 193692 - DNA, 25 bp, Homo sapien
ggtattcaaggttagcagctgggct

SEQ ID NO: 193693 - DNA, 25 bp, Homo sapien
gggagcagaaaacacacttggaacg

SEQ ID NO: 193694 - DNA, 25 bp, Homo sapien
aacacacttggaacgcagggcagac

SEQ ID NO: 193695 - DNA, 25 bp, Homo sapien
ggaacgcagggcagacaccctgacg

SEQ ID NO: 193696 - DNA, 25 bp, Homo sapien
ggcccttccctgaatcggcaatgca

SEQ ID NO: 193697 - DNA, 25 bp, Homo sapien
ggcaatgcagcaaggttatctttac

SEQ ID NO: 193698 - DNA, 25 bp, Homo sapien
aggttatctttacctttgtagagat

SEQ ID NO: 193699 - DNA, 25 bp, Homo sapien
gacctgtactaatatatggtagtca

SEQ ID NO: 193700 - DNA, 25 bp, Homo sapien
atggtagtcactagcaacctgttga

SEQ ID NO: 193701 - DNA, 25 bp, Homo sapien
ggtagtcactagcaacctgttgagc

SEQ ID NO: 193702 - DNA, 25 bp, Homo sapien
gtcactagcaacctgttgagcactt

SEQ ID NO: 193703 - DNA, 25 bp, Homo sapien
cactagcaacctgttgagcacttga

SEQ ID NO: 193704 - DNA, 25 bp, Homo sapien
gagcacttgaaattgagttattgag

SEQ ID NO: 193705 - DNA, 25 bp, Homo sapien
gagttattgagcactgaaatgtggc

SEQ ID NO: 193706 - DNA, 25 bp, Homo sapien
gtaaaacacaagattctgaagactt

SEQ ID NO: 193707 - DNA, 25 bp, Homo sapien
gattctgaagacttagttattttaa

SEQ ID NO: 193708 - DNA, 25 bp, Homo sapien
aaatttatatatgtagctcacgtat

SEQ ID NO: 193709 - DNA, 25 bp, Homo sapien
tatatgtagctcacgtatttctatt

SEQ ID NO: 193710 - DNA, 25 bp, Homo sapien
gatgagggccggactgcctcccctt

SEQ ID NO: 193711 - DNA, 25 bp, Homo sapien
tgcctccccttaagcagctgtgttg

SEQ ID NO: 193712 - DNA, 25 bp, Homo sapien
agctgtgttggaggtactgcccaga

SEQ ID NO: 193713 - DNA, 25 bp, Homo sapien
aggtactgcccagaccgctgcaggt

SEQ ID NO: 193714 - DNA, 25 bp, Homo sapien
actgctctggtggaaaatccagcct

SEQ ID NO: 193715 - DNA, 25 bp, Homo sapien
tgtcctgggtacaggtggagccacc

SEQ ID NO: 193716 - DNA, 25 bp, Homo sapien
caggagttgcgtgtgtttttcttaa

SEQ ID NO: 193717 - DNA, 25 bp, Homo sapien
agtggtcttttcactacccttgcca

SEQ ID NO: 193718 - DNA, 25 bp, Homo sapien
actacccttgccagaaacatgctag

SEQ ID NO: 193719 - DNA, 25 bp, Homo sapien
aaacatgctaggcaccactgggctc

SEQ ID NO: 193720 - DNA, 25 bp, Homo sapien
gcaccactgggctctgtttctgtcc

SEQ ID NO: 193721 - DNA, 25 bp, Homo sapien
gcacagtctatggaacgctaatgga

SEQ ID NO: 193722 - DNA, 25 bp, Homo sapien
gctaatggagtcagcccctaaagct

SEQ ID NO: 193723 - DNA, 25 bp, Homo sapien
gcccctaaagctgtttgctttttca

SEQ ID NO: 193724 - DNA, 25 bp, Homo sapien
caggctttggattacatgcttttaa

SEQ ID NO: 193725 - DNA, 25 bp, Homo sapien
tagaatctggacactttctatgaat

SEQ ID NO: 193726 - DNA, 25 bp, Homo sapien
aattcggctgagaaacatgttgctg

SEQ ID NO: 193727 - DNA, 25 bp, Homo sapien
gagatgcaatcctcagtgttctctg

SEQ ID NO: 193728 - DNA, 25 bp, Homo sapien
gtatacaccacacgttacaactgca

SEQ ID NO: 193729 - DNA, 25 bp, Homo sapien
gttacaactgcatgagcttcctctc

SEQ ID NO: 193730 - DNA, 25 bp, Homo sapien
tctcgcacaagaccagctggaactg

SEQ ID NO: 193731 - DNA, 25 bp, Homo sapien
ggaactgagcatgagacgctgtcaa

SEQ ID NO: 193732 - DNA, 25 bp, Homo sapien
aggccttgaaggctccaacccagca

SEQ ID NO: 193733 - DNA, 25 bp, Homo sapien
aacccagcagctgccatcaggtgtt

SEQ ID NO: 193734 - DNA, 25 bp, Homo sapien
gctgccatcaggtgttcatgtcagg

SEQ ID NO: 193735 - DNA, 25 bp, Homo sapien
gggtacaattccacctgctacagct

SEQ ID NO: 193736 - DNA, 25 bp, Homo sapien
tgctacagcttcatggcacatcctt

SEQ ID NO: 193737 - DNA, 25 bp, Homo sapien
gatgcaaaacaggagctggactgac

SEQ ID NO: 193738 - DNA, 25 bp, Homo sapien
gctggactgacatcaaacatgctgt

SEQ ID NO: 193739 - DNA, 25 bp, Homo sapien
caaacatgctgtaacttgcaatgaa

SEQ ID NO: 193740 - DNA, 25 bp, Homo sapien
gtcacctaagtacttttttggatca

SEQ ID NO: 193741 - DNA, 25 bp, Homo sapien
tttggatcaaatctatgatgccatc

SEQ ID NO: 193742 - DNA, 25 bp, Homo sapien
gccatcattcttaagatcacccttt

SEQ ID NO: 193743 - DNA, 25 bp, Homo sapien
aatcttggccaggtatgtgggagga

SEQ ID NO: 193744 - DNA, 25 bp, Homo sapien
gtggtgagatcatagctcacacctg

SEQ ID NO: 193745 - DNA, 25 bp, Homo sapien
gtaatcccagcctggaatgcagtgg

SEQ ID NO: 193746 - DNA, 25 bp, Homo sapien
tcacagcaacttcaaactcctgagc

SEQ ID NO: 193747 - DNA, 25 bp, Homo sapien
agtgagccgtcatcacaccagtaca

SEQ ID NO: 193748 - DNA, 25 bp, Homo sapien
cagtacactccaggctaggtcacag

SEQ ID NO: 193749 - DNA, 25 bp, Homo sapien
ctccaggctaggtcacagagaccgt

SEQ ID NO: 193750 - DNA, 25 bp, Homo sapien
ccaggctaggtcacagagaccgtgt

SEQ ID NO: 193751 - DNA, 25 bp, Homo sapien
ctcaagatcctcatagtagacgcaa

SEQ ID NO: 193752 - DNA, 25 bp, Homo sapien
gatcctcatagtagacgcaaacttc

SEQ ID NO: 193753 - DNA, 25 bp, Homo sapien
tagtagacgcaaacttcctttgttg

SEQ ID NO: 193754 - DNA, 25 bp, Homo sapien
tgctctgggactgggcacccacaag

SEQ ID NO: 193755 - DNA, 25 bp, Homo sapien
acccacaagggctcagtgggcccaa

SEQ ID NO: 193756 - DNA, 25 bp, Homo sapien
gctcagtgggcccaaacccttgaaa

SEQ ID NO: 193757 - DNA, 25 bp, Homo sapien
tgggcccaaacccttgaaatccgtg

SEQ ID NO: 193758 - DNA, 25 bp, Homo sapien
gtgaaaccgggtggtcccaagagct

SEQ ID NO: 193759 - DNA, 25 bp, Homo sapien
gctagaaactcaggaaaccccaggt

SEQ ID NO: 193760 - DNA, 25 bp, Homo sapien
tcaggaaaccccaggtgctcagggc

SEQ ID NO: 193761 - DNA, 25 bp, Homo sapien
ggcagacccctgctaatatatgcaa

SEQ ID NO: 193762 - DNA, 25 bp, Homo sapien
gctaatatatgcaattctccctccc

SEQ ID NO: 193763 - DNA, 25 bp, Homo sapien
tgacccctaagttattgcccgctca

SEQ ID NO: 193764 - DNA, 25 bp, Homo sapien
gcgcctgcggtttctatgtatttat

SEQ ID NO: 193765 - DNA, 25 bp, Homo sapien
ccaagattgtggactccacctgaag

SEQ ID NO: 193766 - DNA, 25 bp, Homo sapien
caagattgtggactccacctgaaga

SEQ ID NO: 193767 - DNA, 25 bp, Homo sapien
tgcagaaaataacagtgaagtgatt

SEQ ID NO: 193768 - DNA, 25 bp, Homo sapien
gaagtgattgaaactttcttctgat

SEQ ID NO: 193769 - DNA, 25 bp, Homo sapien
aagtgattgaaactttcttctgatg

SEQ ID NO: 193770 - DNA, 25 bp, Homo sapien
tagtccttcaataggaaattgtaat

SEQ ID NO: 193771 - DNA, 25 bp, Homo sapien
gtccttcaataggaaattgtaatta

SEQ ID NO: 193772 - DNA, 25 bp, Homo sapien
atgtaatctgatttgaatgttatag

SEQ ID NO: 193773 - DNA, 25 bp, Homo sapien
gtaatctgatttgaatgttatagtt

SEQ ID NO: 193774 - DNA, 25 bp, Homo sapien
tctgatttgaatgttatagttgata

SEQ ID NO: 193775 - DNA, 25 bp, Homo sapien
ctgatttgaatgttatagttgataa

SEQ ID NO: 193776 - DNA, 25 bp, Homo sapien
tgctgagttccccatattattacag

SEQ ID NO: 193777 - DNA, 25 bp, Homo sapien
atattattacagttccacatcaagg

SEQ ID NO: 193778 - DNA, 25 bp, Homo sapien
attacagttccacatcaaggccgag

SEQ ID NO: 193779 - DNA, 25 bp, Homo sapien
tacagttccacatcaaggccgagtg

SEQ ID NO: 193780 - DNA, 25 bp, Homo sapien
tcgagccgctcgagtgcccatttga

SEQ ID NO: 193781 - DNA, 25 bp, Homo sapien
gctcgagtgcccatttgagcggcag

SEQ ID NO: 193782 - DNA, 25 bp, Homo sapien
tcgagtgcccatttgagcggcagca

SEQ ID NO: 193783 - DNA, 25 bp, Homo sapien
gtgcccatttgagcggcagcactac

SEQ ID NO: 193784 - DNA, 25 bp, Homo sapien
agcggcagcactacccagaggccta

SEQ ID NO: 193785 - DNA, 25 bp, Homo sapien
ggcagcactacccagaggcctatgc

SEQ ID NO: 193786 - DNA, 25 bp, Homo sapien
ctactcctcctacagcgaggcctgg

SEQ ID NO: 193787 - DNA, 25 bp, Homo sapien
gaaaaacgataatagccttacactg

SEQ ID NO: 193788 - DNA, 25 bp, Homo sapien
gataatagccttacactgagtacaa

SEQ ID NO: 193789 - DNA, 25 bp, Homo sapien
tagccttacactgagtacaaataat

SEQ ID NO: 193790 - DNA, 25 bp, Homo sapien
gatgtgatcatttgtgatgttactt

SEQ ID NO: 193791 - DNA, 25 bp, Homo sapien
attctttatcatatcactttttgta

SEQ ID NO: 193792 - DNA, 25 bp, Homo sapien
tatgttctgttttgtagccttaaga

SEQ ID NO: 193793 - DNA, 25 bp, Homo sapien
gtagccttaagaagtgtttcaaaca

SEQ ID NO: 193794 - DNA, 25 bp, Homo sapien
agtgtttcaaacatatctgaatgta

SEQ ID NO: 193795 - DNA, 25 bp, Homo sapien
ataagagtaaatgccctacatggtg

SEQ ID NO: 193796 - DNA, 25 bp, Homo sapien
aatgccctacatggtgtgatgctgc

SEQ ID NO: 193797 - DNA, 25 bp, Homo sapien
ctacatggtgtgatgctgcattata

SEQ ID NO: 193798 - DNA, 25 bp, Homo sapien
gtgtatggtacatgtacatcaaaat

SEQ ID NO: 193799 - DNA, 25 bp, Homo sapien
atttttgtccttaatcagtgtgata

SEQ ID NO: 193800 - DNA, 25 bp, Homo sapien
gaaaagcaagtacaacctcatagga

SEQ ID NO: 193801 - DNA, 25 bp, Homo sapien
gtacaacctcataggactgattata

SEQ ID NO: 193802 - DNA, 25 bp, Homo sapien
ttctttgagctttgaatcaccaggg

SEQ ID NO: 193803 - DNA, 25 bp, Homo sapien
aaatgactttcaactaaccttgtga

SEQ ID NO: 193804 - DNA, 25 bp, Homo sapien
aactaaccttgtgaatcttttgcag

SEQ ID NO: 193805 - DNA, 25 bp, Homo sapien
tgtgaatcttttgcagtgtactgtg

SEQ ID NO: 193806 - DNA, 25 bp, Homo sapien
gtgtactgtgtgcaataccaagggc

SEQ ID NO: 193807 - DNA, 25 bp, Homo sapien
ataccaagggcatagctccctgtaa

SEQ ID NO: 193808 - DNA, 25 bp, Homo sapien
gcatagctccctgtaatttgggaaa

SEQ ID NO: 193809 - DNA, 25 bp, Homo sapien
tgccatctttccttttgaccttatc

SEQ ID NO: 193810 - DNA, 25 bp, Homo sapien
ttttgaccttatctttccccattag

SEQ ID NO: 193811 - DNA, 25 bp, Homo sapien
attagtccctggtggcacctactct

SEQ ID NO: 193812 - DNA, 25 bp, Homo sapien
cacagtttccccttaggagacagca

SEQ ID NO: 193813 - DNA, 25 bp, Homo sapien
ttccccttaggagacagcatgctgg

SEQ ID NO: 193814 - DNA, 25 bp, Homo sapien
caagcctgatgctggtgtaggcgct

SEQ ID NO: 193815 - DNA, 25 bp, Homo sapien
gtgtaggcgctggaatcagcatgca

SEQ ID NO: 193816 - DNA, 25 bp, Homo sapien
tcagcatgcagcaagctcacagtgc

SEQ ID NO: 193817 - DNA, 25 bp, Homo sapien
aaatgtaaccacctccctgcctaga

SEQ ID NO: 193818 - DNA, 25 bp, Homo sapien
tagaatacacacacgtcctccggtg

SEQ ID NO: 193819 - DNA, 25 bp, Homo sapien
aaccacccagcatctttctttgtga

SEQ ID NO: 193820 - DNA, 25 bp, Homo sapien
gaaatataccagcactactaattaa

SEQ ID NO: 193821 - DNA, 25 bp, Homo sapien
tttcacttgcattaagtctaaactg

SEQ ID NO: 193822 - DNA, 25 bp, Homo sapien
gcagctttgactttgacaggcggtt

SEQ ID NO: 193823 - DNA, 25 bp, Homo sapien
ctttgacaggcggtttgtgcaggaa

SEQ ID NO: 193824 - DNA, 25 bp, Homo sapien
gtgcaggaaagcacagtgccgtgtt

SEQ ID NO: 193825 - DNA, 25 bp, Homo sapien
agcacagtgccgtgttgtttacagc

SEQ ID NO: 193826 - DNA, 25 bp, Homo sapien
agtgccgtgttgtttacagcttttc

SEQ ID NO: 193827 - DNA, 25 bp, Homo sapien
gcttttctagagcagctgtgcgacc

SEQ ID NO: 193828 - DNA, 25 bp, Homo sapien
ttctagagcagctgtgcgaccaggg

SEQ ID NO: 193829 - DNA, 25 bp, Homo sapien
ccagggtagagagtgttgaaattca

SEQ ID NO: 193830 - DNA, 25 bp, Homo sapien
gttgaaattcaataccaaatacagt

SEQ ID NO: 193831 - DNA, 25 bp, Homo sapien
aatacatcccagtaggtccacctag

SEQ ID NO: 193832 - DNA, 25 bp, Homo sapien
cagtaggtccacctagtttacaact

SEQ ID NO: 193833 - DNA, 25 bp, Homo sapien
gtgaaacatttgtctgtatacattt

SEQ ID NO: 193834 - DNA, 25 bp, Homo sapien
ttgtagtctttgtaaagccccaaca

SEQ ID NO: 193835 - DNA, 25 bp, Homo sapien
gtaaagccccaacaataagtacttg

SEQ ID NO: 193836 - DNA, 25 bp, Homo sapien
gtacttggtgtcaatggacttaact

SEQ ID NO: 193837 - DNA, 25 bp, Homo sapien
ggacttaactggatgatgtattttc

SEQ ID NO: 193838 - DNA, 25 bp, Homo sapien
tttctattggtttattgttcctcta

SEQ ID NO: 193839 - DNA, 25 bp, Homo sapien
gttcctctagcttgtaaaccagctt

SEQ ID NO: 193840 - DNA, 25 bp, Homo sapien
ttgcaaatgtgcaccctgtatctgt

SEQ ID NO: 193841 - DNA, 25 bp, Homo sapien
gtgcaccctgtatctgtctaaatta

SEQ ID NO: 193842 - DNA, 25 bp, Homo sapien
gttctttgacaattttggtgctcat

SEQ ID NO: 193843 - DNA, 25 bp, Homo sapien
aattttggtgctcatgtgttttggg

SEQ ID NO: 193844 - DNA, 25 bp, Homo sapien
gaaatgaatctgtcattataccaga

SEQ ID NO: 193845 - DNA, 25 bp, Homo sapien
aattctcagatcaaatgtgccttaa

SEQ ID NO: 193846 - DNA, 25 bp, Homo sapien
cagtgatagacttgccattttaata

SEQ ID NO: 193847 - DNA, 25 bp, Homo sapien
ttaatacacgtcattggagggctgc

SEQ ID NO: 193848 - DNA, 25 bp, Homo sapien
cacgtcattggagggctgcgtattt

SEQ ID NO: 193849 - DNA, 25 bp, Homo sapien
ggctgcgtatttgtaaatagcctga

SEQ ID NO: 193850 - DNA, 25 bp, Homo sapien
aaatagcctgatgctcatttggaaa

SEQ ID NO: 193851 - DNA, 25 bp, Homo sapien
tctattgtacttttcagaaccattt

SEQ ID NO: 193852 - DNA, 25 bp, Homo sapien
gaaccattttgtctcattattcctg

SEQ ID NO: 193853 - DNA, 25 bp, Homo sapien
gctacctctttatactcacactgtc

SEQ ID NO: 193854 - DNA, 25 bp, Homo sapien
tacctctttatactcacactgtcct

SEQ ID NO: 193855 - DNA, 25 bp, Homo sapien
tttatactcacactgtcctcccaat

SEQ ID NO: 193856 - DNA, 25 bp, Homo sapien
tactcacactgtcctcccaatatga

SEQ ID NO: 193857 - DNA, 25 bp, Homo sapien
actgtcctcccaatatgacccatgg

SEQ ID NO: 193858 - DNA, 25 bp, Homo sapien
ccatggtagccactgatcccattac

SEQ ID NO: 193859 - DNA, 25 bp, Homo sapien
tggtagccactgatcccattaccct

SEQ ID NO: 193860 - DNA, 25 bp, Homo sapien
gtagccactgatcccattaccctaa

SEQ ID NO: 193861 - DNA, 25 bp, Homo sapien
actgatcccattaccctaattttgt

SEQ ID NO: 193862 - DNA, 25 bp, Homo sapien
gatcccattaccctaattttgttat

SEQ ID NO: 193863 - DNA, 25 bp, Homo sapien
tggaatcgtaaggtacgcaagcttt

SEQ ID NO: 193864 - DNA, 25 bp, Homo sapien
ctcggtgtggtatttgacaagattt

SEQ ID NO: 193865 - DNA, 25 bp, Homo sapien
gattttagctcaaagcctcaccatg

SEQ ID NO: 193866 - DNA, 25 bp, Homo sapien
aagcctcaccatgaattgatttttt

SEQ ID NO: 193867 - DNA, 25 bp, Homo sapien
gacaattttagatacctgagtgcac

SEQ ID NO: 193868 - DNA, 25 bp, Homo sapien
gagtgcactttttcagttagtccta

SEQ ID NO: 193869 - DNA, 25 bp, Homo sapien
agacatatctggtgtacgtgttgca

SEQ ID NO: 193870 - DNA, 25 bp, Homo sapien
gtgtacgtgttgcagtatgaactct

SEQ ID NO: 193871 - DNA, 25 bp, Homo sapien
gtatgaactctggttgcaatccctc

SEQ ID NO: 193872 - DNA, 25 bp, Homo sapien
ccccatttgagtacgccgcacaagt

SEQ ID NO: 193873 - DNA, 25 bp, Homo sapien
acgccgcacaagtcaaacgctagga

SEQ ID NO: 193874 - DNA, 25 bp, Homo sapien
ctaacttgttgctcatttgttgtaa

SEQ ID NO: 193875 - DNA, 25 bp, Homo sapien
gggagcagaaaaatccaatttgttt

SEQ ID NO: 193876 - DNA, 25 bp, Homo sapien
aagtgaaatccaagatcaacaatct

SEQ ID NO: 193877 - DNA, 25 bp, Homo sapien
atgagggaccaggagtagctgtcat

SEQ ID NO: 193878 - DNA, 25 bp, Homo sapien
gaccaggagtagctgtcatttgata

SEQ ID NO: 193879 - DNA, 25 bp, Homo sapien
gatatgtatcgtagctatagcaaaa

SEQ ID NO: 193880 - DNA, 25 bp, Homo sapien
gaaataatgtgcaagcttctcactt

SEQ ID NO: 193881 - DNA, 25 bp, Homo sapien
aatgtgcaagcttctcacttattga

SEQ ID NO: 193882 - DNA, 25 bp, Homo sapien
ttctcacttattgagtttagtggca

SEQ ID NO: 193883 - DNA, 25 bp, Homo sapien
gtttagtggcataggaaatctttgt

SEQ ID NO: 193884 - DNA, 25 bp, Homo sapien
ggaaatctttgtttgcaagcacatg

SEQ ID NO: 193885 - DNA, 25 bp, Homo sapien
gaaggtacattggagttatcgatag

SEQ ID NO: 193886 - DNA, 25 bp, Homo sapien
tgcctgcgacggtgagaggcctgca

SEQ ID NO: 193887 - DNA, 25 bp, Homo sapien
gggcgtgtctcctggccagaaggct

SEQ ID NO: 193888 - DNA, 25 bp, Homo sapien
tgtgctccatcaggaccaaagcagg

SEQ ID NO: 193889 - DNA, 25 bp, Homo sapien
aggaccaaagcagggctctttcaca

SEQ ID NO: 193890 - DNA, 25 bp, Homo sapien
ggctctttcacatgcccaggacaga

SEQ ID NO: 193891 - DNA, 25 bp, Homo sapien
atgagcctggattggctgcagtctc

SEQ ID NO: 193892 - DNA, 25 bp, Homo sapien
gattggctgcagtctcttgtgctag

SEQ ID NO: 193893 - DNA, 25 bp, Homo sapien
cagtctcttgtgctagtttgtcctt

SEQ ID NO: 193894 - DNA, 25 bp, Homo sapien
gctagtttgtcctttgttttggcca

SEQ ID NO: 193895 - DNA, 25 bp, Homo sapien
tttgtcctttgttttggccagatga

SEQ ID NO: 193896 - DNA, 25 bp, Homo sapien
gttttggccagatgactcaatattt

SEQ ID NO: 193897 - DNA, 25 bp, Homo sapien
ttccagtgctacacccacttcttgg

SEQ ID NO: 193898 - DNA, 25 bp, Homo sapien
agtgctacacccacttcttggctga

SEQ ID NO: 193899 - DNA, 25 bp, Homo sapien
gtgctacacccacttcttggctgac

SEQ ID NO: 193900 - DNA, 25 bp, Homo sapien
tgctacacccacttcttggctgaca

SEQ ID NO: 193901 - DNA, 25 bp, Homo sapien
ccacttcttggctgacacacttctg

SEQ ID NO: 193902 - DNA, 25 bp, Homo sapien
acttcttggctgacacacttctgct

SEQ ID NO: 193903 - DNA, 25 bp, Homo sapien
cttcttggctgacacacttctgctc

SEQ ID NO: 193904 - DNA, 25 bp, Homo sapien
ttcttggctgacacacttctgctct

SEQ ID NO: 193905 - DNA, 25 bp, Homo sapien
tcttggctgacacacttctgctcta

SEQ ID NO: 193906 - DNA, 25 bp, Homo sapien
cttggctgacacacttctgctctaa

SEQ ID NO: 193907 - DNA, 25 bp, Homo sapien
ttggctgacacacttctgctctaag

SEQ ID NO: 193908 - DNA, 25 bp, Homo sapien
aatttctaaccacaagacctctcta

SEQ ID NO: 193909 - DNA, 25 bp, Homo sapien
acaagacctctctataatggtaaat

SEQ ID NO: 193910 - DNA, 25 bp, Homo sapien
gtaagacatcaccattttatcactc

SEQ ID NO: 193911 - DNA, 25 bp, Homo sapien
gacatcaccattttatcactcaaag

SEQ ID NO: 193912 - DNA, 25 bp, Homo sapien
tgaaagtttctatttggttgataaa

SEQ ID NO: 193913 - DNA, 25 bp, Homo sapien
acttttgatgcctgtgatgcaattt

SEQ ID NO: 193914 - DNA, 25 bp, Homo sapien
tattgcctacaatgagatacactta

SEQ ID NO: 193915 - DNA, 25 bp, Homo sapien
aaatctggtatttcaaaattgcatt

SEQ ID NO: 193916 - DNA, 25 bp, Homo sapien
ttgcatttcttgtataataggtcag

SEQ ID NO: 193917 - DNA, 25 bp, Homo sapien
ggtcagatttattaactactcatac

SEQ ID NO: 193918 - DNA, 25 bp, Homo sapien
catactttttctttacactaatcga

SEQ ID NO: 193919 - DNA, 25 bp, Homo sapien
gtcattatatagttcagatgctaat

SEQ ID NO: 193920 - DNA, 25 bp, Homo sapien
gttcagatgctaatattctaagtaa

SEQ ID NO: 193921 - DNA, 25 bp, Homo sapien
actgttaagcaaaacaatgcccatt

SEQ ID NO: 193922 - DNA, 25 bp, Homo sapien
aacaatgcccatttgtcggcttaca

SEQ ID NO: 193923 - DNA, 25 bp, Homo sapien
aatgcccatttgtcggcttacagct

SEQ ID NO: 193924 - DNA, 25 bp, Homo sapien
tgtcggcttacagctcttccggagt

SEQ ID NO: 193925 - DNA, 25 bp, Homo sapien
ccggagtctagagcctgttggtgtt

SEQ ID NO: 193926 - DNA, 25 bp, Homo sapien
agagcctgttggtgttctgtcccta

SEQ ID NO: 193927 - DNA, 25 bp, Homo sapien
ggtgttctgtccctactttaagaat

SEQ ID NO: 193928 - DNA, 25 bp, Homo sapien
gaatttaattgctcacttattctga

SEQ ID NO: 193929 - DNA, 25 bp, Homo sapien
tgctcacttattctgaaagctttgt

SEQ ID NO: 193930 - DNA, 25 bp, Homo sapien
ggatctgtattatctgagggttagt

SEQ ID NO: 193931 - DNA, 25 bp, Homo sapien
gtaactaatgcttagccaggcctgc

SEQ ID NO: 193932 - DNA, 25 bp, Homo sapien
gcttcacagagttgctaccagggag

SEQ ID NO: 193933 - DNA, 25 bp, Homo sapien
gctaccagggagtattctttggata

SEQ ID NO: 193934 - DNA, 25 bp, Homo sapien
gcagcatgtgttttaagctctgtta

SEQ ID NO: 193935 - DNA, 25 bp, Homo sapien
atagataacttcgtaaccaccaggg

SEQ ID NO: 193936 - DNA, 25 bp, Homo sapien
acagaatggctgaggaagatccttg

SEQ ID NO: 193937 - DNA, 25 bp, Homo sapien
aagatccttgggttgtgaagagagt

SEQ ID NO: 193938 - DNA, 25 bp, Homo sapien
gaaaccctagggagcagtgcttttg

SEQ ID NO: 193939 - DNA, 25 bp, Homo sapien
agtgcttttgggtcctagaacctgt

SEQ ID NO: 193940 - DNA, 25 bp, Homo sapien
gggtcctagaacctgttgagtttct

SEQ ID NO: 193941 - DNA, 25 bp, Homo sapien
tatcttctccacgacctcacctata

SEQ ID NO: 193942 - DNA, 25 bp, Homo sapien
ctcacctatacatcccacacaccat

SEQ ID NO: 193943 - DNA, 25 bp, Homo sapien
cacaccatcctccaggtctgggaaa

SEQ ID NO: 193944 - DNA, 25 bp, Homo sapien
ttcttaatgtcacattcccacgcca

SEQ ID NO: 193945 - DNA, 25 bp, Homo sapien
tcttaatgtcacattcccacgccag

SEQ ID NO: 193946 - DNA, 25 bp, Homo sapien
cttaatgtcacattcccacgccagg

SEQ ID NO: 193947 - DNA, 25 bp, Homo sapien
ttaatgtcacattcccacgccaggc

SEQ ID NO: 193948 - DNA, 25 bp, Homo sapien
cacgccaggcccaagagagattcta

SEQ ID NO: 193949 - DNA, 25 bp, Homo sapien
acgccaggcccaagagagattctat

SEQ ID NO: 193950 - DNA, 25 bp, Homo sapien
cgccaggcccaagagagattctatg

SEQ ID NO: 193951 - DNA, 25 bp, Homo sapien
agagagaattctatatcaatatata

SEQ ID NO: 193952 - DNA, 25 bp, Homo sapien
ctttgtagagattggtgacggcggt

SEQ ID NO: 193953 - DNA, 25 bp, Homo sapien
acccagagagaaagtcctggctgct

SEQ ID NO: 193954 - DNA, 25 bp, Homo sapien
cagagagaaagtcctggctgctgac

SEQ ID NO: 193955 - DNA, 25 bp, Homo sapien
agagagaaagtcctggctgctgaca

SEQ ID NO: 193956 - DNA, 25 bp, Homo sapien
gagagaaagtcctggctgctgacac

SEQ ID NO: 193957 - DNA, 25 bp, Homo sapien
agagaaagtcctggctgctgacaca

SEQ ID NO: 193958 - DNA, 25 bp, Homo sapien
agaaagtcctggctgctgacacact

SEQ ID NO: 193959 - DNA, 25 bp, Homo sapien
gaaagtcctggctgctgacacactc

SEQ ID NO: 193960 - DNA, 25 bp, Homo sapien
aaagtcctggctgctgacacactcg

SEQ ID NO: 193961 - DNA, 25 bp, Homo sapien
aagtcctggctgctgacacactcgg

SEQ ID NO: 193962 - DNA, 25 bp, Homo sapien
agtcctggctgctgacacactcggt

SEQ ID NO: 193963 - DNA, 25 bp, Homo sapien
ttatctcttcccttatctacaatcg

SEQ ID NO: 193964 - DNA, 25 bp, Homo sapien
tctcttcccttatctacaatcgtaa

SEQ ID NO: 193965 - DNA, 25 bp, Homo sapien
atctacaatcgtaaaagacagacat

SEQ ID NO: 193966 - DNA, 25 bp, Homo sapien
gacagacattcccaaagcagccatt

SEQ ID NO: 193967 - DNA, 25 bp, Homo sapien
gacattcccaaagcagccatttcag

SEQ ID NO: 193968 - DNA, 25 bp, Homo sapien
gaggcctccccttagaaatgcattc

SEQ ID NO: 193969 - DNA, 25 bp, Homo sapien
tccccttagaaatgcattctctttc

SEQ ID NO: 193970 - DNA, 25 bp, Homo sapien
aatatggctctgttccacccagccc

SEQ ID NO: 193971 - DNA, 25 bp, Homo sapien
cacaggcagccagcctttaaggtta

SEQ ID NO: 193972 - DNA, 25 bp, Homo sapien
ggcagccagcctttaaggttatctc

SEQ ID NO: 193973 - DNA, 25 bp, Homo sapien
cagcctttaaggttatctcccttgt

SEQ ID NO: 193974 - DNA, 25 bp, Homo sapien
gaagcccagtgtaacgtcagtccac

SEQ ID NO: 193975 - DNA, 25 bp, Homo sapien
acgtcagtccacagaaatagccaca

SEQ ID NO: 193976 - DNA, 25 bp, Homo sapien
aaatagccacagcttccagtggtgg

SEQ ID NO: 193977 - DNA, 25 bp, Homo sapien
ccagtggtggccgtagacttggctc

SEQ ID NO: 193978 - DNA, 25 bp, Homo sapien
gacttggctcggaacttagtggcac

SEQ ID NO: 193979 - DNA, 25 bp, Homo sapien
gctcggaacttagtggcaccagagt

SEQ ID NO: 193980 - DNA, 25 bp, Homo sapien
ggcaccagagtaactctagtcagtt

SEQ ID NO: 193981 - DNA, 25 bp, Homo sapien
aggcagaagctagcggttgtatccc

SEQ ID NO: 193982 - DNA, 25 bp, Homo sapien
ggttgtatcccaagcatcttttgta

SEQ ID NO: 193983 - DNA, 25 bp, Homo sapien
cccaagcatcttttgtatttgtctt

SEQ ID NO: 193984 - DNA, 25 bp, Homo sapien
gaattctctgaaatacctattactg

SEQ ID NO: 193985 - DNA, 25 bp, Homo sapien
tcctgctctctgatcttattgctta

SEQ ID NO: 193986 - DNA, 25 bp, Homo sapien
tattgcttataaactttggtgacgg

SEQ ID NO: 193987 - DNA, 25 bp, Homo sapien
aaggccgtatttttagcatctgaca

SEQ ID NO: 193988 - DNA, 25 bp, Homo sapien
aaaaagtggttgtcgcactgggaag

SEQ ID NO: 193989 - DNA, 25 bp, Homo sapien
gagtgatggcctcgtctccagtgct

SEQ ID NO: 193990 - DNA, 25 bp, Homo sapien
cagtgctcctctgggctcttgagtt

SEQ ID NO: 193991 - DNA, 25 bp, Homo sapien
gagttgctgcttgaattgccgtgta

SEQ ID NO: 193992 - DNA, 25 bp, Homo sapien
attgccgtgtagacatttgcttgga

SEQ ID NO: 193993 - DNA, 25 bp, Homo sapien
gagagtccacttgttatttgacgga

SEQ ID NO: 193994 - DNA, 25 bp, Homo sapien
ttgacggaggtaggtttcaacccag

SEQ ID NO: 193995 - DNA, 25 bp, Homo sapien
caacccagagttaatgtcaagcatg

SEQ ID NO: 193996 - DNA, 25 bp, Homo sapien
gagctcatgaatgtctgccaacatg

SEQ ID NO: 193997 - DNA, 25 bp, Homo sapien
gtctgccaacatgtgcttgacaagt

SEQ ID NO: 193998 - DNA, 25 bp, Homo sapien
tgaatccacattctagtcctttatg

SEQ ID NO: 193999 - DNA, 25 bp, Homo sapien
attctagtcctttatgcagtataca

SEQ ID NO: 194000 - DNA, 25 bp, Homo sapien
gtcctgtaggatattctcttcctga

SEQ ID NO: 194001 - DNA, 25 bp, Homo sapien
tctcttcctgatggtgcagaaccca

SEQ ID NO: 194002 - DNA, 25 bp, Homo sapien
tgtggttacagcatactctgtcctt

SEQ ID NO: 194003 - DNA, 25 bp, Homo sapien
tactctgtccttcagaaaggcgtga

SEQ ID NO: 194004 - DNA, 25 bp, Homo sapien
agctgttgaccccttgcagctgttg

SEQ ID NO: 194005 - DNA, 25 bp, Homo sapien
gttggaatctctgcaagaacctctg

SEQ ID NO: 194006 - DNA, 25 bp, Homo sapien
agaacctctgtattcttctaataaa

SEQ ID NO: 194007 - DNA, 25 bp, Homo sapien
tttccattggcttcagggcgcatcc

SEQ ID NO: 194008 - DNA, 25 bp, Homo sapien
gcttcagggcgcatccatgtggata

SEQ ID NO: 194009 - DNA, 25 bp, Homo sapien
tgtggatataggaaaagcctctttc

SEQ ID NO: 194010 - DNA, 25 bp, Homo sapien
agcctctttccacagacttaggaag

SEQ ID NO: 194011 - DNA, 25 bp, Homo sapien
gggctgcactcagcaggctgcttga

SEQ ID NO: 194012 - DNA, 25 bp, Homo sapien
gcttgagtgggagctgactccaaca

SEQ ID NO: 194013 - DNA, 25 bp, Homo sapien
tgggactaggcatgcttccagccct

SEQ ID NO: 194014 - DNA, 25 bp, Homo sapien
cctgctgtcaacacttgcgtacaaa

SEQ ID NO: 194015 - DNA, 25 bp, Homo sapien
ttgcgtacaaacctgcctagctgtt

SEQ ID NO: 194016 - DNA, 25 bp, Homo sapien
gcctagctgttgtaagttttcatca

SEQ ID NO: 194017 - DNA, 25 bp, Homo sapien
aagttttcatcagtagcttaagtac

SEQ ID NO: 194018 - DNA, 25 bp, Homo sapien
gggcagcaccgtgaagacgaatatg

SEQ ID NO: 194019 - DNA, 25 bp, Homo sapien
tgaagacgaatatgatctgtgctgg

SEQ ID NO: 194020 - DNA, 25 bp, Homo sapien
gtgatggcgtgatatgcacctgcaa

SEQ ID NO: 194021 - DNA, 25 bp, Homo sapien
tggcgtgatatgcacctgcaacgga

SEQ ID NO: 194022 - DNA, 25 bp, Homo sapien
acctgcaacggagactccggtgggc

SEQ ID NO: 194023 - DNA, 25 bp, Homo sapien
atctgacggccggtgggaggtgcat

SEQ ID NO: 194024 - DNA, 25 bp, Homo sapien
gaggtgcatggcatcggcagcctca

SEQ ID NO: 194025 - DNA, 25 bp, Homo sapien
atggcatcggcagcctcacgtcggt

SEQ ID NO: 194026 - DNA, 25 bp, Homo sapien
tcacgtcggtccttggttgcaacta

SEQ ID NO: 194027 - DNA, 25 bp, Homo sapien
ggtccttggttgcaactactactac

SEQ ID NO: 194028 - DNA, 25 bp, Homo sapien
ttggttgcaactactactacaagcc

SEQ ID NO: 194029 - DNA, 25 bp, Homo sapien
cactgtggacttgggagaaccattg

SEQ ID NO: 194030 - DNA, 25 bp, Homo sapien
gagaaccattgcattccttgatcat

SEQ ID NO: 194031 - DNA, 25 bp, Homo sapien
cttgatcatcacaggaggcagcata

SEQ ID NO: 194032 - DNA, 25 bp, Homo sapien
gaggcagcatacatccaatggagat

SEQ ID NO: 194033 - DNA, 25 bp, Homo sapien
gatgctaagtctgttttccatacca

SEQ ID NO: 194034 - DNA, 25 bp, Homo sapien
tagctcagaatctcaaagcatcaat

SEQ ID NO: 194035 - DNA, 25 bp, Homo sapien
tcccacccaagtctcacttaattta

SEQ ID NO: 194036 - DNA, 25 bp, Homo sapien
aatttaactcatatcccaggtgtgt

SEQ ID NO: 194037 - DNA, 25 bp, Homo sapien
taactcatatcccaggtgtgtggtg

SEQ ID NO: 194038 - DNA, 25 bp, Homo sapien
gggcagttcctcattatcccatgat

SEQ ID NO: 194039 - DNA, 25 bp, Homo sapien
agttcctcattatcccatgatgtga

SEQ ID NO: 194040 - DNA, 25 bp, Homo sapien
atccaggatttttattcgtcgctta

SEQ ID NO: 194041 - DNA, 25 bp, Homo sapien
ttattcgtcgcttattttatgccaa

SEQ ID NO: 194042 - DNA, 25 bp, Homo sapien
gccaaatgtgatcaaattatgcctg

SEQ ID NO: 194043 - DNA, 25 bp, Homo sapien
aatgtgatcaaattatgcctgtttt

SEQ ID NO: 194044 - DNA, 25 bp, Homo sapien
taactttgtttccaggcttttgcta

SEQ ID NO: 194045 - DNA, 25 bp, Homo sapien
gtttccaggcttttgctactcttca

SEQ ID NO: 194046 - DNA, 25 bp, Homo sapien
gcttttgctactcttcactcagcta

SEQ ID NO: 194047 - DNA, 25 bp, Homo sapien
gtacacttcaaaatttttacgtgat

SEQ ID NO: 194048 - DNA, 25 bp, Homo sapien
acgtgatagtataaaccaatgtgac

SEQ ID NO: 194049 - DNA, 25 bp, Homo sapien
aaccaatgtgacttcatgtgatcat

SEQ ID NO: 194050 - DNA, 25 bp, Homo sapien
gacttcatgtgatcatatccaggat

SEQ ID NO: 194051 - DNA, 25 bp, Homo sapien
agagtggaggcctgccacccagaaa

SEQ ID NO: 194052 - DNA, 25 bp, Homo sapien
gccacccagaaaggcacatactagt

SEQ ID NO: 194053 - DNA, 25 bp, Homo sapien
gcacatactagtgccttttagtaca

SEQ ID NO: 194054 - DNA, 25 bp, Homo sapien
tagtgccttttagtacaattttatg

SEQ ID NO: 194055 - DNA, 25 bp, Homo sapien
agaaaatggcaatgttcctcctatt

SEQ ID NO: 194056 - DNA, 25 bp, Homo sapien
gttcctcctattgatacagatacag

SEQ ID NO: 194057 - DNA, 25 bp, Homo sapien
gatacagatacaggcatatgtcatc

SEQ ID NO: 194058 - DNA, 25 bp, Homo sapien
atatgtcatcttattgcgttttgct

SEQ ID NO: 194059 - DNA, 25 bp, Homo sapien
atcttattgcgttttgctttattgc

SEQ ID NO: 194060 - DNA, 25 bp, Homo sapien
gtttatggcaactctgcgttgagcc

SEQ ID NO: 194061 - DNA, 25 bp, Homo sapien
gcgttgagccagtctattggtgcca

SEQ ID NO: 194062 - DNA, 25 bp, Homo sapien
cactgtggacttgggagaaccattg

SEQ ID NO: 194063 - DNA, 25 bp, Homo sapien
tgggagaaccattgcattccttgat

SEQ ID NO: 194064 - DNA, 25 bp, Homo sapien
gagaaccattgcattccttgatcat

SEQ ID NO: 194065 - DNA, 25 bp, Homo sapien
accattgcattccttgatcatcaca

SEQ ID NO: 194066 - DNA, 25 bp, Homo sapien
atcacaggaggcagcatacatccaa

SEQ ID NO: 194067 - DNA, 25 bp, Homo sapien
gaggcagcatacatccaatggagat

SEQ ID NO: 194068 - DNA, 25 bp, Homo sapien
gcagcatacatccaatggagatgga

SEQ ID NO: 194069 - DNA, 25 bp, Homo sapien
ggagatgctaagtctgttttccata

SEQ ID NO: 194070 - DNA, 25 bp, Homo sapien
gatgctaagtctgttttccatacca

SEQ ID NO: 194071 - DNA, 25 bp, Homo sapien
tccataccagaaaatagctcagaat

SEQ ID NO: 194072 - DNA, 25 bp, Homo sapien
agctcagaatctcaaagcatcaatg

SEQ ID NO: 194073 - DNA, 25 bp, Homo sapien
agcaaagttggaagtgctacacact

SEQ ID NO: 194074 - DNA, 25 bp, Homo sapien
acaagatagcaagggagaaatccac

SEQ ID NO: 194075 - DNA, 25 bp, Homo sapien
ccaaccttgggtattacaattgaat

SEQ ID NO: 194076 - DNA, 25 bp, Homo sapien
tgggtattacaattgaatcatgaga

SEQ ID NO: 194077 - DNA, 25 bp, Homo sapien
taatccaaagcctttcagcaaagaa

SEQ ID NO: 194078 - DNA, 25 bp, Homo sapien
agaaaagcctgcaaccagatgtttt

SEQ ID NO: 194079 - DNA, 25 bp, Homo sapien
aaagcctgcaaccagatgttttact

SEQ ID NO: 194080 - DNA, 25 bp, Homo sapien
gcctgcaaccagatgttttactagt

SEQ ID NO: 194081 - DNA, 25 bp, Homo sapien
gcaaccagatgttttactagtgaat

SEQ ID NO: 194082 - DNA, 25 bp, Homo sapien
cagatgttttactagtgaattccac

SEQ ID NO: 194083 - DNA, 25 bp, Homo sapien
ttactagtgaattccacaaacattt

SEQ ID NO: 194084 - DNA, 25 bp, Homo sapien
gacctgccgatgtatttgtatagtg

SEQ ID NO: 194085 - DNA, 25 bp, Homo sapien
gtatagtggtagaaacatgctgctt

SEQ ID NO: 194086 - DNA, 25 bp, Homo sapien
tagaaacatgctgcttaagtggcct

SEQ ID NO: 194087 - DNA, 25 bp, Homo sapien
tgcttaagtggcctaacctgtttct

SEQ ID NO: 194088 - DNA, 25 bp, Homo sapien
ttaagtggcctaacctgtttcttgc

SEQ ID NO: 194089 - DNA, 25 bp, Homo sapien
gcctaacctgtttcttgccaataag

SEQ ID NO: 194090 - DNA, 25 bp, Homo sapien
gtttcttgccaataagtaggcttat

SEQ ID NO: 194091 - DNA, 25 bp, Homo sapien
tttacgtaattctatatctgtgact

SEQ ID NO: 194092 - DNA, 25 bp, Homo sapien
attctatatctgtgactaggttttt

SEQ ID NO: 194093 - DNA, 25 bp, Homo sapien
tatcaattttcactacctaagcaga

SEQ ID NO: 194094 - DNA, 25 bp, Homo sapien
tcactacctaagcagaatttttctc

SEQ ID NO: 194095 - DNA, 25 bp, Homo sapien
aatgcaggcaccgttaggatattct

SEQ ID NO: 194096 - DNA, 25 bp, Homo sapien
aggatattctctagtcttcacgttt

SEQ ID NO: 194097 - DNA, 25 bp, Homo sapien
attctctagtcttcacgtttctggg

SEQ ID NO: 194098 - DNA, 25 bp, Homo sapien
gggaacagctcagccagttgactgg

SEQ ID NO: 194099 - DNA, 25 bp, Homo sapien
ttctgaccaagagggtgattccagt

SEQ ID NO: 194100 - DNA, 25 bp, Homo sapien
gtgtttcctaaactgttacagtaca

SEQ ID NO: 194101 - DNA, 25 bp, Homo sapien
agtacatttctcagcatccttgtga

SEQ ID NO: 194102 - DNA, 25 bp, Homo sapien
agcatccttgtgacagaaagctgca

SEQ ID NO: 194103 - DNA, 25 bp, Homo sapien
ggcactttttgattcatacagggat

SEQ ID NO: 194104 - DNA, 25 bp, Homo sapien
agggatttcttatgtctttggctac

SEQ ID NO: 194105 - DNA, 25 bp, Homo sapien
tatgtctttggctacactagatatt

SEQ ID NO: 194106 - DNA, 25 bp, Homo sapien
gaacactgtggagagtacatgccta

SEQ ID NO: 194107 - DNA, 25 bp, Homo sapien
tacatgcctagtaagagtactggaa

SEQ ID NO: 194108 - DNA, 25 bp, Homo sapien
actggaaacaacatcctggtgattg

SEQ ID NO: 194109 - DNA, 25 bp, Homo sapien
attggaggtcagcagaagagatttt

SEQ ID NO: 194110 - DNA, 25 bp, Homo sapien
ttgctgccaaagttgtattaacgaa

SEQ ID NO: 194111 - DNA, 25 bp, Homo sapien
cgccatgaagtcagcgtaaataatg

SEQ ID NO: 194112 - DNA, 25 bp, Homo sapien
gtcagcgtaaataatgtaacacata

SEQ ID NO: 194113 - DNA, 25 bp, Homo sapien
taaactgtgcagtaaccattgcttt

SEQ ID NO: 194114 - DNA, 25 bp, Homo sapien
gtgcagtaaccattgctttaataag

SEQ ID NO: 194115 - DNA, 25 bp, Homo sapien
gctttaataagtacagattggccaa

SEQ ID NO: 194116 - DNA, 25 bp, Homo sapien
attggccaatggtctaataatgaac

SEQ ID NO: 194117 - DNA, 25 bp, Homo sapien
gggagtgagcttgctagctgctcca

SEQ ID NO: 194118 - DNA, 25 bp, Homo sapien
tgctagctgctccagtacttgagag

SEQ ID NO: 194119 - DNA, 25 bp, Homo sapien
tacttgagagcgactctgtgtccca

SEQ ID NO: 194120 - DNA, 25 bp, Homo sapien
tgctgcggcagccacgaagccagta

SEQ ID NO: 194121 - DNA, 25 bp, Homo sapien
ggcagccacgaagccagtatggcca

SEQ ID NO: 194122 - DNA, 25 bp, Homo sapien
agtcccagctgtgcttggagtcttt

SEQ ID NO: 194123 - DNA, 25 bp, Homo sapien
agctgtgcttggagtctttatttat

SEQ ID NO: 194124 - DNA, 25 bp, Homo sapien
ttattttaactatttcttcgaacat

SEQ ID NO: 194125 - DNA, 25 bp, Homo sapien
ttcttcgaacattccacatttgatg

SEQ ID NO: 194126 - DNA, 25 bp, Homo sapien
tgatgatacctctttcttccctgag

SEQ ID NO: 194127 - DNA, 25 bp, Homo sapien
tcttccctgagtgtatatgttcgta

SEQ ID NO: 194128 - DNA, 25 bp, Homo sapien
ttctgatgtacaaagcttgattacc

SEQ ID NO: 194129 - DNA, 25 bp, Homo sapien
aagcttgattaccatagaaaaccat

SEQ ID NO: 194130 - DNA, 25 bp, Homo sapien
ccatgattttcagggttaatctctt

SEQ ID NO: 194131 - DNA, 25 bp, Homo sapien
aaatgctgctttcctatcttaccct

SEQ ID NO: 194132 - DNA, 25 bp, Homo sapien
ttcctgctctcctttttgtagtgat

SEQ ID NO: 194133 - DNA, 25 bp, Homo sapien
gggcatggtgtaagtgctccacttt

SEQ ID NO: 194134 - DNA, 25 bp, Homo sapien
aagtgctccactttagagagtgtac

SEQ ID NO: 194135 - DNA, 25 bp, Homo sapien
gagagtgtaccttaattactactgt

SEQ ID NO: 194136 - DNA, 25 bp, Homo sapien
gtaccttaattactactgtatttgc

SEQ ID NO: 194137 - DNA, 25 bp, Homo sapien
gggaaatttaggtcatcatttgatt

SEQ ID NO: 194138 - DNA, 25 bp, Homo sapien
tcatcatttgattttcggaaatcta

SEQ ID NO: 194139 - DNA, 25 bp, Homo sapien
agcctcctcagaagacatcgagcgg

SEQ ID NO: 194140 - DNA, 25 bp, Homo sapien
tcctcagaagacatcgagcggtcct

SEQ ID NO: 194141 - DNA, 25 bp, Homo sapien
agacatcgagcggtcctgagagcct

SEQ ID NO: 194142 - DNA, 25 bp, Homo sapien
catcgagcggtcctgagagcctcct

SEQ ID NO: 194143 - DNA, 25 bp, Homo sapien
ctgtgtgctgtaacctgaagtcaaa

SEQ ID NO: 194144 - DNA, 25 bp, Homo sapien
gaagtcaaaccttaagataatggat

SEQ ID NO: 194145 - DNA, 25 bp, Homo sapien
aatggataatcttcggccaatttat

SEQ ID NO: 194146 - DNA, 25 bp, Homo sapien
taatcttcggccaatttatgcagag

SEQ ID NO: 194147 - DNA, 25 bp, Homo sapien
ttcggccaatttatgcagagtcagc

SEQ ID NO: 194148 - DNA, 25 bp, Homo sapien
gccaatttatgcagagtcagccatt

SEQ ID NO: 194149 - DNA, 25 bp, Homo sapien
atttatgcagagtcagccattcctg

SEQ ID NO: 194150 - DNA, 25 bp, Homo sapien
ggcccctcacagagacagtactttg

SEQ ID NO: 194151 - DNA, 25 bp, Homo sapien
gacagtactttgaaactcatgttga

SEQ ID NO: 194152 - DNA, 25 bp, Homo sapien
catgttgagattttaccctctcctc

SEQ ID NO: 194153 - DNA, 25 bp, Homo sapien
gaaaattatggactgggactcttca

SEQ ID NO: 194154 - DNA, 25 bp, Homo sapien
gggactcttcagaaattctgtcttt

SEQ ID NO: 194155 - DNA, 25 bp, Homo sapien
catccttaactttgtatcctggctt

SEQ ID NO: 194156 - DNA, 25 bp, Homo sapien
gtatcctggcttataacaggccatc

SEQ ID NO: 194157 - DNA, 25 bp, Homo sapien
ttataacaggccatccatttttgta

SEQ ID NO: 194158 - DNA, 25 bp, Homo sapien
aattatataccctggtcccatcttt

SEQ ID NO: 194159 - DNA, 25 bp, Homo sapien
ggtcccatctttctagggcctggat

SEQ ID NO: 194160 - DNA, 25 bp, Homo sapien
tagggcctggatctgcttatagagc

SEQ ID NO: 194161 - DNA, 25 bp, Homo sapien
cagatggaattcaaggcagtgcagc

SEQ ID NO: 194162 - DNA, 25 bp, Homo sapien
agtgcagcaggttcagcgtcttcca

SEQ ID NO: 194163 - DNA, 25 bp, Homo sapien
cgtcttccatttctttcaagctcaa

SEQ ID NO: 194164 - DNA, 25 bp, Homo sapien
caagctcaaatctttcactggatgt

SEQ ID NO: 194165 - DNA, 25 bp, Homo sapien
taatgatccatcacaaagcgaagtc

SEQ ID NO: 194166 - DNA, 25 bp, Homo sapien
gcgaagtcatgggagagccacactt

SEQ ID NO: 194167 - DNA, 25 bp, Homo sapien
ggagagccacacttgatggtggaat

SEQ ID NO: 194168 - DNA, 25 bp, Homo sapien
actgtaatagtgtgctgttcatgga

SEQ ID NO: 194169 - DNA, 25 bp, Homo sapien
tgttcatggaaaccgagggctgcat

SEQ ID NO: 194170 - DNA, 25 bp, Homo sapien
gaaaccgagggctgcatcttgttta

SEQ ID NO: 194171 - DNA, 25 bp, Homo sapien
gcatcttgtttatagtcatctttgt

SEQ ID NO: 194172 - DNA, 25 bp, Homo sapien
tgaccgggccattcccaaatttggg

SEQ ID NO: 194173 - DNA, 25 bp, Homo sapien
gctctcggagcagaagaggccagat

SEQ ID NO: 194174 - DNA, 25 bp, Homo sapien
agaggccagataccctgaagcataa

SEQ ID NO: 194175 - DNA, 25 bp, Homo sapien
gcggttccgttctgaagcgtggtct

SEQ ID NO: 194176 - DNA, 25 bp, Homo sapien
tgaagcgtggtctgctgtcccctgg

SEQ ID NO: 194177 - DNA, 25 bp, Homo sapien
ctccgatttcatcctcagacgtaat

SEQ ID NO: 194178 - DNA, 25 bp, Homo sapien
agacgtaatgctcaccaacagcact

SEQ ID NO: 194179 - DNA, 25 bp, Homo sapien
caacagcacttgcactgagttgact

SEQ ID NO: 194180 - DNA, 25 bp, Homo sapien
tgagttgactcttgcacactcgact

SEQ ID NO: 194181 - DNA, 25 bp, Homo sapien
gcacactcgactccataatatgatg

SEQ ID NO: 194182 - DNA, 25 bp, Homo sapien
gtatgttcacaccaataattgcctg

SEQ ID NO: 194183 - DNA, 25 bp, Homo sapien
gatatatttctgcttgaccagcgag

SEQ ID NO: 194184 - DNA, 25 bp, Homo sapien
gaccagcgagatgtgcattttgcca

SEQ ID NO: 194185 - DNA, 25 bp, Homo sapien
gagatgtgcattttgccaggatcat

SEQ ID NO: 194186 - DNA, 25 bp, Homo sapien
gccaggatcatattggtcatgtcta

SEQ ID NO: 194187 - DNA, 25 bp, Homo sapien
attggtcatgtctattggtgtatta

SEQ ID NO: 194188 - DNA, 25 bp, Homo sapien
gtgtattatttcagtatcaccaatg

SEQ ID NO: 194189 - DNA, 25 bp, Homo sapien
tcagtatcaccaatgttttcagaaa

SEQ ID NO: 194190 - DNA, 25 bp, Homo sapien
gaaatacagtactaattcatcatta

SEQ ID NO: 194191 - DNA, 25 bp, Homo sapien
tatttttctgccttctaacttatag

SEQ ID NO: 194192 - DNA, 25 bp, Homo sapien
atagactcaactatgtatctgtagt

SEQ ID NO: 194193 - DNA, 25 bp, Homo sapien
gtatctgtagtttttgggaatggtt

SEQ ID NO: 194194 - DNA, 25 bp, Homo sapien
gtgcaagtaatcctgctgatccagt

SEQ ID NO: 194195 - DNA, 25 bp, Homo sapien
gtaatcctgctgatccagttgtact

SEQ ID NO: 194196 - DNA, 25 bp, Homo sapien
ctgctgatccagttgtacttaagtg

SEQ ID NO: 194197 - DNA, 25 bp, Homo sapien
atccagttgtacttaagtgtgtaac

SEQ ID NO: 194198 - DNA, 25 bp, Homo sapien
gtttaactgaatgaagccatattaa

SEQ ID NO: 194199 - DNA, 25 bp, Homo sapien
gccatattaataactgcattttcct

SEQ ID NO: 194200 - DNA, 25 bp, Homo sapien
ctccaaactagagtacgtaacattg

SEQ ID NO: 194201 - DNA, 25 bp, Homo sapien
aaactgttacagtcaagaccattaa

SEQ ID NO: 194202 - DNA, 25 bp, Homo sapien
gaccattaatggtcttctccaaaat

SEQ ID NO: 194203 - DNA, 25 bp, Homo sapien
gtgaaaattaagtcttcactttctg

SEQ ID NO: 194204 - DNA, 25 bp, Homo sapien
ttcactttctgtgcaagtaatcctg

SEQ ID NO: 194205 - DNA, 25 bp, Homo sapien
ttctactgccgcctttttcatgtgc

SEQ ID NO: 194206 - DNA, 25 bp, Homo sapien
tactgccgcctttttcatgtgcaac

SEQ ID NO: 194207 - DNA, 25 bp, Homo sapien
tgccgcctttttcatgtgcaaccaa

SEQ ID NO: 194208 - DNA, 25 bp, Homo sapien
gccgcctttttcatgtgcaaccaaa

SEQ ID NO: 194209 - DNA, 25 bp, Homo sapien
ccgcctttttcatgtgcaaccaaaa

SEQ ID NO: 194210 - DNA, 25 bp, Homo sapien
gcctttttcatgtgcaaccaaaatg

SEQ ID NO: 194211 - DNA, 25 bp, Homo sapien
taactaacgttaaaagctgtgatgt

SEQ ID NO: 194212 - DNA, 25 bp, Homo sapien
taacgttaaaagctgtgatgtgtgc

SEQ ID NO: 194213 - DNA, 25 bp, Homo sapien
gttaaaagctgtgatgtgtgcgtag

SEQ ID NO: 194214 - DNA, 25 bp, Homo sapien
gtatgcatgttcatgtctaaagaat

SEQ ID NO: 194215 - DNA, 25 bp, Homo sapien
gcatgttcatgtctaaagaatggct

SEQ ID NO: 194216 - DNA, 25 bp, Homo sapien
aatgcagacagcctcttctcctctg

SEQ ID NO: 194217 - DNA, 25 bp, Homo sapien
gcctcaagaagaatgcagtcctgcc

SEQ ID NO: 194218 - DNA, 25 bp, Homo sapien
aagaatgcagtcctgccaatacctt

SEQ ID NO: 194219 - DNA, 25 bp, Homo sapien
aataccttgattttaagccctgtga

SEQ ID NO: 194220 - DNA, 25 bp, Homo sapien
tttcagattgctgacctccagaaca

SEQ ID NO: 194221 - DNA, 25 bp, Homo sapien
gcagccacgggaaacgaatatagat

SEQ ID NO: 194222 - DNA, 25 bp, Homo sapien
acgaatatagattgtggtgcccaaa

SEQ ID NO: 194223 - DNA, 25 bp, Homo sapien
ggtgcccaaattagagtgctgctgt

SEQ ID NO: 194224 - DNA, 25 bp, Homo sapien
agagtgctgctgtaacacacgccta

SEQ ID NO: 194225 - DNA, 25 bp, Homo sapien
gtaacacacgcctactgattgaagt

SEQ ID NO: 194226 - DNA, 25 bp, Homo sapien
gtggctttggaattgcaacgtggaa

SEQ ID NO: 194227 - DNA, 25 bp, Homo sapien
atgtctactacatctatggcactga

SEQ ID NO: 194228 - DNA, 25 bp, Homo sapien
atgcggtggactatcctgagcggta

SEQ ID NO: 194229 - DNA, 25 bp, Homo sapien
ctgagcggtattgctgtggctgtac

SEQ ID NO: 194230 - DNA, 25 bp, Homo sapien
tgtggctgtaccatcgtgtgacata

SEQ ID NO: 194231 - DNA, 25 bp, Homo sapien
gtgtgacatagcatggctgtcccca

SEQ ID NO: 194232 - DNA, 25 bp, Homo sapien
ctgccattcacgtttgccaaggaag

SEQ ID NO: 194233 - DNA, 25 bp, Homo sapien
acactctctgagtgtgttcactgtt

SEQ ID NO: 194234 - DNA, 25 bp, Homo sapien
actgttggctgcattggacaatcac

SEQ ID NO: 194235 - DNA, 25 bp, Homo sapien
aaccctggcatgtccttccagaaaa

SEQ ID NO: 194236 - DNA, 25 bp, Homo sapien
gcttatcatctatcaagctccaacc

SEQ ID NO: 194237 - DNA, 25 bp, Homo sapien
atacagctcctctggtggaatccat

SEQ ID NO: 194238 - DNA, 25 bp, Homo sapien
gaatatgtaagacttggctcataga

SEQ ID NO: 194239 - DNA, 25 bp, Homo sapien
ggctcatagaaacctaatcagatgg

SEQ ID NO: 194240 - DNA, 25 bp, Homo sapien
gcagtttaggacctgctgtcataaa

SEQ ID NO: 194241 - DNA, 25 bp, Homo sapien
ggacctgctgtcataaatgtgtgaa

SEQ ID NO: 194242 - DNA, 25 bp, Homo sapien
tgtgtgaacaaccttttgtaaccta

SEQ ID NO: 194243 - DNA, 25 bp, Homo sapien
gtaacctaacctattgacctgcatg

SEQ ID NO: 194244 - DNA, 25 bp, Homo sapien
tgcatgttttttctttaccccaatt

SEQ ID NO: 194245 - DNA, 25 bp, Homo sapien
taccccaattcattacatggaggct

SEQ ID NO: 194246 - DNA, 25 bp, Homo sapien
atcttgagtttgctttactggttca

SEQ ID NO: 194247 - DNA, 25 bp, Homo sapien
aagccaggaagaacaactttgtagt

SEQ ID NO: 194248 - DNA, 25 bp, Homo sapien
gttatccaactgtatattgtttact

SEQ ID NO: 194249 - DNA, 25 bp, Homo sapien
gtgcatgtttgggaactggcattac

SEQ ID NO: 194250 - DNA, 25 bp, Homo sapien
ctggcattactggaactaatggttt

SEQ ID NO: 194251 - DNA, 25 bp, Homo sapien
actccagagctgcagtgccactgga

SEQ ID NO: 194252 - DNA, 25 bp, Homo sapien
gtgccactggaggagtcagactacc

SEQ ID NO: 194253 - DNA, 25 bp, Homo sapien
gagtcagactaccatgacatcgtag

SEQ ID NO: 194254 - DNA, 25 bp, Homo sapien
taccatgacatcgtagggaaggagg

SEQ ID NO: 194255 - DNA, 25 bp, Homo sapien
aggttttctataaactgtatcattt

SEQ ID NO: 194256 - DNA, 25 bp, Homo sapien
ctgtatcattttctgctgagggtgg

SEQ ID NO: 194257 - DNA, 25 bp, Homo sapien
ttctgctgagggtggagtgtcccat

SEQ ID NO: 194258 - DNA, 25 bp, Homo sapien
tggagtgtcccatccttttaatcaa

SEQ ID NO: 194259 - DNA, 25 bp, Homo sapien
gtgtcccatccttttaatcaaggtg

SEQ ID NO: 194260 - DNA, 25 bp, Homo sapien
tccacagagcccgagggatgatcta

SEQ ID NO: 194261 - DNA, 25 bp, Homo sapien
gcccgagggatgatctagcctgatt

SEQ ID NO: 194262 - DNA, 25 bp, Homo sapien
tagcctgattcctgcgtgtccgaaa

SEQ ID NO: 194263 - DNA, 25 bp, Homo sapien
tcctgcgtgtccgaaagaacttaac

SEQ ID NO: 194264 - DNA, 25 bp, Homo sapien
taacgttttaaaggtgattgtcaag

SEQ ID NO: 194265 - DNA, 25 bp, Homo sapien
gggttctaatgccagtttcctaatt

SEQ ID NO: 194266 - DNA, 25 bp, Homo sapien
gtttcctaattccatctcactggag

SEQ ID NO: 194267 - DNA, 25 bp, Homo sapien
atgtttaaagttggcctctatccta

SEQ ID NO: 194268 - DNA, 25 bp, Homo sapien
gttggcctctatcctaatgactcaa

SEQ ID NO: 194269 - DNA, 25 bp, Homo sapien
gttcttaactaccatgattgctttt

SEQ ID NO: 194270 - DNA, 25 bp, Homo sapien
gattgcttttgagggcccggaatta

SEQ ID NO: 194271 - DNA, 25 bp, Homo sapien
ccggtcatcgtcctggagaaccaag

SEQ ID NO: 194272 - DNA, 25 bp, Homo sapien
tggagaaccaaggtctccgctgggt

SEQ ID NO: 194273 - DNA, 25 bp, Homo sapien
tctccgctgggtccctaaggataag

SEQ ID NO: 194274 - DNA, 25 bp, Homo sapien
tctactggaagatcgggcccaccag

SEQ ID NO: 194275 - DNA, 25 bp, Homo sapien
agcaccttgtggactttgactgcca

SEQ ID NO: 194276 - DNA, 25 bp, Homo sapien
gtggactttgactgccaccttgatg

SEQ ID NO: 194277 - DNA, 25 bp, Homo sapien
accttgatgacatccggcaggactg

SEQ ID NO: 194278 - DNA, 25 bp, Homo sapien
aggactggaccaaccagcggctcaa

SEQ ID NO: 194279 - DNA, 25 bp, Homo sapien
aacactcaaatcacccagtgggttg

SEQ ID NO: 194280 - DNA, 25 bp, Homo sapien
cagtgggttggtcccactaatggaa

SEQ ID NO: 194281 - DNA, 25 bp, Homo sapien
aatggaaatgcctgagccaggccag

SEQ ID NO: 194282 - DNA, 25 bp, Homo sapien
tactggaacccactgaatttttctt

SEQ ID NO: 194283 - DNA, 25 bp, Homo sapien
gaaccaacattaacatcttcatgat

SEQ ID NO: 194284 - DNA, 25 bp, Homo sapien
aacatcttcatgatttgcatttctt

SEQ ID NO: 194285 - DNA, 25 bp, Homo sapien
tttctgggttctatacatggtctct

SEQ ID NO: 194286 - DNA, 25 bp, Homo sapien
gggttctatacatggtctctcttaa

SEQ ID NO: 194287 - DNA, 25 bp, Homo sapien
atggtctctcttaaggcacctttca

SEQ ID NO: 194288 - DNA, 25 bp, Homo sapien
tcttaaggcacctttcatttcaaga

SEQ ID NO: 194289 - DNA, 25 bp, Homo sapien
attgctatgttcagtccaaacagaa

SEQ ID NO: 194290 - DNA, 25 bp, Homo sapien
aacagaattggtttgggaatcttca

SEQ ID NO: 194291 - DNA, 25 bp, Homo sapien
ggtttgggaatcttcatcattctga

SEQ ID NO: 194292 - DNA, 25 bp, Homo sapien
gaaaatcccctagatactgaattgg

SEQ ID NO: 194293 - DNA, 25 bp, Homo sapien
ataggtatatatttagtggccattt

SEQ ID NO: 194294 - DNA, 25 bp, Homo sapien
tatttagtggccatttattatcaat

SEQ ID NO: 194295 - DNA, 25 bp, Homo sapien
atcaatggtaacacaatggagtact

SEQ ID NO: 194296 - DNA, 25 bp, Homo sapien
gtactaagatggtatttgcacattt

SEQ ID NO: 194297 - DNA, 25 bp, Homo sapien
ggtaatcaactctgctactggcatg

SEQ ID NO: 194298 - DNA, 25 bp, Homo sapien
aactctgctactggcatgatgaaat

SEQ ID NO: 194299 - DNA, 25 bp, Homo sapien
gaaatagtacataactggtcattaa

SEQ ID NO: 194300 - DNA, 25 bp, Homo sapien
tacttctccagtgcgtttttatgaa

SEQ ID NO: 194301 - DNA, 25 bp, Homo sapien
gcgtttttatgaagatctggttgaa

SEQ ID NO: 194302 - DNA, 25 bp, Homo sapien
atttctatgtaaactcaacgatatg

SEQ ID NO: 194303 - DNA, 25 bp, Homo sapien
caacgatatgtttggttttcctgaa

SEQ ID NO: 194304 - DNA, 25 bp, Homo sapien
agccagaagatagttggatcccttt

SEQ ID NO: 194305 - DNA, 25 bp, Homo sapien
ggatccctttacttattaatgccat

SEQ ID NO: 194306 - DNA, 25 bp, Homo sapien
gaatagaatcaaggagctcactcag

SEQ ID NO: 194307 - DNA, 25 bp, Homo sapien
tgaattatgacttttcaggctcatt

SEQ ID NO: 194308 - DNA, 25 bp, Homo sapien
tttcaggctcatttgtactctcttc

SEQ ID NO: 194309 - DNA, 25 bp, Homo sapien
tcatcgtcatggtcaggctctgata

SEQ ID NO: 194310 - DNA, 25 bp, Homo sapien
ggctctgatacctgcttttaaaatg

SEQ ID NO: 194311 - DNA, 25 bp, Homo sapien
agctagaatgcttgctggattgaaa

SEQ ID NO: 194312 - DNA, 25 bp, Homo sapien
aagggagtgcctatctatatttagc

SEQ ID NO: 194313 - DNA, 25 bp, Homo sapien
gcaagagacactattaccaaagatt

SEQ ID NO: 194314 - DNA, 25 bp, Homo sapien
ggttaggccagattgacacctattt

SEQ ID NO: 194315 - DNA, 25 bp, Homo sapien
tgtgtcgtggttgtaattctctcat

SEQ ID NO: 194316 - DNA, 25 bp, Homo sapien
gtgtcgtggttgtaattctctcatg

SEQ ID NO: 194317 - DNA, 25 bp, Homo sapien
gtaattctctcatgtgcatattaag

SEQ ID NO: 194318 - DNA, 25 bp, Homo sapien
gtgcatattaagaagttgctgctca

SEQ ID NO: 194319 - DNA, 25 bp, Homo sapien
gcatattaagaagttgctgctcaga

SEQ ID NO: 194320 - DNA, 25 bp, Homo sapien
aagaagttgctgctcagatgtggct

SEQ ID NO: 194321 - DNA, 25 bp, Homo sapien
gatgtggctcttccctttgcagagg

SEQ ID NO: 194322 - DNA, 25 bp, Homo sapien
gagcctcctcagaagacatcgagcg

SEQ ID NO: 194323 - DNA, 25 bp, Homo sapien
ctgggcacgtttgctgtgtgctgta

SEQ ID NO: 194324 - DNA, 25 bp, Homo sapien
ggcacgtttgctgtgtgctgtaacc

SEQ ID NO: 194325 - DNA, 25 bp, Homo sapien
ttatgcagagtcagccattcctggt

SEQ ID NO: 194326 - DNA, 25 bp, Homo sapien
aggatccgtcattggattggctgcg

SEQ ID NO: 194327 - DNA, 25 bp, Homo sapien
ccacctctctaagcctatggaaaag

SEQ ID NO: 194328 - DNA, 25 bp, Homo sapien
gcctatggaaaagcttctgggtctt

SEQ ID NO: 194329 - DNA, 25 bp, Homo sapien
ttctgggtcttgctggctttttccc

SEQ ID NO: 194330 - DNA, 25 bp, Homo sapien
gctttttccctctgcatcctatgat

SEQ ID NO: 194331 - DNA, 25 bp, Homo sapien
gatcacaaatgctgagagactgcga

SEQ ID NO: 194332 - DNA, 25 bp, Homo sapien
acgggcacgtgaagtcctgttagct

SEQ ID NO: 194333 - DNA, 25 bp, Homo sapien
agtcctgttagcttctcagaaaaca

SEQ ID NO: 194334 - DNA, 25 bp, Homo sapien
agctgactttagtgagcatagcagt

SEQ ID NO: 194335 - DNA, 25 bp, Homo sapien
ggtcaaggtccttttgaaacactgc

SEQ ID NO: 194336 - DNA, 25 bp, Homo sapien
aaacactgcagcgatcttaattttg

SEQ ID NO: 194337 - DNA, 25 bp, Homo sapien
gggacagagaccttgatgatattca

SEQ ID NO: 194338 - DNA, 25 bp, Homo sapien
gatgatattcacacacattcaggaa

SEQ ID NO: 194339 - DNA, 25 bp, Homo sapien
attcacacacattcaggaacctgtt

SEQ ID NO: 194340 - DNA, 25 bp, Homo sapien
caggaacctgttttgatgtattata

SEQ ID NO: 194341 - DNA, 25 bp, Homo sapien
caggaagtgtttttgctaccgtgaa

SEQ ID NO: 194342 - DNA, 25 bp, Homo sapien
ttgctaccgtgaaacctttacctag

SEQ ID NO: 194343 - DNA, 25 bp, Homo sapien
aaacctttacctagatcagccatca

SEQ ID NO: 194344 - DNA, 25 bp, Homo sapien
tagatcagccatcagcctgtcaact

SEQ ID NO: 194345 - DNA, 25 bp, Homo sapien
gccatcagcctgtcaactcagttaa

SEQ ID NO: 194346 - DNA, 25 bp, Homo sapien
tcagcctgtcaactcagttaacaag

SEQ ID NO: 194347 - DNA, 25 bp, Homo sapien
ggaccgaagtgtttcaagtggatct

SEQ ID NO: 194348 - DNA, 25 bp, Homo sapien
ggcaggtaatctttgtatacttctg

SEQ ID NO: 194349 - DNA, 25 bp, Homo sapien
gacaattgccagatctatggcataa

SEQ ID NO: 194350 - DNA, 25 bp, Homo sapien
ggagaactttgtaagaagctgccct

SEQ ID NO: 194351 - DNA, 25 bp, Homo sapien
ttttttatccactcgtaaatctgga

SEQ ID NO: 194352 - DNA, 25 bp, Homo sapien
ggatttatttcttctgttttataca

SEQ ID NO: 194353 - DNA, 25 bp, Homo sapien
acaagctctgttaagttatgtttac

SEQ ID NO: 194354 - DNA, 25 bp, Homo sapien
atgtttacagtatcttgtatcgctg

SEQ ID NO: 194355 - DNA, 25 bp, Homo sapien
gtatcgctgtttacaaatcttgcat

SEQ ID NO: 194356 - DNA, 25 bp, Homo sapien
aatcttgcatggactcctgccacag

SEQ ID NO: 194357 - DNA, 25 bp, Homo sapien
atggactcctgccacagtgaaagaa

SEQ ID NO: 194358 - DNA, 25 bp, Homo sapien
gaaaatcttcatgtcttcaaaaatt

SEQ ID NO: 194359 - DNA, 25 bp, Homo sapien
aaatgtccaggttgctacaagatca

SEQ ID NO: 194360 - DNA, 25 bp, Homo sapien
aatgtccaggttgctacaagatcac

SEQ ID NO: 194361 - DNA, 25 bp, Homo sapien
tgtccaggttgctacaagatcacca

SEQ ID NO: 194362 - DNA, 25 bp, Homo sapien
gtccaggttgctacaagatcaccac

SEQ ID NO: 194363 - DNA, 25 bp, Homo sapien
tccaggttgctacaagatcaccacg

SEQ ID NO: 194364 - DNA, 25 bp, Homo sapien
caggttgctacaagatcaccacggt

SEQ ID NO: 194365 - DNA, 25 bp, Homo sapien
aggttgctacaagatcaccacggtt

SEQ ID NO: 194366 - DNA, 25 bp, Homo sapien
ggttgctacaagatcaccacggttt

SEQ ID NO: 194367 - DNA, 25 bp, Homo sapien
gttgctacaagatcaccacggtttt

SEQ ID NO: 194368 - DNA, 25 bp, Homo sapien
ttgctacaagatcaccacggttttc

SEQ ID NO: 194369 - DNA, 25 bp, Homo sapien
gctacaagatcaccacggttttcag

SEQ ID NO: 194370 - DNA, 25 bp, Homo sapien
ttatgaacacccatttcctgacttt

SEQ ID NO: 194371 - DNA, 25 bp, Homo sapien
tatgaacacccatttcctgactttt

SEQ ID NO: 194372 - DNA, 25 bp, Homo sapien
aaaaatttgcctgctgtgttacaaa

SEQ ID NO: 194373 - DNA, 25 bp, Homo sapien
aaatttgcctgctgtgttacaaaaa

SEQ ID NO: 194374 - DNA, 25 bp, Homo sapien
ttgcctgctgtgttacaaaaataaa

SEQ ID NO: 194375 - DNA, 25 bp, Homo sapien
tatgttgtcctgtgccataaagtga

SEQ ID NO: 194376 - DNA, 25 bp, Homo sapien
gttgtcctgtgccataaagtgatat

SEQ ID NO: 194377 - DNA, 25 bp, Homo sapien
gtcctgtgccataaagtgatatatt

SEQ ID NO: 194378 - DNA, 25 bp, Homo sapien
tattctttggttttgaacattgtaa

SEQ ID NO: 194379 - DNA, 25 bp, Homo sapien
gaacattgtaagttcctaaaaacat

SEQ ID NO: 194380 - DNA, 25 bp, Homo sapien
aatttctttgtgcagaatgatttga

SEQ ID NO: 194381 - DNA, 25 bp, Homo sapien
ctgtcaatggagaagtcatgatttt

SEQ ID NO: 194382 - DNA, 25 bp, Homo sapien
tgtcaatggagaagtcatgattttt

SEQ ID NO: 194383 - DNA, 25 bp, Homo sapien
gtcaatggagaagtcatgattttta

SEQ ID NO: 194384 - DNA, 25 bp, Homo sapien
aatggagaagtcatgatttttattt

SEQ ID NO: 194385 - DNA, 25 bp, Homo sapien
acagagtcaggctctgtgcaggctg

SEQ ID NO: 194386 - DNA, 25 bp, Homo sapien
agtcaggctctgtgcaggctggagt

SEQ ID NO: 194387 - DNA, 25 bp, Homo sapien
aatggtgtgatctcgctcactacaa

SEQ ID NO: 194388 - DNA, 25 bp, Homo sapien
aacctctgctcctggctcaagctat

SEQ ID NO: 194389 - DNA, 25 bp, Homo sapien
acctctgctcctggctcaagctatc

SEQ ID NO: 194390 - DNA, 25 bp, Homo sapien
actcctggactcaactgaccccacc

SEQ ID NO: 194391 - DNA, 25 bp, Homo sapien
tggactcaactgaccccacctcggc

SEQ ID NO: 194392 - DNA, 25 bp, Homo sapien
tgcggcaacaccatggctgggtagt

SEQ ID NO: 194393 - DNA, 25 bp, Homo sapien
agctttaagggcaactccatcctat

SEQ ID NO: 194394 - DNA, 25 bp, Homo sapien
cctatgaagattttgtggccgcgtt

SEQ ID NO: 194395 - DNA, 25 bp, Homo sapien
tgaagattttgtggccgcgttaacc

SEQ ID NO: 194396 - DNA, 25 bp, Homo sapien
ggtgaccaccggaaagaagctttca

SEQ ID NO: 194397 - DNA, 25 bp, Homo sapien
gaagctttcagtattgggatgcaga

SEQ ID NO: 194398 - DNA, 25 bp, Homo sapien
ggatgcagagggacctcagccttta

SEQ ID NO: 194399 - DNA, 25 bp, Homo sapien
atggccatactggacgctttataag

SEQ ID NO: 194400 - DNA, 25 bp, Homo sapien
acgctttataagaggtccatgggct

SEQ ID NO: 194401 - DNA, 25 bp, Homo sapien
tatgatggctgctgggcagcacctc

SEQ ID NO: 194402 - DNA, 25 bp, Homo sapien
cagcacctcctaacttcagggaata

SEQ ID NO: 194403 - DNA, 25 bp, Homo sapien
tgttcatgttctgttctatattttc

SEQ ID NO: 194404 - DNA, 25 bp, Homo sapien
attttcttcacctactctccaaata

SEQ ID NO: 194405 - DNA, 25 bp, Homo sapien
tcttcacctactctccaaatattgt

SEQ ID NO: 194406 - DNA, 25 bp, Homo sapien
acctactctccaaatattgtaatgc

SEQ ID NO: 194407 - DNA, 25 bp, Homo sapien
attgtaatgcaaaaagtctcagtaa

SEQ ID NO: 194408 - DNA, 25 bp, Homo sapien
aaaagtctcagtaatgatttggtag

SEQ ID NO: 194409 - DNA, 25 bp, Homo sapien
gtcattgtttctcttcgataaattt

SEQ ID NO: 194410 - DNA, 25 bp, Homo sapien
tcattaaatacttgttagagggttt

SEQ ID NO: 194411 - DNA, 25 bp, Homo sapien
ttggcctccacaagatggctctatg

SEQ ID NO: 194412 - DNA, 25 bp, Homo sapien
gcctccacaagatggctctatgagt

SEQ ID NO: 194413 - DNA, 25 bp, Homo sapien
aagatggctctatgagtattcttcc

SEQ ID NO: 194414 - DNA, 25 bp, Homo sapien
ttaagacggtgtttgcattctgcag

SEQ ID NO: 194415 - DNA, 25 bp, Homo sapien
attctgcagtatgctctgcctgctg

SEQ ID NO: 194416 - DNA, 25 bp, Homo sapien
tctgcctgctgaactccaccgtgaa

SEQ ID NO: 194417 - DNA, 25 bp, Homo sapien
ggagtaaggacctgcgacacgcttt

SEQ ID NO: 194418 - DNA, 25 bp, Homo sapien
gcgacacgctttccggagcatgttt

SEQ ID NO: 194419 - DNA, 25 bp, Homo sapien
ttccctcttgtgaaggcactgcgca

SEQ ID NO: 194420 - DNA, 25 bp, Homo sapien
tgcgcagcctctggataacagcatg

SEQ ID NO: 194421 - DNA, 25 bp, Homo sapien
gggactcggactgcctgcacaaaca

SEQ ID NO: 194422 - DNA, 25 bp, Homo sapien
agccagtgttcacagggccgcagaa

SEQ ID NO: 194423 - DNA, 25 bp, Homo sapien
gctgcatcaagagcacggtcaagat

SEQ ID NO: 194424 - DNA, 25 bp, Homo sapien
aaggtaaccatgtctgtgtccacag

SEQ ID NO: 194425 - DNA, 25 bp, Homo sapien
acggagacccacagtctctcctggg

SEQ ID NO: 194426 - DNA, 25 bp, Homo sapien
acagtctctcctgggacaactaggg

SEQ ID NO: 194427 - DNA, 25 bp, Homo sapien
gtctctcctgggacaactagggctg

SEQ ID NO: 194428 - DNA, 25 bp, Homo sapien
tctcctgggacaactagggctgcga

SEQ ID NO: 194429 - DNA, 25 bp, Homo sapien
ctgggacaactagggctgcgaatct

SEQ ID NO: 194430 - DNA, 25 bp, Homo sapien
aactagggctgcgaatctagaggag

SEQ ID NO: 194431 - DNA, 25 bp, Homo sapien
gggacctaaagggactacctctgtg

SEQ ID NO: 194432 - DNA, 25 bp, Homo sapien
acctaaagggactacctctgtgcct

SEQ ID NO: 194433 - DNA, 25 bp, Homo sapien
aagggactacctctgtgccttgcca

SEQ ID NO: 194434 - DNA, 25 bp, Homo sapien
ggactacctctgtgccttgccacat

SEQ ID NO: 194435 - DNA, 25 bp, Homo sapien
tgggagctcgccctcagggcctcaa

SEQ ID NO: 194436 - DNA, 25 bp, Homo sapien
gaggtgctaaattgtctgccattac

SEQ ID NO: 194437 - DNA, 25 bp, Homo sapien
ctctgataggaggacaaccatgcaa

SEQ ID NO: 194438 - DNA, 25 bp, Homo sapien
ggaggacaaccatgcaaattgtgaa

SEQ ID NO: 194439 - DNA, 25 bp, Homo sapien
gcaaattgtgaaatagtcctgaagt

SEQ ID NO: 194440 - DNA, 25 bp, Homo sapien
aatagtcctgaagttcttggattac

SEQ ID NO: 194441 - DNA, 25 bp, Homo sapien
gttcttggattactttacacctcag

SEQ ID NO: 194442 - DNA, 25 bp, Homo sapien
ggattactttacacctcagtattga

SEQ ID NO: 194443 - DNA, 25 bp, Homo sapien
acacctcagtattgatttgtcccag

SEQ ID NO: 194444 - DNA, 25 bp, Homo sapien
gaattttctggcctttcatggcaat

SEQ ID NO: 194445 - DNA, 25 bp, Homo sapien
ttttctggcctttcatggcaatgaa

SEQ ID NO: 194446 - DNA, 25 bp, Homo sapien
atcccattttatcatcctttcagtt

SEQ ID NO: 194447 - DNA, 25 bp, Homo sapien
cctatgaagattttgtggccgcgtt

SEQ ID NO: 194448 - DNA, 25 bp, Homo sapien
tatgaagattttgtggccgcgttaa

SEQ ID NO: 194449 - DNA, 25 bp, Homo sapien
tgaagattttgtggccgcgttaacc

SEQ ID NO: 194450 - DNA, 25 bp, Homo sapien
gaagctttcagtattgggatgcaga

SEQ ID NO: 194451 - DNA, 25 bp, Homo sapien
cagtattgggatgcagagggacctc

SEQ ID NO: 194452 - DNA, 25 bp, Homo sapien
tattgggatgcagagggacctcagc

SEQ ID NO: 194453 - DNA, 25 bp, Homo sapien
ggatgcagagggacctcagccttta

SEQ ID NO: 194454 - DNA, 25 bp, Homo sapien
atgcagagggacctcagcctttacc

SEQ ID NO: 194455 - DNA, 25 bp, Homo sapien
gcagagggacctcagcctttacctc

SEQ ID NO: 194456 - DNA, 25 bp, Homo sapien
cagcacctcctaacttcagggaata

SEQ ID NO: 194457 - DNA, 25 bp, Homo sapien
agcacctcctaacttcagggaataa

SEQ ID NO: 194458 - DNA, 25 bp, Homo sapien
gaggtcaagattcctttttccaaat

SEQ ID NO: 194459 - DNA, 25 bp, Homo sapien
ccaaatttttcttctctaatcgagg

SEQ ID NO: 194460 - DNA, 25 bp, Homo sapien
gaatccgggatgttcagcatgagct

SEQ ID NO: 194461 - DNA, 25 bp, Homo sapien
atgttcagcatgagcttccgcttga

SEQ ID NO: 194462 - DNA, 25 bp, Homo sapien
gcttccgcttgataagatctcttct

SEQ ID NO: 194463 - DNA, 25 bp, Homo sapien
gatctcttctataggattcaccttg

SEQ ID NO: 194464 - DNA, 25 bp, Homo sapien
attcaccttggctgataaagtggat

SEQ ID NO: 194465 - DNA, 25 bp, Homo sapien
taaagtggatggtccattcttcctg

SEQ ID NO: 194466 - DNA, 25 bp, Homo sapien
attggcgtgtttactgatccagctc

SEQ ID NO: 194467 - DNA, 25 bp, Homo sapien
aattctccagagcttaacccaaggc

SEQ ID NO: 194468 - DNA, 25 bp, Homo sapien
taagggtactagcatctacaatgat

SEQ ID NO: 194469 - DNA, 25 bp, Homo sapien
agcctctgctaggaccaagccaaga

SEQ ID NO: 194470 - DNA, 25 bp, Homo sapien
taggaccaagccaagaccatctgct

SEQ ID NO: 194471 - DNA, 25 bp, Homo sapien
aagccaagaccatctgctgtcacaa

SEQ ID NO: 194472 - DNA, 25 bp, Homo sapien
aagaccatctgctgtcacaaccact

SEQ ID NO: 194473 - DNA, 25 bp, Homo sapien
gggtctgctggccatcctgaccttg

SEQ ID NO: 194474 - DNA, 25 bp, Homo sapien
tggccatcctgaccttggcagtagc

SEQ ID NO: 194475 - DNA, 25 bp, Homo sapien
gaccttggcagtagccacactgtat

SEQ ID NO: 194476 - DNA, 25 bp, Homo sapien
ggcagtagccacactgtatggacta

SEQ ID NO: 194477 - DNA, 25 bp, Homo sapien
agccacactgtatggactatccctg

SEQ ID NO: 194478 - DNA, 25 bp, Homo sapien
actgtatggactatccctggccaca

SEQ ID NO: 194479 - DNA, 25 bp, Homo sapien
atggactatccctggccacacctgg

SEQ ID NO: 194480 - DNA, 25 bp, Homo sapien
ttaactgatcttcaacccttattgg

SEQ ID NO: 194481 - DNA, 25 bp, Homo sapien
aactgatcttcaacccttattggac

SEQ ID NO: 194482 - DNA, 25 bp, Homo sapien
actgatcttcaacccttattggaca

SEQ ID NO: 194483 - DNA, 25 bp, Homo sapien
gatcttcaacccttattggacataa

SEQ ID NO: 194484 - DNA, 25 bp, Homo sapien
atgtggcaaagcttctacctgatcc

SEQ ID NO: 194485 - DNA, 25 bp, Homo sapien
tgtggcaaagcttctacctgatcct

SEQ ID NO: 194486 - DNA, 25 bp, Homo sapien
tggcaaagcttctacctgatcctca

SEQ ID NO: 194487 - DNA, 25 bp, Homo sapien
gcaaagcttctacctgatcctcaaa

SEQ ID NO: 194488 - DNA, 25 bp, Homo sapien
aaagcttctacctgatcctcaaaac

SEQ ID NO: 194489 - DNA, 25 bp, Homo sapien
tctacctgatcctcaaaactcattg

SEQ ID NO: 194490 - DNA, 25 bp, Homo sapien
tacctgatcctcaaaactcattgaa

SEQ ID NO: 194491 - DNA, 25 bp, Homo sapien
agatcctccaggacgtggacctcaa

SEQ ID NO: 194492 - DNA, 25 bp, Homo sapien
gacggtctggtcgacttcgaagagt

SEQ ID NO: 194493 - DNA, 25 bp, Homo sapien
gagtttgtgcgaatgatgtctcggt

SEQ ID NO: 194494 - DNA, 25 bp, Homo sapien
aatgatgtctcggtgagcctgtaca

SEQ ID NO: 194495 - DNA, 25 bp, Homo sapien
tcggtgagcctgtacagaagctgga

SEQ ID NO: 194496 - DNA, 25 bp, Homo sapien
ggcagcataaaggactcaaggacca

SEQ ID NO: 194497 - DNA, 25 bp, Homo sapien
aaggactcaaggaccacagcctctg

SEQ ID NO: 194498 - DNA, 25 bp, Homo sapien
tctgcccaccagcatgttccttgaa

SEQ ID NO: 194499 - DNA, 25 bp, Homo sapien
cagcatgttccttgaagcccatcgc

SEQ ID NO: 194500 - DNA, 25 bp, Homo sapien
atcccacctgtgtgcagtgcccttg

SEQ ID NO: 194501 - DNA, 25 bp, Homo sapien
tttttcaataaagccgcctggcctt

SEQ ID NO: 194502 - DNA, 25 bp, Homo sapien
caggccacaggctgcagcatggagt

SEQ ID NO: 194503 - DNA, 25 bp, Homo sapien
caggctgcagcatggagtcggccct

SEQ ID NO: 194504 - DNA, 25 bp, Homo sapien
ggaccctggactttggtgctgacgc

SEQ ID NO: 194505 - DNA, 25 bp, Homo sapien
tggactttggtgctgacgcagactt

SEQ ID NO: 194506 - DNA, 25 bp, Homo sapien
tgacgcagacttcgtggtgctcgac

SEQ ID NO: 194507 - DNA, 25 bp, Homo sapien
agacttcgtggtgctcgacgactcc

SEQ ID NO: 194508 - DNA, 25 bp, Homo sapien
cctacatctcgggtgagctggtgtg

SEQ ID NO: 194509 - DNA, 25 bp, Homo sapien
acgcagctaggcagtgacaaggacc

SEQ ID NO: 194510 - DNA, 25 bp, Homo sapien
gcagtgacaaggacctcggctgaga

SEQ ID NO: 194511 - DNA, 25 bp, Homo sapien
caaggacctcggctgagaggacacc

SEQ ID NO: 194512 - DNA, 25 bp, Homo sapien
acacctggccgcagcgggatgccat

SEQ ID NO: 194513 - DNA, 25 bp, Homo sapien
taaccaactttccttcaaagtcagt

SEQ ID NO: 194514 - DNA, 25 bp, Homo sapien
tttccttcaaagtcagttactgcca

SEQ ID NO: 194515 - DNA, 25 bp, Homo sapien
aaagtcagttactgccaattttctg

SEQ ID NO: 194516 - DNA, 25 bp, Homo sapien
agcatgttccatatactaagtctct

SEQ ID NO: 194517 - DNA, 25 bp, Homo sapien
ctaagtctcttttctcacggtagga

SEQ ID NO: 194518 - DNA, 25 bp, Homo sapien
gtctcttttctcacggtaggaaata

SEQ ID NO: 194519 - DNA, 25 bp, Homo sapien
tctcacggtaggaaataatacagcc

SEQ ID NO: 194520 - DNA, 25 bp, Homo sapien
agatatgcagcatccttctcattga

SEQ ID NO: 194521 - DNA, 25 bp, Homo sapien
atatgcagcatccttctcattgatg

SEQ ID NO: 194522 - DNA, 25 bp, Homo sapien
tcattgatgtagaaaattctgcgat

SEQ ID NO: 194523 - DNA, 25 bp, Homo sapien
ccagaaaaatcctggcagcttttct

SEQ ID NO: 194524 - DNA, 25 bp, Homo sapien
cagactttaagattgcccggaggaa

SEQ ID NO: 194525 - DNA, 25 bp, Homo sapien
ccggaggaagcaaactcttcgtata

SEQ ID NO: 194526 - DNA, 25 bp, Homo sapien
aagcaggccatctgcttaacccttg

SEQ ID NO: 194527 - DNA, 25 bp, Homo sapien
taacccttggctccaccataaggca

SEQ ID NO: 194528 - DNA, 25 bp, Homo sapien
ataaggcactgggactcggatttct

SEQ ID NO: 194529 - DNA, 25 bp, Homo sapien
gactcggatttctctatctgataga

SEQ ID NO: 194530 - DNA, 25 bp, Homo sapien
atagaggtattttctgtggccctgg

SEQ ID NO: 194531 - DNA, 25 bp, Homo sapien
aggaagacgtccaccattagccatg

SEQ ID NO: 194532 - DNA, 25 bp, Homo sapien
tagccatgtggcaacctttacttct

SEQ ID NO: 194533 - DNA, 25 bp, Homo sapien
ctttacttctatgcctcacaagtgc

SEQ ID NO: 194534 - DNA, 25 bp, Homo sapien
aagtgcctttcagagagccccaatt

SEQ ID NO: 194535 - DNA, 25 bp, Homo sapien
agcggaacccagcaggaccctcggc

SEQ ID NO: 194536 - DNA, 25 bp, Homo sapien
tgctcagactcacagagctagagtc

SEQ ID NO: 194537 - DNA, 25 bp, Homo sapien
actcacagagctagagtctcactgc

SEQ ID NO: 194538 - DNA, 25 bp, Homo sapien
gcccttggatggtgcctgtgtgcct

SEQ ID NO: 194539 - DNA, 25 bp, Homo sapien
gaacgtggcagaagcagccccatgt

SEQ ID NO: 194540 - DNA, 25 bp, Homo sapien
agaagcagccccatgtgttccctgc

SEQ ID NO: 194541 - DNA, 25 bp, Homo sapien
ccccgacctggagtggataagacaa

SEQ ID NO: 194542 - DNA, 25 bp, Homo sapien
agaggggtattttggagtccacctg

SEQ ID NO: 194543 - DNA, 25 bp, Homo sapien
gtccacctgctgagctggaggcctc

SEQ ID NO: 194544 - DNA, 25 bp, Homo sapien
gaggcctcccactgcaacttttcag

SEQ ID NO: 194545 - DNA, 25 bp, Homo sapien
aacttttcagctcaggggttgttga

SEQ ID NO: 194546 - DNA, 25 bp, Homo sapien
gacagcacatttttggaaactaatc

SEQ ID NO: 194547 - DNA, 25 bp, Homo sapien
gaaactaatctcttttccgtaatat

SEQ ID NO: 194548 - DNA, 25 bp, Homo sapien
tccgtaatatttcctttatttcaat

SEQ ID NO: 194549 - DNA, 25 bp, Homo sapien
cacatttaaggttctttaggattat

SEQ ID NO: 194550 - DNA, 25 bp, Homo sapien
ggcttctgagtgttagctcagtgag

SEQ ID NO: 194551 - DNA, 25 bp, Homo sapien
ttctgagtgttagctcagtgagcta

SEQ ID NO: 194552 - DNA, 25 bp, Homo sapien
tagggatactttgttctcaccactg

SEQ ID NO: 194553 - DNA, 25 bp, Homo sapien
agggatactttgttctcaccactgt

SEQ ID NO: 194554 - DNA, 25 bp, Homo sapien
ggatactttgttctcaccactgtcc

SEQ ID NO: 194555 - DNA, 25 bp, Homo sapien
tttgttctcaccactgtccctatgt

SEQ ID NO: 194556 - DNA, 25 bp, Homo sapien
tgttctcaccactgtccctatgtca

SEQ ID NO: 194557 - DNA, 25 bp, Homo sapien
caggtcccgctgcaggactaccagt

SEQ ID NO: 194558 - DNA, 25 bp, Homo sapien
aggactaccagtctgccttggaagc

SEQ ID NO: 194559 - DNA, 25 bp, Homo sapien
cagtctgccttggaagcctccatga

SEQ ID NO: 194560 - DNA, 25 bp, Homo sapien
gaagcccttcatatcttcaaagcag

SEQ ID NO: 194561 - DNA, 25 bp, Homo sapien
gcccttcatatcttcaaagcagatt

SEQ ID NO: 194562 - DNA, 25 bp, Homo sapien
tctcaccatgtgatcatcccaaaag

SEQ ID NO: 194563 - DNA, 25 bp, Homo sapien
gtgatcatcccaaaagagctggagt

SEQ ID NO: 194564 - DNA, 25 bp, Homo sapien
tcactgcctcttcctattaggagga

SEQ ID NO: 194565 - DNA, 25 bp, Homo sapien
tgcctcttcctattaggaggatggt

SEQ ID NO: 194566 - DNA, 25 bp, Homo sapien
gatggtgaagccagccacggttttc

SEQ ID NO: 194567 - DNA, 25 bp, Homo sapien
gtgaagccagccacggttttcccca

SEQ ID NO: 194568 - DNA, 25 bp, Homo sapien
aaagtgggttgattgctgacagcat

SEQ ID NO: 194569 - DNA, 25 bp, Homo sapien
ctccctgcatttcagacataccagt

SEQ ID NO: 194570 - DNA, 25 bp, Homo sapien
ttttaagtgatttctcagtgctgaa

SEQ ID NO: 194571 - DNA, 25 bp, Homo sapien
tgaaaagcctgtccaggtttccttc

SEQ ID NO: 194572 - DNA, 25 bp, Homo sapien
tctctgtaatactccctttgggcga

SEQ ID NO: 194573 - DNA, 25 bp, Homo sapien
ttgggcgaagctaacatcggtgcct

SEQ ID NO: 194574 - DNA, 25 bp, Homo sapien
gaccttgctgactaggcacatggga

SEQ ID NO: 194575 - DNA, 25 bp, Homo sapien
gctgactaggcacatgggacgcaaa

SEQ ID NO: 194576 - DNA, 25 bp, Homo sapien
aaggccttgcctggcgagttgtcat

SEQ ID NO: 194577 - DNA, 25 bp, Homo sapien
ttgcctggcgagttgtcatgtggtt

SEQ ID NO: 194578 - DNA, 25 bp, Homo sapien
gtggttggtggtgactgttttattt

SEQ ID NO: 194579 - DNA, 25 bp, Homo sapien
catttggttcatgtgcattgtttac

SEQ ID NO: 194580 - DNA, 25 bp, Homo sapien
tctgccaaagaccatgatgtgtgtc

SEQ ID NO: 194581 - DNA, 25 bp, Homo sapien
gtgtctgtatgtttaagttatcgta

SEQ ID NO: 194582 - DNA, 25 bp, Homo sapien
acatggctgttttgttatgccaccc

SEQ ID NO: 194583 - DNA, 25 bp, Homo sapien
atggctgttttgttatgccaccctg

SEQ ID NO: 194584 - DNA, 25 bp, Homo sapien
gctgttttgttatgccaccctgtac

SEQ ID NO: 194585 - DNA, 25 bp, Homo sapien
gttatgccaccctgtaccaggattg

SEQ ID NO: 194586 - DNA, 25 bp, Homo sapien
ctgtaccaggattgctgccgcattc

SEQ ID NO: 194587 - DNA, 25 bp, Homo sapien
gtaccaggattgctgccgcattcca

SEQ ID NO: 194588 - DNA, 25 bp, Homo sapien
attgctgccgcattccactgggtat

SEQ ID NO: 194589 - DNA, 25 bp, Homo sapien
gctgccgcattccactgggtataac

SEQ ID NO: 194590 - DNA, 25 bp, Homo sapien
acagagccaaatgagggctgcagtt

SEQ ID NO: 194591 - DNA, 25 bp, Homo sapien
catgccaagggaatccacccagaat

SEQ ID NO: 194592 - DNA, 25 bp, Homo sapien
caagggaatccacccagaatgcacc

SEQ ID NO: 194593 - DNA, 25 bp, Homo sapien
acccctgaacctcaagatcacggtc

SEQ ID NO: 194594 - DNA, 25 bp, Homo sapien
ggagccccagtctccgcagtggaga

SEQ ID NO: 194595 - DNA, 25 bp, Homo sapien
cccagtctccgcagtggagagcaga

SEQ ID NO: 194596 - DNA, 25 bp, Homo sapien
ggcggtaaagctgctgaccgatctc

SEQ ID NO: 194597 - DNA, 25 bp, Homo sapien
aagtgaaggctcgagacttcctgcc

SEQ ID NO: 194598 - DNA, 25 bp, Homo sapien
cacccagtgggtaggccaagtgtgt

SEQ ID NO: 194599 - DNA, 25 bp, Homo sapien
gttgcttcagcaaaccggaccagga

SEQ ID NO: 194600 - DNA, 25 bp, Homo sapien
tcagcaaaccggaccaggagggcca

SEQ ID NO: 194601 - DNA, 25 bp, Homo sapien
atattattggaagggcacacacgct

SEQ ID NO: 194602 - DNA, 25 bp, Homo sapien
tattggaagggcacacacgcttgct

SEQ ID NO: 194603 - DNA, 25 bp, Homo sapien
ttgctgccagccacgttcttcttgg

SEQ ID NO: 194604 - DNA, 25 bp, Homo sapien
gctgccagccacgttcttcttggtg

SEQ ID NO: 194605 - DNA, 25 bp, Homo sapien
atcatgccagcggagaagagcttga

SEQ ID NO: 194606 - DNA, 25 bp, Homo sapien
agaagagcttgagcctaggaacaca

SEQ ID NO: 194607 - DNA, 25 bp, Homo sapien
aagagcttgagcctaggaacacaat

SEQ ID NO: 194608 - DNA, 25 bp, Homo sapien
gagcttgagcctaggaacacaatga

SEQ ID NO: 194609 - DNA, 25 bp, Homo sapien
gcttgagcctaggaacacaatgatg

SEQ ID NO: 194610 - DNA, 25 bp, Homo sapien
ttgagcctaggaacacaatgatggg

SEQ ID NO: 194611 - DNA, 25 bp, Homo sapien
gggcctggtgtcatttggagagaat

SEQ ID NO: 194612 - DNA, 25 bp, Homo sapien
gaaggacttaggttccgtgagccac

SEQ ID NO: 194613 - DNA, 25 bp, Homo sapien
tccgtgagccacctcacaggttatg

SEQ ID NO: 194614 - DNA, 25 bp, Homo sapien
aaagacagcgtcacaacactgctct

SEQ ID NO: 194615 - DNA, 25 bp, Homo sapien
tcttctggctgctacagacttacta

SEQ ID NO: 194616 - DNA, 25 bp, Homo sapien
aaaggctctattctaccagtgcctc

SEQ ID NO: 194617 - DNA, 25 bp, Homo sapien
cccgcttgtgttgctcaggacgtgg

SEQ ID NO: 194618 - DNA, 25 bp, Homo sapien
ggcttgcaggccacaaatgcagtgt

SEQ ID NO: 194619 - DNA, 25 bp, Homo sapien
aatgcagtgtctccactcaaagaac

SEQ ID NO: 194620 - DNA, 25 bp, Homo sapien
agaacagattatggcctttgcaagc

SEQ ID NO: 194621 - DNA, 25 bp, Homo sapien
gcaaatgagtactcctctcctaaag

SEQ ID NO: 194622 - DNA, 25 bp, Homo sapien
gcccaggacccatcatacatatttt

SEQ ID NO: 194623 - DNA, 25 bp, Homo sapien
taagaaacactaaggcaggacagca

SEQ ID NO: 194624 - DNA, 25 bp, Homo sapien
aaacactaaggcaggacagcagggt

SEQ ID NO: 194625 - DNA, 25 bp, Homo sapien
aacactaaggcaggacagcagggtg

SEQ ID NO: 194626 - DNA, 25 bp, Homo sapien
ctaaggcaggacagcagggtggaaa

SEQ ID NO: 194627 - DNA, 25 bp, Homo sapien
cagcagggtggaaaggtgagggcaa

SEQ ID NO: 194628 - DNA, 25 bp, Homo sapien
aaggtgagggcaattaaggaattat

SEQ ID NO: 194629 - DNA, 25 bp, Homo sapien
gagaagacagtgtatttggtgctaa

SEQ ID NO: 194630 - DNA, 25 bp, Homo sapien
agaagacagtgtatttggtgctaaa

SEQ ID NO: 194631 - DNA, 25 bp, Homo sapien
gacagtgtatttggtgctaaaatgt

SEQ ID NO: 194632 - DNA, 25 bp, Homo sapien
atttggtgctaaaatgtgttcctat

SEQ ID NO: 194633 - DNA, 25 bp, Homo sapien
taaaatgtgttcctatttgttttgt

SEQ ID NO: 194634 - DNA, 25 bp, Homo sapien
gtttctttgaatatgcctaaataac

SEQ ID NO: 194635 - DNA, 25 bp, Homo sapien
aaaatctgacagacaagtaacatgt

SEQ ID NO: 194636 - DNA, 25 bp, Homo sapien
attccttgtctccagtaccacaggc

SEQ ID NO: 194637 - DNA, 25 bp, Homo sapien
agtaccacaggccactcttgacatc

SEQ ID NO: 194638 - DNA, 25 bp, Homo sapien
ttgacatcccatgtttgcctggata

SEQ ID NO: 194639 - DNA, 25 bp, Homo sapien
atgtttgcctggataaagttcctca

SEQ ID NO: 194640 - DNA, 25 bp, Homo sapien
gttcctcatttcaaacagtatacat

SEQ ID NO: 194641 - DNA, 25 bp, Homo sapien
tttgcagttcattatagtaaggctt

SEQ ID NO: 194642 - DNA, 25 bp, Homo sapien
gtaaggcttaacctgtaaacagtat

SEQ ID NO: 194643 - DNA, 25 bp, Homo sapien
tatctgatggcccacctataaataa

SEQ ID NO: 194644 - DNA, 25 bp, Homo sapien
ttgtatgccaccaatttgtattatt

SEQ ID NO: 194645 - DNA, 25 bp, Homo sapien
aaacctgcacctaaagtctcagctg

SEQ ID NO: 194646 - DNA, 25 bp, Homo sapien
gaaagctaggcccttgcctaagaaa

SEQ ID NO: 194647 - DNA, 25 bp, Homo sapien
taggcccttgcctaagaaagcacct

SEQ ID NO: 194648 - DNA, 25 bp, Homo sapien
gaaagcacctcctaaggccaaaacg

SEQ ID NO: 194649 - DNA, 25 bp, Homo sapien
aaaacgcctgccaagaagaccagac

SEQ ID NO: 194650 - DNA, 25 bp, Homo sapien
atccacagtcatcaagaaacctagt

SEQ ID NO: 194651 - DNA, 25 bp, Homo sapien
acctagtggtggctcctcaaagaag

SEQ ID NO: 194652 - DNA, 25 bp, Homo sapien
gctcctcaaagaagcctgcaaccag

SEQ ID NO: 194653 - DNA, 25 bp, Homo sapien
agaagcctgcaaccagtgcaagaaa

SEQ ID NO: 194654 - DNA, 25 bp, Homo sapien
ccgggcaagggcaaatccaccatga

SEQ ID NO: 194655 - DNA, 25 bp, Homo sapien
gggcaaatccaccatgaagaagtct

SEQ ID NO: 194656 - DNA, 25 bp, Homo sapien
aaagccaagttcagagtttatgatt

SEQ ID NO: 194657 - DNA, 25 bp, Homo sapien
tttatgattattgctgcttggacag

SEQ ID NO: 194658 - DNA, 25 bp, Homo sapien
gcttggacagctagagcacatcctc

SEQ ID NO: 194659 - DNA, 25 bp, Homo sapien
gagcacatcctctagttagtttgtg

SEQ ID NO: 194660 - DNA, 25 bp, Homo sapien
gtgctaaaaatactcgaaataccat

SEQ ID NO: 194661 - DNA, 25 bp, Homo sapien
actcgaaataccatttccagttaat

SEQ ID NO: 194662 - DNA, 25 bp, Homo sapien
aagtgtaatcttttggctatataat

SEQ ID NO: 194663 - DNA, 25 bp, Homo sapien
ggacattcacctggaaacttaccaa

SEQ ID NO: 194664 - DNA, 25 bp, Homo sapien
aattctgccatgagtgtgggactaa

SEQ ID NO: 194665 - DNA, 25 bp, Homo sapien
gtgggactaaataccctgtagaatg

SEQ ID NO: 194666 - DNA, 25 bp, Homo sapien
gaatgggccaaattttgctgtgaat

SEQ ID NO: 194667 - DNA, 25 bp, Homo sapien
gttctgaaaaaggtgtaatgcccta

SEQ ID NO: 194668 - DNA, 25 bp, Homo sapien
gaaaaaggtgtaatgccctaatatt

SEQ ID NO: 194669 - DNA, 25 bp, Homo sapien
ttttcattttccagtgcagttagtt

SEQ ID NO: 194670 - DNA, 25 bp, Homo sapien
tcattttccagtgcagttagttacc

SEQ ID NO: 194671 - DNA, 25 bp, Homo sapien
attttccagtgcagttagttacctt

SEQ ID NO: 194672 - DNA, 25 bp, Homo sapien
tttccagtgcagttagttacctttt

SEQ ID NO: 194673 - DNA, 25 bp, Homo sapien
ttacctttttaaacataaatgcaca

SEQ ID NO: 194674 - DNA, 25 bp, Homo sapien
aaatgcacaacaagcaaatgaattt

SEQ ID NO: 194675 - DNA, 25 bp, Homo sapien
gaatttaagagaactaaactggaat

SEQ ID NO: 194676 - DNA, 25 bp, Homo sapien
gttcataaatgaaacccttggacta

SEQ ID NO: 194677 - DNA, 25 bp, Homo sapien
tcataaatgaaacccttggactatt

SEQ ID NO: 194678 - DNA, 25 bp, Homo sapien
aaggaaaccccaattttgatgtatg

SEQ ID NO: 194679 - DNA, 25 bp, Homo sapien
gatgcttaagaaactcttgaaggct

SEQ ID NO: 194680 - DNA, 25 bp, Homo sapien
actcttgaaggctatttgtgttgtt

SEQ ID NO: 194681 - DNA, 25 bp, Homo sapien
aactcagccatccttagagaactgt

SEQ ID NO: 194682 - DNA, 25 bp, Homo sapien
gagaactgtggtgcctgtttctttt

SEQ ID NO: 194683 - DNA, 25 bp, Homo sapien
ttattttgaaggctcaggagcatcc

SEQ ID NO: 194684 - DNA, 25 bp, Homo sapien
ggagcatccataggcatttgctttt

SEQ ID NO: 194685 - DNA, 25 bp, Homo sapien
tttgctttttagaagtgtccactgc

SEQ ID NO: 194686 - DNA, 25 bp, Homo sapien
tatttccagttgcactgtatctctg

SEQ ID NO: 194687 - DNA, 25 bp, Homo sapien
actgtatctctggaagtgatgcatg

SEQ ID NO: 194688 - DNA, 25 bp, Homo sapien
gaattcgattggattgtgtcatttt

SEQ ID NO: 194689 - DNA, 25 bp, Homo sapien
agtccttgaagctttacagttaatt

SEQ ID NO: 194690 - DNA, 25 bp, Homo sapien
aggtatgggcttactggactccaac

SEQ ID NO: 194691 - DNA, 25 bp, Homo sapien
ggactccaacatcttttgtactctt

SEQ ID NO: 194692 - DNA, 25 bp, Homo sapien
tcttttgtactctttcatgcttata

SEQ ID NO: 194693 - DNA, 25 bp, Homo sapien
atagaatctgagttcatgctgaata

SEQ ID NO: 194694 - DNA, 25 bp, Homo sapien
gaatacttttcagccaataatttat

SEQ ID NO: 194695 - DNA, 25 bp, Homo sapien
tttatagcctttcccttaaatcaag

SEQ ID NO: 194696 - DNA, 25 bp, Homo sapien
gtttgtcttttgtcttaacagttct

SEQ ID NO: 194697 - DNA, 25 bp, Homo sapien
cagttctgaatgctgtcctcaaagt

SEQ ID NO: 194698 - DNA, 25 bp, Homo sapien
tgtttcatgtaccaagacccttttc

SEQ ID NO: 194699 - DNA, 25 bp, Homo sapien
accaagacccttttcacagtacaat

SEQ ID NO: 194700 - DNA, 25 bp, Homo sapien
tgggcttgtttttacttgtcctatt

SEQ ID NO: 194701 - DNA, 25 bp, Homo sapien
taattccccactattagcaggcttt

SEQ ID NO: 194702 - DNA, 25 bp, Homo sapien
tccccactattagcaggctttggat

SEQ ID NO: 194703 - DNA, 25 bp, Homo sapien
ggctttggatttgtgcctaaggaat

SEQ ID NO: 194704 - DNA, 25 bp, Homo sapien
atcgttacttggaaatggagcctaa

SEQ ID NO: 194705 - DNA, 25 bp, Homo sapien
gcctaagtctgtggtggacagataa

SEQ ID NO: 194706 - DNA, 25 bp, Homo sapien
tcctgggctgaattatgtagacttg

SEQ ID NO: 194707 - DNA, 25 bp, Homo sapien
tagacttgtgtttgacagctatggg

SEQ ID NO: 194708 - DNA, 25 bp, Homo sapien
gtttgacagctatgggtttatttct

SEQ ID NO: 194709 - DNA, 25 bp, Homo sapien
ttttcttttctcattatgttacttc

SEQ ID NO: 194710 - DNA, 25 bp, Homo sapien
cattatgttacttctagtgttcacc

SEQ ID NO: 194711 - DNA, 25 bp, Homo sapien
agaaagaactggcaaaagtcactat

SEQ ID NO: 194712 - DNA, 25 bp, Homo sapien
aaagtcactatcaagaaggaagatc

SEQ ID NO: 194713 - DNA, 25 bp, Homo sapien
ctcgagcagcagcagaacgcagttt

SEQ ID NO: 194714 - DNA, 25 bp, Homo sapien
cgcagtttgcgggaacacatgggca

SEQ ID NO: 194715 - DNA, 25 bp, Homo sapien
aacacatgggcaacgtggtagaggc

SEQ ID NO: 194716 - DNA, 25 bp, Homo sapien
tggtagaggcgcttattgccctaac

SEQ ID NO: 194717 - DNA, 25 bp, Homo sapien
ttattgccctaaccaactgatgcgt

SEQ ID NO: 194718 - DNA, 25 bp, Homo sapien
taaccaactgatgcgtgctttctca

SEQ ID NO: 194719 - DNA, 25 bp, Homo sapien
gatgcgtgctttctcaaatatacct

SEQ ID NO: 194720 - DNA, 25 bp, Homo sapien
gtgctttctcaaatatacctactgg

SEQ ID NO: 194721 - DNA, 25 bp, Homo sapien
atatacctactggattaatttatgg

SEQ ID NO: 194722 - DNA, 25 bp, Homo sapien
ctctggctgtctgcttttgcagggc

SEQ ID NO: 194723 - DNA, 25 bp, Homo sapien
gctgtctgcttttgcagggctgctg

SEQ ID NO: 194724 - DNA, 25 bp, Homo sapien
tttaagctctgtgagaatcctggga

SEQ ID NO: 194725 - DNA, 25 bp, Homo sapien
agctctgtgagaatcctgggagttg

SEQ ID NO: 194726 - DNA, 25 bp, Homo sapien
gtgatgtcagactagttgggtcatt

SEQ ID NO: 194727 - DNA, 25 bp, Homo sapien
tcatttgaaggttagcagcccgggt

SEQ ID NO: 194728 - DNA, 25 bp, Homo sapien
tagcagcccgggtagggttcaccga

SEQ ID NO: 194729 - DNA, 25 bp, Homo sapien
gggttcaccgaaagttcactcgcat

SEQ ID NO: 194730 - DNA, 25 bp, Homo sapien
aagttcactcgcatatattaggcaa

SEQ ID NO: 194731 - DNA, 25 bp, Homo sapien
cactcgcatatattaggcaattcaa

SEQ ID NO: 194732 - DNA, 25 bp, Homo sapien
ggcaattcaatctttcattctgtgt

SEQ ID NO: 194733 - DNA, 25 bp, Homo sapien
tttatagcctttcccttaaatcaag

SEQ ID NO: 194734 - DNA, 25 bp, Homo sapien
tatagcctttcccttaaatcaagat

SEQ ID NO: 194735 - DNA, 25 bp, Homo sapien
gtttgtcttttgtcttaacagttct

SEQ ID NO: 194736 - DNA, 25 bp, Homo sapien
gtcttttgtcttaacagttctgaat

SEQ ID NO: 194737 - DNA, 25 bp, Homo sapien
cagttctgaatgctgtcctcaaagt

SEQ ID NO: 194738 - DNA, 25 bp, Homo sapien
gaatgctgtcctcaaagtatataat

SEQ ID NO: 194739 - DNA, 25 bp, Homo sapien
gctgtcctcaaagtatataatgttt

SEQ ID NO: 194740 - DNA, 25 bp, Homo sapien
taatgtttcatgtaccaagaccctt

SEQ ID NO: 194741 - DNA, 25 bp, Homo sapien
gtttcatgtaccaagacccttttca

SEQ ID NO: 194742 - DNA, 25 bp, Homo sapien
accaagacccttttcacagtacaat

SEQ ID NO: 194743 - DNA, 25 bp, Homo sapien
gacccttttcacagtacaataaaca

SEQ ID NO: 194744 - DNA, 25 bp, Homo sapien
tttccccagtaacattcctgaattt

SEQ ID NO: 194745 - DNA, 25 bp, Homo sapien
attgtagtacttgcatgacatggat

SEQ ID NO: 194746 - DNA, 25 bp, Homo sapien
gacatggattcctgatatctgatga

SEQ ID NO: 194747 - DNA, 25 bp, Homo sapien
taatgacaccaaaaggctcagccca

SEQ ID NO: 194748 - DNA, 25 bp, Homo sapien
cctatctcatgttcagtctgtctaa

SEQ ID NO: 194749 - DNA, 25 bp, Homo sapien
ctgtctaatacatgccagagatttt

SEQ ID NO: 194750 - DNA, 25 bp, Homo sapien
aaagtgctttatccctacaatgtac

SEQ ID NO: 194751 - DNA, 25 bp, Homo sapien
tccctacaatgtactgacagttctt

SEQ ID NO: 194752 - DNA, 25 bp, Homo sapien
gacagttcttacagttgaggatttg

SEQ ID NO: 194753 - DNA, 25 bp, Homo sapien
gaggatttggttcttttcagctaat

SEQ ID NO: 194754 - DNA, 25 bp, Homo sapien
cttttcagctaattgcttggtggat

SEQ ID NO: 194755 - DNA, 25 bp, Homo sapien
gatgacagcgacttggcaatattta

SEQ ID NO: 194756 - DNA, 25 bp, Homo sapien
ttctcagtggagaccgcccaggttt

SEQ ID NO: 194757 - DNA, 25 bp, Homo sapien
gaccgcccaggtttgctgaatgtga

SEQ ID NO: 194758 - DNA, 25 bp, Homo sapien
gtttgctgaatgtgaagcccattga

SEQ ID NO: 194759 - DNA, 25 bp, Homo sapien
gaagacattcaagacaacctgctac

SEQ ID NO: 194760 - DNA, 25 bp, Homo sapien
agacaacctgctacaagccctggag

SEQ ID NO: 194761 - DNA, 25 bp, Homo sapien
tgagtcctcacagctgtttgccaag

SEQ ID NO: 194762 - DNA, 25 bp, Homo sapien
gacagacctcagacagattgtcacg

SEQ ID NO: 194763 - DNA, 25 bp, Homo sapien
gattgtcacggaacacgtgcagcta

SEQ ID NO: 194764 - DNA, 25 bp, Homo sapien
gtgcagctactgcaggtgatcaaga

SEQ ID NO: 194765 - DNA, 25 bp, Homo sapien
agacagacatgagtcttcacccgct

SEQ ID NO: 194766 - DNA, 25 bp, Homo sapien
aggaccactctgagggactcttctg

SEQ ID NO: 194767 - DNA, 25 bp, Homo sapien
ggactcttctgcatattgctgacct

SEQ ID NO: 194768 - DNA, 25 bp, Homo sapien
attgctgacctgagaggatggcctc

SEQ ID NO: 194769 - DNA, 25 bp, Homo sapien
gagaggatggcctcagagctgactt

SEQ ID NO: 194770 - DNA, 25 bp, Homo sapien
tcagagctgacttgggcaatcctcc

SEQ ID NO: 194771 - DNA, 25 bp, Homo sapien
ttgggcaatcctccccaacaggaag

SEQ ID NO: 194772 - DNA, 25 bp, Homo sapien
tgccactgaggaaacaggtcatgaa

SEQ ID NO: 194773 - DNA, 25 bp, Homo sapien
gtcatgaaggtggagataagctgca

SEQ ID NO: 194774 - DNA, 25 bp, Homo sapien
atgtcagtggaaaacgtgtctcttt

SEQ ID NO: 194775 - DNA, 25 bp, Homo sapien
acgtgtctctttaaagctgctatgt

SEQ ID NO: 194776 - DNA, 25 bp, Homo sapien
gctatgtgaacagcttttacagtca

SEQ ID NO: 194777 - DNA, 25 bp, Homo sapien
gtacagtattttcaaacttcccagt

SEQ ID NO: 194778 - DNA, 25 bp, Homo sapien
aagaatatttctcatgttcatacca

SEQ ID NO: 194779 - DNA, 25 bp, Homo sapien
ataccatggatttttctccgagaag

SEQ ID NO: 194780 - DNA, 25 bp, Homo sapien
ctccgagaagtggatactttgcctt

SEQ ID NO: 194781 - DNA, 25 bp, Homo sapien
aaggccctgatgtataggttgcacc

SEQ ID NO: 194782 - DNA, 25 bp, Homo sapien
taggttgcaccattactcagacttc

SEQ ID NO: 194783 - DNA, 25 bp, Homo sapien
tttgaagtccagttgagtcacaaga

SEQ ID NO: 194784 - DNA, 25 bp, Homo sapien
gagaagcctgtcttgatatatcatc

SEQ ID NO: 194785 - DNA, 25 bp, Homo sapien
atatcatctcagaaactttcctgaa

SEQ ID NO: 194786 - DNA, 25 bp, Homo sapien
gatttatagatccagctgtgcttaa

SEQ ID NO: 194787 - DNA, 25 bp, Homo sapien
gatccagctgtgcttaagagccagt

SEQ ID NO: 194788 - DNA, 25 bp, Homo sapien
agtgagtgctgctcatgtcctcccc

SEQ ID NO: 194789 - DNA, 25 bp, Homo sapien
gctgctgctttgaaagcgggatctt

SEQ ID NO: 194790 - DNA, 25 bp, Homo sapien
gggatcttggagacaggccatccat

SEQ ID NO: 194791 - DNA, 25 bp, Homo sapien
ctggagcctcatggaacaggatgat

SEQ ID NO: 194792 - DNA, 25 bp, Homo sapien
ggatgatggcactgagaaagccaat

SEQ ID NO: 194793 - DNA, 25 bp, Homo sapien
agccaatgaccgaatctcttttctc

SEQ ID NO: 194794 - DNA, 25 bp, Homo sapien
gtagactgaaaagccatgtgtattt

SEQ ID NO: 194795 - DNA, 25 bp, Homo sapien
aagccatgtgtattttcctatgtgc

SEQ ID NO: 194796 - DNA, 25 bp, Homo sapien
tattttcctatgtgctgtagctctc

SEQ ID NO: 194797 - DNA, 25 bp, Homo sapien
gtgctgtagctctcctttggaaata

SEQ ID NO: 194798 - DNA, 25 bp, Homo sapien
tggaaataaatcacaggcatctgga

SEQ ID NO: 194799 - DNA, 25 bp, Homo sapien
caaaacagccacaataatcagagat

SEQ ID NO: 194800 - DNA, 25 bp, Homo sapien
atggagcaaaccagtgccatccagt

SEQ ID NO: 194801 - DNA, 25 bp, Homo sapien
aaaccagtgccatccagtctttatg

SEQ ID NO: 194802 - DNA, 25 bp, Homo sapien
cagtgccatccagtctttatgcaaa

SEQ ID NO: 194803 - DNA, 25 bp, Homo sapien
gtgccatccagtctttatgcaaatg

SEQ ID NO: 194804 - DNA, 25 bp, Homo sapien
aaatgaaatgctgcaaagggaagca

SEQ ID NO: 194805 - DNA, 25 bp, Homo sapien
aagcagattctgtatatgttggtaa

SEQ ID NO: 194806 - DNA, 25 bp, Homo sapien
gtatatgttggtaactacccaccaa

SEQ ID NO: 194807 - DNA, 25 bp, Homo sapien
tgttggtaactacccaccaagagca

SEQ ID NO: 194808 - DNA, 25 bp, Homo sapien
aatgcacaaaatgaagggactagtt

SEQ ID NO: 194809 - DNA, 25 bp, Homo sapien
atgctaacatagctatggaggaatt

SEQ ID NO: 194810 - DNA, 25 bp, Homo sapien
aaggagatctgcgacactgtggact

SEQ ID NO: 194811 - DNA, 25 bp, Homo sapien
tggactgaacacactgaagctctga

SEQ ID NO: 194812 - DNA, 25 bp, Homo sapien
actgaagctctgatgggaaaacctg

SEQ ID NO: 194813 - DNA, 25 bp, Homo sapien
acctggtgactgatatagttgttca

SEQ ID NO: 194814 - DNA, 25 bp, Homo sapien
gaatacaacacacaaccaggcagcc

SEQ ID NO: 194815 - DNA, 25 bp, Homo sapien
aggcagccttcttgactatactttg

SEQ ID NO: 194816 - DNA, 25 bp, Homo sapien
gactatactttgcacatgttttctt

SEQ ID NO: 194817 - DNA, 25 bp, Homo sapien
gttttctttaggaattcactcacac

SEQ ID NO: 194818 - DNA, 25 bp, Homo sapien
gaattcactcacacatttaaaccag

SEQ ID NO: 194819 - DNA, 25 bp, Homo sapien
aaaccagttagtgccttctagaaga

SEQ ID NO: 194820 - DNA, 25 bp, Homo sapien
cttctagaagaatggctttcctttc

SEQ ID NO: 194821 - DNA, 25 bp, Homo sapien
ttttaacggagacaaaggatggtat

SEQ ID NO: 194822 - DNA, 25 bp, Homo sapien
taacggagacaaaggatggtattta

SEQ ID NO: 194823 - DNA, 25 bp, Homo sapien
ttttttcatttcacacaaagattta

SEQ ID NO: 194824 - DNA, 25 bp, Homo sapien
atatcttacttgataaggattttta

SEQ ID NO: 194825 - DNA, 25 bp, Homo sapien
cacttttcagagtatatgtttttca

SEQ ID NO: 194826 - DNA, 25 bp, Homo sapien
gcaaaattgtaactcagatttgtga

SEQ ID NO: 194827 - DNA, 25 bp, Homo sapien
cagatttgtgatgctaggaacatga

SEQ ID NO: 194828 - DNA, 25 bp, Homo sapien
gtgatgctaggaacatgagcaaact

SEQ ID NO: 194829 - DNA, 25 bp, Homo sapien
acatgagcaaactgaaaattactat

SEQ ID NO: 194830 - DNA, 25 bp, Homo sapien
gaaaattactatgcacttgtcagaa

SEQ ID NO: 194831 - DNA, 25 bp, Homo sapien
aattactatgcacttgtcagaaaca

SEQ ID NO: 194832 - DNA, 25 bp, Homo sapien
gacaaactagtatctattcctgatg

SEQ ID NO: 194833 - DNA, 25 bp, Homo sapien
ttgccaaagcatcagtacaggactt

SEQ ID NO: 194834 - DNA, 25 bp, Homo sapien
acaatgtgatgagcattccccacca

SEQ ID NO: 194835 - DNA, 25 bp, Homo sapien
attccccaccacatcattgtcaagt

SEQ ID NO: 194836 - DNA, 25 bp, Homo sapien
cacatcattgtcaagttcccacagg

SEQ ID NO: 194837 - DNA, 25 bp, Homo sapien
agttcccacaggtatttaatacaag

SEQ ID NO: 194838 - DNA, 25 bp, Homo sapien
atacaaggctgtttaaggtcaaaga

SEQ ID NO: 194839 - DNA, 25 bp, Homo sapien
gacacttgtttcttacctatttagg

SEQ ID NO: 194840 - DNA, 25 bp, Homo sapien
acctatttaggaagagcacagtatg

SEQ ID NO: 194841 - DNA, 25 bp, Homo sapien
gcacagtatgatccagcaaaaccta

SEQ ID NO: 194842 - DNA, 25 bp, Homo sapien
aaacctaactacatctctttggaca

SEQ ID NO: 194843 - DNA, 25 bp, Homo sapien
agcggaacccagcaggaccctcggc

SEQ ID NO: 194844 - DNA, 25 bp, Homo sapien
tgctcagactcacagagctagagtc

SEQ ID NO: 194845 - DNA, 25 bp, Homo sapien
actcacagagctagagtctcactgc

SEQ ID NO: 194846 - DNA, 25 bp, Homo sapien
ggatggctgtggagggaacgtggca

SEQ ID NO: 194847 - DNA, 25 bp, Homo sapien
gaacgtggcagaagcagccccatgt

SEQ ID NO: 194848 - DNA, 25 bp, Homo sapien
cgtggcagaagcagccccatgtgtt

SEQ ID NO: 194849 - DNA, 25 bp, Homo sapien
agaagcagccccatgtgttccctgc

SEQ ID NO: 194850 - DNA, 25 bp, Homo sapien
ccccgacctggagtggataagacaa

SEQ ID NO: 194851 - DNA, 25 bp, Homo sapien
agaggggtattttggagtccacctg

SEQ ID NO: 194852 - DNA, 25 bp, Homo sapien
gaggcctcccactgcaacttttcag

SEQ ID NO: 194853 - DNA, 25 bp, Homo sapien
aacttttcagctcaggggttgttga

SEQ ID NO: 194854 - DNA, 25 bp, Homo sapien
gctataattgaaaccttatggctta

SEQ ID NO: 194855 - DNA, 25 bp, Homo sapien
tcctttttgattcatgtttgtagtc

SEQ ID NO: 194856 - DNA, 25 bp, Homo sapien
gtttgtagtcatgttgtcaacagag

SEQ ID NO: 194857 - DNA, 25 bp, Homo sapien
gtcaacagaggcaaagttaagcttg

SEQ ID NO: 194858 - DNA, 25 bp, Homo sapien
gcttgatgatggttaaaatcggttt

SEQ ID NO: 194859 - DNA, 25 bp, Homo sapien
aatcggtttgatagcaccatgggac

SEQ ID NO: 194860 - DNA, 25 bp, Homo sapien
tttgatagcaccatgggacattttt

SEQ ID NO: 194861 - DNA, 25 bp, Homo sapien
taaatgcatgaagagacatagcctt

SEQ ID NO: 194862 - DNA, 25 bp, Homo sapien
gacatagccttttagttttgctaat

SEQ ID NO: 194863 - DNA, 25 bp, Homo sapien
aatggaaatgctttacaggaagtaa

SEQ ID NO: 194864 - DNA, 25 bp, Homo sapien
gcaaattacttttaagtgtgcttta

SEQ ID NO: 194865 - DNA, 25 bp, Homo sapien
gaagatctgcactattaactttgtg

SEQ ID NO: 194866 - DNA, 25 bp, Homo sapien
aaacaatattaaaccgcccaagcag

SEQ ID NO: 194867 - DNA, 25 bp, Homo sapien
tattaaaccgcccaagcagtgtgcc

SEQ ID NO: 194868 - DNA, 25 bp, Homo sapien
gcccaagcagtgtgccctagcagag

SEQ ID NO: 194869 - DNA, 25 bp, Homo sapien
aaaatgcaacatctcgcaagcgctg

SEQ ID NO: 194870 - DNA, 25 bp, Homo sapien
gcaagcgctgctgtaacgacttcag

SEQ ID NO: 194871 - DNA, 25 bp, Homo sapien
gtaacgacttcaggagtcactgatt

SEQ ID NO: 194872 - DNA, 25 bp, Homo sapien
ggagtcactgattcagcactaattt

SEQ ID NO: 194873 - DNA, 25 bp, Homo sapien
agcactaatttcctgctgtgaaaac

SEQ ID NO: 194874 - DNA, 25 bp, Homo sapien
catttttgccgtggataggcgcttt

SEQ ID NO: 194875 - DNA, 25 bp, Homo sapien
ggcgcttttattaattgttgtccta

SEQ ID NO: 194876 - DNA, 25 bp, Homo sapien
cagctaacaagggaagtgaaggacc

SEQ ID NO: 194877 - DNA, 25 bp, Homo sapien
aagtggaaaaacgttccatgctcac

SEQ ID NO: 194878 - DNA, 25 bp, Homo sapien
gaaaaacgttccatgctcacagata

SEQ ID NO: 194879 - DNA, 25 bp, Homo sapien
aaaacgttccatgctcacagatagg

SEQ ID NO: 194880 - DNA, 25 bp, Homo sapien
aacgttccatgctcacagataggaa

SEQ ID NO: 194881 - DNA, 25 bp, Homo sapien
tccatgctcacagataggaagaatc

SEQ ID NO: 194882 - DNA, 25 bp, Homo sapien
gaaaatggcaataccacccaaagtg

SEQ ID NO: 194883 - DNA, 25 bp, Homo sapien
atggcaataccacccaaagtgacct

SEQ ID NO: 194884 - DNA, 25 bp, Homo sapien
ggcaataccacccaaagtgacctaa

SEQ ID NO: 194885 - DNA, 25 bp, Homo sapien
taccacccaaagtgacctaaagatt

SEQ ID NO: 194886 - DNA, 25 bp, Homo sapien
agtgacctaaagattcaatgctatt

SEQ ID NO: 194887 - DNA, 25 bp, Homo sapien
gccccaaactcgaggctatgcagac

SEQ ID NO: 194888 - DNA, 25 bp, Homo sapien
aagcaggtcagcaacatcggtcgca

SEQ ID NO: 194889 - DNA, 25 bp, Homo sapien
caggtcagcaacatcggtcgcaagg

SEQ ID NO: 194890 - DNA, 25 bp, Homo sapien
aacatcggtcgcaaggactacctgg

SEQ ID NO: 194891 - DNA, 25 bp, Homo sapien
gtcgcaaggactacctggcccacag

SEQ ID NO: 194892 - DNA, 25 bp, Homo sapien
aagactgccaccagtctacacatac

SEQ ID NO: 194893 - DNA, 25 bp, Homo sapien
tgccaccagtctacacatacagcag

SEQ ID NO: 194894 - DNA, 25 bp, Homo sapien
ggacagaatcagcatttcagctcag

SEQ ID NO: 194895 - DNA, 25 bp, Homo sapien
aatcagcatttcagctcagctggcc

SEQ ID NO: 194896 - DNA, 25 bp, Homo sapien
ctgcctgttccctgtgctcttcaga

SEQ ID NO: 194897 - DNA, 25 bp, Homo sapien
ttgtttccttttaccccagctgcca

SEQ ID NO: 194898 - DNA, 25 bp, Homo sapien
actgcccctgatggaactcatggag

SEQ ID NO: 194899 - DNA, 25 bp, Homo sapien
gaagctctggaaatcctcaccaaag

SEQ ID NO: 194900 - DNA, 25 bp, Homo sapien
aaagccctccggagctaccagttag

SEQ ID NO: 194901 - DNA, 25 bp, Homo sapien
ttagggatcggcagggaccacttcc

SEQ ID NO: 194902 - DNA, 25 bp, Homo sapien
gggaccacttcctgactaaggagct

SEQ ID NO: 194903 - DNA, 25 bp, Homo sapien
gctgcagcgatacatcgaagggctc

SEQ ID NO: 194904 - DNA, 25 bp, Homo sapien
aagggctcaagaagcgccggagcaa

SEQ ID NO: 194905 - DNA, 25 bp, Homo sapien
agcaagaggctgtacgtgaattaaa

SEQ ID NO: 194906 - DNA, 25 bp, Homo sapien
ttaaaaacgccaccttgggctcgag

SEQ ID NO: 194907 - DNA, 25 bp, Homo sapien
ttgggctcgagcagcgacccgaacc

SEQ ID NO: 194908 - DNA, 25 bp, Homo sapien
ctgaccccatccgagtggaatttga

SEQ ID NO: 194909 - DNA, 25 bp, Homo sapien
gtaaagcatttaccatatcctaaat

SEQ ID NO: 194910 - DNA, 25 bp, Homo sapien
catatcctaaatttgcactctttgc

SEQ ID NO: 194911 - DNA, 25 bp, Homo sapien
aatttgcactctttgcagacttgtg

SEQ ID NO: 194912 - DNA, 25 bp, Homo sapien
gcactctttgcagacttgtgcacat

SEQ ID NO: 194913 - DNA, 25 bp, Homo sapien
gacttgtgcacatatattccgcttt

SEQ ID NO: 194914 - DNA, 25 bp, Homo sapien
gtgcacatatattccgctttcagaa

SEQ ID NO: 194915 - DNA, 25 bp, Homo sapien
attccgctttcagaatagttttgca

SEQ ID NO: 194916 - DNA, 25 bp, Homo sapien
taaatctccagttatagtcaattac

SEQ ID NO: 194917 - DNA, 25 bp, Homo sapien
agtcaattactacccatgttgtaca

SEQ ID NO: 194918 - DNA, 25 bp, Homo sapien
gttgtacaacagataccttctattt

SEQ ID NO: 194919 - DNA, 25 bp, Homo sapien
acagataccttctattttagttgct

SEQ ID NO: 194920 - DNA, 25 bp, Homo sapien
agcaacatccagctctctgccatgg

SEQ ID NO: 194921 - DNA, 25 bp, Homo sapien
gcaacatccagctctctgccatggg

SEQ ID NO: 194922 - DNA, 25 bp, Homo sapien
tgccatgggcctctaccagagcttg

SEQ ID NO: 194923 - DNA, 25 bp, Homo sapien
catgggcctctaccagagcttgggc

SEQ ID NO: 194924 - DNA, 25 bp, Homo sapien
ggccagtccttcttccacgtgtggg

SEQ ID NO: 194925 - DNA, 25 bp, Homo sapien
agtccttcttccacgtgtgggccag

SEQ ID NO: 194926 - DNA, 25 bp, Homo sapien
tctgctcaggcagggcgtctatgat

SEQ ID NO: 194927 - DNA, 25 bp, Homo sapien
ctcaggcagggcgtctatgatttct

SEQ ID NO: 194928 - DNA, 25 bp, Homo sapien
caggcagggcgtctatgatttcttt

SEQ ID NO: 194929 - DNA, 25 bp, Homo sapien
tttctttccttctgtattggtcaga

SEQ ID NO: 194930 - DNA, 25 bp, Homo sapien
tctttccttctgtattggtcagaat

SEQ ID NO: 194931 - DNA, 25 bp, Homo sapien
cagataccgctaataaattgcagta

SEQ ID NO: 194932 - DNA, 25 bp, Homo sapien
ataaattgcagtagtccttcccatg

SEQ ID NO: 194933 - DNA, 25 bp, Homo sapien
aaattgcagtagtccttcccatgga

SEQ ID NO: 194934 - DNA, 25 bp, Homo sapien
attgcagtagtccttcccatggagc

SEQ ID NO: 194935 - DNA, 25 bp, Homo sapien
agtagtccttcccatggagccaaag

SEQ ID NO: 194936 - DNA, 25 bp, Homo sapien
tagtccttcccatggagccaaagta

SEQ ID NO: 194937 - DNA, 25 bp, Homo sapien
agtccttcccatggagccaaagtac

SEQ ID NO: 194938 - DNA, 25 bp, Homo sapien
tccacacagcagtcaaggcagttat

SEQ ID NO: 194939 - DNA, 25 bp, Homo sapien
cacacagcagtcaaggcagttatgg

SEQ ID NO: 194940 - DNA, 25 bp, Homo sapien
tcagctgagggtgtcatgtgatgga

SEQ ID NO: 194941 - DNA, 25 bp, Homo sapien
tggaaaaatctgtttgctgttcctg

SEQ ID NO: 194942 - DNA, 25 bp, Homo sapien
atgctctttacaaaatgactggtga

SEQ ID NO: 194943 - DNA, 25 bp, Homo sapien
atgactggtgaaagaactgttccaa

SEQ ID NO: 194944 - DNA, 25 bp, Homo sapien
gaactgttccaagaatatttgtcaa

SEQ ID NO: 194945 - DNA, 25 bp, Homo sapien
atggtacttttattggaggtgcaac

SEQ ID NO: 194946 - DNA, 25 bp, Homo sapien
gaggtgcaactgacactcataggct

SEQ ID NO: 194947 - DNA, 25 bp, Homo sapien
gacactcataggcttcacaaagaag

SEQ ID NO: 194948 - DNA, 25 bp, Homo sapien
aaaattgctcccactagttcatcag

SEQ ID NO: 194949 - DNA, 25 bp, Homo sapien
taagtttgctagtacagtgtcagtt

SEQ ID NO: 194950 - DNA, 25 bp, Homo sapien
gttatttaaagtggtaatgcccgat

SEQ ID NO: 194951 - DNA, 25 bp, Homo sapien
ggtaatgcccgataatgtcttttaa

SEQ ID NO: 194952 - DNA, 25 bp, Homo sapien
aatacatgcattgtcttcacgaaga

SEQ ID NO: 194953 - DNA, 25 bp, Homo sapien
tgtgtcgtggttgtaattctctcat

SEQ ID NO: 194954 - DNA, 25 bp, Homo sapien
gtgtcgtggttgtaattctctcatg

SEQ ID NO: 194955 - DNA, 25 bp, Homo sapien
ttgtaattctctcatgtgcatatta

SEQ ID NO: 194956 - DNA, 25 bp, Homo sapien
gtaattctctcatgtgcatattaag

SEQ ID NO: 194957 - DNA, 25 bp, Homo sapien
taattctctcatgtgcatattaaga

SEQ ID NO: 194958 - DNA, 25 bp, Homo sapien
gtgcatattaagaagttgctgctca

SEQ ID NO: 194959 - DNA, 25 bp, Homo sapien
gcatattaagaagttgctgctcaga

SEQ ID NO: 194960 - DNA, 25 bp, Homo sapien
gatgtggctcttccctttgcagagg

SEQ ID NO: 194961 - DNA, 25 bp, Homo sapien
ctgggcacgtttgctgtgtgctgta

SEQ ID NO: 194962 - DNA, 25 bp, Homo sapien
gggcacgtttgctgtgtgctgtaac

SEQ ID NO: 194963 - DNA, 25 bp, Homo sapien
ggcacgtttgctgtgtgctgtaacc

SEQ ID NO: 194964 - DNA, 25 bp, Homo sapien
tctggagacggccatgtctgtgatt

SEQ ID NO: 194965 - DNA, 25 bp, Homo sapien
ctggagacggccatgtctgtgattg

SEQ ID NO: 194966 - DNA, 25 bp, Homo sapien
tggagacggccatgtctgtgattgg

SEQ ID NO: 194967 - DNA, 25 bp, Homo sapien
ctgtgattggagacagaaggtcccg

SEQ ID NO: 194968 - DNA, 25 bp, Homo sapien
attggagacagaaggtcccgggagc

SEQ ID NO: 194969 - DNA, 25 bp, Homo sapien
aagccaaacaggagcgggagaaaga

SEQ ID NO: 194970 - DNA, 25 bp, Homo sapien
agccaaacaggagcgggagaaagaa

SEQ ID NO: 194971 - DNA, 25 bp, Homo sapien
ccaaacaggagcgggagaaagaact

SEQ ID NO: 194972 - DNA, 25 bp, Homo sapien
gatctggagctaataatgactgaga

SEQ ID NO: 194973 - DNA, 25 bp, Homo sapien
ctggagctaataatgactgagatgg

SEQ ID NO: 194974 - DNA, 25 bp, Homo sapien
ggagctaataatgactgagatggag

SEQ ID NO: 194975 - DNA, 25 bp, Homo sapien
tatgtgccgaacaagaaaccgaaag

SEQ ID NO: 194976 - DNA, 25 bp, Homo sapien
gaaaccgaaagctatattgtactgt

SEQ ID NO: 194977 - DNA, 25 bp, Homo sapien
gaaagctatattgtactgtgtattt

SEQ ID NO: 194978 - DNA, 25 bp, Homo sapien
tttactttagtcctcataatcatgt

SEQ ID NO: 194979 - DNA, 25 bp, Homo sapien
gtcctcataatcatgttgaatttat

SEQ ID NO: 194980 - DNA, 25 bp, Homo sapien
gtgatcattgattttatttcatatg

SEQ ID NO: 194981 - DNA, 25 bp, Homo sapien
tacattacctaatattctcactagc

SEQ ID NO: 194982 - DNA, 25 bp, Homo sapien
tctcactagctatgttctccaatcc

SEQ ID NO: 194983 - DNA, 25 bp, Homo sapien
tagctatgttctccaatccacactg

SEQ ID NO: 194984 - DNA, 25 bp, Homo sapien
aatccacactgccttttattgtaat

SEQ ID NO: 194985 - DNA, 25 bp, Homo sapien
tacagttttctattcagatatgttt

SEQ ID NO: 194986 - DNA, 25 bp, Homo sapien
atatatataaaaccagagctgacaa

SEQ ID NO: 194987 - DNA, 25 bp, Homo sapien
gagctgacaatgacactctggaaca

SEQ ID NO: 194988 - DNA, 25 bp, Homo sapien
gctgacaatgacactctggaacatt

SEQ ID NO: 194989 - DNA, 25 bp, Homo sapien
atgacactctggaacattgcatacc

SEQ ID NO: 194990 - DNA, 25 bp, Homo sapien
ctctggaacattgcataccttctgt

SEQ ID NO: 194991 - DNA, 25 bp, Homo sapien
ggaacattgcataccttctgtacat

SEQ ID NO: 194992 - DNA, 25 bp, Homo sapien
ttgcataccttctgtacattctggg

SEQ ID NO: 194993 - DNA, 25 bp, Homo sapien
gggtacatggatttctactgagttg

SEQ ID NO: 194994 - DNA, 25 bp, Homo sapien
tacatggatttctactgagttggat

SEQ ID NO: 194995 - DNA, 25 bp, Homo sapien
catggatttctactgagttggataa

SEQ ID NO: 194996 - DNA, 25 bp, Homo sapien
ctactgagttggataatatgcattt

SEQ ID NO: 194997 - DNA, 25 bp, Homo sapien
aagcgcaggccttgctggaaggcta

SEQ ID NO: 194998 - DNA, 25 bp, Homo sapien
aaggctatttacttccatgcttctc

SEQ ID NO: 194999 - DNA, 25 bp, Homo sapien
gctatttacttccatgcttctcctt

SEQ ID NO: 195000 - DNA, 25 bp, Homo sapien
ctatagtggcaacattttaaaagct

SEQ ID NO: 195001 - DNA, 25 bp, Homo sapien
ttttaacttagagattaggctgaaa

SEQ ID NO: 195002 - DNA, 25 bp, Homo sapien
gtaatggaattcacctttgcatctt

SEQ ID NO: 195003 - DNA, 25 bp, Homo sapien
atggaattcacctttgcatcttttg

SEQ ID NO: 195004 - DNA, 25 bp, Homo sapien
atcttttgtgtctttcttatcatga

SEQ ID NO: 195005 - DNA, 25 bp, Homo sapien
gtgtctttcttatcatgatttggca

SEQ ID NO: 195006 - DNA, 25 bp, Homo sapien
gatttggcaaaatgcatcacctttg

SEQ ID NO: 195007 - DNA, 25 bp, Homo sapien
gaagcattaattacttgtcactttc

SEQ ID NO: 195008 - DNA, 25 bp, Homo sapien
agcgggcgcactgtagctgctgctc

SEQ ID NO: 195009 - DNA, 25 bp, Homo sapien
tgtagctgctgctccggagcacgca

SEQ ID NO: 195010 - DNA, 25 bp, Homo sapien
aggaggagtactttgtggcccaggg

SEQ ID NO: 195011 - DNA, 25 bp, Homo sapien
agtgaccagccagggcaaatggctt

SEQ ID NO: 195012 - DNA, 25 bp, Homo sapien
aatggcttagaagcaggccactccc

SEQ ID NO: 195013 - DNA, 25 bp, Homo sapien
aagccgccaggcttcatcatggtag

SEQ ID NO: 195014 - DNA, 25 bp, Homo sapien
cttcatcatggtagctgggagctgt

SEQ ID NO: 195015 - DNA, 25 bp, Homo sapien
gatcaccaggtggtgggaccaagcc

SEQ ID NO: 195016 - DNA, 25 bp, Homo sapien
tggtgggaccaagccagggactcat

SEQ ID NO: 195017 - DNA, 25 bp, Homo sapien
aagccagggactcatgacttttgcc

SEQ ID NO: 195018 - DNA, 25 bp, Homo sapien
agggactcatgacttttgcccctcc

SEQ ID NO: 195019 - DNA, 25 bp, Homo sapien
gaatcgtgaattgacataatcttgg

SEQ ID NO: 195020 - DNA, 25 bp, Homo sapien
acataatcttgggtaatggaacgga

SEQ ID NO: 195021 - DNA, 25 bp, Homo sapien
atggaacggagatctgcaacatatc

SEQ ID NO: 195022 - DNA, 25 bp, Homo sapien
gcaacatatcttttaacaacacttt

SEQ ID NO: 195023 - DNA, 25 bp, Homo sapien
ggttgtgctaattcttttggttgtg

SEQ ID NO: 195024 - DNA, 25 bp, Homo sapien
ttttctgttgccttcgttttcatct

SEQ ID NO: 195025 - DNA, 25 bp, Homo sapien
tgttgccttcgttttcatcttctag

SEQ ID NO: 195026 - DNA, 25 bp, Homo sapien
cgttttcatcttctagtttgtctat

SEQ ID NO: 195027 - DNA, 25 bp, Homo sapien
gaaatgtataccaccaatttagaaa

SEQ ID NO: 195028 - DNA, 25 bp, Homo sapien
actcgggtacaaattggcaaacatg

SEQ ID NO: 195029 - DNA, 25 bp, Homo sapien
ggcaaacatgaaaacctatggaact

SEQ ID NO: 195030 - DNA, 25 bp, Homo sapien
tgttcatgttctgttctatattttc

SEQ ID NO: 195031 - DNA, 25 bp, Homo sapien
attttcttcacctactctccaaata

SEQ ID NO: 195032 - DNA, 25 bp, Homo sapien
tcttcacctactctccaaatattgt

SEQ ID NO: 195033 - DNA, 25 bp, Homo sapien
attgtaatgcaaaaagtctcagtaa

SEQ ID NO: 195034 - DNA, 25 bp, Homo sapien
aaaagtctcagtaatgatttggtag

SEQ ID NO: 195035 - DNA, 25 bp, Homo sapien
gtcattgtttctcttcgataaattt

SEQ ID NO: 195036 - DNA, 25 bp, Homo sapien
tcattaaatacttgttagagggttt

SEQ ID NO: 195037 - DNA, 25 bp, Homo sapien
gattgaaattattttggcctccaca

SEQ ID NO: 195038 - DNA, 25 bp, Homo sapien
tggcctccacaagatggctctatga

SEQ ID NO: 195039 - DNA, 25 bp, Homo sapien
ggctctatgagtattcttccaggga

SEQ ID NO: 195040 - DNA, 25 bp, Homo sapien
ttcttccagggattctaatatttat

SEQ ID NO: 195041 - DNA, 25 bp, Homo sapien
cgagcgctacgtgtgtgccgtgacc

SEQ ID NO: 195042 - DNA, 25 bp, Homo sapien
acgtgtgtgccgtgacccgcgacag

SEQ ID NO: 195043 - DNA, 25 bp, Homo sapien
gtggtcaccctcgaatgcgtggaga

SEQ ID NO: 195044 - DNA, 25 bp, Homo sapien
cctcgaatgcgtggagaagctgatt

SEQ ID NO: 195045 - DNA, 25 bp, Homo sapien
tggagaagctgattcggaaggacat

SEQ ID NO: 195046 - DNA, 25 bp, Homo sapien
catggtggaccctgtgactggagac

SEQ ID NO: 195047 - DNA, 25 bp, Homo sapien
ggagacaaactcacagaccgcgaca

SEQ ID NO: 195048 - DNA, 25 bp, Homo sapien
agaccgcgacatcatcgtgctgcag

SEQ ID NO: 195049 - DNA, 25 bp, Homo sapien
aagctgcaagcggagaaatcacggc

SEQ ID NO: 195050 - DNA, 25 bp, Homo sapien
aaatcacggccggtgatgcaggcct

SEQ ID NO: 195051 - DNA, 25 bp, Homo sapien
gcctgagtgtgtgcgggagaccaaa

SEQ ID NO: 195052 - DNA, 25 bp, Homo sapien
gttgaaaaagctgaatacaagtctt

SEQ ID NO: 195053 - DNA, 25 bp, Homo sapien
gctgaatacaagtctttatatagag

SEQ ID NO: 195054 - DNA, 25 bp, Homo sapien
tatagagtaatatttgagctgtgtt

SEQ ID NO: 195055 - DNA, 25 bp, Homo sapien
atgttaatagttttccctggaatag

SEQ ID NO: 195056 - DNA, 25 bp, Homo sapien
taatagttttccctggaataggata

SEQ ID NO: 195057 - DNA, 25 bp, Homo sapien
atagttttccctggaataggataat

SEQ ID NO: 195058 - DNA, 25 bp, Homo sapien
ccctggaataggataataggcaatt

SEQ ID NO: 195059 - DNA, 25 bp, Homo sapien
aaaaaacatagacttctttatatct

SEQ ID NO: 195060 - DNA, 25 bp, Homo sapien
tatatcttttgagctccctcccttt

SEQ ID NO: 195061 - DNA, 25 bp, Homo sapien
atatcttttgagctccctccctttt

SEQ ID NO: 195062 - DNA, 25 bp, Homo sapien
atcttttgagctccctcccttttat

SEQ ID NO: 195063 - DNA, 25 bp, Homo sapien
tcagatttactctcttgagccagat

SEQ ID NO: 195064 - DNA, 25 bp, Homo sapien
ttttgaatttcactgcagactgctt

SEQ ID NO: 195065 - DNA, 25 bp, Homo sapien
actgcagactgcttcagacttctaa

SEQ ID NO: 195066 - DNA, 25 bp, Homo sapien
cagacttctaatcataggcttgtaa

SEQ ID NO: 195067 - DNA, 25 bp, Homo sapien
taaacctactaataggctctgcccc

SEQ ID NO: 195068 - DNA, 25 bp, Homo sapien
ccctcttcccaatactttttgtcat

SEQ ID NO: 195069 - DNA, 25 bp, Homo sapien
aaatgcaacttgtattcctttgtat

SEQ ID NO: 195070 - DNA, 25 bp, Homo sapien
ctgacttataaatcttgagaccttt

SEQ ID NO: 195071 - DNA, 25 bp, Homo sapien
gtaaaagcatttatcatcaggtgag

SEQ ID NO: 195072 - DNA, 25 bp, Homo sapien
ggtcattgagcctcaggtagggaat

SEQ ID NO: 195073 - DNA, 25 bp, Homo sapien
gggaatatatcaacccgatttcttc

SEQ ID NO: 195074 - DNA, 25 bp, Homo sapien
agtgaccagccagggcaaatggctt

SEQ ID NO: 195075 - DNA, 25 bp, Homo sapien
accagccagggcaaatggcttagaa

SEQ ID NO: 195076 - DNA, 25 bp, Homo sapien
aatggcttagaagcaggccactccc

SEQ ID NO: 195077 - DNA, 25 bp, Homo sapien
cactcactgtgctcaagccgccagg

SEQ ID NO: 195078 - DNA, 25 bp, Homo sapien
ccaagccagggactcatgacttttg

SEQ ID NO: 195079 - DNA, 25 bp, Homo sapien
caagccagggactcatgacttttgc

SEQ ID NO: 195080 - DNA, 25 bp, Homo sapien
aagccagggactcatgacttttgcc

SEQ ID NO: 195081 - DNA, 25 bp, Homo sapien
agccagggactcatgacttttgccc

SEQ ID NO: 195082 - DNA, 25 bp, Homo sapien
gccagggactcatgacttttgcccc

SEQ ID NO: 195083 - DNA, 25 bp, Homo sapien
cagggactcatgacttttgcccctc

SEQ ID NO: 195084 - DNA, 25 bp, Homo sapien
agggactcatgacttttgcccctcc

SEQ ID NO: 195085 - DNA, 25 bp, Homo sapien
cagacagtctgcctaaggaccaatg

SEQ ID NO: 195086 - DNA, 25 bp, Homo sapien
acagtctgcctaaggaccaatgccg

SEQ ID NO: 195087 - DNA, 25 bp, Homo sapien
gtctgcctaaggaccaatgccgcaa

SEQ ID NO: 195088 - DNA, 25 bp, Homo sapien
ctgcctaaggaccaatgccgcaagg

SEQ ID NO: 195089 - DNA, 25 bp, Homo sapien
ctaaggaccaatgccgcaaggcctg

SEQ ID NO: 195090 - DNA, 25 bp, Homo sapien
aggaccaatgccgcaaggcctggat

SEQ ID NO: 195091 - DNA, 25 bp, Homo sapien
acgtggtgccgctcagccttctctg

SEQ ID NO: 195092 - DNA, 25 bp, Homo sapien
tcctgggaatctgtcattcgtgggt

SEQ ID NO: 195093 - DNA, 25 bp, Homo sapien
gggaatctgtcattcgtgggtgctt

SEQ ID NO: 195094 - DNA, 25 bp, Homo sapien
atctgtcattcgtgggtgcttcaga

SEQ ID NO: 195095 - DNA, 25 bp, Homo sapien
tctgtcattcgtgggtgcttcagag

SEQ ID NO: 195096 - DNA, 25 bp, Homo sapien
aaaggagatgctaccaagtcttgga

SEQ ID NO: 195097 - DNA, 25 bp, Homo sapien
atgttagggcgagaccctgcaagtt

SEQ ID NO: 195098 - DNA, 25 bp, Homo sapien
gcttgtctttcaaggcaggttcctg

SEQ ID NO: 195099 - DNA, 25 bp, Homo sapien
gaggagcctgcccttttaacagaac

SEQ ID NO: 195100 - DNA, 25 bp, Homo sapien
ttaacagaaccccagtcacatgcgg

SEQ ID NO: 195101 - DNA, 25 bp, Homo sapien
gtcacatgcggctcaagtcactcag

SEQ ID NO: 195102 - DNA, 25 bp, Homo sapien
gtcactcagaggctgttgcatttca

SEQ ID NO: 195103 - DNA, 25 bp, Homo sapien
gcatttcagggctatgttggtcctt

SEQ ID NO: 195104 - DNA, 25 bp, Homo sapien
gctatgttggtcctttgtttacctc

SEQ ID NO: 195105 - DNA, 25 bp, Homo sapien
ttgtttacctcctaaaccacagctg

SEQ ID NO: 195106 - DNA, 25 bp, Homo sapien
accacagctgtttgtgtttcacata

SEQ ID NO: 195107 - DNA, 25 bp, Homo sapien
aagggtcacatttaccagggctctg

SEQ ID NO: 195108 - DNA, 25 bp, Homo sapien
agggtcacatttaccagggctctga

SEQ ID NO: 195109 - DNA, 25 bp, Homo sapien
gggtcacatttaccagggctctgag

SEQ ID NO: 195110 - DNA, 25 bp, Homo sapien
ggtcacatttaccagggctctgagg

SEQ ID NO: 195111 - DNA, 25 bp, Homo sapien
gtcacatttaccagggctctgaggc

SEQ ID NO: 195112 - DNA, 25 bp, Homo sapien
tcacatttaccagggctctgaggcc

SEQ ID NO: 195113 - DNA, 25 bp, Homo sapien
atttaccagggctctgaggccgaca

SEQ ID NO: 195114 - DNA, 25 bp, Homo sapien
ttaccagggctctgaggccgacagc

SEQ ID NO: 195115 - DNA, 25 bp, Homo sapien
ggctggctctgagagccccaggact

SEQ ID NO: 195116 - DNA, 25 bp, Homo sapien
aggactggctgccccgtgacacatg

SEQ ID NO: 195117 - DNA, 25 bp, Homo sapien
aagaagctcgtttcttagacctctt

SEQ ID NO: 195118 - DNA, 25 bp, Homo sapien
gtaattggtgtgtggtatagaagaa

SEQ ID NO: 195119 - DNA, 25 bp, Homo sapien
cacctaccagctatatggccttgaa

SEQ ID NO: 195120 - DNA, 25 bp, Homo sapien
cagctatatggccttgaatgagtca

SEQ ID NO: 195121 - DNA, 25 bp, Homo sapien
ctatatggccttgaatgagtcattc

SEQ ID NO: 195122 - DNA, 25 bp, Homo sapien
gagtcattcagctttaataaggttc

SEQ ID NO: 195123 - DNA, 25 bp, Homo sapien
gctttaataaggttcattttcttct

SEQ ID NO: 195124 - DNA, 25 bp, Homo sapien
atcagctttggccatctacctgaga

SEQ ID NO: 195125 - DNA, 25 bp, Homo sapien
cagctttggccatctacctgagaat

SEQ ID NO: 195126 - DNA, 25 bp, Homo sapien
ttggccatctacctgagaattagaa

SEQ ID NO: 195127 - DNA, 25 bp, Homo sapien
ctacctgagaattagaaagtctgat

SEQ ID NO: 195128 - DNA, 25 bp, Homo sapien
gaaatcatgattgtaggctgggcac

SEQ ID NO: 195129 - DNA, 25 bp, Homo sapien
ttttatcacagtattctcagggtga

SEQ ID NO: 195130 - DNA, 25 bp, Homo sapien
caactataggcctttttcttgggat

SEQ ID NO: 195131 - DNA, 25 bp, Homo sapien
tcttgggatgattttctagtcttaa

SEQ ID NO: 195132 - DNA, 25 bp, Homo sapien
aacttgagtacatttgttgtacaca

SEQ ID NO: 195133 - DNA, 25 bp, Homo sapien
gttgtacacagttgatattccaaat

SEQ ID NO: 195134 - DNA, 25 bp, Homo sapien
gagaggtgtcttaagctgtaggctt

SEQ ID NO: 195135 - DNA, 25 bp, Homo sapien
gtaggcttttctttgtactgcattt

SEQ ID NO: 195136 - DNA, 25 bp, Homo sapien
gtactgcatttatagagatttagct

SEQ ID NO: 195137 - DNA, 25 bp, Homo sapien
acattctgctttcttagtcttacct

SEQ ID NO: 195138 - DNA, 25 bp, Homo sapien
gctttcttagtcttacctagtctga

SEQ ID NO: 195139 - DNA, 25 bp, Homo sapien
ttagtcttacctagtctgaaacatt

SEQ ID NO: 195140 - DNA, 25 bp, Homo sapien
atgctttttttgagttctgttgtac

SEQ ID NO: 195141 - DNA, 25 bp, Homo sapien
tctgttgtacagtgtggtgcctata

SEQ ID NO: 195142 - DNA, 25 bp, Homo sapien
gttgtacagtgtggtgcctatactt

SEQ ID NO: 195143 - DNA, 25 bp, Homo sapien
gtacagtgtggtgcctatacttaat

SEQ ID NO: 195144 - DNA, 25 bp, Homo sapien
gtgtggtgcctatacttaataatgg

SEQ ID NO: 195145 - DNA, 25 bp, Homo sapien
ttgaagtattgcatatgttaactag

SEQ ID NO: 195146 - DNA, 25 bp, Homo sapien
aactagcttgatttaactattccat

SEQ ID NO: 195147 - DNA, 25 bp, Homo sapien
taactattccatattgtatccacaa

SEQ ID NO: 195148 - DNA, 25 bp, Homo sapien
attgtatccacaatttatgatatca

SEQ ID NO: 195149 - DNA, 25 bp, Homo sapien
atgatatcactttgtaacccataca

SEQ ID NO: 195150 - DNA, 25 bp, Homo sapien
tatcactttgtaacccatacattta

SEQ ID NO: 195151 - DNA, 25 bp, Homo sapien
tgtcatttatatctgatccccaaat

SEQ ID NO: 195152 - DNA, 25 bp, Homo sapien
gatccccaaatagctcatacaataa

SEQ ID NO: 195153 - DNA, 25 bp, Homo sapien
gctcatacaataatccattcaatag

SEQ ID NO: 195154 - DNA, 25 bp, Homo sapien
gttcagaatgattttccaactagca

SEQ ID NO: 195155 - DNA, 25 bp, Homo sapien
agcaaatataagtatgcctggttaa

SEQ ID NO: 195156 - DNA, 25 bp, Homo sapien
gcctggttaagatatcttccctttg

SEQ ID NO: 195157 - DNA, 25 bp, Homo sapien
gatatcttccctttgtagaaatgtt

SEQ ID NO: 195158 - DNA, 25 bp, Homo sapien
gacaaaatattcctagacgagtcta

SEQ ID NO: 195159 - DNA, 25 bp, Homo sapien
gacgagtctatcctcaaaccagtag

SEQ ID NO: 195160 - DNA, 25 bp, Homo sapien
atcctcaaaccagtagtgtctttta

SEQ ID NO: 195161 - DNA, 25 bp, Homo sapien
gagatgatttacacctaatagacat

SEQ ID NO: 195162 - DNA, 25 bp, Homo sapien
cctccacttgctccccgacaggtgg

SEQ ID NO: 195163 - DNA, 25 bp, Homo sapien
acaggtggggcacagacctctgttc

SEQ ID NO: 195164 - DNA, 25 bp, Homo sapien
aagcagaaaaggaggttccctctct

SEQ ID NO: 195165 - DNA, 25 bp, Homo sapien
cagaaaaggaggttccctctctctg

SEQ ID NO: 195166 - DNA, 25 bp, Homo sapien
ggatggtttcccctgggagaggcca

SEQ ID NO: 195167 - DNA, 25 bp, Homo sapien
caggagggcctgatcccaggagaca

SEQ ID NO: 195168 - DNA, 25 bp, Homo sapien
aggagggcctgatcccaggagacac

SEQ ID NO: 195169 - DNA, 25 bp, Homo sapien
gacaccagggccagagtgaccacag

SEQ ID NO: 195170 - DNA, 25 bp, Homo sapien
accagggccagagtgaccacagcag

SEQ ID NO: 195171 - DNA, 25 bp, Homo sapien
ccagggccagagtgaccacagcagg

SEQ ID NO: 195172 - DNA, 25 bp, Homo sapien
aaagaattcttgaccaataaaagca

SEQ ID NO: 195173 - DNA, 25 bp, Homo sapien
gcaaagtagcaaaattccgtgatta

SEQ ID NO: 195174 - DNA, 25 bp, Homo sapien
aagaaaaactcattgtttctgcgtg

SEQ ID NO: 195175 - DNA, 25 bp, Homo sapien
ctgcgtggtataataagagtctagc

SEQ ID NO: 195176 - DNA, 25 bp, Homo sapien
agagtctagcattccagaaactggg

SEQ ID NO: 195177 - DNA, 25 bp, Homo sapien
gatggaatctagacttgtgagcggc

SEQ ID NO: 195178 - DNA, 25 bp, Homo sapien
tgcagtgacactggtgcgtgcactc

SEQ ID NO: 195179 - DNA, 25 bp, Homo sapien
tggtgcgtgcactcctgcgcggtct

SEQ ID NO: 195180 - DNA, 25 bp, Homo sapien
tgcgcggtctttcttagcgcagcaa

SEQ ID NO: 195181 - DNA, 25 bp, Homo sapien
ttcttagcgcagcaacggcacatca

SEQ ID NO: 195182 - DNA, 25 bp, Homo sapien
aaatctctctgttaaagtccctgct

SEQ ID NO: 195183 - DNA, 25 bp, Homo sapien
ctctgttaaagtccctgctacaaca

SEQ ID NO: 195184 - DNA, 25 bp, Homo sapien
atgcattaatatttgactgttgaga

SEQ ID NO: 195185 - DNA, 25 bp, Homo sapien
gactgttgagaattttactgccgaa

SEQ ID NO: 195186 - DNA, 25 bp, Homo sapien
ttactgccgaagtttacctccacta

SEQ ID NO: 195187 - DNA, 25 bp, Homo sapien
tacctccactagttctttgtagcag

SEQ ID NO: 195188 - DNA, 25 bp, Homo sapien
ccactagttctttgtagcagagtac

SEQ ID NO: 195189 - DNA, 25 bp, Homo sapien
ataactacataatgccaactctgga

SEQ ID NO: 195190 - DNA, 25 bp, Homo sapien
aactctggaatcaaatttccttgtt

SEQ ID NO: 195191 - DNA, 25 bp, Homo sapien
tccttgtttgaatcctgggacccta

SEQ ID NO: 195192 - DNA, 25 bp, Homo sapien
cctgggaccctattgcattaaagta

SEQ ID NO: 195193 - DNA, 25 bp, Homo sapien
aggattttctcagttgtcagccatg

SEQ ID NO: 195194 - DNA, 25 bp, Homo sapien
gtcagccatgacttatgtttattac

SEQ ID NO: 195195 - DNA, 25 bp, Homo sapien
ttaactgatcttcaacccttattgg

SEQ ID NO: 195196 - DNA, 25 bp, Homo sapien
actgatcttcaacccttattggaca

SEQ ID NO: 195197 - DNA, 25 bp, Homo sapien
gatcttcaacccttattggacataa

SEQ ID NO: 195198 - DNA, 25 bp, Homo sapien
aaccaatcttcaacacttactacac

SEQ ID NO: 195199 - DNA, 25 bp, Homo sapien
atgtggcaaagcttctacctgatcc

SEQ ID NO: 195200 - DNA, 25 bp, Homo sapien
gtggcaaagcttctacctgatcctc

SEQ ID NO: 195201 - DNA, 25 bp, Homo sapien
gcaaagcttctacctgatcctcaaa

SEQ ID NO: 195202 - DNA, 25 bp, Homo sapien
aaagcttctacctgatcctcaaaac

SEQ ID NO: 195203 - DNA, 25 bp, Homo sapien
tctacctgatcctcaaaactcattg

SEQ ID NO: 195204 - DNA, 25 bp, Homo sapien
tacctgatcctcaaaactcattgaa

SEQ ID NO: 195205 - DNA, 25 bp, Homo sapien
tctaaccatttctcaacctttacta

SEQ ID NO: 195206 - DNA, 25 bp, Homo sapien
cctgctttgcaaggtggctttaaga

SEQ ID NO: 195207 - DNA, 25 bp, Homo sapien
ggcctcacttgacctagtcatggca

SEQ ID NO: 195208 - DNA, 25 bp, Homo sapien
gtcatggcaggacaactagtggtta

SEQ ID NO: 195209 - DNA, 25 bp, Homo sapien
agttactaactggactcttgacttt

SEQ ID NO: 195210 - DNA, 25 bp, Homo sapien
gaggagcctcaaatacttgtgttca

SEQ ID NO: 195211 - DNA, 25 bp, Homo sapien
cttgtgttcatttgggaaagctacc

SEQ ID NO: 195212 - DNA, 25 bp, Homo sapien
tactctaccactctactctaagatg

SEQ ID NO: 195213 - DNA, 25 bp, Homo sapien
agagtagcggagtcactgacctctt

SEQ ID NO: 195214 - DNA, 25 bp, Homo sapien
ggagtcactgacctctttaaatcat

SEQ ID NO: 195215 - DNA, 25 bp, Homo sapien
aaggttcttgaattctgcaggacag

SEQ ID NO: 195216 - DNA, 25 bp, Homo sapien
ataactgtattacctgctttgcaag

SEQ ID NO: 195217 - DNA, 25 bp, Homo sapien
gaaagtacaggacactgggtctgtc

SEQ ID NO: 195218 - DNA, 25 bp, Homo sapien
gtacaggacactgggtctgtcccca

SEQ ID NO: 195219 - DNA, 25 bp, Homo sapien
caccccaattcccttacaagtaatg

SEQ ID NO: 195220 - DNA, 25 bp, Homo sapien
ttcccttacaagtaatggagccggg

SEQ ID NO: 195221 - DNA, 25 bp, Homo sapien
gctgggctgccgaaagattcggcca

SEQ ID NO: 195222 - DNA, 25 bp, Homo sapien
ggctgccgaaagattcggccactac

SEQ ID NO: 195223 - DNA, 25 bp, Homo sapien
gaagagttacgtgaagctgccttct

SEQ ID NO: 195224 - DNA, 25 bp, Homo sapien
agagttacgtgaagctgccttctgc

SEQ ID NO: 195225 - DNA, 25 bp, Homo sapien
agttacgtgaagctgccttctgctt

SEQ ID NO: 195226 - DNA, 25 bp, Homo sapien
caaagctgatatccctgtactctaa

SEQ ID NO: 195227 - DNA, 25 bp, Homo sapien
agctgatatccctgtactctaataa

SEQ ID NO: 195228 - DNA, 25 bp, Homo sapien
agtgttgcaagtcttgaacgacaag

SEQ ID NO: 195229 - DNA, 25 bp, Homo sapien
acgacaagacatatcgaacgagttg

SEQ ID NO: 195230 - DNA, 25 bp, Homo sapien
gaacgagttgagaaagtctgcgatt

SEQ ID NO: 195231 - DNA, 25 bp, Homo sapien
agtctgcgattttcttgatgctgct

SEQ ID NO: 195232 - DNA, 25 bp, Homo sapien
cttgatgctgctggtgattatctca

SEQ ID NO: 195233 - DNA, 25 bp, Homo sapien
gtgattatctcaatgtactcccggt

SEQ ID NO: 195234 - DNA, 25 bp, Homo sapien
ttatctcaatgtactcccggttagc

SEQ ID NO: 195235 - DNA, 25 bp, Homo sapien
ggttagcccagtcctggtgaatctc

SEQ ID NO: 195236 - DNA, 25 bp, Homo sapien
agtcctggtgaatctcccgctgcac

SEQ ID NO: 195237 - DNA, 25 bp, Homo sapien
gggctgtcaatttctcgtttagtgt

SEQ ID NO: 195238 - DNA, 25 bp, Homo sapien
atttctcgtttagtgttgcaagtct

SEQ ID NO: 195239 - DNA, 25 bp, Homo sapien
tggttcaagtgggtgtaccagtgat

SEQ ID NO: 195240 - DNA, 25 bp, Homo sapien
tcaagtgggtgtaccagtgatggca

SEQ ID NO: 195241 - DNA, 25 bp, Homo sapien
gtgggtgtaccagtgatggcaataa

SEQ ID NO: 195242 - DNA, 25 bp, Homo sapien
taccagtgatggcaataagaaacaa

SEQ ID NO: 195243 - DNA, 25 bp, Homo sapien
aaatgatatcagaaggactagaccc

SEQ ID NO: 195244 - DNA, 25 bp, Homo sapien
tgatatcagaaggactagacccaga

SEQ ID NO: 195245 - DNA, 25 bp, Homo sapien
gactagacccagatcttcttgagag

SEQ ID NO: 195246 - DNA, 25 bp, Homo sapien
tagacccagatcttcttgagaggcc

SEQ ID NO: 195247 - DNA, 25 bp, Homo sapien
gacccagatcttcttgagaggccag

SEQ ID NO: 195248 - DNA, 25 bp, Homo sapien
cccagatcttcttgagaggccagat

SEQ ID NO: 195249 - DNA, 25 bp, Homo sapien
atcttcttgagaggccagatgctcc

SEQ ID NO: 195250 - DNA, 25 bp, Homo sapien
ctttttgatgggttttgttgtgtct

SEQ ID NO: 195251 - DNA, 25 bp, Homo sapien
gatgggttttgttgtgtcttgtgaa

SEQ ID NO: 195252 - DNA, 25 bp, Homo sapien
tttcttatgaaaaacgaactcagtt

SEQ ID NO: 195253 - DNA, 25 bp, Homo sapien
aaaagtatttttagctcgtatgact

SEQ ID NO: 195254 - DNA, 25 bp, Homo sapien
gtatttttagctcgtatgacttgtt

SEQ ID NO: 195255 - DNA, 25 bp, Homo sapien
tttttagctcgtatgacttgttttc

SEQ ID NO: 195256 - DNA, 25 bp, Homo sapien
tagctcgtatgacttgttttcattc

SEQ ID NO: 195257 - DNA, 25 bp, Homo sapien
gctcgtatgacttgttttcattcat

SEQ ID NO: 195258 - DNA, 25 bp, Homo sapien
cgtatgacttgttttcattcattaa

SEQ ID NO: 195259 - DNA, 25 bp, Homo sapien
gacttgttttcattcattaataata

SEQ ID NO: 195260 - DNA, 25 bp, Homo sapien
ggaaatggaatcttaaaagtctatg

SEQ ID NO: 195261 - DNA, 25 bp, Homo sapien
gagatttagttaatggcagaccttg

SEQ ID NO: 195262 - DNA, 25 bp, Homo sapien
gaccttgtggccactttgtgtgaga

SEQ ID NO: 195263 - DNA, 25 bp, Homo sapien
gtgtgagaagacatctctttctgct

SEQ ID NO: 195264 - DNA, 25 bp, Homo sapien
ttgaggactactctcagtcgctgca

SEQ ID NO: 195265 - DNA, 25 bp, Homo sapien
gtcgctgcacgccagaactctgtct

SEQ ID NO: 195266 - DNA, 25 bp, Homo sapien
cgatcctgttctgagcaagctcgag

SEQ ID NO: 195267 - DNA, 25 bp, Homo sapien
gcaagctcgagtcttcgtggatgat

SEQ ID NO: 195268 - DNA, 25 bp, Homo sapien
gtggatgatgtgaccattgaggacc

SEQ ID NO: 195269 - DNA, 25 bp, Homo sapien
gaggacctgtcaggctacatggagt

SEQ ID NO: 195270 - DNA, 25 bp, Homo sapien
tattcccaagaaaatgtcccacatg

SEQ ID NO: 195271 - DNA, 25 bp, Homo sapien
gatgtacacctgatagcaagaagct

SEQ ID NO: 195272 - DNA, 25 bp, Homo sapien
aaatgaccctgtaaatttggataag

SEQ ID NO: 195273 - DNA, 25 bp, Homo sapien
aatgaccctgtaaatttggataaga

SEQ ID NO: 195274 - DNA, 25 bp, Homo sapien
atgaccctgtaaatttggataagac

SEQ ID NO: 195275 - DNA, 25 bp, Homo sapien
tgaccctgtaaatttggataagacc

SEQ ID NO: 195276 - DNA, 25 bp, Homo sapien
gaccctgtaaatttggataagacca

SEQ ID NO: 195277 - DNA, 25 bp, Homo sapien
cagaatccatttctattgtgggtat

SEQ ID NO: 195278 - DNA, 25 bp, Homo sapien
agaatccatttctattgtgggtatt

SEQ ID NO: 195279 - DNA, 25 bp, Homo sapien
gaatccatttctattgtgggtatta

SEQ ID NO: 195280 - DNA, 25 bp, Homo sapien
ttctattgtgggtattatagggttg

SEQ ID NO: 195281 - DNA, 25 bp, Homo sapien
gttaaaggtgatggccctttttgat

SEQ ID NO: 195282 - DNA, 25 bp, Homo sapien
taaaggtgatggccctttttgatgg

SEQ ID NO: 195283 - DNA, 25 bp, Homo sapien
cggaaagcgccaaatggctgtttaa

SEQ ID NO: 195284 - DNA, 25 bp, Homo sapien
gctgtttaaaaagtgccccaaatca

SEQ ID NO: 195285 - DNA, 25 bp, Homo sapien
gaatagccttcagaatagaacccta

SEQ ID NO: 195286 - DNA, 25 bp, Homo sapien
agaaccctagagaatgtcttataag

SEQ ID NO: 195287 - DNA, 25 bp, Homo sapien
gtcttataaggattgtctgccattt

SEQ ID NO: 195288 - DNA, 25 bp, Homo sapien
tttgcactgctcttttaagagtttt

SEQ ID NO: 195289 - DNA, 25 bp, Homo sapien
gagttttagcagatttagcaggaca

SEQ ID NO: 195290 - DNA, 25 bp, Homo sapien
caggacagatgcattgaagccacat

SEQ ID NO: 195291 - DNA, 25 bp, Homo sapien
gaagccacatggtttagacttgatt

SEQ ID NO: 195292 - DNA, 25 bp, Homo sapien
gttgcatttgggactatgctgctaa

SEQ ID NO: 195293 - DNA, 25 bp, Homo sapien
gactatgctgctaacgaaatggttt

SEQ ID NO: 195294 - DNA, 25 bp, Homo sapien
attctcactagctatgttctccaat

SEQ ID NO: 195295 - DNA, 25 bp, Homo sapien
tagctatgttctccaatccacactg

SEQ ID NO: 195296 - DNA, 25 bp, Homo sapien
aatccacactgccttttattgtaat

SEQ ID NO: 195297 - DNA, 25 bp, Homo sapien
tacagttttctattcagatatgttt

SEQ ID NO: 195298 - DNA, 25 bp, Homo sapien
ggtgaagttccagtcaaccactttt

SEQ ID NO: 195299 - DNA, 25 bp, Homo sapien
tttacccctgaaatttcaagataat

SEQ ID NO: 195300 - DNA, 25 bp, Homo sapien
gctatattaacttttccagatctaa

SEQ ID NO: 195301 - DNA, 25 bp, Homo sapien
aacttttccagatctaacactagct

SEQ ID NO: 195302 - DNA, 25 bp, Homo sapien
taacactagcttattcttccctgtt

SEQ ID NO: 195303 - DNA, 25 bp, Homo sapien
cactagcttattcttccctgttata

SEQ ID NO: 195304 - DNA, 25 bp, Homo sapien
ggtttgaacttactgaggagatatt

SEQ ID NO: 195305 - DNA, 25 bp, Homo sapien
gaacagcaggatttcccaacggcag

SEQ ID NO: 195306 - DNA, 25 bp, Homo sapien
aggatttcccaacggcagcttggga

SEQ ID NO: 195307 - DNA, 25 bp, Homo sapien
ggaaaagacccagcgctccgtttag

SEQ ID NO: 195308 - DNA, 25 bp, Homo sapien
ccagcgctccgtttagaagcaacgt

SEQ ID NO: 195309 - DNA, 25 bp, Homo sapien
gaagcaacgtgtatcagccaactga

SEQ ID NO: 195310 - DNA, 25 bp, Homo sapien
actgagatggccgtcgtgctcaacg

SEQ ID NO: 195311 - DNA, 25 bp, Homo sapien
gtgctcaacggtgggaccatcccaa

SEQ ID NO: 195312 - DNA, 25 bp, Homo sapien
tgctccgccaagtcacacaggaaga

SEQ ID NO: 195313 - DNA, 25 bp, Homo sapien
gtcacacaggaagacacctttggtg

SEQ ID NO: 195314 - DNA, 25 bp, Homo sapien
agaatttctcttaccgatttgcctc

SEQ ID NO: 195315 - DNA, 25 bp, Homo sapien
ctggctgtgtctttcttgagggaga

SEQ ID NO: 195316 - DNA, 25 bp, Homo sapien
tgagattcggcaggcatctcacggc

SEQ ID NO: 195317 - DNA, 25 bp, Homo sapien
tctcacggcctttataccaacatat

SEQ ID NO: 195318 - DNA, 25 bp, Homo sapien
atacgcgacgcttgtgacttgagat

SEQ ID NO: 195319 - DNA, 25 bp, Homo sapien
agatgcggtgaggtgtttactacaa

SEQ ID NO: 195320 - DNA, 25 bp, Homo sapien
aagtccacagtacctgacaacggtg

SEQ ID NO: 195321 - DNA, 25 bp, Homo sapien
gtctcaagctaaggacgtcgggccc

SEQ ID NO: 195322 - DNA, 25 bp, Homo sapien
taggtgatcaagatctcgccggcgt

SEQ ID NO: 195323 - DNA, 25 bp, Homo sapien
gtggcgccacctcgaggtcgaaaac

SEQ ID NO: 195324 - DNA, 25 bp, Homo sapien
gaaatcactcccaattaacttcggc

SEQ ID NO: 195325 - DNA, 25 bp, Homo sapien
taacttcggcttaagacgtctatag

SEQ ID NO: 195326 - DNA, 25 bp, Homo sapien
ctataggtagtgtgaccgccggcga

SEQ ID NO: 195327 - DNA, 25 bp, Homo sapien
gtgtctgtatgtttaagttatcgta

SEQ ID NO: 195328 - DNA, 25 bp, Homo sapien
acatggctgttttgttatgccaccc

SEQ ID NO: 195329 - DNA, 25 bp, Homo sapien
atggctgttttgttatgccaccctg

SEQ ID NO: 195330 - DNA, 25 bp, Homo sapien
gctgttttgttatgccaccctgtac

SEQ ID NO: 195331 - DNA, 25 bp, Homo sapien
tgttatgccaccctgtaccaggatt

SEQ ID NO: 195332 - DNA, 25 bp, Homo sapien
gttatgccaccctgtaccaggattg

SEQ ID NO: 195333 - DNA, 25 bp, Homo sapien
ctgtaccaggattgctgccgcattc

SEQ ID NO: 195334 - DNA, 25 bp, Homo sapien
gtaccaggattgctgccgcattcca

SEQ ID NO: 195335 - DNA, 25 bp, Homo sapien
ggattgctgccgcattccactgggt

SEQ ID NO: 195336 - DNA, 25 bp, Homo sapien
ttgctgccgcattccactgggtata

SEQ ID NO: 195337 - DNA, 25 bp, Homo sapien
gctgccgcattccactgggtataac

SEQ ID NO: 195338 - DNA, 25 bp, Homo sapien
ttatgaccaatatctgccagtaacg

SEQ ID NO: 195339 - DNA, 25 bp, Homo sapien
gccagtaacgctgtttatctcactt

SEQ ID NO: 195340 - DNA, 25 bp, Homo sapien
gctgtttatctcacttgctttgaaa

SEQ ID NO: 195341 - DNA, 25 bp, Homo sapien
tgattttgtttgtatccctacccat

SEQ ID NO: 195342 - DNA, 25 bp, Homo sapien
tcctggcagccctactgagtgaaat

SEQ ID NO: 195343 - DNA, 25 bp, Homo sapien
gaaattgggatacatttggctgtca

SEQ ID NO: 195344 - DNA, 25 bp, Homo sapien
ttggctgtcagaaattataccgagt

SEQ ID NO: 195345 - DNA, 25 bp, Homo sapien
gtctactgggtataacatgtctcac

SEQ ID NO: 195346 - DNA, 25 bp, Homo sapien
acatgtctcacttggaaagctagta

SEQ ID NO: 195347 - DNA, 25 bp, Homo sapien
tgggtgccaaaggtcaactgtaatg

SEQ ID NO: 195348 - DNA, 25 bp, Homo sapien
ctgcctgtgtccatgtcagactttg

SEQ ID NO: 195349 - DNA, 25 bp, Homo sapien
tatgacagtgtaactctacagtcct

SEQ ID NO: 195350 - DNA, 25 bp, Homo sapien
aaatgaccctgtaaatttggataag

SEQ ID NO: 195351 - DNA, 25 bp, Homo sapien
atgaccctgtaaatttggataagac

SEQ ID NO: 195352 - DNA, 25 bp, Homo sapien
gaccctgtaaatttggataagacca

SEQ ID NO: 195353 - DNA, 25 bp, Homo sapien
gggctggtcatattatgattcagaa

SEQ ID NO: 195354 - DNA, 25 bp, Homo sapien
cagaatccatttctattgtgggtat

SEQ ID NO: 195355 - DNA, 25 bp, Homo sapien
gaatccatttctattgtgggtatta

SEQ ID NO: 195356 - DNA, 25 bp, Homo sapien
ttctattgtgggtattatagggttg

SEQ ID NO: 195357 - DNA, 25 bp, Homo sapien
gttaaaggtgatggccctttttgat

SEQ ID NO: 195358 - DNA, 25 bp, Homo sapien
gatggccctttttgatgggttttgt

SEQ ID NO: 195359 - DNA, 25 bp, Homo sapien
agctcgtatgacttgttttcattca

SEQ ID NO: 195360 - DNA, 25 bp, Homo sapien
gaaaagtcatagatccagtgacagg

SEQ ID NO: 195361 - DNA, 25 bp, Homo sapien
caggaaagccctgtgctggaactac

SEQ ID NO: 195362 - DNA, 25 bp, Homo sapien
gaaagccctgtgctggaactaccta

SEQ ID NO: 195363 - DNA, 25 bp, Homo sapien
ggaactacctacctggagagtccgt

SEQ ID NO: 195364 - DNA, 25 bp, Homo sapien
ctacctggagagtccgttgagttcg

SEQ ID NO: 195365 - DNA, 25 bp, Homo sapien
gttgagttcggaaaccacccagcta

SEQ ID NO: 195366 - DNA, 25 bp, Homo sapien
tgagttcggaaaccacccagctaag

SEQ ID NO: 195367 - DNA, 25 bp, Homo sapien
accacccagctaagcaaaaatctgg

SEQ ID NO: 195368 - DNA, 25 bp, Homo sapien
gaactcaatatctcttcagcacagt

SEQ ID NO: 195369 - DNA, 25 bp, Homo sapien
tcttcagcacagtgaagcgggagtg

SEQ ID NO: 195370 - DNA, 25 bp, Homo sapien
aaaactgacatgtttatgttatgga

SEQ ID NO: 195371 - DNA, 25 bp, Homo sapien
ctgaaggctgcgtgcaccttgtccc

SEQ ID NO: 195372 - DNA, 25 bp, Homo sapien
agcccttcttctagtggtagctctg

SEQ ID NO: 195373 - DNA, 25 bp, Homo sapien
gactcttccagagctggagctgggc

SEQ ID NO: 195374 - DNA, 25 bp, Homo sapien
ctgggcacagccataagacaggact

SEQ ID NO: 195375 - DNA, 25 bp, Homo sapien
agacaggactggaccagatgctcct

SEQ ID NO: 195376 - DNA, 25 bp, Homo sapien
cagatgctcctgtaaacatccaggg

SEQ ID NO: 195377 - DNA, 25 bp, Homo sapien
accctcacaactgcttgttcaggta

SEQ ID NO: 195378 - DNA, 25 bp, Homo sapien
gttcaggtatcgtgatgggccactc

SEQ ID NO: 195379 - DNA, 25 bp, Homo sapien
tgatgggccactcggtccaaaatca

SEQ ID NO: 195380 - DNA, 25 bp, Homo sapien
tccaaaatcagccaggccatctttt

SEQ ID NO: 195381 - DNA, 25 bp, Homo sapien
cttttccatcatctcacttcaaata

SEQ ID NO: 195382 - DNA, 25 bp, Homo sapien
tttcttcaacccttaaaagacatca

SEQ ID NO: 195383 - DNA, 25 bp, Homo sapien
attcattatgaagtcagtctctaca

SEQ ID NO: 195384 - DNA, 25 bp, Homo sapien
aaagctccttgtatgctgtccactc

SEQ ID NO: 195385 - DNA, 25 bp, Homo sapien
ttgtatgctgtccactcttaagaaa

SEQ ID NO: 195386 - DNA, 25 bp, Homo sapien
ctgtccactcttaagaaacacaaat

SEQ ID NO: 195387 - DNA, 25 bp, Homo sapien
gagaggaacatacaagtgtgaccaa

SEQ ID NO: 195388 - DNA, 25 bp, Homo sapien
atgtcagaaagccttgtcttttgta

SEQ ID NO: 195389 - DNA, 25 bp, Homo sapien
agccttgtcttttgtaatacttctc

SEQ ID NO: 195390 - DNA, 25 bp, Homo sapien
tgtaatacttctctatttgagcaca

SEQ ID NO: 195391 - DNA, 25 bp, Homo sapien
gagcacaagctaagtcatactggag

SEQ ID NO: 195392 - DNA, 25 bp, Homo sapien
gagtgaaattttcctagtttgaaga

SEQ ID NO: 195393 - DNA, 25 bp, Homo sapien
gtgaagttgtcctggacaccagcaa

SEQ ID NO: 195394 - DNA, 25 bp, Homo sapien
ttgtcctggacaccagcaacatcca

SEQ ID NO: 195395 - DNA, 25 bp, Homo sapien
gcaacatccagctctctgccatggg

SEQ ID NO: 195396 - DNA, 25 bp, Homo sapien
tgccatgggcctctaccagagcttg

SEQ ID NO: 195397 - DNA, 25 bp, Homo sapien
catgggcctctaccagagcttgggc

SEQ ID NO: 195398 - DNA, 25 bp, Homo sapien
ggccagtccttcttccacgtgtggg

SEQ ID NO: 195399 - DNA, 25 bp, Homo sapien
agtccttcttccacgtgtgggccag

SEQ ID NO: 195400 - DNA, 25 bp, Homo sapien
tctgctcaggcagggcgtctatgat

SEQ ID NO: 195401 - DNA, 25 bp, Homo sapien
caggcagggcgtctatgatttcttt

SEQ ID NO: 195402 - DNA, 25 bp, Homo sapien
tttctttccttctgtattggtcaga

SEQ ID NO: 195403 - DNA, 25 bp, Homo sapien
tctttccttctgtattggtcagaat

SEQ ID NO: 195404 - DNA, 25 bp, Homo sapien
tgttacccaaggttgtgtctttaag

SEQ ID NO: 195405 - DNA, 25 bp, Homo sapien
ggttgtgtctttaagggtggttcat

SEQ ID NO: 195406 - DNA, 25 bp, Homo sapien
aagggtggttcattttctctgacct

SEQ ID NO: 195407 - DNA, 25 bp, Homo sapien
actaggagtcctaagaaatgttctg

SEQ ID NO: 195408 - DNA, 25 bp, Homo sapien
gaaatgttctgttcttgtacattat

SEQ ID NO: 195409 - DNA, 25 bp, Homo sapien
ctgagaacagtggtaaaaactcgtt

SEQ ID NO: 195410 - DNA, 25 bp, Homo sapien
aaactcgtttacagaaatgcatttt

SEQ ID NO: 195411 - DNA, 25 bp, Homo sapien
aaacgtgtcgtgaatgtttcttcag

SEQ ID NO: 195412 - DNA, 25 bp, Homo sapien
tcagtttcttgttcagccaatgagg

SEQ ID NO: 195413 - DNA, 25 bp, Homo sapien
gccaatgaggaaagggcattgcctt

SEQ ID NO: 195414 - DNA, 25 bp, Homo sapien
tctttttaccattaatcacttctca

SEQ ID NO: 195415 - DNA, 25 bp, Homo sapien
tgcccatcttcagtcctgaactctc

SEQ ID NO: 195416 - DNA, 25 bp, Homo sapien
tgaactctctcccagaaacctggtt

SEQ ID NO: 195417 - DNA, 25 bp, Homo sapien
actctctcccagaaacctggttctg

SEQ ID NO: 195418 - DNA, 25 bp, Homo sapien
caagatgcccctgggtcaggctctt

SEQ ID NO: 195419 - DNA, 25 bp, Homo sapien
gatgcccctgggtcaggctctttct

SEQ ID NO: 195420 - DNA, 25 bp, Homo sapien
ttctgttctggagactgaagacagc

SEQ ID NO: 195421 - DNA, 25 bp, Homo sapien
ctggagactgaagacagctgatgca

SEQ ID NO: 195422 - DNA, 25 bp, Homo sapien
atcatctgaaagtgcccagagagca

SEQ ID NO: 195423 - DNA, 25 bp, Homo sapien
agtggcagagtacatctcatccaga

SEQ ID NO: 195424 - DNA, 25 bp, Homo sapien
ggcagagtacatctcatccagagaa

SEQ ID NO: 195425 - DNA, 25 bp, Homo sapien
tctcatccagagaaacagcatcctg

SEQ ID NO: 195426 - DNA, 25 bp, Homo sapien
gttctctgggcattcgcgtggtgaa

SEQ ID NO: 195427 - DNA, 25 bp, Homo sapien
ggcattcgcgtggtgaaggacctca

SEQ ID NO: 195428 - DNA, 25 bp, Homo sapien
attcgcgtggtgaaggacctcagtt

SEQ ID NO: 195429 - DNA, 25 bp, Homo sapien
gcgtggtgaaggacctcagttcaga

SEQ ID NO: 195430 - DNA, 25 bp, Homo sapien
tggtgaaggacctcagttcagaaga

SEQ ID NO: 195431 - DNA, 25 bp, Homo sapien
agagcttgcagctttccagaaggaa

SEQ ID NO: 195432 - DNA, 25 bp, Homo sapien
gcttgcagctttccagaaggaacga

SEQ ID NO: 195433 - DNA, 25 bp, Homo sapien
gctttccagaaggaacgagccatct

SEQ ID NO: 195434 - DNA, 25 bp, Homo sapien
cagaaggaacgagccatcttcctgg

SEQ ID NO: 195435 - DNA, 25 bp, Homo sapien
gaaggaggcagatttggctgcccaa

SEQ ID NO: 195436 - DNA, 25 bp, Homo sapien
ggcagatttggctgcccaagaagaa

SEQ ID NO: 195437 - DNA, 25 bp, Homo sapien
gaccacacaggagaagctcggactt

SEQ ID NO: 195438 - DNA, 25 bp, Homo sapien
gagaagctcggacttggcactcctg

SEQ ID NO: 195439 - DNA, 25 bp, Homo sapien
acttggcactcctggacaacctgga

SEQ ID NO: 195440 - DNA, 25 bp, Homo sapien
ctggacccagatgcaagacactgtg

SEQ ID NO: 195441 - DNA, 25 bp, Homo sapien
agaagtccagaagggtcatctgccc

SEQ ID NO: 195442 - DNA, 25 bp, Homo sapien
actcccctccgtctgtgacatggag

SEQ ID NO: 195443 - DNA, 25 bp, Homo sapien
tccgtctgtgacatggagggtgttc

SEQ ID NO: 195444 - DNA, 25 bp, Homo sapien
gggcccatccctctgatgtagtcct

SEQ ID NO: 195445 - DNA, 25 bp, Homo sapien
gagggtcacagtaccttgaatgggc

SEQ ID NO: 195446 - DNA, 25 bp, Homo sapien
agtaccttgaatgggctgagaacag

SEQ ID NO: 195447 - DNA, 25 bp, Homo sapien
aatgggctgagaacagaccaaaaaa

SEQ ID NO: 195448 - DNA, 25 bp, Homo sapien
gtcattgacttttcacatggcctcg

SEQ ID NO: 195449 - DNA, 25 bp, Homo sapien
acatggcctcgcattgtttgaacgt

SEQ ID NO: 195450 - DNA, 25 bp, Homo sapien
gcctcgcattgtttgaacgttgcca

SEQ ID NO: 195451 - DNA, 25 bp, Homo sapien
acgttgccaaagacctgtggagcct

SEQ ID NO: 195452 - DNA, 25 bp, Homo sapien
tgaaggagcaggtcacaatgatgtg

SEQ ID NO: 195453 - DNA, 25 bp, Homo sapien
ggaactttatggacagtatcttgaa

SEQ ID NO: 195454 - DNA, 25 bp, Homo sapien
attttctcaaggtctacagttttca

SEQ ID NO: 195455 - DNA, 25 bp, Homo sapien
ggtctacagttttcaatgacggtac

SEQ ID NO: 195456 - DNA, 25 bp, Homo sapien
gacggtactatgtattccattatct

SEQ ID NO: 195457 - DNA, 25 bp, Homo sapien
tccattatcttctctttaccaaact

SEQ ID NO: 195458 - DNA, 25 bp, Homo sapien
gattaatataccaatgatcctttca

SEQ ID NO: 195459 - DNA, 25 bp, Homo sapien
ggtgtcggtgtattcaggaaacctc

SEQ ID NO: 195460 - DNA, 25 bp, Homo sapien
tgtcggtgtattcaggaaacctcct

SEQ ID NO: 195461 - DNA, 25 bp, Homo sapien
gagattgaagaactaggtgtcatca

SEQ ID NO: 195462 - DNA, 25 bp, Homo sapien
gattgaagaactaggtgtcatcatc

SEQ ID NO: 195463 - DNA, 25 bp, Homo sapien
gaagaactaggtgtcatcatcaaca

SEQ ID NO: 195464 - DNA, 25 bp, Homo sapien
aagaactaggtgtcatcatcaacaa

SEQ ID NO: 195465 - DNA, 25 bp, Homo sapien
gaactaggtgtcatcatcaacaagg

SEQ ID NO: 195466 - DNA, 25 bp, Homo sapien
aactaggtgtcatcatcaacaaggt

SEQ ID NO: 195467 - DNA, 25 bp, Homo sapien
tgatggctcctgcacaggccctgca

SEQ ID NO: 195468 - DNA, 25 bp, Homo sapien
aggtgccagccctgcaagccgcctc

SEQ ID NO: 195469 - DNA, 25 bp, Homo sapien
cgcctcttctcggtagaagggagaa

SEQ ID NO: 195470 - DNA, 25 bp, Homo sapien
ggcaggtgactggaatagctgatta

SEQ ID NO: 195471 - DNA, 25 bp, Homo sapien
gctgattaaaacataaatgctgctt

SEQ ID NO: 195472 - DNA, 25 bp, Homo sapien
aaatgctgcttttaggttaaccaca

SEQ ID NO: 195473 - DNA, 25 bp, Homo sapien
ggttaaccacaaaggaacaactcag

SEQ ID NO: 195474 - DNA, 25 bp, Homo sapien
gaacaactcaggatcagtcgtgatt

SEQ ID NO: 195475 - DNA, 25 bp, Homo sapien
atcagtcgtgattgctaaagtattc

SEQ ID NO: 195476 - DNA, 25 bp, Homo sapien
aagaggcacctctggtactgaagat

SEQ ID NO: 195477 - DNA, 25 bp, Homo sapien
cacctctggtactgaagattcctgc

SEQ ID NO: 195478 - DNA, 25 bp, Homo sapien
gattcctgctgattttgagaactgg

SEQ ID NO: 195479 - DNA, 25 bp, Homo sapien
gaactggatggagaatactttccca

SEQ ID NO: 195480 - DNA, 25 bp, Homo sapien
gatggagaatactttcccatcaggg

SEQ ID NO: 195481 - DNA, 25 bp, Homo sapien
gagatcaatcgaaacttggtccagt

SEQ ID NO: 195482 - DNA, 25 bp, Homo sapien
ttggtccagttttccaggctgtaag

SEQ ID NO: 195483 - DNA, 25 bp, Homo sapien
aaagggccaataaccagactgctga

SEQ ID NO: 195484 - DNA, 25 bp, Homo sapien
agactgctgaggttgcccacaggag

SEQ ID NO: 195485 - DNA, 25 bp, Homo sapien
gaggttgcccacaggaggatcacaa

SEQ ID NO: 195486 - DNA, 25 bp, Homo sapien
ggatcacaaactcacagcacagtgt

SEQ ID NO: 195487 - DNA, 25 bp, Homo sapien
agcacagtgtgtgatgctgtccttc

SEQ ID NO: 195488 - DNA, 25 bp, Homo sapien
tgtccggaggctcatggcccatatt

SEQ ID NO: 195489 - DNA, 25 bp, Homo sapien
atgcccttctttgtatcactgacta

SEQ ID NO: 195490 - DNA, 25 bp, Homo sapien
gactattatatgttgctctcttgcc

SEQ ID NO: 195491 - DNA, 25 bp, Homo sapien
atgttgctctcttgcctaaatcttc

SEQ ID NO: 195492 - DNA, 25 bp, Homo sapien
accccaggctgaaggtgccatggag

SEQ ID NO: 195493 - DNA, 25 bp, Homo sapien
gaaggtgccatggagtcctcttaaa

SEQ ID NO: 195494 - DNA, 25 bp, Homo sapien
gtgccatggagtcctcttaaagagg

SEQ ID NO: 195495 - DNA, 25 bp, Homo sapien
tcttaaagagggacgagggccagac

SEQ ID NO: 195496 - DNA, 25 bp, Homo sapien
gagggccagactgaagcagcacaag

SEQ ID NO: 195497 - DNA, 25 bp, Homo sapien
gacacccatgccaagcagtgggagc

SEQ ID NO: 195498 - DNA, 25 bp, Homo sapien
catgccaagcagtgggagcacgcag

SEQ ID NO: 195499 - DNA, 25 bp, Homo sapien
ggcacggagccttgccggcatcagc

SEQ ID NO: 195500 - DNA, 25 bp, Homo sapien
gagccctcattccaattccaagcta

SEQ ID NO: 195501 - DNA, 25 bp, Homo sapien
ttccaattccaagctaagaaggtat

SEQ ID NO: 195502 - DNA, 25 bp, Homo sapien
ccccaaggagtgatacatatattgt

SEQ ID NO: 195503 - DNA, 25 bp, Homo sapien
cttgggtattgtttgtaatgtgact

SEQ ID NO: 195504 - DNA, 25 bp, Homo sapien
taggttaacagcgtgttttagaaga

SEQ ID NO: 195505 - DNA, 25 bp, Homo sapien
ttcctgtctgcacaattagctattc

SEQ ID NO: 195506 - DNA, 25 bp, Homo sapien
ttagctattcagagcaagagggcct

SEQ ID NO: 195507 - DNA, 25 bp, Homo sapien
gcctgattttatagaagccccttga

SEQ ID NO: 195508 - DNA, 25 bp, Homo sapien
aagccccttgaaaagaggtccagat

SEQ ID NO: 195509 - DNA, 25 bp, Homo sapien
ccagatgagagcagagatacagtga

SEQ ID NO: 195510 - DNA, 25 bp, Homo sapien
aattatgtgatctgtgtgttgtggg

SEQ ID NO: 195511 - DNA, 25 bp, Homo sapien
tttcaatatgtaactacggagctgt

SEQ ID NO: 195512 - DNA, 25 bp, Homo sapien
acggagctgtagtgccattagaaac

SEQ ID NO: 195513 - DNA, 25 bp, Homo sapien
gtagtgccattagaaactgtgaatt

SEQ ID NO: 195514 - DNA, 25 bp, Homo sapien
aatcatacagtgacttgtctttttg

SEQ ID NO: 195515 - DNA, 25 bp, Homo sapien
ttgtgtcaggtgacaggatttcctt

SEQ ID NO: 195516 - DNA, 25 bp, Homo sapien
tttccttcctgtattatacatataa

SEQ ID NO: 195517 - DNA, 25 bp, Homo sapien
ggaatgttccgttacatgtgcgtac

SEQ ID NO: 195518 - DNA, 25 bp, Homo sapien
tgttccgttacatgtgcgtaccaca

SEQ ID NO: 195519 - DNA, 25 bp, Homo sapien
ttacatgtgcgtaccacactctgtt

SEQ ID NO: 195520 - DNA, 25 bp, Homo sapien
actctgttcctccatcagtgaacac

SEQ ID NO: 195521 - DNA, 25 bp, Homo sapien
tcctcttgactattgggagtagtgc

SEQ ID NO: 195522 - DNA, 25 bp, Homo sapien
ggagtagtgctaatacagacacggg

SEQ ID NO: 195523 - DNA, 25 bp, Homo sapien
atatctctttgagactctgccttta

SEQ ID NO: 195524 - DNA, 25 bp, Homo sapien
ctttgagactctgcctttaattcct

SEQ ID NO: 195525 - DNA, 25 bp, Homo sapien
atgccctactcttgtttacaccgcc

SEQ ID NO: 195526 - DNA, 25 bp, Homo sapien
tgccctactcttgtttacaccgccg

SEQ ID NO: 195527 - DNA, 25 bp, Homo sapien
gccctactcttgtttacaccgccgg

SEQ ID NO: 195528 - DNA, 25 bp, Homo sapien
attcccattcttatgtcaccctcta

SEQ ID NO: 195529 - DNA, 25 bp, Homo sapien
ttcccattcttatgtcaccctctac

SEQ ID NO: 195530 - DNA, 25 bp, Homo sapien
tcccattcttatgtcaccctctacc

SEQ ID NO: 195531 - DNA, 25 bp, Homo sapien
cccattcttatgtcaccctctacct

SEQ ID NO: 195532 - DNA, 25 bp, Homo sapien
cattcttatgtcaccctctacctct

SEQ ID NO: 195533 - DNA, 25 bp, Homo sapien
attcttatgtcaccctctacctctc

SEQ ID NO: 195534 - DNA, 25 bp, Homo sapien
tcttatgtcaccctctacctctccc

SEQ ID NO: 195535 - DNA, 25 bp, Homo sapien
ttatgtcaccctctacctctcccca

SEQ ID NO: 195536 - DNA, 25 bp, Homo sapien
tgagcccaagccagttttggccttc

SEQ ID NO: 195537 - DNA, 25 bp, Homo sapien
agttttggccttcacagcctggccg

SEQ ID NO: 195538 - DNA, 25 bp, Homo sapien
ccatctcccattcttactgggagtt

SEQ ID NO: 195539 - DNA, 25 bp, Homo sapien
atctcagcactgtctgaggagggca

SEQ ID NO: 195540 - DNA, 25 bp, Homo sapien
agggtgcacggccaagatctccaga

SEQ ID NO: 195541 - DNA, 25 bp, Homo sapien
aagatctccagactgctggttccca

SEQ ID NO: 195542 - DNA, 25 bp, Homo sapien
agggaaccctccctacatctgggct

SEQ ID NO: 195543 - DNA, 25 bp, Homo sapien
acatctgggcttcagatcctgactc

SEQ ID NO: 195544 - DNA, 25 bp, Homo sapien
tcccctaattccctgagctgtagat

SEQ ID NO: 195545 - DNA, 25 bp, Homo sapien
tgagctgtagatcctctggtgatga

SEQ ID NO: 195546 - DNA, 25 bp, Homo sapien
ggtgatgagtatgttgcactttctt

SEQ ID NO: 195547 - DNA, 25 bp, Homo sapien
ccccaggtggagcaacatgcgattc

SEQ ID NO: 195548 - DNA, 25 bp, Homo sapien
gcaacatgcgattctggaggcacgg

SEQ ID NO: 195549 - DNA, 25 bp, Homo sapien
gagtacatatagtctttctggtttc

SEQ ID NO: 195550 - DNA, 25 bp, Homo sapien
ttctggtttctggagataacccatc

SEQ ID NO: 195551 - DNA, 25 bp, Homo sapien
catcacacttaactcatctaactgc

SEQ ID NO: 195552 - DNA, 25 bp, Homo sapien
cctccacctctagttgttactaagt

SEQ ID NO: 195553 - DNA, 25 bp, Homo sapien
aagtagctgcagtaggcattgctgg

SEQ ID NO: 195554 - DNA, 25 bp, Homo sapien
aaacacacaccaaacagtactgcta

SEQ ID NO: 195555 - DNA, 25 bp, Homo sapien
cttagtttctaaggctgcacaggga

SEQ ID NO: 195556 - DNA, 25 bp, Homo sapien
aagactgggctttggacaatctaga

SEQ ID NO: 195557 - DNA, 25 bp, Homo sapien
tctagaggtaatttatatccgcccc

SEQ ID NO: 195558 - DNA, 25 bp, Homo sapien
gacatatatgttgtgcccgtgttca

SEQ ID NO: 195559 - DNA, 25 bp, Homo sapien
gcccgtgttcatcctgtgtatttat

SEQ ID NO: 195560 - DNA, 25 bp, Homo sapien
gagtctagatttatatactgcaatg

SEQ ID NO: 195561 - DNA, 25 bp, Homo sapien
agcttcatttatttaatgccacttt

SEQ ID NO: 195562 - DNA, 25 bp, Homo sapien
atttgtttcctggtggacagccggg

SEQ ID NO: 195563 - DNA, 25 bp, Homo sapien
ggacagccgggtaatgcttttagct

SEQ ID NO: 195564 - DNA, 25 bp, Homo sapien
taatgcttttagctgctcgcatgct

SEQ ID NO: 195565 - DNA, 25 bp, Homo sapien
ttagctgctcgcatgcttgtctttc

SEQ ID NO: 195566 - DNA, 25 bp, Homo sapien
tgcttgtctttctgcatctccatca

SEQ ID NO: 195567 - DNA, 25 bp, Homo sapien
atctccatcatctgtttaccttttg

SEQ ID NO: 195568 - DNA, 25 bp, Homo sapien
aataaactagtttgggacttggctg

SEQ ID NO: 195569 - DNA, 25 bp, Homo sapien
gtcttcttccaagtggtggagttca

SEQ ID NO: 195570 - DNA, 25 bp, Homo sapien
aaattgaaccaggaacatgacatcg

SEQ ID NO: 195571 - DNA, 25 bp, Homo sapien
gacatcgatacaagtgaaacagcat

SEQ ID NO: 195572 - DNA, 25 bp, Homo sapien
aatttctgaagaccatgcctcttga

SEQ ID NO: 195573 - DNA, 25 bp, Homo sapien
accatgcctcttgaagctttttctg

SEQ ID NO: 195574 - DNA, 25 bp, Homo sapien
tgcctcctgattctctctttgtaaa

SEQ ID NO: 195575 - DNA, 25 bp, Homo sapien
gattctctctttgtaaactattttc

SEQ ID NO: 195576 - DNA, 25 bp, Homo sapien
ccatgagctctggaaggtatatgca

SEQ ID NO: 195577 - DNA, 25 bp, Homo sapien
ggtatatgcatcttctgtaatactc

SEQ ID NO: 195578 - DNA, 25 bp, Homo sapien
gcatcttctgtaatactcagatagg

SEQ ID NO: 195579 - DNA, 25 bp, Homo sapien
ctcagataggtataagatttttcac

SEQ ID NO: 195580 - DNA, 25 bp, Homo sapien
gaaccccaagagagggaggacccag

SEQ ID NO: 195581 - DNA, 25 bp, Homo sapien
gtgagcacgaattaccgaggccttc

SEQ ID NO: 195582 - DNA, 25 bp, Homo sapien
ccctttgatacagtccaggatttgt

SEQ ID NO: 195583 - DNA, 25 bp, Homo sapien
ggtccatacatactctccgaagata

SEQ ID NO: 195584 - DNA, 25 bp, Homo sapien
actctccgaagatagcaacttgctt

SEQ ID NO: 195585 - DNA, 25 bp, Homo sapien
agcaacttgcttcaggtcaaagtga

SEQ ID NO: 195586 - DNA, 25 bp, Homo sapien
actactgctcttgccctggactatt

SEQ ID NO: 195587 - DNA, 25 bp, Homo sapien
tcaggaagggcagcccggatgttcc

SEQ ID NO: 195588 - DNA, 25 bp, Homo sapien
atgttccatgttaaatcgtgacaga

SEQ ID NO: 195589 - DNA, 25 bp, Homo sapien
gtgacagaattgcaccagacctgat

SEQ ID NO: 195590 - DNA, 25 bp, Homo sapien
gcaccagacctgatgagttggaaac

SEQ ID NO: 195591 - DNA, 25 bp, Homo sapien
tgtaacagggctcccacagttcaca

SEQ ID NO: 195592 - DNA, 25 bp, Homo sapien
ctcccacagttcacaggttagcaat

SEQ ID NO: 195593 - DNA, 25 bp, Homo sapien
ttagcaatgtgtgtgagtccgtgtt

SEQ ID NO: 195594 - DNA, 25 bp, Homo sapien
gagtccgtgtttaatttgccctgtt

SEQ ID NO: 195595 - DNA, 25 bp, Homo sapien
tgccctgttaaattctaacttctag

SEQ ID NO: 195596 - DNA, 25 bp, Homo sapien
aacttctaggttttgatctttcatt

SEQ ID NO: 195597 - DNA, 25 bp, Homo sapien
gatctttcattctagactactgaca

SEQ ID NO: 195598 - DNA, 25 bp, Homo sapien
ttgctgaattagctgtctttccatt

SEQ ID NO: 195599 - DNA, 25 bp, Homo sapien
agctgtctttccatttggtctttaa

SEQ ID NO: 195600 - DNA, 25 bp, Homo sapien
actgcacagtactttattgctttga

SEQ ID NO: 195601 - DNA, 25 bp, Homo sapien
gctttgaatgtcaggtgtggcaaca

SEQ ID NO: 195602 - DNA, 25 bp, Homo sapien
aggtggagtgactggtttacatcac

SEQ ID NO: 195603 - DNA, 25 bp, Homo sapien
tgactggtttacatcacagctgccc

SEQ ID NO: 195604 - DNA, 25 bp, Homo sapien
tggtttacatcacagctgccccagg

SEQ ID NO: 195605 - DNA, 25 bp, Homo sapien
gtcccccggaccagtgaagctggag

SEQ ID NO: 195606 - DNA, 25 bp, Homo sapien
aagctggagccagggtgtaaggcaa

SEQ ID NO: 195607 - DNA, 25 bp, Homo sapien
gccaggtcccatggaatcagaaggt

SEQ ID NO: 195608 - DNA, 25 bp, Homo sapien
tggaatcagaaggttacacacacac

SEQ ID NO: 195609 - DNA, 25 bp, Homo sapien
gggaaggaactgttctcagaggctc

SEQ ID NO: 195610 - DNA, 25 bp, Homo sapien
gttctcagaggctccaatttatatt

SEQ ID NO: 195611 - DNA, 25 bp, Homo sapien
gaggctccaatttatattcatctgg

SEQ ID NO: 195612 - DNA, 25 bp, Homo sapien
ctgttttcagggtgggtgatgtaaa

SEQ ID NO: 195613 - DNA, 25 bp, Homo sapien
agctgccagttttgaataatgaata

SEQ ID NO: 195614 - DNA, 25 bp, Homo sapien
tatcatattgtatcatcaatgctga

SEQ ID NO: 195615 - DNA, 25 bp, Homo sapien
gctgatatttaactgagttggtctt

SEQ ID NO: 195616 - DNA, 25 bp, Homo sapien
ctgagttggtctttaggtttaagat

SEQ ID NO: 195617 - DNA, 25 bp, Homo sapien
gaatatcactacttgttctgaaaac

SEQ ID NO: 195618 - DNA, 25 bp, Homo sapien
tgttgctttttatctcgctgcctag

SEQ ID NO: 195619 - DNA, 25 bp, Homo sapien
tatctcgctgcctagattgaaatat

SEQ ID NO: 195620 - DNA, 25 bp, Homo sapien
tgctatttcttctgcataagtgaca

SEQ ID NO: 195621 - DNA, 25 bp, Homo sapien
gtgacagtgaaccaattcatcatga

SEQ ID NO: 195622 - DNA, 25 bp, Homo sapien
ttcatcatgagtaagctcccttctg

SEQ ID NO: 195623 - DNA, 25 bp, Homo sapien
tcatgagtaagctcccttctgtcat

SEQ ID NO: 195624 - DNA, 25 bp, Homo sapien
ctgttacaggcagaaaccgaccgga

SEQ ID NO: 195625 - DNA, 25 bp, Homo sapien
aaaccgaccggaggaccttgcagat

SEQ ID NO: 195626 - DNA, 25 bp, Homo sapien
ccttgcagatgcttcgggagaacct

SEQ ID NO: 195627 - DNA, 25 bp, Homo sapien
aggaggccatcatcatgaaggacgt

SEQ ID NO: 195628 - DNA, 25 bp, Homo sapien
tgtgttccacacaacccgctgggtg

SEQ ID NO: 195629 - DNA, 25 bp, Homo sapien
agctgtacgggctgcgcaccacaga

SEQ ID NO: 195630 - DNA, 25 bp, Homo sapien
gctgcgcaccacagaggaggctctc

SEQ ID NO: 195631 - DNA, 25 bp, Homo sapien
agaggaggctctccatgccagccac

SEQ ID NO: 195632 - DNA, 25 bp, Homo sapien
gccagccacggcttcatgtggtaca

SEQ ID NO: 195633 - DNA, 25 bp, Homo sapien
atgtggtacacgtaggccctgtgcc

SEQ ID NO: 195634 - DNA, 25 bp, Homo sapien
actgggacggaataaatgctctgca

SEQ ID NO: 195635 - DNA, 25 bp, Homo sapien
aaggactcttgcttcctcaagccct

SEQ ID NO: 195636 - DNA, 25 bp, Homo sapien
aagcccttctggcttcgtttatggt

SEQ ID NO: 195637 - DNA, 25 bp, Homo sapien
ttctggcttcgtttatggtcttcat

SEQ ID NO: 195638 - DNA, 25 bp, Homo sapien
ggcttcgtttatggtcttcattaaa

SEQ ID NO: 195639 - DNA, 25 bp, Homo sapien
taagcctaactttgtcgctagtcct

SEQ ID NO: 195640 - DNA, 25 bp, Homo sapien
taactttgtcgctagtcctaaggag

SEQ ID NO: 195641 - DNA, 25 bp, Homo sapien
aaccacaaagtttttatcattgaag

SEQ ID NO: 195642 - DNA, 25 bp, Homo sapien
attgaagacaatattgaacaacccc

SEQ ID NO: 195643 - DNA, 25 bp, Homo sapien
agaggcttgagactttcctttgtgt

SEQ ID NO: 195644 - DNA, 25 bp, Homo sapien
taggacttggaggagaaatcccctg

SEQ ID NO: 195645 - DNA, 25 bp, Homo sapien
tggactttcactaaccctctgacat

SEQ ID NO: 195646 - DNA, 25 bp, Homo sapien
ttcttaaagcaatctatgtaactgt

SEQ ID NO: 195647 - DNA, 25 bp, Homo sapien
aagcaatctatgtaactgtaaatta

SEQ ID NO: 195648 - DNA, 25 bp, Homo sapien
attaaaccaatctacaaactattgt

SEQ ID NO: 195649 - DNA, 25 bp, Homo sapien
caaactattgtaggcatctgtaaat

SEQ ID NO: 195650 - DNA, 25 bp, Homo sapien
attgtaggcatctgtaaattctgtt

SEQ ID NO: 195651 - DNA, 25 bp, Homo sapien
gtaggcatctgtaaattctgttgta

SEQ ID NO: 195652 - DNA, 25 bp, Homo sapien
ggcatctgtaaattctgttgtaggt

SEQ ID NO: 195653 - DNA, 25 bp, Homo sapien
actttgttgaagtcttaatcagcag

SEQ ID NO: 195654 - DNA, 25 bp, Homo sapien
tgttgaagtcttaatcagcagatta

SEQ ID NO: 195655 - DNA, 25 bp, Homo sapien
agtcttaatcagcagattatgttgt

SEQ ID NO: 195656 - DNA, 25 bp, Homo sapien
cagcagattatgttgtgaatatatt

SEQ ID NO: 195657 - DNA, 25 bp, Homo sapien
tcagcctccaggaggcacagcagat

SEQ ID NO: 195658 - DNA, 25 bp, Homo sapien
gccctgaggaggtccagaagaacta

SEQ ID NO: 195659 - DNA, 25 bp, Homo sapien
gaggtccagaagaactatgaacact

SEQ ID NO: 195660 - DNA, 25 bp, Homo sapien
agaactatgaacacttatttaaggt

SEQ ID NO: 195661 - DNA, 25 bp, Homo sapien
aatgataaatccgtgggtggctcct

SEQ ID NO: 195662 - DNA, 25 bp, Homo sapien
gctccttctacctgcagtcaaaggt

SEQ ID NO: 195663 - DNA, 25 bp, Homo sapien
gcagtcaaaggtggtccgcgcaaag

SEQ ID NO: 195664 - DNA, 25 bp, Homo sapien
tccgcgcaaaggagcgcctggatga

SEQ ID NO: 195665 - DNA, 25 bp, Homo sapien
gatgaggaactcaaaatccaggccc

SEQ ID NO: 195666 - DNA, 25 bp, Homo sapien
gaaaaatggcagatgccccatacgt

SEQ ID NO: 195667 - DNA, 25 bp, Homo sapien
agatgccccatacgtgactgctcgg

SEQ ID NO: 195668 - DNA, 25 bp, Homo sapien
cacttccgatccaaagaccacaaga

SEQ ID NO: 195669 - DNA, 25 bp, Homo sapien
tgaagcagctgagcgtcgagcccta

SEQ ID NO: 195670 - DNA, 25 bp, Homo sapien
gcgtcgagccctacagtcaggaaga

SEQ ID NO: 195671 - DNA, 25 bp, Homo sapien
agccctacagtcaggaagaggcgga

SEQ ID NO: 195672 - DNA, 25 bp, Homo sapien
cagcgggtatgggatcctatgtgcc

SEQ ID NO: 195673 - DNA, 25 bp, Homo sapien
tggcagtgcccacggaagtgtccac

SEQ ID NO: 195674 - DNA, 25 bp, Homo sapien
cactgaggtccctgagatggatacc

SEQ ID NO: 195675 - DNA, 25 bp, Homo sapien
gagatggatacctctacctgacatg

SEQ ID NO: 195676 - DNA, 25 bp, Homo sapien
tctacctgacatggcctgaagatgc

SEQ ID NO: 195677 - DNA, 25 bp, Homo sapien
agaggaattgcccatggacagtgac

SEQ ID NO: 195678 - DNA, 25 bp, Homo sapien
gcccatggacagtgacgcaaggact

SEQ ID NO: 195679 - DNA, 25 bp, Homo sapien
aaatcaccccacagggtggaggtct

SEQ ID NO: 195680 - DNA, 25 bp, Homo sapien
ggaggtctcctgttggctacactct

SEQ ID NO: 195681 - DNA, 25 bp, Homo sapien
gtctcctgttggctacactctaaag

SEQ ID NO: 195682 - DNA, 25 bp, Homo sapien
gttggctacactctaaagctgcttt

SEQ ID NO: 195683 - DNA, 25 bp, Homo sapien
aaggttagggcatagatttgtctcc

SEQ ID NO: 195684 - DNA, 25 bp, Homo sapien
agggcatagatttgtctccttccca

SEQ ID NO: 195685 - DNA, 25 bp, Homo sapien
atagatttgtctccttcccaacacg

SEQ ID NO: 195686 - DNA, 25 bp, Homo sapien
ttcccaacacggacccagagagcag

SEQ ID NO: 195687 - DNA, 25 bp, Homo sapien
aactctcctgtccacatatgataat

SEQ ID NO: 195688 - DNA, 25 bp, Homo sapien
gtccacatatgataataccattctg

SEQ ID NO: 195689 - DNA, 25 bp, Homo sapien
atgataataccattctgcatagtat

SEQ ID NO: 195690 - DNA, 25 bp, Homo sapien
atattattggaagggcacacacgct

SEQ ID NO: 195691 - DNA, 25 bp, Homo sapien
tattggaagggcacacacgcttgct

SEQ ID NO: 195692 - DNA, 25 bp, Homo sapien
ttgctgccagccacgttcttcttgg

SEQ ID NO: 195693 - DNA, 25 bp, Homo sapien
gctgccagccacgttcttcttggtg

SEQ ID NO: 195694 - DNA, 25 bp, Homo sapien
ggctgcccacttctgctgcagaact

SEQ ID NO: 195695 - DNA, 25 bp, Homo sapien
atcatgccagcggagaagagcttga

SEQ ID NO: 195696 - DNA, 25 bp, Homo sapien
aagagcttgagcctaggaacacaat

SEQ ID NO: 195697 - DNA, 25 bp, Homo sapien
gagcttgagcctaggaacacaatga

SEQ ID NO: 195698 - DNA, 25 bp, Homo sapien
ttgagcctaggaacacaatgatggg

SEQ ID NO: 195699 - DNA, 25 bp, Homo sapien
gggcctggtgtcatttggagagaat

SEQ ID NO: 195700 - DNA, 25 bp, Homo sapien
aactgggcctagtgtctggaacaac

SEQ ID NO: 195701 - DNA, 25 bp, Homo sapien
agcttagaggatgcttttaatgggc

SEQ ID NO: 195702 - DNA, 25 bp, Homo sapien
cttagaggatgcttttaatgggctt

SEQ ID NO: 195703 - DNA, 25 bp, Homo sapien
tagaggatgcttttaatgggctttt

SEQ ID NO: 195704 - DNA, 25 bp, Homo sapien
atgggcttttacttgcattagaacc

SEQ ID NO: 195705 - DNA, 25 bp, Homo sapien
gcattagaaccacataaagagcagt

SEQ ID NO: 195706 - DNA, 25 bp, Homo sapien
ttagaaccacataaagagcagtata

SEQ ID NO: 195707 - DNA, 25 bp, Homo sapien
aaagagcagtataaagagtttcagg

SEQ ID NO: 195708 - DNA, 25 bp, Homo sapien
aagagtttcaggatctgaaccaaga

SEQ ID NO: 195709 - DNA, 25 bp, Homo sapien
ttcaggatctgaaccaagaagtcat

SEQ ID NO: 195710 - DNA, 25 bp, Homo sapien
caggatctgaaccaagaagtcatga

SEQ ID NO: 195711 - DNA, 25 bp, Homo sapien
gaagtcatgaatttggatgatattc

SEQ ID NO: 195712 - DNA, 25 bp, Homo sapien
ggcacaacatgaacgtgagctccag

SEQ ID NO: 195713 - DNA, 25 bp, Homo sapien
tgagctccagaagctagagcagaga

SEQ ID NO: 195714 - DNA, 25 bp, Homo sapien
gagagtgtctctgcgcagagcacac

SEQ ID NO: 195715 - DNA, 25 bp, Homo sapien
ctgcgcagagcacaccttgagcaga

SEQ ID NO: 195716 - DNA, 25 bp, Homo sapien
agctggctgcccttcagaaggaacg

SEQ ID NO: 195717 - DNA, 25 bp, Homo sapien
gcccttcagaaggaacgcagcgaga

SEQ ID NO: 195718 - DNA, 25 bp, Homo sapien
aacctattggaaaggcaagagcgag

SEQ ID NO: 195719 - DNA, 25 bp, Homo sapien
gagcgagagattgaaacttttgaca

SEQ ID NO: 195720 - DNA, 25 bp, Homo sapien
aaacttttgacatggagagcctcag

SEQ ID NO: 195721 - DNA, 25 bp, Homo sapien
gaatttggttacattagattttcct

SEQ ID NO: 195722 - DNA, 25 bp, Homo sapien
tcctaaggaggactacagatgagat

SEQ ID NO: 195723 - DNA, 25 bp, Homo sapien
cctgatggcgaaagtgagaaaactg

SEQ ID NO: 195724 - DNA, 25 bp, Homo sapien
gaaagttcagatagcgaatcttctt

SEQ ID NO: 195725 - DNA, 25 bp, Homo sapien
gcgaatcttcttttagtgattaagc

SEQ ID NO: 195726 - DNA, 25 bp, Homo sapien
gataagaattacatatgcatgcata

SEQ ID NO: 195727 - DNA, 25 bp, Homo sapien
tacattctgtaagagattgagcctg

SEQ ID NO: 195728 - DNA, 25 bp, Homo sapien
gattgagcctgaactctcttagtca

SEQ ID NO: 195729 - DNA, 25 bp, Homo sapien
gagcctgaactctcttagtcataaa

SEQ ID NO: 195730 - DNA, 25 bp, Homo sapien
gtcataaaaacatcaaatggccaca

SEQ ID NO: 195731 - DNA, 25 bp, Homo sapien
aaatggccacatgtccactaccaag

SEQ ID NO: 195732 - DNA, 25 bp, Homo sapien
ccactaccaagcttcttctatgtta

SEQ ID NO: 195733 - DNA, 25 bp, Homo sapien
taccaagcttcttctatgttaaaaa

SEQ ID NO: 195734 - DNA, 25 bp, Homo sapien
gacatcaaaacaccagcttttcacc

SEQ ID NO: 195735 - DNA, 25 bp, Homo sapien
tttcaccttttccttgagactcagg

SEQ ID NO: 195736 - DNA, 25 bp, Homo sapien
accttttccttgagactcaggagga

SEQ ID NO: 195737 - DNA, 25 bp, Homo sapien
ttccttgagactcaggaggaccaaa

SEQ ID NO: 195738 - DNA, 25 bp, Homo sapien
tccctccccttatcaagggttgaag

SEQ ID NO: 195739 - DNA, 25 bp, Homo sapien
ttgaaggaagggagccatccttact

SEQ ID NO: 195740 - DNA, 25 bp, Homo sapien
gccatccttactgttcagagacagc

SEQ ID NO: 195741 - DNA, 25 bp, Homo sapien
atccttactgttcagagacagcaac

SEQ ID NO: 195742 - DNA, 25 bp, Homo sapien
tccctcccgtaactcaggctgagaa

SEQ ID NO: 195743 - DNA, 25 bp, Homo sapien
aggctgagaaggaaccagccagctc

SEQ ID NO: 195744 - DNA, 25 bp, Homo sapien
ttacctcctcctggttgcttttctt

SEQ ID NO: 195745 - DNA, 25 bp, Homo sapien
ggcaagctaaggaggattttcacta

SEQ ID NO: 195746 - DNA, 25 bp, Homo sapien
ggattttcactagcagtttcatttg

SEQ ID NO: 195747 - DNA, 25 bp, Homo sapien
aataccaatctagaggtgagcttct

SEQ ID NO: 195748 - DNA, 25 bp, Homo sapien
gagcttctcaatctttaatgtgtat

SEQ ID NO: 195749 - DNA, 25 bp, Homo sapien
atagatgccgattctgaaacaggtc

SEQ ID NO: 195750 - DNA, 25 bp, Homo sapien
ggttctgcatgtataacaagctcca

SEQ ID NO: 195751 - DNA, 25 bp, Homo sapien
agctgtcacattcgcaatcacattt

SEQ ID NO: 195752 - DNA, 25 bp, Homo sapien
gttgaggtgtttttcacagaggcat

SEQ ID NO: 195753 - DNA, 25 bp, Homo sapien
ggcatcagaccaccaaagcggtaca

SEQ ID NO: 195754 - DNA, 25 bp, Homo sapien
aaagcggtacaggtcagccttccta

SEQ ID NO: 195755 - DNA, 25 bp, Homo sapien
tacaggtcagccttcctagatcttt

SEQ ID NO: 195756 - DNA, 25 bp, Homo sapien
aagtttcatcacaaactgtgtccag

SEQ ID NO: 195757 - DNA, 25 bp, Homo sapien
agtttcatcacaaactgtgtccagt

SEQ ID NO: 195758 - DNA, 25 bp, Homo sapien
gtttcatcacaaactgtgtccagtt

SEQ ID NO: 195759 - DNA, 25 bp, Homo sapien
tttcatcacaaactgtgtccagttt

SEQ ID NO: 195760 - DNA, 25 bp, Homo sapien
ttcatcacaaactgtgtccagtttc

SEQ ID NO: 195761 - DNA, 25 bp, Homo sapien
tcatcacaaactgtgtccagtttct

SEQ ID NO: 195762 - DNA, 25 bp, Homo sapien
atcacaaactgtgtccagtttctct

SEQ ID NO: 195763 - DNA, 25 bp, Homo sapien
tcacaaactgtgtccagtttctctg

SEQ ID NO: 195764 - DNA, 25 bp, Homo sapien
cacaaactgtgtccagtttctctgt

SEQ ID NO: 195765 - DNA, 25 bp, Homo sapien
acaaactgtgtccagtttctctgtg

SEQ ID NO: 195766 - DNA, 25 bp, Homo sapien
caaactgtgtccagtttctctgtgg

SEQ ID NO: 195767 - DNA, 25 bp, Homo sapien
cagctaacaagggaagtgaaggacc

SEQ ID NO: 195768 - DNA, 25 bp, Homo sapien
accactgctcaaggaaatcagagag

SEQ ID NO: 195769 - DNA, 25 bp, Homo sapien
gaaaaacgttccatgctcacagata

SEQ ID NO: 195770 - DNA, 25 bp, Homo sapien
aaacgttccatgctcacagatagga

SEQ ID NO: 195771 - DNA, 25 bp, Homo sapien
tccatgctcacagataggaagaatc

SEQ ID NO: 195772 - DNA, 25 bp, Homo sapien
gaaaatggcaataccacccaaagtg

SEQ ID NO: 195773 - DNA, 25 bp, Homo sapien
ggcaataccacccaaagtgacctaa

SEQ ID NO: 195774 - DNA, 25 bp, Homo sapien
agtgacctaaagattcaatgctatt

SEQ ID NO: 195775 - DNA, 25 bp, Homo sapien
tgctattcccatcaaactaccatta

SEQ ID NO: 195776 - DNA, 25 bp, Homo sapien
tcaaactaccattaacattcttcac

SEQ ID NO: 195777 - DNA, 25 bp, Homo sapien
agagcccgtatagccaagacaatcc

SEQ ID NO: 195778 - DNA, 25 bp, Homo sapien
aattttatactctatgtttctgttt

SEQ ID NO: 195779 - DNA, 25 bp, Homo sapien
atatactctcgagagaattcctctt

SEQ ID NO: 195780 - DNA, 25 bp, Homo sapien
ctcgagagaattcctcttaattttt

SEQ ID NO: 195781 - DNA, 25 bp, Homo sapien
atttcctcattgtggaatgagcatt

SEQ ID NO: 195782 - DNA, 25 bp, Homo sapien
ggaatgagcattctcttgttttaat

SEQ ID NO: 195783 - DNA, 25 bp, Homo sapien
atgatgctactaatttgccactaaa

SEQ ID NO: 195784 - DNA, 25 bp, Homo sapien
tactaatttgccactaaatactgca

SEQ ID NO: 195785 - DNA, 25 bp, Homo sapien
accctgaatctcttctgacattgga

SEQ ID NO: 195786 - DNA, 25 bp, Homo sapien
gaatctcttctgacattggatgtta

SEQ ID NO: 195787 - DNA, 25 bp, Homo sapien
gacattggatgttatttgcttatat

SEQ ID NO: 195788 - DNA, 25 bp, Homo sapien
taattttaaatgagggcacagtgaa

SEQ ID NO: 195789 - DNA, 25 bp, Homo sapien
acagctttaaccttcttctctggcc

SEQ ID NO: 195790 - DNA, 25 bp, Homo sapien
tctggccaggacagtcgcaatcttt

SEQ ID NO: 195791 - DNA, 25 bp, Homo sapien
caggacagtcgcaatctttgtttta

SEQ ID NO: 195792 - DNA, 25 bp, Homo sapien
agagatacagtcacttcctttgctt

SEQ ID NO: 195793 - DNA, 25 bp, Homo sapien
ttcctttgcttagtcttaccagtga

SEQ ID NO: 195794 - DNA, 25 bp, Homo sapien
tagtcttaccagtgattgtcatcat

SEQ ID NO: 195795 - DNA, 25 bp, Homo sapien
tgtcatcatggttaaagctggtctg

SEQ ID NO: 195796 - DNA, 25 bp, Homo sapien
agacagaagcttagtctgttttcag

SEQ ID NO: 195797 - DNA, 25 bp, Homo sapien
ctgggaaaattttaactgcatggta

SEQ ID NO: 195798 - DNA, 25 bp, Homo sapien
gaattcagagtgtgacttaagggtc

SEQ ID NO: 195799 - DNA, 25 bp, Homo sapien
ttaagggtcaattcaaagcagtatt

SEQ ID NO: 195800 - DNA, 25 bp, Homo sapien
ctttgaaaaaatttggtatctcagc

SEQ ID NO: 195801 - DNA, 25 bp, Homo sapien
ggtatctcagcaaatgacacttcaa

SEQ ID NO: 195802 - DNA, 25 bp, Homo sapien
gcaaatgacacttcaattctaattg

SEQ ID NO: 195803 - DNA, 25 bp, Homo sapien
caagaatacctaatatctcaagtag

SEQ ID NO: 195804 - DNA, 25 bp, Homo sapien
tctcaagtagaaggtcatcaggttt

SEQ ID NO: 195805 - DNA, 25 bp, Homo sapien
gaaggtcatcaggtttctctgaaaa

SEQ ID NO: 195806 - DNA, 25 bp, Homo sapien
ttctctgaaaaatcttcctgaaata

SEQ ID NO: 195807 - DNA, 25 bp, Homo sapien
gatatataaactctcttcacaagaa

SEQ ID NO: 195808 - DNA, 25 bp, Homo sapien
caagaagaaagtatcgggacattat

SEQ ID NO: 195809 - DNA, 25 bp, Homo sapien
atcgggacattattggatgctatca

SEQ ID NO: 195810 - DNA, 25 bp, Homo sapien
ggatgctatcatttgtagaatgtca

SEQ ID NO: 195811 - DNA, 25 bp, Homo sapien
gaaatacgtgtatcatggagaatga

SEQ ID NO: 195812 - DNA, 25 bp, Homo sapien
gataatccaattacattctttagat

SEQ ID NO: 195813 - DNA, 25 bp, Homo sapien
gttattattgattatagtcactcta

SEQ ID NO: 195814 - DNA, 25 bp, Homo sapien
agtcactctattgtgctatcagata

SEQ ID NO: 195815 - DNA, 25 bp, Homo sapien
gctatcagatagtagatcattcttt

SEQ ID NO: 195816 - DNA, 25 bp, Homo sapien
tcagtacccttaccagccactggta

SEQ ID NO: 195817 - DNA, 25 bp, Homo sapien
actggtaaccattcttctactctgt

SEQ ID NO: 195818 - DNA, 25 bp, Homo sapien
gtaaccattcttctactctgtatgc

SEQ ID NO: 195819 - DNA, 25 bp, Homo sapien
attcttctactctgtatgcccatga

SEQ ID NO: 195820 - DNA, 25 bp, Homo sapien
tctactctgtatgcccatgaggtca

SEQ ID NO: 195821 - DNA, 25 bp, Homo sapien
atgcccatgaggtcaattgatttta

SEQ ID NO: 195822 - DNA, 25 bp, Homo sapien
agtctgcccgtcactttggatcata

SEQ ID NO: 195823 - DNA, 25 bp, Homo sapien
ggatcatagccctggcctggcggca

SEQ ID NO: 195824 - DNA, 25 bp, Homo sapien
tggcctggcggcacagcagcacttg

SEQ ID NO: 195825 - DNA, 25 bp, Homo sapien
tgccacctgggcagataacctggag

SEQ ID NO: 195826 - DNA, 25 bp, Homo sapien
gcagataacctggagatttccacct

SEQ ID NO: 195827 - DNA, 25 bp, Homo sapien
ttccaccttttcttttcagcttgat

SEQ ID NO: 195828 - DNA, 25 bp, Homo sapien
cttttcagcttgattgcatttgact

SEQ ID NO: 195829 - DNA, 25 bp, Homo sapien
gcatttgactatattttacagccag

SEQ ID NO: 195830 - DNA, 25 bp, Homo sapien
cagccagtgattgtagtttcatgtt

SEQ ID NO: 195831 - DNA, 25 bp, Homo sapien
gggccctgcatttatgaggcaccta

SEQ ID NO: 195832 - DNA, 25 bp, Homo sapien
tttatgaggcacctaccttcatttt

SEQ ID NO: 195833 - DNA, 25 bp, Homo sapien
ttctgctgttctcattgtggccaag

SEQ ID NO: 195834 - DNA, 25 bp, Homo sapien
tgctgttctcattgtggccaagaaa

SEQ ID NO: 195835 - DNA, 25 bp, Homo sapien
cagctgagggcctttgtcccattgt

SEQ ID NO: 195836 - DNA, 25 bp, Homo sapien
tgtgaccccttcatctttgataaag

SEQ ID NO: 195837 - DNA, 25 bp, Homo sapien
gaccccttcatctttgataaagcac

SEQ ID NO: 195838 - DNA, 25 bp, Homo sapien
agatgggacctcactgacccagacg

SEQ ID NO: 195839 - DNA, 25 bp, Homo sapien
gtgaggctctatgtggagctccacc

SEQ ID NO: 195840 - DNA, 25 bp, Homo sapien
gctctatgtggagctccaccgtggg

SEQ ID NO: 195841 - DNA, 25 bp, Homo sapien
aggaccctgtgcaattgctcagtgg

SEQ ID NO: 195842 - DNA, 25 bp, Homo sapien
aagctgacatggagcggcctctgca

SEQ ID NO: 195843 - DNA, 25 bp, Homo sapien
ggactcgtgccttctgctgttctca

SEQ ID NO: 195844 - DNA, 25 bp, Homo sapien
tcaactgccagggaaggctaaggaa

SEQ ID NO: 195845 - DNA, 25 bp, Homo sapien
ggatttgagcacaacaggaaagcct

SEQ ID NO: 195846 - DNA, 25 bp, Homo sapien
cacaacaggaaagcctgggagggtt

SEQ ID NO: 195847 - DNA, 25 bp, Homo sapien
gaaaaataatccatagtcagcagaa

SEQ ID NO: 195848 - DNA, 25 bp, Homo sapien
gcagaaaacaacagcagtgagccag

SEQ ID NO: 195849 - DNA, 25 bp, Homo sapien
cagaggagcacaggcgggcaggtca

SEQ ID NO: 195850 - DNA, 25 bp, Homo sapien
caggtcactgcagagactgatggaa

SEQ ID NO: 195851 - DNA, 25 bp, Homo sapien
agggaaggagcaggccgcgtgtcac

SEQ ID NO: 195852 - DNA, 25 bp, Homo sapien
gcgtgtcacacccatcattgtatgt

SEQ ID NO: 195853 - DNA, 25 bp, Homo sapien
tgtcacacccatcattgtatgttat

SEQ ID NO: 195854 - DNA, 25 bp, Homo sapien
tatgttatttcccacaacccagttg

SEQ ID NO: 195855 - DNA, 25 bp, Homo sapien
tggtccaccccagatgctgaggatg

SEQ ID NO: 195856 - DNA, 25 bp, Homo sapien
gtccaccccagatgctgaggatggg

SEQ ID NO: 195857 - DNA, 25 bp, Homo sapien
gggtctggatcttttctcagagcgt

SEQ ID NO: 195858 - DNA, 25 bp, Homo sapien
ggatcttttctcagagcgtctccat

SEQ ID NO: 195859 - DNA, 25 bp, Homo sapien
ttttctcagagcgtctccatgctat

SEQ ID NO: 195860 - DNA, 25 bp, Homo sapien
agagcgtctccatgctatggttgca

SEQ ID NO: 195861 - DNA, 25 bp, Homo sapien
agcgtctccatgctatggttgcatt

SEQ ID NO: 195862 - DNA, 25 bp, Homo sapien
gtctccatgctatggttgcatttcc

SEQ ID NO: 195863 - DNA, 25 bp, Homo sapien
tgctatggttgcatttccgttttct

SEQ ID NO: 195864 - DNA, 25 bp, Homo sapien
ctatggttgcatttccgttttctat

SEQ ID NO: 195865 - DNA, 25 bp, Homo sapien
atttccgttttctatgaatgaattt

SEQ ID NO: 195866 - DNA, 25 bp, Homo sapien
tgcagtgcccggaatctggacgtat

SEQ ID NO: 195867 - DNA, 25 bp, Homo sapien
aatctggacgtatgttccccatcag

SEQ ID NO: 195868 - DNA, 25 bp, Homo sapien
gatccccaacatgctgctgagtgaa

SEQ ID NO: 195869 - DNA, 25 bp, Homo sapien
tgagagttgattgtgccaggcgcca

SEQ ID NO: 195870 - DNA, 25 bp, Homo sapien
tgccaggcgccagtttttcttgtta

SEQ ID NO: 195871 - DNA, 25 bp, Homo sapien
gtttttcttgttatgactgtgtatt

SEQ ID NO: 195872 - DNA, 25 bp, Homo sapien
ttgttgatctataccctgtttccga

SEQ ID NO: 195873 - DNA, 25 bp, Homo sapien
atctataccctgtttccgaattctg

SEQ ID NO: 195874 - DNA, 25 bp, Homo sapien
gtttccgaattctgccgtgtgtatc

SEQ ID NO: 195875 - DNA, 25 bp, Homo sapien
gaattctgccgtgtgtatccccaac

SEQ ID NO: 195876 - DNA, 25 bp, Homo sapien
acagtgtttttgagctcggtattat

SEQ ID NO: 195877 - DNA, 25 bp, Homo sapien
aattgctaaatacaggcagctcttg

SEQ ID NO: 195878 - DNA, 25 bp, Homo sapien
gctaaatacaggcagctcttgcagg

SEQ ID NO: 195879 - DNA, 25 bp, Homo sapien
taaatacaggcagctcttgcaggtt

SEQ ID NO: 195880 - DNA, 25 bp, Homo sapien
aatacaggcagctcttgcaggttat

SEQ ID NO: 195881 - DNA, 25 bp, Homo sapien
tacaggcagctcttgcaggttattc

SEQ ID NO: 195882 - DNA, 25 bp, Homo sapien
caggcagctcttgcaggttattcaa

SEQ ID NO: 195883 - DNA, 25 bp, Homo sapien
ggcagctcttgcaggttattcaaga

SEQ ID NO: 195884 - DNA, 25 bp, Homo sapien
agctcttgcaggttattcaagaaaa

SEQ ID NO: 195885 - DNA, 25 bp, Homo sapien
aagtgcagaagagatggtcaaaaac

SEQ ID NO: 195886 - DNA, 25 bp, Homo sapien
gataaactgaccccttgggaacaat

SEQ ID NO: 195887 - DNA, 25 bp, Homo sapien
ggaaacagaaggctcttgctgaaga

SEQ ID NO: 195888 - DNA, 25 bp, Homo sapien
ttatgaacacccatttcctgacttt

SEQ ID NO: 195889 - DNA, 25 bp, Homo sapien
ttcctgactttttgctttaatttag

SEQ ID NO: 195890 - DNA, 25 bp, Homo sapien
atttttctccatcctgtttctagca

SEQ ID NO: 195891 - DNA, 25 bp, Homo sapien
aaaaatttgcctgctgtgttacaaa

SEQ ID NO: 195892 - DNA, 25 bp, Homo sapien
ttgcctgctgtgttacaaaaataaa

SEQ ID NO: 195893 - DNA, 25 bp, Homo sapien
atgttgtcctgtgccataaagtgat

SEQ ID NO: 195894 - DNA, 25 bp, Homo sapien
gtcctgtgccataaagtgatatatt

SEQ ID NO: 195895 - DNA, 25 bp, Homo sapien
tattctttggttttgaacattgtaa

SEQ ID NO: 195896 - DNA, 25 bp, Homo sapien
gaacattgtaagttcctaaaaacat

SEQ ID NO: 195897 - DNA, 25 bp, Homo sapien
aatttctttgtgcagaatgatttga

SEQ ID NO: 195898 - DNA, 25 bp, Homo sapien
ttcagtttacatgcattattggttt

SEQ ID NO: 195899 - DNA, 25 bp, Homo sapien
agcaatggagtgaacctctgctccc

SEQ ID NO: 195900 - DNA, 25 bp, Homo sapien
acagctggctacactgctcaggctt

SEQ ID NO: 195901 - DNA, 25 bp, Homo sapien
aggcttcaggcccacttgttgaaca

SEQ ID NO: 195902 - DNA, 25 bp, Homo sapien
atctgggtagcaacagcatcttcca

SEQ ID NO: 195903 - DNA, 25 bp, Homo sapien
acagcatcttccacagttttccaaa

SEQ ID NO: 195904 - DNA, 25 bp, Homo sapien
ttccaaactggatagctgccaacca

SEQ ID NO: 195905 - DNA, 25 bp, Homo sapien
cagcagacattacccacttgaaatg

SEQ ID NO: 195906 - DNA, 25 bp, Homo sapien
tgaagttgcctttacctagcattcc

SEQ ID NO: 195907 - DNA, 25 bp, Homo sapien
tagcattccctggtgaagtgttgca

SEQ ID NO: 195908 - DNA, 25 bp, Homo sapien
ggttgtgaactctgtagacatcttt

SEQ ID NO: 195909 - DNA, 25 bp, Homo sapien
gacatctttattgcttggctaagag

SEQ ID NO: 195910 - DNA, 25 bp, Homo sapien
atgcataccagcaattattactgtg

SEQ ID NO: 195911 - DNA, 25 bp, Homo sapien
tgtgttcgcacagttctcacttaac

SEQ ID NO: 195912 - DNA, 25 bp, Homo sapien
gcacagttctcacttaactggtgct

SEQ ID NO: 195913 - DNA, 25 bp, Homo sapien
ctcacttaactggtgctatgtgaag

SEQ ID NO: 195914 - DNA, 25 bp, Homo sapien
ggtgctatgtgaagactctgctaat

SEQ ID NO: 195915 - DNA, 25 bp, Homo sapien
agactctgctaatataggtatttta

SEQ ID NO: 195916 - DNA, 25 bp, Homo sapien
gaatggatcccaaaaacttcagaaa

SEQ ID NO: 195917 - DNA, 25 bp, Homo sapien
aagatctagtgcgattttatatata

SEQ ID NO: 195918 - DNA, 25 bp, Homo sapien
caaaggccttagactaattttcgat

SEQ ID NO: 195919 - DNA, 25 bp, Homo sapien
ctttcttgaaataagctaatggctt

SEQ ID NO: 195920 - DNA, 25 bp, Homo sapien
aagctaatggcttgtttgtgtaaag

SEQ ID NO: 195921 - DNA, 25 bp, Homo sapien
gaagttggacagagttaccttaagt

SEQ ID NO: 195922 - DNA, 25 bp, Homo sapien
gagttaccttaagtgtctctactat

SEQ ID NO: 195923 - DNA, 25 bp, Homo sapien
taagtgtctctactatctttgcctc

SEQ ID NO: 195924 - DNA, 25 bp, Homo sapien
acatgtttgttttcagtgctcactc

SEQ ID NO: 195925 - DNA, 25 bp, Homo sapien
gtgctcactcaaaccactaaaacag

SEQ ID NO: 195926 - DNA, 25 bp, Homo sapien
gatggatagctttgaggttttagat

SEQ ID NO: 195927 - DNA, 25 bp, Homo sapien
gatttttgggcaattttacatttgg

SEQ ID NO: 195928 - DNA, 25 bp, Homo sapien
tgggaattttatccactgtggcttt

SEQ ID NO: 195929 - DNA, 25 bp, Homo sapien
gcttttttatatgaggcactgtagt

SEQ ID NO: 195930 - DNA, 25 bp, Homo sapien
gaggcactgtagtattttccacata

SEQ ID NO: 195931 - DNA, 25 bp, Homo sapien
agtatagtactctgggatgttaaaa

SEQ ID NO: 195932 - DNA, 25 bp, Homo sapien
caccccgtaccactgttgatgtgaa

SEQ ID NO: 195933 - DNA, 25 bp, Homo sapien
gtaccactgttgatgtgaagcacct

SEQ ID NO: 195934 - DNA, 25 bp, Homo sapien
cactgttgatgtgaagcacctcttc

SEQ ID NO: 195935 - DNA, 25 bp, Homo sapien
gttgatgtgaagcacctcttctgag

SEQ ID NO: 195936 - DNA, 25 bp, Homo sapien
gatgtgaagcacctcttctgagcca

SEQ ID NO: 195937 - DNA, 25 bp, Homo sapien
cacgcccacccttcgaggaaggtgt

SEQ ID NO: 195938 - DNA, 25 bp, Homo sapien
gcccacccttcgaggaaggtgtcac

SEQ ID NO: 195939 - DNA, 25 bp, Homo sapien
cccttcattccacggaggaagctga

SEQ ID NO: 195940 - DNA, 25 bp, Homo sapien
ttcattccacggaggaagctgaggc

SEQ ID NO: 195941 - DNA, 25 bp, Homo sapien
agggagcggccatcgccattgggaa

SEQ ID NO: 195942 - DNA, 25 bp, Homo sapien
gcgactccacggagagcccagacgg

SEQ ID NO: 195943 - DNA, 25 bp, Homo sapien
aaataattgtcttctatgccaccct

SEQ ID NO: 195944 - DNA, 25 bp, Homo sapien
tatgccaccctacagattctatttt

SEQ ID NO: 195945 - DNA, 25 bp, Homo sapien
gttcccctgttagacaatcatgacc

SEQ ID NO: 195946 - DNA, 25 bp, Homo sapien
agacaatcatgaccttttctacttg

SEQ ID NO: 195947 - DNA, 25 bp, Homo sapien
atcatgaccttttctacttgtcttt

SEQ ID NO: 195948 - DNA, 25 bp, Homo sapien
tgaccttttctacttgtctttttat

SEQ ID NO: 195949 - DNA, 25 bp, Homo sapien
agtagtagatttccacttgtttagg

SEQ ID NO: 195950 - DNA, 25 bp, Homo sapien
gatttccacttgtttagggattaag

SEQ ID NO: 195951 - DNA, 25 bp, Homo sapien
gaatgtagataccttgtccagccat

SEQ ID NO: 195952 - DNA, 25 bp, Homo sapien
gtagataccttgtccagccatagga

SEQ ID NO: 195953 - DNA, 25 bp, Homo sapien
accttgtccagccataggaatcaaa

SEQ ID NO: 195954 - DNA, 25 bp, Homo sapien
cctgacatcaatcctgcctggtacg

SEQ ID NO: 195955 - DNA, 25 bp, Homo sapien
catcaatcctgcctggtacgccagt

SEQ ID NO: 195956 - DNA, 25 bp, Homo sapien
cctggtacgccagtcgcgggatcag

SEQ ID NO: 195957 - DNA, 25 bp, Homo sapien
cctgtgggccgcttcggtcggagga

SEQ ID NO: 195958 - DNA, 25 bp, Homo sapien
ttcggtcggaggagggcaaccctgg

SEQ ID NO: 195959 - DNA, 25 bp, Homo sapien
gtgctgagggcctggctcctgtgcc

SEQ ID NO: 195960 - DNA, 25 bp, Homo sapien
ccctggaaggcggtgctatgtcgtc

SEQ ID NO: 195961 - DNA, 25 bp, Homo sapien
aaggcggtgctatgtcgtcccagga

SEQ ID NO: 195962 - DNA, 25 bp, Homo sapien
ggtgctatgtcgtcccaggatggct

SEQ ID NO: 195963 - DNA, 25 bp, Homo sapien
gggagctgcaagtcgtacccatcgg

SEQ ID NO: 195964 - DNA, 25 bp, Homo sapien
gtacccatcggcactccatggagat

SEQ ID NO: 195965 - DNA, 25 bp, Homo sapien
acatgggcttaagaagttggacaga

SEQ ID NO: 195966 - DNA, 25 bp, Homo sapien
gaagttggacagagttaccttaagt

SEQ ID NO: 195967 - DNA, 25 bp, Homo sapien
ggacagagttaccttaagtgtctct

SEQ ID NO: 195968 - DNA, 25 bp, Homo sapien
gagttaccttaagtgtctctactat

SEQ ID NO: 195969 - DNA, 25 bp, Homo sapien
gttaccttaagtgtctctactatct

SEQ ID NO: 195970 - DNA, 25 bp, Homo sapien
accttaagtgtctctactatctttg

SEQ ID NO: 195971 - DNA, 25 bp, Homo sapien
taagtgtctctactatctttgcctc

SEQ ID NO: 195972 - DNA, 25 bp, Homo sapien
gtgtctctactatctttgcctccag

SEQ ID NO: 195973 - DNA, 25 bp, Homo sapien
tagttttaaacctgaataaacatgt

SEQ ID NO: 195974 - DNA, 25 bp, Homo sapien
gcttttttatatgaggcactgtagt

SEQ ID NO: 195975 - DNA, 25 bp, Homo sapien
ttatatgaggcactgtagtattttc

SEQ ID NO: 195976 - DNA, 25 bp, Homo sapien
tcttcttgatagatgaggccatggt

SEQ ID NO: 195977 - DNA, 25 bp, Homo sapien
ggacacttttgacagcttggcagat

SEQ ID NO: 195978 - DNA, 25 bp, Homo sapien
ggcagattttaactccagaagcact

SEQ ID NO: 195979 - DNA, 25 bp, Homo sapien
gaagcactttatgaaatggtacact

SEQ ID NO: 195980 - DNA, 25 bp, Homo sapien
gaaatggtacactgactaatccaga

SEQ ID NO: 195981 - DNA, 25 bp, Homo sapien
gactaatccagaagacatttccaac

SEQ ID NO: 195982 - DNA, 25 bp, Homo sapien
tttccaacagtttgccagtggttcc

SEQ ID NO: 195983 - DNA, 25 bp, Homo sapien
ggttcctcactacactggtactgaa

SEQ ID NO: 195984 - DNA, 25 bp, Homo sapien
gaaagtgtaatttcttagagccaaa

SEQ ID NO: 195985 - DNA, 25 bp, Homo sapien
gagaaacaaatatcctgccacctct

SEQ ID NO: 195986 - DNA, 25 bp, Homo sapien
cctgccacctctaacaagtacatga

SEQ ID NO: 195987 - DNA, 25 bp, Homo sapien
gaagactggcaataaagctgtccat

SEQ ID NO: 195988 - DNA, 25 bp, Homo sapien
taaagctgtccattcaattccaaat

SEQ ID NO: 195989 - DNA, 25 bp, Homo sapien
tgtccattcaattccaaatactggt

SEQ ID NO: 195990 - DNA, 25 bp, Homo sapien
atactggttttaaggtatagccact

SEQ ID NO: 195991 - DNA, 25 bp, Homo sapien
ggtatagccactgatattctttcat

SEQ ID NO: 195992 - DNA, 25 bp, Homo sapien
tggcatcatgtttgaattcatataa

SEQ ID NO: 195993 - DNA, 25 bp, Homo sapien
ttgaattcatataaagctcccctag

SEQ ID NO: 195994 - DNA, 25 bp, Homo sapien
ataaagctcccctagcattttttat

SEQ ID NO: 195995 - DNA, 25 bp, Homo sapien
tggcttcaggagtacccaaatagta

SEQ ID NO: 195996 - DNA, 25 bp, Homo sapien
ggagtacccaaatagtagcattatg

SEQ ID NO: 195997 - DNA, 25 bp, Homo sapien
gagaatgacgcagacaatttgaata

SEQ ID NO: 195998 - DNA, 25 bp, Homo sapien
aactatgccccaaagggcaattgga

SEQ ID NO: 195999 - DNA, 25 bp, Homo sapien
ggattggagaagcaccatataaagt

SEQ ID NO: 196000 - DNA, 25 bp, Homo sapien
accatgttcatcttgtcctccaagt

SEQ ID NO: 196001 - DNA, 25 bp, Homo sapien
ttcatcttgtcctccaagttatggg

SEQ ID NO: 196002 - DNA, 25 bp, Homo sapien
ttgtactgacaatctgtgttttcca

SEQ ID NO: 196003 - DNA, 25 bp, Homo sapien
ctgtgttttccaggagttacgtcaa

SEQ ID NO: 196004 - DNA, 25 bp, Homo sapien
gttacgtcaaactacctgtactggt

SEQ ID NO: 196005 - DNA, 25 bp, Homo sapien
tcaaactacctgtactggtttaaat

SEQ ID NO: 196006 - DNA, 25 bp, Homo sapien
atacatattttgtgctaatcttgtt

SEQ ID NO: 196007 - DNA, 25 bp, Homo sapien
tgttttcctcttagtattcctttgt

SEQ ID NO: 196008 - DNA, 25 bp, Homo sapien
tcctcttagtattcctttgtataaa

SEQ ID NO: 196009 - DNA, 25 bp, Homo sapien
cgccgcttcctagccatgaagtgga

SEQ ID NO: 196010 - DNA, 25 bp, Homo sapien
ggatgatcactgagtgccgggataa

SEQ ID NO: 196011 - DNA, 25 bp, Homo sapien
aaagcaccagcggacactgatgccg

SEQ ID NO: 196012 - DNA, 25 bp, Homo sapien
gatgccggagaagctgtcacacaag

SEQ ID NO: 196013 - DNA, 25 bp, Homo sapien
tgtcacacaagctgctggaggcttt

SEQ ID NO: 196014 - DNA, 25 bp, Homo sapien
tggaggctttccataaccagggccc

SEQ ID NO: 196015 - DNA, 25 bp, Homo sapien
ggccccgtgatcaagaggaagcatg

SEQ ID NO: 196016 - DNA, 25 bp, Homo sapien
atggcagaggccaaccgtgccctgg

SEQ ID NO: 196017 - DNA, 25 bp, Homo sapien
taccgctggtggtagagtctccagg

SEQ ID NO: 196018 - DNA, 25 bp, Homo sapien
aaacagtgtgagctactgccacgct

SEQ ID NO: 196019 - DNA, 25 bp, Homo sapien
tactgccacgctgaaaactacctgt

SEQ ID NO: 196020 - DNA, 25 bp, Homo sapien
tgctgttcacaattgcctcatgtaa

SEQ ID NO: 196021 - DNA, 25 bp, Homo sapien
atgtaatctgcagattcctgcctcc

SEQ ID NO: 196022 - DNA, 25 bp, Homo sapien
tgtgcacctggaacaactgttctcc

SEQ ID NO: 196023 - DNA, 25 bp, Homo sapien
ttctcccttgtgactaattcctatt

SEQ ID NO: 196024 - DNA, 25 bp, Homo sapien
ttttctagagtttaggcatcatctc

SEQ ID NO: 196025 - DNA, 25 bp, Homo sapien
gaagttatctgattcacgactgcct

SEQ ID NO: 196026 - DNA, 25 bp, Homo sapien
tgattcacgactgccttctctgaca

SEQ ID NO: 196027 - DNA, 25 bp, Homo sapien
agcactgtgtataccgctactacca

SEQ ID NO: 196028 - DNA, 25 bp, Homo sapien
gctactaccactgcaattcacatta

SEQ ID NO: 196029 - DNA, 25 bp, Homo sapien
gaacaattcacatgtctaccacaag

SEQ ID NO: 196030 - DNA, 25 bp, Homo sapien
gtctaccacaagtctgtaaacataa

SEQ ID NO: 196031 - DNA, 25 bp, Homo sapien
agattaaggcctggcagaaaatttt

SEQ ID NO: 196032 - DNA, 25 bp, Homo sapien
ggtacgcagacaaacacatgaacat

SEQ ID NO: 196033 - DNA, 25 bp, Homo sapien
acacatgaacatcgactttgacagt

SEQ ID NO: 196034 - DNA, 25 bp, Homo sapien
gaacatcgactttgacagtttcatc

SEQ ID NO: 196035 - DNA, 25 bp, Homo sapien
atcgactttgacagtttcatctgct

SEQ ID NO: 196036 - DNA, 25 bp, Homo sapien
tggagggcatgttcagagcttttca

SEQ ID NO: 196037 - DNA, 25 bp, Homo sapien
gatggtatcatcaagctcaacgttc

SEQ ID NO: 196038 - DNA, 25 bp, Homo sapien
gtatcatcaagctcaacgttctgga

SEQ ID NO: 196039 - DNA, 25 bp, Homo sapien
atcaagctcaacgttctggagtggc

SEQ ID NO: 196040 - DNA, 25 bp, Homo sapien
aagctcaacgttctggagtggctgc

SEQ ID NO: 196041 - DNA, 25 bp, Homo sapien
gctcaacgttctggagtggctgcag

SEQ ID NO: 196042 - DNA, 25 bp, Homo sapien
atttcttgaaataatccttcatgta

SEQ ID NO: 196043 - DNA, 25 bp, Homo sapien
aatccttcatgtataacttaggtta

SEQ ID NO: 196044 - DNA, 25 bp, Homo sapien
ggttaatagtgcctcatagtctact

SEQ ID NO: 196045 - DNA, 25 bp, Homo sapien
agtgcctcatagtctacttagaaag

SEQ ID NO: 196046 - DNA, 25 bp, Homo sapien
ttgatggcaatgtatttaatagcga

SEQ ID NO: 196047 - DNA, 25 bp, Homo sapien
ttaatagcgaggatcagtgaggaaa

SEQ ID NO: 196048 - DNA, 25 bp, Homo sapien
tcttctctgaagctaggtacacctt

SEQ ID NO: 196049 - DNA, 25 bp, Homo sapien
ggtacaccttagttcatgttgcagc

SEQ ID NO: 196050 - DNA, 25 bp, Homo sapien
ttctttggtgctgtcagatcatagt

SEQ ID NO: 196051 - DNA, 25 bp, Homo sapien
ggtgctgtcagatcatagttggtat

SEQ ID NO: 196052 - DNA, 25 bp, Homo sapien
gaagtttctgaaagtcagatgacac

SEQ ID NO: 196053 - DNA, 25 bp, Homo sapien
attcagtggcatcggccaaccagat

SEQ ID NO: 196054 - DNA, 25 bp, Homo sapien
atctcactcgtgcaatggccaatgt

SEQ ID NO: 196055 - DNA, 25 bp, Homo sapien
atgtacatggtggactatgccggcc

SEQ ID NO: 196056 - DNA, 25 bp, Homo sapien
actatgccggcctgaacgtgcagct

SEQ ID NO: 196057 - DNA, 25 bp, Homo sapien
gggacctcttaattactagacctca

SEQ ID NO: 196058 - DNA, 25 bp, Homo sapien
tagacctcagtactgaatcaggacc

SEQ ID NO: 196059 - DNA, 25 bp, Homo sapien
aatcaggacctcactcagaaagact

SEQ ID NO: 196060 - DNA, 25 bp, Homo sapien
cggatatgtatcgatgccttttagt

SEQ ID NO: 196061 - DNA, 25 bp, Homo sapien
gatgccttttagtttttccaatgat

SEQ ID NO: 196062 - DNA, 25 bp, Homo sapien
atttttacactatattcctgccacc

SEQ ID NO: 196063 - DNA, 25 bp, Homo sapien
tattcctgccaccaaggccttttta

SEQ ID NO: 196064 - DNA, 25 bp, Homo sapien
ttcccctcatgtcactactgaattt

SEQ ID NO: 196065 - DNA, 25 bp, Homo sapien
gtcactactgaattttgacaggagg

SEQ ID NO: 196066 - DNA, 25 bp, Homo sapien
tcagtgaaacactacatacacgaag

SEQ ID NO: 196067 - DNA, 25 bp, Homo sapien
tttaagaaccatttgctgccgcata

SEQ ID NO: 196068 - DNA, 25 bp, Homo sapien
tgctgccgcatagtgccattggata

SEQ ID NO: 196069 - DNA, 25 bp, Homo sapien
gtgccattggatagggaagaacttc

SEQ ID NO: 196070 - DNA, 25 bp, Homo sapien
agaaatctgtggtactcttggcctt

SEQ ID NO: 196071 - DNA, 25 bp, Homo sapien
tgtggtactcttggccttgtctttg

SEQ ID NO: 196072 - DNA, 25 bp, Homo sapien
ttgtctttgtcttccctgaacgtgt

SEQ ID NO: 196073 - DNA, 25 bp, Homo sapien
tccctgaacgtgtctccactctgtg

SEQ ID NO: 196074 - DNA, 25 bp, Homo sapien
gcaaaggaaagcagcatgcattgtc

SEQ ID NO: 196075 - DNA, 25 bp, Homo sapien
cagacagtctgcctaaggaccaatg

SEQ ID NO: 196076 - DNA, 25 bp, Homo sapien
gtctgcctaaggaccaatgccgcaa

SEQ ID NO: 196077 - DNA, 25 bp, Homo sapien
ctaaggaccaatgccgcaaggcctg

SEQ ID NO: 196078 - DNA, 25 bp, Homo sapien
aaggcctggatcagaccccaggatc

SEQ ID NO: 196079 - DNA, 25 bp, Homo sapien
ggatcagaccccaggatcagacctt

SEQ ID NO: 196080 - DNA, 25 bp, Homo sapien
tcttctggccagagcttgtcaccag

SEQ ID NO: 196081 - DNA, 25 bp, Homo sapien
acgtggtgccgctcagccttctctg

SEQ ID NO: 196082 - DNA, 25 bp, Homo sapien
tcctgggaatctgtcattcgtgggt

SEQ ID NO: 196083 - DNA, 25 bp, Homo sapien
gggaatctgtcattcgtgggtgctt

SEQ ID NO: 196084 - DNA, 25 bp, Homo sapien
atctgtcattcgtgggtgcttcaga

SEQ ID NO: 196085 - DNA, 25 bp, Homo sapien
tctgtcattcgtgggtgcttcagag

SEQ ID NO: 196086 - DNA, 25 bp, Homo sapien
tgggtcatcggatcactgactgccc

SEQ ID NO: 196087 - DNA, 25 bp, Homo sapien
gggtcatcggatcactgactgcccc

SEQ ID NO: 196088 - DNA, 25 bp, Homo sapien
ggtcatcggatcactgactgcccca

SEQ ID NO: 196089 - DNA, 25 bp, Homo sapien
gtcatcggatcactgactgccccaa

SEQ ID NO: 196090 - DNA, 25 bp, Homo sapien
tcatcggatcactgactgccccaaa

SEQ ID NO: 196091 - DNA, 25 bp, Homo sapien
atcggatcactgactgccccaaact

SEQ ID NO: 196092 - DNA, 25 bp, Homo sapien
tcggatcactgactgccccaaactc

SEQ ID NO: 196093 - DNA, 25 bp, Homo sapien
cggatcactgactgccccaaactcg

SEQ ID NO: 196094 - DNA, 25 bp, Homo sapien
ggatcactgactgccccaaactcga

SEQ ID NO: 196095 - DNA, 25 bp, Homo sapien
gatcactgactgccccaaactcgag

SEQ ID NO: 196096 - DNA, 25 bp, Homo sapien
atcactgactgccccaaactcgagg

SEQ ID NO: 196097 - DNA, 25 bp, Homo sapien
gttgatattatttttggccgttagt

SEQ ID NO: 196098 - DNA, 25 bp, Homo sapien
tggccgttagttatctattactagt

SEQ ID NO: 196099 - DNA, 25 bp, Homo sapien
gttatactgttttctatagctactt

SEQ ID NO: 196100 - DNA, 25 bp, Homo sapien
gatttctatgcacctttactctttc

SEQ ID NO: 196101 - DNA, 25 bp, Homo sapien
tttactctttcctcaacccttgtct

SEQ ID NO: 196102 - DNA, 25 bp, Homo sapien
aacccttgtctctatctgtacataa

SEQ ID NO: 196103 - DNA, 25 bp, Homo sapien
attgctttgtcttgatgtttctatc

SEQ ID NO: 196104 - DNA, 25 bp, Homo sapien
catgactatctattggttccataac

SEQ ID NO: 196105 - DNA, 25 bp, Homo sapien
ccataactctgtatcatgtgtattt

SEQ ID NO: 196106 - DNA, 25 bp, Homo sapien
catgtgtattttcttattctggtat

SEQ ID NO: 196107 - DNA, 25 bp, Homo sapien
tggtataccacaaatgattcatgca

SEQ ID NO: 196108 - DNA, 25 bp, Homo sapien
gagcggctcattgacaaggccatga

SEQ ID NO: 196109 - DNA, 25 bp, Homo sapien
atgaagaaagatggactcgtgggca

SEQ ID NO: 196110 - DNA, 25 bp, Homo sapien
gggactggccggactcatcggactt

SEQ ID NO: 196111 - DNA, 25 bp, Homo sapien
gactcatcggacttgctgtgtccaa

SEQ ID NO: 196112 - DNA, 25 bp, Homo sapien
gtccaagtccaaatcctgaaggaga

SEQ ID NO: 196113 - DNA, 25 bp, Homo sapien
tccaaatcctgaaggagacgcggga

SEQ ID NO: 196114 - DNA, 25 bp, Homo sapien
acgcgggagcccacggagaacgctc

SEQ ID NO: 196115 - DNA, 25 bp, Homo sapien
cacggagaacgctccaggagggcct

SEQ ID NO: 196116 - DNA, 25 bp, Homo sapien
cgtctctatcctctgtggccttcag

SEQ ID NO: 196117 - DNA, 25 bp, Homo sapien
tgctcccctgagattcgtccttcag

SEQ ID NO: 196118 - DNA, 25 bp, Homo sapien
cttcagccccatcatgtgctttggg

SEQ ID NO: 196119 - DNA, 25 bp, Homo sapien
gccatgctcagacagtggttctttg

SEQ ID NO: 196120 - DNA, 25 bp, Homo sapien
cagtggttctttgtgtaggttgttc

SEQ ID NO: 196121 - DNA, 25 bp, Homo sapien
caacagtgttgtgccagcctacagg

SEQ ID NO: 196122 - DNA, 25 bp, Homo sapien
agactcacagaagggtgttcattta

SEQ ID NO: 196123 - DNA, 25 bp, Homo sapien
gaagaaagcaacactaatgattcaa

SEQ ID NO: 196124 - DNA, 25 bp, Homo sapien
gtgttgtctcacagaaagccttatc

SEQ ID NO: 196125 - DNA, 25 bp, Homo sapien
gaaagccttatcataaattccataa

SEQ ID NO: 196126 - DNA, 25 bp, Homo sapien
catttggttttgtaaggtatacagc

SEQ ID NO: 196127 - DNA, 25 bp, Homo sapien
ggtatacagcagtaatctcctattt

SEQ ID NO: 196128 - DNA, 25 bp, Homo sapien
gcagtaatctcctattttggtgtca

SEQ ID NO: 196129 - DNA, 25 bp, Homo sapien
ctcctattttggtgtcagtttttca

SEQ ID NO: 196130 - DNA, 25 bp, Homo sapien
aaatgctgcatctggttaaatgtcg

SEQ ID NO: 196131 - DNA, 25 bp, Homo sapien
gggaagctgaaggtgctcgcttcat

SEQ ID NO: 196132 - DNA, 25 bp, Homo sapien
aaggtgctcgcttcatttgccttgt

SEQ ID NO: 196133 - DNA, 25 bp, Homo sapien
tcatttgccttgtttactcatcctg

SEQ ID NO: 196134 - DNA, 25 bp, Homo sapien
tcatcctgccctgtaatgtctgtaa

SEQ ID NO: 196135 - DNA, 25 bp, Homo sapien
gccctgtaatgtctgtaatcctgaa

SEQ ID NO: 196136 - DNA, 25 bp, Homo sapien
gtgaacaccatttcagagctctcag

SEQ ID NO: 196137 - DNA, 25 bp, Homo sapien
gagctctcagtgtgcagttcaggaa

SEQ ID NO: 196138 - DNA, 25 bp, Homo sapien
aaagatctgctattgccagctctca

SEQ ID NO: 196139 - DNA, 25 bp, Homo sapien
cagctctcaacccaagtcagtgaat

SEQ ID NO: 196140 - DNA, 25 bp, Homo sapien
gtgaattgtcaacctgcatatccta

SEQ ID NO: 196141 - DNA, 25 bp, Homo sapien
agcatgggcggttcgttttgttaga

SEQ ID NO: 196142 - DNA, 25 bp, Homo sapien
cccggattcacgagatggtttttat

SEQ ID NO: 196143 - DNA, 25 bp, Homo sapien
gtttacaggatttgcactattgata

SEQ ID NO: 196144 - DNA, 25 bp, Homo sapien
agagtttttgccttggcacaggcct

SEQ ID NO: 196145 - DNA, 25 bp, Homo sapien
aaccgtgggcttttcactggaggat

SEQ ID NO: 196146 - DNA, 25 bp, Homo sapien
aagccggtgcttattgcatgcacaa

SEQ ID NO: 196147 - DNA, 25 bp, Homo sapien
gcatgcacaattgctttccagccgt

SEQ ID NO: 196148 - DNA, 25 bp, Homo sapien
agcctgtgtgtacctttgcatatgt

SEQ ID NO: 196149 - DNA, 25 bp, Homo sapien
acctttgcatatgtacttttctctt

SEQ ID NO: 196150 - DNA, 25 bp, Homo sapien
ctctcccttttaaatacgactcttg

SEQ ID NO: 196151 - DNA, 25 bp, Homo sapien
aaatacgactcttgccaggctttaa

SEQ ID NO: 196152 - DNA, 25 bp, Homo sapien
tcaggcgcccgtgttcacattttct

SEQ ID NO: 196153 - DNA, 25 bp, Homo sapien
ccagcaccaggcagagggcaagacg

SEQ ID NO: 196154 - DNA, 25 bp, Homo sapien
agcaagaactgcactgcatctcact

SEQ ID NO: 196155 - DNA, 25 bp, Homo sapien
gcatctcactgcagtctgaatctag

SEQ ID NO: 196156 - DNA, 25 bp, Homo sapien
gtctgaatctagacatcgccattcc

SEQ ID NO: 196157 - DNA, 25 bp, Homo sapien
gacatcgccattccccgaggtgcga

SEQ ID NO: 196158 - DNA, 25 bp, Homo sapien
gtgcgacctcagactaatgacatcc

SEQ ID NO: 196159 - DNA, 25 bp, Homo sapien
cctggctgagcctctgtttttctct

SEQ ID NO: 196160 - DNA, 25 bp, Homo sapien
aattgtgcctacctcagatagacag

SEQ ID NO: 196161 - DNA, 25 bp, Homo sapien
tacctcagatagacagtgccagaat

SEQ ID NO: 196162 - DNA, 25 bp, Homo sapien
gtgccagaattaagtgagtcaagcc

SEQ ID NO: 196163 - DNA, 25 bp, Homo sapien
gactgaacttttgtaattaacaaca

SEQ ID NO: 196164 - DNA, 25 bp, Homo sapien
gattacgaatgcttttgactttttt

SEQ ID NO: 196165 - DNA, 25 bp, Homo sapien
gtccatggaatatttgacagatgaa

SEQ ID NO: 196166 - DNA, 25 bp, Homo sapien
tgaagtaggactgctgagaagattc

SEQ ID NO: 196167 - DNA, 25 bp, Homo sapien
aacaaagttgtggtgaagctataat

SEQ ID NO: 196168 - DNA, 25 bp, Homo sapien
aagctataatatgcaaacttaccag

SEQ ID NO: 196169 - DNA, 25 bp, Homo sapien
aacttaccagatcttgtcagtcatt

SEQ ID NO: 196170 - DNA, 25 bp, Homo sapien
gtcagtcatttcctatgtgtatgtt

SEQ ID NO: 196171 - DNA, 25 bp, Homo sapien
atgtgtatgttgacctggataagaa

SEQ ID NO: 196172 - DNA, 25 bp, Homo sapien
gaatatccaattttgggtggcaata

SEQ ID NO: 196173 - DNA, 25 bp, Homo sapien
ggtggcaataaatatattcgcacat

SEQ ID NO: 196174 - DNA, 25 bp, Homo sapien
gagtgaatgcagtaaaccccacagt

SEQ ID NO: 196175 - DNA, 25 bp, Homo sapien
aaccccacagtggtgatgacgtcca

SEQ ID NO: 196176 - DNA, 25 bp, Homo sapien
gtgatgacgtccatgggccaggcca

SEQ ID NO: 196177 - DNA, 25 bp, Homo sapien
ccccacaaggccaagactatgctga

SEQ ID NO: 196178 - DNA, 25 bp, Homo sapien
aagactatgctgaaccgaatcccac

SEQ ID NO: 196179 - DNA, 25 bp, Homo sapien
gaaccgaatcccacttggcaagttt

SEQ ID NO: 196180 - DNA, 25 bp, Homo sapien
cccacttggcaagtttgctgaggta

SEQ ID NO: 196181 - DNA, 25 bp, Homo sapien
atcctctttctgctgagtgaccgaa

SEQ ID NO: 196182 - DNA, 25 bp, Homo sapien
tgagtgaccgaagtggcatgaccac

SEQ ID NO: 196183 - DNA, 25 bp, Homo sapien
atgaccacgggttccactttgccgg

SEQ ID NO: 196184 - DNA, 25 bp, Homo sapien
ctccaataaacctgattctgctgcc

SEQ ID NO: 196185 - DNA, 25 bp, Homo sapien
caaagtgcgcaagggcctcaacgag

SEQ ID NO: 196186 - DNA, 25 bp, Homo sapien
tcaacgagggatacgacaggcgtcc

SEQ ID NO: 196187 - DNA, 25 bp, Homo sapien
cccaaaagcatcaccagaaaagtgt

SEQ ID NO: 196188 - DNA, 25 bp, Homo sapien
aaaagtgtgatcaacccaggcctgg

SEQ ID NO: 196189 - DNA, 25 bp, Homo sapien
ccaagccacatgtgtcagaccataa

SEQ ID NO: 196190 - DNA, 25 bp, Homo sapien
atgtgtcagaccataaccgcctcct

SEQ ID NO: 196191 - DNA, 25 bp, Homo sapien
tggccaggcccaaagctcagtcgga

SEQ ID NO: 196192 - DNA, 25 bp, Homo sapien
ggcccaaagctcagtcggacaagtg

SEQ ID NO: 196193 - DNA, 25 bp, Homo sapien
aagctcagtcggacaagtgcgttcc

SEQ ID NO: 196194 - DNA, 25 bp, Homo sapien
gacaagtgcgttcctgaccgagatc

SEQ ID NO: 196195 - DNA, 25 bp, Homo sapien
tcctgaccgagatcctcgctgggag

SEQ ID NO: 196196 - DNA, 25 bp, Homo sapien
ccacaatcctctcctgaaacttaaa

SEQ ID NO: 196197 - DNA, 25 bp, Homo sapien
ggaaagggaaccaaatctcattaat

SEQ ID NO: 196198 - DNA, 25 bp, Homo sapien
atctcattaattaattgttctcccc

SEQ ID NO: 196199 - DNA, 25 bp, Homo sapien
attaccccactgaatgaatggccat

SEQ ID NO: 196200 - DNA, 25 bp, Homo sapien
gaatggccatacaggctaagctgaa

SEQ ID NO: 196201 - DNA, 25 bp, Homo sapien
gttgaaaggaccaatacagcccctt

SEQ ID NO: 196202 - DNA, 25 bp, Homo sapien
tacagccccttttataaggattttg

SEQ ID NO: 196203 - DNA, 25 bp, Homo sapien
gtattttgtagccttttcctgggct

SEQ ID NO: 196204 - DNA, 25 bp, Homo sapien
agctcccctacttcttgtatgtgta

SEQ ID NO: 196205 - DNA, 25 bp, Homo sapien
gtgtatgcatactgtagctaaccat

SEQ ID NO: 196206 - DNA, 25 bp, Homo sapien
actgtagctaaccattaaagtcatg

SEQ ID NO: 196207 - DNA, 25 bp, Homo sapien
aataccacttattgagtactctgtt

SEQ ID NO: 196208 - DNA, 25 bp, Homo sapien
gagtactctgtttctacgtatgtag

SEQ ID NO: 196209 - DNA, 25 bp, Homo sapien
gcttccttaaaatgtcattcatagg

SEQ ID NO: 196210 - DNA, 25 bp, Homo sapien
ggagatgtactggaattgctcattc

SEQ ID NO: 196211 - DNA, 25 bp, Homo sapien
actggaattgctcattctgtgactt

SEQ ID NO: 196212 - DNA, 25 bp, Homo sapien
ctgtgactttatttgtgtcctaaac

SEQ ID NO: 196213 - DNA, 25 bp, Homo sapien
tatttgtgtcctaaacattcttcag

SEQ ID NO: 196214 - DNA, 25 bp, Homo sapien
atctttgtcactggatgctacttga

SEQ ID NO: 196215 - DNA, 25 bp, Homo sapien
gtcactggatgctacttgaagaggg

SEQ ID NO: 196216 - DNA, 25 bp, Homo sapien
gggagtactttgtaaccactttgat

SEQ ID NO: 196217 - DNA, 25 bp, Homo sapien
ccactttgatatgctgttatcacca

SEQ ID NO: 196218 - DNA, 25 bp, Homo sapien
gctagacctgagcagttctaccctc

SEQ ID NO: 196219 - DNA, 25 bp, Homo sapien
tgagcagttctaccctcccaaggca

SEQ ID NO: 196220 - DNA, 25 bp, Homo sapien
caaggcaccagtactctaccatggg

SEQ ID NO: 196221 - DNA, 25 bp, Homo sapien
cagtactctaccatggggcatccca

SEQ ID NO: 196222 - DNA, 25 bp, Homo sapien
gggcatcccaagtggggtcctcacc

SEQ ID NO: 196223 - DNA, 25 bp, Homo sapien
tcccagctactgcagctctgtatta

SEQ ID NO: 196224 - DNA, 25 bp, Homo sapien
ccagctactgcagctctgtattact

SEQ ID NO: 196225 - DNA, 25 bp, Homo sapien
agctactgcagctctgtattacttt

SEQ ID NO: 196226 - DNA, 25 bp, Homo sapien
tgagggctcctgcagtaactctgta

SEQ ID NO: 196227 - DNA, 25 bp, Homo sapien
gcagtaactctgtacttctctatct

SEQ ID NO: 196228 - DNA, 25 bp, Homo sapien
caaaatgcccaaggcactcactggg

SEQ ID NO: 196229 - DNA, 25 bp, Homo sapien
acctacactgcattcctcaaagtaa

SEQ ID NO: 196230 - DNA, 25 bp, Homo sapien
aaaatttaagtgtggctctgtgcct

SEQ ID NO: 196231 - DNA, 25 bp, Homo sapien
taagtgtggctctgtgcctatgctc

SEQ ID NO: 196232 - DNA, 25 bp, Homo sapien
tatgctctccccagcggaaagtgac

SEQ ID NO: 196233 - DNA, 25 bp, Homo sapien
gtctgtactccttctgccactggaa

SEQ ID NO: 196234 - DNA, 25 bp, Homo sapien
ttctgccactggaagcaatggtgac

SEQ ID NO: 196235 - DNA, 25 bp, Homo sapien
gcaatggtgaccagctcttggagaa

SEQ ID NO: 196236 - DNA, 25 bp, Homo sapien
gaccagctcttggagaagcaaggcc

SEQ ID NO: 196237 - DNA, 25 bp, Homo sapien
tggccttactgactaatatcactca

SEQ ID NO: 196238 - DNA, 25 bp, Homo sapien
gactaatatcactcagattgtatgt

SEQ ID NO: 196239 - DNA, 25 bp, Homo sapien
gaataataaactgggttgacattta

SEQ ID NO: 196240 - DNA, 25 bp, Homo sapien
gcagcaagaagattggtctttacct

SEQ ID NO: 196241 - DNA, 25 bp, Homo sapien
gattggtctttacctaggctgtgtt

SEQ ID NO: 196242 - DNA, 25 bp, Homo sapien
tacctaggctgtgtttcctaagctc

SEQ ID NO: 196243 - DNA, 25 bp, Homo sapien
ctgtgtttcctaagctctgagtttt

SEQ ID NO: 196244 - DNA, 25 bp, Homo sapien
aagctctgagttttcagcaccagta

SEQ ID NO: 196245 - DNA, 25 bp, Homo sapien
tttcagcaccagtagatttgtatta

SEQ ID NO: 196246 - DNA, 25 bp, Homo sapien
ggcttttaattttgccagctaagga

SEQ ID NO: 196247 - DNA, 25 bp, Homo sapien
taattttgccagctaaggacataaa

SEQ ID NO: 196248 - DNA, 25 bp, Homo sapien
atagccatctgctatcagcatcatt

SEQ ID NO: 196249 - DNA, 25 bp, Homo sapien
ctgctatcagcatcattatgtaaaa

SEQ ID NO: 196250 - DNA, 25 bp, Homo sapien
gtaatctcagaataaaggttgtcat

SEQ ID NO: 196251 - DNA, 25 bp, Homo sapien
ctgttgttgatgcatccgtccaagt

SEQ ID NO: 196252 - DNA, 25 bp, Homo sapien
ttgttgatgcatccgtccaagttca

SEQ ID NO: 196253 - DNA, 25 bp, Homo sapien
tccgtccaagttcactgcctttatt

SEQ ID NO: 196254 - DNA, 25 bp, Homo sapien
ctcctccctcttgttttagctgtta

SEQ ID NO: 196255 - DNA, 25 bp, Homo sapien
gttttagctgttacacacacagtaa

SEQ ID NO: 196256 - DNA, 25 bp, Homo sapien
gctgttacacacacagtaatacctg

SEQ ID NO: 196257 - DNA, 25 bp, Homo sapien
gttacacacacagtaatacctgaat

SEQ ID NO: 196258 - DNA, 25 bp, Homo sapien
acagtaatacctgaatatccaacgg

SEQ ID NO: 196259 - DNA, 25 bp, Homo sapien
acctgaatatccaacggtatagatc

SEQ ID NO: 196260 - DNA, 25 bp, Homo sapien
tatccaacggtatagatcacaaggg

SEQ ID NO: 196261 - DNA, 25 bp, Homo sapien
gattttgacataaaagagccttgat

SEQ ID NO: 196262 - DNA, 25 bp, Homo sapien
aaaatgtaaataggccggtggctca

SEQ ID NO: 196263 - DNA, 25 bp, Homo sapien
aaatgtaaataggccggtggctcat

SEQ ID NO: 196264 - DNA, 25 bp, Homo sapien
aatgtaaataggccggtggctcatg

SEQ ID NO: 196265 - DNA, 25 bp, Homo sapien
atgtaaataggccggtggctcatgc

SEQ ID NO: 196266 - DNA, 25 bp, Homo sapien
tgtaaataggccggtggctcatgcc

SEQ ID NO: 196267 - DNA, 25 bp, Homo sapien
gtaaataggccggtggctcatgcct

SEQ ID NO: 196268 - DNA, 25 bp, Homo sapien
ggaggtggaggttgcggtgaactga

SEQ ID NO: 196269 - DNA, 25 bp, Homo sapien
gtggaggttgcggtgaactgagatt

SEQ ID NO: 196270 - DNA, 25 bp, Homo sapien
acctgcagatttcacctattttgat

SEQ ID NO: 196271 - DNA, 25 bp, Homo sapien
gatttcacctattttgatttactat

SEQ ID NO: 196272 - DNA, 25 bp, Homo sapien
gatttactataagagctgggatttg

SEQ ID NO: 196273 - DNA, 25 bp, Homo sapien
gattcattttatttatgcctaagtc

SEQ ID NO: 196274 - DNA, 25 bp, Homo sapien
gcctaagtcatctatgcattaacat

SEQ ID NO: 196275 - DNA, 25 bp, Homo sapien
atattcttaactttgatctaatgct

SEQ ID NO: 196276 - DNA, 25 bp, Homo sapien
gatctaatgctttttactaggaaat

SEQ ID NO: 196277 - DNA, 25 bp, Homo sapien
aaagatgtttgtcactagtttttca

SEQ ID NO: 196278 - DNA, 25 bp, Homo sapien
gtttgtcactagtttttcattatta

SEQ ID NO: 196279 - DNA, 25 bp, Homo sapien
tcattattaaatgctgaggccaata

SEQ ID NO: 196280 - DNA, 25 bp, Homo sapien
ttatgaattacatgctcagctatat

SEQ ID NO: 196281 - DNA, 25 bp, Homo sapien
gatgacttggagaaatactgggatt

SEQ ID NO: 196282 - DNA, 25 bp, Homo sapien
tgggatttttaccactctctcttta

SEQ ID NO: 196283 - DNA, 25 bp, Homo sapien
ctctctttactgtgtgctgtaactc

SEQ ID NO: 196284 - DNA, 25 bp, Homo sapien
tgtgctgtaactctccaaggactct

SEQ ID NO: 196285 - DNA, 25 bp, Homo sapien
caaggactctcatgcacttatcgag

SEQ ID NO: 196286 - DNA, 25 bp, Homo sapien
acttatcgagatgtgccattagaag

SEQ ID NO: 196287 - DNA, 25 bp, Homo sapien
gaacattacacaacagatgccatag

SEQ ID NO: 196288 - DNA, 25 bp, Homo sapien
agatgccatagagcaattcctttgc

SEQ ID NO: 196289 - DNA, 25 bp, Homo sapien
tagagcaattcctttgctttccctc

SEQ ID NO: 196290 - DNA, 25 bp, Homo sapien
ctttccctcccattgtcattgaaaa

SEQ ID NO: 196291 - DNA, 25 bp, Homo sapien
gaaaaagtacttgcttttagagcca

SEQ ID NO: 196292 - DNA, 25 bp, Homo sapien
atcctcagagagtccttagcagaca

SEQ ID NO: 196293 - DNA, 25 bp, Homo sapien
atggtagatgtatctttgggcagct

SEQ ID NO: 196294 - DNA, 25 bp, Homo sapien
tgggcagctgaacttttctgctttc

SEQ ID NO: 196295 - DNA, 25 bp, Homo sapien
tgctttcctcaaatcagaccatatg

SEQ ID NO: 196296 - DNA, 25 bp, Homo sapien
gagaggatatattctatgcatagat

SEQ ID NO: 196297 - DNA, 25 bp, Homo sapien
tgtaatgctaaccttctgaatatat

SEQ ID NO: 196298 - DNA, 25 bp, Homo sapien
attcactgttgccttataaaactgt

SEQ ID NO: 196299 - DNA, 25 bp, Homo sapien
tataaaactgttagggtaggtctgt

SEQ ID NO: 196300 - DNA, 25 bp, Homo sapien
gtaggtctgtctaccctagcaaaag

SEQ ID NO: 196301 - DNA, 25 bp, Homo sapien
acacaagatatgttaactgcagttt

SEQ ID NO: 196302 - DNA, 25 bp, Homo sapien
aactgcagtttgtttggttattcaa

SEQ ID NO: 196303 - DNA, 25 bp, Homo sapien
ctggccaaggcctgtggacgacgct

SEQ ID NO: 196304 - DNA, 25 bp, Homo sapien
ggtgccagtgggaagcctgatgggt

SEQ ID NO: 196305 - DNA, 25 bp, Homo sapien
gtgccagtgggaagcctgatgggtg

SEQ ID NO: 196306 - DNA, 25 bp, Homo sapien
tgccagtgggaagcctgatgggtgc

SEQ ID NO: 196307 - DNA, 25 bp, Homo sapien
ccagtgggaagcctgatgggtgctg

SEQ ID NO: 196308 - DNA, 25 bp, Homo sapien
cagtgggaagcctgatgggtgctgg

SEQ ID NO: 196309 - DNA, 25 bp, Homo sapien
agtgggaagcctgatgggtgctggt

SEQ ID NO: 196310 - DNA, 25 bp, Homo sapien
gtgggaagcctgatgggtgctggtg

SEQ ID NO: 196311 - DNA, 25 bp, Homo sapien
gggaagcctgatgggtgctggtggc

SEQ ID NO: 196312 - DNA, 25 bp, Homo sapien
ggaagcctgatgggtgctggtggcc

SEQ ID NO: 196313 - DNA, 25 bp, Homo sapien
gcctgcttggcacccccatctgaaa

SEQ ID NO: 196314 - DNA, 25 bp, Homo sapien
catgccccgtatggtgctggtcgag

SEQ ID NO: 196315 - DNA, 25 bp, Homo sapien
gggaactatgatgccttccgaggcc

SEQ ID NO: 196316 - DNA, 25 bp, Homo sapien
gttatcctgggaaacctcgcaacag

SEQ ID NO: 196317 - DNA, 25 bp, Homo sapien
gggccattgtggaatatcgggacct

SEQ ID NO: 196318 - DNA, 25 bp, Homo sapien
ggaatatcgggacctggatgcccca

SEQ ID NO: 196319 - DNA, 25 bp, Homo sapien
ggatgccccagacgatgttgatttc

SEQ ID NO: 196320 - DNA, 25 bp, Homo sapien
tcctgtatcatccatacttgtacta

SEQ ID NO: 196321 - DNA, 25 bp, Homo sapien
tacttgtactaccttgtcctatgaa

SEQ ID NO: 196322 - DNA, 25 bp, Homo sapien
taccttgtcctatgaagctctgaga

SEQ ID NO: 196323 - DNA, 25 bp, Homo sapien
gagaattttttgtacgatcagcctt

SEQ ID NO: 196324 - DNA, 25 bp, Homo sapien
tgtacgatcagccttactgctaata

SEQ ID NO: 196325 - DNA, 25 bp, Homo sapien
aagttgcagtgtgctgttggcttca

SEQ ID NO: 196326 - DNA, 25 bp, Homo sapien
tgcagtgtgctgttggcttcagcat

SEQ ID NO: 196327 - DNA, 25 bp, Homo sapien
gtgtgctgttggcttcagcattgta

SEQ ID NO: 196328 - DNA, 25 bp, Homo sapien
gttggcttcagcattgtagaaagat

SEQ ID NO: 196329 - DNA, 25 bp, Homo sapien
aactacttgcatgttatgctttcat

SEQ ID NO: 196330 - DNA, 25 bp, Homo sapien
catgttatgctttcatttgggtgga

SEQ ID NO: 196331 - DNA, 25 bp, Homo sapien
gctttcatttgggtggaatacttca

SEQ ID NO: 196332 - DNA, 25 bp, Homo sapien
atttgggtggaatacttcattggaa

SEQ ID NO: 196333 - DNA, 25 bp, Homo sapien
tttgccctatctgtttgcacaagtt

SEQ ID NO: 196334 - DNA, 25 bp, Homo sapien
gccctatctgtttgcacaagttgca

SEQ ID NO: 196335 - DNA, 25 bp, Homo sapien
atctgtttgcacaagttgcagtgtg

SEQ ID NO: 196336 - DNA, 25 bp, Homo sapien
ggattgagacaaaaactgtgatttt

SEQ ID NO: 196337 - DNA, 25 bp, Homo sapien
ctgacaaaatgggtggatatctttt

SEQ ID NO: 196338 - DNA, 25 bp, Homo sapien
atcactcttgttgatatctctgccg

SEQ ID NO: 196339 - DNA, 25 bp, Homo sapien
actcttgttgatatctctgccgaca

SEQ ID NO: 196340 - DNA, 25 bp, Homo sapien
gttgatatctctgccgacatcatag

SEQ ID NO: 196341 - DNA, 25 bp, Homo sapien
gatatctctgccgacatcatagaaa

SEQ ID NO: 196342 - DNA, 25 bp, Homo sapien
atctctgccgacatcatagaaattg

SEQ ID NO: 196343 - DNA, 25 bp, Homo sapien
gaaattggtcaagtgtcagtaacac

SEQ ID NO: 196344 - DNA, 25 bp, Homo sapien
ggtcaagtgtcagtaacactttatt

SEQ ID NO: 196345 - DNA, 25 bp, Homo sapien
gcagaaccagcaggtggatagtata

SEQ ID NO: 196346 - DNA, 25 bp, Homo sapien
gatagtatataggtttatgcctggg

SEQ ID NO: 196347 - DNA, 25 bp, Homo sapien
ttggctggattcagttacctggctg

SEQ ID NO: 196348 - DNA, 25 bp, Homo sapien
aggcctggtgagcaaaatatcccaa

SEQ ID NO: 196349 - DNA, 25 bp, Homo sapien
aatatcccaaacctcgcgtgatctg

SEQ ID NO: 196350 - DNA, 25 bp, Homo sapien
aatacggatctccagatgtgccagt

SEQ ID NO: 196351 - DNA, 25 bp, Homo sapien
agatgtgccagtctcgagtctatcg

SEQ ID NO: 196352 - DNA, 25 bp, Homo sapien
tcgagtctatcgatatgaggtcccc

SEQ ID NO: 196353 - DNA, 25 bp, Homo sapien
tctattcatcattttaaccgcattt

SEQ ID NO: 196354 - DNA, 25 bp, Homo sapien
aaccgcatttcatcgatcttgagac

SEQ ID NO: 196355 - DNA, 25 bp, Homo sapien
gagacacggcttttgatattttatc

SEQ ID NO: 196356 - DNA, 25 bp, Homo sapien
atagcagcgtttttctaagagatac

SEQ ID NO: 196357 - DNA, 25 bp, Homo sapien
agaaacgatgctgtcttccatgcga

SEQ ID NO: 196358 - DNA, 25 bp, Homo sapien
gatcatcgtatgcaacagctgggta

SEQ ID NO: 196359 - DNA, 25 bp, Homo sapien
ctgggtaataagactagcatagctc

SEQ ID NO: 196360 - DNA, 25 bp, Homo sapien
agcatagctcaaactatcctgccaa

SEQ ID NO: 196361 - DNA, 25 bp, Homo sapien
tgccaacgctctcatctgatttttc

SEQ ID NO: 196362 - DNA, 25 bp, Homo sapien
caatcaccctgagtcacctgtaaat

SEQ ID NO: 196363 - DNA, 25 bp, Homo sapien
aaattcatttgtcattcaagcggaa

SEQ ID NO: 196364 - DNA, 25 bp, Homo sapien
gcggaataacaagttgtccctagca

SEQ ID NO: 196365 - DNA, 25 bp, Homo sapien
gttgtccctagcaaaaccgctgagc

SEQ ID NO: 196366 - DNA, 25 bp, Homo sapien
aaccgctgagcgctttataattttg

SEQ ID NO: 196367 - DNA, 25 bp, Homo sapien
atttttgtcagtaggtagcagaggc

SEQ ID NO: 196368 - DNA, 25 bp, Homo sapien
cagaggcggaagtattttttggtgt

SEQ ID NO: 196369 - DNA, 25 bp, Homo sapien
tatttcagagggagggtccttttca

SEQ ID NO: 196370 - DNA, 25 bp, Homo sapien
cagagggagggtccttttcattctc

SEQ ID NO: 196371 - DNA, 25 bp, Homo sapien
gagggagggtccttttcattctcct

SEQ ID NO: 196372 - DNA, 25 bp, Homo sapien
gagggtccttttcattctccttgct

SEQ ID NO: 196373 - DNA, 25 bp, Homo sapien
tccttttcattctccttgctttgta

SEQ ID NO: 196374 - DNA, 25 bp, Homo sapien
ttcattctccttgctttgtatttaa

SEQ ID NO: 196375 - DNA, 25 bp, Homo sapien
ccttgctttgtatttaaggactggg

SEQ ID NO: 196376 - DNA, 25 bp, Homo sapien
gagggctaggtgtgatcaacacttt

SEQ ID NO: 196377 - DNA, 25 bp, Homo sapien
taggtgtgatcaacacttttcttct

SEQ ID NO: 196378 - DNA, 25 bp, Homo sapien
ctctgtgccaagaggattcatcctg

SEQ ID NO: 196379 - DNA, 25 bp, Homo sapien
tcacatgtaaaaggaacttgggtag

SEQ ID NO: 196380 - DNA, 25 bp, Homo sapien
acaaagccgtttcttatcatgcctc

SEQ ID NO: 196381 - DNA, 25 bp, Homo sapien
cagtgttgcctacaagcctggaggc

SEQ ID NO: 196382 - DNA, 25 bp, Homo sapien
tgttgcctacaagcctggaggcttc

SEQ ID NO: 196383 - DNA, 25 bp, Homo sapien
tggaggcttcaaggccagcactggc

SEQ ID NO: 196384 - DNA, 25 bp, Homo sapien
aggcttcaaggccagcactggcttt

SEQ ID NO: 196385 - DNA, 25 bp, Homo sapien
cactggctttgggtccaacaccaaa

SEQ ID NO: 196386 - DNA, 25 bp, Homo sapien
agatatacgatggaggtgcccgcac

SEQ ID NO: 196387 - DNA, 25 bp, Homo sapien
tatacgatggaggtgcccgcacaga

SEQ ID NO: 196388 - DNA, 25 bp, Homo sapien
gtgcccgcacagaggacgaggtaca

SEQ ID NO: 196389 - DNA, 25 bp, Homo sapien
gacgaggtacaatcttatccttcca

SEQ ID NO: 196390 - DNA, 25 bp, Homo sapien
tacaatcttatccttccaagcacga

SEQ ID NO: 196391 - DNA, 25 bp, Homo sapien
tttgttaattttcccctgtgttgtg

SEQ ID NO: 196392 - DNA, 25 bp, Homo sapien
gttaattttcccctgtgttgtgata

SEQ ID NO: 196393 - DNA, 25 bp, Homo sapien
aattttcccctgtgttgtgataaat

SEQ ID NO: 196394 - DNA, 25 bp, Homo sapien
tgtttgccagcattcagtactgtgt

SEQ ID NO: 196395 - DNA, 25 bp, Homo sapien
tgccagcattcagtactgtgttggt

SEQ ID NO: 196396 - DNA, 25 bp, Homo sapien
ctacgcattcagtccttaaggggtt

SEQ ID NO: 196397 - DNA, 25 bp, Homo sapien
aaaaagaatctgctcagttccatat

SEQ ID NO: 196398 - DNA, 25 bp, Homo sapien
aatctgctcagttccatatttcatc

SEQ ID NO: 196399 - DNA, 25 bp, Homo sapien
gctcagttccatatttcatccgtga

SEQ ID NO: 196400 - DNA, 25 bp, Homo sapien
ttcatccgtgaaaaacttgcaatac

SEQ ID NO: 196401 - DNA, 25 bp, Homo sapien
aacttgcaatacgagcagtttcaag

SEQ ID NO: 196402 - DNA, 25 bp, Homo sapien
ggactcatatatgcatacattcctt

SEQ ID NO: 196403 - DNA, 25 bp, Homo sapien
atgcatacattccttgagtgactat

SEQ ID NO: 196404 - DNA, 25 bp, Homo sapien
gtgactatgaatgactgccgggcag

SEQ ID NO: 196405 - DNA, 25 bp, Homo sapien
gcagtaacttctgggctgtggttgt

SEQ ID NO: 196406 - DNA, 25 bp, Homo sapien
tgtggttgtaaactgtgagcactac

SEQ ID NO: 196407 - DNA, 25 bp, Homo sapien
gtgagcactacaaaatgtttttcct

SEQ ID NO: 196408 - DNA, 25 bp, Homo sapien
tgtttttccttattgataccatatt

SEQ ID NO: 196409 - DNA, 25 bp, Homo sapien
aatgggtttcattagtgcttagcaa

SEQ ID NO: 196410 - DNA, 25 bp, Homo sapien
attgggagcttggtggaccatctct

SEQ ID NO: 196411 - DNA, 25 bp, Homo sapien
ggaccatctcttggttttggaccat

SEQ ID NO: 196412 - DNA, 25 bp, Homo sapien
tggttttggaccatctcttggtttc

SEQ ID NO: 196413 - DNA, 25 bp, Homo sapien
aagtgctctatatgcataatatcaa

SEQ ID NO: 196414 - DNA, 25 bp, Homo sapien
tatgaagatatgctaatgtgttaat

SEQ ID NO: 196415 - DNA, 25 bp, Homo sapien
gcaaaatgccaataagtgccagttt

SEQ ID NO: 196416 - DNA, 25 bp, Homo sapien
aataagtgccagttttgcattttca

SEQ ID NO: 196417 - DNA, 25 bp, Homo sapien
aagtttgtcacttgagcttatgtac

SEQ ID NO: 196418 - DNA, 25 bp, Homo sapien
ttgtcacttgagcttatgtacagaa

SEQ ID NO: 196419 - DNA, 25 bp, Homo sapien
gtacagaatgctatatgagaaacac

SEQ ID NO: 196420 - DNA, 25 bp, Homo sapien
gagaaacacttttagaatggattta

SEQ ID NO: 196421 - DNA, 25 bp, Homo sapien
tattgtcttttacttttctacataa

SEQ ID NO: 196422 - DNA, 25 bp, Homo sapien
aggtttgtaagatttggatctcaac

SEQ ID NO: 196423 - DNA, 25 bp, Homo sapien
ggatctcaactaatttctacattgc

SEQ ID NO: 196424 - DNA, 25 bp, Homo sapien
gtaaaaatagaacctatccctggtg

SEQ ID NO: 196425 - DNA, 25 bp, Homo sapien
tagaacctatccctggtgagtcacc

SEQ ID NO: 196426 - DNA, 25 bp, Homo sapien
tggtgagtcacccaaaatgtttgga

SEQ ID NO: 196427 - DNA, 25 bp, Homo sapien
gaagctacagatattcttgttagta

SEQ ID NO: 196428 - DNA, 25 bp, Homo sapien
cttgttagtaagatcagccggcagt

SEQ ID NO: 196429 - DNA, 25 bp, Homo sapien
gatcagccggcagtccattgatgca

SEQ ID NO: 196430 - DNA, 25 bp, Homo sapien
ggcagtccattgatgcactcaaaga

SEQ ID NO: 196431 - DNA, 25 bp, Homo sapien
tgatgcactcaaagactggttcaga

SEQ ID NO: 196432 - DNA, 25 bp, Homo sapien
gtgactggcagcttattgtggagct

SEQ ID NO: 196433 - DNA, 25 bp, Homo sapien
atctaattttttcacatggagcagg

SEQ ID NO: 196434 - DNA, 25 bp, Homo sapien
gcaggaactggagtaaatgcaatac

SEQ ID NO: 196435 - DNA, 25 bp, Homo sapien
tcatttcctcacctgtagtggccac

SEQ ID NO: 196436 - DNA, 25 bp, Homo sapien
acctgtagtggccacctctatattg

SEQ ID NO: 196437 - DNA, 25 bp, Homo sapien
ctgtagtggccacctctatattgag

SEQ ID NO: 196438 - DNA, 25 bp, Homo sapien
gtagtggccacctctatattgaggt

SEQ ID NO: 196439 - DNA, 25 bp, Homo sapien
tggccacctctatattgaggtgctc

SEQ ID NO: 196440 - DNA, 25 bp, Homo sapien
gctcaataagcaaaagtggtcggtg

SEQ ID NO: 196441 - DNA, 25 bp, Homo sapien
caaaagtggtcggtggctgctgtat

SEQ ID NO: 196442 - DNA, 25 bp, Homo sapien
aaaagtggtcggtggctgctgtatt

SEQ ID NO: 196443 - DNA, 25 bp, Homo sapien
accacagaaaggtcggctggcagca

SEQ ID NO: 196444 - DNA, 25 bp, Homo sapien
aaggtcggctggcagcactggccaa

SEQ ID NO: 196445 - DNA, 25 bp, Homo sapien
ggtgtgctacacagtgtatgtcact

SEQ ID NO: 196446 - DNA, 25 bp, Homo sapien
atgaaaatcttatcacattaaattc

SEQ ID NO: 196447 - DNA, 25 bp, Homo sapien
ttctatttttcttgaggtgattctc

SEQ ID NO: 196448 - DNA, 25 bp, Homo sapien
tttcttgaggtgattctcaactagc

SEQ ID NO: 196449 - DNA, 25 bp, Homo sapien
gaggtgattctcaactagcaattgg

SEQ ID NO: 196450 - DNA, 25 bp, Homo sapien
gtgattctcaactagcaattggaac

SEQ ID NO: 196451 - DNA, 25 bp, Homo sapien
tctcaactagcaattggaactccta

SEQ ID NO: 196452 - DNA, 25 bp, Homo sapien
tcaactagcaattggaactcctagg

SEQ ID NO: 196453 - DNA, 25 bp, Homo sapien
gaactcctaggctctattaacataa

SEQ ID NO: 196454 - DNA, 25 bp, Homo sapien
ctaggctctattaacataattcttt

SEQ ID NO: 196455 - DNA, 25 bp, Homo sapien
tctttattgtaaacgtatctaatgc

SEQ ID NO: 196456 - DNA, 25 bp, Homo sapien
ttgtaaacgtatctaatgctaaaag

SEQ ID NO: 196457 - DNA, 25 bp, Homo sapien
ataaagtcctgcctgagttggttca

SEQ ID NO: 196458 - DNA, 25 bp, Homo sapien
caacgtgtgccctctggtcaatgag

SEQ ID NO: 196459 - DNA, 25 bp, Homo sapien
aatgaggttctcagaggcttggaca

SEQ ID NO: 196460 - DNA, 25 bp, Homo sapien
gaggcttggacatcaccctggtgca

SEQ ID NO: 196461 - DNA, 25 bp, Homo sapien
atcaccctggtgcatgacattgtta

SEQ ID NO: 196462 - DNA, 25 bp, Homo sapien
taacatgctgatccacggactacag

SEQ ID NO: 196463 - DNA, 25 bp, Homo sapien
ggactacagtttgtcatcaaggtct

SEQ ID NO: 196464 - DNA, 25 bp, Homo sapien
atcaaggtctaagccttccaggaag

SEQ ID NO: 196465 - DNA, 25 bp, Homo sapien
agtgctcacagatggctggcccatg

SEQ ID NO: 196466 - DNA, 25 bp, Homo sapien
tgctggaagatgacacagttgcctt

SEQ ID NO: 196467 - DNA, 25 bp, Homo sapien
agttgccttctctccgaggaacctg

SEQ ID NO: 196468 - DNA, 25 bp, Homo sapien
aaatccaaagttctcgtctgcattt

SEQ ID NO: 196469 - DNA, 25 bp, Homo sapien
aagttctcgtctgcatttgtggacc

SEQ ID NO: 196470 - DNA, 25 bp, Homo sapien
gcatttgtggaccagtgccatttac

SEQ ID NO: 196471 - DNA, 25 bp, Homo sapien
ggaccagtgccatttacagaacaag

SEQ ID NO: 196472 - DNA, 25 bp, Homo sapien
gagtaaggttgctgcatgatctcaa

SEQ ID NO: 196473 - DNA, 25 bp, Homo sapien
gagatccatagttttacagcataat

SEQ ID NO: 196474 - DNA, 25 bp, Homo sapien
agagctgtcattgtcctttattcaa

SEQ ID NO: 196475 - DNA, 25 bp, Homo sapien
ggttaactagaatccagccttcagt

SEQ ID NO: 196476 - DNA, 25 bp, Homo sapien
gaatccagccttcagtttcttaaat

SEQ ID NO: 196477 - DNA, 25 bp, Homo sapien
tgttccttcagtacaggtaacttct

SEQ ID NO: 196478 - DNA, 25 bp, Homo sapien
tacaggtaacttcttggctttcttt

SEQ ID NO: 196479 - DNA, 25 bp, Homo sapien
aattatttggtgtggccatcttacc

SEQ ID NO: 196480 - DNA, 25 bp, Homo sapien
tgtggccatcttacctgcttatgtc

SEQ ID NO: 196481 - DNA, 25 bp, Homo sapien
gcttatgtctcctacacaaagctaa

SEQ ID NO: 196482 - DNA, 25 bp, Homo sapien
tcttactgttgatatatgtatgctc

SEQ ID NO: 196483 - DNA, 25 bp, Homo sapien
tgctctggtacacagatgtcatttt

SEQ ID NO: 196484 - DNA, 25 bp, Homo sapien
ggtacacagatgtcattttgttgtc

SEQ ID NO: 196485 - DNA, 25 bp, Homo sapien
gtcattttgttgtcacagcactaca

SEQ ID NO: 196486 - DNA, 25 bp, Homo sapien
tgttgtcacagcactacagtgaaat

SEQ ID NO: 196487 - DNA, 25 bp, Homo sapien
gacaacataaactacttttgctttg

SEQ ID NO: 196488 - DNA, 25 bp, Homo sapien
acttttgctttgaaatgatgtatgc

SEQ ID NO: 196489 - DNA, 25 bp, Homo sapien
aaatgatgtatgcttcagtaaaatc

SEQ ID NO: 196490 - DNA, 25 bp, Homo sapien
ctcgtcttgggttagctctgactgt

SEQ ID NO: 196491 - DNA, 25 bp, Homo sapien
ttgggttagctctgactgtcctgaa

SEQ ID NO: 196492 - DNA, 25 bp, Homo sapien
gggttagctctgactgtcctgaacg

SEQ ID NO: 196493 - DNA, 25 bp, Homo sapien
tagctctgactgtcctgaacgctgt

SEQ ID NO: 196494 - DNA, 25 bp, Homo sapien
tctgactgtcctgaacgctgtcgtt

SEQ ID NO: 196495 - DNA, 25 bp, Homo sapien
gactgtcctgaacgctgtcgttctg

SEQ ID NO: 196496 - DNA, 25 bp, Homo sapien
aacgctgtcgttctgtctgtttcct

SEQ ID NO: 196497 - DNA, 25 bp, Homo sapien
tgtcgttctgtctgtttcctccatg

SEQ ID NO: 196498 - DNA, 25 bp, Homo sapien
gaactgcacaacttgagcctgactg

SEQ ID NO: 196499 - DNA, 25 bp, Homo sapien
actgcacaacttgagcctgactgta

SEQ ID NO: 196500 - DNA, 25 bp, Homo sapien
acaacttgagcctgactgtacatct

SEQ ID NO: 196501 - DNA, 25 bp, Homo sapien
gtgtagacaaataccagttcccatt

SEQ ID NO: 196502 - DNA, 25 bp, Homo sapien
agttcccattggtgttgttgcctat

SEQ ID NO: 196503 - DNA, 25 bp, Homo sapien
cactgcttatgttcttcgggattct

SEQ ID NO: 196504 - DNA, 25 bp, Homo sapien
gggattctgggagccaccactctat

SEQ ID NO: 196505 - DNA, 25 bp, Homo sapien
tatccgtctccattctgctttgggc

SEQ ID NO: 196506 - DNA, 25 bp, Homo sapien
aaagccaagacttcatgaactacat

SEQ ID NO: 196507 - DNA, 25 bp, Homo sapien
aggtcttaccattgacctaagatca

SEQ ID NO: 196508 - DNA, 25 bp, Homo sapien
tgaactatcttagcccagtcaggga

SEQ ID NO: 196509 - DNA, 25 bp, Homo sapien
gaaaggcatctttcgccagtggatt

SEQ ID NO: 196510 - DNA, 25 bp, Homo sapien
tcgccagtggattcgcctcaaggtt

SEQ ID NO: 196511 - DNA, 25 bp, Homo sapien
gttgaggccgccattggaagatgaa

SEQ ID NO: 196512 - DNA, 25 bp, Homo sapien
ttaagacttttgtcatgtggtgagt

SEQ ID NO: 196513 - DNA, 25 bp, Homo sapien
aagaccattttgattgtaaaccata

SEQ ID NO: 196514 - DNA, 25 bp, Homo sapien
agttcagcaagtagcccacagttct

SEQ ID NO: 196515 - DNA, 25 bp, Homo sapien
agttctggcctaacagcagacttgc

SEQ ID NO: 196516 - DNA, 25 bp, Homo sapien
gcagacttgctgttttcacttggta

SEQ ID NO: 196517 - DNA, 25 bp, Homo sapien
tgctgttttcacttggtatcctgga

SEQ ID NO: 196518 - DNA, 25 bp, Homo sapien
ttttcacttggtatcctggagttgg

SEQ ID NO: 196519 - DNA, 25 bp, Homo sapien
ctggagttgggttgctaaccttaat

SEQ ID NO: 196520 - DNA, 25 bp, Homo sapien
gggttgctaaccttaatttctatga

SEQ ID NO: 196521 - DNA, 25 bp, Homo sapien
acttgataaagtagaccaccagctg

SEQ ID NO: 196522 - DNA, 25 bp, Homo sapien
accaccagctgcaccgtgttttctg

SEQ ID NO: 196523 - DNA, 25 bp, Homo sapien
gccgacttgcaaacggattggccta

SEQ ID NO: 196524 - DNA, 25 bp, Homo sapien
cggattggcctaatgaagaagttca

SEQ ID NO: 196525 - DNA, 25 bp, Homo sapien
ggaaaatcagctctcataactaagt

SEQ ID NO: 196526 - DNA, 25 bp, Homo sapien
gggtataaagtgtaaccatcagtta

SEQ ID NO: 196527 - DNA, 25 bp, Homo sapien
catcagttaaacctctcctgtcatt

SEQ ID NO: 196528 - DNA, 25 bp, Homo sapien
aaacctctcctgtcattcctagctt

SEQ ID NO: 196529 - DNA, 25 bp, Homo sapien
cctagcttccttgcttcagaattga

SEQ ID NO: 196530 - DNA, 25 bp, Homo sapien
gcttccttgcttcagaattgaaatg

SEQ ID NO: 196531 - DNA, 25 bp, Homo sapien
tgggcaaatgtttgtgtggcctcct

SEQ ID NO: 196532 - DNA, 25 bp, Homo sapien
caaatgtttgtgtggcctccttaaa

SEQ ID NO: 196533 - DNA, 25 bp, Homo sapien
tgtgtggcctccttaaactagctgt

SEQ ID NO: 196534 - DNA, 25 bp, Homo sapien
acctcccctatgatgggcggctact

SEQ ID NO: 196535 - DNA, 25 bp, Homo sapien
gaggaagaggcctactacccgcccg

SEQ ID NO: 196536 - DNA, 25 bp, Homo sapien
tactcggagaccgactcgcaggcgt

SEQ ID NO: 196537 - DNA, 25 bp, Homo sapien
agaccgactcgcaggcgtcccgaga

SEQ ID NO: 196538 - DNA, 25 bp, Homo sapien
aggcgtcccgagagcgcaggctcaa

SEQ ID NO: 196539 - DNA, 25 bp, Homo sapien
gcaggctcaagaagaacttggccct

SEQ ID NO: 196540 - DNA, 25 bp, Homo sapien
agaacttggccctgagtcgggaaag

SEQ ID NO: 196541 - DNA, 25 bp, Homo sapien
gtcgggaaagtttagtcgtctgatc

SEQ ID NO: 196542 - DNA, 25 bp, Homo sapien
agtcgtctgatctgacgttttctac

SEQ ID NO: 196543 - DNA, 25 bp, Homo sapien
gatctgacgttttctacgtagcttt

SEQ ID NO: 196544 - DNA, 25 bp, Homo sapien
gacgttttctacgtagcttttgtat

SEQ ID NO: 196545 - DNA, 25 bp, Homo sapien
ggaagtgtccttctacagtgtaagc

SEQ ID NO: 196546 - DNA, 25 bp, Homo sapien
acagtgtaagcgatgggtcccacct

SEQ ID NO: 196547 - DNA, 25 bp, Homo sapien
ggctccgaagtctggtcagatggtc

SEQ ID NO: 196548 - DNA, 25 bp, Homo sapien
tcagatggtcatctccacagtgacc

SEQ ID NO: 196549 - DNA, 25 bp, Homo sapien
atctccacagtgaccatgtgggtga

SEQ ID NO: 196550 - DNA, 25 bp, Homo sapien
tgctcctggctctgcagaaggtgtg

SEQ ID NO: 196551 - DNA, 25 bp, Homo sapien
aaggtgtgggccttctgcttactgc

SEQ ID NO: 196552 - DNA, 25 bp, Homo sapien
tgggccttctgcttactgcaggcca

SEQ ID NO: 196553 - DNA, 25 bp, Homo sapien
agggttctctggcatcacgctggca

SEQ ID NO: 196554 - DNA, 25 bp, Homo sapien
tggcatcacgctggcagccattaga

SEQ ID NO: 196555 - DNA, 25 bp, Homo sapien
gctggcagccattagacacacaggg

SEQ ID NO: 196556 - DNA, 25 bp, Homo sapien
gaatgagatcctgtttctgttcagc

SEQ ID NO: 196557 - DNA, 25 bp, Homo sapien
aatgagatcctgtttctgttcagct

SEQ ID NO: 196558 - DNA, 25 bp, Homo sapien
atgagatcctgtttctgttcagctg

SEQ ID NO: 196559 - DNA, 25 bp, Homo sapien
gagatcctgtttctgttcagctgca

SEQ ID NO: 196560 - DNA, 25 bp, Homo sapien
agatcctgtttctgttcagctgcac

SEQ ID NO: 196561 - DNA, 25 bp, Homo sapien
gatcctgtttctgttcagctgcacc

SEQ ID NO: 196562 - DNA, 25 bp, Homo sapien
cctgtttctgttcagctgcaccctg

SEQ ID NO: 196563 - DNA, 25 bp, Homo sapien
caccctggaggcaaaaacttgccac

SEQ ID NO: 196564 - DNA, 25 bp, Homo sapien
ttgccacaccagagttcctaggaaa

SEQ ID NO: 196565 - DNA, 25 bp, Homo sapien
tgccacaccagagttcctaggaaac

SEQ ID NO: 196566 - DNA, 25 bp, Homo sapien
gccacaccagagttcctaggaaaca

SEQ ID NO: 196567 - DNA, 25 bp, Homo sapien
gaagagagagaacttgatgccaagt

SEQ ID NO: 196568 - DNA, 25 bp, Homo sapien
gatgccaagtccacgaaaaaacaat

SEQ ID NO: 196569 - DNA, 25 bp, Homo sapien
gaagcgcttcatgcgcagcgaccac

SEQ ID NO: 196570 - DNA, 25 bp, Homo sapien
cttccacccgggaatgctgcagcgg

SEQ ID NO: 196571 - DNA, 25 bp, Homo sapien
tccacccgggaatgctgcagcggcg

SEQ ID NO: 196572 - DNA, 25 bp, Homo sapien
ccgggaatgctgcagcggcgcggcg

SEQ ID NO: 196573 - DNA, 25 bp, Homo sapien
ggctccctcagcgactacagccgct

SEQ ID NO: 196574 - DNA, 25 bp, Homo sapien
actacagccgctccgacgccagcag

SEQ ID NO: 196575 - DNA, 25 bp, Homo sapien
atcagcccggccagctcgccctgag

SEQ ID NO: 196576 - DNA, 25 bp, Homo sapien
cctgagcccgcacagccatgagcag

SEQ ID NO: 196577 - DNA, 25 bp, Homo sapien
ctcgtgagtccctggcctttccttt

SEQ ID NO: 196578 - DNA, 25 bp, Homo sapien
tcaggactcaactgtatctcctttt

SEQ ID NO: 196579 - DNA, 25 bp, Homo sapien
ttgtttgccagcattcagtactgtg

SEQ ID NO: 196580 - DNA, 25 bp, Homo sapien
tactgtgttggtgcagatgaggttt

SEQ ID NO: 196581 - DNA, 25 bp, Homo sapien
gaggtttatatctcattttagctta

SEQ ID NO: 196582 - DNA, 25 bp, Homo sapien
ttatatctcattttagcttatttct

SEQ ID NO: 196583 - DNA, 25 bp, Homo sapien
tcttgtacctttcagcatgcctacg

SEQ ID NO: 196584 - DNA, 25 bp, Homo sapien
tgtacctttcagcatgcctacgcat

SEQ ID NO: 196585 - DNA, 25 bp, Homo sapien
tacctttcagcatgcctacgcattc

SEQ ID NO: 196586 - DNA, 25 bp, Homo sapien
tgcctacgcattcagtccttaaggg

SEQ ID NO: 196587 - DNA, 25 bp, Homo sapien
tattttacaaactgtgcgcctgaag

SEQ ID NO: 196588 - DNA, 25 bp, Homo sapien
aatctgctcagttccatatttcatc

SEQ ID NO: 196589 - DNA, 25 bp, Homo sapien
gaaggtccaggtcaagacctcgtct

SEQ ID NO: 196590 - DNA, 25 bp, Homo sapien
aagacctcgtctccgttctcatagt

SEQ ID NO: 196591 - DNA, 25 bp, Homo sapien
ctccgttctcatagtcgtagcagtg

SEQ ID NO: 196592 - DNA, 25 bp, Homo sapien
agtcgtagcagtgaaaggtccagtc

SEQ ID NO: 196593 - DNA, 25 bp, Homo sapien
aggtccagtcacagaagaacgcgta

SEQ ID NO: 196594 - DNA, 25 bp, Homo sapien
aagaacgcgtagtcggtctcgggat

SEQ ID NO: 196595 - DNA, 25 bp, Homo sapien
tcggtctcgggatagagaacgacgt

SEQ ID NO: 196596 - DNA, 25 bp, Homo sapien
gagaacgacgtaagggcagagataa

SEQ ID NO: 196597 - DNA, 25 bp, Homo sapien
ggaatacataacatcaaacgtggga

SEQ ID NO: 196598 - DNA, 25 bp, Homo sapien
catcaaacgtgggaatctggaaaca

SEQ ID NO: 196599 - DNA, 25 bp, Homo sapien
gatttagaacatcttgccaccagct

SEQ ID NO: 196600 - DNA, 25 bp, Homo sapien
aagaaattgttcgttattgctcaga

SEQ ID NO: 196601 - DNA, 25 bp, Homo sapien
attcaaacacgcaaagatcttatgg

SEQ ID NO: 196602 - DNA, 25 bp, Homo sapien
gaaagaaacggtgaactccccagct

SEQ ID NO: 196603 - DNA, 25 bp, Homo sapien
ggtgaactccccagctatttataaa

SEQ ID NO: 196604 - DNA, 25 bp, Homo sapien
tttcagagtcgtcgaaaacgttgac

SEQ ID NO: 196605 - DNA, 25 bp, Homo sapien
cgttgacgtgttatagataagcctt

SEQ ID NO: 196606 - DNA, 25 bp, Homo sapien
ataagccttgtcattctgtatcaaa

SEQ ID NO: 196607 - DNA, 25 bp, Homo sapien
aatctgttgtcgttttctagtaact

SEQ ID NO: 196608 - DNA, 25 bp, Homo sapien
attccattactccaaatggcatggt

SEQ ID NO: 196609 - DNA, 25 bp, Homo sapien
accataactaaattgtcagtctgac

SEQ ID NO: 196610 - DNA, 25 bp, Homo sapien
aatgtctttctatggacaacattaa

SEQ ID NO: 196611 - DNA, 25 bp, Homo sapien
agtggtctgactggtttcattttag

SEQ ID NO: 196612 - DNA, 25 bp, Homo sapien
acagctgcttcaatatgttattcaa

SEQ ID NO: 196613 - DNA, 25 bp, Homo sapien
attcaatgttaatgtttggctgtga

SEQ ID NO: 196614 - DNA, 25 bp, Homo sapien
tggcatggcagcacttatgctctgt

SEQ ID NO: 196615 - DNA, 25 bp, Homo sapien
cagcacttatgctctgtgacagtat

SEQ ID NO: 196616 - DNA, 25 bp, Homo sapien
acagtattgtgtgtcatagttgagc

SEQ ID NO: 196617 - DNA, 25 bp, Homo sapien
gagcagtagctggtagaattaggca

SEQ ID NO: 196618 - DNA, 25 bp, Homo sapien
gtgatagttttactttggtacaaat

SEQ ID NO: 196619 - DNA, 25 bp, Homo sapien
gtccaccagtataatggcattgctg

SEQ ID NO: 196620 - DNA, 25 bp, Homo sapien
taatggcattgctgtgtctggcact

SEQ ID NO: 196621 - DNA, 25 bp, Homo sapien
gctgtgtctggcacttcattgtaca

SEQ ID NO: 196622 - DNA, 25 bp, Homo sapien
atcagaaccggtacctggatggcat

SEQ ID NO: 196623 - DNA, 25 bp, Homo sapien
gatggcatggactcggatttcacaa

SEQ ID NO: 196624 - DNA, 25 bp, Homo sapien
tcggatttcacaagcatgaccagcc

SEQ ID NO: 196625 - DNA, 25 bp, Homo sapien
tgaccagcctgcttacagggagcgt

SEQ ID NO: 196626 - DNA, 25 bp, Homo sapien
agcgtgaagcgcttttccacaatgg

SEQ ID NO: 196627 - DNA, 25 bp, Homo sapien
ttccacaatggcaaggtccggacaa

SEQ ID NO: 196628 - DNA, 25 bp, Homo sapien
cggacaagacaaccggaagcttcta

SEQ ID NO: 196629 - DNA, 25 bp, Homo sapien
gaagcttctatgtggcatggccgtg

SEQ ID NO: 196630 - DNA, 25 bp, Homo sapien
tgggtctaattgtggccttcttcat

SEQ ID NO: 196631 - DNA, 25 bp, Homo sapien
tcctacttcttgtccagggcaagga

SEQ ID NO: 196632 - DNA, 25 bp, Homo sapien
ctgcctggtgttttgggctccacag

SEQ ID NO: 196633 - DNA, 25 bp, Homo sapien
aaaagtttcactgtcagagatattg

SEQ ID NO: 196634 - DNA, 25 bp, Homo sapien
actgtcagagatattgtaggtgcta

SEQ ID NO: 196635 - DNA, 25 bp, Homo sapien
ggtgctaatactggatttcgtctca

SEQ ID NO: 196636 - DNA, 25 bp, Homo sapien
atactggatttcgtctcagatttaa

SEQ ID NO: 196637 - DNA, 25 bp, Homo sapien
taatttcttttatgggtctgttagt

SEQ ID NO: 196638 - DNA, 25 bp, Homo sapien
tatgggtctgttagtcattcaacaa

SEQ ID NO: 196639 - DNA, 25 bp, Homo sapien
gtcattcaacaaatcccataagtat

SEQ ID NO: 196640 - DNA, 25 bp, Homo sapien
ctcatttgttactttacagcctgta

SEQ ID NO: 196641 - DNA, 25 bp, Homo sapien
ctttacagcctgtaatagtgtgtct

SEQ ID NO: 196642 - DNA, 25 bp, Homo sapien
gtgtctgcattttcaacctgttgca

SEQ ID NO: 196643 - DNA, 25 bp, Homo sapien
aacctgttgcaataactttgctgaa

SEQ ID NO: 196644 - DNA, 25 bp, Homo sapien
gaaatttgtaatattgaagcacctg

SEQ ID NO: 196645 - DNA, 25 bp, Homo sapien
gaagcacctgatcattggttgccat

SEQ ID NO: 196646 - DNA, 25 bp, Homo sapien
acctgatcattggttgccattggaa

SEQ ID NO: 196647 - DNA, 25 bp, Homo sapien
ggttgccattggaaatacgtgacaa

SEQ ID NO: 196648 - DNA, 25 bp, Homo sapien
taaattcaagtcttattggcagtaa

SEQ ID NO: 196649 - DNA, 25 bp, Homo sapien
ttggcagtaagttttgcccaactga

SEQ ID NO: 196650 - DNA, 25 bp, Homo sapien
tttgcccaactgaaactaccatgct

SEQ ID NO: 196651 - DNA, 25 bp, Homo sapien
gaaactaccatgctaacaaatatat

SEQ ID NO: 196652 - DNA, 25 bp, Homo sapien
tatattacttagaacatgtccacaa

SEQ ID NO: 196653 - DNA, 25 bp, Homo sapien
gaacatgtccacaagaccacaaact

SEQ ID NO: 196654 - DNA, 25 bp, Homo sapien
gtaaatggaatattctctgtgaaaa

SEQ ID NO: 196655 - DNA, 25 bp, Homo sapien
agatctgatgtgacataccagttac

SEQ ID NO: 196656 - DNA, 25 bp, Homo sapien
gtgacataccagttaccttcatttg

SEQ ID NO: 196657 - DNA, 25 bp, Homo sapien
ataccagttaccttcatttgatcag

SEQ ID NO: 196658 - DNA, 25 bp, Homo sapien
catttgatcagtagtgcattataca

SEQ ID NO: 196659 - DNA, 25 bp, Homo sapien
aattgaaatgtcatactgtgccata

SEQ ID NO: 196660 - DNA, 25 bp, Homo sapien
gtcatactgtgccataattatgtgt

SEQ ID NO: 196661 - DNA, 25 bp, Homo sapien
atcctgattttattcattccctcct

SEQ ID NO: 196662 - DNA, 25 bp, Homo sapien
cattccctcctgcaagaaatatttt

SEQ ID NO: 196663 - DNA, 25 bp, Homo sapien
atgtagtcaaattctgaagcatagt

SEQ ID NO: 196664 - DNA, 25 bp, Homo sapien
ctgaagcatagtacagcatgtgaat

SEQ ID NO: 196665 - DNA, 25 bp, Homo sapien
attattcaagtttctgtcacagcat

SEQ ID NO: 196666 - DNA, 25 bp, Homo sapien
ctgaatttgctgctgtctccagcga

SEQ ID NO: 196667 - DNA, 25 bp, Homo sapien
atttgctgctgtctccagcgagtca

SEQ ID NO: 196668 - DNA, 25 bp, Homo sapien
gctgtctccagcgagtcattgcttc

SEQ ID NO: 196669 - DNA, 25 bp, Homo sapien
tccagcgagtcattgcttctcttaa

SEQ ID NO: 196670 - DNA, 25 bp, Homo sapien
cagcgagtcattgcttctcttaatt

SEQ ID NO: 196671 - DNA, 25 bp, Homo sapien
taatttatttacctggaatcaactt

SEQ ID NO: 196672 - DNA, 25 bp, Homo sapien
ggaatcaacttaatcctgtgtgtta

SEQ ID NO: 196673 - DNA, 25 bp, Homo sapien
aacttaatcctgtgtgttaggctgt

SEQ ID NO: 196674 - DNA, 25 bp, Homo sapien
gctataaagaagtacctgatcagga

SEQ ID NO: 196675 - DNA, 25 bp, Homo sapien
agaagtacctgatcaggatctggga

SEQ ID NO: 196676 - DNA, 25 bp, Homo sapien
atcaggatctgggagaattgaaaaa

SEQ ID NO: 196677 - DNA, 25 bp, Homo sapien
tggaccaggtcagggcctacagctg

SEQ ID NO: 196678 - DNA, 25 bp, Homo sapien
ggcctacagctgtgttgtccagtac

SEQ ID NO: 196679 - DNA, 25 bp, Homo sapien
tccagtacaggagccacgagccaaa

SEQ ID NO: 196680 - DNA, 25 bp, Homo sapien
tcatttcctcacctgtagtggccac

SEQ ID NO: 196681 - DNA, 25 bp, Homo sapien
ctgtagtggccacctctatattgag

SEQ ID NO: 196682 - DNA, 25 bp, Homo sapien
gtggccacctctatattgaggtgct

SEQ ID NO: 196683 - DNA, 25 bp, Homo sapien
gctcaataagcaaaagtggtcggtg

SEQ ID NO: 196684 - DNA, 25 bp, Homo sapien
caaaagtggtcggtggctgctgtat

SEQ ID NO: 196685 - DNA, 25 bp, Homo sapien
accacagaaaggtcggctggcagca

SEQ ID NO: 196686 - DNA, 25 bp, Homo sapien
aaggtcggctggcagcactggccaa

SEQ ID NO: 196687 - DNA, 25 bp, Homo sapien
ggtgtgctacacagtgtatgtcact

SEQ ID NO: 196688 - DNA, 25 bp, Homo sapien
atagctaataaacattgccttttct

SEQ ID NO: 196689 - DNA, 25 bp, Homo sapien
gaactataactgttctacggctttt

SEQ ID NO: 196690 - DNA, 25 bp, Homo sapien
tgttctacggctttttaaatgttgt

SEQ ID NO: 196691 - DNA, 25 bp, Homo sapien
atgttgtgaccatttaaccgtgtaa

SEQ ID NO: 196692 - DNA, 25 bp, Homo sapien
aaatattctaggcttcttcacaaat

SEQ ID NO: 196693 - DNA, 25 bp, Homo sapien
ctacacaacaaaaagcttgctgctt

SEQ ID NO: 196694 - DNA, 25 bp, Homo sapien
cttgctgctttctggctaatgaaag

SEQ ID NO: 196695 - DNA, 25 bp, Homo sapien
gaaagccaaggactatccagcacac

SEQ ID NO: 196696 - DNA, 25 bp, Homo sapien
caaggactatccagcacacacagag

SEQ ID NO: 196697 - DNA, 25 bp, Homo sapien
agatacagacagaagctgctcagtt

SEQ ID NO: 196698 - DNA, 25 bp, Homo sapien
gctgctcagttgcttacaagtttca

SEQ ID NO: 196699 - DNA, 25 bp, Homo sapien
caatgagatcttggactctgcctct

SEQ ID NO: 196700 - DNA, 25 bp, Homo sapien
agatcttggactctgcctctcacga

SEQ ID NO: 196701 - DNA, 25 bp, Homo sapien
actgccccttagtcactcagacata

SEQ ID NO: 196702 - DNA, 25 bp, Homo sapien
agtcactcagacatacggcgcagct

SEQ ID NO: 196703 - DNA, 25 bp, Homo sapien
acgacctgggtgctgtgggtggcgc

SEQ ID NO: 196704 - DNA, 25 bp, Homo sapien
ccctgcgcctggatgaggacagcga

SEQ ID NO: 196705 - DNA, 25 bp, Homo sapien
aggacagcgagcacccgcccatgat

SEQ ID NO: 196706 - DNA, 25 bp, Homo sapien
gcccatgattcttcggactgactga

SEQ ID NO: 196707 - DNA, 25 bp, Homo sapien
gattcttcggactgactgaacttga

SEQ ID NO: 196708 - DNA, 25 bp, Homo sapien
gactgactgaacttgacctgtgacc

SEQ ID NO: 196709 - DNA, 25 bp, Homo sapien
gagcagagaacactggcttcacaga

SEQ ID NO: 196710 - DNA, 25 bp, Homo sapien
gcggttctgatctggcaggcagcca

SEQ ID NO: 196711 - DNA, 25 bp, Homo sapien
aggcagccaggatccctgacccttg

SEQ ID NO: 196712 - DNA, 25 bp, Homo sapien
agcaggctctgctgtttctagtgac

SEQ ID NO: 196713 - DNA, 25 bp, Homo sapien
gctgtttctagtgaccctgagatgt

SEQ ID NO: 196714 - DNA, 25 bp, Homo sapien
gtgaccctgagatgtaaacagcaag

SEQ ID NO: 196715 - DNA, 25 bp, Homo sapien
gatagctgggtggtgacctcttagc

SEQ ID NO: 196716 - DNA, 25 bp, Homo sapien
tggtgacctcttagcgggtggattt

SEQ ID NO: 196717 - DNA, 25 bp, Homo sapien
gggtggatttccctgacccaattca

SEQ ID NO: 196718 - DNA, 25 bp, Homo sapien
gacccaattcagagattctttatgc

SEQ ID NO: 196719 - DNA, 25 bp, Homo sapien
gcaaaagtgagttcagtccatctct

SEQ ID NO: 196720 - DNA, 25 bp, Homo sapien
gtgagttcagtccatctctataata

SEQ ID NO: 196721 - DNA, 25 bp, Homo sapien
catccacctcgctttaaaaataagc

SEQ ID NO: 196722 - DNA, 25 bp, Homo sapien
atccacctcgctttaaaaataagca

SEQ ID NO: 196723 - DNA, 25 bp, Homo sapien
tccacctcgctttaaaaataagcac

SEQ ID NO: 196724 - DNA, 25 bp, Homo sapien
ccacctcgctttaaaaataagcaca

SEQ ID NO: 196725 - DNA, 25 bp, Homo sapien
cacctcgctttaaaaataagcacat

SEQ ID NO: 196726 - DNA, 25 bp, Homo sapien
acctcgctttaaaaataagcacatg

SEQ ID NO: 196727 - DNA, 25 bp, Homo sapien
cctcgctttaaaaataagcacatga

SEQ ID NO: 196728 - DNA, 25 bp, Homo sapien
ctcgctttaaaaataagcacatgat

SEQ ID NO: 196729 - DNA, 25 bp, Homo sapien
tcgctttaaaaataagcacatgatg

SEQ ID NO: 196730 - DNA, 25 bp, Homo sapien
aagcacatgatggctgggcaccgtg

SEQ ID NO: 196731 - DNA, 25 bp, Homo sapien
caattttttgttcttcagagatcat

SEQ ID NO: 196732 - DNA, 25 bp, Homo sapien
attttcagtgataactcctaagagg

SEQ ID NO: 196733 - DNA, 25 bp, Homo sapien
agctgagttgttgtgggttctatgt

SEQ ID NO: 196734 - DNA, 25 bp, Homo sapien
gttctatgtttacttcccctatgga

SEQ ID NO: 196735 - DNA, 25 bp, Homo sapien
tcagtatgttttacactgtaccata

SEQ ID NO: 196736 - DNA, 25 bp, Homo sapien
cactgtaccatatagcaaaactttt

SEQ ID NO: 196737 - DNA, 25 bp, Homo sapien
tacaggtagttaagggccacctaca

SEQ ID NO: 196738 - DNA, 25 bp, Homo sapien
aagggccacctacaatacatctgag

SEQ ID NO: 196739 - DNA, 25 bp, Homo sapien
atacatctgaggtcctgtgatctta

SEQ ID NO: 196740 - DNA, 25 bp, Homo sapien
tgaggtcctgtgatcttatttttct

SEQ ID NO: 196741 - DNA, 25 bp, Homo sapien
ttatttttctaaacgtaagcactgt

SEQ ID NO: 196742 - DNA, 25 bp, Homo sapien
tgaggctccagctgatgccctcagc

SEQ ID NO: 196743 - DNA, 25 bp, Homo sapien
tgatgccctcagctcccagagaggg

SEQ ID NO: 196744 - DNA, 25 bp, Homo sapien
gggtcactgcttgtcagctcagggc

SEQ ID NO: 196745 - DNA, 25 bp, Homo sapien
ctacatctgtgcctgcacatccaga

SEQ ID NO: 196746 - DNA, 25 bp, Homo sapien
aggaagcccaccttgagccagagtc

SEQ ID NO: 196747 - DNA, 25 bp, Homo sapien
agccagagtcaagggctgcagcact

SEQ ID NO: 196748 - DNA, 25 bp, Homo sapien
ggctgcagcactgcccgatagaaca

SEQ ID NO: 196749 - DNA, 25 bp, Homo sapien
tgctgttcttgccttacagccacca

SEQ ID NO: 196750 - DNA, 25 bp, Homo sapien
ctgttcttgccttacagccaccatg

SEQ ID NO: 196751 - DNA, 25 bp, Homo sapien
ggaaagctgcaacctttctgtttta

SEQ ID NO: 196752 - DNA, 25 bp, Homo sapien
aaagctgcaacctttctgttttatt

SEQ ID NO: 196753 - DNA, 25 bp, Homo sapien
gggcatggagcttcactccttgctg

SEQ ID NO: 196754 - DNA, 25 bp, Homo sapien
atggagcttcactccttgctggcca

SEQ ID NO: 196755 - DNA, 25 bp, Homo sapien
agactggcctcaatggcggactcag

SEQ ID NO: 196756 - DNA, 25 bp, Homo sapien
gcctcaatggcggactcagtcacat

SEQ ID NO: 196757 - DNA, 25 bp, Homo sapien
ctcaatggcggactcagtcacattg

SEQ ID NO: 196758 - DNA, 25 bp, Homo sapien
agtcacattgactgacggggaccag

SEQ ID NO: 196759 - DNA, 25 bp, Homo sapien
ttgtgtgggtcgagagcgccctcat

SEQ ID NO: 196760 - DNA, 25 bp, Homo sapien
tcgagagcgccctcatggtgctggt

SEQ ID NO: 196761 - DNA, 25 bp, Homo sapien
gggacacaagcaggcgccaatggta

SEQ ID NO: 196762 - DNA, 25 bp, Homo sapien
aagcaggcgccaatggtatctgggc

SEQ ID NO: 196763 - DNA, 25 bp, Homo sapien
cacagagttcttggaataaaagcaa

SEQ ID NO: 196764 - DNA, 25 bp, Homo sapien
taatgtccagcaccctgtacactgt

SEQ ID NO: 196765 - DNA, 25 bp, Homo sapien
tgtgccctttaacctcattactgag

SEQ ID NO: 196766 - DNA, 25 bp, Homo sapien
cattactgagtaccaccgcgaggaa

SEQ ID NO: 196767 - DNA, 25 bp, Homo sapien
atgcatggtgcagctggctcagatc

SEQ ID NO: 196768 - DNA, 25 bp, Homo sapien
ctcagatcctggtcggaggtggcct

SEQ ID NO: 196769 - DNA, 25 bp, Homo sapien
gcctgggctttctggtcaacacagc

SEQ ID NO: 196770 - DNA, 25 bp, Homo sapien
aacacagccgggaccgttgtcgtcg

SEQ ID NO: 196771 - DNA, 25 bp, Homo sapien
gttgtcgtcgtggtgatcacagcgt

SEQ ID NO: 196772 - DNA, 25 bp, Homo sapien
acagcgtctgcggtggcactgatag

SEQ ID NO: 196773 - DNA, 25 bp, Homo sapien
actgataggctgttgctttgtcgct

SEQ ID NO: 196774 - DNA, 25 bp, Homo sapien
gctttgtcgctctctttgttagata

SEQ ID NO: 196775 - DNA, 25 bp, Homo sapien
gctgccaacgaaccagactcagtga

SEQ ID NO: 196776 - DNA, 25 bp, Homo sapien
agtgaccacgtcatgacagaacagc

SEQ ID NO: 196777 - DNA, 25 bp, Homo sapien
taaagggacgagtctgccttcctgg

SEQ ID NO: 196778 - DNA, 25 bp, Homo sapien
ttcctggctgtgacacgggacccct

SEQ ID NO: 196779 - DNA, 25 bp, Homo sapien
tgtgacacgggaccccttttctaca

SEQ ID NO: 196780 - DNA, 25 bp, Homo sapien
cttttctacagacctcatcactgga

SEQ ID NO: 196781 - DNA, 25 bp, Homo sapien
cagacctcatcactggatttgccaa

SEQ ID NO: 196782 - DNA, 25 bp, Homo sapien
ggatttgccaactagaattcgattt

SEQ ID NO: 196783 - DNA, 25 bp, Homo sapien
ctagaattcgatttcctgtcatagg

SEQ ID NO: 196784 - DNA, 25 bp, Homo sapien
gtcataggaagctccttggaagaag

SEQ ID NO: 196785 - DNA, 25 bp, Homo sapien
gaaatcatgtttacagacctgtttt

SEQ ID NO: 196786 - DNA, 25 bp, Homo sapien
ccaggttcttcagtctgccaaggaa

SEQ ID NO: 196787 - DNA, 25 bp, Homo sapien
aaggctgtggattcaaggctccctg

SEQ ID NO: 196788 - DNA, 25 bp, Homo sapien
accatttccccaatcctggcaaaag

SEQ ID NO: 196789 - DNA, 25 bp, Homo sapien
aaagatcccagggtcaggagagacc

SEQ ID NO: 196790 - DNA, 25 bp, Homo sapien
aggagagacccctctgtatccccag

SEQ ID NO: 196791 - DNA, 25 bp, Homo sapien
tcctaaggtctccagccagggcttc

SEQ ID NO: 196792 - DNA, 25 bp, Homo sapien
gcttctgagatgcaaaggtttggcc

SEQ ID NO: 196793 - DNA, 25 bp, Homo sapien
tcaggagagtcaccttttctcacgg

SEQ ID NO: 196794 - DNA, 25 bp, Homo sapien
acggccctggccttaactcatatct

SEQ ID NO: 196795 - DNA, 25 bp, Homo sapien
taactcatatcttaggcattcctgg

SEQ ID NO: 196796 - DNA, 25 bp, Homo sapien
atcttaggcattcctggccccaggg

SEQ ID NO: 196797 - DNA, 25 bp, Homo sapien
atcaaggtcaagcttctgcgctccc

SEQ ID NO: 196798 - DNA, 25 bp, Homo sapien
cccttcctcagcgtttcaagatgga

SEQ ID NO: 196799 - DNA, 25 bp, Homo sapien
agatggacgtgcacattactccggg

SEQ ID NO: 196800 - DNA, 25 bp, Homo sapien
gacccatgcctcagagcatgcagtg

SEQ ID NO: 196801 - DNA, 25 bp, Homo sapien
gagcatgcagtgaacaagcaacttg

SEQ ID NO: 196802 - DNA, 25 bp, Homo sapien
tggagaacacccacctcttggaggt

SEQ ID NO: 196803 - DNA, 25 bp, Homo sapien
cctcttggaggttgtgaatcagtgc

SEQ ID NO: 196804 - DNA, 25 bp, Homo sapien
tcagcctgcatactggtatcctggt

SEQ ID NO: 196805 - DNA, 25 bp, Homo sapien
tcctgccagggctgttaccgttgtt

SEQ ID NO: 196806 - DNA, 25 bp, Homo sapien
gctgttaccgttgttttcttgaatc

SEQ ID NO: 196807 - DNA, 25 bp, Homo sapien
gttttcttgaatcactcacaatgag

SEQ ID NO: 196808 - DNA, 25 bp, Homo sapien
gaaggatctggaactggaacagtac

SEQ ID NO: 196809 - DNA, 25 bp, Homo sapien
caaaagaagttcttccaagtcttgg

SEQ ID NO: 196810 - DNA, 25 bp, Homo sapien
gtcttggaaacaaatcgagcttgat

SEQ ID NO: 196811 - DNA, 25 bp, Homo sapien
aaatcgagcttgattcttgaaccta

SEQ ID NO: 196812 - DNA, 25 bp, Homo sapien
gagcttgattcttgaacctatttca

SEQ ID NO: 196813 - DNA, 25 bp, Homo sapien
tactgtgaattaactattgtggcaa

SEQ ID NO: 196814 - DNA, 25 bp, Homo sapien
tgttaaaggacaagctggatttctt

SEQ ID NO: 196815 - DNA, 25 bp, Homo sapien
agctggatttcttggactagtgcat

SEQ ID NO: 196816 - DNA, 25 bp, Homo sapien
atttcttggactagtgcatctccct

SEQ ID NO: 196817 - DNA, 25 bp, Homo sapien
gactagtgcatctccctgtatatct

SEQ ID NO: 196818 - DNA, 25 bp, Homo sapien
aaattattgtagaaccacgtgtaat

SEQ ID NO: 196819 - DNA, 25 bp, Homo sapien
gctagacctgagcagttctaccctc

SEQ ID NO: 196820 - DNA, 25 bp, Homo sapien
tgagcagttctaccctcccaaggca

SEQ ID NO: 196821 - DNA, 25 bp, Homo sapien
caaggcaccagtactctaccatggg

SEQ ID NO: 196822 - DNA, 25 bp, Homo sapien
cagtactctaccatggggcatccca

SEQ ID NO: 196823 - DNA, 25 bp, Homo sapien
gggcatcccaagtggggtcctcacc

SEQ ID NO: 196824 - DNA, 25 bp, Homo sapien
tcccagctactgcagctctgtatta

SEQ ID NO: 196825 - DNA, 25 bp, Homo sapien
ccagctactgcagctctgtattact

SEQ ID NO: 196826 - DNA, 25 bp, Homo sapien
cagctactgcagctctgtattactt

SEQ ID NO: 196827 - DNA, 25 bp, Homo sapien
agctactgcagctctgtattacttt

SEQ ID NO: 196828 - DNA, 25 bp, Homo sapien
acaaaatgcccaaggcactcactgg

SEQ ID NO: 196829 - DNA, 25 bp, Homo sapien
caaaatgcccaaggcactcactggg

SEQ ID NO: 196830 - DNA, 25 bp, Homo sapien
aacttttttgttcgatatgcctctt

SEQ ID NO: 196831 - DNA, 25 bp, Homo sapien
tttttgttcgatatgcctctttcca

SEQ ID NO: 196832 - DNA, 25 bp, Homo sapien
gttcgatatgcctctttccacattt

SEQ ID NO: 196833 - DNA, 25 bp, Homo sapien
aattcagtggcatttggtactgaac

SEQ ID NO: 196834 - DNA, 25 bp, Homo sapien
gaacatccacagtgttgtgtaacca

SEQ ID NO: 196835 - DNA, 25 bp, Homo sapien
gtgttgtgtaaccattgcctctgtc

SEQ ID NO: 196836 - DNA, 25 bp, Homo sapien
taaccattgcctctgtctagttcca

SEQ ID NO: 196837 - DNA, 25 bp, Homo sapien
atcccaaaatgaaaccctgtagcca

SEQ ID NO: 196838 - DNA, 25 bp, Homo sapien
tgaaaccctgtagccattaaacaag

SEQ ID NO: 196839 - DNA, 25 bp, Homo sapien
gccattaaacaagagctccccgttt

SEQ ID NO: 196840 - DNA, 25 bp, Homo sapien
tgtccctagcaaccaccagtggact

SEQ ID NO: 196841 - DNA, 25 bp, Homo sapien
gctgcgggagctgtcccgccagtgg

SEQ ID NO: 196842 - DNA, 25 bp, Homo sapien
ctgcgggagctgtcccgccagtggc

SEQ ID NO: 196843 - DNA, 25 bp, Homo sapien
tgcgggagctgtcccgccagtggct

SEQ ID NO: 196844 - DNA, 25 bp, Homo sapien
gcgggagctgtcccgccagtggctg

SEQ ID NO: 196845 - DNA, 25 bp, Homo sapien
cgggagctgtcccgccagtggctgc

SEQ ID NO: 196846 - DNA, 25 bp, Homo sapien
gggagctgtcccgccagtggctgcg

SEQ ID NO: 196847 - DNA, 25 bp, Homo sapien
ggagctgtcccgccagtggctgcgg

SEQ ID NO: 196848 - DNA, 25 bp, Homo sapien
gagctgtcccgccagtggctgcggc

SEQ ID NO: 196849 - DNA, 25 bp, Homo sapien
agctgtcccgccagtggctgcggcc

SEQ ID NO: 196850 - DNA, 25 bp, Homo sapien
gctgtcccgccagtggctgcggcct

SEQ ID NO: 196851 - DNA, 25 bp, Homo sapien
ggatccgccgccgcacggatgtgcg

SEQ ID NO: 196852 - DNA, 25 bp, Homo sapien
tggttggccagtaggtgagtatccc

SEQ ID NO: 196853 - DNA, 25 bp, Homo sapien
ggccagtaggtgagtatccctgtgt

SEQ ID NO: 196854 - DNA, 25 bp, Homo sapien
agtaggtgagtatccctgtgtgtgt

SEQ ID NO: 196855 - DNA, 25 bp, Homo sapien
agtggcagctcagctgcccttcact

SEQ ID NO: 196856 - DNA, 25 bp, Homo sapien
tgctgccaaagtccctgtgctaatg

SEQ ID NO: 196857 - DNA, 25 bp, Homo sapien
tgccaaagtccctgtgctaatggga

SEQ ID NO: 196858 - DNA, 25 bp, Homo sapien
ctgtgctaatgggattacaaataca

SEQ ID NO: 196859 - DNA, 25 bp, Homo sapien
gaaaaatccataagtctgtgtgtgt

SEQ ID NO: 196860 - DNA, 25 bp, Homo sapien
aaatccataagtctgtgtgtgttaa

SEQ ID NO: 196861 - DNA, 25 bp, Homo sapien
gtgtgttaaacatgaggttctgcct

SEQ ID NO: 196862 - DNA, 25 bp, Homo sapien
ttaaacatgaggttctgcctctgtg

SEQ ID NO: 196863 - DNA, 25 bp, Homo sapien
caagttgcagtgtgctgttggcttc

SEQ ID NO: 196864 - DNA, 25 bp, Homo sapien
gcagtgtgctgttggcttcagcatt

SEQ ID NO: 196865 - DNA, 25 bp, Homo sapien
gttggcttcagcattgtagaaagat

SEQ ID NO: 196866 - DNA, 25 bp, Homo sapien
gaatcttctgacacacctggagcaa

SEQ ID NO: 196867 - DNA, 25 bp, Homo sapien
ggagcaactccagaacacagtcacg

SEQ ID NO: 196868 - DNA, 25 bp, Homo sapien
aactacttgcatgttatgctttcat

SEQ ID NO: 196869 - DNA, 25 bp, Homo sapien
catgttatgctttcatttgggtgga

SEQ ID NO: 196870 - DNA, 25 bp, Homo sapien
gctttcatttgggtggaatacttca

SEQ ID NO: 196871 - DNA, 25 bp, Homo sapien
atttgggtggaatacttcattggaa

SEQ ID NO: 196872 - DNA, 25 bp, Homo sapien
tttgccctatctgtttgcacaagtt

SEQ ID NO: 196873 - DNA, 25 bp, Homo sapien
gccctatctgtttgcacaagttgca

SEQ ID NO: 196874 - DNA, 25 bp, Homo sapien
taactatcattaattctctcttcat

SEQ ID NO: 196875 - DNA, 25 bp, Homo sapien
tatcattaattctctcttcatcttt

SEQ ID NO: 196876 - DNA, 25 bp, Homo sapien
ctttgagatgcttggccataacagg

SEQ ID NO: 196877 - DNA, 25 bp, Homo sapien
gatgcttggccataacagggtccat

SEQ ID NO: 196878 - DNA, 25 bp, Homo sapien
ggccataacagggtccatacacatc

SEQ ID NO: 196879 - DNA, 25 bp, Homo sapien
aacagggtccatacacatcttctgg

SEQ ID NO: 196880 - DNA, 25 bp, Homo sapien
agggtccatacacatcttctggttt

SEQ ID NO: 196881 - DNA, 25 bp, Homo sapien
catcttctggtttactatatacaaa

SEQ ID NO: 196882 - DNA, 25 bp, Homo sapien
gatgacaatttaaaagtcagcctaa

SEQ ID NO: 196883 - DNA, 25 bp, Homo sapien
gtatctatatacaaaaggctacctt

SEQ ID NO: 196884 - DNA, 25 bp, Homo sapien
aaggctaccttttctaaaatctgtg

SEQ ID NO: 196885 - DNA, 25 bp, Homo sapien
tagacacaggtcactgccaagcatc

SEQ ID NO: 196886 - DNA, 25 bp, Homo sapien
aagcatcagggccactcgggctcag

SEQ ID NO: 196887 - DNA, 25 bp, Homo sapien
actcgggctcagaggtcactcaggg

SEQ ID NO: 196888 - DNA, 25 bp, Homo sapien
aggtcactcagggtcaatactcagg

SEQ ID NO: 196889 - DNA, 25 bp, Homo sapien
gggtcaatactcagggtcagtgcag

SEQ ID NO: 196890 - DNA, 25 bp, Homo sapien
gtcagtgcaggttatgagatccttg

SEQ ID NO: 196891 - DNA, 25 bp, Homo sapien
tttgctactttggttgtggtcactc

SEQ ID NO: 196892 - DNA, 25 bp, Homo sapien
ctgcctccttcacggactcgaagtg

SEQ ID NO: 196893 - DNA, 25 bp, Homo sapien
cacggactcgaagtgaccttcctgg

SEQ ID NO: 196894 - DNA, 25 bp, Homo sapien
aggtgggcagctcagactccacatg

SEQ ID NO: 196895 - DNA, 25 bp, Homo sapien
ggcagctcagactccacatgctggt

SEQ ID NO: 196896 - DNA, 25 bp, Homo sapien
tgccctccaagtgcaaaaataacaa

SEQ ID NO: 196897 - DNA, 25 bp, Homo sapien
acaaatatgattattgaccatcggg

SEQ ID NO: 196898 - DNA, 25 bp, Homo sapien
accatcggggaattctcacacattg

SEQ ID NO: 196899 - DNA, 25 bp, Homo sapien
ttaagcaattgccagaaaccccctt

SEQ ID NO: 196900 - DNA, 25 bp, Homo sapien
gcgaaagttaatctagccatgtgat

SEQ ID NO: 196901 - DNA, 25 bp, Homo sapien
atctagccatgtgatttttcagaaa

SEQ ID NO: 196902 - DNA, 25 bp, Homo sapien
gaaaagtaagtggaacatgctgcca

SEQ ID NO: 196903 - DNA, 25 bp, Homo sapien
agtggaacatgctgccacttttcaa

SEQ ID NO: 196904 - DNA, 25 bp, Homo sapien
gccacttttcaattctgtcagtgct

SEQ ID NO: 196905 - DNA, 25 bp, Homo sapien
aattctgtcagtgcttccacatgga

SEQ ID NO: 196906 - DNA, 25 bp, Homo sapien
ctgtcagtgcttccacatggaaaca

SEQ ID NO: 196907 - DNA, 25 bp, Homo sapien
tttttgaccacaaatggccaccgtt

SEQ ID NO: 196908 - DNA, 25 bp, Homo sapien
accgtttgctgttgacctgaccatg

SEQ ID NO: 196909 - DNA, 25 bp, Homo sapien
catggaactttaccagcacctggaa

SEQ ID NO: 196910 - DNA, 25 bp, Homo sapien
gagtggtttgtgcagctctattacc

SEQ ID NO: 196911 - DNA, 25 bp, Homo sapien
tgcagctctattaccacgggaagga

SEQ ID NO: 196912 - DNA, 25 bp, Homo sapien
agaggttgccctgatgggctctgcc

SEQ ID NO: 196913 - DNA, 25 bp, Homo sapien
ctgcccgctggacatgttcttgaat

SEQ ID NO: 196914 - DNA, 25 bp, Homo sapien
gttcttgaatgccatgtcagtttat

SEQ ID NO: 196915 - DNA, 25 bp, Homo sapien
gtcagtttataccttaagcccagaa

SEQ ID NO: 196916 - DNA, 25 bp, Homo sapien
gaaaaataccatgcactctgctctc

SEQ ID NO: 196917 - DNA, 25 bp, Homo sapien
actctgctctcaaactcaggtgatg

SEQ ID NO: 196918 - DNA, 25 bp, Homo sapien
ggtctccgccggattctgagtcaga

SEQ ID NO: 196919 - DNA, 25 bp, Homo sapien
ctccgccggattctgagtcagagca

SEQ ID NO: 196920 - DNA, 25 bp, Homo sapien
ggattctgagtcagagcagctgctg

SEQ ID NO: 196921 - DNA, 25 bp, Homo sapien
tgctgctggagacggaacggctgct

SEQ ID NO: 196922 - DNA, 25 bp, Homo sapien
gctgctgggagaggcatcatcgaat

SEQ ID NO: 196923 - DNA, 25 bp, Homo sapien
gcatcatcgaattggagccaggcaa

SEQ ID NO: 196924 - DNA, 25 bp, Homo sapien
tcatcgaattggagccaggcaaaga

SEQ ID NO: 196925 - DNA, 25 bp, Homo sapien
gatccaggacctggtagcaaggaaa

SEQ ID NO: 196926 - DNA, 25 bp, Homo sapien
tagcaaggaaactggaggagactca

SEQ ID NO: 196927 - DNA, 25 bp, Homo sapien
agactcaggagcttctggcagaggt

SEQ ID NO: 196928 - DNA, 25 bp, Homo sapien
tcaggagcttctggcagaggttcag

SEQ ID NO: 196929 - DNA, 25 bp, Homo sapien
ttctagctgtgtgatgtagaccaaa

SEQ ID NO: 196930 - DNA, 25 bp, Homo sapien
gatgtagaccaaagtcgttgcccct

SEQ ID NO: 196931 - DNA, 25 bp, Homo sapien
gaaccagtcggaactgggttccagt

SEQ ID NO: 196932 - DNA, 25 bp, Homo sapien
gtgtgagcctgtgcaagtgacatga

SEQ ID NO: 196933 - DNA, 25 bp, Homo sapien
gcaagtgacatgacctctctaaacc

SEQ ID NO: 196934 - DNA, 25 bp, Homo sapien
gacatgacctctctaaaccttggtt

SEQ ID NO: 196935 - DNA, 25 bp, Homo sapien
agcggtgaaccggtggttgtctgcg

SEQ ID NO: 196936 - DNA, 25 bp, Homo sapien
atgataaagagcacgggcacggtct

SEQ ID NO: 196937 - DNA, 25 bp, Homo sapien
aagagcacgggcacggtctggttca

SEQ ID NO: 196938 - DNA, 25 bp, Homo sapien
gcacggtctggttcatttctgtatc

SEQ ID NO: 196939 - DNA, 25 bp, Homo sapien
tctggttcatttctgtatctacccc

SEQ ID NO: 196940 - DNA, 25 bp, Homo sapien
gtggaggactggatgaacttctaca

SEQ ID NO: 196941 - DNA, 25 bp, Homo sapien
gactggatgaacttctacatcaact

SEQ ID NO: 196942 - DNA, 25 bp, Homo sapien
acatcaactattacaggcagcaggt

SEQ ID NO: 196943 - DNA, 25 bp, Homo sapien
aagagcgagacaaggctctgcagga

SEQ ID NO: 196944 - DNA, 25 bp, Homo sapien
gcaggagcttcggcaagagctgaac

SEQ ID NO: 196945 - DNA, 25 bp, Homo sapien
agagctgaacactcttgccaaccct

SEQ ID NO: 196946 - DNA, 25 bp, Homo sapien
tcctggccaagtacagggacttcct

SEQ ID NO: 196947 - DNA, 25 bp, Homo sapien
ggacttcctgaagtctcatgagctc

SEQ ID NO: 196948 - DNA, 25 bp, Homo sapien
tgaagtctcatgagctcccgagtca

SEQ ID NO: 196949 - DNA, 25 bp, Homo sapien
tctgaccttcatgtccttaggctgt

SEQ ID NO: 196950 - DNA, 25 bp, Homo sapien
ttcatgtccttaggctgtgctcctg

SEQ ID NO: 196951 - DNA, 25 bp, Homo sapien
tcgtgcgccgcgagttccgcaaggc

SEQ ID NO: 196952 - DNA, 25 bp, Homo sapien
gcgagttccgcaaggcgctcaagag

SEQ ID NO: 196953 - DNA, 25 bp, Homo sapien
ttccgcaaggcgctcaagagcctgc

SEQ ID NO: 196954 - DNA, 25 bp, Homo sapien
aagagcctgctgtggcgcatcgcgt

SEQ ID NO: 196955 - DNA, 25 bp, Homo sapien
tggcgcatcgcgtctccttcgatca

SEQ ID NO: 196956 - DNA, 25 bp, Homo sapien
gtctccttcgatcaccagcatgcgc

SEQ ID NO: 196957 - DNA, 25 bp, Homo sapien
actaccaagccggagcacgaggatc

SEQ ID NO: 196958 - DNA, 25 bp, Homo sapien
taccaagccggagcacgaggatcag

SEQ ID NO: 196959 - DNA, 25 bp, Homo sapien
tctactacccacctggcgtcgtggt

SEQ ID NO: 196960 - DNA, 25 bp, Homo sapien
cacctggcgtcgtggtctacagcgg

SEQ ID NO: 196961 - DNA, 25 bp, Homo sapien
tctgcctactgacgcaggcctcagg

SEQ ID NO: 196962 - DNA, 25 bp, Homo sapien
atggaaaaagacacctgcaaggaag

SEQ ID NO: 196963 - DNA, 25 bp, Homo sapien
aagacacctgcaaggaagaagcgat

SEQ ID NO: 196964 - DNA, 25 bp, Homo sapien
acacctgcaaggaagaagcgattga

SEQ ID NO: 196965 - DNA, 25 bp, Homo sapien
ctggaagaggcgaaactggtacgtt

SEQ ID NO: 196966 - DNA, 25 bp, Homo sapien
aagaggcgaaactggtacgttgatg

SEQ ID NO: 196967 - DNA, 25 bp, Homo sapien
gaggcgaaactggtacgttgatgat

SEQ ID NO: 196968 - DNA, 25 bp, Homo sapien
ggcgaaactggtacgttgatgatcc

SEQ ID NO: 196969 - DNA, 25 bp, Homo sapien
gcgaaactggtacgttgatgatcct

SEQ ID NO: 196970 - DNA, 25 bp, Homo sapien
cgaaactggtacgttgatgatcctt

SEQ ID NO: 196971 - DNA, 25 bp, Homo sapien
gaaactggtacgttgatgatcctta

SEQ ID NO: 196972 - DNA, 25 bp, Homo sapien
aaactggtacgttgatgatccttat

SEQ ID NO: 196973 - DNA, 25 bp, Homo sapien
tcatggatccaaagcagatgaatgt

SEQ ID NO: 196974 - DNA, 25 bp, Homo sapien
catggatccaaagcagatgaatgtt

SEQ ID NO: 196975 - DNA, 25 bp, Homo sapien
atggatccaaagcagatgaatgttg

SEQ ID NO: 196976 - DNA, 25 bp, Homo sapien
tggatccaaagcagatgaatgttgc

SEQ ID NO: 196977 - DNA, 25 bp, Homo sapien
ggatccaaagcagatgaatgttgct

SEQ ID NO: 196978 - DNA, 25 bp, Homo sapien
gatccaaagcagatgaatgttgctg

SEQ ID NO: 196979 - DNA, 25 bp, Homo sapien
atccaaagcagatgaatgttgctgc

SEQ ID NO: 196980 - DNA, 25 bp, Homo sapien
tccaaagcagatgaatgttgctgct

SEQ ID NO: 196981 - DNA, 25 bp, Homo sapien
ggtcctattggctattttaccgcag

SEQ ID NO: 196982 - DNA, 25 bp, Homo sapien
ttggcatccgttccatgtatgtgaa

SEQ ID NO: 196983 - DNA, 25 bp, Homo sapien
gtatgtgaatcaaacgcagcgacga

SEQ ID NO: 196984 - DNA, 25 bp, Homo sapien
aaacgcagcgacgagcaactttatt

SEQ ID NO: 196985 - DNA, 25 bp, Homo sapien
tttatttgctggtgccgggattgtg

SEQ ID NO: 196986 - DNA, 25 bp, Homo sapien
tgccgggattgtggctgactccgat

SEQ ID NO: 196987 - DNA, 25 bp, Homo sapien
gctgactccgatgcgcaacaagaat

SEQ ID NO: 196988 - DNA, 25 bp, Homo sapien
aatttgaacccatgcggcaattgtt

SEQ ID NO: 196989 - DNA, 25 bp, Homo sapien
gaagcggccctgtattacattgcga

SEQ ID NO: 196990 - DNA, 25 bp, Homo sapien
cattgcgacccatgagaagacacct

SEQ ID NO: 196991 - DNA, 25 bp, Homo sapien
aagacacctcgtggcttgtttgcag

SEQ ID NO: 196992 - DNA, 25 bp, Homo sapien
attaaaacactagtttgttcacttg

SEQ ID NO: 196993 - DNA, 25 bp, Homo sapien
ttcaggtttctacaaatagggtaat

SEQ ID NO: 196994 - DNA, 25 bp, Homo sapien
tttaaagcattagcatttattggtg

SEQ ID NO: 196995 - DNA, 25 bp, Homo sapien
taaagcattagcatttattggtgaa

SEQ ID NO: 196996 - DNA, 25 bp, Homo sapien
aaagcattagcatttattggtgaat

SEQ ID NO: 196997 - DNA, 25 bp, Homo sapien
aagcattagcatttattggtgaata

SEQ ID NO: 196998 - DNA, 25 bp, Homo sapien
agcattagcatttattggtgaataa

SEQ ID NO: 196999 - DNA, 25 bp, Homo sapien
gcattagcatttattggtgaataat

SEQ ID NO: 197000 - DNA, 25 bp, Homo sapien
tattggtgaataatgtatatatccc

SEQ ID NO: 197001 - DNA, 25 bp, Homo sapien
atccccattccaagaaatataagtg

SEQ ID NO: 197002 - DNA, 25 bp, Homo sapien
tccccattccaagaaatataagtga

SEQ ID NO: 197003 - DNA, 25 bp, Homo sapien
catccacctcgctttaaaaataagc

SEQ ID NO: 197004 - DNA, 25 bp, Homo sapien
atccacctcgctttaaaaataagca

SEQ ID NO: 197005 - DNA, 25 bp, Homo sapien
tccacctcgctttaaaaataagcac

SEQ ID NO: 197006 - DNA, 25 bp, Homo sapien
ccacctcgctttaaaaataagcaca

SEQ ID NO: 197007 - DNA, 25 bp, Homo sapien
cacctcgctttaaaaataagcacat

SEQ ID NO: 197008 - DNA, 25 bp, Homo sapien
acctcgctttaaaaataagcacatg

SEQ ID NO: 197009 - DNA, 25 bp, Homo sapien
cctcgctttaaaaataagcacatga

SEQ ID NO: 197010 - DNA, 25 bp, Homo sapien
ctcgctttaaaaataagcacatgat

SEQ ID NO: 197011 - DNA, 25 bp, Homo sapien
aagcacatgatggctgggcaccgtg

SEQ ID NO: 197012 - DNA, 25 bp, Homo sapien
agcacatgatggctgggcaccgtgg

SEQ ID NO: 197013 - DNA, 25 bp, Homo sapien
tgagggcgggagtttgagacaacct

SEQ ID NO: 197014 - DNA, 25 bp, Homo sapien
cagatgttctatgcagtgtggttca

SEQ ID NO: 197015 - DNA, 25 bp, Homo sapien
ggttcaagtttctttgaccgcactt

SEQ ID NO: 197016 - DNA, 25 bp, Homo sapien
gaccgcacttatatgcattgctaat

SEQ ID NO: 197017 - DNA, 25 bp, Homo sapien
aagataccatacacagtctctcatg

SEQ ID NO: 197018 - DNA, 25 bp, Homo sapien
agtctctcatggacctatctctatt

SEQ ID NO: 197019 - DNA, 25 bp, Homo sapien
catggacctatctctattgtagaat

SEQ ID NO: 197020 - DNA, 25 bp, Homo sapien
caaatttttctgaatgtgacctttt

SEQ ID NO: 197021 - DNA, 25 bp, Homo sapien
tgtgacctttttttgctgatttgct

SEQ ID NO: 197022 - DNA, 25 bp, Homo sapien
ctgggtttgggattaactagcatta

SEQ ID NO: 197023 - DNA, 25 bp, Homo sapien
tagcattattttgccacctttatat

SEQ ID NO: 197024 - DNA, 25 bp, Homo sapien
tgttgtgctggtgtaatgtggattt

SEQ ID NO: 197025 - DNA, 25 bp, Homo sapien
ccagcttgcagatacatgcatttga

SEQ ID NO: 197026 - DNA, 25 bp, Homo sapien
tgcatttgaattttagtagtctgtc

SEQ ID NO: 197027 - DNA, 25 bp, Homo sapien
gtagtctgtcatatttaaaatccca

SEQ ID NO: 197028 - DNA, 25 bp, Homo sapien
taaaatcccacatatgtgagttaaa

SEQ ID NO: 197029 - DNA, 25 bp, Homo sapien
aaagaatacgccttgctgattagcc

SEQ ID NO: 197030 - DNA, 25 bp, Homo sapien
gaatacgccttgctgattagccaca

SEQ ID NO: 197031 - DNA, 25 bp, Homo sapien
attagccacacccaggcaatttaat

SEQ ID NO: 197032 - DNA, 25 bp, Homo sapien
aggcaatttaatatccatggtcttc

SEQ ID NO: 197033 - DNA, 25 bp, Homo sapien
atatccatggtcttctataatgttt

SEQ ID NO: 197034 - DNA, 25 bp, Homo sapien
ggtcttctataatgtttataccaca

SEQ ID NO: 197035 - DNA, 25 bp, Homo sapien
tataccacattgtaaatattcagag

SEQ ID NO: 197036 - DNA, 25 bp, Homo sapien
aagatccagctctgtatacttcctg

SEQ ID NO: 197037 - DNA, 25 bp, Homo sapien
agcctgttaatgctttcaacgtgtg

SEQ ID NO: 197038 - DNA, 25 bp, Homo sapien
tcaacgtgtggaaaacccagcgggc

SEQ ID NO: 197039 - DNA, 25 bp, Homo sapien
acccagcgggcctttagcaaatatg

SEQ ID NO: 197040 - DNA, 25 bp, Homo sapien
cagtgttggtcagcaacagccagtt

SEQ ID NO: 197041 - DNA, 25 bp, Homo sapien
agccagttcttagtaaaaccacttg

SEQ ID NO: 197042 - DNA, 25 bp, Homo sapien
aggcatggaatatgtttgcttcaaa

SEQ ID NO: 197043 - DNA, 25 bp, Homo sapien
gcttcaaaagcctacattcatcagt

SEQ ID NO: 197044 - DNA, 25 bp, Homo sapien
gaggactttttagacagtttcacgt

SEQ ID NO: 197045 - DNA, 25 bp, Homo sapien
cagtttcacgtcattagagcaggtt

SEQ ID NO: 197046 - DNA, 25 bp, Homo sapien
gagcaggttgttgccagttactgta

SEQ ID NO: 197047 - DNA, 25 bp, Homo sapien
acacagtcactgaagcaggccctgt

SEQ ID NO: 197048 - DNA, 25 bp, Homo sapien
cagtcactgaagcaggccctgtttg

SEQ ID NO: 197049 - DNA, 25 bp, Homo sapien
gtcactgaagcaggccctgtttgca

SEQ ID NO: 197050 - DNA, 25 bp, Homo sapien
gaagcaggccctgtttgcaattcac

SEQ ID NO: 197051 - DNA, 25 bp, Homo sapien
agcaggccctgtttgcaattcacgt

SEQ ID NO: 197052 - DNA, 25 bp, Homo sapien
caggccctgtttgcaattcacgttg

SEQ ID NO: 197053 - DNA, 25 bp, Homo sapien
gccctgtttgcaattcacgttgcca

SEQ ID NO: 197054 - DNA, 25 bp, Homo sapien
tgtttgcaattcacgttgccacctc

SEQ ID NO: 197055 - DNA, 25 bp, Homo sapien
ttgcaattcacgttgccacctccaa

SEQ ID NO: 197056 - DNA, 25 bp, Homo sapien
ttcacgttgccacctccaacttaaa

SEQ ID NO: 197057 - DNA, 25 bp, Homo sapien
tgccacctccaacttaaacattctt

SEQ ID NO: 197058 - DNA, 25 bp, Homo sapien
gtggggatccaccaggtcatctagc

SEQ ID NO: 197059 - DNA, 25 bp, Homo sapien
tggggatccaccaggtcatctagct

SEQ ID NO: 197060 - DNA, 25 bp, Homo sapien
gggatccaccaggtcatctagctct

SEQ ID NO: 197061 - DNA, 25 bp, Homo sapien
ggatccaccaggtcatctagctctg

SEQ ID NO: 197062 - DNA, 25 bp, Homo sapien
gatccaccaggtcatctagctctgg

SEQ ID NO: 197063 - DNA, 25 bp, Homo sapien
atccaccaggtcatctagctctggc

SEQ ID NO: 197064 - DNA, 25 bp, Homo sapien
tccaccaggtcatctagctctggcc

SEQ ID NO: 197065 - DNA, 25 bp, Homo sapien
accaggtcatctagctctggcccta

SEQ ID NO: 197066 - DNA, 25 bp, Homo sapien
ccaggtcatctagctctggccctag

SEQ ID NO: 197067 - DNA, 25 bp, Homo sapien
caggtcatctagctctggccctagt

SEQ ID NO: 197068 - DNA, 25 bp, Homo sapien
aggtcatctagctctggccctagtt

SEQ ID NO: 197069 - DNA, 25 bp, Homo sapien
cagggctgtagcctgcagcttagaa

SEQ ID NO: 197070 - DNA, 25 bp, Homo sapien
tgcagcttagaagtgcactgctggt

SEQ ID NO: 197071 - DNA, 25 bp, Homo sapien
actgctggtggctatgctcgtcact

SEQ ID NO: 197072 - DNA, 25 bp, Homo sapien
ggctatgctcgtcacttgaacaagg

SEQ ID NO: 197073 - DNA, 25 bp, Homo sapien
gaaggagactacactctctgcagtc

SEQ ID NO: 197074 - DNA, 25 bp, Homo sapien
aatgcacgggcttgtgtaggttcct

SEQ ID NO: 197075 - DNA, 25 bp, Homo sapien
aggttcctccacagggttgtttcag

SEQ ID NO: 197076 - DNA, 25 bp, Homo sapien
tttggaagcccttcaggtcttacac

SEQ ID NO: 197077 - DNA, 25 bp, Homo sapien
tcaggtcttacactgcacccaaaat

SEQ ID NO: 197078 - DNA, 25 bp, Homo sapien
caaccccaagtgaccacagcagtgg

SEQ ID NO: 197079 - DNA, 25 bp, Homo sapien
agtgggctacaaacagggtcccagt

SEQ ID NO: 197080 - DNA, 25 bp, Homo sapien
tgtaaccattgaaccaccaaaccct

SEQ ID NO: 197081 - DNA, 25 bp, Homo sapien
cctatcaatcccagcactaactgta

SEQ ID NO: 197082 - DNA, 25 bp, Homo sapien
gcactaactgtaatggcttgaaaga

SEQ ID NO: 197083 - DNA, 25 bp, Homo sapien
atccacattgcggaggttctgtaac

SEQ ID NO: 197084 - DNA, 25 bp, Homo sapien
gaggttctgtaacaatgccacccat

SEQ ID NO: 197085 - DNA, 25 bp, Homo sapien
gccacccatcaatctaactaacagt

SEQ ID NO: 197086 - DNA, 25 bp, Homo sapien
actaacagtaatttgatggctgcaa

SEQ ID NO: 197087 - DNA, 25 bp, Homo sapien
gatggctgcaaatctcagttcaaat

SEQ ID NO: 197088 - DNA, 25 bp, Homo sapien
agttcaaatctctttcaccccagtg

SEQ ID NO: 197089 - DNA, 25 bp, Homo sapien
accccagtgtgaggtgagctgtaac

SEQ ID NO: 197090 - DNA, 25 bp, Homo sapien
gaatcgtgttcatagtgtctgtatg

SEQ ID NO: 197091 - DNA, 25 bp, Homo sapien
ctgacccttggacaacatttatcat

SEQ ID NO: 197092 - DNA, 25 bp, Homo sapien
tgagtggccttgaggacgaaccccg

SEQ ID NO: 197093 - DNA, 25 bp, Homo sapien
aaccccgcagggagcaagcagtaca

SEQ ID NO: 197094 - DNA, 25 bp, Homo sapien
aagcagtacagtggcattcccaggg

SEQ ID NO: 197095 - DNA, 25 bp, Homo sapien
gaaccatgcatgaacagtatcagtc

SEQ ID NO: 197096 - DNA, 25 bp, Homo sapien
aacagtatcagtcgtctgggctcat

SEQ ID NO: 197097 - DNA, 25 bp, Homo sapien
gtatcagtcgtctgggctcatgctg

SEQ ID NO: 197098 - DNA, 25 bp, Homo sapien
gctcatgctgggattgtgcagtgct

SEQ ID NO: 197099 - DNA, 25 bp, Homo sapien
gattgtgcagtgctcctgttgcaac

SEQ ID NO: 197100 - DNA, 25 bp, Homo sapien
ggagtgagggctacacccaattcca

SEQ ID NO: 197101 - DNA, 25 bp, Homo sapien
tacacccaattccaaaagcctgaga

SEQ ID NO: 197102 - DNA, 25 bp, Homo sapien
taatgcaccagctgtcgacctagac

SEQ ID NO: 197103 - DNA, 25 bp, Homo sapien
accagctgtcgacctagaccataag

SEQ ID NO: 197104 - DNA, 25 bp, Homo sapien
gctgtcgacctagaccataagttta

SEQ ID NO: 197105 - DNA, 25 bp, Homo sapien
gacctagaccataagtttagatgca

SEQ ID NO: 197106 - DNA, 25 bp, Homo sapien
atttttccgcaaagccaaactgttg

SEQ ID NO: 197107 - DNA, 25 bp, Homo sapien
agccaaactgttgcactatcacatg

SEQ ID NO: 197108 - DNA, 25 bp, Homo sapien
aactgttgcactatcacatgaagta

SEQ ID NO: 197109 - DNA, 25 bp, Homo sapien
agcccgggaaagaggcatgtccaaa

SEQ ID NO: 197110 - DNA, 25 bp, Homo sapien
ggaaagaggcatgtccaaaccaggg

SEQ ID NO: 197111 - DNA, 25 bp, Homo sapien
accaggaagcgggtctctgccagtt

SEQ ID NO: 197112 - DNA, 25 bp, Homo sapien
aggaagcgggtctctgccagttccc

SEQ ID NO: 197113 - DNA, 25 bp, Homo sapien
gccttgcgggaagacctcatgggac

SEQ ID NO: 197114 - DNA, 25 bp, Homo sapien
agacctcatgggacgcaaggactcc

SEQ ID NO: 197115 - DNA, 25 bp, Homo sapien
ggcccctggtcctggaggcacagaa

SEQ ID NO: 197116 - DNA, 25 bp, Homo sapien
atcctcgacccacacgactatgtga

SEQ ID NO: 197117 - DNA, 25 bp, Homo sapien
gactatgtgacctctttataactgg

SEQ ID NO: 197118 - DNA, 25 bp, Homo sapien
gaagacttcgatgatgatgtgtgat

SEQ ID NO: 197119 - DNA, 25 bp, Homo sapien
cgatgatgatgtgtgatctgggact

SEQ ID NO: 197120 - DNA, 25 bp, Homo sapien
gggactggcaggttattaatcgaga

SEQ ID NO: 197121 - DNA, 25 bp, Homo sapien
tcgagatacacttgttaggagggac

SEQ ID NO: 197122 - DNA, 25 bp, Homo sapien
ggcacttttaaagatactctgtaag

SEQ ID NO: 197123 - DNA, 25 bp, Homo sapien
gatactctgtaagaaccattaacaa

SEQ ID NO: 197124 - DNA, 25 bp, Homo sapien
ctgtgcctggccgacaatttacttg

SEQ ID NO: 197125 - DNA, 25 bp, Homo sapien
tgtgcctggccgacaatttacttgt

SEQ ID NO: 197126 - DNA, 25 bp, Homo sapien
gcctggccgacaatttacttgtctt

SEQ ID NO: 197127 - DNA, 25 bp, Homo sapien
tggccgacaatttacttgtcttagt

SEQ ID NO: 197128 - DNA, 25 bp, Homo sapien
gccgacaatttacttgtcttagtat

SEQ ID NO: 197129 - DNA, 25 bp, Homo sapien
acttgtcttagtattatatgtagat

SEQ ID NO: 197130 - DNA, 25 bp, Homo sapien
tatgtgattttttgagactgtattt

SEQ ID NO: 197131 - DNA, 25 bp, Homo sapien
gagactgtatttttagagctgaatt

SEQ ID NO: 197132 - DNA, 25 bp, Homo sapien
agctgaatttttgactaaagactta

SEQ ID NO: 197133 - DNA, 25 bp, Homo sapien
gatacattagagaattttagttaga

SEQ ID NO: 197134 - DNA, 25 bp, Homo sapien
tttgtatgtttcagatgcaaacata

SEQ ID NO: 197135 - DNA, 25 bp, Homo sapien
cctctttgcctaacaatctcggaag

SEQ ID NO: 197136 - DNA, 25 bp, Homo sapien
caatctcggaaggaaaatatatcac

SEQ ID NO: 197137 - DNA, 25 bp, Homo sapien
tttgtgccttttcttaggtataata

SEQ ID NO: 197138 - DNA, 25 bp, Homo sapien
aatgttttcttaactgactttcagt

SEQ ID NO: 197139 - DNA, 25 bp, Homo sapien
gactttcagtcacctttacaattaa

SEQ ID NO: 197140 - DNA, 25 bp, Homo sapien
aactaaatattgtgcaaccgctttg

SEQ ID NO: 197141 - DNA, 25 bp, Homo sapien
aatattgtgcaaccgctttgtaaat

SEQ ID NO: 197142 - DNA, 25 bp, Homo sapien
gcaaccgctttgtaaattaatatga

SEQ ID NO: 197143 - DNA, 25 bp, Homo sapien
taggaatgactattactgccatatt

SEQ ID NO: 197144 - DNA, 25 bp, Homo sapien
attactgccatatttatttagttga

SEQ ID NO: 197145 - DNA, 25 bp, Homo sapien
gtctttgtgttaattcattcatatt

SEQ ID NO: 197146 - DNA, 25 bp, Homo sapien
tcctcatgtaattgccatctgtcac

SEQ ID NO: 197147 - DNA, 25 bp, Homo sapien
atctgtcactcactatattcacaaa

SEQ ID NO: 197148 - DNA, 25 bp, Homo sapien
actcattctaacattgcttacttaa

SEQ ID NO: 197149 - DNA, 25 bp, Homo sapien
tacatagccctatcgaaatgcgagg

SEQ ID NO: 197150 - DNA, 25 bp, Homo sapien
aatgctttaatgcttttagagacag

SEQ ID NO: 197151 - DNA, 25 bp, Homo sapien
aaactccaccaaatgtacttcttat

SEQ ID NO: 197152 - DNA, 25 bp, Homo sapien
taggctttgcttagtatcatgtcca

SEQ ID NO: 197153 - DNA, 25 bp, Homo sapien
agtatcatgtccatgtttccttcac

SEQ ID NO: 197154 - DNA, 25 bp, Homo sapien
atgtttccttcacctcagtggagct

SEQ ID NO: 197155 - DNA, 25 bp, Homo sapien
cagtggagcttctgagttttatact

SEQ ID NO: 197156 - DNA, 25 bp, Homo sapien
gttttatactgctcaagatcgtcat

SEQ ID NO: 197157 - DNA, 25 bp, Homo sapien
ataattctctcaaaatactaaacag

SEQ ID NO: 197158 - DNA, 25 bp, Homo sapien
cagaggtggttttattgataagatt

SEQ ID NO: 197159 - DNA, 25 bp, Homo sapien
gattttggctgtttggttttccact

SEQ ID NO: 197160 - DNA, 25 bp, Homo sapien
ttggctgtttggttttccactattc

SEQ ID NO: 197161 - DNA, 25 bp, Homo sapien
ggctgtttggttttccactattctc

SEQ ID NO: 197162 - DNA, 25 bp, Homo sapien
tttggttttccactattctctattg

SEQ ID NO: 197163 - DNA, 25 bp, Homo sapien
ggttttccactattctctattggct

SEQ ID NO: 197164 - DNA, 25 bp, Homo sapien
tccactattctctattggctaaaat

SEQ ID NO: 197165 - DNA, 25 bp, Homo sapien
aaatgatatgagtttctccctgcca

SEQ ID NO: 197166 - DNA, 25 bp, Homo sapien
atgatatgagtttctccctgccaag

SEQ ID NO: 197167 - DNA, 25 bp, Homo sapien
atatgagtttctccctgccaaggca

SEQ ID NO: 197168 - DNA, 25 bp, Homo sapien
ttgttgaccacctcttggctagcct

SEQ ID NO: 197169 - DNA, 25 bp, Homo sapien
agacacctgcgggaggccggccatg

SEQ ID NO: 197170 - DNA, 25 bp, Homo sapien
ggccatgaagccgaagccgggtctc

SEQ ID NO: 197171 - DNA, 25 bp, Homo sapien
gccgaagccgggtctctccttctgg

SEQ ID NO: 197172 - DNA, 25 bp, Homo sapien
agggggactcaccaggccttcagaa

SEQ ID NO: 197173 - DNA, 25 bp, Homo sapien
ggtgttgaagccacctgtggccctg

SEQ ID NO: 197174 - DNA, 25 bp, Homo sapien
ccttagcagaaaaagcatctggagt

SEQ ID NO: 197175 - DNA, 25 bp, Homo sapien
catctggagttgaatgctgttccca

SEQ ID NO: 197176 - DNA, 25 bp, Homo sapien
aagcaacatgtgtatctgccgattg

SEQ ID NO: 197177 - DNA, 25 bp, Homo sapien
cgattgttctccatggttccaacaa

SEQ ID NO: 197178 - DNA, 25 bp, Homo sapien
tccatggttccaacaaattgcaaat

SEQ ID NO: 197179 - DNA, 25 bp, Homo sapien
acagctttttacttggctttgcaga

SEQ ID NO: 197180 - DNA, 25 bp, Homo sapien
ctttgcagaggctaatggatgagaa

SEQ ID NO: 197181 - DNA, 25 bp, Homo sapien
ggagccagtgttacagcattctcag

SEQ ID NO: 197182 - DNA, 25 bp, Homo sapien
gcattctcagtatttgaggctacgg

SEQ ID NO: 197183 - DNA, 25 bp, Homo sapien
tgaggctacggcagcggatctgtaa

SEQ ID NO: 197184 - DNA, 25 bp, Homo sapien
gatctgtaagagctccatcctccag

SEQ ID NO: 197185 - DNA, 25 bp, Homo sapien
agtggcctgacaacccgaaggcaga

SEQ ID NO: 197186 - DNA, 25 bp, Homo sapien
acaacccgaaggcagaaggcttgtt

SEQ ID NO: 197187 - DNA, 25 bp, Homo sapien
gaaggcttgttttggcaaactctga

SEQ ID NO: 197188 - DNA, 25 bp, Homo sapien
tctgagaaatgtggtcttgactgaa

SEQ ID NO: 197189 - DNA, 25 bp, Homo sapien
atgtatgtcgattccattaagcaat

SEQ ID NO: 197190 - DNA, 25 bp, Homo sapien
gacacctttgactcttctactgtct

SEQ ID NO: 197191 - DNA, 25 bp, Homo sapien
tttgactcttctactgtctcagacc

SEQ ID NO: 197192 - DNA, 25 bp, Homo sapien
tcttctactgtctcagaccttaggt

SEQ ID NO: 197193 - DNA, 25 bp, Homo sapien
tctcagaccttaggtaacatacctg

SEQ ID NO: 197194 - DNA, 25 bp, Homo sapien
gcttttctaacaaactgttgatcag

SEQ ID NO: 197195 - DNA, 25 bp, Homo sapien
aaaggggctacagaaacactcattt

SEQ ID NO: 197196 - DNA, 25 bp, Homo sapien
tccctcttgggcttcatgcaaagac

SEQ ID NO: 197197 - DNA, 25 bp, Homo sapien
gggcttcatgcaaagacaattctgt

SEQ ID NO: 197198 - DNA, 25 bp, Homo sapien
gtaaatgtacagttgactctgattt

SEQ ID NO: 197199 - DNA, 25 bp, Homo sapien
gaaaatcagtccatccttgttataa

SEQ ID NO: 197200 - DNA, 25 bp, Homo sapien
tcagtccatccttgttataaaaaat

SEQ ID NO: 197201 - DNA, 25 bp, Homo sapien
tgagcgacatgtgcagaacggcccc

SEQ ID NO: 197202 - DNA, 25 bp, Homo sapien
gaacggccccttggctgcagttagg

SEQ ID NO: 197203 - DNA, 25 bp, Homo sapien
cttggctgcagttaggacctcagtg

SEQ ID NO: 197204 - DNA, 25 bp, Homo sapien
cagttaggacctcagtggctggtat

SEQ ID NO: 197205 - DNA, 25 bp, Homo sapien
gctggtatggccaagctgctagaag

SEQ ID NO: 197206 - DNA, 25 bp, Homo sapien
gtgacccctgacctttgtcaggaag

SEQ ID NO: 197207 - DNA, 25 bp, Homo sapien
cttctcaatctaaatgcctttcagg

SEQ ID NO: 197208 - DNA, 25 bp, Homo sapien
atgagatgctgctggcaggccactc

SEQ ID NO: 197209 - DNA, 25 bp, Homo sapien
tgctggcaggccactcagaggctcc

SEQ ID NO: 197210 - DNA, 25 bp, Homo sapien
gacagccaggccagatgacctgatt

SEQ ID NO: 197211 - DNA, 25 bp, Homo sapien
caggccagatgacctgattccagca

SEQ ID NO: 197212 - DNA, 25 bp, Homo sapien
aaatatttctgcagtaccaaccata

SEQ ID NO: 197213 - DNA, 25 bp, Homo sapien
aatatttctgcagtaccaaccatat

SEQ ID NO: 197214 - DNA, 25 bp, Homo sapien
atatttctgcagtaccaaccatata

SEQ ID NO: 197215 - DNA, 25 bp, Homo sapien
tatttctgcagtaccaaccatatat

SEQ ID NO: 197216 - DNA, 25 bp, Homo sapien
atttctgcagtaccaaccatatatc

SEQ ID NO: 197217 - DNA, 25 bp, Homo sapien
tttctgcagtaccaaccatatatct

SEQ ID NO: 197218 - DNA, 25 bp, Homo sapien
ttctgcagtaccaaccatatatctg

SEQ ID NO: 197219 - DNA, 25 bp, Homo sapien
tctgcagtaccaaccatatatctgg

SEQ ID NO: 197220 - DNA, 25 bp, Homo sapien
ctgcagtaccaaccatatatctggt

SEQ ID NO: 197221 - DNA, 25 bp, Homo sapien
ctggtactgtgcaaagggaaaaagg

SEQ ID NO: 197222 - DNA, 25 bp, Homo sapien
aaggaaatgggctgggaatggtggt

SEQ ID NO: 197223 - DNA, 25 bp, Homo sapien
tcaataggtccaatctgctctcaag

SEQ ID NO: 197224 - DNA, 25 bp, Homo sapien
tctcaaggccttggtcctggtggga

SEQ ID NO: 197225 - DNA, 25 bp, Homo sapien
cttggtcctggtgggattccttcac

SEQ ID NO: 197226 - DNA, 25 bp, Homo sapien
ggctgcaactgtaagaacccttgtc

SEQ ID NO: 197227 - DNA, 25 bp, Homo sapien
gtctgatatatttgcaactatgctc

SEQ ID NO: 197228 - DNA, 25 bp, Homo sapien
tgcaactatgctcccatttacaaat

SEQ ID NO: 197229 - DNA, 25 bp, Homo sapien
acaaatgtaccttctaatgctcagt

SEQ ID NO: 197230 - DNA, 25 bp, Homo sapien
taatgctcagttgccaggttccaat

SEQ ID NO: 197231 - DNA, 25 bp, Homo sapien
ccaggttccaatgcaaaggtggcgt

SEQ ID NO: 197232 - DNA, 25 bp, Homo sapien
aaggtggcgtggactccctttgtgt

SEQ ID NO: 197233 - DNA, 25 bp, Homo sapien
gaaaaatgccttcaagtgtactaat

SEQ ID NO: 197234 - DNA, 25 bp, Homo sapien
ctgctctcatactgctcagtgacat

SEQ ID NO: 197235 - DNA, 25 bp, Homo sapien
atactgctcagtgacatggcccagg

SEQ ID NO: 197236 - DNA, 25 bp, Homo sapien
gctcagtgacatggcccaggctttc

SEQ ID NO: 197237 - DNA, 25 bp, Homo sapien
aggctttccttccagggccatgctt

SEQ ID NO: 197238 - DNA, 25 bp, Homo sapien
tctctgcacccttggcacgagggca

SEQ ID NO: 197239 - DNA, 25 bp, Homo sapien
ggctggctctcccaatgcctccatc

SEQ ID NO: 197240 - DNA, 25 bp, Homo sapien
tggtgctttggcctcctcaaagcat

SEQ ID NO: 197241 - DNA, 25 bp, Homo sapien
tcctcaaagcatccaccatggtgga

SEQ ID NO: 197242 - DNA, 25 bp, Homo sapien
tccaccatggtggatggactgaagt

SEQ ID NO: 197243 - DNA, 25 bp, Homo sapien
ccaccatggtggatggactgaagtg

SEQ ID NO: 197244 - DNA, 25 bp, Homo sapien
gtatattttcttgatctatttttta

SEQ ID NO: 197245 - DNA, 25 bp, Homo sapien
accctgagcggcatgtcggcgtcag

SEQ ID NO: 197246 - DNA, 25 bp, Homo sapien
catgtcggcgtcagatgagctggac

SEQ ID NO: 197247 - DNA, 25 bp, Homo sapien
gatgagctggacgactcacaggtgc

SEQ ID NO: 197248 - DNA, 25 bp, Homo sapien
acgactcacaggtgcgtcagatgct

SEQ ID NO: 197249 - DNA, 25 bp, Homo sapien
gtcagatgctgttcgacctggagtc

SEQ ID NO: 197250 - DNA, 25 bp, Homo sapien
tgttcgacctggagtcagcctacaa

SEQ ID NO: 197251 - DNA, 25 bp, Homo sapien
tggagtcagcctacaacgccttcaa

SEQ ID NO: 197252 - DNA, 25 bp, Homo sapien
gggcactagcccttgcacagaaggg

SEQ ID NO: 197253 - DNA, 25 bp, Homo sapien
tgtccgccacacaggccgtggtcat

SEQ ID NO: 197254 - DNA, 25 bp, Homo sapien
gtggtcatccacacaactcactgtc

SEQ ID NO: 197255 - DNA, 25 bp, Homo sapien
tctggtgtctgtctttggtgtcaga

SEQ ID NO: 197256 - DNA, 25 bp, Homo sapien
aaaagcttgacgaacttcacagaag

SEQ ID NO: 197257 - DNA, 25 bp, Homo sapien
aaaagctctaggtcagaagtactac

SEQ ID NO: 197258 - DNA, 25 bp, Homo sapien
gtcagaagtactacacagtgctttt

SEQ ID NO: 197259 - DNA, 25 bp, Homo sapien
gagagtttacagacagaagcccgaa

SEQ ID NO: 197260 - DNA, 25 bp, Homo sapien
gaagcccgaagtggaaagaccttat

SEQ ID NO: 197261 - DNA, 25 bp, Homo sapien
gtggaaagaccttatggttttgtag

SEQ ID NO: 197262 - DNA, 25 bp, Homo sapien
ggttttgtagatatggtgactccag

SEQ ID NO: 197263 - DNA, 25 bp, Homo sapien
agctgataaggtttttgtacagtat

SEQ ID NO: 197264 - DNA, 25 bp, Homo sapien
cagtattttctccttcgttgtattg

SEQ ID NO: 197265 - DNA, 25 bp, Homo sapien
ctccttcgttgtattgatttttgta

SEQ ID NO: 197266 - DNA, 25 bp, Homo sapien
aatgtaacttctacgtgtctaacac

SEQ ID NO: 197267 - DNA, 25 bp, Homo sapien
gtttgatgttgacagtaaggaccca

SEQ ID NO: 197268 - DNA, 25 bp, Homo sapien
gttgacagtaaggacccaacactgg

SEQ ID NO: 197269 - DNA, 25 bp, Homo sapien
acactgggaatgagttgtccgcccc

SEQ ID NO: 197270 - DNA, 25 bp, Homo sapien
ccccagcatttgtggagcaatcttt

SEQ ID NO: 197271 - DNA, 25 bp, Homo sapien
ggttaaaagcatcttgactcctgaa

SEQ ID NO: 197272 - DNA, 25 bp, Homo sapien
aagcatcttgactcctgaaggtgtt

SEQ ID NO: 197273 - DNA, 25 bp, Homo sapien
gactcctgaaggtgtttttattctc

SEQ ID NO: 197274 - DNA, 25 bp, Homo sapien
ttttattctcaaccttgtgtgccga

SEQ ID NO: 197275 - DNA, 25 bp, Homo sapien
tcaaccttgtgtgccgagacttggg

SEQ ID NO: 197276 - DNA, 25 bp, Homo sapien
gggctaaaagactcagtgctggctg

SEQ ID NO: 197277 - DNA, 25 bp, Homo sapien
aaagactcagtgctggctgggctca

SEQ ID NO: 197278 - DNA, 25 bp, Homo sapien
tggctgaattcaaggtgaccatcaa

SEQ ID NO: 197279 - DNA, 25 bp, Homo sapien
tacatgtgggattcacagtcgggaa

SEQ ID NO: 197280 - DNA, 25 bp, Homo sapien
ggttccagcagatgggagacgactt

SEQ ID NO: 197281 - DNA, 25 bp, Homo sapien
agacgacttgccagagagcgcatct

SEQ ID NO: 197282 - DNA, 25 bp, Homo sapien
agcgcatctgagtccacagaagagt

SEQ ID NO: 197283 - DNA, 25 bp, Homo sapien
gactcgggactgaaggtctcctgga

SEQ ID NO: 197284 - DNA, 25 bp, Homo sapien
gaagcttctgggtctcactggacca

SEQ ID NO: 197285 - DNA, 25 bp, Homo sapien
tctcactggaccatcaggactgctg

SEQ ID NO: 197286 - DNA, 25 bp, Homo sapien
gagagcagctttttatttgtctgta

SEQ ID NO: 197287 - DNA, 25 bp, Homo sapien
aacatgatgggcactgacctcctgt

SEQ ID NO: 197288 - DNA, 25 bp, Homo sapien
gggcactgacctcctgtaaagaata

SEQ ID NO: 197289 - DNA, 25 bp, Homo sapien
gaggctggccatttagaaaggtgac

SEQ ID NO: 197290 - DNA, 25 bp, Homo sapien
gagaggcaaggccaccctgtacata

SEQ ID NO: 197291 - DNA, 25 bp, Homo sapien
gtacatacaaaaggctccaaggcgc

SEQ ID NO: 197292 - DNA, 25 bp, Homo sapien
gcctcacgccatctaggagagctca

SEQ ID NO: 197293 - DNA, 25 bp, Homo sapien
ggagagctcagagtgccattcccaa

SEQ ID NO: 197294 - DNA, 25 bp, Homo sapien
gctttctgttcacttcatcagcaag

SEQ ID NO: 197295 - DNA, 25 bp, Homo sapien
tagcatctcgctataaccgttaggt

SEQ ID NO: 197296 - DNA, 25 bp, Homo sapien
taaccgttaggtctgggatccatcc

SEQ ID NO: 197297 - DNA, 25 bp, Homo sapien
gggatccatcctatgcccaaagaca

SEQ ID NO: 197298 - DNA, 25 bp, Homo sapien
cccaaagacattttcccagaccttg

SEQ ID NO: 197299 - DNA, 25 bp, Homo sapien
ctttctcgctcttcattctgtttca

SEQ ID NO: 197300 - DNA, 25 bp, Homo sapien
ggaggattaatgacctttgcacaat

SEQ ID NO: 197301 - DNA, 25 bp, Homo sapien
attaatgacctttgcacaatctgtt

SEQ ID NO: 197302 - DNA, 25 bp, Homo sapien
tttcttgattgggtttgttatagtt

SEQ ID NO: 197303 - DNA, 25 bp, Homo sapien
tgggtttgttatagttttgagttgg

SEQ ID NO: 197304 - DNA, 25 bp, Homo sapien
ttgagttgggtattttatgttcatt

SEQ ID NO: 197305 - DNA, 25 bp, Homo sapien
ttattagatctaacttgcagtgtat

SEQ ID NO: 197306 - DNA, 25 bp, Homo sapien
gatctaacttgcagtgtattttcta

SEQ ID NO: 197307 - DNA, 25 bp, Homo sapien
taacttgcagtgtattttctaggct

SEQ ID NO: 197308 - DNA, 25 bp, Homo sapien
cttgcagtgtattttctaggctgga

SEQ ID NO: 197309 - DNA, 25 bp, Homo sapien
cagtgtattttctaggctggaaagt

SEQ ID NO: 197310 - DNA, 25 bp, Homo sapien
aagagtcttgatacaaaatcagttt

SEQ ID NO: 197311 - DNA, 25 bp, Homo sapien
tgcaataccataacagtcaaactga

SEQ ID NO: 197312 - DNA, 25 bp, Homo sapien
aaggctactaagtgactcatgggcg

SEQ ID NO: 197313 - DNA, 25 bp, Homo sapien
gactcatgggcgaggagcatagaca

SEQ ID NO: 197314 - DNA, 25 bp, Homo sapien
tagacagtgtggagacattgggcaa

SEQ ID NO: 197315 - DNA, 25 bp, Homo sapien
gagaattcacatcctgggtgggaca

SEQ ID NO: 197316 - DNA, 25 bp, Homo sapien
ggacaatgcaagattccatcccact

SEQ ID NO: 197317 - DNA, 25 bp, Homo sapien
gattccatcccactactcagaatgg

SEQ ID NO: 197318 - DNA, 25 bp, Homo sapien
tactcagaatggcatgctgcttaag

SEQ ID NO: 197319 - DNA, 25 bp, Homo sapien
gcatgctgcttaagacttttagatt

SEQ ID NO: 197320 - DNA, 25 bp, Homo sapien
ttgaccatggttaactgagactgca

SEQ ID NO: 197321 - DNA, 25 bp, Homo sapien
gggaggactactacaaaagcattaa

SEQ ID NO: 197322 - DNA, 25 bp, Homo sapien
gaaatagtgttggtccctcaagagg

SEQ ID NO: 197323 - DNA, 25 bp, Homo sapien
tattgtctttccacatattggagga

SEQ ID NO: 197324 - DNA, 25 bp, Homo sapien
ggaggaatgtcatcttcctaaatga

SEQ ID NO: 197325 - DNA, 25 bp, Homo sapien
gaagtttatttggaggaacacagtc

SEQ ID NO: 197326 - DNA, 25 bp, Homo sapien
ggaacacagtcatctccttggtgaa

SEQ ID NO: 197327 - DNA, 25 bp, Homo sapien
tctccttggtgaaatctaatccggt

SEQ ID NO: 197328 - DNA, 25 bp, Homo sapien
atctaatccggttacattgtggctg

SEQ ID NO: 197329 - DNA, 25 bp, Homo sapien
ggctggtttcttgaacacattctaa

SEQ ID NO: 197330 - DNA, 25 bp, Homo sapien
gaacacattctaactgtgcaaaatt

SEQ ID NO: 197331 - DNA, 25 bp, Homo sapien
gccttggccgtgtaatgtgaggttt

SEQ ID NO: 197332 - DNA, 25 bp, Homo sapien
ccgtgtaatgtgaggtttacctgat

SEQ ID NO: 197333 - DNA, 25 bp, Homo sapien
aaaaacaaatgtttaagccaggcat

SEQ ID NO: 197334 - DNA, 25 bp, Homo sapien
aaaacaaatgtttaagccaggcatg

SEQ ID NO: 197335 - DNA, 25 bp, Homo sapien
aacaaatgtttaagccaggcatggt

SEQ ID NO: 197336 - DNA, 25 bp, Homo sapien
acaaatgtttaagccaggcatggtg

SEQ ID NO: 197337 - DNA, 25 bp, Homo sapien
acacacacacaaattagccgggcat

SEQ ID NO: 197338 - DNA, 25 bp, Homo sapien
gagccaagatcatttcacctcactc

SEQ ID NO: 197339 - DNA, 25 bp, Homo sapien
gccaagatcatttcacctcactcca

SEQ ID NO: 197340 - DNA, 25 bp, Homo sapien
ccaagatcatttcacctcactccag

SEQ ID NO: 197341 - DNA, 25 bp, Homo sapien
caagatcatttcacctcactccagc

SEQ ID NO: 197342 - DNA, 25 bp, Homo sapien
aagatcatttcacctcactccagcc

SEQ ID NO: 197343 - DNA, 25 bp, Homo sapien
agatcatttcacctcactccagcct

SEQ ID NO: 197344 - DNA, 25 bp, Homo sapien
ctcctgtctttgtcgttgagacttt

SEQ ID NO: 197345 - DNA, 25 bp, Homo sapien
gtcgttgagactttttgatctagaa

SEQ ID NO: 197346 - DNA, 25 bp, Homo sapien
tttgatctagaaaagggagagccct

SEQ ID NO: 197347 - DNA, 25 bp, Homo sapien
agggagagcccttttctcaatgaaa

SEQ ID NO: 197348 - DNA, 25 bp, Homo sapien
tgaaaattcaaataccccaattttg

SEQ ID NO: 197349 - DNA, 25 bp, Homo sapien
gcctcacctatctggccggtttggt

SEQ ID NO: 197350 - DNA, 25 bp, Homo sapien
tatctggccggtttggtacctaaat

SEQ ID NO: 197351 - DNA, 25 bp, Homo sapien
tggccggtttggtacctaaatgaag

SEQ ID NO: 197352 - DNA, 25 bp, Homo sapien
tgaaggaaccagctaagggtcagat

SEQ ID NO: 197353 - DNA, 25 bp, Homo sapien
ccagctaagggtcagattgtttttc

SEQ ID NO: 197354 - DNA, 25 bp, Homo sapien
tttcttccatctcttaaggtagctt

SEQ ID NO: 197355 - DNA, 25 bp, Homo sapien
gattacagttcagagcattgatcct

SEQ ID NO: 197356 - DNA, 25 bp, Homo sapien
cattgatcctggaatgtgtgctgga

SEQ ID NO: 197357 - DNA, 25 bp, Homo sapien
tcctggaatgtgtgctggagaaatt

SEQ ID NO: 197358 - DNA, 25 bp, Homo sapien
taatggtgcctatttagagttggaa

SEQ ID NO: 197359 - DNA, 25 bp, Homo sapien
agttggaagttgaacagctgttgca

SEQ ID NO: 197360 - DNA, 25 bp, Homo sapien
gaacagctgttgcattacatacttt

SEQ ID NO: 197361 - DNA, 25 bp, Homo sapien
gttgcattacatacttttgcttttt

SEQ ID NO: 197362 - DNA, 25 bp, Homo sapien
gatttttctgttctgttgaattgct

SEQ ID NO: 197363 - DNA, 25 bp, Homo sapien
tgaattgctatgttcaggatgttct

SEQ ID NO: 197364 - DNA, 25 bp, Homo sapien
gcagggactcttttcgtaataagca

SEQ ID NO: 197365 - DNA, 25 bp, Homo sapien
ggagtataaaggctacacccttatt

SEQ ID NO: 197366 - DNA, 25 bp, Homo sapien
aagagatcttttcagctgctatttt

SEQ ID NO: 197367 - DNA, 25 bp, Homo sapien
gctgctattttggaataatgactat

SEQ ID NO: 197368 - DNA, 25 bp, Homo sapien
gactatcatatatcataacagtgac

SEQ ID NO: 197369 - DNA, 25 bp, Homo sapien
gtgactgatgttggttgtaatggtt

SEQ ID NO: 197370 - DNA, 25 bp, Homo sapien
ggatgaaccattttaaggatgccaa

SEQ ID NO: 197371 - DNA, 25 bp, Homo sapien
gatttgatcttattacctagattga

SEQ ID NO: 197372 - DNA, 25 bp, Homo sapien
taatctttcctctacctaaactgac

SEQ ID NO: 197373 - DNA, 25 bp, Homo sapien
tttcctctacctaaactgacaatga

SEQ ID NO: 197374 - DNA, 25 bp, Homo sapien
gaattggttatacatcatgcataag

SEQ ID NO: 197375 - DNA, 25 bp, Homo sapien
tacatcatgcataagctacactttt

SEQ ID NO: 197376 - DNA, 25 bp, Homo sapien
gttattctaagacttgtgtttcatc

SEQ ID NO: 197377 - DNA, 25 bp, Homo sapien
tggtcaaagctcctgatgaagaaac

SEQ ID NO: 197378 - DNA, 25 bp, Homo sapien
accctgattgcattattggcccatg

SEQ ID NO: 197379 - DNA, 25 bp, Homo sapien
aatgctgggactgactgtaagttta

SEQ ID NO: 197380 - DNA, 25 bp, Homo sapien
taattcaagatgctggacgtactca

SEQ ID NO: 197381 - DNA, 25 bp, Homo sapien
ggacgtactcagattgcaccaggct

SEQ ID NO: 197382 - DNA, 25 bp, Homo sapien
ggctctcaaactgtcctagggattg

SEQ ID NO: 197383 - DNA, 25 bp, Homo sapien
gaccagcagacctaattgacaaagt

SEQ ID NO: 197384 - DNA, 25 bp, Homo sapien
gacaaagtcactggtcacctaaaac

SEQ ID NO: 197385 - DNA, 25 bp, Homo sapien
aacccctccatcacaagtgtttgaa

SEQ ID NO: 197386 - DNA, 25 bp, Homo sapien
gaagcctgtcagattctaacaacaa

SEQ ID NO: 197387 - DNA, 25 bp, Homo sapien
agctgaatttcttcacccaacttaa

SEQ ID NO: 197388 - DNA, 25 bp, Homo sapien
gactttgggaacatcaacaattgcc

SEQ ID NO: 197389 - DNA, 25 bp, Homo sapien
ttgggaacatcaacaattgccggat

SEQ ID NO: 197390 - DNA, 25 bp, Homo sapien
aacaattgccggatggacctctact

SEQ ID NO: 197391 - DNA, 25 bp, Homo sapien
attgccggatggacctctacttctt

SEQ ID NO: 197392 - DNA, 25 bp, Homo sapien
ttcctgctggctggcattcaggccg

SEQ ID NO: 197393 - DNA, 25 bp, Homo sapien
ggctggcattcaggccgtcacggct

SEQ ID NO: 197394 - DNA, 25 bp, Homo sapien
tcacggctctcctatttgtctggat

SEQ ID NO: 197395 - DNA, 25 bp, Homo sapien
tctcctatttgtctggatcgctgga

SEQ ID NO: 197396 - DNA, 25 bp, Homo sapien
atttgtctggatcgctggacgctat

SEQ ID NO: 197397 - DNA, 25 bp, Homo sapien
tctggatcgctggacgctatgagag

SEQ ID NO: 197398 - DNA, 25 bp, Homo sapien
ctatgagagggcgtcccagggccca

SEQ ID NO: 197399 - DNA, 25 bp, Homo sapien
ccatcacttgatgggccacacaagt

SEQ ID NO: 197400 - DNA, 25 bp, Homo sapien
tgatgggccacacaagtttgagagt

SEQ ID NO: 197401 - DNA, 25 bp, Homo sapien
cacacaagtttgagagtggtacaag

SEQ ID NO: 197402 - DNA, 25 bp, Homo sapien
gagaagtttgggaaaagccttcttg

SEQ ID NO: 197403 - DNA, 25 bp, Homo sapien
aaatgggacattagcattgagtttt

SEQ ID NO: 197404 - DNA, 25 bp, Homo sapien
gacagcaggataaacattccagaga

SEQ ID NO: 197405 - DNA, 25 bp, Homo sapien
aatcatgtttattccctgctgtatc

SEQ ID NO: 197406 - DNA, 25 bp, Homo sapien
atgtttattccctgctgtatcttcc

SEQ ID NO: 197407 - DNA, 25 bp, Homo sapien
gctgtatcttccagaacctaggagg

SEQ ID NO: 197408 - DNA, 25 bp, Homo sapien
acctaggaggatgcctaacagagag

SEQ ID NO: 197409 - DNA, 25 bp, Homo sapien
atgcctaacagagagtaagcactta

SEQ ID NO: 197410 - DNA, 25 bp, Homo sapien
gctcctctgtcccttgagggaggaa

SEQ ID NO: 197411 - DNA, 25 bp, Homo sapien
aagggacgagtctaggctgagggca

SEQ ID NO: 197412 - DNA, 25 bp, Homo sapien
tgggcctccccaggagctgtggact

SEQ ID NO: 197413 - DNA, 25 bp, Homo sapien
tccccaggagctgtggactcagttc

SEQ ID NO: 197414 - DNA, 25 bp, Homo sapien
gtggactcagttcctgacctctgct

SEQ ID NO: 197415 - DNA, 25 bp, Homo sapien
ctcagttcctgacctctgctttggg

SEQ ID NO: 197416 - DNA, 25 bp, Homo sapien
gagtgtagttctggcctagcagcac

SEQ ID NO: 197417 - DNA, 25 bp, Homo sapien
tagcagcaccctcttgtggcttgtt

SEQ ID NO: 197418 - DNA, 25 bp, Homo sapien
ctcttgtggcttgttctagcgtgta

SEQ ID NO: 197419 - DNA, 25 bp, Homo sapien
gtggcttgttctagcgtgtattaaa

SEQ ID NO: 197420 - DNA, 25 bp, Homo sapien
gtgtattaaaacttgacacacaccc

SEQ ID NO: 197421 - DNA, 25 bp, Homo sapien
agcccaagggagtcacagtgcctta

SEQ ID NO: 197422 - DNA, 25 bp, Homo sapien
gtcacagtgccttagaagtggcaga

SEQ ID NO: 197423 - DNA, 25 bp, Homo sapien
ggcagagaaggtttgtgtccctgtt

SEQ ID NO: 197424 - DNA, 25 bp, Homo sapien
gtgtccctgttgaggagccactctg

SEQ ID NO: 197425 - DNA, 25 bp, Homo sapien
tgaggagccactctgccagtctttg

SEQ ID NO: 197426 - DNA, 25 bp, Homo sapien
agtctttgctggtccataggcgtga

SEQ ID NO: 197427 - DNA, 25 bp, Homo sapien
gtccataggcgtgagagtttatttt

SEQ ID NO: 197428 - DNA, 25 bp, Homo sapien
gggccctgtagacgtcgctattttt

SEQ ID NO: 197429 - DNA, 25 bp, Homo sapien
tagacgtcgctatttttggtacgat

SEQ ID NO: 197430 - DNA, 25 bp, Homo sapien
tttggtacgattcctgtcatcccta

SEQ ID NO: 197431 - DNA, 25 bp, Homo sapien
tgtcatccctattgcagagtcgtgt

SEQ ID NO: 197432 - DNA, 25 bp, Homo sapien
gaatccagaactttccatttgcagt

SEQ ID NO: 197433 - DNA, 25 bp, Homo sapien
agaactttccatttgcagtgtgcaa

SEQ ID NO: 197434 - DNA, 25 bp, Homo sapien
aatgtgactcaaggcctgctgttta

SEQ ID NO: 197435 - DNA, 25 bp, Homo sapien
aaggcctgctgtttaatcacagata

SEQ ID NO: 197436 - DNA, 25 bp, Homo sapien
tagaacaagccctggaatgtgcatt

SEQ ID NO: 197437 - DNA, 25 bp, Homo sapien
gaatgtgcattcctgccactggttt

SEQ ID NO: 197438 - DNA, 25 bp, Homo sapien
gccactggtttcaggatactcatca

SEQ ID NO: 197439 - DNA, 25 bp, Homo sapien
atcagtcctgattagcctccggagg

SEQ ID NO: 197440 - DNA, 25 bp, Homo sapien
agtttccctcccgtgaatgtgaagt

SEQ ID NO: 197441 - DNA, 25 bp, Homo sapien
ccgtgaatgtgaagttccccatctt

SEQ ID NO: 197442 - DNA, 25 bp, Homo sapien
ttcagccagtgtcctagcaaagctg

SEQ ID NO: 197443 - DNA, 25 bp, Homo sapien
accacctgagtctaaccagcgtata

SEQ ID NO: 197444 - DNA, 25 bp, Homo sapien
gtctaaccagcgtataatgcaataa

SEQ ID NO: 197445 - DNA, 25 bp, Homo sapien
ccagcgtataatgcaataacaggta

SEQ ID NO: 197446 - DNA, 25 bp, Homo sapien
agtagaactgcttttggcggcgacc

SEQ ID NO: 197447 - DNA, 25 bp, Homo sapien
agaactgcttttggcggcgaccgtc

SEQ ID NO: 197448 - DNA, 25 bp, Homo sapien
ttttggcggcgaccgtcacacactg

SEQ ID NO: 197449 - DNA, 25 bp, Homo sapien
cttagcacatccagtcccagcgtgg

SEQ ID NO: 197450 - DNA, 25 bp, Homo sapien
agcagcaggcgaactcccagaaggt

SEQ ID NO: 197451 - DNA, 25 bp, Homo sapien
gcactgtgagaacgtggcctgccct

SEQ ID NO: 197452 - DNA, 25 bp, Homo sapien
tgagaacgtggcctgccctcactgc

SEQ ID NO: 197453 - DNA, 25 bp, Homo sapien
gtggccacaggaaccccgggcctga

SEQ ID NO: 197454 - DNA, 25 bp, Homo sapien
atcgacatatattaggtgcgtgtac

SEQ ID NO: 197455 - DNA, 25 bp, Homo sapien
atattaggtgcgtgtactgtttcta

SEQ ID NO: 197456 - DNA, 25 bp, Homo sapien
ttaggtgcgtgtactgtttctaaaa

SEQ ID NO: 197457 - DNA, 25 bp, Homo sapien
ttgctaattttactacactcttttg

SEQ ID NO: 197458 - DNA, 25 bp, Homo sapien
attttactacactcttttgttatgt

SEQ ID NO: 197459 - DNA, 25 bp, Homo sapien
gtagggaagtcatagggattataaa

SEQ ID NO: 197460 - DNA, 25 bp, Homo sapien
gataaagggcctttaacttaagatg

SEQ ID NO: 197461 - DNA, 25 bp, Homo sapien
ttaacttaagatggccaaagcactg

SEQ ID NO: 197462 - DNA, 25 bp, Homo sapien
gatggccaaagcactgatattatat

SEQ ID NO: 197463 - DNA, 25 bp, Homo sapien
gcactgatattatatatttgctgta

SEQ ID NO: 197464 - DNA, 25 bp, Homo sapien
tacttaataaagacttgtttccatt

SEQ ID NO: 197465 - DNA, 25 bp, Homo sapien
aaaaatctcaaagcgattggaccta

SEQ ID NO: 197466 - DNA, 25 bp, Homo sapien
aaatctcaaagcgattggacctagc

SEQ ID NO: 197467 - DNA, 25 bp, Homo sapien
atctcaaagcgattggacctagcag

SEQ ID NO: 197468 - DNA, 25 bp, Homo sapien
tctcaaagcgattggacctagcagc

SEQ ID NO: 197469 - DNA, 25 bp, Homo sapien
tcaaagcgattggacctagcagctc

SEQ ID NO: 197470 - DNA, 25 bp, Homo sapien
caaagcgattggacctagcagctca

SEQ ID NO: 197471 - DNA, 25 bp, Homo sapien
aaagcgattggacctagcagctcat

SEQ ID NO: 197472 - DNA, 25 bp, Homo sapien
aagcgattggacctagcagctcatg

SEQ ID NO: 197473 - DNA, 25 bp, Homo sapien
agcgattggacctagcagctcatgc

SEQ ID NO: 197474 - DNA, 25 bp, Homo sapien
gcgattggacctagcagctcatgcc

SEQ ID NO: 197475 - DNA, 25 bp, Homo sapien
gattggacctagcagctcatgcctg

SEQ ID NO: 197476 - DNA, 25 bp, Homo sapien
tccttctggttagatgggtcctacc

SEQ ID NO: 197477 - DNA, 25 bp, Homo sapien
atgggtcctaccatgtggcaggaaa

SEQ ID NO: 197478 - DNA, 25 bp, Homo sapien
tgcattcctgtctgggtgaagagga

SEQ ID NO: 197479 - DNA, 25 bp, Homo sapien
gtgactctgagcacaggtagacgca

SEQ ID NO: 197480 - DNA, 25 bp, Homo sapien
gtagacgcagacgtgtgcagagaat

SEQ ID NO: 197481 - DNA, 25 bp, Homo sapien
tgcagagaatgtgctcttcggagga

SEQ ID NO: 197482 - DNA, 25 bp, Homo sapien
ggaagaacactgatgagcgagctct

SEQ ID NO: 197483 - DNA, 25 bp, Homo sapien
gatgagcgagctctgtaccagccct

SEQ ID NO: 197484 - DNA, 25 bp, Homo sapien
tgtaccagcccttgtcatgtacagc

SEQ ID NO: 197485 - DNA, 25 bp, Homo sapien
tcatgtacagccaagagcctagaat

SEQ ID NO: 197486 - DNA, 25 bp, Homo sapien
agcctagaatgacatggcccttctc

SEQ ID NO: 197487 - DNA, 25 bp, Homo sapien
ctagcggcggcctgagaactttagg

SEQ ID NO: 197488 - DNA, 25 bp, Homo sapien
gaactttagggtgactgatgctacc

SEQ ID NO: 197489 - DNA, 25 bp, Homo sapien
aggcaagagccccaggactaacagc

SEQ ID NO: 197490 - DNA, 25 bp, Homo sapien
gactaacagctgactgaccaaagca

SEQ ID NO: 197491 - DNA, 25 bp, Homo sapien
aaagcagccccttgtaagcagctct

SEQ ID NO: 197492 - DNA, 25 bp, Homo sapien
ttgtaagcagctctgagtcttttgg

SEQ ID NO: 197493 - DNA, 25 bp, Homo sapien
gctgagataagtgtttcctggcaaa

SEQ ID NO: 197494 - DNA, 25 bp, Homo sapien
gtggagcacaaagggtcagtcctct

SEQ ID NO: 197495 - DNA, 25 bp, Homo sapien
aagggtcagtcctctggcagaacag

SEQ ID NO: 197496 - DNA, 25 bp, Homo sapien
gaacagatgccacggagtatcacag

SEQ ID NO: 197497 - DNA, 25 bp, Homo sapien
acaggcaggaaagggtggccttctt

SEQ ID NO: 197498 - DNA, 25 bp, Homo sapien
aagggcaatcattccttctcacttg

SEQ ID NO: 197499 - DNA, 25 bp, Homo sapien
tccttctcacttggcctatggaaaa

SEQ ID NO: 197500 - DNA, 25 bp, Homo sapien
tctcacttggcctatggaaaacggg

SEQ ID NO: 197501 - DNA, 25 bp, Homo sapien
accatctgtcccagcggatgcagtg

SEQ ID NO: 197502 - DNA, 25 bp, Homo sapien
cagtatgacgtggagctgattgcac

SEQ ID NO: 197503 - DNA, 25 bp, Homo sapien
gattgcactaatccgagccaactac

SEQ ID NO: 197504 - DNA, 25 bp, Homo sapien
gccaactactggctaaagctggtga

SEQ ID NO: 197505 - DNA, 25 bp, Homo sapien
taaagctggtgaagggcattttgcc

SEQ ID NO: 197506 - DNA, 25 bp, Homo sapien
ctgggcctcattgggtatcacctat

SEQ ID NO: 197507 - DNA, 25 bp, Homo sapien
gggtatcacctatacagaaaggcca

SEQ ID NO: 197508 - DNA, 25 bp, Homo sapien
aaggccaatagacccaaagtctcca

SEQ ID NO: 197509 - DNA, 25 bp, Homo sapien
gagtagctcaaaatatgcaattaat

SEQ ID NO: 197510 - DNA, 25 bp, Homo sapien
tctgatgatgttttatctgcagtaa

SEQ ID NO: 197511 - DNA, 25 bp, Homo sapien
aaatttgtaaccactagcacttaag

SEQ ID NO: 197512 - DNA, 25 bp, Homo sapien
gtaaccactagcacttaagtactcc

SEQ ID NO: 197513 - DNA, 25 bp, Homo sapien
agtactcctgattcttaacattgtc

SEQ ID NO: 197514 - DNA, 25 bp, Homo sapien
taacattgtctttaatgaccacaag

SEQ ID NO: 197515 - DNA, 25 bp, Homo sapien
atgaccacaagacaaccaacagctg

SEQ ID NO: 197516 - DNA, 25 bp, Homo sapien
caacagctggccacgtacttaaaat

SEQ ID NO: 197517 - DNA, 25 bp, Homo sapien
aatgttacctgtgtatttccatgca

SEQ ID NO: 197518 - DNA, 25 bp, Homo sapien
cctgtgtatttccatgcagtgtata

SEQ ID NO: 197519 - DNA, 25 bp, Homo sapien
gatgctgtaacttaatggcaataaa

SEQ ID NO: 197520 - DNA, 25 bp, Homo sapien
tgctactgctgatgcactgtcctct

SEQ ID NO: 197521 - DNA, 25 bp, Homo sapien
aacagccttggaactccagctgcca

SEQ ID NO: 197522 - DNA, 25 bp, Homo sapien
caccctctgggtcggacactgggac

SEQ ID NO: 197523 - DNA, 25 bp, Homo sapien
actggcccagtcttggctgctgctt

SEQ ID NO: 197524 - DNA, 25 bp, Homo sapien
tgctgcttacccctagccttgatgc

SEQ ID NO: 197525 - DNA, 25 bp, Homo sapien
tagccttgatgcctgcccagggacc

SEQ ID NO: 197526 - DNA, 25 bp, Homo sapien
gttgccctgcagctttaacagagtg

SEQ ID NO: 197527 - DNA, 25 bp, Homo sapien
gcagctttaacagagtgaaccatgt

SEQ ID NO: 197528 - DNA, 25 bp, Homo sapien
gaaccatgtgtattgtacaggcgcg

SEQ ID NO: 197529 - DNA, 25 bp, Homo sapien
tgtacaggcgcggttgtcattgcag

SEQ ID NO: 197530 - DNA, 25 bp, Homo sapien
ggttgtcattgcagaaaccgctggg

SEQ ID NO: 197531 - DNA, 25 bp, Homo sapien
ctaatttgtgagttctgatcacttt

SEQ ID NO: 197532 - DNA, 25 bp, Homo sapien
ctgatcacttttgagctctgaagct

SEQ ID NO: 197533 - DNA, 25 bp, Homo sapien
gagctctgaagctttgaatcattca

SEQ ID NO: 197534 - DNA, 25 bp, Homo sapien
gtggagatggccttctggtaactga

SEQ ID NO: 197535 - DNA, 25 bp, Homo sapien
gatggccttctggtaactgaatatt

SEQ ID NO: 197536 - DNA, 25 bp, Homo sapien
taactgaatattaccttctgtagga

SEQ ID NO: 197537 - DNA, 25 bp, Homo sapien
aataagcatctagaaggttgttgtg

SEQ ID NO: 197538 - DNA, 25 bp, Homo sapien
gtgaatgactctgtgctggcaaaaa

SEQ ID NO: 197539 - DNA, 25 bp, Homo sapien
caaaaatgcttgaaacctctatatt

SEQ ID NO: 197540 - DNA, 25 bp, Homo sapien
aacctctatatttctttcgttcata

SEQ ID NO: 197541 - DNA, 25 bp, Homo sapien
taacaaaagcatgcagttctctgtg

SEQ ID NO: 197542 - DNA, 25 bp, Homo sapien
cagtggtgcagtatgacgtggagct

SEQ ID NO: 197543 - DNA, 25 bp, Homo sapien
ggagctgattgcactaatccgagcc

SEQ ID NO: 197544 - DNA, 25 bp, Homo sapien
tgcactaatccgagccaactactgg

SEQ ID NO: 197545 - DNA, 25 bp, Homo sapien
gccaactactggctaaagctggtga

SEQ ID NO: 197546 - DNA, 25 bp, Homo sapien
ctactggctaaagctggtgaagggc

SEQ ID NO: 197547 - DNA, 25 bp, Homo sapien
ttgcctctggtagggatggccatgg

SEQ ID NO: 197548 - DNA, 25 bp, Homo sapien
ctgggcctcattgggtatcacctat

SEQ ID NO: 197549 - DNA, 25 bp, Homo sapien
ggcctcattgggtatcacctataca

SEQ ID NO: 197550 - DNA, 25 bp, Homo sapien
gggtatcacctatacagaaaggcca

SEQ ID NO: 197551 - DNA, 25 bp, Homo sapien
agaaaggccaatagacccaaagtct

SEQ ID NO: 197552 - DNA, 25 bp, Homo sapien
ggccaatagacccaaagtctccaaa

SEQ ID NO: 197553 - DNA, 25 bp, Homo sapien
gaagaagacgacaacctgcagcgac

SEQ ID NO: 197554 - DNA, 25 bp, Homo sapien
acgacaacctgcagcgacagcagca

SEQ ID NO: 197555 - DNA, 25 bp, Homo sapien
ccagagctagtctgagccggcgcga

SEQ ID NO: 197556 - DNA, 25 bp, Homo sapien
tggactgaaggcatgagatgccctt

SEQ ID NO: 197557 - DNA, 25 bp, Homo sapien
gcatgagatgccctttgagtgtaca

SEQ ID NO: 197558 - DNA, 25 bp, Homo sapien
atgagatgccctttgagtgtacagc

SEQ ID NO: 197559 - DNA, 25 bp, Homo sapien
gcaaatcaatgttttcctgcttggg

SEQ ID NO: 197560 - DNA, 25 bp, Homo sapien
ctcatctctagcagtatggcatccc

SEQ ID NO: 197561 - DNA, 25 bp, Homo sapien
atctctagcagtatggcatcccctc

SEQ ID NO: 197562 - DNA, 25 bp, Homo sapien
aggatctcgggctgccagcgatggg

SEQ ID NO: 197563 - DNA, 25 bp, Homo sapien
atgggcaggcgagacccctccagaa

SEQ ID NO: 197564 - DNA, 25 bp, Homo sapien
agagcaactttccagcagtacattt

SEQ ID NO: 197565 - DNA, 25 bp, Homo sapien
gcaactttccagcagtacatttgaa

SEQ ID NO: 197566 - DNA, 25 bp, Homo sapien
cagcagtacatttgaagcacttttt

SEQ ID NO: 197567 - DNA, 25 bp, Homo sapien
taaaagctcatcatgttaaattttt

SEQ ID NO: 197568 - DNA, 25 bp, Homo sapien
gattatatgtccacctatcttaagt

SEQ ID NO: 197569 - DNA, 25 bp, Homo sapien
atgtccacctatcttaagtgtacag

SEQ ID NO: 197570 - DNA, 25 bp, Homo sapien
aattagcttattcaatgattgcatg

SEQ ID NO: 197571 - DNA, 25 bp, Homo sapien
attgcatgatgccttacagttttca

SEQ ID NO: 197572 - DNA, 25 bp, Homo sapien
gatgccttacagttttcaataactt

SEQ ID NO: 197573 - DNA, 25 bp, Homo sapien
ttttttcttatgcaaacgtcatgca

SEQ ID NO: 197574 - DNA, 25 bp, Homo sapien
gtttataatctgacatcaccccagc

SEQ ID NO: 197575 - DNA, 25 bp, Homo sapien
gatagcgtttgatacactagtcatt

SEQ ID NO: 197576 - DNA, 25 bp, Homo sapien
gatacactagtcattgtctcaatca

SEQ ID NO: 197577 - DNA, 25 bp, Homo sapien
gtcattgtctcaatcactgatcctg

SEQ ID NO: 197578 - DNA, 25 bp, Homo sapien
ttgtctcaatcactgatcctgtaag

SEQ ID NO: 197579 - DNA, 25 bp, Homo sapien
atcactgatcctgtaagttgtcatc

SEQ ID NO: 197580 - DNA, 25 bp, Homo sapien
gatcctgtaagttgtcatcaaaata

SEQ ID NO: 197581 - DNA, 25 bp, Homo sapien
atattggccaaggtgttgctttaac

SEQ ID NO: 197582 - DNA, 25 bp, Homo sapien
caaggtgttgctttaactgaggaga

SEQ ID NO: 197583 - DNA, 25 bp, Homo sapien
aagaaagcacactgcctaaatgtgt

SEQ ID NO: 197584 - DNA, 25 bp, Homo sapien
agcacactgcctaaatgtgtaaaag

SEQ ID NO: 197585 - DNA, 25 bp, Homo sapien
gaagtaacaatctttggatttgtct

SEQ ID NO: 197586 - DNA, 25 bp, Homo sapien
ttccctcttccttttggcaggcagg

SEQ ID NO: 197587 - DNA, 25 bp, Homo sapien
tccctcttccttttggcaggcaggt

SEQ ID NO: 197588 - DNA, 25 bp, Homo sapien
ccttttggcaggcaggttatcagtc

SEQ ID NO: 197589 - DNA, 25 bp, Homo sapien
cttttggcaggcaggttatcagtcc

SEQ ID NO: 197590 - DNA, 25 bp, Homo sapien
ttttggcaggcaggttatcagtcct

SEQ ID NO: 197591 - DNA, 25 bp, Homo sapien
tttggcaggcaggttatcagtcctt

SEQ ID NO: 197592 - DNA, 25 bp, Homo sapien
ttggcaggcaggttatcagtccttg

SEQ ID NO: 197593 - DNA, 25 bp, Homo sapien
tggcaggcaggttatcagtccttgg

SEQ ID NO: 197594 - DNA, 25 bp, Homo sapien
ggcaggcaggttatcagtccttggc

SEQ ID NO: 197595 - DNA, 25 bp, Homo sapien
gcaggcaggttatcagtccttggca

SEQ ID NO: 197596 - DNA, 25 bp, Homo sapien
caggcaggttatcagtccttggcag

SEQ ID NO: 197597 - DNA, 25 bp, Homo sapien
tgttctagagatttaccaccattgc

SEQ ID NO: 197598 - DNA, 25 bp, Homo sapien
gatttaccaccattgcttattgctt

SEQ ID NO: 197599 - DNA, 25 bp, Homo sapien
attgctgcacatagaggagctcaga

SEQ ID NO: 197600 - DNA, 25 bp, Homo sapien
gaagccatagtagctgttcaggcaa

SEQ ID NO: 197601 - DNA, 25 bp, Homo sapien
ggcaattattgctgatccaaagaca

SEQ ID NO: 197602 - DNA, 25 bp, Homo sapien
gatccaaagacagaccacagactgg

SEQ ID NO: 197603 - DNA, 25 bp, Homo sapien
tgaacacttgaggacttcagcttct

SEQ ID NO: 197604 - DNA, 25 bp, Homo sapien
ttcagcttctcacctacttagtaca

SEQ ID NO: 197605 - DNA, 25 bp, Homo sapien
tacttagtacagttgggaaccatac

SEQ ID NO: 197606 - DNA, 25 bp, Homo sapien
ggaaccatacacttctggcatgttt

SEQ ID NO: 197607 - DNA, 25 bp, Homo sapien
acacttctggcatgtttggaaatca

SEQ ID NO: 197608 - DNA, 25 bp, Homo sapien
gtcgccatagttcttccttttctag

SEQ ID NO: 197609 - DNA, 25 bp, Homo sapien
atgtcatttcatggcttaatagtgc

SEQ ID NO: 197610 - DNA, 25 bp, Homo sapien
ttcatggcttaatagtgcatttatt

SEQ ID NO: 197611 - DNA, 25 bp, Homo sapien
ataatactccattgtctagatgaat

SEQ ID NO: 197612 - DNA, 25 bp, Homo sapien
tactccattgtctagatgaatagtt

SEQ ID NO: 197613 - DNA, 25 bp, Homo sapien
gtctagatgaatagtttatccattc

SEQ ID NO: 197614 - DNA, 25 bp, Homo sapien
acctattgaaagacttcttggtggt

SEQ ID NO: 197615 - DNA, 25 bp, Homo sapien
tgaaagacttcttggtggtttccaa

SEQ ID NO: 197616 - DNA, 25 bp, Homo sapien
gttgtaaacatctttgtgcaggttt

SEQ ID NO: 197617 - DNA, 25 bp, Homo sapien
gtgcaggtttttctatgggcatgtt

SEQ ID NO: 197618 - DNA, 25 bp, Homo sapien
caggtttttctatgggcatgttttt

SEQ ID NO: 197619 - DNA, 25 bp, Homo sapien
agccgtctcaggactactgttggat

SEQ ID NO: 197620 - DNA, 25 bp, Homo sapien
tcaggactactgttggattgcaaac

SEQ ID NO: 197621 - DNA, 25 bp, Homo sapien
gattgcaaacagcatctctgaccca

SEQ ID NO: 197622 - DNA, 25 bp, Homo sapien
ccagtcttcggactcattctgtaaa

SEQ ID NO: 197623 - DNA, 25 bp, Homo sapien
tcaagaccacatgcttgcagtccta

SEQ ID NO: 197624 - DNA, 25 bp, Homo sapien
acatgcttgcagtcctacaggcttc

SEQ ID NO: 197625 - DNA, 25 bp, Homo sapien
acaggccagctacggattttgcact

SEQ ID NO: 197626 - DNA, 25 bp, Homo sapien
acggattttgcacttttgctccagg

SEQ ID NO: 197627 - DNA, 25 bp, Homo sapien
acttttgctccaggccacttgtgtg

SEQ ID NO: 197628 - DNA, 25 bp, Homo sapien
gtgtgtaccactgccatctgaacaa

SEQ ID NO: 197629 - DNA, 25 bp, Homo sapien
acaaactatgcaataccacctgctc

SEQ ID NO: 197630 - DNA, 25 bp, Homo sapien
gtaaaatgcaaataagccttcgatg

SEQ ID NO: 197631 - DNA, 25 bp, Homo sapien
gcaaataagccttcgatgacattta

SEQ ID NO: 197632 - DNA, 25 bp, Homo sapien
taagccttcgatgacatttactaac

SEQ ID NO: 197633 - DNA, 25 bp, Homo sapien
gccttcgatgacatttactaacctt

SEQ ID NO: 197634 - DNA, 25 bp, Homo sapien
gatgacatttactaacctttactaa

SEQ ID NO: 197635 - DNA, 25 bp, Homo sapien
atgacttggttgtttaaacagctga

SEQ ID NO: 197636 - DNA, 25 bp, Homo sapien
catttgggcaatttgagtatgtcaa

SEQ ID NO: 197637 - DNA, 25 bp, Homo sapien
tatgtcaaactcaataatactggtt

SEQ ID NO: 197638 - DNA, 25 bp, Homo sapien
taaggaggccaaaaaacatcattta

SEQ ID NO: 197639 - DNA, 25 bp, Homo sapien
gatacgaaaaatatcctacttcagt

SEQ ID NO: 197640 - DNA, 25 bp, Homo sapien
tcctacttcagtaaatattggaatg

SEQ ID NO: 197641 - DNA, 25 bp, Homo sapien
taaatactttggcactgactacaca

SEQ ID NO: 197642 - DNA, 25 bp, Homo sapien
ggcactgactacacaagctgatcaa

SEQ ID NO: 197643 - DNA, 25 bp, Homo sapien
gctgatcaaaataaccctcgtaaaa

SEQ ID NO: 197644 - DNA, 25 bp, Homo sapien
taaccctcgtaaaaatatatgttgg

SEQ ID NO: 197645 - DNA, 25 bp, Homo sapien
gggtacacaaagtaagcctctttat

SEQ ID NO: 197646 - DNA, 25 bp, Homo sapien
ggttttaatgatgatgttctacttc

SEQ ID NO: 197647 - DNA, 25 bp, Homo sapien
gatgttctacttcagatagttcact

SEQ ID NO: 197648 - DNA, 25 bp, Homo sapien
agatagttcactttctactgaatag

SEQ ID NO: 197649 - DNA, 25 bp, Homo sapien
gaagaaaaatcacagctgttggaaa

SEQ ID NO: 197650 - DNA, 25 bp, Homo sapien
agcatatttgattgagaactgtggg

SEQ ID NO: 197651 - DNA, 25 bp, Homo sapien
gatgagatttgtaactgtcaactat

SEQ ID NO: 197652 - DNA, 25 bp, Homo sapien
tcagagacctgagctcttctggcca

SEQ ID NO: 197653 - DNA, 25 bp, Homo sapien
tcttctggccacgtggaacctcgaa

SEQ ID NO: 197654 - DNA, 25 bp, Homo sapien
ggccacgtggaacctcgaacccgag

SEQ ID NO: 197655 - DNA, 25 bp, Homo sapien
tcgaacccgagctcctgcagaagtg

SEQ ID NO: 197656 - DNA, 25 bp, Homo sapien
gagattgagggtccctggacactcc

SEQ ID NO: 197657 - DNA, 25 bp, Homo sapien
tggacactccctatggagatccggg

SEQ ID NO: 197658 - DNA, 25 bp, Homo sapien
ggtagaacggccctgtgcttaagac

SEQ ID NO: 197659 - DNA, 25 bp, Homo sapien
gaacggccctgtgcttaagacactc

SEQ ID NO: 197660 - DNA, 25 bp, Homo sapien
tgaggacaagcacttgccaccaccg

SEQ ID NO: 197661 - DNA, 25 bp, Homo sapien
gtcactcagccctgggcgtagccgg

SEQ ID NO: 197662 - DNA, 25 bp, Homo sapien
atgcggatgggtacccgggcacacc

SEQ ID NO: 197663 - DNA, 25 bp, Homo sapien
atgtcatttcatggcttaatagtgc

SEQ ID NO: 197664 - DNA, 25 bp, Homo sapien
gtcatttcatggcttaatagtgcat

SEQ ID NO: 197665 - DNA, 25 bp, Homo sapien
catttcatggcttaatagtgcattt

SEQ ID NO: 197666 - DNA, 25 bp, Homo sapien
ttcatggcttaatagtgcatttatt

SEQ ID NO: 197667 - DNA, 25 bp, Homo sapien
ataatactccattgtctagatgaat

SEQ ID NO: 197668 - DNA, 25 bp, Homo sapien
aatactccattgtctagatgaatag

SEQ ID NO: 197669 - DNA, 25 bp, Homo sapien
tactccattgtctagatgaatagtt

SEQ ID NO: 197670 - DNA, 25 bp, Homo sapien
gtctagatgaatagtttatccattc

SEQ ID NO: 197671 - DNA, 25 bp, Homo sapien
acctattgaaagacttcttggtggt

SEQ ID NO: 197672 - DNA, 25 bp, Homo sapien
ttgaaagacttcttggtggtttcca

SEQ ID NO: 197673 - DNA, 25 bp, Homo sapien
tgaaagacttcttggtggtttccaa

SEQ ID NO: 197674 - DNA, 25 bp, Homo sapien
tcttttttgcctactccccaagaag

SEQ ID NO: 197675 - DNA, 25 bp, Homo sapien
tttttgcctactccccaagaagata

SEQ ID NO: 197676 - DNA, 25 bp, Homo sapien
tcccgtatgattaagacgtgctgtt

SEQ ID NO: 197677 - DNA, 25 bp, Homo sapien
tgattaagacgtgctgttgatgtgt

SEQ ID NO: 197678 - DNA, 25 bp, Homo sapien
accagtgtgctgacacagaatcttt

SEQ ID NO: 197679 - DNA, 25 bp, Homo sapien
gtgctgacacagaatctttatttac

SEQ ID NO: 197680 - DNA, 25 bp, Homo sapien
tcattgttgccccttaacagttttt

SEQ ID NO: 197681 - DNA, 25 bp, Homo sapien
tgttgccccttaacagtttttcctg

SEQ ID NO: 197682 - DNA, 25 bp, Homo sapien
tgccccttaacagtttttcctgagt

SEQ ID NO: 197683 - DNA, 25 bp, Homo sapien
ttaacagtttttcctgagtttactg

SEQ ID NO: 197684 - DNA, 25 bp, Homo sapien
actgaagaaattgtacttcatccac

SEQ ID NO: 197685 - DNA, 25 bp, Homo sapien
caaagcatttgcatcatgaccttat

SEQ ID NO: 197686 - DNA, 25 bp, Homo sapien
gcatcatgaccttatacatttcaat

SEQ ID NO: 197687 - DNA, 25 bp, Homo sapien
acatttcaatcccttttatgctgga

SEQ ID NO: 197688 - DNA, 25 bp, Homo sapien
tgctggattccgtttaaagaagaca

SEQ ID NO: 197689 - DNA, 25 bp, Homo sapien
gagcaggaagtacaagcatttaaaa

SEQ ID NO: 197690 - DNA, 25 bp, Homo sapien
gtagttcccatatatttcagggtct

SEQ ID NO: 197691 - DNA, 25 bp, Homo sapien
ggtctctgtgtattaagctaactca

SEQ ID NO: 197692 - DNA, 25 bp, Homo sapien
gctaactcagatgttttgaaagctt

SEQ ID NO: 197693 - DNA, 25 bp, Homo sapien
agaggtgaaatatctgtggctaaaa

SEQ ID NO: 197694 - DNA, 25 bp, Homo sapien
gagatttgtgataactttgtagtca

SEQ ID NO: 197695 - DNA, 25 bp, Homo sapien
aaacttaagtgcttcatgcctctcc

SEQ ID NO: 197696 - DNA, 25 bp, Homo sapien
gagctgtcccgccagtggctgcggc

SEQ ID NO: 197697 - DNA, 25 bp, Homo sapien
agtggctgcggcctgacatccgcac

SEQ ID NO: 197698 - DNA, 25 bp, Homo sapien
ctgacatccgcaccaaggagcagat

SEQ ID NO: 197699 - DNA, 25 bp, Homo sapien
gcagatcgtggagatgctggtgcaa

SEQ ID NO: 197700 - DNA, 25 bp, Homo sapien
gatgctggtgcaagagcagctgctc

SEQ ID NO: 197701 - DNA, 25 bp, Homo sapien
tggtgcaagagcagctgctcgccat

SEQ ID NO: 197702 - DNA, 25 bp, Homo sapien
tgcaagagcagctgctcgccatcct

SEQ ID NO: 197703 - DNA, 25 bp, Homo sapien
acggatgtgcgcatcactggctgag

SEQ ID NO: 197704 - DNA, 25 bp, Homo sapien
atcactggctgagcggtggagctgc

SEQ ID NO: 197705 - DNA, 25 bp, Homo sapien
ggccgggcgctctgtgcggactggg

SEQ ID NO: 197706 - DNA, 25 bp, Homo sapien
ccaccccgtgttaatgaaaaatgag

SEQ ID NO: 197707 - DNA, 25 bp, Homo sapien
ggtattgttggaggaatcttttcaa

SEQ ID NO: 197708 - DNA, 25 bp, Homo sapien
aggaatcttttcaacaacaggcatg

SEQ ID NO: 197709 - DNA, 25 bp, Homo sapien
ttcaacaacaggcatgttacatgga

SEQ ID NO: 197710 - DNA, 25 bp, Homo sapien
agttgaaataatttgctgtcgtttc

SEQ ID NO: 197711 - DNA, 25 bp, Homo sapien
gctgtcgtttcagacttggatccta

SEQ ID NO: 197712 - DNA, 25 bp, Homo sapien
gacttggatcctataaacctgtcaa

SEQ ID NO: 197713 - DNA, 25 bp, Homo sapien
aaacctgtcaattctgttccttttg

SEQ ID NO: 197714 - DNA, 25 bp, Homo sapien
tccttttgaggatggccacacagac

SEQ ID NO: 197715 - DNA, 25 bp, Homo sapien
acagacaaccacttacctcttttag

SEQ ID NO: 197716 - DNA, 25 bp, Homo sapien
ataatacacattaacacctcccgat

SEQ ID NO: 197717 - DNA, 25 bp, Homo sapien
ttgcctgagacataaaacctttttt

SEQ ID NO: 197718 - DNA, 25 bp, Homo sapien
tgctctgtctggtacaggcccctgc

SEQ ID NO: 197719 - DNA, 25 bp, Homo sapien
gctctgtctggtacaggcccctgct

SEQ ID NO: 197720 - DNA, 25 bp, Homo sapien
ggtacaggcccctgctgagtgggcc

SEQ ID NO: 197721 - DNA, 25 bp, Homo sapien
cttctgccacggcttcagtcagggc

SEQ ID NO: 197722 - DNA, 25 bp, Homo sapien
gttccttgggaagagggtgcccatt

SEQ ID NO: 197723 - DNA, 25 bp, Homo sapien
ttccttgggaagagggtgcccattg

SEQ ID NO: 197724 - DNA, 25 bp, Homo sapien
gggtgcccattggacctttggcact

SEQ ID NO: 197725 - DNA, 25 bp, Homo sapien
ggtgcccattggacctttggcactg

SEQ ID NO: 197726 - DNA, 25 bp, Homo sapien
gtgcccattggacctttggcactgg

SEQ ID NO: 197727 - DNA, 25 bp, Homo sapien
tgcccattggacctttggcactgga

SEQ ID NO: 197728 - DNA, 25 bp, Homo sapien
gcccattggacctttggcactggat

SEQ ID NO: 197729 - DNA, 25 bp, Homo sapien
tgcggcctgacatccgcaccaagga

SEQ ID NO: 197730 - DNA, 25 bp, Homo sapien
gcggcctgacatccgcaccaaggag

SEQ ID NO: 197731 - DNA, 25 bp, Homo sapien
gcctgacatccgcaccaaggagcag

SEQ ID NO: 197732 - DNA, 25 bp, Homo sapien
atcgtggagatgctggtgcaagagc

SEQ ID NO: 197733 - DNA, 25 bp, Homo sapien
gatgctggtgcaagagcagctgctc

SEQ ID NO: 197734 - DNA, 25 bp, Homo sapien
atgctggtgcaagagcagctgctcg

SEQ ID NO: 197735 - DNA, 25 bp, Homo sapien
tgctggtgcaagagcagctgctcgc

SEQ ID NO: 197736 - DNA, 25 bp, Homo sapien
tggtgcaagagcagctgctcgccat

SEQ ID NO: 197737 - DNA, 25 bp, Homo sapien
ggtgcaagagcagctgctcgccatc

SEQ ID NO: 197738 - DNA, 25 bp, Homo sapien
tgcaagagcagctgctcgccatcct

SEQ ID NO: 197739 - DNA, 25 bp, Homo sapien
tgctcgccatcctgcccgaggcggc

SEQ ID NO: 197740 - DNA, 25 bp, Homo sapien
ggagaatccatttcgttaacactga

SEQ ID NO: 197741 - DNA, 25 bp, Homo sapien
gttaacactgaaagccagttctctt

SEQ ID NO: 197742 - DNA, 25 bp, Homo sapien
gcattttttacaagataccgttcgg

SEQ ID NO: 197743 - DNA, 25 bp, Homo sapien
gaagcgtattcactgtgcgccagta

SEQ ID NO: 197744 - DNA, 25 bp, Homo sapien
tggctgtgctgtggtttctcccgac

SEQ ID NO: 197745 - DNA, 25 bp, Homo sapien
cgacgtgcacatcgatctcgtatgt

SEQ ID NO: 197746 - DNA, 25 bp, Homo sapien
gatctcgtatgtgtggcatctgata

SEQ ID NO: 197747 - DNA, 25 bp, Homo sapien
gcatctgatattaaacgggaggttt

SEQ ID NO: 197748 - DNA, 25 bp, Homo sapien
cacgtttgcgtttggacctgtctgt

SEQ ID NO: 197749 - DNA, 25 bp, Homo sapien
tttggacctgtctgtgcgttctcct

SEQ ID NO: 197750 - DNA, 25 bp, Homo sapien
cctgcgtggcagtcctgatttccat

SEQ ID NO: 197751 - DNA, 25 bp, Homo sapien
gttccttttgaggatggccacacag

SEQ ID NO: 197752 - DNA, 25 bp, Homo sapien
tccttttgaggatggccacacagac

SEQ ID NO: 197753 - DNA, 25 bp, Homo sapien
tttgaggatggccacacagacaacc

SEQ ID NO: 197754 - DNA, 25 bp, Homo sapien
acagacaaccacttacctcttttag

SEQ ID NO: 197755 - DNA, 25 bp, Homo sapien
ataatacacattaacacctcccgat

SEQ ID NO: 197756 - DNA, 25 bp, Homo sapien
atacacattaacacctcccgattga

SEQ ID NO: 197757 - DNA, 25 bp, Homo sapien
acacattaacacctcccgattgaag

SEQ ID NO: 197758 - DNA, 25 bp, Homo sapien
acattaacacctcccgattgaagga

SEQ ID NO: 197759 - DNA, 25 bp, Homo sapien
taacacctcccgattgaaggagaaa

SEQ ID NO: 197760 - DNA, 25 bp, Homo sapien
tttttgcctgagacataaaaccttt

SEQ ID NO: 197761 - DNA, 25 bp, Homo sapien
ttgcctgagacataaaacctttttt

SEQ ID NO: 197762 - DNA, 25 bp, Homo sapien
attaaaacactagtttgttcacttg

SEQ ID NO: 197763 - DNA, 25 bp, Homo sapien
ttcacttgtaggactgcagttctga

SEQ ID NO: 197764 - DNA, 25 bp, Homo sapien
actgcagttctgaattttgggttaa

SEQ ID NO: 197765 - DNA, 25 bp, Homo sapien
ttgggttaaaggttttggctgctgt

SEQ ID NO: 197766 - DNA, 25 bp, Homo sapien
gttttggctgctgtaagaatgtgaa

SEQ ID NO: 197767 - DNA, 25 bp, Homo sapien
ttcaggtttctacaaatagggtaat

SEQ ID NO: 197768 - DNA, 25 bp, Homo sapien
aaagcattagcatttattggtgaat

SEQ ID NO: 197769 - DNA, 25 bp, Homo sapien
aagcattagcatttattggtgaata

SEQ ID NO: 197770 - DNA, 25 bp, Homo sapien
tattggtgaataatgtatatatccc

SEQ ID NO: 197771 - DNA, 25 bp, Homo sapien
atccccattccaagaaatataagtg

SEQ ID NO: 197772 - DNA, 25 bp, Homo sapien
tccccattccaagaaatataagtga

SEQ ID NO: 197773 - DNA, 25 bp, Homo sapien
ctgttcagaccaggtacacatttgg

SEQ ID NO: 197774 - DNA, 25 bp, Homo sapien
gttcagaccaggtacacatttggtg

SEQ ID NO: 197775 - DNA, 25 bp, Homo sapien
ttcagaccaggtacacatttggtgc

SEQ ID NO: 197776 - DNA, 25 bp, Homo sapien
cacatttggtgcggctctgttcgtg

SEQ ID NO: 197777 - DNA, 25 bp, Homo sapien
atttggtgcggctctgttcgtgggc

SEQ ID NO: 197778 - DNA, 25 bp, Homo sapien
tggtgcggctctgttcgtgggctgg

SEQ ID NO: 197779 - DNA, 25 bp, Homo sapien
tgttcgtgggctgggtcgctggagg

SEQ ID NO: 197780 - DNA, 25 bp, Homo sapien
gggctgggtcgctggaggcctcaca

SEQ ID NO: 197781 - DNA, 25 bp, Homo sapien
tggaggcctcacactaattgggggt

SEQ ID NO: 197782 - DNA, 25 bp, Homo sapien
gtgtgatgatgtgcatcgcctgccg

SEQ ID NO: 197783 - DNA, 25 bp, Homo sapien
gtgatgatgtgcatcgcctgccggg

SEQ ID NO: 197784 - DNA, 25 bp, Homo sapien
atgcctgtactttcagctgggtata

SEQ ID NO: 197785 - DNA, 25 bp, Homo sapien
gattgaaacctgaccaatttgcttt

SEQ ID NO: 197786 - DNA, 25 bp, Homo sapien
ctgaccaatttgctttatttcatgg

SEQ ID NO: 197787 - DNA, 25 bp, Homo sapien
cagcgtgcatgtgttcaagccttag

SEQ ID NO: 197788 - DNA, 25 bp, Homo sapien
gttcaagccttagattggcgatgtc

SEQ ID NO: 197789 - DNA, 25 bp, Homo sapien
attggcgatgtcgtattttcctcac

SEQ ID NO: 197790 - DNA, 25 bp, Homo sapien
attttcctcacgtgtggcaatgcca

SEQ ID NO: 197791 - DNA, 25 bp, Homo sapien
gtggcaatgccaaaggctttacttt

SEQ ID NO: 197792 - DNA, 25 bp, Homo sapien
ggctttactttacctgtgagtacac

SEQ ID NO: 197793 - DNA, 25 bp, Homo sapien
atgaattatttccaacgtacattta

SEQ ID NO: 197794 - DNA, 25 bp, Homo sapien
aagggtcacaaattcccaaatcaat

SEQ ID NO: 197795 - DNA, 25 bp, Homo sapien
agccatgcgtactttctaaaaactg

SEQ ID NO: 197796 - DNA, 25 bp, Homo sapien
ggtgaaaagctcttaccgaagcaac

SEQ ID NO: 197797 - DNA, 25 bp, Homo sapien
ttgagttcttcaccatcttttgcaa

SEQ ID NO: 197798 - DNA, 25 bp, Homo sapien
gttcttcaccatcttttgcaactga

SEQ ID NO: 197799 - DNA, 25 bp, Homo sapien
gatggatatgcttaagtacaactga

SEQ ID NO: 197800 - DNA, 25 bp, Homo sapien
gcttaagtacaactgatggcatgaa

SEQ ID NO: 197801 - DNA, 25 bp, Homo sapien
aaatgaatgttgtccctgaacttag

SEQ ID NO: 197802 - DNA, 25 bp, Homo sapien
ccctgaacttagctaaatggtgcaa

SEQ ID NO: 197803 - DNA, 25 bp, Homo sapien
aatggtgcaacttagtttctccttg

SEQ ID NO: 197804 - DNA, 25 bp, Homo sapien
gtttctccttgctttcatattatcg

SEQ ID NO: 197805 - DNA, 25 bp, Homo sapien
atcgaatttcctggcttataaactt

SEQ ID NO: 197806 - DNA, 25 bp, Homo sapien
gcttcggctcggatcagtccgagaa

SEQ ID NO: 197807 - DNA, 25 bp, Homo sapien
gatcagtccgagaatgtcgaccggg

SEQ ID NO: 197808 - DNA, 25 bp, Homo sapien
caggctgaagaggaacgatatttcc

SEQ ID NO: 197809 - DNA, 25 bp, Homo sapien
gagtagagaacaactggcagctttg

SEQ ID NO: 197810 - DNA, 25 bp, Homo sapien
gaagaaatcgttcatcataagaagg

SEQ ID NO: 197811 - DNA, 25 bp, Homo sapien
gaaggagattgagcgtctgcagaaa

SEQ ID NO: 197812 - DNA, 25 bp, Homo sapien
gcagaaagaaattgagcgccataag

SEQ ID NO: 197813 - DNA, 25 bp, Homo sapien
gagcgccataagcagaagatcaaaa

SEQ ID NO: 197814 - DNA, 25 bp, Homo sapien
acatgatgattaagtgcacaccgtg

SEQ ID NO: 197815 - DNA, 25 bp, Homo sapien
tgaggaccatgcaagcccgaggctt

SEQ ID NO: 197816 - DNA, 25 bp, Homo sapien
aagcccgaggcttcggctcggatca

SEQ ID NO: 197817 - DNA, 25 bp, Homo sapien
acaggacttgcgaccttgaagccaa

SEQ ID NO: 197818 - DNA, 25 bp, Homo sapien
aagccaaaggaatctcacttgtggg

SEQ ID NO: 197819 - DNA, 25 bp, Homo sapien
ctgctgctgtctcagagccatctgg

SEQ ID NO: 197820 - DNA, 25 bp, Homo sapien
agccatctggatgagtgtcccgaca

SEQ ID NO: 197821 - DNA, 25 bp, Homo sapien
gatgcagggcaggaccacccagctg

SEQ ID NO: 197822 - DNA, 25 bp, Homo sapien
acccagctggtcagactctgatgtt

SEQ ID NO: 197823 - DNA, 25 bp, Homo sapien
ctgatgttgggtagctggcctctgt

SEQ ID NO: 197824 - DNA, 25 bp, Homo sapien
gtaagtgccctgaggcgctctgtac

SEQ ID NO: 197825 - DNA, 25 bp, Homo sapien
gctctgtactagaaactgctcttaa

SEQ ID NO: 197826 - DNA, 25 bp, Homo sapien
agcacacaggcttctgcagcaatct

SEQ ID NO: 197827 - DNA, 25 bp, Homo sapien
caatctctgagggtaaagccggtgg

SEQ ID NO: 197828 - DNA, 25 bp, Homo sapien
accacagtctggagtgatagctact

SEQ ID NO: 197829 - DNA, 25 bp, Homo sapien
gtctggagtgatagctactgtagaa

SEQ ID NO: 197830 - DNA, 25 bp, Homo sapien
tagaaattaataccactacccgtga

SEQ ID NO: 197831 - DNA, 25 bp, Homo sapien
ttaataccactacccgtgaattata

SEQ ID NO: 197832 - DNA, 25 bp, Homo sapien
cagtactccacaaacatgggtggta

SEQ ID NO: 197833 - DNA, 25 bp, Homo sapien
gggtggtaacaagagttccatccca

SEQ ID NO: 197834 - DNA, 25 bp, Homo sapien
taacaagagttccatcccaggaggc

SEQ ID NO: 197835 - DNA, 25 bp, Homo sapien
cagaagggtaggttagatgctatta

SEQ ID NO: 197836 - DNA, 25 bp, Homo sapien
gttagatgctattaagaaggcactt

SEQ ID NO: 197837 - DNA, 25 bp, Homo sapien
gaaggcacttaatagtacatcatgt

SEQ ID NO: 197838 - DNA, 25 bp, Homo sapien
aggcacttaatagtacatcatgtaa

SEQ ID NO: 197839 - DNA, 25 bp, Homo sapien
gagagaggtgcttttcttcataaaa

SEQ ID NO: 197840 - DNA, 25 bp, Homo sapien
gtgcttttcttcataaaacctttgg

SEQ ID NO: 197841 - DNA, 25 bp, Homo sapien
gatggagaatggaatactcactctt

SEQ ID NO: 197842 - DNA, 25 bp, Homo sapien
aatggaatactcactcttgggtcta

SEQ ID NO: 197843 - DNA, 25 bp, Homo sapien
gaatactcactcttgggtctaatct

SEQ ID NO: 197844 - DNA, 25 bp, Homo sapien
taatctttccccttgacccagaact

SEQ ID NO: 197845 - DNA, 25 bp, Homo sapien
ccagaacttcctccccacaaaaatg

SEQ ID NO: 197846 - DNA, 25 bp, Homo sapien
aaccttcctgagacttaagcattct

SEQ ID NO: 197847 - DNA, 25 bp, Homo sapien
agacttaagcattctgccccactta

SEQ ID NO: 197848 - DNA, 25 bp, Homo sapien
gcatggagtcaggagaaaaccacct

SEQ ID NO: 197849 - DNA, 25 bp, Homo sapien
aaaaccaccttcataaactgctctg

SEQ ID NO: 197850 - DNA, 25 bp, Homo sapien
gcatataacaggaatttctcttgga

SEQ ID NO: 197851 - DNA, 25 bp, Homo sapien
tggaattgggctgctaacaactttt

SEQ ID NO: 197852 - DNA, 25 bp, Homo sapien
aacaacttttatgtatgcaaacaaa

SEQ ID NO: 197853 - DNA, 25 bp, Homo sapien
aaagcattgtaaatcaggtttttct

SEQ ID NO: 197854 - DNA, 25 bp, Homo sapien
aattattaactgtttctctccatag

SEQ ID NO: 197855 - DNA, 25 bp, Homo sapien
aactgtttctctccatagattttag

SEQ ID NO: 197856 - DNA, 25 bp, Homo sapien
gatatattgtaacatccacgttatg

SEQ ID NO: 197857 - DNA, 25 bp, Homo sapien
aaatttggtatctaaatcctggaat

SEQ ID NO: 197858 - DNA, 25 bp, Homo sapien
atcctggaataaattatctctccta

SEQ ID NO: 197859 - DNA, 25 bp, Homo sapien
atctctcctaatgctgaattccttc

SEQ ID NO: 197860 - DNA, 25 bp, Homo sapien
ctcctaatgctgaattccttcacct

SEQ ID NO: 197861 - DNA, 25 bp, Homo sapien
acagtctcaaaatgacctgataaat

SEQ ID NO: 197862 - DNA, 25 bp, Homo sapien
agaatcattttctattgtggtatta

SEQ ID NO: 197863 - DNA, 25 bp, Homo sapien
ttataggttggttaaagtgatggcc

SEQ ID NO: 197864 - DNA, 25 bp, Homo sapien
ggttaaagtgatggcctttttgatg

SEQ ID NO: 197865 - DNA, 25 bp, Homo sapien
ggaatggaattatcactactgtatc

SEQ ID NO: 197866 - DNA, 25 bp, Homo sapien
actactgtatcatgagtgggtattt

SEQ ID NO: 197867 - DNA, 25 bp, Homo sapien
tgagtgggtattttgattctatggt

SEQ ID NO: 197868 - DNA, 25 bp, Homo sapien
tttgattctatggttccctcagtat

SEQ ID NO: 197869 - DNA, 25 bp, Homo sapien
gattctatggttccctcagtattac

SEQ ID NO: 197870 - DNA, 25 bp, Homo sapien
ggttccctcagtattacatcttgac

SEQ ID NO: 197871 - DNA, 25 bp, Homo sapien
ccctcagtattacatcttgacttgt

SEQ ID NO: 197872 - DNA, 25 bp, Homo sapien
aaactggtggcaggagcccgtagtc

SEQ ID NO: 197873 - DNA, 25 bp, Homo sapien
aaatatttctgcagtaccaaccata

SEQ ID NO: 197874 - DNA, 25 bp, Homo sapien
aatatttctgcagtaccaaccatat

SEQ ID NO: 197875 - DNA, 25 bp, Homo sapien
tatttctgcagtaccaaccatatat

SEQ ID NO: 197876 - DNA, 25 bp, Homo sapien
tttctgcagtaccaaccatatatct

SEQ ID NO: 197877 - DNA, 25 bp, Homo sapien
tctgcagtaccaaccatatatctgg

SEQ ID NO: 197878 - DNA, 25 bp, Homo sapien
ctgcagtaccaaccatatatctggt

SEQ ID NO: 197879 - DNA, 25 bp, Homo sapien
ccatatatctggtactgtgcaaagg

SEQ ID NO: 197880 - DNA, 25 bp, Homo sapien
atatctggtactgtgcaaagggaaa

SEQ ID NO: 197881 - DNA, 25 bp, Homo sapien
ctggtactgtgcaaagggaaaaagg

SEQ ID NO: 197882 - DNA, 25 bp, Homo sapien
aaggaaatgggctgggaatggtggt

SEQ ID NO: 197883 - DNA, 25 bp, Homo sapien
tctggctgccccatagaagcttgta

SEQ ID NO: 197884 - DNA, 25 bp, Homo sapien
tggctgccccatagaagcttgtaca

SEQ ID NO: 197885 - DNA, 25 bp, Homo sapien
tgccccatagaagcttgtacacaat

SEQ ID NO: 197886 - DNA, 25 bp, Homo sapien
agcttgtacacaatacagcctctgt

SEQ ID NO: 197887 - DNA, 25 bp, Homo sapien
ggagagaggaggacctactttcaaa

SEQ ID NO: 197888 - DNA, 25 bp, Homo sapien
gaggaggacctactttcaaatggaa

SEQ ID NO: 197889 - DNA, 25 bp, Homo sapien
gacctactttcaaatggaactgtga

SEQ ID NO: 197890 - DNA, 25 bp, Homo sapien
ggaactgtgacacatatgttctgca

SEQ ID NO: 197891 - DNA, 25 bp, Homo sapien
tgtgacacatatgttctgcaggaat

SEQ ID NO: 197892 - DNA, 25 bp, Homo sapien
tatgttctgcaggaataccggccca

SEQ ID NO: 197893 - DNA, 25 bp, Homo sapien
tctgcaggaataccggcccaccaga

SEQ ID NO: 197894 - DNA, 25 bp, Homo sapien
agaggatttggctgaccagcttgct

SEQ ID NO: 197895 - DNA, 25 bp, Homo sapien
agcttgcttgtccaacagccttatt

SEQ ID NO: 197896 - DNA, 25 bp, Homo sapien
ttgcttgtccaacagccttattttg

SEQ ID NO: 197897 - DNA, 25 bp, Homo sapien
tgaagaagagggtttactggccggt

SEQ ID NO: 197898 - DNA, 25 bp, Homo sapien
tactggccggttagaacccgtgact

SEQ ID NO: 197899 - DNA, 25 bp, Homo sapien
actggccggttagaacccgtgactg

SEQ ID NO: 197900 - DNA, 25 bp, Homo sapien
ttggatacccctatgcctacatcat

SEQ ID NO: 197901 - DNA, 25 bp, Homo sapien
atacccctatgcctacatcatattc

SEQ ID NO: 197902 - DNA, 25 bp, Homo sapien
ctatgcctacatcatattccttacc

SEQ ID NO: 197903 - DNA, 25 bp, Homo sapien
tacatcatattccttacctcttttg

SEQ ID NO: 197904 - DNA, 25 bp, Homo sapien
tcatattccttacctcttttgggaa

SEQ ID NO: 197905 - DNA, 25 bp, Homo sapien
gaatctcaaatctcaatgccttata

SEQ ID NO: 197906 - DNA, 25 bp, Homo sapien
tgccttataagcattccttcctgtg

SEQ ID NO: 197907 - DNA, 25 bp, Homo sapien
cttcctgtgtccattaagactctga

SEQ ID NO: 197908 - DNA, 25 bp, Homo sapien
aagactctgataattgtctcccctc

SEQ ID NO: 197909 - DNA, 25 bp, Homo sapien
aattgtctcccctccataggaattt

SEQ ID NO: 197910 - DNA, 25 bp, Homo sapien
gaaagaaatatatccccatctccgt

SEQ ID NO: 197911 - DNA, 25 bp, Homo sapien
gtttcatatcagaactaccgtcccc

SEQ ID NO: 197912 - DNA, 25 bp, Homo sapien
ccccgatattcccttcagagagatt

SEQ ID NO: 197913 - DNA, 25 bp, Homo sapien
ctcttcatctgcacctgtaatagtt

SEQ ID NO: 197914 - DNA, 25 bp, Homo sapien
gtttcagttcctattttcttccatt

SEQ ID NO: 197915 - DNA, 25 bp, Homo sapien
ttgacccatatttatacctttcagg

SEQ ID NO: 197916 - DNA, 25 bp, Homo sapien
agggtagccaagaccttgcatggta

SEQ ID NO: 197917 - DNA, 25 bp, Homo sapien
ccttgcatggtagagtaggaatcat

SEQ ID NO: 197918 - DNA, 25 bp, Homo sapien
aatcatagtgtcagtgaggtcccgt

SEQ ID NO: 197919 - DNA, 25 bp, Homo sapien
tagtgtcagtgaggtcccgtgagtc

SEQ ID NO: 197920 - DNA, 25 bp, Homo sapien
aggtcccgtgagtctttgtgagtcc

SEQ ID NO: 197921 - DNA, 25 bp, Homo sapien
agtctttgtgagtccttgtgtcatc

SEQ ID NO: 197922 - DNA, 25 bp, Homo sapien
gagtccttgtgtcatcgttcgggca

SEQ ID NO: 197923 - DNA, 25 bp, Homo sapien
ttgtgtcatcgttcgggcactgttt

SEQ ID NO: 197924 - DNA, 25 bp, Homo sapien
atgcaagggcaaaaatctttgtatc

SEQ ID NO: 197925 - DNA, 25 bp, Homo sapien
tattgaggtcttcctagtgttactt

SEQ ID NO: 197926 - DNA, 25 bp, Homo sapien
gaggtcttcctagtgttacttaaat

SEQ ID NO: 197927 - DNA, 25 bp, Homo sapien
cagttcccattagatttagtggcct

SEQ ID NO: 197928 - DNA, 25 bp, Homo sapien
cccattagatttagtggccttcatg

SEQ ID NO: 197929 - DNA, 25 bp, Homo sapien
gatttagtggccttcatgttattca

SEQ ID NO: 197930 - DNA, 25 bp, Homo sapien
tttagtggccttcatgttattcaga

SEQ ID NO: 197931 - DNA, 25 bp, Homo sapien
agtggccttcatgttattcagaatt

SEQ ID NO: 197932 - DNA, 25 bp, Homo sapien
ggccttcatgttattcagaattgtt

SEQ ID NO: 197933 - DNA, 25 bp, Homo sapien
tcagaattgttttggtgatacctca

SEQ ID NO: 197934 - DNA, 25 bp, Homo sapien
attgttttggtgatacctcacccct

SEQ ID NO: 197935 - DNA, 25 bp, Homo sapien
tttggtgatacctcacccctgtaat

SEQ ID NO: 197936 - DNA, 25 bp, Homo sapien
agctacttggaattggaaatcgcct

SEQ ID NO: 197937 - DNA, 25 bp, Homo sapien
ttggaattggaaatcgcctgaaccc

SEQ ID NO: 197938 - DNA, 25 bp, Homo sapien
gacttagtggagatggaagcccatt

SEQ ID NO: 197939 - DNA, 25 bp, Homo sapien
gaagcccattaattgggttccccat

SEQ ID NO: 197940 - DNA, 25 bp, Homo sapien
ttccccattaaatcgtttacataca

SEQ ID NO: 197941 - DNA, 25 bp, Homo sapien
agaacacagtttttatactaaggat

SEQ ID NO: 197942 - DNA, 25 bp, Homo sapien
gtaaagttcatgtctttcacccaga

SEQ ID NO: 197943 - DNA, 25 bp, Homo sapien
gtctttcacccagatatatcaaatg

SEQ ID NO: 197944 - DNA, 25 bp, Homo sapien
gaccagtgtgacttcattagataac

SEQ ID NO: 197945 - DNA, 25 bp, Homo sapien
gaatgtgtaaatttgtgctttgaac

SEQ ID NO: 197946 - DNA, 25 bp, Homo sapien
aatttgtgctttgaactgtagttta

SEQ ID NO: 197947 - DNA, 25 bp, Homo sapien
aattgcatcatagtatttgttgacc

SEQ ID NO: 197948 - DNA, 25 bp, Homo sapien
tttgttgacctaatgtaacccttgt

SEQ ID NO: 197949 - DNA, 25 bp, Homo sapien
ggaactgcagcatttgcacagggga

SEQ ID NO: 197950 - DNA, 25 bp, Homo sapien
gtgccctccttccttaggacctggg

SEQ ID NO: 197951 - DNA, 25 bp, Homo sapien
acttggggggcagacttgacactag

SEQ ID NO: 197952 - DNA, 25 bp, Homo sapien
ggcagacttgacactaggccccact

SEQ ID NO: 197953 - DNA, 25 bp, Homo sapien
ccactcactcagatgtcctgaaatt

SEQ ID NO: 197954 - DNA, 25 bp, Homo sapien
tcagatgtcctgaaattccaccacg

SEQ ID NO: 197955 - DNA, 25 bp, Homo sapien
agatgtcctgaaattccaccacggg

SEQ ID NO: 197956 - DNA, 25 bp, Homo sapien
ggcccactaggagggctggccctaa

SEQ ID NO: 197957 - DNA, 25 bp, Homo sapien
gagggctggccctaagatacagacc

SEQ ID NO: 197958 - DNA, 25 bp, Homo sapien
agggctggccctaagatacagaccc

SEQ ID NO: 197959 - DNA, 25 bp, Homo sapien
aagcggggaggagatatttattttg

SEQ ID NO: 197960 - DNA, 25 bp, Homo sapien
aacatgctgggggtccagaagccac

SEQ ID NO: 197961 - DNA, 25 bp, Homo sapien
acatgctgggggtccagaagccacc

SEQ ID NO: 197962 - DNA, 25 bp, Homo sapien
atgctgggggtccagaagccacctc

SEQ ID NO: 197963 - DNA, 25 bp, Homo sapien
tgctgggggtccagaagccacctcg

SEQ ID NO: 197964 - DNA, 25 bp, Homo sapien
ctgggggtccagaagccacctcggg

SEQ ID NO: 197965 - DNA, 25 bp, Homo sapien
ggtccagaagccacctcggggtgac

SEQ ID NO: 197966 - DNA, 25 bp, Homo sapien
gtccagaagccacctcggggtgact

SEQ ID NO: 197967 - DNA, 25 bp, Homo sapien
tccagaagccacctcggggtgactg

SEQ ID NO: 197968 - DNA, 25 bp, Homo sapien
ccagaagccacctcggggtgactga

SEQ ID NO: 197969 - DNA, 25 bp, Homo sapien
agccacctcggggtgactgagcgga

SEQ ID NO: 197970 - DNA, 25 bp, Homo sapien
ctcggggtgactgagcggaaggcca

SEQ ID NO: 197971 - DNA, 25 bp, Homo sapien
aggcactacctgcacgagagcgtgc

SEQ ID NO: 197972 - DNA, 25 bp, Homo sapien
gagagcgtgctcttcaacctgacca

SEQ ID NO: 197973 - DNA, 25 bp, Homo sapien
aacctgaccaccatgtacgagctgg

SEQ ID NO: 197974 - DNA, 25 bp, Homo sapien
caccatgtacgagctggagtcctca

SEQ ID NO: 197975 - DNA, 25 bp, Homo sapien
ggagtcctcacggagcatgcagaag

SEQ ID NO: 197976 - DNA, 25 bp, Homo sapien
gacagcttcaacacacagtgcctca

SEQ ID NO: 197977 - DNA, 25 bp, Homo sapien
ttcaacacacagtgcctcaagctgg

SEQ ID NO: 197978 - DNA, 25 bp, Homo sapien
cacactacgtcagaaggacccgggt

SEQ ID NO: 197979 - DNA, 25 bp, Homo sapien
gacccgggtctttgaaactgtgtct

SEQ ID NO: 197980 - DNA, 25 bp, Homo sapien
gaaactgtgtcttgaagctaatgta

SEQ ID NO: 197981 - DNA, 25 bp, Homo sapien
ctggaggccatggtccagcaggacc

SEQ ID NO: 197982 - DNA, 25 bp, Homo sapien
ccagcacccagcaagattatagagg

SEQ ID NO: 197983 - DNA, 25 bp, Homo sapien
ctaaatgctggtgtgggaggtctaa

SEQ ID NO: 197984 - DNA, 25 bp, Homo sapien
atctggagttgagagccatgggttt

SEQ ID NO: 197985 - DNA, 25 bp, Homo sapien
tgggtttggacatgactggcacaaa

SEQ ID NO: 197986 - DNA, 25 bp, Homo sapien
gactggcacaaacagctgtcatatg

SEQ ID NO: 197987 - DNA, 25 bp, Homo sapien
gctgtcatatgttcatggtcagatg

SEQ ID NO: 197988 - DNA, 25 bp, Homo sapien
ggtcagatgtcatacattctcagct

SEQ ID NO: 197989 - DNA, 25 bp, Homo sapien
atacattctcagctgtcttgttcca

SEQ ID NO: 197990 - DNA, 25 bp, Homo sapien
gtcttgttccaccagtatttaccag

SEQ ID NO: 197991 - DNA, 25 bp, Homo sapien
ccaccccacatcttaagtcagtgtg

SEQ ID NO: 197992 - DNA, 25 bp, Homo sapien
atcttaagtcagtgtgccaagtact

SEQ ID NO: 197993 - DNA, 25 bp, Homo sapien
cagaaacttcaagctctctaaataa

SEQ ID NO: 197994 - DNA, 25 bp, Homo sapien
tgaatatcatgaactctcaatgggt

SEQ ID NO: 197995 - DNA, 25 bp, Homo sapien
actctcaatgggtaggtttcatcct

SEQ ID NO: 197996 - DNA, 25 bp, Homo sapien
gtaggtttcatcctacccattgcca

SEQ ID NO: 197997 - DNA, 25 bp, Homo sapien
attgccactctgtttcctgagagat

SEQ ID NO: 197998 - DNA, 25 bp, Homo sapien
gtttcctgagagatacctcacattc

SEQ ID NO: 197999 - DNA, 25 bp, Homo sapien
cctcacattccaatgccaaacattt

SEQ ID NO: 198000 - DNA, 25 bp, Homo sapien
atgccaaacatttctgcacagggaa

SEQ ID NO: 198001 - DNA, 25 bp, Homo sapien
acagggaagctagaggtggatacac

SEQ ID NO: 198002 - DNA, 25 bp, Homo sapien
aggtggatacacgtgttgcaagtat

SEQ ID NO: 198003 - DNA, 25 bp, Homo sapien
ggagaattgagagaatgtacccaca

SEQ ID NO: 198004 - DNA, 25 bp, Homo sapien
tgaacgcaaagccaagtctcgacaa

SEQ ID NO: 198005 - DNA, 25 bp, Homo sapien
aagccaagtctcgacaagttggaaa

SEQ ID NO: 198006 - DNA, 25 bp, Homo sapien
taaatagaacctgttgtgcaaccac

SEQ ID NO: 198007 - DNA, 25 bp, Homo sapien
gaacctgttgtgcaaccacggttta

SEQ ID NO: 198008 - DNA, 25 bp, Homo sapien
tgttgtgcaaccacggtttaaccgg

SEQ ID NO: 198009 - DNA, 25 bp, Homo sapien
gtttaaccggagattttgaggctag

SEQ ID NO: 198010 - DNA, 25 bp, Homo sapien
attttgaggctagggtgtgtttctt

SEQ ID NO: 198011 - DNA, 25 bp, Homo sapien
ttctttcgaacttttcggaatgtct

SEQ ID NO: 198012 - DNA, 25 bp, Homo sapien
gaacttttcggaatgtctggaacat

SEQ ID NO: 198013 - DNA, 25 bp, Homo sapien
tgttacctgtgcctctgtaaatcta

SEQ ID NO: 198014 - DNA, 25 bp, Homo sapien
tacctgtgcctctgtaaatctactt

SEQ ID NO: 198015 - DNA, 25 bp, Homo sapien
agagacacagcccactgaacaaggt

SEQ ID NO: 198016 - DNA, 25 bp, Homo sapien
gctaagccaagaaggaactttccca

SEQ ID NO: 198017 - DNA, 25 bp, Homo sapien
gaactttcccacactactgaatgga

SEQ ID NO: 198018 - DNA, 25 bp, Homo sapien
gctgtcttgtaaaagcccagatcac

SEQ ID NO: 198019 - DNA, 25 bp, Homo sapien
aaggaaagggtctgcgccagccctg

SEQ ID NO: 198020 - DNA, 25 bp, Homo sapien
caagcctactagagcaagaaaccag

SEQ ID NO: 198021 - DNA, 25 bp, Homo sapien
ataaaatgcactgccctactgttgg

SEQ ID NO: 198022 - DNA, 25 bp, Homo sapien
actgccctactgttggtatgactac

SEQ ID NO: 198023 - DNA, 25 bp, Homo sapien
gtatgactaccgttacctactgttg

SEQ ID NO: 198024 - DNA, 25 bp, Homo sapien
cgttacctactgttgtcattgttat

SEQ ID NO: 198025 - DNA, 25 bp, Homo sapien
acagctatggccactattattaaag

SEQ ID NO: 198026 - DNA, 25 bp, Homo sapien
gtgcttttcttcataaaacctttgg

SEQ ID NO: 198027 - DNA, 25 bp, Homo sapien
gatggagaatggaatactcactctt

SEQ ID NO: 198028 - DNA, 25 bp, Homo sapien
gaatggaatactcactcttgggtct

SEQ ID NO: 198029 - DNA, 25 bp, Homo sapien
aatggaatactcactcttgggtcta

SEQ ID NO: 198030 - DNA, 25 bp, Homo sapien
tggaatactcactcttgggtctaat

SEQ ID NO: 198031 - DNA, 25 bp, Homo sapien
gaatactcactcttgggtctaatct

SEQ ID NO: 198032 - DNA, 25 bp, Homo sapien
ccagaacttcctccccacaaaaatg

SEQ ID NO: 198033 - DNA, 25 bp, Homo sapien
aaaccttcctgagacttaagcattc

SEQ ID NO: 198034 - DNA, 25 bp, Homo sapien
aaccttcctgagacttaagcattct

SEQ ID NO: 198035 - DNA, 25 bp, Homo sapien
ttctgccccacttactaactgccag

SEQ ID NO: 198036 - DNA, 25 bp, Homo sapien
gcatggagtcaggagaaaaccacct

SEQ ID NO: 198037 - DNA, 25 bp, Homo sapien
aattgtcactagaactatttgctgt

SEQ ID NO: 198038 - DNA, 25 bp, Homo sapien
tttgctgtgggcatttcctctattc

SEQ ID NO: 198039 - DNA, 25 bp, Homo sapien
catttcctctattctgttacgtcat

SEQ ID NO: 198040 - DNA, 25 bp, Homo sapien
attaacagtgccttactgtgcaagg

SEQ ID NO: 198041 - DNA, 25 bp, Homo sapien
ggacataaatacgtacttgcaaaga

SEQ ID NO: 198042 - DNA, 25 bp, Homo sapien
cttgcaaagattccagatgagctgt

SEQ ID NO: 198043 - DNA, 25 bp, Homo sapien
agatgagctgttcatgtgggcccct

SEQ ID NO: 198044 - DNA, 25 bp, Homo sapien
atgtgggccccttgctgactatatt

SEQ ID NO: 198045 - DNA, 25 bp, Homo sapien
tgactatattccagccacttcaggg

SEQ ID NO: 198046 - DNA, 25 bp, Homo sapien
ccagccacttcagggttgtttgtaa

SEQ ID NO: 198047 - DNA, 25 bp, Homo sapien
agggctcgacctgcagaagaaactg

SEQ ID NO: 198048 - DNA, 25 bp, Homo sapien
tgtggagtacatcaaagccaggact

SEQ ID NO: 198049 - DNA, 25 bp, Homo sapien
aagccaggactcatttaattcgttg

SEQ ID NO: 198050 - DNA, 25 bp, Homo sapien
aattcgttgggtcggattatctcgc

SEQ ID NO: 198051 - DNA, 25 bp, Homo sapien
ggtcggattatctcgccagaagtcg

SEQ ID NO: 198052 - DNA, 25 bp, Homo sapien
aggatggctcggttatctcagaaaa

SEQ ID NO: 198053 - DNA, 25 bp, Homo sapien
aattgtgcttattttcataatggga

SEQ ID NO: 198054 - DNA, 25 bp, Homo sapien
tgggaaaatgcaccctaccttctgt

SEQ ID NO: 198055 - DNA, 25 bp, Homo sapien
cctaccttctgtgagaacaaacatt

SEQ ID NO: 198056 - DNA, 25 bp, Homo sapien
tgaccaaggtggaccaactacctta

SEQ ID NO: 198057 - DNA, 25 bp, Homo sapien
gtggaccaactaccttaatgcaaag

SEQ ID NO: 198058 - DNA, 25 bp, Homo sapien
ggacaggataacacagataagggct

SEQ ID NO: 198059 - DNA, 25 bp, Homo sapien
gaagcaaaattactttcccctgact

SEQ ID NO: 198060 - DNA, 25 bp, Homo sapien
gactccatccgagcccagtttggaa

SEQ ID NO: 198061 - DNA, 25 bp, Homo sapien
atccgagcccagtttggaataagta

SEQ ID NO: 198062 - DNA, 25 bp, Homo sapien
ttgaaaaacattgtccatggagcat

SEQ ID NO: 198063 - DNA, 25 bp, Homo sapien
ttgtccatggagcatctaacgccta

SEQ ID NO: 198064 - DNA, 25 bp, Homo sapien
tggagcatctaacgcctatgaagca

SEQ ID NO: 198065 - DNA, 25 bp, Homo sapien
tagactctttgaggatcctgaggaa

SEQ ID NO: 198066 - DNA, 25 bp, Homo sapien
gataatacatatgttcacgtcaata

SEQ ID NO: 198067 - DNA, 25 bp, Homo sapien
gttcacgtcaatatacaaccatttg

SEQ ID NO: 198068 - DNA, 25 bp, Homo sapien
caaccatttggcacagcttcctggg

SEQ ID NO: 198069 - DNA, 25 bp, Homo sapien
aaaacatgctttggaggaaaactca

SEQ ID NO: 198070 - DNA, 25 bp, Homo sapien
taaactcaggacttgccttgcagat

SEQ ID NO: 198071 - DNA, 25 bp, Homo sapien
tcaggacttgccttgcagataaaat

SEQ ID NO: 198072 - DNA, 25 bp, Homo sapien
ggatttttgcattggcaaagtcaat

SEQ ID NO: 198073 - DNA, 25 bp, Homo sapien
gaacgaaacttccaatggacaccag

SEQ ID NO: 198074 - DNA, 25 bp, Homo sapien
gaacctttaacttggtgcaaagttg

SEQ ID NO: 198075 - DNA, 25 bp, Homo sapien
gtgcaaagttgagcctttgaattct

SEQ ID NO: 198076 - DNA, 25 bp, Homo sapien
attctgcaggtgtcatgtgctggcc

SEQ ID NO: 198077 - DNA, 25 bp, Homo sapien
tggccctgtgattttgcctcccaca

SEQ ID NO: 198078 - DNA, 25 bp, Homo sapien
tcccagcttggagaacacctcagaa

SEQ ID NO: 198079 - DNA, 25 bp, Homo sapien
gagaacacctcagaattcagaagat

SEQ ID NO: 198080 - DNA, 25 bp, Homo sapien
gaacgcattgggaacaattctattt

SEQ ID NO: 198081 - DNA, 25 bp, Homo sapien
ctggcatgggatgggctgggatctt

SEQ ID NO: 198082 - DNA, 25 bp, Homo sapien
tgggatcttctctgtgaatccaccc

SEQ ID NO: 198083 - DNA, 25 bp, Homo sapien
ggatcttctctgtgaatccacccct

SEQ ID NO: 198084 - DNA, 25 bp, Homo sapien
atcttctctgtgaatccacccctgg

SEQ ID NO: 198085 - DNA, 25 bp, Homo sapien
ttctctgtgaatccacccctggcta

SEQ ID NO: 198086 - DNA, 25 bp, Homo sapien
taccccaacggcatcccaaggccag

SEQ ID NO: 198087 - DNA, 25 bp, Homo sapien
tcagctgagggaaggtacgagctcc

SEQ ID NO: 198088 - DNA, 25 bp, Homo sapien
ctgagggaaggtacgagctccctgc

SEQ ID NO: 198089 - DNA, 25 bp, Homo sapien
gaaggtacgagctccctgctggagc

SEQ ID NO: 198090 - DNA, 25 bp, Homo sapien
gtacgagctccctgctggagcctgg

SEQ ID NO: 198091 - DNA, 25 bp, Homo sapien
agcctgggacccatggcacaggcca

SEQ ID NO: 198092 - DNA, 25 bp, Homo sapien
gtgggatacagagccaagcttcaat

SEQ ID NO: 198093 - DNA, 25 bp, Homo sapien
gagccaagcttcaatgtctcttatg

SEQ ID NO: 198094 - DNA, 25 bp, Homo sapien
tcaatgtctcttatgccctgcattt

SEQ ID NO: 198095 - DNA, 25 bp, Homo sapien
ttgtggaaccacatgaaccaggagg

SEQ ID NO: 198096 - DNA, 25 bp, Homo sapien
ttagaggaagcaacacactggtgga

SEQ ID NO: 198097 - DNA, 25 bp, Homo sapien
ggaaaatctctatcgcaagcactgt

SEQ ID NO: 198098 - DNA, 25 bp, Homo sapien
agcactgtcccaggacttacaggga

SEQ ID NO: 198099 - DNA, 25 bp, Homo sapien
cagggacctgattaaaggcccagag

SEQ ID NO: 198100 - DNA, 25 bp, Homo sapien
gagctgggtccaggtaacaaataaa

SEQ ID NO: 198101 - DNA, 25 bp, Homo sapien
aaagctaacactcgtttgctgctgc

SEQ ID NO: 198102 - DNA, 25 bp, Homo sapien
ctatcgagagtggaggcgctactat

SEQ ID NO: 198103 - DNA, 25 bp, Homo sapien
ttacgctgggcatacatatgcacac

SEQ ID NO: 198104 - DNA, 25 bp, Homo sapien
tgcacacaagcatgcacagaggcat

SEQ ID NO: 198105 - DNA, 25 bp, Homo sapien
gggtagtgtatgcagaccttccact

SEQ ID NO: 198106 - DNA, 25 bp, Homo sapien
agaccttccactgggcaaatgccat

SEQ ID NO: 198107 - DNA, 25 bp, Homo sapien
gcaaatgccatgtgtcaggagggaa

SEQ ID NO: 198108 - DNA, 25 bp, Homo sapien
tttattccctcctctaaatgctata

SEQ ID NO: 198109 - DNA, 25 bp, Homo sapien
taaatacgttagcacttgagtcgac

SEQ ID NO: 198110 - DNA, 25 bp, Homo sapien
cacttgagtcgactggaggctgcca

SEQ ID NO: 198111 - DNA, 25 bp, Homo sapien
gaggctgccaggaattcaggatgca

SEQ ID NO: 198112 - DNA, 25 bp, Homo sapien
ggaattcaggatgcatacagctgta

SEQ ID NO: 198113 - DNA, 25 bp, Homo sapien
gtaatttaacccagagcagctccac

SEQ ID NO: 198114 - DNA, 25 bp, Homo sapien
ccagggatgtggcctcattgctgtc

SEQ ID NO: 198115 - DNA, 25 bp, Homo sapien
gggctaaaagggctgtacagttatt

SEQ ID NO: 198116 - DNA, 25 bp, Homo sapien
agggctggccccacaaagggtctcg

SEQ ID NO: 198117 - DNA, 25 bp, Homo sapien
gctggccccacaaagggtctcgtgg

SEQ ID NO: 198118 - DNA, 25 bp, Homo sapien
gggtctcgtggcctttttcctcaca

SEQ ID NO: 198119 - DNA, 25 bp, Homo sapien
tctcgtggcctttttcctcacacag

SEQ ID NO: 198120 - DNA, 25 bp, Homo sapien
tttcctcacacagaagaggtcagca

SEQ ID NO: 198121 - DNA, 25 bp, Homo sapien
tcctcacacagaagaggtcagcaat

SEQ ID NO: 198122 - DNA, 25 bp, Homo sapien
tgtcactgtggacccagtctcactc

SEQ ID NO: 198123 - DNA, 25 bp, Homo sapien
cacacactgaagcagtagcttctgg

SEQ ID NO: 198124 - DNA, 25 bp, Homo sapien
cacactgaagcagtagcttctgggc

SEQ ID NO: 198125 - DNA, 25 bp, Homo sapien
aattagacgagcgtggtggtggaca

SEQ ID NO: 198126 - DNA, 25 bp, Homo sapien
gaggcaggagactagctggaaccag

SEQ ID NO: 198127 - DNA, 25 bp, Homo sapien
aggcaggagactagctggaaccagg

SEQ ID NO: 198128 - DNA, 25 bp, Homo sapien
ggcaggagactagctggaaccaggg

SEQ ID NO: 198129 - DNA, 25 bp, Homo sapien
gcaggagactagctggaaccaggga

SEQ ID NO: 198130 - DNA, 25 bp, Homo sapien
caggagactagctggaaccagggag

SEQ ID NO: 198131 - DNA, 25 bp, Homo sapien
ggagactagctggaaccagggaggt

SEQ ID NO: 198132 - DNA, 25 bp, Homo sapien
gagactagctggaaccagggaggta

SEQ ID NO: 198133 - DNA, 25 bp, Homo sapien
agactagctggaaccagggaggtag

SEQ ID NO: 198134 - DNA, 25 bp, Homo sapien
gactagctggaaccagggaggtaga

SEQ ID NO: 198135 - DNA, 25 bp, Homo sapien
actagctggaaccagggaggtagag

SEQ ID NO: 198136 - DNA, 25 bp, Homo sapien
aagacttcaagggacgattcaaagc

SEQ ID NO: 198137 - DNA, 25 bp, Homo sapien
gattcaaagctcgaccagaactgga

SEQ ID NO: 198138 - DNA, 25 bp, Homo sapien
ctgttggccaagttgaagtagctac

SEQ ID NO: 198139 - DNA, 25 bp, Homo sapien
aagtagctactgtagaccctttcat

SEQ ID NO: 198140 - DNA, 25 bp, Homo sapien
gcttactgggtagttagagttcatc

SEQ ID NO: 198141 - DNA, 25 bp, Homo sapien
gagacccaacccttagatttcataa

SEQ ID NO: 198142 - DNA, 25 bp, Homo sapien
gatttcataagtacccattcccata

SEQ ID NO: 198143 - DNA, 25 bp, Homo sapien
tcccatagccagtaatgtcctcact

SEQ ID NO: 198144 - DNA, 25 bp, Homo sapien
actcctctgtggcttggctgtactt

SEQ ID NO: 198145 - DNA, 25 bp, Homo sapien
gcttggctgtacttgccatttctta

SEQ ID NO: 198146 - DNA, 25 bp, Homo sapien
ccatttcttaccacttacctatgag

SEQ ID NO: 198147 - DNA, 25 bp, Homo sapien
acaagtttctttacaatggaatact

SEQ ID NO: 198148 - DNA, 25 bp, Homo sapien
ggaatactttctatggaatcattat

SEQ ID NO: 198149 - DNA, 25 bp, Homo sapien
ataattctgttgtgtggaactatca

SEQ ID NO: 198150 - DNA, 25 bp, Homo sapien
ggaactatcaagctaagagtcacta

SEQ ID NO: 198151 - DNA, 25 bp, Homo sapien
ggttgtgtgaaatatgacagctttc

SEQ ID NO: 198152 - DNA, 25 bp, Homo sapien
gacagctttctaaattaatttgtat

SEQ ID NO: 198153 - DNA, 25 bp, Homo sapien
ttctctggcaactgtccaactggaa

SEQ ID NO: 198154 - DNA, 25 bp, Homo sapien
gcaactgtccaactggaatccagat

SEQ ID NO: 198155 - DNA, 25 bp, Homo sapien
aaaagctctaagtttcttgcagtct

SEQ ID NO: 198156 - DNA, 25 bp, Homo sapien
ttcttgcagtctttttctcagctta

SEQ ID NO: 198157 - DNA, 25 bp, Homo sapien
cagtctttttctcagcttagttcca

SEQ ID NO: 198158 - DNA, 25 bp, Homo sapien
tctgcatctctaacaactgcacaca

SEQ ID NO: 198159 - DNA, 25 bp, Homo sapien
acaccatgtcactgcttcaagatac

SEQ ID NO: 198160 - DNA, 25 bp, Homo sapien
attttgcctgtggttatcgcgctgg

SEQ ID NO: 198161 - DNA, 25 bp, Homo sapien
tatcgcgctggttgttataacactc

SEQ ID NO: 198162 - DNA, 25 bp, Homo sapien
taacactcttggtatttactctggt

SEQ ID NO: 198163 - DNA, 25 bp, Homo sapien
actctggtgggtttgtatcgaatat

SEQ ID NO: 198164 - DNA, 25 bp, Homo sapien
gagagacccaggcactccagaaaac

SEQ ID NO: 198165 - DNA, 25 bp, Homo sapien
gagagtgtgaagctgctcactgtta

SEQ ID NO: 198166 - DNA, 25 bp, Homo sapien
gctgctcactgttaagacaatctct

SEQ ID NO: 198167 - DNA, 25 bp, Homo sapien
gacaatctctcatgagtctggcgaa

SEQ ID NO: 198168 - DNA, 25 bp, Homo sapien
agtctggcgaacactctgcacaggg

SEQ ID NO: 198169 - DNA, 25 bp, Homo sapien
ttcacacatgtgagatccatgctga

SEQ ID NO: 198170 - DNA, 25 bp, Homo sapien
atggcacagggctagttgccaccaa

SEQ ID NO: 198171 - DNA, 25 bp, Homo sapien
gggctagttgccaccaaccaattta

SEQ ID NO: 198172 - DNA, 25 bp, Homo sapien
atttactgatgaatgaagcccaggg

SEQ ID NO: 198173 - DNA, 25 bp, Homo sapien
agcccaggggactgccattttataa

SEQ ID NO: 198174 - DNA, 25 bp, Homo sapien
agcagttggaaaaatcgtcacgaat

SEQ ID NO: 198175 - DNA, 25 bp, Homo sapien
aatcgtcacgaattgacttagagca

SEQ ID NO: 198176 - DNA, 25 bp, Homo sapien
tgacttagagcaagggtcagcaagc

SEQ ID NO: 198177 - DNA, 25 bp, Homo sapien
tcagcaagcttgtctgtaaagggcc

SEQ ID NO: 198178 - DNA, 25 bp, Homo sapien
gccatagacaacacatacatgaacg

SEQ ID NO: 198179 - DNA, 25 bp, Homo sapien
atgaacgaacgtggctgtattccaa

SEQ ID NO: 198180 - DNA, 25 bp, Homo sapien
tttttaaggctcctctttatctcct

SEQ ID NO: 198181 - DNA, 25 bp, Homo sapien
ttatctcctttcttaaggcactgtt

SEQ ID NO: 198182 - DNA, 25 bp, Homo sapien
aggcactgttgctatggcacttttc

SEQ ID NO: 198183 - DNA, 25 bp, Homo sapien
ggcacttttctataaccttttcatt

SEQ ID NO: 198184 - DNA, 25 bp, Homo sapien
aaccttttcattcctgtgtacagta

SEQ ID NO: 198185 - DNA, 25 bp, Homo sapien
gattgagcataacctacttgtttgt

SEQ ID NO: 198186 - DNA, 25 bp, Homo sapien
ggacttaaaagtactgctggacagg

SEQ ID NO: 198187 - DNA, 25 bp, Homo sapien
tgctggacaggcatgtgtgctcaaa

SEQ ID NO: 198188 - DNA, 25 bp, Homo sapien
gtgctcaaagtacattgattgctca

SEQ ID NO: 198189 - DNA, 25 bp, Homo sapien
gaaatggcccaatgaacgtggttgt

SEQ ID NO: 198190 - DNA, 25 bp, Homo sapien
aggaaacagagctagtcagatgtga

SEQ ID NO: 198191 - DNA, 25 bp, Homo sapien
gcatgacagccttcgaacctgaggc

SEQ ID NO: 198192 - DNA, 25 bp, Homo sapien
catcgattctattttgaaaacctgt

SEQ ID NO: 198193 - DNA, 25 bp, Homo sapien
gaaaacctgtggtcccggaacagca

SEQ ID NO: 198194 - DNA, 25 bp, Homo sapien
tgtggtcccggaacagcaagcccgt

SEQ ID NO: 198195 - DNA, 25 bp, Homo sapien
tgaatccccacatccacctgatggg

SEQ ID NO: 198196 - DNA, 25 bp, Homo sapien
tgatgggcgacgagtcagcctgcat

SEQ ID NO: 198197 - DNA, 25 bp, Homo sapien
gacgagtcagcctgcatcgcctaca

SEQ ID NO: 198198 - DNA, 25 bp, Homo sapien
acgcagtacctggacgctggcggca

SEQ ID NO: 198199 - DNA, 25 bp, Homo sapien
gcccagtcggaggagacccgtgtct

SEQ ID NO: 198200 - DNA, 25 bp, Homo sapien
aaatggcagatcgtccacttccaca

SEQ ID NO: 198201 - DNA, 25 bp, Homo sapien
gatcgtccacttccacagatctggg

SEQ ID NO: 198202 - DNA, 25 bp, Homo sapien
aagagctgcgtggatagattcaaac

SEQ ID NO: 198203 - DNA, 25 bp, Homo sapien
gatagattcaaacttcctgtggtag

SEQ ID NO: 198204 - DNA, 25 bp, Homo sapien
aaacttcctgtggtagtgctcccag

SEQ ID NO: 198205 - DNA, 25 bp, Homo sapien
ttcctgtggtagtgctcccagtctg

SEQ ID NO: 198206 - DNA, 25 bp, Homo sapien
agtctgacctctgtagaccttcagt

SEQ ID NO: 198207 - DNA, 25 bp, Homo sapien
gacctctgtagaccttcagtactca

SEQ ID NO: 198208 - DNA, 25 bp, Homo sapien
tgtagaccttcagtactcactcttc

SEQ ID NO: 198209 - DNA, 25 bp, Homo sapien
agtactcactcttcttgcttaggct

SEQ ID NO: 198210 - DNA, 25 bp, Homo sapien
ttgcttaggctctctgtgtgttgaa

SEQ ID NO: 198211 - DNA, 25 bp, Homo sapien
aattttctgtgatacttgcaattta

SEQ ID NO: 198212 - DNA, 25 bp, Homo sapien
gatacttgcaatttatgtttgagaa

SEQ ID NO: 198213 - DNA, 25 bp, Homo sapien
caaaaatacttctagttatggttgt

SEQ ID NO: 198214 - DNA, 25 bp, Homo sapien
gattacacaatgtttacctatatca

SEQ ID NO: 198215 - DNA, 25 bp, Homo sapien
atcaaatcatcatatcgtatacctt

SEQ ID NO: 198216 - DNA, 25 bp, Homo sapien
tgtgtcaattataactcagtaagtc

SEQ ID NO: 198217 - DNA, 25 bp, Homo sapien
gtctgggaaaatatcgttaagtcaa

SEQ ID NO: 198218 - DNA, 25 bp, Homo sapien
taagtcaaagattagagtcaacaga

SEQ ID NO: 198219 - DNA, 25 bp, Homo sapien
gataacttcaggactaatcaaggat

SEQ ID NO: 198220 - DNA, 25 bp, Homo sapien
gactaatcaaggatcaatgggtgac

SEQ ID NO: 198221 - DNA, 25 bp, Homo sapien
ggatcaatgggtgacatgatatcat

SEQ ID NO: 198222 - DNA, 25 bp, Homo sapien
catgatatcatgctatgtgccattt

SEQ ID NO: 198223 - DNA, 25 bp, Homo sapien
catgctatgtgccattttgtgttaa

SEQ ID NO: 198224 - DNA, 25 bp, Homo sapien
ccagagagggggtgccccatctagc

SEQ ID NO: 198225 - DNA, 25 bp, Homo sapien
agagagggggtgccccatctagctg

SEQ ID NO: 198226 - DNA, 25 bp, Homo sapien
gagagggggtgccccatctagctgg

SEQ ID NO: 198227 - DNA, 25 bp, Homo sapien
agagggggtgccccatctagctggg

SEQ ID NO: 198228 - DNA, 25 bp, Homo sapien
gagggggtgccccatctagctgggt

SEQ ID NO: 198229 - DNA, 25 bp, Homo sapien
agggggtgccccatctagctgggtg

SEQ ID NO: 198230 - DNA, 25 bp, Homo sapien
gggggtgccccatctagctgggtgc

SEQ ID NO: 198231 - DNA, 25 bp, Homo sapien
ggggtgccccatctagctgggtgca

SEQ ID NO: 198232 - DNA, 25 bp, Homo sapien
tgctgttcttgccttacagccacca

SEQ ID NO: 198233 - DNA, 25 bp, Homo sapien
gctgttcttgccttacagccaccat

SEQ ID NO: 198234 - DNA, 25 bp, Homo sapien
ctgttcttgccttacagccaccatg

SEQ ID NO: 198235 - DNA, 25 bp, Homo sapien
aaacaggaaagatatggctgcacca

SEQ ID NO: 198236 - DNA, 25 bp, Homo sapien
gaaagatatggctgcaccatgcagt

SEQ ID NO: 198237 - DNA, 25 bp, Homo sapien
caccatgcagtgctactatatgctg

SEQ ID NO: 198238 - DNA, 25 bp, Homo sapien
catgcagtgctactatatgctgaga

SEQ ID NO: 198239 - DNA, 25 bp, Homo sapien
gtgctactatatgctgagattctac

SEQ ID NO: 198240 - DNA, 25 bp, Homo sapien
gctgagattctacaggatgagattt

SEQ ID NO: 198241 - DNA, 25 bp, Homo sapien
gatgagatttttgaatagctgagca

SEQ ID NO: 198242 - DNA, 25 bp, Homo sapien
atagctgagcagttgcctataatct

SEQ ID NO: 198243 - DNA, 25 bp, Homo sapien
gagcagttgcctataatctgtgatg

SEQ ID NO: 198244 - DNA, 25 bp, Homo sapien
gttgcctataatctgtgatgacata

SEQ ID NO: 198245 - DNA, 25 bp, Homo sapien
gatgacataaaagtatttgacctaa

SEQ ID NO: 198246 - DNA, 25 bp, Homo sapien
tttgcctcagttgaattagtgaaat

SEQ ID NO: 198247 - DNA, 25 bp, Homo sapien
gtgacttctgagtacagttaagttc

SEQ ID NO: 198248 - DNA, 25 bp, Homo sapien
acagttaagttcctcctatttgcca

SEQ ID NO: 198249 - DNA, 25 bp, Homo sapien
ctatttgccactgggctgttggtta

SEQ ID NO: 198250 - DNA, 25 bp, Homo sapien
gtggacacaaactatcctttctcca

SEQ ID NO: 198251 - DNA, 25 bp, Homo sapien
ttctccaccatggactcaatctgag

SEQ ID NO: 198252 - DNA, 25 bp, Homo sapien
gagaacaacagcattcatttccatt

SEQ ID NO: 198253 - DNA, 25 bp, Homo sapien
cattcatttccatactggcttttga

SEQ ID NO: 198254 - DNA, 25 bp, Homo sapien
gcttttgattatatgcagattccta

SEQ ID NO: 198255 - DNA, 25 bp, Homo sapien
agattcctagtagcatgccttacct

SEQ ID NO: 198256 - DNA, 25 bp, Homo sapien
tgccttacctacagcactatgtgca

SEQ ID NO: 198257 - DNA, 25 bp, Homo sapien
gtactgtgttggtgcagatgaggtt

SEQ ID NO: 198258 - DNA, 25 bp, Homo sapien
tactgtgttggtgcagatgaggttt

SEQ ID NO: 198259 - DNA, 25 bp, Homo sapien
actgtgttggtgcagatgaggttta

SEQ ID NO: 198260 - DNA, 25 bp, Homo sapien
ttatatctcattttagcttatttct

SEQ ID NO: 198261 - DNA, 25 bp, Homo sapien
tcttgtacctttcagcatgcctacg

SEQ ID NO: 198262 - DNA, 25 bp, Homo sapien
cttgtacctttcagcatgcctacgc

SEQ ID NO: 198263 - DNA, 25 bp, Homo sapien
ttgtacctttcagcatgcctacgca

SEQ ID NO: 198264 - DNA, 25 bp, Homo sapien
tgtacctttcagcatgcctacgcat

SEQ ID NO: 198265 - DNA, 25 bp, Homo sapien
gtacctttcagcatgcctacgcatt

SEQ ID NO: 198266 - DNA, 25 bp, Homo sapien
tacctttcagcatgcctacgcattc

SEQ ID NO: 198267 - DNA, 25 bp, Homo sapien
acctttcagcatgcctacgcattca

SEQ ID NO: 198268 - DNA, 25 bp, Homo sapien
ctcaagcccgtttagcaatgaggca

SEQ ID NO: 198269 - DNA, 25 bp, Homo sapien
gcaatgaggcagtgtagatgaatac

SEQ ID NO: 198270 - DNA, 25 bp, Homo sapien
ataatgggacttagcactgtatgca

SEQ ID NO: 198271 - DNA, 25 bp, Homo sapien
ggacttagcactgtatgcatactta

SEQ ID NO: 198272 - DNA, 25 bp, Homo sapien
tatatttttctctaacatcatgcta

SEQ ID NO: 198273 - DNA, 25 bp, Homo sapien
tctaacatcatgctatgtgtcagtc

SEQ ID NO: 198274 - DNA, 25 bp, Homo sapien
gctatgtgtcagtctgaacatctga

SEQ ID NO: 198275 - DNA, 25 bp, Homo sapien
tcagtctgaacatctgacaacagaa

SEQ ID NO: 198276 - DNA, 25 bp, Homo sapien
aatttcagttattattctagctaag

SEQ ID NO: 198277 - DNA, 25 bp, Homo sapien
gcaaaccagagatactgactccatt

SEQ ID NO: 198278 - DNA, 25 bp, Homo sapien
agagatactgactccattaataaac

SEQ ID NO: 198279 - DNA, 25 bp, Homo sapien
cggtttaaaccccagttgctgcagg

SEQ ID NO: 198280 - DNA, 25 bp, Homo sapien
ggtttaaaccccagttgctgcaggc

SEQ ID NO: 198281 - DNA, 25 bp, Homo sapien
aaaggataagccagcacttgcaggg

SEQ ID NO: 198282 - DNA, 25 bp, Homo sapien
gccagcacttgcagggggaatttga

SEQ ID NO: 198283 - DNA, 25 bp, Homo sapien
gggaacaattggtaactgtcatggg

SEQ ID NO: 198284 - DNA, 25 bp, Homo sapien
caattggtaactgtcatggggggaa

SEQ ID NO: 198285 - DNA, 25 bp, Homo sapien
ctttaattccagtttaacatctctt

SEQ ID NO: 198286 - DNA, 25 bp, Homo sapien
ttaattccagtttaacatctcttta

SEQ ID NO: 198287 - DNA, 25 bp, Homo sapien
taattccagtttaacatctctttat

SEQ ID NO: 198288 - DNA, 25 bp, Homo sapien
attccagtttaacatctctttattg

SEQ ID NO: 198289 - DNA, 25 bp, Homo sapien
ttccagtttaacatctctttattgc

SEQ ID NO: 198290 - DNA, 25 bp, Homo sapien
ccatcacttgatgggccacacaagt

SEQ ID NO: 198291 - DNA, 25 bp, Homo sapien
ttgatgggccacacaagtttgagag

SEQ ID NO: 198292 - DNA, 25 bp, Homo sapien
gatgggccacacaagtttgagagtg

SEQ ID NO: 198293 - DNA, 25 bp, Homo sapien
cacacaagtttgagagtggtacaag

SEQ ID NO: 198294 - DNA, 25 bp, Homo sapien
gagaagtttgggaaaagccttcttg

SEQ ID NO: 198295 - DNA, 25 bp, Homo sapien
aaatgggacattagcattgagtttt

SEQ ID NO: 198296 - DNA, 25 bp, Homo sapien
gagtaggagtttgctaagaatagat

SEQ ID NO: 198297 - DNA, 25 bp, Homo sapien
gacagcaggataaacattccagaga

SEQ ID NO: 198298 - DNA, 25 bp, Homo sapien
attccagagaaaatcatgtttattc

SEQ ID NO: 198299 - DNA, 25 bp, Homo sapien
acctaggaggatgcctaacagagag

SEQ ID NO: 198300 - DNA, 25 bp, Homo sapien
atgcctaacagagagtaagcactta

SEQ ID NO: 198301 - DNA, 25 bp, Homo sapien
gacctgcagcaagtactgcaagacc

SEQ ID NO: 198302 - DNA, 25 bp, Homo sapien
gcagcaagtactgcaagaccaaggc

SEQ ID NO: 198303 - DNA, 25 bp, Homo sapien
aaggcctggaccgagttccacaaga

SEQ ID NO: 198304 - DNA, 25 bp, Homo sapien
ggcctggaccgagttccacaagaag

SEQ ID NO: 198305 - DNA, 25 bp, Homo sapien
tggaccgagttccacaagaaggact

SEQ ID NO: 198306 - DNA, 25 bp, Homo sapien
gaccgagttccacaagaaggactgc

SEQ ID NO: 198307 - DNA, 25 bp, Homo sapien
cgagttccacaagaaggactgcggg

SEQ ID NO: 198308 - DNA, 25 bp, Homo sapien
gaggagagaagaattccagtgaagc

SEQ ID NO: 198309 - DNA, 25 bp, Homo sapien
gaagcagcagctgcacgtccgaggc

SEQ ID NO: 198310 - DNA, 25 bp, Homo sapien
agcagcagctgcacgtccgaggctt

SEQ ID NO: 198311 - DNA, 25 bp, Homo sapien
ggtttcttacctgcctgagccacct

SEQ ID NO: 198312 - DNA, 25 bp, Homo sapien
gaatcaaacctttccagtgcccgga

SEQ ID NO: 198313 - DNA, 25 bp, Homo sapien
cagtgcccggactgtgaccgcagct

SEQ ID NO: 198314 - DNA, 25 bp, Homo sapien
agcttctcccgttctgaccatcttg

SEQ ID NO: 198315 - DNA, 25 bp, Homo sapien
ggaaacgccacatgctagtctgatt

SEQ ID NO: 198316 - DNA, 25 bp, Homo sapien
atgctagtctgattgcctctgtgtc

SEQ ID NO: 198317 - DNA, 25 bp, Homo sapien
tgcctcccattatctaacacatttt

SEQ ID NO: 198318 - DNA, 25 bp, Homo sapien
gtacattttaatttgattcagctgg

SEQ ID NO: 198319 - DNA, 25 bp, Homo sapien
ttcagctggtctgaatctctgaatt

SEQ ID NO: 198320 - DNA, 25 bp, Homo sapien
gaatttatatcatccaaaacttcca

SEQ ID NO: 198321 - DNA, 25 bp, Homo sapien
aaaacttccatatggtcagtagtag

SEQ ID NO: 198322 - DNA, 25 bp, Homo sapien
tagtagatgttctctaatcctccct

SEQ ID NO: 198323 - DNA, 25 bp, Homo sapien
ctgctcagagaaggtgtcagccaca

SEQ ID NO: 198324 - DNA, 25 bp, Homo sapien
gtgtcagccacaagagaagagctct

SEQ ID NO: 198325 - DNA, 25 bp, Homo sapien
agaagagctctagtcctggactcta

SEQ ID NO: 198326 - DNA, 25 bp, Homo sapien
agagctctagtcctggactctaccc

SEQ ID NO: 198327 - DNA, 25 bp, Homo sapien
gactctaccctcctctgaaagaagc

SEQ ID NO: 198328 - DNA, 25 bp, Homo sapien
tctaccctcctctgaaagaagctgg

SEQ ID NO: 198329 - DNA, 25 bp, Homo sapien
gggcttgctctgacggtctccactc

SEQ ID NO: 198330 - DNA, 25 bp, Homo sapien
gcactcgggcctgggtgggagtcaa

SEQ ID NO: 198331 - DNA, 25 bp, Homo sapien
ataaaacccagtgacctcacttctt

SEQ ID NO: 198332 - DNA, 25 bp, Homo sapien
ccagtgacctcacttcttttctctg

SEQ ID NO: 198333 - DNA, 25 bp, Homo sapien
gtgcagacattggtgtttctgctga

SEQ ID NO: 198334 - DNA, 25 bp, Homo sapien
tctgggtccagggtgcaacagagaa

SEQ ID NO: 198335 - DNA, 25 bp, Homo sapien
agggtgcaacagagaaaaacttcat

SEQ ID NO: 198336 - DNA, 25 bp, Homo sapien
acttcatgcatgaatgagcattccc

SEQ ID NO: 198337 - DNA, 25 bp, Homo sapien
atgaatgagcattcccagggaaact

SEQ ID NO: 198338 - DNA, 25 bp, Homo sapien
agcattcccagggaaactgccttgg

SEQ ID NO: 198339 - DNA, 25 bp, Homo sapien
tgcgccatcaggaggagagaagcta

SEQ ID NO: 198340 - DNA, 25 bp, Homo sapien
acatggagggccgttgttgcctctc

SEQ ID NO: 198341 - DNA, 25 bp, Homo sapien
gtttctcctcagtctcctgtccaat

SEQ ID NO: 198342 - DNA, 25 bp, Homo sapien
agtctcctgtccaatttcttgctgg

SEQ ID NO: 198343 - DNA, 25 bp, Homo sapien
ctgtccaatttcttgctggtggtca

SEQ ID NO: 198344 - DNA, 25 bp, Homo sapien
caggagggaaggaagctttacctgt

SEQ ID NO: 198345 - DNA, 25 bp, Homo sapien
ggcacatgatggctccgctacttac

SEQ ID NO: 198346 - DNA, 25 bp, Homo sapien
tgatggctccgctacttacttgaga

SEQ ID NO: 198347 - DNA, 25 bp, Homo sapien
ggctccgctacttacttgagattca

SEQ ID NO: 198348 - DNA, 25 bp, Homo sapien
tccgctacttacttgagattcatta

SEQ ID NO: 198349 - DNA, 25 bp, Homo sapien
gagattcattattgtatcagccttt

SEQ ID NO: 198350 - DNA, 25 bp, Homo sapien
gtatcagcctttgatcattttgcat

SEQ ID NO: 198351 - DNA, 25 bp, Homo sapien
cagcctttgatcattttgcatctgt

SEQ ID NO: 198352 - DNA, 25 bp, Homo sapien
aatctttcctcataatgataacaaa

SEQ ID NO: 198353 - DNA, 25 bp, Homo sapien
aatgataacaaaatgctcttgcatg

SEQ ID NO: 198354 - DNA, 25 bp, Homo sapien
aatgctcttgcatgattttttaaca

SEQ ID NO: 198355 - DNA, 25 bp, Homo sapien
ggaagttgtcactgatatactttat

SEQ ID NO: 198356 - DNA, 25 bp, Homo sapien
cttccacccgggaatgctgcagcgg

SEQ ID NO: 198357 - DNA, 25 bp, Homo sapien
ttccacccgggaatgctgcagcggc

SEQ ID NO: 198358 - DNA, 25 bp, Homo sapien
tccacccgggaatgctgcagcggcg

SEQ ID NO: 198359 - DNA, 25 bp, Homo sapien
acccgggaatgctgcagcggcgcgg

SEQ ID NO: 198360 - DNA, 25 bp, Homo sapien
ccgggaatgctgcagcggcgcggcg

SEQ ID NO: 198361 - DNA, 25 bp, Homo sapien
gcggcgggggctcgcggaccggctc

SEQ ID NO: 198362 - DNA, 25 bp, Homo sapien
ggctccctcagcgactacagccgct

SEQ ID NO: 198363 - DNA, 25 bp, Homo sapien
tcagcgactacagccgctccgacgc

SEQ ID NO: 198364 - DNA, 25 bp, Homo sapien
actacagccgctccgacgccagcag

SEQ ID NO: 198365 - DNA, 25 bp, Homo sapien
atcagcccggccagctcgccctgag

SEQ ID NO: 198366 - DNA, 25 bp, Homo sapien
cctgagcccgcacagccatgagcag

SEQ ID NO: 198367 - DNA, 25 bp, Homo sapien
accatatgaagctagaaaatgcaca

SEQ ID NO: 198368 - DNA, 25 bp, Homo sapien
gaaaatgcacaaacgatattcctta

SEQ ID NO: 198369 - DNA, 25 bp, Homo sapien
gcacaaacgatattccttatctgta

SEQ ID NO: 198370 - DNA, 25 bp, Homo sapien
tgcaattgtcagatcttgattaaac

SEQ ID NO: 198371 - DNA, 25 bp, Homo sapien
gatcttgattaaactggttgtctta

SEQ ID NO: 198372 - DNA, 25 bp, Homo sapien
gattaaactggttgtcttatttctt

SEQ ID NO: 198373 - DNA, 25 bp, Homo sapien
ttcttctcatcattaacggaaaaaa

SEQ ID NO: 198374 - DNA, 25 bp, Homo sapien
ctatctttgatatctaagtgttttg

SEQ ID NO: 198375 - DNA, 25 bp, Homo sapien
aaactgaattttatctgctatacca

SEQ ID NO: 198376 - DNA, 25 bp, Homo sapien
tatctgctataccagttatttgaga

SEQ ID NO: 198377 - DNA, 25 bp, Homo sapien
gacaaaagtataatttccagtgatt

SEQ ID NO: 198378 - DNA, 25 bp, Homo sapien
ggttgtgtctgacctgacataccct

SEQ ID NO: 198379 - DNA, 25 bp, Homo sapien
gtctgacctgacataccctgcagct

SEQ ID NO: 198380 - DNA, 25 bp, Homo sapien
tctcagctggctgcagtaacatttt

SEQ ID NO: 198381 - DNA, 25 bp, Homo sapien
gaaatgattgtctcttggttctcag

SEQ ID NO: 198382 - DNA, 25 bp, Homo sapien
ttggttctcagtttttagcccttga

SEQ ID NO: 198383 - DNA, 25 bp, Homo sapien
tagcccttgagaggacatacttttc

SEQ ID NO: 198384 - DNA, 25 bp, Homo sapien
aggacatacttttccagcctcatgg

SEQ ID NO: 198385 - DNA, 25 bp, Homo sapien
agcctcatgggtatggcactcttaa

SEQ ID NO: 198386 - DNA, 25 bp, Homo sapien
gggtatggcactcttaattaaaatt

SEQ ID NO: 198387 - DNA, 25 bp, Homo sapien
aatttcagtgactgtttactggatg

SEQ ID NO: 198388 - DNA, 25 bp, Homo sapien
ctggatgaggcagatttttcacatt

SEQ ID NO: 198389 - DNA, 25 bp, Homo sapien
atgtcattgcttctccggtgcctcc

SEQ ID NO: 198390 - DNA, 25 bp, Homo sapien
gcatcgccggccctggtttctctgg

SEQ ID NO: 198391 - DNA, 25 bp, Homo sapien
gggacttttctttgtgtgcgagagt

SEQ ID NO: 198392 - DNA, 25 bp, Homo sapien
tgtgtgcgagagtgtgtttcctttc

SEQ ID NO: 198393 - DNA, 25 bp, Homo sapien
agagtgtgtttcctttcgtgtctgc

SEQ ID NO: 198394 - DNA, 25 bp, Homo sapien
gggtcccttctgtcggtctgtctgt

SEQ ID NO: 198395 - DNA, 25 bp, Homo sapien
ttctgtcggtctgtctgttctgccc

SEQ ID NO: 198396 - DNA, 25 bp, Homo sapien
tttcgttttccggagacttgttgag

SEQ ID NO: 198397 - DNA, 25 bp, Homo sapien
gaaatacgaccccacagactgcgag

SEQ ID NO: 198398 - DNA, 25 bp, Homo sapien
agactgcgagactgaaccgccgcta

SEQ ID NO: 198399 - DNA, 25 bp, Homo sapien
tgaaccgccgctacaagccaaagat

SEQ ID NO: 198400 - DNA, 25 bp, Homo sapien
aaacccactatgctataagttaggc

SEQ ID NO: 198401 - DNA, 25 bp, Homo sapien
ctatgctataagttaggccatctaa

SEQ ID NO: 198402 - DNA, 25 bp, Homo sapien
gttaggccatctaaaacagattatt

SEQ ID NO: 198403 - DNA, 25 bp, Homo sapien
aaagaggttcatgttaaaaggcatt

SEQ ID NO: 198404 - DNA, 25 bp, Homo sapien
taatacaagaacgatttccctgcat

SEQ ID NO: 198405 - DNA, 25 bp, Homo sapien
tacaagaacgatttccctgcataat

SEQ ID NO: 198406 - DNA, 25 bp, Homo sapien
gaacgatttccctgcataattttag

SEQ ID NO: 198407 - DNA, 25 bp, Homo sapien
gatttccctgcataattttagtact

SEQ ID NO: 198408 - DNA, 25 bp, Homo sapien
ccctgcataattttagtacttgaat

SEQ ID NO: 198409 - DNA, 25 bp, Homo sapien
gaataagtatgcagcagaactccaa

SEQ ID NO: 198410 - DNA, 25 bp, Homo sapien
cagcagaactccaactatctttttt

SEQ ID NO: 198411 - DNA, 25 bp, Homo sapien
gagacgcccctgctgacgaggaaaa

SEQ ID NO: 198412 - DNA, 25 bp, Homo sapien
agacgcccctgctgacgaggaaaat

SEQ ID NO: 198413 - DNA, 25 bp, Homo sapien
gacgcccctgctgacgaggaaaatg

SEQ ID NO: 198414 - DNA, 25 bp, Homo sapien
acgcccctgctgacgaggaaaatgg

SEQ ID NO: 198415 - DNA, 25 bp, Homo sapien
cgcccctgctgacgaggaaaatggg

SEQ ID NO: 198416 - DNA, 25 bp, Homo sapien
gcaagaggctgacaatgaagtagat

SEQ ID NO: 198417 - DNA, 25 bp, Homo sapien
caagaggctgacaatgaagtagatg

SEQ ID NO: 198418 - DNA, 25 bp, Homo sapien
aagaggctgacaatgaagtagatga

SEQ ID NO: 198419 - DNA, 25 bp, Homo sapien
agaggctgacaatgaagtagatgaa

SEQ ID NO: 198420 - DNA, 25 bp, Homo sapien
ctgacaatgaagtagatgaagaaca

SEQ ID NO: 198421 - DNA, 25 bp, Homo sapien
gacaatgaagtagatgaagaacagg

SEQ ID NO: 198422 - DNA, 25 bp, Homo sapien
atattctctctcagaaatcaatggc

SEQ ID NO: 198423 - DNA, 25 bp, Homo sapien
tattctctctcagaaatcaatggca

SEQ ID NO: 198424 - DNA, 25 bp, Homo sapien
ttctctctcagaaatcaatggcatt

SEQ ID NO: 198425 - DNA, 25 bp, Homo sapien
tctctctcagaaatcaatggcattt

SEQ ID NO: 198426 - DNA, 25 bp, Homo sapien
ctctctcagaaatcaatggcatttg

SEQ ID NO: 198427 - DNA, 25 bp, Homo sapien
tctctcagaaatcaatggcatttga

SEQ ID NO: 198428 - DNA, 25 bp, Homo sapien
tcaatggcatttgaaccaccaaaaa

SEQ ID NO: 198429 - DNA, 25 bp, Homo sapien
aatggcatttgaaccaccaaaaaga

SEQ ID NO: 198430 - DNA, 25 bp, Homo sapien
aaataaagggctgagtgtggtgctc

SEQ ID NO: 198431 - DNA, 25 bp, Homo sapien
ataaagggctgagtgtggtgctcac

SEQ ID NO: 198432 - DNA, 25 bp, Homo sapien
taaagggctgagtgtggtgctcacg

SEQ ID NO: 198433 - DNA, 25 bp, Homo sapien
ttttgtgatctgtaacagggtagtg

SEQ ID NO: 198434 - DNA, 25 bp, Homo sapien
ggtagtgtggtattgtaataggcat

SEQ ID NO: 198435 - DNA, 25 bp, Homo sapien
atgtgcaataactcagcagttaaat

SEQ ID NO: 198436 - DNA, 25 bp, Homo sapien
gaacaaaattgaagggtggtcagta

SEQ ID NO: 198437 - DNA, 25 bp, Homo sapien
ggtcagtagtttcatttccttgtcc

SEQ ID NO: 198438 - DNA, 25 bp, Homo sapien
gtcagtagtttcatttccttgtcct

SEQ ID NO: 198439 - DNA, 25 bp, Homo sapien
agtagtttcatttccttgtcctgct

SEQ ID NO: 198440 - DNA, 25 bp, Homo sapien
gtagtttcatttccttgtcctgctt

SEQ ID NO: 198441 - DNA, 25 bp, Homo sapien
tttcatttccttgtcctgcttattc

SEQ ID NO: 198442 - DNA, 25 bp, Homo sapien
acctggctttgcttagcttgttgaa

SEQ ID NO: 198443 - DNA, 25 bp, Homo sapien
ggctttgcttagcttgttgaagaaa

SEQ ID NO: 198444 - DNA, 25 bp, Homo sapien
gaatttcccaaagggatccttccat

SEQ ID NO: 198445 - DNA, 25 bp, Homo sapien
agggatccttccattcaggacatca

SEQ ID NO: 198446 - DNA, 25 bp, Homo sapien
ttccattcaggacatcataagggtg

SEQ ID NO: 198447 - DNA, 25 bp, Homo sapien
gatgacagagtcagtcgacaaagac

SEQ ID NO: 198448 - DNA, 25 bp, Homo sapien
gaaacactccagtttgctagcaggt

SEQ ID NO: 198449 - DNA, 25 bp, Homo sapien
actccagtttgctagcaggtgaaca

SEQ ID NO: 198450 - DNA, 25 bp, Homo sapien
caggtgaacacaagcaaagacttat

SEQ ID NO: 198451 - DNA, 25 bp, Homo sapien
atgagcatagcaaaggtcagggctt

SEQ ID NO: 198452 - DNA, 25 bp, Homo sapien
ggtcagggcttaatgcccaatgccc

SEQ ID NO: 198453 - DNA, 25 bp, Homo sapien
cctcactagggcattggtttaagtc

SEQ ID NO: 198454 - DNA, 25 bp, Homo sapien
ctttaggtaagagggacagctggct

SEQ ID NO: 198455 - DNA, 25 bp, Homo sapien
tctggtgggccaagaacccacccaa

SEQ ID NO: 198456 - DNA, 25 bp, Homo sapien
gggccaagaacccacccaacagaat

SEQ ID NO: 198457 - DNA, 25 bp, Homo sapien
gccaagaacccacccaacagaatag

SEQ ID NO: 198458 - DNA, 25 bp, Homo sapien
gaacccacccaacagaataggccag

SEQ ID NO: 198459 - DNA, 25 bp, Homo sapien
acccaacagaataggccagcccatg

SEQ ID NO: 198460 - DNA, 25 bp, Homo sapien
aacagaataggccagcccatgccag

SEQ ID NO: 198461 - DNA, 25 bp, Homo sapien
acagaataggccagcccatgccagc

SEQ ID NO: 198462 - DNA, 25 bp, Homo sapien
gaataggccagcccatgccagccgg

SEQ ID NO: 198463 - DNA, 25 bp, Homo sapien
ctctgagaagccctgagctaccttg

SEQ ID NO: 198464 - DNA, 25 bp, Homo sapien
ctgagaagccctgagctaccttggg

SEQ ID NO: 198465 - DNA, 25 bp, Homo sapien
cagctgagcccctcaccgggaagga

SEQ ID NO: 198466 - DNA, 25 bp, Homo sapien
gacacagagcaagacaataacatca

SEQ ID NO: 198467 - DNA, 25 bp, Homo sapien
taacatcacaagctaaaagccagag

SEQ ID NO: 198468 - DNA, 25 bp, Homo sapien
aacatccttgttggagtaagacagt

SEQ ID NO: 198469 - DNA, 25 bp, Homo sapien
gacagtaaatatcagccttgcagca

SEQ ID NO: 198470 - DNA, 25 bp, Homo sapien
gtaaatatcagccttgcagcaagac

SEQ ID NO: 198471 - DNA, 25 bp, Homo sapien
tgcagcaagacagctctgagcagct

SEQ ID NO: 198472 - DNA, 25 bp, Homo sapien
gtgcaaggagactgtctgcagctta

SEQ ID NO: 198473 - DNA, 25 bp, Homo sapien
gactgtctgcagcttagggcagaaa

SEQ ID NO: 198474 - DNA, 25 bp, Homo sapien
gggatccaacttgtgaaatgcttca

SEQ ID NO: 198475 - DNA, 25 bp, Homo sapien
tgtgaaatgcttcatgttttacaaa

SEQ ID NO: 198476 - DNA, 25 bp, Homo sapien
agtcgggtagcaacaaacttattgt

SEQ ID NO: 198477 - DNA, 25 bp, Homo sapien
ttagacctggattgaattgggccct

SEQ ID NO: 198478 - DNA, 25 bp, Homo sapien
acctggattgaattgggccctgttg

SEQ ID NO: 198479 - DNA, 25 bp, Homo sapien
tgaattgggccctgttgtttcctgg

SEQ ID NO: 198480 - DNA, 25 bp, Homo sapien
gccctgttgtttcctgggatcttgg

SEQ ID NO: 198481 - DNA, 25 bp, Homo sapien
aacagcctggcatcttcttgtttct

SEQ ID NO: 198482 - DNA, 25 bp, Homo sapien
gcctggcatcttcttgtttctctgt

SEQ ID NO: 198483 - DNA, 25 bp, Homo sapien
tttctctgtgtgtttactcattcat

SEQ ID NO: 198484 - DNA, 25 bp, Homo sapien
ttattcagctgataaatattgactg

SEQ ID NO: 198485 - DNA, 25 bp, Homo sapien
attgactgatgccagctctgtgcca

SEQ ID NO: 198486 - DNA, 25 bp, Homo sapien
ggatacactagtgggcagaaatagc

SEQ ID NO: 198487 - DNA, 25 bp, Homo sapien
gtgggcagaaatagccccgtcccag

SEQ ID NO: 198488 - DNA, 25 bp, Homo sapien
gatcctttctacaatgaatccttca

SEQ ID NO: 198489 - DNA, 25 bp, Homo sapien
cttcagcttcaaagttccccaagaa

SEQ ID NO: 198490 - DNA, 25 bp, Homo sapien
tggaaaatgccagcctagtgtttac

SEQ ID NO: 198491 - DNA, 25 bp, Homo sapien
tagtgtttacagttttcggccacaa

SEQ ID NO: 198492 - DNA, 25 bp, Homo sapien
gttttcggccacaacatgaagagca

SEQ ID NO: 198493 - DNA, 25 bp, Homo sapien
gcagcaatgacttcatcgggaggat

SEQ ID NO: 198494 - DNA, 25 bp, Homo sapien
gggaggatcgtcattggccagtact

SEQ ID NO: 198495 - DNA, 25 bp, Homo sapien
tgagaccaaccactggaggcgcatg

SEQ ID NO: 198496 - DNA, 25 bp, Homo sapien
cgcacagccgtggagcagtggcata

SEQ ID NO: 198497 - DNA, 25 bp, Homo sapien
agtggcatagcctgaggtcccgagc

SEQ ID NO: 198498 - DNA, 25 bp, Homo sapien
ccgagctgagtgtgaccgcgtgtct

SEQ ID NO: 198499 - DNA, 25 bp, Homo sapien
tccactttcttgtttaatataccag

SEQ ID NO: 198500 - DNA, 25 bp, Homo sapien
aatataccagatacatagcaaaagc

SEQ ID NO: 198501 - DNA, 25 bp, Homo sapien
atagctgtttatttggctgtgctca

SEQ ID NO: 198502 - DNA, 25 bp, Homo sapien
ttaagatcttgtactgtgtaacagt

SEQ ID NO: 198503 - DNA, 25 bp, Homo sapien
gtgtaacagtaactcttttttgctt

SEQ ID NO: 198504 - DNA, 25 bp, Homo sapien
cagtaatttaatatgttcacttaac

SEQ ID NO: 198505 - DNA, 25 bp, Homo sapien
aaatacgaactttgagatgcactaa

SEQ ID NO: 198506 - DNA, 25 bp, Homo sapien
ctttgagatgcactaaagttttgtt

SEQ ID NO: 198507 - DNA, 25 bp, Homo sapien
gcaattaattgttcttttatcttac

SEQ ID NO: 198508 - DNA, 25 bp, Homo sapien
tgttcttttatcttacaattgttta

SEQ ID NO: 198509 - DNA, 25 bp, Homo sapien
ttgtttaagcctgtgatctttcttc

SEQ ID NO: 198510 - DNA, 25 bp, Homo sapien
gtggagcaagagatcctggtcccct

SEQ ID NO: 198511 - DNA, 25 bp, Homo sapien
ttcctgcctagtcccactgggctgg

SEQ ID NO: 198512 - DNA, 25 bp, Homo sapien
acagtctgtgcctgtagcctcatga

SEQ ID NO: 198513 - DNA, 25 bp, Homo sapien
aggcatggctaacccctgactgctt

SEQ ID NO: 198514 - DNA, 25 bp, Homo sapien
ccctgactgcttgcctcatatttaa

SEQ ID NO: 198515 - DNA, 25 bp, Homo sapien
gactgcttgcctcatatttaagctg

SEQ ID NO: 198516 - DNA, 25 bp, Homo sapien
tgcctcatatttaagctgctgctct

SEQ ID NO: 198517 - DNA, 25 bp, Homo sapien
ctcatatttaagctgctgctctggc

SEQ ID NO: 198518 - DNA, 25 bp, Homo sapien
tgctgctctggccaagtgcctaatt

SEQ ID NO: 198519 - DNA, 25 bp, Homo sapien
ggccaagtgcctaattttaacccag

SEQ ID NO: 198520 - DNA, 25 bp, Homo sapien
gcctaattttaacccagacctcaat

SEQ ID NO: 198521 - DNA, 25 bp, Homo sapien
gaggatatggtactcctgatggttt

SEQ ID NO: 198522 - DNA, 25 bp, Homo sapien
tatggtactcctgatggtttgggtg

SEQ ID NO: 198523 - DNA, 25 bp, Homo sapien
ttactatgggcaaggcggcatgagt

SEQ ID NO: 198524 - DNA, 25 bp, Homo sapien
ggtggatggcgtgggatgtactgaa

SEQ ID NO: 198525 - DNA, 25 bp, Homo sapien
aaaacaccaacatacaagtcttgac

SEQ ID NO: 198526 - DNA, 25 bp, Homo sapien
aagtcttgacaacagcatctggtct

SEQ ID NO: 198527 - DNA, 25 bp, Homo sapien
gacaacagcatctggtctactagac

SEQ ID NO: 198528 - DNA, 25 bp, Homo sapien
gcatctggtctactagactttctta

SEQ ID NO: 198529 - DNA, 25 bp, Homo sapien
ggtctactagactttcttacagatt

SEQ ID NO: 198530 - DNA, 25 bp, Homo sapien
gactttcttacagatttaatttctt

SEQ ID NO: 198531 - DNA, 25 bp, Homo sapien
ataatgactgaaggaatgtgttttc

SEQ ID NO: 198532 - DNA, 25 bp, Homo sapien
aaaccctgtttcacaatctgtgcgg

SEQ ID NO: 198533 - DNA, 25 bp, Homo sapien
atctgtgcggaagtagcttgcctca

SEQ ID NO: 198534 - DNA, 25 bp, Homo sapien
cttgcctcacttctgcttaggaaag

SEQ ID NO: 198535 - DNA, 25 bp, Homo sapien
ttaggaaagcggctgttgctccata

SEQ ID NO: 198536 - DNA, 25 bp, Homo sapien
agcggctgttgctccataactctaa

SEQ ID NO: 198537 - DNA, 25 bp, Homo sapien
cataactctaaccagcacagggctg

SEQ ID NO: 198538 - DNA, 25 bp, Homo sapien
gaggcccttcccaaggtgtggtgac

SEQ ID NO: 198539 - DNA, 25 bp, Homo sapien
gtgtggtgactgtgccttactgtac

SEQ ID NO: 198540 - DNA, 25 bp, Homo sapien
tgtgccttactgtacatgctcggag

SEQ ID NO: 198541 - DNA, 25 bp, Homo sapien
gtacatgctcggaggcctggccata

SEQ ID NO: 198542 - DNA, 25 bp, Homo sapien
tactttctggagtaatcaggtggaa

SEQ ID NO: 198543 - DNA, 25 bp, Homo sapien
cacctgcggaacctgtgtttcctgg

SEQ ID NO: 198544 - DNA, 25 bp, Homo sapien
aacctgtgtttcctggcgcaggaga

SEQ ID NO: 198545 - DNA, 25 bp, Homo sapien
atggacagggccacgacagggctct

SEQ ID NO: 198546 - DNA, 25 bp, Homo sapien
cacgacagggctctgagaggctcat

SEQ ID NO: 198547 - DNA, 25 bp, Homo sapien
tgagaggctcatccctcagtggcaa

SEQ ID NO: 198548 - DNA, 25 bp, Homo sapien
tcatccctcagtggcaacagaaaca

SEQ ID NO: 198549 - DNA, 25 bp, Homo sapien
ctggaagacttggaacctcaaagct

SEQ ID NO: 198550 - DNA, 25 bp, Homo sapien
gaacctcaaagcttgtattccatct

SEQ ID NO: 198551 - DNA, 25 bp, Homo sapien
gtattccatctgctgtagcaatggc

SEQ ID NO: 198552 - DNA, 25 bp, Homo sapien
tagcaatggctaaagggtcaagatc

SEQ ID NO: 198553 - DNA, 25 bp, Homo sapien
ggtcaagatcttagctgtatggagt

SEQ ID NO: 198554 - DNA, 25 bp, Homo sapien
aagagctcccaaagcctgagaccag

SEQ ID NO: 198555 - DNA, 25 bp, Homo sapien
agctcccaaagcctgagaccagggt

SEQ ID NO: 198556 - DNA, 25 bp, Homo sapien
tgagaccagggtcatttgtccccaa

SEQ ID NO: 198557 - DNA, 25 bp, Homo sapien
agaccagggtcatttgtccccaact

SEQ ID NO: 198558 - DNA, 25 bp, Homo sapien
ctgttgctagtacctgttatttatt

SEQ ID NO: 198559 - DNA, 25 bp, Homo sapien
gctagtacctgttatttattacctg

SEQ ID NO: 198560 - DNA, 25 bp, Homo sapien
agtacctgttatttattacctggag

SEQ ID NO: 198561 - DNA, 25 bp, Homo sapien
ctgttatttattacctggaggcctg

SEQ ID NO: 198562 - DNA, 25 bp, Homo sapien
tatttattacctggaggcctgtcca

SEQ ID NO: 198563 - DNA, 25 bp, Homo sapien
ttattacctggaggcctgtccagca

SEQ ID NO: 198564 - DNA, 25 bp, Homo sapien
agggggaatcccgtacctgctgctg

SEQ ID NO: 198565 - DNA, 25 bp, Homo sapien
ggtcctggccattcggagtcgatat

SEQ ID NO: 198566 - DNA, 25 bp, Homo sapien
tcggagtcgatatgtgctggaagct

SEQ ID NO: 198567 - DNA, 25 bp, Homo sapien
tgctggaagctgcagtctacacctt

SEQ ID NO: 198568 - DNA, 25 bp, Homo sapien
atgttcttctccacggtatgcggtg

SEQ ID NO: 198569 - DNA, 25 bp, Homo sapien
tatgcggtggtgtctgcatcttatc

SEQ ID NO: 198570 - DNA, 25 bp, Homo sapien
gcatcttatcactgggtgcttgtgc

SEQ ID NO: 198571 - DNA, 25 bp, Homo sapien
catggtggtgggtcacagtctgtat

SEQ ID NO: 198572 - DNA, 25 bp, Homo sapien
agtctgtatttccaccacgttctcc

SEQ ID NO: 198573 - DNA, 25 bp, Homo sapien
cacgttctccgagggtttgggaatg

SEQ ID NO: 198574 - DNA, 25 bp, Homo sapien
gccttcactgtgtcttctacagaca

SEQ ID NO: 198575 - DNA, 25 bp, Homo sapien
gtgcttcccaaactgtcatgcatag

SEQ ID NO: 198576 - DNA, 25 bp, Homo sapien
ggagcagcacggacacggcatccat

SEQ ID NO: 198577 - DNA, 25 bp, Homo sapien
gcacggacacggcatccatctttgg

SEQ ID NO: 198578 - DNA, 25 bp, Homo sapien
acggacacggcatccatctttggca

SEQ ID NO: 198579 - DNA, 25 bp, Homo sapien
ctttggcatcataccagacattatt

SEQ ID NO: 198580 - DNA, 25 bp, Homo sapien
caccccagatcgaatgaacttggca

SEQ ID NO: 198581 - DNA, 25 bp, Homo sapien
cccagatcgaatgaacttggcagaa

SEQ ID NO: 198582 - DNA, 25 bp, Homo sapien
gtttagaaaagtatacaagcgtgtt

SEQ ID NO: 198583 - DNA, 25 bp, Homo sapien
gtatataaatctaagactgcctgtg

SEQ ID NO: 198584 - DNA, 25 bp, Homo sapien
ataaatctaagactgcctgtgtgat

SEQ ID NO: 198585 - DNA, 25 bp, Homo sapien
aaatctaagactgcctgtgtgataa

SEQ ID NO: 198586 - DNA, 25 bp, Homo sapien
tctaagactgcctgtgtgataaaac

SEQ ID NO: 198587 - DNA, 25 bp, Homo sapien
tggaattcagtcacaaggagttgtt

SEQ ID NO: 198588 - DNA, 25 bp, Homo sapien
tagagactatacaagcacagctgga

SEQ ID NO: 198589 - DNA, 25 bp, Homo sapien
aagcacagctggattcccttacatg

SEQ ID NO: 198590 - DNA, 25 bp, Homo sapien
gctggattcccttacatgatgtttt

SEQ ID NO: 198591 - DNA, 25 bp, Homo sapien
catgatgttttcgaagactgttttt

SEQ ID NO: 198592 - DNA, 25 bp, Homo sapien
aagactgtttttttcatcacgctcc

SEQ ID NO: 198593 - DNA, 25 bp, Homo sapien
tcctgccacctcattattttgcatt

SEQ ID NO: 198594 - DNA, 25 bp, Homo sapien
gatacattgccaggttgtgttttct

SEQ ID NO: 198595 - DNA, 25 bp, Homo sapien
ccaggttgtgttttctgaaggattc

SEQ ID NO: 198596 - DNA, 25 bp, Homo sapien
ggattcagtgacttgctttctgtaa

SEQ ID NO: 198597 - DNA, 25 bp, Homo sapien
atatggcttatcacttcttagacaa

SEQ ID NO: 198598 - DNA, 25 bp, Homo sapien
gtcaagtaacttgagacctcacagt

SEQ ID NO: 198599 - DNA, 25 bp, Homo sapien
tgagacctcacagtaatcttcacac

SEQ ID NO: 198600 - DNA, 25 bp, Homo sapien
atcttcacacttaaccttagacacc

SEQ ID NO: 198601 - DNA, 25 bp, Homo sapien
acttaaccttagacacctatgcagt

SEQ ID NO: 198602 - DNA, 25 bp, Homo sapien
agacacctatgcagtcatgttggga

SEQ ID NO: 198603 - DNA, 25 bp, Homo sapien
cagtcatgttgggagcaggttacaa

SEQ ID NO: 198604 - DNA, 25 bp, Homo sapien
ggttacaatgttacttcagcccaca

SEQ ID NO: 198605 - DNA, 25 bp, Homo sapien
aatgttacttcagcccacagtttat

SEQ ID NO: 198606 - DNA, 25 bp, Homo sapien
aaatttatttgagacctcttgatga

SEQ ID NO: 198607 - DNA, 25 bp, Homo sapien
atattatatatttctgccacctgga

SEQ ID NO: 198608 - DNA, 25 bp, Homo sapien
tgccacctggattttcctggataat

SEQ ID NO: 198609 - DNA, 25 bp, Homo sapien
ctgagtcctgatgagtgttccccag

SEQ ID NO: 198610 - DNA, 25 bp, Homo sapien
agtgttccccaggatgcacattgaa

SEQ ID NO: 198611 - DNA, 25 bp, Homo sapien
gaggcagttggaatctagacactat

SEQ ID NO: 198612 - DNA, 25 bp, Homo sapien
tagacactatgctgggttccctgag

SEQ ID NO: 198613 - DNA, 25 bp, Homo sapien
ctatgctgggttccctgagtcgtca

SEQ ID NO: 198614 - DNA, 25 bp, Homo sapien
gagtcgtcaggccagacatttcaac

SEQ ID NO: 198615 - DNA, 25 bp, Homo sapien
gagaggacttactcagagaccccaa

SEQ ID NO: 198616 - DNA, 25 bp, Homo sapien
gagaccccaacaggtgatactgcac

SEQ ID NO: 198617 - DNA, 25 bp, Homo sapien
gatactgcacaaagcctggttcttc

SEQ ID NO: 198618 - DNA, 25 bp, Homo sapien
gttcttcaattttcctaccctgtat

SEQ ID NO: 198619 - DNA, 25 bp, Homo sapien
ctaccctgtatctaacataggagtt

SEQ ID NO: 198620 - DNA, 25 bp, Homo sapien
tctttctcttaatatttgctctggg

SEQ ID NO: 198621 - DNA, 25 bp, Homo sapien
atttgctctgggtcaggaagaagct

SEQ ID NO: 198622 - DNA, 25 bp, Homo sapien
ggaagaagctgttcacggtgtgata

SEQ ID NO: 198623 - DNA, 25 bp, Homo sapien
cacggtgtgataatactctttagat

SEQ ID NO: 198624 - DNA, 25 bp, Homo sapien
tatagatgcatcatgtcttctgctt

SEQ ID NO: 198625 - DNA, 25 bp, Homo sapien
catgtcttctgctttcacgtgtctg

SEQ ID NO: 198626 - DNA, 25 bp, Homo sapien
tctgctttcacgtgtctgggatggg

SEQ ID NO: 198627 - DNA, 25 bp, Homo sapien
gggtcagaaatgcatcctccagctg

SEQ ID NO: 198628 - DNA, 25 bp, Homo sapien
aatgcatcctccagctgacagaaaa

SEQ ID NO: 198629 - DNA, 25 bp, Homo sapien
gatactggtgttttctgacttttac

SEQ ID NO: 198630 - DNA, 25 bp, Homo sapien
aaactatgtttcttgttactattag

SEQ ID NO: 198631 - DNA, 25 bp, Homo sapien
gatcagagtctatcatggcttctag

SEQ ID NO: 198632 - DNA, 25 bp, Homo sapien
ggcttctagtagcatgagaccatgt

SEQ ID NO: 198633 - DNA, 25 bp, Homo sapien
agaccatgtctcacgaatgacccta

SEQ ID NO: 198634 - DNA, 25 bp, Homo sapien
atgaccctaggctcccatgacaatg

SEQ ID NO: 198635 - DNA, 25 bp, Homo sapien
caatgcctacctaagaaagctcaag

SEQ ID NO: 198636 - DNA, 25 bp, Homo sapien
gggaacttactttagtctagccaat

SEQ ID NO: 198637 - DNA, 25 bp, Homo sapien
atggcagtttcaggatctttctttc

SEQ ID NO: 198638 - DNA, 25 bp, Homo sapien
ggatctttctttcttatagcactta

SEQ ID NO: 198639 - DNA, 25 bp, Homo sapien
ttcctccatccctttgatatatgtg

SEQ ID NO: 198640 - DNA, 25 bp, Homo sapien
atatgtgtgtatctcctagggactt

SEQ ID NO: 198641 - DNA, 25 bp, Homo sapien
ggacttcaatgtatctttgcccagg

SEQ ID NO: 198642 - DNA, 25 bp, Homo sapien
gtgcacaacatcacccgcaaggtaa

SEQ ID NO: 198643 - DNA, 25 bp, Homo sapien
gcagagtcgtgtcccaaatgcgaac

SEQ ID NO: 198644 - DNA, 25 bp, Homo sapien
aaatgcgaacatcctcgtgcttact

SEQ ID NO: 198645 - DNA, 25 bp, Homo sapien
gtgcttacttcatgcagcttcagac

SEQ ID NO: 198646 - DNA, 25 bp, Homo sapien
gcttcagacccgctctgcagatgag

SEQ ID NO: 198647 - DNA, 25 bp, Homo sapien
tgcagatgagccgatgaccaccttc

SEQ ID NO: 198648 - DNA, 25 bp, Homo sapien
gaccaccttctacaagtgctgcaat

SEQ ID NO: 198649 - DNA, 25 bp, Homo sapien
aagtgctgcaatgctcagtgtggac

SEQ ID NO: 198650 - DNA, 25 bp, Homo sapien
aatgctcagtgtggacaccgctgga

SEQ ID NO: 198651 - DNA, 25 bp, Homo sapien
gatggcccagctgccctagtgtgtg

SEQ ID NO: 198652 - DNA, 25 bp, Homo sapien
tagtgtgtgcttgccttgtccctcg

SEQ ID NO: 198653 - DNA, 25 bp, Homo sapien
ttagcatttcgaacatctcggccat

SEQ ID NO: 198654 - DNA, 25 bp, Homo sapien
tttcgaacatctcggccattcaaag

SEQ ID NO: 198655 - DNA, 25 bp, Homo sapien
ccatgttctctgcactgtttggcca

SEQ ID NO: 198656 - DNA, 25 bp, Homo sapien
cagcataacctctagcatcgattca

SEQ ID NO: 198657 - DNA, 25 bp, Homo sapien
gcatcgattcaaagcagagttttaa

SEQ ID NO: 198658 - DNA, 25 bp, Homo sapien
agagttttaacctgacggcatggaa

SEQ ID NO: 198659 - DNA, 25 bp, Homo sapien
gatactctaatcactacattgcttt

SEQ ID NO: 198660 - DNA, 25 bp, Homo sapien
ttctataaaactacccataagcctt

SEQ ID NO: 198661 - DNA, 25 bp, Homo sapien
aggactgaccgcttcataagccagt

SEQ ID NO: 198662 - DNA, 25 bp, Homo sapien
ataagccagtacgtctgagctgagt

SEQ ID NO: 198663 - DNA, 25 bp, Homo sapien
acgtctgagctgagtatgtttcaat

SEQ ID NO: 198664 - DNA, 25 bp, Homo sapien
cttatacgagactgccacgaaattc

SEQ ID NO: 198665 - DNA, 25 bp, Homo sapien
acgaaattctccgaagtggctcttc

SEQ ID NO: 198666 - DNA, 25 bp, Homo sapien
gtggctcttccatgtttcattcccg

SEQ ID NO: 198667 - DNA, 25 bp, Homo sapien
gtttcattcccgcagctacagcgtc

SEQ ID NO: 198668 - DNA, 25 bp, Homo sapien
agctacagcgtccagggtgctccac

SEQ ID NO: 198669 - DNA, 25 bp, Homo sapien
tcacccacactccatgttgtctttt

SEQ ID NO: 198670 - DNA, 25 bp, Homo sapien
atcctgtctgatttggttttagttt

SEQ ID NO: 198671 - DNA, 25 bp, Homo sapien
gatgcctattgatgttgagcaactt

SEQ ID NO: 198672 - DNA, 25 bp, Homo sapien
aacttctcataagctatcggccgtt

SEQ ID NO: 198673 - DNA, 25 bp, Homo sapien
atcggccgtttgtagatcttctgaa

SEQ ID NO: 198674 - DNA, 25 bp, Homo sapien
tggatttttatcttcttattgtcaa

SEQ ID NO: 198675 - DNA, 25 bp, Homo sapien
gtaaaccaaatgttctttcttgcag

SEQ ID NO: 198676 - DNA, 25 bp, Homo sapien
ccaaatgttctttcttgcagccaaa

SEQ ID NO: 198677 - DNA, 25 bp, Homo sapien
tcttgcagccaaagaactttacacc

SEQ ID NO: 198678 - DNA, 25 bp, Homo sapien
ctgaactgtgtgtaaccatagtaac

SEQ ID NO: 198679 - DNA, 25 bp, Homo sapien
gtaaccatagtaacaccaagcacgt

SEQ ID NO: 198680 - DNA, 25 bp, Homo sapien
aacaccaagcacgtatttatttata

SEQ ID NO: 198681 - DNA, 25 bp, Homo sapien
taagtttttgccattataattttga

SEQ ID NO: 198682 - DNA, 25 bp, Homo sapien
aaattaatttgaccatctctcttat

SEQ ID NO: 198683 - DNA, 25 bp, Homo sapien
atttgaccatctctcttattaatag

SEQ ID NO: 198684 - DNA, 25 bp, Homo sapien
aatgtaagttgaccttctcttagat

SEQ ID NO: 198685 - DNA, 25 bp, Homo sapien
taagttgaccttctcttagattatg

SEQ ID NO: 198686 - DNA, 25 bp, Homo sapien
tggagggataaaacatttcggcacc

SEQ ID NO: 198687 - DNA, 25 bp, Homo sapien
ggataaaacatttcggcacctagta

SEQ ID NO: 198688 - DNA, 25 bp, Homo sapien
aacatttcggcacctagtaatggta

SEQ ID NO: 198689 - DNA, 25 bp, Homo sapien
tcggcacctagtaatggtaaattag

SEQ ID NO: 198690 - DNA, 25 bp, Homo sapien
attagtcaatatttgttagtttcgt

SEQ ID NO: 198691 - DNA, 25 bp, Homo sapien
gaagtttcagtgtctttcagagttt

SEQ ID NO: 198692 - DNA, 25 bp, Homo sapien
gtttcagtgtctttcagagtttgag

SEQ ID NO: 198693 - DNA, 25 bp, Homo sapien
caattataagcccaaatttgctaaa

SEQ ID NO: 198694 - DNA, 25 bp, Homo sapien
gttggaattgctctgtcataataag

SEQ ID NO: 198695 - DNA, 25 bp, Homo sapien
ggaattgctctgtcataataagtca

SEQ ID NO: 198696 - DNA, 25 bp, Homo sapien
gctctgtcataataagtcagggata

SEQ ID NO: 198697 - DNA, 25 bp, Homo sapien
tagataatcatgttactgagtgctt

SEQ ID NO: 198698 - DNA, 25 bp, Homo sapien
aatcatgttactgagtgcttggaaa

SEQ ID NO: 198699 - DNA, 25 bp, Homo sapien
ctgagtgcttggaaattatttgtgc

SEQ ID NO: 198700 - DNA, 25 bp, Homo sapien
gcttggaaattatttgtgcatgatt

SEQ ID NO: 198701 - DNA, 25 bp, Homo sapien
gagatataactattggtaggtctga

SEQ ID NO: 198702 - DNA, 25 bp, Homo sapien
ctattggtaggtctgatattgtctt

SEQ ID NO: 198703 - DNA, 25 bp, Homo sapien
ggtaggtctgatattgtcttttagt

SEQ ID NO: 198704 - DNA, 25 bp, Homo sapien
tctgatattgtcttttagttttggg

SEQ ID NO: 198705 - DNA, 25 bp, Homo sapien
gaaagtttcctatgacaaagggaag

SEQ ID NO: 198706 - DNA, 25 bp, Homo sapien
agaaccattctctcagcagtttgca

SEQ ID NO: 198707 - DNA, 25 bp, Homo sapien
gaaccattctctcagcagtttgcag

SEQ ID NO: 198708 - DNA, 25 bp, Homo sapien
gcagtgggaacatcgagcacccgga

SEQ ID NO: 198709 - DNA, 25 bp, Homo sapien
agcacccggaggacaagctcttcaa

SEQ ID NO: 198710 - DNA, 25 bp, Homo sapien
tcaacacgtctgtggaggtgctgcc

SEQ ID NO: 198711 - DNA, 25 bp, Homo sapien
ttcgacaaccctcagtcagacaagg

SEQ ID NO: 198712 - DNA, 25 bp, Homo sapien
ctcagtcagacaaggaggccctgca

SEQ ID NO: 198713 - DNA, 25 bp, Homo sapien
agatcggctccttctacaagggagt

SEQ ID NO: 198714 - DNA, 25 bp, Homo sapien
agccttcggccctctggaagcactg

SEQ ID NO: 198715 - DNA, 25 bp, Homo sapien
gaagcactgcgcctctcgatccaga

SEQ ID NO: 198716 - DNA, 25 bp, Homo sapien
gacggactcccctgtgtgggtgatt

SEQ ID NO: 198717 - DNA, 25 bp, Homo sapien
gtgattctgagcgagatcttcctga

SEQ ID NO: 198718 - DNA, 25 bp, Homo sapien
cttcctgaaaaaggccgactaagct

SEQ ID NO: 198719 - DNA, 25 bp, Homo sapien
gacctcaatacactaatgccaacct

SEQ ID NO: 198720 - DNA, 25 bp, Homo sapien
ggcagcccagggagatcacaccttt

SEQ ID NO: 198721 - DNA, 25 bp, Homo sapien
gggagatcacacctttggcaaagtc

SEQ ID NO: 198722 - DNA, 25 bp, Homo sapien
tggcaaagtccagacaaggcccact

SEQ ID NO: 198723 - DNA, 25 bp, Homo sapien
actgcagttcctatggcgccagtca

SEQ ID NO: 198724 - DNA, 25 bp, Homo sapien
atggcgccagtcaccagctcctaga

SEQ ID NO: 198725 - DNA, 25 bp, Homo sapien
agctcctagacagcacttgggtacc

SEQ ID NO: 198726 - DNA, 25 bp, Homo sapien
tgaaattgctcctacccatccatat

SEQ ID NO: 198727 - DNA, 25 bp, Homo sapien
tacccatccatatttctggtcatgc

SEQ ID NO: 198728 - DNA, 25 bp, Homo sapien
ctggtcatgctttcagtctgacaaa

SEQ ID NO: 198729 - DNA, 25 bp, Homo sapien
ggatgatactgctgtttttggtaac

SEQ ID NO: 198730 - DNA, 25 bp, Homo sapien
taataggatgctgcctaacccagtt

SEQ ID NO: 198731 - DNA, 25 bp, Homo sapien
tgcctaacccagttcatctctatgt

SEQ ID NO: 198732 - DNA, 25 bp, Homo sapien
catctctatgtcctgttcactgaat

SEQ ID NO: 198733 - DNA, 25 bp, Homo sapien
gtcctgttcactgaatattccgggt

SEQ ID NO: 198734 - DNA, 25 bp, Homo sapien
gttcactgaatattccgggtaattg

SEQ ID NO: 198735 - DNA, 25 bp, Homo sapien
ggatgggctccattaaaaccagctc

SEQ ID NO: 198736 - DNA, 25 bp, Homo sapien
cttgtcagtaaagatttcttgtcaa

SEQ ID NO: 198737 - DNA, 25 bp, Homo sapien
tcaagatgtcttggattgcactttt

SEQ ID NO: 198738 - DNA, 25 bp, Homo sapien
cttggattgcacttttgttgaggaa

SEQ ID NO: 198739 - DNA, 25 bp, Homo sapien
ttgtgtgtggttttagagggtttct

SEQ ID NO: 198740 - DNA, 25 bp, Homo sapien
agagggtttctgtttgtgaaatgta

SEQ ID NO: 198741 - DNA, 25 bp, Homo sapien
ttgaagagcagtacaaaaaccaggg

SEQ ID NO: 198742 - DNA, 25 bp, Homo sapien
taaagaaggtagtcatggcggagaa

SEQ ID NO: 198743 - DNA, 25 bp, Homo sapien
tagtcatggcggagaaggtttcagc

SEQ ID NO: 198744 - DNA, 25 bp, Homo sapien
gaaggtttcagccagattgcaaatc

SEQ ID NO: 198745 - DNA, 25 bp, Homo sapien
agattgcaaatctcagtctgaacaa

SEQ ID NO: 198746 - DNA, 25 bp, Homo sapien
tccttctggaggaaagctttgggaa

SEQ ID NO: 198747 - DNA, 25 bp, Homo sapien
gtggaaaagtcttgagccatcattc

SEQ ID NO: 198748 - DNA, 25 bp, Homo sapien
agtcttgagccatcattcatccctt

SEQ ID NO: 198749 - DNA, 25 bp, Homo sapien
cccttaacaggcacattagatctta

SEQ ID NO: 198750 - DNA, 25 bp, Homo sapien
ggcacattagatcttacaccagaca

SEQ ID NO: 198751 - DNA, 25 bp, Homo sapien
gatcttacaccagacacaaactgta

SEQ ID NO: 198752 - DNA, 25 bp, Homo sapien
gatgacacagacaagagttcctgga

SEQ ID NO: 198753 - DNA, 25 bp, Homo sapien
gggagtgttaagacttttgacttct

SEQ ID NO: 198754 - DNA, 25 bp, Homo sapien
gtaagttttgtactgctttggagag

SEQ ID NO: 198755 - DNA, 25 bp, Homo sapien
actgctttggagagtgaatgctgcc

SEQ ID NO: 198756 - DNA, 25 bp, Homo sapien
gaatgctgccaagagttcctcagat

SEQ ID NO: 198757 - DNA, 25 bp, Homo sapien
gagttcctcagattacaaacagcag

SEQ ID NO: 198758 - DNA, 25 bp, Homo sapien
aaacagcagtggtgccatttccttc

SEQ ID NO: 198759 - DNA, 25 bp, Homo sapien
ttccccatcttcatgttacaaacct

SEQ ID NO: 198760 - DNA, 25 bp, Homo sapien
cagccattaggcgtcagcatcttga

SEQ ID NO: 198761 - DNA, 25 bp, Homo sapien
tgacttttccccagcatcacaaaca

SEQ ID NO: 198762 - DNA, 25 bp, Homo sapien
ggaacaattacactggccatgccat

SEQ ID NO: 198763 - DNA, 25 bp, Homo sapien
aggtgaaagaaagctatagtggcat

SEQ ID NO: 198764 - DNA, 25 bp, Homo sapien
gaaaaagtataaagctcagttagtt

SEQ ID NO: 198765 - DNA, 25 bp, Homo sapien
aattcaggactgatgtgacctacca

SEQ ID NO: 198766 - DNA, 25 bp, Homo sapien
aggactgatgtgacctaccagattt

SEQ ID NO: 198767 - DNA, 25 bp, Homo sapien
gtgttaatagtatatatgccactga

SEQ ID NO: 198768 - DNA, 25 bp, Homo sapien
aatattacttaaacatgtggcttgc

SEQ ID NO: 198769 - DNA, 25 bp, Homo sapien
aacatgtggcttgctcagtgtttaa

SEQ ID NO: 198770 - DNA, 25 bp, Homo sapien
catgtggcttgctcagtgtttaatt

SEQ ID NO: 198771 - DNA, 25 bp, Homo sapien
gtggcttgctcagtgtttaattgca

SEQ ID NO: 198772 - DNA, 25 bp, Homo sapien
gctcagtgtttaattgcaagttttc

SEQ ID NO: 198773 - DNA, 25 bp, Homo sapien
aattgcaagttttcaatcttggact

SEQ ID NO: 198774 - DNA, 25 bp, Homo sapien
aaagtctttcaccagcacacaagag

SEQ ID NO: 198775 - DNA, 25 bp, Homo sapien
tcaccagcacacaagagtttgattg

SEQ ID NO: 198776 - DNA, 25 bp, Homo sapien
gtacaaatatatcttctgcattaac

SEQ ID NO: 198777 - DNA, 25 bp, Homo sapien
tctgcattaacatctctgcctgttg

SEQ ID NO: 198778 - DNA, 25 bp, Homo sapien
gttgcttaagatcagttgcttttat

SEQ ID NO: 198779 - DNA, 25 bp, Homo sapien
gatcagttgcttttatactcagaat

SEQ ID NO: 198780 - DNA, 25 bp, Homo sapien
ggaaatacctgatcttggctagttt

SEQ ID NO: 198781 - DNA, 25 bp, Homo sapien
gatttcatttagatttccctccacg

SEQ ID NO: 198782 - DNA, 25 bp, Homo sapien
gatttccctccacgaggtcagcaaa

SEQ ID NO: 198783 - DNA, 25 bp, Homo sapien
ggtcagcaaactatcatgttcttat

SEQ ID NO: 198784 - DNA, 25 bp, Homo sapien
ttatgtaaacttaggccaaggccag

SEQ ID NO: 198785 - DNA, 25 bp, Homo sapien
gcagcgtgactgacattatgaaggc

SEQ ID NO: 198786 - DNA, 25 bp, Homo sapien
cattatgaaggcctgtactgaagac

SEQ ID NO: 198787 - DNA, 25 bp, Homo sapien
gacagcaagctgttagtacagacca

SEQ ID NO: 198788 - DNA, 25 bp, Homo sapien
gtacagaccagatgctttcttggca

SEQ ID NO: 198789 - DNA, 25 bp, Homo sapien
atgctttcttggcaggctcgttgta

SEQ ID NO: 198790 - DNA, 25 bp, Homo sapien
caggctcgttgtacctcttggaaaa

SEQ ID NO: 198791 - DNA, 25 bp, Homo sapien
gtacctcttggaaaacctcaatgca

SEQ ID NO: 198792 - DNA, 25 bp, Homo sapien
caagatagtgtttcagtgctggcat

SEQ ID NO: 198793 - DNA, 25 bp, Homo sapien
ggcatattttggaattctgcacatt

SEQ ID NO: 198794 - DNA, 25 bp, Homo sapien
gcaataatactgtatagctttcccc

SEQ ID NO: 198795 - DNA, 25 bp, Homo sapien
ctcccacaaaatcacccagttaatg

SEQ ID NO: 198796 - DNA, 25 bp, Homo sapien
gactccactgccagaaaaaaccatt

SEQ ID NO: 198797 - DNA, 25 bp, Homo sapien
aagaggcttgtacacaggacatacc

SEQ ID NO: 198798 - DNA, 25 bp, Homo sapien
gaggcttgtacacaggacataccgt

SEQ ID NO: 198799 - DNA, 25 bp, Homo sapien
aggcttgtacacaggacataccgta

SEQ ID NO: 198800 - DNA, 25 bp, Homo sapien
ggcttgtacacaggacataccgtaa

SEQ ID NO: 198801 - DNA, 25 bp, Homo sapien
gcttgtacacaggacataccgtaaa

SEQ ID NO: 198802 - DNA, 25 bp, Homo sapien
ttgtacacaggacataccgtaaaga

SEQ ID NO: 198803 - DNA, 25 bp, Homo sapien
gtacacaggacataccgtaaagacc

SEQ ID NO: 198804 - DNA, 25 bp, Homo sapien
ttgtgggagacgctacaagaggcgc

SEQ ID NO: 198805 - DNA, 25 bp, Homo sapien
gggtacaacgtgctattttaatgtg

SEQ ID NO: 198806 - DNA, 25 bp, Homo sapien
tacaacgtgctattttaatgtgtgc

SEQ ID NO: 198807 - DNA, 25 bp, Homo sapien
atactgctcgtatatcctatgacta

SEQ ID NO: 198808 - DNA, 25 bp, Homo sapien
gtatatcctatgactattccccttc

SEQ ID NO: 198809 - DNA, 25 bp, Homo sapien
atgactattccccttctgttgttcc

SEQ ID NO: 198810 - DNA, 25 bp, Homo sapien
tctgttgttccctaatcattagaat

SEQ ID NO: 198811 - DNA, 25 bp, Homo sapien
ggtacagcctacactccagccagag

SEQ ID NO: 198812 - DNA, 25 bp, Homo sapien
tacactccagccagagaaagcagct

SEQ ID NO: 198813 - DNA, 25 bp, Homo sapien
gggtcatgtgtactgctgcccttcc

SEQ ID NO: 198814 - DNA, 25 bp, Homo sapien
cacccggaaggtcactttaggagct

SEQ ID NO: 198815 - DNA, 25 bp, Homo sapien
ggtcactttaggagcttttctctac

SEQ ID NO: 198816 - DNA, 25 bp, Homo sapien
taggagcttttctctactcaaattt

SEQ ID NO: 198817 - DNA, 25 bp, Homo sapien
gtatctttatactgctcgtatatcc

SEQ ID NO: 198818 - DNA, 25 bp, Homo sapien
atctatatggaattgcttaccaaag

SEQ ID NO: 198819 - DNA, 25 bp, Homo sapien
tagtgcgatgtttcaggaggctgga

SEQ ID NO: 198820 - DNA, 25 bp, Homo sapien
cagcccactgagaagtcaaacattt

SEQ ID NO: 198821 - DNA, 25 bp, Homo sapien
gtggcatgtgctgtgaccatttata

SEQ ID NO: 198822 - DNA, 25 bp, Homo sapien
atgtgctgtgaccatttataatgtt

SEQ ID NO: 198823 - DNA, 25 bp, Homo sapien
attttacaataggtgcttattctca

SEQ ID NO: 198824 - DNA, 25 bp, Homo sapien
ataggtgcttattctcaaagcagga

SEQ ID NO: 198825 - DNA, 25 bp, Homo sapien
ttctcaaagcaggaattggtggcag

SEQ ID NO: 198826 - DNA, 25 bp, Homo sapien
gcaggaattggtggcagattttaca

SEQ ID NO: 198827 - DNA, 25 bp, Homo sapien
cttctctttgacaattcctagataa

SEQ ID NO: 198828 - DNA, 25 bp, Homo sapien
attcctagataaaaagatggccttt

SEQ ID NO: 198829 - DNA, 25 bp, Homo sapien
tataatactttaaagtcccagtaga

SEQ ID NO: 198830 - DNA, 25 bp, Homo sapien
ctttaaagtcccagtagaaatagct

SEQ ID NO: 198831 - DNA, 25 bp, Homo sapien
tttaaagtcccagtagaaatagcta

SEQ ID NO: 198832 - DNA, 25 bp, Homo sapien
taaagtcccagtagaaatagctaac

SEQ ID NO: 198833 - DNA, 25 bp, Homo sapien
aaagtcccagtagaaatagctaaca

SEQ ID NO: 198834 - DNA, 25 bp, Homo sapien
aagtcccagtagaaatagctaacaa

SEQ ID NO: 198835 - DNA, 25 bp, Homo sapien
agtcccagtagaaatagctaacaaa

SEQ ID NO: 198836 - DNA, 25 bp, Homo sapien
gtcccagtagaaatagctaacaaag

SEQ ID NO: 198837 - DNA, 25 bp, Homo sapien
tagaaatagctaacaaaggctgggt

SEQ ID NO: 198838 - DNA, 25 bp, Homo sapien
acaaaggctgggtgcgctgtggctc

SEQ ID NO: 198839 - DNA, 25 bp, Homo sapien
ggacgttgcagtgatcccagattgt

SEQ ID NO: 198840 - DNA, 25 bp, Homo sapien
gacacagtcacccacgaagattacg

SEQ ID NO: 198841 - DNA, 25 bp, Homo sapien
gaagattacgtgaccacaagattgt

SEQ ID NO: 198842 - DNA, 25 bp, Homo sapien
tacacatacgtattttccgtagtgc

SEQ ID NO: 198843 - DNA, 25 bp, Homo sapien
gtattttccgtagtgctctgggtgg

SEQ ID NO: 198844 - DNA, 25 bp, Homo sapien
tagcaaatgctaacttacactttat

SEQ ID NO: 198845 - DNA, 25 bp, Homo sapien
ttatagcatttatcagctgtggcat

SEQ ID NO: 198846 - DNA, 25 bp, Homo sapien
cagctgtggcatattacctgtaaca

SEQ ID NO: 198847 - DNA, 25 bp, Homo sapien
ggcatattacctgtaacatgtttaa

SEQ ID NO: 198848 - DNA, 25 bp, Homo sapien
ttgtagcctgcttttgctttcacaa

SEQ ID NO: 198849 - DNA, 25 bp, Homo sapien
gcctgcttttgctttcacaatttgt

SEQ ID NO: 198850 - DNA, 25 bp, Homo sapien
tgctttcacaatttgtcttacaatt

SEQ ID NO: 198851 - DNA, 25 bp, Homo sapien
gccccactcacaacatcttgtaaga

SEQ ID NO: 198852 - DNA, 25 bp, Homo sapien
acaacatcttgtaagactgtgcccg

SEQ ID NO: 198853 - DNA, 25 bp, Homo sapien
acatcttgtaagactgtgcccggcc

SEQ ID NO: 198854 - DNA, 25 bp, Homo sapien
ttgtaagactgtgcccggccccatt

SEQ ID NO: 198855 - DNA, 25 bp, Homo sapien
ttcactccatcctgtgagaccacgc

SEQ ID NO: 198856 - DNA, 25 bp, Homo sapien
actcactctatcctgtgagaccacg

SEQ ID NO: 198857 - DNA, 25 bp, Homo sapien
ctctatcctgtgagaccacgcctgg

SEQ ID NO: 198858 - DNA, 25 bp, Homo sapien
actcacaccatcctatgagcccacg

SEQ ID NO: 198859 - DNA, 25 bp, Homo sapien
cactccactcgcacgtgattacagt

SEQ ID NO: 198860 - DNA, 25 bp, Homo sapien
tccactcgcacgtgattacagtctg

SEQ ID NO: 198861 - DNA, 25 bp, Homo sapien
actcgcacgtgattacagtctgtaa

SEQ ID NO: 198862 - DNA, 25 bp, Homo sapien
ttagacctggattgaattgggccct

SEQ ID NO: 198863 - DNA, 25 bp, Homo sapien
gacctggattgaattgggccctgtt

SEQ ID NO: 198864 - DNA, 25 bp, Homo sapien
ctggattgaattgggccctgttgtt

SEQ ID NO: 198865 - DNA, 25 bp, Homo sapien
ttgaattgggccctgttgtttcctg

SEQ ID NO: 198866 - DNA, 25 bp, Homo sapien
gaattgggccctgttgtttcctggg

SEQ ID NO: 198867 - DNA, 25 bp, Homo sapien
gtgcccaacagcctggcatcttctt

SEQ ID NO: 198868 - DNA, 25 bp, Homo sapien
aacagcctggcatcttcttgtttct

SEQ ID NO: 198869 - DNA, 25 bp, Homo sapien
gcctggcatcttcttgtttctctgt

SEQ ID NO: 198870 - DNA, 25 bp, Homo sapien
ttattcagctgataaatattgactg

SEQ ID NO: 198871 - DNA, 25 bp, Homo sapien
ggatacactagtgggcagaaatagc

SEQ ID NO: 198872 - DNA, 25 bp, Homo sapien
gtgggcagaaatagccccgtcccag

SEQ ID NO: 198873 - DNA, 25 bp, Homo sapien
ccagggccatcatggaggaggttat

SEQ ID NO: 198874 - DNA, 25 bp, Homo sapien
aggaggttatgagcctgctgcagcc

SEQ ID NO: 198875 - DNA, 25 bp, Homo sapien
tgcagcccctcaatatcactcaggt

SEQ ID NO: 198876 - DNA, 25 bp, Homo sapien
gaagggacagacatcaacttttgga

SEQ ID NO: 198877 - DNA, 25 bp, Homo sapien
tcaacttttggatccaagctggagt

SEQ ID NO: 198878 - DNA, 25 bp, Homo sapien
tgcctggagccagtctacttgatga

SEQ ID NO: 198879 - DNA, 25 bp, Homo sapien
gacttatacaagtatttcttcttcc

SEQ ID NO: 198880 - DNA, 25 bp, Homo sapien
ccacggagacaccatgactgtcatg

SEQ ID NO: 198881 - DNA, 25 bp, Homo sapien
ctgtttgggctgttgtttcttatgt

SEQ ID NO: 198882 - DNA, 25 bp, Homo sapien
gttgtttcttatgttgttgcagaca

SEQ ID NO: 198883 - DNA, 25 bp, Homo sapien
ggaagaaatgctgcctaggtcctag

SEQ ID NO: 198884 - DNA, 25 bp, Homo sapien
actgctacctctgacaaatatcatc

SEQ ID NO: 198885 - DNA, 25 bp, Homo sapien
gctacctctgacaaatatcatcaca

SEQ ID NO: 198886 - DNA, 25 bp, Homo sapien
aatatcatcacatatgccacagaat

SEQ ID NO: 198887 - DNA, 25 bp, Homo sapien
tatgccacagaattatagccacagt

SEQ ID NO: 198888 - DNA, 25 bp, Homo sapien
gaattatagccacagtgagagagga

SEQ ID NO: 198889 - DNA, 25 bp, Homo sapien
gaaaatagtgacaaattgggttcag

SEQ ID NO: 198890 - DNA, 25 bp, Homo sapien
tgggtgcaccagaatctcacaagta

SEQ ID NO: 198891 - DNA, 25 bp, Homo sapien
accagaatctcacaagtaaccactt

SEQ ID NO: 198892 - DNA, 25 bp, Homo sapien
taaccacttaattacttacgcatgt

SEQ ID NO: 198893 - DNA, 25 bp, Homo sapien
tacttacgcatgtaaccagatacca

SEQ ID NO: 198894 - DNA, 25 bp, Homo sapien
ttccccaaacacctatggaaataat

SEQ ID NO: 198895 - DNA, 25 bp, Homo sapien
ctacagtcgatttaaagctcatgat

SEQ ID NO: 198896 - DNA, 25 bp, Homo sapien
aaagctcatgataaagtgtgtatag

SEQ ID NO: 198897 - DNA, 25 bp, Homo sapien
tgtggcatcctcatgaaacttctaa

SEQ ID NO: 198898 - DNA, 25 bp, Homo sapien
gaaacttctaaggtcataacatgtg

SEQ ID NO: 198899 - DNA, 25 bp, Homo sapien
taacatgtggttgggatggtctcat

SEQ ID NO: 198900 - DNA, 25 bp, Homo sapien
gatggtctcattaaattgtgggatt

SEQ ID NO: 198901 - DNA, 25 bp, Homo sapien
tccttaaactagctgggatcatttt

SEQ ID NO: 198902 - DNA, 25 bp, Homo sapien
taaactagctgggatcatttttgat

SEQ ID NO: 198903 - DNA, 25 bp, Homo sapien
atttttgatccattgtcatatttat

SEQ ID NO: 198904 - DNA, 25 bp, Homo sapien
gtatctgatgataacttgatttaca

SEQ ID NO: 198905 - DNA, 25 bp, Homo sapien
aatttcatttgcaacttcattttgt

SEQ ID NO: 198906 - DNA, 25 bp, Homo sapien
gaatggaaccacagtgggtcccaat

SEQ ID NO: 198907 - DNA, 25 bp, Homo sapien
agtgggtcccaatcagctgggttta

SEQ ID NO: 198908 - DNA, 25 bp, Homo sapien
gtcccaatcagctgggtttactgat

SEQ ID NO: 198909 - DNA, 25 bp, Homo sapien
ctgatgattcagtaaggttaacaat

SEQ ID NO: 198910 - DNA, 25 bp, Homo sapien
agtgactgcaacaaataaaccttct

SEQ ID NO: 198911 - DNA, 25 bp, Homo sapien
gaagattatctgctaagtccaggca

SEQ ID NO: 198912 - DNA, 25 bp, Homo sapien
atctgctaagtccaggcatttttat

SEQ ID NO: 198913 - DNA, 25 bp, Homo sapien
agtccaggcatttttatggtgtaga

SEQ ID NO: 198914 - DNA, 25 bp, Homo sapien
aatagtacacttctgaatttttata

SEQ ID NO: 198915 - DNA, 25 bp, Homo sapien
aaatgtggttggaaggtgtactaat

SEQ ID NO: 198916 - DNA, 25 bp, Homo sapien
ttctaactttgtatggataatcttt

SEQ ID NO: 198917 - DNA, 25 bp, Homo sapien
gtggccgaggttacaacacccatgt

SEQ ID NO: 198918 - DNA, 25 bp, Homo sapien
acacccatgtggtcaggcacgtgga

SEQ ID NO: 198919 - DNA, 25 bp, Homo sapien
gagtgtaagttcatctggtgctgct

SEQ ID NO: 198920 - DNA, 25 bp, Homo sapien
atctggtgctgctatgtccgttgca

SEQ ID NO: 198921 - DNA, 25 bp, Homo sapien
atgactgatgtccacacttgcaagt

SEQ ID NO: 198922 - DNA, 25 bp, Homo sapien
actccatccagccttgggcaagatg

SEQ ID NO: 198923 - DNA, 25 bp, Homo sapien
gggcaagatgcctcagcaatataca

SEQ ID NO: 198924 - DNA, 25 bp, Homo sapien
cagagaggtgcccatccctgtgcag

SEQ ID NO: 198925 - DNA, 25 bp, Homo sapien
gaatcccagggacacaaggcagaga

SEQ ID NO: 198926 - DNA, 25 bp, Homo sapien
ggcagagaatgcaaccgtacatcag

SEQ ID NO: 198927 - DNA, 25 bp, Homo sapien
gagggtgcagatggctgcaacctcc

SEQ ID NO: 198928 - DNA, 25 bp, Homo sapien
tggtcctggctatttttgtgtcatt

SEQ ID NO: 198929 - DNA, 25 bp, Homo sapien
gagaacctggcctgtggtaggcact

SEQ ID NO: 198930 - DNA, 25 bp, Homo sapien
gcctgtggtaggcactgtacttaat

SEQ ID NO: 198931 - DNA, 25 bp, Homo sapien
ggcactgtacttaatactaggatac

SEQ ID NO: 198932 - DNA, 25 bp, Homo sapien
aatgcaaaagatacggcccatgcaa

SEQ ID NO: 198933 - DNA, 25 bp, Homo sapien
gatacggcccatgcaattttattaa

SEQ ID NO: 198934 - DNA, 25 bp, Homo sapien
acaaatggtgaatggatttccaact

SEQ ID NO: 198935 - DNA, 25 bp, Homo sapien
attgttgggaggacagcccttttgt

SEQ ID NO: 198936 - DNA, 25 bp, Homo sapien
acagcccttttgtgaaccttgtttg

SEQ ID NO: 198937 - DNA, 25 bp, Homo sapien
agtttctatctctaagctgttctat

SEQ ID NO: 198938 - DNA, 25 bp, Homo sapien
ctatctctaagctgttctattttaa

SEQ ID NO: 198939 - DNA, 25 bp, Homo sapien
gactgtgtccgatgccaaggagtcc

SEQ ID NO: 198940 - DNA, 25 bp, Homo sapien
aggagtcctggcctccgcagatgct

SEQ ID NO: 198941 - DNA, 25 bp, Homo sapien
gcagatgcttcattttgacccttgg

SEQ ID NO: 198942 - DNA, 25 bp, Homo sapien
tgtcctggacgggtggacttagcta

SEQ ID NO: 198943 - DNA, 25 bp, Homo sapien
ggagaaagtcgaggcagcagccctc

SEQ ID NO: 198944 - DNA, 25 bp, Homo sapien
gaggccctcacagatgtctaggcag

SEQ ID NO: 198945 - DNA, 25 bp, Homo sapien
gatgtctaggcaggcctcatttcat

SEQ ID NO: 198946 - DNA, 25 bp, Homo sapien
atttcatcacgcagcatgtgcaggc

SEQ ID NO: 198947 - DNA, 25 bp, Homo sapien
aaagccaaatctcagggaagtcctt

SEQ ID NO: 198948 - DNA, 25 bp, Homo sapien
gggaagtccttggttgatgtatctg

SEQ ID NO: 198949 - DNA, 25 bp, Homo sapien
gatgtatctgggtctcctctggagc

SEQ ID NO: 198950 - DNA, 25 bp, Homo sapien
ttccagcttcctctgagccgcaggg

SEQ ID NO: 198951 - DNA, 25 bp, Homo sapien
tgctacgcgggcaagcgtgctgcct

SEQ ID NO: 198952 - DNA, 25 bp, Homo sapien
tgcctctcttctgtgtcgttttgtt

SEQ ID NO: 198953 - DNA, 25 bp, Homo sapien
tgaaaagtccttaaccgtggactct

SEQ ID NO: 198954 - DNA, 25 bp, Homo sapien
tcctttaccccacatatgcaatgac

SEQ ID NO: 198955 - DNA, 25 bp, Homo sapien
tcacttttgtagtttaatcctttgt

SEQ ID NO: 198956 - DNA, 25 bp, Homo sapien
gttgcatatatggacaccgacttgg

SEQ ID NO: 198957 - DNA, 25 bp, Homo sapien
acaccgacttgggaggacaggtcct

SEQ ID NO: 198958 - DNA, 25 bp, Homo sapien
gacaggtcctgaatgtcctttctcc

SEQ ID NO: 198959 - DNA, 25 bp, Homo sapien
gaatgtcctttctccagtgtaacat

SEQ ID NO: 198960 - DNA, 25 bp, Homo sapien
cagtgtaacatgttttactcacaaa

SEQ ID NO: 198961 - DNA, 25 bp, Homo sapien
actgctgcggttgtaccctgatacg

SEQ ID NO: 198962 - DNA, 25 bp, Homo sapien
ttgtaccctgatacggcctggccat

SEQ ID NO: 198963 - DNA, 25 bp, Homo sapien
catccggcctctgtgtcaagaggtg

SEQ ID NO: 198964 - DNA, 25 bp, Homo sapien
agccgcacctttctgtgagaacgga

SEQ ID NO: 198965 - DNA, 25 bp, Homo sapien
tgagaacggaactcgggttatttca

SEQ ID NO: 198966 - DNA, 25 bp, Homo sapien
agtggaagcgcccagcggcctttcc

SEQ ID NO: 198967 - DNA, 25 bp, Homo sapien
agtctcagggcctcaccgtatttct

SEQ ID NO: 198968 - DNA, 25 bp, Homo sapien
accgtatttctactactacttaatg

SEQ ID NO: 198969 - DNA, 25 bp, Homo sapien
gtgtgaactttatagaatcctctct

SEQ ID NO: 198970 - DNA, 25 bp, Homo sapien
tagaatcctctctgtactggatgtg

SEQ ID NO: 198971 - DNA, 25 bp, Homo sapien
ctcggctctatgcagacctttttat

SEQ ID NO: 198972 - DNA, 25 bp, Homo sapien
ttcttaattccactaaagtgcctat

SEQ ID NO: 198973 - DNA, 25 bp, Homo sapien
aagtgcctattgaaactcttatcat

SEQ ID NO: 198974 - DNA, 25 bp, Homo sapien
gtacagtacactctgctgtgatggt

SEQ ID NO: 198975 - DNA, 25 bp, Homo sapien
ctgctgtgatggtattgcgggattc

SEQ ID NO: 198976 - DNA, 25 bp, Homo sapien
ttgcgggattcagagataaagacat

SEQ ID NO: 198977 - DNA, 25 bp, Homo sapien
aaagacaccgtctttatgtcaagaa

SEQ ID NO: 198978 - DNA, 25 bp, Homo sapien
caccgtctttatgtcaagaagcaat

SEQ ID NO: 198979 - DNA, 25 bp, Homo sapien
gaagcaatagcgacactctgactct

SEQ ID NO: 198980 - DNA, 25 bp, Homo sapien
gatctccaccttcttctaattcaaa

SEQ ID NO: 198981 - DNA, 25 bp, Homo sapien
aaactgtatgctaaaacgtatttgt

SEQ ID NO: 198982 - DNA, 25 bp, Homo sapien
ttgtttatcctatcctttcagaaaa

SEQ ID NO: 198983 - DNA, 25 bp, Homo sapien
gattccaagatccatcaaggagcaa

SEQ ID NO: 198984 - DNA, 25 bp, Homo sapien
ataaagctgtctgacccaggagaaa

SEQ ID NO: 198985 - DNA, 25 bp, Homo sapien
ctatacagcatagtggagttttgtg

SEQ ID NO: 198986 - DNA, 25 bp, Homo sapien
ggagttttgtgtactaaaattgcta

SEQ ID NO: 198987 - DNA, 25 bp, Homo sapien
aattgctatctactggtcctttgga

SEQ ID NO: 198988 - DNA, 25 bp, Homo sapien
atctactggtcctttggaattgaag

SEQ ID NO: 198989 - DNA, 25 bp, Homo sapien
aacctaaaggcttggcgtcaggctt

SEQ ID NO: 198990 - DNA, 25 bp, Homo sapien
ggcgtcaggcttgaatatctcagaa

SEQ ID NO: 198991 - DNA, 25 bp, Homo sapien
gaacttaaactcttaccaaaatctg

SEQ ID NO: 198992 - DNA, 25 bp, Homo sapien
ctgtatatttttcttaaggagtggg

SEQ ID NO: 198993 - DNA, 25 bp, Homo sapien
gagtgggattcctactttatgtaat

SEQ ID NO: 198994 - DNA, 25 bp, Homo sapien
agatccccaagtaagaaaatgcaga

SEQ ID NO: 198995 - DNA, 25 bp, Homo sapien
aaaatgcagaggctcgggcttgttt

SEQ ID NO: 198996 - DNA, 25 bp, Homo sapien
tcgggcttgtttgagggttcacgac

SEQ ID NO: 198997 - DNA, 25 bp, Homo sapien
ggttcacgacccctccagcaaagga

SEQ ID NO: 198998 - DNA, 25 bp, Homo sapien
gacccctccagcaaaggagtctgag

SEQ ID NO: 198999 - DNA, 25 bp, Homo sapien
ggagtctgaggctgattccagtaga

SEQ ID NO: 199000 - DNA, 25 bp, Homo sapien
attccagtagaattagcagccctca

SEQ ID NO: 199001 - DNA, 25 bp, Homo sapien
gtagaattagcagccctcaatgctg

SEQ ID NO: 199002 - DNA, 25 bp, Homo sapien
attctcctctgtacttctctaagga

SEQ ID NO: 199003 - DNA, 25 bp, Homo sapien
gtacttctctaaggatgactacttt

SEQ ID NO: 199004 - DNA, 25 bp, Homo sapien
gatgactactttagattccgaatat

SEQ ID NO: 199005 - DNA, 25 bp, Homo sapien
gcaaagggcgcttttaaagagcttt

SEQ ID NO: 199006 - DNA, 25 bp, Homo sapien
aaagctccccccaatgacttttgct

SEQ ID NO: 199007 - DNA, 25 bp, Homo sapien
ggctgggaaatgtggcttatttgct

SEQ ID NO: 199008 - DNA, 25 bp, Homo sapien
ggcttatttgctgggtacgtgacta

SEQ ID NO: 199009 - DNA, 25 bp, Homo sapien
tttgctgggtacgtgactatcccta

SEQ ID NO: 199010 - DNA, 25 bp, Homo sapien
ggtacgtgactatccctaataacaa

SEQ ID NO: 199011 - DNA, 25 bp, Homo sapien
gaatgttgggtaggcagccagccct

SEQ ID NO: 199012 - DNA, 25 bp, Homo sapien
cagccagccctcttttaccataggg

SEQ ID NO: 199013 - DNA, 25 bp, Homo sapien
ttaccatagggcctcctggtgtttg

SEQ ID NO: 199014 - DNA, 25 bp, Homo sapien
gtttggattttgatctcaatgtgta

SEQ ID NO: 199015 - DNA, 25 bp, Homo sapien
gagatgtaacaagctcatagggtat

SEQ ID NO: 199016 - DNA, 25 bp, Homo sapien
gtcaccagtaattcaatcagacact

SEQ ID NO: 199017 - DNA, 25 bp, Homo sapien
agacactaatctaggtatttctgtg

SEQ ID NO: 199018 - DNA, 25 bp, Homo sapien
gaagtccattcccaattgactaagt

SEQ ID NO: 199019 - DNA, 25 bp, Homo sapien
agataatctgggtcagcctgacctg

SEQ ID NO: 199020 - DNA, 25 bp, Homo sapien
tgacctgattagtcagaaggcctaa

SEQ ID NO: 199021 - DNA, 25 bp, Homo sapien
cagagctaagggtttccctgaggaa

SEQ ID NO: 199022 - DNA, 25 bp, Homo sapien
cagcagcccagtgcttggcgagagt

SEQ ID NO: 199023 - DNA, 25 bp, Homo sapien
agtgcttggcgagagttcctgacag

SEQ ID NO: 199024 - DNA, 25 bp, Homo sapien
tgcctcacagagtttagacatgact

SEQ ID NO: 199025 - DNA, 25 bp, Homo sapien
gtttagacatgactagccagctcct

SEQ ID NO: 199026 - DNA, 25 bp, Homo sapien
gactagccagctcctacaatcactg

SEQ ID NO: 199027 - DNA, 25 bp, Homo sapien
cagaaaaagacgacccagcaagcct

SEQ ID NO: 199028 - DNA, 25 bp, Homo sapien
gcaagcctcacatgtttccaaagat

SEQ ID NO: 199029 - DNA, 25 bp, Homo sapien
aaatcacagatctccgtagcatcag

SEQ ID NO: 199030 - DNA, 25 bp, Homo sapien
gtgcagagcgtgtaattaccttgaa

SEQ ID NO: 199031 - DNA, 25 bp, Homo sapien
ggaaattcctggatcaatgccacct

SEQ ID NO: 199032 - DNA, 25 bp, Homo sapien
caatgccacctctcattcaagaaat

SEQ ID NO: 199033 - DNA, 25 bp, Homo sapien
gaattctgaaggacatgaacccttg

SEQ ID NO: 199034 - DNA, 25 bp, Homo sapien
atgaacccttgaccccaagttcaag

SEQ ID NO: 199035 - DNA, 25 bp, Homo sapien
agcagagcacagtcctagcatctca

SEQ ID NO: 199036 - DNA, 25 bp, Homo sapien
tctcacccagctcagtggaaaacag

SEQ ID NO: 199037 - DNA, 25 bp, Homo sapien
agtcagtcaccactcgtgcaataag

SEQ ID NO: 199038 - DNA, 25 bp, Homo sapien
aaagttattctttctggatctgccg

SEQ ID NO: 199039 - DNA, 25 bp, Homo sapien
ggatctgccgtgtccttataaagtg

SEQ ID NO: 199040 - DNA, 25 bp, Homo sapien
gaaaaatgttttgtacccatctgga

SEQ ID NO: 199041 - DNA, 25 bp, Homo sapien
tgttttgtacccatctggaaaacca

SEQ ID NO: 199042 - DNA, 25 bp, Homo sapien
gaaatctcaggtattccaggtcact

SEQ ID NO: 199043 - DNA, 25 bp, Homo sapien
caggtattccaggtcactgacatga

SEQ ID NO: 199044 - DNA, 25 bp, Homo sapien
ttccaggtcactgacatgaatttga

SEQ ID NO: 199045 - DNA, 25 bp, Homo sapien
agagagatatctggcttggttttaa

SEQ ID NO: 199046 - DNA, 25 bp, Homo sapien
atatctggcttggttttaattatgt

SEQ ID NO: 199047 - DNA, 25 bp, Homo sapien
gtgccaataattgcatatagatttt

SEQ ID NO: 199048 - DNA, 25 bp, Homo sapien
atttgactgtggaacatgccatttt

SEQ ID NO: 199049 - DNA, 25 bp, Homo sapien
aaatccaatgttgtgggtagagaga

SEQ ID NO: 199050 - DNA, 25 bp, Homo sapien
aatgagtttgtgactaggagagact

SEQ ID NO: 199051 - DNA, 25 bp, Homo sapien
gactaggagagactaaacttttgtt

SEQ ID NO: 199052 - DNA, 25 bp, Homo sapien
ttttccttacccagtataaatatat

SEQ ID NO: 199053 - DNA, 25 bp, Homo sapien
taaaagaaccccaagcatgcatctt

SEQ ID NO: 199054 - DNA, 25 bp, Homo sapien
aagcatgcatctttcatgtgtgtaa

SEQ ID NO: 199055 - DNA, 25 bp, Homo sapien
tcatttctgggctaatttcaaaaga

SEQ ID NO: 199056 - DNA, 25 bp, Homo sapien
agaatcccaatattgctgtatagaa

SEQ ID NO: 199057 - DNA, 25 bp, Homo sapien
gaaagagaactagcttgcacatttt

SEQ ID NO: 199058 - DNA, 25 bp, Homo sapien
cacattttaggtctgtgaaattttg

SEQ ID NO: 199059 - DNA, 25 bp, Homo sapien
gagacttttcctgcactggacagta

SEQ ID NO: 199060 - DNA, 25 bp, Homo sapien
acatgaattttcctgactgatctta

SEQ ID NO: 199061 - DNA, 25 bp, Homo sapien
aagagattcagtttgttgcacccag

SEQ ID NO: 199062 - DNA, 25 bp, Homo sapien
gtttgttgcacccagtgttaacaca

SEQ ID NO: 199063 - DNA, 25 bp, Homo sapien
gtgttaacacatctttgtcagagaa

SEQ ID NO: 199064 - DNA, 25 bp, Homo sapien
tgttagttacatattccctcgcaaa

SEQ ID NO: 199065 - DNA, 25 bp, Homo sapien
atattccctcgcaaacctggagtgc

SEQ ID NO: 199066 - DNA, 25 bp, Homo sapien
cgcaaacctggagtgcagaccacag

SEQ ID NO: 199067 - DNA, 25 bp, Homo sapien
gggaagctatctttgccctcccaac

SEQ ID NO: 199068 - DNA, 25 bp, Homo sapien
aactcgtctgcagtgcttagcctaa

SEQ ID NO: 199069 - DNA, 25 bp, Homo sapien
gtgcttagcctaacttttgtttatg

SEQ ID NO: 199070 - DNA, 25 bp, Homo sapien
gtcgttatgaagcattcaactgtgc

SEQ ID NO: 199071 - DNA, 25 bp, Homo sapien
cacatcgatacctgcagcatcttta

SEQ ID NO: 199072 - DNA, 25 bp, Homo sapien
tgcagcatctttagtcaagttggag

SEQ ID NO: 199073 - DNA, 25 bp, Homo sapien
gcatctttagtcaagttggaggaga

SEQ ID NO: 199074 - DNA, 25 bp, Homo sapien
ttggaggagaaagacaacacttggt

SEQ ID NO: 199075 - DNA, 25 bp, Homo sapien
ggagaaagacaacacttggtctaag

SEQ ID NO: 199076 - DNA, 25 bp, Homo sapien
cacttggtctaagacacggcagcaa

SEQ ID NO: 199077 - DNA, 25 bp, Homo sapien
taagacacggcagcaagacatccct

SEQ ID NO: 199078 - DNA, 25 bp, Homo sapien
cacggcagcaagacatccctgcata

SEQ ID NO: 199079 - DNA, 25 bp, Homo sapien
aaacagcttcgtgtctagtatgagc

SEQ ID NO: 199080 - DNA, 25 bp, Homo sapien
cagcttcgtgtctagtatgagctca

SEQ ID NO: 199081 - DNA, 25 bp, Homo sapien
cttcgtgtctagtatgagctcagta

SEQ ID NO: 199082 - DNA, 25 bp, Homo sapien
caccttacaggcctgcattacagga

SEQ ID NO: 199083 - DNA, 25 bp, Homo sapien
tacaggcctgcattacaggacttaa

SEQ ID NO: 199084 - DNA, 25 bp, Homo sapien
ctgcattacaggacttaaacacata

SEQ ID NO: 199085 - DNA, 25 bp, Homo sapien
aacacataatccaagaatttcttac

SEQ ID NO: 199086 - DNA, 25 bp, Homo sapien
atacattttaattggttgcatatat

SEQ ID NO: 199087 - DNA, 25 bp, Homo sapien
ggttgcatatattaacatgtactat

SEQ ID NO: 199088 - DNA, 25 bp, Homo sapien
taacatgtactataagattcttttc

SEQ ID NO: 199089 - DNA, 25 bp, Homo sapien
agatacatacaaaactcagcctgat

SEQ ID NO: 199090 - DNA, 25 bp, Homo sapien
aactcagcctgatcagactgggtgt

SEQ ID NO: 199091 - DNA, 25 bp, Homo sapien
cagcctgatcagactgggtgtgagc

SEQ ID NO: 199092 - DNA, 25 bp, Homo sapien
gatcagactgggtgtgagcctgtaa

SEQ ID NO: 199093 - DNA, 25 bp, Homo sapien
atacattttaattggttgcatatat

SEQ ID NO: 199094 - DNA, 25 bp, Homo sapien
ggttgcatatattaacatgtactat

SEQ ID NO: 199095 - DNA, 25 bp, Homo sapien
taacatgtactataagattcttttc

SEQ ID NO: 199096 - DNA, 25 bp, Homo sapien
gatactgtaaaaagatctgattagt

SEQ ID NO: 199097 - DNA, 25 bp, Homo sapien
agcattaacagatagatacatacaa

SEQ ID NO: 199098 - DNA, 25 bp, Homo sapien
agatacatacaaaactcagcctgat

SEQ ID NO: 199099 - DNA, 25 bp, Homo sapien
tacatacaaaactcagcctgatcag

SEQ ID NO: 199100 - DNA, 25 bp, Homo sapien
aaactcagcctgatcagactgggtg

SEQ ID NO: 199101 - DNA, 25 bp, Homo sapien
actcagcctgatcagactgggtgtg

SEQ ID NO: 199102 - DNA, 25 bp, Homo sapien
cagcctgatcagactgggtgtgagc

SEQ ID NO: 199103 - DNA, 25 bp, Homo sapien
tcccaaggggtagccttcaaggagg

SEQ ID NO: 199104 - DNA, 25 bp, Homo sapien
cagttaaatttttcacctgctgtgt

SEQ ID NO: 199105 - DNA, 25 bp, Homo sapien
atttttcacctgctgtgtaactgaa

SEQ ID NO: 199106 - DNA, 25 bp, Homo sapien
ggagataattttgcaactcatgtta

SEQ ID NO: 199107 - DNA, 25 bp, Homo sapien
ttgcaactcatgttatgggttaaat

SEQ ID NO: 199108 - DNA, 25 bp, Homo sapien
gaaactttacaacacaattgcatcc

SEQ ID NO: 199109 - DNA, 25 bp, Homo sapien
aattgcatcccaaatacaaattgta

SEQ ID NO: 199110 - DNA, 25 bp, Homo sapien
acaaattgtattgcttattcattat

SEQ ID NO: 199111 - DNA, 25 bp, Homo sapien
attcattatagctattcgtcctgta

SEQ ID NO: 199112 - DNA, 25 bp, Homo sapien
tattcgtcctgtaatctgtttctag

SEQ ID NO: 199113 - DNA, 25 bp, Homo sapien
gtttctaggtgaagcatactccagt

SEQ ID NO: 199114 - DNA, 25 bp, Homo sapien
tgaagcatactccagtgttttaggg

SEQ ID NO: 199115 - DNA, 25 bp, Homo sapien
aagtcctatggaagaaacagcagaa

SEQ ID NO: 199116 - DNA, 25 bp, Homo sapien
atgtgcaattattcactagagcatg

SEQ ID NO: 199117 - DNA, 25 bp, Homo sapien
gcatgaggagtgaaacgctctgttt

SEQ ID NO: 199118 - DNA, 25 bp, Homo sapien
aaacgctctgtttagtatgtataac

SEQ ID NO: 199119 - DNA, 25 bp, Homo sapien
ggaagatcagacaacattggtcctg

SEQ ID NO: 199120 - DNA, 25 bp, Homo sapien
gacaacattggtcctgaattcccac

SEQ ID NO: 199121 - DNA, 25 bp, Homo sapien
acattggtcctgaattcccacagag

SEQ ID NO: 199122 - DNA, 25 bp, Homo sapien
cccacagagcagcaagctactagag

SEQ ID NO: 199123 - DNA, 25 bp, Homo sapien
gcaagctactagagctcaatctgtt

SEQ ID NO: 199124 - DNA, 25 bp, Homo sapien
gctactagagctcaatctgttattt

SEQ ID NO: 199125 - DNA, 25 bp, Homo sapien
tagagctcaatctgttatttctttt

SEQ ID NO: 199126 - DNA, 25 bp, Homo sapien
gagcagtacaagagtaagtatcaca

SEQ ID NO: 199127 - DNA, 25 bp, Homo sapien
gtaagtatcacattcacaggatgaa

SEQ ID NO: 199128 - DNA, 25 bp, Homo sapien
tgaattaagaattgccaaggtgttc

SEQ ID NO: 199129 - DNA, 25 bp, Homo sapien
tggaaactgcagcatctcctgtccc

SEQ ID NO: 199130 - DNA, 25 bp, Homo sapien
gccatgtcattctagctgtgaactg

SEQ ID NO: 199131 - DNA, 25 bp, Homo sapien
cattctagctgtgaactggcacgaa

SEQ ID NO: 199132 - DNA, 25 bp, Homo sapien
aactggcacgaatgtcagcagcttt

SEQ ID NO: 199133 - DNA, 25 bp, Homo sapien
cattcagctgaatgctctttgagag

SEQ ID NO: 199134 - DNA, 25 bp, Homo sapien
tgagttggaaattcatgctttgatg

SEQ ID NO: 199135 - DNA, 25 bp, Homo sapien
gatgagatataagacctatgtgcat

SEQ ID NO: 199136 - DNA, 25 bp, Homo sapien
gacctatgtgcatcttttctaatac

SEQ ID NO: 199137 - DNA, 25 bp, Homo sapien
gaatatttaattctggttttagcat

SEQ ID NO: 199138 - DNA, 25 bp, Homo sapien
actaaagtggagctttaatcactat

SEQ ID NO: 199139 - DNA, 25 bp, Homo sapien
gtatctatagacacagacacttgcc

SEQ ID NO: 199140 - DNA, 25 bp, Homo sapien
gacacagacacttgcctatacagag

SEQ ID NO: 199141 - DNA, 25 bp, Homo sapien
gacacttgcctatacagagacataa

SEQ ID NO: 199142 - DNA, 25 bp, Homo sapien
atacagagacataaccacacacact

SEQ ID NO: 199143 - DNA, 25 bp, Homo sapien
ataaccacacacactcagaggatag

SEQ ID NO: 199144 - DNA, 25 bp, Homo sapien
gaggatagtgaacaaatctgtcttt

SEQ ID NO: 199145 - DNA, 25 bp, Homo sapien
ctgtctttgacttacgacccatttt

SEQ ID NO: 199146 - DNA, 25 bp, Homo sapien
tgacttacgacccattttgcaagac

SEQ ID NO: 199147 - DNA, 25 bp, Homo sapien
attttgcaagacttaaagccggaag

SEQ ID NO: 199148 - DNA, 25 bp, Homo sapien
ccaattctcttaactattcatgtag

SEQ ID NO: 199149 - DNA, 25 bp, Homo sapien
aattctcttaactattcatgtagta

SEQ ID NO: 199150 - DNA, 25 bp, Homo sapien
ttctcttaactattcatgtagtaag

SEQ ID NO: 199151 - DNA, 25 bp, Homo sapien
ctattcatgtagtaaggtgggaacc

SEQ ID NO: 199152 - DNA, 25 bp, Homo sapien
tagtaaggtgggaaccttcgcctgc

SEQ ID NO: 199153 - DNA, 25 bp, Homo sapien
agtaaggtgggaaccttcgcctgcg

SEQ ID NO: 199154 - DNA, 25 bp, Homo sapien
aggtgggaaccttcgcctgcggtag

SEQ ID NO: 199155 - DNA, 25 bp, Homo sapien
gaaccttcgcctgcggtagggccgg

SEQ ID NO: 199156 - DNA, 25 bp, Homo sapien
ttcgcctgcggtagggccggcgttg

SEQ ID NO: 199157 - DNA, 25 bp, Homo sapien
tagggccggcgttgttgggcctggc

SEQ ID NO: 199158 - DNA, 25 bp, Homo sapien
gccggcgttgttgggcctggccttc

SEQ ID NO: 199159 - DNA, 25 bp, Homo sapien
aaaggttctttgtgtatagccaaat

SEQ ID NO: 199160 - DNA, 25 bp, Homo sapien
tagccaaatgactgaaagcactgat

SEQ ID NO: 199161 - DNA, 25 bp, Homo sapien
atttgtaccatttcagtaaacctgt

SEQ ID NO: 199162 - DNA, 25 bp, Homo sapien
aaacctgtctgaatgtacctgtata

SEQ ID NO: 199163 - DNA, 25 bp, Homo sapien
tgtacctgtatacgtttcaaaaaca

SEQ ID NO: 199164 - DNA, 25 bp, Homo sapien
cacacttagctggagatgtctctaa

SEQ ID NO: 199165 - DNA, 25 bp, Homo sapien
ggagatgtctctaaaagccctgtat

SEQ ID NO: 199166 - DNA, 25 bp, Homo sapien
aaaagccctgtatcgtattcacctt

SEQ ID NO: 199167 - DNA, 25 bp, Homo sapien
gtatcgtattcaccttcagtttttg

SEQ ID NO: 199168 - DNA, 25 bp, Homo sapien
tcgtattcaccttcagtttttgtgt

SEQ ID NO: 199169 - DNA, 25 bp, Homo sapien
gattgcttttttgtagtgttcagaa

SEQ ID NO: 199170 - DNA, 25 bp, Homo sapien
aggaattgccctatttgtcgcctac

SEQ ID NO: 199171 - DNA, 25 bp, Homo sapien
tgtcgcctacagatgactggagcaa

SEQ ID NO: 199172 - DNA, 25 bp, Homo sapien
gaatcttgggtggtatcagatgcac

SEQ ID NO: 199173 - DNA, 25 bp, Homo sapien
agatgcacccactgaagatgatatg

SEQ ID NO: 199174 - DNA, 25 bp, Homo sapien
ggctaactatattcttaacatggct

SEQ ID NO: 199175 - DNA, 25 bp, Homo sapien
tattcttaacatggctgatgaggca

SEQ ID NO: 199176 - DNA, 25 bp, Homo sapien
gtgaaagtcttctgttgctattgtg

SEQ ID NO: 199177 - DNA, 25 bp, Homo sapien
ctgttgctattgtgggctcaaatat

SEQ ID NO: 199178 - DNA, 25 bp, Homo sapien
tagggttgtggcactggcacagaca

SEQ ID NO: 199179 - DNA, 25 bp, Homo sapien
gtggcactggcacagacacaggaaa

SEQ ID NO: 199180 - DNA, 25 bp, Homo sapien
tttgctattctgatcatttgtcccc

SEQ ID NO: 199181 - DNA, 25 bp, Homo sapien
acagcactgtcctatgaaccttcct

SEQ ID NO: 199182 - DNA, 25 bp, Homo sapien
attctccacctcagtatctgctttc

SEQ ID NO: 199183 - DNA, 25 bp, Homo sapien
gggaacccaacctgcgacagtgctt

SEQ ID NO: 199184 - DNA, 25 bp, Homo sapien
gcttctgtgtgttttcagtcctgca

SEQ ID NO: 199185 - DNA, 25 bp, Homo sapien
cagtcctgcaggtttgaactctgac

SEQ ID NO: 199186 - DNA, 25 bp, Homo sapien
gaactctgactttggagacttttcc

SEQ ID NO: 199187 - DNA, 25 bp, Homo sapien
gagacttttccagttatctcgtgga

SEQ ID NO: 199188 - DNA, 25 bp, Homo sapien
tctcgtggaatgacagattgtgcct

SEQ ID NO: 199189 - DNA, 25 bp, Homo sapien
gacagattgtgcctgtatgatatca

SEQ ID NO: 199190 - DNA, 25 bp, Homo sapien
taggcagacctatttattctagatg

SEQ ID NO: 199191 - DNA, 25 bp, Homo sapien
tttatgtgttatgtgactctgaact

SEQ ID NO: 199192 - DNA, 25 bp, Homo sapien
agtattggatcatgaagagctcttc

SEQ ID NO: 199193 - DNA, 25 bp, Homo sapien
agagctcttcatgcattctttgcaa

SEQ ID NO: 199194 - DNA, 25 bp, Homo sapien
ggaggttataaagttacgccctcag

SEQ ID NO: 199195 - DNA, 25 bp, Homo sapien
agttacgccctcagaacatttataa

SEQ ID NO: 199196 - DNA, 25 bp, Homo sapien
gaatgtgccagttaaagtgctcaac

SEQ ID NO: 199197 - DNA, 25 bp, Homo sapien
aaactcacatagcttacttctctct

SEQ ID NO: 199198 - DNA, 25 bp, Homo sapien
ttctctctctaaagtgcaacaagga

SEQ ID NO: 199199 - DNA, 25 bp, Homo sapien
gaatgggccaaggtatgacaattaa

SEQ ID NO: 199200 - DNA, 25 bp, Homo sapien
taatggttctgcatgacctagccac

SEQ ID NO: 199201 - DNA, 25 bp, Homo sapien
gttttcttctataacgttgtccttg

SEQ ID NO: 199202 - DNA, 25 bp, Homo sapien
gttgtccttgtgaaaacttttgtga

SEQ ID NO: 199203 - DNA, 25 bp, Homo sapien
cgtttattacggctgttcttgtgga

SEQ ID NO: 199204 - DNA, 25 bp, Homo sapien
tttattacggctgttcttgtggaat

SEQ ID NO: 199205 - DNA, 25 bp, Homo sapien
gcaaggtgatatttggaagcccaga

SEQ ID NO: 199206 - DNA, 25 bp, Homo sapien
ggaaagaagctttctgcgaaactgc

SEQ ID NO: 199207 - DNA, 25 bp, Homo sapien
tttctgcgaaactgctttgtgttct

SEQ ID NO: 199208 - DNA, 25 bp, Homo sapien
ttcaagaagcctctgcctaagactg

SEQ ID NO: 199209 - DNA, 25 bp, Homo sapien
agaagcctctgcctaagactgttgt

SEQ ID NO: 199210 - DNA, 25 bp, Homo sapien
agcctctgcctaagactgttgttgt

SEQ ID NO: 199211 - DNA, 25 bp, Homo sapien
ctgcctaagactgttgttgtggaat

SEQ ID NO: 199212 - DNA, 25 bp, Homo sapien
agtgatattttaaagcccttagaga

SEQ ID NO: 199213 - DNA, 25 bp, Homo sapien
attttaaagcccttagagagctatg

SEQ ID NO: 199214 - DNA, 25 bp, Homo sapien
gtgcagcttattgtagaccattact

SEQ ID NO: 199215 - DNA, 25 bp, Homo sapien
tgcagcttattgtagaccattacta

SEQ ID NO: 199216 - DNA, 25 bp, Homo sapien
gcaaagctctttcttattttcctca

SEQ ID NO: 199217 - DNA, 25 bp, Homo sapien
tattttcctcataatcagctaccct

SEQ ID NO: 199218 - DNA, 25 bp, Homo sapien
gagggagaactcattttacagaact

SEQ ID NO: 199219 - DNA, 25 bp, Homo sapien
agaacttggtttcctttgccgatct

SEQ ID NO: 199220 - DNA, 25 bp, Homo sapien
ctttgccgatcttatgtacataccc

SEQ ID NO: 199221 - DNA, 25 bp, Homo sapien
ttttagctttcccatgcatacttaa

SEQ ID NO: 199222 - DNA, 25 bp, Homo sapien
tgcatacttaactgcacttgcttta

SEQ ID NO: 199223 - DNA, 25 bp, Homo sapien
acttgctttatctccttgggcattc

SEQ ID NO: 199224 - DNA, 25 bp, Homo sapien
cttgggcattcgtacttaggattca

SEQ ID NO: 199225 - DNA, 25 bp, Homo sapien
aaccctgagtccctaaaggcagcag

SEQ ID NO: 199226 - DNA, 25 bp, Homo sapien
gcagcagctcaaggatggcactcag

SEQ ID NO: 199227 - DNA, 25 bp, Homo sapien
aggatggcactcagatctccatggc

SEQ ID NO: 199228 - DNA, 25 bp, Homo sapien
aggccaagataaatctaccacccca

SEQ ID NO: 199229 - DNA, 25 bp, Homo sapien
aagataaatctaccaccccaggcac

SEQ ID NO: 199230 - DNA, 25 bp, Homo sapien
ccaggcacctgtgagccaacaggtt

SEQ ID NO: 199231 - DNA, 25 bp, Homo sapien
gagccaacaggttaattagtccatt

SEQ ID NO: 199232 - DNA, 25 bp, Homo sapien
tagtgggacctgcatatgttgaaaa

SEQ ID NO: 199233 - DNA, 25 bp, Homo sapien
aattaccaatactgactgacatgtg

SEQ ID NO: 199234 - DNA, 25 bp, Homo sapien
gactgacatgtgatgctgacctatg

SEQ ID NO: 199235 - DNA, 25 bp, Homo sapien
catgtgatgctgacctatgataagg

SEQ ID NO: 199236 - DNA, 25 bp, Homo sapien
cagctgcctcgacacagcactgtgg

SEQ ID NO: 199237 - DNA, 25 bp, Homo sapien
tattgcccaggcacgccatttccaa

SEQ ID NO: 199238 - DNA, 25 bp, Homo sapien
aggcacgccatttccaagggcagga

SEQ ID NO: 199239 - DNA, 25 bp, Homo sapien
ggcagtgtcctgaagcccatctttt

SEQ ID NO: 199240 - DNA, 25 bp, Homo sapien
gtcctgaagcccatcttttctgtga

SEQ ID NO: 199241 - DNA, 25 bp, Homo sapien
tgaagcccatcttttctgtgactgt

SEQ ID NO: 199242 - DNA, 25 bp, Homo sapien
aagcccatcttttctgtgactgtct

SEQ ID NO: 199243 - DNA, 25 bp, Homo sapien
ccatcttttctgtgactgtcttagg

SEQ ID NO: 199244 - DNA, 25 bp, Homo sapien
tctgtgactgtcttaggtgatgtgt

SEQ ID NO: 199245 - DNA, 25 bp, Homo sapien
actgtcttaggtgatgtgtagcccc

SEQ ID NO: 199246 - DNA, 25 bp, Homo sapien
ttaggtgatgtgtagccccctccac

SEQ ID NO: 199247 - DNA, 25 bp, Homo sapien
acaacatcttgtaagactgtgcccg

SEQ ID NO: 199248 - DNA, 25 bp, Homo sapien
actcacaccatcctatgagcccacg

SEQ ID NO: 199249 - DNA, 25 bp, Homo sapien
ccatcctgtgaaccccactccactc

SEQ ID NO: 199250 - DNA, 25 bp, Homo sapien
catcctgtgaaccccactccactcg

SEQ ID NO: 199251 - DNA, 25 bp, Homo sapien
cactccactcgcacgtgattacagt

SEQ ID NO: 199252 - DNA, 25 bp, Homo sapien
actccactcgcacgtgattacagtc

SEQ ID NO: 199253 - DNA, 25 bp, Homo sapien
ctccactcgcacgtgattacagtct

SEQ ID NO: 199254 - DNA, 25 bp, Homo sapien
tccactcgcacgtgattacagtctg

SEQ ID NO: 199255 - DNA, 25 bp, Homo sapien
ccactcgcacgtgattacagtctgt

SEQ ID NO: 199256 - DNA, 25 bp, Homo sapien
cactcgcacgtgattacagtctgta

SEQ ID NO: 199257 - DNA, 25 bp, Homo sapien
actcgcacgtgattacagtctgtaa

SEQ ID NO: 199258 - DNA, 25 bp, Homo sapien
tggcatggaggatttcggtagattt

SEQ ID NO: 199259 - DNA, 25 bp, Homo sapien
tcggtagatttgaaagcttgtttgg

SEQ ID NO: 199260 - DNA, 25 bp, Homo sapien
gaaagcatccaaatttaaagggccg

SEQ ID NO: 199261 - DNA, 25 bp, Homo sapien
gccggtacataggaggagagaaaat

SEQ ID NO: 199262 - DNA, 25 bp, Homo sapien
gggatgccaagaatttttagaattt

SEQ ID NO: 199263 - DNA, 25 bp, Homo sapien
gaattcattggttataagcaacagt

SEQ ID NO: 199264 - DNA, 25 bp, Homo sapien
taagcaacagttgcccattgaccag

SEQ ID NO: 199265 - DNA, 25 bp, Homo sapien
aacagttgcccattgaccagactta

SEQ ID NO: 199266 - DNA, 25 bp, Homo sapien
gttgcccattgaccagacttaagtc

SEQ ID NO: 199267 - DNA, 25 bp, Homo sapien
tcaagaaggagcattagcctggtgt

SEQ ID NO: 199268 - DNA, 25 bp, Homo sapien
gggagaccaaatgagaaggattgct

SEQ ID NO: 199269 - DNA, 25 bp, Homo sapien
atttttcatgcatcaaagatatgag

SEQ ID NO: 199270 - DNA, 25 bp, Homo sapien
gaaatcatttctgttaggtcggtat

SEQ ID NO: 199271 - DNA, 25 bp, Homo sapien
atcatttctgttaggtcggtattat

SEQ ID NO: 199272 - DNA, 25 bp, Homo sapien
tttctgttaggtcggtattatttat

SEQ ID NO: 199273 - DNA, 25 bp, Homo sapien
ttaggtcggtattatttatgacact

SEQ ID NO: 199274 - DNA, 25 bp, Homo sapien
gatgcatgatgaaaacctgagtgaa

SEQ ID NO: 199275 - DNA, 25 bp, Homo sapien
aaacctgagtgaagaggctgtttgt

SEQ ID NO: 199276 - DNA, 25 bp, Homo sapien
gaagaggctgtttgtgtttaactta

SEQ ID NO: 199277 - DNA, 25 bp, Homo sapien
taatattgagtgatccatgaagtag

SEQ ID NO: 199278 - DNA, 25 bp, Homo sapien
gagtgatccatgaagtaggttttca

SEQ ID NO: 199279 - DNA, 25 bp, Homo sapien
ccatgaagtaggttttcagagcaat

SEQ ID NO: 199280 - DNA, 25 bp, Homo sapien
atagcagctccatttctggagtctg

SEQ ID NO: 199281 - DNA, 25 bp, Homo sapien
tcttcaagtgaacatctcttgccat

SEQ ID NO: 199282 - DNA, 25 bp, Homo sapien
cttcaagtgaacatctcttgccatc

SEQ ID NO: 199283 - DNA, 25 bp, Homo sapien
ttcaagtgaacatctcttgccatca

SEQ ID NO: 199284 - DNA, 25 bp, Homo sapien
tcaagtgaacatctcttgccatcac

SEQ ID NO: 199285 - DNA, 25 bp, Homo sapien
gtgaacatctcttgccatcacctag

SEQ ID NO: 199286 - DNA, 25 bp, Homo sapien
tgaacatctcttgccatcacctagc

SEQ ID NO: 199287 - DNA, 25 bp, Homo sapien
gaacatctcttgccatcacctagct

SEQ ID NO: 199288 - DNA, 25 bp, Homo sapien
aacatctcttgccatcacctagctg

SEQ ID NO: 199289 - DNA, 25 bp, Homo sapien
acatctcttgccatcacctagctgc

SEQ ID NO: 199290 - DNA, 25 bp, Homo sapien
gagaagagtttaggagtcctcctcg

SEQ ID NO: 199291 - DNA, 25 bp, Homo sapien
catggcctcttcatggaaggtgcct

SEQ ID NO: 199292 - DNA, 25 bp, Homo sapien
ttcatggaaggtgcctgctgggaca

SEQ ID NO: 199293 - DNA, 25 bp, Homo sapien
gacacacaggctgggatcattacag

SEQ ID NO: 199294 - DNA, 25 bp, Homo sapien
gcaaagctgaaggatctgacacccc

SEQ ID NO: 199295 - DNA, 25 bp, Homo sapien
cctatgcctgtgatgttcatcaagg

SEQ ID NO: 199296 - DNA, 25 bp, Homo sapien
aggactgccgcagtgtctattcctg

SEQ ID NO: 199297 - DNA, 25 bp, Homo sapien
gtctattcctgtcctgtgtacaaga

SEQ ID NO: 199298 - DNA, 25 bp, Homo sapien
acctacgtgtggactttcaacctga

SEQ ID NO: 199299 - DNA, 25 bp, Homo sapien
aaacccatccaagtgggttctggct

SEQ ID NO: 199300 - DNA, 25 bp, Homo sapien
ggttctggctggagtagccttgctt

SEQ ID NO: 199301 - DNA, 25 bp, Homo sapien
atattctctctcagaaatcaatggc

SEQ ID NO: 199302 - DNA, 25 bp, Homo sapien
tattctctctcagaaatcaatggca

SEQ ID NO: 199303 - DNA, 25 bp, Homo sapien
ttctctctcagaaatcaatggcatt

SEQ ID NO: 199304 - DNA, 25 bp, Homo sapien
tctctctcagaaatcaatggcattt

SEQ ID NO: 199305 - DNA, 25 bp, Homo sapien
ctctctcagaaatcaatggcatttg

SEQ ID NO: 199306 - DNA, 25 bp, Homo sapien
tctctcagaaatcaatggcatttga

SEQ ID NO: 199307 - DNA, 25 bp, Homo sapien
gaaatcaatggcatttgaaccacca

SEQ ID NO: 199308 - DNA, 25 bp, Homo sapien
tcaatggcatttgaaccaccaaaaa

SEQ ID NO: 199309 - DNA, 25 bp, Homo sapien
aatggcatttgaaccaccaaaaaga

SEQ ID NO: 199310 - DNA, 25 bp, Homo sapien
ataaagggctgagtgtggtgctcac

SEQ ID NO: 199311 - DNA, 25 bp, Homo sapien
taaagggctgagtgtggtgctcacg

SEQ ID NO: 199312 - DNA, 25 bp, Homo sapien
aaagtgggcatccaagccgggttct

SEQ ID NO: 199313 - DNA, 25 bp, Homo sapien
caagccgggttctggctgcagaagt

SEQ ID NO: 199314 - DNA, 25 bp, Homo sapien
gacctggtgggtgaacctgagctct

SEQ ID NO: 199315 - DNA, 25 bp, Homo sapien
ggtgaacctgagctctcccaggaga

SEQ ID NO: 199316 - DNA, 25 bp, Homo sapien
gctctcccaggagacaacttagctg

SEQ ID NO: 199317 - DNA, 25 bp, Homo sapien
gagacaacttagctgccagtcacca

SEQ ID NO: 199318 - DNA, 25 bp, Homo sapien
agtcaccacctatgaggctcttcta

SEQ ID NO: 199319 - DNA, 25 bp, Homo sapien
acctatgaggctcttctaccccgtg

SEQ ID NO: 199320 - DNA, 25 bp, Homo sapien
cagacctctctgtgttgtgtgcgtg

SEQ ID NO: 199321 - DNA, 25 bp, Homo sapien
acctctctgtgttgtgtgcgtggca

SEQ ID NO: 199322 - DNA, 25 bp, Homo sapien
gtgtgcgtggcagcctccaggaata

SEQ ID NO: 199323 - DNA, 25 bp, Homo sapien
gaattcatagcaattaccgtctgta

SEQ ID NO: 199324 - DNA, 25 bp, Homo sapien
taccgtctgtatcacttctttggaa

SEQ ID NO: 199325 - DNA, 25 bp, Homo sapien
ttaattatgtacaagcagaccccaa

SEQ ID NO: 199326 - DNA, 25 bp, Homo sapien
gcagaccccaaattatggcaggctt

SEQ ID NO: 199327 - DNA, 25 bp, Homo sapien
tatggcaggcttgtcattgaaaagt

SEQ ID NO: 199328 - DNA, 25 bp, Homo sapien
ggatttccagctggcccatggaagc

SEQ ID NO: 199329 - DNA, 25 bp, Homo sapien
ggaagcctctttaacctacaatgta

SEQ ID NO: 199330 - DNA, 25 bp, Homo sapien
gtattattagtcctgtcgtcgttcc

SEQ ID NO: 199331 - DNA, 25 bp, Homo sapien
ctgtcgtcgttcctcattgttttca

SEQ ID NO: 199332 - DNA, 25 bp, Homo sapien
gaaaacgtgtcctgacttccaagct

SEQ ID NO: 199333 - DNA, 25 bp, Homo sapien
ctttctctggagctcaagcctctgg

SEQ ID NO: 199334 - DNA, 25 bp, Homo sapien
ttttgccatctctgggtaccggtga

SEQ ID NO: 199335 - DNA, 25 bp, Homo sapien
taccggtgaccctagtggctgctgg

SEQ ID NO: 199336 - DNA, 25 bp, Homo sapien
accgcacgtcacagtacatgccagc

SEQ ID NO: 199337 - DNA, 25 bp, Homo sapien
ggcgtacccagactacgcagaccag

SEQ ID NO: 199338 - DNA, 25 bp, Homo sapien
cagactacgcagaccagagcacata

SEQ ID NO: 199339 - DNA, 25 bp, Homo sapien
gactacgcagaccagagcacataga

SEQ ID NO: 199340 - DNA, 25 bp, Homo sapien
tacgcagaccagagcacatagaggg

SEQ ID NO: 199341 - DNA, 25 bp, Homo sapien
gaccagagcacatagagggcagcat

SEQ ID NO: 199342 - DNA, 25 bp, Homo sapien
agagcacatagagggcagcatttgg

SEQ ID NO: 199343 - DNA, 25 bp, Homo sapien
agagggcagcatttgggcagaatat

SEQ ID NO: 199344 - DNA, 25 bp, Homo sapien
atgtgctggtcaataaatgtgtcag

SEQ ID NO: 199345 - DNA, 25 bp, Homo sapien
aagtagaaaaacatgttggcaacat

SEQ ID NO: 199346 - DNA, 25 bp, Homo sapien
gattgagataatatgacttaactag

SEQ ID NO: 199347 - DNA, 25 bp, Homo sapien
acttaactagttttgtcattccatt

SEQ ID NO: 199348 - DNA, 25 bp, Homo sapien
actagttttgtcattccatttgtta

SEQ ID NO: 199349 - DNA, 25 bp, Homo sapien
agttttgtcattccatttgttaaag

SEQ ID NO: 199350 - DNA, 25 bp, Homo sapien
ttgtcattccatttgttaaagatac

SEQ ID NO: 199351 - DNA, 25 bp, Homo sapien
gttaaagatacagtcaccaagaatg

SEQ ID NO: 199352 - DNA, 25 bp, Homo sapien
gatacagtcaccaagaatgttttga

SEQ ID NO: 199353 - DNA, 25 bp, Homo sapien
gtcaccaagaatgttttgagttttt

SEQ ID NO: 199354 - DNA, 25 bp, Homo sapien
atttccattcagtgatgttggatgt

SEQ ID NO: 199355 - DNA, 25 bp, Homo sapien
cattcagtgatgttggatgtatatc

SEQ ID NO: 199356 - DNA, 25 bp, Homo sapien
tgctaggtttgctgtcttccctctc

SEQ ID NO: 199357 - DNA, 25 bp, Homo sapien
atactctcctttaccatactattgg

SEQ ID NO: 199358 - DNA, 25 bp, Homo sapien
catactattggactggactcaggct

SEQ ID NO: 199359 - DNA, 25 bp, Homo sapien
ctattggactggactcaggctggag

SEQ ID NO: 199360 - DNA, 25 bp, Homo sapien
tggaggcagatagacacagtatagg

SEQ ID NO: 199361 - DNA, 25 bp, Homo sapien
gggaatgggcttgcttctcccaaac

SEQ ID NO: 199362 - DNA, 25 bp, Homo sapien
cttctggaccaggaattagttgctg

SEQ ID NO: 199363 - DNA, 25 bp, Homo sapien
acagctgaagtcagtttgtcttgct

SEQ ID NO: 199364 - DNA, 25 bp, Homo sapien
gaagtcagtttgtcttgctggttta

SEQ ID NO: 199365 - DNA, 25 bp, Homo sapien
atagatctttcagagctgggtgctg

SEQ ID NO: 199366 - DNA, 25 bp, Homo sapien
tgaaaagcagcttagttaccctttt

SEQ ID NO: 199367 - DNA, 25 bp, Homo sapien
tagattctgcctgacacggaacacc

SEQ ID NO: 199368 - DNA, 25 bp, Homo sapien
tgacacggaacaccaggtctgctcg

SEQ ID NO: 199369 - DNA, 25 bp, Homo sapien
ggaacaccaggtctgctcgtctttt

SEQ ID NO: 199370 - DNA, 25 bp, Homo sapien
accaggtctgctcgtcttttttgtg

SEQ ID NO: 199371 - DNA, 25 bp, Homo sapien
gcttatttaaggtacatttctttgg

SEQ ID NO: 199372 - DNA, 25 bp, Homo sapien
ggtacatttctttgggtttctagag

SEQ ID NO: 199373 - DNA, 25 bp, Homo sapien
acatttctttgggtttctagagacg

SEQ ID NO: 199374 - DNA, 25 bp, Homo sapien
tcattagacggtttccaggttttct

SEQ ID NO: 199375 - DNA, 25 bp, Homo sapien
aggtgacgctgttagcgcctcagct

SEQ ID NO: 199376 - DNA, 25 bp, Homo sapien
gtgacgctgttagcgcctcagctgg

SEQ ID NO: 199377 - DNA, 25 bp, Homo sapien
acaccgcagagctgtccaggcacag

SEQ ID NO: 199378 - DNA, 25 bp, Homo sapien
ctcctcctccagaagattacgaaga

SEQ ID NO: 199379 - DNA, 25 bp, Homo sapien
tgtggttgagtatagtgatccttat

SEQ ID NO: 199380 - DNA, 25 bp, Homo sapien
gagtatagtgatccttatgctgaag

SEQ ID NO: 199381 - DNA, 25 bp, Homo sapien
tatgctgaagaggacccaccgtggg

SEQ ID NO: 199382 - DNA, 25 bp, Homo sapien
gaagaggacccaccgtgggctccac

SEQ ID NO: 199383 - DNA, 25 bp, Homo sapien
tgggctccacgttcttacttggaaa

SEQ ID NO: 199384 - DNA, 25 bp, Homo sapien
aggttgtggcaatttatgactatac

SEQ ID NO: 199385 - DNA, 25 bp, Homo sapien
gaagatgagctgtcctttcaggaag

SEQ ID NO: 199386 - DNA, 25 bp, Homo sapien
gagccattatttatgtcatcaagaa

SEQ ID NO: 199387 - DNA, 25 bp, Homo sapien
tcctgggaattacgttgagtctatc

SEQ ID NO: 199388 - DNA, 25 bp, Homo sapien
acgttgagtctatcatgcattattc

SEQ ID NO: 199389 - DNA, 25 bp, Homo sapien
agtgaaaggattccgcggcactgcc

SEQ ID NO: 199390 - DNA, 25 bp, Homo sapien
ggcactgcctctattattataccgt

SEQ ID NO: 199391 - DNA, 25 bp, Homo sapien
aggatatgtctcaatttgttctgca

SEQ ID NO: 199392 - DNA, 25 bp, Homo sapien
ttgttctgcattaatgccacagtgg

SEQ ID NO: 199393 - DNA, 25 bp, Homo sapien
agagcagatacgtaggcccatgaaa

SEQ ID NO: 199394 - DNA, 25 bp, Homo sapien
cgtaggcccatgaaattgatgaact

SEQ ID NO: 199395 - DNA, 25 bp, Homo sapien
tgagagttgtcttccagtcctgagc

SEQ ID NO: 199396 - DNA, 25 bp, Homo sapien
tgagcgcaccatctggaattccagt

SEQ ID NO: 199397 - DNA, 25 bp, Homo sapien
attccagtctgaggttacaattaga

SEQ ID NO: 199398 - DNA, 25 bp, Homo sapien
gttacaattagaactcctgacccca

SEQ ID NO: 199399 - DNA, 25 bp, Homo sapien
ctgaccccagattcaactttgtaaa

SEQ ID NO: 199400 - DNA, 25 bp, Homo sapien
tataatactttaaagtcccagtaga

SEQ ID NO: 199401 - DNA, 25 bp, Homo sapien
ctttaaagtcccagtagaaatagct

SEQ ID NO: 199402 - DNA, 25 bp, Homo sapien
tttaaagtcccagtagaaatagcta

SEQ ID NO: 199403 - DNA, 25 bp, Homo sapien
ttaaagtcccagtagaaatagctaa

SEQ ID NO: 199404 - DNA, 25 bp, Homo sapien
taaagtcccagtagaaatagctaac

SEQ ID NO: 199405 - DNA, 25 bp, Homo sapien
aaagtcccagtagaaatagctaaca

SEQ ID NO: 199406 - DNA, 25 bp, Homo sapien
aagtcccagtagaaatagctaacaa

SEQ ID NO: 199407 - DNA, 25 bp, Homo sapien
agtcccagtagaaatagctaacaaa

SEQ ID NO: 199408 - DNA, 25 bp, Homo sapien
gtcccagtagaaatagctaacaaag

SEQ ID NO: 199409 - DNA, 25 bp, Homo sapien
tcccagtagaaatagctaacaaagg

SEQ ID NO: 199410 - DNA, 25 bp, Homo sapien
ccagtagaaatagctaacaaaggct

SEQ ID NO: 199411 - DNA, 25 bp, Homo sapien
cagttttctgcccaatagagtttaa

SEQ ID NO: 199412 - DNA, 25 bp, Homo sapien
aatgtaagcaacaagtccatgtcat

SEQ ID NO: 199413 - DNA, 25 bp, Homo sapien
gcaacaagtccatgtcatagtcaat

SEQ ID NO: 199414 - DNA, 25 bp, Homo sapien
agtccatgtcatagtcaataaaaac

SEQ ID NO: 199415 - DNA, 25 bp, Homo sapien
aaacaatcctgcagttgggttttgt

SEQ ID NO: 199416 - DNA, 25 bp, Homo sapien
aatcctgcagttgggttttgtatct

SEQ ID NO: 199417 - DNA, 25 bp, Homo sapien
tgggttttgtatctgatccctgctt

SEQ ID NO: 199418 - DNA, 25 bp, Homo sapien
taatccctttgatcaatatggcttt

SEQ ID NO: 199419 - DNA, 25 bp, Homo sapien
cctttgatcaatatggcttttttcc

SEQ ID NO: 199420 - DNA, 25 bp, Homo sapien
ggctaatggatcaaaatgaaacctg

SEQ ID NO: 199421 - DNA, 25 bp, Homo sapien
acctgttgatgtgaattcagttatt

SEQ ID NO: 199422 - DNA, 25 bp, Homo sapien
gcctgaagtcaaacaccttgtacat

SEQ ID NO: 199423 - DNA, 25 bp, Homo sapien
gtcaaacaccttgtacatcagagag

SEQ ID NO: 199424 - DNA, 25 bp, Homo sapien
acaggttagtgtggacatccccttg

SEQ ID NO: 199425 - DNA, 25 bp, Homo sapien
gtggacatccccttgtgtgttggac

SEQ ID NO: 199426 - DNA, 25 bp, Homo sapien
atccccttgtgtgttggactcataa

SEQ ID NO: 199427 - DNA, 25 bp, Homo sapien
gttggactcataatctgaagactca

SEQ ID NO: 199428 - DNA, 25 bp, Homo sapien
tgattataacaagaccacatggtat

SEQ ID NO: 199429 - DNA, 25 bp, Homo sapien
gaccacatggtataacaatactaga

SEQ ID NO: 199430 - DNA, 25 bp, Homo sapien
gaatgtatatacatgtcaccatgga

SEQ ID NO: 199431 - DNA, 25 bp, Homo sapien
tgtcaccatggattggaactgtttt

SEQ ID NO: 199432 - DNA, 25 bp, Homo sapien
gaactgttttgcatatcagggaaat

SEQ ID NO: 199433 - DNA, 25 bp, Homo sapien
gacctagcccgggttctagatttgg

SEQ ID NO: 199434 - DNA, 25 bp, Homo sapien
acagtctcccggtgtcatgaatgga

SEQ ID NO: 199435 - DNA, 25 bp, Homo sapien
tgaatggaacccctagcactgcagg

SEQ ID NO: 199436 - DNA, 25 bp, Homo sapien
tgtcctcctggcttggctgttctga

SEQ ID NO: 199437 - DNA, 25 bp, Homo sapien
gaaagccggttctcagttcagatgt

SEQ ID NO: 199438 - DNA, 25 bp, Homo sapien
ttcagatgttcatgtttgctggaca

SEQ ID NO: 199439 - DNA, 25 bp, Homo sapien
gacattatgacctagttttcctgca

SEQ ID NO: 199440 - DNA, 25 bp, Homo sapien
gacctagttttcctgcattgtgaga

SEQ ID NO: 199441 - DNA, 25 bp, Homo sapien
tgtgattctcttaatgaacagtgcc

SEQ ID NO: 199442 - DNA, 25 bp, Homo sapien
ttgctcaagaagtcaagtccgcagt

SEQ ID NO: 199443 - DNA, 25 bp, Homo sapien
aagtccgcagtgaagtaccggccat

SEQ ID NO: 199444 - DNA, 25 bp, Homo sapien
taagaccaaagagggtgttgtgcag

SEQ ID NO: 199445 - DNA, 25 bp, Homo sapien
ttgtgcagagtgtgacttcagtggc

SEQ ID NO: 199446 - DNA, 25 bp, Homo sapien
gccaacgccgtgagtgaggccgtgg

SEQ ID NO: 199447 - DNA, 25 bp, Homo sapien
gaggccgtggtctccagtgtcaaca

SEQ ID NO: 199448 - DNA, 25 bp, Homo sapien
gtggtctccagtgtcaacactgtgg

SEQ ID NO: 199449 - DNA, 25 bp, Homo sapien
gtggagaacattgcagtcacctctg

SEQ ID NO: 199450 - DNA, 25 bp, Homo sapien
aacattgcagtcacctctggagtgg

SEQ ID NO: 199451 - DNA, 25 bp, Homo sapien
gcagtcacctctggagtggtgcaca

SEQ ID NO: 199452 - DNA, 25 bp, Homo sapien
tcacctctggagtggtgcacaagga

SEQ ID NO: 199453 - DNA, 25 bp, Homo sapien
atgaggcagccaaagcggaagagca

SEQ ID NO: 199454 - DNA, 25 bp, Homo sapien
ccaaagcggaagagcaagtggctga

SEQ ID NO: 199455 - DNA, 25 bp, Homo sapien
ctcataaattaagtccctgtagatt

SEQ ID NO: 199456 - DNA, 25 bp, Homo sapien
gaaaaactccttaaactgtatctag

SEQ ID NO: 199457 - DNA, 25 bp, Homo sapien
gtatctagaggtctagcacttccta

SEQ ID NO: 199458 - DNA, 25 bp, Homo sapien
gaggtctagcacttcctagtaggat

SEQ ID NO: 199459 - DNA, 25 bp, Homo sapien
ttcctagtaggatagacagtccttt

SEQ ID NO: 199460 - DNA, 25 bp, Homo sapien
aggatagacagtcctttctagatac

SEQ ID NO: 199461 - DNA, 25 bp, Homo sapien
gtcctttctagatactgtaactttt

SEQ ID NO: 199462 - DNA, 25 bp, Homo sapien
ttttctgtaccgctttggagtacag

SEQ ID NO: 199463 - DNA, 25 bp, Homo sapien
accgctttggagtacagtctttatg

SEQ ID NO: 199464 - DNA, 25 bp, Homo sapien
gtctttatgaagttgtttgtaagca

SEQ ID NO: 199465 - DNA, 25 bp, Homo sapien
tttaagcctaaaggctgggcgcgat

SEQ ID NO: 199466 - DNA, 25 bp, Homo sapien
gagctgtcccctagtgagggactgt

SEQ ID NO: 199467 - DNA, 25 bp, Homo sapien
gctgtcccctagtgagggactgtgt

SEQ ID NO: 199468 - DNA, 25 bp, Homo sapien
cccctagtgagggactgtgttgact

SEQ ID NO: 199469 - DNA, 25 bp, Homo sapien
ccctagtgagggactgtgttgactg

SEQ ID NO: 199470 - DNA, 25 bp, Homo sapien
ctagtgagggactgtgttgactgac

SEQ ID NO: 199471 - DNA, 25 bp, Homo sapien
gggactgtgttgactgacgagccga

SEQ ID NO: 199472 - DNA, 25 bp, Homo sapien
actgtgttgactgacgagccgaggg

SEQ ID NO: 199473 - DNA, 25 bp, Homo sapien
gctccagaagggtgcccagtcaggc

SEQ ID NO: 199474 - DNA, 25 bp, Homo sapien
agaagggtgcccagtcaggccgcac

SEQ ID NO: 199475 - DNA, 25 bp, Homo sapien
aagggtgcccagtcaggccgcaccg

SEQ ID NO: 199476 - DNA, 25 bp, Homo sapien
ctccggccctggagggagcatctcg

SEQ ID NO: 199477 - DNA, 25 bp, Homo sapien
acagaaacattacagcctggcatcc

SEQ ID NO: 199478 - DNA, 25 bp, Homo sapien
aaacattacagcctggcatccccag

SEQ ID NO: 199479 - DNA, 25 bp, Homo sapien
attacagcctggcatccccagtctt

SEQ ID NO: 199480 - DNA, 25 bp, Homo sapien
tggcatccccagtctttgccttctt

SEQ ID NO: 199481 - DNA, 25 bp, Homo sapien
cctgtcctgctgcatggtccggagt

SEQ ID NO: 199482 - DNA, 25 bp, Homo sapien
tgtcctgctgcatggtccggagtct

SEQ ID NO: 199483 - DNA, 25 bp, Homo sapien
tcctgctgcatggtccggagtctgg

SEQ ID NO: 199484 - DNA, 25 bp, Homo sapien
tgcatggtccggagtctgggaccta

SEQ ID NO: 199485 - DNA, 25 bp, Homo sapien
atggtccggagtctgggacctactt

SEQ ID NO: 199486 - DNA, 25 bp, Homo sapien
tccggagtctgggacctactttgtt

SEQ ID NO: 199487 - DNA, 25 bp, Homo sapien
ttgttatttatgaccttgtttaaag

SEQ ID NO: 199488 - DNA, 25 bp, Homo sapien
ggaactggggatacatcatctgaag

SEQ ID NO: 199489 - DNA, 25 bp, Homo sapien
agaagagcccctcaatagtgaagat

SEQ ID NO: 199490 - DNA, 25 bp, Homo sapien
aagagcccctcaatagtgaagatga

SEQ ID NO: 199491 - DNA, 25 bp, Homo sapien
gagcccctcaatagtgaagatgatg

SEQ ID NO: 199492 - DNA, 25 bp, Homo sapien
acacagaaaatgttgttgtatgcca

SEQ ID NO: 199493 - DNA, 25 bp, Homo sapien
gaaaatgttgttgtatgccaatatg

SEQ ID NO: 199494 - DNA, 25 bp, Homo sapien
aatgttgttgtatgccaatatgata

SEQ ID NO: 199495 - DNA, 25 bp, Homo sapien
atgccaatatgataagatacacaga

SEQ ID NO: 199496 - DNA, 25 bp, Homo sapien
caaatggaaatttcatctcaaggat

SEQ ID NO: 199497 - DNA, 25 bp, Homo sapien
tctcaaggatggcattatgaatctt

SEQ ID NO: 199498 - DNA, 25 bp, Homo sapien
caaggatggcattatgaatcttaat

SEQ ID NO: 199499 - DNA, 25 bp, Homo sapien
ctggagaaggttgcttcattggccc

SEQ ID NO: 199500 - DNA, 25 bp, Homo sapien
attggccctgggacttctctctgca

SEQ ID NO: 199501 - DNA, 25 bp, Homo sapien
agagaacgctgcctctcctctggat

SEQ ID NO: 199502 - DNA, 25 bp, Homo sapien
tctggattggtctcaggctctctgt

SEQ ID NO: 199503 - DNA, 25 bp, Homo sapien
ttggcctttggtcagcgtttccaca

SEQ ID NO: 199504 - DNA, 25 bp, Homo sapien
ggctggatccaccaaggcagctcac

SEQ ID NO: 199505 - DNA, 25 bp, Homo sapien
agctcacagcgggaaaactctggga

SEQ ID NO: 199506 - DNA, 25 bp, Homo sapien
aaactctgggactgaaccactgaat

SEQ ID NO: 199507 - DNA, 25 bp, Homo sapien
ccggttctcgaggtgtgtgccagct

SEQ ID NO: 199508 - DNA, 25 bp, Homo sapien
tgccagctacacgtgtgttctgtat

SEQ ID NO: 199509 - DNA, 25 bp, Homo sapien
ttctgtatgggtccagctgcgtttc

SEQ ID NO: 199510 - DNA, 25 bp, Homo sapien
gggaattttctattagcagtggtgt

SEQ ID NO: 199511 - DNA, 25 bp, Homo sapien
agcagtggtgttttaattggttgaa

SEQ ID NO: 199512 - DNA, 25 bp, Homo sapien
ggttgaattccacttagttctccac

SEQ ID NO: 199513 - DNA, 25 bp, Homo sapien
acttagttctccacagtgttttgta

SEQ ID NO: 199514 - DNA, 25 bp, Homo sapien
ataattttcccaatgtcaggtatag

SEQ ID NO: 199515 - DNA, 25 bp, Homo sapien
tgtcaggtatagaagttatcccatt

SEQ ID NO: 199516 - DNA, 25 bp, Homo sapien
aagttatcccattcttctttacctg

SEQ ID NO: 199517 - DNA, 25 bp, Homo sapien
gtctccttccttcgtctagaacctt

SEQ ID NO: 199518 - DNA, 25 bp, Homo sapien
tagaaccttccccacagtagctaat

SEQ ID NO: 199519 - DNA, 25 bp, Homo sapien
gtagctaatcctaacaactttttat

SEQ ID NO: 199520 - DNA, 25 bp, Homo sapien
tgataataatagctcatcccgctca

SEQ ID NO: 199521 - DNA, 25 bp, Homo sapien
tagagggcctctttttcaccaacgg

SEQ ID NO: 199522 - DNA, 25 bp, Homo sapien
acaagcaaagccaccctggaactct

SEQ ID NO: 199523 - DNA, 25 bp, Homo sapien
ggaactctctccatggcaaatgtca

SEQ ID NO: 199524 - DNA, 25 bp, Homo sapien
tggcaaatgtcagctcttgttcagg

SEQ ID NO: 199525 - DNA, 25 bp, Homo sapien
ttgttcaggtccatgcaagtcagcc

SEQ ID NO: 199526 - DNA, 25 bp, Homo sapien
aagtcagcccagttccttccatgat

SEQ ID NO: 199527 - DNA, 25 bp, Homo sapien
gaagtggccctgaatgctaacacta

SEQ ID NO: 199528 - DNA, 25 bp, Homo sapien
aagtccggattcattctgggtcttt

SEQ ID NO: 199529 - DNA, 25 bp, Homo sapien
tgggtctttccagagccaggtcgag

SEQ ID NO: 199530 - DNA, 25 bp, Homo sapien
gagccaggtcgagctttccaatgac

SEQ ID NO: 199531 - DNA, 25 bp, Homo sapien
gaaaaggcacaccttgacattgcag

SEQ ID NO: 199532 - DNA, 25 bp, Homo sapien
ggtaagacaagagaattttcttcat

SEQ ID NO: 199533 - DNA, 25 bp, Homo sapien
ttttcttcatcacataatatcaatg

SEQ ID NO: 199534 - DNA, 25 bp, Homo sapien
aaacgcagaggatattcagaaaagt

SEQ ID NO: 199535 - DNA, 25 bp, Homo sapien
aaaagtgttgtcttacaggatgtac

SEQ ID NO: 199536 - DNA, 25 bp, Homo sapien
gtgttgtcttacaggatgtacaaaa

SEQ ID NO: 199537 - DNA, 25 bp, Homo sapien
gaacttagcattgcatgtcttccat

SEQ ID NO: 199538 - DNA, 25 bp, Homo sapien
cttagcattgcatgtcttccatata

SEQ ID NO: 199539 - DNA, 25 bp, Homo sapien
gcattgcatgtcttccatatattga

SEQ ID NO: 199540 - DNA, 25 bp, Homo sapien
ttgcatgtcttccatatattgattt

SEQ ID NO: 199541 - DNA, 25 bp, Homo sapien
ggaaaaaagatcatcacttgtaact

SEQ ID NO: 199542 - DNA, 25 bp, Homo sapien
gatcatcacttgtaactaagatata

SEQ ID NO: 199543 - DNA, 25 bp, Homo sapien
aaattcatctgttcattgggctgat

SEQ ID NO: 199544 - DNA, 25 bp, Homo sapien
ttctgggtgcatttaaaatcttttt

SEQ ID NO: 199545 - DNA, 25 bp, Homo sapien
aaatgattcccttgtacccatcatt

SEQ ID NO: 199546 - DNA, 25 bp, Homo sapien
ttcccttgtacccatcattcaattt

SEQ ID NO: 199547 - DNA, 25 bp, Homo sapien
gtacccatcattcaatttcaataag

SEQ ID NO: 199548 - DNA, 25 bp, Homo sapien
gcctttcaaattttacctattgcca

SEQ ID NO: 199549 - DNA, 25 bp, Homo sapien
attttacctattgccactaacatcc

SEQ ID NO: 199550 - DNA, 25 bp, Homo sapien
acctattgccactaacatccttttt

SEQ ID NO: 199551 - DNA, 25 bp, Homo sapien
ttttttctggagtagctgaactgat

SEQ ID NO: 199552 - DNA, 25 bp, Homo sapien
ctggagtagctgaactgatttaaga

SEQ ID NO: 199553 - DNA, 25 bp, Homo sapien
gttattcattgatactctagccaaa

SEQ ID NO: 199554 - DNA, 25 bp, Homo sapien
accattgagtacatgcgagaccctg

SEQ ID NO: 199555 - DNA, 25 bp, Homo sapien
tgagtacatgcgagaccctgacgac

SEQ ID NO: 199556 - DNA, 25 bp, Homo sapien
gtacatgcgagaccctgacgaccag

SEQ ID NO: 199557 - DNA, 25 bp, Homo sapien
atgcgagaccctgacgaccagtaca

SEQ ID NO: 199558 - DNA, 25 bp, Homo sapien
gagaccctgacgaccagtacaagct

SEQ ID NO: 199559 - DNA, 25 bp, Homo sapien
gacgaccagtacaagctcacggagg

SEQ ID NO: 199560 - DNA, 25 bp, Homo sapien
ccagtacaagctcacggaggacacc

SEQ ID NO: 199561 - DNA, 25 bp, Homo sapien
aggacacccggcagctgggcctcgt

SEQ ID NO: 199562 - DNA, 25 bp, Homo sapien
gggcacgtccgtggtgctaatctgc

SEQ ID NO: 199563 - DNA, 25 bp, Homo sapien
gtggtgctaatctgcccgcaggacg

SEQ ID NO: 199564 - DNA, 25 bp, Homo sapien
taatctgcccgcaggacggcatgga

SEQ ID NO: 199565 - DNA, 25 bp, Homo sapien
cattccttagataccttgaaaggca

SEQ ID NO: 199566 - DNA, 25 bp, Homo sapien
aggcaggaagggaagcgtatatact

SEQ ID NO: 199567 - DNA, 25 bp, Homo sapien
gaagggaagcgtatatacttaagaa

SEQ ID NO: 199568 - DNA, 25 bp, Homo sapien
gttagttaatccctttgtctgtcaa

SEQ ID NO: 199569 - DNA, 25 bp, Homo sapien
gttaatccctttgtctgtcaatcac

SEQ ID NO: 199570 - DNA, 25 bp, Homo sapien
atccctttgtctgtcaatcacagtc

SEQ ID NO: 199571 - DNA, 25 bp, Homo sapien
caatcacagtctcagttctcttgct

SEQ ID NO: 199572 - DNA, 25 bp, Homo sapien
tcagttctcttgctttcacattgta

SEQ ID NO: 199573 - DNA, 25 bp, Homo sapien
gttctcttgctttcacattgtactt

SEQ ID NO: 199574 - DNA, 25 bp, Homo sapien
tcacattgtacttaaacctcctgct

SEQ ID NO: 199575 - DNA, 25 bp, Homo sapien
attgtacttaaacctcctgctgtgc

SEQ ID NO: 199576 - DNA, 25 bp, Homo sapien
agtctgaataaccatctgctgctta

SEQ ID NO: 199577 - DNA, 25 bp, Homo sapien
tgaataaccatctgctgcttaggaa

SEQ ID NO: 199578 - DNA, 25 bp, Homo sapien
ctgctgcttaggaaactcaatgaaa

SEQ ID NO: 199579 - DNA, 25 bp, Homo sapien
gaaactcaatgaaatgacatgcctt

SEQ ID NO: 199580 - DNA, 25 bp, Homo sapien
gacatgcctttttagcaggaagcaa

SEQ ID NO: 199581 - DNA, 25 bp, Homo sapien
caggaagcaaagttggtttctgttt

SEQ ID NO: 199582 - DNA, 25 bp, Homo sapien
catgtgcattttacagttcagtatc

SEQ ID NO: 199583 - DNA, 25 bp, Homo sapien
gtgcattttacagttcagtatcaaa

SEQ ID NO: 199584 - DNA, 25 bp, Homo sapien
gaatgtttctatttacaactgtgct

SEQ ID NO: 199585 - DNA, 25 bp, Homo sapien
ttctatttacaactgtgcttatcaa

SEQ ID NO: 199586 - DNA, 25 bp, Homo sapien
tgcttatcaaaattgtgaacacccc

SEQ ID NO: 199587 - DNA, 25 bp, Homo sapien
tgctgtttggtcttcctttggaaat

SEQ ID NO: 199588 - DNA, 25 bp, Homo sapien
tcttcctttggaaattcatgatgcc

SEQ ID NO: 199589 - DNA, 25 bp, Homo sapien
catgatgccatatcagatggtttta

SEQ ID NO: 199590 - DNA, 25 bp, Homo sapien
gatggttttagaattctgcacttta

SEQ ID NO: 199591 - DNA, 25 bp, Homo sapien
tatgccatatataatatcccagagg

SEQ ID NO: 199592 - DNA, 25 bp, Homo sapien
tatcccagagggatctgctataata

SEQ ID NO: 199593 - DNA, 25 bp, Homo sapien
gagggatctgctataatattgcata

SEQ ID NO: 199594 - DNA, 25 bp, Homo sapien
atcgaattcatatttctgcagcaaa

SEQ ID NO: 199595 - DNA, 25 bp, Homo sapien
aaatgtgtggatactctcacaaggc

SEQ ID NO: 199596 - DNA, 25 bp, Homo sapien
ggatactctcacaaggcaggataaa

SEQ ID NO: 199597 - DNA, 25 bp, Homo sapien
gagactatatatactgggccaggtg

SEQ ID NO: 199598 - DNA, 25 bp, Homo sapien
tgttgaaacatcctaggctttttct

SEQ ID NO: 199599 - DNA, 25 bp, Homo sapien
taggctttttctttccactcctatt

SEQ ID NO: 199600 - DNA, 25 bp, Homo sapien
tctttccactcctattacaactgat

SEQ ID NO: 199601 - DNA, 25 bp, Homo sapien
tacaactgatctgatttggcccctt

SEQ ID NO: 199602 - DNA, 25 bp, Homo sapien
acacctcactcctagattttgctag

SEQ ID NO: 199603 - DNA, 25 bp, Homo sapien
ttttgctagacctttctattttgtc

SEQ ID NO: 199604 - DNA, 25 bp, Homo sapien
gtctccctgaattaagcttttcctt

SEQ ID NO: 199605 - DNA, 25 bp, Homo sapien
tttccttttggacactttacatatg

SEQ ID NO: 199606 - DNA, 25 bp, Homo sapien
tggacactttacatatggattctaa

SEQ ID NO: 199607 - DNA, 25 bp, Homo sapien
aaaacaatcctctgcatgtctacac

SEQ ID NO: 199608 - DNA, 25 bp, Homo sapien
gcatgtctacacttgcacataatgc

SEQ ID NO: 199609 - DNA, 25 bp, Homo sapien
tttggaactgtatgccaatgatcct

SEQ ID NO: 199610 - DNA, 25 bp, Homo sapien
gaactgtatgccaatgatcctgagt

SEQ ID NO: 199611 - DNA, 25 bp, Homo sapien
gtatgccaatgatcctgagtttgca

SEQ ID NO: 199612 - DNA, 25 bp, Homo sapien
tcctgagtttgcagcttttgtgaga

SEQ ID NO: 199613 - DNA, 25 bp, Homo sapien
tgcagcttttgtgagagagcaacaa

SEQ ID NO: 199614 - DNA, 25 bp, Homo sapien
gagcaacaagtggaagaggtttaac

SEQ ID NO: 199615 - DNA, 25 bp, Homo sapien
gaagatggagattacttgttactta

SEQ ID NO: 199616 - DNA, 25 bp, Homo sapien
ggagattacttgttacttatgtcat

SEQ ID NO: 199617 - DNA, 25 bp, Homo sapien
gattacttgttacttatgtcatata

SEQ ID NO: 199618 - DNA, 25 bp, Homo sapien
atgtcatataattaacctggatttt

SEQ ID NO: 199619 - DNA, 25 bp, Homo sapien
aaaattaaatatagggcacactgtt

SEQ ID NO: 199620 - DNA, 25 bp, Homo sapien
gtggaatatgaatgcttggaaaatt

SEQ ID NO: 199621 - DNA, 25 bp, Homo sapien
tattgacattgtacatagctctgtg

SEQ ID NO: 199622 - DNA, 25 bp, Homo sapien
gacattgtacatagctctgtgtaaa

SEQ ID NO: 199623 - DNA, 25 bp, Homo sapien
gtgtaaatagaattgcaactgtcag

SEQ ID NO: 199624 - DNA, 25 bp, Homo sapien
tgcaactgtcaggttttgtgttctt

SEQ ID NO: 199625 - DNA, 25 bp, Homo sapien
ttatttccaggtcacagaattgctg

SEQ ID NO: 199626 - DNA, 25 bp, Homo sapien
ttccaggtcacagaattgctgttaa

SEQ ID NO: 199627 - DNA, 25 bp, Homo sapien
aaaagagttgtctgcaacatttttg

SEQ ID NO: 199628 - DNA, 25 bp, Homo sapien
gaaagtgctatttcctattttcacc

SEQ ID NO: 199629 - DNA, 25 bp, Homo sapien
tatttcctattttcaccaaaattgg

SEQ ID NO: 199630 - DNA, 25 bp, Homo sapien
gggaaggagtgccactttccagctc

SEQ ID NO: 199631 - DNA, 25 bp, Homo sapien
gataatcatgttactgagtgcttgg

SEQ ID NO: 199632 - DNA, 25 bp, Homo sapien
ctgagtgcttggaaattatttgtgc

SEQ ID NO: 199633 - DNA, 25 bp, Homo sapien
gatgattcatgaagggccattggtt

SEQ ID NO: 199634 - DNA, 25 bp, Homo sapien
gccattggtttggaaggtgaataga

SEQ ID NO: 199635 - DNA, 25 bp, Homo sapien
gagatataactattggtaggtctga

SEQ ID NO: 199636 - DNA, 25 bp, Homo sapien
ggtaggtctgatattgtcttttagt

SEQ ID NO: 199637 - DNA, 25 bp, Homo sapien
tctgatattgtcttttagttttggg

SEQ ID NO: 199638 - DNA, 25 bp, Homo sapien
gaaagtttcctatgacaaagggaag

SEQ ID NO: 199639 - DNA, 25 bp, Homo sapien
agaaccattctctcagcagtttgca

SEQ ID NO: 199640 - DNA, 25 bp, Homo sapien
gaaccattctctcagcagtttgcag

SEQ ID NO: 199641 - DNA, 25 bp, Homo sapien
agtttgcagtgctacctcgtgttat

SEQ ID NO: 199642 - DNA, 25 bp, Homo sapien
cactgagtttaatgtcctccacttt

SEQ ID NO: 199643 - DNA, 25 bp, Homo sapien
tccactttccattaacatcattcca

SEQ ID NO: 199644 - DNA, 25 bp, Homo sapien
ctccagtttctctcagtatggaatt

SEQ ID NO: 199645 - DNA, 25 bp, Homo sapien
ttatttttccaacttctgcactctg

SEQ ID NO: 199646 - DNA, 25 bp, Homo sapien
tgcactctgcctgatcttccttaga

SEQ ID NO: 199647 - DNA, 25 bp, Homo sapien
tgatcttccttagactctcagtgac

SEQ ID NO: 199648 - DNA, 25 bp, Homo sapien
cagtgacctaaaaatcttggcccct

SEQ ID NO: 199649 - DNA, 25 bp, Homo sapien
tcaaactcaaagtgttccaatctct

SEQ ID NO: 199650 - DNA, 25 bp, Homo sapien
atacttccactccttggatcttcca

SEQ ID NO: 199651 - DNA, 25 bp, Homo sapien
tccatactctcttaagcaacctgtg

SEQ ID NO: 199652 - DNA, 25 bp, Homo sapien
ttaagcaacctgtgttcctagctct

SEQ ID NO: 199653 - DNA, 25 bp, Homo sapien
gcatggccccacttgtatccagaag

SEQ ID NO: 199654 - DNA, 25 bp, Homo sapien
catggccccacttgtatccagaagt

SEQ ID NO: 199655 - DNA, 25 bp, Homo sapien
ggtgattgtgatggtggttgggact

SEQ ID NO: 199656 - DNA, 25 bp, Homo sapien
agttggaattagttggtccctactg

SEQ ID NO: 199657 - DNA, 25 bp, Homo sapien
gttggaattagttggtccctactgt

SEQ ID NO: 199658 - DNA, 25 bp, Homo sapien
ttggaattagttggtccctactgtc

SEQ ID NO: 199659 - DNA, 25 bp, Homo sapien
tggaattagttggtccctactgtcc

SEQ ID NO: 199660 - DNA, 25 bp, Homo sapien
ctactgtcccccatgaggttgtgaa

SEQ ID NO: 199661 - DNA, 25 bp, Homo sapien
tactgtcccccatgaggttgtgaac

SEQ ID NO: 199662 - DNA, 25 bp, Homo sapien
actgtcccccatgaggttgtgaacc

SEQ ID NO: 199663 - DNA, 25 bp, Homo sapien
gtcccccatgaggttgtgaacccct

SEQ ID NO: 199664 - DNA, 25 bp, Homo sapien
gttcttcagagaacaccctctaggg

SEQ ID NO: 199665 - DNA, 25 bp, Homo sapien
gccatggtcactcggcagccctttt

SEQ ID NO: 199666 - DNA, 25 bp, Homo sapien
cttttcccaggagaagacacctctg

SEQ ID NO: 199667 - DNA, 25 bp, Homo sapien
ggagaagacacctctgggagcctgc

SEQ ID NO: 199668 - DNA, 25 bp, Homo sapien
gtcctgggactgagggttactccag

SEQ ID NO: 199669 - DNA, 25 bp, Homo sapien
tgagggttactccagttgctctgtg

SEQ ID NO: 199670 - DNA, 25 bp, Homo sapien
agttgctctgtgttgcatactctcc

SEQ ID NO: 199671 - DNA, 25 bp, Homo sapien
aagcctgtgtatgaagaattgtccc

SEQ ID NO: 199672 - DNA, 25 bp, Homo sapien
gtgtatgaagaattgtcccctggct

SEQ ID NO: 199673 - DNA, 25 bp, Homo sapien
ggctgttttgtgactgttacattgt

SEQ ID NO: 199674 - DNA, 25 bp, Homo sapien
tttgtgactgttacattgtgcaggg

SEQ ID NO: 199675 - DNA, 25 bp, Homo sapien
aatattaccagagagcctgatgctc

SEQ ID NO: 199676 - DNA, 25 bp, Homo sapien
gagcctgatgctctctgatagctgt

SEQ ID NO: 199677 - DNA, 25 bp, Homo sapien
gatgctctctgatagctgtgccata

SEQ ID NO: 199678 - DNA, 25 bp, Homo sapien
tctctgatagctgtgccataagtgc

SEQ ID NO: 199679 - DNA, 25 bp, Homo sapien
ccataagtgcttgtgaggtatttgc

SEQ ID NO: 199680 - DNA, 25 bp, Homo sapien
cttgtgaggtatttgcaaagtgcat

SEQ ID NO: 199681 - DNA, 25 bp, Homo sapien
catgatagtaatgctcggagttttt

SEQ ID NO: 199682 - DNA, 25 bp, Homo sapien
taatgctcggagtttttataatttt

SEQ ID NO: 199683 - DNA, 25 bp, Homo sapien
gtgccaaatttgtcagtattgcatg

SEQ ID NO: 199684 - DNA, 25 bp, Homo sapien
tattttactgtagcatagattctat

SEQ ID NO: 199685 - DNA, 25 bp, Homo sapien
cagtgaagtgtttacagttgtttaa

SEQ ID NO: 199686 - DNA, 25 bp, Homo sapien
tggcacacccgtgatcacggagatt

SEQ ID NO: 199687 - DNA, 25 bp, Homo sapien
gtgatcacggagattttcagcctgg

SEQ ID NO: 199688 - DNA, 25 bp, Homo sapien
gattttcagcctgggtggaacccgc

SEQ ID NO: 199689 - DNA, 25 bp, Homo sapien
ggtggaacccgcttccgagatacag

SEQ ID NO: 199690 - DNA, 25 bp, Homo sapien
gcttccgagatacagcagtctggtt

SEQ ID NO: 199691 - DNA, 25 bp, Homo sapien
gagatacagcagtctggttgccaag

SEQ ID NO: 199692 - DNA, 25 bp, Homo sapien
gcagggcaggcactcgggaagggaa

SEQ ID NO: 199693 - DNA, 25 bp, Homo sapien
gagaccgaggacacagtggagccca

SEQ ID NO: 199694 - DNA, 25 bp, Homo sapien
aggacacagtggagcccacgagcac

SEQ ID NO: 199695 - DNA, 25 bp, Homo sapien
cacctccagcttcgatgatgtgggt

SEQ ID NO: 199696 - DNA, 25 bp, Homo sapien
ctccagcttcgatgatgtgggtgtc

SEQ ID NO: 199697 - DNA, 25 bp, Homo sapien
atggtattcctttgcaagtcaattt

SEQ ID NO: 199698 - DNA, 25 bp, Homo sapien
gcaagtcaatttaggtttcgtgtta

SEQ ID NO: 199699 - DNA, 25 bp, Homo sapien
tcaatttaggtttcgtgttataact

SEQ ID NO: 199700 - DNA, 25 bp, Homo sapien
acaatatctagtactgcaactgcca

SEQ ID NO: 199701 - DNA, 25 bp, Homo sapien
tatctagtactgcaactgccagaac

SEQ ID NO: 199702 - DNA, 25 bp, Homo sapien
agtactgcaactgccagaacttggt

SEQ ID NO: 199703 - DNA, 25 bp, Homo sapien
tactgcaactgccagaacttggtat

SEQ ID NO: 199704 - DNA, 25 bp, Homo sapien
tgcccgctgactagcagctggactg

SEQ ID NO: 199705 - DNA, 25 bp, Homo sapien
gctgactagcagctggactgatttt

SEQ ID NO: 199706 - DNA, 25 bp, Homo sapien
gactagcagctggactgattttgaa

SEQ ID NO: 199707 - DNA, 25 bp, Homo sapien
tagcagctggactgattttgaataa

SEQ ID NO: 199708 - DNA, 25 bp, Homo sapien
aaggaagatgattcatgaagggcca

SEQ ID NO: 199709 - DNA, 25 bp, Homo sapien
ggaagatgattcatgaagggccatt

SEQ ID NO: 199710 - DNA, 25 bp, Homo sapien
gaagatgattcatgaagggccattg

SEQ ID NO: 199711 - DNA, 25 bp, Homo sapien
aagatgattcatgaagggccattgg

SEQ ID NO: 199712 - DNA, 25 bp, Homo sapien
agatgattcatgaagggccattggt

SEQ ID NO: 199713 - DNA, 25 bp, Homo sapien
gatgattcatgaagggccattggtt

SEQ ID NO: 199714 - DNA, 25 bp, Homo sapien
atgattcatgaagggccattggttt

SEQ ID NO: 199715 - DNA, 25 bp, Homo sapien
gattcatgaagggccattggtttgg

SEQ ID NO: 199716 - DNA, 25 bp, Homo sapien
gccattggtttggaaggtgaataga

SEQ ID NO: 199717 - DNA, 25 bp, Homo sapien
ccattggtttggaaggtgaatagag

SEQ ID NO: 199718 - DNA, 25 bp, Homo sapien
ttggtttggaaggtgaatagagata

SEQ ID NO: 199719 - DNA, 25 bp, Homo sapien
aatctggttgcctctaattttatgt

SEQ ID NO: 199720 - DNA, 25 bp, Homo sapien
ggttgcctctaattttatgttaaag

SEQ ID NO: 199721 - DNA, 25 bp, Homo sapien
attctgagaaatagctctgattaag

SEQ ID NO: 199722 - DNA, 25 bp, Homo sapien
gctctgattaagaatctttcccact

SEQ ID NO: 199723 - DNA, 25 bp, Homo sapien
ctcagcctgcactttgttattgtgc

SEQ ID NO: 199724 - DNA, 25 bp, Homo sapien
gcctgcactttgttattgtgctata

SEQ ID NO: 199725 - DNA, 25 bp, Homo sapien
tgtgctatatttcttacttactctc

SEQ ID NO: 199726 - DNA, 25 bp, Homo sapien
atttcttacttactctcaaaaagca

SEQ ID NO: 199727 - DNA, 25 bp, Homo sapien
tgtttacattacctttcccctctct

SEQ ID NO: 199728 - DNA, 25 bp, Homo sapien
tttcccctctctcataggagagatt

SEQ ID NO: 199729 - DNA, 25 bp, Homo sapien
aagtgtctgatttgatatagcatga

SEQ ID NO: 199730 - DNA, 25 bp, Homo sapien
tggtcaaaggccaccaccttcaagc

SEQ ID NO: 199731 - DNA, 25 bp, Homo sapien
cctccatgaaccacagctacattgg

SEQ ID NO: 199732 - DNA, 25 bp, Homo sapien
tctatccctgacactgctttatttc

SEQ ID NO: 199733 - DNA, 25 bp, Homo sapien
ttatttcccctatctgatgtttctc

SEQ ID NO: 199734 - DNA, 25 bp, Homo sapien
gatgtttctctgtagtgtgttcaga

SEQ ID NO: 199735 - DNA, 25 bp, Homo sapien
agtgtgttcagatgtatgccccacc

SEQ ID NO: 199736 - DNA, 25 bp, Homo sapien
gggcttgccatgtcggcctcagtat

SEQ ID NO: 199737 - DNA, 25 bp, Homo sapien
tcagtatccccagtacagagaaagg

SEQ ID NO: 199738 - DNA, 25 bp, Homo sapien
cagagaaaggcttagcgcccaggag

SEQ ID NO: 199739 - DNA, 25 bp, Homo sapien
gagtatgaatggattccctgttact

SEQ ID NO: 199740 - DNA, 25 bp, Homo sapien
gaatggattccctgttacttagaat

SEQ ID NO: 199741 - DNA, 25 bp, Homo sapien
gaggtgtactttatactttgatgaa

SEQ ID NO: 199742 - DNA, 25 bp, Homo sapien
ctttgatgaaggctaaggtgtacct

SEQ ID NO: 199743 - DNA, 25 bp, Homo sapien
ggctaaggtgtacctaacagctttt

SEQ ID NO: 199744 - DNA, 25 bp, Homo sapien
aggtgtacctaacagctttttatag

SEQ ID NO: 199745 - DNA, 25 bp, Homo sapien
gtacctaacagctttttatagtata

SEQ ID NO: 199746 - DNA, 25 bp, Homo sapien
tattcatttatggagttagctgtat

SEQ ID NO: 199747 - DNA, 25 bp, Homo sapien
gaagagaacttcatgatgatttaaa

SEQ ID NO: 199748 - DNA, 25 bp, Homo sapien
ataaagaacaaataggtcctgcatt

SEQ ID NO: 199749 - DNA, 25 bp, Homo sapien
aaataggtcctgcattttataagac

SEQ ID NO: 199750 - DNA, 25 bp, Homo sapien
gctttaattattcaactaagaacca

SEQ ID NO: 199751 - DNA, 25 bp, Homo sapien
aagaaccaataatggcttcttcaag

SEQ ID NO: 199752 - DNA, 25 bp, Homo sapien
acaacagaattatcaggcccaaaat

SEQ ID NO: 199753 - DNA, 25 bp, Homo sapien
tcaggcccaaaatggtagcggtgct

SEQ ID NO: 199754 - DNA, 25 bp, Homo sapien
cccaaaatggtagcggtgctgagat

SEQ ID NO: 199755 - DNA, 25 bp, Homo sapien
gattgagaaaccctgctttagacat

SEQ ID NO: 199756 - DNA, 25 bp, Homo sapien
gaaaccctgctttagacatagtgct

SEQ ID NO: 199757 - DNA, 25 bp, Homo sapien
agacatagtgctttctttcaacctc

SEQ ID NO: 199758 - DNA, 25 bp, Homo sapien
atagtgctttctttcaacctccata

SEQ ID NO: 199759 - DNA, 25 bp, Homo sapien
aacctccatacttctgtacagttac

SEQ ID NO: 199760 - DNA, 25 bp, Homo sapien
catacttctgtacagttacctccat

SEQ ID NO: 199761 - DNA, 25 bp, Homo sapien
agttacctccatctgtaatgtttgt

SEQ ID NO: 199762 - DNA, 25 bp, Homo sapien
gctagagtatagtggcgtgatttca

SEQ ID NO: 199763 - DNA, 25 bp, Homo sapien
gacaagtgcaaggtcagccagctaa

SEQ ID NO: 199764 - DNA, 25 bp, Homo sapien
gcaaggtcagccagctaagatataa

SEQ ID NO: 199765 - DNA, 25 bp, Homo sapien
aataacttctactggcatgtcctct

SEQ ID NO: 199766 - DNA, 25 bp, Homo sapien
agtctccattttctccactgatatt

SEQ ID NO: 199767 - DNA, 25 bp, Homo sapien
ttttctccactgatattcatccaaa

SEQ ID NO: 199768 - DNA, 25 bp, Homo sapien
acaattgcaattgagtttactatta

SEQ ID NO: 199769 - DNA, 25 bp, Homo sapien
gtttactattatcaatggcactctc

SEQ ID NO: 199770 - DNA, 25 bp, Homo sapien
aatggcactctcatcacggttctta

SEQ ID NO: 199771 - DNA, 25 bp, Homo sapien
tcatcacggttcttacagatcgaat

SEQ ID NO: 199772 - DNA, 25 bp, Homo sapien
gatcgaataaggttcattagctgtg

SEQ ID NO: 199773 - DNA, 25 bp, Homo sapien
tgtgatttaattcccagctgctgcc

SEQ ID NO: 199774 - DNA, 25 bp, Homo sapien
acgcagacagacacaccgactttgt

SEQ ID NO: 199775 - DNA, 25 bp, Homo sapien
cagacacaccgactttgtccttttt

SEQ ID NO: 199776 - DNA, 25 bp, Homo sapien
ttgtcctttttctcagcatcagagc

SEQ ID NO: 199777 - DNA, 25 bp, Homo sapien
agagccagacaggattcagaataag

SEQ ID NO: 199778 - DNA, 25 bp, Homo sapien
gaatgacatcgtgcggcagggtcct

SEQ ID NO: 199779 - DNA, 25 bp, Homo sapien
gctgggccacagagtctactttgaa

SEQ ID NO: 199780 - DNA, 25 bp, Homo sapien
gagtctactttgaaggcacctcatg

SEQ ID NO: 199781 - DNA, 25 bp, Homo sapien
ggttttcaggatgctgacagctgca

SEQ ID NO: 199782 - DNA, 25 bp, Homo sapien
agctgcaagcaacaggcactgccaa

SEQ ID NO: 199783 - DNA, 25 bp, Homo sapien
aggcactgccaaattcagggaacag

SEQ ID NO: 199784 - DNA, 25 bp, Homo sapien
gccagcttggaggatggacatttct

SEQ ID NO: 199785 - DNA, 25 bp, Homo sapien
tttaacctttgatagaaccattgca

SEQ ID NO: 199786 - DNA, 25 bp, Homo sapien
ttgggaacggactggtatgtaaaag

SEQ ID NO: 199787 - DNA, 25 bp, Homo sapien
tatcgagcagcattttatttacccc

SEQ ID NO: 199788 - DNA, 25 bp, Homo sapien
cgagcagcattttatttacccctcc

SEQ ID NO: 199789 - DNA, 25 bp, Homo sapien
ctatccctaggcacttaaccaagac

SEQ ID NO: 199790 - DNA, 25 bp, Homo sapien
agccacaatgaacatccctttttca

SEQ ID NO: 199791 - DNA, 25 bp, Homo sapien
tgaacatccctttttcaatgaattt

SEQ ID NO: 199792 - DNA, 25 bp, Homo sapien
tgcagctctattccgagcccttagc

SEQ ID NO: 199793 - DNA, 25 bp, Homo sapien
ttagcacccattccgaccatagtat

SEQ ID NO: 199794 - DNA, 25 bp, Homo sapien
acccattccgaccatagtataatca

SEQ ID NO: 199795 - DNA, 25 bp, Homo sapien
ggtgagaatcatttagcatgttgtt

SEQ ID NO: 199796 - DNA, 25 bp, Homo sapien
gaaaggacagtatagctgcccttgc

SEQ ID NO: 199797 - DNA, 25 bp, Homo sapien
cctacccacagcacctgagttaaaa

SEQ ID NO: 199798 - DNA, 25 bp, Homo sapien
attggtctaagggacttccatcttg

SEQ ID NO: 199799 - DNA, 25 bp, Homo sapien
ttccatcttggtctgaagtcctgag

SEQ ID NO: 199800 - DNA, 25 bp, Homo sapien
gaagtcctgagctcagacgcaggta

SEQ ID NO: 199801 - DNA, 25 bp, Homo sapien
tcagacgcaggtactgccagccata

SEQ ID NO: 199802 - DNA, 25 bp, Homo sapien
agccataccttcctggtagcatctg

SEQ ID NO: 199803 - DNA, 25 bp, Homo sapien
gtagcatctgctggacctaagtaag

SEQ ID NO: 199804 - DNA, 25 bp, Homo sapien
gcatgtctgtctaaggccaagtctg

SEQ ID NO: 199805 - DNA, 25 bp, Homo sapien
agtctgcccggcttaaggatgctgg

SEQ ID NO: 199806 - DNA, 25 bp, Homo sapien
aaggatgctggttctgactctaccc

SEQ ID NO: 199807 - DNA, 25 bp, Homo sapien
agattacacctaaatactcctcctt

SEQ ID NO: 199808 - DNA, 25 bp, Homo sapien
atactcctccttttgtatcattcag

SEQ ID NO: 199809 - DNA, 25 bp, Homo sapien
ttttgtatcattcagccttttgttt

SEQ ID NO: 199810 - DNA, 25 bp, Homo sapien
gaaatttcagcagcaaagttgttat

SEQ ID NO: 199811 - DNA, 25 bp, Homo sapien
aaagttgttattcagtgggcacgat

SEQ ID NO: 199812 - DNA, 25 bp, Homo sapien
attcagtgggcacgatggactccaa

SEQ ID NO: 199813 - DNA, 25 bp, Homo sapien
gatggactccaaatgcctcaagtta

SEQ ID NO: 199814 - DNA, 25 bp, Homo sapien
gcctcaagttatgtatacctgtccc

SEQ ID NO: 199815 - DNA, 25 bp, Homo sapien
aagttatgtatacctgtcccagatg

SEQ ID NO: 199816 - DNA, 25 bp, Homo sapien
tacctgtcccagatgtaaacttcat

SEQ ID NO: 199817 - DNA, 25 bp, Homo sapien
gtaaacttcattgtcctttgttgga

SEQ ID NO: 199818 - DNA, 25 bp, Homo sapien
caggtgtgatgctgaccgttggcac

SEQ ID NO: 199819 - DNA, 25 bp, Homo sapien
ggtgtgatgctgaccgttggcacta

SEQ ID NO: 199820 - DNA, 25 bp, Homo sapien
gtgtgatgctgaccgttggcactaa

SEQ ID NO: 199821 - DNA, 25 bp, Homo sapien
gtgatgctgaccgttggcactaagc

SEQ ID NO: 199822 - DNA, 25 bp, Homo sapien
tgatgctgaccgttggcactaagcc

SEQ ID NO: 199823 - DNA, 25 bp, Homo sapien
gatgctgaccgttggcactaagcca

SEQ ID NO: 199824 - DNA, 25 bp, Homo sapien
atgctgaccgttggcactaagccag

SEQ ID NO: 199825 - DNA, 25 bp, Homo sapien
gctgaccgttggcactaagccagat

SEQ ID NO: 199826 - DNA, 25 bp, Homo sapien
tgaccgttggcactaagccagatgg

SEQ ID NO: 199827 - DNA, 25 bp, Homo sapien
accgttggcactaagccagatggca

SEQ ID NO: 199828 - DNA, 25 bp, Homo sapien
ttggcactaagccagatggcagccc

SEQ ID NO: 199829 - DNA, 25 bp, Homo sapien
tgggaaagtcaaggtgggcatcaca

SEQ ID NO: 199830 - DNA, 25 bp, Homo sapien
gatagatgagatttgtcagacacat

SEQ ID NO: 199831 - DNA, 25 bp, Homo sapien
agacacattgaagagctcctgccta

SEQ ID NO: 199832 - DNA, 25 bp, Homo sapien
tgaagagctcctgcctataggaagc

SEQ ID NO: 199833 - DNA, 25 bp, Homo sapien
gcctataggaagcatttgcatgcat

SEQ ID NO: 199834 - DNA, 25 bp, Homo sapien
ctcttcctgctgtcctatttaaata

SEQ ID NO: 199835 - DNA, 25 bp, Homo sapien
cacaattctgtgttgaaatttttgt

SEQ ID NO: 199836 - DNA, 25 bp, Homo sapien
tttgtatgctttacctaattaggac

SEQ ID NO: 199837 - DNA, 25 bp, Homo sapien
ggacaaatattctgactcttgcatt

SEQ ID NO: 199838 - DNA, 25 bp, Homo sapien
ttctgactcttgcatttgttatcaa

SEQ ID NO: 199839 - DNA, 25 bp, Homo sapien
tttggcctttagatgatgcatttcc

SEQ ID NO: 199840 - DNA, 25 bp, Homo sapien
cagcagtcactctgtgttctcctgg

SEQ ID NO: 199841 - DNA, 25 bp, Homo sapien
gcagtcactctgtgttctcctggcg

SEQ ID NO: 199842 - DNA, 25 bp, Homo sapien
agtcactctgtgttctcctggcgct

SEQ ID NO: 199843 - DNA, 25 bp, Homo sapien
gctcctcccctaagttattgctgtt

SEQ ID NO: 199844 - DNA, 25 bp, Homo sapien
tcctcccctaagttattgctgttcg

SEQ ID NO: 199845 - DNA, 25 bp, Homo sapien
tcccctaagttattgctgttcgccc

SEQ ID NO: 199846 - DNA, 25 bp, Homo sapien
ctaagttattgctgttcgcccgctg

SEQ ID NO: 199847 - DNA, 25 bp, Homo sapien
aagttattgctgttcgcccgctgtg

SEQ ID NO: 199848 - DNA, 25 bp, Homo sapien
gttattgctgttcgcccgctgtgtg

SEQ ID NO: 199849 - DNA, 25 bp, Homo sapien
tgttcgcccgctgtgtgtgctcatc

SEQ ID NO: 199850 - DNA, 25 bp, Homo sapien
gagggtgggaagagtcatgtttttt

SEQ ID NO: 199851 - DNA, 25 bp, Homo sapien
cacaaggacccttcaggtgttacta

SEQ ID NO: 199852 - DNA, 25 bp, Homo sapien
aggtgttactagaaggcgtccatgt

SEQ ID NO: 199853 - DNA, 25 bp, Homo sapien
agaatgtttggcactctctaacgtc

SEQ ID NO: 199854 - DNA, 25 bp, Homo sapien
tctaacgtccactagcttactgagt

SEQ ID NO: 199855 - DNA, 25 bp, Homo sapien
gttatcaggtgcaggtcagactctt

SEQ ID NO: 199856 - DNA, 25 bp, Homo sapien
caggtcagactcttggctacagtga

SEQ ID NO: 199857 - DNA, 25 bp, Homo sapien
ggcagcttctagacagagttgctta

SEQ ID NO: 199858 - DNA, 25 bp, Homo sapien
aaaccattacctgtacctggcctgg

SEQ ID NO: 199859 - DNA, 25 bp, Homo sapien
tggcctggcctccaaaatattaaca

SEQ ID NO: 199860 - DNA, 25 bp, Homo sapien
ttttctgttgaaactcgcgagtgta

SEQ ID NO: 199861 - DNA, 25 bp, Homo sapien
gcgagtgtaactttcataccacttg

SEQ ID NO: 199862 - DNA, 25 bp, Homo sapien
acgctggagatcaaccccaggcacg

SEQ ID NO: 199863 - DNA, 25 bp, Homo sapien
ccaggcacgcgctcatcaagaagct

SEQ ID NO: 199864 - DNA, 25 bp, Homo sapien
agctgaatcagctgcgcgcaagcga

SEQ ID NO: 199865 - DNA, 25 bp, Homo sapien
ctcagctgctggtggatcagatata

SEQ ID NO: 199866 - DNA, 25 bp, Homo sapien
atacgagaacgccatgattgctgct

SEQ ID NO: 199867 - DNA, 25 bp, Homo sapien
tgattgctgctggacttgttgacga

SEQ ID NO: 199868 - DNA, 25 bp, Homo sapien
ttgttgacgaccctagggccatggt

SEQ ID NO: 199869 - DNA, 25 bp, Homo sapien
agctgcttgtcaaggccctggagcg

SEQ ID NO: 199870 - DNA, 25 bp, Homo sapien
tcaaggccctggagcgacactgaca

SEQ ID NO: 199871 - DNA, 25 bp, Homo sapien
ggccagaaggactgacaccacagat

SEQ ID NO: 199872 - DNA, 25 bp, Homo sapien
cacctccttgagctttatttaccta

SEQ ID NO: 199873 - DNA, 25 bp, Homo sapien
gaaagcccgagacagtatgctctca

SEQ ID NO: 199874 - DNA, 25 bp, Homo sapien
tatgctctcatctgaaattagtctg

SEQ ID NO: 199875 - DNA, 25 bp, Homo sapien
agtctgctggatagctgtcactcta

SEQ ID NO: 199876 - DNA, 25 bp, Homo sapien
gggtgagatacccttttggctgtca

SEQ ID NO: 199877 - DNA, 25 bp, Homo sapien
acccttttggctgtcactctagaat

SEQ ID NO: 199878 - DNA, 25 bp, Homo sapien
gagacatcctaagtaaggtccactg

SEQ ID NO: 199879 - DNA, 25 bp, Homo sapien
ggtccactgttttatggatcccatt

SEQ ID NO: 199880 - DNA, 25 bp, Homo sapien
atcctcattttgctggagaatttcc

SEQ ID NO: 199881 - DNA, 25 bp, Homo sapien
gatacttcctcagtaagggtgcaaa

SEQ ID NO: 199882 - DNA, 25 bp, Homo sapien
agactttctgaaaatttgcctgaca

SEQ ID NO: 199883 - DNA, 25 bp, Homo sapien
tctatggcactgaatgcacattctt

SEQ ID NO: 199884 - DNA, 25 bp, Homo sapien
cctcctccagttctttggaaatttg

SEQ ID NO: 199885 - DNA, 25 bp, Homo sapien
gggatcttagttgcttatttgtttt

SEQ ID NO: 199886 - DNA, 25 bp, Homo sapien
gcttatttgttttgactcttgtgtg

SEQ ID NO: 199887 - DNA, 25 bp, Homo sapien
tatttgttttgactcttgtgtgctg

SEQ ID NO: 199888 - DNA, 25 bp, Homo sapien
actcttgtgtgctgtgggcactgga

SEQ ID NO: 199889 - DNA, 25 bp, Homo sapien
ctgtgggcactggagtagagatttc

SEQ ID NO: 199890 - DNA, 25 bp, Homo sapien
cactggagtagagatttctggagaa

SEQ ID NO: 199891 - DNA, 25 bp, Homo sapien
tggatcacaatgtcatttcctaata

SEQ ID NO: 199892 - DNA, 25 bp, Homo sapien
gtcatttcctaatacaaggcaggat

SEQ ID NO: 199893 - DNA, 25 bp, Homo sapien
tatttcccactgacctaaactttca

SEQ ID NO: 199894 - DNA, 25 bp, Homo sapien
atttcccactgacctaaactttcag

SEQ ID NO: 199895 - DNA, 25 bp, Homo sapien
gatgcaatcacacgggaacttctat

SEQ ID NO: 199896 - DNA, 25 bp, Homo sapien
gggaacttctatttgacctgcaacc

SEQ ID NO: 199897 - DNA, 25 bp, Homo sapien
atttgacctgcaaccttctacttaa

SEQ ID NO: 199898 - DNA, 25 bp, Homo sapien
gtttaaagtcggctgtgacctcctg

SEQ ID NO: 199899 - DNA, 25 bp, Homo sapien
cccagagctgtacggccctgcagtg

SEQ ID NO: 199900 - DNA, 25 bp, Homo sapien
ggtgggaggaacttgcataaatata

SEQ ID NO: 199901 - DNA, 25 bp, Homo sapien
gacacacagtttgcatcagaacgtg

SEQ ID NO: 199902 - DNA, 25 bp, Homo sapien
gtttgcatcagaacgtgtttataga

SEQ ID NO: 199903 - DNA, 25 bp, Homo sapien
gaatgtgttttatacccgatcgtgt

SEQ ID NO: 199904 - DNA, 25 bp, Homo sapien
tatacccgatcgtgtgtggtgtgcg

SEQ ID NO: 199905 - DNA, 25 bp, Homo sapien
gtgtgcgtgaggacaaactccgcag

SEQ ID NO: 199906 - DNA, 25 bp, Homo sapien
aagtattgagtgaggacattcccaa

SEQ ID NO: 199907 - DNA, 25 bp, Homo sapien
tgaggacattcccaaaaccaaagga

SEQ ID NO: 199908 - DNA, 25 bp, Homo sapien
aaaggacaactgaggagactgccca

SEQ ID NO: 199909 - DNA, 25 bp, Homo sapien
ggagactgcccagcacataatgaat

SEQ ID NO: 199910 - DNA, 25 bp, Homo sapien
ggagttattaacatcatttggaaaa

SEQ ID NO: 199911 - DNA, 25 bp, Homo sapien
aaaagatttcccattcacttgatat

SEQ ID NO: 199912 - DNA, 25 bp, Homo sapien
cacttgatattgtttgttcactcat

SEQ ID NO: 199913 - DNA, 25 bp, Homo sapien
gtttgttcactcatttagtcattaa

SEQ ID NO: 199914 - DNA, 25 bp, Homo sapien
gccaggtaattaataatctgcactg

SEQ ID NO: 199915 - DNA, 25 bp, Homo sapien
atctgcactgatattacatccacag

SEQ ID NO: 199916 - DNA, 25 bp, Homo sapien
acatccacagtaccacagtatttat

SEQ ID NO: 199917 - DNA, 25 bp, Homo sapien
atttccctctcaggagctctggcta

SEQ ID NO: 199918 - DNA, 25 bp, Homo sapien
ggctattgttaatgcagtaccctgc

SEQ ID NO: 199919 - DNA, 25 bp, Homo sapien
taccctgctttgctttggatggaca

SEQ ID NO: 199920 - DNA, 25 bp, Homo sapien
aactctttcttggatgccaccctta

SEQ ID NO: 199921 - DNA, 25 bp, Homo sapien
gccacccttacctcagtgattggag

SEQ ID NO: 199922 - DNA, 25 bp, Homo sapien
aatagggtttttcatcttgctgggt

SEQ ID NO: 199923 - DNA, 25 bp, Homo sapien
tttggctgccaatgtgaccctggga

SEQ ID NO: 199924 - DNA, 25 bp, Homo sapien
gaccctgggactctggatggttaca

SEQ ID NO: 199925 - DNA, 25 bp, Homo sapien
acagcacggtaatgtttgcactcat

SEQ ID NO: 199926 - DNA, 25 bp, Homo sapien
ttgcactcatctgacagaatccctg

SEQ ID NO: 199927 - DNA, 25 bp, Homo sapien
gaatccctgagttacagtatacagc

SEQ ID NO: 199928 - DNA, 25 bp, Homo sapien
tcagcaaatttgcatgtcccttttc

SEQ ID NO: 199929 - DNA, 25 bp, Homo sapien
ttgcatgtcccttttcatctgtttc

SEQ ID NO: 199930 - DNA, 25 bp, Homo sapien
gagtaagttcaatttcaccacggta

SEQ ID NO: 199931 - DNA, 25 bp, Homo sapien
ttcaccacggtaaactgggatgttt

SEQ ID NO: 199932 - DNA, 25 bp, Homo sapien
ttcaaaagtgccttgccatgtacct

SEQ ID NO: 199933 - DNA, 25 bp, Homo sapien
gcacacactggttctcctcttttgg

SEQ ID NO: 199934 - DNA, 25 bp, Homo sapien
atttcagtatctttctccgtggttt

SEQ ID NO: 199935 - DNA, 25 bp, Homo sapien
gggttatacccaggacatgattttc

SEQ ID NO: 199936 - DNA, 25 bp, Homo sapien
ggacatgattttcacctactaacaa

SEQ ID NO: 199937 - DNA, 25 bp, Homo sapien
acctactaacaaacacctccatgtg

SEQ ID NO: 199938 - DNA, 25 bp, Homo sapien
aacacctccatgtgctcagcaaatt

SEQ ID NO: 199939 - DNA, 25 bp, Homo sapien
gaaaagctaactctgaaccgaatgt

SEQ ID NO: 199940 - DNA, 25 bp, Homo sapien
gcaatatgaccgtcggcacactgct

SEQ ID NO: 199941 - DNA, 25 bp, Homo sapien
gttcctccagttccatggacaggtt

SEQ ID NO: 199942 - DNA, 25 bp, Homo sapien
gacaggttctgttttcactttttcg

SEQ ID NO: 199943 - DNA, 25 bp, Homo sapien
gttttcactttttcgtatgcactac

SEQ ID NO: 199944 - DNA, 25 bp, Homo sapien
ttcgtatgcactactgtatttcctt

SEQ ID NO: 199945 - DNA, 25 bp, Homo sapien
aaggagactatcagaatttcttgct

SEQ ID NO: 199946 - DNA, 25 bp, Homo sapien
gaatttcttgctattggtttgcatt

SEQ ID NO: 199947 - DNA, 25 bp, Homo sapien
aattcatagcaagttgacctcagag

SEQ ID NO: 199948 - DNA, 25 bp, Homo sapien
gacctcagagttcctgtatcaggga

SEQ ID NO: 199949 - DNA, 25 bp, Homo sapien
tcagggagattgtctgattctctaa

SEQ ID NO: 199950 - DNA, 25 bp, Homo sapien
ttgtagaaggcccaaatcacagaat

SEQ ID NO: 199951 - DNA, 25 bp, Homo sapien
gtagaaggcccaaatcacagaataa

SEQ ID NO: 199952 - DNA, 25 bp, Homo sapien
ggcccaaatcacagaataaaggact

SEQ ID NO: 199953 - DNA, 25 bp, Homo sapien
ggactaagagtggatttgctgacat

SEQ ID NO: 199954 - DNA, 25 bp, Homo sapien
ggatttgctgacattccatactaat

SEQ ID NO: 199955 - DNA, 25 bp, Homo sapien
gctgacattccatactaatatacat

SEQ ID NO: 199956 - DNA, 25 bp, Homo sapien
gacattccatactaatatacattgt

SEQ ID NO: 199957 - DNA, 25 bp, Homo sapien
atacattgtttatgctttctttaaa

SEQ ID NO: 199958 - DNA, 25 bp, Homo sapien
gaatctcagaagtagtttgctgcta

SEQ ID NO: 199959 - DNA, 25 bp, Homo sapien
ctcagaagtagtttgctgctaatat

SEQ ID NO: 199960 - DNA, 25 bp, Homo sapien
agtagtttgctgctaatatatacat

SEQ ID NO: 199961 - DNA, 25 bp, Homo sapien
agctaaagctgggttgttccccagc

SEQ ID NO: 199962 - DNA, 25 bp, Homo sapien
ttgttccccagccaatggaaattct

SEQ ID NO: 199963 - DNA, 25 bp, Homo sapien
ttcccttccggataataatgccttg

SEQ ID NO: 199964 - DNA, 25 bp, Homo sapien
ataatgccttgtttgtaaccgctgc

SEQ ID NO: 199965 - DNA, 25 bp, Homo sapien
gtaaccgctgcacagacctctgggt

SEQ ID NO: 199966 - DNA, 25 bp, Homo sapien
gacctctgggttgccatctagtgta

SEQ ID NO: 199967 - DNA, 25 bp, Homo sapien
gagagaactgggtaggcctctccca

SEQ ID NO: 199968 - DNA, 25 bp, Homo sapien
ggagaggcttctttcgtttcctcgt

SEQ ID NO: 199969 - DNA, 25 bp, Homo sapien
tttcgtttcctcgtcaaacatctga

SEQ ID NO: 199970 - DNA, 25 bp, Homo sapien
aaacatctgattgacgcttgcaaac

SEQ ID NO: 199971 - DNA, 25 bp, Homo sapien
ctgattgacgcttgcaaactgtctg

SEQ ID NO: 199972 - DNA, 25 bp, Homo sapien
cagcagccttgttagtgcacttgaa

SEQ ID NO: 199973 - DNA, 25 bp, Homo sapien
atgctgaccctgatgacttgtactg

SEQ ID NO: 199974 - DNA, 25 bp, Homo sapien
atgacttgtactgattcctgagcct

SEQ ID NO: 199975 - DNA, 25 bp, Homo sapien
tgattcctgagccttaacactgtgc

SEQ ID NO: 199976 - DNA, 25 bp, Homo sapien
gctctttccttctgtatataccatg

SEQ ID NO: 199977 - DNA, 25 bp, Homo sapien
taccatggtcttactttccaactct

SEQ ID NO: 199978 - DNA, 25 bp, Homo sapien
attcctttgatcttggtgtttgcgt

SEQ ID NO: 199979 - DNA, 25 bp, Homo sapien
ataggctgaacctgttatggacccc

SEQ ID NO: 199980 - DNA, 25 bp, Homo sapien
ccccaaattctgagagttcctgcaa

SEQ ID NO: 199981 - DNA, 25 bp, Homo sapien
gttcctgcaacaagaatactgctgt

SEQ ID NO: 199982 - DNA, 25 bp, Homo sapien
actgctgttgacactccagtggaaa

SEQ ID NO: 199983 - DNA, 25 bp, Homo sapien
agactctcccgtggtgagattccaa

SEQ ID NO: 199984 - DNA, 25 bp, Homo sapien
agattccaacgttgcagaggagtta

SEQ ID NO: 199985 - DNA, 25 bp, Homo sapien
agtgtgaggcactcccggagcaaag

SEQ ID NO: 199986 - DNA, 25 bp, Homo sapien
gcactcccggagcaaagtctatgaa

SEQ ID NO: 199987 - DNA, 25 bp, Homo sapien
aagtctatgaaggatcttctgcaag

SEQ ID NO: 199988 - DNA, 25 bp, Homo sapien
aagaggctgcctcctggtccactga

SEQ ID NO: 199989 - DNA, 25 bp, Homo sapien
ggtccactgaacctggaaactgagt

SEQ ID NO: 199990 - DNA, 25 bp, Homo sapien
aactgagtgggctttaaccaggaga

SEQ ID NO: 199991 - DNA, 25 bp, Homo sapien
gaactcaggattcagagatctttga

SEQ ID NO: 199992 - DNA, 25 bp, Homo sapien
tggtgggttctgacattattcttcc

SEQ ID NO: 199993 - DNA, 25 bp, Homo sapien
attcttccataagaccatgtgggtt

SEQ ID NO: 199994 - DNA, 25 bp, Homo sapien
aagcaggttgtagaacgtggcattc

SEQ ID NO: 199995 - DNA, 25 bp, Homo sapien
agaacgtggcattcttgggcaagta

SEQ ID NO: 199996 - DNA, 25 bp, Homo sapien
ggcaagtaggtagactttacccagt

SEQ ID NO: 199997 - DNA, 25 bp, Homo sapien
tagactttacccagtctctttcctt

SEQ ID NO: 199998 - DNA, 25 bp, Homo sapien
ttttgctgatgtgtgctctctctct

SEQ ID NO: 199999 - DNA, 25 bp, Homo sapien
tctctgtctgtctcgcttgctcgct

SEQ ID NO: 200000 - DNA, 25 bp, Homo sapien
gcttgctcgctctcgctgtttctct

SEQ ID NO: 200001 - DNA, 25 bp, Homo sapien
ctctctttgaggcatttgtttggaa

SEQ ID NO: 200002 - DNA, 25 bp, Homo sapien
aaatcgttgagatgcccaagaacct

SEQ ID NO: 200003 - DNA, 25 bp, Homo sapien
tgcccaagaacctgggataattctt

SEQ ID NO: 200004 - DNA, 25 bp, Homo sapien
caagaacctgggataattctttact

SEQ ID NO: 200005 - DNA, 25 bp, Homo sapien
tgtagaacgtggcattcttgggcaa

SEQ ID NO: 200006 - DNA, 25 bp, Homo sapien
agaacgtggcattcttgggcaagta

SEQ ID NO: 200007 - DNA, 25 bp, Homo sapien
cgtggcattcttgggcaagtaggta

SEQ ID NO: 200008 - DNA, 25 bp, Homo sapien
attcttgggcaagtaggtagacttt

SEQ ID NO: 200009 - DNA, 25 bp, Homo sapien
ggcaagtaggtagactttacccagt

SEQ ID NO: 200010 - DNA, 25 bp, Homo sapien
gtaggtagactttacccagtctctt

SEQ ID NO: 200011 - DNA, 25 bp, Homo sapien
tagactttacccagtctctttcctt

SEQ ID NO: 200012 - DNA, 25 bp, Homo sapien
ttttgctgatgtgtgctctctctct

SEQ ID NO: 200013 - DNA, 25 bp, Homo sapien
tttgctgatgtgtgctctctctctc

SEQ ID NO: 200014 - DNA, 25 bp, Homo sapien
tctctgtctgtctcgcttgctcgct

SEQ ID NO: 200015 - DNA, 25 bp, Homo sapien
gcttgctcgctctcgctgtttctct

SEQ ID NO: 200016 - DNA, 25 bp, Homo sapien
tccactttcttgtttaatataccag

SEQ ID NO: 200017 - DNA, 25 bp, Homo sapien
aatataccagatacatagcaaaagc

SEQ ID NO: 200018 - DNA, 25 bp, Homo sapien
actatattaagatcttgtactgtgt

SEQ ID NO: 200019 - DNA, 25 bp, Homo sapien
ttaagatcttgtactgtgtaacagt

SEQ ID NO: 200020 - DNA, 25 bp, Homo sapien
gtgtaacagtaactcttttttgctt

SEQ ID NO: 200021 - DNA, 25 bp, Homo sapien
cagtaatttaatatgttcacttaac

SEQ ID NO: 200022 - DNA, 25 bp, Homo sapien
aaaatacgaactttgagatgcacta

SEQ ID NO: 200023 - DNA, 25 bp, Homo sapien
aatacgaactttgagatgcactaaa

SEQ ID NO: 200024 - DNA, 25 bp, Homo sapien
ctttgagatgcactaaagttttgtt

SEQ ID NO: 200025 - DNA, 25 bp, Homo sapien
gcaattaattgttcttttatcttac

SEQ ID NO: 200026 - DNA, 25 bp, Homo sapien
tgttcttttatcttacaattgttta

SEQ ID NO: 200027 - DNA, 25 bp, Homo sapien
gggcacgtggagcaagagatcctgg

SEQ ID NO: 200028 - DNA, 25 bp, Homo sapien
ttcctgcctagtcccactgggctgg

SEQ ID NO: 200029 - DNA, 25 bp, Homo sapien
ggggacagtctgtgcctgtagcctc

SEQ ID NO: 200030 - DNA, 25 bp, Homo sapien
aggcatggctaacccctgactgctt

SEQ ID NO: 200031 - DNA, 25 bp, Homo sapien
ccctgactgcttgcctcatatttaa

SEQ ID NO: 200032 - DNA, 25 bp, Homo sapien
gactgcttgcctcatatttaagctg

SEQ ID NO: 200033 - DNA, 25 bp, Homo sapien
tgcctcatatttaagctgctgctct

SEQ ID NO: 200034 - DNA, 25 bp, Homo sapien
ctcatatttaagctgctgctctggc

SEQ ID NO: 200035 - DNA, 25 bp, Homo sapien
tgctgctctggccaagtgcctaatt

SEQ ID NO: 200036 - DNA, 25 bp, Homo sapien
ggccaagtgcctaattttaacccag

SEQ ID NO: 200037 - DNA, 25 bp, Homo sapien
gcctaattttaacccagacctcaat

SEQ ID NO: 200038 - DNA, 25 bp, Homo sapien
ctccaaactccaacactgtgtgtat

SEQ ID NO: 200039 - DNA, 25 bp, Homo sapien
actccaacactgtgtgtattatata

SEQ ID NO: 200040 - DNA, 25 bp, Homo sapien
atgactagggtttgatcattcaaag

SEQ ID NO: 200041 - DNA, 25 bp, Homo sapien
gagggaagaactgtactaacttatt

SEQ ID NO: 200042 - DNA, 25 bp, Homo sapien
agaatgtttatgctccctatacaag

SEQ ID NO: 200043 - DNA, 25 bp, Homo sapien
atgctccctatacaagctttctgac

SEQ ID NO: 200044 - DNA, 25 bp, Homo sapien
ccctatacaagctttctgactcaac

SEQ ID NO: 200045 - DNA, 25 bp, Homo sapien
gctttctgactcaacatcatcatcg

SEQ ID NO: 200046 - DNA, 25 bp, Homo sapien
atcatcatcgagatgctcagcatca

SEQ ID NO: 200047 - DNA, 25 bp, Homo sapien
ttaactttatagtctgtctctccaa

SEQ ID NO: 200048 - DNA, 25 bp, Homo sapien
tatagtctgtctctccaaactccaa

SEQ ID NO: 200049 - DNA, 25 bp, Homo sapien
tggaaggccgagttccaccgctgga

SEQ ID NO: 200050 - DNA, 25 bp, Homo sapien
ggagctcctacatggtgcactggaa

SEQ ID NO: 200051 - DNA, 25 bp, Homo sapien
gaagaaccagttcgaccactacagc

SEQ ID NO: 200052 - DNA, 25 bp, Homo sapien
accactacagcaagcaggatcgctg

SEQ ID NO: 200053 - DNA, 25 bp, Homo sapien
aggatcgctgctcagacctgtgacc

SEQ ID NO: 200054 - DNA, 25 bp, Homo sapien
tgctcagacctgtgaccccggcggg

SEQ ID NO: 200055 - DNA, 25 bp, Homo sapien
ggccccctagctgtatatactattt

SEQ ID NO: 200056 - DNA, 25 bp, Homo sapien
gtatatactatttatttcagggctg

SEQ ID NO: 200057 - DNA, 25 bp, Homo sapien
ttatttcagggctgggctataacac

SEQ ID NO: 200058 - DNA, 25 bp, Homo sapien
ctataacacagacgagccccagact

SEQ ID NO: 200059 - DNA, 25 bp, Homo sapien
ccggtcctctggcatgtcttcaggc

SEQ ID NO: 200060 - DNA, 25 bp, Homo sapien
agcaggtctctgtgggccgaccaga

SEQ ID NO: 200061 - DNA, 25 bp, Homo sapien
ggacagcccagggtgcagctctgcc

SEQ ID NO: 200062 - DNA, 25 bp, Homo sapien
tctgcccgggctcgtgaagcctcag

SEQ ID NO: 200063 - DNA, 25 bp, Homo sapien
tgtccccaatccaagggtctggagg

SEQ ID NO: 200064 - DNA, 25 bp, Homo sapien
ggctgccgtgactccagaggcctga

SEQ ID NO: 200065 - DNA, 25 bp, Homo sapien
cagggctggctctggtgtttacaag

SEQ ID NO: 200066 - DNA, 25 bp, Homo sapien
ctctggtgtttacaagctggactca

SEQ ID NO: 200067 - DNA, 25 bp, Homo sapien
ttacaagctggactcagggatcctc

SEQ ID NO: 200068 - DNA, 25 bp, Homo sapien
tggacggcaagtccgtctagctcac

SEQ ID NO: 200069 - DNA, 25 bp, Homo sapien
ggcaagtccgtctagctcacgggcc

SEQ ID NO: 200070 - DNA, 25 bp, Homo sapien
ctcacgggcccctccagtggaatgg

SEQ ID NO: 200071 - DNA, 25 bp, Homo sapien
atctgtcagtttttgcccagtgagt

SEQ ID NO: 200072 - DNA, 25 bp, Homo sapien
gcatttgcagctccttgttttggtc

SEQ ID NO: 200073 - DNA, 25 bp, Homo sapien
gttttggtctgttcgtaactgcagt

SEQ ID NO: 200074 - DNA, 25 bp, Homo sapien
gtaactgcagtgttctccatgagta

SEQ ID NO: 200075 - DNA, 25 bp, Homo sapien
ggagtaagaacagtccccagtccag

SEQ ID NO: 200076 - DNA, 25 bp, Homo sapien
acccttttcagctgctgttcattgc

SEQ ID NO: 200077 - DNA, 25 bp, Homo sapien
gctgttcattgccagttgatgaggt

SEQ ID NO: 200078 - DNA, 25 bp, Homo sapien
atgaggtgagtgtcatctgcctctc

SEQ ID NO: 200079 - DNA, 25 bp, Homo sapien
tggagaacaccgcaggtactgtaaa

SEQ ID NO: 200080 - DNA, 25 bp, Homo sapien
aagtacttttcacagcgtggccttt

SEQ ID NO: 200081 - DNA, 25 bp, Homo sapien
cagcgtggcctttcaccataatttt

SEQ ID NO: 200082 - DNA, 25 bp, Homo sapien
ccccatggtgataccagcctagaag

SEQ ID NO: 200083 - DNA, 25 bp, Homo sapien
gataccagcctagaagggtcacatt

SEQ ID NO: 200084 - DNA, 25 bp, Homo sapien
cagcctagaagggtcacattttgga

SEQ ID NO: 200085 - DNA, 25 bp, Homo sapien
gggtcacattttggaccctgtctat

SEQ ID NO: 200086 - DNA, 25 bp, Homo sapien
ttttggaccctgtctatccactagg

SEQ ID NO: 200087 - DNA, 25 bp, Homo sapien
tggacttccctgaatgaggccgtct

SEQ ID NO: 200088 - DNA, 25 bp, Homo sapien
ttccctgaatgaggccgtctcggtg

SEQ ID NO: 200089 - DNA, 25 bp, Homo sapien
ctcggtgcccccagctggatagagg

SEQ ID NO: 200090 - DNA, 25 bp, Homo sapien
gagatgctgtccatgtttctagggg

SEQ ID NO: 200091 - DNA, 25 bp, Homo sapien
ttgctttctcgttgaaacctgttgt

SEQ ID NO: 200092 - DNA, 25 bp, Homo sapien
ttctcgttgaaacctgttgttaata

SEQ ID NO: 200093 - DNA, 25 bp, Homo sapien
tatttgttctggtgggtttgtaccg

SEQ ID NO: 200094 - DNA, 25 bp, Homo sapien
gtttgtaccgaatgtgctggaaggc

SEQ ID NO: 200095 - DNA, 25 bp, Homo sapien
tgctggaaggcagatccgggcacac

SEQ ID NO: 200096 - DNA, 25 bp, Homo sapien
gcagatccgggcacaccagaaaatg

SEQ ID NO: 200097 - DNA, 25 bp, Homo sapien
tggaaatgatcaacctcagtctgat

SEQ ID NO: 200098 - DNA, 25 bp, Homo sapien
gagcgtgaagcttcttaccgttaag

SEQ ID NO: 200099 - DNA, 25 bp, Homo sapien
taccgttaagacaatttctcatgag

SEQ ID NO: 200100 - DNA, 25 bp, Homo sapien
tgagtctggtgagcactctgcacaa

SEQ ID NO: 200101 - DNA, 25 bp, Homo sapien
gacagcttgaggaattctctccaca

SEQ ID NO: 200102 - DNA, 25 bp, Homo sapien
attctctccacacctaggcaataat

SEQ ID NO: 200103 - DNA, 25 bp, Homo sapien
cagcttctatgcaccaagcgtggaa

SEQ ID NO: 200104 - DNA, 25 bp, Homo sapien
gttgcatttgaagttatgatcattt

SEQ ID NO: 200105 - DNA, 25 bp, Homo sapien
atatattcatattaccaagactatt

SEQ ID NO: 200106 - DNA, 25 bp, Homo sapien
ccaagactattatactggaagtggt

SEQ ID NO: 200107 - DNA, 25 bp, Homo sapien
acataaggcagttacttaatgtgat

SEQ ID NO: 200108 - DNA, 25 bp, Homo sapien
gtatacatttgttaacaatgccatg

SEQ ID NO: 200109 - DNA, 25 bp, Homo sapien
ttctttctcctaaggaaaagtgaat

SEQ ID NO: 200110 - DNA, 25 bp, Homo sapien
ggaaaagtgaatttcttatcagaat

SEQ ID NO: 200111 - DNA, 25 bp, Homo sapien
tatcagaatatctggctggccctgt

SEQ ID NO: 200112 - DNA, 25 bp, Homo sapien
gaatatctggctggccctgtaattt

SEQ ID NO: 200113 - DNA, 25 bp, Homo sapien
atctggctggccctgtaatttaaat

SEQ ID NO: 200114 - DNA, 25 bp, Homo sapien
tggctggccctgtaatttaaattaa

SEQ ID NO: 200115 - DNA, 25 bp, Homo sapien
tggagcgcatgcaggcttccctccc

SEQ ID NO: 200116 - DNA, 25 bp, Homo sapien
gctggacaacatctcctaccgcagg

SEQ ID NO: 200117 - DNA, 25 bp, Homo sapien
ctggacaacatctcctaccgcaggg

SEQ ID NO: 200118 - DNA, 25 bp, Homo sapien
ctaccgcagggagtctgccatctga

SEQ ID NO: 200119 - DNA, 25 bp, Homo sapien
taccgcagggagtctgccatctgac

SEQ ID NO: 200120 - DNA, 25 bp, Homo sapien
accgcagggagtctgccatctgacc

SEQ ID NO: 200121 - DNA, 25 bp, Homo sapien
ccgcagggagtctgccatctgacct

SEQ ID NO: 200122 - DNA, 25 bp, Homo sapien
cagggagtctgccatctgacctcca

SEQ ID NO: 200123 - DNA, 25 bp, Homo sapien
agggagtctgccatctgacctccag

SEQ ID NO: 200124 - DNA, 25 bp, Homo sapien
tgccgggggtgggatgccaggacac

SEQ ID NO: 200125 - DNA, 25 bp, Homo sapien
cgatcagcctgagttccgccagcgc

SEQ ID NO: 200126 - DNA, 25 bp, Homo sapien
ggaagctgagtaactccaacagcaa

SEQ ID NO: 200127 - DNA, 25 bp, Homo sapien
gcaaagatggcaacatgcagactgc

SEQ ID NO: 200128 - DNA, 25 bp, Homo sapien
agactgcaaagccttccgctatgaa

SEQ ID NO: 200129 - DNA, 25 bp, Homo sapien
gaagctggccacaaagtcttctcca

SEQ ID NO: 200130 - DNA, 25 bp, Homo sapien
aaagtcttctccagtgaaagtaggg

SEQ ID NO: 200131 - DNA, 25 bp, Homo sapien
aagctgctgatgagacgctgtgcca

SEQ ID NO: 200132 - DNA, 25 bp, Homo sapien
tgtgccaaacaaagaggcggccagc

SEQ ID NO: 200133 - DNA, 25 bp, Homo sapien
aggcggccagccagtgagcagagag

SEQ ID NO: 200134 - DNA, 25 bp, Homo sapien
agaggaagaactgtgccagcaggca

SEQ ID NO: 200135 - DNA, 25 bp, Homo sapien
aggagatagaacagcccggcctagc

SEQ ID NO: 200136 - DNA, 25 bp, Homo sapien
aacagcccggcctagccaggagaga

SEQ ID NO: 200137 - DNA, 25 bp, Homo sapien
cgggaagaagccacaccccagaggt

SEQ ID NO: 200138 - DNA, 25 bp, Homo sapien
ggaagaagccacaccccagaggtga

SEQ ID NO: 200139 - DNA, 25 bp, Homo sapien
gaagaagccacaccccagaggtgac

SEQ ID NO: 200140 - DNA, 25 bp, Homo sapien
cccagcctctgacttgctgtgttgt

SEQ ID NO: 200141 - DNA, 25 bp, Homo sapien
cagcctctgacttgctgtgttgtcc

SEQ ID NO: 200142 - DNA, 25 bp, Homo sapien
tgctgtgttgtccagaggtgaggct

SEQ ID NO: 200143 - DNA, 25 bp, Homo sapien
tccctggtctccagcttaaacagga

SEQ ID NO: 200144 - DNA, 25 bp, Homo sapien
cctggtctccagcttaaacaggagt

SEQ ID NO: 200145 - DNA, 25 bp, Homo sapien
tggtctccagcttaaacaggagtga

SEQ ID NO: 200146 - DNA, 25 bp, Homo sapien
aaacaggagtgaactccctctgtcc

SEQ ID NO: 200147 - DNA, 25 bp, Homo sapien
ggagtgaactccctctgtccccagg

SEQ ID NO: 200148 - DNA, 25 bp, Homo sapien
gtgatgaaaggaacagtctgtgcaa

SEQ ID NO: 200149 - DNA, 25 bp, Homo sapien
cagtctgtgcaatgggttttactta

SEQ ID NO: 200150 - DNA, 25 bp, Homo sapien
aaacttcactgttcaacctatgagc

SEQ ID NO: 200151 - DNA, 25 bp, Homo sapien
cctatgagcaaatctgtatgtgtga

SEQ ID NO: 200152 - DNA, 25 bp, Homo sapien
gttgagcatagcatacttccagagg

SEQ ID NO: 200153 - DNA, 25 bp, Homo sapien
gcatacttccagaggtggtcttatg

SEQ ID NO: 200154 - DNA, 25 bp, Homo sapien
ggaaatgatttcttcagatctcaaa

SEQ ID NO: 200155 - DNA, 25 bp, Homo sapien
gatttcttcagatctcaaaggagtc

SEQ ID NO: 200156 - DNA, 25 bp, Homo sapien
ggctagagggaaacagctactgata

SEQ ID NO: 200157 - DNA, 25 bp, Homo sapien
actgataatcgaaaactgctgtttg

SEQ ID NO: 200158 - DNA, 25 bp, Homo sapien
aggaacccctggctgtgcaaataat
